United States Patent 7,888,497 (BIOINFORMATICALLY DETECTABLE GROUP OF NOVEL REGULATORY OLIGONUCLEOTIDES AND USES THEREOF) - sequence listing, part 129

SEQ ID NO: 5468052 - DNA, 15 bp, Homo sapiens
ttttacacagaaaca

SEQ ID NO: 5468053 - DNA, 17 bp, Homo sapiens
ttttacacagaaacact

SEQ ID NO: 5468054 - DNA, 14 bp, Homo sapiens
ttttacacagagaa

SEQ ID NO: 5468055 - DNA, 23 bp, Homo sapiens
ttttacactaatatatggaccta

SEQ ID NO: 5468056 - DNA, 22 bp, Homo sapiens
ttttacactattgtgaatattt

SEQ ID NO: 5468057 - DNA, 17 bp, Homo sapiens
ttttacagagaatctga

SEQ ID NO: 5468058 - DNA, 23 bp, Homo sapiens
ttttacagagaggatacatttaa

SEQ ID NO: 5468059 - DNA, 20 bp, Homo sapiens
ttttacagagcttgaaaact

SEQ ID NO: 5468060 - DNA, 16 bp, Homo sapiens
ttttacagctacttta

SEQ ID NO: 5468061 - DNA, 19 bp, Homo sapiens
ttttacagctttacacaca

SEQ ID NO: 5468062 - DNA, 13 bp, Homo sapiens
ttttacagtatat

SEQ ID NO: 5468063 - DNA, 22 bp, Homo sapiens
ttttacagtatatcttaagata

SEQ ID NO: 5468064 - DNA, 17 bp, Homo sapiens
ttttacagtctctgttg

SEQ ID NO: 5468065 - DNA, 17 bp, Homo sapiens
ttttacagtgacctttt

SEQ ID NO: 5468066 - DNA, 16 bp, Homo sapiens
ttttacatactgctgt

SEQ ID NO: 5468067 - DNA, 18 bp, Homo sapiens
ttttacatacttttgcaa

SEQ ID NO: 5468068 - DNA, 20 bp, Homo sapiens
ttttacatacttttgcaaaa

SEQ ID NO: 5468069 - DNA, 11 bp, Homo sapiens
ttttacatgaa

SEQ ID NO: 5468070 - DNA, 15 bp, Homo sapiens
ttttacatgaagtat

SEQ ID NO: 5468071 - DNA, 18 bp, Homo sapiens
ttttacatgaagtatttt

SEQ ID NO: 5468072 - DNA, 23 bp, Homo sapiens
ttttacatgctggttacctgttc

SEQ ID NO: 5468073 - DNA, 9 bp, Homo sapiens
ttttacatt

SEQ ID NO: 5468074 - DNA, 13 bp, Homo sapiens
ttttacattaaat

SEQ ID NO: 5468075 - DNA, 12 bp, Homo sapiens
ttttacattaca

SEQ ID NO: 5468076 - DNA, 21 bp, Homo sapiens
ttttacattatgcaaataaaa

SEQ ID NO: 5468077 - DNA, 12 bp, Homo sapiens
ttttacatttca

SEQ ID NO: 5468078 - DNA, 11 bp, Homo sapiens
ttttaccaaag

SEQ ID NO: 5468079 - DNA, 14 bp, Homo sapiens
ttttaccaaagcat

SEQ ID NO: 5468080 - DNA, 20 bp, Homo sapiens
ttttaccaactctatactca

SEQ ID NO: 5468081 - DNA, 15 bp, Homo sapiens
ttttaccaagagtaa

SEQ ID NO: 5468082 - DNA, 17 bp, Homo sapiens
ttttaccaagagtaact

SEQ ID NO: 5468083 - DNA, 13 bp, Homo sapiens
ttttaccaagttt

SEQ ID NO: 5468084 - DNA, 14 bp, Homo sapiens
ttttaccaattcca

SEQ ID NO: 5468085 - DNA, 15 bp, Homo sapiens
ttttaccaattccaa

SEQ ID NO: 5468086 - DNA, 13 bp, Homo sapiens
ttttaccagctcc

SEQ ID NO: 5468087 - DNA, 15 bp, Homo sapiens
ttttaccagctttta

SEQ ID NO: 5468088 - DNA, 16 bp, Homo sapiens
ttttaccataatctta

SEQ ID NO: 5468089 - DNA, 15 bp, Homo sapiens
ttttaccattagcat

SEQ ID NO: 5468090 - DNA, 22 bp, Homo sapiens
ttttaccattttgcgatgtgtt

SEQ ID NO: 5468091 - DNA, 18 bp, Homo sapiens
ttttacccatatcccctc

SEQ ID NO: 5468092 - DNA, 18 bp, Homo sapiens
ttttaccgtttcttccct

SEQ ID NO: 5468093 - DNA, 18 bp, Homo sapiens
ttttacctaccacagtgt

SEQ ID NO: 5468094 - DNA, 15 bp, Homo sapiens
ttttacctctctctg

SEQ ID NO: 5468095 - DNA, 16 bp, Homo sapiens
ttttacctctctctgg

SEQ ID NO: 5468096 - DNA, 16 bp, Homo sapiens
ttttacgctagattaa

SEQ ID NO: 5468097 - DNA, 21 bp, Homo sapiens
ttttacgctagattaaaatat

SEQ ID NO: 5468098 - DNA, 14 bp, Homo sapiens
ttttacggaattcc

SEQ ID NO: 5468099 - DNA, 17 bp, Homo sapiens
ttttacggaattccaat

SEQ ID NO: 5468100 - DNA, 18 bp, Homo sapiens
ttttacggaattccaata

SEQ ID NO: 5468101 - DNA, 19 bp, Homo sapiens
ttttacgtccatctcttgt

SEQ ID NO: 5468102 - DNA, 23 bp, Homo sapiens
ttttacgtgcaaacaacctgaat

SEQ ID NO: 5468103 - DNA, 16 bp, Homo sapiens
ttttactaagatcaca

SEQ ID NO: 5468104 - DNA, 20 bp, Homo sapiens
ttttactaagttttcaaatt

SEQ ID NO: 5468105 - DNA, 16 bp, Homo sapiens
ttttactaatatatat

SEQ ID NO: 5468106 - DNA, 21 bp, Homo sapiens
ttttactaatatatattttaa

SEQ ID NO: 5468107 - DNA, 14 bp, Homo sapiens
ttttactactgtgg

SEQ ID NO: 5468108 - DNA, 18 bp, Homo sapiens
ttttactcaggctttcta

SEQ ID NO: 5468109 - DNA, 18 bp, Homo sapiens
ttttcaaaataaagcttt

SEQ ID NO: 5468110 - DNA, 21 bp, Homo sapiens
ttttcaaaataaagcttttgc

SEQ ID NO: 5468111 - DNA, 22 bp, Homo sapiens
ttttcaaaataaagcttttgca

SEQ ID NO: 5468112 - DNA, 18 bp, Homo sapiens
ttttcaaaatacttcttt

SEQ ID NO: 5468113 - DNA, 19 bp, Homo sapiens
ttttcaaaatagaaaagtt

SEQ ID NO: 5468114 - DNA, 20 bp, Homo sapiens
ttttcaaaatagaaaagtta

SEQ ID NO: 5468115 - DNA, 21 bp, Homo sapiens
ttttcaaaattgttacaaatt

SEQ ID NO: 5468116 - DNA, 15 bp, Homo sapiens
ttttcaaagacttca

SEQ ID NO: 5468117 - DNA, 13 bp, Homo sapiens
ttttcaaagcaat

SEQ ID NO: 5468118 - DNA, 17 bp, Homo sapiens
ttttcaaataataggta

SEQ ID NO: 5468119 - DNA, 15 bp, Homo sapiens
ttttcaaatagattt

SEQ ID NO: 5468120 - DNA, 15 bp, Homo sapiens
ttttcaaatattgaa

SEQ ID NO: 5468121 - DNA, 16 bp, Homo sapiens
ttttcaaatattgaat

SEQ ID NO: 5468122 - DNA, 13 bp, Homo sapiens
ttttcaaatcatt

SEQ ID NO: 5468123 - DNA, 21 bp, Homo sapiens
ttttcaaatcattccttagat

SEQ ID NO: 5468124 - DNA, 22 bp, Homo sapiens
ttttcaaatcatttttgagact

SEQ ID NO: 5468125 - DNA, 17 bp, Homo sapiens
ttttcaaatgcagcaat

SEQ ID NO: 5468126 - DNA, 15 bp, Homo sapiens
ttttcaaatgtcagc

SEQ ID NO: 5468127 - DNA, 19 bp, Homo sapiens
ttttcaaattgtatctagt

SEQ ID NO: 5468128 - DNA, 18 bp, Homo sapiens
ttttcaacaagcctgaaa

SEQ ID NO: 5468129 - DNA, 14 bp, Homo sapiens
ttttcaacaattag

SEQ ID NO: 5468130 - DNA, 22 bp, Homo sapiens
ttttcaacactgaaaaaatact

SEQ ID NO: 5468131 - DNA, 18 bp, Homo sapiens
ttttcaacagtgaagaca

SEQ ID NO: 5468132 - DNA, 23 bp, Homo sapiens
ttttcaaccagataacatacctt

SEQ ID NO: 5468133 - DNA, 16 bp, Homo sapiens
ttttcaaccagattta

SEQ ID NO: 5468134 - DNA, 16 bp, Homo sapiens
ttttcaaccagcattt

SEQ ID NO: 5468135 - DNA, 17 bp, Homo sapiens
ttttcaaccagcatttt

SEQ ID NO: 5468136 - DNA, 20 bp, Homo sapiens
ttttcaaccagcattttact

SEQ ID NO: 5468137 - DNA, 19 bp, Homo sapiens
ttttcaacctctagaattt

SEQ ID NO: 5468138 - DNA, 22 bp, Homo sapiens
ttttcaacgcagccctgctttg

SEQ ID NO: 5468139 - DNA, 13 bp, Homo sapiens
ttttcaactgcca

SEQ ID NO: 5468140 - DNA, 14 bp, Homo sapiens
ttttcaactggctg

SEQ ID NO: 5468141 - DNA, 15 bp, Homo sapiens
ttttcaacttggaaa

SEQ ID NO: 5468142 - DNA, 17 bp, Homo sapiens
ttttcaagaaaattttg

SEQ ID NO: 5468143 - DNA, 19 bp, Homo sapiens
ttttcaagaaaattttgca

SEQ ID NO: 5468144 - DNA, 21 bp, Homo sapiens
ttttcaagagaagaaaaaatt

SEQ ID NO: 5468145 - DNA, 13 bp, Homo sapiens
ttttcaagattga

SEQ ID NO: 5468146 - DNA, 23 bp, Homo sapiens
ttttcaagcaaaacagttctcag

SEQ ID NO: 5468147 - DNA, 14 bp, Homo sapiens
ttttcaagcaaagt

SEQ ID NO: 5468148 - DNA, 15 bp, Homo sapiens
ttttcaagcagcatc

SEQ ID NO: 5468149 - DNA, 18 bp, Homo sapiens
ttttcaagcatctcctga

SEQ ID NO: 5468150 - DNA, 19 bp, Homo sapiens
ttttcaaggaagaaaacgg

SEQ ID NO: 5468151 - DNA, 12 bp, Homo sapiens
ttttcaaggcat

SEQ ID NO: 5468152 - DNA, 14 bp, Homo sapiens
ttttcaaggcattt

SEQ ID NO: 5468153 - DNA, 16 bp, Homo sapiens
ttttcaaggccctcag

SEQ ID NO: 5468154 - DNA, 15 bp, Homo sapiens
ttttcaaggccttca

SEQ ID NO: 5468155 - DNA, 22 bp, Homo sapiens
ttttcaagtaattttcatatta

SEQ ID NO: 5468156 - DNA, 12 bp, Homo sapiens
ttttcaagtatt

SEQ ID NO: 5468157 - DNA, 17 bp, Homo sapiens
ttttcaagtatttaagc

SEQ ID NO: 5468158 - DNA, 20 bp, Homo sapiens
ttttcaagtatttaagccta

SEQ ID NO: 5468159 - DNA, 20 bp, Homo sapiens
ttttcaagttattcagaaat

SEQ ID NO: 5468160 - DNA, 18 bp, Homo sapiens
ttttcaagttgcagtcag

SEQ ID NO: 5468161 - DNA, 13 bp, Homo sapiens
ttttcaagttgta

SEQ ID NO: 5468162 - DNA, 12 bp, Homo sapiens
ttttcaataaat

SEQ ID NO: 5468163 - DNA, 18 bp, Homo sapiens
ttttcaataaatttctgc

SEQ ID NO: 5468164 - DNA, 19 bp, Homo sapiens
ttttcaataactggaacac

SEQ ID NO: 5468165 - DNA, 23 bp, Homo sapiens
ttttcaataactggaacactcta

SEQ ID NO: 5468166 - DNA, 17 bp, Homo sapiens
ttttcaatactgtccca

SEQ ID NO: 5468167 - DNA, 18 bp, Homo sapiens
ttttcaatatattgaact

SEQ ID NO: 5468168 - DNA, 13 bp, Homo sapiens
ttttcaatatgca

SEQ ID NO: 5468169 - DNA, 17 bp, Homo sapiens
ttttcaatatgcaagca

SEQ ID NO: 5468170 - DNA, 13 bp, Homo sapiens
ttttcaatcttct

SEQ ID NO: 5468171 - DNA, 21 bp, Homo sapiens
ttttcaatgaattaagaaaga

SEQ ID NO: 5468172 - DNA, 20 bp, Homo sapiens
ttttcaatgcaatgcatctg

SEQ ID NO: 5468173 - DNA, 14 bp, Homo sapiens
ttttcaattaaacg

SEQ ID NO: 5468174 - DNA, 22 bp, Homo sapiens
ttttcaattcaaaaatgtacaa

SEQ ID NO: 5468175 - DNA, 18 bp, Homo sapiens
ttttcaattttgcatgct

SEQ ID NO: 5468176 - DNA, 14 bp, Homo sapiens
ttttcacaaataaa

SEQ ID NO: 5468177 - DNA, 18 bp, Homo sapiens
ttttcacaacatatcaga

SEQ ID NO: 5468178 - DNA, 21 bp, Homo sapiens
ttttcacaatgtgaaactgaa

SEQ ID NO: 5468179 - DNA, 18 bp, Homo sapiens
ttttcacagcaacatttt

SEQ ID NO: 5468180 - DNA, 23 bp, Homo sapiens
ttttcacaggtgtggtgtaattt

SEQ ID NO: 5468181 - DNA, 20 bp, Homo sapiens
ttttcacagtatgggctaca

SEQ ID NO: 5468182 - DNA, 15 bp, Homo sapiens
ttttcacagttctct

SEQ ID NO: 5468183 - DNA, 15 bp, Homo sapiens
ttttcacataaatgc

SEQ ID NO: 5468184 - DNA, 16 bp, Homo sapiens
ttttcacatatctagt

SEQ ID NO: 5468185 - DNA, 13 bp, Homo sapiens
ttttcacatgaac

SEQ ID NO: 5468186 - DNA, 14 bp, Homo sapiens
ttttcacatgaaca

SEQ ID NO: 5468187 - DNA, 23 bp, Homo sapiens
ttttcacatgaacatactggctg

SEQ ID NO: 5468188 - DNA, 18 bp, Homo sapiens
ttttcacattcttataaa

SEQ ID NO: 5468189 - DNA, 11 bp, Homo sapiens
ttttcaccaat

SEQ ID NO: 5468190 - DNA, 18 bp, Homo sapiens
ttttcaccatctttctaa

SEQ ID NO: 5468191 - DNA, 20 bp, Homo sapiens
ttttcaccccacccttcccc

SEQ ID NO: 5468192 - DNA, 17 bp, Homo sapiens
ttttcacccttctactc

SEQ ID NO: 5468193 - DNA, 18 bp, Homo sapiens
ttttcaccgagcagaggt

SEQ ID NO: 5468194 - DNA, 15 bp, Homo sapiens
ttttcacctgaaatg

SEQ ID NO: 5468195 - DNA, 15 bp, Homo sapiens
ttttcacggaagttt

SEQ ID NO: 5468196 - DNA, 14 bp, Homo sapiens
ttttcactaaaagt

SEQ ID NO: 5468197 - DNA, 21 bp, Homo sapiens
ttttcactctaagtcatgtat

SEQ ID NO: 5468198 - DNA, 20 bp, Homo sapiens
ttttcactgctggctgcctt

SEQ ID NO: 5468199 - DNA, 21 bp, Homo sapiens
ttttcactggcataaatctga

SEQ ID NO: 5468200 - DNA, 13 bp, Homo sapiens
ttttcacttctgt

SEQ ID NO: 5468201 - DNA, 15 bp, Homo sapiens
ttttcacttgtctcc

SEQ ID NO: 5468202 - DNA, 21 bp, Homo sapiens
ttttcacttgtcttgctctta

SEQ ID NO: 5468203 - DNA, 17 bp, Homo sapiens
ttttcagaaaaagaaat

SEQ ID NO: 5468204 - DNA, 16 bp, Homo sapiens
ttttcagaaaatatta

SEQ ID NO: 5468205 - DNA, 22 bp, Homo sapiens
ttttcagaaaatattatgtgtt

SEQ ID NO: 5468206 - DNA, 20 bp, Homo sapiens
ttttcagaaagtttgaagca

SEQ ID NO: 5468207 - DNA, 18 bp, Homo sapiens
ttttcagaacctcttccc

SEQ ID NO: 5468208 - DNA, 21 bp, Homo sapiens
ttttcagaagtcagcctacat

SEQ ID NO: 5468209 - DNA, 16 bp, Homo sapiens
ttttcagaatctgaat

SEQ ID NO: 5468210 - DNA, 16 bp, Homo sapiens
ttttcagaatgctctt

SEQ ID NO: 5468211 - DNA, 14 bp, Homo sapiens
ttttcagactcaga

SEQ ID NO: 5468212 - DNA, 16 bp, Homo sapiens
ttttcagactcagact

SEQ ID NO: 5468213 - DNA, 16 bp, Homo sapiens
ttttcagacttgtcaa

SEQ ID NO: 5468214 - DNA, 14 bp, Homo sapiens
ttttcagagaatta

SEQ ID NO: 5468215 - DNA, 23 bp, Homo sapiens
ttttcagagaattatctcaagta

SEQ ID NO: 5468216 - DNA, 22 bp, Homo sapiens
ttttcagagtcatttatgagca

SEQ ID NO: 5468217 - DNA, 13 bp, Homo sapiens
ttttcagatataa

SEQ ID NO: 5468218 - DNA, 22 bp, Homo sapiens
ttttcagatataaaagactgac

SEQ ID NO: 5468219 - DNA, 18 bp, Homo sapiens
ttttcagattcaggcatt

SEQ ID NO: 5468220 - DNA, 14 bp, Homo sapiens
ttttcagatttgca

SEQ ID NO: 5468221 - DNA, 21 bp, Homo sapiens
ttttcagcatcaaacatgaaa

SEQ ID NO: 5468222 - DNA, 13 bp, Homo sapiens
ttttcagcattga

SEQ ID NO: 5468223 - DNA, 19 bp, Homo sapiens
ttttcagccaatttgtctc

SEQ ID NO: 5468224 - DNA, 19 bp, Homo sapiens
ttttcagctaggaacaaat

SEQ ID NO: 5468225 - DNA, 12 bp, Homo sapiens
ttttcagctccc

SEQ ID NO: 5468226 - DNA, 15 bp, Homo sapiens
ttttcagctgcaagg

SEQ ID NO: 5468227 - DNA, 15 bp, Homo sapiens
ttttcagcttctgct

SEQ ID NO: 5468228 - DNA, 23 bp, Homo sapiens
ttttcaggaccttagttccagca

SEQ ID NO: 5468229 - DNA, 23 bp, Homo sapiens
ttttcaggctcgccaaggcctag

SEQ ID NO: 5468230 - DNA, 22 bp, Homo sapiens
ttttcagggctggctcctgatc

SEQ ID NO: 5468231 - DNA, 21 bp, Homo sapiens
ttttcaggtgctcaaaatgca

SEQ ID NO: 5468232 - DNA, 15 bp, Homo sapiens
ttttcagtaccaaag

SEQ ID NO: 5468233 - DNA, 23 bp, Homo sapiens
ttttcagtagggctacaaaacct

SEQ ID NO: 5468234 - DNA, 15 bp, Homo sapiens
ttttcagtcatataa

SEQ ID NO: 5468235 - DNA, 18 bp, Homo sapiens
ttttcagtgatcttcact

SEQ ID NO: 5468236 - DNA, 18 bp, Homo sapiens
ttttcagttataatttca

SEQ ID NO: 5468237 - DNA, 24 bp, Homo sapiens
ttttcagttcaaagtcatgatgtt

SEQ ID NO: 5468238 - DNA, 16 bp, Homo sapiens
ttttcagttccaagaa

SEQ ID NO: 5468239 - DNA, 16 bp, Homo sapiens
ttttcagttgtttgtt

SEQ ID NO: 5468240 - DNA, 22 bp, Homo sapiens
ttttcagttgtttgtttttgct

SEQ ID NO: 5468241 - DNA, 22 bp, Homo sapiens
ttttcagtttatttgaaccaat

SEQ ID NO: 5468242 - DNA, 13 bp, Homo sapiens
ttttcataactta

SEQ ID NO: 5468243 - DNA, 17 bp, Homo sapiens
ttttcataagatatttt

SEQ ID NO: 5468244 - DNA, 16 bp, Homo sapiens
ttttcatacattttct

SEQ ID NO: 5468245 - DNA, 21 bp, Homo sapiens
ttttcatacattttctaagaa

SEQ ID NO: 5468246 - DNA, 21 bp, Homo sapiens
ttttcatactcttaagtgtaa

SEQ ID NO: 5468247 - DNA, 18 bp, Homo sapiens
ttttcatacttttacctt

SEQ ID NO: 5468248 - DNA, 17 bp, Homo sapiens
ttttcataggtctgaaa

SEQ ID NO: 5468249 - DNA, 16 bp, Homo sapiens
ttttcatatttgcact

SEQ ID NO: 5468250 - DNA, 22 bp, Homo sapiens
ttttcatattttaatttcaagc

SEQ ID NO: 5468251 - DNA, 15 bp, Homo sapiens
ttttcatcactggga

SEQ ID NO: 5468252 - DNA, 22 bp, Homo sapiens
ttttcatcattgttgtgtataa

SEQ ID NO: 5468253 - DNA, 23 bp, Homo sapiens
ttttcatcattgttgtgtataat

SEQ ID NO: 5468254 - DNA, 11 bp, Homo sapiens
ttttcatccat

SEQ ID NO: 5468255 - DNA, 22 bp, Homo sapiens
ttttcatcccgtatcacagtgt

SEQ ID NO: 5468256 - DNA, 22 bp, Homo sapiens
ttttcatccctgccaagaactc

SEQ ID NO: 5468257 - DNA, 15 bp, Homo sapiens
ttttcatcctggcct

SEQ ID NO: 5468258 - DNA, 16 bp, Homo sapiens
ttttcatcctggcctc

SEQ ID NO: 5468259 - DNA, 18 bp, Homo sapiens
ttttcatcctggcctcct

SEQ ID NO: 5468260 - DNA, 11 bp, Homo sapiens
ttttcatcctt

SEQ ID NO: 5468261 - DNA, 22 bp, Homo sapiens
ttttcatccttttttctcttct

SEQ ID NO: 5468262 - DNA, 13 bp, Homo sapiens
ttttcatctcatt

SEQ ID NO: 5468263 - DNA, 23 bp, Homo sapiens
ttttcatctcattaattcaatta

SEQ ID NO: 5468264 - DNA, 17 bp, Homo sapiens
ttttcatctgaaaagca

SEQ ID NO: 5468265 - DNA, 12 bp, Homo sapiens
ttttcatctgtt

SEQ ID NO: 5468266 - DNA, 16 bp, Homo sapiens
ttttcatcttcagttg

SEQ ID NO: 5468267 - DNA, 18 bp, Homo sapiens
ttttcatgacagaatata

SEQ ID NO: 5468268 - DNA, 14 bp, Homo sapiens
ttttcatgacataa

SEQ ID NO: 5468269 - DNA, 22 bp, Homo sapiens
ttttcatgcgatgacacttgta

SEQ ID NO: 5468270 - DNA, 16 bp, Homo sapiens
ttttcatgctccacta

SEQ ID NO: 5468271 - DNA, 20 bp, Homo sapiens
ttttcatggcccttcaaatt

SEQ ID NO: 5468272 - DNA, 21 bp, Homo sapiens
ttttcatggtgaaaatgtact

SEQ ID NO: 5468273 - DNA, 18 bp, Homo sapiens
ttttcatgtaagtttaat

SEQ ID NO: 5468274 - DNA, 14 bp, Homo sapiens
ttttcatgtacagc

SEQ ID NO: 5468275 - DNA, 14 bp, Homo sapiens
ttttcatgtgtgat

SEQ ID NO: 5468276 - DNA, 20 bp, Homo sapiens
ttttcattagcaaaaaaagt

SEQ ID NO: 5468277 - DNA, 23 bp, Homo sapiens
ttttcattagcaaaaaaagttgt

SEQ ID NO: 5468278 - DNA, 16 bp, Homo sapiens
ttttcattagcagttg

SEQ ID NO: 5468279 - DNA, 19 bp, Homo sapiens
ttttcattatttggaaatt

SEQ ID NO: 5468280 - DNA, 16 bp, Homo sapiens
ttttcattcatgaata

SEQ ID NO: 5468281 - DNA, 12 bp, Homo sapiens
ttttcattccct

SEQ ID NO: 5468282 - DNA, 14 bp, Homo sapiens
ttttcattctcctc

SEQ ID NO: 5468283 - DNA, 16 bp, Homo sapiens
ttttcattctgccaaa

SEQ ID NO: 5468284 - DNA, 19 bp, Homo sapiens
ttttcattgaggataaatt

SEQ ID NO: 5468285 - DNA, 13 bp, Homo sapiens
ttttcatttatct

SEQ ID NO: 5468286 - DNA, 14 bp, Homo sapiens
ttttgcaagggaat

SEQ ID NO: 5468287 - DNA, 18 bp, Homo sapiens
ttttgcaaggtaaaattt

SEQ ID NO: 5468288 - DNA, 21 bp, Homo sapiens
ttttgcaaggttccacagagt

SEQ ID NO: 5468289 - DNA, 22 bp, Homo sapiens
ttttgcaagtgaaggtttacaa

SEQ ID NO: 5468290 - DNA, 23 bp, Homo sapiens
ttttgcaagtgaaggtttacaat

SEQ ID NO: 5468291 - DNA, 12 bp, Homo sapiens
ttttgcaataag

SEQ ID NO: 5468292 - DNA, 22 bp, Homo sapiens
ttttgcaattggaataatcact

SEQ ID NO: 5468293 - DNA, 10 bp, Homo sapiens
ttttgcacaa

SEQ ID NO: 5468294 - DNA, 22 bp, Homo sapiens
ttttgcacaccttttccccagg

SEQ ID NO: 5468295 - DNA, 17 bp, Homo sapiens
ttttgcacagccaaatt

SEQ ID NO: 5468296 - DNA, 20 bp, Homo sapiens
ttttgcacatcatgtatctg

SEQ ID NO: 5468297 - DNA, 17 bp, Homo sapiens
ttttgcaccccatgctg

SEQ ID NO: 5468298 - DNA, 21 bp, Homo sapiens
ttttgcaccccatgctgttga

SEQ ID NO: 5468299 - DNA, 16 bp, Homo sapiens
ttttgcacccctccca

SEQ ID NO: 5468300 - DNA, 17 bp, Homo sapiens
ttttgcacccctcccat

SEQ ID NO: 5468301 - DNA, 21 bp, Homo sapiens
ttttgcacgtcttgctatttg

SEQ ID NO: 5468302 - DNA, 14 bp, Homo sapiens
ttttgcactagaac

SEQ ID NO: 5468303 - DNA, 13 bp, Homo sapiens
ttttgcactgaca

SEQ ID NO: 5468304 - DNA, 21 bp, Homo sapiens
ttttgcactgaggatattcag

SEQ ID NO: 5468305 - DNA, 19 bp, Homo sapiens
ttttgcactgctcaattct

SEQ ID NO: 5468306 - DNA, 15 bp, Homo sapiens
ttttgcactgtctgt

SEQ ID NO: 5468307 - DNA, 16 bp, Homo sapiens
ttttgcagaaggaaat

SEQ ID NO: 5468308 - DNA, 18 bp, Homo sapiens
ttttgcagaaggaaatga

SEQ ID NO: 5468309 - DNA, 18 bp, Homo sapiens
ttttgcagcagaggagct

SEQ ID NO: 5468310 - DNA, 12 bp, Homo sapiens
ttttgcagcttt

SEQ ID NO: 5468311 - DNA, 22 bp, Homo sapiens
ttttgcaggggactgggccatg

SEQ ID NO: 5468312 - DNA, 9 bp, Homo sapiens
ttttgcagt

SEQ ID NO: 5468313 - DNA, 16 bp, Homo sapiens
ttttgcagtaactgtt

SEQ ID NO: 5468314 - DNA, 15 bp, Homo sapiens
ttttgcataatgcaa

SEQ ID NO: 5468315 - DNA, 21 bp, Homo sapiens
ttttgcatagttctagtgcag

SEQ ID NO: 5468316 - DNA, 20 bp, Homo sapiens
ttttgcatctcacaaacata

SEQ ID NO: 5468317 - DNA, 12 bp, Homo sapiens
ttttgcatgaaa

SEQ ID NO: 5468318 - DNA, 22 bp, Homo sapiens
ttttgcatggcacttgcatctg

SEQ ID NO: 5468319 - DNA, 15 bp, Homo sapiens
ttttgcatgtctgca

SEQ ID NO: 5468320 - DNA, 14 bp, Homo sapiens
ttttgcatgtttaa

SEQ ID NO: 5468321 - DNA, 17 bp, Homo sapiens
ttttgcatgtttaataa

SEQ ID NO: 5468322 - DNA, 14 bp, Homo sapiens
ttttgcattattca

SEQ ID NO: 5468323 - DNA, 16 bp, Homo sapiens
ttttgcattccagaat

SEQ ID NO: 5468324 - DNA, 18 bp, Homo sapiens
ttttgcattccagaatct

SEQ ID NO: 5468325 - DNA, 19 bp, Homo sapiens
ttttgcattccagaatctt

SEQ ID NO: 5468326 - DNA, 22 bp, Homo sapiens
ttttgcattgtgtgagcttcta

SEQ ID NO: 5468327 - DNA, 13 bp, Homo sapiens
ttttgcatttatg

SEQ ID NO: 5468328 - DNA, 22 bp, Homo sapiens
ttttgcatttctcttcctaaat

SEQ ID NO: 5468329 - DNA, 15 bp, Homo sapiens
ttttgccaacattgc

SEQ ID NO: 5468330 - DNA, 23 bp, Homo sapiens
ttttgccacaaagaagattctta

SEQ ID NO: 5468331 - DNA, 14 bp, Homo sapiens
ttttgccacagctt

SEQ ID NO: 5468332 - DNA, 23 bp, Homo sapiens
ttttgccactgcaaacaataaac

SEQ ID NO: 5468333 - DNA, 20 bp, Homo sapiens
ttttgccactgcctttcaga

SEQ ID NO: 5468334 - DNA, 17 bp, Homo sapiens
ttttgccagttttccct

SEQ ID NO: 5468335 - DNA, 19 bp, Homo sapiens
ttttgccagttttccctgg

SEQ ID NO: 5468336 - DNA, 15 bp, Homo sapiens
ttttgccattaaact

SEQ ID NO: 5468337 - DNA, 19 bp, Homo sapiens
ttttgcccattttgaatca

SEQ ID NO: 5468338 - DNA, 13 bp, Homo sapiens
ttttgccctcctg

SEQ ID NO: 5468339 - DNA, 18 bp, Homo sapiens
ttttgcccttcacagtgt

SEQ ID NO: 5468340 - DNA, 19 bp, Homo sapiens
ttttgccctttagggctgt

SEQ ID NO: 5468341 - DNA, 23 bp, Homo sapiens
ttttgccggctggtgaattcaaa

SEQ ID NO: 5468342 - DNA, 13 bp, Homo sapiens
ttttgcctatctt

SEQ ID NO: 5468343 - DNA, 17 bp, Homo sapiens
ttttgcctatctttaaa

SEQ ID NO: 5468344 - DNA, 18 bp, Homo sapiens
ttttgcctatctttaaac

SEQ ID NO: 5468345 - DNA, 14 bp, Homo sapiens
ttttgcctcatgaa

SEQ ID NO: 5468346 - DNA, 12 bp, Homo sapiens
ttttgcctctgc

SEQ ID NO: 5468347 - DNA, 21 bp, Homo sapiens
ttttgcctgacaattgcaaat

SEQ ID NO: 5468348 - DNA, 20 bp, Homo sapiens
ttttgcctgagaaggggcag

SEQ ID NO: 5468349 - DNA, 12 bp, Homo sapiens
ttttgcctggct

SEQ ID NO: 5468350 - DNA, 13 bp, Homo sapiens
ttttgcctggctg

SEQ ID NO: 5468351 - DNA, 22 bp, Homo sapiens
ttttgcctggctgtggaggcct

SEQ ID NO: 5468352 - DNA, 17 bp, Homo sapiens
ttttgccttcattacct

SEQ ID NO: 5468353 - DNA, 15 bp, Homo sapiens
ttttgccttttgcaa

SEQ ID NO: 5468354 - DNA, 14 bp, Homo sapiens
ttttgcgatgtgtt

SEQ ID NO: 5468355 - DNA, 18 bp, Homo sapiens
ttttgcgatgtgttttat

SEQ ID NO: 5468356 - DNA, 15 bp, Homo sapiens
ttttgcgatttcaca

SEQ ID NO: 5468357 - DNA, 17 bp, Homo sapiens
ttttgcgtacacagaga

SEQ ID NO: 5468358 - DNA, 11 bp, Homo sapiens
ttttgctaact

SEQ ID NO: 5468359 - DNA, 14 bp, Homo sapiens
ttttgctaactggg

SEQ ID NO: 5468360 - DNA, 23 bp, Homo sapiens
ttttgctaaggagaagctaatat

SEQ ID NO: 5468361 - DNA, 19 bp, Homo sapiens
ttttgctaggagccccagc

SEQ ID NO: 5468362 - DNA, 11 bp, Homo sapiens
ttttgctatac

SEQ ID NO: 5468363 - DNA, 19 bp, Homo sapiens
ttttgctccttctgtgttt

SEQ ID NO: 5468364 - DNA, 16 bp, Homo sapiens
ttttgctctaaaatat

SEQ ID NO: 5468365 - DNA, 13 bp, Homo sapiens
ttttgctgctgct

SEQ ID NO: 5468366 - DNA, 13 bp, Homo sapiens
ttttgctggaata

SEQ ID NO: 5468367 - DNA, 22 bp, Homo sapiens
ttttgctgtaatgttaatattg

SEQ ID NO: 5468368 - DNA, 11 bp, Homo sapiens
ttttgctgtct

SEQ ID NO: 5468369 - DNA, 17 bp, Homo sapiens
ttttgctgtctttctct

SEQ ID NO: 5468370 - DNA, 15 bp, Homo sapiens
ttttgctgtgctgta

SEQ ID NO: 5468371 - DNA, 13 bp, Homo sapiens
ttttgctgttcca

SEQ ID NO: 5468372 - DNA, 19 bp, Homo sapiens
ttttgctgtttattaaaaa

SEQ ID NO: 5468373 - DNA, 18 bp, Homo sapiens
ttttgctgtttcctttta

SEQ ID NO: 5468374 - DNA, 15 bp, Homo sapiens
ttttgcttaaaattt

SEQ ID NO: 5468375 - DNA, 16 bp, Homo sapiens
ttttgcttaaaatttt

SEQ ID NO: 5468376 - DNA, 18 bp, Homo sapiens
ttttgcttaacattagat

SEQ ID NO: 5468377 - DNA, 13 bp, Homo sapiens
ttttgctttaatt

SEQ ID NO: 5468378 - DNA, 19 bp, Homo sapiens
ttttgctttaattccatga

SEQ ID NO: 5468379 - DNA, 21 bp, Homo sapiens
ttttgctttagagaatgccac

SEQ ID NO: 5468380 - DNA, 11 bp, Homo sapiens
ttttgctttat

SEQ ID NO: 5468381 - DNA, 13 bp, Homo sapiens
ttttgctttgtta

SEQ ID NO: 5468382 - DNA, 13 bp, Homo sapiens
ttttgctttgttt

SEQ ID NO: 5468383 - DNA, 17 bp, Homo sapiens
ttttgcttttatccact

SEQ ID NO: 5468384 - DNA, 12 bp, Homo sapiens
ttttgcttttta

SEQ ID NO: 5468385 - DNA, 17 bp, Homo sapiens
ttttgctttttctgact

SEQ ID NO: 5468386 - DNA, 20 bp, Homo sapiens
ttttgctttttctgactcca

SEQ ID NO: 5468387 - DNA, 11 bp, Homo sapiens
ttttggaaact

SEQ ID NO: 5468388 - DNA, 17 bp, Homo sapiens
ttttggaaagtcagaat

SEQ ID NO: 5468389 - DNA, 21 bp, Homo sapiens
ttttggaactaaagcaaattt

SEQ ID NO: 5468390 - DNA, 20 bp, Homo sapiens
ttttggaagattttcagtct

SEQ ID NO: 5468391 - DNA, 16 bp, Homo sapiens
ttttggaatctagaag

SEQ ID NO: 5468392 - DNA, 19 bp, Homo sapiens
ttttggaattggtgtatat

SEQ ID NO: 5468393 - DNA, 13 bp, Homo sapiens
ttttggaattgtc

SEQ ID NO: 5468394 - DNA, 21 bp, Homo sapiens
ttttggacctaaacattattt

SEQ ID NO: 5468395 - DNA, 15 bp, Homo sapiens
ttttggactagccag

SEQ ID NO: 5468396 - DNA, 19 bp, Homo sapiens
ttttggactctctgtggtc

SEQ ID NO: 5468397 - DNA, 18 bp, Homo sapiens
ttttggagaaaaattaca

SEQ ID NO: 5468398 - DNA, 15 bp, Homo sapiens
ttttggaggtgctta

SEQ ID NO: 5468399 - DNA, 16 bp, Homo sapiens
ttttggagtgttatgt

SEQ ID NO: 5468400 - DNA, 17 bp, Homo sapiens
ttttggagtgttatgta

SEQ ID NO: 5468401 - DNA, 23 bp, Homo sapiens
ttttggatcataaactggaaata

SEQ ID NO: 5468402 - DNA, 17 bp, Homo sapiens
ttttggatcttgaatgt

SEQ ID NO: 5468403 - DNA, 16 bp, Homo sapiens
ttttggatgcagtgct

SEQ ID NO: 5468404 - DNA, 11 bp, Homo sapiens
ttttggatgcc

SEQ ID NO: 5468405 - DNA, 18 bp, Homo sapiens
ttttggatggtgttacat

SEQ ID NO: 5468406 - DNA, 21 bp, Homo sapiens
ttttggatgttgctatagtga

SEQ ID NO: 5468407 - DNA, 18 bp, Homo sapiens
ttttggattgtcaaagag

SEQ ID NO: 5468408 - DNA, 23 bp, Homo sapiens
ttttggatttagagactgtaaat

SEQ ID NO: 5468409 - DNA, 19 bp, Homo sapiens
ttttggcaaaactctactt

SEQ ID NO: 5468410 - DNA, 22 bp, Homo sapiens
ttttggcaatacatttgatttg

SEQ ID NO: 5468411 - DNA, 22 bp, Homo sapiens
ttttggcaatgactcaaagtct

SEQ ID NO: 5468412 - DNA, 11 bp, Homo sapiens
ttttggcacct

SEQ ID NO: 5468413 - DNA, 14 bp, Homo sapiens
ttttggcattcctc

SEQ ID NO: 5468414 - DNA, 23 bp, Homo sapiens
ttttggcctcatctctgcctgac

SEQ ID NO: 5468415 - DNA, 17 bp, Homo sapiens
ttttggcgctattacaa

SEQ ID NO: 5468416 - DNA, 20 bp, Homo sapiens
ttttggctagagtttccact

SEQ ID NO: 5468417 - DNA, 14 bp, Homo sapiens
ttttggctcagagt

SEQ ID NO: 5468418 - DNA, 16 bp, Homo sapiens
ttttggctcagagtcc

SEQ ID NO: 5468419 - DNA, 14 bp, Homo sapiens
ttttggctctgaag

SEQ ID NO: 5468420 - DNA, 22 bp, Homo sapiens
ttttggctgagtactggaataa

SEQ ID NO: 5468421 - DNA, 14 bp, Homo sapiens
ttttggctgctgaa

SEQ ID NO: 5468422 - DNA, 19 bp, Homo sapiens
ttttggctgtgacctcttc

SEQ ID NO: 5468423 - DNA, 21 bp, Homo sapiens
ttttggctgtgacctcttcaa

SEQ ID NO: 5468424 - DNA, 17 bp, Homo sapiens
ttttggctgttttccct

SEQ ID NO: 5468425 - DNA, 17 bp, Homo sapiens
ttttggcttcatttcaa

SEQ ID NO: 5468426 - DNA, 14 bp, Homo sapiens
ttttggctttctcc

SEQ ID NO: 5468427 - DNA, 16 bp, Homo sapiens
ttttggctttctccct

SEQ ID NO: 5468428 - DNA, 17 bp, Homo sapiens
ttttgggacaattgttt

SEQ ID NO: 5468429 - DNA, 20 bp, Homo sapiens
ttttgggaggggatggcaga

SEQ ID NO: 5468430 - DNA, 12 bp, Homo sapiens
ttttgggatgtc

SEQ ID NO: 5468431 - DNA, 21 bp, Homo sapiens
ttttgggatttgttgaaatct

SEQ ID NO: 5468432 - DNA, 14 bp, Homo sapiens
ttttgggccattac

SEQ ID NO: 5468433 - DNA, 17 bp, Homo sapiens
ttttgggctcaaagccc

SEQ ID NO: 5468434 - DNA, 22 bp, Homo sapiens
ttttgggctcctttttctccct

SEQ ID NO: 5468435 - DNA, 19 bp, Homo sapiens
ttttggggaaaaaagcaca

SEQ ID NO: 5468436 - DNA, 20 bp, Homo sapiens
ttttggggaaaaaagcacat

SEQ ID NO: 5468437 - DNA, 22 bp, Homo sapiens
ttttggggattttcaaaagata

SEQ ID NO: 5468438 - DNA, 18 bp, Homo sapiens
ttttggggcatcctggat

SEQ ID NO: 5468439 - DNA, 18 bp, Homo sapiens
ttttgggggtcaggcagc

SEQ ID NO: 5468440 - DNA, 18 bp, Homo sapiens
ttttgggggtgggtctgg

SEQ ID NO: 5468441 - DNA, 18 bp, Homo sapiens
ttttgggggtgtgagtgt

SEQ ID NO: 5468442 - DNA, 19 bp, Homo sapiens
ttttgggggtttttaatct

SEQ ID NO: 5468443 - DNA, 18 bp, Homo sapiens
ttttggggtgtgacctca

SEQ ID NO: 5468444 - DNA, 21 bp, Homo sapiens
ttttgggtaaaatctgtaatt

SEQ ID NO: 5468445 - DNA, 17 bp, Homo sapiens
ttttgggtactggagct

SEQ ID NO: 5468446 - DNA, 19 bp, Homo sapiens
ttttgggtactttctatct

SEQ ID NO: 5468447 - DNA, 16 bp, Homo sapiens
ttttggtaataacaaa

SEQ ID NO: 5468448 - DNA, 20 bp, Homo sapiens
ttttggtaatatatatattt

SEQ ID NO: 5468449 - DNA, 14 bp, Homo sapiens
ttttggtacaaaaa

SEQ ID NO: 5468450 - DNA, 17 bp, Homo sapiens
ttttggtagagaaggag

SEQ ID NO: 5468451 - DNA, 13 bp, Homo sapiens
ttttggtatttat

SEQ ID NO: 5468452 - DNA, 14 bp, Homo sapiens
ttttggtatttatg

SEQ ID NO: 5468453 - DNA, 16 bp, Homo sapiens
ttttggtatttgaaac

SEQ ID NO: 5468454 - DNA, 18 bp, Homo sapiens
ttttggtatttgtttgta

SEQ ID NO: 5468455 - DNA, 19 bp, Homo sapiens
ttttggtccaaattcttta

SEQ ID NO: 5468456 - DNA, 15 bp, Homo sapiens
ttttggtccttcttt

SEQ ID NO: 5468457 - DNA, 14 bp, Homo sapiens
ttttggtctttttg

SEQ ID NO: 5468458 - DNA, 17 bp, Homo sapiens
ttttggtgcacaaatac

SEQ ID NO: 5468459 - DNA, 17 bp, Homo sapiens
ttttggtggatgtaaat

SEQ ID NO: 5468460 - DNA, 16 bp, Homo sapiens
ttttggtggtgaaatt

SEQ ID NO: 5468461 - DNA, 16 bp, Homo sapiens
ttttggttatttctaa

SEQ ID NO: 5468462 - DNA, 19 bp, Homo sapiens
ttttggttatttctaaacc

SEQ ID NO: 5468463 - DNA, 22 bp, Homo sapiens
ttttggttcattttcagattca

SEQ ID NO: 5468464 - DNA, 16 bp, Homo sapiens
ttttggttcttagttc

SEQ ID NO: 5468465 - DNA, 14 bp, Homo sapiens
tttttccccaaagt

SEQ ID NO: 5468466 - DNA, 16 bp, Homo sapiens
tttttccccaaagtct

SEQ ID NO: 5468467 - DNA, 12 bp, Homo sapiens
tttttccccctt

SEQ ID NO: 5468468 - DNA, 20 bp, Homo sapiens
tttttccccgattttccaga

SEQ ID NO: 5468469 - DNA, 23 bp, Homo sapiens
tttttcccttcatctgggcactg

SEQ ID NO: 5468470 - DNA, 11 bp, Homo sapiens
tttttcccttt

SEQ ID NO: 5468471 - DNA, 16 bp, Homo sapiens
tttttccgtaaaaatg

SEQ ID NO: 5468472 - DNA, 11 bp, Homo sapiens
tttttccgtgt

SEQ ID NO: 5468473 - DNA, 15 bp, Homo sapiens
tttttcctagaagtg

SEQ ID NO: 5468474 - DNA, 18 bp, Homo sapiens
tttttcctagccctctca

SEQ ID NO: 5468475 - DNA, 15 bp, Homo sapiens
tttttcctagcctgt

SEQ ID NO: 5468476 - DNA, 22 bp, Homo sapiens
tttttcctatgaccataaaatt

SEQ ID NO: 5468477 - DNA, 18 bp, Homo sapiens
tttttcctcatgtaacat

SEQ ID NO: 5468478 - DNA, 13 bp, Homo sapiens
tttttcctcccag

SEQ ID NO: 5468479 - DNA, 11 bp, Homo sapiens
tttttcctcct

SEQ ID NO: 5468480 - DNA, 16 bp, Homo sapiens
tttttcctctaagtgc

SEQ ID NO: 5468481 - DNA, 16 bp, Homo sapiens
tttttcctctaatatg

SEQ ID NO: 5468482 - DNA, 12 bp, Homo sapiens
tttttcctctgt

SEQ ID NO: 5468483 - DNA, 18 bp, Homo sapiens
tttttcctgcatgttctg

SEQ ID NO: 5468484 - DNA, 20 bp, Homo sapiens
tttttccttacataaacatc

SEQ ID NO: 5468485 - DNA, 16 bp, Homo sapiens
tttttccttactgtgc

SEQ ID NO: 5468486 - DNA, 21 bp, Homo sapiens
tttttccttcaagaatgcagt

SEQ ID NO: 5468487 - DNA, 17 bp, Homo sapiens
tttttccttcataattt

SEQ ID NO: 5468488 - DNA, 15 bp, Homo sapiens
tttttccttctctgg

SEQ ID NO: 5468489 - DNA, 17 bp, Homo sapiens
tttttcctttttctgat

SEQ ID NO: 5468490 - DNA, 13 bp, Homo sapiens
tttttcgtgtttt

SEQ ID NO: 5468491 - DNA, 22 bp, Homo sapiens
tttttctaaacaagaaccattt

SEQ ID NO: 5468492 - DNA, 15 bp, Homo sapiens
tttttctaactacaa

SEQ ID NO: 5468493 - DNA, 15 bp, Homo sapiens
tttttctaagagaag

SEQ ID NO: 5468494 - DNA, 23 bp, Homo sapiens
tttttctaagtgtaacctcagta

SEQ ID NO: 5468495 - DNA, 22 bp, Homo sapiens
tttttctacacagtaaaaactt

SEQ ID NO: 5468496 - DNA, 21 bp, Homo sapiens
tttttctaccataagtgacac

SEQ ID NO: 5468497 - DNA, 18 bp, Homo sapiens
tttttctacttttaaaga

SEQ ID NO: 5468498 - DNA, 14 bp, Homo sapiens
tttttctagtacac

SEQ ID NO: 5468499 - DNA, 19 bp, Homo sapiens
tttttctagtttggcacat

SEQ ID NO: 5468500 - DNA, 15 bp, Homo sapiens
tttttctataaatca

SEQ ID NO: 5468501 - DNA, 11 bp, Homo sapiens
tttttctatga

SEQ ID NO: 5468502 - DNA, 10 bp, Homo sapiens
tttttctcaa

SEQ ID NO: 5468503 - DNA, 12 bp, Homo sapiens
tttttctcaaat

SEQ ID NO: 5468504 - DNA, 11 bp, Homo sapiens
tttttctctaa

SEQ ID NO: 5468505 - DNA, 16 bp, Homo sapiens
tttttctctaatgctt

SEQ ID NO: 5468506 - DNA, 12 bp, Homo sapiens
tttttctctttc

SEQ ID NO: 5468507 - DNA, 14 bp, Homo sapiens
tttttctctttctc

SEQ ID NO: 5468508 - DNA, 9 bp, Homo sapiens
tttttctga

SEQ ID NO: 5468509 - DNA, 22 bp, Homo sapiens
tttttctgaataaaaaagattc

SEQ ID NO: 5468510 - DNA, 18 bp, Homo sapiens
tttttctgactccagtgg

SEQ ID NO: 5468511 - DNA, 11 bp, Homo sapiens
tttttctgatt

SEQ ID NO: 5468512 - DNA, 16 bp, Homo sapiens
tttttctgatttgtcc

SEQ ID NO: 5468513 - DNA, 13 bp, Homo sapiens
tttttctgcacag

SEQ ID NO: 5468514 - DNA, 16 bp, Homo sapiens
tttttctgcacagctt

SEQ ID NO: 5468515 - DNA, 22 bp, Homo sapiens
tttttctgcactatatgcaaac

SEQ ID NO: 5468516 - DNA, 14 bp, Homo sapiens
tttttctgcactga

SEQ ID NO: 5468517 - DNA, 13 bp, Homo sapiens
tttttctgcagaa

SEQ ID NO: 5468518 - DNA, 12 bp, Homo sapiens
tttttctgcctc

SEQ ID NO: 5468519 - DNA, 13 bp, Homo sapiens
tttttctgcctcc

SEQ ID NO: 5468520 - DNA, 20 bp, Homo sapiens
tttttctgctttagacttga

SEQ ID NO: 5468521 - DNA, 11 bp, Homo sapiens
tttttctggaa

SEQ ID NO: 5468522 - DNA, 21 bp, Homo sapiens
tttttctggaccaaggtgaag

SEQ ID NO: 5468523 - DNA, 16 bp, Homo sapiens
tttttctggccttgac

SEQ ID NO: 5468524 - DNA, 22 bp, Homo sapiens
tttttctggctgtgatcttaaa

SEQ ID NO: 5468525 - DNA, 13 bp, Homo sapiens
tttttctgggctt

SEQ ID NO: 5468526 - DNA, 18 bp, Homo sapiens
tttttctgtaactgtgct

SEQ ID NO: 5468527 - DNA, 11 bp, Homo sapiens
tttttctgtat

SEQ ID NO: 5468528 - DNA, 20 bp, Homo sapiens
tttttctgtgataactctgc

SEQ ID NO: 5468529 - DNA, 12 bp, Homo sapiens
tttttcttaaaa

SEQ ID NO: 5468530 - DNA, 19 bp, Homo sapiens
tttttcttaaatatgtata

SEQ ID NO: 5468531 - DNA, 14 bp, Homo sapiens
tttttcttaacaag

SEQ ID NO: 5468532 - DNA, 21 bp, Homo sapiens
tttttcttaatatatagcatt

SEQ ID NO: 5468533 - DNA, 15 bp, Homo sapiens
tttttcttacacatt

SEQ ID NO: 5468534 - DNA, 13 bp, Homo sapiens
tttttcttatcca

SEQ ID NO: 5468535 - DNA, 16 bp, Homo sapiens
tttttcttcactgcaa

SEQ ID NO: 5468536 - DNA, 12 bp, Homo sapiens
tttttcttcagc

SEQ ID NO: 5468537 - DNA, 11 bp, Homo sapiens
tttttcttccc

SEQ ID NO: 5468538 - DNA, 14 bp, Homo sapiens
tttttcttcgctgg

SEQ ID NO: 5468539 - DNA, 11 bp, Homo sapiens
tttttcttctg

SEQ ID NO: 5468540 - DNA, 14 bp, Homo sapiens
tttttcttctttta

SEQ ID NO: 5468541 - DNA, 14 bp, Homo sapiens
tttttcttgatctt

SEQ ID NO: 5468542 - DNA, 18 bp, Homo sapiens
tttttcttgctgttcagt

SEQ ID NO: 5468543 - DNA, 12 bp, Homo sapiens
tttttcttggga

SEQ ID NO: 5468544 - DNA, 12 bp, Homo sapiens
tttttcttgtct

SEQ ID NO: 5468545 - DNA, 22 bp, Homo sapiens
tttttcttgtctataaagcatt

SEQ ID NO: 5468546 - DNA, 16 bp, Homo sapiens
tttttctttataaact

SEQ ID NO: 5468547 - DNA, 18 bp, Homo sapiens
tttttctttgtatttatt

SEQ ID NO: 5468548 - DNA, 13 bp, Homo sapiens
tttttcttttgta

SEQ ID NO: 5468549 - DNA, 23 bp, Homo sapiens
tttttctttttccagtgttctat

SEQ ID NO: 5468550 - DNA, 20 bp, Homo sapiens
tttttcttttttttttctgt

SEQ ID NO: 5468551 - DNA, 18 bp, Homo sapiens
tttttgaaaaagagattt

SEQ ID NO: 5468552 - DNA, 15 bp, Homo sapiens
tttttgaaaaatatt

SEQ ID NO: 5468553 - DNA, 16 bp, Homo sapiens
tttttgaaaagagaag

SEQ ID NO: 5468554 - DNA, 16 bp, Homo sapiens
tttttgaaacccacag

SEQ ID NO: 5468555 - DNA, 19 bp, Homo sapiens
tttttgaaacccacagttt

SEQ ID NO: 5468556 - DNA, 23 bp, Homo sapiens
tttttgaaaggcatgttcctctg

SEQ ID NO: 5468557 - DNA, 23 bp, Homo sapiens
tttttgaaatcagtaaacactgt

SEQ ID NO: 5468558 - DNA, 23 bp, Homo sapiens
tttttgaactaagaaacttttgt

SEQ ID NO: 5468559 - DNA, 16 bp, Homo sapiens
tttttgaacttttcat

SEQ ID NO: 5468560 - DNA, 22 bp, Homo sapiens
tttttgaaggcagaaagcaaaa

SEQ ID NO: 5468561 - DNA, 23 bp, Homo sapiens
tttttgaaggcagaaagcaaaat

SEQ ID NO: 5468562 - DNA, 23 bp, Homo sapiens
tttttgaagtaaattaaacattt

SEQ ID NO: 5468563 - DNA, 15 bp, Homo sapiens
tttttgaagtcttgt

SEQ ID NO: 5468564 - DNA, 12 bp, Homo sapiens
tttttgaagtgt

SEQ ID NO: 5468565 - DNA, 15 bp, Homo sapiens
tttttgaatatgcct

SEQ ID NO: 5468566 - DNA, 12 bp, Homo sapiens
tttttgaattct

SEQ ID NO: 5468567 - DNA, 13 bp, Homo sapiens
tttttgacactga

SEQ ID NO: 5468568 - DNA, 13 bp, Homo sapiens
tttttgacagaat

SEQ ID NO: 5468569 - DNA, 18 bp, Homo sapiens
tttttgaccagtttcttt

SEQ ID NO: 5468570 - DNA, 12 bp, Homo sapiens
tttttgactttt

SEQ ID NO: 5468571 - DNA, 23 bp, Homo sapiens
tttttgactttttttgtatgtgt

SEQ ID NO: 5468572 - DNA, 16 bp, Homo sapiens
tttttgagacagagtc

SEQ ID NO: 5468573 - DNA, 20 bp, Homo sapiens
tttttgagacagagtctcgc

SEQ ID NO: 5468574 - DNA, 18 bp, Homo sapiens
tttttgaggtatcactgc

SEQ ID NO: 5468575 - DNA, 14 bp, Homo sapiens
tttttgagtactgt

SEQ ID NO: 5468576 - DNA, 16 bp, Homo sapiens
tttttgagtcaaagac

SEQ ID NO: 5468577 - DNA, 15 bp, Homo sapiens
tttttgagtgacagc

SEQ ID NO: 5468578 - DNA, 20 bp, Homo sapiens
tttttgagttttcttatata

SEQ ID NO: 5468579 - DNA, 17 bp, Homo sapiens
tttttgataatccaaag

SEQ ID NO: 5468580 - DNA, 13 bp, Homo sapiens
tttttgatagcat

SEQ ID NO: 5468581 - DNA, 12 bp, Homo sapiens
tttttgatatag

SEQ ID NO: 5468582 - DNA, 12 bp, Homo sapiens
tttttgatatat

SEQ ID NO: 5468583 - DNA, 18 bp, Homo sapiens
tttttgatcaaatgtaca

SEQ ID NO: 5468584 - DNA, 22 bp, Homo sapiens
tttttgatcaatgtatatgaag

SEQ ID NO: 5468585 - DNA, 19 bp, Homo sapiens
tttttgatcatccctttct

SEQ ID NO: 5468586 - DNA, 15 bp, Homo sapiens
tttttgatgcctttt

SEQ ID NO: 5468587 - DNA, 18 bp, Homo sapiens
tttttgattaacaatgta

SEQ ID NO: 5468588 - DNA, 18 bp, Homo sapiens
tttttgatttatcaatat

SEQ ID NO: 5468589 - DNA, 11 bp, Homo sapiens
tttttgcaaaa

SEQ ID NO: 5468590 - DNA, 11 bp, Homo sapiens
tttttgcaata

SEQ ID NO: 5468591 - DNA, 14 bp, Homo sapiens
tttttgcaataagg

SEQ ID NO: 5468592 - DNA, 20 bp, Homo sapiens
tttttgcacatgtttcctct

SEQ ID NO: 5468593 - DNA, 19 bp, Homo sapiens
tttttgcaccccatgctgt

SEQ ID NO: 5468594 - DNA, 22 bp, Homo sapiens
tttttgcaccccatgctgttga

SEQ ID NO: 5468595 - DNA, 16 bp, Homo sapiens
tttttgcaggggactg

SEQ ID NO: 5468596 - DNA, 21 bp, Homo sapiens
tttttgccaaaatatcatgtt

SEQ ID NO: 5468597 - DNA, 19 bp, Homo sapiens
tttttgccacaaagaagat

SEQ ID NO: 5468598 - DNA, 20 bp, Homo sapiens
tttttgccactgcaaacaat

SEQ ID NO: 5468599 - DNA, 11 bp, Homo sapiens
tttttgctata

SEQ ID NO: 5468600 - DNA, 13 bp, Homo sapiens
tttttgctgtgta

SEQ ID NO: 5468601 - DNA, 14 bp, Homo sapiens
tttttgctgttagt

SEQ ID NO: 5468602 - DNA, 14 bp, Homo sapiens
tttttgcttaacat

SEQ ID NO: 5468603 - DNA, 18 bp, Homo sapiens
tttttgcttctactttca

SEQ ID NO: 5468604 - DNA, 23 bp, Homo sapiens
tttttggaaaagagctgggatcc

SEQ ID NO: 5468605 - DNA, 17 bp, Homo sapiens
tttttggaaagtcagaa

SEQ ID NO: 5468606 - DNA, 15 bp, Homo sapiens
tttttggaagtgaaa

SEQ ID NO: 5468607 - DNA, 19 bp, Homo sapiens
tttttggaagtgaaaactt

SEQ ID NO: 5468608 - DNA, 9 bp, Homo sapiens
tttttggat

SEQ ID NO: 5468609 - DNA, 21 bp, Homo sapiens
tttttggatggcttaagcctg

SEQ ID NO: 5468610 - DNA, 16 bp, Homo sapiens
tttttggatttagctt

SEQ ID NO: 5468611 - DNA, 15 bp, Homo sapiens
tttttggatttctgt

SEQ ID NO: 5468612 - DNA, 19 bp, Homo sapiens
tttttggcaacaggagaga

SEQ ID NO: 5468613 - DNA, 15 bp, Homo sapiens
tttttggcattatct

SEQ ID NO: 5468614 - DNA, 16 bp, Homo sapiens
tttttggctagagttt

SEQ ID NO: 5468615 - DNA, 20 bp, Homo sapiens
tttttgggcagcaatttaaa

SEQ ID NO: 5468616 - DNA, 15 bp, Homo sapiens
tttttgggggctttc

SEQ ID NO: 5468617 - DNA, 15 bp, Homo sapiens
tttttgggtttggcc

SEQ ID NO: 5468618 - DNA, 23 bp, Homo sapiens
tttttggtaataacaaacgtgtt

SEQ ID NO: 5468619 - DNA, 14 bp, Homo sapiens
tttttggtaattat

SEQ ID NO: 5468620 - DNA, 12 bp, Homo sapiens
tttttggtacaa

SEQ ID NO: 5468621 - DNA, 15 bp, Homo sapiens
tttttggtataatgt

SEQ ID NO: 5468622 - DNA, 20 bp, Homo sapiens
tttttggtataatgtttaaa

SEQ ID NO: 5468623 - DNA, 12 bp, Homo sapiens
tttttggtcaaa

SEQ ID NO: 5468624 - DNA, 22 bp, Homo sapiens
tttttggtcttctgttgacatt

SEQ ID NO: 5468625 - DNA, 17 bp, Homo sapiens
tttttggtgtatttgag

SEQ ID NO: 5468626 - DNA, 21 bp, Homo sapiens
tttttggttaaaaaaaagaat

SEQ ID NO: 5468627 - DNA, 15 bp, Homo sapiens
tttttggttttaaaa

SEQ ID NO: 5468628 - DNA, 19 bp, Homo sapiens
tttttggttttctccttcc

SEQ ID NO: 5468629 - DNA, 13 bp, Homo sapiens
tttttgtaaactg

SEQ ID NO: 5468630 - DNA, 16 bp, Homo sapiens
tttttgtaaagtgtgg

SEQ ID NO: 5468631 - DNA, 12 bp, Homo sapiens
tttttgtaaatg

SEQ ID NO: 5468632 - DNA, 12 bp, Homo sapiens
tttttgtaacta

SEQ ID NO: 5468633 - DNA, 15 bp, Homo sapiens
tttttgtaactacaa

SEQ ID NO: 5468634 - DNA, 14 bp, Homo sapiens
tttttgtaactctt

SEQ ID NO: 5468635 - DNA, 12 bp, Homo sapiens
tttttgtaataa

SEQ ID NO: 5468636 - DNA, 18 bp, Homo sapiens
tttttgtaataacattta

SEQ ID NO: 5468637 - DNA, 13 bp, Homo sapiens
tttttgtaattta

SEQ ID NO: 5468638 - DNA, 11 bp, Homo sapiens
tttttgtacat

SEQ ID NO: 5468639 - DNA, 18 bp, Homo sapiens
tttttgtacattacacta

SEQ ID NO: 5468640 - DNA, 16 bp, Homo sapiens
tttttgtacctggtga

SEQ ID NO: 5468641 - DNA, 11 bp, Homo sapiens
tttttgtactt

SEQ ID NO: 5468642 - DNA, 12 bp, Homo sapiens
tttttgtacttt

SEQ ID NO: 5468643 - DNA, 19 bp, Homo sapiens
tttttgtagcactgacaga

SEQ ID NO: 5468644 - DNA, 20 bp, Homo sapiens
tttttgtagtgacctgttta

SEQ ID NO: 5468645 - DNA, 18 bp, Homo sapiens
tttttgtataaaatagac

SEQ ID NO: 5468646 - DNA, 15 bp, Homo sapiens
tttttgtatattaca

SEQ ID NO: 5468647 - DNA, 15 bp, Homo sapiens
tttttgtatgtgaac

SEQ ID NO: 5468648 - DNA, 12 bp, Homo sapiens
gtaattattttc

SEQ ID NO: 5468649 - DNA, 13 bp, Homo sapiens
gtaattcaagaaa

SEQ ID NO: 5468650 - DNA, 14 bp, Homo sapiens
gtaattcaagaaaa

SEQ ID NO: 5468651 - DNA, 13 bp, Homo sapiens
gtaattcaggact

SEQ ID NO: 5468652 - DNA, 22 bp, Homo sapiens
gtaattcattgagcagttagct

SEQ ID NO: 5468653 - DNA, 17 bp, Homo sapiens
gtaattcccatctgctt

SEQ ID NO: 5468654 - DNA, 17 bp, Homo sapiens
gtaattcgtttgctaga

SEQ ID NO: 5468655 - DNA, 18 bp, Homo sapiens
gtaattctaccctgaaag

SEQ ID NO: 5468656 - DNA, 22 bp, Homo sapiens
gtaattctccctaaggaatctg

SEQ ID NO: 5468657 - DNA, 21 bp, Homo sapiens
gtaattctgtcattcctaaaa

SEQ ID NO: 5468658 - DNA, 12 bp, Homo sapiens
gtaattcttatg

SEQ ID NO: 5468659 - DNA, 15 bp, Homo sapiens
gtaattcttcagttg

SEQ ID NO: 5468660 - DNA, 20 bp, Homo sapiens
gtaattcttctgcctcagcc

SEQ ID NO: 5468661 - DNA, 16 bp, Homo sapiens
gtaattctttctgtct

SEQ ID NO: 5468662 - DNA, 15 bp, Homo sapiens
gtaattgaacttatc

SEQ ID NO: 5468663 - DNA, 21 bp, Homo sapiens
gtaattgacagagtaaaagta

SEQ ID NO: 5468664 - DNA, 15 bp, Homo sapiens
gtaattgacatgtgc

SEQ ID NO: 5468665 - DNA, 19 bp, Homo sapiens
gtaattgcatgacaaacct

SEQ ID NO: 5468666 - DNA, 20 bp, Homo sapiens
gtaattgcctacaataaaaa

SEQ ID NO: 5468667 - DNA, 15 bp, Homo sapiens
gtaattgcttacatt

SEQ ID NO: 5468668 - DNA, 13 bp, Homo sapiens
gtaattggaatct

SEQ ID NO: 5468669 - DNA, 16 bp, Homo sapiens
gtaattggaatcttca

SEQ ID NO: 5468670 - DNA, 17 bp, Homo sapiens
gtaattggaatcttcac

SEQ ID NO: 5468671 - DNA, 23 bp, Homo sapiens
gtaattggaatcttcacctcaga

SEQ ID NO: 5468672 - DNA, 12 bp, Homo sapiens
gtaattgggaac

SEQ ID NO: 5468673 - DNA, 14 bp, Homo sapiens
gtaattgggaactg

SEQ ID NO: 5468674 - DNA, 13 bp, Homo sapiens
gtaattgtacaat

SEQ ID NO: 5468675 - DNA, 16 bp, Homo sapiens
gtaattgtacaataaa

SEQ ID NO: 5468676 - DNA, 17 bp, Homo sapiens
gtaattgtacaataaat

SEQ ID NO: 5468677 - DNA, 18 bp, Homo sapiens
gtaattgtacaataaatt

SEQ ID NO: 5468678 - DNA, 18 bp, Homo sapiens
gtaattgtactaaagcca

SEQ ID NO: 5468679 - DNA, 17 bp, Homo sapiens
gtaattgtagacctgtt

SEQ ID NO: 5468680 - DNA, 19 bp, Homo sapiens
gtaattgttgtttgtatgt

SEQ ID NO: 5468681 - DNA, 14 bp, Homo sapiens
gtaatttaaacagg

SEQ ID NO: 5468682 - DNA, 16 bp, Homo sapiens
gtaatttaaacaggcc

SEQ ID NO: 5468683 - DNA, 22 bp, Homo sapiens
gtaatttaaacatttgttcctg

SEQ ID NO: 5468684 - DNA, 23 bp, Homo sapiens
gtaatttaaatgaaagaaaattg

SEQ ID NO: 5468685 - DNA, 15 bp, Homo sapiens
gtaatttaatgaaaa

SEQ ID NO: 5468686 - DNA, 19 bp, Homo sapiens
gtaatttaattccccttcc

SEQ ID NO: 5468687 - DNA, 23 bp, Homo sapiens
gtaatttatagtttatacagttt

SEQ ID NO: 5468688 - DNA, 14 bp, Homo sapiens
gtaatttatatggt

SEQ ID NO: 5468689 - DNA, 18 bp, Homo sapiens
gtaatttatattccattt

SEQ ID NO: 5468690 - DNA, 11 bp, Homo sapiens
gtaatttatgc

SEQ ID NO: 5468691 - DNA, 13 bp, Homo sapiens
gtaatttattgtc

SEQ ID NO: 5468692 - DNA, 15 bp, Homo sapiens
gtaatttattgtctg

SEQ ID NO: 5468693 - DNA, 21 bp, Homo sapiens
gtaatttattgtctgtctaca

SEQ ID NO: 5468694 - DNA, 12 bp, Homo sapiens
gtaatttcaaaa

SEQ ID NO: 5468695 - DNA, 19 bp, Homo sapiens
gtaatttcgccttaaactc

SEQ ID NO: 5468696 - DNA, 18 bp, Homo sapiens
gtaatttctaaagcagtt

SEQ ID NO: 5468697 - DNA, 20 bp, Homo sapiens
gtaatttctgtgtattttga

SEQ ID NO: 5468698 - DNA, 21 bp, Homo sapiens
gtaatttctgtgtattttgag

SEQ ID NO: 5468699 - DNA, 16 bp, Homo sapiens
gtaatttgaggacaac

SEQ ID NO: 5468700 - DNA, 20 bp, Homo sapiens
gtaatttgatggtatttctt

SEQ ID NO: 5468701 - DNA, 23 bp, Homo sapiens
gtaatttgatggtatttctttct

SEQ ID NO: 5468702 - DNA, 18 bp, Homo sapiens
gtaatttggatctcttct

SEQ ID NO: 5468703 - DNA, 14 bp, Homo sapiens
gtaatttgtaaagt

SEQ ID NO: 5468704 - DNA, 17 bp, Homo sapiens
gtaatttgtacaggggc

SEQ ID NO: 5468705 - DNA, 17 bp, Homo sapiens
gtaatttgtgatacaat

SEQ ID NO: 5468706 - DNA, 21 bp, Homo sapiens
gtaatttgtgtaataaagtgt

SEQ ID NO: 5468707 - DNA, 11 bp, Homo sapiens
gtaattttaaa

SEQ ID NO: 5468708 - DNA, 20 bp, Homo sapiens
gtaattttatgagctgtgag

SEQ ID NO: 5468709 - DNA, 19 bp, Homo sapiens
gtaattttattttaaaatt

SEQ ID NO: 5468710 - DNA, 23 bp, Homo sapiens
gtaattttcggatgggagagttt

SEQ ID NO: 5468711 - DNA, 13 bp, Homo sapiens
gtaattttctgat

SEQ ID NO: 5468712 - DNA, 17 bp, Homo sapiens
gtaattttgcacagaca

SEQ ID NO: 5468713 - DNA, 19 bp, Homo sapiens
gtaattttgtatcacctct

SEQ ID NO: 5468714 - DNA, 16 bp, Homo sapiens
gtaattttgtgaaaga

SEQ ID NO: 5468715 - DNA, 14 bp, Homo sapiens
gtaattttgtgtaa

SEQ ID NO: 5468716 - DNA, 13 bp, Homo sapiens
gtaatttttctgt

SEQ ID NO: 5468717 - DNA, 15 bp, Homo sapiens
gtaatttttctgtat

SEQ ID NO: 5468718 - DNA, 21 bp, Homo sapiens
gtaatttttggggaaaaaagc

SEQ ID NO: 5468719 - DNA, 14 bp, Homo sapiens
gtaattttttaaat

SEQ ID NO: 5468720 - DNA, 17 bp, Homo sapiens
gtaattttttaaatgaa

SEQ ID NO: 5468721 - DNA, 15 bp, Homo sapiens
gtaatttttttcacc

SEQ ID NO: 5468722 - DNA, 16 bp, Homo sapiens
gtaatttttttcttat

SEQ ID NO: 5468723 - DNA, 20 bp, Homo sapiens
gtaatttttttgaaaaaagt

SEQ ID NO: 5468724 - DNA, 17 bp, Homo sapiens
gtaatttttttgtaaag

SEQ ID NO: 5468725 - DNA, 22 bp, Homo sapiens
gtaattttttttgttttttgta

SEQ ID NO: 5468726 - DNA, 16 bp, Homo sapiens
gtaatttttttttgta

SEQ ID NO: 5468727 - DNA, 13 bp, Homo sapiens
gtacaaaaaagtt

SEQ ID NO: 5468728 - DNA, 15 bp, Homo sapiens
gtacaaaaaagttat

SEQ ID NO: 5468729 - DNA, 12 bp, Homo sapiens
gtacaaaaacaa

SEQ ID NO: 5468730 - DNA, 23 bp, Homo sapiens
gtacaaaaggagaagaggaacat

SEQ ID NO: 5468731 - DNA, 14 bp, Homo sapiens
gtacaaaagggaca

SEQ ID NO: 5468732 - DNA, 15 bp, Homo sapiens
gtacaaaagtaccat

SEQ ID NO: 5468733 - DNA, 16 bp, Homo sapiens
gtacaaaagtaccata

SEQ ID NO: 5468734 - DNA, 21 bp, Homo sapiens
gtacaaaataaagttacattg

SEQ ID NO: 5468735 - DNA, 18 bp, Homo sapiens
gtacaaaatgaattgcct

SEQ ID NO: 5468736 - DNA, 14 bp, Homo sapiens
gtacaaaatggtcc

SEQ ID NO: 5468737 - DNA, 14 bp, Homo sapiens
gtacaaacatgaaa

SEQ ID NO: 5468738 - DNA, 16 bp, Homo sapiens
gtacaaacatgaaaaa

SEQ ID NO: 5468739 - DNA, 18 bp, Homo sapiens
gtacaaactaaggtgcta

SEQ ID NO: 5468740 - DNA, 14 bp, Homo sapiens
gtacaaagatactt

SEQ ID NO: 5468741 - DNA, 16 bp, Homo sapiens
gtacaaagatatgcta

SEQ ID NO: 5468742 - DNA, 21 bp, Homo sapiens
gtacaaagattagtttcaatg

SEQ ID NO: 5468743 - DNA, 16 bp, Homo sapiens
gtacaaagtaaaaata

SEQ ID NO: 5468744 - DNA, 20 bp, Homo sapiens
gtacaaagtattaagcatat

SEQ ID NO: 5468745 - DNA, 17 bp, Homo sapiens
gtacaaagttttccttt

SEQ ID NO: 5468746 - DNA, 11 bp, Homo sapiens
gtacaaataaa

SEQ ID NO: 5468747 - DNA, 13 bp, Homo sapiens
gtacaaataaacc

SEQ ID NO: 5468748 - DNA, 20 bp, Homo sapiens
gtacaaataatattgccttg

SEQ ID NO: 5468749 - DNA, 22 bp, Homo sapiens
gtacaaataatttagaaataaa

SEQ ID NO: 5468750 - DNA, 13 bp, Homo sapiens
gtacaaatataag

SEQ ID NO: 5468751 - DNA, 20 bp, Homo sapiens
gtacaaatataagaataaaa

SEQ ID NO: 5468752 - DNA, 21 bp, Homo sapiens
gtacaaatattcctgtttctg

SEQ ID NO: 5468753 - DNA, 17 bp, Homo sapiens
gtacaaatgaagaaagt

SEQ ID NO: 5468754 - DNA, 18 bp, Homo sapiens
gtacaaatgtaagcaaag

SEQ ID NO: 5468755 - DNA, 15 bp, Homo sapiens
gtacaaatgtatttt

SEQ ID NO: 5468756 - DNA, 17 bp, Homo sapiens
gtacaaatgtattttga

SEQ ID NO: 5468757 - DNA, 12 bp, Homo sapiens
gtacaaatgtgt

SEQ ID NO: 5468758 - DNA, 22 bp, Homo sapiens
gtacaaattataaaaagccact

SEQ ID NO: 5468759 - DNA, 23 bp, Homo sapiens
gtacaaattatacataataaagt

SEQ ID NO: 5468760 - DNA, 22 bp, Homo sapiens
gtacaacatttatatattgtct

SEQ ID NO: 5468761 - DNA, 11 bp, Homo sapiens
gtacaaccctg

SEQ ID NO: 5468762 - DNA, 12 bp, Homo sapiens
gtacaaccctga

SEQ ID NO: 5468763 - DNA, 16 bp, Homo sapiens
gtacaaccggatgcca

SEQ ID NO: 5468764 - DNA, 17 bp, Homo sapiens
gtacaactttttaaata

SEQ ID NO: 5468765 - DNA, 15 bp, Homo sapiens
gtacaagatctcagg

SEQ ID NO: 5468766 - DNA, 14 bp, Homo sapiens
gtacaagctgtaaa

SEQ ID NO: 5468767 - DNA, 15 bp, Homo sapiens
gtacaaggggcccag

SEQ ID NO: 5468768 - DNA, 18 bp, Homo sapiens
gtacaaggtatgtacagt

SEQ ID NO: 5468769 - DNA, 17 bp, Homo sapiens
gtacaagtagttctgta

SEQ ID NO: 5468770 - DNA, 21 bp, Homo sapiens
gtacaagtagttctgtatttg

SEQ ID NO: 5468771 - DNA, 23 bp, Homo sapiens
gtacaagtatataatatgtcacc

SEQ ID NO: 5468772 - DNA, 23 bp, Homo sapiens
gtacaagtggtaatttttgtaca

SEQ ID NO: 5468773 - DNA, 17 bp, Homo sapiens
gtacaagttctggcaag

SEQ ID NO: 5468774 - DNA, 13 bp, Homo sapiens
gtacaagttgctt

SEQ ID NO: 5468775 - DNA, 20 bp, Homo sapiens
gtacaagttgctttgttaca

SEQ ID NO: 5468776 - DNA, 16 bp, Homo sapiens
gtacaagttttgtata

SEQ ID NO: 5468777 - DNA, 21 bp, Homo sapiens
gtacaataagttacttgaaat

SEQ ID NO: 5468778 - DNA, 20 bp, Homo sapiens
gtacaataatctctatttga

SEQ ID NO: 5468779 - DNA, 13 bp, Homo sapiens
gtacaatacaatg

SEQ ID NO: 5468780 - DNA, 14 bp, Homo sapiens
gtacaatacaatgt

SEQ ID NO: 5468781 - DNA, 17 bp, Homo sapiens
gtacaatacaatgtaca

SEQ ID NO: 5468782 - DNA, 20 bp, Homo sapiens
gtacaatagtatacatttta

SEQ ID NO: 5468783 - DNA, 14 bp, Homo sapiens
gtacaatattttaa

SEQ ID NO: 5468784 - DNA, 18 bp, Homo sapiens
gtacaatattttaagcat

SEQ ID NO: 5468785 - DNA, 20 bp, Homo sapiens
gtacaatattttaagcatta

SEQ ID NO: 5468786 - DNA, 24 bp, Homo sapiens
gtacaatattttaagcattactct

SEQ ID NO: 5468787 - DNA, 21 bp, Homo sapiens
gtacaatcaaaacacactact

SEQ ID NO: 5468788 - DNA, 22 bp, Homo sapiens
gtacaatcatgaacagctctga

SEQ ID NO: 5468789 - DNA, 17 bp, Homo sapiens
gtacaatcctttgagtt

SEQ ID NO: 5468790 - DNA, 23 bp, Homo sapiens
gtacaatcgacatcctagcccca

SEQ ID NO: 5468791 - DNA, 23 bp, Homo sapiens
gtacaatctttcaccaagtaaat

SEQ ID NO: 5468792 - DNA, 21 bp, Homo sapiens
gtacaatgactttattgcatc

SEQ ID NO: 5468793 - DNA, 13 bp, Homo sapiens
gtacaatggttta

SEQ ID NO: 5468794 - DNA, 12 bp, Homo sapiens
gtacaatgtgag

SEQ ID NO: 5468795 - DNA, 21 bp, Homo sapiens
gtacaattaattatcttttca

SEQ ID NO: 5468796 - DNA, 13 bp, Homo sapiens
gtacaattactgt

SEQ ID NO: 5468797 - DNA, 14 bp, Homo sapiens
gtacaattatgtct

SEQ ID NO: 5468798 - DNA, 18 bp, Homo sapiens
gtacaattctttgttgct

SEQ ID NO: 5468799 - DNA, 14 bp, Homo sapiens
gtacaattgatctt

SEQ ID NO: 5468800 - DNA, 23 bp, Homo sapiens
gtacaattttaaagttcttattt

SEQ ID NO: 5468801 - DNA, 22 bp, Homo sapiens
gtacacaacttagaaaccaaat

SEQ ID NO: 5468802 - DNA, 21 bp, Homo sapiens
gtacacaccctccagcacaga

SEQ ID NO: 5468803 - DNA, 23 bp, Homo sapiens
gtacacaccctccagcacagact

SEQ ID NO: 5468804 - DNA, 14 bp, Homo sapiens
gtacacactttatt

SEQ ID NO: 5468805 - DNA, 15 bp, Homo sapiens
gtacacactttattt

SEQ ID NO: 5468806 - DNA, 15 bp, Homo sapiens
gtacacagagctaag

SEQ ID NO: 5468807 - DNA, 20 bp, Homo sapiens
gtacacagagctaaggccaa

SEQ ID NO: 5468808 - DNA, 19 bp, Homo sapiens
gtacacagagggacttgag

SEQ ID NO: 5468809 - DNA, 20 bp, Homo sapiens
gtacacagagggacttgagc

SEQ ID NO: 5468810 - DNA, 14 bp, Homo sapiens
gtacacataagcca

SEQ ID NO: 5468811 - DNA, 23 bp, Homo sapiens
gtacacatctattctcaaagcta

SEQ ID NO: 5468812 - DNA, 14 bp, Homo sapiens
gtacacatttctta

SEQ ID NO: 5468813 - DNA, 21 bp, Homo sapiens
gtacacatttcttaaaacaca

SEQ ID NO: 5468814 - DNA, 14 bp, Homo sapiens
gtacaccccacctc

SEQ ID NO: 5468815 - DNA, 14 bp, Homo sapiens
gtacacctccccct

SEQ ID NO: 5468816 - DNA, 15 bp, Homo sapiens
gtacacctgcggggc

SEQ ID NO: 5468817 - DNA, 18 bp, Homo sapiens
gtacacgggaccagctca

SEQ ID NO: 5468818 - DNA, 14 bp, Homo sapiens
gtacacgtgtaaca

SEQ ID NO: 5468819 - DNA, 12 bp, Homo sapiens
gtacactaacat

SEQ ID NO: 5468820 - DNA, 22 bp, Homo sapiens
gtacactcagccactgtcacag

SEQ ID NO: 5468821 - DNA, 14 bp, Homo sapiens
gtacactctgctgt

SEQ ID NO: 5468822 - DNA, 14 bp, Homo sapiens
gtacactgaatatt

SEQ ID NO: 5468823 - DNA, 17 bp, Homo sapiens
gtacactgcatctcaag

SEQ ID NO: 5468824 - DNA, 12 bp, Homo sapiens
gtacactgctgt

SEQ ID NO: 5468825 - DNA, 11 bp, Homo sapiens
gtacactgtgt

SEQ ID NO: 5468826 - DNA, 23 bp, Homo sapiens
gtacactgttcccaatatgtagc

SEQ ID NO: 5468827 - DNA, 19 bp, Homo sapiens
gtactgttcatacagtttt

SEQ ID NO: 5468828 - DNA, 14 bp, Homo sapiens
gtactgttctgtgt

SEQ ID NO: 5468829 - DNA, 15 bp, Homo sapiens
gtactgttctgtgtc

SEQ ID NO: 5468830 - DNA, 18 bp, Homo sapiens
gtactgttctgtgtcttt

SEQ ID NO: 5468831 - DNA, 19 bp, Homo sapiens
gtactgttgaaaaagataa

SEQ ID NO: 5468832 - DNA, 18 bp, Homo sapiens
gtactgttgctttaatat

SEQ ID NO: 5468833 - DNA, 18 bp, Homo sapiens
gtactgttttctgggcca

SEQ ID NO: 5468834 - DNA, 14 bp, Homo sapiens
gtacttaactgtgt

SEQ ID NO: 5468835 - DNA, 21 bp, Homo sapiens
gtacttaagctcccctgcctt

SEQ ID NO: 5468836 - DNA, 22 bp, Homo sapiens
gtacttaagctcccctgcctta

SEQ ID NO: 5468837 - DNA, 15 bp, Homo sapiens
gtacttaataaattc

SEQ ID NO: 5468838 - DNA, 20 bp, Homo sapiens
gtacttaatttacttaagtg

SEQ ID NO: 5468839 - DNA, 21 bp, Homo sapiens
gtacttacactgaaatccaaa

SEQ ID NO: 5468840 - DNA, 16 bp, Homo sapiens
gtacttacccggagaa

SEQ ID NO: 5468841 - DNA, 23 bp, Homo sapiens
gtacttacccggagaaggccgct

SEQ ID NO: 5468842 - DNA, 17 bp, Homo sapiens
gtacttagagtttctgt

SEQ ID NO: 5468843 - DNA, 19 bp, Homo sapiens
gtacttagccagttcaaag

SEQ ID NO: 5468844 - DNA, 23 bp, Homo sapiens
gtacttaggcttggctgccctgt

SEQ ID NO: 5468845 - DNA, 20 bp, Homo sapiens
gtacttattttccaataaaa

SEQ ID NO: 5468846 - DNA, 21 bp, Homo sapiens
gtacttcaaatccttgaagat

SEQ ID NO: 5468847 - DNA, 21 bp, Homo sapiens
gtacttcactgtcaggaagaa

SEQ ID NO: 5468848 - DNA, 14 bp, Homo sapiens
gtacttcagcaaga

SEQ ID NO: 5468849 - DNA, 17 bp, Homo sapiens
gtacttcagtcttggag

SEQ ID NO: 5468850 - DNA, 14 bp, Homo sapiens
gtacttccactgat

SEQ ID NO: 5468851 - DNA, 20 bp, Homo sapiens
gtacttcccgggccagggct

SEQ ID NO: 5468852 - DNA, 15 bp, Homo sapiens
gtacttcctcctgat

SEQ ID NO: 5468853 - DNA, 18 bp, Homo sapiens
gtacttcctcctgatggc

SEQ ID NO: 5468854 - DNA, 19 bp, Homo sapiens
gtacttcctctaggaaatg

SEQ ID NO: 5468855 - DNA, 16 bp, Homo sapiens
gtacttcctctgtgaa

SEQ ID NO: 5468856 - DNA, 21 bp, Homo sapiens
gtacttcctctgtgaactgtg

SEQ ID NO: 5468857 - DNA, 12 bp, Homo sapiens
gtacttcctgtg

SEQ ID NO: 5468858 - DNA, 13 bp, Homo sapiens
gtacttcctgtgt

SEQ ID NO: 5468859 - DNA, 12 bp, Homo sapiens
gtacttctaaga

SEQ ID NO: 5468860 - DNA, 16 bp, Homo sapiens
gtacttctccaccctg

SEQ ID NO: 5468861 - DNA, 21 bp, Homo sapiens
gtacttctccaccctgctctc

SEQ ID NO: 5468862 - DNA, 15 bp, Homo sapiens
gtacttctgtgttca

SEQ ID NO: 5468863 - DNA, 16 bp, Homo sapiens
gtacttcttattgcaa

SEQ ID NO: 5468864 - DNA, 23 bp, Homo sapiens
gtacttcttcatccatagacaca

SEQ ID NO: 5468865 - DNA, 18 bp, Homo sapiens
gtacttcttctgtaatat

SEQ ID NO: 5468866 - DNA, 18 bp, Homo sapiens
gtacttcttgaatataaa

SEQ ID NO: 5468867 - DNA, 21 bp, Homo sapiens
gtacttgaccgtttttatatt

SEQ ID NO: 5468868 - DNA, 24 bp, Homo sapiens
gtacttgaccgtttttatattact

SEQ ID NO: 5468869 - DNA, 22 bp, Homo sapiens
gtacttgactacctactggtgt

SEQ ID NO: 5468870 - DNA, 14 bp, Homo sapiens
gtacttgatactga

SEQ ID NO: 5468871 - DNA, 21 bp, Homo sapiens
gtacttgatttttcaaagact

SEQ ID NO: 5468872 - DNA, 22 bp, Homo sapiens
gtacttgccctgaccatgcatt

SEQ ID NO: 5468873 - DNA, 23 bp, Homo sapiens
gtacttgccctgaccatgcattt

SEQ ID NO: 5468874 - DNA, 17 bp, Homo sapiens
gtacttgctcaataaag

SEQ ID NO: 5468875 - DNA, 18 bp, Homo sapiens
gtacttgctccttttgct

SEQ ID NO: 5468876 - DNA, 12 bp, Homo sapiens
gtacttgctctc

SEQ ID NO: 5468877 - DNA, 18 bp, Homo sapiens
gtacttgctcttgatgcc

SEQ ID NO: 5468878 - DNA, 18 bp, Homo sapiens
gtacttgctgctatttta

SEQ ID NO: 5468879 - DNA, 16 bp, Homo sapiens
gtacttggagggctca

SEQ ID NO: 5468880 - DNA, 13 bp, Homo sapiens
gtacttggcacca

SEQ ID NO: 5468881 - DNA, 23 bp, Homo sapiens
gtacttggcccccttcaggagcc

SEQ ID NO: 5468882 - DNA, 13 bp, Homo sapiens
gtacttggtccaa

SEQ ID NO: 5468883 - DNA, 15 bp, Homo sapiens
gtacttggtccaact

SEQ ID NO: 5468884 - DNA, 18 bp, Homo sapiens
gtacttgtaatatgtata

SEQ ID NO: 5468885 - DNA, 23 bp, Homo sapiens
gtacttgtcctcagcttgggctt

SEQ ID NO: 5468886 - DNA, 20 bp, Homo sapiens
gtacttgtgaaacacagctg

SEQ ID NO: 5468887 - DNA, 21 bp, Homo sapiens
gtacttgtgaaacacagctgt

SEQ ID NO: 5468888 - DNA, 20 bp, Homo sapiens
gtacttgtggacacagctct

SEQ ID NO: 5468889 - DNA, 16 bp, Homo sapiens
gtacttgtttctctgt

SEQ ID NO: 5468890 - DNA, 15 bp, Homo sapiens
gtacttgtttgctat

SEQ ID NO: 5468891 - DNA, 16 bp, Homo sapiens
gtactttaaaaaggaa

SEQ ID NO: 5468892 - DNA, 14 bp, Homo sapiens
gtactttaaaaatt

SEQ ID NO: 5468893 - DNA, 21 bp, Homo sapiens
gtactttagggaaacctttgc

SEQ ID NO: 5468894 - DNA, 19 bp, Homo sapiens
gtactttatattttctata

SEQ ID NO: 5468895 - DNA, 22 bp, Homo sapiens
gtactttatgaaaaaaatatat

SEQ ID NO: 5468896 - DNA, 18 bp, Homo sapiens
gtactttattcttgctgg

SEQ ID NO: 5468897 - DNA, 16 bp, Homo sapiens
gtactttcacatctct

SEQ ID NO: 5468898 - DNA, 21 bp, Homo sapiens
gtactttcacatctctgtaga

SEQ ID NO: 5468899 - DNA, 20 bp, Homo sapiens
gtactttcccaggttgacta

SEQ ID NO: 5468900 - DNA, 23 bp, Homo sapiens
gtactttctatctcatctgtctc

SEQ ID NO: 5468901 - DNA, 16 bp, Homo sapiens
gtactttctgttaaaa

SEQ ID NO: 5468902 - DNA, 23 bp, Homo sapiens
gtactttgtctaagaaacattgg

SEQ ID NO: 5468903 - DNA, 20 bp, Homo sapiens
gtactttgttaaaaacactg

SEQ ID NO: 5468904 - DNA, 12 bp, Homo sapiens
gtactttgtttt

SEQ ID NO: 5468905 - DNA, 23 bp, Homo sapiens
gtactttgtttttccatgtgttt

SEQ ID NO: 5468906 - DNA, 16 bp, Homo sapiens
gtacttttaaaaacat

SEQ ID NO: 5468907 - DNA, 17 bp, Homo sapiens
gtacttttaaaaacata

SEQ ID NO: 5468908 - DNA, 15 bp, Homo sapiens
gtacttttattgatg

SEQ ID NO: 5468909 - DNA, 17 bp, Homo sapiens
gtacttttcattctctt

SEQ ID NO: 5468910 - DNA, 22 bp, Homo sapiens
gtacttttcattctcttttaat

SEQ ID NO: 5468911 - DNA, 14 bp, Homo sapiens
gtacttttccattt

SEQ ID NO: 5468912 - DNA, 13 bp, Homo sapiens
gtacttttccttt

SEQ ID NO: 5468913 - DNA, 19 bp, Homo sapiens
gtacttttctggttccaaa

SEQ ID NO: 5468914 - DNA, 20 bp, Homo sapiens
gtacttttctggttccaaac

SEQ ID NO: 5468915 - DNA, 23 bp, Homo sapiens
gtacttttgtgttactgcagtga

SEQ ID NO: 5468916 - DNA, 15 bp, Homo sapiens
gtactttttgtgaag

SEQ ID NO: 5468917 - DNA, 13 bp, Homo sapiens
gtactttttgttt

SEQ ID NO: 5468918 - DNA, 16 bp, Homo sapiens
gtacttttttcaaata

SEQ ID NO: 5468919 - DNA, 16 bp, Homo sapiens
gtacttttttcttaag

SEQ ID NO: 5468920 - DNA, 20 bp, Homo sapiens
gtagaaaaaaaaattcacat

SEQ ID NO: 5468921 - DNA, 22 bp, Homo sapiens
gtagaaaaaggggcctgagtgg

SEQ ID NO: 5468922 - DNA, 10 bp, Homo sapiens
gtagaaaaat

SEQ ID NO: 5468923 - DNA, 15 bp, Homo sapiens
gtagaaaaataaaga

SEQ ID NO: 5468924 - DNA, 19 bp, Homo sapiens
gtagaaaaattattagaac

SEQ ID NO: 5468925 - DNA, 16 bp, Homo sapiens
gtagaaaaattgtttc

SEQ ID NO: 5468926 - DNA, 16 bp, Homo sapiens
gtagaaaactccaggg

SEQ ID NO: 5468927 - DNA, 23 bp, Homo sapiens
gtagaaaacttcaaggaaaataa

SEQ ID NO: 5468928 - DNA, 18 bp, Homo sapiens
gtagaaaagaaaacattt

SEQ ID NO: 5468929 - DNA, 18 bp, Homo sapiens
gtagaaaagagacttctc

SEQ ID NO: 5468930 - DNA, 20 bp, Homo sapiens
gtagaaaagggaactgaaca

SEQ ID NO: 5468931 - DNA, 13 bp, Homo sapiens
gtagaaaatgtga

SEQ ID NO: 5468932 - DNA, 18 bp, Homo sapiens
gtagaaaatgtgaccctc

SEQ ID NO: 5468933 - DNA, 18 bp, Homo sapiens
gtagaaacacagttttga

SEQ ID NO: 5468934 - DNA, 21 bp, Homo sapiens
gtagaaagacagagctgggat

SEQ ID NO: 5468935 - DNA, 21 bp, Homo sapiens
gtagaaagacatctgcctgta

SEQ ID NO: 5468936 - DNA, 21 bp, Homo sapiens
gtagaaagcaaacaaaattgt

SEQ ID NO: 5468937 - DNA, 17 bp, Homo sapiens
gtagaaagctaatacaa

SEQ ID NO: 5468938 - DNA, 21 bp, Homo sapiens
gtagaaagctaatacaaaact

SEQ ID NO: 5468939 - DNA, 17 bp, Homo sapiens
gtagaaaggcctttaaa

SEQ ID NO: 5468940 - DNA, 22 bp, Homo sapiens
gtagaaagttgtaaaatagaaa

SEQ ID NO: 5468941 - DNA, 17 bp, Homo sapiens
gtagaaataatatgcat

SEQ ID NO: 5468942 - DNA, 12 bp, Homo sapiens
gtagaaatgatt

SEQ ID NO: 5468943 - DNA, 22 bp, Homo sapiens
gtagaaatggttgtattagatg

SEQ ID NO: 5468944 - DNA, 15 bp, Homo sapiens
gtagaaattcttaat

SEQ ID NO: 5468945 - DNA, 22 bp, Homo sapiens
gtagaaattttatctcttcttc

SEQ ID NO: 5468946 - DNA, 22 bp, Homo sapiens
gtagaacacaaggtcatttgct

SEQ ID NO: 5468947 - DNA, 16 bp, Homo sapiens
gtagaactcactctgg

SEQ ID NO: 5468948 - DNA, 19 bp, Homo sapiens
gtagaactcactctgggct

SEQ ID NO: 5468949 - DNA, 20 bp, Homo sapiens
gtagaactcactctgggctg

SEQ ID NO: 5468950 - DNA, 13 bp, Homo sapiens
gtagaactcagca

SEQ ID NO: 5468951 - DNA, 12 bp, Homo sapiens
gtagaactctgc

SEQ ID NO: 5468952 - DNA, 17 bp, Homo sapiens
gtagaactttaaaagaa

SEQ ID NO: 5468953 - DNA, 20 bp, Homo sapiens
gtagaactttattaagtaaa

SEQ ID NO: 5468954 - DNA, 15 bp, Homo sapiens
gtagaagaaagcaaa

SEQ ID NO: 5468955 - DNA, 19 bp, Homo sapiens
gtagaagaagtgaacactt

SEQ ID NO: 5468956 - DNA, 16 bp, Homo sapiens
gtagaagagggagaag

SEQ ID NO: 5468957 - DNA, 12 bp, Homo sapiens
gtagaagatggc

SEQ ID NO: 5468958 - DNA, 20 bp, Homo sapiens
gtagaagatttgatgctgga

SEQ ID NO: 5468959 - DNA, 18 bp, Homo sapiens
gtagaagcaaaggcagga

SEQ ID NO: 5468960 - DNA, 11 bp, Homo sapiens
gtagaagccac

SEQ ID NO: 5468961 - DNA, 15 bp, Homo sapiens
gtagaagccaccctt

SEQ ID NO: 5468962 - DNA, 21 bp, Homo sapiens
gtagaagccacccttccctgc

SEQ ID NO: 5468963 - DNA, 15 bp, Homo sapiens
gtagaaggagccttg

SEQ ID NO: 5468964 - DNA, 12 bp, Homo sapiens
gtagaaggcaca

SEQ ID NO: 5468965 - DNA, 14 bp, Homo sapiens
gtagaagggaaagc

SEQ ID NO: 5468966 - DNA, 19 bp, Homo sapiens
gtagaaggttgacacagtt

SEQ ID NO: 5468967 - DNA, 12 bp, Homo sapiens
gtagaagtagtt

SEQ ID NO: 5468968 - DNA, 21 bp, Homo sapiens
gtagaagtcttagatgtatat

SEQ ID NO: 5468969 - DNA, 21 bp, Homo sapiens
gtagaagtgagtttgtaaata

SEQ ID NO: 5468970 - DNA, 14 bp, Homo sapiens
gtagaagtttttgt

SEQ ID NO: 5468971 - DNA, 19 bp, Homo sapiens
gtagaagtttttgtactgt

SEQ ID NO: 5468972 - DNA, 17 bp, Homo sapiens
gtagaataaatgaagaa

SEQ ID NO: 5468973 - DNA, 14 bp, Homo sapiens
gtagaataataata

SEQ ID NO: 5468974 - DNA, 19 bp, Homo sapiens
gtagaatagcctgtggcct

SEQ ID NO: 5468975 - DNA, 15 bp, Homo sapiens
gtagaataggcaggg

SEQ ID NO: 5468976 - DNA, 14 bp, Homo sapiens
gtagaatctgtgta

SEQ ID NO: 5468977 - DNA, 17 bp, Homo sapiens
gtagaatgctgtagaat

SEQ ID NO: 5468978 - DNA, 23 bp, Homo sapiens
gtagaatggttgagtgcaaatcc

SEQ ID NO: 5468979 - DNA, 19 bp, Homo sapiens
gtagaatgtaaagcttgtc

SEQ ID NO: 5468980 - DNA, 19 bp, Homo sapiens
gtagaatgtattgtacctt

SEQ ID NO: 5468981 - DNA, 15 bp, Homo sapiens
gtagaattatatcta

SEQ ID NO: 5468982 - DNA, 22 bp, Homo sapiens
gtagaattatctaatttataaa

SEQ ID NO: 5468983 - DNA, 13 bp, Homo sapiens
gtagaattccttc

SEQ ID NO: 5468984 - DNA, 21 bp, Homo sapiens
gtagaattcgcagtgatatac

SEQ ID NO: 5468985 - DNA, 17 bp, Homo sapiens
gtagaattgaaaatgca

SEQ ID NO: 5468986 - DNA, 15 bp, Homo sapiens
gtagaattgcattga

SEQ ID NO: 5468987 - DNA, 18 bp, Homo sapiens
gtagaattgggaagctgg

SEQ ID NO: 5468988 - DNA, 14 bp, Homo sapiens
gtagaattgtatat

SEQ ID NO: 5468989 - DNA, 15 bp, Homo sapiens
gtagacaactggtcc

SEQ ID NO: 5468990 - DNA, 21 bp, Homo sapiens
gtagacacactatcatagtta

SEQ ID NO: 5468991 - DNA, 14 bp, Homo sapiens
gtagacacttactt

SEQ ID NO: 5468992 - DNA, 16 bp, Homo sapiens
gtagacagttgggttt

SEQ ID NO: 5468993 - DNA, 15 bp, Homo sapiens
gtagacatttataac

SEQ ID NO: 5468994 - DNA, 21 bp, Homo sapiens
gtagacattttaacaagaaga

SEQ ID NO: 5468995 - DNA, 14 bp, Homo sapiens
gtagaccaaaataa

SEQ ID NO: 5468996 - DNA, 15 bp, Homo sapiens
gtagaccactgtcct

SEQ ID NO: 5468997 - DNA, 15 bp, Homo sapiens
gtagacccctggctg

SEQ ID NO: 5468998 - DNA, 16 bp, Homo sapiens
gtagacctagggagga

SEQ ID NO: 5468999 - DNA, 20 bp, Homo sapiens
gtagacctagggaggacctt

SEQ ID NO: 5469000 - DNA, 16 bp, Homo sapiens
gtagacctgattttca

SEQ ID NO: 5469001 - DNA, 18 bp, Homo sapiens
gtagacctgattttcaaa

SEQ ID NO: 5469002 - DNA, 22 bp, Homo sapiens
gtagaccttgagggtgggccag

SEQ ID NO: 5469003 - DNA, 23 bp, Homo sapiens
gtagacgtgcacgcacactgtct

SEQ ID NO: 5469004 - DNA, 13 bp, Homo sapiens
tccagcccctcct

SEQ ID NO: 5469005 - DNA, 23 bp, Homo sapiens
tccagcccctctggtcgctcctg

SEQ ID NO: 5469006 - DNA, 22 bp, Homo sapiens
tccagcccctggatgcagcctc

SEQ ID NO: 5469007 - DNA, 13 bp, Homo sapiens
tccagcccctgtc

SEQ ID NO: 5469008 - DNA, 20 bp, Homo sapiens
tccagccccttcaattattt

SEQ ID NO: 5469009 - DNA, 18 bp, Homo sapiens
tccagccccttctcagaa

SEQ ID NO: 5469010 - DNA, 21 bp, Homo sapiens
tccagccccttctcagaatct

SEQ ID NO: 5469011 - DNA, 16 bp, Homo sapiens
tccagcccctttccaa

SEQ ID NO: 5469012 - DNA, 17 bp, Homo sapiens
tccagcccctttccaaa

SEQ ID NO: 5469013 - DNA, 22 bp, Homo sapiens
tccagcccctttgcctctgtcc

SEQ ID NO: 5469014 - DNA, 14 bp, Homo sapiens
tccagcccgggagc

SEQ ID NO: 5469015 - DNA, 18 bp, Homo sapiens
tccagcccgggagcctag

SEQ ID NO: 5469016 - DNA, 19 bp, Homo sapiens
tccagccctattctgccac

SEQ ID NO: 5469017 - DNA, 11 bp, Homo sapiens
tccagccctcc

SEQ ID NO: 5469018 - DNA, 18 bp, Homo sapiens
tccagccctccgccagcc

SEQ ID NO: 5469019 - DNA, 21 bp, Homo sapiens
tccagccctccgccagccctg

SEQ ID NO: 5469020 - DNA, 23 bp, Homo sapiens
tccagccctgactaaactaccac

SEQ ID NO: 5469021 - DNA, 19 bp, Homo sapiens
tccagccctgcccaccctc

SEQ ID NO: 5469022 - DNA, 17 bp, Homo sapiens
tccagccctggctgaag

SEQ ID NO: 5469023 - DNA, 21 bp, Homo sapiens
tccagccctggctgaaggact

SEQ ID NO: 5469024 - DNA, 13 bp, Homo sapiens
tccagccctgggc

SEQ ID NO: 5469025 - DNA, 17 bp, Homo sapiens
tccagccgaagctgcag

SEQ ID NO: 5469026 - DNA, 21 bp, Homo sapiens
tccagccgccattgccaccag

SEQ ID NO: 5469027 - DNA, 21 bp, Homo sapiens
tccagccgtgtgtgcatgtgc

SEQ ID NO: 5469028 - DNA, 12 bp, Homo sapiens
tccagcctagag

SEQ ID NO: 5469029 - DNA, 11 bp, Homo sapiens
tccagcctcac

SEQ ID NO: 5469030 - DNA, 21 bp, Homo sapiens
tccagcctcacagatgctggc

SEQ ID NO: 5469031 - DNA, 15 bp, Homo sapiens
tccagcctcagcccc

SEQ ID NO: 5469032 - DNA, 12 bp, Homo sapiens
tccagcctccag

SEQ ID NO: 5469033 - DNA, 15 bp, Homo sapiens
tccagcctcccctcc

SEQ ID NO: 5469034 - DNA, 20 bp, Homo sapiens
tccagcctcccctcccctgg

SEQ ID NO: 5469035 - DNA, 20 bp, Homo sapiens
tccagcctccctgtctccag

SEQ ID NO: 5469036 - DNA, 16 bp, Homo sapiens
tccagcctcctgctgg

SEQ ID NO: 5469037 - DNA, 17 bp, Homo sapiens
tccagcctctcccggct

SEQ ID NO: 5469038 - DNA, 19 bp, Homo sapiens
tccagcctctcccggctgc

SEQ ID NO: 5469039 - DNA, 13 bp, Homo sapiens
tccagcctctgcc

SEQ ID NO: 5469040 - DNA, 21 bp, Homo sapiens
tccagcctctgccgctgccat

SEQ ID NO: 5469041 - DNA, 21 bp, Homo sapiens
tccagcctctgttcccctagt

SEQ ID NO: 5469042 - DNA, 14 bp, Homo sapiens
tccagcctgaagag

SEQ ID NO: 5469043 - DNA, 21 bp, Homo sapiens
tccagcctgacatcaaaaaag

SEQ ID NO: 5469044 - DNA, 20 bp, Homo sapiens
tccagcctgagatgtaggct

SEQ ID NO: 5469045 - DNA, 20 bp, Homo sapiens
tccagcctgagcgacagtga

SEQ ID NO: 5469046 - DNA, 20 bp, Homo sapiens
tccagcctgagtgacagagc

SEQ ID NO: 5469047 - DNA, 24 bp, Homo sapiens
tccagcctgagtgacagagcgaga

SEQ ID NO: 5469048 - DNA, 13 bp, Homo sapiens
tccagcctgccac

SEQ ID NO: 5469049 - DNA, 20 bp, Homo sapiens
tccagcctgcccaagcccag

SEQ ID NO: 5469050 - DNA, 16 bp, Homo sapiens
tccagcctgccccgga

SEQ ID NO: 5469051 - DNA, 20 bp, Homo sapiens
tccagcctgctgcctgcttt

SEQ ID NO: 5469052 - DNA, 12 bp, Homo sapiens
tccagcctggac

SEQ ID NO: 5469053 - DNA, 17 bp, Homo sapiens
tccagcctggaccccca

SEQ ID NO: 5469054 - DNA, 18 bp, Homo sapiens
tccagcctggacccccag

SEQ ID NO: 5469055 - DNA, 22 bp, Homo sapiens
tccagcctggacccccagcttt

SEQ ID NO: 5469056 - DNA, 17 bp, Homo sapiens
tccagcctgggacacac

SEQ ID NO: 5469057 - DNA, 12 bp, Homo sapiens
tccagcctgggc

SEQ ID NO: 5469058 - DNA, 18 bp, Homo sapiens
tccagcctgggcgacaga

SEQ ID NO: 5469059 - DNA, 13 bp, Homo sapiens
tccagcctgggga

SEQ ID NO: 5469060 - DNA, 18 bp, Homo sapiens
tccagcctggggacccca

SEQ ID NO: 5469061 - DNA, 19 bp, Homo sapiens
tccagcctggggaccccac

SEQ ID NO: 5469062 - DNA, 20 bp, Homo sapiens
tccagcctggggaccccact

SEQ ID NO: 5469063 - DNA, 17 bp, Homo sapiens
tccagcctggggtctgg

SEQ ID NO: 5469064 - DNA, 20 bp, Homo sapiens
tccagcctgggtcacagagt

SEQ ID NO: 5469065 - DNA, 23 bp, Homo sapiens
tccagcctgggtcacagagtgag

SEQ ID NO: 5469066 - DNA, 17 bp, Homo sapiens
tccagcctgggtgacag

SEQ ID NO: 5469067 - DNA, 24 bp, Homo sapiens
tccagcctgggtgacagagcaagt

SEQ ID NO: 5469068 - DNA, 13 bp, Homo sapiens
tccagcctggtgg

SEQ ID NO: 5469069 - DNA, 22 bp, Homo sapiens
tccagcctggtggcccagctat

SEQ ID NO: 5469070 - DNA, 20 bp, Homo sapiens
tccagcctggtttagcctgg

SEQ ID NO: 5469071 - DNA, 21 bp, Homo sapiens
tccagcctgtcggccacaccc

SEQ ID NO: 5469072 - DNA, 22 bp, Homo sapiens
tccagcctgtcggccacacccc

SEQ ID NO: 5469073 - DNA, 23 bp, Homo sapiens
tccagcctgtcggccacacccca

SEQ ID NO: 5469074 - DNA, 23 bp, Homo sapiens
tccagccttaatagacttctctt

SEQ ID NO: 5469075 - DNA, 20 bp, Homo sapiens
tccagccttatgtgttacat

SEQ ID NO: 5469076 - DNA, 14 bp, Homo sapiens
tccagccttccagg

SEQ ID NO: 5469077 - DNA, 15 bp, Homo sapiens
tccagccttccaggt

SEQ ID NO: 5469078 - DNA, 14 bp, Homo sapiens
tccagcgaaatggt

SEQ ID NO: 5469079 - DNA, 20 bp, Homo sapiens
tccagcgatggtgctgccca

SEQ ID NO: 5469080 - DNA, 21 bp, Homo sapiens
tccagcgcctgccctccctgg

SEQ ID NO: 5469081 - DNA, 19 bp, Homo sapiens
tccagcggggcttctgggc

SEQ ID NO: 5469082 - DNA, 19 bp, Homo sapiens
tccagcggttgcctttttt

SEQ ID NO: 5469083 - DNA, 20 bp, Homo sapiens
tccagcgtcactccagtgct

SEQ ID NO: 5469084 - DNA, 14 bp, Homo sapiens
tccagcgtcctcag

SEQ ID NO: 5469085 - DNA, 18 bp, Homo sapiens
tccagcgtctgctgttga

SEQ ID NO: 5469086 - DNA, 16 bp, Homo sapiens
tccagcgtcttctaga

SEQ ID NO: 5469087 - DNA, 17 bp, Homo sapiens
tccagcgtggtgtgaga

SEQ ID NO: 5469088 - DNA, 20 bp, Homo sapiens
tccagctagtgacccacatg

SEQ ID NO: 5469089 - DNA, 20 bp, Homo sapiens
tccagctataacagtaggga

SEQ ID NO: 5469090 - DNA, 14 bp, Homo sapiens
tccagctcaccagc

SEQ ID NO: 5469091 - DNA, 17 bp, Homo sapiens
tccagctcaccagcccc

SEQ ID NO: 5469092 - DNA, 20 bp, Homo sapiens
tccagctcagaacccagggc

SEQ ID NO: 5469093 - DNA, 23 bp, Homo sapiens
tccagctcagccctggcctggct

SEQ ID NO: 5469094 - DNA, 11 bp, Homo sapiens
tccagctcagt

SEQ ID NO: 5469095 - DNA, 12 bp, Homo sapiens
tccagctcagtc

SEQ ID NO: 5469096 - DNA, 14 bp, Homo sapiens
tccagctcagtccc

SEQ ID NO: 5469097 - DNA, 22 bp, Homo sapiens
tccagctcagtcccacagcccc

SEQ ID NO: 5469098 - DNA, 16 bp, Homo sapiens
tccagctcatctgcca

SEQ ID NO: 5469099 - DNA, 16 bp, Homo sapiens
tccagctcattcattt

SEQ ID NO: 5469100 - DNA, 19 bp, Homo sapiens
tccagctcattcattttat

SEQ ID NO: 5469101 - DNA, 10 bp, Homo sapiens
tccagctcca

SEQ ID NO: 5469102 - DNA, 12 bp, Homo sapiens
tccagctccaac

SEQ ID NO: 5469103 - DNA, 16 bp, Homo sapiens
tccagctccaacctgc

SEQ ID NO: 5469104 - DNA, 15 bp, Homo sapiens
tccagctcccactcc

SEQ ID NO: 5469105 - DNA, 20 bp, Homo sapiens
tccagctcccactccctttc

SEQ ID NO: 5469106 - DNA, 18 bp, Homo sapiens
tccagctccccccaagat

SEQ ID NO: 5469107 - DNA, 15 bp, Homo sapiens
tccagctccctagac

SEQ ID NO: 5469108 - DNA, 19 bp, Homo sapiens
tccagctccctagactgca

SEQ ID NO: 5469109 - DNA, 17 bp, Homo sapiens
tccagctccctgtgccc

SEQ ID NO: 5469110 - DNA, 20 bp, Homo sapiens
tccagctccctgtgccccca

SEQ ID NO: 5469111 - DNA, 21 bp, Homo sapiens
tccagctcctctaggggcagc

SEQ ID NO: 5469112 - DNA, 18 bp, Homo sapiens
tccagctcctgccccgcc

SEQ ID NO: 5469113 - DNA, 13 bp, Homo sapiens
tccagctcctgta

SEQ ID NO: 5469114 - DNA, 18 bp, Homo sapiens
tccagctctaataaaaca

SEQ ID NO: 5469115 - DNA, 13 bp, Homo sapiens
tccagctctgaca

SEQ ID NO: 5469116 - DNA, 19 bp, Homo sapiens
tccagctctgacatccctt

SEQ ID NO: 5469117 - DNA, 23 bp, Homo sapiens
tccagctctgacatcccttcctg

SEQ ID NO: 5469118 - DNA, 13 bp, Homo sapiens
tccagctctgccc

SEQ ID NO: 5469119 - DNA, 12 bp, Homo sapiens
tccagctctgga

SEQ ID NO: 5469120 - DNA, 15 bp, Homo sapiens
tccagctctggaggg

SEQ ID NO: 5469121 - DNA, 20 bp, Homo sapiens
tccagctctggaggggaggg

SEQ ID NO: 5469122 - DNA, 22 bp, Homo sapiens
tccagctctggcttcctgctga

SEQ ID NO: 5469123 - DNA, 18 bp, Homo sapiens
tccagctctgggagccct

SEQ ID NO: 5469124 - DNA, 13 bp, Homo sapiens
tccagctctgtgg

SEQ ID NO: 5469125 - DNA, 17 bp, Homo sapiens
tccagctctgtgggccc

SEQ ID NO: 5469126 - DNA, 18 bp, Homo sapiens
tccagctctgtgggccct

SEQ ID NO: 5469127 - DNA, 11 bp, Homo sapiens
tccagctcttg

SEQ ID NO: 5469128 - DNA, 17 bp, Homo sapiens
tccagctctttagaatg

SEQ ID NO: 5469129 - DNA, 18 bp, Homo sapiens
tccagctctttcctcctt

SEQ ID NO: 5469130 - DNA, 14 bp, Homo sapiens
tccagctgactaaa

SEQ ID NO: 5469131 - DNA, 16 bp, Homo sapiens
tccagctgagcgccag

SEQ ID NO: 5469132 - DNA, 17 bp, Homo sapiens
tccagctgagtcctggg

SEQ ID NO: 5469133 - DNA, 22 bp, Homo sapiens
tccagctgattttaactttttt

SEQ ID NO: 5469134 - DNA, 13 bp, Homo sapiens
tccagctgccccg

SEQ ID NO: 5469135 - DNA, 22 bp, Homo sapiens
tccagctgccccggcccctccc

SEQ ID NO: 5469136 - DNA, 17 bp, Homo sapiens
tccagctgcctattgat

SEQ ID NO: 5469137 - DNA, 13 bp, Homo sapiens
tccagctgcctgg

SEQ ID NO: 5469138 - DNA, 16 bp, Homo sapiens
tccagctgcctgggcc

SEQ ID NO: 5469139 - DNA, 17 bp, Homo sapiens
tccagctgcctgggccc

SEQ ID NO: 5469140 - DNA, 11 bp, Homo sapiens
tccagctgctc

SEQ ID NO: 5469141 - DNA, 14 bp, Homo sapiens
tccagctgctgaga

SEQ ID NO: 5469142 - DNA, 17 bp, Homo sapiens
tccagctgctgtcttct

SEQ ID NO: 5469143 - DNA, 23 bp, Homo sapiens
tccagctggaattgctgctctct

SEQ ID NO: 5469144 - DNA, 24 bp, Homo sapiens
tccagctggaattgctgctctctg

SEQ ID NO: 5469145 - DNA, 20 bp, Homo sapiens
tccagctggatcccagggaa

SEQ ID NO: 5469146 - DNA, 11 bp, Homo sapiens
tccagctggcc

SEQ ID NO: 5469147 - DNA, 21 bp, Homo sapiens
tccagctggccgggagcctga

SEQ ID NO: 5469148 - DNA, 17 bp, Homo sapiens
tccagctggcctggaca

SEQ ID NO: 5469149 - DNA, 18 bp, Homo sapiens
tccagctggcctggacag

SEQ ID NO: 5469150 - DNA, 21 bp, Homo sapiens
tccagctgggacctaatgctg

SEQ ID NO: 5469151 - DNA, 23 bp, Homo sapiens
tccagctgggcctcctgcctccg

SEQ ID NO: 5469152 - DNA, 17 bp, Homo sapiens
tccagctggggccagag

SEQ ID NO: 5469153 - DNA, 22 bp, Homo sapiens
tccagctggggccagaggctgg

SEQ ID NO: 5469154 - DNA, 12 bp, Homo sapiens
tccagctggtgc

SEQ ID NO: 5469155 - DNA, 18 bp, Homo sapiens
tccagctggtgcccccag

SEQ ID NO: 5469156 - DNA, 22 bp, Homo sapiens
tccagctgtcagcctggttttc

SEQ ID NO: 5469157 - DNA, 14 bp, Homo sapiens
tccagctgtccccc

SEQ ID NO: 5469158 - DNA, 14 bp, Homo sapiens
tccagctgtcgtct

SEQ ID NO: 5469159 - DNA, 17 bp, Homo sapiens
tccagcttcagctcaac

SEQ ID NO: 5469160 - DNA, 14 bp, Homo sapiens
tccagcttcccgag

SEQ ID NO: 5469161 - DNA, 15 bp, Homo sapiens
tccagcttcctctga

SEQ ID NO: 5469162 - DNA, 16 bp, Homo sapiens
tccagcttcggagggc

SEQ ID NO: 5469163 - DNA, 23 bp, Homo sapiens
tccagcttctcatgttaaatatt

SEQ ID NO: 5469164 - DNA, 13 bp, Homo sapiens
tccagcttgccag

SEQ ID NO: 5469165 - DNA, 15 bp, Homo sapiens
tccagcttgctcttc

SEQ ID NO: 5469166 - DNA, 16 bp, Homo sapiens
tccagcttgctcttca

SEQ ID NO: 5469167 - DNA, 18 bp, Homo sapiens
tccagctttactgtggct

SEQ ID NO: 5469168 - DNA, 18 bp, Homo sapiens
tccagctttccttctgcc

SEQ ID NO: 5469169 - DNA, 20 bp, Homo sapiens
tccagctttccttctgccct

SEQ ID NO: 5469170 - DNA, 17 bp, Homo sapiens
tccagctttctctttgt

SEQ ID NO: 5469171 - DNA, 19 bp, Homo sapiens
tccagcttttcctcagggt

SEQ ID NO: 5469172 - DNA, 23 bp, Homo sapiens
tccagcttttgtagatggcactt

SEQ ID NO: 5469173 - DNA, 17 bp, Homo sapiens
tccaggaaaaaataaaa

SEQ ID NO: 5469174 - DNA, 19 bp, Homo sapiens
tccaggaaaaaataaaaag

SEQ ID NO: 5469175 - DNA, 21 bp, Homo sapiens
tccaggaaaaaataaaaagag

SEQ ID NO: 5469176 - DNA, 16 bp, Homo sapiens
tccaggaaaactgttt

SEQ ID NO: 5469177 - DNA, 18 bp, Homo sapiens
tccaggaaaatgtgaggg

SEQ ID NO: 5469178 - DNA, 15 bp, Homo sapiens
tccaggaaagagcag

SEQ ID NO: 5469179 - DNA, 21 bp, Homo sapiens
tccaggaaagagcagtcagag

SEQ ID NO: 5469180 - DNA, 22 bp, Homo sapiens
tccaggaaagatgtcccacagg

SEQ ID NO: 5469181 - DNA, 22 bp, Homo sapiens
tccatagttttgatgactggca

SEQ ID NO: 5469182 - DNA, 19 bp, Homo sapiens
tccatataagcccttgatt

SEQ ID NO: 5469183 - DNA, 15 bp, Homo sapiens
tccatatagtttgtt

SEQ ID NO: 5469184 - DNA, 17 bp, Homo sapiens
tccatatattagcattt

SEQ ID NO: 5469185 - DNA, 20 bp, Homo sapiens
tccatatattagcatttagt

SEQ ID NO: 5469186 - DNA, 20 bp, Homo sapiens
tccatatcagaactgtgcca

SEQ ID NO: 5469187 - DNA, 15 bp, Homo sapiens
tccatatcagacctc

SEQ ID NO: 5469188 - DNA, 23 bp, Homo sapiens
tccatatcagacctctgatccct

SEQ ID NO: 5469189 - DNA, 15 bp, Homo sapiens
tccatatcagctctg

SEQ ID NO: 5469190 - DNA, 19 bp, Homo sapiens
tccatatcagctctgcata

SEQ ID NO: 5469191 - DNA, 20 bp, Homo sapiens
tccatatcagctctgcataa

SEQ ID NO: 5469192 - DNA, 14 bp, Homo sapiens
tccatatccgggtg

SEQ ID NO: 5469193 - DNA, 16 bp, Homo sapiens
tccatatccgggtgct

SEQ ID NO: 5469194 - DNA, 20 bp, Homo sapiens
tccatatccgggtgctcaat

SEQ ID NO: 5469195 - DNA, 22 bp, Homo sapiens
tccatatccgggtgctcaataa

SEQ ID NO: 5469196 - DNA, 23 bp, Homo sapiens
tccatatccgggtgctcaataaa

SEQ ID NO: 5469197 - DNA, 13 bp, Homo sapiens
tccatatcctggt

SEQ ID NO: 5469198 - DNA, 14 bp, Homo sapiens
tccatatcctggtg

SEQ ID NO: 5469199 - DNA, 17 bp, Homo sapiens
tccatatccttctggct

SEQ ID NO: 5469200 - DNA, 22 bp, Homo sapiens
tccatatccttctggctgtaga

SEQ ID NO: 5469201 - DNA, 19 bp, Homo sapiens
tccatatctaaccagtgat

SEQ ID NO: 5469202 - DNA, 17 bp, Homo sapiens
tccatatgacctcatgc

SEQ ID NO: 5469203 - DNA, 19 bp, Homo sapiens
tccatatgacctcatgcat

SEQ ID NO: 5469204 - DNA, 24 bp, Homo sapiens
tccatatgacctcatgcatctcca

SEQ ID NO: 5469205 - DNA, 15 bp, Homo sapiens
tccatatgagggaaa

SEQ ID NO: 5469206 - DNA, 16 bp, Homo sapiens
tccatatgctccagga

SEQ ID NO: 5469207 - DNA, 20 bp, Homo sapiens
tccatatggagcatttttca

SEQ ID NO: 5469208 - DNA, 21 bp, Homo sapiens
tccatatggagcatttttcag

SEQ ID NO: 5469209 - DNA, 22 bp, Homo sapiens
tccatatggagcatttttcaga

SEQ ID NO: 5469210 - DNA, 17 bp, Homo sapiens
tccatattacgttgttt

SEQ ID NO: 5469211 - DNA, 21 bp, Homo sapiens
tccatatttaacctatttcca

SEQ ID NO: 5469212 - DNA, 13 bp, Homo sapiens
tccatatttacat

SEQ ID NO: 5469213 - DNA, 16 bp, Homo sapiens
tccatatttcaacaga

SEQ ID NO: 5469214 - DNA, 20 bp, Homo sapiens
tccatattttattactgttt

SEQ ID NO: 5469215 - DNA, 12 bp, Homo sapiens
tccatattttca

SEQ ID NO: 5469216 - DNA, 18 bp, Homo sapiens
tccatatttttttcctta

SEQ ID NO: 5469217 - DNA, 22 bp, Homo sapiens
tccatcaaacctcacatttgtg

SEQ ID NO: 5469218 - DNA, 16 bp, Homo sapiens
tccatcaaagccctcc

SEQ ID NO: 5469219 - DNA, 22 bp, Homo sapiens
tccatcaagccaagcctcctgt

SEQ ID NO: 5469220 - DNA, 15 bp, Homo sapiens
tccatcacagccagc

SEQ ID NO: 5469221 - DNA, 17 bp, Homo sapiens
tccatcaccctcttcct

SEQ ID NO: 5469222 - DNA, 23 bp, Homo sapiens
tccatcaccctcttcctgtgatc

SEQ ID NO: 5469223 - DNA, 23 bp, Homo sapiens
tccatcacctgaaacactggacc

SEQ ID NO: 5469224 - DNA, 19 bp, Homo sapiens
tccatcacgttagctgtcc

SEQ ID NO: 5469225 - DNA, 13 bp, Homo sapiens
tccatcactgaga

SEQ ID NO: 5469226 - DNA, 14 bp, Homo sapiens
tccatcagaaaacc

SEQ ID NO: 5469227 - DNA, 12 bp, Homo sapiens
tccatcagaagg

SEQ ID NO: 5469228 - DNA, 19 bp, Homo sapiens
tccatcagatgtgttcctc

SEQ ID NO: 5469229 - DNA, 16 bp, Homo sapiens
tccatcagcaatgctt

SEQ ID NO: 5469230 - DNA, 14 bp, Homo sapiens
tccatcagcagtga

SEQ ID NO: 5469231 - DNA, 16 bp, Homo sapiens
tccatcagcagtgatt

SEQ ID NO: 5469232 - DNA, 22 bp, Homo sapiens
tccatcagcgggtctcctccca

SEQ ID NO: 5469233 - DNA, 23 bp, Homo sapiens
tccatcagcgggtctcctcccag

SEQ ID NO: 5469234 - DNA, 13 bp, Homo sapiens
tccatcagctccc

SEQ ID NO: 5469235 - DNA, 14 bp, Homo sapiens
tccatcagctccct

SEQ ID NO: 5469236 - DNA, 17 bp, Homo sapiens
tccatcaggacttggga

SEQ ID NO: 5469237 - DNA, 18 bp, Homo sapiens
tccatcaggttccatccc

SEQ ID NO: 5469238 - DNA, 19 bp, Homo sapiens
tccatcaggttccatcccg

SEQ ID NO: 5469239 - DNA, 15 bp, Homo sapiens
tccatcagtgcatga

SEQ ID NO: 5469240 - DNA, 18 bp, Homo sapiens
tccatcagttagagctga

SEQ ID NO: 5469241 - DNA, 16 bp, Homo sapiens
tccatcatcactgtaa

SEQ ID NO: 5469242 - DNA, 13 bp, Homo sapiens
tccatcatcatgt

SEQ ID NO: 5469243 - DNA, 13 bp, Homo sapiens
tccatcatctgct

SEQ ID NO: 5469244 - DNA, 14 bp, Homo sapiens
tccatcatgtcccc

SEQ ID NO: 5469245 - DNA, 22 bp, Homo sapiens
tccatcatgtctgtatactcct

SEQ ID NO: 5469246 - DNA, 23 bp, Homo sapiens
tccatcatgtctgtatactcctg

SEQ ID NO: 5469247 - DNA, 13 bp, Homo sapiens
tccatcattcatc

SEQ ID NO: 5469248 - DNA, 22 bp, Homo sapiens
tccatcatttctgtctttaaga

SEQ ID NO: 5469249 - DNA, 13 bp, Homo sapiens
tccatcattttac

SEQ ID NO: 5469250 - DNA, 16 bp, Homo sapiens
tccatcattttacagt

SEQ ID NO: 5469251 - DNA, 18 bp, Homo sapiens
tccatccaaacctacctt

SEQ ID NO: 5469252 - DNA, 18 bp, Homo sapiens
tccatccacacacagcag

SEQ ID NO: 5469253 - DNA, 15 bp, Homo sapiens
tccatccacatggga

SEQ ID NO: 5469254 - DNA, 13 bp, Homo sapiens
tccatccaccacc

SEQ ID NO: 5469255 - DNA, 14 bp, Homo sapiens
tccatccaccacct

SEQ ID NO: 5469256 - DNA, 17 bp, Homo sapiens
tccatccaccaccttgc

SEQ ID NO: 5469257 - DNA, 15 bp, Homo sapiens
tccatccacccctgc

SEQ ID NO: 5469258 - DNA, 21 bp, Homo sapiens
tccatccacctcatcactgga

SEQ ID NO: 5469259 - DNA, 18 bp, Homo sapiens
tccatccacctttcccaa

SEQ ID NO: 5469260 - DNA, 15 bp, Homo sapiens
tccatccacgtggcc

SEQ ID NO: 5469261 - DNA, 22 bp, Homo sapiens
tccatccataaatccagttcta

SEQ ID NO: 5469262 - DNA, 13 bp, Homo sapiens
tccatccatcctt

SEQ ID NO: 5469263 - DNA, 14 bp, Homo sapiens
tccatccatccttc

SEQ ID NO: 5469264 - DNA, 18 bp, Homo sapiens
tccatccatgtgttccaa

SEQ ID NO: 5469265 - DNA, 17 bp, Homo sapiens
tccatccattgtgttct

SEQ ID NO: 5469266 - DNA, 17 bp, Homo sapiens
tccatcccaacacatca

SEQ ID NO: 5469267 - DNA, 19 bp, Homo sapiens
tccatcccaacagccatgc

SEQ ID NO: 5469268 - DNA, 18 bp, Homo sapiens
tccatcccaaccagtgcc

SEQ ID NO: 5469269 - DNA, 12 bp, Homo sapiens
tccatcccactc

SEQ ID NO: 5469270 - DNA, 22 bp, Homo sapiens
tccatcccaggacaccacaccc

SEQ ID NO: 5469271 - DNA, 18 bp, Homo sapiens
tccatcccaggaggccaa

SEQ ID NO: 5469272 - DNA, 16 bp, Homo sapiens
tccatcccattcactt

SEQ ID NO: 5469273 - DNA, 23 bp, Homo sapiens
tccatccccaaactgtgccctgc

SEQ ID NO: 5469274 - DNA, 12 bp, Homo sapiens
tccatccccagt

SEQ ID NO: 5469275 - DNA, 19 bp, Homo sapiens
tccatccccctctgtctgc

SEQ ID NO: 5469276 - DNA, 21 bp, Homo sapiens
tccatcccccttcttcctccc

SEQ ID NO: 5469277 - DNA, 22 bp, Homo sapiens
tccatcccccttcttcctcccc

SEQ ID NO: 5469278 - DNA, 18 bp, Homo sapiens
tccatcccctccctgcct

SEQ ID NO: 5469279 - DNA, 18 bp, Homo sapiens
tccatccctaccccctaa

SEQ ID NO: 5469280 - DNA, 20 bp, Homo sapiens
tccatccctctcctctgccc

SEQ ID NO: 5469281 - DNA, 16 bp, Homo sapiens
tccatccctgctctgg

SEQ ID NO: 5469282 - DNA, 13 bp, Homo sapiens
tccatccctggcc

SEQ ID NO: 5469283 - DNA, 15 bp, Homo sapiens
tccatcccttcccca

SEQ ID NO: 5469284 - DNA, 17 bp, Homo sapiens
tccatcccttttcctgt

SEQ ID NO: 5469285 - DNA, 20 bp, Homo sapiens
tccatcccttttcctgtcag

SEQ ID NO: 5469286 - DNA, 20 bp, Homo sapiens
tccatcctaccccctgtgcc

SEQ ID NO: 5469287 - DNA, 15 bp, Homo sapiens
tccatcctcatctct

SEQ ID NO: 5469288 - DNA, 24 bp, Homo sapiens
tccatcctcatctctcttgggcca

SEQ ID NO: 5469289 - DNA, 16 bp, Homo sapiens
tccatcctcctccttc

SEQ ID NO: 5469290 - DNA, 13 bp, Homo sapiens
tccatcctcctct

SEQ ID NO: 5469291 - DNA, 16 bp, Homo sapiens
tccatcctcctctcca

SEQ ID NO: 5469292 - DNA, 23 bp, Homo sapiens
tccatcctcctctccatgcaagt

SEQ ID NO: 5469293 - DNA, 19 bp, Homo sapiens
tccatcctcctgtgtcact

SEQ ID NO: 5469294 - DNA, 13 bp, Homo sapiens
tccatcctgagcc

SEQ ID NO: 5469295 - DNA, 23 bp, Homo sapiens
tccatcctgaggaccgccccaac

SEQ ID NO: 5469296 - DNA, 15 bp, Homo sapiens
tccatcctgaggctc

SEQ ID NO: 5469297 - DNA, 20 bp, Homo sapiens
tccatcctgaggctccactt

SEQ ID NO: 5469298 - DNA, 19 bp, Homo sapiens
tccatcctgaggtgcctcc

SEQ ID NO: 5469299 - DNA, 22 bp, Homo sapiens
tccatcctgaggtgcctcccag

SEQ ID NO: 5469300 - DNA, 23 bp, Homo sapiens
tccatcctgaggtgcctcccagt

SEQ ID NO: 5469301 - DNA, 16 bp, Homo sapiens
tccatcctgtacaagt

SEQ ID NO: 5469302 - DNA, 14 bp, Homo sapiens
tccatcctgttttt

SEQ ID NO: 5469303 - DNA, 16 bp, Homo sapiens
tccatccttaactgtc

SEQ ID NO: 5469304 - DNA, 16 bp, Homo sapiens
tccatccttgactgaa

SEQ ID NO: 5469305 - DNA, 18 bp, Homo sapiens
tccatccttgcatcactg

SEQ ID NO: 5469306 - DNA, 15 bp, Homo sapiens
tccatcctttgcatt

SEQ ID NO: 5469307 - DNA, 16 bp, Homo sapiens
tccatcctttgcattt

SEQ ID NO: 5469308 - DNA, 17 bp, Homo sapiens
tccatctagcagctggc

SEQ ID NO: 5469309 - DNA, 18 bp, Homo sapiens
tccatctccaagaatgct

SEQ ID NO: 5469310 - DNA, 18 bp, Homo sapiens
tccatctccgcctccaca

SEQ ID NO: 5469311 - DNA, 21 bp, Homo sapiens
tccatctcctataatctgtca

SEQ ID NO: 5469312 - DNA, 16 bp, Homo sapiens
tccatctcctgctcac

SEQ ID NO: 5469313 - DNA, 14 bp, Homo sapiens
tccatctcgccacc

SEQ ID NO: 5469314 - DNA, 16 bp, Homo sapiens
tccatctctcatcctc

SEQ ID NO: 5469315 - DNA, 12 bp, Homo sapiens
tccatctctctc

SEQ ID NO: 5469316 - DNA, 16 bp, Homo sapiens
tccatctctctggccc

SEQ ID NO: 5469317 - DNA, 13 bp, Homo sapiens
tccatctctgaaa

SEQ ID NO: 5469318 - DNA, 15 bp, Homo sapiens
tccatctctgaaaac

SEQ ID NO: 5469319 - DNA, 17 bp, Homo sapiens
tccatctctgaaaacaa

SEQ ID NO: 5469320 - DNA, 15 bp, Homo sapiens
tccatctcttccttt

SEQ ID NO: 5469321 - DNA, 17 bp, Homo sapiens
tccatctcttcctttcc

SEQ ID NO: 5469322 - DNA, 14 bp, Homo sapiens
tccatctcttctgc

SEQ ID NO: 5469323 - DNA, 21 bp, Homo sapiens
tccatctcttgtaccagccca

SEQ ID NO: 5469324 - DNA, 17 bp, Homo sapiens
tccatctgattccagca

SEQ ID NO: 5469325 - DNA, 19 bp, Homo sapiens
tccatctgcatcttaacat

SEQ ID NO: 5469326 - DNA, 20 bp, Homo sapiens
tccatctgcccgcctgccca

SEQ ID NO: 5469327 - DNA, 20 bp, Homo sapiens
tccatctggggatggagaat

SEQ ID NO: 5469328 - DNA, 21 bp, Homo sapiens
tccatctggttttctctccag

SEQ ID NO: 5469329 - DNA, 14 bp, Homo sapiens
tccatctgtcactt

SEQ ID NO: 5469330 - DNA, 12 bp, Homo sapiens
tccatctgtcca

SEQ ID NO: 5469331 - DNA, 16 bp, Homo sapiens
tccatctgtccgtcca

SEQ ID NO: 5469332 - DNA, 21 bp, Homo sapiens
tccatctgtccgtccagagcc

SEQ ID NO: 5469333 - DNA, 23 bp, Homo sapiens
tccatcttattcccaattaaaag

SEQ ID NO: 5469334 - DNA, 14 bp, Homo sapiens
tccatcttcagctt

SEQ ID NO: 5469335 - DNA, 21 bp, Homo sapiens
tccatcttccctacccttcct

SEQ ID NO: 5469336 - DNA, 23 bp, Homo sapiens
tccatcttctccccacagcctct

SEQ ID NO: 5469337 - DNA, 21 bp, Homo sapiens
tccatcttgagatggtgaggc

SEQ ID NO: 5469338 - DNA, 18 bp, Homo sapiens
tccatcttgagccacagt

SEQ ID NO: 5469339 - DNA, 12 bp, Homo sapiens
tccatcttgcta

SEQ ID NO: 5469340 - DNA, 18 bp, Homo sapiens
tccatcttgctttttccc

SEQ ID NO: 5469341 - DNA, 23 bp, Homo sapiens
tccatcttggtagttctgtgcct

SEQ ID NO: 5469342 - DNA, 19 bp, Homo sapiens
tccatcttgtggggccagg

SEQ ID NO: 5469343 - DNA, 20 bp, Homo sapiens
tccatcttgtggggccagga

SEQ ID NO: 5469344 - DNA, 16 bp, Homo sapiens
tccatcttgtttcatt

SEQ ID NO: 5469345 - DNA, 22 bp, Homo sapiens
tccatcttgtttcatttgcttg

SEQ ID NO: 5469346 - DNA, 18 bp, Homo sapiens
tccatctttcctgatggc

SEQ ID NO: 5469347 - DNA, 15 bp, Homo sapiens
tccatctttctacag

SEQ ID NO: 5469348 - DNA, 15 bp, Homo sapiens
tccatctttgtatat

SEQ ID NO: 5469349 - DNA, 17 bp, Homo sapiens
tccatgaaaaacagcag

SEQ ID NO: 5469350 - DNA, 15 bp, Homo sapiens
tccatgaaaacgttt

SEQ ID NO: 5469351 - DNA, 18 bp, Homo sapiens
tccatgaaaacgttttat

SEQ ID NO: 5469352 - DNA, 16 bp, Homo sapiens
tccatgaaaataaacg

SEQ ID NO: 5469353 - DNA, 13 bp, Homo sapiens
tccatgaagatgt

SEQ ID NO: 5469354 - DNA, 22 bp, Homo sapiens
tccatgaagatgtagaggagaa

SEQ ID NO: 5469355 - DNA, 15 bp, Homo sapiens
tccatgaaggcagag

SEQ ID NO: 5469356 - DNA, 19 bp, Homo sapiens
tccatgaatcgcttctctt

SEQ ID NO: 5469357 - DNA, 19 bp, Homo sapiens
tccatgacagtagcatact

SEQ ID NO: 5469358 - DNA, 20 bp, Homo sapiens
tgtccagataagttatttat

SEQ ID NO: 5469359 - DNA, 20 bp, Homo sapiens
tgtccagatgtgcaggctcc

SEQ ID NO: 5469360 - DNA, 21 bp, Homo sapiens
tgtccagcacagaaggaatct

SEQ ID NO: 5469361 - DNA, 22 bp, Homo sapiens
tgtccagcaccttgtgcctggg

SEQ ID NO: 5469362 - DNA, 15 bp, Homo sapiens
tgtccagcagtctga

SEQ ID NO: 5469363 - DNA, 19 bp, Homo sapiens
tgtccagcattgctggact

SEQ ID NO: 5469364 - DNA, 14 bp, Homo sapiens
tgtccagccacccc

SEQ ID NO: 5469365 - DNA, 15 bp, Homo sapiens
tgtccagccagctcc

SEQ ID NO: 5469366 - DNA, 12 bp, Homo sapiens
tgtccagcctgg

SEQ ID NO: 5469367 - DNA, 23 bp, Homo sapiens
tgtccagcctgggcagccaggct

SEQ ID NO: 5469368 - DNA, 17 bp, Homo sapiens
tgtccagccttaataga

SEQ ID NO: 5469369 - DNA, 19 bp, Homo sapiens
tgtccagccttaatagact

SEQ ID NO: 5469370 - DNA, 19 bp, Homo sapiens
tgtccagctagccaactcc

SEQ ID NO: 5469371 - DNA, 11 bp, Homo sapiens
tgtccagctcc

SEQ ID NO: 5469372 - DNA, 17 bp, Homo sapiens
tgtccagctgagcgcca

SEQ ID NO: 5469373 - DNA, 23 bp, Homo sapiens
tgtccagctggggccagaggctg

SEQ ID NO: 5469374 - DNA, 21 bp, Homo sapiens
tgtccaggagccccgccaggt

SEQ ID NO: 5469375 - DNA, 21 bp, Homo sapiens
tgtccaggagctaatctgacc

SEQ ID NO: 5469376 - DNA, 12 bp, Homo sapiens
tgtccaggcagc

SEQ ID NO: 5469377 - DNA, 15 bp, Homo sapiens
tgtccaggcagctcc

SEQ ID NO: 5469378 - DNA, 17 bp, Homo sapiens
tgtccaggcagctccct

SEQ ID NO: 5469379 - DNA, 16 bp, Homo sapiens
tgtccaggcccttagg

SEQ ID NO: 5469380 - DNA, 16 bp, Homo sapiens
tgtccaggctctgggc

SEQ ID NO: 5469381 - DNA, 19 bp, Homo sapiens
tgtccaggctctgggcaca

SEQ ID NO: 5469382 - DNA, 23 bp, Homo sapiens
tgtccaggctctgggcacagtgc

SEQ ID NO: 5469383 - DNA, 23 bp, Homo sapiens
tgtccaggctggtctgaaaccct

SEQ ID NO: 5469384 - DNA, 19 bp, Homo sapiens
tgtccagggaaacagcctc

SEQ ID NO: 5469385 - DNA, 22 bp, Homo sapiens
tgtccagggaaacagcctctct

SEQ ID NO: 5469386 - DNA, 12 bp, Homo sapiens
tgtccagggccc

SEQ ID NO: 5469387 - DNA, 13 bp, Homo sapiens
tgtccagggccca

SEQ ID NO: 5469388 - DNA, 16 bp, Homo sapiens
tgtccagggcccatgt

SEQ ID NO: 5469389 - DNA, 17 bp, Homo sapiens
tgtccagggcttcagat

SEQ ID NO: 5469390 - DNA, 21 bp, Homo sapiens
tgtccagggggagaaggaaga

SEQ ID NO: 5469391 - DNA, 13 bp, Homo sapiens
tgtccagggtcct

SEQ ID NO: 5469392 - DNA, 23 bp, Homo sapiens
tgtccaggtagaaaagaaatggt

SEQ ID NO: 5469393 - DNA, 13 bp, Homo sapiens
tgtccaggtcaca

SEQ ID NO: 5469394 - DNA, 21 bp, Homo sapiens
tgtccaggtctagaaggccag

SEQ ID NO: 5469395 - DNA, 22 bp, Homo sapiens
tgtccaggtctagaaggccagg

SEQ ID NO: 5469396 - DNA, 15 bp, Homo sapiens
tgtccagtccagtga

SEQ ID NO: 5469397 - DNA, 23 bp, Homo sapiens
tgtccagtgcccattcctcacct

SEQ ID NO: 5469398 - DNA, 16 bp, Homo sapiens
tgtccagtgcctacat

SEQ ID NO: 5469399 - DNA, 20 bp, Homo sapiens
tgtccatacactttgttgca

SEQ ID NO: 5469400 - DNA, 16 bp, Homo sapiens
tgtccatattttcaca

SEQ ID NO: 5469401 - DNA, 14 bp, Homo sapiens
tgtccatcagatga

SEQ ID NO: 5469402 - DNA, 16 bp, Homo sapiens
tgtccatcagatgaca

SEQ ID NO: 5469403 - DNA, 17 bp, Homo sapiens
tgtccatcagatgacaa

SEQ ID NO: 5469404 - DNA, 15 bp, Homo sapiens
tgtccatcatattaa

SEQ ID NO: 5469405 - DNA, 22 bp, Homo sapiens
tgtccatcatattaaaaatata

SEQ ID NO: 5469406 - DNA, 11 bp, Homo sapiens
tgtccatccct

SEQ ID NO: 5469407 - DNA, 14 bp, Homo sapiens
tgtccatccctttt

SEQ ID NO: 5469408 - DNA, 18 bp, Homo sapiens
tgtccatcccttttcctg

SEQ ID NO: 5469409 - DNA, 13 bp, Homo sapiens
tgtccatctgccc

SEQ ID NO: 5469410 - DNA, 14 bp, Homo sapiens
tgtccatctgcccg

SEQ ID NO: 5469411 - DNA, 18 bp, Homo sapiens
tgtccatctgtctgtcct

SEQ ID NO: 5469412 - DNA, 21 bp, Homo sapiens
tgtccatctgtctgtcctacc

SEQ ID NO: 5469413 - DNA, 10 bp, Homo sapiens
tgtccatctt

SEQ ID NO: 5469414 - DNA, 20 bp, Homo sapiens
tgtccatgaaaaacagcaga

SEQ ID NO: 5469415 - DNA, 21 bp, Homo sapiens
tgtccatgaaaaacagcagag

SEQ ID NO: 5469416 - DNA, 18 bp, Homo sapiens
tgtccatgcctacagata

SEQ ID NO: 5469417 - DNA, 20 bp, Homo sapiens
tgtccatgcgctcagggcca

SEQ ID NO: 5469418 - DNA, 22 bp, Homo sapiens
tgtccatgcgctcagggccatg

SEQ ID NO: 5469419 - DNA, 17 bp, Homo sapiens
tgtccatgcttctcatc

SEQ ID NO: 5469420 - DNA, 19 bp, Homo sapiens
tgtccatggcagctggtct

SEQ ID NO: 5469421 - DNA, 13 bp, Homo sapiens
tgtccatgtcccc

SEQ ID NO: 5469422 - DNA, 14 bp, Homo sapiens
tgtccatgtccccc

SEQ ID NO: 5469423 - DNA, 14 bp, Homo sapiens
tgtccatgtgaaat

SEQ ID NO: 5469424 - DNA, 21 bp, Homo sapiens
tgtccatgtgcacccggcctg

SEQ ID NO: 5469425 - DNA, 11 bp, Homo sapiens
tgtccatgtgt

SEQ ID NO: 5469426 - DNA, 12 bp, Homo sapiens
tgtccatgtgtg

SEQ ID NO: 5469427 - DNA, 16 bp, Homo sapiens
tgtccattacttgcca

SEQ ID NO: 5469428 - DNA, 14 bp, Homo sapiens
tgtccattgacatg

SEQ ID NO: 5469429 - DNA, 16 bp, Homo sapiens
tgtccattgacatgta

SEQ ID NO: 5469430 - DNA, 21 bp, Homo sapiens
tgtccattgccacggccatga

SEQ ID NO: 5469431 - DNA, 19 bp, Homo sapiens
tgtccattgtaaatctgaa

SEQ ID NO: 5469432 - DNA, 12 bp, Homo sapiens
tgtccatttata

SEQ ID NO: 5469433 - DNA, 13 bp, Homo sapiens
tgtccatttgtaa

SEQ ID NO: 5469434 - DNA, 16 bp, Homo sapiens
tgtccatttgtcccaa

SEQ ID NO: 5469435 - DNA, 15 bp, Homo sapiens
tgtccattttgcaaa

SEQ ID NO: 5469436 - DNA, 16 bp, Homo sapiens
tgtccattttgtgaag

SEQ ID NO: 5469437 - DNA, 22 bp, Homo sapiens
tgtccattttgtgaagccctgt

SEQ ID NO: 5469438 - DNA, 17 bp, Homo sapiens
tgtcccaaaatcccctc

SEQ ID NO: 5469439 - DNA, 18 bp, Homo sapiens
tgtcccaaaatcccctca

SEQ ID NO: 5469440 - DNA, 19 bp, Homo sapiens
tgtcccaaaatcccctcag

SEQ ID NO: 5469441 - DNA, 20 bp, Homo sapiens
tgtcccaaaatcccctcagc

SEQ ID NO: 5469442 - DNA, 21 bp, Homo sapiens
tgtcccaaatccgccagtgtt

SEQ ID NO: 5469443 - DNA, 22 bp, Homo sapiens
tgtcccaagtcctgctcctttc

SEQ ID NO: 5469444 - DNA, 12 bp, Homo sapiens
tgtcccaagtgc

SEQ ID NO: 5469445 - DNA, 14 bp, Homo sapiens
tgtcccaagtgcca

SEQ ID NO: 5469446 - DNA, 16 bp, Homo sapiens
tgtcccaattaaaata

SEQ ID NO: 5469447 - DNA, 19 bp, Homo sapiens
tgtcccacaaaatatttct

SEQ ID NO: 5469448 - DNA, 12 bp, Homo sapiens
tgtcccacaggg

SEQ ID NO: 5469449 - DNA, 18 bp, Homo sapiens
tgtcccacagggaccaca

SEQ ID NO: 5469450 - DNA, 13 bp, Homo sapiens
tgtcccaccaact

SEQ ID NO: 5469451 - DNA, 16 bp, Homo sapiens
tgtcccaccaactctg

SEQ ID NO: 5469452 - DNA, 13 bp, Homo sapiens
tgtcccaccagct

SEQ ID NO: 5469453 - DNA, 21 bp, Homo sapiens
tgtcccacccacacagctgcc

SEQ ID NO: 5469454 - DNA, 22 bp, Homo sapiens
tgtcccacccacacagctgccc

SEQ ID NO: 5469455 - DNA, 23 bp, Homo sapiens
tgtcccacccccacccccagctc

SEQ ID NO: 5469456 - DNA, 19 bp, Homo sapiens
tgtcccacccccttccccc

SEQ ID NO: 5469457 - DNA, 19 bp, Homo sapiens
tgtcccacccctagccacc

SEQ ID NO: 5469458 - DNA, 12 bp, Homo sapiens
tgtcccacctca

SEQ ID NO: 5469459 - DNA, 14 bp, Homo sapiens
tgtcccacctggct

SEQ ID NO: 5469460 - DNA, 14 bp, Homo sapiens
tgtcccactggctc

SEQ ID NO: 5469461 - DNA, 17 bp, Homo sapiens
tgtcccactggctcctc

SEQ ID NO: 5469462 - DNA, 20 bp, Homo sapiens
tgtcccactggctcctccca

SEQ ID NO: 5469463 - DNA, 16 bp, Homo sapiens
tgtcccactgggacac

SEQ ID NO: 5469464 - DNA, 20 bp, Homo sapiens
tgtcccagaggctgccccac

SEQ ID NO: 5469465 - DNA, 24 bp, Homo sapiens
tgtcccagaggttatctgcctggc

SEQ ID NO: 5469466 - DNA, 18 bp, Homo sapiens
tgtcccagatgctgtcat

SEQ ID NO: 5469467 - DNA, 12 bp, Homo sapiens
tgtcccagccac

SEQ ID NO: 5469468 - DNA, 12 bp, Homo sapiens
tgtcccagcccc

SEQ ID NO: 5469469 - DNA, 15 bp, Homo sapiens
tgtcccagcctgggg

SEQ ID NO: 5469470 - DNA, 18 bp, Homo sapiens
tgtcccagcctggggctc

SEQ ID NO: 5469471 - DNA, 16 bp, Homo sapiens
tgtcccaggcactgta

SEQ ID NO: 5469472 - DNA, 20 bp, Homo sapiens
tgtcccaggcagcacagtgt

SEQ ID NO: 5469473 - DNA, 21 bp, Homo sapiens
tgtcccaggcagcgccactgt

SEQ ID NO: 5469474 - DNA, 23 bp, Homo sapiens
tgtcccaggcagcgccactgtcc

SEQ ID NO: 5469475 - DNA, 19 bp, Homo sapiens
tgtcccaggcatgcagctg

SEQ ID NO: 5469476 - DNA, 21 bp, Homo sapiens
tgtcccaggcatgcagctgcc

SEQ ID NO: 5469477 - DNA, 18 bp, Homo sapiens
tgtcccaggccggcccag

SEQ ID NO: 5469478 - DNA, 14 bp, Homo sapiens
tgtcccagggccct

SEQ ID NO: 5469479 - DNA, 18 bp, Homo sapiens
tgtcccagggccctccca

SEQ ID NO: 5469480 - DNA, 20 bp, Homo sapiens
tgtcccagggccctcccagc

SEQ ID NO: 5469481 - DNA, 21 bp, Homo sapiens
tgtcccagggccctcccagcc

SEQ ID NO: 5469482 - DNA, 18 bp, Homo sapiens
tgtcccagggccctggat

SEQ ID NO: 5469483 - DNA, 17 bp, Homo sapiens
tgtcccagtagccaagg

SEQ ID NO: 5469484 - DNA, 22 bp, Homo sapiens
tgtcccagtcccagcctctggg

SEQ ID NO: 5469485 - DNA, 18 bp, Homo sapiens
tgtcccagtgtctggccc

SEQ ID NO: 5469486 - DNA, 19 bp, Homo sapiens
tgtcccagtgtctggccca

SEQ ID NO: 5469487 - DNA, 18 bp, Homo sapiens
tgtcccagttgtggcaac

SEQ ID NO: 5469488 - DNA, 17 bp, Homo sapiens
tgtcccatactcccact

SEQ ID NO: 5469489 - DNA, 19 bp, Homo sapiens
tgtcccatagtccctgcca

SEQ ID NO: 5469490 - DNA, 17 bp, Homo sapiens
tgtcccatctctacccc

SEQ ID NO: 5469491 - DNA, 15 bp, Homo sapiens
tgtcccatctgccct

SEQ ID NO: 5469492 - DNA, 19 bp, Homo sapiens
tgtcccatctgctcctccc

SEQ ID NO: 5469493 - DNA, 16 bp, Homo sapiens
tgtcccatgatccctg

SEQ ID NO: 5469494 - DNA, 17 bp, Homo sapiens
tgtcccatgcaggccct

SEQ ID NO: 5469495 - DNA, 18 bp, Homo sapiens
tgtcccatggacactcca

SEQ ID NO: 5469496 - DNA, 22 bp, Homo sapiens
tgtcccatggacactccagtgc

SEQ ID NO: 5469497 - DNA, 15 bp, Homo sapiens
tgtcccatgggctct

SEQ ID NO: 5469498 - DNA, 17 bp, Homo sapiens
tgtcccatgggctctgg

SEQ ID NO: 5469499 - DNA, 15 bp, Homo sapiens
tgtcccattccctgg

SEQ ID NO: 5469500 - DNA, 14 bp, Homo sapiens
tgtcccattctaga

SEQ ID NO: 5469501 - DNA, 13 bp, Homo sapiens
tgtcccatttatt

SEQ ID NO: 5469502 - DNA, 21 bp, Homo sapiens
tgtcccatttccttggaggcc

SEQ ID NO: 5469503 - DNA, 23 bp, Homo sapiens
tgtcccatttccttggaggccac

SEQ ID NO: 5469504 - DNA, 21 bp, Homo sapiens
tgtcccattttcagactgctt

SEQ ID NO: 5469505 - DNA, 16 bp, Homo sapiens
tgtccccaaaatgtga

SEQ ID NO: 5469506 - DNA, 21 bp, Homo sapiens
tgtccccaaatccgaacctcc

SEQ ID NO: 5469507 - DNA, 18 bp, Homo sapiens
tgtccccaacgtcccctc

SEQ ID NO: 5469508 - DNA, 19 bp, Homo sapiens
tgtccccaacgtcccctcc

SEQ ID NO: 5469509 - DNA, 22 bp, Homo sapiens
tgtccccaacgtcccctccgcc

SEQ ID NO: 5469510 - DNA, 22 bp, Homo sapiens
tgtccccaagacacttcccctt

SEQ ID NO: 5469511 - DNA, 18 bp, Homo sapiens
tgtccccacacagcctct

SEQ ID NO: 5469512 - DNA, 19 bp, Homo sapiens
tgtccccacacagcctcta

SEQ ID NO: 5469513 - DNA, 16 bp, Homo sapiens
tgtccccaccccatgg

SEQ ID NO: 5469514 - DNA, 18 bp, Homo sapiens
tgtccccaccgcagacag

SEQ ID NO: 5469515 - DNA, 14 bp, Homo sapiens
tgtccccagaccct

SEQ ID NO: 5469516 - DNA, 14 bp, Homo sapiens
tgtccccagcccac

SEQ ID NO: 5469517 - DNA, 15 bp, Homo sapiens
tgtccccagcccact

SEQ ID NO: 5469518 - DNA, 15 bp, Homo sapiens
tgtccccagccctgt

SEQ ID NO: 5469519 - DNA, 21 bp, Homo sapiens
tgtccccagcctacctctcca

SEQ ID NO: 5469520 - DNA, 13 bp, Homo sapiens
tgtccccagctcc

SEQ ID NO: 5469521 - DNA, 16 bp, Homo sapiens
tgtccccaggcccagc

SEQ ID NO: 5469522 - DNA, 21 bp, Homo sapiens
tgtccccaggcccagccctcc

SEQ ID NO: 5469523 - DNA, 16 bp, Homo sapiens
tgtccccaggcctggc

SEQ ID NO: 5469524 - DNA, 14 bp, Homo sapiens
tgtccccagggccc

SEQ ID NO: 5469525 - DNA, 15 bp, Homo sapiens
tgtccccagggcccc

SEQ ID NO: 5469526 - DNA, 21 bp, Homo sapiens
tgtccccaggtcctgtctctg

SEQ ID NO: 5469527 - DNA, 19 bp, Homo sapiens
tgtccccagtccccagccc

SEQ ID NO: 5469528 - DNA, 20 bp, Homo sapiens
tgtccccagtccccagccct

SEQ ID NO: 5469529 - DNA, 21 bp, Homo sapiens
tgtccccagtccccagccctg

SEQ ID NO: 5469530 - DNA, 22 bp, Homo sapiens
tgtccccagtccccagccctgg

SEQ ID NO: 5469531 - DNA, 22 bp, Homo sapiens
tgtccccagtgtggactctgga

SEQ ID NO: 5469532 - DNA, 15 bp, Homo sapiens
tgtccccataagaca

SEQ ID NO: 5469533 - DNA, 20 bp, Homo sapiens
tgtccccataagacaaacac

SEQ ID NO: 5469534 - DNA, 21 bp, Homo sapiens
tgtccccataagacaaacact

SEQ ID NO: 5469535 - DNA, 23 bp, Homo sapiens
tgtctggtgtttgtcatggtgaa

SEQ ID NO: 5469536 - DNA, 14 bp, Homo sapiens
tgtctggttctcaa

SEQ ID NO: 5469537 - DNA, 16 bp, Homo sapiens
tgtctggtttctgtcc

SEQ ID NO: 5469538 - DNA, 16 bp, Homo sapiens
tgtctggttttaacaa

SEQ ID NO: 5469539 - DNA, 21 bp, Homo sapiens
tgtctgtaaaaaatggagctc

SEQ ID NO: 5469540 - DNA, 23 bp, Homo sapiens
tgtctgtaaaaaatggagctcag

SEQ ID NO: 5469541 - DNA, 14 bp, Homo sapiens
tgtctgtaaatcaa

SEQ ID NO: 5469542 - DNA, 18 bp, Homo sapiens
tgtctgtaagagaattct

SEQ ID NO: 5469543 - DNA, 23 bp, Homo sapiens
tgtctgtaatgggatctattttt

SEQ ID NO: 5469544 - DNA, 13 bp, Homo sapiens
tgtctgtacacgt

SEQ ID NO: 5469545 - DNA, 11 bp, Homo sapiens
tgtctgtacat

SEQ ID NO: 5469546 - DNA, 20 bp, Homo sapiens
tgtctgtacatactggcctc

SEQ ID NO: 5469547 - DNA, 21 bp, Homo sapiens
tgtctgtacatactggcctct

SEQ ID NO: 5469548 - DNA, 18 bp, Homo sapiens
tgtctgtagagaatgaaa

SEQ ID NO: 5469549 - DNA, 18 bp, Homo sapiens
tgtctgtaggtgtctctg

SEQ ID NO: 5469550 - DNA, 19 bp, Homo sapiens
tgtctgtaggtgtctctgg

SEQ ID NO: 5469551 - DNA, 20 bp, Homo sapiens
tgtctgtaggtgtctctggg

SEQ ID NO: 5469552 - DNA, 15 bp, Homo sapiens
tgtctgtatccccag

SEQ ID NO: 5469553 - DNA, 20 bp, Homo sapiens
tgtctgtatttcatgtggct

SEQ ID NO: 5469554 - DNA, 16 bp, Homo sapiens
tgtctgtcacaggctg

SEQ ID NO: 5469555 - DNA, 21 bp, Homo sapiens
tgtctgtcacaggctgggtca

SEQ ID NO: 5469556 - DNA, 11 bp, Homo sapiens
tgtctgtcacc

SEQ ID NO: 5469557 - DNA, 21 bp, Homo sapiens
tgtctgtccagccgtgtgtgc

SEQ ID NO: 5469558 - DNA, 23 bp, Homo sapiens
tgtctgtccatctgtctgtccta

SEQ ID NO: 5469559 - DNA, 21 bp, Homo sapiens
tgtctgtccctaaacatagtg

SEQ ID NO: 5469560 - DNA, 21 bp, Homo sapiens
tgtctgtcccttttctttgac

SEQ ID NO: 5469561 - DNA, 14 bp, Homo sapiens
tgtctgtcctacaa

SEQ ID NO: 5469562 - DNA, 18 bp, Homo sapiens
tgtctgtcctacccgccc

SEQ ID NO: 5469563 - DNA, 19 bp, Homo sapiens
tgtctgtcctacccgcccg

SEQ ID NO: 5469564 - DNA, 12 bp, Homo sapiens
tgtctgtcctgg

SEQ ID NO: 5469565 - DNA, 13 bp, Homo sapiens
tgtctgtcctggt

SEQ ID NO: 5469566 - DNA, 14 bp, Homo sapiens
tgtctgtcctttat

SEQ ID NO: 5469567 - DNA, 18 bp, Homo sapiens
tgtctgtcgcccttctcc

SEQ ID NO: 5469568 - DNA, 22 bp, Homo sapiens
tgtctgtcgcccttctcccggc

SEQ ID NO: 5469569 - DNA, 14 bp, Homo sapiens
tgtctgtctacatt

SEQ ID NO: 5469570 - DNA, 11 bp, Homo sapiens
tgtctgtctcc

SEQ ID NO: 5469571 - DNA, 12 bp, Homo sapiens
tgtctgtctccc

SEQ ID NO: 5469572 - DNA, 15 bp, Homo sapiens
tgtctgtctccctcc

SEQ ID NO: 5469573 - DNA, 14 bp, Homo sapiens
tgtctgtctctaat

SEQ ID NO: 5469574 - DNA, 12 bp, Homo sapiens
tgtctgtctgct

SEQ ID NO: 5469575 - DNA, 14 bp, Homo sapiens
tgtctgtctgctct

SEQ ID NO: 5469576 - DNA, 16 bp, Homo sapiens
tgtctgtctgctctta

SEQ ID NO: 5469577 - DNA, 16 bp, Homo sapiens
tgtctgtctggtccat

SEQ ID NO: 5469578 - DNA, 15 bp, Homo sapiens
tgtctgtctgtccca

SEQ ID NO: 5469579 - DNA, 15 bp, Homo sapiens
tgtctgtctgtgggc

SEQ ID NO: 5469580 - DNA, 11 bp, Homo sapiens
tgtctgtcttc

SEQ ID NO: 5469581 - DNA, 14 bp, Homo sapiens
tgtctgtcttctcc

SEQ ID NO: 5469582 - DNA, 14 bp, Homo sapiens
tgtctgtgaacaga

SEQ ID NO: 5469583 - DNA, 19 bp, Homo sapiens
tgtctgtgaacagagagac

SEQ ID NO: 5469584 - DNA, 21 bp, Homo sapiens
tgtctgtgaacataggtgtgc

SEQ ID NO: 5469585 - DNA, 19 bp, Homo sapiens
tgtctgtgaagtgagacct

SEQ ID NO: 5469586 - DNA, 20 bp, Homo sapiens
tgtctgtgacttttgtgaaa

SEQ ID NO: 5469587 - DNA, 16 bp, Homo sapiens
tgtctgtgatctctgc

SEQ ID NO: 5469588 - DNA, 12 bp, Homo sapiens
tgtctgtgcaca

SEQ ID NO: 5469589 - DNA, 24 bp, Homo sapiens
tgtctgtgcacatgcctctgtaga

SEQ ID NO: 5469590 - DNA, 21 bp, Homo sapiens
tgtctgtgcagatgctttgcc

SEQ ID NO: 5469591 - DNA, 18 bp, Homo sapiens
tgtctgtgccatggcccc

SEQ ID NO: 5469592 - DNA, 18 bp, Homo sapiens
tgtctgtgccatttctca

SEQ ID NO: 5469593 - DNA, 22 bp, Homo sapiens
tgtctgtgccatttctcaggga

SEQ ID NO: 5469594 - DNA, 14 bp, Homo sapiens
tgtctgtgggcttc

SEQ ID NO: 5469595 - DNA, 12 bp, Homo sapiens
tgtctgtgtata

SEQ ID NO: 5469596 - DNA, 13 bp, Homo sapiens
tgtctgtgtatac

SEQ ID NO: 5469597 - DNA, 16 bp, Homo sapiens
tgtctgtgtatacata

SEQ ID NO: 5469598 - DNA, 15 bp, Homo sapiens
tgtctgtgtcagcct

SEQ ID NO: 5469599 - DNA, 12 bp, Homo sapiens
tgtctgtgtcct

SEQ ID NO: 5469600 - DNA, 21 bp, Homo sapiens
tgtctgtgtgcaagtgtgtgc

SEQ ID NO: 5469601 - DNA, 17 bp, Homo sapiens
tgtctgtgtgctactaa

SEQ ID NO: 5469602 - DNA, 14 bp, Homo sapiens
tgtctgtgtgctgt

SEQ ID NO: 5469603 - DNA, 15 bp, Homo sapiens
tgtctgtgtgctgta

SEQ ID NO: 5469604 - DNA, 16 bp, Homo sapiens
tgtctgtgtgctgtaa

SEQ ID NO: 5469605 - DNA, 21 bp, Homo sapiens
tgtctgtgtgtgtgtgtgcat

SEQ ID NO: 5469606 - DNA, 16 bp, Homo sapiens
tgtctgtgttgctgtt

SEQ ID NO: 5469607 - DNA, 17 bp, Homo sapiens
tgtctgtgttgctgttt

SEQ ID NO: 5469608 - DNA, 14 bp, Homo sapiens
tgtctgtgtttaat

SEQ ID NO: 5469609 - DNA, 11 bp, Homo sapiens
tgtctgttaca

SEQ ID NO: 5469610 - DNA, 19 bp, Homo sapiens
tgtctgttcagtttcccca

SEQ ID NO: 5469611 - DNA, 16 bp, Homo sapiens
tgtctgttcccagccc

SEQ ID NO: 5469612 - DNA, 17 bp, Homo sapiens
tgtctgttcccagcccc

SEQ ID NO: 5469613 - DNA, 19 bp, Homo sapiens
tgtctgttcccagcccctg

SEQ ID NO: 5469614 - DNA, 19 bp, Homo sapiens
tgtctgttcttcatttcta

SEQ ID NO: 5469615 - DNA, 22 bp, Homo sapiens
tgtctgttcttcatttctatag

SEQ ID NO: 5469616 - DNA, 15 bp, Homo sapiens
tgtctgttgaacagc

SEQ ID NO: 5469617 - DNA, 13 bp, Homo sapiens
tgtctgttgcttg

SEQ ID NO: 5469618 - DNA, 18 bp, Homo sapiens
tgtctgttggcaaatttg

SEQ ID NO: 5469619 - DNA, 22 bp, Homo sapiens
tgtctgtttcaatgacctgtat

SEQ ID NO: 5469620 - DNA, 13 bp, Homo sapiens
tgtctgtttgttt

SEQ ID NO: 5469621 - DNA, 15 bp, Homo sapiens
tgtctgtttgtttca

SEQ ID NO: 5469622 - DNA, 16 bp, Homo sapiens
tgtctgtttgtttcaa

SEQ ID NO: 5469623 - DNA, 22 bp, Homo sapiens
tgtctgtttgtttcaagaacct

SEQ ID NO: 5469624 - DNA, 19 bp, Homo sapiens
tgtctgttttccaaagata

SEQ ID NO: 5469625 - DNA, 19 bp, Homo sapiens
tgtctgtttttgtatcttt

SEQ ID NO: 5469626 - DNA, 17 bp, Homo sapiens
tgtcttaaaaatttata

SEQ ID NO: 5469627 - DNA, 18 bp, Homo sapiens
tgtcttaaaaatttatac

SEQ ID NO: 5469628 - DNA, 21 bp, Homo sapiens
tgtcttaaaacctgcttttca

SEQ ID NO: 5469629 - DNA, 22 bp, Homo sapiens
tgtcttaaaggggcctgcgcag

SEQ ID NO: 5469630 - DNA, 19 bp, Homo sapiens
tgtcttaaataaaagaaat

SEQ ID NO: 5469631 - DNA, 18 bp, Homo sapiens
tgtcttaaatgctcataa

SEQ ID NO: 5469632 - DNA, 19 bp, Homo sapiens
tgtcttaaatgctcataaa

SEQ ID NO: 5469633 - DNA, 14 bp, Homo sapiens
tgtcttaagaaaaa

SEQ ID NO: 5469634 - DNA, 22 bp, Homo sapiens
tgtcttaagatggaaatacagt

SEQ ID NO: 5469635 - DNA, 15 bp, Homo sapiens
tgtcttaagtgtttc

SEQ ID NO: 5469636 - DNA, 17 bp, Homo sapiens
tgtcttaatactgtcct

SEQ ID NO: 5469637 - DNA, 16 bp, Homo sapiens
tgtcttaatggatgaa

SEQ ID NO: 5469638 - DNA, 19 bp, Homo sapiens
tgtcttaatggatgaaatc

SEQ ID NO: 5469639 - DNA, 14 bp, Homo sapiens
tgtcttaattaagt

SEQ ID NO: 5469640 - DNA, 21 bp, Homo sapiens
tgtcttaattaagtaaactaa

SEQ ID NO: 5469641 - DNA, 22 bp, Homo sapiens
tgtcttaattaagtaaactaat

SEQ ID NO: 5469642 - DNA, 18 bp, Homo sapiens
tgtcttaattttctttca

SEQ ID NO: 5469643 - DNA, 23 bp, Homo sapiens
tgtcttacaactgactgacttag

SEQ ID NO: 5469644 - DNA, 15 bp, Homo sapiens
tgtcttagctctgga

SEQ ID NO: 5469645 - DNA, 14 bp, Homo sapiens
tgtcttaggctgat

SEQ ID NO: 5469646 - DNA, 18 bp, Homo sapiens
tgtcttaggctgatgcca

SEQ ID NO: 5469647 - DNA, 18 bp, Homo sapiens
tgtcttagtcataccatc

SEQ ID NO: 5469648 - DNA, 13 bp, Homo sapiens
tgtcttatatata

SEQ ID NO: 5469649 - DNA, 21 bp, Homo sapiens
tgtcttatcccccccagcctg

SEQ ID NO: 5469650 - DNA, 23 bp, Homo sapiens
tgtcttatcccccccagcctggc

SEQ ID NO: 5469651 - DNA, 19 bp, Homo sapiens
tgtcttatggattcattta

SEQ ID NO: 5469652 - DNA, 15 bp, Homo sapiens
tgtcttatggtccag

SEQ ID NO: 5469653 - DNA, 17 bp, Homo sapiens
tgtcttattaagactgg

SEQ ID NO: 5469654 - DNA, 12 bp, Homo sapiens
tgtcttattcct

SEQ ID NO: 5469655 - DNA, 19 bp, Homo sapiens
tgtcttattcctaattcct

SEQ ID NO: 5469656 - DNA, 12 bp, Homo sapiens
tgtcttattctt

SEQ ID NO: 5469657 - DNA, 14 bp, Homo sapiens
tgtcttattcttaa

SEQ ID NO: 5469658 - DNA, 14 bp, Homo sapiens
tgtcttattgaaaa

SEQ ID NO: 5469659 - DNA, 15 bp, Homo sapiens
tgtcttattgaaaaa

SEQ ID NO: 5469660 - DNA, 12 bp, Homo sapiens
tgtcttattgca

SEQ ID NO: 5469661 - DNA, 13 bp, Homo sapiens
tgtcttatttgtt

SEQ ID NO: 5469662 - DNA, 23 bp, Homo sapiens
tgtcttatttttagatggttaca

SEQ ID NO: 5469663 - DNA, 20 bp, Homo sapiens
tgtcttcaaccctgccctgc

SEQ ID NO: 5469664 - DNA, 13 bp, Homo sapiens
tgtcttcaaggct

SEQ ID NO: 5469665 - DNA, 20 bp, Homo sapiens
tgtcttcaaggcttcagtct

SEQ ID NO: 5469666 - DNA, 14 bp, Homo sapiens
tgtcttcacaacct

SEQ ID NO: 5469667 - DNA, 14 bp, Homo sapiens
tgtcttcacatgta

SEQ ID NO: 5469668 - DNA, 14 bp, Homo sapiens
tgtcttcacctgcc

SEQ ID NO: 5469669 - DNA, 22 bp, Homo sapiens
tgtcttcagaggctcatctaac

SEQ ID NO: 5469670 - DNA, 19 bp, Homo sapiens
tgtcttcagatcctgctgc

SEQ ID NO: 5469671 - DNA, 23 bp, Homo sapiens
tgtcttcagcagtcaatacaaat

SEQ ID NO: 5469672 - DNA, 22 bp, Homo sapiens
tgtcttcagcctctccaggcac

SEQ ID NO: 5469673 - DNA, 19 bp, Homo sapiens
tgtcttcaggagaatgtgc

SEQ ID NO: 5469674 - DNA, 20 bp, Homo sapiens
tgtcttcaggctctgcccag

SEQ ID NO: 5469675 - DNA, 21 bp, Homo sapiens
tgtcttcatcacttcttccac

SEQ ID NO: 5469676 - DNA, 16 bp, Homo sapiens
tgtcttcatttcattg

SEQ ID NO: 5469677 - DNA, 23 bp, Homo sapiens
tgtcttcatttcattgtatgatg

SEQ ID NO: 5469678 - DNA, 20 bp, Homo sapiens
tgtcttcattttcattacca

SEQ ID NO: 5469679 - DNA, 14 bp, Homo sapiens
tgtcttccaacccc

SEQ ID NO: 5469680 - DNA, 19 bp, Homo sapiens
tgtcttccaaccccagctg

SEQ ID NO: 5469681 - DNA, 22 bp, Homo sapiens
tgtcttccaaccccagctggcc

SEQ ID NO: 5469682 - DNA, 23 bp, Homo sapiens
tgtcttccaaccccagctggcct

SEQ ID NO: 5469683 - DNA, 13 bp, Homo sapiens
tgtcttccaagga

SEQ ID NO: 5469684 - DNA, 16 bp, Homo sapiens
tgtcttccaaggagac

SEQ ID NO: 5469685 - DNA, 24 bp, Homo sapiens
tgtcttccaaggagaccaagtcct

SEQ ID NO: 5469686 - DNA, 15 bp, Homo sapiens
tgtcttccactttgc

SEQ ID NO: 5469687 - DNA, 16 bp, Homo sapiens
tgtcttccaggcccag

SEQ ID NO: 5469688 - DNA, 18 bp, Homo sapiens
tgtcttccaggtccaaac

SEQ ID NO: 5469689 - DNA, 20 bp, Homo sapiens
tgtcttccaggtccaaaccc

SEQ ID NO: 5469690 - DNA, 21 bp, Homo sapiens
tgtcttcccagggtagcccgc

SEQ ID NO: 5469691 - DNA, 16 bp, Homo sapiens
tgtcttcccccctctc

SEQ ID NO: 5469692 - DNA, 17 bp, Homo sapiens
tgtcttcccccctctcc

SEQ ID NO: 5469693 - DNA, 21 bp, Homo sapiens
tgtcttcccccctctcctccc

SEQ ID NO: 5469694 - DNA, 15 bp, Homo sapiens
tgtcttccctgcctg

SEQ ID NO: 5469695 - DNA, 15 bp, Homo sapiens
tgtcttccctgggct

SEQ ID NO: 5469696 - DNA, 20 bp, Homo sapiens
tgtcttccgatcaacattta

SEQ ID NO: 5469697 - DNA, 16 bp, Homo sapiens
tgtcttcctatttcag

SEQ ID NO: 5469698 - DNA, 17 bp, Homo sapiens
tgtcttcctatttcaga

SEQ ID NO: 5469699 - DNA, 19 bp, Homo sapiens
tgtcttcctatttcagaag

SEQ ID NO: 5469700 - DNA, 10 bp, Homo sapiens
tgtcttcctc

SEQ ID NO: 5469701 - DNA, 11 bp, Homo sapiens
tgtcttcctct

SEQ ID NO: 5469702 - DNA, 23 bp, Homo sapiens
tgtcttcctctgcaagtgctcag

SEQ ID NO: 5469703 - DNA, 14 bp, Homo sapiens
tgtcttcctggtca

SEQ ID NO: 5469704 - DNA, 13 bp, Homo sapiens
tgtcttccttttc

SEQ ID NO: 5469705 - DNA, 14 bp, Homo sapiens
tgtcttcgctggct

SEQ ID NO: 5469706 - DNA, 16 bp, Homo sapiens
tgtcttcggaaacctt

SEQ ID NO: 5469707 - DNA, 20 bp, Homo sapiens
tgtcttcggaaaccttggtg

SEQ ID NO: 5469708 - DNA, 19 bp, Homo sapiens
tgtcttcggccgagctggt

SEQ ID NO: 5469709 - DNA, 16 bp, Homo sapiens
tgtcttctagtttaga

SEQ ID NO: 5469710 - DNA, 21 bp, Homo sapiens
tgtcttctcaggctctgccct

SEQ ID NO: 5469711 - DNA, 17 bp, Homo sapiens
tgtcttctcccagagca

SEQ ID NO: 5469712 - DNA, 15 bp, Homo sapiens
tgtcttctccctcct

SEQ ID NO: 5469713 - DNA, 18 bp, Homo sapiens
atgtttgatgtccccaaa

SEQ ID NO: 5469714 - DNA, 15 bp, Homo sapiens
atgtttgcatataag

SEQ ID NO: 5469715 - DNA, 23 bp, Homo sapiens
atgtttgccctgttcaaagtact

SEQ ID NO: 5469716 - DNA, 17 bp, Homo sapiens
atgtttgcctctgcctc

SEQ ID NO: 5469717 - DNA, 19 bp, Homo sapiens
atgtttgcctctgcctctg

SEQ ID NO: 5469718 - DNA, 22 bp, Homo sapiens
atgtttgcctctgcctctgaca

SEQ ID NO: 5469719 - DNA, 16 bp, Homo sapiens
atgtttgctattgaca

SEQ ID NO: 5469720 - DNA, 19 bp, Homo sapiens
atgtttgctcagaacacat

SEQ ID NO: 5469721 - DNA, 22 bp, Homo sapiens
atgtttgctgattatttatgac

SEQ ID NO: 5469722 - DNA, 15 bp, Homo sapiens
atgtttgctgttcca

SEQ ID NO: 5469723 - DNA, 18 bp, Homo sapiens
atgtttgcttcataaatg

SEQ ID NO: 5469724 - DNA, 20 bp, Homo sapiens
atgtttgcttcataaatgaa

SEQ ID NO: 5469725 - DNA, 17 bp, Homo sapiens
atgtttgcttttcactg

SEQ ID NO: 5469726 - DNA, 15 bp, Homo sapiens
atgtttggctctgct

SEQ ID NO: 5469727 - DNA, 19 bp, Homo sapiens
atgtttggctgaaattatg

SEQ ID NO: 5469728 - DNA, 20 bp, Homo sapiens
atgtttgggatattaaaaca

SEQ ID NO: 5469729 - DNA, 19 bp, Homo sapiens
atgtttggggatcgatgtg

SEQ ID NO: 5469730 - DNA, 12 bp, Homo sapiens
atgtttggggtc

SEQ ID NO: 5469731 - DNA, 23 bp, Homo sapiens
atgtttgggtgggttaagtgggc

SEQ ID NO: 5469732 - DNA, 13 bp, Homo sapiens
atgtttggtaaga

SEQ ID NO: 5469733 - DNA, 18 bp, Homo sapiens
atgtttggtgaactatat

SEQ ID NO: 5469734 - DNA, 20 bp, Homo sapiens
atgtttggtgcatagaactg

SEQ ID NO: 5469735 - DNA, 14 bp, Homo sapiens
atgtttgtaaaact

SEQ ID NO: 5469736 - DNA, 19 bp, Homo sapiens
atgtttgtaaattaatact

SEQ ID NO: 5469737 - DNA, 18 bp, Homo sapiens
atgtttgtacacaacacc

SEQ ID NO: 5469738 - DNA, 22 bp, Homo sapiens
atgtttgtacacaacacctaaa

SEQ ID NO: 5469739 - DNA, 13 bp, Homo sapiens
atgtttgtatcat

SEQ ID NO: 5469740 - DNA, 21 bp, Homo sapiens
atgtttgtctgtgtgctgtaa

SEQ ID NO: 5469741 - DNA, 24 bp, Homo sapiens
atgtttgtgagaagcttctaatta

SEQ ID NO: 5469742 - DNA, 19 bp, Homo sapiens
atgtttgtgatattaaatt

SEQ ID NO: 5469743 - DNA, 21 bp, Homo sapiens
atgtttgtgctgcagacaaaa

SEQ ID NO: 5469744 - DNA, 10 bp, Homo sapiens
atgtttgtgg

SEQ ID NO: 5469745 - DNA, 19 bp, Homo sapiens
atgtttgtggaatggattt

SEQ ID NO: 5469746 - DNA, 14 bp, Homo sapiens
atgtttgtggcctc

SEQ ID NO: 5469747 - DNA, 17 bp, Homo sapiens
atgtttgtggcctcaga

SEQ ID NO: 5469748 - DNA, 20 bp, Homo sapiens
atgtttgtggttttgggaaa

SEQ ID NO: 5469749 - DNA, 14 bp, Homo sapiens
atgtttgtgtctgt

SEQ ID NO: 5469750 - DNA, 22 bp, Homo sapiens
atgtttgttatttacactggtc

SEQ ID NO: 5469751 - DNA, 23 bp, Homo sapiens
atgtttgttggttgattgtttaa

SEQ ID NO: 5469752 - DNA, 13 bp, Homo sapiens
atgtttgtttcag

SEQ ID NO: 5469753 - DNA, 13 bp, Homo sapiens
atgtttgttttca

SEQ ID NO: 5469754 - DNA, 16 bp, Homo sapiens
atgttttaaaagtttg

SEQ ID NO: 5469755 - DNA, 18 bp, Homo sapiens
atgttttaaaattatata

SEQ ID NO: 5469756 - DNA, 19 bp, Homo sapiens
atgttttaaaattatatag

SEQ ID NO: 5469757 - DNA, 18 bp, Homo sapiens
atgttttaaatgtacaga

SEQ ID NO: 5469758 - DNA, 15 bp, Homo sapiens
atgttttaacaaaaa

SEQ ID NO: 5469759 - DNA, 16 bp, Homo sapiens
atgttttaagaggcag

SEQ ID NO: 5469760 - DNA, 18 bp, Homo sapiens
atgttttaagaggcaggg

SEQ ID NO: 5469761 - DNA, 19 bp, Homo sapiens
atgttttaattccatgaat

SEQ ID NO: 5469762 - DNA, 16 bp, Homo sapiens
atgttttacactgtac

SEQ ID NO: 5469763 - DNA, 20 bp, Homo sapiens
atgttttaccgtaataatta

SEQ ID NO: 5469764 - DNA, 17 bp, Homo sapiens
atgttttacgcaaggaa

SEQ ID NO: 5469765 - DNA, 21 bp, Homo sapiens
atgttttacgcaaggaaggac

SEQ ID NO: 5469766 - DNA, 23 bp, Homo sapiens
atgttttacgcaaggaaggactt

SEQ ID NO: 5469767 - DNA, 16 bp, Homo sapiens
atgttttacgtgcaaa

SEQ ID NO: 5469768 - DNA, 18 bp, Homo sapiens
atgttttagagataaata

SEQ ID NO: 5469769 - DNA, 17 bp, Homo sapiens
atgttttagcacagcgt

SEQ ID NO: 5469770 - DNA, 18 bp, Homo sapiens
atgttttagcatttgtat

SEQ ID NO: 5469771 - DNA, 22 bp, Homo sapiens
atgttttagtaaaaaagagaat

SEQ ID NO: 5469772 - DNA, 20 bp, Homo sapiens
atgttttagtttaaaaatca

SEQ ID NO: 5469773 - DNA, 18 bp, Homo sapiens
atgttttatactgctcta

SEQ ID NO: 5469774 - DNA, 22 bp, Homo sapiens
atgttttatcgtccagtgactt

SEQ ID NO: 5469775 - DNA, 15 bp, Homo sapiens
atgttttatgacatt

SEQ ID NO: 5469776 - DNA, 18 bp, Homo sapiens
atgttttattatttctat

SEQ ID NO: 5469777 - DNA, 21 bp, Homo sapiens
atgttttattggggaattaaa

SEQ ID NO: 5469778 - DNA, 20 bp, Homo sapiens
atgttttatttaaatgcttt

SEQ ID NO: 5469779 - DNA, 23 bp, Homo sapiens
atgttttatttatcaaaatgtag

SEQ ID NO: 5469780 - DNA, 13 bp, Homo sapiens
atgttttcaaatg

SEQ ID NO: 5469781 - DNA, 15 bp, Homo sapiens
atgttttcaaatgga

SEQ ID NO: 5469782 - DNA, 13 bp, Homo sapiens
atgttttcacagt

SEQ ID NO: 5469783 - DNA, 15 bp, Homo sapiens
atgttttcaggctag

SEQ ID NO: 5469784 - DNA, 12 bp, Homo sapiens
atgttttcatta

SEQ ID NO: 5469785 - DNA, 12 bp, Homo sapiens
atgttttcattt

SEQ ID NO: 5469786 - DNA, 15 bp, Homo sapiens
atgttttccacataa

SEQ ID NO: 5469787 - DNA, 16 bp, Homo sapiens
atgttttccagctcct

SEQ ID NO: 5469788 - DNA, 14 bp, Homo sapiens
atgttttccatgag

SEQ ID NO: 5469789 - DNA, 20 bp, Homo sapiens
atgttttccatttgggcaca

SEQ ID NO: 5469790 - DNA, 21 bp, Homo sapiens
atgttttccccaattatcctc

SEQ ID NO: 5469791 - DNA, 23 bp, Homo sapiens
atgttttcctttgtcatcattgt

SEQ ID NO: 5469792 - DNA, 15 bp, Homo sapiens
atgttttctgcttta

SEQ ID NO: 5469793 - DNA, 16 bp, Homo sapiens
atgttttctttgcaaa

SEQ ID NO: 5469794 - DNA, 17 bp, Homo sapiens
atgttttctttgcaaag

SEQ ID NO: 5469795 - DNA, 21 bp, Homo sapiens
atgttttctttgcaaagtatt

SEQ ID NO: 5469796 - DNA, 18 bp, Homo sapiens
atgttttctttgtttcct

SEQ ID NO: 5469797 - DNA, 15 bp, Homo sapiens
atgttttgaatgtgg

SEQ ID NO: 5469798 - DNA, 16 bp, Homo sapiens
atgttttgaatgtgga

SEQ ID NO: 5469799 - DNA, 17 bp, Homo sapiens
atgttttgaatgtggat

SEQ ID NO: 5469800 - DNA, 12 bp, Homo sapiens
atgttttgagaa

SEQ ID NO: 5469801 - DNA, 14 bp, Homo sapiens
atgttttgagaaaa

SEQ ID NO: 5469802 - DNA, 21 bp, Homo sapiens
atgttttgagacataaatgtt

SEQ ID NO: 5469803 - DNA, 12 bp, Homo sapiens
atgttttgataa

SEQ ID NO: 5469804 - DNA, 22 bp, Homo sapiens
atgttttgatatttatttcctg

SEQ ID NO: 5469805 - DNA, 14 bp, Homo sapiens
atgttttgcaaagg

SEQ ID NO: 5469806 - DNA, 23 bp, Homo sapiens
atgttttgcatgtaaaagcctag

SEQ ID NO: 5469807 - DNA, 22 bp, Homo sapiens
atgttttggagagagcaatctt

SEQ ID NO: 5469808 - DNA, 21 bp, Homo sapiens
atgttttgggatcaggagccc

SEQ ID NO: 5469809 - DNA, 20 bp, Homo sapiens
atgttttggtatctgttctt

SEQ ID NO: 5469810 - DNA, 17 bp, Homo sapiens
atgttttggtccacttt

SEQ ID NO: 5469811 - DNA, 13 bp, Homo sapiens
atgttttgtaaga

SEQ ID NO: 5469812 - DNA, 16 bp, Homo sapiens
atgttttgtataaaat

SEQ ID NO: 5469813 - DNA, 14 bp, Homo sapiens
atgttttgtataca

SEQ ID NO: 5469814 - DNA, 22 bp, Homo sapiens
atgttttgtatacaaatatatt

SEQ ID NO: 5469815 - DNA, 17 bp, Homo sapiens
atgttttgtatatacag

SEQ ID NO: 5469816 - DNA, 17 bp, Homo sapiens
atgttttgtgactatat

SEQ ID NO: 5469817 - DNA, 15 bp, Homo sapiens
atgttttgtgcattt

SEQ ID NO: 5469818 - DNA, 22 bp, Homo sapiens
atgttttgtgcatttgtaaatg

SEQ ID NO: 5469819 - DNA, 14 bp, Homo sapiens
atgttttgtttctg

SEQ ID NO: 5469820 - DNA, 19 bp, Homo sapiens
atgttttgtttctgaaaat

SEQ ID NO: 5469821 - DNA, 23 bp, Homo sapiens
atgtttttaaaaacctattttga

SEQ ID NO: 5469822 - DNA, 20 bp, Homo sapiens
atgtttttaaaagtttcaat

SEQ ID NO: 5469823 - DNA, 22 bp, Homo sapiens
atgtttttaaaagtttcaatgt

SEQ ID NO: 5469824 - DNA, 23 bp, Homo sapiens
atgtttttaaaagtttcaatgtg

SEQ ID NO: 5469825 - DNA, 13 bp, Homo sapiens
atgtttttaaaat

SEQ ID NO: 5469826 - DNA, 23 bp, Homo sapiens
atgtttttaaaatcttattaaag

SEQ ID NO: 5469827 - DNA, 17 bp, Homo sapiens
atgtttttaaagtgtac

SEQ ID NO: 5469828 - DNA, 15 bp, Homo sapiens
atgtttttaactttt

SEQ ID NO: 5469829 - DNA, 18 bp, Homo sapiens
atgtttttaagtgctatg

SEQ ID NO: 5469830 - DNA, 16 bp, Homo sapiens
atgtttttaataaaag

SEQ ID NO: 5469831 - DNA, 19 bp, Homo sapiens
atgtttttaataaaagaaa

SEQ ID NO: 5469832 - DNA, 21 bp, Homo sapiens
atgtttttacattatgcaaat

SEQ ID NO: 5469833 - DNA, 23 bp, Homo sapiens
atgtttttactgaatgatctatt

SEQ ID NO: 5469834 - DNA, 23 bp, Homo sapiens
atgtttttagttctgactttgaa

SEQ ID NO: 5469835 - DNA, 18 bp, Homo sapiens
atgtttttatacaaaata

SEQ ID NO: 5469836 - DNA, 15 bp, Homo sapiens
atgtttttatttcaa

SEQ ID NO: 5469837 - DNA, 16 bp, Homo sapiens
atgtttttatttcaat

SEQ ID NO: 5469838 - DNA, 14 bp, Homo sapiens
atgtttttatttcc

SEQ ID NO: 5469839 - DNA, 13 bp, Homo sapiens
atgtttttcagtt

SEQ ID NO: 5469840 - DNA, 16 bp, Homo sapiens
atgtttttcagttcaa

SEQ ID NO: 5469841 - DNA, 19 bp, Homo sapiens
atgtttttcatccattcct

SEQ ID NO: 5469842 - DNA, 15 bp, Homo sapiens
atgtttttcatgaaa

SEQ ID NO: 5469843 - DNA, 15 bp, Homo sapiens
atgtttttccctccc

SEQ ID NO: 5469844 - DNA, 20 bp, Homo sapiens
atgtttttccctccccagaa

SEQ ID NO: 5469845 - DNA, 17 bp, Homo sapiens
atgtttttcctttctta

SEQ ID NO: 5469846 - DNA, 14 bp, Homo sapiens
atgtttttctcaaa

SEQ ID NO: 5469847 - DNA, 18 bp, Homo sapiens
atgtttttgaaaagctaa

SEQ ID NO: 5469848 - DNA, 19 bp, Homo sapiens
atgtttttgaaggcagaaa

SEQ ID NO: 5469849 - DNA, 22 bp, Homo sapiens
atgtttttgatcaaaaactatt

SEQ ID NO: 5469850 - DNA, 13 bp, Homo sapiens
atgtttttgtgta

SEQ ID NO: 5469851 - DNA, 17 bp, Homo sapiens
atgtttttgtgtatttg

SEQ ID NO: 5469852 - DNA, 13 bp, Homo sapiens
atgttttttagaa

SEQ ID NO: 5469853 - DNA, 22 bp, Homo sapiens
atgttttttatacttcaaatgt

SEQ ID NO: 5469854 - DNA, 16 bp, Homo sapiens
atgttttttctgtaat

SEQ ID NO: 5469855 - DNA, 20 bp, Homo sapiens
atgttttttctgtaatgtaa

SEQ ID NO: 5469856 - DNA, 21 bp, Homo sapiens
atgttttttctgtaatgtaaa

SEQ ID NO: 5469857 - DNA, 20 bp, Homo sapiens
atgttttttcttcaaatgtt

SEQ ID NO: 5469858 - DNA, 19 bp, Homo sapiens
atgttttttgaagttctgg

SEQ ID NO: 5469859 - DNA, 18 bp, Homo sapiens
atgttttttggaaattca

SEQ ID NO: 5469860 - DNA, 16 bp, Homo sapiens
atgtttttttaattaa

SEQ ID NO: 5469861 - DNA, 23 bp, Homo sapiens
atgtttttttccaatgcttctta

SEQ ID NO: 5469862 - DNA, 15 bp, Homo sapiens
attaaaaaaaacaaa

SEQ ID NO: 5469863 - DNA, 18 bp, Homo sapiens
attaaaaaaacacaaaaa

SEQ ID NO: 5469864 - DNA, 14 bp, Homo sapiens
attaaaaaaatttt

SEQ ID NO: 5469865 - DNA, 24 bp, Homo sapiens
attaaaaaaattttaagtatctag

SEQ ID NO: 5469866 - DNA, 13 bp, Homo sapiens
attaaaaaacaat

SEQ ID NO: 5469867 - DNA, 20 bp, Homo sapiens
attaaaaaacaattaactgc

SEQ ID NO: 5469868 - DNA, 13 bp, Homo sapiens
attaaaaaagaaa

SEQ ID NO: 5469869 - DNA, 18 bp, Homo sapiens
attaaaaaagataaacac

SEQ ID NO: 5469870 - DNA, 12 bp, Homo sapiens
attaaaaaattt

SEQ ID NO: 5469871 - DNA, 15 bp, Homo sapiens
attaaaaaatttgta

SEQ ID NO: 5469872 - DNA, 15 bp, Homo sapiens
attaaaaacacctaa

SEQ ID NO: 5469873 - DNA, 14 bp, Homo sapiens
attaaaaacagaaa

SEQ ID NO: 5469874 - DNA, 15 bp, Homo sapiens
attaaaaacagaaaa

SEQ ID NO: 5469875 - DNA, 16 bp, Homo sapiens
attaaaaacagaaaat

SEQ ID NO: 5469876 - DNA, 17 bp, Homo sapiens
attaaaaacatagaaaa

SEQ ID NO: 5469877 - DNA, 14 bp, Homo sapiens
attaaaaacatgaa

SEQ ID NO: 5469878 - DNA, 13 bp, Homo sapiens
attaaaaacattt

SEQ ID NO: 5469879 - DNA, 18 bp, Homo sapiens
attaaaaacgaaaacctg

SEQ ID NO: 5469880 - DNA, 21 bp, Homo sapiens
attaaaaacgaaaacctgact

SEQ ID NO: 5469881 - DNA, 17 bp, Homo sapiens
attaaaaactagtagtt

SEQ ID NO: 5469882 - DNA, 13 bp, Homo sapiens
attaaaaacttta

SEQ ID NO: 5469883 - DNA, 14 bp, Homo sapiens
attaaaaactttaa

SEQ ID NO: 5469884 - DNA, 14 bp, Homo sapiens
attaaaaagaagat

SEQ ID NO: 5469885 - DNA, 16 bp, Homo sapiens
attaaaaagaatagaa

SEQ ID NO: 5469886 - DNA, 15 bp, Homo sapiens
attaaaaagacactt

SEQ ID NO: 5469887 - DNA, 19 bp, Homo sapiens
attaaaaagattctttttc

SEQ ID NO: 5469888 - DNA, 13 bp, Homo sapiens
attaaaaagcctt

SEQ ID NO: 5469889 - DNA, 14 bp, Homo sapiens
attaaaaagcctta

SEQ ID NO: 5469890 - DNA, 22 bp, Homo sapiens
attaacctgccagggagacaga

SEQ ID NO: 5469891 - DNA, 14 bp, Homo sapiens
attaacctggtgct

SEQ ID NO: 5469892 - DNA, 17 bp, Homo sapiens
attaacctggtgctgga

SEQ ID NO: 5469893 - DNA, 17 bp, Homo sapiens
attaaccttactaatta

SEQ ID NO: 5469894 - DNA, 16 bp, Homo sapiens
attaacctttcaggaa

SEQ ID NO: 5469895 - DNA, 21 bp, Homo sapiens
attaacgctaaaggtgtaaga

SEQ ID NO: 5469896 - DNA, 14 bp, Homo sapiens
attaactaaagaag

SEQ ID NO: 5469897 - DNA, 13 bp, Homo sapiens
attaactaaatgc

SEQ ID NO: 5469898 - DNA, 14 bp, Homo sapiens
attaactaaatgct

SEQ ID NO: 5469899 - DNA, 20 bp, Homo sapiens
attaactactgaataatgct

SEQ ID NO: 5469900 - DNA, 21 bp, Homo sapiens
attaactactgaataatgcta

SEQ ID NO: 5469901 - DNA, 21 bp, Homo sapiens
attaactatcttctttggact

SEQ ID NO: 5469902 - DNA, 15 bp, Homo sapiens
attaactattagtat

SEQ ID NO: 5469903 - DNA, 20 bp, Homo sapiens
attaactcaccagatttact

SEQ ID NO: 5469904 - DNA, 19 bp, Homo sapiens
attaactccctccaccagc

SEQ ID NO: 5469905 - DNA, 18 bp, Homo sapiens
attaactccgtttccaaa

SEQ ID NO: 5469906 - DNA, 14 bp, Homo sapiens
attaactctccagt

SEQ ID NO: 5469907 - DNA, 22 bp, Homo sapiens
attaactcttagaagtgttgta

SEQ ID NO: 5469908 - DNA, 14 bp, Homo sapiens
attaactgaaacat

SEQ ID NO: 5469909 - DNA, 19 bp, Homo sapiens
attaactgaagcaaatacc

SEQ ID NO: 5469910 - DNA, 19 bp, Homo sapiens
attaactgacgaagaagca

SEQ ID NO: 5469911 - DNA, 22 bp, Homo sapiens
attaactgagtagctctcctga

SEQ ID NO: 5469912 - DNA, 22 bp, Homo sapiens
attaactgccctctgaaataat

SEQ ID NO: 5469913 - DNA, 23 bp, Homo sapiens
attaactgctccaaatttaacca

SEQ ID NO: 5469914 - DNA, 19 bp, Homo sapiens
attaactgggtaatgaaac

SEQ ID NO: 5469915 - DNA, 17 bp, Homo sapiens
attaactgggtacccaa

SEQ ID NO: 5469916 - DNA, 21 bp, Homo sapiens
attaactgggtacccaaaaca

SEQ ID NO: 5469917 - DNA, 15 bp, Homo sapiens
attaactgtaaactt

SEQ ID NO: 5469918 - DNA, 16 bp, Homo sapiens
attaactgtattttct

SEQ ID NO: 5469919 - DNA, 16 bp, Homo sapiens
attaactgttgcactt

SEQ ID NO: 5469920 - DNA, 15 bp, Homo sapiens
attaacttagttttt

SEQ ID NO: 5469921 - DNA, 18 bp, Homo sapiens
attaacttctattttcaa

SEQ ID NO: 5469922 - DNA, 19 bp, Homo sapiens
attaacttgtattttctta

SEQ ID NO: 5469923 - DNA, 17 bp, Homo sapiens
attaacttttaaatgtt

SEQ ID NO: 5469924 - DNA, 18 bp, Homo sapiens
attaacttttaaatgttt

SEQ ID NO: 5469925 - DNA, 13 bp, Homo sapiens
attaacttttaat

SEQ ID NO: 5469926 - DNA, 14 bp, Homo sapiens
attaacttttaatg

SEQ ID NO: 5469927 - DNA, 12 bp, Homo sapiens
attaacttttat

SEQ ID NO: 5469928 - DNA, 14 bp, Homo sapiens
attaacttttgtaa

SEQ ID NO: 5469929 - DNA, 21 bp, Homo sapiens
attaagaaaaacaataaagat

SEQ ID NO: 5469930 - DNA, 13 bp, Homo sapiens
attaagaaaacta

SEQ ID NO: 5469931 - DNA, 18 bp, Homo sapiens
attaagaaaatattctaa

SEQ ID NO: 5469932 - DNA, 15 bp, Homo sapiens
attaagaaaatattt

SEQ ID NO: 5469933 - DNA, 12 bp, Homo sapiens
attaagaaaatc

SEQ ID NO: 5469934 - DNA, 14 bp, Homo sapiens
attaagaaaatcat

SEQ ID NO: 5469935 - DNA, 15 bp, Homo sapiens
attaagaaaatcata

SEQ ID NO: 5469936 - DNA, 20 bp, Homo sapiens
attaagaaaatcatattgct

SEQ ID NO: 5469937 - DNA, 12 bp, Homo sapiens
attaagaaaccc

SEQ ID NO: 5469938 - DNA, 11 bp, Homo sapiens
attaagaaact

SEQ ID NO: 5469939 - DNA, 14 bp, Homo sapiens
attaagaaagacta

SEQ ID NO: 5469940 - DNA, 16 bp, Homo sapiens
attaagaaagattaaa

SEQ ID NO: 5469941 - DNA, 19 bp, Homo sapiens
attaagaaagattaaatat

SEQ ID NO: 5469942 - DNA, 13 bp, Homo sapiens
attaagaaaggaa

SEQ ID NO: 5469943 - DNA, 14 bp, Homo sapiens
attaagaaaggaag

SEQ ID NO: 5469944 - DNA, 17 bp, Homo sapiens
attaagaaaggaagcat

SEQ ID NO: 5469945 - DNA, 15 bp, Homo sapiens
attaagaaaggaagt

SEQ ID NO: 5469946 - DNA, 12 bp, Homo sapiens
attaagaaatag

SEQ ID NO: 5469947 - DNA, 13 bp, Homo sapiens
attaagaacacta

SEQ ID NO: 5469948 - DNA, 15 bp, Homo sapiens
attaagaacatttta

SEQ ID NO: 5469949 - DNA, 19 bp, Homo sapiens
attaagaactgctgtttca

SEQ ID NO: 5469950 - DNA, 19 bp, Homo sapiens
attaagaaggcaaaaatgt

SEQ ID NO: 5469951 - DNA, 17 bp, Homo sapiens
attaagaatagtctctg

SEQ ID NO: 5469952 - DNA, 18 bp, Homo sapiens
attaagaatcattgtgct

SEQ ID NO: 5469953 - DNA, 21 bp, Homo sapiens
attaagaatcttagataactt

SEQ ID NO: 5469954 - DNA, 22 bp, Homo sapiens
attaagaatgaaatactgtttg

SEQ ID NO: 5469955 - DNA, 14 bp, Homo sapiens
attaagacaaaaag

SEQ ID NO: 5469956 - DNA, 13 bp, Homo sapiens
attaagacagtgt

SEQ ID NO: 5469957 - DNA, 15 bp, Homo sapiens
attaagacagtgtac

SEQ ID NO: 5469958 - DNA, 17 bp, Homo sapiens
attaagacagtgtacaa

SEQ ID NO: 5469959 - DNA, 23 bp, Homo sapiens
attaagacagtgtacaaaactgt

SEQ ID NO: 5469960 - DNA, 21 bp, Homo sapiens
attaagaccaaagacttgtta

SEQ ID NO: 5469961 - DNA, 24 bp, Homo sapiens
attaagacttacttgcattgctgg

SEQ ID NO: 5469962 - DNA, 11 bp, Homo sapiens
attaagacttt

SEQ ID NO: 5469963 - DNA, 13 bp, Homo sapiens
attaagactttaa

SEQ ID NO: 5469964 - DNA, 20 bp, Homo sapiens
attaagagagtctatttacg

SEQ ID NO: 5469965 - DNA, 23 bp, Homo sapiens
attaagagcaaactttagtgtct

SEQ ID NO: 5469966 - DNA, 21 bp, Homo sapiens
attaagagctattttagaaag

SEQ ID NO: 5469967 - DNA, 14 bp, Homo sapiens
attaagagtgaatg

SEQ ID NO: 5469968 - DNA, 14 bp, Homo sapiens
attaagatacaaat

SEQ ID NO: 5469969 - DNA, 14 bp, Homo sapiens
attaagatacttag

SEQ ID NO: 5469970 - DNA, 17 bp, Homo sapiens
attaagatcctaaactc

SEQ ID NO: 5469971 - DNA, 18 bp, Homo sapiens
attaagatctgtgtttta

SEQ ID NO: 5469972 - DNA, 20 bp, Homo sapiens
attaagatggattctcagat

SEQ ID NO: 5469973 - DNA, 13 bp, Homo sapiens
attaagattataa

SEQ ID NO: 5469974 - DNA, 16 bp, Homo sapiens
attaagattataattg

SEQ ID NO: 5469975 - DNA, 17 bp, Homo sapiens
attaagattataattgt

SEQ ID NO: 5469976 - DNA, 15 bp, Homo sapiens
attaagattatttta

SEQ ID NO: 5469977 - DNA, 13 bp, Homo sapiens
attaagatttcca

SEQ ID NO: 5469978 - DNA, 16 bp, Homo sapiens
attaagatttccaagt

SEQ ID NO: 5469979 - DNA, 17 bp, Homo sapiens
attaagattttacttta

SEQ ID NO: 5469980 - DNA, 11 bp, Homo sapiens
attaagcaaat

SEQ ID NO: 5469981 - DNA, 12 bp, Homo sapiens
attaagcacaca

SEQ ID NO: 5469982 - DNA, 17 bp, Homo sapiens
attaagcacacacatct

SEQ ID NO: 5469983 - DNA, 20 bp, Homo sapiens
attaagcacattattgtaga

SEQ ID NO: 5469984 - DNA, 22 bp, Homo sapiens
attaagcacattattgtagaga

SEQ ID NO: 5469985 - DNA, 21 bp, Homo sapiens
attaagcactttaagctcctt

SEQ ID NO: 5469986 - DNA, 14 bp, Homo sapiens
attaagcagaaaca

SEQ ID NO: 5469987 - DNA, 12 bp, Homo sapiens
attaagcagttc

SEQ ID NO: 5469988 - DNA, 13 bp, Homo sapiens
attaagcagttca

SEQ ID NO: 5469989 - DNA, 20 bp, Homo sapiens
attaagcatgacagaaaata

SEQ ID NO: 5469990 - DNA, 20 bp, Homo sapiens
attaagcattttgaaacaaa

SEQ ID NO: 5469991 - DNA, 14 bp, Homo sapiens
attaagccaaacat

SEQ ID NO: 5469992 - DNA, 17 bp, Homo sapiens
attaagccacttaaaat

SEQ ID NO: 5469993 - DNA, 19 bp, Homo sapiens
attaagccaggaaacatga

SEQ ID NO: 5469994 - DNA, 18 bp, Homo sapiens
attaagcccacagtatat

SEQ ID NO: 5469995 - DNA, 22 bp, Homo sapiens
attaagccccaacatgttcaga

SEQ ID NO: 5469996 - DNA, 20 bp, Homo sapiens
attaagccctcttccatcat

SEQ ID NO: 5469997 - DNA, 21 bp, Homo sapiens
attaagcccttatttgttttg

SEQ ID NO: 5469998 - DNA, 21 bp, Homo sapiens
attaagcctaccgtatttcag

SEQ ID NO: 5469999 - DNA, 19 bp, Homo sapiens
attaagctctcatagctca

SEQ ID NO: 5470000 - DNA, 22 bp, Homo sapiens
attaagctgttcctgttcagta

SEQ ID NO: 5470001 - DNA, 13 bp, Homo sapiens
attaagcttaaaa

SEQ ID NO: 5470002 - DNA, 22 bp, Homo sapiens
attaagcttaaaaaagaaagat

SEQ ID NO: 5470003 - DNA, 21 bp, Homo sapiens
attaagcttttcattttaata

SEQ ID NO: 5470004 - DNA, 18 bp, Homo sapiens
attaagctttttggaatc

SEQ ID NO: 5470005 - DNA, 20 bp, Homo sapiens
attaagctttttttttttga

SEQ ID NO: 5470006 - DNA, 14 bp, Homo sapiens
attaaggaaatgtt

SEQ ID NO: 5470007 - DNA, 13 bp, Homo sapiens
attaaggaagaca

SEQ ID NO: 5470008 - DNA, 19 bp, Homo sapiens
attaaggcaactgaacaaa

SEQ ID NO: 5470009 - DNA, 19 bp, Homo sapiens
attaagggaaaggaaaaga

SEQ ID NO: 5470010 - DNA, 21 bp, Homo sapiens
attaagggacatttctataaa

SEQ ID NO: 5470011 - DNA, 22 bp, Homo sapiens
attaagggacatttctataaaa

SEQ ID NO: 5470012 - DNA, 14 bp, Homo sapiens
attaagggtaggat

SEQ ID NO: 5470013 - DNA, 14 bp, Homo sapiens
attaaggtacatca

SEQ ID NO: 5470014 - DNA, 22 bp, Homo sapiens
attaaggtacatcattattgta

SEQ ID NO: 5470015 - DNA, 14 bp, Homo sapiens
attaaggtatttcg

SEQ ID NO: 5470016 - DNA, 17 bp, Homo sapiens
attaaggtctctctttg

SEQ ID NO: 5470017 - DNA, 21 bp, Homo sapiens
attaaggtctctctttggact

SEQ ID NO: 5470018 - DNA, 23 bp, Homo sapiens
attaaggtctgggagtgttctgt

SEQ ID NO: 5470019 - DNA, 15 bp, Homo sapiens
attaaggtttgccct

SEQ ID NO: 5470020 - DNA, 20 bp, Homo sapiens
attaaggtttgccctgcctg

SEQ ID NO: 5470021 - DNA, 15 bp, Homo sapiens
attaagtaatcaata

SEQ ID NO: 5470022 - DNA, 21 bp, Homo sapiens
attaagtaatctttttacagt

SEQ ID NO: 5470023 - DNA, 15 bp, Homo sapiens
attaagtaatgataa

SEQ ID NO: 5470024 - DNA, 15 bp, Homo sapiens
attaagtagatgaaa

SEQ ID NO: 5470025 - DNA, 14 bp, Homo sapiens
attaagtatatttg

SEQ ID NO: 5470026 - DNA, 16 bp, Homo sapiens
attaagtatatttgta

SEQ ID NO: 5470027 - DNA, 19 bp, Homo sapiens
attaagtatatttgtaaaa

SEQ ID NO: 5470028 - DNA, 23 bp, Homo sapiens
attaagtatatttgtaaaagcta

SEQ ID NO: 5470029 - DNA, 17 bp, Homo sapiens
attaagtatctgacatc

SEQ ID NO: 5470030 - DNA, 22 bp, Homo sapiens
attaagtatctgggattattct

SEQ ID NO: 5470031 - DNA, 22 bp, Homo sapiens
attaagtattccttggcccagc

SEQ ID NO: 5470032 - DNA, 20 bp, Homo sapiens
attaagtcagtggctttgca

SEQ ID NO: 5470033 - DNA, 15 bp, Homo sapiens
attaagtcatcatct

SEQ ID NO: 5470034 - DNA, 14 bp, Homo sapiens
attaagtcatgtgt

SEQ ID NO: 5470035 - DNA, 16 bp, Homo sapiens
attaagtcatgtgtga

SEQ ID NO: 5470036 - DNA, 22 bp, Homo sapiens
attaagtctcagtacacttcct

SEQ ID NO: 5470037 - DNA, 21 bp, Homo sapiens
attaagtggggtagactgagg

SEQ ID NO: 5470038 - DNA, 19 bp, Homo sapiens
attaagtggtcccaatgct

SEQ ID NO: 5470039 - DNA, 20 bp, Homo sapiens
attaagtggttactttgtgt

SEQ ID NO: 5470040 - DNA, 12 bp, Homo sapiens
attaagtgttga

SEQ ID NO: 5470041 - DNA, 14 bp, Homo sapiens
attaagtgttgtac

SEQ ID NO: 5470042 - DNA, 13 bp, Homo sapiens
attaagttatctt

SEQ ID NO: 5470043 - DNA, 22 bp, Homo sapiens
attaagtttgaaaatagttacc

SEQ ID NO: 5470044 - DNA, 18 bp, Homo sapiens
attaagttttaaataaac

SEQ ID NO: 5470045 - DNA, 14 bp, Homo sapiens
attaataaaactgt

SEQ ID NO: 5470046 - DNA, 16 bp, Homo sapiens
attaataaaactgtgc

SEQ ID NO: 5470047 - DNA, 12 bp, Homo sapiens
attaataaaata

SEQ ID NO: 5470048 - DNA, 15 bp, Homo sapiens
attaataaaatatct

SEQ ID NO: 5470049 - DNA, 18 bp, Homo sapiens
attaataaagaaaaagaa

SEQ ID NO: 5470050 - DNA, 11 bp, Homo sapiens
attaataaagc

SEQ ID NO: 5470051 - DNA, 12 bp, Homo sapiens
attaataaagca

SEQ ID NO: 5470052 - DNA, 13 bp, Homo sapiens
attaataaagcat

SEQ ID NO: 5470053 - DNA, 15 bp, Homo sapiens
attaataaagcattc

SEQ ID NO: 5470054 - DNA, 16 bp, Homo sapiens
attaataaagcattct

SEQ ID NO: 5470055 - DNA, 17 bp, Homo sapiens
attaataaatagagcaa

SEQ ID NO: 5470056 - DNA, 15 bp, Homo sapiens
attaataaatttata

SEQ ID NO: 5470057 - DNA, 14 bp, Homo sapiens
attaataacctgcc

SEQ ID NO: 5470058 - DNA, 17 bp, Homo sapiens
attaataactgaataaa

SEQ ID NO: 5470059 - DNA, 12 bp, Homo sapiens
attaataacttt

SEQ ID NO: 5470060 - DNA, 22 bp, Homo sapiens
attaataactttctctgtgaaa

SEQ ID NO: 5470061 - DNA, 23 bp, Homo sapiens
attaataactttctctgtgaaag

SEQ ID NO: 5470062 - DNA, 21 bp, Homo sapiens
attaataagatttttcaaaat

SEQ ID NO: 5470063 - DNA, 11 bp, Homo sapiens
attaataatag

SEQ ID NO: 5470064 - DNA, 17 bp, Homo sapiens
attaataatatttatgt

SEQ ID NO: 5470065 - DNA, 12 bp, Homo sapiens
attaataatctt

SEQ ID NO: 5470066 - DNA, 15 bp, Homo sapiens
attaataatgaagta

SEQ ID NO: 5470067 - DNA, 15 bp, Homo sapiens
attaatacaatatta

SEQ ID NO: 5470068 - DNA, 18 bp, Homo sapiens
attaatacaatattaatt

SEQ ID NO: 5470069 - DNA, 19 bp, Homo sapiens
ccacaggatctgaactttg

SEQ ID NO: 5470070 - DNA, 22 bp, Homo sapiens
ccacaggatgaactagccatga

SEQ ID NO: 5470071 - DNA, 15 bp, Homo sapiens
ccacaggatgcatat

SEQ ID NO: 5470072 - DNA, 17 bp, Homo sapiens
ccacaggcaaaactcag

SEQ ID NO: 5470073 - DNA, 15 bp, Homo sapiens
ccacaggcagcccag

SEQ ID NO: 5470074 - DNA, 13 bp, Homo sapiens
ccacaggcagctt

SEQ ID NO: 5470075 - DNA, 19 bp, Homo sapiens
ccacaggcaggggtgagag

SEQ ID NO: 5470076 - DNA, 14 bp, Homo sapiens
ccacaggcagtcca

SEQ ID NO: 5470077 - DNA, 23 bp, Homo sapiens
ccacaggcatctacacagcctgg

SEQ ID NO: 5470078 - DNA, 18 bp, Homo sapiens
ccacaggccactgcaaac

SEQ ID NO: 5470079 - DNA, 16 bp, Homo sapiens
ccacaggcccacagta

SEQ ID NO: 5470080 - DNA, 20 bp, Homo sapiens
ccacaggccccccgcagcac

SEQ ID NO: 5470081 - DNA, 21 bp, Homo sapiens
ccacaggccccccgcagcacc

SEQ ID NO: 5470082 - DNA, 16 bp, Homo sapiens
ccacaggcccttcctc

SEQ ID NO: 5470083 - DNA, 18 bp, Homo sapiens
ccacaggcccttcctctc

SEQ ID NO: 5470084 - DNA, 19 bp, Homo sapiens
ccacaggccctttcctcag

SEQ ID NO: 5470085 - DNA, 16 bp, Homo sapiens
ccacaggccgccctgc

SEQ ID NO: 5470086 - DNA, 17 bp, Homo sapiens
ccacaggccgccctgcg

SEQ ID NO: 5470087 - DNA, 13 bp, Homo sapiens
ccacaggcctccc

SEQ ID NO: 5470088 - DNA, 14 bp, Homo sapiens
ccacaggcctgaga

SEQ ID NO: 5470089 - DNA, 22 bp, Homo sapiens
ccacaggcctgagatttcatct

SEQ ID NO: 5470090 - DNA, 20 bp, Homo sapiens
ccacaggcctgttcccttgt

SEQ ID NO: 5470091 - DNA, 16 bp, Homo sapiens
ccacaggctcaggcag

SEQ ID NO: 5470092 - DNA, 20 bp, Homo sapiens
ccacaggctcaggcaggggc

SEQ ID NO: 5470093 - DNA, 21 bp, Homo sapiens
ccacaggcttagggacaggac

SEQ ID NO: 5470094 - DNA, 21 bp, Homo sapiens
ccacagggaaatgtgtatcta

SEQ ID NO: 5470095 - DNA, 17 bp, Homo sapiens
ccacagggaagctcaca

SEQ ID NO: 5470096 - DNA, 12 bp, Homo sapiens
ccacagggacca

SEQ ID NO: 5470097 - DNA, 17 bp, Homo sapiens
ccacagggaccagggcc

SEQ ID NO: 5470098 - DNA, 15 bp, Homo sapiens
ccacagggagccaca

SEQ ID NO: 5470099 - DNA, 12 bp, Homo sapiens
ccacagggccag

SEQ ID NO: 5470100 - DNA, 15 bp, Homo sapiens
ccacagggccagagg

SEQ ID NO: 5470101 - DNA, 16 bp, Homo sapiens
ccacagggccagaggg

SEQ ID NO: 5470102 - DNA, 19 bp, Homo sapiens
ccacagggccagagggagc

SEQ ID NO: 5470103 - DNA, 24 bp, Homo sapiens
ccacagggccagagggagctggaa

SEQ ID NO: 5470104 - DNA, 12 bp, Homo sapiens
ccacagggcctg

SEQ ID NO: 5470105 - DNA, 21 bp, Homo sapiens
ccacagggcctgacttttaca

SEQ ID NO: 5470106 - DNA, 19 bp, Homo sapiens
ccacagggctcctgaagga

SEQ ID NO: 5470107 - DNA, 14 bp, Homo sapiens
ccacaggggcaggc

SEQ ID NO: 5470108 - DNA, 16 bp, Homo sapiens
ccacaggggcaggcct

SEQ ID NO: 5470109 - DNA, 17 bp, Homo sapiens
ccacaggggcaggcctg

SEQ ID NO: 5470110 - DNA, 18 bp, Homo sapiens
ccacaggggcaggcctgg

SEQ ID NO: 5470111 - DNA, 19 bp, Homo sapiens
ccacagggtcccacagcca

SEQ ID NO: 5470112 - DNA, 11 bp, Homo sapiens
ccacagggtct

SEQ ID NO: 5470113 - DNA, 16 bp, Homo sapiens
ccacagggtctgcctc

SEQ ID NO: 5470114 - DNA, 15 bp, Homo sapiens
ccacagggtgggatg

SEQ ID NO: 5470115 - DNA, 17 bp, Homo sapiens
ccacaggtcatcagatg

SEQ ID NO: 5470116 - DNA, 21 bp, Homo sapiens
ccacaggtcatcagatgcctg

SEQ ID NO: 5470117 - DNA, 22 bp, Homo sapiens
ccacaggtcttcactgcccagg

SEQ ID NO: 5470118 - DNA, 17 bp, Homo sapiens
ccacaggtgaggggcag

SEQ ID NO: 5470119 - DNA, 15 bp, Homo sapiens
ccacaggtgtcccca

SEQ ID NO: 5470120 - DNA, 22 bp, Homo sapiens
ccacaggtgtccccagcccact

SEQ ID NO: 5470121 - DNA, 22 bp, Homo sapiens
ccacaggtttccccaaggcctc

SEQ ID NO: 5470122 - DNA, 16 bp, Homo sapiens
ccacagtaagttccta

SEQ ID NO: 5470123 - DNA, 18 bp, Homo sapiens
ccacagtacatatgtaat

SEQ ID NO: 5470124 - DNA, 15 bp, Homo sapiens
ccacagtactcactt

SEQ ID NO: 5470125 - DNA, 23 bp, Homo sapiens
ccacagtatattttatttcaatg

SEQ ID NO: 5470126 - DNA, 15 bp, Homo sapiens
ccacagtcactggat

SEQ ID NO: 5470127 - DNA, 18 bp, Homo sapiens
ccacagtcccccacccac

SEQ ID NO: 5470128 - DNA, 18 bp, Homo sapiens
ccacagtcctcacagcct

SEQ ID NO: 5470129 - DNA, 15 bp, Homo sapiens
ccacagtctctggga

SEQ ID NO: 5470130 - DNA, 15 bp, Homo sapiens
ccacagtgacagtca

SEQ ID NO: 5470131 - DNA, 17 bp, Homo sapiens
ccacagtgacagtcact

SEQ ID NO: 5470132 - DNA, 18 bp, Homo sapiens
ccacagtgacagtcactt

SEQ ID NO: 5470133 - DNA, 17 bp, Homo sapiens
ccacagtgactgggccc

SEQ ID NO: 5470134 - DNA, 22 bp, Homo sapiens
ccacagtgactgggccctgtcc

SEQ ID NO: 5470135 - DNA, 23 bp, Homo sapiens
ccacagtgactgggccctgtcca

SEQ ID NO: 5470136 - DNA, 23 bp, Homo sapiens
ccacagtgagaggggagggctcc

SEQ ID NO: 5470137 - DNA, 16 bp, Homo sapiens
ccacagtgctcagttg

SEQ ID NO: 5470138 - DNA, 13 bp, Homo sapiens
ccacagtgctgct

SEQ ID NO: 5470139 - DNA, 14 bp, Homo sapiens
ccacagtgctgtct

SEQ ID NO: 5470140 - DNA, 15 bp, Homo sapiens
ccacagtggggccca

SEQ ID NO: 5470141 - DNA, 21 bp, Homo sapiens
ccacagtggggcccatggccc

SEQ ID NO: 5470142 - DNA, 22 bp, Homo sapiens
ccacagtgggtggcacctcctg

SEQ ID NO: 5470143 - DNA, 21 bp, Homo sapiens
ccacagtgtaccattaaaata

SEQ ID NO: 5470144 - DNA, 23 bp, Homo sapiens
ccacagtgtcactggtcaggtgc

SEQ ID NO: 5470145 - DNA, 14 bp, Homo sapiens
ccacagtgtcaggc

SEQ ID NO: 5470146 - DNA, 17 bp, Homo sapiens
ccacagttatcttagct

SEQ ID NO: 5470147 - DNA, 22 bp, Homo sapiens
ccacagttcttaatacaggaga

SEQ ID NO: 5470148 - DNA, 16 bp, Homo sapiens
ccacagttgccaccac

SEQ ID NO: 5470149 - DNA, 14 bp, Homo sapiens
ccacagttgctcta

SEQ ID NO: 5470150 - DNA, 23 bp, Homo sapiens
ccacagttgtcagttgtgaagag

SEQ ID NO: 5470151 - DNA, 21 bp, Homo sapiens
ccacagttgtgttcatgctga

SEQ ID NO: 5470152 - DNA, 15 bp, Homo sapiens
ccacagttttaataa

SEQ ID NO: 5470153 - DNA, 18 bp, Homo sapiens
ccacagttttagttggtg

SEQ ID NO: 5470154 - DNA, 14 bp, Homo sapiens
ccacagttttgcct

SEQ ID NO: 5470155 - DNA, 21 bp, Homo sapiens
ccacataaaagccccagcttg

SEQ ID NO: 5470156 - DNA, 24 bp, Homo sapiens
ccacataaaagccccagcttggct

SEQ ID NO: 5470157 - DNA, 21 bp, Homo sapiens
ccacataaacacttctcctta

SEQ ID NO: 5470158 - DNA, 23 bp, Homo sapiens
ccacataaacacttctccttaac

SEQ ID NO: 5470159 - DNA, 14 bp, Homo sapiens
ccacataaatttta

SEQ ID NO: 5470160 - DNA, 13 bp, Homo sapiens
ccacataagtcca

SEQ ID NO: 5470161 - DNA, 24 bp, Homo sapiens
ccacataatacattccatcacagc

SEQ ID NO: 5470162 - DNA, 23 bp, Homo sapiens
ccacataattctgttactttgct

SEQ ID NO: 5470163 - DNA, 20 bp, Homo sapiens
ccacatacaacacaaagaga

SEQ ID NO: 5470164 - DNA, 19 bp, Homo sapiens
ccacatacaggtgctcaat

SEQ ID NO: 5470165 - DNA, 12 bp, Homo sapiens
ccacatacctct

SEQ ID NO: 5470166 - DNA, 23 bp, Homo sapiens
ccacatacgtgagggggagctga

SEQ ID NO: 5470167 - DNA, 23 bp, Homo sapiens
ccacatagcatgcttcctttctc

SEQ ID NO: 5470168 - DNA, 20 bp, Homo sapiens
ccacatatctagatttttct

SEQ ID NO: 5470169 - DNA, 19 bp, Homo sapiens
ccacatatcttacagccag

SEQ ID NO: 5470170 - DNA, 23 bp, Homo sapiens
ccacatatttcaaaaacatgctt

SEQ ID NO: 5470171 - DNA, 17 bp, Homo sapiens
ccacatcagccccacag

SEQ ID NO: 5470172 - DNA, 19 bp, Homo sapiens
ccacatcatggaccaaatg

SEQ ID NO: 5470173 - DNA, 22 bp, Homo sapiens
ccacatccaacatttcctcagg

SEQ ID NO: 5470174 - DNA, 18 bp, Homo sapiens
ccacatccaactccagca

SEQ ID NO: 5470175 - DNA, 22 bp, Homo sapiens
ccacatccacacacgcaggaac

SEQ ID NO: 5470176 - DNA, 16 bp, Homo sapiens
ccacatccacagtctc

SEQ ID NO: 5470177 - DNA, 22 bp, Homo sapiens
ccacatccaccccagccccact

SEQ ID NO: 5470178 - DNA, 22 bp, Homo sapiens
ccacatcccactcacaacagct

SEQ ID NO: 5470179 - DNA, 14 bp, Homo sapiens
ccacatcccactgg

SEQ ID NO: 5470180 - DNA, 20 bp, Homo sapiens
ccacatcccactggatctgg

SEQ ID NO: 5470181 - DNA, 14 bp, Homo sapiens
ccacatcccagcag

SEQ ID NO: 5470182 - DNA, 16 bp, Homo sapiens
ccacatcccagcagcc

SEQ ID NO: 5470183 - DNA, 17 bp, Homo sapiens
ccacatcccagcagccc

SEQ ID NO: 5470184 - DNA, 15 bp, Homo sapiens
ccacatcccaggctt

SEQ ID NO: 5470185 - DNA, 13 bp, Homo sapiens
ccacatccccaat

SEQ ID NO: 5470186 - DNA, 17 bp, Homo sapiens
ccacatccccaccttcc

SEQ ID NO: 5470187 - DNA, 21 bp, Homo sapiens
ccacatccccagagcccagct

SEQ ID NO: 5470188 - DNA, 15 bp, Homo sapiens
ccacatcctcatggc

SEQ ID NO: 5470189 - DNA, 19 bp, Homo sapiens
ccacatcctccgtccagcc

SEQ ID NO: 5470190 - DNA, 13 bp, Homo sapiens
ccacatcctgtgt

SEQ ID NO: 5470191 - DNA, 14 bp, Homo sapiens
ccacatcctgtgtc

SEQ ID NO: 5470192 - DNA, 15 bp, Homo sapiens
ccacatcctgtgtca

SEQ ID NO: 5470193 - DNA, 13 bp, Homo sapiens
ccacatcgcacac

SEQ ID NO: 5470194 - DNA, 19 bp, Homo sapiens
ccacatcgcacactggggc

SEQ ID NO: 5470195 - DNA, 16 bp, Homo sapiens
ccacatctctgaaagc

SEQ ID NO: 5470196 - DNA, 15 bp, Homo sapiens
ccacatctgccagac

SEQ ID NO: 5470197 - DNA, 12 bp, Homo sapiens
ccacatctgcct

SEQ ID NO: 5470198 - DNA, 13 bp, Homo sapiens
ccacatctgcctc

SEQ ID NO: 5470199 - DNA, 18 bp, Homo sapiens
ccacatctgcctcctctc

SEQ ID NO: 5470200 - DNA, 19 bp, Homo sapiens
ccacatctgcctcctctcc

SEQ ID NO: 5470201 - DNA, 22 bp, Homo sapiens
ccacatctgccttaaaaccaaa

SEQ ID NO: 5470202 - DNA, 23 bp, Homo sapiens
ccacatctgccttaaaaccaaag

SEQ ID NO: 5470203 - DNA, 13 bp, Homo sapiens
ccacatctgctct

SEQ ID NO: 5470204 - DNA, 18 bp, Homo sapiens
ccacatctgtcctcaccc

SEQ ID NO: 5470205 - DNA, 18 bp, Homo sapiens
ccacatcttccatttcca

SEQ ID NO: 5470206 - DNA, 18 bp, Homo sapiens
ccacatcttgctctgctg

SEQ ID NO: 5470207 - DNA, 19 bp, Homo sapiens
ccacatcttgctctgctga

SEQ ID NO: 5470208 - DNA, 14 bp, Homo sapiens
ccacatgaaaccta

SEQ ID NO: 5470209 - DNA, 21 bp, Homo sapiens
ccacatgaggccatctcagga

SEQ ID NO: 5470210 - DNA, 21 bp, Homo sapiens
ccacatgatcttgagatttct

SEQ ID NO: 5470211 - DNA, 13 bp, Homo sapiens
ccacatgcacatg

SEQ ID NO: 5470212 - DNA, 17 bp, Homo sapiens
ccacatgcacatgtatt

SEQ ID NO: 5470213 - DNA, 13 bp, Homo sapiens
ccacatgcatgtc

SEQ ID NO: 5470214 - DNA, 14 bp, Homo sapiens
ccacatgcatgtct

SEQ ID NO: 5470215 - DNA, 16 bp, Homo sapiens
ccacatgccactgcct

SEQ ID NO: 5470216 - DNA, 20 bp, Homo sapiens
ccacatgccgcgtccctgcc

SEQ ID NO: 5470217 - DNA, 21 bp, Homo sapiens
ccacatgccgcgtccctgccc

SEQ ID NO: 5470218 - DNA, 15 bp, Homo sapiens
ccacatgctgcctgg

SEQ ID NO: 5470219 - DNA, 22 bp, Homo sapiens
ccacatgctgcctggcacagac

SEQ ID NO: 5470220 - DNA, 21 bp, Homo sapiens
ccacatggaacttaaaacata

SEQ ID NO: 5470221 - DNA, 15 bp, Homo sapiens
ccacatggagccccc

SEQ ID NO: 5470222 - DNA, 15 bp, Homo sapiens
ccacatggcacagag

SEQ ID NO: 5470223 - DNA, 18 bp, Homo sapiens
ccacatggccatcttctt

SEQ ID NO: 5470224 - DNA, 21 bp, Homo sapiens
ccacatggccatcttctttct

SEQ ID NO: 5470225 - DNA, 18 bp, Homo sapiens
ccacatggccgctgccca

SEQ ID NO: 5470226 - DNA, 23 bp, Homo sapiens
ccacatgggaggaaggcccaggg

SEQ ID NO: 5470227 - DNA, 15 bp, Homo sapiens
ccacatgggctgggg

SEQ ID NO: 5470228 - DNA, 20 bp, Homo sapiens
ccacatgggctgggggccag

SEQ ID NO: 5470229 - DNA, 21 bp, Homo sapiens
ccacatggtcttcgtccttga

SEQ ID NO: 5470230 - DNA, 16 bp, Homo sapiens
ccacatggtgtctccc

SEQ ID NO: 5470231 - DNA, 20 bp, Homo sapiens
ccacatggtgtctcccaaca

SEQ ID NO: 5470232 - DNA, 16 bp, Homo sapiens
ccacatggtgtggcca

SEQ ID NO: 5470233 - DNA, 22 bp, Homo sapiens
ccacatgtatttattcctctgt

SEQ ID NO: 5470234 - DNA, 14 bp, Homo sapiens
ccacatgtcaccgt

SEQ ID NO: 5470235 - DNA, 13 bp, Homo sapiens
ccacatgtccagc

SEQ ID NO: 5470236 - DNA, 16 bp, Homo sapiens
ccacatgtgcacatgc

SEQ ID NO: 5470237 - DNA, 21 bp, Homo sapiens
ccacatgttctaggtttcagc

SEQ ID NO: 5470238 - DNA, 16 bp, Homo sapiens
ccacattaaagaagac

SEQ ID NO: 5470239 - DNA, 15 bp, Homo sapiens
ccacattccatgacg

SEQ ID NO: 5470240 - DNA, 15 bp, Homo sapiens
ccacattcccatgaa

SEQ ID NO: 5470241 - DNA, 23 bp, Homo sapiens
ccacattcccccttcaacaaaca

SEQ ID NO: 5470242 - DNA, 13 bp, Homo sapiens
ccacattctactt

SEQ ID NO: 5470243 - DNA, 13 bp, Homo sapiens
ccacattctgctg

SEQ ID NO: 5470244 - DNA, 23 bp, Homo sapiens
ccacattctgctgcccccagacc

SEQ ID NO: 5470245 - DNA, 16 bp, Homo sapiens
ccaccctttctggcac

SEQ ID NO: 5470246 - DNA, 19 bp, Homo sapiens
ccaccgaagagccctgagc

SEQ ID NO: 5470247 - DNA, 17 bp, Homo sapiens
ccaccgaccaactgccc

SEQ ID NO: 5470248 - DNA, 12 bp, Homo sapiens
ccaccgaccccc

SEQ ID NO: 5470249 - DNA, 13 bp, Homo sapiens
ccaccgaccccct

SEQ ID NO: 5470250 - DNA, 14 bp, Homo sapiens
ccaccgagctctgt

SEQ ID NO: 5470251 - DNA, 16 bp, Homo sapiens
ccaccgagctggagcg

SEQ ID NO: 5470252 - DNA, 17 bp, Homo sapiens
ccaccgaggagccccag

SEQ ID NO: 5470253 - DNA, 22 bp, Homo sapiens
ccaccgaggagccccagccccg

SEQ ID NO: 5470254 - DNA, 14 bp, Homo sapiens
ccaccgatggagcc

SEQ ID NO: 5470255 - DNA, 20 bp, Homo sapiens
ccaccgatggagcccccaga

SEQ ID NO: 5470256 - DNA, 16 bp, Homo sapiens
ccaccgcagaaggaag

SEQ ID NO: 5470257 - DNA, 14 bp, Homo sapiens
ccaccgcagacagg

SEQ ID NO: 5470258 - DNA, 18 bp, Homo sapiens
ccaccgcagacaggacca

SEQ ID NO: 5470259 - DNA, 22 bp, Homo sapiens
ccaccgcagcgtcccccgccgc

SEQ ID NO: 5470260 - DNA, 21 bp, Homo sapiens
ccaccgcaggggactgtctca

SEQ ID NO: 5470261 - DNA, 18 bp, Homo sapiens
ccaccgcatcctcactgg

SEQ ID NO: 5470262 - DNA, 17 bp, Homo sapiens
ccaccgcatgccccctc

SEQ ID NO: 5470263 - DNA, 18 bp, Homo sapiens
ccaccgcatgccccctcg

SEQ ID NO: 5470264 - DNA, 14 bp, Homo sapiens
ccaccgccacccca

SEQ ID NO: 5470265 - DNA, 18 bp, Homo sapiens
ccaccgccaccgtgtgcc

SEQ ID NO: 5470266 - DNA, 18 bp, Homo sapiens
ccaccgcccactctccac

SEQ ID NO: 5470267 - DNA, 15 bp, Homo sapiens
ccaccgccctcctcc

SEQ ID NO: 5470268 - DNA, 16 bp, Homo sapiens
ccaccgccctcctcca

SEQ ID NO: 5470269 - DNA, 15 bp, Homo sapiens
ccaccgccctgcctc

SEQ ID NO: 5470270 - DNA, 18 bp, Homo sapiens
ccaccgccggggtcctgg

SEQ ID NO: 5470271 - DNA, 19 bp, Homo sapiens
ccaccgccggggtcctggg

SEQ ID NO: 5470272 - DNA, 20 bp, Homo sapiens
ccaccgccggggtcctggga

SEQ ID NO: 5470273 - DNA, 14 bp, Homo sapiens
ccaccgcctctggc

SEQ ID NO: 5470274 - DNA, 19 bp, Homo sapiens
ccaccgccttgcccagcct

SEQ ID NO: 5470275 - DNA, 14 bp, Homo sapiens
ccaccgcgcccagc

SEQ ID NO: 5470276 - DNA, 12 bp, Homo sapiens
ccaccgcgcccc

SEQ ID NO: 5470277 - DNA, 14 bp, Homo sapiens
ccaccgctcagtgt

SEQ ID NO: 5470278 - DNA, 14 bp, Homo sapiens
ccaccgctccccag

SEQ ID NO: 5470279 - DNA, 21 bp, Homo sapiens
ccaccgctccccagcccaggg

SEQ ID NO: 5470280 - DNA, 20 bp, Homo sapiens
ccaccgctgccagcacagag

SEQ ID NO: 5470281 - DNA, 14 bp, Homo sapiens
ccaccgctgcctcg

SEQ ID NO: 5470282 - DNA, 18 bp, Homo sapiens
ccaccggaactgggctgg

SEQ ID NO: 5470283 - DNA, 18 bp, Homo sapiens
ccaccggatgctgtgcct

SEQ ID NO: 5470284 - DNA, 20 bp, Homo sapiens
ccaccggatgctgtgcctgg

SEQ ID NO: 5470285 - DNA, 13 bp, Homo sapiens
ccaccggcccctg

SEQ ID NO: 5470286 - DNA, 23 bp, Homo sapiens
ccaccggcctgtgggtctctgaa

SEQ ID NO: 5470287 - DNA, 17 bp, Homo sapiens
ccaccgggacagacctg

SEQ ID NO: 5470288 - DNA, 19 bp, Homo sapiens
ccaccgggcatgtctgcct

SEQ ID NO: 5470289 - DNA, 14 bp, Homo sapiens
ccaccgggccactc

SEQ ID NO: 5470290 - DNA, 18 bp, Homo sapiens
ccaccgggccactccttc

SEQ ID NO: 5470291 - DNA, 14 bp, Homo sapiens
ccaccgggctgcag

SEQ ID NO: 5470292 - DNA, 15 bp, Homo sapiens
ccaccgggctgcagg

SEQ ID NO: 5470293 - DNA, 19 bp, Homo sapiens
ccaccgggctgggagctct

SEQ ID NO: 5470294 - DNA, 21 bp, Homo sapiens
ccaccggggaacccagccctg

SEQ ID NO: 5470295 - DNA, 17 bp, Homo sapiens
ccaccggggcaagaggg

SEQ ID NO: 5470296 - DNA, 19 bp, Homo sapiens
ccaccggggcaagagggaa

SEQ ID NO: 5470297 - DNA, 16 bp, Homo sapiens
ccaccggggcactggc

SEQ ID NO: 5470298 - DNA, 13 bp, Homo sapiens
ccaccgggtgaaa

SEQ ID NO: 5470299 - DNA, 23 bp, Homo sapiens
ccaccgggttctgcagcggcaga

SEQ ID NO: 5470300 - DNA, 17 bp, Homo sapiens
ccaccggtccagctggc

SEQ ID NO: 5470301 - DNA, 14 bp, Homo sapiens
ccaccggtgccaaa

SEQ ID NO: 5470302 - DNA, 14 bp, Homo sapiens
ccaccggtgggcag

SEQ ID NO: 5470303 - DNA, 20 bp, Homo sapiens
ccaccggttgcttctgggaa

SEQ ID NO: 5470304 - DNA, 21 bp, Homo sapiens
ccaccgtagggcctgactcct

SEQ ID NO: 5470305 - DNA, 18 bp, Homo sapiens
ccaccgtccctctgcaga

SEQ ID NO: 5470306 - DNA, 15 bp, Homo sapiens
ccaccgtccgccctg

SEQ ID NO: 5470307 - DNA, 17 bp, Homo sapiens
ccaccgtccgccctgct

SEQ ID NO: 5470308 - DNA, 20 bp, Homo sapiens
ccaccgtccgccctgctcct

SEQ ID NO: 5470309 - DNA, 20 bp, Homo sapiens
ccaccgtctcggccctgaac

SEQ ID NO: 5470310 - DNA, 14 bp, Homo sapiens
ccaccgtgcctggc

SEQ ID NO: 5470311 - DNA, 15 bp, Homo sapiens
ccaccgtgcctggct

SEQ ID NO: 5470312 - DNA, 18 bp, Homo sapiens
ccaccgttcaagcgccag

SEQ ID NO: 5470313 - DNA, 19 bp, Homo sapiens
ccaccgttgtctcatgcca

SEQ ID NO: 5470314 - DNA, 21 bp, Homo sapiens
ccacctaaagggaagccctga

SEQ ID NO: 5470315 - DNA, 23 bp, Homo sapiens
ccacctaattcgatgaaggctgc

SEQ ID NO: 5470316 - DNA, 19 bp, Homo sapiens
ccacctacaatacatctga

SEQ ID NO: 5470317 - DNA, 20 bp, Homo sapiens
ccacctacacccctgtgctc

SEQ ID NO: 5470318 - DNA, 13 bp, Homo sapiens
ccacctacccagc

SEQ ID NO: 5470319 - DNA, 20 bp, Homo sapiens
ccacctaccttcaaagctga

SEQ ID NO: 5470320 - DNA, 14 bp, Homo sapiens
ccacctactctcag

SEQ ID NO: 5470321 - DNA, 22 bp, Homo sapiens
ccacctactgcactttccccct

SEQ ID NO: 5470322 - DNA, 22 bp, Homo sapiens
ccacctacttagatatttcatg

SEQ ID NO: 5470323 - DNA, 19 bp, Homo sapiens
ccacctacttgtgactgaa

SEQ ID NO: 5470324 - DNA, 21 bp, Homo sapiens
ccacctagaaaggggcccatt

SEQ ID NO: 5470325 - DNA, 22 bp, Homo sapiens
ccacctagaagtctccctgcac

SEQ ID NO: 5470326 - DNA, 21 bp, Homo sapiens
ccacctagactgtaaacctct

SEQ ID NO: 5470327 - DNA, 16 bp, Homo sapiens
ccacctagtgccccag

SEQ ID NO: 5470328 - DNA, 19 bp, Homo sapiens
ccacctagtgccccagact

SEQ ID NO: 5470329 - DNA, 16 bp, Homo sapiens
ccacctagtggctgtc

SEQ ID NO: 5470330 - DNA, 19 bp, Homo sapiens
ccacctagtggctgtccag

SEQ ID NO: 5470331 - DNA, 20 bp, Homo sapiens
ccacctagtggctgtccagt

SEQ ID NO: 5470332 - DNA, 20 bp, Homo sapiens
ccacctatctcgtgggagag

SEQ ID NO: 5470333 - DNA, 20 bp, Homo sapiens
ccacctatgccagtgctcaa

SEQ ID NO: 5470334 - DNA, 20 bp, Homo sapiens
ccacctatgcctgtggtgaa

SEQ ID NO: 5470335 - DNA, 21 bp, Homo sapiens
ccacctatgcctgtggtgaag

SEQ ID NO: 5470336 - DNA, 14 bp, Homo sapiens
ccacctcaaattta

SEQ ID NO: 5470337 - DNA, 14 bp, Homo sapiens
ccacctcacagcta

SEQ ID NO: 5470338 - DNA, 12 bp, Homo sapiens
ccacctcacccc

SEQ ID NO: 5470339 - DNA, 15 bp, Homo sapiens
ccacctcacccggcc

SEQ ID NO: 5470340 - DNA, 19 bp, Homo sapiens
ccacctcacctagcctgat

SEQ ID NO: 5470341 - DNA, 19 bp, Homo sapiens
ccacctcacctctttgttc

SEQ ID NO: 5470342 - DNA, 18 bp, Homo sapiens
ccacctcactagctcccc

SEQ ID NO: 5470343 - DNA, 15 bp, Homo sapiens
ccacctcagaaagga

SEQ ID NO: 5470344 - DNA, 17 bp, Homo sapiens
ccacctcagcctcccag

SEQ ID NO: 5470345 - DNA, 19 bp, Homo sapiens
ccacctcagcctcccaggt

SEQ ID NO: 5470346 - DNA, 16 bp, Homo sapiens
ccacctcagccttgga

SEQ ID NO: 5470347 - DNA, 16 bp, Homo sapiens
ccacctcagggcacgc

SEQ ID NO: 5470348 - DNA, 20 bp, Homo sapiens
ccacctcagggcacgcagga

SEQ ID NO: 5470349 - DNA, 14 bp, Homo sapiens
ccacctcaggggag

SEQ ID NO: 5470350 - DNA, 18 bp, Homo sapiens
ccacctcatcactggact

SEQ ID NO: 5470351 - DNA, 19 bp, Homo sapiens
ccacctcatcactggactg

SEQ ID NO: 5470352 - DNA, 23 bp, Homo sapiens
ccacctcatcactggactgcatg

SEQ ID NO: 5470353 - DNA, 14 bp, Homo sapiens
ccacctccacccag

SEQ ID NO: 5470354 - DNA, 15 bp, Homo sapiens
ccacctccacccagc

SEQ ID NO: 5470355 - DNA, 23 bp, Homo sapiens
ccacctccacccccaagaaacct

SEQ ID NO: 5470356 - DNA, 13 bp, Homo sapiens
ccacctccacctg

SEQ ID NO: 5470357 - DNA, 19 bp, Homo sapiens
ccacctccagcccgggagc

SEQ ID NO: 5470358 - DNA, 13 bp, Homo sapiens
ccacctccagcct

SEQ ID NO: 5470359 - DNA, 24 bp, Homo sapiens
ccacctccagtccccctatccttg

SEQ ID NO: 5470360 - DNA, 19 bp, Homo sapiens
ccacctcccaagagggctc

SEQ ID NO: 5470361 - DNA, 20 bp, Homo sapiens
ccacctcccaaggactttcc

SEQ ID NO: 5470362 - DNA, 17 bp, Homo sapiens
ccacctcccacaaagga

SEQ ID NO: 5470363 - DNA, 14 bp, Homo sapiens
ccacctcccacccc

SEQ ID NO: 5470364 - DNA, 15 bp, Homo sapiens
ccacctcccacccca

SEQ ID NO: 5470365 - DNA, 19 bp, Homo sapiens
ccacctcccaccccactcc

SEQ ID NO: 5470366 - DNA, 19 bp, Homo sapiens
ccacctcccactcctgctg

SEQ ID NO: 5470367 - DNA, 12 bp, Homo sapiens
ccacctccccac

SEQ ID NO: 5470368 - DNA, 23 bp, Homo sapiens
ccacctccccacgccctcccctc

SEQ ID NO: 5470369 - DNA, 13 bp, Homo sapiens
ccacctccccagg

SEQ ID NO: 5470370 - DNA, 16 bp, Homo sapiens
ccacctccccaggccg

SEQ ID NO: 5470371 - DNA, 20 bp, Homo sapiens
ccacctcccccaaaccctgc

SEQ ID NO: 5470372 - DNA, 21 bp, Homo sapiens
ccacctcccccaaaccctgct

SEQ ID NO: 5470373 - DNA, 20 bp, Homo sapiens
ccacctccccctcccccttc

SEQ ID NO: 5470374 - DNA, 17 bp, Homo sapiens
ccacctcccctatccac

SEQ ID NO: 5470375 - DNA, 16 bp, Homo sapiens
ccacctccccttgggc

SEQ ID NO: 5470376 - DNA, 13 bp, Homo sapiens
ccacctcccgccc

SEQ ID NO: 5470377 - DNA, 22 bp, Homo sapiens
ccacctcccgggttcacgccat

SEQ ID NO: 5470378 - DNA, 15 bp, Homo sapiens
ccacctccctcacca

SEQ ID NO: 5470379 - DNA, 12 bp, Homo sapiens
ccacctccctgc

SEQ ID NO: 5470380 - DNA, 14 bp, Homo sapiens
ccacctccctgcaa

SEQ ID NO: 5470381 - DNA, 15 bp, Homo sapiens
ccacctccctgcaat

SEQ ID NO: 5470382 - DNA, 15 bp, Homo sapiens
ccacctccctgccca

SEQ ID NO: 5470383 - DNA, 16 bp, Homo sapiens
ccacctccctgcccag

SEQ ID NO: 5470384 - DNA, 14 bp, Homo sapiens
ccacctccctgcct

SEQ ID NO: 5470385 - DNA, 18 bp, Homo sapiens
ccacctccctgcctccag

SEQ ID NO: 5470386 - DNA, 13 bp, Homo sapiens
ccacctccgccag

SEQ ID NO: 5470387 - DNA, 15 bp, Homo sapiens
ccacctccgccagac

SEQ ID NO: 5470388 - DNA, 18 bp, Homo sapiens
ccacctccgccagacccc

SEQ ID NO: 5470389 - DNA, 19 bp, Homo sapiens
ccacctccgccccagacac

SEQ ID NO: 5470390 - DNA, 24 bp, Homo sapiens
ccacctcctaccccttcctgtcct

SEQ ID NO: 5470391 - DNA, 14 bp, Homo sapiens
ccacctcctccagc

SEQ ID NO: 5470392 - DNA, 12 bp, Homo sapiens
ccacctcctccc

SEQ ID NO: 5470393 - DNA, 22 bp, Homo sapiens
ccacctcctccccctgttctgt

SEQ ID NO: 5470394 - DNA, 15 bp, Homo sapiens
ccacctcctctcttg

SEQ ID NO: 5470395 - DNA, 21 bp, Homo sapiens
ccacctcctctgccagcagga

SEQ ID NO: 5470396 - DNA, 15 bp, Homo sapiens
ccacctcctgcggct

SEQ ID NO: 5470397 - DNA, 15 bp, Homo sapiens
ccacctcggcacaca

SEQ ID NO: 5470398 - DNA, 15 bp, Homo sapiens
ccacctcggcctccc

SEQ ID NO: 5470399 - DNA, 18 bp, Homo sapiens
ccacctcggcctcccaaa

SEQ ID NO: 5470400 - DNA, 18 bp, Homo sapiens
ccacctcggcctcccaga

SEQ ID NO: 5470401 - DNA, 19 bp, Homo sapiens
ccacctcggtcactccaac

SEQ ID NO: 5470402 - DNA, 19 bp, Homo sapiens
ccacctctcacgggccctg

SEQ ID NO: 5470403 - DNA, 22 bp, Homo sapiens
ccacctctcacgggccctgccc

SEQ ID NO: 5470404 - DNA, 17 bp, Homo sapiens
ccacctctccaagggct

SEQ ID NO: 5470405 - DNA, 13 bp, Homo sapiens
ccacctctcccag

SEQ ID NO: 5470406 - DNA, 14 bp, Homo sapiens
ccacctctcccagc

SEQ ID NO: 5470407 - DNA, 13 bp, Homo sapiens
ccacctctccctg

SEQ ID NO: 5470408 - DNA, 18 bp, Homo sapiens
ccacctctccctgaccct

SEQ ID NO: 5470409 - DNA, 16 bp, Homo sapiens
ccacctctccctgcat

SEQ ID NO: 5470410 - DNA, 17 bp, Homo sapiens
ccacctctccctgcatc

SEQ ID NO: 5470411 - DNA, 19 bp, Homo sapiens
ccacctctctcactccttg

SEQ ID NO: 5470412 - DNA, 16 bp, Homo sapiens
ccacctctctgcctgt

SEQ ID NO: 5470413 - DNA, 14 bp, Homo sapiens
ccacctctgcctct

SEQ ID NO: 5470414 - DNA, 20 bp, Homo sapiens
ccacctctgcggaccccagc

SEQ ID NO: 5470415 - DNA, 14 bp, Homo sapiens
ccacctctgctgcc

SEQ ID NO: 5470416 - DNA, 17 bp, Homo sapiens
ccacctctgctgcctcc

SEQ ID NO: 5470417 - DNA, 16 bp, Homo sapiens
ccacctctggccctgt

SEQ ID NO: 5470418 - DNA, 18 bp, Homo sapiens
ccacctctggccctgttg

SEQ ID NO: 5470419 - DNA, 22 bp, Homo sapiens
ccacctctgggtccttggctcc

SEQ ID NO: 5470420 - DNA, 11 bp, Homo sapiens
ccacctctggt

SEQ ID NO: 5470421 - DNA, 14 bp, Homo sapiens
ccacctctggtcca

SEQ ID NO: 5470422 - DNA, 21 bp, Homo sapiens
ccacctctggtggctcctcct

SEQ ID NO: 5470423 - DNA, 19 bp, Homo sapiens
ctcgacccagaatggagcc

SEQ ID NO: 5470424 - DNA, 13 bp, Homo sapiens
ctcgaccctgtcc

SEQ ID NO: 5470425 - DNA, 21 bp, Homo sapiens
ctcgaccctgtcccctaggga

SEQ ID NO: 5470426 - DNA, 16 bp, Homo sapiens
ctcgacctccccaccc

SEQ ID NO: 5470427 - DNA, 16 bp, Homo sapiens
ctcgacggcacgcact

SEQ ID NO: 5470428 - DNA, 20 bp, Homo sapiens
ctcgacggcacgcacttgcc

SEQ ID NO: 5470429 - DNA, 16 bp, Homo sapiens
ctcgacgtcccttgga

SEQ ID NO: 5470430 - DNA, 23 bp, Homo sapiens
ctcgacgtttacaagccccccct

SEQ ID NO: 5470431 - DNA, 13 bp, Homo sapiens
ctcgactcagcac

SEQ ID NO: 5470432 - DNA, 16 bp, Homo sapiens
ctcgactctgctgctc

SEQ ID NO: 5470433 - DNA, 22 bp, Homo sapiens
ctcgactgagctttagacagca

SEQ ID NO: 5470434 - DNA, 22 bp, Homo sapiens
ctcgactggaggaccacactca

SEQ ID NO: 5470435 - DNA, 18 bp, Homo sapiens
ctcgagagggctgagccc

SEQ ID NO: 5470436 - DNA, 19 bp, Homo sapiens
ctcgagagggctgagcccc

SEQ ID NO: 5470437 - DNA, 21 bp, Homo sapiens
ctcgagagggctgagcccctc

SEQ ID NO: 5470438 - DNA, 23 bp, Homo sapiens
ctcgagagggctgagcccctcct

SEQ ID NO: 5470439 - DNA, 23 bp, Homo sapiens
ctcgagatcccaacactgccagc

SEQ ID NO: 5470440 - DNA, 20 bp, Homo sapiens
ctcgagatgggtgctggtcc

SEQ ID NO: 5470441 - DNA, 17 bp, Homo sapiens
ctcgagcagtcctgcct

SEQ ID NO: 5470442 - DNA, 15 bp, Homo sapiens
ctcgagcatgcctgg

SEQ ID NO: 5470443 - DNA, 19 bp, Homo sapiens
ctcgagcatgcctggatgg

SEQ ID NO: 5470444 - DNA, 15 bp, Homo sapiens
ctcgagccccctgga

SEQ ID NO: 5470445 - DNA, 23 bp, Homo sapiens
ctcgagccccctggatgtcccct

SEQ ID NO: 5470446 - DNA, 15 bp, Homo sapiens
ctcgagcgccctgca

SEQ ID NO: 5470447 - DNA, 16 bp, Homo sapiens
ctcgagcgccctgcag

SEQ ID NO: 5470448 - DNA, 19 bp, Homo sapiens
ctcgagcgccctgcagacc

SEQ ID NO: 5470449 - DNA, 18 bp, Homo sapiens
ctcgagctcggggctggg

SEQ ID NO: 5470450 - DNA, 18 bp, Homo sapiens
ctcgagctctgtagcctg

SEQ ID NO: 5470451 - DNA, 15 bp, Homo sapiens
ctcgagcttggggca

SEQ ID NO: 5470452 - DNA, 17 bp, Homo sapiens
ctcgaggactgtatttg

SEQ ID NO: 5470453 - DNA, 22 bp, Homo sapiens
ctcgaggactgtatttgtgact

SEQ ID NO: 5470454 - DNA, 20 bp, Homo sapiens
ctcgaggcaccggcgctgca

SEQ ID NO: 5470455 - DNA, 17 bp, Homo sapiens
ctcgaggctggtgccag

SEQ ID NO: 5470456 - DNA, 15 bp, Homo sapiens
ctcgaggctggtggt

SEQ ID NO: 5470457 - DNA, 23 bp, Homo sapiens
ctcgaggggcccagggaagcctg

SEQ ID NO: 5470458 - DNA, 14 bp, Homo sapiens
ctcgaggggtgggc

SEQ ID NO: 5470459 - DNA, 15 bp, Homo sapiens
ctcgaggtgccttct

SEQ ID NO: 5470460 - DNA, 20 bp, Homo sapiens
ctcgaggtgccttcttcagg

SEQ ID NO: 5470461 - DNA, 13 bp, Homo sapiens
ctcgagtactgtg

SEQ ID NO: 5470462 - DNA, 17 bp, Homo sapiens
ctcgagtactgtgggca

SEQ ID NO: 5470463 - DNA, 20 bp, Homo sapiens
ctcgagtcacattctgctta

SEQ ID NO: 5470464 - DNA, 16 bp, Homo sapiens
ctcgagtccccccacc

SEQ ID NO: 5470465 - DNA, 17 bp, Homo sapiens
ctcgagtccccccaccc

SEQ ID NO: 5470466 - DNA, 22 bp, Homo sapiens
ctcgagtgaatttctaaatgtt

SEQ ID NO: 5470467 - DNA, 20 bp, Homo sapiens
ctcgagtgtttaaatgctgt

SEQ ID NO: 5470468 - DNA, 16 bp, Homo sapiens
ctcgagttacagacaa

SEQ ID NO: 5470469 - DNA, 14 bp, Homo sapiens
ctcgatgcactgac

SEQ ID NO: 5470470 - DNA, 15 bp, Homo sapiens
ctcgatgcactgacc

SEQ ID NO: 5470471 - DNA, 21 bp, Homo sapiens
ctcgatgtaagggattccttg

SEQ ID NO: 5470472 - DNA, 18 bp, Homo sapiens
ctcgatgtcctcctctgt

SEQ ID NO: 5470473 - DNA, 13 bp, Homo sapiens
ctcgatgttcatg

SEQ ID NO: 5470474 - DNA, 17 bp, Homo sapiens
ctcgattcatattgaat

SEQ ID NO: 5470475 - DNA, 18 bp, Homo sapiens
ctcgatttaaactccagc

SEQ ID NO: 5470476 - DNA, 14 bp, Homo sapiens
ctcgatttctccag

SEQ ID NO: 5470477 - DNA, 18 bp, Homo sapiens
ctcgattttgtatctgca

SEQ ID NO: 5470478 - DNA, 15 bp, Homo sapiens
ctcgcaaccctgcct

SEQ ID NO: 5470479 - DNA, 17 bp, Homo sapiens
ctcgcaaccctgcctgt

SEQ ID NO: 5470480 - DNA, 21 bp, Homo sapiens
ctcgcaagagggtctctttgt

SEQ ID NO: 5470481 - DNA, 14 bp, Homo sapiens
ctcgcacacagggc

SEQ ID NO: 5470482 - DNA, 15 bp, Homo sapiens
ctcgcacacagggct

SEQ ID NO: 5470483 - DNA, 17 bp, Homo sapiens
ctcgcacacagggctca

SEQ ID NO: 5470484 - DNA, 21 bp, Homo sapiens
ctcgcacacagggctcacagg

SEQ ID NO: 5470485 - DNA, 14 bp, Homo sapiens
ctcgcacccccact

SEQ ID NO: 5470486 - DNA, 16 bp, Homo sapiens
ctcgcacccccctgtt

SEQ ID NO: 5470487 - DNA, 17 bp, Homo sapiens
ctcgcacccccctgttc

SEQ ID NO: 5470488 - DNA, 19 bp, Homo sapiens
ctcgcacccccctgttcta

SEQ ID NO: 5470489 - DNA, 19 bp, Homo sapiens
ctcgcacctcttggctttg

SEQ ID NO: 5470490 - DNA, 15 bp, Homo sapiens
ctcgcacctgtgctg

SEQ ID NO: 5470491 - DNA, 15 bp, Homo sapiens
ctcgcacctttccaa

SEQ ID NO: 5470492 - DNA, 23 bp, Homo sapiens
ctcgcactacatctgatatcagg

SEQ ID NO: 5470493 - DNA, 13 bp, Homo sapiens
ctcgcactgccca

SEQ ID NO: 5470494 - DNA, 22 bp, Homo sapiens
ctcgcactgcccacatgggacc

SEQ ID NO: 5470495 - DNA, 17 bp, Homo sapiens
ctcgcacttgcagagga

SEQ ID NO: 5470496 - DNA, 22 bp, Homo sapiens
ctcgcacttgcagaggagccca

SEQ ID NO: 5470497 - DNA, 14 bp, Homo sapiens
ctcgcagagaggcc

SEQ ID NO: 5470498 - DNA, 20 bp, Homo sapiens
ctcgcagagaggccaggtgc

SEQ ID NO: 5470499 - DNA, 17 bp, Homo sapiens
ctcgcagcacccacagc

SEQ ID NO: 5470500 - DNA, 18 bp, Homo sapiens
ctcgcagcctgaagcctg

SEQ ID NO: 5470501 - DNA, 20 bp, Homo sapiens
ctcgcagcctgaagcctgga

SEQ ID NO: 5470502 - DNA, 20 bp, Homo sapiens
ctcgcagcctggcggggcag

SEQ ID NO: 5470503 - DNA, 21 bp, Homo sapiens
ctcgcagcctggcggggcagg

SEQ ID NO: 5470504 - DNA, 23 bp, Homo sapiens
ctcgcagcctggcggggcaggag

SEQ ID NO: 5470505 - DNA, 12 bp, Homo sapiens
ctcgcaggaaga

SEQ ID NO: 5470506 - DNA, 13 bp, Homo sapiens
ctcgcaggaagac

SEQ ID NO: 5470507 - DNA, 15 bp, Homo sapiens
ctcgcaggaccaagg

SEQ ID NO: 5470508 - DNA, 17 bp, Homo sapiens
ctcgcaggggcgctggc

SEQ ID NO: 5470509 - DNA, 16 bp, Homo sapiens
ctcgcagggtgcagga

SEQ ID NO: 5470510 - DNA, 14 bp, Homo sapiens
ctcgcatcattgca

SEQ ID NO: 5470511 - DNA, 18 bp, Homo sapiens
ctcgcatccgcctctgag

SEQ ID NO: 5470512 - DNA, 19 bp, Homo sapiens
ctcgcatccgcctctgagc

SEQ ID NO: 5470513 - DNA, 15 bp, Homo sapiens
ctcgcatcctatgct

SEQ ID NO: 5470514 - DNA, 17 bp, Homo sapiens
ctcgcatgccagagcct

SEQ ID NO: 5470515 - DNA, 14 bp, Homo sapiens
ctcgcattgacaca

SEQ ID NO: 5470516 - DNA, 17 bp, Homo sapiens
ctcgccaaggcctagga

SEQ ID NO: 5470517 - DNA, 17 bp, Homo sapiens
ctcgccacgctcagtgc

SEQ ID NO: 5470518 - DNA, 16 bp, Homo sapiens
ctcgccacggggaggg

SEQ ID NO: 5470519 - DNA, 14 bp, Homo sapiens
ctcgccagcttctc

SEQ ID NO: 5470520 - DNA, 19 bp, Homo sapiens
ctcgccagcttctcctgcg

SEQ ID NO: 5470521 - DNA, 15 bp, Homo sapiens
ctcgccagcttggct

SEQ ID NO: 5470522 - DNA, 24 bp, Homo sapiens
ctcgccatgatcagacatacagct

SEQ ID NO: 5470523 - DNA, 19 bp, Homo sapiens
ctcgccatttcctcacgtg

SEQ ID NO: 5470524 - DNA, 20 bp, Homo sapiens
ctcgccatttcctcacgtgc

SEQ ID NO: 5470525 - DNA, 18 bp, Homo sapiens
ctcgcccaccgcatgccc

SEQ ID NO: 5470526 - DNA, 21 bp, Homo sapiens
ctcgcccatcagtgccagccc

SEQ ID NO: 5470527 - DNA, 17 bp, Homo sapiens
ctcgccccaaagttgct

SEQ ID NO: 5470528 - DNA, 19 bp, Homo sapiens
ctcgccccaaagttgctca

SEQ ID NO: 5470529 - DNA, 14 bp, Homo sapiens
ctcgccccacctcc

SEQ ID NO: 5470530 - DNA, 18 bp, Homo sapiens
ctcgccccacctccacct

SEQ ID NO: 5470531 - DNA, 14 bp, Homo sapiens
ctcgccccagcagg

SEQ ID NO: 5470532 - DNA, 12 bp, Homo sapiens
ctcgccccagcc

SEQ ID NO: 5470533 - DNA, 19 bp, Homo sapiens
ctcgccccagccaagcctg

SEQ ID NO: 5470534 - DNA, 13 bp, Homo sapiens
ctcgccccagcct

SEQ ID NO: 5470535 - DNA, 15 bp, Homo sapiens
ctcgccccatccctg

SEQ ID NO: 5470536 - DNA, 13 bp, Homo sapiens
ctcgcccccacca

SEQ ID NO: 5470537 - DNA, 18 bp, Homo sapiens
ctcgcccccacttttcta

SEQ ID NO: 5470538 - DNA, 16 bp, Homo sapiens
ctcgcccctccagtgt

SEQ ID NO: 5470539 - DNA, 18 bp, Homo sapiens
ctcgcccctccagtgttg

SEQ ID NO: 5470540 - DNA, 20 bp, Homo sapiens
ctcgcccctcccctcagcct

SEQ ID NO: 5470541 - DNA, 21 bp, Homo sapiens
ctcgcccctcccctcagcctg

SEQ ID NO: 5470542 - DNA, 16 bp, Homo sapiens
ctcgcccctggcagag

SEQ ID NO: 5470543 - DNA, 12 bp, Homo sapiens
ctcgccccttcc

SEQ ID NO: 5470544 - DNA, 15 bp, Homo sapiens
ctcgcccgcccactg

SEQ ID NO: 5470545 - DNA, 15 bp, Homo sapiens
ctcgccctcctttct

SEQ ID NO: 5470546 - DNA, 19 bp, Homo sapiens
ctcgccctcctttctgtgc

SEQ ID NO: 5470547 - DNA, 19 bp, Homo sapiens
ctcgccctctctcaccagc

SEQ ID NO: 5470548 - DNA, 21 bp, Homo sapiens
ctcgccctctctcaccagcct

SEQ ID NO: 5470549 - DNA, 22 bp, Homo sapiens
ctcgccctctctcaccagcctt

SEQ ID NO: 5470550 - DNA, 20 bp, Homo sapiens
ctcgccctgcggtagatggg

SEQ ID NO: 5470551 - DNA, 18 bp, Homo sapiens
ctcgccctggccagggcc

SEQ ID NO: 5470552 - DNA, 13 bp, Homo sapiens
ctcgccctgtccc

SEQ ID NO: 5470553 - DNA, 17 bp, Homo sapiens
ctcgccctgtccctccc

SEQ ID NO: 5470554 - DNA, 19 bp, Homo sapiens
ctcgccctgtccctcccac

SEQ ID NO: 5470555 - DNA, 14 bp, Homo sapiens
ctcgccctgtgagg

SEQ ID NO: 5470556 - DNA, 16 bp, Homo sapiens
ctcgccctgtgccctc

SEQ ID NO: 5470557 - DNA, 17 bp, Homo sapiens
ctcgcccttcagcccac

SEQ ID NO: 5470558 - DNA, 22 bp, Homo sapiens
ctcgccgagctgtcggagggct

SEQ ID NO: 5470559 - DNA, 17 bp, Homo sapiens
ctcgccgggccattctg

SEQ ID NO: 5470560 - DNA, 19 bp, Homo sapiens
ctcgccgtccctcccaggt

SEQ ID NO: 5470561 - DNA, 16 bp, Homo sapiens
ctcgccgtctgtgaat

SEQ ID NO: 5470562 - DNA, 19 bp, Homo sapiens
ctcgcctaccaatctctgc

SEQ ID NO: 5470563 - DNA, 19 bp, Homo sapiens
ctcgcctactaagtaccct

SEQ ID NO: 5470564 - DNA, 16 bp, Homo sapiens
ctcgcctaggcctgtg

SEQ ID NO: 5470565 - DNA, 17 bp, Homo sapiens
ctcgcctatcttaggta

SEQ ID NO: 5470566 - DNA, 17 bp, Homo sapiens
ctcgcctcactttccac

SEQ ID NO: 5470567 - DNA, 21 bp, Homo sapiens
ctcgcctcactttccaccaag

SEQ ID NO: 5470568 - DNA, 11 bp, Homo sapiens
ctcgcctcagc

SEQ ID NO: 5470569 - DNA, 17 bp, Homo sapiens
ctcgcctcagcctgatc

SEQ ID NO: 5470570 - DNA, 17 bp, Homo sapiens
ctcgcctcctactctga

SEQ ID NO: 5470571 - DNA, 18 bp, Homo sapiens
ctcgcctcctactctgag

SEQ ID NO: 5470572 - DNA, 12 bp, Homo sapiens
ctcgcctcctcc

SEQ ID NO: 5470573 - DNA, 13 bp, Homo sapiens
ctcgcctcctcct

SEQ ID NO: 5470574 - DNA, 18 bp, Homo sapiens
ctcgcctcctcctcctgc

SEQ ID NO: 5470575 - DNA, 19 bp, Homo sapiens
ctcgcctcctcctcctgcc

SEQ ID NO: 5470576 - DNA, 20 bp, Homo sapiens
ctcgcctcctcctcctgccc

SEQ ID NO: 5470577 - DNA, 14 bp, Homo sapiens
ctcgcctctcccac

SEQ ID NO: 5470578 - DNA, 13 bp, Homo sapiens
ctcgcctgaggga

SEQ ID NO: 5470579 - DNA, 18 bp, Homo sapiens
ctcgcctggaaacagagg

SEQ ID NO: 5470580 - DNA, 16 bp, Homo sapiens
ctcgcctggcctgagg

SEQ ID NO: 5470581 - DNA, 20 bp, Homo sapiens
ctcgcctggcctgaggtctc

SEQ ID NO: 5470582 - DNA, 21 bp, Homo sapiens
ctcgcctgggaaattgctcca

SEQ ID NO: 5470583 - DNA, 16 bp, Homo sapiens
ctcgcctgggcccagg

SEQ ID NO: 5470584 - DNA, 19 bp, Homo sapiens
ctcgcctgggcccaggctc

SEQ ID NO: 5470585 - DNA, 21 bp, Homo sapiens
ctcgcctgggcccaggctctg

SEQ ID NO: 5470586 - DNA, 22 bp, Homo sapiens
ctcgcctgggcccaggctctgg

SEQ ID NO: 5470587 - DNA, 16 bp, Homo sapiens
ctcgccttccctcctg

SEQ ID NO: 5470588 - DNA, 17 bp, Homo sapiens
ctcgccttccctcctgc

SEQ ID NO: 5470589 - DNA, 15 bp, Homo sapiens
ctcgccttcctgcag

SEQ ID NO: 5470590 - DNA, 14 bp, Homo sapiens
ctcgcgcccctgtc

SEQ ID NO: 5470591 - DNA, 16 bp, Homo sapiens
ctcgcgcgactgagaa

SEQ ID NO: 5470592 - DNA, 21 bp, Homo sapiens
ctcgcggcctcttctctcaga

SEQ ID NO: 5470593 - DNA, 13 bp, Homo sapiens
ctcgctagtcagt

SEQ ID NO: 5470594 - DNA, 14 bp, Homo sapiens
ctcgctcagaagag

SEQ ID NO: 5470595 - DNA, 13 bp, Homo sapiens
ctcgctcaggtga

SEQ ID NO: 5470596 - DNA, 20 bp, Homo sapiens
ctcgctcagtcagtgcacta

SEQ ID NO: 5470597 - DNA, 24 bp, Homo sapiens
ctcgctccaactccaacatccact

SEQ ID NO: 5470598 - DNA, 17 bp, Homo sapiens
ctcgctccccactctgc

SEQ ID NO: 5470599 - DNA, 16 bp, Homo sapiens
ctcgctcccctctgcc

SEQ ID NO: 5470600 - DNA, 17 bp, Homo sapiens
ctcgctcccctctggaa

SEQ ID NO: 5470601 - DNA, 17 bp, Homo sapiens
ctcgggctcctgtgccc

SEQ ID NO: 5470602 - DNA, 18 bp, Homo sapiens
ctcgggctggagcctccg

SEQ ID NO: 5470603 - DNA, 23 bp, Homo sapiens
ctcgggctggtgtcttgagacca

SEQ ID NO: 5470604 - DNA, 18 bp, Homo sapiens
ctcggggacaccagagct

SEQ ID NO: 5470605 - DNA, 18 bp, Homo sapiens
ctcggggagagggggagg

SEQ ID NO: 5470606 - DNA, 15 bp, Homo sapiens
ctcggggatggggag

SEQ ID NO: 5470607 - DNA, 20 bp, Homo sapiens
ctcggggcccttggggcctg

SEQ ID NO: 5470608 - DNA, 15 bp, Homo sapiens
ctcggggctccaggc

SEQ ID NO: 5470609 - DNA, 16 bp, Homo sapiens
ctcggggctccaggct

SEQ ID NO: 5470610 - DNA, 14 bp, Homo sapiens
ctcggggctcccca

SEQ ID NO: 5470611 - DNA, 16 bp, Homo sapiens
ctcggggctgggcaga

SEQ ID NO: 5470612 - DNA, 14 bp, Homo sapiens
ctcgggggcctgtg

SEQ ID NO: 5470613 - DNA, 16 bp, Homo sapiens
ctcgggggcgcctgga

SEQ ID NO: 5470614 - DNA, 23 bp, Homo sapiens
ctcgggggcgcctggagggatgc

SEQ ID NO: 5470615 - DNA, 16 bp, Homo sapiens
ctcgggggctcttccc

SEQ ID NO: 5470616 - DNA, 18 bp, Homo sapiens
ctcgggggctgtctcaga

SEQ ID NO: 5470617 - DNA, 16 bp, Homo sapiens
ctcggggggctctgcc

SEQ ID NO: 5470618 - DNA, 18 bp, Homo sapiens
ctcggggggctctgcctt

SEQ ID NO: 5470619 - DNA, 18 bp, Homo sapiens
ctcggggggtcacaggcc

SEQ ID NO: 5470620 - DNA, 23 bp, Homo sapiens
ctcgggggtggagtgagactgac

SEQ ID NO: 5470621 - DNA, 19 bp, Homo sapiens
ctcggggtaaaaagtggct

SEQ ID NO: 5470622 - DNA, 16 bp, Homo sapiens
ctcggggtgcacagga

SEQ ID NO: 5470623 - DNA, 16 bp, Homo sapiens
ctcgggtcaccctgct

SEQ ID NO: 5470624 - DNA, 18 bp, Homo sapiens
ctcgggtctccccacctg

SEQ ID NO: 5470625 - DNA, 23 bp, Homo sapiens
ctcgggtgcgtgtgtttgtatgt

SEQ ID NO: 5470626 - DNA, 16 bp, Homo sapiens
ctcgggtggggcctgc

SEQ ID NO: 5470627 - DNA, 19 bp, Homo sapiens
ctcgggtggggctggtggg

SEQ ID NO: 5470628 - DNA, 21 bp, Homo sapiens
ctcggtacccggggcccaggg

SEQ ID NO: 5470629 - DNA, 19 bp, Homo sapiens
ctcggtagcagaggccctg

SEQ ID NO: 5470630 - DNA, 12 bp, Homo sapiens
ctcggtatctgg

SEQ ID NO: 5470631 - DNA, 22 bp, Homo sapiens
ctcggtatctggcttccctgga

SEQ ID NO: 5470632 - DNA, 23 bp, Homo sapiens
ctcggtatctggcttccctggaa

SEQ ID NO: 5470633 - DNA, 13 bp, Homo sapiens
ctcggtcactgag

SEQ ID NO: 5470634 - DNA, 20 bp, Homo sapiens
ctcggtctccaccccagggt

SEQ ID NO: 5470635 - DNA, 20 bp, Homo sapiens
ctcggtctcccaaagtgctg

SEQ ID NO: 5470636 - DNA, 23 bp, Homo sapiens
ctcggtctcccttccgtccatcc

SEQ ID NO: 5470637 - DNA, 14 bp, Homo sapiens
ctcggtgagccggg

SEQ ID NO: 5470638 - DNA, 17 bp, Homo sapiens
ctcggtgatgccttccg

SEQ ID NO: 5470639 - DNA, 21 bp, Homo sapiens
ctcggtgcagagtgcagaggc

SEQ ID NO: 5470640 - DNA, 22 bp, Homo sapiens
ctcggtgcagagtgcagaggcg

SEQ ID NO: 5470641 - DNA, 13 bp, Homo sapiens
ctcggtggccatg

SEQ ID NO: 5470642 - DNA, 16 bp, Homo sapiens
ctcggtggccatgctt

SEQ ID NO: 5470643 - DNA, 18 bp, Homo sapiens
ctcggtggccatgcttct

SEQ ID NO: 5470644 - DNA, 19 bp, Homo sapiens
ctcggtggccatgcttctt

SEQ ID NO: 5470645 - DNA, 15 bp, Homo sapiens
ctcggtggctctggg

SEQ ID NO: 5470646 - DNA, 19 bp, Homo sapiens
ctcggtgggccagagctga

SEQ ID NO: 5470647 - DNA, 11 bp, Homo sapiens
ctcggtggtac

SEQ ID NO: 5470648 - DNA, 13 bp, Homo sapiens
ctcggtgtcccca

SEQ ID NO: 5470649 - DNA, 21 bp, Homo sapiens
ctcggtgtccccaccatctgc

SEQ ID NO: 5470650 - DNA, 15 bp, Homo sapiens
ctcggtgtggcgtga

SEQ ID NO: 5470651 - DNA, 23 bp, Homo sapiens
ctcggtgtgtggccgcctggcag

SEQ ID NO: 5470652 - DNA, 20 bp, Homo sapiens
ctcggttctgcgccacttcc

SEQ ID NO: 5470653 - DNA, 22 bp, Homo sapiens
ctcggtttgccaaaattcattt

SEQ ID NO: 5470654 - DNA, 14 bp, Homo sapiens
ctcgtaactggttt

SEQ ID NO: 5470655 - DNA, 20 bp, Homo sapiens
ctcgtaatagcttctgtgtg

SEQ ID NO: 5470656 - DNA, 16 bp, Homo sapiens
ctcgtaccagccagga

SEQ ID NO: 5470657 - DNA, 14 bp, Homo sapiens
ctcgtagagtgacc

SEQ ID NO: 5470658 - DNA, 20 bp, Homo sapiens
ctcgtagagtgacctcggac

SEQ ID NO: 5470659 - DNA, 15 bp, Homo sapiens
ctcgtagatgctgcc

SEQ ID NO: 5470660 - DNA, 13 bp, Homo sapiens
ctcgtaggcctgc

SEQ ID NO: 5470661 - DNA, 13 bp, Homo sapiens
ctcgtatagcatg

SEQ ID NO: 5470662 - DNA, 21 bp, Homo sapiens
ctcgtatcccaaatctgtcag

SEQ ID NO: 5470663 - DNA, 24 bp, Homo sapiens
ctcgtcaagagcatgcacatgctg

SEQ ID NO: 5470664 - DNA, 17 bp, Homo sapiens
ctcgtcagccacctggg

SEQ ID NO: 5470665 - DNA, 15 bp, Homo sapiens
ctcgtcaggctgcca

SEQ ID NO: 5470666 - DNA, 16 bp, Homo sapiens
ctcgtcaggctgccag

SEQ ID NO: 5470667 - DNA, 14 bp, Homo sapiens
ctcgtcagtctctc

SEQ ID NO: 5470668 - DNA, 22 bp, Homo sapiens
ctcgtcatcatttttccttccc

SEQ ID NO: 5470669 - DNA, 19 bp, Homo sapiens
ctcgtccaaggcagttctg

SEQ ID NO: 5470670 - DNA, 20 bp, Homo sapiens
ctcgtccaagggacagccca

SEQ ID NO: 5470671 - DNA, 15 bp, Homo sapiens
ctcgtccacaggggc

SEQ ID NO: 5470672 - DNA, 16 bp, Homo sapiens
ctcgtccacaggggca

SEQ ID NO: 5470673 - DNA, 18 bp, Homo sapiens
ctcgtccacaggggcagg

SEQ ID NO: 5470674 - DNA, 20 bp, Homo sapiens
ctcgtccacaggggcaggcc

SEQ ID NO: 5470675 - DNA, 23 bp, Homo sapiens
ctcgtccacaggggcaggcctgg

SEQ ID NO: 5470676 - DNA, 23 bp, Homo sapiens
ctcgtccaccccccacacacact

SEQ ID NO: 5470677 - DNA, 15 bp, Homo sapiens
ctcgtcccagccctc

SEQ ID NO: 5470678 - DNA, 15 bp, Homo sapiens
ctcgtccccattgct

SEQ ID NO: 5470679 - DNA, 13 bp, Homo sapiens
ctcgtccccctcc

SEQ ID NO: 5470680 - DNA, 14 bp, Homo sapiens
ctcgtccccctccc

SEQ ID NO: 5470681 - DNA, 21 bp, Homo sapiens
ctcgtccccctccctgcccaa

SEQ ID NO: 5470682 - DNA, 19 bp, Homo sapiens
ctcgtcccgagggcgcctg

SEQ ID NO: 5470683 - DNA, 22 bp, Homo sapiens
ctcgtcccgagggcgcctgggt

SEQ ID NO: 5470684 - DNA, 16 bp, Homo sapiens
ctcgtccctctgctcc

SEQ ID NO: 5470685 - DNA, 18 bp, Homo sapiens
ctcgtccctctgctccgt

SEQ ID NO: 5470686 - DNA, 13 bp, Homo sapiens
ctcgtccggcctg

SEQ ID NO: 5470687 - DNA, 15 bp, Homo sapiens
ctcgtccggcctgca

SEQ ID NO: 5470688 - DNA, 17 bp, Homo sapiens
ctcgtccggcctgcagc

SEQ ID NO: 5470689 - DNA, 20 bp, Homo sapiens
ctcgtccggcctgcagccca

SEQ ID NO: 5470690 - DNA, 14 bp, Homo sapiens
ctcgtcctccccct

SEQ ID NO: 5470691 - DNA, 20 bp, Homo sapiens
ctcgtcctccccctgccagt

SEQ ID NO: 5470692 - DNA, 24 bp, Homo sapiens
ctcgtcctccccctgccagtgcct

SEQ ID NO: 5470693 - DNA, 16 bp, Homo sapiens
ctcgtcttcagctgca

SEQ ID NO: 5470694 - DNA, 14 bp, Homo sapiens
ctcgtctttcagcg

SEQ ID NO: 5470695 - DNA, 16 bp, Homo sapiens
ctcgtctttcagcgag

SEQ ID NO: 5470696 - DNA, 13 bp, Homo sapiens
ctcgtctttccca

SEQ ID NO: 5470697 - DNA, 22 bp, Homo sapiens
ctcgtctttgcttgtcctgctc

SEQ ID NO: 5470698 - DNA, 14 bp, Homo sapiens
ctcgtgacagcctc

SEQ ID NO: 5470699 - DNA, 14 bp, Homo sapiens
ctcgtgacccagtg

SEQ ID NO: 5470700 - DNA, 15 bp, Homo sapiens
ctcgtgaggggcaag

SEQ ID NO: 5470701 - DNA, 20 bp, Homo sapiens
ctcgtgagtcatttaaatgt

SEQ ID NO: 5470702 - DNA, 19 bp, Homo sapiens
ctcgtgatccgcctgcctc

SEQ ID NO: 5470703 - DNA, 13 bp, Homo sapiens
ctcgtgcagagct

SEQ ID NO: 5470704 - DNA, 18 bp, Homo sapiens
ctcgtgcagagctggggc

SEQ ID NO: 5470705 - DNA, 14 bp, Homo sapiens
ctcgtgcatgtaat

SEQ ID NO: 5470706 - DNA, 20 bp, Homo sapiens
ctcgtgcattaaaatttctt

SEQ ID NO: 5470707 - DNA, 21 bp, Homo sapiens
ctcgtgcattaaaatttctta

SEQ ID NO: 5470708 - DNA, 12 bp, Homo sapiens
ctcgtgccagca

SEQ ID NO: 5470709 - DNA, 17 bp, Homo sapiens
ctcgtgccagcagcctc

SEQ ID NO: 5470710 - DNA, 19 bp, Homo sapiens
ctcgtgccagcagcctcgc

SEQ ID NO: 5470711 - DNA, 21 bp, Homo sapiens
ctcgtgccagcagcctcgcac

SEQ ID NO: 5470712 - DNA, 22 bp, Homo sapiens
ctcgtgccagtcgcgctgcctg

SEQ ID NO: 5470713 - DNA, 24 bp, Homo sapiens
ctcgtgccagtcgcgctgcctgtg

SEQ ID NO: 5470714 - DNA, 17 bp, Homo sapiens
ctcgtgccatgatctgt

SEQ ID NO: 5470715 - DNA, 18 bp, Homo sapiens
ctcgtgcgcatctcagaa

SEQ ID NO: 5470716 - DNA, 15 bp, Homo sapiens
ctcgtggagctcgcc

SEQ ID NO: 5470717 - DNA, 23 bp, Homo sapiens
ctcgtggagctcgcccctcccct

SEQ ID NO: 5470718 - DNA, 12 bp, Homo sapiens
ctcgtggccagc

SEQ ID NO: 5470719 - DNA, 18 bp, Homo sapiens
ctcgtggccagcccggct

SEQ ID NO: 5470720 - DNA, 20 bp, Homo sapiens
ctcgtggccttccccagcct

SEQ ID NO: 5470721 - DNA, 14 bp, Homo sapiens
ctcgtgggctctgg

SEQ ID NO: 5470722 - DNA, 15 bp, Homo sapiens
ctcgtgggctctggc

SEQ ID NO: 5470723 - DNA, 16 bp, Homo sapiens
ctcgtgggctctggct

SEQ ID NO: 5470724 - DNA, 11 bp, Homo sapiens
ctcgtgggtcc

SEQ ID NO: 5470725 - DNA, 14 bp, Homo sapiens
ctcgtgggttcttc

SEQ ID NO: 5470726 - DNA, 16 bp, Homo sapiens
ctcgtggtccccaaca

SEQ ID NO: 5470727 - DNA, 17 bp, Homo sapiens
ctcgtggtgaggctgac

SEQ ID NO: 5470728 - DNA, 20 bp, Homo sapiens
ctcgtggttggaagcctccc

SEQ ID NO: 5470729 - DNA, 15 bp, Homo sapiens
ctcgtgtatcctggg

SEQ ID NO: 5470730 - DNA, 21 bp, Homo sapiens
ctcgtgtcagtaatttatatg

SEQ ID NO: 5470731 - DNA, 13 bp, Homo sapiens
ctcgtgtcctgct

SEQ ID NO: 5470732 - DNA, 21 bp, Homo sapiens
ctcgtgtcctgctagctgtct

SEQ ID NO: 5470733 - DNA, 15 bp, Homo sapiens
ctcgtgtctggcaca

SEQ ID NO: 5470734 - DNA, 13 bp, Homo sapiens
ctcgtgtgcatga

SEQ ID NO: 5470735 - DNA, 18 bp, Homo sapiens
ctcgtgttcgctggctga

SEQ ID NO: 5470736 - DNA, 14 bp, Homo sapiens
ctcgtgtttcacag

SEQ ID NO: 5470737 - DNA, 16 bp, Homo sapiens
ctcgttaggacaaggc

SEQ ID NO: 5470738 - DNA, 16 bp, Homo sapiens
ctcgttcaaaacattc

SEQ ID NO: 5470739 - DNA, 23 bp, Homo sapiens
ctcgttcctacctggctggagac

SEQ ID NO: 5470740 - DNA, 14 bp, Homo sapiens
ctcgttctccctgg

SEQ ID NO: 5470741 - DNA, 16 bp, Homo sapiens
ctcgttctccctggga

SEQ ID NO: 5470742 - DNA, 16 bp, Homo sapiens
ctcgttctccttcccc

SEQ ID NO: 5470743 - DNA, 23 bp, Homo sapiens
ctcgttctccttccccatttcca

SEQ ID NO: 5470744 - DNA, 20 bp, Homo sapiens
ctcgttctcgtgacccagtg

SEQ ID NO: 5470745 - DNA, 15 bp, Homo sapiens
ctcgttcttatttaa

SEQ ID NO: 5470746 - DNA, 23 bp, Homo sapiens
ctcgttcttatttaatctccatt

SEQ ID NO: 5470747 - DNA, 19 bp, Homo sapiens
ctcgttgcctctgattttc

SEQ ID NO: 5470748 - DNA, 16 bp, Homo sapiens
ctcgttggatgtctgt

SEQ ID NO: 5470749 - DNA, 21 bp, Homo sapiens
ctcgttgggccgctctgattt

SEQ ID NO: 5470750 - DNA, 16 bp, Homo sapiens
ctcgtttagtgccaat

SEQ ID NO: 5470751 - DNA, 12 bp, Homo sapiens
ctcgtttgatag

SEQ ID NO: 5470752 - DNA, 14 bp, Homo sapiens
ctcgtttgggagtg

SEQ ID NO: 5470753 - DNA, 16 bp, Homo sapiens
ctcgttttgggccaga

SEQ ID NO: 5470754 - DNA, 23 bp, Homo sapiens
ctcgttttgggtactttctatct

SEQ ID NO: 5470755 - DNA, 19 bp, Homo sapiens
ctcgtttttcagcaccccc

SEQ ID NO: 5470756 - DNA, 23 bp, Homo sapiens
ctctaaaaaaataaaaatagaaa

SEQ ID NO: 5470757 - DNA, 19 bp, Homo sapiens
ctctaaaaagaagccacag

SEQ ID NO: 5470758 - DNA, 18 bp, Homo sapiens
ctctaaaaataaaatgat

SEQ ID NO: 5470759 - DNA, 20 bp, Homo sapiens
ctctaaaagatcctttttaa

SEQ ID NO: 5470760 - DNA, 16 bp, Homo sapiens
ctctaaaaggttcagg

SEQ ID NO: 5470761 - DNA, 17 bp, Homo sapiens
ctctaaaaggttcaggg

SEQ ID NO: 5470762 - DNA, 23 bp, Homo sapiens
ctctaaaataggtaaatgtattt

SEQ ID NO: 5470763 - DNA, 18 bp, Homo sapiens
ctctaaaatggacatttt

SEQ ID NO: 5470764 - DNA, 15 bp, Homo sapiens
ctctaaaattataaa

SEQ ID NO: 5470765 - DNA, 15 bp, Homo sapiens
ctctaaaattctagt

SEQ ID NO: 5470766 - DNA, 16 bp, Homo sapiens
ctctaaacacacaagt

SEQ ID NO: 5470767 - DNA, 13 bp, Homo sapiens
ctctaaactgttt

SEQ ID NO: 5470768 - DNA, 21 bp, Homo sapiens
ctctaaacttccctctagttg

SEQ ID NO: 5470769 - DNA, 18 bp, Homo sapiens
ctctaaagaaaaatgcct

SEQ ID NO: 5470770 - DNA, 14 bp, Homo sapiens
ctctaaagaaactt

SEQ ID NO: 5470771 - DNA, 14 bp, Homo sapiens
ctctaaagaccaaa

SEQ ID NO: 5470772 - DNA, 17 bp, Homo sapiens
ctctaaagccaagcact

SEQ ID NO: 5470773 - DNA, 17 bp, Homo sapiens
ctctaaagtagcaactg

SEQ ID NO: 5470774 - DNA, 15 bp, Homo sapiens
ctctaaataaagacg

SEQ ID NO: 5470775 - DNA, 23 bp, Homo sapiens
ctctaaatactgagaaaacctgt

SEQ ID NO: 5470776 - DNA, 22 bp, Homo sapiens
ctctaaatgaggggcctcaggt

SEQ ID NO: 5470777 - DNA, 13 bp, Homo sapiens
ctctaacaaatga

SEQ ID NO: 5470778 - DNA, 22 bp, Homo sapiens
ctctattttacttttctgccaa

SEQ ID NO: 5470779 - DNA, 13 bp, Homo sapiens
ctctattttgtga

SEQ ID NO: 5470780 - DNA, 15 bp, Homo sapiens
ctctattttgtgatg

SEQ ID NO: 5470781 - DNA, 22 bp, Homo sapiens
ctctatttttgtaaaaagggaa

SEQ ID NO: 5470782 - DNA, 13 bp, Homo sapiens
ctctatttttgtt

SEQ ID NO: 5470783 - DNA, 23 bp, Homo sapiens
ctctatttttgttaatcatcttc

SEQ ID NO: 5470784 - DNA, 15 bp, Homo sapiens
ctctatttttgttgg

SEQ ID NO: 5470785 - DNA, 23 bp, Homo sapiens
ctctcaaaacaatattactttgt

SEQ ID NO: 5470786 - DNA, 23 bp, Homo sapiens
ctctcaaaagagaaaaacaaaac

SEQ ID NO: 5470787 - DNA, 19 bp, Homo sapiens
ctctcaaaagtctattttt

SEQ ID NO: 5470788 - DNA, 16 bp, Homo sapiens
ctctcaaacctggcag

SEQ ID NO: 5470789 - DNA, 17 bp, Homo sapiens
ctctcaaacctggcaga

SEQ ID NO: 5470790 - DNA, 20 bp, Homo sapiens
ctctcaaacggcaacattcc

SEQ ID NO: 5470791 - DNA, 15 bp, Homo sapiens
ctctcaaagacccca

SEQ ID NO: 5470792 - DNA, 21 bp, Homo sapiens
ctctcaaagccatgtgtggag

SEQ ID NO: 5470793 - DNA, 16 bp, Homo sapiens
ctctcaaatccctctc

SEQ ID NO: 5470794 - DNA, 13 bp, Homo sapiens
ctctcaaatgtga

SEQ ID NO: 5470795 - DNA, 20 bp, Homo sapiens
ctctcaaatgtgtgttcctg

SEQ ID NO: 5470796 - DNA, 15 bp, Homo sapiens
ctctcaaattcagct

SEQ ID NO: 5470797 - DNA, 18 bp, Homo sapiens
ctctcaaattcagctctg

SEQ ID NO: 5470798 - DNA, 18 bp, Homo sapiens
ctctcaaccttggccttc

SEQ ID NO: 5470799 - DNA, 16 bp, Homo sapiens
ctctcaagagtgctga

SEQ ID NO: 5470800 - DNA, 15 bp, Homo sapiens
ctctcaagctagcca

SEQ ID NO: 5470801 - DNA, 21 bp, Homo sapiens
ctctcaagctagtgtttctag

SEQ ID NO: 5470802 - DNA, 14 bp, Homo sapiens
ctctcaaggcttgg

SEQ ID NO: 5470803 - DNA, 23 bp, Homo sapiens
ctctcaaggcttggagaggtatg

SEQ ID NO: 5470804 - DNA, 11 bp, Homo sapiens
ctctcaagtga

SEQ ID NO: 5470805 - DNA, 17 bp, Homo sapiens
ctctcaataaaattata

SEQ ID NO: 5470806 - DNA, 10 bp, Homo sapiens
ctctcaatat

SEQ ID NO: 5470807 - DNA, 19 bp, Homo sapiens
ctctcaatattcaataaag

SEQ ID NO: 5470808 - DNA, 21 bp, Homo sapiens
ctctcaatattcaataaagct

SEQ ID NO: 5470809 - DNA, 16 bp, Homo sapiens
ctctcaatccctttgc

SEQ ID NO: 5470810 - DNA, 19 bp, Homo sapiens
ctctcaatgctgtttgggt

SEQ ID NO: 5470811 - DNA, 13 bp, Homo sapiens
ctctcaattaaag

SEQ ID NO: 5470812 - DNA, 19 bp, Homo sapiens
ctctcaatttttggttgaa

SEQ ID NO: 5470813 - DNA, 13 bp, Homo sapiens
ctctcacacacac

SEQ ID NO: 5470814 - DNA, 14 bp, Homo sapiens
ctctcacacacata

SEQ ID NO: 5470815 - DNA, 21 bp, Homo sapiens
ctctcacacacatagattaat

SEQ ID NO: 5470816 - DNA, 13 bp, Homo sapiens
ctctcacactgaa

SEQ ID NO: 5470817 - DNA, 14 bp, Homo sapiens
ctctcacagacagg

SEQ ID NO: 5470818 - DNA, 11 bp, Homo sapiens
ctctcacagat

SEQ ID NO: 5470819 - DNA, 12 bp, Homo sapiens
ctctcacagata

SEQ ID NO: 5470820 - DNA, 17 bp, Homo sapiens
ctctcacagctgagttg

SEQ ID NO: 5470821 - DNA, 20 bp, Homo sapiens
ctctcacaggcagctctgag

SEQ ID NO: 5470822 - DNA, 22 bp, Homo sapiens
ctctcacaggcagctctgagcc

SEQ ID NO: 5470823 - DNA, 22 bp, Homo sapiens
ctctcacatgtttagagttgca

SEQ ID NO: 5470824 - DNA, 19 bp, Homo sapiens
ctctcaccatgatgtgaag

SEQ ID NO: 5470825 - DNA, 16 bp, Homo sapiens
ctctcaccatttggat

SEQ ID NO: 5470826 - DNA, 13 bp, Homo sapiens
ctctcacccacca

SEQ ID NO: 5470827 - DNA, 14 bp, Homo sapiens
ctctcacccaccag

SEQ ID NO: 5470828 - DNA, 23 bp, Homo sapiens
ctctcacccagaatccctctaac

SEQ ID NO: 5470829 - DNA, 13 bp, Homo sapiens
ctctcaccccact

SEQ ID NO: 5470830 - DNA, 15 bp, Homo sapiens
ctctcaccccactcc

SEQ ID NO: 5470831 - DNA, 19 bp, Homo sapiens
ctctcaccccactcctgtc

SEQ ID NO: 5470832 - DNA, 13 bp, Homo sapiens
ctctcacccccat

SEQ ID NO: 5470833 - DNA, 22 bp, Homo sapiens
ctctcaccccccgacctggctg

SEQ ID NO: 5470834 - DNA, 19 bp, Homo sapiens
ctctcacccgggactctcc

SEQ ID NO: 5470835 - DNA, 15 bp, Homo sapiens
ctctcacctcagcct

SEQ ID NO: 5470836 - DNA, 13 bp, Homo sapiens
ctctcacctcgtg

SEQ ID NO: 5470837 - DNA, 14 bp, Homo sapiens
ctctcacctctagg

SEQ ID NO: 5470838 - DNA, 18 bp, Homo sapiens
ctctcacctgctcccagt

SEQ ID NO: 5470839 - DNA, 16 bp, Homo sapiens
ctctcacctgtactct

SEQ ID NO: 5470840 - DNA, 23 bp, Homo sapiens
ctctcaccttggttcctggggca

SEQ ID NO: 5470841 - DNA, 15 bp, Homo sapiens
ctctcacgggccctg

SEQ ID NO: 5470842 - DNA, 17 bp, Homo sapiens
ctctcacgggccctgcc

SEQ ID NO: 5470843 - DNA, 21 bp, Homo sapiens
ctctcactaaactttacccaa

SEQ ID NO: 5470844 - DNA, 16 bp, Homo sapiens
ctctcactagtgccaa

SEQ ID NO: 5470845 - DNA, 17 bp, Homo sapiens
ctctcactcacattttc

SEQ ID NO: 5470846 - DNA, 18 bp, Homo sapiens
ctctcactcacattttct

SEQ ID NO: 5470847 - DNA, 12 bp, Homo sapiens
ctctcactccag

SEQ ID NO: 5470848 - DNA, 22 bp, Homo sapiens
ctctcactccccagcctgggcc

SEQ ID NO: 5470849 - DNA, 23 bp, Homo sapiens
ctctcactccccagcctgggccc

SEQ ID NO: 5470850 - DNA, 18 bp, Homo sapiens
ctctcactctcttccttt

SEQ ID NO: 5470851 - DNA, 22 bp, Homo sapiens
ctctcactctggcagcctcaga

SEQ ID NO: 5470852 - DNA, 23 bp, Homo sapiens
ctctcactctggcagcctcagag

SEQ ID NO: 5470853 - DNA, 14 bp, Homo sapiens
ctctcactgcctcc

SEQ ID NO: 5470854 - DNA, 12 bp, Homo sapiens
ctctcactgtct

SEQ ID NO: 5470855 - DNA, 19 bp, Homo sapiens
ctctcactgtgttactgct

SEQ ID NO: 5470856 - DNA, 20 bp, Homo sapiens
ctctcactgtgttactgctt

SEQ ID NO: 5470857 - DNA, 23 bp, Homo sapiens
ctctcacttaccccgagacctca

SEQ ID NO: 5470858 - DNA, 12 bp, Homo sapiens
ctctcagaacat

SEQ ID NO: 5470859 - DNA, 21 bp, Homo sapiens
ctctcagaccgtcttcctcca

SEQ ID NO: 5470860 - DNA, 17 bp, Homo sapiens
ctctcagagactcccag

SEQ ID NO: 5470861 - DNA, 22 bp, Homo sapiens
ctctcagagactcccaggagtt

SEQ ID NO: 5470862 - DNA, 14 bp, Homo sapiens
ctctcagagcagca

SEQ ID NO: 5470863 - DNA, 22 bp, Homo sapiens
ctctcagagcatctggctgttt

SEQ ID NO: 5470864 - DNA, 16 bp, Homo sapiens
ctctcagagcctcagc

SEQ ID NO: 5470865 - DNA, 20 bp, Homo sapiens
ctctcagagctacttgggcc

SEQ ID NO: 5470866 - DNA, 22 bp, Homo sapiens
ctctcagaggcctgctgccagt

SEQ ID NO: 5470867 - DNA, 20 bp, Homo sapiens
ctctcagatacccagtggaa

SEQ ID NO: 5470868 - DNA, 21 bp, Homo sapiens
ctctcagatcaccccagcctc

SEQ ID NO: 5470869 - DNA, 18 bp, Homo sapiens
ctctcagatccctcggtc

SEQ ID NO: 5470870 - DNA, 12 bp, Homo sapiens
ctctcagatttc

SEQ ID NO: 5470871 - DNA, 19 bp, Homo sapiens
ctctcagatttccacagag

SEQ ID NO: 5470872 - DNA, 13 bp, Homo sapiens
ctctcagcaagtg

SEQ ID NO: 5470873 - DNA, 22 bp, Homo sapiens
ctctcagcaagtgcccagtgga

SEQ ID NO: 5470874 - DNA, 15 bp, Homo sapiens
ctctcagcacagcct

SEQ ID NO: 5470875 - DNA, 19 bp, Homo sapiens
ctctcagcatagcctgcct

SEQ ID NO: 5470876 - DNA, 22 bp, Homo sapiens
ctctcagcatagcctgcctgat

SEQ ID NO: 5470877 - DNA, 23 bp, Homo sapiens
ctctcagcataggtatgcttact

SEQ ID NO: 5470878 - DNA, 14 bp, Homo sapiens
ctctcagcccagaa

SEQ ID NO: 5470879 - DNA, 15 bp, Homo sapiens
ctctcagcccagaag

SEQ ID NO: 5470880 - DNA, 16 bp, Homo sapiens
ctctcagcccaggtct

SEQ ID NO: 5470881 - DNA, 20 bp, Homo sapiens
ctctcagcccaggtctcctg

SEQ ID NO: 5470882 - DNA, 18 bp, Homo sapiens
ctctcagccccatcgccc

SEQ ID NO: 5470883 - DNA, 17 bp, Homo sapiens
ctctcagcccctcagag

SEQ ID NO: 5470884 - DNA, 21 bp, Homo sapiens
ctctcagcccctgatcctgtg

SEQ ID NO: 5470885 - DNA, 19 bp, Homo sapiens
ctctcagcctcccaacccc

SEQ ID NO: 5470886 - DNA, 22 bp, Homo sapiens
ctctcagcctcccaaccccagg

SEQ ID NO: 5470887 - DNA, 15 bp, Homo sapiens
ctctcagcctcccac

SEQ ID NO: 5470888 - DNA, 17 bp, Homo sapiens
ctctcagccttacattt

SEQ ID NO: 5470889 - DNA, 19 bp, Homo sapiens
ctctcagccttacatttgt

SEQ ID NO: 5470890 - DNA, 15 bp, Homo sapiens
ctctcagctcccagg

SEQ ID NO: 5470891 - DNA, 18 bp, Homo sapiens
ctctcagctcccaggcca

SEQ ID NO: 5470892 - DNA, 12 bp, Homo sapiens
ctctcagctgcc

SEQ ID NO: 5470893 - DNA, 15 bp, Homo sapiens
ctctcagctgctgga

SEQ ID NO: 5470894 - DNA, 17 bp, Homo sapiens
ctctcagctgctggatg

SEQ ID NO: 5470895 - DNA, 20 bp, Homo sapiens
ctctcaggaccaccctgcca

SEQ ID NO: 5470896 - DNA, 22 bp, Homo sapiens
ctctcaggaccaccctgccaag

SEQ ID NO: 5470897 - DNA, 23 bp, Homo sapiens
ctctcaggaccaccctgccaagg

SEQ ID NO: 5470898 - DNA, 15 bp, Homo sapiens
ctctcaggagcacag

SEQ ID NO: 5470899 - DNA, 17 bp, Homo sapiens
ctctcaggagcacaggc

SEQ ID NO: 5470900 - DNA, 18 bp, Homo sapiens
ctctcaggagcacaggca

SEQ ID NO: 5470901 - DNA, 19 bp, Homo sapiens
ctctcaggagcacaggcag

SEQ ID NO: 5470902 - DNA, 19 bp, Homo sapiens
ctctcaggaggcgcagccc

SEQ ID NO: 5470903 - DNA, 21 bp, Homo sapiens
ctctcaggaggcgcagcccga

SEQ ID NO: 5470904 - DNA, 14 bp, Homo sapiens
ctctcaggatcaag

SEQ ID NO: 5470905 - DNA, 14 bp, Homo sapiens
ctctcaggatccaa

SEQ ID NO: 5470906 - DNA, 16 bp, Homo sapiens
ctctcaggatccaagc

SEQ ID NO: 5470907 - DNA, 19 bp, Homo sapiens
ctctcaggcatgcctgtgt

SEQ ID NO: 5470908 - DNA, 21 bp, Homo sapiens
ctctcaggcatgcctgtgtga

SEQ ID NO: 5470909 - DNA, 20 bp, Homo sapiens
ctctcaggccaaactcacct

SEQ ID NO: 5470910 - DNA, 21 bp, Homo sapiens
ctctcaggccaaactcacctg

SEQ ID NO: 5470911 - DNA, 13 bp, Homo sapiens
ctctcaggccagc

SEQ ID NO: 5470912 - DNA, 15 bp, Homo sapiens
ctctcaggccagctg

SEQ ID NO: 5470913 - DNA, 18 bp, Homo sapiens
ctctcaggccagctgctt

SEQ ID NO: 5470914 - DNA, 21 bp, Homo sapiens
ctctcaggccagctgcttggg

SEQ ID NO: 5470915 - DNA, 22 bp, Homo sapiens
ctctcaggccagctgcttgggc

SEQ ID NO: 5470916 - DNA, 23 bp, Homo sapiens
ctctcaggccagctgcttgggct

SEQ ID NO: 5470917 - DNA, 14 bp, Homo sapiens
ctctcaggccgaga

SEQ ID NO: 5470918 - DNA, 18 bp, Homo sapiens
ctctcaggccgagagcct

SEQ ID NO: 5470919 - DNA, 18 bp, Homo sapiens
ctctcaggctgtcccaag

SEQ ID NO: 5470920 - DNA, 16 bp, Homo sapiens
ctctcaggctgtgctt

SEQ ID NO: 5470921 - DNA, 19 bp, Homo sapiens
ctctcagggccaggcctct

SEQ ID NO: 5470922 - DNA, 13 bp, Homo sapiens
ctctcagggcctg

SEQ ID NO: 5470923 - DNA, 17 bp, Homo sapiens
ctctcagggcctggcag

SEQ ID NO: 5470924 - DNA, 24 bp, Homo sapiens
ctctcagggcctggcaggccagtg

SEQ ID NO: 5470925 - DNA, 18 bp, Homo sapiens
ctctcaggggccagtgag

SEQ ID NO: 5470926 - DNA, 20 bp, Homo sapiens
ctctcaggggccagtgaggg

SEQ ID NO: 5470927 - DNA, 16 bp, Homo sapiens
ctctcaggtcactcca

SEQ ID NO: 5470928 - DNA, 18 bp, Homo sapiens
ctctcaggtgaaaggaaa

SEQ ID NO: 5470929 - DNA, 19 bp, Homo sapiens
ctctcagtatcttaaaatt

SEQ ID NO: 5470930 - DNA, 13 bp, Homo sapiens
ctctcagtctctg

SEQ ID NO: 5470931 - DNA, 15 bp, Homo sapiens
ctctcagtctctgag

SEQ ID NO: 5470932 - DNA, 18 bp, Homo sapiens
ctctcagtctctgagcag

SEQ ID NO: 5470933 - DNA, 17 bp, Homo sapiens
ctctcagtgccctccag

SEQ ID NO: 5470934 - DNA, 14 bp, Homo sapiens
ctctcagtgccttc

SEQ ID NO: 5470935 - DNA, 13 bp, Homo sapiens
ctctcagtgtgtt

SEQ ID NO: 5470936 - DNA, 15 bp, Homo sapiens
ctctcagttctctcc

SEQ ID NO: 5470937 - DNA, 16 bp, Homo sapiens
ctctcagttctctccc

SEQ ID NO: 5470938 - DNA, 17 bp, Homo sapiens
ctctcatagaacattga

SEQ ID NO: 5470939 - DNA, 16 bp, Homo sapiens
ctctcatatatatttt

SEQ ID NO: 5470940 - DNA, 21 bp, Homo sapiens
ctctcatatgccaccccatgt

SEQ ID NO: 5470941 - DNA, 12 bp, Homo sapiens
ctctcatattcg

SEQ ID NO: 5470942 - DNA, 16 bp, Homo sapiens
ctctcatcaactgaat

SEQ ID NO: 5470943 - DNA, 17 bp, Homo sapiens
ctctcatcaactgaatg

SEQ ID NO: 5470944 - DNA, 22 bp, Homo sapiens
ctctcatcacagtgggaagaat

SEQ ID NO: 5470945 - DNA, 20 bp, Homo sapiens
ctctcatcaccccagaggcc

SEQ ID NO: 5470946 - DNA, 22 bp, Homo sapiens
ctctcatcaccccagaggcctt

SEQ ID NO: 5470947 - DNA, 23 bp, Homo sapiens
ctctcatcatttgcattgggcat

SEQ ID NO: 5470948 - DNA, 12 bp, Homo sapiens
ctctcatccccc

SEQ ID NO: 5470949 - DNA, 18 bp, Homo sapiens
ctctcatccccctgtgga

SEQ ID NO: 5470950 - DNA, 18 bp, Homo sapiens
ctctcatccttttctcct

SEQ ID NO: 5470951 - DNA, 14 bp, Homo sapiens
ctctcatcggaggc

SEQ ID NO: 5470952 - DNA, 13 bp, Homo sapiens
ctctcatgcctcc

SEQ ID NO: 5470953 - DNA, 20 bp, Homo sapiens
ctctcatgcctcctgaggct

SEQ ID NO: 5470954 - DNA, 16 bp, Homo sapiens
ctctcatgcctgcctg

SEQ ID NO: 5470955 - DNA, 14 bp, Homo sapiens
gatctcaggggctg

SEQ ID NO: 5470956 - DNA, 19 bp, Homo sapiens
gatctcaggggctgtttga

SEQ ID NO: 5470957 - DNA, 16 bp, Homo sapiens
gatctcataatgcttt

SEQ ID NO: 5470958 - DNA, 14 bp, Homo sapiens
gatctcatagatga

SEQ ID NO: 5470959 - DNA, 22 bp, Homo sapiens
gatctcatggaaactggccagg

SEQ ID NO: 5470960 - DNA, 15 bp, Homo sapiens
gatctccaggcccag

SEQ ID NO: 5470961 - DNA, 18 bp, Homo sapiens
gatctccaggcccagcct

SEQ ID NO: 5470962 - DNA, 19 bp, Homo sapiens
gatctccatggcttcctcc

SEQ ID NO: 5470963 - DNA, 14 bp, Homo sapiens
gatctcccagggct

SEQ ID NO: 5470964 - DNA, 20 bp, Homo sapiens
gatctcccagggctctctgg

SEQ ID NO: 5470965 - DNA, 16 bp, Homo sapiens
gatctccccgaatctc

SEQ ID NO: 5470966 - DNA, 13 bp, Homo sapiens
gatctccctgccg

SEQ ID NO: 5470967 - DNA, 18 bp, Homo sapiens
gatctccctgccgcctca

SEQ ID NO: 5470968 - DNA, 20 bp, Homo sapiens
gatctcccttggtcttccat

SEQ ID NO: 5470969 - DNA, 22 bp, Homo sapiens
gatctcccttggtcttccatgg

SEQ ID NO: 5470970 - DNA, 19 bp, Homo sapiens
gatctcctgccagcccagc

SEQ ID NO: 5470971 - DNA, 20 bp, Homo sapiens
gatctcctgccagcccagct

SEQ ID NO: 5470972 - DNA, 16 bp, Homo sapiens
gatctcctgctgcctt

SEQ ID NO: 5470973 - DNA, 14 bp, Homo sapiens
gatctcctgtgcac

SEQ ID NO: 5470974 - DNA, 14 bp, Homo sapiens
gatctccttccctt

SEQ ID NO: 5470975 - DNA, 13 bp, Homo sapiens
gatctcggtgctg

SEQ ID NO: 5470976 - DNA, 20 bp, Homo sapiens
gatctcggtttgccaaaatt

SEQ ID NO: 5470977 - DNA, 22 bp, Homo sapiens
gatctcgtgatccgcctgcctc

SEQ ID NO: 5470978 - DNA, 18 bp, Homo sapiens
gatctctattatatcttg

SEQ ID NO: 5470979 - DNA, 14 bp, Homo sapiens
gatctctcaggagc

SEQ ID NO: 5470980 - DNA, 17 bp, Homo sapiens
gatctctcaggagcaca

SEQ ID NO: 5470981 - DNA, 22 bp, Homo sapiens
gatctctcaggagcacaggcag

SEQ ID NO: 5470982 - DNA, 23 bp, Homo sapiens
gatctctcaggagcacaggcagc

SEQ ID NO: 5470983 - DNA, 16 bp, Homo sapiens
gatctctcctggccta

SEQ ID NO: 5470984 - DNA, 16 bp, Homo sapiens
gatctctcttgtcctc

SEQ ID NO: 5470985 - DNA, 20 bp, Homo sapiens
gatctctcttgtcctcttct

SEQ ID NO: 5470986 - DNA, 22 bp, Homo sapiens
gatctctcttgtcctcttctgc

SEQ ID NO: 5470987 - DNA, 17 bp, Homo sapiens
gatctctgacctctgct

SEQ ID NO: 5470988 - DNA, 18 bp, Homo sapiens
gatctctgagaccacaga

SEQ ID NO: 5470989 - DNA, 24 bp, Homo sapiens
gatctctgagaccacagaggctca

SEQ ID NO: 5470990 - DNA, 23 bp, Homo sapiens
gatctctgcaggaaatggctgtg

SEQ ID NO: 5470991 - DNA, 20 bp, Homo sapiens
gatctctgcagggccgccag

SEQ ID NO: 5470992 - DNA, 11 bp, Homo sapiens
gatctctgctt

SEQ ID NO: 5470993 - DNA, 12 bp, Homo sapiens
gatctctgctta

SEQ ID NO: 5470994 - DNA, 22 bp, Homo sapiens
gatctctgggatttatgctcat

SEQ ID NO: 5470995 - DNA, 18 bp, Homo sapiens
gatctctgtagaaggagt

SEQ ID NO: 5470996 - DNA, 15 bp, Homo sapiens
gatctctgtcacatc

SEQ ID NO: 5470997 - DNA, 18 bp, Homo sapiens
gatctctgttctttcata

SEQ ID NO: 5470998 - DNA, 21 bp, Homo sapiens
gatctcttagaagccatggga

SEQ ID NO: 5470999 - DNA, 21 bp, Homo sapiens
gatctcttcttaatgtacata

SEQ ID NO: 5471000 - DNA, 12 bp, Homo sapiens
gatctcttgagc

SEQ ID NO: 5471001 - DNA, 17 bp, Homo sapiens
gatctgaaaacttggct

SEQ ID NO: 5471002 - DNA, 14 bp, Homo sapiens
gatctgaaatccat

SEQ ID NO: 5471003 - DNA, 15 bp, Homo sapiens
gatctgaaatccata

SEQ ID NO: 5471004 - DNA, 12 bp, Homo sapiens
gatctgaacaga

SEQ ID NO: 5471005 - DNA, 19 bp, Homo sapiens
gatctgaacagaaatacca

SEQ ID NO: 5471006 - DNA, 23 bp, Homo sapiens
gatctgaactttgtttccagaaa

SEQ ID NO: 5471007 - DNA, 21 bp, Homo sapiens
gatctgacatgattccttcct

SEQ ID NO: 5471008 - DNA, 21 bp, Homo sapiens
gatctgagaacacgttgccag

SEQ ID NO: 5471009 - DNA, 14 bp, Homo sapiens
gatctgagaatctt

SEQ ID NO: 5471010 - DNA, 21 bp, Homo sapiens
gatctgagctcccacctccct

SEQ ID NO: 5471011 - DNA, 24 bp, Homo sapiens
gatctgagctcccacctcccttcc

SEQ ID NO: 5471012 - DNA, 14 bp, Homo sapiens
gatctgaggacaag

SEQ ID NO: 5471013 - DNA, 22 bp, Homo sapiens
gatctgaggttggatttgctca

SEQ ID NO: 5471014 - DNA, 22 bp, Homo sapiens
gatctgagtcagagccatgtct

SEQ ID NO: 5471015 - DNA, 15 bp, Homo sapiens
gatctgagtcccagg

SEQ ID NO: 5471016 - DNA, 19 bp, Homo sapiens
gatctgatccccaagacat

SEQ ID NO: 5471017 - DNA, 17 bp, Homo sapiens
gatctgatctgtaccat

SEQ ID NO: 5471018 - DNA, 18 bp, Homo sapiens
gatctgatggtgagctgg

SEQ ID NO: 5471019 - DNA, 23 bp, Homo sapiens
gatctgattgaccgtgttggtct

SEQ ID NO: 5471020 - DNA, 12 bp, Homo sapiens
gatctgattttt

SEQ ID NO: 5471021 - DNA, 15 bp, Homo sapiens
gatctgcacagtcag

SEQ ID NO: 5471022 - DNA, 16 bp, Homo sapiens
gatctgcacagtcaga

SEQ ID NO: 5471023 - DNA, 20 bp, Homo sapiens
gatctgcacagtcagaagga

SEQ ID NO: 5471024 - DNA, 15 bp, Homo sapiens
gatctgcactgggtg

SEQ ID NO: 5471025 - DNA, 16 bp, Homo sapiens
gatctgcaggggtctg

SEQ ID NO: 5471026 - DNA, 17 bp, Homo sapiens
gatctgcaggggtctgg

SEQ ID NO: 5471027 - DNA, 18 bp, Homo sapiens
gatctgcatatttctgta

SEQ ID NO: 5471028 - DNA, 20 bp, Homo sapiens
gatctgcatatttctgtata

SEQ ID NO: 5471029 - DNA, 22 bp, Homo sapiens
gatctgcatatttctgtatatt

SEQ ID NO: 5471030 - DNA, 17 bp, Homo sapiens
gatctgcattccccgct

SEQ ID NO: 5471031 - DNA, 22 bp, Homo sapiens
gatctgcattccccgctgccca

SEQ ID NO: 5471032 - DNA, 17 bp, Homo sapiens
gatctgccattgggacc

SEQ ID NO: 5471033 - DNA, 19 bp, Homo sapiens
gatctgcccatcgtgaaga

SEQ ID NO: 5471034 - DNA, 23 bp, Homo sapiens
gatctgccccctagttcaggtcc

SEQ ID NO: 5471035 - DNA, 13 bp, Homo sapiens
gatctgcccctcc

SEQ ID NO: 5471036 - DNA, 23 bp, Homo sapiens
gatctgcccgcctcggcctccca

SEQ ID NO: 5471037 - DNA, 23 bp, Homo sapiens
gatctgcccgcctcggtctccca

SEQ ID NO: 5471038 - DNA, 19 bp, Homo sapiens
gatctgcccttctctgcct

SEQ ID NO: 5471039 - DNA, 20 bp, Homo sapiens
gatctgcctaaggacttctt

SEQ ID NO: 5471040 - DNA, 11 bp, Homo sapiens
gatctgcctgg

SEQ ID NO: 5471041 - DNA, 12 bp, Homo sapiens
gatctgcctggg

SEQ ID NO: 5471042 - DNA, 13 bp, Homo sapiens
gatctgcctgggc

SEQ ID NO: 5471043 - DNA, 21 bp, Homo sapiens
gatctgcctgggcctgtgcag

SEQ ID NO: 5471044 - DNA, 21 bp, Homo sapiens
gatctgcggatctcagctttg

SEQ ID NO: 5471045 - DNA, 15 bp, Homo sapiens
gatctgctagtgctg

SEQ ID NO: 5471046 - DNA, 14 bp, Homo sapiens
gatctgctcagccc

SEQ ID NO: 5471047 - DNA, 18 bp, Homo sapiens
gatctgctcagccctgga

SEQ ID NO: 5471048 - DNA, 17 bp, Homo sapiens
gatctgctccatgcaga

SEQ ID NO: 5471049 - DNA, 18 bp, Homo sapiens
gatctgctgcagagcagt

SEQ ID NO: 5471050 - DNA, 13 bp, Homo sapiens
gatctgcttcttc

SEQ ID NO: 5471051 - DNA, 20 bp, Homo sapiens
gatctgcttgatatcccaag

SEQ ID NO: 5471052 - DNA, 13 bp, Homo sapiens
gatctgctttctg

SEQ ID NO: 5471053 - DNA, 16 bp, Homo sapiens
gatctgctttctgttc

SEQ ID NO: 5471054 - DNA, 17 bp, Homo sapiens
gatctgctttctgttca

SEQ ID NO: 5471055 - DNA, 20 bp, Homo sapiens
gatctgctttctgttcatct

SEQ ID NO: 5471056 - DNA, 15 bp, Homo sapiens
gatctggaacccaga

SEQ ID NO: 5471057 - DNA, 17 bp, Homo sapiens
gatctggaacccagact

SEQ ID NO: 5471058 - DNA, 18 bp, Homo sapiens
gatctggaacccagactc

SEQ ID NO: 5471059 - DNA, 20 bp, Homo sapiens
gatctggaacccagactcag

SEQ ID NO: 5471060 - DNA, 18 bp, Homo sapiens
gatctggaacctcagcct

SEQ ID NO: 5471061 - DNA, 17 bp, Homo sapiens
gatctggaagggccaag

SEQ ID NO: 5471062 - DNA, 18 bp, Homo sapiens
gatctggacagaacattt

SEQ ID NO: 5471063 - DNA, 17 bp, Homo sapiens
gatctggagtctgaagg

SEQ ID NO: 5471064 - DNA, 17 bp, Homo sapiens
gatctggcccaagctgg

SEQ ID NO: 5471065 - DNA, 17 bp, Homo sapiens
gatctgggaactcccaa

SEQ ID NO: 5471066 - DNA, 17 bp, Homo sapiens
gatctgggaccctttcc

SEQ ID NO: 5471067 - DNA, 23 bp, Homo sapiens
gatctgggaccctttccttcctt

SEQ ID NO: 5471068 - DNA, 21 bp, Homo sapiens
gatctgggcattttcctcctc

SEQ ID NO: 5471069 - DNA, 23 bp, Homo sapiens
gatctgggcattttcctcctctg

SEQ ID NO: 5471070 - DNA, 20 bp, Homo sapiens
gatctggggagagcggctgg

SEQ ID NO: 5471071 - DNA, 12 bp, Homo sapiens
gatctggggagt

SEQ ID NO: 5471072 - DNA, 13 bp, Homo sapiens
gatctggggagtg

SEQ ID NO: 5471073 - DNA, 19 bp, Homo sapiens
gatctggggcatgaaaaaa

SEQ ID NO: 5471074 - DNA, 18 bp, Homo sapiens
gatctggggctctgggat

SEQ ID NO: 5471075 - DNA, 16 bp, Homo sapiens
gatctggggggtgggg

SEQ ID NO: 5471076 - DNA, 18 bp, Homo sapiens
gatctggggggtggggag

SEQ ID NO: 5471077 - DNA, 19 bp, Homo sapiens
gatctggggggtggggagg

SEQ ID NO: 5471078 - DNA, 21 bp, Homo sapiens
gatctggtgcgtgtggccctg

SEQ ID NO: 5471079 - DNA, 19 bp, Homo sapiens
gatctggtggtcagcccta

SEQ ID NO: 5471080 - DNA, 18 bp, Homo sapiens
gatctggttttgctatta

SEQ ID NO: 5471081 - DNA, 14 bp, Homo sapiens
gatctgtactgtaa

SEQ ID NO: 5471082 - DNA, 15 bp, Homo sapiens
gatctgtactgtaat

SEQ ID NO: 5471083 - DNA, 22 bp, Homo sapiens
gatctgtataaataagagcatg

SEQ ID NO: 5471084 - DNA, 20 bp, Homo sapiens
gatctgtatatacaataaca

SEQ ID NO: 5471085 - DNA, 17 bp, Homo sapiens
gatctgtcacaccagcc

SEQ ID NO: 5471086 - DNA, 19 bp, Homo sapiens
gatctgtcacaccagccat

SEQ ID NO: 5471087 - DNA, 14 bp, Homo sapiens
gatctgtcctcagc

SEQ ID NO: 5471088 - DNA, 16 bp, Homo sapiens
gatctgtcctcagcct

SEQ ID NO: 5471089 - DNA, 11 bp, Homo sapiens
gatctgtcctg

SEQ ID NO: 5471090 - DNA, 12 bp, Homo sapiens
gatctgtcctgg

SEQ ID NO: 5471091 - DNA, 12 bp, Homo sapiens
gatctgtccttc

SEQ ID NO: 5471092 - DNA, 15 bp, Homo sapiens
gatctgtctgtgcac

SEQ ID NO: 5471093 - DNA, 14 bp, Homo sapiens
gatctgtcttggca

SEQ ID NO: 5471094 - DNA, 14 bp, Homo sapiens
gatctgtgattggc

SEQ ID NO: 5471095 - DNA, 15 bp, Homo sapiens
gatctgtgattggct

SEQ ID NO: 5471096 - DNA, 17 bp, Homo sapiens
gatctgtgattggctgg

SEQ ID NO: 5471097 - DNA, 19 bp, Homo sapiens
gatctgtgattggctggtt

SEQ ID NO: 5471098 - DNA, 17 bp, Homo sapiens
gatctgtgatttcttct

SEQ ID NO: 5471099 - DNA, 16 bp, Homo sapiens
gatctgtgcccagaga

SEQ ID NO: 5471100 - DNA, 13 bp, Homo sapiens
gatctgtgcctgg

SEQ ID NO: 5471101 - DNA, 20 bp, Homo sapiens
gatctgtgctttccagctca

SEQ ID NO: 5471102 - DNA, 23 bp, Homo sapiens
gatctgtgctttccagctcaccc

SEQ ID NO: 5471103 - DNA, 11 bp, Homo sapiens
gatctgtgtgg

SEQ ID NO: 5471104 - DNA, 13 bp, Homo sapiens
gatctgtgtggct

SEQ ID NO: 5471105 - DNA, 18 bp, Homo sapiens
gatctgtgtggctcctgg

SEQ ID NO: 5471106 - DNA, 12 bp, Homo sapiens
gatctgttcagt

SEQ ID NO: 5471107 - DNA, 21 bp, Homo sapiens
gatctgttgcaaactcagcct

SEQ ID NO: 5471108 - DNA, 15 bp, Homo sapiens
gatctgttttacagg

SEQ ID NO: 5471109 - DNA, 13 bp, Homo sapiens
gatctgttttgaa

SEQ ID NO: 5471110 - DNA, 21 bp, Homo sapiens
gatctgttttggatgttgcta

SEQ ID NO: 5471111 - DNA, 12 bp, Homo sapiens
gatcttaaattt

SEQ ID NO: 5471112 - DNA, 19 bp, Homo sapiens
gatcttaagaggctgacag

SEQ ID NO: 5471113 - DNA, 19 bp, Homo sapiens
gatcttactctactgctgc

SEQ ID NO: 5471114 - DNA, 18 bp, Homo sapiens
gatcttagggaactttga

SEQ ID NO: 5471115 - DNA, 19 bp, Homo sapiens
gatcttagggaactttgat

SEQ ID NO: 5471116 - DNA, 19 bp, Homo sapiens
gatcttagggtgaaccact

SEQ ID NO: 5471117 - DNA, 13 bp, Homo sapiens
gatcttatttgga

SEQ ID NO: 5471118 - DNA, 18 bp, Homo sapiens
gatcttattttgtgaact

SEQ ID NO: 5471119 - DNA, 19 bp, Homo sapiens
gatcttatttttctaaacg

SEQ ID NO: 5471120 - DNA, 17 bp, Homo sapiens
gatcttcagaactgccc

SEQ ID NO: 5471121 - DNA, 15 bp, Homo sapiens
gatcttcagaaggct

SEQ ID NO: 5471122 - DNA, 23 bp, Homo sapiens
gatcttcccacaggagggccagc

SEQ ID NO: 5471123 - DNA, 23 bp, Homo sapiens
gatcttccttccgctctgaggca

SEQ ID NO: 5471124 - DNA, 18 bp, Homo sapiens
gatcttctatcattccaa

SEQ ID NO: 5471125 - DNA, 19 bp, Homo sapiens
gatcttctatcattccaat

SEQ ID NO: 5471126 - DNA, 15 bp, Homo sapiens
gatcttctgaaatga

SEQ ID NO: 5471127 - DNA, 13 bp, Homo sapiens
gatcttgaactcc

SEQ ID NO: 5471128 - DNA, 17 bp, Homo sapiens
gatcttgagagagaaat

SEQ ID NO: 5471129 - DNA, 16 bp, Homo sapiens
gatcttgagagctgct

SEQ ID NO: 5471130 - DNA, 18 bp, Homo sapiens
gatcttgagagctgctga

SEQ ID NO: 5471131 - DNA, 17 bp, Homo sapiens
gatcttgccacatttct

SEQ ID NO: 5471132 - DNA, 13 bp, Homo sapiens
gatcttgcctgtc

SEQ ID NO: 5471133 - DNA, 15 bp, Homo sapiens
gatcttgtgctcagc

SEQ ID NO: 5471134 - DNA, 16 bp, Homo sapiens
gatcttgttctttgct

SEQ ID NO: 5471135 - DNA, 14 bp, Homo sapiens
gatctttaaaatac

SEQ ID NO: 5471136 - DNA, 16 bp, Homo sapiens
gatctttaaatacagt

SEQ ID NO: 5471137 - DNA, 19 bp, Homo sapiens
gatctttcacccacagaaa

SEQ ID NO: 5471138 - DNA, 12 bp, Homo sapiens
gatctttcagaa

SEQ ID NO: 5471139 - DNA, 15 bp, Homo sapiens
gatctttcagaaata

SEQ ID NO: 5471140 - DNA, 19 bp, Homo sapiens
gatctttctcttccctgaa

SEQ ID NO: 5471141 - DNA, 14 bp, Homo sapiens
gatctttctgggag

SEQ ID NO: 5471142 - DNA, 18 bp, Homo sapiens
gatctttctttccaaaac

SEQ ID NO: 5471143 - DNA, 19 bp, Homo sapiens
gatctttctttccaaaaca

SEQ ID NO: 5471144 - DNA, 14 bp, Homo sapiens
gatctttgagccca

SEQ ID NO: 5471145 - DNA, 15 bp, Homo sapiens
gatctttgagcccat

SEQ ID NO: 5471146 - DNA, 22 bp, Homo sapiens
gatctttgagcccattcttctg

SEQ ID NO: 5471147 - DNA, 23 bp, Homo sapiens
gatctttgagcccattcttctgg

SEQ ID NO: 5471148 - DNA, 16 bp, Homo sapiens
gatctttgcagacagg

SEQ ID NO: 5471149 - DNA, 14 bp, Homo sapiens
gatctttgtggcca

SEQ ID NO: 5471150 - DNA, 20 bp, Homo sapiens
gatcttttaaagtgttactt

SEQ ID NO: 5471151 - DNA, 14 bp, Homo sapiens
gatcttttattttg

SEQ ID NO: 5471152 - DNA, 15 bp, Homo sapiens
gatcttttattttgc

SEQ ID NO: 5471153 - DNA, 19 bp, Homo sapiens
gatcttttggtggagtcag

SEQ ID NO: 5471154 - DNA, 11 bp, Homo sapiens
gatcttttgta

SEQ ID NO: 5471155 - DNA, 17 bp, Homo sapiens
gatctttttatattctt

SEQ ID NO: 5471156 - DNA, 19 bp, Homo sapiens
gatctttttgtgaaattca

SEQ ID NO: 5471157 - DNA, 16 bp, Homo sapiens
gatctttttttaagtg

SEQ ID NO: 5471158 - DNA, 13 bp, Homo sapiens
gatgaaaaagaat

SEQ ID NO: 5471159 - DNA, 21 bp, Homo sapiens
gatgaaaaagaataaaaactt

SEQ ID NO: 5471160 - DNA, 18 bp, Homo sapiens
gatgaaaaatatttctga

SEQ ID NO: 5471161 - DNA, 18 bp, Homo sapiens
gatgaaaaattgctgact

SEQ ID NO: 5471162 - DNA, 13 bp, Homo sapiens
gatgaaaagccat

SEQ ID NO: 5471163 - DNA, 15 bp, Homo sapiens
gatgaaaagccatat

SEQ ID NO: 5471164 - DNA, 21 bp, Homo sapiens
gatgaaaagtatattgataac

SEQ ID NO: 5471165 - DNA, 23 bp, Homo sapiens
gatgaaaagtatattgataacct

SEQ ID NO: 5471166 - DNA, 11 bp, Homo sapiens
gatgaaaataa

SEQ ID NO: 5471167 - DNA, 18 bp, Homo sapiens
gatgaaaataaagaatgg

SEQ ID NO: 5471168 - DNA, 14 bp, Homo sapiens
gatgaaaatattta

SEQ ID NO: 5471169 - DNA, 20 bp, Homo sapiens
gatgaaaccttgaagttctg

SEQ ID NO: 5471170 - DNA, 19 bp, Homo sapiens
gatgaaagagaaggtgggt

SEQ ID NO: 5471171 - DNA, 14 bp, Homo sapiens
gatgaaagaggagg

SEQ ID NO: 5471172 - DNA, 16 bp, Homo sapiens
gatgaaagttccccca

SEQ ID NO: 5471173 - DNA, 18 bp, Homo sapiens
gatgaaataactccttct

SEQ ID NO: 5471174 - DNA, 19 bp, Homo sapiens
gatgaaatcttacagctgg

SEQ ID NO: 5471175 - DNA, 20 bp, Homo sapiens
gatgaaatcttacagctggg

SEQ ID NO: 5471176 - DNA, 21 bp, Homo sapiens
gatgaaatgaggtcagagcct

SEQ ID NO: 5471177 - DNA, 13 bp, Homo sapiens
gatgaaatgccaa

SEQ ID NO: 5471178 - DNA, 18 bp, Homo sapiens
gatgaaatgccaagactc

SEQ ID NO: 5471179 - DNA, 16 bp, Homo sapiens
gatgaaatgtaaatac

SEQ ID NO: 5471180 - DNA, 17 bp, Homo sapiens
gatgaaattccatttgt

SEQ ID NO: 5471181 - DNA, 13 bp, Homo sapiens
gatgaacacaggc

SEQ ID NO: 5471182 - DNA, 15 bp, Homo sapiens
gatgaacatattcat

SEQ ID NO: 5471183 - DNA, 13 bp, Homo sapiens
gatgaacctgcag

SEQ ID NO: 5471184 - DNA, 16 bp, Homo sapiens
gatgaactagccatga

SEQ ID NO: 5471185 - DNA, 18 bp, Homo sapiens
gatgaactcaatgcatga

SEQ ID NO: 5471186 - DNA, 23 bp, Homo sapiens
gatgaactcaatgcatgatgact

SEQ ID NO: 5471187 - DNA, 18 bp, Homo sapiens
gatgaacttgagctctgt

SEQ ID NO: 5471188 - DNA, 12 bp, Homo sapiens
gatgaacttttt

SEQ ID NO: 5471189 - DNA, 20 bp, Homo sapiens
gatgaagaaaagtgggccag

SEQ ID NO: 5471190 - DNA, 16 bp, Homo sapiens
gatgaagaacatctgg

SEQ ID NO: 5471191 - DNA, 12 bp, Homo sapiens
gatgaagaccct

SEQ ID NO: 5471192 - DNA, 21 bp, Homo sapiens
gatgaagagagagagggcctg

SEQ ID NO: 5471193 - DNA, 21 bp, Homo sapiens
gatgaagagtgagagggcatg

SEQ ID NO: 5471194 - DNA, 15 bp, Homo sapiens
gatgaagcaaacaca

SEQ ID NO: 5471195 - DNA, 16 bp, Homo sapiens
gatgaagcaaacacat

SEQ ID NO: 5471196 - DNA, 19 bp, Homo sapiens
gatgaagccgaccttagat

SEQ ID NO: 5471197 - DNA, 19 bp, Homo sapiens
gatgaagctgaggctgctg

SEQ ID NO: 5471198 - DNA, 22 bp, Homo sapiens
gatgaagcttggaggtcacagc

SEQ ID NO: 5471199 - DNA, 18 bp, Homo sapiens
gatgaaggctgtgaaaaa

SEQ ID NO: 5471200 - DNA, 18 bp, Homo sapiens
gatgaagggcgagtgaat

SEQ ID NO: 5471201 - DNA, 15 bp, Homo sapiens
gatgaagtatacttt

SEQ ID NO: 5471202 - DNA, 14 bp, Homo sapiens
gatgaataaaatgt

SEQ ID NO: 5471203 - DNA, 17 bp, Homo sapiens
gatgaataaacactttt

SEQ ID NO: 5471204 - DNA, 14 bp, Homo sapiens
gatgaatacatttt

SEQ ID NO: 5471205 - DNA, 20 bp, Homo sapiens
gatgaatagaagaaagaaaa

SEQ ID NO: 5471206 - DNA, 14 bp, Homo sapiens
gatgaatatgagct

SEQ ID NO: 5471207 - DNA, 15 bp, Homo sapiens
gatgaatccaaatgt

SEQ ID NO: 5471208 - DNA, 19 bp, Homo sapiens
gatgaatccaaatgtgaaa

SEQ ID NO: 5471209 - DNA, 17 bp, Homo sapiens
gatgaatctacatttgt

SEQ ID NO: 5471210 - DNA, 18 bp, Homo sapiens
gatgaatctacatttgtt

SEQ ID NO: 5471211 - DNA, 19 bp, Homo sapiens
gatgaatctcccactccag

SEQ ID NO: 5471212 - DNA, 15 bp, Homo sapiens
gatgaatgccgtgga

SEQ ID NO: 5471213 - DNA, 14 bp, Homo sapiens
gatgaatgtattta

SEQ ID NO: 5471214 - DNA, 16 bp, Homo sapiens
gatgaattaaatttaa

SEQ ID NO: 5471215 - DNA, 18 bp, Homo sapiens
gatgaattcttcctctcc

SEQ ID NO: 5471216 - DNA, 19 bp, Homo sapiens
gatgaattcttcctctcct

SEQ ID NO: 5471217 - DNA, 23 bp, Homo sapiens
gatgaattcttcctctccttccc

SEQ ID NO: 5471218 - DNA, 18 bp, Homo sapiens
gatgaattgtcacatcta

SEQ ID NO: 5471219 - DNA, 19 bp, Homo sapiens
gatgaattttccagaccta

SEQ ID NO: 5471220 - DNA, 16 bp, Homo sapiens
gatgaattttctgcag

SEQ ID NO: 5471221 - DNA, 18 bp, Homo sapiens
gatgaattttctgcagct

SEQ ID NO: 5471222 - DNA, 20 bp, Homo sapiens
gatgaattttctgcagctgt

SEQ ID NO: 5471223 - DNA, 22 bp, Homo sapiens
gatgaattttctgcagctgttt

SEQ ID NO: 5471224 - DNA, 12 bp, Homo sapiens
gatgacaaagaa

SEQ ID NO: 5471225 - DNA, 17 bp, Homo sapiens
gatgacaacaaattttg

SEQ ID NO: 5471226 - DNA, 23 bp, Homo sapiens
gatgacaacctgtgtgagagaat

SEQ ID NO: 5471227 - DNA, 19 bp, Homo sapiens
gatgacaactacagaaaaa

SEQ ID NO: 5471228 - DNA, 17 bp, Homo sapiens
gatgacaagatggtaca

SEQ ID NO: 5471229 - DNA, 15 bp, Homo sapiens
gatgacaccctggcc

SEQ ID NO: 5471230 - DNA, 17 bp, Homo sapiens
gatgacaccctggcctg

SEQ ID NO: 5471231 - DNA, 20 bp, Homo sapiens
gatgacacctccatttctct

SEQ ID NO: 5471232 - DNA, 21 bp, Homo sapiens
gatgacagctcttctaaggaa

SEQ ID NO: 5471233 - DNA, 19 bp, Homo sapiens
gatgacaggcgcctgccat

SEQ ID NO: 5471234 - DNA, 20 bp, Homo sapiens
gatgacaggcgcctgccatc

SEQ ID NO: 5471235 - DNA, 13 bp, Homo sapiens
gatgacaggctct

SEQ ID NO: 5471236 - DNA, 19 bp, Homo sapiens
gatgacagggagctgggga

SEQ ID NO: 5471237 - DNA, 22 bp, Homo sapiens
gatgacaggtgtgagccactgc

SEQ ID NO: 5471238 - DNA, 22 bp, Homo sapiens
gatgacagtgctctaggctgcc

SEQ ID NO: 5471239 - DNA, 22 bp, Homo sapiens
gatgacataaaatttacattta

SEQ ID NO: 5471240 - DNA, 18 bp, Homo sapiens
gatgacatgtgactccta

SEQ ID NO: 5471241 - DNA, 20 bp, Homo sapiens
gatgacattccaccattgtg

SEQ ID NO: 5471242 - DNA, 21 bp, Homo sapiens
gatgacattgactatttttgt

SEQ ID NO: 5471243 - DNA, 23 bp, Homo sapiens
gatgacattgactatttttgttt

SEQ ID NO: 5471244 - DNA, 21 bp, Homo sapiens
gatgacattgctaagatgctc

SEQ ID NO: 5471245 - DNA, 14 bp, Homo sapiens
gatgacatttcgtt

SEQ ID NO: 5471246 - DNA, 22 bp, Homo sapiens
gatgaccaaagtcccttcctgc

SEQ ID NO: 5471247 - DNA, 18 bp, Homo sapiens
gatgaccaatctctgtga

SEQ ID NO: 5471248 - DNA, 18 bp, Homo sapiens
gatgaccaatgggatgag

SEQ ID NO: 5471249 - DNA, 19 bp, Homo sapiens
gatgaccacgcacctccac

SEQ ID NO: 5471250 - DNA, 14 bp, Homo sapiens
gatgaccacttttt

SEQ ID NO: 5471251 - DNA, 14 bp, Homo sapiens
gatgaccagggatg

SEQ ID NO: 5471252 - DNA, 16 bp, Homo sapiens
gatgacccactaaaga

SEQ ID NO: 5471253 - DNA, 13 bp, Homo sapiens
gatgacccaggct

SEQ ID NO: 5471254 - DNA, 17 bp, Homo sapiens
gatgaccccatagacct

SEQ ID NO: 5471255 - DNA, 20 bp, Homo sapiens
gatgacccctaccccctcat

SEQ ID NO: 5471256 - DNA, 12 bp, Homo sapiens
gatgacccctcc

SEQ ID NO: 5471257 - DNA, 23 bp, Homo sapiens
gatgaccctgcgaaggggccctg

SEQ ID NO: 5471258 - DNA, 14 bp, Homo sapiens
gatgaccgtgtaca

SEQ ID NO: 5471259 - DNA, 15 bp, Homo sapiens
gatgaccgtgtacaa

SEQ ID NO: 5471260 - DNA, 20 bp, Homo sapiens
gatgacctccttagaaaaga

SEQ ID NO: 5471261 - DNA, 22 bp, Homo sapiens
gatgacctcgtactcaggagcc

SEQ ID NO: 5471262 - DNA, 15 bp, Homo sapiens
gatgacctggataac

SEQ ID NO: 5471263 - DNA, 20 bp, Homo sapiens
gatgaccttgaatgatgcca

SEQ ID NO: 5471264 - DNA, 18 bp, Homo sapiens
gatgacgcctctggacct

SEQ ID NO: 5471265 - DNA, 14 bp, Homo sapiens
gatgacgcctgtct

SEQ ID NO: 5471266 - DNA, 15 bp, Homo sapiens
gatgacgggatgctc

SEQ ID NO: 5471267 - DNA, 15 bp, Homo sapiens
gatgactaaaatatt

SEQ ID NO: 5471268 - DNA, 15 bp, Homo sapiens
gatgactaacaagat

SEQ ID NO: 5471269 - DNA, 22 bp, Homo sapiens
gatgactatgcagaggcctggg

SEQ ID NO: 5471270 - DNA, 16 bp, Homo sapiens
gatgactcaagattcc

SEQ ID NO: 5471271 - DNA, 22 bp, Homo sapiens
gatgactcaagattttttctgg

SEQ ID NO: 5471272 - DNA, 18 bp, Homo sapiens
gatgactcccttaaaata

SEQ ID NO: 5471273 - DNA, 12 bp, Homo sapiens
gatgactctgag

SEQ ID NO: 5471274 - DNA, 22 bp, Homo sapiens
gatgactcttcttatcacactt

SEQ ID NO: 5471275 - DNA, 18 bp, Homo sapiens
gatgactgaaaatgaact

SEQ ID NO: 5471276 - DNA, 16 bp, Homo sapiens
gatgactgaatttcta

SEQ ID NO: 5471277 - DNA, 13 bp, Homo sapiens
gatgactgccttg

SEQ ID NO: 5471278 - DNA, 22 bp, Homo sapiens
gatgactgccttgcctcctcag

SEQ ID NO: 5471279 - DNA, 12 bp, Homo sapiens
gatgactgctga

SEQ ID NO: 5471280 - DNA, 14 bp, Homo sapiens
gatgactgctgatt

SEQ ID NO: 5471281 - DNA, 18 bp, Homo sapiens
gatgactggcattttata

SEQ ID NO: 5471282 - DNA, 16 bp, Homo sapiens
gatgacttgagatgaa

SEQ ID NO: 5471283 - DNA, 15 bp, Homo sapiens
gatgacttgagccct

SEQ ID NO: 5471284 - DNA, 22 bp, Homo sapiens
gatgacttggggacaccccaga

SEQ ID NO: 5471285 - DNA, 13 bp, Homo sapiens
gatgactttagaa

SEQ ID NO: 5471286 - DNA, 14 bp, Homo sapiens
gatgactttgcaga

SEQ ID NO: 5471287 - DNA, 18 bp, Homo sapiens
gatgagaaaactgagagg

SEQ ID NO: 5471288 - DNA, 22 bp, Homo sapiens
gatgagaaaggttgaagcacca

SEQ ID NO: 5471289 - DNA, 14 bp, Homo sapiens
gatgagaacaagct

SEQ ID NO: 5471290 - DNA, 13 bp, Homo sapiens
gatgagaatgtga

SEQ ID NO: 5471291 - DNA, 16 bp, Homo sapiens
gatgagacaacacaca

SEQ ID NO: 5471292 - DNA, 23 bp, Homo sapiens
gatgagacagggttttttcattt

SEQ ID NO: 5471293 - DNA, 19 bp, Homo sapiens
gatgagacccagccccttc

SEQ ID NO: 5471294 - DNA, 21 bp, Homo sapiens
gatgagacccagccccttccc

SEQ ID NO: 5471295 - DNA, 11 bp, Homo sapiens
gatgagagaat

SEQ ID NO: 5471296 - DNA, 14 bp, Homo sapiens
gatgagagcccaga

SEQ ID NO: 5471297 - DNA, 21 bp, Homo sapiens
gatgagagcccagaggtaaca

SEQ ID NO: 5471298 - DNA, 11 bp, Homo sapiens
gatgagaggca

SEQ ID NO: 5471299 - DNA, 15 bp, Homo sapiens
gatgagaggcagagg

SEQ ID NO: 5471300 - DNA, 14 bp, Homo sapiens
gatgagaggccagc

SEQ ID NO: 5471301 - DNA, 13 bp, Homo sapiens
gatgagagtggct

SEQ ID NO: 5471302 - DNA, 18 bp, Homo sapiens
gatgagagtggcttaaaa

SEQ ID NO: 5471303 - DNA, 21 bp, Homo sapiens
gatgagagttttggatgcagt

SEQ ID NO: 5471304 - DNA, 18 bp, Homo sapiens
gatgagatattaaattct

SEQ ID NO: 5471305 - DNA, 20 bp, Homo sapiens
gatgagattccctctcctcc

SEQ ID NO: 5471306 - DNA, 20 bp, Homo sapiens
gatgagattggcatggcttt

SEQ ID NO: 5471307 - DNA, 21 bp, Homo sapiens
gatgagatttgccagcacagg

SEQ ID NO: 5471308 - DNA, 17 bp, Homo sapiens
gatgagatttttcatgt

SEQ ID NO: 5471309 - DNA, 20 bp, Homo sapiens
gatgagcacatctctctgcc

SEQ ID NO: 5471310 - DNA, 12 bp, Homo sapiens
gatgctgaggcc

SEQ ID NO: 5471311 - DNA, 16 bp, Homo sapiens
gatgctgaggccaccc

SEQ ID NO: 5471312 - DNA, 18 bp, Homo sapiens
gatgctgaggccacccac

SEQ ID NO: 5471313 - DNA, 15 bp, Homo sapiens
gatgctgaggcccct

SEQ ID NO: 5471314 - DNA, 13 bp, Homo sapiens
gatgctgatgttc

SEQ ID NO: 5471315 - DNA, 23 bp, Homo sapiens
gatgctgccccgttccctgtcag

SEQ ID NO: 5471316 - DNA, 19 bp, Homo sapiens
gatgctgctccgcccgctc

SEQ ID NO: 5471317 - DNA, 16 bp, Homo sapiens
gatgctgctggcctcc

SEQ ID NO: 5471318 - DNA, 18 bp, Homo sapiens
gatgctgctggcctccct

SEQ ID NO: 5471319 - DNA, 14 bp, Homo sapiens
gatgctggagaggt

SEQ ID NO: 5471320 - DNA, 16 bp, Homo sapiens
gatgctggagaggtta

SEQ ID NO: 5471321 - DNA, 14 bp, Homo sapiens
gatgctggatgctc

SEQ ID NO: 5471322 - DNA, 18 bp, Homo sapiens
gatgctggatgctccttc

SEQ ID NO: 5471323 - DNA, 22 bp, Homo sapiens
gatgctggcccagggcccagag

SEQ ID NO: 5471324 - DNA, 23 bp, Homo sapiens
gatgctggcccagggcccagagc

SEQ ID NO: 5471325 - DNA, 22 bp, Homo sapiens
gatgctggcctgcgcctgcacc

SEQ ID NO: 5471326 - DNA, 13 bp, Homo sapiens
gatgctggctggg

SEQ ID NO: 5471327 - DNA, 15 bp, Homo sapiens
gatgctgggaccctc

SEQ ID NO: 5471328 - DNA, 13 bp, Homo sapiens
gatgctgggaggg

SEQ ID NO: 5471329 - DNA, 16 bp, Homo sapiens
gatgctgggagggctg

SEQ ID NO: 5471330 - DNA, 19 bp, Homo sapiens
gatgctgggagttctaaca

SEQ ID NO: 5471331 - DNA, 19 bp, Homo sapiens
gatgctgggcaatgaggca

SEQ ID NO: 5471332 - DNA, 21 bp, Homo sapiens
gatgctgggcacttcatctga

SEQ ID NO: 5471333 - DNA, 11 bp, Homo sapiens
gatgctgggct

SEQ ID NO: 5471334 - DNA, 20 bp, Homo sapiens
gatgctgggctctgttcttg

SEQ ID NO: 5471335 - DNA, 17 bp, Homo sapiens
gatgctgggctggctcc

SEQ ID NO: 5471336 - DNA, 22 bp, Homo sapiens
gatgctgggctggctccctctt

SEQ ID NO: 5471337 - DNA, 20 bp, Homo sapiens
gatgctgggctgggccctct

SEQ ID NO: 5471338 - DNA, 20 bp, Homo sapiens
gatgctggggagaatgaaga

SEQ ID NO: 5471339 - DNA, 12 bp, Homo sapiens
gatgctgggtgg

SEQ ID NO: 5471340 - DNA, 23 bp, Homo sapiens
gatgctggtcaagccccctttga

SEQ ID NO: 5471341 - DNA, 19 bp, Homo sapiens
gatgctggtggaggaaggg

SEQ ID NO: 5471342 - DNA, 20 bp, Homo sapiens
gatgctggtggaggaagggc

SEQ ID NO: 5471343 - DNA, 21 bp, Homo sapiens
gatgctggtggaggaagggct

SEQ ID NO: 5471344 - DNA, 22 bp, Homo sapiens
gatgctggtggaggaagggctg

SEQ ID NO: 5471345 - DNA, 23 bp, Homo sapiens
gatgctggtggaggaagggctgg

SEQ ID NO: 5471346 - DNA, 13 bp, Homo sapiens
gatgctgtatttg

SEQ ID NO: 5471347 - DNA, 18 bp, Homo sapiens
gatgctgtcggcaccatg

SEQ ID NO: 5471348 - DNA, 16 bp, Homo sapiens
gatgctgtgcctccca

SEQ ID NO: 5471349 - DNA, 12 bp, Homo sapiens
gatgctgttgcc

SEQ ID NO: 5471350 - DNA, 19 bp, Homo sapiens
gatgcttaataaacgcagc

SEQ ID NO: 5471351 - DNA, 14 bp, Homo sapiens
gatgcttacagtga

SEQ ID NO: 5471352 - DNA, 18 bp, Homo sapiens
gatgcttacagtgactgt

SEQ ID NO: 5471353 - DNA, 15 bp, Homo sapiens
gatgcttacatctgg

SEQ ID NO: 5471354 - DNA, 20 bp, Homo sapiens
gatgcttaggtgaaggcaga

SEQ ID NO: 5471355 - DNA, 11 bp, Homo sapiens
gatgcttctgc

SEQ ID NO: 5471356 - DNA, 19 bp, Homo sapiens
gatgcttggagcaatcaga

SEQ ID NO: 5471357 - DNA, 21 bp, Homo sapiens
gatgcttgtaacaagaaaaca

SEQ ID NO: 5471358 - DNA, 16 bp, Homo sapiens
gatgcttgtacataat

SEQ ID NO: 5471359 - DNA, 21 bp, Homo sapiens
gatgctttaccaaacagcaaa

SEQ ID NO: 5471360 - DNA, 23 bp, Homo sapiens
gatgctttgtttctttcatatga

SEQ ID NO: 5471361 - DNA, 14 bp, Homo sapiens
gatgcttttaacag

SEQ ID NO: 5471362 - DNA, 14 bp, Homo sapiens
gatgcttttctctc

SEQ ID NO: 5471363 - DNA, 20 bp, Homo sapiens
gatgcttttctgtctctgcc

SEQ ID NO: 5471364 - DNA, 11 bp, Homo sapiens
gatgcttttgc

SEQ ID NO: 5471365 - DNA, 19 bp, Homo sapiens
gatgcttttgctgctgctt

SEQ ID NO: 5471366 - DNA, 20 bp, Homo sapiens
gatggaaaaaaaaaacaaaa

SEQ ID NO: 5471367 - DNA, 13 bp, Homo sapiens
gatggaaaaataa

SEQ ID NO: 5471368 - DNA, 18 bp, Homo sapiens
gatggaaaagaactagga

SEQ ID NO: 5471369 - DNA, 15 bp, Homo sapiens
gatggaaaaggaaga

SEQ ID NO: 5471370 - DNA, 17 bp, Homo sapiens
gatggaaaaggaagact

SEQ ID NO: 5471371 - DNA, 16 bp, Homo sapiens
gatggaaaataaacat

SEQ ID NO: 5471372 - DNA, 14 bp, Homo sapiens
gatggaaacaaagt

SEQ ID NO: 5471373 - DNA, 18 bp, Homo sapiens
gatggaaacaatgtggag

SEQ ID NO: 5471374 - DNA, 16 bp, Homo sapiens
gatggaaacgcactta

SEQ ID NO: 5471375 - DNA, 19 bp, Homo sapiens
gatggaaacgcacttacaa

SEQ ID NO: 5471376 - DNA, 15 bp, Homo sapiens
gatggaaactgccaa

SEQ ID NO: 5471377 - DNA, 14 bp, Homo sapiens
gatggaaatacagt

SEQ ID NO: 5471378 - DNA, 21 bp, Homo sapiens
gatggaaattctgaaaactga

SEQ ID NO: 5471379 - DNA, 15 bp, Homo sapiens
gatggaacatcagtg

SEQ ID NO: 5471380 - DNA, 19 bp, Homo sapiens
gatggaaccgcaggaagct

SEQ ID NO: 5471381 - DNA, 18 bp, Homo sapiens
gatggaactgtgtattta

SEQ ID NO: 5471382 - DNA, 16 bp, Homo sapiens
gatggaagaaagaagc

SEQ ID NO: 5471383 - DNA, 14 bp, Homo sapiens
gatggaagagtcat

SEQ ID NO: 5471384 - DNA, 13 bp, Homo sapiens
gatggaagcacac

SEQ ID NO: 5471385 - DNA, 20 bp, Homo sapiens
gatggaagtgggccagtcct

SEQ ID NO: 5471386 - DNA, 22 bp, Homo sapiens
gatggaagtgggccagtcctgg

SEQ ID NO: 5471387 - DNA, 20 bp, Homo sapiens
gatggaatatcatgaatgtg

SEQ ID NO: 5471388 - DNA, 14 bp, Homo sapiens
gatggaatcacagc

SEQ ID NO: 5471389 - DNA, 16 bp, Homo sapiens
gatggaatcacagcca

SEQ ID NO: 5471390 - DNA, 17 bp, Homo sapiens
gatggaatcacagccaa

SEQ ID NO: 5471391 - DNA, 13 bp, Homo sapiens
gatggaatgatgg

SEQ ID NO: 5471392 - DNA, 17 bp, Homo sapiens
gatggaatgtgccacct

SEQ ID NO: 5471393 - DNA, 20 bp, Homo sapiens
gatggaattcttcctcctct

SEQ ID NO: 5471394 - DNA, 21 bp, Homo sapiens
gatggaattcttcctcctctg

SEQ ID NO: 5471395 - DNA, 21 bp, Homo sapiens
gatggaatttttctgtacttc

SEQ ID NO: 5471396 - DNA, 18 bp, Homo sapiens
gatggacaaaggcctggc

SEQ ID NO: 5471397 - DNA, 16 bp, Homo sapiens
gatggacacccccagc

SEQ ID NO: 5471398 - DNA, 11 bp, Homo sapiens
gatggacagac

SEQ ID NO: 5471399 - DNA, 13 bp, Homo sapiens
gatggacagacac

SEQ ID NO: 5471400 - DNA, 14 bp, Homo sapiens
gatggacagacacc

SEQ ID NO: 5471401 - DNA, 15 bp, Homo sapiens
gatggacagacacct

SEQ ID NO: 5471402 - DNA, 17 bp, Homo sapiens
gatggacagacacctcc

SEQ ID NO: 5471403 - DNA, 20 bp, Homo sapiens
gatggacagacacctccccc

SEQ ID NO: 5471404 - DNA, 15 bp, Homo sapiens
gatggacagatggac

SEQ ID NO: 5471405 - DNA, 15 bp, Homo sapiens
gatggacaggaaagg

SEQ ID NO: 5471406 - DNA, 16 bp, Homo sapiens
gatggacagtttgttt

SEQ ID NO: 5471407 - DNA, 14 bp, Homo sapiens
gatggaccaaagcc

SEQ ID NO: 5471408 - DNA, 15 bp, Homo sapiens
gatggaccaaagcca

SEQ ID NO: 5471409 - DNA, 21 bp, Homo sapiens
gatggaccaaagccacctgct

SEQ ID NO: 5471410 - DNA, 18 bp, Homo sapiens
gatggaccaacctgctct

SEQ ID NO: 5471411 - DNA, 13 bp, Homo sapiens
gatggaccccagc

SEQ ID NO: 5471412 - DNA, 14 bp, Homo sapiens
gatggaccccagca

SEQ ID NO: 5471413 - DNA, 13 bp, Homo sapiens
gatggaccctcgc

SEQ ID NO: 5471414 - DNA, 18 bp, Homo sapiens
gatggaccctcgcagcag

SEQ ID NO: 5471415 - DNA, 19 bp, Homo sapiens
gatggaccgggtgggcctg

SEQ ID NO: 5471416 - DNA, 22 bp, Homo sapiens
gatggaccgggtgggcctggcc

SEQ ID NO: 5471417 - DNA, 24 bp, Homo sapiens
gatggacctgccccggacctacct

SEQ ID NO: 5471418 - DNA, 16 bp, Homo sapiens
gatggactgggaggag

SEQ ID NO: 5471419 - DNA, 14 bp, Homo sapiens
gatggacttgaaaa

SEQ ID NO: 5471420 - DNA, 23 bp, Homo sapiens
gatggacttgtgattggctgcag

SEQ ID NO: 5471421 - DNA, 16 bp, Homo sapiens
gatggagaaacaggct

SEQ ID NO: 5471422 - DNA, 18 bp, Homo sapiens
gatggagaaagaagtgga

SEQ ID NO: 5471423 - DNA, 11 bp, Homo sapiens
gatggagaagg

SEQ ID NO: 5471424 - DNA, 15 bp, Homo sapiens
gatggagaaggaagg

SEQ ID NO: 5471425 - DNA, 16 bp, Homo sapiens
gatggagaaggaaggc

SEQ ID NO: 5471426 - DNA, 17 bp, Homo sapiens
gatggagaatgccagcc

SEQ ID NO: 5471427 - DNA, 19 bp, Homo sapiens
gatggagaatgccagccca

SEQ ID NO: 5471428 - DNA, 18 bp, Homo sapiens
gatggagacaccctctgg

SEQ ID NO: 5471429 - DNA, 22 bp, Homo sapiens
gatggagacaccctctgggggt

SEQ ID NO: 5471430 - DNA, 15 bp, Homo sapiens
gatggagacacgggg

SEQ ID NO: 5471431 - DNA, 18 bp, Homo sapiens
gatggagaggaagaaacg

SEQ ID NO: 5471432 - DNA, 14 bp, Homo sapiens
gatggagaggcatg

SEQ ID NO: 5471433 - DNA, 23 bp, Homo sapiens
gatggagaggcatgggggcccaa

SEQ ID NO: 5471434 - DNA, 15 bp, Homo sapiens
gatggagaggcggcc

SEQ ID NO: 5471435 - DNA, 17 bp, Homo sapiens
gatggagcaagctcttc

SEQ ID NO: 5471436 - DNA, 21 bp, Homo sapiens
gatggagcaagctcttccctt

SEQ ID NO: 5471437 - DNA, 17 bp, Homo sapiens
gatggagcccaggcggg

SEQ ID NO: 5471438 - DNA, 22 bp, Homo sapiens
gatggagcccaggcgggagcgg

SEQ ID NO: 5471439 - DNA, 16 bp, Homo sapiens
gatggagccccacctt

SEQ ID NO: 5471440 - DNA, 23 bp, Homo sapiens
gatggagccccaccttgtctgct

SEQ ID NO: 5471441 - DNA, 18 bp, Homo sapiens
gatggagcccccagatag

SEQ ID NO: 5471442 - DNA, 16 bp, Homo sapiens
gatggagcctgaaccg

SEQ ID NO: 5471443 - DNA, 15 bp, Homo sapiens
gatggaggaaaaagg

SEQ ID NO: 5471444 - DNA, 21 bp, Homo sapiens
gatggaggaacccaagaaagg

SEQ ID NO: 5471445 - DNA, 13 bp, Homo sapiens
gatggaggagaag

SEQ ID NO: 5471446 - DNA, 12 bp, Homo sapiens
gatggaggccag

SEQ ID NO: 5471447 - DNA, 18 bp, Homo sapiens
gatggaggcctacctctc

SEQ ID NO: 5471448 - DNA, 14 bp, Homo sapiens
gatggaggggagag

SEQ ID NO: 5471449 - DNA, 19 bp, Homo sapiens
gatggagggggctggggtc

SEQ ID NO: 5471450 - DNA, 21 bp, Homo sapiens
gatggaggggtggtcctgact

SEQ ID NO: 5471451 - DNA, 22 bp, Homo sapiens
gatggaggggtggtcctgactc

SEQ ID NO: 5471452 - DNA, 14 bp, Homo sapiens
gatggaggtagggc

SEQ ID NO: 5471453 - DNA, 19 bp, Homo sapiens
gatggaggttctctcggag

SEQ ID NO: 5471454 - DNA, 16 bp, Homo sapiens
gatggaggtttcatac

SEQ ID NO: 5471455 - DNA, 18 bp, Homo sapiens
gatggagtccagggaaga

SEQ ID NO: 5471456 - DNA, 17 bp, Homo sapiens
gatggagtgagcccatg

SEQ ID NO: 5471457 - DNA, 14 bp, Homo sapiens
gatggagtgtgcag

SEQ ID NO: 5471458 - DNA, 16 bp, Homo sapiens
gatggagttcttgtgc

SEQ ID NO: 5471459 - DNA, 17 bp, Homo sapiens
gatggagtttctctctt

SEQ ID NO: 5471460 - DNA, 17 bp, Homo sapiens
gatggataaactgagcc

SEQ ID NO: 5471461 - DNA, 18 bp, Homo sapiens
gatggataaactgagcct

SEQ ID NO: 5471462 - DNA, 18 bp, Homo sapiens
gatggataacctatatga

SEQ ID NO: 5471463 - DNA, 14 bp, Homo sapiens
gatggatcaccatt

SEQ ID NO: 5471464 - DNA, 15 bp, Homo sapiens
gatggatctgctcca

SEQ ID NO: 5471465 - DNA, 18 bp, Homo sapiens
gatggatctgctccatgc

SEQ ID NO: 5471466 - DNA, 14 bp, Homo sapiens
gatggatggacaga

SEQ ID NO: 5471467 - DNA, 16 bp, Homo sapiens
gatggatggacagaat

SEQ ID NO: 5471468 - DNA, 17 bp, Homo sapiens
gatggatggacagaatg

SEQ ID NO: 5471469 - DNA, 17 bp, Homo sapiens
gatggatggcacaatga

SEQ ID NO: 5471470 - DNA, 18 bp, Homo sapiens
gatggatggcaccctgga

SEQ ID NO: 5471471 - DNA, 19 bp, Homo sapiens
gatggatggcaccctggaa

SEQ ID NO: 5471472 - DNA, 14 bp, Homo sapiens
gatggatggcagac

SEQ ID NO: 5471473 - DNA, 16 bp, Homo sapiens
gatggatggcagactc

SEQ ID NO: 5471474 - DNA, 17 bp, Homo sapiens
gatggatgtagatacag

SEQ ID NO: 5471475 - DNA, 14 bp, Homo sapiens
gatggattcatcat

SEQ ID NO: 5471476 - DNA, 22 bp, Homo sapiens
gatggattccaaccccaactcc

SEQ ID NO: 5471477 - DNA, 21 bp, Homo sapiens
gatggattcccccccctttcc

SEQ ID NO: 5471478 - DNA, 23 bp, Homo sapiens
gatggattcccccccctttccta

SEQ ID NO: 5471479 - DNA, 16 bp, Homo sapiens
gatggattctcagata

SEQ ID NO: 5471480 - DNA, 19 bp, Homo sapiens
gatggattctcagatattt

SEQ ID NO: 5471481 - DNA, 20 bp, Homo sapiens
gatggattggcctccagggc

SEQ ID NO: 5471482 - DNA, 17 bp, Homo sapiens
gatggatttaacagcat

SEQ ID NO: 5471483 - DNA, 22 bp, Homo sapiens
gatggatttaacagcatgacaa

SEQ ID NO: 5471484 - DNA, 14 bp, Homo sapiens
gatggatttgacac

SEQ ID NO: 5471485 - DNA, 19 bp, Homo sapiens
gatggatttgacacactca

SEQ ID NO: 5471486 - DNA, 14 bp, Homo sapiens
gatggatttgcctg

SEQ ID NO: 5471487 - DNA, 15 bp, Homo sapiens
gatggcaacagatct

SEQ ID NO: 5471488 - DNA, 17 bp, Homo sapiens
gatggcaacattggaca

SEQ ID NO: 5471489 - DNA, 22 bp, Homo sapiens
tattttcacagatggaagaagt

SEQ ID NO: 5471490 - DNA, 12 bp, Homo sapiens
tattttcagaat

SEQ ID NO: 5471491 - DNA, 22 bp, Homo sapiens
tattttcagaatctgaatgtaa

SEQ ID NO: 5471492 - DNA, 14 bp, Homo sapiens
tattttcagatgtg

SEQ ID NO: 5471493 - DNA, 16 bp, Homo sapiens
tattttcagctcaatt

SEQ ID NO: 5471494 - DNA, 17 bp, Homo sapiens
tattttcagtattttgg

SEQ ID NO: 5471495 - DNA, 19 bp, Homo sapiens
tattttcagtcaaaacttt

SEQ ID NO: 5471496 - DNA, 16 bp, Homo sapiens
tattttcataattcat

SEQ ID NO: 5471497 - DNA, 11 bp, Homo sapiens
tattttcatag

SEQ ID NO: 5471498 - DNA, 13 bp, Homo sapiens
tattttcatagtg

SEQ ID NO: 5471499 - DNA, 13 bp, Homo sapiens
tattttcatattt

SEQ ID NO: 5471500 - DNA, 18 bp, Homo sapiens
tattttcattctgccaaa

SEQ ID NO: 5471501 - DNA, 13 bp, Homo sapiens
tattttcattgta

SEQ ID NO: 5471502 - DNA, 15 bp, Homo sapiens
tattttcattgtaaa

SEQ ID NO: 5471503 - DNA, 20 bp, Homo sapiens
tattttcatttaactacaaa

SEQ ID NO: 5471504 - DNA, 14 bp, Homo sapiens
tattttcatttcta

SEQ ID NO: 5471505 - DNA, 22 bp, Homo sapiens
tattttccaaaagtggcctctt

SEQ ID NO: 5471506 - DNA, 18 bp, Homo sapiens
tattttccaccttttgtt

SEQ ID NO: 5471507 - DNA, 14 bp, Homo sapiens
tattttccatatat

SEQ ID NO: 5471508 - DNA, 18 bp, Homo sapiens
tattttcccaatagcact

SEQ ID NO: 5471509 - DNA, 23 bp, Homo sapiens
tattttcccaatagcactttcat

SEQ ID NO: 5471510 - DNA, 19 bp, Homo sapiens
tattttcccacaattcttt

SEQ ID NO: 5471511 - DNA, 19 bp, Homo sapiens
tattttcccctatcattta

SEQ ID NO: 5471512 - DNA, 16 bp, Homo sapiens
tattttccctacctaa

SEQ ID NO: 5471513 - DNA, 20 bp, Homo sapiens
tattttccctacctaagaat

SEQ ID NO: 5471514 - DNA, 20 bp, Homo sapiens
tattttcccttcatgtttta

SEQ ID NO: 5471515 - DNA, 20 bp, Homo sapiens
tattttccctttttaaaaaa

SEQ ID NO: 5471516 - DNA, 14 bp, Homo sapiens
tattttcctgtaaa

SEQ ID NO: 5471517 - DNA, 18 bp, Homo sapiens
tattttccttccatgctc

SEQ ID NO: 5471518 - DNA, 22 bp, Homo sapiens
tattttccttccatgctcccaa

SEQ ID NO: 5471519 - DNA, 19 bp, Homo sapiens
tattttccttgcttttctt

SEQ ID NO: 5471520 - DNA, 14 bp, Homo sapiens
tattttcctttaga

SEQ ID NO: 5471521 - DNA, 17 bp, Homo sapiens
tattttcgtgcatttgt

SEQ ID NO: 5471522 - DNA, 23 bp, Homo sapiens
tattttcgtgcatttgtgagcca

SEQ ID NO: 5471523 - DNA, 20 bp, Homo sapiens
tattttctacgtttctttaa

SEQ ID NO: 5471524 - DNA, 13 bp, Homo sapiens
tattttctatatt

SEQ ID NO: 5471525 - DNA, 19 bp, Homo sapiens
tattttctatatttggatt

SEQ ID NO: 5471526 - DNA, 19 bp, Homo sapiens
tattttctatatttgtaac

SEQ ID NO: 5471527 - DNA, 20 bp, Homo sapiens
tattttctatatttgtaact

SEQ ID NO: 5471528 - DNA, 14 bp, Homo sapiens
tattttctatgtac

SEQ ID NO: 5471529 - DNA, 15 bp, Homo sapiens
tattttctatgtact

SEQ ID NO: 5471530 - DNA, 17 bp, Homo sapiens
tattttctatgtactag

SEQ ID NO: 5471531 - DNA, 16 bp, Homo sapiens
tattttctccacttca

SEQ ID NO: 5471532 - DNA, 12 bp, Homo sapiens
tattttctgaat

SEQ ID NO: 5471533 - DNA, 11 bp, Homo sapiens
tattttctgac

SEQ ID NO: 5471534 - DNA, 14 bp, Homo sapiens
tattttctgaccaa

SEQ ID NO: 5471535 - DNA, 15 bp, Homo sapiens
tattttctgaccaaa

SEQ ID NO: 5471536 - DNA, 12 bp, Homo sapiens
tattttctgcaa

SEQ ID NO: 5471537 - DNA, 17 bp, Homo sapiens
tattttctgtaattctt

SEQ ID NO: 5471538 - DNA, 13 bp, Homo sapiens
tattttctgtcac

SEQ ID NO: 5471539 - DNA, 14 bp, Homo sapiens
tattttctgtcaga

SEQ ID NO: 5471540 - DNA, 17 bp, Homo sapiens
tattttctgtcagatga

SEQ ID NO: 5471541 - DNA, 17 bp, Homo sapiens
tattttctgtgtaaaat

SEQ ID NO: 5471542 - DNA, 16 bp, Homo sapiens
tattttctgtgtgttc

SEQ ID NO: 5471543 - DNA, 17 bp, Homo sapiens
tattttctgtgtgttcc

SEQ ID NO: 5471544 - DNA, 12 bp, Homo sapiens
tattttctgttt

SEQ ID NO: 5471545 - DNA, 12 bp, Homo sapiens
tattttcttaaa

SEQ ID NO: 5471546 - DNA, 20 bp, Homo sapiens
tattttcttatgtaagtttg

SEQ ID NO: 5471547 - DNA, 13 bp, Homo sapiens
tattttctttcac

SEQ ID NO: 5471548 - DNA, 19 bp, Homo sapiens
tattttctttgaaattcat

SEQ ID NO: 5471549 - DNA, 22 bp, Homo sapiens
tattttcttttatatctgtaaa

SEQ ID NO: 5471550 - DNA, 16 bp, Homo sapiens
tattttcttttgtaaa

SEQ ID NO: 5471551 - DNA, 17 bp, Homo sapiens
tattttgaaaacactta

SEQ ID NO: 5471552 - DNA, 20 bp, Homo sapiens
tattttgaaaagcttcttaa

SEQ ID NO: 5471553 - DNA, 12 bp, Homo sapiens
tattttgaaagg

SEQ ID NO: 5471554 - DNA, 13 bp, Homo sapiens
tattttgaaatga

SEQ ID NO: 5471555 - DNA, 17 bp, Homo sapiens
tattttgaaatggaaat

SEQ ID NO: 5471556 - DNA, 12 bp, Homo sapiens
tattttgaaatt

SEQ ID NO: 5471557 - DNA, 12 bp, Homo sapiens
tattttgaacaa

SEQ ID NO: 5471558 - DNA, 14 bp, Homo sapiens
tattttgaagaaaa

SEQ ID NO: 5471559 - DNA, 14 bp, Homo sapiens
tattttgaagaata

SEQ ID NO: 5471560 - DNA, 21 bp, Homo sapiens
tattttgaagaatatttaaga

SEQ ID NO: 5471561 - DNA, 11 bp, Homo sapiens
tattttgaagt

SEQ ID NO: 5471562 - DNA, 14 bp, Homo sapiens
tattttgaagttta

SEQ ID NO: 5471563 - DNA, 18 bp, Homo sapiens
tattttgaagtttacatt

SEQ ID NO: 5471564 - DNA, 13 bp, Homo sapiens
tattttgaatcaa

SEQ ID NO: 5471565 - DNA, 15 bp, Homo sapiens
tattttgaatcaata

SEQ ID NO: 5471566 - DNA, 11 bp, Homo sapiens
tattttgaatg

SEQ ID NO: 5471567 - DNA, 16 bp, Homo sapiens
tattttgaatgtacct

SEQ ID NO: 5471568 - DNA, 12 bp, Homo sapiens
tattttgacaaa

SEQ ID NO: 5471569 - DNA, 14 bp, Homo sapiens
tattttgacaaaaa

SEQ ID NO: 5471570 - DNA, 15 bp, Homo sapiens
tattttgacaaaaat

SEQ ID NO: 5471571 - DNA, 20 bp, Homo sapiens
tattttgacttgttgagggt

SEQ ID NO: 5471572 - DNA, 18 bp, Homo sapiens
tattttgagtttcagctg

SEQ ID NO: 5471573 - DNA, 14 bp, Homo sapiens
tattttgataataa

SEQ ID NO: 5471574 - DNA, 18 bp, Homo sapiens
tattttgataataatatt

SEQ ID NO: 5471575 - DNA, 12 bp, Homo sapiens
tattttgatcac

SEQ ID NO: 5471576 - DNA, 12 bp, Homo sapiens
tattttgatctt

SEQ ID NO: 5471577 - DNA, 14 bp, Homo sapiens
tattttgatcttca

SEQ ID NO: 5471578 - DNA, 18 bp, Homo sapiens
tattttgatcttcaacaa

SEQ ID NO: 5471579 - DNA, 13 bp, Homo sapiens
tattttgatgcag

SEQ ID NO: 5471580 - DNA, 17 bp, Homo sapiens
tattttgatgcagcatt

SEQ ID NO: 5471581 - DNA, 19 bp, Homo sapiens
tattttgatgcagcatttg

SEQ ID NO: 5471582 - DNA, 23 bp, Homo sapiens
tattttgatgcagcatttgataa

SEQ ID NO: 5471583 - DNA, 17 bp, Homo sapiens
tattttgatgtaaagat

SEQ ID NO: 5471584 - DNA, 16 bp, Homo sapiens
tattttgattttacat

SEQ ID NO: 5471585 - DNA, 13 bp, Homo sapiens
tattttgcaaaca

SEQ ID NO: 5471586 - DNA, 21 bp, Homo sapiens
tattttgcagttcccacatta

SEQ ID NO: 5471587 - DNA, 18 bp, Homo sapiens
tattttgcatatatgttc

SEQ ID NO: 5471588 - DNA, 13 bp, Homo sapiens
tattttgccactg

SEQ ID NO: 5471589 - DNA, 15 bp, Homo sapiens
tattttgctaactgg

SEQ ID NO: 5471590 - DNA, 16 bp, Homo sapiens
tattttgctaactggt

SEQ ID NO: 5471591 - DNA, 17 bp, Homo sapiens
tattttgctaactggtt

SEQ ID NO: 5471592 - DNA, 19 bp, Homo sapiens
tattttgctaactggttaa

SEQ ID NO: 5471593 - DNA, 22 bp, Homo sapiens
tattttgctaactggttaaaca

SEQ ID NO: 5471594 - DNA, 14 bp, Homo sapiens
tattttgctccctc

SEQ ID NO: 5471595 - DNA, 16 bp, Homo sapiens
tattttgctccctctg

SEQ ID NO: 5471596 - DNA, 17 bp, Homo sapiens
tattttgctccctctgt

SEQ ID NO: 5471597 - DNA, 18 bp, Homo sapiens
tattttgctccctctgtt

SEQ ID NO: 5471598 - DNA, 20 bp, Homo sapiens
tattttgctccctctgttag

SEQ ID NO: 5471599 - DNA, 16 bp, Homo sapiens
tattttgctcttgttt

SEQ ID NO: 5471600 - DNA, 21 bp, Homo sapiens
tattttgctgagttgttctaa

SEQ ID NO: 5471601 - DNA, 21 bp, Homo sapiens
tattttgctgcttgatgatga

SEQ ID NO: 5471602 - DNA, 15 bp, Homo sapiens
tattttgctttgtga

SEQ ID NO: 5471603 - DNA, 12 bp, Homo sapiens
tattttggaaac

SEQ ID NO: 5471604 - DNA, 13 bp, Homo sapiens
tattttggaaact

SEQ ID NO: 5471605 - DNA, 23 bp, Homo sapiens
tattttggaaactgctaaattct

SEQ ID NO: 5471606 - DNA, 16 bp, Homo sapiens
tattttggaactatga

SEQ ID NO: 5471607 - DNA, 20 bp, Homo sapiens
tattttggaagacatatatt

SEQ ID NO: 5471608 - DNA, 21 bp, Homo sapiens
tattttggaagacatatatta

SEQ ID NO: 5471609 - DNA, 21 bp, Homo sapiens
tattttggaataagcattgtt

SEQ ID NO: 5471610 - DNA, 23 bp, Homo sapiens
tattttggaggtgcttgatctat

SEQ ID NO: 5471611 - DNA, 23 bp, Homo sapiens
tattttggattgtatattgtgtt

SEQ ID NO: 5471612 - DNA, 16 bp, Homo sapiens
tattttggattgtgga

SEQ ID NO: 5471613 - DNA, 21 bp, Homo sapiens
tattttggctcaaataaaatt

SEQ ID NO: 5471614 - DNA, 16 bp, Homo sapiens
tattttggctttctcc

SEQ ID NO: 5471615 - DNA, 18 bp, Homo sapiens
tattttggctttctccct

SEQ ID NO: 5471616 - DNA, 19 bp, Homo sapiens
tattttggggaactgttgt

SEQ ID NO: 5471617 - DNA, 22 bp, Homo sapiens
tattttgggtatattttcaaga

SEQ ID NO: 5471618 - DNA, 14 bp, Homo sapiens
tattttggtacttt

SEQ ID NO: 5471619 - DNA, 17 bp, Homo sapiens
tattttggtacttttat

SEQ ID NO: 5471620 - DNA, 14 bp, Homo sapiens
tattttgtaaaatg

SEQ ID NO: 5471621 - DNA, 18 bp, Homo sapiens
tattttgtaaaatgtatt

SEQ ID NO: 5471622 - DNA, 22 bp, Homo sapiens
tattttgtaaaatgtattatgt

SEQ ID NO: 5471623 - DNA, 13 bp, Homo sapiens
tattttgtaaact

SEQ ID NO: 5471624 - DNA, 14 bp, Homo sapiens
tattttgtaataaa

SEQ ID NO: 5471625 - DNA, 17 bp, Homo sapiens
tattttgtaataaactc

SEQ ID NO: 5471626 - DNA, 19 bp, Homo sapiens
tattttgtaataaactctc

SEQ ID NO: 5471627 - DNA, 22 bp, Homo sapiens
tattttgtaataaactctctag

SEQ ID NO: 5471628 - DNA, 21 bp, Homo sapiens
tattttgtaatttttttgaaa

SEQ ID NO: 5471629 - DNA, 21 bp, Homo sapiens
tattttgtacaaagtaaaaat

SEQ ID NO: 5471630 - DNA, 17 bp, Homo sapiens
tattttgtacatttttc

SEQ ID NO: 5471631 - DNA, 15 bp, Homo sapiens
tattttgtatgaaat

SEQ ID NO: 5471632 - DNA, 23 bp, Homo sapiens
tattttgtcacccaacctggcat

SEQ ID NO: 5471633 - DNA, 16 bp, Homo sapiens
tattttgtcactgctg

SEQ ID NO: 5471634 - DNA, 23 bp, Homo sapiens
tattttgtcactgctgtaaagca

SEQ ID NO: 5471635 - DNA, 16 bp, Homo sapiens
tattttgtcataaaat

SEQ ID NO: 5471636 - DNA, 16 bp, Homo sapiens
tattttgtcatatcaa

SEQ ID NO: 5471637 - DNA, 18 bp, Homo sapiens
tattttgtcatatcaaat

SEQ ID NO: 5471638 - DNA, 23 bp, Homo sapiens
tattttgtggaggcagtgtcatt

SEQ ID NO: 5471639 - DNA, 22 bp, Homo sapiens
tattttgtgggcttaattgaaa

SEQ ID NO: 5471640 - DNA, 23 bp, Homo sapiens
tattttgtggttctattttactt

SEQ ID NO: 5471641 - DNA, 12 bp, Homo sapiens
tattttgtgtaa

SEQ ID NO: 5471642 - DNA, 16 bp, Homo sapiens
tattttgtgtaaaaaa

SEQ ID NO: 5471643 - DNA, 17 bp, Homo sapiens
tattttgtgtttaggaa

SEQ ID NO: 5471644 - DNA, 16 bp, Homo sapiens
tattttgttaaagctg

SEQ ID NO: 5471645 - DNA, 19 bp, Homo sapiens
tattttgttaccttttaca

SEQ ID NO: 5471646 - DNA, 15 bp, Homo sapiens
tattttgttactgtc

SEQ ID NO: 5471647 - DNA, 16 bp, Homo sapiens
tattttgttactgtct

SEQ ID NO: 5471648 - DNA, 17 bp, Homo sapiens
tattttgttgctttctt

SEQ ID NO: 5471649 - DNA, 16 bp, Homo sapiens
tattttgttgtgcact

SEQ ID NO: 5471650 - DNA, 20 bp, Homo sapiens
tattttgtttcaatctctga

SEQ ID NO: 5471651 - DNA, 23 bp, Homo sapiens
tatttttaaaaaatgaaatcctt

SEQ ID NO: 5471652 - DNA, 15 bp, Homo sapiens
tatttttaaaaagaa

SEQ ID NO: 5471653 - DNA, 15 bp, Homo sapiens
tatttttaaaataaa

SEQ ID NO: 5471654 - DNA, 20 bp, Homo sapiens
tatttttaaaataaaaatat

SEQ ID NO: 5471655 - DNA, 21 bp, Homo sapiens
tatttttaaaatatttaactt

SEQ ID NO: 5471656 - DNA, 13 bp, Homo sapiens
tatttttaaagat

SEQ ID NO: 5471657 - DNA, 15 bp, Homo sapiens
tatttttaaagatag

SEQ ID NO: 5471658 - DNA, 13 bp, Homo sapiens
tatttttaaataa

SEQ ID NO: 5471659 - DNA, 18 bp, Homo sapiens
tatttttaacacttaaat

SEQ ID NO: 5471660 - DNA, 20 bp, Homo sapiens
tatttttaacacttaaattt

SEQ ID NO: 5471661 - DNA, 12 bp, Homo sapiens
tatttttaagaa

SEQ ID NO: 5471662 - DNA, 22 bp, Homo sapiens
tatttttaagaaaaattcacaa

SEQ ID NO: 5471663 - DNA, 18 bp, Homo sapiens
tatttttaagaaagaaat

SEQ ID NO: 5471664 - DNA, 12 bp, Homo sapiens
tatttttaaggt

SEQ ID NO: 5471665 - DNA, 14 bp, Homo sapiens
tatttttaatatgt

SEQ ID NO: 5471666 - DNA, 17 bp, Homo sapiens
tatttttaattaaataa

SEQ ID NO: 5471667 - DNA, 20 bp, Homo sapiens
tatttttaatttcctgtgag

SEQ ID NO: 5471668 - DNA, 15 bp, Homo sapiens
tatttttactgccac

SEQ ID NO: 5471669 - DNA, 18 bp, Homo sapiens
tcaaaggattttggaaaa

SEQ ID NO: 5471670 - DNA, 20 bp, Homo sapiens
tcaaaggattttggaaaaga

SEQ ID NO: 5471671 - DNA, 21 bp, Homo sapiens
tcaaaggattttggaaaagaa

SEQ ID NO: 5471672 - DNA, 12 bp, Homo sapiens
tcaaaggccaga

SEQ ID NO: 5471673 - DNA, 14 bp, Homo sapiens
tcaaaggccagacc

SEQ ID NO: 5471674 - DNA, 16 bp, Homo sapiens
tcaaagggacttttgt

SEQ ID NO: 5471675 - DNA, 17 bp, Homo sapiens
tcaaagggagagaaaag

SEQ ID NO: 5471676 - DNA, 20 bp, Homo sapiens
tcaaagggattgctttttcc

SEQ ID NO: 5471677 - DNA, 17 bp, Homo sapiens
tcaaagggcagttttga

SEQ ID NO: 5471678 - DNA, 15 bp, Homo sapiens
tcaaagggtaaatta

SEQ ID NO: 5471679 - DNA, 21 bp, Homo sapiens
tcaaagggtaaattataaatg

SEQ ID NO: 5471680 - DNA, 17 bp, Homo sapiens
tcaaaggtgatgtaatt

SEQ ID NO: 5471681 - DNA, 12 bp, Homo sapiens
tcaaaggttcta

SEQ ID NO: 5471682 - DNA, 22 bp, Homo sapiens
tcaaagtaaaaaattaaagccc

SEQ ID NO: 5471683 - DNA, 14 bp, Homo sapiens
tcaaagtaaaactt

SEQ ID NO: 5471684 - DNA, 17 bp, Homo sapiens
tcaaagtaaaggcctcc

SEQ ID NO: 5471685 - DNA, 16 bp, Homo sapiens
tcaaagtaaggctggt

SEQ ID NO: 5471686 - DNA, 16 bp, Homo sapiens
tcaaagtactaaaact

SEQ ID NO: 5471687 - DNA, 17 bp, Homo sapiens
tcaaagtactaaaacta

SEQ ID NO: 5471688 - DNA, 19 bp, Homo sapiens
tcaaagtaggtatacaaaa

SEQ ID NO: 5471689 - DNA, 21 bp, Homo sapiens
tcaaagtagttttattttaat

SEQ ID NO: 5471690 - DNA, 20 bp, Homo sapiens
tcaaagtataatctttctat

SEQ ID NO: 5471691 - DNA, 14 bp, Homo sapiens
tcaaagtatgcaat

SEQ ID NO: 5471692 - DNA, 18 bp, Homo sapiens
tcaaagtatgcaatgctt

SEQ ID NO: 5471693 - DNA, 17 bp, Homo sapiens
tcaaagtcatgatgttt

SEQ ID NO: 5471694 - DNA, 19 bp, Homo sapiens
tcaaagtcatgatgttttt

SEQ ID NO: 5471695 - DNA, 22 bp, Homo sapiens
tcaaagtcatgatgtttttaaa

SEQ ID NO: 5471696 - DNA, 20 bp, Homo sapiens
tcaaagtccaactacagcca

SEQ ID NO: 5471697 - DNA, 20 bp, Homo sapiens
tcaaagtcccttgagactcc

SEQ ID NO: 5471698 - DNA, 21 bp, Homo sapiens
tcaaagtctgctctcatataa

SEQ ID NO: 5471699 - DNA, 13 bp, Homo sapiens
tcaaagtgcctgg

SEQ ID NO: 5471700 - DNA, 22 bp, Homo sapiens
tcaaagtggaaaggatcacaga

SEQ ID NO: 5471701 - DNA, 19 bp, Homo sapiens
tcaaagtggcaagtatttg

SEQ ID NO: 5471702 - DNA, 22 bp, Homo sapiens
tcaaagtggcaagtatttggct

SEQ ID NO: 5471703 - DNA, 18 bp, Homo sapiens
tcaaagtggggtacagta

SEQ ID NO: 5471704 - DNA, 19 bp, Homo sapiens
tcaaagtggggtacagtaa

SEQ ID NO: 5471705 - DNA, 18 bp, Homo sapiens
tcaaagtggtaaatactg

SEQ ID NO: 5471706 - DNA, 21 bp, Homo sapiens
tcaaagtggtaaatactgtga

SEQ ID NO: 5471707 - DNA, 22 bp, Homo sapiens
tcaaagtggtaaatactgtgaa

SEQ ID NO: 5471708 - DNA, 19 bp, Homo sapiens
tcaaagtggtacaggaagg

SEQ ID NO: 5471709 - DNA, 15 bp, Homo sapiens
tcaaagtgtatattt

SEQ ID NO: 5471710 - DNA, 21 bp, Homo sapiens
tcaaagtgtctcattctcaga

SEQ ID NO: 5471711 - DNA, 20 bp, Homo sapiens
tcaaagtgttgtgttcctgg

SEQ ID NO: 5471712 - DNA, 16 bp, Homo sapiens
tcaaagtgtttaattg

SEQ ID NO: 5471713 - DNA, 19 bp, Homo sapiens
tcaaagtgttttctctgaa

SEQ ID NO: 5471714 - DNA, 17 bp, Homo sapiens
tcaaagttaaaagtaaa

SEQ ID NO: 5471715 - DNA, 17 bp, Homo sapiens
tcaaagttcatagagtt

SEQ ID NO: 5471716 - DNA, 14 bp, Homo sapiens
tcaaagttcctgtt

SEQ ID NO: 5471717 - DNA, 15 bp, Homo sapiens
tcaaagttgcctaaa

SEQ ID NO: 5471718 - DNA, 18 bp, Homo sapiens
tcaaagttgcctaaatcc

SEQ ID NO: 5471719 - DNA, 16 bp, Homo sapiens
tcaaagttgtagttct

SEQ ID NO: 5471720 - DNA, 14 bp, Homo sapiens
tcaaagtttaataa

SEQ ID NO: 5471721 - DNA, 12 bp, Homo sapiens
tcaaagtttata

SEQ ID NO: 5471722 - DNA, 22 bp, Homo sapiens
tcaaagtttcctaatcagaaat

SEQ ID NO: 5471723 - DNA, 13 bp, Homo sapiens
tcaaagttttgaa

SEQ ID NO: 5471724 - DNA, 14 bp, Homo sapiens
tcaaagttttgaaa

SEQ ID NO: 5471725 - DNA, 22 bp, Homo sapiens
tcaaagtttttacagtgtatct

SEQ ID NO: 5471726 - DNA, 19 bp, Homo sapiens
tcaaataaaaattctagat

SEQ ID NO: 5471727 - DNA, 23 bp, Homo sapiens
tcaaataaaactagtgacagctt

SEQ ID NO: 5471728 - DNA, 17 bp, Homo sapiens
tcaaataaaatatcata

SEQ ID NO: 5471729 - DNA, 23 bp, Homo sapiens
tcaaataaaatatcataaagcat

SEQ ID NO: 5471730 - DNA, 15 bp, Homo sapiens
tcaaataaacactgt

SEQ ID NO: 5471731 - DNA, 12 bp, Homo sapiens
tcaaataaagaa

SEQ ID NO: 5471732 - DNA, 13 bp, Homo sapiens
tcaaataaagaaa

SEQ ID NO: 5471733 - DNA, 21 bp, Homo sapiens
tcaaataaagaaatttggtac

SEQ ID NO: 5471734 - DNA, 12 bp, Homo sapiens
tcaaataaatgt

SEQ ID NO: 5471735 - DNA, 15 bp, Homo sapiens
tcaaataaatgtttc

SEQ ID NO: 5471736 - DNA, 16 bp, Homo sapiens
tcaaataaatgtttcc

SEQ ID NO: 5471737 - DNA, 17 bp, Homo sapiens
tcaaataaatgtttccc

SEQ ID NO: 5471738 - DNA, 18 bp, Homo sapiens
tcaaataaatgtttcccc

SEQ ID NO: 5471739 - DNA, 20 bp, Homo sapiens
tcaaataaatttctgggata

SEQ ID NO: 5471740 - DNA, 21 bp, Homo sapiens
tcaaataataccttagaaggt

SEQ ID NO: 5471741 - DNA, 14 bp, Homo sapiens
tcaaataattaaat

SEQ ID NO: 5471742 - DNA, 13 bp, Homo sapiens
tcaaatacaaagt

SEQ ID NO: 5471743 - DNA, 14 bp, Homo sapiens
tcaaatacacattt

SEQ ID NO: 5471744 - DNA, 21 bp, Homo sapiens
tcaaatacagtagtataatgt

SEQ ID NO: 5471745 - DNA, 16 bp, Homo sapiens
tcaaatacatctccag

SEQ ID NO: 5471746 - DNA, 16 bp, Homo sapiens
tcaaatacatgcacag

SEQ ID NO: 5471747 - DNA, 19 bp, Homo sapiens
tcaaatacatgcacagtca

SEQ ID NO: 5471748 - DNA, 20 bp, Homo sapiens
tcaaatacatgcacagtcat

SEQ ID NO: 5471749 - DNA, 23 bp, Homo sapiens
tcaaatacattctaaatcacttt

SEQ ID NO: 5471750 - DNA, 21 bp, Homo sapiens
tcaaatacatttaaaacatta

SEQ ID NO: 5471751 - DNA, 20 bp, Homo sapiens
tcaaatacgtgggcattcaa

SEQ ID NO: 5471752 - DNA, 17 bp, Homo sapiens
tcaaatacttcaaatca

SEQ ID NO: 5471753 - DNA, 15 bp, Homo sapiens
tcaaatactttaaag

SEQ ID NO: 5471754 - DNA, 23 bp, Homo sapiens
tcaaatactttaaaggaaaaaat

SEQ ID NO: 5471755 - DNA, 15 bp, Homo sapiens
tcaaatagaatatgg

SEQ ID NO: 5471756 - DNA, 20 bp, Homo sapiens
tcaaataggctattaaaaaa

SEQ ID NO: 5471757 - DNA, 15 bp, Homo sapiens
tcaaatatagaaagt

SEQ ID NO: 5471758 - DNA, 18 bp, Homo sapiens
tcaaatatagagatattt

SEQ ID NO: 5471759 - DNA, 22 bp, Homo sapiens
tcaaatatattcagcctggctt

SEQ ID NO: 5471760 - DNA, 13 bp, Homo sapiens
tcaaatatcaaaa

SEQ ID NO: 5471761 - DNA, 18 bp, Homo sapiens
tcaaatatctctatttaa

SEQ ID NO: 5471762 - DNA, 17 bp, Homo sapiens
tcaaatatgcaaagcac

SEQ ID NO: 5471763 - DNA, 11 bp, Homo sapiens
tcaaatatgta

SEQ ID NO: 5471764 - DNA, 14 bp, Homo sapiens
tcaaatatgtaaac

SEQ ID NO: 5471765 - DNA, 21 bp, Homo sapiens
tcaaatatgtaaactttaact

SEQ ID NO: 5471766 - DNA, 18 bp, Homo sapiens
tcaaatatgttctggaca

SEQ ID NO: 5471767 - DNA, 15 bp, Homo sapiens
tcaaatattgaatgc

SEQ ID NO: 5471768 - DNA, 18 bp, Homo sapiens
tcaaatattgaatgcctt

SEQ ID NO: 5471769 - DNA, 19 bp, Homo sapiens
tcaaatattgaatgcctta

SEQ ID NO: 5471770 - DNA, 14 bp, Homo sapiens
tcaaatattgtaaa

SEQ ID NO: 5471771 - DNA, 20 bp, Homo sapiens
tcaaatatttattggatgat

SEQ ID NO: 5471772 - DNA, 14 bp, Homo sapiens
tcaaatatttcttg

SEQ ID NO: 5471773 - DNA, 23 bp, Homo sapiens
tcaaatatttcttgctgcttcta

SEQ ID NO: 5471774 - DNA, 13 bp, Homo sapiens
tcaaatcaacttt

SEQ ID NO: 5471775 - DNA, 15 bp, Homo sapiens
tcaaatcagagcagt

SEQ ID NO: 5471776 - DNA, 17 bp, Homo sapiens
tcaaatcagagcagtga

SEQ ID NO: 5471777 - DNA, 16 bp, Homo sapiens
tcaaatcagtcttcct

SEQ ID NO: 5471778 - DNA, 17 bp, Homo sapiens
tcaaatcagtgataatt

SEQ ID NO: 5471779 - DNA, 17 bp, Homo sapiens
tcaaatcagtgatctat

SEQ ID NO: 5471780 - DNA, 21 bp, Homo sapiens
tcaaatcagtgatctatgttt

SEQ ID NO: 5471781 - DNA, 23 bp, Homo sapiens
tcaaatcagtgatctatgtttgt

SEQ ID NO: 5471782 - DNA, 12 bp, Homo sapiens
tcaaatcattca

SEQ ID NO: 5471783 - DNA, 15 bp, Homo sapiens
tcaaatccaaaatgg

SEQ ID NO: 5471784 - DNA, 16 bp, Homo sapiens
tcaaatccactgacag

SEQ ID NO: 5471785 - DNA, 17 bp, Homo sapiens
tcaaatccactgacaga

SEQ ID NO: 5471786 - DNA, 15 bp, Homo sapiens
tcaaatccaggaccc

SEQ ID NO: 5471787 - DNA, 12 bp, Homo sapiens
tcaaatccagtg

SEQ ID NO: 5471788 - DNA, 18 bp, Homo sapiens
tcaaatccagtggtgggt

SEQ ID NO: 5471789 - DNA, 19 bp, Homo sapiens
tcaaatccagtggtgggta

SEQ ID NO: 5471790 - DNA, 15 bp, Homo sapiens
tcaaatccatccaga

SEQ ID NO: 5471791 - DNA, 17 bp, Homo sapiens
tcaaatccatgtgtccc

SEQ ID NO: 5471792 - DNA, 13 bp, Homo sapiens
tcaaatccctttt

SEQ ID NO: 5471793 - DNA, 17 bp, Homo sapiens
tcaaatcgatggcctgg

SEQ ID NO: 5471794 - DNA, 15 bp, Homo sapiens
tcaaatcgatttagt

SEQ ID NO: 5471795 - DNA, 17 bp, Homo sapiens
tcaaatctagaagatgc

SEQ ID NO: 5471796 - DNA, 18 bp, Homo sapiens
tcaaatctattcagacaa

SEQ ID NO: 5471797 - DNA, 12 bp, Homo sapiens
tcaaatctcagc

SEQ ID NO: 5471798 - DNA, 15 bp, Homo sapiens
tcaaatctcagcaaa

SEQ ID NO: 5471799 - DNA, 19 bp, Homo sapiens
tcaaatctcagcaaagcta

SEQ ID NO: 5471800 - DNA, 16 bp, Homo sapiens
tcaaatctcctgctga

SEQ ID NO: 5471801 - DNA, 17 bp, Homo sapiens
tcaaatctcctgctgat

SEQ ID NO: 5471802 - DNA, 22 bp, Homo sapiens
tcaaatctctacaaatttttct

SEQ ID NO: 5471803 - DNA, 19 bp, Homo sapiens
tcaaatctcttccttccct

SEQ ID NO: 5471804 - DNA, 21 bp, Homo sapiens
tcaaatctggtccatatttac

SEQ ID NO: 5471805 - DNA, 22 bp, Homo sapiens
tcaaatctggtccatatttaca

SEQ ID NO: 5471806 - DNA, 23 bp, Homo sapiens
tcaaatctggtccatatttacat

SEQ ID NO: 5471807 - DNA, 13 bp, Homo sapiens
tcaaatctgtaat

SEQ ID NO: 5471808 - DNA, 19 bp, Homo sapiens
tcaaatctgtaatcagcaa

SEQ ID NO: 5471809 - DNA, 14 bp, Homo sapiens
tcaaatcttaagaa

SEQ ID NO: 5471810 - DNA, 16 bp, Homo sapiens
tcaaatcttacaaaat

SEQ ID NO: 5471811 - DNA, 17 bp, Homo sapiens
tcaaatcttacaaaatc

SEQ ID NO: 5471812 - DNA, 14 bp, Homo sapiens
tcaaatgaaatgta

SEQ ID NO: 5471813 - DNA, 20 bp, Homo sapiens
tcaaatgaaatgtatgcatt

SEQ ID NO: 5471814 - DNA, 15 bp, Homo sapiens
tcaaatgaacacgtg

SEQ ID NO: 5471815 - DNA, 15 bp, Homo sapiens
tcaaatgaagattca

SEQ ID NO: 5471816 - DNA, 21 bp, Homo sapiens
tcaaatgaagattcagcagtg

SEQ ID NO: 5471817 - DNA, 22 bp, Homo sapiens
tcaaatgagtaacatttgctgt

SEQ ID NO: 5471818 - DNA, 20 bp, Homo sapiens
tcaaatgagtttaaaaaaat

SEQ ID NO: 5471819 - DNA, 16 bp, Homo sapiens
tcaaatgatacagtca

SEQ ID NO: 5471820 - DNA, 17 bp, Homo sapiens
tcaaatgatcctcccac

SEQ ID NO: 5471821 - DNA, 17 bp, Homo sapiens
tcaaatgatccttccta

SEQ ID NO: 5471822 - DNA, 21 bp, Homo sapiens
tcaaatgatgtgcaaaacctt

SEQ ID NO: 5471823 - DNA, 18 bp, Homo sapiens
tcaaatgatgtgcctgct

SEQ ID NO: 5471824 - DNA, 19 bp, Homo sapiens
tcaaatgatgtgcctgctt

SEQ ID NO: 5471825 - DNA, 12 bp, Homo sapiens
tcaaatgcaaaa

SEQ ID NO: 5471826 - DNA, 23 bp, Homo sapiens
tcaaatgcagtccagtgagaaat

SEQ ID NO: 5471827 - DNA, 12 bp, Homo sapiens
tcaaatgcatga

SEQ ID NO: 5471828 - DNA, 20 bp, Homo sapiens
tcaaatgcatgatattgtat

SEQ ID NO: 5471829 - DNA, 21 bp, Homo sapiens
tcaaatgccttcatgaatctt

SEQ ID NO: 5471830 - DNA, 17 bp, Homo sapiens
tcaaatgctagaaaaat

SEQ ID NO: 5471831 - DNA, 18 bp, Homo sapiens
tcaaatgctagaaaaatt

SEQ ID NO: 5471832 - DNA, 15 bp, Homo sapiens
tcaaatgcttttcct

SEQ ID NO: 5471833 - DNA, 23 bp, Homo sapiens
tcaaatggaaaggagaggaaaga

SEQ ID NO: 5471834 - DNA, 17 bp, Homo sapiens
tcaaatggaagacacat

SEQ ID NO: 5471835 - DNA, 13 bp, Homo sapiens
tcaaatggactgt

SEQ ID NO: 5471836 - DNA, 20 bp, Homo sapiens
tcaaatggactgttacagac

SEQ ID NO: 5471837 - DNA, 18 bp, Homo sapiens
tcaaatggatgtaatata

SEQ ID NO: 5471838 - DNA, 19 bp, Homo sapiens
tcaaatggcattgggctga

SEQ ID NO: 5471839 - DNA, 18 bp, Homo sapiens
tcaaatggggccagatcc

SEQ ID NO: 5471840 - DNA, 16 bp, Homo sapiens
tcaaatggtatctttt

SEQ ID NO: 5471841 - DNA, 22 bp, Homo sapiens
tcaaatggtattttttgtgaat

SEQ ID NO: 5471842 - DNA, 12 bp, Homo sapiens
tcaaatgtacat

SEQ ID NO: 5471843 - DNA, 10 bp, Homo sapiens
tcaaatgtca

SEQ ID NO: 5471844 - DNA, 15 bp, Homo sapiens
tcaaatgtcagagct

SEQ ID NO: 5471845 - DNA, 13 bp, Homo sapiens
tcaaatgtcagtt

SEQ ID NO: 5471846 - DNA, 16 bp, Homo sapiens
tcaaatgtcagttcat

SEQ ID NO: 5471847 - DNA, 23 bp, Homo sapiens
tggatggagcccagttggaaaat

SEQ ID NO: 5471848 - DNA, 16 bp, Homo sapiens
tggatggatggacaga

SEQ ID NO: 5471849 - DNA, 13 bp, Homo sapiens
tggatggcacaat

SEQ ID NO: 5471850 - DNA, 14 bp, Homo sapiens
tggatggcacaatg

SEQ ID NO: 5471851 - DNA, 19 bp, Homo sapiens
tggatggcacaatgaatgt

SEQ ID NO: 5471852 - DNA, 15 bp, Homo sapiens
tggatggcaccctgg

SEQ ID NO: 5471853 - DNA, 14 bp, Homo sapiens
tggatggcaggagg

SEQ ID NO: 5471854 - DNA, 21 bp, Homo sapiens
tggatggcagtgtggggaggg

SEQ ID NO: 5471855 - DNA, 17 bp, Homo sapiens
tggatggcatctagcca

SEQ ID NO: 5471856 - DNA, 19 bp, Homo sapiens
tggatggcccagcaggcag

SEQ ID NO: 5471857 - DNA, 20 bp, Homo sapiens
tggatggcccagcaggcagg

SEQ ID NO: 5471858 - DNA, 16 bp, Homo sapiens
tggatggccccagcac

SEQ ID NO: 5471859 - DNA, 17 bp, Homo sapiens
tggatggccgggctgct

SEQ ID NO: 5471860 - DNA, 20 bp, Homo sapiens
tggatggccgggctgctgct

SEQ ID NO: 5471861 - DNA, 16 bp, Homo sapiens
tggatggcctctgggg

SEQ ID NO: 5471862 - DNA, 12 bp, Homo sapiens
tggatggctccc

SEQ ID NO: 5471863 - DNA, 20 bp, Homo sapiens
tggatgggaggctcctggtg

SEQ ID NO: 5471864 - DNA, 20 bp, Homo sapiens
tggatgggagtgggcacctc

SEQ ID NO: 5471865 - DNA, 23 bp, Homo sapiens
tggatgggagtgggcacctcaga

SEQ ID NO: 5471866 - DNA, 18 bp, Homo sapiens
tggatgggcattgggctg

SEQ ID NO: 5471867 - DNA, 15 bp, Homo sapiens
tggatgggccctgca

SEQ ID NO: 5471868 - DNA, 20 bp, Homo sapiens
tggatgggcctttgagcctg

SEQ ID NO: 5471869 - DNA, 24 bp, Homo sapiens
tggatgggcctttgagcctgatgt

SEQ ID NO: 5471870 - DNA, 17 bp, Homo sapiens
tggatggggataagaat

SEQ ID NO: 5471871 - DNA, 12 bp, Homo sapiens
tggatggggcag

SEQ ID NO: 5471872 - DNA, 13 bp, Homo sapiens
tggatggggcagg

SEQ ID NO: 5471873 - DNA, 20 bp, Homo sapiens
tggatggggcaggccacctg

SEQ ID NO: 5471874 - DNA, 20 bp, Homo sapiens
tggatggggcggcctgcaga

SEQ ID NO: 5471875 - DNA, 15 bp, Homo sapiens
tggatgggggctctg

SEQ ID NO: 5471876 - DNA, 20 bp, Homo sapiens
tggatgggggtgcaggcagc

SEQ ID NO: 5471877 - DNA, 17 bp, Homo sapiens
tggatgggtggatggcc

SEQ ID NO: 5471878 - DNA, 18 bp, Homo sapiens
tggatggtcattgcagtt

SEQ ID NO: 5471879 - DNA, 15 bp, Homo sapiens
tggatggtccagtgt

SEQ ID NO: 5471880 - DNA, 20 bp, Homo sapiens
tggatggtgacttttgaaga

SEQ ID NO: 5471881 - DNA, 14 bp, Homo sapiens
tggatggtgtgcct

SEQ ID NO: 5471882 - DNA, 22 bp, Homo sapiens
tggatgtaaagcgggaaggaca

SEQ ID NO: 5471883 - DNA, 17 bp, Homo sapiens
tggatgtaatatagggt

SEQ ID NO: 5471884 - DNA, 12 bp, Homo sapiens
tggatgtaattc

SEQ ID NO: 5471885 - DNA, 15 bp, Homo sapiens
tggatgtagatacag

SEQ ID NO: 5471886 - DNA, 18 bp, Homo sapiens
tggatgtagtctgaggcc

SEQ ID NO: 5471887 - DNA, 13 bp, Homo sapiens
tggatgtcattgt

SEQ ID NO: 5471888 - DNA, 14 bp, Homo sapiens
tggatgtcccttcc

SEQ ID NO: 5471889 - DNA, 14 bp, Homo sapiens
tggatgtcttcctt

SEQ ID NO: 5471890 - DNA, 21 bp, Homo sapiens
tggatgtgaagctcacactga

SEQ ID NO: 5471891 - DNA, 14 bp, Homo sapiens
tggatgtgagcaga

SEQ ID NO: 5471892 - DNA, 15 bp, Homo sapiens
tggatgtgagcagaa

SEQ ID NO: 5471893 - DNA, 18 bp, Homo sapiens
tggatgtgcatctggcct

SEQ ID NO: 5471894 - DNA, 19 bp, Homo sapiens
tggatgtgcatctggccta

SEQ ID NO: 5471895 - DNA, 15 bp, Homo sapiens
tggatgtgctggagg

SEQ ID NO: 5471896 - DNA, 23 bp, Homo sapiens
tggatgtggggtccccatcatcc

SEQ ID NO: 5471897 - DNA, 17 bp, Homo sapiens
tggatgtgtaaatggag

SEQ ID NO: 5471898 - DNA, 17 bp, Homo sapiens
tggatgttatgaacagc

SEQ ID NO: 5471899 - DNA, 19 bp, Homo sapiens
tggatgttatgaacagctg

SEQ ID NO: 5471900 - DNA, 12 bp, Homo sapiens
tggatgttctga

SEQ ID NO: 5471901 - DNA, 13 bp, Homo sapiens
tggatgttgctat

SEQ ID NO: 5471902 - DNA, 18 bp, Homo sapiens
tggatgttgctatagtga

SEQ ID NO: 5471903 - DNA, 18 bp, Homo sapiens
tggatgtttaccgtgtgt

SEQ ID NO: 5471904 - DNA, 16 bp, Homo sapiens
tggatgtttcttcttt

SEQ ID NO: 5471905 - DNA, 13 bp, Homo sapiens
tggattaaaacaa

SEQ ID NO: 5471906 - DNA, 22 bp, Homo sapiens
tggattaaacttaatctaaatg

SEQ ID NO: 5471907 - DNA, 13 bp, Homo sapiens
tggattaaatggc

SEQ ID NO: 5471908 - DNA, 14 bp, Homo sapiens
tggattaaatggca

SEQ ID NO: 5471909 - DNA, 21 bp, Homo sapiens
tggattaaattagtttgtgaa

SEQ ID NO: 5471910 - DNA, 19 bp, Homo sapiens
tggattaaattctgggtga

SEQ ID NO: 5471911 - DNA, 18 bp, Homo sapiens
tggattaaggaagactga

SEQ ID NO: 5471912 - DNA, 22 bp, Homo sapiens
tggattaatagagttggagttt

SEQ ID NO: 5471913 - DNA, 19 bp, Homo sapiens
tggattaatctttaataac

SEQ ID NO: 5471914 - DNA, 17 bp, Homo sapiens
tggattaattaaatgca

SEQ ID NO: 5471915 - DNA, 18 bp, Homo sapiens
tggattacgatgtaaatt

SEQ ID NO: 5471916 - DNA, 18 bp, Homo sapiens
tggattagaaatttaaca

SEQ ID NO: 5471917 - DNA, 17 bp, Homo sapiens
tggattagcctggagca

SEQ ID NO: 5471918 - DNA, 13 bp, Homo sapiens
tggattagccttt

SEQ ID NO: 5471919 - DNA, 19 bp, Homo sapiens
tggattagcctttgacatt

SEQ ID NO: 5471920 - DNA, 19 bp, Homo sapiens
tggattagctagaatgcac

SEQ ID NO: 5471921 - DNA, 22 bp, Homo sapiens
tggattataagttctattttac

SEQ ID NO: 5471922 - DNA, 16 bp, Homo sapiens
tggattataatcagaa

SEQ ID NO: 5471923 - DNA, 17 bp, Homo sapiens
tggattataatcagaat

SEQ ID NO: 5471924 - DNA, 22 bp, Homo sapiens
tggattatagagtatactaaaa

SEQ ID NO: 5471925 - DNA, 17 bp, Homo sapiens
tggattatccactgcaa

SEQ ID NO: 5471926 - DNA, 20 bp, Homo sapiens
tggattatctactacagagt

SEQ ID NO: 5471927 - DNA, 16 bp, Homo sapiens
tggattattcaggctt

SEQ ID NO: 5471928 - DNA, 13 bp, Homo sapiens
tggattattcatt

SEQ ID NO: 5471929 - DNA, 14 bp, Homo sapiens
tggattattcattt

SEQ ID NO: 5471930 - DNA, 20 bp, Homo sapiens
tggattattcatttaaaatg

SEQ ID NO: 5471931 - DNA, 13 bp, Homo sapiens
tggattattttct

SEQ ID NO: 5471932 - DNA, 20 bp, Homo sapiens
tggattcaattacggactct

SEQ ID NO: 5471933 - DNA, 12 bp, Homo sapiens
tggattcacttc

SEQ ID NO: 5471934 - DNA, 17 bp, Homo sapiens
tggattcagccttcttt

SEQ ID NO: 5471935 - DNA, 17 bp, Homo sapiens
tggattcattctcataa

SEQ ID NO: 5471936 - DNA, 14 bp, Homo sapiens
tggattcattgtct

SEQ ID NO: 5471937 - DNA, 14 bp, Homo sapiens
tggattccaaacca

SEQ ID NO: 5471938 - DNA, 20 bp, Homo sapiens
tggattccaaagcattttca

SEQ ID NO: 5471939 - DNA, 17 bp, Homo sapiens
tggattccaaccccaac

SEQ ID NO: 5471940 - DNA, 12 bp, Homo sapiens
tggattccagag

SEQ ID NO: 5471941 - DNA, 22 bp, Homo sapiens
tggattcccccccctttcctaa

SEQ ID NO: 5471942 - DNA, 23 bp, Homo sapiens
tggattcccttttgactcttccg

SEQ ID NO: 5471943 - DNA, 16 bp, Homo sapiens
tggattcctctaagat

SEQ ID NO: 5471944 - DNA, 19 bp, Homo sapiens
tggattcctctaagatctt

SEQ ID NO: 5471945 - DNA, 12 bp, Homo sapiens
tggattcctgtc

SEQ ID NO: 5471946 - DNA, 15 bp, Homo sapiens
tggattctaaaatgc

SEQ ID NO: 5471947 - DNA, 15 bp, Homo sapiens
tggattctaaataca

SEQ ID NO: 5471948 - DNA, 22 bp, Homo sapiens
tggattctacaaaaaaccagga

SEQ ID NO: 5471949 - DNA, 16 bp, Homo sapiens
tggattctatatttca

SEQ ID NO: 5471950 - DNA, 21 bp, Homo sapiens
tggattctatatttcatattg

SEQ ID NO: 5471951 - DNA, 17 bp, Homo sapiens
tggattctccctgggcc

SEQ ID NO: 5471952 - DNA, 14 bp, Homo sapiens
tggattctgaatct

SEQ ID NO: 5471953 - DNA, 17 bp, Homo sapiens
tggattctgagagctgt

SEQ ID NO: 5471954 - DNA, 22 bp, Homo sapiens
tggattctgggaggcaagaaaa

SEQ ID NO: 5471955 - DNA, 17 bp, Homo sapiens
tggattcttgttttgct

SEQ ID NO: 5471956 - DNA, 17 bp, Homo sapiens
tggattgacagtaactt

SEQ ID NO: 5471957 - DNA, 20 bp, Homo sapiens
tggattgattcagtcttctg

SEQ ID NO: 5471958 - DNA, 21 bp, Homo sapiens
tggattgattcagtcttctgg

SEQ ID NO: 5471959 - DNA, 19 bp, Homo sapiens
tggattgcaatatctgaag

SEQ ID NO: 5471960 - DNA, 15 bp, Homo sapiens
tggattggacaaaat

SEQ ID NO: 5471961 - DNA, 21 bp, Homo sapiens
tggattggagatagggaaaga

SEQ ID NO: 5471962 - DNA, 16 bp, Homo sapiens
tggattggattattta

SEQ ID NO: 5471963 - DNA, 14 bp, Homo sapiens
tggattgggctgca

SEQ ID NO: 5471964 - DNA, 17 bp, Homo sapiens
tggattggtgtaaaagg

SEQ ID NO: 5471965 - DNA, 13 bp, Homo sapiens
tggattgtacata

SEQ ID NO: 5471966 - DNA, 19 bp, Homo sapiens
tggattgtagaacttgttg

SEQ ID NO: 5471967 - DNA, 19 bp, Homo sapiens
tggattgtgcctaatgtgt

SEQ ID NO: 5471968 - DNA, 23 bp, Homo sapiens
tggattgtgcctaatgtgtttga

SEQ ID NO: 5471969 - DNA, 14 bp, Homo sapiens
tggattgtggttcc

SEQ ID NO: 5471970 - DNA, 18 bp, Homo sapiens
tggattgttaatttcagt

SEQ ID NO: 5471971 - DNA, 19 bp, Homo sapiens
tggatttaaaaatgccaaa

SEQ ID NO: 5471972 - DNA, 16 bp, Homo sapiens
tggatttaaaagcctg

SEQ ID NO: 5471973 - DNA, 24 bp, Homo sapiens
tggatttaacagaaatgtacagca

SEQ ID NO: 5471974 - DNA, 18 bp, Homo sapiens
tggatttactgagagaag

SEQ ID NO: 5471975 - DNA, 21 bp, Homo sapiens
tggatttactgagagaaggtg

SEQ ID NO: 5471976 - DNA, 20 bp, Homo sapiens
tggatttagaaaaaaacatg

SEQ ID NO: 5471977 - DNA, 12 bp, Homo sapiens
tggatttagaga

SEQ ID NO: 5471978 - DNA, 13 bp, Homo sapiens
tggatttagagac

SEQ ID NO: 5471979 - DNA, 14 bp, Homo sapiens
tggatttataaatg

SEQ ID NO: 5471980 - DNA, 23 bp, Homo sapiens
tggatttatagtatgtgactttt

SEQ ID NO: 5471981 - DNA, 21 bp, Homo sapiens
tggatttatgttgtatagatt

SEQ ID NO: 5471982 - DNA, 21 bp, Homo sapiens
tggatttattttttgtaactc

SEQ ID NO: 5471983 - DNA, 14 bp, Homo sapiens
tggatttcagaaag

SEQ ID NO: 5471984 - DNA, 15 bp, Homo sapiens
tggatttcctatttt

SEQ ID NO: 5471985 - DNA, 19 bp, Homo sapiens
tggatttcctattttaaaa

SEQ ID NO: 5471986 - DNA, 22 bp, Homo sapiens
tggatttcctattttaaaacca

SEQ ID NO: 5471987 - DNA, 20 bp, Homo sapiens
tggatttccttctaacatgt

SEQ ID NO: 5471988 - DNA, 18 bp, Homo sapiens
tggatttcctttatactg

SEQ ID NO: 5471989 - DNA, 14 bp, Homo sapiens
tggatttcctttga

SEQ ID NO: 5471990 - DNA, 19 bp, Homo sapiens
tggatttctggttctgatg

SEQ ID NO: 5471991 - DNA, 14 bp, Homo sapiens
tggatttctttaga

SEQ ID NO: 5471992 - DNA, 13 bp, Homo sapiens
tggatttgaagca

SEQ ID NO: 5471993 - DNA, 16 bp, Homo sapiens
tggatttgacacactc

SEQ ID NO: 5471994 - DNA, 14 bp, Homo sapiens
tggatttgacattg

SEQ ID NO: 5471995 - DNA, 13 bp, Homo sapiens
tggatttgatgct

SEQ ID NO: 5471996 - DNA, 23 bp, Homo sapiens
tggatttgattcattttcctgtt

SEQ ID NO: 5471997 - DNA, 14 bp, Homo sapiens
tggatttgcagaag

SEQ ID NO: 5471998 - DNA, 15 bp, Homo sapiens
tggatttgcagaagt

SEQ ID NO: 5471999 - DNA, 15 bp, Homo sapiens
tggatttgcatattt

SEQ ID NO: 5472000 - DNA, 17 bp, Homo sapiens
tggatttgcctgtgcca

SEQ ID NO: 5472001 - DNA, 19 bp, Homo sapiens
tggatttgctcattgctgt

SEQ ID NO: 5472002 - DNA, 21 bp, Homo sapiens
tggatttggcactagccaaag

SEQ ID NO: 5472003 - DNA, 20 bp, Homo sapiens
tggatttgggatgaaatact

SEQ ID NO: 5472004 - DNA, 19 bp, Homo sapiens
tggatttgtccaaacaggt

SEQ ID NO: 5472005 - DNA, 16 bp, Homo sapiens
tggatttgtttaaaag

SEQ ID NO: 5472006 - DNA, 17 bp, Homo sapiens
tggatttgtttaaaagg

SEQ ID NO: 5472007 - DNA, 19 bp, Homo sapiens
tggattttaaaaaatcaat

SEQ ID NO: 5472008 - DNA, 15 bp, Homo sapiens
tggattttaaacaaa

SEQ ID NO: 5472009 - DNA, 19 bp, Homo sapiens
tggattttagtcaaatatt

SEQ ID NO: 5472010 - DNA, 16 bp, Homo sapiens
tggattttatgttgac

SEQ ID NO: 5472011 - DNA, 23 bp, Homo sapiens
tggattttcctgaagctgcttaa

SEQ ID NO: 5472012 - DNA, 17 bp, Homo sapiens
tggattttctactgtaa

SEQ ID NO: 5472013 - DNA, 18 bp, Homo sapiens
tggattttctttctatgt

SEQ ID NO: 5472014 - DNA, 19 bp, Homo sapiens
tggattttctttctatgta

SEQ ID NO: 5472015 - DNA, 21 bp, Homo sapiens
tggattttctttctatgtaga

SEQ ID NO: 5472016 - DNA, 17 bp, Homo sapiens
tggattttgtagatgtt

SEQ ID NO: 5472017 - DNA, 15 bp, Homo sapiens
tggatttttaattaa

SEQ ID NO: 5472018 - DNA, 21 bp, Homo sapiens
tggatttttacaaataaagat

SEQ ID NO: 5472019 - DNA, 19 bp, Homo sapiens
tggatttttgactctggca

SEQ ID NO: 5472020 - DNA, 17 bp, Homo sapiens
tggatttttgtcttgtg

SEQ ID NO: 5472021 - DNA, 13 bp, Homo sapiens
tggatttttgtta

SEQ ID NO: 5472022 - DNA, 17 bp, Homo sapiens
tggattttttaaatcat

SEQ ID NO: 5472023 - DNA, 22 bp, Homo sapiens
tggattttttatgtacaaccct

SEQ ID NO: 5472024 - DNA, 22 bp, Homo sapiens
tggattttttattattattcaa

SEQ ID NO: 5472025 - DNA, 19 bp, Homo sapiens
tggcagctgcggtccaccc

SEQ ID NO: 5472026 - DNA, 21 bp, Homo sapiens
tggcagctgcggtccacccag

SEQ ID NO: 5472027 - DNA, 11 bp, Homo sapiens
tggcagctgct

SEQ ID NO: 5472028 - DNA, 13 bp, Homo sapiens
tggcagctgcttt

SEQ ID NO: 5472029 - DNA, 17 bp, Homo sapiens
tggcagctggaatttaa

SEQ ID NO: 5472030 - DNA, 14 bp, Homo sapiens
tggcagctggacca

SEQ ID NO: 5472031 - DNA, 11 bp, Homo sapiens
tggcagctggg

SEQ ID NO: 5472032 - DNA, 20 bp, Homo sapiens
tggcagctgggcccacagcc

SEQ ID NO: 5472033 - DNA, 22 bp, Homo sapiens
tggcagctggggagcagctgag

SEQ ID NO: 5472034 - DNA, 14 bp, Homo sapiens
tggcagctgtctca

SEQ ID NO: 5472035 - DNA, 14 bp, Homo sapiens
tggcagctgtttct

SEQ ID NO: 5472036 - DNA, 19 bp, Homo sapiens
tggcagctgtttctcatga

SEQ ID NO: 5472037 - DNA, 17 bp, Homo sapiens
tggcagcttaacattga

SEQ ID NO: 5472038 - DNA, 15 bp, Homo sapiens
tggcagcttcaaaac

SEQ ID NO: 5472039 - DNA, 13 bp, Homo sapiens
tggcagctttttc

SEQ ID NO: 5472040 - DNA, 17 bp, Homo sapiens
tggcagctttttctgtg

SEQ ID NO: 5472041 - DNA, 18 bp, Homo sapiens
tggcagctttttctgtgg

SEQ ID NO: 5472042 - DNA, 19 bp, Homo sapiens
tggcagctttttctgtgga

SEQ ID NO: 5472043 - DNA, 17 bp, Homo sapiens
tggcaggaaagagggag

SEQ ID NO: 5472044 - DNA, 15 bp, Homo sapiens
tggcaggaagatgta

SEQ ID NO: 5472045 - DNA, 23 bp, Homo sapiens
tggcaggaagatgtatgctttga

SEQ ID NO: 5472046 - DNA, 15 bp, Homo sapiens
tggcaggaaggcttg

SEQ ID NO: 5472047 - DNA, 11 bp, Homo sapiens
tggcaggacca

SEQ ID NO: 5472048 - DNA, 17 bp, Homo sapiens
tggcaggaccaggacta

SEQ ID NO: 5472049 - DNA, 17 bp, Homo sapiens
tggcaggaccctgtcag

SEQ ID NO: 5472050 - DNA, 14 bp, Homo sapiens
tggcaggacctgcc

SEQ ID NO: 5472051 - DNA, 16 bp, Homo sapiens
tggcaggactcctggc

SEQ ID NO: 5472052 - DNA, 18 bp, Homo sapiens
tggcaggactcctggcag

SEQ ID NO: 5472053 - DNA, 22 bp, Homo sapiens
tggcaggagacactggtctcag

SEQ ID NO: 5472054 - DNA, 11 bp, Homo sapiens
tggcaggagcc

SEQ ID NO: 5472055 - DNA, 17 bp, Homo sapiens
tggcaggagcctcgtgt

SEQ ID NO: 5472056 - DNA, 13 bp, Homo sapiens
tggcaggagctcc

SEQ ID NO: 5472057 - DNA, 15 bp, Homo sapiens
tggcaggagctcctg

SEQ ID NO: 5472058 - DNA, 16 bp, Homo sapiens
tggcaggagctcctgg

SEQ ID NO: 5472059 - DNA, 20 bp, Homo sapiens
tggcaggagctcctggaagc

SEQ ID NO: 5472060 - DNA, 16 bp, Homo sapiens
tggcaggaggacaggt

SEQ ID NO: 5472061 - DNA, 23 bp, Homo sapiens
tggcaggaggacaggtggaggcg

SEQ ID NO: 5472062 - DNA, 17 bp, Homo sapiens
tggcaggaggagctgcc

SEQ ID NO: 5472063 - DNA, 15 bp, Homo sapiens
tggcaggaggcagga

SEQ ID NO: 5472064 - DNA, 16 bp, Homo sapiens
tggcaggagtggggtg

SEQ ID NO: 5472065 - DNA, 15 bp, Homo sapiens
tggcaggatccaagg

SEQ ID NO: 5472066 - DNA, 22 bp, Homo sapiens
tggcaggatgaccctgcgaagg

SEQ ID NO: 5472067 - DNA, 19 bp, Homo sapiens
tggcaggatggcctggcca

SEQ ID NO: 5472068 - DNA, 20 bp, Homo sapiens
tggcaggatggcctggccag

SEQ ID NO: 5472069 - DNA, 17 bp, Homo sapiens
tggcaggattcttcccg

SEQ ID NO: 5472070 - DNA, 22 bp, Homo sapiens
tggcaggattcttcccgctccc

SEQ ID NO: 5472071 - DNA, 20 bp, Homo sapiens
tggcaggcacacagcagccc

SEQ ID NO: 5472072 - DNA, 15 bp, Homo sapiens
tggcaggcagcgcca

SEQ ID NO: 5472073 - DNA, 19 bp, Homo sapiens
tggcaggcagcgccaagca

SEQ ID NO: 5472074 - DNA, 19 bp, Homo sapiens
tggcaggcagttctagaag

SEQ ID NO: 5472075 - DNA, 15 bp, Homo sapiens
tggcaggcatctgta

SEQ ID NO: 5472076 - DNA, 15 bp, Homo sapiens
tggcaggccagctgt

SEQ ID NO: 5472077 - DNA, 22 bp, Homo sapiens
tggcaggcccactccccagccc

SEQ ID NO: 5472078 - DNA, 12 bp, Homo sapiens
tggcaggccctg

SEQ ID NO: 5472079 - DNA, 13 bp, Homo sapiens
tggcaggccctgc

SEQ ID NO: 5472080 - DNA, 14 bp, Homo sapiens
tggcaggccctgcc

SEQ ID NO: 5472081 - DNA, 15 bp, Homo sapiens
tggcaggcctgaccc

SEQ ID NO: 5472082 - DNA, 20 bp, Homo sapiens
tggcaggcctgacccacggg

SEQ ID NO: 5472083 - DNA, 19 bp, Homo sapiens
tggcaggctactctgccca

SEQ ID NO: 5472084 - DNA, 21 bp, Homo sapiens
tggcaggcttccatccccgtc

SEQ ID NO: 5472085 - DNA, 13 bp, Homo sapiens
tggcaggcttccc

SEQ ID NO: 5472086 - DNA, 15 bp, Homo sapiens
tggcaggcttccccc

SEQ ID NO: 5472087 - DNA, 11 bp, Homo sapiens
tggcagggaag

SEQ ID NO: 5472088 - DNA, 17 bp, Homo sapiens
tggcagggaagctttca

SEQ ID NO: 5472089 - DNA, 13 bp, Homo sapiens
tggcagggaccgg

SEQ ID NO: 5472090 - DNA, 17 bp, Homo sapiens
tggcagggacctgagag

SEQ ID NO: 5472091 - DNA, 13 bp, Homo sapiens
tggcagggcacag

SEQ ID NO: 5472092 - DNA, 19 bp, Homo sapiens
tggcagggcacagggcctg

SEQ ID NO: 5472093 - DNA, 15 bp, Homo sapiens
tggcagggcaggcag

SEQ ID NO: 5472094 - DNA, 19 bp, Homo sapiens
tggcagggcaggcagagct

SEQ ID NO: 5472095 - DNA, 21 bp, Homo sapiens
tggcagggcaggcagagctca

SEQ ID NO: 5472096 - DNA, 20 bp, Homo sapiens
tggcagggccacctgcagga

SEQ ID NO: 5472097 - DNA, 14 bp, Homo sapiens
tggcagggccaggc

SEQ ID NO: 5472098 - DNA, 15 bp, Homo sapiens
tggcagggcctagct

SEQ ID NO: 5472099 - DNA, 14 bp, Homo sapiens
tggcagggcctcat

SEQ ID NO: 5472100 - DNA, 15 bp, Homo sapiens
tggcagggcctcatc

SEQ ID NO: 5472101 - DNA, 22 bp, Homo sapiens
tggcagggcctcatctcacctc

SEQ ID NO: 5472102 - DNA, 22 bp, Homo sapiens
tggcagggcgccaagtctggca

SEQ ID NO: 5472103 - DNA, 23 bp, Homo sapiens
tggcagggcgccaagtctggcac

SEQ ID NO: 5472104 - DNA, 14 bp, Homo sapiens
tggcagggcggggg

SEQ ID NO: 5472105 - DNA, 23 bp, Homo sapiens
tggcagggctcacactcctgggc

SEQ ID NO: 5472106 - DNA, 15 bp, Homo sapiens
tggcagggctcagga

SEQ ID NO: 5472107 - DNA, 23 bp, Homo sapiens
tggcagggctggccccagggcac

SEQ ID NO: 5472108 - DNA, 24 bp, Homo sapiens
tggcagggctgttccctccaggca

SEQ ID NO: 5472109 - DNA, 24 bp, Homo sapiens
tggcaggggagacaggagcctagc

SEQ ID NO: 5472110 - DNA, 14 bp, Homo sapiens
tggcaggggagcag

SEQ ID NO: 5472111 - DNA, 15 bp, Homo sapiens
tggcaggggcagtgg

SEQ ID NO: 5472112 - DNA, 17 bp, Homo sapiens
tggcaggggcagtggcc

SEQ ID NO: 5472113 - DNA, 23 bp, Homo sapiens
tggcaggggcagtggcctggatg

SEQ ID NO: 5472114 - DNA, 24 bp, Homo sapiens
tggcaggggcagtggcctggatgc

SEQ ID NO: 5472115 - DNA, 22 bp, Homo sapiens
tggcagggggccccgccagggc

SEQ ID NO: 5472116 - DNA, 15 bp, Homo sapiens
tggcagggggctgct

SEQ ID NO: 5472117 - DNA, 19 bp, Homo sapiens
tggcagggggctgctgctg

SEQ ID NO: 5472118 - DNA, 21 bp, Homo sapiens
tggcagggggctgctgctggg

SEQ ID NO: 5472119 - DNA, 23 bp, Homo sapiens
tggcagggggctgctgctgggct

SEQ ID NO: 5472120 - DNA, 16 bp, Homo sapiens
tggcagggtccctcca

SEQ ID NO: 5472121 - DNA, 16 bp, Homo sapiens
tggcagggtgggatgg

SEQ ID NO: 5472122 - DNA, 17 bp, Homo sapiens
tggcaggtaggaatatt

SEQ ID NO: 5472123 - DNA, 19 bp, Homo sapiens
tggcaggtcactgtcactg

SEQ ID NO: 5472124 - DNA, 22 bp, Homo sapiens
tggcaggtcactgtcactgccg

SEQ ID NO: 5472125 - DNA, 21 bp, Homo sapiens
tggcaggtcatggagcagccc

SEQ ID NO: 5472126 - DNA, 22 bp, Homo sapiens
tggcaggtcatggagcagcccc

SEQ ID NO: 5472127 - DNA, 14 bp, Homo sapiens
tggcaggtcccctg

SEQ ID NO: 5472128 - DNA, 14 bp, Homo sapiens
tggcaggtgagcaa

SEQ ID NO: 5472129 - DNA, 20 bp, Homo sapiens
tggcaggtgcagatgggctg

SEQ ID NO: 5472130 - DNA, 22 bp, Homo sapiens
tggcaggtggaggtgtcaggct

SEQ ID NO: 5472131 - DNA, 20 bp, Homo sapiens
tggcaggtgggggtgggctg

SEQ ID NO: 5472132 - DNA, 18 bp, Homo sapiens
tggcaggtgtgggctccc

SEQ ID NO: 5472133 - DNA, 19 bp, Homo sapiens
tggcaggtgtgggctccca

SEQ ID NO: 5472134 - DNA, 21 bp, Homo sapiens
tggcaggtgtgggctcccacg

SEQ ID NO: 5472135 - DNA, 18 bp, Homo sapiens
tggcaggtgttgggacct

SEQ ID NO: 5472136 - DNA, 21 bp, Homo sapiens
tggcaggtgttgggacctgct

SEQ ID NO: 5472137 - DNA, 17 bp, Homo sapiens
tggcagtaaagagaaac

SEQ ID NO: 5472138 - DNA, 19 bp, Homo sapiens
tggcagtaaagagaaactt

SEQ ID NO: 5472139 - DNA, 13 bp, Homo sapiens
tggcagtacagag

SEQ ID NO: 5472140 - DNA, 18 bp, Homo sapiens
tggcagtacagagtgcag

SEQ ID NO: 5472141 - DNA, 11 bp, Homo sapiens
tggcagtattg

SEQ ID NO: 5472142 - DNA, 14 bp, Homo sapiens
tggcagtatttcat

SEQ ID NO: 5472143 - DNA, 18 bp, Homo sapiens
tggcagtatttcatttct

SEQ ID NO: 5472144 - DNA, 17 bp, Homo sapiens
tggcagtcactgaattc

SEQ ID NO: 5472145 - DNA, 18 bp, Homo sapiens
tggcagtccagccagctc

SEQ ID NO: 5472146 - DNA, 14 bp, Homo sapiens
tggcagtcctggag

SEQ ID NO: 5472147 - DNA, 20 bp, Homo sapiens
tggcagtcctggaggcaggg

SEQ ID NO: 5472148 - DNA, 14 bp, Homo sapiens
tggcagtgactttg

SEQ ID NO: 5472149 - DNA, 17 bp, Homo sapiens
tggcagtgagtgagcct

SEQ ID NO: 5472150 - DNA, 18 bp, Homo sapiens
tggcagtgagtgagcctg

SEQ ID NO: 5472151 - DNA, 21 bp, Homo sapiens
tggcagtgagtgagcctggct

SEQ ID NO: 5472152 - DNA, 22 bp, Homo sapiens
tggcagtgcagcaaccagagca

SEQ ID NO: 5472153 - DNA, 15 bp, Homo sapiens
tggcagtggcagaga

SEQ ID NO: 5472154 - DNA, 15 bp, Homo sapiens
tggcagtggccaggc

SEQ ID NO: 5472155 - DNA, 22 bp, Homo sapiens
tggcagtggctctcagagcagc

SEQ ID NO: 5472156 - DNA, 17 bp, Homo sapiens
tggcagtggctgtgaag

SEQ ID NO: 5472157 - DNA, 14 bp, Homo sapiens
tggcagtgggaatg

SEQ ID NO: 5472158 - DNA, 19 bp, Homo sapiens
tggcagtgggaatgttctt

SEQ ID NO: 5472159 - DNA, 14 bp, Homo sapiens
tggcagtgggagct

SEQ ID NO: 5472160 - DNA, 20 bp, Homo sapiens
tggcagtgggagctgcctgt

SEQ ID NO: 5472161 - DNA, 12 bp, Homo sapiens
tggcagtggttt

SEQ ID NO: 5472162 - DNA, 19 bp, Homo sapiens
tggcagtgtgcggagctga

SEQ ID NO: 5472163 - DNA, 20 bp, Homo sapiens
tggcagtgtgcggagctgat

SEQ ID NO: 5472164 - DNA, 23 bp, Homo sapiens
tggcagtgtggggagggcaggtc

SEQ ID NO: 5472165 - DNA, 11 bp, Homo sapiens
tggcagtgtgt

SEQ ID NO: 5472166 - DNA, 22 bp, Homo sapiens
tggcagtgtgtcacactgagct

SEQ ID NO: 5472167 - DNA, 11 bp, Homo sapiens
tggcagtgttt

SEQ ID NO: 5472168 - DNA, 13 bp, Homo sapiens
tggcagtgtttgt

SEQ ID NO: 5472169 - DNA, 16 bp, Homo sapiens
tggcagtgttttgaga

SEQ ID NO: 5472170 - DNA, 18 bp, Homo sapiens
tggcagtgttttggttca

SEQ ID NO: 5472171 - DNA, 21 bp, Homo sapiens
tggcagtgttttggttcagac

SEQ ID NO: 5472172 - DNA, 13 bp, Homo sapiens
tggcagttcttta

SEQ ID NO: 5472173 - DNA, 23 bp, Homo sapiens
tggcagttgaacagagggagaga

SEQ ID NO: 5472174 - DNA, 13 bp, Homo sapiens
tggcagttgcagt

SEQ ID NO: 5472175 - DNA, 12 bp, Homo sapiens
tggcagttgcat

SEQ ID NO: 5472176 - DNA, 14 bp, Homo sapiens
tggcagtttcctcc

SEQ ID NO: 5472177 - DNA, 19 bp, Homo sapiens
tggcagtttgttgatcttt

SEQ ID NO: 5472178 - DNA, 18 bp, Homo sapiens
tggcagttttgacatcag

SEQ ID NO: 5472179 - DNA, 18 bp, Homo sapiens
tggcataacaaaggcaag

SEQ ID NO: 5472180 - DNA, 17 bp, Homo sapiens
tggcataacataaatct

SEQ ID NO: 5472181 - DNA, 23 bp, Homo sapiens
tggcataactaaaattaagtata

SEQ ID NO: 5472182 - DNA, 12 bp, Homo sapiens
tggcataagaca

SEQ ID NO: 5472183 - DNA, 20 bp, Homo sapiens
tggcataatagtcaatttct

SEQ ID NO: 5472184 - DNA, 22 bp, Homo sapiens
tggcatacgcctgtagtcctag

SEQ ID NO: 5472185 - DNA, 21 bp, Homo sapiens
tggcatagagcagcactaaat

SEQ ID NO: 5472186 - DNA, 19 bp, Homo sapiens
tggcatagaggttttgtat

SEQ ID NO: 5472187 - DNA, 15 bp, Homo sapiens
tggcatagctctggg

SEQ ID NO: 5472188 - DNA, 14 bp, Homo sapiens
tggcatagtttcat

SEQ ID NO: 5472189 - DNA, 16 bp, Homo sapiens
tggcatagtttcataa

SEQ ID NO: 5472190 - DNA, 23 bp, Homo sapiens
tggcatatatgtgatctgggcat

SEQ ID NO: 5472191 - DNA, 20 bp, Homo sapiens
tggcatatccattgtggaaa

SEQ ID NO: 5472192 - DNA, 18 bp, Homo sapiens
tggcatatgtttctgcta

SEQ ID NO: 5472193 - DNA, 19 bp, Homo sapiens
tggcatatgtttctgctag

SEQ ID NO: 5472194 - DNA, 14 bp, Homo sapiens
tggcatattttaat

SEQ ID NO: 5472195 - DNA, 22 bp, Homo sapiens
tggcatcacagaccccagctgg

SEQ ID NO: 5472196 - DNA, 15 bp, Homo sapiens
tggcatcacagggca

SEQ ID NO: 5472197 - DNA, 20 bp, Homo sapiens
tggcatcacagggcagagcc

SEQ ID NO: 5472198 - DNA, 13 bp, Homo sapiens
tggcatcacgtca

SEQ ID NO: 5472199 - DNA, 18 bp, Homo sapiens
tggcatcagctggcgtca

SEQ ID NO: 5472200 - DNA, 20 bp, Homo sapiens
tggcatcatccattctctct

SEQ ID NO: 5472201 - DNA, 15 bp, Homo sapiens
tggcatcatggtgga

SEQ ID NO: 5472202 - DNA, 20 bp, Homo sapiens
tggcatccagggctgccagg

SEQ ID NO: 5472203 - DNA, 17 bp, Homo sapiens
aaaggaggaatcagacc

SEQ ID NO: 5472204 - DNA, 13 bp, Homo sapiens
aaaggaggaccag

SEQ ID NO: 5472205 - DNA, 16 bp, Homo sapiens
aaaggaggagacagag

SEQ ID NO: 5472206 - DNA, 18 bp, Homo sapiens
aaaggaggatagaaaaag

SEQ ID NO: 5472207 - DNA, 14 bp, Homo sapiens
aaaggaggctggca

SEQ ID NO: 5472208 - DNA, 21 bp, Homo sapiens
aaaggaggggaaacaatgaaa

SEQ ID NO: 5472209 - DNA, 13 bp, Homo sapiens
aaaggaggtgaaa

SEQ ID NO: 5472210 - DNA, 23 bp, Homo sapiens
aaaggagtgcatggccacagcca

SEQ ID NO: 5472211 - DNA, 15 bp, Homo sapiens
aaaggagtttatgtt

SEQ ID NO: 5472212 - DNA, 14 bp, Homo sapiens
aaaggataaagaag

SEQ ID NO: 5472213 - DNA, 22 bp, Homo sapiens
aaaggataaagaaggatgatgt

SEQ ID NO: 5472214 - DNA, 14 bp, Homo sapiens
aaaggataaatttt

SEQ ID NO: 5472215 - DNA, 22 bp, Homo sapiens
aaaggataattatccaataaaa

SEQ ID NO: 5472216 - DNA, 18 bp, Homo sapiens
aaaggatactgtaacact

SEQ ID NO: 5472217 - DNA, 15 bp, Homo sapiens
aaaggatacttattt

SEQ ID NO: 5472218 - DNA, 17 bp, Homo sapiens
aaaggatacttatttaa

SEQ ID NO: 5472219 - DNA, 21 bp, Homo sapiens
aaaggatagatcaaagtcaaa

SEQ ID NO: 5472220 - DNA, 17 bp, Homo sapiens
aaaggatatgaaactct

SEQ ID NO: 5472221 - DNA, 12 bp, Homo sapiens
aaaggatatttc

SEQ ID NO: 5472222 - DNA, 15 bp, Homo sapiens
aaaggatatttcaaa

SEQ ID NO: 5472223 - DNA, 16 bp, Homo sapiens
aaaggatatttcaaat

SEQ ID NO: 5472224 - DNA, 17 bp, Homo sapiens
aaaggatatttcaaatg

SEQ ID NO: 5472225 - DNA, 20 bp, Homo sapiens
aaaggatcatggtttttgct

SEQ ID NO: 5472226 - DNA, 13 bp, Homo sapiens
aaaggatctcctt

SEQ ID NO: 5472227 - DNA, 22 bp, Homo sapiens
aaaggatctgtgattggctggt

SEQ ID NO: 5472228 - DNA, 22 bp, Homo sapiens
aaaggatcttattttgtgaact

SEQ ID NO: 5472229 - DNA, 17 bp, Homo sapiens
aaaggatgaaagtctga

SEQ ID NO: 5472230 - DNA, 16 bp, Homo sapiens
aaaggatgagggttca

SEQ ID NO: 5472231 - DNA, 20 bp, Homo sapiens
aaaggatgcccaaagatgca

SEQ ID NO: 5472232 - DNA, 15 bp, Homo sapiens
aaaggatggaagaaa

SEQ ID NO: 5472233 - DNA, 23 bp, Homo sapiens
aaaggatggcagcctcagggctt

SEQ ID NO: 5472234 - DNA, 14 bp, Homo sapiens
aaaggatggtggtt

SEQ ID NO: 5472235 - DNA, 20 bp, Homo sapiens
aaaggatggtggttatttta

SEQ ID NO: 5472236 - DNA, 13 bp, Homo sapiens
aaaggatgtgatt

SEQ ID NO: 5472237 - DNA, 13 bp, Homo sapiens
aaaggatgttaca

SEQ ID NO: 5472238 - DNA, 14 bp, Homo sapiens
aaaggatgttacaa

SEQ ID NO: 5472239 - DNA, 21 bp, Homo sapiens
aaaggatgttacaagtttgct

SEQ ID NO: 5472240 - DNA, 19 bp, Homo sapiens
aaaggattaagatacactc

SEQ ID NO: 5472241 - DNA, 21 bp, Homo sapiens
aaaggattaagatacactcct

SEQ ID NO: 5472242 - DNA, 21 bp, Homo sapiens
aaaggattaggcaaaaataat

SEQ ID NO: 5472243 - DNA, 18 bp, Homo sapiens
aaaggattcatgtggaat

SEQ ID NO: 5472244 - DNA, 23 bp, Homo sapiens
aaaggatttgaaacttggtgtgt

SEQ ID NO: 5472245 - DNA, 19 bp, Homo sapiens
aaaggattttaccaaagca

SEQ ID NO: 5472246 - DNA, 12 bp, Homo sapiens
aaaggattttgg

SEQ ID NO: 5472247 - DNA, 16 bp, Homo sapiens
aaaggcaaaaccttac

SEQ ID NO: 5472248 - DNA, 19 bp, Homo sapiens
aaaggcaaaagaatggcta

SEQ ID NO: 5472249 - DNA, 13 bp, Homo sapiens
aaaggcaaaagac

SEQ ID NO: 5472250 - DNA, 15 bp, Homo sapiens
aaaggcaaaagactg

SEQ ID NO: 5472251 - DNA, 13 bp, Homo sapiens
aaaggcaaatatt

SEQ ID NO: 5472252 - DNA, 14 bp, Homo sapiens
aaaggcaaatattg

SEQ ID NO: 5472253 - DNA, 16 bp, Homo sapiens
aaaggcaaatattgaa

SEQ ID NO: 5472254 - DNA, 20 bp, Homo sapiens
aaaggcaaatattgaagttg

SEQ ID NO: 5472255 - DNA, 23 bp, Homo sapiens
aaaggcaaatattgaagttgttt

SEQ ID NO: 5472256 - DNA, 17 bp, Homo sapiens
aaaggcaaatgtgtaca

SEQ ID NO: 5472257 - DNA, 17 bp, Homo sapiens
aaaggcaaccaataaaa

SEQ ID NO: 5472258 - DNA, 15 bp, Homo sapiens
aaaggcaagccagca

SEQ ID NO: 5472259 - DNA, 22 bp, Homo sapiens
aaaggcaagcttgaggccaaga

SEQ ID NO: 5472260 - DNA, 12 bp, Homo sapiens
aaaggcaatttt

SEQ ID NO: 5472261 - DNA, 14 bp, Homo sapiens
aaaggcaatttttg

SEQ ID NO: 5472262 - DNA, 18 bp, Homo sapiens
aaaggcacatattggagg

SEQ ID NO: 5472263 - DNA, 17 bp, Homo sapiens
aaaggcacctataaaac

SEQ ID NO: 5472264 - DNA, 20 bp, Homo sapiens
aaaggcacctataaaacagg

SEQ ID NO: 5472265 - DNA, 13 bp, Homo sapiens
aaaggcagaaaca

SEQ ID NO: 5472266 - DNA, 14 bp, Homo sapiens
aaaggcagaagcaa

SEQ ID NO: 5472267 - DNA, 15 bp, Homo sapiens
aaaggcagagattgg

SEQ ID NO: 5472268 - DNA, 16 bp, Homo sapiens
aaaggcagccagatcc

SEQ ID NO: 5472269 - DNA, 21 bp, Homo sapiens
aaaggcagccagatccccagg

SEQ ID NO: 5472270 - DNA, 23 bp, Homo sapiens
aaaggcagccagatccccagggc

SEQ ID NO: 5472271 - DNA, 16 bp, Homo sapiens
aaaggcagccctcacc

SEQ ID NO: 5472272 - DNA, 23 bp, Homo sapiens
aaaggcagccctcacctctgagg

SEQ ID NO: 5472273 - DNA, 23 bp, Homo sapiens
aaaggcagctaagatagaaagct

SEQ ID NO: 5472274 - DNA, 19 bp, Homo sapiens
aaaggcagctgcctctgct

SEQ ID NO: 5472275 - DNA, 22 bp, Homo sapiens
aaaggcagctgcctctgctccc

SEQ ID NO: 5472276 - DNA, 12 bp, Homo sapiens
aaaggcagctgt

SEQ ID NO: 5472277 - DNA, 23 bp, Homo sapiens
aaaggcagctgtgtctgagccca

SEQ ID NO: 5472278 - DNA, 17 bp, Homo sapiens
aaaggcagctgttgtct

SEQ ID NO: 5472279 - DNA, 20 bp, Homo sapiens
aaaggcaggaagggaagcgt

SEQ ID NO: 5472280 - DNA, 20 bp, Homo sapiens
aaaggcagggccacttttga

SEQ ID NO: 5472281 - DNA, 23 bp, Homo sapiens
aaaggcagggtagcctgaattgc

SEQ ID NO: 5472282 - DNA, 16 bp, Homo sapiens
aaaggcagtattttgt

SEQ ID NO: 5472283 - DNA, 17 bp, Homo sapiens
aaaggcagtccagagct

SEQ ID NO: 5472284 - DNA, 19 bp, Homo sapiens
aaaggcagtggggctgggg

SEQ ID NO: 5472285 - DNA, 15 bp, Homo sapiens
aaaggcagttaccat

SEQ ID NO: 5472286 - DNA, 14 bp, Homo sapiens
aaaggcagttttct

SEQ ID NO: 5472287 - DNA, 15 bp, Homo sapiens
aaaggcatcagtccc

SEQ ID NO: 5472288 - DNA, 23 bp, Homo sapiens
aaaggcatcagtccccctgtgca

SEQ ID NO: 5472289 - DNA, 19 bp, Homo sapiens
aaaggcatgttttaaaatc

SEQ ID NO: 5472290 - DNA, 21 bp, Homo sapiens
aaaggcatgttttaaaatcta

SEQ ID NO: 5472291 - DNA, 17 bp, Homo sapiens
aaaggccaaacctctgt

SEQ ID NO: 5472292 - DNA, 18 bp, Homo sapiens
aaaggccaaacctctgtt

SEQ ID NO: 5472293 - DNA, 13 bp, Homo sapiens
aaaggccaaactg

SEQ ID NO: 5472294 - DNA, 15 bp, Homo sapiens
aaaggccaaactgct

SEQ ID NO: 5472295 - DNA, 15 bp, Homo sapiens
aaaggccaacagcat

SEQ ID NO: 5472296 - DNA, 19 bp, Homo sapiens
aaaggccagcagccttcca

SEQ ID NO: 5472297 - DNA, 20 bp, Homo sapiens
aaaggccagctggcagcaga

SEQ ID NO: 5472298 - DNA, 12 bp, Homo sapiens
aaaggcccagag

SEQ ID NO: 5472299 - DNA, 14 bp, Homo sapiens
aaaggcccagggag

SEQ ID NO: 5472300 - DNA, 13 bp, Homo sapiens
aaaggccccttcc

SEQ ID NO: 5472301 - DNA, 15 bp, Homo sapiens
aaaggccctgtggtc

SEQ ID NO: 5472302 - DNA, 19 bp, Homo sapiens
aaaggcccttagagggaat

SEQ ID NO: 5472303 - DNA, 23 bp, Homo sapiens
aaaggccgtgtgtttagaagcct

SEQ ID NO: 5472304 - DNA, 21 bp, Homo sapiens
aaaggccgttggctgtgctgt

SEQ ID NO: 5472305 - DNA, 16 bp, Homo sapiens
aaaggcctcatctcct

SEQ ID NO: 5472306 - DNA, 21 bp, Homo sapiens
aaaggcctcttgtaaagactg

SEQ ID NO: 5472307 - DNA, 16 bp, Homo sapiens
aaaggcctgcttttgt

SEQ ID NO: 5472308 - DNA, 12 bp, Homo sapiens
aaaggcctgggg

SEQ ID NO: 5472309 - DNA, 21 bp, Homo sapiens
aaaggcgatagctgactttca

SEQ ID NO: 5472310 - DNA, 21 bp, Homo sapiens
aaaggcgcagtgcttctctac

SEQ ID NO: 5472311 - DNA, 18 bp, Homo sapiens
aaaggcgcccccgcccca

SEQ ID NO: 5472312 - DNA, 19 bp, Homo sapiens
aaaggcggtgttttttgtt

SEQ ID NO: 5472313 - DNA, 17 bp, Homo sapiens
aaaggctacctttgtat

SEQ ID NO: 5472314 - DNA, 19 bp, Homo sapiens
aaaggctaggtacacagct

SEQ ID NO: 5472315 - DNA, 14 bp, Homo sapiens
aaaggctcatttaa

SEQ ID NO: 5472316 - DNA, 18 bp, Homo sapiens
aaaggctcatttaaaaca

SEQ ID NO: 5472317 - DNA, 21 bp, Homo sapiens
aaaggctcatttaaaacaggc

SEQ ID NO: 5472318 - DNA, 24 bp, Homo sapiens
aaaggctcatttaaaacaggcaaa

SEQ ID NO: 5472319 - DNA, 14 bp, Homo sapiens
aaaggctccaggag

SEQ ID NO: 5472320 - DNA, 19 bp, Homo sapiens
aaaggctccaggagcagcc

SEQ ID NO: 5472321 - DNA, 12 bp, Homo sapiens
aaaggctccctc

SEQ ID NO: 5472322 - DNA, 22 bp, Homo sapiens
aaaggctccctcgccctgtgag

SEQ ID NO: 5472323 - DNA, 15 bp, Homo sapiens
aaaggctcctgagac

SEQ ID NO: 5472324 - DNA, 19 bp, Homo sapiens
aaaggctcgattttgtatc

SEQ ID NO: 5472325 - DNA, 15 bp, Homo sapiens
aaaggctgaaaagaa

SEQ ID NO: 5472326 - DNA, 18 bp, Homo sapiens
aaaggctgacattcactg

SEQ ID NO: 5472327 - DNA, 19 bp, Homo sapiens
aaaggctgacattcactga

SEQ ID NO: 5472328 - DNA, 14 bp, Homo sapiens
aaaggctgagaagg

SEQ ID NO: 5472329 - DNA, 21 bp, Homo sapiens
aaaggctgcagctaatttgtg

SEQ ID NO: 5472330 - DNA, 20 bp, Homo sapiens
aaaggctggagagagattct

SEQ ID NO: 5472331 - DNA, 18 bp, Homo sapiens
aaaggctggatgtgcttt

SEQ ID NO: 5472332 - DNA, 19 bp, Homo sapiens
aaaggctggctgaaaatca

SEQ ID NO: 5472333 - DNA, 22 bp, Homo sapiens
aaaggctggctgaaaatcacta

SEQ ID NO: 5472334 - DNA, 18 bp, Homo sapiens
aaaggctgtcatttcatt

SEQ ID NO: 5472335 - DNA, 16 bp, Homo sapiens
aaaggcttgaagctgt

SEQ ID NO: 5472336 - DNA, 19 bp, Homo sapiens
aaaggcttgagtctggata

SEQ ID NO: 5472337 - DNA, 12 bp, Homo sapiens
aaaggcttggct

SEQ ID NO: 5472338 - DNA, 17 bp, Homo sapiens
aaaggcttggctggtgt

SEQ ID NO: 5472339 - DNA, 22 bp, Homo sapiens
aaaggctttggcaacagaaaac

SEQ ID NO: 5472340 - DNA, 14 bp, Homo sapiens
aaagggaaaaagac

SEQ ID NO: 5472341 - DNA, 15 bp, Homo sapiens
aaagggaaaaagacc

SEQ ID NO: 5472342 - DNA, 15 bp, Homo sapiens
aaagggaaactggct

SEQ ID NO: 5472343 - DNA, 19 bp, Homo sapiens
aaagggaaagttttgttct

SEQ ID NO: 5472344 - DNA, 13 bp, Homo sapiens
aaagggaaattga

SEQ ID NO: 5472345 - DNA, 15 bp, Homo sapiens
aaagggaagaaagga

SEQ ID NO: 5472346 - DNA, 11 bp, Homo sapiens
aaagggaagta

SEQ ID NO: 5472347 - DNA, 22 bp, Homo sapiens
aaagggaagttatttatatttt

SEQ ID NO: 5472348 - DNA, 22 bp, Homo sapiens
aaagggacagcatgccccttgg

SEQ ID NO: 5472349 - DNA, 10 bp, Homo sapiens
aaagggaccc

SEQ ID NO: 5472350 - DNA, 14 bp, Homo sapiens
aaagggacccacct

SEQ ID NO: 5472351 - DNA, 23 bp, Homo sapiens
aaagggacccgaagcccaggctg

SEQ ID NO: 5472352 - DNA, 13 bp, Homo sapiens
aaagggacttttg

SEQ ID NO: 5472353 - DNA, 23 bp, Homo sapiens
aaagggagcactgggttgacttt

SEQ ID NO: 5472354 - DNA, 22 bp, Homo sapiens
aaagggagcagagaaggccagg

SEQ ID NO: 5472355 - DNA, 18 bp, Homo sapiens
aaagggagctatcaggaa

SEQ ID NO: 5472356 - DNA, 15 bp, Homo sapiens
aaagggaggaacact

SEQ ID NO: 5472357 - DNA, 13 bp, Homo sapiens
aaagggagggagg

SEQ ID NO: 5472358 - DNA, 14 bp, Homo sapiens
aaagggagggtggc

SEQ ID NO: 5472359 - DNA, 18 bp, Homo sapiens
aaagggagggtggcagag

SEQ ID NO: 5472360 - DNA, 19 bp, Homo sapiens
aaagggagggtggcagaga

SEQ ID NO: 5472361 - DNA, 20 bp, Homo sapiens
aaagggatggcaagatgtgg

SEQ ID NO: 5472362 - DNA, 19 bp, Homo sapiens
aaagggatggtcaggccca

SEQ ID NO: 5472363 - DNA, 19 bp, Homo sapiens
aaagggcacttaatttgta

SEQ ID NO: 5472364 - DNA, 16 bp, Homo sapiens
aaagggcagaggaaga

SEQ ID NO: 5472365 - DNA, 14 bp, Homo sapiens
aaagggcagccagg

SEQ ID NO: 5472366 - DNA, 15 bp, Homo sapiens
aaagggcagccaggg

SEQ ID NO: 5472367 - DNA, 14 bp, Homo sapiens
aaagggcagccctc

SEQ ID NO: 5472368 - DNA, 23 bp, Homo sapiens
aaagggcagccctccacttctgg

SEQ ID NO: 5472369 - DNA, 11 bp, Homo sapiens
aaagggcagga

SEQ ID NO: 5472370 - DNA, 22 bp, Homo sapiens
aaagggcaggcctgttccctga

SEQ ID NO: 5472371 - DNA, 20 bp, Homo sapiens
aaagggcagggcatctcctg

SEQ ID NO: 5472372 - DNA, 15 bp, Homo sapiens
aaagggcattttgta

SEQ ID NO: 5472373 - DNA, 13 bp, Homo sapiens
aaagggccaggag

SEQ ID NO: 5472374 - DNA, 20 bp, Homo sapiens
aaagggcccacacctggtgg

SEQ ID NO: 5472375 - DNA, 14 bp, Homo sapiens
aaagggcctggcca

SEQ ID NO: 5472376 - DNA, 15 bp, Homo sapiens
aaagggcggaagagt

SEQ ID NO: 5472377 - DNA, 17 bp, Homo sapiens
aaagggcggaagagtta

SEQ ID NO: 5472378 - DNA, 20 bp, Homo sapiens
aaagggcggaagagttacaa

SEQ ID NO: 5472379 - DNA, 18 bp, Homo sapiens
aaagggctggctccccct

SEQ ID NO: 5472380 - DNA, 16 bp, Homo sapiens
aaaggggacaggcctc

SEQ ID NO: 5472381 - DNA, 19 bp, Homo sapiens
aaagttataataactgaac

SEQ ID NO: 5472382 - DNA, 16 bp, Homo sapiens
aaagttatataggttt

SEQ ID NO: 5472383 - DNA, 14 bp, Homo sapiens
aaagttatatttca

SEQ ID NO: 5472384 - DNA, 12 bp, Homo sapiens
aaagttatctta

SEQ ID NO: 5472385 - DNA, 19 bp, Homo sapiens
aaagttatcttaaatatga

SEQ ID NO: 5472386 - DNA, 22 bp, Homo sapiens
aaagttatgtatttaaagttgt

SEQ ID NO: 5472387 - DNA, 16 bp, Homo sapiens
aaagttattaaaattg

SEQ ID NO: 5472388 - DNA, 21 bp, Homo sapiens
aaagttattaatattttaatt

SEQ ID NO: 5472389 - DNA, 18 bp, Homo sapiens
aaagttattagtggttta

SEQ ID NO: 5472390 - DNA, 23 bp, Homo sapiens
aaagttattcttgtcattttgaa

SEQ ID NO: 5472391 - DNA, 23 bp, Homo sapiens
aaagttattgataagttcataca

SEQ ID NO: 5472392 - DNA, 22 bp, Homo sapiens
aaagttattgtgttgccttagc

SEQ ID NO: 5472393 - DNA, 14 bp, Homo sapiens
aaagttatttatgc

SEQ ID NO: 5472394 - DNA, 15 bp, Homo sapiens
aaagttatttatgct

SEQ ID NO: 5472395 - DNA, 15 bp, Homo sapiens
aaagttattttcaga

SEQ ID NO: 5472396 - DNA, 18 bp, Homo sapiens
aaagttcaaagcaaccac

SEQ ID NO: 5472397 - DNA, 20 bp, Homo sapiens
aaagttcaacttatttcata

SEQ ID NO: 5472398 - DNA, 18 bp, Homo sapiens
aaagttcacaatgtggcc

SEQ ID NO: 5472399 - DNA, 20 bp, Homo sapiens
aaagttcacattaactcagg

SEQ ID NO: 5472400 - DNA, 20 bp, Homo sapiens
aaagttcagatgtttcatca

SEQ ID NO: 5472401 - DNA, 19 bp, Homo sapiens
aaagttcataacagtgcca

SEQ ID NO: 5472402 - DNA, 22 bp, Homo sapiens
aaagttcataacagtgccattg

SEQ ID NO: 5472403 - DNA, 19 bp, Homo sapiens
aaagttcatataatttaaa

SEQ ID NO: 5472404 - DNA, 13 bp, Homo sapiens
aaagttcatgttg

SEQ ID NO: 5472405 - DNA, 22 bp, Homo sapiens
aaagttccaaatgtttataaag

SEQ ID NO: 5472406 - DNA, 18 bp, Homo sapiens
aaagttccagcagtttca

SEQ ID NO: 5472407 - DNA, 19 bp, Homo sapiens
aaagttccagcagtttcat

SEQ ID NO: 5472408 - DNA, 21 bp, Homo sapiens
aaagttcccactccttcagga

SEQ ID NO: 5472409 - DNA, 19 bp, Homo sapiens
aaagttcctgtcattcctc

SEQ ID NO: 5472410 - DNA, 15 bp, Homo sapiens
aaagttctaagattc

SEQ ID NO: 5472411 - DNA, 16 bp, Homo sapiens
aaagttctaagattct

SEQ ID NO: 5472412 - DNA, 21 bp, Homo sapiens
aaagttctaataatttctaat

SEQ ID NO: 5472413 - DNA, 21 bp, Homo sapiens
aaagttctattatctgggttt

SEQ ID NO: 5472414 - DNA, 15 bp, Homo sapiens
aaagttctcaatgta

SEQ ID NO: 5472415 - DNA, 14 bp, Homo sapiens
aaagttctgtactc

SEQ ID NO: 5472416 - DNA, 17 bp, Homo sapiens
aaagttcttaaaacact

SEQ ID NO: 5472417 - DNA, 18 bp, Homo sapiens
aaagttgaaaagccaaag

SEQ ID NO: 5472418 - DNA, 12 bp, Homo sapiens
aaagttgaaaat

SEQ ID NO: 5472419 - DNA, 21 bp, Homo sapiens
aaagttgaaccattatacttt

SEQ ID NO: 5472420 - DNA, 16 bp, Homo sapiens
aaagttgaatttattg

SEQ ID NO: 5472421 - DNA, 17 bp, Homo sapiens
aaagttgaccaatgaaa

SEQ ID NO: 5472422 - DNA, 24 bp, Homo sapiens
aaagttgagagacagtaacacaat

SEQ ID NO: 5472423 - DNA, 16 bp, Homo sapiens
aaagttgagtttccaa

SEQ ID NO: 5472424 - DNA, 23 bp, Homo sapiens
aaagttgataaagattttttaat

SEQ ID NO: 5472425 - DNA, 21 bp, Homo sapiens
aaagttgataggagacttgta

SEQ ID NO: 5472426 - DNA, 17 bp, Homo sapiens
aaagttgattttgaact

SEQ ID NO: 5472427 - DNA, 12 bp, Homo sapiens
aaagttgcagat

SEQ ID NO: 5472428 - DNA, 13 bp, Homo sapiens
aaagttgcagatg

SEQ ID NO: 5472429 - DNA, 19 bp, Homo sapiens
aaagttgcagatgtattga

SEQ ID NO: 5472430 - DNA, 23 bp, Homo sapiens
aaagttgcagctgttttgttgac

SEQ ID NO: 5472431 - DNA, 17 bp, Homo sapiens
aaagttgccattattct

SEQ ID NO: 5472432 - DNA, 19 bp, Homo sapiens
aaagttgccattattctat

SEQ ID NO: 5472433 - DNA, 23 bp, Homo sapiens
aaagttgcctaaatccatttgga

SEQ ID NO: 5472434 - DNA, 21 bp, Homo sapiens
aaagttgcgtttaagttgtat

SEQ ID NO: 5472435 - DNA, 17 bp, Homo sapiens
aaagttggaaaggaaaa

SEQ ID NO: 5472436 - DNA, 19 bp, Homo sapiens
aaagttggaaggatctgct

SEQ ID NO: 5472437 - DNA, 15 bp, Homo sapiens
aaagttggactaaat

SEQ ID NO: 5472438 - DNA, 17 bp, Homo sapiens
aaagttgggcagagaaa

SEQ ID NO: 5472439 - DNA, 17 bp, Homo sapiens
aaagttggtaaaccttt

SEQ ID NO: 5472440 - DNA, 19 bp, Homo sapiens
aaagttggttcacttcaaa

SEQ ID NO: 5472441 - DNA, 18 bp, Homo sapiens
aaagttggttttgtaaaa

SEQ ID NO: 5472442 - DNA, 24 bp, Homo sapiens
aaagttggttttgtaaaattccat

SEQ ID NO: 5472443 - DNA, 18 bp, Homo sapiens
aaagttgtaaataatttt

SEQ ID NO: 5472444 - DNA, 19 bp, Homo sapiens
aaagttgtaacaaatacag

SEQ ID NO: 5472445 - DNA, 16 bp, Homo sapiens
aaagttgtactttaaa

SEQ ID NO: 5472446 - DNA, 21 bp, Homo sapiens
aaagttgtagtgaagctctca

SEQ ID NO: 5472447 - DNA, 13 bp, Homo sapiens
aaagttgtatcca

SEQ ID NO: 5472448 - DNA, 22 bp, Homo sapiens
aaagttgtatccattaacctgg

SEQ ID NO: 5472449 - DNA, 18 bp, Homo sapiens
aaagttgtatttcaaata

SEQ ID NO: 5472450 - DNA, 18 bp, Homo sapiens
aaagttgttcaactattt

SEQ ID NO: 5472451 - DNA, 19 bp, Homo sapiens
aaagttgttcaactatttt

SEQ ID NO: 5472452 - DNA, 13 bp, Homo sapiens
aaagttgttcttt

SEQ ID NO: 5472453 - DNA, 15 bp, Homo sapiens
aaagttgttgcattc

SEQ ID NO: 5472454 - DNA, 17 bp, Homo sapiens
aaagttgtttaataagt

SEQ ID NO: 5472455 - DNA, 13 bp, Homo sapiens
aaagttgtttata

SEQ ID NO: 5472456 - DNA, 13 bp, Homo sapiens
aaagtttaaaatg

SEQ ID NO: 5472457 - DNA, 16 bp, Homo sapiens
aaagtttaaaatgtat

SEQ ID NO: 5472458 - DNA, 22 bp, Homo sapiens
aaagtttaaagaagagtaacac

SEQ ID NO: 5472459 - DNA, 17 bp, Homo sapiens
aaagtttaagcaattca

SEQ ID NO: 5472460 - DNA, 12 bp, Homo sapiens
aaagtttaataa

SEQ ID NO: 5472461 - DNA, 21 bp, Homo sapiens
aaagtttaatattaaagccat

SEQ ID NO: 5472462 - DNA, 18 bp, Homo sapiens
aaagtttacaacttgatt

SEQ ID NO: 5472463 - DNA, 15 bp, Homo sapiens
aaagtttacagatgt

SEQ ID NO: 5472464 - DNA, 16 bp, Homo sapiens
aaagtttacattgtcc

SEQ ID NO: 5472465 - DNA, 21 bp, Homo sapiens
aaagtttatcagatattttca

SEQ ID NO: 5472466 - DNA, 15 bp, Homo sapiens
aaagtttatttcatg

SEQ ID NO: 5472467 - DNA, 18 bp, Homo sapiens
aaagtttcaaaaatctga

SEQ ID NO: 5472468 - DNA, 19 bp, Homo sapiens
aaagtttcaaaaatctgaa

SEQ ID NO: 5472469 - DNA, 20 bp, Homo sapiens
aaagtttcaaaaatctgaag

SEQ ID NO: 5472470 - DNA, 21 bp, Homo sapiens
aaagtttcaaaaatctgaaga

SEQ ID NO: 5472471 - DNA, 13 bp, Homo sapiens
aaagtttcaatgt

SEQ ID NO: 5472472 - DNA, 21 bp, Homo sapiens
aaagtttcattagtcatattt

SEQ ID NO: 5472473 - DNA, 22 bp, Homo sapiens
aaagtttcccctctattttggt

SEQ ID NO: 5472474 - DNA, 18 bp, Homo sapiens
aaagtttcctaggatgtc

SEQ ID NO: 5472475 - DNA, 18 bp, Homo sapiens
aaagtttctagaatttta

SEQ ID NO: 5472476 - DNA, 21 bp, Homo sapiens
aaagtttctcttttcaaaaca

SEQ ID NO: 5472477 - DNA, 22 bp, Homo sapiens
aaagtttgatcttcctctgcta

SEQ ID NO: 5472478 - DNA, 13 bp, Homo sapiens
aaagtttgccaga

SEQ ID NO: 5472479 - DNA, 15 bp, Homo sapiens
aaagtttgcttagaa

SEQ ID NO: 5472480 - DNA, 22 bp, Homo sapiens
aaagtttgcttgtttcttggtc

SEQ ID NO: 5472481 - DNA, 22 bp, Homo sapiens
aaagtttgtaagaaaatgttca

SEQ ID NO: 5472482 - DNA, 17 bp, Homo sapiens
aaagtttgtagcatttt

SEQ ID NO: 5472483 - DNA, 22 bp, Homo sapiens
aaagtttgtagcatttttctaa

SEQ ID NO: 5472484 - DNA, 19 bp, Homo sapiens
aaagtttgttactttgaat

SEQ ID NO: 5472485 - DNA, 21 bp, Homo sapiens
aaagtttgttactttgaatag

SEQ ID NO: 5472486 - DNA, 23 bp, Homo sapiens
aaagtttgttactttgaatagtc

SEQ ID NO: 5472487 - DNA, 15 bp, Homo sapiens
aaagtttgttcactt

SEQ ID NO: 5472488 - DNA, 16 bp, Homo sapiens
aaagtttgttgaaaca

SEQ ID NO: 5472489 - DNA, 16 bp, Homo sapiens
aaagttttacaaaggg

SEQ ID NO: 5472490 - DNA, 13 bp, Homo sapiens
aaagttttacaga

SEQ ID NO: 5472491 - DNA, 15 bp, Homo sapiens
aaagttttacagaga

SEQ ID NO: 5472492 - DNA, 13 bp, Homo sapiens
aaagttttatata

SEQ ID NO: 5472493 - DNA, 14 bp, Homo sapiens
aaagttttatatat

SEQ ID NO: 5472494 - DNA, 15 bp, Homo sapiens
aaagttttatatatt

SEQ ID NO: 5472495 - DNA, 17 bp, Homo sapiens
aaagttttatatattat

SEQ ID NO: 5472496 - DNA, 21 bp, Homo sapiens
aaagttttatatattatatgg

SEQ ID NO: 5472497 - DNA, 22 bp, Homo sapiens
aaagttttatatattatatgga

SEQ ID NO: 5472498 - DNA, 13 bp, Homo sapiens
aaagttttattat

SEQ ID NO: 5472499 - DNA, 21 bp, Homo sapiens
aaagttttattataaattcta

SEQ ID NO: 5472500 - DNA, 17 bp, Homo sapiens
aaagttttcaaattatt

SEQ ID NO: 5472501 - DNA, 12 bp, Homo sapiens
aaagttttcaga

SEQ ID NO: 5472502 - DNA, 16 bp, Homo sapiens
aaagttttccagtatt

SEQ ID NO: 5472503 - DNA, 21 bp, Homo sapiens
aaagttttccatttttgtcag

SEQ ID NO: 5472504 - DNA, 15 bp, Homo sapiens
aaagttttcccttga

SEQ ID NO: 5472505 - DNA, 12 bp, Homo sapiens
aaagttttcctt

SEQ ID NO: 5472506 - DNA, 13 bp, Homo sapiens
aaagttttgaaaa

SEQ ID NO: 5472507 - DNA, 14 bp, Homo sapiens
aaagttttgaaaag

SEQ ID NO: 5472508 - DNA, 16 bp, Homo sapiens
aaagttttgaaaagct

SEQ ID NO: 5472509 - DNA, 17 bp, Homo sapiens
aaagttttgaaggaaac

SEQ ID NO: 5472510 - DNA, 22 bp, Homo sapiens
aaagttttgagataagttttgt

SEQ ID NO: 5472511 - DNA, 22 bp, Homo sapiens
aaagttttgagtagatattact

SEQ ID NO: 5472512 - DNA, 13 bp, Homo sapiens
aaagttttgcaac

SEQ ID NO: 5472513 - DNA, 16 bp, Homo sapiens
aaagttttgtaaaaga

SEQ ID NO: 5472514 - DNA, 15 bp, Homo sapiens
aaagttttgttctgt

SEQ ID NO: 5472515 - DNA, 17 bp, Homo sapiens
aaagttttgttctgtat

SEQ ID NO: 5472516 - DNA, 21 bp, Homo sapiens
aaagtttttaattcatatttt

SEQ ID NO: 5472517 - DNA, 17 bp, Homo sapiens
aaagtttttaatttgat

SEQ ID NO: 5472518 - DNA, 14 bp, Homo sapiens
aaagtttttagaat

SEQ ID NO: 5472519 - DNA, 14 bp, Homo sapiens
aaagtttttgtttg

SEQ ID NO: 5472520 - DNA, 18 bp, Homo sapiens
aaagttttttatatatga

SEQ ID NO: 5472521 - DNA, 22 bp, Homo sapiens
aaagttttttattatgcattat

SEQ ID NO: 5472522 - DNA, 18 bp, Homo sapiens
aaagtttttttatttctt

SEQ ID NO: 5472523 - DNA, 19 bp, Homo sapiens
aaataaaaaaaaaaaagag

SEQ ID NO: 5472524 - DNA, 15 bp, Homo sapiens
aaataaaaaaaaaac

SEQ ID NO: 5472525 - DNA, 15 bp, Homo sapiens
aaataaaaaagatcc

SEQ ID NO: 5472526 - DNA, 16 bp, Homo sapiens
aaataaaaaagatccc

SEQ ID NO: 5472527 - DNA, 13 bp, Homo sapiens
aaataaaaacaaa

SEQ ID NO: 5472528 - DNA, 20 bp, Homo sapiens
aaataaaaaccagaatcata

SEQ ID NO: 5472529 - DNA, 23 bp, Homo sapiens
aaataaaaactaaattgtaaact

SEQ ID NO: 5472530 - DNA, 13 bp, Homo sapiens
aaataaaaactat

SEQ ID NO: 5472531 - DNA, 16 bp, Homo sapiens
aaataaaaacttattt

SEQ ID NO: 5472532 - DNA, 20 bp, Homo sapiens
aaataaaaagaaaggctgtt

SEQ ID NO: 5472533 - DNA, 17 bp, Homo sapiens
aaataaaaagtaactga

SEQ ID NO: 5472534 - DNA, 19 bp, Homo sapiens
aaataaaaagtatgttgta

SEQ ID NO: 5472535 - DNA, 19 bp, Homo sapiens
aaataaaaagtgacacagc

SEQ ID NO: 5472536 - DNA, 20 bp, Homo sapiens
aaataaaaagtgacacagca

SEQ ID NO: 5472537 - DNA, 16 bp, Homo sapiens
aaataaaaataaattc

SEQ ID NO: 5472538 - DNA, 17 bp, Homo sapiens
aaataaaaataagtcat

SEQ ID NO: 5472539 - DNA, 17 bp, Homo sapiens
aaataaaaatatgtaat

SEQ ID NO: 5472540 - DNA, 20 bp, Homo sapiens
aaataaaaatattgtgttgt

SEQ ID NO: 5472541 - DNA, 22 bp, Homo sapiens
aaataaaaatcaacttgtgtac

SEQ ID NO: 5472542 - DNA, 14 bp, Homo sapiens
aaataaaaatggca

SEQ ID NO: 5472543 - DNA, 23 bp, Homo sapiens
aaataaaaattattattgatttt

SEQ ID NO: 5472544 - DNA, 12 bp, Homo sapiens
aaataaaacaag

SEQ ID NO: 5472545 - DNA, 14 bp, Homo sapiens
aaataaaacaagcc

SEQ ID NO: 5472546 - DNA, 16 bp, Homo sapiens
aaataaaacaagcctt

SEQ ID NO: 5472547 - DNA, 18 bp, Homo sapiens
aaataaaacacacctcgt

SEQ ID NO: 5472548 - DNA, 17 bp, Homo sapiens
aaataaaaccagaaaga

SEQ ID NO: 5472549 - DNA, 22 bp, Homo sapiens
aaataaaaccagaaagaggaat

SEQ ID NO: 5472550 - DNA, 14 bp, Homo sapiens
aaataaaaccagct

SEQ ID NO: 5472551 - DNA, 16 bp, Homo sapiens
aaataaaacctcagct

SEQ ID NO: 5472552 - DNA, 14 bp, Homo sapiens
aaataaaacctttc

SEQ ID NO: 5472553 - DNA, 14 bp, Homo sapiens
aaataaaactgaat

SEQ ID NO: 5472554 - DNA, 12 bp, Homo sapiens
aaataaaactgt

SEQ ID NO: 5472555 - DNA, 22 bp, Homo sapiens
aaataaaactttccaaatattt

SEQ ID NO: 5472556 - DNA, 21 bp, Homo sapiens
aaataaaagaacacattagat

SEQ ID NO: 5472557 - DNA, 18 bp, Homo sapiens
aaataaaagaggtccatt

SEQ ID NO: 5472558 - DNA, 14 bp, Homo sapiens
agacaatacagtaa

SEQ ID NO: 5472559 - DNA, 17 bp, Homo sapiens
agacaatacgtttgata

SEQ ID NO: 5472560 - DNA, 13 bp, Homo sapiens
agacaatagtatt

SEQ ID NO: 5472561 - DNA, 20 bp, Homo sapiens
agacaatagtatttctcctt

SEQ ID NO: 5472562 - DNA, 13 bp, Homo sapiens
agacaatatacaa

SEQ ID NO: 5472563 - DNA, 15 bp, Homo sapiens
agacaatcactgcca

SEQ ID NO: 5472564 - DNA, 15 bp, Homo sapiens
agacaatcattgttt

SEQ ID NO: 5472565 - DNA, 22 bp, Homo sapiens
agacaatcattgttttgaatat

SEQ ID NO: 5472566 - DNA, 15 bp, Homo sapiens
agacaatccactctc

SEQ ID NO: 5472567 - DNA, 20 bp, Homo sapiens
agacaatccactctcaggag

SEQ ID NO: 5472568 - DNA, 20 bp, Homo sapiens
agacaatccccacataccat

SEQ ID NO: 5472569 - DNA, 15 bp, Homo sapiens
agacaatcttctgtt

SEQ ID NO: 5472570 - DNA, 19 bp, Homo sapiens
agacaatgacttactgtac

SEQ ID NO: 5472571 - DNA, 20 bp, Homo sapiens
agacaatgatttggccaggc

SEQ ID NO: 5472572 - DNA, 21 bp, Homo sapiens
agacaatgatttggccaggcc

SEQ ID NO: 5472573 - DNA, 20 bp, Homo sapiens
agacaatgcacctagctgtg

SEQ ID NO: 5472574 - DNA, 22 bp, Homo sapiens
agacaatgcagatgccagagca

SEQ ID NO: 5472575 - DNA, 20 bp, Homo sapiens
agacaatgctgctttggtta

SEQ ID NO: 5472576 - DNA, 13 bp, Homo sapiens
agacaatgtctgc

SEQ ID NO: 5472577 - DNA, 20 bp, Homo sapiens
agacaatgtggaattacata

SEQ ID NO: 5472578 - DNA, 21 bp, Homo sapiens
agacaatgtggaattacataa

SEQ ID NO: 5472579 - DNA, 17 bp, Homo sapiens
agacaatgttttcttca

SEQ ID NO: 5472580 - DNA, 12 bp, Homo sapiens
agacaattacaa

SEQ ID NO: 5472581 - DNA, 14 bp, Homo sapiens
agacaattcagaag

SEQ ID NO: 5472582 - DNA, 15 bp, Homo sapiens
agacaattcctccag

SEQ ID NO: 5472583 - DNA, 18 bp, Homo sapiens
agacaattcctccagaga

SEQ ID NO: 5472584 - DNA, 12 bp, Homo sapiens
agacaattctaa

SEQ ID NO: 5472585 - DNA, 13 bp, Homo sapiens
agacaattctaat

SEQ ID NO: 5472586 - DNA, 19 bp, Homo sapiens
agacaattctaatggtaac

SEQ ID NO: 5472587 - DNA, 21 bp, Homo sapiens
agacaatttattatggcacat

SEQ ID NO: 5472588 - DNA, 22 bp, Homo sapiens
agacaatttgatacataataaa

SEQ ID NO: 5472589 - DNA, 16 bp, Homo sapiens
agacaatttgccttag

SEQ ID NO: 5472590 - DNA, 21 bp, Homo sapiens
agacaattttttttcaaatgt

SEQ ID NO: 5472591 - DNA, 20 bp, Homo sapiens
agacacaaacaaacaagcta

SEQ ID NO: 5472592 - DNA, 18 bp, Homo sapiens
agacacaacaactcctag

SEQ ID NO: 5472593 - DNA, 20 bp, Homo sapiens
agacacaactatttttccaa

SEQ ID NO: 5472594 - DNA, 14 bp, Homo sapiens
agacacaagccttc

SEQ ID NO: 5472595 - DNA, 22 bp, Homo sapiens
agacacaaggtgatttcagact

SEQ ID NO: 5472596 - DNA, 15 bp, Homo sapiens
agacacaattagaga

SEQ ID NO: 5472597 - DNA, 17 bp, Homo sapiens
agacacacaacatcaag

SEQ ID NO: 5472598 - DNA, 21 bp, Homo sapiens
agacacacaagcagacacaca

SEQ ID NO: 5472599 - DNA, 23 bp, Homo sapiens
agacacacaattcattggctcct

SEQ ID NO: 5472600 - DNA, 12 bp, Homo sapiens
agacacacacac

SEQ ID NO: 5472601 - DNA, 14 bp, Homo sapiens
agacacacacacac

SEQ ID NO: 5472602 - DNA, 15 bp, Homo sapiens
agacacacacacaca

SEQ ID NO: 5472603 - DNA, 22 bp, Homo sapiens
agacacacacacacacacacat

SEQ ID NO: 5472604 - DNA, 20 bp, Homo sapiens
agacacacacacgcacgcac

SEQ ID NO: 5472605 - DNA, 14 bp, Homo sapiens
agacacacacatat

SEQ ID NO: 5472606 - DNA, 20 bp, Homo sapiens
agacacacacatatatacat

SEQ ID NO: 5472607 - DNA, 18 bp, Homo sapiens
agacacacagcctttctg

SEQ ID NO: 5472608 - DNA, 17 bp, Homo sapiens
agacacacatatacatt

SEQ ID NO: 5472609 - DNA, 21 bp, Homo sapiens
agacacacatgggcagcccaa

SEQ ID NO: 5472610 - DNA, 16 bp, Homo sapiens
agacacaccccccagt

SEQ ID NO: 5472611 - DNA, 18 bp, Homo sapiens
agacacacgcacacacac

SEQ ID NO: 5472612 - DNA, 20 bp, Homo sapiens
agacacactatcatagttaa

SEQ ID NO: 5472613 - DNA, 16 bp, Homo sapiens
agacacactgaagaag

SEQ ID NO: 5472614 - DNA, 17 bp, Homo sapiens
agacacactgaagaagc

SEQ ID NO: 5472615 - DNA, 16 bp, Homo sapiens
agacacacttaactac

SEQ ID NO: 5472616 - DNA, 19 bp, Homo sapiens
agacacagaatagtttaca

SEQ ID NO: 5472617 - DNA, 21 bp, Homo sapiens
agacacagaatagtttacaca

SEQ ID NO: 5472618 - DNA, 12 bp, Homo sapiens
agacacagactg

SEQ ID NO: 5472619 - DNA, 20 bp, Homo sapiens
agacacagactggcaataaa

SEQ ID NO: 5472620 - DNA, 22 bp, Homo sapiens
agacacagagtggagccctcag

SEQ ID NO: 5472621 - DNA, 13 bp, Homo sapiens
agacacagataca

SEQ ID NO: 5472622 - DNA, 12 bp, Homo sapiens
agacacagatgt

SEQ ID NO: 5472623 - DNA, 13 bp, Homo sapiens
agacacagatgtt

SEQ ID NO: 5472624 - DNA, 21 bp, Homo sapiens
agacacagatttttacactaa

SEQ ID NO: 5472625 - DNA, 20 bp, Homo sapiens
agacacagcccagagactga

SEQ ID NO: 5472626 - DNA, 13 bp, Homo sapiens
agacacagcctcc

SEQ ID NO: 5472627 - DNA, 16 bp, Homo sapiens
agacacaggaaaaata

SEQ ID NO: 5472628 - DNA, 18 bp, Homo sapiens
agacacaggaaaaataaa

SEQ ID NO: 5472629 - DNA, 15 bp, Homo sapiens
agacacaggaaacaa

SEQ ID NO: 5472630 - DNA, 13 bp, Homo sapiens
agacacaggatga

SEQ ID NO: 5472631 - DNA, 13 bp, Homo sapiens
agacacaggcccg

SEQ ID NO: 5472632 - DNA, 14 bp, Homo sapiens
agacacaggccgtg

SEQ ID NO: 5472633 - DNA, 15 bp, Homo sapiens
agacacagggacttg

SEQ ID NO: 5472634 - DNA, 22 bp, Homo sapiens
agacacagggacttgaagttgt

SEQ ID NO: 5472635 - DNA, 15 bp, Homo sapiens
agacacagggcatcc

SEQ ID NO: 5472636 - DNA, 19 bp, Homo sapiens
agacacagtattgacttct

SEQ ID NO: 5472637 - DNA, 16 bp, Homo sapiens
agacacatactcattt

SEQ ID NO: 5472638 - DNA, 19 bp, Homo sapiens
agacacatgaaggtaaata

SEQ ID NO: 5472639 - DNA, 16 bp, Homo sapiens
agacacatgctatgtt

SEQ ID NO: 5472640 - DNA, 16 bp, Homo sapiens
agacacatgggcttgt

SEQ ID NO: 5472641 - DNA, 16 bp, Homo sapiens
agacacatgtccaaga

SEQ ID NO: 5472642 - DNA, 20 bp, Homo sapiens
agacacatgtccaagaagcc

SEQ ID NO: 5472643 - DNA, 24 bp, Homo sapiens
agacacatgtccaagaagcccagg

SEQ ID NO: 5472644 - DNA, 20 bp, Homo sapiens
agacacatgtggagaaggtg

SEQ ID NO: 5472645 - DNA, 18 bp, Homo sapiens
agacacattatcttctgg

SEQ ID NO: 5472646 - DNA, 23 bp, Homo sapiens
agacacattcctagttccccgtg

SEQ ID NO: 5472647 - DNA, 15 bp, Homo sapiens
agacacattgccttc

SEQ ID NO: 5472648 - DNA, 16 bp, Homo sapiens
agacacattgccttct

SEQ ID NO: 5472649 - DNA, 21 bp, Homo sapiens
agacacattgccttctggagc

SEQ ID NO: 5472650 - DNA, 17 bp, Homo sapiens
agacacattttttagga

SEQ ID NO: 5472651 - DNA, 20 bp, Homo sapiens
agacacattttttaggaaat

SEQ ID NO: 5472652 - DNA, 16 bp, Homo sapiens
agacaccaaagttcta

SEQ ID NO: 5472653 - DNA, 14 bp, Homo sapiens
agacaccacagacg

SEQ ID NO: 5472654 - DNA, 17 bp, Homo sapiens
agacaccacagacgcca

SEQ ID NO: 5472655 - DNA, 15 bp, Homo sapiens
agacaccacagcctc

SEQ ID NO: 5472656 - DNA, 21 bp, Homo sapiens
agacaccacagcctccccttc

SEQ ID NO: 5472657 - DNA, 14 bp, Homo sapiens
agacaccacctgga

SEQ ID NO: 5472658 - DNA, 17 bp, Homo sapiens
agacaccacctggagtg

SEQ ID NO: 5472659 - DNA, 18 bp, Homo sapiens
agacaccagagtgtatgc

SEQ ID NO: 5472660 - DNA, 16 bp, Homo sapiens
agacaccattcattcc

SEQ ID NO: 5472661 - DNA, 18 bp, Homo sapiens
agacacccaagtccaggc

SEQ ID NO: 5472662 - DNA, 13 bp, Homo sapiens
agacacccaggac

SEQ ID NO: 5472663 - DNA, 15 bp, Homo sapiens
agacaccctaactct

SEQ ID NO: 5472664 - DNA, 19 bp, Homo sapiens
agacaccctaactcttgct

SEQ ID NO: 5472665 - DNA, 23 bp, Homo sapiens
agacaccctaactcttgctcact

SEQ ID NO: 5472666 - DNA, 13 bp, Homo sapiens
agacaccctctgg

SEQ ID NO: 5472667 - DNA, 18 bp, Homo sapiens
agacacccttggagctct

SEQ ID NO: 5472668 - DNA, 16 bp, Homo sapiens
agacaccgtggacagc

SEQ ID NO: 5472669 - DNA, 14 bp, Homo sapiens
agacacctcagagc

SEQ ID NO: 5472670 - DNA, 21 bp, Homo sapiens
agacacctccccctacccata

SEQ ID NO: 5472671 - DNA, 22 bp, Homo sapiens
agacacctccccctacccatat

SEQ ID NO: 5472672 - DNA, 17 bp, Homo sapiens
agacacctgcacctccc

SEQ ID NO: 5472673 - DNA, 14 bp, Homo sapiens
agacacctggactg

SEQ ID NO: 5472674 - DNA, 17 bp, Homo sapiens
agacacctggactgagc

SEQ ID NO: 5472675 - DNA, 20 bp, Homo sapiens
agacacctggactgagccaa

SEQ ID NO: 5472676 - DNA, 16 bp, Homo sapiens
agacacctgtgcaccc

SEQ ID NO: 5472677 - DNA, 17 bp, Homo sapiens
agacacctgttcacaga

SEQ ID NO: 5472678 - DNA, 21 bp, Homo sapiens
agacacctgttcacagaaaaa

SEQ ID NO: 5472679 - DNA, 21 bp, Homo sapiens
agacaccttcattttgagggg

SEQ ID NO: 5472680 - DNA, 22 bp, Homo sapiens
agacaccttggacatcctcctc

SEQ ID NO: 5472681 - DNA, 21 bp, Homo sapiens
agacaccttttgtatttaaaa

SEQ ID NO: 5472682 - DNA, 17 bp, Homo sapiens
agacacgacagcacaca

SEQ ID NO: 5472683 - DNA, 21 bp, Homo sapiens
agacacgacagcacacacagt

SEQ ID NO: 5472684 - DNA, 21 bp, Homo sapiens
agacacgattgagaactgaca

SEQ ID NO: 5472685 - DNA, 14 bp, Homo sapiens
agacacgcacttct

SEQ ID NO: 5472686 - DNA, 18 bp, Homo sapiens
agacacgcacttctgggg

SEQ ID NO: 5472687 - DNA, 18 bp, Homo sapiens
agacacgccttcccctca

SEQ ID NO: 5472688 - DNA, 21 bp, Homo sapiens
agacacgctcgcgggcagcgg

SEQ ID NO: 5472689 - DNA, 23 bp, Homo sapiens
agacacgctcgcgggcagcgggc

SEQ ID NO: 5472690 - DNA, 15 bp, Homo sapiens
agacacggatctgag

SEQ ID NO: 5472691 - DNA, 18 bp, Homo sapiens
agacacggatctgagaat

SEQ ID NO: 5472692 - DNA, 20 bp, Homo sapiens
agacacggatctgagaatct

SEQ ID NO: 5472693 - DNA, 17 bp, Homo sapiens
agacacgtggcctcgtg

SEQ ID NO: 5472694 - DNA, 20 bp, Homo sapiens
agacactaattccttaaatg

SEQ ID NO: 5472695 - DNA, 16 bp, Homo sapiens
agacactacagaggat

SEQ ID NO: 5472696 - DNA, 20 bp, Homo sapiens
agacactagtagagcaaaga

SEQ ID NO: 5472697 - DNA, 14 bp, Homo sapiens
agacactcaagagc

SEQ ID NO: 5472698 - DNA, 21 bp, Homo sapiens
agacactccagtttgcccacc

SEQ ID NO: 5472699 - DNA, 17 bp, Homo sapiens
agacactcccagggaca

SEQ ID NO: 5472700 - DNA, 20 bp, Homo sapiens
agacactcctggggggcctg

SEQ ID NO: 5472701 - DNA, 16 bp, Homo sapiens
agacactccttgaaat

SEQ ID NO: 5472702 - DNA, 15 bp, Homo sapiens
agacactctgacaag

SEQ ID NO: 5472703 - DNA, 17 bp, Homo sapiens
agacactctgacaagct

SEQ ID NO: 5472704 - DNA, 23 bp, Homo sapiens
agacactctgacaagctggccaa

SEQ ID NO: 5472705 - DNA, 12 bp, Homo sapiens
agacactctgct

SEQ ID NO: 5472706 - DNA, 20 bp, Homo sapiens
agacactgaaatatacacac

SEQ ID NO: 5472707 - DNA, 16 bp, Homo sapiens
agacactgaaggcaaa

SEQ ID NO: 5472708 - DNA, 17 bp, Homo sapiens
agacactgaaggcaaat

SEQ ID NO: 5472709 - DNA, 13 bp, Homo sapiens
agacactgagcca

SEQ ID NO: 5472710 - DNA, 23 bp, Homo sapiens
agacactgccgacatcagcattg

SEQ ID NO: 5472711 - DNA, 15 bp, Homo sapiens
agacactgcctgggc

SEQ ID NO: 5472712 - DNA, 13 bp, Homo sapiens
agacactggcccc

SEQ ID NO: 5472713 - DNA, 15 bp, Homo sapiens
agacactggcccctc

SEQ ID NO: 5472714 - DNA, 20 bp, Homo sapiens
agacactggctgccagctat

SEQ ID NO: 5472715 - DNA, 16 bp, Homo sapiens
agacactgggagaaga

SEQ ID NO: 5472716 - DNA, 19 bp, Homo sapiens
agacactggtctcagagga

SEQ ID NO: 5472717 - DNA, 20 bp, Homo sapiens
agacactggtttacacttta

SEQ ID NO: 5472718 - DNA, 13 bp, Homo sapiens
agacactgtcaag

SEQ ID NO: 5472719 - DNA, 22 bp, Homo sapiens
agacactgtctctaccaaaaaa

SEQ ID NO: 5472720 - DNA, 16 bp, Homo sapiens
agacactgtgcaggcc

SEQ ID NO: 5472721 - DNA, 18 bp, Homo sapiens
agacactgtttacaagaa

SEQ ID NO: 5472722 - DNA, 14 bp, Homo sapiens
agacacttatttat

SEQ ID NO: 5472723 - DNA, 15 bp, Homo sapiens
agacacttcagatct

SEQ ID NO: 5472724 - DNA, 16 bp, Homo sapiens
agacactttacctctt

SEQ ID NO: 5472725 - DNA, 12 bp, Homo sapiens
agacagaaaagt

SEQ ID NO: 5472726 - DNA, 18 bp, Homo sapiens
agacagaaaagtgcctga

SEQ ID NO: 5472727 - DNA, 18 bp, Homo sapiens
agacagaaacagagagag

SEQ ID NO: 5472728 - DNA, 23 bp, Homo sapiens
agacagaaacagagagagacaga

SEQ ID NO: 5472729 - DNA, 18 bp, Homo sapiens
agacagaaactggattaa

SEQ ID NO: 5472730 - DNA, 12 bp, Homo sapiens
agacagaaagcc

SEQ ID NO: 5472731 - DNA, 17 bp, Homo sapiens
agacagaagaaacaagg

SEQ ID NO: 5472732 - DNA, 22 bp, Homo sapiens
agacagaagagaaggaagccat

SEQ ID NO: 5472733 - DNA, 12 bp, Homo sapiens
agacagaaggca

SEQ ID NO: 5472734 - DNA, 12 bp, Homo sapiens
agacagaagtgt

SEQ ID NO: 5472735 - DNA, 12 bp, Homo sapiens
agacagaatctc

SEQ ID NO: 5472736 - DNA, 14 bp, Homo sapiens
agacccctctggcc

SEQ ID NO: 5472737 - DNA, 18 bp, Homo sapiens
agacccctgcctggactt

SEQ ID NO: 5472738 - DNA, 16 bp, Homo sapiens
agacccctggcctccg

SEQ ID NO: 5472739 - DNA, 14 bp, Homo sapiens
agacccctggggga

SEQ ID NO: 5472740 - DNA, 19 bp, Homo sapiens
agaccccttcctttcctct

SEQ ID NO: 5472741 - DNA, 13 bp, Homo sapiens
agaccccttgttg

SEQ ID NO: 5472742 - DNA, 20 bp, Homo sapiens
agaccccttgttgcactgcc

SEQ ID NO: 5472743 - DNA, 13 bp, Homo sapiens
agacccctttgag

SEQ ID NO: 5472744 - DNA, 15 bp, Homo sapiens
agacccgggaaggaa

SEQ ID NO: 5472745 - DNA, 21 bp, Homo sapiens
agacccgggaaggaaggctct

SEQ ID NO: 5472746 - DNA, 22 bp, Homo sapiens
agacccggttattcgcccaccc

SEQ ID NO: 5472747 - DNA, 18 bp, Homo sapiens
agacccgtgacctgagat

SEQ ID NO: 5472748 - DNA, 17 bp, Homo sapiens
agaccctaaacatccat

SEQ ID NO: 5472749 - DNA, 16 bp, Homo sapiens
agaccctaccccacca

SEQ ID NO: 5472750 - DNA, 18 bp, Homo sapiens
agaccctaccccaccacg

SEQ ID NO: 5472751 - DNA, 20 bp, Homo sapiens
agaccctactgaagtggctg

SEQ ID NO: 5472752 - DNA, 16 bp, Homo sapiens
agaccctaggtgctca

SEQ ID NO: 5472753 - DNA, 18 bp, Homo sapiens
agaccctaggtgctcata

SEQ ID NO: 5472754 - DNA, 18 bp, Homo sapiens
agaccctcatgctgccaa

SEQ ID NO: 5472755 - DNA, 19 bp, Homo sapiens
agaccctcatgctgccaat

SEQ ID NO: 5472756 - DNA, 20 bp, Homo sapiens
agaccctcatgctgccaata

SEQ ID NO: 5472757 - DNA, 21 bp, Homo sapiens
agaccctcatgctgccaatat

SEQ ID NO: 5472758 - DNA, 14 bp, Homo sapiens
agaccctccccaca

SEQ ID NO: 5472759 - DNA, 16 bp, Homo sapiens
agaccctcccccacca

SEQ ID NO: 5472760 - DNA, 13 bp, Homo sapiens
agaccctcccctg

SEQ ID NO: 5472761 - DNA, 19 bp, Homo sapiens
agaccctcccctgcctccg

SEQ ID NO: 5472762 - DNA, 20 bp, Homo sapiens
agaccctccttccccacccc

SEQ ID NO: 5472763 - DNA, 13 bp, Homo sapiens
agaccctcgggcc

SEQ ID NO: 5472764 - DNA, 12 bp, Homo sapiens
agaccctctcaa

SEQ ID NO: 5472765 - DNA, 17 bp, Homo sapiens
agaccctctcaggctgt

SEQ ID NO: 5472766 - DNA, 16 bp, Homo sapiens
agaccctctgccacca

SEQ ID NO: 5472767 - DNA, 17 bp, Homo sapiens
agaccctctgccaccag

SEQ ID NO: 5472768 - DNA, 13 bp, Homo sapiens
agaccctcttctc

SEQ ID NO: 5472769 - DNA, 14 bp, Homo sapiens
agaccctcttctct

SEQ ID NO: 5472770 - DNA, 14 bp, Homo sapiens
agaccctcttgccc

SEQ ID NO: 5472771 - DNA, 17 bp, Homo sapiens
agaccctgaagatttca

SEQ ID NO: 5472772 - DNA, 19 bp, Homo sapiens
agaccctgatgcaggtcag

SEQ ID NO: 5472773 - DNA, 17 bp, Homo sapiens
agaccctgcccacccca

SEQ ID NO: 5472774 - DNA, 22 bp, Homo sapiens
agaccctgcccaccccatccct

SEQ ID NO: 5472775 - DNA, 23 bp, Homo sapiens
agaccctgcccaccccatccctg

SEQ ID NO: 5472776 - DNA, 19 bp, Homo sapiens
agaccctgccccctgccag

SEQ ID NO: 5472777 - DNA, 21 bp, Homo sapiens
agaccctgccccctgccagcc

SEQ ID NO: 5472778 - DNA, 19 bp, Homo sapiens
agaccctgccctgtgggcc

SEQ ID NO: 5472779 - DNA, 15 bp, Homo sapiens
agaccctgcgcccct

SEQ ID NO: 5472780 - DNA, 22 bp, Homo sapiens
agaccctgcttaggatggggga

SEQ ID NO: 5472781 - DNA, 20 bp, Homo sapiens
agaccctggaattcagcacc

SEQ ID NO: 5472782 - DNA, 12 bp, Homo sapiens
agaccctggagg

SEQ ID NO: 5472783 - DNA, 13 bp, Homo sapiens
agaccctgggaga

SEQ ID NO: 5472784 - DNA, 12 bp, Homo sapiens
agaccctgggca

SEQ ID NO: 5472785 - DNA, 21 bp, Homo sapiens
agaccctgggcaaacagagct

SEQ ID NO: 5472786 - DNA, 20 bp, Homo sapiens
agaccctgggtgggctctgt

SEQ ID NO: 5472787 - DNA, 14 bp, Homo sapiens
agaccctggtgcct

SEQ ID NO: 5472788 - DNA, 22 bp, Homo sapiens
agaccctgtctcaaagcataaa

SEQ ID NO: 5472789 - DNA, 13 bp, Homo sapiens
agaccctgtctct

SEQ ID NO: 5472790 - DNA, 13 bp, Homo sapiens
agaccctgtcttt

SEQ ID NO: 5472791 - DNA, 24 bp, Homo sapiens
agaccctgtgtcctccaccatgca

SEQ ID NO: 5472792 - DNA, 14 bp, Homo sapiens
agaccctgtgttca

SEQ ID NO: 5472793 - DNA, 22 bp, Homo sapiens
agacccttattgctgtcctgga

SEQ ID NO: 5472794 - DNA, 15 bp, Homo sapiens
agacccttcttgcct

SEQ ID NO: 5472795 - DNA, 20 bp, Homo sapiens
agacccttcttgcctgctgg

SEQ ID NO: 5472796 - DNA, 15 bp, Homo sapiens
agacccttgaagatg

SEQ ID NO: 5472797 - DNA, 17 bp, Homo sapiens
agacccttgcattagaa

SEQ ID NO: 5472798 - DNA, 22 bp, Homo sapiens
agacccttgtggtcccacccca

SEQ ID NO: 5472799 - DNA, 23 bp, Homo sapiens
agacccttgtggtcccaccccac

SEQ ID NO: 5472800 - DNA, 14 bp, Homo sapiens
agaccctttcagaa

SEQ ID NO: 5472801 - DNA, 16 bp, Homo sapiens
agaccctttgtctctg

SEQ ID NO: 5472802 - DNA, 15 bp, Homo sapiens
agaccctttgttgaa

SEQ ID NO: 5472803 - DNA, 19 bp, Homo sapiens
agacccttttgggtttctg

SEQ ID NO: 5472804 - DNA, 17 bp, Homo sapiens
agaccgaactgttgtat

SEQ ID NO: 5472805 - DNA, 14 bp, Homo sapiens
agaccgaattttat

SEQ ID NO: 5472806 - DNA, 15 bp, Homo sapiens
agaccgagaggccag

SEQ ID NO: 5472807 - DNA, 16 bp, Homo sapiens
agaccgagaggccagt

SEQ ID NO: 5472808 - DNA, 23 bp, Homo sapiens
agaccgagtgtggagctgcttcc

SEQ ID NO: 5472809 - DNA, 14 bp, Homo sapiens
agaccgatccttcc

SEQ ID NO: 5472810 - DNA, 15 bp, Homo sapiens
agaccgatcggcggc

SEQ ID NO: 5472811 - DNA, 12 bp, Homo sapiens
agaccgccccag

SEQ ID NO: 5472812 - DNA, 14 bp, Homo sapiens
agaccgccctggct

SEQ ID NO: 5472813 - DNA, 19 bp, Homo sapiens
agaccgcgcccctgggact

SEQ ID NO: 5472814 - DNA, 21 bp, Homo sapiens
agaccgcgcccctgggactaa

SEQ ID NO: 5472815 - DNA, 17 bp, Homo sapiens
agaccgctctcttttct

SEQ ID NO: 5472816 - DNA, 22 bp, Homo sapiens
agaccgctctcttttctgtact

SEQ ID NO: 5472817 - DNA, 20 bp, Homo sapiens
agaccggaattgagaggtgg

SEQ ID NO: 5472818 - DNA, 17 bp, Homo sapiens
agaccggcctgccagga

SEQ ID NO: 5472819 - DNA, 18 bp, Homo sapiens
agaccggcctgccaggag

SEQ ID NO: 5472820 - DNA, 14 bp, Homo sapiens
agaccgggggccag

SEQ ID NO: 5472821 - DNA, 15 bp, Homo sapiens
agaccgggggccaga

SEQ ID NO: 5472822 - DNA, 14 bp, Homo sapiens
agaccggggtggag

SEQ ID NO: 5472823 - DNA, 23 bp, Homo sapiens
agaccggggtggagtcagggctg

SEQ ID NO: 5472824 - DNA, 23 bp, Homo sapiens
agaccggggttcccgtgtgcctg

SEQ ID NO: 5472825 - DNA, 14 bp, Homo sapiens
agaccgtcctcacc

SEQ ID NO: 5472826 - DNA, 20 bp, Homo sapiens
agaccgtcctcacccctgtc

SEQ ID NO: 5472827 - DNA, 18 bp, Homo sapiens
agaccgtcgggggctgag

SEQ ID NO: 5472828 - DNA, 23 bp, Homo sapiens
agaccgtcgggggctgaggggca

SEQ ID NO: 5472829 - DNA, 13 bp, Homo sapiens
agaccgtcttcct

SEQ ID NO: 5472830 - DNA, 20 bp, Homo sapiens
agaccgtggtgtcctctgtc

SEQ ID NO: 5472831 - DNA, 21 bp, Homo sapiens
agaccgtggtgtcctctgtcc

SEQ ID NO: 5472832 - DNA, 18 bp, Homo sapiens
agaccgtttacctagaag

SEQ ID NO: 5472833 - DNA, 21 bp, Homo sapiens
agaccgtttacctagaagaag

SEQ ID NO: 5472834 - DNA, 20 bp, Homo sapiens
agacctaaatgacctcagca

SEQ ID NO: 5472835 - DNA, 16 bp, Homo sapiens
agacctaaccagggcc

SEQ ID NO: 5472836 - DNA, 14 bp, Homo sapiens
agacctaaggcaga

SEQ ID NO: 5472837 - DNA, 16 bp, Homo sapiens
agacctaaggcagaca

SEQ ID NO: 5472838 - DNA, 18 bp, Homo sapiens
agacctaaggcagacagg

SEQ ID NO: 5472839 - DNA, 16 bp, Homo sapiens
agacctaatatcattt

SEQ ID NO: 5472840 - DNA, 20 bp, Homo sapiens
agacctaatatcattttatt

SEQ ID NO: 5472841 - DNA, 22 bp, Homo sapiens
agacctaatatcattttattca

SEQ ID NO: 5472842 - DNA, 19 bp, Homo sapiens
agacctaatctctgtaaag

SEQ ID NO: 5472843 - DNA, 18 bp, Homo sapiens
agacctaatgctccttgt

SEQ ID NO: 5472844 - DNA, 18 bp, Homo sapiens
agacctacagacctggct

SEQ ID NO: 5472845 - DNA, 16 bp, Homo sapiens
agacctacaggctgac

SEQ ID NO: 5472846 - DNA, 21 bp, Homo sapiens
agacctacagggggtctggct

SEQ ID NO: 5472847 - DNA, 15 bp, Homo sapiens
agacctacctcaggt

SEQ ID NO: 5472848 - DNA, 19 bp, Homo sapiens
agacctacctccagacttc

SEQ ID NO: 5472849 - DNA, 15 bp, Homo sapiens
agacctagacctggg

SEQ ID NO: 5472850 - DNA, 17 bp, Homo sapiens
agacctagacctgggcc

SEQ ID NO: 5472851 - DNA, 19 bp, Homo sapiens
agacctagacctgggccaa

SEQ ID NO: 5472852 - DNA, 18 bp, Homo sapiens
agacctagcaggctgttc

SEQ ID NO: 5472853 - DNA, 20 bp, Homo sapiens
agacctagcaggctgttcca

SEQ ID NO: 5472854 - DNA, 16 bp, Homo sapiens
agacctagctatgttg

SEQ ID NO: 5472855 - DNA, 18 bp, Homo sapiens
agacctagctatgttggc

SEQ ID NO: 5472856 - DNA, 15 bp, Homo sapiens
agacctagggaggac

SEQ ID NO: 5472857 - DNA, 19 bp, Homo sapiens
agacctattcctcctgggc

SEQ ID NO: 5472858 - DNA, 16 bp, Homo sapiens
agacctatttgacata

SEQ ID NO: 5472859 - DNA, 15 bp, Homo sapiens
agacctcaagccatc

SEQ ID NO: 5472860 - DNA, 14 bp, Homo sapiens
agacctcactgtca

SEQ ID NO: 5472861 - DNA, 17 bp, Homo sapiens
agacctcactgtcaggg

SEQ ID NO: 5472862 - DNA, 14 bp, Homo sapiens
agacctcagaagta

SEQ ID NO: 5472863 - DNA, 11 bp, Homo sapiens
agacctcagcc

SEQ ID NO: 5472864 - DNA, 18 bp, Homo sapiens
agacctcagccatgagga

SEQ ID NO: 5472865 - DNA, 12 bp, Homo sapiens
agacctcagcct

SEQ ID NO: 5472866 - DNA, 14 bp, Homo sapiens
agacctcagcctgt

SEQ ID NO: 5472867 - DNA, 15 bp, Homo sapiens
agacctcagcctgtg

SEQ ID NO: 5472868 - DNA, 16 bp, Homo sapiens
agacctcagcttggca

SEQ ID NO: 5472869 - DNA, 15 bp, Homo sapiens
agacctcagggcaca

SEQ ID NO: 5472870 - DNA, 18 bp, Homo sapiens
agacctcagtgccttcct

SEQ ID NO: 5472871 - DNA, 20 bp, Homo sapiens
agacctcagtgccttcctgt

SEQ ID NO: 5472872 - DNA, 16 bp, Homo sapiens
agacctcatcagcctt

SEQ ID NO: 5472873 - DNA, 21 bp, Homo sapiens
agacctcatcagccttgggat

SEQ ID NO: 5472874 - DNA, 16 bp, Homo sapiens
agacctcatcaggatg

SEQ ID NO: 5472875 - DNA, 17 bp, Homo sapiens
agacctcatcaggatga

SEQ ID NO: 5472876 - DNA, 13 bp, Homo sapiens
agacctcatcctg

SEQ ID NO: 5472877 - DNA, 22 bp, Homo sapiens
agacctcatctccaagatagca

SEQ ID NO: 5472878 - DNA, 17 bp, Homo sapiens
agacctcatctgcctgc

SEQ ID NO: 5472879 - DNA, 22 bp, Homo sapiens
agacctccactccacatctgca

SEQ ID NO: 5472880 - DNA, 13 bp, Homo sapiens
agacctccccacc

SEQ ID NO: 5472881 - DNA, 14 bp, Homo sapiens
agacctccccagcc

SEQ ID NO: 5472882 - DNA, 17 bp, Homo sapiens
agacctcccccagggag

SEQ ID NO: 5472883 - DNA, 16 bp, Homo sapiens
agacctccccctcact

SEQ ID NO: 5472884 - DNA, 20 bp, Homo sapiens
agacctcggctgtgtgggga

SEQ ID NO: 5472885 - DNA, 19 bp, Homo sapiens
agacctctatatttgctct

SEQ ID NO: 5472886 - DNA, 16 bp, Homo sapiens
agacctctcccaccca

SEQ ID NO: 5472887 - DNA, 22 bp, Homo sapiens
agacctctgaatgtcccagagg

SEQ ID NO: 5472888 - DNA, 17 bp, Homo sapiens
agacctctgagaccaaa

SEQ ID NO: 5472889 - DNA, 11 bp, Homo sapiens
agacctctgat

SEQ ID NO: 5472890 - DNA, 12 bp, Homo sapiens
agacctctgatc

SEQ ID NO: 5472891 - DNA, 13 bp, Homo sapiens
agacctctgatcc

SEQ ID NO: 5472892 - DNA, 19 bp, Homo sapiens
agacctctggttaatttat

SEQ ID NO: 5472893 - DNA, 23 bp, Homo sapiens
agacctctgtgaggaaagcacac

SEQ ID NO: 5472894 - DNA, 22 bp, Homo sapiens
agacctcttccctctgggcctg

SEQ ID NO: 5472895 - DNA, 20 bp, Homo sapiens
agacctcttcctggaataaa

SEQ ID NO: 5472896 - DNA, 21 bp, Homo sapiens
agacctcttcctggaataaac

SEQ ID NO: 5472897 - DNA, 11 bp, Homo sapiens
agacctgaaag

SEQ ID NO: 5472898 - DNA, 15 bp, Homo sapiens
agacctgaattcttt

SEQ ID NO: 5472899 - DNA, 22 bp, Homo sapiens
agacctgacaccgtccctcagt

SEQ ID NO: 5472900 - DNA, 19 bp, Homo sapiens
agacctgacacctttcata

SEQ ID NO: 5472901 - DNA, 18 bp, Homo sapiens
agacctgaccagtcagat

SEQ ID NO: 5472902 - DNA, 17 bp, Homo sapiens
agacctgacccaacacc

SEQ ID NO: 5472903 - DNA, 14 bp, Homo sapiens
agacctgactcagg

SEQ ID NO: 5472904 - DNA, 16 bp, Homo sapiens
agacctgagaatgtat

SEQ ID NO: 5472905 - DNA, 14 bp, Homo sapiens
agacctgaggcaga

SEQ ID NO: 5472906 - DNA, 16 bp, Homo sapiens
agacctgatcctggag

SEQ ID NO: 5472907 - DNA, 23 bp, Homo sapiens
agacctgatcctggaggcccagt

SEQ ID NO: 5472908 - DNA, 19 bp, Homo sapiens
agacctgcagcgggcaaag

SEQ ID NO: 5472909 - DNA, 20 bp, Homo sapiens
agacctgcatggtcaagcct

SEQ ID NO: 5472910 - DNA, 13 bp, Homo sapiens
agacctgcatttg

SEQ ID NO: 5472911 - DNA, 16 bp, Homo sapiens
agacctgccctctctg

SEQ ID NO: 5472912 - DNA, 17 bp, Homo sapiens
agacctgccctctctgc

SEQ ID NO: 5472913 - DNA, 18 bp, Homo sapiens
agacctgctccagatcct

SEQ ID NO: 5472914 - DNA, 23 bp, Homo sapiens
attacttatcatccacattgttt

SEQ ID NO: 5472915 - DNA, 19 bp, Homo sapiens
attacttatttatcctagt

SEQ ID NO: 5472916 - DNA, 15 bp, Homo sapiens
attacttcagggctg

SEQ ID NO: 5472917 - DNA, 14 bp, Homo sapiens
attacttctgctac

SEQ ID NO: 5472918 - DNA, 20 bp, Homo sapiens
attacttctgtttgggagac

SEQ ID NO: 5472919 - DNA, 14 bp, Homo sapiens
attacttgcacaag

SEQ ID NO: 5472920 - DNA, 17 bp, Homo sapiens
attacttgcctatctga

SEQ ID NO: 5472921 - DNA, 17 bp, Homo sapiens
attacttgctttcaatt

SEQ ID NO: 5472922 - DNA, 22 bp, Homo sapiens
attacttgctttcaattgacaa

SEQ ID NO: 5472923 - DNA, 22 bp, Homo sapiens
attacttgtaaataaagtctat

SEQ ID NO: 5472924 - DNA, 18 bp, Homo sapiens
attacttgtaaatataaa

SEQ ID NO: 5472925 - DNA, 20 bp, Homo sapiens
attacttgtaaatataaaga

SEQ ID NO: 5472926 - DNA, 16 bp, Homo sapiens
attacttgtgcactta

SEQ ID NO: 5472927 - DNA, 14 bp, Homo sapiens
attactttaaaata

SEQ ID NO: 5472928 - DNA, 21 bp, Homo sapiens
attactttaaaataaaaaagt

SEQ ID NO: 5472929 - DNA, 16 bp, Homo sapiens
attactttaaattata

SEQ ID NO: 5472930 - DNA, 22 bp, Homo sapiens
attactttaaattatatgatat

SEQ ID NO: 5472931 - DNA, 13 bp, Homo sapiens
attactttaacat

SEQ ID NO: 5472932 - DNA, 15 bp, Homo sapiens
attactttaacatgc

SEQ ID NO: 5472933 - DNA, 21 bp, Homo sapiens
attactttaacattttggaaa

SEQ ID NO: 5472934 - DNA, 22 bp, Homo sapiens
attactttaatactcacctcct

SEQ ID NO: 5472935 - DNA, 11 bp, Homo sapiens
attactttatc

SEQ ID NO: 5472936 - DNA, 14 bp, Homo sapiens
attactttatcact

SEQ ID NO: 5472937 - DNA, 14 bp, Homo sapiens
attactttcagaat

SEQ ID NO: 5472938 - DNA, 18 bp, Homo sapiens
attactttgaacattaat

SEQ ID NO: 5472939 - DNA, 19 bp, Homo sapiens
attactttgattccatttt

SEQ ID NO: 5472940 - DNA, 16 bp, Homo sapiens
attactttgtagatgt

SEQ ID NO: 5472941 - DNA, 15 bp, Homo sapiens
attactttgtcccgc

SEQ ID NO: 5472942 - DNA, 20 bp, Homo sapiens
attactttgtcttttcaatc

SEQ ID NO: 5472943 - DNA, 22 bp, Homo sapiens
attacttttaaaaatgtagaaa

SEQ ID NO: 5472944 - DNA, 14 bp, Homo sapiens
attacttttaaata

SEQ ID NO: 5472945 - DNA, 15 bp, Homo sapiens
attacttttctgcaa

SEQ ID NO: 5472946 - DNA, 18 bp, Homo sapiens
attacttttctgcaatgt

SEQ ID NO: 5472947 - DNA, 19 bp, Homo sapiens
attacttttgaaaaaggat

SEQ ID NO: 5472948 - DNA, 16 bp, Homo sapiens
attacttttgtaaata

SEQ ID NO: 5472949 - DNA, 21 bp, Homo sapiens
attacttttgtaaatattctt

SEQ ID NO: 5472950 - DNA, 11 bp, Homo sapiens
attactttttt

SEQ ID NO: 5472951 - DNA, 15 bp, Homo sapiens
attacttttttccaa

SEQ ID NO: 5472952 - DNA, 18 bp, Homo sapiens
attactttttttgtagat

SEQ ID NO: 5472953 - DNA, 21 bp, Homo sapiens
attactttttttgtagatgaa

SEQ ID NO: 5472954 - DNA, 22 bp, Homo sapiens
attactttttttgtagatgaac

SEQ ID NO: 5472955 - DNA, 12 bp, Homo sapiens
attagaaaaaaa

SEQ ID NO: 5472956 - DNA, 14 bp, Homo sapiens
attagaaaaaaaca

SEQ ID NO: 5472957 - DNA, 16 bp, Homo sapiens
attagaaaaaaacaaa

SEQ ID NO: 5472958 - DNA, 16 bp, Homo sapiens
attagaaaaaaattac

SEQ ID NO: 5472959 - DNA, 21 bp, Homo sapiens
attagaaaaatagcaacttgt

SEQ ID NO: 5472960 - DNA, 17 bp, Homo sapiens
attagaaaaattcctaa

SEQ ID NO: 5472961 - DNA, 11 bp, Homo sapiens
attagaaaaca

SEQ ID NO: 5472962 - DNA, 16 bp, Homo sapiens
attagaaaactttgtt

SEQ ID NO: 5472963 - DNA, 17 bp, Homo sapiens
attagaaaactttgtta

SEQ ID NO: 5472964 - DNA, 18 bp, Homo sapiens
attagaaaagttaacatt

SEQ ID NO: 5472965 - DNA, 20 bp, Homo sapiens
attagaaaatgtatttatag

SEQ ID NO: 5472966 - DNA, 18 bp, Homo sapiens
attagaaaatgttattta

SEQ ID NO: 5472967 - DNA, 19 bp, Homo sapiens
attagaaaatgttatttaa

SEQ ID NO: 5472968 - DNA, 14 bp, Homo sapiens
attagaaaattttg

SEQ ID NO: 5472969 - DNA, 19 bp, Homo sapiens
attagaaaggacaacagtt

SEQ ID NO: 5472970 - DNA, 16 bp, Homo sapiens
attagaaatagacagt

SEQ ID NO: 5472971 - DNA, 12 bp, Homo sapiens
attagaaatatt

SEQ ID NO: 5472972 - DNA, 16 bp, Homo sapiens
atttcatttcacattt

SEQ ID NO: 5472973 - DNA, 14 bp, Homo sapiens
atttcatttccagc

SEQ ID NO: 5472974 - DNA, 23 bp, Homo sapiens
atttcatttcttgtcaattatgt

SEQ ID NO: 5472975 - DNA, 20 bp, Homo sapiens
atttcatttgctgttcatct

SEQ ID NO: 5472976 - DNA, 22 bp, Homo sapiens
atttcatttgtgccagaatgct

SEQ ID NO: 5472977 - DNA, 19 bp, Homo sapiens
atttcattttaacatgatt

SEQ ID NO: 5472978 - DNA, 22 bp, Homo sapiens
atttcattttttatgtattgtt

SEQ ID NO: 5472979 - DNA, 15 bp, Homo sapiens
atttccaaaatgttt

SEQ ID NO: 5472980 - DNA, 18 bp, Homo sapiens
atttccaaataaaatgag

SEQ ID NO: 5472981 - DNA, 18 bp, Homo sapiens
atttccaaatattctaaa

SEQ ID NO: 5472982 - DNA, 24 bp, Homo sapiens
atttccaaatgtggcctccatgtg

SEQ ID NO: 5472983 - DNA, 17 bp, Homo sapiens
atttccaaattcacaag

SEQ ID NO: 5472984 - DNA, 23 bp, Homo sapiens
atttccaacaaacttactgtcag

SEQ ID NO: 5472985 - DNA, 15 bp, Homo sapiens
atttccaagagctga

SEQ ID NO: 5472986 - DNA, 16 bp, Homo sapiens
atttccaagagctgag

SEQ ID NO: 5472987 - DNA, 13 bp, Homo sapiens
atttccaagctgt

SEQ ID NO: 5472988 - DNA, 21 bp, Homo sapiens
atttccaccaagggtatctgc

SEQ ID NO: 5472989 - DNA, 22 bp, Homo sapiens
atttccactcaggtctgttttc

SEQ ID NO: 5472990 - DNA, 18 bp, Homo sapiens
atttccactgaacaaaac

SEQ ID NO: 5472991 - DNA, 18 bp, Homo sapiens
atttccagaactgcacaa

SEQ ID NO: 5472992 - DNA, 21 bp, Homo sapiens
atttccagctttctccccgct

SEQ ID NO: 5472993 - DNA, 18 bp, Homo sapiens
atttccaggaaaaaataa

SEQ ID NO: 5472994 - DNA, 18 bp, Homo sapiens
atttccaggcccctgagg

SEQ ID NO: 5472995 - DNA, 22 bp, Homo sapiens
atttccaggcccctgaggactg

SEQ ID NO: 5472996 - DNA, 23 bp, Homo sapiens
atttccaggcccctgaggactgg

SEQ ID NO: 5472997 - DNA, 14 bp, Homo sapiens
atttccagggatat

SEQ ID NO: 5472998 - DNA, 19 bp, Homo sapiens
atttccagggcagcagccg

SEQ ID NO: 5472999 - DNA, 21 bp, Homo sapiens
atttccagtgagtgtaaataa

SEQ ID NO: 5473000 - DNA, 20 bp, Homo sapiens
atttccagtggtcatgctca

SEQ ID NO: 5473001 - DNA, 21 bp, Homo sapiens
atttccagtgttctatgaaca

SEQ ID NO: 5473002 - DNA, 22 bp, Homo sapiens
atttccagtgttctatgaacaa

SEQ ID NO: 5473003 - DNA, 17 bp, Homo sapiens
atttccagtttttcttt

SEQ ID NO: 5473004 - DNA, 22 bp, Homo sapiens
atttccataaggatttaggtat

SEQ ID NO: 5473005 - DNA, 20 bp, Homo sapiens
atttccatccaaacctacct

SEQ ID NO: 5473006 - DNA, 18 bp, Homo sapiens
atttccatgggccccacc

SEQ ID NO: 5473007 - DNA, 20 bp, Homo sapiens
atttccatgtcccctcccag

SEQ ID NO: 5473008 - DNA, 23 bp, Homo sapiens
atttccatgtcccctcccagagc

SEQ ID NO: 5473009 - DNA, 20 bp, Homo sapiens
atttccattcttttaaatgg

SEQ ID NO: 5473010 - DNA, 18 bp, Homo sapiens
atttccattgtgtggcct

SEQ ID NO: 5473011 - DNA, 15 bp, Homo sapiens
atttccatttattgt

SEQ ID NO: 5473012 - DNA, 19 bp, Homo sapiens
atttccatttattgtttga

SEQ ID NO: 5473013 - DNA, 16 bp, Homo sapiens
atttccatttcttcct

SEQ ID NO: 5473014 - DNA, 24 bp, Homo sapiens
atttccatttggggatattgtcat

SEQ ID NO: 5473015 - DNA, 23 bp, Homo sapiens
atttcccaaaaacactaaaggtg

SEQ ID NO: 5473016 - DNA, 16 bp, Homo sapiens
atttcccaaagcagtg

SEQ ID NO: 5473017 - DNA, 19 bp, Homo sapiens
atttcccaaagcagtgcat

SEQ ID NO: 5473018 - DNA, 23 bp, Homo sapiens
atttcccaaagtcctctgctcca

SEQ ID NO: 5473019 - DNA, 18 bp, Homo sapiens
atttcccaacacaaagat

SEQ ID NO: 5473020 - DNA, 23 bp, Homo sapiens
atttcccaacccaggattcaaca

SEQ ID NO: 5473021 - DNA, 17 bp, Homo sapiens
atttcccaattaggaag

SEQ ID NO: 5473022 - DNA, 13 bp, Homo sapiens
atttcccacaccc

SEQ ID NO: 5473023 - DNA, 23 bp, Homo sapiens
atttcccactgcactccagcctg

SEQ ID NO: 5473024 - DNA, 20 bp, Homo sapiens
atttcccagcacatgaaacc

SEQ ID NO: 5473025 - DNA, 14 bp, Homo sapiens
atttcccaggaccc

SEQ ID NO: 5473026 - DNA, 15 bp, Homo sapiens
atttcccatctgcac

SEQ ID NO: 5473027 - DNA, 15 bp, Homo sapiens
atttccccaacagtg

SEQ ID NO: 5473028 - DNA, 20 bp, Homo sapiens
atttccccacccccctctct

SEQ ID NO: 5473029 - DNA, 15 bp, Homo sapiens
atttccccaggtgtg

SEQ ID NO: 5473030 - DNA, 15 bp, Homo sapiens
atttccccatctgcc

SEQ ID NO: 5473031 - DNA, 14 bp, Homo sapiens
atttcccccaaagg

SEQ ID NO: 5473032 - DNA, 18 bp, Homo sapiens
atttcccccctccgcctc

SEQ ID NO: 5473033 - DNA, 21 bp, Homo sapiens
atttcccccttcatccatcct

SEQ ID NO: 5473034 - DNA, 17 bp, Homo sapiens
atttccccctttcttcc

SEQ ID NO: 5473035 - DNA, 18 bp, Homo sapiens
atttccccctttcttcct

SEQ ID NO: 5473036 - DNA, 19 bp, Homo sapiens
atttccccctttcttcctc

SEQ ID NO: 5473037 - DNA, 19 bp, Homo sapiens
atttccccgatgtcccctg

SEQ ID NO: 5473038 - DNA, 22 bp, Homo sapiens
atttccccgatgtcccctgcgg

SEQ ID NO: 5473039 - DNA, 17 bp, Homo sapiens
atttcccctaatctttt

SEQ ID NO: 5473040 - DNA, 21 bp, Homo sapiens
atttcccctcccaatcctctc

SEQ ID NO: 5473041 - DNA, 23 bp, Homo sapiens
atttcccctcccgcttcctccgg

SEQ ID NO: 5473042 - DNA, 22 bp, Homo sapiens
atttcccctctgcacccagaac

SEQ ID NO: 5473043 - DNA, 22 bp, Homo sapiens
atttcccctctgtgtcctctcc

SEQ ID NO: 5473044 - DNA, 23 bp, Homo sapiens
atttcccctctgtgtcctctccc

SEQ ID NO: 5473045 - DNA, 13 bp, Homo sapiens
atttcccctgtca

SEQ ID NO: 5473046 - DNA, 16 bp, Homo sapiens
atttcccctgtggttt

SEQ ID NO: 5473047 - DNA, 20 bp, Homo sapiens
atttcccctttccaattcca

SEQ ID NO: 5473048 - DNA, 21 bp, Homo sapiens
atttcccctttccaattccaa

SEQ ID NO: 5473049 - DNA, 15 bp, Homo sapiens
atttccccttttgca

SEQ ID NO: 5473050 - DNA, 16 bp, Homo sapiens
atttcccggagccatc

SEQ ID NO: 5473051 - DNA, 21 bp, Homo sapiens
atttcccggagccatcaccct

SEQ ID NO: 5473052 - DNA, 16 bp, Homo sapiens
atttcccgtggcccca

SEQ ID NO: 5473053 - DNA, 14 bp, Homo sapiens
atttccctaaaaat

SEQ ID NO: 5473054 - DNA, 20 bp, Homo sapiens
atttccctaaaatacattta

SEQ ID NO: 5473055 - DNA, 21 bp, Homo sapiens
atttccctaaaatacatttaa

SEQ ID NO: 5473056 - DNA, 17 bp, Homo sapiens
atttccctatcttctcc

SEQ ID NO: 5473057 - DNA, 14 bp, Homo sapiens
atttccctatttta

SEQ ID NO: 5473058 - DNA, 21 bp, Homo sapiens
atttccctattttaggctatt

SEQ ID NO: 5473059 - DNA, 14 bp, Homo sapiens
atttccctcaggtt

SEQ ID NO: 5473060 - DNA, 21 bp, Homo sapiens
atttccctcatcttgccccct

SEQ ID NO: 5473061 - DNA, 18 bp, Homo sapiens
atttccctccagagaaag

SEQ ID NO: 5473062 - DNA, 14 bp, Homo sapiens
atttccctctctca

SEQ ID NO: 5473063 - DNA, 17 bp, Homo sapiens
atttccctgaaggaacc

SEQ ID NO: 5473064 - DNA, 23 bp, Homo sapiens
atttccctgaaggaaccaaagcg

SEQ ID NO: 5473065 - DNA, 20 bp, Homo sapiens
atttcccttccttcctctcc

SEQ ID NO: 5473066 - DNA, 16 bp, Homo sapiens
atttcccttcttgcat

SEQ ID NO: 5473067 - DNA, 23 bp, Homo sapiens
atttcccttgaaattttaaacta

SEQ ID NO: 5473068 - DNA, 23 bp, Homo sapiens
atttccctttagctgtgttatta

SEQ ID NO: 5473069 - DNA, 22 bp, Homo sapiens
atttccgaagaccttctgaaga

SEQ ID NO: 5473070 - DNA, 16 bp, Homo sapiens
atttccgtaattctta

SEQ ID NO: 5473071 - DNA, 14 bp, Homo sapiens
atttccgtgaaggg

SEQ ID NO: 5473072 - DNA, 16 bp, Homo sapiens
atttccgtgagagtca

SEQ ID NO: 5473073 - DNA, 21 bp, Homo sapiens
atttccgtgagagtcatctca

SEQ ID NO: 5473074 - DNA, 14 bp, Homo sapiens
atttcctaaggcat

SEQ ID NO: 5473075 - DNA, 17 bp, Homo sapiens
atttcctaatactgtca

SEQ ID NO: 5473076 - DNA, 19 bp, Homo sapiens
atttcctagctgttctaat

SEQ ID NO: 5473077 - DNA, 16 bp, Homo sapiens
atttcctatgatgtat

SEQ ID NO: 5473078 - DNA, 13 bp, Homo sapiens
atttcctatttta

SEQ ID NO: 5473079 - DNA, 19 bp, Homo sapiens
atttcctattttaaaacca

SEQ ID NO: 5473080 - DNA, 23 bp, Homo sapiens
atttcctattttaaaaccatgca

SEQ ID NO: 5473081 - DNA, 18 bp, Homo sapiens
atttcctcataaacattt

SEQ ID NO: 5473082 - DNA, 23 bp, Homo sapiens
atttcctccacattcatgtacaa

SEQ ID NO: 5473083 - DNA, 16 bp, Homo sapiens
atttcctccatggtgg

SEQ ID NO: 5473084 - DNA, 17 bp, Homo sapiens
atttcctcccccagtta

SEQ ID NO: 5473085 - DNA, 21 bp, Homo sapiens
atttcctccctctgcccctcc

SEQ ID NO: 5473086 - DNA, 20 bp, Homo sapiens
atttcctccgtcacctcaga

SEQ ID NO: 5473087 - DNA, 20 bp, Homo sapiens
atttcctcctcccagtgcct

SEQ ID NO: 5473088 - DNA, 24 bp, Homo sapiens
atttcctcctcccagtgccttctg

SEQ ID NO: 5473089 - DNA, 17 bp, Homo sapiens
atttctcactagtgtca

SEQ ID NO: 5473090 - DNA, 21 bp, Homo sapiens
atttctcagactttggaaaat

SEQ ID NO: 5473091 - DNA, 23 bp, Homo sapiens
atttctcatagcaggaaatgtag

SEQ ID NO: 5473092 - DNA, 14 bp, Homo sapiens
atttctcatcacag

SEQ ID NO: 5473093 - DNA, 20 bp, Homo sapiens
atttctcatgcttcttctca

SEQ ID NO: 5473094 - DNA, 17 bp, Homo sapiens
atttctcatgtgctttg

SEQ ID NO: 5473095 - DNA, 22 bp, Homo sapiens
atttctcatgtgctttgtagct

SEQ ID NO: 5473096 - DNA, 23 bp, Homo sapiens
atttctcatgttccttttgaaat

SEQ ID NO: 5473097 - DNA, 22 bp, Homo sapiens
atttctcattgacttttataaa

SEQ ID NO: 5473098 - DNA, 22 bp, Homo sapiens
atttctccaagaaagccaacaa

SEQ ID NO: 5473099 - DNA, 17 bp, Homo sapiens
atttctccagaacccat

SEQ ID NO: 5473100 - DNA, 12 bp, Homo sapiens
atttctccagac

SEQ ID NO: 5473101 - DNA, 13 bp, Homo sapiens
atttctccagacc

SEQ ID NO: 5473102 - DNA, 21 bp, Homo sapiens
atttctccaggtttgctgtgt

SEQ ID NO: 5473103 - DNA, 15 bp, Homo sapiens
atttctccatacgca

SEQ ID NO: 5473104 - DNA, 19 bp, Homo sapiens
atttctcctcatttaatat

SEQ ID NO: 5473105 - DNA, 14 bp, Homo sapiens
atttctcctccctt

SEQ ID NO: 5473106 - DNA, 19 bp, Homo sapiens
atttctcctcccttccttt

SEQ ID NO: 5473107 - DNA, 10 bp, Homo sapiens
atttctcctt

SEQ ID NO: 5473108 - DNA, 17 bp, Homo sapiens
atttctcctttaaagag

SEQ ID NO: 5473109 - DNA, 14 bp, Homo sapiens
atttctcctttgca

SEQ ID NO: 5473110 - DNA, 16 bp, Homo sapiens
atttctcctttgcaat

SEQ ID NO: 5473111 - DNA, 17 bp, Homo sapiens
atttctccttttgtgtt

SEQ ID NO: 5473112 - DNA, 17 bp, Homo sapiens
atttctctaattatgca

SEQ ID NO: 5473113 - DNA, 23 bp, Homo sapiens
atttctctagtgtattatcactg

SEQ ID NO: 5473114 - DNA, 23 bp, Homo sapiens
atttctctattttcataatcagt

SEQ ID NO: 5473115 - DNA, 18 bp, Homo sapiens
atttctctctccagtctt

SEQ ID NO: 5473116 - DNA, 17 bp, Homo sapiens
atttctctctcctggtg

SEQ ID NO: 5473117 - DNA, 19 bp, Homo sapiens
atttctctctcctggtgtg

SEQ ID NO: 5473118 - DNA, 13 bp, Homo sapiens
atttctctgcaca

SEQ ID NO: 5473119 - DNA, 16 bp, Homo sapiens
atttctctggcaaact

SEQ ID NO: 5473120 - DNA, 19 bp, Homo sapiens
atttctctggcaaactttt

SEQ ID NO: 5473121 - DNA, 19 bp, Homo sapiens
atttctctggggtctgtga

SEQ ID NO: 5473122 - DNA, 14 bp, Homo sapiens
atttctctgtgaat

SEQ ID NO: 5473123 - DNA, 20 bp, Homo sapiens
atttctctgtgtatttatat

SEQ ID NO: 5473124 - DNA, 15 bp, Homo sapiens
atttctcttaagtac

SEQ ID NO: 5473125 - DNA, 20 bp, Homo sapiens
atttctcttactgcaaatgt

SEQ ID NO: 5473126 - DNA, 15 bp, Homo sapiens
atttctcttcagtgt

SEQ ID NO: 5473127 - DNA, 15 bp, Homo sapiens
atttctcttcctaaa

SEQ ID NO: 5473128 - DNA, 18 bp, Homo sapiens
atttctcttctacccttt

SEQ ID NO: 5473129 - DNA, 21 bp, Homo sapiens
atttctcttctacccttttcc

SEQ ID NO: 5473130 - DNA, 19 bp, Homo sapiens
atttctcttctcagctctt

SEQ ID NO: 5473131 - DNA, 23 bp, Homo sapiens
atttctcttctcagctcttccat

SEQ ID NO: 5473132 - DNA, 15 bp, Homo sapiens
atttctctttcaaaa

SEQ ID NO: 5473133 - DNA, 16 bp, Homo sapiens
atttctctttctctct

SEQ ID NO: 5473134 - DNA, 16 bp, Homo sapiens
atttctctttgaaaca

SEQ ID NO: 5473135 - DNA, 13 bp, Homo sapiens
atttctgaaatga

SEQ ID NO: 5473136 - DNA, 22 bp, Homo sapiens
atttctgaacaaagagagctca

SEQ ID NO: 5473137 - DNA, 13 bp, Homo sapiens
atttctgaactgt

SEQ ID NO: 5473138 - DNA, 16 bp, Homo sapiens
atttctgaactgttac

SEQ ID NO: 5473139 - DNA, 23 bp, Homo sapiens
atttctgaagaagttaattctta

SEQ ID NO: 5473140 - DNA, 16 bp, Homo sapiens
atttctgaattcaaag

SEQ ID NO: 5473141 - DNA, 17 bp, Homo sapiens
atttctgaattcaaagc

SEQ ID NO: 5473142 - DNA, 11 bp, Homo sapiens
atttctgagaa

SEQ ID NO: 5473143 - DNA, 17 bp, Homo sapiens
atttctgagcaaagcat

SEQ ID NO: 5473144 - DNA, 21 bp, Homo sapiens
atttctgaggtgcactgggag

SEQ ID NO: 5473145 - DNA, 23 bp, Homo sapiens
atttctgagtttcattctcctgc

SEQ ID NO: 5473146 - DNA, 15 bp, Homo sapiens
atttctgataaagtt

SEQ ID NO: 5473147 - DNA, 21 bp, Homo sapiens
atttctgataaagttccttaa

SEQ ID NO: 5473148 - DNA, 23 bp, Homo sapiens
attagtcattcaataaattgtaa

SEQ ID NO: 5473149 - DNA, 19 bp, Homo sapiens
attagtcctaattcaatcc

SEQ ID NO: 5473150 - DNA, 18 bp, Homo sapiens
attagtcctcacagccta

SEQ ID NO: 5473151 - DNA, 13 bp, Homo sapiens
attagtccttgct

SEQ ID NO: 5473152 - DNA, 14 bp, Homo sapiens
attagtccttgctt

SEQ ID NO: 5473153 - DNA, 19 bp, Homo sapiens
attagtcgggcatgagtct

SEQ ID NO: 5473154 - DNA, 24 bp, Homo sapiens
attagtctatatggttctccaaga

SEQ ID NO: 5473155 - DNA, 18 bp, Homo sapiens
attagtcttttgtaatat

SEQ ID NO: 5473156 - DNA, 13 bp, Homo sapiens
attagtgaagatg

SEQ ID NO: 5473157 - DNA, 21 bp, Homo sapiens
attagtgaagtatgcactaat

SEQ ID NO: 5473158 - DNA, 18 bp, Homo sapiens
attagtgaccattattca

SEQ ID NO: 5473159 - DNA, 16 bp, Homo sapiens
attagtgagacatcag

SEQ ID NO: 5473160 - DNA, 17 bp, Homo sapiens
attagtgagatttgtat

SEQ ID NO: 5473161 - DNA, 15 bp, Homo sapiens
attagtgattctgat

SEQ ID NO: 5473162 - DNA, 22 bp, Homo sapiens
attagtgattctgatttcagtt

SEQ ID NO: 5473163 - DNA, 23 bp, Homo sapiens
attagtgattctgatttcagttt

SEQ ID NO: 5473164 - DNA, 13 bp, Homo sapiens
attagtgcagtta

SEQ ID NO: 5473165 - DNA, 21 bp, Homo sapiens
attagtgccaagtttttcaga

SEQ ID NO: 5473166 - DNA, 23 bp, Homo sapiens
attagtgccaagtttttcagaaa

SEQ ID NO: 5473167 - DNA, 16 bp, Homo sapiens
attagtgccacttaat

SEQ ID NO: 5473168 - DNA, 20 bp, Homo sapiens
attagtgccacttaatgtat

SEQ ID NO: 5473169 - DNA, 16 bp, Homo sapiens
attagtgccagaattt

SEQ ID NO: 5473170 - DNA, 22 bp, Homo sapiens
attagtgccagaattttaggaa

SEQ ID NO: 5473171 - DNA, 15 bp, Homo sapiens
attagtgctaagtgt

SEQ ID NO: 5473172 - DNA, 17 bp, Homo sapiens
attagtgctaagtgtga

SEQ ID NO: 5473173 - DNA, 22 bp, Homo sapiens
attagtgctaagtgtgaactgg

SEQ ID NO: 5473174 - DNA, 17 bp, Homo sapiens
attagtggaaagtgatt

SEQ ID NO: 5473175 - DNA, 13 bp, Homo sapiens
attagtggatttt

SEQ ID NO: 5473176 - DNA, 17 bp, Homo sapiens
attagtggtcataaaat

SEQ ID NO: 5473177 - DNA, 18 bp, Homo sapiens
attagtgtcaacttttaa

SEQ ID NO: 5473178 - DNA, 13 bp, Homo sapiens
attagtgtccccc

SEQ ID NO: 5473179 - DNA, 15 bp, Homo sapiens
attagtgtgttgtct

SEQ ID NO: 5473180 - DNA, 14 bp, Homo sapiens
attagttaatatat

SEQ ID NO: 5473181 - DNA, 20 bp, Homo sapiens
attagttaggtgtgccaaac

SEQ ID NO: 5473182 - DNA, 12 bp, Homo sapiens
attagttatata

SEQ ID NO: 5473183 - DNA, 18 bp, Homo sapiens
attagttcccctactaca

SEQ ID NO: 5473184 - DNA, 18 bp, Homo sapiens
attagttccctgtctctt

SEQ ID NO: 5473185 - DNA, 13 bp, Homo sapiens
attagttgcacta

SEQ ID NO: 5473186 - DNA, 21 bp, Homo sapiens
attagttgcattggtttgaga

SEQ ID NO: 5473187 - DNA, 13 bp, Homo sapiens
attagttgctttg

SEQ ID NO: 5473188 - DNA, 15 bp, Homo sapiens
attagttgctttgtt

SEQ ID NO: 5473189 - DNA, 17 bp, Homo sapiens
attagttgtatataaaa

SEQ ID NO: 5473190 - DNA, 20 bp, Homo sapiens
attagttgtgtactctggcc

SEQ ID NO: 5473191 - DNA, 20 bp, Homo sapiens
attagtttacctcatccatg

SEQ ID NO: 5473192 - DNA, 12 bp, Homo sapiens
attagtttagaa

SEQ ID NO: 5473193 - DNA, 15 bp, Homo sapiens
attagtttagaacag

SEQ ID NO: 5473194 - DNA, 17 bp, Homo sapiens
attagtttagaacaggt

SEQ ID NO: 5473195 - DNA, 21 bp, Homo sapiens
attagtttagaacaggttttt

SEQ ID NO: 5473196 - DNA, 23 bp, Homo sapiens
attagtttcaattgagtaattct

SEQ ID NO: 5473197 - DNA, 12 bp, Homo sapiens
attagtttcctt

SEQ ID NO: 5473198 - DNA, 20 bp, Homo sapiens
attagtttgatttaatatct

SEQ ID NO: 5473199 - DNA, 21 bp, Homo sapiens
attagtttgatttaatatctg

SEQ ID NO: 5473200 - DNA, 11 bp, Homo sapiens
attagttttaa

SEQ ID NO: 5473201 - DNA, 16 bp, Homo sapiens
attagttttaaaatac

SEQ ID NO: 5473202 - DNA, 17 bp, Homo sapiens
attagttttaatctctt

SEQ ID NO: 5473203 - DNA, 20 bp, Homo sapiens
attagttttctgtatatgat

SEQ ID NO: 5473204 - DNA, 15 bp, Homo sapiens
attagttttcttgtt

SEQ ID NO: 5473205 - DNA, 19 bp, Homo sapiens
attagttttcttgttgctt

SEQ ID NO: 5473206 - DNA, 21 bp, Homo sapiens
attagttttcttgttgctttg

SEQ ID NO: 5473207 - DNA, 20 bp, Homo sapiens
attataaaaaatgtaacatc

SEQ ID NO: 5473208 - DNA, 21 bp, Homo sapiens
attataaaaaattaacttagt

SEQ ID NO: 5473209 - DNA, 15 bp, Homo sapiens
attataaaaacactt

SEQ ID NO: 5473210 - DNA, 22 bp, Homo sapiens
attataaaaatattaagacaat

SEQ ID NO: 5473211 - DNA, 22 bp, Homo sapiens
attataaaagctcagatgacat

SEQ ID NO: 5473212 - DNA, 13 bp, Homo sapiens
attataaaattga

SEQ ID NO: 5473213 - DNA, 17 bp, Homo sapiens
attataaaattgaaaac

SEQ ID NO: 5473214 - DNA, 15 bp, Homo sapiens
attataaacagcagg

SEQ ID NO: 5473215 - DNA, 14 bp, Homo sapiens
attataaacgctta

SEQ ID NO: 5473216 - DNA, 15 bp, Homo sapiens
attataaactataaa

SEQ ID NO: 5473217 - DNA, 19 bp, Homo sapiens
attataaactataaactta

SEQ ID NO: 5473218 - DNA, 23 bp, Homo sapiens
attataaactctaagtgtaaaaa

SEQ ID NO: 5473219 - DNA, 21 bp, Homo sapiens
attataaagccaattatctga

SEQ ID NO: 5473220 - DNA, 12 bp, Homo sapiens
attataaagctt

SEQ ID NO: 5473221 - DNA, 13 bp, Homo sapiens
attataaagctta

SEQ ID NO: 5473222 - DNA, 16 bp, Homo sapiens
attataaagcttaaat

SEQ ID NO: 5473223 - DNA, 21 bp, Homo sapiens
attataaagcttaaattttat

SEQ ID NO: 5473224 - DNA, 22 bp, Homo sapiens
attataaaggataaagaaggat

SEQ ID NO: 5473225 - DNA, 17 bp, Homo sapiens
attataaataaatgcca

SEQ ID NO: 5473226 - DNA, 19 bp, Homo sapiens
attataaataaatgccaac

SEQ ID NO: 5473227 - DNA, 20 bp, Homo sapiens
attataaatgaaatttgcaa

SEQ ID NO: 5473228 - DNA, 13 bp, Homo sapiens
attataaatgtta

SEQ ID NO: 5473229 - DNA, 13 bp, Homo sapiens
attataaatgttt

SEQ ID NO: 5473230 - DNA, 19 bp, Homo sapiens
attataaatgtttcatgaa

SEQ ID NO: 5473231 - DNA, 19 bp, Homo sapiens
attataaatgtttggaaag

SEQ ID NO: 5473232 - DNA, 22 bp, Homo sapiens
attataaatgtttggaaaggtt

SEQ ID NO: 5473233 - DNA, 16 bp, Homo sapiens
attataaattctacta

SEQ ID NO: 5473234 - DNA, 20 bp, Homo sapiens
attataaattctactaagtt

SEQ ID NO: 5473235 - DNA, 19 bp, Homo sapiens
attataacaactatttact

SEQ ID NO: 5473236 - DNA, 17 bp, Homo sapiens
attataacaagtgtgtc

SEQ ID NO: 5473237 - DNA, 16 bp, Homo sapiens
attataacagttatat

SEQ ID NO: 5473238 - DNA, 17 bp, Homo sapiens
attataacataaaagca

SEQ ID NO: 5473239 - DNA, 22 bp, Homo sapiens
attataaccttaatttattatt

SEQ ID NO: 5473240 - DNA, 12 bp, Homo sapiens
attataactatt

SEQ ID NO: 5473241 - DNA, 13 bp, Homo sapiens
attataactatta

SEQ ID NO: 5473242 - DNA, 17 bp, Homo sapiens
attataactggaaagaa

SEQ ID NO: 5473243 - DNA, 12 bp, Homo sapiens
attataactgta

SEQ ID NO: 5473244 - DNA, 22 bp, Homo sapiens
attataacttaaaaaaatgaca

SEQ ID NO: 5473245 - DNA, 14 bp, Homo sapiens
attataagatgtca

SEQ ID NO: 5473246 - DNA, 12 bp, Homo sapiens
attataagcatt

SEQ ID NO: 5473247 - DNA, 18 bp, Homo sapiens
attataagcattgaaatt

SEQ ID NO: 5473248 - DNA, 13 bp, Homo sapiens
attataaggactg

SEQ ID NO: 5473249 - DNA, 16 bp, Homo sapiens
attataaggactgcat

SEQ ID NO: 5473250 - DNA, 15 bp, Homo sapiens
attataagtagattt

SEQ ID NO: 5473251 - DNA, 15 bp, Homo sapiens
attataagtcttaca

SEQ ID NO: 5473252 - DNA, 15 bp, Homo sapiens
attataagtgcttca

SEQ ID NO: 5473253 - DNA, 14 bp, Homo sapiens
attataagttctat

SEQ ID NO: 5473254 - DNA, 22 bp, Homo sapiens
attataagttctattttactgt

SEQ ID NO: 5473255 - DNA, 13 bp, Homo sapiens
attataagttgac

SEQ ID NO: 5473256 - DNA, 18 bp, Homo sapiens
attataataaaggtcaca

SEQ ID NO: 5473257 - DNA, 17 bp, Homo sapiens
attataatatagaaaga

SEQ ID NO: 5473258 - DNA, 18 bp, Homo sapiens
attataatcaaagctcat

SEQ ID NO: 5473259 - DNA, 14 bp, Homo sapiens
attataatcatact

SEQ ID NO: 5473260 - DNA, 19 bp, Homo sapiens
attataatcctcaagagaa

SEQ ID NO: 5473261 - DNA, 14 bp, Homo sapiens
attataatctcaaa

SEQ ID NO: 5473262 - DNA, 15 bp, Homo sapiens
attataatctcaaag

SEQ ID NO: 5473263 - DNA, 19 bp, Homo sapiens
attataatctcaaaggaga

SEQ ID NO: 5473264 - DNA, 13 bp, Homo sapiens
attataatgcaaa

SEQ ID NO: 5473265 - DNA, 15 bp, Homo sapiens
attataatgcaaatt

SEQ ID NO: 5473266 - DNA, 18 bp, Homo sapiens
attataatgcatctaaac

SEQ ID NO: 5473267 - DNA, 14 bp, Homo sapiens
caggagccagcagg

SEQ ID NO: 5473268 - DNA, 15 bp, Homo sapiens
caggagccagcaggg

SEQ ID NO: 5473269 - DNA, 14 bp, Homo sapiens
caggagccagcctg

SEQ ID NO: 5473270 - DNA, 19 bp, Homo sapiens
caggagccccagccagccc

SEQ ID NO: 5473271 - DNA, 17 bp, Homo sapiens
caggagcccccaacaca

SEQ ID NO: 5473272 - DNA, 19 bp, Homo sapiens
caggagcccccaacacagg

SEQ ID NO: 5473273 - DNA, 21 bp, Homo sapiens
caggagcccccaacacaggca

SEQ ID NO: 5473274 - DNA, 13 bp, Homo sapiens
caggagcccccct

SEQ ID NO: 5473275 - DNA, 14 bp, Homo sapiens
caggagccccccta

SEQ ID NO: 5473276 - DNA, 16 bp, Homo sapiens
caggagccccgaggcc

SEQ ID NO: 5473277 - DNA, 22 bp, Homo sapiens
caggagccccgaggccttctct

SEQ ID NO: 5473278 - DNA, 23 bp, Homo sapiens
caggagccccgaggccttctctg

SEQ ID NO: 5473279 - DNA, 15 bp, Homo sapiens
caggagccccgccac

SEQ ID NO: 5473280 - DNA, 20 bp, Homo sapiens
caggagccccgccaggtgcc

SEQ ID NO: 5473281 - DNA, 20 bp, Homo sapiens
caggagcccctggggctgta

SEQ ID NO: 5473282 - DNA, 11 bp, Homo sapiens
caggagccctg

SEQ ID NO: 5473283 - DNA, 13 bp, Homo sapiens
caggagccctgct

SEQ ID NO: 5473284 - DNA, 12 bp, Homo sapiens
caggagccctgg

SEQ ID NO: 5473285 - DNA, 15 bp, Homo sapiens
caggagccctggccc

SEQ ID NO: 5473286 - DNA, 16 bp, Homo sapiens
caggagccctggcccg

SEQ ID NO: 5473287 - DNA, 18 bp, Homo sapiens
caggagccgcagaggccc

SEQ ID NO: 5473288 - DNA, 20 bp, Homo sapiens
caggagccggacacttctca

SEQ ID NO: 5473289 - DNA, 12 bp, Homo sapiens
caggagcctaga

SEQ ID NO: 5473290 - DNA, 15 bp, Homo sapiens
caggagcctagagga

SEQ ID NO: 5473291 - DNA, 16 bp, Homo sapiens
caggagcctagcggag

SEQ ID NO: 5473292 - DNA, 20 bp, Homo sapiens
caggagcctagcggagccca

SEQ ID NO: 5473293 - DNA, 21 bp, Homo sapiens
caggagcctagcggagcccag

SEQ ID NO: 5473294 - DNA, 13 bp, Homo sapiens
caggagcctccct

SEQ ID NO: 5473295 - DNA, 14 bp, Homo sapiens
caggagcctccctg

SEQ ID NO: 5473296 - DNA, 21 bp, Homo sapiens
caggagcctccctgcacggcc

SEQ ID NO: 5473297 - DNA, 14 bp, Homo sapiens
caggagcctcctgc

SEQ ID NO: 5473298 - DNA, 17 bp, Homo sapiens
caggagcctcctgccct

SEQ ID NO: 5473299 - DNA, 20 bp, Homo sapiens
caggagcctcctgcccttac

SEQ ID NO: 5473300 - DNA, 20 bp, Homo sapiens
caggagcctcgtgtcctgct

SEQ ID NO: 5473301 - DNA, 11 bp, Homo sapiens
caggagcctgc

SEQ ID NO: 5473302 - DNA, 12 bp, Homo sapiens
caggagcctgct

SEQ ID NO: 5473303 - DNA, 15 bp, Homo sapiens
caggagcctgctaag

SEQ ID NO: 5473304 - DNA, 18 bp, Homo sapiens
caggagcctgctaaggaa

SEQ ID NO: 5473305 - DNA, 23 bp, Homo sapiens
caggagcctgctaaggaacaatg

SEQ ID NO: 5473306 - DNA, 21 bp, Homo sapiens
caggagcctggagggaagttg

SEQ ID NO: 5473307 - DNA, 13 bp, Homo sapiens
caggagcctggcc

SEQ ID NO: 5473308 - DNA, 16 bp, Homo sapiens
caggagcctggccagg

SEQ ID NO: 5473309 - DNA, 18 bp, Homo sapiens
caggagcctggccaggca

SEQ ID NO: 5473310 - DNA, 14 bp, Homo sapiens
caggagcctggtcc

SEQ ID NO: 5473311 - DNA, 14 bp, Homo sapiens
caggagcctgtgac

SEQ ID NO: 5473312 - DNA, 23 bp, Homo sapiens
caggagccttcctttctcctgcc

SEQ ID NO: 5473313 - DNA, 16 bp, Homo sapiens
caggagcgcagctgca

SEQ ID NO: 5473314 - DNA, 16 bp, Homo sapiens
caggagcgtgtactac

SEQ ID NO: 5473315 - DNA, 15 bp, Homo sapiens
caggagcgtgtccta

SEQ ID NO: 5473316 - DNA, 17 bp, Homo sapiens
caggagcgtgtcctatc

SEQ ID NO: 5473317 - DNA, 19 bp, Homo sapiens
caggagctagcccagtccc

SEQ ID NO: 5473318 - DNA, 23 bp, Homo sapiens
caggagctagcccagtccctgga

SEQ ID NO: 5473319 - DNA, 20 bp, Homo sapiens
caggagctagttctcagctt

SEQ ID NO: 5473320 - DNA, 13 bp, Homo sapiens
caggagctcagcc

SEQ ID NO: 5473321 - DNA, 18 bp, Homo sapiens
caggagctcccctcccca

SEQ ID NO: 5473322 - DNA, 19 bp, Homo sapiens
caggagctccctttttgaa

SEQ ID NO: 5473323 - DNA, 13 bp, Homo sapiens
caggagctcctgg

SEQ ID NO: 5473324 - DNA, 15 bp, Homo sapiens
caggagctcctggaa

SEQ ID NO: 5473325 - DNA, 14 bp, Homo sapiens
caggagctctctgc

SEQ ID NO: 5473326 - DNA, 18 bp, Homo sapiens
caggagctctctgctgag

SEQ ID NO: 5473327 - DNA, 13 bp, Homo sapiens
caggagctctgcg

SEQ ID NO: 5473328 - DNA, 18 bp, Homo sapiens
caggagctctgcgccagg

SEQ ID NO: 5473329 - DNA, 15 bp, Homo sapiens
caggagctcttcagg

SEQ ID NO: 5473330 - DNA, 18 bp, Homo sapiens
caggagctgacagagcca

SEQ ID NO: 5473331 - DNA, 21 bp, Homo sapiens
caggagctgacagagccagag

SEQ ID NO: 5473332 - DNA, 23 bp, Homo sapiens
caggagctgacagagccagaggc

SEQ ID NO: 5473333 - DNA, 24 bp, Homo sapiens
caggagctgacagagccagaggca

SEQ ID NO: 5473334 - DNA, 17 bp, Homo sapiens
caggagctgatggcagc

SEQ ID NO: 5473335 - DNA, 18 bp, Homo sapiens
caggagctgatggcagct

SEQ ID NO: 5473336 - DNA, 19 bp, Homo sapiens
caggagctgatggcagctg

SEQ ID NO: 5473337 - DNA, 20 bp, Homo sapiens
caggagctgatggcagctgg

SEQ ID NO: 5473338 - DNA, 13 bp, Homo sapiens
caggagctgctca

SEQ ID NO: 5473339 - DNA, 20 bp, Homo sapiens
caggagctgctcctggctga

SEQ ID NO: 5473340 - DNA, 14 bp, Homo sapiens
caggagctgggatc

SEQ ID NO: 5473341 - DNA, 20 bp, Homo sapiens
caggagcttattacagaaaa

SEQ ID NO: 5473342 - DNA, 12 bp, Homo sapiens
caggagcttcct

SEQ ID NO: 5473343 - DNA, 23 bp, Homo sapiens
caggagcttgggcagtgccccag

SEQ ID NO: 5473344 - DNA, 24 bp, Homo sapiens
caggagcttgggtctctctcggcc

SEQ ID NO: 5473345 - DNA, 17 bp, Homo sapiens
caggagctttggaccta

SEQ ID NO: 5473346 - DNA, 14 bp, Homo sapiens
caggagcttttgtg

SEQ ID NO: 5473347 - DNA, 13 bp, Homo sapiens
caggaggaactgg

SEQ ID NO: 5473348 - DNA, 16 bp, Homo sapiens
caggaggaatactgaa

SEQ ID NO: 5473349 - DNA, 15 bp, Homo sapiens
caggaggacaattca

SEQ ID NO: 5473350 - DNA, 16 bp, Homo sapiens
caggaggacaattcat

SEQ ID NO: 5473351 - DNA, 22 bp, Homo sapiens
caggaggacagagtgccctggg

SEQ ID NO: 5473352 - DNA, 16 bp, Homo sapiens
caggaggacaggtgga

SEQ ID NO: 5473353 - DNA, 17 bp, Homo sapiens
caggaggacccagggct

SEQ ID NO: 5473354 - DNA, 23 bp, Homo sapiens
caggaggacctggggggggcaag

SEQ ID NO: 5473355 - DNA, 17 bp, Homo sapiens
caggaggactgttctaa

SEQ ID NO: 5473356 - DNA, 22 bp, Homo sapiens
caggaggagaaaagaaatgcac

SEQ ID NO: 5473357 - DNA, 16 bp, Homo sapiens
caggaggagaccctcc

SEQ ID NO: 5473358 - DNA, 24 bp, Homo sapiens
caggaggagagagatgctgctccc

SEQ ID NO: 5473359 - DNA, 22 bp, Homo sapiens
caggaggagattaacacactga

SEQ ID NO: 5473360 - DNA, 23 bp, Homo sapiens
caggaggagctgcctcttctctt

SEQ ID NO: 5473361 - DNA, 18 bp, Homo sapiens
caggaggaggagatggcc

SEQ ID NO: 5473362 - DNA, 19 bp, Homo sapiens
caggaggaggattgtgctg

SEQ ID NO: 5473363 - DNA, 21 bp, Homo sapiens
caggaggaggctgccctgagg

SEQ ID NO: 5473364 - DNA, 17 bp, Homo sapiens
caggaggagtgggacag

SEQ ID NO: 5473365 - DNA, 18 bp, Homo sapiens
caggaggagtgggacaga

SEQ ID NO: 5473366 - DNA, 20 bp, Homo sapiens
caggaggatcccctgaggtc

SEQ ID NO: 5473367 - DNA, 16 bp, Homo sapiens
caggaggattccttgt

SEQ ID NO: 5473368 - DNA, 15 bp, Homo sapiens
caggaggattgcctt

SEQ ID NO: 5473369 - DNA, 23 bp, Homo sapiens
caggaggattgcttgagcccagg

SEQ ID NO: 5473370 - DNA, 20 bp, Homo sapiens
caggaggcaagcgtgttctc

SEQ ID NO: 5473371 - DNA, 23 bp, Homo sapiens
caggaggcaagcgtgttctcagc

SEQ ID NO: 5473372 - DNA, 14 bp, Homo sapiens
caggaggcagaagg

SEQ ID NO: 5473373 - DNA, 21 bp, Homo sapiens
caggaggcagagggttgcagt

SEQ ID NO: 5473374 - DNA, 23 bp, Homo sapiens
caggaggcaggcatggccctggg

SEQ ID NO: 5473375 - DNA, 19 bp, Homo sapiens
caggaggcagggaggcagc

SEQ ID NO: 5473376 - DNA, 13 bp, Homo sapiens
caggaggcagtgg

SEQ ID NO: 5473377 - DNA, 14 bp, Homo sapiens
caggaggcagtgga

SEQ ID NO: 5473378 - DNA, 21 bp, Homo sapiens
caggaggcatctggaaagggg

SEQ ID NO: 5473379 - DNA, 20 bp, Homo sapiens
caggaggccaaactgtccct

SEQ ID NO: 5473380 - DNA, 22 bp, Homo sapiens
caggaggccaataaaaagttca

SEQ ID NO: 5473381 - DNA, 12 bp, Homo sapiens
caggaggccagc

SEQ ID NO: 5473382 - DNA, 14 bp, Homo sapiens
caggaggccagcct

SEQ ID NO: 5473383 - DNA, 15 bp, Homo sapiens
caggaggccagcctt

SEQ ID NO: 5473384 - DNA, 17 bp, Homo sapiens
caggaggccagccttga

SEQ ID NO: 5473385 - DNA, 17 bp, Homo sapiens
caggaggccatgcccac

SEQ ID NO: 5473386 - DNA, 16 bp, Homo sapiens
caggaggccccaggct

SEQ ID NO: 5473387 - DNA, 16 bp, Homo sapiens
caggaggcccctggcc

SEQ ID NO: 5473388 - DNA, 17 bp, Homo sapiens
caggaggcccctggccc

SEQ ID NO: 5473389 - DNA, 18 bp, Homo sapiens
caggaggcccctggccca

SEQ ID NO: 5473390 - DNA, 20 bp, Homo sapiens
caggaggccctggtcctggc

SEQ ID NO: 5473391 - DNA, 13 bp, Homo sapiens
caggaggcccttg

SEQ ID NO: 5473392 - DNA, 19 bp, Homo sapiens
caggaggccggggccgggt

SEQ ID NO: 5473393 - DNA, 15 bp, Homo sapiens
caggaggcctgcacc

SEQ ID NO: 5473394 - DNA, 13 bp, Homo sapiens
caggaggcctggc

SEQ ID NO: 5473395 - DNA, 16 bp, Homo sapiens
caggaggcctggcctt

SEQ ID NO: 5473396 - DNA, 17 bp, Homo sapiens
caggaggcctggccttg

SEQ ID NO: 5473397 - DNA, 17 bp, Homo sapiens
caggaggcgaataaatg

SEQ ID NO: 5473398 - DNA, 19 bp, Homo sapiens
caggaggcgaataaatgtt

SEQ ID NO: 5473399 - DNA, 15 bp, Homo sapiens
caggaggcgcagccc

SEQ ID NO: 5473400 - DNA, 22 bp, Homo sapiens
caggaggcgcccttggcttctg

SEQ ID NO: 5473401 - DNA, 17 bp, Homo sapiens
caggaggctagcaaagc

SEQ ID NO: 5473402 - DNA, 14 bp, Homo sapiens
caggaggctccggc

SEQ ID NO: 5473403 - DNA, 20 bp, Homo sapiens
caggaggctccggcccacag

SEQ ID NO: 5473404 - DNA, 19 bp, Homo sapiens
caggaggctccgtgagccc

SEQ ID NO: 5473405 - DNA, 20 bp, Homo sapiens
caggaggctccgtgagccct

SEQ ID NO: 5473406 - DNA, 12 bp, Homo sapiens
caggaggctgag

SEQ ID NO: 5473407 - DNA, 17 bp, Homo sapiens
caggaggctgagacagg

SEQ ID NO: 5473408 - DNA, 21 bp, Homo sapiens
caggaggctgagacaggagaa

SEQ ID NO: 5473409 - DNA, 16 bp, Homo sapiens
caggaggctgaggcag

SEQ ID NO: 5473410 - DNA, 20 bp, Homo sapiens
caggaggctgaggcagaaga

SEQ ID NO: 5473411 - DNA, 17 bp, Homo sapiens
caggaggctgaggcagg

SEQ ID NO: 5473412 - DNA, 18 bp, Homo sapiens
caggaggctgaggcagga

SEQ ID NO: 5473413 - DNA, 15 bp, Homo sapiens
caggaggctgagggg

SEQ ID NO: 5473414 - DNA, 13 bp, Homo sapiens
caggaggctggag

SEQ ID NO: 5473415 - DNA, 22 bp, Homo sapiens
caggaggctgggacgctctgct

SEQ ID NO: 5473416 - DNA, 19 bp, Homo sapiens
caggaggctttaagctcca

SEQ ID NO: 5473417 - DNA, 21 bp, Homo sapiens
caggaggctttctgggctctg

SEQ ID NO: 5473418 - DNA, 19 bp, Homo sapiens
caggagggacaaaggagcc

SEQ ID NO: 5473419 - DNA, 20 bp, Homo sapiens
caggagggacaaaggagcct

SEQ ID NO: 5473420 - DNA, 24 bp, Homo sapiens
caggagggacaaaggagcctgtga

SEQ ID NO: 5473421 - DNA, 19 bp, Homo sapiens
cactgccttcgtttatatt

SEQ ID NO: 5473422 - DNA, 20 bp, Homo sapiens
cactgccttctcaactccaa

SEQ ID NO: 5473423 - DNA, 20 bp, Homo sapiens
cactgccttctcctctctgg

SEQ ID NO: 5473424 - DNA, 21 bp, Homo sapiens
cactgccttctcctctctggg

SEQ ID NO: 5473425 - DNA, 22 bp, Homo sapiens
cactgccttggcccctccctcc

SEQ ID NO: 5473426 - DNA, 13 bp, Homo sapiens
cactgcctttgct

SEQ ID NO: 5473427 - DNA, 22 bp, Homo sapiens
cactgcctttgctgccttctgt

SEQ ID NO: 5473428 - DNA, 12 bp, Homo sapiens
cactgccttttt

SEQ ID NO: 5473429 - DNA, 16 bp, Homo sapiens
cactgcgaactctcag

SEQ ID NO: 5473430 - DNA, 20 bp, Homo sapiens
cactgcgaagaccctcttgc

SEQ ID NO: 5473431 - DNA, 23 bp, Homo sapiens
cactgcgcaggtctcttctgggc

SEQ ID NO: 5473432 - DNA, 14 bp, Homo sapiens
cactgcggaagcca

SEQ ID NO: 5473433 - DNA, 16 bp, Homo sapiens
cactgcggaagccaaa

SEQ ID NO: 5473434 - DNA, 20 bp, Homo sapiens
cactgcggagaaccttgtgc

SEQ ID NO: 5473435 - DNA, 18 bp, Homo sapiens
cactgcgggagctctgta

SEQ ID NO: 5473436 - DNA, 21 bp, Homo sapiens
cactgcggggcttggctgaga

SEQ ID NO: 5473437 - DNA, 16 bp, Homo sapiens
cactgcggtgtctgca

SEQ ID NO: 5473438 - DNA, 19 bp, Homo sapiens
cactgcggtgtctgcagct

SEQ ID NO: 5473439 - DNA, 20 bp, Homo sapiens
cactgcgtagagcctggaag

SEQ ID NO: 5473440 - DNA, 20 bp, Homo sapiens
cactgctaaaatagaatata

SEQ ID NO: 5473441 - DNA, 18 bp, Homo sapiens
cactgctaaggctgctgg

SEQ ID NO: 5473442 - DNA, 21 bp, Homo sapiens
cactgctaaggctgctggctt

SEQ ID NO: 5473443 - DNA, 15 bp, Homo sapiens
cactgctaataaatg

SEQ ID NO: 5473444 - DNA, 16 bp, Homo sapiens
cccagaactggctggg

SEQ ID NO: 5473445 - DNA, 17 bp, Homo sapiens
cccagaactggctgggc

SEQ ID NO: 5473446 - DNA, 23 bp, Homo sapiens
cccagaactggctgggcccctgg

SEQ ID NO: 5473447 - DNA, 16 bp, Homo sapiens
cccagaacttccctga

SEQ ID NO: 5473448 - DNA, 19 bp, Homo sapiens
cccagaacttccctgattg

SEQ ID NO: 5473449 - DNA, 17 bp, Homo sapiens
cccagaactttgggagg

SEQ ID NO: 5473450 - DNA, 21 bp, Homo sapiens
cccagaactttgggaggccaa

SEQ ID NO: 5473451 - DNA, 20 bp, Homo sapiens
cccagaagcccagtaactgc

SEQ ID NO: 5473452 - DNA, 19 bp, Homo sapiens
cccagaaggacctcctgag

SEQ ID NO: 5473453 - DNA, 13 bp, Homo sapiens
cccagaagggagt

SEQ ID NO: 5473454 - DNA, 18 bp, Homo sapiens
cccagaagtccacaggac

SEQ ID NO: 5473455 - DNA, 19 bp, Homo sapiens
cccagaagtggctactgac

SEQ ID NO: 5473456 - DNA, 20 bp, Homo sapiens
cccagaagtggctactgact

SEQ ID NO: 5473457 - DNA, 16 bp, Homo sapiens
cccagaatcccagccg

SEQ ID NO: 5473458 - DNA, 19 bp, Homo sapiens
cccagaatcccagccggcc

SEQ ID NO: 5473459 - DNA, 16 bp, Homo sapiens
cccagaatctctgagc

SEQ ID NO: 5473460 - DNA, 20 bp, Homo sapiens
cccagaatctctgagccaac

SEQ ID NO: 5473461 - DNA, 12 bp, Homo sapiens
cccagaatgaga

SEQ ID NO: 5473462 - DNA, 20 bp, Homo sapiens
cccagaatgagacatccagc

SEQ ID NO: 5473463 - DNA, 17 bp, Homo sapiens
cccagaatgaggctgct

SEQ ID NO: 5473464 - DNA, 15 bp, Homo sapiens
cccagaatggagcct

SEQ ID NO: 5473465 - DNA, 19 bp, Homo sapiens
cccagaatggagcctgctc

SEQ ID NO: 5473466 - DNA, 20 bp, Homo sapiens
cccagaatggagcctgctct

SEQ ID NO: 5473467 - DNA, 21 bp, Homo sapiens
cccagaatttaccatcatctc

SEQ ID NO: 5473468 - DNA, 17 bp, Homo sapiens
cccagacaacagcccag

SEQ ID NO: 5473469 - DNA, 16 bp, Homo sapiens
cccagacaaggagagc

SEQ ID NO: 5473470 - DNA, 23 bp, Homo sapiens
cccagacacatcgcactgtggat

SEQ ID NO: 5473471 - DNA, 20 bp, Homo sapiens
cccagacagcaaggtgtgga

SEQ ID NO: 5473472 - DNA, 14 bp, Homo sapiens
cccagacagcagtg

SEQ ID NO: 5473473 - DNA, 16 bp, Homo sapiens
cccagacagctgctca

SEQ ID NO: 5473474 - DNA, 17 bp, Homo sapiens
cccagacagctggaccc

SEQ ID NO: 5473475 - DNA, 22 bp, Homo sapiens
cccagacaggccctccctgtct

SEQ ID NO: 5473476 - DNA, 13 bp, Homo sapiens
cccagacagggct

SEQ ID NO: 5473477 - DNA, 15 bp, Homo sapiens
cccagacagggctcc

SEQ ID NO: 5473478 - DNA, 16 bp, Homo sapiens
cccagacataaaggaa

SEQ ID NO: 5473479 - DNA, 13 bp, Homo sapiens
cccagacatgctg

SEQ ID NO: 5473480 - DNA, 20 bp, Homo sapiens
cccagaccaaccctgggacc

SEQ ID NO: 5473481 - DNA, 17 bp, Homo sapiens
cccagaccacctccctg

SEQ ID NO: 5473482 - DNA, 17 bp, Homo sapiens
cccagaccactgtctcc

SEQ ID NO: 5473483 - DNA, 19 bp, Homo sapiens
cccagaccagtagtgacca

SEQ ID NO: 5473484 - DNA, 20 bp, Homo sapiens
cccagaccagtagtgaccaa

SEQ ID NO: 5473485 - DNA, 21 bp, Homo sapiens
cccagaccagtagtgaccaat

SEQ ID NO: 5473486 - DNA, 19 bp, Homo sapiens
cccagacccagaggtccag

SEQ ID NO: 5473487 - DNA, 14 bp, Homo sapiens
cccagacccagggc

SEQ ID NO: 5473488 - DNA, 16 bp, Homo sapiens
cccagacccagggcag

SEQ ID NO: 5473489 - DNA, 22 bp, Homo sapiens
ccaaataaacggactcagtgga

SEQ ID NO: 5473490 - DNA, 16 bp, Homo sapiens
ccaaataaactcctta

SEQ ID NO: 5473491 - DNA, 23 bp, Homo sapiens
ccaaataaaggttttcactcctc

SEQ ID NO: 5473492 - DNA, 18 bp, Homo sapiens
ccaaataaagttaaaagt

SEQ ID NO: 5473493 - DNA, 15 bp, Homo sapiens
ccaaataaatgtgta

SEQ ID NO: 5473494 - DNA, 16 bp, Homo sapiens
ccaaataaatgtgtaa

SEQ ID NO: 5473495 - DNA, 15 bp, Homo sapiens
ccaaataagacagtt

SEQ ID NO: 5473496 - DNA, 17 bp, Homo sapiens
ccaaataatgtctctgt

SEQ ID NO: 5473497 - DNA, 16 bp, Homo sapiens
ccaaatacaagtacta

SEQ ID NO: 5473498 - DNA, 18 bp, Homo sapiens
ccaaatacaattcaaatg

SEQ ID NO: 5473499 - DNA, 20 bp, Homo sapiens
ccaaatacacatttcacatt

SEQ ID NO: 5473500 - DNA, 20 bp, Homo sapiens
ccaaatacctcaatttttgt

SEQ ID NO: 5473501 - DNA, 15 bp, Homo sapiens
ccaaatactctgaaa

SEQ ID NO: 5473502 - DNA, 18 bp, Homo sapiens
ccaaatagccaccttgat

SEQ ID NO: 5473503 - DNA, 23 bp, Homo sapiens
ccaaatagccccagactgggccc

SEQ ID NO: 5473504 - DNA, 13 bp, Homo sapiens
ccaaatagggcaa

SEQ ID NO: 5473505 - DNA, 20 bp, Homo sapiens
ccaaatagggcaaagaatca

SEQ ID NO: 5473506 - DNA, 16 bp, Homo sapiens
ccaaatataagacatt

SEQ ID NO: 5473507 - DNA, 20 bp, Homo sapiens
ccaaatatatgccttactat

SEQ ID NO: 5473508 - DNA, 19 bp, Homo sapiens
ccaaatatattctctttgg

SEQ ID NO: 5473509 - DNA, 16 bp, Homo sapiens
ccaaatatatttaatg

SEQ ID NO: 5473510 - DNA, 14 bp, Homo sapiens
ccaaatatgcactt

SEQ ID NO: 5473511 - DNA, 19 bp, Homo sapiens
ccaaatatgtattttccta

SEQ ID NO: 5473512 - DNA, 13 bp, Homo sapiens
ccaaatatgtcct

SEQ ID NO: 5473513 - DNA, 19 bp, Homo sapiens
ccaaatatgttaaagttta

SEQ ID NO: 5473514 - DNA, 20 bp, Homo sapiens
ccaaatattattcaagtgcc

SEQ ID NO: 5473515 - DNA, 15 bp, Homo sapiens
ccaaatattgatctg

SEQ ID NO: 5473516 - DNA, 16 bp, Homo sapiens
ccaaatattgatctgt

SEQ ID NO: 5473517 - DNA, 17 bp, Homo sapiens
ccaaatattgatctgta

SEQ ID NO: 5473518 - DNA, 22 bp, Homo sapiens
ccaaatatttgaaaggatggta

SEQ ID NO: 5473519 - DNA, 11 bp, Homo sapiens
ccaaatatttt

SEQ ID NO: 5473520 - DNA, 15 bp, Homo sapiens
ccaaatcaaaataaa

SEQ ID NO: 5473521 - DNA, 19 bp, Homo sapiens
ccaaatcaaaataaaagaa

SEQ ID NO: 5473522 - DNA, 16 bp, Homo sapiens
ccaaatcaaaatctct

SEQ ID NO: 5473523 - DNA, 18 bp, Homo sapiens
ccaaatcaaggataaata

SEQ ID NO: 5473524 - DNA, 19 bp, Homo sapiens
ccaaatcacccaatcccag

SEQ ID NO: 5473525 - DNA, 14 bp, Homo sapiens
ccaaatcaggctgg

SEQ ID NO: 5473526 - DNA, 15 bp, Homo sapiens
ccaaatcatcctgaa

SEQ ID NO: 5473527 - DNA, 17 bp, Homo sapiens
ccaaatcattgtatcaa

SEQ ID NO: 5473528 - DNA, 15 bp, Homo sapiens
ccaaatcccagggaa

SEQ ID NO: 5473529 - DNA, 16 bp, Homo sapiens
ccaaatcccagggaag

SEQ ID NO: 5473530 - DNA, 17 bp, Homo sapiens
ccaaatccgaacctcct

SEQ ID NO: 5473531 - DNA, 15 bp, Homo sapiens
ccaaatcctggaagg

SEQ ID NO: 5473532 - DNA, 19 bp, Homo sapiens
ccaaatctctcaaatctgt

SEQ ID NO: 5473533 - DNA, 18 bp, Homo sapiens
ccaaatctcttccacaag

SEQ ID NO: 5473534 - DNA, 13 bp, Homo sapiens
ccaaatctgccta

SEQ ID NO: 5473535 - DNA, 16 bp, Homo sapiens
ccaaatctgcctagaa

SEQ ID NO: 5473536 - DNA, 14 bp, Homo sapiens
ccaaatctggaagc

SEQ ID NO: 5473537 - DNA, 13 bp, Homo sapiens
ccaaatctgtcct

SEQ ID NO: 5473538 - DNA, 13 bp, Homo sapiens
ccaaatctgtcta

SEQ ID NO: 5473539 - DNA, 13 bp, Homo sapiens
ccaaatcttcttc

SEQ ID NO: 5473540 - DNA, 21 bp, Homo sapiens
ccaaatgaaatactgccttgg

SEQ ID NO: 5473541 - DNA, 18 bp, Homo sapiens
ccaaatgaaatatattta

SEQ ID NO: 5473542 - DNA, 23 bp, Homo sapiens
ccaaatgaaatgccaaaggaagt

SEQ ID NO: 5473543 - DNA, 23 bp, Homo sapiens
ccaaatgaagggacggctgtggg

SEQ ID NO: 5473544 - DNA, 15 bp, Homo sapiens
ccaaatgaccgagcc

SEQ ID NO: 5473545 - DNA, 19 bp, Homo sapiens
ccaaatgaccgagccctgg

SEQ ID NO: 5473546 - DNA, 20 bp, Homo sapiens
ccaaatgaccgagccctgga

SEQ ID NO: 5473547 - DNA, 19 bp, Homo sapiens
ccaaatgacttcatttctg

SEQ ID NO: 5473548 - DNA, 18 bp, Homo sapiens
ccaaatgactttgcacct

SEQ ID NO: 5473549 - DNA, 15 bp, Homo sapiens
ccaaatgcaatgtga

SEQ ID NO: 5473550 - DNA, 15 bp, Homo sapiens
ccaaatgcaatttga

SEQ ID NO: 5473551 - DNA, 17 bp, Homo sapiens
ccaaatgcacaagctca

SEQ ID NO: 5473552 - DNA, 13 bp, Homo sapiens
ccaaatgcagctt

SEQ ID NO: 5473553 - DNA, 16 bp, Homo sapiens
ccaaatgcagttcatt

SEQ ID NO: 5473554 - DNA, 23 bp, Homo sapiens
ccaaatgcagttcattgcagaca

SEQ ID NO: 5473555 - DNA, 22 bp, Homo sapiens
ccaaatgcatggtgcagttgac

SEQ ID NO: 5473556 - DNA, 15 bp, Homo sapiens
ccaaatgcccaagga

SEQ ID NO: 5473557 - DNA, 19 bp, Homo sapiens
ccaaatgcccaaggatgcc

SEQ ID NO: 5473558 - DNA, 16 bp, Homo sapiens
ccaaatgctggggcag

SEQ ID NO: 5473559 - DNA, 19 bp, Homo sapiens
ccaaatgctggggcagggg

SEQ ID NO: 5473560 - DNA, 23 bp, Homo sapiens
ccaaatgctgtcgggcaagatag

SEQ ID NO: 5473561 - DNA, 22 bp, Homo sapiens
ccaaatgctttaaaaactattt

SEQ ID NO: 5473562 - DNA, 22 bp, Homo sapiens
ccaaatggaaatgggcagagca

SEQ ID NO: 5473563 - DNA, 20 bp, Homo sapiens
ccaaatggagaagctgcagg

SEQ ID NO: 5473564 - DNA, 21 bp, Homo sapiens
ccaaatggagaagctgcaggc

SEQ ID NO: 5473565 - DNA, 19 bp, Homo sapiens
ccaaatggattcctgtttc

SEQ ID NO: 5473566 - DNA, 16 bp, Homo sapiens
ccaaatggccatttta

SEQ ID NO: 5473567 - DNA, 19 bp, Homo sapiens
ccaaatggctctgtgaaat

SEQ ID NO: 5473568 - DNA, 23 bp, Homo sapiens
ccaaatggttcttacttttcctg

SEQ ID NO: 5473569 - DNA, 15 bp, Homo sapiens
ccaaatgtccctcca

SEQ ID NO: 5473570 - DNA, 22 bp, Homo sapiens
ccaaatgtcggggttggggtgg

SEQ ID NO: 5473571 - DNA, 14 bp, Homo sapiens
ccaaatgtgaaaga

SEQ ID NO: 5473572 - DNA, 22 bp, Homo sapiens
ccaaatgtgtcttgtattatca

SEQ ID NO: 5473573 - DNA, 20 bp, Homo sapiens
ccaaatgtgtgcccagctta

SEQ ID NO: 5473574 - DNA, 17 bp, Homo sapiens
ccaaatgttaactgcca

SEQ ID NO: 5473575 - DNA, 15 bp, Homo sapiens
ccaaatgttcatcct

SEQ ID NO: 5473576 - DNA, 23 bp, Homo sapiens
ccaaatgtttacagggagcctcc

SEQ ID NO: 5473577 - DNA, 12 bp, Homo sapiens
ccaaattaaaaa

SEQ ID NO: 5473578 - DNA, 17 bp, Homo sapiens
ccaaattaaaaaagata

SEQ ID NO: 5473579 - DNA, 18 bp, Homo sapiens
ccaaattaaaaaagataa

SEQ ID NO: 5473580 - DNA, 16 bp, Homo sapiens
ccaaattaaaaatttt

SEQ ID NO: 5473581 - DNA, 14 bp, Homo sapiens
ccaaattaaaacaa

SEQ ID NO: 5473582 - DNA, 19 bp, Homo sapiens
ccaaattaaacgtaaatgt

SEQ ID NO: 5473583 - DNA, 23 bp, Homo sapiens
ccaaattaacctttcaggaaagt

SEQ ID NO: 5473584 - DNA, 19 bp, Homo sapiens
ccaaattaatcttttaaaa

SEQ ID NO: 5473585 - DNA, 20 bp, Homo sapiens
ccaaattacaagtattcagt

SEQ ID NO: 5473586 - DNA, 17 bp, Homo sapiens
ccaaattataagggccc

SEQ ID NO: 5473587 - DNA, 19 bp, Homo sapiens
ccaaattataagggccctg

SEQ ID NO: 5473588 - DNA, 21 bp, Homo sapiens
ccaaattataagggccctgcc

SEQ ID NO: 5473589 - DNA, 18 bp, Homo sapiens
ccaaattatgtgaaatgc

SEQ ID NO: 5473590 - DNA, 15 bp, Homo sapiens
ccaaattcaaaagta

SEQ ID NO: 5473591 - DNA, 12 bp, Homo sapiens
ccaaattcaaag

SEQ ID NO: 5473592 - DNA, 13 bp, Homo sapiens
ccaaattcaaaga

SEQ ID NO: 5473593 - DNA, 22 bp, Homo sapiens
ccaaattcaccttcccctaaac

SEQ ID NO: 5473594 - DNA, 18 bp, Homo sapiens
ccaaattcagtttcataa

SEQ ID NO: 5473595 - DNA, 13 bp, Homo sapiens
ccaaattcatata

SEQ ID NO: 5473596 - DNA, 15 bp, Homo sapiens
ccaaattccctcctc

SEQ ID NO: 5473597 - DNA, 16 bp, Homo sapiens
ccaaattccctctgga

SEQ ID NO: 5473598 - DNA, 17 bp, Homo sapiens
ccaaattccctctggag

SEQ ID NO: 5473599 - DNA, 13 bp, Homo sapiens
ccaaattctaaag

SEQ ID NO: 5473600 - DNA, 13 bp, Homo sapiens
ccaaattctctga

SEQ ID NO: 5473601 - DNA, 19 bp, Homo sapiens
ccaaattctgtggctgcca

SEQ ID NO: 5473602 - DNA, 19 bp, Homo sapiens
ccaaattgcactgaagttt

SEQ ID NO: 5473603 - DNA, 22 bp, Homo sapiens
ccaaattgctcctaagcttcaa

SEQ ID NO: 5473604 - DNA, 14 bp, Homo sapiens
ccaaattgcttcta

SEQ ID NO: 5473605 - DNA, 19 bp, Homo sapiens
ccaaattgcttgagcctgg

SEQ ID NO: 5473606 - DNA, 14 bp, Homo sapiens
ccaaattgtgcttc

SEQ ID NO: 5473607 - DNA, 16 bp, Homo sapiens
ccaaattgtgcttctc

SEQ ID NO: 5473608 - DNA, 20 bp, Homo sapiens
ccaaattgtgcttctcccca

SEQ ID NO: 5473609 - DNA, 16 bp, Homo sapiens
ccaaattgtgtatata

SEQ ID NO: 5473610 - DNA, 15 bp, Homo sapiens
ccaaatttaattaaa

SEQ ID NO: 5473611 - DNA, 21 bp, Homo sapiens
ccaaatttggctcacttgcct

SEQ ID NO: 5473612 - DNA, 22 bp, Homo sapiens
ccaaatttggctcacttgcctt

SEQ ID NO: 5473613 - DNA, 17 bp, Homo sapiens
ccaaattttaaaagcca

SEQ ID NO: 5473614 - DNA, 21 bp, Homo sapiens
ccaaattttagatttaccttg

SEQ ID NO: 5473615 - DNA, 19 bp, Homo sapiens
ccaaatttttttcttagga

SEQ ID NO: 5473616 - DNA, 11 bp, Homo sapiens
ccaacaaacca

SEQ ID NO: 5473617 - DNA, 16 bp, Homo sapiens
ccaacaaacctgcttg

SEQ ID NO: 5473618 - DNA, 12 bp, Homo sapiens
ccaacaaagctg

SEQ ID NO: 5473619 - DNA, 13 bp, Homo sapiens
ccaacaaagctgt

SEQ ID NO: 5473620 - DNA, 22 bp, Homo sapiens
ccaacaaagggttttaatgtag

SEQ ID NO: 5473621 - DNA, 22 bp, Homo sapiens
cccagccaccttcctgactggg

SEQ ID NO: 5473622 - DNA, 18 bp, Homo sapiens
cccagccacgactgccat

SEQ ID NO: 5473623 - DNA, 19 bp, Homo sapiens
cccagccacgactgccatg

SEQ ID NO: 5473624 - DNA, 22 bp, Homo sapiens
cccagccacggacgctggctcc

SEQ ID NO: 5473625 - DNA, 18 bp, Homo sapiens
cccagccactccaagccc

SEQ ID NO: 5473626 - DNA, 12 bp, Homo sapiens
cccagccagaaa

SEQ ID NO: 5473627 - DNA, 20 bp, Homo sapiens
cccagccagcagttcagagc

SEQ ID NO: 5473628 - DNA, 14 bp, Homo sapiens
cccagccagccacc

SEQ ID NO: 5473629 - DNA, 15 bp, Homo sapiens
cccagccagccaccc

SEQ ID NO: 5473630 - DNA, 15 bp, Homo sapiens
cccagccagcccttc

SEQ ID NO: 5473631 - DNA, 11 bp, Homo sapiens
cccagccagcg

SEQ ID NO: 5473632 - DNA, 17 bp, Homo sapiens
cccagccagctcctttc

SEQ ID NO: 5473633 - DNA, 13 bp, Homo sapiens
cccagccagctgc

SEQ ID NO: 5473634 - DNA, 14 bp, Homo sapiens
cccagccagctgca

SEQ ID NO: 5473635 - DNA, 16 bp, Homo sapiens
cccagccagctgcagg

SEQ ID NO: 5473636 - DNA, 22 bp, Homo sapiens
cccagccagctgcagggcacgg

SEQ ID NO: 5473637 - DNA, 12 bp, Homo sapiens
cccagccaggcc

SEQ ID NO: 5473638 - DNA, 15 bp, Homo sapiens
cccagccaggcccag

SEQ ID NO: 5473639 - DNA, 17 bp, Homo sapiens
cccagccaggcccagcc

SEQ ID NO: 5473640 - DNA, 13 bp, Homo sapiens
cccagccaggcta

SEQ ID NO: 5473641 - DNA, 18 bp, Homo sapiens
cccagccaggctatggtt

SEQ ID NO: 5473642 - DNA, 22 bp, Homo sapiens
cccagccagttggtggggccag

SEQ ID NO: 5473643 - DNA, 24 bp, Homo sapiens
cccagccataaaagcattgtctct

SEQ ID NO: 5473644 - DNA, 18 bp, Homo sapiens
cccagccatctgcccagg

SEQ ID NO: 5473645 - DNA, 21 bp, Homo sapiens
cccagccatctgcccaggggt

SEQ ID NO: 5473646 - DNA, 22 bp, Homo sapiens
cccagccatctgcccaggggtg

SEQ ID NO: 5473647 - DNA, 23 bp, Homo sapiens
cccagccatctgcccaggggtgc

SEQ ID NO: 5473648 - DNA, 17 bp, Homo sapiens
cccagccatgccagctg

SEQ ID NO: 5473649 - DNA, 13 bp, Homo sapiens
cccagccatgccc

SEQ ID NO: 5473650 - DNA, 14 bp, Homo sapiens
cccagccatgccca

SEQ ID NO: 5473651 - DNA, 16 bp, Homo sapiens
cccagccatgcccagg

SEQ ID NO: 5473652 - DNA, 12 bp, Homo sapiens
cccagccatggg

SEQ ID NO: 5473653 - DNA, 14 bp, Homo sapiens
cccagccatggtga

SEQ ID NO: 5473654 - DNA, 12 bp, Homo sapiens
cccagccatgtg

SEQ ID NO: 5473655 - DNA, 10 bp, Homo sapiens
cccagccatt

SEQ ID NO: 5473656 - DNA, 18 bp, Homo sapiens
cccagccattaccatgga

SEQ ID NO: 5473657 - DNA, 20 bp, Homo sapiens
cccagccattaccatggaga

SEQ ID NO: 5473658 - DNA, 9 bp, Homo sapiens
cccagccca

SEQ ID NO: 5473659 - DNA, 16 bp, Homo sapiens
cccagcccaaagctgt

SEQ ID NO: 5473660 - DNA, 19 bp, Homo sapiens
cccagcccaaaggggacag

SEQ ID NO: 5473661 - DNA, 22 bp, Homo sapiens
cccagcccaaccgggaaaggca

SEQ ID NO: 5473662 - DNA, 14 bp, Homo sapiens
cccagcccaagaga

SEQ ID NO: 5473663 - DNA, 17 bp, Homo sapiens
cccagcccaagagatga

SEQ ID NO: 5473664 - DNA, 14 bp, Homo sapiens
cccagcccaagtcc

SEQ ID NO: 5473665 - DNA, 12 bp, Homo sapiens
cccagcccaata

SEQ ID NO: 5473666 - DNA, 21 bp, Homo sapiens
cccagcccaataaaggtccct

SEQ ID NO: 5473667 - DNA, 12 bp, Homo sapiens
cccagcccaatc

SEQ ID NO: 5473668 - DNA, 19 bp, Homo sapiens
cccagcccacagagcctga

SEQ ID NO: 5473669 - DNA, 11 bp, Homo sapiens
cccagcccacc

SEQ ID NO: 5473670 - DNA, 15 bp, Homo sapiens
cccagcccacccccg

SEQ ID NO: 5473671 - DNA, 15 bp, Homo sapiens
cccagcccaccctcc

SEQ ID NO: 5473672 - DNA, 18 bp, Homo sapiens
ccaacctgcaaagatctg

SEQ ID NO: 5473673 - DNA, 12 bp, Homo sapiens
ccaacctgctct

SEQ ID NO: 5473674 - DNA, 13 bp, Homo sapiens
ccaacctgctctc

SEQ ID NO: 5473675 - DNA, 13 bp, Homo sapiens
ccaacctggacaa

SEQ ID NO: 5473676 - DNA, 12 bp, Homo sapiens
ccaacctggact

SEQ ID NO: 5473677 - DNA, 13 bp, Homo sapiens
ccaacctggactt

SEQ ID NO: 5473678 - DNA, 18 bp, Homo sapiens
ccaacctggacttcctgt

SEQ ID NO: 5473679 - DNA, 12 bp, Homo sapiens
ccaacctggagg

SEQ ID NO: 5473680 - DNA, 13 bp, Homo sapiens
ccaacctggaggc

SEQ ID NO: 5473681 - DNA, 17 bp, Homo sapiens
ccaacctggaggctgga

SEQ ID NO: 5473682 - DNA, 20 bp, Homo sapiens
ccaacctggaggctggacca

SEQ ID NO: 5473683 - DNA, 16 bp, Homo sapiens
ccaacctggtaattat

SEQ ID NO: 5473684 - DNA, 17 bp, Homo sapiens
ccaacctggtaattatc

SEQ ID NO: 5473685 - DNA, 16 bp, Homo sapiens
ccaacctgtaataaat

SEQ ID NO: 5473686 - DNA, 18 bp, Homo sapiens
ccaacctgtaataaatat

SEQ ID NO: 5473687 - DNA, 21 bp, Homo sapiens
ccaacctgtaataaatatgag

SEQ ID NO: 5473688 - DNA, 13 bp, Homo sapiens
ccaacctgtttct

SEQ ID NO: 5473689 - DNA, 23 bp, Homo sapiens
ccaaccttagatgttctaagtct

SEQ ID NO: 5473690 - DNA, 21 bp, Homo sapiens
ccaaccttcacatctgtcacg

SEQ ID NO: 5473691 - DNA, 17 bp, Homo sapiens
ccaaccttgctcttggg

SEQ ID NO: 5473692 - DNA, 19 bp, Homo sapiens
ccaaccttgctcttgggga

SEQ ID NO: 5473693 - DNA, 12 bp, Homo sapiens
ccaacctttctg

SEQ ID NO: 5473694 - DNA, 14 bp, Homo sapiens
ccaacctttctgac

SEQ ID NO: 5473695 - DNA, 15 bp, Homo sapiens
ccaacgaaaagcaca

SEQ ID NO: 5473696 - DNA, 17 bp, Homo sapiens
ccaacgacccatgaccg

SEQ ID NO: 5473697 - DNA, 20 bp, Homo sapiens
ccaacgagacacattgcctt

SEQ ID NO: 5473698 - DNA, 14 bp, Homo sapiens
ccaacgagcctcct

SEQ ID NO: 5473699 - DNA, 13 bp, Homo sapiens
ccaacgcacagga

SEQ ID NO: 5473700 - DNA, 13 bp, Homo sapiens
ccaacgcccctgt

SEQ ID NO: 5473701 - DNA, 16 bp, Homo sapiens
ccaacgcccctgtggc

SEQ ID NO: 5473702 - DNA, 12 bp, Homo sapiens
ccaacgccgcct

SEQ ID NO: 5473703 - DNA, 23 bp, Homo sapiens
ccaacgccgccttggccttgcag

SEQ ID NO: 5473704 - DNA, 19 bp, Homo sapiens
ccaacgcctcctgtcccca

SEQ ID NO: 5473705 - DNA, 15 bp, Homo sapiens
ccaacgctccaaagt

SEQ ID NO: 5473706 - DNA, 16 bp, Homo sapiens
ccaacgtcccctccgc

SEQ ID NO: 5473707 - DNA, 15 bp, Homo sapiens
ccaacgtctgtgcca

SEQ ID NO: 5473708 - DNA, 16 bp, Homo sapiens
ccaacgtctgtgccat

SEQ ID NO: 5473709 - DNA, 20 bp, Homo sapiens
ccaacgtgcaaagccaaggc

SEQ ID NO: 5473710 - DNA, 21 bp, Homo sapiens
ccaacgtgcaaagccaaggca

SEQ ID NO: 5473711 - DNA, 17 bp, Homo sapiens
ccaacgtggacctgcct

SEQ ID NO: 5473712 - DNA, 16 bp, Homo sapiens
ccaacgtggggcagca

SEQ ID NO: 5473713 - DNA, 19 bp, Homo sapiens
ccaacgttaaaagacagtg

SEQ ID NO: 5473714 - DNA, 19 bp, Homo sapiens
ccaacgttcgatttctacc

SEQ ID NO: 5473715 - DNA, 20 bp, Homo sapiens
ccaacgttcgatttctacct

SEQ ID NO: 5473716 - DNA, 21 bp, Homo sapiens
ccaacgtttggaagatcctgt

SEQ ID NO: 5473717 - DNA, 22 bp, Homo sapiens
ccaacgtttggaagatcctgtg

SEQ ID NO: 5473718 - DNA, 23 bp, Homo sapiens
ccaacgtttggaagatcctgtga

SEQ ID NO: 5473719 - DNA, 19 bp, Homo sapiens
ccaactaacaagaaactca

SEQ ID NO: 5473720 - DNA, 14 bp, Homo sapiens
ccaactaagccctc

SEQ ID NO: 5473721 - DNA, 22 bp, Homo sapiens
ccaactacaaccaagctctctg

SEQ ID NO: 5473722 - DNA, 23 bp, Homo sapiens
ccaactacacacccccaagccac

SEQ ID NO: 5473723 - DNA, 13 bp, Homo sapiens
ccaactactgagc

SEQ ID NO: 5473724 - DNA, 22 bp, Homo sapiens
ccaactactgtgttatgcaaaa

SEQ ID NO: 5473725 - DNA, 15 bp, Homo sapiens
ccaactagcccctgg

SEQ ID NO: 5473726 - DNA, 15 bp, Homo sapiens
ccaactagctgggac

SEQ ID NO: 5473727 - DNA, 14 bp, Homo sapiens
ccaactatccaagt

SEQ ID NO: 5473728 - DNA, 18 bp, Homo sapiens
ccaactattaaagtgcca

SEQ ID NO: 5473729 - DNA, 16 bp, Homo sapiens
ccaactatttcaataa

SEQ ID NO: 5473730 - DNA, 22 bp, Homo sapiens
ccaactcaagtgtcacctcctt

SEQ ID NO: 5473731 - DNA, 17 bp, Homo sapiens
ccaactcaccccagccc

SEQ ID NO: 5473732 - DNA, 19 bp, Homo sapiens
ccaactcagcctgttcctt

SEQ ID NO: 5473733 - DNA, 16 bp, Homo sapiens
ccaactccaacatcca

SEQ ID NO: 5473734 - DNA, 15 bp, Homo sapiens
ccaactccacaccct

SEQ ID NO: 5473735 - DNA, 15 bp, Homo sapiens
ccaactccacagggc

SEQ ID NO: 5473736 - DNA, 14 bp, Homo sapiens
ccaactccagcaac

SEQ ID NO: 5473737 - DNA, 12 bp, Homo sapiens
ccaactccagga

SEQ ID NO: 5473738 - DNA, 11 bp, Homo sapiens
ccaactccagt

SEQ ID NO: 5473739 - DNA, 19 bp, Homo sapiens
ccaactccatactccactc

SEQ ID NO: 5473740 - DNA, 22 bp, Homo sapiens
ccaactccatggggttcgagac

SEQ ID NO: 5473741 - DNA, 23 bp, Homo sapiens
ccaactccatggggttcgagact

SEQ ID NO: 5473742 - DNA, 14 bp, Homo sapiens
ccaactcccagcca

SEQ ID NO: 5473743 - DNA, 14 bp, Homo sapiens
ccaactccctctct

SEQ ID NO: 5473744 - DNA, 19 bp, Homo sapiens
ccaactccctgccattttt

SEQ ID NO: 5473745 - DNA, 18 bp, Homo sapiens
ccaactcccttctgcttg

SEQ ID NO: 5473746 - DNA, 20 bp, Homo sapiens
ccaactccgcccagcctctc

SEQ ID NO: 5473747 - DNA, 16 bp, Homo sapiens
ccaactcctaatttta

SEQ ID NO: 5473748 - DNA, 13 bp, Homo sapiens
ccaactcctaccg

SEQ ID NO: 5473749 - DNA, 13 bp, Homo sapiens
ccaactcctcctt

SEQ ID NO: 5473750 - DNA, 15 bp, Homo sapiens
ccaactcctggaagc

SEQ ID NO: 5473751 - DNA, 12 bp, Homo sapiens
ccaactccttcc

SEQ ID NO: 5473752 - DNA, 18 bp, Homo sapiens
ccaactcctttcagccac

SEQ ID NO: 5473753 - DNA, 15 bp, Homo sapiens
ccaactcgggagcat

SEQ ID NO: 5473754 - DNA, 19 bp, Homo sapiens
ccaactcgggctcccgggt

SEQ ID NO: 5473755 - DNA, 21 bp, Homo sapiens
ccaactctaaagccaagcact

SEQ ID NO: 5473756 - DNA, 12 bp, Homo sapiens
ccaactctaata

SEQ ID NO: 5473757 - DNA, 13 bp, Homo sapiens
ccaactctcccca

SEQ ID NO: 5473758 - DNA, 14 bp, Homo sapiens
ccaactctccccag

SEQ ID NO: 5473759 - DNA, 19 bp, Homo sapiens
ccaactctctctgccccca

SEQ ID NO: 5473760 - DNA, 14 bp, Homo sapiens
ccaactctctctgt

SEQ ID NO: 5473761 - DNA, 12 bp, Homo sapiens
ccaactctggcc

SEQ ID NO: 5473762 - DNA, 18 bp, Homo sapiens
ccaactctggccttggtt

SEQ ID NO: 5473763 - DNA, 19 bp, Homo sapiens
ccaactcttcattttgagt

SEQ ID NO: 5473764 - DNA, 12 bp, Homo sapiens
ccaactcttcct

SEQ ID NO: 5473765 - DNA, 18 bp, Homo sapiens
ccaactgaagccttcttc

SEQ ID NO: 5473766 - DNA, 16 bp, Homo sapiens
ccaactgacctgccag

SEQ ID NO: 5473767 - DNA, 13 bp, Homo sapiens
ccaactgacttct

SEQ ID NO: 5473768 - DNA, 21 bp, Homo sapiens
ccaactgacttgtatctgtcc

SEQ ID NO: 5473769 - DNA, 20 bp, Homo sapiens
ccaactgatcctgctccagc

SEQ ID NO: 5473770 - DNA, 21 bp, Homo sapiens
ccaactgatcctgctccagca

SEQ ID NO: 5473771 - DNA, 17 bp, Homo sapiens
ccaactgccagaacatg

SEQ ID NO: 5473772 - DNA, 12 bp, Homo sapiens
ccaactgcccta

SEQ ID NO: 5473773 - DNA, 16 bp, Homo sapiens
ccaactgctccagcct

SEQ ID NO: 5473774 - DNA, 20 bp, Homo sapiens
ccaactgctccagcctctgc

SEQ ID NO: 5473775 - DNA, 12 bp, Homo sapiens
ccaactgctgct

SEQ ID NO: 5473776 - DNA, 18 bp, Homo sapiens
ccaactgctttgttttgg

SEQ ID NO: 5473777 - DNA, 16 bp, Homo sapiens
ccaactggccctcttc

SEQ ID NO: 5473778 - DNA, 13 bp, Homo sapiens
ccaactggcttct

SEQ ID NO: 5473779 - DNA, 16 bp, Homo sapiens
ccaactgggcccaaga

SEQ ID NO: 5473780 - DNA, 17 bp, Homo sapiens
ccaactgggcccaagac

SEQ ID NO: 5473781 - DNA, 14 bp, Homo sapiens
ccaactgggcctct

SEQ ID NO: 5473782 - DNA, 13 bp, Homo sapiens
ccaactgtatata

SEQ ID NO: 5473783 - DNA, 21 bp, Homo sapiens
ccaactgtccctttgtttgaa

SEQ ID NO: 5473784 - DNA, 23 bp, Homo sapiens
ccaactgtccctttgtttgaagt

SEQ ID NO: 5473785 - DNA, 19 bp, Homo sapiens
ccaactgtggtagctccag

SEQ ID NO: 5473786 - DNA, 21 bp, Homo sapiens
ccaactgtgttgtattaacaa

SEQ ID NO: 5473787 - DNA, 14 bp, Homo sapiens
ccaactgttggaat

SEQ ID NO: 5473788 - DNA, 18 bp, Homo sapiens
ccaactgtttccctgctg

SEQ ID NO: 5473789 - DNA, 20 bp, Homo sapiens
ccaactgtttccctgctgaa

SEQ ID NO: 5473790 - DNA, 21 bp, Homo sapiens
ccaacttagtgtctctattta

SEQ ID NO: 5473791 - DNA, 18 bp, Homo sapiens
ccaacttcaccaccccct

SEQ ID NO: 5473792 - DNA, 21 bp, Homo sapiens
ccaacttcatttgatgctaaa

SEQ ID NO: 5473793 - DNA, 13 bp, Homo sapiens
ccaacttcccagt

SEQ ID NO: 5473794 - DNA, 17 bp, Homo sapiens
ccaacttccctgttctt

SEQ ID NO: 5473795 - DNA, 16 bp, Homo sapiens
ccaacttcctgtggcc

SEQ ID NO: 5473796 - DNA, 14 bp, Homo sapiens
ccaacttctcccac

SEQ ID NO: 5473797 - DNA, 16 bp, Homo sapiens
ccaacttctcccaccc

SEQ ID NO: 5473798 - DNA, 18 bp, Homo sapiens
ccaacttctcccacccct

SEQ ID NO: 5473799 - DNA, 19 bp, Homo sapiens
ccaacttcttcagagctga

SEQ ID NO: 5473800 - DNA, 16 bp, Homo sapiens
ccaacttcttcctgtg

SEQ ID NO: 5473801 - DNA, 10 bp, Homo sapiens
ccaacttgag

SEQ ID NO: 5473802 - DNA, 15 bp, Homo sapiens
cgatgatgggctgga

SEQ ID NO: 5473803 - DNA, 16 bp, Homo sapiens
cgatgattcaggtgca

SEQ ID NO: 5473804 - DNA, 17 bp, Homo sapiens
cgatgattcaggtgcag

SEQ ID NO: 5473805 - DNA, 15 bp, Homo sapiens
cgatgcaatgaacac

SEQ ID NO: 5473806 - DNA, 20 bp, Homo sapiens
cgatgcactcgcactgcaaa

SEQ ID NO: 5473807 - DNA, 14 bp, Homo sapiens
cgatgcatttaata

SEQ ID NO: 5473808 - DNA, 19 bp, Homo sapiens
cgatgcatttaataaagat

SEQ ID NO: 5473809 - DNA, 24 bp, Homo sapiens
cgatgcatttaataaagatgagtt

SEQ ID NO: 5473810 - DNA, 19 bp, Homo sapiens
cgatgcccgcccggggagt

SEQ ID NO: 5473811 - DNA, 22 bp, Homo sapiens
cgatgccgtgtgtctcgtctcc

SEQ ID NO: 5473812 - DNA, 19 bp, Homo sapiens
cgatgcctgcaggcatgga

SEQ ID NO: 5473813 - DNA, 18 bp, Homo sapiens
cgatgcctggcctgccag

SEQ ID NO: 5473814 - DNA, 18 bp, Homo sapiens
cgatgcgtattctgtggc

SEQ ID NO: 5473815 - DNA, 16 bp, Homo sapiens
cgatgcgtattttagt

SEQ ID NO: 5473816 - DNA, 22 bp, Homo sapiens
cgatgctccctcagcctcagag

SEQ ID NO: 5473817 - DNA, 23 bp, Homo sapiens
cgatgctccctcagcctcagagg

SEQ ID NO: 5473818 - DNA, 23 bp, Homo sapiens
cgatgctgacctcacctggtcct

SEQ ID NO: 5473819 - DNA, 16 bp, Homo sapiens
cgatggacctcagcaa

SEQ ID NO: 5473820 - DNA, 17 bp, Homo sapiens
cgatggacctcagcaag

SEQ ID NO: 5473821 - DNA, 22 bp, Homo sapiens
cgatggacctcagcaagctgcc

SEQ ID NO: 5473822 - DNA, 14 bp, Homo sapiens
cgatggagccccca

SEQ ID NO: 5473823 - DNA, 21 bp, Homo sapiens
cgatggatccgtgacagcact

SEQ ID NO: 5473824 - DNA, 14 bp, Homo sapiens
cgatggcaggcctg

SEQ ID NO: 5473825 - DNA, 19 bp, Homo sapiens
cgatggcaggcctgaccca

SEQ ID NO: 5473826 - DNA, 22 bp, Homo sapiens
cgatgggagggatggcccttcc

SEQ ID NO: 5473827 - DNA, 21 bp, Homo sapiens
cgatgggggatgcttcatgtg

SEQ ID NO: 5473828 - DNA, 17 bp, Homo sapiens
cgatggtcccaggaagc

SEQ ID NO: 5473829 - DNA, 17 bp, Homo sapiens
cgatggtctctctccct

SEQ ID NO: 5473830 - DNA, 15 bp, Homo sapiens
cgatgtacagtatca

SEQ ID NO: 5473831 - DNA, 21 bp, Homo sapiens
cgatgtcaaaggtcgggacag

SEQ ID NO: 5473832 - DNA, 21 bp, Homo sapiens
cgatgtcaaccttgtgtgagt

SEQ ID NO: 5473833 - DNA, 23 bp, Homo sapiens
cgatgtcactcagccccttcccg

SEQ ID NO: 5473834 - DNA, 13 bp, Homo sapiens
cgatgtcccctgc

SEQ ID NO: 5473835 - DNA, 21 bp, Homo sapiens
cgatgtccctgtcccctcctc

SEQ ID NO: 5473836 - DNA, 13 bp, Homo sapiens
cgatgtgctcagc

SEQ ID NO: 5473837 - DNA, 15 bp, Homo sapiens
cgatgtggaactgct

SEQ ID NO: 5473838 - DNA, 11 bp, Homo sapiens
cgatgtggccc

SEQ ID NO: 5473839 - DNA, 17 bp, Homo sapiens
cgatgtggccctggcct

SEQ ID NO: 5473840 - DNA, 18 bp, Homo sapiens
cgatgtggtcacagctgt

SEQ ID NO: 5473841 - DNA, 15 bp, Homo sapiens
cgatgtgtctcccag

SEQ ID NO: 5473842 - DNA, 17 bp, Homo sapiens
cgatgttattagatgtt

SEQ ID NO: 5473843 - DNA, 13 bp, Homo sapiens
cgatgttgtattg

SEQ ID NO: 5473844 - DNA, 13 bp, Homo sapiens
cgatgttgtgatg

SEQ ID NO: 5473845 - DNA, 19 bp, Homo sapiens
cgatgtttgtgtcacacaa

SEQ ID NO: 5473846 - DNA, 21 bp, Homo sapiens
cgattaagagacagagaatct

SEQ ID NO: 5473847 - DNA, 16 bp, Homo sapiens
cgattaatttatggtt

SEQ ID NO: 5473848 - DNA, 18 bp, Homo sapiens
cgattaatttatggtttc

SEQ ID NO: 5473849 - DNA, 11 bp, Homo sapiens
cgattagactg

SEQ ID NO: 5473850 - DNA, 15 bp, Homo sapiens
cgattagtgatgtcc

SEQ ID NO: 5473851 - DNA, 14 bp, Homo sapiens
cgattatacttgag

SEQ ID NO: 5473852 - DNA, 13 bp, Homo sapiens
cgattcacagcct

SEQ ID NO: 5473853 - DNA, 14 bp, Homo sapiens
cgattcacagcctc

SEQ ID NO: 5473854 - DNA, 15 bp, Homo sapiens
cgattcacagcctcc

SEQ ID NO: 5473855 - DNA, 21 bp, Homo sapiens
cgattcaccctgtccaaactg

SEQ ID NO: 5473856 - DNA, 18 bp, Homo sapiens
cgattccctctcccaggc

SEQ ID NO: 5473857 - DNA, 21 bp, Homo sapiens
cgattccgatcgactgccaag

SEQ ID NO: 5473858 - DNA, 17 bp, Homo sapiens
cgattcctccagccctg

SEQ ID NO: 5473859 - DNA, 13 bp, Homo sapiens
cgattccttctct

SEQ ID NO: 5473860 - DNA, 15 bp, Homo sapiens
cgattctcctgcctc

SEQ ID NO: 5473861 - DNA, 11 bp, Homo sapiens
cgattctggat

SEQ ID NO: 5473862 - DNA, 19 bp, Homo sapiens
cgattcttccttgccacaa

SEQ ID NO: 5473863 - DNA, 21 bp, Homo sapiens
cgattcttctgcttcagcctc

SEQ ID NO: 5473864 - DNA, 19 bp, Homo sapiens
cgattgacctgtcctcttt

SEQ ID NO: 5473865 - DNA, 21 bp, Homo sapiens
cgattgacctgtcctctttgt

SEQ ID NO: 5473866 - DNA, 18 bp, Homo sapiens
cgattgattgatgtacag

SEQ ID NO: 5473867 - DNA, 22 bp, Homo sapiens
cgattgattgatgtacagaaca

SEQ ID NO: 5473868 - DNA, 19 bp, Homo sapiens
cgattggagaatactttgc

SEQ ID NO: 5473869 - DNA, 14 bp, Homo sapiens
cgattggccacctg

SEQ ID NO: 5473870 - DNA, 12 bp, Homo sapiens
cgattgtatttg

SEQ ID NO: 5473871 - DNA, 21 bp, Homo sapiens
cgattgtgtacttttcctttg

SEQ ID NO: 5473872 - DNA, 17 bp, Homo sapiens
cgatttaaactccagca

SEQ ID NO: 5473873 - DNA, 14 bp, Homo sapiens
cgatttaattctct

SEQ ID NO: 5473874 - DNA, 13 bp, Homo sapiens
cgatttcctaagc

SEQ ID NO: 5473875 - DNA, 15 bp, Homo sapiens
cgatttcctaagctg

SEQ ID NO: 5473876 - DNA, 21 bp, Homo sapiens
cgatttcctaagctgttggaa

SEQ ID NO: 5473877 - DNA, 14 bp, Homo sapiens
cgatttctttcctc

SEQ ID NO: 5473878 - DNA, 15 bp, Homo sapiens
cgatttgggggctcg

SEQ ID NO: 5473879 - DNA, 14 bp, Homo sapiens
cgattttattactg

SEQ ID NO: 5473880 - DNA, 16 bp, Homo sapiens
cgattttattactggc

SEQ ID NO: 5473881 - DNA, 18 bp, Homo sapiens
cgattttcaagattctaa

SEQ ID NO: 5473882 - DNA, 13 bp, Homo sapiens
cgattttgtatct

SEQ ID NO: 5473883 - DNA, 17 bp, Homo sapiens
cgattttgtatctgcag

SEQ ID NO: 5473884 - DNA, 13 bp, Homo sapiens
cgatttttaagag

SEQ ID NO: 5473885 - DNA, 20 bp, Homo sapiens
cgcaaaccccctttgtgctg

SEQ ID NO: 5473886 - DNA, 21 bp, Homo sapiens
cgcaaagcaagggggaaggct

SEQ ID NO: 5473887 - DNA, 23 bp, Homo sapiens
cgcaaagggcatgggtcgggaga

SEQ ID NO: 5473888 - DNA, 14 bp, Homo sapiens
cgcaaagggcgggc

SEQ ID NO: 5473889 - DNA, 19 bp, Homo sapiens
cgcaaagggctgaaagcca

SEQ ID NO: 5473890 - DNA, 18 bp, Homo sapiens
cgcaacaacaaggaccct

SEQ ID NO: 5473891 - DNA, 17 bp, Homo sapiens
cgcaaccaagtgtgcta

SEQ ID NO: 5473892 - DNA, 13 bp, Homo sapiens
cgcaacccacagc

SEQ ID NO: 5473893 - DNA, 14 bp, Homo sapiens
cgcaacccacagct

SEQ ID NO: 5473894 - DNA, 19 bp, Homo sapiens
cgcaacccgtgccaagtcc

SEQ ID NO: 5473895 - DNA, 17 bp, Homo sapiens
cgcaacccttgctgctg

SEQ ID NO: 5473896 - DNA, 18 bp, Homo sapiens
cgcaacccttgctgctgc

SEQ ID NO: 5473897 - DNA, 20 bp, Homo sapiens
cgcaacccttgctgctgccc

SEQ ID NO: 5473898 - DNA, 18 bp, Homo sapiens
cgcaacgtctaactggac

SEQ ID NO: 5473899 - DNA, 17 bp, Homo sapiens
cgcaactcacacctcct

SEQ ID NO: 5473900 - DNA, 16 bp, Homo sapiens
cgcaacttcccaggcc

SEQ ID NO: 5473901 - DNA, 17 bp, Homo sapiens
cgcaagagggacagagc

SEQ ID NO: 5473902 - DNA, 19 bp, Homo sapiens
cgcaagagggacagagccc

SEQ ID NO: 5473903 - DNA, 16 bp, Homo sapiens
cgcaagagggtctctt

SEQ ID NO: 5473904 - DNA, 21 bp, Homo sapiens
cgcaagcaccatcccctccgg

SEQ ID NO: 5473905 - DNA, 13 bp, Homo sapiens
cgcaagccacagc

SEQ ID NO: 5473906 - DNA, 15 bp, Homo sapiens
cgcaagccacagcct

SEQ ID NO: 5473907 - DNA, 17 bp, Homo sapiens
cgcaagccacagcctgt

SEQ ID NO: 5473908 - DNA, 21 bp, Homo sapiens
cgcaagcgacacaggctgccg

SEQ ID NO: 5473909 - DNA, 21 bp, Homo sapiens
cgcaagcgcagggaggatgcc

SEQ ID NO: 5473910 - DNA, 19 bp, Homo sapiens
cgcaaggaaggacttaccc

SEQ ID NO: 5473911 - DNA, 22 bp, Homo sapiens
cgcaaggatcacttgagcccag

SEQ ID NO: 5473912 - DNA, 14 bp, Homo sapiens
cgcaaggccctgtc

SEQ ID NO: 5473913 - DNA, 21 bp, Homo sapiens
cgcaaggcctctcagacccag

SEQ ID NO: 5473914 - DNA, 16 bp, Homo sapiens
cgcaaggcctgtgctg

SEQ ID NO: 5473915 - DNA, 14 bp, Homo sapiens
cgcaaggctgtgct

SEQ ID NO: 5473916 - DNA, 16 bp, Homo sapiens
cgcaagggcatcaggc

SEQ ID NO: 5473917 - DNA, 14 bp, Homo sapiens
cgcaagggcctgat

SEQ ID NO: 5473918 - DNA, 17 bp, Homo sapiens
cgcaaggggaccgcccc

SEQ ID NO: 5473919 - DNA, 15 bp, Homo sapiens
cgcaagtccccagcc

SEQ ID NO: 5473920 - DNA, 14 bp, Homo sapiens
cgcaagtctgcagc

SEQ ID NO: 5473921 - DNA, 15 bp, Homo sapiens
cgcaagtctgcagcc

SEQ ID NO: 5473922 - DNA, 16 bp, Homo sapiens
cgcaagttaacttgga

SEQ ID NO: 5473923 - DNA, 21 bp, Homo sapiens
cgcaatatgggaggaacaaag

SEQ ID NO: 5473924 - DNA, 21 bp, Homo sapiens
cgcaatccgagccagctctgg

SEQ ID NO: 5473925 - DNA, 20 bp, Homo sapiens
cgcaatctcagctcactgca

SEQ ID NO: 5473926 - DNA, 20 bp, Homo sapiens
cgcaatctcggctcactgca

SEQ ID NO: 5473927 - DNA, 11 bp, Homo sapiens
cgcaatgtgac

SEQ ID NO: 5473928 - DNA, 18 bp, Homo sapiens
cgcaatgtgcccccagac

SEQ ID NO: 5473929 - DNA, 23 bp, Homo sapiens
cgcaattctcgattctttgaaga

SEQ ID NO: 5473930 - DNA, 20 bp, Homo sapiens
cgcaattgtatatatatgtg

SEQ ID NO: 5473931 - DNA, 22 bp, Homo sapiens
cgcaattgtgggatgtcctctt

SEQ ID NO: 5473932 - DNA, 15 bp, Homo sapiens
cgcacaaacacacac

SEQ ID NO: 5473933 - DNA, 18 bp, Homo sapiens
cgcacaaacacacacact

SEQ ID NO: 5473934 - DNA, 13 bp, Homo sapiens
cgcacaaggacat

SEQ ID NO: 5473935 - DNA, 19 bp, Homo sapiens
cgcacaatctacactgcct

SEQ ID NO: 5473936 - DNA, 10 bp, Homo sapiens
cgcacacaca

SEQ ID NO: 5473937 - DNA, 17 bp, Homo sapiens
cgcacacacacatacag

SEQ ID NO: 5473938 - DNA, 12 bp, Homo sapiens
cgcacacacacc

SEQ ID NO: 5473939 - DNA, 12 bp, Homo sapiens
cgcacacagggc

SEQ ID NO: 5473940 - DNA, 15 bp, Homo sapiens
cgcacacagggctca

SEQ ID NO: 5473941 - DNA, 20 bp, Homo sapiens
cgcacacagggctcacaggg

SEQ ID NO: 5473942 - DNA, 22 bp, Homo sapiens
cgcacacagggctcacagggca

SEQ ID NO: 5473943 - DNA, 20 bp, Homo sapiens
cgcacaccctcactctgcca

SEQ ID NO: 5473944 - DNA, 16 bp, Homo sapiens
cgcacacctctggctg

SEQ ID NO: 5473945 - DNA, 15 bp, Homo sapiens
cgcacactggggccc

SEQ ID NO: 5473946 - DNA, 20 bp, Homo sapiens
cgcacagaaggaaggagcca

SEQ ID NO: 5473947 - DNA, 10 bp, Homo sapiens
cgcacagcag

SEQ ID NO: 5473948 - DNA, 20 bp, Homo sapiens
cgcacagcagcctgcttccc

SEQ ID NO: 5473949 - DNA, 13 bp, Homo sapiens
cgcacagcagttc

SEQ ID NO: 5473950 - DNA, 19 bp, Homo sapiens
cgcacagcatgagaggctc

SEQ ID NO: 5473951 - DNA, 17 bp, Homo sapiens
cgcacaggtgctgacct

SEQ ID NO: 5473952 - DNA, 21 bp, Homo sapiens
cgcacagtggacggaggtccc

SEQ ID NO: 5473953 - DNA, 12 bp, Homo sapiens
cgcacatataca

SEQ ID NO: 5473954 - DNA, 20 bp, Homo sapiens
cgcaccaaaactatcctgat

SEQ ID NO: 5473955 - DNA, 15 bp, Homo sapiens
cgcaccaatcagcac

SEQ ID NO: 5473956 - DNA, 18 bp, Homo sapiens
cgcaccactgcactccag

SEQ ID NO: 5473957 - DNA, 22 bp, Homo sapiens
cgcaccactgcactccagcctg

SEQ ID NO: 5473958 - DNA, 12 bp, Homo sapiens
cgcaccactgct

SEQ ID NO: 5473959 - DNA, 16 bp, Homo sapiens
cgcaccactgcttccc

SEQ ID NO: 5473960 - DNA, 17 bp, Homo sapiens
cgcaccactgcttccca

SEQ ID NO: 5473961 - DNA, 13 bp, Homo sapiens
cgcaccagctgct

SEQ ID NO: 5473962 - DNA, 23 bp, Homo sapiens
cgcaccagctgctctgccccttg

SEQ ID NO: 5473963 - DNA, 15 bp, Homo sapiens
cgcaccattctgact

SEQ ID NO: 5473964 - DNA, 19 bp, Homo sapiens
cgcaccattgcactccagc

SEQ ID NO: 5473965 - DNA, 16 bp, Homo sapiens
cgcaccattttgtcag

SEQ ID NO: 5473966 - DNA, 18 bp, Homo sapiens
cgcacccacaccctacag

SEQ ID NO: 5473967 - DNA, 22 bp, Homo sapiens
cgcacccacaccctacagcaga

SEQ ID NO: 5473968 - DNA, 13 bp, Homo sapiens
cgcaccccacagc

SEQ ID NO: 5473969 - DNA, 14 bp, Homo sapiens
cgcaccccacagct

SEQ ID NO: 5473970 - DNA, 13 bp, Homo sapiens
cgcaccccatccc

SEQ ID NO: 5473971 - DNA, 14 bp, Homo sapiens
cgcacccccaccct

SEQ ID NO: 5473972 - DNA, 19 bp, Homo sapiens
cgcacccccaccctttggg

SEQ ID NO: 5473973 - DNA, 23 bp, Homo sapiens
cgcacccccactttcgcctcctc

SEQ ID NO: 5473974 - DNA, 14 bp, Homo sapiens
cgcacccccctgtt

SEQ ID NO: 5473975 - DNA, 10 bp, Homo sapiens
cgcacccccg

SEQ ID NO: 5473976 - DNA, 16 bp, Homo sapiens
cgcacccccgccaggc

SEQ ID NO: 5473977 - DNA, 19 bp, Homo sapiens
cgcacccccgccaggcgca

SEQ ID NO: 5473978 - DNA, 19 bp, Homo sapiens
cgcaccccggcctcagggc

SEQ ID NO: 5473979 - DNA, 17 bp, Homo sapiens
cgcacccctcctccttg

SEQ ID NO: 5473980 - DNA, 18 bp, Homo sapiens
cgcaccctgcacctgctg

SEQ ID NO: 5473981 - DNA, 19 bp, Homo sapiens
cgccagcgtgtggagcaga

SEQ ID NO: 5473982 - DNA, 15 bp, Homo sapiens
cgccagctgatgact

SEQ ID NO: 5473983 - DNA, 16 bp, Homo sapiens
cgccagctgatgactc

SEQ ID NO: 5473984 - DNA, 17 bp, Homo sapiens
cgccagctgatgactca

SEQ ID NO: 5473985 - DNA, 20 bp, Homo sapiens
cgccagctgggagcactggt

SEQ ID NO: 5473986 - DNA, 17 bp, Homo sapiens
cgccagcttctcctgcg

SEQ ID NO: 5473987 - DNA, 14 bp, Homo sapiens
cgccaggaagccag

SEQ ID NO: 5473988 - DNA, 15 bp, Homo sapiens
cgccaggaagccaga

SEQ ID NO: 5473989 - DNA, 16 bp, Homo sapiens
cgccaggaagccagag

SEQ ID NO: 5473990 - DNA, 21 bp, Homo sapiens
cgccaggaagccagagcccca

SEQ ID NO: 5473991 - DNA, 14 bp, Homo sapiens
cgccaggacagcag

SEQ ID NO: 5473992 - DNA, 15 bp, Homo sapiens
cgccaggacagcagc

SEQ ID NO: 5473993 - DNA, 16 bp, Homo sapiens
cgccaggacagcagca

SEQ ID NO: 5473994 - DNA, 18 bp, Homo sapiens
cgccaggacagcagcact

SEQ ID NO: 5473995 - DNA, 12 bp, Homo sapiens
cgccaggactgt

SEQ ID NO: 5473996 - DNA, 14 bp, Homo sapiens
cgccaggagaagtt

SEQ ID NO: 5473997 - DNA, 19 bp, Homo sapiens
cgccaggaggtcctcctct

SEQ ID NO: 5473998 - DNA, 20 bp, Homo sapiens
cgccaggaggtcctcctctc

SEQ ID NO: 5473999 - DNA, 19 bp, Homo sapiens
cgccaggatggcgcaggaa

SEQ ID NO: 5474000 - DNA, 14 bp, Homo sapiens
cgccaggcagagct

SEQ ID NO: 5474001 - DNA, 23 bp, Homo sapiens
cgccaggcagagctgagggccct

SEQ ID NO: 5474002 - DNA, 18 bp, Homo sapiens
cgccaggcgcatgtctgc

SEQ ID NO: 5474003 - DNA, 20 bp, Homo sapiens
cgccaggcgcatgtctgcac

SEQ ID NO: 5474004 - DNA, 16 bp, Homo sapiens
cgccaggctgaccaca

SEQ ID NO: 5474005 - DNA, 17 bp, Homo sapiens
cgccagggaccccagaa

SEQ ID NO: 5474006 - DNA, 19 bp, Homo sapiens
cgccagggaccccagaatc

SEQ ID NO: 5474007 - DNA, 16 bp, Homo sapiens
cgccagggagacctgg

SEQ ID NO: 5474008 - DNA, 16 bp, Homo sapiens
cgccagggcccaggcc

SEQ ID NO: 5474009 - DNA, 17 bp, Homo sapiens
cgccagggcccaggcca

SEQ ID NO: 5474010 - DNA, 13 bp, Homo sapiens
cgccagggctggg

SEQ ID NO: 5474011 - DNA, 21 bp, Homo sapiens
cgccaggggcaggcagctagg

SEQ ID NO: 5474012 - DNA, 13 bp, Homo sapiens
cgccataggccaa

SEQ ID NO: 5474013 - DNA, 17 bp, Homo sapiens
cgccatcaaggtccagt

SEQ ID NO: 5474014 - DNA, 18 bp, Homo sapiens
cgccatcaaggtccagtg

SEQ ID NO: 5474015 - DNA, 20 bp, Homo sapiens
cgccatcccagccccaatga

SEQ ID NO: 5474016 - DNA, 12 bp, Homo sapiens
cgccatcctctg

SEQ ID NO: 5474017 - DNA, 20 bp, Homo sapiens
cgccatccttcaccagagcc

SEQ ID NO: 5474018 - DNA, 21 bp, Homo sapiens
cgccatctgatccccatgcct

SEQ ID NO: 5474019 - DNA, 22 bp, Homo sapiens
cgccatggggtcggctcctgat

SEQ ID NO: 5474020 - DNA, 14 bp, Homo sapiens
cgccatggtgtccc

SEQ ID NO: 5474021 - DNA, 18 bp, Homo sapiens
cgccatgtgctgtgcacc

SEQ ID NO: 5474022 - DNA, 17 bp, Homo sapiens
cgccattgcactccagc

SEQ ID NO: 5474023 - DNA, 21 bp, Homo sapiens
cgccattgcactccagcctgg

SEQ ID NO: 5474024 - DNA, 20 bp, Homo sapiens
cgccattgcactcccgcctg

SEQ ID NO: 5474025 - DNA, 17 bp, Homo sapiens
cgccattgccaccagga

SEQ ID NO: 5474026 - DNA, 18 bp, Homo sapiens
cgccattgccaccaggag

SEQ ID NO: 5474027 - DNA, 14 bp, Homo sapiens
cgccattggcctta

SEQ ID NO: 5474028 - DNA, 23 bp, Homo sapiens
cgccattggccttaactggccct

SEQ ID NO: 5474029 - DNA, 18 bp, Homo sapiens
cgccattgtactccagcc

SEQ ID NO: 5474030 - DNA, 22 bp, Homo sapiens
cgccattgtactccagcctggg

SEQ ID NO: 5474031 - DNA, 17 bp, Homo sapiens
cgcccaaagccagacag

SEQ ID NO: 5474032 - DNA, 17 bp, Homo sapiens
cgcccaaaggacgcact

SEQ ID NO: 5474033 - DNA, 22 bp, Homo sapiens
cgcccaaaggacgcactgagca

SEQ ID NO: 5474034 - DNA, 17 bp, Homo sapiens
cgcccaacccccacctc

SEQ ID NO: 5474035 - DNA, 14 bp, Homo sapiens
cgcccaacccttcc

SEQ ID NO: 5474036 - DNA, 16 bp, Homo sapiens
cgcccaacccttcccc

SEQ ID NO: 5474037 - DNA, 13 bp, Homo sapiens
cgcccaactccac

SEQ ID NO: 5474038 - DNA, 13 bp, Homo sapiens
cgcccaaggctgc

SEQ ID NO: 5474039 - DNA, 14 bp, Homo sapiens
cgcccaaggggact

SEQ ID NO: 5474040 - DNA, 22 bp, Homo sapiens
cgcccacaagccttactcacct

SEQ ID NO: 5474041 - DNA, 22 bp, Homo sapiens
cgcccacaggaagcctgcagtc

SEQ ID NO: 5474042 - DNA, 22 bp, Homo sapiens
cgcccaccagccttgctctctt

SEQ ID NO: 5474043 - DNA, 15 bp, Homo sapiens
cgcccacccacaccc

SEQ ID NO: 5474044 - DNA, 14 bp, Homo sapiens
cgcccacccagctg

SEQ ID NO: 5474045 - DNA, 23 bp, Homo sapiens
cgcccacccccagtctccaggga

SEQ ID NO: 5474046 - DNA, 19 bp, Homo sapiens
cgcccaccccgctctgcat

SEQ ID NO: 5474047 - DNA, 16 bp, Homo sapiens
cgcccaccccgctgcc

SEQ ID NO: 5474048 - DNA, 16 bp, Homo sapiens
cgcccacccgagtacc

SEQ ID NO: 5474049 - DNA, 17 bp, Homo sapiens
cgcccacccgccttgtg

SEQ ID NO: 5474050 - DNA, 15 bp, Homo sapiens
cgcccaccctgggct

SEQ ID NO: 5474051 - DNA, 13 bp, Homo sapiens
cgcccaccgcatg

SEQ ID NO: 5474052 - DNA, 17 bp, Homo sapiens
cgcccaccgcatgcccc

SEQ ID NO: 5474053 - DNA, 19 bp, Homo sapiens
cgcccaccgtgggcagtgc

SEQ ID NO: 5474054 - DNA, 23 bp, Homo sapiens
cgcccaccgtgggcagtgccacc

SEQ ID NO: 5474055 - DNA, 22 bp, Homo sapiens
cgcccacctaaagggaagccct

SEQ ID NO: 5474056 - DNA, 22 bp, Homo sapiens
cgcccacctcagcctcccaaag

SEQ ID NO: 5474057 - DNA, 23 bp, Homo sapiens
cgcccacctcgctcccctctgga

SEQ ID NO: 5474058 - DNA, 16 bp, Homo sapiens
cgcccacctctgctgc

SEQ ID NO: 5474059 - DNA, 18 bp, Homo sapiens
cgcccacctctgctgccc

SEQ ID NO: 5474060 - DNA, 16 bp, Homo sapiens
cgcccacctgcatcag

SEQ ID NO: 5474061 - DNA, 12 bp, Homo sapiens
cgcccacctgcc

SEQ ID NO: 5474062 - DNA, 12 bp, Homo sapiens
cgcccacctgtg

SEQ ID NO: 5474063 - DNA, 22 bp, Homo sapiens
cgcccacgcggctgctgcttct

SEQ ID NO: 5474064 - DNA, 13 bp, Homo sapiens
cgcccactcctgg

SEQ ID NO: 5474065 - DNA, 18 bp, Homo sapiens
cgcccactgtcctgggcg

SEQ ID NO: 5474066 - DNA, 12 bp, Homo sapiens
cgcccacttccc

SEQ ID NO: 5474067 - DNA, 18 bp, Homo sapiens
cgcccagacaccacagac

SEQ ID NO: 5474068 - DNA, 21 bp, Homo sapiens
cgcccagacaccatgtgcaat

SEQ ID NO: 5474069 - DNA, 22 bp, Homo sapiens
cgcccagagacccaagctgcct

SEQ ID NO: 5474070 - DNA, 13 bp, Homo sapiens
cgcccagagctgg

SEQ ID NO: 5474071 - DNA, 14 bp, Homo sapiens
cgcccagagctggc

SEQ ID NO: 5474072 - DNA, 14 bp, Homo sapiens
cgcccagcagaggc

SEQ ID NO: 5474073 - DNA, 15 bp, Homo sapiens
cgcccagcagcctgc

SEQ ID NO: 5474074 - DNA, 17 bp, Homo sapiens
cgcccagcagcctgcca

SEQ ID NO: 5474075 - DNA, 16 bp, Homo sapiens
cgcccagcccaggcct

SEQ ID NO: 5474076 - DNA, 17 bp, Homo sapiens
cgcccagcccaggcctg

SEQ ID NO: 5474077 - DNA, 19 bp, Homo sapiens
cgcccagcccaggcctggt

SEQ ID NO: 5474078 - DNA, 14 bp, Homo sapiens
cgcccagccccatc

SEQ ID NO: 5474079 - DNA, 13 bp, Homo sapiens
cgcccagccccca

SEQ ID NO: 5474080 - DNA, 15 bp, Homo sapiens
cgcccagcccccacc

SEQ ID NO: 5474081 - DNA, 12 bp, Homo sapiens
cgcccagctccg

SEQ ID NO: 5474082 - DNA, 15 bp, Homo sapiens
cgcccagctcctgac

SEQ ID NO: 5474083 - DNA, 16 bp, Homo sapiens
cgcccagctcctgaca

SEQ ID NO: 5474084 - DNA, 18 bp, Homo sapiens
cgcccagctgaggctggg

SEQ ID NO: 5474085 - DNA, 15 bp, Homo sapiens
cgcccaggagacatc

SEQ ID NO: 5474086 - DNA, 21 bp, Homo sapiens
cgcccaggatgaaggggccag

SEQ ID NO: 5474087 - DNA, 18 bp, Homo sapiens
cgcccaggccagtgctgt

SEQ ID NO: 5474088 - DNA, 21 bp, Homo sapiens
cgcccaggccagtgctgtgag

SEQ ID NO: 5474089 - DNA, 11 bp, Homo sapiens
cgcccaggcct

SEQ ID NO: 5474090 - DNA, 17 bp, Homo sapiens
cgcccaggcctgctggc

SEQ ID NO: 5474091 - DNA, 23 bp, Homo sapiens
cgcccaggcctgctggcatcagg

SEQ ID NO: 5474092 - DNA, 21 bp, Homo sapiens
cgcccaggcctgggatgcagt

SEQ ID NO: 5474093 - DNA, 13 bp, Homo sapiens
cgcccaggctgga

SEQ ID NO: 5474094 - DNA, 20 bp, Homo sapiens
cgcccaggctggagtgcagt

SEQ ID NO: 5474095 - DNA, 15 bp, Homo sapiens
cgcccaggctggcca

SEQ ID NO: 5474096 - DNA, 19 bp, Homo sapiens
cgcccaggctggccagccc

SEQ ID NO: 5474097 - DNA, 14 bp, Homo sapiens
cgcccagtcccagc

SEQ ID NO: 5474098 - DNA, 17 bp, Homo sapiens
cgcccagtcccagcagc

SEQ ID NO: 5474099 - DNA, 23 bp, Homo sapiens
cgcccagttgggtggatgcctgg

SEQ ID NO: 5474100 - DNA, 14 bp, Homo sapiens
cgcccatctcagga

SEQ ID NO: 5474101 - DNA, 20 bp, Homo sapiens
cgcccatgagagcgcagccc

SEQ ID NO: 5474102 - DNA, 18 bp, Homo sapiens
cgcccatgcactggggac

SEQ ID NO: 5474103 - DNA, 14 bp, Homo sapiens
cgcccatgctgtcc

SEQ ID NO: 5474104 - DNA, 15 bp, Homo sapiens
cgcccatgctgtccg

SEQ ID NO: 5474105 - DNA, 22 bp, Homo sapiens
cgcccattcgtctgtcccagag

SEQ ID NO: 5474106 - DNA, 16 bp, Homo sapiens
cgccccaaccctcgga

SEQ ID NO: 5474107 - DNA, 18 bp, Homo sapiens
cgccccaactccaacctc

SEQ ID NO: 5474108 - DNA, 13 bp, Homo sapiens
cgccccacagggc

SEQ ID NO: 5474109 - DNA, 13 bp, Homo sapiens
cgccccacccaga

SEQ ID NO: 5474110 - DNA, 13 bp, Homo sapiens
cgccccacctccc

SEQ ID NO: 5474111 - DNA, 17 bp, Homo sapiens
cgccccagagactgccc

SEQ ID NO: 5474112 - DNA, 21 bp, Homo sapiens
cgccccagagactgcccaccc

SEQ ID NO: 5474113 - DNA, 12 bp, Homo sapiens
cgccccagagct

SEQ ID NO: 5474114 - DNA, 20 bp, Homo sapiens
cgccccagataccagcccct

SEQ ID NO: 5474115 - DNA, 11 bp, Homo sapiens
cgccccagcct

SEQ ID NO: 5474116 - DNA, 13 bp, Homo sapiens
cgccccagcctcc

SEQ ID NO: 5474117 - DNA, 15 bp, Homo sapiens
cgccccagcctcctg

SEQ ID NO: 5474118 - DNA, 14 bp, Homo sapiens
cgccccagcctctg

SEQ ID NO: 5474119 - DNA, 21 bp, Homo sapiens
cgccccagcgacgcggcccgc

SEQ ID NO: 5474120 - DNA, 10 bp, Homo sapiens
cgccccaggc

SEQ ID NO: 5474121 - DNA, 14 bp, Homo sapiens
cgccccaggcccca

SEQ ID NO: 5474122 - DNA, 16 bp, Homo sapiens
cgccccaggccccagc

SEQ ID NO: 5474123 - DNA, 14 bp, Homo sapiens
cgccccagggtctg

SEQ ID NO: 5474124 - DNA, 15 bp, Homo sapiens
cgccccatgggccct

SEQ ID NO: 5474125 - DNA, 13 bp, Homo sapiens
cctcctcagccag

SEQ ID NO: 5474126 - DNA, 17 bp, Homo sapiens
cctcctcagccagcctc

SEQ ID NO: 5474127 - DNA, 13 bp, Homo sapiens
cctcctcagcctc

SEQ ID NO: 5474128 - DNA, 19 bp, Homo sapiens
cctcctcagcctctgcaac

SEQ ID NO: 5474129 - DNA, 14 bp, Homo sapiens
cctcctcagcctga

SEQ ID NO: 5474130 - DNA, 20 bp, Homo sapiens
cctcctcagcgagaggcagc

SEQ ID NO: 5474131 - DNA, 12 bp, Homo sapiens
cctcctcagctc

SEQ ID NO: 5474132 - DNA, 13 bp, Homo sapiens
cctcctcagctcc

SEQ ID NO: 5474133 - DNA, 14 bp, Homo sapiens
cctcctcaggggca

SEQ ID NO: 5474134 - DNA, 14 bp, Homo sapiens
cctcctcagggggt

SEQ ID NO: 5474135 - DNA, 16 bp, Homo sapiens
cctcctcatcagtgtg

SEQ ID NO: 5474136 - DNA, 19 bp, Homo sapiens
cctcctccaagaagccctc

SEQ ID NO: 5474137 - DNA, 15 bp, Homo sapiens
cctcctccacaccag

SEQ ID NO: 5474138 - DNA, 13 bp, Homo sapiens
cctcctccacagc

SEQ ID NO: 5474139 - DNA, 20 bp, Homo sapiens
cctcctccacagtgctgctt

SEQ ID NO: 5474140 - DNA, 18 bp, Homo sapiens
cctcctccaccaccgccc

SEQ ID NO: 5474141 - DNA, 12 bp, Homo sapiens
cctcctccactc

SEQ ID NO: 5474142 - DNA, 13 bp, Homo sapiens
cctcctccactca

SEQ ID NO: 5474143 - DNA, 16 bp, Homo sapiens
cctcctccactctccc

SEQ ID NO: 5474144 - DNA, 16 bp, Homo sapiens
cctcctccagagcctg

SEQ ID NO: 5474145 - DNA, 12 bp, Homo sapiens
cctcctccagcc

SEQ ID NO: 5474146 - DNA, 12 bp, Homo sapiens
cctcctccagct

SEQ ID NO: 5474147 - DNA, 13 bp, Homo sapiens
cctcctccaggga

SEQ ID NO: 5474148 - DNA, 15 bp, Homo sapiens
cctcctccagggaca

SEQ ID NO: 5474149 - DNA, 20 bp, Homo sapiens
cctcctccagggtgatttta

SEQ ID NO: 5474150 - DNA, 12 bp, Homo sapiens
cctcctccagta

SEQ ID NO: 5474151 - DNA, 14 bp, Homo sapiens
cctcctccatcacc

SEQ ID NO: 5474152 - DNA, 20 bp, Homo sapiens
cctcctccatcacctgaaac

SEQ ID NO: 5474153 - DNA, 22 bp, Homo sapiens
cctcctccatgctgtccctgtg

SEQ ID NO: 5474154 - DNA, 15 bp, Homo sapiens
cctcctcccaaggca

SEQ ID NO: 5474155 - DNA, 19 bp, Homo sapiens
cctcctcccacccggctgc

SEQ ID NO: 5474156 - DNA, 14 bp, Homo sapiens
cctcctcccactgc

SEQ ID NO: 5474157 - DNA, 15 bp, Homo sapiens
cctcctcccactggg

SEQ ID NO: 5474158 - DNA, 13 bp, Homo sapiens
cctcctcccaggg

SEQ ID NO: 5474159 - DNA, 19 bp, Homo sapiens
cctcctcccagggcctcct

SEQ ID NO: 5474160 - DNA, 21 bp, Homo sapiens
cctcctcccatccagcgtctg

SEQ ID NO: 5474161 - DNA, 12 bp, Homo sapiens
cctcctcccatg

SEQ ID NO: 5474162 - DNA, 17 bp, Homo sapiens
ctccagggtcccctgcc

SEQ ID NO: 5474163 - DNA, 21 bp, Homo sapiens
ctccagggtctaaagagaaca

SEQ ID NO: 5474164 - DNA, 16 bp, Homo sapiens
ctccagggtcttgggc

SEQ ID NO: 5474165 - DNA, 23 bp, Homo sapiens
ctccagggtcttgggctactggc

SEQ ID NO: 5474166 - DNA, 22 bp, Homo sapiens
ctccagggtgacaaggcctgct

SEQ ID NO: 5474167 - DNA, 23 bp, Homo sapiens
ctccaggtattcgttatctaata

SEQ ID NO: 5474168 - DNA, 16 bp, Homo sapiens
ctccaggtcagcctgg

SEQ ID NO: 5474169 - DNA, 17 bp, Homo sapiens
ctccaggtcagcctgga

SEQ ID NO: 5474170 - DNA, 23 bp, Homo sapiens
ctccaggtccctaagctggggac

SEQ ID NO: 5474171 - DNA, 20 bp, Homo sapiens
ctccaggtccggaggggttg

SEQ ID NO: 5474172 - DNA, 22 bp, Homo sapiens
ctccaggtcctctacttaatga

SEQ ID NO: 5474173 - DNA, 18 bp, Homo sapiens
ctccaggtctcacgggca

SEQ ID NO: 5474174 - DNA, 18 bp, Homo sapiens
ctccaggtgcagaggtac

SEQ ID NO: 5474175 - DNA, 22 bp, Homo sapiens
ctccaggtgccctgtgggagag

SEQ ID NO: 5474176 - DNA, 14 bp, Homo sapiens
ctccaggtgctcat

SEQ ID NO: 5474177 - DNA, 14 bp, Homo sapiens
ctccaggtggctct

SEQ ID NO: 5474178 - DNA, 17 bp, Homo sapiens
ctccaggtggctctgag

SEQ ID NO: 5474179 - DNA, 23 bp, Homo sapiens
ctccaggtgtggaccggccgcag

SEQ ID NO: 5474180 - DNA, 19 bp, Homo sapiens
ctccaggtgttgttgaggg

SEQ ID NO: 5474181 - DNA, 14 bp, Homo sapiens
ctccaggttcgtat

SEQ ID NO: 5474182 - DNA, 21 bp, Homo sapiens
ctccaggttcgtatagaaaaa

SEQ ID NO: 5474183 - DNA, 17 bp, Homo sapiens
ctccaggtttgctgtgt

SEQ ID NO: 5474184 - DNA, 14 bp, Homo sapiens
ctccaggtttttca

SEQ ID NO: 5474185 - DNA, 22 bp, Homo sapiens
ctccaggtttttcaattaaacg

SEQ ID NO: 5474186 - DNA, 23 bp, Homo sapiens
ctccaggtttttcaattaaacgg

SEQ ID NO: 5474187 - DNA, 19 bp, Homo sapiens
ctccagtacaataaataaa

SEQ ID NO: 5474188 - DNA, 16 bp, Homo sapiens
ctccagtactggagct

SEQ ID NO: 5474189 - DNA, 18 bp, Homo sapiens
ctccagtagctccgcgtg

SEQ ID NO: 5474190 - DNA, 23 bp, Homo sapiens
ctccagtagtggacaacaggttt

SEQ ID NO: 5474191 - DNA, 20 bp, Homo sapiens
ctccagtatgacagaggagg

SEQ ID NO: 5474192 - DNA, 16 bp, Homo sapiens
ctccagtcaacagatt

SEQ ID NO: 5474193 - DNA, 17 bp, Homo sapiens
ctccagtcaacagattc

SEQ ID NO: 5474194 - DNA, 22 bp, Homo sapiens
ctccagtcatggtactacccca

SEQ ID NO: 5474195 - DNA, 22 bp, Homo sapiens
ctccagtcattatgttaatatt

SEQ ID NO: 5474196 - DNA, 18 bp, Homo sapiens
ctccagtccccctatcct

SEQ ID NO: 5474197 - DNA, 22 bp, Homo sapiens
ctccagtccccctatccttggc

SEQ ID NO: 5474198 - DNA, 15 bp, Homo sapiens
ctccagtcctgctct

SEQ ID NO: 5474199 - DNA, 16 bp, Homo sapiens
ctccagtcctgctctc

SEQ ID NO: 5474200 - DNA, 22 bp, Homo sapiens
ctccagtcctgctctctaccca

SEQ ID NO: 5474201 - DNA, 23 bp, Homo sapiens
ctccagtcctgctctctacccag

SEQ ID NO: 5474202 - DNA, 15 bp, Homo sapiens
ctccagtctcatcct

SEQ ID NO: 5474203 - DNA, 19 bp, Homo sapiens
ctccagtctcatcctccca

SEQ ID NO: 5474204 - DNA, 15 bp, Homo sapiens
ctgccccctcctgag

SEQ ID NO: 5474205 - DNA, 19 bp, Homo sapiens
ctgccccctctgccctgcg

SEQ ID NO: 5474206 - DNA, 22 bp, Homo sapiens
ctgccccctctttgtagctcct

SEQ ID NO: 5474207 - DNA, 17 bp, Homo sapiens
ctgccccctgaaactta

SEQ ID NO: 5474208 - DNA, 23 bp, Homo sapiens
ctgccccctgcaggaaggagctg

SEQ ID NO: 5474209 - DNA, 18 bp, Homo sapiens
ctgccccctgccagtgaa

SEQ ID NO: 5474210 - DNA, 12 bp, Homo sapiens
ctgccccctggc

SEQ ID NO: 5474211 - DNA, 15 bp, Homo sapiens
ctgccccctgggctg

SEQ ID NO: 5474212 - DNA, 16 bp, Homo sapiens
ctgcccccttccccag

SEQ ID NO: 5474213 - DNA, 19 bp, Homo sapiens
ctgcccccttccccagccc

SEQ ID NO: 5474214 - DNA, 20 bp, Homo sapiens
ctgcccccttccccagccct

SEQ ID NO: 5474215 - DNA, 14 bp, Homo sapiens
ctgcccccttctcc

SEQ ID NO: 5474216 - DNA, 19 bp, Homo sapiens
ctgcccccttctcccacac

SEQ ID NO: 5474217 - DNA, 20 bp, Homo sapiens
ctgcccccttctcccacact

SEQ ID NO: 5474218 - DNA, 11 bp, Homo sapiens
ctgccccgccc

SEQ ID NO: 5474219 - DNA, 16 bp, Homo sapiens
ctgccccgcccagctg

SEQ ID NO: 5474220 - DNA, 12 bp, Homo sapiens
ctgccccgcccc

SEQ ID NO: 5474221 - DNA, 19 bp, Homo sapiens
ctgccccgccccccagagc

SEQ ID NO: 5474222 - DNA, 15 bp, Homo sapiens
ctgccccgccctcat

SEQ ID NO: 5474223 - DNA, 17 bp, Homo sapiens
ctgccccggacctacct

SEQ ID NO: 5474224 - DNA, 19 bp, Homo sapiens
ctgccccggacctacctcc

SEQ ID NO: 5474225 - DNA, 16 bp, Homo sapiens
ctgccccggccactct

SEQ ID NO: 5474226 - DNA, 23 bp, Homo sapiens
ctgccccggcccaacctcgccct

SEQ ID NO: 5474227 - DNA, 17 bp, Homo sapiens
ctgccccgggtccccag

SEQ ID NO: 5474228 - DNA, 19 bp, Homo sapiens
ctgccccgtcccctgggcc

SEQ ID NO: 5474229 - DNA, 21 bp, Homo sapiens
ctgccccgtcccctgggccac

SEQ ID NO: 5474230 - DNA, 22 bp, Homo sapiens
ctgccccgtcggactgccccca

SEQ ID NO: 5474231 - DNA, 15 bp, Homo sapiens
ctgccccgtgcagac

SEQ ID NO: 5474232 - DNA, 18 bp, Homo sapiens
ctgccccgtgcagactgg

SEQ ID NO: 5474233 - DNA, 19 bp, Homo sapiens
ctgccccgtgtgtgtggcc

SEQ ID NO: 5474234 - DNA, 20 bp, Homo sapiens
ctgccccgtgtgtgtggccg

SEQ ID NO: 5474235 - DNA, 16 bp, Homo sapiens
ctgccccgttccctgt

SEQ ID NO: 5474236 - DNA, 22 bp, Homo sapiens
ctgccccgttccctgtcagagg

SEQ ID NO: 5474237 - DNA, 23 bp, Homo sapiens
ctgccccgttccctgtcagaggc

SEQ ID NO: 5474238 - DNA, 21 bp, Homo sapiens
ctgccccgttgcttcccgctg

SEQ ID NO: 5474239 - DNA, 21 bp, Homo sapiens
ctgcccctaaagatgggagga

SEQ ID NO: 5474240 - DNA, 17 bp, Homo sapiens
ctgcccctaccctggac

SEQ ID NO: 5474241 - DNA, 19 bp, Homo sapiens
ctgcccctacgggcgctgc

SEQ ID NO: 5474242 - DNA, 22 bp, Homo sapiens
ctgcccctacgggcgctgcagc

SEQ ID NO: 5474243 - DNA, 24 bp, Homo sapiens
ctgcccctacgggcgctgcagcct

SEQ ID NO: 5474244 - DNA, 22 bp, Homo sapiens
ctgcccctaggatgctgcagca

SEQ ID NO: 5474245 - DNA, 13 bp, Homo sapiens
ctgcccctcacaa

SEQ ID NO: 5474246 - DNA, 13 bp, Homo sapiens
ctgcccctcacct

SEQ ID NO: 5474247 - DNA, 19 bp, Homo sapiens
ctgcccctcaccttgggct

SEQ ID NO: 5474248 - DNA, 20 bp, Homo sapiens
ctgcccctcccaacccagcc

SEQ ID NO: 5474249 - DNA, 15 bp, Homo sapiens
ctgcccctcccagaa

SEQ ID NO: 5474250 - DNA, 22 bp, Homo sapiens
ctgcccctcccccaacccccac

SEQ ID NO: 5474251 - DNA, 16 bp, Homo sapiens
ctgcccctcccccagc

SEQ ID NO: 5474252 - DNA, 13 bp, Homo sapiens
ctgcccctccccg

SEQ ID NO: 5474253 - DNA, 20 bp, Homo sapiens
ctgcccctccccgtccctgt

SEQ ID NO: 5474254 - DNA, 15 bp, Homo sapiens
ctgcccctccctaga

SEQ ID NO: 5474255 - DNA, 20 bp, Homo sapiens
ctgcccctccctagatccag

SEQ ID NO: 5474256 - DNA, 21 bp, Homo sapiens
ctgcccctccctagatccagg

SEQ ID NO: 5474257 - DNA, 15 bp, Homo sapiens
ctgcccctccctcag

SEQ ID NO: 5474258 - DNA, 16 bp, Homo sapiens
ctgcccctccctcagg

SEQ ID NO: 5474259 - DNA, 13 bp, Homo sapiens
ctgcccctccctg

SEQ ID NO: 5474260 - DNA, 13 bp, Homo sapiens
ctgcccctccctt

SEQ ID NO: 5474261 - DNA, 21 bp, Homo sapiens
ctgcccctccgtccccagggt

SEQ ID NO: 5474262 - DNA, 21 bp, Homo sapiens
ctgcccctcctctctgcccta

SEQ ID NO: 5474263 - DNA, 21 bp, Homo sapiens
ctgcccctcgcacacagggct

SEQ ID NO: 5474264 - DNA, 17 bp, Homo sapiens
ctgcccctctctgggcc

SEQ ID NO: 5474265 - DNA, 12 bp, Homo sapiens
ctgcccctctgt

SEQ ID NO: 5474266 - DNA, 14 bp, Homo sapiens
ctgcccctctgttc

SEQ ID NO: 5474267 - DNA, 18 bp, Homo sapiens
ctgcccctcttcccggga

SEQ ID NO: 5474268 - DNA, 15 bp, Homo sapiens
ctgcccctcttccct

SEQ ID NO: 5474269 - DNA, 18 bp, Homo sapiens
ctgcccctcttccctggc

SEQ ID NO: 5474270 - DNA, 15 bp, Homo sapiens
ctgcccctctttctc

SEQ ID NO: 5474271 - DNA, 21 bp, Homo sapiens
ctgcccctgatcactcccagc

SEQ ID NO: 5474272 - DNA, 10 bp, Homo sapiens
ctgcccctgc

SEQ ID NO: 5474273 - DNA, 14 bp, Homo sapiens
ctgcccctgcacag

SEQ ID NO: 5474274 - DNA, 19 bp, Homo sapiens
ctgcccctgcacagcaggc

SEQ ID NO: 5474275 - DNA, 13 bp, Homo sapiens
ctgcccctgcacc

SEQ ID NO: 5474276 - DNA, 20 bp, Homo sapiens
ctgcccctgcacctgcttct

SEQ ID NO: 5474277 - DNA, 12 bp, Homo sapiens
ctgcccctgcag

SEQ ID NO: 5474278 - DNA, 13 bp, Homo sapiens
ctgcccctgcagc

SEQ ID NO: 5474279 - DNA, 16 bp, Homo sapiens
ctgcccctgccccgtc

SEQ ID NO: 5474280 - DNA, 14 bp, Homo sapiens
ctgcccctgccctg

SEQ ID NO: 5474281 - DNA, 15 bp, Homo sapiens
ctgcccctgccctga

SEQ ID NO: 5474282 - DNA, 18 bp, Homo sapiens
ctgcccctgccctgagga

SEQ ID NO: 5474283 - DNA, 18 bp, Homo sapiens
ctgcccctgcctgacagc

SEQ ID NO: 5474284 - DNA, 20 bp, Homo sapiens
ctgcccctgcgtggcctgag

SEQ ID NO: 5474285 - DNA, 14 bp, Homo sapiens
ctgcccctgctgct

SEQ ID NO: 5474286 - DNA, 20 bp, Homo sapiens
ctgcccctgctgtgctgctc

SEQ ID NO: 5474287 - DNA, 14 bp, Homo sapiens
ctgcccctggacct

SEQ ID NO: 5474288 - DNA, 14 bp, Homo sapiens
ctgcccctggcacc

SEQ ID NO: 5474289 - DNA, 17 bp, Homo sapiens
ctgcccctggcacctgt

SEQ ID NO: 5474290 - DNA, 18 bp, Homo sapiens
ctgcccctggcagcccct

SEQ ID NO: 5474291 - DNA, 16 bp, Homo sapiens
ctgcccctggctctga

SEQ ID NO: 5474292 - DNA, 13 bp, Homo sapiens
ctgcccctgtagg

SEQ ID NO: 5474293 - DNA, 12 bp, Homo sapiens
ctgcccctgtct

SEQ ID NO: 5474294 - DNA, 20 bp, Homo sapiens
ctgcccctgtgcctctgtcc

SEQ ID NO: 5474295 - DNA, 13 bp, Homo sapiens
ctgcccctgttct

SEQ ID NO: 5474296 - DNA, 23 bp, Homo sapiens
ctgccccttaaacacaggctgtc

SEQ ID NO: 5474297 - DNA, 23 bp, Homo sapiens
ctgccccttctacactctcctgg

SEQ ID NO: 5474298 - DNA, 20 bp, Homo sapiens
ctgccccttgaccccacacg

SEQ ID NO: 5474299 - DNA, 15 bp, Homo sapiens
ctgccccttgcaagc

SEQ ID NO: 5474300 - DNA, 16 bp, Homo sapiens
ctgccccttgcaagcc

SEQ ID NO: 5474301 - DNA, 15 bp, Homo sapiens
ctgccccttgcttct

SEQ ID NO: 5474302 - DNA, 19 bp, Homo sapiens
ctgccccttgggcatccac

SEQ ID NO: 5474303 - DNA, 14 bp, Homo sapiens
ctgccccttgggcc

SEQ ID NO: 5474304 - DNA, 17 bp, Homo sapiens
ctgccccttgggcctcc

SEQ ID NO: 5474305 - DNA, 19 bp, Homo sapiens
ctgccccttgggcctccca

SEQ ID NO: 5474306 - DNA, 21 bp, Homo sapiens
ctgccccttgggcctcccact

SEQ ID NO: 5474307 - DNA, 23 bp, Homo sapiens
ctgccccttgggcctcccactcc

SEQ ID NO: 5474308 - DNA, 17 bp, Homo sapiens
ctgcccctttcaggcct

SEQ ID NO: 5474309 - DNA, 21 bp, Homo sapiens
ctgcccctttcttccccaccc

SEQ ID NO: 5474310 - DNA, 16 bp, Homo sapiens
ctgcccgagctggtgc

SEQ ID NO: 5474311 - DNA, 15 bp, Homo sapiens
ctgcccgagggcagc

SEQ ID NO: 5474312 - DNA, 22 bp, Homo sapiens
ctgcccgagggcaggggccgtg

SEQ ID NO: 5474313 - DNA, 16 bp, Homo sapiens
ctgcccgcacaccctc

SEQ ID NO: 5474314 - DNA, 17 bp, Homo sapiens
ctgcccgcacaccctca

SEQ ID NO: 5474315 - DNA, 17 bp, Homo sapiens
ctgcccgcacagcagcc

SEQ ID NO: 5474316 - DNA, 20 bp, Homo sapiens
ctgcccgcacagcagcctgc

SEQ ID NO: 5474317 - DNA, 18 bp, Homo sapiens
ctgcccgcaccctggcct

SEQ ID NO: 5474318 - DNA, 20 bp, Homo sapiens
ctgcccgcaccctggcctgg

SEQ ID NO: 5474319 - DNA, 21 bp, Homo sapiens
ctgcccgcaccctggcctggt

SEQ ID NO: 5474320 - DNA, 14 bp, Homo sapiens
ctgcccgcagagcc

SEQ ID NO: 5474321 - DNA, 17 bp, Homo sapiens
ctgcccgccctccctcc

SEQ ID NO: 5474322 - DNA, 19 bp, Homo sapiens
ctgcccgcctaagaccctg

SEQ ID NO: 5474323 - DNA, 22 bp, Homo sapiens
ctgcccgcctcggcctcccaaa

SEQ ID NO: 5474324 - DNA, 13 bp, Homo sapiens
ctgcccgcctgcc

SEQ ID NO: 5474325 - DNA, 20 bp, Homo sapiens
ctgcccgcctgcccacctgc

SEQ ID NO: 5474326 - DNA, 17 bp, Homo sapiens
ctgcccgcgcccgccgc

SEQ ID NO: 5474327 - DNA, 21 bp, Homo sapiens
ctgcccgctcccaacccccct

SEQ ID NO: 5474328 - DNA, 15 bp, Homo sapiens
ctgcccgctgcaatg

SEQ ID NO: 5474329 - DNA, 15 bp, Homo sapiens
ctgcccggcccagga

SEQ ID NO: 5474330 - DNA, 17 bp, Homo sapiens
ctgcccggcgccctctg

SEQ ID NO: 5474331 - DNA, 20 bp, Homo sapiens
ctgcccggcgccctctgtcc

SEQ ID NO: 5474332 - DNA, 23 bp, Homo sapiens
ctgcccggcgccctctgtcctga

SEQ ID NO: 5474333 - DNA, 15 bp, Homo sapiens
ctgcccggcgcctgc

SEQ ID NO: 5474334 - DNA, 16 bp, Homo sapiens
ctgcccggcgcctgcc

SEQ ID NO: 5474335 - DNA, 18 bp, Homo sapiens
ctgcccggcgcctgccct

SEQ ID NO: 5474336 - DNA, 19 bp, Homo sapiens
ctgcccggcgcctgccctg

SEQ ID NO: 5474337 - DNA, 16 bp, Homo sapiens
ctgcccggctgcccac

SEQ ID NO: 5474338 - DNA, 12 bp, Homo sapiens
cttaagctgccc

SEQ ID NO: 5474339 - DNA, 22 bp, Homo sapiens
cttaagctttggacccaaggaa

SEQ ID NO: 5474340 - DNA, 21 bp, Homo sapiens
cttaaggaacatctctgcttt

SEQ ID NO: 5474341 - DNA, 18 bp, Homo sapiens
cttaaggaagtttgattt

SEQ ID NO: 5474342 - DNA, 22 bp, Homo sapiens
cttaaggaattgacttcagcag

SEQ ID NO: 5474343 - DNA, 16 bp, Homo sapiens
cttaaggacagtgttc

SEQ ID NO: 5474344 - DNA, 21 bp, Homo sapiens
cttaaggacttagctggccac

SEQ ID NO: 5474345 - DNA, 17 bp, Homo sapiens
cttaaggagaaatagct

SEQ ID NO: 5474346 - DNA, 15 bp, Homo sapiens
cttaaggagactggt

SEQ ID NO: 5474347 - DNA, 17 bp, Homo sapiens
cttaaggagactggtag

SEQ ID NO: 5474348 - DNA, 22 bp, Homo sapiens
cttaaggagaggagaaactgag

SEQ ID NO: 5474349 - DNA, 18 bp, Homo sapiens
cttaaggagaggagagca

SEQ ID NO: 5474350 - DNA, 21 bp, Homo sapiens
cttaaggatggagccagctct

SEQ ID NO: 5474351 - DNA, 21 bp, Homo sapiens
cttaaggcacagtgggagctg

SEQ ID NO: 5474352 - DNA, 17 bp, Homo sapiens
cttaaggccacactggc

SEQ ID NO: 5474353 - DNA, 22 bp, Homo sapiens
cttaaggccacactggcatctc

SEQ ID NO: 5474354 - DNA, 20 bp, Homo sapiens
cttaaggcctaaggaagcca

SEQ ID NO: 5474355 - DNA, 13 bp, Homo sapiens
cttaagggaaagg

SEQ ID NO: 5474356 - DNA, 12 bp, Homo sapiens
cttaaggggcag

SEQ ID NO: 5474357 - DNA, 21 bp, Homo sapiens
cttaaggggctgggatgcttt

SEQ ID NO: 5474358 - DNA, 19 bp, Homo sapiens
cttaagggggccttggaat

SEQ ID NO: 5474359 - DNA, 14 bp, Homo sapiens
cttaaggggggatg

SEQ ID NO: 5474360 - DNA, 18 bp, Homo sapiens
cttaagggttgaaggcag

SEQ ID NO: 5474361 - DNA, 19 bp, Homo sapiens
cttaagggttgaaggcagt

SEQ ID NO: 5474362 - DNA, 20 bp, Homo sapiens
cttaagggttgaaggcagtc

SEQ ID NO: 5474363 - DNA, 17 bp, Homo sapiens
cttaagggttgcttgct

SEQ ID NO: 5474364 - DNA, 16 bp, Homo sapiens
cttaaggtctaactgt

SEQ ID NO: 5474365 - DNA, 15 bp, Homo sapiens
cttaaggtgaggcct

SEQ ID NO: 5474366 - DNA, 23 bp, Homo sapiens
cttaaggtgaggcctgtctgtga

SEQ ID NO: 5474367 - DNA, 14 bp, Homo sapiens
cttaaggtggaaag

SEQ ID NO: 5474368 - DNA, 16 bp, Homo sapiens
cttaaggtggaaagtg

SEQ ID NO: 5474369 - DNA, 23 bp, Homo sapiens
cttaaggtggaaagtgttcattg

SEQ ID NO: 5474370 - DNA, 22 bp, Homo sapiens
cttaagtaagcaacagcataac

SEQ ID NO: 5474371 - DNA, 19 bp, Homo sapiens
cttaagtaatcatctaagt

SEQ ID NO: 5474372 - DNA, 14 bp, Homo sapiens
cttaagtaccaatg

SEQ ID NO: 5474373 - DNA, 15 bp, Homo sapiens
cttaagtaccaatgg

SEQ ID NO: 5474374 - DNA, 20 bp, Homo sapiens
cttaagtaccaatgggaagc

SEQ ID NO: 5474375 - DNA, 14 bp, Homo sapiens
cttaagtagtttct

SEQ ID NO: 5474376 - DNA, 16 bp, Homo sapiens
cttaagtataaacctt

SEQ ID NO: 5474377 - DNA, 14 bp, Homo sapiens
cttaagtatcagaa

SEQ ID NO: 5474378 - DNA, 15 bp, Homo sapiens
cttaagtatttacag

SEQ ID NO: 5474379 - DNA, 20 bp, Homo sapiens
cttaagtcaccctagccctc

SEQ ID NO: 5474380 - DNA, 18 bp, Homo sapiens
cttaagtcagaacagcag

SEQ ID NO: 5474381 - DNA, 20 bp, Homo sapiens
cttaagtcccagtatacctc

SEQ ID NO: 5474382 - DNA, 21 bp, Homo sapiens
cttaagtcccagtatacctca

SEQ ID NO: 5474383 - DNA, 17 bp, Homo sapiens
cttaagtcctaaaagtt

SEQ ID NO: 5474384 - DNA, 23 bp, Homo sapiens
cttaagtcctaaaagttctcaat

SEQ ID NO: 5474385 - DNA, 16 bp, Homo sapiens
cttaagtctcgaatgt

SEQ ID NO: 5474386 - DNA, 14 bp, Homo sapiens
cttaagtgagcaga

SEQ ID NO: 5474387 - DNA, 16 bp, Homo sapiens
cttaagtgagcagaac

SEQ ID NO: 5474388 - DNA, 18 bp, Homo sapiens
cttaagtgagcagaacag

SEQ ID NO: 5474389 - DNA, 20 bp, Homo sapiens
cttaagtgaggaaatcaaag

SEQ ID NO: 5474390 - DNA, 15 bp, Homo sapiens
cttaagtgcactttt

SEQ ID NO: 5474391 - DNA, 22 bp, Homo sapiens
cttaagtgcatgcattgagctg

SEQ ID NO: 5474392 - DNA, 17 bp, Homo sapiens
cttaagtgtaaatgaag

SEQ ID NO: 5474393 - DNA, 19 bp, Homo sapiens
cttaagttctatgaagagt

SEQ ID NO: 5474394 - DNA, 23 bp, Homo sapiens
cttaagttctttgatttgtacca

SEQ ID NO: 5474395 - DNA, 14 bp, Homo sapiens
cttaagtttagaaa

SEQ ID NO: 5474396 - DNA, 20 bp, Homo sapiens
cttaagtttctcagctccca

SEQ ID NO: 5474397 - DNA, 16 bp, Homo sapiens
cttaagttttttatgc

SEQ ID NO: 5474398 - DNA, 18 bp, Homo sapiens
cttaataaaataaactag

SEQ ID NO: 5474399 - DNA, 19 bp, Homo sapiens
cttaataaactgtggtgct

SEQ ID NO: 5474400 - DNA, 18 bp, Homo sapiens
cttaataaatatgtaata

SEQ ID NO: 5474401 - DNA, 20 bp, Homo sapiens
cttaataacacttcaccttc

SEQ ID NO: 5474402 - DNA, 19 bp, Homo sapiens
cttaataacatacaatgac

SEQ ID NO: 5474403 - DNA, 20 bp, Homo sapiens
cttaataactgtgtactgtt

SEQ ID NO: 5474404 - DNA, 12 bp, Homo sapiens
cttaataataat

SEQ ID NO: 5474405 - DNA, 14 bp, Homo sapiens
cttaataataatgc

SEQ ID NO: 5474406 - DNA, 23 bp, Homo sapiens
cttaataataatgccaatgaaca

SEQ ID NO: 5474407 - DNA, 14 bp, Homo sapiens
cttaataatcaaga

SEQ ID NO: 5474408 - DNA, 21 bp, Homo sapiens
cttaataatcaagagccttaa

SEQ ID NO: 5474409 - DNA, 16 bp, Homo sapiens
cttaatacaggagacc

SEQ ID NO: 5474410 - DNA, 21 bp, Homo sapiens
cttaatacctgggtgattaca

SEQ ID NO: 5474411 - DNA, 13 bp, Homo sapiens
cttaatactaagg

SEQ ID NO: 5474412 - DNA, 17 bp, Homo sapiens
cttaatactgaatttct

SEQ ID NO: 5474413 - DNA, 16 bp, Homo sapiens
cttaatagacattttt

SEQ ID NO: 5474414 - DNA, 19 bp, Homo sapiens
cttaatagacttctcttac

SEQ ID NO: 5474415 - DNA, 22 bp, Homo sapiens
cttaatagctgtagttttccct

SEQ ID NO: 5474416 - DNA, 16 bp, Homo sapiens
cttaatagtatttatg

SEQ ID NO: 5474417 - DNA, 15 bp, Homo sapiens
cttaatataaatcgt

SEQ ID NO: 5474418 - DNA, 13 bp, Homo sapiens
cttaatataaatt

SEQ ID NO: 5474419 - DNA, 21 bp, Homo sapiens
cttaatataaattcactttca

SEQ ID NO: 5474420 - DNA, 18 bp, Homo sapiens
cttaatatacaatctatc

SEQ ID NO: 5474421 - DNA, 22 bp, Homo sapiens
cttaatatacaatctatctttt

SEQ ID NO: 5474422 - DNA, 19 bp, Homo sapiens
cttaatatatagcatttat

SEQ ID NO: 5474423 - DNA, 20 bp, Homo sapiens
cttaatatatagcatttatg

SEQ ID NO: 5474424 - DNA, 14 bp, Homo sapiens
cttaatatatttga

SEQ ID NO: 5474425 - DNA, 19 bp, Homo sapiens
cttaatatgatctgtggag

SEQ ID NO: 5474426 - DNA, 23 bp, Homo sapiens
cttaatatgctgcaacaaaatgt

SEQ ID NO: 5474427 - DNA, 20 bp, Homo sapiens
cttaatattagcttgcttaa

SEQ ID NO: 5474428 - DNA, 19 bp, Homo sapiens
cttaatattctggagtcat

SEQ ID NO: 5474429 - DNA, 15 bp, Homo sapiens
cttaatattgagaat

SEQ ID NO: 5474430 - DNA, 15 bp, Homo sapiens
cttaatatttcttca

SEQ ID NO: 5474431 - DNA, 23 bp, Homo sapiens
cttaatcaagaatattcaaatgt

SEQ ID NO: 5474432 - DNA, 22 bp, Homo sapiens
cttaatcaagatttttttcctg

SEQ ID NO: 5474433 - DNA, 15 bp, Homo sapiens
cttaatcactactgt

SEQ ID NO: 5474434 - DNA, 21 bp, Homo sapiens
cttaatcagatagatattcct

SEQ ID NO: 5474435 - DNA, 17 bp, Homo sapiens
cttaatcatatcaactt

SEQ ID NO: 5474436 - DNA, 14 bp, Homo sapiens
cttaatcattttca

SEQ ID NO: 5474437 - DNA, 20 bp, Homo sapiens
cttaatcattttcattccta

SEQ ID NO: 5474438 - DNA, 21 bp, Homo sapiens
cttaatcctaccccctcttca

SEQ ID NO: 5474439 - DNA, 18 bp, Homo sapiens
cttaatcgatgaatgtaa

SEQ ID NO: 5474440 - DNA, 19 bp, Homo sapiens
cttaatctaagaaacaaag

SEQ ID NO: 5474441 - DNA, 18 bp, Homo sapiens
cttaatctggacacactg

SEQ ID NO: 5474442 - DNA, 20 bp, Homo sapiens
cttaatctgtgtgtatattg

SEQ ID NO: 5474443 - DNA, 21 bp, Homo sapiens
cttaatctgtttatttacaag

SEQ ID NO: 5474444 - DNA, 19 bp, Homo sapiens
cttaatcttctctcttgat

SEQ ID NO: 5474445 - DNA, 15 bp, Homo sapiens
cttaatgaaaacaat

SEQ ID NO: 5474446 - DNA, 17 bp, Homo sapiens
cttaatgaagtttgaat

SEQ ID NO: 5474447 - DNA, 18 bp, Homo sapiens
cttaatgaagtttgaatg

SEQ ID NO: 5474448 - DNA, 23 bp, Homo sapiens
cttaatgaagtttgaatgttaaa

SEQ ID NO: 5474449 - DNA, 15 bp, Homo sapiens
cttaatgacaacact

SEQ ID NO: 5474450 - DNA, 23 bp, Homo sapiens
cttaatgacattcccctcccacc

SEQ ID NO: 5474451 - DNA, 19 bp, Homo sapiens
cttaatgaccatgttatat

SEQ ID NO: 5474452 - DNA, 19 bp, Homo sapiens
cttaatgagaacatttaca

SEQ ID NO: 5474453 - DNA, 14 bp, Homo sapiens
cttaatgagatagt

SEQ ID NO: 5474454 - DNA, 20 bp, Homo sapiens
cttaatgagcaatatctgct

SEQ ID NO: 5474455 - DNA, 19 bp, Homo sapiens
cttaatgatgttatcttaa

SEQ ID NO: 5474456 - DNA, 18 bp, Homo sapiens
cttaatgccactaaattg

SEQ ID NO: 5474457 - DNA, 12 bp, Homo sapiens
cttaatgctgaa

SEQ ID NO: 5474458 - DNA, 15 bp, Homo sapiens
cttaatgcttctttc

SEQ ID NO: 5474459 - DNA, 15 bp, Homo sapiens
gaagatggatgtaat

SEQ ID NO: 5474460 - DNA, 19 bp, Homo sapiens
gaagatggcactgtccagg

SEQ ID NO: 5474461 - DNA, 20 bp, Homo sapiens
gaagatggcactgtccaggg

SEQ ID NO: 5474462 - DNA, 21 bp, Homo sapiens
gaagatggctcccaaggttcc

SEQ ID NO: 5474463 - DNA, 16 bp, Homo sapiens
gaagatggctgttagc

SEQ ID NO: 5474464 - DNA, 18 bp, Homo sapiens
gaagatgggggcaagaag

SEQ ID NO: 5474465 - DNA, 15 bp, Homo sapiens
gaagatgggggctgg

SEQ ID NO: 5474466 - DNA, 16 bp, Homo sapiens
gaagatgggggctgga

SEQ ID NO: 5474467 - DNA, 19 bp, Homo sapiens
gaagatggtagcagataaa

SEQ ID NO: 5474468 - DNA, 20 bp, Homo sapiens
gaagatggtagcagataaag

SEQ ID NO: 5474469 - DNA, 15 bp, Homo sapiens
gaagatggtggccac

SEQ ID NO: 5474470 - DNA, 21 bp, Homo sapiens
gaagatgtattcagagccacc

SEQ ID NO: 5474471 - DNA, 15 bp, Homo sapiens
gaagatgtcccccag

SEQ ID NO: 5474472 - DNA, 17 bp, Homo sapiens
gaagatgtctcctcaag

SEQ ID NO: 5474473 - DNA, 12 bp, Homo sapiens
gaagatgtgtaa

SEQ ID NO: 5474474 - DNA, 14 bp, Homo sapiens
gaagatgtgtaaac

SEQ ID NO: 5474475 - DNA, 18 bp, Homo sapiens
gaagatgtgtaaacaggt

SEQ ID NO: 5474476 - DNA, 21 bp, Homo sapiens
gaagatgtgtaaacaggtatt

SEQ ID NO: 5474477 - DNA, 21 bp, Homo sapiens
gaagatgtttaacttaatcaa

SEQ ID NO: 5474478 - DNA, 16 bp, Homo sapiens
gaagatgtttacattt

SEQ ID NO: 5474479 - DNA, 21 bp, Homo sapiens
gaagatgtttactcattgccc

SEQ ID NO: 5474480 - DNA, 17 bp, Homo sapiens
gaagattaaaaccacag

SEQ ID NO: 5474481 - DNA, 18 bp, Homo sapiens
gaagattaaaaccacaga

SEQ ID NO: 5474482 - DNA, 19 bp, Homo sapiens
gaagattaggagaaacaca

SEQ ID NO: 5474483 - DNA, 15 bp, Homo sapiens
gaagattaggcacac

SEQ ID NO: 5474484 - DNA, 17 bp, Homo sapiens
gaagattaggcacacag

SEQ ID NO: 5474485 - DNA, 15 bp, Homo sapiens
gaagattatttttta

SEQ ID NO: 5474486 - DNA, 18 bp, Homo sapiens
gaagattattttttaaaa

SEQ ID NO: 5474487 - DNA, 13 bp, Homo sapiens
gaagattctaaaa

SEQ ID NO: 5474488 - DNA, 15 bp, Homo sapiens
gaagattctatgtta

SEQ ID NO: 5474489 - DNA, 23 bp, Homo sapiens
gaagattctatgttaatatttta

SEQ ID NO: 5474490 - DNA, 21 bp, Homo sapiens
gaagattctatttaattgaaa

SEQ ID NO: 5474491 - DNA, 22 bp, Homo sapiens
gaagattcttcccattctccat

SEQ ID NO: 5474492 - DNA, 19 bp, Homo sapiens
gaagattgaaaaaaataaa

SEQ ID NO: 5474493 - DNA, 22 bp, Homo sapiens
gaagattgagatgtgttcacaa

SEQ ID NO: 5474494 - DNA, 13 bp, Homo sapiens
gaagattgcctct

SEQ ID NO: 5474495 - DNA, 16 bp, Homo sapiens
gaagattgggccgcct

SEQ ID NO: 5474496 - DNA, 23 bp, Homo sapiens
gaagattgtttatctagatgtaa

SEQ ID NO: 5474497 - DNA, 23 bp, Homo sapiens
gaagatttatgaacagaaatatt

SEQ ID NO: 5474498 - DNA, 16 bp, Homo sapiens
gaagatttgaaaacaa

SEQ ID NO: 5474499 - DNA, 17 bp, Homo sapiens
gaagatttggtttttgt

SEQ ID NO: 5474500 - DNA, 22 bp, Homo sapiens
gaagattttatgcacagcctag

SEQ ID NO: 5474501 - DNA, 23 bp, Homo sapiens
gaagattttatgcacagcctagt

SEQ ID NO: 5474502 - DNA, 16 bp, Homo sapiens
gaagattttcagtcta

SEQ ID NO: 5474503 - DNA, 17 bp, Homo sapiens
gaagattttggtaatga

SEQ ID NO: 5474504 - DNA, 12 bp, Homo sapiens
gaagcaaaaact

SEQ ID NO: 5474505 - DNA, 14 bp, Homo sapiens
gaagcaaaaactac

SEQ ID NO: 5474506 - DNA, 14 bp, Homo sapiens
gaagcaaaattttt

SEQ ID NO: 5474507 - DNA, 19 bp, Homo sapiens
gaagcaaacaagcttgatt

SEQ ID NO: 5474508 - DNA, 15 bp, Homo sapiens
gaagcaaacacacag

SEQ ID NO: 5474509 - DNA, 14 bp, Homo sapiens
gaagcaaagacaaa

SEQ ID NO: 5474510 - DNA, 23 bp, Homo sapiens
gaagcaaagacaaaagaaactta

SEQ ID NO: 5474511 - DNA, 17 bp, Homo sapiens
gaagcaaagatttcagt

SEQ ID NO: 5474512 - DNA, 18 bp, Homo sapiens
gaagcaaagatttcagta

SEQ ID NO: 5474513 - DNA, 16 bp, Homo sapiens
gaagcaaagcaccagc

SEQ ID NO: 5474514 - DNA, 12 bp, Homo sapiens
gaagccagtgac

SEQ ID NO: 5474515 - DNA, 18 bp, Homo sapiens
gaagccagtgcggcaggt

SEQ ID NO: 5474516 - DNA, 12 bp, Homo sapiens
gaagccagttgc

SEQ ID NO: 5474517 - DNA, 22 bp, Homo sapiens
gaagccataacgttagactgca

SEQ ID NO: 5474518 - DNA, 19 bp, Homo sapiens
gaagccatagatgctggct

SEQ ID NO: 5474519 - DNA, 17 bp, Homo sapiens
gaagccatagggggctg

SEQ ID NO: 5474520 - DNA, 18 bp, Homo sapiens
gaagccatagggggctgc

SEQ ID NO: 5474521 - DNA, 19 bp, Homo sapiens
gaagccatagggggctgca

SEQ ID NO: 5474522 - DNA, 21 bp, Homo sapiens
gaagccatatatgaccagaag

SEQ ID NO: 5474523 - DNA, 22 bp, Homo sapiens
gaagccatatatgaccagaagc

SEQ ID NO: 5474524 - DNA, 17 bp, Homo sapiens
gaagccatcaattttaa

SEQ ID NO: 5474525 - DNA, 22 bp, Homo sapiens
gaagccatcacttctccccgca

SEQ ID NO: 5474526 - DNA, 15 bp, Homo sapiens
gaagccatctttctt

SEQ ID NO: 5474527 - DNA, 13 bp, Homo sapiens
gaagccattgtct

SEQ ID NO: 5474528 - DNA, 14 bp, Homo sapiens
gaagcccaaagcct

SEQ ID NO: 5474529 - DNA, 22 bp, Homo sapiens
gaagcccaaagcctgaggacag

SEQ ID NO: 5474530 - DNA, 16 bp, Homo sapiens
gaagcccaagtgaaat

SEQ ID NO: 5474531 - DNA, 12 bp, Homo sapiens
gaagcccacact

SEQ ID NO: 5474532 - DNA, 13 bp, Homo sapiens
gaagcccacacta

SEQ ID NO: 5474533 - DNA, 19 bp, Homo sapiens
gaagcccaccaatctgccc

SEQ ID NO: 5474534 - DNA, 20 bp, Homo sapiens
gaagcccaccaatctgccct

SEQ ID NO: 5474535 - DNA, 12 bp, Homo sapiens
gaagcccacccg

SEQ ID NO: 5474536 - DNA, 18 bp, Homo sapiens
gaagcccacccgccccag

SEQ ID NO: 5474537 - DNA, 23 bp, Homo sapiens
gaagcccacccgccccagagact

SEQ ID NO: 5474538 - DNA, 17 bp, Homo sapiens
gaagcccactgcctcct

SEQ ID NO: 5474539 - DNA, 23 bp, Homo sapiens
gaagcccactgggtttaaagatg

SEQ ID NO: 5474540 - DNA, 13 bp, Homo sapiens
gaagcccagaggg

SEQ ID NO: 5474541 - DNA, 14 bp, Homo sapiens
gaagcccagagggt

SEQ ID NO: 5474542 - DNA, 17 bp, Homo sapiens
gaagcccagagggtctg

SEQ ID NO: 5474543 - DNA, 11 bp, Homo sapiens
gaagcccagcc

SEQ ID NO: 5474544 - DNA, 14 bp, Homo sapiens
gaagcccagcctgc

SEQ ID NO: 5474545 - DNA, 16 bp, Homo sapiens
gaagcccagctccagg

SEQ ID NO: 5474546 - DNA, 15 bp, Homo sapiens
gaagcccaggaaagg

SEQ ID NO: 5474547 - DNA, 19 bp, Homo sapiens
gaagcccaggaaaggctcc

SEQ ID NO: 5474548 - DNA, 22 bp, Homo sapiens
gaagcccaggaaaggctccagg

SEQ ID NO: 5474549 - DNA, 13 bp, Homo sapiens
gaagcccaggagg

SEQ ID NO: 5474550 - DNA, 13 bp, Homo sapiens
gaagcccaggctg

SEQ ID NO: 5474551 - DNA, 16 bp, Homo sapiens
gaagcccaggctgaag

SEQ ID NO: 5474552 - DNA, 10 bp, Homo sapiens
gaagcccagt

SEQ ID NO: 5474553 - DNA, 15 bp, Homo sapiens
gaagcccagtttccc

SEQ ID NO: 5474554 - DNA, 18 bp, Homo sapiens
gaagcccatggagcaggg

SEQ ID NO: 5474555 - DNA, 19 bp, Homo sapiens
gaagcccatgtcttctgct

SEQ ID NO: 5474556 - DNA, 20 bp, Homo sapiens
gaagcccattcctctgccag

SEQ ID NO: 5474557 - DNA, 16 bp, Homo sapiens
gaagccccaagccatg

SEQ ID NO: 5474558 - DNA, 18 bp, Homo sapiens
gaagccccacatgtccag

SEQ ID NO: 5474559 - DNA, 23 bp, Homo sapiens
gaagccccacatgtccagcacct

SEQ ID NO: 5474560 - DNA, 14 bp, Homo sapiens
gaagcccccagcta

SEQ ID NO: 5474561 - DNA, 21 bp, Homo sapiens
gaagcccccagctaagaacct

SEQ ID NO: 5474562 - DNA, 20 bp, Homo sapiens
gaagccccccacctttctcg

SEQ ID NO: 5474563 - DNA, 16 bp, Homo sapiens
gaagccccgacacacg

SEQ ID NO: 5474564 - DNA, 15 bp, Homo sapiens
gaagccccgcacggg

SEQ ID NO: 5474565 - DNA, 18 bp, Homo sapiens
gaagccccgcacgggctg

SEQ ID NO: 5474566 - DNA, 22 bp, Homo sapiens
gaagccccgcacgggctgtctg

SEQ ID NO: 5474567 - DNA, 16 bp, Homo sapiens
gaagccccgctcaggt

SEQ ID NO: 5474568 - DNA, 20 bp, Homo sapiens
gaagccccgctcaggtagcc

SEQ ID NO: 5474569 - DNA, 19 bp, Homo sapiens
gaagcccctgagtcctgag

SEQ ID NO: 5474570 - DNA, 22 bp, Homo sapiens
gaagcccctgggggctccctga

SEQ ID NO: 5474571 - DNA, 21 bp, Homo sapiens
gaagccccttgtcctctcccg

SEQ ID NO: 5474572 - DNA, 14 bp, Homo sapiens
gaagcccggctcct

SEQ ID NO: 5474573 - DNA, 18 bp, Homo sapiens
gaagcccgtgtcctgcct

SEQ ID NO: 5474574 - DNA, 19 bp, Homo sapiens
gaagcccgtgtcctgcctt

SEQ ID NO: 5474575 - DNA, 18 bp, Homo sapiens
gaagccctaactcagcca

SEQ ID NO: 5474576 - DNA, 23 bp, Homo sapiens
gaagccctcaaagaagtcggaat

SEQ ID NO: 5474577 - DNA, 17 bp, Homo sapiens
gaagccctccaaaagca

SEQ ID NO: 5474578 - DNA, 13 bp, Homo sapiens
gaagccctcccag

SEQ ID NO: 5474579 - DNA, 15 bp, Homo sapiens
gaagccctcccaggt

SEQ ID NO: 5474580 - DNA, 12 bp, Homo sapiens
gaagccctcctt

SEQ ID NO: 5474581 - DNA, 13 bp, Homo sapiens
gaagccctccttg

SEQ ID NO: 5474582 - DNA, 11 bp, Homo sapiens
gaagccctgga

SEQ ID NO: 5474583 - DNA, 21 bp, Homo sapiens
gaagccctggatttcagaaag

SEQ ID NO: 5474584 - DNA, 13 bp, Homo sapiens
gaagccctgttct

SEQ ID NO: 5474585 - DNA, 14 bp, Homo sapiens
gaagccctgttctc

SEQ ID NO: 5474586 - DNA, 14 bp, Homo sapiens
gaagccctgttgtg

SEQ ID NO: 5474587 - DNA, 21 bp, Homo sapiens
gaagccctttgcctgtagagc

SEQ ID NO: 5474588 - DNA, 23 bp, Homo sapiens
gaagccctttgcctgtagagcca

SEQ ID NO: 5474589 - DNA, 15 bp, Homo sapiens
gaagccgactctggc

SEQ ID NO: 5474590 - DNA, 16 bp, Homo sapiens
gaagccgactctggcc

SEQ ID NO: 5474591 - DNA, 14 bp, Homo sapiens
gaagccgcagggac

SEQ ID NO: 5474592 - DNA, 14 bp, Homo sapiens
gaagccgctcccgg

SEQ ID NO: 5474593 - DNA, 19 bp, Homo sapiens
gaagccgcttatcctgttt

SEQ ID NO: 5474594 - DNA, 22 bp, Homo sapiens
gaagccggacacggcttcactg

SEQ ID NO: 5474595 - DNA, 15 bp, Homo sapiens
gaagccggacagctg

SEQ ID NO: 5474596 - DNA, 17 bp, Homo sapiens
gaagccggacagctgcc

SEQ ID NO: 5474597 - DNA, 15 bp, Homo sapiens
gaagccggcggagct

SEQ ID NO: 5474598 - DNA, 16 bp, Homo sapiens
gaagccggcggagctc

SEQ ID NO: 5474599 - DNA, 15 bp, Homo sapiens
gaagccggcggccca

SEQ ID NO: 5474600 - DNA, 16 bp, Homo sapiens
gaagccggtgcctggg

SEQ ID NO: 5474601 - DNA, 22 bp, Homo sapiens
gaagccgtcctggcgcctggca

SEQ ID NO: 5474602 - DNA, 16 bp, Homo sapiens
gaagccgtctgactcc

SEQ ID NO: 5474603 - DNA, 20 bp, Homo sapiens
gaagccgtctgactccagag

SEQ ID NO: 5474604 - DNA, 23 bp, Homo sapiens
gaagccgtctgactccagagtct

SEQ ID NO: 5474605 - DNA, 17 bp, Homo sapiens
gaagccgtgcctgtagc

SEQ ID NO: 5474606 - DNA, 22 bp, Homo sapiens
gaagccgttgaatctgggaggg

SEQ ID NO: 5474607 - DNA, 14 bp, Homo sapiens
gaagcctaaataaa

SEQ ID NO: 5474608 - DNA, 22 bp, Homo sapiens
gaagcctaattgtcacatcaag

SEQ ID NO: 5474609 - DNA, 18 bp, Homo sapiens
gaagcctaggaggactgg

SEQ ID NO: 5474610 - DNA, 17 bp, Homo sapiens
gaagcctattagctggg

SEQ ID NO: 5474611 - DNA, 14 bp, Homo sapiens
gaagcctattgtaa

SEQ ID NO: 5474612 - DNA, 19 bp, Homo sapiens
gaagcctcaagttccagtg

SEQ ID NO: 5474613 - DNA, 17 bp, Homo sapiens
gaagcctcatgggagtc

SEQ ID NO: 5474614 - DNA, 17 bp, Homo sapiens
gaagcctccaagcacag

SEQ ID NO: 5474615 - DNA, 22 bp, Homo sapiens
gaagcctccttacattaaaaag

SEQ ID NO: 5474616 - DNA, 22 bp, Homo sapiens
gaagcctctaacaaatgatcta

SEQ ID NO: 5474617 - DNA, 12 bp, Homo sapiens
gaagcctctggc

SEQ ID NO: 5474618 - DNA, 17 bp, Homo sapiens
gaagcctgagcaggcag

SEQ ID NO: 5474619 - DNA, 19 bp, Homo sapiens
gaagcctgagcaggcaggg

SEQ ID NO: 5474620 - DNA, 15 bp, Homo sapiens
gaagcctgagcaggg

SEQ ID NO: 5474621 - DNA, 12 bp, Homo sapiens
gaagcctgccct

SEQ ID NO: 5474622 - DNA, 23 bp, Homo sapiens
gaagcctgcgttggtccagagcg

SEQ ID NO: 5474623 - DNA, 15 bp, Homo sapiens
gaagcctgctccttc

SEQ ID NO: 5474624 - DNA, 12 bp, Homo sapiens
gaagcctgctga

SEQ ID NO: 5474625 - DNA, 13 bp, Homo sapiens
gaagcctgctgat

SEQ ID NO: 5474626 - DNA, 15 bp, Homo sapiens
gaagcctggacgcag

SEQ ID NO: 5474627 - DNA, 21 bp, Homo sapiens
gaagcctggactctaagctgg

SEQ ID NO: 5474628 - DNA, 16 bp, Homo sapiens
gaagcctggactctgc

SEQ ID NO: 5474629 - DNA, 19 bp, Homo sapiens
gaagcctggactctgcccc

SEQ ID NO: 5474630 - DNA, 17 bp, Homo sapiens
gaagcctggagctttcc

SEQ ID NO: 5474631 - DNA, 12 bp, Homo sapiens
gaagcctggggg

SEQ ID NO: 5474632 - DNA, 17 bp, Homo sapiens
gaagcctgggggcctgg

SEQ ID NO: 5474633 - DNA, 19 bp, Homo sapiens
gaagcctgtaccaggtcat

SEQ ID NO: 5474634 - DNA, 13 bp, Homo sapiens
gaagcctgtgcca

SEQ ID NO: 5474635 - DNA, 14 bp, Homo sapiens
gaagcctgtgccac

SEQ ID NO: 5474636 - DNA, 18 bp, Homo sapiens
gaagcctgtggatgatca

SEQ ID NO: 5474637 - DNA, 20 bp, Homo sapiens
gaagcctgtggatgatcaat

SEQ ID NO: 5474638 - DNA, 19 bp, Homo sapiens
gaagccttatgaaaattat

SEQ ID NO: 5474639 - DNA, 16 bp, Homo sapiens
gaagccttcaagctct

SEQ ID NO: 5474640 - DNA, 13 bp, Homo sapiens
cttaccaagatca

SEQ ID NO: 5474641 - DNA, 23 bp, Homo sapiens
cttaccaagttgtgcttttctgt

SEQ ID NO: 5474642 - DNA, 16 bp, Homo sapiens
cttaccaatagcctga

SEQ ID NO: 5474643 - DNA, 20 bp, Homo sapiens
cttaccagggagatttgctc

SEQ ID NO: 5474644 - DNA, 19 bp, Homo sapiens
cttaccagtgacgctgctg

SEQ ID NO: 5474645 - DNA, 23 bp, Homo sapiens
cttaccattcctatagtacttta

SEQ ID NO: 5474646 - DNA, 12 bp, Homo sapiens
cttacccaaagc

SEQ ID NO: 5474647 - DNA, 14 bp, Homo sapiens
cttacccaatggga

SEQ ID NO: 5474648 - DNA, 17 bp, Homo sapiens
cttacccaatgggaccg

SEQ ID NO: 5474649 - DNA, 22 bp, Homo sapiens
cttacccaatgggaccgtgccc

SEQ ID NO: 5474650 - DNA, 21 bp, Homo sapiens
cttacccagattgtgtacata

SEQ ID NO: 5474651 - DNA, 21 bp, Homo sapiens
cttacccaggtgggtcccggc

SEQ ID NO: 5474652 - DNA, 11 bp, Homo sapiens
cttacccatct

SEQ ID NO: 5474653 - DNA, 15 bp, Homo sapiens
cttacccatcttgct

SEQ ID NO: 5474654 - DNA, 16 bp, Homo sapiens
cttacccatcttgctt

SEQ ID NO: 5474655 - DNA, 19 bp, Homo sapiens
cttacccatcttgcttcca

SEQ ID NO: 5474656 - DNA, 18 bp, Homo sapiens
cttaccccaaagagaaag

SEQ ID NO: 5474657 - DNA, 22 bp, Homo sapiens
cttaccccagcctacccttcct

SEQ ID NO: 5474658 - DNA, 18 bp, Homo sapiens
cttaccccagctgcggca

SEQ ID NO: 5474659 - DNA, 16 bp, Homo sapiens
cttacccccaccacta

SEQ ID NO: 5474660 - DNA, 17 bp, Homo sapiens
cttaccccgagacctca

SEQ ID NO: 5474661 - DNA, 19 bp, Homo sapiens
cttaccccgagacctcact

SEQ ID NO: 5474662 - DNA, 23 bp, Homo sapiens
cttaccccgtccctttccctgca

SEQ ID NO: 5474663 - DNA, 19 bp, Homo sapiens
cttacccctggctgtttgg

SEQ ID NO: 5474664 - DNA, 23 bp, Homo sapiens
cttacccgaaagcatcactgcct

SEQ ID NO: 5474665 - DNA, 22 bp, Homo sapiens
cttacccggagaaggccgctgc

SEQ ID NO: 5474666 - DNA, 12 bp, Homo sapiens
cttaccctactg

SEQ ID NO: 5474667 - DNA, 18 bp, Homo sapiens
cttaccctagttctctta

SEQ ID NO: 5474668 - DNA, 18 bp, Homo sapiens
cttaccctcatgttctta

SEQ ID NO: 5474669 - DNA, 19 bp, Homo sapiens
cttaccctcatgttcttaa

SEQ ID NO: 5474670 - DNA, 18 bp, Homo sapiens
cttaccctcctctgctgg

SEQ ID NO: 5474671 - DNA, 16 bp, Homo sapiens
cttaccctgggctgga

SEQ ID NO: 5474672 - DNA, 14 bp, Homo sapiens
cttacccttggttt

SEQ ID NO: 5474673 - DNA, 21 bp, Homo sapiens
cttacccttggtttgcacata

SEQ ID NO: 5474674 - DNA, 18 bp, Homo sapiens
cttaccgaaatgaaaatg

SEQ ID NO: 5474675 - DNA, 14 bp, Homo sapiens
cttaccgacaagca

SEQ ID NO: 5474676 - DNA, 16 bp, Homo sapiens
cttaccgagagccaaa

SEQ ID NO: 5474677 - DNA, 20 bp, Homo sapiens
cttaccgtgagcgacaaaga

SEQ ID NO: 5474678 - DNA, 21 bp, Homo sapiens
cttacctaaacagatataaat

SEQ ID NO: 5474679 - DNA, 22 bp, Homo sapiens
cttacctaaacagatataaatg

SEQ ID NO: 5474680 - DNA, 18 bp, Homo sapiens
cttacctagtgaaacttt

SEQ ID NO: 5474681 - DNA, 21 bp, Homo sapiens
cttacctagtgaaacttttct

SEQ ID NO: 5474682 - DNA, 18 bp, Homo sapiens
cttacctcccacctttgg

SEQ ID NO: 5474683 - DNA, 13 bp, Homo sapiens
cttacctcctgcc

SEQ ID NO: 5474684 - DNA, 14 bp, Homo sapiens
cttacctcctgccc

SEQ ID NO: 5474685 - DNA, 18 bp, Homo sapiens
cttacctcctgcccagga

SEQ ID NO: 5474686 - DNA, 19 bp, Homo sapiens
cttacctcctgcccaggag

SEQ ID NO: 5474687 - DNA, 18 bp, Homo sapiens
cttacctcggggagaggg

SEQ ID NO: 5474688 - DNA, 13 bp, Homo sapiens
cttacctcggtgc

SEQ ID NO: 5474689 - DNA, 14 bp, Homo sapiens
cttacctctctggg

SEQ ID NO: 5474690 - DNA, 18 bp, Homo sapiens
cttacctctctgggacct

SEQ ID NO: 5474691 - DNA, 17 bp, Homo sapiens
cttacctctgcttctga

SEQ ID NO: 5474692 - DNA, 12 bp, Homo sapiens
cttagacctcag

SEQ ID NO: 5474693 - DNA, 20 bp, Homo sapiens
cttagacctcagcctgtgct

SEQ ID NO: 5474694 - DNA, 22 bp, Homo sapiens
cttagacctcctaaatgcccca

SEQ ID NO: 5474695 - DNA, 21 bp, Homo sapiens
cttagacctcttcctggaata

SEQ ID NO: 5474696 - DNA, 15 bp, Homo sapiens
cttagacctgccagc

SEQ ID NO: 5474697 - DNA, 21 bp, Homo sapiens
cttagacgaagaagctggcta

SEQ ID NO: 5474698 - DNA, 22 bp, Homo sapiens
cttagacggtcttcactgtgtg

SEQ ID NO: 5474699 - DNA, 17 bp, Homo sapiens
cttagactagttgaaca

SEQ ID NO: 5474700 - DNA, 15 bp, Homo sapiens
cttagactccttctc

SEQ ID NO: 5474701 - DNA, 16 bp, Homo sapiens
cttagactccttctcc

SEQ ID NO: 5474702 - DNA, 21 bp, Homo sapiens
cttagactccttctccccaat

SEQ ID NO: 5474703 - DNA, 21 bp, Homo sapiens
cttagactctagtatttatgg

SEQ ID NO: 5474704 - DNA, 15 bp, Homo sapiens
cttagactcttttcc

SEQ ID NO: 5474705 - DNA, 13 bp, Homo sapiens
cttagactgaaaa

SEQ ID NO: 5474706 - DNA, 18 bp, Homo sapiens
cttagactgaaaaactgt

SEQ ID NO: 5474707 - DNA, 19 bp, Homo sapiens
cttagacttcgactcagga

SEQ ID NO: 5474708 - DNA, 16 bp, Homo sapiens
cttagacttgaaatac

SEQ ID NO: 5474709 - DNA, 21 bp, Homo sapiens
cttagagaatagttatatttt

SEQ ID NO: 5474710 - DNA, 17 bp, Homo sapiens
cttagagagagagagag

SEQ ID NO: 5474711 - DNA, 17 bp, Homo sapiens
cttagagagaggaggca

SEQ ID NO: 5474712 - DNA, 15 bp, Homo sapiens
cttagagaggaaaag

SEQ ID NO: 5474713 - DNA, 16 bp, Homo sapiens
cttagagaggaaaagc

SEQ ID NO: 5474714 - DNA, 21 bp, Homo sapiens
cttagagataccctctgagac

SEQ ID NO: 5474715 - DNA, 14 bp, Homo sapiens
cttagagatatgta

SEQ ID NO: 5474716 - DNA, 13 bp, Homo sapiens
cttagagatgcta

SEQ ID NO: 5474717 - DNA, 21 bp, Homo sapiens
cttagagatgctactgtcagt

SEQ ID NO: 5474718 - DNA, 22 bp, Homo sapiens
cttagagattgccccagagccc

SEQ ID NO: 5474719 - DNA, 19 bp, Homo sapiens
cttagagcaacctctgtat

SEQ ID NO: 5474720 - DNA, 14 bp, Homo sapiens
cttagagcatctct

SEQ ID NO: 5474721 - DNA, 19 bp, Homo sapiens
cttagagccaagtgtcttt

SEQ ID NO: 5474722 - DNA, 15 bp, Homo sapiens
cttagagccaggcac

SEQ ID NO: 5474723 - DNA, 21 bp, Homo sapiens
cttagagcctcgtccctccct

SEQ ID NO: 5474724 - DNA, 22 bp, Homo sapiens
cttagagccttttatctgcaga

SEQ ID NO: 5474725 - DNA, 21 bp, Homo sapiens
cttagaggcatgggcttgctg

SEQ ID NO: 5474726 - DNA, 18 bp, Homo sapiens
cttagaggcttgatgatg

SEQ ID NO: 5474727 - DNA, 20 bp, Homo sapiens
cttagagggatttctttgct

SEQ ID NO: 5474728 - DNA, 15 bp, Homo sapiens
cttagagtcatgagt

SEQ ID NO: 5474729 - DNA, 16 bp, Homo sapiens
cttagagtgtagctgt

SEQ ID NO: 5474730 - DNA, 18 bp, Homo sapiens
cttagagtgtagctgtaa

SEQ ID NO: 5474731 - DNA, 17 bp, Homo sapiens
cttagagttggccatat

SEQ ID NO: 5474732 - DNA, 15 bp, Homo sapiens
cttagagtttacagt

SEQ ID NO: 5474733 - DNA, 16 bp, Homo sapiens
cttagagtttacagtt

SEQ ID NO: 5474734 - DNA, 21 bp, Homo sapiens
cttagagtttacagtttgtgt

SEQ ID NO: 5474735 - DNA, 22 bp, Homo sapiens
cttagagtttacagtttgtgtt

SEQ ID NO: 5474736 - DNA, 22 bp, Homo sapiens
cttagagtttctgtttgattct

SEQ ID NO: 5474737 - DNA, 22 bp, Homo sapiens
cttagataacttcttgaaaaag

SEQ ID NO: 5474738 - DNA, 19 bp, Homo sapiens
cttagataatatttctgaa

SEQ ID NO: 5474739 - DNA, 21 bp, Homo sapiens
cttagataccttgaaaggcag

SEQ ID NO: 5474740 - DNA, 17 bp, Homo sapiens
cttagatatctttttat

SEQ ID NO: 5474741 - DNA, 14 bp, Homo sapiens
cttagatattaaaa

SEQ ID NO: 5474742 - DNA, 13 bp, Homo sapiens
cttagatatttca

SEQ ID NO: 5474743 - DNA, 19 bp, Homo sapiens
cttagatcatagttttatt

SEQ ID NO: 5474744 - DNA, 22 bp, Homo sapiens
cttagatcatagttttatttat

SEQ ID NO: 5474745 - DNA, 15 bp, Homo sapiens
cttagatccaaggca

SEQ ID NO: 5474746 - DNA, 15 bp, Homo sapiens
cttagatctgagccc

SEQ ID NO: 5474747 - DNA, 21 bp, Homo sapiens
cttagatctggcatgttagcc

SEQ ID NO: 5474748 - DNA, 22 bp, Homo sapiens
cttagatgacggggcctccttc

SEQ ID NO: 5474749 - DNA, 20 bp, Homo sapiens
cttagatgcagttctgaaga

SEQ ID NO: 5474750 - DNA, 22 bp, Homo sapiens
cttagatgcagttctgaagaag

SEQ ID NO: 5474751 - DNA, 16 bp, Homo sapiens
cttagatggattctcc

SEQ ID NO: 5474752 - DNA, 14 bp, Homo sapiens
cttagatgttaaat

SEQ ID NO: 5474753 - DNA, 20 bp, Homo sapiens
cttagattaagattttactt

SEQ ID NO: 5474754 - DNA, 17 bp, Homo sapiens
cttagattagctctgga

SEQ ID NO: 5474755 - DNA, 18 bp, Homo sapiens
cttagattatgttcaatg

SEQ ID NO: 5474756 - DNA, 15 bp, Homo sapiens
cttagattcagggga

SEQ ID NO: 5474757 - DNA, 24 bp, Homo sapiens
cttagattcaggggaagggcaggc

SEQ ID NO: 5474758 - DNA, 16 bp, Homo sapiens
cttagattcttaattc

SEQ ID NO: 5474759 - DNA, 14 bp, Homo sapiens
cttagatttcatag

SEQ ID NO: 5474760 - DNA, 21 bp, Homo sapiens
cttagatttcatagttcagaa

SEQ ID NO: 5474761 - DNA, 15 bp, Homo sapiens
cttagattttacatg

SEQ ID NO: 5474762 - DNA, 17 bp, Homo sapiens
cttagcaaaaaatgaac

SEQ ID NO: 5474763 - DNA, 13 bp, Homo sapiens
cttagcaactgct

SEQ ID NO: 5474764 - DNA, 22 bp, Homo sapiens
cttagcaactgctggggagaca

SEQ ID NO: 5474765 - DNA, 18 bp, Homo sapiens
cttagcaagacctgaaaa

SEQ ID NO: 5474766 - DNA, 19 bp, Homo sapiens
cttagcaataaatgctttt

SEQ ID NO: 5474767 - DNA, 20 bp, Homo sapiens
cttagcacagagagggacac

SEQ ID NO: 5474768 - DNA, 15 bp, Homo sapiens
cttagcaccttcagg

SEQ ID NO: 5474769 - DNA, 21 bp, Homo sapiens
cttagcactaccactcctgcc

SEQ ID NO: 5474770 - DNA, 16 bp, Homo sapiens
cttagcacttctttcc

SEQ ID NO: 5474771 - DNA, 20 bp, Homo sapiens
cttagcagcaactgaagaca

SEQ ID NO: 5474772 - DNA, 17 bp, Homo sapiens
cttagcagccctggatg

SEQ ID NO: 5474773 - DNA, 19 bp, Homo sapiens
cttagcagccctggatggt

SEQ ID NO: 5474774 - DNA, 22 bp, Homo sapiens
cttagcagctatctctcagtga

SEQ ID NO: 5474775 - DNA, 23 bp, Homo sapiens
cttagcagctatctctcagtgaa

SEQ ID NO: 5474776 - DNA, 17 bp, Homo sapiens
cttagcagctcttcccc

SEQ ID NO: 5474777 - DNA, 15 bp, Homo sapiens
cttagcagcttccag

SEQ ID NO: 5474778 - DNA, 16 bp, Homo sapiens
cttagcagcttccaga

SEQ ID NO: 5474779 - DNA, 17 bp, Homo sapiens
cttagcagcttctgtcc

SEQ ID NO: 5474780 - DNA, 21 bp, Homo sapiens
cttagcagggaaacagctaat

SEQ ID NO: 5474781 - DNA, 17 bp, Homo sapiens
cttagcagggacaggag

SEQ ID NO: 5474782 - DNA, 20 bp, Homo sapiens
cttagcagtcatagggctga

SEQ ID NO: 5474783 - DNA, 18 bp, Homo sapiens
cttagcagtccccttccc

SEQ ID NO: 5474784 - DNA, 21 bp, Homo sapiens
cttagcagtgagtattggaag

SEQ ID NO: 5474785 - DNA, 14 bp, Homo sapiens
cttagcagtgattt

SEQ ID NO: 5474786 - DNA, 22 bp, Homo sapiens
cttagcagtgatttttatccaa

SEQ ID NO: 5474787 - DNA, 14 bp, Homo sapiens
cttagcataatatt

SEQ ID NO: 5474788 - DNA, 22 bp, Homo sapiens
cttagcatagcttattattgaa

SEQ ID NO: 5474789 - DNA, 17 bp, Homo sapiens
cttagcatcccctgtga

SEQ ID NO: 5474790 - DNA, 22 bp, Homo sapiens
cttagcatgtgttgcagctgtc

SEQ ID NO: 5474791 - DNA, 17 bp, Homo sapiens
cttagcatgtttgctga

SEQ ID NO: 5474792 - DNA, 18 bp, Homo sapiens
cttagcatgtttgctgaa

SEQ ID NO: 5474793 - DNA, 21 bp, Homo sapiens
cttagcattttctgcatctcc

SEQ ID NO: 5474794 - DNA, 22 bp, Homo sapiens
cttagccaagccctaagcctgt

SEQ ID NO: 5474795 - DNA, 20 bp, Homo sapiens
cttagccatgatctgcaggg

SEQ ID NO: 5474796 - DNA, 13 bp, Homo sapiens
cttagccatgatg

SEQ ID NO: 5474797 - DNA, 12 bp, Homo sapiens
cttagcccaaga

SEQ ID NO: 5474798 - DNA, 18 bp, Homo sapiens
cttagccccattgctcca

SEQ ID NO: 5474799 - DNA, 13 bp, Homo sapiens
cttagcccccacc

SEQ ID NO: 5474800 - DNA, 18 bp, Homo sapiens
cttagcccggatgcccac

SEQ ID NO: 5474801 - DNA, 17 bp, Homo sapiens
cttagccgcaccctgca

SEQ ID NO: 5474802 - DNA, 22 bp, Homo sapiens
cttagccgcaccctgcacctgc

SEQ ID NO: 5474803 - DNA, 17 bp, Homo sapiens
cttagccgtccatggca

SEQ ID NO: 5474804 - DNA, 18 bp, Homo sapiens
cttagccgtccatggcac

SEQ ID NO: 5474805 - DNA, 20 bp, Homo sapiens
cttagccgtccatggcacca

SEQ ID NO: 5474806 - DNA, 15 bp, Homo sapiens
cttagcctccagcac

SEQ ID NO: 5474807 - DNA, 16 bp, Homo sapiens
cttagcctccagcacc

SEQ ID NO: 5474808 - DNA, 14 bp, Homo sapiens
cttagcctccctga

SEQ ID NO: 5474809 - DNA, 14 bp, Homo sapiens
cttagcctcctgac

SEQ ID NO: 5474810 - DNA, 20 bp, Homo sapiens
cttagcctcttggaaatcag

SEQ ID NO: 5474811 - DNA, 18 bp, Homo sapiens
cttagcctgcctcaccca

SEQ ID NO: 5474812 - DNA, 22 bp, Homo sapiens
cttagcctggagcacctttcct

SEQ ID NO: 5474813 - DNA, 18 bp, Homo sapiens
cttagcctggatttcctt

SEQ ID NO: 5474814 - DNA, 13 bp, Homo sapiens
cttagcctgggcc

SEQ ID NO: 5474815 - DNA, 19 bp, Homo sapiens
cttagccttgctgtagaga

SEQ ID NO: 5474816 - DNA, 21 bp, Homo sapiens
cttagccttgctgtagagact

SEQ ID NO: 5474817 - DNA, 22 bp, Homo sapiens
cttagccttgctgtagagactt

SEQ ID NO: 5474818 - DNA, 23 bp, Homo sapiens
gaagctttggttatgaaacatgt

SEQ ID NO: 5474819 - DNA, 19 bp, Homo sapiens
gaagctttgtacctttaga

SEQ ID NO: 5474820 - DNA, 16 bp, Homo sapiens
gaagctttgtagaaat

SEQ ID NO: 5474821 - DNA, 22 bp, Homo sapiens
gaagctttgtaggtgagatgca

SEQ ID NO: 5474822 - DNA, 19 bp, Homo sapiens
gaagctttgtcccctgctt

SEQ ID NO: 5474823 - DNA, 14 bp, Homo sapiens
gaagctttttaaaa

SEQ ID NO: 5474824 - DNA, 21 bp, Homo sapiens
gaagctttttaaaaattgtaa

SEQ ID NO: 5474825 - DNA, 18 bp, Homo sapiens
gaagctttttgtttgcat

SEQ ID NO: 5474826 - DNA, 14 bp, Homo sapiens
gaaggaaaaaagga

SEQ ID NO: 5474827 - DNA, 14 bp, Homo sapiens
gaaggaaaaacatg

SEQ ID NO: 5474828 - DNA, 16 bp, Homo sapiens
gaaggaaaaacatgct

SEQ ID NO: 5474829 - DNA, 15 bp, Homo sapiens
gaaggaaaaatgtgt

SEQ ID NO: 5474830 - DNA, 13 bp, Homo sapiens
gaaggaaaaattc

SEQ ID NO: 5474831 - DNA, 15 bp, Homo sapiens
gaaggaaaaattcaa

SEQ ID NO: 5474832 - DNA, 15 bp, Homo sapiens
gaaggaaaagagtaa

SEQ ID NO: 5474833 - DNA, 15 bp, Homo sapiens
gaaggaaaagcaaga

SEQ ID NO: 5474834 - DNA, 18 bp, Homo sapiens
gaaggaaaaggcagggag

SEQ ID NO: 5474835 - DNA, 20 bp, Homo sapiens
gaaggaaaaggcagggagcg

SEQ ID NO: 5474836 - DNA, 15 bp, Homo sapiens
gaaggaaaaggctgg

SEQ ID NO: 5474837 - DNA, 18 bp, Homo sapiens
gaaggaaaatactacctg

SEQ ID NO: 5474838 - DNA, 14 bp, Homo sapiens
gaaggaaacaacaa

SEQ ID NO: 5474839 - DNA, 21 bp, Homo sapiens
gaaggaaacaacaaaggaagt

SEQ ID NO: 5474840 - DNA, 14 bp, Homo sapiens
gaaggaaacccagc

SEQ ID NO: 5474841 - DNA, 22 bp, Homo sapiens
gaaggaaacccagctctggtcc

SEQ ID NO: 5474842 - DNA, 14 bp, Homo sapiens
gaaggaaacggaag

SEQ ID NO: 5474843 - DNA, 14 bp, Homo sapiens
gaaggaaagctata

SEQ ID NO: 5474844 - DNA, 17 bp, Homo sapiens
gaaggaaataaaaaagt

SEQ ID NO: 5474845 - DNA, 23 bp, Homo sapiens
gaaggaaataaaaaagtctctat

SEQ ID NO: 5474846 - DNA, 15 bp, Homo sapiens
gaaggaaataaacat

SEQ ID NO: 5474847 - DNA, 16 bp, Homo sapiens
gaaggaaataaacatt

SEQ ID NO: 5474848 - DNA, 16 bp, Homo sapiens
gaaggaaataacattg

SEQ ID NO: 5474849 - DNA, 15 bp, Homo sapiens
gaaggaaatgagtgg

SEQ ID NO: 5474850 - DNA, 19 bp, Homo sapiens
gaaggaaatgagtggccag

SEQ ID NO: 5474851 - DNA, 21 bp, Homo sapiens
gaaggaaatgagtggccagcg

SEQ ID NO: 5474852 - DNA, 13 bp, Homo sapiens
gaaggaaatgatg

SEQ ID NO: 5474853 - DNA, 14 bp, Homo sapiens
gaaggaaatgatgg

SEQ ID NO: 5474854 - DNA, 23 bp, Homo sapiens
gaaggaacacaaagatcaaatga

SEQ ID NO: 5474855 - DNA, 20 bp, Homo sapiens
gaaggaacatggagctgtca

SEQ ID NO: 5474856 - DNA, 23 bp, Homo sapiens
gaaggaaccaaagcgaattttaa

SEQ ID NO: 5474857 - DNA, 20 bp, Homo sapiens
gaaggaactcaaggtggctg

SEQ ID NO: 5474858 - DNA, 21 bp, Homo sapiens
gaaggaactcaaggtggctgg

SEQ ID NO: 5474859 - DNA, 15 bp, Homo sapiens
gaaggaactctggct

SEQ ID NO: 5474860 - DNA, 23 bp, Homo sapiens
gaaggaactctggcttccaggta

SEQ ID NO: 5474861 - DNA, 23 bp, Homo sapiens
gaaggaacttgtctcttcatcta

SEQ ID NO: 5474862 - DNA, 13 bp, Homo sapiens
gaaggaagagaag

SEQ ID NO: 5474863 - DNA, 14 bp, Homo sapiens
gaaggaagagaaga

SEQ ID NO: 5474864 - DNA, 21 bp, Homo sapiens
gaaggaagcccgcggggagag

SEQ ID NO: 5474865 - DNA, 23 bp, Homo sapiens
gaaggaagctgtgttgaaacaga

SEQ ID NO: 5474866 - DNA, 17 bp, Homo sapiens
gaaggaaggagccagct

SEQ ID NO: 5474867 - DNA, 13 bp, Homo sapiens
gaaggaaggaggg

SEQ ID NO: 5474868 - DNA, 17 bp, Homo sapiens
gcattatttaatgtttg

SEQ ID NO: 5474869 - DNA, 23 bp, Homo sapiens
gcattatttaatgtttgatttag

SEQ ID NO: 5474870 - DNA, 21 bp, Homo sapiens
gcattatttagtcaattgttt

SEQ ID NO: 5474871 - DNA, 16 bp, Homo sapiens
gcattattttatatat

SEQ ID NO: 5474872 - DNA, 13 bp, Homo sapiens
gcattattttcca

SEQ ID NO: 5474873 - DNA, 16 bp, Homo sapiens
gcattattttgtcata

SEQ ID NO: 5474874 - DNA, 15 bp, Homo sapiens
gcattattttttgtt

SEQ ID NO: 5474875 - DNA, 15 bp, Homo sapiens
gcattcaatcctcag

SEQ ID NO: 5474876 - DNA, 18 bp, Homo sapiens
gcattcacacacagcctg

SEQ ID NO: 5474877 - DNA, 20 bp, Homo sapiens
gcattcacacacagcctggc

SEQ ID NO: 5474878 - DNA, 22 bp, Homo sapiens
gcattcacacacagcctggcct

SEQ ID NO: 5474879 - DNA, 17 bp, Homo sapiens
gcattcacatatctgct

SEQ ID NO: 5474880 - DNA, 20 bp, Homo sapiens
gcattcacccagacagctcc

SEQ ID NO: 5474881 - DNA, 17 bp, Homo sapiens
gcattcagaacataaat

SEQ ID NO: 5474882 - DNA, 16 bp, Homo sapiens
gcattcagaagaaaaa

SEQ ID NO: 5474883 - DNA, 16 bp, Homo sapiens
gcattcagagagcagc

SEQ ID NO: 5474884 - DNA, 18 bp, Homo sapiens
gcattcaggcagcactga

SEQ ID NO: 5474885 - DNA, 23 bp, Homo sapiens
gcattcaggcagcactgacaata

SEQ ID NO: 5474886 - DNA, 22 bp, Homo sapiens
gcattcatgcaagagtttcttg

SEQ ID NO: 5474887 - DNA, 22 bp, Homo sapiens
gagagtcctttgggattctagg

SEQ ID NO: 5474888 - DNA, 18 bp, Homo sapiens
gagagtctaagataaaag

SEQ ID NO: 5474889 - DNA, 16 bp, Homo sapiens
gagagtctagattctc

SEQ ID NO: 5474890 - DNA, 12 bp, Homo sapiens
gagagtctgaga

SEQ ID NO: 5474891 - DNA, 22 bp, Homo sapiens
gagagtgaggtcatcccggggc

SEQ ID NO: 5474892 - DNA, 12 bp, Homo sapiens
gagagtgcactg

SEQ ID NO: 5474893 - DNA, 21 bp, Homo sapiens
gagagtgcagatctgtgctca

SEQ ID NO: 5474894 - DNA, 17 bp, Homo sapiens
gagagtggagagagcag

SEQ ID NO: 5474895 - DNA, 18 bp, Homo sapiens
gagagtggagagagcagg

SEQ ID NO: 5474896 - DNA, 15 bp, Homo sapiens
gagagtggcaggtgg

SEQ ID NO: 5474897 - DNA, 21 bp, Homo sapiens
gagagtggcatcatggggaca

SEQ ID NO: 5474898 - DNA, 16 bp, Homo sapiens
gagagtggctcctccc

SEQ ID NO: 5474899 - DNA, 18 bp, Homo sapiens
gagagtggtaaaaaagaa

SEQ ID NO: 5474900 - DNA, 17 bp, Homo sapiens
gagagtggtgagtggaa

SEQ ID NO: 5474901 - DNA, 14 bp, Homo sapiens
gagagtgtcaacca

SEQ ID NO: 5474902 - DNA, 21 bp, Homo sapiens
gagagtgtcttcacggcagga

SEQ ID NO: 5474903 - DNA, 12 bp, Homo sapiens
gagagtgtgcaa

SEQ ID NO: 5474904 - DNA, 20 bp, Homo sapiens
gagagtgtgcaactggccag

SEQ ID NO: 5474905 - DNA, 18 bp, Homo sapiens
gagagtgtgtgggcaggg

SEQ ID NO: 5474906 - DNA, 16 bp, Homo sapiens
gagagttaaaagcagc

SEQ ID NO: 5474907 - DNA, 19 bp, Homo sapiens
gagagttaaaagcagcagc

SEQ ID NO: 5474908 - DNA, 20 bp, Homo sapiens
gagagttaataggagtattt

SEQ ID NO: 5474909 - DNA, 14 bp, Homo sapiens
gagagttctggtga

SEQ ID NO: 5474910 - DNA, 19 bp, Homo sapiens
gagagttgacccctcctga

SEQ ID NO: 5474911 - DNA, 16 bp, Homo sapiens
gagagttgctcctcag

SEQ ID NO: 5474912 - DNA, 13 bp, Homo sapiens
gagagttggctca

SEQ ID NO: 5474913 - DNA, 18 bp, Homo sapiens
gagagttggctcaggcag

SEQ ID NO: 5474914 - DNA, 19 bp, Homo sapiens
gagagttggctcaggcaga

SEQ ID NO: 5474915 - DNA, 18 bp, Homo sapiens
gagagttgggggccagca

SEQ ID NO: 5474916 - DNA, 20 bp, Homo sapiens
gagagttgggggccagcaca

SEQ ID NO: 5474917 - DNA, 19 bp, Homo sapiens
gagagttgtgatggagggg

SEQ ID NO: 5474918 - DNA, 20 bp, Homo sapiens
gagagttgttcccccagggg

SEQ ID NO: 5474919 - DNA, 22 bp, Homo sapiens
gagagtttatcattgggagaag

SEQ ID NO: 5474920 - DNA, 13 bp, Homo sapiens
gagagtttcaaaa

SEQ ID NO: 5474921 - DNA, 13 bp, Homo sapiens
gagagtttcctca

SEQ ID NO: 5474922 - DNA, 17 bp, Homo sapiens
gagagtttttaatagaa

SEQ ID NO: 5474923 - DNA, 14 bp, Homo sapiens
gagataaaaatcat

SEQ ID NO: 5474924 - DNA, 23 bp, Homo sapiens
gagataaaacagaatcttctggg

SEQ ID NO: 5474925 - DNA, 15 bp, Homo sapiens
gagataaatgagctt

SEQ ID NO: 5474926 - DNA, 19 bp, Homo sapiens
gagataaatgcacatttca

SEQ ID NO: 5474927 - DNA, 14 bp, Homo sapiens
gagataaattttat

SEQ ID NO: 5474928 - DNA, 15 bp, Homo sapiens
gagataacagcctct

SEQ ID NO: 5474929 - DNA, 14 bp, Homo sapiens
gagataataagatt

SEQ ID NO: 5474930 - DNA, 22 bp, Homo sapiens
gagataatatgagatttctact

SEQ ID NO: 5474931 - DNA, 23 bp, Homo sapiens
gagataatctaaatataaaccag

SEQ ID NO: 5474932 - DNA, 14 bp, Homo sapiens
gagataatgaggca

SEQ ID NO: 5474933 - DNA, 23 bp, Homo sapiens
gagataccacaaaccctgctgaa

SEQ ID NO: 5474934 - DNA, 15 bp, Homo sapiens
gagataccagcgagg

SEQ ID NO: 5474935 - DNA, 16 bp, Homo sapiens
gagataccatcttctg

SEQ ID NO: 5474936 - DNA, 16 bp, Homo sapiens
gagataccctctgaga

SEQ ID NO: 5474937 - DNA, 19 bp, Homo sapiens
gagataccctctgagacag

SEQ ID NO: 5474938 - DNA, 17 bp, Homo sapiens
gagatacgaatttctat

SEQ ID NO: 5474939 - DNA, 18 bp, Homo sapiens
gagatacgtctgtgactt

SEQ ID NO: 5474940 - DNA, 16 bp, Homo sapiens
gagatactaaatctgg

SEQ ID NO: 5474941 - DNA, 21 bp, Homo sapiens
gagatacttgatgccaaaatg

SEQ ID NO: 5474942 - DNA, 23 bp, Homo sapiens
gagatacttgatgccaaaatgac

SEQ ID NO: 5474943 - DNA, 13 bp, Homo sapiens
gagatactttttc

SEQ ID NO: 5474944 - DNA, 21 bp, Homo sapiens
gagatagcaccattgcactcc

SEQ ID NO: 5474945 - DNA, 12 bp, Homo sapiens
gagatagcattg

SEQ ID NO: 5474946 - DNA, 16 bp, Homo sapiens
gagatagccaaggcca

SEQ ID NO: 5474947 - DNA, 14 bp, Homo sapiens
gagatagcctgtgg

SEQ ID NO: 5474948 - DNA, 17 bp, Homo sapiens
gagatagcctgtggccc

SEQ ID NO: 5474949 - DNA, 12 bp, Homo sapiens
gagatagctggg

SEQ ID NO: 5474950 - DNA, 14 bp, Homo sapiens
gagatagctggggc

SEQ ID NO: 5474951 - DNA, 12 bp, Homo sapiens
gagatagcttag

SEQ ID NO: 5474952 - DNA, 18 bp, Homo sapiens
gagatagcttagtgtctc

SEQ ID NO: 5474953 - DNA, 12 bp, Homo sapiens
gagataggggag

SEQ ID NO: 5474954 - DNA, 13 bp, Homo sapiens
gagatagttttca

SEQ ID NO: 5474955 - DNA, 18 bp, Homo sapiens
gagatatctgagggagga

SEQ ID NO: 5474956 - DNA, 21 bp, Homo sapiens
gagatatctgagggaggaggc

SEQ ID NO: 5474957 - DNA, 19 bp, Homo sapiens
gagatatgcaataaatatt

SEQ ID NO: 5474958 - DNA, 12 bp, Homo sapiens
gagatatgcaca

SEQ ID NO: 5474959 - DNA, 16 bp, Homo sapiens
gagatatggcagcgaa

SEQ ID NO: 5474960 - DNA, 15 bp, Homo sapiens
gagatatgtgtgtgt

SEQ ID NO: 5474961 - DNA, 11 bp, Homo sapiens
gagatattaaa

SEQ ID NO: 5474962 - DNA, 17 bp, Homo sapiens
gagatattaaattctca

SEQ ID NO: 5474963 - DNA, 18 bp, Homo sapiens
gagatattaatgcccaga

SEQ ID NO: 5474964 - DNA, 19 bp, Homo sapiens
gagatattaatgcccagac

SEQ ID NO: 5474965 - DNA, 14 bp, Homo sapiens
gagatattataagg

SEQ ID NO: 5474966 - DNA, 19 bp, Homo sapiens
gagatattataagggagag

SEQ ID NO: 5474967 - DNA, 19 bp, Homo sapiens
gagatattcttatttcact

SEQ ID NO: 5474968 - DNA, 14 bp, Homo sapiens
gagatattgatatt

SEQ ID NO: 5474969 - DNA, 22 bp, Homo sapiens
gagatatttacatgaattgcat

SEQ ID NO: 5474970 - DNA, 22 bp, Homo sapiens
gagatatttatggggggagaac

SEQ ID NO: 5474971 - DNA, 23 bp, Homo sapiens
gagatatttcaagctcatgtcat

SEQ ID NO: 5474972 - DNA, 14 bp, Homo sapiens
gagatcaaagatga

SEQ ID NO: 5474973 - DNA, 17 bp, Homo sapiens
gagatcaaatggaaagg

SEQ ID NO: 5474974 - DNA, 23 bp, Homo sapiens
gagatcaaatggaaaggagagga

SEQ ID NO: 5474975 - DNA, 17 bp, Homo sapiens
gagatcacagcctccag

SEQ ID NO: 5474976 - DNA, 12 bp, Homo sapiens
gagatcagcagt

SEQ ID NO: 5474977 - DNA, 15 bp, Homo sapiens
gagatcagcagtggc

SEQ ID NO: 5474978 - DNA, 19 bp, Homo sapiens
gagatcagcagtggcagga

SEQ ID NO: 5474979 - DNA, 16 bp, Homo sapiens
gagatcagcctgggca

SEQ ID NO: 5474980 - DNA, 20 bp, Homo sapiens
gagatcaggaagagaaggag

SEQ ID NO: 5474981 - DNA, 13 bp, Homo sapiens
gagatcaggctct

SEQ ID NO: 5474982 - DNA, 13 bp, Homo sapiens
gagatcagggcct

SEQ ID NO: 5474983 - DNA, 17 bp, Homo sapiens
gagatcagggcctgccc

SEQ ID NO: 5474984 - DNA, 23 bp, Homo sapiens
gagatcagggcctgccccctggg

SEQ ID NO: 5474985 - DNA, 22 bp, Homo sapiens
gagatcagggcgacctgcacgc

SEQ ID NO: 5474986 - DNA, 14 bp, Homo sapiens
gagatcatgagaaa

SEQ ID NO: 5474987 - DNA, 21 bp, Homo sapiens
gagatccaaaagaagccccca

SEQ ID NO: 5474988 - DNA, 13 bp, Homo sapiens
gagatccaaagac

SEQ ID NO: 5474989 - DNA, 10 bp, Homo sapiens
gagatccagt

SEQ ID NO: 5474990 - DNA, 18 bp, Homo sapiens
gagatcccttaagaagtt

SEQ ID NO: 5474991 - DNA, 17 bp, Homo sapiens
gagatccgccctgggct

SEQ ID NO: 5474992 - DNA, 19 bp, Homo sapiens
gagatccgccctgggctct

SEQ ID NO: 5474993 - DNA, 13 bp, Homo sapiens
gagatcctgatag

SEQ ID NO: 5474994 - DNA, 17 bp, Homo sapiens
gagatcctgtgattcct

SEQ ID NO: 5474995 - DNA, 17 bp, Homo sapiens
gagatcgacagacagcc

SEQ ID NO: 5474996 - DNA, 14 bp, Homo sapiens
gagatcgagaccat

SEQ ID NO: 5474997 - DNA, 16 bp, Homo sapiens
gagatcgctggcagag

SEQ ID NO: 5474998 - DNA, 23 bp, Homo sapiens
gagatcgtgccattacactccag

SEQ ID NO: 5474999 - DNA, 12 bp, Homo sapiens
gagatctacaca

SEQ ID NO: 5475000 - DNA, 16 bp, Homo sapiens
gagatctacacatgtt

SEQ ID NO: 5475001 - DNA, 17 bp, Homo sapiens
gagatctacacatgttg

SEQ ID NO: 5475002 - DNA, 19 bp, Homo sapiens
gagatctagaaagtgggtt

SEQ ID NO: 5475003 - DNA, 22 bp, Homo sapiens
gagatctccttgccctagatga

SEQ ID NO: 5475004 - DNA, 16 bp, Homo sapiens
gagatctgaacccagc

SEQ ID NO: 5475005 - DNA, 23 bp, Homo sapiens
gagatctgcacagtcagaaggac

SEQ ID NO: 5475006 - DNA, 18 bp, Homo sapiens
gagatctgctgtcctgtt

SEQ ID NO: 5475007 - DNA, 12 bp, Homo sapiens
gagatctgtata

SEQ ID NO: 5475008 - DNA, 18 bp, Homo sapiens
gagatctgtgtggctcct

SEQ ID NO: 5475009 - DNA, 22 bp, Homo sapiens
gagatcttacaggtatcaggca

SEQ ID NO: 5475010 - DNA, 21 bp, Homo sapiens
gagatcttcccctaacctttg

SEQ ID NO: 5475011 - DNA, 15 bp, Homo sapiens
gagatcttcctgctg

SEQ ID NO: 5475012 - DNA, 12 bp, Homo sapiens
gagatcttcctt

SEQ ID NO: 5475013 - DNA, 15 bp, Homo sapiens
gagatcttccttccg

SEQ ID NO: 5475014 - DNA, 23 bp, Homo sapiens
gagatcttccttccgctctgagg

SEQ ID NO: 5475015 - DNA, 18 bp, Homo sapiens
gagatctttctttccaaa

SEQ ID NO: 5475016 - DNA, 15 bp, Homo sapiens
gagatgaaaagacag

SEQ ID NO: 5475017 - DNA, 15 bp, Homo sapiens
gagatgaaatgcctt

SEQ ID NO: 5475018 - DNA, 18 bp, Homo sapiens
gagatgaagcaaacacat

SEQ ID NO: 5475019 - DNA, 20 bp, Homo sapiens
gagatgaagcaaacacatta

SEQ ID NO: 5475020 - DNA, 14 bp, Homo sapiens
gagatgaatagaag

SEQ ID NO: 5475021 - DNA, 21 bp, Homo sapiens
gagatgagaggtagccgggct

SEQ ID NO: 5475022 - DNA, 16 bp, Homo sapiens
gagatgagcagtgagt

SEQ ID NO: 5475023 - DNA, 12 bp, Homo sapiens
gagatgagccca

SEQ ID NO: 5475024 - DNA, 13 bp, Homo sapiens
gagatgagcccac

SEQ ID NO: 5475025 - DNA, 14 bp, Homo sapiens
gagatgaggagggg

SEQ ID NO: 5475026 - DNA, 18 bp, Homo sapiens
gagatgaggaggggagcg

SEQ ID NO: 5475027 - DNA, 15 bp, Homo sapiens
gagatgaggctggat

SEQ ID NO: 5475028 - DNA, 21 bp, Homo sapiens
gagatgagggatgggcctggc

SEQ ID NO: 5475029 - DNA, 18 bp, Homo sapiens
gagatgaggttttggaaa

SEQ ID NO: 5475030 - DNA, 16 bp, Homo sapiens
gagatgagtgggcttc

SEQ ID NO: 5475031 - DNA, 15 bp, Homo sapiens
gagatgagtgtctgg

SEQ ID NO: 5475032 - DNA, 17 bp, Homo sapiens
gagatgagtgtctggag

SEQ ID NO: 5475033 - DNA, 20 bp, Homo sapiens
gagatgagttgcagttttta

SEQ ID NO: 5475034 - DNA, 16 bp, Homo sapiens
gagatgagttttagga

SEQ ID NO: 5475035 - DNA, 20 bp, Homo sapiens
gagatgatcagtccaactga

SEQ ID NO: 5475036 - DNA, 14 bp, Homo sapiens
gagatgatcttgcc

SEQ ID NO: 5475037 - DNA, 18 bp, Homo sapiens
gagatgatgaaaatattt

SEQ ID NO: 5475038 - DNA, 14 bp, Homo sapiens
gagatgatgatgat

SEQ ID NO: 5475039 - DNA, 17 bp, Homo sapiens
gagatgattcagaaggg

SEQ ID NO: 5475040 - DNA, 14 bp, Homo sapiens
gagatgcaaggtgc

SEQ ID NO: 5475041 - DNA, 21 bp, Homo sapiens
gagatgcaccaccaagccaag

SEQ ID NO: 5475042 - DNA, 12 bp, Homo sapiens
gagatgcagagg

SEQ ID NO: 5475043 - DNA, 14 bp, Homo sapiens
gagatgcagaggta

SEQ ID NO: 5475044 - DNA, 16 bp, Homo sapiens
gagatgcagaggtaaa

SEQ ID NO: 5475045 - DNA, 20 bp, Homo sapiens
gagatgcagctactggaatg

SEQ ID NO: 5475046 - DNA, 13 bp, Homo sapiens
gagatgcagctgg

SEQ ID NO: 5475047 - DNA, 16 bp, Homo sapiens
gcatttttttattcag

SEQ ID NO: 5475048 - DNA, 15 bp, Homo sapiens
gcatttttttccttt

SEQ ID NO: 5475049 - DNA, 20 bp, Homo sapiens
gcattttttttttttaaagg

SEQ ID NO: 5475050 - DNA, 15 bp, Homo sapiens
gccaaaaaaaaaaga

SEQ ID NO: 5475051 - DNA, 16 bp, Homo sapiens
gccaaaaaaagacagg

SEQ ID NO: 5475052 - DNA, 21 bp, Homo sapiens
gccaaaaatacaacacagacg

SEQ ID NO: 5475053 - DNA, 13 bp, Homo sapiens
gccaaaaatagct

SEQ ID NO: 5475054 - DNA, 17 bp, Homo sapiens
gccaaaacacttaggaa

SEQ ID NO: 5475055 - DNA, 17 bp, Homo sapiens
gccaaaaccaatgctga

SEQ ID NO: 5475056 - DNA, 17 bp, Homo sapiens
gccaaaaccacatgggc

SEQ ID NO: 5475057 - DNA, 19 bp, Homo sapiens
gccaaaaccacatgggctg

SEQ ID NO: 5475058 - DNA, 21 bp, Homo sapiens
gccaaaaccacatgggctggg

SEQ ID NO: 5475059 - DNA, 13 bp, Homo sapiens
gccaaaacccagc

SEQ ID NO: 5475060 - DNA, 14 bp, Homo sapiens
gccaaaagaagttt

SEQ ID NO: 5475061 - DNA, 19 bp, Homo sapiens
gccaaaagatctggggagt

SEQ ID NO: 5475062 - DNA, 16 bp, Homo sapiens
gccaaaagctagacag

SEQ ID NO: 5475063 - DNA, 14 bp, Homo sapiens
gccaaaagctgctc

SEQ ID NO: 5475064 - DNA, 14 bp, Homo sapiens
gccaaaagcttccc

SEQ ID NO: 5475065 - DNA, 13 bp, Homo sapiens
gccaaaaggaaaa

SEQ ID NO: 5475066 - DNA, 19 bp, Homo sapiens
gccaaaaggccccttccca

SEQ ID NO: 5475067 - DNA, 19 bp, Homo sapiens
gccaaaaggtttcatgtag

SEQ ID NO: 5475068 - DNA, 15 bp, Homo sapiens
gccaaaagtccctcc

SEQ ID NO: 5475069 - DNA, 18 bp, Homo sapiens
gccaaaagtccctccctg

SEQ ID NO: 5475070 - DNA, 11 bp, Homo sapiens
gagatggagct

SEQ ID NO: 5475071 - DNA, 14 bp, Homo sapiens
gagatggagctacg

SEQ ID NO: 5475072 - DNA, 14 bp, Homo sapiens
gagatggaggagga

SEQ ID NO: 5475073 - DNA, 14 bp, Homo sapiens
gagatggagggctt

SEQ ID NO: 5475074 - DNA, 15 bp, Homo sapiens
gagatggaggtaggg

SEQ ID NO: 5475075 - DNA, 18 bp, Homo sapiens
gagatggagttcttgtgc

SEQ ID NO: 5475076 - DNA, 23 bp, Homo sapiens
gagatggatcaatcaaacccggc

SEQ ID NO: 5475077 - DNA, 11 bp, Homo sapiens
gagatggatgt

SEQ ID NO: 5475078 - DNA, 15 bp, Homo sapiens
gagatggcagagcca

SEQ ID NO: 5475079 - DNA, 12 bp, Homo sapiens
gagatggccata

SEQ ID NO: 5475080 - DNA, 15 bp, Homo sapiens
gagatggccccaaca

SEQ ID NO: 5475081 - DNA, 16 bp, Homo sapiens
gagatggccctctggt

SEQ ID NO: 5475082 - DNA, 17 bp, Homo sapiens
gagatggccctctggta

SEQ ID NO: 5475083 - DNA, 15 bp, Homo sapiens
gagatggctcccagg

SEQ ID NO: 5475084 - DNA, 23 bp, Homo sapiens
gagatggctccttgggatgaaga

SEQ ID NO: 5475085 - DNA, 12 bp, Homo sapiens
gagatggctgct

SEQ ID NO: 5475086 - DNA, 12 bp, Homo sapiens
gagatgggaagg

SEQ ID NO: 5475087 - DNA, 17 bp, Homo sapiens
gagatgggaagggctta

SEQ ID NO: 5475088 - DNA, 15 bp, Homo sapiens
gagatgggagctcct

SEQ ID NO: 5475089 - DNA, 16 bp, Homo sapiens
gagatgggcttcccaa

SEQ ID NO: 5475090 - DNA, 17 bp, Homo sapiens
gagatgggcttcccaag

SEQ ID NO: 5475091 - DNA, 20 bp, Homo sapiens
gagatggggaaagaattcct

SEQ ID NO: 5475092 - DNA, 13 bp, Homo sapiens
gagatgggggctt

SEQ ID NO: 5475093 - DNA, 16 bp, Homo sapiens
gagatgggggtgtatt

SEQ ID NO: 5475094 - DNA, 14 bp, Homo sapiens
gagatggggtgggg

SEQ ID NO: 5475095 - DNA, 23 bp, Homo sapiens
gagatgggtttggggctggcccc

SEQ ID NO: 5475096 - DNA, 15 bp, Homo sapiens
gagatggtgaggctg

SEQ ID NO: 5475097 - DNA, 19 bp, Homo sapiens
gagatggtgccccctgggg

SEQ ID NO: 5475098 - DNA, 22 bp, Homo sapiens
gagatggttaaaaaggccaaag

SEQ ID NO: 5475099 - DNA, 17 bp, Homo sapiens
gagatgtaaaaggtatt

SEQ ID NO: 5475100 - DNA, 22 bp, Homo sapiens
gagatgtaaaatgagtttgtat

SEQ ID NO: 5475101 - DNA, 16 bp, Homo sapiens
gagatgtaattgtttt

SEQ ID NO: 5475102 - DNA, 21 bp, Homo sapiens
gagatgtaccatgttaaagag

SEQ ID NO: 5475103 - DNA, 18 bp, Homo sapiens
gagatgtatgaaggcttt

SEQ ID NO: 5475104 - DNA, 16 bp, Homo sapiens
gagatgtatgcccaaa

SEQ ID NO: 5475105 - DNA, 20 bp, Homo sapiens
gagatgtatttctaaatgtt

SEQ ID NO: 5475106 - DNA, 21 bp, Homo sapiens
gagatgtcatcagagctcctc

SEQ ID NO: 5475107 - DNA, 23 bp, Homo sapiens
gagatgtccttgtaatattccct

SEQ ID NO: 5475108 - DNA, 16 bp, Homo sapiens
gagatgtctctgtgtg

SEQ ID NO: 5475109 - DNA, 23 bp, Homo sapiens
gagatgtctgttctaagtccact

SEQ ID NO: 5475110 - DNA, 13 bp, Homo sapiens
gagatgtgccccc

SEQ ID NO: 5475111 - DNA, 15 bp, Homo sapiens
gagatgtgcccccac

SEQ ID NO: 5475112 - DNA, 19 bp, Homo sapiens
gagatgtgcccccaccccc

SEQ ID NO: 5475113 - DNA, 18 bp, Homo sapiens
gagatgtgcctgtgggag

SEQ ID NO: 5475114 - DNA, 20 bp, Homo sapiens
gagatgtgtaatttttctgt

SEQ ID NO: 5475115 - DNA, 17 bp, Homo sapiens
gagatgtgtatcagtgt

SEQ ID NO: 5475116 - DNA, 20 bp, Homo sapiens
gagatgtgtccatgtgaaat

SEQ ID NO: 5475117 - DNA, 17 bp, Homo sapiens
gagatgtgtgttgatac

SEQ ID NO: 5475118 - DNA, 23 bp, Homo sapiens
gagatgtgtgttgatactgttgc

SEQ ID NO: 5475119 - DNA, 21 bp, Homo sapiens
gagatgtgttcctcctgctgt

SEQ ID NO: 5475120 - DNA, 14 bp, Homo sapiens
gagatgttgggaac

SEQ ID NO: 5475121 - DNA, 18 bp, Homo sapiens
gagatgtttttaaaagtt

SEQ ID NO: 5475122 - DNA, 16 bp, Homo sapiens
gagattaacacactga

SEQ ID NO: 5475123 - DNA, 14 bp, Homo sapiens
gagattaagatgcc

SEQ ID NO: 5475124 - DNA, 15 bp, Homo sapiens
gagattaattttaac

SEQ ID NO: 5475125 - DNA, 17 bp, Homo sapiens
gagattagaacatttaa

SEQ ID NO: 5475126 - DNA, 18 bp, Homo sapiens
gagattaggctgaggcag

SEQ ID NO: 5475127 - DNA, 13 bp, Homo sapiens
gagattatatttc

SEQ ID NO: 5475128 - DNA, 23 bp, Homo sapiens
gagattatttacaagaagaactc

SEQ ID NO: 5475129 - DNA, 21 bp, Homo sapiens
gagattcaaaaaaaaaatata

SEQ ID NO: 5475130 - DNA, 17 bp, Homo sapiens
gagattcaagacaagag

SEQ ID NO: 5475131 - DNA, 17 bp, Homo sapiens
gagattcagttttcatt

SEQ ID NO: 5475132 - DNA, 18 bp, Homo sapiens
gagattccacacaggggt

SEQ ID NO: 5475133 - DNA, 21 bp, Homo sapiens
gagattccagaacgccctgtg

SEQ ID NO: 5475134 - DNA, 23 bp, Homo sapiens
gagattccagaacgccctgtgtc

SEQ ID NO: 5475135 - DNA, 17 bp, Homo sapiens
gagattcccaccttcca

SEQ ID NO: 5475136 - DNA, 23 bp, Homo sapiens
gagattcccgcgggttccgcagg

SEQ ID NO: 5475137 - DNA, 19 bp, Homo sapiens
gagattcctgtaaatgtga

SEQ ID NO: 5475138 - DNA, 20 bp, Homo sapiens
gagattctgcctcagcctcc

SEQ ID NO: 5475139 - DNA, 21 bp, Homo sapiens
gagattctgcctttgccaggt

SEQ ID NO: 5475140 - DNA, 12 bp, Homo sapiens
gagattctggga

SEQ ID NO: 5475141 - DNA, 21 bp, Homo sapiens
gagattctgggaaaggtgctc

SEQ ID NO: 5475142 - DNA, 22 bp, Homo sapiens
gagattctgggaaaggtgctca

SEQ ID NO: 5475143 - DNA, 21 bp, Homo sapiens
gagattctttaaggagataga

SEQ ID NO: 5475144 - DNA, 16 bp, Homo sapiens
gagattgcaccactgc

SEQ ID NO: 5475145 - DNA, 12 bp, Homo sapiens
gagattgctaat

SEQ ID NO: 5475146 - DNA, 19 bp, Homo sapiens
gagattggatcaagtatta

SEQ ID NO: 5475147 - DNA, 15 bp, Homo sapiens
gagattggccagtga

SEQ ID NO: 5475148 - DNA, 13 bp, Homo sapiens
gagattggctttg

SEQ ID NO: 5475149 - DNA, 14 bp, Homo sapiens
gagattgggagaaa

SEQ ID NO: 5475150 - DNA, 17 bp, Homo sapiens
gagattgggatactgta

SEQ ID NO: 5475151 - DNA, 14 bp, Homo sapiens
gagattgggcctcc

SEQ ID NO: 5475152 - DNA, 18 bp, Homo sapiens
gagattggtcattaaata

SEQ ID NO: 5475153 - DNA, 17 bp, Homo sapiens
gagattggttttcctgt

SEQ ID NO: 5475154 - DNA, 21 bp, Homo sapiens
gagattgtgcccctgcactcc

SEQ ID NO: 5475155 - DNA, 22 bp, Homo sapiens
gagatttaccagggatgtagat

SEQ ID NO: 5475156 - DNA, 14 bp, Homo sapiens
gagatttatataaa

SEQ ID NO: 5475157 - DNA, 16 bp, Homo sapiens
gagatttatataaatg

SEQ ID NO: 5475158 - DNA, 16 bp, Homo sapiens
gagatttattaaagaa

SEQ ID NO: 5475159 - DNA, 13 bp, Homo sapiens
gagatttcatctg

SEQ ID NO: 5475160 - DNA, 17 bp, Homo sapiens
gagatttcatctgctct

SEQ ID NO: 5475161 - DNA, 21 bp, Homo sapiens
gagatttcatctgctctcctt

SEQ ID NO: 5475162 - DNA, 23 bp, Homo sapiens
gagatttcatctgctctccttcc

SEQ ID NO: 5475163 - DNA, 12 bp, Homo sapiens
gagatttcttag

SEQ ID NO: 5475164 - DNA, 18 bp, Homo sapiens
gagatttcttgttgctca

SEQ ID NO: 5475165 - DNA, 18 bp, Homo sapiens
gagatttcttttttatgt

SEQ ID NO: 5475166 - DNA, 15 bp, Homo sapiens
gagatttgccagcac

SEQ ID NO: 5475167 - DNA, 18 bp, Homo sapiens
gagatttgccagcacagg

SEQ ID NO: 5475168 - DNA, 22 bp, Homo sapiens
gagatttgccagcacaggggcc

SEQ ID NO: 5475169 - DNA, 22 bp, Homo sapiens
gagatttgctttttctgggtgc

SEQ ID NO: 5475170 - DNA, 15 bp, Homo sapiens
gagatttgggagctg

SEQ ID NO: 5475171 - DNA, 12 bp, Homo sapiens
gagatttgtaaa

SEQ ID NO: 5475172 - DNA, 12 bp, Homo sapiens
gagatttgtcta

SEQ ID NO: 5475173 - DNA, 14 bp, Homo sapiens
gagattttcatttt

SEQ ID NO: 5475174 - DNA, 16 bp, Homo sapiens
gagattttttattgct

SEQ ID NO: 5475175 - DNA, 17 bp, Homo sapiens
gagattttttattgcta

SEQ ID NO: 5475176 - DNA, 19 bp, Homo sapiens
gagatttttttgtgtatgt

SEQ ID NO: 5475177 - DNA, 14 bp, Homo sapiens
gagattttttttcc

SEQ ID NO: 5475178 - DNA, 19 bp, Homo sapiens
gagcaaaaatgtaaaaaac

SEQ ID NO: 5475179 - DNA, 23 bp, Homo sapiens
gagcaaaaatgtaaaaaacaaaa

SEQ ID NO: 5475180 - DNA, 22 bp, Homo sapiens
gagcaaaagaaacaccagtgtt

SEQ ID NO: 5475181 - DNA, 17 bp, Homo sapiens
gagcaaaaggcagctca

SEQ ID NO: 5475182 - DNA, 17 bp, Homo sapiens
gagcaaaataatgcaac

SEQ ID NO: 5475183 - DNA, 19 bp, Homo sapiens
gagcaaaatcgatgcagtg

SEQ ID NO: 5475184 - DNA, 13 bp, Homo sapiens
gagcaaaattcaa

SEQ ID NO: 5475185 - DNA, 14 bp, Homo sapiens
gagcaaaattcaaa

SEQ ID NO: 5475186 - DNA, 18 bp, Homo sapiens
gagcaaaattcaaaaaga

SEQ ID NO: 5475187 - DNA, 21 bp, Homo sapiens
gagcaaacaccagtgaggctc

SEQ ID NO: 5475188 - DNA, 19 bp, Homo sapiens
gagcaaacccagaggtgga

SEQ ID NO: 5475189 - DNA, 21 bp, Homo sapiens
gagcaaacctaacaggagaaa

SEQ ID NO: 5475190 - DNA, 13 bp, Homo sapiens
gagcaaacctgcc

SEQ ID NO: 5475191 - DNA, 20 bp, Homo sapiens
gagcaaactgaagcccacag

SEQ ID NO: 5475192 - DNA, 19 bp, Homo sapiens
gagcaaactgcatgcccag

SEQ ID NO: 5475193 - DNA, 23 bp, Homo sapiens
gagcaaactgcatgcccagagac

SEQ ID NO: 5475194 - DNA, 11 bp, Homo sapiens
gagcaaagcag

SEQ ID NO: 5475195 - DNA, 13 bp, Homo sapiens
gagcaaagcgccc

SEQ ID NO: 5475196 - DNA, 14 bp, Homo sapiens
gagcaaaggagaaa

SEQ ID NO: 5475197 - DNA, 13 bp, Homo sapiens
gagcaaaggccca

SEQ ID NO: 5475198 - DNA, 14 bp, Homo sapiens
gagcaaaggcccat

SEQ ID NO: 5475199 - DNA, 14 bp, Homo sapiens
gagcaaaggccctg

SEQ ID NO: 5475200 - DNA, 13 bp, Homo sapiens
gagcaaaggctga

SEQ ID NO: 5475201 - DNA, 16 bp, Homo sapiens
gagcaaaggctgagaa

SEQ ID NO: 5475202 - DNA, 22 bp, Homo sapiens
gagcaaaggctgagaacactgt

SEQ ID NO: 5475203 - DNA, 17 bp, Homo sapiens
gagcaaagtagatcatg

SEQ ID NO: 5475204 - DNA, 19 bp, Homo sapiens
gagcaaagtctaaagttta

SEQ ID NO: 5475205 - DNA, 20 bp, Homo sapiens
gagcaaagtgaagacactgg

SEQ ID NO: 5475206 - DNA, 18 bp, Homo sapiens
gagcaaatgcttaaaaca

SEQ ID NO: 5475207 - DNA, 14 bp, Homo sapiens
gagcaaatgtttct

SEQ ID NO: 5475208 - DNA, 19 bp, Homo sapiens
gagcaaatgtttctgcagt

SEQ ID NO: 5475209 - DNA, 13 bp, Homo sapiens
gagcaacatttta

SEQ ID NO: 5475210 - DNA, 22 bp, Homo sapiens
gagcaacccctggaccccagcc

SEQ ID NO: 5475211 - DNA, 15 bp, Homo sapiens
gagcaaccgtggccc

SEQ ID NO: 5475212 - DNA, 22 bp, Homo sapiens
gagcaaccgtggcccttcctgg

SEQ ID NO: 5475213 - DNA, 23 bp, Homo sapiens
gagcaaccgtggcccttcctgga

SEQ ID NO: 5475214 - DNA, 22 bp, Homo sapiens
gagcaacctactgtctaagcag

SEQ ID NO: 5475215 - DNA, 20 bp, Homo sapiens
gagcaacctcttcagctggg

SEQ ID NO: 5475216 - DNA, 21 bp, Homo sapiens
gagcaacggcccatagccttg

SEQ ID NO: 5475217 - DNA, 17 bp, Homo sapiens
gagcaacggccccagcg

SEQ ID NO: 5475218 - DNA, 19 bp, Homo sapiens
gagcaactctccactccat

SEQ ID NO: 5475219 - DNA, 24 bp, Homo sapiens
gagcaagaaaaaagtacagaacat

SEQ ID NO: 5475220 - DNA, 15 bp, Homo sapiens
gagcaagaagaaaat

SEQ ID NO: 5475221 - DNA, 19 bp, Homo sapiens
gagcaagaagaaaatgtgg

SEQ ID NO: 5475222 - DNA, 23 bp, Homo sapiens
gagcaagaaggaaggaggcagac

SEQ ID NO: 5475223 - DNA, 15 bp, Homo sapiens
gagcaagacagagac

SEQ ID NO: 5475224 - DNA, 21 bp, Homo sapiens
gagcaagacgctgtgctgccc

SEQ ID NO: 5475225 - DNA, 16 bp, Homo sapiens
ggcagatgacaagatg

SEQ ID NO: 5475226 - DNA, 12 bp, Homo sapiens
ggcagatgaggg

SEQ ID NO: 5475227 - DNA, 16 bp, Homo sapiens
ggcagatgagggctgg

SEQ ID NO: 5475228 - DNA, 13 bp, Homo sapiens
ggcagatggagcc

SEQ ID NO: 5475229 - DNA, 21 bp, Homo sapiens
ggcagatggcagggctgagga

SEQ ID NO: 5475230 - DNA, 15 bp, Homo sapiens
ggcagatggggagac

SEQ ID NO: 5475231 - DNA, 14 bp, Homo sapiens
ggcagatgggggcc

SEQ ID NO: 5475232 - DNA, 21 bp, Homo sapiens
ggcagatgtcccccactgcta

SEQ ID NO: 5475233 - DNA, 15 bp, Homo sapiens
ggcagatgtcttccc

SEQ ID NO: 5475234 - DNA, 17 bp, Homo sapiens
ggcagatgtcttccctg

SEQ ID NO: 5475235 - DNA, 17 bp, Homo sapiens
ggcagatgtttgcctca

SEQ ID NO: 5475236 - DNA, 21 bp, Homo sapiens
ggcagattaataacagaaata

SEQ ID NO: 5475237 - DNA, 16 bp, Homo sapiens
ggcagattcccactgc

SEQ ID NO: 5475238 - DNA, 22 bp, Homo sapiens
ggcagattggttcatgcctggg

SEQ ID NO: 5475239 - DNA, 13 bp, Homo sapiens
ggcagattgtttt

SEQ ID NO: 5475240 - DNA, 24 bp, Homo sapiens
ggcagatttagtgaaagctagaga

SEQ ID NO: 5475241 - DNA, 14 bp, Homo sapiens
ggcagatttgcaac

SEQ ID NO: 5475242 - DNA, 20 bp, Homo sapiens
ggcagattttacagagcgca

SEQ ID NO: 5475243 - DNA, 19 bp, Homo sapiens
ggcagcaaagaggggcgct

SEQ ID NO: 5475244 - DNA, 20 bp, Homo sapiens
ggcagcaaagaggggcgctg

SEQ ID NO: 5475245 - DNA, 22 bp, Homo sapiens
ggcagcaaagaggggcgctgtc

SEQ ID NO: 5475246 - DNA, 16 bp, Homo sapiens
ggcagcaaagcagctg

SEQ ID NO: 5475247 - DNA, 13 bp, Homo sapiens
ggcagcaaaggaa

SEQ ID NO: 5475248 - DNA, 15 bp, Homo sapiens
ggcagcaaaggaaga

SEQ ID NO: 5475249 - DNA, 16 bp, Homo sapiens
ggcagcaacagcagag

SEQ ID NO: 5475250 - DNA, 13 bp, Homo sapiens
ggcagcaaggccc

SEQ ID NO: 5475251 - DNA, 21 bp, Homo sapiens
ggcagcaaggcccgagcagct

SEQ ID NO: 5475252 - DNA, 13 bp, Homo sapiens
ggcagcaaggctg

SEQ ID NO: 5475253 - DNA, 15 bp, Homo sapiens
ggcagcaaggctgct

SEQ ID NO: 5475254 - DNA, 17 bp, Homo sapiens
ggcagcaaggtcatggt

SEQ ID NO: 5475255 - DNA, 16 bp, Homo sapiens
ggcagcaatggcgctg

SEQ ID NO: 5475256 - DNA, 20 bp, Homo sapiens
ggcagcaatggcgctgtgcg

SEQ ID NO: 5475257 - DNA, 17 bp, Homo sapiens
ggcagcacacctctggg

SEQ ID NO: 5475258 - DNA, 15 bp, Homo sapiens
ggcagcacagcccag

SEQ ID NO: 5475259 - DNA, 16 bp, Homo sapiens
ggcagcacagcccagg

SEQ ID NO: 5475260 - DNA, 17 bp, Homo sapiens
ggcagcacagcccaggg

SEQ ID NO: 5475261 - DNA, 19 bp, Homo sapiens
ggcagcacagcccagggcc

SEQ ID NO: 5475262 - DNA, 23 bp, Homo sapiens
ggcagcacagcccagggcctgca

SEQ ID NO: 5475263 - DNA, 22 bp, Homo sapiens
ggcagcacagctactcagatct

SEQ ID NO: 5475264 - DNA, 17 bp, Homo sapiens
ggcagcaccctataaat

SEQ ID NO: 5475265 - DNA, 22 bp, Homo sapiens
ggcagcacctccgggactgacc

SEQ ID NO: 5475266 - DNA, 13 bp, Homo sapiens
ggcagcagaaaac

SEQ ID NO: 5475267 - DNA, 14 bp, Homo sapiens
ggcagcagacacat

SEQ ID NO: 5475268 - DNA, 11 bp, Homo sapiens
ggcagcagaga

SEQ ID NO: 5475269 - DNA, 13 bp, Homo sapiens
ggcagcagagaga

SEQ ID NO: 5475270 - DNA, 12 bp, Homo sapiens
ggcagcagagcg

SEQ ID NO: 5475271 - DNA, 15 bp, Homo sapiens
ggcagcagcagcagc

SEQ ID NO: 5475272 - DNA, 18 bp, Homo sapiens
ggcagcagcatcccagcc

SEQ ID NO: 5475273 - DNA, 11 bp, Homo sapiens
ggcagcagcca

SEQ ID NO: 5475274 - DNA, 14 bp, Homo sapiens
ggcagcagccagcc

SEQ ID NO: 5475275 - DNA, 17 bp, Homo sapiens
ggcagcagccagccctg

SEQ ID NO: 5475276 - DNA, 19 bp, Homo sapiens
ggcagcagccagccctgcc

SEQ ID NO: 5475277 - DNA, 23 bp, Homo sapiens
ggcagcagccagccctgcctgga

SEQ ID NO: 5475278 - DNA, 12 bp, Homo sapiens
ggcagcagccat

SEQ ID NO: 5475279 - DNA, 15 bp, Homo sapiens
ggcagcagcccccag

SEQ ID NO: 5475280 - DNA, 23 bp, Homo sapiens
ggcagcagcccccagctcccacc

SEQ ID NO: 5475281 - DNA, 13 bp, Homo sapiens
ggcagcagctcag

SEQ ID NO: 5475282 - DNA, 13 bp, Homo sapiens
ggcagcaggagga

SEQ ID NO: 5475283 - DNA, 15 bp, Homo sapiens
ggcagcaggccagag

SEQ ID NO: 5475284 - DNA, 16 bp, Homo sapiens
ggcagcaggccagaga

SEQ ID NO: 5475285 - DNA, 21 bp, Homo sapiens
ggcagcaggcctgttgctttt

SEQ ID NO: 5475286 - DNA, 18 bp, Homo sapiens
ggcagcagggctaccctg

SEQ ID NO: 5475287 - DNA, 21 bp, Homo sapiens
ggcagcagggctaccctgagc

SEQ ID NO: 5475288 - DNA, 12 bp, Homo sapiens
ggcagcaggggc

SEQ ID NO: 5475289 - DNA, 20 bp, Homo sapiens
ggcagcaggggctgctgtga

SEQ ID NO: 5475290 - DNA, 15 bp, Homo sapiens
ggcagcaggtgctgc

SEQ ID NO: 5475291 - DNA, 21 bp, Homo sapiens
ggcagcaggtgctgctaccct

SEQ ID NO: 5475292 - DNA, 14 bp, Homo sapiens
ggcagcagtgtctg

SEQ ID NO: 5475293 - DNA, 22 bp, Homo sapiens
ggcagcagtgtgaggccagggc

SEQ ID NO: 5475294 - DNA, 21 bp, Homo sapiens
ggcagcagttccatgaagaca

SEQ ID NO: 5475295 - DNA, 17 bp, Homo sapiens
ggcagcatagcaagaca

SEQ ID NO: 5475296 - DNA, 21 bp, Homo sapiens
ggcagcatgaattccaactca

SEQ ID NO: 5475297 - DNA, 14 bp, Homo sapiens
ggcagcatgcccag

SEQ ID NO: 5475298 - DNA, 16 bp, Homo sapiens
ggcagcatgcccagat

SEQ ID NO: 5475299 - DNA, 23 bp, Homo sapiens
ggcagcatgcttgggctgaccca

SEQ ID NO: 5475300 - DNA, 21 bp, Homo sapiens
ggcagcattttcatatccaag

SEQ ID NO: 5475301 - DNA, 16 bp, Homo sapiens
ggcagccaaacccatg

SEQ ID NO: 5475302 - DNA, 19 bp, Homo sapiens
ggcagccaaacccatgagg

SEQ ID NO: 5475303 - DNA, 15 bp, Homo sapiens
ggcagccaaggaatg

SEQ ID NO: 5475304 - DNA, 15 bp, Homo sapiens
ggcagccacacgcag

SEQ ID NO: 5475305 - DNA, 16 bp, Homo sapiens
ggcagccacacgcagg

SEQ ID NO: 5475306 - DNA, 17 bp, Homo sapiens
ggcagccacacgcaggc

SEQ ID NO: 5475307 - DNA, 20 bp, Homo sapiens
ggcagccacacttctcagga

SEQ ID NO: 5475308 - DNA, 13 bp, Homo sapiens
ggcagccacagga

SEQ ID NO: 5475309 - DNA, 15 bp, Homo sapiens
ggcagccacaggact

SEQ ID NO: 5475310 - DNA, 17 bp, Homo sapiens
ggcagccacaggactga

SEQ ID NO: 5475311 - DNA, 12 bp, Homo sapiens
ggcagccaccca

SEQ ID NO: 5475312 - DNA, 23 bp, Homo sapiens
ggcagccacttcggccaggtcac

SEQ ID NO: 5475313 - DNA, 13 bp, Homo sapiens
ggcagccagacca

SEQ ID NO: 5475314 - DNA, 15 bp, Homo sapiens
ggcagccagaccagc

SEQ ID NO: 5475315 - DNA, 15 bp, Homo sapiens
ggcagccagacccag

SEQ ID NO: 5475316 - DNA, 11 bp, Homo sapiens
ggcagccagat

SEQ ID NO: 5475317 - DNA, 17 bp, Homo sapiens
ggcagccagatccccag

SEQ ID NO: 5475318 - DNA, 19 bp, Homo sapiens
ggcagccagatccccaggg

SEQ ID NO: 5475319 - DNA, 22 bp, Homo sapiens
ggcagccagatccccagggcag

SEQ ID NO: 5475320 - DNA, 15 bp, Homo sapiens
ggcagccagatggcc

SEQ ID NO: 5475321 - DNA, 12 bp, Homo sapiens
ggcagccagcag

SEQ ID NO: 5475322 - DNA, 15 bp, Homo sapiens
ggcagccagccgtgg

SEQ ID NO: 5475323 - DNA, 14 bp, Homo sapiens
ggcagccaggccac

SEQ ID NO: 5475324 - DNA, 18 bp, Homo sapiens
ggcagccaggctgggccg

SEQ ID NO: 5475325 - DNA, 17 bp, Homo sapiens
ggcagccagggagagcc

SEQ ID NO: 5475326 - DNA, 21 bp, Homo sapiens
ggcagccagggagagcccagg

SEQ ID NO: 5475327 - DNA, 22 bp, Homo sapiens
ggcagccagggagcccggggca

SEQ ID NO: 5475328 - DNA, 12 bp, Homo sapiens
gcctcctcccat

SEQ ID NO: 5475329 - DNA, 21 bp, Homo sapiens
gcctcctcccatccagcgtct

SEQ ID NO: 5475330 - DNA, 18 bp, Homo sapiens
gcctcctcccccacccct

SEQ ID NO: 5475331 - DNA, 19 bp, Homo sapiens
gcctcctcccccacccctt

SEQ ID NO: 5475332 - DNA, 16 bp, Homo sapiens
gcctcctccctcccag

SEQ ID NO: 5475333 - DNA, 17 bp, Homo sapiens
gcctcctccctcccagc

SEQ ID NO: 5475334 - DNA, 20 bp, Homo sapiens
gcctcctccctcccagctgc

SEQ ID NO: 5475335 - DNA, 24 bp, Homo sapiens
gcctcctccctcccagctgcactt

SEQ ID NO: 5475336 - DNA, 16 bp, Homo sapiens
gcctcctccctccctc

SEQ ID NO: 5475337 - DNA, 20 bp, Homo sapiens
gcctcctccctccctctccg

SEQ ID NO: 5475338 - DNA, 16 bp, Homo sapiens
gcctcctccctggctg

SEQ ID NO: 5475339 - DNA, 17 bp, Homo sapiens
gcctcctccctggctgc

SEQ ID NO: 5475340 - DNA, 16 bp, Homo sapiens
gcctcctcctcaccct

SEQ ID NO: 5475341 - DNA, 13 bp, Homo sapiens
gcctcctcctgac

SEQ ID NO: 5475342 - DNA, 13 bp, Homo sapiens
gcctcctcctgca

SEQ ID NO: 5475343 - DNA, 13 bp, Homo sapiens
gcctcctcctgcc

SEQ ID NO: 5475344 - DNA, 22 bp, Homo sapiens
gcctcctcggagagcagcagca

SEQ ID NO: 5475345 - DNA, 23 bp, Homo sapiens
gcctcctcggagagcagcagcac

SEQ ID NO: 5475346 - DNA, 16 bp, Homo sapiens
gcctcctctctccctg

SEQ ID NO: 5475347 - DNA, 17 bp, Homo sapiens
gcctcctctctccctgc

SEQ ID NO: 5475348 - DNA, 22 bp, Homo sapiens
gcctcctctctccctgcctcac

SEQ ID NO: 5475349 - DNA, 11 bp, Homo sapiens
gcctcctctgc

SEQ ID NO: 5475350 - DNA, 21 bp, Homo sapiens
gcctcctctgtctgcccttca

SEQ ID NO: 5475351 - DNA, 17 bp, Homo sapiens
gcctcctcttcaccccg

SEQ ID NO: 5475352 - DNA, 21 bp, Homo sapiens
gcctcctgacacacctgcagc

SEQ ID NO: 5475353 - DNA, 17 bp, Homo sapiens
gcctcctgacctgaggc

SEQ ID NO: 5475354 - DNA, 16 bp, Homo sapiens
gcctcctgagcctgtg

SEQ ID NO: 5475355 - DNA, 13 bp, Homo sapiens
gcctcctgaggct

SEQ ID NO: 5475356 - DNA, 21 bp, Homo sapiens
gcctcctgagggctccatgct

SEQ ID NO: 5475357 - DNA, 23 bp, Homo sapiens
gcctcctgagtagctgggactac

SEQ ID NO: 5475358 - DNA, 13 bp, Homo sapiens
gcctcctgccatg

SEQ ID NO: 5475359 - DNA, 20 bp, Homo sapiens
gcctcctgcccagtccccca

SEQ ID NO: 5475360 - DNA, 16 bp, Homo sapiens
gcctcctgccccctgc

SEQ ID NO: 5475361 - DNA, 18 bp, Homo sapiens
gcctcctgccccctgcca

SEQ ID NO: 5475362 - DNA, 19 bp, Homo sapiens
gcctcctgccccctgccag

SEQ ID NO: 5475363 - DNA, 20 bp, Homo sapiens
gcctcctgccggctccttgg

SEQ ID NO: 5475364 - DNA, 13 bp, Homo sapiens
gcctcctgcctcc

SEQ ID NO: 5475365 - DNA, 13 bp, Homo sapiens
gcctcctgcctct

SEQ ID NO: 5475366 - DNA, 17 bp, Homo sapiens
gcctcctgcctgcccct

SEQ ID NO: 5475367 - DNA, 12 bp, Homo sapiens
gcctcctgcgcc

SEQ ID NO: 5475368 - DNA, 21 bp, Homo sapiens
gcctcctgcgccctgtgcccg

SEQ ID NO: 5475369 - DNA, 15 bp, Homo sapiens
gcctcctgctctgca

SEQ ID NO: 5475370 - DNA, 13 bp, Homo sapiens
gcctcctgctgag

SEQ ID NO: 5475371 - DNA, 13 bp, Homo sapiens
gcctcctgctttg

SEQ ID NO: 5475372 - DNA, 20 bp, Homo sapiens
gcctcctgctttgggaagac

SEQ ID NO: 5475373 - DNA, 15 bp, Homo sapiens
gcctcctggccagac

SEQ ID NO: 5475374 - DNA, 20 bp, Homo sapiens
gcctcctgggaccatggaca

SEQ ID NO: 5475375 - DNA, 16 bp, Homo sapiens
gcctcctgtacctcag

SEQ ID NO: 5475376 - DNA, 19 bp, Homo sapiens
gcctcctgtacctcagtgg

SEQ ID NO: 5475377 - DNA, 13 bp, Homo sapiens
gcctcctgtgcct

SEQ ID NO: 5475378 - DNA, 19 bp, Homo sapiens
gcctcctgtgcctcccttt

SEQ ID NO: 5475379 - DNA, 16 bp, Homo sapiens
gcctcctgtgcctggc

SEQ ID NO: 5475380 - DNA, 20 bp, Homo sapiens
gcctcctgtggcctgccagt

SEQ ID NO: 5475381 - DNA, 14 bp, Homo sapiens
gcctcctgtgggga

SEQ ID NO: 5475382 - DNA, 19 bp, Homo sapiens
gcctcctgtgtactgtgtc

SEQ ID NO: 5475383 - DNA, 13 bp, Homo sapiens
gcctcctgtgtgt

SEQ ID NO: 5475384 - DNA, 21 bp, Homo sapiens
gcctcctgtgtgtctgcagac

SEQ ID NO: 5475385 - DNA, 19 bp, Homo sapiens
gcctcctgtgtgtgcgcct

SEQ ID NO: 5475386 - DNA, 23 bp, Homo sapiens
gcctcctgtgtgtgcgcctacag

SEQ ID NO: 5475387 - DNA, 17 bp, Homo sapiens
gcctcctgtttgcaggc

SEQ ID NO: 5475388 - DNA, 22 bp, Homo sapiens
gcctccttatatttggcccaaa

SEQ ID NO: 5475389 - DNA, 16 bp, Homo sapiens
gcctccttatttatca

SEQ ID NO: 5475390 - DNA, 18 bp, Homo sapiens
gcctccttccacctccct

SEQ ID NO: 5475391 - DNA, 17 bp, Homo sapiens
gcctccttcccatgcct

SEQ ID NO: 5475392 - DNA, 19 bp, Homo sapiens
gcctccttcccatgcctgt

SEQ ID NO: 5475393 - DNA, 24 bp, Homo sapiens
gcctccttcctcttttccttccca

SEQ ID NO: 5475394 - DNA, 19 bp, Homo sapiens
gcctccttcttaactctgc

SEQ ID NO: 5475395 - DNA, 20 bp, Homo sapiens
gcctccttgccagccccacc

SEQ ID NO: 5475396 - DNA, 12 bp, Homo sapiens
gcctccttgtgc

SEQ ID NO: 5475397 - DNA, 19 bp, Homo sapiens
gcctcctttgtgaggaagc

SEQ ID NO: 5475398 - DNA, 20 bp, Homo sapiens
gcctcctttgtgaggaagcc

SEQ ID NO: 5475399 - DNA, 15 bp, Homo sapiens
gcctcgaaagtgtca

SEQ ID NO: 5475400 - DNA, 17 bp, Homo sapiens
gcctcgaactggctgca

SEQ ID NO: 5475401 - DNA, 20 bp, Homo sapiens
gcctcgaactggctgcaaag

SEQ ID NO: 5475402 - DNA, 17 bp, Homo sapiens
gcctcgacacagagtgg

SEQ ID NO: 5475403 - DNA, 17 bp, Homo sapiens
gcctcgacaccccccca

SEQ ID NO: 5475404 - DNA, 14 bp, Homo sapiens
gcctctgaccccag

SEQ ID NO: 5475405 - DNA, 15 bp, Homo sapiens
gcctctgacccctcc

SEQ ID NO: 5475406 - DNA, 17 bp, Homo sapiens
gcctctgacccctcctc

SEQ ID NO: 5475407 - DNA, 19 bp, Homo sapiens
gcctctgacccctcctcac

SEQ ID NO: 5475408 - DNA, 14 bp, Homo sapiens
gcctctgagagcat

SEQ ID NO: 5475409 - DNA, 15 bp, Homo sapiens
gcctctgagatttgg

SEQ ID NO: 5475410 - DNA, 18 bp, Homo sapiens
gcctctgagccactggag

SEQ ID NO: 5475411 - DNA, 13 bp, Homo sapiens
gcctctgagccag

SEQ ID NO: 5475412 - DNA, 20 bp, Homo sapiens
gcctctgagccaggagcctc

SEQ ID NO: 5475413 - DNA, 14 bp, Homo sapiens
gcctctgagcccaa

SEQ ID NO: 5475414 - DNA, 19 bp, Homo sapiens
gcctctgagcccaagctaa

SEQ ID NO: 5475415 - DNA, 22 bp, Homo sapiens
gcctctgagcccaagctaagcc

SEQ ID NO: 5475416 - DNA, 15 bp, Homo sapiens
gcctctgaggagccc

SEQ ID NO: 5475417 - DNA, 16 bp, Homo sapiens
gcctctgaggccagcc

SEQ ID NO: 5475418 - DNA, 17 bp, Homo sapiens
gcctctgaggccagcct

SEQ ID NO: 5475419 - DNA, 21 bp, Homo sapiens
gcctctgaggccagcctggcc

SEQ ID NO: 5475420 - DNA, 22 bp, Homo sapiens
gcctctgaggccagcctggcct

SEQ ID NO: 5475421 - DNA, 13 bp, Homo sapiens
gcctctgatatgg

SEQ ID NO: 5475422 - DNA, 15 bp, Homo sapiens
gcctctgatatggga

SEQ ID NO: 5475423 - DNA, 18 bp, Homo sapiens
gcctctgatatgggactg

SEQ ID NO: 5475424 - DNA, 19 bp, Homo sapiens
gcctctgatatgggactga

SEQ ID NO: 5475425 - DNA, 17 bp, Homo sapiens
gcctctgatctgtgcag

SEQ ID NO: 5475426 - DNA, 17 bp, Homo sapiens
gcctctgcaaaggaaat

SEQ ID NO: 5475427 - DNA, 20 bp, Homo sapiens
gcctctgcaactgctcagct

SEQ ID NO: 5475428 - DNA, 17 bp, Homo sapiens
gcctctgcacgtgcaca

SEQ ID NO: 5475429 - DNA, 21 bp, Homo sapiens
gcctctgcacgtgcacacacc

SEQ ID NO: 5475430 - DNA, 23 bp, Homo sapiens
gcctctgcacgtgcacacacctg

SEQ ID NO: 5475431 - DNA, 15 bp, Homo sapiens
gcctctgcactcccc

SEQ ID NO: 5475432 - DNA, 16 bp, Homo sapiens
gcctctgcactcccct

SEQ ID NO: 5475433 - DNA, 18 bp, Homo sapiens
gcctctgcagtctcattt

SEQ ID NO: 5475434 - DNA, 19 bp, Homo sapiens
gcctctgccacactctgac

SEQ ID NO: 5475435 - DNA, 15 bp, Homo sapiens
gcctctgccacagca

SEQ ID NO: 5475436 - DNA, 20 bp, Homo sapiens
gcctctgccacagcaaggct

SEQ ID NO: 5475437 - DNA, 14 bp, Homo sapiens
gcctctgccaggcc

SEQ ID NO: 5475438 - DNA, 15 bp, Homo sapiens
gcctctgccatcctc

SEQ ID NO: 5475439 - DNA, 22 bp, Homo sapiens
gcctctgccatcctccctgttc

SEQ ID NO: 5475440 - DNA, 12 bp, Homo sapiens
gcctctgcccca

SEQ ID NO: 5475441 - DNA, 17 bp, Homo sapiens
gcctctgccccaagagc

SEQ ID NO: 5475442 - DNA, 16 bp, Homo sapiens
gcctctgccccaaggg

SEQ ID NO: 5475443 - DNA, 15 bp, Homo sapiens
gcctctgccccaccc

SEQ ID NO: 5475444 - DNA, 16 bp, Homo sapiens
gcctctgcccctcttc

SEQ ID NO: 5475445 - DNA, 19 bp, Homo sapiens
gcctctgcccctcttccct

SEQ ID NO: 5475446 - DNA, 16 bp, Homo sapiens
gcctctgccctgcctc

SEQ ID NO: 5475447 - DNA, 14 bp, Homo sapiens
gcctctgccctgga

SEQ ID NO: 5475448 - DNA, 15 bp, Homo sapiens
gcctctgccctggat

SEQ ID NO: 5475449 - DNA, 16 bp, Homo sapiens
gcctctgccgctgcca

SEQ ID NO: 5475450 - DNA, 19 bp, Homo sapiens
gcctctgccgctgccatgc

SEQ ID NO: 5475451 - DNA, 15 bp, Homo sapiens
gcctctgcctccagg

SEQ ID NO: 5475452 - DNA, 16 bp, Homo sapiens
gcctctgcctccagga

SEQ ID NO: 5475453 - DNA, 20 bp, Homo sapiens
gcctctgcctccaggagggc

SEQ ID NO: 5475454 - DNA, 16 bp, Homo sapiens
gcctctgcctcccagg

SEQ ID NO: 5475455 - DNA, 13 bp, Homo sapiens
gcctctgcctctg

SEQ ID NO: 5475456 - DNA, 21 bp, Homo sapiens
gcctctgcctgacagcatcct

SEQ ID NO: 5475457 - DNA, 13 bp, Homo sapiens
gcctctgcctgct

SEQ ID NO: 5475458 - DNA, 13 bp, Homo sapiens
gcctctgcctggg

SEQ ID NO: 5475459 - DNA, 17 bp, Homo sapiens
gcctctgcctggggcct

SEQ ID NO: 5475460 - DNA, 13 bp, Homo sapiens
gcctctgcctgtc

SEQ ID NO: 5475461 - DNA, 24 bp, Homo sapiens
gcctctgcggagcacactggctca

SEQ ID NO: 5475462 - DNA, 15 bp, Homo sapiens
gcctctgctctgtgc

SEQ ID NO: 5475463 - DNA, 18 bp, Homo sapiens
gcctctgctgaatgcagg

SEQ ID NO: 5475464 - DNA, 18 bp, Homo sapiens
gcctctgctgatcctccc

SEQ ID NO: 5475465 - DNA, 11 bp, Homo sapiens
gcctctgctgc

SEQ ID NO: 5475466 - DNA, 13 bp, Homo sapiens
gcctctgctggct

SEQ ID NO: 5475467 - DNA, 17 bp, Homo sapiens
gcctctgctggctcagg

SEQ ID NO: 5475468 - DNA, 18 bp, Homo sapiens
gcctctgctggctcagga

SEQ ID NO: 5475469 - DNA, 22 bp, Homo sapiens
gcctctgctggctcaggaggag

SEQ ID NO: 5475470 - DNA, 13 bp, Homo sapiens
gcctctgctggtc

SEQ ID NO: 5475471 - DNA, 22 bp, Homo sapiens
gcctctgctggtctctggctct

SEQ ID NO: 5475472 - DNA, 17 bp, Homo sapiens
gcctctgcttacttttt

SEQ ID NO: 5475473 - DNA, 19 bp, Homo sapiens
gcctctgcttgccagccag

SEQ ID NO: 5475474 - DNA, 20 bp, Homo sapiens
gcctctgcttgccagccagg

SEQ ID NO: 5475475 - DNA, 19 bp, Homo sapiens
gcctctgctttctcctgta

SEQ ID NO: 5475476 - DNA, 22 bp, Homo sapiens
gcctctgctttctcctgtagca

SEQ ID NO: 5475477 - DNA, 16 bp, Homo sapiens
gcctctggaaaactat

SEQ ID NO: 5475478 - DNA, 17 bp, Homo sapiens
gcctctggaaagcaaag

SEQ ID NO: 5475479 - DNA, 20 bp, Homo sapiens
gcctctggaagggagggctt

SEQ ID NO: 5475480 - DNA, 23 bp, Homo sapiens
gcctctggacagatgggtgtccc

SEQ ID NO: 5475481 - DNA, 16 bp, Homo sapiens
gcctctggacagccag

SEQ ID NO: 5475482 - DNA, 17 bp, Homo sapiens
gcctctggacagccagt

SEQ ID NO: 5475483 - DNA, 18 bp, Homo sapiens
gcctctggacagccagtg

SEQ ID NO: 5475484 - DNA, 19 bp, Homo sapiens
gcctctggacagccagtga

SEQ ID NO: 5475485 - DNA, 22 bp, Homo sapiens
gcctctggacagccagtgacct

SEQ ID NO: 5475486 - DNA, 17 bp, Homo sapiens
gcctctggactggcctg

SEQ ID NO: 5475487 - DNA, 17 bp, Homo sapiens
gcctctggaggcctctg

SEQ ID NO: 5475488 - DNA, 20 bp, Homo sapiens
gcctctggaggcctctggcc

SEQ ID NO: 5475489 - DNA, 13 bp, Homo sapiens
gcctctggccctc

SEQ ID NO: 5475490 - DNA, 11 bp, Homo sapiens
gcctctggccg

SEQ ID NO: 5475491 - DNA, 13 bp, Homo sapiens
gcctctggcctgg

SEQ ID NO: 5475492 - DNA, 17 bp, Homo sapiens
gcctctggcctgggaaa

SEQ ID NO: 5475493 - DNA, 19 bp, Homo sapiens
gcctctggctagaggccag

SEQ ID NO: 5475494 - DNA, 13 bp, Homo sapiens
gcctctggctcca

SEQ ID NO: 5475495 - DNA, 15 bp, Homo sapiens
gcctctggctccaca

SEQ ID NO: 5475496 - DNA, 12 bp, Homo sapiens
gcctctggctgc

SEQ ID NO: 5475497 - DNA, 13 bp, Homo sapiens
gcctctggcttcc

SEQ ID NO: 5475498 - DNA, 19 bp, Homo sapiens
gcctctggcttccctaaac

SEQ ID NO: 5475499 - DNA, 22 bp, Homo sapiens
gcctctggcttccctaaactgc

SEQ ID NO: 5475500 - DNA, 18 bp, Homo sapiens
gcctctggcttccctgcc

SEQ ID NO: 5475501 - DNA, 14 bp, Homo sapiens
gcctctgggaccca

SEQ ID NO: 5475502 - DNA, 12 bp, Homo sapiens
gcctctgggact

SEQ ID NO: 5475503 - DNA, 16 bp, Homo sapiens
gcctctgggcagcctg

SEQ ID NO: 5475504 - DNA, 17 bp, Homo sapiens
gcctctgggcagcctgc

SEQ ID NO: 5475505 - DNA, 18 bp, Homo sapiens
gcctctgggcagcctgct

SEQ ID NO: 5475506 - DNA, 21 bp, Homo sapiens
gcctctgggcagcctgctttg

SEQ ID NO: 5475507 - DNA, 15 bp, Homo sapiens
gcctctgggcagtgt

SEQ ID NO: 5475508 - DNA, 13 bp, Homo sapiens
gcctctgggctca

SEQ ID NO: 5475509 - DNA, 17 bp, Homo sapiens
ggcagcttgagcctgtc

SEQ ID NO: 5475510 - DNA, 21 bp, Homo sapiens
ggcagcttgagcctgtcacgt

SEQ ID NO: 5475511 - DNA, 21 bp, Homo sapiens
ggcagcttgagggttgggctg

SEQ ID NO: 5475512 - DNA, 18 bp, Homo sapiens
ggcagcttgccccggccc

SEQ ID NO: 5475513 - DNA, 17 bp, Homo sapiens
ggcagcttgctgggctt

SEQ ID NO: 5475514 - DNA, 20 bp, Homo sapiens
ggcagcttgctgggctttgg

SEQ ID NO: 5475515 - DNA, 14 bp, Homo sapiens
ggcagctttctaga

SEQ ID NO: 5475516 - DNA, 14 bp, Homo sapiens
ggcagctttgctca

SEQ ID NO: 5475517 - DNA, 14 bp, Homo sapiens
ggcagcttttaaaa

SEQ ID NO: 5475518 - DNA, 20 bp, Homo sapiens
ggcagctttttctgtggagg

SEQ ID NO: 5475519 - DNA, 15 bp, Homo sapiens
ggcaggaaagccaca

SEQ ID NO: 5475520 - DNA, 18 bp, Homo sapiens
ggcaggaaagccacatct

SEQ ID NO: 5475521 - DNA, 18 bp, Homo sapiens
ggcaggaaccatggacct

SEQ ID NO: 5475522 - DNA, 22 bp, Homo sapiens
ggcaggaacggtggaggcagag

SEQ ID NO: 5475523 - DNA, 16 bp, Homo sapiens
ggcaggaaggagagcc

SEQ ID NO: 5475524 - DNA, 14 bp, Homo sapiens
ggcaggaaggagcg

SEQ ID NO: 5475525 - DNA, 18 bp, Homo sapiens
ggcaggaaggcgggggat

SEQ ID NO: 5475526 - DNA, 16 bp, Homo sapiens
ggcaggaagggaagcg

SEQ ID NO: 5475527 - DNA, 19 bp, Homo sapiens
ggcaggaagtcaggagcca

SEQ ID NO: 5475528 - DNA, 23 bp, Homo sapiens
ggcaggaagtcaggagccagcag

SEQ ID NO: 5475529 - DNA, 13 bp, Homo sapiens
ggcaggaatgcgg

SEQ ID NO: 5475530 - DNA, 16 bp, Homo sapiens
ggcaggacacatcccg

SEQ ID NO: 5475531 - DNA, 19 bp, Homo sapiens
ggcaggacactgcagaaca

SEQ ID NO: 5475532 - DNA, 15 bp, Homo sapiens
ggcaggacagctcct

SEQ ID NO: 5475533 - DNA, 23 bp, Homo sapiens
ggcaggacatgctgaagccaaag

SEQ ID NO: 5475534 - DNA, 17 bp, Homo sapiens
ggcaggaccagaaggca

SEQ ID NO: 5475535 - DNA, 15 bp, Homo sapiens
ggcaggaccagccca

SEQ ID NO: 5475536 - DNA, 15 bp, Homo sapiens
ggcaggaccaggact

SEQ ID NO: 5475537 - DNA, 23 bp, Homo sapiens
ggcaggaccaggtggcacttcca

SEQ ID NO: 5475538 - DNA, 13 bp, Homo sapiens
ggcaggacctgcc

SEQ ID NO: 5475539 - DNA, 21 bp, Homo sapiens
ggcaggaccttcgggctgtgc

SEQ ID NO: 5475540 - DNA, 23 bp, Homo sapiens
ggcaggaccttcgggctgtgccc

SEQ ID NO: 5475541 - DNA, 20 bp, Homo sapiens
ggcaggacgagactcctcgg

SEQ ID NO: 5475542 - DNA, 14 bp, Homo sapiens
ggcaggactcctgg

SEQ ID NO: 5475543 - DNA, 16 bp, Homo sapiens
ggcaggactcctggca

SEQ ID NO: 5475544 - DNA, 17 bp, Homo sapiens
ggcaggactcctggcag

SEQ ID NO: 5475545 - DNA, 22 bp, Homo sapiens
ggcaggactcctggcagggcca

SEQ ID NO: 5475546 - DNA, 11 bp, Homo sapiens
ggcaggactga

SEQ ID NO: 5475547 - DNA, 17 bp, Homo sapiens
ggcaggactgcagagca

SEQ ID NO: 5475548 - DNA, 21 bp, Homo sapiens
ggcaggacttctcaccagcag

SEQ ID NO: 5475549 - DNA, 18 bp, Homo sapiens
ggcaggagacactggtct

SEQ ID NO: 5475550 - DNA, 20 bp, Homo sapiens
ggcaggagaggctgggctgg

SEQ ID NO: 5475551 - DNA, 23 bp, Homo sapiens
ggcaggagcaggaacagagactc

SEQ ID NO: 5475552 - DNA, 12 bp, Homo sapiens
ggcaggagccta

SEQ ID NO: 5475553 - DNA, 14 bp, Homo sapiens
ggcaggagcctaga

SEQ ID NO: 5475554 - DNA, 21 bp, Homo sapiens
ggcaggagcctagaggaggaa

SEQ ID NO: 5475555 - DNA, 15 bp, Homo sapiens
ggcaggagcctcgtg

SEQ ID NO: 5475556 - DNA, 16 bp, Homo sapiens
ggcaggagccttcctt

SEQ ID NO: 5475557 - DNA, 10 bp, Homo sapiens
ggcaggagct

SEQ ID NO: 5475558 - DNA, 14 bp, Homo sapiens
ggcaggagctactg

SEQ ID NO: 5475559 - DNA, 14 bp, Homo sapiens
ggcaggagctcctg

SEQ ID NO: 5475560 - DNA, 16 bp, Homo sapiens
ggcaggagctcctgga

SEQ ID NO: 5475561 - DNA, 13 bp, Homo sapiens
ggcaggagctgct

SEQ ID NO: 5475562 - DNA, 21 bp, Homo sapiens
ggcaggagcttggcagagaga

SEQ ID NO: 5475563 - DNA, 15 bp, Homo sapiens
ggcaggaggacaggt

SEQ ID NO: 5475564 - DNA, 20 bp, Homo sapiens
ggcaggaggacaggtggagg

SEQ ID NO: 5475565 - DNA, 17 bp, Homo sapiens
ggcaggaggagctgcct

SEQ ID NO: 5475566 - DNA, 24 bp, Homo sapiens
ggcaggaggattgcttgagcccag

SEQ ID NO: 5475567 - DNA, 18 bp, Homo sapiens
ggcaggaggccattccag

SEQ ID NO: 5475568 - DNA, 16 bp, Homo sapiens
ggcaggaggccccagg

SEQ ID NO: 5475569 - DNA, 17 bp, Homo sapiens
ggcaggaggccccaggc

SEQ ID NO: 5475570 - DNA, 16 bp, Homo sapiens
ggcaggaggcctggcc

SEQ ID NO: 5475571 - DNA, 16 bp, Homo sapiens
ggcaggagggcagtgg

SEQ ID NO: 5475572 - DNA, 15 bp, Homo sapiens
ggcaggaggtgggtg

SEQ ID NO: 5475573 - DNA, 16 bp, Homo sapiens
ggcaggaggtgggtga

SEQ ID NO: 5475574 - DNA, 17 bp, Homo sapiens
ggcaggagtagctgagc

SEQ ID NO: 5475575 - DNA, 18 bp, Homo sapiens
ggcaggagtcaccatgca

SEQ ID NO: 5475576 - DNA, 19 bp, Homo sapiens
ggcaggagtgccaggacca

SEQ ID NO: 5475577 - DNA, 22 bp, Homo sapiens
ggcaggagtgccaggaccagcc

SEQ ID NO: 5475578 - DNA, 19 bp, Homo sapiens
ggcaggagtgggctctgag

SEQ ID NO: 5475579 - DNA, 17 bp, Homo sapiens
ggcaggatcacagctca

SEQ ID NO: 5475580 - DNA, 15 bp, Homo sapiens
ggcaggatgaccctg

SEQ ID NO: 5475581 - DNA, 16 bp, Homo sapiens
ggcaggatggcctggc

SEQ ID NO: 5475582 - DNA, 19 bp, Homo sapiens
ggcaggatggcctggccag

SEQ ID NO: 5475583 - DNA, 14 bp, Homo sapiens
gcctgaggctgaga

SEQ ID NO: 5475584 - DNA, 15 bp, Homo sapiens
gcctgaggctgagac

SEQ ID NO: 5475585 - DNA, 18 bp, Homo sapiens
gcctgagggaagcccacc

SEQ ID NO: 5475586 - DNA, 21 bp, Homo sapiens
gcctgagggaagcccacccgc

SEQ ID NO: 5475587 - DNA, 19 bp, Homo sapiens
gcctgagggaggaggcagg

SEQ ID NO: 5475588 - DNA, 13 bp, Homo sapiens
gcctgagggcagt

SEQ ID NO: 5475589 - DNA, 21 bp, Homo sapiens
gcctgagggcccctctgccca

SEQ ID NO: 5475590 - DNA, 22 bp, Homo sapiens
gcctgagggcccctctgcccag

SEQ ID NO: 5475591 - DNA, 10 bp, Homo sapiens
gcctgagggg

SEQ ID NO: 5475592 - DNA, 13 bp, Homo sapiens
gcctgaggggcag

SEQ ID NO: 5475593 - DNA, 16 bp, Homo sapiens
gcctgaggggcagcct

SEQ ID NO: 5475594 - DNA, 20 bp, Homo sapiens
gcctgagggtccacctggag

SEQ ID NO: 5475595 - DNA, 14 bp, Homo sapiens
gcctgagggtggag

SEQ ID NO: 5475596 - DNA, 14 bp, Homo sapiens
gcctgagggtgggc

SEQ ID NO: 5475597 - DNA, 15 bp, Homo sapiens
gcctgagggtgggct

SEQ ID NO: 5475598 - DNA, 19 bp, Homo sapiens
gcctgaggtcatcggcgtg

SEQ ID NO: 5475599 - DNA, 13 bp, Homo sapiens
gcctgaggtctgt

SEQ ID NO: 5475600 - DNA, 18 bp, Homo sapiens
gcctgaggtctgtacgtt

SEQ ID NO: 5475601 - DNA, 22 bp, Homo sapiens
gcctgaggtgcccactccgcca

SEQ ID NO: 5475602 - DNA, 20 bp, Homo sapiens
gcctgaggtgggagaatcac

SEQ ID NO: 5475603 - DNA, 19 bp, Homo sapiens
gcctgagtcagggcccaga

SEQ ID NO: 5475604 - DNA, 16 bp, Homo sapiens
gcctgagtcagtgctc

SEQ ID NO: 5475605 - DNA, 20 bp, Homo sapiens
gcctgagtcagtgctctcag

SEQ ID NO: 5475606 - DNA, 22 bp, Homo sapiens
gcctgagtcagtgctctcagct

SEQ ID NO: 5475607 - DNA, 23 bp, Homo sapiens
gcctgagtccacgacctaggcag

SEQ ID NO: 5475608 - DNA, 16 bp, Homo sapiens
gcctgagtcctggtcc

SEQ ID NO: 5475609 - DNA, 17 bp, Homo sapiens
gcctgagtcctggtccc

SEQ ID NO: 5475610 - DNA, 18 bp, Homo sapiens
gcctgagtcctggtccct

SEQ ID NO: 5475611 - DNA, 21 bp, Homo sapiens
gcctgagtcctggtccctctg

SEQ ID NO: 5475612 - DNA, 18 bp, Homo sapiens
gcctgagtcgtgacctgc

SEQ ID NO: 5475613 - DNA, 20 bp, Homo sapiens
gcctgagtgacagagcaaga

SEQ ID NO: 5475614 - DNA, 17 bp, Homo sapiens
gcctgagtgacagagcg

SEQ ID NO: 5475615 - DNA, 20 bp, Homo sapiens
gcctgagtgacagagcgaga

SEQ ID NO: 5475616 - DNA, 15 bp, Homo sapiens
gcctgagtgacctcc

SEQ ID NO: 5475617 - DNA, 18 bp, Homo sapiens
gcctgagtgacctccttc

SEQ ID NO: 5475618 - DNA, 19 bp, Homo sapiens
gcctgagtggtgaggggcc

SEQ ID NO: 5475619 - DNA, 18 bp, Homo sapiens
gcctgagttataaatatt

SEQ ID NO: 5475620 - DNA, 20 bp, Homo sapiens
gcctgagttataaatatttt

SEQ ID NO: 5475621 - DNA, 15 bp, Homo sapiens
gcctgataagcttca

SEQ ID NO: 5475622 - DNA, 15 bp, Homo sapiens
gcctgatataaatgc

SEQ ID NO: 5475623 - DNA, 21 bp, Homo sapiens
gcctgatccagcctctcccct

SEQ ID NO: 5475624 - DNA, 22 bp, Homo sapiens
gcctgatccagcctctcccctg

SEQ ID NO: 5475625 - DNA, 12 bp, Homo sapiens
gcctgatccctg

SEQ ID NO: 5475626 - DNA, 16 bp, Homo sapiens
gcctgatcctccaaca

SEQ ID NO: 5475627 - DNA, 13 bp, Homo sapiens
gcctgatctgccc

SEQ ID NO: 5475628 - DNA, 17 bp, Homo sapiens
gcctgatctttctagag

SEQ ID NO: 5475629 - DNA, 20 bp, Homo sapiens
gcctgatgacaataaagctt

SEQ ID NO: 5475630 - DNA, 21 bp, Homo sapiens
gcctgatgacaataaagcttg

SEQ ID NO: 5475631 - DNA, 16 bp, Homo sapiens
gcctgatgagggggaa

SEQ ID NO: 5475632 - DNA, 21 bp, Homo sapiens
gcctgatgccacctcctctgt

SEQ ID NO: 5475633 - DNA, 19 bp, Homo sapiens
gcctgatgctccctcccct

SEQ ID NO: 5475634 - DNA, 13 bp, Homo sapiens
gcctgatgctgcc

SEQ ID NO: 5475635 - DNA, 14 bp, Homo sapiens
gcctgatgctgccc

SEQ ID NO: 5475636 - DNA, 16 bp, Homo sapiens
gcctgatgctgccccg

SEQ ID NO: 5475637 - DNA, 14 bp, Homo sapiens
gcctgatggacctg

SEQ ID NO: 5475638 - DNA, 15 bp, Homo sapiens
gcctgatggccaagg

SEQ ID NO: 5475639 - DNA, 14 bp, Homo sapiens
gcctgatgggagta

SEQ ID NO: 5475640 - DNA, 17 bp, Homo sapiens
gcctgatggtgctgctc

SEQ ID NO: 5475641 - DNA, 15 bp, Homo sapiens
gcctgatggtggggc

SEQ ID NO: 5475642 - DNA, 15 bp, Homo sapiens
gcctgattattttag

SEQ ID NO: 5475643 - DNA, 20 bp, Homo sapiens
gcctgattcatagtaaaata

SEQ ID NO: 5475644 - DNA, 17 bp, Homo sapiens
gcctgattcggctgtct

SEQ ID NO: 5475645 - DNA, 20 bp, Homo sapiens
gcctgattgccaagctcagg

SEQ ID NO: 5475646 - DNA, 16 bp, Homo sapiens
gcctgattggggcctc

SEQ ID NO: 5475647 - DNA, 22 bp, Homo sapiens
gcctgattggggcctcacccag

SEQ ID NO: 5475648 - DNA, 23 bp, Homo sapiens
gcctgattggggcctcacccaga

SEQ ID NO: 5475649 - DNA, 20 bp, Homo sapiens
gcctgatttaggcactgctt

SEQ ID NO: 5475650 - DNA, 20 bp, Homo sapiens
gcctgcaaacctgctggtgg

SEQ ID NO: 5475651 - DNA, 17 bp, Homo sapiens
gcctgcaaaccttcctg

SEQ ID NO: 5475652 - DNA, 21 bp, Homo sapiens
gcctgcaaaccttcctgggag

SEQ ID NO: 5475653 - DNA, 17 bp, Homo sapiens
gcctgcaaacgctgcct

SEQ ID NO: 5475654 - DNA, 18 bp, Homo sapiens
gcctgcaaacgctgcctg

SEQ ID NO: 5475655 - DNA, 18 bp, Homo sapiens
gcctgcaaatctagtgcc

SEQ ID NO: 5475656 - DNA, 16 bp, Homo sapiens
gcctgcacacacctgc

SEQ ID NO: 5475657 - DNA, 17 bp, Homo sapiens
gcctgcacacacctgcc

SEQ ID NO: 5475658 - DNA, 20 bp, Homo sapiens
gcctgcacagatacctcatc

SEQ ID NO: 5475659 - DNA, 23 bp, Homo sapiens
gcctgcacagatacctcatcatc

SEQ ID NO: 5475660 - DNA, 22 bp, Homo sapiens
gcctgcacagtggtccagggtc

SEQ ID NO: 5475661 - DNA, 13 bp, Homo sapiens
gcctgcaccagga

SEQ ID NO: 5475662 - DNA, 14 bp, Homo sapiens
gcctgcaccaggag

SEQ ID NO: 5475663 - DNA, 16 bp, Homo sapiens
gcctgcaccaggagac

SEQ ID NO: 5475664 - DNA, 22 bp, Homo sapiens
gcctgcacccaggtactgagtg

SEQ ID NO: 5475665 - DNA, 18 bp, Homo sapiens
gcctgcacccttccctct

SEQ ID NO: 5475666 - DNA, 18 bp, Homo sapiens
gcctgcacccttcctcct

SEQ ID NO: 5475667 - DNA, 20 bp, Homo sapiens
gcctgcaccgacccgaggcc

SEQ ID NO: 5475668 - DNA, 12 bp, Homo sapiens
gcctgcacctgc

SEQ ID NO: 5475669 - DNA, 17 bp, Homo sapiens
gcctgcacctgccccgt

SEQ ID NO: 5475670 - DNA, 13 bp, Homo sapiens
gcctgcacctgcg

SEQ ID NO: 5475671 - DNA, 15 bp, Homo sapiens
gcctgcactccctgg

SEQ ID NO: 5475672 - DNA, 16 bp, Homo sapiens
gcctgcactccctggc

SEQ ID NO: 5475673 - DNA, 22 bp, Homo sapiens
gcctgcactccctggccttgcc

SEQ ID NO: 5475674 - DNA, 17 bp, Homo sapiens
gcctgcactcctcaggg

SEQ ID NO: 5475675 - DNA, 19 bp, Homo sapiens
gcctgcacttgggggctca

SEQ ID NO: 5475676 - DNA, 22 bp, Homo sapiens
gcctgcacttgggggctcagca

SEQ ID NO: 5475677 - DNA, 21 bp, Homo sapiens
gcctgcagaagtaagcctcat

SEQ ID NO: 5475678 - DNA, 18 bp, Homo sapiens
gcctgcagagagaagcct

SEQ ID NO: 5475679 - DNA, 20 bp, Homo sapiens
gcctgcagagctgcgggctg

SEQ ID NO: 5475680 - DNA, 21 bp, Homo sapiens
gcctgcagaggacagagctgg

SEQ ID NO: 5475681 - DNA, 13 bp, Homo sapiens
gcctgcagcaggc

SEQ ID NO: 5475682 - DNA, 20 bp, Homo sapiens
gcctgcagccacatgggagg

SEQ ID NO: 5475683 - DNA, 12 bp, Homo sapiens
gcctgcagccca

SEQ ID NO: 5475684 - DNA, 18 bp, Homo sapiens
gcctgcagcctcccccac

SEQ ID NO: 5475685 - DNA, 23 bp, Homo sapiens
gcctgcagcctcccccacaaata

SEQ ID NO: 5475686 - DNA, 14 bp, Homo sapiens
gcctgcagctgaga

SEQ ID NO: 5475687 - DNA, 17 bp, Homo sapiens
gcctgcaggacctcgtg

SEQ ID NO: 5475688 - DNA, 23 bp, Homo sapiens
gcctgcaggacctcgtgccaccc

SEQ ID NO: 5475689 - DNA, 16 bp, Homo sapiens
gcctgcaggacctgcc

SEQ ID NO: 5475690 - DNA, 22 bp, Homo sapiens
ggcagtggctctcagagcagca

SEQ ID NO: 5475691 - DNA, 14 bp, Homo sapiens
ggcagtggctgtga

SEQ ID NO: 5475692 - DNA, 23 bp, Homo sapiens
ggcagtggcttggagcagaggtg

SEQ ID NO: 5475693 - DNA, 21 bp, Homo sapiens
ggcagtgggacagggcatggc

SEQ ID NO: 5475694 - DNA, 13 bp, Homo sapiens
ggcagtgggagac

SEQ ID NO: 5475695 - DNA, 15 bp, Homo sapiens
ggcagtggggctggg

SEQ ID NO: 5475696 - DNA, 23 bp, Homo sapiens
ggcagtgggtcccacttcccctc

SEQ ID NO: 5475697 - DNA, 19 bp, Homo sapiens
ggcagtgggtggatcctgg

SEQ ID NO: 5475698 - DNA, 21 bp, Homo sapiens
ggcagtgtagggagttgtggg

SEQ ID NO: 5475699 - DNA, 16 bp, Homo sapiens
ggcagtgtcattgagc

SEQ ID NO: 5475700 - DNA, 13 bp, Homo sapiens
ggcagtgtcccag

SEQ ID NO: 5475701 - DNA, 16 bp, Homo sapiens
ggcagtgtggcctctt

SEQ ID NO: 5475702 - DNA, 17 bp, Homo sapiens
ggcagtgtggcctcttg

SEQ ID NO: 5475703 - DNA, 21 bp, Homo sapiens
ggcagtgtggggagggcaggt

SEQ ID NO: 5475704 - DNA, 16 bp, Homo sapiens
ggcagttaccattaaa

SEQ ID NO: 5475705 - DNA, 12 bp, Homo sapiens
ggcagttatatt

SEQ ID NO: 5475706 - DNA, 20 bp, Homo sapiens
ggcagttccttacctccctg

SEQ ID NO: 5475707 - DNA, 19 bp, Homo sapiens
ggcagttcgcagccaccct

SEQ ID NO: 5475708 - DNA, 20 bp, Homo sapiens
ggcagttcgcagccaccctg

SEQ ID NO: 5475709 - DNA, 22 bp, Homo sapiens
ggcagttcgcagccaccctgag

SEQ ID NO: 5475710 - DNA, 12 bp, Homo sapiens
ggcagttctaga

SEQ ID NO: 5475711 - DNA, 13 bp, Homo sapiens
ggcagttctagaa

SEQ ID NO: 5475712 - DNA, 23 bp, Homo sapiens
ggcagttctcactcctaggagag

SEQ ID NO: 5475713 - DNA, 18 bp, Homo sapiens
ggcagttctcccagggag

SEQ ID NO: 5475714 - DNA, 21 bp, Homo sapiens
ggcagttgacggggcagtcag

SEQ ID NO: 5475715 - DNA, 11 bp, Homo sapiens
ggcagttgcat

SEQ ID NO: 5475716 - DNA, 16 bp, Homo sapiens
ggcagtttcagagatg

SEQ ID NO: 5475717 - DNA, 17 bp, Homo sapiens
ggcagtttcagagatgg

SEQ ID NO: 5475718 - DNA, 19 bp, Homo sapiens
ggcagtttttaaaattggc

SEQ ID NO: 5475719 - DNA, 12 bp, Homo sapiens
ggcagtttttct

SEQ ID NO: 5475720 - DNA, 16 bp, Homo sapiens
ggcagtttttctgtat

SEQ ID NO: 5475721 - DNA, 19 bp, Homo sapiens
ggcagtttttgttccttcc

SEQ ID NO: 5475722 - DNA, 12 bp, Homo sapiens
ggcataaaacaa

SEQ ID NO: 5475723 - DNA, 14 bp, Homo sapiens
ggcataaactgttt

SEQ ID NO: 5475724 - DNA, 16 bp, Homo sapiens
ggcataaattaaaatg

SEQ ID NO: 5475725 - DNA, 16 bp, Homo sapiens
ggcataaattacagtc

SEQ ID NO: 5475726 - DNA, 21 bp, Homo sapiens
ggcataaattacagtcatctg

SEQ ID NO: 5475727 - DNA, 18 bp, Homo sapiens
ggcataacaaaggcaaga

SEQ ID NO: 5475728 - DNA, 16 bp, Homo sapiens
ggcataacataaatct

SEQ ID NO: 5475729 - DNA, 17 bp, Homo sapiens
ggcataactaaaattaa

SEQ ID NO: 5475730 - DNA, 16 bp, Homo sapiens
ggcataagacagagaa

SEQ ID NO: 5475731 - DNA, 16 bp, Homo sapiens
ggcatacaatgaaaag

SEQ ID NO: 5475732 - DNA, 17 bp, Homo sapiens
ggcatacacacagcagt

SEQ ID NO: 5475733 - DNA, 15 bp, Homo sapiens
ggcataccaaatggc

SEQ ID NO: 5475734 - DNA, 20 bp, Homo sapiens
ggcataccgtttggtgtctg

SEQ ID NO: 5475735 - DNA, 23 bp, Homo sapiens
ggcataccgtttggtgtctgatg

SEQ ID NO: 5475736 - DNA, 21 bp, Homo sapiens
ggcatacctgtcctagcagga

SEQ ID NO: 5475737 - DNA, 21 bp, Homo sapiens
ggcatacctgtgcctgcttct

SEQ ID NO: 5475738 - DNA, 14 bp, Homo sapiens
ggcatactaataaa

SEQ ID NO: 5475739 - DNA, 18 bp, Homo sapiens
ggcatactctccaggatt

SEQ ID NO: 5475740 - DNA, 20 bp, Homo sapiens
ggcatactttttaaaaaact

SEQ ID NO: 5475741 - DNA, 19 bp, Homo sapiens
ggcatagaaactgaggagt

SEQ ID NO: 5475742 - DNA, 21 bp, Homo sapiens
ggcatagagggagaggaagca

SEQ ID NO: 5475743 - DNA, 22 bp, Homo sapiens
ggcatagagggagaggaagcac

SEQ ID NO: 5475744 - DNA, 16 bp, Homo sapiens
ggcatagcctttccct

SEQ ID NO: 5475745 - DNA, 15 bp, Homo sapiens
ggcataggactcttt

SEQ ID NO: 5475746 - DNA, 14 bp, Homo sapiens
ggcataggcctggg

SEQ ID NO: 5475747 - DNA, 19 bp, Homo sapiens
ggcataggtctctttgctt

SEQ ID NO: 5475748 - DNA, 22 bp, Homo sapiens
ggcatatattgggttccattct

SEQ ID NO: 5475749 - DNA, 21 bp, Homo sapiens
ggcatatgtttccccatctct

SEQ ID NO: 5475750 - DNA, 22 bp, Homo sapiens
ggcatatgtttccccatctctg

SEQ ID NO: 5475751 - DNA, 19 bp, Homo sapiens
ggcatattccctgcacaca

SEQ ID NO: 5475752 - DNA, 15 bp, Homo sapiens
ggcatatttttcaca

SEQ ID NO: 5475753 - DNA, 13 bp, Homo sapiens
ggcatcacagggc

SEQ ID NO: 5475754 - DNA, 17 bp, Homo sapiens
ggcatcacagggcagag

SEQ ID NO: 5475755 - DNA, 21 bp, Homo sapiens
ggcatcacatgctcaatgact

SEQ ID NO: 5475756 - DNA, 12 bp, Homo sapiens
ggcatcacctgc

SEQ ID NO: 5475757 - DNA, 19 bp, Homo sapiens
ggcatcactgattccctct

SEQ ID NO: 5475758 - DNA, 14 bp, Homo sapiens
ggcatcagcacttt

SEQ ID NO: 5475759 - DNA, 16 bp, Homo sapiens
ggcatcagctttccct

SEQ ID NO: 5475760 - DNA, 18 bp, Homo sapiens
gggagggaagtgtgagcg

SEQ ID NO: 5475761 - DNA, 18 bp, Homo sapiens
gggagggacagggcaggc

SEQ ID NO: 5475762 - DNA, 21 bp, Homo sapiens
gggagggaccgcgcaggctcc

SEQ ID NO: 5475763 - DNA, 12 bp, Homo sapiens
gggagggactgc

SEQ ID NO: 5475764 - DNA, 16 bp, Homo sapiens
gggagggagcaagccc

SEQ ID NO: 5475765 - DNA, 22 bp, Homo sapiens
gggagggagccatggaaggtgc

SEQ ID NO: 5475766 - DNA, 16 bp, Homo sapiens
gggagggaggcatctg

SEQ ID NO: 5475767 - DNA, 17 bp, Homo sapiens
gggagggagggcggtgg

SEQ ID NO: 5475768 - DNA, 15 bp, Homo sapiens
gggagggagggctcc

SEQ ID NO: 5475769 - DNA, 14 bp, Homo sapiens
gtggcccttcctgg

SEQ ID NO: 5475770 - DNA, 23 bp, Homo sapiens
gtggcccttgtttacagtgagga

SEQ ID NO: 5475771 - DNA, 23 bp, Homo sapiens
gtggccctttcggatccagggag

SEQ ID NO: 5475772 - DNA, 18 bp, Homo sapiens
gtggccgcacgcctctcc

SEQ ID NO: 5475773 - DNA, 13 bp, Homo sapiens
gtggccgccatct

SEQ ID NO: 5475774 - DNA, 19 bp, Homo sapiens
gtggccgcctggcaggtgg

SEQ ID NO: 5475775 - DNA, 23 bp, Homo sapiens
gtggccgcctggcaggtggaact

SEQ ID NO: 5475776 - DNA, 21 bp, Homo sapiens
gtggccgctcctccctgctcc

SEQ ID NO: 5475777 - DNA, 14 bp, Homo sapiens
gtggccggccctgc

SEQ ID NO: 5475778 - DNA, 15 bp, Homo sapiens
gtggccggccctgcc

SEQ ID NO: 5475779 - DNA, 16 bp, Homo sapiens
gtggccggccctgccc

SEQ ID NO: 5475780 - DNA, 18 bp, Homo sapiens
gtggccggccctgccccc

SEQ ID NO: 5475781 - DNA, 21 bp, Homo sapiens
gtggccggccctgccccccac

SEQ ID NO: 5475782 - DNA, 15 bp, Homo sapiens
gtggccggcctcctc

SEQ ID NO: 5475783 - DNA, 16 bp, Homo sapiens
gtggccggcctcctcc

SEQ ID NO: 5475784 - DNA, 14 bp, Homo sapiens
gtggccgggcacag

SEQ ID NO: 5475785 - DNA, 22 bp, Homo sapiens
gtggccgggctggggaggcctg

SEQ ID NO: 5475786 - DNA, 19 bp, Homo sapiens
gtggccggggaagctggca

SEQ ID NO: 5475787 - DNA, 21 bp, Homo sapiens
gtggccgggggtgggggcctg

SEQ ID NO: 5475788 - DNA, 23 bp, Homo sapiens
gtggccggtgccagctgcccttg

SEQ ID NO: 5475789 - DNA, 15 bp, Homo sapiens
gtggccgtcctgagg

SEQ ID NO: 5475790 - DNA, 17 bp, Homo sapiens
gtggccgtcctgagggg

SEQ ID NO: 5475791 - DNA, 18 bp, Homo sapiens
gtggccgtctcctccctc

SEQ ID NO: 5475792 - DNA, 20 bp, Homo sapiens
gtggccgtctcctccctcag

SEQ ID NO: 5475793 - DNA, 19 bp, Homo sapiens
gtggcctaaggctgctgta

SEQ ID NO: 5475794 - DNA, 16 bp, Homo sapiens
gtggcctaatttacaa

SEQ ID NO: 5475795 - DNA, 9 bp, Homo sapiens
gtggcctat

SEQ ID NO: 5475796 - DNA, 19 bp, Homo sapiens
gtggcctcaaccctccctc

SEQ ID NO: 5475797 - DNA, 21 bp, Homo sapiens
gtggcctcaaccctccctcag

SEQ ID NO: 5475798 - DNA, 17 bp, Homo sapiens
gtggcctcaagagcaca

SEQ ID NO: 5475799 - DNA, 15 bp, Homo sapiens
gtggcctcaccctga

SEQ ID NO: 5475800 - DNA, 21 bp, Homo sapiens
gtggcctcacttccctgggaa

SEQ ID NO: 5475801 - DNA, 11 bp, Homo sapiens
gtggcctcaga

SEQ ID NO: 5475802 - DNA, 13 bp, Homo sapiens
gtggcctcagcat

SEQ ID NO: 5475803 - DNA, 12 bp, Homo sapiens
gtggcctcagcc

SEQ ID NO: 5475804 - DNA, 16 bp, Homo sapiens
gtggcctcagccctca

SEQ ID NO: 5475805 - DNA, 17 bp, Homo sapiens
gtggcctcagccctcag

SEQ ID NO: 5475806 - DNA, 22 bp, Homo sapiens
gtggcctcagctcaatgcagtt

SEQ ID NO: 5475807 - DNA, 23 bp, Homo sapiens
gtggcctcagctcccacaagcct

SEQ ID NO: 5475808 - DNA, 23 bp, Homo sapiens
gtggcctcagctgaatgcctcct

SEQ ID NO: 5475809 - DNA, 18 bp, Homo sapiens
gtggcctcattcagcaga

SEQ ID NO: 5475810 - DNA, 13 bp, Homo sapiens
gtggcctcccaac

SEQ ID NO: 5475811 - DNA, 14 bp, Homo sapiens
gtggcctccctcca

SEQ ID NO: 5475812 - DNA, 15 bp, Homo sapiens
gtggcctccctccag

SEQ ID NO: 5475813 - DNA, 22 bp, Homo sapiens
gtggcctccctgctgtgccatg

SEQ ID NO: 5475814 - DNA, 13 bp, Homo sapiens
gtggcctccctgg

SEQ ID NO: 5475815 - DNA, 17 bp, Homo sapiens
gtggcctccctggctcc

SEQ ID NO: 5475816 - DNA, 21 bp, Homo sapiens
gtggcctccttgcttgttaca

SEQ ID NO: 5475817 - DNA, 14 bp, Homo sapiens
gtggcctctctctc

SEQ ID NO: 5475818 - DNA, 20 bp, Homo sapiens
gtggcctctgccccgtctca

SEQ ID NO: 5475819 - DNA, 24 bp, Homo sapiens
gtggcctctgccccgtctcatgag

SEQ ID NO: 5475820 - DNA, 15 bp, Homo sapiens
gtggcctctgctggt

SEQ ID NO: 5475821 - DNA, 17 bp, Homo sapiens
gtggcctctgctggtct

SEQ ID NO: 5475822 - DNA, 22 bp, Homo sapiens
gtggcctctgctggtctctggc

SEQ ID NO: 5475823 - DNA, 16 bp, Homo sapiens
gtggcctctttgtcta

SEQ ID NO: 5475824 - DNA, 15 bp, Homo sapiens
gtggcctgagaagag

SEQ ID NO: 5475825 - DNA, 15 bp, Homo sapiens
gtggcctgcaggagg

SEQ ID NO: 5475826 - DNA, 13 bp, Homo sapiens
gtggcctgccagt

SEQ ID NO: 5475827 - DNA, 13 bp, Homo sapiens
gtggcctgcccag

SEQ ID NO: 5475828 - DNA, 14 bp, Homo sapiens
gtggcctgcccagc

SEQ ID NO: 5475829 - DNA, 19 bp, Homo sapiens
gtggcctgcccagcctcaa

SEQ ID NO: 5475830 - DNA, 20 bp, Homo sapiens
gtggcctgcggccgggctgc

SEQ ID NO: 5475831 - DNA, 16 bp, Homo sapiens
gtggcctggcatctgt

SEQ ID NO: 5475832 - DNA, 12 bp, Homo sapiens
gtggcctggctt

SEQ ID NO: 5475833 - DNA, 13 bp, Homo sapiens
gtggcctggcttg

SEQ ID NO: 5475834 - DNA, 12 bp, Homo sapiens
gtggcctgggca

SEQ ID NO: 5475835 - DNA, 14 bp, Homo sapiens
gtggcctgggcaag

SEQ ID NO: 5475836 - DNA, 18 bp, Homo sapiens
gtggcctgggcttggccc

SEQ ID NO: 5475837 - DNA, 13 bp, Homo sapiens
gtggcctgggtcc

SEQ ID NO: 5475838 - DNA, 21 bp, Homo sapiens
gtggcctgggtcccagggctg

SEQ ID NO: 5475839 - DNA, 14 bp, Homo sapiens
gtggcctgggtcct

SEQ ID NO: 5475840 - DNA, 18 bp, Homo sapiens
gtggcctgggtcctcggc

SEQ ID NO: 5475841 - DNA, 19 bp, Homo sapiens
gtggcctgggtcctcggcc

SEQ ID NO: 5475842 - DNA, 21 bp, Homo sapiens
gtggcctgggtcctcggccct

SEQ ID NO: 5475843 - DNA, 14 bp, Homo sapiens
gtggcctggtccct

SEQ ID NO: 5475844 - DNA, 14 bp, Homo sapiens
gtggcctggtgcac

SEQ ID NO: 5475845 - DNA, 13 bp, Homo sapiens
gtggcctggtggg

SEQ ID NO: 5475846 - DNA, 13 bp, Homo sapiens
gtggcctgtgagc

SEQ ID NO: 5475847 - DNA, 23 bp, Homo sapiens
gtggcctgtgagcaagagccagg

SEQ ID NO: 5475848 - DNA, 22 bp, Homo sapiens
gtggcctgtgaggggcccctgg

SEQ ID NO: 5475849 - DNA, 15 bp, Homo sapiens
gtggcctgtggcctg

SEQ ID NO: 5475850 - DNA, 17 bp, Homo sapiens
gtggcctgtggctgtcg

SEQ ID NO: 5475851 - DNA, 19 bp, Homo sapiens
gtggcctgtgtccagcagc

SEQ ID NO: 5475852 - DNA, 13 bp, Homo sapiens
gtggcctgtgtgg

SEQ ID NO: 5475853 - DNA, 15 bp, Homo sapiens
gtggcctgttcccta

SEQ ID NO: 5475854 - DNA, 21 bp, Homo sapiens
gtggcctgttccctagagaga

SEQ ID NO: 5475855 - DNA, 20 bp, Homo sapiens
gtggcctgtttctgcagccc

SEQ ID NO: 5475856 - DNA, 23 bp, Homo sapiens
gtggcctgtttgaaagtaaaaac

SEQ ID NO: 5475857 - DNA, 12 bp, Homo sapiens
gtggccttcccc

SEQ ID NO: 5475858 - DNA, 17 bp, Homo sapiens
gtggccttccccagcct

SEQ ID NO: 5475859 - DNA, 19 bp, Homo sapiens
gtggccttccccagcctct

SEQ ID NO: 5475860 - DNA, 20 bp, Homo sapiens
gtggccttccccagcctctt

SEQ ID NO: 5475861 - DNA, 19 bp, Homo sapiens
gtggccttctgctgcccag

SEQ ID NO: 5475862 - DNA, 15 bp, Homo sapiens
gtggccttgcccgcc

SEQ ID NO: 5475863 - DNA, 23 bp, Homo sapiens
gtggccttgcccgccagcctcag

SEQ ID NO: 5475864 - DNA, 19 bp, Homo sapiens
gtggccttggccggctgtg

SEQ ID NO: 5475865 - DNA, 13 bp, Homo sapiens
gtggccttgggag

SEQ ID NO: 5475866 - DNA, 16 bp, Homo sapiens
gtggccttgggaggac

SEQ ID NO: 5475867 - DNA, 20 bp, Homo sapiens
gtggccttgttctgtcacca

SEQ ID NO: 5475868 - DNA, 20 bp, Homo sapiens
gtggccttttttataactaa

SEQ ID NO: 5475869 - DNA, 20 bp, Homo sapiens
gtggcgagccatttgtccca

SEQ ID NO: 5475870 - DNA, 23 bp, Homo sapiens
gtggcgagccatttgtcccaagt

SEQ ID NO: 5475871 - DNA, 24 bp, Homo sapiens
gtggcgcaatctcggctcactgca

SEQ ID NO: 5475872 - DNA, 22 bp, Homo sapiens
gtggcgcagcatattcaggaag

SEQ ID NO: 5475873 - DNA, 14 bp, Homo sapiens
gtggcgcaggtgcc

SEQ ID NO: 5475874 - DNA, 22 bp, Homo sapiens
gtggcgcaggtgccatgcctgc

SEQ ID NO: 5475875 - DNA, 17 bp, Homo sapiens
gtggcgcgcctgccttt

SEQ ID NO: 5475876 - DNA, 14 bp, Homo sapiens
gtggcgctggtgca

SEQ ID NO: 5475877 - DNA, 14 bp, Homo sapiens
gtggcggcagggcc

SEQ ID NO: 5475878 - DNA, 15 bp, Homo sapiens
gtggcgggcgcctgt

SEQ ID NO: 5475879 - DNA, 17 bp, Homo sapiens
gtggcggggcagcagga

SEQ ID NO: 5475880 - DNA, 13 bp, Homo sapiens
gtggcggggtggg

SEQ ID NO: 5475881 - DNA, 16 bp, Homo sapiens
gtggcggggtggggtg

SEQ ID NO: 5475882 - DNA, 23 bp, Homo sapiens
gtggcgggtgatggccagcccct

SEQ ID NO: 5475883 - DNA, 13 bp, Homo sapiens
gtggcggtgcctg

SEQ ID NO: 5475884 - DNA, 13 bp, Homo sapiens
gtggcggtggacc

SEQ ID NO: 5475885 - DNA, 15 bp, Homo sapiens
gtggcgtctccctcg

SEQ ID NO: 5475886 - DNA, 16 bp, Homo sapiens
gtggcgtctccctcgc

SEQ ID NO: 5475887 - DNA, 19 bp, Homo sapiens
gtggcgtgatctcagctca

SEQ ID NO: 5475888 - DNA, 14 bp, Homo sapiens
gtggcgtggcccgt

SEQ ID NO: 5475889 - DNA, 18 bp, Homo sapiens
gtggcgtgggagccagcc

SEQ ID NO: 5475890 - DNA, 22 bp, Homo sapiens
gtggctaaatgcctaataaaca

SEQ ID NO: 5475891 - DNA, 19 bp, Homo sapiens
gtggctaattataattcag

SEQ ID NO: 5475892 - DNA, 14 bp, Homo sapiens
gtggctaattcaat

SEQ ID NO: 5475893 - DNA, 24 bp, Homo sapiens
gtggctaccgatttcagcacatgc

SEQ ID NO: 5475894 - DNA, 15 bp, Homo sapiens
gtggctactctgtgc

SEQ ID NO: 5475895 - DNA, 17 bp, Homo sapiens
gtggctactctgtgcca

SEQ ID NO: 5475896 - DNA, 14 bp, Homo sapiens
gtggctactgacat

SEQ ID NO: 5475897 - DNA, 12 bp, Homo sapiens
gtggctaggcag

SEQ ID NO: 5475898 - DNA, 17 bp, Homo sapiens
gtggctaggcctttcct

SEQ ID NO: 5475899 - DNA, 19 bp, Homo sapiens
gtggctagtcaagctcctc

SEQ ID NO: 5475900 - DNA, 20 bp, Homo sapiens
gtggctagtcaagctcctcc

SEQ ID NO: 5475901 - DNA, 21 bp, Homo sapiens
gtggctagtcaagctcctcct

SEQ ID NO: 5475902 - DNA, 22 bp, Homo sapiens
gtggctagtcaagctcctcctc

SEQ ID NO: 5475903 - DNA, 19 bp, Homo sapiens
gtggctagtcagagagagt

SEQ ID NO: 5475904 - DNA, 23 bp, Homo sapiens
gtggctagtggggtgaacagctg

SEQ ID NO: 5475905 - DNA, 21 bp, Homo sapiens
gtggctatgggaatcagctgg

SEQ ID NO: 5475906 - DNA, 17 bp, Homo sapiens
gtggctattaaaactct

SEQ ID NO: 5475907 - DNA, 23 bp, Homo sapiens
gtggctcacgcctataatcccag

SEQ ID NO: 5475908 - DNA, 22 bp, Homo sapiens
gtggctcacgcctgtaatccca

SEQ ID NO: 5475909 - DNA, 20 bp, Homo sapiens
gtggctcacgtgtgtgactc

SEQ ID NO: 5475910 - DNA, 15 bp, Homo sapiens
gtggctcactggctg

SEQ ID NO: 5475911 - DNA, 18 bp, Homo sapiens
gtggctcaggggagcaag

SEQ ID NO: 5475912 - DNA, 14 bp, Homo sapiens
gtggctccaggagc

SEQ ID NO: 5475913 - DNA, 16 bp, Homo sapiens
gtggctcccagcagag

SEQ ID NO: 5475914 - DNA, 12 bp, Homo sapiens
gtggctccccac

SEQ ID NO: 5475915 - DNA, 23 bp, Homo sapiens
gtggctccccacctggacacaca

SEQ ID NO: 5475916 - DNA, 18 bp, Homo sapiens
gtggctccccctctgctt

SEQ ID NO: 5475917 - DNA, 21 bp, Homo sapiens
gtggctcccctgcccagcctg

SEQ ID NO: 5475918 - DNA, 16 bp, Homo sapiens
gtggctccctctctcc

SEQ ID NO: 5475919 - DNA, 12 bp, Homo sapiens
gtggctccctgg

SEQ ID NO: 5475920 - DNA, 22 bp, Homo sapiens
gtggctccctgggggcggccag

SEQ ID NO: 5475921 - DNA, 20 bp, Homo sapiens
gtggctcctcctaggaaacc

SEQ ID NO: 5475922 - DNA, 11 bp, Homo sapiens
gtggctcctgc

SEQ ID NO: 5475923 - DNA, 17 bp, Homo sapiens
gtggctcctgccactga

SEQ ID NO: 5475924 - DNA, 14 bp, Homo sapiens
gtggctcctgggcc

SEQ ID NO: 5475925 - DNA, 15 bp, Homo sapiens
gtggctcctgggccg

SEQ ID NO: 5475926 - DNA, 21 bp, Homo sapiens
gtggctcctgggccggctgag

SEQ ID NO: 5475927 - DNA, 13 bp, Homo sapiens
gtggctccttccc

SEQ ID NO: 5475928 - DNA, 19 bp, Homo sapiens
gtggctcgatttttaagag

SEQ ID NO: 5475929 - DNA, 15 bp, Homo sapiens
gtggctctgccctgg

SEQ ID NO: 5475930 - DNA, 19 bp, Homo sapiens
gtggctctgccctggaaag

SEQ ID NO: 5475931 - DNA, 11 bp, Homo sapiens
gtggctctggg

SEQ ID NO: 5475932 - DNA, 20 bp, Homo sapiens
gtggctctgggagagccagc

SEQ ID NO: 5475933 - DNA, 13 bp, Homo sapiens
gtggctctggggt

SEQ ID NO: 5475934 - DNA, 13 bp, Homo sapiens
gtggctcttattt

SEQ ID NO: 5475935 - DNA, 17 bp, Homo sapiens
gtggctcttatttctga

SEQ ID NO: 5475936 - DNA, 20 bp, Homo sapiens
gtggctcttctaacctcagc

SEQ ID NO: 5475937 - DNA, 11 bp, Homo sapiens
gtggctgaaaa

SEQ ID NO: 5475938 - DNA, 16 bp, Homo sapiens
tcaagcaccaggaagt

SEQ ID NO: 5475939 - DNA, 22 bp, Homo sapiens
tcaagcaccaggaagtgtttat

SEQ ID NO: 5475940 - DNA, 23 bp, Homo sapiens
tcaagcaccaggaagtgtttatg

SEQ ID NO: 5475941 - DNA, 16 bp, Homo sapiens
tcaagcaccctgttcc

SEQ ID NO: 5475942 - DNA, 16 bp, Homo sapiens
tcaagcactaaaaagt

SEQ ID NO: 5475943 - DNA, 14 bp, Homo sapiens
tcaagcacttccca

SEQ ID NO: 5475944 - DNA, 15 bp, Homo sapiens
tcaagcacttcccag

SEQ ID NO: 5475945 - DNA, 16 bp, Homo sapiens
tcaagcacttcccagg

SEQ ID NO: 5475946 - DNA, 13 bp, Homo sapiens
tcaagcagagacc

SEQ ID NO: 5475947 - DNA, 13 bp, Homo sapiens
tcaagcagcaaaa

SEQ ID NO: 5475948 - DNA, 21 bp, Homo sapiens
tcaagcagcgaccgccccctc

SEQ ID NO: 5475949 - DNA, 15 bp, Homo sapiens
tctatgatgttgctg

SEQ ID NO: 5475950 - DNA, 21 bp, Homo sapiens
tctatgatgttgctgttcaca

SEQ ID NO: 5475951 - DNA, 13 bp, Homo sapiens
tctatgatgtttc

SEQ ID NO: 5475952 - DNA, 22 bp, Homo sapiens
tctatgattcgtgtaattactt

SEQ ID NO: 5475953 - DNA, 16 bp, Homo sapiens
tctatgattgtacttt

SEQ ID NO: 5475954 - DNA, 18 bp, Homo sapiens
tctatgattgtactttga

SEQ ID NO: 5475955 - DNA, 19 bp, Homo sapiens
tctatgattgtactttgaa

SEQ ID NO: 5475956 - DNA, 14 bp, Homo sapiens
tctatgcaaataaa

SEQ ID NO: 5475957 - DNA, 16 bp, Homo sapiens
tctatgcaattgtaca

SEQ ID NO: 5475958 - DNA, 13 bp, Homo sapiens
tctatgcaatttt

SEQ ID NO: 5475959 - DNA, 21 bp, Homo sapiens
tctatgcaatttttaaactag

SEQ ID NO: 5475960 - DNA, 13 bp, Homo sapiens
tctatgcagcatg

SEQ ID NO: 5475961 - DNA, 13 bp, Homo sapiens
tctatgcaggcag

SEQ ID NO: 5475962 - DNA, 19 bp, Homo sapiens
tctatgcataaaaaaatga

SEQ ID NO: 5475963 - DNA, 14 bp, Homo sapiens
tctatgcattttct

SEQ ID NO: 5475964 - DNA, 15 bp, Homo sapiens
tctatgcattttctg

SEQ ID NO: 5475965 - DNA, 15 bp, Homo sapiens
tctatgccaaagatc

SEQ ID NO: 5475966 - DNA, 16 bp, Homo sapiens
tctatgccaaagatca

SEQ ID NO: 5475967 - DNA, 21 bp, Homo sapiens
tctatgccaaagatcacttgt

SEQ ID NO: 5475968 - DNA, 16 bp, Homo sapiens
tctatgccatttttag

SEQ ID NO: 5475969 - DNA, 21 bp, Homo sapiens
tctatgccatttttagtttaa

SEQ ID NO: 5475970 - DNA, 18 bp, Homo sapiens
tctatgccccaaatatag

SEQ ID NO: 5475971 - DNA, 20 bp, Homo sapiens
tctatgccctgcagagcaat

SEQ ID NO: 5475972 - DNA, 13 bp, Homo sapiens
tctatgcctgtct

SEQ ID NO: 5475973 - DNA, 12 bp, Homo sapiens
tctatgctctgg

SEQ ID NO: 5475974 - DNA, 16 bp, Homo sapiens
tctatgctgagtttgt

SEQ ID NO: 5475975 - DNA, 15 bp, Homo sapiens
tctatgctgcttcca

SEQ ID NO: 5475976 - DNA, 15 bp, Homo sapiens
tctatgctgctttta

SEQ ID NO: 5475977 - DNA, 23 bp, Homo sapiens
tctatgctggtgaaaacaatttt

SEQ ID NO: 5475978 - DNA, 15 bp, Homo sapiens
tctatgctgtgtgca

SEQ ID NO: 5475979 - DNA, 17 bp, Homo sapiens
tctatgctttccaaacc

SEQ ID NO: 5475980 - DNA, 23 bp, Homo sapiens
tctatgctttccaaaccttatct

SEQ ID NO: 5475981 - DNA, 13 bp, Homo sapiens
tctatggaaatgt

SEQ ID NO: 5475982 - DNA, 15 bp, Homo sapiens
tctatggaaatgtga

SEQ ID NO: 5475983 - DNA, 20 bp, Homo sapiens
tctatggaaatgtgagaaat

SEQ ID NO: 5475984 - DNA, 13 bp, Homo sapiens
tctatggaaggag

SEQ ID NO: 5475985 - DNA, 18 bp, Homo sapiens
tctatggaccaaatgtaa

SEQ ID NO: 5475986 - DNA, 18 bp, Homo sapiens
tctatggagactttgctg

SEQ ID NO: 5475987 - DNA, 20 bp, Homo sapiens
tctatggagactttgctgtt

SEQ ID NO: 5475988 - DNA, 21 bp, Homo sapiens
tctatggagcaaaacaaagct

SEQ ID NO: 5475989 - DNA, 16 bp, Homo sapiens
tctatggattcacttc

SEQ ID NO: 5475990 - DNA, 18 bp, Homo sapiens
tctatggattcacttcta

SEQ ID NO: 5475991 - DNA, 21 bp, Homo sapiens
tctatggcatattgataataa

SEQ ID NO: 5475992 - DNA, 16 bp, Homo sapiens
tctatggcttatttct

SEQ ID NO: 5475993 - DNA, 17 bp, Homo sapiens
tctatggcttatttcta

SEQ ID NO: 5475994 - DNA, 14 bp, Homo sapiens
tctatggctttcaa

SEQ ID NO: 5475995 - DNA, 15 bp, Homo sapiens
tctatggctttcaaa

SEQ ID NO: 5475996 - DNA, 13 bp, Homo sapiens
tctatgggaagat

SEQ ID NO: 5475997 - DNA, 13 bp, Homo sapiens
tctatgggactca

SEQ ID NO: 5475998 - DNA, 23 bp, Homo sapiens
tctatgggagattaaaaccagag

SEQ ID NO: 5475999 - DNA, 17 bp, Homo sapiens
tctatggggatacatga

SEQ ID NO: 5476000 - DNA, 18 bp, Homo sapiens
tctatggggatacatgaa

SEQ ID NO: 5476001 - DNA, 17 bp, Homo sapiens
tctatggtaaagatatt

SEQ ID NO: 5476002 - DNA, 18 bp, Homo sapiens
tctatggttatgaaagaa

SEQ ID NO: 5476003 - DNA, 13 bp, Homo sapiens
tctatgtaacttg

SEQ ID NO: 5476004 - DNA, 14 bp, Homo sapiens
tctatgtaacttgt

SEQ ID NO: 5476005 - DNA, 15 bp, Homo sapiens
tctatgtaacttgtt

SEQ ID NO: 5476006 - DNA, 14 bp, Homo sapiens
tctatgtacagatg

SEQ ID NO: 5476007 - DNA, 17 bp, Homo sapiens
tctatgtacagatgatg

SEQ ID NO: 5476008 - DNA, 18 bp, Homo sapiens
tctatgtactagtactgt

SEQ ID NO: 5476009 - DNA, 19 bp, Homo sapiens
tctatgtagaactgttcat

SEQ ID NO: 5476010 - DNA, 15 bp, Homo sapiens
tctatgtagtggttt

SEQ ID NO: 5476011 - DNA, 14 bp, Homo sapiens
tctatgtatattct

SEQ ID NO: 5476012 - DNA, 13 bp, Homo sapiens
tctatgtatcaaa

SEQ ID NO: 5476013 - DNA, 22 bp, Homo sapiens
tctatgtatcaaatgtaactta

SEQ ID NO: 5476014 - DNA, 12 bp, Homo sapiens
tctatgtatgtt

SEQ ID NO: 5476015 - DNA, 16 bp, Homo sapiens
tctatgtatgttaatt

SEQ ID NO: 5476016 - DNA, 23 bp, Homo sapiens
tctatgtcaattgatatttctgt

SEQ ID NO: 5476017 - DNA, 22 bp, Homo sapiens
tctatgtcatttttaatgtatc

SEQ ID NO: 5476018 - DNA, 16 bp, Homo sapiens
tctatgtccaaacctg

SEQ ID NO: 5476019 - DNA, 20 bp, Homo sapiens
tctatgtccggctttaacta

SEQ ID NO: 5476020 - DNA, 17 bp, Homo sapiens
tctatgtcctagtaact

SEQ ID NO: 5476021 - DNA, 13 bp, Homo sapiens
tctatgtcctgga

SEQ ID NO: 5476022 - DNA, 22 bp, Homo sapiens
tctatgtgctctgtactggagg

SEQ ID NO: 5476023 - DNA, 13 bp, Homo sapiens
tctatgtggaaaa

SEQ ID NO: 5476024 - DNA, 11 bp, Homo sapiens
tctatgtgtat

SEQ ID NO: 5476025 - DNA, 14 bp, Homo sapiens
tctatgtgtatata

SEQ ID NO: 5476026 - DNA, 17 bp, Homo sapiens
tctatgtgtatatatta

SEQ ID NO: 5476027 - DNA, 20 bp, Homo sapiens
tctatgtgtatgttgacttt

SEQ ID NO: 5476028 - DNA, 12 bp, Homo sapiens
tctatgtgtttc

SEQ ID NO: 5476029 - DNA, 18 bp, Homo sapiens
tctatgtgtttctgtaac

SEQ ID NO: 5476030 - DNA, 19 bp, Homo sapiens
tctatgtgttttttgcaac

SEQ ID NO: 5476031 - DNA, 17 bp, Homo sapiens
tctatgttaaatactgt

SEQ ID NO: 5476032 - DNA, 23 bp, Homo sapiens
tctatgttaaatactgtgcagaa

SEQ ID NO: 5476033 - DNA, 22 bp, Homo sapiens
tctatgttaatattttatgtgt

SEQ ID NO: 5476034 - DNA, 14 bp, Homo sapiens
tctatgttcaaaga

SEQ ID NO: 5476035 - DNA, 17 bp, Homo sapiens
tctatgttggtttcagt

SEQ ID NO: 5476036 - DNA, 13 bp, Homo sapiens
tctatgttgtaat

SEQ ID NO: 5476037 - DNA, 16 bp, Homo sapiens
tctatgtttgtgtgat

SEQ ID NO: 5476038 - DNA, 22 bp, Homo sapiens
tctatgtttgtgtgatttccta

SEQ ID NO: 5476039 - DNA, 17 bp, Homo sapiens
tctatgttttaaaataa

SEQ ID NO: 5476040 - DNA, 18 bp, Homo sapiens
tctatgttttctactcca

SEQ ID NO: 5476041 - DNA, 14 bp, Homo sapiens
tctattaaaagact

SEQ ID NO: 5476042 - DNA, 18 bp, Homo sapiens
tctattaaaagactcatc

SEQ ID NO: 5476043 - DNA, 21 bp, Homo sapiens
tctattaaaagactcatccgt

SEQ ID NO: 5476044 - DNA, 13 bp, Homo sapiens
tctattaaaagcc

SEQ ID NO: 5476045 - DNA, 20 bp, Homo sapiens
tctattaaaattctgatgtt

SEQ ID NO: 5476046 - DNA, 14 bp, Homo sapiens
tctattaaagtgac

SEQ ID NO: 5476047 - DNA, 16 bp, Homo sapiens
tctattaaagtgactt

SEQ ID NO: 5476048 - DNA, 20 bp, Homo sapiens
tctattaaagtgactttcta

SEQ ID NO: 5476049 - DNA, 19 bp, Homo sapiens
tctattaagattggaaatg

SEQ ID NO: 5476050 - DNA, 13 bp, Homo sapiens
tctattaatatat

SEQ ID NO: 5476051 - DNA, 13 bp, Homo sapiens
tctattaatcatt

SEQ ID NO: 5476052 - DNA, 20 bp, Homo sapiens
tctattaatgaggtctttaa

SEQ ID NO: 5476053 - DNA, 16 bp, Homo sapiens
tctattaattactgtg

SEQ ID NO: 5476054 - DNA, 21 bp, Homo sapiens
tctattaattactgtgtgtga

SEQ ID NO: 5476055 - DNA, 19 bp, Homo sapiens
tctattacccctcatttaa

SEQ ID NO: 5476056 - DNA, 16 bp, Homo sapiens
tctattactctgacat

SEQ ID NO: 5476057 - DNA, 18 bp, Homo sapiens
tctattactctgacataa

SEQ ID NO: 5476058 - DNA, 18 bp, Homo sapiens
tctattagactttagaaa

SEQ ID NO: 5476059 - DNA, 20 bp, Homo sapiens
tctattagcttactgattaa

SEQ ID NO: 5476060 - DNA, 17 bp, Homo sapiens
tctattagtttcaattg

SEQ ID NO: 5476061 - DNA, 15 bp, Homo sapiens
tctattatactgtat

SEQ ID NO: 5476062 - DNA, 14 bp, Homo sapiens
tctattatccagag

SEQ ID NO: 5476063 - DNA, 15 bp, Homo sapiens
tctattatctgggtt

SEQ ID NO: 5476064 - DNA, 21 bp, Homo sapiens
tctattatctgggttttagaa

SEQ ID NO: 5476065 - DNA, 23 bp, Homo sapiens
tctattatctgggttttagaaat

SEQ ID NO: 5476066 - DNA, 15 bp, Homo sapiens
tctattatgaatgtg

SEQ ID NO: 5476067 - DNA, 22 bp, Homo sapiens
tctattatgaatgtgaagcctt

SEQ ID NO: 5476068 - DNA, 14 bp, Homo sapiens
tctattattatgaa

SEQ ID NO: 5476069 - DNA, 23 bp, Homo sapiens
tctattattatgaagaattgcca

SEQ ID NO: 5476070 - DNA, 21 bp, Homo sapiens
tctattcaatttaattcttat

SEQ ID NO: 5476071 - DNA, 15 bp, Homo sapiens
tctattccagctcat

SEQ ID NO: 5476072 - DNA, 18 bp, Homo sapiens
tctattccagctcattca

SEQ ID NO: 5476073 - DNA, 19 bp, Homo sapiens
tctattccagctcattcat

SEQ ID NO: 5476074 - DNA, 23 bp, Homo sapiens
tctattccagctcattcatttta

SEQ ID NO: 5476075 - DNA, 13 bp, Homo sapiens
tctattccctgga

SEQ ID NO: 5476076 - DNA, 18 bp, Homo sapiens
tctattccctggaattca

SEQ ID NO: 5476077 - DNA, 18 bp, Homo sapiens
tctattcctgaccctccc

SEQ ID NO: 5476078 - DNA, 19 bp, Homo sapiens
tctattcctgaccctccct

SEQ ID NO: 5476079 - DNA, 16 bp, Homo sapiens
tctattccttctggcc

SEQ ID NO: 5476080 - DNA, 22 bp, Homo sapiens
tctattcgccacacagtatttt

SEQ ID NO: 5476081 - DNA, 17 bp, Homo sapiens
tctattctaataactgc

SEQ ID NO: 5476082 - DNA, 13 bp, Homo sapiens
tctattctccaga

SEQ ID NO: 5476083 - DNA, 14 bp, Homo sapiens
tctattctccagac

SEQ ID NO: 5476084 - DNA, 19 bp, Homo sapiens
tctattctctcctcagact

SEQ ID NO: 5476085 - DNA, 17 bp, Homo sapiens
tctattctctgcaattt

SEQ ID NO: 5476086 - DNA, 14 bp, Homo sapiens
tctattctctgcct

SEQ ID NO: 5476087 - DNA, 19 bp, Homo sapiens
tctattctgagaaaacaag

SEQ ID NO: 5476088 - DNA, 13 bp, Homo sapiens
tctattctgagcc

SEQ ID NO: 5476089 - DNA, 12 bp, Homo sapiens
tctattctgtgt

SEQ ID NO: 5476090 - DNA, 16 bp, Homo sapiens
tctattctttaactcc

SEQ ID NO: 5476091 - DNA, 14 bp, Homo sapiens
tctattgaaaacag

SEQ ID NO: 5476092 - DNA, 18 bp, Homo sapiens
tctattgaaaacagtgtc

SEQ ID NO: 5476093 - DNA, 20 bp, Homo sapiens
tctattgactttcttaaaaa

SEQ ID NO: 5476094 - DNA, 21 bp, Homo sapiens
tctattgacttttcaataaat

SEQ ID NO: 5476095 - DNA, 13 bp, Homo sapiens
tctattgagccaa

SEQ ID NO: 5476096 - DNA, 14 bp, Homo sapiens
tctattgatttgaa

SEQ ID NO: 5476097 - DNA, 16 bp, Homo sapiens
tctattgatttgaaaa

SEQ ID NO: 5476098 - DNA, 22 bp, Homo sapiens
tctattgatttgaaaagaattt

SEQ ID NO: 5476099 - DNA, 19 bp, Homo sapiens
tctattgcctctgagagca

SEQ ID NO: 5476100 - DNA, 16 bp, Homo sapiens
tctattgccttctttg

SEQ ID NO: 5476101 - DNA, 17 bp, Homo sapiens
tctattgccttctttga

SEQ ID NO: 5476102 - DNA, 20 bp, Homo sapiens
tctattgccttctttgaaga

SEQ ID NO: 5476103 - DNA, 17 bp, Homo sapiens
tctattgctggcaaaga

SEQ ID NO: 5476104 - DNA, 22 bp, Homo sapiens
tctattgctggcaaagacagaa

SEQ ID NO: 5476105 - DNA, 20 bp, Homo sapiens
tctattggaggtgagatcac

SEQ ID NO: 5476106 - DNA, 21 bp, Homo sapiens
tctattggatttgtccaaaca

SEQ ID NO: 5476107 - DNA, 14 bp, Homo sapiens
tctattgtagcatt

SEQ ID NO: 5476108 - DNA, 23 bp, Homo sapiens
tctattgtcatggggatcaattt

SEQ ID NO: 5476109 - DNA, 15 bp, Homo sapiens
tctattgtccaaagt

SEQ ID NO: 5476110 - DNA, 15 bp, Homo sapiens
tctattgtgcctatg

SEQ ID NO: 5476111 - DNA, 12 bp, Homo sapiens
tctattgtgctt

SEQ ID NO: 5476112 - DNA, 18 bp, Homo sapiens
tctattgttaaacaaatg

SEQ ID NO: 5476113 - DNA, 19 bp, Homo sapiens
tctattgttaaacaaatga

SEQ ID NO: 5476114 - DNA, 20 bp, Homo sapiens
tctattgttaaacaaatgat

SEQ ID NO: 5476115 - DNA, 16 bp, Homo sapiens
tctattgttaagtatt

SEQ ID NO: 5476116 - DNA, 17 bp, Homo sapiens
tctattgtttattcttt

SEQ ID NO: 5476117 - DNA, 18 bp, Homo sapiens
tcaataaaattctgtaat

SEQ ID NO: 5476118 - DNA, 16 bp, Homo sapiens
tcaataaacaacagct

SEQ ID NO: 5476119 - DNA, 15 bp, Homo sapiens
tcaataaacagcagg

SEQ ID NO: 5476120 - DNA, 19 bp, Homo sapiens
tcaataaacagcaggtgat

SEQ ID NO: 5476121 - DNA, 16 bp, Homo sapiens
tcaataaacagtcact

SEQ ID NO: 5476122 - DNA, 15 bp, Homo sapiens
tcaataaacgattta

SEQ ID NO: 5476123 - DNA, 18 bp, Homo sapiens
tcaataaacgatttaatt

SEQ ID NO: 5476124 - DNA, 19 bp, Homo sapiens
tcaataaactaaagaaaaa

SEQ ID NO: 5476125 - DNA, 15 bp, Homo sapiens
tcaataaactgaatt

SEQ ID NO: 5476126 - DNA, 12 bp, Homo sapiens
tcaataaactta

SEQ ID NO: 5476127 - DNA, 13 bp, Homo sapiens
tcaataaacttgt

SEQ ID NO: 5476128 - DNA, 15 bp, Homo sapiens
tcaataaacttgtgc

SEQ ID NO: 5476129 - DNA, 18 bp, Homo sapiens
tcaataaacttgtgcctc

SEQ ID NO: 5476130 - DNA, 19 bp, Homo sapiens
tcaataaacttgtgcctcc

SEQ ID NO: 5476131 - DNA, 20 bp, Homo sapiens
tcaataaacttgtgcctcca

SEQ ID NO: 5476132 - DNA, 19 bp, Homo sapiens
tcaataaagaaaaaaatag

SEQ ID NO: 5476133 - DNA, 15 bp, Homo sapiens
aactctgacaagggc

SEQ ID NO: 5476134 - DNA, 19 bp, Homo sapiens
aactctgagtgcaaacttc

SEQ ID NO: 5476135 - DNA, 13 bp, Homo sapiens
aactctgatgtaa

SEQ ID NO: 5476136 - DNA, 17 bp, Homo sapiens
aactctgcaaaggcctg

SEQ ID NO: 5476137 - DNA, 15 bp, Homo sapiens
aactctgcactactc

SEQ ID NO: 5476138 - DNA, 16 bp, Homo sapiens
aactctgcactccatg

SEQ ID NO: 5476139 - DNA, 23 bp, Homo sapiens
aactctgcactccatggccaccc

SEQ ID NO: 5476140 - DNA, 16 bp, Homo sapiens
aactctgcccaccctc

SEQ ID NO: 5476141 - DNA, 15 bp, Homo sapiens
aactctgctgagggt

SEQ ID NO: 5476142 - DNA, 11 bp, Homo sapiens
aactctgctgt

SEQ ID NO: 5476143 - DNA, 16 bp, Homo sapiens
aactctgcttgatttt

SEQ ID NO: 5476144 - DNA, 19 bp, Homo sapiens
aactctggacccctgggcc

SEQ ID NO: 5476145 - DNA, 23 bp, Homo sapiens
aactctggatgattcttccagat

SEQ ID NO: 5476146 - DNA, 10 bp, Homo sapiens
aactctggcc

SEQ ID NO: 5476147 - DNA, 18 bp, Homo sapiens
aactctggcttccaggta

SEQ ID NO: 5476148 - DNA, 19 bp, Homo sapiens
aactctggtgccggggagg

SEQ ID NO: 5476149 - DNA, 14 bp, Homo sapiens
aactctgtaagaaa

SEQ ID NO: 5476150 - DNA, 22 bp, Homo sapiens
aactctgtataagttgaaggaa

SEQ ID NO: 5476151 - DNA, 16 bp, Homo sapiens
aactctgtgcaggtgc

SEQ ID NO: 5476152 - DNA, 21 bp, Homo sapiens
aactctgtgtgagagagaggg

SEQ ID NO: 5476153 - DNA, 14 bp, Homo sapiens
aactctgttccccc

SEQ ID NO: 5476154 - DNA, 23 bp, Homo sapiens
aactctgttgtaagtaataattt

SEQ ID NO: 5476155 - DNA, 18 bp, Homo sapiens
aactcttaaatacttttt

SEQ ID NO: 5476156 - DNA, 20 bp, Homo sapiens
aactcttaattagacctagg

SEQ ID NO: 5476157 - DNA, 18 bp, Homo sapiens
aactcttagactgagtaa

SEQ ID NO: 5476158 - DNA, 19 bp, Homo sapiens
aactcttaggcacatcaat

SEQ ID NO: 5476159 - DNA, 14 bp, Homo sapiens
aactcttatctcag

SEQ ID NO: 5476160 - DNA, 18 bp, Homo sapiens
aactcttatttctttcct

SEQ ID NO: 5476161 - DNA, 20 bp, Homo sapiens
aactcttatttctttccttt

SEQ ID NO: 5476162 - DNA, 17 bp, Homo sapiens
aactcttcaaatgggag

SEQ ID NO: 5476163 - DNA, 15 bp, Homo sapiens
aactcttcaaggcca

SEQ ID NO: 5476164 - DNA, 16 bp, Homo sapiens
aactcttcaaggccaa

SEQ ID NO: 5476165 - DNA, 13 bp, Homo sapiens
aactcttcagaac

SEQ ID NO: 5476166 - DNA, 21 bp, Homo sapiens
aactcttcagcctcattcact

SEQ ID NO: 5476167 - DNA, 13 bp, Homo sapiens
aactcttcagtgc

SEQ ID NO: 5476168 - DNA, 22 bp, Homo sapiens
aactcttcagtgcaaattgtat

SEQ ID NO: 5476169 - DNA, 16 bp, Homo sapiens
aactcttccatttatt

SEQ ID NO: 5476170 - DNA, 20 bp, Homo sapiens
aactcttccatttattgcac

SEQ ID NO: 5476171 - DNA, 23 bp, Homo sapiens
aactcttccccctctcccagttg

SEQ ID NO: 5476172 - DNA, 14 bp, Homo sapiens
aactcttcctcccc

SEQ ID NO: 5476173 - DNA, 17 bp, Homo sapiens
aactcttgattatccat

SEQ ID NO: 5476174 - DNA, 13 bp, Homo sapiens
aactcttgctcac

SEQ ID NO: 5476175 - DNA, 16 bp, Homo sapiens
aactcttgctcactcc

SEQ ID NO: 5476176 - DNA, 19 bp, Homo sapiens
aactcttggccagagctga

SEQ ID NO: 5476177 - DNA, 12 bp, Homo sapiens
aactcttggcct

SEQ ID NO: 5476178 - DNA, 18 bp, Homo sapiens
aactcttggcctctgctt

SEQ ID NO: 5476179 - DNA, 21 bp, Homo sapiens
aactcttgtattgctccattt

SEQ ID NO: 5476180 - DNA, 19 bp, Homo sapiens
aactctttcattcttctca

SEQ ID NO: 5476181 - DNA, 19 bp, Homo sapiens
aactctttgaatgacaaag

SEQ ID NO: 5476182 - DNA, 13 bp, Homo sapiens
aactctttgctgc

SEQ ID NO: 5476183 - DNA, 23 bp, Homo sapiens
aactctttgctgctgcccatgtt

SEQ ID NO: 5476184 - DNA, 17 bp, Homo sapiens
aactctttggctattgt

SEQ ID NO: 5476185 - DNA, 18 bp, Homo sapiens
aactctttggctattgtc

SEQ ID NO: 5476186 - DNA, 23 bp, Homo sapiens
aactcttttatctcctgaaaaaa

SEQ ID NO: 5476187 - DNA, 14 bp, Homo sapiens
aactcttttctatt

SEQ ID NO: 5476188 - DNA, 16 bp, Homo sapiens
aactcttttctatttt

SEQ ID NO: 5476189 - DNA, 17 bp, Homo sapiens
aactcttttctattttg

SEQ ID NO: 5476190 - DNA, 22 bp, Homo sapiens
aactcttttttaaaaattactt

SEQ ID NO: 5476191 - DNA, 11 bp, Homo sapiens
aactgaaaaca

SEQ ID NO: 5476192 - DNA, 12 bp, Homo sapiens
aactgaaaacat

SEQ ID NO: 5476193 - DNA, 17 bp, Homo sapiens
aactgaaaactgtaaat

SEQ ID NO: 5476194 - DNA, 14 bp, Homo sapiens
aactgaaaagagag

SEQ ID NO: 5476195 - DNA, 19 bp, Homo sapiens
aactgaaaagagagcagag

SEQ ID NO: 5476196 - DNA, 16 bp, Homo sapiens
aactgaaacatgctta

SEQ ID NO: 5476197 - DNA, 17 bp, Homo sapiens
aactgaaacttttctaa

SEQ ID NO: 5476198 - DNA, 23 bp, Homo sapiens
aactgaaagcacatgaataattt

SEQ ID NO: 5476199 - DNA, 17 bp, Homo sapiens
aactgaaagtgttttac

SEQ ID NO: 5476200 - DNA, 12 bp, Homo sapiens
aactgaaataaa

SEQ ID NO: 5476201 - DNA, 14 bp, Homo sapiens
aactgaaataaaaa

SEQ ID NO: 5476202 - DNA, 20 bp, Homo sapiens
aactgaaataaaaaattatg

SEQ ID NO: 5476203 - DNA, 17 bp, Homo sapiens
aactgaaatgagcatgc

SEQ ID NO: 5476204 - DNA, 16 bp, Homo sapiens
aactgaaatgcctgct

SEQ ID NO: 5476205 - DNA, 13 bp, Homo sapiens
aactgaaatgtgg

SEQ ID NO: 5476206 - DNA, 17 bp, Homo sapiens
aactgaaattaaaacta

SEQ ID NO: 5476207 - DNA, 14 bp, Homo sapiens
aactgaaattcaga

SEQ ID NO: 5476208 - DNA, 11 bp, Homo sapiens
aactgaaccaa

SEQ ID NO: 5476209 - DNA, 20 bp, Homo sapiens
aactgaacgaccttacaaat

SEQ ID NO: 5476210 - DNA, 21 bp, Homo sapiens
aactgaacgaccttacaaatg

SEQ ID NO: 5476211 - DNA, 11 bp, Homo sapiens
aactgaactgt

SEQ ID NO: 5476212 - DNA, 22 bp, Homo sapiens
aactgaagaaaaggttcttctt

SEQ ID NO: 5476213 - DNA, 22 bp, Homo sapiens
aactgaagaattttgagtgaat

SEQ ID NO: 5476214 - DNA, 20 bp, Homo sapiens
aactgaagacctccacatta

SEQ ID NO: 5476215 - DNA, 18 bp, Homo sapiens
aactgaagagtaatcaat

SEQ ID NO: 5476216 - DNA, 17 bp, Homo sapiens
aactgaagatgttgaga

SEQ ID NO: 5476217 - DNA, 20 bp, Homo sapiens
aactgaagcataaacatcac

SEQ ID NO: 5476218 - DNA, 13 bp, Homo sapiens
aactgaagccact

SEQ ID NO: 5476219 - DNA, 14 bp, Homo sapiens
aactgaagccgtgt

SEQ ID NO: 5476220 - DNA, 14 bp, Homo sapiens
aactgaagccttct

SEQ ID NO: 5476221 - DNA, 16 bp, Homo sapiens
aactgaaggaaggctg

SEQ ID NO: 5476222 - DNA, 10 bp, Homo sapiens
aactgaaggg

SEQ ID NO: 5476223 - DNA, 19 bp, Homo sapiens
aactgaaggggtgcaccca

SEQ ID NO: 5476224 - DNA, 21 bp, Homo sapiens
aactgaaggggtgcacccacc

SEQ ID NO: 5476225 - DNA, 14 bp, Homo sapiens
aactgaataaaaaa

SEQ ID NO: 5476226 - DNA, 13 bp, Homo sapiens
aactgaataccac

SEQ ID NO: 5476227 - DNA, 24 bp, Homo sapiens
aactgaataccactctgtaattgc

SEQ ID NO: 5476228 - DNA, 15 bp, Homo sapiens
aactgaatacctaag

SEQ ID NO: 5476229 - DNA, 22 bp, Homo sapiens
aactgaataggaaaatgtacat

SEQ ID NO: 5476230 - DNA, 14 bp, Homo sapiens
aactgaatattttg

SEQ ID NO: 5476231 - DNA, 18 bp, Homo sapiens
aactgaatattttggaaa

SEQ ID NO: 5476232 - DNA, 17 bp, Homo sapiens
aactgaatctatggctt

SEQ ID NO: 5476233 - DNA, 18 bp, Homo sapiens
aactgaatgaaaccccca

SEQ ID NO: 5476234 - DNA, 23 bp, Homo sapiens
aactgaatgaaacccccacacac

SEQ ID NO: 5476235 - DNA, 17 bp, Homo sapiens
aactgaattaaacatga

SEQ ID NO: 5476236 - DNA, 16 bp, Homo sapiens
aactgaattttgggac

SEQ ID NO: 5476237 - DNA, 15 bp, Homo sapiens
aactgaattttgtct

SEQ ID NO: 5476238 - DNA, 18 bp, Homo sapiens
aactgaatttttcttgcg

SEQ ID NO: 5476239 - DNA, 15 bp, Homo sapiens
aactgacaaatcaag

SEQ ID NO: 5476240 - DNA, 17 bp, Homo sapiens
aactgacaacctgtgca

SEQ ID NO: 5476241 - DNA, 16 bp, Homo sapiens
aactgacaagccatct

SEQ ID NO: 5476242 - DNA, 23 bp, Homo sapiens
aactgacagggcccagttaaata

SEQ ID NO: 5476243 - DNA, 18 bp, Homo sapiens
aactgacagtattaaggg

SEQ ID NO: 5476244 - DNA, 13 bp, Homo sapiens
aactgacatcaga

SEQ ID NO: 5476245 - DNA, 21 bp, Homo sapiens
aactgacatcagatttcttaa

SEQ ID NO: 5476246 - DNA, 18 bp, Homo sapiens
aactgacatgccctccct

SEQ ID NO: 5476247 - DNA, 14 bp, Homo sapiens
aactgaccagcctc

SEQ ID NO: 5476248 - DNA, 19 bp, Homo sapiens
aactgaccagcctccatgc

SEQ ID NO: 5476249 - DNA, 22 bp, Homo sapiens
aactgacctgaccccattcctg

SEQ ID NO: 5476250 - DNA, 22 bp, Homo sapiens
aactgacgaagaagcaactaag

SEQ ID NO: 5476251 - DNA, 22 bp, Homo sapiens
aactgacgattcttaatcaaga

SEQ ID NO: 5476252 - DNA, 18 bp, Homo sapiens
aactgactaaccattgat

SEQ ID NO: 5476253 - DNA, 23 bp, Homo sapiens
aactgactattcttgatgtaaaa

SEQ ID NO: 5476254 - DNA, 20 bp, Homo sapiens
aactgactcttaagaagact

SEQ ID NO: 5476255 - DNA, 13 bp, Homo sapiens
aactgacttgtat

SEQ ID NO: 5476256 - DNA, 13 bp, Homo sapiens
aactgactttatc

SEQ ID NO: 5476257 - DNA, 18 bp, Homo sapiens
aactgagaaatgaatgct

SEQ ID NO: 5476258 - DNA, 18 bp, Homo sapiens
aactgagaagccaagcct

SEQ ID NO: 5476259 - DNA, 16 bp, Homo sapiens
aactgagaccaagtct

SEQ ID NO: 5476260 - DNA, 12 bp, Homo sapiens
aactgagagaag

SEQ ID NO: 5476261 - DNA, 23 bp, Homo sapiens
aactgagagtaattcatctgtga

SEQ ID NO: 5476262 - DNA, 20 bp, Homo sapiens
aactgagatattattttaaa

SEQ ID NO: 5476263 - DNA, 18 bp, Homo sapiens
aactgagatccttccttt

SEQ ID NO: 5476264 - DNA, 18 bp, Homo sapiens
aactgagccaaaaacaat

SEQ ID NO: 5476265 - DNA, 18 bp, Homo sapiens
aactgagcctcttttcaa

SEQ ID NO: 5476266 - DNA, 14 bp, Homo sapiens
aactgagctcctct

SEQ ID NO: 5476267 - DNA, 18 bp, Homo sapiens
aactgagctcgcagcccc

SEQ ID NO: 5476268 - DNA, 17 bp, Homo sapiens
aactgagctgccagtgg

SEQ ID NO: 5476269 - DNA, 13 bp, Homo sapiens
aactgaggaattt

SEQ ID NO: 5476270 - DNA, 18 bp, Homo sapiens
aactgaggaattttcttt

SEQ ID NO: 5476271 - DNA, 20 bp, Homo sapiens
aactgaggagcggactcact

SEQ ID NO: 5476272 - DNA, 13 bp, Homo sapiens
aactgaggagcta

SEQ ID NO: 5476273 - DNA, 20 bp, Homo sapiens
aactgaggcagacagcagct

SEQ ID NO: 5476274 - DNA, 23 bp, Homo sapiens
aactgaggcccacggtttcagct

SEQ ID NO: 5476275 - DNA, 14 bp, Homo sapiens
aactgaggccttgt

SEQ ID NO: 5476276 - DNA, 21 bp, Homo sapiens
aactgaggccttgtgtgtcag

SEQ ID NO: 5476277 - DNA, 22 bp, Homo sapiens
aactgaggccttgtgtgtcagg

SEQ ID NO: 5476278 - DNA, 23 bp, Homo sapiens
aactgaggccttgtgtgtcaggc

SEQ ID NO: 5476279 - DNA, 18 bp, Homo sapiens
aactgaggcttagaaagg

SEQ ID NO: 5476280 - DNA, 21 bp, Homo sapiens
aactgagggcatgagtctcac

SEQ ID NO: 5476281 - DNA, 20 bp, Homo sapiens
aactgagggctctgtttgtg

SEQ ID NO: 5476282 - DNA, 18 bp, Homo sapiens
aactgagggctgatcttt

SEQ ID NO: 5476283 - DNA, 20 bp, Homo sapiens
aactgaggtgttattttcaa

SEQ ID NO: 5476284 - DNA, 20 bp, Homo sapiens
aactgagtacaattgttatg

SEQ ID NO: 5476285 - DNA, 19 bp, Homo sapiens
aactgagtagcagaaaaca

SEQ ID NO: 5476286 - DNA, 23 bp, Homo sapiens
aactgagtattaatatctgagga

SEQ ID NO: 5476287 - DNA, 16 bp, Homo sapiens
aactgagtccatgaaa

SEQ ID NO: 5476288 - DNA, 22 bp, Homo sapiens
aactgagtccatgaaaatacca

SEQ ID NO: 5476289 - DNA, 14 bp, Homo sapiens
aactgagtcctgtt

SEQ ID NO: 5476290 - DNA, 17 bp, Homo sapiens
aactgagtccttaaaca

SEQ ID NO: 5476291 - DNA, 17 bp, Homo sapiens
aactgagtgtggcggga

SEQ ID NO: 5476292 - DNA, 23 bp, Homo sapiens
aactgatagttactgttgtgacc

SEQ ID NO: 5476293 - DNA, 15 bp, Homo sapiens
aactgatcaaaaata

SEQ ID NO: 5476294 - DNA, 16 bp, Homo sapiens
aactgatcaaaaataa

SEQ ID NO: 5476295 - DNA, 20 bp, Homo sapiens
tgcggagtgaagaggggcag

SEQ ID NO: 5476296 - DNA, 21 bp, Homo sapiens
tgcggagtgaagaggggcagc

SEQ ID NO: 5476297 - DNA, 15 bp, Homo sapiens
tgcggatgagggcat

SEQ ID NO: 5476298 - DNA, 15 bp, Homo sapiens
tgcggcaaaaggaaa

SEQ ID NO: 5476299 - DNA, 16 bp, Homo sapiens
tgcggcaggactgcag

SEQ ID NO: 5476300 - DNA, 12 bp, Homo sapiens
tgcggcaggagc

SEQ ID NO: 5476301 - DNA, 17 bp, Homo sapiens
tgcggcaggagcaggaa

SEQ ID NO: 5476302 - DNA, 15 bp, Homo sapiens
tgcggcagggaagag

SEQ ID NO: 5476303 - DNA, 22 bp, Homo sapiens
tgcggcagggcaggagcttggc

SEQ ID NO: 5476304 - DNA, 15 bp, Homo sapiens
tgcggcatccctgtg

SEQ ID NO: 5476305 - DNA, 16 bp, Homo sapiens
tgcggcccagccatgg

SEQ ID NO: 5476306 - DNA, 13 bp, Homo sapiens
tgcggcccagccc

SEQ ID NO: 5476307 - DNA, 16 bp, Homo sapiens
tgcggcccagcccggc

SEQ ID NO: 5476308 - DNA, 13 bp, Homo sapiens
tgcggccccagga

SEQ ID NO: 5476309 - DNA, 19 bp, Homo sapiens
tgcggcccgtgcgcagccg

SEQ ID NO: 5476310 - DNA, 23 bp, Homo sapiens
tgcggcccgtgcgcagccgcgct

SEQ ID NO: 5476311 - DNA, 18 bp, Homo sapiens
tgcggccgcattccctga

SEQ ID NO: 5476312 - DNA, 19 bp, Homo sapiens
tgcggccgcattccctgag

SEQ ID NO: 5476313 - DNA, 19 bp, Homo sapiens
tgcggccgccccccgcccc

SEQ ID NO: 5476314 - DNA, 18 bp, Homo sapiens
tgcggccgtcaccccgcc

SEQ ID NO: 5476315 - DNA, 20 bp, Homo sapiens
tgcggccgtcaccccgccag

SEQ ID NO: 5476316 - DNA, 23 bp, Homo sapiens
tgcggccgtcaccccgccagcct

SEQ ID NO: 5476317 - DNA, 19 bp, Homo sapiens
tgcggccttccaccgggcc

SEQ ID NO: 5476318 - DNA, 23 bp, Homo sapiens
tgcggccttccaccgggcctgaa

SEQ ID NO: 5476319 - DNA, 15 bp, Homo sapiens
tgcggccttttcatg

SEQ ID NO: 5476320 - DNA, 15 bp, Homo sapiens
tgcggcgccagcctc

SEQ ID NO: 5476321 - DNA, 16 bp, Homo sapiens
tgcggcgccagcctca

SEQ ID NO: 5476322 - DNA, 16 bp, Homo sapiens
tgcggcgtacaggctg

SEQ ID NO: 5476323 - DNA, 17 bp, Homo sapiens
tgcggctcagccttgca

SEQ ID NO: 5476324 - DNA, 13 bp, Homo sapiens
tgcggctctggaa

SEQ ID NO: 5476325 - DNA, 14 bp, Homo sapiens
tgcggctgccgggc

SEQ ID NO: 5476326 - DNA, 11 bp, Homo sapiens
tgcggctgctg

SEQ ID NO: 5476327 - DNA, 13 bp, Homo sapiens
tgcggctgtgtgt

SEQ ID NO: 5476328 - DNA, 15 bp, Homo sapiens
tgcggctttctctgc

SEQ ID NO: 5476329 - DNA, 16 bp, Homo sapiens
tgcggctttctctgcc

SEQ ID NO: 5476330 - DNA, 17 bp, Homo sapiens
tgcggctttctctgcct

SEQ ID NO: 5476331 - DNA, 21 bp, Homo sapiens
tgcgggaccggtacagaaagg

SEQ ID NO: 5476332 - DNA, 17 bp, Homo sapiens
tgcgggagccagactgt

SEQ ID NO: 5476333 - DNA, 20 bp, Homo sapiens
tgcgggagccagactgtcca

SEQ ID NO: 5476334 - DNA, 16 bp, Homo sapiens
tgcgggaggccctggc

SEQ ID NO: 5476335 - DNA, 18 bp, Homo sapiens
tgcgggaggccctggccc

SEQ ID NO: 5476336 - DNA, 19 bp, Homo sapiens
tgcgggaggccctggccct

SEQ ID NO: 5476337 - DNA, 15 bp, Homo sapiens
tgcgggatacagctg

SEQ ID NO: 5476338 - DNA, 17 bp, Homo sapiens
tgcgggatggtcctggg

SEQ ID NO: 5476339 - DNA, 19 bp, Homo sapiens
tgcgggatggtcctggggc

SEQ ID NO: 5476340 - DNA, 17 bp, Homo sapiens
tgcgggcacaataaatc

SEQ ID NO: 5476341 - DNA, 23 bp, Homo sapiens
tgcgggcattttgaatgtgatca

SEQ ID NO: 5476342 - DNA, 13 bp, Homo sapiens
tgcgggccacagg

SEQ ID NO: 5476343 - DNA, 16 bp, Homo sapiens
tgcgggccacagggca

SEQ ID NO: 5476344 - DNA, 19 bp, Homo sapiens
tgcgggcctggccctcact

SEQ ID NO: 5476345 - DNA, 22 bp, Homo sapiens
tgcgggcgcgggcagccaccca

SEQ ID NO: 5476346 - DNA, 14 bp, Homo sapiens
tgcgggctccctcc

SEQ ID NO: 5476347 - DNA, 15 bp, Homo sapiens
tgcgggctccctcct

SEQ ID NO: 5476348 - DNA, 17 bp, Homo sapiens
tgcgggctccctcctct

SEQ ID NO: 5476349 - DNA, 19 bp, Homo sapiens
tgcgggctccctcctctgg

SEQ ID NO: 5476350 - DNA, 16 bp, Homo sapiens
tgcgggctgggcagct

SEQ ID NO: 5476351 - DNA, 13 bp, Homo sapiens
tgcggggacaggc

SEQ ID NO: 5476352 - DNA, 14 bp, Homo sapiens
tgcggggacaggct

SEQ ID NO: 5476353 - DNA, 18 bp, Homo sapiens
tgcggggagacagaagcc

SEQ ID NO: 5476354 - DNA, 13 bp, Homo sapiens
tgcggggcagcag

SEQ ID NO: 5476355 - DNA, 17 bp, Homo sapiens
tgcggggcagggccttc

SEQ ID NO: 5476356 - DNA, 15 bp, Homo sapiens
tgcggggcctgtctc

SEQ ID NO: 5476357 - DNA, 20 bp, Homo sapiens
tgcggggcctgtctcagtga

SEQ ID NO: 5476358 - DNA, 18 bp, Homo sapiens
tgcggggcgggcacacct

SEQ ID NO: 5476359 - DNA, 20 bp, Homo sapiens
tgcggggcttttaaaaggaa

SEQ ID NO: 5476360 - DNA, 16 bp, Homo sapiens
tgcgggggagcaggca

SEQ ID NO: 5476361 - DNA, 18 bp, Homo sapiens
tgcgggggagcaggcagt

SEQ ID NO: 5476362 - DNA, 22 bp, Homo sapiens
tgcgggggagccagttctgggg

SEQ ID NO: 5476363 - DNA, 16 bp, Homo sapiens
tgcggggtggagtgag

SEQ ID NO: 5476364 - DNA, 14 bp, Homo sapiens
tgcgggtcacagga

SEQ ID NO: 5476365 - DNA, 13 bp, Homo sapiens
tgcgggtcctcag

SEQ ID NO: 5476366 - DNA, 15 bp, Homo sapiens
tgcgggtctgaagga

SEQ ID NO: 5476367 - DNA, 23 bp, Homo sapiens
tgcgggtggggcttggggctcac

SEQ ID NO: 5476368 - DNA, 15 bp, Homo sapiens
tgcggtagccagcac

SEQ ID NO: 5476369 - DNA, 17 bp, Homo sapiens
tgcggtagccagcacac

SEQ ID NO: 5476370 - DNA, 24 bp, Homo sapiens
tgcggtcaggctgggcagccccag

SEQ ID NO: 5476371 - DNA, 15 bp, Homo sapiens
tgcggtccacccagg

SEQ ID NO: 5476372 - DNA, 14 bp, Homo sapiens
tgcggtgaggcagg

SEQ ID NO: 5476373 - DNA, 16 bp, Homo sapiens
tgcggtgggcagccat

SEQ ID NO: 5476374 - DNA, 15 bp, Homo sapiens
tgcggtgggtgctgc

SEQ ID NO: 5476375 - DNA, 18 bp, Homo sapiens
tgcggtggtgccagaggt

SEQ ID NO: 5476376 - DNA, 22 bp, Homo sapiens
tgcggtgtctgcagctcctgga

SEQ ID NO: 5476377 - DNA, 13 bp, Homo sapiens
tgcggtgtgtctc

SEQ ID NO: 5476378 - DNA, 16 bp, Homo sapiens
tgcggttaattttgaa

SEQ ID NO: 5476379 - DNA, 23 bp, Homo sapiens
tgcggttcaggaaaattgaatgc

SEQ ID NO: 5476380 - DNA, 18 bp, Homo sapiens
tgcggttccggcatggac

SEQ ID NO: 5476381 - DNA, 19 bp, Homo sapiens
tgcggttcttacagcacat

SEQ ID NO: 5476382 - DNA, 13 bp, Homo sapiens
tgcggttgggagg

SEQ ID NO: 5476383 - DNA, 18 bp, Homo sapiens
tgcggtttccaaggtgca

SEQ ID NO: 5476384 - DNA, 18 bp, Homo sapiens
tgcgtaaatggttttcaa

SEQ ID NO: 5476385 - DNA, 20 bp, Homo sapiens
tgcgtaaatggttttcaaca

SEQ ID NO: 5476386 - DNA, 15 bp, Homo sapiens
tgcgtaaccctcgcc

SEQ ID NO: 5476387 - DNA, 21 bp, Homo sapiens
tgcgtaaccctcgccctgtcc

SEQ ID NO: 5476388 - DNA, 13 bp, Homo sapiens
tgcgtacacagag

SEQ ID NO: 5476389 - DNA, 14 bp, Homo sapiens
tgcgtacacagaga

SEQ ID NO: 5476390 - DNA, 15 bp, Homo sapiens
tgcgtactccactgg

SEQ ID NO: 5476391 - DNA, 14 bp, Homo sapiens
tctggggtgcagct

SEQ ID NO: 5476392 - DNA, 17 bp, Homo sapiens
tctggggttcagcccct

SEQ ID NO: 5476393 - DNA, 18 bp, Homo sapiens
tctggggttcagcccctc

SEQ ID NO: 5476394 - DNA, 22 bp, Homo sapiens
tctggggttcagcccctcctct

SEQ ID NO: 5476395 - DNA, 20 bp, Homo sapiens
tctggggttggcaacaggac

SEQ ID NO: 5476396 - DNA, 21 bp, Homo sapiens
tctgggtacctgcaagcagaa

SEQ ID NO: 5476397 - DNA, 12 bp, Homo sapiens
tctgggtagaag

SEQ ID NO: 5476398 - DNA, 15 bp, Homo sapiens
tctgggtcagtggtc

SEQ ID NO: 5476399 - DNA, 18 bp, Homo sapiens
tctgggtcatgcactgag

SEQ ID NO: 5476400 - DNA, 18 bp, Homo sapiens
tctgggtccaggcctggc

SEQ ID NO: 5476401 - DNA, 15 bp, Homo sapiens
tctgggtccagggag

SEQ ID NO: 5476402 - DNA, 13 bp, Homo sapiens
tctgggtcccggg

SEQ ID NO: 5476403 - DNA, 17 bp, Homo sapiens
tctgggtccctcggagc

SEQ ID NO: 5476404 - DNA, 20 bp, Homo sapiens
tctgggtccctgctcccctt

SEQ ID NO: 5476405 - DNA, 17 bp, Homo sapiens
tctgggtccttggctcc

SEQ ID NO: 5476406 - DNA, 22 bp, Homo sapiens
tctgggtctgattttctcactg

SEQ ID NO: 5476407 - DNA, 14 bp, Homo sapiens
tctgggtgaggtag

SEQ ID NO: 5476408 - DNA, 23 bp, Homo sapiens
tctgggtgatggaaactgccaaa

SEQ ID NO: 5476409 - DNA, 19 bp, Homo sapiens
tctgggtgatttctagaat

SEQ ID NO: 5476410 - DNA, 22 bp, Homo sapiens
tctgggtgcaggagcgctccct

SEQ ID NO: 5476411 - DNA, 18 bp, Homo sapiens
tctgggtgctagatccag

SEQ ID NO: 5476412 - DNA, 19 bp, Homo sapiens
tctgggtgctagatccagc

SEQ ID NO: 5476413 - DNA, 14 bp, Homo sapiens
tctgggtgctgccc

SEQ ID NO: 5476414 - DNA, 18 bp, Homo sapiens
tctgggtggaagtgccca

SEQ ID NO: 5476415 - DNA, 21 bp, Homo sapiens
tctgggtggaagtgcccagcc

SEQ ID NO: 5476416 - DNA, 22 bp, Homo sapiens
tctgggtggaagtgcccagccc

SEQ ID NO: 5476417 - DNA, 15 bp, Homo sapiens
tctgggtggatgtga

SEQ ID NO: 5476418 - DNA, 13 bp, Homo sapiens
tctgggtggcctc

SEQ ID NO: 5476419 - DNA, 20 bp, Homo sapiens
tctgggtggggcccaggccc

SEQ ID NO: 5476420 - DNA, 19 bp, Homo sapiens
tctgggtggtaactgccag

SEQ ID NO: 5476421 - DNA, 22 bp, Homo sapiens
tctgggtggtaactgccagcct

SEQ ID NO: 5476422 - DNA, 16 bp, Homo sapiens
tctgggtggttgccct

SEQ ID NO: 5476423 - DNA, 19 bp, Homo sapiens
tctgggtggttgcccttca

SEQ ID NO: 5476424 - DNA, 21 bp, Homo sapiens
tctgggtgtccgccatccagg

SEQ ID NO: 5476425 - DNA, 16 bp, Homo sapiens
tctgggttaatttctt

SEQ ID NO: 5476426 - DNA, 14 bp, Homo sapiens
tctgggttcactgc

SEQ ID NO: 5476427 - DNA, 16 bp, Homo sapiens
tctgggttccttcctc

SEQ ID NO: 5476428 - DNA, 18 bp, Homo sapiens
tctgggttcgttggggac

SEQ ID NO: 5476429 - DNA, 13 bp, Homo sapiens
tctgggttctggg

SEQ ID NO: 5476430 - DNA, 15 bp, Homo sapiens
tctgggttctgggtg

SEQ ID NO: 5476431 - DNA, 18 bp, Homo sapiens
tctgggtttacaacaaac

SEQ ID NO: 5476432 - DNA, 20 bp, Homo sapiens
tctgggtttacaacaaacac

SEQ ID NO: 5476433 - DNA, 23 bp, Homo sapiens
tctgggtttacaacaaacactgt

SEQ ID NO: 5476434 - DNA, 14 bp, Homo sapiens
tctgggtttctaag

SEQ ID NO: 5476435 - DNA, 16 bp, Homo sapiens
tctgggtttgcccagt

SEQ ID NO: 5476436 - DNA, 13 bp, Homo sapiens
tctgggtttggat

SEQ ID NO: 5476437 - DNA, 16 bp, Homo sapiens
tctgggtttggcccaa

SEQ ID NO: 5476438 - DNA, 19 bp, Homo sapiens
tctgggtttggcccaagac

SEQ ID NO: 5476439 - DNA, 13 bp, Homo sapiens
tctggtaaatatg

SEQ ID NO: 5476440 - DNA, 16 bp, Homo sapiens
tctggtagatagaaat

SEQ ID NO: 5476441 - DNA, 23 bp, Homo sapiens
tctggtataaagctctcaaatgt

SEQ ID NO: 5476442 - DNA, 21 bp, Homo sapiens
tctggtatctaattctttaat

SEQ ID NO: 5476443 - DNA, 14 bp, Homo sapiens
tctggtatctgcat

SEQ ID NO: 5476444 - DNA, 22 bp, Homo sapiens
tctggtatcttgttagagagct

SEQ ID NO: 5476445 - DNA, 19 bp, Homo sapiens
tctggtatgcattctttat

SEQ ID NO: 5476446 - DNA, 22 bp, Homo sapiens
tctggtatggtgctaatatttt

SEQ ID NO: 5476447 - DNA, 14 bp, Homo sapiens
tctggtattaaatg

SEQ ID NO: 5476448 - DNA, 15 bp, Homo sapiens
tctggtattaaatgc

SEQ ID NO: 5476449 - DNA, 20 bp, Homo sapiens
tctggtatttcccctgtcag

SEQ ID NO: 5476450 - DNA, 22 bp, Homo sapiens
tctggtatttcccctgtcagtt

SEQ ID NO: 5476451 - DNA, 23 bp, Homo sapiens
tctggtcaaagaaagaaagttta

SEQ ID NO: 5476452 - DNA, 16 bp, Homo sapiens
tctggtcagagccaca

SEQ ID NO: 5476453 - DNA, 19 bp, Homo sapiens
tctggtcagagccacaggg

SEQ ID NO: 5476454 - DNA, 20 bp, Homo sapiens
tctggtcaggcaatgccctg

SEQ ID NO: 5476455 - DNA, 15 bp, Homo sapiens
tctggtccacacacc

SEQ ID NO: 5476456 - DNA, 16 bp, Homo sapiens
tctggtcccctgtggt

SEQ ID NO: 5476457 - DNA, 15 bp, Homo sapiens
tctggtccctcttct

SEQ ID NO: 5476458 - DNA, 14 bp, Homo sapiens
tctggtcccttgca

SEQ ID NO: 5476459 - DNA, 14 bp, Homo sapiens
tctggtcctaccca

SEQ ID NO: 5476460 - DNA, 21 bp, Homo sapiens
tctggtcctgttttctaaaaa

SEQ ID NO: 5476461 - DNA, 22 bp, Homo sapiens
tctggtcctgttttctaaaaaa

SEQ ID NO: 5476462 - DNA, 17 bp, Homo sapiens
tctggtccttagtaaat

SEQ ID NO: 5476463 - DNA, 13 bp, Homo sapiens
tctggtccttttt

SEQ ID NO: 5476464 - DNA, 18 bp, Homo sapiens
tctggtctactctagaag

SEQ ID NO: 5476465 - DNA, 14 bp, Homo sapiens
tctggtctcgaact

SEQ ID NO: 5476466 - DNA, 24 bp, Homo sapiens
tctggtctcgtgttcgctggctga

SEQ ID NO: 5476467 - DNA, 16 bp, Homo sapiens
tctggtctctaggctg

SEQ ID NO: 5476468 - DNA, 18 bp, Homo sapiens
tctggtctctaggctggg

SEQ ID NO: 5476469 - DNA, 21 bp, Homo sapiens
tctggtctctaggctggggaa

SEQ ID NO: 5476470 - DNA, 19 bp, Homo sapiens
tctggtctgtgtgtgttct

SEQ ID NO: 5476471 - DNA, 17 bp, Homo sapiens
tctggtgaagctcactt

SEQ ID NO: 5476472 - DNA, 16 bp, Homo sapiens
tctggtgacaccagcc

SEQ ID NO: 5476473 - DNA, 11 bp, Homo sapiens
ttacagctgtt

SEQ ID NO: 5476474 - DNA, 22 bp, Homo sapiens
ttacaggaaaaaaaattctgtt

SEQ ID NO: 5476475 - DNA, 16 bp, Homo sapiens
ttacaggaaattgcaa

SEQ ID NO: 5476476 - DNA, 15 bp, Homo sapiens
ttacaggaagtactg

SEQ ID NO: 5476477 - DNA, 16 bp, Homo sapiens
ttacaggaatgaagaa

SEQ ID NO: 5476478 - DNA, 14 bp, Homo sapiens
ttacaggagccagc

SEQ ID NO: 5476479 - DNA, 18 bp, Homo sapiens
ttacaggagccagcctgc

SEQ ID NO: 5476480 - DNA, 12 bp, Homo sapiens
ttacaggagggc

SEQ ID NO: 5476481 - DNA, 14 bp, Homo sapiens
ttacaggatcatgt

SEQ ID NO: 5476482 - DNA, 14 bp, Homo sapiens
ttacaggcatgagc

SEQ ID NO: 5476483 - DNA, 20 bp, Homo sapiens
ttacaggcatgagccactgc

SEQ ID NO: 5476484 - DNA, 20 bp, Homo sapiens
ttacaggcatggacatgcag

SEQ ID NO: 5476485 - DNA, 16 bp, Homo sapiens
ttacaggcatgtgcca

SEQ ID NO: 5476486 - DNA, 19 bp, Homo sapiens
ttacagggagcctcctgcc

SEQ ID NO: 5476487 - DNA, 21 bp, Homo sapiens
ttacagggagcctcctgccca

SEQ ID NO: 5476488 - DNA, 17 bp, Homo sapiens
ttacaggggattttatt

SEQ ID NO: 5476489 - DNA, 17 bp, Homo sapiens
ttacaggggcagtgcct

SEQ ID NO: 5476490 - DNA, 11 bp, Homo sapiens
ttacagggtat

SEQ ID NO: 5476491 - DNA, 14 bp, Homo sapiens
ttacagggtgactc

SEQ ID NO: 5476492 - DNA, 15 bp, Homo sapiens
ttacagggtgactca

SEQ ID NO: 5476493 - DNA, 19 bp, Homo sapiens
ttacaggtcctgctgaaac

SEQ ID NO: 5476494 - DNA, 18 bp, Homo sapiens
ttacaggtggacacacaa

SEQ ID NO: 5476495 - DNA, 16 bp, Homo sapiens
ttacaggtgtgagcca

SEQ ID NO: 5476496 - DNA, 18 bp, Homo sapiens
ttacaggtgtgagccaca

SEQ ID NO: 5476497 - DNA, 20 bp, Homo sapiens
ttacaggtgtgagccacagc

SEQ ID NO: 5476498 - DNA, 13 bp, Homo sapiens
ttacaggttcctt

SEQ ID NO: 5476499 - DNA, 16 bp, Homo sapiens
ttacagtaaataaatt

SEQ ID NO: 5476500 - DNA, 22 bp, Homo sapiens
ttacagtaatcccatttcccaa

SEQ ID NO: 5476501 - DNA, 21 bp, Homo sapiens
ttacagtacacatccccagaa

SEQ ID NO: 5476502 - DNA, 13 bp, Homo sapiens
ttacagtataatt

SEQ ID NO: 5476503 - DNA, 18 bp, Homo sapiens
ttacagtataattaacat

SEQ ID NO: 5476504 - DNA, 19 bp, Homo sapiens
ttacagtataattaacatg

SEQ ID NO: 5476505 - DNA, 20 bp, Homo sapiens
ttacagtataattaacatgt

SEQ ID NO: 5476506 - DNA, 16 bp, Homo sapiens
ttacagtatcttcaaa

SEQ ID NO: 5476507 - DNA, 17 bp, Homo sapiens
ttacagtatcttcaaaa

SEQ ID NO: 5476508 - DNA, 21 bp, Homo sapiens
ttacagtatcttcaaaaatac

SEQ ID NO: 5476509 - DNA, 23 bp, Homo sapiens
ttacagtatgatgaaaataattt

SEQ ID NO: 5476510 - DNA, 19 bp, Homo sapiens
ttacagtattgctatttat

SEQ ID NO: 5476511 - DNA, 22 bp, Homo sapiens
ttacagtcattggaataaggca

SEQ ID NO: 5476512 - DNA, 20 bp, Homo sapiens
ttacagtctctgttgtaaat

SEQ ID NO: 5476513 - DNA, 19 bp, Homo sapiens
ttacagtgaaaatgtaagc

SEQ ID NO: 5476514 - DNA, 13 bp, Homo sapiens
ttacagtgactgt

SEQ ID NO: 5476515 - DNA, 18 bp, Homo sapiens
ttacagtgcctaaaataa

SEQ ID NO: 5476516 - DNA, 14 bp, Homo sapiens
ttacagtggcagta

SEQ ID NO: 5476517 - DNA, 15 bp, Homo sapiens
ttacagtggcagtat

SEQ ID NO: 5476518 - DNA, 16 bp, Homo sapiens
ttacagtggcagtatt

SEQ ID NO: 5476519 - DNA, 13 bp, Homo sapiens
ttacagtgtatct

SEQ ID NO: 5476520 - DNA, 14 bp, Homo sapiens
ttacagtgtattta

SEQ ID NO: 5476521 - DNA, 17 bp, Homo sapiens
ttacagtgtctgtgtgt

SEQ ID NO: 5476522 - DNA, 13 bp, Homo sapiens
ttacagtgtttta

SEQ ID NO: 5476523 - DNA, 17 bp, Homo sapiens
ttacagttaaggaatat

SEQ ID NO: 5476524 - DNA, 19 bp, Homo sapiens
ttacagttagggttttgca

SEQ ID NO: 5476525 - DNA, 14 bp, Homo sapiens
ttacagttcacact

SEQ ID NO: 5476526 - DNA, 19 bp, Homo sapiens
ttacagttctggaggagga

SEQ ID NO: 5476527 - DNA, 12 bp, Homo sapiens
ttacagttctgt

SEQ ID NO: 5476528 - DNA, 20 bp, Homo sapiens
ttacagtttaagattttaag

SEQ ID NO: 5476529 - DNA, 18 bp, Homo sapiens
ttacagtttcaaaaactg

SEQ ID NO: 5476530 - DNA, 14 bp, Homo sapiens
ttacagtttcttca

SEQ ID NO: 5476531 - DNA, 20 bp, Homo sapiens
ttacagtttgatacaggaat

SEQ ID NO: 5476532 - DNA, 13 bp, Homo sapiens
ttacagtttgtgt

SEQ ID NO: 5476533 - DNA, 21 bp, Homo sapiens
ttacagtttgtgttttaaaaa

SEQ ID NO: 5476534 - DNA, 22 bp, Homo sapiens
ttacagtttgtgttttaaaaaa

SEQ ID NO: 5476535 - DNA, 22 bp, Homo sapiens
ttacataaaacacccttgaaaa

SEQ ID NO: 5476536 - DNA, 14 bp, Homo sapiens
ttacataaacatca

SEQ ID NO: 5476537 - DNA, 20 bp, Homo sapiens
ttacataaagctcccttgaa

SEQ ID NO: 5476538 - DNA, 19 bp, Homo sapiens
ttacataacggaaagtttt

SEQ ID NO: 5476539 - DNA, 17 bp, Homo sapiens
ttacataactgatctat

SEQ ID NO: 5476540 - DNA, 15 bp, Homo sapiens
ttacataactgcctt

SEQ ID NO: 5476541 - DNA, 16 bp, Homo sapiens
ttacataagaaatgta

SEQ ID NO: 5476542 - DNA, 20 bp, Homo sapiens
ttacataagataaatgtgct

SEQ ID NO: 5476543 - DNA, 17 bp, Homo sapiens
ttacataaggatacact

SEQ ID NO: 5476544 - DNA, 14 bp, Homo sapiens
ttacataatcagta

SEQ ID NO: 5476545 - DNA, 20 bp, Homo sapiens
ttacataattcactctgagt

SEQ ID NO: 5476546 - DNA, 16 bp, Homo sapiens
ttacataattgccaat

SEQ ID NO: 5476547 - DNA, 13 bp, Homo sapiens
ttacatacagatt

SEQ ID NO: 5476548 - DNA, 19 bp, Homo sapiens
ttacatacatatttttcta

SEQ ID NO: 5476549 - DNA, 15 bp, Homo sapiens
ttacatacatttaaa

SEQ ID NO: 5476550 - DNA, 19 bp, Homo sapiens
ttacatactaggtgccttt

SEQ ID NO: 5476551 - DNA, 16 bp, Homo sapiens
ttacatacttttgcaa

SEQ ID NO: 5476552 - DNA, 17 bp, Homo sapiens
ttacatagaacacttca

SEQ ID NO: 5476553 - DNA, 24 bp, Homo sapiens
ttacatagacttaggcattaacat

SEQ ID NO: 5476554 - DNA, 19 bp, Homo sapiens
ttacatagatcagccatta

SEQ ID NO: 5476555 - DNA, 20 bp, Homo sapiens
ttacatagatcagccattaa

SEQ ID NO: 5476556 - DNA, 22 bp, Homo sapiens
ttacatagatcagccattaaaa

SEQ ID NO: 5476557 - DNA, 13 bp, Homo sapiens
ttacatagcattt

SEQ ID NO: 5476558 - DNA, 18 bp, Homo sapiens
ttacatagctcaaatatt

SEQ ID NO: 5476559 - DNA, 16 bp, Homo sapiens
ttacataggtatatat

SEQ ID NO: 5476560 - DNA, 18 bp, Homo sapiens
ttacatagtctgaagtga

SEQ ID NO: 5476561 - DNA, 22 bp, Homo sapiens
ttacatagtgcaaaactgtgtc

SEQ ID NO: 5476562 - DNA, 20 bp, Homo sapiens
ttacatagtgtaggctttac

SEQ ID NO: 5476563 - DNA, 15 bp, Homo sapiens
ttacatagttgagat

SEQ ID NO: 5476564 - DNA, 18 bp, Homo sapiens
ttacatcaaggcttcaaa

SEQ ID NO: 5476565 - DNA, 17 bp, Homo sapiens
ttacatcactttgtgaa

SEQ ID NO: 5476566 - DNA, 18 bp, Homo sapiens
ttacatcagaagtttgca

SEQ ID NO: 5476567 - DNA, 16 bp, Homo sapiens
ttacatccagaaagaa

SEQ ID NO: 5476568 - DNA, 22 bp, Homo sapiens
ttacatccgtaggacaagtttt

SEQ ID NO: 5476569 - DNA, 23 bp, Homo sapiens
ttacatccgtaggacaagtttta

SEQ ID NO: 5476570 - DNA, 17 bp, Homo sapiens
ttacatcctctgatagc

SEQ ID NO: 5476571 - DNA, 14 bp, Homo sapiens
ttacatcctctgct

SEQ ID NO: 5476572 - DNA, 21 bp, Homo sapiens
ttacatcctctgcttgtcatt

SEQ ID NO: 5476573 - DNA, 23 bp, Homo sapiens
ttacatccttgattacttccact

SEQ ID NO: 5476574 - DNA, 16 bp, Homo sapiens
ttacatctaatgcttc

SEQ ID NO: 5476575 - DNA, 14 bp, Homo sapiens
ttacatctggaatc

SEQ ID NO: 5476576 - DNA, 19 bp, Homo sapiens
ttacatctgggatcatgat

SEQ ID NO: 5476577 - DNA, 14 bp, Homo sapiens
ttacatctgtgcag

SEQ ID NO: 5476578 - DNA, 13 bp, Homo sapiens
ttacatctgtgtt

SEQ ID NO: 5476579 - DNA, 18 bp, Homo sapiens
ttacatcttctgtgaaat

SEQ ID NO: 5476580 - DNA, 13 bp, Homo sapiens
ttacatcttgtag

SEQ ID NO: 5476581 - DNA, 23 bp, Homo sapiens
ttacatcttgttggtacctttct

SEQ ID NO: 5476582 - DNA, 13 bp, Homo sapiens
ttacatcttttct

SEQ ID NO: 5476583 - DNA, 18 bp, Homo sapiens
ttacatcttttctaatca

SEQ ID NO: 5476584 - DNA, 17 bp, Homo sapiens
ttacatgaattgcattt

SEQ ID NO: 5476585 - DNA, 14 bp, Homo sapiens
ttacatgactattg

SEQ ID NO: 5476586 - DNA, 14 bp, Homo sapiens
ttacatgactgttt

SEQ ID NO: 5476587 - DNA, 17 bp, Homo sapiens
ttacatgagaacagact

SEQ ID NO: 5476588 - DNA, 19 bp, Homo sapiens
ttacatgagttcaaatact

SEQ ID NO: 5476589 - DNA, 21 bp, Homo sapiens
ttacatgagttcaaatacttt

SEQ ID NO: 5476590 - DNA, 22 bp, Homo sapiens
ttacatgcaatttattaaaatg

SEQ ID NO: 5476591 - DNA, 23 bp, Homo sapiens
ttacatgcaatttattaaaatga

SEQ ID NO: 5476592 - DNA, 20 bp, Homo sapiens
ttacatgcataaaagggtca

SEQ ID NO: 5476593 - DNA, 14 bp, Homo sapiens
ttacatgcatactt

SEQ ID NO: 5476594 - DNA, 16 bp, Homo sapiens
ttacatgcatgagcac

SEQ ID NO: 5476595 - DNA, 23 bp, Homo sapiens
ttacatgctgctatacacaagca

SEQ ID NO: 5476596 - DNA, 16 bp, Homo sapiens
ttacatgctgtatatg

SEQ ID NO: 5476597 - DNA, 20 bp, Homo sapiens
ttacatgcttattccatgac

SEQ ID NO: 5476598 - DNA, 12 bp, Homo sapiens
ttacatggctct

SEQ ID NO: 5476599 - DNA, 16 bp, Homo sapiens
ttacatggctgtggtt

SEQ ID NO: 5476600 - DNA, 16 bp, Homo sapiens
ttacatgtaaagctgt

SEQ ID NO: 5476601 - DNA, 21 bp, Homo sapiens
ttacatgtaatatatttcaga

SEQ ID NO: 5476602 - DNA, 16 bp, Homo sapiens
ttacatgtaatttgat

SEQ ID NO: 5476603 - DNA, 13 bp, Homo sapiens
ttacatgtataaa

SEQ ID NO: 5476604 - DNA, 15 bp, Homo sapiens
ttacatgtatgcctg

SEQ ID NO: 5476605 - DNA, 12 bp, Homo sapiens
ttacatgtgatg

SEQ ID NO: 5476606 - DNA, 22 bp, Homo sapiens
ttacatgtgttagtgtatgtga

SEQ ID NO: 5476607 - DNA, 16 bp, Homo sapiens
ttacatgtttataaat

SEQ ID NO: 5476608 - DNA, 12 bp, Homo sapiens
ttacatgtttcc

SEQ ID NO: 5476609 - DNA, 14 bp, Homo sapiens
ttacatgtttgcac

SEQ ID NO: 5476610 - DNA, 16 bp, Homo sapiens
ttacatgttttaaaga

SEQ ID NO: 5476611 - DNA, 22 bp, Homo sapiens
ttacatgttttctttgctttaa

SEQ ID NO: 5476612 - DNA, 14 bp, Homo sapiens
ttacatgttttttc

SEQ ID NO: 5476613 - DNA, 20 bp, Homo sapiens
ttacatgttttttcatttgt

SEQ ID NO: 5476614 - DNA, 22 bp, Homo sapiens
ttacatgttttttcatttgtaa

SEQ ID NO: 5476615 - DNA, 11 bp, Homo sapiens
ttacattaaaa

SEQ ID NO: 5476616 - DNA, 15 bp, Homo sapiens
ttacattaaaaagcc

SEQ ID NO: 5476617 - DNA, 18 bp, Homo sapiens
ttacattaaaaagcctta

SEQ ID NO: 5476618 - DNA, 14 bp, Homo sapiens
ttacattaacattt

SEQ ID NO: 5476619 - DNA, 22 bp, Homo sapiens
ttacattaatgcccagccagcc

SEQ ID NO: 5476620 - DNA, 12 bp, Homo sapiens
ttacattaggaa

SEQ ID NO: 5476621 - DNA, 14 bp, Homo sapiens
ttacattaggaaga

SEQ ID NO: 5476622 - DNA, 15 bp, Homo sapiens
ttacattatgcaaat

SEQ ID NO: 5476623 - DNA, 16 bp, Homo sapiens
ttacattatgcaaata

SEQ ID NO: 5476624 - DNA, 15 bp, Homo sapiens
ttacattattaatca

SEQ ID NO: 5476625 - DNA, 19 bp, Homo sapiens
ttacattattatcaacaat

SEQ ID NO: 5476626 - DNA, 19 bp, Homo sapiens
ttacattattccaatgata

SEQ ID NO: 5476627 - DNA, 22 bp, Homo sapiens
ttacattcaacttttctaagaa

SEQ ID NO: 5476628 - DNA, 13 bp, Homo sapiens
ttacattctgtgt

SEQ ID NO: 5476629 - DNA, 21 bp, Homo sapiens
ttacattgcctgactaaaatg

SEQ ID NO: 5476630 - DNA, 19 bp, Homo sapiens
ttacattgtgtcctgctta

SEQ ID NO: 5476631 - DNA, 20 bp, Homo sapiens
ttacatttacaaactgaaga

SEQ ID NO: 5476632 - DNA, 13 bp, Homo sapiens
ttacatttatcta

SEQ ID NO: 5476633 - DNA, 10 bp, Homo sapiens
ttacatttca

SEQ ID NO: 5476634 - DNA, 18 bp, Homo sapiens
ttacatttcagacatatc

SEQ ID NO: 5476635 - DNA, 17 bp, Homo sapiens
ttacatttccaaatgaa

SEQ ID NO: 5476636 - DNA, 14 bp, Homo sapiens
ttacatttcctaaa

SEQ ID NO: 5476637 - DNA, 17 bp, Homo sapiens
ttacatttctatcagta

SEQ ID NO: 5476638 - DNA, 20 bp, Homo sapiens
ttacatttctatcagtactt

SEQ ID NO: 5476639 - DNA, 21 bp, Homo sapiens
ttacatttctatcagtacttt

SEQ ID NO: 5476640 - DNA, 12 bp, Homo sapiens
ttacatttgaat

SEQ ID NO: 5476641 - DNA, 21 bp, Homo sapiens
ttacatttggattagaaattt

SEQ ID NO: 5476642 - DNA, 18 bp, Homo sapiens
ttacatttgtaatttaag

SEQ ID NO: 5476643 - DNA, 19 bp, Homo sapiens
ttacatttgtaatttaagg

SEQ ID NO: 5476644 - DNA, 19 bp, Homo sapiens
tggcaacaaactgcacatg

SEQ ID NO: 5476645 - DNA, 22 bp, Homo sapiens
tggcaacagaaaccaagagaca

SEQ ID NO: 5476646 - DNA, 16 bp, Homo sapiens
tggcaacagatctgga

SEQ ID NO: 5476647 - DNA, 20 bp, Homo sapiens
tggcaacagatctggaacct

SEQ ID NO: 5476648 - DNA, 20 bp, Homo sapiens
tggcaacattggacagaaaa

SEQ ID NO: 5476649 - DNA, 16 bp, Homo sapiens
tggcaacatttgggga

SEQ ID NO: 5476650 - DNA, 18 bp, Homo sapiens
tggcaacatttggggaga

SEQ ID NO: 5476651 - DNA, 14 bp, Homo sapiens
aagatccaagaagg

SEQ ID NO: 5476652 - DNA, 18 bp, Homo sapiens
aagatccaagcaaaactt

SEQ ID NO: 5476653 - DNA, 19 bp, Homo sapiens
aagatccacatcctctaca

SEQ ID NO: 5476654 - DNA, 12 bp, Homo sapiens
aagatccagaaa

SEQ ID NO: 5476655 - DNA, 19 bp, Homo sapiens
aagatccagaaatacttaa

SEQ ID NO: 5476656 - DNA, 19 bp, Homo sapiens
aagatccatttgcctttct

SEQ ID NO: 5476657 - DNA, 20 bp, Homo sapiens
aagatcccagtgtgaagtat

SEQ ID NO: 5476658 - DNA, 16 bp, Homo sapiens
aagatcccctcaggac

SEQ ID NO: 5476659 - DNA, 18 bp, Homo sapiens
aagatcccctctcctgcc

SEQ ID NO: 5476660 - DNA, 22 bp, Homo sapiens
aagatcctaaaacaaaagctca

SEQ ID NO: 5476661 - DNA, 21 bp, Homo sapiens
aagatcctaaactctctagct

SEQ ID NO: 5476662 - DNA, 23 bp, Homo sapiens
aagatcctaccccaattccttgt

SEQ ID NO: 5476663 - DNA, 17 bp, Homo sapiens
aagatcctcttgccaca

SEQ ID NO: 5476664 - DNA, 23 bp, Homo sapiens
aagatcctcttgccacatcttga

SEQ ID NO: 5476665 - DNA, 15 bp, Homo sapiens
aagatcctgaagcag

SEQ ID NO: 5476666 - DNA, 14 bp, Homo sapiens
aagatcctgtgagg

SEQ ID NO: 5476667 - DNA, 22 bp, Homo sapiens
aagatccttcgggtgctggaag

SEQ ID NO: 5476668 - DNA, 16 bp, Homo sapiens
aagatcgaatttttca

SEQ ID NO: 5476669 - DNA, 16 bp, Homo sapiens
aagatcgcccccacct

SEQ ID NO: 5476670 - DNA, 20 bp, Homo sapiens
aagatcgcgccactgcactc

SEQ ID NO: 5476671 - DNA, 20 bp, Homo sapiens
aagatcggttaacaaataac

SEQ ID NO: 5476672 - DNA, 21 bp, Homo sapiens
aagatcggttaacaaataaca

SEQ ID NO: 5476673 - DNA, 14 bp, Homo sapiens
aagatcgttagtat

SEQ ID NO: 5476674 - DNA, 23 bp, Homo sapiens
aagatctacatacaaacaatgca

SEQ ID NO: 5476675 - DNA, 14 bp, Homo sapiens
aagatctacatgaa

SEQ ID NO: 5476676 - DNA, 14 bp, Homo sapiens
aagatctacctgca

SEQ ID NO: 5476677 - DNA, 21 bp, Homo sapiens
aagatctacctgcaacacaac

SEQ ID NO: 5476678 - DNA, 16 bp, Homo sapiens
aagatctcaaattgta

SEQ ID NO: 5476679 - DNA, 16 bp, Homo sapiens
aagatctcaacatgga

SEQ ID NO: 5476680 - DNA, 21 bp, Homo sapiens
aagatctcactctgccccccc

SEQ ID NO: 5476681 - DNA, 15 bp, Homo sapiens
aagatctcagcagcc

SEQ ID NO: 5476682 - DNA, 16 bp, Homo sapiens
aagatctcctgtgcac

SEQ ID NO: 5476683 - DNA, 12 bp, Homo sapiens
aagatctctgtc

SEQ ID NO: 5476684 - DNA, 21 bp, Homo sapiens
aagatctctgtcacatccaac

SEQ ID NO: 5476685 - DNA, 14 bp, Homo sapiens
aagatctctttcta

SEQ ID NO: 5476686 - DNA, 15 bp, Homo sapiens
aagatctgactgcca

SEQ ID NO: 5476687 - DNA, 16 bp, Homo sapiens
aagatctgactgccaa

SEQ ID NO: 5476688 - DNA, 12 bp, Homo sapiens
aagatctgctcc

SEQ ID NO: 5476689 - DNA, 18 bp, Homo sapiens
aagatctgtcctcagcct

SEQ ID NO: 5476690 - DNA, 17 bp, Homo sapiens
aagatctgtgcagcccc

SEQ ID NO: 5476691 - DNA, 16 bp, Homo sapiens
aagatctgtgttttag

SEQ ID NO: 5476692 - DNA, 21 bp, Homo sapiens
aagatctgttttgaaggcaaa

SEQ ID NO: 5476693 - DNA, 14 bp, Homo sapiens
aagatcttaaattt

SEQ ID NO: 5476694 - DNA, 14 bp, Homo sapiens
aagatcttagattc

SEQ ID NO: 5476695 - DNA, 15 bp, Homo sapiens
aagatcttatttatt

SEQ ID NO: 5476696 - DNA, 18 bp, Homo sapiens
aagatcttatttattaac

SEQ ID NO: 5476697 - DNA, 22 bp, Homo sapiens
aagatcttcaaaagtaatgcct

SEQ ID NO: 5476698 - DNA, 13 bp, Homo sapiens
aagatcttgcaga

SEQ ID NO: 5476699 - DNA, 15 bp, Homo sapiens
aagatcttggcttaa

SEQ ID NO: 5476700 - DNA, 15 bp, Homo sapiens
aagatcttgtctcca

SEQ ID NO: 5476701 - DNA, 22 bp, Homo sapiens
aagatctttatatttcaataaa

SEQ ID NO: 5476702 - DNA, 19 bp, Homo sapiens
aagatctttggcatgattt

SEQ ID NO: 5476703 - DNA, 18 bp, Homo sapiens
aagatctttttttaagtg

SEQ ID NO: 5476704 - DNA, 14 bp, Homo sapiens
aagatgaaaaagaa

SEQ ID NO: 5476705 - DNA, 19 bp, Homo sapiens
aagatgaaaggcaggccta

SEQ ID NO: 5476706 - DNA, 15 bp, Homo sapiens
aagatgaaattgcca

SEQ ID NO: 5476707 - DNA, 16 bp, Homo sapiens
aagatgaagaagaaaa

SEQ ID NO: 5476708 - DNA, 17 bp, Homo sapiens
aagatgaagagaagctg

SEQ ID NO: 5476709 - DNA, 23 bp, Homo sapiens
aagatgaagagaagctgagaaga

SEQ ID NO: 5476710 - DNA, 14 bp, Homo sapiens
aagatgaagtttta

SEQ ID NO: 5476711 - DNA, 19 bp, Homo sapiens
aagatgaatacattttgtt

SEQ ID NO: 5476712 - DNA, 14 bp, Homo sapiens
aagatgaatccaaa

SEQ ID NO: 5476713 - DNA, 23 bp, Homo sapiens
aagatgaatccaaatgtgaaaga

SEQ ID NO: 5476714 - DNA, 16 bp, Homo sapiens
aagatgaatttgtcca

SEQ ID NO: 5476715 - DNA, 15 bp, Homo sapiens
aagatgacactttta

SEQ ID NO: 5476716 - DNA, 14 bp, Homo sapiens
aagatgacctgccc

SEQ ID NO: 5476717 - DNA, 23 bp, Homo sapiens
aagatgactaccaactttcactt

SEQ ID NO: 5476718 - DNA, 14 bp, Homo sapiens
aagatgactgaggg

SEQ ID NO: 5476719 - DNA, 22 bp, Homo sapiens
aagatgacttaaggtgaagtga

SEQ ID NO: 5476720 - DNA, 14 bp, Homo sapiens
aagatgacttccca

SEQ ID NO: 5476721 - DNA, 22 bp, Homo sapiens
aagatgacttcccctgcctcct

SEQ ID NO: 5476722 - DNA, 17 bp, Homo sapiens
aagatgagaagccaaag

SEQ ID NO: 5476723 - DNA, 21 bp, Homo sapiens
aagatgagattggcatggctt

SEQ ID NO: 5476724 - DNA, 16 bp, Homo sapiens
aagatgagcctgggct

SEQ ID NO: 5476725 - DNA, 17 bp, Homo sapiens
aagatgagcctgggctc

SEQ ID NO: 5476726 - DNA, 19 bp, Homo sapiens
aagatgagccttgcagata

SEQ ID NO: 5476727 - DNA, 16 bp, Homo sapiens
aagatgagctctgaac

SEQ ID NO: 5476728 - DNA, 22 bp, Homo sapiens
aagatgatcgctgtattttgag

SEQ ID NO: 5476729 - DNA, 17 bp, Homo sapiens
aagatgatctactcaga

SEQ ID NO: 5476730 - DNA, 19 bp, Homo sapiens
aagatgatggaaacgcact

SEQ ID NO: 5476731 - DNA, 23 bp, Homo sapiens
aagatgattcaaagtagttttat

SEQ ID NO: 5476732 - DNA, 20 bp, Homo sapiens
aagatgatttaatgttgatt

SEQ ID NO: 5476733 - DNA, 15 bp, Homo sapiens
aagatgatttgcaat

SEQ ID NO: 5476734 - DNA, 16 bp, Homo sapiens
aagatgatttgcaatg

SEQ ID NO: 5476735 - DNA, 12 bp, Homo sapiens
aagatgattttg

SEQ ID NO: 5476736 - DNA, 22 bp, Homo sapiens
aagatgatttttaagtacaaaa

SEQ ID NO: 5476737 - DNA, 23 bp, Homo sapiens
aagatgattttttaaggagctgg

SEQ ID NO: 5476738 - DNA, 12 bp, Homo sapiens
aagatgcagccg

SEQ ID NO: 5476739 - DNA, 20 bp, Homo sapiens
aagatgcatgttactgccaa

SEQ ID NO: 5476740 - DNA, 19 bp, Homo sapiens
aagatgcattttaaatgtc

SEQ ID NO: 5476741 - DNA, 20 bp, Homo sapiens
aagatgcattttaaatgtct

SEQ ID NO: 5476742 - DNA, 22 bp, Homo sapiens
aagatgcattttaaatgtctat

SEQ ID NO: 5476743 - DNA, 15 bp, Homo sapiens
aagatgcattttgag

SEQ ID NO: 5476744 - DNA, 19 bp, Homo sapiens
aagatgccaacagacacta

SEQ ID NO: 5476745 - DNA, 11 bp, Homo sapiens
aagatgccaag

SEQ ID NO: 5476746 - DNA, 22 bp, Homo sapiens
aagatgccagcttctctctcca

SEQ ID NO: 5476747 - DNA, 23 bp, Homo sapiens
aagatgccatagcataatatgaa

SEQ ID NO: 5476748 - DNA, 16 bp, Homo sapiens
aagatgccatctgtgt

SEQ ID NO: 5476749 - DNA, 15 bp, Homo sapiens
aagatgccccaggga

SEQ ID NO: 5476750 - DNA, 14 bp, Homo sapiens
aagatgcccctgct

SEQ ID NO: 5476751 - DNA, 15 bp, Homo sapiens
aagatgcccctgctc

SEQ ID NO: 5476752 - DNA, 21 bp, Homo sapiens
aagatgccctccaatcctttc

SEQ ID NO: 5476753 - DNA, 22 bp, Homo sapiens
aagatgctacttcccactgtat

SEQ ID NO: 5476754 - DNA, 23 bp, Homo sapiens
aagatgctccagcaacacagcct

SEQ ID NO: 5476755 - DNA, 15 bp, Homo sapiens
aagatgctcttttaa

SEQ ID NO: 5476756 - DNA, 18 bp, Homo sapiens
aagatgctgcctgtattt

SEQ ID NO: 5476757 - DNA, 14 bp, Homo sapiens
aagatgctgctgag

SEQ ID NO: 5476758 - DNA, 10 bp, Homo sapiens
aagatgctgg

SEQ ID NO: 5476759 - DNA, 22 bp, Homo sapiens
aagatgctggatgtctgccaat

SEQ ID NO: 5476760 - DNA, 20 bp, Homo sapiens
aagatgctgggttggtgcac

SEQ ID NO: 5476761 - DNA, 15 bp, Homo sapiens
aagatgctgtaaata

SEQ ID NO: 5476762 - DNA, 18 bp, Homo sapiens
aagatgctgtcggcacca

SEQ ID NO: 5476763 - DNA, 12 bp, Homo sapiens
aagatgcttggt

SEQ ID NO: 5476764 - DNA, 22 bp, Homo sapiens
aagatgcttttaacagagtctg

SEQ ID NO: 5476765 - DNA, 19 bp, Homo sapiens
aagatgcttttcaaactga

SEQ ID NO: 5476766 - DNA, 20 bp, Homo sapiens
aagatggagaaacaacaaat

SEQ ID NO: 5476767 - DNA, 17 bp, Homo sapiens
aagatggagaataaatt

SEQ ID NO: 5476768 - DNA, 13 bp, Homo sapiens
aagatggagagga

SEQ ID NO: 5476769 - DNA, 19 bp, Homo sapiens
aagatggagaggaagaaac

SEQ ID NO: 5476770 - DNA, 23 bp, Homo sapiens
aagatggagaggaagaaacgcta

SEQ ID NO: 5476771 - DNA, 18 bp, Homo sapiens
aagatggagggggctggg

SEQ ID NO: 5476772 - DNA, 21 bp, Homo sapiens
aagatggagttgtattttgac

SEQ ID NO: 5476773 - DNA, 15 bp, Homo sapiens
aagatggagtttcta

SEQ ID NO: 5476774 - DNA, 20 bp, Homo sapiens
aagatggagtttctaaggtc

SEQ ID NO: 5476775 - DNA, 20 bp, Homo sapiens
aagatggatgtaaagtgtgg

SEQ ID NO: 5476776 - DNA, 15 bp, Homo sapiens
aagatggatgtaatt

SEQ ID NO: 5476777 - DNA, 15 bp, Homo sapiens
aagatggattaaaga

SEQ ID NO: 5476778 - DNA, 14 bp, Homo sapiens
aagatggattctca

SEQ ID NO: 5476779 - DNA, 19 bp, Homo sapiens
aagatggatttgacacact

SEQ ID NO: 5476780 - DNA, 20 bp, Homo sapiens
aagatggatttgacacactc

SEQ ID NO: 5476781 - DNA, 18 bp, Homo sapiens
aagatggcactgtccagg

SEQ ID NO: 5476782 - DNA, 22 bp, Homo sapiens
aagatggcactgtccagggccc

SEQ ID NO: 5476783 - DNA, 19 bp, Homo sapiens
aagatggcataacctgtct

SEQ ID NO: 5476784 - DNA, 18 bp, Homo sapiens
aagatggcatcctgtgaa

SEQ ID NO: 5476785 - DNA, 23 bp, Homo sapiens
aagatggccatgccctccatgtg

SEQ ID NO: 5476786 - DNA, 15 bp, Homo sapiens
aagatggcccatcct

SEQ ID NO: 5476787 - DNA, 19 bp, Homo sapiens
aagatggctcagaggggga

SEQ ID NO: 5476788 - DNA, 20 bp, Homo sapiens
aagatggctcccaaggttcc

SEQ ID NO: 5476789 - DNA, 20 bp, Homo sapiens
aagatggctgctgcctgctc

SEQ ID NO: 5476790 - DNA, 20 bp, Homo sapiens
aagatggctgtgcctctgcc

SEQ ID NO: 5476791 - DNA, 18 bp, Homo sapiens
aagatgggcagctagttc

SEQ ID NO: 5476792 - DNA, 20 bp, Homo sapiens
aagatggggaaactgagggc

SEQ ID NO: 5476793 - DNA, 18 bp, Homo sapiens
aagatgggggcagggctg

SEQ ID NO: 5476794 - DNA, 19 bp, Homo sapiens
aagatgggggcagggctgt

SEQ ID NO: 5476795 - DNA, 18 bp, Homo sapiens
aagatgggtgaaggctgg

SEQ ID NO: 5476796 - DNA, 22 bp, Homo sapiens
aagatgggtgattatgaaatgc

SEQ ID NO: 5476797 - DNA, 23 bp, Homo sapiens
aagatggtagcagataaagacag

SEQ ID NO: 5476798 - DNA, 18 bp, Homo sapiens
aagatggtatcatatatt

SEQ ID NO: 5476799 - DNA, 15 bp, Homo sapiens
aagatggtccatttg

SEQ ID NO: 5476800 - DNA, 20 bp, Homo sapiens
aagatggtccatttgttcct

SEQ ID NO: 5476801 - DNA, 21 bp, Homo sapiens
aagatggtgaagacagaaacc

SEQ ID NO: 5476802 - DNA, 12 bp, Homo sapiens
aagatggtggcc

SEQ ID NO: 5476803 - DNA, 15 bp, Homo sapiens
aagatggtggctgtg

SEQ ID NO: 5476804 - DNA, 20 bp, Homo sapiens
aagatggtgtgggtgtcctg

SEQ ID NO: 5476805 - DNA, 15 bp, Homo sapiens
aagatggttcaaaga

SEQ ID NO: 5476806 - DNA, 14 bp, Homo sapiens
aagatggttgtagc

SEQ ID NO: 5476807 - DNA, 13 bp, Homo sapiens
aagatggttttga

SEQ ID NO: 5476808 - DNA, 23 bp, Homo sapiens
aagatgtaactaggccatttgta

SEQ ID NO: 5476809 - DNA, 13 bp, Homo sapiens
aagatgtaaggaa

SEQ ID NO: 5476810 - DNA, 19 bp, Homo sapiens
aagatgtactgagaggagg

SEQ ID NO: 5476811 - DNA, 19 bp, Homo sapiens
aagatgtagaggagaaact

SEQ ID NO: 5476812 - DNA, 22 bp, Homo sapiens
aagatgtagaggagaaactgga

SEQ ID NO: 5476813 - DNA, 23 bp, Homo sapiens
aagatgtagcaaaccctgtcaaa

SEQ ID NO: 5476814 - DNA, 22 bp, Homo sapiens
aagatgtattaacctacctgtg

SEQ ID NO: 5476815 - DNA, 15 bp, Homo sapiens
aagatgtcaaatatc

SEQ ID NO: 5476816 - DNA, 21 bp, Homo sapiens
aagatgtcaaatatctcagag

SEQ ID NO: 5476817 - DNA, 22 bp, Homo sapiens
aagatgtcaagctggccgtgga

SEQ ID NO: 5476818 - DNA, 19 bp, Homo sapiens
aagatgtcccacagggacc

SEQ ID NO: 5476819 - DNA, 19 bp, Homo sapiens
aagatgtcccattgataat

SEQ ID NO: 5476820 - DNA, 20 bp, Homo sapiens
aagatgtcctccttgttcta

SEQ ID NO: 5476821 - DNA, 22 bp, Homo sapiens
ttactatttgccaatgtatatt

SEQ ID NO: 5476822 - DNA, 17 bp, Homo sapiens
ttactattttctacaat

SEQ ID NO: 5476823 - DNA, 18 bp, Homo sapiens
ttactcaaaatctgtcat

SEQ ID NO: 5476824 - DNA, 13 bp, Homo sapiens
ttactcaaccaaa

SEQ ID NO: 5476825 - DNA, 23 bp, Homo sapiens
ttactcaaccaaattaaaaattt

SEQ ID NO: 5476826 - DNA, 15 bp, Homo sapiens
ttactcaaccctctc

SEQ ID NO: 5476827 - DNA, 11 bp, Homo sapiens
ttttgaataaa

SEQ ID NO: 5476828 - DNA, 15 bp, Homo sapiens
ttttgaataaaaact

SEQ ID NO: 5476829 - DNA, 14 bp, Homo sapiens
ttttgaataaaaag

SEQ ID NO: 5476830 - DNA, 17 bp, Homo sapiens
ttttgaataaaaagtga

SEQ ID NO: 5476831 - DNA, 16 bp, Homo sapiens
ttttgaataatgtagt

SEQ ID NO: 5476832 - DNA, 13 bp, Homo sapiens
ttttgaatacatt

SEQ ID NO: 5476833 - DNA, 17 bp, Homo sapiens
ttttgaatacatttgta

SEQ ID NO: 5476834 - DNA, 18 bp, Homo sapiens
ttttgaatacatttgtat

SEQ ID NO: 5476835 - DNA, 19 bp, Homo sapiens
ttttgaatacatttgtatt

SEQ ID NO: 5476836 - DNA, 22 bp, Homo sapiens
ttttgaatatgccttaatttag

SEQ ID NO: 5476837 - DNA, 22 bp, Homo sapiens
ttttgaatgcctcataaattaa

SEQ ID NO: 5476838 - DNA, 18 bp, Homo sapiens
ttttgaatggtgttgtat

SEQ ID NO: 5476839 - DNA, 19 bp, Homo sapiens
ttttgaatgtcataaagaa

SEQ ID NO: 5476840 - DNA, 22 bp, Homo sapiens
ttttgaatgtggataaaactgt

SEQ ID NO: 5476841 - DNA, 14 bp, Homo sapiens
ttttgaatgttatt

SEQ ID NO: 5476842 - DNA, 14 bp, Homo sapiens
ttttgaattgttac

SEQ ID NO: 5476843 - DNA, 14 bp, Homo sapiens
ttttgaatttagtg

SEQ ID NO: 5476844 - DNA, 11 bp, Homo sapiens
ttttgaatttt

SEQ ID NO: 5476845 - DNA, 16 bp, Homo sapiens
ttttgacactatatct

SEQ ID NO: 5476846 - DNA, 13 bp, Homo sapiens
ttttgacactgaa

SEQ ID NO: 5476847 - DNA, 14 bp, Homo sapiens
ttttgacactgaaa

SEQ ID NO: 5476848 - DNA, 21 bp, Homo sapiens
ttttgacactgaaataaccgt

SEQ ID NO: 5476849 - DNA, 22 bp, Homo sapiens
ttttgacacttttaaaaaacaa

SEQ ID NO: 5476850 - DNA, 22 bp, Homo sapiens
ttttgacagaatatgtttcaaa

SEQ ID NO: 5476851 - DNA, 20 bp, Homo sapiens
ttttgacagactatttgcta

SEQ ID NO: 5476852 - DNA, 23 bp, Homo sapiens
ttttgacagactatttgctaatg

SEQ ID NO: 5476853 - DNA, 19 bp, Homo sapiens
ttttgacaggttttccaaa

SEQ ID NO: 5476854 - DNA, 24 bp, Homo sapiens
ttttgacagtgttgaaaatgttca

SEQ ID NO: 5476855 - DNA, 15 bp, Homo sapiens
ttttgacataaagtt

SEQ ID NO: 5476856 - DNA, 14 bp, Homo sapiens
ttttgacataagat

SEQ ID NO: 5476857 - DNA, 13 bp, Homo sapiens
ttttgacataatg

SEQ ID NO: 5476858 - DNA, 18 bp, Homo sapiens
ttttgacataatgagtaa

SEQ ID NO: 5476859 - DNA, 19 bp, Homo sapiens
ttttgaccatatagatttt

SEQ ID NO: 5476860 - DNA, 16 bp, Homo sapiens
ttttgaccctcattct

SEQ ID NO: 5476861 - DNA, 19 bp, Homo sapiens
ttttgactaaagctatgtt

SEQ ID NO: 5476862 - DNA, 13 bp, Homo sapiens
ttttgactggctt

SEQ ID NO: 5476863 - DNA, 18 bp, Homo sapiens
ttttgactgtagccacag

SEQ ID NO: 5476864 - DNA, 14 bp, Homo sapiens
ttttgacttaatgt

SEQ ID NO: 5476865 - DNA, 20 bp, Homo sapiens
ttttgactttcattggaaat

SEQ ID NO: 5476866 - DNA, 11 bp, Homo sapiens
ttttgagaaaa

SEQ ID NO: 5476867 - DNA, 12 bp, Homo sapiens
ttttgagaaaaa

SEQ ID NO: 5476868 - DNA, 23 bp, Homo sapiens
ttttgagatattaatgcccagac

SEQ ID NO: 5476869 - DNA, 23 bp, Homo sapiens
ttttgagatggagtctcactctt

SEQ ID NO: 5476870 - DNA, 16 bp, Homo sapiens
ttttgagcaactttct

SEQ ID NO: 5476871 - DNA, 19 bp, Homo sapiens
ttttgagccttattaaaat

SEQ ID NO: 5476872 - DNA, 20 bp, Homo sapiens
ttttgaggatgggatgtatt

SEQ ID NO: 5476873 - DNA, 15 bp, Homo sapiens
ttttgaggtagaaat

SEQ ID NO: 5476874 - DNA, 22 bp, Homo sapiens
ttttgaggttttgtaaaactgt

SEQ ID NO: 5476875 - DNA, 20 bp, Homo sapiens
ttttgagtaattttctgatg

SEQ ID NO: 5476876 - DNA, 21 bp, Homo sapiens
ttttgagtacggctatagcct

SEQ ID NO: 5476877 - DNA, 19 bp, Homo sapiens
ttttgagtagatattactt

SEQ ID NO: 5476878 - DNA, 22 bp, Homo sapiens
ttttgagtgaattagaccttta

SEQ ID NO: 5476879 - DNA, 18 bp, Homo sapiens
ttttgagtggatgatgtt

SEQ ID NO: 5476880 - DNA, 13 bp, Homo sapiens
ttttgagtgtact

SEQ ID NO: 5476881 - DNA, 22 bp, Homo sapiens
ttttgagtgtactgtgcctggt

SEQ ID NO: 5476882 - DNA, 21 bp, Homo sapiens
ttttgagtgtgcaatatgtaa

SEQ ID NO: 5476883 - DNA, 14 bp, Homo sapiens
ttttgagttctaca

SEQ ID NO: 5476884 - DNA, 20 bp, Homo sapiens
ttttgagtttcagctggaaa

SEQ ID NO: 5476885 - DNA, 21 bp, Homo sapiens
ttttgagtttgcctcagtaga

SEQ ID NO: 5476886 - DNA, 20 bp, Homo sapiens
ttttgataaaatgttccttt

SEQ ID NO: 5476887 - DNA, 16 bp, Homo sapiens
ttttgataaagtaatt

SEQ ID NO: 5476888 - DNA, 15 bp, Homo sapiens
ttttgataaattact

SEQ ID NO: 5476889 - DNA, 13 bp, Homo sapiens
ttttgatacaaac

SEQ ID NO: 5476890 - DNA, 12 bp, Homo sapiens
ttttgatacatt

SEQ ID NO: 5476891 - DNA, 22 bp, Homo sapiens
ttttgatacatttatcttctgt

SEQ ID NO: 5476892 - DNA, 17 bp, Homo sapiens
ttttgatacttgtaact

SEQ ID NO: 5476893 - DNA, 18 bp, Homo sapiens
ttttgatacttgtaactt

SEQ ID NO: 5476894 - DNA, 19 bp, Homo sapiens
ttttgatagcattgtaagc

SEQ ID NO: 5476895 - DNA, 15 bp, Homo sapiens
ttttgatataatctt

SEQ ID NO: 5476896 - DNA, 17 bp, Homo sapiens
ttttgatataatcttgg

SEQ ID NO: 5476897 - DNA, 22 bp, Homo sapiens
ttttgatataattgtactgtgt

SEQ ID NO: 5476898 - DNA, 17 bp, Homo sapiens
ttttgatatacattgtg

SEQ ID NO: 5476899 - DNA, 17 bp, Homo sapiens
ttttgatccaagctggt

SEQ ID NO: 5476900 - DNA, 22 bp, Homo sapiens
ttttgatcctgtaatcacaact

SEQ ID NO: 5476901 - DNA, 19 bp, Homo sapiens
ttttgatcttcaacaaatt

SEQ ID NO: 5476902 - DNA, 17 bp, Homo sapiens
ttttgatcttgtgctat

SEQ ID NO: 5476903 - DNA, 21 bp, Homo sapiens
ttttgatgactacctcagaac

SEQ ID NO: 5476904 - DNA, 20 bp, Homo sapiens
ttttgatgacttcagtgaaa

SEQ ID NO: 5476905 - DNA, 17 bp, Homo sapiens
ttttgatgcagataaaa

SEQ ID NO: 5476906 - DNA, 20 bp, Homo sapiens
ttttgatgcagcatttgata

SEQ ID NO: 5476907 - DNA, 22 bp, Homo sapiens
ttttgatgccatttgtcttttg

SEQ ID NO: 5476908 - DNA, 13 bp, Homo sapiens
ttttgatggctaa

SEQ ID NO: 5476909 - DNA, 16 bp, Homo sapiens
ttttgatgtaaagatg

SEQ ID NO: 5476910 - DNA, 18 bp, Homo sapiens
ttttgatgtataaaactt

SEQ ID NO: 5476911 - DNA, 20 bp, Homo sapiens
ttttgatgtttgtggcctca

SEQ ID NO: 5476912 - DNA, 22 bp, Homo sapiens
ttttgatgtttgtggcctcaga

SEQ ID NO: 5476913 - DNA, 16 bp, Homo sapiens
ttttgattaacaatgt

SEQ ID NO: 5476914 - DNA, 13 bp, Homo sapiens
ttttgattaatgt

SEQ ID NO: 5476915 - DNA, 18 bp, Homo sapiens
ttttgattattgtattta

SEQ ID NO: 5476916 - DNA, 22 bp, Homo sapiens
ttttgattattttttttttctt

SEQ ID NO: 5476917 - DNA, 23 bp, Homo sapiens
ttttgattccaatccaattatca

SEQ ID NO: 5476918 - DNA, 12 bp, Homo sapiens
ttttgattgaag

SEQ ID NO: 5476919 - DNA, 22 bp, Homo sapiens
ttttgatttaataacataacaa

SEQ ID NO: 5476920 - DNA, 15 bp, Homo sapiens
ttttgatttatgcat

SEQ ID NO: 5476921 - DNA, 21 bp, Homo sapiens
ttttgatttggtggatgtgat

SEQ ID NO: 5476922 - DNA, 13 bp, Homo sapiens
ttttgcaaatata

SEQ ID NO: 5476923 - DNA, 21 bp, Homo sapiens
ttttgcaacctcgctggactc

SEQ ID NO: 5476924 - DNA, 17 bp, Homo sapiens
ttttgcaaggttccaca

SEQ ID NO: 5476925 - DNA, 10 bp, Homo sapiens
ttttgcacag

SEQ ID NO: 5476926 - DNA, 13 bp, Homo sapiens
ttttgcacatata

SEQ ID NO: 5476927 - DNA, 20 bp, Homo sapiens
ttttgcacatgtttcctcta

SEQ ID NO: 5476928 - DNA, 19 bp, Homo sapiens
ttttgcacattccaaaatt

SEQ ID NO: 5476929 - DNA, 13 bp, Homo sapiens
ttttgcacatttt

SEQ ID NO: 5476930 - DNA, 15 bp, Homo sapiens
ttttgcacattttgt

SEQ ID NO: 5476931 - DNA, 19 bp, Homo sapiens
ttttgcacctgcagccaag

SEQ ID NO: 5476932 - DNA, 20 bp, Homo sapiens
ttttgcacctgcagccaagc

SEQ ID NO: 5476933 - DNA, 23 bp, Homo sapiens
ttttgcacgtcttgctatttgag

SEQ ID NO: 5476934 - DNA, 22 bp, Homo sapiens
ttttgcactgaagagagcattt

SEQ ID NO: 5476935 - DNA, 12 bp, Homo sapiens
ttttgcagatag

SEQ ID NO: 5476936 - DNA, 21 bp, Homo sapiens
ttttgcagcccagacaaatgt

SEQ ID NO: 5476937 - DNA, 17 bp, Homo sapiens
ttttgcagctatggaca

SEQ ID NO: 5476938 - DNA, 19 bp, Homo sapiens
ttttgcagcttccttccaa

SEQ ID NO: 5476939 - DNA, 15 bp, Homo sapiens
ttttgcaggggactg

SEQ ID NO: 5476940 - DNA, 16 bp, Homo sapiens
ttttgcaggggactgg

SEQ ID NO: 5476941 - DNA, 14 bp, Homo sapiens
ttttgcagtaactg

SEQ ID NO: 5476942 - DNA, 15 bp, Homo sapiens
ttttgcagtaactgt

SEQ ID NO: 5476943 - DNA, 17 bp, Homo sapiens
ttttgcagtcttttgct

SEQ ID NO: 5476944 - DNA, 16 bp, Homo sapiens
ttttgcataatgcaat

SEQ ID NO: 5476945 - DNA, 15 bp, Homo sapiens
ttttgcatactgaaa

SEQ ID NO: 5476946 - DNA, 13 bp, Homo sapiens
ttttgcatgaaat

SEQ ID NO: 5476947 - DNA, 16 bp, Homo sapiens
ttttgcatggcacttg

SEQ ID NO: 5476948 - DNA, 16 bp, Homo sapiens
ttttgcattattcata

SEQ ID NO: 5476949 - DNA, 14 bp, Homo sapiens
ttttgcattccaga

SEQ ID NO: 5476950 - DNA, 14 bp, Homo sapiens
ttttgcattgtctg

SEQ ID NO: 5476951 - DNA, 18 bp, Homo sapiens
ttttgcatttaaaacaga

SEQ ID NO: 5476952 - DNA, 11 bp, Homo sapiens
ttttgcatttc

SEQ ID NO: 5476953 - DNA, 15 bp, Homo sapiens
ttttgcatttcatgc

SEQ ID NO: 5476954 - DNA, 18 bp, Homo sapiens
ttttgccaatttgcacat

SEQ ID NO: 5476955 - DNA, 16 bp, Homo sapiens
ttttgccacctttcct

SEQ ID NO: 5476956 - DNA, 22 bp, Homo sapiens
ttttgccactaattttagtatt

SEQ ID NO: 5476957 - DNA, 13 bp, Homo sapiens
ttttgccagccca

SEQ ID NO: 5476958 - DNA, 19 bp, Homo sapiens
ttttgccagtattatgcat

SEQ ID NO: 5476959 - DNA, 15 bp, Homo sapiens
ttttgcccatataaa

SEQ ID NO: 5476960 - DNA, 17 bp, Homo sapiens
ttttgcccattttgaat

SEQ ID NO: 5476961 - DNA, 21 bp, Homo sapiens
ttttgcccgttgaccagataa

SEQ ID NO: 5476962 - DNA, 11 bp, Homo sapiens
ttttgccctcc

SEQ ID NO: 5476963 - DNA, 17 bp, Homo sapiens
ttttgccgctgagatat

SEQ ID NO: 5476964 - DNA, 15 bp, Homo sapiens
ttttgcctaaaatat

SEQ ID NO: 5476965 - DNA, 23 bp, Homo sapiens
ttttgcctaatacattaaagcag

SEQ ID NO: 5476966 - DNA, 15 bp, Homo sapiens
ttttgcctatcttta

SEQ ID NO: 5476967 - DNA, 15 bp, Homo sapiens
ttttgcctctgccca

SEQ ID NO: 5476968 - DNA, 14 bp, Homo sapiens
ttttgcctggctgt

SEQ ID NO: 5476969 - DNA, 13 bp, Homo sapiens
ttttgcctgtaag

SEQ ID NO: 5476970 - DNA, 13 bp, Homo sapiens
ttttgccttcatt

SEQ ID NO: 5476971 - DNA, 15 bp, Homo sapiens
ttttgcctttaaatt

SEQ ID NO: 5476972 - DNA, 21 bp, Homo sapiens
ttttgcgtttggtttacttgt

SEQ ID NO: 5476973 - DNA, 13 bp, Homo sapiens
ttttgctaaaaag

SEQ ID NO: 5476974 - DNA, 17 bp, Homo sapiens
ttttgctaaatgtgagt

SEQ ID NO: 5476975 - DNA, 15 bp, Homo sapiens
ttttgctaactgggt

SEQ ID NO: 5476976 - DNA, 18 bp, Homo sapiens
ttttgctacgattccact

SEQ ID NO: 5476977 - DNA, 21 bp, Homo sapiens
ttttgctaggtataaaaaata

SEQ ID NO: 5476978 - DNA, 18 bp, Homo sapiens
ttttgctcagttccatgg

SEQ ID NO: 5476979 - DNA, 11 bp, Homo sapiens
ttttgctccct

SEQ ID NO: 5476980 - DNA, 13 bp, Homo sapiens
ttttgctccctct

SEQ ID NO: 5476981 - DNA, 20 bp, Homo sapiens
ttttgctctactttataatc

SEQ ID NO: 5476982 - DNA, 18 bp, Homo sapiens
ttttgctctgtgaactat

SEQ ID NO: 5476983 - DNA, 15 bp, Homo sapiens
ttttgctcttctgta

SEQ ID NO: 5476984 - DNA, 20 bp, Homo sapiens
ttttgctcttctgtatgtga

SEQ ID NO: 5476985 - DNA, 14 bp, Homo sapiens
ttttgctgaattcc

SEQ ID NO: 5476986 - DNA, 15 bp, Homo sapiens
ttttgctgaattcct

SEQ ID NO: 5476987 - DNA, 19 bp, Homo sapiens
ttttgctgagactaatctt

SEQ ID NO: 5476988 - DNA, 15 bp, Homo sapiens
ttttgctgagttgtt

SEQ ID NO: 5476989 - DNA, 14 bp, Homo sapiens
ttttgctgcttctg

SEQ ID NO: 5476990 - DNA, 22 bp, Homo sapiens
ttttgctggagactatttaagt

SEQ ID NO: 5476991 - DNA, 13 bp, Homo sapiens
ttttgctgtagaa

SEQ ID NO: 5476992 - DNA, 15 bp, Homo sapiens
ttttgctgtctttct

SEQ ID NO: 5476993 - DNA, 18 bp, Homo sapiens
ttttgctgtgctgtacat

SEQ ID NO: 5476994 - DNA, 19 bp, Homo sapiens
ttttgctgtgtgaaatctt

SEQ ID NO: 5476995 - DNA, 23 bp, Homo sapiens
ttttgctgtgtgaaatctttcaa

SEQ ID NO: 5476996 - DNA, 23 bp, Homo sapiens
ttttgctgtttatgatctatttg

SEQ ID NO: 5476997 - DNA, 12 bp, Homo sapiens
ttttgctgtttt

SEQ ID NO: 5476998 - DNA, 18 bp, Homo sapiens
ttttgcttaaaattttac

SEQ ID NO: 5476999 - DNA, 14 bp, Homo sapiens
ttttgcttaacatt

SEQ ID NO: 5477000 - DNA, 23 bp, Homo sapiens
ttttgcttaccttttcctattct

SEQ ID NO: 5477001 - DNA, 16 bp, Homo sapiens
ttttgcttcatctgga

SEQ ID NO: 5477002 - DNA, 18 bp, Homo sapiens
ttttgcttccccgtgcat

SEQ ID NO: 5477003 - DNA, 14 bp, Homo sapiens
ttttgcttcctagt

SEQ ID NO: 5477004 - DNA, 17 bp, Homo sapiens
ttttgctttcctttcct

SEQ ID NO: 5477005 - DNA, 21 bp, Homo sapiens
ttttgctttcgaactgctagt

SEQ ID NO: 5477006 - DNA, 21 bp, Homo sapiens
tttttaaagccttctggatcc

SEQ ID NO: 5477007 - DNA, 12 bp, Homo sapiens
tttttaaagtaa

SEQ ID NO: 5477008 - DNA, 17 bp, Homo sapiens
tttttaaagtaaattat

SEQ ID NO: 5477009 - DNA, 13 bp, Homo sapiens
tttttaaagtgta

SEQ ID NO: 5477010 - DNA, 20 bp, Homo sapiens
tttttaaagtttaaatacca

SEQ ID NO: 5477011 - DNA, 13 bp, Homo sapiens
tttttaaataaac

SEQ ID NO: 5477012 - DNA, 16 bp, Homo sapiens
tttttaaataaacttt

SEQ ID NO: 5477013 - DNA, 22 bp, Homo sapiens
tttttaaatattatgctgcttt

SEQ ID NO: 5477014 - DNA, 15 bp, Homo sapiens
tttttaaatcatgtt

SEQ ID NO: 5477015 - DNA, 11 bp, Homo sapiens
tttttaaatgt

SEQ ID NO: 5477016 - DNA, 13 bp, Homo sapiens
tttttaaatgtaa

SEQ ID NO: 5477017 - DNA, 20 bp, Homo sapiens
tttttaaatgtaaagatatt

SEQ ID NO: 5477018 - DNA, 15 bp, Homo sapiens
tttttaaatgtatac

SEQ ID NO: 5477019 - DNA, 19 bp, Homo sapiens
tttttaaatgtcagttgaa

SEQ ID NO: 5477020 - DNA, 20 bp, Homo sapiens
tttttaaatgtcagttgaaa

SEQ ID NO: 5477021 - DNA, 15 bp, Homo sapiens
tttttaaatgtgaat

SEQ ID NO: 5477022 - DNA, 19 bp, Homo sapiens
tttttaaatgttcatgtca

SEQ ID NO: 5477023 - DNA, 18 bp, Homo sapiens
tttttaaattctgctcct

SEQ ID NO: 5477024 - DNA, 23 bp, Homo sapiens
tttttaaccaagtcgctcctagg

SEQ ID NO: 5477025 - DNA, 13 bp, Homo sapiens
tttttaacctgtt

SEQ ID NO: 5477026 - DNA, 14 bp, Homo sapiens
tttttaacctgttt

SEQ ID NO: 5477027 - DNA, 15 bp, Homo sapiens
tttttaacctgttta

SEQ ID NO: 5477028 - DNA, 21 bp, Homo sapiens
tttttaacgtggcttgtagaa

SEQ ID NO: 5477029 - DNA, 12 bp, Homo sapiens
tttttaactcat

SEQ ID NO: 5477030 - DNA, 23 bp, Homo sapiens
tttttaactgattcttatgatta

SEQ ID NO: 5477031 - DNA, 22 bp, Homo sapiens
tttttaacttgaaaagattgca

SEQ ID NO: 5477032 - DNA, 16 bp, Homo sapiens
tttttaactttgtggt

SEQ ID NO: 5477033 - DNA, 21 bp, Homo sapiens
tttttaagaaaaaaagcaaaa

SEQ ID NO: 5477034 - DNA, 15 bp, Homo sapiens
tttttaagaaaacat

SEQ ID NO: 5477035 - DNA, 21 bp, Homo sapiens
tttttaagaaagtaatttaat

SEQ ID NO: 5477036 - DNA, 18 bp, Homo sapiens
tttttaagaatatctgta

SEQ ID NO: 5477037 - DNA, 13 bp, Homo sapiens
tttttaagaattg

SEQ ID NO: 5477038 - DNA, 16 bp, Homo sapiens
tttttaagacagggtc

SEQ ID NO: 5477039 - DNA, 11 bp, Homo sapiens
tttttaagata

SEQ ID NO: 5477040 - DNA, 20 bp, Homo sapiens
tttttaagataataatatat

SEQ ID NO: 5477041 - DNA, 13 bp, Homo sapiens
tttttaagcaaat

SEQ ID NO: 5477042 - DNA, 18 bp, Homo sapiens
tttttaagcaacaaaact

SEQ ID NO: 5477043 - DNA, 19 bp, Homo sapiens
tttttaagcaactggaaaa

SEQ ID NO: 5477044 - DNA, 20 bp, Homo sapiens
tttttaagctccatgtgcat

SEQ ID NO: 5477045 - DNA, 23 bp, Homo sapiens
tttttaagctgtaaaaagagaga

SEQ ID NO: 5477046 - DNA, 13 bp, Homo sapiens
tttttaaggacac

SEQ ID NO: 5477047 - DNA, 18 bp, Homo sapiens
tttttaaggactcagctg

SEQ ID NO: 5477048 - DNA, 17 bp, Homo sapiens
tttttaaggttatttat

SEQ ID NO: 5477049 - DNA, 16 bp, Homo sapiens
tttttaagtagaaaaa

SEQ ID NO: 5477050 - DNA, 15 bp, Homo sapiens
tttttaagtgaaatt

SEQ ID NO: 5477051 - DNA, 20 bp, Homo sapiens
tttttaagtgcaacatttct

SEQ ID NO: 5477052 - DNA, 23 bp, Homo sapiens
tttttaagtgcaacatttctgta

SEQ ID NO: 5477053 - DNA, 22 bp, Homo sapiens
tttttaagtgggctcctgacaa

SEQ ID NO: 5477054 - DNA, 17 bp, Homo sapiens
tttttaagtgtcagact

SEQ ID NO: 5477055 - DNA, 15 bp, Homo sapiens
tttttaagtgttctg

SEQ ID NO: 5477056 - DNA, 18 bp, Homo sapiens
tttttaagttacacattt

SEQ ID NO: 5477057 - DNA, 19 bp, Homo sapiens
tttttaagttattgtacaa

SEQ ID NO: 5477058 - DNA, 13 bp, Homo sapiens
tttttaagttcaa

SEQ ID NO: 5477059 - DNA, 17 bp, Homo sapiens
tttttaagttcactttt

SEQ ID NO: 5477060 - DNA, 19 bp, Homo sapiens
tttttaagttgtcaaagaa

SEQ ID NO: 5477061 - DNA, 22 bp, Homo sapiens
tttttaagttgtcaaagaagct

SEQ ID NO: 5477062 - DNA, 19 bp, Homo sapiens
tttttaagttgtctgtctg

SEQ ID NO: 5477063 - DNA, 12 bp, Homo sapiens
tttttaataaaa

SEQ ID NO: 5477064 - DNA, 15 bp, Homo sapiens
tttttaataaactac

SEQ ID NO: 5477065 - DNA, 20 bp, Homo sapiens
tttttaataaagacagggtt

SEQ ID NO: 5477066 - DNA, 14 bp, Homo sapiens
tttttaataattta

SEQ ID NO: 5477067 - DNA, 12 bp, Homo sapiens
tttttaatagaa

SEQ ID NO: 5477068 - DNA, 14 bp, Homo sapiens
tttttaatatgctt

SEQ ID NO: 5477069 - DNA, 18 bp, Homo sapiens
tttttaatatgttgactt

SEQ ID NO: 5477070 - DNA, 17 bp, Homo sapiens
tttttaatatttattga

SEQ ID NO: 5477071 - DNA, 22 bp, Homo sapiens
tttttaatcgtttttgttttaa

SEQ ID NO: 5477072 - DNA, 16 bp, Homo sapiens
tttttaatctagacaa

SEQ ID NO: 5477073 - DNA, 22 bp, Homo sapiens
tttttaatctagacaatataca

SEQ ID NO: 5477074 - DNA, 18 bp, Homo sapiens
tttttaatctcttgtcat

SEQ ID NO: 5477075 - DNA, 19 bp, Homo sapiens
tttttaatctcttgtcatt

SEQ ID NO: 5477076 - DNA, 20 bp, Homo sapiens
tttttaatgagatgaaaata

SEQ ID NO: 5477077 - DNA, 21 bp, Homo sapiens
tttttaatgctaatcttgtga

SEQ ID NO: 5477078 - DNA, 13 bp, Homo sapiens
tttttaatgctat

SEQ ID NO: 5477079 - DNA, 20 bp, Homo sapiens
tttttaattaaaaactagta

SEQ ID NO: 5477080 - DNA, 14 bp, Homo sapiens
tttttaattaattg

SEQ ID NO: 5477081 - DNA, 15 bp, Homo sapiens
tttttaattatttaa

SEQ ID NO: 5477082 - DNA, 16 bp, Homo sapiens
tttttaattattttct

SEQ ID NO: 5477083 - DNA, 19 bp, Homo sapiens
tttttaattcaccaaagta

SEQ ID NO: 5477084 - DNA, 12 bp, Homo sapiens
tttttaattcat

SEQ ID NO: 5477085 - DNA, 13 bp, Homo sapiens
tttttaattgtat

SEQ ID NO: 5477086 - DNA, 16 bp, Homo sapiens
tttttaattgtttaaa

SEQ ID NO: 5477087 - DNA, 20 bp, Homo sapiens
tttttaatttaatttttcct

SEQ ID NO: 5477088 - DNA, 11 bp, Homo sapiens
tttttaatttg

SEQ ID NO: 5477089 - DNA, 17 bp, Homo sapiens
tttttaatttgatgaaa

SEQ ID NO: 5477090 - DNA, 20 bp, Homo sapiens
tttttaatttgatgaaagct

SEQ ID NO: 5477091 - DNA, 22 bp, Homo sapiens
tttttaatttgatgaaagctga

SEQ ID NO: 5477092 - DNA, 15 bp, Homo sapiens
ttcattttagattaa

SEQ ID NO: 5477093 - DNA, 17 bp, Homo sapiens
ttcattttagtgactgt

SEQ ID NO: 5477094 - DNA, 19 bp, Homo sapiens
ttcattttatattgaaaaa

SEQ ID NO: 5477095 - DNA, 15 bp, Homo sapiens
ttcattttcagagtg

SEQ ID NO: 5477096 - DNA, 22 bp, Homo sapiens
ttcattttctagatacaataaa

SEQ ID NO: 5477097 - DNA, 14 bp, Homo sapiens
ttcattttctcaaa

SEQ ID NO: 5477098 - DNA, 17 bp, Homo sapiens
ttcattttctctcctcg

SEQ ID NO: 5477099 - DNA, 22 bp, Homo sapiens
ttcattttctgacatgcattgt

SEQ ID NO: 5477100 - DNA, 13 bp, Homo sapiens
ttcattttgaaaa

SEQ ID NO: 5477101 - DNA, 17 bp, Homo sapiens
ttcattttgaaaaacac

SEQ ID NO: 5477102 - DNA, 16 bp, Homo sapiens
ttcattttgaaaagta

SEQ ID NO: 5477103 - DNA, 16 bp, Homo sapiens
ttcattttgagaacat

SEQ ID NO: 5477104 - DNA, 13 bp, Homo sapiens
ttcattttgagct

SEQ ID NO: 5477105 - DNA, 20 bp, Homo sapiens
ttcattttgagctgaaatgc

SEQ ID NO: 5477106 - DNA, 14 bp, Homo sapiens
ttcattttgcagaa

SEQ ID NO: 5477107 - DNA, 16 bp, Homo sapiens
ttcatttttaaatgtg

SEQ ID NO: 5477108 - DNA, 19 bp, Homo sapiens
ttcatttttaagactgtaa

SEQ ID NO: 5477109 - DNA, 14 bp, Homo sapiens
ttcatttttaatca

SEQ ID NO: 5477110 - DNA, 21 bp, Homo sapiens
ttcatttttattaaacagtga

SEQ ID NO: 5477111 - DNA, 17 bp, Homo sapiens
ttcatttttccatgaca

SEQ ID NO: 5477112 - DNA, 13 bp, Homo sapiens
ttcatttttccta

SEQ ID NO: 5477113 - DNA, 22 bp, Homo sapiens
ttcatttttgaaactgcatttg

SEQ ID NO: 5477114 - DNA, 11 bp, Homo sapiens
ttcatttttgg

SEQ ID NO: 5477115 - DNA, 23 bp, Homo sapiens
ttcatttttgtaataacatttaa

SEQ ID NO: 5477116 - DNA, 24 bp, Homo sapiens
ttcatttttgtgagcctctttgta

SEQ ID NO: 5477117 - DNA, 21 bp, Homo sapiens
ttcatttttgttatccttttt

SEQ ID NO: 5477118 - DNA, 17 bp, Homo sapiens
ttcatttttttccaggc

SEQ ID NO: 5477119 - DNA, 18 bp, Homo sapiens
ttcatttttttccaggct

SEQ ID NO: 5477120 - DNA, 18 bp, Homo sapiens
ttcatttttttctctctg

SEQ ID NO: 5477121 - DNA, 15 bp, Homo sapiens
ttccaaaaaaatact

SEQ ID NO: 5477122 - DNA, 22 bp, Homo sapiens
ttccaaaaacaaagtgcaaagc

SEQ ID NO: 5477123 - DNA, 16 bp, Homo sapiens
ttccaaaagtggcctc

SEQ ID NO: 5477124 - DNA, 22 bp, Homo sapiens
ttccaaaataaaaaccttccaa

SEQ ID NO: 5477125 - DNA, 15 bp, Homo sapiens
ttccaaaataaaatg

SEQ ID NO: 5477126 - DNA, 20 bp, Homo sapiens
ttccaaaataatctatatta

SEQ ID NO: 5477127 - DNA, 13 bp, Homo sapiens
ttccaaaataatt

SEQ ID NO: 5477128 - DNA, 13 bp, Homo sapiens
ttccaaaatacaa

SEQ ID NO: 5477129 - DNA, 18 bp, Homo sapiens
ttccaaaattccatccct

SEQ ID NO: 5477130 - DNA, 13 bp, Homo sapiens
ttccaaaattctt

SEQ ID NO: 5477131 - DNA, 16 bp, Homo sapiens
ttccaaaattcttatt

SEQ ID NO: 5477132 - DNA, 15 bp, Homo sapiens
ttccaaacaaaagca

SEQ ID NO: 5477133 - DNA, 21 bp, Homo sapiens
ttccaaacaacagaaagtcat

SEQ ID NO: 5477134 - DNA, 16 bp, Homo sapiens
ttccaaaccagtttat

SEQ ID NO: 5477135 - DNA, 18 bp, Homo sapiens
ttccaaacccaggctatt

SEQ ID NO: 5477136 - DNA, 14 bp, Homo sapiens
ttccaaaccctcct

SEQ ID NO: 5477137 - DNA, 17 bp, Homo sapiens
ttccaaaccctcctggg

SEQ ID NO: 5477138 - DNA, 20 bp, Homo sapiens
ttccaaagaatgttagagca

SEQ ID NO: 5477139 - DNA, 21 bp, Homo sapiens
ttccaaagaatgttagagcac

SEQ ID NO: 5477140 - DNA, 15 bp, Homo sapiens
ttccaaagaattctt

SEQ ID NO: 5477141 - DNA, 19 bp, Homo sapiens
ttccaaagagaaggcctgg

SEQ ID NO: 5477142 - DNA, 21 bp, Homo sapiens
ttccaaagagtagaattgcat

SEQ ID NO: 5477143 - DNA, 21 bp, Homo sapiens
ttccaaagagtgctaagcatt

SEQ ID NO: 5477144 - DNA, 18 bp, Homo sapiens
ttccaaagagtgtggaat

SEQ ID NO: 5477145 - DNA, 20 bp, Homo sapiens
ttccaaagcagagagcatta

SEQ ID NO: 5477146 - DNA, 16 bp, Homo sapiens
ttccaaagccagtgaa

SEQ ID NO: 5477147 - DNA, 23 bp, Homo sapiens
ttccaaagcctagacaacctttc

SEQ ID NO: 5477148 - DNA, 22 bp, Homo sapiens
ttccaaagctttattaccagtg

SEQ ID NO: 5477149 - DNA, 14 bp, Homo sapiens
ttccaaaggcagcg

SEQ ID NO: 5477150 - DNA, 16 bp, Homo sapiens
ttccaaagtgcatgtc

SEQ ID NO: 5477151 - DNA, 14 bp, Homo sapiens
ttccaaagttctta

SEQ ID NO: 5477152 - DNA, 11 bp, Homo sapiens
ttccaaataaa

SEQ ID NO: 5477153 - DNA, 17 bp, Homo sapiens
ttccaaataaaacttga

SEQ ID NO: 5477154 - DNA, 16 bp, Homo sapiens
ttccaaataaataatt

SEQ ID NO: 5477155 - DNA, 21 bp, Homo sapiens
ttccaaataaggatttgttca

SEQ ID NO: 5477156 - DNA, 19 bp, Homo sapiens
ttccaaataataaagtcta

SEQ ID NO: 5477157 - DNA, 23 bp, Homo sapiens
ttccaaataatatgtttccttcc

SEQ ID NO: 5477158 - DNA, 11 bp, Homo sapiens
ttccaaatatt

SEQ ID NO: 5477159 - DNA, 14 bp, Homo sapiens
ttccaaatattcta

SEQ ID NO: 5477160 - DNA, 22 bp, Homo sapiens
ttccaaatattctaaaaaagat

SEQ ID NO: 5477161 - DNA, 14 bp, Homo sapiens
ttccaaatcaggct

SEQ ID NO: 5477162 - DNA, 22 bp, Homo sapiens
ttccaaatcctggaaggacaca

SEQ ID NO: 5477163 - DNA, 12 bp, Homo sapiens
ttccaaatgaac

SEQ ID NO: 5477164 - DNA, 13 bp, Homo sapiens
ttccaaatgaact

SEQ ID NO: 5477165 - DNA, 17 bp, Homo sapiens
ttccaaatgaatgttgt

SEQ ID NO: 5477166 - DNA, 16 bp, Homo sapiens
ttccaaatgtgtataa

SEQ ID NO: 5477167 - DNA, 17 bp, Homo sapiens
ttccaaatgtgtataat

SEQ ID NO: 5477168 - DNA, 22 bp, Homo sapiens
ttccaaatgtttataaaggtaa

SEQ ID NO: 5477169 - DNA, 12 bp, Homo sapiens
ttccaaattatt

SEQ ID NO: 5477170 - DNA, 16 bp, Homo sapiens
ttccaaattattaatt

SEQ ID NO: 5477171 - DNA, 13 bp, Homo sapiens
ttccaaattattt

SEQ ID NO: 5477172 - DNA, 18 bp, Homo sapiens
ttccaaattatttcttaa

SEQ ID NO: 5477173 - DNA, 19 bp, Homo sapiens
ttccaaattatttcttaat

SEQ ID NO: 5477174 - DNA, 23 bp, Homo sapiens
ttccaaattatttcttaattatt

SEQ ID NO: 5477175 - DNA, 14 bp, Homo sapiens
ttccaaattcagtt

SEQ ID NO: 5477176 - DNA, 19 bp, Homo sapiens
ttccaaattcagtttcata

SEQ ID NO: 5477177 - DNA, 16 bp, Homo sapiens
ttccaaatttgcttta

SEQ ID NO: 5477178 - DNA, 21 bp, Homo sapiens
ttccaacaaagggttttaatg

SEQ ID NO: 5477179 - DNA, 20 bp, Homo sapiens
ttccaacaagaagggactga

SEQ ID NO: 5477180 - DNA, 17 bp, Homo sapiens
ttccaacaccacagaca

SEQ ID NO: 5477181 - DNA, 20 bp, Homo sapiens
ttccaacaccacagacacac

SEQ ID NO: 5477182 - DNA, 22 bp, Homo sapiens
ttccaacaccacagacacacac

SEQ ID NO: 5477183 - DNA, 14 bp, Homo sapiens
ttccaacacctgcc

SEQ ID NO: 5477184 - DNA, 17 bp, Homo sapiens
acgtaaagctagaaatg

SEQ ID NO: 5477185 - DNA, 16 bp, Homo sapiens
acgtaaagtacttgta

SEQ ID NO: 5477186 - DNA, 19 bp, Homo sapiens
acgtaaagtacttgtagtt

SEQ ID NO: 5477187 - DNA, 17 bp, Homo sapiens
acgtaataaggttttaa

SEQ ID NO: 5477188 - DNA, 15 bp, Homo sapiens
acgtaatcctcctga

SEQ ID NO: 5477189 - DNA, 21 bp, Homo sapiens
acgtaatgattatatgacaat

SEQ ID NO: 5477190 - DNA, 16 bp, Homo sapiens
acgtaatgtatttata

SEQ ID NO: 5477191 - DNA, 19 bp, Homo sapiens
acgtaatttgttatatcag

SEQ ID NO: 5477192 - DNA, 21 bp, Homo sapiens
acgtacaagtagttctgtatt

SEQ ID NO: 5477193 - DNA, 24 bp, Homo sapiens
acgtacaagtagttctgtatttga

SEQ ID NO: 5477194 - DNA, 18 bp, Homo sapiens
acgtacaccatatgcaag

SEQ ID NO: 5477195 - DNA, 14 bp, Homo sapiens
acgtacatacacac

SEQ ID NO: 5477196 - DNA, 13 bp, Homo sapiens
acgtacatgttta

SEQ ID NO: 5477197 - DNA, 21 bp, Homo sapiens
acgtacccaaggtcacatagc

SEQ ID NO: 5477198 - DNA, 17 bp, Homo sapiens
acgtactacttgtttca

SEQ ID NO: 5477199 - DNA, 20 bp, Homo sapiens
acgtactgcagcctccagag

SEQ ID NO: 5477200 - DNA, 18 bp, Homo sapiens
acgtactgtaactgctca

SEQ ID NO: 5477201 - DNA, 20 bp, Homo sapiens
acgtactgtaactgctcaga

SEQ ID NO: 5477202 - DNA, 21 bp, Homo sapiens
acgtagcaaatcgtacattgt

SEQ ID NO: 5477203 - DNA, 22 bp, Homo sapiens
acgtagcaaatcgtacattgtg

SEQ ID NO: 5477204 - DNA, 12 bp, Homo sapiens
acgtagcatgtg

SEQ ID NO: 5477205 - DNA, 12 bp, Homo sapiens
acgtagccacag

SEQ ID NO: 5477206 - DNA, 12 bp, Homo sapiens
acgtagctattt

SEQ ID NO: 5477207 - DNA, 17 bp, Homo sapiens
acgtagctgaggccgga

SEQ ID NO: 5477208 - DNA, 16 bp, Homo sapiens
acgtagggggcagggg

SEQ ID NO: 5477209 - DNA, 18 bp, Homo sapiens
acgtagggggcaggggca

SEQ ID NO: 5477210 - DNA, 20 bp, Homo sapiens
acgtagtcggcacagcctgg

SEQ ID NO: 5477211 - DNA, 22 bp, Homo sapiens
acgtataaaagcctgtttaaga

SEQ ID NO: 5477212 - DNA, 15 bp, Homo sapiens
acgtataaatatcag

SEQ ID NO: 5477213 - DNA, 16 bp, Homo sapiens
acgtataaatatcagt

SEQ ID NO: 5477214 - DNA, 19 bp, Homo sapiens
acgtataaatatgaaatga

SEQ ID NO: 5477215 - DNA, 16 bp, Homo sapiens
acgtataatgctttct

SEQ ID NO: 5477216 - DNA, 18 bp, Homo sapiens
acgtatattgtatcattt

SEQ ID NO: 5477217 - DNA, 14 bp, Homo sapiens
acgtatatttttaa

SEQ ID NO: 5477218 - DNA, 12 bp, Homo sapiens
acgtatcatttc

SEQ ID NO: 5477219 - DNA, 13 bp, Homo sapiens
acgtatcatttct

SEQ ID NO: 5477220 - DNA, 16 bp, Homo sapiens
acgtatgagaaaccta

SEQ ID NO: 5477221 - DNA, 15 bp, Homo sapiens
acgtatgcaagtctg

SEQ ID NO: 5477222 - DNA, 13 bp, Homo sapiens
acgtatgcatgtg

SEQ ID NO: 5477223 - DNA, 16 bp, Homo sapiens
acgtatggaatgcttc

SEQ ID NO: 5477224 - DNA, 18 bp, Homo sapiens
acgtatggaatgcttctt

SEQ ID NO: 5477225 - DNA, 22 bp, Homo sapiens
acgtatgtaacatgatgttaac

SEQ ID NO: 5477226 - DNA, 20 bp, Homo sapiens
acgtatgtatatacacacat

SEQ ID NO: 5477227 - DNA, 19 bp, Homo sapiens
acgtattagttgccaatat

SEQ ID NO: 5477228 - DNA, 17 bp, Homo sapiens
acgtattcattcagtga

SEQ ID NO: 5477229 - DNA, 13 bp, Homo sapiens
acgtatttaatag

SEQ ID NO: 5477230 - DNA, 15 bp, Homo sapiens
acgtatttataatag

SEQ ID NO: 5477231 - DNA, 17 bp, Homo sapiens
acgtatttatatttgga

SEQ ID NO: 5477232 - DNA, 22 bp, Homo sapiens
acgtatttatatttggaaagag

SEQ ID NO: 5477233 - DNA, 19 bp, Homo sapiens
acgtattttgatcagtgtt

SEQ ID NO: 5477234 - DNA, 15 bp, Homo sapiens
acgtatttttctgac

SEQ ID NO: 5477235 - DNA, 16 bp, Homo sapiens
acgtcaaacatgaagt

SEQ ID NO: 5477236 - DNA, 17 bp, Homo sapiens
acgtcaagtctccttcc

SEQ ID NO: 5477237 - DNA, 13 bp, Homo sapiens
acgtcaatgcata

SEQ ID NO: 5477238 - DNA, 16 bp, Homo sapiens
acgtcacccaaaagca

SEQ ID NO: 5477239 - DNA, 18 bp, Homo sapiens
acgtcaccctcctgagcc

SEQ ID NO: 5477240 - DNA, 16 bp, Homo sapiens
acgtcacgctccctga

SEQ ID NO: 5477241 - DNA, 17 bp, Homo sapiens
acgtcacgctccctgac

SEQ ID NO: 5477242 - DNA, 18 bp, Homo sapiens
acgtcactgccagagcta

SEQ ID NO: 5477243 - DNA, 21 bp, Homo sapiens
acgtcactggaccactgggca

SEQ ID NO: 5477244 - DNA, 17 bp, Homo sapiens
acgtcagacttggctca

SEQ ID NO: 5477245 - DNA, 18 bp, Homo sapiens
acgtcagacttggctcag

SEQ ID NO: 5477246 - DNA, 13 bp, Homo sapiens
acgtcagcctctt

SEQ ID NO: 5477247 - DNA, 22 bp, Homo sapiens
acgtcaggccctgactcctctg

SEQ ID NO: 5477248 - DNA, 19 bp, Homo sapiens
acgtcaggcctggcctcat

SEQ ID NO: 5477249 - DNA, 18 bp, Homo sapiens
acgtcatcggaggctggg

SEQ ID NO: 5477250 - DNA, 12 bp, Homo sapiens
acgtcatctcag

SEQ ID NO: 5477251 - DNA, 17 bp, Homo sapiens
acgtcatctcagggtcc

SEQ ID NO: 5477252 - DNA, 17 bp, Homo sapiens
acgtcatgagcgtcaaa

SEQ ID NO: 5477253 - DNA, 19 bp, Homo sapiens
acgtcatgagcgtcaaaga

SEQ ID NO: 5477254 - DNA, 17 bp, Homo sapiens
acgtcatgtattttatg

SEQ ID NO: 5477255 - DNA, 11 bp, Homo sapiens
acgtcattcag

SEQ ID NO: 5477256 - DNA, 18 bp, Homo sapiens
acgtccacgcggccacct

SEQ ID NO: 5477257 - DNA, 21 bp, Homo sapiens
acgtccacgcggccacctcac

SEQ ID NO: 5477258 - DNA, 21 bp, Homo sapiens
acgtccaggtccgtagctccc

SEQ ID NO: 5477259 - DNA, 24 bp, Homo sapiens
acgtccaggtccgtagctcccctg

SEQ ID NO: 5477260 - DNA, 13 bp, Homo sapiens
acgtccatctctc

SEQ ID NO: 5477261 - DNA, 18 bp, Homo sapiens
acgtcccagcatccctgg

SEQ ID NO: 5477262 - DNA, 19 bp, Homo sapiens
acgtcccagcatccctgga

SEQ ID NO: 5477263 - DNA, 20 bp, Homo sapiens
acgtcccagcatccctggag

SEQ ID NO: 5477264 - DNA, 22 bp, Homo sapiens
acgtcccagcatccctggagca

SEQ ID NO: 5477265 - DNA, 20 bp, Homo sapiens
acgtcccagcggcctcaggg

SEQ ID NO: 5477266 - DNA, 15 bp, Homo sapiens
acgtcccctcaagcc

SEQ ID NO: 5477267 - DNA, 16 bp, Homo sapiens
acgtcccgctgcctcc

SEQ ID NO: 5477268 - DNA, 18 bp, Homo sapiens
acgtcccgctgcctcctg

SEQ ID NO: 5477269 - DNA, 19 bp, Homo sapiens
acgtcccgctgcctcctgc

SEQ ID NO: 5477270 - DNA, 20 bp, Homo sapiens
acgtcccgctgcctcctgct

SEQ ID NO: 5477271 - DNA, 18 bp, Homo sapiens
acgtccctcgagctctgt

SEQ ID NO: 5477272 - DNA, 21 bp, Homo sapiens
acgtccctcgagctctgtagc

SEQ ID NO: 5477273 - DNA, 12 bp, Homo sapiens
acgtcccttgga

SEQ ID NO: 5477274 - DNA, 18 bp, Homo sapiens
acgtccgtgtgtcccaga

SEQ ID NO: 5477275 - DNA, 15 bp, Homo sapiens
acgtcctatctcccc

SEQ ID NO: 5477276 - DNA, 17 bp, Homo sapiens
acgtcctatctccccca

SEQ ID NO: 5477277 - DNA, 13 bp, Homo sapiens
acgtcctccaccg

SEQ ID NO: 5477278 - DNA, 18 bp, Homo sapiens
acgtcctccaccggtgcc

SEQ ID NO: 5477279 - DNA, 15 bp, Homo sapiens
acgtcctgccacctg

SEQ ID NO: 5477280 - DNA, 16 bp, Homo sapiens
acgtcctgcctggcac

SEQ ID NO: 5477281 - DNA, 21 bp, Homo sapiens
acgtcctgctggcacctcaga

SEQ ID NO: 5477282 - DNA, 12 bp, Homo sapiens
acgtccttccat

SEQ ID NO: 5477283 - DNA, 21 bp, Homo sapiens
acgtccttccatatccctgcc

SEQ ID NO: 5477284 - DNA, 22 bp, Homo sapiens
acgtccttccatatccctgccc

SEQ ID NO: 5477285 - DNA, 13 bp, Homo sapiens
acgtccttccttg

SEQ ID NO: 5477286 - DNA, 14 bp, Homo sapiens
acgtccttccttga

SEQ ID NO: 5477287 - DNA, 16 bp, Homo sapiens
acgtccttccttgact

SEQ ID NO: 5477288 - DNA, 22 bp, Homo sapiens
acgtcgcccgctgagctgagtg

SEQ ID NO: 5477289 - DNA, 16 bp, Homo sapiens
acgtcgcggccgcctt

SEQ ID NO: 5477290 - DNA, 16 bp, Homo sapiens
acgtcgggcttccctg

SEQ ID NO: 5477291 - DNA, 19 bp, Homo sapiens
acgtctaacttcatgctgt

SEQ ID NO: 5477292 - DNA, 14 bp, Homo sapiens
acgtctacgtatgc

SEQ ID NO: 5477293 - DNA, 15 bp, Homo sapiens
acgtctcaagactga

SEQ ID NO: 5477294 - DNA, 14 bp, Homo sapiens
acgtctcatctccc

SEQ ID NO: 5477295 - DNA, 23 bp, Homo sapiens
acgtctccccttctctgcctcac

SEQ ID NO: 5477296 - DNA, 12 bp, Homo sapiens
acgtctcctgct

SEQ ID NO: 5477297 - DNA, 16 bp, Homo sapiens
acgtctcgccaagcag

SEQ ID NO: 5477298 - DNA, 14 bp, Homo sapiens
acgtctctctgcct

SEQ ID NO: 5477299 - DNA, 17 bp, Homo sapiens
acgtctctctgcctgct

SEQ ID NO: 5477300 - DNA, 21 bp, Homo sapiens
acgtctctctgcctgctgggc

SEQ ID NO: 5477301 - DNA, 20 bp, Homo sapiens
acgtctgaagcttgactccc

SEQ ID NO: 5477302 - DNA, 13 bp, Homo sapiens
acgtctgacaggc

SEQ ID NO: 5477303 - DNA, 16 bp, Homo sapiens
acgtctgaccctctcc

SEQ ID NO: 5477304 - DNA, 22 bp, Homo sapiens
acgtctgaccctctccacccca

SEQ ID NO: 5477305 - DNA, 23 bp, Homo sapiens
acgtctgccaccagcgcccccac

SEQ ID NO: 5477306 - DNA, 14 bp, Homo sapiens
acgtctgccaggcc

SEQ ID NO: 5477307 - DNA, 18 bp, Homo sapiens
acgtctgccaggcccatc

SEQ ID NO: 5477308 - DNA, 17 bp, Homo sapiens
acgtctggactgctatt

SEQ ID NO: 5477309 - DNA, 17 bp, Homo sapiens
acgtctggccaggcact

SEQ ID NO: 5477310 - DNA, 16 bp, Homo sapiens
acgtctggctccctgc

SEQ ID NO: 5477311 - DNA, 17 bp, Homo sapiens
acgtctggctccctgcc

SEQ ID NO: 5477312 - DNA, 23 bp, Homo sapiens
acgtctgggagaaattgacagat

SEQ ID NO: 5477313 - DNA, 18 bp, Homo sapiens
acgtctggtgttctcaat

SEQ ID NO: 5477314 - DNA, 20 bp, Homo sapiens
acgtctgtcaggggcttgga

SEQ ID NO: 5477315 - DNA, 12 bp, Homo sapiens
acgtctgtgagt

SEQ ID NO: 5477316 - DNA, 18 bp, Homo sapiens
acgtctgtgagtctgtcc

SEQ ID NO: 5477317 - DNA, 12 bp, Homo sapiens
acgtctgtgcca

SEQ ID NO: 5477318 - DNA, 13 bp, Homo sapiens
acgtctgtgccat

SEQ ID NO: 5477319 - DNA, 13 bp, Homo sapiens
acgtcttaaatat

SEQ ID NO: 5477320 - DNA, 14 bp, Homo sapiens
acgtcttaaatatt

SEQ ID NO: 5477321 - DNA, 21 bp, Homo sapiens
acgtcttcttgctgcagcctg

SEQ ID NO: 5477322 - DNA, 16 bp, Homo sapiens
acgtcttggtgccttt

SEQ ID NO: 5477323 - DNA, 15 bp, Homo sapiens
acgtctttctttttt

SEQ ID NO: 5477324 - DNA, 21 bp, Homo sapiens
acgtgaaatgctcaagaatgt

SEQ ID NO: 5477325 - DNA, 13 bp, Homo sapiens
acgtgaaattcta

SEQ ID NO: 5477326 - DNA, 16 bp, Homo sapiens
acgtgaaatttgcctc

SEQ ID NO: 5477327 - DNA, 19 bp, Homo sapiens
acgtgaacgttttaataat

SEQ ID NO: 5477328 - DNA, 18 bp, Homo sapiens
acgtgaagaaataaatga

SEQ ID NO: 5477329 - DNA, 16 bp, Homo sapiens
acgtgaagccacagga

SEQ ID NO: 5477330 - DNA, 20 bp, Homo sapiens
acgtgacacaaacacacaca

SEQ ID NO: 5477331 - DNA, 23 bp, Homo sapiens
acgtgacaccaccgaatatatta

SEQ ID NO: 5477332 - DNA, 13 bp, Homo sapiens
acgtgacaggctc

SEQ ID NO: 5477333 - DNA, 19 bp, Homo sapiens
acgtgaccaattgccctgc

SEQ ID NO: 5477334 - DNA, 21 bp, Homo sapiens
acgtgaccaattgccctgcca

SEQ ID NO: 5477335 - DNA, 12 bp, Homo sapiens
acgtgaccctgt

SEQ ID NO: 5477336 - DNA, 16 bp, Homo sapiens
acgtgaccctgtgccc

SEQ ID NO: 5477337 - DNA, 16 bp, Homo sapiens
acgtgactcagagctt

SEQ ID NO: 5477338 - DNA, 21 bp, Homo sapiens
acgtgactgtggcacacgcct

SEQ ID NO: 5477339 - DNA, 14 bp, Homo sapiens
acgtgagagaaaga

SEQ ID NO: 5477340 - DNA, 15 bp, Homo sapiens
acgtgagagaaagag

SEQ ID NO: 5477341 - DNA, 21 bp, Homo sapiens
acgtgagagaaagagagaagc

SEQ ID NO: 5477342 - DNA, 22 bp, Homo sapiens
acgtgagagaaagagagaagcc

SEQ ID NO: 5477343 - DNA, 18 bp, Homo sapiens
acgtgagagaatctgcct

SEQ ID NO: 5477344 - DNA, 19 bp, Homo sapiens
acgtgaggcccctgtgcag

SEQ ID NO: 5477345 - DNA, 14 bp, Homo sapiens
acgtgataaatata

SEQ ID NO: 5477346 - DNA, 21 bp, Homo sapiens
acgtgatctctgttacaaaag

SEQ ID NO: 5477347 - DNA, 17 bp, Homo sapiens
acgtgatggaccaaagc

SEQ ID NO: 5477348 - DNA, 18 bp, Homo sapiens
acgtgatggaccaaagcc

SEQ ID NO: 5477349 - DNA, 16 bp, Homo sapiens
acgtgattaatatgca

SEQ ID NO: 5477350 - DNA, 22 bp, Homo sapiens
acgtgattagtgaaaggaagat

SEQ ID NO: 5477351 - DNA, 12 bp, Homo sapiens
acgtgcaaacaa

SEQ ID NO: 5477352 - DNA, 15 bp, Homo sapiens
acgtgcaaacaacct

SEQ ID NO: 5477353 - DNA, 17 bp, Homo sapiens
acgtgcaaggactcccg

SEQ ID NO: 5477354 - DNA, 20 bp, Homo sapiens
acgtgcaatttgtttgtgct

SEQ ID NO: 5477355 - DNA, 21 bp, Homo sapiens
acgtgcaatttgtttgtgctt

SEQ ID NO: 5477356 - DNA, 19 bp, Homo sapiens
acgtgcacaaaccttcttt

SEQ ID NO: 5477357 - DNA, 14 bp, Homo sapiens
acgtgcacacacct

SEQ ID NO: 5477358 - DNA, 12 bp, Homo sapiens
acgtgcacagct

SEQ ID NO: 5477359 - DNA, 14 bp, Homo sapiens
acgtgcactgacag

SEQ ID NO: 5477360 - DNA, 17 bp, Homo sapiens
acgtgcagcacctgtca

SEQ ID NO: 5477361 - DNA, 13 bp, Homo sapiens
acgtgcaggacag

SEQ ID NO: 5477362 - DNA, 20 bp, Homo sapiens
acgtgcatgctgtagctgca

SEQ ID NO: 5477363 - DNA, 14 bp, Homo sapiens
acgttttataagca

SEQ ID NO: 5477364 - DNA, 23 bp, Homo sapiens
acgttttatattatataaggaca

SEQ ID NO: 5477365 - DNA, 16 bp, Homo sapiens
acgttttccattatga

SEQ ID NO: 5477366 - DNA, 16 bp, Homo sapiens
acgttttctaattgct

SEQ ID NO: 5477367 - DNA, 18 bp, Homo sapiens
acgttttctaattgctta

SEQ ID NO: 5477368 - DNA, 14 bp, Homo sapiens
acgttttctgcaat

SEQ ID NO: 5477369 - DNA, 17 bp, Homo sapiens
acgttttctggcttctg

SEQ ID NO: 5477370 - DNA, 14 bp, Homo sapiens
acgttttcttaaat

SEQ ID NO: 5477371 - DNA, 16 bp, Homo sapiens
acgttttcttctttcc

SEQ ID NO: 5477372 - DNA, 19 bp, Homo sapiens
acgttttcttctttccctg

SEQ ID NO: 5477373 - DNA, 23 bp, Homo sapiens
acgttttgcctcatgaacactgg

SEQ ID NO: 5477374 - DNA, 16 bp, Homo sapiens
acgtttttaataggat

SEQ ID NO: 5477375 - DNA, 20 bp, Homo sapiens
acgtttttaatataaagcct

SEQ ID NO: 5477376 - DNA, 13 bp, Homo sapiens
acgtttttctggt

SEQ ID NO: 5477377 - DNA, 22 bp, Homo sapiens
acgtttttgtaaattaatcttt

SEQ ID NO: 5477378 - DNA, 16 bp, Homo sapiens
actaaaaaaaagatga

SEQ ID NO: 5477379 - DNA, 23 bp, Homo sapiens
actaaaaaaatttttgacacttt

SEQ ID NO: 5477380 - DNA, 16 bp, Homo sapiens
actaaaaacaaaccct

SEQ ID NO: 5477381 - DNA, 15 bp, Homo sapiens
actaaaaagtaccag

SEQ ID NO: 5477382 - DNA, 17 bp, Homo sapiens
actaaaaagtataaaat

SEQ ID NO: 5477383 - DNA, 21 bp, Homo sapiens
actaaaaagtataaaatagta

SEQ ID NO: 5477384 - DNA, 20 bp, Homo sapiens
actaaaaagtggctaattca

SEQ ID NO: 5477385 - DNA, 15 bp, Homo sapiens
actaaaaataaatta

SEQ ID NO: 5477386 - DNA, 16 bp, Homo sapiens
actaaaaatacaaaaa

SEQ ID NO: 5477387 - DNA, 15 bp, Homo sapiens
actaaaaatatgaaa

SEQ ID NO: 5477388 - DNA, 13 bp, Homo sapiens
actaaaaatatta

SEQ ID NO: 5477389 - DNA, 19 bp, Homo sapiens
actaaaaatattcctccaa

SEQ ID NO: 5477390 - DNA, 13 bp, Homo sapiens
actaaaaatgcat

SEQ ID NO: 5477391 - DNA, 16 bp, Homo sapiens
actaaaaatttttaca

SEQ ID NO: 5477392 - DNA, 16 bp, Homo sapiens
actaaaacaaagccac

SEQ ID NO: 5477393 - DNA, 22 bp, Homo sapiens
actaaaacacctcagctgcctc

SEQ ID NO: 5477394 - DNA, 15 bp, Homo sapiens
actaaaacattgtct

SEQ ID NO: 5477395 - DNA, 24 bp, Homo sapiens
actaaaacccctaggtcatttgta

SEQ ID NO: 5477396 - DNA, 16 bp, Homo sapiens
actaaaactcagagaa

SEQ ID NO: 5477397 - DNA, 14 bp, Homo sapiens
actaaaagaaacta

SEQ ID NO: 5477398 - DNA, 15 bp, Homo sapiens
actaaaagacatttg

SEQ ID NO: 5477399 - DNA, 19 bp, Homo sapiens
actaaaagatataagtgct

SEQ ID NO: 5477400 - DNA, 15 bp, Homo sapiens
actaaaagcaaatct

SEQ ID NO: 5477401 - DNA, 12 bp, Homo sapiens
actaaaagcatg

SEQ ID NO: 5477402 - DNA, 14 bp, Homo sapiens
actaaaagcatgaa

SEQ ID NO: 5477403 - DNA, 22 bp, Homo sapiens
actaaaagtggcatagagaata

SEQ ID NO: 5477404 - DNA, 17 bp, Homo sapiens
actaaaagtgtgtgaaa

SEQ ID NO: 5477405 - DNA, 16 bp, Homo sapiens
actaaaagtttagaac

SEQ ID NO: 5477406 - DNA, 18 bp, Homo sapiens
actaaaagtttagaactt

SEQ ID NO: 5477407 - DNA, 22 bp, Homo sapiens
actaaaataaattaagttactg

SEQ ID NO: 5477408 - DNA, 16 bp, Homo sapiens
actaaaataattttgt

SEQ ID NO: 5477409 - DNA, 23 bp, Homo sapiens
actaaaatagtttaaaaatattc

SEQ ID NO: 5477410 - DNA, 14 bp, Homo sapiens
actaaaatatatat

SEQ ID NO: 5477411 - DNA, 16 bp, Homo sapiens
actaaaatccacccag

SEQ ID NO: 5477412 - DNA, 14 bp, Homo sapiens
actaaaattaagta

SEQ ID NO: 5477413 - DNA, 23 bp, Homo sapiens
actaaaattaggactgtataagt

SEQ ID NO: 5477414 - DNA, 18 bp, Homo sapiens
actaaaattatgttactg

SEQ ID NO: 5477415 - DNA, 19 bp, Homo sapiens
actaaaattatgttactgt

SEQ ID NO: 5477416 - DNA, 13 bp, Homo sapiens
actaaaattcaac

SEQ ID NO: 5477417 - DNA, 22 bp, Homo sapiens
actaaaattctgggcctaattt

SEQ ID NO: 5477418 - DNA, 23 bp, Homo sapiens
actaaaattctgggcctaatttt

SEQ ID NO: 5477419 - DNA, 22 bp, Homo sapiens
actaaaattttaggcactctta

SEQ ID NO: 5477420 - DNA, 13 bp, Homo sapiens
actaaaattttct

SEQ ID NO: 5477421 - DNA, 18 bp, Homo sapiens
actaaacacgtgacacaa

SEQ ID NO: 5477422 - DNA, 11 bp, Homo sapiens
actaaacagaa

SEQ ID NO: 5477423 - DNA, 12 bp, Homo sapiens
actaaacagaaa

SEQ ID NO: 5477424 - DNA, 19 bp, Homo sapiens
actaaacatatgatttcac

SEQ ID NO: 5477425 - DNA, 12 bp, Homo sapiens
actaaacatttc

SEQ ID NO: 5477426 - DNA, 13 bp, Homo sapiens
actaaacatttcc

SEQ ID NO: 5477427 - DNA, 16 bp, Homo sapiens
actaaacatttccttt

SEQ ID NO: 5477428 - DNA, 17 bp, Homo sapiens
actaaaccgataatgca

SEQ ID NO: 5477429 - DNA, 12 bp, Homo sapiens
actaaactaaaa

SEQ ID NO: 5477430 - DNA, 16 bp, Homo sapiens
actaaactaaaataga

SEQ ID NO: 5477431 - DNA, 15 bp, Homo sapiens
actaaactaacaaga

SEQ ID NO: 5477432 - DNA, 12 bp, Homo sapiens
actaaactcatt

SEQ ID NO: 5477433 - DNA, 16 bp, Homo sapiens
actaaactcatttata

SEQ ID NO: 5477434 - DNA, 17 bp, Homo sapiens
actaaactccatgatat

SEQ ID NO: 5477435 - DNA, 23 bp, Homo sapiens
actaaactctctttgggaatgtt

SEQ ID NO: 5477436 - DNA, 22 bp, Homo sapiens
actaaactctgaataagcactt

SEQ ID NO: 5477437 - DNA, 13 bp, Homo sapiens
actaaacttaatt

SEQ ID NO: 5477438 - DNA, 23 bp, Homo sapiens
actaaacttggtgcttattgata

SEQ ID NO: 5477439 - DNA, 19 bp, Homo sapiens
actaaactttttttctgta

SEQ ID NO: 5477440 - DNA, 20 bp, Homo sapiens
actaaactttttttctgtac

SEQ ID NO: 5477441 - DNA, 12 bp, Homo sapiens
actaaagaagag

SEQ ID NO: 5477442 - DNA, 22 bp, Homo sapiens
actaaagaagaggagaaaaaga

SEQ ID NO: 5477443 - DNA, 19 bp, Homo sapiens
actaaagaatagtgcctca

SEQ ID NO: 5477444 - DNA, 13 bp, Homo sapiens
actaaagagacat

SEQ ID NO: 5477445 - DNA, 14 bp, Homo sapiens
actaaagagagaat

SEQ ID NO: 5477446 - DNA, 15 bp, Homo sapiens
actaaagagtgaatg

SEQ ID NO: 5477447 - DNA, 19 bp, Homo sapiens
actaaagatatcagagctc

SEQ ID NO: 5477448 - DNA, 22 bp, Homo sapiens
actaaagatatcagagctctta

SEQ ID NO: 5477449 - DNA, 16 bp, Homo sapiens
actaaagatccaagaa

SEQ ID NO: 5477450 - DNA, 14 bp, Homo sapiens
actaaagcaataga

SEQ ID NO: 5477451 - DNA, 20 bp, Homo sapiens
actaaagcacttcttttcca

SEQ ID NO: 5477452 - DNA, 20 bp, Homo sapiens
actaaagcaggccttttgat

SEQ ID NO: 5477453 - DNA, 14 bp, Homo sapiens
actaaagcagtgtt

SEQ ID NO: 5477454 - DNA, 19 bp, Homo sapiens
actaaagcagtgttttcac

SEQ ID NO: 5477455 - DNA, 22 bp, Homo sapiens
actaaagcatgaaatgtgaatt

SEQ ID NO: 5477456 - DNA, 16 bp, Homo sapiens
actaaagcttcagact

SEQ ID NO: 5477457 - DNA, 20 bp, Homo sapiens
actaaagcttcagactcaag

SEQ ID NO: 5477458 - DNA, 23 bp, Homo sapiens
actaaaggaaaaaactttgactt

SEQ ID NO: 5477459 - DNA, 19 bp, Homo sapiens
actaaagggtgtgggtcag

SEQ ID NO: 5477460 - DNA, 16 bp, Homo sapiens
actaaagtatagagaa

SEQ ID NO: 5477461 - DNA, 20 bp, Homo sapiens
actaaagtatagagaaaagt

SEQ ID NO: 5477462 - DNA, 22 bp, Homo sapiens
actaaagtatagagaaaagtgt

SEQ ID NO: 5477463 - DNA, 22 bp, Homo sapiens
actaaagtatttaaagaaactg

SEQ ID NO: 5477464 - DNA, 21 bp, Homo sapiens
actaaagtgcttgaggctacc

SEQ ID NO: 5477465 - DNA, 18 bp, Homo sapiens
actaaagtgtctattagt

SEQ ID NO: 5477466 - DNA, 22 bp, Homo sapiens
actaaagtgtgctttataaaaa

SEQ ID NO: 5477467 - DNA, 16 bp, Homo sapiens
actaaagttgaaaata

SEQ ID NO: 5477468 - DNA, 19 bp, Homo sapiens
actaaagttgaaaatacat

SEQ ID NO: 5477469 - DNA, 16 bp, Homo sapiens
actaaataaacacgat

SEQ ID NO: 5477470 - DNA, 18 bp, Homo sapiens
actaaataaactactttg

SEQ ID NO: 5477471 - DNA, 19 bp, Homo sapiens
actaaataagaaaataaca

SEQ ID NO: 5477472 - DNA, 23 bp, Homo sapiens
actaaataatgaataaactgaat

SEQ ID NO: 5477473 - DNA, 18 bp, Homo sapiens
actaaatacttgctccat

SEQ ID NO: 5477474 - DNA, 17 bp, Homo sapiens
actaaatagatttttag

SEQ ID NO: 5477475 - DNA, 18 bp, Homo sapiens
actaaatagatttttaga

SEQ ID NO: 5477476 - DNA, 18 bp, Homo sapiens
actaaatagcatgtattg

SEQ ID NO: 5477477 - DNA, 20 bp, Homo sapiens
actaaatataaattttcaga

SEQ ID NO: 5477478 - DNA, 17 bp, Homo sapiens
actaaatatatgtctgt

SEQ ID NO: 5477479 - DNA, 22 bp, Homo sapiens
actaaatatgaaccctttgttt

SEQ ID NO: 5477480 - DNA, 20 bp, Homo sapiens
actaaatatgcaatatatgt

SEQ ID NO: 5477481 - DNA, 15 bp, Homo sapiens
actaaatcagagaca

SEQ ID NO: 5477482 - DNA, 14 bp, Homo sapiens
actaaatctctaat

SEQ ID NO: 5477483 - DNA, 20 bp, Homo sapiens
actaaatctgtaagctcttt

SEQ ID NO: 5477484 - DNA, 15 bp, Homo sapiens
actaaatgagctcct

SEQ ID NO: 5477485 - DNA, 15 bp, Homo sapiens
actaaatgccctgct

SEQ ID NO: 5477486 - DNA, 21 bp, Homo sapiens
actaaatgctcatacacagtt

SEQ ID NO: 5477487 - DNA, 11 bp, Homo sapiens
actaaatgctg

SEQ ID NO: 5477488 - DNA, 14 bp, Homo sapiens
actaaatgtaaaat

SEQ ID NO: 5477489 - DNA, 12 bp, Homo sapiens
actaaatgttaa

SEQ ID NO: 5477490 - DNA, 14 bp, Homo sapiens
actaaatgttaaag

SEQ ID NO: 5477491 - DNA, 14 bp, Homo sapiens
actaaattactgtt

SEQ ID NO: 5477492 - DNA, 13 bp, Homo sapiens
actaaattagttt

SEQ ID NO: 5477493 - DNA, 18 bp, Homo sapiens
actaaattgtatacattt

SEQ ID NO: 5477494 - DNA, 14 bp, Homo sapiens
actaaatttctcag

SEQ ID NO: 5477495 - DNA, 15 bp, Homo sapiens
actaaatttgatact

SEQ ID NO: 5477496 - DNA, 16 bp, Homo sapiens
actaaattttctaatt

SEQ ID NO: 5477497 - DNA, 20 bp, Homo sapiens
actaaattttcttttaagca

SEQ ID NO: 5477498 - DNA, 17 bp, Homo sapiens
actaaatttttcataga

SEQ ID NO: 5477499 - DNA, 17 bp, Homo sapiens
actaacaaaatttgaat

SEQ ID NO: 5477500 - DNA, 20 bp, Homo sapiens
actaacaaagttttcatgtg

SEQ ID NO: 5477501 - DNA, 16 bp, Homo sapiens
actaacaaatgtaaaa

SEQ ID NO: 5477502 - DNA, 13 bp, Homo sapiens
actaacaagaatg

SEQ ID NO: 5477503 - DNA, 14 bp, Homo sapiens
actaacaagattaa

SEQ ID NO: 5477504 - DNA, 23 bp, Homo sapiens
actaacaagatttgtaattacag

SEQ ID NO: 5477505 - DNA, 15 bp, Homo sapiens
actaacactcagaag

SEQ ID NO: 5477506 - DNA, 18 bp, Homo sapiens
actaacactcagaagcct

SEQ ID NO: 5477507 - DNA, 20 bp, Homo sapiens
actaacactcagaagcctgg

SEQ ID NO: 5477508 - DNA, 21 bp, Homo sapiens
actaacactcagaagcctggg

SEQ ID NO: 5477509 - DNA, 12 bp, Homo sapiens
actaacactggc

SEQ ID NO: 5477510 - DNA, 10 bp, Homo sapiens
actaacagat

SEQ ID NO: 5477511 - DNA, 13 bp, Homo sapiens
actaacagataag

SEQ ID NO: 5477512 - DNA, 16 bp, Homo sapiens
actaacagataagcaa

SEQ ID NO: 5477513 - DNA, 17 bp, Homo sapiens
actaacagataagcaag

SEQ ID NO: 5477514 - DNA, 11 bp, Homo sapiens
actaacagatt

SEQ ID NO: 5477515 - DNA, 20 bp, Homo sapiens
actaacagattataataaat

SEQ ID NO: 5477516 - DNA, 21 bp, Homo sapiens
actaacagctacaaactttta

SEQ ID NO: 5477517 - DNA, 17 bp, Homo sapiens
actaacataaaatctgt

SEQ ID NO: 5477518 - DNA, 18 bp, Homo sapiens
actaacataaaatctgtg

SEQ ID NO: 5477519 - DNA, 17 bp, Homo sapiens
actaacatataatgttg

SEQ ID NO: 5477520 - DNA, 23 bp, Homo sapiens
actaacatttcccccgagctctt

SEQ ID NO: 5477521 - DNA, 21 bp, Homo sapiens
actaaccacattttaggatct

SEQ ID NO: 5477522 - DNA, 17 bp, Homo sapiens
actaaccagcagaaatg

SEQ ID NO: 5477523 - DNA, 20 bp, Homo sapiens
actaaccatccccaactcca

SEQ ID NO: 5477524 - DNA, 18 bp, Homo sapiens
actaaccccagctgccgg

SEQ ID NO: 5477525 - DNA, 17 bp, Homo sapiens
actaacctatctatgaa

SEQ ID NO: 5477526 - DNA, 15 bp, Homo sapiens
actaacctggagaca

SEQ ID NO: 5477527 - DNA, 18 bp, Homo sapiens
actaacctggagacagta

SEQ ID NO: 5477528 - DNA, 15 bp, Homo sapiens
actaaccttgcctgg

SEQ ID NO: 5477529 - DNA, 17 bp, Homo sapiens
actaaccttgcctggta

SEQ ID NO: 5477530 - DNA, 18 bp, Homo sapiens
actaacgaacgttttaaa

SEQ ID NO: 5477531 - DNA, 20 bp, Homo sapiens
actaacgaccgacgcccctc

SEQ ID NO: 5477532 - DNA, 14 bp, Homo sapiens
actaactaaactct

SEQ ID NO: 5477533 - DNA, 22 bp, Homo sapiens
actaactagacaccaaagttct

SEQ ID NO: 5477534 - DNA, 13 bp, Homo sapiens
actaactagagca

SEQ ID NO: 5477535 - DNA, 23 bp, Homo sapiens
actaactagagcagccctggagt

SEQ ID NO: 5477536 - DNA, 19 bp, Homo sapiens
actaactcaagataatcct

SEQ ID NO: 5477537 - DNA, 20 bp, Homo sapiens
actaactcctaggaaaatac

SEQ ID NO: 5477538 - DNA, 13 bp, Homo sapiens
actaactgaggag

SEQ ID NO: 5477539 - DNA, 13 bp, Homo sapiens
actaactgccatg

SEQ ID NO: 5477540 - DNA, 12 bp, Homo sapiens
actaactgctgg

SEQ ID NO: 5477541 - DNA, 23 bp, Homo sapiens
atcagcgccggcctccagaactt

SEQ ID NO: 5477542 - DNA, 17 bp, Homo sapiens
atcagcgtggcagtcac

SEQ ID NO: 5477543 - DNA, 15 bp, Homo sapiens
atcagcgtggccttg

SEQ ID NO: 5477544 - DNA, 15 bp, Homo sapiens
atcagctaccattca

SEQ ID NO: 5477545 - DNA, 16 bp, Homo sapiens
atcagctacccctgca

SEQ ID NO: 5477546 - DNA, 18 bp, Homo sapiens
atcagctacttaagagaa

SEQ ID NO: 5477547 - DNA, 16 bp, Homo sapiens
atcagctagcaaaaga

SEQ ID NO: 5477548 - DNA, 18 bp, Homo sapiens
atcagctccactttcagt

SEQ ID NO: 5477549 - DNA, 16 bp, Homo sapiens
atcagctcccaacgag

SEQ ID NO: 5477550 - DNA, 13 bp, Homo sapiens
atcagctccttcc

SEQ ID NO: 5477551 - DNA, 15 bp, Homo sapiens
atcagctccttcctg

SEQ ID NO: 5477552 - DNA, 17 bp, Homo sapiens
atcagctccttcctgga

SEQ ID NO: 5477553 - DNA, 12 bp, Homo sapiens
atcagctccttt

SEQ ID NO: 5477554 - DNA, 21 bp, Homo sapiens
atcagctccttttccgttctg

SEQ ID NO: 5477555 - DNA, 16 bp, Homo sapiens
atcagctctctgctgg

SEQ ID NO: 5477556 - DNA, 17 bp, Homo sapiens
atcagctctctgctggg

SEQ ID NO: 5477557 - DNA, 15 bp, Homo sapiens
atcagctctgcataa

SEQ ID NO: 5477558 - DNA, 12 bp, Homo sapiens
atcagctctgcc

SEQ ID NO: 5477559 - DNA, 12 bp, Homo sapiens
atcagctgaatt

SEQ ID NO: 5477560 - DNA, 15 bp, Homo sapiens
atcagctgaattcac

SEQ ID NO: 5477561 - DNA, 18 bp, Homo sapiens
atcagctgagccttctga

SEQ ID NO: 5477562 - DNA, 19 bp, Homo sapiens
atcagctgcaatccattta

SEQ ID NO: 5477563 - DNA, 13 bp, Homo sapiens
atcagctgctact

SEQ ID NO: 5477564 - DNA, 16 bp, Homo sapiens
atcagctgctttgtta

SEQ ID NO: 5477565 - DNA, 12 bp, Homo sapiens
atcagctgggca

SEQ ID NO: 5477566 - DNA, 15 bp, Homo sapiens
atcagctgtctgtca

SEQ ID NO: 5477567 - DNA, 19 bp, Homo sapiens
atcagctgtctgtcatctg

SEQ ID NO: 5477568 - DNA, 18 bp, Homo sapiens
atcagctgttgcaggcag

SEQ ID NO: 5477569 - DNA, 19 bp, Homo sapiens
atcagctgttgcaggcagt

SEQ ID NO: 5477570 - DNA, 20 bp, Homo sapiens
atcagctgttgcaggcagtg

SEQ ID NO: 5477571 - DNA, 22 bp, Homo sapiens
atcagctgttgcaggcagtgtc

SEQ ID NO: 5477572 - DNA, 16 bp, Homo sapiens
atcagctgtttgtcat

SEQ ID NO: 5477573 - DNA, 15 bp, Homo sapiens
atcagcttaatttaa

SEQ ID NO: 5477574 - DNA, 21 bp, Homo sapiens
atcagcttctatccttgactt

SEQ ID NO: 5477575 - DNA, 16 bp, Homo sapiens
atcagcttcttgcact

SEQ ID NO: 5477576 - DNA, 19 bp, Homo sapiens
atcagctttataataaact

SEQ ID NO: 5477577 - DNA, 18 bp, Homo sapiens
atcagctttccctggctc

SEQ ID NO: 5477578 - DNA, 11 bp, Homo sapiens
atcagctttga

SEQ ID NO: 5477579 - DNA, 23 bp, Homo sapiens
atcagcttttaataaaattgaca

SEQ ID NO: 5477580 - DNA, 18 bp, Homo sapiens
atcagcttttctgatggt

SEQ ID NO: 5477581 - DNA, 19 bp, Homo sapiens
atcagcttttcttattcct

SEQ ID NO: 5477582 - DNA, 18 bp, Homo sapiens
atcagcttttgttctaga

SEQ ID NO: 5477583 - DNA, 15 bp, Homo sapiens
atcagctttttgtat

SEQ ID NO: 5477584 - DNA, 17 bp, Homo sapiens
atcaggaaccagggcct

SEQ ID NO: 5477585 - DNA, 19 bp, Homo sapiens
atcaggaaccagggcctcc

SEQ ID NO: 5477586 - DNA, 19 bp, Homo sapiens
atcaggaagagaaggagca

SEQ ID NO: 5477587 - DNA, 20 bp, Homo sapiens
atcaggaattctaaataaat

SEQ ID NO: 5477588 - DNA, 22 bp, Homo sapiens
atcaggaattctaaataaattt

SEQ ID NO: 5477589 - DNA, 16 bp, Homo sapiens
atcaggaattgtcaaa

SEQ ID NO: 5477590 - DNA, 23 bp, Homo sapiens
atcaggaccaaaaaacctcactg

SEQ ID NO: 5477591 - DNA, 16 bp, Homo sapiens
atcaggacccagagga

SEQ ID NO: 5477592 - DNA, 20 bp, Homo sapiens
atcaggacccagaggaaggg

SEQ ID NO: 5477593 - DNA, 15 bp, Homo sapiens
atcaggactgtgacc

SEQ ID NO: 5477594 - DNA, 18 bp, Homo sapiens
atcaggactgtgaccaaa

SEQ ID NO: 5477595 - DNA, 15 bp, Homo sapiens
atcaggacttgggaa

SEQ ID NO: 5477596 - DNA, 23 bp, Homo sapiens
atcaggagaaagcttggttctgt

SEQ ID NO: 5477597 - DNA, 15 bp, Homo sapiens
atcaggagaaggtgg

SEQ ID NO: 5477598 - DNA, 20 bp, Homo sapiens
atcaggagagggatacaaga

SEQ ID NO: 5477599 - DNA, 14 bp, Homo sapiens
atcaggagcctgct

SEQ ID NO: 5477600 - DNA, 20 bp, Homo sapiens
atcaggagcctgctaaggaa

SEQ ID NO: 5477601 - DNA, 22 bp, Homo sapiens
atcaggagcctgctaaggaaca

SEQ ID NO: 5477602 - DNA, 10 bp, Homo sapiens
atcaggaggg

SEQ ID NO: 5477603 - DNA, 15 bp, Homo sapiens
atcaggagttccagt

SEQ ID NO: 5477604 - DNA, 21 bp, Homo sapiens
atcaggatactcaaagtggaa

SEQ ID NO: 5477605 - DNA, 13 bp, Homo sapiens
atcaggatcagct

SEQ ID NO: 5477606 - DNA, 12 bp, Homo sapiens
atcaggatgaac

SEQ ID NO: 5477607 - DNA, 18 bp, Homo sapiens
atcaggatgaacccagga

SEQ ID NO: 5477608 - DNA, 17 bp, Homo sapiens
atcaggcaaggaggagg

SEQ ID NO: 5477609 - DNA, 15 bp, Homo sapiens
atcaggcacaggcag

SEQ ID NO: 5477610 - DNA, 17 bp, Homo sapiens
atcaggcacaggcagga

SEQ ID NO: 5477611 - DNA, 23 bp, Homo sapiens
atcaggcacaggcaggaagagag

SEQ ID NO: 5477612 - DNA, 17 bp, Homo sapiens
atcaggcacaggtcagg

SEQ ID NO: 5477613 - DNA, 22 bp, Homo sapiens
atcaggcacccggggccagaga

SEQ ID NO: 5477614 - DNA, 16 bp, Homo sapiens
atcaggcactggtggc

SEQ ID NO: 5477615 - DNA, 22 bp, Homo sapiens
atcaggcagaagaatctttctt

SEQ ID NO: 5477616 - DNA, 13 bp, Homo sapiens
atcaggccaggcc

SEQ ID NO: 5477617 - DNA, 18 bp, Homo sapiens
atcaggccaggccctctg

SEQ ID NO: 5477618 - DNA, 10 bp, Homo sapiens
atcaggcccc

SEQ ID NO: 5477619 - DNA, 11 bp, Homo sapiens
atcaggcccca

SEQ ID NO: 5477620 - DNA, 15 bp, Homo sapiens
atcaggccccacccc

SEQ ID NO: 5477621 - DNA, 17 bp, Homo sapiens
atcaggccccacccctg

SEQ ID NO: 5477622 - DNA, 19 bp, Homo sapiens
atcaggcctaatctcatac

SEQ ID NO: 5477623 - DNA, 14 bp, Homo sapiens
atcaggcctagagg

SEQ ID NO: 5477624 - DNA, 18 bp, Homo sapiens
atcaggctaagaccctgt

SEQ ID NO: 5477625 - DNA, 15 bp, Homo sapiens
atcaggctcctcagc

SEQ ID NO: 5477626 - DNA, 16 bp, Homo sapiens
atcaggctcctcagcc

SEQ ID NO: 5477627 - DNA, 19 bp, Homo sapiens
atcaggctctgttcctcaa

SEQ ID NO: 5477628 - DNA, 14 bp, Homo sapiens
atcaggctgctgga

SEQ ID NO: 5477629 - DNA, 16 bp, Homo sapiens
atcaggctgttattat

SEQ ID NO: 5477630 - DNA, 19 bp, Homo sapiens
atcaggctgttattatgaa

SEQ ID NO: 5477631 - DNA, 14 bp, Homo sapiens
atcaggcttcctgg

SEQ ID NO: 5477632 - DNA, 21 bp, Homo sapiens
atcaggcttcctggtgagaac

SEQ ID NO: 5477633 - DNA, 14 bp, Homo sapiens
atcaggctttcttt

SEQ ID NO: 5477634 - DNA, 19 bp, Homo sapiens
atcagggaatccagctccc

SEQ ID NO: 5477635 - DNA, 18 bp, Homo sapiens
atcagggaccaccagagg

SEQ ID NO: 5477636 - DNA, 16 bp, Homo sapiens
atcagggaccagcttt

SEQ ID NO: 5477637 - DNA, 17 bp, Homo sapiens
atcagggaccagcttta

SEQ ID NO: 5477638 - DNA, 15 bp, Homo sapiens
atcagggaggaagat

SEQ ID NO: 5477639 - DNA, 19 bp, Homo sapiens
atcagggatcctctctcca

SEQ ID NO: 5477640 - DNA, 23 bp, Homo sapiens
atcagggcaagctcatagcacat

SEQ ID NO: 5477641 - DNA, 21 bp, Homo sapiens
atcagggcaatcccaacacat

SEQ ID NO: 5477642 - DNA, 23 bp, Homo sapiens
atcagggcattgcctgtgactga

SEQ ID NO: 5477643 - DNA, 16 bp, Homo sapiens
atcagggcctgagtga

SEQ ID NO: 5477644 - DNA, 13 bp, Homo sapiens
atcagggcctggg

SEQ ID NO: 5477645 - DNA, 21 bp, Homo sapiens
atcagggcctggggcctgaga

SEQ ID NO: 5477646 - DNA, 17 bp, Homo sapiens
atcagggcctttctcct

SEQ ID NO: 5477647 - DNA, 15 bp, Homo sapiens
atcaggggaatttca

SEQ ID NO: 5477648 - DNA, 15 bp, Homo sapiens
atcaggggagaaaaa

SEQ ID NO: 5477649 - DNA, 13 bp, Homo sapiens
atcaggggccaga

SEQ ID NO: 5477650 - DNA, 16 bp, Homo sapiens
atcagggggaagaagc

SEQ ID NO: 5477651 - DNA, 21 bp, Homo sapiens
atcagggggaagaagcagaga

SEQ ID NO: 5477652 - DNA, 23 bp, Homo sapiens
atcagggtataaattatatccgt

SEQ ID NO: 5477653 - DNA, 14 bp, Homo sapiens
atcagggtggagaa

SEQ ID NO: 5477654 - DNA, 20 bp, Homo sapiens
atcagggtgggccactctcc

SEQ ID NO: 5477655 - DNA, 13 bp, Homo sapiens
atcaggtaacttt

SEQ ID NO: 5477656 - DNA, 14 bp, Homo sapiens
atcaggtaactttc

SEQ ID NO: 5477657 - DNA, 17 bp, Homo sapiens
atcaggtcagagcccag

SEQ ID NO: 5477658 - DNA, 13 bp, Homo sapiens
atcaggtcaggga

SEQ ID NO: 5477659 - DNA, 21 bp, Homo sapiens
atcaggtcattattttttaca

SEQ ID NO: 5477660 - DNA, 21 bp, Homo sapiens
atcaggtcctgctcagcagtg

SEQ ID NO: 5477661 - DNA, 15 bp, Homo sapiens
atcaggtctgggcaa

SEQ ID NO: 5477662 - DNA, 16 bp, Homo sapiens
atcaggtctgggcaag

SEQ ID NO: 5477663 - DNA, 20 bp, Homo sapiens
atcaggtgatccacctgcct

SEQ ID NO: 5477664 - DNA, 17 bp, Homo sapiens
atcaggtgtataaatgt

SEQ ID NO: 5477665 - DNA, 15 bp, Homo sapiens
atcaggttccatccc

SEQ ID NO: 5477666 - DNA, 15 bp, Homo sapiens
atcaggttgttaatg

SEQ ID NO: 5477667 - DNA, 20 bp, Homo sapiens
atcaggtttactcagtgaaa

SEQ ID NO: 5477668 - DNA, 14 bp, Homo sapiens
atcagtaaacactg

SEQ ID NO: 5477669 - DNA, 19 bp, Homo sapiens
atcagtaaacactgtgtat

SEQ ID NO: 5477670 - DNA, 18 bp, Homo sapiens
atcagtaaataactggaa

SEQ ID NO: 5477671 - DNA, 19 bp, Homo sapiens
atcagtaacccccttaaat

SEQ ID NO: 5477672 - DNA, 23 bp, Homo sapiens
atcagtaacccccttaaatttaa

SEQ ID NO: 5477673 - DNA, 15 bp, Homo sapiens
atcagtaatatttat

SEQ ID NO: 5477674 - DNA, 19 bp, Homo sapiens
atcagtaatgctaaatgtg

SEQ ID NO: 5477675 - DNA, 20 bp, Homo sapiens
atcagtaatgctaaatgtgt

SEQ ID NO: 5477676 - DNA, 14 bp, Homo sapiens
atcagtactcccac

SEQ ID NO: 5477677 - DNA, 15 bp, Homo sapiens
atcagtacttgtttc

SEQ ID NO: 5477678 - DNA, 15 bp, Homo sapiens
atcagtagaaagagt

SEQ ID NO: 5477679 - DNA, 16 bp, Homo sapiens
atcagtaggctaatgt

SEQ ID NO: 5477680 - DNA, 15 bp, Homo sapiens
atcagtagtgtacat

SEQ ID NO: 5477681 - DNA, 16 bp, Homo sapiens
atcagtagttcacata

SEQ ID NO: 5477682 - DNA, 14 bp, Homo sapiens
atcagtataaacaa

SEQ ID NO: 5477683 - DNA, 16 bp, Homo sapiens
atcagtataaacaaag

SEQ ID NO: 5477684 - DNA, 21 bp, Homo sapiens
atcagtataattctgtactga

SEQ ID NO: 5477685 - DNA, 22 bp, Homo sapiens
atcagtataattctgtactgat

SEQ ID NO: 5477686 - DNA, 15 bp, Homo sapiens
atcagtatattttct

SEQ ID NO: 5477687 - DNA, 19 bp, Homo sapiens
atcagtatattttctgtat

SEQ ID NO: 5477688 - DNA, 20 bp, Homo sapiens
atcagtatgggaaccccaaa

SEQ ID NO: 5477689 - DNA, 23 bp, Homo sapiens
atcagtattaatactaaaatatg

SEQ ID NO: 5477690 - DNA, 12 bp, Homo sapiens
atcagtattctg

SEQ ID NO: 5477691 - DNA, 20 bp, Homo sapiens
atcagtattctgacatgtaa

SEQ ID NO: 5477692 - DNA, 23 bp, Homo sapiens
atcagtattctgacatgtaagaa

SEQ ID NO: 5477693 - DNA, 15 bp, Homo sapiens
atcagtattgaagca

SEQ ID NO: 5477694 - DNA, 16 bp, Homo sapiens
atcagtatttccttcc

SEQ ID NO: 5477695 - DNA, 22 bp, Homo sapiens
atcagtatttttttttaatttt

SEQ ID NO: 5477696 - DNA, 16 bp, Homo sapiens
atcagtcccctcccat

SEQ ID NO: 5477697 - DNA, 22 bp, Homo sapiens
atcagtcccctcccatctggga

SEQ ID NO: 5477698 - DNA, 22 bp, Homo sapiens
atcagtcctagaatgtttcatt

SEQ ID NO: 5477699 - DNA, 19 bp, Homo sapiens
atcagtctatccacagaga

SEQ ID NO: 5477700 - DNA, 19 bp, Homo sapiens
atcagtctgattcccaagc

SEQ ID NO: 5477701 - DNA, 14 bp, Homo sapiens
atcagtcttccttg

SEQ ID NO: 5477702 - DNA, 15 bp, Homo sapiens
atcagtgaaaaacat

SEQ ID NO: 5477703 - DNA, 15 bp, Homo sapiens
atcagtgaagcagtt

SEQ ID NO: 5477704 - DNA, 22 bp, Homo sapiens
atcagtgaatataaatgtacta

SEQ ID NO: 5477705 - DNA, 15 bp, Homo sapiens
atcagtgacatctga

SEQ ID NO: 5477706 - DNA, 23 bp, Homo sapiens
atcagtgacatctgattggcaga

SEQ ID NO: 5477707 - DNA, 20 bp, Homo sapiens
atcagtgagctcaggagaga

SEQ ID NO: 5477708 - DNA, 19 bp, Homo sapiens
atcagtgaggagggatgtg

SEQ ID NO: 5477709 - DNA, 15 bp, Homo sapiens
atcagtgataattgg

SEQ ID NO: 5477710 - DNA, 17 bp, Homo sapiens
atcagtgataattggtt

SEQ ID NO: 5477711 - DNA, 16 bp, Homo sapiens
atcagtgatctatgtt

SEQ ID NO: 5477712 - DNA, 22 bp, Homo sapiens
atcagtgatctatgtttgtgtg

SEQ ID NO: 5477713 - DNA, 18 bp, Homo sapiens
atcagtgatctcactaaa

SEQ ID NO: 5477714 - DNA, 18 bp, Homo sapiens
atcagtgattttcaaacc

SEQ ID NO: 5477715 - DNA, 17 bp, Homo sapiens
atcagtgcctctttgaa

SEQ ID NO: 5477716 - DNA, 20 bp, Homo sapiens
atcagtgctctgcttttagt

SEQ ID NO: 5477717 - DNA, 16 bp, Homo sapiens
atcagtggatttccca

SEQ ID NO: 5477718 - DNA, 18 bp, Homo sapiens
atcagtgggcaggataaa

SEQ ID NO: 5477719 - DNA, 20 bp, Homo sapiens
atccacagaactagccttat

SEQ ID NO: 5477720 - DNA, 21 bp, Homo sapiens
atccacagactccctcccctg

SEQ ID NO: 5477721 - DNA, 19 bp, Homo sapiens
atccacagagagtcccact

SEQ ID NO: 5477722 - DNA, 18 bp, Homo sapiens
atccacagaggccaggca

SEQ ID NO: 5477723 - DNA, 17 bp, Homo sapiens
atccacagccttgcagc

SEQ ID NO: 5477724 - DNA, 11 bp, Homo sapiens
atccacaggat

SEQ ID NO: 5477725 - DNA, 16 bp, Homo sapiens
atccacagtaatcttt

SEQ ID NO: 5477726 - DNA, 18 bp, Homo sapiens
atccacagttgtcagttg

SEQ ID NO: 5477727 - DNA, 21 bp, Homo sapiens
atccacataaatgctccttgt

SEQ ID NO: 5477728 - DNA, 22 bp, Homo sapiens
atccacataccctgacctggcc

SEQ ID NO: 5477729 - DNA, 16 bp, Homo sapiens
atccacatgaaaataa

SEQ ID NO: 5477730 - DNA, 18 bp, Homo sapiens
atccacatgtttcagagc

SEQ ID NO: 5477731 - DNA, 18 bp, Homo sapiens
atccacattgttttaaaa

SEQ ID NO: 5477732 - DNA, 15 bp, Homo sapiens
atccacatttctaaa

SEQ ID NO: 5477733 - DNA, 17 bp, Homo sapiens
atccaccaaactcctgc

SEQ ID NO: 5477734 - DNA, 13 bp, Homo sapiens
atccaccacccca

SEQ ID NO: 5477735 - DNA, 13 bp, Homo sapiens
atccacccaaata

SEQ ID NO: 5477736 - DNA, 13 bp, Homo sapiens
atccacccacctc

SEQ ID NO: 5477737 - DNA, 20 bp, Homo sapiens
atccacccacctcagcctcc

SEQ ID NO: 5477738 - DNA, 19 bp, Homo sapiens
atccacccaccttggcctc

SEQ ID NO: 5477739 - DNA, 15 bp, Homo sapiens
atccacccagcccat

SEQ ID NO: 5477740 - DNA, 15 bp, Homo sapiens
atccacccagtgctg

SEQ ID NO: 5477741 - DNA, 22 bp, Homo sapiens
atccacccagtgctgccatgcc

SEQ ID NO: 5477742 - DNA, 23 bp, Homo sapiens
atccacccagtgctgccatgcca

SEQ ID NO: 5477743 - DNA, 16 bp, Homo sapiens
atccacccatatgtta

SEQ ID NO: 5477744 - DNA, 16 bp, Homo sapiens
atccacccatgttatc

SEQ ID NO: 5477745 - DNA, 23 bp, Homo sapiens
atccacccatgtttattaagaat

SEQ ID NO: 5477746 - DNA, 22 bp, Homo sapiens
atccaccccactggatcttcag

SEQ ID NO: 5477747 - DNA, 11 bp, Homo sapiens
atccaccccag

SEQ ID NO: 5477748 - DNA, 21 bp, Homo sapiens
atccaccccagccccactgcc

SEQ ID NO: 5477749 - DNA, 22 bp, Homo sapiens
atccacccctgcgtcgagctgg

SEQ ID NO: 5477750 - DNA, 20 bp, Homo sapiens
atccacccgcctcagcctcc

SEQ ID NO: 5477751 - DNA, 23 bp, Homo sapiens
atccacccgctgcccctccccgt

SEQ ID NO: 5477752 - DNA, 15 bp, Homo sapiens
atccaccctatccct

SEQ ID NO: 5477753 - DNA, 18 bp, Homo sapiens
atccaccctcaaatgtca

SEQ ID NO: 5477754 - DNA, 11 bp, Homo sapiens
atccaccctga

SEQ ID NO: 5477755 - DNA, 12 bp, Homo sapiens
atccaccctgca

SEQ ID NO: 5477756 - DNA, 15 bp, Homo sapiens
atccaccgccacccc

SEQ ID NO: 5477757 - DNA, 22 bp, Homo sapiens
atccaccgccaccccactgaga

SEQ ID NO: 5477758 - DNA, 19 bp, Homo sapiens
atccaccgtcccctcccag

SEQ ID NO: 5477759 - DNA, 20 bp, Homo sapiens
atccacctcatcactggact

SEQ ID NO: 5477760 - DNA, 13 bp, Homo sapiens
atccacctccttc

SEQ ID NO: 5477761 - DNA, 14 bp, Homo sapiens
atccacctgcagtt

SEQ ID NO: 5477762 - DNA, 18 bp, Homo sapiens
atccacctgcctcggcct

SEQ ID NO: 5477763 - DNA, 18 bp, Homo sapiens
atccacctgcttatgcat

SEQ ID NO: 5477764 - DNA, 13 bp, Homo sapiens
atccacctgtctc

SEQ ID NO: 5477765 - DNA, 18 bp, Homo sapiens
atccacctgtctcagcct

SEQ ID NO: 5477766 - DNA, 21 bp, Homo sapiens
atccaccttcccttctacaag

SEQ ID NO: 5477767 - DNA, 18 bp, Homo sapiens
atccaccttcctgcccag

SEQ ID NO: 5477768 - DNA, 20 bp, Homo sapiens
atccaccttggctctgccag

SEQ ID NO: 5477769 - DNA, 16 bp, Homo sapiens
atccacgctcatcttg

SEQ ID NO: 5477770 - DNA, 14 bp, Homo sapiens
atccacgctgggcc

SEQ ID NO: 5477771 - DNA, 16 bp, Homo sapiens
atccacgctgggccta

SEQ ID NO: 5477772 - DNA, 22 bp, Homo sapiens
atccacgtagggggcaggggca

SEQ ID NO: 5477773 - DNA, 22 bp, Homo sapiens
atccacgtattccccttcccac

SEQ ID NO: 5477774 - DNA, 16 bp, Homo sapiens
atccacgtggcctctc

SEQ ID NO: 5477775 - DNA, 19 bp, Homo sapiens
atccacgtggcctctctct

SEQ ID NO: 5477776 - DNA, 16 bp, Homo sapiens
atccacgtgtggcctc

SEQ ID NO: 5477777 - DNA, 18 bp, Homo sapiens
atccacgtgtggcctccg

SEQ ID NO: 5477778 - DNA, 19 bp, Homo sapiens
atccactaggtgcccagtc

SEQ ID NO: 5477779 - DNA, 19 bp, Homo sapiens
atccactagtgcaaatcat

SEQ ID NO: 5477780 - DNA, 19 bp, Homo sapiens
atccactatgggaagctct

SEQ ID NO: 5477781 - DNA, 16 bp, Homo sapiens
atccactcccaggcag

SEQ ID NO: 5477782 - DNA, 18 bp, Homo sapiens
atccactctaccctccca

SEQ ID NO: 5477783 - DNA, 21 bp, Homo sapiens
atccactctaccctcccaccc

SEQ ID NO: 5477784 - DNA, 23 bp, Homo sapiens
atccactctaccctcccaccccc

SEQ ID NO: 5477785 - DNA, 18 bp, Homo sapiens
atccactctgcaggaaat

SEQ ID NO: 5477786 - DNA, 20 bp, Homo sapiens
atccactggaaaaggtgaaa

SEQ ID NO: 5477787 - DNA, 19 bp, Homo sapiens
atccactggacactgtgaa

SEQ ID NO: 5477788 - DNA, 17 bp, Homo sapiens
atccactgggaccccca

SEQ ID NO: 5477789 - DNA, 21 bp, Homo sapiens
atccactgtgccatgtgccag

SEQ ID NO: 5477790 - DNA, 16 bp, Homo sapiens
atccacttcaggagcc

SEQ ID NO: 5477791 - DNA, 17 bp, Homo sapiens
atccacttcaggagccc

SEQ ID NO: 5477792 - DNA, 12 bp, Homo sapiens
atccactttgca

SEQ ID NO: 5477793 - DNA, 15 bp, Homo sapiens
atccagaaaatgtgt

SEQ ID NO: 5477794 - DNA, 23 bp, Homo sapiens
atccagaaaatgtgtcagcatgc

SEQ ID NO: 5477795 - DNA, 23 bp, Homo sapiens
atccagaactgaggtcactgggt

SEQ ID NO: 5477796 - DNA, 14 bp, Homo sapiens
atccagaaggaagc

SEQ ID NO: 5477797 - DNA, 16 bp, Homo sapiens
atccagaaggggagct

SEQ ID NO: 5477798 - DNA, 23 bp, Homo sapiens
atccagaagtattgtttacatta

SEQ ID NO: 5477799 - DNA, 17 bp, Homo sapiens
atccagaagtgtattca

SEQ ID NO: 5477800 - DNA, 13 bp, Homo sapiens
atccagaagtttt

SEQ ID NO: 5477801 - DNA, 20 bp, Homo sapiens
atccagaatgcttctcttta

SEQ ID NO: 5477802 - DNA, 22 bp, Homo sapiens
atccagacagtcgctcagtctg

SEQ ID NO: 5477803 - DNA, 23 bp, Homo sapiens
atccagacagtcgctcagtctgt

SEQ ID NO: 5477804 - DNA, 18 bp, Homo sapiens
atccagacatcatgaatt

SEQ ID NO: 5477805 - DNA, 15 bp, Homo sapiens
atccagacctgagcg

SEQ ID NO: 5477806 - DNA, 15 bp, Homo sapiens
atccagacctggctc

SEQ ID NO: 5477807 - DNA, 12 bp, Homo sapiens
atccagactgta

SEQ ID NO: 5477808 - DNA, 19 bp, Homo sapiens
atccagactgtaagatgtt

SEQ ID NO: 5477809 - DNA, 17 bp, Homo sapiens
atccagactttcttttt

SEQ ID NO: 5477810 - DNA, 17 bp, Homo sapiens
atccagagaccaaataa

SEQ ID NO: 5477811 - DNA, 19 bp, Homo sapiens
atccagagacctgctccag

SEQ ID NO: 5477812 - DNA, 14 bp, Homo sapiens
atccagagagcagc

SEQ ID NO: 5477813 - DNA, 22 bp, Homo sapiens
atccagagattcattttctaga

SEQ ID NO: 5477814 - DNA, 11 bp, Homo sapiens
atccagagcag

SEQ ID NO: 5477815 - DNA, 13 bp, Homo sapiens
atccagagcagag

SEQ ID NO: 5477816 - DNA, 21 bp, Homo sapiens
atccagaggaacaagcatgtc

SEQ ID NO: 5477817 - DNA, 20 bp, Homo sapiens
atccagagggttgtgatttt

SEQ ID NO: 5477818 - DNA, 21 bp, Homo sapiens
atccagaggtgagggaggcct

SEQ ID NO: 5477819 - DNA, 13 bp, Homo sapiens
atccagagttctt

SEQ ID NO: 5477820 - DNA, 14 bp, Homo sapiens
atccagagttctta

SEQ ID NO: 5477821 - DNA, 22 bp, Homo sapiens
atccagagtttagaggaaaaaa

SEQ ID NO: 5477822 - DNA, 16 bp, Homo sapiens
atccagatagcctagg

SEQ ID NO: 5477823 - DNA, 20 bp, Homo sapiens
atccagatcattcctcagaa

SEQ ID NO: 5477824 - DNA, 15 bp, Homo sapiens
atccagatgtggcta

SEQ ID NO: 5477825 - DNA, 20 bp, Homo sapiens
atccagattcccaggccagg

SEQ ID NO: 5477826 - DNA, 23 bp, Homo sapiens
atccagcacaactcagtctgtgg

SEQ ID NO: 5477827 - DNA, 17 bp, Homo sapiens
atccagcagcagcactt

SEQ ID NO: 5477828 - DNA, 18 bp, Homo sapiens
atccagcagtccaaggta

SEQ ID NO: 5477829 - DNA, 12 bp, Homo sapiens
atccagcagtgt

SEQ ID NO: 5477830 - DNA, 19 bp, Homo sapiens
atccagccccatagaaaac

SEQ ID NO: 5477831 - DNA, 21 bp, Homo sapiens
atccagccccatagaaaacaa

SEQ ID NO: 5477832 - DNA, 21 bp, Homo sapiens
atccagccgcaaatccatacc

SEQ ID NO: 5477833 - DNA, 15 bp, Homo sapiens
atccagcctcagaga

SEQ ID NO: 5477834 - DNA, 14 bp, Homo sapiens
atccagccttcttc

SEQ ID NO: 5477835 - DNA, 17 bp, Homo sapiens
atccagcctttccaagt

SEQ ID NO: 5477836 - DNA, 22 bp, Homo sapiens
atccagcgtgacggagcccaca

SEQ ID NO: 5477837 - DNA, 20 bp, Homo sapiens
atccagcgtgcaccccgccg

SEQ ID NO: 5477838 - DNA, 15 bp, Homo sapiens
atccagctatgttat

SEQ ID NO: 5477839 - DNA, 14 bp, Homo sapiens
atccagctcactca

SEQ ID NO: 5477840 - DNA, 15 bp, Homo sapiens
atccagctccctaga

SEQ ID NO: 5477841 - DNA, 17 bp, Homo sapiens
atccagctccctagact

SEQ ID NO: 5477842 - DNA, 21 bp, Homo sapiens
atccagctccctagactgcat

SEQ ID NO: 5477843 - DNA, 21 bp, Homo sapiens
atccagctcctctaggggcag

SEQ ID NO: 5477844 - DNA, 15 bp, Homo sapiens
atccagctgcccctc

SEQ ID NO: 5477845 - DNA, 16 bp, Homo sapiens
atccagctgcccctcc

SEQ ID NO: 5477846 - DNA, 14 bp, Homo sapiens
atccagctggtgag

SEQ ID NO: 5477847 - DNA, 14 bp, Homo sapiens
atccagctgtgtgt

SEQ ID NO: 5477848 - DNA, 20 bp, Homo sapiens
atccagcttgccagatgctg

SEQ ID NO: 5477849 - DNA, 19 bp, Homo sapiens
atccaggaaaatgtgaggg

SEQ ID NO: 5477850 - DNA, 16 bp, Homo sapiens
atccaggaaagatgtc

SEQ ID NO: 5477851 - DNA, 17 bp, Homo sapiens
atccaggaaagatgtcc

SEQ ID NO: 5477852 - DNA, 18 bp, Homo sapiens
atccaggaacacatgcac

SEQ ID NO: 5477853 - DNA, 19 bp, Homo sapiens
atccaggaacacatgcaca

SEQ ID NO: 5477854 - DNA, 16 bp, Homo sapiens
atccaggaattgatac

SEQ ID NO: 5477855 - DNA, 13 bp, Homo sapiens
atccaggaccctg

SEQ ID NO: 5477856 - DNA, 19 bp, Homo sapiens
atccaggaccctgccaggc

SEQ ID NO: 5477857 - DNA, 23 bp, Homo sapiens
atccaggaccctgccaggcacag

SEQ ID NO: 5477858 - DNA, 22 bp, Homo sapiens
atccaggactatatttgggcct

SEQ ID NO: 5477859 - DNA, 23 bp, Homo sapiens
atccaggactatatttgggcctg

SEQ ID NO: 5477860 - DNA, 15 bp, Homo sapiens
atccaggactgagat

SEQ ID NO: 5477861 - DNA, 18 bp, Homo sapiens
atccaggaggcagtggac

SEQ ID NO: 5477862 - DNA, 16 bp, Homo sapiens
atccaggcaccaggac

SEQ ID NO: 5477863 - DNA, 19 bp, Homo sapiens
atccaggcagatccaggac

SEQ ID NO: 5477864 - DNA, 22 bp, Homo sapiens
atccaggcagatccaggactat

SEQ ID NO: 5477865 - DNA, 24 bp, Homo sapiens
atccaggcagtcgggggctggcct

SEQ ID NO: 5477866 - DNA, 19 bp, Homo sapiens
atccaggccaaagccccat

SEQ ID NO: 5477867 - DNA, 16 bp, Homo sapiens
atccaggccagggctc

SEQ ID NO: 5477868 - DNA, 14 bp, Homo sapiens
atccaggcccctcc

SEQ ID NO: 5477869 - DNA, 23 bp, Homo sapiens
atccaggccggcttgccacaccc

SEQ ID NO: 5477870 - DNA, 18 bp, Homo sapiens
atccaggcctgaggctgc

SEQ ID NO: 5477871 - DNA, 15 bp, Homo sapiens
atccaggcttctccc

SEQ ID NO: 5477872 - DNA, 12 bp, Homo sapiens
atccagggacag

SEQ ID NO: 5477873 - DNA, 23 bp, Homo sapiens
atccagggaggctggtcctatgg

SEQ ID NO: 5477874 - DNA, 17 bp, Homo sapiens
atccagggcagcaggcc

SEQ ID NO: 5477875 - DNA, 16 bp, Homo sapiens
atccagggtctggcag

SEQ ID NO: 5477876 - DNA, 19 bp, Homo sapiens
atccagggtctggcagagc

SEQ ID NO: 5477877 - DNA, 20 bp, Homo sapiens
atccagggtctggcagagcc

SEQ ID NO: 5477878 - DNA, 23 bp, Homo sapiens
atccagggtctggcagagcctct

SEQ ID NO: 5477879 - DNA, 17 bp, Homo sapiens
atccagggtggtggtga

SEQ ID NO: 5477880 - DNA, 17 bp, Homo sapiens
atccaggtaactttgaa

SEQ ID NO: 5477881 - DNA, 14 bp, Homo sapiens
atccaggtaatcca

SEQ ID NO: 5477882 - DNA, 20 bp, Homo sapiens
atccaggtcaacagaatgaa

SEQ ID NO: 5477883 - DNA, 23 bp, Homo sapiens
atccaggtcatgcagttcctggc

SEQ ID NO: 5477884 - DNA, 17 bp, Homo sapiens
atccaggtcctttcctt

SEQ ID NO: 5477885 - DNA, 19 bp, Homo sapiens
atccaggtcctttccttct

SEQ ID NO: 5477886 - DNA, 18 bp, Homo sapiens
atccaggtcttgactcat

SEQ ID NO: 5477887 - DNA, 15 bp, Homo sapiens
atccaggtgggagag

SEQ ID NO: 5477888 - DNA, 15 bp, Homo sapiens
atccaggtggtccca

SEQ ID NO: 5477889 - DNA, 16 bp, Homo sapiens
atccaggtgtgcccct

SEQ ID NO: 5477890 - DNA, 21 bp, Homo sapiens
atccaggttggttttgctgtt

SEQ ID NO: 5477891 - DNA, 15 bp, Homo sapiens
atccagtaagcacat

SEQ ID NO: 5477892 - DNA, 18 bp, Homo sapiens
atccagtacatttaattg

SEQ ID NO: 5477893 - DNA, 19 bp, Homo sapiens
atccagtagagatttccca

SEQ ID NO: 5477894 - DNA, 16 bp, Homo sapiens
atccagtaggatccag

SEQ ID NO: 5477895 - DNA, 23 bp, Homo sapiens
cagtgcagtagtgccaaaaggcc

SEQ ID NO: 5477896 - DNA, 20 bp, Homo sapiens
cagtgcagtccatttcctaa

SEQ ID NO: 5477897 - DNA, 17 bp, Homo sapiens
cagtgcagtgatacatg

SEQ ID NO: 5477898 - DNA, 20 bp, Homo sapiens
cagtgcagtttctaagcatg

SEQ ID NO: 5477899 - DNA, 16 bp, Homo sapiens
cagtgcatcacatctg

SEQ ID NO: 5477900 - DNA, 20 bp, Homo sapiens
cagtgcatcacatctgcaca

SEQ ID NO: 5477901 - DNA, 23 bp, Homo sapiens
cagtgcatcacatctgcacactc

SEQ ID NO: 5477902 - DNA, 14 bp, Homo sapiens
cagtgcatcattac

SEQ ID NO: 5477903 - DNA, 16 bp, Homo sapiens
cagtgcatctcagatg

SEQ ID NO: 5477904 - DNA, 15 bp, Homo sapiens
cagtgcatctcagcc

SEQ ID NO: 5477905 - DNA, 17 bp, Homo sapiens
cagtgcatctcagccca

SEQ ID NO: 5477906 - DNA, 18 bp, Homo sapiens
cagtgcatctcagcccac

SEQ ID NO: 5477907 - DNA, 15 bp, Homo sapiens
cagtgcatgacgttt

SEQ ID NO: 5477908 - DNA, 15 bp, Homo sapiens
cagtgcatgcatgtt

SEQ ID NO: 5477909 - DNA, 16 bp, Homo sapiens
cagtgcatgctgtccc

SEQ ID NO: 5477910 - DNA, 17 bp, Homo sapiens
cagtgcatggtggccag

SEQ ID NO: 5477911 - DNA, 19 bp, Homo sapiens
cagtgcatgtgaagcatgc

SEQ ID NO: 5477912 - DNA, 22 bp, Homo sapiens
cagtgcatgtgaagcatgcttt

SEQ ID NO: 5477913 - DNA, 17 bp, Homo sapiens
cagtgcatgtgcatgca

SEQ ID NO: 5477914 - DNA, 17 bp, Homo sapiens
cagtgcattttgtttct

SEQ ID NO: 5477915 - DNA, 21 bp, Homo sapiens
cagtgccaaatgctggggcag

SEQ ID NO: 5477916 - DNA, 16 bp, Homo sapiens
cagtgccaactgtggc

SEQ ID NO: 5477917 - DNA, 22 bp, Homo sapiens
cagtgccaataaaatttaggaa

SEQ ID NO: 5477918 - DNA, 11 bp, Homo sapiens
cagtgccacag

SEQ ID NO: 5477919 - DNA, 15 bp, Homo sapiens
cagtgccacagagaa

SEQ ID NO: 5477920 - DNA, 13 bp, Homo sapiens
cagtgccacagcc

SEQ ID NO: 5477921 - DNA, 14 bp, Homo sapiens
cagtgccacagcct

SEQ ID NO: 5477922 - DNA, 16 bp, Homo sapiens
cagtgccacagcctgc

SEQ ID NO: 5477923 - DNA, 17 bp, Homo sapiens
cagtgccacagcctgct

SEQ ID NO: 5477924 - DNA, 12 bp, Homo sapiens
cagtgccaccaa

SEQ ID NO: 5477925 - DNA, 17 bp, Homo sapiens
cagtgccaccaagctca

SEQ ID NO: 5477926 - DNA, 13 bp, Homo sapiens
cagtgccacccat

SEQ ID NO: 5477927 - DNA, 19 bp, Homo sapiens
cagtgccacctatgcctgt

SEQ ID NO: 5477928 - DNA, 20 bp, Homo sapiens
cagtgccacctatgcctgtg

SEQ ID NO: 5477929 - DNA, 23 bp, Homo sapiens
cagtgccacctatgcctgtggtg

SEQ ID NO: 5477930 - DNA, 24 bp, Homo sapiens
cagtgccacctatgcctgtggtga

SEQ ID NO: 5477931 - DNA, 16 bp, Homo sapiens
cagtgccacgtcatga

SEQ ID NO: 5477932 - DNA, 15 bp, Homo sapiens
cagtgccagcccctg

SEQ ID NO: 5477933 - DNA, 19 bp, Homo sapiens
cagtgccagcccctgctgg

SEQ ID NO: 5477934 - DNA, 13 bp, Homo sapiens
cagtgccagctcc

SEQ ID NO: 5477935 - DNA, 14 bp, Homo sapiens
cagtgccagctcca

SEQ ID NO: 5477936 - DNA, 23 bp, Homo sapiens
cagtgccagctccagtgccgctc

SEQ ID NO: 5477937 - DNA, 16 bp, Homo sapiens
cagtgccagctccctc

SEQ ID NO: 5477938 - DNA, 17 bp, Homo sapiens
cagtgccaggaaagagt

SEQ ID NO: 5477939 - DNA, 13 bp, Homo sapiens
cagtgccaggaca

SEQ ID NO: 5477940 - DNA, 20 bp, Homo sapiens
cagtgccaggacagctggct

SEQ ID NO: 5477941 - DNA, 20 bp, Homo sapiens
cagtgccagggtgggctggg

SEQ ID NO: 5477942 - DNA, 20 bp, Homo sapiens
cagtgccatgtaaatcccca

SEQ ID NO: 5477943 - DNA, 20 bp, Homo sapiens
cagtgccattccactccact

SEQ ID NO: 5477944 - DNA, 21 bp, Homo sapiens
cagtgccattccactccactc

SEQ ID NO: 5477945 - DNA, 17 bp, Homo sapiens
cagtgccattgtcttta

SEQ ID NO: 5477946 - DNA, 21 bp, Homo sapiens
cagtgccattgtctttatatg

SEQ ID NO: 5477947 - DNA, 17 bp, Homo sapiens
cagtgcccaagagtggg

SEQ ID NO: 5477948 - DNA, 13 bp, Homo sapiens
cagtgcccacagg

SEQ ID NO: 5477949 - DNA, 16 bp, Homo sapiens
cagtgcccaccgccct

SEQ ID NO: 5477950 - DNA, 18 bp, Homo sapiens
cagtgcccaccgccctcc

SEQ ID NO: 5477951 - DNA, 21 bp, Homo sapiens
cagtgcccaccgccctcctcc

SEQ ID NO: 5477952 - DNA, 22 bp, Homo sapiens
cagtgcccaggtggctgtggaa

SEQ ID NO: 5477953 - DNA, 13 bp, Homo sapiens
cagtgcccagtga

SEQ ID NO: 5477954 - DNA, 17 bp, Homo sapiens
cagtgcccatgtgtaca

SEQ ID NO: 5477955 - DNA, 17 bp, Homo sapiens
cagtgcccatgtgtatg

SEQ ID NO: 5477956 - DNA, 14 bp, Homo sapiens
cagtgccccaggga

SEQ ID NO: 5477957 - DNA, 22 bp, Homo sapiens
cagtgccccagggagtccaggg

SEQ ID NO: 5477958 - DNA, 16 bp, Homo sapiens
cagtgccccagtggtg

SEQ ID NO: 5477959 - DNA, 12 bp, Homo sapiens
cagtgcccccac

SEQ ID NO: 5477960 - DNA, 17 bp, Homo sapiens
cagtgcccccactgacc

SEQ ID NO: 5477961 - DNA, 14 bp, Homo sapiens
cagtgcccctagct

SEQ ID NO: 5477962 - DNA, 13 bp, Homo sapiens
cagtgccctccag

SEQ ID NO: 5477963 - DNA, 14 bp, Homo sapiens
cagtgccctccagc

SEQ ID NO: 5477964 - DNA, 14 bp, Homo sapiens
cagtgccctggggc

SEQ ID NO: 5477965 - DNA, 13 bp, Homo sapiens
cagtgccctttga

SEQ ID NO: 5477966 - DNA, 18 bp, Homo sapiens
cagtgccgagaaggaagc

SEQ ID NO: 5477967 - DNA, 15 bp, Homo sapiens
cagtgccgaggacat

SEQ ID NO: 5477968 - DNA, 18 bp, Homo sapiens
cagtgccgccgcctcgcc

SEQ ID NO: 5477969 - DNA, 13 bp, Homo sapiens
cagtgccgctcct

SEQ ID NO: 5477970 - DNA, 19 bp, Homo sapiens
cagtgccgctcctgcttcc

SEQ ID NO: 5477971 - DNA, 13 bp, Homo sapiens
cagtgccggaggc

SEQ ID NO: 5477972 - DNA, 15 bp, Homo sapiens
cagtgcctaaaataa

SEQ ID NO: 5477973 - DNA, 22 bp, Homo sapiens
cagtgcctacatcccgggcctc

SEQ ID NO: 5477974 - DNA, 12 bp, Homo sapiens
cagtgcctcagt

SEQ ID NO: 5477975 - DNA, 19 bp, Homo sapiens
cagtgcctcctgggaccat

SEQ ID NO: 5477976 - DNA, 18 bp, Homo sapiens
cagtgcctcgaggcaccg

SEQ ID NO: 5477977 - DNA, 15 bp, Homo sapiens
cagtgcctcttccag

SEQ ID NO: 5477978 - DNA, 21 bp, Homo sapiens
cagtgcctcttccagtgaaca

SEQ ID NO: 5477979 - DNA, 15 bp, Homo sapiens
cagtgcctgaacatg

SEQ ID NO: 5477980 - DNA, 10 bp, Homo sapiens
cagtgcctgc

SEQ ID NO: 5477981 - DNA, 11 bp, Homo sapiens
cagtgcctgcc

SEQ ID NO: 5477982 - DNA, 13 bp, Homo sapiens
cagtgcctgccac

SEQ ID NO: 5477983 - DNA, 11 bp, Homo sapiens
cagtgcctgct

SEQ ID NO: 5477984 - DNA, 13 bp, Homo sapiens
cagtgcctgctga

SEQ ID NO: 5477985 - DNA, 15 bp, Homo sapiens
cagtgcctgctgttc

SEQ ID NO: 5477986 - DNA, 15 bp, Homo sapiens
cagtgcctgtctgga

SEQ ID NO: 5477987 - DNA, 18 bp, Homo sapiens
cagtgcctgtctggagct

SEQ ID NO: 5477988 - DNA, 13 bp, Homo sapiens
cagtgcctgtgag

SEQ ID NO: 5477989 - DNA, 21 bp, Homo sapiens
cagtgcctgtgagcatggggc

SEQ ID NO: 5477990 - DNA, 23 bp, Homo sapiens
cagtgccttacctcctgcccagg

SEQ ID NO: 5477991 - DNA, 13 bp, Homo sapiens
cagtgccttatgg

SEQ ID NO: 5477992 - DNA, 18 bp, Homo sapiens
cagtgccttatggaacac

SEQ ID NO: 5477993 - DNA, 22 bp, Homo sapiens
cagtgccttattacccaggaag

SEQ ID NO: 5477994 - DNA, 13 bp, Homo sapiens
cagtgccttcaac

SEQ ID NO: 5477995 - DNA, 16 bp, Homo sapiens
cagtgccttccataat

SEQ ID NO: 5477996 - DNA, 23 bp, Homo sapiens
cagtgccttccataattatgaca

SEQ ID NO: 5477997 - DNA, 22 bp, Homo sapiens
cagtgccttctctcagctccca

SEQ ID NO: 5477998 - DNA, 13 bp, Homo sapiens
cagtgccttgctc

SEQ ID NO: 5477999 - DNA, 23 bp, Homo sapiens
cagtgccttggagcagaaagcca

SEQ ID NO: 5478000 - DNA, 21 bp, Homo sapiens
cagtgccttggggaatttcct

SEQ ID NO: 5478001 - DNA, 22 bp, Homo sapiens
cagtgccttggggaatttcctc

SEQ ID NO: 5478002 - DNA, 15 bp, Homo sapiens
cagtgcctttgtagc

SEQ ID NO: 5478003 - DNA, 17 bp, Homo sapiens
cagtgccttttggtttc

SEQ ID NO: 5478004 - DNA, 24 bp, Homo sapiens
cagtgcgcgtgcacgtggagagct

SEQ ID NO: 5478005 - DNA, 21 bp, Homo sapiens
cagtgcggacccttcccagcc

SEQ ID NO: 5478006 - DNA, 23 bp, Homo sapiens
cagtgcggacccttcccagccct

SEQ ID NO: 5478007 - DNA, 18 bp, Homo sapiens
cagtgcggttcctcatct

SEQ ID NO: 5478008 - DNA, 15 bp, Homo sapiens
cagtgctaaaaatgg

SEQ ID NO: 5478009 - DNA, 16 bp, Homo sapiens
cagtgctaaaaatggg

SEQ ID NO: 5478010 - DNA, 15 bp, Homo sapiens
cagtgctaaagcctg

SEQ ID NO: 5478011 - DNA, 19 bp, Homo sapiens
cagtgctaaagcctgtggg

SEQ ID NO: 5478012 - DNA, 19 bp, Homo sapiens
cagtgctaagctgccctga

SEQ ID NO: 5478013 - DNA, 20 bp, Homo sapiens
cagtgctaagctgccctgag

SEQ ID NO: 5478014 - DNA, 14 bp, Homo sapiens
cagtgctacatttt

SEQ ID NO: 5478015 - DNA, 15 bp, Homo sapiens
cagtgctacattttg

SEQ ID NO: 5478016 - DNA, 16 bp, Homo sapiens
cagtgctataaatgcc

SEQ ID NO: 5478017 - DNA, 20 bp, Homo sapiens
cagtgctataaatgccagag

SEQ ID NO: 5478018 - DNA, 22 bp, Homo sapiens
cagtgctattctgagtgaaaat

SEQ ID NO: 5478019 - DNA, 13 bp, Homo sapiens
cagtgctcaaggt

SEQ ID NO: 5478020 - DNA, 15 bp, Homo sapiens
cagtgctcacacaat

SEQ ID NO: 5478021 - DNA, 18 bp, Homo sapiens
cagtgctcaccagccctg

SEQ ID NO: 5478022 - DNA, 18 bp, Homo sapiens
cagtgctcacccacacca

SEQ ID NO: 5478023 - DNA, 17 bp, Homo sapiens
cagtgctcagctgtggc

SEQ ID NO: 5478024 - DNA, 23 bp, Homo sapiens
cagtgctcatacgtatctgctca

SEQ ID NO: 5478025 - DNA, 23 bp, Homo sapiens
cagtgctccatccaaactcagaa

SEQ ID NO: 5478026 - DNA, 13 bp, Homo sapiens
cagtgctcctgga

SEQ ID NO: 5478027 - DNA, 16 bp, Homo sapiens
cagtgctcctgtgcag

SEQ ID NO: 5478028 - DNA, 16 bp, Homo sapiens
cagtgctcggcagtca

SEQ ID NO: 5478029 - DNA, 19 bp, Homo sapiens
cagtgctctcagctggcag

SEQ ID NO: 5478030 - DNA, 17 bp, Homo sapiens
cagtgctctgcctcaga

SEQ ID NO: 5478031 - DNA, 17 bp, Homo sapiens
cagtgctgaagggggca

SEQ ID NO: 5478032 - DNA, 23 bp, Homo sapiens
cagtgctgatccggctgctcctc

SEQ ID NO: 5478033 - DNA, 16 bp, Homo sapiens
cagtgctgattcagcc

SEQ ID NO: 5478034 - DNA, 20 bp, Homo sapiens
cagtgctgcaattgagggct

SEQ ID NO: 5478035 - DNA, 15 bp, Homo sapiens
cagtgctgcagctcc

SEQ ID NO: 5478036 - DNA, 13 bp, Homo sapiens
cagtgctgccatg

SEQ ID NO: 5478037 - DNA, 16 bp, Homo sapiens
cagtgctgccatgcca

SEQ ID NO: 5478038 - DNA, 18 bp, Homo sapiens
cagtgctgccatgccact

SEQ ID NO: 5478039 - DNA, 21 bp, Homo sapiens
cagtgctgccatgccactgcc

SEQ ID NO: 5478040 - DNA, 13 bp, Homo sapiens
cagtgctgcccct

SEQ ID NO: 5478041 - DNA, 21 bp, Homo sapiens
cagtgctgccccttgcaagcc

SEQ ID NO: 5478042 - DNA, 13 bp, Homo sapiens
cagtgctgccctg

SEQ ID NO: 5478043 - DNA, 14 bp, Homo sapiens
cagtgctgctgaac

SEQ ID NO: 5478044 - DNA, 17 bp, Homo sapiens
cagtgctgctgtaaata

SEQ ID NO: 5478045 - DNA, 13 bp, Homo sapiens
cagtgctgcttct

SEQ ID NO: 5478046 - DNA, 22 bp, Homo sapiens
cagtgctggagaaatcttgaat

SEQ ID NO: 5478047 - DNA, 18 bp, Homo sapiens
cagtgctggccacacagc

SEQ ID NO: 5478048 - DNA, 19 bp, Homo sapiens
cagtgctggccacacagca

SEQ ID NO: 5478049 - DNA, 21 bp, Homo sapiens
cagtgctgggaccagagccag

SEQ ID NO: 5478050 - DNA, 18 bp, Homo sapiens
cagtgctgggcccagccg

SEQ ID NO: 5478051 - DNA, 22 bp, Homo sapiens
cagtgctgtaatcggctcccgc

SEQ ID NO: 5478052 - DNA, 15 bp, Homo sapiens
cagtgctgtacttga

SEQ ID NO: 5478053 - DNA, 22 bp, Homo sapiens
cagtgctgtgctgtgctatggt

SEQ ID NO: 5478054 - DNA, 17 bp, Homo sapiens
cagtgctgtggcctggg

SEQ ID NO: 5478055 - DNA, 18 bp, Homo sapiens
cagtgctgttctggagct

SEQ ID NO: 5478056 - DNA, 14 bp, Homo sapiens
cagtgctgttggtg

SEQ ID NO: 5478057 - DNA, 20 bp, Homo sapiens
cagtgcttcagcctgaggct

SEQ ID NO: 5478058 - DNA, 23 bp, Homo sapiens
cagtgcttctacacatttcatct

SEQ ID NO: 5478059 - DNA, 12 bp, Homo sapiens
cagtgcttctca

SEQ ID NO: 5478060 - DNA, 17 bp, Homo sapiens
cagtgcttctctacaga

SEQ ID NO: 5478061 - DNA, 21 bp, Homo sapiens
cagtgcttctctgtgcaggag

SEQ ID NO: 5478062 - DNA, 22 bp, Homo sapiens
cagtgcttctctgtgcaggagc

SEQ ID NO: 5478063 - DNA, 14 bp, Homo sapiens
cagtgcttgccaca

SEQ ID NO: 5478064 - DNA, 15 bp, Homo sapiens
cagtgcttggcccag

SEQ ID NO: 5478065 - DNA, 17 bp, Homo sapiens
cagtgcttggcccagga

SEQ ID NO: 5478066 - DNA, 19 bp, Homo sapiens
cagtgcttggcccaggagt

SEQ ID NO: 5478067 - DNA, 16 bp, Homo sapiens
cagtgcttggctgccc

SEQ ID NO: 5478068 - DNA, 16 bp, Homo sapiens
cagtgcttgggctcca

SEQ ID NO: 5478069 - DNA, 17 bp, Homo sapiens
cagtgcttgggctccac

SEQ ID NO: 5478070 - DNA, 18 bp, Homo sapiens
cagtgcttgggctccacg

SEQ ID NO: 5478071 - DNA, 12 bp, Homo sapiens
cagtgcttgtaa

SEQ ID NO: 5478072 - DNA, 16 bp, Homo sapiens
cagtgctttaatggca

SEQ ID NO: 5478073 - DNA, 16 bp, Homo sapiens
cagtgtgtcagttttt

SEQ ID NO: 5478074 - DNA, 14 bp, Homo sapiens
cagtgtgtctaaat

SEQ ID NO: 5478075 - DNA, 19 bp, Homo sapiens
cagtgtgtctcctgcatgc

SEQ ID NO: 5478076 - DNA, 17 bp, Homo sapiens
cagtgtgtgaaaattca

SEQ ID NO: 5478077 - DNA, 14 bp, Homo sapiens
cagtgtgtgactta

SEQ ID NO: 5478078 - DNA, 21 bp, Homo sapiens
cagtgtgtgggggagattctg

SEQ ID NO: 5478079 - DNA, 17 bp, Homo sapiens
cagtgtgtggtcaacat

SEQ ID NO: 5478080 - DNA, 22 bp, Homo sapiens
cagtgtgtggtcaacatttctc

SEQ ID NO: 5478081 - DNA, 20 bp, Homo sapiens
cagtgtgtgtttaacattca

SEQ ID NO: 5478082 - DNA, 17 bp, Homo sapiens
cagtgtgtttgtgattg

SEQ ID NO: 5478083 - DNA, 14 bp, Homo sapiens
cagtgttaaaaaat

SEQ ID NO: 5478084 - DNA, 22 bp, Homo sapiens
cagtgttaaagtggtctgaact

SEQ ID NO: 5478085 - DNA, 14 bp, Homo sapiens
cagtgttaaattca

SEQ ID NO: 5478086 - DNA, 13 bp, Homo sapiens
cagtgttaagata

SEQ ID NO: 5478087 - DNA, 17 bp, Homo sapiens
cagtgttaatactgaga

SEQ ID NO: 5478088 - DNA, 19 bp, Homo sapiens
cagtgttaatactgagaaa

SEQ ID NO: 5478089 - DNA, 16 bp, Homo sapiens
cagtgttaatgctgaa

SEQ ID NO: 5478090 - DNA, 17 bp, Homo sapiens
cagtgttacaagggtat

SEQ ID NO: 5478091 - DNA, 21 bp, Homo sapiens
cagtgttacctgttagctccc

SEQ ID NO: 5478092 - DNA, 14 bp, Homo sapiens
cagtgttagcttag

SEQ ID NO: 5478093 - DNA, 19 bp, Homo sapiens
cagtgttaggcctggcaca

SEQ ID NO: 5478094 - DNA, 22 bp, Homo sapiens
cagtgttaggcctggcacagtg

SEQ ID NO: 5478095 - DNA, 19 bp, Homo sapiens
cagtgttagtgggaagagc

SEQ ID NO: 5478096 - DNA, 22 bp, Homo sapiens
cagtgttagtgggaagagctgg

SEQ ID NO: 5478097 - DNA, 18 bp, Homo sapiens
cagtgttatcccaagacc

SEQ ID NO: 5478098 - DNA, 19 bp, Homo sapiens
cagtgttatttattcccca

SEQ ID NO: 5478099 - DNA, 17 bp, Homo sapiens
cagtgttattttctttg

SEQ ID NO: 5478100 - DNA, 22 bp, Homo sapiens
cagtgttcaaataaactgaagg

SEQ ID NO: 5478101 - DNA, 24 bp, Homo sapiens
cagtgttcagccaaacagtatgat

SEQ ID NO: 5478102 - DNA, 18 bp, Homo sapiens
cagtgttccccccataga

SEQ ID NO: 5478103 - DNA, 18 bp, Homo sapiens
cagtgttccgtggttaaa

SEQ ID NO: 5478104 - DNA, 16 bp, Homo sapiens
cagtgttcctgaagct

SEQ ID NO: 5478105 - DNA, 18 bp, Homo sapiens
cagtgttcctgaagctgc

SEQ ID NO: 5478106 - DNA, 20 bp, Homo sapiens
cagtgttcctgaagctgctg

SEQ ID NO: 5478107 - DNA, 21 bp, Homo sapiens
cagtgttcctgaagctgctgt

SEQ ID NO: 5478108 - DNA, 20 bp, Homo sapiens
cagtgttccttgtgcccgtg

SEQ ID NO: 5478109 - DNA, 14 bp, Homo sapiens
cagtgttcgcttgg

SEQ ID NO: 5478110 - DNA, 15 bp, Homo sapiens
cagtgttcgcttggc

SEQ ID NO: 5478111 - DNA, 18 bp, Homo sapiens
cagtgttctatgaacaac

SEQ ID NO: 5478112 - DNA, 17 bp, Homo sapiens
cagtgttctatttgctt

SEQ ID NO: 5478113 - DNA, 15 bp, Homo sapiens
cagtgttctgagccc

SEQ ID NO: 5478114 - DNA, 14 bp, Homo sapiens
cagtgttctgtgaa

SEQ ID NO: 5478115 - DNA, 17 bp, Homo sapiens
cagtgttctgtgaatag

SEQ ID NO: 5478116 - DNA, 14 bp, Homo sapiens
cagtgttgacatag

SEQ ID NO: 5478117 - DNA, 18 bp, Homo sapiens
cagtgttgacatagcctt

SEQ ID NO: 5478118 - DNA, 18 bp, Homo sapiens
cagtgttgactgtaggcg

SEQ ID NO: 5478119 - DNA, 12 bp, Homo sapiens
cagtgttgagat

SEQ ID NO: 5478120 - DNA, 14 bp, Homo sapiens
cagtgttgcctaag

SEQ ID NO: 5478121 - DNA, 15 bp, Homo sapiens
cagtgttgcctcctc

SEQ ID NO: 5478122 - DNA, 16 bp, Homo sapiens
cagtgttgcctcctcc

SEQ ID NO: 5478123 - DNA, 20 bp, Homo sapiens
cagtgttgcgtttttccttg

SEQ ID NO: 5478124 - DNA, 13 bp, Homo sapiens
cagtgttggagaa

SEQ ID NO: 5478125 - DNA, 14 bp, Homo sapiens
cagtgttggctgtg

SEQ ID NO: 5478126 - DNA, 14 bp, Homo sapiens
cagtgttgtcacca

SEQ ID NO: 5478127 - DNA, 19 bp, Homo sapiens
cagtgttgtggatttaaca

SEQ ID NO: 5478128 - DNA, 17 bp, Homo sapiens
cagtgttgtttgtaaat

SEQ ID NO: 5478129 - DNA, 18 bp, Homo sapiens
cagtgttgtttgtaaata

SEQ ID NO: 5478130 - DNA, 15 bp, Homo sapiens
cagtgtttaatgtaa

SEQ ID NO: 5478131 - DNA, 15 bp, Homo sapiens
cagtgtttatattgg

SEQ ID NO: 5478132 - DNA, 21 bp, Homo sapiens
cagtgtttcaattctgtaatt

SEQ ID NO: 5478133 - DNA, 13 bp, Homo sapiens
cagtgtttccagt

SEQ ID NO: 5478134 - DNA, 14 bp, Homo sapiens
cagtgtttccagtg

SEQ ID NO: 5478135 - DNA, 15 bp, Homo sapiens
cagtgtttcccataa

SEQ ID NO: 5478136 - DNA, 18 bp, Homo sapiens
cagtgtttcccataattt

SEQ ID NO: 5478137 - DNA, 18 bp, Homo sapiens
cagtgtttccctctgtgt

SEQ ID NO: 5478138 - DNA, 20 bp, Homo sapiens
cagtgtttccctctgtgtta

SEQ ID NO: 5478139 - DNA, 13 bp, Homo sapiens
cagtgtttcgtca

SEQ ID NO: 5478140 - DNA, 22 bp, Homo sapiens
cagtgtttcgtcatgttggcca

SEQ ID NO: 5478141 - DNA, 15 bp, Homo sapiens
cagtgtttctgaatg

SEQ ID NO: 5478142 - DNA, 16 bp, Homo sapiens
cagtgtttctgaatgt

SEQ ID NO: 5478143 - DNA, 18 bp, Homo sapiens
cagtgtttctgaatgttt

SEQ ID NO: 5478144 - DNA, 19 bp, Homo sapiens
cagtgtttctgaatgtttg

SEQ ID NO: 5478145 - DNA, 20 bp, Homo sapiens
cagtgtttcttcacttcttt

SEQ ID NO: 5478146 - DNA, 14 bp, Homo sapiens
cagtgtttctttta

SEQ ID NO: 5478147 - DNA, 17 bp, Homo sapiens
cagtgtttgggaaatta

SEQ ID NO: 5478148 - DNA, 17 bp, Homo sapiens
cagtgtttggtgacata

SEQ ID NO: 5478149 - DNA, 13 bp, Homo sapiens
cagtgtttggtgc

SEQ ID NO: 5478150 - DNA, 13 bp, Homo sapiens
cagtgtttgtgtg

SEQ ID NO: 5478151 - DNA, 20 bp, Homo sapiens
cagtgttttaaactctccta

SEQ ID NO: 5478152 - DNA, 16 bp, Homo sapiens
cagtgttttaaattct

SEQ ID NO: 5478153 - DNA, 17 bp, Homo sapiens
cagtgttttaaattctg

SEQ ID NO: 5478154 - DNA, 19 bp, Homo sapiens
cagtgttttataggagaga

SEQ ID NO: 5478155 - DNA, 13 bp, Homo sapiens
cagtgttttcaga

SEQ ID NO: 5478156 - DNA, 19 bp, Homo sapiens
cagtgttttcagaagaaat

SEQ ID NO: 5478157 - DNA, 12 bp, Homo sapiens
cagtgttttctt

SEQ ID NO: 5478158 - DNA, 14 bp, Homo sapiens
cagtgttttcttgt

SEQ ID NO: 5478159 - DNA, 21 bp, Homo sapiens
cagtgttttgacctttgatac

SEQ ID NO: 5478160 - DNA, 18 bp, Homo sapiens
cagtgttttgcaagtgct

SEQ ID NO: 5478161 - DNA, 22 bp, Homo sapiens
cagtgttttggactccatctct

SEQ ID NO: 5478162 - DNA, 19 bp, Homo sapiens
cagtgttttggtggaaaaa

SEQ ID NO: 5478163 - DNA, 17 bp, Homo sapiens
cagtgtttttattgctc

SEQ ID NO: 5478164 - DNA, 18 bp, Homo sapiens
cagtgtttttattgctcg

SEQ ID NO: 5478165 - DNA, 20 bp, Homo sapiens
cagtgtttttattgctcgcc

SEQ ID NO: 5478166 - DNA, 17 bp, Homo sapiens
cagtgtttttgcaggtg

SEQ ID NO: 5478167 - DNA, 16 bp, Homo sapiens
cagtgttttttaggaa

SEQ ID NO: 5478168 - DNA, 18 bp, Homo sapiens
cagtgttttttaggaaaa

SEQ ID NO: 5478169 - DNA, 22 bp, Homo sapiens
cagtgttttttcactttagcta

SEQ ID NO: 5478170 - DNA, 15 bp, Homo sapiens
cagttaaaaaaaatt

SEQ ID NO: 5478171 - DNA, 15 bp, Homo sapiens
cagttaaactggctt

SEQ ID NO: 5478172 - DNA, 17 bp, Homo sapiens
cagttaaacttgcaatg

SEQ ID NO: 5478173 - DNA, 12 bp, Homo sapiens
cagttaaagaag

SEQ ID NO: 5478174 - DNA, 17 bp, Homo sapiens
cagttaaagaagcaatc

SEQ ID NO: 5478175 - DNA, 13 bp, Homo sapiens
cagttaaagatta

SEQ ID NO: 5478176 - DNA, 21 bp, Homo sapiens
cagttaaagtagatcacctcc

SEQ ID NO: 5478177 - DNA, 20 bp, Homo sapiens
cagttaaataaatagaaaga

SEQ ID NO: 5478178 - DNA, 22 bp, Homo sapiens
cagttaaatatgatttgcattt

SEQ ID NO: 5478179 - DNA, 18 bp, Homo sapiens
cagttaaatctcctgtgg

SEQ ID NO: 5478180 - DNA, 16 bp, Homo sapiens
cagttaacgtattagt

SEQ ID NO: 5478181 - DNA, 23 bp, Homo sapiens
cagttaacgtattagttgccaat

SEQ ID NO: 5478182 - DNA, 22 bp, Homo sapiens
cagttaacgtcacccaaaagca

SEQ ID NO: 5478183 - DNA, 21 bp, Homo sapiens
cagttaactattgcatttata

SEQ ID NO: 5478184 - DNA, 18 bp, Homo sapiens
cagttaacttactcttta

SEQ ID NO: 5478185 - DNA, 17 bp, Homo sapiens
cagttaagaaaaaaata

SEQ ID NO: 5478186 - DNA, 14 bp, Homo sapiens
cagttaagaagccc

SEQ ID NO: 5478187 - DNA, 17 bp, Homo sapiens
cagttaagaagccctgc

SEQ ID NO: 5478188 - DNA, 19 bp, Homo sapiens
cagttaagcagccgccaca

SEQ ID NO: 5478189 - DNA, 14 bp, Homo sapiens
cagttaagcctttg

SEQ ID NO: 5478190 - DNA, 15 bp, Homo sapiens
cagttaagcctttgg

SEQ ID NO: 5478191 - DNA, 20 bp, Homo sapiens
cagttaaggaccgtggccct

SEQ ID NO: 5478192 - DNA, 15 bp, Homo sapiens
cagttaagttcttct

SEQ ID NO: 5478193 - DNA, 16 bp, Homo sapiens
cagttaatacttaaca

SEQ ID NO: 5478194 - DNA, 17 bp, Homo sapiens
cagttaatacttaacat

SEQ ID NO: 5478195 - DNA, 16 bp, Homo sapiens
cagttaatgtgccaaa

SEQ ID NO: 5478196 - DNA, 17 bp, Homo sapiens
cagttaatgtgccaaaa

SEQ ID NO: 5478197 - DNA, 13 bp, Homo sapiens
cagttaattacat

SEQ ID NO: 5478198 - DNA, 20 bp, Homo sapiens
cagttaattccctgctaaat

SEQ ID NO: 5478199 - DNA, 13 bp, Homo sapiens
cagttaatttttc

SEQ ID NO: 5478200 - DNA, 14 bp, Homo sapiens
cagttacaaaaata

SEQ ID NO: 5478201 - DNA, 15 bp, Homo sapiens
cagttacaaaaatag

SEQ ID NO: 5478202 - DNA, 19 bp, Homo sapiens
cagttacaaattataatgt

SEQ ID NO: 5478203 - DNA, 17 bp, Homo sapiens
cagttacaagctttaaa

SEQ ID NO: 5478204 - DNA, 12 bp, Homo sapiens
cagttacacatg

SEQ ID NO: 5478205 - DNA, 13 bp, Homo sapiens
cagttacagaaag

SEQ ID NO: 5478206 - DNA, 23 bp, Homo sapiens
cagttacagcaggccagaaacat

SEQ ID NO: 5478207 - DNA, 13 bp, Homo sapiens
cagttacagctct

SEQ ID NO: 5478208 - DNA, 20 bp, Homo sapiens
cagttacagggcccaggtga

SEQ ID NO: 5478209 - DNA, 15 bp, Homo sapiens
cagttacaggggttg

SEQ ID NO: 5478210 - DNA, 20 bp, Homo sapiens
cagttacagtggcagtattg

SEQ ID NO: 5478211 - DNA, 19 bp, Homo sapiens
cagttaccattaaaccatc

SEQ ID NO: 5478212 - DNA, 21 bp, Homo sapiens
cagttacccactcggtcccag

SEQ ID NO: 5478213 - DNA, 21 bp, Homo sapiens
cagttacctccaaaaaagaaa

SEQ ID NO: 5478214 - DNA, 21 bp, Homo sapiens
cagttaccttaaagctgaatt

SEQ ID NO: 5478215 - DNA, 20 bp, Homo sapiens
cagttacctttgctgtcact

SEQ ID NO: 5478216 - DNA, 13 bp, Homo sapiens
cagttactatttt

SEQ ID NO: 5478217 - DNA, 14 bp, Homo sapiens
cagttactcagaat

SEQ ID NO: 5478218 - DNA, 15 bp, Homo sapiens
cagttactcaggagg

SEQ ID NO: 5478219 - DNA, 16 bp, Homo sapiens
cagttactcaggaggc

SEQ ID NO: 5478220 - DNA, 19 bp, Homo sapiens
cagttactccctacactga

SEQ ID NO: 5478221 - DNA, 23 bp, Homo sapiens
cagttactccctacactgatgca

SEQ ID NO: 5478222 - DNA, 13 bp, Homo sapiens
cagttactctgaa

SEQ ID NO: 5478223 - DNA, 15 bp, Homo sapiens
cagttactctgaagg

SEQ ID NO: 5478224 - DNA, 13 bp, Homo sapiens
cagttactggttt

SEQ ID NO: 5478225 - DNA, 15 bp, Homo sapiens
cagttactggtttca

SEQ ID NO: 5478226 - DNA, 13 bp, Homo sapiens
cagttactgttca

SEQ ID NO: 5478227 - DNA, 15 bp, Homo sapiens
cagttacttaagatt

SEQ ID NO: 5478228 - DNA, 15 bp, Homo sapiens
cagttacttaatgac

SEQ ID NO: 5478229 - DNA, 16 bp, Homo sapiens
cagttacttacacacc

SEQ ID NO: 5478230 - DNA, 16 bp, Homo sapiens
cagttacttttttaca

SEQ ID NO: 5478231 - DNA, 13 bp, Homo sapiens
cagttagactagt

SEQ ID NO: 5478232 - DNA, 14 bp, Homo sapiens
cagttagactcaaa

SEQ ID NO: 5478233 - DNA, 17 bp, Homo sapiens
cagttagagatgcctcc

SEQ ID NO: 5478234 - DNA, 20 bp, Homo sapiens
cagttagagcagcctcgtgg

SEQ ID NO: 5478235 - DNA, 22 bp, Homo sapiens
cagttagagcagcctcgtggag

SEQ ID NO: 5478236 - DNA, 23 bp, Homo sapiens
cagttagagcccattaatcttga

SEQ ID NO: 5478237 - DNA, 21 bp, Homo sapiens
cagttagcagggatgttcctt

SEQ ID NO: 5478238 - DNA, 22 bp, Homo sapiens
cagttagccccagaaaatgaaa

SEQ ID NO: 5478239 - DNA, 19 bp, Homo sapiens
cagttagcccggccaagga

SEQ ID NO: 5478240 - DNA, 22 bp, Homo sapiens
cagttagggttttgcaataact

SEQ ID NO: 5478241 - DNA, 23 bp, Homo sapiens
cagttagggttttgcaataactt

SEQ ID NO: 5478242 - DNA, 20 bp, Homo sapiens
cagttaggtgctgaatgaag

SEQ ID NO: 5478243 - DNA, 17 bp, Homo sapiens
cagttagtaatggtgct

SEQ ID NO: 5478244 - DNA, 23 bp, Homo sapiens
cagttagtatagctttatactct

SEQ ID NO: 5478245 - DNA, 20 bp, Homo sapiens
cagttagttgtgaaagaaag

SEQ ID NO: 5478246 - DNA, 17 bp, Homo sapiens
cagttataaaattaaaa

SEQ ID NO: 5478247 - DNA, 15 bp, Homo sapiens
cagttataaagaaag

SEQ ID NO: 5478248 - DNA, 15 bp, Homo sapiens
cagttataagcgtat

SEQ ID NO: 5478249 - DNA, 12 bp, Homo sapiens
cagttataatta

SEQ ID NO: 5478250 - DNA, 20 bp, Homo sapiens
cagttatacagttataaaat

SEQ ID NO: 5478251 - DNA, 14 bp, Homo sapiens
cagtttatcattca

SEQ ID NO: 5478252 - DNA, 15 bp, Homo sapiens
cagtttatcattcaa

SEQ ID NO: 5478253 - DNA, 21 bp, Homo sapiens
cagtttatcctgacatattca

SEQ ID NO: 5478254 - DNA, 13 bp, Homo sapiens
cagtttatcctgt

SEQ ID NO: 5478255 - DNA, 20 bp, Homo sapiens
cagtttatgcagtgctgctt

SEQ ID NO: 5478256 - DNA, 22 bp, Homo sapiens
cagtttatggatatgctgcttt

SEQ ID NO: 5478257 - DNA, 19 bp, Homo sapiens
cagtttatgttttggtcca

SEQ ID NO: 5478258 - DNA, 18 bp, Homo sapiens
cagtttattccagagctg

SEQ ID NO: 5478259 - DNA, 18 bp, Homo sapiens
cagtttattctgtggttc

SEQ ID NO: 5478260 - DNA, 22 bp, Homo sapiens
cagtttattctgtggttctata

SEQ ID NO: 5478261 - DNA, 14 bp, Homo sapiens
cagtttattgatat

SEQ ID NO: 5478262 - DNA, 13 bp, Homo sapiens
cagtttattttct

SEQ ID NO: 5478263 - DNA, 18 bp, Homo sapiens
cagtttatttttaaagat

SEQ ID NO: 5478264 - DNA, 18 bp, Homo sapiens
cagtttcaataaagtttg

SEQ ID NO: 5478265 - DNA, 24 bp, Homo sapiens
cagtttcaccatctttgaggtgag

SEQ ID NO: 5478266 - DNA, 20 bp, Homo sapiens
cagtttcactccctcttggt

SEQ ID NO: 5478267 - DNA, 23 bp, Homo sapiens
cagtttcactttcacatagatgt

SEQ ID NO: 5478268 - DNA, 14 bp, Homo sapiens
cagtttcactttgg

SEQ ID NO: 5478269 - DNA, 14 bp, Homo sapiens
cagtttcagaagca

SEQ ID NO: 5478270 - DNA, 19 bp, Homo sapiens
cagtttcagaagcaggcag

SEQ ID NO: 5478271 - DNA, 17 bp, Homo sapiens
cagtttcagagatggac

SEQ ID NO: 5478272 - DNA, 13 bp, Homo sapiens
cagtttcaggctt

SEQ ID NO: 5478273 - DNA, 13 bp, Homo sapiens
cagtttccaaatt

SEQ ID NO: 5478274 - DNA, 12 bp, Homo sapiens
cagtttccagtc

SEQ ID NO: 5478275 - DNA, 18 bp, Homo sapiens
cagtttccagtcatggcc

SEQ ID NO: 5478276 - DNA, 13 bp, Homo sapiens
cagtttcccagaa

SEQ ID NO: 5478277 - DNA, 11 bp, Homo sapiens
cagtttcccca

SEQ ID NO: 5478278 - DNA, 19 bp, Homo sapiens
cagtttcccttctatgcag

SEQ ID NO: 5478279 - DNA, 17 bp, Homo sapiens
cagtttccgaatctctt

SEQ ID NO: 5478280 - DNA, 22 bp, Homo sapiens
cagtttcctcagtgatggaata

SEQ ID NO: 5478281 - DNA, 14 bp, Homo sapiens
cagtttccttggga

SEQ ID NO: 5478282 - DNA, 14 bp, Homo sapiens
cagtttctaaaatt

SEQ ID NO: 5478283 - DNA, 17 bp, Homo sapiens
cagtttctaaactggag

SEQ ID NO: 5478284 - DNA, 18 bp, Homo sapiens
cagtttctaaactggaga

SEQ ID NO: 5478285 - DNA, 20 bp, Homo sapiens
cagtttctaaactggagact

SEQ ID NO: 5478286 - DNA, 18 bp, Homo sapiens
cagtttctgttgtttctt

SEQ ID NO: 5478287 - DNA, 22 bp, Homo sapiens
cagtttcttacaaataaagttt

SEQ ID NO: 5478288 - DNA, 18 bp, Homo sapiens
cagtttcttagcttttta

SEQ ID NO: 5478289 - DNA, 17 bp, Homo sapiens
cagtttcttctgtaaat

SEQ ID NO: 5478290 - DNA, 22 bp, Homo sapiens
cagtttcttgaagtccagtgtt

SEQ ID NO: 5478291 - DNA, 23 bp, Homo sapiens
cagtttcttgcaagctccagtag

SEQ ID NO: 5478292 - DNA, 14 bp, Homo sapiens
cagtttcttgtgta

SEQ ID NO: 5478293 - DNA, 17 bp, Homo sapiens
cagtttcttgtgtagat

SEQ ID NO: 5478294 - DNA, 23 bp, Homo sapiens
cagtttcttttcacattaggctg

SEQ ID NO: 5478295 - DNA, 17 bp, Homo sapiens
cagtttgaaattctgaa

SEQ ID NO: 5478296 - DNA, 22 bp, Homo sapiens
cagtttgaaattctgaatttgc

SEQ ID NO: 5478297 - DNA, 13 bp, Homo sapiens
cagtttgaacaaa

SEQ ID NO: 5478298 - DNA, 20 bp, Homo sapiens
cagtttgactttttggaatt

SEQ ID NO: 5478299 - DNA, 19 bp, Homo sapiens
cagtttgagaccagcctgg

SEQ ID NO: 5478300 - DNA, 20 bp, Homo sapiens
cagtttgagaccagcctggg

SEQ ID NO: 5478301 - DNA, 21 bp, Homo sapiens
cagtttgagcttgctggagag

SEQ ID NO: 5478302 - DNA, 23 bp, Homo sapiens
cagtttgaggaagtggctgtccc

SEQ ID NO: 5478303 - DNA, 20 bp, Homo sapiens
cagtttgataactagggaag

SEQ ID NO: 5478304 - DNA, 21 bp, Homo sapiens
cagtttgatcacactatttta

SEQ ID NO: 5478305 - DNA, 12 bp, Homo sapiens
cagtttgatgct

SEQ ID NO: 5478306 - DNA, 16 bp, Homo sapiens
cagtttgcaaatagaa

SEQ ID NO: 5478307 - DNA, 18 bp, Homo sapiens
cagtttgcacctgtcccc

SEQ ID NO: 5478308 - DNA, 21 bp, Homo sapiens
cagtttgcagaaaagcacctg

SEQ ID NO: 5478309 - DNA, 22 bp, Homo sapiens
cagtttgcagaaaagcacctgc

SEQ ID NO: 5478310 - DNA, 12 bp, Homo sapiens
cagtttgcatga

SEQ ID NO: 5478311 - DNA, 15 bp, Homo sapiens
cagtttgcatgattc

SEQ ID NO: 5478312 - DNA, 13 bp, Homo sapiens
cagtttgcctctg

SEQ ID NO: 5478313 - DNA, 18 bp, Homo sapiens
cagtttgcctgctgtatt

SEQ ID NO: 5478314 - DNA, 19 bp, Homo sapiens
cagtttgctatttgcttta

SEQ ID NO: 5478315 - DNA, 21 bp, Homo sapiens
cagtttgcttagttctcactg

SEQ ID NO: 5478316 - DNA, 16 bp, Homo sapiens
cagtttgctttgccct

SEQ ID NO: 5478317 - DNA, 13 bp, Homo sapiens
cagtttggaatta

SEQ ID NO: 5478318 - DNA, 13 bp, Homo sapiens
cagtttggccctg

SEQ ID NO: 5478319 - DNA, 17 bp, Homo sapiens
cagtttggccctggagc

SEQ ID NO: 5478320 - DNA, 19 bp, Homo sapiens
cagtttggccctggagcca

SEQ ID NO: 5478321 - DNA, 22 bp, Homo sapiens
cagtttggccctggagccaggg

SEQ ID NO: 5478322 - DNA, 20 bp, Homo sapiens
cagtttggctgtaatttaat

SEQ ID NO: 5478323 - DNA, 18 bp, Homo sapiens
cagtttggtagtgcccca

SEQ ID NO: 5478324 - DNA, 16 bp, Homo sapiens
cagtttggtatttgcg

SEQ ID NO: 5478325 - DNA, 13 bp, Homo sapiens
cagtttggttggg

SEQ ID NO: 5478326 - DNA, 13 bp, Homo sapiens
cagtttgtaaagt

SEQ ID NO: 5478327 - DNA, 17 bp, Homo sapiens
cagtttgtaaatgttat

SEQ ID NO: 5478328 - DNA, 21 bp, Homo sapiens
cagtttgtaaatgttatttct

SEQ ID NO: 5478329 - DNA, 21 bp, Homo sapiens
cagtttgtacagacgtatgct

SEQ ID NO: 5478330 - DNA, 18 bp, Homo sapiens
cagtttgtagtgccactg

SEQ ID NO: 5478331 - DNA, 13 bp, Homo sapiens
cagtttgtcagac

SEQ ID NO: 5478332 - DNA, 17 bp, Homo sapiens
cagtttgtccacacaag

SEQ ID NO: 5478333 - DNA, 22 bp, Homo sapiens
cagtttgtccacacaagacagc

SEQ ID NO: 5478334 - DNA, 16 bp, Homo sapiens
cagtttgtcttggata

SEQ ID NO: 5478335 - DNA, 12 bp, Homo sapiens
cagtttgtgaac

SEQ ID NO: 5478336 - DNA, 18 bp, Homo sapiens
cagtttgtgaagtgattg

SEQ ID NO: 5478337 - DNA, 12 bp, Homo sapiens
cagtttgtgaat

SEQ ID NO: 5478338 - DNA, 12 bp, Homo sapiens
cagtttgtgatc

SEQ ID NO: 5478339 - DNA, 16 bp, Homo sapiens
cagtttgtgatttcta

SEQ ID NO: 5478340 - DNA, 20 bp, Homo sapiens
cagtttgtggcatcttgcca

SEQ ID NO: 5478341 - DNA, 16 bp, Homo sapiens
cagtttgtgttttaaa

SEQ ID NO: 5478342 - DNA, 22 bp, Homo sapiens
cagtttgtgttttaaaaaaact

SEQ ID NO: 5478343 - DNA, 13 bp, Homo sapiens
cagtttgttcagt

SEQ ID NO: 5478344 - DNA, 18 bp, Homo sapiens
cagtttgttcagtgaggt

SEQ ID NO: 5478345 - DNA, 19 bp, Homo sapiens
cagtttgttccttttgtac

SEQ ID NO: 5478346 - DNA, 13 bp, Homo sapiens
cagtttgtttaca

SEQ ID NO: 5478347 - DNA, 14 bp, Homo sapiens
cagtttgtttacac

SEQ ID NO: 5478348 - DNA, 18 bp, Homo sapiens
cagtttgtttacacacgt

SEQ ID NO: 5478349 - DNA, 12 bp, Homo sapiens
cagtttgtttcc

SEQ ID NO: 5478350 - DNA, 14 bp, Homo sapiens
cagtttgtttcctg

SEQ ID NO: 5478351 - DNA, 19 bp, Homo sapiens
cagtttgtttcctgtctga

SEQ ID NO: 5478352 - DNA, 14 bp, Homo sapiens
cagttttaacaaat

SEQ ID NO: 5478353 - DNA, 16 bp, Homo sapiens
cagttttaactagaat

SEQ ID NO: 5478354 - DNA, 17 bp, Homo sapiens
cagttttaataagaaca

SEQ ID NO: 5478355 - DNA, 22 bp, Homo sapiens
cagttttaataagaacagatca

SEQ ID NO: 5478356 - DNA, 13 bp, Homo sapiens
cagttttagaata

SEQ ID NO: 5478357 - DNA, 15 bp, Homo sapiens
cagttttatgctctt

SEQ ID NO: 5478358 - DNA, 16 bp, Homo sapiens
cagttttatgctcttt

SEQ ID NO: 5478359 - DNA, 22 bp, Homo sapiens
cagttttcaagtcaaattaata

SEQ ID NO: 5478360 - DNA, 23 bp, Homo sapiens
cagttttcaagtcaaattaataa

SEQ ID NO: 5478361 - DNA, 13 bp, Homo sapiens
cagttttcagaaa

SEQ ID NO: 5478362 - DNA, 13 bp, Homo sapiens
cagttttcatagt

SEQ ID NO: 5478363 - DNA, 13 bp, Homo sapiens
cagttttccatga

SEQ ID NO: 5478364 - DNA, 15 bp, Homo sapiens
cagttttccatgaaa

SEQ ID NO: 5478365 - DNA, 17 bp, Homo sapiens
cagttttccatgaaaac

SEQ ID NO: 5478366 - DNA, 13 bp, Homo sapiens
cagttttccttct

SEQ ID NO: 5478367 - DNA, 22 bp, Homo sapiens
cagttttccttctcatctgtga

SEQ ID NO: 5478368 - DNA, 13 bp, Homo sapiens
cagttttcggaaa

SEQ ID NO: 5478369 - DNA, 20 bp, Homo sapiens
cagttttgacatcagccagc

SEQ ID NO: 5478370 - DNA, 20 bp, Homo sapiens
cagttttgacctaacatacc

SEQ ID NO: 5478371 - DNA, 13 bp, Homo sapiens
cagttttgctgct

SEQ ID NO: 5478372 - DNA, 11 bp, Homo sapiens
cagttttggaa

SEQ ID NO: 5478373 - DNA, 18 bp, Homo sapiens
cagttttggatcttttta

SEQ ID NO: 5478374 - DNA, 17 bp, Homo sapiens
cagttttggttgcttta

SEQ ID NO: 5478375 - DNA, 19 bp, Homo sapiens
cagttttggttgctttaat

SEQ ID NO: 5478376 - DNA, 12 bp, Homo sapiens
cagttttgtaaa

SEQ ID NO: 5478377 - DNA, 16 bp, Homo sapiens
cagttttgtaaatgta

SEQ ID NO: 5478378 - DNA, 18 bp, Homo sapiens
cagttttgtaagccctct

SEQ ID NO: 5478379 - DNA, 19 bp, Homo sapiens
cagttttgtaagccctctt

SEQ ID NO: 5478380 - DNA, 21 bp, Homo sapiens
cagttttgtggattaaacctt

SEQ ID NO: 5478381 - DNA, 18 bp, Homo sapiens
cagttttgtgtacagtat

SEQ ID NO: 5478382 - DNA, 14 bp, Homo sapiens
cagttttgtttagt

SEQ ID NO: 5478383 - DNA, 21 bp, Homo sapiens
cagttttgtttggaccaaaaa

SEQ ID NO: 5478384 - DNA, 16 bp, Homo sapiens
cagtttttaaaattgg

SEQ ID NO: 5478385 - DNA, 22 bp, Homo sapiens
cagtttttaactctactgtgta

SEQ ID NO: 5478386 - DNA, 13 bp, Homo sapiens
cagtttttataat

SEQ ID NO: 5478387 - DNA, 16 bp, Homo sapiens
cagtttttattaatct

SEQ ID NO: 5478388 - DNA, 12 bp, Homo sapiens
cagtttttcatt

SEQ ID NO: 5478389 - DNA, 14 bp, Homo sapiens
cagtttttcatttg

SEQ ID NO: 5478390 - DNA, 15 bp, Homo sapiens
cagtttttcatttgt

SEQ ID NO: 5478391 - DNA, 16 bp, Homo sapiens
cagtttttcatttgtt

SEQ ID NO: 5478392 - DNA, 20 bp, Homo sapiens
cagtttttcattttaaaaag

SEQ ID NO: 5478393 - DNA, 20 bp, Homo sapiens
cagtttttcggtgggacagc

SEQ ID NO: 5478394 - DNA, 16 bp, Homo sapiens
cagtttttcttaatat

SEQ ID NO: 5478395 - DNA, 19 bp, Homo sapiens
cagtttttgctgattgcta

SEQ ID NO: 5478396 - DNA, 21 bp, Homo sapiens
cagtttttgtaaagcccttgc

SEQ ID NO: 5478397 - DNA, 13 bp, Homo sapiens
cagtttttgtgtt

SEQ ID NO: 5478398 - DNA, 20 bp, Homo sapiens
cagtttttgttccttcctgc

SEQ ID NO: 5478399 - DNA, 21 bp, Homo sapiens
cagtttttgttccttcctgcg

SEQ ID NO: 5478400 - DNA, 23 bp, Homo sapiens
cagtttttgtttttgcatgaaat

SEQ ID NO: 5478401 - DNA, 23 bp, Homo sapiens
cagttttttcacctccatgtcat

SEQ ID NO: 5478402 - DNA, 20 bp, Homo sapiens
cagttttttgccactgcaaa

SEQ ID NO: 5478403 - DNA, 17 bp, Homo sapiens
cagttttttggaagaaa

SEQ ID NO: 5478404 - DNA, 13 bp, Homo sapiens
cagttttttgttg

SEQ ID NO: 5478405 - DNA, 21 bp, Homo sapiens
cagtttttttatggcattttt

SEQ ID NO: 5478406 - DNA, 19 bp, Homo sapiens
cagtttttttccttcaaga

SEQ ID NO: 5478407 - DNA, 20 bp, Homo sapiens
cagttttttttttcttgtct

SEQ ID NO: 5478408 - DNA, 13 bp, Homo sapiens
cataaaaaaatga

SEQ ID NO: 5478409 - DNA, 17 bp, Homo sapiens
cataaaaaagaagcact

SEQ ID NO: 5478410 - DNA, 20 bp, Homo sapiens
cataaaaaagaagcactttg

SEQ ID NO: 5478411 - DNA, 18 bp, Homo sapiens
cataaaaaataacaactg

SEQ ID NO: 5478412 - DNA, 23 bp, Homo sapiens
cataaaaacaactttatacccag

SEQ ID NO: 5478413 - DNA, 19 bp, Homo sapiens
cataaaaacattttaaaaa

SEQ ID NO: 5478414 - DNA, 13 bp, Homo sapiens
cataaaaaccaaa

SEQ ID NO: 5478415 - DNA, 14 bp, Homo sapiens
cataaaaaccaaac

SEQ ID NO: 5478416 - DNA, 22 bp, Homo sapiens
cataaaaactactgaataaatc

SEQ ID NO: 5478417 - DNA, 19 bp, Homo sapiens
cataaaaaggacatcagca

SEQ ID NO: 5478418 - DNA, 15 bp, Homo sapiens
cataaaaatgatcta

SEQ ID NO: 5478419 - DNA, 21 bp, Homo sapiens
cataaaacaaaaccaagcctt

SEQ ID NO: 5478420 - DNA, 23 bp, Homo sapiens
cataaaacaaaaccaagccttgg

SEQ ID NO: 5478421 - DNA, 17 bp, Homo sapiens
cataaaacattaagaaa

SEQ ID NO: 5478422 - DNA, 19 bp, Homo sapiens
cataaaacattaagaaaat

SEQ ID NO: 5478423 - DNA, 23 bp, Homo sapiens
cataaaacattaagaaaatcata

SEQ ID NO: 5478424 - DNA, 17 bp, Homo sapiens
cataaaacggtgctttc

SEQ ID NO: 5478425 - DNA, 22 bp, Homo sapiens
cataaaacggtgctttctgtga

SEQ ID NO: 5478426 - DNA, 16 bp, Homo sapiens
cataaaactttaaaag

SEQ ID NO: 5478427 - DNA, 20 bp, Homo sapiens
cataaaactttaaaaggcaa

SEQ ID NO: 5478428 - DNA, 10 bp, Homo sapiens
cataaaagaa

SEQ ID NO: 5478429 - DNA, 20 bp, Homo sapiens
ctaaccctgggctccctgga

SEQ ID NO: 5478430 - DNA, 13 bp, Homo sapiens
ctaaccctgtgga

SEQ ID NO: 5478431 - DNA, 14 bp, Homo sapiens
ctaaccctgtggaa

SEQ ID NO: 5478432 - DNA, 15 bp, Homo sapiens
ctaaccctgtggaag

SEQ ID NO: 5478433 - DNA, 19 bp, Homo sapiens
ctaacccttatcaccagct

SEQ ID NO: 5478434 - DNA, 19 bp, Homo sapiens
ctaacccttcaaccccctc

SEQ ID NO: 5478435 - DNA, 13 bp, Homo sapiens
ctaacctcagcca

SEQ ID NO: 5478436 - DNA, 13 bp, Homo sapiens
ctaacctccttta

SEQ ID NO: 5478437 - DNA, 17 bp, Homo sapiens
ctaacctcgggcctgct

SEQ ID NO: 5478438 - DNA, 20 bp, Homo sapiens
ctaacctctaaccctcattg

SEQ ID NO: 5478439 - DNA, 21 bp, Homo sapiens
ctaacctctaaccctcattgc

SEQ ID NO: 5478440 - DNA, 13 bp, Homo sapiens
ctaacctgacaga

SEQ ID NO: 5478441 - DNA, 18 bp, Homo sapiens
ctaacctggacctggaac

SEQ ID NO: 5478442 - DNA, 17 bp, Homo sapiens
ctaacctggagacagta

SEQ ID NO: 5478443 - DNA, 14 bp, Homo sapiens
ctaacctggcttat

SEQ ID NO: 5478444 - DNA, 12 bp, Homo sapiens
ctaacctgggac

SEQ ID NO: 5478445 - DNA, 13 bp, Homo sapiens
ctaacctgggacc

SEQ ID NO: 5478446 - DNA, 16 bp, Homo sapiens
ctaaccttgcctggta

SEQ ID NO: 5478447 - DNA, 17 bp, Homo sapiens
ctaaccttgcctggtac

SEQ ID NO: 5478448 - DNA, 20 bp, Homo sapiens
ctaaccttgcctggtacagt

SEQ ID NO: 5478449 - DNA, 20 bp, Homo sapiens
ctaacgaagtatccttcagc

SEQ ID NO: 5478450 - DNA, 21 bp, Homo sapiens
ctaacgaccgacgcccctccg

SEQ ID NO: 5478451 - DNA, 18 bp, Homo sapiens
ctaacgcaaaaatagctc

SEQ ID NO: 5478452 - DNA, 21 bp, Homo sapiens
ctaacgcaaaaatagctcttg

SEQ ID NO: 5478453 - DNA, 22 bp, Homo sapiens
ctaacgcaaaaatagctcttgc

SEQ ID NO: 5478454 - DNA, 23 bp, Homo sapiens
ctaacgcaaaaatagctcttgct

SEQ ID NO: 5478455 - DNA, 12 bp, Homo sapiens
ctaacgcctgag

SEQ ID NO: 5478456 - DNA, 14 bp, Homo sapiens
ctaacgcctgagcc

SEQ ID NO: 5478457 - DNA, 15 bp, Homo sapiens
ctaacgcctgagccc

SEQ ID NO: 5478458 - DNA, 20 bp, Homo sapiens
ctaacgcctgagcccaggga

SEQ ID NO: 5478459 - DNA, 21 bp, Homo sapiens
ctaacgcctgagcccagggag

SEQ ID NO: 5478460 - DNA, 20 bp, Homo sapiens
ctaacggccgtctgctctca

SEQ ID NO: 5478461 - DNA, 16 bp, Homo sapiens
ctaacgggaggctggg

SEQ ID NO: 5478462 - DNA, 19 bp, Homo sapiens
ctaacgggaggctgggcac

SEQ ID NO: 5478463 - DNA, 20 bp, Homo sapiens
ctaacgggaggctgggcaca

SEQ ID NO: 5478464 - DNA, 20 bp, Homo sapiens
ctaacgttttctactttgaa

SEQ ID NO: 5478465 - DNA, 22 bp, Homo sapiens
ctaacgttttctactttgaaat

SEQ ID NO: 5478466 - DNA, 13 bp, Homo sapiens
ctaactaaactaa

SEQ ID NO: 5478467 - DNA, 19 bp, Homo sapiens
ctaactaaactctctttgg

SEQ ID NO: 5478468 - DNA, 16 bp, Homo sapiens
ctaactaaataccatt

SEQ ID NO: 5478469 - DNA, 21 bp, Homo sapiens
ctaactaaccacattttagga

SEQ ID NO: 5478470 - DNA, 14 bp, Homo sapiens
ctaactaattctgt

SEQ ID NO: 5478471 - DNA, 19 bp, Homo sapiens
ctaactacaaaggtttaaa

SEQ ID NO: 5478472 - DNA, 23 bp, Homo sapiens
ctaactacaaaggtttaaatgaa

SEQ ID NO: 5478473 - DNA, 21 bp, Homo sapiens
ctaactagacaccaaagttct

SEQ ID NO: 5478474 - DNA, 22 bp, Homo sapiens
ctaactagacaccaaagttcta

SEQ ID NO: 5478475 - DNA, 20 bp, Homo sapiens
ctaactagagcagccctgga

SEQ ID NO: 5478476 - DNA, 14 bp, Homo sapiens
ctaactcaaggaat

SEQ ID NO: 5478477 - DNA, 14 bp, Homo sapiens
ctaactccctcctc

SEQ ID NO: 5478478 - DNA, 14 bp, Homo sapiens
ctaactccgagagc

SEQ ID NO: 5478479 - DNA, 24 bp, Homo sapiens
ctaactcctataaagtgcctcgga

SEQ ID NO: 5478480 - DNA, 22 bp, Homo sapiens
ctaactcctgccattcttctgg

SEQ ID NO: 5478481 - DNA, 15 bp, Homo sapiens
ctaactccttatgtt

SEQ ID NO: 5478482 - DNA, 14 bp, Homo sapiens
ctaactctgatgta

SEQ ID NO: 5478483 - DNA, 21 bp, Homo sapiens
ctaactctgatgtaaatgaag

SEQ ID NO: 5478484 - DNA, 19 bp, Homo sapiens
ctaactctgcccaccctcc

SEQ ID NO: 5478485 - DNA, 14 bp, Homo sapiens
ctaactcttgctca

SEQ ID NO: 5478486 - DNA, 15 bp, Homo sapiens
ctaactcttgctcac

SEQ ID NO: 5478487 - DNA, 16 bp, Homo sapiens
ctaactcttgctcact

SEQ ID NO: 5478488 - DNA, 19 bp, Homo sapiens
ctaactcttttctattttg

SEQ ID NO: 5478489 - DNA, 22 bp, Homo sapiens
ctaactgattcagggcccctga

SEQ ID NO: 5478490 - DNA, 15 bp, Homo sapiens
ctaactgcatacact

SEQ ID NO: 5478491 - DNA, 23 bp, Homo sapiens
ctaactggacagcctcttctgtc

SEQ ID NO: 5478492 - DNA, 17 bp, Homo sapiens
ctaactggacatgaagg

SEQ ID NO: 5478493 - DNA, 13 bp, Homo sapiens
ctaactggcccca

SEQ ID NO: 5478494 - DNA, 16 bp, Homo sapiens
ctaactggccccaggc

SEQ ID NO: 5478495 - DNA, 15 bp, Homo sapiens
ctaactgggaagaac

SEQ ID NO: 5478496 - DNA, 18 bp, Homo sapiens
ctaactgggaagaacaag

SEQ ID NO: 5478497 - DNA, 19 bp, Homo sapiens
ctaactgggaggacattct

SEQ ID NO: 5478498 - DNA, 17 bp, Homo sapiens
ctaactgggttaaatat

SEQ ID NO: 5478499 - DNA, 23 bp, Homo sapiens
ctaactgggttaaatattttgct

SEQ ID NO: 5478500 - DNA, 12 bp, Homo sapiens
ctaactgtaaat

SEQ ID NO: 5478501 - DNA, 17 bp, Homo sapiens
ctaactgtaaatcactt

SEQ ID NO: 5478502 - DNA, 18 bp, Homo sapiens
ctaactgtaaatcacttg

SEQ ID NO: 5478503 - DNA, 18 bp, Homo sapiens
ctaactgtaaatcatgtt

SEQ ID NO: 5478504 - DNA, 10 bp, Homo sapiens
ctaactgtat

SEQ ID NO: 5478505 - DNA, 14 bp, Homo sapiens
ctaactgtatgtgt

SEQ ID NO: 5478506 - DNA, 20 bp, Homo sapiens
ctaactgtgacaaagaagac

SEQ ID NO: 5478507 - DNA, 13 bp, Homo sapiens
ctaactgtgattt

SEQ ID NO: 5478508 - DNA, 20 bp, Homo sapiens
ctaactgtgctcaagaggtt

SEQ ID NO: 5478509 - DNA, 18 bp, Homo sapiens
ctaactgtggaatataaa

SEQ ID NO: 5478510 - DNA, 20 bp, Homo sapiens
ctaactgtggaatataaata

SEQ ID NO: 5478511 - DNA, 22 bp, Homo sapiens
ctaactgtggaatataaatagc

SEQ ID NO: 5478512 - DNA, 23 bp, Homo sapiens
ctaactgtggaatataaatagct

SEQ ID NO: 5478513 - DNA, 20 bp, Homo sapiens
ctaactgttcccttatctgt

SEQ ID NO: 5478514 - DNA, 16 bp, Homo sapiens
ctaacttacaaactgg

SEQ ID NO: 5478515 - DNA, 20 bp, Homo sapiens
ctaacttacaaactggtttg

SEQ ID NO: 5478516 - DNA, 21 bp, Homo sapiens
ctaacttacaaagattctcta

SEQ ID NO: 5478517 - DNA, 22 bp, Homo sapiens
ctaacttattttatttccatca

SEQ ID NO: 5478518 - DNA, 16 bp, Homo sapiens
ctaacttcaccatatt

SEQ ID NO: 5478519 - DNA, 17 bp, Homo sapiens
ctaacttcctgtgcctt

SEQ ID NO: 5478520 - DNA, 16 bp, Homo sapiens
ctaacttcgaatatat

SEQ ID NO: 5478521 - DNA, 18 bp, Homo sapiens
ctaacttctaaaactgta

SEQ ID NO: 5478522 - DNA, 19 bp, Homo sapiens
ctaacttcttccacttttt

SEQ ID NO: 5478523 - DNA, 19 bp, Homo sapiens
ctaacttgcttaaatgtga

SEQ ID NO: 5478524 - DNA, 20 bp, Homo sapiens
ctaacttggagccccagtgc

SEQ ID NO: 5478525 - DNA, 21 bp, Homo sapiens
ctaacttggagccccagtgcc

SEQ ID NO: 5478526 - DNA, 22 bp, Homo sapiens
ctaacttggagccccagtgcca

SEQ ID NO: 5478527 - DNA, 22 bp, Homo sapiens
ctaacttgtctttggaccctga

SEQ ID NO: 5478528 - DNA, 12 bp, Homo sapiens
ctaactttcttg

SEQ ID NO: 5478529 - DNA, 14 bp, Homo sapiens
ctaactttggtttt

SEQ ID NO: 5478530 - DNA, 13 bp, Homo sapiens
ctaacttttgtgt

SEQ ID NO: 5478531 - DNA, 18 bp, Homo sapiens
ctaagaaaaaaagcacaa

SEQ ID NO: 5478532 - DNA, 22 bp, Homo sapiens
ctaagaaaaaaagcacaaagtt

SEQ ID NO: 5478533 - DNA, 15 bp, Homo sapiens
ctaagaaaaaggaaa

SEQ ID NO: 5478534 - DNA, 15 bp, Homo sapiens
ctaagaaaagatttt

SEQ ID NO: 5478535 - DNA, 13 bp, Homo sapiens
ctaagaaaatgta

SEQ ID NO: 5478536 - DNA, 13 bp, Homo sapiens
ctaagaaacattg

SEQ ID NO: 5478537 - DNA, 22 bp, Homo sapiens
ctaagaaacattggaagcaggt

SEQ ID NO: 5478538 - DNA, 15 bp, Homo sapiens
ctaagaaaccccagg

SEQ ID NO: 5478539 - DNA, 16 bp, Homo sapiens
ctaagaaacttttgta

SEQ ID NO: 5478540 - DNA, 11 bp, Homo sapiens
ctaagaaagaa

SEQ ID NO: 5478541 - DNA, 17 bp, Homo sapiens
ctaagaaagaaaggaaa

SEQ ID NO: 5478542 - DNA, 23 bp, Homo sapiens
ctaagaaagaaaggaaagaagga

SEQ ID NO: 5478543 - DNA, 12 bp, Homo sapiens
ctaagaaagaac

SEQ ID NO: 5478544 - DNA, 16 bp, Homo sapiens
ctaagaaagaggagtg

SEQ ID NO: 5478545 - DNA, 21 bp, Homo sapiens
ctaagaaagaggagtgcttgt

SEQ ID NO: 5478546 - DNA, 19 bp, Homo sapiens
ctaagaaatatctgtgaaa

SEQ ID NO: 5478547 - DNA, 17 bp, Homo sapiens
ctaagaaatatgtgaga

SEQ ID NO: 5478548 - DNA, 20 bp, Homo sapiens
ctaagaaatatgtgagattt

SEQ ID NO: 5478549 - DNA, 21 bp, Homo sapiens
ctaagaaatatgtgagatttt

SEQ ID NO: 5478550 - DNA, 22 bp, Homo sapiens
ctaagaaatcaagtaatgaatc

SEQ ID NO: 5478551 - DNA, 15 bp, Homo sapiens
ctaagaaatcatgtg

SEQ ID NO: 5478552 - DNA, 16 bp, Homo sapiens
ctaagaaatgctgaaa

SEQ ID NO: 5478553 - DNA, 21 bp, Homo sapiens
ctaagaaattgaatactttga

SEQ ID NO: 5478554 - DNA, 14 bp, Homo sapiens
ctaagaacctggaa

SEQ ID NO: 5478555 - DNA, 14 bp, Homo sapiens
ctaagaagaaggcc

SEQ ID NO: 5478556 - DNA, 21 bp, Homo sapiens
ctaagaagaaggccagagagg

SEQ ID NO: 5478557 - DNA, 14 bp, Homo sapiens
ctaagaagacattt

SEQ ID NO: 5478558 - DNA, 20 bp, Homo sapiens
ctaagaagacattttgttac

SEQ ID NO: 5478559 - DNA, 20 bp, Homo sapiens
ctaagaagatgttttgaaat

SEQ ID NO: 5478560 - DNA, 17 bp, Homo sapiens
ctaagaagctgcaataa

SEQ ID NO: 5478561 - DNA, 19 bp, Homo sapiens
ctaagaagctgcaataaag

SEQ ID NO: 5478562 - DNA, 22 bp, Homo sapiens
ctaagaagtacattgttacctc

SEQ ID NO: 5478563 - DNA, 17 bp, Homo sapiens
ctaagaagttattttct

SEQ ID NO: 5478564 - DNA, 18 bp, Homo sapiens
ctaagaagttattttctt

SEQ ID NO: 5478565 - DNA, 21 bp, Homo sapiens
ctaagaagttcaccagccctg

SEQ ID NO: 5478566 - DNA, 23 bp, Homo sapiens
ctaagaagttcaccagccctgag

SEQ ID NO: 5478567 - DNA, 13 bp, Homo sapiens
ctaagaagtttaa

SEQ ID NO: 5478568 - DNA, 17 bp, Homo sapiens
ctaagaataacaagaag

SEQ ID NO: 5478569 - DNA, 22 bp, Homo sapiens
ctaagaataacaagaagcccag

SEQ ID NO: 5478570 - DNA, 21 bp, Homo sapiens
ctaagaatagactaagtttgt

SEQ ID NO: 5478571 - DNA, 18 bp, Homo sapiens
ctaagaatgcattattga

SEQ ID NO: 5478572 - DNA, 13 bp, Homo sapiens
ctaagaattccca

SEQ ID NO: 5478573 - DNA, 15 bp, Homo sapiens
ctaagaatttagagg

SEQ ID NO: 5478574 - DNA, 19 bp, Homo sapiens
ctaagaatttcactgtctt

SEQ ID NO: 5478575 - DNA, 21 bp, Homo sapiens
ctaagaattttgttttacttt

SEQ ID NO: 5478576 - DNA, 22 bp, Homo sapiens
ctaagaattttgttttactttt

SEQ ID NO: 5478577 - DNA, 14 bp, Homo sapiens
ctaagacaaatgca

SEQ ID NO: 5478578 - DNA, 15 bp, Homo sapiens
ctaagacacaaatgc

SEQ ID NO: 5478579 - DNA, 13 bp, Homo sapiens
ctaagacatgtga

SEQ ID NO: 5478580 - DNA, 14 bp, Homo sapiens
ctaagacatttttc

SEQ ID NO: 5478581 - DNA, 14 bp, Homo sapiens
ctaagaccctgtgt

SEQ ID NO: 5478582 - DNA, 19 bp, Homo sapiens
ctaagaccctgtgtcctcc

SEQ ID NO: 5478583 - DNA, 13 bp, Homo sapiens
ctaagacctcccc

SEQ ID NO: 5478584 - DNA, 23 bp, Homo sapiens
ctaagacctccccacccccgctg

SEQ ID NO: 5478585 - DNA, 18 bp, Homo sapiens
ctaagactaacaaaggca

SEQ ID NO: 5478586 - DNA, 21 bp, Homo sapiens
ctaagactaacaaaggcagct

SEQ ID NO: 5478587 - DNA, 22 bp, Homo sapiens
ctaagactaacaaaggcagctg

SEQ ID NO: 5478588 - DNA, 23 bp, Homo sapiens
ctaagactaacaaaggcagctgt

SEQ ID NO: 5478589 - DNA, 22 bp, Homo sapiens
ctaagactatatatataaatgt

SEQ ID NO: 5478590 - DNA, 13 bp, Homo sapiens
ctaagactcaaat

SEQ ID NO: 5478591 - DNA, 16 bp, Homo sapiens
ctaagactcaaatgtt

SEQ ID NO: 5478592 - DNA, 12 bp, Homo sapiens
ctaagactcccg

SEQ ID NO: 5478593 - DNA, 22 bp, Homo sapiens
ctaagactcctcggcctggctc

SEQ ID NO: 5478594 - DNA, 23 bp, Homo sapiens
ctaagactcctcggcctggctcc

SEQ ID NO: 5478595 - DNA, 14 bp, Homo sapiens
ctaagactctgtgt

SEQ ID NO: 5478596 - DNA, 13 bp, Homo sapiens
ctaagactgcctt

SEQ ID NO: 5478597 - DNA, 14 bp, Homo sapiens
ctaagactgccttc

SEQ ID NO: 5478598 - DNA, 17 bp, Homo sapiens
ctaagacttactctaag

SEQ ID NO: 5478599 - DNA, 18 bp, Homo sapiens
ctaagacttactctaaga

SEQ ID NO: 5478600 - DNA, 22 bp, Homo sapiens
ctaagacttactctaagatctt

SEQ ID NO: 5478601 - DNA, 20 bp, Homo sapiens
ctaagacttcagtcctggtc

SEQ ID NO: 5478602 - DNA, 15 bp, Homo sapiens
ctaagactttactta

SEQ ID NO: 5478603 - DNA, 17 bp, Homo sapiens
ctaagagaaactgtgta

SEQ ID NO: 5478604 - DNA, 11 bp, Homo sapiens
ctaagagaagt

SEQ ID NO: 5478605 - DNA, 14 bp, Homo sapiens
ctaagagagagaga

SEQ ID NO: 5478606 - DNA, 16 bp, Homo sapiens
ctaatattaaaagtca

SEQ ID NO: 5478607 - DNA, 16 bp, Homo sapiens
ctaatattaaaccttt

SEQ ID NO: 5478608 - DNA, 15 bp, Homo sapiens
ctaatattcacatgt

SEQ ID NO: 5478609 - DNA, 18 bp, Homo sapiens
ctaatattcatgctgcct

SEQ ID NO: 5478610 - DNA, 15 bp, Homo sapiens
ctaatattgcttctt

SEQ ID NO: 5478611 - DNA, 23 bp, Homo sapiens
ctaatattgcttcttgtgtttta

SEQ ID NO: 5478612 - DNA, 18 bp, Homo sapiens
ctaatatttaggcaagag

SEQ ID NO: 5478613 - DNA, 17 bp, Homo sapiens
ctaatatttattgcttt

SEQ ID NO: 5478614 - DNA, 14 bp, Homo sapiens
ctaatattttatgt

SEQ ID NO: 5478615 - DNA, 18 bp, Homo sapiens
ctaatattttatttgaaa

SEQ ID NO: 5478616 - DNA, 15 bp, Homo sapiens
ctaatatttttaaca

SEQ ID NO: 5478617 - DNA, 18 bp, Homo sapiens
ctaatatttttaacaagt

SEQ ID NO: 5478618 - DNA, 22 bp, Homo sapiens
ctaatcaaaaaggtctcaccac

SEQ ID NO: 5478619 - DNA, 13 bp, Homo sapiens
ctaatcaaagcca

SEQ ID NO: 5478620 - DNA, 16 bp, Homo sapiens
ctaatcaaagccaggg

SEQ ID NO: 5478621 - DNA, 21 bp, Homo sapiens
ctaatcaaattctgtctgggg

SEQ ID NO: 5478622 - DNA, 18 bp, Homo sapiens
ctaatcaagagtctctcc

SEQ ID NO: 5478623 - DNA, 16 bp, Homo sapiens
ctaatcaagtcaaatg

SEQ ID NO: 5478624 - DNA, 15 bp, Homo sapiens
ctaatcactctgagt

SEQ ID NO: 5478625 - DNA, 19 bp, Homo sapiens
ctaatcagcattctcactc

SEQ ID NO: 5478626 - DNA, 18 bp, Homo sapiens
ctaatcagctcccttccc

SEQ ID NO: 5478627 - DNA, 20 bp, Homo sapiens
ctaatcagggaggtcatttt

SEQ ID NO: 5478628 - DNA, 22 bp, Homo sapiens
ctaatcagtgattatttttcca

SEQ ID NO: 5478629 - DNA, 15 bp, Homo sapiens
ctaatcagtgtctca

SEQ ID NO: 5478630 - DNA, 16 bp, Homo sapiens
ctaatcagtgtctcac

SEQ ID NO: 5478631 - DNA, 18 bp, Homo sapiens
ctaatcagtgtctcacac

SEQ ID NO: 5478632 - DNA, 21 bp, Homo sapiens
ctaatcataacatagttgaaa

SEQ ID NO: 5478633 - DNA, 13 bp, Homo sapiens
ctaatccaaccca

SEQ ID NO: 5478634 - DNA, 14 bp, Homo sapiens
ctaatccacctggt

SEQ ID NO: 5478635 - DNA, 19 bp, Homo sapiens
ctaatccaggcagatccag

SEQ ID NO: 5478636 - DNA, 20 bp, Homo sapiens
ctaatccaggcagatccagg

SEQ ID NO: 5478637 - DNA, 15 bp, Homo sapiens
ctaatccccttctcc

SEQ ID NO: 5478638 - DNA, 18 bp, Homo sapiens
ctaatcccgattcaccct

SEQ ID NO: 5478639 - DNA, 21 bp, Homo sapiens
ctaatcccgtgcccctttcct

SEQ ID NO: 5478640 - DNA, 21 bp, Homo sapiens
ctaatccctgggcattgcttt

SEQ ID NO: 5478641 - DNA, 22 bp, Homo sapiens
ctaatccctgggcattgctttc

SEQ ID NO: 5478642 - DNA, 23 bp, Homo sapiens
ctaatcccttcctctcccattca

SEQ ID NO: 5478643 - DNA, 21 bp, Homo sapiens
ctaatccttctcattacccac

SEQ ID NO: 5478644 - DNA, 13 bp, Homo sapiens
ctaatccttttcc

SEQ ID NO: 5478645 - DNA, 17 bp, Homo sapiens
ctaatccttttccttat

SEQ ID NO: 5478646 - DNA, 22 bp, Homo sapiens
ctaatccttttccttatttgcc

SEQ ID NO: 5478647 - DNA, 17 bp, Homo sapiens
ctaatcgccctgagcta

SEQ ID NO: 5478648 - DNA, 16 bp, Homo sapiens
ctaatctactttctgt

SEQ ID NO: 5478649 - DNA, 18 bp, Homo sapiens
ctaatctatggtcgggag

SEQ ID NO: 5478650 - DNA, 15 bp, Homo sapiens
ctaatctcttattct

SEQ ID NO: 5478651 - DNA, 14 bp, Homo sapiens
ctaatctgagattg

SEQ ID NO: 5478652 - DNA, 13 bp, Homo sapiens
ctaatctgagctg

SEQ ID NO: 5478653 - DNA, 19 bp, Homo sapiens
ctaatctgagctgcagcct

SEQ ID NO: 5478654 - DNA, 21 bp, Homo sapiens
ctaatctgagctgcagcctgg

SEQ ID NO: 5478655 - DNA, 14 bp, Homo sapiens
ctaatctgcagtgg

SEQ ID NO: 5478656 - DNA, 19 bp, Homo sapiens
ctaatctgcctggttttat

SEQ ID NO: 5478657 - DNA, 20 bp, Homo sapiens
ctaatctgctatgcttgaat

SEQ ID NO: 5478658 - DNA, 22 bp, Homo sapiens
ctaatctgctatgcttgaatgc

SEQ ID NO: 5478659 - DNA, 14 bp, Homo sapiens
ctaatctgtagggc

SEQ ID NO: 5478660 - DNA, 20 bp, Homo sapiens
ctaatctgtgctgtttcaaa

SEQ ID NO: 5478661 - DNA, 17 bp, Homo sapiens
ctaatcttaaatcagaa

SEQ ID NO: 5478662 - DNA, 21 bp, Homo sapiens
ctaatcttgaatgtttgtgat

SEQ ID NO: 5478663 - DNA, 22 bp, Homo sapiens
ctaatcttgttaaattgcttat

SEQ ID NO: 5478664 - DNA, 13 bp, Homo sapiens
ctaatctttaata

SEQ ID NO: 5478665 - DNA, 20 bp, Homo sapiens
ctaatctttaatataatatt

SEQ ID NO: 5478666 - DNA, 11 bp, Homo sapiens
ctaatctttca

SEQ ID NO: 5478667 - DNA, 19 bp, Homo sapiens
ctaatgaaaaacaaaaagc

SEQ ID NO: 5478668 - DNA, 22 bp, Homo sapiens
ctaatgaaaaacaaaaagctaa

SEQ ID NO: 5478669 - DNA, 15 bp, Homo sapiens
ctaatgaacaaatat

SEQ ID NO: 5478670 - DNA, 14 bp, Homo sapiens
ctaatgaagacaat

SEQ ID NO: 5478671 - DNA, 15 bp, Homo sapiens
ctaatgaagacaatg

SEQ ID NO: 5478672 - DNA, 15 bp, Homo sapiens
ctaatgaagagaaaa

SEQ ID NO: 5478673 - DNA, 18 bp, Homo sapiens
ctaatgaattgaaatttt

SEQ ID NO: 5478674 - DNA, 11 bp, Homo sapiens
ctaatgaattt

SEQ ID NO: 5478675 - DNA, 12 bp, Homo sapiens
ctaatgaatttt

SEQ ID NO: 5478676 - DNA, 14 bp, Homo sapiens
ctaatgaattttaa

SEQ ID NO: 5478677 - DNA, 19 bp, Homo sapiens
ctaatgaattttaaaagca

SEQ ID NO: 5478678 - DNA, 14 bp, Homo sapiens
ctaatgacaagtga

SEQ ID NO: 5478679 - DNA, 23 bp, Homo sapiens
ctaatgacatgcctatatgagaa

SEQ ID NO: 5478680 - DNA, 14 bp, Homo sapiens
ctaatgacccagat

SEQ ID NO: 5478681 - DNA, 20 bp, Homo sapiens
ctaatgagctagtgtcttat

SEQ ID NO: 5478682 - DNA, 17 bp, Homo sapiens
ctaatgagggtgtgaga

SEQ ID NO: 5478683 - DNA, 20 bp, Homo sapiens
ctaatgagttgctggaaaat

SEQ ID NO: 5478684 - DNA, 22 bp, Homo sapiens
ctaatgagtttcttttataaaa

SEQ ID NO: 5478685 - DNA, 19 bp, Homo sapiens
ctaatgatcactctggaaa

SEQ ID NO: 5478686 - DNA, 15 bp, Homo sapiens
ctaatgatcatctga

SEQ ID NO: 5478687 - DNA, 18 bp, Homo sapiens
ctaatgatgacttgagcc

SEQ ID NO: 5478688 - DNA, 23 bp, Homo sapiens
ctaatgatgagcatttagcacaa

SEQ ID NO: 5478689 - DNA, 22 bp, Homo sapiens
ctaatgatggcccattctactt

SEQ ID NO: 5478690 - DNA, 15 bp, Homo sapiens
ctaatgatttagtgt

SEQ ID NO: 5478691 - DNA, 19 bp, Homo sapiens
ctaatgcaaatacccacca

SEQ ID NO: 5478692 - DNA, 14 bp, Homo sapiens
ctaatgcaaattaa

SEQ ID NO: 5478693 - DNA, 16 bp, Homo sapiens
ctaatgcaaattaaaa

SEQ ID NO: 5478694 - DNA, 11 bp, Homo sapiens
ctaatgcatat

SEQ ID NO: 5478695 - DNA, 18 bp, Homo sapiens
ctaatgcatatttataag

SEQ ID NO: 5478696 - DNA, 19 bp, Homo sapiens
ctaatgcatatttataaga

SEQ ID NO: 5478697 - DNA, 11 bp, Homo sapiens
ctaatgcatta

SEQ ID NO: 5478698 - DNA, 23 bp, Homo sapiens
ctaatgccttttgaatacatttg

SEQ ID NO: 5478699 - DNA, 16 bp, Homo sapiens
ctaatgcgcaggctgg

SEQ ID NO: 5478700 - DNA, 23 bp, Homo sapiens
ctaatgcgcaggctggccctgcc

SEQ ID NO: 5478701 - DNA, 15 bp, Homo sapiens
ctaatgctaagaaat

SEQ ID NO: 5478702 - DNA, 19 bp, Homo sapiens
ctaatgctcacctttatca

SEQ ID NO: 5478703 - DNA, 19 bp, Homo sapiens
ctaatgctccttgttccta

SEQ ID NO: 5478704 - DNA, 13 bp, Homo sapiens
ctaatgctgcaca

SEQ ID NO: 5478705 - DNA, 20 bp, Homo sapiens
ctaatgctggcctgactggt

SEQ ID NO: 5478706 - DNA, 21 bp, Homo sapiens
ctaatgcttgccaagaaatcg

SEQ ID NO: 5478707 - DNA, 17 bp, Homo sapiens
ctaatggaaaatgattt

SEQ ID NO: 5478708 - DNA, 16 bp, Homo sapiens
ctaatggcatgagaaa

SEQ ID NO: 5478709 - DNA, 14 bp, Homo sapiens
ctaatggctttcac

SEQ ID NO: 5478710 - DNA, 13 bp, Homo sapiens
ctaatgggacact

SEQ ID NO: 5478711 - DNA, 17 bp, Homo sapiens
ctaatgggctgctgtca

SEQ ID NO: 5478712 - DNA, 19 bp, Homo sapiens
ctaatgggtatttaaacaa

SEQ ID NO: 5478713 - DNA, 20 bp, Homo sapiens
ctaatggtaacttttgtagt

SEQ ID NO: 5478714 - DNA, 23 bp, Homo sapiens
ctaatggttgggttgattgtatg

SEQ ID NO: 5478715 - DNA, 16 bp, Homo sapiens
ctaatggttgtacata

SEQ ID NO: 5478716 - DNA, 14 bp, Homo sapiens
ctaatgtaaagatt

SEQ ID NO: 5478717 - DNA, 21 bp, Homo sapiens
ctaatgtaaatattgctgtct

SEQ ID NO: 5478718 - DNA, 19 bp, Homo sapiens
ctaatgtaataactgtgaa

SEQ ID NO: 5478719 - DNA, 13 bp, Homo sapiens
ctaatgtactgta

SEQ ID NO: 5478720 - DNA, 20 bp, Homo sapiens
ctaatgtactgtacataaat

SEQ ID NO: 5478721 - DNA, 18 bp, Homo sapiens
ctaatgtattatgagcca

SEQ ID NO: 5478722 - DNA, 18 bp, Homo sapiens
ctaatgtattttattgta

SEQ ID NO: 5478723 - DNA, 22 bp, Homo sapiens
ctaatgtattttattgtaacag

SEQ ID NO: 5478724 - DNA, 15 bp, Homo sapiens
ctaatgtctcactgt

SEQ ID NO: 5478725 - DNA, 16 bp, Homo sapiens
ctaatgtctcactgtt

SEQ ID NO: 5478726 - DNA, 23 bp, Homo sapiens
ctaatgtctcttcctctgttcta

SEQ ID NO: 5478727 - DNA, 18 bp, Homo sapiens
ctaatgtctgtatcactc

SEQ ID NO: 5478728 - DNA, 13 bp, Homo sapiens
ctaatgtcttcat

SEQ ID NO: 5478729 - DNA, 16 bp, Homo sapiens
ctaatgtgaatgtgag

SEQ ID NO: 5478730 - DNA, 23 bp, Homo sapiens
ctaatgtgcagggatattgcctt

SEQ ID NO: 5478731 - DNA, 16 bp, Homo sapiens
ctaatgtgttatgaga

SEQ ID NO: 5478732 - DNA, 23 bp, Homo sapiens
ctaatgtgttatgagaaattagt

SEQ ID NO: 5478733 - DNA, 17 bp, Homo sapiens
ctaatgttagaattgat

SEQ ID NO: 5478734 - DNA, 20 bp, Homo sapiens
ctaatgttagaattgatttc

SEQ ID NO: 5478735 - DNA, 21 bp, Homo sapiens
ctaatgttagaattgatttcc

SEQ ID NO: 5478736 - DNA, 18 bp, Homo sapiens
ctaatgttctaaattcta

SEQ ID NO: 5478737 - DNA, 17 bp, Homo sapiens
ctaatgttgatcagcaa

SEQ ID NO: 5478738 - DNA, 22 bp, Homo sapiens
ctaatgttggacagacactgtt

SEQ ID NO: 5478739 - DNA, 18 bp, Homo sapiens
ctaatgtttaagcagaat

SEQ ID NO: 5478740 - DNA, 22 bp, Homo sapiens
ctaatgtttaagcagaattgga

SEQ ID NO: 5478741 - DNA, 12 bp, Homo sapiens
ctaatgtttact

SEQ ID NO: 5478742 - DNA, 18 bp, Homo sapiens
ctaatgtttgcatataag

SEQ ID NO: 5478743 - DNA, 23 bp, Homo sapiens
ctaatgtttgtatttttagtaga

SEQ ID NO: 5478744 - DNA, 15 bp, Homo sapiens
ctaatgttttgctta

SEQ ID NO: 5478745 - DNA, 17 bp, Homo sapiens
ctaattaaaaaaataat

SEQ ID NO: 5478746 - DNA, 13 bp, Homo sapiens
ctaattaaaaact

SEQ ID NO: 5478747 - DNA, 15 bp, Homo sapiens
ctaattaaaaactgt

SEQ ID NO: 5478748 - DNA, 15 bp, Homo sapiens
ctaattaaaaagtta

SEQ ID NO: 5478749 - DNA, 20 bp, Homo sapiens
ctaattaaaacactttcaaa

SEQ ID NO: 5478750 - DNA, 17 bp, Homo sapiens
ctaattaaaattgtgca

SEQ ID NO: 5478751 - DNA, 23 bp, Homo sapiens
ctaattaaagatggtttatgcat

SEQ ID NO: 5478752 - DNA, 18 bp, Homo sapiens
ctaattaaataatacaac

SEQ ID NO: 5478753 - DNA, 17 bp, Homo sapiens
ctaattaactgaaacat

SEQ ID NO: 5478754 - DNA, 14 bp, Homo sapiens
ctaattaataaatt

SEQ ID NO: 5478755 - DNA, 22 bp, Homo sapiens
ctaattaatagccaaagatttc

SEQ ID NO: 5478756 - DNA, 13 bp, Homo sapiens
ctaattaatatat

SEQ ID NO: 5478757 - DNA, 15 bp, Homo sapiens
ctaattaatatatta

SEQ ID NO: 5478758 - DNA, 18 bp, Homo sapiens
ctaattaatatattaaaa

SEQ ID NO: 5478759 - DNA, 17 bp, Homo sapiens
ctaattaattgtaatct

SEQ ID NO: 5478760 - DNA, 15 bp, Homo sapiens
ctaattaatttcagt

SEQ ID NO: 5478761 - DNA, 20 bp, Homo sapiens
ctaattacgataaggaagaa

SEQ ID NO: 5478762 - DNA, 16 bp, Homo sapiens
ctaattagaaatcaac

SEQ ID NO: 5478763 - DNA, 15 bp, Homo sapiens
ctaattagagaactg

SEQ ID NO: 5478764 - DNA, 21 bp, Homo sapiens
ctaattagaggatgtggcagg

SEQ ID NO: 5478765 - DNA, 19 bp, Homo sapiens
ctaattagggcatcctgcc

SEQ ID NO: 5478766 - DNA, 20 bp, Homo sapiens
ctaattagggtacatttata

SEQ ID NO: 5478767 - DNA, 14 bp, Homo sapiens
ctaattagtgtcca

SEQ ID NO: 5478768 - DNA, 15 bp, Homo sapiens
ctaattatatatttt

SEQ ID NO: 5478769 - DNA, 17 bp, Homo sapiens
ctaattatcacgtctga

SEQ ID NO: 5478770 - DNA, 17 bp, Homo sapiens
ctaattatcttatctac

SEQ ID NO: 5478771 - DNA, 17 bp, Homo sapiens
ctaattatgtagctctt

SEQ ID NO: 5478772 - DNA, 23 bp, Homo sapiens
ctaattattattttaaaatatat

SEQ ID NO: 5478773 - DNA, 12 bp, Homo sapiens
ctaattatttaa

SEQ ID NO: 5478774 - DNA, 13 bp, Homo sapiens
ctaattatttaaa

SEQ ID NO: 5478775 - DNA, 14 bp, Homo sapiens
ctaattatttaatt

SEQ ID NO: 5478776 - DNA, 16 bp, Homo sapiens
ctaattattttaatta

SEQ ID NO: 5478777 - DNA, 22 bp, Homo sapiens
ctaattattttaattaggttaa

SEQ ID NO: 5478778 - DNA, 23 bp, Homo sapiens
ctaattcaaatggcttaagcaat

SEQ ID NO: 5478779 - DNA, 18 bp, Homo sapiens
ctaattcaaggaatttct

SEQ ID NO: 5478780 - DNA, 16 bp, Homo sapiens
ctaattcagacagaga

SEQ ID NO: 5478781 - DNA, 18 bp, Homo sapiens
ctaattcagcatgtgttc

SEQ ID NO: 5478782 - DNA, 16 bp, Homo sapiens
ctaattcagtgtcaca

SEQ ID NO: 5478783 - DNA, 23 bp, Homo sapiens
ctacacagtgggaactctgacaa

SEQ ID NO: 5478784 - DNA, 20 bp, Homo sapiens
ctacacatataaacacagta

SEQ ID NO: 5478785 - DNA, 23 bp, Homo sapiens
ctacacatataaacacagtaaga

SEQ ID NO: 5478786 - DNA, 21 bp, Homo sapiens
ctacacatatgtgcttctcag

SEQ ID NO: 5478787 - DNA, 23 bp, Homo sapiens
ctacacatgtaaaatatgtaaaa

SEQ ID NO: 5478788 - DNA, 13 bp, Homo sapiens
ctacacatgttgc

SEQ ID NO: 5478789 - DNA, 14 bp, Homo sapiens
ctacacatttcatc

SEQ ID NO: 5478790 - DNA, 23 bp, Homo sapiens
ctacacatttcatctaatttaat

SEQ ID NO: 5478791 - DNA, 14 bp, Homo sapiens
ctacacatttttaa

SEQ ID NO: 5478792 - DNA, 16 bp, Homo sapiens
ctacaccaattaatgt

SEQ ID NO: 5478793 - DNA, 15 bp, Homo sapiens
ctacaccacacacaa

SEQ ID NO: 5478794 - DNA, 14 bp, Homo sapiens
ctacaccactctgg

SEQ ID NO: 5478795 - DNA, 16 bp, Homo sapiens
ctacaccactctggca

SEQ ID NO: 5478796 - DNA, 16 bp, Homo sapiens
ctacacccctgtgctc

SEQ ID NO: 5478797 - DNA, 15 bp, Homo sapiens
ctacaccccttttcc

SEQ ID NO: 5478798 - DNA, 14 bp, Homo sapiens
ctacaccctctgcc

SEQ ID NO: 5478799 - DNA, 16 bp, Homo sapiens
ctacacccttttccag

SEQ ID NO: 5478800 - DNA, 18 bp, Homo sapiens
ctacacccttttccagct

SEQ ID NO: 5478801 - DNA, 20 bp, Homo sapiens
ctacaccttagcagctcttc

SEQ ID NO: 5478802 - DNA, 20 bp, Homo sapiens
ctacaccttgcttttttact

SEQ ID NO: 5478803 - DNA, 18 bp, Homo sapiens
ctacacctttctcctttg

SEQ ID NO: 5478804 - DNA, 21 bp, Homo sapiens
ctacacgcatgatggagctga

SEQ ID NO: 5478805 - DNA, 22 bp, Homo sapiens
ctacacgcatgatggagctgat

SEQ ID NO: 5478806 - DNA, 23 bp, Homo sapiens
ctacacggactgaggtgcctgct

SEQ ID NO: 5478807 - DNA, 20 bp, Homo sapiens
ctacactaaaatttaaatca

SEQ ID NO: 5478808 - DNA, 15 bp, Homo sapiens
ctacactaataaatg

SEQ ID NO: 5478809 - DNA, 22 bp, Homo sapiens
ctacactagtccataagcttta

SEQ ID NO: 5478810 - DNA, 20 bp, Homo sapiens
ctacactattgcattgttca

SEQ ID NO: 5478811 - DNA, 20 bp, Homo sapiens
ctacactcattgaaatgtaa

SEQ ID NO: 5478812 - DNA, 21 bp, Homo sapiens
ctacactcattgaaatgtaat

SEQ ID NO: 5478813 - DNA, 14 bp, Homo sapiens
ctacactccagcct

SEQ ID NO: 5478814 - DNA, 17 bp, Homo sapiens
ctacactccagtgagac

SEQ ID NO: 5478815 - DNA, 23 bp, Homo sapiens
ctacactcttgtaataaaatgtc

SEQ ID NO: 5478816 - DNA, 15 bp, Homo sapiens
ctacactgacactgg

SEQ ID NO: 5478817 - DNA, 13 bp, Homo sapiens
ctacactgaggag

SEQ ID NO: 5478818 - DNA, 13 bp, Homo sapiens
ctacactgatgca

SEQ ID NO: 5478819 - DNA, 14 bp, Homo sapiens
ctacactgcaatca

SEQ ID NO: 5478820 - DNA, 21 bp, Homo sapiens
ctacactgcaatcatatgtga

SEQ ID NO: 5478821 - DNA, 13 bp, Homo sapiens
ctacactgccagc

SEQ ID NO: 5478822 - DNA, 14 bp, Homo sapiens
ctacactgggtgct

SEQ ID NO: 5478823 - DNA, 23 bp, Homo sapiens
ctacactgtataactgttcttca

SEQ ID NO: 5478824 - DNA, 22 bp, Homo sapiens
ctacactgtattacataaataa

SEQ ID NO: 5478825 - DNA, 14 bp, Homo sapiens
ctacacttctcctt

SEQ ID NO: 5478826 - DNA, 15 bp, Homo sapiens
ctacactttgctagt

SEQ ID NO: 5478827 - DNA, 14 bp, Homo sapiens
ctacagaaaaacct

SEQ ID NO: 5478828 - DNA, 15 bp, Homo sapiens
ctacagaaaagaaat

SEQ ID NO: 5478829 - DNA, 21 bp, Homo sapiens
ctacagaaagcaaatcagaca

SEQ ID NO: 5478830 - DNA, 15 bp, Homo sapiens
ctacagaaagcacaa

SEQ ID NO: 5478831 - DNA, 17 bp, Homo sapiens
ctacagaaatactgctc

SEQ ID NO: 5478832 - DNA, 19 bp, Homo sapiens
ctacagaacaacccaccat

SEQ ID NO: 5478833 - DNA, 19 bp, Homo sapiens
ctacagaacttcagaaaga

SEQ ID NO: 5478834 - DNA, 23 bp, Homo sapiens
ctacagaagccaagctccctgga

SEQ ID NO: 5478835 - DNA, 12 bp, Homo sapiens
ctacagaataat

SEQ ID NO: 5478836 - DNA, 17 bp, Homo sapiens
ctacagaatagggtggc

SEQ ID NO: 5478837 - DNA, 19 bp, Homo sapiens
ctacagaatattaaatatt

SEQ ID NO: 5478838 - DNA, 15 bp, Homo sapiens
ctacagacaaagaga

SEQ ID NO: 5478839 - DNA, 11 bp, Homo sapiens
ctacagacagc

SEQ ID NO: 5478840 - DNA, 22 bp, Homo sapiens
ctacagacagcttacaggagcc

SEQ ID NO: 5478841 - DNA, 14 bp, Homo sapiens
ctacagacattaaa

SEQ ID NO: 5478842 - DNA, 21 bp, Homo sapiens
ctacagaccatatttttaaag

SEQ ID NO: 5478843 - DNA, 22 bp, Homo sapiens
ctacagacctgctttttgaaat

SEQ ID NO: 5478844 - DNA, 23 bp, Homo sapiens
ctacagacctgctttttgaaatg

SEQ ID NO: 5478845 - DNA, 20 bp, Homo sapiens
ctacagactccatctcttct

SEQ ID NO: 5478846 - DNA, 23 bp, Homo sapiens
ctacagactccatctcttctgca

SEQ ID NO: 5478847 - DNA, 21 bp, Homo sapiens
ctacagacttctccagaccca

SEQ ID NO: 5478848 - DNA, 20 bp, Homo sapiens
ctacagagaaaatgaatttg

SEQ ID NO: 5478849 - DNA, 12 bp, Homo sapiens
ctacagagaaac

SEQ ID NO: 5478850 - DNA, 14 bp, Homo sapiens
ctacagagaaacca

SEQ ID NO: 5478851 - DNA, 15 bp, Homo sapiens
ctacagagaaaccag

SEQ ID NO: 5478852 - DNA, 21 bp, Homo sapiens
ctacagagaaaccagcttcct

SEQ ID NO: 5478853 - DNA, 22 bp, Homo sapiens
ctacagagaacctggagttcct

SEQ ID NO: 5478854 - DNA, 22 bp, Homo sapiens
ctacagagaggaaattctccac

SEQ ID NO: 5478855 - DNA, 13 bp, Homo sapiens
ctacagagctgtg

SEQ ID NO: 5478856 - DNA, 17 bp, Homo sapiens
ctacagagcttccctga

SEQ ID NO: 5478857 - DNA, 17 bp, Homo sapiens
ctacagaggccatgggc

SEQ ID NO: 5478858 - DNA, 23 bp, Homo sapiens
ctacagaggtctctgccggctct

SEQ ID NO: 5478859 - DNA, 21 bp, Homo sapiens
ctacagagtctgacaggaaga

SEQ ID NO: 5478860 - DNA, 23 bp, Homo sapiens
ctacagagtctgacaggaagact

SEQ ID NO: 5478861 - DNA, 18 bp, Homo sapiens
ctacagagtgttataaca

SEQ ID NO: 5478862 - DNA, 14 bp, Homo sapiens
ctacagataattta

SEQ ID NO: 5478863 - DNA, 19 bp, Homo sapiens
ctacagatcctttttccat

SEQ ID NO: 5478864 - DNA, 23 bp, Homo sapiens
ctacagatggcatacctgtgcct

SEQ ID NO: 5478865 - DNA, 13 bp, Homo sapiens
ctacagatgtccc

SEQ ID NO: 5478866 - DNA, 14 bp, Homo sapiens
ctacagattttaga

SEQ ID NO: 5478867 - DNA, 16 bp, Homo sapiens
ctacagcaaatttata

SEQ ID NO: 5478868 - DNA, 19 bp, Homo sapiens
ctacagcaccttaaaaatt

SEQ ID NO: 5478869 - DNA, 11 bp, Homo sapiens
ctacagcagat

SEQ ID NO: 5478870 - DNA, 13 bp, Homo sapiens
ctacagcagatcc

SEQ ID NO: 5478871 - DNA, 15 bp, Homo sapiens
ctacagcagatccac

SEQ ID NO: 5478872 - DNA, 20 bp, Homo sapiens
ctacagcagatccacctgca

SEQ ID NO: 5478873 - DNA, 22 bp, Homo sapiens
ctacagcagatccacctgcaca

SEQ ID NO: 5478874 - DNA, 14 bp, Homo sapiens
ctacagcagtgtgg

SEQ ID NO: 5478875 - DNA, 18 bp, Homo sapiens
ctacagccaaattgcaga

SEQ ID NO: 5478876 - DNA, 13 bp, Homo sapiens
ctacagccagaag

SEQ ID NO: 5478877 - DNA, 18 bp, Homo sapiens
ctacagccagtaaggcag

SEQ ID NO: 5478878 - DNA, 17 bp, Homo sapiens
ctacagccctggaggcc

SEQ ID NO: 5478879 - DNA, 20 bp, Homo sapiens
ctacagccgtcccgcgttca

SEQ ID NO: 5478880 - DNA, 18 bp, Homo sapiens
ctacagcctcagaaacca

SEQ ID NO: 5478881 - DNA, 15 bp, Homo sapiens
ctacagcctctttcc

SEQ ID NO: 5478882 - DNA, 20 bp, Homo sapiens
ctacagcctgcacacacctg

SEQ ID NO: 5478883 - DNA, 18 bp, Homo sapiens
ctacagccttgtccccct

SEQ ID NO: 5478884 - DNA, 19 bp, Homo sapiens
ctacagccttgtccccctc

SEQ ID NO: 5478885 - DNA, 13 bp, Homo sapiens
ctacagctatgaa

SEQ ID NO: 5478886 - DNA, 14 bp, Homo sapiens
ctacagctatgaag

SEQ ID NO: 5478887 - DNA, 19 bp, Homo sapiens
ctacagctcacctctgaag

SEQ ID NO: 5478888 - DNA, 13 bp, Homo sapiens
ctacagctccaca

SEQ ID NO: 5478889 - DNA, 23 bp, Homo sapiens
ctacagctccagatgtttctcat

SEQ ID NO: 5478890 - DNA, 19 bp, Homo sapiens
ctacagctcccccagctcc

SEQ ID NO: 5478891 - DNA, 17 bp, Homo sapiens
ctacagctggggtgcag

SEQ ID NO: 5478892 - DNA, 22 bp, Homo sapiens
ctacagctggggtgcagggatg

SEQ ID NO: 5478893 - DNA, 14 bp, Homo sapiens
ctacagctgtcttc

SEQ ID NO: 5478894 - DNA, 15 bp, Homo sapiens
ctacagcttgtttaa

SEQ ID NO: 5478895 - DNA, 21 bp, Homo sapiens
ctacagctttgggtcattttt

SEQ ID NO: 5478896 - DNA, 18 bp, Homo sapiens
ctacaggaaatacagaga

SEQ ID NO: 5478897 - DNA, 22 bp, Homo sapiens
ctacaggaagcaccccatgcca

SEQ ID NO: 5478898 - DNA, 23 bp, Homo sapiens
ctacaggacaaagggagggagca

SEQ ID NO: 5478899 - DNA, 18 bp, Homo sapiens
ctacaggagagggaagag

SEQ ID NO: 5478900 - DNA, 23 bp, Homo sapiens
ctacaggatggtgggcaggatct

SEQ ID NO: 5478901 - DNA, 12 bp, Homo sapiens
ctacaggcctca

SEQ ID NO: 5478902 - DNA, 16 bp, Homo sapiens
ctacaggcctcacaca

SEQ ID NO: 5478903 - DNA, 19 bp, Homo sapiens
ctacaggcctgcagcccct

SEQ ID NO: 5478904 - DNA, 22 bp, Homo sapiens
ctacaggggaaggtggcctctg

SEQ ID NO: 5478905 - DNA, 14 bp, Homo sapiens
ctacaggggccaga

SEQ ID NO: 5478906 - DNA, 19 bp, Homo sapiens
ctacagggggtctggctgg

SEQ ID NO: 5478907 - DNA, 22 bp, Homo sapiens
ctacagggggtctggctggtgt

SEQ ID NO: 5478908 - DNA, 15 bp, Homo sapiens
ctacagggtgtctgt

SEQ ID NO: 5478909 - DNA, 17 bp, Homo sapiens
ctacaggtcaagaaata

SEQ ID NO: 5478910 - DNA, 22 bp, Homo sapiens
ctacaggtgaaggctctcaccc

SEQ ID NO: 5478911 - DNA, 14 bp, Homo sapiens
ctacaggtgtgagt

SEQ ID NO: 5478912 - DNA, 22 bp, Homo sapiens
ctacaggttgtgaaataatttt

SEQ ID NO: 5478913 - DNA, 15 bp, Homo sapiens
ctacaggttttatga

SEQ ID NO: 5478914 - DNA, 23 bp, Homo sapiens
ctacagtaagctggtttacagat

SEQ ID NO: 5478915 - DNA, 14 bp, Homo sapiens
ctacagtaatgaaa

SEQ ID NO: 5478916 - DNA, 16 bp, Homo sapiens
ctacagtaatgaaatg

SEQ ID NO: 5478917 - DNA, 18 bp, Homo sapiens
ctacagtactgacagaaa

SEQ ID NO: 5478918 - DNA, 21 bp, Homo sapiens
ctacagtactgacagaaagca

SEQ ID NO: 5478919 - DNA, 15 bp, Homo sapiens
ctacagtagctgtgg

SEQ ID NO: 5478920 - DNA, 22 bp, Homo sapiens
ctacagtagctgtggggagctg

SEQ ID NO: 5478921 - DNA, 22 bp, Homo sapiens
ctacagtattactcttacaaga

SEQ ID NO: 5478922 - DNA, 14 bp, Homo sapiens
ctacagtcaggaaa

SEQ ID NO: 5478923 - DNA, 15 bp, Homo sapiens
ctacagtcaggaaag

SEQ ID NO: 5478924 - DNA, 18 bp, Homo sapiens
ctacagtcaggaaaggaa

SEQ ID NO: 5478925 - DNA, 21 bp, Homo sapiens
ctacagtcaggaaaggaatca

SEQ ID NO: 5478926 - DNA, 13 bp, Homo sapiens
ctacagtcctccc

SEQ ID NO: 5478927 - DNA, 15 bp, Homo sapiens
ctacagtcctcccat

SEQ ID NO: 5478928 - DNA, 17 bp, Homo sapiens
ctacagtcctcccatct

SEQ ID NO: 5478929 - DNA, 18 bp, Homo sapiens
ctacagtcctcccatctc

SEQ ID NO: 5478930 - DNA, 16 bp, Homo sapiens
ctacagtcgtaaaaga

SEQ ID NO: 5478931 - DNA, 19 bp, Homo sapiens
ctacagtcgtaaaagagat

SEQ ID NO: 5478932 - DNA, 20 bp, Homo sapiens
ctacagtcgtaaaagagata

SEQ ID NO: 5478933 - DNA, 11 bp, Homo sapiens
ctacagtgcca

SEQ ID NO: 5478934 - DNA, 12 bp, Homo sapiens
ctacagtgccaa

SEQ ID NO: 5478935 - DNA, 19 bp, Homo sapiens
ctacagtgccaactcctca

SEQ ID NO: 5478936 - DNA, 13 bp, Homo sapiens
ctacagtgctgtg

SEQ ID NO: 5478937 - DNA, 17 bp, Homo sapiens
ctacagtggagggagac

SEQ ID NO: 5478938 - DNA, 14 bp, Homo sapiens
ctacagtggtttta

SEQ ID NO: 5478939 - DNA, 16 bp, Homo sapiens
ctacagtgtacagtct

SEQ ID NO: 5478940 - DNA, 15 bp, Homo sapiens
ctacagttcacagag

SEQ ID NO: 5478941 - DNA, 13 bp, Homo sapiens
ctacagttgaaaa

SEQ ID NO: 5478942 - DNA, 21 bp, Homo sapiens
ctacagttgaaaaacagctga

SEQ ID NO: 5478943 - DNA, 22 bp, Homo sapiens
ctacagttggaaatccatccag

SEQ ID NO: 5478944 - DNA, 23 bp, Homo sapiens
ctacagttgggaagtctcagcct

SEQ ID NO: 5478945 - DNA, 20 bp, Homo sapiens
ctacagttgttttttgaaaa

SEQ ID NO: 5478946 - DNA, 15 bp, Homo sapiens
ctacagttttaactg

SEQ ID NO: 5478947 - DNA, 17 bp, Homo sapiens
ctacagttttaactgtg

SEQ ID NO: 5478948 - DNA, 21 bp, Homo sapiens
ctacataaaataaatctactg

SEQ ID NO: 5478949 - DNA, 22 bp, Homo sapiens
ctacataaactgactttatcct

SEQ ID NO: 5478950 - DNA, 12 bp, Homo sapiens
ctacataaattg

SEQ ID NO: 5478951 - DNA, 19 bp, Homo sapiens
ctacataactaatacagct

SEQ ID NO: 5478952 - DNA, 16 bp, Homo sapiens
ctacataagtcctttc

SEQ ID NO: 5478953 - DNA, 23 bp, Homo sapiens
ctacataagtcctttcaattcca

SEQ ID NO: 5478954 - DNA, 14 bp, Homo sapiens
ctacataatctctg

SEQ ID NO: 5478955 - DNA, 13 bp, Homo sapiens
ctacataatggaa

SEQ ID NO: 5478956 - DNA, 18 bp, Homo sapiens
ctacatacaattccaaac

SEQ ID NO: 5478957 - DNA, 14 bp, Homo sapiens
ctacataggcaaag

SEQ ID NO: 5478958 - DNA, 17 bp, Homo sapiens
ctacataggttaatttt

SEQ ID NO: 5478959 - DNA, 18 bp, Homo sapiens
ctacataggttaattttt

SEQ ID NO: 5478960 - DNA, 17 bp, Homo sapiens
gaccaaactcagttcaa

SEQ ID NO: 5478961 - DNA, 16 bp, Homo sapiens
gaccaaagactgcaga

SEQ ID NO: 5478962 - DNA, 20 bp, Homo sapiens
gaccaaagactgcagaaccc

SEQ ID NO: 5478963 - DNA, 20 bp, Homo sapiens
gaccaaagagcctgtcgatg

SEQ ID NO: 5478964 - DNA, 19 bp, Homo sapiens
gaccaaagccacctgctgc

SEQ ID NO: 5478965 - DNA, 20 bp, Homo sapiens
gaccaaagccacctgctgcg

SEQ ID NO: 5478966 - DNA, 21 bp, Homo sapiens
gaccaaaggatccagagactt

SEQ ID NO: 5478967 - DNA, 14 bp, Homo sapiens
gaccaaagggggag

SEQ ID NO: 5478968 - DNA, 13 bp, Homo sapiens
gaccaaaggtcag

SEQ ID NO: 5478969 - DNA, 16 bp, Homo sapiens
gaccaaataattaaaa

SEQ ID NO: 5478970 - DNA, 21 bp, Homo sapiens
gaccaaatggaaacagaggac

SEQ ID NO: 5478971 - DNA, 16 bp, Homo sapiens
gaccaaatgtaaaata

SEQ ID NO: 5478972 - DNA, 21 bp, Homo sapiens
gaccaaatgtgccatactaat

SEQ ID NO: 5478973 - DNA, 22 bp, Homo sapiens
gaccaaatgtgccatactaatg

SEQ ID NO: 5478974 - DNA, 22 bp, Homo sapiens
gaccaaattccttggcatgcct

SEQ ID NO: 5478975 - DNA, 14 bp, Homo sapiens
gaccaaattgagct

SEQ ID NO: 5478976 - DNA, 16 bp, Homo sapiens
gaccaacagaaacctt

SEQ ID NO: 5478977 - DNA, 16 bp, Homo sapiens
gaccaacatggagaaa

SEQ ID NO: 5478978 - DNA, 18 bp, Homo sapiens
gaccaacccatgccctgc

SEQ ID NO: 5478979 - DNA, 16 bp, Homo sapiens
gaccaaccctgtttcc

SEQ ID NO: 5478980 - DNA, 18 bp, Homo sapiens
gaccaaccctgtttcctg

SEQ ID NO: 5478981 - DNA, 14 bp, Homo sapiens
gaccaacctgacca

SEQ ID NO: 5478982 - DNA, 13 bp, Homo sapiens
gaccaacctgctc

SEQ ID NO: 5478983 - DNA, 20 bp, Homo sapiens
gaccaacgttactcagggct

SEQ ID NO: 5478984 - DNA, 21 bp, Homo sapiens
gaccaacgttactcagggctc

SEQ ID NO: 5478985 - DNA, 14 bp, Homo sapiens
gaccaactgcccta

SEQ ID NO: 5478986 - DNA, 12 bp, Homo sapiens
gaccaactggct

SEQ ID NO: 5478987 - DNA, 19 bp, Homo sapiens
gaccaactggcttctgtgc

SEQ ID NO: 5478988 - DNA, 19 bp, Homo sapiens
gaccaactgggcccaagac

SEQ ID NO: 5478989 - DNA, 13 bp, Homo sapiens
gaccaactgtgtt

SEQ ID NO: 5478990 - DNA, 20 bp, Homo sapiens
gaccaagatggcccatcctg

SEQ ID NO: 5478991 - DNA, 17 bp, Homo sapiens
gaccaagatgggcacat

SEQ ID NO: 5478992 - DNA, 18 bp, Homo sapiens
gaccaagatgtcaagctg

SEQ ID NO: 5478993 - DNA, 12 bp, Homo sapiens
gaccaagcagga

SEQ ID NO: 5478994 - DNA, 15 bp, Homo sapiens
gaccaagcaggaagc

SEQ ID NO: 5478995 - DNA, 20 bp, Homo sapiens
gaccaagcaggaagctcaga

SEQ ID NO: 5478996 - DNA, 15 bp, Homo sapiens
gaccaagcatcttgg

SEQ ID NO: 5478997 - DNA, 17 bp, Homo sapiens
gaccaagcgaccaagga

SEQ ID NO: 5478998 - DNA, 18 bp, Homo sapiens
gaccaagcttaaggagag

SEQ ID NO: 5478999 - DNA, 19 bp, Homo sapiens
gaccaagcttaaggagagg

SEQ ID NO: 5479000 - DNA, 22 bp, Homo sapiens
gaccaagcttaaggagaggaga

SEQ ID NO: 5479001 - DNA, 19 bp, Homo sapiens
gaccaagcttagtcctggg

SEQ ID NO: 5479002 - DNA, 23 bp, Homo sapiens
gaccaagcttagtcctgggagag

SEQ ID NO: 5479003 - DNA, 20 bp, Homo sapiens
gaccaagcttgtttccctgc

SEQ ID NO: 5479004 - DNA, 11 bp, Homo sapiens
gaccaaggaac

SEQ ID NO: 5479005 - DNA, 17 bp, Homo sapiens
gaccaaggacccctcac

SEQ ID NO: 5479006 - DNA, 15 bp, Homo sapiens
gaccaaggagatggg

SEQ ID NO: 5479007 - DNA, 19 bp, Homo sapiens
gaccaaggcaaggcaggtg

SEQ ID NO: 5479008 - DNA, 23 bp, Homo sapiens
gaccaaggcaaggcaggtgcctc

SEQ ID NO: 5479009 - DNA, 21 bp, Homo sapiens
gaccaaggcctcggcagaact

SEQ ID NO: 5479010 - DNA, 13 bp, Homo sapiens
gaccaagggactc

SEQ ID NO: 5479011 - DNA, 13 bp, Homo sapiens
gaccaagggcaga

SEQ ID NO: 5479012 - DNA, 21 bp, Homo sapiens
gaccaaggtaccgatttctgc

SEQ ID NO: 5479013 - DNA, 18 bp, Homo sapiens
gaccaagtcctcaaagca

SEQ ID NO: 5479014 - DNA, 19 bp, Homo sapiens
gaccaataaaaaaataagt

SEQ ID NO: 5479015 - DNA, 20 bp, Homo sapiens
gaccaataaaatttctaaga

SEQ ID NO: 5479016 - DNA, 15 bp, Homo sapiens
gaccaatacatttgt

SEQ ID NO: 5479017 - DNA, 19 bp, Homo sapiens
gaccaatacatttgtattt

SEQ ID NO: 5479018 - DNA, 17 bp, Homo sapiens
gaccaataccccgactc

SEQ ID NO: 5479019 - DNA, 20 bp, Homo sapiens
gaccaatatatagtgggtac

SEQ ID NO: 5479020 - DNA, 20 bp, Homo sapiens
gaccaatattatactaagaa

SEQ ID NO: 5479021 - DNA, 17 bp, Homo sapiens
gaccaatattgtacagt

SEQ ID NO: 5479022 - DNA, 19 bp, Homo sapiens
gaccaatattgtacagttt

SEQ ID NO: 5479023 - DNA, 16 bp, Homo sapiens
gaccaatcaaatatat

SEQ ID NO: 5479024 - DNA, 22 bp, Homo sapiens
gaccaatcaaatatattattta

SEQ ID NO: 5479025 - DNA, 12 bp, Homo sapiens
gaccaatcccca

SEQ ID NO: 5479026 - DNA, 21 bp, Homo sapiens
gaccaatcgggagtagcaagg

SEQ ID NO: 5479027 - DNA, 19 bp, Homo sapiens
gaccaatgaaatgaattta

SEQ ID NO: 5479028 - DNA, 21 bp, Homo sapiens
gaccaatgggtttgccaagcc

SEQ ID NO: 5479029 - DNA, 20 bp, Homo sapiens
gaccaattagtcactgctgc

SEQ ID NO: 5479030 - DNA, 16 bp, Homo sapiens
gaccaattattgatat

SEQ ID NO: 5479031 - DNA, 13 bp, Homo sapiens
gaccaattgaagc

SEQ ID NO: 5479032 - DNA, 17 bp, Homo sapiens
gaccaattgaagcatga

SEQ ID NO: 5479033 - DNA, 18 bp, Homo sapiens
gaccaattgccctgccag

SEQ ID NO: 5479034 - DNA, 13 bp, Homo sapiens
gaccaattgtgct

SEQ ID NO: 5479035 - DNA, 23 bp, Homo sapiens
gaccacaaggctgaaaagtgctt

SEQ ID NO: 5479036 - DNA, 13 bp, Homo sapiens
gaccacacagtcc

SEQ ID NO: 5479037 - DNA, 17 bp, Homo sapiens
gaccacacagtccccag

SEQ ID NO: 5479038 - DNA, 18 bp, Homo sapiens
gaccacacattttatgag

SEQ ID NO: 5479039 - DNA, 20 bp, Homo sapiens
gaccacacattttatgagag

SEQ ID NO: 5479040 - DNA, 23 bp, Homo sapiens
gaccacaccactaaccatcccca

SEQ ID NO: 5479041 - DNA, 15 bp, Homo sapiens
gaccacaccagcctc

SEQ ID NO: 5479042 - DNA, 18 bp, Homo sapiens
gaccacaccagcctcctg

SEQ ID NO: 5479043 - DNA, 20 bp, Homo sapiens
gaccacaccagcctcctggg

SEQ ID NO: 5479044 - DNA, 14 bp, Homo sapiens
gaccacactccagc

SEQ ID NO: 5479045 - DNA, 17 bp, Homo sapiens
gaccacacttcctgtcc

SEQ ID NO: 5479046 - DNA, 15 bp, Homo sapiens
gaccacactttgaga

SEQ ID NO: 5479047 - DNA, 13 bp, Homo sapiens
gaccacagacact

SEQ ID NO: 5479048 - DNA, 16 bp, Homo sapiens
gaccacagacactcct

SEQ ID NO: 5479049 - DNA, 20 bp, Homo sapiens
gaccacagacactcctgggg

SEQ ID NO: 5479050 - DNA, 12 bp, Homo sapiens
gaccacagaggc

SEQ ID NO: 5479051 - DNA, 11 bp, Homo sapiens
gaccacagcaa

SEQ ID NO: 5479052 - DNA, 23 bp, Homo sapiens
gaccacagcaagccatcatcctc

SEQ ID NO: 5479053 - DNA, 14 bp, Homo sapiens
gaccacagcacagc

SEQ ID NO: 5479054 - DNA, 14 bp, Homo sapiens
gaccacagctgctg

SEQ ID NO: 5479055 - DNA, 18 bp, Homo sapiens
gaccacagctgctggcca

SEQ ID NO: 5479056 - DNA, 13 bp, Homo sapiens
gaccacaggctca

SEQ ID NO: 5479057 - DNA, 17 bp, Homo sapiens
gaccacagtgggtggca

SEQ ID NO: 5479058 - DNA, 21 bp, Homo sapiens
gaccacagtgggtggcacctc

SEQ ID NO: 5479059 - DNA, 20 bp, Homo sapiens
gaccacataagaaggcaatt

SEQ ID NO: 5479060 - DNA, 15 bp, Homo sapiens
gaccacatagaacat

SEQ ID NO: 5479061 - DNA, 14 bp, Homo sapiens
gaccacatccaccc

SEQ ID NO: 5479062 - DNA, 19 bp, Homo sapiens
gaccacatccaccccagcc

SEQ ID NO: 5479063 - DNA, 12 bp, Homo sapiens
gaccacatctgt

SEQ ID NO: 5479064 - DNA, 19 bp, Homo sapiens
gaccacatctgtcctcacc

SEQ ID NO: 5479065 - DNA, 20 bp, Homo sapiens
gaccacatctgtcctcaccc

SEQ ID NO: 5479066 - DNA, 21 bp, Homo sapiens
gaccacatctgtcctcaccct

SEQ ID NO: 5479067 - DNA, 12 bp, Homo sapiens
gaccaccaaagt

SEQ ID NO: 5479068 - DNA, 15 bp, Homo sapiens
gaccaccaagccttg

SEQ ID NO: 5479069 - DNA, 22 bp, Homo sapiens
gaccaccaagccttgattggtg

SEQ ID NO: 5479070 - DNA, 22 bp, Homo sapiens
gaccaccaccccaacaaaccat

SEQ ID NO: 5479071 - DNA, 12 bp, Homo sapiens
gaccaccagagg

SEQ ID NO: 5479072 - DNA, 14 bp, Homo sapiens
gaccaccagcaggc

SEQ ID NO: 5479073 - DNA, 16 bp, Homo sapiens
gaccaccagcaggcag

SEQ ID NO: 5479074 - DNA, 23 bp, Homo sapiens
gaccaccagccgccccagcccct

SEQ ID NO: 5479075 - DNA, 21 bp, Homo sapiens
gaccaccagggcatctctggg

SEQ ID NO: 5479076 - DNA, 20 bp, Homo sapiens
gaccaccagggtcccaggaa

SEQ ID NO: 5479077 - DNA, 17 bp, Homo sapiens
gaccacccccgagcttg

SEQ ID NO: 5479078 - DNA, 19 bp, Homo sapiens
gaccacccccgagcttgcc

SEQ ID NO: 5479079 - DNA, 21 bp, Homo sapiens
gaccacccctctcgcctcatt

SEQ ID NO: 5479080 - DNA, 14 bp, Homo sapiens
gaccacccctgcct

SEQ ID NO: 5479081 - DNA, 22 bp, Homo sapiens
gaccacccctgcctccaccctc

SEQ ID NO: 5479082 - DNA, 14 bp, Homo sapiens
gaccaccctcactg

SEQ ID NO: 5479083 - DNA, 19 bp, Homo sapiens
gaccaccctcactggctct

SEQ ID NO: 5479084 - DNA, 14 bp, Homo sapiens
gaccaccctcccct

SEQ ID NO: 5479085 - DNA, 15 bp, Homo sapiens
gaccaccctcccctc

SEQ ID NO: 5479086 - DNA, 22 bp, Homo sapiens
gaccaccctccctgactggcct

SEQ ID NO: 5479087 - DNA, 17 bp, Homo sapiens
gaccaccctgccaaggc

SEQ ID NO: 5479088 - DNA, 14 bp, Homo sapiens
gaccaccctgcctg

SEQ ID NO: 5479089 - DNA, 17 bp, Homo sapiens
gaccaccctgcctgtgg

SEQ ID NO: 5479090 - DNA, 18 bp, Homo sapiens
gaccaccgcgcccctctg

SEQ ID NO: 5479091 - DNA, 18 bp, Homo sapiens
gaccacctcaaatttaaa

SEQ ID NO: 5479092 - DNA, 21 bp, Homo sapiens
gaccacctcctctgccagcag

SEQ ID NO: 5479093 - DNA, 16 bp, Homo sapiens
gaccacctctcaatat

SEQ ID NO: 5479094 - DNA, 13 bp, Homo sapiens
gaccacctgccca

SEQ ID NO: 5479095 - DNA, 13 bp, Homo sapiens
gaccaccttccct

SEQ ID NO: 5479096 - DNA, 16 bp, Homo sapiens
gaccacctttcacaaa

SEQ ID NO: 5479097 - DNA, 22 bp, Homo sapiens
gaccacctttgtttctccccca

SEQ ID NO: 5479098 - DNA, 17 bp, Homo sapiens
gaccacgacctcgtcca

SEQ ID NO: 5479099 - DNA, 15 bp, Homo sapiens
gaccacgccccagga

SEQ ID NO: 5479100 - DNA, 14 bp, Homo sapiens
gaccacgctttcta

SEQ ID NO: 5479101 - DNA, 22 bp, Homo sapiens
gaccacggacgtttccatcagg

SEQ ID NO: 5479102 - DNA, 15 bp, Homo sapiens
gaccacgggcctcag

SEQ ID NO: 5479103 - DNA, 16 bp, Homo sapiens
gaccacgggcctcagt

SEQ ID NO: 5479104 - DNA, 18 bp, Homo sapiens
gaccacgggcctcagttt

SEQ ID NO: 5479105 - DNA, 21 bp, Homo sapiens
gaccacgggcctcagtttccc

SEQ ID NO: 5479106 - DNA, 21 bp, Homo sapiens
gaccacggggagcaaaccagc

SEQ ID NO: 5479107 - DNA, 16 bp, Homo sapiens
gaccacggtgtggggg

SEQ ID NO: 5479108 - DNA, 16 bp, Homo sapiens
gaccacgtctccctgg

SEQ ID NO: 5479109 - DNA, 21 bp, Homo sapiens
gaccacgtctccctggcccca

SEQ ID NO: 5479110 - DNA, 20 bp, Homo sapiens
gaccacgtgaaatttgcctc

SEQ ID NO: 5479111 - DNA, 14 bp, Homo sapiens
gaccacgtttctaa

SEQ ID NO: 5479112 - DNA, 20 bp, Homo sapiens
gaccactagctaagcaagcc

SEQ ID NO: 5479113 - DNA, 21 bp, Homo sapiens
gaccactcagagacatgcaga

SEQ ID NO: 5479114 - DNA, 14 bp, Homo sapiens
gaccactcagcccc

SEQ ID NO: 5479115 - DNA, 17 bp, Homo sapiens
gaccactcagcccctag

SEQ ID NO: 5479116 - DNA, 19 bp, Homo sapiens
gaccactcagcccctagga

SEQ ID NO: 5479117 - DNA, 16 bp, Homo sapiens
gaccactcctgtccct

SEQ ID NO: 5479118 - DNA, 20 bp, Homo sapiens
gaccactcctgtccctgtag

SEQ ID NO: 5479119 - DNA, 18 bp, Homo sapiens
gaccactcgaggcctgca

SEQ ID NO: 5479120 - DNA, 21 bp, Homo sapiens
gaccactcttctttaagccat

SEQ ID NO: 5479121 - DNA, 19 bp, Homo sapiens
gaccactgaattcactcca

SEQ ID NO: 5479122 - DNA, 17 bp, Homo sapiens
gaccactgacagcctcc

SEQ ID NO: 5479123 - DNA, 18 bp, Homo sapiens
gaccactgagagccacag

SEQ ID NO: 5479124 - DNA, 22 bp, Homo sapiens
gaccactgagccaggcttttct

SEQ ID NO: 5479125 - DNA, 21 bp, Homo sapiens
gaccactgcatgagcttttat

SEQ ID NO: 5479126 - DNA, 18 bp, Homo sapiens
gaccactggcctacccct

SEQ ID NO: 5479127 - DNA, 14 bp, Homo sapiens
gaccactgggcctg

SEQ ID NO: 5479128 - DNA, 17 bp, Homo sapiens
gaccactgtcctggctg

SEQ ID NO: 5479129 - DNA, 22 bp, Homo sapiens
gaccactgtctccacccacctt

SEQ ID NO: 5479130 - DNA, 19 bp, Homo sapiens
gaccactgtttcttgcttg

SEQ ID NO: 5479131 - DNA, 14 bp, Homo sapiens
gaccacttccttaa

SEQ ID NO: 5479132 - DNA, 15 bp, Homo sapiens
gaccacttccttaac

SEQ ID NO: 5479133 - DNA, 16 bp, Homo sapiens
gaccacttgccacgct

SEQ ID NO: 5479134 - DNA, 17 bp, Homo sapiens
gaccacttggaaataaa

SEQ ID NO: 5479135 - DNA, 21 bp, Homo sapiens
gaccactttggagactggggt

SEQ ID NO: 5479136 - DNA, 16 bp, Homo sapiens
gaccacttttatttat

SEQ ID NO: 5479137 - DNA, 18 bp, Homo sapiens
gaccccagatacctgtga

SEQ ID NO: 5479138 - DNA, 18 bp, Homo sapiens
gaccccagatgtgagggc

SEQ ID NO: 5479139 - DNA, 15 bp, Homo sapiens
gaccccagccatcca

SEQ ID NO: 5479140 - DNA, 17 bp, Homo sapiens
gaccccagcccagacag

SEQ ID NO: 5479141 - DNA, 13 bp, Homo sapiens
gaccccagccttg

SEQ ID NO: 5479142 - DNA, 19 bp, Homo sapiens
gaccccagccttggtgggg

SEQ ID NO: 5479143 - DNA, 16 bp, Homo sapiens
gaccccagctccaggc

SEQ ID NO: 5479144 - DNA, 14 bp, Homo sapiens
gaccccagctctgc

SEQ ID NO: 5479145 - DNA, 21 bp, Homo sapiens
gaccccagctgctctaagccc

SEQ ID NO: 5479146 - DNA, 14 bp, Homo sapiens
gaccccaggaagtg

SEQ ID NO: 5479147 - DNA, 13 bp, Homo sapiens
gaccccaggacct

SEQ ID NO: 5479148 - DNA, 17 bp, Homo sapiens
gaccccaggacctcttc

SEQ ID NO: 5479149 - DNA, 19 bp, Homo sapiens
gaccccaggatcccagagc

SEQ ID NO: 5479150 - DNA, 15 bp, Homo sapiens
gaccccaggcccact

SEQ ID NO: 5479151 - DNA, 11 bp, Homo sapiens
gaccccagggc

SEQ ID NO: 5479152 - DNA, 15 bp, Homo sapiens
gaccccagggcacag

SEQ ID NO: 5479153 - DNA, 14 bp, Homo sapiens
gaccccagggcctg

SEQ ID NO: 5479154 - DNA, 19 bp, Homo sapiens
gaccccagggcctgtctcc

SEQ ID NO: 5479155 - DNA, 20 bp, Homo sapiens
gaccccaggtcagccctgtg

SEQ ID NO: 5479156 - DNA, 22 bp, Homo sapiens
gaccccatcactcgcaggacca

SEQ ID NO: 5479157 - DNA, 15 bp, Homo sapiens
gaccccatctgctga

SEQ ID NO: 5479158 - DNA, 15 bp, Homo sapiens
gaccccattcctgat

SEQ ID NO: 5479159 - DNA, 14 bp, Homo sapiens
gaccccattctggg

SEQ ID NO: 5479160 - DNA, 16 bp, Homo sapiens
gaccccattctgggac

SEQ ID NO: 5479161 - DNA, 19 bp, Homo sapiens
gacccccaagcttccacct

SEQ ID NO: 5479162 - DNA, 13 bp, Homo sapiens
gacccccacacct

SEQ ID NO: 5479163 - DNA, 21 bp, Homo sapiens
gacccccaccccttccccact

SEQ ID NO: 5479164 - DNA, 22 bp, Homo sapiens
gacccccaccccttccccactg

SEQ ID NO: 5479165 - DNA, 18 bp, Homo sapiens
gacccccactctcattcc

SEQ ID NO: 5479166 - DNA, 19 bp, Homo sapiens
gacccccactctcattccc

SEQ ID NO: 5479167 - DNA, 18 bp, Homo sapiens
gacccccactgccgcctc

SEQ ID NO: 5479168 - DNA, 17 bp, Homo sapiens
gacccccagctccggcc

SEQ ID NO: 5479169 - DNA, 15 bp, Homo sapiens
gacccccaggaagga

SEQ ID NO: 5479170 - DNA, 19 bp, Homo sapiens
gacccccatccagcctcca

SEQ ID NO: 5479171 - DNA, 21 bp, Homo sapiens
gacccccatcgctctgagcat

SEQ ID NO: 5479172 - DNA, 22 bp, Homo sapiens
gacccccattctgacatccaca

SEQ ID NO: 5479173 - DNA, 20 bp, Homo sapiens
gaccccccaccaccagccgg

SEQ ID NO: 5479174 - DNA, 12 bp, Homo sapiens
gaccccccaccc

SEQ ID NO: 5479175 - DNA, 20 bp, Homo sapiens
gaccccccagcccctcctcc

SEQ ID NO: 5479176 - DNA, 22 bp, Homo sapiens
gaccccccagcccctcctccct

SEQ ID NO: 5479177 - DNA, 21 bp, Homo sapiens
gacccccccccaactccagga

SEQ ID NO: 5479178 - DNA, 18 bp, Homo sapiens
gaccccccccccccccgc

SEQ ID NO: 5479179 - DNA, 16 bp, Homo sapiens
gacccccctcaggacc

SEQ ID NO: 5479180 - DNA, 22 bp, Homo sapiens
gacccccctttcacaggcagcc

SEQ ID NO: 5479181 - DNA, 16 bp, Homo sapiens
gacccccgcagaggca

SEQ ID NO: 5479182 - DNA, 11 bp, Homo sapiens
gacccccgccc

SEQ ID NO: 5479183 - DNA, 15 bp, Homo sapiens
gacccccgccccctg

SEQ ID NO: 5479184 - DNA, 19 bp, Homo sapiens
gacccccgccccctgccct

SEQ ID NO: 5479185 - DNA, 18 bp, Homo sapiens
gacccccggcctccaggc

SEQ ID NO: 5479186 - DNA, 21 bp, Homo sapiens
gacccccggcctccaggctgg

SEQ ID NO: 5479187 - DNA, 14 bp, Homo sapiens
gacccccgtcagct

SEQ ID NO: 5479188 - DNA, 23 bp, Homo sapiens
gaccccctccccccaatccctca

SEQ ID NO: 5479189 - DNA, 13 bp, Homo sapiens
gaccccctcgcca

SEQ ID NO: 5479190 - DNA, 14 bp, Homo sapiens
gaccccctcgccag

SEQ ID NO: 5479191 - DNA, 18 bp, Homo sapiens
gaccccctcgccagcttg

SEQ ID NO: 5479192 - DNA, 12 bp, Homo sapiens
gaccccctggag

SEQ ID NO: 5479193 - DNA, 14 bp, Homo sapiens
gacccccttgccca

SEQ ID NO: 5479194 - DNA, 19 bp, Homo sapiens
gacccccttgcccaggcct

SEQ ID NO: 5479195 - DNA, 21 bp, Homo sapiens
gaccccgacgccacagcccag

SEQ ID NO: 5479196 - DNA, 19 bp, Homo sapiens
gaccccgagggctgaggag

SEQ ID NO: 5479197 - DNA, 20 bp, Homo sapiens
gaccccgccatgcatgcagc

SEQ ID NO: 5479198 - DNA, 21 bp, Homo sapiens
gaccccgcctcccagccccag

SEQ ID NO: 5479199 - DNA, 15 bp, Homo sapiens
gaccccggcctgtct

SEQ ID NO: 5479200 - DNA, 17 bp, Homo sapiens
gaccccggtggcagtgg

SEQ ID NO: 5479201 - DNA, 14 bp, Homo sapiens
gaccccgtggctct

SEQ ID NO: 5479202 - DNA, 15 bp, Homo sapiens
gaccccgtggctctg

SEQ ID NO: 5479203 - DNA, 16 bp, Homo sapiens
gaccccgtggctctgg

SEQ ID NO: 5479204 - DNA, 18 bp, Homo sapiens
gaccccgtggctctggga

SEQ ID NO: 5479205 - DNA, 21 bp, Homo sapiens
gaccccgtggctctgggagag

SEQ ID NO: 5479206 - DNA, 17 bp, Homo sapiens
gacccctaatgtcagct

SEQ ID NO: 5479207 - DNA, 12 bp, Homo sapiens
gacccctcacca

SEQ ID NO: 5479208 - DNA, 16 bp, Homo sapiens
gacccctcaccacccc

SEQ ID NO: 5479209 - DNA, 21 bp, Homo sapiens
gacccctcaccacccccactg

SEQ ID NO: 5479210 - DNA, 12 bp, Homo sapiens
gacccctcacct

SEQ ID NO: 5479211 - DNA, 13 bp, Homo sapiens
gacccctcacctt

SEQ ID NO: 5479212 - DNA, 14 bp, Homo sapiens
gacccctcaccttg

SEQ ID NO: 5479213 - DNA, 18 bp, Homo sapiens
gacccctcagccccagcc

SEQ ID NO: 5479214 - DNA, 21 bp, Homo sapiens
gacccctcagccccagcccag

SEQ ID NO: 5479215 - DNA, 12 bp, Homo sapiens
gacccctcagtg

SEQ ID NO: 5479216 - DNA, 23 bp, Homo sapiens
gacccctcatagccctcaccctg

SEQ ID NO: 5479217 - DNA, 19 bp, Homo sapiens
gacccctcccctaatgcct

SEQ ID NO: 5479218 - DNA, 23 bp, Homo sapiens
gacccctcctcactggccatccc

SEQ ID NO: 5479219 - DNA, 11 bp, Homo sapiens
gacccctcctg

SEQ ID NO: 5479220 - DNA, 21 bp, Homo sapiens
gacccctcctgcccctctctc

SEQ ID NO: 5479221 - DNA, 14 bp, Homo sapiens
gacccctcctgggg

SEQ ID NO: 5479222 - DNA, 17 bp, Homo sapiens
gacccctcctggggcca

SEQ ID NO: 5479223 - DNA, 11 bp, Homo sapiens
gacccctcctt

SEQ ID NO: 5479224 - DNA, 17 bp, Homo sapiens
gacccctcgcaaccctg

SEQ ID NO: 5479225 - DNA, 11 bp, Homo sapiens
gacccctgcat

SEQ ID NO: 5479226 - DNA, 11 bp, Homo sapiens
gacccctgccc

SEQ ID NO: 5479227 - DNA, 21 bp, Homo sapiens
gacccctgcccaagtggctct

SEQ ID NO: 5479228 - DNA, 23 bp, Homo sapiens
gacccctgcccaagtggctcttg

SEQ ID NO: 5479229 - DNA, 15 bp, Homo sapiens
gacccctgccctcgg

SEQ ID NO: 5479230 - DNA, 18 bp, Homo sapiens
gacccctgccctcggcca

SEQ ID NO: 5479231 - DNA, 14 bp, Homo sapiens
gacccctgccttcc

SEQ ID NO: 5479232 - DNA, 14 bp, Homo sapiens
gacccctgccttgg

SEQ ID NO: 5479233 - DNA, 23 bp, Homo sapiens
gacccctgctcccagcctgctga

SEQ ID NO: 5479234 - DNA, 20 bp, Homo sapiens
gacccctggccacagccttc

SEQ ID NO: 5479235 - DNA, 14 bp, Homo sapiens
gacccctggcctcc

SEQ ID NO: 5479236 - DNA, 15 bp, Homo sapiens
gacccctggcctccg

SEQ ID NO: 5479237 - DNA, 17 bp, Homo sapiens
gacccctggctctgggc

SEQ ID NO: 5479238 - DNA, 13 bp, Homo sapiens
gacccctggcttt

SEQ ID NO: 5479239 - DNA, 21 bp, Homo sapiens
gacccctggcttttcactgct

SEQ ID NO: 5479240 - DNA, 16 bp, Homo sapiens
gacccctgggcctcat

SEQ ID NO: 5479241 - DNA, 22 bp, Homo sapiens
gacccctgggggaggcttccag

SEQ ID NO: 5479242 - DNA, 23 bp, Homo sapiens
gacccctgggggaggcttccagc

SEQ ID NO: 5479243 - DNA, 21 bp, Homo sapiens
gacccctggggtggccagggc

SEQ ID NO: 5479244 - DNA, 22 bp, Homo sapiens
gacccctggggtggccagggct

SEQ ID NO: 5479245 - DNA, 18 bp, Homo sapiens
gacccctgggtgggccct

SEQ ID NO: 5479246 - DNA, 15 bp, Homo sapiens
gacccctgtggcaga

SEQ ID NO: 5479247 - DNA, 20 bp, Homo sapiens
gaccccttaatcttgctttc

SEQ ID NO: 5479248 - DNA, 12 bp, Homo sapiens
gaccccttccca

SEQ ID NO: 5479249 - DNA, 12 bp, Homo sapiens
gaccccttcctg

SEQ ID NO: 5479250 - DNA, 19 bp, Homo sapiens
gaccccttctctctccaga

SEQ ID NO: 5479251 - DNA, 18 bp, Homo sapiens
gacccctttaaactgtct

SEQ ID NO: 5479252 - DNA, 20 bp, Homo sapiens
gacccctttcccccacccca

SEQ ID NO: 5479253 - DNA, 23 bp, Homo sapiens
gacccgaaaatccagcgtgcacc

SEQ ID NO: 5479254 - DNA, 22 bp, Homo sapiens
gacccgaagcccaggctgaaga

SEQ ID NO: 5479255 - DNA, 16 bp, Homo sapiens
gacccgacactctcac

SEQ ID NO: 5479256 - DNA, 14 bp, Homo sapiens
gacccgaggcccag

SEQ ID NO: 5479257 - DNA, 13 bp, Homo sapiens
gacccgcctgctc

SEQ ID NO: 5479258 - DNA, 17 bp, Homo sapiens
gacccgctgggggctgg

SEQ ID NO: 5479259 - DNA, 22 bp, Homo sapiens
gacccggagctaacactggccc

SEQ ID NO: 5479260 - DNA, 15 bp, Homo sapiens
gacccggaggccaca

SEQ ID NO: 5479261 - DNA, 18 bp, Homo sapiens
gacccggaggggcctggc

SEQ ID NO: 5479262 - DNA, 19 bp, Homo sapiens
gacccggaggggcctggca

SEQ ID NO: 5479263 - DNA, 20 bp, Homo sapiens
gacccggaggggcctggcag

SEQ ID NO: 5479264 - DNA, 20 bp, Homo sapiens
gacccggattggccctgccc

SEQ ID NO: 5479265 - DNA, 17 bp, Homo sapiens
gacccggcaccccctgc

SEQ ID NO: 5479266 - DNA, 21 bp, Homo sapiens
gacccggcaccccctgcagct

SEQ ID NO: 5479267 - DNA, 21 bp, Homo sapiens
gacccggcccccgccctctgc

SEQ ID NO: 5479268 - DNA, 21 bp, Homo sapiens
gacccggccgccgccaggact

SEQ ID NO: 5479269 - DNA, 12 bp, Homo sapiens
gacccggctgcg

SEQ ID NO: 5479270 - DNA, 13 bp, Homo sapiens
gacccggctgcgt

SEQ ID NO: 5479271 - DNA, 22 bp, Homo sapiens
gacccgggaccacagctgctgg

SEQ ID NO: 5479272 - DNA, 14 bp, Homo sapiens
gacccgtccatttg

SEQ ID NO: 5479273 - DNA, 14 bp, Homo sapiens
gacccgtctccagc

SEQ ID NO: 5479274 - DNA, 22 bp, Homo sapiens
gacccgttcaacttttcctttg

SEQ ID NO: 5479275 - DNA, 23 bp, Homo sapiens
gacccgttcatgggggagggggc

SEQ ID NO: 5479276 - DNA, 16 bp, Homo sapiens
gacccgttccatatcc

SEQ ID NO: 5479277 - DNA, 14 bp, Homo sapiens
gaccctacagacag

SEQ ID NO: 5479278 - DNA, 14 bp, Homo sapiens
gaccctacaggaga

SEQ ID NO: 5479279 - DNA, 16 bp, Homo sapiens
gaccctaccccaccac

SEQ ID NO: 5479280 - DNA, 16 bp, Homo sapiens
gaccctaggtgctcat

SEQ ID NO: 5479281 - DNA, 16 bp, Homo sapiens
gaccctatacattttg

SEQ ID NO: 5479282 - DNA, 17 bp, Homo sapiens
gaccctatgaccaaaac

SEQ ID NO: 5479283 - DNA, 16 bp, Homo sapiens
gaccctatttgtttca

SEQ ID NO: 5479284 - DNA, 19 bp, Homo sapiens
gaccctatttgtttcatta

SEQ ID NO: 5479285 - DNA, 11 bp, Homo sapiens
gaccctcactt

SEQ ID NO: 5479286 - DNA, 13 bp, Homo sapiens
gaccctcagcagc

SEQ ID NO: 5479287 - DNA, 14 bp, Homo sapiens
gaccctcagcagct

SEQ ID NO: 5479288 - DNA, 17 bp, Homo sapiens
gaccctcagcagctctg

SEQ ID NO: 5479289 - DNA, 23 bp, Homo sapiens
gaccctcagcagctctggctctg

SEQ ID NO: 5479290 - DNA, 14 bp, Homo sapiens
gaccctcagcccca

SEQ ID NO: 5479291 - DNA, 20 bp, Homo sapiens
gaccctcagccccaggagaa

SEQ ID NO: 5479292 - DNA, 17 bp, Homo sapiens
gaccctcaggcacacct

SEQ ID NO: 5479293 - DNA, 23 bp, Homo sapiens
gaccctcaggtgtagctgagctg

SEQ ID NO: 5479294 - DNA, 15 bp, Homo sapiens
gaccctcatctttct

SEQ ID NO: 5479295 - DNA, 12 bp, Homo sapiens
gaccctcatgct

SEQ ID NO: 5479296 - DNA, 14 bp, Homo sapiens
gaccctcatgctgc

SEQ ID NO: 5479297 - DNA, 22 bp, Homo sapiens
gaccctcatgctgccaatatcc

SEQ ID NO: 5479298 - DNA, 18 bp, Homo sapiens
gaccctcatggcccccag

SEQ ID NO: 5479299 - DNA, 21 bp, Homo sapiens
gaccctcatggcccccagggg

SEQ ID NO: 5479300 - DNA, 23 bp, Homo sapiens
gaccctcatggcccccaggggca

SEQ ID NO: 5479301 - DNA, 11 bp, Homo sapiens
gaccctccaaa

SEQ ID NO: 5479302 - DNA, 19 bp, Homo sapiens
gaccctccaccgcagaagg

SEQ ID NO: 5479303 - DNA, 14 bp, Homo sapiens
gaccctccactcac

SEQ ID NO: 5479304 - DNA, 16 bp, Homo sapiens
gaccctcccactccca

SEQ ID NO: 5479305 - DNA, 21 bp, Homo sapiens
gaccctcccactcccatctcc

SEQ ID NO: 5479306 - DNA, 16 bp, Homo sapiens
gaccctcccagtgaga

SEQ ID NO: 5479307 - DNA, 21 bp, Homo sapiens
gaccctccccacagtgccacc

SEQ ID NO: 5479308 - DNA, 15 bp, Homo sapiens
gaccctcccccacca

SEQ ID NO: 5479309 - DNA, 17 bp, Homo sapiens
gaccctccccgcacccc

SEQ ID NO: 5479310 - DNA, 15 bp, Homo sapiens
gaccctcccctgcct

SEQ ID NO: 5479311 - DNA, 16 bp, Homo sapiens
gaccctcccctgcctc

SEQ ID NO: 5479312 - DNA, 14 bp, Homo sapiens
gaccctcctggcct

SEQ ID NO: 5479313 - DNA, 19 bp, Homo sapiens
gaccctcctggccttcctc

SEQ ID NO: 5479314 - DNA, 21 bp, Homo sapiens
gaccctcctggccttcctcgt

SEQ ID NO: 5479315 - DNA, 14 bp, Homo sapiens
gaccctcctgtcca

SEQ ID NO: 5479316 - DNA, 22 bp, Homo sapiens
gacctctctcagccccatcgcc

SEQ ID NO: 5479317 - DNA, 14 bp, Homo sapiens
gacctctctgcctc

SEQ ID NO: 5479318 - DNA, 16 bp, Homo sapiens
gacctctctgcctctc

SEQ ID NO: 5479319 - DNA, 19 bp, Homo sapiens
gacctctctgcctctcttc

SEQ ID NO: 5479320 - DNA, 19 bp, Homo sapiens
gacctctgaagagctgagt

SEQ ID NO: 5479321 - DNA, 22 bp, Homo sapiens
gacctctgaatgtcccagaggc

SEQ ID NO: 5479322 - DNA, 13 bp, Homo sapiens
gacctctgagcac

SEQ ID NO: 5479323 - DNA, 14 bp, Homo sapiens
gacctctgatccct

SEQ ID NO: 5479324 - DNA, 13 bp, Homo sapiens
gacctctgcctga

SEQ ID NO: 5479325 - DNA, 11 bp, Homo sapiens
gacctctgctg

SEQ ID NO: 5479326 - DNA, 13 bp, Homo sapiens
gacctctgctgag

SEQ ID NO: 5479327 - DNA, 21 bp, Homo sapiens
gacctctgcttttgcacacct

SEQ ID NO: 5479328 - DNA, 23 bp, Homo sapiens
gacctctggattaggtctctgtt

SEQ ID NO: 5479329 - DNA, 10 bp, Homo sapiens
gacctctggg

SEQ ID NO: 5479330 - DNA, 22 bp, Homo sapiens
gacctctgtaggcagcagagag

SEQ ID NO: 5479331 - DNA, 16 bp, Homo sapiens
gacctctgttgtcctc

SEQ ID NO: 5479332 - DNA, 14 bp, Homo sapiens
gacctcttagaaaa

SEQ ID NO: 5479333 - DNA, 18 bp, Homo sapiens
gacctcttcagctgctga

SEQ ID NO: 5479334 - DNA, 20 bp, Homo sapiens
gacctcttccctctgggcct

SEQ ID NO: 5479335 - DNA, 17 bp, Homo sapiens
gacctcttcctggaata

SEQ ID NO: 5479336 - DNA, 16 bp, Homo sapiens
gacctcttctctcctc

SEQ ID NO: 5479337 - DNA, 19 bp, Homo sapiens
gacctcttctctcctcccc

SEQ ID NO: 5479338 - DNA, 20 bp, Homo sapiens
gacctcttctctcctcccct

SEQ ID NO: 5479339 - DNA, 12 bp, Homo sapiens
gacctcttctgg

SEQ ID NO: 5479340 - DNA, 11 bp, Homo sapiens
gacctcttgcc

SEQ ID NO: 5479341 - DNA, 13 bp, Homo sapiens
gacctcttgcctc

SEQ ID NO: 5479342 - DNA, 12 bp, Homo sapiens
gacctcttgctg

SEQ ID NO: 5479343 - DNA, 15 bp, Homo sapiens
gacctcttgctgtct

SEQ ID NO: 5479344 - DNA, 16 bp, Homo sapiens
gacctcttgctgtctc

SEQ ID NO: 5479345 - DNA, 20 bp, Homo sapiens
gacctcttgctgtctctgct

SEQ ID NO: 5479346 - DNA, 19 bp, Homo sapiens
gacctgaaattccaaagtc

SEQ ID NO: 5479347 - DNA, 22 bp, Homo sapiens
gacctgaagagcgctcctctgc

SEQ ID NO: 5479348 - DNA, 15 bp, Homo sapiens
gacctgaaggacctc

SEQ ID NO: 5479349 - DNA, 24 bp, Homo sapiens
gacctgaagggttgactttaccca

SEQ ID NO: 5479350 - DNA, 18 bp, Homo sapiens
gacctgaattgaaagaga

SEQ ID NO: 5479351 - DNA, 11 bp, Homo sapiens
gacctgacacc

SEQ ID NO: 5479352 - DNA, 21 bp, Homo sapiens
gacctgacaccgtccctcagt

SEQ ID NO: 5479353 - DNA, 14 bp, Homo sapiens
gacctgacagcttg

SEQ ID NO: 5479354 - DNA, 15 bp, Homo sapiens
gacctgacagcttga

SEQ ID NO: 5479355 - DNA, 18 bp, Homo sapiens
gacctgaccccattcctg

SEQ ID NO: 5479356 - DNA, 17 bp, Homo sapiens
gacctgaccggcacctg

SEQ ID NO: 5479357 - DNA, 23 bp, Homo sapiens
gacctgacgatcttcccccttcc

SEQ ID NO: 5479358 - DNA, 21 bp, Homo sapiens
gacctgagactcacactctct

SEQ ID NO: 5479359 - DNA, 17 bp, Homo sapiens
gacctgagagcatctca

SEQ ID NO: 5479360 - DNA, 16 bp, Homo sapiens
gacctgagatgctggg

SEQ ID NO: 5479361 - DNA, 18 bp, Homo sapiens
gacctgagatgctgggag

SEQ ID NO: 5479362 - DNA, 19 bp, Homo sapiens
gacctgagatgctgggagg

SEQ ID NO: 5479363 - DNA, 22 bp, Homo sapiens
gacctgagcccgcagcccagac

SEQ ID NO: 5479364 - DNA, 14 bp, Homo sapiens
gacctgagcctgcc

SEQ ID NO: 5479365 - DNA, 18 bp, Homo sapiens
gacctgagcctgccgagc

SEQ ID NO: 5479366 - DNA, 14 bp, Homo sapiens
gacctgagcctggc

SEQ ID NO: 5479367 - DNA, 23 bp, Homo sapiens
gacctgagcggcaccctggtctg

SEQ ID NO: 5479368 - DNA, 13 bp, Homo sapiens
gacctgagctggc

SEQ ID NO: 5479369 - DNA, 22 bp, Homo sapiens
gacctgagctggccaggccctg

SEQ ID NO: 5479370 - DNA, 14 bp, Homo sapiens
gacctgaggagaca

SEQ ID NO: 5479371 - DNA, 11 bp, Homo sapiens
gacctgaggcc

SEQ ID NO: 5479372 - DNA, 13 bp, Homo sapiens
gacctgaggccct

SEQ ID NO: 5479373 - DNA, 19 bp, Homo sapiens
gacctgaggccctcactga

SEQ ID NO: 5479374 - DNA, 18 bp, Homo sapiens
gacctgaggcccttctct

SEQ ID NO: 5479375 - DNA, 18 bp, Homo sapiens
gacctgaggctcctgtgc

SEQ ID NO: 5479376 - DNA, 20 bp, Homo sapiens
gacctgaggctcctgtgcta

SEQ ID NO: 5479377 - DNA, 13 bp, Homo sapiens
gacctgaggctgt

SEQ ID NO: 5479378 - DNA, 14 bp, Homo sapiens
gacctgatcctgga

SEQ ID NO: 5479379 - DNA, 19 bp, Homo sapiens
gacctgatttacagtttca

SEQ ID NO: 5479380 - DNA, 15 bp, Homo sapiens
gacctgatttattga

SEQ ID NO: 5479381 - DNA, 20 bp, Homo sapiens
gacctgatttattgaaattt

SEQ ID NO: 5479382 - DNA, 21 bp, Homo sapiens
gacctgatttattgaaatttt

SEQ ID NO: 5479383 - DNA, 17 bp, Homo sapiens
gacctgatttcagaaga

SEQ ID NO: 5479384 - DNA, 18 bp, Homo sapiens
gacctgatttcagaagag

SEQ ID NO: 5479385 - DNA, 16 bp, Homo sapiens
gacctgcactggggag

SEQ ID NO: 5479386 - DNA, 20 bp, Homo sapiens
gacctgcactggggagcccg

SEQ ID NO: 5479387 - DNA, 13 bp, Homo sapiens
gacctgcaggcca

SEQ ID NO: 5479388 - DNA, 16 bp, Homo sapiens
gacctgcagtcagggc

SEQ ID NO: 5479389 - DNA, 19 bp, Homo sapiens
gacctgcagtcagggccca

SEQ ID NO: 5479390 - DNA, 18 bp, Homo sapiens
gacctgcagtgaggggcc

SEQ ID NO: 5479391 - DNA, 21 bp, Homo sapiens
gacctgcagttggcctcagca

SEQ ID NO: 5479392 - DNA, 12 bp, Homo sapiens
gacctgcatatt

SEQ ID NO: 5479393 - DNA, 16 bp, Homo sapiens
gacctgcatatttagc

SEQ ID NO: 5479394 - DNA, 19 bp, Homo sapiens
gacctgcatggtcaagcct

SEQ ID NO: 5479395 - DNA, 11 bp, Homo sapiens
gacctgcccat

SEQ ID NO: 5479396 - DNA, 12 bp, Homo sapiens
gacctgccccaa

SEQ ID NO: 5479397 - DNA, 16 bp, Homo sapiens
gacctgcccctccctc

SEQ ID NO: 5479398 - DNA, 14 bp, Homo sapiens
gacctgccctctct

SEQ ID NO: 5479399 - DNA, 17 bp, Homo sapiens
gacctgcctagcatggg

SEQ ID NO: 5479400 - DNA, 22 bp, Homo sapiens
gacctgcctcccttcatgcatg

SEQ ID NO: 5479401 - DNA, 14 bp, Homo sapiens
gacctgcctcctgc

SEQ ID NO: 5479402 - DNA, 16 bp, Homo sapiens
gacctgcctcctgcct

SEQ ID NO: 5479403 - DNA, 22 bp, Homo sapiens
gacctgcctctcacacacatag

SEQ ID NO: 5479404 - DNA, 13 bp, Homo sapiens
gacctgcctgtgt

SEQ ID NO: 5479405 - DNA, 15 bp, Homo sapiens
gacctgcgaaggatg

SEQ ID NO: 5479406 - DNA, 16 bp, Homo sapiens
gacctgcggctgctgt

SEQ ID NO: 5479407 - DNA, 15 bp, Homo sapiens
gacctgcgggtcctc

SEQ ID NO: 5479408 - DNA, 20 bp, Homo sapiens
gacctgcgggtcctcagctg

SEQ ID NO: 5479409 - DNA, 23 bp, Homo sapiens
gacctgctaggccagagcccact

SEQ ID NO: 5479410 - DNA, 13 bp, Homo sapiens
gacctgctcaggc

SEQ ID NO: 5479411 - DNA, 13 bp, Homo sapiens
gacctgctccaga

SEQ ID NO: 5479412 - DNA, 15 bp, Homo sapiens
gacctgctccgctgc

SEQ ID NO: 5479413 - DNA, 17 bp, Homo sapiens
gacctgctccgctgctc

SEQ ID NO: 5479414 - DNA, 18 bp, Homo sapiens
gacctgctccgctgctcc

SEQ ID NO: 5479415 - DNA, 23 bp, Homo sapiens
gacctgctccgctgctccttggc

SEQ ID NO: 5479416 - DNA, 13 bp, Homo sapiens
gacctgctgaagt

SEQ ID NO: 5479417 - DNA, 20 bp, Homo sapiens
gacctgctgaagtccggaac

SEQ ID NO: 5479418 - DNA, 19 bp, Homo sapiens
gacctgctgacctgtgcac

SEQ ID NO: 5479419 - DNA, 13 bp, Homo sapiens
gacctgctgagct

SEQ ID NO: 5479420 - DNA, 14 bp, Homo sapiens
gacctgctgagctc

SEQ ID NO: 5479421 - DNA, 22 bp, Homo sapiens
gacctgctgagctctgagaggc

SEQ ID NO: 5479422 - DNA, 11 bp, Homo sapiens
gacctgctgct

SEQ ID NO: 5479423 - DNA, 20 bp, Homo sapiens
gacctgctgtaataaatgta

SEQ ID NO: 5479424 - DNA, 21 bp, Homo sapiens
gacctgctgtaataaatgtat

SEQ ID NO: 5479425 - DNA, 18 bp, Homo sapiens
gacctgctgtggatgtcc

SEQ ID NO: 5479426 - DNA, 16 bp, Homo sapiens
gacctgctttttgaaa

SEQ ID NO: 5479427 - DNA, 20 bp, Homo sapiens
gacctgctttttgaaatgaa

SEQ ID NO: 5479428 - DNA, 17 bp, Homo sapiens
gacctggaaccagagcc

SEQ ID NO: 5479429 - DNA, 14 bp, Homo sapiens
gacctggaagaaca

SEQ ID NO: 5479430 - DNA, 17 bp, Homo sapiens
gacctggaagagctggg

SEQ ID NO: 5479431 - DNA, 14 bp, Homo sapiens
gacctggagacagg

SEQ ID NO: 5479432 - DNA, 16 bp, Homo sapiens
gacctggagcccctgg

SEQ ID NO: 5479433 - DNA, 17 bp, Homo sapiens
gacctggagcccctggg

SEQ ID NO: 5479434 - DNA, 18 bp, Homo sapiens
gacctggagcccctgggt

SEQ ID NO: 5479435 - DNA, 20 bp, Homo sapiens
gacctggagcccctgggtgg

SEQ ID NO: 5479436 - DNA, 16 bp, Homo sapiens
gacctggagctgccag

SEQ ID NO: 5479437 - DNA, 12 bp, Homo sapiens
gacctggagggg

SEQ ID NO: 5479438 - DNA, 18 bp, Homo sapiens
gacctggaggggagaggt

SEQ ID NO: 5479439 - DNA, 15 bp, Homo sapiens
gacctggataactta

SEQ ID NO: 5479440 - DNA, 22 bp, Homo sapiens
gacctggatagttaagggcttt

SEQ ID NO: 5479441 - DNA, 16 bp, Homo sapiens
gacctggcaaggacac

SEQ ID NO: 5479442 - DNA, 17 bp, Homo sapiens
gacctggcaaggacaca

SEQ ID NO: 5479443 - DNA, 18 bp, Homo sapiens
gacctggcaaggacacag

SEQ ID NO: 5479444 - DNA, 15 bp, Homo sapiens
gacctggcacagaaa

SEQ ID NO: 5479445 - DNA, 20 bp, Homo sapiens
gacctggcactgggaggcag

SEQ ID NO: 5479446 - DNA, 10 bp, Homo sapiens
gacctggcag

SEQ ID NO: 5479447 - DNA, 21 bp, Homo sapiens
gacctggcccagtgcaatctg

SEQ ID NO: 5479448 - DNA, 15 bp, Homo sapiens
gacctggccccaggc

SEQ ID NO: 5479449 - DNA, 13 bp, Homo sapiens
gacctggcctctg

SEQ ID NO: 5479450 - DNA, 14 bp, Homo sapiens
gacctggcctctgc

SEQ ID NO: 5479451 - DNA, 15 bp, Homo sapiens
gacctggcctctgcc

SEQ ID NO: 5479452 - DNA, 16 bp, Homo sapiens
gacctggcctttcact

SEQ ID NO: 5479453 - DNA, 12 bp, Homo sapiens
gacctggctgag

SEQ ID NO: 5479454 - DNA, 18 bp, Homo sapiens
gacctggctgggcctggg

SEQ ID NO: 5479455 - DNA, 12 bp, Homo sapiens
gacctggcttgg

SEQ ID NO: 5479456 - DNA, 17 bp, Homo sapiens
gacctgggaacgactgg

SEQ ID NO: 5479457 - DNA, 18 bp, Homo sapiens
gacctgggacctcccctg

SEQ ID NO: 5479458 - DNA, 21 bp, Homo sapiens
gacctgggccaaaagggcagc

SEQ ID NO: 5479459 - DNA, 15 bp, Homo sapiens
gacctgggcccacag

SEQ ID NO: 5479460 - DNA, 17 bp, Homo sapiens
gacctgggcccacagag

SEQ ID NO: 5479461 - DNA, 20 bp, Homo sapiens
gacctgggcccacagagcct

SEQ ID NO: 5479462 - DNA, 22 bp, Homo sapiens
gacctgggcccacagagcctgg

SEQ ID NO: 5479463 - DNA, 23 bp, Homo sapiens
gacctgggcccacagagcctggc

SEQ ID NO: 5479464 - DNA, 21 bp, Homo sapiens
gacctggggcacagtccagga

SEQ ID NO: 5479465 - DNA, 22 bp, Homo sapiens
gacctggggcacagtccaggaa

SEQ ID NO: 5479466 - DNA, 15 bp, Homo sapiens
gacctggggcagata

SEQ ID NO: 5479467 - DNA, 16 bp, Homo sapiens
gacctggggggaggga

SEQ ID NO: 5479468 - DNA, 22 bp, Homo sapiens
gacctggggtcccccctccctg

SEQ ID NO: 5479469 - DNA, 17 bp, Homo sapiens
gacctgggtatcccctg

SEQ ID NO: 5479470 - DNA, 20 bp, Homo sapiens
gacctgggtatcccctgcct

SEQ ID NO: 5479471 - DNA, 21 bp, Homo sapiens
gacctgggtatcccctgcctc

SEQ ID NO: 5479472 - DNA, 22 bp, Homo sapiens
gacctgggtatcccctgcctcc

SEQ ID NO: 5479473 - DNA, 23 bp, Homo sapiens
gacctgggtatcccctgcctcct

SEQ ID NO: 5479474 - DNA, 17 bp, Homo sapiens
gacctggtaccctcctg

SEQ ID NO: 5479475 - DNA, 18 bp, Homo sapiens
gacctggtccacagggca

SEQ ID NO: 5479476 - DNA, 15 bp, Homo sapiens
gacctggtctggtca

SEQ ID NO: 5479477 - DNA, 15 bp, Homo sapiens
gacctggtgcccctg

SEQ ID NO: 5479478 - DNA, 16 bp, Homo sapiens
gacctggtgtgcggag

SEQ ID NO: 5479479 - DNA, 14 bp, Homo sapiens
gacctggttcccac

SEQ ID NO: 5479480 - DNA, 15 bp, Homo sapiens
gacctggttcccact

SEQ ID NO: 5479481 - DNA, 20 bp, Homo sapiens
gacctggttggccgtggtcc

SEQ ID NO: 5479482 - DNA, 22 bp, Homo sapiens
gacctggttggccgtggtccag

SEQ ID NO: 5479483 - DNA, 20 bp, Homo sapiens
gacctggttgtccaggtcta

SEQ ID NO: 5479484 - DNA, 13 bp, Homo sapiens
gacctggttttta

SEQ ID NO: 5479485 - DNA, 12 bp, Homo sapiens
gacctgtaatca

SEQ ID NO: 5479486 - DNA, 21 bp, Homo sapiens
gacctgtatatttgtaaagct

SEQ ID NO: 5479487 - DNA, 13 bp, Homo sapiens
gacctgtatttaa

SEQ ID NO: 5479488 - DNA, 22 bp, Homo sapiens
gacctgtatttaagcaaatact

SEQ ID NO: 5479489 - DNA, 19 bp, Homo sapiens
gacctgtcatgcccccctc

SEQ ID NO: 5479490 - DNA, 14 bp, Homo sapiens
gacctgtcccccac

SEQ ID NO: 5479491 - DNA, 17 bp, Homo sapiens
gacctgtcccccactct

SEQ ID NO: 5479492 - DNA, 11 bp, Homo sapiens
gacctgtcctg

SEQ ID NO: 5479493 - DNA, 17 bp, Homo sapiens
gacctgtcctgtctttg

SEQ ID NO: 5479494 - DNA, 16 bp, Homo sapiens
gacctgtcgtctctcc

SEQ ID NO: 5479495 - DNA, 24 bp, Homo sapiens
ggctcacgcctgtaatcccagcag

SEQ ID NO: 5479496 - DNA, 13 bp, Homo sapiens
ggctcacgtgtgt

SEQ ID NO: 5479497 - DNA, 16 bp, Homo sapiens
ggctcactcagcactt

SEQ ID NO: 5479498 - DNA, 14 bp, Homo sapiens
ggctcactcagcca

SEQ ID NO: 5479499 - DNA, 13 bp, Homo sapiens
ggctcactctggc

SEQ ID NO: 5479500 - DNA, 16 bp, Homo sapiens
ggctcactctggcccc

SEQ ID NO: 5479501 - DNA, 23 bp, Homo sapiens
ggctcactgcaacctctgcctcc

SEQ ID NO: 5479502 - DNA, 14 bp, Homo sapiens
ggctcactgcagcc

SEQ ID NO: 5479503 - DNA, 15 bp, Homo sapiens
ggctcactgcagcct

SEQ ID NO: 5479504 - DNA, 16 bp, Homo sapiens
ggctcactgcagcctc

SEQ ID NO: 5479505 - DNA, 15 bp, Homo sapiens
ggctcactgcagcgc

SEQ ID NO: 5479506 - DNA, 18 bp, Homo sapiens
ggctcactgccaggccag

SEQ ID NO: 5479507 - DNA, 16 bp, Homo sapiens
ggctcactggctggga

SEQ ID NO: 5479508 - DNA, 18 bp, Homo sapiens
ggctcactggctgggagt

SEQ ID NO: 5479509 - DNA, 21 bp, Homo sapiens
ggctcactggctgggagtcct

SEQ ID NO: 5479510 - DNA, 17 bp, Homo sapiens
ggctcactggctttgaa

SEQ ID NO: 5479511 - DNA, 12 bp, Homo sapiens
ggctcagaaaat

SEQ ID NO: 5479512 - DNA, 16 bp, Homo sapiens
ggctcagacacctaga

SEQ ID NO: 5479513 - DNA, 22 bp, Homo sapiens
ggctcagacatccacataaccc

SEQ ID NO: 5479514 - DNA, 16 bp, Homo sapiens
ggctcagacccctcag

SEQ ID NO: 5479515 - DNA, 21 bp, Homo sapiens
ggctcagacccctcagcccca

SEQ ID NO: 5479516 - DNA, 22 bp, Homo sapiens
ggctcagagactgcaagctgct

SEQ ID NO: 5479517 - DNA, 12 bp, Homo sapiens
ggctcagagagg

SEQ ID NO: 5479518 - DNA, 14 bp, Homo sapiens
ggctcagagaggac

SEQ ID NO: 5479519 - DNA, 17 bp, Homo sapiens
ggctcagagaggacaaa

SEQ ID NO: 5479520 - DNA, 23 bp, Homo sapiens
ggctcagagaggacaaaataaag

SEQ ID NO: 5479521 - DNA, 13 bp, Homo sapiens
ggctcagagatgt

SEQ ID NO: 5479522 - DNA, 12 bp, Homo sapiens
ggctcagagctt

SEQ ID NO: 5479523 - DNA, 15 bp, Homo sapiens
ggctcagagggggac

SEQ ID NO: 5479524 - DNA, 18 bp, Homo sapiens
ggctcagagtgaccctca

SEQ ID NO: 5479525 - DNA, 21 bp, Homo sapiens
ggctcagagtgaccctcagct

SEQ ID NO: 5479526 - DNA, 14 bp, Homo sapiens
ggctcagagtgggg

SEQ ID NO: 5479527 - DNA, 21 bp, Homo sapiens
ggctcagatcggccacagggc

SEQ ID NO: 5479528 - DNA, 20 bp, Homo sapiens
ggctcagatggactgggagg

SEQ ID NO: 5479529 - DNA, 16 bp, Homo sapiens
ggctcagattgtaata

SEQ ID NO: 5479530 - DNA, 22 bp, Homo sapiens
ggctcagcaaggccacctcttc

SEQ ID NO: 5479531 - DNA, 15 bp, Homo sapiens
ggctcagcagggctg

SEQ ID NO: 5479532 - DNA, 17 bp, Homo sapiens
ggctcagcatcctccac

SEQ ID NO: 5479533 - DNA, 12 bp, Homo sapiens
ggctcagccagg

SEQ ID NO: 5479534 - DNA, 19 bp, Homo sapiens
ggctcagcccgggatcctg

SEQ ID NO: 5479535 - DNA, 20 bp, Homo sapiens
ggctcagcccgggatcctga

SEQ ID NO: 5479536 - DNA, 21 bp, Homo sapiens
ggctcagcccgggatcctgat

SEQ ID NO: 5479537 - DNA, 15 bp, Homo sapiens
ggctcagccctgagc

SEQ ID NO: 5479538 - DNA, 16 bp, Homo sapiens
ggctcagccctgagct

SEQ ID NO: 5479539 - DNA, 17 bp, Homo sapiens
ggctcagccctgagctg

SEQ ID NO: 5479540 - DNA, 18 bp, Homo sapiens
ggctcagcggggacagct

SEQ ID NO: 5479541 - DNA, 20 bp, Homo sapiens
ggctcagctcggggagcctt

SEQ ID NO: 5479542 - DNA, 21 bp, Homo sapiens
ggctcagctctggctcacaga

SEQ ID NO: 5479543 - DNA, 16 bp, Homo sapiens
ggctcagctgtggtcc

SEQ ID NO: 5479544 - DNA, 19 bp, Homo sapiens
ggctcagctgtggtcccac

SEQ ID NO: 5479545 - DNA, 12 bp, Homo sapiens
ggctcaggaaga

SEQ ID NO: 5479546 - DNA, 23 bp, Homo sapiens
ggctcaggaagaaaccccaagca

SEQ ID NO: 5479547 - DNA, 12 bp, Homo sapiens
ggctcaggagaa

SEQ ID NO: 5479548 - DNA, 17 bp, Homo sapiens
ggctcaggagagggcct

SEQ ID NO: 5479549 - DNA, 18 bp, Homo sapiens
ggctcaggagagggcctt

SEQ ID NO: 5479550 - DNA, 20 bp, Homo sapiens
ggctcaggagagggccttcc

SEQ ID NO: 5479551 - DNA, 15 bp, Homo sapiens
ggctcaggaggaggg

SEQ ID NO: 5479552 - DNA, 22 bp, Homo sapiens
ggctcaggatttcgtgggtctg

SEQ ID NO: 5479553 - DNA, 17 bp, Homo sapiens
ggctcaggcaggggcct

SEQ ID NO: 5479554 - DNA, 21 bp, Homo sapiens
ggctcaggcaggggcctccat

SEQ ID NO: 5479555 - DNA, 16 bp, Homo sapiens
ggctcaggctctgctg

SEQ ID NO: 5479556 - DNA, 15 bp, Homo sapiens
ggctcaggctgagct

SEQ ID NO: 5479557 - DNA, 22 bp, Homo sapiens
ggctcagggaggttaagtgact

SEQ ID NO: 5479558 - DNA, 12 bp, Homo sapiens
ggctcagggcca

SEQ ID NO: 5479559 - DNA, 16 bp, Homo sapiens
ggctcagggcccacct

SEQ ID NO: 5479560 - DNA, 23 bp, Homo sapiens
ggctcagggcccacctcctccag

SEQ ID NO: 5479561 - DNA, 14 bp, Homo sapiens
ggctcagggctgga

SEQ ID NO: 5479562 - DNA, 14 bp, Homo sapiens
ggctcagtctcagg

SEQ ID NO: 5479563 - DNA, 17 bp, Homo sapiens
ggctcagtctcaggagc

SEQ ID NO: 5479564 - DNA, 19 bp, Homo sapiens
ggctcagtgaagttgctgc

SEQ ID NO: 5479565 - DNA, 20 bp, Homo sapiens
ggctcagtgaagttgctgct

SEQ ID NO: 5479566 - DNA, 19 bp, Homo sapiens
ggctcagtgcaacctctgc

SEQ ID NO: 5479567 - DNA, 14 bp, Homo sapiens
ggctcagtgccacc

SEQ ID NO: 5479568 - DNA, 23 bp, Homo sapiens
ggctcagtgccacctatgcctgt

SEQ ID NO: 5479569 - DNA, 17 bp, Homo sapiens
ggctcatatgcgtccca

SEQ ID NO: 5479570 - DNA, 13 bp, Homo sapiens
ggctcatcagaac

SEQ ID NO: 5479571 - DNA, 16 bp, Homo sapiens
ggctcatcagaactga

SEQ ID NO: 5479572 - DNA, 23 bp, Homo sapiens
ggctcatgattttttacaaatta

SEQ ID NO: 5479573 - DNA, 15 bp, Homo sapiens
ggctcatgccccttg

SEQ ID NO: 5479574 - DNA, 16 bp, Homo sapiens
ggctcatgccccttgg

SEQ ID NO: 5479575 - DNA, 12 bp, Homo sapiens
ggctcatgcctg

SEQ ID NO: 5479576 - DNA, 18 bp, Homo sapiens
ggctcatgttcaggcaga

SEQ ID NO: 5479577 - DNA, 22 bp, Homo sapiens
ggctccacacacacaaaaaaag

SEQ ID NO: 5479578 - DNA, 13 bp, Homo sapiens
ggctccacacagc

SEQ ID NO: 5479579 - DNA, 14 bp, Homo sapiens
ggctccacacagca

SEQ ID NO: 5479580 - DNA, 17 bp, Homo sapiens
ggctccacacctccacc

SEQ ID NO: 5479581 - DNA, 17 bp, Homo sapiens
ggctccactccaagggt

SEQ ID NO: 5479582 - DNA, 14 bp, Homo sapiens
ggctccagaaatgt

SEQ ID NO: 5479583 - DNA, 10 bp, Homo sapiens
ggctccagac

SEQ ID NO: 5479584 - DNA, 16 bp, Homo sapiens
ggctccagagggcact

SEQ ID NO: 5479585 - DNA, 22 bp, Homo sapiens
ggctccagagggcactctgctt

SEQ ID NO: 5479586 - DNA, 17 bp, Homo sapiens
ggctccagatgcagggc

SEQ ID NO: 5479587 - DNA, 19 bp, Homo sapiens
ggctccagcatccagcctg

SEQ ID NO: 5479588 - DNA, 21 bp, Homo sapiens
ggctccagcatccagcctgtg

SEQ ID NO: 5479589 - DNA, 18 bp, Homo sapiens
ggctccagccatctcatg

SEQ ID NO: 5479590 - DNA, 12 bp, Homo sapiens
ggctccagcctg

SEQ ID NO: 5479591 - DNA, 15 bp, Homo sapiens
ggctccagctctggc

SEQ ID NO: 5479592 - DNA, 20 bp, Homo sapiens
ggctccagctctggcacagt

SEQ ID NO: 5479593 - DNA, 14 bp, Homo sapiens
ggctccaggagcag

SEQ ID NO: 5479594 - DNA, 16 bp, Homo sapiens
ggctccaggagcctca

SEQ ID NO: 5479595 - DNA, 10 bp, Homo sapiens
ggctccaggc

SEQ ID NO: 5479596 - DNA, 15 bp, Homo sapiens
ggctccaggcctgta

SEQ ID NO: 5479597 - DNA, 17 bp, Homo sapiens
ggctccaggcctgtact

SEQ ID NO: 5479598 - DNA, 14 bp, Homo sapiens
ggctccaggctcct

SEQ ID NO: 5479599 - DNA, 17 bp, Homo sapiens
ggctccagggagtgggg

SEQ ID NO: 5479600 - DNA, 13 bp, Homo sapiens
ggctccagggcca

SEQ ID NO: 5479601 - DNA, 13 bp, Homo sapiens
ggctccaggtccg

SEQ ID NO: 5479602 - DNA, 12 bp, Homo sapiens
ggctccagtctc

SEQ ID NO: 5479603 - DNA, 17 bp, Homo sapiens
ggctccagtctcatcct

SEQ ID NO: 5479604 - DNA, 15 bp, Homo sapiens
ggctccagtctgctg

SEQ ID NO: 5479605 - DNA, 24 bp, Homo sapiens
ggctccagtctgctgccctccatc

SEQ ID NO: 5479606 - DNA, 14 bp, Homo sapiens
ggctccatgcacct

SEQ ID NO: 5479607 - DNA, 14 bp, Homo sapiens
ggctccatgccagc

SEQ ID NO: 5479608 - DNA, 16 bp, Homo sapiens
ggctccatgcctctgg

SEQ ID NO: 5479609 - DNA, 17 bp, Homo sapiens
ggctccatgcctctgga

SEQ ID NO: 5479610 - DNA, 23 bp, Homo sapiens
ggctccatgctgaaggctcccat

SEQ ID NO: 5479611 - DNA, 17 bp, Homo sapiens
ggctccatgctgggtct

SEQ ID NO: 5479612 - DNA, 18 bp, Homo sapiens
ggctccatgctgggtctg

SEQ ID NO: 5479613 - DNA, 19 bp, Homo sapiens
ggctccatgctgggtctga

SEQ ID NO: 5479614 - DNA, 16 bp, Homo sapiens
ggctccatgctggtgt

SEQ ID NO: 5479615 - DNA, 15 bp, Homo sapiens
ggctccatggaggag

SEQ ID NO: 5479616 - DNA, 17 bp, Homo sapiens
ggctcccaagggaggcc

SEQ ID NO: 5479617 - DNA, 20 bp, Homo sapiens
ggctcccaagtcacacccac

SEQ ID NO: 5479618 - DNA, 21 bp, Homo sapiens
ggctcccaagtcacacccact

SEQ ID NO: 5479619 - DNA, 17 bp, Homo sapiens
ggctcccacaggccctt

SEQ ID NO: 5479620 - DNA, 21 bp, Homo sapiens
ggctcccacataagcactagt

SEQ ID NO: 5479621 - DNA, 11 bp, Homo sapiens
ggctcccaccc

SEQ ID NO: 5479622 - DNA, 18 bp, Homo sapiens
ggctcccacgccctcctc

SEQ ID NO: 5479623 - DNA, 13 bp, Homo sapiens
ggctcccagaccc

SEQ ID NO: 5479624 - DNA, 15 bp, Homo sapiens
ggctcccagccaggc

SEQ ID NO: 5479625 - DNA, 18 bp, Homo sapiens
ggctcccagccaggccct

SEQ ID NO: 5479626 - DNA, 21 bp, Homo sapiens
ggctcccagcctaagggagac

SEQ ID NO: 5479627 - DNA, 23 bp, Homo sapiens
ggctcccagcctaagggagacag

SEQ ID NO: 5479628 - DNA, 13 bp, Homo sapiens
ggctcccagcctc

SEQ ID NO: 5479629 - DNA, 16 bp, Homo sapiens
ggctcccagcctcagc

SEQ ID NO: 5479630 - DNA, 17 bp, Homo sapiens
ggctcccagcctcagcg

SEQ ID NO: 5479631 - DNA, 11 bp, Homo sapiens
ggctcccaggg

SEQ ID NO: 5479632 - DNA, 21 bp, Homo sapiens
ggctcccaggggtctccctgg

SEQ ID NO: 5479633 - DNA, 20 bp, Homo sapiens
ggctcccatgggctaggagc

SEQ ID NO: 5479634 - DNA, 19 bp, Homo sapiens
ggctcccatgtgagtccct

SEQ ID NO: 5479635 - DNA, 15 bp, Homo sapiens
ggctcccattcactc

SEQ ID NO: 5479636 - DNA, 19 bp, Homo sapiens
ggctccccaagacttgacg

SEQ ID NO: 5479637 - DNA, 14 bp, Homo sapiens
ggctccccaaggct

SEQ ID NO: 5479638 - DNA, 17 bp, Homo sapiens
ggctccccacctggaca

SEQ ID NO: 5479639 - DNA, 18 bp, Homo sapiens
ggctccccacctggacac

SEQ ID NO: 5479640 - DNA, 23 bp, Homo sapiens
ggctccccacctggacacacact

SEQ ID NO: 5479641 - DNA, 17 bp, Homo sapiens
ggctccccacgccccca

SEQ ID NO: 5479642 - DNA, 14 bp, Homo sapiens
ggctccccagaact

SEQ ID NO: 5479643 - DNA, 20 bp, Homo sapiens
ggctccccagaactggctgg

SEQ ID NO: 5479644 - DNA, 22 bp, Homo sapiens
ggctccccagaactggctgggc

SEQ ID NO: 5479645 - DNA, 19 bp, Homo sapiens
ggctccccaggaagcccac

SEQ ID NO: 5479646 - DNA, 13 bp, Homo sapiens
ggctccccagggc

SEQ ID NO: 5479647 - DNA, 14 bp, Homo sapiens
ggctccccagggct

SEQ ID NO: 5479648 - DNA, 15 bp, Homo sapiens
ggctccccagggctc

SEQ ID NO: 5479649 - DNA, 19 bp, Homo sapiens
ggctccccagtgctcctgg

SEQ ID NO: 5479650 - DNA, 22 bp, Homo sapiens
ggctccccatgtgtcctggttc

SEQ ID NO: 5479651 - DNA, 14 bp, Homo sapiens
ggctcccccaggcc

SEQ ID NO: 5479652 - DNA, 15 bp, Homo sapiens
ggctcccccaggcct

SEQ ID NO: 5479653 - DNA, 16 bp, Homo sapiens
ggctcccccaggggct

SEQ ID NO: 5479654 - DNA, 22 bp, Homo sapiens
ggctccccccagtgggatggga

SEQ ID NO: 5479655 - DNA, 15 bp, Homo sapiens
ggctccccctcccca

SEQ ID NO: 5479656 - DNA, 22 bp, Homo sapiens
ggctccccctccccaggctgga

SEQ ID NO: 5479657 - DNA, 15 bp, Homo sapiens
ggctccccctctgct

SEQ ID NO: 5479658 - DNA, 17 bp, Homo sapiens
ggctccccctctgcttc

SEQ ID NO: 5479659 - DNA, 14 bp, Homo sapiens
ggctccccctgcca

SEQ ID NO: 5479660 - DNA, 17 bp, Homo sapiens
ggctccccctgccagca

SEQ ID NO: 5479661 - DNA, 23 bp, Homo sapiens
ggctccccctgcttctcagcccc

SEQ ID NO: 5479662 - DNA, 19 bp, Homo sapiens
ggctccccctggacggggc

SEQ ID NO: 5479663 - DNA, 17 bp, Homo sapiens
ggctccccgcctccact

SEQ ID NO: 5479664 - DNA, 20 bp, Homo sapiens
ggctcccctcccaggggagc

SEQ ID NO: 5479665 - DNA, 16 bp, Homo sapiens
ggctcccctctgcttc

SEQ ID NO: 5479666 - DNA, 20 bp, Homo sapiens
ggctcccctctgcttctcat

SEQ ID NO: 5479667 - DNA, 12 bp, Homo sapiens
ggctcccctctt

SEQ ID NO: 5479668 - DNA, 17 bp, Homo sapiens
ggctcccctcttcctct

SEQ ID NO: 5479669 - DNA, 19 bp, Homo sapiens
ggctcccctgcccagcctg

SEQ ID NO: 5479670 - DNA, 14 bp, Homo sapiens
ggctcccctggaca

SEQ ID NO: 5479671 - DNA, 14 bp, Homo sapiens
ggctcccctggtct

SEQ ID NO: 5479672 - DNA, 17 bp, Homo sapiens
ggctcccctggtctcct

SEQ ID NO: 5479673 - DNA, 15 bp, Homo sapiens
ggctcccgcctccaa

SEQ ID NO: 5479674 - DNA, 21 bp, Homo sapiens
ggctgagacgccggcttcctc

SEQ ID NO: 5479675 - DNA, 21 bp, Homo sapiens
ggctgagactgcagaggagcc

SEQ ID NO: 5479676 - DNA, 21 bp, Homo sapiens
ggctgagactgcgggatggtc

SEQ ID NO: 5479677 - DNA, 12 bp, Homo sapiens
ggctgagactgg

SEQ ID NO: 5479678 - DNA, 13 bp, Homo sapiens
ggctgagactgga

SEQ ID NO: 5479679 - DNA, 17 bp, Homo sapiens
ggctgagagagtggcat

SEQ ID NO: 5479680 - DNA, 18 bp, Homo sapiens
ggctgagagccccagctg

SEQ ID NO: 5479681 - DNA, 12 bp, Homo sapiens
ggctgagagctc

SEQ ID NO: 5479682 - DNA, 23 bp, Homo sapiens
ggctgagagggtgtgggtgccct

SEQ ID NO: 5479683 - DNA, 21 bp, Homo sapiens
ggctgagatagcagaggggct

SEQ ID NO: 5479684 - DNA, 18 bp, Homo sapiens
ggctgagcacctctcaga

SEQ ID NO: 5479685 - DNA, 15 bp, Homo sapiens
ggctgagccaaagcc

SEQ ID NO: 5479686 - DNA, 12 bp, Homo sapiens
ggctgagccatg

SEQ ID NO: 5479687 - DNA, 16 bp, Homo sapiens
ggctgagccatgagga

SEQ ID NO: 5479688 - DNA, 14 bp, Homo sapiens
ggctgagccatggg

SEQ ID NO: 5479689 - DNA, 19 bp, Homo sapiens
ggctgagccattgagtgct

SEQ ID NO: 5479690 - DNA, 15 bp, Homo sapiens
ggctgagcccagcca

SEQ ID NO: 5479691 - DNA, 12 bp, Homo sapiens
ggctgagccccc

SEQ ID NO: 5479692 - DNA, 23 bp, Homo sapiens
ggctgagccccctctcctgaagc

SEQ ID NO: 5479693 - DNA, 13 bp, Homo sapiens
ggctgagccccta

SEQ ID NO: 5479694 - DNA, 19 bp, Homo sapiens
ggctgagcccctcctctcc

SEQ ID NO: 5479695 - DNA, 18 bp, Homo sapiens
ggctgagcccctggggaa

SEQ ID NO: 5479696 - DNA, 15 bp, Homo sapiens
ggctgagcccctggt

SEQ ID NO: 5479697 - DNA, 15 bp, Homo sapiens
ggctgagccctggca

SEQ ID NO: 5479698 - DNA, 18 bp, Homo sapiens
ggctgagccctgtaccca

SEQ ID NO: 5479699 - DNA, 21 bp, Homo sapiens
ggctgagccctgtacccaccc

SEQ ID NO: 5479700 - DNA, 21 bp, Homo sapiens
ggctgagccgaagctgcgggg

SEQ ID NO: 5479701 - DNA, 19 bp, Homo sapiens
ggctgagccgatctggtct

SEQ ID NO: 5479702 - DNA, 15 bp, Homo sapiens
ggctgagcgtggaag

SEQ ID NO: 5479703 - DNA, 19 bp, Homo sapiens
ggctgagctagcctccagc

SEQ ID NO: 5479704 - DNA, 16 bp, Homo sapiens
ggctgagctccagcca

SEQ ID NO: 5479705 - DNA, 17 bp, Homo sapiens
ggctgagctccagccac

SEQ ID NO: 5479706 - DNA, 15 bp, Homo sapiens
ggctgagctctctgt

SEQ ID NO: 5479707 - DNA, 13 bp, Homo sapiens
ggctgagctgggg

SEQ ID NO: 5479708 - DNA, 16 bp, Homo sapiens
ggctgagctgtgccag

SEQ ID NO: 5479709 - DNA, 18 bp, Homo sapiens
ggctgagctgtgccagct

SEQ ID NO: 5479710 - DNA, 19 bp, Homo sapiens
ggctgagctgtgccagctg

SEQ ID NO: 5479711 - DNA, 17 bp, Homo sapiens
ggctgaggaaaggccag

SEQ ID NO: 5479712 - DNA, 18 bp, Homo sapiens
ggctgaggatgggctctg

SEQ ID NO: 5479713 - DNA, 13 bp, Homo sapiens
ggctgaggcagaa

SEQ ID NO: 5479714 - DNA, 15 bp, Homo sapiens
ggctgaggcaggaga

SEQ ID NO: 5479715 - DNA, 15 bp, Homo sapiens
ggctgaggccagagt

SEQ ID NO: 5479716 - DNA, 16 bp, Homo sapiens
ggctgaggcctggact

SEQ ID NO: 5479717 - DNA, 21 bp, Homo sapiens
ggctgaggctgccctgaccct

SEQ ID NO: 5479718 - DNA, 16 bp, Homo sapiens
ggctgagggagcctgg

SEQ ID NO: 5479719 - DNA, 17 bp, Homo sapiens
ggctgagggaggcagaa

SEQ ID NO: 5479720 - DNA, 14 bp, Homo sapiens
ggctgagggcagct

SEQ ID NO: 5479721 - DNA, 21 bp, Homo sapiens
ggctgagggcagttcgcagcc

SEQ ID NO: 5479722 - DNA, 15 bp, Homo sapiens
ggctgagggcatctc

SEQ ID NO: 5479723 - DNA, 18 bp, Homo sapiens
ggctgagggcatctctga

SEQ ID NO: 5479724 - DNA, 21 bp, Homo sapiens
ggctgagggcatctctgagtg

SEQ ID NO: 5479725 - DNA, 14 bp, Homo sapiens
ggctgagggcctgc

SEQ ID NO: 5479726 - DNA, 16 bp, Homo sapiens
ggctgaggggatacca

SEQ ID NO: 5479727 - DNA, 19 bp, Homo sapiens
ggctgaggggcaacgaaga

SEQ ID NO: 5479728 - DNA, 14 bp, Homo sapiens
ggctgaggggcctg

SEQ ID NO: 5479729 - DNA, 17 bp, Homo sapiens
ggctgaggggcttggga

SEQ ID NO: 5479730 - DNA, 23 bp, Homo sapiens
ggctgagggtgcccttttccagc

SEQ ID NO: 5479731 - DNA, 14 bp, Homo sapiens
ggctgaggtggcag

SEQ ID NO: 5479732 - DNA, 15 bp, Homo sapiens
ggctgaggtggggaa

SEQ ID NO: 5479733 - DNA, 14 bp, Homo sapiens
ggctgaggttcctc

SEQ ID NO: 5479734 - DNA, 17 bp, Homo sapiens
ggctgaggttcctctgc

SEQ ID NO: 5479735 - DNA, 21 bp, Homo sapiens
ggctgaggttcctctgcctgc

SEQ ID NO: 5479736 - DNA, 23 bp, Homo sapiens
ggctgaggttcctctgcctgccc

SEQ ID NO: 5479737 - DNA, 22 bp, Homo sapiens
ggctgagtactggaataaacag

SEQ ID NO: 5479738 - DNA, 23 bp, Homo sapiens
ggctgagtcatgatctccctgcc

SEQ ID NO: 5479739 - DNA, 14 bp, Homo sapiens
ggctgagtgcagcc

SEQ ID NO: 5479740 - DNA, 15 bp, Homo sapiens
ggctgagtgcaggcc

SEQ ID NO: 5479741 - DNA, 19 bp, Homo sapiens
ggctgagtgcaggcccacc

SEQ ID NO: 5479742 - DNA, 20 bp, Homo sapiens
ggctgagtggaatgcaggga

SEQ ID NO: 5479743 - DNA, 13 bp, Homo sapiens
ggctgagtggcag

SEQ ID NO: 5479744 - DNA, 19 bp, Homo sapiens
ggctgagtggcagcagccc

SEQ ID NO: 5479745 - DNA, 13 bp, Homo sapiens
ggctgagttctgg

SEQ ID NO: 5479746 - DNA, 15 bp, Homo sapiens
ggctgatctcaggga

SEQ ID NO: 5479747 - DNA, 22 bp, Homo sapiens
ggctgatgaagaagggggtggg

SEQ ID NO: 5479748 - DNA, 22 bp, Homo sapiens
ggctgatgccaagttgtttgag

SEQ ID NO: 5479749 - DNA, 18 bp, Homo sapiens
ggctgatggaggaaaaag

SEQ ID NO: 5479750 - DNA, 20 bp, Homo sapiens
ggctgatggattccaaacca

SEQ ID NO: 5479751 - DNA, 23 bp, Homo sapiens
ggctgatggtgtggcctgtggct

SEQ ID NO: 5479752 - DNA, 22 bp, Homo sapiens
ggctgatgtcaatttctgtgtt

SEQ ID NO: 5479753 - DNA, 24 bp, Homo sapiens
ggctgatgtcaatttctgtgttgc

SEQ ID NO: 5479754 - DNA, 15 bp, Homo sapiens
ggctgatgtcttctt

SEQ ID NO: 5479755 - DNA, 18 bp, Homo sapiens
ggctgatgtggactgtct

SEQ ID NO: 5479756 - DNA, 20 bp, Homo sapiens
ggctgattcagcatttttta

SEQ ID NO: 5479757 - DNA, 23 bp, Homo sapiens
ggctgattcctaaaactctgcca

SEQ ID NO: 5479758 - DNA, 19 bp, Homo sapiens
ggctgattcctctcatttc

SEQ ID NO: 5479759 - DNA, 17 bp, Homo sapiens
ggctgattggaaaataa

SEQ ID NO: 5479760 - DNA, 18 bp, Homo sapiens
ggctgattggaaaataat

SEQ ID NO: 5479761 - DNA, 23 bp, Homo sapiens
ggctgattggaaaataataaaag

SEQ ID NO: 5479762 - DNA, 17 bp, Homo sapiens
ggctgatttacatgtat

SEQ ID NO: 5479763 - DNA, 20 bp, Homo sapiens
ggctgatttacatgtatggt

SEQ ID NO: 5479764 - DNA, 23 bp, Homo sapiens
ggctgatttacatgtatggttac

SEQ ID NO: 5479765 - DNA, 18 bp, Homo sapiens
ggctgcaaaactggaagc

SEQ ID NO: 5479766 - DNA, 22 bp, Homo sapiens
ggctgcaaaagaagtttctgga

SEQ ID NO: 5479767 - DNA, 19 bp, Homo sapiens
ggctgcaaataaggacagc

SEQ ID NO: 5479768 - DNA, 21 bp, Homo sapiens
ggctgcaattgcagctcactg

SEQ ID NO: 5479769 - DNA, 17 bp, Homo sapiens
ggctgcacaacagccct

SEQ ID NO: 5479770 - DNA, 23 bp, Homo sapiens
ggctgcacaacagccctgcctga

SEQ ID NO: 5479771 - DNA, 13 bp, Homo sapiens
ggctgcacagaag

SEQ ID NO: 5479772 - DNA, 19 bp, Homo sapiens
ggctgcacagaagggctct

SEQ ID NO: 5479773 - DNA, 13 bp, Homo sapiens
ggctgcacagcat

SEQ ID NO: 5479774 - DNA, 13 bp, Homo sapiens
ggctgcacaggct

SEQ ID NO: 5479775 - DNA, 19 bp, Homo sapiens
ggctgcacccctgggccag

SEQ ID NO: 5479776 - DNA, 20 bp, Homo sapiens
ggctgcaccctgtatggagc

SEQ ID NO: 5479777 - DNA, 16 bp, Homo sapiens
ggctgcacctgcaggg

SEQ ID NO: 5479778 - DNA, 20 bp, Homo sapiens
ggctgcacctgcagggagca

SEQ ID NO: 5479779 - DNA, 23 bp, Homo sapiens
ggctgcacgtaggttccccagag

SEQ ID NO: 5479780 - DNA, 17 bp, Homo sapiens
ggctgcacgtcaccctc

SEQ ID NO: 5479781 - DNA, 20 bp, Homo sapiens
ggctgcacgtcaccctcctg

SEQ ID NO: 5479782 - DNA, 16 bp, Homo sapiens
ggctgcactctgtgcc

SEQ ID NO: 5479783 - DNA, 18 bp, Homo sapiens
ggctgcactctgtgccca

SEQ ID NO: 5479784 - DNA, 19 bp, Homo sapiens
ggctgcactctgtgcccat

SEQ ID NO: 5479785 - DNA, 13 bp, Homo sapiens
ggctgcactgcag

SEQ ID NO: 5479786 - DNA, 23 bp, Homo sapiens
ggctgcactggagccacaggcag

SEQ ID NO: 5479787 - DNA, 15 bp, Homo sapiens
ggctgcagagcccgg

SEQ ID NO: 5479788 - DNA, 19 bp, Homo sapiens
ggctgcagagtctgcccca

SEQ ID NO: 5479789 - DNA, 15 bp, Homo sapiens
ggctgcagcaggcag

SEQ ID NO: 5479790 - DNA, 17 bp, Homo sapiens
ggctgcagcaggcagag

SEQ ID NO: 5479791 - DNA, 19 bp, Homo sapiens
ggctgcagcaggtgctggg

SEQ ID NO: 5479792 - DNA, 12 bp, Homo sapiens
ggctgcagccag

SEQ ID NO: 5479793 - DNA, 13 bp, Homo sapiens
ggctgcagccagg

SEQ ID NO: 5479794 - DNA, 14 bp, Homo sapiens
ggctgcagccaggc

SEQ ID NO: 5479795 - DNA, 19 bp, Homo sapiens
ggctgcagccccctgcttc

SEQ ID NO: 5479796 - DNA, 12 bp, Homo sapiens
ggctgcagcctc

SEQ ID NO: 5479797 - DNA, 15 bp, Homo sapiens
ggctgcagcctcagg

SEQ ID NO: 5479798 - DNA, 19 bp, Homo sapiens
ggctgcagcctcaggactg

SEQ ID NO: 5479799 - DNA, 22 bp, Homo sapiens
ggctgcagcctcaggactggga

SEQ ID NO: 5479800 - DNA, 16 bp, Homo sapiens
ggctgcagctggacag

SEQ ID NO: 5479801 - DNA, 14 bp, Homo sapiens
ggctgcaggagggc

SEQ ID NO: 5479802 - DNA, 15 bp, Homo sapiens
ggctgcaggcaggcg

SEQ ID NO: 5479803 - DNA, 17 bp, Homo sapiens
ggctgcaggcaggcggc

SEQ ID NO: 5479804 - DNA, 14 bp, Homo sapiens
ggctgcagggctgg

SEQ ID NO: 5479805 - DNA, 19 bp, Homo sapiens
ggctgcagggtcggtactg

SEQ ID NO: 5479806 - DNA, 13 bp, Homo sapiens
ggctgcaggtgct

SEQ ID NO: 5479807 - DNA, 23 bp, Homo sapiens
ggctgcaggtgggactttgttgt

SEQ ID NO: 5479808 - DNA, 13 bp, Homo sapiens
ggctgcaggtgtt

SEQ ID NO: 5479809 - DNA, 15 bp, Homo sapiens
ggctgcagtgagcca

SEQ ID NO: 5479810 - DNA, 16 bp, Homo sapiens
ggctgcagtggctccc

SEQ ID NO: 5479811 - DNA, 19 bp, Homo sapiens
ggctgcagtggctcccctg

SEQ ID NO: 5479812 - DNA, 21 bp, Homo sapiens
ggctgcagtggctcccctgcc

SEQ ID NO: 5479813 - DNA, 23 bp, Homo sapiens
ggctgcagttcgactctgtgctg

SEQ ID NO: 5479814 - DNA, 19 bp, Homo sapiens
ggctgcatcaaatgcatgc

SEQ ID NO: 5479815 - DNA, 17 bp, Homo sapiens
ggctgcatcctcagccc

SEQ ID NO: 5479816 - DNA, 18 bp, Homo sapiens
ggctgcatcctcagcccc

SEQ ID NO: 5479817 - DNA, 23 bp, Homo sapiens
ggctgcatctgggattcccacca

SEQ ID NO: 5479818 - DNA, 16 bp, Homo sapiens
ggctgcatgatgtttg

SEQ ID NO: 5479819 - DNA, 20 bp, Homo sapiens
ggctgcatgatttttgccct

SEQ ID NO: 5479820 - DNA, 22 bp, Homo sapiens
ggctgcatgatttttgccctgc

SEQ ID NO: 5479821 - DNA, 14 bp, Homo sapiens
ggctgcatgctctg

SEQ ID NO: 5479822 - DNA, 19 bp, Homo sapiens
ggctgcatgctctggaagc

SEQ ID NO: 5479823 - DNA, 21 bp, Homo sapiens
ggctgcatgctctggaagcct

SEQ ID NO: 5479824 - DNA, 15 bp, Homo sapiens
ggctgccaaggccag

SEQ ID NO: 5479825 - DNA, 13 bp, Homo sapiens
ggctgccaccaag

SEQ ID NO: 5479826 - DNA, 17 bp, Homo sapiens
ggctgccaccagccccc

SEQ ID NO: 5479827 - DNA, 20 bp, Homo sapiens
ggctgccactaacctgtaga

SEQ ID NO: 5479828 - DNA, 14 bp, Homo sapiens
ggctgccagagaaa

SEQ ID NO: 5479829 - DNA, 16 bp, Homo sapiens
ggctgccagcagcccc

SEQ ID NO: 5479830 - DNA, 18 bp, Homo sapiens
ggctgccagcagccccgt

SEQ ID NO: 5479831 - DNA, 15 bp, Homo sapiens
ggctgccagcccagc

SEQ ID NO: 5479832 - DNA, 12 bp, Homo sapiens
ggctgccagcct

SEQ ID NO: 5479833 - DNA, 16 bp, Homo sapiens
ggctgccagcctgagc

SEQ ID NO: 5479834 - DNA, 16 bp, Homo sapiens
ggctgccagcgtctgt

SEQ ID NO: 5479835 - DNA, 19 bp, Homo sapiens
ggctgccagcgtctgttgt

SEQ ID NO: 5479836 - DNA, 12 bp, Homo sapiens
ggctgccagctt

SEQ ID NO: 5479837 - DNA, 10 bp, Homo sapiens
ggctgccagg

SEQ ID NO: 5479838 - DNA, 11 bp, Homo sapiens
ggctgccaggc

SEQ ID NO: 5479839 - DNA, 23 bp, Homo sapiens
ggctgccaggcgttggtgccact

SEQ ID NO: 5479840 - DNA, 15 bp, Homo sapiens
ggctgccagtgcctg

SEQ ID NO: 5479841 - DNA, 18 bp, Homo sapiens
ggctgccagtgcctgggt

SEQ ID NO: 5479842 - DNA, 17 bp, Homo sapiens
ggctgccatagggtctg

SEQ ID NO: 5479843 - DNA, 21 bp, Homo sapiens
ggctgccatctcacctcctgc

SEQ ID NO: 5479844 - DNA, 23 bp, Homo sapiens
ggctgccatctcacctcctgctg

SEQ ID NO: 5479845 - DNA, 18 bp, Homo sapiens
ggctgccatgtgaagagg

SEQ ID NO: 5479846 - DNA, 19 bp, Homo sapiens
ggctgcccacacaccccaa

SEQ ID NO: 5479847 - DNA, 21 bp, Homo sapiens
ggctgcccacctggctgccaa

SEQ ID NO: 5479848 - DNA, 17 bp, Homo sapiens
ggctgcccactctgggg

SEQ ID NO: 5479849 - DNA, 19 bp, Homo sapiens
ggctgcccactctggggac

SEQ ID NO: 5479850 - DNA, 15 bp, Homo sapiens
ggctgcccagagctg

SEQ ID NO: 5479851 - DNA, 19 bp, Homo sapiens
ggctggacatgggtgggct

SEQ ID NO: 5479852 - DNA, 15 bp, Homo sapiens
ggctggaccacgtct

SEQ ID NO: 5479853 - DNA, 14 bp, Homo sapiens
ggctggacccagcc

SEQ ID NO: 5479854 - DNA, 14 bp, Homo sapiens
ggctggacctgcac

SEQ ID NO: 5479855 - DNA, 16 bp, Homo sapiens
ggctggacctgctgac

SEQ ID NO: 5479856 - DNA, 20 bp, Homo sapiens
ggctggactccagatctgca

SEQ ID NO: 5479857 - DNA, 15 bp, Homo sapiens
ggctggactggccat

SEQ ID NO: 5479858 - DNA, 21 bp, Homo sapiens
ggctggacttttgcagcttcc

SEQ ID NO: 5479859 - DNA, 22 bp, Homo sapiens
ggctggacttttgcagcttcct

SEQ ID NO: 5479860 - DNA, 14 bp, Homo sapiens
ggctggagaaagag

SEQ ID NO: 5479861 - DNA, 22 bp, Homo sapiens
ggctggagaaggacatgagatc

SEQ ID NO: 5479862 - DNA, 19 bp, Homo sapiens
ggctggagaccatgcagag

SEQ ID NO: 5479863 - DNA, 13 bp, Homo sapiens
ggctggagacccc

SEQ ID NO: 5479864 - DNA, 15 bp, Homo sapiens
ggctggagaccgagg

SEQ ID NO: 5479865 - DNA, 13 bp, Homo sapiens
ggctggagagttg

SEQ ID NO: 5479866 - DNA, 12 bp, Homo sapiens
ggctggagcccc

SEQ ID NO: 5479867 - DNA, 15 bp, Homo sapiens
ggctggagcggagat

SEQ ID NO: 5479868 - DNA, 18 bp, Homo sapiens
ggctggagctagaatttg

SEQ ID NO: 5479869 - DNA, 14 bp, Homo sapiens
ggctggagctggcc

SEQ ID NO: 5479870 - DNA, 15 bp, Homo sapiens
ggctggaggagccca

SEQ ID NO: 5479871 - DNA, 14 bp, Homo sapiens
ggctggaggagctg

SEQ ID NO: 5479872 - DNA, 18 bp, Homo sapiens
ggctggaggagctggcct

SEQ ID NO: 5479873 - DNA, 15 bp, Homo sapiens
ggctggaggcattcc

SEQ ID NO: 5479874 - DNA, 14 bp, Homo sapiens
ggctggagggctgg

SEQ ID NO: 5479875 - DNA, 15 bp, Homo sapiens
ggctggagggctggg

SEQ ID NO: 5479876 - DNA, 22 bp, Homo sapiens
ggctggagggctgggcagggcc

SEQ ID NO: 5479877 - DNA, 24 bp, Homo sapiens
ggctggagggctgggcagggccct

SEQ ID NO: 5479878 - DNA, 17 bp, Homo sapiens
ggctggagggggcagag

SEQ ID NO: 5479879 - DNA, 18 bp, Homo sapiens
ggctggagggggcagagt

SEQ ID NO: 5479880 - DNA, 15 bp, Homo sapiens
ggctggaggtgctgg

SEQ ID NO: 5479881 - DNA, 21 bp, Homo sapiens
ggctggaggtgctggtagctg

SEQ ID NO: 5479882 - DNA, 18 bp, Homo sapiens
ggctggagtcctctccag

SEQ ID NO: 5479883 - DNA, 17 bp, Homo sapiens
ggctggagtgcagtggc

SEQ ID NO: 5479884 - DNA, 19 bp, Homo sapiens
ggctggagtgcagtggcat

SEQ ID NO: 5479885 - DNA, 20 bp, Homo sapiens
ggctggagtgcagtggcgcc

SEQ ID NO: 5479886 - DNA, 20 bp, Homo sapiens
ggctggagtgcagtggtgca

SEQ ID NO: 5479887 - DNA, 20 bp, Homo sapiens
ggctggagtgcagtggtgtg

SEQ ID NO: 5479888 - DNA, 13 bp, Homo sapiens
ggctggagtgggc

SEQ ID NO: 5479889 - DNA, 20 bp, Homo sapiens
ggctggagttcagtggtgtg

SEQ ID NO: 5479890 - DNA, 16 bp, Homo sapiens
ggctggagttggggca

SEQ ID NO: 5479891 - DNA, 19 bp, Homo sapiens
ggctggataggagaggaaa

SEQ ID NO: 5479892 - DNA, 16 bp, Homo sapiens
ggctggatgctgggtt

SEQ ID NO: 5479893 - DNA, 13 bp, Homo sapiens
ggctggatggaca

SEQ ID NO: 5479894 - DNA, 19 bp, Homo sapiens
ggctggatggcacctcagg

SEQ ID NO: 5479895 - DNA, 15 bp, Homo sapiens
ggctggatgggaaag

SEQ ID NO: 5479896 - DNA, 14 bp, Homo sapiens
ggctggatgggggc

SEQ ID NO: 5479897 - DNA, 21 bp, Homo sapiens
ggctggcaaaccctcccagaa

SEQ ID NO: 5479898 - DNA, 13 bp, Homo sapiens
ggctggcaagcag

SEQ ID NO: 5479899 - DNA, 15 bp, Homo sapiens
ggctggcacagcccc

SEQ ID NO: 5479900 - DNA, 14 bp, Homo sapiens
ggctggcacaggac

SEQ ID NO: 5479901 - DNA, 15 bp, Homo sapiens
ggctggcacaggaca

SEQ ID NO: 5479902 - DNA, 13 bp, Homo sapiens
ggctggcaccagc

SEQ ID NO: 5479903 - DNA, 15 bp, Homo sapiens
ggctggcaccagcag

SEQ ID NO: 5479904 - DNA, 16 bp, Homo sapiens
ggctggcaccagcagg

SEQ ID NO: 5479905 - DNA, 20 bp, Homo sapiens
ggctggcaccagcaggcact

SEQ ID NO: 5479906 - DNA, 15 bp, Homo sapiens
ggctggcagagggga

SEQ ID NO: 5479907 - DNA, 17 bp, Homo sapiens
ggctggcagctgagagc

SEQ ID NO: 5479908 - DNA, 21 bp, Homo sapiens
ggctggcaggcagttctagaa

SEQ ID NO: 5479909 - DNA, 15 bp, Homo sapiens
ggctggcagggctgg

SEQ ID NO: 5479910 - DNA, 14 bp, Homo sapiens
ggctggcaggtgtt

SEQ ID NO: 5479911 - DNA, 14 bp, Homo sapiens
ggctggcagtgctg

SEQ ID NO: 5479912 - DNA, 18 bp, Homo sapiens
ggctggcatcctggctgg

SEQ ID NO: 5479913 - DNA, 19 bp, Homo sapiens
ggctggcatcctggctggc

SEQ ID NO: 5479914 - DNA, 20 bp, Homo sapiens
ggctggcatcctggctggct

SEQ ID NO: 5479915 - DNA, 11 bp, Homo sapiens
ggctggcatct

SEQ ID NO: 5479916 - DNA, 12 bp, Homo sapiens
ggctggcatggg

SEQ ID NO: 5479917 - DNA, 18 bp, Homo sapiens
ggctggcattgaggctaa

SEQ ID NO: 5479918 - DNA, 14 bp, Homo sapiens
ggctggccactgca

SEQ ID NO: 5479919 - DNA, 11 bp, Homo sapiens
ggctggccagc

SEQ ID NO: 5479920 - DNA, 19 bp, Homo sapiens
ggctggccagcaaggcagg

SEQ ID NO: 5479921 - DNA, 17 bp, Homo sapiens
ggctggccagccccaca

SEQ ID NO: 5479922 - DNA, 13 bp, Homo sapiens
ggctggccagccg

SEQ ID NO: 5479923 - DNA, 23 bp, Homo sapiens
ggctggccagccgctctcctgcc

SEQ ID NO: 5479924 - DNA, 12 bp, Homo sapiens
ggctggccagct

SEQ ID NO: 5479925 - DNA, 14 bp, Homo sapiens
ggctggccagctgt

SEQ ID NO: 5479926 - DNA, 16 bp, Homo sapiens
ggctggccagtccagg

SEQ ID NO: 5479927 - DNA, 13 bp, Homo sapiens
ggctggccatgga

SEQ ID NO: 5479928 - DNA, 12 bp, Homo sapiens
ggctggcccagc

SEQ ID NO: 5479929 - DNA, 14 bp, Homo sapiens
ggctggcccagccc

SEQ ID NO: 5479930 - DNA, 17 bp, Homo sapiens
ggctggcccagccctgc

SEQ ID NO: 5479931 - DNA, 18 bp, Homo sapiens
ggctggcccagccctgct

SEQ ID NO: 5479932 - DNA, 19 bp, Homo sapiens
ggctggcccagccctgctg

SEQ ID NO: 5479933 - DNA, 16 bp, Homo sapiens
ggctggccccagggca

SEQ ID NO: 5479934 - DNA, 12 bp, Homo sapiens
ggctggccccca

SEQ ID NO: 5479935 - DNA, 15 bp, Homo sapiens
ggctggcccccaccc

SEQ ID NO: 5479936 - DNA, 21 bp, Homo sapiens
ggctggcccccacccaccttc

SEQ ID NO: 5479937 - DNA, 10 bp, Homo sapiens
ggctggccct

SEQ ID NO: 5479938 - DNA, 15 bp, Homo sapiens
ggctggccctaggca

SEQ ID NO: 5479939 - DNA, 11 bp, Homo sapiens
ggctggccctg

SEQ ID NO: 5479940 - DNA, 21 bp, Homo sapiens
ggctggccctgccctccccca

SEQ ID NO: 5479941 - DNA, 22 bp, Homo sapiens
ggctggccctgccctcccccac

SEQ ID NO: 5479942 - DNA, 17 bp, Homo sapiens
ggctggccctgccctgg

SEQ ID NO: 5479943 - DNA, 18 bp, Homo sapiens
ggctggccctgtgcagac

SEQ ID NO: 5479944 - DNA, 22 bp, Homo sapiens
ggctggccgggactgctgctct

SEQ ID NO: 5479945 - DNA, 23 bp, Homo sapiens
ggctggccgggactgctgctctc

SEQ ID NO: 5479946 - DNA, 15 bp, Homo sapiens
ggctggcctcagact

SEQ ID NO: 5479947 - DNA, 20 bp, Homo sapiens
ggctggcctcccaaatgagc

SEQ ID NO: 5479948 - DNA, 19 bp, Homo sapiens
ggctggcctctggctctca

SEQ ID NO: 5479949 - DNA, 10 bp, Homo sapiens
ggctggcctg

SEQ ID NO: 5479950 - DNA, 20 bp, Homo sapiens
ggctggcctggaggctcagc

SEQ ID NO: 5479951 - DNA, 21 bp, Homo sapiens
ggctggcctggaggctcagcc

SEQ ID NO: 5479952 - DNA, 13 bp, Homo sapiens
ggctggcctggcc

SEQ ID NO: 5479953 - DNA, 14 bp, Homo sapiens
ggctggcctggccc

SEQ ID NO: 5479954 - DNA, 15 bp, Homo sapiens
ggctggcctggcccc

SEQ ID NO: 5479955 - DNA, 14 bp, Homo sapiens
ggctggcggcctcg

SEQ ID NO: 5479956 - DNA, 14 bp, Homo sapiens
ggctggcgggccct

SEQ ID NO: 5479957 - DNA, 20 bp, Homo sapiens
ggctggcgtgcagtggtgcg

SEQ ID NO: 5479958 - DNA, 17 bp, Homo sapiens
ggctggctaactggaag

SEQ ID NO: 5479959 - DNA, 22 bp, Homo sapiens
ggctggctccagatgcagggca

SEQ ID NO: 5479960 - DNA, 15 bp, Homo sapiens
ggctggctcccaggg

SEQ ID NO: 5479961 - DNA, 16 bp, Homo sapiens
ggctggctcccagggt

SEQ ID NO: 5479962 - DNA, 14 bp, Homo sapiens
ggctggctccccct

SEQ ID NO: 5479963 - DNA, 15 bp, Homo sapiens
ggctggctccccctc

SEQ ID NO: 5479964 - DNA, 13 bp, Homo sapiens
ggctggctcctga

SEQ ID NO: 5479965 - DNA, 15 bp, Homo sapiens
ggctggctcctgatc

SEQ ID NO: 5479966 - DNA, 19 bp, Homo sapiens
ggctggctctaccttcctg

SEQ ID NO: 5479967 - DNA, 22 bp, Homo sapiens
ggctggctctaccttcctgtcc

SEQ ID NO: 5479968 - DNA, 12 bp, Homo sapiens
ggctggctctgc

SEQ ID NO: 5479969 - DNA, 20 bp, Homo sapiens
ggctggctctgcactaagag

SEQ ID NO: 5479970 - DNA, 21 bp, Homo sapiens
ggctggctctgtggaggggcc

SEQ ID NO: 5479971 - DNA, 19 bp, Homo sapiens
ggctggctgaaaatcacta

SEQ ID NO: 5479972 - DNA, 13 bp, Homo sapiens
ggctggctgcctt

SEQ ID NO: 5479973 - DNA, 19 bp, Homo sapiens
ggctggctgccttctgcgg

SEQ ID NO: 5479974 - DNA, 15 bp, Homo sapiens
ggctggctggaggaa

SEQ ID NO: 5479975 - DNA, 12 bp, Homo sapiens
ggctggctgggg

SEQ ID NO: 5479976 - DNA, 13 bp, Homo sapiens
ggctggctggggc

SEQ ID NO: 5479977 - DNA, 23 bp, Homo sapiens
ggctggctgtgtcctctccagct

SEQ ID NO: 5479978 - DNA, 13 bp, Homo sapiens
ggctggcttcagg

SEQ ID NO: 5479979 - DNA, 18 bp, Homo sapiens
ggctggcttctccctgga

SEQ ID NO: 5479980 - DNA, 23 bp, Homo sapiens
ggctggctttggaatagatggac

SEQ ID NO: 5479981 - DNA, 23 bp, Homo sapiens
ggctggcttttctgtttcctgta

SEQ ID NO: 5479982 - DNA, 21 bp, Homo sapiens
ggctgggaaagaacttggact

SEQ ID NO: 5479983 - DNA, 18 bp, Homo sapiens
ggctgggaaccagggagg

SEQ ID NO: 5479984 - DNA, 21 bp, Homo sapiens
ggctgggaactgcagacctgt

SEQ ID NO: 5479985 - DNA, 18 bp, Homo sapiens
ggctgggacgtggctcag

SEQ ID NO: 5479986 - DNA, 15 bp, Homo sapiens
ggctgggactcctgg

SEQ ID NO: 5479987 - DNA, 23 bp, Homo sapiens
ggctgggacttcttacccaaagc

SEQ ID NO: 5479988 - DNA, 15 bp, Homo sapiens
ggctgggagagcctt

SEQ ID NO: 5479989 - DNA, 16 bp, Homo sapiens
ggctgggagagccttc

SEQ ID NO: 5479990 - DNA, 19 bp, Homo sapiens
ggctgggagagccttccag

SEQ ID NO: 5479991 - DNA, 20 bp, Homo sapiens
ggctgggagagccttccagg

SEQ ID NO: 5479992 - DNA, 20 bp, Homo sapiens
ggctgggagcctcgcccctc

SEQ ID NO: 5479993 - DNA, 15 bp, Homo sapiens
ggctgggagctctgc

SEQ ID NO: 5479994 - DNA, 14 bp, Homo sapiens
ggctgggaggagcc

SEQ ID NO: 5479995 - DNA, 20 bp, Homo sapiens
ggctgggaggagggcaggca

SEQ ID NO: 5479996 - DNA, 23 bp, Homo sapiens
ggctgggagtagttgtctttcct

SEQ ID NO: 5479997 - DNA, 22 bp, Homo sapiens
ggctgggagtccttacctcggg

SEQ ID NO: 5479998 - DNA, 22 bp, Homo sapiens
ggctgggatcagagcaggagca

SEQ ID NO: 5479999 - DNA, 17 bp, Homo sapiens
ggctgggcacagaggtc

SEQ ID NO: 5480000 - DNA, 20 bp, Homo sapiens
ggctgggcaccgtgtcctcc

SEQ ID NO: 5480001 - DNA, 22 bp, Homo sapiens
ggctgggcaccgtgtcctcctc

SEQ ID NO: 5480002 - DNA, 14 bp, Homo sapiens
ggctgggcagagga

SEQ ID NO: 5480003 - DNA, 15 bp, Homo sapiens
ggctgggcagaggaa

SEQ ID NO: 5480004 - DNA, 18 bp, Homo sapiens
ggctgggcagaggggaga

SEQ ID NO: 5480005 - DNA, 15 bp, Homo sapiens
ggctgggcagcccca

SEQ ID NO: 5480006 - DNA, 13 bp, Homo sapiens
ggctgggcagcta

SEQ ID NO: 5480007 - DNA, 17 bp, Homo sapiens
ggctgggcagggccctg

SEQ ID NO: 5480008 - DNA, 19 bp, Homo sapiens
ggctgggcagggccctgtg

SEQ ID NO: 5480009 - DNA, 19 bp, Homo sapiens
ggctgggcagggccgcagg

SEQ ID NO: 5480010 - DNA, 14 bp, Homo sapiens
ggctgggcatccca

SEQ ID NO: 5480011 - DNA, 22 bp, Homo sapiens
ggctgggccaagccagggatgg

SEQ ID NO: 5480012 - DNA, 14 bp, Homo sapiens
ggctgggccaccag

SEQ ID NO: 5480013 - DNA, 18 bp, Homo sapiens
ggctgggccaccagggat

SEQ ID NO: 5480014 - DNA, 19 bp, Homo sapiens
ggctgggccaccagggatc

SEQ ID NO: 5480015 - DNA, 22 bp, Homo sapiens
ggctgggccagcctcagctcag

SEQ ID NO: 5480016 - DNA, 14 bp, Homo sapiens
ggctgggccatcct

SEQ ID NO: 5480017 - DNA, 21 bp, Homo sapiens
ggctgggccatgtccaaagag

SEQ ID NO: 5480018 - DNA, 19 bp, Homo sapiens
ggctgggcccacccaggga

SEQ ID NO: 5480019 - DNA, 13 bp, Homo sapiens
ggctgggcccaga

SEQ ID NO: 5480020 - DNA, 14 bp, Homo sapiens
ggctgggcccagag

SEQ ID NO: 5480021 - DNA, 20 bp, Homo sapiens
ggctgggcccagcaggggcc

SEQ ID NO: 5480022 - DNA, 15 bp, Homo sapiens
ggctgggcccctggg

SEQ ID NO: 5480023 - DNA, 17 bp, Homo sapiens
ggctgggcccctgggga

SEQ ID NO: 5480024 - DNA, 21 bp, Homo sapiens
ggctgggcccctggggacaga

SEQ ID NO: 5480025 - DNA, 18 bp, Homo sapiens
ggctgggccctctgtcca

SEQ ID NO: 5480026 - DNA, 20 bp, Homo sapiens
ggctgggccgcaagggcctg

SEQ ID NO: 5480027 - DNA, 23 bp, Homo sapiens
ggctgggccgcaagggcctggac

SEQ ID NO: 5480028 - DNA, 14 bp, Homo sapiens
ggctgggcctgagc

SEQ ID NO: 5480029 - DNA, 21 bp, Homo sapiens
ggctgggcctgggcttccaca

SEQ ID NO: 5480030 - DNA, 14 bp, Homo sapiens
gcagcccccacgcc

SEQ ID NO: 5480031 - DNA, 23 bp, Homo sapiens
gcagcccccactgacctgcccat

SEQ ID NO: 5480032 - DNA, 16 bp, Homo sapiens
gcagcccccactgcac

SEQ ID NO: 5480033 - DNA, 22 bp, Homo sapiens
gcagcccccactgcacccctgc

SEQ ID NO: 5480034 - DNA, 15 bp, Homo sapiens
gcagcccccactttc

SEQ ID NO: 5480035 - DNA, 23 bp, Homo sapiens
gcagcccccagctcccacctccc

SEQ ID NO: 5480036 - DNA, 16 bp, Homo sapiens
gcagcccccatgggct

SEQ ID NO: 5480037 - DNA, 15 bp, Homo sapiens
gcagccccccagcac

SEQ ID NO: 5480038 - DNA, 22 bp, Homo sapiens
gcagccccccagtgtccccagg

SEQ ID NO: 5480039 - DNA, 23 bp, Homo sapiens
gcagccccccagtgtccccaggg

SEQ ID NO: 5480040 - DNA, 19 bp, Homo sapiens
gcagcccccccctcaaggg

SEQ ID NO: 5480041 - DNA, 20 bp, Homo sapiens
gcagcccccgcgccctccct

SEQ ID NO: 5480042 - DNA, 16 bp, Homo sapiens
gcagccccctccacac

SEQ ID NO: 5480043 - DNA, 18 bp, Homo sapiens
gcagccccctgtggcggc

SEQ ID NO: 5480044 - DNA, 20 bp, Homo sapiens
gcagccccgacccctgtcca

SEQ ID NO: 5480045 - DNA, 23 bp, Homo sapiens
gcagccccgacccctgtccagcg

SEQ ID NO: 5480046 - DNA, 17 bp, Homo sapiens
gcagccccgccctctgc

SEQ ID NO: 5480047 - DNA, 19 bp, Homo sapiens
gcagccccgcgaccacccc

SEQ ID NO: 5480048 - DNA, 22 bp, Homo sapiens
gcagccccgcgaccacccctgt

SEQ ID NO: 5480049 - DNA, 23 bp, Homo sapiens
gcagccccgcgcctccttccttg

SEQ ID NO: 5480050 - DNA, 21 bp, Homo sapiens
gcagccccggcaactctggct

SEQ ID NO: 5480051 - DNA, 19 bp, Homo sapiens
gcagccccgggcggagcct

SEQ ID NO: 5480052 - DNA, 21 bp, Homo sapiens
gcagcccctcagcgcccccag

SEQ ID NO: 5480053 - DNA, 17 bp, Homo sapiens
gcagcccctcccagcct

SEQ ID NO: 5480054 - DNA, 18 bp, Homo sapiens
gcagcccctcccagccta

SEQ ID NO: 5480055 - DNA, 17 bp, Homo sapiens
gcagcccctcgaggcct

SEQ ID NO: 5480056 - DNA, 22 bp, Homo sapiens
gcagcccctcgaggcctacaga

SEQ ID NO: 5480057 - DNA, 22 bp, Homo sapiens
gcagcccctctcacaggcagct

SEQ ID NO: 5480058 - DNA, 15 bp, Homo sapiens
gcagcccctgagagc

SEQ ID NO: 5480059 - DNA, 14 bp, Homo sapiens
gcagcccctgcaga

SEQ ID NO: 5480060 - DNA, 22 bp, Homo sapiens
gcagcccctgctggaccaaggt

SEQ ID NO: 5480061 - DNA, 22 bp, Homo sapiens
gcagcccctggagctcctgctg

SEQ ID NO: 5480062 - DNA, 21 bp, Homo sapiens
gcagcccctgttctggcagag

SEQ ID NO: 5480063 - DNA, 16 bp, Homo sapiens
gcagcccctgttttct

SEQ ID NO: 5480064 - DNA, 21 bp, Homo sapiens
gcagcccctgttttctgctgt

SEQ ID NO: 5480065 - DNA, 13 bp, Homo sapiens
gcagccccttctg

SEQ ID NO: 5480066 - DNA, 14 bp, Homo sapiens
gcagccccttctgg

SEQ ID NO: 5480067 - DNA, 16 bp, Homo sapiens
gcagccccttctggcc

SEQ ID NO: 5480068 - DNA, 21 bp, Homo sapiens
gcagccccttgctctcagctg

SEQ ID NO: 5480069 - DNA, 15 bp, Homo sapiens
gcagcccgccttggc

SEQ ID NO: 5480070 - DNA, 16 bp, Homo sapiens
gcagcccggctgctgc

SEQ ID NO: 5480071 - DNA, 15 bp, Homo sapiens
gcagcccgggagatc

SEQ ID NO: 5480072 - DNA, 15 bp, Homo sapiens
gcagcccggggagga

SEQ ID NO: 5480073 - DNA, 22 bp, Homo sapiens
gcagcccgtgaagcagtgcctc

SEQ ID NO: 5480074 - DNA, 20 bp, Homo sapiens
gcagcccgtgtccaggagcc

SEQ ID NO: 5480075 - DNA, 19 bp, Homo sapiens
gcagcccgtgtggcccctt

SEQ ID NO: 5480076 - DNA, 21 bp, Homo sapiens
gcagcccgtgtggccccttca

SEQ ID NO: 5480077 - DNA, 23 bp, Homo sapiens
gcagccctaaggatctctcagga

SEQ ID NO: 5480078 - DNA, 23 bp, Homo sapiens
gcagccctaccttaaggaaagtt

SEQ ID NO: 5480079 - DNA, 22 bp, Homo sapiens
gcagccctagagcctgcctgga

SEQ ID NO: 5480080 - DNA, 23 bp, Homo sapiens
gcagccctcaacaggcccaggga

SEQ ID NO: 5480081 - DNA, 19 bp, Homo sapiens
gcagccctcaattgtgaaa

SEQ ID NO: 5480082 - DNA, 16 bp, Homo sapiens
gcagccctcacctctg

SEQ ID NO: 5480083 - DNA, 21 bp, Homo sapiens
gcagccctcacctctgaggac

SEQ ID NO: 5480084 - DNA, 18 bp, Homo sapiens
gcagccctccacttctgg

SEQ ID NO: 5480085 - DNA, 14 bp, Homo sapiens
gcagccctccatgg

SEQ ID NO: 5480086 - DNA, 18 bp, Homo sapiens
gcagccctccatggtcct

SEQ ID NO: 5480087 - DNA, 24 bp, Homo sapiens
gcagccctccatggtcctgtctgt

SEQ ID NO: 5480088 - DNA, 12 bp, Homo sapiens
gcagccctctcc

SEQ ID NO: 5480089 - DNA, 17 bp, Homo sapiens
gcagccctctccaccca

SEQ ID NO: 5480090 - DNA, 21 bp, Homo sapiens
gcagccctctccacccagagg

SEQ ID NO: 5480091 - DNA, 21 bp, Homo sapiens
gcagccctgagaaagccctgt

SEQ ID NO: 5480092 - DNA, 14 bp, Homo sapiens
gcagccctggagtc

SEQ ID NO: 5480093 - DNA, 17 bp, Homo sapiens
gcagccctggcccatca

SEQ ID NO: 5480094 - DNA, 22 bp, Homo sapiens
gcagccctggcccccatcagcc

SEQ ID NO: 5480095 - DNA, 18 bp, Homo sapiens
gcagccctgggggccagc

SEQ ID NO: 5480096 - DNA, 16 bp, Homo sapiens
gcagcccttcctcctg

SEQ ID NO: 5480097 - DNA, 17 bp, Homo sapiens
gcagcccttcctcctga

SEQ ID NO: 5480098 - DNA, 12 bp, Homo sapiens
gcagcccttgct

SEQ ID NO: 5480099 - DNA, 14 bp, Homo sapiens
gcagcccttgggca

SEQ ID NO: 5480100 - DNA, 16 bp, Homo sapiens
gcagcccttgggcagt

SEQ ID NO: 5480101 - DNA, 23 bp, Homo sapiens
gcagcccttgtgtgtgccctggg

SEQ ID NO: 5480102 - DNA, 20 bp, Homo sapiens
gcagccgagccccaggagcc

SEQ ID NO: 5480103 - DNA, 14 bp, Homo sapiens
gcagccgagctcgt

SEQ ID NO: 5480104 - DNA, 15 bp, Homo sapiens
gcagccgaggcctgg

SEQ ID NO: 5480105 - DNA, 16 bp, Homo sapiens
gcagccgaggcctggc

SEQ ID NO: 5480106 - DNA, 20 bp, Homo sapiens
gcagccgccccatctgcccc

SEQ ID NO: 5480107 - DNA, 17 bp, Homo sapiens
gcagccgccgggcaggc

SEQ ID NO: 5480108 - DNA, 19 bp, Homo sapiens
gcagccgcctcccttatgc

SEQ ID NO: 5480109 - DNA, 14 bp, Homo sapiens
gcagccgccttcac

SEQ ID NO: 5480110 - DNA, 14 bp, Homo sapiens
gcagccgccttcct

SEQ ID NO: 5480111 - DNA, 14 bp, Homo sapiens
gcagccgcgctctg

SEQ ID NO: 5480112 - DNA, 20 bp, Homo sapiens
gcagccgcgctctgcccctc

SEQ ID NO: 5480113 - DNA, 16 bp, Homo sapiens
gcagccgctaggagag

SEQ ID NO: 5480114 - DNA, 17 bp, Homo sapiens
gcagccgctgagcgagg

SEQ ID NO: 5480115 - DNA, 16 bp, Homo sapiens
gcagccggaggaggag

SEQ ID NO: 5480116 - DNA, 20 bp, Homo sapiens
gcagccggaggaggagatgt

SEQ ID NO: 5480117 - DNA, 15 bp, Homo sapiens
gcagccggagggagg

SEQ ID NO: 5480118 - DNA, 22 bp, Homo sapiens
gcagccggagtcactgcctgga

SEQ ID NO: 5480119 - DNA, 18 bp, Homo sapiens
gcagccggcacagggtct

SEQ ID NO: 5480120 - DNA, 18 bp, Homo sapiens
gcagccggggagctgagg

SEQ ID NO: 5480121 - DNA, 16 bp, Homo sapiens
gcagccgtccatagca

SEQ ID NO: 5480122 - DNA, 14 bp, Homo sapiens
gcagccgtcccagg

SEQ ID NO: 5480123 - DNA, 18 bp, Homo sapiens
gcagccgtcccaggccac

SEQ ID NO: 5480124 - DNA, 14 bp, Homo sapiens
gcagccgtgccttc

SEQ ID NO: 5480125 - DNA, 17 bp, Homo sapiens
gcagccgtgccttcagc

SEQ ID NO: 5480126 - DNA, 18 bp, Homo sapiens
gcagccgtttgagaagaa

SEQ ID NO: 5480127 - DNA, 22 bp, Homo sapiens
gcagccgtttgagaagaaaaca

SEQ ID NO: 5480128 - DNA, 16 bp, Homo sapiens
gcagccgttttcctca

SEQ ID NO: 5480129 - DNA, 15 bp, Homo sapiens
gcagcctaagaagaa

SEQ ID NO: 5480130 - DNA, 16 bp, Homo sapiens
gcagcctaagaagaag

SEQ ID NO: 5480131 - DNA, 19 bp, Homo sapiens
gcagcctaagaagaaggcc

SEQ ID NO: 5480132 - DNA, 22 bp, Homo sapiens
gcagcctaagaagaaggccaga

SEQ ID NO: 5480133 - DNA, 16 bp, Homo sapiens
gcagcctactagggac

SEQ ID NO: 5480134 - DNA, 23 bp, Homo sapiens
gcagcctactagggacctgggga

SEQ ID NO: 5480135 - DNA, 23 bp, Homo sapiens
gcagcctagcctatgtctggcag

SEQ ID NO: 5480136 - DNA, 19 bp, Homo sapiens
gcagcctcaacctcctggg

SEQ ID NO: 5480137 - DNA, 14 bp, Homo sapiens
gcagcctcaaggcc

SEQ ID NO: 5480138 - DNA, 21 bp, Homo sapiens
gcagcctcacactggcgtctg

SEQ ID NO: 5480139 - DNA, 19 bp, Homo sapiens
gcagcctcacagtccttac

SEQ ID NO: 5480140 - DNA, 12 bp, Homo sapiens
gcagcctcagag

SEQ ID NO: 5480141 - DNA, 15 bp, Homo sapiens
gcagcctcagagtgg

SEQ ID NO: 5480142 - DNA, 13 bp, Homo sapiens
gcagcctcaggac

SEQ ID NO: 5480143 - DNA, 21 bp, Homo sapiens
gcagcctcaggactgggagcc

SEQ ID NO: 5480144 - DNA, 14 bp, Homo sapiens
gcagcctcagggct

SEQ ID NO: 5480145 - DNA, 21 bp, Homo sapiens
gcagcctcatactcctgggct

SEQ ID NO: 5480146 - DNA, 13 bp, Homo sapiens
gcagcctccactg

SEQ ID NO: 5480147 - DNA, 17 bp, Homo sapiens
gcagcctccactgtgtc

SEQ ID NO: 5480148 - DNA, 13 bp, Homo sapiens
gcagcctccagag

SEQ ID NO: 5480149 - DNA, 14 bp, Homo sapiens
gcagcctccagagc

SEQ ID NO: 5480150 - DNA, 15 bp, Homo sapiens
gcagcctccagagcc

SEQ ID NO: 5480151 - DNA, 18 bp, Homo sapiens
gcagcctccagagccagc

SEQ ID NO: 5480152 - DNA, 22 bp, Homo sapiens
gcagcctccagagccagcctgg

SEQ ID NO: 5480153 - DNA, 16 bp, Homo sapiens
gcagcctccagtctgc

SEQ ID NO: 5480154 - DNA, 15 bp, Homo sapiens
gcagcctccagtgct

SEQ ID NO: 5480155 - DNA, 16 bp, Homo sapiens
gcagcctccagtgctg

SEQ ID NO: 5480156 - DNA, 17 bp, Homo sapiens
gcagcctccagtgctgg

SEQ ID NO: 5480157 - DNA, 20 bp, Homo sapiens
gcagcctccagtgctggctg

SEQ ID NO: 5480158 - DNA, 22 bp, Homo sapiens
gcagcctccctctgacctgcag

SEQ ID NO: 5480159 - DNA, 23 bp, Homo sapiens
gcagcctcccttccatgccccag

SEQ ID NO: 5480160 - DNA, 21 bp, Homo sapiens
gcagcctccgggcgtgtgaag

SEQ ID NO: 5480161 - DNA, 15 bp, Homo sapiens
gcagcctcctgggca

SEQ ID NO: 5480162 - DNA, 18 bp, Homo sapiens
gcagcctcctgggcagtc

SEQ ID NO: 5480163 - DNA, 18 bp, Homo sapiens
gcagcctccttgcctgga

SEQ ID NO: 5480164 - DNA, 17 bp, Homo sapiens
gcagcctcctttgtgtg

SEQ ID NO: 5480165 - DNA, 20 bp, Homo sapiens
gcagcctcgacctccctggc

SEQ ID NO: 5480166 - DNA, 17 bp, Homo sapiens
gcagcctcgaggctggt

SEQ ID NO: 5480167 - DNA, 18 bp, Homo sapiens
gcagcctcgaggctggtg

SEQ ID NO: 5480168 - DNA, 15 bp, Homo sapiens
gcagcctcgcacagg

SEQ ID NO: 5480169 - DNA, 19 bp, Homo sapiens
gcagcctcgcacaggccct

SEQ ID NO: 5480170 - DNA, 19 bp, Homo sapiens
gcagcctcgcccctggcag

SEQ ID NO: 5480171 - DNA, 21 bp, Homo sapiens
gcagcctcgcccctggcagag

SEQ ID NO: 5480172 - DNA, 18 bp, Homo sapiens
gcagcctcgttaggacaa

SEQ ID NO: 5480173 - DNA, 12 bp, Homo sapiens
gcagcctctccc

SEQ ID NO: 5480174 - DNA, 16 bp, Homo sapiens
gcagcctctccccagg

SEQ ID NO: 5480175 - DNA, 20 bp, Homo sapiens
gcagcctctccccaggtcca

SEQ ID NO: 5480176 - DNA, 14 bp, Homo sapiens
gcagcctctctggc

SEQ ID NO: 5480177 - DNA, 16 bp, Homo sapiens
gcagcctctcttcact

SEQ ID NO: 5480178 - DNA, 16 bp, Homo sapiens
gcagcctctgatctgt

SEQ ID NO: 5480179 - DNA, 20 bp, Homo sapiens
gcagcctctgatctgtgcag

SEQ ID NO: 5480180 - DNA, 15 bp, Homo sapiens
gcagcctctgccagg

SEQ ID NO: 5480181 - DNA, 17 bp, Homo sapiens
gcagcctctgccaggcc

SEQ ID NO: 5480182 - DNA, 20 bp, Homo sapiens
gcagcctctggacagccagt

SEQ ID NO: 5480183 - DNA, 21 bp, Homo sapiens
gcagcctctggacagccagtg

SEQ ID NO: 5480184 - DNA, 22 bp, Homo sapiens
gcagcctctggacagccagtga

SEQ ID NO: 5480185 - DNA, 14 bp, Homo sapiens
gcagcctctggggg

SEQ ID NO: 5480186 - DNA, 13 bp, Homo sapiens
gcagcctctgtcc

SEQ ID NO: 5480187 - DNA, 17 bp, Homo sapiens
gcagcctgaagcctgga

SEQ ID NO: 5480188 - DNA, 18 bp, Homo sapiens
gcagcctgaccccaggca

SEQ ID NO: 5480189 - DNA, 16 bp, Homo sapiens
gcagcctgagaatgac

SEQ ID NO: 5480190 - DNA, 17 bp, Homo sapiens
gcagcctgagagctggc

SEQ ID NO: 5480191 - DNA, 11 bp, Homo sapiens
gcagcctgagc

SEQ ID NO: 5480192 - DNA, 15 bp, Homo sapiens
gcagcctgagctcca

SEQ ID NO: 5480193 - DNA, 20 bp, Homo sapiens
gcagcctgagctccaccctc

SEQ ID NO: 5480194 - DNA, 21 bp, Homo sapiens
gcagcctgagctccaccctcc

SEQ ID NO: 5480195 - DNA, 13 bp, Homo sapiens
gcagcctgatggc

SEQ ID NO: 5480196 - DNA, 17 bp, Homo sapiens
gcagcctgatggccaag

SEQ ID NO: 5480197 - DNA, 19 bp, Homo sapiens
gcagcctgatggccaaggg

SEQ ID NO: 5480198 - DNA, 17 bp, Homo sapiens
gcagcctgattcggggc

SEQ ID NO: 5480199 - DNA, 15 bp, Homo sapiens
gcagcctgcacctgc

SEQ ID NO: 5480200 - DNA, 20 bp, Homo sapiens
gcagcctgcacctgccccgt

SEQ ID NO: 5480201 - DNA, 14 bp, Homo sapiens
gcagcctgccagca

SEQ ID NO: 5480202 - DNA, 16 bp, Homo sapiens
gcagcctgctctagtg

SEQ ID NO: 5480203 - DNA, 22 bp, Homo sapiens
gcagcctgcttcccacctccct

SEQ ID NO: 5480204 - DNA, 13 bp, Homo sapiens
gcagcctgctttg

SEQ ID NO: 5480205 - DNA, 18 bp, Homo sapiens
gcagcctgctttggcctt

SEQ ID NO: 5480206 - DNA, 17 bp, Homo sapiens
gcagctgagatgtggac

SEQ ID NO: 5480207 - DNA, 18 bp, Homo sapiens
gcagctgagcagggccgg

SEQ ID NO: 5480208 - DNA, 20 bp, Homo sapiens
gcagctgagcagggccgggg

SEQ ID NO: 5480209 - DNA, 15 bp, Homo sapiens
gcagctgagcctgag

SEQ ID NO: 5480210 - DNA, 13 bp, Homo sapiens
gcagctgaggccc

SEQ ID NO: 5480211 - DNA, 16 bp, Homo sapiens
gcagctgatacaaatt

SEQ ID NO: 5480212 - DNA, 16 bp, Homo sapiens
gcagctgatccaggca

SEQ ID NO: 5480213 - DNA, 16 bp, Homo sapiens
gcagctgatccatagg

SEQ ID NO: 5480214 - DNA, 16 bp, Homo sapiens
gcagctgatgcctgaa

SEQ ID NO: 5480215 - DNA, 18 bp, Homo sapiens
gcagctgatgcctgaatg

SEQ ID NO: 5480216 - DNA, 21 bp, Homo sapiens
gcagctgattcagcagtgcct

SEQ ID NO: 5480217 - DNA, 15 bp, Homo sapiens
gcagctgattttaac

SEQ ID NO: 5480218 - DNA, 18 bp, Homo sapiens
gcagctgcaccagcaggt

SEQ ID NO: 5480219 - DNA, 22 bp, Homo sapiens
gcagctgcagttagcacagagg

SEQ ID NO: 5480220 - DNA, 19 bp, Homo sapiens
gcagctgcatttggggtgg

SEQ ID NO: 5480221 - DNA, 20 bp, Homo sapiens
gcagctgcatttggggtggg

SEQ ID NO: 5480222 - DNA, 13 bp, Homo sapiens
gcagctgcccctc

SEQ ID NO: 5480223 - DNA, 14 bp, Homo sapiens
gcagctgcccctcc

SEQ ID NO: 5480224 - DNA, 14 bp, Homo sapiens
gcagctgcccctgg

SEQ ID NO: 5480225 - DNA, 10 bp, Homo sapiens
gcagctgcct

SEQ ID NO: 5480226 - DNA, 15 bp, Homo sapiens
gcagctgcctcccct

SEQ ID NO: 5480227 - DNA, 18 bp, Homo sapiens
gcagctgcctcccctcct

SEQ ID NO: 5480228 - DNA, 22 bp, Homo sapiens
gcagctgcctcccctcctctgc

SEQ ID NO: 5480229 - DNA, 14 bp, Homo sapiens
gcagctgcctctgc

SEQ ID NO: 5480230 - DNA, 15 bp, Homo sapiens
gcagctgcctctgct

SEQ ID NO: 5480231 - DNA, 16 bp, Homo sapiens
gcagctgcctctgctc

SEQ ID NO: 5480232 - DNA, 18 bp, Homo sapiens
gcagctgcctctgctccc

SEQ ID NO: 5480233 - DNA, 17 bp, Homo sapiens
gcagctgcctggggccc

SEQ ID NO: 5480234 - DNA, 17 bp, Homo sapiens
gcagctgcgggtctgaa

SEQ ID NO: 5480235 - DNA, 19 bp, Homo sapiens
gcagctgcggtccacccag

SEQ ID NO: 5480236 - DNA, 15 bp, Homo sapiens
gcagctgctccccag

SEQ ID NO: 5480237 - DNA, 18 bp, Homo sapiens
gcagctgctcttagtgcc

SEQ ID NO: 5480238 - DNA, 21 bp, Homo sapiens
gcagctgctgccactctgctg

SEQ ID NO: 5480239 - DNA, 13 bp, Homo sapiens
gcagctgctggtt

SEQ ID NO: 5480240 - DNA, 11 bp, Homo sapiens
gcagctgctgt

SEQ ID NO: 5480241 - DNA, 13 bp, Homo sapiens
gcagctgctgtct

SEQ ID NO: 5480242 - DNA, 22 bp, Homo sapiens
gcagctgctgtgggtggggccc

SEQ ID NO: 5480243 - DNA, 17 bp, Homo sapiens
gcagctgcttgttgtca

SEQ ID NO: 5480244 - DNA, 19 bp, Homo sapiens
gcagctggaagtggctctg

SEQ ID NO: 5480245 - DNA, 16 bp, Homo sapiens
gcagctggactaccca

SEQ ID NO: 5480246 - DNA, 21 bp, Homo sapiens
gcagctggatggggcggcctg

SEQ ID NO: 5480247 - DNA, 15 bp, Homo sapiens
gcagctggcactgac

SEQ ID NO: 5480248 - DNA, 18 bp, Homo sapiens
gcagctggcactgacagc

SEQ ID NO: 5480249 - DNA, 21 bp, Homo sapiens
gcagctggcactgacagcctg

SEQ ID NO: 5480250 - DNA, 14 bp, Homo sapiens
gcagctggcagaga

SEQ ID NO: 5480251 - DNA, 13 bp, Homo sapiens
gcagctggcagga

SEQ ID NO: 5480252 - DNA, 16 bp, Homo sapiens
gcagctggcaggagag

SEQ ID NO: 5480253 - DNA, 21 bp, Homo sapiens
gcagctggcaggagagagcct

SEQ ID NO: 5480254 - DNA, 15 bp, Homo sapiens
gcagctggcaggagt

SEQ ID NO: 5480255 - DNA, 11 bp, Homo sapiens
gcagctggccc

SEQ ID NO: 5480256 - DNA, 13 bp, Homo sapiens
gcagctggcccac

SEQ ID NO: 5480257 - DNA, 21 bp, Homo sapiens
gcagctggcccactgctggct

SEQ ID NO: 5480258 - DNA, 13 bp, Homo sapiens
gcagctggccccc

SEQ ID NO: 5480259 - DNA, 17 bp, Homo sapiens
gcagctggcccccagcc

SEQ ID NO: 5480260 - DNA, 20 bp, Homo sapiens
gcagctggcccccagccctg

SEQ ID NO: 5480261 - DNA, 22 bp, Homo sapiens
gcagctggcccccagccctggg

SEQ ID NO: 5480262 - DNA, 12 bp, Homo sapiens
gcagctggccta

SEQ ID NO: 5480263 - DNA, 11 bp, Homo sapiens
gcagctggctc

SEQ ID NO: 5480264 - DNA, 13 bp, Homo sapiens
gcagctggctctg

SEQ ID NO: 5480265 - DNA, 14 bp, Homo sapiens
gcagctggctctga

SEQ ID NO: 5480266 - DNA, 18 bp, Homo sapiens
gcagctgggaagaggagc

SEQ ID NO: 5480267 - DNA, 14 bp, Homo sapiens
gcagctgggcactg

SEQ ID NO: 5480268 - DNA, 12 bp, Homo sapiens
gcagctgggccc

SEQ ID NO: 5480269 - DNA, 13 bp, Homo sapiens
gcagctgggccca

SEQ ID NO: 5480270 - DNA, 23 bp, Homo sapiens
gcagctgggcccaaccctgtctg

SEQ ID NO: 5480271 - DNA, 15 bp, Homo sapiens
gcagctgggcccaca

SEQ ID NO: 5480272 - DNA, 17 bp, Homo sapiens
gcagctgggccccacct

SEQ ID NO: 5480273 - DNA, 14 bp, Homo sapiens
gcagctgggccggc

SEQ ID NO: 5480274 - DNA, 17 bp, Homo sapiens
gcagctgggccggccag

SEQ ID NO: 5480275 - DNA, 18 bp, Homo sapiens
gcagctgggccggccagc

SEQ ID NO: 5480276 - DNA, 20 bp, Homo sapiens
gcagctgggccggccagcct

SEQ ID NO: 5480277 - DNA, 22 bp, Homo sapiens
gcagctgggccggccagccttg

SEQ ID NO: 5480278 - DNA, 23 bp, Homo sapiens
gcagctgggccggccagccttgc

SEQ ID NO: 5480279 - DNA, 12 bp, Homo sapiens
gcagctgggctg

SEQ ID NO: 5480280 - DNA, 23 bp, Homo sapiens
gcagctgggcttggcctggagag

SEQ ID NO: 5480281 - DNA, 16 bp, Homo sapiens
gcagctggggagcagc

SEQ ID NO: 5480282 - DNA, 20 bp, Homo sapiens
gcagctggggccggagcctt

SEQ ID NO: 5480283 - DNA, 21 bp, Homo sapiens
gcagctggggggcaccggctc

SEQ ID NO: 5480284 - DNA, 21 bp, Homo sapiens
gcagctggggggctgtcctga

SEQ ID NO: 5480285 - DNA, 12 bp, Homo sapiens
gcagctggggta

SEQ ID NO: 5480286 - DNA, 22 bp, Homo sapiens
gcagctggggtaggctgtctgt

SEQ ID NO: 5480287 - DNA, 20 bp, Homo sapiens
gcagctggtctttattcctc

SEQ ID NO: 5480288 - DNA, 14 bp, Homo sapiens
gcagctggtctttt

SEQ ID NO: 5480289 - DNA, 17 bp, Homo sapiens
gcagctggtcttttctc

SEQ ID NO: 5480290 - DNA, 19 bp, Homo sapiens
gcagctggtcttttctcct

SEQ ID NO: 5480291 - DNA, 16 bp, Homo sapiens
gcagctggtgccccac

SEQ ID NO: 5480292 - DNA, 22 bp, Homo sapiens
gcagctggtgccccacctgcct

SEQ ID NO: 5480293 - DNA, 11 bp, Homo sapiens
gcagctgtcac

SEQ ID NO: 5480294 - DNA, 18 bp, Homo sapiens
gcagctgtcaccactaca

SEQ ID NO: 5480295 - DNA, 21 bp, Homo sapiens
gcagctgtcccctctccctgg

SEQ ID NO: 5480296 - DNA, 22 bp, Homo sapiens
gcagctgtcccttgcttgcctg

SEQ ID NO: 5480297 - DNA, 14 bp, Homo sapiens
gcagctgtcctgaa

SEQ ID NO: 5480298 - DNA, 17 bp, Homo sapiens
gcagctgtcctgtgatg

SEQ ID NO: 5480299 - DNA, 12 bp, Homo sapiens
gcagctgtgaga

SEQ ID NO: 5480300 - DNA, 16 bp, Homo sapiens
gcagctgtgctgcacc

SEQ ID NO: 5480301 - DNA, 20 bp, Homo sapiens
gcagctgtgctgggtgagct

SEQ ID NO: 5480302 - DNA, 21 bp, Homo sapiens
gcagctgtggtacaaatgtga

SEQ ID NO: 5480303 - DNA, 16 bp, Homo sapiens
gcagctgtgtctgagc

SEQ ID NO: 5480304 - DNA, 20 bp, Homo sapiens
gcagctgtgtctgagcccaa

SEQ ID NO: 5480305 - DNA, 21 bp, Homo sapiens
gcagctgtgtctgagcccaac

SEQ ID NO: 5480306 - DNA, 10 bp, Homo sapiens
gcagctgttg

SEQ ID NO: 5480307 - DNA, 16 bp, Homo sapiens
gcagctgttgcagtga

SEQ ID NO: 5480308 - DNA, 16 bp, Homo sapiens
gcagctgttgtctctt

SEQ ID NO: 5480309 - DNA, 18 bp, Homo sapiens
gcagctgttgtctcttct

SEQ ID NO: 5480310 - DNA, 19 bp, Homo sapiens
gcagctgttgtctcttctc

SEQ ID NO: 5480311 - DNA, 22 bp, Homo sapiens
gcagctgttttcaaagcccccg

SEQ ID NO: 5480312 - DNA, 17 bp, Homo sapiens
gcagctgttttgttgac

SEQ ID NO: 5480313 - DNA, 20 bp, Homo sapiens
gcagctgttttgttgacatt

SEQ ID NO: 5480314 - DNA, 14 bp, Homo sapiens
gcagcttaaaaact

SEQ ID NO: 5480315 - DNA, 15 bp, Homo sapiens
gcagcttaacattga

SEQ ID NO: 5480316 - DNA, 17 bp, Homo sapiens
gcagcttaagtccagct

SEQ ID NO: 5480317 - DNA, 19 bp, Homo sapiens
gcagcttagagttggccat

SEQ ID NO: 5480318 - DNA, 15 bp, Homo sapiens
gcagcttagggccct

SEQ ID NO: 5480319 - DNA, 19 bp, Homo sapiens
gcagcttagggccctggag

SEQ ID NO: 5480320 - DNA, 20 bp, Homo sapiens
gcagcttagggccctggagg

SEQ ID NO: 5480321 - DNA, 21 bp, Homo sapiens
gcagcttagggccctggaggc

SEQ ID NO: 5480322 - DNA, 15 bp, Homo sapiens
gcagcttattcacaa

SEQ ID NO: 5480323 - DNA, 21 bp, Homo sapiens
gcagcttcaggtgagccaagg

SEQ ID NO: 5480324 - DNA, 17 bp, Homo sapiens
gcagcttcatcaatttt

SEQ ID NO: 5480325 - DNA, 19 bp, Homo sapiens
gcagcttcatcaattttta

SEQ ID NO: 5480326 - DNA, 22 bp, Homo sapiens
gcagcttcatcaatttttatac

SEQ ID NO: 5480327 - DNA, 12 bp, Homo sapiens
gcagcttccaga

SEQ ID NO: 5480328 - DNA, 17 bp, Homo sapiens
gcagcttcctgtctgtt

SEQ ID NO: 5480329 - DNA, 17 bp, Homo sapiens
gcagcttctactcctgc

SEQ ID NO: 5480330 - DNA, 18 bp, Homo sapiens
gcagcttctactcctgcc

SEQ ID NO: 5480331 - DNA, 18 bp, Homo sapiens
gcagcttctgccacttcc

SEQ ID NO: 5480332 - DNA, 17 bp, Homo sapiens
gcagcttctgccccctg

SEQ ID NO: 5480333 - DNA, 21 bp, Homo sapiens
gcagcttctgccccctgcaga

SEQ ID NO: 5480334 - DNA, 14 bp, Homo sapiens
gcagcttctgtcct

SEQ ID NO: 5480335 - DNA, 16 bp, Homo sapiens
gcagcttctgtcctct

SEQ ID NO: 5480336 - DNA, 14 bp, Homo sapiens
gcagcttcttgggc

SEQ ID NO: 5480337 - DNA, 18 bp, Homo sapiens
gcagcttcttgggctgag

SEQ ID NO: 5480338 - DNA, 23 bp, Homo sapiens
gcagcttgagagggcaaacccaa

SEQ ID NO: 5480339 - DNA, 14 bp, Homo sapiens
gcagcttgagcctg

SEQ ID NO: 5480340 - DNA, 21 bp, Homo sapiens
gcagcttgagggttgggctgg

SEQ ID NO: 5480341 - DNA, 13 bp, Homo sapiens
gcagcttgccccg

SEQ ID NO: 5480342 - DNA, 13 bp, Homo sapiens
gcagcttgctggg

SEQ ID NO: 5480343 - DNA, 17 bp, Homo sapiens
gcagcttgctgggcttt

SEQ ID NO: 5480344 - DNA, 20 bp, Homo sapiens
gcagcttgctgggctttggg

SEQ ID NO: 5480345 - DNA, 16 bp, Homo sapiens
gcagcttggagacagg

SEQ ID NO: 5480346 - DNA, 14 bp, Homo sapiens
gcagcttggctgag

SEQ ID NO: 5480347 - DNA, 22 bp, Homo sapiens
gcagcttgggctggcgggccct

SEQ ID NO: 5480348 - DNA, 21 bp, Homo sapiens
gcagcttgtagccagccgggg

SEQ ID NO: 5480349 - DNA, 22 bp, Homo sapiens
gcagcttgtagccagccggggc

SEQ ID NO: 5480350 - DNA, 23 bp, Homo sapiens
gcagcttgtagccagccggggcg

SEQ ID NO: 5480351 - DNA, 19 bp, Homo sapiens
gcagcttgtccttgctcct

SEQ ID NO: 5480352 - DNA, 19 bp, Homo sapiens
gcagcttgtgctgagcctg

SEQ ID NO: 5480353 - DNA, 17 bp, Homo sapiens
gcagctttaaactcagg

SEQ ID NO: 5480354 - DNA, 20 bp, Homo sapiens
gcagctttaaactcagggac

SEQ ID NO: 5480355 - DNA, 18 bp, Homo sapiens
gcagctttaaccattaaa

SEQ ID NO: 5480356 - DNA, 21 bp, Homo sapiens
gcagctttaaccattaaaact

SEQ ID NO: 5480357 - DNA, 22 bp, Homo sapiens
gcagctttaacctgctgggaat

SEQ ID NO: 5480358 - DNA, 23 bp, Homo sapiens
gcagctttactgccttcctcctt

SEQ ID NO: 5480359 - DNA, 19 bp, Homo sapiens
gcagctttagaatcccagc

SEQ ID NO: 5480360 - DNA, 14 bp, Homo sapiens
gcagctttatgttc

SEQ ID NO: 5480361 - DNA, 15 bp, Homo sapiens
gcagctttctagaag

SEQ ID NO: 5480362 - DNA, 23 bp, Homo sapiens
gcagctttgaggctggcggggtc

SEQ ID NO: 5480363 - DNA, 20 bp, Homo sapiens
gcagcttttggtctccttgg

SEQ ID NO: 5480364 - DNA, 14 bp, Homo sapiens
gcagctttttctgt

SEQ ID NO: 5480365 - DNA, 13 bp, Homo sapiens
gcaggaaaatgga

SEQ ID NO: 5480366 - DNA, 21 bp, Homo sapiens
gcaggaaacatttctgacacc

SEQ ID NO: 5480367 - DNA, 19 bp, Homo sapiens
gcaggaaaccctttttgta

SEQ ID NO: 5480368 - DNA, 17 bp, Homo sapiens
gcaggaaagactggccc

SEQ ID NO: 5480369 - DNA, 16 bp, Homo sapiens
gcaggaaagagggagc

SEQ ID NO: 5480370 - DNA, 18 bp, Homo sapiens
gcaggaaagccacatctt

SEQ ID NO: 5480371 - DNA, 15 bp, Homo sapiens
gcaggaaatcagagc

SEQ ID NO: 5480372 - DNA, 21 bp, Homo sapiens
gcaggaaatgaaaatgtcttg

SEQ ID NO: 5480373 - DNA, 21 bp, Homo sapiens
gcaggaaattcagcccaccag

SEQ ID NO: 5480374 - DNA, 17 bp, Homo sapiens
gcaggaacaatgactac

SEQ ID NO: 5480375 - DNA, 17 bp, Homo sapiens
gcaggaaccatggacct

SEQ ID NO: 5480376 - DNA, 19 bp, Homo sapiens
gcaggaaccatggacctgc

SEQ ID NO: 5480377 - DNA, 17 bp, Homo sapiens
gcaggaaccgaggactc

SEQ ID NO: 5480378 - DNA, 20 bp, Homo sapiens
gcaggaaccggagggtgacc

SEQ ID NO: 5480379 - DNA, 17 bp, Homo sapiens
gcaggaacgagcactgg

SEQ ID NO: 5480380 - DNA, 18 bp, Homo sapiens
gcaggaacgagcactggc

SEQ ID NO: 5480381 - DNA, 15 bp, Homo sapiens
gcaggaactcccagc

SEQ ID NO: 5480382 - DNA, 16 bp, Homo sapiens
gcaggaactgaaaacc

SEQ ID NO: 5480383 - DNA, 19 bp, Homo sapiens
gcaggaactgaaaaccagt

SEQ ID NO: 5480384 - DNA, 15 bp, Homo sapiens
gcaggatggactggc

SEQ ID NO: 5480385 - DNA, 22 bp, Homo sapiens
gcaggatggcctttccttccct

SEQ ID NO: 5480386 - DNA, 19 bp, Homo sapiens
gcaggatgggggagagggg

SEQ ID NO: 5480387 - DNA, 15 bp, Homo sapiens
gcaggattctctgca

SEQ ID NO: 5480388 - DNA, 15 bp, Homo sapiens
gcaggattcttcccg

SEQ ID NO: 5480389 - DNA, 22 bp, Homo sapiens
gcaggattcttcccgctcccca

SEQ ID NO: 5480390 - DNA, 20 bp, Homo sapiens
gcaggattcttcctccctcc

SEQ ID NO: 5480391 - DNA, 19 bp, Homo sapiens
gcaggattgattatgcaga

SEQ ID NO: 5480392 - DNA, 17 bp, Homo sapiens
gcaggatttgttctctg

SEQ ID NO: 5480393 - DNA, 19 bp, Homo sapiens
gcaggatttgttctctgtc

SEQ ID NO: 5480394 - DNA, 20 bp, Homo sapiens
gcaggatttttagagcatta

SEQ ID NO: 5480395 - DNA, 13 bp, Homo sapiens
gcaggcaaaggcc

SEQ ID NO: 5480396 - DNA, 20 bp, Homo sapiens
gcaggcaagacaccttccca

SEQ ID NO: 5480397 - DNA, 16 bp, Homo sapiens
gcaggcaagcccttcg

SEQ ID NO: 5480398 - DNA, 16 bp, Homo sapiens
gcaggcacacacgcct

SEQ ID NO: 5480399 - DNA, 22 bp, Homo sapiens
gcaggcacacacgccttcatgc

SEQ ID NO: 5480400 - DNA, 15 bp, Homo sapiens
gcaggcacagcacag

SEQ ID NO: 5480401 - DNA, 17 bp, Homo sapiens
gcaggcaccagcagcag

SEQ ID NO: 5480402 - DNA, 16 bp, Homo sapiens
gcaggcaccgccacgt

SEQ ID NO: 5480403 - DNA, 19 bp, Homo sapiens
gcaggcacgggtggtcccc

SEQ ID NO: 5480404 - DNA, 12 bp, Homo sapiens
gcaggcagacac

SEQ ID NO: 5480405 - DNA, 13 bp, Homo sapiens
gcaggcagacacg

SEQ ID NO: 5480406 - DNA, 20 bp, Homo sapiens
gcaggcagacacggatctga

SEQ ID NO: 5480407 - DNA, 12 bp, Homo sapiens
gcaggcagacca

SEQ ID NO: 5480408 - DNA, 12 bp, Homo sapiens
gcaggcagagag

SEQ ID NO: 5480409 - DNA, 22 bp, Homo sapiens
gcaggcagagagtacagactgc

SEQ ID NO: 5480410 - DNA, 14 bp, Homo sapiens
gcaggcagagcggg

SEQ ID NO: 5480411 - DNA, 18 bp, Homo sapiens
gcaggcagagcggggagg

SEQ ID NO: 5480412 - DNA, 19 bp, Homo sapiens
gcaggcagaggcccaggct

SEQ ID NO: 5480413 - DNA, 12 bp, Homo sapiens
gcaggcagagtg

SEQ ID NO: 5480414 - DNA, 22 bp, Homo sapiens
gcaggcagataagttggagcag

SEQ ID NO: 5480415 - DNA, 20 bp, Homo sapiens
gcaggcagatcacctgaggt

SEQ ID NO: 5480416 - DNA, 17 bp, Homo sapiens
gcaggcagattaataac

SEQ ID NO: 5480417 - DNA, 22 bp, Homo sapiens
gcaggcagatttactgtcccag

SEQ ID NO: 5480418 - DNA, 14 bp, Homo sapiens
gcaggcagccagca

SEQ ID NO: 5480419 - DNA, 16 bp, Homo sapiens
gcaggcagccaggcca

SEQ ID NO: 5480420 - DNA, 16 bp, Homo sapiens
gcaggcagcctgagag

SEQ ID NO: 5480421 - DNA, 21 bp, Homo sapiens
gcaggcagcctgagagctggc

SEQ ID NO: 5480422 - DNA, 23 bp, Homo sapiens
gcaggcagcgcagggctggcacg

SEQ ID NO: 5480423 - DNA, 13 bp, Homo sapiens
gcaggcagcgcca

SEQ ID NO: 5480424 - DNA, 18 bp, Homo sapiens
gcaggcagcgcctgtccc

SEQ ID NO: 5480425 - DNA, 16 bp, Homo sapiens
gcaggcaggcagcctg

SEQ ID NO: 5480426 - DNA, 17 bp, Homo sapiens
gcaggcaggcggctcct

SEQ ID NO: 5480427 - DNA, 18 bp, Homo sapiens
gcaggcaggcggctcctc

SEQ ID NO: 5480428 - DNA, 15 bp, Homo sapiens
gcaggcaggctccca

SEQ ID NO: 5480429 - DNA, 18 bp, Homo sapiens
gcaggcaggctcccaggg

SEQ ID NO: 5480430 - DNA, 19 bp, Homo sapiens
gcaggcagggctctcctgg

SEQ ID NO: 5480431 - DNA, 11 bp, Homo sapiens
gcaggcagggg

SEQ ID NO: 5480432 - DNA, 14 bp, Homo sapiens
gcaggcaggggcat

SEQ ID NO: 5480433 - DNA, 21 bp, Homo sapiens
gcaggcaggggcatctgtctg

SEQ ID NO: 5480434 - DNA, 19 bp, Homo sapiens
gcaggcaggggcttggctg

SEQ ID NO: 5480435 - DNA, 14 bp, Homo sapiens
gcaggcaggtggac

SEQ ID NO: 5480436 - DNA, 17 bp, Homo sapiens
gcaggcatagaggcttc

SEQ ID NO: 5480437 - DNA, 22 bp, Homo sapiens
gcaggcatcggggagccgggag

SEQ ID NO: 5480438 - DNA, 15 bp, Homo sapiens
gcaggcatggccctg

SEQ ID NO: 5480439 - DNA, 19 bp, Homo sapiens
gcaggcatggctggtgcct

SEQ ID NO: 5480440 - DNA, 23 bp, Homo sapiens
gcaggcattgcctcggctggctc

SEQ ID NO: 5480441 - DNA, 21 bp, Homo sapiens
gcaggcattgctttgccctgg

SEQ ID NO: 5480442 - DNA, 22 bp, Homo sapiens
gcaggccaagagcagaggcagc

SEQ ID NO: 5480443 - DNA, 20 bp, Homo sapiens
gcaggccaaggccttctcct

SEQ ID NO: 5480444 - DNA, 23 bp, Homo sapiens
gcaggccaaggccttctcctccc

SEQ ID NO: 5480445 - DNA, 15 bp, Homo sapiens
gcaggccaaggtctg

SEQ ID NO: 5480446 - DNA, 16 bp, Homo sapiens
gcaggccaaggtctga

SEQ ID NO: 5480447 - DNA, 20 bp, Homo sapiens
gcaggccaagtcaggccctt

SEQ ID NO: 5480448 - DNA, 20 bp, Homo sapiens
gcaggccacacttcaaacta

SEQ ID NO: 5480449 - DNA, 18 bp, Homo sapiens
gcaggccacccgggctgc

SEQ ID NO: 5480450 - DNA, 17 bp, Homo sapiens
gcaggccacctggctct

SEQ ID NO: 5480451 - DNA, 15 bp, Homo sapiens
gcaggccactagtga

SEQ ID NO: 5480452 - DNA, 15 bp, Homo sapiens
gcaggccagagaaag

SEQ ID NO: 5480453 - DNA, 22 bp, Homo sapiens
gcaggccagctgtggttttctt

SEQ ID NO: 5480454 - DNA, 20 bp, Homo sapiens
gcaggccagcttcgtgctgg

SEQ ID NO: 5480455 - DNA, 12 bp, Homo sapiens
gcaggccaggcc

SEQ ID NO: 5480456 - DNA, 13 bp, Homo sapiens
gcaggccaggcca

SEQ ID NO: 5480457 - DNA, 16 bp, Homo sapiens
gcaggccaggccagct

SEQ ID NO: 5480458 - DNA, 18 bp, Homo sapiens
gcaggccaggccagcttc

SEQ ID NO: 5480459 - DNA, 19 bp, Homo sapiens
gcaggccaggctgcctcgg

SEQ ID NO: 5480460 - DNA, 19 bp, Homo sapiens
gcaggccaggggaggggtg

SEQ ID NO: 5480461 - DNA, 19 bp, Homo sapiens
gcaggccaggtccagagag

SEQ ID NO: 5480462 - DNA, 10 bp, Homo sapiens
gcaggccagt

SEQ ID NO: 5480463 - DNA, 19 bp, Homo sapiens
gcaggccagtcccacggct

SEQ ID NO: 5480464 - DNA, 19 bp, Homo sapiens
gcaggccagtggacagagg

SEQ ID NO: 5480465 - DNA, 22 bp, Homo sapiens
gcaggcccaaattatcaagcta

SEQ ID NO: 5480466 - DNA, 16 bp, Homo sapiens
gcaggcccaatgctgc

SEQ ID NO: 5480467 - DNA, 19 bp, Homo sapiens
gcaggcccaatgctgcttt

SEQ ID NO: 5480468 - DNA, 14 bp, Homo sapiens
gcaggcccaccctg

SEQ ID NO: 5480469 - DNA, 16 bp, Homo sapiens
gcaggcccactcccca

SEQ ID NO: 5480470 - DNA, 11 bp, Homo sapiens
gcaggcccagc

SEQ ID NO: 5480471 - DNA, 15 bp, Homo sapiens
gcaggcccagcagac

SEQ ID NO: 5480472 - DNA, 15 bp, Homo sapiens
gcaggcccagcctct

SEQ ID NO: 5480473 - DNA, 12 bp, Homo sapiens
gcaggcccagct

SEQ ID NO: 5480474 - DNA, 17 bp, Homo sapiens
gcaggcccagctggggc

SEQ ID NO: 5480475 - DNA, 14 bp, Homo sapiens
gcaggcccaggaga

SEQ ID NO: 5480476 - DNA, 13 bp, Homo sapiens
gcaggcccaggca

SEQ ID NO: 5480477 - DNA, 17 bp, Homo sapiens
gcaggcccaggcaggcc

SEQ ID NO: 5480478 - DNA, 23 bp, Homo sapiens
gcaggcccaggcaggcccagcct

SEQ ID NO: 5480479 - DNA, 13 bp, Homo sapiens
gcaggcccagtga

SEQ ID NO: 5480480 - DNA, 16 bp, Homo sapiens
gcaggccccagccaag

SEQ ID NO: 5480481 - DNA, 23 bp, Homo sapiens
gcaggcccccggggaggggccag

SEQ ID NO: 5480482 - DNA, 13 bp, Homo sapiens
gcaggcccctctc

SEQ ID NO: 5480483 - DNA, 14 bp, Homo sapiens
gcaggcccctctcc

SEQ ID NO: 5480484 - DNA, 23 bp, Homo sapiens
gcaggcccctctcctccgtggca

SEQ ID NO: 5480485 - DNA, 13 bp, Homo sapiens
gcaggcccgacag

SEQ ID NO: 5480486 - DNA, 16 bp, Homo sapiens
gcaggcccgacagaga

SEQ ID NO: 5480487 - DNA, 19 bp, Homo sapiens
gcaggcccgacagagagat

SEQ ID NO: 5480488 - DNA, 21 bp, Homo sapiens
gcaggcccgacagagagatga

SEQ ID NO: 5480489 - DNA, 22 bp, Homo sapiens
gcaggcccgacagagagatgaa

SEQ ID NO: 5480490 - DNA, 14 bp, Homo sapiens
gcaggccctgcact

SEQ ID NO: 5480491 - DNA, 20 bp, Homo sapiens
gcaggccctgcactgtcctg

SEQ ID NO: 5480492 - DNA, 14 bp, Homo sapiens
gcaggccctgccca

SEQ ID NO: 5480493 - DNA, 20 bp, Homo sapiens
gcaggccctgcccagccagc

SEQ ID NO: 5480494 - DNA, 14 bp, Homo sapiens
gcaggccctgcctt

SEQ ID NO: 5480495 - DNA, 16 bp, Homo sapiens
gcaggccctgggcctc

SEQ ID NO: 5480496 - DNA, 17 bp, Homo sapiens
gcaggccgaggcaggtg

SEQ ID NO: 5480497 - DNA, 14 bp, Homo sapiens
gcaggccggaacca

SEQ ID NO: 5480498 - DNA, 17 bp, Homo sapiens
gcaggccggaaccacag

SEQ ID NO: 5480499 - DNA, 18 bp, Homo sapiens
gcaggccggaaccacagg

SEQ ID NO: 5480500 - DNA, 19 bp, Homo sapiens
gcaggccggaaccacaggg

SEQ ID NO: 5480501 - DNA, 22 bp, Homo sapiens
gcaggccggaaccacagggcca

SEQ ID NO: 5480502 - DNA, 20 bp, Homo sapiens
gcaggcctaggacctcaggc

SEQ ID NO: 5480503 - DNA, 23 bp, Homo sapiens
gcaggcctccaacgcccctgtgg

SEQ ID NO: 5480504 - DNA, 13 bp, Homo sapiens
gcaggcctcccaa

SEQ ID NO: 5480505 - DNA, 14 bp, Homo sapiens
gcaggcctcccaag

SEQ ID NO: 5480506 - DNA, 13 bp, Homo sapiens
gcaggcctccctg

SEQ ID NO: 5480507 - DNA, 14 bp, Homo sapiens
gcaggcctccctga

SEQ ID NO: 5480508 - DNA, 14 bp, Homo sapiens
gcaggcctccctgc

SEQ ID NO: 5480509 - DNA, 16 bp, Homo sapiens
gcaggcctctgggacc

SEQ ID NO: 5480510 - DNA, 22 bp, Homo sapiens
gcaggcctctgggacccacaga

SEQ ID NO: 5480511 - DNA, 14 bp, Homo sapiens
gcaggcctctggtt

SEQ ID NO: 5480512 - DNA, 23 bp, Homo sapiens
gcaggcctctggttgcctccccc

SEQ ID NO: 5480513 - DNA, 12 bp, Homo sapiens
gcaggcctgaga

SEQ ID NO: 5480514 - DNA, 16 bp, Homo sapiens
gcaggcctgaggcaga

SEQ ID NO: 5480515 - DNA, 15 bp, Homo sapiens
gcaggcctgtccctg

SEQ ID NO: 5480516 - DNA, 18 bp, Homo sapiens
gcaggcctgtccctggga

SEQ ID NO: 5480517 - DNA, 20 bp, Homo sapiens
gcaggcctgtccctgggagt

SEQ ID NO: 5480518 - DNA, 18 bp, Homo sapiens
gcaggcctgttccctgag

SEQ ID NO: 5480519 - DNA, 22 bp, Homo sapiens
gcaggcctgttccctgaggacc

SEQ ID NO: 5480520 - DNA, 23 bp, Homo sapiens
gcaggccttagtacggctgctgc

SEQ ID NO: 5480521 - DNA, 16 bp, Homo sapiens
gcaggcgactggaggc

SEQ ID NO: 5480522 - DNA, 21 bp, Homo sapiens
gcaggcgatccccgcttcccc

SEQ ID NO: 5480523 - DNA, 17 bp, Homo sapiens
gcaggcgcgcaccgccc

SEQ ID NO: 5480524 - DNA, 12 bp, Homo sapiens
gcaggcggccag

SEQ ID NO: 5480525 - DNA, 20 bp, Homo sapiens
gcaggcggccagggcggcca

SEQ ID NO: 5480526 - DNA, 21 bp, Homo sapiens
gcaggcggccagggcggccag

SEQ ID NO: 5480527 - DNA, 15 bp, Homo sapiens
gcaggcggccctcag

SEQ ID NO: 5480528 - DNA, 20 bp, Homo sapiens
gcaggcgggcccatgaagaa

SEQ ID NO: 5480529 - DNA, 23 bp, Homo sapiens
gcaggcgggccggggcagggact

SEQ ID NO: 5480530 - DNA, 20 bp, Homo sapiens
gcaggcggggctcctcctga

SEQ ID NO: 5480531 - DNA, 23 bp, Homo sapiens
gcaggcggggctcctcctgaagg

SEQ ID NO: 5480532 - DNA, 22 bp, Homo sapiens
gcaggcggggggggcgcctgga

SEQ ID NO: 5480533 - DNA, 21 bp, Homo sapiens
gcaggcgggggtttgagccct

SEQ ID NO: 5480534 - DNA, 18 bp, Homo sapiens
gcaggcggtatccagagg

SEQ ID NO: 5480535 - DNA, 20 bp, Homo sapiens
gcaggcggtatccagaggtg

SEQ ID NO: 5480536 - DNA, 15 bp, Homo sapiens
gcaggcggtgggcac

SEQ ID NO: 5480537 - DNA, 20 bp, Homo sapiens
gcaggcgtgactcagcagcc

SEQ ID NO: 5480538 - DNA, 15 bp, Homo sapiens
gcaggctaaagtgat

SEQ ID NO: 5480539 - DNA, 17 bp, Homo sapiens
gcaggctaaggcgtgga

SEQ ID NO: 5480540 - DNA, 22 bp, Homo sapiens
gcaggctaaggcgtggagctgc

SEQ ID NO: 5480541 - DNA, 16 bp, Homo sapiens
gcaggctacactgaca

SEQ ID NO: 5480542 - DNA, 15 bp, Homo sapiens
gcaggctcactgcca

SEQ ID NO: 5480543 - DNA, 21 bp, Homo sapiens
gcaggctcactgccaggccag

SEQ ID NO: 5480544 - DNA, 22 bp, Homo sapiens
gcaggctcactgccaggccagc

SEQ ID NO: 5480545 - DNA, 17 bp, Homo sapiens
gcaggctcagactctgg

SEQ ID NO: 5480546 - DNA, 15 bp, Homo sapiens
gcaggctccatgcac

SEQ ID NO: 5480547 - DNA, 20 bp, Homo sapiens
gcaggctccatgcacctccc

SEQ ID NO: 5480548 - DNA, 23 bp, Homo sapiens
gcaggctcccagggacacctggg

SEQ ID NO: 5480549 - DNA, 14 bp, Homo sapiens
gcaggctcctcagc

SEQ ID NO: 5480550 - DNA, 16 bp, Homo sapiens
gcaggctcctcagccc

SEQ ID NO: 5480551 - DNA, 18 bp, Homo sapiens
gcaggctcctggctgtgc

SEQ ID NO: 5480552 - DNA, 21 bp, Homo sapiens
gcaggctcctggctgtgccca

SEQ ID NO: 5480553 - DNA, 13 bp, Homo sapiens
gcaggctctcagg

SEQ ID NO: 5480554 - DNA, 13 bp, Homo sapiens
gcaggctctctcc

SEQ ID NO: 5480555 - DNA, 15 bp, Homo sapiens
gcaggctgacatctg

SEQ ID NO: 5480556 - DNA, 22 bp, Homo sapiens
gcaggctgaggtggggaaggag

SEQ ID NO: 5480557 - DNA, 12 bp, Homo sapiens
gcaggctgattt

SEQ ID NO: 5480558 - DNA, 15 bp, Homo sapiens
gcaggctgcagagcc

SEQ ID NO: 5480559 - DNA, 18 bp, Homo sapiens
gcaggctgcagagcccgg

SEQ ID NO: 5480560 - DNA, 18 bp, Homo sapiens
gcaggctgcagcaggcag

SEQ ID NO: 5480561 - DNA, 12 bp, Homo sapiens
gcaggggcaggc

SEQ ID NO: 5480562 - DNA, 21 bp, Homo sapiens
gcaggggcaggcgcagaggtc

SEQ ID NO: 5480563 - DNA, 14 bp, Homo sapiens
gcaggggcagtggc

SEQ ID NO: 5480564 - DNA, 17 bp, Homo sapiens
gcaggggcagtggcctg

SEQ ID NO: 5480565 - DNA, 18 bp, Homo sapiens
gcaggggcatctgtctgt

SEQ ID NO: 5480566 - DNA, 20 bp, Homo sapiens
gcaggggccactccaaactc

SEQ ID NO: 5480567 - DNA, 23 bp, Homo sapiens
gcaggggcccctcctctgtgctc

SEQ ID NO: 5480568 - DNA, 13 bp, Homo sapiens
gcaggggcccctg

SEQ ID NO: 5480569 - DNA, 18 bp, Homo sapiens
gcaggggccgcttcgcca

SEQ ID NO: 5480570 - DNA, 23 bp, Homo sapiens
gcaggggccgcttcgccatgtgc

SEQ ID NO: 5480571 - DNA, 20 bp, Homo sapiens
gcaggggccgggggcagtct

SEQ ID NO: 5480572 - DNA, 13 bp, Homo sapiens
gcaggggcctgga

SEQ ID NO: 5480573 - DNA, 16 bp, Homo sapiens
gcaggggcctggagat

SEQ ID NO: 5480574 - DNA, 16 bp, Homo sapiens
gcaggggcctgggccg

SEQ ID NO: 5480575 - DNA, 21 bp, Homo sapiens
gcaggggcgggcggagggagg

SEQ ID NO: 5480576 - DNA, 23 bp, Homo sapiens
gcaggggcggtccagaggaggtg

SEQ ID NO: 5480577 - DNA, 23 bp, Homo sapiens
gcaggggctacgttagcagccca

SEQ ID NO: 5480578 - DNA, 14 bp, Homo sapiens
gcaggggctctgct

SEQ ID NO: 5480579 - DNA, 21 bp, Homo sapiens
gcaggggctctggagagaaac

SEQ ID NO: 5480580 - DNA, 15 bp, Homo sapiens
gcaggggctgcatcc

SEQ ID NO: 5480581 - DNA, 13 bp, Homo sapiens
gcaggggctgctg

SEQ ID NO: 5480582 - DNA, 18 bp, Homo sapiens
gcaggggctgctgggggc

SEQ ID NO: 5480583 - DNA, 21 bp, Homo sapiens
gcaggggctgctgggggctcc

SEQ ID NO: 5480584 - DNA, 12 bp, Homo sapiens
gcaggggctggg

SEQ ID NO: 5480585 - DNA, 16 bp, Homo sapiens
gcaggggctgggcaga

SEQ ID NO: 5480586 - DNA, 15 bp, Homo sapiens
gcaggggcttcctgg

SEQ ID NO: 5480587 - DNA, 18 bp, Homo sapiens
gcaggggcttcctggtgc

SEQ ID NO: 5480588 - DNA, 22 bp, Homo sapiens
gcaggggcttcctggtgctgga

SEQ ID NO: 5480589 - DNA, 18 bp, Homo sapiens
gcaggggcttggctgccc

SEQ ID NO: 5480590 - DNA, 23 bp, Homo sapiens
gcagggggccccgccagggctgg

SEQ ID NO: 5480591 - DNA, 18 bp, Homo sapiens
gcagggggccctgcccca

SEQ ID NO: 5480592 - DNA, 23 bp, Homo sapiens
gcagggggcttggctcgcacccc

SEQ ID NO: 5480593 - DNA, 16 bp, Homo sapiens
gcaggggggctgtgcc

SEQ ID NO: 5480594 - DNA, 22 bp, Homo sapiens
gcaggggggttgggttccagac

SEQ ID NO: 5480595 - DNA, 23 bp, Homo sapiens
gcaggggggttgggttccagaca

SEQ ID NO: 5480596 - DNA, 16 bp, Homo sapiens
gcagggggtccccatc

SEQ ID NO: 5480597 - DNA, 16 bp, Homo sapiens
gcagggggtgaaggca

SEQ ID NO: 5480598 - DNA, 14 bp, Homo sapiens
gcagggggtgaggg

SEQ ID NO: 5480599 - DNA, 21 bp, Homo sapiens
gcagggggtggacaaactgga

SEQ ID NO: 5480600 - DNA, 22 bp, Homo sapiens
gcaggggtcagtgcagcagagg

SEQ ID NO: 5480601 - DNA, 12 bp, Homo sapiens
gcaggggtcccc

SEQ ID NO: 5480602 - DNA, 19 bp, Homo sapiens
gcaggggtccttggtgtga

SEQ ID NO: 5480603 - DNA, 14 bp, Homo sapiens
gcaggggtctgagc

SEQ ID NO: 5480604 - DNA, 14 bp, Homo sapiens
gcaggggtgagagc

SEQ ID NO: 5480605 - DNA, 23 bp, Homo sapiens
gcaggggtgggggtggaggcttc

SEQ ID NO: 5480606 - DNA, 20 bp, Homo sapiens
gcaggggtggtggagggggc

SEQ ID NO: 5480607 - DNA, 16 bp, Homo sapiens
gcaggggtgtcctgat

SEQ ID NO: 5480608 - DNA, 13 bp, Homo sapiens
gcaggggttccca

SEQ ID NO: 5480609 - DNA, 19 bp, Homo sapiens
gcaggggttggggaaacag

SEQ ID NO: 5480610 - DNA, 20 bp, Homo sapiens
gcaggggttggtcaaggcca

SEQ ID NO: 5480611 - DNA, 21 bp, Homo sapiens
gcaggggttggtcaaggccac

SEQ ID NO: 5480612 - DNA, 15 bp, Homo sapiens
gcagggtcaggagag

SEQ ID NO: 5480613 - DNA, 18 bp, Homo sapiens
gcagggtccacagctgga

SEQ ID NO: 5480614 - DNA, 23 bp, Homo sapiens
gcagggtccctccagcaaagctc

SEQ ID NO: 5480615 - DNA, 24 bp, Homo sapiens
gcagggtcctccggggctcagccc

SEQ ID NO: 5480616 - DNA, 17 bp, Homo sapiens
gcagggtctagaaggct

SEQ ID NO: 5480617 - DNA, 16 bp, Homo sapiens
gcagggtctctgctcc

SEQ ID NO: 5480618 - DNA, 17 bp, Homo sapiens
gcagggtctgggcagga

SEQ ID NO: 5480619 - DNA, 14 bp, Homo sapiens
gcagggtctgggct

SEQ ID NO: 5480620 - DNA, 19 bp, Homo sapiens
gcagggtctgggctgggca

SEQ ID NO: 5480621 - DNA, 15 bp, Homo sapiens
gcagggtcttttcat

SEQ ID NO: 5480622 - DNA, 21 bp, Homo sapiens
gcagggtcttttcatctggga

SEQ ID NO: 5480623 - DNA, 14 bp, Homo sapiens
gcagggtgacgcct

SEQ ID NO: 5480624 - DNA, 23 bp, Homo sapiens
gcagggtgacgcctgagacagca

SEQ ID NO: 5480625 - DNA, 14 bp, Homo sapiens
gcagggtgcaggag

SEQ ID NO: 5480626 - DNA, 19 bp, Homo sapiens
gcagggtggaagcggctcc

SEQ ID NO: 5480627 - DNA, 15 bp, Homo sapiens
gcagggtgggagccg

SEQ ID NO: 5480628 - DNA, 17 bp, Homo sapiens
gcagggtgggcagccta

SEQ ID NO: 5480629 - DNA, 17 bp, Homo sapiens
gcagggtggggagggag

SEQ ID NO: 5480630 - DNA, 18 bp, Homo sapiens
gcagggtggggtctggga

SEQ ID NO: 5480631 - DNA, 21 bp, Homo sapiens
gcagggtggggtctgggaggg

SEQ ID NO: 5480632 - DNA, 20 bp, Homo sapiens
gcagggtggtggtattctgt

SEQ ID NO: 5480633 - DNA, 14 bp, Homo sapiens
gcagggttctagaa

SEQ ID NO: 5480634 - DNA, 14 bp, Homo sapiens
gcagggtttctttt

SEQ ID NO: 5480635 - DNA, 14 bp, Homo sapiens
gcagggtttgagca

SEQ ID NO: 5480636 - DNA, 16 bp, Homo sapiens
gcaggtaaactcctgt

SEQ ID NO: 5480637 - DNA, 15 bp, Homo sapiens
gcaggtaataataaa

SEQ ID NO: 5480638 - DNA, 15 bp, Homo sapiens
gcaggtacatttctg

SEQ ID NO: 5480639 - DNA, 23 bp, Homo sapiens
gcaggtacttcctcctgatggcc

SEQ ID NO: 5480640 - DNA, 19 bp, Homo sapiens
gcaggtagacctgtctcct

SEQ ID NO: 5480641 - DNA, 20 bp, Homo sapiens
gcaggtagatcgcttgagcc

SEQ ID NO: 5480642 - DNA, 22 bp, Homo sapiens
gcaggtagatcgcttgagccca

SEQ ID NO: 5480643 - DNA, 21 bp, Homo sapiens
gcaggtagccagggggactag

SEQ ID NO: 5480644 - DNA, 16 bp, Homo sapiens
gcaggtaggaatatta

SEQ ID NO: 5480645 - DNA, 20 bp, Homo sapiens
gcaggtaggaatattatatt

SEQ ID NO: 5480646 - DNA, 20 bp, Homo sapiens
gcaggtagttggtgaacaga

SEQ ID NO: 5480647 - DNA, 20 bp, Homo sapiens
gcaggtatttcagaaggaga

SEQ ID NO: 5480648 - DNA, 14 bp, Homo sapiens
gcaggtcacactgg

SEQ ID NO: 5480649 - DNA, 14 bp, Homo sapiens
gcaggtcaggacca

SEQ ID NO: 5480650 - DNA, 23 bp, Homo sapiens
gcaggtcaggaccaggacccagg

SEQ ID NO: 5480651 - DNA, 18 bp, Homo sapiens
gcaggtcatggagcagcc

SEQ ID NO: 5480652 - DNA, 16 bp, Homo sapiens
gcaggtccagctctgt

SEQ ID NO: 5480653 - DNA, 21 bp, Homo sapiens
gcaggtccagctctgtgggcc

SEQ ID NO: 5480654 - DNA, 15 bp, Homo sapiens
gcaggtccctaataa

SEQ ID NO: 5480655 - DNA, 19 bp, Homo sapiens
gcaggtccctaataaagct

SEQ ID NO: 5480656 - DNA, 20 bp, Homo sapiens
gcaggtccctaataaagctg

SEQ ID NO: 5480657 - DNA, 21 bp, Homo sapiens
gcaggtccctaataaagctgt

SEQ ID NO: 5480658 - DNA, 14 bp, Homo sapiens
gcaggtcctgccca

SEQ ID NO: 5480659 - DNA, 21 bp, Homo sapiens
gcaggtcctgcccatgtgtcc

SEQ ID NO: 5480660 - DNA, 18 bp, Homo sapiens
gcaggtcctggggaggct

SEQ ID NO: 5480661 - DNA, 16 bp, Homo sapiens
gcaggtcgggctgcca

SEQ ID NO: 5480662 - DNA, 17 bp, Homo sapiens
gcaggtcgggctgccag

SEQ ID NO: 5480663 - DNA, 18 bp, Homo sapiens
gcaggtcgggctgccagc

SEQ ID NO: 5480664 - DNA, 21 bp, Homo sapiens
gcaggtctcagcccgggacag

SEQ ID NO: 5480665 - DNA, 18 bp, Homo sapiens
gcaggtctctggcagaga

SEQ ID NO: 5480666 - DNA, 16 bp, Homo sapiens
gcaggtctcttctggg

SEQ ID NO: 5480667 - DNA, 16 bp, Homo sapiens
gcaggtctgcaggcca

SEQ ID NO: 5480668 - DNA, 14 bp, Homo sapiens
gcaggtctgggcca

SEQ ID NO: 5480669 - DNA, 17 bp, Homo sapiens
gcaggtgaaacccagtc

SEQ ID NO: 5480670 - DNA, 15 bp, Homo sapiens
gcaggtgaattgttt

SEQ ID NO: 5480671 - DNA, 19 bp, Homo sapiens
gcaggtgaccttctgggaa

SEQ ID NO: 5480672 - DNA, 17 bp, Homo sapiens
gcaggtgactgtgctgt

SEQ ID NO: 5480673 - DNA, 16 bp, Homo sapiens
gcaggtgagaacccag

SEQ ID NO: 5480674 - DNA, 22 bp, Homo sapiens
gcaggtgattggaccaggccat

SEQ ID NO: 5480675 - DNA, 14 bp, Homo sapiens
gcaggtgcaagaga

SEQ ID NO: 5480676 - DNA, 13 bp, Homo sapiens
gcaggtgccaggg

SEQ ID NO: 5480677 - DNA, 17 bp, Homo sapiens
gcaggtgccatgcctgc

SEQ ID NO: 5480678 - DNA, 18 bp, Homo sapiens
gcaggtgccatgcctgct

SEQ ID NO: 5480679 - DNA, 23 bp, Homo sapiens
gcaggtgccatgcctgctccctg

SEQ ID NO: 5480680 - DNA, 15 bp, Homo sapiens
gcaggtgcccccagg

SEQ ID NO: 5480681 - DNA, 18 bp, Homo sapiens
gcaggtgcctccaggtgt

SEQ ID NO: 5480682 - DNA, 19 bp, Homo sapiens
gcaggtgcctggcttgctg

SEQ ID NO: 5480683 - DNA, 20 bp, Homo sapiens
gcaggtgcctggcttgctgt

SEQ ID NO: 5480684 - DNA, 16 bp, Homo sapiens
gcaggtgcggcgcgca

SEQ ID NO: 5480685 - DNA, 16 bp, Homo sapiens
gcaggtgctcatgctg

SEQ ID NO: 5480686 - DNA, 18 bp, Homo sapiens
gcaggtgctcatgctgct

SEQ ID NO: 5480687 - DNA, 19 bp, Homo sapiens
gcaggtgctgccttgagac

SEQ ID NO: 5480688 - DNA, 14 bp, Homo sapiens
gcaggtgctgctac

SEQ ID NO: 5480689 - DNA, 21 bp, Homo sapiens
gcaggtgctgctaccctccct

SEQ ID NO: 5480690 - DNA, 22 bp, Homo sapiens
gcaggtgctgctaccctccctg

SEQ ID NO: 5480691 - DNA, 15 bp, Homo sapiens
gcaggtgctgctgcg

SEQ ID NO: 5480692 - DNA, 18 bp, Homo sapiens
gcaggtgctggagcactg

SEQ ID NO: 5480693 - DNA, 19 bp, Homo sapiens
gcaggtgcttttggcagag

SEQ ID NO: 5480694 - DNA, 21 bp, Homo sapiens
gcaggtgcttttggcagagac

SEQ ID NO: 5480695 - DNA, 21 bp, Homo sapiens
gcaggtggacgctgcagaccc

SEQ ID NO: 5480696 - DNA, 23 bp, Homo sapiens
gcaggtggacgctgcagacccca

SEQ ID NO: 5480697 - DNA, 13 bp, Homo sapiens
gcaggtggatcta

SEQ ID NO: 5480698 - DNA, 21 bp, Homo sapiens
gcaggtggatctccttgagat

SEQ ID NO: 5480699 - DNA, 17 bp, Homo sapiens
gcaggtggcatctctaa

SEQ ID NO: 5480700 - DNA, 19 bp, Homo sapiens
gcaggtggccgcccctgag

SEQ ID NO: 5480701 - DNA, 21 bp, Homo sapiens
gcaggtggccgcccctgaggc

SEQ ID NO: 5480702 - DNA, 21 bp, Homo sapiens
gcaggtggcctctgctggtct

SEQ ID NO: 5480703 - DNA, 16 bp, Homo sapiens
gcaggtgggagcttga

SEQ ID NO: 5480704 - DNA, 12 bp, Homo sapiens
gcaggtgggcag

SEQ ID NO: 5480705 - DNA, 22 bp, Homo sapiens
gcaggtgggctgcctgctgtgt

SEQ ID NO: 5480706 - DNA, 17 bp, Homo sapiens
gcaggtggggagactgg

SEQ ID NO: 5480707 - DNA, 17 bp, Homo sapiens
gcaggtggggagggggt

SEQ ID NO: 5480708 - DNA, 22 bp, Homo sapiens
gcaggtgggtgctgccctgtgt

SEQ ID NO: 5480709 - DNA, 13 bp, Homo sapiens
gcaggtggtggag

SEQ ID NO: 5480710 - DNA, 16 bp, Homo sapiens
gcaggtgtcctgagca

SEQ ID NO: 5480711 - DNA, 18 bp, Homo sapiens
gcaggtgtcctttcccct

SEQ ID NO: 5480712 - DNA, 12 bp, Homo sapiens
gcaggtgtctga

SEQ ID NO: 5480713 - DNA, 20 bp, Homo sapiens
gcaggtgtggtggctcatgg

SEQ ID NO: 5480714 - DNA, 16 bp, Homo sapiens
gcaggtgttgggacct

SEQ ID NO: 5480715 - DNA, 21 bp, Homo sapiens
gcaggtgttgggacctgctgc

SEQ ID NO: 5480716 - DNA, 15 bp, Homo sapiens
gcaggtgtttggcac

SEQ ID NO: 5480717 - DNA, 13 bp, Homo sapiens
gcaggttaaatgt

SEQ ID NO: 5480718 - DNA, 14 bp, Homo sapiens
gcaggttaaatgtt

SEQ ID NO: 5480719 - DNA, 18 bp, Homo sapiens
gcaggttatgtcagcagc

SEQ ID NO: 5480720 - DNA, 20 bp, Homo sapiens
gcaggttatgtcagcagctc

SEQ ID NO: 5480721 - DNA, 14 bp, Homo sapiens
gcaggttcatggat

SEQ ID NO: 5480722 - DNA, 18 bp, Homo sapiens
gcaggttcccaagctcag

SEQ ID NO: 5480723 - DNA, 23 bp, Homo sapiens
gcaggttcccacttaaaaattaa

SEQ ID NO: 5480724 - DNA, 15 bp, Homo sapiens
gcaggttccccaagg

SEQ ID NO: 5480725 - DNA, 12 bp, Homo sapiens
gcaggttcctgg

SEQ ID NO: 5480726 - DNA, 19 bp, Homo sapiens
gcaggttcctggggccgcc

SEQ ID NO: 5480727 - DNA, 19 bp, Homo sapiens
gcaggttctctcctgtgag

SEQ ID NO: 5480728 - DNA, 14 bp, Homo sapiens
gcaggttctctttg

SEQ ID NO: 5480729 - DNA, 20 bp, Homo sapiens
gcaggttcttcttcctgaag

SEQ ID NO: 5480730 - DNA, 15 bp, Homo sapiens
gcaggttcttgatgt

SEQ ID NO: 5480731 - DNA, 13 bp, Homo sapiens
gcaggttcttgtt

SEQ ID NO: 5480732 - DNA, 22 bp, Homo sapiens
gcaggttcttgttggtgcacag

SEQ ID NO: 5480733 - DNA, 14 bp, Homo sapiens
gcaggttgaagcca

SEQ ID NO: 5480734 - DNA, 17 bp, Homo sapiens
gcaggttgaagccatgt

SEQ ID NO: 5480735 - DNA, 19 bp, Homo sapiens
gcaggttgaggggctcctg

SEQ ID NO: 5480736 - DNA, 20 bp, Homo sapiens
gcaggttgaggggctcctgg

SEQ ID NO: 5480737 - DNA, 13 bp, Homo sapiens
gcagtttcagata

SEQ ID NO: 5480738 - DNA, 19 bp, Homo sapiens
gcagtttcagataaatcat

SEQ ID NO: 5480739 - DNA, 22 bp, Homo sapiens
gcagtttcatgtatgtatataa

SEQ ID NO: 5480740 - DNA, 14 bp, Homo sapiens
gcagtttcccagaa

SEQ ID NO: 5480741 - DNA, 20 bp, Homo sapiens
gcagtttctgacaattaaca

SEQ ID NO: 5480742 - DNA, 13 bp, Homo sapiens
gcagtttcttgtg

SEQ ID NO: 5480743 - DNA, 17 bp, Homo sapiens
gcagtttcttgtgtaga

SEQ ID NO: 5480744 - DNA, 18 bp, Homo sapiens
gcagtttcttgtgtagat

SEQ ID NO: 5480745 - DNA, 22 bp, Homo sapiens
gcagtttgaaattctgaatttg

SEQ ID NO: 5480746 - DNA, 19 bp, Homo sapiens
gcagtttgaggattagttt

SEQ ID NO: 5480747 - DNA, 16 bp, Homo sapiens
gcagtttgcaaaaaat

SEQ ID NO: 5480748 - DNA, 22 bp, Homo sapiens
gcagtttgccacccctgtccag

SEQ ID NO: 5480749 - DNA, 14 bp, Homo sapiens
gcagtttgcctctg

SEQ ID NO: 5480750 - DNA, 17 bp, Homo sapiens
gcagtttgcctctgcac

SEQ ID NO: 5480751 - DNA, 21 bp, Homo sapiens
gcagtttgcctggtgcagtgg

SEQ ID NO: 5480752 - DNA, 15 bp, Homo sapiens
gcagtttggccctgg

SEQ ID NO: 5480753 - DNA, 16 bp, Homo sapiens
gcagtttggccctgga

SEQ ID NO: 5480754 - DNA, 19 bp, Homo sapiens
gcagtttggccctggagcc

SEQ ID NO: 5480755 - DNA, 21 bp, Homo sapiens
gcagtttggccctggagccag

SEQ ID NO: 5480756 - DNA, 14 bp, Homo sapiens
gcagtttgggaggt

SEQ ID NO: 5480757 - DNA, 17 bp, Homo sapiens
gcagtttggggcagggg

SEQ ID NO: 5480758 - DNA, 16 bp, Homo sapiens
gcagtttgtgaacttc

SEQ ID NO: 5480759 - DNA, 16 bp, Homo sapiens
gcagttttaagaattg

SEQ ID NO: 5480760 - DNA, 15 bp, Homo sapiens
gcagttttcccctgg

SEQ ID NO: 5480761 - DNA, 14 bp, Homo sapiens
gcagttttgtaaat

SEQ ID NO: 5480762 - DNA, 22 bp, Homo sapiens
gcagttttgtaaataagtgaaa

SEQ ID NO: 5480763 - DNA, 15 bp, Homo sapiens
gcagttttgtaaatg

SEQ ID NO: 5480764 - DNA, 17 bp, Homo sapiens
gcagttttgtaaatgta

SEQ ID NO: 5480765 - DNA, 13 bp, Homo sapiens
gcagtttttaatt

SEQ ID NO: 5480766 - DNA, 12 bp, Homo sapiens
gcagtttttcag

SEQ ID NO: 5480767 - DNA, 22 bp, Homo sapiens
gcagtttttcagagtggaatgc

SEQ ID NO: 5480768 - DNA, 12 bp, Homo sapiens
gcagtttttccc

SEQ ID NO: 5480769 - DNA, 14 bp, Homo sapiens
gcagtttttccccc

SEQ ID NO: 5480770 - DNA, 15 bp, Homo sapiens
gcagtttttccccct

SEQ ID NO: 5480771 - DNA, 14 bp, Homo sapiens
gcagtttttctgta

SEQ ID NO: 5480772 - DNA, 16 bp, Homo sapiens
gcagtttttgttcctt

SEQ ID NO: 5480773 - DNA, 12 bp, Homo sapiens
gcagttttttga

SEQ ID NO: 5480774 - DNA, 18 bp, Homo sapiens
gcagttttttgaaaatgg

SEQ ID NO: 5480775 - DNA, 17 bp, Homo sapiens
gcagttttttttttctt

SEQ ID NO: 5480776 - DNA, 16 bp, Homo sapiens
gcataaaaacatttta

SEQ ID NO: 5480777 - DNA, 21 bp, Homo sapiens
gcataaaaattgaattcgttt

SEQ ID NO: 5480778 - DNA, 22 bp, Homo sapiens
gcataaaaattgaattcgtttc

SEQ ID NO: 5480779 - DNA, 11 bp, Homo sapiens
gcataaaacag

SEQ ID NO: 5480780 - DNA, 13 bp, Homo sapiens
gcataaaacctaa

SEQ ID NO: 5480781 - DNA, 14 bp, Homo sapiens
gcataaaagatcac

SEQ ID NO: 5480782 - DNA, 21 bp, Homo sapiens
gcataaataattttgttttaa

SEQ ID NO: 5480783 - DNA, 20 bp, Homo sapiens
gcataaatcacttcaactgc

SEQ ID NO: 5480784 - DNA, 22 bp, Homo sapiens
gcataaatctgaagtggttcag

SEQ ID NO: 5480785 - DNA, 17 bp, Homo sapiens
gcataaattaatcagcc

SEQ ID NO: 5480786 - DNA, 16 bp, Homo sapiens
gcataaatttaatgta

SEQ ID NO: 5480787 - DNA, 15 bp, Homo sapiens
gcataaatttgtaat

SEQ ID NO: 5480788 - DNA, 17 bp, Homo sapiens
gcataaatttgtaatat

SEQ ID NO: 5480789 - DNA, 20 bp, Homo sapiens
gcataaatttgtaatatatc

SEQ ID NO: 5480790 - DNA, 18 bp, Homo sapiens
gcataacaaggtccaaga

SEQ ID NO: 5480791 - DNA, 16 bp, Homo sapiens
gcataacaattcctct

SEQ ID NO: 5480792 - DNA, 21 bp, Homo sapiens
gcataacataaatctgtgaac

SEQ ID NO: 5480793 - DNA, 19 bp, Homo sapiens
gcataactgacaaatcaag

SEQ ID NO: 5480794 - DNA, 22 bp, Homo sapiens
gcataactgacaaatcaagttt

SEQ ID NO: 5480795 - DNA, 22 bp, Homo sapiens
gcataactgtagctcaagttta

SEQ ID NO: 5480796 - DNA, 16 bp, Homo sapiens
gcataagaaaaagaat

SEQ ID NO: 5480797 - DNA, 14 bp, Homo sapiens
gcataagaccaatc

SEQ ID NO: 5480798 - DNA, 16 bp, Homo sapiens
gcataagaccaatctc

SEQ ID NO: 5480799 - DNA, 23 bp, Homo sapiens
gcataagattaaaggaaggaaaa

SEQ ID NO: 5480800 - DNA, 20 bp, Homo sapiens
gcataagattatatacaaag

SEQ ID NO: 5480801 - DNA, 18 bp, Homo sapiens
gcataagcctcaggcctg

SEQ ID NO: 5480802 - DNA, 23 bp, Homo sapiens
gcataagtggttttcttcaggaa

SEQ ID NO: 5480803 - DNA, 20 bp, Homo sapiens
gcataataaatgcttcagtg

SEQ ID NO: 5480804 - DNA, 15 bp, Homo sapiens
gcataatactaattt

SEQ ID NO: 5480805 - DNA, 19 bp, Homo sapiens
gcataatatgaagcctttg

SEQ ID NO: 5480806 - DNA, 22 bp, Homo sapiens
gcataatgaaccgtttacagtg

SEQ ID NO: 5480807 - DNA, 15 bp, Homo sapiens
gcataatgataaaat

SEQ ID NO: 5480808 - DNA, 22 bp, Homo sapiens
gcataatgataaaataaataat

SEQ ID NO: 5480809 - DNA, 16 bp, Homo sapiens
gcataatgcaatcaaa

SEQ ID NO: 5480810 - DNA, 18 bp, Homo sapiens
gcataatgctttggaaaa

SEQ ID NO: 5480811 - DNA, 17 bp, Homo sapiens
gcataatgtccctctct

SEQ ID NO: 5480812 - DNA, 22 bp, Homo sapiens
gcataatgttaagctttattgt

SEQ ID NO: 5480813 - DNA, 21 bp, Homo sapiens
gcataattccgaaacaaaact

SEQ ID NO: 5480814 - DNA, 15 bp, Homo sapiens
gcataattgtgagtt

SEQ ID NO: 5480815 - DNA, 20 bp, Homo sapiens
gcataatttaaaaatatatt

SEQ ID NO: 5480816 - DNA, 19 bp, Homo sapiens
gcataatttgtttaaaatt

SEQ ID NO: 5480817 - DNA, 21 bp, Homo sapiens
gcataatttgtttaaaattct

SEQ ID NO: 5480818 - DNA, 23 bp, Homo sapiens
gcataatttgtttaaaattctct

SEQ ID NO: 5480819 - DNA, 17 bp, Homo sapiens
gcatacaaaaatatatt

SEQ ID NO: 5480820 - DNA, 19 bp, Homo sapiens
gcatacaaaaatatattaa

SEQ ID NO: 5480821 - DNA, 11 bp, Homo sapiens
gcatacaaaat

SEQ ID NO: 5480822 - DNA, 13 bp, Homo sapiens
gcatacaataaaa

SEQ ID NO: 5480823 - DNA, 19 bp, Homo sapiens
gcatacaataaaagagctt

SEQ ID NO: 5480824 - DNA, 13 bp, Homo sapiens
gcatacaatctga

SEQ ID NO: 5480825 - DNA, 14 bp, Homo sapiens
gcatacacacacac

SEQ ID NO: 5480826 - DNA, 22 bp, Homo sapiens
gcatacacacacacacacagcc

SEQ ID NO: 5480827 - DNA, 18 bp, Homo sapiens
gcatacaccaaacatttc

SEQ ID NO: 5480828 - DNA, 16 bp, Homo sapiens
gcatacactgtagttt

SEQ ID NO: 5480829 - DNA, 17 bp, Homo sapiens
gcatacaggggaggggc

SEQ ID NO: 5480830 - DNA, 14 bp, Homo sapiens
gcatacagttttct

SEQ ID NO: 5480831 - DNA, 23 bp, Homo sapiens
gcatacatacacacacacacata

SEQ ID NO: 5480832 - DNA, 13 bp, Homo sapiens
gcatacatgttca

SEQ ID NO: 5480833 - DNA, 23 bp, Homo sapiens
gcataccaattacccataaacag

SEQ ID NO: 5480834 - DNA, 18 bp, Homo sapiens
gcataccagttcttgcaa

SEQ ID NO: 5480835 - DNA, 23 bp, Homo sapiens
gcatacccagtgtctaccttcat

SEQ ID NO: 5480836 - DNA, 20 bp, Homo sapiens
gcataccgtttggtgtctga

SEQ ID NO: 5480837 - DNA, 22 bp, Homo sapiens
gcataccgtttggtgtctgatg

SEQ ID NO: 5480838 - DNA, 19 bp, Homo sapiens
gcatacctgtcctagcagg

SEQ ID NO: 5480839 - DNA, 19 bp, Homo sapiens
gcatacctttcacagcttt

SEQ ID NO: 5480840 - DNA, 13 bp, Homo sapiens
gcatactattaaa

SEQ ID NO: 5480841 - DNA, 22 bp, Homo sapiens
gcatactccgtgaggctgctgc

SEQ ID NO: 5480842 - DNA, 14 bp, Homo sapiens
gcatactctccagg

SEQ ID NO: 5480843 - DNA, 23 bp, Homo sapiens
gcatactgagccaagtataattt

SEQ ID NO: 5480844 - DNA, 17 bp, Homo sapiens
gcatactgtgtatgttt

SEQ ID NO: 5480845 - DNA, 18 bp, Homo sapiens
gcatactgttgatacaaa

SEQ ID NO: 5480846 - DNA, 20 bp, Homo sapiens
gcatactgttgatacaaacc

SEQ ID NO: 5480847 - DNA, 19 bp, Homo sapiens
gcatacttacctagtgaaa

SEQ ID NO: 5480848 - DNA, 16 bp, Homo sapiens
gcatacttcaaaagta

SEQ ID NO: 5480849 - DNA, 16 bp, Homo sapiens
gcatactttctctcta

SEQ ID NO: 5480850 - DNA, 18 bp, Homo sapiens
gcatactttgacaaggaa

SEQ ID NO: 5480851 - DNA, 14 bp, Homo sapiens
gcatactttgtaaa

SEQ ID NO: 5480852 - DNA, 13 bp, Homo sapiens
gcatacttttaat

SEQ ID NO: 5480853 - DNA, 15 bp, Homo sapiens
gcatacttttaatca

SEQ ID NO: 5480854 - DNA, 16 bp, Homo sapiens
gcatacttttaatcaa

SEQ ID NO: 5480855 - DNA, 17 bp, Homo sapiens
gcatactttttaaaaaa

SEQ ID NO: 5480856 - DNA, 15 bp, Homo sapiens
gcatagaaactgagg

SEQ ID NO: 5480857 - DNA, 17 bp, Homo sapiens
gcatagaactgggtaaa

SEQ ID NO: 5480858 - DNA, 23 bp, Homo sapiens
gcatagaaggaagtgtgtttgcc

SEQ ID NO: 5480859 - DNA, 12 bp, Homo sapiens
gcatagaaggag

SEQ ID NO: 5480860 - DNA, 14 bp, Homo sapiens
gcatagaaggcagg

SEQ ID NO: 5480861 - DNA, 16 bp, Homo sapiens
gcatagaataatgaag

SEQ ID NO: 5480862 - DNA, 15 bp, Homo sapiens
gcatagacatggatg

SEQ ID NO: 5480863 - DNA, 12 bp, Homo sapiens
gcatagagccct

SEQ ID NO: 5480864 - DNA, 13 bp, Homo sapiens
gcatagagccctg

SEQ ID NO: 5480865 - DNA, 14 bp, Homo sapiens
gcatagagccctgg

SEQ ID NO: 5480866 - DNA, 18 bp, Homo sapiens
gcatagagccctggccag

SEQ ID NO: 5480867 - DNA, 21 bp, Homo sapiens
gcatagagccctggccagccc

SEQ ID NO: 5480868 - DNA, 20 bp, Homo sapiens
gcatagagggagaggaagca

SEQ ID NO: 5480869 - DNA, 21 bp, Homo sapiens
gcatagagggagaggaagcac

SEQ ID NO: 5480870 - DNA, 23 bp, Homo sapiens
gcatagagggagaggaagcacac

SEQ ID NO: 5480871 - DNA, 15 bp, Homo sapiens
gcatagaggttttgt

SEQ ID NO: 5480872 - DNA, 23 bp, Homo sapiens
gcatagataatattgtttggtaa

SEQ ID NO: 5480873 - DNA, 14 bp, Homo sapiens
gcatagcaaacaga

SEQ ID NO: 5480874 - DNA, 20 bp, Homo sapiens
gcatagccagttctgacagt

SEQ ID NO: 5480875 - DNA, 16 bp, Homo sapiens
gcatagccattcattt

SEQ ID NO: 5480876 - DNA, 15 bp, Homo sapiens
gcatagccctcctga

SEQ ID NO: 5480877 - DNA, 18 bp, Homo sapiens
gcatagccctcctgagca

SEQ ID NO: 5480878 - DNA, 20 bp, Homo sapiens
gcatagccggtgggtgagga

SEQ ID NO: 5480879 - DNA, 12 bp, Homo sapiens
gcatagcctttc

SEQ ID NO: 5480880 - DNA, 18 bp, Homo sapiens
gcatagcgtcctgccctg

SEQ ID NO: 5480881 - DNA, 17 bp, Homo sapiens
gcatagctacaatttgt

SEQ ID NO: 5480882 - DNA, 14 bp, Homo sapiens
gcatagctctgggg

SEQ ID NO: 5480883 - DNA, 15 bp, Homo sapiens
gcatagctctggggt

SEQ ID NO: 5480884 - DNA, 17 bp, Homo sapiens
gcatagctgttttagct

SEQ ID NO: 5480885 - DNA, 15 bp, Homo sapiens
gcataggaagaaaat

SEQ ID NO: 5480886 - DNA, 17 bp, Homo sapiens
gcataggaggggtctgg

SEQ ID NO: 5480887 - DNA, 21 bp, Homo sapiens
gcataggagtttggaggaagt

SEQ ID NO: 5480888 - DNA, 18 bp, Homo sapiens
gcataggcccagccaggg

SEQ ID NO: 5480889 - DNA, 12 bp, Homo sapiens
gcataggcctgg

SEQ ID NO: 5480890 - DNA, 24 bp, Homo sapiens
gcataggctcttaagcagcatgga

SEQ ID NO: 5480891 - DNA, 15 bp, Homo sapiens
gcatagggaatatgt

SEQ ID NO: 5480892 - DNA, 17 bp, Homo sapiens
gcataggtctctttgct

SEQ ID NO: 5480893 - DNA, 21 bp, Homo sapiens
gcataggtgatctcatttaat

SEQ ID NO: 5480894 - DNA, 17 bp, Homo sapiens
gcatagtactggcacaa

SEQ ID NO: 5480895 - DNA, 23 bp, Homo sapiens
gcatagtattccattgtgtgagt

SEQ ID NO: 5480896 - DNA, 14 bp, Homo sapiens
gcatagtccccaga

SEQ ID NO: 5480897 - DNA, 21 bp, Homo sapiens
gcatagtccccagagctcccc

SEQ ID NO: 5480898 - DNA, 15 bp, Homo sapiens
gcatagtctgttcct

SEQ ID NO: 5480899 - DNA, 12 bp, Homo sapiens
gcatagtgctgg

SEQ ID NO: 5480900 - DNA, 22 bp, Homo sapiens
gcatagtgtgctcggacacagt

SEQ ID NO: 5480901 - DNA, 17 bp, Homo sapiens
gcatagtttctttattt

SEQ ID NO: 5480902 - DNA, 22 bp, Homo sapiens
gcatataaaatggcaacaaact

SEQ ID NO: 5480903 - DNA, 17 bp, Homo sapiens
gcatataaatatattta

SEQ ID NO: 5480904 - DNA, 16 bp, Homo sapiens
gcatataaatgtttat

SEQ ID NO: 5480905 - DNA, 15 bp, Homo sapiens
gcatataagggaagt

SEQ ID NO: 5480906 - DNA, 16 bp, Homo sapiens
gcatatagacacacat

SEQ ID NO: 5480907 - DNA, 15 bp, Homo sapiens
gcatatagactgtac

SEQ ID NO: 5480908 - DNA, 14 bp, Homo sapiens
gcatatagagatga

SEQ ID NO: 5480909 - DNA, 19 bp, Homo sapiens
gcatataggtgatgtttgc

SEQ ID NO: 5480910 - DNA, 19 bp, Homo sapiens
gcatatagttaaactgaga

SEQ ID NO: 5480911 - DNA, 22 bp, Homo sapiens
gcatatatataaaatacacgtg

SEQ ID NO: 5480912 - DNA, 12 bp, Homo sapiens
gcatatatatgt

SEQ ID NO: 5480913 - DNA, 23 bp, Homo sapiens
gcatatatgaaaacaatactaaa

SEQ ID NO: 5480914 - DNA, 19 bp, Homo sapiens
gcatatattaaaagcaggc

SEQ ID NO: 5480915 - DNA, 19 bp, Homo sapiens
gcatccccttggctgtgag

SEQ ID NO: 5480916 - DNA, 16 bp, Homo sapiens
gcatcccctttattaa

SEQ ID NO: 5480917 - DNA, 21 bp, Homo sapiens
gcatcccgagcaaccctctga

SEQ ID NO: 5480918 - DNA, 16 bp, Homo sapiens
gcatcccggctgaccc

SEQ ID NO: 5480919 - DNA, 17 bp, Homo sapiens
gcatccctccaccccag

SEQ ID NO: 5480920 - DNA, 13 bp, Homo sapiens
gcatccctcctgg

SEQ ID NO: 5480921 - DNA, 14 bp, Homo sapiens
gcatccctcctggt

SEQ ID NO: 5480922 - DNA, 13 bp, Homo sapiens
gcatccctgagac

SEQ ID NO: 5480923 - DNA, 18 bp, Homo sapiens
gcatccctgaggagccag

SEQ ID NO: 5480924 - DNA, 18 bp, Homo sapiens
gcatccctgcagaggaaa

SEQ ID NO: 5480925 - DNA, 16 bp, Homo sapiens
gcatccctgcttctgg

SEQ ID NO: 5480926 - DNA, 20 bp, Homo sapiens
gcatccctggagcaggagcc

SEQ ID NO: 5480927 - DNA, 21 bp, Homo sapiens
gcatccctggagcaggagccc

SEQ ID NO: 5480928 - DNA, 12 bp, Homo sapiens
gcatccctgggc

SEQ ID NO: 5480929 - DNA, 20 bp, Homo sapiens
gcatccctgggccttgggct

SEQ ID NO: 5480930 - DNA, 17 bp, Homo sapiens
gcatccctgtgagcaaa

SEQ ID NO: 5480931 - DNA, 19 bp, Homo sapiens
gcatccctgtgtccactga

SEQ ID NO: 5480932 - DNA, 20 bp, Homo sapiens
gcatcccttcccacatgcct

SEQ ID NO: 5480933 - DNA, 22 bp, Homo sapiens
gcatcccttcccacatgcctgc

SEQ ID NO: 5480934 - DNA, 18 bp, Homo sapiens
gcatcccttgaccaggcc

SEQ ID NO: 5480935 - DNA, 16 bp, Homo sapiens
gcatcccttggcccct

SEQ ID NO: 5480936 - DNA, 18 bp, Homo sapiens
gcatcccttggcccctct

SEQ ID NO: 5480937 - DNA, 14 bp, Homo sapiens
gcatccgaaggtgt

SEQ ID NO: 5480938 - DNA, 14 bp, Homo sapiens
gcatccgaccaggt

SEQ ID NO: 5480939 - DNA, 13 bp, Homo sapiens
gcatccgagcccc

SEQ ID NO: 5480940 - DNA, 16 bp, Homo sapiens
gcatccgcaggtgctg

SEQ ID NO: 5480941 - DNA, 17 bp, Homo sapiens
gcatccgcctctgagcc

SEQ ID NO: 5480942 - DNA, 18 bp, Homo sapiens
gcatccgcctctgagcca

SEQ ID NO: 5480943 - DNA, 19 bp, Homo sapiens
gcatccgcctctgagccag

SEQ ID NO: 5480944 - DNA, 23 bp, Homo sapiens
gcatccgcctctgagccaggagc

SEQ ID NO: 5480945 - DNA, 22 bp, Homo sapiens
gcatccgcctgaaagtgttttg

SEQ ID NO: 5480946 - DNA, 18 bp, Homo sapiens
gcatccgctgcgctccca

SEQ ID NO: 5480947 - DNA, 19 bp, Homo sapiens
gcatccggccaaatgcaaa

SEQ ID NO: 5480948 - DNA, 15 bp, Homo sapiens
gcatccgtcctgggc

SEQ ID NO: 5480949 - DNA, 20 bp, Homo sapiens
gcatcctaaagataaagcca

SEQ ID NO: 5480950 - DNA, 13 bp, Homo sapiens
gcatcctaagaaa

SEQ ID NO: 5480951 - DNA, 14 bp, Homo sapiens
gcatcctaagaaat

SEQ ID NO: 5480952 - DNA, 21 bp, Homo sapiens
gcatcctaagaaatatgtgag

SEQ ID NO: 5480953 - DNA, 11 bp, Homo sapiens
gcatcctagtc

SEQ ID NO: 5480954 - DNA, 12 bp, Homo sapiens
gcatcctcactg

SEQ ID NO: 5480955 - DNA, 13 bp, Homo sapiens
gcatcctcagccc

SEQ ID NO: 5480956 - DNA, 17 bp, Homo sapiens
gcatcctcagccccagg

SEQ ID NO: 5480957 - DNA, 18 bp, Homo sapiens
gcatcctcagccccaggg

SEQ ID NO: 5480958 - DNA, 20 bp, Homo sapiens
gcatcctcagccccagggcc

SEQ ID NO: 5480959 - DNA, 22 bp, Homo sapiens
gcatcctcagccccagggccct

SEQ ID NO: 5480960 - DNA, 14 bp, Homo sapiens
gcatcctccacatc

SEQ ID NO: 5480961 - DNA, 21 bp, Homo sapiens
gcatcctccacatcctgtgtc

SEQ ID NO: 5480962 - DNA, 17 bp, Homo sapiens
gcatcctccagcccctg

SEQ ID NO: 5480963 - DNA, 14 bp, Homo sapiens
gcatcctccggaga

SEQ ID NO: 5480964 - DNA, 16 bp, Homo sapiens
gcatcctcctcagccc

SEQ ID NO: 5480965 - DNA, 21 bp, Homo sapiens
gcatcctcctcagcccccagg

SEQ ID NO: 5480966 - DNA, 15 bp, Homo sapiens
gcatcctctccccca

SEQ ID NO: 5480967 - DNA, 13 bp, Homo sapiens
gcatcctctgact

SEQ ID NO: 5480968 - DNA, 15 bp, Homo sapiens
gcatcctctgactcc

SEQ ID NO: 5480969 - DNA, 16 bp, Homo sapiens
gcatcctgaaagccag

SEQ ID NO: 5480970 - DNA, 18 bp, Homo sapiens
gcatcctgaaagccagca

SEQ ID NO: 5480971 - DNA, 14 bp, Homo sapiens
gcatcctgagcccc

SEQ ID NO: 5480972 - DNA, 22 bp, Homo sapiens
gcatcctgagccccgccctctt

SEQ ID NO: 5480973 - DNA, 16 bp, Homo sapiens
gcatcctgaggccagt

SEQ ID NO: 5480974 - DNA, 15 bp, Homo sapiens
gcatcctgcctgggt

SEQ ID NO: 5480975 - DNA, 17 bp, Homo sapiens
gcatcctgcctgggtgg

SEQ ID NO: 5480976 - DNA, 22 bp, Homo sapiens
gcatcctgcctgggtgggacag

SEQ ID NO: 5480977 - DNA, 11 bp, Homo sapiens
gcatcctgctt

SEQ ID NO: 5480978 - DNA, 13 bp, Homo sapiens
gcatcctggatga

SEQ ID NO: 5480979 - DNA, 13 bp, Homo sapiens
gcatcctggcacc

SEQ ID NO: 5480980 - DNA, 13 bp, Homo sapiens
gcatcctggcagg

SEQ ID NO: 5480981 - DNA, 13 bp, Homo sapiens
gcatcctggctgg

SEQ ID NO: 5480982 - DNA, 14 bp, Homo sapiens
gcatcctggctggc

SEQ ID NO: 5480983 - DNA, 15 bp, Homo sapiens
gcatcctggctggct

SEQ ID NO: 5480984 - DNA, 18 bp, Homo sapiens
gcatcctggcttgcctcc

SEQ ID NO: 5480985 - DNA, 13 bp, Homo sapiens
gcatccttctgcc

SEQ ID NO: 5480986 - DNA, 13 bp, Homo sapiens
gcatccttgtctt

SEQ ID NO: 5480987 - DNA, 17 bp, Homo sapiens
gcatcgaaatgtattca

SEQ ID NO: 5480988 - DNA, 21 bp, Homo sapiens
gcatcgaggaagggccgagga

SEQ ID NO: 5480989 - DNA, 12 bp, Homo sapiens
gcatcgcaggag

SEQ ID NO: 5480990 - DNA, 21 bp, Homo sapiens
gcatcgcaggagtctctgcca

SEQ ID NO: 5480991 - DNA, 19 bp, Homo sapiens
gcatcgcatccgtcctggg

SEQ ID NO: 5480992 - DNA, 16 bp, Homo sapiens
gcatcggcctagggcc

SEQ ID NO: 5480993 - DNA, 17 bp, Homo sapiens
gcatcggggagccggga

SEQ ID NO: 5480994 - DNA, 19 bp, Homo sapiens
gcatcgtgacccttcaggg

SEQ ID NO: 5480995 - DNA, 21 bp, Homo sapiens
gcatcgtgacccttcagggcc

SEQ ID NO: 5480996 - DNA, 13 bp, Homo sapiens
gcatcgtggagac

SEQ ID NO: 5480997 - DNA, 15 bp, Homo sapiens
gcatcgtgtattcca

SEQ ID NO: 5480998 - DNA, 22 bp, Homo sapiens
gcatcgttttctttgctgtgcc

SEQ ID NO: 5480999 - DNA, 23 bp, Homo sapiens
gcatcgttttctttgctgtgcca

SEQ ID NO: 5481000 - DNA, 19 bp, Homo sapiens
gcatctaaactttaatatg

SEQ ID NO: 5481001 - DNA, 21 bp, Homo sapiens
gcatctaaactttaatatgta

SEQ ID NO: 5481002 - DNA, 22 bp, Homo sapiens
gcatctaagcatctgggttgcc

SEQ ID NO: 5481003 - DNA, 13 bp, Homo sapiens
gcatctaatgaaa

SEQ ID NO: 5481004 - DNA, 14 bp, Homo sapiens
gcatctaatgaaaa

SEQ ID NO: 5481005 - DNA, 18 bp, Homo sapiens
gcatctaatgaaaaacaa

SEQ ID NO: 5481006 - DNA, 19 bp, Homo sapiens
gcatctaatgaaaaacaaa

SEQ ID NO: 5481007 - DNA, 12 bp, Homo sapiens
gcatctacctgc

SEQ ID NO: 5481008 - DNA, 19 bp, Homo sapiens
gcatctactctaaagaaaa

SEQ ID NO: 5481009 - DNA, 20 bp, Homo sapiens
gcatctactctaaagaaaaa

SEQ ID NO: 5481010 - DNA, 22 bp, Homo sapiens
gcatctagaggcttccttcatt

SEQ ID NO: 5481011 - DNA, 13 bp, Homo sapiens
gcatctagccaga

SEQ ID NO: 5481012 - DNA, 16 bp, Homo sapiens
gcatctagctggagcc

SEQ ID NO: 5481013 - DNA, 20 bp, Homo sapiens
gcatctagttcccctgttta

SEQ ID NO: 5481014 - DNA, 22 bp, Homo sapiens
gcatctagttcccctgtttatt

SEQ ID NO: 5481015 - DNA, 20 bp, Homo sapiens
gcatctagtttccctggtgc

SEQ ID NO: 5481016 - DNA, 15 bp, Homo sapiens
gcatctataatgtca

SEQ ID NO: 5481017 - DNA, 19 bp, Homo sapiens
gcatctcaaaacagagggc

SEQ ID NO: 5481018 - DNA, 19 bp, Homo sapiens
gcatctcaatggaaacatc

SEQ ID NO: 5481019 - DNA, 12 bp, Homo sapiens
gcatctcactcc

SEQ ID NO: 5481020 - DNA, 14 bp, Homo sapiens
gcatctcagctcat

SEQ ID NO: 5481021 - DNA, 16 bp, Homo sapiens
gcatctcaggaggggc

SEQ ID NO: 5481022 - DNA, 19 bp, Homo sapiens
gcatctcaggaggggcagc

SEQ ID NO: 5481023 - DNA, 13 bp, Homo sapiens
gcatctcattgta

SEQ ID NO: 5481024 - DNA, 20 bp, Homo sapiens
gcatctccaagcagcttaga

SEQ ID NO: 5481025 - DNA, 17 bp, Homo sapiens
gcatctccacctgctcc

SEQ ID NO: 5481026 - DNA, 18 bp, Homo sapiens
gcatctccacctgctccc

SEQ ID NO: 5481027 - DNA, 20 bp, Homo sapiens
gcatctccacctgctcccag

SEQ ID NO: 5481028 - DNA, 22 bp, Homo sapiens
gcatctccagcattctcagcca

SEQ ID NO: 5481029 - DNA, 19 bp, Homo sapiens
gcatctccatttcacgggc

SEQ ID NO: 5481030 - DNA, 13 bp, Homo sapiens
gcatctcccccac

SEQ ID NO: 5481031 - DNA, 18 bp, Homo sapiens
gcatctcccccaccctgt

SEQ ID NO: 5481032 - DNA, 16 bp, Homo sapiens
gcatctccctgacctt

SEQ ID NO: 5481033 - DNA, 22 bp, Homo sapiens
gcatctccctgaccttctccag

SEQ ID NO: 5481034 - DNA, 20 bp, Homo sapiens
gcatctcctcccgcccttcc

SEQ ID NO: 5481035 - DNA, 14 bp, Homo sapiens
gcatctcctgagga

SEQ ID NO: 5481036 - DNA, 22 bp, Homo sapiens
gcatctcctgaggatcagaaag

SEQ ID NO: 5481037 - DNA, 15 bp, Homo sapiens
gcatctcctgtgcat

SEQ ID NO: 5481038 - DNA, 21 bp, Homo sapiens
gcatctcggttctgcgccact

SEQ ID NO: 5481039 - DNA, 23 bp, Homo sapiens
gcatctctatgaagagaaggagg

SEQ ID NO: 5481040 - DNA, 14 bp, Homo sapiens
gcatctctgaccag

SEQ ID NO: 5481041 - DNA, 15 bp, Homo sapiens
gcatctctgaccaga

SEQ ID NO: 5481042 - DNA, 23 bp, Homo sapiens
gcatctctgagtgtctctgcctg

SEQ ID NO: 5481043 - DNA, 24 bp, Homo sapiens
gcatctctgagtgtctctgcctgg

SEQ ID NO: 5481044 - DNA, 13 bp, Homo sapiens
gcatctctgggct

SEQ ID NO: 5481045 - DNA, 18 bp, Homo sapiens
gcatctctgggctgagcc

SEQ ID NO: 5481046 - DNA, 19 bp, Homo sapiens
gcatctctgggctgagcct

SEQ ID NO: 5481047 - DNA, 14 bp, Homo sapiens
gcatctctgtactt

SEQ ID NO: 5481048 - DNA, 18 bp, Homo sapiens
gcatctcttccccagaga

SEQ ID NO: 5481049 - DNA, 19 bp, Homo sapiens
gcatctcttccccagagag

SEQ ID NO: 5481050 - DNA, 22 bp, Homo sapiens
gcatctcttccccagagaggca

SEQ ID NO: 5481051 - DNA, 22 bp, Homo sapiens
gcatctcttcctgattccccac

SEQ ID NO: 5481052 - DNA, 16 bp, Homo sapiens
gcatctctttaaaggc

SEQ ID NO: 5481053 - DNA, 15 bp, Homo sapiens
gcatctgaaaacaat

SEQ ID NO: 5481054 - DNA, 16 bp, Homo sapiens
gcatctgaaagttttg

SEQ ID NO: 5481055 - DNA, 19 bp, Homo sapiens
gcatctgacacaaaaaaag

SEQ ID NO: 5481056 - DNA, 14 bp, Homo sapiens
gcatctgaccagca

SEQ ID NO: 5481057 - DNA, 15 bp, Homo sapiens
gcatctgaccagcag

SEQ ID NO: 5481058 - DNA, 20 bp, Homo sapiens
gcatctgaccagcagcgcct

SEQ ID NO: 5481059 - DNA, 19 bp, Homo sapiens
gcatctgactcacaagaag

SEQ ID NO: 5481060 - DNA, 15 bp, Homo sapiens
gcatctgagaaaggt

SEQ ID NO: 5481061 - DNA, 16 bp, Homo sapiens
gcatctgatttgcata

SEQ ID NO: 5481062 - DNA, 20 bp, Homo sapiens
gcatctgatttgcatattca

SEQ ID NO: 5481063 - DNA, 13 bp, Homo sapiens
gcatctgcaaagg

SEQ ID NO: 5481064 - DNA, 16 bp, Homo sapiens
gcatctgcaacaaaaa

SEQ ID NO: 5481065 - DNA, 21 bp, Homo sapiens
gcatctgcaggcaccgggctg

SEQ ID NO: 5481066 - DNA, 11 bp, Homo sapiens
gcatctgcatg

SEQ ID NO: 5481067 - DNA, 13 bp, Homo sapiens
gcatctgcatggg

SEQ ID NO: 5481068 - DNA, 15 bp, Homo sapiens
gcatctgcccctccc

SEQ ID NO: 5481069 - DNA, 17 bp, Homo sapiens
gcatctgcccctccccc

SEQ ID NO: 5481070 - DNA, 18 bp, Homo sapiens
gcatctgcctggagcctg

SEQ ID NO: 5481071 - DNA, 15 bp, Homo sapiens
gcatctgctctgaga

SEQ ID NO: 5481072 - DNA, 16 bp, Homo sapiens
gcatctggagagaaca

SEQ ID NO: 5481073 - DNA, 23 bp, Homo sapiens
gcatctggattctgcctaataaa

SEQ ID NO: 5481074 - DNA, 16 bp, Homo sapiens
gcatctggattgaaag

SEQ ID NO: 5481075 - DNA, 17 bp, Homo sapiens
gcatctggccctgctgc

SEQ ID NO: 5481076 - DNA, 21 bp, Homo sapiens
gcatctggccctgctgccccc

SEQ ID NO: 5481077 - DNA, 11 bp, Homo sapiens
gcatctggcct

SEQ ID NO: 5481078 - DNA, 14 bp, Homo sapiens
gcatctggcctatg

SEQ ID NO: 5481079 - DNA, 21 bp, Homo sapiens
gcatctggcctatgaccctgt

SEQ ID NO: 5481080 - DNA, 22 bp, Homo sapiens
gcatctggcctatgaccctgtg

SEQ ID NO: 5481081 - DNA, 12 bp, Homo sapiens
gcatctggctgt

SEQ ID NO: 5481082 - DNA, 13 bp, Homo sapiens
gcatctggctgtc

SEQ ID NO: 5481083 - DNA, 20 bp, Homo sapiens
gcatctggctgtctagaatg

SEQ ID NO: 5481084 - DNA, 22 bp, Homo sapiens
gcatctggctgtttagcagaac

SEQ ID NO: 5481085 - DNA, 23 bp, Homo sapiens
gcatctgggattcccaccaaggt

SEQ ID NO: 5481086 - DNA, 12 bp, Homo sapiens
gcatctggggcc

SEQ ID NO: 5481087 - DNA, 16 bp, Homo sapiens
gcatctggtgtaggaa

SEQ ID NO: 5481088 - DNA, 18 bp, Homo sapiens
gcatctggtgtaggaagt

SEQ ID NO: 5481089 - DNA, 15 bp, Homo sapiens
gcatctgtacaaagg

SEQ ID NO: 5481090 - DNA, 11 bp, Homo sapiens
gcatctgtata

SEQ ID NO: 5481091 - DNA, 23 bp, Homo sapiens
gcatctgtataagtaagaaaata

SEQ ID NO: 5481092 - DNA, 16 bp, Homo sapiens
gcatctgtcccccttt

SEQ ID NO: 5481093 - DNA, 13 bp, Homo sapiens
gcatctgtcctca

SEQ ID NO: 5481094 - DNA, 15 bp, Homo sapiens
gcatgcgcccgaggc

SEQ ID NO: 5481095 - DNA, 15 bp, Homo sapiens
gcatgcgcgctgtgg

SEQ ID NO: 5481096 - DNA, 17 bp, Homo sapiens
gcatgcggagccagcag

SEQ ID NO: 5481097 - DNA, 18 bp, Homo sapiens
gcatgcggcaaaccgcat

SEQ ID NO: 5481098 - DNA, 17 bp, Homo sapiens
gcatgcggcccagcccg

SEQ ID NO: 5481099 - DNA, 18 bp, Homo sapiens
gcatgcggcccagcccgg

SEQ ID NO: 5481100 - DNA, 15 bp, Homo sapiens
gcatgcggcccagga

SEQ ID NO: 5481101 - DNA, 20 bp, Homo sapiens
gcatgctagtgttgtatttc

SEQ ID NO: 5481102 - DNA, 14 bp, Homo sapiens
gcatgctcagtgcc

SEQ ID NO: 5481103 - DNA, 18 bp, Homo sapiens
gcatgctcagtgcctttt

SEQ ID NO: 5481104 - DNA, 12 bp, Homo sapiens
gcatgctcccag

SEQ ID NO: 5481105 - DNA, 13 bp, Homo sapiens
gcatgctcccagc

SEQ ID NO: 5481106 - DNA, 15 bp, Homo sapiens
gcatgctcccagcat

SEQ ID NO: 5481107 - DNA, 14 bp, Homo sapiens
gcatgctccctcct

SEQ ID NO: 5481108 - DNA, 22 bp, Homo sapiens
gcatgctcctctgcctgtgccc

SEQ ID NO: 5481109 - DNA, 13 bp, Homo sapiens
gcatgctctctgc

SEQ ID NO: 5481110 - DNA, 14 bp, Homo sapiens
gcatgctctctgca

SEQ ID NO: 5481111 - DNA, 17 bp, Homo sapiens
gcatgctctctgcagcc

SEQ ID NO: 5481112 - DNA, 23 bp, Homo sapiens
gcatgctctctgcagccagccca

SEQ ID NO: 5481113 - DNA, 13 bp, Homo sapiens
gcatgctctggaa

SEQ ID NO: 5481114 - DNA, 14 bp, Homo sapiens
gcatgctctggaag

SEQ ID NO: 5481115 - DNA, 15 bp, Homo sapiens
gcatgctctggaagc

SEQ ID NO: 5481116 - DNA, 22 bp, Homo sapiens
gcatgctgaatgccccctgctt

SEQ ID NO: 5481117 - DNA, 13 bp, Homo sapiens
gcatgctgcccag

SEQ ID NO: 5481118 - DNA, 20 bp, Homo sapiens
gcatgctgcctgcctccggc

SEQ ID NO: 5481119 - DNA, 16 bp, Homo sapiens
gcatgctgctggacag

SEQ ID NO: 5481120 - DNA, 22 bp, Homo sapiens
gcatgctggagtacccagccta

SEQ ID NO: 5481121 - DNA, 23 bp, Homo sapiens
gcatgctggagtacccagcctat

SEQ ID NO: 5481122 - DNA, 12 bp, Homo sapiens
gcatgctggcct

SEQ ID NO: 5481123 - DNA, 15 bp, Homo sapiens
gcatgctggcctgtg

SEQ ID NO: 5481124 - DNA, 13 bp, Homo sapiens
gcatgctggggca

SEQ ID NO: 5481125 - DNA, 21 bp, Homo sapiens
gcatgcttattagcagctggg

SEQ ID NO: 5481126 - DNA, 22 bp, Homo sapiens
gcatgcttattagcagctgggt

SEQ ID NO: 5481127 - DNA, 11 bp, Homo sapiens
gcatgcttccc

SEQ ID NO: 5481128 - DNA, 21 bp, Homo sapiens
gcatgcttcccagagggagca

SEQ ID NO: 5481129 - DNA, 22 bp, Homo sapiens
gcatgcttcccagagggagcag

SEQ ID NO: 5481130 - DNA, 21 bp, Homo sapiens
gcatgcttccctgcagctgac

SEQ ID NO: 5481131 - DNA, 15 bp, Homo sapiens
gcatgcttcctttct

SEQ ID NO: 5481132 - DNA, 16 bp, Homo sapiens
gcatgcttcctttctc

SEQ ID NO: 5481133 - DNA, 22 bp, Homo sapiens
gcatgcttcctttctctcctgg

SEQ ID NO: 5481134 - DNA, 16 bp, Homo sapiens
gcatgcttcttctcaa

SEQ ID NO: 5481135 - DNA, 20 bp, Homo sapiens
gcatgcttgggctgacccag

SEQ ID NO: 5481136 - DNA, 14 bp, Homo sapiens
gcatgctttccata

SEQ ID NO: 5481137 - DNA, 23 bp, Homo sapiens
gcatgctttgctgctatgaaaat

SEQ ID NO: 5481138 - DNA, 13 bp, Homo sapiens
gcatggaaaaatg

SEQ ID NO: 5481139 - DNA, 19 bp, Homo sapiens
gcatggaaagatggggagc

SEQ ID NO: 5481140 - DNA, 19 bp, Homo sapiens
gcatggaaatcagccaagt

SEQ ID NO: 5481141 - DNA, 23 bp, Homo sapiens
gcatggaaattcccttcatctgg

SEQ ID NO: 5481142 - DNA, 16 bp, Homo sapiens
gcatggaacaaagcat

SEQ ID NO: 5481143 - DNA, 21 bp, Homo sapiens
gcatggaaggcaagattgtgt

SEQ ID NO: 5481144 - DNA, 11 bp, Homo sapiens
gcatggaaggg

SEQ ID NO: 5481145 - DNA, 18 bp, Homo sapiens
gcatggaagttggggcac

SEQ ID NO: 5481146 - DNA, 18 bp, Homo sapiens
gcatggacaatggaccgg

SEQ ID NO: 5481147 - DNA, 21 bp, Homo sapiens
gcatggacaatggaccggaga

SEQ ID NO: 5481148 - DNA, 16 bp, Homo sapiens
gcatggacctaacatt

SEQ ID NO: 5481149 - DNA, 23 bp, Homo sapiens
gcatggacgcctggctccaggct

SEQ ID NO: 5481150 - DNA, 15 bp, Homo sapiens
gcatggactctgggt

SEQ ID NO: 5481151 - DNA, 14 bp, Homo sapiens
gcatggagaatggg

SEQ ID NO: 5481152 - DNA, 14 bp, Homo sapiens
gcatggagacagca

SEQ ID NO: 5481153 - DNA, 17 bp, Homo sapiens
gcatggagacagcagtt

SEQ ID NO: 5481154 - DNA, 16 bp, Homo sapiens
gcatggagacgcattt

SEQ ID NO: 5481155 - DNA, 17 bp, Homo sapiens
gcatggagactctgaga

SEQ ID NO: 5481156 - DNA, 20 bp, Homo sapiens
gcatggagactctgagagcg

SEQ ID NO: 5481157 - DNA, 17 bp, Homo sapiens
gcatggagagtggcatc

SEQ ID NO: 5481158 - DNA, 12 bp, Homo sapiens
gcatggagctgg

SEQ ID NO: 5481159 - DNA, 15 bp, Homo sapiens
gcatggagctggccg

SEQ ID NO: 5481160 - DNA, 19 bp, Homo sapiens
gcatggaggaggagggagg

SEQ ID NO: 5481161 - DNA, 20 bp, Homo sapiens
gcatggagtgtgtattgttc

SEQ ID NO: 5481162 - DNA, 24 bp, Homo sapiens
gcatggagtgtgtattgttcccag

SEQ ID NO: 5481163 - DNA, 18 bp, Homo sapiens
gcatggagttgggcgtta

SEQ ID NO: 5481164 - DNA, 20 bp, Homo sapiens
gcatggatatagttttactt

SEQ ID NO: 5481165 - DNA, 17 bp, Homo sapiens
gcatggatgcatttcaa

SEQ ID NO: 5481166 - DNA, 18 bp, Homo sapiens
gcatggatttctttgaaa

SEQ ID NO: 5481167 - DNA, 18 bp, Homo sapiens
gcatggattttggataaa

SEQ ID NO: 5481168 - DNA, 17 bp, Homo sapiens
gcatggcaaatcagggg

SEQ ID NO: 5481169 - DNA, 21 bp, Homo sapiens
gcatggcaaatcaggggccag

SEQ ID NO: 5481170 - DNA, 14 bp, Homo sapiens
gcatggcaattctg

SEQ ID NO: 5481171 - DNA, 14 bp, Homo sapiens
gcatggcacctgtc

SEQ ID NO: 5481172 - DNA, 14 bp, Homo sapiens
gcatggcactccct

SEQ ID NO: 5481173 - DNA, 20 bp, Homo sapiens
gcatggcactccctccagca

SEQ ID NO: 5481174 - DNA, 18 bp, Homo sapiens
gcatggcactgaccgccg

SEQ ID NO: 5481175 - DNA, 15 bp, Homo sapiens
gcatggcactgactg

SEQ ID NO: 5481176 - DNA, 15 bp, Homo sapiens
gcatggcacttgcat

SEQ ID NO: 5481177 - DNA, 17 bp, Homo sapiens
gcatggcagaagcgtct

SEQ ID NO: 5481178 - DNA, 22 bp, Homo sapiens
gcatggcagaagcgtctccctt

SEQ ID NO: 5481179 - DNA, 14 bp, Homo sapiens
gcatggcagccctc

SEQ ID NO: 5481180 - DNA, 16 bp, Homo sapiens
gcatggcagggcctca

SEQ ID NO: 5481181 - DNA, 20 bp, Homo sapiens
gcatggcagggggctgctgc

SEQ ID NO: 5481182 - DNA, 16 bp, Homo sapiens
gcatggcatattttaa

SEQ ID NO: 5481183 - DNA, 18 bp, Homo sapiens
gcatggcatcctccagcc

SEQ ID NO: 5481184 - DNA, 12 bp, Homo sapiens
gcatggccacag

SEQ ID NO: 5481185 - DNA, 14 bp, Homo sapiens
gcatggccacagcc

SEQ ID NO: 5481186 - DNA, 17 bp, Homo sapiens
gcatggccagcagcttg

SEQ ID NO: 5481187 - DNA, 16 bp, Homo sapiens
gcatggcccagcctgg

SEQ ID NO: 5481188 - DNA, 17 bp, Homo sapiens
gcatggcccagcctgga

SEQ ID NO: 5481189 - DNA, 19 bp, Homo sapiens
gcatggcccagcctggagc

SEQ ID NO: 5481190 - DNA, 13 bp, Homo sapiens
gcatggcccctcc

SEQ ID NO: 5481191 - DNA, 17 bp, Homo sapiens
gcatggcccctccagga

SEQ ID NO: 5481192 - DNA, 21 bp, Homo sapiens
gcatggcccctccaggaacat

SEQ ID NO: 5481193 - DNA, 12 bp, Homo sapiens
gcatggccctgg

SEQ ID NO: 5481194 - DNA, 14 bp, Homo sapiens
gcatggccctgggc

SEQ ID NO: 5481195 - DNA, 18 bp, Homo sapiens
gcatggcctcccagccac

SEQ ID NO: 5481196 - DNA, 15 bp, Homo sapiens
gcatggcgccccggg

SEQ ID NO: 5481197 - DNA, 23 bp, Homo sapiens
gcatggcgtagagggtgctgccc

SEQ ID NO: 5481198 - DNA, 16 bp, Homo sapiens
gcatggcgtggaggag

SEQ ID NO: 5481199 - DNA, 13 bp, Homo sapiens
gcatggctccagt

SEQ ID NO: 5481200 - DNA, 15 bp, Homo sapiens
gcatggctcctgtct

SEQ ID NO: 5481201 - DNA, 19 bp, Homo sapiens
gcatggctcctgtctggct

SEQ ID NO: 5481202 - DNA, 13 bp, Homo sapiens
gcatggctggggt

SEQ ID NO: 5481203 - DNA, 15 bp, Homo sapiens
gcatggctgtgagga

SEQ ID NO: 5481204 - DNA, 18 bp, Homo sapiens
gcatggcttgcccctgtg

SEQ ID NO: 5481205 - DNA, 21 bp, Homo sapiens
gcatggcttgcccctgtggcc

SEQ ID NO: 5481206 - DNA, 15 bp, Homo sapiens
gcatggcttggggag

SEQ ID NO: 5481207 - DNA, 18 bp, Homo sapiens
gcatggcttggggagcag

SEQ ID NO: 5481208 - DNA, 17 bp, Homo sapiens
gcatggctttatttgtt

SEQ ID NO: 5481209 - DNA, 16 bp, Homo sapiens
gcatgggaaaaagaga

SEQ ID NO: 5481210 - DNA, 19 bp, Homo sapiens
gcatgggaaagccacctct

SEQ ID NO: 5481211 - DNA, 20 bp, Homo sapiens
gcatgggaaagccacctctc

SEQ ID NO: 5481212 - DNA, 20 bp, Homo sapiens
gcatgggaaatagcggccct

SEQ ID NO: 5481213 - DNA, 17 bp, Homo sapiens
gcatgggaatacaaaag

SEQ ID NO: 5481214 - DNA, 14 bp, Homo sapiens
gcatgggaggtgag

SEQ ID NO: 5481215 - DNA, 15 bp, Homo sapiens
gcatgggcactccct

SEQ ID NO: 5481216 - DNA, 19 bp, Homo sapiens
gcatgggcagtttcagttt

SEQ ID NO: 5481217 - DNA, 20 bp, Homo sapiens
gcatgggcccttggaaaaac

SEQ ID NO: 5481218 - DNA, 23 bp, Homo sapiens
gcatgggcctctctgggggaggc

SEQ ID NO: 5481219 - DNA, 13 bp, Homo sapiens
gcatgggcctggc

SEQ ID NO: 5481220 - DNA, 23 bp, Homo sapiens
gcatgggcgatgtcactcagccc

SEQ ID NO: 5481221 - DNA, 18 bp, Homo sapiens
gcatgggcgcaggcccag

SEQ ID NO: 5481222 - DNA, 20 bp, Homo sapiens
gcatgggcgcaggcccagtg

SEQ ID NO: 5481223 - DNA, 13 bp, Homo sapiens
gcatgggctcgcc

SEQ ID NO: 5481224 - DNA, 13 bp, Homo sapiens
gcatggggagggg

SEQ ID NO: 5481225 - DNA, 16 bp, Homo sapiens
gcatggggcagaggct

SEQ ID NO: 5481226 - DNA, 19 bp, Homo sapiens
gcatggggcagaggcttcc

SEQ ID NO: 5481227 - DNA, 14 bp, Homo sapiens
gcatggggcatgtc

SEQ ID NO: 5481228 - DNA, 16 bp, Homo sapiens
gcatggggcatgtcct

SEQ ID NO: 5481229 - DNA, 16 bp, Homo sapiens
gcatggggccaggaaa

SEQ ID NO: 5481230 - DNA, 20 bp, Homo sapiens
gcatggggcgggtcctagct

SEQ ID NO: 5481231 - DNA, 21 bp, Homo sapiens
gcatggggcgggtcctagctg

SEQ ID NO: 5481232 - DNA, 21 bp, Homo sapiens
gcatgggggaccccttcccac

SEQ ID NO: 5481233 - DNA, 21 bp, Homo sapiens
gcatggggtcagccccaaggg

SEQ ID NO: 5481234 - DNA, 22 bp, Homo sapiens
gcatggggtcagccccaagggc

SEQ ID NO: 5481235 - DNA, 15 bp, Homo sapiens
gcatggggtgggcct

SEQ ID NO: 5481236 - DNA, 15 bp, Homo sapiens
gcatggggtttttat

SEQ ID NO: 5481237 - DNA, 16 bp, Homo sapiens
gcatgggtccaagaga

SEQ ID NO: 5481238 - DNA, 18 bp, Homo sapiens
gcatgggtccaagagaca

SEQ ID NO: 5481239 - DNA, 23 bp, Homo sapiens
gcatgggtccagaagacgtggtc

SEQ ID NO: 5481240 - DNA, 15 bp, Homo sapiens
gcatgggtccagggc

SEQ ID NO: 5481241 - DNA, 16 bp, Homo sapiens
gcatgggtccagggcc

SEQ ID NO: 5481242 - DNA, 21 bp, Homo sapiens
gcatgggtccttgatgccaga

SEQ ID NO: 5481243 - DNA, 21 bp, Homo sapiens
gcatgggtcgggagaggggac

SEQ ID NO: 5481244 - DNA, 21 bp, Homo sapiens
gcatgggtgaagggagagcca

SEQ ID NO: 5481245 - DNA, 15 bp, Homo sapiens
gcatgggttttgtag

SEQ ID NO: 5481246 - DNA, 16 bp, Homo sapiens
gcatgggttttgtagg

SEQ ID NO: 5481247 - DNA, 17 bp, Homo sapiens
gcatggtaccagccctg

SEQ ID NO: 5481248 - DNA, 20 bp, Homo sapiens
gcatggtaccagccctgggg

SEQ ID NO: 5481249 - DNA, 15 bp, Homo sapiens
gcatggtcacacact

SEQ ID NO: 5481250 - DNA, 15 bp, Homo sapiens
gcatggtccattctc

SEQ ID NO: 5481251 - DNA, 19 bp, Homo sapiens
gcatggtcccacatccctg

SEQ ID NO: 5481252 - DNA, 23 bp, Homo sapiens
gcatggtcctggaggatgaccag

SEQ ID NO: 5481253 - DNA, 15 bp, Homo sapiens
gcatggtgccccagg

SEQ ID NO: 5481254 - DNA, 20 bp, Homo sapiens
gcatggtgccccaggaccag

SEQ ID NO: 5481255 - DNA, 23 bp, Homo sapiens
gcatggtgccccaggaccagctc

SEQ ID NO: 5481256 - DNA, 15 bp, Homo sapiens
gcatggtggcaccag

SEQ ID NO: 5481257 - DNA, 18 bp, Homo sapiens
gcatggtggctcatgcct

SEQ ID NO: 5481258 - DNA, 18 bp, Homo sapiens
gcatggtggtgcgtgcct

SEQ ID NO: 5481259 - DNA, 15 bp, Homo sapiens
gcatggtgttctcct

SEQ ID NO: 5481260 - DNA, 21 bp, Homo sapiens
gcatggtgtttatgcacacag

SEQ ID NO: 5481261 - DNA, 15 bp, Homo sapiens
gcatggtgttttcat

SEQ ID NO: 5481262 - DNA, 22 bp, Homo sapiens
gcatggtgttttcattccccct

SEQ ID NO: 5481263 - DNA, 17 bp, Homo sapiens
gcatggttttacagtga

SEQ ID NO: 5481264 - DNA, 19 bp, Homo sapiens
gcatggttttgtgccatct

SEQ ID NO: 5481265 - DNA, 18 bp, Homo sapiens
gcatggtttttataatat

SEQ ID NO: 5481266 - DNA, 17 bp, Homo sapiens
gcatgtaaaagcggaaa

SEQ ID NO: 5481267 - DNA, 17 bp, Homo sapiens
gcatgtaaaatcttcag

SEQ ID NO: 5481268 - DNA, 22 bp, Homo sapiens
gcatgtaaaatcttcagctggt

SEQ ID NO: 5481269 - DNA, 14 bp, Homo sapiens
gcatgtaaaatgca

SEQ ID NO: 5481270 - DNA, 16 bp, Homo sapiens
gcatgtaaaatgcagt

SEQ ID NO: 5481271 - DNA, 17 bp, Homo sapiens
gcatgtaaaatgcagtc

SEQ ID NO: 5481272 - DNA, 22 bp, Homo sapiens
gcattcaaaatagttctatttc

SEQ ID NO: 5481273 - DNA, 21 bp, Homo sapiens
gcattcaaccacgcaggaagc

SEQ ID NO: 5481274 - DNA, 18 bp, Homo sapiens
gcattcaaccttaccaaa

SEQ ID NO: 5481275 - DNA, 23 bp, Homo sapiens
gcattcacaaggtgactgggatg

SEQ ID NO: 5481276 - DNA, 19 bp, Homo sapiens
gcattcacacacagcctgg

SEQ ID NO: 5481277 - DNA, 23 bp, Homo sapiens
gcattcacacacagcctggcctc

SEQ ID NO: 5481278 - DNA, 20 bp, Homo sapiens
gcattcacagctacgtgtgc

SEQ ID NO: 5481279 - DNA, 15 bp, Homo sapiens
gcattcacccagaca

SEQ ID NO: 5481280 - DNA, 19 bp, Homo sapiens
gcattcacccagacagctc

SEQ ID NO: 5481281 - DNA, 14 bp, Homo sapiens
gcattcagcacaca

SEQ ID NO: 5481282 - DNA, 17 bp, Homo sapiens
gcattcagcacacccca

SEQ ID NO: 5481283 - DNA, 23 bp, Homo sapiens
gcattcagtccgcctggccggct

SEQ ID NO: 5481284 - DNA, 16 bp, Homo sapiens
gcattcattctgagcc

SEQ ID NO: 5481285 - DNA, 17 bp, Homo sapiens
gcattcattctgagccc

SEQ ID NO: 5481286 - DNA, 20 bp, Homo sapiens
gcattccacactgcagggag

SEQ ID NO: 5481287 - DNA, 12 bp, Homo sapiens
gcattccacagg

SEQ ID NO: 5481288 - DNA, 14 bp, Homo sapiens
gcattccagaatct

SEQ ID NO: 5481289 - DNA, 14 bp, Homo sapiens
gcattccagctctg

SEQ ID NO: 5481290 - DNA, 18 bp, Homo sapiens
gcattccagctctgcccc

SEQ ID NO: 5481291 - DNA, 22 bp, Homo sapiens
gcattccagtaacttttttgtg

SEQ ID NO: 5481292 - DNA, 20 bp, Homo sapiens
gcattccatgattttacaga

SEQ ID NO: 5481293 - DNA, 12 bp, Homo sapiens
gcattcccaatt

SEQ ID NO: 5481294 - DNA, 14 bp, Homo sapiens
gcattcccaccaac

SEQ ID NO: 5481295 - DNA, 14 bp, Homo sapiens
gcattcccaggaaa

SEQ ID NO: 5481296 - DNA, 12 bp, Homo sapiens
gcattcccaggt

SEQ ID NO: 5481297 - DNA, 16 bp, Homo sapiens
gcattccccgctgccc

SEQ ID NO: 5481298 - DNA, 22 bp, Homo sapiens
gcattccctacagcctagggca

SEQ ID NO: 5481299 - DNA, 18 bp, Homo sapiens
gcattcctctaatgttgt

SEQ ID NO: 5481300 - DNA, 19 bp, Homo sapiens
gcattcctgtaacttttaa

SEQ ID NO: 5481301 - DNA, 18 bp, Homo sapiens
gcattcctgtgccctaga

SEQ ID NO: 5481302 - DNA, 13 bp, Homo sapiens
gcattccttagca

SEQ ID NO: 5481303 - DNA, 21 bp, Homo sapiens
gcattccttagcagctcaggc

SEQ ID NO: 5481304 - DNA, 22 bp, Homo sapiens
gcattccttagcagctcaggcg

SEQ ID NO: 5481305 - DNA, 23 bp, Homo sapiens
gcattccttctttgataatgtta

SEQ ID NO: 5481306 - DNA, 16 bp, Homo sapiens
gcattcctttctttaa

SEQ ID NO: 5481307 - DNA, 19 bp, Homo sapiens
gcattcgaagaaacccttg

SEQ ID NO: 5481308 - DNA, 14 bp, Homo sapiens
gcattcggagggag

SEQ ID NO: 5481309 - DNA, 23 bp, Homo sapiens
gcattcgttgtgttttttaagat

SEQ ID NO: 5481310 - DNA, 15 bp, Homo sapiens
gcattctacacctgg

SEQ ID NO: 5481311 - DNA, 21 bp, Homo sapiens
gcattctaccactacattttg

SEQ ID NO: 5481312 - DNA, 13 bp, Homo sapiens
gcattctagtact

SEQ ID NO: 5481313 - DNA, 16 bp, Homo sapiens
gcattctagtgcagaa

SEQ ID NO: 5481314 - DNA, 23 bp, Homo sapiens
gcattctatcgttattataaatg

SEQ ID NO: 5481315 - DNA, 24 bp, Homo sapiens
gcattctatcgttattataaatgt

SEQ ID NO: 5481316 - DNA, 18 bp, Homo sapiens
gcattctattgccttctt

SEQ ID NO: 5481317 - DNA, 22 bp, Homo sapiens
gcattctattgccttctttgaa

SEQ ID NO: 5481318 - DNA, 18 bp, Homo sapiens
gcattctcattggaaatt

SEQ ID NO: 5481319 - DNA, 21 bp, Homo sapiens
gcattctccccagtgtatgtc

SEQ ID NO: 5481320 - DNA, 15 bp, Homo sapiens
gcattctctctgctc

SEQ ID NO: 5481321 - DNA, 18 bp, Homo sapiens
gcattctctctgctcagt

SEQ ID NO: 5481322 - DNA, 15 bp, Homo sapiens
gcattctgagctggg

SEQ ID NO: 5481323 - DNA, 16 bp, Homo sapiens
gcattctgagctgggc

SEQ ID NO: 5481324 - DNA, 21 bp, Homo sapiens
gcattctgataggagggggcg

SEQ ID NO: 5481325 - DNA, 16 bp, Homo sapiens
gcattctgcacgctgc

SEQ ID NO: 5481326 - DNA, 15 bp, Homo sapiens
gcattctgcagcccg

SEQ ID NO: 5481327 - DNA, 22 bp, Homo sapiens
gcattctggggtggggcttgga

SEQ ID NO: 5481328 - DNA, 18 bp, Homo sapiens
gcattctgtataaatgca

SEQ ID NO: 5481329 - DNA, 16 bp, Homo sapiens
gcattctgtttcctct

SEQ ID NO: 5481330 - DNA, 14 bp, Homo sapiens
gcattcttattcat

SEQ ID NO: 5481331 - DNA, 15 bp, Homo sapiens
gcattcttattcatc

SEQ ID NO: 5481332 - DNA, 21 bp, Homo sapiens
gcattcttctgatcactgaaa

SEQ ID NO: 5481333 - DNA, 17 bp, Homo sapiens
gcattcttggttggctg

SEQ ID NO: 5481334 - DNA, 15 bp, Homo sapiens
gcattcttgtacagt

SEQ ID NO: 5481335 - DNA, 21 bp, Homo sapiens
gcattcttgtcacaataaatg

SEQ ID NO: 5481336 - DNA, 20 bp, Homo sapiens
gcattctttgcaatactgct

SEQ ID NO: 5481337 - DNA, 13 bp, Homo sapiens
gcattctttggta

SEQ ID NO: 5481338 - DNA, 15 bp, Homo sapiens
gcattctttggtaat

SEQ ID NO: 5481339 - DNA, 18 bp, Homo sapiens
gcattgaaaaatttctaa

SEQ ID NO: 5481340 - DNA, 16 bp, Homo sapiens
gcattgaaaagagctg

SEQ ID NO: 5481341 - DNA, 16 bp, Homo sapiens
gcattgaacacaaact

SEQ ID NO: 5481342 - DNA, 23 bp, Homo sapiens
gcattgaagtatggtgtgttcac

SEQ ID NO: 5481343 - DNA, 14 bp, Homo sapiens
gcattgacctggag

SEQ ID NO: 5481344 - DNA, 17 bp, Homo sapiens
gcattgacctggagggg

SEQ ID NO: 5481345 - DNA, 20 bp, Homo sapiens
gcattgactcagatatagat

SEQ ID NO: 5481346 - DNA, 16 bp, Homo sapiens
gcattgagaaactgaa

SEQ ID NO: 5481347 - DNA, 12 bp, Homo sapiens
gcattgagctgc

SEQ ID NO: 5481348 - DNA, 16 bp, Homo sapiens
gcattgagcttgcatg

SEQ ID NO: 5481349 - DNA, 13 bp, Homo sapiens
gcattgagggctc

SEQ ID NO: 5481350 - DNA, 10 bp, Homo sapiens
gcattgagta

SEQ ID NO: 5481351 - DNA, 15 bp, Homo sapiens
gcattgagtattgtt

SEQ ID NO: 5481352 - DNA, 20 bp, Homo sapiens
gcattgagtccagctttcct

SEQ ID NO: 5481353 - DNA, 13 bp, Homo sapiens
gcattgataatct

SEQ ID NO: 5481354 - DNA, 14 bp, Homo sapiens
gcattgataatctt

SEQ ID NO: 5481355 - DNA, 16 bp, Homo sapiens
gcattgataatcttca

SEQ ID NO: 5481356 - DNA, 18 bp, Homo sapiens
gcattgataatcttcagg

SEQ ID NO: 5481357 - DNA, 16 bp, Homo sapiens
gcattgatattgtgaa

SEQ ID NO: 5481358 - DNA, 16 bp, Homo sapiens
gcattgatccaggaga

SEQ ID NO: 5481359 - DNA, 17 bp, Homo sapiens
gcattgcactaaaagtg

SEQ ID NO: 5481360 - DNA, 16 bp, Homo sapiens
gcattgcagcctaaga

SEQ ID NO: 5481361 - DNA, 13 bp, Homo sapiens
gcattgcatggac

SEQ ID NO: 5481362 - DNA, 16 bp, Homo sapiens
gcattgccaagggctt

SEQ ID NO: 5481363 - DNA, 16 bp, Homo sapiens
gcattgccaagtgcca

SEQ ID NO: 5481364 - DNA, 22 bp, Homo sapiens
gcattgccacggaaacatacag

SEQ ID NO: 5481365 - DNA, 19 bp, Homo sapiens
gcattgccataccattccc

SEQ ID NO: 5481366 - DNA, 14 bp, Homo sapiens
gcattgccattccc

SEQ ID NO: 5481367 - DNA, 13 bp, Homo sapiens
gcattgcctggac

SEQ ID NO: 5481368 - DNA, 23 bp, Homo sapiens
gcattgctcagcccgcttggcca

SEQ ID NO: 5481369 - DNA, 16 bp, Homo sapiens
gcattgctggactctg

SEQ ID NO: 5481370 - DNA, 16 bp, Homo sapiens
gcattgctgtccttgg

SEQ ID NO: 5481371 - DNA, 13 bp, Homo sapiens
gcattgctgtgtg

SEQ ID NO: 5481372 - DNA, 13 bp, Homo sapiens
gcattgctttcgt

SEQ ID NO: 5481373 - DNA, 17 bp, Homo sapiens
gcattggatacagcagt

SEQ ID NO: 5481374 - DNA, 15 bp, Homo sapiens
gcattggcagcaggt

SEQ ID NO: 5481375 - DNA, 20 bp, Homo sapiens
gcattggcatctgcttttaa

SEQ ID NO: 5481376 - DNA, 22 bp, Homo sapiens
gcattggcccctgagcccagag

SEQ ID NO: 5481377 - DNA, 16 bp, Homo sapiens
gcattggcctggcctc

SEQ ID NO: 5481378 - DNA, 18 bp, Homo sapiens
gcattggggttcctctgt

SEQ ID NO: 5481379 - DNA, 21 bp, Homo sapiens
gcattggggttcctctgtaca

SEQ ID NO: 5481380 - DNA, 16 bp, Homo sapiens
gcattgggtgatcatt

SEQ ID NO: 5481381 - DNA, 15 bp, Homo sapiens
gcattggtctgctga

SEQ ID NO: 5481382 - DNA, 15 bp, Homo sapiens
gcattggtgactcac

SEQ ID NO: 5481383 - DNA, 12 bp, Homo sapiens
gcattggtggct

SEQ ID NO: 5481384 - DNA, 10 bp, Homo sapiens
gcattgtaaa

SEQ ID NO: 5481385 - DNA, 12 bp, Homo sapiens
gcattgtaagcg

SEQ ID NO: 5481386 - DNA, 21 bp, Homo sapiens
gcattgtaattatgtaaataa

SEQ ID NO: 5481387 - DNA, 20 bp, Homo sapiens
gcattgtcaccgcaggtgct

SEQ ID NO: 5481388 - DNA, 16 bp, Homo sapiens
gcattgtccctgtgcc

SEQ ID NO: 5481389 - DNA, 12 bp, Homo sapiens
gcattgtcctct

SEQ ID NO: 5481390 - DNA, 13 bp, Homo sapiens
gcattgtctctct

SEQ ID NO: 5481391 - DNA, 14 bp, Homo sapiens
gcattgtctgcaat

SEQ ID NO: 5481392 - DNA, 14 bp, Homo sapiens
gcattgtcttgtgg

SEQ ID NO: 5481393 - DNA, 16 bp, Homo sapiens
gcattgtctttaatat

SEQ ID NO: 5481394 - DNA, 19 bp, Homo sapiens
gcattgtgaattgcctgcc

SEQ ID NO: 5481395 - DNA, 12 bp, Homo sapiens
gcattgtggctg

SEQ ID NO: 5481396 - DNA, 13 bp, Homo sapiens
gcattgtgggaag

SEQ ID NO: 5481397 - DNA, 16 bp, Homo sapiens
gcattgtgggaagggg

SEQ ID NO: 5481398 - DNA, 14 bp, Homo sapiens
gcattgtgtggaat

SEQ ID NO: 5481399 - DNA, 15 bp, Homo sapiens
gcattgttagtttag

SEQ ID NO: 5481400 - DNA, 17 bp, Homo sapiens
gcattgttattgtggaa

SEQ ID NO: 5481401 - DNA, 11 bp, Homo sapiens
gcattgttcca

SEQ ID NO: 5481402 - DNA, 16 bp, Homo sapiens
gcattgttgatgctca

SEQ ID NO: 5481403 - DNA, 23 bp, Homo sapiens
gcattgttgatgctcacatatga

SEQ ID NO: 5481404 - DNA, 13 bp, Homo sapiens
gcattgttgtaaa

SEQ ID NO: 5481405 - DNA, 16 bp, Homo sapiens
gcattgtttcaaaata

SEQ ID NO: 5481406 - DNA, 21 bp, Homo sapiens
gcattgtttgcttattgttcc

SEQ ID NO: 5481407 - DNA, 14 bp, Homo sapiens
gcattgttttgcat

SEQ ID NO: 5481408 - DNA, 15 bp, Homo sapiens
gcattgttttgcatc

SEQ ID NO: 5481409 - DNA, 14 bp, Homo sapiens
gcatttaaaagagt

SEQ ID NO: 5481410 - DNA, 16 bp, Homo sapiens
gcatttaaaagataca

SEQ ID NO: 5481411 - DNA, 17 bp, Homo sapiens
gcatttaaaagatacag

SEQ ID NO: 5481412 - DNA, 16 bp, Homo sapiens
gcatttaaacatgttt

SEQ ID NO: 5481413 - DNA, 16 bp, Homo sapiens
gcatttaaactctgcc

SEQ ID NO: 5481414 - DNA, 21 bp, Homo sapiens
gcatttaaagttgtataaaaa

SEQ ID NO: 5481415 - DNA, 23 bp, Homo sapiens
gcatttaaagttgtataaaaaca

SEQ ID NO: 5481416 - DNA, 23 bp, Homo sapiens
gcatttaagaattgccagtcttt

SEQ ID NO: 5481417 - DNA, 16 bp, Homo sapiens
gcatttaaggagattg

SEQ ID NO: 5481418 - DNA, 12 bp, Homo sapiens
gcatttaataaa

SEQ ID NO: 5481419 - DNA, 15 bp, Homo sapiens
gcatttaataaagat

SEQ ID NO: 5481420 - DNA, 17 bp, Homo sapiens
gcatttaataaagatga

SEQ ID NO: 5481421 - DNA, 17 bp, Homo sapiens
gcatttaatggcagcta

SEQ ID NO: 5481422 - DNA, 16 bp, Homo sapiens
gcatttaatgtagcca

SEQ ID NO: 5481423 - DNA, 18 bp, Homo sapiens
gcatttaccaacatgtat

SEQ ID NO: 5481424 - DNA, 21 bp, Homo sapiens
gcatttaccactgtatatgca

SEQ ID NO: 5481425 - DNA, 15 bp, Homo sapiens
gcatttagaaatcaa

SEQ ID NO: 5481426 - DNA, 12 bp, Homo sapiens
gcatttagatgt

SEQ ID NO: 5481427 - DNA, 13 bp, Homo sapiens
gcatttagcacag

SEQ ID NO: 5481428 - DNA, 16 bp, Homo sapiens
gcatttagcacagtat

SEQ ID NO: 5481429 - DNA, 16 bp, Homo sapiens
gcatttagctgtattc

SEQ ID NO: 5481430 - DNA, 22 bp, Homo sapiens
gcatttaggagaatagcagaga

SEQ ID NO: 5481431 - DNA, 23 bp, Homo sapiens
gcatttagtgctcagtccctact

SEQ ID NO: 5481432 - DNA, 21 bp, Homo sapiens
gcatttagtggtggtagaaat

SEQ ID NO: 5481433 - DNA, 22 bp, Homo sapiens
gcatttagtggtggtagaaatg

SEQ ID NO: 5481434 - DNA, 23 bp, Homo sapiens
gcatttagtggtggtagaaatga

SEQ ID NO: 5481435 - DNA, 22 bp, Homo sapiens
gcatttagttttatggcatgat

SEQ ID NO: 5481436 - DNA, 16 bp, Homo sapiens
gcatttataaatgtgt

SEQ ID NO: 5481437 - DNA, 17 bp, Homo sapiens
gcatttataaatgtgtg

SEQ ID NO: 5481438 - DNA, 18 bp, Homo sapiens
gcatttatagatcatttc

SEQ ID NO: 5481439 - DNA, 18 bp, Homo sapiens
gcatttatatttttcaaa

SEQ ID NO: 5481440 - DNA, 17 bp, Homo sapiens
gcatttatcattcttgt

SEQ ID NO: 5481441 - DNA, 13 bp, Homo sapiens
gcatttatgcatg

SEQ ID NO: 5481442 - DNA, 23 bp, Homo sapiens
gcatttatgcatgagaactaaat

SEQ ID NO: 5481443 - DNA, 23 bp, Homo sapiens
gcatttatgtagacattgtaaat

SEQ ID NO: 5481444 - DNA, 16 bp, Homo sapiens
gcatttattgcagttt

SEQ ID NO: 5481445 - DNA, 15 bp, Homo sapiens
gcatttatttctctg

SEQ ID NO: 5481446 - DNA, 13 bp, Homo sapiens
gcatttattttat

SEQ ID NO: 5481447 - DNA, 17 bp, Homo sapiens
gcatttcaaagccctgc

SEQ ID NO: 5481448 - DNA, 18 bp, Homo sapiens
gcatttcaaagccctgcc

SEQ ID NO: 5481449 - DNA, 22 bp, Homo sapiens
gcatttcaaagccctgcctctg

SEQ ID NO: 5481450 - DNA, 22 bp, Homo sapiens
gcatttcaagcagctgaagaaa

SEQ ID NO: 5481451 - DNA, 18 bp, Homo sapiens
gccaaagcacagctgggc

SEQ ID NO: 5481452 - DNA, 15 bp, Homo sapiens
gccaaagcagacatt

SEQ ID NO: 5481453 - DNA, 15 bp, Homo sapiens
gccaaagcagctaca

SEQ ID NO: 5481454 - DNA, 16 bp, Homo sapiens
gccaaagcagctacaa

SEQ ID NO: 5481455 - DNA, 13 bp, Homo sapiens
gccaaagcatgcc

SEQ ID NO: 5481456 - DNA, 13 bp, Homo sapiens
gccaaagccccat

SEQ ID NO: 5481457 - DNA, 15 bp, Homo sapiens
gccaaagctttacta

SEQ ID NO: 5481458 - DNA, 23 bp, Homo sapiens
gccaaagctttactactgtggaa

SEQ ID NO: 5481459 - DNA, 15 bp, Homo sapiens
gccaaaggagacccg

SEQ ID NO: 5481460 - DNA, 23 bp, Homo sapiens
gccaaaggagggtcaggaaggat

SEQ ID NO: 5481461 - DNA, 17 bp, Homo sapiens
gccaaaggatgtgatat

SEQ ID NO: 5481462 - DNA, 13 bp, Homo sapiens
gccaaaggctggc

SEQ ID NO: 5481463 - DNA, 20 bp, Homo sapiens
gccaaagtcacttccccaag

SEQ ID NO: 5481464 - DNA, 17 bp, Homo sapiens
gccaaagtttctgttga

SEQ ID NO: 5481465 - DNA, 19 bp, Homo sapiens
gccaaagttttcaaactgc

SEQ ID NO: 5481466 - DNA, 20 bp, Homo sapiens
gccaaataaaatgtttacat

SEQ ID NO: 5481467 - DNA, 14 bp, Homo sapiens
gccaaataaagtct

SEQ ID NO: 5481468 - DNA, 19 bp, Homo sapiens
gccaaataaatcatcctca

SEQ ID NO: 5481469 - DNA, 16 bp, Homo sapiens
gccaaataatgtctct

SEQ ID NO: 5481470 - DNA, 18 bp, Homo sapiens
gccaaataatgtctctgt

SEQ ID NO: 5481471 - DNA, 23 bp, Homo sapiens
gccaaatagagtttttatatttg

SEQ ID NO: 5481472 - DNA, 17 bp, Homo sapiens
gccaaatagccccagac

SEQ ID NO: 5481473 - DNA, 18 bp, Homo sapiens
gccaaatagccccagact

SEQ ID NO: 5481474 - DNA, 19 bp, Homo sapiens
gccaaatagccccagactg

SEQ ID NO: 5481475 - DNA, 21 bp, Homo sapiens
gccaaataggagggagactgt

SEQ ID NO: 5481476 - DNA, 16 bp, Homo sapiens
gccaaatatattctct

SEQ ID NO: 5481477 - DNA, 12 bp, Homo sapiens
gccaaatatgca

SEQ ID NO: 5481478 - DNA, 14 bp, Homo sapiens
gccaaatatgcact

SEQ ID NO: 5481479 - DNA, 22 bp, Homo sapiens
gccaaatatgcactttccctag

SEQ ID NO: 5481480 - DNA, 24 bp, Homo sapiens
gccaaatatgcactttccctagaa

SEQ ID NO: 5481481 - DNA, 19 bp, Homo sapiens
gccaaatattgatctgtat

SEQ ID NO: 5481482 - DNA, 20 bp, Homo sapiens
gccaaatccgctctcttcct

SEQ ID NO: 5481483 - DNA, 21 bp, Homo sapiens
gccaaatcctgggcatcccca

SEQ ID NO: 5481484 - DNA, 21 bp, Homo sapiens
gccaaatctagaatttagtga

SEQ ID NO: 5481485 - DNA, 12 bp, Homo sapiens
gccaaatgaaac

SEQ ID NO: 5481486 - DNA, 17 bp, Homo sapiens
gccaaatgaccgagccc

SEQ ID NO: 5481487 - DNA, 23 bp, Homo sapiens
gccaaatgaccgagccctggaga

SEQ ID NO: 5481488 - DNA, 18 bp, Homo sapiens
gccaaatgacttcatttc

SEQ ID NO: 5481489 - DNA, 14 bp, Homo sapiens
gccaaatgcaaaat

SEQ ID NO: 5481490 - DNA, 20 bp, Homo sapiens
gccaaatgctatactgtgtc

SEQ ID NO: 5481491 - DNA, 12 bp, Homo sapiens
gccaaatgctgg

SEQ ID NO: 5481492 - DNA, 14 bp, Homo sapiens
gccaaatgctgggg

SEQ ID NO: 5481493 - DNA, 13 bp, Homo sapiens
gccaaatgttcat

SEQ ID NO: 5481494 - DNA, 15 bp, Homo sapiens
gccaaattatttgtg

SEQ ID NO: 5481495 - DNA, 15 bp, Homo sapiens
gccaaattgcagaag

SEQ ID NO: 5481496 - DNA, 19 bp, Homo sapiens
gccaaattgctgcatattt

SEQ ID NO: 5481497 - DNA, 23 bp, Homo sapiens
gccaaattgctgcatatttgtgc

SEQ ID NO: 5481498 - DNA, 21 bp, Homo sapiens
gccaaatttaaaactgttgga

SEQ ID NO: 5481499 - DNA, 13 bp, Homo sapiens
gccaaatttatca

SEQ ID NO: 5481500 - DNA, 18 bp, Homo sapiens
gccaaatttcctgtttga

SEQ ID NO: 5481501 - DNA, 15 bp, Homo sapiens
gccaaatttcttttg

SEQ ID NO: 5481502 - DNA, 19 bp, Homo sapiens
gccaacaaccacagtgcca

SEQ ID NO: 5481503 - DNA, 22 bp, Homo sapiens
gccaacaaccacagtgccacca

SEQ ID NO: 5481504 - DNA, 14 bp, Homo sapiens
gccaacaagaatgc

SEQ ID NO: 5481505 - DNA, 20 bp, Homo sapiens
gccaacaagaatgcattgat

SEQ ID NO: 5481506 - DNA, 20 bp, Homo sapiens
gccaacaccacagaaatggg

SEQ ID NO: 5481507 - DNA, 14 bp, Homo sapiens
gccaacaccaggga

SEQ ID NO: 5481508 - DNA, 21 bp, Homo sapiens
gccaacacgcacctgcctcag

SEQ ID NO: 5481509 - DNA, 21 bp, Homo sapiens
gccaacactgtgggtgtgtga

SEQ ID NO: 5481510 - DNA, 19 bp, Homo sapiens
gccaacagaagcttccatt

SEQ ID NO: 5481511 - DNA, 15 bp, Homo sapiens
gccaacagcacctcc

SEQ ID NO: 5481512 - DNA, 22 bp, Homo sapiens
gccaacagggtagatttctctt

SEQ ID NO: 5481513 - DNA, 21 bp, Homo sapiens
gccaacaggtagcatagctct

SEQ ID NO: 5481514 - DNA, 16 bp, Homo sapiens
gccaacaggtggcagg

SEQ ID NO: 5481515 - DNA, 20 bp, Homo sapiens
gccaacagtgttaggcctgg

SEQ ID NO: 5481516 - DNA, 21 bp, Homo sapiens
gccaacagtgttaggcctggc

SEQ ID NO: 5481517 - DNA, 23 bp, Homo sapiens
gccaacagtgttaggcctggcac

SEQ ID NO: 5481518 - DNA, 20 bp, Homo sapiens
gccaacatcgtgaaaccctg

SEQ ID NO: 5481519 - DNA, 23 bp, Homo sapiens
gccaacatcgtgaaaccctgtct

SEQ ID NO: 5481520 - DNA, 15 bp, Homo sapiens
gccaacatgaggaca

SEQ ID NO: 5481521 - DNA, 17 bp, Homo sapiens
gccaacatgaggacaga

SEQ ID NO: 5481522 - DNA, 20 bp, Homo sapiens
gccaacatgaggacagaagg

SEQ ID NO: 5481523 - DNA, 21 bp, Homo sapiens
gccaacatgaggacagaagga

SEQ ID NO: 5481524 - DNA, 13 bp, Homo sapiens
gccaaccagcccg

SEQ ID NO: 5481525 - DNA, 14 bp, Homo sapiens
gccaaccaggaccc

SEQ ID NO: 5481526 - DNA, 13 bp, Homo sapiens
gccaaccatacct

SEQ ID NO: 5481527 - DNA, 23 bp, Homo sapiens
gccaaccataccttccttccctg

SEQ ID NO: 5481528 - DNA, 22 bp, Homo sapiens
gccaaccccagcagtcctgggc

SEQ ID NO: 5481529 - DNA, 23 bp, Homo sapiens
gccaaccccagcagtcctgggcc

SEQ ID NO: 5481530 - DNA, 19 bp, Homo sapiens
gccaaccctgggctattgc

SEQ ID NO: 5481531 - DNA, 16 bp, Homo sapiens
gccaacctattttgaa

SEQ ID NO: 5481532 - DNA, 16 bp, Homo sapiens
gccaacctcaggctcc

SEQ ID NO: 5481533 - DNA, 23 bp, Homo sapiens
gccaacctcgctccaactccaac

SEQ ID NO: 5481534 - DNA, 22 bp, Homo sapiens
gccaacctcggcttgtgggctg

SEQ ID NO: 5481535 - DNA, 21 bp, Homo sapiens
gccaacctgatgccccttccc

SEQ ID NO: 5481536 - DNA, 13 bp, Homo sapiens
gccaacctggact

SEQ ID NO: 5481537 - DNA, 14 bp, Homo sapiens
gccaacctggactt

SEQ ID NO: 5481538 - DNA, 19 bp, Homo sapiens
gccaacctggacttcctgt

SEQ ID NO: 5481539 - DNA, 21 bp, Homo sapiens
gccaacctggacttcctgtca

SEQ ID NO: 5481540 - DNA, 22 bp, Homo sapiens
gccaacctgtaataaatatgag

SEQ ID NO: 5481541 - DNA, 22 bp, Homo sapiens
gccaacctgttcttagagtgta

SEQ ID NO: 5481542 - DNA, 18 bp, Homo sapiens
gccaaccttcaaagaaac

SEQ ID NO: 5481543 - DNA, 23 bp, Homo sapiens
gccaacgacaaagccaaactctg

SEQ ID NO: 5481544 - DNA, 17 bp, Homo sapiens
gccaacgagacacattg

SEQ ID NO: 5481545 - DNA, 22 bp, Homo sapiens
gccaacgagacacattgccttc

SEQ ID NO: 5481546 - DNA, 23 bp, Homo sapiens
gccaacgagacacattgccttct

SEQ ID NO: 5481547 - DNA, 18 bp, Homo sapiens
gccaacggccccagcttc

SEQ ID NO: 5481548 - DNA, 15 bp, Homo sapiens
gccaacgtggacctg

SEQ ID NO: 5481549 - DNA, 17 bp, Homo sapiens
gccaacgtggacctgcc

SEQ ID NO: 5481550 - DNA, 14 bp, Homo sapiens
gccaacgttcatgc

SEQ ID NO: 5481551 - DNA, 16 bp, Homo sapiens
gccaactaagccctcg

SEQ ID NO: 5481552 - DNA, 15 bp, Homo sapiens
gccaactatggcctg

SEQ ID NO: 5481553 - DNA, 20 bp, Homo sapiens
gccaactcacaggtgctttt

SEQ ID NO: 5481554 - DNA, 17 bp, Homo sapiens
gccaactcacccttggc

SEQ ID NO: 5481555 - DNA, 21 bp, Homo sapiens
gccaactcactcttatgaaat

SEQ ID NO: 5481556 - DNA, 20 bp, Homo sapiens
gccaactccatgaccaggcc

SEQ ID NO: 5481557 - DNA, 13 bp, Homo sapiens
gccaactccatgt

SEQ ID NO: 5481558 - DNA, 22 bp, Homo sapiens
gccaactgaagccttcttctgc

SEQ ID NO: 5481559 - DNA, 22 bp, Homo sapiens
gccaactgacaaagatgcatca

SEQ ID NO: 5481560 - DNA, 15 bp, Homo sapiens
gccaactgattttgt

SEQ ID NO: 5481561 - DNA, 16 bp, Homo sapiens
gccaactgattttgta

SEQ ID NO: 5481562 - DNA, 20 bp, Homo sapiens
gccaactgattttgtatgta

SEQ ID NO: 5481563 - DNA, 23 bp, Homo sapiens
gccaactgccaggctgcctcctg

SEQ ID NO: 5481564 - DNA, 13 bp, Homo sapiens
gccaactgccccg

SEQ ID NO: 5481565 - DNA, 17 bp, Homo sapiens
gccaactgcctccttgc

SEQ ID NO: 5481566 - DNA, 19 bp, Homo sapiens
gccaactgcctccttgcca

SEQ ID NO: 5481567 - DNA, 17 bp, Homo sapiens
gccaactgctaatgcaa

SEQ ID NO: 5481568 - DNA, 12 bp, Homo sapiens
gccaactgctgc

SEQ ID NO: 5481569 - DNA, 12 bp, Homo sapiens
gccaactgttgt

SEQ ID NO: 5481570 - DNA, 18 bp, Homo sapiens
gccaactgtttccctgct

SEQ ID NO: 5481571 - DNA, 13 bp, Homo sapiens
gccaacttaaacc

SEQ ID NO: 5481572 - DNA, 19 bp, Homo sapiens
gccaacttcccacacggca

SEQ ID NO: 5481573 - DNA, 13 bp, Homo sapiens
gccaacttctccc

SEQ ID NO: 5481574 - DNA, 23 bp, Homo sapiens
gccaacttctcccaccccttggc

SEQ ID NO: 5481575 - DNA, 23 bp, Homo sapiens
gccaacttgagggcccagagcag

SEQ ID NO: 5481576 - DNA, 16 bp, Homo sapiens
gccaacttgccatgtt

SEQ ID NO: 5481577 - DNA, 18 bp, Homo sapiens
gccaacttgtaaatacac

SEQ ID NO: 5481578 - DNA, 20 bp, Homo sapiens
gccaacttgtaaatacacca

SEQ ID NO: 5481579 - DNA, 20 bp, Homo sapiens
gccaagaaaagggctgacat

SEQ ID NO: 5481580 - DNA, 22 bp, Homo sapiens
gccaagaaaattgcctttaaaa

SEQ ID NO: 5481581 - DNA, 22 bp, Homo sapiens
gccaagaaacgtcttctaaact

SEQ ID NO: 5481582 - DNA, 19 bp, Homo sapiens
gccaagaagcagtggcctt

SEQ ID NO: 5481583 - DNA, 18 bp, Homo sapiens
gccaagaagtttaaggaa

SEQ ID NO: 5481584 - DNA, 13 bp, Homo sapiens
gccaagaatactt

SEQ ID NO: 5481585 - DNA, 15 bp, Homo sapiens
gccaagaatattgca

SEQ ID NO: 5481586 - DNA, 13 bp, Homo sapiens
gccaagaatgtac

SEQ ID NO: 5481587 - DNA, 18 bp, Homo sapiens
gccaagaattcttaaata

SEQ ID NO: 5481588 - DNA, 16 bp, Homo sapiens
gccaagacaaggaggt

SEQ ID NO: 5481589 - DNA, 16 bp, Homo sapiens
gccaagacacagcagg

SEQ ID NO: 5481590 - DNA, 19 bp, Homo sapiens
gccaagaccatttcacaga

SEQ ID NO: 5481591 - DNA, 14 bp, Homo sapiens
gccaagactcctca

SEQ ID NO: 5481592 - DNA, 15 bp, Homo sapiens
gccaagactcctcag

SEQ ID NO: 5481593 - DNA, 15 bp, Homo sapiens
gccaagactgctgtg

SEQ ID NO: 5481594 - DNA, 20 bp, Homo sapiens
gccaagactgctgtggccag

SEQ ID NO: 5481595 - DNA, 22 bp, Homo sapiens
gccaagactgctgtggccagga

SEQ ID NO: 5481596 - DNA, 21 bp, Homo sapiens
gccaagagaaaggcctgcaca

SEQ ID NO: 5481597 - DNA, 23 bp, Homo sapiens
gccaagagaaaggcctgcacaca

SEQ ID NO: 5481598 - DNA, 12 bp, Homo sapiens
gccaagagaagg

SEQ ID NO: 5481599 - DNA, 14 bp, Homo sapiens
gccaagagaagggc

SEQ ID NO: 5481600 - DNA, 13 bp, Homo sapiens
gccaagagagaca

SEQ ID NO: 5481601 - DNA, 22 bp, Homo sapiens
gccaagagagacattgcctcca

SEQ ID NO: 5481602 - DNA, 16 bp, Homo sapiens
gccaagagcagaggca

SEQ ID NO: 5481603 - DNA, 18 bp, Homo sapiens
gccaagagcccgtctgct

SEQ ID NO: 5481604 - DNA, 23 bp, Homo sapiens
gccaagaggaaaaacagggaaaa

SEQ ID NO: 5481605 - DNA, 13 bp, Homo sapiens
gccaagaggctgc

SEQ ID NO: 5481606 - DNA, 17 bp, Homo sapiens
gccaagaggctgcagcc

SEQ ID NO: 5481607 - DNA, 22 bp, Homo sapiens
gccaagaggtttggctcctgcc

SEQ ID NO: 5481608 - DNA, 13 bp, Homo sapiens
gccaagagtcact

SEQ ID NO: 5481609 - DNA, 14 bp, Homo sapiens
gccaagagtggccc

SEQ ID NO: 5481610 - DNA, 18 bp, Homo sapiens
gccaagagtggccccacc

SEQ ID NO: 5481611 - DNA, 20 bp, Homo sapiens
gccaagagtggccccacctg

SEQ ID NO: 5481612 - DNA, 18 bp, Homo sapiens
gccaagataggaccttgg

SEQ ID NO: 5481613 - DNA, 20 bp, Homo sapiens
gccaagataggaccttgggc

SEQ ID NO: 5481614 - DNA, 22 bp, Homo sapiens
gccaagataggaccttgggcca

SEQ ID NO: 5481615 - DNA, 21 bp, Homo sapiens
gccaagatcacagtggccacg

SEQ ID NO: 5481616 - DNA, 20 bp, Homo sapiens
gccaagatcgcaccactgca

SEQ ID NO: 5481617 - DNA, 18 bp, Homo sapiens
gccaagatctacaggaca

SEQ ID NO: 5481618 - DNA, 19 bp, Homo sapiens
gccaagatctacaggacaa

SEQ ID NO: 5481619 - DNA, 16 bp, Homo sapiens
gccaagatgatccttc

SEQ ID NO: 5481620 - DNA, 18 bp, Homo sapiens
gccaagatgcttttcaaa

SEQ ID NO: 5481621 - DNA, 19 bp, Homo sapiens
gccaagatggaagtcacct

SEQ ID NO: 5481622 - DNA, 17 bp, Homo sapiens
gccaagatggctgctgc

SEQ ID NO: 5481623 - DNA, 21 bp, Homo sapiens
gccaagatggctgctgcctgc

SEQ ID NO: 5481624 - DNA, 16 bp, Homo sapiens
gccaagattaccctcg

SEQ ID NO: 5481625 - DNA, 19 bp, Homo sapiens
gccaagcaacctgggtcca

SEQ ID NO: 5481626 - DNA, 13 bp, Homo sapiens
gccaatgggctag

SEQ ID NO: 5481627 - DNA, 14 bp, Homo sapiens
gccaatgtccaggt

SEQ ID NO: 5481628 - DNA, 15 bp, Homo sapiens
gccaatgtctgattt

SEQ ID NO: 5481629 - DNA, 20 bp, Homo sapiens
gccaatgtgaacagcggctg

SEQ ID NO: 5481630 - DNA, 12 bp, Homo sapiens
gccaatgtgggc

SEQ ID NO: 5481631 - DNA, 12 bp, Homo sapiens
gccaatgttata

SEQ ID NO: 5481632 - DNA, 22 bp, Homo sapiens
gccaatgttgctgatggcccct

SEQ ID NO: 5481633 - DNA, 13 bp, Homo sapiens
gccaatgttgtgt

SEQ ID NO: 5481634 - DNA, 19 bp, Homo sapiens
gccaatgttgtgtgttgca

SEQ ID NO: 5481635 - DNA, 19 bp, Homo sapiens
gccaattaaaatatatata

SEQ ID NO: 5481636 - DNA, 21 bp, Homo sapiens
gccaattaaaatatatataaa

SEQ ID NO: 5481637 - DNA, 22 bp, Homo sapiens
gccaattaaaatatatataaat

SEQ ID NO: 5481638 - DNA, 19 bp, Homo sapiens
gccaattacggtgtacagt

SEQ ID NO: 5481639 - DNA, 23 bp, Homo sapiens
gccaattacggtgtacagtttaa

SEQ ID NO: 5481640 - DNA, 18 bp, Homo sapiens
gccaattagacttgaaat

SEQ ID NO: 5481641 - DNA, 18 bp, Homo sapiens
gccaattcagacaggcaa

SEQ ID NO: 5481642 - DNA, 13 bp, Homo sapiens
gccaattcagttt

SEQ ID NO: 5481643 - DNA, 20 bp, Homo sapiens
gccaattgcctaaaatttct

SEQ ID NO: 5481644 - DNA, 22 bp, Homo sapiens
gccaatttcaaagaaaacagac

SEQ ID NO: 5481645 - DNA, 22 bp, Homo sapiens
gccaatttcaccccattttctg

SEQ ID NO: 5481646 - DNA, 12 bp, Homo sapiens
gccaatttgcac

SEQ ID NO: 5481647 - DNA, 12 bp, Homo sapiens
gccaatttgtct

SEQ ID NO: 5481648 - DNA, 17 bp, Homo sapiens
gccaattttggatgagc

SEQ ID NO: 5481649 - DNA, 22 bp, Homo sapiens
gccaattttgtcacagctcttg

SEQ ID NO: 5481650 - DNA, 11 bp, Homo sapiens
gccaatttttc

SEQ ID NO: 5481651 - DNA, 14 bp, Homo sapiens
gccaatttttgtac

SEQ ID NO: 5481652 - DNA, 13 bp, Homo sapiens
gccaatttttgtt

SEQ ID NO: 5481653 - DNA, 13 bp, Homo sapiens
gccacaaaaacaa

SEQ ID NO: 5481654 - DNA, 14 bp, Homo sapiens
gccacaaaaacaat

SEQ ID NO: 5481655 - DNA, 17 bp, Homo sapiens
gccacaaaaatagagaa

SEQ ID NO: 5481656 - DNA, 18 bp, Homo sapiens
gccacaaaactctgtcag

SEQ ID NO: 5481657 - DNA, 16 bp, Homo sapiens
gccacaaaccaccagg

SEQ ID NO: 5481658 - DNA, 18 bp, Homo sapiens
gccacaaagccccccagc

SEQ ID NO: 5481659 - DNA, 19 bp, Homo sapiens
gccacaaagccccccagct

SEQ ID NO: 5481660 - DNA, 20 bp, Homo sapiens
gccacaaagctaggatggtt

SEQ ID NO: 5481661 - DNA, 14 bp, Homo sapiens
gccacaaagggaca

SEQ ID NO: 5481662 - DNA, 15 bp, Homo sapiens
gccacaaatgccttg

SEQ ID NO: 5481663 - DNA, 15 bp, Homo sapiens
gccacaaatgtgtcc

SEQ ID NO: 5481664 - DNA, 14 bp, Homo sapiens
gccacaaattgaaa

SEQ ID NO: 5481665 - DNA, 19 bp, Homo sapiens
gccacaacagaataaagca

SEQ ID NO: 5481666 - DNA, 21 bp, Homo sapiens
gccacaacagaataaagcagc

SEQ ID NO: 5481667 - DNA, 22 bp, Homo sapiens
gccacaacagaataaagcagcc

SEQ ID NO: 5481668 - DNA, 21 bp, Homo sapiens
gccacaaccctgttttatact

SEQ ID NO: 5481669 - DNA, 17 bp, Homo sapiens
gccacaactgctgtggc

SEQ ID NO: 5481670 - DNA, 18 bp, Homo sapiens
gccacaactgctgtggcc

SEQ ID NO: 5481671 - DNA, 21 bp, Homo sapiens
gccacaactgctgtggccccc

SEQ ID NO: 5481672 - DNA, 16 bp, Homo sapiens
gccacaagaaatttga

SEQ ID NO: 5481673 - DNA, 22 bp, Homo sapiens
gccacaagaataagcagcaaat

SEQ ID NO: 5481674 - DNA, 15 bp, Homo sapiens
gccacaagcacaatt

SEQ ID NO: 5481675 - DNA, 15 bp, Homo sapiens
gccacaagctgcact

SEQ ID NO: 5481676 - DNA, 22 bp, Homo sapiens
gccacaagctgcactgtgaacc

SEQ ID NO: 5481677 - DNA, 15 bp, Homo sapiens
gccacaaggaagaaa

SEQ ID NO: 5481678 - DNA, 22 bp, Homo sapiens
gccacaaggaagaaattaactt

SEQ ID NO: 5481679 - DNA, 21 bp, Homo sapiens
gccacaaggacgctggctact

SEQ ID NO: 5481680 - DNA, 19 bp, Homo sapiens
gccacaaggacttcctgtc

SEQ ID NO: 5481681 - DNA, 14 bp, Homo sapiens
gccacaaggctggc

SEQ ID NO: 5481682 - DNA, 19 bp, Homo sapiens
gccacaagggcagtggaag

SEQ ID NO: 5481683 - DNA, 17 bp, Homo sapiens
gccacaatcactaaata

SEQ ID NO: 5481684 - DNA, 20 bp, Homo sapiens
gccacaatgcagttctgagc

SEQ ID NO: 5481685 - DNA, 17 bp, Homo sapiens
gccacaatgtgatatgt

SEQ ID NO: 5481686 - DNA, 19 bp, Homo sapiens
gccacacaagggtcctttc

SEQ ID NO: 5481687 - DNA, 12 bp, Homo sapiens
gccacacacaca

SEQ ID NO: 5481688 - DNA, 15 bp, Homo sapiens
gccacacacacagaa

SEQ ID NO: 5481689 - DNA, 19 bp, Homo sapiens
gccacacacacagaaaata

SEQ ID NO: 5481690 - DNA, 23 bp, Homo sapiens
gccacacacacagaaaatatact

SEQ ID NO: 5481691 - DNA, 21 bp, Homo sapiens
gccacacagagcctgcctcag

SEQ ID NO: 5481692 - DNA, 15 bp, Homo sapiens
gccacacagcccaga

SEQ ID NO: 5481693 - DNA, 17 bp, Homo sapiens
gccacacagcccagaag

SEQ ID NO: 5481694 - DNA, 18 bp, Homo sapiens
gccacacagcccagaagg

SEQ ID NO: 5481695 - DNA, 13 bp, Homo sapiens
gccacacagctgc

SEQ ID NO: 5481696 - DNA, 14 bp, Homo sapiens
gccacacagctgcc

SEQ ID NO: 5481697 - DNA, 16 bp, Homo sapiens
gccacacaggcagggc

SEQ ID NO: 5481698 - DNA, 17 bp, Homo sapiens
gccacacaggcagggcc

SEQ ID NO: 5481699 - DNA, 19 bp, Homo sapiens
gccacacaggcagggcctg

SEQ ID NO: 5481700 - DNA, 22 bp, Homo sapiens
gccacacaggcagggcctggct

SEQ ID NO: 5481701 - DNA, 14 bp, Homo sapiens
gccacacagtggcc

SEQ ID NO: 5481702 - DNA, 21 bp, Homo sapiens
gccacacagtggccggggctg

SEQ ID NO: 5481703 - DNA, 23 bp, Homo sapiens
gccacacatcacccttaccatgt

SEQ ID NO: 5481704 - DNA, 18 bp, Homo sapiens
gccacacatgggcatcta

SEQ ID NO: 5481705 - DNA, 20 bp, Homo sapiens
gccacacattgtgcttggcc

SEQ ID NO: 5481706 - DNA, 13 bp, Homo sapiens
gccacaccaagct

SEQ ID NO: 5481707 - DNA, 17 bp, Homo sapiens
gccacaccaatcagaga

SEQ ID NO: 5481708 - DNA, 20 bp, Homo sapiens
gccacaccacagcaagccgg

SEQ ID NO: 5481709 - DNA, 13 bp, Homo sapiens
gccacaccaggat

SEQ ID NO: 5481710 - DNA, 19 bp, Homo sapiens
gccacaccatctcctttca

SEQ ID NO: 5481711 - DNA, 17 bp, Homo sapiens
gccacacccagcggccc

SEQ ID NO: 5481712 - DNA, 16 bp, Homo sapiens
gccacacccaggaagg

SEQ ID NO: 5481713 - DNA, 17 bp, Homo sapiens
gccacacccaggaaggg

SEQ ID NO: 5481714 - DNA, 18 bp, Homo sapiens
gccacacccaggaaggga

SEQ ID NO: 5481715 - DNA, 16 bp, Homo sapiens
gccacaccccagactc

SEQ ID NO: 5481716 - DNA, 21 bp, Homo sapiens
gccacaccccagactccaggc

SEQ ID NO: 5481717 - DNA, 18 bp, Homo sapiens
gccacacccctctgctgc

SEQ ID NO: 5481718 - DNA, 13 bp, Homo sapiens
gccacaccctccc

SEQ ID NO: 5481719 - DNA, 16 bp, Homo sapiens
gccacaccgctggctc

SEQ ID NO: 5481720 - DNA, 22 bp, Homo sapiens
gccacaccgtggcagcttgctg

SEQ ID NO: 5481721 - DNA, 19 bp, Homo sapiens
gccacacctctatcccggc

SEQ ID NO: 5481722 - DNA, 13 bp, Homo sapiens
gccacacctggcc

SEQ ID NO: 5481723 - DNA, 14 bp, Homo sapiens
gccacacctggcct

SEQ ID NO: 5481724 - DNA, 19 bp, Homo sapiens
gccacacctggtctgtttt

SEQ ID NO: 5481725 - DNA, 16 bp, Homo sapiens
gccacacgcactggtg

SEQ ID NO: 5481726 - DNA, 21 bp, Homo sapiens
gccacacgcactggtgccaaa

SEQ ID NO: 5481727 - DNA, 21 bp, Homo sapiens
gccacacgcaggcggccaggg

SEQ ID NO: 5481728 - DNA, 22 bp, Homo sapiens
gccacacgcaggcggccagggc

SEQ ID NO: 5481729 - DNA, 20 bp, Homo sapiens
gccacacgctgcccaggctc

SEQ ID NO: 5481730 - DNA, 14 bp, Homo sapiens
gccacacggaagca

SEQ ID NO: 5481731 - DNA, 23 bp, Homo sapiens
gccacacggaagcaagcagatga

SEQ ID NO: 5481732 - DNA, 16 bp, Homo sapiens
gccacacgtggctggc

SEQ ID NO: 5481733 - DNA, 21 bp, Homo sapiens
gccacactattaccatgagaa

SEQ ID NO: 5481734 - DNA, 17 bp, Homo sapiens
gccacactcagcacaag

SEQ ID NO: 5481735 - DNA, 19 bp, Homo sapiens
gccacactcagcacaaggc

SEQ ID NO: 5481736 - DNA, 18 bp, Homo sapiens
gccacactctccatcacc

SEQ ID NO: 5481737 - DNA, 20 bp, Homo sapiens
gccacactctttctcctgct

SEQ ID NO: 5481738 - DNA, 21 bp, Homo sapiens
gccacactctttctcctgctt

SEQ ID NO: 5481739 - DNA, 14 bp, Homo sapiens
gccacactggccgg

SEQ ID NO: 5481740 - DNA, 11 bp, Homo sapiens
gccacactggg

SEQ ID NO: 5481741 - DNA, 15 bp, Homo sapiens
gccacactgggcctg

SEQ ID NO: 5481742 - DNA, 17 bp, Homo sapiens
gccacactgggcctgga

SEQ ID NO: 5481743 - DNA, 16 bp, Homo sapiens
gccacactggggctga

SEQ ID NO: 5481744 - DNA, 15 bp, Homo sapiens
gccacacttccttta

SEQ ID NO: 5481745 - DNA, 11 bp, Homo sapiens
gccacagaaat

SEQ ID NO: 5481746 - DNA, 14 bp, Homo sapiens
gccacagaagccag

SEQ ID NO: 5481747 - DNA, 15 bp, Homo sapiens
gccacagaaggtgaa

SEQ ID NO: 5481748 - DNA, 22 bp, Homo sapiens
gccacagaccacctgcttctga

SEQ ID NO: 5481749 - DNA, 18 bp, Homo sapiens
gccacagacccctgggag

SEQ ID NO: 5481750 - DNA, 21 bp, Homo sapiens
gccacagagaagtttgtagcc

SEQ ID NO: 5481751 - DNA, 23 bp, Homo sapiens
gccacagagaagtttgtagccag

SEQ ID NO: 5481752 - DNA, 23 bp, Homo sapiens
gccacagaggactcacttgccca

SEQ ID NO: 5481753 - DNA, 17 bp, Homo sapiens
gccacagaggccccacc

SEQ ID NO: 5481754 - DNA, 19 bp, Homo sapiens
gccacagagggctgtgtct

SEQ ID NO: 5481755 - DNA, 23 bp, Homo sapiens
gccacagagtgtagccaggtccc

SEQ ID NO: 5481756 - DNA, 23 bp, Homo sapiens
gccacagattgttagagagtata

SEQ ID NO: 5481757 - DNA, 15 bp, Homo sapiens
gccacagcaaggctg

SEQ ID NO: 5481758 - DNA, 16 bp, Homo sapiens
gccacagcaaggctgt

SEQ ID NO: 5481759 - DNA, 15 bp, Homo sapiens
gccacagcaggactg

SEQ ID NO: 5481760 - DNA, 16 bp, Homo sapiens
gccacagccacctcca

SEQ ID NO: 5481761 - DNA, 19 bp, Homo sapiens
gccacagccacctccaccc

SEQ ID NO: 5481762 - DNA, 20 bp, Homo sapiens
gccacagccacctccacccc

SEQ ID NO: 5481763 - DNA, 16 bp, Homo sapiens
gccacagccagaggag

SEQ ID NO: 5481764 - DNA, 19 bp, Homo sapiens
gccacagcccagccacgga

SEQ ID NO: 5481765 - DNA, 22 bp, Homo sapiens
gccacagcccaggcctccagct

SEQ ID NO: 5481766 - DNA, 21 bp, Homo sapiens
gccacagcccatccatagtaa

SEQ ID NO: 5481767 - DNA, 13 bp, Homo sapiens
gccacagccccaa

SEQ ID NO: 5481768 - DNA, 13 bp, Homo sapiens
gccacagccccac

SEQ ID NO: 5481769 - DNA, 14 bp, Homo sapiens
gccacagccccaca

SEQ ID NO: 5481770 - DNA, 18 bp, Homo sapiens
gccacagccccacagcac

SEQ ID NO: 5481771 - DNA, 16 bp, Homo sapiens
gccacagcccctggca

SEQ ID NO: 5481772 - DNA, 14 bp, Homo sapiens
gccacagccctgtc

SEQ ID NO: 5481773 - DNA, 13 bp, Homo sapiens
gccacagcccttt

SEQ ID NO: 5481774 - DNA, 20 bp, Homo sapiens
gccacagcccttttgtctct

SEQ ID NO: 5481775 - DNA, 19 bp, Homo sapiens
gccacagccgcctttgggt

SEQ ID NO: 5481776 - DNA, 12 bp, Homo sapiens
gccacagcctgc

SEQ ID NO: 5481777 - DNA, 14 bp, Homo sapiens
gccacagcctgctg

SEQ ID NO: 5481778 - DNA, 15 bp, Homo sapiens
gccacagcctgctgg

SEQ ID NO: 5481779 - DNA, 12 bp, Homo sapiens
gccacagcctgt

SEQ ID NO: 5481780 - DNA, 21 bp, Homo sapiens
gccacagccttccctctgcat

SEQ ID NO: 5481781 - DNA, 14 bp, Homo sapiens
gccacagctgctgg

SEQ ID NO: 5481782 - DNA, 13 bp, Homo sapiens
gccacagcttttg

SEQ ID NO: 5481783 - DNA, 18 bp, Homo sapiens
gccacagcttttgcaact

SEQ ID NO: 5481784 - DNA, 17 bp, Homo sapiens
gccacaggaacggccct

SEQ ID NO: 5481785 - DNA, 18 bp, Homo sapiens
gccacaggaacggccctg

SEQ ID NO: 5481786 - DNA, 21 bp, Homo sapiens
gccacaggaacggccctgcag

SEQ ID NO: 5481787 - DNA, 20 bp, Homo sapiens
gccacaggaaggaggggaga

SEQ ID NO: 5481788 - DNA, 18 bp, Homo sapiens
gccacaggacacagtcag

SEQ ID NO: 5481789 - DNA, 15 bp, Homo sapiens
gccacaggaccacct

SEQ ID NO: 5481790 - DNA, 20 bp, Homo sapiens
gccacaggagccctgctatg

SEQ ID NO: 5481791 - DNA, 19 bp, Homo sapiens
gccacaggcaggtcacaga

SEQ ID NO: 5481792 - DNA, 20 bp, Homo sapiens
gccacaggccaaatccttgg

SEQ ID NO: 5481793 - DNA, 13 bp, Homo sapiens
gccacaggccact

SEQ ID NO: 5481794 - DNA, 16 bp, Homo sapiens
gccacaggcctccctg

SEQ ID NO: 5481795 - DNA, 17 bp, Homo sapiens
gccacaggcctccctgt

SEQ ID NO: 5481796 - DNA, 22 bp, Homo sapiens
gccacaggcctccctgtttgaa

SEQ ID NO: 5481797 - DNA, 12 bp, Homo sapiens
gccacaggcctg

SEQ ID NO: 5481798 - DNA, 15 bp, Homo sapiens
gccacaggcctggcc

SEQ ID NO: 5481799 - DNA, 19 bp, Homo sapiens
gccacagggaagctcacac

SEQ ID NO: 5481800 - DNA, 23 bp, Homo sapiens
gccacagggaagctcacacatcc

SEQ ID NO: 5481801 - DNA, 14 bp, Homo sapiens
gccacagggagcca

SEQ ID NO: 5481802 - DNA, 21 bp, Homo sapiens
gccacagggtctgcctccagc

SEQ ID NO: 5481803 - DNA, 13 bp, Homo sapiens
gccacagggtgag

SEQ ID NO: 5481804 - DNA, 23 bp, Homo sapiens
gccacccttggtctcatgccccg

SEQ ID NO: 5481805 - DNA, 14 bp, Homo sapiens
gccaccctttctgg

SEQ ID NO: 5481806 - DNA, 16 bp, Homo sapiens
gccaccctttctggca

SEQ ID NO: 5481807 - DNA, 16 bp, Homo sapiens
gccaccgactgcccag

SEQ ID NO: 5481808 - DNA, 22 bp, Homo sapiens
gccaccgactgcccagccactc

SEQ ID NO: 5481809 - DNA, 17 bp, Homo sapiens
gccaccgagtgccttca

SEQ ID NO: 5481810 - DNA, 18 bp, Homo sapiens
gccaccgagtgccttcaa

SEQ ID NO: 5481811 - DNA, 15 bp, Homo sapiens
gccaccgcagctgct

SEQ ID NO: 5481812 - DNA, 17 bp, Homo sapiens
gccaccgcagctgctgc

SEQ ID NO: 5481813 - DNA, 21 bp, Homo sapiens
gccaccgcagctgctgccact

SEQ ID NO: 5481814 - DNA, 15 bp, Homo sapiens
gccaccgccagagga

SEQ ID NO: 5481815 - DNA, 16 bp, Homo sapiens
gccaccgccagaggac

SEQ ID NO: 5481816 - DNA, 18 bp, Homo sapiens
gccaccgcccagctcatg

SEQ ID NO: 5481817 - DNA, 22 bp, Homo sapiens
gccaccgccgactttgtacccc

SEQ ID NO: 5481818 - DNA, 16 bp, Homo sapiens
gccaccgcgcctggcc

SEQ ID NO: 5481819 - DNA, 15 bp, Homo sapiens
gccaccggcctgtgg

SEQ ID NO: 5481820 - DNA, 19 bp, Homo sapiens
gccaccggcctgtgggtct

SEQ ID NO: 5481821 - DNA, 21 bp, Homo sapiens
gccaccggcctgtgggtctct

SEQ ID NO: 5481822 - DNA, 22 bp, Homo sapiens
gccaccggcctgtgggtctctg

SEQ ID NO: 5481823 - DNA, 23 bp, Homo sapiens
gccaccgggacagacctggacac

SEQ ID NO: 5481824 - DNA, 18 bp, Homo sapiens
gccaccggggaacccagc

SEQ ID NO: 5481825 - DNA, 15 bp, Homo sapiens
gccaccggggcaaga

SEQ ID NO: 5481826 - DNA, 13 bp, Homo sapiens
gccaccgtgcctg

SEQ ID NO: 5481827 - DNA, 16 bp, Homo sapiens
gccaccgtgcctggcc

SEQ ID NO: 5481828 - DNA, 17 bp, Homo sapiens
gccaccgtgcctggcca

SEQ ID NO: 5481829 - DNA, 16 bp, Homo sapiens
gccaccgtgcctggct

SEQ ID NO: 5481830 - DNA, 17 bp, Homo sapiens
gccaccgtgcctggcta

SEQ ID NO: 5481831 - DNA, 14 bp, Homo sapiens
gccaccgtttcttc

SEQ ID NO: 5481832 - DNA, 15 bp, Homo sapiens
gccaccgtttcttcc

SEQ ID NO: 5481833 - DNA, 22 bp, Homo sapiens
gccacctagaagtctccctgca

SEQ ID NO: 5481834 - DNA, 23 bp, Homo sapiens
gccacctagaagtctccctgcac

SEQ ID NO: 5481835 - DNA, 15 bp, Homo sapiens
gccacctatctcgtg

SEQ ID NO: 5481836 - DNA, 20 bp, Homo sapiens
gccacctatctcgtgggaga

SEQ ID NO: 5481837 - DNA, 13 bp, Homo sapiens
gccacctcagggc

SEQ ID NO: 5481838 - DNA, 14 bp, Homo sapiens
gccacctcagggca

SEQ ID NO: 5481839 - DNA, 15 bp, Homo sapiens
gccacctcagggcac

SEQ ID NO: 5481840 - DNA, 16 bp, Homo sapiens
gccacctccaccccca

SEQ ID NO: 5481841 - DNA, 23 bp, Homo sapiens
gccacctcccaaggactttccag

SEQ ID NO: 5481842 - DNA, 13 bp, Homo sapiens
gccacctccccac

SEQ ID NO: 5481843 - DNA, 14 bp, Homo sapiens
gccacctccccact

SEQ ID NO: 5481844 - DNA, 13 bp, Homo sapiens
gccacctccccta

SEQ ID NO: 5481845 - DNA, 17 bp, Homo sapiens
gccacctcccctatcca

SEQ ID NO: 5481846 - DNA, 21 bp, Homo sapiens
gccacctcccctatccaccca

SEQ ID NO: 5481847 - DNA, 22 bp, Homo sapiens
gccacctccccttgccagctgc

SEQ ID NO: 5481848 - DNA, 24 bp, Homo sapiens
gccacctccccttgccagctgctg

SEQ ID NO: 5481849 - DNA, 20 bp, Homo sapiens
gccacctcctaaaaggccca

SEQ ID NO: 5481850 - DNA, 23 bp, Homo sapiens
gccacctcctaaaaggcccagag

SEQ ID NO: 5481851 - DNA, 18 bp, Homo sapiens
gccacctcctaccccttc

SEQ ID NO: 5481852 - DNA, 22 bp, Homo sapiens
gccacctcctaccccttcctgt

SEQ ID NO: 5481853 - DNA, 13 bp, Homo sapiens
gccacctcctccc

SEQ ID NO: 5481854 - DNA, 16 bp, Homo sapiens
gccacctcctccccct

SEQ ID NO: 5481855 - DNA, 22 bp, Homo sapiens
gccacctcctccccctgttctg

SEQ ID NO: 5481856 - DNA, 16 bp, Homo sapiens
gccacctccttggcac

SEQ ID NO: 5481857 - DNA, 19 bp, Homo sapiens
gccacctctaacagcacca

SEQ ID NO: 5481858 - DNA, 12 bp, Homo sapiens
gccacctctcca

SEQ ID NO: 5481859 - DNA, 17 bp, Homo sapiens
gccacctctccaagggc

SEQ ID NO: 5481860 - DNA, 18 bp, Homo sapiens
gccacctctccaagggct

SEQ ID NO: 5481861 - DNA, 16 bp, Homo sapiens
gccacctctcccagcc

SEQ ID NO: 5481862 - DNA, 13 bp, Homo sapiens
gccacctctgcct

SEQ ID NO: 5481863 - DNA, 14 bp, Homo sapiens
gccacctctgcctc

SEQ ID NO: 5481864 - DNA, 20 bp, Homo sapiens
gccacctctgcggaccccag

SEQ ID NO: 5481865 - DNA, 16 bp, Homo sapiens
gccacctctgtcattt

SEQ ID NO: 5481866 - DNA, 17 bp, Homo sapiens
gccacctctttaaaaac

SEQ ID NO: 5481867 - DNA, 20 bp, Homo sapiens
gccacctgaggtgggcccag

SEQ ID NO: 5481868 - DNA, 16 bp, Homo sapiens
gccacctgagttcctg

SEQ ID NO: 5481869 - DNA, 17 bp, Homo sapiens
gccacctgagttcctga

SEQ ID NO: 5481870 - DNA, 11 bp, Homo sapiens
gccacctgcaa

SEQ ID NO: 5481871 - DNA, 12 bp, Homo sapiens
gccacctgcaca

SEQ ID NO: 5481872 - DNA, 14 bp, Homo sapiens
gccacctgccaggc

SEQ ID NO: 5481873 - DNA, 17 bp, Homo sapiens
gccacctgcccccttct

SEQ ID NO: 5481874 - DNA, 20 bp, Homo sapiens
gccacctgcccccttctccc

SEQ ID NO: 5481875 - DNA, 21 bp, Homo sapiens
gccacctgcccccttctccca

SEQ ID NO: 5481876 - DNA, 23 bp, Homo sapiens
gccacctgcccccttctcccaca

SEQ ID NO: 5481877 - DNA, 12 bp, Homo sapiens
gccacctgcctg

SEQ ID NO: 5481878 - DNA, 14 bp, Homo sapiens
gccacctgcctgcg

SEQ ID NO: 5481879 - DNA, 14 bp, Homo sapiens
gccacctgcggtgc

SEQ ID NO: 5481880 - DNA, 22 bp, Homo sapiens
gccacctgcggtgctatctccc

SEQ ID NO: 5481881 - DNA, 13 bp, Homo sapiens
gccacctgctgcg

SEQ ID NO: 5481882 - DNA, 18 bp, Homo sapiens
gccacctggacccctgca

SEQ ID NO: 5481883 - DNA, 19 bp, Homo sapiens
gccacctggacccctgcat

SEQ ID NO: 5481884 - DNA, 13 bp, Homo sapiens
gccacctggatct

SEQ ID NO: 5481885 - DNA, 17 bp, Homo sapiens
gccacctgggctgggag

SEQ ID NO: 5481886 - DNA, 12 bp, Homo sapiens
gccacctggggc

SEQ ID NO: 5481887 - DNA, 16 bp, Homo sapiens
gccacctggggcagtc

SEQ ID NO: 5481888 - DNA, 11 bp, Homo sapiens
gccacctgggt

SEQ ID NO: 5481889 - DNA, 20 bp, Homo sapiens
gccacctgtagccatctgca

SEQ ID NO: 5481890 - DNA, 13 bp, Homo sapiens
gccacctgtccca

SEQ ID NO: 5481891 - DNA, 19 bp, Homo sapiens
gccacctgtcccacctcaa

SEQ ID NO: 5481892 - DNA, 19 bp, Homo sapiens
gccacctgtccggcccagt

SEQ ID NO: 5481893 - DNA, 21 bp, Homo sapiens
gccacctgtgtgttcttttga

SEQ ID NO: 5481894 - DNA, 16 bp, Homo sapiens
gccaccttggtcctag

SEQ ID NO: 5481895 - DNA, 18 bp, Homo sapiens
gccaccttgtacagaacc

SEQ ID NO: 5481896 - DNA, 19 bp, Homo sapiens
gccaccttgtacagaacca

SEQ ID NO: 5481897 - DNA, 12 bp, Homo sapiens
gccacctttgtg

SEQ ID NO: 5481898 - DNA, 17 bp, Homo sapiens
gccacctttgtgcagct

SEQ ID NO: 5481899 - DNA, 13 bp, Homo sapiens
gccacgaccagcc

SEQ ID NO: 5481900 - DNA, 14 bp, Homo sapiens
gccacgaccagccc

SEQ ID NO: 5481901 - DNA, 16 bp, Homo sapiens
gccacgaccagcccct

SEQ ID NO: 5481902 - DNA, 13 bp, Homo sapiens
gccacgactgcca

SEQ ID NO: 5481903 - DNA, 15 bp, Homo sapiens
gccacgaggttaaag

SEQ ID NO: 5481904 - DNA, 14 bp, Homo sapiens
gccacgattggaga

SEQ ID NO: 5481905 - DNA, 20 bp, Homo sapiens
gccacgattggagaatactt

SEQ ID NO: 5481906 - DNA, 18 bp, Homo sapiens
gccacgatttagatttaa

SEQ ID NO: 5481907 - DNA, 16 bp, Homo sapiens
gccacgcacaggtgct

SEQ ID NO: 5481908 - DNA, 23 bp, Homo sapiens
gccacgcaggccacccgggctgc

SEQ ID NO: 5481909 - DNA, 21 bp, Homo sapiens
gccacgcagggccatccactg

SEQ ID NO: 5481910 - DNA, 22 bp, Homo sapiens
gccacgcagggccatccactgt

SEQ ID NO: 5481911 - DNA, 23 bp, Homo sapiens
gccacgcaggggccctgagccaa

SEQ ID NO: 5481912 - DNA, 20 bp, Homo sapiens
gccacgcccaactaattttt

SEQ ID NO: 5481913 - DNA, 14 bp, Homo sapiens
gccacgccccagcc

SEQ ID NO: 5481914 - DNA, 15 bp, Homo sapiens
gccacgccccagccc

SEQ ID NO: 5481915 - DNA, 15 bp, Homo sapiens
gccacgccctccctg

SEQ ID NO: 5481916 - DNA, 19 bp, Homo sapiens
gccacgccggccacacccc

SEQ ID NO: 5481917 - DNA, 21 bp, Homo sapiens
gccacgcctatgccctgccct

SEQ ID NO: 5481918 - DNA, 12 bp, Homo sapiens
gccacgcctctc

SEQ ID NO: 5481919 - DNA, 18 bp, Homo sapiens
gccacgcctctctcagcc

SEQ ID NO: 5481920 - DNA, 22 bp, Homo sapiens
gccacgcctctctcagcccagg

SEQ ID NO: 5481921 - DNA, 23 bp, Homo sapiens
gccacgcctctctcagcccaggt

SEQ ID NO: 5481922 - DNA, 13 bp, Homo sapiens
gccacgcctggaa

SEQ ID NO: 5481923 - DNA, 15 bp, Homo sapiens
gccacgcctggaagg

SEQ ID NO: 5481924 - DNA, 14 bp, Homo sapiens
gccacgcgctctgc

SEQ ID NO: 5481925 - DNA, 17 bp, Homo sapiens
gccacgcgctctgcatg

SEQ ID NO: 5481926 - DNA, 13 bp, Homo sapiens
gccacgctcaggc

SEQ ID NO: 5481927 - DNA, 14 bp, Homo sapiens
gccacgctcagtgc

SEQ ID NO: 5481928 - DNA, 16 bp, Homo sapiens
gccacgctcagtgccc

SEQ ID NO: 5481929 - DNA, 14 bp, Homo sapiens
gccacgctccagct

SEQ ID NO: 5481930 - DNA, 15 bp, Homo sapiens
gccacgctccagctg

SEQ ID NO: 5481931 - DNA, 17 bp, Homo sapiens
gccacgctccagctgcc

SEQ ID NO: 5481932 - DNA, 21 bp, Homo sapiens
gccacgctgtcctctcgagcc

SEQ ID NO: 5481933 - DNA, 16 bp, Homo sapiens
gccacggacgctggct

SEQ ID NO: 5481934 - DNA, 20 bp, Homo sapiens
gccacggaggagggatgctg

SEQ ID NO: 5481935 - DNA, 15 bp, Homo sapiens
gccacggccacagtc

SEQ ID NO: 5481936 - DNA, 15 bp, Homo sapiens
gccacggccaggcca

SEQ ID NO: 5481937 - DNA, 15 bp, Homo sapiens
gccacggcctggctg

SEQ ID NO: 5481938 - DNA, 14 bp, Homo sapiens
gccacggcctggga

SEQ ID NO: 5481939 - DNA, 16 bp, Homo sapiens
gccacggggaggggga

SEQ ID NO: 5481940 - DNA, 22 bp, Homo sapiens
gccacgggggaggccgaggcag

SEQ ID NO: 5481941 - DNA, 21 bp, Homo sapiens
gccacggtggacttagctctg

SEQ ID NO: 5481942 - DNA, 15 bp, Homo sapiens
gccacgtatagtcct

SEQ ID NO: 5481943 - DNA, 15 bp, Homo sapiens
gccacgtcatgtctc

SEQ ID NO: 5481944 - DNA, 15 bp, Homo sapiens
gccacgtcccacccc

SEQ ID NO: 5481945 - DNA, 15 bp, Homo sapiens
gccacgtcccagcat

SEQ ID NO: 5481946 - DNA, 18 bp, Homo sapiens
gccacgtcccagcatccc

SEQ ID NO: 5481947 - DNA, 21 bp, Homo sapiens
gccacgtcccagcatccctgg

SEQ ID NO: 5481948 - DNA, 22 bp, Homo sapiens
gccacgtcccagcatccctgga

SEQ ID NO: 5481949 - DNA, 23 bp, Homo sapiens
gccacgtcccgctgcctcctgct

SEQ ID NO: 5481950 - DNA, 18 bp, Homo sapiens
gccacgtctgtgctctgt

SEQ ID NO: 5481951 - DNA, 14 bp, Homo sapiens
gccacgtgaatggc

SEQ ID NO: 5481952 - DNA, 16 bp, Homo sapiens
gccacgtgccaggccc

SEQ ID NO: 5481953 - DNA, 18 bp, Homo sapiens
gccacgtgccaggcccgg

SEQ ID NO: 5481954 - DNA, 21 bp, Homo sapiens
gccacgtggccgctgcccacg

SEQ ID NO: 5481955 - DNA, 21 bp, Homo sapiens
gccacgtgggcaaacaggcag

SEQ ID NO: 5481956 - DNA, 17 bp, Homo sapiens
gccacgtggtcactgtg

SEQ ID NO: 5481957 - DNA, 20 bp, Homo sapiens
gccacgtggtcactgtgcac

SEQ ID NO: 5481958 - DNA, 19 bp, Homo sapiens
gccacgtggtggcccagct

SEQ ID NO: 5481959 - DNA, 21 bp, Homo sapiens
gccacgtggtggcccagctcc

SEQ ID NO: 5481960 - DNA, 22 bp, Homo sapiens
gccacgtgtgctgtggccaggc

SEQ ID NO: 5481961 - DNA, 14 bp, Homo sapiens
gccacgttttcacc

SEQ ID NO: 5481962 - DNA, 15 bp, Homo sapiens
gccactaaagcttca

SEQ ID NO: 5481963 - DNA, 22 bp, Homo sapiens
gccactaaccttgcctggtaca

SEQ ID NO: 5481964 - DNA, 20 bp, Homo sapiens
gccactaagaacccctctgc

SEQ ID NO: 5481965 - DNA, 14 bp, Homo sapiens
gccactaagcagag

SEQ ID NO: 5481966 - DNA, 14 bp, Homo sapiens
gccactaagccaac

SEQ ID NO: 5481967 - DNA, 18 bp, Homo sapiens
gccactacactccagcct

SEQ ID NO: 5481968 - DNA, 20 bp, Homo sapiens
gccactacactccagcctga

SEQ ID NO: 5481969 - DNA, 15 bp, Homo sapiens
gccactacctttgtc

SEQ ID NO: 5481970 - DNA, 16 bp, Homo sapiens
gccactacctttgtcc

SEQ ID NO: 5481971 - DNA, 13 bp, Homo sapiens
gccactaggccct

SEQ ID NO: 5481972 - DNA, 18 bp, Homo sapiens
gccactaggtgtccccaa

SEQ ID NO: 5481973 - DNA, 17 bp, Homo sapiens
gccactatgtccagcta

SEQ ID NO: 5481974 - DNA, 21 bp, Homo sapiens
gccactattgttagtctcttg

SEQ ID NO: 5481975 - DNA, 23 bp, Homo sapiens
gccactcacccttcctggcccag

SEQ ID NO: 5481976 - DNA, 19 bp, Homo sapiens
gccactcactaggccccca

SEQ ID NO: 5481977 - DNA, 17 bp, Homo sapiens
gccactcagaggccccc

SEQ ID NO: 5481978 - DNA, 20 bp, Homo sapiens
gccactcagaggcccccagt

SEQ ID NO: 5481979 - DNA, 22 bp, Homo sapiens
gccactcagagttctatactgt

SEQ ID NO: 5481980 - DNA, 22 bp, Homo sapiens
gccactcagccatttccccctc

SEQ ID NO: 5481981 - DNA, 15 bp, Homo sapiens
gccactcagcttcct

SEQ ID NO: 5481982 - DNA, 14 bp, Homo sapiens
gccagaaggaaggt

SEQ ID NO: 5481983 - DNA, 19 bp, Homo sapiens
gccagaaggaatcttctca

SEQ ID NO: 5481984 - DNA, 18 bp, Homo sapiens
gccagaaggagggcagag

SEQ ID NO: 5481985 - DNA, 21 bp, Homo sapiens
gccagaaggagggcagagcca

SEQ ID NO: 5481986 - DNA, 17 bp, Homo sapiens
gccagaagtaccagact

SEQ ID NO: 5481987 - DNA, 18 bp, Homo sapiens
gccagaagtaccagacta

SEQ ID NO: 5481988 - DNA, 16 bp, Homo sapiens
gccagaagtagctttg

SEQ ID NO: 5481989 - DNA, 20 bp, Homo sapiens
gccagaagtcaaggcttaga

SEQ ID NO: 5481990 - DNA, 22 bp, Homo sapiens
gccagaagtcctccctcctgca

SEQ ID NO: 5481991 - DNA, 15 bp, Homo sapiens
gccagaatctcatta

SEQ ID NO: 5481992 - DNA, 20 bp, Homo sapiens
gccagaatcttcgtcctgcc

SEQ ID NO: 5481993 - DNA, 19 bp, Homo sapiens
gccagaatgtaggctggtc

SEQ ID NO: 5481994 - DNA, 12 bp, Homo sapiens
gccagaatgttt

SEQ ID NO: 5481995 - DNA, 13 bp, Homo sapiens
gccagacaacttc

SEQ ID NO: 5481996 - DNA, 16 bp, Homo sapiens
gccagacacagataca

SEQ ID NO: 5481997 - DNA, 14 bp, Homo sapiens
gccagacacaggcc

SEQ ID NO: 5481998 - DNA, 16 bp, Homo sapiens
gccagacacaggccct

SEQ ID NO: 5481999 - DNA, 16 bp, Homo sapiens
gccagacacaggccgt

SEQ ID NO: 5482000 - DNA, 22 bp, Homo sapiens
gccagacagccccaagcttctg

SEQ ID NO: 5482001 - DNA, 14 bp, Homo sapiens
gccagaccagagct

SEQ ID NO: 5482002 - DNA, 16 bp, Homo sapiens
gccagaccagcaggct

SEQ ID NO: 5482003 - DNA, 17 bp, Homo sapiens
gccagaccaggtgacct

SEQ ID NO: 5482004 - DNA, 21 bp, Homo sapiens
gccagacccacgggctcatgc

SEQ ID NO: 5482005 - DNA, 22 bp, Homo sapiens
gccagacccacgggctcatgca

SEQ ID NO: 5482006 - DNA, 16 bp, Homo sapiens
gccagaccccacgctg

SEQ ID NO: 5482007 - DNA, 12 bp, Homo sapiens
gccagacctgca

SEQ ID NO: 5482008 - DNA, 13 bp, Homo sapiens
gccagacctgcag

SEQ ID NO: 5482009 - DNA, 14 bp, Homo sapiens
gccagacctgcatg

SEQ ID NO: 5482010 - DNA, 18 bp, Homo sapiens
gccagacctgcatggtca

SEQ ID NO: 5482011 - DNA, 18 bp, Homo sapiens
gccagacgctgccgctgc

SEQ ID NO: 5482012 - DNA, 19 bp, Homo sapiens
gccagacgctgccgctgcc

SEQ ID NO: 5482013 - DNA, 23 bp, Homo sapiens
gccagacggcacccacccagcac

SEQ ID NO: 5482014 - DNA, 21 bp, Homo sapiens
gccagacgtggtggctcacac

SEQ ID NO: 5482015 - DNA, 13 bp, Homo sapiens
gccagactctggt

SEQ ID NO: 5482016 - DNA, 16 bp, Homo sapiens
gccagactggagtgca

SEQ ID NO: 5482017 - DNA, 15 bp, Homo sapiens
gccagactggcacag

SEQ ID NO: 5482018 - DNA, 15 bp, Homo sapiens
gccagactggctgca

SEQ ID NO: 5482019 - DNA, 15 bp, Homo sapiens
gccagactgtccagg

SEQ ID NO: 5482020 - DNA, 15 bp, Homo sapiens
gccagacttctaaaa

SEQ ID NO: 5482021 - DNA, 17 bp, Homo sapiens
gccagacttctaaaata

SEQ ID NO: 5482022 - DNA, 18 bp, Homo sapiens
gccagacttctaaaataa

SEQ ID NO: 5482023 - DNA, 19 bp, Homo sapiens
gccagacttgcttcctgca

SEQ ID NO: 5482024 - DNA, 17 bp, Homo sapiens
gccagagaacccagccc

SEQ ID NO: 5482025 - DNA, 22 bp, Homo sapiens
gccagagaagtctggtcagagc

SEQ ID NO: 5482026 - DNA, 13 bp, Homo sapiens
gccagagaagtga

SEQ ID NO: 5482027 - DNA, 16 bp, Homo sapiens
gccagagacacaagcc

SEQ ID NO: 5482028 - DNA, 22 bp, Homo sapiens
gccagagacacaagccttcggc

SEQ ID NO: 5482029 - DNA, 20 bp, Homo sapiens
gccagagacggaagcctttt

SEQ ID NO: 5482030 - DNA, 18 bp, Homo sapiens
gccagagagcaggggagc

SEQ ID NO: 5482031 - DNA, 20 bp, Homo sapiens
gccagagagcaggggagctt

SEQ ID NO: 5482032 - DNA, 15 bp, Homo sapiens
gccagagaggagcac

SEQ ID NO: 5482033 - DNA, 16 bp, Homo sapiens
gccagagagggaaaag

SEQ ID NO: 5482034 - DNA, 14 bp, Homo sapiens
gccagagagggccc

SEQ ID NO: 5482035 - DNA, 17 bp, Homo sapiens
gccagagagggcccagc

SEQ ID NO: 5482036 - DNA, 18 bp, Homo sapiens
gccagagagggcccagct

SEQ ID NO: 5482037 - DNA, 20 bp, Homo sapiens
gccagagagggcccagctgt

SEQ ID NO: 5482038 - DNA, 21 bp, Homo sapiens
gccagagatccaaaagaagcc

SEQ ID NO: 5482039 - DNA, 17 bp, Homo sapiens
gccagagcaaacagaaa

SEQ ID NO: 5482040 - DNA, 19 bp, Homo sapiens
gccagagcaaacagaaaaa

SEQ ID NO: 5482041 - DNA, 18 bp, Homo sapiens
gccagagcaaagggccag

SEQ ID NO: 5482042 - DNA, 12 bp, Homo sapiens
gccagagcagct

SEQ ID NO: 5482043 - DNA, 21 bp, Homo sapiens
gccagagcagctccaccactg

SEQ ID NO: 5482044 - DNA, 14 bp, Homo sapiens
gccagagcaggggg

SEQ ID NO: 5482045 - DNA, 11 bp, Homo sapiens
gccagagccaa

SEQ ID NO: 5482046 - DNA, 15 bp, Homo sapiens
gccagagccaacctg

SEQ ID NO: 5482047 - DNA, 18 bp, Homo sapiens
gccagagccaacctggac

SEQ ID NO: 5482048 - DNA, 19 bp, Homo sapiens
gccagagccaacctggact

SEQ ID NO: 5482049 - DNA, 20 bp, Homo sapiens
gccagagccaacctggactt

SEQ ID NO: 5482050 - DNA, 22 bp, Homo sapiens
gccagagccaacctggacttcc

SEQ ID NO: 5482051 - DNA, 12 bp, Homo sapiens
gccagagccagg

SEQ ID NO: 5482052 - DNA, 18 bp, Homo sapiens
gccagagcccaagtgcca

SEQ ID NO: 5482053 - DNA, 20 bp, Homo sapiens
gccagagcccactccatctg

SEQ ID NO: 5482054 - DNA, 16 bp, Homo sapiens
gccagagccccaagca

SEQ ID NO: 5482055 - DNA, 22 bp, Homo sapiens
gccagagcccttcactgccatg

SEQ ID NO: 5482056 - DNA, 19 bp, Homo sapiens
gccagagccgcaccctggc

SEQ ID NO: 5482057 - DNA, 22 bp, Homo sapiens
gccagagccgcaccctggctgg

SEQ ID NO: 5482058 - DNA, 14 bp, Homo sapiens
gccagagccgggca

SEQ ID NO: 5482059 - DNA, 12 bp, Homo sapiens
gccagagcctgg

SEQ ID NO: 5482060 - DNA, 14 bp, Homo sapiens
gccagagcctgggg

SEQ ID NO: 5482061 - DNA, 16 bp, Homo sapiens
gccagagcctggggca

SEQ ID NO: 5482062 - DNA, 16 bp, Homo sapiens
gccagagcctggggct

SEQ ID NO: 5482063 - DNA, 17 bp, Homo sapiens
gccagagcctggggctc

SEQ ID NO: 5482064 - DNA, 16 bp, Homo sapiens
gccagagcctggggtg

SEQ ID NO: 5482065 - DNA, 16 bp, Homo sapiens
gccagagctagggctg

SEQ ID NO: 5482066 - DNA, 21 bp, Homo sapiens
gccagagctagggctgctgct

SEQ ID NO: 5482067 - DNA, 22 bp, Homo sapiens
gccagagctagggctgctgctt

SEQ ID NO: 5482068 - DNA, 20 bp, Homo sapiens
gccagagctcccaggacgca

SEQ ID NO: 5482069 - DNA, 14 bp, Homo sapiens
gccagagctgaacc

SEQ ID NO: 5482070 - DNA, 17 bp, Homo sapiens
gccagagctgagtggca

SEQ ID NO: 5482071 - DNA, 16 bp, Homo sapiens
gccagagctggaaggc

SEQ ID NO: 5482072 - DNA, 18 bp, Homo sapiens
gccagagctggaaggcag

SEQ ID NO: 5482073 - DNA, 12 bp, Homo sapiens
gccagagctggg

SEQ ID NO: 5482074 - DNA, 16 bp, Homo sapiens
gccagagctgggtggg

SEQ ID NO: 5482075 - DNA, 22 bp, Homo sapiens
gccagagctgggtggggacagt

SEQ ID NO: 5482076 - DNA, 17 bp, Homo sapiens
gccagagctgtgcctgc

SEQ ID NO: 5482077 - DNA, 22 bp, Homo sapiens
gccagagctgtgcctgctcagc

SEQ ID NO: 5482078 - DNA, 23 bp, Homo sapiens
gccagaggaaccagcactccatc

SEQ ID NO: 5482079 - DNA, 22 bp, Homo sapiens
gccagaggaactgtccagagag

SEQ ID NO: 5482080 - DNA, 16 bp, Homo sapiens
gccagaggaaggaaaa

SEQ ID NO: 5482081 - DNA, 17 bp, Homo sapiens
gccagaggaagggaggc

SEQ ID NO: 5482082 - DNA, 18 bp, Homo sapiens
gccagaggaagggaggcc

SEQ ID NO: 5482083 - DNA, 17 bp, Homo sapiens
gccagaggaatcctggc

SEQ ID NO: 5482084 - DNA, 18 bp, Homo sapiens
gccagaggaatcctggca

SEQ ID NO: 5482085 - DNA, 21 bp, Homo sapiens
gccagaggaatcctggcagcc

SEQ ID NO: 5482086 - DNA, 22 bp, Homo sapiens
gccagaggaatcctggcagccc

SEQ ID NO: 5482087 - DNA, 13 bp, Homo sapiens
gccagaggagaag

SEQ ID NO: 5482088 - DNA, 12 bp, Homo sapiens
gccagaggagag

SEQ ID NO: 5482089 - DNA, 19 bp, Homo sapiens
gccagaggagagaggaccc

SEQ ID NO: 5482090 - DNA, 13 bp, Homo sapiens
gccagaggagggc

SEQ ID NO: 5482091 - DNA, 20 bp, Homo sapiens
gccagaggagggcagaggga

SEQ ID NO: 5482092 - DNA, 22 bp, Homo sapiens
gccagaggagggcagagggaga

SEQ ID NO: 5482093 - DNA, 13 bp, Homo sapiens
gccagaggccagg

SEQ ID NO: 5482094 - DNA, 17 bp, Homo sapiens
gccagaggccaggatgc

SEQ ID NO: 5482095 - DNA, 11 bp, Homo sapiens
gccagaggccc

SEQ ID NO: 5482096 - DNA, 16 bp, Homo sapiens
gccagaggcccccagc

SEQ ID NO: 5482097 - DNA, 23 bp, Homo sapiens
gccagaggcccccagcccagggc

SEQ ID NO: 5482098 - DNA, 15 bp, Homo sapiens
gccagaggccctgga

SEQ ID NO: 5482099 - DNA, 16 bp, Homo sapiens
gccagaggccctggag

SEQ ID NO: 5482100 - DNA, 22 bp, Homo sapiens
gccagaggcctggtgccctggc

SEQ ID NO: 5482101 - DNA, 13 bp, Homo sapiens
gccagaggctggg

SEQ ID NO: 5482102 - DNA, 15 bp, Homo sapiens
gccagagggactttg

SEQ ID NO: 5482103 - DNA, 13 bp, Homo sapiens
gccagagggagct

SEQ ID NO: 5482104 - DNA, 22 bp, Homo sapiens
gccagagggagtgacagaggca

SEQ ID NO: 5482105 - DNA, 23 bp, Homo sapiens
gccagagggagtgacagaggcag

SEQ ID NO: 5482106 - DNA, 16 bp, Homo sapiens
gccagagggccagcag

SEQ ID NO: 5482107 - DNA, 21 bp, Homo sapiens
gccagagggccagcaggctcc

SEQ ID NO: 5482108 - DNA, 22 bp, Homo sapiens
gccagagggccagcaggctcct

SEQ ID NO: 5482109 - DNA, 17 bp, Homo sapiens
gccagagggcccctcac

SEQ ID NO: 5482110 - DNA, 15 bp, Homo sapiens
gccagaggtgcttca

SEQ ID NO: 5482111 - DNA, 19 bp, Homo sapiens
gccagaggtgcttcaccct

SEQ ID NO: 5482112 - DNA, 13 bp, Homo sapiens
gccagaggtggag

SEQ ID NO: 5482113 - DNA, 16 bp, Homo sapiens
gccagaggtgggcagg

SEQ ID NO: 5482114 - DNA, 22 bp, Homo sapiens
gccagaggtgggcaggtggtgg

SEQ ID NO: 5482115 - DNA, 20 bp, Homo sapiens
gccagaggttttaggaaacc

SEQ ID NO: 5482116 - DNA, 18 bp, Homo sapiens
gccagagtctcccagtgg

SEQ ID NO: 5482117 - DNA, 15 bp, Homo sapiens
gccagagtggcctgg

SEQ ID NO: 5482118 - DNA, 17 bp, Homo sapiens
gccagagtggcctggcc

SEQ ID NO: 5482119 - DNA, 14 bp, Homo sapiens
gccagagtgtcctg

SEQ ID NO: 5482120 - DNA, 13 bp, Homo sapiens
gccagagttcctg

SEQ ID NO: 5482121 - DNA, 18 bp, Homo sapiens
gccagagttcctgcggag

SEQ ID NO: 5482122 - DNA, 18 bp, Homo sapiens
gccagagttgttctcagg

SEQ ID NO: 5482123 - DNA, 16 bp, Homo sapiens
gccagagtttgcctcc

SEQ ID NO: 5482124 - DNA, 14 bp, Homo sapiens
gccagatccagcct

SEQ ID NO: 5482125 - DNA, 23 bp, Homo sapiens
gccagatccccagggcagcctcg

SEQ ID NO: 5482126 - DNA, 16 bp, Homo sapiens
gccagatgacagggag

SEQ ID NO: 5482127 - DNA, 17 bp, Homo sapiens
gccagatgattttcctc

SEQ ID NO: 5482128 - DNA, 16 bp, Homo sapiens
gccagatgcaggacag

SEQ ID NO: 5482129 - DNA, 14 bp, Homo sapiens
gccagatgccctgt

SEQ ID NO: 5482130 - DNA, 16 bp, Homo sapiens
gccagatgctgatgtt

SEQ ID NO: 5482131 - DNA, 17 bp, Homo sapiens
gccagatggggcctctg

SEQ ID NO: 5482132 - DNA, 18 bp, Homo sapiens
gccagatggggcctctgt

SEQ ID NO: 5482133 - DNA, 23 bp, Homo sapiens
gccagattacaggaatgaagaac

SEQ ID NO: 5482134 - DNA, 18 bp, Homo sapiens
gccagattaggcctggag

SEQ ID NO: 5482135 - DNA, 13 bp, Homo sapiens
gccagattctctt

SEQ ID NO: 5482136 - DNA, 14 bp, Homo sapiens
gccagattctgcct

SEQ ID NO: 5482137 - DNA, 16 bp, Homo sapiens
gccagattctgcctct

SEQ ID NO: 5482138 - DNA, 16 bp, Homo sapiens
gccagattctttcctg

SEQ ID NO: 5482139 - DNA, 24 bp, Homo sapiens
gccagattctttcctgaggctggg

SEQ ID NO: 5482140 - DNA, 15 bp, Homo sapiens
gccagattgccatcc

SEQ ID NO: 5482141 - DNA, 19 bp, Homo sapiens
gccagattggccaattaaa

SEQ ID NO: 5482142 - DNA, 21 bp, Homo sapiens
gccagatttcactctccttgg

SEQ ID NO: 5482143 - DNA, 15 bp, Homo sapiens
gccagatttgtcttt

SEQ ID NO: 5482144 - DNA, 12 bp, Homo sapiens
gccagatttttt

SEQ ID NO: 5482145 - DNA, 21 bp, Homo sapiens
gccagcaaaaactgtgggaag

SEQ ID NO: 5482146 - DNA, 22 bp, Homo sapiens
gccagcaaagccccatgctgga

SEQ ID NO: 5482147 - DNA, 17 bp, Homo sapiens
gccagcaaagcctccag

SEQ ID NO: 5482148 - DNA, 18 bp, Homo sapiens
gccagcaaagcctccagc

SEQ ID NO: 5482149 - DNA, 11 bp, Homo sapiens
gccagcaaata

SEQ ID NO: 5482150 - DNA, 13 bp, Homo sapiens
gccagcaaataaa

SEQ ID NO: 5482151 - DNA, 16 bp, Homo sapiens
gccagcaacacagagc

SEQ ID NO: 5482152 - DNA, 13 bp, Homo sapiens
gccagcaactgaa

SEQ ID NO: 5482153 - DNA, 15 bp, Homo sapiens
gccagcaagaggaag

SEQ ID NO: 5482154 - DNA, 17 bp, Homo sapiens
gccagcaagaggaaggg

SEQ ID NO: 5482155 - DNA, 23 bp, Homo sapiens
gccagcaagaggaaggggtgctg

SEQ ID NO: 5482156 - DNA, 19 bp, Homo sapiens
gccagcaagagttaggggc

SEQ ID NO: 5482157 - DNA, 16 bp, Homo sapiens
gccagcaaggcaggtt

SEQ ID NO: 5482158 - DNA, 14 bp, Homo sapiens
gccagcaagtcctt

SEQ ID NO: 5482159 - DNA, 18 bp, Homo sapiens
gccagcaagtccttaggc

SEQ ID NO: 5482160 - DNA, 21 bp, Homo sapiens
gccagccgtgatgctcaggct

SEQ ID NO: 5482161 - DNA, 17 bp, Homo sapiens
gccagcctacactgcca

SEQ ID NO: 5482162 - DNA, 14 bp, Homo sapiens
gccagcctcagctc

SEQ ID NO: 5482163 - DNA, 23 bp, Homo sapiens
gccagcctcagctcagcctcccc

SEQ ID NO: 5482164 - DNA, 13 bp, Homo sapiens
gccagcctcaggc

SEQ ID NO: 5482165 - DNA, 13 bp, Homo sapiens
gccagcctcagtg

SEQ ID NO: 5482166 - DNA, 13 bp, Homo sapiens
gccagcctcctct

SEQ ID NO: 5482167 - DNA, 16 bp, Homo sapiens
gccagcctcctctgga

SEQ ID NO: 5482168 - DNA, 17 bp, Homo sapiens
gccagcctcctctggac

SEQ ID NO: 5482169 - DNA, 16 bp, Homo sapiens
gccagcctccttgctg

SEQ ID NO: 5482170 - DNA, 13 bp, Homo sapiens
gccagcctgacct

SEQ ID NO: 5482171 - DNA, 13 bp, Homo sapiens
gccagcctgagcg

SEQ ID NO: 5482172 - DNA, 21 bp, Homo sapiens
gccagcctgaggtgcccactc

SEQ ID NO: 5482173 - DNA, 21 bp, Homo sapiens
gccagcctgcttcccacaact

SEQ ID NO: 5482174 - DNA, 15 bp, Homo sapiens
gccagcctggcatca

SEQ ID NO: 5482175 - DNA, 14 bp, Homo sapiens
gccagcctggcctc

SEQ ID NO: 5482176 - DNA, 19 bp, Homo sapiens
gccagcctggcctcctgcc

SEQ ID NO: 5482177 - DNA, 12 bp, Homo sapiens
gccagcctggct

SEQ ID NO: 5482178 - DNA, 15 bp, Homo sapiens
gccagcctggctctg

SEQ ID NO: 5482179 - DNA, 18 bp, Homo sapiens
gccagcctggctctgccc

SEQ ID NO: 5482180 - DNA, 19 bp, Homo sapiens
gccagcctggcttctggag

SEQ ID NO: 5482181 - DNA, 21 bp, Homo sapiens
gccagcctggcttctggagcc

SEQ ID NO: 5482182 - DNA, 16 bp, Homo sapiens
gccagcctggggcctg

SEQ ID NO: 5482183 - DNA, 17 bp, Homo sapiens
gccagcctggggcctgg

SEQ ID NO: 5482184 - DNA, 18 bp, Homo sapiens
gccagcctggggcctggc

SEQ ID NO: 5482185 - DNA, 15 bp, Homo sapiens
gccagcctgtccctg

SEQ ID NO: 5482186 - DNA, 20 bp, Homo sapiens
gccagcctgtcgtgtccagc

SEQ ID NO: 5482187 - DNA, 21 bp, Homo sapiens
gccagccttgaccattctcca

SEQ ID NO: 5482188 - DNA, 18 bp, Homo sapiens
gccagccttgagccctgg

SEQ ID NO: 5482189 - DNA, 21 bp, Homo sapiens
gccagccttgtacagtctgct

SEQ ID NO: 5482190 - DNA, 16 bp, Homo sapiens
gccagcgaacttgaca

SEQ ID NO: 5482191 - DNA, 21 bp, Homo sapiens
gccagcgacctctctgcctct

SEQ ID NO: 5482192 - DNA, 22 bp, Homo sapiens
gccagcgagcgcccagctcctg

SEQ ID NO: 5482193 - DNA, 17 bp, Homo sapiens
gccagcgaggcgaggct

SEQ ID NO: 5482194 - DNA, 18 bp, Homo sapiens
gccagcgccagggcccag

SEQ ID NO: 5482195 - DNA, 23 bp, Homo sapiens
gccagcgccagggcccaggccat

SEQ ID NO: 5482196 - DNA, 19 bp, Homo sapiens
gccagcgcccctcagcctc

SEQ ID NO: 5482197 - DNA, 14 bp, Homo sapiens
gccagcgcctccct

SEQ ID NO: 5482198 - DNA, 17 bp, Homo sapiens
gccagcgcctccctcca

SEQ ID NO: 5482199 - DNA, 18 bp, Homo sapiens
gccagcgcctccctccac

SEQ ID NO: 5482200 - DNA, 14 bp, Homo sapiens
gccagcgctgaaca

SEQ ID NO: 5482201 - DNA, 14 bp, Homo sapiens
gccagcggccctcc

SEQ ID NO: 5482202 - DNA, 13 bp, Homo sapiens
gccagcggctcca

SEQ ID NO: 5482203 - DNA, 14 bp, Homo sapiens
gccagcgggcacag

SEQ ID NO: 5482204 - DNA, 16 bp, Homo sapiens
gccagcgggcacaggg

SEQ ID NO: 5482205 - DNA, 17 bp, Homo sapiens
gccagcgggcacagggc

SEQ ID NO: 5482206 - DNA, 19 bp, Homo sapiens
gccagcgggcacagggcac

SEQ ID NO: 5482207 - DNA, 16 bp, Homo sapiens
gccagcgggcccagca

SEQ ID NO: 5482208 - DNA, 15 bp, Homo sapiens
gccagcggggctgct

SEQ ID NO: 5482209 - DNA, 18 bp, Homo sapiens
gccagcggggctgctcac

SEQ ID NO: 5482210 - DNA, 15 bp, Homo sapiens
gccagcggtgaccag

SEQ ID NO: 5482211 - DNA, 17 bp, Homo sapiens
gccagcggtgaccagcc

SEQ ID NO: 5482212 - DNA, 21 bp, Homo sapiens
gccagcggtgaccagcctgtc

SEQ ID NO: 5482213 - DNA, 17 bp, Homo sapiens
gccagcggtttcctggt

SEQ ID NO: 5482214 - DNA, 15 bp, Homo sapiens
gccagcgtcccaggg

SEQ ID NO: 5482215 - DNA, 16 bp, Homo sapiens
gccagcgtcccagggt

SEQ ID NO: 5482216 - DNA, 13 bp, Homo sapiens
gccagcgtcctcc

SEQ ID NO: 5482217 - DNA, 18 bp, Homo sapiens
gccagcgtcggtctgtgc

SEQ ID NO: 5482218 - DNA, 17 bp, Homo sapiens
gccagcgtctgttgtgg

SEQ ID NO: 5482219 - DNA, 19 bp, Homo sapiens
gccagcgtgaaggacctgg

SEQ ID NO: 5482220 - DNA, 14 bp, Homo sapiens
gccagcgtggcaac

SEQ ID NO: 5482221 - DNA, 14 bp, Homo sapiens
gccagcgtggcgca

SEQ ID NO: 5482222 - DNA, 16 bp, Homo sapiens
gccagcgtgtggagca

SEQ ID NO: 5482223 - DNA, 19 bp, Homo sapiens
gccagctaccccttgtggg

SEQ ID NO: 5482224 - DNA, 23 bp, Homo sapiens
gccagctagagcttccactgtca

SEQ ID NO: 5482225 - DNA, 17 bp, Homo sapiens
gccagctatctgcctga

SEQ ID NO: 5482226 - DNA, 20 bp, Homo sapiens
gccagctcagcagttcactt

SEQ ID NO: 5482227 - DNA, 12 bp, Homo sapiens
gccagctcagga

SEQ ID NO: 5482228 - DNA, 14 bp, Homo sapiens
gccagctccacagg

SEQ ID NO: 5482229 - DNA, 17 bp, Homo sapiens
gccagctccacagggtg

SEQ ID NO: 5482230 - DNA, 13 bp, Homo sapiens
gccagctccagtg

SEQ ID NO: 5482231 - DNA, 21 bp, Homo sapiens
gccagctccagtgccgctcct

SEQ ID NO: 5482232 - DNA, 16 bp, Homo sapiens
gccagctccatgttct

SEQ ID NO: 5482233 - DNA, 22 bp, Homo sapiens
gccagctcccccttgcccgcca

SEQ ID NO: 5482234 - DNA, 13 bp, Homo sapiens
gccagctccctct

SEQ ID NO: 5482235 - DNA, 18 bp, Homo sapiens
gccagctcctctctgaag

SEQ ID NO: 5482236 - DNA, 16 bp, Homo sapiens
gccagctccttagaca

SEQ ID NO: 5482237 - DNA, 13 bp, Homo sapiens
gccagctcctttc

SEQ ID NO: 5482238 - DNA, 22 bp, Homo sapiens
gccagctccttttctgtgaagc

SEQ ID NO: 5482239 - DNA, 13 bp, Homo sapiens
gccagctctaggc

SEQ ID NO: 5482240 - DNA, 14 bp, Homo sapiens
gccagctctcagcc

SEQ ID NO: 5482241 - DNA, 13 bp, Homo sapiens
gccagctctgagc

SEQ ID NO: 5482242 - DNA, 18 bp, Homo sapiens
gccagctctgagcagaca

SEQ ID NO: 5482243 - DNA, 20 bp, Homo sapiens
gccagctctgaggggaggca

SEQ ID NO: 5482244 - DNA, 15 bp, Homo sapiens
gccagctctgtatca

SEQ ID NO: 5482245 - DNA, 23 bp, Homo sapiens
gccagctctgtatcaggacccag

SEQ ID NO: 5482246 - DNA, 19 bp, Homo sapiens
gccagctctgtcaccctgg

SEQ ID NO: 5482247 - DNA, 21 bp, Homo sapiens
gccagctctgtcaccctggcc

SEQ ID NO: 5482248 - DNA, 13 bp, Homo sapiens
gccagctctgttc

SEQ ID NO: 5482249 - DNA, 23 bp, Homo sapiens
gccagctctgttcttcctcagcc

SEQ ID NO: 5482250 - DNA, 17 bp, Homo sapiens
gccagctcttcctagct

SEQ ID NO: 5482251 - DNA, 19 bp, Homo sapiens
gccagctcttcctagctgg

SEQ ID NO: 5482252 - DNA, 21 bp, Homo sapiens
gccagctcttcctagctggag

SEQ ID NO: 5482253 - DNA, 14 bp, Homo sapiens
gccagctgatgact

SEQ ID NO: 5482254 - DNA, 12 bp, Homo sapiens
gccagctgcaga

SEQ ID NO: 5482255 - DNA, 16 bp, Homo sapiens
gccagctgcagcctgg

SEQ ID NO: 5482256 - DNA, 23 bp, Homo sapiens
gccagctgcagggcacggggacc

SEQ ID NO: 5482257 - DNA, 14 bp, Homo sapiens
gccagctgcatcta

SEQ ID NO: 5482258 - DNA, 17 bp, Homo sapiens
gccagctgccccagcca

SEQ ID NO: 5482259 - DNA, 18 bp, Homo sapiens
gccagctgccccagccag

SEQ ID NO: 5482260 - DNA, 13 bp, Homo sapiens
gccagctgccctt

SEQ ID NO: 5482261 - DNA, 16 bp, Homo sapiens
gccagctgcccttgca

SEQ ID NO: 5482262 - DNA, 18 bp, Homo sapiens
gccagctgcccttgcagg

SEQ ID NO: 5482263 - DNA, 20 bp, Homo sapiens
gccagctgcccttgcagggt

SEQ ID NO: 5482264 - DNA, 22 bp, Homo sapiens
gccagctgcccttgcagggtgg

SEQ ID NO: 5482265 - DNA, 23 bp, Homo sapiens
gccagctgcccttgcagggtggg

SEQ ID NO: 5482266 - DNA, 15 bp, Homo sapiens
gccagctgccgacca

SEQ ID NO: 5482267 - DNA, 19 bp, Homo sapiens
gccagctgccgcaccagcc

SEQ ID NO: 5482268 - DNA, 23 bp, Homo sapiens
gccagctgcctgtgcctgccatg

SEQ ID NO: 5482269 - DNA, 15 bp, Homo sapiens
gccagctgctgagcc

SEQ ID NO: 5482270 - DNA, 16 bp, Homo sapiens
gccagctgctgagccg

SEQ ID NO: 5482271 - DNA, 15 bp, Homo sapiens
gccagctgcttctgc

SEQ ID NO: 5482272 - DNA, 20 bp, Homo sapiens
gccagctgcttctgcccacc

SEQ ID NO: 5482273 - DNA, 14 bp, Homo sapiens
gccagctgcttggg

SEQ ID NO: 5482274 - DNA, 16 bp, Homo sapiens
gccagctgcttgggct

SEQ ID NO: 5482275 - DNA, 19 bp, Homo sapiens
gccagctggatcgctgcac

SEQ ID NO: 5482276 - DNA, 14 bp, Homo sapiens
gccagctggcagca

SEQ ID NO: 5482277 - DNA, 18 bp, Homo sapiens
gccagctggcagcagagt

SEQ ID NO: 5482278 - DNA, 12 bp, Homo sapiens
gccagctggccc

SEQ ID NO: 5482279 - DNA, 17 bp, Homo sapiens
gccagctgggagcactg

SEQ ID NO: 5482280 - DNA, 16 bp, Homo sapiens
gccagctgggcccagc

SEQ ID NO: 5482281 - DNA, 17 bp, Homo sapiens
gccagctgggcccagca

SEQ ID NO: 5482282 - DNA, 16 bp, Homo sapiens
gccagctggggagatg

SEQ ID NO: 5482283 - DNA, 16 bp, Homo sapiens
gccagctgggtgcccc

SEQ ID NO: 5482284 - DNA, 22 bp, Homo sapiens
gccagctgggtgccccagggac

SEQ ID NO: 5482285 - DNA, 14 bp, Homo sapiens
gccagctggtgaat

SEQ ID NO: 5482286 - DNA, 17 bp, Homo sapiens
gccagctggtgaatcca

SEQ ID NO: 5482287 - DNA, 21 bp, Homo sapiens
gccagctggtgctgcaaggaa

SEQ ID NO: 5482288 - DNA, 12 bp, Homo sapiens
gccagctgtgca

SEQ ID NO: 5482289 - DNA, 20 bp, Homo sapiens
gccagctgtggttttctttt

SEQ ID NO: 5482290 - DNA, 20 bp, Homo sapiens
gccagcttaaacccatacaa

SEQ ID NO: 5482291 - DNA, 15 bp, Homo sapiens
gccagcttctcctgc

SEQ ID NO: 5482292 - DNA, 21 bp, Homo sapiens
gccagcttctcctgcgccccg

SEQ ID NO: 5482293 - DNA, 17 bp, Homo sapiens
gccagcttgtttacatg

SEQ ID NO: 5482294 - DNA, 20 bp, Homo sapiens
gccagcttgtttacatgctt

SEQ ID NO: 5482295 - DNA, 22 bp, Homo sapiens
gccaggaacagggaccagctcc

SEQ ID NO: 5482296 - DNA, 15 bp, Homo sapiens
gccaggaacctgtcc

SEQ ID NO: 5482297 - DNA, 11 bp, Homo sapiens
gccaggaactc

SEQ ID NO: 5482298 - DNA, 15 bp, Homo sapiens
gccaggaagccagca

SEQ ID NO: 5482299 - DNA, 20 bp, Homo sapiens
gccaggaagccagcaggctc

SEQ ID NO: 5482300 - DNA, 18 bp, Homo sapiens
gccaggaaggggacagga

SEQ ID NO: 5482301 - DNA, 17 bp, Homo sapiens
gccaggaagtacttcca

SEQ ID NO: 5482302 - DNA, 17 bp, Homo sapiens
gccaggaagtagcacag

SEQ ID NO: 5482303 - DNA, 21 bp, Homo sapiens
gccaggaagtagcacaggctg

SEQ ID NO: 5482304 - DNA, 16 bp, Homo sapiens
gccaggaatgtttcag

SEQ ID NO: 5482305 - DNA, 19 bp, Homo sapiens
gccaggaatttcccaggac

SEQ ID NO: 5482306 - DNA, 20 bp, Homo sapiens
gccaggaatttcccaggacc

SEQ ID NO: 5482307 - DNA, 14 bp, Homo sapiens
gccaggacacactg

SEQ ID NO: 5482308 - DNA, 15 bp, Homo sapiens
gccaggacaccgggc

SEQ ID NO: 5482309 - DNA, 12 bp, Homo sapiens
gccaggacacct

SEQ ID NO: 5482310 - DNA, 19 bp, Homo sapiens
gccaggacacctgccccag

SEQ ID NO: 5482311 - DNA, 22 bp, Homo sapiens
gccaggacacctgccccagcgc

SEQ ID NO: 5482312 - DNA, 16 bp, Homo sapiens
gccaggacagcagcac

SEQ ID NO: 5482313 - DNA, 14 bp, Homo sapiens
gccaggacagctgg

SEQ ID NO: 5482314 - DNA, 18 bp, Homo sapiens
gccaggacagctggctgc

SEQ ID NO: 5482315 - DNA, 23 bp, Homo sapiens
gccaggacagctggctgctgaca

SEQ ID NO: 5482316 - DNA, 14 bp, Homo sapiens
gccaggacaggccc

SEQ ID NO: 5482317 - DNA, 16 bp, Homo sapiens
gccaggacagtcagct

SEQ ID NO: 5482318 - DNA, 11 bp, Homo sapiens
gccaggaccac

SEQ ID NO: 5482319 - DNA, 13 bp, Homo sapiens
gccaggaccccaa

SEQ ID NO: 5482320 - DNA, 15 bp, Homo sapiens
gccaggaccccaggt

SEQ ID NO: 5482321 - DNA, 17 bp, Homo sapiens
gccaggacccgccagcc

SEQ ID NO: 5482322 - DNA, 18 bp, Homo sapiens
gccaggacccgccagccc

SEQ ID NO: 5482323 - DNA, 19 bp, Homo sapiens
gccaggacccgcctgctcc

SEQ ID NO: 5482324 - DNA, 20 bp, Homo sapiens
gccaggacccgcctgctccc

SEQ ID NO: 5482325 - DNA, 22 bp, Homo sapiens
gccaggacccgcctgctcccat

SEQ ID NO: 5482326 - DNA, 15 bp, Homo sapiens
gccaggactcccaga

SEQ ID NO: 5482327 - DNA, 16 bp, Homo sapiens
gccaggactcccagaa

SEQ ID NO: 5482328 - DNA, 17 bp, Homo sapiens
gccaggactccttagac

SEQ ID NO: 5482329 - DNA, 14 bp, Homo sapiens
gccaggactctgca

SEQ ID NO: 5482330 - DNA, 15 bp, Homo sapiens
gccaggactctgcag

SEQ ID NO: 5482331 - DNA, 16 bp, Homo sapiens
gccaggactctgcagc

SEQ ID NO: 5482332 - DNA, 18 bp, Homo sapiens
gccaggactctgcagcct

SEQ ID NO: 5482333 - DNA, 20 bp, Homo sapiens
gccaggactctgcagcctca

SEQ ID NO: 5482334 - DNA, 13 bp, Homo sapiens
gccaggactgtga

SEQ ID NO: 5482335 - DNA, 14 bp, Homo sapiens
gccaggactgtgtt

SEQ ID NO: 5482336 - DNA, 22 bp, Homo sapiens
gccaggagaagacccctgccca

SEQ ID NO: 5482337 - DNA, 12 bp, Homo sapiens
gccaggagaagc

SEQ ID NO: 5482338 - DNA, 15 bp, Homo sapiens
gccaggagaagctca

SEQ ID NO: 5482339 - DNA, 22 bp, Homo sapiens
gccagggaccccagaatcatgt

SEQ ID NO: 5482340 - DNA, 16 bp, Homo sapiens
gccagggacccccaga

SEQ ID NO: 5482341 - DNA, 15 bp, Homo sapiens
gccagggacccccga

SEQ ID NO: 5482342 - DNA, 18 bp, Homo sapiens
gccagggacccccgaggc

SEQ ID NO: 5482343 - DNA, 20 bp, Homo sapiens
gccagggacccccgaggccc

SEQ ID NO: 5482344 - DNA, 9 bp, Homo sapiens
gccagggag

SEQ ID NO: 5482345 - DNA, 22 bp, Homo sapiens
gccagggagacctggacacagg

SEQ ID NO: 5482346 - DNA, 19 bp, Homo sapiens
gccagggagactttctgaa

SEQ ID NO: 5482347 - DNA, 13 bp, Homo sapiens
gccagggagagcc

SEQ ID NO: 5482348 - DNA, 17 bp, Homo sapiens
gccagggagagcccagg

SEQ ID NO: 5482349 - DNA, 19 bp, Homo sapiens
gccagggagagcccaggag

SEQ ID NO: 5482350 - DNA, 19 bp, Homo sapiens
gccagggagcttgccacac

SEQ ID NO: 5482351 - DNA, 22 bp, Homo sapiens
gccagggagcttgccacactct

SEQ ID NO: 5482352 - DNA, 15 bp, Homo sapiens
gccagggaggagccc

SEQ ID NO: 5482353 - DNA, 24 bp, Homo sapiens
gccagggaggagccccagtggtga

SEQ ID NO: 5482354 - DNA, 11 bp, Homo sapiens
gccagggaggc

SEQ ID NO: 5482355 - DNA, 16 bp, Homo sapiens
gccagggaggcgcagg

SEQ ID NO: 5482356 - DNA, 18 bp, Homo sapiens
gccagggaggcgcaggga

SEQ ID NO: 5482357 - DNA, 19 bp, Homo sapiens
gccagggaggcgcagggac

SEQ ID NO: 5482358 - DNA, 22 bp, Homo sapiens
gccagggaggtggaaggaccct

SEQ ID NO: 5482359 - DNA, 15 bp, Homo sapiens
gccagggatggcagt

SEQ ID NO: 5482360 - DNA, 22 bp, Homo sapiens
gccagggatggcagtggctgtg

SEQ ID NO: 5482361 - DNA, 21 bp, Homo sapiens
gccagggatggggccacagcc

SEQ ID NO: 5482362 - DNA, 20 bp, Homo sapiens
gccagggattgaagtttatt

SEQ ID NO: 5482363 - DNA, 24 bp, Homo sapiens
gccagggcagcaagggacctgctc

SEQ ID NO: 5482364 - DNA, 16 bp, Homo sapiens
gccagggcaggctacc

SEQ ID NO: 5482365 - DNA, 15 bp, Homo sapiens
gccagggcagggcca

SEQ ID NO: 5482366 - DNA, 16 bp, Homo sapiens
gccagggcagggccac

SEQ ID NO: 5482367 - DNA, 14 bp, Homo sapiens
gccagggcagggtc

SEQ ID NO: 5482368 - DNA, 18 bp, Homo sapiens
gccagggcagtgctagtg

SEQ ID NO: 5482369 - DNA, 22 bp, Homo sapiens
gccagggccacgctccagctgc

SEQ ID NO: 5482370 - DNA, 16 bp, Homo sapiens
gccagggcccacccca

SEQ ID NO: 5482371 - DNA, 17 bp, Homo sapiens
gccagggcccaccccag

SEQ ID NO: 5482372 - DNA, 21 bp, Homo sapiens
gccagggcccaccccagcctc

SEQ ID NO: 5482373 - DNA, 12 bp, Homo sapiens
gccagggcccag

SEQ ID NO: 5482374 - DNA, 13 bp, Homo sapiens
gccagggcccaga

SEQ ID NO: 5482375 - DNA, 18 bp, Homo sapiens
gccagggcccagagccct

SEQ ID NO: 5482376 - DNA, 16 bp, Homo sapiens
gccagggcccaggcca

SEQ ID NO: 5482377 - DNA, 14 bp, Homo sapiens
gccagggcccctct

SEQ ID NO: 5482378 - DNA, 16 bp, Homo sapiens
gccagggcccctctcc

SEQ ID NO: 5482379 - DNA, 13 bp, Homo sapiens
gccagggcccctg

SEQ ID NO: 5482380 - DNA, 19 bp, Homo sapiens
gccagggcccctggatctc

SEQ ID NO: 5482381 - DNA, 13 bp, Homo sapiens
gccagggccctgc

SEQ ID NO: 5482382 - DNA, 16 bp, Homo sapiens
gccagggccctgcaga

SEQ ID NO: 5482383 - DNA, 19 bp, Homo sapiens
gccagggccctgcagaggg

SEQ ID NO: 5482384 - DNA, 16 bp, Homo sapiens
gccagggcctgcgagg

SEQ ID NO: 5482385 - DNA, 14 bp, Homo sapiens
gccagggcctggtg

SEQ ID NO: 5482386 - DNA, 16 bp, Homo sapiens
gccagggcctggtgtg

SEQ ID NO: 5482387 - DNA, 13 bp, Homo sapiens
gccagggcgcact

SEQ ID NO: 5482388 - DNA, 18 bp, Homo sapiens
gccagggctcaccagctg

SEQ ID NO: 5482389 - DNA, 16 bp, Homo sapiens
gccagggctcagatgg

SEQ ID NO: 5482390 - DNA, 21 bp, Homo sapiens
gccagggctcagatggggcct

SEQ ID NO: 5482391 - DNA, 23 bp, Homo sapiens
gccagggctcctgtggcagctgc

SEQ ID NO: 5482392 - DNA, 14 bp, Homo sapiens
gccagggctcgggc

SEQ ID NO: 5482393 - DNA, 19 bp, Homo sapiens
gccagggctctgggggcag

SEQ ID NO: 5482394 - DNA, 11 bp, Homo sapiens
gccagggctgc

SEQ ID NO: 5482395 - DNA, 18 bp, Homo sapiens
gccagggctgccctgaga

SEQ ID NO: 5482396 - DNA, 19 bp, Homo sapiens
gccagggctgccctgagaa

SEQ ID NO: 5482397 - DNA, 12 bp, Homo sapiens
gccagggctgga

SEQ ID NO: 5482398 - DNA, 22 bp, Homo sapiens
gccagggctggatggacagaca

SEQ ID NO: 5482399 - DNA, 14 bp, Homo sapiens
gccagggctgggga

SEQ ID NO: 5482400 - DNA, 21 bp, Homo sapiens
gccagggctggggacagaggg

SEQ ID NO: 5482401 - DNA, 14 bp, Homo sapiens
gccagggctgggtc

SEQ ID NO: 5482402 - DNA, 19 bp, Homo sapiens
gccagggctgggtcacagg

SEQ ID NO: 5482403 - DNA, 13 bp, Homo sapiens
gccagggctgtcc

SEQ ID NO: 5482404 - DNA, 12 bp, Homo sapiens
gccagggcttcc

SEQ ID NO: 5482405 - DNA, 23 bp, Homo sapiens
gccagggcttcctcttccgggca

SEQ ID NO: 5482406 - DNA, 14 bp, Homo sapiens
gccagggcttgtgg

SEQ ID NO: 5482407 - DNA, 23 bp, Homo sapiens
gccagggcttgtggactctctgc

SEQ ID NO: 5482408 - DNA, 17 bp, Homo sapiens
gccaggggaaaatcagc

SEQ ID NO: 5482409 - DNA, 22 bp, Homo sapiens
gccaggggaggttacaggtacc

SEQ ID NO: 5482410 - DNA, 23 bp, Homo sapiens
gccaggggattgtctcagggccg

SEQ ID NO: 5482411 - DNA, 19 bp, Homo sapiens
gccaggggcaggcagggct

SEQ ID NO: 5482412 - DNA, 17 bp, Homo sapiens
gccaggggccaggagtg

SEQ ID NO: 5482413 - DNA, 19 bp, Homo sapiens
gccaggggcgaggcccttc

SEQ ID NO: 5482414 - DNA, 14 bp, Homo sapiens
gccaggggcttccc

SEQ ID NO: 5482415 - DNA, 19 bp, Homo sapiens
gccaggggcttctccccct

SEQ ID NO: 5482416 - DNA, 19 bp, Homo sapiens
gccagggggactagcccct

SEQ ID NO: 5482417 - DNA, 21 bp, Homo sapiens
gccagggggactagcccctgt

SEQ ID NO: 5482418 - DNA, 20 bp, Homo sapiens
gccagggggagctgggcctg

SEQ ID NO: 5482419 - DNA, 15 bp, Homo sapiens
gccagggggatgcca

SEQ ID NO: 5482420 - DNA, 17 bp, Homo sapiens
gccagggggtttgagga

SEQ ID NO: 5482421 - DNA, 18 bp, Homo sapiens
gccaggggtctccctgga

SEQ ID NO: 5482422 - DNA, 13 bp, Homo sapiens
gccaggggtgctc

SEQ ID NO: 5482423 - DNA, 20 bp, Homo sapiens
gccagggtagacttggagct

SEQ ID NO: 5482424 - DNA, 17 bp, Homo sapiens
gccagggtcctgagtgg

SEQ ID NO: 5482425 - DNA, 17 bp, Homo sapiens
gccagggtctcactgag

SEQ ID NO: 5482426 - DNA, 19 bp, Homo sapiens
gccagggtctccagaaagc

SEQ ID NO: 5482427 - DNA, 22 bp, Homo sapiens
gccagggtctctccctcaggtg

SEQ ID NO: 5482428 - DNA, 20 bp, Homo sapiens
gccagggtctgtgtgaatgt

SEQ ID NO: 5482429 - DNA, 17 bp, Homo sapiens
gccagggtgagagctgc

SEQ ID NO: 5482430 - DNA, 19 bp, Homo sapiens
gccagggtgggaagagaag

SEQ ID NO: 5482431 - DNA, 22 bp, Homo sapiens
gccagggtgggaagagaagaaa

SEQ ID NO: 5482432 - DNA, 17 bp, Homo sapiens
gccagggtgggtgtcca

SEQ ID NO: 5482433 - DNA, 22 bp, Homo sapiens
gccagggtgtgactcgggagct

SEQ ID NO: 5482434 - DNA, 14 bp, Homo sapiens
gccagggtgtggcc

SEQ ID NO: 5482435 - DNA, 13 bp, Homo sapiens
gccagggttccag

SEQ ID NO: 5482436 - DNA, 21 bp, Homo sapiens
gccagggtttcgagaagctgc

SEQ ID NO: 5482437 - DNA, 19 bp, Homo sapiens
gccagggttttttggccta

SEQ ID NO: 5482438 - DNA, 14 bp, Homo sapiens
gccaggtactgcat

SEQ ID NO: 5482439 - DNA, 18 bp, Homo sapiens
gccaggtccccctgcagc

SEQ ID NO: 5482440 - DNA, 19 bp, Homo sapiens
gccaggtccccctgcagct

SEQ ID NO: 5482441 - DNA, 17 bp, Homo sapiens
gccaggtcctcacagca

SEQ ID NO: 5482442 - DNA, 18 bp, Homo sapiens
gccaggtcctcacagcag

SEQ ID NO: 5482443 - DNA, 19 bp, Homo sapiens
gccaggtctcctgggaaag

SEQ ID NO: 5482444 - DNA, 17 bp, Homo sapiens
gccaggtctgactccaa

SEQ ID NO: 5482445 - DNA, 18 bp, Homo sapiens
gccaggtctgactccaaa

SEQ ID NO: 5482446 - DNA, 20 bp, Homo sapiens
gccaggtctggcgccagggg

SEQ ID NO: 5482447 - DNA, 21 bp, Homo sapiens
gccaggtctggcgccaggggc

SEQ ID NO: 5482448 - DNA, 20 bp, Homo sapiens
gccaggtgaggtccaccggc

SEQ ID NO: 5482449 - DNA, 18 bp, Homo sapiens
gccaggtgcaaccaggga

SEQ ID NO: 5482450 - DNA, 21 bp, Homo sapiens
gccaggtgcaatctactggaa

SEQ ID NO: 5482451 - DNA, 19 bp, Homo sapiens
gccaggtgcagaccttggg

SEQ ID NO: 5482452 - DNA, 20 bp, Homo sapiens
gccaggtgcccgcgccaggc

SEQ ID NO: 5482453 - DNA, 16 bp, Homo sapiens
gccaggtgcctcctga

SEQ ID NO: 5482454 - DNA, 16 bp, Homo sapiens
gccaggtgccttggag

SEQ ID NO: 5482455 - DNA, 16 bp, Homo sapiens
gccaggtggcacctgc

SEQ ID NO: 5482456 - DNA, 17 bp, Homo sapiens
gccaggtggcacctgca

SEQ ID NO: 5482457 - DNA, 14 bp, Homo sapiens
gccaggtgggcgga

SEQ ID NO: 5482458 - DNA, 15 bp, Homo sapiens
gccaggtgggcggac

SEQ ID NO: 5482459 - DNA, 18 bp, Homo sapiens
gccaggttatgcctcatg

SEQ ID NO: 5482460 - DNA, 22 bp, Homo sapiens
gccaggttcacactcagaaaga

SEQ ID NO: 5482461 - DNA, 20 bp, Homo sapiens
gccaggttctatttggaatt

SEQ ID NO: 5482462 - DNA, 15 bp, Homo sapiens
gccaggttgcagctg

SEQ ID NO: 5482463 - DNA, 17 bp, Homo sapiens
gccaggttgcagctgct

SEQ ID NO: 5482464 - DNA, 23 bp, Homo sapiens
gccaggttgttttatagaggttc

SEQ ID NO: 5482465 - DNA, 19 bp, Homo sapiens
gccaggttttctgggtgtc

SEQ ID NO: 5482466 - DNA, 21 bp, Homo sapiens
gccagtaaaaaaaaaaaatgg

SEQ ID NO: 5482467 - DNA, 15 bp, Homo sapiens
gccagtaaaagtata

SEQ ID NO: 5482468 - DNA, 23 bp, Homo sapiens
gccagtaaatgggggtgcatttg

SEQ ID NO: 5482469 - DNA, 19 bp, Homo sapiens
gccagtaacgcgtcttcct

SEQ ID NO: 5482470 - DNA, 21 bp, Homo sapiens
gccagtaacgcgtcttcctga

SEQ ID NO: 5482471 - DNA, 20 bp, Homo sapiens
gccagtaaggcagctctgtc

SEQ ID NO: 5482472 - DNA, 23 bp, Homo sapiens
gccagtaagggaaatagaaaaac

SEQ ID NO: 5482473 - DNA, 21 bp, Homo sapiens
gccagtagctgccaaaaagaa

SEQ ID NO: 5482474 - DNA, 16 bp, Homo sapiens
gccagtaggagaaatc

SEQ ID NO: 5482475 - DNA, 12 bp, Homo sapiens
gccagtatttct

SEQ ID NO: 5482476 - DNA, 17 bp, Homo sapiens
gccagtattttaaaata

SEQ ID NO: 5482477 - DNA, 17 bp, Homo sapiens
gccagtatttttaaagg

SEQ ID NO: 5482478 - DNA, 21 bp, Homo sapiens
gccagtcaacggggggctcct

SEQ ID NO: 5482479 - DNA, 22 bp, Homo sapiens
gccagtcaacggggggctcctg

SEQ ID NO: 5482480 - DNA, 17 bp, Homo sapiens
gccagtcaagaagaaaa

SEQ ID NO: 5482481 - DNA, 17 bp, Homo sapiens
gccagtcaccttctggg

SEQ ID NO: 5482482 - DNA, 17 bp, Homo sapiens
gccagtcactccgtttt

SEQ ID NO: 5482483 - DNA, 13 bp, Homo sapiens
gccagtcactgct

SEQ ID NO: 5482484 - DNA, 18 bp, Homo sapiens
gccagtcatcatctcttg

SEQ ID NO: 5482485 - DNA, 15 bp, Homo sapiens
gccagtcatggtggc

SEQ ID NO: 5482486 - DNA, 13 bp, Homo sapiens
gccagtccaggct

SEQ ID NO: 5482487 - DNA, 14 bp, Homo sapiens
gccagtccaggctg

SEQ ID NO: 5482488 - DNA, 21 bp, Homo sapiens
gccagtccaggctgccgtggg

SEQ ID NO: 5482489 - DNA, 18 bp, Homo sapiens
gccagtcccacggctctg

SEQ ID NO: 5482490 - DNA, 22 bp, Homo sapiens
gccagtcccacggctctgtgcc

SEQ ID NO: 5482491 - DNA, 16 bp, Homo sapiens
gccagtcccaggggca

SEQ ID NO: 5482492 - DNA, 12 bp, Homo sapiens
gccagtccccat

SEQ ID NO: 5482493 - DNA, 20 bp, Homo sapiens
gccagtccccatttctgcct

SEQ ID NO: 5482494 - DNA, 23 bp, Homo sapiens
gccagtccccatttctgcctcgc

SEQ ID NO: 5482495 - DNA, 14 bp, Homo sapiens
gccagtccccgcta

SEQ ID NO: 5482496 - DNA, 15 bp, Homo sapiens
gccagtcctagagct

SEQ ID NO: 5482497 - DNA, 23 bp, Homo sapiens
gccagtcctagagctcctgtccc

SEQ ID NO: 5482498 - DNA, 15 bp, Homo sapiens
gccagtcctcctggg

SEQ ID NO: 5482499 - DNA, 16 bp, Homo sapiens
gccagtcctcctggga

SEQ ID NO: 5482500 - DNA, 21 bp, Homo sapiens
gccagtcctcctgggagcccc

SEQ ID NO: 5482501 - DNA, 16 bp, Homo sapiens
gccagtcctgcctggc

SEQ ID NO: 5482502 - DNA, 18 bp, Homo sapiens
gccagtcctggtcctggc

SEQ ID NO: 5482503 - DNA, 14 bp, Homo sapiens
gccagtcctgtcct

SEQ ID NO: 5482504 - DNA, 15 bp, Homo sapiens
gccagtcgcgctgcc

SEQ ID NO: 5482505 - DNA, 15 bp, Homo sapiens
gccagtctagttcct

SEQ ID NO: 5482506 - DNA, 15 bp, Homo sapiens
gccagtctcagagac

SEQ ID NO: 5482507 - DNA, 19 bp, Homo sapiens
gccagtctcagagaccagc

SEQ ID NO: 5482508 - DNA, 20 bp, Homo sapiens
gccagtctcagagaccagca

SEQ ID NO: 5482509 - DNA, 22 bp, Homo sapiens
gccagtctcagagaccagcact

SEQ ID NO: 5482510 - DNA, 14 bp, Homo sapiens
gccagtctcccagg

SEQ ID NO: 5482511 - DNA, 15 bp, Homo sapiens
gccagtctcccaggc

SEQ ID NO: 5482512 - DNA, 23 bp, Homo sapiens
gccagtctgggtctgggtttgga

SEQ ID NO: 5482513 - DNA, 20 bp, Homo sapiens
gccagtcttccagaaagcaa

SEQ ID NO: 5482514 - DNA, 13 bp, Homo sapiens
gccagtcttcctc

SEQ ID NO: 5482515 - DNA, 20 bp, Homo sapiens
gccagtcttgacgagtgtga

SEQ ID NO: 5482516 - DNA, 21 bp, Homo sapiens
gccatgctcaacccccctccc

SEQ ID NO: 5482517 - DNA, 20 bp, Homo sapiens
gccatgctcctcttccccag

SEQ ID NO: 5482518 - DNA, 14 bp, Homo sapiens
gccatgctcctggc

SEQ ID NO: 5482519 - DNA, 17 bp, Homo sapiens
gccatgctgaggcctgg

SEQ ID NO: 5482520 - DNA, 19 bp, Homo sapiens
gccatgctgaggcctgggc

SEQ ID NO: 5482521 - DNA, 13 bp, Homo sapiens
gccatgctgggcc

SEQ ID NO: 5482522 - DNA, 17 bp, Homo sapiens
gccatgctgggccactg

SEQ ID NO: 5482523 - DNA, 22 bp, Homo sapiens
gccatgctgggccactggggac

SEQ ID NO: 5482524 - DNA, 16 bp, Homo sapiens
gccatgctgtccctgc

SEQ ID NO: 5482525 - DNA, 18 bp, Homo sapiens
gccatgctgtccctgcac

SEQ ID NO: 5482526 - DNA, 18 bp, Homo sapiens
gccatgcttcttgcccct

SEQ ID NO: 5482527 - DNA, 19 bp, Homo sapiens
gccatgcttcttgcccctt

SEQ ID NO: 5482528 - DNA, 18 bp, Homo sapiens
gccatgctttccttttct

SEQ ID NO: 5482529 - DNA, 16 bp, Homo sapiens
gccatggaagctggca

SEQ ID NO: 5482530 - DNA, 23 bp, Homo sapiens
gccatggaagctggcaggagaca

SEQ ID NO: 5482531 - DNA, 23 bp, Homo sapiens
gccatggaaggtgccagaaggaa

SEQ ID NO: 5482532 - DNA, 19 bp, Homo sapiens
gccatggaattccctcctg

SEQ ID NO: 5482533 - DNA, 21 bp, Homo sapiens
gccatggaattccctcctgag

SEQ ID NO: 5482534 - DNA, 18 bp, Homo sapiens
gccatggacagaagaagg

SEQ ID NO: 5482535 - DNA, 22 bp, Homo sapiens
gccatggacatgagtttaaagc

SEQ ID NO: 5482536 - DNA, 18 bp, Homo sapiens
gccatggactctacactg

SEQ ID NO: 5482537 - DNA, 22 bp, Homo sapiens
gccatggactctacactgtgaa

SEQ ID NO: 5482538 - DNA, 18 bp, Homo sapiens
gccatggactctgtcctg

SEQ ID NO: 5482539 - DNA, 19 bp, Homo sapiens
gccatggactctgtcctga

SEQ ID NO: 5482540 - DNA, 14 bp, Homo sapiens
gccatggagaaagc

SEQ ID NO: 5482541 - DNA, 15 bp, Homo sapiens
gccatggagaaagct

SEQ ID NO: 5482542 - DNA, 20 bp, Homo sapiens
gccatggagaaagctgactt

SEQ ID NO: 5482543 - DNA, 22 bp, Homo sapiens
gccatggagaaagctgacttgg

SEQ ID NO: 5482544 - DNA, 18 bp, Homo sapiens
gccatggagagctggagc

SEQ ID NO: 5482545 - DNA, 15 bp, Homo sapiens
gccatggaggcacac

SEQ ID NO: 5482546 - DNA, 16 bp, Homo sapiens
gccatggaggcacaca

SEQ ID NO: 5482547 - DNA, 20 bp, Homo sapiens
gccatggagtgagacccagg

SEQ ID NO: 5482548 - DNA, 13 bp, Homo sapiens
gccatggagttgt

SEQ ID NO: 5482549 - DNA, 23 bp, Homo sapiens
gccatggatggaaaacgctctct

SEQ ID NO: 5482550 - DNA, 14 bp, Homo sapiens
gccatggccaaggg

SEQ ID NO: 5482551 - DNA, 21 bp, Homo sapiens
gccatggccccccactccccc

SEQ ID NO: 5482552 - DNA, 22 bp, Homo sapiens
gccatggccccccactccccct

SEQ ID NO: 5482553 - DNA, 16 bp, Homo sapiens
gccatggccctgagcc

SEQ ID NO: 5482554 - DNA, 12 bp, Homo sapiens
gccatggcctct

SEQ ID NO: 5482555 - DNA, 14 bp, Homo sapiens
gccatggcctctgc

SEQ ID NO: 5482556 - DNA, 17 bp, Homo sapiens
gccatggcctgcaaact

SEQ ID NO: 5482557 - DNA, 21 bp, Homo sapiens
gccatggcgagatactgcatg

SEQ ID NO: 5482558 - DNA, 16 bp, Homo sapiens
gccatggcgtgtccct

SEQ ID NO: 5482559 - DNA, 22 bp, Homo sapiens
gccatggcgtgtccctctcgga

SEQ ID NO: 5482560 - DNA, 17 bp, Homo sapiens
gccatggctcaggcaag

SEQ ID NO: 5482561 - DNA, 22 bp, Homo sapiens
gccatggctcaggcaagcccct

SEQ ID NO: 5482562 - DNA, 23 bp, Homo sapiens
gccatggctcagggtggtctctt

SEQ ID NO: 5482563 - DNA, 13 bp, Homo sapiens
gccatggctgctt

SEQ ID NO: 5482564 - DNA, 12 bp, Homo sapiens
gccatggctgga

SEQ ID NO: 5482565 - DNA, 22 bp, Homo sapiens
gccatggctggatgtgcatctg

SEQ ID NO: 5482566 - DNA, 15 bp, Homo sapiens
gccatggctgggggg

SEQ ID NO: 5482567 - DNA, 20 bp, Homo sapiens
gccatggctgtctcaaacca

SEQ ID NO: 5482568 - DNA, 20 bp, Homo sapiens
gccatggctttcatcctgtg

SEQ ID NO: 5482569 - DNA, 23 bp, Homo sapiens
gccatggctttcatcctgtgtcc

SEQ ID NO: 5482570 - DNA, 18 bp, Homo sapiens
gccatgggaaatgagcca

SEQ ID NO: 5482571 - DNA, 19 bp, Homo sapiens
gccatgggaaatgagccag

SEQ ID NO: 5482572 - DNA, 20 bp, Homo sapiens
gccatgggaaatgagccagc

SEQ ID NO: 5482573 - DNA, 18 bp, Homo sapiens
gccatgggagagtccagg

SEQ ID NO: 5482574 - DNA, 19 bp, Homo sapiens
gccatgggagagtccaggc

SEQ ID NO: 5482575 - DNA, 21 bp, Homo sapiens
gccatgggagagtccaggcct

SEQ ID NO: 5482576 - DNA, 21 bp, Homo sapiens
gccatgggcacaaagggccca

SEQ ID NO: 5482577 - DNA, 13 bp, Homo sapiens
gccatgggccagc

SEQ ID NO: 5482578 - DNA, 14 bp, Homo sapiens
gccatgggccagcc

SEQ ID NO: 5482579 - DNA, 18 bp, Homo sapiens
gccatgggccagcctagc

SEQ ID NO: 5482580 - DNA, 14 bp, Homo sapiens
gccatgggcctggg

SEQ ID NO: 5482581 - DNA, 20 bp, Homo sapiens
gccatgggcctgggcctgct

SEQ ID NO: 5482582 - DNA, 21 bp, Homo sapiens
gccatgggcctgggcctgctt

SEQ ID NO: 5482583 - DNA, 15 bp, Homo sapiens
gccatggggccctcc

SEQ ID NO: 5482584 - DNA, 17 bp, Homo sapiens
gccatggggccctccca

SEQ ID NO: 5482585 - DNA, 20 bp, Homo sapiens
gccatgggggcccctcggca

SEQ ID NO: 5482586 - DNA, 14 bp, Homo sapiens
gccatggggtaggg

SEQ ID NO: 5482587 - DNA, 19 bp, Homo sapiens
gccatggggtcggctcctg

SEQ ID NO: 5482588 - DNA, 17 bp, Homo sapiens
gccatgggtagcctggg

SEQ ID NO: 5482589 - DNA, 16 bp, Homo sapiens
gccatgggtcctcggc

SEQ ID NO: 5482590 - DNA, 17 bp, Homo sapiens
gccatgggtcctcggcc

SEQ ID NO: 5482591 - DNA, 16 bp, Homo sapiens
gccatggtaatcagaa

SEQ ID NO: 5482592 - DNA, 16 bp, Homo sapiens
gccatggtaccccctt

SEQ ID NO: 5482593 - DNA, 20 bp, Homo sapiens
gccatggtacccccttctgg

SEQ ID NO: 5482594 - DNA, 17 bp, Homo sapiens
gccatggtgacacacag

SEQ ID NO: 5482595 - DNA, 18 bp, Homo sapiens
gccatggtgacacacagc

SEQ ID NO: 5482596 - DNA, 17 bp, Homo sapiens
gccatggtgagaaaaat

SEQ ID NO: 5482597 - DNA, 15 bp, Homo sapiens
gccatggtggagggc

SEQ ID NO: 5482598 - DNA, 17 bp, Homo sapiens
gccatggtggagggcac

SEQ ID NO: 5482599 - DNA, 20 bp, Homo sapiens
gccatggtgttggaggggca

SEQ ID NO: 5482600 - DNA, 22 bp, Homo sapiens
gccatggtgttggaggggcagg

SEQ ID NO: 5482601 - DNA, 21 bp, Homo sapiens
gccatgtaaatccccactggg

SEQ ID NO: 5482602 - DNA, 22 bp, Homo sapiens
gccatgtaaatccccactggga

SEQ ID NO: 5482603 - DNA, 23 bp, Homo sapiens
gccatgtaaggttgtgcagggtg

SEQ ID NO: 5482604 - DNA, 15 bp, Homo sapiens
gccatgtacctcccc

SEQ ID NO: 5482605 - DNA, 17 bp, Homo sapiens
gccatgtactagtttta

SEQ ID NO: 5482606 - DNA, 15 bp, Homo sapiens
gccatgtagaagctg

SEQ ID NO: 5482607 - DNA, 23 bp, Homo sapiens
gccatgtagccacccaactttgt

SEQ ID NO: 5482608 - DNA, 20 bp, Homo sapiens
gccatgtattatgaaaaaga

SEQ ID NO: 5482609 - DNA, 22 bp, Homo sapiens
gccatgtatttcagggacctca

SEQ ID NO: 5482610 - DNA, 14 bp, Homo sapiens
gccatgtcacctgg

SEQ ID NO: 5482611 - DNA, 14 bp, Homo sapiens
gccatgtcagacac

SEQ ID NO: 5482612 - DNA, 20 bp, Homo sapiens
gccatgtcgccaaaaataca

SEQ ID NO: 5482613 - DNA, 19 bp, Homo sapiens
gccatgtcgcctgccccca

SEQ ID NO: 5482614 - DNA, 12 bp, Homo sapiens
gccatgtctaca

SEQ ID NO: 5482615 - DNA, 15 bp, Homo sapiens
gccatgtctcctgca

SEQ ID NO: 5482616 - DNA, 12 bp, Homo sapiens
gccatgtctgag

SEQ ID NO: 5482617 - DNA, 16 bp, Homo sapiens
gccatgtctgtgctgt

SEQ ID NO: 5482618 - DNA, 14 bp, Homo sapiens
gccatgtcttctcc

SEQ ID NO: 5482619 - DNA, 15 bp, Homo sapiens
gccatgtgaagaggg

SEQ ID NO: 5482620 - DNA, 20 bp, Homo sapiens
gccatgtgagccaccgctgc

SEQ ID NO: 5482621 - DNA, 17 bp, Homo sapiens
gccatgtgcaccttggg

SEQ ID NO: 5482622 - DNA, 12 bp, Homo sapiens
gccatgtgcata

SEQ ID NO: 5482623 - DNA, 14 bp, Homo sapiens
gccatgtgccaggt

SEQ ID NO: 5482624 - DNA, 22 bp, Homo sapiens
gccatgtgctagtaattggaaa

SEQ ID NO: 5482625 - DNA, 13 bp, Homo sapiens
gccatgtgctgcc

SEQ ID NO: 5482626 - DNA, 14 bp, Homo sapiens
gccatgtgctgccc

SEQ ID NO: 5482627 - DNA, 15 bp, Homo sapiens
gccatgtgctgtgca

SEQ ID NO: 5482628 - DNA, 18 bp, Homo sapiens
gccatgtgctgtgcaccc

SEQ ID NO: 5482629 - DNA, 17 bp, Homo sapiens
gccatgtggcctgccca

SEQ ID NO: 5482630 - DNA, 18 bp, Homo sapiens
gccatgtggcctgcccag

SEQ ID NO: 5482631 - DNA, 19 bp, Homo sapiens
gccatgtggcctgcccagc

SEQ ID NO: 5482632 - DNA, 16 bp, Homo sapiens
gccatgtgtcatgtaa

SEQ ID NO: 5482633 - DNA, 18 bp, Homo sapiens
gccatgtgtgtcagccca

SEQ ID NO: 5482634 - DNA, 23 bp, Homo sapiens
gccatgttaaatgacttgattgt

SEQ ID NO: 5482635 - DNA, 20 bp, Homo sapiens
gccatgttccaataaacagg

SEQ ID NO: 5482636 - DNA, 14 bp, Homo sapiens
gccatgttcccaga

SEQ ID NO: 5482637 - DNA, 15 bp, Homo sapiens
gccatgttcccagaa

SEQ ID NO: 5482638 - DNA, 15 bp, Homo sapiens
gccatgttgcccctt

SEQ ID NO: 5482639 - DNA, 14 bp, Homo sapiens
gccatgttggccag

SEQ ID NO: 5482640 - DNA, 15 bp, Homo sapiens
gccatgttggccagg

SEQ ID NO: 5482641 - DNA, 18 bp, Homo sapiens
gccatgttggccaggctg

SEQ ID NO: 5482642 - DNA, 24 bp, Homo sapiens
gccatgttggccaggctggtctca

SEQ ID NO: 5482643 - DNA, 21 bp, Homo sapiens
gccatgttgtgcctccctggt

SEQ ID NO: 5482644 - DNA, 14 bp, Homo sapiens
gccatgtttagtga

SEQ ID NO: 5482645 - DNA, 23 bp, Homo sapiens
gccatgtttagtgaatgactttt

SEQ ID NO: 5482646 - DNA, 11 bp, Homo sapiens
gccatgtttat

SEQ ID NO: 5482647 - DNA, 19 bp, Homo sapiens
gccattaaaaaacagcttg

SEQ ID NO: 5482648 - DNA, 14 bp, Homo sapiens
gccattaaaataaa

SEQ ID NO: 5482649 - DNA, 16 bp, Homo sapiens
gccattaaaataaaac

SEQ ID NO: 5482650 - DNA, 14 bp, Homo sapiens
gccattaacaaatg

SEQ ID NO: 5482651 - DNA, 13 bp, Homo sapiens
gccattaccccat

SEQ ID NO: 5482652 - DNA, 14 bp, Homo sapiens
gccattaccccata

SEQ ID NO: 5482653 - DNA, 22 bp, Homo sapiens
gccattagactgaatttaacta

SEQ ID NO: 5482654 - DNA, 14 bp, Homo sapiens
gccattagccaagg

SEQ ID NO: 5482655 - DNA, 14 bp, Homo sapiens
gccattataatttt

SEQ ID NO: 5482656 - DNA, 22 bp, Homo sapiens
gccattatatttgcattatgta

SEQ ID NO: 5482657 - DNA, 21 bp, Homo sapiens
gccattatctgtattaatgct

SEQ ID NO: 5482658 - DNA, 14 bp, Homo sapiens
gccattattctatg

SEQ ID NO: 5482659 - DNA, 20 bp, Homo sapiens
gccattattttctgtcagat

SEQ ID NO: 5482660 - DNA, 18 bp, Homo sapiens
gccattatttttgtagtt

SEQ ID NO: 5482661 - DNA, 22 bp, Homo sapiens
gccattcagtctatgctgtgtg

SEQ ID NO: 5482662 - DNA, 18 bp, Homo sapiens
gccattcatctgggctgg

SEQ ID NO: 5482663 - DNA, 19 bp, Homo sapiens
gccattcatgtatgtcaga

SEQ ID NO: 5482664 - DNA, 22 bp, Homo sapiens
gccattcatttacaacttccag

SEQ ID NO: 5482665 - DNA, 14 bp, Homo sapiens
gccattccactcca

SEQ ID NO: 5482666 - DNA, 12 bp, Homo sapiens
gccattccctgt

SEQ ID NO: 5482667 - DNA, 16 bp, Homo sapiens
gccattccgaccttca

SEQ ID NO: 5482668 - DNA, 20 bp, Homo sapiens
gccattcctggtacccagcc

SEQ ID NO: 5482669 - DNA, 15 bp, Homo sapiens
gccattctccccctc

SEQ ID NO: 5482670 - DNA, 15 bp, Homo sapiens
gccattctcctgcct

SEQ ID NO: 5482671 - DNA, 16 bp, Homo sapiens
gccattctcctgcctc

SEQ ID NO: 5482672 - DNA, 17 bp, Homo sapiens
gccattctcctgcctca

SEQ ID NO: 5482673 - DNA, 23 bp, Homo sapiens
gccattctcctgcctcagccttc

SEQ ID NO: 5482674 - DNA, 18 bp, Homo sapiens
gccattctcttgcattgt

SEQ ID NO: 5482675 - DNA, 17 bp, Homo sapiens
gccattctgactcatat

SEQ ID NO: 5482676 - DNA, 19 bp, Homo sapiens
gccattctgattggacctg

SEQ ID NO: 5482677 - DNA, 22 bp, Homo sapiens
gccattctgattggacctggcc

SEQ ID NO: 5482678 - DNA, 13 bp, Homo sapiens
gccattctgcctc

SEQ ID NO: 5482679 - DNA, 15 bp, Homo sapiens
gccattctggcactt

SEQ ID NO: 5482680 - DNA, 22 bp, Homo sapiens
gccattctggcactttaatgat

SEQ ID NO: 5482681 - DNA, 16 bp, Homo sapiens
gccattctgtgcaggc

SEQ ID NO: 5482682 - DNA, 12 bp, Homo sapiens
gccattcttcag

SEQ ID NO: 5482683 - DNA, 20 bp, Homo sapiens
gccattcttctggtgctact

SEQ ID NO: 5482684 - DNA, 12 bp, Homo sapiens
gccattctttcc

SEQ ID NO: 5482685 - DNA, 18 bp, Homo sapiens
gccattgaacactgcacc

SEQ ID NO: 5482686 - DNA, 17 bp, Homo sapiens
gccattgacttcttccc

SEQ ID NO: 5482687 - DNA, 21 bp, Homo sapiens
gccattgcacccagcccagat

SEQ ID NO: 5482688 - DNA, 17 bp, Homo sapiens
gccattgccaccaggag

SEQ ID NO: 5482689 - DNA, 19 bp, Homo sapiens
gccattgccaccaggagaa

SEQ ID NO: 5482690 - DNA, 23 bp, Homo sapiens
gccattgccaggagatggcccca

SEQ ID NO: 5482691 - DNA, 16 bp, Homo sapiens
gccattgcggccccag

SEQ ID NO: 5482692 - DNA, 18 bp, Homo sapiens
gccattgcttctccctca

SEQ ID NO: 5482693 - DNA, 19 bp, Homo sapiens
gcccacaactcccttgcac

SEQ ID NO: 5482694 - DNA, 20 bp, Homo sapiens
gcccacaacttgtcacccaa

SEQ ID NO: 5482695 - DNA, 22 bp, Homo sapiens
gcccacaacttgtcacccaaag

SEQ ID NO: 5482696 - DNA, 20 bp, Homo sapiens
gcccacaagccttactcacc

SEQ ID NO: 5482697 - DNA, 23 bp, Homo sapiens
gcccacaagccttactcacctct

SEQ ID NO: 5482698 - DNA, 19 bp, Homo sapiens
gcccacaataatgaataat

SEQ ID NO: 5482699 - DNA, 22 bp, Homo sapiens
gcccacaatccctttctaagga

SEQ ID NO: 5482700 - DNA, 14 bp, Homo sapiens
gcccacacacactc

SEQ ID NO: 5482701 - DNA, 17 bp, Homo sapiens
gcccacacacactcctt

SEQ ID NO: 5482702 - DNA, 20 bp, Homo sapiens
gcccacacacactccttccc

SEQ ID NO: 5482703 - DNA, 21 bp, Homo sapiens
gcccacaccaccgccctcctc

SEQ ID NO: 5482704 - DNA, 22 bp, Homo sapiens
gcccacaccagggcctggctgg

SEQ ID NO: 5482705 - DNA, 18 bp, Homo sapiens
gcccacaccatctggccc

SEQ ID NO: 5482706 - DNA, 23 bp, Homo sapiens
gcccacacccagctactttaaca

SEQ ID NO: 5482707 - DNA, 13 bp, Homo sapiens
gcccacaccccct

SEQ ID NO: 5482708 - DNA, 13 bp, Homo sapiens
gcccacacccctc

SEQ ID NO: 5482709 - DNA, 14 bp, Homo sapiens
gcccacacccctcc

SEQ ID NO: 5482710 - DNA, 18 bp, Homo sapiens
gcccacacctcctggggc

SEQ ID NO: 5482711 - DNA, 15 bp, Homo sapiens
gcccacacctgcctc

SEQ ID NO: 5482712 - DNA, 12 bp, Homo sapiens
gcccacacctgg

SEQ ID NO: 5482713 - DNA, 16 bp, Homo sapiens
gcccacacgtgctctc

SEQ ID NO: 5482714 - DNA, 23 bp, Homo sapiens
gcccacactatgcacagagccca

SEQ ID NO: 5482715 - DNA, 11 bp, Homo sapiens
gcccacagagc

SEQ ID NO: 5482716 - DNA, 15 bp, Homo sapiens
gcccacagagcctgg

SEQ ID NO: 5482717 - DNA, 20 bp, Homo sapiens
gcccacagcacagctccctg

SEQ ID NO: 5482718 - DNA, 11 bp, Homo sapiens
gcccacagccc

SEQ ID NO: 5482719 - DNA, 16 bp, Homo sapiens
gcccacagcccccacc

SEQ ID NO: 5482720 - DNA, 17 bp, Homo sapiens
gcccacagcccccaccc

SEQ ID NO: 5482721 - DNA, 22 bp, Homo sapiens
gcccacagcccgcatgcagcag

SEQ ID NO: 5482722 - DNA, 19 bp, Homo sapiens
gcccacagcgagcctgtgc

SEQ ID NO: 5482723 - DNA, 20 bp, Homo sapiens
gcccacagcgagcctgtgcc

SEQ ID NO: 5482724 - DNA, 17 bp, Homo sapiens
gcccacagctcccaccc

SEQ ID NO: 5482725 - DNA, 14 bp, Homo sapiens
gcccacagctctgc

SEQ ID NO: 5482726 - DNA, 17 bp, Homo sapiens
gcccacagctctgctgg

SEQ ID NO: 5482727 - DNA, 19 bp, Homo sapiens
gcccacaggaagctcagcc

SEQ ID NO: 5482728 - DNA, 21 bp, Homo sapiens
gcccacaggaagctcagcctt

SEQ ID NO: 5482729 - DNA, 18 bp, Homo sapiens
gcccacaggagctccctt

SEQ ID NO: 5482730 - DNA, 24 bp, Homo sapiens
gcccacaggaggcaagcaagctct

SEQ ID NO: 5482731 - DNA, 13 bp, Homo sapiens
gcccacaggatca

SEQ ID NO: 5482732 - DNA, 22 bp, Homo sapiens
gcccacagggaacacattcctt

SEQ ID NO: 5482733 - DNA, 19 bp, Homo sapiens
gcccacagggaccaagaag

SEQ ID NO: 5482734 - DNA, 18 bp, Homo sapiens
gcccacagtgctcagttg

SEQ ID NO: 5482735 - DNA, 12 bp, Homo sapiens
gcccacatattc

SEQ ID NO: 5482736 - DNA, 15 bp, Homo sapiens
gcccacatccattcc

SEQ ID NO: 5482737 - DNA, 18 bp, Homo sapiens
gcccacatccattccaga

SEQ ID NO: 5482738 - DNA, 23 bp, Homo sapiens
gcccacatccggggccagctccg

SEQ ID NO: 5482739 - DNA, 16 bp, Homo sapiens
gcccacatcgggctca

SEQ ID NO: 5482740 - DNA, 13 bp, Homo sapiens
gcccacatgggac

SEQ ID NO: 5482741 - DNA, 16 bp, Homo sapiens
gcccacatgggacctg

SEQ ID NO: 5482742 - DNA, 23 bp, Homo sapiens
gcccacatgtgtccatcccagcg

SEQ ID NO: 5482743 - DNA, 17 bp, Homo sapiens
gcccacattgcccacac

SEQ ID NO: 5482744 - DNA, 16 bp, Homo sapiens
gcccacattggaccca

SEQ ID NO: 5482745 - DNA, 15 bp, Homo sapiens
gcccacatttagtct

SEQ ID NO: 5482746 - DNA, 21 bp, Homo sapiens
gcccacatttagtctctttat

SEQ ID NO: 5482747 - DNA, 14 bp, Homo sapiens
gcccacatttgatg

SEQ ID NO: 5482748 - DNA, 18 bp, Homo sapiens
gcccacatttgggctcag

SEQ ID NO: 5482749 - DNA, 17 bp, Homo sapiens
gcccaccaacatcccat

SEQ ID NO: 5482750 - DNA, 18 bp, Homo sapiens
gcccaccaatctgccctt

SEQ ID NO: 5482751 - DNA, 13 bp, Homo sapiens
gcccaccaccctg

SEQ ID NO: 5482752 - DNA, 18 bp, Homo sapiens
gcccaccagagcctccct

SEQ ID NO: 5482753 - DNA, 13 bp, Homo sapiens
gcccaccagccag

SEQ ID NO: 5482754 - DNA, 15 bp, Homo sapiens
gcccaccagccagcc

SEQ ID NO: 5482755 - DNA, 16 bp, Homo sapiens
gcccaccagcggcctt

SEQ ID NO: 5482756 - DNA, 17 bp, Homo sapiens
gcccaccagctggctct

SEQ ID NO: 5482757 - DNA, 11 bp, Homo sapiens
gcccaccagga

SEQ ID NO: 5482758 - DNA, 23 bp, Homo sapiens
gcccaccaggagcacctggaccc

SEQ ID NO: 5482759 - DNA, 18 bp, Homo sapiens
gcccaccagggacacctc

SEQ ID NO: 5482760 - DNA, 17 bp, Homo sapiens
gcccaccattcccggcc

SEQ ID NO: 5482761 - DNA, 15 bp, Homo sapiens
gcccacccacacccc

SEQ ID NO: 5482762 - DNA, 14 bp, Homo sapiens
gcccacccacatga

SEQ ID NO: 5482763 - DNA, 16 bp, Homo sapiens
gcccacccacatgact

SEQ ID NO: 5482764 - DNA, 14 bp, Homo sapiens
gcccacccagcagc

SEQ ID NO: 5482765 - DNA, 13 bp, Homo sapiens
gcccacccagctg

SEQ ID NO: 5482766 - DNA, 18 bp, Homo sapiens
gcccacccagctggtcct

SEQ ID NO: 5482767 - DNA, 23 bp, Homo sapiens
gcccacccagctggtcctgtgga

SEQ ID NO: 5482768 - DNA, 14 bp, Homo sapiens
gcccacccagggaa

SEQ ID NO: 5482769 - DNA, 16 bp, Homo sapiens
gcccacccagggagct

SEQ ID NO: 5482770 - DNA, 14 bp, Homo sapiens
gcccacccagggcc

SEQ ID NO: 5482771 - DNA, 15 bp, Homo sapiens
gcccacccagggccc

SEQ ID NO: 5482772 - DNA, 22 bp, Homo sapiens
gcccacccagggcccggcacag

SEQ ID NO: 5482773 - DNA, 23 bp, Homo sapiens
gcccacccagtccatgctccagg

SEQ ID NO: 5482774 - DNA, 13 bp, Homo sapiens
gcccaccccaccc

SEQ ID NO: 5482775 - DNA, 22 bp, Homo sapiens
gcccaccccacccacttctgca

SEQ ID NO: 5482776 - DNA, 23 bp, Homo sapiens
gcccaccccagcctcgcctgtca

SEQ ID NO: 5482777 - DNA, 17 bp, Homo sapiens
gcccaccccatccctgg

SEQ ID NO: 5482778 - DNA, 13 bp, Homo sapiens
gcccacccccacc

SEQ ID NO: 5482779 - DNA, 20 bp, Homo sapiens
gcccacccccagtctccagg

SEQ ID NO: 5482780 - DNA, 13 bp, Homo sapiens
gcccaccccccag

SEQ ID NO: 5482781 - DNA, 19 bp, Homo sapiens
gcccaccccccagcctcca

SEQ ID NO: 5482782 - DNA, 19 bp, Homo sapiens
gcccacccccctccccaac

SEQ ID NO: 5482783 - DNA, 20 bp, Homo sapiens
gcccacccccctccccaact

SEQ ID NO: 5482784 - DNA, 16 bp, Homo sapiens
gcccacccccggcagc

SEQ ID NO: 5482785 - DNA, 15 bp, Homo sapiens
gcccaccccctgccc

SEQ ID NO: 5482786 - DNA, 16 bp, Homo sapiens
gcccaccccctgccct

SEQ ID NO: 5482787 - DNA, 17 bp, Homo sapiens
gcccaccccctgccctg

SEQ ID NO: 5482788 - DNA, 19 bp, Homo sapiens
gcccaccccctgccctgca

SEQ ID NO: 5482789 - DNA, 14 bp, Homo sapiens
gcccaccccctgct

SEQ ID NO: 5482790 - DNA, 15 bp, Homo sapiens
gcccaccccctgctg

SEQ ID NO: 5482791 - DNA, 10 bp, Homo sapiens
gcccaccccg

SEQ ID NO: 5482792 - DNA, 17 bp, Homo sapiens
gcccaccccgcctctgg

SEQ ID NO: 5482793 - DNA, 20 bp, Homo sapiens
gcccaccccgcctgccctcc

SEQ ID NO: 5482794 - DNA, 19 bp, Homo sapiens
gcccaccccgctgcctggc

SEQ ID NO: 5482795 - DNA, 23 bp, Homo sapiens
gcccacccctcactccccaggga

SEQ ID NO: 5482796 - DNA, 23 bp, Homo sapiens
gcccacccctcttcccccttccc

SEQ ID NO: 5482797 - DNA, 19 bp, Homo sapiens
gcccacccgagtacctcca

SEQ ID NO: 5482798 - DNA, 14 bp, Homo sapiens
gcccacccgcccca

SEQ ID NO: 5482799 - DNA, 19 bp, Homo sapiens
gcccacccgccccagagac

SEQ ID NO: 5482800 - DNA, 20 bp, Homo sapiens
gcccacccgccccagagact

SEQ ID NO: 5482801 - DNA, 21 bp, Homo sapiens
gcccacccgccccagagactg

SEQ ID NO: 5482802 - DNA, 15 bp, Homo sapiens
gcccacccgccttgt

SEQ ID NO: 5482803 - DNA, 16 bp, Homo sapiens
gcccacccgccttgtg

SEQ ID NO: 5482804 - DNA, 17 bp, Homo sapiens
gcccacccgccttgtga

SEQ ID NO: 5482805 - DNA, 23 bp, Homo sapiens
gcccacccgtcttcaatctctgt

SEQ ID NO: 5482806 - DNA, 17 bp, Homo sapiens
gcccaccctccctccac

SEQ ID NO: 5482807 - DNA, 18 bp, Homo sapiens
gcccaccctcctgtcttc

SEQ ID NO: 5482808 - DNA, 22 bp, Homo sapiens
gcccaccctctgcccagggagt

SEQ ID NO: 5482809 - DNA, 10 bp, Homo sapiens
gcccaccctg

SEQ ID NO: 5482810 - DNA, 15 bp, Homo sapiens
gcccaccctgctgcc

SEQ ID NO: 5482811 - DNA, 18 bp, Homo sapiens
gcccaccctgctgccttc

SEQ ID NO: 5482812 - DNA, 18 bp, Homo sapiens
gcccaccctgctgctggt

SEQ ID NO: 5482813 - DNA, 19 bp, Homo sapiens
gcccaccctgctgctggtg

SEQ ID NO: 5482814 - DNA, 21 bp, Homo sapiens
gcccaccctgctgctggtgca

SEQ ID NO: 5482815 - DNA, 23 bp, Homo sapiens
gcccaccctgcttggcccagggg

SEQ ID NO: 5482816 - DNA, 21 bp, Homo sapiens
gcccaccctgggcctcccgtc

SEQ ID NO: 5482817 - DNA, 16 bp, Homo sapiens
gcccaccctgggctcc

SEQ ID NO: 5482818 - DNA, 22 bp, Homo sapiens
gcccaccctgggctccacacag

SEQ ID NO: 5482819 - DNA, 15 bp, Homo sapiens
gcccaccgaggagcc

SEQ ID NO: 5482820 - DNA, 20 bp, Homo sapiens
gcccaccgaggagccccagc

SEQ ID NO: 5482821 - DNA, 16 bp, Homo sapiens
gcccaccgcatgcccc

SEQ ID NO: 5482822 - DNA, 17 bp, Homo sapiens
gcccaccgcatgccccc

SEQ ID NO: 5482823 - DNA, 13 bp, Homo sapiens
gcccaccgccctc

SEQ ID NO: 5482824 - DNA, 22 bp, Homo sapiens
gcccaccgtgggcagtgccacc

SEQ ID NO: 5482825 - DNA, 18 bp, Homo sapiens
gcccaccgttaggattca

SEQ ID NO: 5482826 - DNA, 15 bp, Homo sapiens
gcccacctaccttca

SEQ ID NO: 5482827 - DNA, 21 bp, Homo sapiens
gcccacctaccttcaaagctg

SEQ ID NO: 5482828 - DNA, 22 bp, Homo sapiens
gcccacctaccttcaaagctga

SEQ ID NO: 5482829 - DNA, 21 bp, Homo sapiens
gcccacctccccacgccctcc

SEQ ID NO: 5482830 - DNA, 21 bp, Homo sapiens
gcccacctcggccctccctgc

SEQ ID NO: 5482831 - DNA, 17 bp, Homo sapiens
gcccacctcggcctccc

SEQ ID NO: 5482832 - DNA, 11 bp, Homo sapiens
gcccacctctc

SEQ ID NO: 5482833 - DNA, 13 bp, Homo sapiens
gcccacctctccc

SEQ ID NO: 5482834 - DNA, 17 bp, Homo sapiens
gcccacctctccctgca

SEQ ID NO: 5482835 - DNA, 19 bp, Homo sapiens
gcccacctctgctgcccac

SEQ ID NO: 5482836 - DNA, 22 bp, Homo sapiens
gcccacctctgctgcccacggc

SEQ ID NO: 5482837 - DNA, 23 bp, Homo sapiens
gcccacctctgctgcccacggcc

SEQ ID NO: 5482838 - DNA, 17 bp, Homo sapiens
gcccacctgaaagcctg

SEQ ID NO: 5482839 - DNA, 16 bp, Homo sapiens
gcccacctgcacgtga

SEQ ID NO: 5482840 - DNA, 14 bp, Homo sapiens
gcccacctgccagg

SEQ ID NO: 5482841 - DNA, 17 bp, Homo sapiens
gcccacctgccaggctg

SEQ ID NO: 5482842 - DNA, 22 bp, Homo sapiens
gcccacctgccaggctgcaggg

SEQ ID NO: 5482843 - DNA, 23 bp, Homo sapiens
gcccacctgccaggctgcaggga

SEQ ID NO: 5482844 - DNA, 15 bp, Homo sapiens
gcccacctgcccatc

SEQ ID NO: 5482845 - DNA, 13 bp, Homo sapiens
gcccacctgcctg

SEQ ID NO: 5482846 - DNA, 16 bp, Homo sapiens
gcccacctgcctggcc

SEQ ID NO: 5482847 - DNA, 21 bp, Homo sapiens
gcccacctgcctggccggcca

SEQ ID NO: 5482848 - DNA, 13 bp, Homo sapiens
gcccacctgctcc

SEQ ID NO: 5482849 - DNA, 16 bp, Homo sapiens
gcccacctgctgcccg

SEQ ID NO: 5482850 - DNA, 14 bp, Homo sapiens
gcccacctggccac

SEQ ID NO: 5482851 - DNA, 16 bp, Homo sapiens
gcccacctggcctctg

SEQ ID NO: 5482852 - DNA, 24 bp, Homo sapiens
gcccacctggcctctgcactcccc

SEQ ID NO: 5482853 - DNA, 16 bp, Homo sapiens
gcccacctggctgcca

SEQ ID NO: 5482854 - DNA, 13 bp, Homo sapiens
gcccacctgggcc

SEQ ID NO: 5482855 - DNA, 18 bp, Homo sapiens
gcccacctgggccctagg

SEQ ID NO: 5482856 - DNA, 20 bp, Homo sapiens
gcccacctggggtctctctc

SEQ ID NO: 5482857 - DNA, 18 bp, Homo sapiens
gcccaccttggaccctgg

SEQ ID NO: 5482858 - DNA, 19 bp, Homo sapiens
gcccaccttggaccctggt

SEQ ID NO: 5482859 - DNA, 13 bp, Homo sapiens
gcccaccttggct

SEQ ID NO: 5482860 - DNA, 15 bp, Homo sapiens
gcccaccttggctca

SEQ ID NO: 5482861 - DNA, 16 bp, Homo sapiens
gcccaccttggctcaa

SEQ ID NO: 5482862 - DNA, 19 bp, Homo sapiens
gcccacgacactgcagccc

SEQ ID NO: 5482863 - DNA, 15 bp, Homo sapiens
gcccacgaggagcag

SEQ ID NO: 5482864 - DNA, 16 bp, Homo sapiens
gcccacgatcccctcc

SEQ ID NO: 5482865 - DNA, 20 bp, Homo sapiens
gcccacgatcccctccccca

SEQ ID NO: 5482866 - DNA, 22 bp, Homo sapiens
gcccacgcacgacgtcagcctc

SEQ ID NO: 5482867 - DNA, 18 bp, Homo sapiens
gcccacgcagagccccgg

SEQ ID NO: 5482868 - DNA, 19 bp, Homo sapiens
gcccacgcagagccccgga

SEQ ID NO: 5482869 - DNA, 18 bp, Homo sapiens
gcccacgcagaggacgca

SEQ ID NO: 5482870 - DNA, 16 bp, Homo sapiens
gcccagcaccccttcc

SEQ ID NO: 5482871 - DNA, 17 bp, Homo sapiens
gcccagcacctcctccg

SEQ ID NO: 5482872 - DNA, 15 bp, Homo sapiens
gcccagcacctggag

SEQ ID NO: 5482873 - DNA, 13 bp, Homo sapiens
gcccagcacgagc

SEQ ID NO: 5482874 - DNA, 22 bp, Homo sapiens
gcccagcactgcccatcccacc

SEQ ID NO: 5482875 - DNA, 14 bp, Homo sapiens
gcccagcactgtga

SEQ ID NO: 5482876 - DNA, 22 bp, Homo sapiens
gcccagcagacatcaagctcaa

SEQ ID NO: 5482877 - DNA, 13 bp, Homo sapiens
gcccagcagagag

SEQ ID NO: 5482878 - DNA, 21 bp, Homo sapiens
gcccagcagagccgttcctgg

SEQ ID NO: 5482879 - DNA, 23 bp, Homo sapiens
gcccagcagagccgttcctggga

SEQ ID NO: 5482880 - DNA, 19 bp, Homo sapiens
gcccagcagcccctgagag

SEQ ID NO: 5482881 - DNA, 12 bp, Homo sapiens
gcccagcagcct

SEQ ID NO: 5482882 - DNA, 20 bp, Homo sapiens
gcccagcagcctgccagcag

SEQ ID NO: 5482883 - DNA, 17 bp, Homo sapiens
gcccagcagcggcccag

SEQ ID NO: 5482884 - DNA, 18 bp, Homo sapiens
gcccagcagcggcccaga

SEQ ID NO: 5482885 - DNA, 17 bp, Homo sapiens
gcccagcagcttggctg

SEQ ID NO: 5482886 - DNA, 18 bp, Homo sapiens
gcccagcagcttggctga

SEQ ID NO: 5482887 - DNA, 19 bp, Homo sapiens
gcccagcagcttggctgag

SEQ ID NO: 5482888 - DNA, 21 bp, Homo sapiens
gcccagcagcttggctgagcc

SEQ ID NO: 5482889 - DNA, 10 bp, Homo sapiens
gcccagcagg

SEQ ID NO: 5482890 - DNA, 21 bp, Homo sapiens
gcccagcaggcaggcactgtg

SEQ ID NO: 5482891 - DNA, 13 bp, Homo sapiens
gcccagcaggccc

SEQ ID NO: 5482892 - DNA, 23 bp, Homo sapiens
gcccagcatatgtgccataaaca

SEQ ID NO: 5482893 - DNA, 14 bp, Homo sapiens
gcccagcattgctg

SEQ ID NO: 5482894 - DNA, 12 bp, Homo sapiens
gcccagccaccc

SEQ ID NO: 5482895 - DNA, 13 bp, Homo sapiens
gcccagccacccc

SEQ ID NO: 5482896 - DNA, 15 bp, Homo sapiens
gcccagccacccctc

SEQ ID NO: 5482897 - DNA, 17 bp, Homo sapiens
gcccagccacccctcag

SEQ ID NO: 5482898 - DNA, 12 bp, Homo sapiens
gcccagccacct

SEQ ID NO: 5482899 - DNA, 13 bp, Homo sapiens
gcccagccacctc

SEQ ID NO: 5482900 - DNA, 14 bp, Homo sapiens
gcccagccacctcc

SEQ ID NO: 5482901 - DNA, 22 bp, Homo sapiens
gcccagccacctcccaaggact

SEQ ID NO: 5482902 - DNA, 14 bp, Homo sapiens
gcccagccactgca

SEQ ID NO: 5482903 - DNA, 16 bp, Homo sapiens
gcccagccactgcagc

SEQ ID NO: 5482904 - DNA, 11 bp, Homo sapiens
gcccagccagc

SEQ ID NO: 5482905 - DNA, 16 bp, Homo sapiens
gcccagccagccaccc

SEQ ID NO: 5482906 - DNA, 13 bp, Homo sapiens
gcccagccagcgt

SEQ ID NO: 5482907 - DNA, 14 bp, Homo sapiens
gcccagccagcgtc

SEQ ID NO: 5482908 - DNA, 22 bp, Homo sapiens
gcccagccagcgtcggtctgtg

SEQ ID NO: 5482909 - DNA, 17 bp, Homo sapiens
gcccagccaggagcaga

SEQ ID NO: 5482910 - DNA, 14 bp, Homo sapiens
gcccagccaggccc

SEQ ID NO: 5482911 - DNA, 16 bp, Homo sapiens
gcccagccaggcccca

SEQ ID NO: 5482912 - DNA, 23 bp, Homo sapiens
gcccagccagttggtggggccag

SEQ ID NO: 5482913 - DNA, 15 bp, Homo sapiens
gcccagccatggctg

SEQ ID NO: 5482914 - DNA, 22 bp, Homo sapiens
gcccagccattaccatggagac

SEQ ID NO: 5482915 - DNA, 9 bp, Homo sapiens
gcccagccc

SEQ ID NO: 5482916 - DNA, 15 bp, Homo sapiens
gcccagcccaagcac

SEQ ID NO: 5482917 - DNA, 13 bp, Homo sapiens
gcccagcccagag

SEQ ID NO: 5482918 - DNA, 17 bp, Homo sapiens
gcccagcccagagccac

SEQ ID NO: 5482919 - DNA, 14 bp, Homo sapiens
gcccagcccaggcc

SEQ ID NO: 5482920 - DNA, 16 bp, Homo sapiens
gcccagcccaggcctg

SEQ ID NO: 5482921 - DNA, 11 bp, Homo sapiens
gcccagcccca

SEQ ID NO: 5482922 - DNA, 23 bp, Homo sapiens
gcccagccccactcctctgctga

SEQ ID NO: 5482923 - DNA, 17 bp, Homo sapiens
gcccagccccaggtctc

SEQ ID NO: 5482924 - DNA, 20 bp, Homo sapiens
gcccagccccatccctgtcc

SEQ ID NO: 5482925 - DNA, 11 bp, Homo sapiens
gcccagcccct

SEQ ID NO: 5482926 - DNA, 12 bp, Homo sapiens
gcccagccccta

SEQ ID NO: 5482927 - DNA, 19 bp, Homo sapiens
gcccagcccctactgctgt

SEQ ID NO: 5482928 - DNA, 14 bp, Homo sapiens
gcccagcccctaga

SEQ ID NO: 5482929 - DNA, 15 bp, Homo sapiens
gcccagcccctagaa

SEQ ID NO: 5482930 - DNA, 16 bp, Homo sapiens
gcccagcccctccacg

SEQ ID NO: 5482931 - DNA, 18 bp, Homo sapiens
gcccagcccctcctccct

SEQ ID NO: 5482932 - DNA, 19 bp, Homo sapiens
gcccagcccctcctccctg

SEQ ID NO: 5482933 - DNA, 13 bp, Homo sapiens
gcccagcccctgc

SEQ ID NO: 5482934 - DNA, 15 bp, Homo sapiens
gcccagcccctgccc

SEQ ID NO: 5482935 - DNA, 16 bp, Homo sapiens
gcccagcccctgttta

SEQ ID NO: 5482936 - DNA, 22 bp, Homo sapiens
gcccagccccttttctctgctc

SEQ ID NO: 5482937 - DNA, 13 bp, Homo sapiens
gcccagcccggct

SEQ ID NO: 5482938 - DNA, 14 bp, Homo sapiens
gcccagcccggctc

SEQ ID NO: 5482939 - DNA, 15 bp, Homo sapiens
gcccagccctcccag

SEQ ID NO: 5482940 - DNA, 18 bp, Homo sapiens
gcccagccctcccagctg

SEQ ID NO: 5482941 - DNA, 14 bp, Homo sapiens
gcccagccctcctt

SEQ ID NO: 5482942 - DNA, 20 bp, Homo sapiens
gcccagccctctgtggccag

SEQ ID NO: 5482943 - DNA, 22 bp, Homo sapiens
gcccagccctctgtggccagga

SEQ ID NO: 5482944 - DNA, 13 bp, Homo sapiens
gcccagccctgct

SEQ ID NO: 5482945 - DNA, 15 bp, Homo sapiens
gcccagccctgctgg

SEQ ID NO: 5482946 - DNA, 16 bp, Homo sapiens
gcccagccctgctggc

SEQ ID NO: 5482947 - DNA, 17 bp, Homo sapiens
gcccagccctgctggcc

SEQ ID NO: 5482948 - DNA, 13 bp, Homo sapiens
gcccagccctggc

SEQ ID NO: 5482949 - DNA, 18 bp, Homo sapiens
gcccagccctggcccagg

SEQ ID NO: 5482950 - DNA, 18 bp, Homo sapiens
gcccagccctgggcaagg

SEQ ID NO: 5482951 - DNA, 19 bp, Homo sapiens
gcccagccctgggcaagga

SEQ ID NO: 5482952 - DNA, 16 bp, Homo sapiens
gcccagccggcctctc

SEQ ID NO: 5482953 - DNA, 18 bp, Homo sapiens
gcccagccggcctctctg

SEQ ID NO: 5482954 - DNA, 15 bp, Homo sapiens
gcccagccgggcaca

SEQ ID NO: 5482955 - DNA, 19 bp, Homo sapiens
gcccagccgggcacagtgg

SEQ ID NO: 5482956 - DNA, 16 bp, Homo sapiens
gcccagccggggtggg

SEQ ID NO: 5482957 - DNA, 23 bp, Homo sapiens
gcccagccggggtggggtgcctg

SEQ ID NO: 5482958 - DNA, 15 bp, Homo sapiens
gcccagcctaggccc

SEQ ID NO: 5482959 - DNA, 20 bp, Homo sapiens
gcccagcctcctcccaccac

SEQ ID NO: 5482960 - DNA, 13 bp, Homo sapiens
gcccagcctctcc

SEQ ID NO: 5482961 - DNA, 22 bp, Homo sapiens
gcccagcctctccccgctctgg

SEQ ID NO: 5482962 - DNA, 15 bp, Homo sapiens
gcccagcctctctgg

SEQ ID NO: 5482963 - DNA, 18 bp, Homo sapiens
gcccagcctctctggctc

SEQ ID NO: 5482964 - DNA, 13 bp, Homo sapiens
gcccagcctctga

SEQ ID NO: 5482965 - DNA, 21 bp, Homo sapiens
gcccagcctctgccccaccca

SEQ ID NO: 5482966 - DNA, 15 bp, Homo sapiens
gcccagcctctgtcc

SEQ ID NO: 5482967 - DNA, 13 bp, Homo sapiens
gcccagcctcttg

SEQ ID NO: 5482968 - DNA, 14 bp, Homo sapiens
gcccagcctcttgt

SEQ ID NO: 5482969 - DNA, 15 bp, Homo sapiens
gcccagcctctttcc

SEQ ID NO: 5482970 - DNA, 23 bp, Homo sapiens
gcccagcctgcatctagctggag

SEQ ID NO: 5482971 - DNA, 11 bp, Homo sapiens
gcccagcctgg

SEQ ID NO: 5482972 - DNA, 13 bp, Homo sapiens
gcccagcctggaa

SEQ ID NO: 5482973 - DNA, 18 bp, Homo sapiens
gcccagcctggagcggag

SEQ ID NO: 5482974 - DNA, 14 bp, Homo sapiens
gcccagcctggatg

SEQ ID NO: 5482975 - DNA, 13 bp, Homo sapiens
gcccagcctggcc

SEQ ID NO: 5482976 - DNA, 16 bp, Homo sapiens
gcccagcctggcccca

SEQ ID NO: 5482977 - DNA, 21 bp, Homo sapiens
gcccagcctggccccaaatgt

SEQ ID NO: 5482978 - DNA, 14 bp, Homo sapiens
gcccagcctgggag

SEQ ID NO: 5482979 - DNA, 16 bp, Homo sapiens
gcccagcctgggagcc

SEQ ID NO: 5482980 - DNA, 21 bp, Homo sapiens
gcccagcctgggagcccagag

SEQ ID NO: 5482981 - DNA, 22 bp, Homo sapiens
gcccagcctgggagcccagagg

SEQ ID NO: 5482982 - DNA, 18 bp, Homo sapiens
gcccagcctgtcctggta

SEQ ID NO: 5482983 - DNA, 22 bp, Homo sapiens
gcccagcctgtggcctcagcat

SEQ ID NO: 5482984 - DNA, 23 bp, Homo sapiens
gcccagcctttgttccccactgg

SEQ ID NO: 5482985 - DNA, 17 bp, Homo sapiens
gcccagcgcggacatcc

SEQ ID NO: 5482986 - DNA, 17 bp, Homo sapiens
gcccagcgctcgccacg

SEQ ID NO: 5482987 - DNA, 18 bp, Homo sapiens
gcccagcgctctcctgga

SEQ ID NO: 5482988 - DNA, 18 bp, Homo sapiens
gcccagcggacagtggca

SEQ ID NO: 5482989 - DNA, 19 bp, Homo sapiens
gcccagcggacagtggcag

SEQ ID NO: 5482990 - DNA, 20 bp, Homo sapiens
gcccagcggacagtggcagg

SEQ ID NO: 5482991 - DNA, 20 bp, Homo sapiens
gcccagcggcccaagagccc

SEQ ID NO: 5482992 - DNA, 21 bp, Homo sapiens
gcccagcggcccaagagcccg

SEQ ID NO: 5482993 - DNA, 16 bp, Homo sapiens
gcccagcggcccctcc

SEQ ID NO: 5482994 - DNA, 20 bp, Homo sapiens
gcccagcggcccctcccaca

SEQ ID NO: 5482995 - DNA, 13 bp, Homo sapiens
gcccagcggctct

SEQ ID NO: 5482996 - DNA, 14 bp, Homo sapiens
gcccagcgggcaga

SEQ ID NO: 5482997 - DNA, 23 bp, Homo sapiens
gcccagcgtcagaagtctagttt

SEQ ID NO: 5482998 - DNA, 17 bp, Homo sapiens
gcccagctacattcctc

SEQ ID NO: 5482999 - DNA, 18 bp, Homo sapiens
gcccagctacattcctca

SEQ ID NO: 5483000 - DNA, 23 bp, Homo sapiens
gcccagctacattcctcagctgc

SEQ ID NO: 5483001 - DNA, 19 bp, Homo sapiens
gcccagctatacctgtgcc

SEQ ID NO: 5483002 - DNA, 12 bp, Homo sapiens
gcccagctcagt

SEQ ID NO: 5483003 - DNA, 14 bp, Homo sapiens
gcccagctcagtgc

SEQ ID NO: 5483004 - DNA, 22 bp, Homo sapiens
gcccagctccactcagggctgg

SEQ ID NO: 5483005 - DNA, 23 bp, Homo sapiens
gcccagctccactcagggctggc

SEQ ID NO: 5483006 - DNA, 18 bp, Homo sapiens
gcccagctccagggccag

SEQ ID NO: 5483007 - DNA, 13 bp, Homo sapiens
gcccagctccccc

SEQ ID NO: 5483008 - DNA, 19 bp, Homo sapiens
gcccagctcccccgggagg

SEQ ID NO: 5483009 - DNA, 11 bp, Homo sapiens
gcccagctccg

SEQ ID NO: 5483010 - DNA, 19 bp, Homo sapiens
gcccagctccgcctgctgg

SEQ ID NO: 5483011 - DNA, 12 bp, Homo sapiens
gcccagctcctg

SEQ ID NO: 5483012 - DNA, 13 bp, Homo sapiens
gcccagctctgag

SEQ ID NO: 5483013 - DNA, 15 bp, Homo sapiens
gcccagctctgggaa

SEQ ID NO: 5483014 - DNA, 13 bp, Homo sapiens
gcccagctgcacc

SEQ ID NO: 5483015 - DNA, 14 bp, Homo sapiens
gcccagctgcacct

SEQ ID NO: 5483016 - DNA, 23 bp, Homo sapiens
gcccagctgcacctgccagcctg

SEQ ID NO: 5483017 - DNA, 13 bp, Homo sapiens
gcccagctgccag

SEQ ID NO: 5483018 - DNA, 15 bp, Homo sapiens
gcccagctgccaggg

SEQ ID NO: 5483019 - DNA, 18 bp, Homo sapiens
gcccagctgccagggaag

SEQ ID NO: 5483020 - DNA, 15 bp, Homo sapiens
gcccagctgcctgga

SEQ ID NO: 5483021 - DNA, 16 bp, Homo sapiens
gcccagctgcctggag

SEQ ID NO: 5483022 - DNA, 13 bp, Homo sapiens
gcccagctgctct

SEQ ID NO: 5483023 - DNA, 13 bp, Homo sapiens
gcccagctggcca

SEQ ID NO: 5483024 - DNA, 14 bp, Homo sapiens
gcccagctggcctg

SEQ ID NO: 5483025 - DNA, 13 bp, Homo sapiens
gcccagctgggct

SEQ ID NO: 5483026 - DNA, 16 bp, Homo sapiens
gcccagctgggctctg

SEQ ID NO: 5483027 - DNA, 18 bp, Homo sapiens
gcccagctgggctctgcc

SEQ ID NO: 5483028 - DNA, 17 bp, Homo sapiens
gcccagctggggcccct

SEQ ID NO: 5483029 - DNA, 22 bp, Homo sapiens
gcccagctggggcccctcggct

SEQ ID NO: 5483030 - DNA, 13 bp, Homo sapiens
gcccagctgggtc

SEQ ID NO: 5483031 - DNA, 18 bp, Homo sapiens
gcccagctgggtcaggca

SEQ ID NO: 5483032 - DNA, 19 bp, Homo sapiens
gcccagctgggtcaggcag

SEQ ID NO: 5483033 - DNA, 17 bp, Homo sapiens
gcccagctggtgggaag

SEQ ID NO: 5483034 - DNA, 18 bp, Homo sapiens
gcccagctgtagccatgg

SEQ ID NO: 5483035 - DNA, 23 bp, Homo sapiens
gcccagctgtagccatggctcag

SEQ ID NO: 5483036 - DNA, 17 bp, Homo sapiens
gcccagctgtgctggga

SEQ ID NO: 5483037 - DNA, 22 bp, Homo sapiens
gcccagctgtgctgggaggtcc

SEQ ID NO: 5483038 - DNA, 17 bp, Homo sapiens
gcccagcttcctggtgt

SEQ ID NO: 5483039 - DNA, 19 bp, Homo sapiens
gcccagcttcgtcagctcc

SEQ ID NO: 5483040 - DNA, 19 bp, Homo sapiens
gcccagcttggagtgccac

SEQ ID NO: 5483041 - DNA, 13 bp, Homo sapiens
gcccagcttgggc

SEQ ID NO: 5483042 - DNA, 17 bp, Homo sapiens
gcccagcttgggcccag

SEQ ID NO: 5483043 - DNA, 20 bp, Homo sapiens
gcccagcttgggcccagctg

SEQ ID NO: 5483044 - DNA, 23 bp, Homo sapiens
gcccagcttgggcccagctgggc

SEQ ID NO: 5483045 - DNA, 23 bp, Homo sapiens
gcccagcttttcattgctgtgac

SEQ ID NO: 5483046 - DNA, 18 bp, Homo sapiens
gcccaggaaaaacctgtg

SEQ ID NO: 5483047 - DNA, 19 bp, Homo sapiens
gcccaggaaaaacctgtgg

SEQ ID NO: 5483048 - DNA, 21 bp, Homo sapiens
gcccaggaaaggctccaggag

SEQ ID NO: 5483049 - DNA, 17 bp, Homo sapiens
gcccaggaagcccacac

SEQ ID NO: 5483050 - DNA, 14 bp, Homo sapiens
gcccaggtccctcc

SEQ ID NO: 5483051 - DNA, 14 bp, Homo sapiens
gcccaggtctcctg

SEQ ID NO: 5483052 - DNA, 20 bp, Homo sapiens
gcccaggtgagggaaggaga

SEQ ID NO: 5483053 - DNA, 13 bp, Homo sapiens
gcccaggtggcta

SEQ ID NO: 5483054 - DNA, 20 bp, Homo sapiens
gcccaggttggagtgcagtg

SEQ ID NO: 5483055 - DNA, 14 bp, Homo sapiens
gcccaggtttctgg

SEQ ID NO: 5483056 - DNA, 14 bp, Homo sapiens
gcccagtaaaattt

SEQ ID NO: 5483057 - DNA, 18 bp, Homo sapiens
gcccagtaaaatttcagg

SEQ ID NO: 5483058 - DNA, 15 bp, Homo sapiens
gcccagtccactggg

SEQ ID NO: 5483059 - DNA, 14 bp, Homo sapiens
gcccagtcccagca

SEQ ID NO: 5483060 - DNA, 15 bp, Homo sapiens
gcccagtcccagcag

SEQ ID NO: 5483061 - DNA, 16 bp, Homo sapiens
gcccagtcccagcagc

SEQ ID NO: 5483062 - DNA, 17 bp, Homo sapiens
gcccagtcccccaaccc

SEQ ID NO: 5483063 - DNA, 14 bp, Homo sapiens
gcccagtccctgga

SEQ ID NO: 5483064 - DNA, 15 bp, Homo sapiens
gcccagtccctggag

SEQ ID NO: 5483065 - DNA, 18 bp, Homo sapiens
gcccagtcctctcccaag

SEQ ID NO: 5483066 - DNA, 12 bp, Homo sapiens
gcccagtcctgg

SEQ ID NO: 5483067 - DNA, 15 bp, Homo sapiens
gcccagtcctgggtt

SEQ ID NO: 5483068 - DNA, 18 bp, Homo sapiens
gcccagtccttccacctc

SEQ ID NO: 5483069 - DNA, 19 bp, Homo sapiens
gcccagtccttccacctcg

SEQ ID NO: 5483070 - DNA, 14 bp, Homo sapiens
gcccagtcgacccc

SEQ ID NO: 5483071 - DNA, 22 bp, Homo sapiens
gcccagtcgtccgctcagccaa

SEQ ID NO: 5483072 - DNA, 22 bp, Homo sapiens
gcccagtctggaatgcagtggt

SEQ ID NO: 5483073 - DNA, 14 bp, Homo sapiens
gcccagtctgttga

SEQ ID NO: 5483074 - DNA, 15 bp, Homo sapiens
gcccagtctgttgag

SEQ ID NO: 5483075 - DNA, 23 bp, Homo sapiens
gcccagtcttgagtgggccccct

SEQ ID NO: 5483076 - DNA, 18 bp, Homo sapiens
gcccagtctttcatgtgt

SEQ ID NO: 5483077 - DNA, 21 bp, Homo sapiens
gcccagtctttggagagctca

SEQ ID NO: 5483078 - DNA, 15 bp, Homo sapiens
gcccagtgaagcctc

SEQ ID NO: 5483079 - DNA, 16 bp, Homo sapiens
gcccagtgacctgacc

SEQ ID NO: 5483080 - DNA, 17 bp, Homo sapiens
gcccagtgagccctgct

SEQ ID NO: 5483081 - DNA, 23 bp, Homo sapiens
gcccagtgatggcattactctgc

SEQ ID NO: 5483082 - DNA, 15 bp, Homo sapiens
gcccagtgcactgaa

SEQ ID NO: 5483083 - DNA, 19 bp, Homo sapiens
gcccagtgcacttgctgga

SEQ ID NO: 5483084 - DNA, 22 bp, Homo sapiens
gcccagtgcacttgctggaaga

SEQ ID NO: 5483085 - DNA, 11 bp, Homo sapiens
gcccagtgcat

SEQ ID NO: 5483086 - DNA, 20 bp, Homo sapiens
gcccagtgcatatgcaatgt

SEQ ID NO: 5483087 - DNA, 14 bp, Homo sapiens
gcccagtgcatggt

SEQ ID NO: 5483088 - DNA, 17 bp, Homo sapiens
gcccagtgccactgccc

SEQ ID NO: 5483089 - DNA, 13 bp, Homo sapiens
gcccagtgccagc

SEQ ID NO: 5483090 - DNA, 16 bp, Homo sapiens
gcccagtgccccctgg

SEQ ID NO: 5483091 - DNA, 17 bp, Homo sapiens
gcccagtgccctggggc

SEQ ID NO: 5483092 - DNA, 14 bp, Homo sapiens
gcccagtgcttctc

SEQ ID NO: 5483093 - DNA, 19 bp, Homo sapiens
gcccagtgggacccacagt

SEQ ID NO: 5483094 - DNA, 19 bp, Homo sapiens
gcccagtgggctgcacgct

SEQ ID NO: 5483095 - DNA, 23 bp, Homo sapiens
gcccagtgggctgcacgctcccc

SEQ ID NO: 5483096 - DNA, 18 bp, Homo sapiens
gcccagtgttgtttgtaa

SEQ ID NO: 5483097 - DNA, 23 bp, Homo sapiens
gcccagtgttgtttgtaaataag

SEQ ID NO: 5483098 - DNA, 14 bp, Homo sapiens
gcccagttaatctt

SEQ ID NO: 5483099 - DNA, 16 bp, Homo sapiens
gcccagttagcccggc

SEQ ID NO: 5483100 - DNA, 18 bp, Homo sapiens
gcccagttcatcaccatt

SEQ ID NO: 5483101 - DNA, 18 bp, Homo sapiens
gcccagttctcgtgccct

SEQ ID NO: 5483102 - DNA, 22 bp, Homo sapiens
gcccagttctcgtgcccttaga

SEQ ID NO: 5483103 - DNA, 21 bp, Homo sapiens
gcccagttggagactgtctgg

SEQ ID NO: 5483104 - DNA, 15 bp, Homo sapiens
gcccagttgggtgga

SEQ ID NO: 5483105 - DNA, 17 bp, Homo sapiens
gcccagtttcagggcta

SEQ ID NO: 5483106 - DNA, 22 bp, Homo sapiens
gcccataaagtctgagaaatag

SEQ ID NO: 5483107 - DNA, 22 bp, Homo sapiens
gcccataatagttagccctcag

SEQ ID NO: 5483108 - DNA, 21 bp, Homo sapiens
gcccatacccgtgacagtggc

SEQ ID NO: 5483109 - DNA, 22 bp, Homo sapiens
gcccatacccgtgacagtggct

SEQ ID NO: 5483110 - DNA, 14 bp, Homo sapiens
gcccatactcagcc

SEQ ID NO: 5483111 - DNA, 17 bp, Homo sapiens
gcccatactcagcctgc

SEQ ID NO: 5483112 - DNA, 19 bp, Homo sapiens
gcccatactcagcctgctg

SEQ ID NO: 5483113 - DNA, 16 bp, Homo sapiens
gcccatactgagcctg

SEQ ID NO: 5483114 - DNA, 16 bp, Homo sapiens
gcccatactggttggc

SEQ ID NO: 5483115 - DNA, 21 bp, Homo sapiens
gcccatagaaacatgacactg

SEQ ID NO: 5483116 - DNA, 19 bp, Homo sapiens
gcccatagctattttcctt

SEQ ID NO: 5483117 - DNA, 20 bp, Homo sapiens
gcccatatgctaccaccagc

SEQ ID NO: 5483118 - DNA, 22 bp, Homo sapiens
gcccatatgctaccaccagctg

SEQ ID NO: 5483119 - DNA, 22 bp, Homo sapiens
gcccatattttacttggaaata

SEQ ID NO: 5483120 - DNA, 14 bp, Homo sapiens
gcccatcaaaatgt

SEQ ID NO: 5483121 - DNA, 21 bp, Homo sapiens
gcccatcacagggttgggccc

SEQ ID NO: 5483122 - DNA, 19 bp, Homo sapiens
gcccatcactcggctgtgg

SEQ ID NO: 5483123 - DNA, 12 bp, Homo sapiens
gcccatcagcca

SEQ ID NO: 5483124 - DNA, 15 bp, Homo sapiens
gcccatcaggcagtg

SEQ ID NO: 5483125 - DNA, 17 bp, Homo sapiens
gcccatcaggggcagga

SEQ ID NO: 5483126 - DNA, 18 bp, Homo sapiens
gcccatcagtgccagccc

SEQ ID NO: 5483127 - DNA, 20 bp, Homo sapiens
gcccatcagtgccagcccct

SEQ ID NO: 5483128 - DNA, 22 bp, Homo sapiens
gcccatcagtgtacccccgccc

SEQ ID NO: 5483129 - DNA, 13 bp, Homo sapiens
gcccatcatctct

SEQ ID NO: 5483130 - DNA, 17 bp, Homo sapiens
gcccatcatctctgcct

SEQ ID NO: 5483131 - DNA, 13 bp, Homo sapiens
gcccatcccaccc

SEQ ID NO: 5483132 - DNA, 13 bp, Homo sapiens
gcccatcccagtg

SEQ ID NO: 5483133 - DNA, 18 bp, Homo sapiens
gcccatccccaggcacct

SEQ ID NO: 5483134 - DNA, 14 bp, Homo sapiens
gcccatcccccctc

SEQ ID NO: 5483135 - DNA, 16 bp, Homo sapiens
gcccatcccccctcac

SEQ ID NO: 5483136 - DNA, 18 bp, Homo sapiens
gcccatcccctgcctcta

SEQ ID NO: 5483137 - DNA, 19 bp, Homo sapiens
gcccatcccctgcctctat

SEQ ID NO: 5483138 - DNA, 19 bp, Homo sapiens
gcccatcccgccttctcca

SEQ ID NO: 5483139 - DNA, 20 bp, Homo sapiens
gcccatcccgccttctccag

SEQ ID NO: 5483140 - DNA, 21 bp, Homo sapiens
gcccatcccgccttctccagg

SEQ ID NO: 5483141 - DNA, 21 bp, Homo sapiens
gcccatccctggaaggtgctg

SEQ ID NO: 5483142 - DNA, 13 bp, Homo sapiens
gcccatcctgcca

SEQ ID NO: 5483143 - DNA, 12 bp, Homo sapiens
gcccatccttcc

SEQ ID NO: 5483144 - DNA, 19 bp, Homo sapiens
gcccatcgggaccagaaac

SEQ ID NO: 5483145 - DNA, 16 bp, Homo sapiens
gcccatctcagcctcc

SEQ ID NO: 5483146 - DNA, 14 bp, Homo sapiens
gcccatctcaggac

SEQ ID NO: 5483147 - DNA, 17 bp, Homo sapiens
gcccatctcaggtgcca

SEQ ID NO: 5483148 - DNA, 23 bp, Homo sapiens
gcccatctcaggtgccactccct

SEQ ID NO: 5483149 - DNA, 18 bp, Homo sapiens
gcccatctccctgctttg

SEQ ID NO: 5483150 - DNA, 13 bp, Homo sapiens
gcccatctcggag

SEQ ID NO: 5483151 - DNA, 17 bp, Homo sapiens
gcccatctctccagaga

SEQ ID NO: 5483152 - DNA, 12 bp, Homo sapiens
gcccatctgtcc

SEQ ID NO: 5483153 - DNA, 18 bp, Homo sapiens
gcccatctgtccatcctc

SEQ ID NO: 5483154 - DNA, 22 bp, Homo sapiens
gcccatctgtccatcctcctct

SEQ ID NO: 5483155 - DNA, 19 bp, Homo sapiens
gcccatgaagaaagcccct

SEQ ID NO: 5483156 - DNA, 13 bp, Homo sapiens
gcccatgaatttg

SEQ ID NO: 5483157 - DNA, 17 bp, Homo sapiens
gcccatgagagcgcagc

SEQ ID NO: 5483158 - DNA, 19 bp, Homo sapiens
gcccatgagagcgcagccc

SEQ ID NO: 5483159 - DNA, 17 bp, Homo sapiens
gcccatgagtccttgaa

SEQ ID NO: 5483160 - DNA, 12 bp, Homo sapiens
gcccatgccccc

SEQ ID NO: 5483161 - DNA, 16 bp, Homo sapiens
gcccatgcctccagct

SEQ ID NO: 5483162 - DNA, 21 bp, Homo sapiens
gcccatgctcaaccactgtgg

SEQ ID NO: 5483163 - DNA, 15 bp, Homo sapiens
gcccatgctggctgg

SEQ ID NO: 5483164 - DNA, 19 bp, Homo sapiens
gcccatgctggctggggcc

SEQ ID NO: 5483165 - DNA, 17 bp, Homo sapiens
gcccatgctgtccggcc

SEQ ID NO: 5483166 - DNA, 15 bp, Homo sapiens
gcccatgctttccca

SEQ ID NO: 5483167 - DNA, 22 bp, Homo sapiens
gcccatggagattgacctggat

SEQ ID NO: 5483168 - DNA, 15 bp, Homo sapiens
gcccatggaggagac

SEQ ID NO: 5483169 - DNA, 17 bp, Homo sapiens
gcccatggccccagctg

SEQ ID NO: 5483170 - DNA, 22 bp, Homo sapiens
gcccatggccccagctggctgg

SEQ ID NO: 5483171 - DNA, 14 bp, Homo sapiens
gcccatggccccca

SEQ ID NO: 5483172 - DNA, 22 bp, Homo sapiens
gcccatggcctctggccaggca

SEQ ID NO: 5483173 - DNA, 15 bp, Homo sapiens
gcccatggcttctgg

SEQ ID NO: 5483174 - DNA, 15 bp, Homo sapiens
gcccatgggcactgc

SEQ ID NO: 5483175 - DNA, 17 bp, Homo sapiens
gcccatgggcactgctg

SEQ ID NO: 5483176 - DNA, 23 bp, Homo sapiens
gcccatgggcactgctgggtggc

SEQ ID NO: 5483177 - DNA, 21 bp, Homo sapiens
gcccatggttgagaaatgaat

SEQ ID NO: 5483178 - DNA, 18 bp, Homo sapiens
gcccatgtagctggcaag

SEQ ID NO: 5483179 - DNA, 22 bp, Homo sapiens
gcccatgtagctggcaagctgc

SEQ ID NO: 5483180 - DNA, 21 bp, Homo sapiens
gcccatgtatggccaggaagt

SEQ ID NO: 5483181 - DNA, 21 bp, Homo sapiens
gcccatgtcgcgctcagcatg

SEQ ID NO: 5483182 - DNA, 20 bp, Homo sapiens
gcccatgtcttctgctgttc

SEQ ID NO: 5483183 - DNA, 14 bp, Homo sapiens
gcccatgtgactgt

SEQ ID NO: 5483184 - DNA, 17 bp, Homo sapiens
gcccatgtgtatggaag

SEQ ID NO: 5483185 - DNA, 17 bp, Homo sapiens
gcccatgtgtcccctca

SEQ ID NO: 5483186 - DNA, 23 bp, Homo sapiens
gcccatgtgtcccctcactctgt

SEQ ID NO: 5483187 - DNA, 23 bp, Homo sapiens
gcccatgttaagtcctccctgac

SEQ ID NO: 5483188 - DNA, 15 bp, Homo sapiens
gcccatgttctgccc

SEQ ID NO: 5483189 - DNA, 23 bp, Homo sapiens
gcccatgttctgcccccagccca

SEQ ID NO: 5483190 - DNA, 23 bp, Homo sapiens
gcccattagttgagaaagtcaca

SEQ ID NO: 5483191 - DNA, 14 bp, Homo sapiens
gcccattcagcctc

SEQ ID NO: 5483192 - DNA, 17 bp, Homo sapiens
gcccattcagcctcgtc

SEQ ID NO: 5483193 - DNA, 19 bp, Homo sapiens
gcccattcattccattctg

SEQ ID NO: 5483194 - DNA, 23 bp, Homo sapiens
gcccattcattccattctggaag

SEQ ID NO: 5483195 - DNA, 13 bp, Homo sapiens
gcccattcccacc

SEQ ID NO: 5483196 - DNA, 22 bp, Homo sapiens
gcccattccccagcctctcttc

SEQ ID NO: 5483197 - DNA, 13 bp, Homo sapiens
gcccattcctgcc

SEQ ID NO: 5483198 - DNA, 14 bp, Homo sapiens
gcccattcctgcct

SEQ ID NO: 5483199 - DNA, 22 bp, Homo sapiens
gcccattcctgcctggtccagt

SEQ ID NO: 5483200 - DNA, 18 bp, Homo sapiens
gcccattcgtctgtccca

SEQ ID NO: 5483201 - DNA, 13 bp, Homo sapiens
gcccattctactt

SEQ ID NO: 5483202 - DNA, 18 bp, Homo sapiens
gcccattctacttgctct

SEQ ID NO: 5483203 - DNA, 19 bp, Homo sapiens
gcccattctctctcctgtc

SEQ ID NO: 5483204 - DNA, 18 bp, Homo sapiens
gcccattctgcatgccct

SEQ ID NO: 5483205 - DNA, 14 bp, Homo sapiens
gcccattcttctgg

SEQ ID NO: 5483206 - DNA, 12 bp, Homo sapiens
gcccattgctgc

SEQ ID NO: 5483207 - DNA, 15 bp, Homo sapiens
gcccattgctgcaaa

SEQ ID NO: 5483208 - DNA, 14 bp, Homo sapiens
gcccattgctgcca

SEQ ID NO: 5483209 - DNA, 17 bp, Homo sapiens
gcccattgctgccaagg

SEQ ID NO: 5483210 - DNA, 18 bp, Homo sapiens
gcccattggagcacctgg

SEQ ID NO: 5483211 - DNA, 22 bp, Homo sapiens
gcccattggagcacctgggccc

SEQ ID NO: 5483212 - DNA, 22 bp, Homo sapiens
gcccattggccgagctcctggg

SEQ ID NO: 5483213 - DNA, 13 bp, Homo sapiens
gcccattgtcctc

SEQ ID NO: 5483214 - DNA, 21 bp, Homo sapiens
gcccattgtcctccttttcac

SEQ ID NO: 5483215 - DNA, 23 bp, Homo sapiens
gcccattgtggaggcggtggggg

SEQ ID NO: 5483216 - DNA, 21 bp, Homo sapiens
gcccatttacacttttgagac

SEQ ID NO: 5483217 - DNA, 23 bp, Homo sapiens
gcccatttagaggatgtggctgt

SEQ ID NO: 5483218 - DNA, 18 bp, Homo sapiens
gcccatttcaattctcaa

SEQ ID NO: 5483219 - DNA, 18 bp, Homo sapiens
gcccatttcatattcttt

SEQ ID NO: 5483220 - DNA, 19 bp, Homo sapiens
gcccatttgggcagagagg

SEQ ID NO: 5483221 - DNA, 20 bp, Homo sapiens
gcccatttgggcagagaggc

SEQ ID NO: 5483222 - DNA, 18 bp, Homo sapiens
gcccattttatctttgaa

SEQ ID NO: 5483223 - DNA, 14 bp, Homo sapiens
gcccatttttgcta

SEQ ID NO: 5483224 - DNA, 22 bp, Homo sapiens
gccccaaaaccacagccctgtc

SEQ ID NO: 5483225 - DNA, 17 bp, Homo sapiens
gccccaaacaaatatgc

SEQ ID NO: 5483226 - DNA, 18 bp, Homo sapiens
gccccaaacaaatatgca

SEQ ID NO: 5483227 - DNA, 11 bp, Homo sapiens
gccccagagaa

SEQ ID NO: 5483228 - DNA, 19 bp, Homo sapiens
gccccagagaaactgccac

SEQ ID NO: 5483229 - DNA, 12 bp, Homo sapiens
gccccagagact

SEQ ID NO: 5483230 - DNA, 13 bp, Homo sapiens
gccccagagactg

SEQ ID NO: 5483231 - DNA, 16 bp, Homo sapiens
gccccagagactgccc

SEQ ID NO: 5483232 - DNA, 21 bp, Homo sapiens
gccccagagactgcccaccct

SEQ ID NO: 5483233 - DNA, 23 bp, Homo sapiens
gccccagagactgcccaccctgg

SEQ ID NO: 5483234 - DNA, 12 bp, Homo sapiens
gccccagagaga

SEQ ID NO: 5483235 - DNA, 13 bp, Homo sapiens
gccccagagagag

SEQ ID NO: 5483236 - DNA, 22 bp, Homo sapiens
gccccagagcagggtgttggga

SEQ ID NO: 5483237 - DNA, 21 bp, Homo sapiens
gccccagagctccgatgcccg

SEQ ID NO: 5483238 - DNA, 12 bp, Homo sapiens
gccccagagctg

SEQ ID NO: 5483239 - DNA, 14 bp, Homo sapiens
gccccagagctgtt

SEQ ID NO: 5483240 - DNA, 22 bp, Homo sapiens
gccccagagctgtttatggcct

SEQ ID NO: 5483241 - DNA, 12 bp, Homo sapiens
gccccagaggcc

SEQ ID NO: 5483242 - DNA, 17 bp, Homo sapiens
gccccagaggccctgga

SEQ ID NO: 5483243 - DNA, 18 bp, Homo sapiens
gccccagaggccctggag

SEQ ID NO: 5483244 - DNA, 19 bp, Homo sapiens
gccccagaggccctggagg

SEQ ID NO: 5483245 - DNA, 16 bp, Homo sapiens
gccccagagtgcttta

SEQ ID NO: 5483246 - DNA, 15 bp, Homo sapiens
gccccagataccatg

SEQ ID NO: 5483247 - DNA, 20 bp, Homo sapiens
gccccagatcaccagcccgg

SEQ ID NO: 5483248 - DNA, 20 bp, Homo sapiens
gccccagatctgcctgggcc

SEQ ID NO: 5483249 - DNA, 21 bp, Homo sapiens
gccccagatgcctcctctgtc

SEQ ID NO: 5483250 - DNA, 15 bp, Homo sapiens
gccccagcaacacgt

SEQ ID NO: 5483251 - DNA, 13 bp, Homo sapiens
gccccagcacagc

SEQ ID NO: 5483252 - DNA, 18 bp, Homo sapiens
gccccagcaccaccaggt

SEQ ID NO: 5483253 - DNA, 19 bp, Homo sapiens
gccccagcaccaccaggtc

SEQ ID NO: 5483254 - DNA, 17 bp, Homo sapiens
gccccagcactcacacc

SEQ ID NO: 5483255 - DNA, 20 bp, Homo sapiens
gccccagcagccctcaacag

SEQ ID NO: 5483256 - DNA, 16 bp, Homo sapiens
gccccagccaagcctg

SEQ ID NO: 5483257 - DNA, 13 bp, Homo sapiens
gccccagccaagt

SEQ ID NO: 5483258 - DNA, 11 bp, Homo sapiens
gccccagccag

SEQ ID NO: 5483259 - DNA, 12 bp, Homo sapiens
gccccagccaga

SEQ ID NO: 5483260 - DNA, 14 bp, Homo sapiens
gccccagccagagt

SEQ ID NO: 5483261 - DNA, 20 bp, Homo sapiens
gccccagccagagttcctgc

SEQ ID NO: 5483262 - DNA, 13 bp, Homo sapiens
gccccagccagcc

SEQ ID NO: 5483263 - DNA, 21 bp, Homo sapiens
gccccagccagcccttcccag

SEQ ID NO: 5483264 - DNA, 15 bp, Homo sapiens
gccccagcccaagtc

SEQ ID NO: 5483265 - DNA, 15 bp, Homo sapiens
gccccagcccagaca

SEQ ID NO: 5483266 - DNA, 22 bp, Homo sapiens
gccccagcccagccccactcct

SEQ ID NO: 5483267 - DNA, 11 bp, Homo sapiens
gccccagcccc

SEQ ID NO: 5483268 - DNA, 21 bp, Homo sapiens
gccccagccccaatccagaga

SEQ ID NO: 5483269 - DNA, 13 bp, Homo sapiens
gccccagccccca

SEQ ID NO: 5483270 - DNA, 12 bp, Homo sapiens
gccccagccccg

SEQ ID NO: 5483271 - DNA, 13 bp, Homo sapiens
gccccagccccta

SEQ ID NO: 5483272 - DNA, 16 bp, Homo sapiens
gccccagccccttctc

SEQ ID NO: 5483273 - DNA, 21 bp, Homo sapiens
gccccagccccttctcccagc

SEQ ID NO: 5483274 - DNA, 23 bp, Homo sapiens
gccccagccccttctcccagcac

SEQ ID NO: 5483275 - DNA, 20 bp, Homo sapiens
gccccagcccgacaggcatg

SEQ ID NO: 5483276 - DNA, 18 bp, Homo sapiens
gccccagcctccctgaag

SEQ ID NO: 5483277 - DNA, 20 bp, Homo sapiens
gccccagcctggcccagctc

SEQ ID NO: 5483278 - DNA, 22 bp, Homo sapiens
gccccagcctggcccagctccc

SEQ ID NO: 5483279 - DNA, 12 bp, Homo sapiens
gccccagcctgt

SEQ ID NO: 5483280 - DNA, 14 bp, Homo sapiens
gccccagcgcggct

SEQ ID NO: 5483281 - DNA, 22 bp, Homo sapiens
gccccagcgcggcttggccgcc

SEQ ID NO: 5483282 - DNA, 21 bp, Homo sapiens
gccccagcgggctggcgggcc

SEQ ID NO: 5483283 - DNA, 14 bp, Homo sapiens
gccccagctctgag

SEQ ID NO: 5483284 - DNA, 22 bp, Homo sapiens
gccccagctctgaggggagggg

SEQ ID NO: 5483285 - DNA, 13 bp, Homo sapiens
gccccagctgcca

SEQ ID NO: 5483286 - DNA, 14 bp, Homo sapiens
gccccagctgccag

SEQ ID NO: 5483287 - DNA, 15 bp, Homo sapiens
gccccagctgccagg

SEQ ID NO: 5483288 - DNA, 22 bp, Homo sapiens
gccccagctgccaggcggccct

SEQ ID NO: 5483289 - DNA, 15 bp, Homo sapiens
gccccagctggctgg

SEQ ID NO: 5483290 - DNA, 17 bp, Homo sapiens
gccccagctggctgggt

SEQ ID NO: 5483291 - DNA, 11 bp, Homo sapiens
gccccagcttg

SEQ ID NO: 5483292 - DNA, 14 bp, Homo sapiens
gccccaggaagccg

SEQ ID NO: 5483293 - DNA, 15 bp, Homo sapiens
gccccaggaccagct

SEQ ID NO: 5483294 - DNA, 19 bp, Homo sapiens
gccccaggaccagctcagg

SEQ ID NO: 5483295 - DNA, 22 bp, Homo sapiens
gccccaggaccagctcaggaca

SEQ ID NO: 5483296 - DNA, 18 bp, Homo sapiens
gccccaggactctggcac

SEQ ID NO: 5483297 - DNA, 21 bp, Homo sapiens
gccccaggactctggcacttc

SEQ ID NO: 5483298 - DNA, 11 bp, Homo sapiens
gccccaggaga

SEQ ID NO: 5483299 - DNA, 12 bp, Homo sapiens
gccccaggagaa

SEQ ID NO: 5483300 - DNA, 13 bp, Homo sapiens
gccccaggagaag

SEQ ID NO: 5483301 - DNA, 12 bp, Homo sapiens
gccccaggcacc

SEQ ID NO: 5483302 - DNA, 15 bp, Homo sapiens
gccccaggcaccgcc

SEQ ID NO: 5483303 - DNA, 12 bp, Homo sapiens
gccccaggcagg

SEQ ID NO: 5483304 - DNA, 19 bp, Homo sapiens
gccccaggcaggctgtgcg

SEQ ID NO: 5483305 - DNA, 22 bp, Homo sapiens
gccccaggcagggccaaccctt

SEQ ID NO: 5483306 - DNA, 18 bp, Homo sapiens
gccccaggccagctgcgg

SEQ ID NO: 5483307 - DNA, 19 bp, Homo sapiens
gccccaggccagctgcggc

SEQ ID NO: 5483308 - DNA, 18 bp, Homo sapiens
gccccaggccccagacag

SEQ ID NO: 5483309 - DNA, 19 bp, Homo sapiens
gccccaggccccagacagg

SEQ ID NO: 5483310 - DNA, 16 bp, Homo sapiens
gccccaggcccgccct

SEQ ID NO: 5483311 - DNA, 16 bp, Homo sapiens
gccccaggccctacta

SEQ ID NO: 5483312 - DNA, 17 bp, Homo sapiens
gccccaggccctccctg

SEQ ID NO: 5483313 - DNA, 15 bp, Homo sapiens
gccccaggccggagc

SEQ ID NO: 5483314 - DNA, 17 bp, Homo sapiens
gccccaggccggagccc

SEQ ID NO: 5483315 - DNA, 18 bp, Homo sapiens
gccccaggccggagccca

SEQ ID NO: 5483316 - DNA, 23 bp, Homo sapiens
gccccaggcctggacgggccctc

SEQ ID NO: 5483317 - DNA, 15 bp, Homo sapiens
gccccaggcctggcc

SEQ ID NO: 5483318 - DNA, 18 bp, Homo sapiens
gccccaggcctggcctcg

SEQ ID NO: 5483319 - DNA, 17 bp, Homo sapiens
gccccaggcggaggggc

SEQ ID NO: 5483320 - DNA, 22 bp, Homo sapiens
gccccaggcggaggggcttgga

SEQ ID NO: 5483321 - DNA, 21 bp, Homo sapiens
gccccaggctcaggctgccca

SEQ ID NO: 5483322 - DNA, 24 bp, Homo sapiens
gccccaggctcccctggtctcctc

SEQ ID NO: 5483323 - DNA, 16 bp, Homo sapiens
gccccaggctggatgc

SEQ ID NO: 5483324 - DNA, 16 bp, Homo sapiens
gccccaggcttccgcg

SEQ ID NO: 5483325 - DNA, 19 bp, Homo sapiens
gccccagggacagaggcca

SEQ ID NO: 5483326 - DNA, 12 bp, Homo sapiens
gccccagggcag

SEQ ID NO: 5483327 - DNA, 12 bp, Homo sapiens
gccccagggccc

SEQ ID NO: 5483328 - DNA, 16 bp, Homo sapiens
gccccagggccctgct

SEQ ID NO: 5483329 - DNA, 20 bp, Homo sapiens
gccccagggccctgctcagg

SEQ ID NO: 5483330 - DNA, 19 bp, Homo sapiens
gccccaggggaacactggg

SEQ ID NO: 5483331 - DNA, 21 bp, Homo sapiens
gccccaggggacgtgggccct

SEQ ID NO: 5483332 - DNA, 15 bp, Homo sapiens
gccccaggggcagca

SEQ ID NO: 5483333 - DNA, 17 bp, Homo sapiens
gccccaggggcagcaag

SEQ ID NO: 5483334 - DNA, 19 bp, Homo sapiens
gccccaggggggcctcctc

SEQ ID NO: 5483335 - DNA, 13 bp, Homo sapiens
gccccaggggtgc

SEQ ID NO: 5483336 - DNA, 14 bp, Homo sapiens
gccccagggtctga

SEQ ID NO: 5483337 - DNA, 16 bp, Homo sapiens
gccccagggtctgaaa

SEQ ID NO: 5483338 - DNA, 17 bp, Homo sapiens
gccccagggtctgaaag

SEQ ID NO: 5483339 - DNA, 18 bp, Homo sapiens
gccccagggtctgaaagg

SEQ ID NO: 5483340 - DNA, 16 bp, Homo sapiens
gccccagggtcttccc

SEQ ID NO: 5483341 - DNA, 23 bp, Homo sapiens
gccccagggtcttccctacctca

SEQ ID NO: 5483342 - DNA, 21 bp, Homo sapiens
gccccagggtgagcagggccc

SEQ ID NO: 5483343 - DNA, 23 bp, Homo sapiens
gccccagggtgagcagggccctc

SEQ ID NO: 5483344 - DNA, 14 bp, Homo sapiens
gccccagggttgaa

SEQ ID NO: 5483345 - DNA, 20 bp, Homo sapiens
gccccagtcagaagttctgg

SEQ ID NO: 5483346 - DNA, 23 bp, Homo sapiens
gccccagtcccaccctgctgctg

SEQ ID NO: 5483347 - DNA, 12 bp, Homo sapiens
gccccagtgccc

SEQ ID NO: 5483348 - DNA, 16 bp, Homo sapiens
gccccagtgcccacag

SEQ ID NO: 5483349 - DNA, 19 bp, Homo sapiens
gccccagtgctggaaggga

SEQ ID NO: 5483350 - DNA, 22 bp, Homo sapiens
gccccagtgttatttattcccc

SEQ ID NO: 5483351 - DNA, 24 bp, Homo sapiens
gccccagtgttatttattccccag

SEQ ID NO: 5483352 - DNA, 18 bp, Homo sapiens
gccccagttcaatctccc

SEQ ID NO: 5483353 - DNA, 15 bp, Homo sapiens
gccccatagaaaaca

SEQ ID NO: 5483354 - DNA, 13 bp, Homo sapiens
gccccatcactgc

SEQ ID NO: 5483355 - DNA, 22 bp, Homo sapiens
gccccatcactgcgccactgct

SEQ ID NO: 5483356 - DNA, 19 bp, Homo sapiens
gccccatcagaacctgagc

SEQ ID NO: 5483357 - DNA, 20 bp, Homo sapiens
gccccatcagaacctgagct

SEQ ID NO: 5483358 - DNA, 16 bp, Homo sapiens
gccccatcagcagctt

SEQ ID NO: 5483359 - DNA, 19 bp, Homo sapiens
gccccatcagcagcttgac

SEQ ID NO: 5483360 - DNA, 16 bp, Homo sapiens
gccccatcagctgcca

SEQ ID NO: 5483361 - DNA, 14 bp, Homo sapiens
gccccatcagtgct

SEQ ID NO: 5483362 - DNA, 20 bp, Homo sapiens
gccccatcattgcacctgca

SEQ ID NO: 5483363 - DNA, 18 bp, Homo sapiens
gccccatccagcatgtgt

SEQ ID NO: 5483364 - DNA, 19 bp, Homo sapiens
gccccatccagcatgtgtg

SEQ ID NO: 5483365 - DNA, 22 bp, Homo sapiens
gccccatccagcatgtgtgtgt

SEQ ID NO: 5483366 - DNA, 17 bp, Homo sapiens
gccccatcctcatccct

SEQ ID NO: 5483367 - DNA, 14 bp, Homo sapiens
gccccatcctccag

SEQ ID NO: 5483368 - DNA, 16 bp, Homo sapiens
gccccatcctccagca

SEQ ID NO: 5483369 - DNA, 17 bp, Homo sapiens
gccccatcctccagcag

SEQ ID NO: 5483370 - DNA, 17 bp, Homo sapiens
gccccatcctcctgccc

SEQ ID NO: 5483371 - DNA, 14 bp, Homo sapiens
gccccatcctctgt

SEQ ID NO: 5483372 - DNA, 23 bp, Homo sapiens
gccccatcctctgtacagagccc

SEQ ID NO: 5483373 - DNA, 15 bp, Homo sapiens
gccccatcctggccc

SEQ ID NO: 5483374 - DNA, 14 bp, Homo sapiens
gccccatcctgggc

SEQ ID NO: 5483375 - DNA, 15 bp, Homo sapiens
gccccatccttcccg

SEQ ID NO: 5483376 - DNA, 24 bp, Homo sapiens
gccccatccttcccgcagcaccag

SEQ ID NO: 5483377 - DNA, 17 bp, Homo sapiens
gccccatcgccccaccg

SEQ ID NO: 5483378 - DNA, 16 bp, Homo sapiens
gccccatcggccaaga

SEQ ID NO: 5483379 - DNA, 18 bp, Homo sapiens
gccccatctcatcctggc

SEQ ID NO: 5483380 - DNA, 20 bp, Homo sapiens
gccccatctcccctcagctc

SEQ ID NO: 5483381 - DNA, 13 bp, Homo sapiens
gccccatctcctc

SEQ ID NO: 5483382 - DNA, 14 bp, Homo sapiens
gccccatcttgatc

SEQ ID NO: 5483383 - DNA, 20 bp, Homo sapiens
gccccatcttgatctttgag

SEQ ID NO: 5483384 - DNA, 21 bp, Homo sapiens
gccccatcttgatctttgagc

SEQ ID NO: 5483385 - DNA, 19 bp, Homo sapiens
gccccatgaagccacagcc

SEQ ID NO: 5483386 - DNA, 15 bp, Homo sapiens
gccccatgacctcca

SEQ ID NO: 5483387 - DNA, 17 bp, Homo sapiens
gccccatgacctccagc

SEQ ID NO: 5483388 - DNA, 18 bp, Homo sapiens
gccccatgacctccagct

SEQ ID NO: 5483389 - DNA, 13 bp, Homo sapiens
gccccatgagaca

SEQ ID NO: 5483390 - DNA, 23 bp, Homo sapiens
gccccatgcctgtccagcctggg

SEQ ID NO: 5483391 - DNA, 16 bp, Homo sapiens
gccccatgctctgccc

SEQ ID NO: 5483392 - DNA, 13 bp, Homo sapiens
gccccatgctgga

SEQ ID NO: 5483393 - DNA, 14 bp, Homo sapiens
gccccatgctggag

SEQ ID NO: 5483394 - DNA, 15 bp, Homo sapiens
gccccatgctggagc

SEQ ID NO: 5483395 - DNA, 17 bp, Homo sapiens
gccccatgctggagcct

SEQ ID NO: 5483396 - DNA, 18 bp, Homo sapiens
gccccatgctggagcctg

SEQ ID NO: 5483397 - DNA, 22 bp, Homo sapiens
gccccatggcagctcctgacct

SEQ ID NO: 5483398 - DNA, 15 bp, Homo sapiens
gccccatgggccctc

SEQ ID NO: 5483399 - DNA, 19 bp, Homo sapiens
gccccatgggccctcagcg

SEQ ID NO: 5483400 - DNA, 19 bp, Homo sapiens
gccccatggtcacagaccc

SEQ ID NO: 5483401 - DNA, 23 bp, Homo sapiens
gccccatgtgtcctggtgagaaa

SEQ ID NO: 5483402 - DNA, 20 bp, Homo sapiens
gccccattcacggcctggca

SEQ ID NO: 5483403 - DNA, 22 bp, Homo sapiens
gccccattcagaactctcagac

SEQ ID NO: 5483404 - DNA, 12 bp, Homo sapiens
gccccattccag

SEQ ID NO: 5483405 - DNA, 15 bp, Homo sapiens
gccccattcctaaga

SEQ ID NO: 5483406 - DNA, 17 bp, Homo sapiens
gccccccggcctgatgg

SEQ ID NO: 5483407 - DNA, 17 bp, Homo sapiens
gccccccggcctggccc

SEQ ID NO: 5483408 - DNA, 21 bp, Homo sapiens
gcccccctagaataatctcat

SEQ ID NO: 5483409 - DNA, 11 bp, Homo sapiens
gcccccctcaa

SEQ ID NO: 5483410 - DNA, 15 bp, Homo sapiens
gcccccctccaggca

SEQ ID NO: 5483411 - DNA, 16 bp, Homo sapiens
gcccccctcccaacag

SEQ ID NO: 5483412 - DNA, 13 bp, Homo sapiens
gcccccctcccag

SEQ ID NO: 5483413 - DNA, 15 bp, Homo sapiens
gcccccctcccagag

SEQ ID NO: 5483414 - DNA, 17 bp, Homo sapiens
gcccccctcccagaggc

SEQ ID NO: 5483415 - DNA, 12 bp, Homo sapiens
gcccccctcctc

SEQ ID NO: 5483416 - DNA, 14 bp, Homo sapiens
gcccccctcctcca

SEQ ID NO: 5483417 - DNA, 15 bp, Homo sapiens
gcccccctcctccag

SEQ ID NO: 5483418 - DNA, 16 bp, Homo sapiens
gcccccctctgccttt

SEQ ID NO: 5483419 - DNA, 13 bp, Homo sapiens
gcccccctgctgc

SEQ ID NO: 5483420 - DNA, 18 bp, Homo sapiens
gccccccttcccacccct

SEQ ID NO: 5483421 - DNA, 13 bp, Homo sapiens
gcccccctttggc

SEQ ID NO: 5483422 - DNA, 20 bp, Homo sapiens
gcccccctttggtttggcct

SEQ ID NO: 5483423 - DNA, 22 bp, Homo sapiens
gcccccctttggtttggcctcc

SEQ ID NO: 5483424 - DNA, 17 bp, Homo sapiens
gcccccgaactgtgcct

SEQ ID NO: 5483425 - DNA, 14 bp, Homo sapiens
gcccccgagccctg

SEQ ID NO: 5483426 - DNA, 22 bp, Homo sapiens
gcccccgagccctgactcctgg

SEQ ID NO: 5483427 - DNA, 23 bp, Homo sapiens
gcccccgagccctgactcctgga

SEQ ID NO: 5483428 - DNA, 18 bp, Homo sapiens
gcccccgcatcccctgcc

SEQ ID NO: 5483429 - DNA, 20 bp, Homo sapiens
gcccccgcatcccctgcctc

SEQ ID NO: 5483430 - DNA, 14 bp, Homo sapiens
gcccccgcccagcc

SEQ ID NO: 5483431 - DNA, 12 bp, Homo sapiens
gcccccgcccca

SEQ ID NO: 5483432 - DNA, 15 bp, Homo sapiens
gcccccgccccagag

SEQ ID NO: 5483433 - DNA, 21 bp, Homo sapiens
gcccccgccccagagtggccc

SEQ ID NO: 5483434 - DNA, 22 bp, Homo sapiens
gcccccgccccagagtggccca

SEQ ID NO: 5483435 - DNA, 16 bp, Homo sapiens
gcccccgccccctccc

SEQ ID NO: 5483436 - DNA, 18 bp, Homo sapiens
gcccccgcccctccccct

SEQ ID NO: 5483437 - DNA, 21 bp, Homo sapiens
gcccccgcccctccccctaca

SEQ ID NO: 5483438 - DNA, 19 bp, Homo sapiens
gcccccgcccgcacagctc

SEQ ID NO: 5483439 - DNA, 16 bp, Homo sapiens
gcccccgccctcgctc

SEQ ID NO: 5483440 - DNA, 14 bp, Homo sapiens
gcccccgcctgcca

SEQ ID NO: 5483441 - DNA, 15 bp, Homo sapiens
gcccccgcctgccac

SEQ ID NO: 5483442 - DNA, 13 bp, Homo sapiens
gcccccgcgccct

SEQ ID NO: 5483443 - DNA, 19 bp, Homo sapiens
gcccccgcgccctccctcc

SEQ ID NO: 5483444 - DNA, 16 bp, Homo sapiens
gcccccgctcatgggc

SEQ ID NO: 5483445 - DNA, 21 bp, Homo sapiens
gcccccgctcccgctcccagg

SEQ ID NO: 5483446 - DNA, 20 bp, Homo sapiens
gcccccggaggcgcccacct

SEQ ID NO: 5483447 - DNA, 21 bp, Homo sapiens
gcccccggaggcgcccacctg

SEQ ID NO: 5483448 - DNA, 22 bp, Homo sapiens
gcccccggaggcgcccacctgc

SEQ ID NO: 5483449 - DNA, 14 bp, Homo sapiens
gcccccggccccct

SEQ ID NO: 5483450 - DNA, 14 bp, Homo sapiens
gcccccggctttcc

SEQ ID NO: 5483451 - DNA, 13 bp, Homo sapiens
gcccccgggcctg

SEQ ID NO: 5483452 - DNA, 16 bp, Homo sapiens
gcccccgggcctgcac

SEQ ID NO: 5483453 - DNA, 18 bp, Homo sapiens
gcccccgggcctgcacag

SEQ ID NO: 5483454 - DNA, 16 bp, Homo sapiens
gcccccgtcccacctc

SEQ ID NO: 5483455 - DNA, 16 bp, Homo sapiens
gcccccgtcttctctc

SEQ ID NO: 5483456 - DNA, 12 bp, Homo sapiens
gccccctaggat

SEQ ID NO: 5483457 - DNA, 19 bp, Homo sapiens
gccccctattgtctccaag

SEQ ID NO: 5483458 - DNA, 21 bp, Homo sapiens
gccccctattgtctccaaggt

SEQ ID NO: 5483459 - DNA, 15 bp, Homo sapiens
gccccctcaccccag

SEQ ID NO: 5483460 - DNA, 19 bp, Homo sapiens
gccccctcaccccagctcc

SEQ ID NO: 5483461 - DNA, 15 bp, Homo sapiens
gccccctcacctctc

SEQ ID NO: 5483462 - DNA, 11 bp, Homo sapiens
gccccctcagg

SEQ ID NO: 5483463 - DNA, 15 bp, Homo sapiens
gccccctccacacca

SEQ ID NO: 5483464 - DNA, 14 bp, Homo sapiens
gccccctcccaccg

SEQ ID NO: 5483465 - DNA, 21 bp, Homo sapiens
gccccctcccaccgctgcctc

SEQ ID NO: 5483466 - DNA, 13 bp, Homo sapiens
gccccctccccca

SEQ ID NO: 5483467 - DNA, 16 bp, Homo sapiens
gccccctcccccatgg

SEQ ID NO: 5483468 - DNA, 19 bp, Homo sapiens
gccccctccccccagactc

SEQ ID NO: 5483469 - DNA, 20 bp, Homo sapiens
gccccctccccccagactct

SEQ ID NO: 5483470 - DNA, 14 bp, Homo sapiens
gccccctcccccgc

SEQ ID NO: 5483471 - DNA, 18 bp, Homo sapiens
gccccctcccccgcagac

SEQ ID NO: 5483472 - DNA, 20 bp, Homo sapiens
gccccctcccccgcagacag

SEQ ID NO: 5483473 - DNA, 22 bp, Homo sapiens
gccccctccccggcaccctctg

SEQ ID NO: 5483474 - DNA, 13 bp, Homo sapiens
gccccctcccctc

SEQ ID NO: 5483475 - DNA, 18 bp, Homo sapiens
gccccctccctgctccca

SEQ ID NO: 5483476 - DNA, 14 bp, Homo sapiens
gccccctccctgga

SEQ ID NO: 5483477 - DNA, 17 bp, Homo sapiens
gccccctcccttcacag

SEQ ID NO: 5483478 - DNA, 16 bp, Homo sapiens
gccccctcctctccca

SEQ ID NO: 5483479 - DNA, 17 bp, Homo sapiens
gccccctcctctcccat

SEQ ID NO: 5483480 - DNA, 21 bp, Homo sapiens
gccccctcctctcccatcccc

SEQ ID NO: 5483481 - DNA, 12 bp, Homo sapiens
gccccctcctga

SEQ ID NO: 5483482 - DNA, 15 bp, Homo sapiens
gccccctcctgaacc

SEQ ID NO: 5483483 - DNA, 21 bp, Homo sapiens
gccccctccttttcccactgg

SEQ ID NO: 5483484 - DNA, 14 bp, Homo sapiens
gccccctcgcgccc

SEQ ID NO: 5483485 - DNA, 19 bp, Homo sapiens
gccccctcggcccctcacc

SEQ ID NO: 5483486 - DNA, 20 bp, Homo sapiens
gccccctcggcccctcacca

SEQ ID NO: 5483487 - DNA, 12 bp, Homo sapiens
gccccctcgtgc

SEQ ID NO: 5483488 - DNA, 16 bp, Homo sapiens
gccccctcgtgccagt

SEQ ID NO: 5483489 - DNA, 17 bp, Homo sapiens
gccccctcgtgccagtc

SEQ ID NO: 5483490 - DNA, 14 bp, Homo sapiens
gccccctctaggcc

SEQ ID NO: 5483491 - DNA, 17 bp, Homo sapiens
gccccctctcctgaagc

SEQ ID NO: 5483492 - DNA, 21 bp, Homo sapiens
gccccctctcttaccccgtcc

SEQ ID NO: 5483493 - DNA, 23 bp, Homo sapiens
gccccctgaaacatgtgcccctg

SEQ ID NO: 5483494 - DNA, 17 bp, Homo sapiens
gccccctgaccactcag

SEQ ID NO: 5483495 - DNA, 18 bp, Homo sapiens
gccccctgaccactcaga

SEQ ID NO: 5483496 - DNA, 19 bp, Homo sapiens
gccccctgaccactcagag

SEQ ID NO: 5483497 - DNA, 12 bp, Homo sapiens
gccccctgcacc

SEQ ID NO: 5483498 - DNA, 19 bp, Homo sapiens
gccccctgcacccacccct

SEQ ID NO: 5483499 - DNA, 11 bp, Homo sapiens
gccccctgcag

SEQ ID NO: 5483500 - DNA, 12 bp, Homo sapiens
gccccctgcagg

SEQ ID NO: 5483501 - DNA, 18 bp, Homo sapiens
gccccctgcaggaaggag

SEQ ID NO: 5483502 - DNA, 20 bp, Homo sapiens
gccccctgcaggaaggagct

SEQ ID NO: 5483503 - DNA, 11 bp, Homo sapiens
gccccctgcca

SEQ ID NO: 5483504 - DNA, 19 bp, Homo sapiens
gccccctgccagttgaagt

SEQ ID NO: 5483505 - DNA, 18 bp, Homo sapiens
gccccctgccccccagcc

SEQ ID NO: 5483506 - DNA, 14 bp, Homo sapiens
gccccctgccctcc

SEQ ID NO: 5483507 - DNA, 19 bp, Homo sapiens
gccccctgccctcccctct

SEQ ID NO: 5483508 - DNA, 13 bp, Homo sapiens
gccccctgcctgc

SEQ ID NO: 5483509 - DNA, 14 bp, Homo sapiens
gccccctgcctgcc

SEQ ID NO: 5483510 - DNA, 13 bp, Homo sapiens
gccccctgctggc

SEQ ID NO: 5483511 - DNA, 20 bp, Homo sapiens
gccccctgctggctcttctg

SEQ ID NO: 5483512 - DNA, 18 bp, Homo sapiens
gccccctgcttcagtccc

SEQ ID NO: 5483513 - DNA, 13 bp, Homo sapiens
gccccctgcttct

SEQ ID NO: 5483514 - DNA, 20 bp, Homo sapiens
gccccctgcttggccaggag

SEQ ID NO: 5483515 - DNA, 21 bp, Homo sapiens
gccccctgcttggccaggagg

SEQ ID NO: 5483516 - DNA, 13 bp, Homo sapiens
gccccctggatgg

SEQ ID NO: 5483517 - DNA, 21 bp, Homo sapiens
gccccctggatgtcccctgtc

SEQ ID NO: 5483518 - DNA, 12 bp, Homo sapiens
gccccctggcag

SEQ ID NO: 5483519 - DNA, 13 bp, Homo sapiens
gccccctggcctc

SEQ ID NO: 5483520 - DNA, 19 bp, Homo sapiens
gccccctggcctctgtgcc

SEQ ID NO: 5483521 - DNA, 14 bp, Homo sapiens
gccccctggcggca

SEQ ID NO: 5483522 - DNA, 15 bp, Homo sapiens
gccccctggctgact

SEQ ID NO: 5483523 - DNA, 12 bp, Homo sapiens
gccccctgggct

SEQ ID NO: 5483524 - DNA, 11 bp, Homo sapiens
gccccctgggg

SEQ ID NO: 5483525 - DNA, 23 bp, Homo sapiens
gccccctggggggcacagccaga

SEQ ID NO: 5483526 - DNA, 14 bp, Homo sapiens
gccccctggtctct

SEQ ID NO: 5483527 - DNA, 17 bp, Homo sapiens
gccccctggtctctggt

SEQ ID NO: 5483528 - DNA, 21 bp, Homo sapiens
gccccctgtacatttgtgctc

SEQ ID NO: 5483529 - DNA, 17 bp, Homo sapiens
gccccctgtccccaaga

SEQ ID NO: 5483530 - DNA, 18 bp, Homo sapiens
gccccctgtccccaagac

SEQ ID NO: 5483531 - DNA, 21 bp, Homo sapiens
gccccctgtccttcccacggc

SEQ ID NO: 5483532 - DNA, 16 bp, Homo sapiens
gccccctgtctctcag

SEQ ID NO: 5483533 - DNA, 12 bp, Homo sapiens
gccccctgtgcc

SEQ ID NO: 5483534 - DNA, 14 bp, Homo sapiens
gccccctgtgccag

SEQ ID NO: 5483535 - DNA, 15 bp, Homo sapiens
gccccctgtgccagc

SEQ ID NO: 5483536 - DNA, 16 bp, Homo sapiens
gccccctgtgccagct

SEQ ID NO: 5483537 - DNA, 19 bp, Homo sapiens
gccccctgtgccagctcag

SEQ ID NO: 5483538 - DNA, 23 bp, Homo sapiens
gccccctgtgcccacccagggcc

SEQ ID NO: 5483539 - DNA, 14 bp, Homo sapiens
gccccctgtgccct

SEQ ID NO: 5483540 - DNA, 17 bp, Homo sapiens
gcccccttcaggagcct

SEQ ID NO: 5483541 - DNA, 20 bp, Homo sapiens
gcccccttcctggcccctca

SEQ ID NO: 5483542 - DNA, 15 bp, Homo sapiens
gcccccttcctgtcc

SEQ ID NO: 5483543 - DNA, 22 bp, Homo sapiens
gcccccttcctgtccccagggg

SEQ ID NO: 5483544 - DNA, 15 bp, Homo sapiens
gcccccttctcccac

SEQ ID NO: 5483545 - DNA, 17 bp, Homo sapiens
gcccccttctcccacac

SEQ ID NO: 5483546 - DNA, 19 bp, Homo sapiens
gcccccttgcccatcagcc

SEQ ID NO: 5483547 - DNA, 16 bp, Homo sapiens
gcccccttgccctccg

SEQ ID NO: 5483548 - DNA, 19 bp, Homo sapiens
gcccccttgccctccgcct

SEQ ID NO: 5483549 - DNA, 18 bp, Homo sapiens
gccccctttcagatgtct

SEQ ID NO: 5483550 - DNA, 16 bp, Homo sapiens
gccccctttcccgggc

SEQ ID NO: 5483551 - DNA, 20 bp, Homo sapiens
gccccctttcccgggctgtc

SEQ ID NO: 5483552 - DNA, 23 bp, Homo sapiens
gccccctttcccgggctgtccac

SEQ ID NO: 5483553 - DNA, 19 bp, Homo sapiens
gccccctttgaccttcccc

SEQ ID NO: 5483554 - DNA, 19 bp, Homo sapiens
gccccctttgggcccaggg

SEQ ID NO: 5483555 - DNA, 21 bp, Homo sapiens
gccccctttgggcccagggac

SEQ ID NO: 5483556 - DNA, 20 bp, Homo sapiens
gccccgaccccacctgaggc

SEQ ID NO: 5483557 - DNA, 16 bp, Homo sapiens
gccccgacccctgtcc

SEQ ID NO: 5483558 - DNA, 14 bp, Homo sapiens
gccccgactccagc

SEQ ID NO: 5483559 - DNA, 20 bp, Homo sapiens
gccccgactccagccagcgc

SEQ ID NO: 5483560 - DNA, 18 bp, Homo sapiens
gccccgagacaccatcct

SEQ ID NO: 5483561 - DNA, 19 bp, Homo sapiens
gccccgagacaccatcctg

SEQ ID NO: 5483562 - DNA, 22 bp, Homo sapiens
gccccgagacaccatcctgagc

SEQ ID NO: 5483563 - DNA, 22 bp, Homo sapiens
gccccgaggacccagacccagt

SEQ ID NO: 5483564 - DNA, 15 bp, Homo sapiens
gccccgaggctcgag

SEQ ID NO: 5483565 - DNA, 15 bp, Homo sapiens
gccccgatggactcc

SEQ ID NO: 5483566 - DNA, 18 bp, Homo sapiens
gccccgatggactcctga

SEQ ID NO: 5483567 - DNA, 20 bp, Homo sapiens
gccccgatggactcctgacc

SEQ ID NO: 5483568 - DNA, 20 bp, Homo sapiens
gccccgcaaaacccactgac

SEQ ID NO: 5483569 - DNA, 20 bp, Homo sapiens
gccccgcacccccgccaggc

SEQ ID NO: 5483570 - DNA, 22 bp, Homo sapiens
gccccgcacccccgccaggcgc

SEQ ID NO: 5483571 - DNA, 21 bp, Homo sapiens
gccccgcacgactgcgggagc

SEQ ID NO: 5483572 - DNA, 22 bp, Homo sapiens
gccccgcacgactgcgggagcc

SEQ ID NO: 5483573 - DNA, 13 bp, Homo sapiens
gccccgcacgggc

SEQ ID NO: 5483574 - DNA, 15 bp, Homo sapiens
gccccgcagacctcc

SEQ ID NO: 5483575 - DNA, 21 bp, Homo sapiens
gccccgcagacctccccagcc

SEQ ID NO: 5483576 - DNA, 16 bp, Homo sapiens
gccccgccagggctgg

SEQ ID NO: 5483577 - DNA, 20 bp, Homo sapiens
gccccgccagggctggggac

SEQ ID NO: 5483578 - DNA, 14 bp, Homo sapiens
gccccgccatggtc

SEQ ID NO: 5483579 - DNA, 22 bp, Homo sapiens
gccccgccatggtcaccctcag

SEQ ID NO: 5483580 - DNA, 13 bp, Homo sapiens
gccccgcccacac

SEQ ID NO: 5483581 - DNA, 15 bp, Homo sapiens
gccccgcccacaccc

SEQ ID NO: 5483582 - DNA, 18 bp, Homo sapiens
gccccgcccacaccctcg

SEQ ID NO: 5483583 - DNA, 14 bp, Homo sapiens
gccccgcccaggct

SEQ ID NO: 5483584 - DNA, 18 bp, Homo sapiens
gccccgccccccagagcc

SEQ ID NO: 5483585 - DNA, 17 bp, Homo sapiens
gcccctggagcctcaga

SEQ ID NO: 5483586 - DNA, 20 bp, Homo sapiens
gcccctggaggctgcctccc

SEQ ID NO: 5483587 - DNA, 16 bp, Homo sapiens
gcccctggatgcagcc

SEQ ID NO: 5483588 - DNA, 18 bp, Homo sapiens
gcccctggatgcagcctc

SEQ ID NO: 5483589 - DNA, 18 bp, Homo sapiens
gcccctggcacctgtgtt

SEQ ID NO: 5483590 - DNA, 13 bp, Homo sapiens
gcccctggcacgt

SEQ ID NO: 5483591 - DNA, 19 bp, Homo sapiens
gcccctggcacgtcctcca

SEQ ID NO: 5483592 - DNA, 21 bp, Homo sapiens
gcccctggcacgtcctccacc

SEQ ID NO: 5483593 - DNA, 13 bp, Homo sapiens
gcccctggcactc

SEQ ID NO: 5483594 - DNA, 15 bp, Homo sapiens
gcccctggcactgca

SEQ ID NO: 5483595 - DNA, 22 bp, Homo sapiens
gcccctggcagagatgcctccc

SEQ ID NO: 5483596 - DNA, 22 bp, Homo sapiens
gcccctggcagcacagcccagg

SEQ ID NO: 5483597 - DNA, 16 bp, Homo sapiens
gcccctggcagcccct

SEQ ID NO: 5483598 - DNA, 17 bp, Homo sapiens
gcccctggcagcccctg

SEQ ID NO: 5483599 - DNA, 11 bp, Homo sapiens
gcccctggccc

SEQ ID NO: 5483600 - DNA, 12 bp, Homo sapiens
gcccctggccca

SEQ ID NO: 5483601 - DNA, 22 bp, Homo sapiens
gcccctggcccagcggcccctc

SEQ ID NO: 5483602 - DNA, 20 bp, Homo sapiens
gcccctggcccatctcagcc

SEQ ID NO: 5483603 - DNA, 18 bp, Homo sapiens
gcccctggccccgcctgc

SEQ ID NO: 5483604 - DNA, 19 bp, Homo sapiens
gcccctggccccgcctgcc

SEQ ID NO: 5483605 - DNA, 19 bp, Homo sapiens
gcccctggccctgcctcac

SEQ ID NO: 5483606 - DNA, 21 bp, Homo sapiens
gcccctggccctgcctcactg

SEQ ID NO: 5483607 - DNA, 12 bp, Homo sapiens
gcccctggctgg

SEQ ID NO: 5483608 - DNA, 11 bp, Homo sapiens
gcccctggctt

SEQ ID NO: 5483609 - DNA, 15 bp, Homo sapiens
gcccctggctttgcc

SEQ ID NO: 5483610 - DNA, 18 bp, Homo sapiens
gcccctggctttgcctct

SEQ ID NO: 5483611 - DNA, 22 bp, Homo sapiens
gcccctggctttgcctcttctt

SEQ ID NO: 5483612 - DNA, 21 bp, Homo sapiens
gcccctgggatccgagggccc

SEQ ID NO: 5483613 - DNA, 15 bp, Homo sapiens
gcccctgggatggga

SEQ ID NO: 5483614 - DNA, 13 bp, Homo sapiens
gcccctgggccct

SEQ ID NO: 5483615 - DNA, 16 bp, Homo sapiens
gcccctgggcccttgt

SEQ ID NO: 5483616 - DNA, 16 bp, Homo sapiens
gcccctgggctaccat

SEQ ID NO: 5483617 - DNA, 23 bp, Homo sapiens
gcccctgggctaccatctgcatg

SEQ ID NO: 5483618 - DNA, 20 bp, Homo sapiens
gcccctgggctctcacccag

SEQ ID NO: 5483619 - DNA, 23 bp, Homo sapiens
gcccctgggctctcacccagtcc

SEQ ID NO: 5483620 - DNA, 19 bp, Homo sapiens
gcccctgggcttggcctgc

SEQ ID NO: 5483621 - DNA, 22 bp, Homo sapiens
gcccctgggcttggcctgctgt

SEQ ID NO: 5483622 - DNA, 12 bp, Homo sapiens
gcccctggggac

SEQ ID NO: 5483623 - DNA, 22 bp, Homo sapiens
gcccctggggacagagccaccc

SEQ ID NO: 5483624 - DNA, 15 bp, Homo sapiens
gcccctggggcccag

SEQ ID NO: 5483625 - DNA, 16 bp, Homo sapiens
gcccctggggcccagc

SEQ ID NO: 5483626 - DNA, 17 bp, Homo sapiens
gcccctggggcctagac

SEQ ID NO: 5483627 - DNA, 15 bp, Homo sapiens
gcccctggggctgta

SEQ ID NO: 5483628 - DNA, 21 bp, Homo sapiens
gcccctggggtggccaccagt

SEQ ID NO: 5483629 - DNA, 19 bp, Homo sapiens
gcccctgggtccttctagc

SEQ ID NO: 5483630 - DNA, 20 bp, Homo sapiens
gcccctgggtgggtggtggg

SEQ ID NO: 5483631 - DNA, 22 bp, Homo sapiens
gcccctgggtgggtggtgggga

SEQ ID NO: 5483632 - DNA, 16 bp, Homo sapiens
gcccctggtcctgagg

SEQ ID NO: 5483633 - DNA, 18 bp, Homo sapiens
gcccctggtgccctgaga

SEQ ID NO: 5483634 - DNA, 21 bp, Homo sapiens
gcccctggtggtcacaggctg

SEQ ID NO: 5483635 - DNA, 19 bp, Homo sapiens
gcccctgtaaggtttcaat

SEQ ID NO: 5483636 - DNA, 22 bp, Homo sapiens
gcccctgtaaggtttcaatgca

SEQ ID NO: 5483637 - DNA, 17 bp, Homo sapiens
gcccctgtatggcactg

SEQ ID NO: 5483638 - DNA, 15 bp, Homo sapiens
gcccctgtcccaccc

SEQ ID NO: 5483639 - DNA, 16 bp, Homo sapiens
gcccctgtccccagtc

SEQ ID NO: 5483640 - DNA, 17 bp, Homo sapiens
gcccctgtccccagtcc

SEQ ID NO: 5483641 - DNA, 18 bp, Homo sapiens
gcccctgtcgcccaccca

SEQ ID NO: 5483642 - DNA, 22 bp, Homo sapiens
gcccctgtcgcccacccagctg

SEQ ID NO: 5483643 - DNA, 11 bp, Homo sapiens
gcccctgtcta

SEQ ID NO: 5483644 - DNA, 21 bp, Homo sapiens
gcccctgtctaacctacgacc

SEQ ID NO: 5483645 - DNA, 18 bp, Homo sapiens
gcccctgtctagagaggg

SEQ ID NO: 5483646 - DNA, 17 bp, Homo sapiens
gcccctgtctgttccca

SEQ ID NO: 5483647 - DNA, 21 bp, Homo sapiens
gcccctgtctgttcccagccc

SEQ ID NO: 5483648 - DNA, 13 bp, Homo sapiens
gcccctgtggcca

SEQ ID NO: 5483649 - DNA, 15 bp, Homo sapiens
gcccctgtggccaac

SEQ ID NO: 5483650 - DNA, 17 bp, Homo sapiens
gcccctgtggccaactg

SEQ ID NO: 5483651 - DNA, 20 bp, Homo sapiens
gcccctgtggccctggccac

SEQ ID NO: 5483652 - DNA, 14 bp, Homo sapiens
gcccctgtgggact

SEQ ID NO: 5483653 - DNA, 21 bp, Homo sapiens
gcccctgtggggaacaggtct

SEQ ID NO: 5483654 - DNA, 16 bp, Homo sapiens
gcccctgtgtgggagg

SEQ ID NO: 5483655 - DNA, 14 bp, Homo sapiens
gcccctgtgttggg

SEQ ID NO: 5483656 - DNA, 17 bp, Homo sapiens
gcccctgtgttgggggg

SEQ ID NO: 5483657 - DNA, 18 bp, Homo sapiens
gcccctgttcccccgctg

SEQ ID NO: 5483658 - DNA, 24 bp, Homo sapiens
gcccctgttcccccgctggcagcc

SEQ ID NO: 5483659 - DNA, 21 bp, Homo sapiens
gcccctgttctggcagagttg

SEQ ID NO: 5483660 - DNA, 20 bp, Homo sapiens
gcccctgttgaggtgggtgg

SEQ ID NO: 5483661 - DNA, 17 bp, Homo sapiens
gcccctgttttctgctg

SEQ ID NO: 5483662 - DNA, 22 bp, Homo sapiens
gccccttaaatttctgccctga

SEQ ID NO: 5483663 - DNA, 16 bp, Homo sapiens
gccccttaagggttga

SEQ ID NO: 5483664 - DNA, 18 bp, Homo sapiens
gccccttaagggttgaag

SEQ ID NO: 5483665 - DNA, 16 bp, Homo sapiens
gccccttagacagagg

SEQ ID NO: 5483666 - DNA, 22 bp, Homo sapiens
gccccttagacagaggccctca

SEQ ID NO: 5483667 - DNA, 20 bp, Homo sapiens
gccccttcaaacctcatagc

SEQ ID NO: 5483668 - DNA, 20 bp, Homo sapiens
gccccttcacttctgaccac

SEQ ID NO: 5483669 - DNA, 22 bp, Homo sapiens
gccccttcattgatttcctgtg

SEQ ID NO: 5483670 - DNA, 10 bp, Homo sapiens
gccccttcca

SEQ ID NO: 5483671 - DNA, 11 bp, Homo sapiens
gccccttccac

SEQ ID NO: 5483672 - DNA, 17 bp, Homo sapiens
gccccttccacgggggc

SEQ ID NO: 5483673 - DNA, 18 bp, Homo sapiens
gccccttccacgggggct

SEQ ID NO: 5483674 - DNA, 22 bp, Homo sapiens
gccccttccatggtactgtagc

SEQ ID NO: 5483675 - DNA, 15 bp, Homo sapiens
gccccttcccacgtc

SEQ ID NO: 5483676 - DNA, 23 bp, Homo sapiens
gccccttccccatgaaccctgcc

SEQ ID NO: 5483677 - DNA, 16 bp, Homo sapiens
gccccttccccatggg

SEQ ID NO: 5483678 - DNA, 12 bp, Homo sapiens
gccccttccccc

SEQ ID NO: 5483679 - DNA, 19 bp, Homo sapiens
gccccttcccctgggaact

SEQ ID NO: 5483680 - DNA, 11 bp, Homo sapiens
gccccttccct

SEQ ID NO: 5483681 - DNA, 15 bp, Homo sapiens
gccccttccctctct

SEQ ID NO: 5483682 - DNA, 20 bp, Homo sapiens
gccccttccctctctccctg

SEQ ID NO: 5483683 - DNA, 12 bp, Homo sapiens
gccccttccctg

SEQ ID NO: 5483684 - DNA, 22 bp, Homo sapiens
gccccttccctgggtttgggag

SEQ ID NO: 5483685 - DNA, 15 bp, Homo sapiens
gccccttccgccact

SEQ ID NO: 5483686 - DNA, 21 bp, Homo sapiens
gccccttccgccactggggct

SEQ ID NO: 5483687 - DNA, 20 bp, Homo sapiens
gccccttccttgctctgcac

SEQ ID NO: 5483688 - DNA, 16 bp, Homo sapiens
gccccttcgggagcag

SEQ ID NO: 5483689 - DNA, 19 bp, Homo sapiens
gccccttctacactctcct

SEQ ID NO: 5483690 - DNA, 17 bp, Homo sapiens
gccccttctcagaatct

SEQ ID NO: 5483691 - DNA, 18 bp, Homo sapiens
gccccttctcagaatcta

SEQ ID NO: 5483692 - DNA, 23 bp, Homo sapiens
gccccttctccccttcctggaca

SEQ ID NO: 5483693 - DNA, 12 bp, Homo sapiens
gccccttctctc

SEQ ID NO: 5483694 - DNA, 13 bp, Homo sapiens
gccccttctctca

SEQ ID NO: 5483695 - DNA, 19 bp, Homo sapiens
gccccttctctccctgcca

SEQ ID NO: 5483696 - DNA, 14 bp, Homo sapiens
gccccttctgctca

SEQ ID NO: 5483697 - DNA, 17 bp, Homo sapiens
gccccttctgctcagct

SEQ ID NO: 5483698 - DNA, 19 bp, Homo sapiens
gccccttctgctcagctct

SEQ ID NO: 5483699 - DNA, 23 bp, Homo sapiens
gccccttctgctcagctctgggc

SEQ ID NO: 5483700 - DNA, 19 bp, Homo sapiens
gccccttctggccggtgct

SEQ ID NO: 5483701 - DNA, 22 bp, Homo sapiens
gccccttctggccggtgctggg

SEQ ID NO: 5483702 - DNA, 23 bp, Homo sapiens
gccccttctggccggtgctgggt

SEQ ID NO: 5483703 - DNA, 22 bp, Homo sapiens
gccccttcttgggccccagacc

SEQ ID NO: 5483704 - DNA, 17 bp, Homo sapiens
gccccttgaccccacac

SEQ ID NO: 5483705 - DNA, 20 bp, Homo sapiens
gccccttgctctcccctgcc

SEQ ID NO: 5483706 - DNA, 15 bp, Homo sapiens
gccccttgctgctgg

SEQ ID NO: 5483707 - DNA, 15 bp, Homo sapiens
gccccttggacacgc

SEQ ID NO: 5483708 - DNA, 19 bp, Homo sapiens
gccccttggattactttgt

SEQ ID NO: 5483709 - DNA, 18 bp, Homo sapiens
gccccttggattcctgca

SEQ ID NO: 5483710 - DNA, 21 bp, Homo sapiens
gccccttgggcatccacccag

SEQ ID NO: 5483711 - DNA, 16 bp, Homo sapiens
gccccttgggcctccc

SEQ ID NO: 5483712 - DNA, 19 bp, Homo sapiens
gccccttgggcctcccact

SEQ ID NO: 5483713 - DNA, 20 bp, Homo sapiens
gccccttgtcctctcagagc

SEQ ID NO: 5483714 - DNA, 22 bp, Homo sapiens
gccccttgtcctctcagagcct

SEQ ID NO: 5483715 - DNA, 17 bp, Homo sapiens
gccccttgtcctctccc

SEQ ID NO: 5483716 - DNA, 23 bp, Homo sapiens
gccccttgtcgcgcgtctcccat

SEQ ID NO: 5483717 - DNA, 15 bp, Homo sapiens
gcccctttacggaca

SEQ ID NO: 5483718 - DNA, 20 bp, Homo sapiens
gcccctttacggacaccccc

SEQ ID NO: 5483719 - DNA, 12 bp, Homo sapiens
gcccctttataa

SEQ ID NO: 5483720 - DNA, 20 bp, Homo sapiens
gcccctttccttcactgccc

SEQ ID NO: 5483721 - DNA, 15 bp, Homo sapiens
gcccctttctcttgc

SEQ ID NO: 5483722 - DNA, 14 bp, Homo sapiens
gcccctttcttccc

SEQ ID NO: 5483723 - DNA, 17 bp, Homo sapiens
gcccctttcttccccac

SEQ ID NO: 5483724 - DNA, 18 bp, Homo sapiens
gcccctttgctgaccctc

SEQ ID NO: 5483725 - DNA, 20 bp, Homo sapiens
gcccctttgctgaccctccc

SEQ ID NO: 5483726 - DNA, 16 bp, Homo sapiens
gcccctttggacctgc

SEQ ID NO: 5483727 - DNA, 18 bp, Homo sapiens
gcccctttgggccctgca

SEQ ID NO: 5483728 - DNA, 19 bp, Homo sapiens
gccccttttacttttttat

SEQ ID NO: 5483729 - DNA, 21 bp, Homo sapiens
gccccttttcgccccctgcct

SEQ ID NO: 5483730 - DNA, 16 bp, Homo sapiens
gccccttttctctgct

SEQ ID NO: 5483731 - DNA, 20 bp, Homo sapiens
gccccttttctctgctcttg

SEQ ID NO: 5483732 - DNA, 18 bp, Homo sapiens
gcccctttttactcccct

SEQ ID NO: 5483733 - DNA, 20 bp, Homo sapiens
gcccctttttactccccttg

SEQ ID NO: 5483734 - DNA, 21 bp, Homo sapiens
gcccctttttactccccttga

SEQ ID NO: 5483735 - DNA, 17 bp, Homo sapiens
gcccgaaactaagccag

SEQ ID NO: 5483736 - DNA, 19 bp, Homo sapiens
gcccgaaactaagccaggc

SEQ ID NO: 5483737 - DNA, 22 bp, Homo sapiens
gcccgaaactaagccaggcctg

SEQ ID NO: 5483738 - DNA, 14 bp, Homo sapiens
gcccgaatgcctgt

SEQ ID NO: 5483739 - DNA, 18 bp, Homo sapiens
gcccgaatttctcactcc

SEQ ID NO: 5483740 - DNA, 14 bp, Homo sapiens
gcccgacagcctgg

SEQ ID NO: 5483741 - DNA, 15 bp, Homo sapiens
gcccgacaggtgggc

SEQ ID NO: 5483742 - DNA, 15 bp, Homo sapiens
gcccgacagtgccat

SEQ ID NO: 5483743 - DNA, 16 bp, Homo sapiens
gcccgacagtgccatc

SEQ ID NO: 5483744 - DNA, 16 bp, Homo sapiens
gcccgactctctccat

SEQ ID NO: 5483745 - DNA, 17 bp, Homo sapiens
gcccgactgactggagg

SEQ ID NO: 5483746 - DNA, 13 bp, Homo sapiens
gcccgagagctct

SEQ ID NO: 5483747 - DNA, 14 bp, Homo sapiens
gcccgagagctggg

SEQ ID NO: 5483748 - DNA, 12 bp, Homo sapiens
gcccgagcagct

SEQ ID NO: 5483749 - DNA, 23 bp, Homo sapiens
gcccgagcagctgagcagggccg

SEQ ID NO: 5483750 - DNA, 14 bp, Homo sapiens
gcccgagcgcctgc

SEQ ID NO: 5483751 - DNA, 15 bp, Homo sapiens
gcccgagcgcgtgcc

SEQ ID NO: 5483752 - DNA, 23 bp, Homo sapiens
gcccgagcgcgtgccttccccgt

SEQ ID NO: 5483753 - DNA, 18 bp, Homo sapiens
gcccgagctgtttatgtt

SEQ ID NO: 5483754 - DNA, 22 bp, Homo sapiens
gcccgagctgtttatgttttta

SEQ ID NO: 5483755 - DNA, 13 bp, Homo sapiens
gcccgaggaccgg

SEQ ID NO: 5483756 - DNA, 17 bp, Homo sapiens
gcccgaggaccgggctg

SEQ ID NO: 5483757 - DNA, 21 bp, Homo sapiens
gcccgaggaccgggctggggt

SEQ ID NO: 5483758 - DNA, 24 bp, Homo sapiens
gcccgaggaggccgactgggctgc

SEQ ID NO: 5483759 - DNA, 16 bp, Homo sapiens
gcccgaggccagggcc

SEQ ID NO: 5483760 - DNA, 18 bp, Homo sapiens
gcccgaggccagggccgc

SEQ ID NO: 5483761 - DNA, 18 bp, Homo sapiens
gcccggtgcagggcctgg

SEQ ID NO: 5483762 - DNA, 21 bp, Homo sapiens
gcccggtggcggcagggccag

SEQ ID NO: 5483763 - DNA, 22 bp, Homo sapiens
gcccggtggcggcagggccagg

SEQ ID NO: 5483764 - DNA, 15 bp, Homo sapiens
gcccggtggcgtggc

SEQ ID NO: 5483765 - DNA, 18 bp, Homo sapiens
gcccggtggtttgccatg

SEQ ID NO: 5483766 - DNA, 18 bp, Homo sapiens
gcccggtgtgaggagggg

SEQ ID NO: 5483767 - DNA, 18 bp, Homo sapiens
gcccggtttggggctgcg

SEQ ID NO: 5483768 - DNA, 18 bp, Homo sapiens
gcccgtaatcccagctac

SEQ ID NO: 5483769 - DNA, 19 bp, Homo sapiens
gcccgtaatcccagctact

SEQ ID NO: 5483770 - DNA, 22 bp, Homo sapiens
gcccgtcagcatcactgatggg

SEQ ID NO: 5483771 - DNA, 15 bp, Homo sapiens
gcccgtcagcgtggg

SEQ ID NO: 5483772 - DNA, 17 bp, Homo sapiens
gcccgtcgcgctggaca

SEQ ID NO: 5483773 - DNA, 19 bp, Homo sapiens
gcccgtcgcgctggacagc

SEQ ID NO: 5483774 - DNA, 13 bp, Homo sapiens
gcccgtcggagct

SEQ ID NO: 5483775 - DNA, 21 bp, Homo sapiens
gcccgtcggagctgcctgcag

SEQ ID NO: 5483776 - DNA, 13 bp, Homo sapiens
gcccgtcggccct

SEQ ID NO: 5483777 - DNA, 16 bp, Homo sapiens
gcccgtcggccctgcg

SEQ ID NO: 5483778 - DNA, 13 bp, Homo sapiens
gcccgtctcagtg

SEQ ID NO: 5483779 - DNA, 16 bp, Homo sapiens
gcccgtctctctccca

SEQ ID NO: 5483780 - DNA, 17 bp, Homo sapiens
gcccgtctctctcccat

SEQ ID NO: 5483781 - DNA, 22 bp, Homo sapiens
gcccgtctgtgtgtgacccctc

SEQ ID NO: 5483782 - DNA, 14 bp, Homo sapiens
gcccgtcttcagcc

SEQ ID NO: 5483783 - DNA, 18 bp, Homo sapiens
gcccgtgaagcagtgcct

SEQ ID NO: 5483784 - DNA, 21 bp, Homo sapiens
gcccgtgaagcagtgcctcga

SEQ ID NO: 5483785 - DNA, 22 bp, Homo sapiens
gcccgtgaagcagtgcctcgag

SEQ ID NO: 5483786 - DNA, 19 bp, Homo sapiens
gcccgtgacagactcctga

SEQ ID NO: 5483787 - DNA, 13 bp, Homo sapiens
gcccgtgaggagg

SEQ ID NO: 5483788 - DNA, 18 bp, Homo sapiens
gcccgtgcaacggaagcc

SEQ ID NO: 5483789 - DNA, 12 bp, Homo sapiens
gcccgtgcagta

SEQ ID NO: 5483790 - DNA, 17 bp, Homo sapiens
gcccgtgcagtacaggc

SEQ ID NO: 5483791 - DNA, 17 bp, Homo sapiens
gcccgtgccacccccag

SEQ ID NO: 5483792 - DNA, 16 bp, Homo sapiens
gcccgtgcccgcagga

SEQ ID NO: 5483793 - DNA, 14 bp, Homo sapiens
gcccgtgcgcagcc

SEQ ID NO: 5483794 - DNA, 23 bp, Homo sapiens
gcccgtgcgcagccgcgctctgc

SEQ ID NO: 5483795 - DNA, 18 bp, Homo sapiens
gcccgtggacaccccaga

SEQ ID NO: 5483796 - DNA, 19 bp, Homo sapiens
gcccgtggatctgggcaca

SEQ ID NO: 5483797 - DNA, 20 bp, Homo sapiens
gcccgtggcttggcatctgt

SEQ ID NO: 5483798 - DNA, 22 bp, Homo sapiens
gcccgtggggccggggcttctg

SEQ ID NO: 5483799 - DNA, 21 bp, Homo sapiens
gcccgtgggggcaggggacct

SEQ ID NO: 5483800 - DNA, 22 bp, Homo sapiens
gcccgtggtgaggttgtgctgc

SEQ ID NO: 5483801 - DNA, 20 bp, Homo sapiens
gcccgtgtaaatatgtacat

SEQ ID NO: 5483802 - DNA, 14 bp, Homo sapiens
gcccgtgtacatag

SEQ ID NO: 5483803 - DNA, 15 bp, Homo sapiens
gcccgtgtggcccct

SEQ ID NO: 5483804 - DNA, 17 bp, Homo sapiens
gcccgtgtggccccttc

SEQ ID NO: 5483805 - DNA, 18 bp, Homo sapiens
gcccgtgtggccccttca

SEQ ID NO: 5483806 - DNA, 14 bp, Homo sapiens
gcccgtgtggcctg

SEQ ID NO: 5483807 - DNA, 19 bp, Homo sapiens
gcccgtgtggcctgggtcc

SEQ ID NO: 5483808 - DNA, 15 bp, Homo sapiens
gcccgttagccccag

SEQ ID NO: 5483809 - DNA, 18 bp, Homo sapiens
gcccgttgccgggcctgg

SEQ ID NO: 5483810 - DNA, 19 bp, Homo sapiens
gcccgttgtctccctggcc

SEQ ID NO: 5483811 - DNA, 22 bp, Homo sapiens
gcccgttgtctccctggccctc

SEQ ID NO: 5483812 - DNA, 21 bp, Homo sapiens
gccctaacctctgagtcacca

SEQ ID NO: 5483813 - DNA, 16 bp, Homo sapiens
gccctaacctgacaga

SEQ ID NO: 5483814 - DNA, 23 bp, Homo sapiens
gccctaacgggggtgcggcagga

SEQ ID NO: 5483815 - DNA, 13 bp, Homo sapiens
gccctaactccta

SEQ ID NO: 5483816 - DNA, 12 bp, Homo sapiens
gccctaacttct

SEQ ID NO: 5483817 - DNA, 13 bp, Homo sapiens
gccctaagaactt

SEQ ID NO: 5483818 - DNA, 12 bp, Homo sapiens
gccctaagcaga

SEQ ID NO: 5483819 - DNA, 14 bp, Homo sapiens
gccctaagccactc

SEQ ID NO: 5483820 - DNA, 16 bp, Homo sapiens
gccctaagcccccagg

SEQ ID NO: 5483821 - DNA, 20 bp, Homo sapiens
gccctaagcccccagggcct

SEQ ID NO: 5483822 - DNA, 23 bp, Homo sapiens
gccctaagcccccagggcctcca

SEQ ID NO: 5483823 - DNA, 16 bp, Homo sapiens
gccctaagcctgtccc

SEQ ID NO: 5483824 - DNA, 14 bp, Homo sapiens
gccctaagggagtg

SEQ ID NO: 5483825 - DNA, 21 bp, Homo sapiens
gccctaagtgatttccacagg

SEQ ID NO: 5483826 - DNA, 17 bp, Homo sapiens
gccctaatgcgcaggct

SEQ ID NO: 5483827 - DNA, 15 bp, Homo sapiens
gccctaatgtctgta

SEQ ID NO: 5483828 - DNA, 22 bp, Homo sapiens
gccctaattcagccatgtacag

SEQ ID NO: 5483829 - DNA, 20 bp, Homo sapiens
gccctacagagctgtggagg

SEQ ID NO: 5483830 - DNA, 13 bp, Homo sapiens
gccctacagccct

SEQ ID NO: 5483831 - DNA, 21 bp, Homo sapiens
gccctacatcttcagctccca

SEQ ID NO: 5483832 - DNA, 21 bp, Homo sapiens
gccctaccctcctgctgagct

SEQ ID NO: 5483833 - DNA, 22 bp, Homo sapiens
gccctaccctcctgctgagctg

SEQ ID NO: 5483834 - DNA, 24 bp, Homo sapiens
gccctaccctcctgctgagctgcc

SEQ ID NO: 5483835 - DNA, 18 bp, Homo sapiens
gccctacctgccccactt

SEQ ID NO: 5483836 - DNA, 22 bp, Homo sapiens
gccctacctgcctgttctccag

SEQ ID NO: 5483837 - DNA, 14 bp, Homo sapiens
gccctactattcag

SEQ ID NO: 5483838 - DNA, 13 bp, Homo sapiens
gccctactccact

SEQ ID NO: 5483839 - DNA, 18 bp, Homo sapiens
gccctactccactgccct

SEQ ID NO: 5483840 - DNA, 22 bp, Homo sapiens
gccctactcctgcggctgcctg

SEQ ID NO: 5483841 - DNA, 23 bp, Homo sapiens
gccctactcggatggggcacgga

SEQ ID NO: 5483842 - DNA, 12 bp, Homo sapiens
gccctactggga

SEQ ID NO: 5483843 - DNA, 17 bp, Homo sapiens
gccctactgggagactg

SEQ ID NO: 5483844 - DNA, 16 bp, Homo sapiens
gccctagaccctcccc

SEQ ID NO: 5483845 - DNA, 18 bp, Homo sapiens
gccctagaccctccccca

SEQ ID NO: 5483846 - DNA, 21 bp, Homo sapiens
gccctagaccctcccccacca

SEQ ID NO: 5483847 - DNA, 22 bp, Homo sapiens
gccctagaccctcccccaccat

SEQ ID NO: 5483848 - DNA, 19 bp, Homo sapiens
gccctagagcacactgtag

SEQ ID NO: 5483849 - DNA, 13 bp, Homo sapiens
gccctagaggaca

SEQ ID NO: 5483850 - DNA, 20 bp, Homo sapiens
gccctagaggcgagccaggc

SEQ ID NO: 5483851 - DNA, 19 bp, Homo sapiens
gccctagcagtttgcctct

SEQ ID NO: 5483852 - DNA, 21 bp, Homo sapiens
gccctagcagtttgcctctgc

SEQ ID NO: 5483853 - DNA, 22 bp, Homo sapiens
gccctagcagtttgcctctgca

SEQ ID NO: 5483854 - DNA, 14 bp, Homo sapiens
gccctagcccagac

SEQ ID NO: 5483855 - DNA, 21 bp, Homo sapiens
gccctagcccagactctgagc

SEQ ID NO: 5483856 - DNA, 19 bp, Homo sapiens
gccctagcctgacccggag

SEQ ID NO: 5483857 - DNA, 19 bp, Homo sapiens
gccctagcgctctcttcca

SEQ ID NO: 5483858 - DNA, 15 bp, Homo sapiens
gccctagcggctgct

SEQ ID NO: 5483859 - DNA, 14 bp, Homo sapiens
gccctagctgaccc

SEQ ID NO: 5483860 - DNA, 15 bp, Homo sapiens
gccctagctgacccc

SEQ ID NO: 5483861 - DNA, 22 bp, Homo sapiens
gccctaggaggagaacttgaac

SEQ ID NO: 5483862 - DNA, 19 bp, Homo sapiens
gccctaggatatgccctcc

SEQ ID NO: 5483863 - DNA, 23 bp, Homo sapiens
gccctaggatatgccctcctggt

SEQ ID NO: 5483864 - DNA, 23 bp, Homo sapiens
gccctaggattcctcccccagag

SEQ ID NO: 5483865 - DNA, 20 bp, Homo sapiens
gccctaggcatactctccag

SEQ ID NO: 5483866 - DNA, 21 bp, Homo sapiens
gccctaggcatactctccagg

SEQ ID NO: 5483867 - DNA, 18 bp, Homo sapiens
gccctaggcgggatgggc

SEQ ID NO: 5483868 - DNA, 15 bp, Homo sapiens
gccctagggctcaga

SEQ ID NO: 5483869 - DNA, 17 bp, Homo sapiens
gccctagggctcagagg

SEQ ID NO: 5483870 - DNA, 22 bp, Homo sapiens
gccctagtatgaaagctggggg

SEQ ID NO: 5483871 - DNA, 23 bp, Homo sapiens
gccctagtatgaaagctgggggt

SEQ ID NO: 5483872 - DNA, 20 bp, Homo sapiens
gccctataacccctgcctgg

SEQ ID NO: 5483873 - DNA, 15 bp, Homo sapiens
gccctatctatgtcc

SEQ ID NO: 5483874 - DNA, 11 bp, Homo sapiens
gccctatctgt

SEQ ID NO: 5483875 - DNA, 14 bp, Homo sapiens
gccctatgctgtgc

SEQ ID NO: 5483876 - DNA, 13 bp, Homo sapiens
gccctatggatgt

SEQ ID NO: 5483877 - DNA, 16 bp, Homo sapiens
gccctatgggcctgcc

SEQ ID NO: 5483878 - DNA, 14 bp, Homo sapiens
gccctatgtctcag

SEQ ID NO: 5483879 - DNA, 17 bp, Homo sapiens
gccctatgtctcaggag

SEQ ID NO: 5483880 - DNA, 21 bp, Homo sapiens
gccctatttagatgataaaga

SEQ ID NO: 5483881 - DNA, 17 bp, Homo sapiens
gccctatttcttgataa

SEQ ID NO: 5483882 - DNA, 19 bp, Homo sapiens
gccctcaaacttgactcta

SEQ ID NO: 5483883 - DNA, 15 bp, Homo sapiens
gccctcaacaggccc

SEQ ID NO: 5483884 - DNA, 16 bp, Homo sapiens
gccctcaacaggccca

SEQ ID NO: 5483885 - DNA, 20 bp, Homo sapiens
gccctcaacaggcccaggga

SEQ ID NO: 5483886 - DNA, 21 bp, Homo sapiens
gccctcaacaggcccagggag

SEQ ID NO: 5483887 - DNA, 23 bp, Homo sapiens
gccctcaagacccttttgggttt

SEQ ID NO: 5483888 - DNA, 22 bp, Homo sapiens
gccctcaaggcctcccacagtg

SEQ ID NO: 5483889 - DNA, 13 bp, Homo sapiens
gccctcaagggtg

SEQ ID NO: 5483890 - DNA, 18 bp, Homo sapiens
gccctcaagtaaaagaaa

SEQ ID NO: 5483891 - DNA, 23 bp, Homo sapiens
gccctcaatccccaagctggcag

SEQ ID NO: 5483892 - DNA, 15 bp, Homo sapiens
gccctcacatcttcc

SEQ ID NO: 5483893 - DNA, 12 bp, Homo sapiens
gccctcaccacc

SEQ ID NO: 5483894 - DNA, 19 bp, Homo sapiens
gccctcaccaccacactac

SEQ ID NO: 5483895 - DNA, 12 bp, Homo sapiens
gccctcacccca

SEQ ID NO: 5483896 - DNA, 23 bp, Homo sapiens
gccctcaccccaatccctgccac

SEQ ID NO: 5483897 - DNA, 15 bp, Homo sapiens
gccctcacctctgag

SEQ ID NO: 5483898 - DNA, 23 bp, Homo sapiens
gccctcacctctgaggacagagg

SEQ ID NO: 5483899 - DNA, 15 bp, Homo sapiens
gccctcactaagccc

SEQ ID NO: 5483900 - DNA, 22 bp, Homo sapiens
gccctcactcaggaaccctgga

SEQ ID NO: 5483901 - DNA, 17 bp, Homo sapiens
gccctcactccactccc

SEQ ID NO: 5483902 - DNA, 21 bp, Homo sapiens
gccctcactccactcccctca

SEQ ID NO: 5483903 - DNA, 13 bp, Homo sapiens
gccctcactcttg

SEQ ID NO: 5483904 - DNA, 15 bp, Homo sapiens
gccctcactcttgaa

SEQ ID NO: 5483905 - DNA, 22 bp, Homo sapiens
gccctcactcttgaagtccagg

SEQ ID NO: 5483906 - DNA, 16 bp, Homo sapiens
gccctcactgagcctc

SEQ ID NO: 5483907 - DNA, 20 bp, Homo sapiens
gccctcactgtcagtcccac

SEQ ID NO: 5483908 - DNA, 22 bp, Homo sapiens
gccctcactgtcagtcccactg

SEQ ID NO: 5483909 - DNA, 23 bp, Homo sapiens
gccctcactgtcagtcccactgc

SEQ ID NO: 5483910 - DNA, 12 bp, Homo sapiens
gccctcagaaca

SEQ ID NO: 5483911 - DNA, 14 bp, Homo sapiens
gccctcagaaccct

SEQ ID NO: 5483912 - DNA, 16 bp, Homo sapiens
gccctcagaagaaaac

SEQ ID NO: 5483913 - DNA, 11 bp, Homo sapiens
gccctcagagg

SEQ ID NO: 5483914 - DNA, 15 bp, Homo sapiens
gccctcagatgtccc

SEQ ID NO: 5483915 - DNA, 16 bp, Homo sapiens
gccctcagatgtccct

SEQ ID NO: 5483916 - DNA, 11 bp, Homo sapiens
gccctcagccc

SEQ ID NO: 5483917 - DNA, 16 bp, Homo sapiens
gccctcagcccacctg

SEQ ID NO: 5483918 - DNA, 19 bp, Homo sapiens
gccctcagcgtcagacagc

SEQ ID NO: 5483919 - DNA, 23 bp, Homo sapiens
gccctcagcgtctccccatgctg

SEQ ID NO: 5483920 - DNA, 16 bp, Homo sapiens
gccctcagctccctga

SEQ ID NO: 5483921 - DNA, 17 bp, Homo sapiens
gccctcagctcttagct

SEQ ID NO: 5483922 - DNA, 20 bp, Homo sapiens
gccctcagctggtcctgacc

SEQ ID NO: 5483923 - DNA, 14 bp, Homo sapiens
gccctcaggccagt

SEQ ID NO: 5483924 - DNA, 16 bp, Homo sapiens
gccctcaggccagtgc

SEQ ID NO: 5483925 - DNA, 13 bp, Homo sapiens
gccctcaggccat

SEQ ID NO: 5483926 - DNA, 17 bp, Homo sapiens
gccctcaggccattccc

SEQ ID NO: 5483927 - DNA, 17 bp, Homo sapiens
gccctcaggctccccag

SEQ ID NO: 5483928 - DNA, 19 bp, Homo sapiens
gccctcaggctccccagaa

SEQ ID NO: 5483929 - DNA, 17 bp, Homo sapiens
gccctcagggactgcac

SEQ ID NO: 5483930 - DNA, 20 bp, Homo sapiens
gccctcaggggcctctctcc

SEQ ID NO: 5483931 - DNA, 19 bp, Homo sapiens
gccctcagtagtccctgca

SEQ ID NO: 5483932 - DNA, 23 bp, Homo sapiens
gccctcagtagtccctgcacagt

SEQ ID NO: 5483933 - DNA, 14 bp, Homo sapiens
gccctcagtcaccc

SEQ ID NO: 5483934 - DNA, 13 bp, Homo sapiens
gccctcatcccac

SEQ ID NO: 5483935 - DNA, 18 bp, Homo sapiens
gccctcattacggctcct

SEQ ID NO: 5483936 - DNA, 16 bp, Homo sapiens
gccctcattctcattt

SEQ ID NO: 5483937 - DNA, 15 bp, Homo sapiens
gccctctcccctgcc

SEQ ID NO: 5483938 - DNA, 18 bp, Homo sapiens
gccctctcccctgccccc

SEQ ID NO: 5483939 - DNA, 23 bp, Homo sapiens
gccctctcccctgccccctgcag

SEQ ID NO: 5483940 - DNA, 15 bp, Homo sapiens
gccctctccctcagt

SEQ ID NO: 5483941 - DNA, 17 bp, Homo sapiens
gccctctccctctaggc

SEQ ID NO: 5483942 - DNA, 24 bp, Homo sapiens
gccctctccctctaggctctgcct

SEQ ID NO: 5483943 - DNA, 22 bp, Homo sapiens
gccctctcccttaccctgggaa

SEQ ID NO: 5483944 - DNA, 14 bp, Homo sapiens
gccctctcctcccc

SEQ ID NO: 5483945 - DNA, 14 bp, Homo sapiens
gccctctcctccct

SEQ ID NO: 5483946 - DNA, 21 bp, Homo sapiens
gccctctcctgggcagctgcc

SEQ ID NO: 5483947 - DNA, 23 bp, Homo sapiens
gccctctcctgggcagctgcctc

SEQ ID NO: 5483948 - DNA, 22 bp, Homo sapiens
gccctctcctttgttcccggct

SEQ ID NO: 5483949 - DNA, 19 bp, Homo sapiens
gccctctctcaccagcctt

SEQ ID NO: 5483950 - DNA, 19 bp, Homo sapiens
gccctctctccgccccgga

SEQ ID NO: 5483951 - DNA, 13 bp, Homo sapiens
gccctctctcggg

SEQ ID NO: 5483952 - DNA, 15 bp, Homo sapiens
gccctctctcgggag

SEQ ID NO: 5483953 - DNA, 17 bp, Homo sapiens
gccctctctctgcggca

SEQ ID NO: 5483954 - DNA, 21 bp, Homo sapiens
gccctctctgagtctggactt

SEQ ID NO: 5483955 - DNA, 21 bp, Homo sapiens
gccctctctgcagtcctcggc

SEQ ID NO: 5483956 - DNA, 16 bp, Homo sapiens
gccctctctgctcctt

SEQ ID NO: 5483957 - DNA, 21 bp, Homo sapiens
gccctctctgctccttcactg

SEQ ID NO: 5483958 - DNA, 11 bp, Homo sapiens
gccctctctta

SEQ ID NO: 5483959 - DNA, 12 bp, Homo sapiens
gccctctctttt

SEQ ID NO: 5483960 - DNA, 12 bp, Homo sapiens
gccctctgaaat

SEQ ID NO: 5483961 - DNA, 16 bp, Homo sapiens
gccctctgaaattaaa

SEQ ID NO: 5483962 - DNA, 16 bp, Homo sapiens
gccctctgagccgcca

SEQ ID NO: 5483963 - DNA, 19 bp, Homo sapiens
gccctctgcatcctctgga

SEQ ID NO: 5483964 - DNA, 20 bp, Homo sapiens
gccctctgcatcctctggag

SEQ ID NO: 5483965 - DNA, 22 bp, Homo sapiens
gccctctgcatcctctggagcc

SEQ ID NO: 5483966 - DNA, 10 bp, Homo sapiens
gccctctgcc

SEQ ID NO: 5483967 - DNA, 16 bp, Homo sapiens
gccctctgcccactcc

SEQ ID NO: 5483968 - DNA, 18 bp, Homo sapiens
gccctctgcccactccct

SEQ ID NO: 5483969 - DNA, 21 bp, Homo sapiens
gccctctgcccccagctgctc

SEQ ID NO: 5483970 - DNA, 24 bp, Homo sapiens
gccctctgccgaccgcctgcttca

SEQ ID NO: 5483971 - DNA, 15 bp, Homo sapiens
gccctctgcctcctc

SEQ ID NO: 5483972 - DNA, 16 bp, Homo sapiens
gccctctgcctgcact

SEQ ID NO: 5483973 - DNA, 17 bp, Homo sapiens
gccctctgctctgcctg

SEQ ID NO: 5483974 - DNA, 19 bp, Homo sapiens
gccctctgctgctgcccgg

SEQ ID NO: 5483975 - DNA, 15 bp, Homo sapiens
gccctctgctgcttt

SEQ ID NO: 5483976 - DNA, 22 bp, Homo sapiens
gccctctggagtggccactaag

SEQ ID NO: 5483977 - DNA, 22 bp, Homo sapiens
gccctctggatcctgctgtggc

SEQ ID NO: 5483978 - DNA, 15 bp, Homo sapiens
gccctctgggctctg

SEQ ID NO: 5483979 - DNA, 21 bp, Homo sapiens
gccctctggggctcagccctg

SEQ ID NO: 5483980 - DNA, 19 bp, Homo sapiens
gccctctgggtccctcctc

SEQ ID NO: 5483981 - DNA, 12 bp, Homo sapiens
gccctctgtagc

SEQ ID NO: 5483982 - DNA, 17 bp, Homo sapiens
gccctctgtgcctaata

SEQ ID NO: 5483983 - DNA, 20 bp, Homo sapiens
gccctctgtgcctaataaag

SEQ ID NO: 5483984 - DNA, 13 bp, Homo sapiens
gccctctgtggcc

SEQ ID NO: 5483985 - DNA, 14 bp, Homo sapiens
gccctctgtggcca

SEQ ID NO: 5483986 - DNA, 20 bp, Homo sapiens
gccctctgtggccaggagcc

SEQ ID NO: 5483987 - DNA, 17 bp, Homo sapiens
gccctcttaagatctga

SEQ ID NO: 5483988 - DNA, 17 bp, Homo sapiens
gccctcttagtagggac

SEQ ID NO: 5483989 - DNA, 11 bp, Homo sapiens
gccctcttcaa

SEQ ID NO: 5483990 - DNA, 15 bp, Homo sapiens
gccctcttcaatccc

SEQ ID NO: 5483991 - DNA, 15 bp, Homo sapiens
gccctcttcaggggt

SEQ ID NO: 5483992 - DNA, 12 bp, Homo sapiens
gccctcttcctg

SEQ ID NO: 5483993 - DNA, 16 bp, Homo sapiens
gccctcttcctgacga

SEQ ID NO: 5483994 - DNA, 15 bp, Homo sapiens
gccctcttgccagcc

SEQ ID NO: 5483995 - DNA, 16 bp, Homo sapiens
gccctcttgccagcct

SEQ ID NO: 5483996 - DNA, 17 bp, Homo sapiens
gccctcttgccagcctc

SEQ ID NO: 5483997 - DNA, 21 bp, Homo sapiens
gccctcttgccagcctccttg

SEQ ID NO: 5483998 - DNA, 13 bp, Homo sapiens
gccctcttggggg

SEQ ID NO: 5483999 - DNA, 19 bp, Homo sapiens
gccctcttgggggcactgc

SEQ ID NO: 5484000 - DNA, 15 bp, Homo sapiens
gccctctttccctgc

SEQ ID NO: 5484001 - DNA, 16 bp, Homo sapiens
gccctctttccctgcg

SEQ ID NO: 5484002 - DNA, 17 bp, Homo sapiens
gccctctttccctgcga

SEQ ID NO: 5484003 - DNA, 20 bp, Homo sapiens
gccctctttccctgcgagac

SEQ ID NO: 5484004 - DNA, 16 bp, Homo sapiens
gccctctttctctctg

SEQ ID NO: 5484005 - DNA, 17 bp, Homo sapiens
gccctctttctctctgt

SEQ ID NO: 5484006 - DNA, 21 bp, Homo sapiens
gccctctttctctctgtgtgg

SEQ ID NO: 5484007 - DNA, 23 bp, Homo sapiens
gccctctttctctctgtgtggca

SEQ ID NO: 5484008 - DNA, 16 bp, Homo sapiens
gccctgaaagggccct

SEQ ID NO: 5484009 - DNA, 16 bp, Homo sapiens
gccctgaaagtcccag

SEQ ID NO: 5484010 - DNA, 17 bp, Homo sapiens
gccctgaaagtcccaga

SEQ ID NO: 5484011 - DNA, 19 bp, Homo sapiens
gccctgaaatggcctgtcc

SEQ ID NO: 5484012 - DNA, 21 bp, Homo sapiens
gccctgaaccacgaggctgcc

SEQ ID NO: 5484013 - DNA, 18 bp, Homo sapiens
gccctgaaggttcctgag

SEQ ID NO: 5484014 - DNA, 16 bp, Homo sapiens
gccctgaatttcttct

SEQ ID NO: 5484015 - DNA, 17 bp, Homo sapiens
gccctgaatttcttctt

SEQ ID NO: 5484016 - DNA, 20 bp, Homo sapiens
gccctgacaacaactatcac

SEQ ID NO: 5484017 - DNA, 16 bp, Homo sapiens
gccctgacatgctaac

SEQ ID NO: 5484018 - DNA, 13 bp, Homo sapiens
gccctgaccccca

SEQ ID NO: 5484019 - DNA, 17 bp, Homo sapiens
gccctgacccctgcacc

SEQ ID NO: 5484020 - DNA, 15 bp, Homo sapiens
gccctgacccttcca

SEQ ID NO: 5484021 - DNA, 17 bp, Homo sapiens
gccctgacctcccagcc

SEQ ID NO: 5484022 - DNA, 22 bp, Homo sapiens
gccctgaccttggctgactggg

SEQ ID NO: 5484023 - DNA, 15 bp, Homo sapiens
gccctgactcctgga

SEQ ID NO: 5484024 - DNA, 20 bp, Homo sapiens
gccctgactcctggactccg

SEQ ID NO: 5484025 - DNA, 12 bp, Homo sapiens
gccctgagaaga

SEQ ID NO: 5484026 - DNA, 20 bp, Homo sapiens
gccctgagaagctgctccag

SEQ ID NO: 5484027 - DNA, 12 bp, Homo sapiens
gccctgagacct

SEQ ID NO: 5484028 - DNA, 22 bp, Homo sapiens
gccctgagacctctagagaaaa

SEQ ID NO: 5484029 - DNA, 14 bp, Homo sapiens
gccctgagactccc

SEQ ID NO: 5484030 - DNA, 21 bp, Homo sapiens
gccctgagactcccgcctttg

SEQ ID NO: 5484031 - DNA, 23 bp, Homo sapiens
gccctgagagagaatagagctgc

SEQ ID NO: 5484032 - DNA, 12 bp, Homo sapiens
gccctgagccag

SEQ ID NO: 5484033 - DNA, 21 bp, Homo sapiens
gccctgagccagggtctccag

SEQ ID NO: 5484034 - DNA, 23 bp, Homo sapiens
gccctgagcccagaaaaaaggac

SEQ ID NO: 5484035 - DNA, 12 bp, Homo sapiens
gccctgagccct

SEQ ID NO: 5484036 - DNA, 13 bp, Homo sapiens
gccctgagctcag

SEQ ID NO: 5484037 - DNA, 23 bp, Homo sapiens
gccctgagctcaggctgagccca

SEQ ID NO: 5484038 - DNA, 13 bp, Homo sapiens
gccctgagctcgg

SEQ ID NO: 5484039 - DNA, 16 bp, Homo sapiens
gccctgagctttctgc

SEQ ID NO: 5484040 - DNA, 16 bp, Homo sapiens
gccctgaggaaggagg

SEQ ID NO: 5484041 - DNA, 12 bp, Homo sapiens
gccctgaggaat

SEQ ID NO: 5484042 - DNA, 13 bp, Homo sapiens
gccctgaggaata

SEQ ID NO: 5484043 - DNA, 14 bp, Homo sapiens
gccctgaggaataa

SEQ ID NO: 5484044 - DNA, 15 bp, Homo sapiens
gccctgaggaataaa

SEQ ID NO: 5484045 - DNA, 18 bp, Homo sapiens
gccctgaggaataaagct

SEQ ID NO: 5484046 - DNA, 20 bp, Homo sapiens
gccctgaggagggccctgag

SEQ ID NO: 5484047 - DNA, 20 bp, Homo sapiens
gccctgaggggcctgccact

SEQ ID NO: 5484048 - DNA, 21 bp, Homo sapiens
gccctgaggggcctgccactc

SEQ ID NO: 5484049 - DNA, 13 bp, Homo sapiens
gccctgaggggct

SEQ ID NO: 5484050 - DNA, 15 bp, Homo sapiens
gccctgaggggctgg

SEQ ID NO: 5484051 - DNA, 17 bp, Homo sapiens
gccctgaggggctgggc

SEQ ID NO: 5484052 - DNA, 19 bp, Homo sapiens
gccctgaggggctgggctg

SEQ ID NO: 5484053 - DNA, 18 bp, Homo sapiens
gccctgaggggctgggga

SEQ ID NO: 5484054 - DNA, 19 bp, Homo sapiens
gccctgaggggctggggag

SEQ ID NO: 5484055 - DNA, 13 bp, Homo sapiens
gccctgaggtgtg

SEQ ID NO: 5484056 - DNA, 22 bp, Homo sapiens
gccctgaggtgtgggggctgca

SEQ ID NO: 5484057 - DNA, 15 bp, Homo sapiens
gccctgagtcctggt

SEQ ID NO: 5484058 - DNA, 15 bp, Homo sapiens
gccctgagtgtccca

SEQ ID NO: 5484059 - DNA, 22 bp, Homo sapiens
gccctgagttttacccagactc

SEQ ID NO: 5484060 - DNA, 20 bp, Homo sapiens
gccctgatccaggaaaatgt

SEQ ID NO: 5484061 - DNA, 15 bp, Homo sapiens
gccctgatcccagag

SEQ ID NO: 5484062 - DNA, 13 bp, Homo sapiens
gccctgatctccg

SEQ ID NO: 5484063 - DNA, 19 bp, Homo sapiens
gccctgatctccgcagagg

SEQ ID NO: 5484064 - DNA, 17 bp, Homo sapiens
gccctgattgtgccagt

SEQ ID NO: 5484065 - DNA, 19 bp, Homo sapiens
gccctgattgtgccagtgc

SEQ ID NO: 5484066 - DNA, 21 bp, Homo sapiens
gccctgcaaaaggactctcag

SEQ ID NO: 5484067 - DNA, 15 bp, Homo sapiens
gccctgcaagggcgt

SEQ ID NO: 5484068 - DNA, 23 bp, Homo sapiens
gccctgcaatgtatcccttctca

SEQ ID NO: 5484069 - DNA, 19 bp, Homo sapiens
gccctgcacagacctggag

SEQ ID NO: 5484070 - DNA, 15 bp, Homo sapiens
gccctgcaccttccc

SEQ ID NO: 5484071 - DNA, 17 bp, Homo sapiens
gccctgcactgtcctgc

SEQ ID NO: 5484072 - DNA, 18 bp, Homo sapiens
gccctgcactgtcctgct

SEQ ID NO: 5484073 - DNA, 19 bp, Homo sapiens
gccctgcactgtcctgctc

SEQ ID NO: 5484074 - DNA, 18 bp, Homo sapiens
gccctgcagaccctgccc

SEQ ID NO: 5484075 - DNA, 18 bp, Homo sapiens
gccctgcagagcaataac

SEQ ID NO: 5484076 - DNA, 19 bp, Homo sapiens
gccctgcagagcaataaca

SEQ ID NO: 5484077 - DNA, 15 bp, Homo sapiens
gccctgcagagggca

SEQ ID NO: 5484078 - DNA, 16 bp, Homo sapiens
gccctgcagagggcac

SEQ ID NO: 5484079 - DNA, 18 bp, Homo sapiens
gccctgcagagggcacag

SEQ ID NO: 5484080 - DNA, 17 bp, Homo sapiens
gccctgcagcagaacct

SEQ ID NO: 5484081 - DNA, 14 bp, Homo sapiens
gccctgcagccagc

SEQ ID NO: 5484082 - DNA, 15 bp, Homo sapiens
gccctgcagccagct

SEQ ID NO: 5484083 - DNA, 12 bp, Homo sapiens
gccctgcagctc

SEQ ID NO: 5484084 - DNA, 19 bp, Homo sapiens
gccctgcaggagcagggcg

SEQ ID NO: 5484085 - DNA, 14 bp, Homo sapiens
gccctgcaggaggc

SEQ ID NO: 5484086 - DNA, 13 bp, Homo sapiens
gccctgcaggcac

SEQ ID NO: 5484087 - DNA, 16 bp, Homo sapiens
gccctgcaggcacaga

SEQ ID NO: 5484088 - DNA, 21 bp, Homo sapiens
gccctgcaggcacagaggagg

SEQ ID NO: 5484089 - DNA, 22 bp, Homo sapiens
gccctgcaggcacagaggaggt

SEQ ID NO: 5484090 - DNA, 16 bp, Homo sapiens
gccctgcagggccggg

SEQ ID NO: 5484091 - DNA, 20 bp, Homo sapiens
gccctgcagggccgggcagg

SEQ ID NO: 5484092 - DNA, 20 bp, Homo sapiens
gccctgcagtaatctccagg

SEQ ID NO: 5484093 - DNA, 22 bp, Homo sapiens
gccctgcagtaatctccagggc

SEQ ID NO: 5484094 - DNA, 22 bp, Homo sapiens
gccctgcagtgttcgcttggct

SEQ ID NO: 5484095 - DNA, 13 bp, Homo sapiens
gccctgcatctgt

SEQ ID NO: 5484096 - DNA, 15 bp, Homo sapiens
gccctgcatctgtct

SEQ ID NO: 5484097 - DNA, 16 bp, Homo sapiens
gccctgcatctgtctg

SEQ ID NO: 5484098 - DNA, 17 bp, Homo sapiens
gccctgcatgctgccca

SEQ ID NO: 5484099 - DNA, 18 bp, Homo sapiens
gccctgcatgggccagcc

SEQ ID NO: 5484100 - DNA, 14 bp, Homo sapiens
gccctgcatgtagt

SEQ ID NO: 5484101 - DNA, 19 bp, Homo sapiens
gccctgcattggcctggcc

SEQ ID NO: 5484102 - DNA, 21 bp, Homo sapiens
gccctgcattggcctggcctc

SEQ ID NO: 5484103 - DNA, 14 bp, Homo sapiens
gccctgccaagcct

SEQ ID NO: 5484104 - DNA, 19 bp, Homo sapiens
gccctgccaagcctggagc

SEQ ID NO: 5484105 - DNA, 14 bp, Homo sapiens
gccctgccacctgt

SEQ ID NO: 5484106 - DNA, 15 bp, Homo sapiens
gccctgccacctgtc

SEQ ID NO: 5484107 - DNA, 17 bp, Homo sapiens
gccctgccacctgtctg

SEQ ID NO: 5484108 - DNA, 23 bp, Homo sapiens
gccctgccacgtcccgctgcctc

SEQ ID NO: 5484109 - DNA, 11 bp, Homo sapiens
gccctgccact

SEQ ID NO: 5484110 - DNA, 12 bp, Homo sapiens
gccctgccactc

SEQ ID NO: 5484111 - DNA, 23 bp, Homo sapiens
gccctgccactcaatgggagaat

SEQ ID NO: 5484112 - DNA, 19 bp, Homo sapiens
gccctgccactcactaggc

SEQ ID NO: 5484113 - DNA, 21 bp, Homo sapiens
gccctgccactcactaggccc

SEQ ID NO: 5484114 - DNA, 16 bp, Homo sapiens
gccctgccagagcagg

SEQ ID NO: 5484115 - DNA, 14 bp, Homo sapiens
gccctggccctttc

SEQ ID NO: 5484116 - DNA, 21 bp, Homo sapiens
gccctggcctaccacagctgc

SEQ ID NO: 5484117 - DNA, 14 bp, Homo sapiens
gccctggcctcccc

SEQ ID NO: 5484118 - DNA, 16 bp, Homo sapiens
gccctggcctcccctg

SEQ ID NO: 5484119 - DNA, 12 bp, Homo sapiens
gccctggcctgc

SEQ ID NO: 5484120 - DNA, 15 bp, Homo sapiens
gccctggcctgctgg

SEQ ID NO: 5484121 - DNA, 13 bp, Homo sapiens
gccctggcctggc

SEQ ID NO: 5484122 - DNA, 14 bp, Homo sapiens
gccctggcgggtgg

SEQ ID NO: 5484123 - DNA, 19 bp, Homo sapiens
gccctggctccagtgaaac

SEQ ID NO: 5484124 - DNA, 20 bp, Homo sapiens
gccctggctcccaagggagg

SEQ ID NO: 5484125 - DNA, 21 bp, Homo sapiens
gccctggctcccaagggaggc

SEQ ID NO: 5484126 - DNA, 16 bp, Homo sapiens
gccctggctccttgca

SEQ ID NO: 5484127 - DNA, 22 bp, Homo sapiens
gccctggctccttgcagcaggg

SEQ ID NO: 5484128 - DNA, 11 bp, Homo sapiens
gccctggctct

SEQ ID NO: 5484129 - DNA, 12 bp, Homo sapiens
gccctggctctg

SEQ ID NO: 5484130 - DNA, 13 bp, Homo sapiens
gccctggctctgc

SEQ ID NO: 5484131 - DNA, 18 bp, Homo sapiens
gccctggctctgcccctc

SEQ ID NO: 5484132 - DNA, 19 bp, Homo sapiens
gccctggctctgcccctca

SEQ ID NO: 5484133 - DNA, 21 bp, Homo sapiens
gccctggctctgcccctcagg

SEQ ID NO: 5484134 - DNA, 23 bp, Homo sapiens
gccctggctctgcccctcagggg

SEQ ID NO: 5484135 - DNA, 17 bp, Homo sapiens
gccctggctgaaggact

SEQ ID NO: 5484136 - DNA, 11 bp, Homo sapiens
gccctggctgc

SEQ ID NO: 5484137 - DNA, 16 bp, Homo sapiens
gccctggctgccggca

SEQ ID NO: 5484138 - DNA, 18 bp, Homo sapiens
gccctggctggggacttg

SEQ ID NO: 5484139 - DNA, 14 bp, Homo sapiens
gccctggctgtggg

SEQ ID NO: 5484140 - DNA, 13 bp, Homo sapiens
gccctggcttgga

SEQ ID NO: 5484141 - DNA, 18 bp, Homo sapiens
gccctgggaaccactccc

SEQ ID NO: 5484142 - DNA, 20 bp, Homo sapiens
gccctgggaccgctacacca

SEQ ID NO: 5484143 - DNA, 11 bp, Homo sapiens
gccctgggagg

SEQ ID NO: 5484144 - DNA, 19 bp, Homo sapiens
gccctgggaggctctggag

SEQ ID NO: 5484145 - DNA, 21 bp, Homo sapiens
gccctgggaggctctggagcc

SEQ ID NO: 5484146 - DNA, 17 bp, Homo sapiens
gccctgggatcactgtg

SEQ ID NO: 5484147 - DNA, 16 bp, Homo sapiens
gccctgggatgcctca

SEQ ID NO: 5484148 - DNA, 18 bp, Homo sapiens
gccctgggatgcctcacc

SEQ ID NO: 5484149 - DNA, 23 bp, Homo sapiens
gccctgggcaaggaagctttgga

SEQ ID NO: 5484150 - DNA, 19 bp, Homo sapiens
gccctgggcacccacctcc

SEQ ID NO: 5484151 - DNA, 15 bp, Homo sapiens
gccctgggcagggca

SEQ ID NO: 5484152 - DNA, 17 bp, Homo sapiens
gccctgggccacactga

SEQ ID NO: 5484153 - DNA, 13 bp, Homo sapiens
gccctgggccagg

SEQ ID NO: 5484154 - DNA, 18 bp, Homo sapiens
gccctgggccaggcaggc

SEQ ID NO: 5484155 - DNA, 14 bp, Homo sapiens
gccctgggccaggg

SEQ ID NO: 5484156 - DNA, 23 bp, Homo sapiens
gccctgggcctcagttcaacctg

SEQ ID NO: 5484157 - DNA, 13 bp, Homo sapiens
gccctgggcctcc

SEQ ID NO: 5484158 - DNA, 16 bp, Homo sapiens
gccctgggcctgcctc

SEQ ID NO: 5484159 - DNA, 22 bp, Homo sapiens
gccctgggcctgcctcaccacg

SEQ ID NO: 5484160 - DNA, 13 bp, Homo sapiens
gccctgggcctgg

SEQ ID NO: 5484161 - DNA, 19 bp, Homo sapiens
gccctgggcgcagctgaag

SEQ ID NO: 5484162 - DNA, 11 bp, Homo sapiens
gccctgggctc

SEQ ID NO: 5484163 - DNA, 15 bp, Homo sapiens
gccctgggctcggag

SEQ ID NO: 5484164 - DNA, 15 bp, Homo sapiens
gccctgggctgcctc

SEQ ID NO: 5484165 - DNA, 12 bp, Homo sapiens
gccctgggctgg

SEQ ID NO: 5484166 - DNA, 14 bp, Homo sapiens
gccctgggctggac

SEQ ID NO: 5484167 - DNA, 21 bp, Homo sapiens
gccctgggctggactggaggt

SEQ ID NO: 5484168 - DNA, 21 bp, Homo sapiens
gccctgggcttggctcttggc

SEQ ID NO: 5484169 - DNA, 17 bp, Homo sapiens
gccctggggaagaggcc

SEQ ID NO: 5484170 - DNA, 18 bp, Homo sapiens
gccctggggactgttcca

SEQ ID NO: 5484171 - DNA, 20 bp, Homo sapiens
gccctggggagtgagcttgg

SEQ ID NO: 5484172 - DNA, 21 bp, Homo sapiens
gccctggggatcttcccacag

SEQ ID NO: 5484173 - DNA, 15 bp, Homo sapiens
gccctggggcagggt

SEQ ID NO: 5484174 - DNA, 21 bp, Homo sapiens
gccctggggcatcatgggcaa

SEQ ID NO: 5484175 - DNA, 23 bp, Homo sapiens
gccctggggcatccaccttcctg

SEQ ID NO: 5484176 - DNA, 13 bp, Homo sapiens
gccctggggcctg

SEQ ID NO: 5484177 - DNA, 15 bp, Homo sapiens
gccctggggcctgta

SEQ ID NO: 5484178 - DNA, 17 bp, Homo sapiens
gccctggggcctgtaca

SEQ ID NO: 5484179 - DNA, 19 bp, Homo sapiens
gccctggggctgatctcag

SEQ ID NO: 5484180 - DNA, 16 bp, Homo sapiens
gccctgggggatacca

SEQ ID NO: 5484181 - DNA, 21 bp, Homo sapiens
gccctgggggataccagctga

SEQ ID NO: 5484182 - DNA, 22 bp, Homo sapiens
gccctgggggataccagctgag

SEQ ID NO: 5484183 - DNA, 21 bp, Homo sapiens
gccctgggggattcctgagct

SEQ ID NO: 5484184 - DNA, 15 bp, Homo sapiens
gccctgggggccagc

SEQ ID NO: 5484185 - DNA, 16 bp, Homo sapiens
gccctgggggccagct

SEQ ID NO: 5484186 - DNA, 17 bp, Homo sapiens
gccctgggggtctgggc

SEQ ID NO: 5484187 - DNA, 16 bp, Homo sapiens
gccctggggtccccac

SEQ ID NO: 5484188 - DNA, 20 bp, Homo sapiens
gccctggggtccccactccc

SEQ ID NO: 5484189 - DNA, 21 bp, Homo sapiens
gccctggggtccccactccct

SEQ ID NO: 5484190 - DNA, 19 bp, Homo sapiens
gccctggggtctctgagca

SEQ ID NO: 5484191 - DNA, 18 bp, Homo sapiens
gccctggggtggcgtctg

SEQ ID NO: 5484192 - DNA, 24 bp, Homo sapiens
gccctggggtggcgtctgcctagg

SEQ ID NO: 5484193 - DNA, 21 bp, Homo sapiens
gccctggggtttccacacagg

SEQ ID NO: 5484194 - DNA, 23 bp, Homo sapiens
gccctggggtttccacacaggcc

SEQ ID NO: 5484195 - DNA, 18 bp, Homo sapiens
gccctgggtcctgcctgc

SEQ ID NO: 5484196 - DNA, 20 bp, Homo sapiens
gccctgggtcctgcctgcag

SEQ ID NO: 5484197 - DNA, 14 bp, Homo sapiens
gccctggtaaaata

SEQ ID NO: 5484198 - DNA, 16 bp, Homo sapiens
gccctggtccagggaa

SEQ ID NO: 5484199 - DNA, 17 bp, Homo sapiens
gccctggtccagggaag

SEQ ID NO: 5484200 - DNA, 16 bp, Homo sapiens
gccctggtcctggcct

SEQ ID NO: 5484201 - DNA, 15 bp, Homo sapiens
gccctggtccttcca

SEQ ID NO: 5484202 - DNA, 15 bp, Homo sapiens
gccctggtctggctt

SEQ ID NO: 5484203 - DNA, 23 bp, Homo sapiens
gccctggtgaatcacctggctga

SEQ ID NO: 5484204 - DNA, 15 bp, Homo sapiens
gccctggtgctgcca

SEQ ID NO: 5484205 - DNA, 21 bp, Homo sapiens
gccctggtggcagtgggagct

SEQ ID NO: 5484206 - DNA, 21 bp, Homo sapiens
gccctggtggccaagcctgcc

SEQ ID NO: 5484207 - DNA, 23 bp, Homo sapiens
gccctggtggccaagcctgcccc

SEQ ID NO: 5484208 - DNA, 13 bp, Homo sapiens
gccctggtggccc

SEQ ID NO: 5484209 - DNA, 19 bp, Homo sapiens
gccctggtggccctctccc

SEQ ID NO: 5484210 - DNA, 17 bp, Homo sapiens
gccctggttagctgaca

SEQ ID NO: 5484211 - DNA, 21 bp, Homo sapiens
gccctggttcccccaggaccc

SEQ ID NO: 5484212 - DNA, 20 bp, Homo sapiens
gccctggttcctgctgtcct

SEQ ID NO: 5484213 - DNA, 22 bp, Homo sapiens
gccctggttcctgctgtcctgg

SEQ ID NO: 5484214 - DNA, 19 bp, Homo sapiens
gccctggttctccatcccc

SEQ ID NO: 5484215 - DNA, 20 bp, Homo sapiens
gccctggttctccatcccca

SEQ ID NO: 5484216 - DNA, 18 bp, Homo sapiens
gccctggtttcactggcc

SEQ ID NO: 5484217 - DNA, 15 bp, Homo sapiens
gccctggtttcctgc

SEQ ID NO: 5484218 - DNA, 19 bp, Homo sapiens
gccctggtttcctgccctg

SEQ ID NO: 5484219 - DNA, 23 bp, Homo sapiens
gccctggtttcctgccctgggag

SEQ ID NO: 5484220 - DNA, 15 bp, Homo sapiens
gccctggtttgaaat

SEQ ID NO: 5484221 - DNA, 15 bp, Homo sapiens
gccctgtacccaccc

SEQ ID NO: 5484222 - DNA, 16 bp, Homo sapiens
gccctgtacccacccc

SEQ ID NO: 5484223 - DNA, 20 bp, Homo sapiens
gccctgtacccaccccagca

SEQ ID NO: 5484224 - DNA, 22 bp, Homo sapiens
gccctgtacccaccccagcaca

SEQ ID NO: 5484225 - DNA, 17 bp, Homo sapiens
gccctgtacctctctct

SEQ ID NO: 5484226 - DNA, 13 bp, Homo sapiens
gccctgtagccct

SEQ ID NO: 5484227 - DNA, 18 bp, Homo sapiens
gccctgtagccctggccc

SEQ ID NO: 5484228 - DNA, 20 bp, Homo sapiens
gccctgtagccctggcccgg

SEQ ID NO: 5484229 - DNA, 14 bp, Homo sapiens
gccctgtagctcct

SEQ ID NO: 5484230 - DNA, 18 bp, Homo sapiens
gccctgtagctccttagc

SEQ ID NO: 5484231 - DNA, 15 bp, Homo sapiens
gccctgtagctctga

SEQ ID NO: 5484232 - DNA, 22 bp, Homo sapiens
gccctgtatttattcccccatc

SEQ ID NO: 5484233 - DNA, 17 bp, Homo sapiens
gccctgtcactgtccag

SEQ ID NO: 5484234 - DNA, 15 bp, Homo sapiens
gccctgtcaggaggc

SEQ ID NO: 5484235 - DNA, 17 bp, Homo sapiens
gccctgtcaggaggcag

SEQ ID NO: 5484236 - DNA, 20 bp, Homo sapiens
gccctgtccaaaagcgccct

SEQ ID NO: 5484237 - DNA, 19 bp, Homo sapiens
gccctgtccactctgctca

SEQ ID NO: 5484238 - DNA, 13 bp, Homo sapiens
gccctgtccagcc

SEQ ID NO: 5484239 - DNA, 15 bp, Homo sapiens
gccctgtccagggca

SEQ ID NO: 5484240 - DNA, 16 bp, Homo sapiens
gccctgtccagggcag

SEQ ID NO: 5484241 - DNA, 23 bp, Homo sapiens
gccctgtcccaggccggcccaga

SEQ ID NO: 5484242 - DNA, 15 bp, Homo sapiens
gccctgtcccctgga

SEQ ID NO: 5484243 - DNA, 19 bp, Homo sapiens
gccctgtccctagctcaca

SEQ ID NO: 5484244 - DNA, 20 bp, Homo sapiens
gccctgtccctagctcacac

SEQ ID NO: 5484245 - DNA, 18 bp, Homo sapiens
gccctgtccctcccactc

SEQ ID NO: 5484246 - DNA, 21 bp, Homo sapiens
gccctgtccctcccactccct

SEQ ID NO: 5484247 - DNA, 14 bp, Homo sapiens
gccctgtcctccag

SEQ ID NO: 5484248 - DNA, 17 bp, Homo sapiens
gccctgtcgagacactt

SEQ ID NO: 5484249 - DNA, 18 bp, Homo sapiens
gccctgtcgcccctcctt

SEQ ID NO: 5484250 - DNA, 17 bp, Homo sapiens
gccctgtcgggctttgt

SEQ ID NO: 5484251 - DNA, 15 bp, Homo sapiens
gccctgtctccctac

SEQ ID NO: 5484252 - DNA, 15 bp, Homo sapiens
gccctgtctctggct

SEQ ID NO: 5484253 - DNA, 17 bp, Homo sapiens
gccctgtctctggctac

SEQ ID NO: 5484254 - DNA, 11 bp, Homo sapiens
gccctgtctgt

SEQ ID NO: 5484255 - DNA, 17 bp, Homo sapiens
gccctgtgagcacaaag

SEQ ID NO: 5484256 - DNA, 22 bp, Homo sapiens
gccctgtgagcacaaagaagaa

SEQ ID NO: 5484257 - DNA, 15 bp, Homo sapiens
gccctgtgagggcga

SEQ ID NO: 5484258 - DNA, 21 bp, Homo sapiens
gccctgtgcaacctcttggcc

SEQ ID NO: 5484259 - DNA, 16 bp, Homo sapiens
gccctgtgcagacctt

SEQ ID NO: 5484260 - DNA, 20 bp, Homo sapiens
gccctgtgcccgactgactg

SEQ ID NO: 5484261 - DNA, 12 bp, Homo sapiens
gccctgtgcctg

SEQ ID NO: 5484262 - DNA, 20 bp, Homo sapiens
gccctgtgcctgggccctgg

SEQ ID NO: 5484263 - DNA, 11 bp, Homo sapiens
gccctgtgctt

SEQ ID NO: 5484264 - DNA, 13 bp, Homo sapiens
gccctgtgctttg

SEQ ID NO: 5484265 - DNA, 17 bp, Homo sapiens
gccctgtggaagggact

SEQ ID NO: 5484266 - DNA, 13 bp, Homo sapiens
gccctgtggccgc

SEQ ID NO: 5484267 - DNA, 18 bp, Homo sapiens
gccctgtgggaccccagg

SEQ ID NO: 5484268 - DNA, 20 bp, Homo sapiens
gccctgtgggagccgcagag

SEQ ID NO: 5484269 - DNA, 16 bp, Homo sapiens
gccctgtgggccccca

SEQ ID NO: 5484270 - DNA, 17 bp, Homo sapiens
gccctgtgggcccccaa

SEQ ID NO: 5484271 - DNA, 21 bp, Homo sapiens
gccctgtgggcccccaaatgg

SEQ ID NO: 5484272 - DNA, 14 bp, Homo sapiens
gccctgtggtgctg

SEQ ID NO: 5484273 - DNA, 17 bp, Homo sapiens
gccctgtggtgctggga

SEQ ID NO: 5484274 - DNA, 18 bp, Homo sapiens
gccctgtgtaggggcagg

SEQ ID NO: 5484275 - DNA, 13 bp, Homo sapiens
gccctgtgtctgt

SEQ ID NO: 5484276 - DNA, 16 bp, Homo sapiens
gccctgtgtctgtcac

SEQ ID NO: 5484277 - DNA, 19 bp, Homo sapiens
gccctgtgtctgtcacagg

SEQ ID NO: 5484278 - DNA, 22 bp, Homo sapiens
gccctgtgtctgtcacaggctg

SEQ ID NO: 5484279 - DNA, 12 bp, Homo sapiens
gccctgtgtgca

SEQ ID NO: 5484280 - DNA, 13 bp, Homo sapiens
gccctgtgtgcag

SEQ ID NO: 5484281 - DNA, 14 bp, Homo sapiens
gccctgtgtgcagg

SEQ ID NO: 5484282 - DNA, 15 bp, Homo sapiens
gccctgtgtgcaggt

SEQ ID NO: 5484283 - DNA, 23 bp, Homo sapiens
gccctgtgtgtttgacatgtgaa

SEQ ID NO: 5484284 - DNA, 18 bp, Homo sapiens
gccctgtgttctttcccc

SEQ ID NO: 5484285 - DNA, 19 bp, Homo sapiens
gccctgtgttctttcccca

SEQ ID NO: 5484286 - DNA, 14 bp, Homo sapiens
gccctgttaaaaga

SEQ ID NO: 5484287 - DNA, 17 bp, Homo sapiens
gccctgttaaaagatga

SEQ ID NO: 5484288 - DNA, 17 bp, Homo sapiens
gccctgttagctttcca

SEQ ID NO: 5484289 - DNA, 16 bp, Homo sapiens
gccctgttcatgtgcc

SEQ ID NO: 5484290 - DNA, 20 bp, Homo sapiens
gccctgttcatgtgcctctg

SEQ ID NO: 5484291 - DNA, 21 bp, Homo sapiens
gccctgttccctggagtcagg

SEQ ID NO: 5484292 - DNA, 18 bp, Homo sapiens
gccctgttccgcctcact

SEQ ID NO: 5484293 - DNA, 13 bp, Homo sapiens
gcccttttcccct

SEQ ID NO: 5484294 - DNA, 19 bp, Homo sapiens
gcccttttcccctaccaat

SEQ ID NO: 5484295 - DNA, 23 bp, Homo sapiens
gcccttttctctcacccatccca

SEQ ID NO: 5484296 - DNA, 19 bp, Homo sapiens
gcccttttctggctcctgt

SEQ ID NO: 5484297 - DNA, 17 bp, Homo sapiens
gcccttttgcccactgt

SEQ ID NO: 5484298 - DNA, 14 bp, Homo sapiens
gcccttttgtctct

SEQ ID NO: 5484299 - DNA, 14 bp, Homo sapiens
gccctttttcaata

SEQ ID NO: 5484300 - DNA, 19 bp, Homo sapiens
gcccttttttctgcctcct

SEQ ID NO: 5484301 - DNA, 12 bp, Homo sapiens
gccgaaactgga

SEQ ID NO: 5484302 - DNA, 19 bp, Homo sapiens
gccgaacacacatcccagg

SEQ ID NO: 5484303 - DNA, 21 bp, Homo sapiens
gccgaacacacatcccaggag

SEQ ID NO: 5484304 - DNA, 19 bp, Homo sapiens
gccgaaccccccactccct

SEQ ID NO: 5484305 - DNA, 16 bp, Homo sapiens
gccgaagccccttgga

SEQ ID NO: 5484306 - DNA, 14 bp, Homo sapiens
gccgaagctctggc

SEQ ID NO: 5484307 - DNA, 15 bp, Homo sapiens
gccgaagctgctgtg

SEQ ID NO: 5484308 - DNA, 16 bp, Homo sapiens
gccgaagctgctgtga

SEQ ID NO: 5484309 - DNA, 21 bp, Homo sapiens
gccgaaggtgcctcagactcc

SEQ ID NO: 5484310 - DNA, 19 bp, Homo sapiens
gccgaagtccagctttctg

SEQ ID NO: 5484311 - DNA, 17 bp, Homo sapiens
gccgaatcccccaggga

SEQ ID NO: 5484312 - DNA, 14 bp, Homo sapiens
gccgaattgtggtg

SEQ ID NO: 5484313 - DNA, 18 bp, Homo sapiens
gccgaatttggtacacat

SEQ ID NO: 5484314 - DNA, 19 bp, Homo sapiens
gccgaatttggtacacatg

SEQ ID NO: 5484315 - DNA, 22 bp, Homo sapiens
gccgaatttggtacacatgtgt

SEQ ID NO: 5484316 - DNA, 20 bp, Homo sapiens
gccgacaatgccctgctggc

SEQ ID NO: 5484317 - DNA, 21 bp, Homo sapiens
gccgacaatgccctgctggcc

SEQ ID NO: 5484318 - DNA, 12 bp, Homo sapiens
gccgacactgtt

SEQ ID NO: 5484319 - DNA, 21 bp, Homo sapiens
gccgacagcacagatgtgaag

SEQ ID NO: 5484320 - DNA, 16 bp, Homo sapiens
gccgacaggaggccat

SEQ ID NO: 5484321 - DNA, 14 bp, Homo sapiens
gccgacatccctcc

SEQ ID NO: 5484322 - DNA, 17 bp, Homo sapiens
gccgacattgtctcccg

SEQ ID NO: 5484323 - DNA, 17 bp, Homo sapiens
gccgaccaggctggaca

SEQ ID NO: 5484324 - DNA, 20 bp, Homo sapiens
gccgaccccctctccctgca

SEQ ID NO: 5484325 - DNA, 16 bp, Homo sapiens
gccgaccctcctggcc

SEQ ID NO: 5484326 - DNA, 15 bp, Homo sapiens
gccgaccctgcggcc

SEQ ID NO: 5484327 - DNA, 16 bp, Homo sapiens
gccgaccctgcggcct

SEQ ID NO: 5484328 - DNA, 19 bp, Homo sapiens
gccgacctcgtcctccccc

SEQ ID NO: 5484329 - DNA, 13 bp, Homo sapiens
gccgaccttccct

SEQ ID NO: 5484330 - DNA, 15 bp, Homo sapiens
gccgacggagccact

SEQ ID NO: 5484331 - DNA, 15 bp, Homo sapiens
gccgactcagggacc

SEQ ID NO: 5484332 - DNA, 12 bp, Homo sapiens
gccgactccctg

SEQ ID NO: 5484333 - DNA, 15 bp, Homo sapiens
gccgactccctgagt

SEQ ID NO: 5484334 - DNA, 14 bp, Homo sapiens
gccgactctggccc

SEQ ID NO: 5484335 - DNA, 15 bp, Homo sapiens
gccgactctggccct

SEQ ID NO: 5484336 - DNA, 16 bp, Homo sapiens
gccgactctggccctg

SEQ ID NO: 5484337 - DNA, 22 bp, Homo sapiens
gccgactgcacagcggcccctg

SEQ ID NO: 5484338 - DNA, 14 bp, Homo sapiens
gccgactgcgctgc

SEQ ID NO: 5484339 - DNA, 16 bp, Homo sapiens
gccgactggctgtgag

SEQ ID NO: 5484340 - DNA, 13 bp, Homo sapiens
gccgactgggctg

SEQ ID NO: 5484341 - DNA, 18 bp, Homo sapiens
gccgactgggctgctggg

SEQ ID NO: 5484342 - DNA, 15 bp, Homo sapiens
gccgacttggagact

SEQ ID NO: 5484343 - DNA, 19 bp, Homo sapiens
gccgagactcgactctgtg

SEQ ID NO: 5484344 - DNA, 12 bp, Homo sapiens
gccgagagcctg

SEQ ID NO: 5484345 - DNA, 17 bp, Homo sapiens
gccgagagcctgctccc

SEQ ID NO: 5484346 - DNA, 22 bp, Homo sapiens
gccgagatcacgccactgcact

SEQ ID NO: 5484347 - DNA, 20 bp, Homo sapiens
gccgagattgcgccactgca

SEQ ID NO: 5484348 - DNA, 14 bp, Homo sapiens
gccgagcaggaggc

SEQ ID NO: 5484349 - DNA, 12 bp, Homo sapiens
gccgagccagca

SEQ ID NO: 5484350 - DNA, 16 bp, Homo sapiens
gccgagccatgtgtct

SEQ ID NO: 5484351 - DNA, 13 bp, Homo sapiens
gccgagcccacac

SEQ ID NO: 5484352 - DNA, 23 bp, Homo sapiens
gccgagcccagctgtgggcggct

SEQ ID NO: 5484353 - DNA, 16 bp, Homo sapiens
gccgagccgggcctgg

SEQ ID NO: 5484354 - DNA, 17 bp, Homo sapiens
gccgagccgggcctggg

SEQ ID NO: 5484355 - DNA, 13 bp, Homo sapiens
gccgagcctaatg

SEQ ID NO: 5484356 - DNA, 19 bp, Homo sapiens
gccgagcctaatgaaaggg

SEQ ID NO: 5484357 - DNA, 17 bp, Homo sapiens
gccgagcgttcccagca

SEQ ID NO: 5484358 - DNA, 20 bp, Homo sapiens
gccgagctcctggggagctc

SEQ ID NO: 5484359 - DNA, 24 bp, Homo sapiens
gccgagctcctggggagctcctgg

SEQ ID NO: 5484360 - DNA, 21 bp, Homo sapiens
gccgagctcgtgtatcctggg

SEQ ID NO: 5484361 - DNA, 16 bp, Homo sapiens
gccgagctctcctggg

SEQ ID NO: 5484362 - DNA, 20 bp, Homo sapiens
gccgagctctcctgggccag

SEQ ID NO: 5484363 - DNA, 21 bp, Homo sapiens
gccgagctctcctgggccagg

SEQ ID NO: 5484364 - DNA, 14 bp, Homo sapiens
gccgagctggtttc

SEQ ID NO: 5484365 - DNA, 19 bp, Homo sapiens
gccgagctgtcggagggct

SEQ ID NO: 5484366 - DNA, 22 bp, Homo sapiens
gccgaggacatgcatgacactt

SEQ ID NO: 5484367 - DNA, 16 bp, Homo sapiens
gccgaggcccagcggg

SEQ ID NO: 5484368 - DNA, 19 bp, Homo sapiens
gccgaggcccagcgggcag

SEQ ID NO: 5484369 - DNA, 21 bp, Homo sapiens
gccgaggcccagcgggcagat

SEQ ID NO: 5484370 - DNA, 15 bp, Homo sapiens
gccgaggcctggcca

SEQ ID NO: 5484371 - DNA, 19 bp, Homo sapiens
gccgagggaaatgctgttg

SEQ ID NO: 5484372 - DNA, 12 bp, Homo sapiens
gccgagggcagc

SEQ ID NO: 5484373 - DNA, 12 bp, Homo sapiens
gccgagggccag

SEQ ID NO: 5484374 - DNA, 14 bp, Homo sapiens
gccgagggccaggc

SEQ ID NO: 5484375 - DNA, 15 bp, Homo sapiens
gccgagggcgtcaga

SEQ ID NO: 5484376 - DNA, 13 bp, Homo sapiens
gccgagggctggc

SEQ ID NO: 5484377 - DNA, 16 bp, Homo sapiens
gccgagggctggccgg

SEQ ID NO: 5484378 - DNA, 18 bp, Homo sapiens
gccgagggctggccggga

SEQ ID NO: 5484379 - DNA, 19 bp, Homo sapiens
gccgaggggagagagggac

SEQ ID NO: 5484380 - DNA, 14 bp, Homo sapiens
gccgaggggccagg

SEQ ID NO: 5484381 - DNA, 20 bp, Homo sapiens
gccgagggtcctggctcctg

SEQ ID NO: 5484382 - DNA, 15 bp, Homo sapiens
gccgaggtccctgct

SEQ ID NO: 5484383 - DNA, 21 bp, Homo sapiens
gccgaggtccctgctgccagc

SEQ ID NO: 5484384 - DNA, 23 bp, Homo sapiens
gccgagtaatgacgtgtgtggct

SEQ ID NO: 5484385 - DNA, 15 bp, Homo sapiens
gccgagtccaggagc

SEQ ID NO: 5484386 - DNA, 15 bp, Homo sapiens
gccgagtctgtcctg

SEQ ID NO: 5484387 - DNA, 14 bp, Homo sapiens
gccgagtggctgcc

SEQ ID NO: 5484388 - DNA, 20 bp, Homo sapiens
gccgagtggctgccggagga

SEQ ID NO: 5484389 - DNA, 22 bp, Homo sapiens
gccgatatactctagatgaagt

SEQ ID NO: 5484390 - DNA, 14 bp, Homo sapiens
gccgatcccaggtg

SEQ ID NO: 5484391 - DNA, 14 bp, Homo sapiens
gccgatgagctggt

SEQ ID NO: 5484392 - DNA, 15 bp, Homo sapiens
gccgatgccaccggc

SEQ ID NO: 5484393 - DNA, 16 bp, Homo sapiens
gccgatgccaccggcc

SEQ ID NO: 5484394 - DNA, 21 bp, Homo sapiens
gccgatggagacaccaaccga

SEQ ID NO: 5484395 - DNA, 21 bp, Homo sapiens
gccgatgggagtctccctccg

SEQ ID NO: 5484396 - DNA, 16 bp, Homo sapiens
gccgatggggcccaca

SEQ ID NO: 5484397 - DNA, 21 bp, Homo sapiens
gccgatgtgggtccctctctt

SEQ ID NO: 5484398 - DNA, 18 bp, Homo sapiens
gccgattcctccagccct

SEQ ID NO: 5484399 - DNA, 15 bp, Homo sapiens
gccgattctctgccc

SEQ ID NO: 5484400 - DNA, 21 bp, Homo sapiens
gccgcaaaccacactggactc

SEQ ID NO: 5484401 - DNA, 22 bp, Homo sapiens
gccgcaaaccacactggactcc

SEQ ID NO: 5484402 - DNA, 13 bp, Homo sapiens
gccgcaaatcaac

SEQ ID NO: 5484403 - DNA, 17 bp, Homo sapiens
gccgcaacttcccaggc

SEQ ID NO: 5484404 - DNA, 18 bp, Homo sapiens
gccgcaacttcccaggcc

SEQ ID NO: 5484405 - DNA, 16 bp, Homo sapiens
gccgcaagctctcagc

SEQ ID NO: 5484406 - DNA, 18 bp, Homo sapiens
gccgcaagtccccagccc

SEQ ID NO: 5484407 - DNA, 16 bp, Homo sapiens
gccgcaatacaggaac

SEQ ID NO: 5484408 - DNA, 23 bp, Homo sapiens
gccgcaatctggctcctcctgga

SEQ ID NO: 5484409 - DNA, 18 bp, Homo sapiens
gccgcaccatttctgtca

SEQ ID NO: 5484410 - DNA, 23 bp, Homo sapiens
gccgcaccccagagtgtgggaag

SEQ ID NO: 5484411 - DNA, 13 bp, Homo sapiens
gccgcaccctgca

SEQ ID NO: 5484412 - DNA, 14 bp, Homo sapiens
gccgcaccctgcac

SEQ ID NO: 5484413 - DNA, 21 bp, Homo sapiens
gccgcaccctgcacctgctgc

SEQ ID NO: 5484414 - DNA, 22 bp, Homo sapiens
gccgcaccctgcacctgctgcg

SEQ ID NO: 5484415 - DNA, 16 bp, Homo sapiens
gccgcaccctggctgg

SEQ ID NO: 5484416 - DNA, 17 bp, Homo sapiens
gccgcaccctggctgga

SEQ ID NO: 5484417 - DNA, 21 bp, Homo sapiens
gccgcacctaaagcagccagc

SEQ ID NO: 5484418 - DNA, 21 bp, Homo sapiens
gccgcactagcctccctctcc

SEQ ID NO: 5484419 - DNA, 15 bp, Homo sapiens
gccgcactgggagca

SEQ ID NO: 5484420 - DNA, 15 bp, Homo sapiens
gccgcagaagcagcc

SEQ ID NO: 5484421 - DNA, 19 bp, Homo sapiens
gccgcagaagcagcccctc

SEQ ID NO: 5484422 - DNA, 17 bp, Homo sapiens
gccgcagaccagctggc

SEQ ID NO: 5484423 - DNA, 12 bp, Homo sapiens
gccgcagacctg

SEQ ID NO: 5484424 - DNA, 16 bp, Homo sapiens
gccgcagacctggagc

SEQ ID NO: 5484425 - DNA, 17 bp, Homo sapiens
gccgcagacgggcacag

SEQ ID NO: 5484426 - DNA, 21 bp, Homo sapiens
gccgcagacgggcacagacac

SEQ ID NO: 5484427 - DNA, 15 bp, Homo sapiens
gccgcagagaaatgc

SEQ ID NO: 5484428 - DNA, 19 bp, Homo sapiens
gccgcagagaaatgcccca

SEQ ID NO: 5484429 - DNA, 21 bp, Homo sapiens
gccgcagagaaatgccccagt

SEQ ID NO: 5484430 - DNA, 12 bp, Homo sapiens
gccgcagccccc

SEQ ID NO: 5484431 - DNA, 14 bp, Homo sapiens
gccgcagcccccac

SEQ ID NO: 5484432 - DNA, 23 bp, Homo sapiens
gccgcagcccccactgacctgcc

SEQ ID NO: 5484433 - DNA, 11 bp, Homo sapiens
gccgcagccct

SEQ ID NO: 5484434 - DNA, 15 bp, Homo sapiens
gccgcagctcttgcc

SEQ ID NO: 5484435 - DNA, 15 bp, Homo sapiens
gccgcaggaaggcag

SEQ ID NO: 5484436 - DNA, 21 bp, Homo sapiens
gccgcaggaaggcagaataaa

SEQ ID NO: 5484437 - DNA, 17 bp, Homo sapiens
gccgcaggagggaggcg

SEQ ID NO: 5484438 - DNA, 18 bp, Homo sapiens
gccgcagggcccaccttg

SEQ ID NO: 5484439 - DNA, 22 bp, Homo sapiens
gccgcagggcccaccttggacc

SEQ ID NO: 5484440 - DNA, 18 bp, Homo sapiens
gccgcagggcgctccggc

SEQ ID NO: 5484441 - DNA, 19 bp, Homo sapiens
gccgcagggcgctccggca

SEQ ID NO: 5484442 - DNA, 23 bp, Homo sapiens
gccgcagggcgctccggcagagg

SEQ ID NO: 5484443 - DNA, 12 bp, Homo sapiens
gccgcaggtgtt

SEQ ID NO: 5484444 - DNA, 20 bp, Homo sapiens
gccgcaggtgtttggcaccc

SEQ ID NO: 5484445 - DNA, 20 bp, Homo sapiens
gccgcagtggggtcaagctg

SEQ ID NO: 5484446 - DNA, 21 bp, Homo sapiens
gccgcagtggggtcaagctga

SEQ ID NO: 5484447 - DNA, 20 bp, Homo sapiens
gccgcataggcccagccagg

SEQ ID NO: 5484448 - DNA, 15 bp, Homo sapiens
gccgcatctgcctgg

SEQ ID NO: 5484449 - DNA, 16 bp, Homo sapiens
gccgcatctgcctgga

SEQ ID NO: 5484450 - DNA, 17 bp, Homo sapiens
gccgcatgtctgcatgg

SEQ ID NO: 5484451 - DNA, 17 bp, Homo sapiens
gccgcattggtgactca

SEQ ID NO: 5484452 - DNA, 15 bp, Homo sapiens
gccgccacctgaggt

SEQ ID NO: 5484453 - DNA, 14 bp, Homo sapiens
gccgccactaggtg

SEQ ID NO: 5484454 - DNA, 17 bp, Homo sapiens
gccgccactaggtgtcc

SEQ ID NO: 5484455 - DNA, 19 bp, Homo sapiens
gccgccactaggtgtcccc

SEQ ID NO: 5484456 - DNA, 21 bp, Homo sapiens
gccgccactcccgggccaaga

SEQ ID NO: 5484457 - DNA, 17 bp, Homo sapiens
gccgccagcgtgtggag

SEQ ID NO: 5484458 - DNA, 14 bp, Homo sapiens
gccgccaggactgt

SEQ ID NO: 5484459 - DNA, 18 bp, Homo sapiens
gccgccatagccccagta

SEQ ID NO: 5484460 - DNA, 17 bp, Homo sapiens
gccgccatccgggacgc

SEQ ID NO: 5484461 - DNA, 20 bp, Homo sapiens
gccgccatctgcgcagggtg

SEQ ID NO: 5484462 - DNA, 22 bp, Homo sapiens
gccgcccacatcgggctcacct

SEQ ID NO: 5484463 - DNA, 13 bp, Homo sapiens
gccgcccacctcg

SEQ ID NO: 5484464 - DNA, 15 bp, Homo sapiens
gccgcccacctgcat

SEQ ID NO: 5484465 - DNA, 16 bp, Homo sapiens
gccgcccacctgcatc

SEQ ID NO: 5484466 - DNA, 20 bp, Homo sapiens
gccgcccacctgcatcagcc

SEQ ID NO: 5484467 - DNA, 18 bp, Homo sapiens
gccgcccacgccggcctc

SEQ ID NO: 5484468 - DNA, 21 bp, Homo sapiens
gccgcccacgccggcctctgc

SEQ ID NO: 5484469 - DNA, 20 bp, Homo sapiens
gccgcccagacaccacagac

SEQ ID NO: 5484470 - DNA, 23 bp, Homo sapiens
gccgcccagtgggacccacagtc

SEQ ID NO: 5484471 - DNA, 17 bp, Homo sapiens
gccggccgcgcaccgcc

SEQ ID NO: 5484472 - DNA, 14 bp, Homo sapiens
gccggccggctggg

SEQ ID NO: 5484473 - DNA, 19 bp, Homo sapiens
gccggcctcctcctcaccc

SEQ ID NO: 5484474 - DNA, 12 bp, Homo sapiens
gccggcctctct

SEQ ID NO: 5484475 - DNA, 13 bp, Homo sapiens
gccggcctctctg

SEQ ID NO: 5484476 - DNA, 14 bp, Homo sapiens
gccggcctctctgg

SEQ ID NO: 5484477 - DNA, 16 bp, Homo sapiens
gccggcctctctggcc

SEQ ID NO: 5484478 - DNA, 19 bp, Homo sapiens
gccggcctctctggcctcc

SEQ ID NO: 5484479 - DNA, 17 bp, Homo sapiens
gccggcctctgctgccc

SEQ ID NO: 5484480 - DNA, 15 bp, Homo sapiens
gccggcctgagaaac

SEQ ID NO: 5484481 - DNA, 14 bp, Homo sapiens
gccggcgccccgga

SEQ ID NO: 5484482 - DNA, 19 bp, Homo sapiens
gccggcggcagccccactt

SEQ ID NO: 5484483 - DNA, 14 bp, Homo sapiens
gccggctctgggcc

SEQ ID NO: 5484484 - DNA, 18 bp, Homo sapiens
gccggctctgggcctgag

SEQ ID NO: 5484485 - DNA, 16 bp, Homo sapiens
gccggctctggtggcc

SEQ ID NO: 5484486 - DNA, 16 bp, Homo sapiens
gccggctgagtggcag

SEQ ID NO: 5484487 - DNA, 22 bp, Homo sapiens
gccggctgagtggcagcagccc

SEQ ID NO: 5484488 - DNA, 22 bp, Homo sapiens
gccggctggaaatgctgggctg

SEQ ID NO: 5484489 - DNA, 22 bp, Homo sapiens
gccggctggcctggaggctcag

SEQ ID NO: 5484490 - DNA, 11 bp, Homo sapiens
gccggctggtt

SEQ ID NO: 5484491 - DNA, 17 bp, Homo sapiens
gccggctgtgcagtcct

SEQ ID NO: 5484492 - DNA, 21 bp, Homo sapiens
gccggctgtgcagtcctgggt

SEQ ID NO: 5484493 - DNA, 16 bp, Homo sapiens
gccggctgtgctcaga

SEQ ID NO: 5484494 - DNA, 16 bp, Homo sapiens
gccggctgtggagcaa

SEQ ID NO: 5484495 - DNA, 15 bp, Homo sapiens
gccggctgtttcctg

SEQ ID NO: 5484496 - DNA, 18 bp, Homo sapiens
gccggcttcctccttcca

SEQ ID NO: 5484497 - DNA, 18 bp, Homo sapiens
gccggcttctgcctgggg

SEQ ID NO: 5484498 - DNA, 12 bp, Homo sapiens
gccggctttcag

SEQ ID NO: 5484499 - DNA, 16 bp, Homo sapiens
gccggctttcaggagc

SEQ ID NO: 5484500 - DNA, 18 bp, Homo sapiens
gccggctttcagggcagc

SEQ ID NO: 5484501 - DNA, 20 bp, Homo sapiens
gccgggaacagacaacagaa

SEQ ID NO: 5484502 - DNA, 17 bp, Homo sapiens
gccgggaagagccacct

SEQ ID NO: 5484503 - DNA, 19 bp, Homo sapiens
gccgggacatgcagctctg

SEQ ID NO: 5484504 - DNA, 18 bp, Homo sapiens
gccgggaccaccctgagc

SEQ ID NO: 5484505 - DNA, 14 bp, Homo sapiens
gccgggactgctgc

SEQ ID NO: 5484506 - DNA, 23 bp, Homo sapiens
gccgggactgctgctctcccaag

SEQ ID NO: 5484507 - DNA, 13 bp, Homo sapiens
gccgggagcctga

SEQ ID NO: 5484508 - DNA, 19 bp, Homo sapiens
gccgggagcctgaccctca

SEQ ID NO: 5484509 - DNA, 22 bp, Homo sapiens
gccgggagcgagtaaagtctgg

SEQ ID NO: 5484510 - DNA, 14 bp, Homo sapiens
gccgggagcttggc

SEQ ID NO: 5484511 - DNA, 12 bp, Homo sapiens
gccgggcacagc

SEQ ID NO: 5484512 - DNA, 16 bp, Homo sapiens
gccgggcacagctgtg

SEQ ID NO: 5484513 - DNA, 17 bp, Homo sapiens
gccgggcacagctgtgg

SEQ ID NO: 5484514 - DNA, 21 bp, Homo sapiens
gccgggcacagtggctcacgc

SEQ ID NO: 5484515 - DNA, 22 bp, Homo sapiens
gccgggcacattgagctgtgca

SEQ ID NO: 5484516 - DNA, 21 bp, Homo sapiens
gccgggcaccacccccagtcc

SEQ ID NO: 5484517 - DNA, 14 bp, Homo sapiens
gccgggcagagcac

SEQ ID NO: 5484518 - DNA, 15 bp, Homo sapiens
gccgggcaggcctgc

SEQ ID NO: 5484519 - DNA, 22 bp, Homo sapiens
gccgggcaggcgtgactcagca

SEQ ID NO: 5484520 - DNA, 17 bp, Homo sapiens
gccgggcagggtgtggg

SEQ ID NO: 5484521 - DNA, 15 bp, Homo sapiens
gccgggcatgatggt

SEQ ID NO: 5484522 - DNA, 19 bp, Homo sapiens
gccgggcatggtggcaggc

SEQ ID NO: 5484523 - DNA, 23 bp, Homo sapiens
gccgggcatggtggcgcaagcct

SEQ ID NO: 5484524 - DNA, 14 bp, Homo sapiens
gccgggcccagggc

SEQ ID NO: 5484525 - DNA, 15 bp, Homo sapiens
gccgggcccagggcc

SEQ ID NO: 5484526 - DNA, 14 bp, Homo sapiens
gccgggccccatgg

SEQ ID NO: 5484527 - DNA, 12 bp, Homo sapiens
gccgggcccctg

SEQ ID NO: 5484528 - DNA, 17 bp, Homo sapiens
gccgggcccctgggctt

SEQ ID NO: 5484529 - DNA, 13 bp, Homo sapiens
gccgggcctccca

SEQ ID NO: 5484530 - DNA, 12 bp, Homo sapiens
gccgggcctgga

SEQ ID NO: 5484531 - DNA, 14 bp, Homo sapiens
gccgggcctgggcc

SEQ ID NO: 5484532 - DNA, 16 bp, Homo sapiens
gccgggcctgggcctc

SEQ ID NO: 5484533 - DNA, 13 bp, Homo sapiens
gccgggcgcagtg

SEQ ID NO: 5484534 - DNA, 15 bp, Homo sapiens
gccgggcgccaggac

SEQ ID NO: 5484535 - DNA, 16 bp, Homo sapiens
gccgggcgccaggaca

SEQ ID NO: 5484536 - DNA, 17 bp, Homo sapiens
gccgggcgccaggacag

SEQ ID NO: 5484537 - DNA, 16 bp, Homo sapiens
gccgggcgcggtggct

SEQ ID NO: 5484538 - DNA, 16 bp, Homo sapiens
gccgggcggtcacagc

SEQ ID NO: 5484539 - DNA, 19 bp, Homo sapiens
gccgggcgtggtggcgggc

SEQ ID NO: 5484540 - DNA, 19 bp, Homo sapiens
gccgggctccagggagtgg

SEQ ID NO: 5484541 - DNA, 24 bp, Homo sapiens
gccgggctgcccttcgctgccagg

SEQ ID NO: 5484542 - DNA, 15 bp, Homo sapiens
gccgggctgctgctg

SEQ ID NO: 5484543 - DNA, 20 bp, Homo sapiens
gccgggctggcttctccctg

SEQ ID NO: 5484544 - DNA, 18 bp, Homo sapiens
gccgggcttgggccctgc

SEQ ID NO: 5484545 - DNA, 19 bp, Homo sapiens
gccgggcttgggccctgca

SEQ ID NO: 5484546 - DNA, 22 bp, Homo sapiens
gccgggcttgggccctgcacag

SEQ ID NO: 5484547 - DNA, 16 bp, Homo sapiens
gccgggctttccagaa

SEQ ID NO: 5484548 - DNA, 23 bp, Homo sapiens
gccgggctttccagaaggccaca

SEQ ID NO: 5484549 - DNA, 20 bp, Homo sapiens
gccggggaactggccaagct

SEQ ID NO: 5484550 - DNA, 18 bp, Homo sapiens
gccggggaagctgccagc

SEQ ID NO: 5484551 - DNA, 22 bp, Homo sapiens
gccggggaagctgccagcccag

SEQ ID NO: 5484552 - DNA, 16 bp, Homo sapiens
gccggggacagaggcc

SEQ ID NO: 5484553 - DNA, 14 bp, Homo sapiens
gccggggagctgag

SEQ ID NO: 5484554 - DNA, 19 bp, Homo sapiens
gccggggaggggcagagag

SEQ ID NO: 5484555 - DNA, 23 bp, Homo sapiens
gccggggaggggcagagaggaag

SEQ ID NO: 5484556 - DNA, 23 bp, Homo sapiens
gccggggagggggcacggcaggc

SEQ ID NO: 5484557 - DNA, 21 bp, Homo sapiens
gccggggatggatcttttcta

SEQ ID NO: 5484558 - DNA, 13 bp, Homo sapiens
gccggggcctgga

SEQ ID NO: 5484559 - DNA, 17 bp, Homo sapiens
gccggggcgagtggcac

SEQ ID NO: 5484560 - DNA, 20 bp, Homo sapiens
gccggggctctgggtgctgc

SEQ ID NO: 5484561 - DNA, 23 bp, Homo sapiens
gccggggctctgggtgctgccct

SEQ ID NO: 5484562 - DNA, 16 bp, Homo sapiens
gccggggctgaagcca

SEQ ID NO: 5484563 - DNA, 18 bp, Homo sapiens
gccggggctgaagccaca

SEQ ID NO: 5484564 - DNA, 21 bp, Homo sapiens
gccggggctgaagccacacag

SEQ ID NO: 5484565 - DNA, 13 bp, Homo sapiens
gccggggctgccg

SEQ ID NO: 5484566 - DNA, 17 bp, Homo sapiens
gccggggctggccctgc

SEQ ID NO: 5484567 - DNA, 18 bp, Homo sapiens
gccggggctggccctgcc

SEQ ID NO: 5484568 - DNA, 21 bp, Homo sapiens
gccggggcttctgtgcacctg

SEQ ID NO: 5484569 - DNA, 23 bp, Homo sapiens
gccgggggaggggccctcaggcc

SEQ ID NO: 5484570 - DNA, 17 bp, Homo sapiens
gccggggggagcaggag

SEQ ID NO: 5484571 - DNA, 23 bp, Homo sapiens
gccggggggggtaggagaggaga

SEQ ID NO: 5484572 - DNA, 13 bp, Homo sapiens
gccggggtcctgg

SEQ ID NO: 5484573 - DNA, 16 bp, Homo sapiens
gccggggtcctgggag

SEQ ID NO: 5484574 - DNA, 22 bp, Homo sapiens
gccggggtggagcatgggcctg

SEQ ID NO: 5484575 - DNA, 12 bp, Homo sapiens
gccggggtggat

SEQ ID NO: 5484576 - DNA, 19 bp, Homo sapiens
gccggggtggggtgcctga

SEQ ID NO: 5484577 - DNA, 22 bp, Homo sapiens
gccggggtggggtgcctgagcc

SEQ ID NO: 5484578 - DNA, 19 bp, Homo sapiens
gccggggtggggtggctgc

SEQ ID NO: 5484579 - DNA, 20 bp, Homo sapiens
gccggggtggggtggctgca

SEQ ID NO: 5484580 - DNA, 22 bp, Homo sapiens
gccggggtggggtggctgcagc

SEQ ID NO: 5484581 - DNA, 24 bp, Homo sapiens
gccggggtgtaacttcctgctgca

SEQ ID NO: 5484582 - DNA, 16 bp, Homo sapiens
gccggggtgtggaatc

SEQ ID NO: 5484583 - DNA, 22 bp, Homo sapiens
gccgggtactgagagtctgcac

SEQ ID NO: 5484584 - DNA, 19 bp, Homo sapiens
gccgggtccggcctctccc

SEQ ID NO: 5484585 - DNA, 14 bp, Homo sapiens
gccgggtctgcctc

SEQ ID NO: 5484586 - DNA, 16 bp, Homo sapiens
gccgggtgcggtggct

SEQ ID NO: 5484587 - DNA, 19 bp, Homo sapiens
gccgggtgcggtggctcac

SEQ ID NO: 5484588 - DNA, 23 bp, Homo sapiens
gccgggtgtccccaacagcgccc

SEQ ID NO: 5484589 - DNA, 19 bp, Homo sapiens
gccgggttggaggcctcac

SEQ ID NO: 5484590 - DNA, 16 bp, Homo sapiens
gccggtaactgtcctg

SEQ ID NO: 5484591 - DNA, 17 bp, Homo sapiens
gccggtaactgtcctgt

SEQ ID NO: 5484592 - DNA, 22 bp, Homo sapiens
gccggtaactgtcctgtcctgc

SEQ ID NO: 5484593 - DNA, 20 bp, Homo sapiens
gccggtagaggctccccagg

SEQ ID NO: 5484594 - DNA, 14 bp, Homo sapiens
gccggtaggctgct

SEQ ID NO: 5484595 - DNA, 15 bp, Homo sapiens
gccggtaggctgctg

SEQ ID NO: 5484596 - DNA, 19 bp, Homo sapiens
gccggtaggctgctggcgc

SEQ ID NO: 5484597 - DNA, 20 bp, Homo sapiens
gccggtaggctgctggcgcc

SEQ ID NO: 5484598 - DNA, 16 bp, Homo sapiens
gccggtcaggcacaca

SEQ ID NO: 5484599 - DNA, 12 bp, Homo sapiens
gccggtcatttt

SEQ ID NO: 5484600 - DNA, 13 bp, Homo sapiens
gccggtcccccat

SEQ ID NO: 5484601 - DNA, 15 bp, Homo sapiens
gccggtccggcgccc

SEQ ID NO: 5484602 - DNA, 19 bp, Homo sapiens
gccggtccggcgccccgca

SEQ ID NO: 5484603 - DNA, 15 bp, Homo sapiens
gccggtcgggcagcc

SEQ ID NO: 5484604 - DNA, 18 bp, Homo sapiens
gccggtcgggcagccagc

SEQ ID NO: 5484605 - DNA, 18 bp, Homo sapiens
gccggtctgcaagtcaga

SEQ ID NO: 5484606 - DNA, 19 bp, Homo sapiens
gccggtctgcaagtcagag

SEQ ID NO: 5484607 - DNA, 20 bp, Homo sapiens
gccggtctgcaagtcagagg

SEQ ID NO: 5484608 - DNA, 14 bp, Homo sapiens
gccggtgaggggag

SEQ ID NO: 5484609 - DNA, 15 bp, Homo sapiens
gccggtgaggggagg

SEQ ID NO: 5484610 - DNA, 18 bp, Homo sapiens
gccggtgaggggaggggc

SEQ ID NO: 5484611 - DNA, 18 bp, Homo sapiens
gccggtgcacaggcctct

SEQ ID NO: 5484612 - DNA, 22 bp, Homo sapiens
gccggtgcacaggcctctgcct

SEQ ID NO: 5484613 - DNA, 14 bp, Homo sapiens
gccggtgccagctg

SEQ ID NO: 5484614 - DNA, 16 bp, Homo sapiens
gccggtgccagctgcc

SEQ ID NO: 5484615 - DNA, 17 bp, Homo sapiens
gccggtgccagctgccc

SEQ ID NO: 5484616 - DNA, 19 bp, Homo sapiens
gccggtgccagctgccctt

SEQ ID NO: 5484617 - DNA, 15 bp, Homo sapiens
gccggtgcctgggtg

SEQ ID NO: 5484618 - DNA, 18 bp, Homo sapiens
gccggtgctgggggcaca

SEQ ID NO: 5484619 - DNA, 23 bp, Homo sapiens
gccggtgctgggttcccactccc

SEQ ID NO: 5484620 - DNA, 18 bp, Homo sapiens
gccggtgggaccctgtcc

SEQ ID NO: 5484621 - DNA, 15 bp, Homo sapiens
gccggtggtgcaggt

SEQ ID NO: 5484622 - DNA, 15 bp, Homo sapiens
gccggtgtccctgga

SEQ ID NO: 5484623 - DNA, 22 bp, Homo sapiens
gccggttttcctcagctctagg

SEQ ID NO: 5484624 - DNA, 16 bp, Homo sapiens
gccgtaaccaggggct

SEQ ID NO: 5484625 - DNA, 18 bp, Homo sapiens
gccgtaattctttctgtc

SEQ ID NO: 5484626 - DNA, 21 bp, Homo sapiens
gccgtaattctttctgtctcc

SEQ ID NO: 5484627 - DNA, 13 bp, Homo sapiens
gccgtaatttaac

SEQ ID NO: 5484628 - DNA, 12 bp, Homo sapiens
gccgtacagttc

SEQ ID NO: 5484629 - DNA, 16 bp, Homo sapiens
gccgtaccccaccctc

SEQ ID NO: 5484630 - DNA, 23 bp, Homo sapiens
gccgtagcgtttccgtgagctca

SEQ ID NO: 5484631 - DNA, 18 bp, Homo sapiens
gccgtagggtggcactgg

SEQ ID NO: 5484632 - DNA, 13 bp, Homo sapiens
gccgtatctgagg

SEQ ID NO: 5484633 - DNA, 14 bp, Homo sapiens
gccgtatctgtcac

SEQ ID NO: 5484634 - DNA, 23 bp, Homo sapiens
gccgtattttacatgaagctgta

SEQ ID NO: 5484635 - DNA, 23 bp, Homo sapiens
gccgtcaccaccacccctaccac

SEQ ID NO: 5484636 - DNA, 20 bp, Homo sapiens
gccgtcaccccgccagccta

SEQ ID NO: 5484637 - DNA, 21 bp, Homo sapiens
gccgtcaccccgccagcctac

SEQ ID NO: 5484638 - DNA, 16 bp, Homo sapiens
gccgtcaccctgggag

SEQ ID NO: 5484639 - DNA, 12 bp, Homo sapiens
gccgtcacctct

SEQ ID NO: 5484640 - DNA, 23 bp, Homo sapiens
gccgtcactattcatcaatgaag

SEQ ID NO: 5484641 - DNA, 20 bp, Homo sapiens
gccgtcagccatcagccatg

SEQ ID NO: 5484642 - DNA, 19 bp, Homo sapiens
gccgtccatggcaccagcc

SEQ ID NO: 5484643 - DNA, 20 bp, Homo sapiens
gccgtccatggcaccagccc

SEQ ID NO: 5484644 - DNA, 14 bp, Homo sapiens
gccgtcccaggcca

SEQ ID NO: 5484645 - DNA, 15 bp, Homo sapiens
gccgtcccaggccac

SEQ ID NO: 5484646 - DNA, 20 bp, Homo sapiens
gccgtcccctagagtcccag

SEQ ID NO: 5484647 - DNA, 18 bp, Homo sapiens
gccgtcccgcgttcaaga

SEQ ID NO: 5484648 - DNA, 18 bp, Homo sapiens
gcctagaaatatctttct

SEQ ID NO: 5484649 - DNA, 16 bp, Homo sapiens
gcctagaacatccctg

SEQ ID NO: 5484650 - DNA, 18 bp, Homo sapiens
gcctagaacatccctggg

SEQ ID NO: 5484651 - DNA, 19 bp, Homo sapiens
gcctagaacatccctgggc

SEQ ID NO: 5484652 - DNA, 21 bp, Homo sapiens
gcctagaacatccctgggcaa

SEQ ID NO: 5484653 - DNA, 13 bp, Homo sapiens
gcctagaagctgg

SEQ ID NO: 5484654 - DNA, 18 bp, Homo sapiens
gcctagaatctttattca

SEQ ID NO: 5484655 - DNA, 13 bp, Homo sapiens
gcctagactgtgt

SEQ ID NO: 5484656 - DNA, 15 bp, Homo sapiens
gcctagactgttact

SEQ ID NO: 5484657 - DNA, 20 bp, Homo sapiens
gcctagactgttactttggc

SEQ ID NO: 5484658 - DNA, 19 bp, Homo sapiens
gcctagacttgtgtgttct

SEQ ID NO: 5484659 - DNA, 16 bp, Homo sapiens
gcctagagcgcggctg

SEQ ID NO: 5484660 - DNA, 20 bp, Homo sapiens
gcctagagcgcggctggctc

SEQ ID NO: 5484661 - DNA, 13 bp, Homo sapiens
gcctagaggagga

SEQ ID NO: 5484662 - DNA, 22 bp, Homo sapiens
gcctagaggaggaaaaaggctg

SEQ ID NO: 5484663 - DNA, 13 bp, Homo sapiens
gcctagaggcctg

SEQ ID NO: 5484664 - DNA, 14 bp, Homo sapiens
gcctagagtggcag

SEQ ID NO: 5484665 - DNA, 17 bp, Homo sapiens
gcctagatccacacaca

SEQ ID NO: 5484666 - DNA, 20 bp, Homo sapiens
gcctagatccacacacagag

SEQ ID NO: 5484667 - DNA, 23 bp, Homo sapiens
gcctagatccacacacagaggaa

SEQ ID NO: 5484668 - DNA, 21 bp, Homo sapiens
gcctagatccacgtgtggcct

SEQ ID NO: 5484669 - DNA, 22 bp, Homo sapiens
gcctagatccacgtgtggcctc

SEQ ID NO: 5484670 - DNA, 23 bp, Homo sapiens
gcctagatccacgtgtggcctcc

SEQ ID NO: 5484671 - DNA, 21 bp, Homo sapiens
gcctagatttggagactttgt

SEQ ID NO: 5484672 - DNA, 15 bp, Homo sapiens
gcctagcaagctggc

SEQ ID NO: 5484673 - DNA, 16 bp, Homo sapiens
gcctagcaagctggcc

SEQ ID NO: 5484674 - DNA, 16 bp, Homo sapiens
gcctagcacagcagct

SEQ ID NO: 5484675 - DNA, 21 bp, Homo sapiens
gcctagcagagtgctggcact

SEQ ID NO: 5484676 - DNA, 23 bp, Homo sapiens
gcctagcatacgtacacatttta

SEQ ID NO: 5484677 - DNA, 12 bp, Homo sapiens
gcctagccacct

SEQ ID NO: 5484678 - DNA, 14 bp, Homo sapiens
gcctagccacctcc

SEQ ID NO: 5484679 - DNA, 23 bp, Homo sapiens
gcctagccacctcccaccccact

SEQ ID NO: 5484680 - DNA, 15 bp, Homo sapiens
gcctagcctataaat

SEQ ID NO: 5484681 - DNA, 18 bp, Homo sapiens
gcctagcctatgtctggc

SEQ ID NO: 5484682 - DNA, 17 bp, Homo sapiens
gcctagctcttgggcct

SEQ ID NO: 5484683 - DNA, 22 bp, Homo sapiens
gcctagctgctacaaagaagac

SEQ ID NO: 5484684 - DNA, 23 bp, Homo sapiens
gcctagctgctacaaagaagaca

SEQ ID NO: 5484685 - DNA, 13 bp, Homo sapiens
gcctagctgctgt

SEQ ID NO: 5484686 - DNA, 15 bp, Homo sapiens
gcctagctgctgtca

SEQ ID NO: 5484687 - DNA, 15 bp, Homo sapiens
gcctaggaccactca

SEQ ID NO: 5484688 - DNA, 23 bp, Homo sapiens
gcctaggaccactcagcccctag

SEQ ID NO: 5484689 - DNA, 13 bp, Homo sapiens
gcctaggacgcca

SEQ ID NO: 5484690 - DNA, 23 bp, Homo sapiens
gcctaggacgccaacttctccca

SEQ ID NO: 5484691 - DNA, 11 bp, Homo sapiens
gcctaggagat

SEQ ID NO: 5484692 - DNA, 18 bp, Homo sapiens
gcctaggagatatctgag

SEQ ID NO: 5484693 - DNA, 15 bp, Homo sapiens
gcctaggagctggct

SEQ ID NO: 5484694 - DNA, 19 bp, Homo sapiens
gcctaggagctggctggca

SEQ ID NO: 5484695 - DNA, 14 bp, Homo sapiens
gcctaggagctggg

SEQ ID NO: 5484696 - DNA, 15 bp, Homo sapiens
gcctaggaggactgg

SEQ ID NO: 5484697 - DNA, 17 bp, Homo sapiens
gcctaggaggctggcca

SEQ ID NO: 5484698 - DNA, 18 bp, Homo sapiens
gcctaggaggctggccaa

SEQ ID NO: 5484699 - DNA, 15 bp, Homo sapiens
gcctaggagggtcct

SEQ ID NO: 5484700 - DNA, 16 bp, Homo sapiens
gcctaggagggtcctc

SEQ ID NO: 5484701 - DNA, 21 bp, Homo sapiens
gcctaggagttgagtacagtg

SEQ ID NO: 5484702 - DNA, 15 bp, Homo sapiens
gcctaggattctaaa

SEQ ID NO: 5484703 - DNA, 16 bp, Homo sapiens
gcctaggattctaaaa

SEQ ID NO: 5484704 - DNA, 13 bp, Homo sapiens
gcctaggatttca

SEQ ID NO: 5484705 - DNA, 20 bp, Homo sapiens
gcctaggatttcagccatgc

SEQ ID NO: 5484706 - DNA, 15 bp, Homo sapiens
gcctaggcagccagc

SEQ ID NO: 5484707 - DNA, 19 bp, Homo sapiens
gcctaggccaaatgcacaa

SEQ ID NO: 5484708 - DNA, 12 bp, Homo sapiens
gcctaggccagc

SEQ ID NO: 5484709 - DNA, 19 bp, Homo sapiens
gcctaggccaggagttccc

SEQ ID NO: 5484710 - DNA, 16 bp, Homo sapiens
gcctaggcctcagcca

SEQ ID NO: 5484711 - DNA, 19 bp, Homo sapiens
gcctaggcctgggcagtgg

SEQ ID NO: 5484712 - DNA, 16 bp, Homo sapiens
gcctaggcttggctcc

SEQ ID NO: 5484713 - DNA, 17 bp, Homo sapiens
gcctagggtgagggtga

SEQ ID NO: 5484714 - DNA, 21 bp, Homo sapiens
gcctaggtcccttcccgaccc

SEQ ID NO: 5484715 - DNA, 22 bp, Homo sapiens
gcctaggtcccttcccgaccca

SEQ ID NO: 5484716 - DNA, 23 bp, Homo sapiens
gcctaggtcccttcccgacccag

SEQ ID NO: 5484717 - DNA, 14 bp, Homo sapiens
gcctaggtgacaga

SEQ ID NO: 5484718 - DNA, 14 bp, Homo sapiens
gcctaggtgggagc

SEQ ID NO: 5484719 - DNA, 17 bp, Homo sapiens
gcctagtaaatgttaac

SEQ ID NO: 5484720 - DNA, 20 bp, Homo sapiens
gcctagtaaccaaggccctg

SEQ ID NO: 5484721 - DNA, 20 bp, Homo sapiens
gcctagtacaatcttgggaa

SEQ ID NO: 5484722 - DNA, 20 bp, Homo sapiens
gcctagtaggagctgagctt

SEQ ID NO: 5484723 - DNA, 19 bp, Homo sapiens
gcctagtcagccacatggg

SEQ ID NO: 5484724 - DNA, 22 bp, Homo sapiens
gcctagtcagccacatgggaaa

SEQ ID NO: 5484725 - DNA, 15 bp, Homo sapiens
gcctagtgggagtta

SEQ ID NO: 5484726 - DNA, 20 bp, Homo sapiens
gcctagtggggaggggcctg

SEQ ID NO: 5484727 - DNA, 21 bp, Homo sapiens
gcctagttatcaaggggatga

SEQ ID NO: 5484728 - DNA, 21 bp, Homo sapiens
gcctagttcatccaatcctca

SEQ ID NO: 5484729 - DNA, 22 bp, Homo sapiens
gcctagttcctgtggccaggag

SEQ ID NO: 5484730 - DNA, 16 bp, Homo sapiens
gcctagtttactgttt

SEQ ID NO: 5484731 - DNA, 21 bp, Homo sapiens
gcctagtttttagtaatctgt

SEQ ID NO: 5484732 - DNA, 14 bp, Homo sapiens
gcctataacttttt

SEQ ID NO: 5484733 - DNA, 18 bp, Homo sapiens
gcctataatacttgcaac

SEQ ID NO: 5484734 - DNA, 13 bp, Homo sapiens
gcctataatccca

SEQ ID NO: 5484735 - DNA, 20 bp, Homo sapiens
gcctataatcccagcatgtt

SEQ ID NO: 5484736 - DNA, 16 bp, Homo sapiens
gcctataatgaagctt

SEQ ID NO: 5484737 - DNA, 17 bp, Homo sapiens
gcctatacgtttctgtg

SEQ ID NO: 5484738 - DNA, 15 bp, Homo sapiens
gcctatagattgatt

SEQ ID NO: 5484739 - DNA, 15 bp, Homo sapiens
gcctatatttataaa

SEQ ID NO: 5484740 - DNA, 20 bp, Homo sapiens
gcctatcaacctaagcaaca

SEQ ID NO: 5484741 - DNA, 13 bp, Homo sapiens
gcctatcagtgtg

SEQ ID NO: 5484742 - DNA, 16 bp, Homo sapiens
gcctatcctaagagct

SEQ ID NO: 5484743 - DNA, 21 bp, Homo sapiens
gcctatctaatttctttagtt

SEQ ID NO: 5484744 - DNA, 21 bp, Homo sapiens
gcctatctcctagggctatgg

SEQ ID NO: 5484745 - DNA, 13 bp, Homo sapiens
gcctatgaccctg

SEQ ID NO: 5484746 - DNA, 21 bp, Homo sapiens
gcctatgaccctgtgcctgtg

SEQ ID NO: 5484747 - DNA, 20 bp, Homo sapiens
gcctatgagcatcctgagcc

SEQ ID NO: 5484748 - DNA, 21 bp, Homo sapiens
gcctatgagcatcctgagccc

SEQ ID NO: 5484749 - DNA, 22 bp, Homo sapiens
gcctatgagcatcctgagcccc

SEQ ID NO: 5484750 - DNA, 20 bp, Homo sapiens
gcctatgcacatatggactc

SEQ ID NO: 5484751 - DNA, 21 bp, Homo sapiens
gcctatgcactgaagagctct

SEQ ID NO: 5484752 - DNA, 22 bp, Homo sapiens
gcctatgcagacatctctggag

SEQ ID NO: 5484753 - DNA, 23 bp, Homo sapiens
gcctatgcagacatctctggagc

SEQ ID NO: 5484754 - DNA, 19 bp, Homo sapiens
gcctatgccctgcccttcc

SEQ ID NO: 5484755 - DNA, 22 bp, Homo sapiens
gcctatggaaagggtgtggctt

SEQ ID NO: 5484756 - DNA, 13 bp, Homo sapiens
gcctatggagagc

SEQ ID NO: 5484757 - DNA, 16 bp, Homo sapiens
gcctatggagagccct

SEQ ID NO: 5484758 - DNA, 18 bp, Homo sapiens
gcctatggagagccctgg

SEQ ID NO: 5484759 - DNA, 19 bp, Homo sapiens
gcctatggagagccctggg

SEQ ID NO: 5484760 - DNA, 20 bp, Homo sapiens
gcctatggagagccctggga

SEQ ID NO: 5484761 - DNA, 22 bp, Homo sapiens
gcctatggagagccctgggacc

SEQ ID NO: 5484762 - DNA, 12 bp, Homo sapiens
gcctatgtctgg

SEQ ID NO: 5484763 - DNA, 19 bp, Homo sapiens
gcctatgttgggggggacc

SEQ ID NO: 5484764 - DNA, 20 bp, Homo sapiens
gcctatgttttcttttagtt

SEQ ID NO: 5484765 - DNA, 20 bp, Homo sapiens
gcctattagatgttttacaa

SEQ ID NO: 5484766 - DNA, 15 bp, Homo sapiens
gcctattatattaaa

SEQ ID NO: 5484767 - DNA, 21 bp, Homo sapiens
gcctattccaggaattcctct

SEQ ID NO: 5484768 - DNA, 15 bp, Homo sapiens
gcctattgatacttg

SEQ ID NO: 5484769 - DNA, 19 bp, Homo sapiens
gcctattgctagagctcct

SEQ ID NO: 5484770 - DNA, 21 bp, Homo sapiens
gcctattgtaatatagaaaaa

SEQ ID NO: 5484771 - DNA, 18 bp, Homo sapiens
gcctattgttgaataaat

SEQ ID NO: 5484772 - DNA, 21 bp, Homo sapiens
gcctatttaacaagatgtttc

SEQ ID NO: 5484773 - DNA, 14 bp, Homo sapiens
gcctatttaagccc

SEQ ID NO: 5484774 - DNA, 23 bp, Homo sapiens
gcctatttactggaaacctgtta

SEQ ID NO: 5484775 - DNA, 17 bp, Homo sapiens
gcctatttattcattca

SEQ ID NO: 5484776 - DNA, 18 bp, Homo sapiens
gcctatttattcattcag

SEQ ID NO: 5484777 - DNA, 18 bp, Homo sapiens
gcctatttattggggtgc

SEQ ID NO: 5484778 - DNA, 16 bp, Homo sapiens
gcctatttatttgaaa

SEQ ID NO: 5484779 - DNA, 19 bp, Homo sapiens
gcctatttcagctgctttg

SEQ ID NO: 5484780 - DNA, 17 bp, Homo sapiens
gcctattttggtgaggt

SEQ ID NO: 5484781 - DNA, 23 bp, Homo sapiens
gcctatttttttagattgagaaa

SEQ ID NO: 5484782 - DNA, 14 bp, Homo sapiens
gcctcaaaaacagt

SEQ ID NO: 5484783 - DNA, 20 bp, Homo sapiens
gcctcaaaaacgccctcaag

SEQ ID NO: 5484784 - DNA, 20 bp, Homo sapiens
gcctcaaaacgggtcagtat

SEQ ID NO: 5484785 - DNA, 12 bp, Homo sapiens
gcctcaaaatgt

SEQ ID NO: 5484786 - DNA, 13 bp, Homo sapiens
gcctcaaaatgtg

SEQ ID NO: 5484787 - DNA, 14 bp, Homo sapiens
gcctcaaaatgtgt

SEQ ID NO: 5484788 - DNA, 22 bp, Homo sapiens
gcctcaaagcaagcattcagaa

SEQ ID NO: 5484789 - DNA, 20 bp, Homo sapiens
gcctcaaataaaaagtgctt

SEQ ID NO: 5484790 - DNA, 16 bp, Homo sapiens
gcctcaaatccaggac

SEQ ID NO: 5484791 - DNA, 18 bp, Homo sapiens
gcctcaaatccaggaccc

SEQ ID NO: 5484792 - DNA, 13 bp, Homo sapiens
gcctcaaatgcag

SEQ ID NO: 5484793 - DNA, 19 bp, Homo sapiens
gcctcaacagcaggaggca

SEQ ID NO: 5484794 - DNA, 23 bp, Homo sapiens
gcctcaaccctccctcagcccct

SEQ ID NO: 5484795 - DNA, 16 bp, Homo sapiens
gcctcaacctcctggg

SEQ ID NO: 5484796 - DNA, 14 bp, Homo sapiens
gcctcaaccttctg

SEQ ID NO: 5484797 - DNA, 20 bp, Homo sapiens
gcctcaactccaccctctgc

SEQ ID NO: 5484798 - DNA, 17 bp, Homo sapiens
gcctcaactcctcccat

SEQ ID NO: 5484799 - DNA, 22 bp, Homo sapiens
gcctcaactgagaagccaagcc

SEQ ID NO: 5484800 - DNA, 23 bp, Homo sapiens
gcctcaactgagaagccaagcct

SEQ ID NO: 5484801 - DNA, 14 bp, Homo sapiens
gcctcaagagcaca

SEQ ID NO: 5484802 - DNA, 19 bp, Homo sapiens
gcctcaagcaaggaagcag

SEQ ID NO: 5484803 - DNA, 20 bp, Homo sapiens
gcctcaagcaatccacctgc

SEQ ID NO: 5484804 - DNA, 14 bp, Homo sapiens
gcctcaagccatct

SEQ ID NO: 5484805 - DNA, 17 bp, Homo sapiens
gcctcaagccatcttcc

SEQ ID NO: 5484806 - DNA, 18 bp, Homo sapiens
gcctcaagccatcttccc

SEQ ID NO: 5484807 - DNA, 18 bp, Homo sapiens
gcctcaaggaagagccag

SEQ ID NO: 5484808 - DNA, 19 bp, Homo sapiens
gcctcaaggaagagccagc

SEQ ID NO: 5484809 - DNA, 22 bp, Homo sapiens
gcctcaaggaagagccagccgt

SEQ ID NO: 5484810 - DNA, 13 bp, Homo sapiens
gcctcaaggactt

SEQ ID NO: 5484811 - DNA, 22 bp, Homo sapiens
gcctcaaggatacagggagccg

SEQ ID NO: 5484812 - DNA, 18 bp, Homo sapiens
gcctcaagtcactcccaa

SEQ ID NO: 5484813 - DNA, 15 bp, Homo sapiens
gcctcaagtgagcca

SEQ ID NO: 5484814 - DNA, 21 bp, Homo sapiens
gcctcaagtgattctcctgcc

SEQ ID NO: 5484815 - DNA, 14 bp, Homo sapiens
gcctcaagttcaat

SEQ ID NO: 5484816 - DNA, 18 bp, Homo sapiens
gcctcaataagccttgtc

SEQ ID NO: 5484817 - DNA, 16 bp, Homo sapiens
gcctcaatctaaggcc

SEQ ID NO: 5484818 - DNA, 23 bp, Homo sapiens
gcctcaatggggaattttttgat

SEQ ID NO: 5484819 - DNA, 21 bp, Homo sapiens
gcctcaatgtggttgcaaggc

SEQ ID NO: 5484820 - DNA, 17 bp, Homo sapiens
gcctcaattctccatta

SEQ ID NO: 5484821 - DNA, 21 bp, Homo sapiens
gcctcaattttggtttttctc

SEQ ID NO: 5484822 - DNA, 14 bp, Homo sapiens
gcctcacaaatgct

SEQ ID NO: 5484823 - DNA, 20 bp, Homo sapiens
gcctcccaagtagctgggat

SEQ ID NO: 5484824 - DNA, 17 bp, Homo sapiens
gcctcccaataaagctg

SEQ ID NO: 5484825 - DNA, 16 bp, Homo sapiens
gcctcccacagtgact

SEQ ID NO: 5484826 - DNA, 14 bp, Homo sapiens
gcctcccacagtgc

SEQ ID NO: 5484827 - DNA, 20 bp, Homo sapiens
gcctcccaccagagccggga

SEQ ID NO: 5484828 - DNA, 12 bp, Homo sapiens
gcctcccacccg

SEQ ID NO: 5484829 - DNA, 18 bp, Homo sapiens
gcctcccacccgatgctg

SEQ ID NO: 5484830 - DNA, 17 bp, Homo sapiens
gcctcccaccgcagcgt

SEQ ID NO: 5484831 - DNA, 17 bp, Homo sapiens
gcctcccactcccatgg

SEQ ID NO: 5484832 - DNA, 18 bp, Homo sapiens
gcctcccactcccatggc

SEQ ID NO: 5484833 - DNA, 12 bp, Homo sapiens
gcctcccagagt

SEQ ID NO: 5484834 - DNA, 17 bp, Homo sapiens
gcctcccagagtgctgg

SEQ ID NO: 5484835 - DNA, 20 bp, Homo sapiens
gcctcccagccccaggggtg

SEQ ID NO: 5484836 - DNA, 21 bp, Homo sapiens
gcctcccagccccaggggtgc

SEQ ID NO: 5484837 - DNA, 20 bp, Homo sapiens
gcctcccagccctgccagga

SEQ ID NO: 5484838 - DNA, 18 bp, Homo sapiens
gcctcccagccctgccca

SEQ ID NO: 5484839 - DNA, 13 bp, Homo sapiens
gcctcccagcctg

SEQ ID NO: 5484840 - DNA, 13 bp, Homo sapiens
gcctcccaggcaa

SEQ ID NO: 5484841 - DNA, 15 bp, Homo sapiens
gcctcccaggcaagc

SEQ ID NO: 5484842 - DNA, 19 bp, Homo sapiens
gcctcccaggcaagcagct

SEQ ID NO: 5484843 - DNA, 13 bp, Homo sapiens
gcctcccaggcca

SEQ ID NO: 5484844 - DNA, 14 bp, Homo sapiens
gcctcccaggccac

SEQ ID NO: 5484845 - DNA, 13 bp, Homo sapiens
gcctcccagtggc

SEQ ID NO: 5484846 - DNA, 20 bp, Homo sapiens
gcctcccagtggcctggctt

SEQ ID NO: 5484847 - DNA, 14 bp, Homo sapiens
gcctcccatcaccc

SEQ ID NO: 5484848 - DNA, 17 bp, Homo sapiens
gcctcccatcacccgct

SEQ ID NO: 5484849 - DNA, 19 bp, Homo sapiens
gcctcccatccttccctca

SEQ ID NO: 5484850 - DNA, 17 bp, Homo sapiens
gcctcccattctgcacc

SEQ ID NO: 5484851 - DNA, 20 bp, Homo sapiens
gcctccccaaccctgcccct

SEQ ID NO: 5484852 - DNA, 21 bp, Homo sapiens
gcctccccaaccctgcccctg

SEQ ID NO: 5484853 - DNA, 19 bp, Homo sapiens
gcctccccaacttgagcct

SEQ ID NO: 5484854 - DNA, 18 bp, Homo sapiens
gcctccccaatccaggcc

SEQ ID NO: 5484855 - DNA, 22 bp, Homo sapiens
gcctccccaatccatttggcag

SEQ ID NO: 5484856 - DNA, 20 bp, Homo sapiens
gcctccccaccccagtggga

SEQ ID NO: 5484857 - DNA, 22 bp, Homo sapiens
gcctccccaccccagtgggaac

SEQ ID NO: 5484858 - DNA, 18 bp, Homo sapiens
gcctccccaccctcctct

SEQ ID NO: 5484859 - DNA, 19 bp, Homo sapiens
gcctccccaccctcctctt

SEQ ID NO: 5484860 - DNA, 21 bp, Homo sapiens
gcctccccaccctcctcttgg

SEQ ID NO: 5484861 - DNA, 16 bp, Homo sapiens
gcctccccatacttcc

SEQ ID NO: 5484862 - DNA, 18 bp, Homo sapiens
gcctccccatacttcctg

SEQ ID NO: 5484863 - DNA, 13 bp, Homo sapiens
gcctccccatctg

SEQ ID NO: 5484864 - DNA, 13 bp, Homo sapiens
gcctccccatttc

SEQ ID NO: 5484865 - DNA, 21 bp, Homo sapiens
gcctccccatttcccatctgc

SEQ ID NO: 5484866 - DNA, 23 bp, Homo sapiens
gcctccccatttcccatctgcac

SEQ ID NO: 5484867 - DNA, 12 bp, Homo sapiens
gcctcccccaac

SEQ ID NO: 5484868 - DNA, 21 bp, Homo sapiens
gcctcccccaacacctgctgc

SEQ ID NO: 5484869 - DNA, 22 bp, Homo sapiens
gcctcccccaacacctgctgcg

SEQ ID NO: 5484870 - DNA, 11 bp, Homo sapiens
gcctcccccac

SEQ ID NO: 5484871 - DNA, 13 bp, Homo sapiens
gcctcccccactt

SEQ ID NO: 5484872 - DNA, 20 bp, Homo sapiens
gcctcccccactttctttct

SEQ ID NO: 5484873 - DNA, 24 bp, Homo sapiens
gcctcccccagcacagatgaggag

SEQ ID NO: 5484874 - DNA, 17 bp, Homo sapiens
gcctcccccagccagga

SEQ ID NO: 5484875 - DNA, 12 bp, Homo sapiens
gcctcccccagg

SEQ ID NO: 5484876 - DNA, 15 bp, Homo sapiens
gcctcccccaggctg

SEQ ID NO: 5484877 - DNA, 20 bp, Homo sapiens
gcctcccccaggctgcgcct

SEQ ID NO: 5484878 - DNA, 14 bp, Homo sapiens
gcctccccccagac

SEQ ID NO: 5484879 - DNA, 15 bp, Homo sapiens
gcctccccccagccc

SEQ ID NO: 5484880 - DNA, 17 bp, Homo sapiens
gcctccccccagcccct

SEQ ID NO: 5484881 - DNA, 21 bp, Homo sapiens
gcctccccccagcccctcctc

SEQ ID NO: 5484882 - DNA, 14 bp, Homo sapiens
gcctcccccgccac

SEQ ID NO: 5484883 - DNA, 21 bp, Homo sapiens
gcctcccccgccacctgtgtg

SEQ ID NO: 5484884 - DNA, 16 bp, Homo sapiens
gcctcccccgccagcc

SEQ ID NO: 5484885 - DNA, 20 bp, Homo sapiens
gcctcccccgccagccccaa

SEQ ID NO: 5484886 - DNA, 18 bp, Homo sapiens
gcctccccctagccattt

SEQ ID NO: 5484887 - DNA, 13 bp, Homo sapiens
gcctccccctcag

SEQ ID NO: 5484888 - DNA, 22 bp, Homo sapiens
gcctccccctcagatgatctct

SEQ ID NO: 5484889 - DNA, 18 bp, Homo sapiens
gcctccccgaaacaggct

SEQ ID NO: 5484890 - DNA, 21 bp, Homo sapiens
gcctccccgaggttgtgggga

SEQ ID NO: 5484891 - DNA, 15 bp, Homo sapiens
gcctccccgggggtc

SEQ ID NO: 5484892 - DNA, 11 bp, Homo sapiens
gcctcccctcc

SEQ ID NO: 5484893 - DNA, 23 bp, Homo sapiens
gcctcccctccactccttcccaa

SEQ ID NO: 5484894 - DNA, 19 bp, Homo sapiens
gcctcccctcccctgggga

SEQ ID NO: 5484895 - DNA, 21 bp, Homo sapiens
gcctcccctcccctggggacg

SEQ ID NO: 5484896 - DNA, 22 bp, Homo sapiens
gcctcccctcccctggggacgc

SEQ ID NO: 5484897 - DNA, 12 bp, Homo sapiens
gcctcccctcct

SEQ ID NO: 5484898 - DNA, 17 bp, Homo sapiens
gcctcccctcctctgct

SEQ ID NO: 5484899 - DNA, 22 bp, Homo sapiens
gcctcccctcctctgcttgcca

SEQ ID NO: 5484900 - DNA, 21 bp, Homo sapiens
gcctcccctgaggatcccctg

SEQ ID NO: 5484901 - DNA, 19 bp, Homo sapiens
gcctcccctgccaccaggc

SEQ ID NO: 5484902 - DNA, 14 bp, Homo sapiens
gcctcccctgcgga

SEQ ID NO: 5484903 - DNA, 20 bp, Homo sapiens
gcctcccctgctgaaggtgg

SEQ ID NO: 5484904 - DNA, 20 bp, Homo sapiens
gcctcccctgggttaacaaa

SEQ ID NO: 5484905 - DNA, 21 bp, Homo sapiens
gcctcccctgtctctaaggag

SEQ ID NO: 5484906 - DNA, 20 bp, Homo sapiens
gcctccccttaaaggggaga

SEQ ID NO: 5484907 - DNA, 21 bp, Homo sapiens
gcctccccttaaaggggagac

SEQ ID NO: 5484908 - DNA, 14 bp, Homo sapiens
gcctccccttccca

SEQ ID NO: 5484909 - DNA, 18 bp, Homo sapiens
gcctccccttcccagacc

SEQ ID NO: 5484910 - DNA, 16 bp, Homo sapiens
gcctccccttcttccc

SEQ ID NO: 5484911 - DNA, 17 bp, Homo sapiens
gcctccccttcttcccg

SEQ ID NO: 5484912 - DNA, 19 bp, Homo sapiens
gcctcccgaatagctggga

SEQ ID NO: 5484913 - DNA, 23 bp, Homo sapiens
gcctcccgaatagctgggactac

SEQ ID NO: 5484914 - DNA, 16 bp, Homo sapiens
gcctcccgaggagggg

SEQ ID NO: 5484915 - DNA, 14 bp, Homo sapiens
gcctcccgaggctt

SEQ ID NO: 5484916 - DNA, 21 bp, Homo sapiens
gcctcccgcatgctgcctgcc

SEQ ID NO: 5484917 - DNA, 17 bp, Homo sapiens
gcctcccgccaccctgt

SEQ ID NO: 5484918 - DNA, 17 bp, Homo sapiens
gcctcccgccactcgcc

SEQ ID NO: 5484919 - DNA, 17 bp, Homo sapiens
gcctcccggctttgcag

SEQ ID NO: 5484920 - DNA, 21 bp, Homo sapiens
gcctcccgggaagcatcctcc

SEQ ID NO: 5484921 - DNA, 14 bp, Homo sapiens
gcctcccggggccc

SEQ ID NO: 5484922 - DNA, 16 bp, Homo sapiens
gcctcccggggcccag

SEQ ID NO: 5484923 - DNA, 18 bp, Homo sapiens
gcctcccggggcccagga

SEQ ID NO: 5484924 - DNA, 20 bp, Homo sapiens
gcctccctagttagcatcca

SEQ ID NO: 5484925 - DNA, 23 bp, Homo sapiens
gcctccctagttagcatccaggc

SEQ ID NO: 5484926 - DNA, 14 bp, Homo sapiens
gcctccctatgctt

SEQ ID NO: 5484927 - DNA, 18 bp, Homo sapiens
gcctccctcaccctgagc

SEQ ID NO: 5484928 - DNA, 20 bp, Homo sapiens
gcctccctcaccctgagccc

SEQ ID NO: 5484929 - DNA, 19 bp, Homo sapiens
gcctccctcagccacgcct

SEQ ID NO: 5484930 - DNA, 19 bp, Homo sapiens
gcctccctcagcccccagg

SEQ ID NO: 5484931 - DNA, 20 bp, Homo sapiens
gcctccctcagcccccagga

SEQ ID NO: 5484932 - DNA, 19 bp, Homo sapiens
gcctccctccccagtgcaa

SEQ ID NO: 5484933 - DNA, 13 bp, Homo sapiens
gcctccctcctcg

SEQ ID NO: 5484934 - DNA, 13 bp, Homo sapiens
gcctccctctcca

SEQ ID NO: 5484935 - DNA, 23 bp, Homo sapiens
gcctccctctccatatctccttc

SEQ ID NO: 5484936 - DNA, 20 bp, Homo sapiens
gcctccctctcctctgtccc

SEQ ID NO: 5484937 - DNA, 14 bp, Homo sapiens
gcctccctctgacc

SEQ ID NO: 5484938 - DNA, 21 bp, Homo sapiens
gcctccctctgacctgcaggc

SEQ ID NO: 5484939 - DNA, 22 bp, Homo sapiens
gcctccctgaaaatgtttttct

SEQ ID NO: 5484940 - DNA, 21 bp, Homo sapiens
gcctccctgaaacactgcttc

SEQ ID NO: 5484941 - DNA, 13 bp, Homo sapiens
gcctccctgaagc

SEQ ID NO: 5484942 - DNA, 19 bp, Homo sapiens
gcctccctgacgtctgcca

SEQ ID NO: 5484943 - DNA, 20 bp, Homo sapiens
gcctccctgacgtctgccac

SEQ ID NO: 5484944 - DNA, 12 bp, Homo sapiens
gcctccctgagc

SEQ ID NO: 5484945 - DNA, 17 bp, Homo sapiens
gcctccctgagcctgca

SEQ ID NO: 5484946 - DNA, 18 bp, Homo sapiens
gcctccctgcagccacca

SEQ ID NO: 5484947 - DNA, 14 bp, Homo sapiens
gcctccctgccagt

SEQ ID NO: 5484948 - DNA, 16 bp, Homo sapiens
gcctccctgcctcagc

SEQ ID NO: 5484949 - DNA, 17 bp, Homo sapiens
gcctccctgcctcaggc

SEQ ID NO: 5484950 - DNA, 20 bp, Homo sapiens
gcctccctggggaccaggag

SEQ ID NO: 5484951 - DNA, 15 bp, Homo sapiens
gcctccctggtgaga

SEQ ID NO: 5484952 - DNA, 19 bp, Homo sapiens
gcctccctgtcactcagct

SEQ ID NO: 5484953 - DNA, 21 bp, Homo sapiens
gcctccctgtcactcagctga

SEQ ID NO: 5484954 - DNA, 14 bp, Homo sapiens
gcctccctgtccac

SEQ ID NO: 5484955 - DNA, 21 bp, Homo sapiens
gcctccctgtctccagctgcc

SEQ ID NO: 5484956 - DNA, 22 bp, Homo sapiens
gcctccctgtctccagctgcct

SEQ ID NO: 5484957 - DNA, 20 bp, Homo sapiens
gcctccctgttgaagctctg

SEQ ID NO: 5484958 - DNA, 18 bp, Homo sapiens
gcctcccttatgcaggac

SEQ ID NO: 5484959 - DNA, 18 bp, Homo sapiens
gcctcccttcatgcatgg

SEQ ID NO: 5484960 - DNA, 23 bp, Homo sapiens
gcctcccttcatgcatggaaatt

SEQ ID NO: 5484961 - DNA, 20 bp, Homo sapiens
gcctcccttccatgccccag

SEQ ID NO: 5484962 - DNA, 22 bp, Homo sapiens
gcctcccttccatgccccagga

SEQ ID NO: 5484963 - DNA, 14 bp, Homo sapiens
gcctcccttccgct

SEQ ID NO: 5484964 - DNA, 20 bp, Homo sapiens
gcctcccttccgctgcgggc

SEQ ID NO: 5484965 - DNA, 14 bp, Homo sapiens
gcctcccttctcct

SEQ ID NO: 5484966 - DNA, 13 bp, Homo sapiens
gcctcccttgact

SEQ ID NO: 5484967 - DNA, 23 bp, Homo sapiens
gcctcccttgagtaggccctgct

SEQ ID NO: 5484968 - DNA, 14 bp, Homo sapiens
gcctcccttgggct

SEQ ID NO: 5484969 - DNA, 14 bp, Homo sapiens
gcctccctttctgg

SEQ ID NO: 5484970 - DNA, 15 bp, Homo sapiens
gcctccctttctggg

SEQ ID NO: 5484971 - DNA, 19 bp, Homo sapiens
gcctccctttgccagccac

SEQ ID NO: 5484972 - DNA, 20 bp, Homo sapiens
gcctccgaaggggctctgag

SEQ ID NO: 5484973 - DNA, 18 bp, Homo sapiens
gcctccgagagggagaga

SEQ ID NO: 5484974 - DNA, 16 bp, Homo sapiens
gcctccgaggcctacc

SEQ ID NO: 5484975 - DNA, 18 bp, Homo sapiens
gcctccgaggctccccgc

SEQ ID NO: 5484976 - DNA, 21 bp, Homo sapiens
gcctccgaggctccccgcctc

SEQ ID NO: 5484977 - DNA, 14 bp, Homo sapiens
gcctccgcacctga

SEQ ID NO: 5484978 - DNA, 13 bp, Homo sapiens
gcctccgcctccc

SEQ ID NO: 5484979 - DNA, 22 bp, Homo sapiens
gcctccgcctgctgtgtggact

SEQ ID NO: 5484980 - DNA, 15 bp, Homo sapiens
gcctccgcctgggtc

SEQ ID NO: 5484981 - DNA, 18 bp, Homo sapiens
gcctccgcggactggggt

SEQ ID NO: 5484982 - DNA, 13 bp, Homo sapiens
gcctccgctggct

SEQ ID NO: 5484983 - DNA, 18 bp, Homo sapiens
gcctccgctgggcttcat

SEQ ID NO: 5484984 - DNA, 15 bp, Homo sapiens
gcctccggccctgcc

SEQ ID NO: 5484985 - DNA, 18 bp, Homo sapiens
gcctccggccctgcccca

SEQ ID NO: 5484986 - DNA, 14 bp, Homo sapiens
gcctccggcctgca

SEQ ID NO: 5484987 - DNA, 17 bp, Homo sapiens
gcctccggcctgcactc

SEQ ID NO: 5484988 - DNA, 19 bp, Homo sapiens
gcctccgggacccccagga

SEQ ID NO: 5484989 - DNA, 20 bp, Homo sapiens
gcctccgggacccccaggac

SEQ ID NO: 5484990 - DNA, 14 bp, Homo sapiens
gcctccgggcctcg

SEQ ID NO: 5484991 - DNA, 18 bp, Homo sapiens
gcctccgggcctcggcct

SEQ ID NO: 5484992 - DNA, 20 bp, Homo sapiens
gcctccgggcctcggcctgg

SEQ ID NO: 5484993 - DNA, 20 bp, Homo sapiens
gcctccggtgagcagggtca

SEQ ID NO: 5484994 - DNA, 20 bp, Homo sapiens
gcctccgtcactacctggct

SEQ ID NO: 5484995 - DNA, 16 bp, Homo sapiens
gcctccgtcaggagag

SEQ ID NO: 5484996 - DNA, 21 bp, Homo sapiens
gcctccgtcatgaatgccttc

SEQ ID NO: 5484997 - DNA, 14 bp, Homo sapiens
gcctccgtcttccc

SEQ ID NO: 5484998 - DNA, 23 bp, Homo sapiens
gcctccgtttatgggccttgctt

SEQ ID NO: 5484999 - DNA, 14 bp, Homo sapiens
gcctcggcctccca

SEQ ID NO: 5485000 - DNA, 23 bp, Homo sapiens
gcctcggcctcccaaagtgctgg

SEQ ID NO: 5485001 - DNA, 12 bp, Homo sapiens
gcctcggcctgg

SEQ ID NO: 5485002 - DNA, 17 bp, Homo sapiens
gcctcggctcctgctgc

SEQ ID NO: 5485003 - DNA, 18 bp, Homo sapiens
gcctcggctcctgctgca

SEQ ID NO: 5485004 - DNA, 15 bp, Homo sapiens
gcctcggctggctcc

SEQ ID NO: 5485005 - DNA, 16 bp, Homo sapiens
gcctcggctggctccc

SEQ ID NO: 5485006 - DNA, 17 bp, Homo sapiens
gcctcggctggctcccc

SEQ ID NO: 5485007 - DNA, 19 bp, Homo sapiens
gcctcggctggctcccctg

SEQ ID NO: 5485008 - DNA, 16 bp, Homo sapiens
gcctcggctgtctcct

SEQ ID NO: 5485009 - DNA, 20 bp, Homo sapiens
gcctcggcttttctcagctg

SEQ ID NO: 5485010 - DNA, 18 bp, Homo sapiens
gcctcgggaacctcactc

SEQ ID NO: 5485011 - DNA, 23 bp, Homo sapiens
gcctcgggaacctcactcttgcc

SEQ ID NO: 5485012 - DNA, 22 bp, Homo sapiens
gcctcgggacacctgccctgcc

SEQ ID NO: 5485013 - DNA, 13 bp, Homo sapiens
gcctcgggacctc

SEQ ID NO: 5485014 - DNA, 18 bp, Homo sapiens
gcctcggtatctggcttc

SEQ ID NO: 5485015 - DNA, 14 bp, Homo sapiens
gcctcggtggccat

SEQ ID NO: 5485016 - DNA, 16 bp, Homo sapiens
gcctcggtggccatgc

SEQ ID NO: 5485017 - DNA, 22 bp, Homo sapiens
gcctcggttgcggacctaggac

SEQ ID NO: 5485018 - DNA, 17 bp, Homo sapiens
gcctcgtaccagccagg

SEQ ID NO: 5485019 - DNA, 22 bp, Homo sapiens
gcctcgtaggatgtatgttgga

SEQ ID NO: 5485020 - DNA, 13 bp, Homo sapiens
gcctcgtccctcc

SEQ ID NO: 5485021 - DNA, 16 bp, Homo sapiens
gcctcgtgaggggcaa

SEQ ID NO: 5485022 - DNA, 18 bp, Homo sapiens
gcctcgtgccagcagcct

SEQ ID NO: 5485023 - DNA, 19 bp, Homo sapiens
gcctcgtgccagcagcctc

SEQ ID NO: 5485024 - DNA, 22 bp, Homo sapiens
gcctcgtgccagcagcctcgca

SEQ ID NO: 5485025 - DNA, 24 bp, Homo sapiens
gcctcgtgccagcagcctcgcaca

SEQ ID NO: 5485026 - DNA, 17 bp, Homo sapiens
gcctcgtgctccgcagg

SEQ ID NO: 5485027 - DNA, 21 bp, Homo sapiens
gcctcgtgctccgcagggcgc

SEQ ID NO: 5485028 - DNA, 13 bp, Homo sapiens
gcctcgtggagct

SEQ ID NO: 5485029 - DNA, 21 bp, Homo sapiens
gcctcgtggagctcgcccctc

SEQ ID NO: 5485030 - DNA, 13 bp, Homo sapiens
gcctcgtgtccag

SEQ ID NO: 5485031 - DNA, 13 bp, Homo sapiens
gcctcgtgtcctg

SEQ ID NO: 5485032 - DNA, 17 bp, Homo sapiens
gcctcgtgtcctgctag

SEQ ID NO: 5485033 - DNA, 19 bp, Homo sapiens
gcctcgtgtcctgctagct

SEQ ID NO: 5485034 - DNA, 20 bp, Homo sapiens
gcctcgtgtcctgctagctg

SEQ ID NO: 5485035 - DNA, 21 bp, Homo sapiens
gcctcgttccagtggcggcac

SEQ ID NO: 5485036 - DNA, 14 bp, Homo sapiens
gcctcgttggagag

SEQ ID NO: 5485037 - DNA, 21 bp, Homo sapiens
gcctctaacagcacagggaag

SEQ ID NO: 5485038 - DNA, 16 bp, Homo sapiens
gcctctaaccccaggc

SEQ ID NO: 5485039 - DNA, 18 bp, Homo sapiens
gcctctaaccccaggccc

SEQ ID NO: 5485040 - DNA, 14 bp, Homo sapiens
gcctctaactccct

SEQ ID NO: 5485041 - DNA, 16 bp, Homo sapiens
gcctctaagagtgccc

SEQ ID NO: 5485042 - DNA, 19 bp, Homo sapiens
gcctctaaggccaaggcct

SEQ ID NO: 5485043 - DNA, 20 bp, Homo sapiens
gcctctaaggccaaggcctc

SEQ ID NO: 5485044 - DNA, 23 bp, Homo sapiens
gcctctaaggccaaggcctcagg

SEQ ID NO: 5485045 - DNA, 23 bp, Homo sapiens
gcctctacctgacactcccttgg

SEQ ID NO: 5485046 - DNA, 22 bp, Homo sapiens
gcctctactaggtctgctcctg

SEQ ID NO: 5485047 - DNA, 17 bp, Homo sapiens
gcctctagaacacccac

SEQ ID NO: 5485048 - DNA, 18 bp, Homo sapiens
gcctctagaacacccact

SEQ ID NO: 5485049 - DNA, 20 bp, Homo sapiens
gcctctagaacacccactgg

SEQ ID NO: 5485050 - DNA, 20 bp, Homo sapiens
gcctctagggacccctcctc

SEQ ID NO: 5485051 - DNA, 23 bp, Homo sapiens
gcctctagggacccctcctccct

SEQ ID NO: 5485052 - DNA, 15 bp, Homo sapiens
gcctctatccctggc

SEQ ID NO: 5485053 - DNA, 17 bp, Homo sapiens
gcctctatccctggcca

SEQ ID NO: 5485054 - DNA, 18 bp, Homo sapiens
gcctctatccctggccac

SEQ ID NO: 5485055 - DNA, 21 bp, Homo sapiens
gcctctatccctggccacctg

SEQ ID NO: 5485056 - DNA, 23 bp, Homo sapiens
gcctctatccctggccacctgcc

SEQ ID NO: 5485057 - DNA, 15 bp, Homo sapiens
gcctctcacacacat

SEQ ID NO: 5485058 - DNA, 22 bp, Homo sapiens
gcctctcacacatttctgccac

SEQ ID NO: 5485059 - DNA, 14 bp, Homo sapiens
gcctctcactctgg

SEQ ID NO: 5485060 - DNA, 18 bp, Homo sapiens
gcctctcactctggcagc

SEQ ID NO: 5485061 - DNA, 19 bp, Homo sapiens
gcctctcactctggcagcc

SEQ ID NO: 5485062 - DNA, 15 bp, Homo sapiens
gcctctcagacccag

SEQ ID NO: 5485063 - DNA, 15 bp, Homo sapiens
gcctctcagtgccct

SEQ ID NO: 5485064 - DNA, 12 bp, Homo sapiens
gcctctcatccc

SEQ ID NO: 5485065 - DNA, 16 bp, Homo sapiens
gcctctccaaccactg

SEQ ID NO: 5485066 - DNA, 17 bp, Homo sapiens
gcctctccaaccactgt

SEQ ID NO: 5485067 - DNA, 21 bp, Homo sapiens
gcctctccaaccactgtgcca

SEQ ID NO: 5485068 - DNA, 13 bp, Homo sapiens
gcctctccactgt

SEQ ID NO: 5485069 - DNA, 16 bp, Homo sapiens
gcctctccaggcacca

SEQ ID NO: 5485070 - DNA, 22 bp, Homo sapiens
gcctctccatttgctcttcaga

SEQ ID NO: 5485071 - DNA, 15 bp, Homo sapiens
gcctctcccaggcag

SEQ ID NO: 5485072 - DNA, 15 bp, Homo sapiens
gcctctcccaggctg

SEQ ID NO: 5485073 - DNA, 13 bp, Homo sapiens
gcctctccccacc

SEQ ID NO: 5485074 - DNA, 12 bp, Homo sapiens
gcctctccccag

SEQ ID NO: 5485075 - DNA, 20 bp, Homo sapiens
gcctctccccaggtccagct

SEQ ID NO: 5485076 - DNA, 16 bp, Homo sapiens
gcctctcccctgcctg

SEQ ID NO: 5485077 - DNA, 16 bp, Homo sapiens
gcctctcccgcaccag

SEQ ID NO: 5485078 - DNA, 20 bp, Homo sapiens
gcctctcccgcaccaggccg

SEQ ID NO: 5485079 - DNA, 20 bp, Homo sapiens
gcctctcccggctgcctgcc

SEQ ID NO: 5485080 - DNA, 23 bp, Homo sapiens
gcctctcccggctgcctgccgcc

SEQ ID NO: 5485081 - DNA, 21 bp, Homo sapiens
gcctctccctaggagaagagt

SEQ ID NO: 5485082 - DNA, 23 bp, Homo sapiens
gcctctccctcctccaggaagcc

SEQ ID NO: 5485083 - DNA, 19 bp, Homo sapiens
gcctctccctgcctgtggc

SEQ ID NO: 5485084 - DNA, 17 bp, Homo sapiens
gcctctccctgctgctc

SEQ ID NO: 5485085 - DNA, 20 bp, Homo sapiens
gcctctccctgctgctccta

SEQ ID NO: 5485086 - DNA, 16 bp, Homo sapiens
gcctctccctggccct

SEQ ID NO: 5485087 - DNA, 23 bp, Homo sapiens
gcctctccgactctgcacccgcc

SEQ ID NO: 5485088 - DNA, 19 bp, Homo sapiens
gcctctccgcccctgagcc

SEQ ID NO: 5485089 - DNA, 23 bp, Homo sapiens
gcctctccgcccctgagcccact

SEQ ID NO: 5485090 - DNA, 24 bp, Homo sapiens
gcctctccgcccctgagcccactg

SEQ ID NO: 5485091 - DNA, 14 bp, Homo sapiens
gcctctcctgccct

SEQ ID NO: 5485092 - DNA, 18 bp, Homo sapiens
gcctctcctgccctctgc

SEQ ID NO: 5485093 - DNA, 14 bp, Homo sapiens
gcctctccttaaat

SEQ ID NO: 5485094 - DNA, 23 bp, Homo sapiens
gcctctccttgccccagtcctgg

SEQ ID NO: 5485095 - DNA, 20 bp, Homo sapiens
gcctctccttgtggcctggg

SEQ ID NO: 5485096 - DNA, 21 bp, Homo sapiens
gcctctccttgtggcctgggc

SEQ ID NO: 5485097 - DNA, 17 bp, Homo sapiens
gcctctcctttgtatat

SEQ ID NO: 5485098 - DNA, 21 bp, Homo sapiens
gcctctcggtgacctccgtcc

SEQ ID NO: 5485099 - DNA, 19 bp, Homo sapiens
gcctctcggtggccagcag

SEQ ID NO: 5485100 - DNA, 23 bp, Homo sapiens
gcctctctatcctctcttcctct

SEQ ID NO: 5485101 - DNA, 15 bp, Homo sapiens
gcctctctcagccca

SEQ ID NO: 5485102 - DNA, 19 bp, Homo sapiens
gcctctctcagcccaggtc

SEQ ID NO: 5485103 - DNA, 22 bp, Homo sapiens
gcctctctcagcccaggtctcc

SEQ ID NO: 5485104 - DNA, 14 bp, Homo sapiens
gcctctctcaggag

SEQ ID NO: 5485105 - DNA, 13 bp, Homo sapiens
gcctctctcaggc

SEQ ID NO: 5485106 - DNA, 22 bp, Homo sapiens
gcctctctcatggcttgggctg

SEQ ID NO: 5485107 - DNA, 17 bp, Homo sapiens
gcctctctccactaccc

SEQ ID NO: 5485108 - DNA, 18 bp, Homo sapiens
gcctctctccactacccc

SEQ ID NO: 5485109 - DNA, 14 bp, Homo sapiens
gcctctctccctct

SEQ ID NO: 5485110 - DNA, 13 bp, Homo sapiens
gcctctctcctgc

SEQ ID NO: 5485111 - DNA, 22 bp, Homo sapiens
gcctctctccttggccacagac

SEQ ID NO: 5485112 - DNA, 23 bp, Homo sapiens
gcctctctccttggccacagact

SEQ ID NO: 5485113 - DNA, 19 bp, Homo sapiens
gcctctctctctctcctca

SEQ ID NO: 5485114 - DNA, 12 bp, Homo sapiens
gcctctctctgc

SEQ ID NO: 5485115 - DNA, 14 bp, Homo sapiens
gcctctctctgctc

SEQ ID NO: 5485116 - DNA, 16 bp, Homo sapiens
gcctctctgcaggtcc

SEQ ID NO: 5485117 - DNA, 20 bp, Homo sapiens
gcctctctgcaggtccctaa

SEQ ID NO: 5485118 - DNA, 21 bp, Homo sapiens
gcctctctgcaggtccctaat

SEQ ID NO: 5485119 - DNA, 23 bp, Homo sapiens
gcctctctgcaggtccctaataa

SEQ ID NO: 5485120 - DNA, 13 bp, Homo sapiens
gcctctctgccag

SEQ ID NO: 5485121 - DNA, 14 bp, Homo sapiens
gcctctctgccagc

SEQ ID NO: 5485122 - DNA, 19 bp, Homo sapiens
gcctctctgccccacccaa

SEQ ID NO: 5485123 - DNA, 17 bp, Homo sapiens
gcctctctggaagaggg

SEQ ID NO: 5485124 - DNA, 13 bp, Homo sapiens
gcctctctggcct

SEQ ID NO: 5485125 - DNA, 23 bp, Homo sapiens
gcctctctggcctcccacccgat

SEQ ID NO: 5485126 - DNA, 16 bp, Homo sapiens
gcctctctgggggagg

SEQ ID NO: 5485127 - DNA, 18 bp, Homo sapiens
gcctctctgggggaggca

SEQ ID NO: 5485128 - DNA, 19 bp, Homo sapiens
gcctctctgggggaggcag

SEQ ID NO: 5485129 - DNA, 19 bp, Homo sapiens
gcctctcttcactgctaca

SEQ ID NO: 5485130 - DNA, 17 bp, Homo sapiens
gcctctcttcctatccc

SEQ ID NO: 5485131 - DNA, 18 bp, Homo sapiens
gcctctcttcctatccca

SEQ ID NO: 5485132 - DNA, 15 bp, Homo sapiens
gcctctcttcttccc

SEQ ID NO: 5485133 - DNA, 19 bp, Homo sapiens
gcctctcttgccccttgtc

SEQ ID NO: 5485134 - DNA, 20 bp, Homo sapiens
gcctctcttggaactgcacc

SEQ ID NO: 5485135 - DNA, 21 bp, Homo sapiens
gcctctcttggaactgcacca

SEQ ID NO: 5485136 - DNA, 21 bp, Homo sapiens
gcctctcttggaccctgggag

SEQ ID NO: 5485137 - DNA, 22 bp, Homo sapiens
gcctctcttggaccctgggagt

SEQ ID NO: 5485138 - DNA, 13 bp, Homo sapiens
gcctctgaaaata

SEQ ID NO: 5485139 - DNA, 12 bp, Homo sapiens
gcctctgaactg

SEQ ID NO: 5485140 - DNA, 17 bp, Homo sapiens
gcctctgaactgctgct

SEQ ID NO: 5485141 - DNA, 20 bp, Homo sapiens
gcctctgaactgctgctggt

SEQ ID NO: 5485142 - DNA, 21 bp, Homo sapiens
gcctctgaactgctgctggtc

SEQ ID NO: 5485143 - DNA, 19 bp, Homo sapiens
gcctctgaagttggacagc

SEQ ID NO: 5485144 - DNA, 17 bp, Homo sapiens
gcctctgacacacagct

SEQ ID NO: 5485145 - DNA, 20 bp, Homo sapiens
gcctctgacacacagctctg

SEQ ID NO: 5485146 - DNA, 21 bp, Homo sapiens
gcctctgacacacagctctgt

SEQ ID NO: 5485147 - DNA, 17 bp, Homo sapiens
gcctctgacagcagcct

SEQ ID NO: 5485148 - DNA, 19 bp, Homo sapiens
gcctctgacagcagcctgt

SEQ ID NO: 5485149 - DNA, 21 bp, Homo sapiens
gcctctgacagcagcctgtga

SEQ ID NO: 5485150 - DNA, 15 bp, Homo sapiens
gcctctgacagtcca

SEQ ID NO: 5485151 - DNA, 20 bp, Homo sapiens
gcctctgacagtccacaggg

SEQ ID NO: 5485152 - DNA, 22 bp, Homo sapiens
gcctctgacagtccacaggggc

SEQ ID NO: 5485153 - DNA, 18 bp, Homo sapiens
gcctctgacccctcctca

SEQ ID NO: 5485154 - DNA, 21 bp, Homo sapiens
gcctctgacccctcctcactg

SEQ ID NO: 5485155 - DNA, 17 bp, Homo sapiens
gcctctgactcaaactc

SEQ ID NO: 5485156 - DNA, 15 bp, Homo sapiens
gcctctgagccagga

SEQ ID NO: 5485157 - DNA, 22 bp, Homo sapiens
gcctctgaggagcccacggggc

SEQ ID NO: 5485158 - DNA, 19 bp, Homo sapiens
gcctctgaggccagcctgg

SEQ ID NO: 5485159 - DNA, 23 bp, Homo sapiens
gcctctgatatgggactgagcct

SEQ ID NO: 5485160 - DNA, 17 bp, Homo sapiens
gcctctgattctatgta

SEQ ID NO: 5485161 - DNA, 20 bp, Homo sapiens
gcctctgattctatgtaact

SEQ ID NO: 5485162 - DNA, 16 bp, Homo sapiens
gcctctgcaaactaag

SEQ ID NO: 5485163 - DNA, 18 bp, Homo sapiens
gcctctgcacgtgcacac

SEQ ID NO: 5485164 - DNA, 21 bp, Homo sapiens
gcctctgcactcccacgcctg

SEQ ID NO: 5485165 - DNA, 19 bp, Homo sapiens
gcctctgcactcccctgct

SEQ ID NO: 5485166 - DNA, 20 bp, Homo sapiens
gcctctgcactcccctgctg

SEQ ID NO: 5485167 - DNA, 17 bp, Homo sapiens
gcctctgcagtctcatt

SEQ ID NO: 5485168 - DNA, 20 bp, Homo sapiens
gcctctgcagtctcatttct

SEQ ID NO: 5485169 - DNA, 12 bp, Homo sapiens
gcctctgcattc

SEQ ID NO: 5485170 - DNA, 23 bp, Homo sapiens
gcctctgccacagcaaggctgtc

SEQ ID NO: 5485171 - DNA, 17 bp, Homo sapiens
gcctctgccatcctccc

SEQ ID NO: 5485172 - DNA, 20 bp, Homo sapiens
gcctctgccatcctccctgt

SEQ ID NO: 5485173 - DNA, 13 bp, Homo sapiens
gcctctgccatgc

SEQ ID NO: 5485174 - DNA, 22 bp, Homo sapiens
gcctctttttccttcttcagca

SEQ ID NO: 5485175 - DNA, 17 bp, Homo sapiens
gcctctttttgcccttt

SEQ ID NO: 5485176 - DNA, 21 bp, Homo sapiens
gcctgaaaaaactggtatgtt

SEQ ID NO: 5485177 - DNA, 16 bp, Homo sapiens
gcctgaaaaggaagga

SEQ ID NO: 5485178 - DNA, 15 bp, Homo sapiens
gcctgaaacccattt

SEQ ID NO: 5485179 - DNA, 20 bp, Homo sapiens
gcctgaaacccatttactta

SEQ ID NO: 5485180 - DNA, 22 bp, Homo sapiens
gcctgaaactttgaggataact

SEQ ID NO: 5485181 - DNA, 16 bp, Homo sapiens
gcctgaaagaggctga

SEQ ID NO: 5485182 - DNA, 14 bp, Homo sapiens
gcctgaaagataca

SEQ ID NO: 5485183 - DNA, 19 bp, Homo sapiens
gcctgaaagcaacagctgg

SEQ ID NO: 5485184 - DNA, 21 bp, Homo sapiens
gcctgaaagctgggagcgtgg

SEQ ID NO: 5485185 - DNA, 17 bp, Homo sapiens
gcctgaaaggagccctt

SEQ ID NO: 5485186 - DNA, 19 bp, Homo sapiens
gcctgaaatcctggttcct

SEQ ID NO: 5485187 - DNA, 20 bp, Homo sapiens
gcctgaaatgttacacatta

SEQ ID NO: 5485188 - DNA, 18 bp, Homo sapiens
gcctgaaatgtttccagg

SEQ ID NO: 5485189 - DNA, 21 bp, Homo sapiens
gcctgaaatgtttccaggcat

SEQ ID NO: 5485190 - DNA, 22 bp, Homo sapiens
gcctgaaatgtttccaggcatg

SEQ ID NO: 5485191 - DNA, 19 bp, Homo sapiens
gcctgaacagatgtaaatc

SEQ ID NO: 5485192 - DNA, 16 bp, Homo sapiens
gcctgaacagccctct

SEQ ID NO: 5485193 - DNA, 22 bp, Homo sapiens
gcctgaactaggtgctggcatg

SEQ ID NO: 5485194 - DNA, 17 bp, Homo sapiens
gcctgaactcctgccat

SEQ ID NO: 5485195 - DNA, 15 bp, Homo sapiens
gcctgaactgagccc

SEQ ID NO: 5485196 - DNA, 14 bp, Homo sapiens
gcctgaactgagga

SEQ ID NO: 5485197 - DNA, 21 bp, Homo sapiens
gcctgaagaagcacttctgct

SEQ ID NO: 5485198 - DNA, 22 bp, Homo sapiens
gcctgaagaagcacttctgctg

SEQ ID NO: 5485199 - DNA, 14 bp, Homo sapiens
gcctgaagacccca

SEQ ID NO: 5485200 - DNA, 13 bp, Homo sapiens
gcctgaagagagg

SEQ ID NO: 5485201 - DNA, 20 bp, Homo sapiens
gcctgaagagtcctctgaat

SEQ ID NO: 5485202 - DNA, 18 bp, Homo sapiens
gcctgaagatcagagctg

SEQ ID NO: 5485203 - DNA, 21 bp, Homo sapiens
gcctgaagatcagagctgcag

SEQ ID NO: 5485204 - DNA, 15 bp, Homo sapiens
gcctgaagccagctg

SEQ ID NO: 5485205 - DNA, 15 bp, Homo sapiens
gcctgaagcctggat

SEQ ID NO: 5485206 - DNA, 18 bp, Homo sapiens
gcctgaaggattctggga

SEQ ID NO: 5485207 - DNA, 16 bp, Homo sapiens
gcctgaaggcacagct

SEQ ID NO: 5485208 - DNA, 13 bp, Homo sapiens
gcctgaagggcct

SEQ ID NO: 5485209 - DNA, 14 bp, Homo sapiens
gcctgaagggcctc

SEQ ID NO: 5485210 - DNA, 19 bp, Homo sapiens
gcctgaagggcctcccagc

SEQ ID NO: 5485211 - DNA, 21 bp, Homo sapiens
gcctgaagggcctcccagccc

SEQ ID NO: 5485212 - DNA, 17 bp, Homo sapiens
gcctgaaggggcgtctg

SEQ ID NO: 5485213 - DNA, 18 bp, Homo sapiens
gcctgaagttggagtgag

SEQ ID NO: 5485214 - DNA, 11 bp, Homo sapiens
gcctgaataaa

SEQ ID NO: 5485215 - DNA, 15 bp, Homo sapiens
gcctgaataaaccaa

SEQ ID NO: 5485216 - DNA, 19 bp, Homo sapiens
gcctgaatcatgagcctgc

SEQ ID NO: 5485217 - DNA, 20 bp, Homo sapiens
gcctgaatccatcaggactt

SEQ ID NO: 5485218 - DNA, 16 bp, Homo sapiens
gcctgacaacagcctg

SEQ ID NO: 5485219 - DNA, 18 bp, Homo sapiens
gcctgacaacagcctgag

SEQ ID NO: 5485220 - DNA, 19 bp, Homo sapiens
gcctgacaacagcctgaga

SEQ ID NO: 5485221 - DNA, 20 bp, Homo sapiens
gcctgacaacagcctgagaa

SEQ ID NO: 5485222 - DNA, 22 bp, Homo sapiens
gcctgacaacagcctgagaaat

SEQ ID NO: 5485223 - DNA, 15 bp, Homo sapiens
gcctgacaaggccag

SEQ ID NO: 5485224 - DNA, 16 bp, Homo sapiens
gcctgacaagtgaagt

SEQ ID NO: 5485225 - DNA, 23 bp, Homo sapiens
gcctgacaattatgaaaaaatgt

SEQ ID NO: 5485226 - DNA, 16 bp, Homo sapiens
gcctgacacaatggta

SEQ ID NO: 5485227 - DNA, 15 bp, Homo sapiens
gcctgacacactaac

SEQ ID NO: 5485228 - DNA, 22 bp, Homo sapiens
gcctgacacactaaccaagctg

SEQ ID NO: 5485229 - DNA, 24 bp, Homo sapiens
gcctgacacaggccagccttggca

SEQ ID NO: 5485230 - DNA, 20 bp, Homo sapiens
gcctgacacaggggacactg

SEQ ID NO: 5485231 - DNA, 15 bp, Homo sapiens
gcctgacaccccctc

SEQ ID NO: 5485232 - DNA, 21 bp, Homo sapiens
gcctgacaccccctccccgcc

SEQ ID NO: 5485233 - DNA, 20 bp, Homo sapiens
gcctgacactgagccccacc

SEQ ID NO: 5485234 - DNA, 21 bp, Homo sapiens
gcctgacactgagccccacct

SEQ ID NO: 5485235 - DNA, 21 bp, Homo sapiens
gcctgacaggttcccagcagc

SEQ ID NO: 5485236 - DNA, 23 bp, Homo sapiens
gcctgacaggttcccagcagctg

SEQ ID NO: 5485237 - DNA, 23 bp, Homo sapiens
gcctgacattcacttccagagag

SEQ ID NO: 5485238 - DNA, 16 bp, Homo sapiens
gcctgaccaaaagtga

SEQ ID NO: 5485239 - DNA, 18 bp, Homo sapiens
gcctgacccacggggcag

SEQ ID NO: 5485240 - DNA, 14 bp, Homo sapiens
gcctgaccccttca

SEQ ID NO: 5485241 - DNA, 15 bp, Homo sapiens
gcctgaccccttgct

SEQ ID NO: 5485242 - DNA, 17 bp, Homo sapiens
gcctgaccctcatcttt

SEQ ID NO: 5485243 - DNA, 15 bp, Homo sapiens
gcctgacctccagtc

SEQ ID NO: 5485244 - DNA, 20 bp, Homo sapiens
gcctgacctccagtcctgct

SEQ ID NO: 5485245 - DNA, 22 bp, Homo sapiens
gcctgacctccagtcctgctgg

SEQ ID NO: 5485246 - DNA, 23 bp, Homo sapiens
gcctgacctccagtcctgctggc

SEQ ID NO: 5485247 - DNA, 20 bp, Homo sapiens
gcctgacctccccctccttc

SEQ ID NO: 5485248 - DNA, 16 bp, Homo sapiens
gcctgacctgagactg

SEQ ID NO: 5485249 - DNA, 15 bp, Homo sapiens
gcctgacctggcaca

SEQ ID NO: 5485250 - DNA, 17 bp, Homo sapiens
gcctgacctggcacaga

SEQ ID NO: 5485251 - DNA, 14 bp, Homo sapiens
gcctgaccttggaa

SEQ ID NO: 5485252 - DNA, 21 bp, Homo sapiens
gcctgactaggaaaagttggg

SEQ ID NO: 5485253 - DNA, 15 bp, Homo sapiens
gcctgactcccccag

SEQ ID NO: 5485254 - DNA, 21 bp, Homo sapiens
gcctgactcccccagtcccct

SEQ ID NO: 5485255 - DNA, 16 bp, Homo sapiens
gcctgactccttctgc

SEQ ID NO: 5485256 - DNA, 15 bp, Homo sapiens
gcctgactgccaagc

SEQ ID NO: 5485257 - DNA, 20 bp, Homo sapiens
gcctgactgccaagccatgg

SEQ ID NO: 5485258 - DNA, 22 bp, Homo sapiens
gcctgactgccaggaccccagg

SEQ ID NO: 5485259 - DNA, 14 bp, Homo sapiens
gcctgactgctcag

SEQ ID NO: 5485260 - DNA, 15 bp, Homo sapiens
gcctgactgctcaga

SEQ ID NO: 5485261 - DNA, 16 bp, Homo sapiens
gcctgacttctgctgg

SEQ ID NO: 5485262 - DNA, 21 bp, Homo sapiens
gcctgacttgggataggactg

SEQ ID NO: 5485263 - DNA, 13 bp, Homo sapiens
gcctgagaagagt

SEQ ID NO: 5485264 - DNA, 20 bp, Homo sapiens
gcctgagaatgcctaggcca

SEQ ID NO: 5485265 - DNA, 23 bp, Homo sapiens
gcctgagaattgaggggaggtgg

SEQ ID NO: 5485266 - DNA, 14 bp, Homo sapiens
gcctgagacagcac

SEQ ID NO: 5485267 - DNA, 16 bp, Homo sapiens
gcctgagacagcacca

SEQ ID NO: 5485268 - DNA, 19 bp, Homo sapiens
gcctgagacagcaccactg

SEQ ID NO: 5485269 - DNA, 14 bp, Homo sapiens
gcctgagaccacgg

SEQ ID NO: 5485270 - DNA, 18 bp, Homo sapiens
gcctgagaccagggtggc

SEQ ID NO: 5485271 - DNA, 12 bp, Homo sapiens
gcctgagaccca

SEQ ID NO: 5485272 - DNA, 14 bp, Homo sapiens
gcctgagacccagg

SEQ ID NO: 5485273 - DNA, 15 bp, Homo sapiens
gcctgagacccagga

SEQ ID NO: 5485274 - DNA, 19 bp, Homo sapiens
gcctgagagaattggctca

SEQ ID NO: 5485275 - DNA, 20 bp, Homo sapiens
gcctgagagaattggctcaa

SEQ ID NO: 5485276 - DNA, 13 bp, Homo sapiens
gcctgagagcaga

SEQ ID NO: 5485277 - DNA, 15 bp, Homo sapiens
gcctgagagcagaat

SEQ ID NO: 5485278 - DNA, 17 bp, Homo sapiens
gcctgagagcagaatga

SEQ ID NO: 5485279 - DNA, 13 bp, Homo sapiens
gcctgagagctgg

SEQ ID NO: 5485280 - DNA, 16 bp, Homo sapiens
gcctgagagctggccc

SEQ ID NO: 5485281 - DNA, 14 bp, Homo sapiens
gcctgagaggcagg

SEQ ID NO: 5485282 - DNA, 15 bp, Homo sapiens
gcctgagaggcaggc

SEQ ID NO: 5485283 - DNA, 16 bp, Homo sapiens
gcctgagaggcaggca

SEQ ID NO: 5485284 - DNA, 20 bp, Homo sapiens
gcctgagaggcaggcataga

SEQ ID NO: 5485285 - DNA, 16 bp, Homo sapiens
gcctgagaggggaagc

SEQ ID NO: 5485286 - DNA, 13 bp, Homo sapiens
gcctgagagtatt

SEQ ID NO: 5485287 - DNA, 20 bp, Homo sapiens
gcctgagagtcagctctctg

SEQ ID NO: 5485288 - DNA, 13 bp, Homo sapiens
gcctgagatggtc

SEQ ID NO: 5485289 - DNA, 15 bp, Homo sapiens
gcctgagattcttta

SEQ ID NO: 5485290 - DNA, 18 bp, Homo sapiens
gcctgagatttcatctgc

SEQ ID NO: 5485291 - DNA, 18 bp, Homo sapiens
gcctgagcaactcttgat

SEQ ID NO: 5485292 - DNA, 17 bp, Homo sapiens
gcctgagcacctcccag

SEQ ID NO: 5485293 - DNA, 20 bp, Homo sapiens
gcctgagcacctcccagccc

SEQ ID NO: 5485294 - DNA, 17 bp, Homo sapiens
gcctgagccacagtggg

SEQ ID NO: 5485295 - DNA, 12 bp, Homo sapiens
gcctgagcccag

SEQ ID NO: 5485296 - DNA, 13 bp, Homo sapiens
gcctgagcccagg

SEQ ID NO: 5485297 - DNA, 17 bp, Homo sapiens
gcctgagcccaggagct

SEQ ID NO: 5485298 - DNA, 17 bp, Homo sapiens
gcctgagcccagggagg

SEQ ID NO: 5485299 - DNA, 12 bp, Homo sapiens
gcctgagcccct

SEQ ID NO: 5485300 - DNA, 14 bp, Homo sapiens
gcctgagcccctca

SEQ ID NO: 5485301 - DNA, 16 bp, Homo sapiens
gcctgagcccctcaga

SEQ ID NO: 5485302 - DNA, 18 bp, Homo sapiens
gcctgagcctcccgaggc

SEQ ID NO: 5485303 - DNA, 15 bp, Homo sapiens
gcctgagccttagct

SEQ ID NO: 5485304 - DNA, 17 bp, Homo sapiens
gcctgagcgacagtgag

SEQ ID NO: 5485305 - DNA, 20 bp, Homo sapiens
gcctgagcgacagtgagact

SEQ ID NO: 5485306 - DNA, 23 bp, Homo sapiens
gcctgagcgctcctgccgcagag

SEQ ID NO: 5485307 - DNA, 14 bp, Homo sapiens
gcctgagctcactc

SEQ ID NO: 5485308 - DNA, 17 bp, Homo sapiens
gcctgagctcactcggc

SEQ ID NO: 5485309 - DNA, 13 bp, Homo sapiens
gcctgagctcctg

SEQ ID NO: 5485310 - DNA, 14 bp, Homo sapiens
gcctgagctcctgc

SEQ ID NO: 5485311 - DNA, 15 bp, Homo sapiens
gcctgagctcctgct

SEQ ID NO: 5485312 - DNA, 16 bp, Homo sapiens
gcctgagctcctgctg

SEQ ID NO: 5485313 - DNA, 17 bp, Homo sapiens
gcctgagctgcttcact

SEQ ID NO: 5485314 - DNA, 18 bp, Homo sapiens
gcctgagctggggccaca

SEQ ID NO: 5485315 - DNA, 16 bp, Homo sapiens
gcctgagctggggcct

SEQ ID NO: 5485316 - DNA, 17 bp, Homo sapiens
gcctgagctggggcctg

SEQ ID NO: 5485317 - DNA, 18 bp, Homo sapiens
gcctgagctggggcctgg

SEQ ID NO: 5485318 - DNA, 22 bp, Homo sapiens
gcctgagctggggcctggagag

SEQ ID NO: 5485319 - DNA, 18 bp, Homo sapiens
gcctgaggaggaggacac

SEQ ID NO: 5485320 - DNA, 23 bp, Homo sapiens
gcctgaggaggaggacacagcac

SEQ ID NO: 5485321 - DNA, 17 bp, Homo sapiens
gcctgaggatgagctgg

SEQ ID NO: 5485322 - DNA, 13 bp, Homo sapiens
gcctgaggcagat

SEQ ID NO: 5485323 - DNA, 13 bp, Homo sapiens
gcctgaggcagga

SEQ ID NO: 5485324 - DNA, 16 bp, Homo sapiens
gcctgaggcaggagaa

SEQ ID NO: 5485325 - DNA, 17 bp, Homo sapiens
gcctgaggccttccaga

SEQ ID NO: 5485326 - DNA, 22 bp, Homo sapiens
gcctgaggctcaagaggcccag

SEQ ID NO: 5485327 - DNA, 23 bp, Homo sapiens
gcctgaggctcaagaggcccagg

SEQ ID NO: 5485328 - DNA, 13 bp, Homo sapiens
gcctgaggctcct

SEQ ID NO: 5485329 - DNA, 18 bp, Homo sapiens
gcctgaggctgagactgc

SEQ ID NO: 5485330 - DNA, 12 bp, Homo sapiens
gcctgaggctgg

SEQ ID NO: 5485331 - DNA, 13 bp, Homo sapiens
gcctgaggctggg

SEQ ID NO: 5485332 - DNA, 14 bp, Homo sapiens
gcctgagggaaagg

SEQ ID NO: 5485333 - DNA, 13 bp, Homo sapiens
gcctgagggaagc

SEQ ID NO: 5485334 - DNA, 14 bp, Homo sapiens
gcctgagggaagcc

SEQ ID NO: 5485335 - DNA, 16 bp, Homo sapiens
gcctgagggaagccca

SEQ ID NO: 5485336 - DNA, 18 bp, Homo sapiens
gcctgagggaggaggcag

SEQ ID NO: 5485337 - DNA, 15 bp, Homo sapiens
gcctgagggcccctc

SEQ ID NO: 5485338 - DNA, 19 bp, Homo sapiens
gcctgagggcccctctgcc

SEQ ID NO: 5485339 - DNA, 23 bp, Homo sapiens
gcctgagggcgaggggagggtgg

SEQ ID NO: 5485340 - DNA, 20 bp, Homo sapiens
gcctgaggggcagcctgcct

SEQ ID NO: 5485341 - DNA, 13 bp, Homo sapiens
gcctgagggtcca

SEQ ID NO: 5485342 - DNA, 18 bp, Homo sapiens
gcctgagggtccacctgg

SEQ ID NO: 5485343 - DNA, 22 bp, Homo sapiens
gcctgagggtccacctggagag

SEQ ID NO: 5485344 - DNA, 15 bp, Homo sapiens
gcctgagggtggaga

SEQ ID NO: 5485345 - DNA, 17 bp, Homo sapiens
gcctgagggtggagact

SEQ ID NO: 5485346 - DNA, 16 bp, Homo sapiens
gcctgaggtcaatggt

SEQ ID NO: 5485347 - DNA, 17 bp, Homo sapiens
gcctgaggtctcgctga

SEQ ID NO: 5485348 - DNA, 16 bp, Homo sapiens
gcctgaggtctggctg

SEQ ID NO: 5485349 - DNA, 18 bp, Homo sapiens
gcctgaggtctggctgct

SEQ ID NO: 5485350 - DNA, 24 bp, Homo sapiens
gcctgaggtgcccactccgccagc

SEQ ID NO: 5485351 - DNA, 16 bp, Homo sapiens
gcctgaggttactgga

SEQ ID NO: 5485352 - DNA, 14 bp, Homo sapiens
gcctgccccctggg

SEQ ID NO: 5485353 - DNA, 21 bp, Homo sapiens
gcctgccccctgggctggggc

SEQ ID NO: 5485354 - DNA, 15 bp, Homo sapiens
gcctgccccctgggg

SEQ ID NO: 5485355 - DNA, 20 bp, Homo sapiens
gcctgccccgcccccagtcc

SEQ ID NO: 5485356 - DNA, 21 bp, Homo sapiens
gcctgccccgcccccagtccc

SEQ ID NO: 5485357 - DNA, 17 bp, Homo sapiens
gcctgccccggccactc

SEQ ID NO: 5485358 - DNA, 18 bp, Homo sapiens
gcctgccccggccactct

SEQ ID NO: 5485359 - DNA, 21 bp, Homo sapiens
gcctgcccctaccctggactt

SEQ ID NO: 5485360 - DNA, 14 bp, Homo sapiens
gcctgcccctccca

SEQ ID NO: 5485361 - DNA, 15 bp, Homo sapiens
gcctgcccctcccag

SEQ ID NO: 5485362 - DNA, 16 bp, Homo sapiens
gcctgcccctgctgct

SEQ ID NO: 5485363 - DNA, 20 bp, Homo sapiens
gcctgcccgcacagcagcct

SEQ ID NO: 5485364 - DNA, 13 bp, Homo sapiens
gcctgcccgcccg

SEQ ID NO: 5485365 - DNA, 17 bp, Homo sapiens
gcctgcccggccggaga

SEQ ID NO: 5485366 - DNA, 20 bp, Homo sapiens
gcctgcccgtctctctccca

SEQ ID NO: 5485367 - DNA, 18 bp, Homo sapiens
gcctgcccgtgccctggt

SEQ ID NO: 5485368 - DNA, 21 bp, Homo sapiens
gcctgcccgttgccgggcctg

SEQ ID NO: 5485369 - DNA, 14 bp, Homo sapiens
gcctgccctcactc

SEQ ID NO: 5485370 - DNA, 22 bp, Homo sapiens
gcctgccctcactccctctgca

SEQ ID NO: 5485371 - DNA, 20 bp, Homo sapiens
gcctgccctcatggcccctc

SEQ ID NO: 5485372 - DNA, 22 bp, Homo sapiens
gcctgccctcatggcccctctg

SEQ ID NO: 5485373 - DNA, 14 bp, Homo sapiens
gcctgccctccagc

SEQ ID NO: 5485374 - DNA, 15 bp, Homo sapiens
gcctgccctccagct

SEQ ID NO: 5485375 - DNA, 16 bp, Homo sapiens
gcctgccctccagctg

SEQ ID NO: 5485376 - DNA, 12 bp, Homo sapiens
gcctgccctccc

SEQ ID NO: 5485377 - DNA, 13 bp, Homo sapiens
gcctgccctccca

SEQ ID NO: 5485378 - DNA, 16 bp, Homo sapiens
gcctgccctcccaccc

SEQ ID NO: 5485379 - DNA, 18 bp, Homo sapiens
gcctgccctcccaccccc

SEQ ID NO: 5485380 - DNA, 22 bp, Homo sapiens
gcctgccctccccagagcactg

SEQ ID NO: 5485381 - DNA, 17 bp, Homo sapiens
gcctgccctcccgcacc

SEQ ID NO: 5485382 - DNA, 18 bp, Homo sapiens
gcctgccctcctctcccg

SEQ ID NO: 5485383 - DNA, 22 bp, Homo sapiens
gcctgccctcctctcccgtctc

SEQ ID NO: 5485384 - DNA, 15 bp, Homo sapiens
gcctgccctctgccc

SEQ ID NO: 5485385 - DNA, 11 bp, Homo sapiens
gcctgccctgc

SEQ ID NO: 5485386 - DNA, 15 bp, Homo sapiens
gcctgccctgcccag

SEQ ID NO: 5485387 - DNA, 14 bp, Homo sapiens
gcctgccctgcctt

SEQ ID NO: 5485388 - DNA, 15 bp, Homo sapiens
gcctgccctgccttg

SEQ ID NO: 5485389 - DNA, 18 bp, Homo sapiens
gcctgccctgccttgccg

SEQ ID NO: 5485390 - DNA, 17 bp, Homo sapiens
gcctgccctgctatttc

SEQ ID NO: 5485391 - DNA, 12 bp, Homo sapiens
gcctgccctgga

SEQ ID NO: 5485392 - DNA, 13 bp, Homo sapiens
gcctgccctggag

SEQ ID NO: 5485393 - DNA, 16 bp, Homo sapiens
gcctgccctttgtcct

SEQ ID NO: 5485394 - DNA, 14 bp, Homo sapiens
gcctgccgagcaac

SEQ ID NO: 5485395 - DNA, 20 bp, Homo sapiens
gcctgccgagcaaccgtggc

SEQ ID NO: 5485396 - DNA, 15 bp, Homo sapiens
gcctgccgcccccgc

SEQ ID NO: 5485397 - DNA, 14 bp, Homo sapiens
gcctgccgctgcac

SEQ ID NO: 5485398 - DNA, 17 bp, Homo sapiens
gcctgccgctgcacctg

SEQ ID NO: 5485399 - DNA, 19 bp, Homo sapiens
gcctgccgctgcacctgcc

SEQ ID NO: 5485400 - DNA, 14 bp, Homo sapiens
gcctgccgggctga

SEQ ID NO: 5485401 - DNA, 16 bp, Homo sapiens
gcctgccggtaaacac

SEQ ID NO: 5485402 - DNA, 15 bp, Homo sapiens
gcctgcctaaccagg

SEQ ID NO: 5485403 - DNA, 22 bp, Homo sapiens
gcctgcctaaccaggcccagcc

SEQ ID NO: 5485404 - DNA, 11 bp, Homo sapiens
gcctgcctcag

SEQ ID NO: 5485405 - DNA, 13 bp, Homo sapiens
gcctgcctcagtg

SEQ ID NO: 5485406 - DNA, 15 bp, Homo sapiens
gcctgcctcagtggc

SEQ ID NO: 5485407 - DNA, 18 bp, Homo sapiens
gcctgcctcagtggcagc

SEQ ID NO: 5485408 - DNA, 18 bp, Homo sapiens
gcctgcctcatgctctct

SEQ ID NO: 5485409 - DNA, 15 bp, Homo sapiens
gcctgcctccacccg

SEQ ID NO: 5485410 - DNA, 22 bp, Homo sapiens
gcctgcctccacccgtcctccc

SEQ ID NO: 5485411 - DNA, 17 bp, Homo sapiens
gcctgcctccagggctg

SEQ ID NO: 5485412 - DNA, 22 bp, Homo sapiens
gcctgcctccagggctggactg

SEQ ID NO: 5485413 - DNA, 18 bp, Homo sapiens
gcctgcctcccaaggtcc

SEQ ID NO: 5485414 - DNA, 14 bp, Homo sapiens
gcctgcctcccagc

SEQ ID NO: 5485415 - DNA, 22 bp, Homo sapiens
gcctgcctcccctgcctcacca

SEQ ID NO: 5485416 - DNA, 14 bp, Homo sapiens
gcctgcctccggcc

SEQ ID NO: 5485417 - DNA, 12 bp, Homo sapiens
gcctgcctccta

SEQ ID NO: 5485418 - DNA, 15 bp, Homo sapiens
gcctgcctcctaggc

SEQ ID NO: 5485419 - DNA, 22 bp, Homo sapiens
gcctgcctcctaggctggaagc

SEQ ID NO: 5485420 - DNA, 17 bp, Homo sapiens
gcctgcctcctccctcc

SEQ ID NO: 5485421 - DNA, 19 bp, Homo sapiens
gcctgcctcctccctccca

SEQ ID NO: 5485422 - DNA, 21 bp, Homo sapiens
gcctgcctcctccctcccagc

SEQ ID NO: 5485423 - DNA, 14 bp, Homo sapiens
gcctgcctcctggc

SEQ ID NO: 5485424 - DNA, 15 bp, Homo sapiens
gcctgcctctgccac

SEQ ID NO: 5485425 - DNA, 22 bp, Homo sapiens
gcctgcctctgccatgcccaga

SEQ ID NO: 5485426 - DNA, 16 bp, Homo sapiens
gcctgcctcttctcta

SEQ ID NO: 5485427 - DNA, 19 bp, Homo sapiens
gcctgcctcttggcctcac

SEQ ID NO: 5485428 - DNA, 18 bp, Homo sapiens
gcctgcctgaagagagga

SEQ ID NO: 5485429 - DNA, 22 bp, Homo sapiens
gcctgcctgaagagaggaaact

SEQ ID NO: 5485430 - DNA, 20 bp, Homo sapiens
gcctgcctgataccctgctt

SEQ ID NO: 5485431 - DNA, 19 bp, Homo sapiens
gcctgcctgcaaacctgct

SEQ ID NO: 5485432 - DNA, 17 bp, Homo sapiens
gcctgcctgcagcaggc

SEQ ID NO: 5485433 - DNA, 13 bp, Homo sapiens
gcctgcctgcatg

SEQ ID NO: 5485434 - DNA, 12 bp, Homo sapiens
gcctgcctgcct

SEQ ID NO: 5485435 - DNA, 17 bp, Homo sapiens
gcctgcctgcctccacc

SEQ ID NO: 5485436 - DNA, 14 bp, Homo sapiens
gcctgcctggaaga

SEQ ID NO: 5485437 - DNA, 13 bp, Homo sapiens
gcctgcctggagc

SEQ ID NO: 5485438 - DNA, 15 bp, Homo sapiens
gcctgcctggcccct

SEQ ID NO: 5485439 - DNA, 16 bp, Homo sapiens
gcctgcctggcccctc

SEQ ID NO: 5485440 - DNA, 12 bp, Homo sapiens
gcctgcctggga

SEQ ID NO: 5485441 - DNA, 14 bp, Homo sapiens
gcctgcctgggaga

SEQ ID NO: 5485442 - DNA, 16 bp, Homo sapiens
gcctgcctgggcctcc

SEQ ID NO: 5485443 - DNA, 14 bp, Homo sapiens
gcctgcctgtctgt

SEQ ID NO: 5485444 - DNA, 16 bp, Homo sapiens
gcctgcctgtctgtct

SEQ ID NO: 5485445 - DNA, 22 bp, Homo sapiens
gcctgcctgtctgtctctccat

SEQ ID NO: 5485446 - DNA, 17 bp, Homo sapiens
gcctgccttctcaggga

SEQ ID NO: 5485447 - DNA, 18 bp, Homo sapiens
gcctgccttctcccctcc

SEQ ID NO: 5485448 - DNA, 14 bp, Homo sapiens
gcctgccttttcta

SEQ ID NO: 5485449 - DNA, 18 bp, Homo sapiens
gcctgcgaaacccagcgt

SEQ ID NO: 5485450 - DNA, 14 bp, Homo sapiens
gcctgcgagggcag

SEQ ID NO: 5485451 - DNA, 23 bp, Homo sapiens
gcctgcgcccaccccgctctgca

SEQ ID NO: 5485452 - DNA, 15 bp, Homo sapiens
gcctgcgcccagagc

SEQ ID NO: 5485453 - DNA, 17 bp, Homo sapiens
gcctgcgcccagagctg

SEQ ID NO: 5485454 - DNA, 19 bp, Homo sapiens
gcctgcgcccagagctggc

SEQ ID NO: 5485455 - DNA, 19 bp, Homo sapiens
gcctgcgccccccagtgga

SEQ ID NO: 5485456 - DNA, 13 bp, Homo sapiens
gcctgcgcctcct

SEQ ID NO: 5485457 - DNA, 18 bp, Homo sapiens
gcctgcgcctcctcctgc

SEQ ID NO: 5485458 - DNA, 19 bp, Homo sapiens
gcctgcgcctgcacctgcg

SEQ ID NO: 5485459 - DNA, 15 bp, Homo sapiens
gcctgcgcctgctgc

SEQ ID NO: 5485460 - DNA, 22 bp, Homo sapiens
gcctgcgcctgctgcatgccct

SEQ ID NO: 5485461 - DNA, 19 bp, Homo sapiens
gcctgcgctcctctgcagc

SEQ ID NO: 5485462 - DNA, 14 bp, Homo sapiens
gcctgcgctcggca

SEQ ID NO: 5485463 - DNA, 18 bp, Homo sapiens
gcctgcggactccatggc

SEQ ID NO: 5485464 - DNA, 19 bp, Homo sapiens
gcctgcggccgggctgccc

SEQ ID NO: 5485465 - DNA, 13 bp, Homo sapiens
gcctgcggctgct

SEQ ID NO: 5485466 - DNA, 17 bp, Homo sapiens
gcctgcggctgctggca

SEQ ID NO: 5485467 - DNA, 17 bp, Homo sapiens
gcctgcggggttccctg

SEQ ID NO: 5485468 - DNA, 16 bp, Homo sapiens
gcctgcggtcaaggcc

SEQ ID NO: 5485469 - DNA, 19 bp, Homo sapiens
gcctgcggtggagggatca

SEQ ID NO: 5485470 - DNA, 14 bp, Homo sapiens
gcctgcgtcttccg

SEQ ID NO: 5485471 - DNA, 23 bp, Homo sapiens
gcctgcgtcttccgcccctgcct

SEQ ID NO: 5485472 - DNA, 14 bp, Homo sapiens
gcctgcgtgcgctg

SEQ ID NO: 5485473 - DNA, 14 bp, Homo sapiens
gcctgcgtggcctg

SEQ ID NO: 5485474 - DNA, 16 bp, Homo sapiens
gcctgcgtggcctggg

SEQ ID NO: 5485475 - DNA, 14 bp, Homo sapiens
gcctgcgtggctga

SEQ ID NO: 5485476 - DNA, 16 bp, Homo sapiens
gcctgcgtggctgacc

SEQ ID NO: 5485477 - DNA, 18 bp, Homo sapiens
gcctgcgttggtccagag

SEQ ID NO: 5485478 - DNA, 20 bp, Homo sapiens
gcctgcgttttggaagctct

SEQ ID NO: 5485479 - DNA, 13 bp, Homo sapiens
gcctgctaaggaa

SEQ ID NO: 5485480 - DNA, 16 bp, Homo sapiens
gcctgctaaggaacaa

SEQ ID NO: 5485481 - DNA, 23 bp, Homo sapiens
gcctgctaattccccagattgca

SEQ ID NO: 5485482 - DNA, 16 bp, Homo sapiens
gcctgctacacaggca

SEQ ID NO: 5485483 - DNA, 19 bp, Homo sapiens
gcctgctacacaggcagga

SEQ ID NO: 5485484 - DNA, 21 bp, Homo sapiens
gcctgctacttgagggccagg

SEQ ID NO: 5485485 - DNA, 17 bp, Homo sapiens
gcctgctagagcaaccc

SEQ ID NO: 5485486 - DNA, 14 bp, Homo sapiens
gcctgctagtcact

SEQ ID NO: 5485487 - DNA, 15 bp, Homo sapiens
gcctgctatccagcc

SEQ ID NO: 5485488 - DNA, 17 bp, Homo sapiens
gcctgctatccagccgc

SEQ ID NO: 5485489 - DNA, 14 bp, Homo sapiens
gcctgctattgcag

SEQ ID NO: 5485490 - DNA, 18 bp, Homo sapiens
gcctgctcagcagccagt

SEQ ID NO: 5485491 - DNA, 15 bp, Homo sapiens
gcctgctcaggtgct

SEQ ID NO: 5485492 - DNA, 12 bp, Homo sapiens
gcctgctccaga

SEQ ID NO: 5485493 - DNA, 16 bp, Homo sapiens
gcctgctccagacctg

SEQ ID NO: 5485494 - DNA, 21 bp, Homo sapiens
gcctgctccagacctgatcct

SEQ ID NO: 5485495 - DNA, 13 bp, Homo sapiens
gcctgctccagct

SEQ ID NO: 5485496 - DNA, 15 bp, Homo sapiens
gcctgctccagctgt

SEQ ID NO: 5485497 - DNA, 19 bp, Homo sapiens
gcctgctcccatcctcacc

SEQ ID NO: 5485498 - DNA, 21 bp, Homo sapiens
gcctgctcccatcctcaccca

SEQ ID NO: 5485499 - DNA, 16 bp, Homo sapiens
gcctgctcccccaccc

SEQ ID NO: 5485500 - DNA, 19 bp, Homo sapiens
gcctgctcccccaccccct

SEQ ID NO: 5485501 - DNA, 12 bp, Homo sapiens
gcctgctccctg

SEQ ID NO: 5485502 - DNA, 13 bp, Homo sapiens
gcctgctccctgt

SEQ ID NO: 5485503 - DNA, 16 bp, Homo sapiens
gcctgctccctgtctg

SEQ ID NO: 5485504 - DNA, 18 bp, Homo sapiens
gcctgctccctgtctgtg

SEQ ID NO: 5485505 - DNA, 20 bp, Homo sapiens
gcctgctccctgtctgtgtc

SEQ ID NO: 5485506 - DNA, 14 bp, Homo sapiens
gcctgctcctgctt

SEQ ID NO: 5485507 - DNA, 22 bp, Homo sapiens
gcctgctcctgcttaaacacaa

SEQ ID NO: 5485508 - DNA, 21 bp, Homo sapiens
gcctgctccttggcaccccca

SEQ ID NO: 5485509 - DNA, 19 bp, Homo sapiens
gcctgctctagtgggacag

SEQ ID NO: 5485510 - DNA, 12 bp, Homo sapiens
gcctgctctccc

SEQ ID NO: 5485511 - DNA, 21 bp, Homo sapiens
gcctgctctccttgccctggg

SEQ ID NO: 5485512 - DNA, 16 bp, Homo sapiens
gcctgctctgcagccc

SEQ ID NO: 5485513 - DNA, 15 bp, Homo sapiens
gcctgctctgccact

SEQ ID NO: 5485514 - DNA, 23 bp, Homo sapiens
gcctgctcttacttcccccaccc

SEQ ID NO: 5485515 - DNA, 23 bp, Homo sapiens
gcctgctgattgatttttttctc

SEQ ID NO: 5485516 - DNA, 14 bp, Homo sapiens
gcctgctgcatgcc

SEQ ID NO: 5485517 - DNA, 18 bp, Homo sapiens
gcctgctgcatggggtgg

SEQ ID NO: 5485518 - DNA, 18 bp, Homo sapiens
gcctgctgcccaggctgt

SEQ ID NO: 5485519 - DNA, 17 bp, Homo sapiens
gcctgctgcgccccagg

SEQ ID NO: 5485520 - DNA, 19 bp, Homo sapiens
gcctgctgcgccccaggcc

SEQ ID NO: 5485521 - DNA, 14 bp, Homo sapiens
gcctgctgctgaga

SEQ ID NO: 5485522 - DNA, 20 bp, Homo sapiens
gcctgctggagaaaccttca

SEQ ID NO: 5485523 - DNA, 23 bp, Homo sapiens
gcctgctggagaaaccttcactc

SEQ ID NO: 5485524 - DNA, 13 bp, Homo sapiens
gcctgctggaggc

SEQ ID NO: 5485525 - DNA, 15 bp, Homo sapiens
gcctgctggaggcct

SEQ ID NO: 5485526 - DNA, 23 bp, Homo sapiens
gcctgctggagttccggcctggg

SEQ ID NO: 5485527 - DNA, 13 bp, Homo sapiens
gcctgctggcagg

SEQ ID NO: 5485528 - DNA, 18 bp, Homo sapiens
gcctgctggcagggccag

SEQ ID NO: 5485529 - DNA, 20 bp, Homo sapiens
gcctgctggcagggccaggg

SEQ ID NO: 5485530 - DNA, 23 bp, Homo sapiens
gcctgctggcagggccagggcaa

SEQ ID NO: 5485531 - DNA, 21 bp, Homo sapiens
gcctggccagcctacaatggg

SEQ ID NO: 5485532 - DNA, 17 bp, Homo sapiens
gcctggccaggagcagg

SEQ ID NO: 5485533 - DNA, 19 bp, Homo sapiens
gcctggccaggagctcttc

SEQ ID NO: 5485534 - DNA, 12 bp, Homo sapiens
gcctggccaggc

SEQ ID NO: 5485535 - DNA, 13 bp, Homo sapiens
gcctggccaggcc

SEQ ID NO: 5485536 - DNA, 16 bp, Homo sapiens
gcctggccaggccctg

SEQ ID NO: 5485537 - DNA, 12 bp, Homo sapiens
gcctggccaggg

SEQ ID NO: 5485538 - DNA, 15 bp, Homo sapiens
gcctggccagggcag

SEQ ID NO: 5485539 - DNA, 17 bp, Homo sapiens
gcctggccagggcaggg

SEQ ID NO: 5485540 - DNA, 15 bp, Homo sapiens
gcctggccagtcctg

SEQ ID NO: 5485541 - DNA, 18 bp, Homo sapiens
gcctggccagtcctggtc

SEQ ID NO: 5485542 - DNA, 23 bp, Homo sapiens
gcctggccagtcctggtcctggc

SEQ ID NO: 5485543 - DNA, 16 bp, Homo sapiens
gcctggccagtcttcc

SEQ ID NO: 5485544 - DNA, 17 bp, Homo sapiens
gcctggccagtcttcct

SEQ ID NO: 5485545 - DNA, 19 bp, Homo sapiens
gcctggccagtcttcctct

SEQ ID NO: 5485546 - DNA, 15 bp, Homo sapiens
gcctggccatcccca

SEQ ID NO: 5485547 - DNA, 19 bp, Homo sapiens
gcctggccatgctgtccct

SEQ ID NO: 5485548 - DNA, 22 bp, Homo sapiens
gcctggccatgtcacctggctg

SEQ ID NO: 5485549 - DNA, 21 bp, Homo sapiens
gcctggcccacagcaggtgct

SEQ ID NO: 5485550 - DNA, 14 bp, Homo sapiens
gcctggcccacccc

SEQ ID NO: 5485551 - DNA, 11 bp, Homo sapiens
gcctggcccag

SEQ ID NO: 5485552 - DNA, 15 bp, Homo sapiens
gcctggcccagctcc

SEQ ID NO: 5485553 - DNA, 16 bp, Homo sapiens
gcctggcccagggagg

SEQ ID NO: 5485554 - DNA, 18 bp, Homo sapiens
gcctggcccagtgagagt

SEQ ID NO: 5485555 - DNA, 10 bp, Homo sapiens
gcctggcccc

SEQ ID NO: 5485556 - DNA, 17 bp, Homo sapiens
gcctggccccaaatgtt

SEQ ID NO: 5485557 - DNA, 15 bp, Homo sapiens
gcctggccccaagca

SEQ ID NO: 5485558 - DNA, 13 bp, Homo sapiens
gcctggccccagc

SEQ ID NO: 5485559 - DNA, 17 bp, Homo sapiens
gcctggccccagcctgg

SEQ ID NO: 5485560 - DNA, 18 bp, Homo sapiens
gcctggccccagcctggg

SEQ ID NO: 5485561 - DNA, 16 bp, Homo sapiens
gcctggccccatggtc

SEQ ID NO: 5485562 - DNA, 22 bp, Homo sapiens
gcctggcccccaacctcagggc

SEQ ID NO: 5485563 - DNA, 14 bp, Homo sapiens
gcctggcccccagc

SEQ ID NO: 5485564 - DNA, 15 bp, Homo sapiens
gcctggcccccagct

SEQ ID NO: 5485565 - DNA, 15 bp, Homo sapiens
gcctggcccccctcc

SEQ ID NO: 5485566 - DNA, 17 bp, Homo sapiens
gcctggcccccctccag

SEQ ID NO: 5485567 - DNA, 18 bp, Homo sapiens
gcctggcccccctccagg

SEQ ID NO: 5485568 - DNA, 13 bp, Homo sapiens
gcctggccccctc

SEQ ID NO: 5485569 - DNA, 17 bp, Homo sapiens
gcctggccccctgtcct

SEQ ID NO: 5485570 - DNA, 15 bp, Homo sapiens
gcctggcccctcagg

SEQ ID NO: 5485571 - DNA, 16 bp, Homo sapiens
gcctggcccctcaggg

SEQ ID NO: 5485572 - DNA, 16 bp, Homo sapiens
gcctggccccttctcc

SEQ ID NO: 5485573 - DNA, 11 bp, Homo sapiens
gcctggccctc

SEQ ID NO: 5485574 - DNA, 17 bp, Homo sapiens
gcctggccctccccaca

SEQ ID NO: 5485575 - DNA, 20 bp, Homo sapiens
gcctggccctccctccctag

SEQ ID NO: 5485576 - DNA, 15 bp, Homo sapiens
gcctggccctcctct

SEQ ID NO: 5485577 - DNA, 17 bp, Homo sapiens
gcctggccctcctctgg

SEQ ID NO: 5485578 - DNA, 15 bp, Homo sapiens
gcctggccctgccct

SEQ ID NO: 5485579 - DNA, 14 bp, Homo sapiens
gcctggccctgctt

SEQ ID NO: 5485580 - DNA, 11 bp, Homo sapiens
gcctggccctt

SEQ ID NO: 5485581 - DNA, 23 bp, Homo sapiens
gcctggcccttgccggggcctgg

SEQ ID NO: 5485582 - DNA, 15 bp, Homo sapiens
gcctggccggccagc

SEQ ID NO: 5485583 - DNA, 16 bp, Homo sapiens
gcctggccggccagcc

SEQ ID NO: 5485584 - DNA, 17 bp, Homo sapiens
gcctggccggccagcca

SEQ ID NO: 5485585 - DNA, 14 bp, Homo sapiens
gcctggccggctcc

SEQ ID NO: 5485586 - DNA, 12 bp, Homo sapiens
gcctggcctcaa

SEQ ID NO: 5485587 - DNA, 14 bp, Homo sapiens
gcctggcctcaact

SEQ ID NO: 5485588 - DNA, 17 bp, Homo sapiens
gcctggcctcatctcag

SEQ ID NO: 5485589 - DNA, 12 bp, Homo sapiens
gcctggcctcca

SEQ ID NO: 5485590 - DNA, 16 bp, Homo sapiens
gcctggcctccagctc

SEQ ID NO: 5485591 - DNA, 19 bp, Homo sapiens
gcctggcctccagctccca

SEQ ID NO: 5485592 - DNA, 14 bp, Homo sapiens
gcctggcctccagg

SEQ ID NO: 5485593 - DNA, 15 bp, Homo sapiens
gcctggcctccaggc

SEQ ID NO: 5485594 - DNA, 15 bp, Homo sapiens
gcctggcctcctgcc

SEQ ID NO: 5485595 - DNA, 23 bp, Homo sapiens
gcctggcctcggggcagggcagg

SEQ ID NO: 5485596 - DNA, 14 bp, Homo sapiens
gcctggcctctgcc

SEQ ID NO: 5485597 - DNA, 11 bp, Homo sapiens
gcctggcctga

SEQ ID NO: 5485598 - DNA, 17 bp, Homo sapiens
gcctggcctgagctggg

SEQ ID NO: 5485599 - DNA, 18 bp, Homo sapiens
gcctggcctgagctgggg

SEQ ID NO: 5485600 - DNA, 20 bp, Homo sapiens
gcctggcctgagctggggcc

SEQ ID NO: 5485601 - DNA, 22 bp, Homo sapiens
gcctggcctgagctggggccac

SEQ ID NO: 5485602 - DNA, 15 bp, Homo sapiens
gcctggcctgaggac

SEQ ID NO: 5485603 - DNA, 13 bp, Homo sapiens
gcctggcctgccc

SEQ ID NO: 5485604 - DNA, 22 bp, Homo sapiens
gcctggcctgcccgtgccctgg

SEQ ID NO: 5485605 - DNA, 19 bp, Homo sapiens
gcctggcctggccctgccc

SEQ ID NO: 5485606 - DNA, 15 bp, Homo sapiens
gcctggcctggctcc

SEQ ID NO: 5485607 - DNA, 13 bp, Homo sapiens
gcctggcctgggt

SEQ ID NO: 5485608 - DNA, 15 bp, Homo sapiens
gcctggcctggtcca

SEQ ID NO: 5485609 - DNA, 20 bp, Homo sapiens
gcctggccttgtcaggaccc

SEQ ID NO: 5485610 - DNA, 22 bp, Homo sapiens
gcctggccttgtcaggacccag

SEQ ID NO: 5485611 - DNA, 23 bp, Homo sapiens
gcctggccttgtcaggacccagg

SEQ ID NO: 5485612 - DNA, 23 bp, Homo sapiens
gcctggccttgtccccagctcca

SEQ ID NO: 5485613 - DNA, 21 bp, Homo sapiens
gcctggcgggatgggccaccg

SEQ ID NO: 5485614 - DNA, 22 bp, Homo sapiens
gcctggcgggcagcccctgctg

SEQ ID NO: 5485615 - DNA, 16 bp, Homo sapiens
gcctggcggggcagga

SEQ ID NO: 5485616 - DNA, 19 bp, Homo sapiens
gcctggcggggcaggaggc

SEQ ID NO: 5485617 - DNA, 21 bp, Homo sapiens
gcctggcggggcaggaggcct

SEQ ID NO: 5485618 - DNA, 20 bp, Homo sapiens
gcctggcggggttggccctt

SEQ ID NO: 5485619 - DNA, 16 bp, Homo sapiens
gcctggcgtcggccag

SEQ ID NO: 5485620 - DNA, 17 bp, Homo sapiens
gcctggcgtcggccaga

SEQ ID NO: 5485621 - DNA, 18 bp, Homo sapiens
gcctggcgtcggccagag

SEQ ID NO: 5485622 - DNA, 14 bp, Homo sapiens
gcctggctcagagc

SEQ ID NO: 5485623 - DNA, 18 bp, Homo sapiens
gcctggctcagagccagt

SEQ ID NO: 5485624 - DNA, 13 bp, Homo sapiens
gcctggctcaggt

SEQ ID NO: 5485625 - DNA, 23 bp, Homo sapiens
gcctggctccaaaccctcgaggc

SEQ ID NO: 5485626 - DNA, 16 bp, Homo sapiens
gcctggctccaggctc

SEQ ID NO: 5485627 - DNA, 20 bp, Homo sapiens
gcctggctccaggctccagg

SEQ ID NO: 5485628 - DNA, 16 bp, Homo sapiens
gcctggctccagtctc

SEQ ID NO: 5485629 - DNA, 19 bp, Homo sapiens
gcctggctcccacaggcag

SEQ ID NO: 5485630 - DNA, 18 bp, Homo sapiens
gcctggctcccaggacac

SEQ ID NO: 5485631 - DNA, 22 bp, Homo sapiens
gcctggctccccacgagtcacc

SEQ ID NO: 5485632 - DNA, 13 bp, Homo sapiens
gcctggctccccg

SEQ ID NO: 5485633 - DNA, 23 bp, Homo sapiens
gcctggctccctcactctcagga

SEQ ID NO: 5485634 - DNA, 16 bp, Homo sapiens
gcctggctccgtccag

SEQ ID NO: 5485635 - DNA, 15 bp, Homo sapiens
gcctggctctcctgt

SEQ ID NO: 5485636 - DNA, 22 bp, Homo sapiens
gcctggctctgccccctccccc

SEQ ID NO: 5485637 - DNA, 12 bp, Homo sapiens
gcctggctctgg

SEQ ID NO: 5485638 - DNA, 13 bp, Homo sapiens
gcctggctctgtc

SEQ ID NO: 5485639 - DNA, 19 bp, Homo sapiens
gcctggctcttgtgctgga

SEQ ID NO: 5485640 - DNA, 23 bp, Homo sapiens
gcctggctctttcgtcacccttg

SEQ ID NO: 5485641 - DNA, 18 bp, Homo sapiens
gcctggctgattcagcat

SEQ ID NO: 5485642 - DNA, 20 bp, Homo sapiens
gcctggctgattcagcattt

SEQ ID NO: 5485643 - DNA, 17 bp, Homo sapiens
gcctggctgcagctggg

SEQ ID NO: 5485644 - DNA, 16 bp, Homo sapiens
gcctggctggctgagg

SEQ ID NO: 5485645 - DNA, 17 bp, Homo sapiens
gcctggctggctgaggg

SEQ ID NO: 5485646 - DNA, 20 bp, Homo sapiens
gcctggctggctgagggcag

SEQ ID NO: 5485647 - DNA, 21 bp, Homo sapiens
gcctggctggctgagggcagt

SEQ ID NO: 5485648 - DNA, 14 bp, Homo sapiens
gcctggctggtggg

SEQ ID NO: 5485649 - DNA, 17 bp, Homo sapiens
gcctggctgtggaggcc

SEQ ID NO: 5485650 - DNA, 21 bp, Homo sapiens
gcctggcttacctatctgtgg

SEQ ID NO: 5485651 - DNA, 23 bp, Homo sapiens
gcctggcttcaccgcattccagg

SEQ ID NO: 5485652 - DNA, 14 bp, Homo sapiens
gcctggcttctgga

SEQ ID NO: 5485653 - DNA, 15 bp, Homo sapiens
gcctggcttctggag

SEQ ID NO: 5485654 - DNA, 22 bp, Homo sapiens
gcctggcttctggagcccttgg

SEQ ID NO: 5485655 - DNA, 13 bp, Homo sapiens
gcctggcttctta

SEQ ID NO: 5485656 - DNA, 14 bp, Homo sapiens
gcctggcttgctcc

SEQ ID NO: 5485657 - DNA, 19 bp, Homo sapiens
gcctggcttgctccagggt

SEQ ID NO: 5485658 - DNA, 21 bp, Homo sapiens
gcctggcttgctccagggtct

SEQ ID NO: 5485659 - DNA, 13 bp, Homo sapiens
gcctggctttgga

SEQ ID NO: 5485660 - DNA, 17 bp, Homo sapiens
gcctgggaaaagggcag

SEQ ID NO: 5485661 - DNA, 18 bp, Homo sapiens
gcctgggaaagcccctgc

SEQ ID NO: 5485662 - DNA, 15 bp, Homo sapiens
gcctgggaaaggaaa

SEQ ID NO: 5485663 - DNA, 22 bp, Homo sapiens
gcctgggaaaggaaaaccaggg

SEQ ID NO: 5485664 - DNA, 23 bp, Homo sapiens
gcctgggaaaggaaaaccaggga

SEQ ID NO: 5485665 - DNA, 22 bp, Homo sapiens
gcctgggaaattgctccattcc

SEQ ID NO: 5485666 - DNA, 16 bp, Homo sapiens
gcctgggaaatttcta

SEQ ID NO: 5485667 - DNA, 21 bp, Homo sapiens
gcctgggaaccttcctgtctt

SEQ ID NO: 5485668 - DNA, 18 bp, Homo sapiens
gcctgggaatcctgctgc

SEQ ID NO: 5485669 - DNA, 21 bp, Homo sapiens
gcctgggaatcctgctgccag

SEQ ID NO: 5485670 - DNA, 19 bp, Homo sapiens
gcctgggacaactgctccc

SEQ ID NO: 5485671 - DNA, 21 bp, Homo sapiens
gcctgggacacttccctgggc

SEQ ID NO: 5485672 - DNA, 16 bp, Homo sapiens
gcctgggacgcccctt

SEQ ID NO: 5485673 - DNA, 22 bp, Homo sapiens
gcctgggacgcccctttctctt

SEQ ID NO: 5485674 - DNA, 15 bp, Homo sapiens
gcctgggactcccag

SEQ ID NO: 5485675 - DNA, 16 bp, Homo sapiens
gcctgggagatgcagc

SEQ ID NO: 5485676 - DNA, 17 bp, Homo sapiens
gcctgggagcccagagg

SEQ ID NO: 5485677 - DNA, 10 bp, Homo sapiens
gcctgggagg

SEQ ID NO: 5485678 - DNA, 15 bp, Homo sapiens
gcctgggaggagtgg

SEQ ID NO: 5485679 - DNA, 15 bp, Homo sapiens
gcctgggaggcacag

SEQ ID NO: 5485680 - DNA, 21 bp, Homo sapiens
gcctgggagggtggttcctgt

SEQ ID NO: 5485681 - DNA, 20 bp, Homo sapiens
gcctgggagggttcccctgg

SEQ ID NO: 5485682 - DNA, 18 bp, Homo sapiens
gcctgggatccctcatcc

SEQ ID NO: 5485683 - DNA, 21 bp, Homo sapiens
gcctgggatccctcatcctca

SEQ ID NO: 5485684 - DNA, 23 bp, Homo sapiens
gcctgggatccctcatcctcata

SEQ ID NO: 5485685 - DNA, 19 bp, Homo sapiens
gcctgggatcgtgcatttg

SEQ ID NO: 5485686 - DNA, 18 bp, Homo sapiens
gcctgggatgcccttccc

SEQ ID NO: 5485687 - DNA, 20 bp, Homo sapiens
gcctgggatgcccttccccc

SEQ ID NO: 5485688 - DNA, 22 bp, Homo sapiens
gcctgggcaacaagagcaaaac

SEQ ID NO: 5485689 - DNA, 16 bp, Homo sapiens
gcctgggcaacagagc

SEQ ID NO: 5485690 - DNA, 18 bp, Homo sapiens
gcctgggcaacagagcaa

SEQ ID NO: 5485691 - DNA, 22 bp, Homo sapiens
gcctgggcaacatagtgagacc

SEQ ID NO: 5485692 - DNA, 18 bp, Homo sapiens
gcctgggcaatggccagg

SEQ ID NO: 5485693 - DNA, 19 bp, Homo sapiens
gcctgggcaatggccaggg

SEQ ID NO: 5485694 - DNA, 21 bp, Homo sapiens
gcctgggcaatggccaggggc

SEQ ID NO: 5485695 - DNA, 19 bp, Homo sapiens
gcctgggcaccgggacccc

SEQ ID NO: 5485696 - DNA, 11 bp, Homo sapiens
gcctgggcaga

SEQ ID NO: 5485697 - DNA, 13 bp, Homo sapiens
gcctgggcagcac

SEQ ID NO: 5485698 - DNA, 13 bp, Homo sapiens
gcctgggcagcat

SEQ ID NO: 5485699 - DNA, 13 bp, Homo sapiens
gcctgggcagccc

SEQ ID NO: 5485700 - DNA, 18 bp, Homo sapiens
gcctgggcagccccacag

SEQ ID NO: 5485701 - DNA, 21 bp, Homo sapiens
gcctgggccacacctgagcgc

SEQ ID NO: 5485702 - DNA, 15 bp, Homo sapiens
gcctgggccactggc

SEQ ID NO: 5485703 - DNA, 19 bp, Homo sapiens
gcctgggccactggcatct

SEQ ID NO: 5485704 - DNA, 12 bp, Homo sapiens
gcctgggccagg

SEQ ID NO: 5485705 - DNA, 20 bp, Homo sapiens
gcctgggccatgcgaggggc

SEQ ID NO: 5485706 - DNA, 13 bp, Homo sapiens
gcctgggcccagg

SEQ ID NO: 5485707 - DNA, 16 bp, Homo sapiens
gcctgggcccaggccc

SEQ ID NO: 5485708 - DNA, 18 bp, Homo sapiens
gcctgggcccaggcccag

SEQ ID NO: 5485709 - DNA, 20 bp, Homo sapiens
gcctgtcaccagagcttctc

SEQ ID NO: 5485710 - DNA, 20 bp, Homo sapiens
gcctgtcacgctctggtgca

SEQ ID NO: 5485711 - DNA, 19 bp, Homo sapiens
gcctgtcactactggtctg

SEQ ID NO: 5485712 - DNA, 22 bp, Homo sapiens
gcctgtcagatccaggagctcc

SEQ ID NO: 5485713 - DNA, 22 bp, Homo sapiens
gcctgtcagccaacattgcctt

SEQ ID NO: 5485714 - DNA, 17 bp, Homo sapiens
gcctgtcagctaaagaa

SEQ ID NO: 5485715 - DNA, 20 bp, Homo sapiens
gcctgtcaggaccattttag

SEQ ID NO: 5485716 - DNA, 14 bp, Homo sapiens
gcctgtcaggctct

SEQ ID NO: 5485717 - DNA, 18 bp, Homo sapiens
gcctgtcagtttcatgga

SEQ ID NO: 5485718 - DNA, 15 bp, Homo sapiens
gcctgtccaccctgc

SEQ ID NO: 5485719 - DNA, 21 bp, Homo sapiens
gcctgtccaccctgccaagac

SEQ ID NO: 5485720 - DNA, 17 bp, Homo sapiens
gcctgtccagcctgggc

SEQ ID NO: 5485721 - DNA, 11 bp, Homo sapiens
gcctgtcccaa

SEQ ID NO: 5485722 - DNA, 22 bp, Homo sapiens
gcctgtcccaattctgcccgct

SEQ ID NO: 5485723 - DNA, 13 bp, Homo sapiens
gcctgtcccagga

SEQ ID NO: 5485724 - DNA, 23 bp, Homo sapiens
gcctgtcccaggactcaccctcc

SEQ ID NO: 5485725 - DNA, 19 bp, Homo sapiens
gcctgtccccagaccaacc

SEQ ID NO: 5485726 - DNA, 22 bp, Homo sapiens
gcctgtccccgccttccctcac

SEQ ID NO: 5485727 - DNA, 13 bp, Homo sapiens
gcctgtccctagg

SEQ ID NO: 5485728 - DNA, 14 bp, Homo sapiens
gcctgtccctaggg

SEQ ID NO: 5485729 - DNA, 18 bp, Homo sapiens
gcctgtccctctcaggca

SEQ ID NO: 5485730 - DNA, 13 bp, Homo sapiens
gcctgtccctggg

SEQ ID NO: 5485731 - DNA, 22 bp, Homo sapiens
gcctgtcctagtctcctttgaa

SEQ ID NO: 5485732 - DNA, 18 bp, Homo sapiens
gcctgtcctgaaagcggc

SEQ ID NO: 5485733 - DNA, 14 bp, Homo sapiens
gcctgtcctgcctc

SEQ ID NO: 5485734 - DNA, 18 bp, Homo sapiens
gcctgtccttggtggccg

SEQ ID NO: 5485735 - DNA, 18 bp, Homo sapiens
gcctgtcggccacacccc

SEQ ID NO: 5485736 - DNA, 19 bp, Homo sapiens
gcctgtcggccacacccca

SEQ ID NO: 5485737 - DNA, 15 bp, Homo sapiens
gcctgtcgtgttctc

SEQ ID NO: 5485738 - DNA, 17 bp, Homo sapiens
gcctgtctcagtgattc

SEQ ID NO: 5485739 - DNA, 17 bp, Homo sapiens
gcctgtctcatccccag

SEQ ID NO: 5485740 - DNA, 21 bp, Homo sapiens
gcctgtctcatcttctgaaga

SEQ ID NO: 5485741 - DNA, 22 bp, Homo sapiens
gcctgtctcatcttctgaagag

SEQ ID NO: 5485742 - DNA, 15 bp, Homo sapiens
gcctgtctccatgag

SEQ ID NO: 5485743 - DNA, 14 bp, Homo sapiens
gcctgtctccctag

SEQ ID NO: 5485744 - DNA, 17 bp, Homo sapiens
gcctgtctccctaggga

SEQ ID NO: 5485745 - DNA, 13 bp, Homo sapiens
gcctgtctccttt

SEQ ID NO: 5485746 - DNA, 16 bp, Homo sapiens
gcctgtctcgggctga

SEQ ID NO: 5485747 - DNA, 17 bp, Homo sapiens
gcctgtctcgggctgac

SEQ ID NO: 5485748 - DNA, 23 bp, Homo sapiens
gcctgtctcgggctgaccctttt

SEQ ID NO: 5485749 - DNA, 21 bp, Homo sapiens
gcctgtctctattagctgggt

SEQ ID NO: 5485750 - DNA, 11 bp, Homo sapiens
gcctgtctctc

SEQ ID NO: 5485751 - DNA, 14 bp, Homo sapiens
gcctgtctctttcc

SEQ ID NO: 5485752 - DNA, 13 bp, Homo sapiens
gcctgtctgcccc

SEQ ID NO: 5485753 - DNA, 16 bp, Homo sapiens
gcctgtctggagctca

SEQ ID NO: 5485754 - DNA, 16 bp, Homo sapiens
gcctgtctggctcagg

SEQ ID NO: 5485755 - DNA, 20 bp, Homo sapiens
gcctgtctgtccaacccctc

SEQ ID NO: 5485756 - DNA, 12 bp, Homo sapiens
gcctgtctgtct

SEQ ID NO: 5485757 - DNA, 14 bp, Homo sapiens
gcctgtctgtctct

SEQ ID NO: 5485758 - DNA, 16 bp, Homo sapiens
gcctgtcttaattttc

SEQ ID NO: 5485759 - DNA, 17 bp, Homo sapiens
gcctgtcttaattttct

SEQ ID NO: 5485760 - DNA, 22 bp, Homo sapiens
gcctgtcttcagatcctgctgc

SEQ ID NO: 5485761 - DNA, 20 bp, Homo sapiens
gcctgtctttcagcattcag

SEQ ID NO: 5485762 - DNA, 23 bp, Homo sapiens
gcctgtgaaaaagaaactgaata

SEQ ID NO: 5485763 - DNA, 19 bp, Homo sapiens
gcctgtgaacccaggacaa

SEQ ID NO: 5485764 - DNA, 12 bp, Homo sapiens
gcctgtgaagaa

SEQ ID NO: 5485765 - DNA, 22 bp, Homo sapiens
gcctgtgaagaaccctgcaggg

SEQ ID NO: 5485766 - DNA, 19 bp, Homo sapiens
gcctgtgagcaagagccag

SEQ ID NO: 5485767 - DNA, 21 bp, Homo sapiens
gcctgtgagcaagagccaggg

SEQ ID NO: 5485768 - DNA, 23 bp, Homo sapiens
gcctgtgaggggcccctggccca

SEQ ID NO: 5485769 - DNA, 17 bp, Homo sapiens
gcctgtgaggtgcagag

SEQ ID NO: 5485770 - DNA, 24 bp, Homo sapiens
gcctgtgaggtgcagagtgcccag

SEQ ID NO: 5485771 - DNA, 13 bp, Homo sapiens
gcctgtgagtgac

SEQ ID NO: 5485772 - DNA, 13 bp, Homo sapiens
gcctgtgatccag

SEQ ID NO: 5485773 - DNA, 15 bp, Homo sapiens
gcctgtgcaatgcat

SEQ ID NO: 5485774 - DNA, 13 bp, Homo sapiens
gcctgtgcacaca

SEQ ID NO: 5485775 - DNA, 17 bp, Homo sapiens
gcctgtgcactgggcag

SEQ ID NO: 5485776 - DNA, 17 bp, Homo sapiens
gcctgtgcagcagccca

SEQ ID NO: 5485777 - DNA, 15 bp, Homo sapiens
gcctgtgccacctgc

SEQ ID NO: 5485778 - DNA, 18 bp, Homo sapiens
gcctgtgccagcaccaca

SEQ ID NO: 5485779 - DNA, 22 bp, Homo sapiens
gcctgtgccagcaccacagccg

SEQ ID NO: 5485780 - DNA, 13 bp, Homo sapiens
gcctgtgccaggt

SEQ ID NO: 5485781 - DNA, 14 bp, Homo sapiens
gcctgtgccaggtg

SEQ ID NO: 5485782 - DNA, 17 bp, Homo sapiens
gcctgtgccatgcccaa

SEQ ID NO: 5485783 - DNA, 18 bp, Homo sapiens
gcctgtgccatgcccaag

SEQ ID NO: 5485784 - DNA, 14 bp, Homo sapiens
gcctgtgcctccca

SEQ ID NO: 5485785 - DNA, 15 bp, Homo sapiens
gcctgtgcctcccag

SEQ ID NO: 5485786 - DNA, 19 bp, Homo sapiens
gcctgtgcctcctcacccc

SEQ ID NO: 5485787 - DNA, 21 bp, Homo sapiens
gcctgtgcctgccatgggcca

SEQ ID NO: 5485788 - DNA, 22 bp, Homo sapiens
gcctgtgcctgccatgggccag

SEQ ID NO: 5485789 - DNA, 15 bp, Homo sapiens
gcctgtgccttcctc

SEQ ID NO: 5485790 - DNA, 18 bp, Homo sapiens
gcctgtgcgtcccagctg

SEQ ID NO: 5485791 - DNA, 19 bp, Homo sapiens
gcctgtgcgtcccagctga

SEQ ID NO: 5485792 - DNA, 14 bp, Homo sapiens
gcctgtgctcctgc

SEQ ID NO: 5485793 - DNA, 19 bp, Homo sapiens
gcctgtgctgaggactccc

SEQ ID NO: 5485794 - DNA, 15 bp, Homo sapiens
gcctgtgctgcccgt

SEQ ID NO: 5485795 - DNA, 16 bp, Homo sapiens
gcctgtgctgcccgtc

SEQ ID NO: 5485796 - DNA, 22 bp, Homo sapiens
gcctgtgctgggccagtggctg

SEQ ID NO: 5485797 - DNA, 13 bp, Homo sapiens
gcctgtgctgtgg

SEQ ID NO: 5485798 - DNA, 19 bp, Homo sapiens
gcctgtgcttggaggcctc

SEQ ID NO: 5485799 - DNA, 20 bp, Homo sapiens
gcctgtgcttggaggcctca

SEQ ID NO: 5485800 - DNA, 19 bp, Homo sapiens
gcctgtggaatctggagtg

SEQ ID NO: 5485801 - DNA, 19 bp, Homo sapiens
gcctgtggagctcagcccc

SEQ ID NO: 5485802 - DNA, 15 bp, Homo sapiens
gcctgtggaggggct

SEQ ID NO: 5485803 - DNA, 18 bp, Homo sapiens
gcctgtggaggtgacctg

SEQ ID NO: 5485804 - DNA, 15 bp, Homo sapiens
gcctgtggcacagcc

SEQ ID NO: 5485805 - DNA, 22 bp, Homo sapiens
gcctgtggcagaaaagaggaga

SEQ ID NO: 5485806 - DNA, 14 bp, Homo sapiens
gcctgtggccagca

SEQ ID NO: 5485807 - DNA, 23 bp, Homo sapiens
gcctgtggccatgaccctgcctc

SEQ ID NO: 5485808 - DNA, 14 bp, Homo sapiens
gcctgtggcccctc

SEQ ID NO: 5485809 - DNA, 16 bp, Homo sapiens
gcctgtggcccctccc

SEQ ID NO: 5485810 - DNA, 21 bp, Homo sapiens
gcctgtggcccctcccctgca

SEQ ID NO: 5485811 - DNA, 23 bp, Homo sapiens
gcctgtggcccctcccctgcaga

SEQ ID NO: 5485812 - DNA, 13 bp, Homo sapiens
gcctgtggcctca

SEQ ID NO: 5485813 - DNA, 13 bp, Homo sapiens
gcctgtggctgcg

SEQ ID NO: 5485814 - DNA, 12 bp, Homo sapiens
gcctgtggctgt

SEQ ID NO: 5485815 - DNA, 16 bp, Homo sapiens
gcctgtggcttggagt

SEQ ID NO: 5485816 - DNA, 21 bp, Homo sapiens
gcctgtggcttggagtggcca

SEQ ID NO: 5485817 - DNA, 18 bp, Homo sapiens
gcctgtgggaagagaagg

SEQ ID NO: 5485818 - DNA, 14 bp, Homo sapiens
gcctgtgggagaag

SEQ ID NO: 5485819 - DNA, 16 bp, Homo sapiens
gcctgtgggaggggga

SEQ ID NO: 5485820 - DNA, 12 bp, Homo sapiens
gcctgtgggcct

SEQ ID NO: 5485821 - DNA, 16 bp, Homo sapiens
gcctgtgggcctcacc

SEQ ID NO: 5485822 - DNA, 22 bp, Homo sapiens
gcctgtgggcctcacctgcccc

SEQ ID NO: 5485823 - DNA, 15 bp, Homo sapiens
gcctgtgggcctggg

SEQ ID NO: 5485824 - DNA, 13 bp, Homo sapiens
gcctgtgggcttc

SEQ ID NO: 5485825 - DNA, 20 bp, Homo sapiens
gcctgtggggactgaacctg

SEQ ID NO: 5485826 - DNA, 14 bp, Homo sapiens
gcctgtggggagcc

SEQ ID NO: 5485827 - DNA, 22 bp, Homo sapiens
gcctgtgggggtccatttgggt

SEQ ID NO: 5485828 - DNA, 22 bp, Homo sapiens
gcctgtgggtccccactcaccc

SEQ ID NO: 5485829 - DNA, 17 bp, Homo sapiens
gcctgtgggtctctgaa

SEQ ID NO: 5485830 - DNA, 18 bp, Homo sapiens
gcctgtgggtctctgaag

SEQ ID NO: 5485831 - DNA, 13 bp, Homo sapiens
gcctgtggtgaag

SEQ ID NO: 5485832 - DNA, 14 bp, Homo sapiens
gcctgtggtgaagt

SEQ ID NO: 5485833 - DNA, 19 bp, Homo sapiens
gcctgtggtgaagtgtggc

SEQ ID NO: 5485834 - DNA, 12 bp, Homo sapiens
gcctgtggtgct

SEQ ID NO: 5485835 - DNA, 23 bp, Homo sapiens
gcctgtggtggctccccctctgc

SEQ ID NO: 5485836 - DNA, 21 bp, Homo sapiens
gcctgtggttacagtgcagac

SEQ ID NO: 5485837 - DNA, 12 bp, Homo sapiens
gcctgtggttct

SEQ ID NO: 5485838 - DNA, 14 bp, Homo sapiens
gcctgtgtaacagc

SEQ ID NO: 5485839 - DNA, 17 bp, Homo sapiens
gcctgtgtaacagctcc

SEQ ID NO: 5485840 - DNA, 15 bp, Homo sapiens
gcctgtgtccagcag

SEQ ID NO: 5485841 - DNA, 16 bp, Homo sapiens
gcctgtgtccagcagc

SEQ ID NO: 5485842 - DNA, 21 bp, Homo sapiens
gcctgtgtccatgcgctcagg

SEQ ID NO: 5485843 - DNA, 23 bp, Homo sapiens
gcctgtgtccatgcgctcagggc

SEQ ID NO: 5485844 - DNA, 21 bp, Homo sapiens
gcctgtgtcccatgacccacc

SEQ ID NO: 5485845 - DNA, 12 bp, Homo sapiens
gcctgtgtctgg

SEQ ID NO: 5485846 - DNA, 15 bp, Homo sapiens
gcctgtgtgactcca

SEQ ID NO: 5485847 - DNA, 12 bp, Homo sapiens
gcctgtgtgcag

SEQ ID NO: 5485848 - DNA, 14 bp, Homo sapiens
gcctgtgtgcagtg

SEQ ID NO: 5485849 - DNA, 20 bp, Homo sapiens
gcctgtgtgcagtggagctg

SEQ ID NO: 5485850 - DNA, 21 bp, Homo sapiens
gcctgtgtgtaagctgactgg

SEQ ID NO: 5485851 - DNA, 17 bp, Homo sapiens
gcctgtgtgtgggtggg

SEQ ID NO: 5485852 - DNA, 22 bp, Homo sapiens
gcctgtgttagtgtctgtccat

SEQ ID NO: 5485853 - DNA, 13 bp, Homo sapiens
gcctgtgtttcat

SEQ ID NO: 5485854 - DNA, 18 bp, Homo sapiens
gcctgtgtttcatgttct

SEQ ID NO: 5485855 - DNA, 20 bp, Homo sapiens
gcctgtgtttcatgttctgt

SEQ ID NO: 5485856 - DNA, 22 bp, Homo sapiens
gcctgttaatttataatgtatt

SEQ ID NO: 5485857 - DNA, 21 bp, Homo sapiens
gcctgttagcatgctggtgag

SEQ ID NO: 5485858 - DNA, 15 bp, Homo sapiens
gcctgttaggtctgt

SEQ ID NO: 5485859 - DNA, 16 bp, Homo sapiens
gcctgttcagctccag

SEQ ID NO: 5485860 - DNA, 15 bp, Homo sapiens
gcctgttcagttaca

SEQ ID NO: 5485861 - DNA, 19 bp, Homo sapiens
gcctgttcagttacagaaa

SEQ ID NO: 5485862 - DNA, 20 bp, Homo sapiens
gcctgttcatacaagccaac

SEQ ID NO: 5485863 - DNA, 16 bp, Homo sapiens
gcctgttcatggcaga

SEQ ID NO: 5485864 - DNA, 23 bp, Homo sapiens
gcctgttcccattcttgcatggc

SEQ ID NO: 5485865 - DNA, 20 bp, Homo sapiens
gcctgttcccccgccgcttt

SEQ ID NO: 5485866 - DNA, 22 bp, Homo sapiens
gcctgttcccctcactggatga

SEQ ID NO: 5485867 - DNA, 14 bp, Homo sapiens
gcctgttccctaga

SEQ ID NO: 5485868 - DNA, 20 bp, Homo sapiens
gcctgttccctagagagaat

SEQ ID NO: 5485869 - DNA, 23 bp, Homo sapiens
gcctgttccctagagagaataaa

SEQ ID NO: 5485870 - DNA, 16 bp, Homo sapiens
gcctgttccctgagga

SEQ ID NO: 5485871 - DNA, 22 bp, Homo sapiens
gcctgttcctcccaagaggcca

SEQ ID NO: 5485872 - DNA, 15 bp, Homo sapiens
gcctgttctccagat

SEQ ID NO: 5485873 - DNA, 17 bp, Homo sapiens
gcctgttctccagatgg

SEQ ID NO: 5485874 - DNA, 19 bp, Homo sapiens
gcctgttctgaggattcag

SEQ ID NO: 5485875 - DNA, 15 bp, Homo sapiens
gcctgttctgcttcg

SEQ ID NO: 5485876 - DNA, 15 bp, Homo sapiens
gcctgttctgtagga

SEQ ID NO: 5485877 - DNA, 21 bp, Homo sapiens
gcctgttgcaggcaaatgtaa

SEQ ID NO: 5485878 - DNA, 14 bp, Homo sapiens
gcctgttgcccttt

SEQ ID NO: 5485879 - DNA, 19 bp, Homo sapiens
gcctgttgctttcttcctg

SEQ ID NO: 5485880 - DNA, 23 bp, Homo sapiens
gcctgttgctttcttcctgcata

SEQ ID NO: 5485881 - DNA, 21 bp, Homo sapiens
gcctgttggacccgctctgga

SEQ ID NO: 5485882 - DNA, 17 bp, Homo sapiens
gcctgttggcaggccca

SEQ ID NO: 5485883 - DNA, 13 bp, Homo sapiens
gcctgttggctgc

SEQ ID NO: 5485884 - DNA, 16 bp, Homo sapiens
gcctgttggctgctgc

SEQ ID NO: 5485885 - DNA, 19 bp, Homo sapiens
gcctgttggctgctgcggc

SEQ ID NO: 5485886 - DNA, 16 bp, Homo sapiens
gccttccccagcctct

SEQ ID NO: 5485887 - DNA, 13 bp, Homo sapiens
gccttcccccaac

SEQ ID NO: 5485888 - DNA, 15 bp, Homo sapiens
gccttccccgtgcgg

SEQ ID NO: 5485889 - DNA, 22 bp, Homo sapiens
gccttccccgtgcggcccgtgc

SEQ ID NO: 5485890 - DNA, 18 bp, Homo sapiens
gccttcccctcagccaca

SEQ ID NO: 5485891 - DNA, 23 bp, Homo sapiens
gccttcccctcccagccctgagg

SEQ ID NO: 5485892 - DNA, 14 bp, Homo sapiens
gccttcccctgggc

SEQ ID NO: 5485893 - DNA, 13 bp, Homo sapiens
gccttcccctgtc

SEQ ID NO: 5485894 - DNA, 14 bp, Homo sapiens
gccttcccctgtct

SEQ ID NO: 5485895 - DNA, 20 bp, Homo sapiens
gccttcccctgtcttcacct

SEQ ID NO: 5485896 - DNA, 22 bp, Homo sapiens
gccttccccttatcctccctgt

SEQ ID NO: 5485897 - DNA, 23 bp, Homo sapiens
gccttccccttttgcctggctgt

SEQ ID NO: 5485898 - DNA, 24 bp, Homo sapiens
gccttccccttttgcctggctgtg

SEQ ID NO: 5485899 - DNA, 21 bp, Homo sapiens
gccttcccgccggaggccagc

SEQ ID NO: 5485900 - DNA, 23 bp, Homo sapiens
gccttcccgccggaggccagcta

SEQ ID NO: 5485901 - DNA, 15 bp, Homo sapiens
gccttccctcactct

SEQ ID NO: 5485902 - DNA, 16 bp, Homo sapiens
gccttccctccccaca

SEQ ID NO: 5485903 - DNA, 20 bp, Homo sapiens
gccttccgctcccaccagcc

SEQ ID NO: 5485904 - DNA, 22 bp, Homo sapiens
gccttcctaagcctgtggctgt

SEQ ID NO: 5485905 - DNA, 19 bp, Homo sapiens
gccttcctattttgcataa

SEQ ID NO: 5485906 - DNA, 18 bp, Homo sapiens
gccttcctccacatcctt

SEQ ID NO: 5485907 - DNA, 18 bp, Homo sapiens
gccttcctccatggccca

SEQ ID NO: 5485908 - DNA, 15 bp, Homo sapiens
gccttcctcctccac

SEQ ID NO: 5485909 - DNA, 16 bp, Homo sapiens
gccttcctcctccaca

SEQ ID NO: 5485910 - DNA, 15 bp, Homo sapiens
gccttcctcctctca

SEQ ID NO: 5485911 - DNA, 17 bp, Homo sapiens
gccttcctcctctcaaa

SEQ ID NO: 5485912 - DNA, 16 bp, Homo sapiens
gccttcctcctgggcc

SEQ ID NO: 5485913 - DNA, 22 bp, Homo sapiens
gccttcctcgtgcagagctggg

SEQ ID NO: 5485914 - DNA, 12 bp, Homo sapiens
gccttcctctct

SEQ ID NO: 5485915 - DNA, 13 bp, Homo sapiens
gccttcctctctc

SEQ ID NO: 5485916 - DNA, 19 bp, Homo sapiens
gccttcctctctctaccag

SEQ ID NO: 5485917 - DNA, 16 bp, Homo sapiens
gccttcctctctggat

SEQ ID NO: 5485918 - DNA, 18 bp, Homo sapiens
gccttcctctgaggacag

SEQ ID NO: 5485919 - DNA, 19 bp, Homo sapiens
gccttcctgccctacagag

SEQ ID NO: 5485920 - DNA, 22 bp, Homo sapiens
gccttcctgcctactgcccctg

SEQ ID NO: 5485921 - DNA, 17 bp, Homo sapiens
gccttcctggctttggg

SEQ ID NO: 5485922 - DNA, 20 bp, Homo sapiens
gccttcctggttttgtacac

SEQ ID NO: 5485923 - DNA, 12 bp, Homo sapiens
gccttccttctg

SEQ ID NO: 5485924 - DNA, 13 bp, Homo sapiens
gccttccttctgc

SEQ ID NO: 5485925 - DNA, 22 bp, Homo sapiens
gccttccttctgctcccacccc

SEQ ID NO: 5485926 - DNA, 13 bp, Homo sapiens
gccttccttgacc

SEQ ID NO: 5485927 - DNA, 18 bp, Homo sapiens
gccttccttgaccttcct

SEQ ID NO: 5485928 - DNA, 11 bp, Homo sapiens
gccttccttgc

SEQ ID NO: 5485929 - DNA, 17 bp, Homo sapiens
gccttcctttctccagg

SEQ ID NO: 5485930 - DNA, 20 bp, Homo sapiens
gccttcctttctccaggacc

SEQ ID NO: 5485931 - DNA, 21 bp, Homo sapiens
gccttcctttctccaggacca

SEQ ID NO: 5485932 - DNA, 16 bp, Homo sapiens
gccttcgaaaagaaat

SEQ ID NO: 5485933 - DNA, 22 bp, Homo sapiens
gccttcgatacaccgggcctgg

SEQ ID NO: 5485934 - DNA, 23 bp, Homo sapiens
gccttcgatacaccgggcctgga

SEQ ID NO: 5485935 - DNA, 18 bp, Homo sapiens
gccttcgctccatgtttt

SEQ ID NO: 5485936 - DNA, 17 bp, Homo sapiens
gccttcgcttcttgcct

SEQ ID NO: 5485937 - DNA, 18 bp, Homo sapiens
gccttcggcctccatcct

SEQ ID NO: 5485938 - DNA, 20 bp, Homo sapiens
gccttcggcctccatcctga

SEQ ID NO: 5485939 - DNA, 23 bp, Homo sapiens
gccttcggcctccatcctgaggc

SEQ ID NO: 5485940 - DNA, 15 bp, Homo sapiens
gccttcgtgcctgag

SEQ ID NO: 5485941 - DNA, 20 bp, Homo sapiens
gccttcgtgcctgagaccag

SEQ ID NO: 5485942 - DNA, 21 bp, Homo sapiens
gccttcgtgcctgagaccagg

SEQ ID NO: 5485943 - DNA, 15 bp, Homo sapiens
gccttcgtgtgctgc

SEQ ID NO: 5485944 - DNA, 17 bp, Homo sapiens
gccttcgtgtggctcct

SEQ ID NO: 5485945 - DNA, 19 bp, Homo sapiens
gccttcgtgtggctcctgg

SEQ ID NO: 5485946 - DNA, 14 bp, Homo sapiens
gccttcgtttatat

SEQ ID NO: 5485947 - DNA, 15 bp, Homo sapiens
gccttctacctgcag

SEQ ID NO: 5485948 - DNA, 20 bp, Homo sapiens
gccttctacctgcaggactc

SEQ ID NO: 5485949 - DNA, 20 bp, Homo sapiens
gccttctaggaatggaggag

SEQ ID NO: 5485950 - DNA, 17 bp, Homo sapiens
gccttctcaccagctgc

SEQ ID NO: 5485951 - DNA, 18 bp, Homo sapiens
gccttctcaccagctgca

SEQ ID NO: 5485952 - DNA, 16 bp, Homo sapiens
gccttctcagaagcac

SEQ ID NO: 5485953 - DNA, 17 bp, Homo sapiens
gccttctcagcctacag

SEQ ID NO: 5485954 - DNA, 14 bp, Homo sapiens
gccttctcaggccc

SEQ ID NO: 5485955 - DNA, 20 bp, Homo sapiens
gccttctccaggcttcccct

SEQ ID NO: 5485956 - DNA, 15 bp, Homo sapiens
gccttctccatatct

SEQ ID NO: 5485957 - DNA, 13 bp, Homo sapiens
gccttctcccctc

SEQ ID NO: 5485958 - DNA, 14 bp, Homo sapiens
gccttctcccctcc

SEQ ID NO: 5485959 - DNA, 16 bp, Homo sapiens
gccttctcccctccac

SEQ ID NO: 5485960 - DNA, 14 bp, Homo sapiens
gccttctcccctct

SEQ ID NO: 5485961 - DNA, 15 bp, Homo sapiens
gccttctcccctctc

SEQ ID NO: 5485962 - DNA, 18 bp, Homo sapiens
gccttctcccctcttctg

SEQ ID NO: 5485963 - DNA, 16 bp, Homo sapiens
gccttctccctgggaa

SEQ ID NO: 5485964 - DNA, 13 bp, Homo sapiens
gccttctcctccc

SEQ ID NO: 5485965 - DNA, 16 bp, Homo sapiens
gccttctcctcccaag

SEQ ID NO: 5485966 - DNA, 14 bp, Homo sapiens
gccttctcctctct

SEQ ID NO: 5485967 - DNA, 23 bp, Homo sapiens
gccttctcctgcctacattccct

SEQ ID NO: 5485968 - DNA, 21 bp, Homo sapiens
gccttctcggagctggcccag

SEQ ID NO: 5485969 - DNA, 22 bp, Homo sapiens
gccttctcggagctggcccagg

SEQ ID NO: 5485970 - DNA, 16 bp, Homo sapiens
gccttctctcagctcc

SEQ ID NO: 5485971 - DNA, 20 bp, Homo sapiens
gccttctctcagctcccagg

SEQ ID NO: 5485972 - DNA, 21 bp, Homo sapiens
gccttctctcagctcccaggc

SEQ ID NO: 5485973 - DNA, 24 bp, Homo sapiens
gccttctctcagctcccaggccaa

SEQ ID NO: 5485974 - DNA, 14 bp, Homo sapiens
gccttctctctctg

SEQ ID NO: 5485975 - DNA, 17 bp, Homo sapiens
gccttctctgcccacag

SEQ ID NO: 5485976 - DNA, 14 bp, Homo sapiens
gccttctcttgagg

SEQ ID NO: 5485977 - DNA, 19 bp, Homo sapiens
gccttctgaaatgtgaccc

SEQ ID NO: 5485978 - DNA, 14 bp, Homo sapiens
gccttctgatgtct

SEQ ID NO: 5485979 - DNA, 12 bp, Homo sapiens
gccttctgcagc

SEQ ID NO: 5485980 - DNA, 14 bp, Homo sapiens
gccttctgcagcag

SEQ ID NO: 5485981 - DNA, 13 bp, Homo sapiens
gccttctgccaac

SEQ ID NO: 5485982 - DNA, 22 bp, Homo sapiens
gccttctgccaacgcctcctgt

SEQ ID NO: 5485983 - DNA, 15 bp, Homo sapiens
gccttctgcggagct

SEQ ID NO: 5485984 - DNA, 21 bp, Homo sapiens
gccttctgcggagcttctcca

SEQ ID NO: 5485985 - DNA, 10 bp, Homo sapiens
gccttctgct

SEQ ID NO: 5485986 - DNA, 13 bp, Homo sapiens
gccttctgctgaa

SEQ ID NO: 5485987 - DNA, 17 bp, Homo sapiens
gccttctgctgcccagg

SEQ ID NO: 5485988 - DNA, 20 bp, Homo sapiens
gccttctgctgcccaggcca

SEQ ID NO: 5485989 - DNA, 22 bp, Homo sapiens
gccttctgctgcccaggccaca

SEQ ID NO: 5485990 - DNA, 24 bp, Homo sapiens
gccttctgctgcccaggccacagc

SEQ ID NO: 5485991 - DNA, 20 bp, Homo sapiens
gccttctggatccatggggg

SEQ ID NO: 5485992 - DNA, 18 bp, Homo sapiens
gccttctggccgctgcag

SEQ ID NO: 5485993 - DNA, 14 bp, Homo sapiens
gccttctggccttg

SEQ ID NO: 5485994 - DNA, 19 bp, Homo sapiens
gccttctgggaactctcct

SEQ ID NO: 5485995 - DNA, 23 bp, Homo sapiens
gccttctggggagggacacagag

SEQ ID NO: 5485996 - DNA, 17 bp, Homo sapiens
gccttctggttttagga

SEQ ID NO: 5485997 - DNA, 18 bp, Homo sapiens
gccttctgtcctggtgtc

SEQ ID NO: 5485998 - DNA, 14 bp, Homo sapiens
gccttctgtctctt

SEQ ID NO: 5485999 - DNA, 18 bp, Homo sapiens
gccttctgtctcttgcat

SEQ ID NO: 5486000 - DNA, 13 bp, Homo sapiens
gccttctgtggcc

SEQ ID NO: 5486001 - DNA, 13 bp, Homo sapiens
gccttctgtgggg

SEQ ID NO: 5486002 - DNA, 14 bp, Homo sapiens
gccttctgtgggga

SEQ ID NO: 5486003 - DNA, 19 bp, Homo sapiens
gccttctgtggggactccg

SEQ ID NO: 5486004 - DNA, 21 bp, Homo sapiens
gccttctgtggggctgggcac

SEQ ID NO: 5486005 - DNA, 19 bp, Homo sapiens
gccttctgttttccaaagg

SEQ ID NO: 5486006 - DNA, 19 bp, Homo sapiens
gccttcttatatctgaaga

SEQ ID NO: 5486007 - DNA, 17 bp, Homo sapiens
gccttcttcagggcctg

SEQ ID NO: 5486008 - DNA, 18 bp, Homo sapiens
gccttcttcagggcctgg

SEQ ID NO: 5486009 - DNA, 23 bp, Homo sapiens
gccttcttcggggaactcctgga

SEQ ID NO: 5486010 - DNA, 16 bp, Homo sapiens
gccttcttgctgccca

SEQ ID NO: 5486011 - DNA, 18 bp, Homo sapiens
gccttcttgctgcccaca

SEQ ID NO: 5486012 - DNA, 14 bp, Homo sapiens
gccttcttggtttc

SEQ ID NO: 5486013 - DNA, 12 bp, Homo sapiens
gccttctttcca

SEQ ID NO: 5486014 - DNA, 21 bp, Homo sapiens
gccttcttttctcccttttaa

SEQ ID NO: 5486015 - DNA, 15 bp, Homo sapiens
gccttcttttgatta

SEQ ID NO: 5486016 - DNA, 17 bp, Homo sapiens
gccttctttttctggac

SEQ ID NO: 5486017 - DNA, 13 bp, Homo sapiens
gccttgaaaaaca

SEQ ID NO: 5486018 - DNA, 13 bp, Homo sapiens
gccttgaaaacaa

SEQ ID NO: 5486019 - DNA, 15 bp, Homo sapiens
gccttgaaaacaaac

SEQ ID NO: 5486020 - DNA, 23 bp, Homo sapiens
gccttgaaatttacacagtgaga

SEQ ID NO: 5486021 - DNA, 19 bp, Homo sapiens
gccttgaaccacttccctc

SEQ ID NO: 5486022 - DNA, 17 bp, Homo sapiens
gccttgaacctgtgagt

SEQ ID NO: 5486023 - DNA, 23 bp, Homo sapiens
gccttgaactttgacctctgcag

SEQ ID NO: 5486024 - DNA, 14 bp, Homo sapiens
gccttgaagaaaat

SEQ ID NO: 5486025 - DNA, 20 bp, Homo sapiens
gccttgaagaaaatgacttt

SEQ ID NO: 5486026 - DNA, 17 bp, Homo sapiens
gccttgaagactccctg

SEQ ID NO: 5486027 - DNA, 18 bp, Homo sapiens
gccttgaagactccctga

SEQ ID NO: 5486028 - DNA, 20 bp, Homo sapiens
gccttgaagaggcaggtctg

SEQ ID NO: 5486029 - DNA, 14 bp, Homo sapiens
gccttgaataataa

SEQ ID NO: 5486030 - DNA, 22 bp, Homo sapiens
gccttgacaatgttgtcctcct

SEQ ID NO: 5486031 - DNA, 18 bp, Homo sapiens
gccttgacatcagttcct

SEQ ID NO: 5486032 - DNA, 22 bp, Homo sapiens
gccttgaccattctccacctgc

SEQ ID NO: 5486033 - DNA, 21 bp, Homo sapiens
gccttgagagaaaaagtgccc

SEQ ID NO: 5486034 - DNA, 13 bp, Homo sapiens
gccttgagcatct

SEQ ID NO: 5486035 - DNA, 14 bp, Homo sapiens
gccttgagcatctg

SEQ ID NO: 5486036 - DNA, 18 bp, Homo sapiens
gccttgataaatatatat

SEQ ID NO: 5486037 - DNA, 18 bp, Homo sapiens
gccttgatgaagcccgtg

SEQ ID NO: 5486038 - DNA, 19 bp, Homo sapiens
gccttgatgaagcctgtgc

SEQ ID NO: 5486039 - DNA, 14 bp, Homo sapiens
gccttgatggagaa

SEQ ID NO: 5486040 - DNA, 14 bp, Homo sapiens
gccttgatgtttct

SEQ ID NO: 5486041 - DNA, 18 bp, Homo sapiens
gccttgattataccactg

SEQ ID NO: 5486042 - DNA, 20 bp, Homo sapiens
gccttgattcccttgttatt

SEQ ID NO: 5486043 - DNA, 17 bp, Homo sapiens
gccttgattttaattca

SEQ ID NO: 5486044 - DNA, 16 bp, Homo sapiens
gccttgcaacccaagg

SEQ ID NO: 5486045 - DNA, 20 bp, Homo sapiens
gccttgcacaaaaagcacaa

SEQ ID NO: 5486046 - DNA, 22 bp, Homo sapiens
gccttgcacaaaaagcacaagc

SEQ ID NO: 5486047 - DNA, 24 bp, Homo sapiens
gccttgcacaagtacttgagaata

SEQ ID NO: 5486048 - DNA, 18 bp, Homo sapiens
gccttgcacacccactgc

SEQ ID NO: 5486049 - DNA, 18 bp, Homo sapiens
gccttgcacggctgctcg

SEQ ID NO: 5486050 - DNA, 18 bp, Homo sapiens
gccttgcagaactgccat

SEQ ID NO: 5486051 - DNA, 18 bp, Homo sapiens
gccttgcagatatctgca

SEQ ID NO: 5486052 - DNA, 16 bp, Homo sapiens
gccttgcagccacatg

SEQ ID NO: 5486053 - DNA, 17 bp, Homo sapiens
gccttgcagcggctcct

SEQ ID NO: 5486054 - DNA, 20 bp, Homo sapiens
gccttgcagcggctcctgca

SEQ ID NO: 5486055 - DNA, 14 bp, Homo sapiens
gccttgcataccca

SEQ ID NO: 5486056 - DNA, 18 bp, Homo sapiens
gccttgcatgtacttgaa

SEQ ID NO: 5486057 - DNA, 19 bp, Homo sapiens
gccttgcatgtacttgaag

SEQ ID NO: 5486058 - DNA, 14 bp, Homo sapiens
gccttgccagagat

SEQ ID NO: 5486059 - DNA, 15 bp, Homo sapiens
gccttgccagttttc

SEQ ID NO: 5486060 - DNA, 22 bp, Homo sapiens
gccttgcccactcctgctctgc

SEQ ID NO: 5486061 - DNA, 12 bp, Homo sapiens
gccttgcccaga

SEQ ID NO: 5486062 - DNA, 20 bp, Homo sapiens
gccttgcccagagatgcctc

SEQ ID NO: 5486063 - DNA, 15 bp, Homo sapiens
gcgactggatgctcg

SEQ ID NO: 5486064 - DNA, 19 bp, Homo sapiens
gcgacttccacaaacctgg

SEQ ID NO: 5486065 - DNA, 18 bp, Homo sapiens
gcgacttgttttgctgct

SEQ ID NO: 5486066 - DNA, 16 bp, Homo sapiens
gcgactttctgcctgg

SEQ ID NO: 5486067 - DNA, 17 bp, Homo sapiens
gcgactttctgcctgga

SEQ ID NO: 5486068 - DNA, 12 bp, Homo sapiens
gcgacttttgtt

SEQ ID NO: 5486069 - DNA, 19 bp, Homo sapiens
gcgacttttgttctcttct

SEQ ID NO: 5486070 - DNA, 24 bp, Homo sapiens
gcgagaaaacttcgtaagaacatg

SEQ ID NO: 5486071 - DNA, 22 bp, Homo sapiens
gcgagaatgcaggccccgcccc

SEQ ID NO: 5486072 - DNA, 13 bp, Homo sapiens
gcgagaattttca

SEQ ID NO: 5486073 - DNA, 22 bp, Homo sapiens
gcgagaccccctgtcctgtgct

SEQ ID NO: 5486074 - DNA, 15 bp, Homo sapiens
gcgagactccatctc

SEQ ID NO: 5486075 - DNA, 16 bp, Homo sapiens
gcgagagaggagccag

SEQ ID NO: 5486076 - DNA, 20 bp, Homo sapiens
gcgagagaggtgggcagcag

SEQ ID NO: 5486077 - DNA, 15 bp, Homo sapiens
gcgagagtccctgca

SEQ ID NO: 5486078 - DNA, 22 bp, Homo sapiens
gcgagattccgtctcaaaaaaa

SEQ ID NO: 5486079 - DNA, 18 bp, Homo sapiens
gcgagcatgggggctgcc

SEQ ID NO: 5486080 - DNA, 18 bp, Homo sapiens
gcgagcatgtcgtggaca

SEQ ID NO: 5486081 - DNA, 16 bp, Homo sapiens
gcgagcatttccctcc

SEQ ID NO: 5486082 - DNA, 20 bp, Homo sapiens
gcgagccagattaggcctgg

SEQ ID NO: 5486083 - DNA, 13 bp, Homo sapiens
gcgagccaggcaa

SEQ ID NO: 5486084 - DNA, 18 bp, Homo sapiens
gcgagcccctccttctcc

SEQ ID NO: 5486085 - DNA, 21 bp, Homo sapiens
gcgagcccctcggctctggag

SEQ ID NO: 5486086 - DNA, 17 bp, Homo sapiens
gcgagccctggtggcag

SEQ ID NO: 5486087 - DNA, 13 bp, Homo sapiens
gcgagcccttagc

SEQ ID NO: 5486088 - DNA, 14 bp, Homo sapiens
gcgagcccttagcc

SEQ ID NO: 5486089 - DNA, 14 bp, Homo sapiens
gcgagcctgactct

SEQ ID NO: 5486090 - DNA, 17 bp, Homo sapiens
gcgagcctgtgccttcc

SEQ ID NO: 5486091 - DNA, 16 bp, Homo sapiens
gcgagcggcaaaggcc

SEQ ID NO: 5486092 - DNA, 19 bp, Homo sapiens
gcgagctgagatcacacca

SEQ ID NO: 5486093 - DNA, 15 bp, Homo sapiens
gcgaggaaaaacaaa

SEQ ID NO: 5486094 - DNA, 15 bp, Homo sapiens
gcgaggaaaaacaac

SEQ ID NO: 5486095 - DNA, 13 bp, Homo sapiens
gcgaggaggcgcg

SEQ ID NO: 5486096 - DNA, 16 bp, Homo sapiens
gcgaggaggcgcggcc

SEQ ID NO: 5486097 - DNA, 22 bp, Homo sapiens
gcgaggaggcgcggcctcccga

SEQ ID NO: 5486098 - DNA, 13 bp, Homo sapiens
gcgaggattataa

SEQ ID NO: 5486099 - DNA, 14 bp, Homo sapiens
gcgaggcagaatgg

SEQ ID NO: 5486100 - DNA, 12 bp, Homo sapiens
gcgaggcagagg

SEQ ID NO: 5486101 - DNA, 13 bp, Homo sapiens
gcgaggcagagga

SEQ ID NO: 5486102 - DNA, 12 bp, Homo sapiens
gcgaggcaggcc

SEQ ID NO: 5486103 - DNA, 19 bp, Homo sapiens
gcgaggcccttcctctttg

SEQ ID NO: 5486104 - DNA, 22 bp, Homo sapiens
gcgaggcctattgttgaataaa

SEQ ID NO: 5486105 - DNA, 20 bp, Homo sapiens
gcgaggcctgacacaggcca

SEQ ID NO: 5486106 - DNA, 18 bp, Homo sapiens
gcgaggcgaggctgcctc

SEQ ID NO: 5486107 - DNA, 19 bp, Homo sapiens
gcgaggcgggggagcctgg

SEQ ID NO: 5486108 - DNA, 21 bp, Homo sapiens
gcgaggcgggggagcctggag

SEQ ID NO: 5486109 - DNA, 22 bp, Homo sapiens
gcgaggcgggggagcctggagc

SEQ ID NO: 5486110 - DNA, 24 bp, Homo sapiens
gcgaggcgggggagcctggagccc

SEQ ID NO: 5486111 - DNA, 13 bp, Homo sapiens
gcgaggctgggct

SEQ ID NO: 5486112 - DNA, 11 bp, Homo sapiens
gcgagggaggg

SEQ ID NO: 5486113 - DNA, 13 bp, Homo sapiens
gcgagggcagctg

SEQ ID NO: 5486114 - DNA, 15 bp, Homo sapiens
gcgagggcagctgct

SEQ ID NO: 5486115 - DNA, 17 bp, Homo sapiens
gcgagggcagctgctat

SEQ ID NO: 5486116 - DNA, 12 bp, Homo sapiens
gcgagggcctgc

SEQ ID NO: 5486117 - DNA, 13 bp, Homo sapiens
gcgagggcctgcg

SEQ ID NO: 5486118 - DNA, 14 bp, Homo sapiens
gcgagggctactca

SEQ ID NO: 5486119 - DNA, 18 bp, Homo sapiens
gcgaggggccagcagagg

SEQ ID NO: 5486120 - DNA, 19 bp, Homo sapiens
gcgagggggccggggggag

SEQ ID NO: 5486121 - DNA, 18 bp, Homo sapiens
gcgaggtcaacagagaag

SEQ ID NO: 5486122 - DNA, 19 bp, Homo sapiens
gcgaggtcaacagagaagg

SEQ ID NO: 5486123 - DNA, 23 bp, Homo sapiens
gcgaggtcaacagagaaggcagg

SEQ ID NO: 5486124 - DNA, 16 bp, Homo sapiens
gcgaggtgcggccacc

SEQ ID NO: 5486125 - DNA, 14 bp, Homo sapiens
gcgaggtgtaaagt

SEQ ID NO: 5486126 - DNA, 16 bp, Homo sapiens
gcgagtccaaggccag

SEQ ID NO: 5486127 - DNA, 13 bp, Homo sapiens
gcgagtccagaca

SEQ ID NO: 5486128 - DNA, 22 bp, Homo sapiens
gcgagtccagacaccatcacca

SEQ ID NO: 5486129 - DNA, 21 bp, Homo sapiens
gcgagtctggagaccaggact

SEQ ID NO: 5486130 - DNA, 14 bp, Homo sapiens
gcgagtctggggac

SEQ ID NO: 5486131 - DNA, 17 bp, Homo sapiens
gcgagtctggggacctg

SEQ ID NO: 5486132 - DNA, 15 bp, Homo sapiens
gcgagtgccaggact

SEQ ID NO: 5486133 - DNA, 14 bp, Homo sapiens
gcgagtggcttagg

SEQ ID NO: 5486134 - DNA, 13 bp, Homo sapiens
gcgatagagtctc

SEQ ID NO: 5486135 - DNA, 14 bp, Homo sapiens
gcgatatacagatg

SEQ ID NO: 5486136 - DNA, 19 bp, Homo sapiens
gcgatatacagatgaaaat

SEQ ID NO: 5486137 - DNA, 17 bp, Homo sapiens
gcgatcaagtccagagc

SEQ ID NO: 5486138 - DNA, 17 bp, Homo sapiens
gcgatcatggctcactg

SEQ ID NO: 5486139 - DNA, 20 bp, Homo sapiens
gcgatcatggctcactgcag

SEQ ID NO: 5486140 - DNA, 16 bp, Homo sapiens
gcgatccacctgtctc

SEQ ID NO: 5486141 - DNA, 15 bp, Homo sapiens
gcgatccaggggaag

SEQ ID NO: 5486142 - DNA, 20 bp, Homo sapiens
gcgatcccacacaggctggc

SEQ ID NO: 5486143 - DNA, 20 bp, Homo sapiens
gcgatccccgcttccccttg

SEQ ID NO: 5486144 - DNA, 19 bp, Homo sapiens
gcgatccctcccctcagcc

SEQ ID NO: 5486145 - DNA, 17 bp, Homo sapiens
gcgatctcggctcactg

SEQ ID NO: 5486146 - DNA, 19 bp, Homo sapiens
gcgatgaatttggagactc

SEQ ID NO: 5486147 - DNA, 20 bp, Homo sapiens
gcgatgacacttgtacaatt

SEQ ID NO: 5486148 - DNA, 17 bp, Homo sapiens
gcgatgaggtaattctc

SEQ ID NO: 5486149 - DNA, 12 bp, Homo sapiens
gcgatgatgggc

SEQ ID NO: 5486150 - DNA, 14 bp, Homo sapiens
gcgatgccagccaa

SEQ ID NO: 5486151 - DNA, 23 bp, Homo sapiens
gcgatgctccctcagcctcagag

SEQ ID NO: 5486152 - DNA, 14 bp, Homo sapiens
gcgatggcaggcct

SEQ ID NO: 5486153 - DNA, 21 bp, Homo sapiens
gcgatggctgtcttttcttga

SEQ ID NO: 5486154 - DNA, 21 bp, Homo sapiens
gcgatggggcaagacagaaaa

SEQ ID NO: 5486155 - DNA, 21 bp, Homo sapiens
gcgatgtcactcagccccttc

SEQ ID NO: 5486156 - DNA, 21 bp, Homo sapiens
gcgatgtggaactgctgccac

SEQ ID NO: 5486157 - DNA, 10 bp, Homo sapiens
gcgatgtgtt

SEQ ID NO: 5486158 - DNA, 22 bp, Homo sapiens
gcgatgtgttctttgtacctgt

SEQ ID NO: 5486159 - DNA, 23 bp, Homo sapiens
gcgatgtttcaggaggctggagg

SEQ ID NO: 5486160 - DNA, 16 bp, Homo sapiens
gcgattccctctcacc

SEQ ID NO: 5486161 - DNA, 14 bp, Homo sapiens
gcgattccctctcc

SEQ ID NO: 5486162 - DNA, 19 bp, Homo sapiens
gcgattccctctcccaggc

SEQ ID NO: 5486163 - DNA, 22 bp, Homo sapiens
gcgattccctctcccaggcccc

SEQ ID NO: 5486164 - DNA, 14 bp, Homo sapiens
gcgattcctgccaa

SEQ ID NO: 5486165 - DNA, 12 bp, Homo sapiens
gcgattctcatg

SEQ ID NO: 5486166 - DNA, 20 bp, Homo sapiens
gcgattctcccgcctcagcc

SEQ ID NO: 5486167 - DNA, 21 bp, Homo sapiens
gcgattctcttgcctcagctt

SEQ ID NO: 5486168 - DNA, 13 bp, Homo sapiens
gcgattcttctgc

SEQ ID NO: 5486169 - DNA, 17 bp, Homo sapiens
gcgattcttctgcttca

SEQ ID NO: 5486170 - DNA, 23 bp, Homo sapiens
gcgattcttctgcttcagcctcc

SEQ ID NO: 5486171 - DNA, 18 bp, Homo sapiens
gcgattcttgtgcctcag

SEQ ID NO: 5486172 - DNA, 15 bp, Homo sapiens
gcgattttattactg

SEQ ID NO: 5486173 - DNA, 15 bp, Homo sapiens
gcgatttttgtatgt

SEQ ID NO: 5486174 - DNA, 22 bp, Homo sapiens
gcgcaaaactgcctgaaagcaa

SEQ ID NO: 5486175 - DNA, 22 bp, Homo sapiens
gcgcaaagggcatgggtcggga

SEQ ID NO: 5486176 - DNA, 20 bp, Homo sapiens
gcgcaactggagccagcaac

SEQ ID NO: 5486177 - DNA, 20 bp, Homo sapiens
gcgcaagatagatttggaat

SEQ ID NO: 5486178 - DNA, 15 bp, Homo sapiens
gcgcaagccacagcc

SEQ ID NO: 5486179 - DNA, 22 bp, Homo sapiens
gcgcaagcgacacaggctgccg

SEQ ID NO: 5486180 - DNA, 19 bp, Homo sapiens
gcgcaagggaggcccagcg

SEQ ID NO: 5486181 - DNA, 18 bp, Homo sapiens
gcgcaatctcgccttcct

SEQ ID NO: 5486182 - DNA, 19 bp, Homo sapiens
gcgcaatctcggctcactg

SEQ ID NO: 5486183 - DNA, 21 bp, Homo sapiens
gcgcaatctcggctcactgca

SEQ ID NO: 5486184 - DNA, 18 bp, Homo sapiens
gcgcacaaggctgaccaa

SEQ ID NO: 5486185 - DNA, 13 bp, Homo sapiens
gcgcacacacaca

SEQ ID NO: 5486186 - DNA, 15 bp, Homo sapiens
gcgcacacacacaca

SEQ ID NO: 5486187 - DNA, 18 bp, Homo sapiens
gcgcacacacacacatac

SEQ ID NO: 5486188 - DNA, 13 bp, Homo sapiens
gcgcacaccacca

SEQ ID NO: 5486189 - DNA, 22 bp, Homo sapiens
gcgcacacgcacgcacacacac

SEQ ID NO: 5486190 - DNA, 18 bp, Homo sapiens
gcgcacagagggaagcca

SEQ ID NO: 5486191 - DNA, 16 bp, Homo sapiens
gcgcaccaatgcccag

SEQ ID NO: 5486192 - DNA, 21 bp, Homo sapiens
gcgcacccagagaaaattaat

SEQ ID NO: 5486193 - DNA, 15 bp, Homo sapiens
gcgcaccccacagct

SEQ ID NO: 5486194 - DNA, 15 bp, Homo sapiens
gcgcaccccacgccc

SEQ ID NO: 5486195 - DNA, 17 bp, Homo sapiens
gcgcaccctcccctccc

SEQ ID NO: 5486196 - DNA, 14 bp, Homo sapiens
gcgcaccgcccaac

SEQ ID NO: 5486197 - DNA, 20 bp, Homo sapiens
gcgcacctatcacccaggct

SEQ ID NO: 5486198 - DNA, 12 bp, Homo sapiens
gcgcacctgccc

SEQ ID NO: 5486199 - DNA, 17 bp, Homo sapiens
gcgcacctgccccctgg

SEQ ID NO: 5486200 - DNA, 19 bp, Homo sapiens
gcgcacctgccccctggtg

SEQ ID NO: 5486201 - DNA, 12 bp, Homo sapiens
gcgcactgcatg

SEQ ID NO: 5486202 - DNA, 22 bp, Homo sapiens
gcgcactgtgacccccagctcc

SEQ ID NO: 5486203 - DNA, 17 bp, Homo sapiens
gcgcacttacctgcttg

SEQ ID NO: 5486204 - DNA, 20 bp, Homo sapiens
gcgcacttacctgcttgagc

SEQ ID NO: 5486205 - DNA, 21 bp, Homo sapiens
gcgcactttcctcctggcaga

SEQ ID NO: 5486206 - DNA, 15 bp, Homo sapiens
gcgcagaatgaaggg

SEQ ID NO: 5486207 - DNA, 17 bp, Homo sapiens
gcgcagagccctccagg

SEQ ID NO: 5486208 - DNA, 24 bp, Homo sapiens
gcgcagagccctccaggcctgcag

SEQ ID NO: 5486209 - DNA, 20 bp, Homo sapiens
gcgcagaggtcccagcccca

SEQ ID NO: 5486210 - DNA, 17 bp, Homo sapiens
gcgcagatgaggggcca

SEQ ID NO: 5486211 - DNA, 15 bp, Homo sapiens
gcgcagccccatctg

SEQ ID NO: 5486212 - DNA, 13 bp, Homo sapiens
gcgcagcccctgg

SEQ ID NO: 5486213 - DNA, 19 bp, Homo sapiens
gcgcagcccgaagcccagt

SEQ ID NO: 5486214 - DNA, 16 bp, Homo sapiens
gcgcagccgcgctctg

SEQ ID NO: 5486215 - DNA, 21 bp, Homo sapiens
gcgcagccgcgctctgcccct

SEQ ID NO: 5486216 - DNA, 16 bp, Homo sapiens
gcgcagcctccagggc

SEQ ID NO: 5486217 - DNA, 13 bp, Homo sapiens
gcgcagcgccagg

SEQ ID NO: 5486218 - DNA, 17 bp, Homo sapiens
gcgcagcgcctccaccc

SEQ ID NO: 5486219 - DNA, 20 bp, Homo sapiens
gcgcagcgcctccaccctgc

SEQ ID NO: 5486220 - DNA, 21 bp, Homo sapiens
gcgcagcgcctccaccctgcc

SEQ ID NO: 5486221 - DNA, 16 bp, Homo sapiens
gcgcagctccttccct

SEQ ID NO: 5486222 - DNA, 15 bp, Homo sapiens
gcgcagctgaagcct

SEQ ID NO: 5486223 - DNA, 19 bp, Homo sapiens
gcgcagctgaagcctggac

SEQ ID NO: 5486224 - DNA, 22 bp, Homo sapiens
gcgcagctgcatttggggtggg

SEQ ID NO: 5486225 - DNA, 15 bp, Homo sapiens
gcgcaggaaccgagg

SEQ ID NO: 5486226 - DNA, 16 bp, Homo sapiens
gcgcaggcagcgcagg

SEQ ID NO: 5486227 - DNA, 18 bp, Homo sapiens
gcgcaggcagcgcagggc

SEQ ID NO: 5486228 - DNA, 16 bp, Homo sapiens
gcgcaggcccagtgac

SEQ ID NO: 5486229 - DNA, 19 bp, Homo sapiens
gcgcaggccgtgacgtctg

SEQ ID NO: 5486230 - DNA, 22 bp, Homo sapiens
gcgcaggcgggactatcaggag

SEQ ID NO: 5486231 - DNA, 12 bp, Homo sapiens
gcgcaggctgca

SEQ ID NO: 5486232 - DNA, 14 bp, Homo sapiens
gcgcaggctgcaga

SEQ ID NO: 5486233 - DNA, 15 bp, Homo sapiens
gcgcaggctgcagag

SEQ ID NO: 5486234 - DNA, 21 bp, Homo sapiens
gcgcaggctgcagagcccggc

SEQ ID NO: 5486235 - DNA, 15 bp, Homo sapiens
gcgcaggctggccct

SEQ ID NO: 5486236 - DNA, 19 bp, Homo sapiens
gcgcaggctggccctgccc

SEQ ID NO: 5486237 - DNA, 19 bp, Homo sapiens
gcgcaggtctcttctgggc

SEQ ID NO: 5486238 - DNA, 21 bp, Homo sapiens
gcgcaggtgccatgcctgctc

SEQ ID NO: 5486239 - DNA, 22 bp, Homo sapiens
gcgcaggtgccatgcctgctcc

SEQ ID NO: 5486240 - DNA, 14 bp, Homo sapiens
gcgcagtgcctctg

SEQ ID NO: 5486241 - DNA, 23 bp, Homo sapiens
gcgcctttccgcggagcccttgg

SEQ ID NO: 5486242 - DNA, 15 bp, Homo sapiens
gcgcctttttggcct

SEQ ID NO: 5486243 - DNA, 17 bp, Homo sapiens
gcgcctttttggcctgt

SEQ ID NO: 5486244 - DNA, 17 bp, Homo sapiens
gcgcgaccctccccggc

SEQ ID NO: 5486245 - DNA, 21 bp, Homo sapiens
gcgcgatcccacacaggctgg

SEQ ID NO: 5486246 - DNA, 16 bp, Homo sapiens
gcgcgatctcagctca

SEQ ID NO: 5486247 - DNA, 13 bp, Homo sapiens
gcgcgcaccgccc

SEQ ID NO: 5486248 - DNA, 17 bp, Homo sapiens
gcgcgcaccgcccaacc

SEQ ID NO: 5486249 - DNA, 20 bp, Homo sapiens
gcgcgcaggcagggagaagg

SEQ ID NO: 5486250 - DNA, 21 bp, Homo sapiens
gcgcgcatgtaatcccagcta

SEQ ID NO: 5486251 - DNA, 17 bp, Homo sapiens
gcgcgccaccgtgcctg

SEQ ID NO: 5486252 - DNA, 12 bp, Homo sapiens
gcgcgcccccag

SEQ ID NO: 5486253 - DNA, 15 bp, Homo sapiens
gcgcgcccctagccg

SEQ ID NO: 5486254 - DNA, 13 bp, Homo sapiens
gcgcgcccctgcc

SEQ ID NO: 5486255 - DNA, 20 bp, Homo sapiens
gcgcgccctcccttggcgtg

SEQ ID NO: 5486256 - DNA, 19 bp, Homo sapiens
gcgcgcgggacagcggccc

SEQ ID NO: 5486257 - DNA, 23 bp, Homo sapiens
gcgcgctcctgacccctccctgc

SEQ ID NO: 5486258 - DNA, 21 bp, Homo sapiens
gcgcggacatcccctgctggc

SEQ ID NO: 5486259 - DNA, 20 bp, Homo sapiens
gcgcggatgtagcatgttct

SEQ ID NO: 5486260 - DNA, 13 bp, Homo sapiens
gcgcggccagccc

SEQ ID NO: 5486261 - DNA, 14 bp, Homo sapiens
gcgcggccagcccc

SEQ ID NO: 5486262 - DNA, 16 bp, Homo sapiens
gcgcggccagccccgg

SEQ ID NO: 5486263 - DNA, 21 bp, Homo sapiens
gcgcggccagccccggccctg

SEQ ID NO: 5486264 - DNA, 18 bp, Homo sapiens
gcgcggcctcccgaggag

SEQ ID NO: 5486265 - DNA, 20 bp, Homo sapiens
gcgcggcctcccgaggaggg

SEQ ID NO: 5486266 - DNA, 16 bp, Homo sapiens
gcgcggcggctctgcc

SEQ ID NO: 5486267 - DNA, 14 bp, Homo sapiens
gcgcgggagagagt

SEQ ID NO: 5486268 - DNA, 15 bp, Homo sapiens
gcgcgggagagagtg

SEQ ID NO: 5486269 - DNA, 16 bp, Homo sapiens
gcgcgggaggcaccag

SEQ ID NO: 5486270 - DNA, 15 bp, Homo sapiens
gcgcgggagggggcg

SEQ ID NO: 5486271 - DNA, 21 bp, Homo sapiens
gcgcggggaggccggcgcagc

SEQ ID NO: 5486272 - DNA, 23 bp, Homo sapiens
gcgcgtatcaccatacccagcta

SEQ ID NO: 5486273 - DNA, 15 bp, Homo sapiens
gcgcgtccccctgcc

SEQ ID NO: 5486274 - DNA, 16 bp, Homo sapiens
gcgcgtccttccctaa

SEQ ID NO: 5486275 - DNA, 19 bp, Homo sapiens
gcgcgtgtgggtctctggg

SEQ ID NO: 5486276 - DNA, 13 bp, Homo sapiens
gcgcgttgtgtat

SEQ ID NO: 5486277 - DNA, 14 bp, Homo sapiens
gcgcgttgtgtata

SEQ ID NO: 5486278 - DNA, 15 bp, Homo sapiens
gcgctaacccccagc

SEQ ID NO: 5486279 - DNA, 19 bp, Homo sapiens
gcgctaacccccagcccac

SEQ ID NO: 5486280 - DNA, 22 bp, Homo sapiens
gcgctaacttgcttaaatgtga

SEQ ID NO: 5486281 - DNA, 23 bp, Homo sapiens
gcgctagagcattctggggtggg

SEQ ID NO: 5486282 - DNA, 21 bp, Homo sapiens
gcgctagcacagctcccttct

SEQ ID NO: 5486283 - DNA, 13 bp, Homo sapiens
gcgctagcagccc

SEQ ID NO: 5486284 - DNA, 18 bp, Homo sapiens
gcgctaggggacttgggg

SEQ ID NO: 5486285 - DNA, 15 bp, Homo sapiens
gcgctagtgccttgc

SEQ ID NO: 5486286 - DNA, 22 bp, Homo sapiens
gcgctagtgccttgcccacagg

SEQ ID NO: 5486287 - DNA, 15 bp, Homo sapiens
gcgctatccacagaa

SEQ ID NO: 5486288 - DNA, 16 bp, Homo sapiens
gcgctcacctcagagc

SEQ ID NO: 5486289 - DNA, 14 bp, Homo sapiens
gcgctcagacggcg

SEQ ID NO: 5486290 - DNA, 20 bp, Homo sapiens
gcgctcagacggcggccagg

SEQ ID NO: 5486291 - DNA, 19 bp, Homo sapiens
gcgctcagaggccgctctg

SEQ ID NO: 5486292 - DNA, 14 bp, Homo sapiens
gcgctcagatgccg

SEQ ID NO: 5486293 - DNA, 14 bp, Homo sapiens
gcgctcagcagccc

SEQ ID NO: 5486294 - DNA, 12 bp, Homo sapiens
gcgctcaggacc

SEQ ID NO: 5486295 - DNA, 13 bp, Homo sapiens
gcgctcaggaccc

SEQ ID NO: 5486296 - DNA, 16 bp, Homo sapiens
gcgctcagggccatgc

SEQ ID NO: 5486297 - DNA, 22 bp, Homo sapiens
gcgctcagggccatgctgaggc

SEQ ID NO: 5486298 - DNA, 18 bp, Homo sapiens
gcgctcaggggctccatg

SEQ ID NO: 5486299 - DNA, 12 bp, Homo sapiens
gcgctcagtaaa

SEQ ID NO: 5486300 - DNA, 15 bp, Homo sapiens
gcgctcatctggctt

SEQ ID NO: 5486301 - DNA, 19 bp, Homo sapiens
gcgctcattttaggcctcc

SEQ ID NO: 5486302 - DNA, 23 bp, Homo sapiens
gcgctccaggccactctcagaga

SEQ ID NO: 5486303 - DNA, 11 bp, Homo sapiens
gcgctccaggg

SEQ ID NO: 5486304 - DNA, 14 bp, Homo sapiens
gcgctcccactcag

SEQ ID NO: 5486305 - DNA, 17 bp, Homo sapiens
gcgctcccactcagaac

SEQ ID NO: 5486306 - DNA, 15 bp, Homo sapiens
gcgctcccagcctgc

SEQ ID NO: 5486307 - DNA, 17 bp, Homo sapiens
gcgctcccctggaagcg

SEQ ID NO: 5486308 - DNA, 19 bp, Homo sapiens
gcgctcccgcatttctcat

SEQ ID NO: 5486309 - DNA, 18 bp, Homo sapiens
gcgctccctgtcgcctgc

SEQ ID NO: 5486310 - DNA, 19 bp, Homo sapiens
gcgctcccttgacctgctg

SEQ ID NO: 5486311 - DNA, 21 bp, Homo sapiens
gcgctccggcagaggcagggc

SEQ ID NO: 5486312 - DNA, 22 bp, Homo sapiens
gcgctccggcagaggcagggcc

SEQ ID NO: 5486313 - DNA, 22 bp, Homo sapiens
gcgctccgggacgtggcacctc

SEQ ID NO: 5486314 - DNA, 16 bp, Homo sapiens
gcgctcctcccagctg

SEQ ID NO: 5486315 - DNA, 11 bp, Homo sapiens
gcgctcctcct

SEQ ID NO: 5486316 - DNA, 14 bp, Homo sapiens
gcgctcctcctgtg

SEQ ID NO: 5486317 - DNA, 12 bp, Homo sapiens
gcgctcctctgc

SEQ ID NO: 5486318 - DNA, 13 bp, Homo sapiens
gcgctcctctgca

SEQ ID NO: 5486319 - DNA, 14 bp, Homo sapiens
gcgctcctctgcag

SEQ ID NO: 5486320 - DNA, 15 bp, Homo sapiens
gcgctcctctgcagc

SEQ ID NO: 5486321 - DNA, 22 bp, Homo sapiens
gcgctcctctgcagcctgagct

SEQ ID NO: 5486322 - DNA, 23 bp, Homo sapiens
gcgctcctctgcagcctgagctc

SEQ ID NO: 5486323 - DNA, 13 bp, Homo sapiens
gcgctcctctgcc

SEQ ID NO: 5486324 - DNA, 19 bp, Homo sapiens
gcgctcctgccgcagagct

SEQ ID NO: 5486325 - DNA, 20 bp, Homo sapiens
gcgctcctgccgcagagctg

SEQ ID NO: 5486326 - DNA, 21 bp, Homo sapiens
gcgctcctgccgcagagctgg

SEQ ID NO: 5486327 - DNA, 18 bp, Homo sapiens
gcgctcctggcccagcct

SEQ ID NO: 5486328 - DNA, 20 bp, Homo sapiens
gcgctcctggcccagccttt

SEQ ID NO: 5486329 - DNA, 13 bp, Homo sapiens
gcgctccttggcg

SEQ ID NO: 5486330 - DNA, 21 bp, Homo sapiens
gcgctcgccacgctcagtgcc

SEQ ID NO: 5486331 - DNA, 16 bp, Homo sapiens
gcgctcgcccagcagg

SEQ ID NO: 5486332 - DNA, 16 bp, Homo sapiens
gcgctcggcccggagc

SEQ ID NO: 5486333 - DNA, 22 bp, Homo sapiens
gcgctcggcccggagcagcagg

SEQ ID NO: 5486334 - DNA, 17 bp, Homo sapiens
gcgctctcaagaccaga

SEQ ID NO: 5486335 - DNA, 20 bp, Homo sapiens
gcgctctccctaccttgcct

SEQ ID NO: 5486336 - DNA, 12 bp, Homo sapiens
gcgctctcctgg

SEQ ID NO: 5486337 - DNA, 12 bp, Homo sapiens
gcgctctctctc

SEQ ID NO: 5486338 - DNA, 18 bp, Homo sapiens
gcgctctctctctttctc

SEQ ID NO: 5486339 - DNA, 16 bp, Homo sapiens
gcgctctgcatgctcc

SEQ ID NO: 5486340 - DNA, 21 bp, Homo sapiens
gcgctctgcatgctcctctgc

SEQ ID NO: 5486341 - DNA, 13 bp, Homo sapiens
gcgctctgcccct

SEQ ID NO: 5486342 - DNA, 15 bp, Homo sapiens
gcgctctgcccctcc

SEQ ID NO: 5486343 - DNA, 13 bp, Homo sapiens
gcgctctggacag

SEQ ID NO: 5486344 - DNA, 23 bp, Homo sapiens
gcgctctgtggatgccagggccg

SEQ ID NO: 5486345 - DNA, 21 bp, Homo sapiens
gcgctcttgggaccccagaga

SEQ ID NO: 5486346 - DNA, 20 bp, Homo sapiens
gcgctcttggtccctggtcc

SEQ ID NO: 5486347 - DNA, 11 bp, Homo sapiens
gcgctgcaaat

SEQ ID NO: 5486348 - DNA, 13 bp, Homo sapiens
gcgctgcagcctc

SEQ ID NO: 5486349 - DNA, 22 bp, Homo sapiens
gcgctgcaggtacttcctcctg

SEQ ID NO: 5486350 - DNA, 20 bp, Homo sapiens
gcgctgcatacaggggaggg

SEQ ID NO: 5486351 - DNA, 23 bp, Homo sapiens
gcgctgcatacaggggaggggcg

SEQ ID NO: 5486352 - DNA, 19 bp, Homo sapiens
gcgctgcccacctgccggc

SEQ ID NO: 5486353 - DNA, 14 bp, Homo sapiens
gcgctgcccccaca

SEQ ID NO: 5486354 - DNA, 17 bp, Homo sapiens
gcgctgccccctcccca

SEQ ID NO: 5486355 - DNA, 17 bp, Homo sapiens
gcgctgcccctggcagc

SEQ ID NO: 5486356 - DNA, 21 bp, Homo sapiens
gcgctgcccctggcagcccct

SEQ ID NO: 5486357 - DNA, 11 bp, Homo sapiens
gcgctgccctg

SEQ ID NO: 5486358 - DNA, 13 bp, Homo sapiens
gcgctgccctgtg

SEQ ID NO: 5486359 - DNA, 22 bp, Homo sapiens
gcgctgccctgtgagagccacg

SEQ ID NO: 5486360 - DNA, 17 bp, Homo sapiens
gcgctgcctcaggcact

SEQ ID NO: 5486361 - DNA, 14 bp, Homo sapiens
gcgctgcctggcca

SEQ ID NO: 5486362 - DNA, 10 bp, Homo sapiens
gcgctgctaa

SEQ ID NO: 5486363 - DNA, 21 bp, Homo sapiens
gcgctgctcaacctctctcct

SEQ ID NO: 5486364 - DNA, 14 bp, Homo sapiens
gcgctgctggtgtt

SEQ ID NO: 5486365 - DNA, 23 bp, Homo sapiens
gcgctggaatccagaaggaagct

SEQ ID NO: 5486366 - DNA, 23 bp, Homo sapiens
gcgctggacacctacagcagcac

SEQ ID NO: 5486367 - DNA, 18 bp, Homo sapiens
gcgctggcagcgctcctg

SEQ ID NO: 5486368 - DNA, 15 bp, Homo sapiens
gcgctggcccagccg

SEQ ID NO: 5486369 - DNA, 14 bp, Homo sapiens
gcgctggctcagga

SEQ ID NO: 5486370 - DNA, 15 bp, Homo sapiens
gcgctggctcaggaa

SEQ ID NO: 5486371 - DNA, 17 bp, Homo sapiens
gcgctggctcaggaaga

SEQ ID NO: 5486372 - DNA, 21 bp, Homo sapiens
gcgctggctcaggaagaaacc

SEQ ID NO: 5486373 - DNA, 15 bp, Homo sapiens
gcgctggctccaggc

SEQ ID NO: 5486374 - DNA, 12 bp, Homo sapiens
gcgctgggaagg

SEQ ID NO: 5486375 - DNA, 18 bp, Homo sapiens
gcgctgggcacttccctg

SEQ ID NO: 5486376 - DNA, 17 bp, Homo sapiens
gcgctggtcctttcttc

SEQ ID NO: 5486377 - DNA, 22 bp, Homo sapiens
gcgctggtgcattctgtttcct

SEQ ID NO: 5486378 - DNA, 18 bp, Homo sapiens
gcgctgtatttacagaca

SEQ ID NO: 5486379 - DNA, 23 bp, Homo sapiens
gcgctgtcaggattgcgagagat

SEQ ID NO: 5486380 - DNA, 14 bp, Homo sapiens
gcgctgtcctgcgt

SEQ ID NO: 5486381 - DNA, 23 bp, Homo sapiens
gcgctgtcggtgtttggaggctg

SEQ ID NO: 5486382 - DNA, 17 bp, Homo sapiens
gcgctgtgctccagcag

SEQ ID NO: 5486383 - DNA, 13 bp, Homo sapiens
gcgctgtgctggt

SEQ ID NO: 5486384 - DNA, 20 bp, Homo sapiens
gcgctgtggctcctgccttg

SEQ ID NO: 5486385 - DNA, 22 bp, Homo sapiens
gcgctgttgattgtgttttcct

SEQ ID NO: 5486386 - DNA, 13 bp, Homo sapiens
gcgctgttgcccg

SEQ ID NO: 5486387 - DNA, 18 bp, Homo sapiens
gcgctgtttttgttgtgt

SEQ ID NO: 5486388 - DNA, 21 bp, Homo sapiens
gcgcttcacttgggtccaggc

SEQ ID NO: 5486389 - DNA, 15 bp, Homo sapiens
gcgcttcccacctgc

SEQ ID NO: 5486390 - DNA, 13 bp, Homo sapiens
gcgcttccctggg

SEQ ID NO: 5486391 - DNA, 13 bp, Homo sapiens
gcgcttcctgagc

SEQ ID NO: 5486392 - DNA, 17 bp, Homo sapiens
gcgcttctgcagcctcg

SEQ ID NO: 5486393 - DNA, 13 bp, Homo sapiens
gcgcttgctggcc

SEQ ID NO: 5486394 - DNA, 19 bp, Homo sapiens
gcgcttgggaggggccgga

SEQ ID NO: 5486395 - DNA, 13 bp, Homo sapiens
gcgcttgggcgcc

SEQ ID NO: 5486396 - DNA, 22 bp, Homo sapiens
gcgcttgggcgccgtgctgggc

SEQ ID NO: 5486397 - DNA, 23 bp, Homo sapiens
gcgcttgggcgccgtgctgggca

SEQ ID NO: 5486398 - DNA, 16 bp, Homo sapiens
gcgctttcccctcctc

SEQ ID NO: 5486399 - DNA, 22 bp, Homo sapiens
gcgctttctggaaaagaggagt

SEQ ID NO: 5486400 - DNA, 16 bp, Homo sapiens
gcgctttgaacgtgcc

SEQ ID NO: 5486401 - DNA, 20 bp, Homo sapiens
gcgctttgaacgtgccagca

SEQ ID NO: 5486402 - DNA, 22 bp, Homo sapiens
gcgctttgaacgtgccagcagc

SEQ ID NO: 5486403 - DNA, 23 bp, Homo sapiens
gcgctttgcttaccaaaagctca

SEQ ID NO: 5486404 - DNA, 16 bp, Homo sapiens
gcggaaaccttgcagc

SEQ ID NO: 5486405 - DNA, 19 bp, Homo sapiens
gcggaaaccttgcagcatt

SEQ ID NO: 5486406 - DNA, 16 bp, Homo sapiens
gcggaaaggagatggg

SEQ ID NO: 5486407 - DNA, 20 bp, Homo sapiens
gcggaacaaggagtcagaca

SEQ ID NO: 5486408 - DNA, 17 bp, Homo sapiens
gcggaacaggagtgact

SEQ ID NO: 5486409 - DNA, 16 bp, Homo sapiens
gcggaacctggctgcg

SEQ ID NO: 5486410 - DNA, 19 bp, Homo sapiens
gcggaactatgaaaagtgg

SEQ ID NO: 5486411 - DNA, 15 bp, Homo sapiens
gcggaagagttacaa

SEQ ID NO: 5486412 - DNA, 22 bp, Homo sapiens
gcggaagagttacaataaagtt

SEQ ID NO: 5486413 - DNA, 12 bp, Homo sapiens
gcggaagccata

SEQ ID NO: 5486414 - DNA, 13 bp, Homo sapiens
gcggaagccatag

SEQ ID NO: 5486415 - DNA, 18 bp, Homo sapiens
gcggaagccatagggggc

SEQ ID NO: 5486416 - DNA, 23 bp, Homo sapiens
gcggaagccatagggggctgcac

SEQ ID NO: 5486417 - DNA, 12 bp, Homo sapiens
gcggaaggaggt

SEQ ID NO: 5486418 - DNA, 19 bp, Homo sapiens
gcggaatgaaccacatctt

SEQ ID NO: 5486419 - DNA, 13 bp, Homo sapiens
gcggctggatggg

SEQ ID NO: 5486420 - DNA, 20 bp, Homo sapiens
gcggctggatgggggctctg

SEQ ID NO: 5486421 - DNA, 18 bp, Homo sapiens
gcggctggccatggagaa

SEQ ID NO: 5486422 - DNA, 13 bp, Homo sapiens
gcggctggctctg

SEQ ID NO: 5486423 - DNA, 17 bp, Homo sapiens
gcggctgggaggagggc

SEQ ID NO: 5486424 - DNA, 19 bp, Homo sapiens
gcggctggggtcccagcag

SEQ ID NO: 5486425 - DNA, 21 bp, Homo sapiens
gcggctggggtcccagcagct

SEQ ID NO: 5486426 - DNA, 14 bp, Homo sapiens
gcggctgttccccc

SEQ ID NO: 5486427 - DNA, 17 bp, Homo sapiens
gcggcttagccaagccc

SEQ ID NO: 5486428 - DNA, 18 bp, Homo sapiens
gcggcttagccaagccct

SEQ ID NO: 5486429 - DNA, 14 bp, Homo sapiens
gcggcttccctgcg

SEQ ID NO: 5486430 - DNA, 19 bp, Homo sapiens
gcggcttcctgtccactct

SEQ ID NO: 5486431 - DNA, 14 bp, Homo sapiens
gcggcttggccgcc

SEQ ID NO: 5486432 - DNA, 19 bp, Homo sapiens
gcggctttctctgcctctg

SEQ ID NO: 5486433 - DNA, 20 bp, Homo sapiens
gcggctttctctgcctctgg

SEQ ID NO: 5486434 - DNA, 17 bp, Homo sapiens
gcgggaagggtgggccc

SEQ ID NO: 5486435 - DNA, 22 bp, Homo sapiens
gcgggaagggtgggccctggag

SEQ ID NO: 5486436 - DNA, 19 bp, Homo sapiens
gcgggaatattgtttcttt

SEQ ID NO: 5486437 - DNA, 16 bp, Homo sapiens
gcgggaatgagctgtg

SEQ ID NO: 5486438 - DNA, 17 bp, Homo sapiens
gcgggacagcggccccg

SEQ ID NO: 5486439 - DNA, 14 bp, Homo sapiens
gcgggacctgtggc

SEQ ID NO: 5486440 - DNA, 23 bp, Homo sapiens
gcgggacgagaccctacaggaga

SEQ ID NO: 5486441 - DNA, 13 bp, Homo sapiens
gcgggagacccct

SEQ ID NO: 5486442 - DNA, 20 bp, Homo sapiens
gcgggagagagtgagagaga

SEQ ID NO: 5486443 - DNA, 16 bp, Homo sapiens
gcgggagccagactgt

SEQ ID NO: 5486444 - DNA, 20 bp, Homo sapiens
gcgggagccagactgtccag

SEQ ID NO: 5486445 - DNA, 14 bp, Homo sapiens
gcgggagcctccct

SEQ ID NO: 5486446 - DNA, 21 bp, Homo sapiens
gcgggagcggtggccctgtcc

SEQ ID NO: 5486447 - DNA, 22 bp, Homo sapiens
gcgggaggatgttctgggacac

SEQ ID NO: 5486448 - DNA, 13 bp, Homo sapiens
gcgggaggcacca

SEQ ID NO: 5486449 - DNA, 14 bp, Homo sapiens
gcgggaggccctgg

SEQ ID NO: 5486450 - DNA, 13 bp, Homo sapiens
gcgggaggctggg

SEQ ID NO: 5486451 - DNA, 23 bp, Homo sapiens
gcgggagtctcctcactgccact

SEQ ID NO: 5486452 - DNA, 18 bp, Homo sapiens
gcgggagtgtgggggtgc

SEQ ID NO: 5486453 - DNA, 23 bp, Homo sapiens
gcgggatcccagcatctcagagt

SEQ ID NO: 5486454 - DNA, 18 bp, Homo sapiens
gcgggatcctccacagag

SEQ ID NO: 5486455 - DNA, 21 bp, Homo sapiens
gcgggatcctccacagagagg

SEQ ID NO: 5486456 - DNA, 18 bp, Homo sapiens
gcgggcaagcgtgctgcc

SEQ ID NO: 5486457 - DNA, 22 bp, Homo sapiens
gcgggcacacctcctcccactg

SEQ ID NO: 5486458 - DNA, 17 bp, Homo sapiens
gcgggcacctgtagtcc

SEQ ID NO: 5486459 - DNA, 16 bp, Homo sapiens
gcgggcagagggctgg

SEQ ID NO: 5486460 - DNA, 16 bp, Homo sapiens
gcgggcagcacagcaa

SEQ ID NO: 5486461 - DNA, 21 bp, Homo sapiens
gcgggcagcaccctccgaccc

SEQ ID NO: 5486462 - DNA, 10 bp, Homo sapiens
gcgggcagcc

SEQ ID NO: 5486463 - DNA, 13 bp, Homo sapiens
gcgggcagccagg

SEQ ID NO: 5486464 - DNA, 17 bp, Homo sapiens
gcgggcagccaggctgg

SEQ ID NO: 5486465 - DNA, 12 bp, Homo sapiens
gcgggcagcccc

SEQ ID NO: 5486466 - DNA, 13 bp, Homo sapiens
gcgggcagcccct

SEQ ID NO: 5486467 - DNA, 14 bp, Homo sapiens
gcgggcagcccctg

SEQ ID NO: 5486468 - DNA, 17 bp, Homo sapiens
gcgggcagcgggccagg

SEQ ID NO: 5486469 - DNA, 18 bp, Homo sapiens
gcgggcagcgggccaggc

SEQ ID NO: 5486470 - DNA, 19 bp, Homo sapiens
gcgggcagcgggccaggcc

SEQ ID NO: 5486471 - DNA, 14 bp, Homo sapiens
gcgggcagggccgc

SEQ ID NO: 5486472 - DNA, 18 bp, Homo sapiens
gcgggcaggttctgcctg

SEQ ID NO: 5486473 - DNA, 20 bp, Homo sapiens
gcgggcagtcgctgcaggga

SEQ ID NO: 5486474 - DNA, 13 bp, Homo sapiens
gcgggccacaggg

SEQ ID NO: 5486475 - DNA, 16 bp, Homo sapiens
gcgggccagccaggcg

SEQ ID NO: 5486476 - DNA, 12 bp, Homo sapiens
gcgggccaggag

SEQ ID NO: 5486477 - DNA, 13 bp, Homo sapiens
gcgggccaggaga

SEQ ID NO: 5486478 - DNA, 20 bp, Homo sapiens
gcgggccaggaggctgccac

SEQ ID NO: 5486479 - DNA, 11 bp, Homo sapiens
gcgggccaggc

SEQ ID NO: 5486480 - DNA, 14 bp, Homo sapiens
gcgggccaggcagg

SEQ ID NO: 5486481 - DNA, 14 bp, Homo sapiens
gcgggccaggcccg

SEQ ID NO: 5486482 - DNA, 23 bp, Homo sapiens
gcgggccaggcccgcaccccggc

SEQ ID NO: 5486483 - DNA, 12 bp, Homo sapiens
gcgggccagggt

SEQ ID NO: 5486484 - DNA, 14 bp, Homo sapiens
gcgggccagggtcc

SEQ ID NO: 5486485 - DNA, 16 bp, Homo sapiens
gcgggccagggtcctg

SEQ ID NO: 5486486 - DNA, 19 bp, Homo sapiens
gcgggccagggtgggaaga

SEQ ID NO: 5486487 - DNA, 15 bp, Homo sapiens
gcgggcccaggccta

SEQ ID NO: 5486488 - DNA, 15 bp, Homo sapiens
gcgggcccctggtga

SEQ ID NO: 5486489 - DNA, 13 bp, Homo sapiens
gcgggccctgcct

SEQ ID NO: 5486490 - DNA, 14 bp, Homo sapiens
gcgggccctgcctg

SEQ ID NO: 5486491 - DNA, 15 bp, Homo sapiens
gcgggccctgcctga

SEQ ID NO: 5486492 - DNA, 22 bp, Homo sapiens
gcgggccctgcctgagggtggg

SEQ ID NO: 5486493 - DNA, 11 bp, Homo sapiens
gcgggcctctt

SEQ ID NO: 5486494 - DNA, 18 bp, Homo sapiens
gcgggcctcttccctcag

SEQ ID NO: 5486495 - DNA, 22 bp, Homo sapiens
gcgggcctgtttggtgaggacc

SEQ ID NO: 5486496 - DNA, 19 bp, Homo sapiens
gcgggcgaatcacgaggtc

SEQ ID NO: 5486497 - DNA, 17 bp, Homo sapiens
gcgggcgcactgcctct

SEQ ID NO: 5486498 - DNA, 14 bp, Homo sapiens
gcgggcgcgggaca

SEQ ID NO: 5486499 - DNA, 14 bp, Homo sapiens
gcgggcgctgctgg

SEQ ID NO: 5486500 - DNA, 21 bp, Homo sapiens
gcgggcggaggcggctccagg

SEQ ID NO: 5486501 - DNA, 16 bp, Homo sapiens
gcgggcggccaggcaa

SEQ ID NO: 5486502 - DNA, 19 bp, Homo sapiens
gcgggcggctgggtctgtg

SEQ ID NO: 5486503 - DNA, 20 bp, Homo sapiens
gcgggctaacgggaggctgg

SEQ ID NO: 5486504 - DNA, 21 bp, Homo sapiens
gcgggctaacgggaggctggg

SEQ ID NO: 5486505 - DNA, 12 bp, Homo sapiens
gcgggctcagag

SEQ ID NO: 5486506 - DNA, 14 bp, Homo sapiens
gcgggctcagagct

SEQ ID NO: 5486507 - DNA, 13 bp, Homo sapiens
gcgggctccctcc

SEQ ID NO: 5486508 - DNA, 17 bp, Homo sapiens
gcgggctccctggcagg

SEQ ID NO: 5486509 - DNA, 17 bp, Homo sapiens
gcgggctgactgggcca

SEQ ID NO: 5486510 - DNA, 16 bp, Homo sapiens
gcgggctgagggcatc

SEQ ID NO: 5486511 - DNA, 14 bp, Homo sapiens
gcgggctgggcagc

SEQ ID NO: 5486512 - DNA, 19 bp, Homo sapiens
gcgggctgggggtagcctg

SEQ ID NO: 5486513 - DNA, 20 bp, Homo sapiens
gcgggctgggggtagcctgg

SEQ ID NO: 5486514 - DNA, 17 bp, Homo sapiens
gcgggctgtgcccggcc

SEQ ID NO: 5486515 - DNA, 24 bp, Homo sapiens
gcggggacaccgggaagtgcagcg

SEQ ID NO: 5486516 - DNA, 14 bp, Homo sapiens
gcggggaccttggt

SEQ ID NO: 5486517 - DNA, 14 bp, Homo sapiens
gcggggaggaggaa

SEQ ID NO: 5486518 - DNA, 16 bp, Homo sapiens
gcggggaggaggagct

SEQ ID NO: 5486519 - DNA, 14 bp, Homo sapiens
gcggggcagagcca

SEQ ID NO: 5486520 - DNA, 15 bp, Homo sapiens
gcggggcagagccac

SEQ ID NO: 5486521 - DNA, 14 bp, Homo sapiens
gcggggcagcaggg

SEQ ID NO: 5486522 - DNA, 12 bp, Homo sapiens
gcggggcaggag

SEQ ID NO: 5486523 - DNA, 20 bp, Homo sapiens
gcggggcaggaggcctggcc

SEQ ID NO: 5486524 - DNA, 16 bp, Homo sapiens
gcggggcagtatgtga

SEQ ID NO: 5486525 - DNA, 23 bp, Homo sapiens
gcggggcccagcgctctcctgga

SEQ ID NO: 5486526 - DNA, 21 bp, Homo sapiens
gcggggcccaggcagcctccg

SEQ ID NO: 5486527 - DNA, 19 bp, Homo sapiens
gcggggcctgaggcaagcc

SEQ ID NO: 5486528 - DNA, 13 bp, Homo sapiens
gcggggcctgcag

SEQ ID NO: 5486529 - DNA, 14 bp, Homo sapiens
gcggggcctgcagg

SEQ ID NO: 5486530 - DNA, 18 bp, Homo sapiens
gcggggcctgcaggccag

SEQ ID NO: 5486531 - DNA, 19 bp, Homo sapiens
gcggggcctgcaggccagt

SEQ ID NO: 5486532 - DNA, 23 bp, Homo sapiens
gcggggcctgcaggccagtccca

SEQ ID NO: 5486533 - DNA, 12 bp, Homo sapiens
gcggggccttgc

SEQ ID NO: 5486534 - DNA, 20 bp, Homo sapiens
gcggggcgaagcccaggccc

SEQ ID NO: 5486535 - DNA, 18 bp, Homo sapiens
gcggggctcgaggctggt

SEQ ID NO: 5486536 - DNA, 14 bp, Homo sapiens
gcggggctctagga

SEQ ID NO: 5486537 - DNA, 17 bp, Homo sapiens
gcggggctggaggtggc

SEQ ID NO: 5486538 - DNA, 14 bp, Homo sapiens
gcggggctgtcacc

SEQ ID NO: 5486539 - DNA, 11 bp, Homo sapiens
gcggggcttct

SEQ ID NO: 5486540 - DNA, 17 bp, Homo sapiens
gcggggcttctcttggg

SEQ ID NO: 5486541 - DNA, 14 bp, Homo sapiens
gcggggcttctggg

SEQ ID NO: 5486542 - DNA, 22 bp, Homo sapiens
gcggggcttctgggtggctcct

SEQ ID NO: 5486543 - DNA, 23 bp, Homo sapiens
gcggggcttctgggtggctcctg

SEQ ID NO: 5486544 - DNA, 18 bp, Homo sapiens
gcggggcttttaaaagga

SEQ ID NO: 5486545 - DNA, 16 bp, Homo sapiens
gcgggggagcaggcag

SEQ ID NO: 5486546 - DNA, 20 bp, Homo sapiens
gcgggggagccaacagcagc

SEQ ID NO: 5486547 - DNA, 14 bp, Homo sapiens
gcgggggagcctgg

SEQ ID NO: 5486548 - DNA, 16 bp, Homo sapiens
gcgggggagcctggag

SEQ ID NO: 5486549 - DNA, 14 bp, Homo sapiens
gcgggggagctgga

SEQ ID NO: 5486550 - DNA, 14 bp, Homo sapiens
gcgggggcaggccg

SEQ ID NO: 5486551 - DNA, 22 bp, Homo sapiens
gcgggggcaggccgggcctgct

SEQ ID NO: 5486552 - DNA, 16 bp, Homo sapiens
gcgggggcggaggagg

SEQ ID NO: 5486553 - DNA, 20 bp, Homo sapiens
gcgggggctaactggcccca

SEQ ID NO: 5486554 - DNA, 23 bp, Homo sapiens
gcgggggctaactggccccaggc

SEQ ID NO: 5486555 - DNA, 13 bp, Homo sapiens
gcggggggaggga

SEQ ID NO: 5486556 - DNA, 21 bp, Homo sapiens
gcggggggggcgcctggagag

SEQ ID NO: 5486557 - DNA, 23 bp, Homo sapiens
gcggggggtgtcttccctgcctg

SEQ ID NO: 5486558 - DNA, 23 bp, Homo sapiens
gcgggggttccgtgtccaccccc

SEQ ID NO: 5486559 - DNA, 16 bp, Homo sapiens
gcggggtcccctctgt

SEQ ID NO: 5486560 - DNA, 17 bp, Homo sapiens
gcggggtctgctcctgg

SEQ ID NO: 5486561 - DNA, 13 bp, Homo sapiens
gcggggtgcagaa

SEQ ID NO: 5486562 - DNA, 14 bp, Homo sapiens
gcggggtgcctgct

SEQ ID NO: 5486563 - DNA, 15 bp, Homo sapiens
gcggggtgcctgctg

SEQ ID NO: 5486564 - DNA, 14 bp, Homo sapiens
gcggggtgctgtgg

SEQ ID NO: 5486565 - DNA, 22 bp, Homo sapiens
gcggggttagagccaagctgca

SEQ ID NO: 5486566 - DNA, 22 bp, Homo sapiens
gcgggtaaaaaacctgggttag

SEQ ID NO: 5486567 - DNA, 18 bp, Homo sapiens
gcgggtaaaaagagaagg

SEQ ID NO: 5486568 - DNA, 19 bp, Homo sapiens
gcgggtaaaaagagaaggc

SEQ ID NO: 5486569 - DNA, 22 bp, Homo sapiens
gcgggtacttatttctcagctg

SEQ ID NO: 5486570 - DNA, 18 bp, Homo sapiens
gcgggtagatgccggcag

SEQ ID NO: 5486571 - DNA, 22 bp, Homo sapiens
gcgggtccacttgccagggctc

SEQ ID NO: 5486572 - DNA, 15 bp, Homo sapiens
gcgggtcctagctgt

SEQ ID NO: 5486573 - DNA, 17 bp, Homo sapiens
gcgggtcctcagctgct

SEQ ID NO: 5486574 - DNA, 14 bp, Homo sapiens
gcgggtctgaagga

SEQ ID NO: 5486575 - DNA, 17 bp, Homo sapiens
gcgggtgacgcccacct

SEQ ID NO: 5486576 - DNA, 19 bp, Homo sapiens
gcgggtggatcacaaggtc

SEQ ID NO: 5486577 - DNA, 19 bp, Homo sapiens
gcgggtggatcacgaggtc

SEQ ID NO: 5486578 - DNA, 13 bp, Homo sapiens
gcgggtggctgca

SEQ ID NO: 5486579 - DNA, 15 bp, Homo sapiens
gcgggtggctgcaag

SEQ ID NO: 5486580 - DNA, 18 bp, Homo sapiens
gcgggtggctggagcccc

SEQ ID NO: 5486581 - DNA, 22 bp, Homo sapiens
gcgggtgggactcttccctggg

SEQ ID NO: 5486582 - DNA, 15 bp, Homo sapiens
gcgggtgggggtgga

SEQ ID NO: 5486583 - DNA, 20 bp, Homo sapiens
gcgggtgtggagaccaggct

SEQ ID NO: 5486584 - DNA, 17 bp, Homo sapiens
gcgggttccgcaggcag

SEQ ID NO: 5486585 - DNA, 15 bp, Homo sapiens
gcggtaggtgctggc

SEQ ID NO: 5486586 - DNA, 16 bp, Homo sapiens
gcggtaggtgctggcc

SEQ ID NO: 5486587 - DNA, 13 bp, Homo sapiens
gcggtatccagag

SEQ ID NO: 5486588 - DNA, 21 bp, Homo sapiens
gcggtcaataattgtggagag

SEQ ID NO: 5486589 - DNA, 23 bp, Homo sapiens
gcggtcaataattgtggagagga

SEQ ID NO: 5486590 - DNA, 15 bp, Homo sapiens
gcggtcactgcccac

SEQ ID NO: 5486591 - DNA, 22 bp, Homo sapiens
gcggtcactgcccacctgccag

SEQ ID NO: 5486592 - DNA, 23 bp, Homo sapiens
gcggtcactgcccacctgccagg

SEQ ID NO: 5486593 - DNA, 15 bp, Homo sapiens
gcggtcagactggag

SEQ ID NO: 5486594 - DNA, 16 bp, Homo sapiens
gcggtcagactggagg

SEQ ID NO: 5486595 - DNA, 21 bp, Homo sapiens
gcggtcaggctgggcagcccc

SEQ ID NO: 5486596 - DNA, 13 bp, Homo sapiens
gcggtcatgtgtg

SEQ ID NO: 5486597 - DNA, 22 bp, Homo sapiens
gcggtcatgtgtgcatgtgagc

SEQ ID NO: 5486598 - DNA, 21 bp, Homo sapiens
gcgtggaactcgtgtctggca

SEQ ID NO: 5486599 - DNA, 14 bp, Homo sapiens
gcgtggaaggggga

SEQ ID NO: 5486600 - DNA, 15 bp, Homo sapiens
gcgtggaagggggag

SEQ ID NO: 5486601 - DNA, 17 bp, Homo sapiens
gcgtggaagggggagga

SEQ ID NO: 5486602 - DNA, 16 bp, Homo sapiens
gcgtggaagtgttcct

SEQ ID NO: 5486603 - DNA, 22 bp, Homo sapiens
gcgtggaccacccgccctggca

SEQ ID NO: 5486604 - DNA, 14 bp, Homo sapiens
gcgtggactctgca

SEQ ID NO: 5486605 - DNA, 17 bp, Homo sapiens
gcgtggactctgcacat

SEQ ID NO: 5486606 - DNA, 15 bp, Homo sapiens
gcgtggactggttgg

SEQ ID NO: 5486607 - DNA, 21 bp, Homo sapiens
gcgtggagactggcaggcggg

SEQ ID NO: 5486608 - DNA, 13 bp, Homo sapiens
gcgtggaggagag

SEQ ID NO: 5486609 - DNA, 17 bp, Homo sapiens
gcgtggaggagaggaga

SEQ ID NO: 5486610 - DNA, 21 bp, Homo sapiens
gcgtggagggaggccccaggg

SEQ ID NO: 5486611 - DNA, 22 bp, Homo sapiens
gcgtggagggaggccccagggg

SEQ ID NO: 5486612 - DNA, 22 bp, Homo sapiens
gcgtggaggggtaggggctggg

SEQ ID NO: 5486613 - DNA, 20 bp, Homo sapiens
gcgtggattaaacttatgaa

SEQ ID NO: 5486614 - DNA, 22 bp, Homo sapiens
gcgtggccacgggggcagtgtg

SEQ ID NO: 5486615 - DNA, 17 bp, Homo sapiens
gcgtggcccaccaggcc

SEQ ID NO: 5486616 - DNA, 22 bp, Homo sapiens
gcgtggcccaccaggcccccct

SEQ ID NO: 5486617 - DNA, 17 bp, Homo sapiens
gcgtggcccaggccggg

SEQ ID NO: 5486618 - DNA, 12 bp, Homo sapiens
gcgtggcctccc

SEQ ID NO: 5486619 - DNA, 22 bp, Homo sapiens
gcgtggcctgcataggctcctt

SEQ ID NO: 5486620 - DNA, 17 bp, Homo sapiens
gcgtggcctggggctgc

SEQ ID NO: 5486621 - DNA, 14 bp, Homo sapiens
gcgtggccttggga

SEQ ID NO: 5486622 - DNA, 23 bp, Homo sapiens
gcgtggctctgggtgggcggggc

SEQ ID NO: 5486623 - DNA, 13 bp, Homo sapiens
gcgtggctgtggc

SEQ ID NO: 5486624 - DNA, 13 bp, Homo sapiens
gcgtggcttctgc

SEQ ID NO: 5486625 - DNA, 16 bp, Homo sapiens
gcgtggcttctgcagg

SEQ ID NO: 5486626 - DNA, 15 bp, Homo sapiens
gcgtgggagccagcc

SEQ ID NO: 5486627 - DNA, 12 bp, Homo sapiens
gcgtgggcagag

SEQ ID NO: 5486628 - DNA, 15 bp, Homo sapiens
gcgtgggcagaggaa

SEQ ID NO: 5486629 - DNA, 13 bp, Homo sapiens
gcgtgggctctgc

SEQ ID NO: 5486630 - DNA, 15 bp, Homo sapiens
gcgtgggctctgcca

SEQ ID NO: 5486631 - DNA, 19 bp, Homo sapiens
gcgtggggaatgggcaggt

SEQ ID NO: 5486632 - DNA, 17 bp, Homo sapiens
gcgtggggacagggctc

SEQ ID NO: 5486633 - DNA, 18 bp, Homo sapiens
gcgtggggaggggctgag

SEQ ID NO: 5486634 - DNA, 20 bp, Homo sapiens
gcgtggggaggggctgagga

SEQ ID NO: 5486635 - DNA, 16 bp, Homo sapiens
gcgtggggcagcagct

SEQ ID NO: 5486636 - DNA, 14 bp, Homo sapiens
gcgtgggtcagaag

SEQ ID NO: 5486637 - DNA, 13 bp, Homo sapiens
gcgtgggtctctg

SEQ ID NO: 5486638 - DNA, 13 bp, Homo sapiens
gcgtggtgcgagt

SEQ ID NO: 5486639 - DNA, 23 bp, Homo sapiens
gcgtggtggcgggcacctgtagt

SEQ ID NO: 5486640 - DNA, 16 bp, Homo sapiens
gcgtggtggctcatgc

SEQ ID NO: 5486641 - DNA, 16 bp, Homo sapiens
gcgtggtggtccctgg

SEQ ID NO: 5486642 - DNA, 20 bp, Homo sapiens
gcgtggtgtgtccctggaca

SEQ ID NO: 5486643 - DNA, 22 bp, Homo sapiens
gcgtggtgtgtccctggacaca

SEQ ID NO: 5486644 - DNA, 23 bp, Homo sapiens
gcgtggtgtgtccctggacacag

SEQ ID NO: 5486645 - DNA, 19 bp, Homo sapiens
gcgtgtagcgtcctgagga

SEQ ID NO: 5486646 - DNA, 20 bp, Homo sapiens
gcgtgtagcgtcctgaggaa

SEQ ID NO: 5486647 - DNA, 15 bp, Homo sapiens
gcgtgtccctcctct

SEQ ID NO: 5486648 - DNA, 21 bp, Homo sapiens
gcgtgtccctcctcttcctgt

SEQ ID NO: 5486649 - DNA, 19 bp, Homo sapiens
gcgtgtcgtgggtgtgtgt

SEQ ID NO: 5486650 - DNA, 17 bp, Homo sapiens
gcgtgtctcatttgcca

SEQ ID NO: 5486651 - DNA, 16 bp, Homo sapiens
gcgtgtgcaggccgac

SEQ ID NO: 5486652 - DNA, 13 bp, Homo sapiens
gcgtgtgcagtgc

SEQ ID NO: 5486653 - DNA, 21 bp, Homo sapiens
gcgtgtgcatagcgtcctgcc

SEQ ID NO: 5486654 - DNA, 14 bp, Homo sapiens
gcgtgtgccaggca

SEQ ID NO: 5486655 - DNA, 16 bp, Homo sapiens
gcgtgtgcgtgcgtgt

SEQ ID NO: 5486656 - DNA, 18 bp, Homo sapiens
gcgtgtgctcctctcctt

SEQ ID NO: 5486657 - DNA, 14 bp, Homo sapiens
gcgtgtggcagcca

SEQ ID NO: 5486658 - DNA, 15 bp, Homo sapiens
gcgtgtggccctgtg

SEQ ID NO: 5486659 - DNA, 23 bp, Homo sapiens
gcgtgtgggaggctggggaccca

SEQ ID NO: 5486660 - DNA, 22 bp, Homo sapiens
gcgtgtgggtcccgcactctgc

SEQ ID NO: 5486661 - DNA, 13 bp, Homo sapiens
gcgtgtgtacaca

SEQ ID NO: 5486662 - DNA, 12 bp, Homo sapiens
gcgtgtgtagag

SEQ ID NO: 5486663 - DNA, 17 bp, Homo sapiens
gcgtgtgtccatgtgtg

SEQ ID NO: 5486664 - DNA, 18 bp, Homo sapiens
gcgtgtgtccatgtgtgt

SEQ ID NO: 5486665 - DNA, 13 bp, Homo sapiens
gcgtgtgtgacac

SEQ ID NO: 5486666 - DNA, 14 bp, Homo sapiens
gcgtgtgtggccta

SEQ ID NO: 5486667 - DNA, 16 bp, Homo sapiens
gcgtgtgtgggtggat

SEQ ID NO: 5486668 - DNA, 22 bp, Homo sapiens
gcgtgttagtgtgtgtgcatgt

SEQ ID NO: 5486669 - DNA, 15 bp, Homo sapiens
gcgtgttcagcagaa

SEQ ID NO: 5486670 - DNA, 22 bp, Homo sapiens
gcgtgttccagccaaagcatgc

SEQ ID NO: 5486671 - DNA, 22 bp, Homo sapiens
gcgttaaaggctcgattttgta

SEQ ID NO: 5486672 - DNA, 20 bp, Homo sapiens
gcgttaacacagtaaaatat

SEQ ID NO: 5486673 - DNA, 16 bp, Homo sapiens
gcgttaagggcagagt

SEQ ID NO: 5486674 - DNA, 18 bp, Homo sapiens
gcgttagaatgaggagga

SEQ ID NO: 5486675 - DNA, 22 bp, Homo sapiens
gcgttagaatgaggaggaagga

SEQ ID NO: 5486676 - DNA, 14 bp, Homo sapiens
gcgttagggctgct

SEQ ID NO: 5486677 - DNA, 18 bp, Homo sapiens
gcgttatgaagagctaat

SEQ ID NO: 5486678 - DNA, 22 bp, Homo sapiens
gcgttatggcagcccggctgct

SEQ ID NO: 5486679 - DNA, 22 bp, Homo sapiens
gcgttattggtcggcagccttc

SEQ ID NO: 5486680 - DNA, 19 bp, Homo sapiens
gcgttatttatggaccact

SEQ ID NO: 5486681 - DNA, 13 bp, Homo sapiens
gcgttcagcccct

SEQ ID NO: 5486682 - DNA, 22 bp, Homo sapiens
gcgttcatggaacgcgttgaaa

SEQ ID NO: 5486683 - DNA, 18 bp, Homo sapiens
gcgttccatgatgctggg

SEQ ID NO: 5486684 - DNA, 14 bp, Homo sapiens
gcgttcccagcagg

SEQ ID NO: 5486685 - DNA, 13 bp, Homo sapiens
gcgttcccttctc

SEQ ID NO: 5486686 - DNA, 16 bp, Homo sapiens
gcgttctcccaaagat

SEQ ID NO: 5486687 - DNA, 23 bp, Homo sapiens
gcgttctcctatctaccttcctt

SEQ ID NO: 5486688 - DNA, 16 bp, Homo sapiens
gcgttctcctgcttgt

SEQ ID NO: 5486689 - DNA, 23 bp, Homo sapiens
gcgttcttaggctgctgggatgg

SEQ ID NO: 5486690 - DNA, 14 bp, Homo sapiens
gcgttcttgtaatt

SEQ ID NO: 5486691 - DNA, 18 bp, Homo sapiens
gcgttgaaattgtaatta

SEQ ID NO: 5486692 - DNA, 16 bp, Homo sapiens
gcgttgcctgtcgctt

SEQ ID NO: 5486693 - DNA, 14 bp, Homo sapiens
gcgttggaattaaa

SEQ ID NO: 5486694 - DNA, 14 bp, Homo sapiens
gcgttggtgccact

SEQ ID NO: 5486695 - DNA, 15 bp, Homo sapiens
gcgttggtgccactt

SEQ ID NO: 5486696 - DNA, 23 bp, Homo sapiens
gcgttggtgccacttcttaaagg

SEQ ID NO: 5486697 - DNA, 15 bp, Homo sapiens
gcgttgtaaaatata

SEQ ID NO: 5486698 - DNA, 16 bp, Homo sapiens
gcgttgtgggcaggct

SEQ ID NO: 5486699 - DNA, 15 bp, Homo sapiens
gcgttgttacaggaa

SEQ ID NO: 5486700 - DNA, 16 bp, Homo sapiens
gcgttgttacaggaag

SEQ ID NO: 5486701 - DNA, 19 bp, Homo sapiens
gcgttgttgcatgtttgaa

SEQ ID NO: 5486702 - DNA, 21 bp, Homo sapiens
gcgttgttttgtggataagaa

SEQ ID NO: 5486703 - DNA, 14 bp, Homo sapiens
gcgtttagaccaag

SEQ ID NO: 5486704 - DNA, 16 bp, Homo sapiens
gcgtttagaccaagga

SEQ ID NO: 5486705 - DNA, 21 bp, Homo sapiens
gcgtttagtttctagaggcct

SEQ ID NO: 5486706 - DNA, 22 bp, Homo sapiens
gcgtttagtttctagaggcctc

SEQ ID NO: 5486707 - DNA, 23 bp, Homo sapiens
gcgtttagtttctagaggcctca

SEQ ID NO: 5486708 - DNA, 17 bp, Homo sapiens
gcgtttattgtagtaaa

SEQ ID NO: 5486709 - DNA, 20 bp, Homo sapiens
gcgtttcttccactgagtct

SEQ ID NO: 5486710 - DNA, 14 bp, Homo sapiens
gcgtttgcctcctg

SEQ ID NO: 5486711 - DNA, 12 bp, Homo sapiens
gcgttttctccg

SEQ ID NO: 5486712 - DNA, 18 bp, Homo sapiens
gcgttttgtctgtgttgc

SEQ ID NO: 5486713 - DNA, 18 bp, Homo sapiens
gctaaaaaggcccttaga

SEQ ID NO: 5486714 - DNA, 22 bp, Homo sapiens
gctaaaaatatgcagaatctct

SEQ ID NO: 5486715 - DNA, 20 bp, Homo sapiens
gctaaaaatgggacttcttt

SEQ ID NO: 5486716 - DNA, 13 bp, Homo sapiens
gctaaaacagctt

SEQ ID NO: 5486717 - DNA, 16 bp, Homo sapiens
gctaaaacctgagcta

SEQ ID NO: 5486718 - DNA, 15 bp, Homo sapiens
gctaaaagaaacttt

SEQ ID NO: 5486719 - DNA, 14 bp, Homo sapiens
gctaaaagaagaga

SEQ ID NO: 5486720 - DNA, 15 bp, Homo sapiens
gctaaaagaagagag

SEQ ID NO: 5486721 - DNA, 19 bp, Homo sapiens
gctaaaagtgcatttaagg

SEQ ID NO: 5486722 - DNA, 22 bp, Homo sapiens
gctaaaagtgcatttaaggaga

SEQ ID NO: 5486723 - DNA, 13 bp, Homo sapiens
gctaaaataaacc

SEQ ID NO: 5486724 - DNA, 12 bp, Homo sapiens
gctaaaatgttt

SEQ ID NO: 5486725 - DNA, 14 bp, Homo sapiens
gctaaaatgttttc

SEQ ID NO: 5486726 - DNA, 17 bp, Homo sapiens
gctaaaatgttttcagc

SEQ ID NO: 5486727 - DNA, 20 bp, Homo sapiens
gctaaacactgcgctttatt

SEQ ID NO: 5486728 - DNA, 22 bp, Homo sapiens
gctaaacactgcgctttatttt

SEQ ID NO: 5486729 - DNA, 21 bp, Homo sapiens
gctaaacatgtgaggcctgga

SEQ ID NO: 5486730 - DNA, 18 bp, Homo sapiens
gctaaacctatctgtatt

SEQ ID NO: 5486731 - DNA, 15 bp, Homo sapiens
gctaaactgaatcta

SEQ ID NO: 5486732 - DNA, 13 bp, Homo sapiens
gctaaacttttct

SEQ ID NO: 5486733 - DNA, 13 bp, Homo sapiens
gctaaagaaaaag

SEQ ID NO: 5486734 - DNA, 19 bp, Homo sapiens
gctaaagaagtttgaacat

SEQ ID NO: 5486735 - DNA, 20 bp, Homo sapiens
gctaaagaagtttgaacatt

SEQ ID NO: 5486736 - DNA, 15 bp, Homo sapiens
gctaaagacatgaag

SEQ ID NO: 5486737 - DNA, 19 bp, Homo sapiens
gctaaagcaatatgcattt

SEQ ID NO: 5486738 - DNA, 21 bp, Homo sapiens
gctaaagcactttgcacttaa

SEQ ID NO: 5486739 - DNA, 14 bp, Homo sapiens
gctaaagccttcct

SEQ ID NO: 5486740 - DNA, 17 bp, Homo sapiens
gctaaagggaccatctg

SEQ ID NO: 5486741 - DNA, 21 bp, Homo sapiens
gctaaagtaaacaactcaagg

SEQ ID NO: 5486742 - DNA, 19 bp, Homo sapiens
gctaaagtcatccagtgaa

SEQ ID NO: 5486743 - DNA, 14 bp, Homo sapiens
gctaaagtgcattt

SEQ ID NO: 5486744 - DNA, 21 bp, Homo sapiens
gctaaataaaatttgttgcat

SEQ ID NO: 5486745 - DNA, 22 bp, Homo sapiens
gctaaataaacatgtgccctca

SEQ ID NO: 5486746 - DNA, 16 bp, Homo sapiens
gctaaataaagaggag

SEQ ID NO: 5486747 - DNA, 13 bp, Homo sapiens
gctaaatatttac

SEQ ID NO: 5486748 - DNA, 12 bp, Homo sapiens
gctaaatgaagt

SEQ ID NO: 5486749 - DNA, 21 bp, Homo sapiens
gctaaatgcaaacactgtgta

SEQ ID NO: 5486750 - DNA, 19 bp, Homo sapiens
gctaaatgcctaataaaca

SEQ ID NO: 5486751 - DNA, 14 bp, Homo sapiens
gctaaatgtaacag

SEQ ID NO: 5486752 - DNA, 21 bp, Homo sapiens
gctaaatgtaacttattccaa

SEQ ID NO: 5486753 - DNA, 16 bp, Homo sapiens
gctaaatgtgaatgat

SEQ ID NO: 5486754 - DNA, 17 bp, Homo sapiens
gctaaatgttagcaaga

SEQ ID NO: 5486755 - DNA, 16 bp, Homo sapiens
gctaaatgtttaaaga

SEQ ID NO: 5486756 - DNA, 22 bp, Homo sapiens
gctaaattactcaggaagaaca

SEQ ID NO: 5486757 - DNA, 13 bp, Homo sapiens
gctaaattataaa

SEQ ID NO: 5486758 - DNA, 22 bp, Homo sapiens
gctaaattataaaattgaaaac

SEQ ID NO: 5486759 - DNA, 23 bp, Homo sapiens
gctaaattataaaattgaaaaca

SEQ ID NO: 5486760 - DNA, 22 bp, Homo sapiens
gctaaattctatgttaaatact

SEQ ID NO: 5486761 - DNA, 19 bp, Homo sapiens
gctaaattgaatacacaaa

SEQ ID NO: 5486762 - DNA, 13 bp, Homo sapiens
gctaaatttgtgt

SEQ ID NO: 5486763 - DNA, 18 bp, Homo sapiens
gctaaattttgttactga

SEQ ID NO: 5486764 - DNA, 15 bp, Homo sapiens
gctaacaaactagaa

SEQ ID NO: 5486765 - DNA, 21 bp, Homo sapiens
gctaacaaattttaagtgcca

SEQ ID NO: 5486766 - DNA, 16 bp, Homo sapiens
gctaacaccagacaga

SEQ ID NO: 5486767 - DNA, 19 bp, Homo sapiens
gctaacacgtgaaaccccg

SEQ ID NO: 5486768 - DNA, 15 bp, Homo sapiens
gctaacagggaaggc

SEQ ID NO: 5486769 - DNA, 18 bp, Homo sapiens
gctaacagggaaggcagg

SEQ ID NO: 5486770 - DNA, 19 bp, Homo sapiens
gctaacagttcacttgcag

SEQ ID NO: 5486771 - DNA, 22 bp, Homo sapiens
gctaacatctttacgtactgta

SEQ ID NO: 5486772 - DNA, 14 bp, Homo sapiens
gctaacatgagtat

SEQ ID NO: 5486773 - DNA, 20 bp, Homo sapiens
gctaacatggtaaaaccccg

SEQ ID NO: 5486774 - DNA, 14 bp, Homo sapiens
gctaacattttaaa

SEQ ID NO: 5486775 - DNA, 21 bp, Homo sapiens
gctaacattttaaataaaaga

SEQ ID NO: 5486776 - DNA, 21 bp, Homo sapiens
gctacagagaaaccagcttcc

SEQ ID NO: 5486777 - DNA, 14 bp, Homo sapiens
gctacagagaagcc

SEQ ID NO: 5486778 - DNA, 18 bp, Homo sapiens
gctacagattgggcgggg

SEQ ID NO: 5486779 - DNA, 19 bp, Homo sapiens
gctacagcaatttctaatt

SEQ ID NO: 5486780 - DNA, 12 bp, Homo sapiens
gctacagctcca

SEQ ID NO: 5486781 - DNA, 15 bp, Homo sapiens
gctacagctccacac

SEQ ID NO: 5486782 - DNA, 16 bp, Homo sapiens
gctacagctccacacg

SEQ ID NO: 5486783 - DNA, 22 bp, Homo sapiens
gctacagctgtgtcccttcctg

SEQ ID NO: 5486784 - DNA, 19 bp, Homo sapiens
gctacagctttcttgctcc

SEQ ID NO: 5486785 - DNA, 12 bp, Homo sapiens
gctacaggactg

SEQ ID NO: 5486786 - DNA, 12 bp, Homo sapiens
gctacaggaggg

SEQ ID NO: 5486787 - DNA, 15 bp, Homo sapiens
gctacaggaggggtc

SEQ ID NO: 5486788 - DNA, 21 bp, Homo sapiens
gctacaggatggtgggcagga

SEQ ID NO: 5486789 - DNA, 16 bp, Homo sapiens
gctacaggtgccccac

SEQ ID NO: 5486790 - DNA, 12 bp, Homo sapiens
gctacaggttac

SEQ ID NO: 5486791 - DNA, 14 bp, Homo sapiens
gctacaggttacaa

SEQ ID NO: 5486792 - DNA, 18 bp, Homo sapiens
gctacaggttacaacaga

SEQ ID NO: 5486793 - DNA, 14 bp, Homo sapiens
gctacagtaataaa

SEQ ID NO: 5486794 - DNA, 17 bp, Homo sapiens
gctacagtagctgtggg

SEQ ID NO: 5486795 - DNA, 15 bp, Homo sapiens
gctacagttgatatt

SEQ ID NO: 5486796 - DNA, 22 bp, Homo sapiens
gctacatcagactctagaaaaa

SEQ ID NO: 5486797 - DNA, 14 bp, Homo sapiens
gctacatcccagcc

SEQ ID NO: 5486798 - DNA, 16 bp, Homo sapiens
gctacatctccaaata

SEQ ID NO: 5486799 - DNA, 16 bp, Homo sapiens
gctacatgctggggtc

SEQ ID NO: 5486800 - DNA, 13 bp, Homo sapiens
gctacattataaa

SEQ ID NO: 5486801 - DNA, 12 bp, Homo sapiens
gctacattcctc

SEQ ID NO: 5486802 - DNA, 18 bp, Homo sapiens
gctacattcctcagctgc

SEQ ID NO: 5486803 - DNA, 19 bp, Homo sapiens
gctacattcctcagctgcc

SEQ ID NO: 5486804 - DNA, 15 bp, Homo sapiens
gctacatttccgcca

SEQ ID NO: 5486805 - DNA, 13 bp, Homo sapiens
gctacattttcag

SEQ ID NO: 5486806 - DNA, 20 bp, Homo sapiens
gctacattttcagaagttaa

SEQ ID NO: 5486807 - DNA, 18 bp, Homo sapiens
gctaccaacggccaggaa

SEQ ID NO: 5486808 - DNA, 18 bp, Homo sapiens
gctaccaaggcccagcta

SEQ ID NO: 5486809 - DNA, 14 bp, Homo sapiens
gctaccaagtcaga

SEQ ID NO: 5486810 - DNA, 22 bp, Homo sapiens
gctaccaagtcagacaccaagg

SEQ ID NO: 5486811 - DNA, 16 bp, Homo sapiens
gctaccaatctgtgag

SEQ ID NO: 5486812 - DNA, 17 bp, Homo sapiens
gctaccaatctgtgaga

SEQ ID NO: 5486813 - DNA, 13 bp, Homo sapiens
gctaccacagact

SEQ ID NO: 5486814 - DNA, 12 bp, Homo sapiens
gctaccaccagc

SEQ ID NO: 5486815 - DNA, 14 bp, Homo sapiens
gctaccaccagctg

SEQ ID NO: 5486816 - DNA, 15 bp, Homo sapiens
gctaccaccagctgt

SEQ ID NO: 5486817 - DNA, 13 bp, Homo sapiens
gctaccactggta

SEQ ID NO: 5486818 - DNA, 20 bp, Homo sapiens
gctaccagaagaggggcagc

SEQ ID NO: 5486819 - DNA, 22 bp, Homo sapiens
gctaccagcgccaaatgttcat

SEQ ID NO: 5486820 - DNA, 23 bp, Homo sapiens
gctaccagcgccaaatgttcatc

SEQ ID NO: 5486821 - DNA, 14 bp, Homo sapiens
gctaccatctgcat

SEQ ID NO: 5486822 - DNA, 14 bp, Homo sapiens
gctacccagaacct

SEQ ID NO: 5486823 - DNA, 19 bp, Homo sapiens
gctaccccccgtctcctgc

SEQ ID NO: 5486824 - DNA, 20 bp, Homo sapiens
gctaccccccgtctcctgcc

SEQ ID NO: 5486825 - DNA, 20 bp, Homo sapiens
gctacccctcgactcagcac

SEQ ID NO: 5486826 - DNA, 15 bp, Homo sapiens
gctaccccttgtggg

SEQ ID NO: 5486827 - DNA, 22 bp, Homo sapiens
gctacccgcagagttctcagaa

SEQ ID NO: 5486828 - DNA, 17 bp, Homo sapiens
gctacccgctgtggccg

SEQ ID NO: 5486829 - DNA, 23 bp, Homo sapiens
gctacccgctgtggccggtgcca

SEQ ID NO: 5486830 - DNA, 21 bp, Homo sapiens
gctacccgggaagggggctgg

SEQ ID NO: 5486831 - DNA, 15 bp, Homo sapiens
gctaccctcagcctc

SEQ ID NO: 5486832 - DNA, 16 bp, Homo sapiens
gctaccctcagcctcc

SEQ ID NO: 5486833 - DNA, 22 bp, Homo sapiens
gctaccctcagcctccaatgca

SEQ ID NO: 5486834 - DNA, 14 bp, Homo sapiens
gctaccctccctgc

SEQ ID NO: 5486835 - DNA, 23 bp, Homo sapiens
gctaccctccctgctgtcccctc

SEQ ID NO: 5486836 - DNA, 20 bp, Homo sapiens
gctaccctttttctccagct

SEQ ID NO: 5486837 - DNA, 15 bp, Homo sapiens
gctaccgccctgggc

SEQ ID NO: 5486838 - DNA, 19 bp, Homo sapiens
gctaccgccctgggctgga

SEQ ID NO: 5486839 - DNA, 19 bp, Homo sapiens
gctaccgtggatctccttc

SEQ ID NO: 5486840 - DNA, 21 bp, Homo sapiens
gctacctaaaaaaagatgttt

SEQ ID NO: 5486841 - DNA, 13 bp, Homo sapiens
gctacctcaaggg

SEQ ID NO: 5486842 - DNA, 15 bp, Homo sapiens
gctacctcacctggg

SEQ ID NO: 5486843 - DNA, 14 bp, Homo sapiens
gctacctcagtgct

SEQ ID NO: 5486844 - DNA, 18 bp, Homo sapiens
gctacctcagtgctcctg

SEQ ID NO: 5486845 - DNA, 22 bp, Homo sapiens
gctacctctaacaccacactga

SEQ ID NO: 5486846 - DNA, 20 bp, Homo sapiens
gctacctctaatagtcctgt

SEQ ID NO: 5486847 - DNA, 14 bp, Homo sapiens
gctacctctctgtc

SEQ ID NO: 5486848 - DNA, 14 bp, Homo sapiens
gctacctctgatca

SEQ ID NO: 5486849 - DNA, 23 bp, Homo sapiens
gctacctgaatggcggtttttat

SEQ ID NO: 5486850 - DNA, 13 bp, Homo sapiens
gctacctgagcca

SEQ ID NO: 5486851 - DNA, 15 bp, Homo sapiens
gctacctgatttcag

SEQ ID NO: 5486852 - DNA, 17 bp, Homo sapiens
gctacctgcacctctgg

SEQ ID NO: 5486853 - DNA, 19 bp, Homo sapiens
gctacctgctcagccctgc

SEQ ID NO: 5486854 - DNA, 19 bp, Homo sapiens
gctacctgtgtggacagga

SEQ ID NO: 5486855 - DNA, 20 bp, Homo sapiens
gctacctgtgtggacaggac

SEQ ID NO: 5486856 - DNA, 22 bp, Homo sapiens
gctacctgtgtggacaggacta

SEQ ID NO: 5486857 - DNA, 23 bp, Homo sapiens
gctaccttctctacccatctccc

SEQ ID NO: 5486858 - DNA, 20 bp, Homo sapiens
gctaccttgccccaaccctt

SEQ ID NO: 5486859 - DNA, 13 bp, Homo sapiens
gctaccttgtggg

SEQ ID NO: 5486860 - DNA, 17 bp, Homo sapiens
gctaccttgtgggaata

SEQ ID NO: 5486861 - DNA, 17 bp, Homo sapiens
gctacctttcaaagctt

SEQ ID NO: 5486862 - DNA, 16 bp, Homo sapiens
gctacctttgtattct

SEQ ID NO: 5486863 - DNA, 13 bp, Homo sapiens
gctacctttttat

SEQ ID NO: 5486864 - DNA, 20 bp, Homo sapiens
gctaccttttttttacggaa

SEQ ID NO: 5486865 - DNA, 15 bp, Homo sapiens
gctacgcctcttctg

SEQ ID NO: 5486866 - DNA, 17 bp, Homo sapiens
gctacgcctcttctgtc

SEQ ID NO: 5486867 - DNA, 23 bp, Homo sapiens
gctacggttccctgcctaggagc

SEQ ID NO: 5486868 - DNA, 16 bp, Homo sapiens
gctacgtgcctcccga

SEQ ID NO: 5486869 - DNA, 14 bp, Homo sapiens
gctacgtgtgaaat

SEQ ID NO: 5486870 - DNA, 18 bp, Homo sapiens
gctacgttagcagcccag

SEQ ID NO: 5486871 - DNA, 19 bp, Homo sapiens
gctacgttcctattgtcat

SEQ ID NO: 5486872 - DNA, 20 bp, Homo sapiens
gctacgttttggttctatgc

SEQ ID NO: 5486873 - DNA, 17 bp, Homo sapiens
gctactaacctggagac

SEQ ID NO: 5486874 - DNA, 21 bp, Homo sapiens
gctactaagttcacattagaa

SEQ ID NO: 5486875 - DNA, 22 bp, Homo sapiens
gctactaagttcacattagaat

SEQ ID NO: 5486876 - DNA, 18 bp, Homo sapiens
gctactagaattctgtat

SEQ ID NO: 5486877 - DNA, 19 bp, Homo sapiens
gctactagggaggctgagg

SEQ ID NO: 5486878 - DNA, 21 bp, Homo sapiens
gctactataatcaaatgattt

SEQ ID NO: 5486879 - DNA, 17 bp, Homo sapiens
gctactcaagaggctga

SEQ ID NO: 5486880 - DNA, 20 bp, Homo sapiens
gctactcaagaggctgaggc

SEQ ID NO: 5486881 - DNA, 21 bp, Homo sapiens
gctactcaagaggctgaggca

SEQ ID NO: 5486882 - DNA, 17 bp, Homo sapiens
gctactcagaagcctga

SEQ ID NO: 5486883 - DNA, 21 bp, Homo sapiens
gctactcagaagcctgaggct

SEQ ID NO: 5486884 - DNA, 11 bp, Homo sapiens
gctactcagca

SEQ ID NO: 5486885 - DNA, 18 bp, Homo sapiens
gctactcagcagtaagca

SEQ ID NO: 5486886 - DNA, 12 bp, Homo sapiens
gctactcaggag

SEQ ID NO: 5486887 - DNA, 14 bp, Homo sapiens
gctactcaggaggc

SEQ ID NO: 5486888 - DNA, 16 bp, Homo sapiens
gctactcaggaggctg

SEQ ID NO: 5486889 - DNA, 18 bp, Homo sapiens
gctactcaggaggctgag

SEQ ID NO: 5486890 - DNA, 23 bp, Homo sapiens
gctactcaggaggctgagacagg

SEQ ID NO: 5486891 - DNA, 20 bp, Homo sapiens
gctactcagtggggctggca

SEQ ID NO: 5486892 - DNA, 19 bp, Homo sapiens
gctactccactgacctgga

SEQ ID NO: 5486893 - DNA, 12 bp, Homo sapiens
gctactccccac

SEQ ID NO: 5486894 - DNA, 13 bp, Homo sapiens
gctactcctgtgc

SEQ ID NO: 5486895 - DNA, 18 bp, Homo sapiens
gctactcgggaggctgag

SEQ ID NO: 5486896 - DNA, 22 bp, Homo sapiens
gctactcgggaggctgaggcac

SEQ ID NO: 5486897 - DNA, 14 bp, Homo sapiens
gctactctcttgcc

SEQ ID NO: 5486898 - DNA, 20 bp, Homo sapiens
gctactctgatccctctggg

SEQ ID NO: 5486899 - DNA, 13 bp, Homo sapiens
gctactctgccca

SEQ ID NO: 5486900 - DNA, 14 bp, Homo sapiens
gctactctggaatg

SEQ ID NO: 5486901 - DNA, 13 bp, Homo sapiens
gctactctgtcca

SEQ ID NO: 5486902 - DNA, 14 bp, Homo sapiens
gctactctgtccag

SEQ ID NO: 5486903 - DNA, 21 bp, Homo sapiens
gctactctgtccaggccactg

SEQ ID NO: 5486904 - DNA, 18 bp, Homo sapiens
gctactctgtgccagagc

SEQ ID NO: 5486905 - DNA, 20 bp, Homo sapiens
gctactctgtgccagagcct

SEQ ID NO: 5486906 - DNA, 21 bp, Homo sapiens
gctactctgtgccagagcctg

SEQ ID NO: 5486907 - DNA, 23 bp, Homo sapiens
gctactctgtgccagagcctggg

SEQ ID NO: 5486908 - DNA, 17 bp, Homo sapiens
gctactctgttccttca

SEQ ID NO: 5486909 - DNA, 14 bp, Homo sapiens
gctactcttgactt

SEQ ID NO: 5486910 - DNA, 18 bp, Homo sapiens
gctactgaaaaaaatgga

SEQ ID NO: 5486911 - DNA, 18 bp, Homo sapiens
gctactgaaccagccacg

SEQ ID NO: 5486912 - DNA, 20 bp, Homo sapiens
gctactgactgtattttgtt

SEQ ID NO: 5486913 - DNA, 15 bp, Homo sapiens
gctactgagaacata

SEQ ID NO: 5486914 - DNA, 15 bp, Homo sapiens
gctactgagacttgg

SEQ ID NO: 5486915 - DNA, 16 bp, Homo sapiens
gctactgagacttgga

SEQ ID NO: 5486916 - DNA, 21 bp, Homo sapiens
gctactgaggcaggggagtag

SEQ ID NO: 5486917 - DNA, 18 bp, Homo sapiens
gctactgatgagaattta

SEQ ID NO: 5486918 - DNA, 20 bp, Homo sapiens
gctactgatttcctttggag

SEQ ID NO: 5486919 - DNA, 16 bp, Homo sapiens
gctactgatttttgtg

SEQ ID NO: 5486920 - DNA, 14 bp, Homo sapiens
gctactgccactgt

SEQ ID NO: 5486921 - DNA, 18 bp, Homo sapiens
gctactgccatcctggcc

SEQ ID NO: 5486922 - DNA, 17 bp, Homo sapiens
gctactgcccctctccg

SEQ ID NO: 5486923 - DNA, 22 bp, Homo sapiens
gctactgccgtcagtgctgtgc

SEQ ID NO: 5486924 - DNA, 16 bp, Homo sapiens
gctactgctcagcttc

SEQ ID NO: 5486925 - DNA, 23 bp, Homo sapiens
gctactggcaaaaggatctttgt

SEQ ID NO: 5486926 - DNA, 13 bp, Homo sapiens
gctactggcagct

SEQ ID NO: 5486927 - DNA, 17 bp, Homo sapiens
gctactggcagctcctc

SEQ ID NO: 5486928 - DNA, 20 bp, Homo sapiens
gctactggcatagtttcata

SEQ ID NO: 5486929 - DNA, 21 bp, Homo sapiens
gctactggggaaactggccat

SEQ ID NO: 5486930 - DNA, 23 bp, Homo sapiens
gctactggggaaactggccatgg

SEQ ID NO: 5486931 - DNA, 17 bp, Homo sapiens
gctactggggaggctga

SEQ ID NO: 5486932 - DNA, 19 bp, Homo sapiens
gctactggggaggctgagg

SEQ ID NO: 5486933 - DNA, 17 bp, Homo sapiens
gctactgtaactttttt

SEQ ID NO: 5486934 - DNA, 18 bp, Homo sapiens
gctactgtaaggcaatca

SEQ ID NO: 5486935 - DNA, 23 bp, Homo sapiens
gctactgtaatgctgcctcagga

SEQ ID NO: 5486936 - DNA, 11 bp, Homo sapiens
gctactgtaga

SEQ ID NO: 5486937 - DNA, 17 bp, Homo sapiens
gctactgtagaaaggaa

SEQ ID NO: 5486938 - DNA, 15 bp, Homo sapiens
gctactgtcagctcc

SEQ ID NO: 5486939 - DNA, 20 bp, Homo sapiens
gctactgtcctacccaccct

SEQ ID NO: 5486940 - DNA, 14 bp, Homo sapiens
gctactgtcttact

SEQ ID NO: 5486941 - DNA, 16 bp, Homo sapiens
gctactgtctttggaa

SEQ ID NO: 5486942 - DNA, 16 bp, Homo sapiens
gctacttaagagaaat

SEQ ID NO: 5486943 - DNA, 21 bp, Homo sapiens
gctacttaagagaaatggcaa

SEQ ID NO: 5486944 - DNA, 23 bp, Homo sapiens
gctacttaattcctttctcatcc

SEQ ID NO: 5486945 - DNA, 23 bp, Homo sapiens
gctacttatcatttttgtataaa

SEQ ID NO: 5486946 - DNA, 17 bp, Homo sapiens
gctacttcccactgtat

SEQ ID NO: 5486947 - DNA, 21 bp, Homo sapiens
gctacttccccagctctcagt

SEQ ID NO: 5486948 - DNA, 17 bp, Homo sapiens
gctacttcctgcctggt

SEQ ID NO: 5486949 - DNA, 20 bp, Homo sapiens
gctacttcttattcactttt

SEQ ID NO: 5486950 - DNA, 23 bp, Homo sapiens
gctacttcttattcacttttgta

SEQ ID NO: 5486951 - DNA, 22 bp, Homo sapiens
gctacttgagggccaggatgct

SEQ ID NO: 5486952 - DNA, 24 bp, Homo sapiens
gctacttgatgtaactgagaattt

SEQ ID NO: 5486953 - DNA, 22 bp, Homo sapiens
gctagtccggacccacctcacc

SEQ ID NO: 5486954 - DNA, 19 bp, Homo sapiens
gctagtcctagtgaacctc

SEQ ID NO: 5486955 - DNA, 14 bp, Homo sapiens
gctagtcgcccctc

SEQ ID NO: 5486956 - DNA, 17 bp, Homo sapiens
gctagtcgcccctcaga

SEQ ID NO: 5486957 - DNA, 20 bp, Homo sapiens
gctagtcgcccctcagagca

SEQ ID NO: 5486958 - DNA, 21 bp, Homo sapiens
gctagtcgcccctcagagcat

SEQ ID NO: 5486959 - DNA, 15 bp, Homo sapiens
gctagtctatggtca

SEQ ID NO: 5486960 - DNA, 16 bp, Homo sapiens
gctagtctcttctcag

SEQ ID NO: 5486961 - DNA, 20 bp, Homo sapiens
gctagtctcttctcagagca

SEQ ID NO: 5486962 - DNA, 21 bp, Homo sapiens
gctagtctcttctcagagcag

SEQ ID NO: 5486963 - DNA, 22 bp, Homo sapiens
gctagtctcttctcagagcagc

SEQ ID NO: 5486964 - DNA, 13 bp, Homo sapiens
gctagtctgtgcc

SEQ ID NO: 5486965 - DNA, 19 bp, Homo sapiens
gctagtctgtgcctcagtg

SEQ ID NO: 5486966 - DNA, 17 bp, Homo sapiens
gctagtgaaatggctgg

SEQ ID NO: 5486967 - DNA, 18 bp, Homo sapiens
gctagtgaaatggctggg

SEQ ID NO: 5486968 - DNA, 21 bp, Homo sapiens
gctagtgaagaccagagcagt

SEQ ID NO: 5486969 - DNA, 15 bp, Homo sapiens
gctagtgaagtggcc

SEQ ID NO: 5486970 - DNA, 13 bp, Homo sapiens
gctagtgagctgg

SEQ ID NO: 5486971 - DNA, 16 bp, Homo sapiens
gctagtgatttacaca

SEQ ID NO: 5486972 - DNA, 17 bp, Homo sapiens
gctagtgatttacacag

SEQ ID NO: 5486973 - DNA, 18 bp, Homo sapiens
gctagtgccaaataattg

SEQ ID NO: 5486974 - DNA, 16 bp, Homo sapiens
gctagtgccttgccca

SEQ ID NO: 5486975 - DNA, 17 bp, Homo sapiens
gctagtggctcttctca

SEQ ID NO: 5486976 - DNA, 22 bp, Homo sapiens
gctagtgggccctctctctggg

SEQ ID NO: 5486977 - DNA, 21 bp, Homo sapiens
gctagtggggtgaacagctgg

SEQ ID NO: 5486978 - DNA, 16 bp, Homo sapiens
gctagtggtagtatct

SEQ ID NO: 5486979 - DNA, 17 bp, Homo sapiens
gctagtgtacctcctct

SEQ ID NO: 5486980 - DNA, 18 bp, Homo sapiens
gctagtgtctcctctctg

SEQ ID NO: 5486981 - DNA, 13 bp, Homo sapiens
gctagtgtcttat

SEQ ID NO: 5486982 - DNA, 19 bp, Homo sapiens
gctagtgtgagtggcagcc

SEQ ID NO: 5486983 - DNA, 20 bp, Homo sapiens
gctagtgtgctttcctttct

SEQ ID NO: 5486984 - DNA, 21 bp, Homo sapiens
gctagtgttaatccagagaac

SEQ ID NO: 5486985 - DNA, 17 bp, Homo sapiens
gctagttaaggtgtgca

SEQ ID NO: 5486986 - DNA, 19 bp, Homo sapiens
gctagttagagactcgcct

SEQ ID NO: 5486987 - DNA, 15 bp, Homo sapiens
gctagttctcttaac

SEQ ID NO: 5486988 - DNA, 16 bp, Homo sapiens
gctagttctgctgccc

SEQ ID NO: 5486989 - DNA, 16 bp, Homo sapiens
gctagttgaatacttg

SEQ ID NO: 5486990 - DNA, 22 bp, Homo sapiens
gctagttgaatacttgaaccat

SEQ ID NO: 5486991 - DNA, 19 bp, Homo sapiens
gctagttggggagctaagg

SEQ ID NO: 5486992 - DNA, 17 bp, Homo sapiens
gctagttggttgaattt

SEQ ID NO: 5486993 - DNA, 17 bp, Homo sapiens
gctagtttaaaattatt

SEQ ID NO: 5486994 - DNA, 21 bp, Homo sapiens
gctagttttacagattgcctc

SEQ ID NO: 5486995 - DNA, 23 bp, Homo sapiens
gctagttttcagctgctcagaat

SEQ ID NO: 5486996 - DNA, 16 bp, Homo sapiens
gctagttttttgcttc

SEQ ID NO: 5486997 - DNA, 16 bp, Homo sapiens
gctataaatagtgaaa

SEQ ID NO: 5486998 - DNA, 14 bp, Homo sapiens
gctataaatgccag

SEQ ID NO: 5486999 - DNA, 15 bp, Homo sapiens
gctataaatgccaga

SEQ ID NO: 5487000 - DNA, 18 bp, Homo sapiens
gctataaatgccagagcc

SEQ ID NO: 5487001 - DNA, 21 bp, Homo sapiens
gctataaatgccagagccaac

SEQ ID NO: 5487002 - DNA, 18 bp, Homo sapiens
gctataacaactctattt

SEQ ID NO: 5487003 - DNA, 22 bp, Homo sapiens
gctataacagtgtctttctagc

SEQ ID NO: 5487004 - DNA, 16 bp, Homo sapiens
gctataacattctgac

SEQ ID NO: 5487005 - DNA, 22 bp, Homo sapiens
gctataacatttgctgaatatg

SEQ ID NO: 5487006 - DNA, 12 bp, Homo sapiens
gctataagtgct

SEQ ID NO: 5487007 - DNA, 20 bp, Homo sapiens
gctataagtgctcaatagct

SEQ ID NO: 5487008 - DNA, 18 bp, Homo sapiens
gctataatcattagtttt

SEQ ID NO: 5487009 - DNA, 20 bp, Homo sapiens
gctataatcattagttttag

SEQ ID NO: 5487010 - DNA, 23 bp, Homo sapiens
gctataatcattagttttagagg

SEQ ID NO: 5487011 - DNA, 18 bp, Homo sapiens
gctataatgagcatgttt

SEQ ID NO: 5487012 - DNA, 22 bp, Homo sapiens
gctataatgtttccctcaagaa

SEQ ID NO: 5487013 - DNA, 18 bp, Homo sapiens
gctatactggaaatgtaa

SEQ ID NO: 5487014 - DNA, 21 bp, Homo sapiens
gctatagatgggactgtgtcc

SEQ ID NO: 5487015 - DNA, 15 bp, Homo sapiens
gctatagcaaaaata

SEQ ID NO: 5487016 - DNA, 16 bp, Homo sapiens
gctatagctcaggacc

SEQ ID NO: 5487017 - DNA, 23 bp, Homo sapiens
gctatagctttagccgtgtcacg

SEQ ID NO: 5487018 - DNA, 21 bp, Homo sapiens
gctatagggtgtgatgaagtc

SEQ ID NO: 5487019 - DNA, 15 bp, Homo sapiens
gctatagtgaagaat

SEQ ID NO: 5487020 - DNA, 18 bp, Homo sapiens
gctatagtgacatgcagt

SEQ ID NO: 5487021 - DNA, 23 bp, Homo sapiens
gctatagtgtataccacctgtac

SEQ ID NO: 5487022 - DNA, 19 bp, Homo sapiens
gctatagttgcagcccaag

SEQ ID NO: 5487023 - DNA, 15 bp, Homo sapiens
gctatataaaatgtg

SEQ ID NO: 5487024 - DNA, 15 bp, Homo sapiens
gctatataattgtga

SEQ ID NO: 5487025 - DNA, 19 bp, Homo sapiens
gctatatatataaatattt

SEQ ID NO: 5487026 - DNA, 18 bp, Homo sapiens
gctatatccagttcctgc

SEQ ID NO: 5487027 - DNA, 14 bp, Homo sapiens
gctatatccatgta

SEQ ID NO: 5487028 - DNA, 14 bp, Homo sapiens
gctatattagctga

SEQ ID NO: 5487029 - DNA, 22 bp, Homo sapiens
gctatattaggcatgttcaggg

SEQ ID NO: 5487030 - DNA, 20 bp, Homo sapiens
gctatattcctttttctatg

SEQ ID NO: 5487031 - DNA, 19 bp, Homo sapiens
gctatattgcccaggctgg

SEQ ID NO: 5487032 - DNA, 22 bp, Homo sapiens
gctatattgcccaggctggtct

SEQ ID NO: 5487033 - DNA, 15 bp, Homo sapiens
gctatatttaagtat

SEQ ID NO: 5487034 - DNA, 21 bp, Homo sapiens
gctatatttaagtattcaaga

SEQ ID NO: 5487035 - DNA, 23 bp, Homo sapiens
gctatcaaaataaattgaaatat

SEQ ID NO: 5487036 - DNA, 14 bp, Homo sapiens
gctatcaaataact

SEQ ID NO: 5487037 - DNA, 19 bp, Homo sapiens
gctatcaagaggctgagac

SEQ ID NO: 5487038 - DNA, 21 bp, Homo sapiens
gctatcacatgtgaaaagctt

SEQ ID NO: 5487039 - DNA, 19 bp, Homo sapiens
gctatcacctagcagcctc

SEQ ID NO: 5487040 - DNA, 14 bp, Homo sapiens
gctatcagaaacag

SEQ ID NO: 5487041 - DNA, 19 bp, Homo sapiens
gctatcagagcctctccca

SEQ ID NO: 5487042 - DNA, 11 bp, Homo sapiens
gctatcagcaa

SEQ ID NO: 5487043 - DNA, 22 bp, Homo sapiens
gctatcagcaatactcatcaga

SEQ ID NO: 5487044 - DNA, 13 bp, Homo sapiens
gctatcagcaatg

SEQ ID NO: 5487045 - DNA, 15 bp, Homo sapiens
gctatcagggaggaa

SEQ ID NO: 5487046 - DNA, 20 bp, Homo sapiens
gctatcagtgctttgttgat

SEQ ID NO: 5487047 - DNA, 16 bp, Homo sapiens
gctatcccttctcaga

SEQ ID NO: 5487048 - DNA, 17 bp, Homo sapiens
gctatcccttctcagaa

SEQ ID NO: 5487049 - DNA, 14 bp, Homo sapiens
gctatcctgcagga

SEQ ID NO: 5487050 - DNA, 18 bp, Homo sapiens
gctatcgccctcctttcc

SEQ ID NO: 5487051 - DNA, 20 bp, Homo sapiens
gctatcgccctcctttccct

SEQ ID NO: 5487052 - DNA, 15 bp, Homo sapiens
gctatcggcagatga

SEQ ID NO: 5487053 - DNA, 16 bp, Homo sapiens
gctatcgtaaaattaa

SEQ ID NO: 5487054 - DNA, 17 bp, Homo sapiens
gctatcgtaaaattaag

SEQ ID NO: 5487055 - DNA, 16 bp, Homo sapiens
gctatctactaagttt

SEQ ID NO: 5487056 - DNA, 22 bp, Homo sapiens
gctatctcccccagccccatcc

SEQ ID NO: 5487057 - DNA, 13 bp, Homo sapiens
gctatctctgtgt

SEQ ID NO: 5487058 - DNA, 20 bp, Homo sapiens
gctatctctgtgtgcacaaa

SEQ ID NO: 5487059 - DNA, 22 bp, Homo sapiens
gctatctgcactctaaactgca

SEQ ID NO: 5487060 - DNA, 23 bp, Homo sapiens
gctatctgcactctaaactgcaa

SEQ ID NO: 5487061 - DNA, 12 bp, Homo sapiens
gctatctgcctg

SEQ ID NO: 5487062 - DNA, 21 bp, Homo sapiens
gctatctgtcatctctctggg

SEQ ID NO: 5487063 - DNA, 13 bp, Homo sapiens
gctatgaacagaa

SEQ ID NO: 5487064 - DNA, 15 bp, Homo sapiens
gctatgaatgttact

SEQ ID NO: 5487065 - DNA, 16 bp, Homo sapiens
gctatgacagctggct

SEQ ID NO: 5487066 - DNA, 16 bp, Homo sapiens
gctatgactacatttt

SEQ ID NO: 5487067 - DNA, 11 bp, Homo sapiens
gctatgactta

SEQ ID NO: 5487068 - DNA, 22 bp, Homo sapiens
gctatgagttgaaatgttctgt

SEQ ID NO: 5487069 - DNA, 20 bp, Homo sapiens
gctatgataagattgaaatt

SEQ ID NO: 5487070 - DNA, 17 bp, Homo sapiens
gctatgatcgcgccact

SEQ ID NO: 5487071 - DNA, 21 bp, Homo sapiens
gctatgatggaagtgttcaga

SEQ ID NO: 5487072 - DNA, 21 bp, Homo sapiens
gctatgcaaaaaattctttag

SEQ ID NO: 5487073 - DNA, 17 bp, Homo sapiens
gctatgcacaccaaatt

SEQ ID NO: 5487074 - DNA, 18 bp, Homo sapiens
gctatgcacaccaaattg

SEQ ID NO: 5487075 - DNA, 22 bp, Homo sapiens
gctatgcacaccaaattgctga

SEQ ID NO: 5487076 - DNA, 13 bp, Homo sapiens
gctatgcatttga

SEQ ID NO: 5487077 - DNA, 12 bp, Homo sapiens
gctatgcatttt

SEQ ID NO: 5487078 - DNA, 18 bp, Homo sapiens
gctatgcattttcttcac

SEQ ID NO: 5487079 - DNA, 20 bp, Homo sapiens
gctatgccactaggccctgg

SEQ ID NO: 5487080 - DNA, 23 bp, Homo sapiens
gctatgccactaggccctggtct

SEQ ID NO: 5487081 - DNA, 19 bp, Homo sapiens
gctatgccatttcttctct

SEQ ID NO: 5487082 - DNA, 18 bp, Homo sapiens
gctatgcctccatttcag

SEQ ID NO: 5487083 - DNA, 20 bp, Homo sapiens
gctatgctagaggcttttat

SEQ ID NO: 5487084 - DNA, 16 bp, Homo sapiens
gctatgctcaggggcc

SEQ ID NO: 5487085 - DNA, 13 bp, Homo sapiens
gctatgctgaaga

SEQ ID NO: 5487086 - DNA, 20 bp, Homo sapiens
gctatgctgaagacattcaa

SEQ ID NO: 5487087 - DNA, 13 bp, Homo sapiens
gctatgcttgaat

SEQ ID NO: 5487088 - DNA, 22 bp, Homo sapiens
gctatggacaatttaccacagg

SEQ ID NO: 5487089 - DNA, 16 bp, Homo sapiens
gctatggacacagggt

SEQ ID NO: 5487090 - DNA, 18 bp, Homo sapiens
gctatggacacagggtga

SEQ ID NO: 5487091 - DNA, 15 bp, Homo sapiens
gctatggatctgatt

SEQ ID NO: 5487092 - DNA, 18 bp, Homo sapiens
gctatggatggggcccag

SEQ ID NO: 5487093 - DNA, 22 bp, Homo sapiens
gctatggattttctaaggaaga

SEQ ID NO: 5487094 - DNA, 15 bp, Homo sapiens
gctatggcaaggggg

SEQ ID NO: 5487095 - DNA, 19 bp, Homo sapiens
gctatggcaggataagaaa

SEQ ID NO: 5487096 - DNA, 13 bp, Homo sapiens
gctatgggagccc

SEQ ID NO: 5487097 - DNA, 18 bp, Homo sapiens
gctatgggagccccaggg

SEQ ID NO: 5487098 - DNA, 18 bp, Homo sapiens
gctatgggaggcagccga

SEQ ID NO: 5487099 - DNA, 18 bp, Homo sapiens
gctatggttgccacccca

SEQ ID NO: 5487100 - DNA, 13 bp, Homo sapiens
gctatggttttct

SEQ ID NO: 5487101 - DNA, 17 bp, Homo sapiens
gctatgtagacataaag

SEQ ID NO: 5487102 - DNA, 19 bp, Homo sapiens
gctatgtagtcataataaa

SEQ ID NO: 5487103 - DNA, 20 bp, Homo sapiens
gctatgtagtcataataaat

SEQ ID NO: 5487104 - DNA, 22 bp, Homo sapiens
gctatgtatggaatacagtgtt

SEQ ID NO: 5487105 - DNA, 15 bp, Homo sapiens
gctatgtcagtacta

SEQ ID NO: 5487106 - DNA, 12 bp, Homo sapiens
gctatgtcattt

SEQ ID NO: 5487107 - DNA, 18 bp, Homo sapiens
gctatgtcccaggaatca

SEQ ID NO: 5487108 - DNA, 15 bp, Homo sapiens
gctatgtctcatgtt

SEQ ID NO: 5487109 - DNA, 18 bp, Homo sapiens
gctatgtgcacagcccct

SEQ ID NO: 5487110 - DNA, 20 bp, Homo sapiens
gctatgttattttcagtgct

SEQ ID NO: 5487111 - DNA, 22 bp, Homo sapiens
gctatgttattttcagtgcttt

SEQ ID NO: 5487112 - DNA, 17 bp, Homo sapiens
gctatgttccctccagc

SEQ ID NO: 5487113 - DNA, 19 bp, Homo sapiens
gctatgttctgtcttccca

SEQ ID NO: 5487114 - DNA, 19 bp, Homo sapiens
gctatgttgcccaagctgg

SEQ ID NO: 5487115 - DNA, 18 bp, Homo sapiens
gctatgtttttaatgtat

SEQ ID NO: 5487116 - DNA, 18 bp, Homo sapiens
gctattaaaactctttta

SEQ ID NO: 5487117 - DNA, 19 bp, Homo sapiens
gctattaaaactcttttaa

SEQ ID NO: 5487118 - DNA, 18 bp, Homo sapiens
gctattaaaagaatccaa

SEQ ID NO: 5487119 - DNA, 14 bp, Homo sapiens
gctattaagaaact

SEQ ID NO: 5487120 - DNA, 13 bp, Homo sapiens
gctattaagaagg

SEQ ID NO: 5487121 - DNA, 12 bp, Homo sapiens
gctattaatatt

SEQ ID NO: 5487122 - DNA, 12 bp, Homo sapiens
gctattacaaat

SEQ ID NO: 5487123 - DNA, 22 bp, Homo sapiens
gctattacatgtgttagtgtat

SEQ ID NO: 5487124 - DNA, 21 bp, Homo sapiens
gctattagccaggatcatggt

SEQ ID NO: 5487125 - DNA, 18 bp, Homo sapiens
gctattagcggctcctcg

SEQ ID NO: 5487126 - DNA, 14 bp, Homo sapiens
gctattatactgtt

SEQ ID NO: 5487127 - DNA, 22 bp, Homo sapiens
gctattatgtaacatccagaag

SEQ ID NO: 5487128 - DNA, 17 bp, Homo sapiens
gctattattttcactgt

SEQ ID NO: 5487129 - DNA, 19 bp, Homo sapiens
gctcagccctgagctggcc

SEQ ID NO: 5487130 - DNA, 21 bp, Homo sapiens
gctcagccctgagctggcctc

SEQ ID NO: 5487131 - DNA, 12 bp, Homo sapiens
gctcagccctgc

SEQ ID NO: 5487132 - DNA, 15 bp, Homo sapiens
gctcagccctggagg

SEQ ID NO: 5487133 - DNA, 20 bp, Homo sapiens
gctcagccctggaggtgcca

SEQ ID NO: 5487134 - DNA, 16 bp, Homo sapiens
gctcagccctggcctg

SEQ ID NO: 5487135 - DNA, 20 bp, Homo sapiens
gctcagccctggcctggctg

SEQ ID NO: 5487136 - DNA, 13 bp, Homo sapiens
gctcagcctcccc

SEQ ID NO: 5487137 - DNA, 21 bp, Homo sapiens
gctcagcctcccgagtagctg

SEQ ID NO: 5487138 - DNA, 17 bp, Homo sapiens
gctcagcctggtgggcc

SEQ ID NO: 5487139 - DNA, 18 bp, Homo sapiens
gctcagcctggtgggcct

SEQ ID NO: 5487140 - DNA, 17 bp, Homo sapiens
gctcagcctggtttctg

SEQ ID NO: 5487141 - DNA, 23 bp, Homo sapiens
gctcagcctggtttctgggtgct

SEQ ID NO: 5487142 - DNA, 20 bp, Homo sapiens
gctcagccttctcctcccaa

SEQ ID NO: 5487143 - DNA, 16 bp, Homo sapiens
gctcagccttgcacac

SEQ ID NO: 5487144 - DNA, 22 bp, Homo sapiens
gctcagccttgctgctctgcgt

SEQ ID NO: 5487145 - DNA, 15 bp, Homo sapiens
gctcagcgccagcct

SEQ ID NO: 5487146 - DNA, 17 bp, Homo sapiens
gctcagcggggacagct

SEQ ID NO: 5487147 - DNA, 20 bp, Homo sapiens
gctcagcggggacagctcct

SEQ ID NO: 5487148 - DNA, 22 bp, Homo sapiens
gctcagctagaagatccacatc

SEQ ID NO: 5487149 - DNA, 19 bp, Homo sapiens
gctcagctagacattgcaa

SEQ ID NO: 5487150 - DNA, 15 bp, Homo sapiens
gctcagctatgaaat

SEQ ID NO: 5487151 - DNA, 15 bp, Homo sapiens
gctcagctcctacct

SEQ ID NO: 5487152 - DNA, 23 bp, Homo sapiens
gctcagctcctacctctgtgcca

SEQ ID NO: 5487153 - DNA, 19 bp, Homo sapiens
gctcagctcggggagcctt

SEQ ID NO: 5487154 - DNA, 10 bp, Homo sapiens
gctcagctct

SEQ ID NO: 5487155 - DNA, 14 bp, Homo sapiens
gctcagctctgctt

SEQ ID NO: 5487156 - DNA, 16 bp, Homo sapiens
gctcagctctggctca

SEQ ID NO: 5487157 - DNA, 18 bp, Homo sapiens
gctcagctctggctcaca

SEQ ID NO: 5487158 - DNA, 18 bp, Homo sapiens
gctcagctgagcatggag

SEQ ID NO: 5487159 - DNA, 19 bp, Homo sapiens
gctcagctgcattccgcag

SEQ ID NO: 5487160 - DNA, 14 bp, Homo sapiens
gctcagctggccgg

SEQ ID NO: 5487161 - DNA, 17 bp, Homo sapiens
gctcagctgtggtccca

SEQ ID NO: 5487162 - DNA, 16 bp, Homo sapiens
gctcagcttcttccta

SEQ ID NO: 5487163 - DNA, 13 bp, Homo sapiens
gctcaggaaaacg

SEQ ID NO: 5487164 - DNA, 16 bp, Homo sapiens
gctcaggaaccgaggc

SEQ ID NO: 5487165 - DNA, 20 bp, Homo sapiens
gctcaggacagatgccacac

SEQ ID NO: 5487166 - DNA, 14 bp, Homo sapiens
gctcaggaccaggc

SEQ ID NO: 5487167 - DNA, 13 bp, Homo sapiens
gctcaggacccag

SEQ ID NO: 5487168 - DNA, 14 bp, Homo sapiens
gctcaggacccagg

SEQ ID NO: 5487169 - DNA, 16 bp, Homo sapiens
gctcaggacccaggcc

SEQ ID NO: 5487170 - DNA, 19 bp, Homo sapiens
gctcaggacccaggccctc

SEQ ID NO: 5487171 - DNA, 19 bp, Homo sapiens
gctcaggactcagaagcct

SEQ ID NO: 5487172 - DNA, 11 bp, Homo sapiens
gctcaggagaa

SEQ ID NO: 5487173 - DNA, 16 bp, Homo sapiens
gctcaggagaagccag

SEQ ID NO: 5487174 - DNA, 13 bp, Homo sapiens
gctcaggagagag

SEQ ID NO: 5487175 - DNA, 15 bp, Homo sapiens
gctcaggagagggcc

SEQ ID NO: 5487176 - DNA, 17 bp, Homo sapiens
gctcaggagagggcctt

SEQ ID NO: 5487177 - DNA, 22 bp, Homo sapiens
gctcaggagagggccttcccct

SEQ ID NO: 5487178 - DNA, 15 bp, Homo sapiens
gctcaggagccctgg

SEQ ID NO: 5487179 - DNA, 18 bp, Homo sapiens
gctcaggagccctgggag

SEQ ID NO: 5487180 - DNA, 20 bp, Homo sapiens
gctcaggaggaggggtgaga

SEQ ID NO: 5487181 - DNA, 13 bp, Homo sapiens
gctcaggaggcga

SEQ ID NO: 5487182 - DNA, 20 bp, Homo sapiens
gctcaggaggcgaataaatg

SEQ ID NO: 5487183 - DNA, 22 bp, Homo sapiens
gctcaggaggcgaataaatgtt

SEQ ID NO: 5487184 - DNA, 23 bp, Homo sapiens
gctcaggaggcgaataaatgttc

SEQ ID NO: 5487185 - DNA, 13 bp, Homo sapiens
gctcaggaggctt

SEQ ID NO: 5487186 - DNA, 15 bp, Homo sapiens
gctcaggaggcttgg

SEQ ID NO: 5487187 - DNA, 22 bp, Homo sapiens
gctcaggagggtgacgcccagc

SEQ ID NO: 5487188 - DNA, 13 bp, Homo sapiens
gctcaggagtttg

SEQ ID NO: 5487189 - DNA, 21 bp, Homo sapiens
gctcaggagtttgagaccagg

SEQ ID NO: 5487190 - DNA, 19 bp, Homo sapiens
gctcaggatattcactctg

SEQ ID NO: 5487191 - DNA, 18 bp, Homo sapiens
gctcaggcaagcccctca

SEQ ID NO: 5487192 - DNA, 23 bp, Homo sapiens
gctcaggcaagcccctcagccct

SEQ ID NO: 5487193 - DNA, 12 bp, Homo sapiens
gctcaggcaggg

SEQ ID NO: 5487194 - DNA, 22 bp, Homo sapiens
gctcaggcaggggcctccatgg

SEQ ID NO: 5487195 - DNA, 23 bp, Homo sapiens
gctcaggccagtaatcccagtga

SEQ ID NO: 5487196 - DNA, 20 bp, Homo sapiens
gctcaggcctataaccccag

SEQ ID NO: 5487197 - DNA, 17 bp, Homo sapiens
gctcaggcctcacctcc

SEQ ID NO: 5487198 - DNA, 21 bp, Homo sapiens
gctcaggcctcacctcccagg

SEQ ID NO: 5487199 - DNA, 23 bp, Homo sapiens
gctcaggcctcacctcccagggc

SEQ ID NO: 5487200 - DNA, 16 bp, Homo sapiens
gctcaggcctcacctg

SEQ ID NO: 5487201 - DNA, 18 bp, Homo sapiens
gctcaggcctcacctggc

SEQ ID NO: 5487202 - DNA, 17 bp, Homo sapiens
gctcaggcctccctagc

SEQ ID NO: 5487203 - DNA, 24 bp, Homo sapiens
gctcaggcgatccacctgtctcag

SEQ ID NO: 5487204 - DNA, 14 bp, Homo sapiens
gctcaggctgagcc

SEQ ID NO: 5487205 - DNA, 20 bp, Homo sapiens
gctcaggctgagcccagcca

SEQ ID NO: 5487206 - DNA, 22 bp, Homo sapiens
gctcaggctgagcccagccacc

SEQ ID NO: 5487207 - DNA, 23 bp, Homo sapiens
gctcaggctgagcccagccacct

SEQ ID NO: 5487208 - DNA, 16 bp, Homo sapiens
gctcaggctgcccagc

SEQ ID NO: 5487209 - DNA, 14 bp, Homo sapiens
gctcaggctggtct

SEQ ID NO: 5487210 - DNA, 17 bp, Homo sapiens
gctcaggcttggcggag

SEQ ID NO: 5487211 - DNA, 17 bp, Homo sapiens
gctcagggaaaggccag

SEQ ID NO: 5487212 - DNA, 19 bp, Homo sapiens
gctcagggaaatggccttc

SEQ ID NO: 5487213 - DNA, 20 bp, Homo sapiens
gctcagggaaatggccttcc

SEQ ID NO: 5487214 - DNA, 16 bp, Homo sapiens
gctcagggaccacagc

SEQ ID NO: 5487215 - DNA, 20 bp, Homo sapiens
gctcagggaccacagcaagg

SEQ ID NO: 5487216 - DNA, 23 bp, Homo sapiens
gctcagggcagtggcttctttcc

SEQ ID NO: 5487217 - DNA, 13 bp, Homo sapiens
gctcagggccagg

SEQ ID NO: 5487218 - DNA, 16 bp, Homo sapiens
gctcagggccaggtcc

SEQ ID NO: 5487219 - DNA, 19 bp, Homo sapiens
gctcagggccatgctgagg

SEQ ID NO: 5487220 - DNA, 11 bp, Homo sapiens
gctcagggccc

SEQ ID NO: 5487221 - DNA, 18 bp, Homo sapiens
gctcagggcccacctcct

SEQ ID NO: 5487222 - DNA, 21 bp, Homo sapiens
gctcagggcctcaggcacccg

SEQ ID NO: 5487223 - DNA, 13 bp, Homo sapiens
gctcagggcctgg

SEQ ID NO: 5487224 - DNA, 20 bp, Homo sapiens
gctcagggcctggctcaggt

SEQ ID NO: 5487225 - DNA, 15 bp, Homo sapiens
gctcagggctggagt

SEQ ID NO: 5487226 - DNA, 23 bp, Homo sapiens
gctcagggctggagtgcgctctt

SEQ ID NO: 5487227 - DNA, 16 bp, Homo sapiens
gctcagggctggattg

SEQ ID NO: 5487228 - DNA, 15 bp, Homo sapiens
gctcaggggcagctc

SEQ ID NO: 5487229 - DNA, 19 bp, Homo sapiens
gctcaggggccctggagca

SEQ ID NO: 5487230 - DNA, 21 bp, Homo sapiens
gctcaggggcctggaggtctg

SEQ ID NO: 5487231 - DNA, 15 bp, Homo sapiens
gctcaggggctccat

SEQ ID NO: 5487232 - DNA, 19 bp, Homo sapiens
gctcagggtcaaagacaga

SEQ ID NO: 5487233 - DNA, 23 bp, Homo sapiens
gctcagggtcaaagacagaatgg

SEQ ID NO: 5487234 - DNA, 20 bp, Homo sapiens
gctcaggtacagagaaggaa

SEQ ID NO: 5487235 - DNA, 17 bp, Homo sapiens
gctcaggtagccaccac

SEQ ID NO: 5487236 - DNA, 18 bp, Homo sapiens
gctcaggtagccaccacc

SEQ ID NO: 5487237 - DNA, 17 bp, Homo sapiens
gctcaggtgactggagc

SEQ ID NO: 5487238 - DNA, 18 bp, Homo sapiens
gctcaggtgactggagcc

SEQ ID NO: 5487239 - DNA, 12 bp, Homo sapiens
gctcaggtgcct

SEQ ID NO: 5487240 - DNA, 14 bp, Homo sapiens
gctcaggtgcctta

SEQ ID NO: 5487241 - DNA, 22 bp, Homo sapiens
gctcaggtgctatgtcccaaga

SEQ ID NO: 5487242 - DNA, 22 bp, Homo sapiens
gctcaggtggggtcactctggc

SEQ ID NO: 5487243 - DNA, 23 bp, Homo sapiens
gctcaggtggggtcactctggca

SEQ ID NO: 5487244 - DNA, 19 bp, Homo sapiens
gctcaggtgtccctgcact

SEQ ID NO: 5487245 - DNA, 18 bp, Homo sapiens
gctcaggttccctgccac

SEQ ID NO: 5487246 - DNA, 18 bp, Homo sapiens
gctcagtaaacgggaaca

SEQ ID NO: 5487247 - DNA, 16 bp, Homo sapiens
gctcagtaacataact

SEQ ID NO: 5487248 - DNA, 20 bp, Homo sapiens
gctcagtaacataactgctt

SEQ ID NO: 5487249 - DNA, 13 bp, Homo sapiens
gctcagtacaggg

SEQ ID NO: 5487250 - DNA, 16 bp, Homo sapiens
gctcagtacagggcag

SEQ ID NO: 5487251 - DNA, 17 bp, Homo sapiens
gctcagtacagggcagg

SEQ ID NO: 5487252 - DNA, 18 bp, Homo sapiens
gctcagtattactttctg

SEQ ID NO: 5487253 - DNA, 20 bp, Homo sapiens
gctcagtattactttctgcc

SEQ ID NO: 5487254 - DNA, 11 bp, Homo sapiens
gctcagtattt

SEQ ID NO: 5487255 - DNA, 15 bp, Homo sapiens
gctcagtcgccctgt

SEQ ID NO: 5487256 - DNA, 17 bp, Homo sapiens
gctcagtcgccctgttc

SEQ ID NO: 5487257 - DNA, 14 bp, Homo sapiens
gctcagtctccctt

SEQ ID NO: 5487258 - DNA, 16 bp, Homo sapiens
gctcagtctccttggt

SEQ ID NO: 5487259 - DNA, 15 bp, Homo sapiens
gctcagtctgttcac

SEQ ID NO: 5487260 - DNA, 19 bp, Homo sapiens
gctcagtctgttcactgca

SEQ ID NO: 5487261 - DNA, 20 bp, Homo sapiens
gctcagtgaagttgctgctt

SEQ ID NO: 5487262 - DNA, 19 bp, Homo sapiens
gctcagtgcaacctctgct

SEQ ID NO: 5487263 - DNA, 20 bp, Homo sapiens
gctcagtgcaacctctgctt

SEQ ID NO: 5487264 - DNA, 21 bp, Homo sapiens
gctcagtgcaacctctgcttc

SEQ ID NO: 5487265 - DNA, 16 bp, Homo sapiens
gctcagtgccacctat

SEQ ID NO: 5487266 - DNA, 23 bp, Homo sapiens
gctcagtgccacctatgcctgtg

SEQ ID NO: 5487267 - DNA, 12 bp, Homo sapiens
gctcagtgcccg

SEQ ID NO: 5487268 - DNA, 16 bp, Homo sapiens
gctcagtgcctcctgg

SEQ ID NO: 5487269 - DNA, 15 bp, Homo sapiens
gctcagtgccttcct

SEQ ID NO: 5487270 - DNA, 16 bp, Homo sapiens
gctcagtgccttcctc

SEQ ID NO: 5487271 - DNA, 21 bp, Homo sapiens
gctcagtgcttgggctccacg

SEQ ID NO: 5487272 - DNA, 10 bp, Homo sapiens
gctcagtgtc

SEQ ID NO: 5487273 - DNA, 13 bp, Homo sapiens
gctcagtgtccag

SEQ ID NO: 5487274 - DNA, 16 bp, Homo sapiens
gctcagttctagtctc

SEQ ID NO: 5487275 - DNA, 16 bp, Homo sapiens
gctcagttgagaaaca

SEQ ID NO: 5487276 - DNA, 15 bp, Homo sapiens
gctcagttgtacttt

SEQ ID NO: 5487277 - DNA, 16 bp, Homo sapiens
gctcagtttggctgta

SEQ ID NO: 5487278 - DNA, 20 bp, Homo sapiens
gctcagtttggctgtaattt

SEQ ID NO: 5487279 - DNA, 16 bp, Homo sapiens
gctcagttttaaacgt

SEQ ID NO: 5487280 - DNA, 23 bp, Homo sapiens
gctcagttttacgcaacactaaa

SEQ ID NO: 5487281 - DNA, 16 bp, Homo sapiens
gctcataaaaataaaa

SEQ ID NO: 5487282 - DNA, 19 bp, Homo sapiens
gctcataaaacatgaatca

SEQ ID NO: 5487283 - DNA, 17 bp, Homo sapiens
gctcataacatctttga

SEQ ID NO: 5487284 - DNA, 19 bp, Homo sapiens
gctcataacatctttgaaa

SEQ ID NO: 5487285 - DNA, 21 bp, Homo sapiens
gctcataactagagtatgtgt

SEQ ID NO: 5487286 - DNA, 19 bp, Homo sapiens
gctcataagtaaatgtctt

SEQ ID NO: 5487287 - DNA, 20 bp, Homo sapiens
gctcatacaaaataaatggt

SEQ ID NO: 5487288 - DNA, 23 bp, Homo sapiens
gctcatagaggtgagaaaactca

SEQ ID NO: 5487289 - DNA, 12 bp, Homo sapiens
gctcatagcaca

SEQ ID NO: 5487290 - DNA, 15 bp, Homo sapiens
gctcatagcacatgt

SEQ ID NO: 5487291 - DNA, 19 bp, Homo sapiens
gctcataggacctgcatcc

SEQ ID NO: 5487292 - DNA, 20 bp, Homo sapiens
gctcatagtgaacacagcag

SEQ ID NO: 5487293 - DNA, 19 bp, Homo sapiens
gctcatatgctgacagctc

SEQ ID NO: 5487294 - DNA, 16 bp, Homo sapiens
gctcatattcctgcag

SEQ ID NO: 5487295 - DNA, 20 bp, Homo sapiens
gctcatattcctgcagcctg

SEQ ID NO: 5487296 - DNA, 20 bp, Homo sapiens
gctcatcacccagtcctggc

SEQ ID NO: 5487297 - DNA, 15 bp, Homo sapiens
gctcatcagaaacaa

SEQ ID NO: 5487298 - DNA, 22 bp, Homo sapiens
gctcatcagaaacaatttctgt

SEQ ID NO: 5487299 - DNA, 16 bp, Homo sapiens
gctcatcattctctgt

SEQ ID NO: 5487300 - DNA, 18 bp, Homo sapiens
gctcatcattctctgtct

SEQ ID NO: 5487301 - DNA, 19 bp, Homo sapiens
gctcatcattctctgtctc

SEQ ID NO: 5487302 - DNA, 15 bp, Homo sapiens
gctcatccagggtgt

SEQ ID NO: 5487303 - DNA, 20 bp, Homo sapiens
gctcatcccccctgctgccc

SEQ ID NO: 5487304 - DNA, 22 bp, Homo sapiens
gctcatcccccctgctgcccag

SEQ ID NO: 5487305 - DNA, 16 bp, Homo sapiens
gctcatccctggactt

SEQ ID NO: 5487306 - DNA, 21 bp, Homo sapiens
gctccagtctgctgccctcca

SEQ ID NO: 5487307 - DNA, 23 bp, Homo sapiens
gctccagtgtcctgagctcagcg

SEQ ID NO: 5487308 - DNA, 19 bp, Homo sapiens
gctccagtgttttcttgtg

SEQ ID NO: 5487309 - DNA, 17 bp, Homo sapiens
gctccagttgaacacta

SEQ ID NO: 5487310 - DNA, 23 bp, Homo sapiens
gctccagtttccaagttcctgca

SEQ ID NO: 5487311 - DNA, 19 bp, Homo sapiens
gctccagtttccccatggg

SEQ ID NO: 5487312 - DNA, 16 bp, Homo sapiens
gctccagtttgcattt

SEQ ID NO: 5487313 - DNA, 14 bp, Homo sapiens
gctccataaagtac

SEQ ID NO: 5487314 - DNA, 17 bp, Homo sapiens
gctccatacacacgctg

SEQ ID NO: 5487315 - DNA, 21 bp, Homo sapiens
gctccatacacacgctgcctt

SEQ ID NO: 5487316 - DNA, 19 bp, Homo sapiens
gctccatatttgatttcta

SEQ ID NO: 5487317 - DNA, 20 bp, Homo sapiens
gctccatatttgatttctaa

SEQ ID NO: 5487318 - DNA, 15 bp, Homo sapiens
gctccatccaaactc

SEQ ID NO: 5487319 - DNA, 22 bp, Homo sapiens
gctccatcccaaccaggcacct

SEQ ID NO: 5487320 - DNA, 19 bp, Homo sapiens
gctccatccccctgcctcc

SEQ ID NO: 5487321 - DNA, 15 bp, Homo sapiens
gctccatccttctcc

SEQ ID NO: 5487322 - DNA, 13 bp, Homo sapiens
gctccatcgccca

SEQ ID NO: 5487323 - DNA, 19 bp, Homo sapiens
gctccatcgcccaggcctg

SEQ ID NO: 5487324 - DNA, 19 bp, Homo sapiens
gctccatctccgcctccac

SEQ ID NO: 5487325 - DNA, 20 bp, Homo sapiens
gctccatctccgcctccaca

SEQ ID NO: 5487326 - DNA, 20 bp, Homo sapiens
gctccatgactggctgtctg

SEQ ID NO: 5487327 - DNA, 17 bp, Homo sapiens
gctccatgattctctga

SEQ ID NO: 5487328 - DNA, 21 bp, Homo sapiens
gctccatgattctctgagtgg

SEQ ID NO: 5487329 - DNA, 13 bp, Homo sapiens
gctccatgcacag

SEQ ID NO: 5487330 - DNA, 19 bp, Homo sapiens
gctccatgctcctcactgc

SEQ ID NO: 5487331 - DNA, 23 bp, Homo sapiens
gctccatgctcctcactgcccgc

SEQ ID NO: 5487332 - DNA, 17 bp, Homo sapiens
gctccatgctgggtctg

SEQ ID NO: 5487333 - DNA, 22 bp, Homo sapiens
gctccatgctggtgtggccaag

SEQ ID NO: 5487334 - DNA, 13 bp, Homo sapiens
gctccatggagga

SEQ ID NO: 5487335 - DNA, 22 bp, Homo sapiens
gctccatggaggaggtgtccca

SEQ ID NO: 5487336 - DNA, 16 bp, Homo sapiens
gctccatgggcacctc

SEQ ID NO: 5487337 - DNA, 22 bp, Homo sapiens
gctccatggggaagtgctcccc

SEQ ID NO: 5487338 - DNA, 23 bp, Homo sapiens
gctccatggggaagtgctcccca

SEQ ID NO: 5487339 - DNA, 12 bp, Homo sapiens
gctccattcact

SEQ ID NO: 5487340 - DNA, 17 bp, Homo sapiens
gctccattcactcccag

SEQ ID NO: 5487341 - DNA, 18 bp, Homo sapiens
gctccattcatacacaac

SEQ ID NO: 5487342 - DNA, 12 bp, Homo sapiens
gctccattccca

SEQ ID NO: 5487343 - DNA, 15 bp, Homo sapiens
gctccattcccatca

SEQ ID NO: 5487344 - DNA, 16 bp, Homo sapiens
gctccattcctgagta

SEQ ID NO: 5487345 - DNA, 19 bp, Homo sapiens
gctccatttaaacagatgt

SEQ ID NO: 5487346 - DNA, 20 bp, Homo sapiens
gctccatttcaattgctttg

SEQ ID NO: 5487347 - DNA, 22 bp, Homo sapiens
gctccattttcttattgcgctg

SEQ ID NO: 5487348 - DNA, 14 bp, Homo sapiens
gctccattttttct

SEQ ID NO: 5487349 - DNA, 20 bp, Homo sapiens
gctcccaaaaagatgcttta

SEQ ID NO: 5487350 - DNA, 19 bp, Homo sapiens
gctcccaacagaggcctcc

SEQ ID NO: 5487351 - DNA, 14 bp, Homo sapiens
gctcccaacccccc

SEQ ID NO: 5487352 - DNA, 20 bp, Homo sapiens
gctcccaacccccctcctgc

SEQ ID NO: 5487353 - DNA, 20 bp, Homo sapiens
gctcccaacgagcctcctca

SEQ ID NO: 5487354 - DNA, 21 bp, Homo sapiens
gctcccaactcccttctgctt

SEQ ID NO: 5487355 - DNA, 12 bp, Homo sapiens
gctcccaaggga

SEQ ID NO: 5487356 - DNA, 15 bp, Homo sapiens
gctcccaagggaggc

SEQ ID NO: 5487357 - DNA, 12 bp, Homo sapiens
gctcccaagggt

SEQ ID NO: 5487358 - DNA, 19 bp, Homo sapiens
gctcccaatggtgcttgga

SEQ ID NO: 5487359 - DNA, 15 bp, Homo sapiens
gctcccacaagcctc

SEQ ID NO: 5487360 - DNA, 21 bp, Homo sapiens
gctcccacacccacctctgcc

SEQ ID NO: 5487361 - DNA, 23 bp, Homo sapiens
gctcccacacccacctctgccac

SEQ ID NO: 5487362 - DNA, 22 bp, Homo sapiens
gctcccacaccgcgtcccagct

SEQ ID NO: 5487363 - DNA, 23 bp, Homo sapiens
gctcccacaccgcgtcccagctc

SEQ ID NO: 5487364 - DNA, 13 bp, Homo sapiens
gctcccacagaac

SEQ ID NO: 5487365 - DNA, 22 bp, Homo sapiens
gctcccacagaagggggaacgc

SEQ ID NO: 5487366 - DNA, 12 bp, Homo sapiens
gctcccacagct

SEQ ID NO: 5487367 - DNA, 15 bp, Homo sapiens
gctcccacagcttcc

SEQ ID NO: 5487368 - DNA, 15 bp, Homo sapiens
gctcccacaggcagc

SEQ ID NO: 5487369 - DNA, 16 bp, Homo sapiens
gctcccacaggcagct

SEQ ID NO: 5487370 - DNA, 17 bp, Homo sapiens
gctcccacaggcagctt

SEQ ID NO: 5487371 - DNA, 17 bp, Homo sapiens
gctcccacaggcccttc

SEQ ID NO: 5487372 - DNA, 12 bp, Homo sapiens
gctcccaccagc

SEQ ID NO: 5487373 - DNA, 13 bp, Homo sapiens
gctcccaccaggc

SEQ ID NO: 5487374 - DNA, 15 bp, Homo sapiens
gctcccacccacctg

SEQ ID NO: 5487375 - DNA, 21 bp, Homo sapiens
gctcccaccccacccccttca

SEQ ID NO: 5487376 - DNA, 13 bp, Homo sapiens
gctcccaccccag

SEQ ID NO: 5487377 - DNA, 15 bp, Homo sapiens
gctcccaccccagaa

SEQ ID NO: 5487378 - DNA, 12 bp, Homo sapiens
gctcccaccctc

SEQ ID NO: 5487379 - DNA, 14 bp, Homo sapiens
gctcccaccgcccc

SEQ ID NO: 5487380 - DNA, 20 bp, Homo sapiens
gctcccaccgcccccacccc

SEQ ID NO: 5487381 - DNA, 23 bp, Homo sapiens
gctcccaccgcccccaccccttc

SEQ ID NO: 5487382 - DNA, 16 bp, Homo sapiens
gctcccaccggtgcca

SEQ ID NO: 5487383 - DNA, 19 bp, Homo sapiens
gctcccaccggtgccaaac

SEQ ID NO: 5487384 - DNA, 13 bp, Homo sapiens
gctcccacctagt

SEQ ID NO: 5487385 - DNA, 15 bp, Homo sapiens
gctcccacctagtgc

SEQ ID NO: 5487386 - DNA, 20 bp, Homo sapiens
gctcccacctagtgccccag

SEQ ID NO: 5487387 - DNA, 22 bp, Homo sapiens
gctcccacctagtgccccagac

SEQ ID NO: 5487388 - DNA, 12 bp, Homo sapiens
gctcccacctcc

SEQ ID NO: 5487389 - DNA, 15 bp, Homo sapiens
gctcccacctcggac

SEQ ID NO: 5487390 - DNA, 14 bp, Homo sapiens
gctcccacctggct

SEQ ID NO: 5487391 - DNA, 17 bp, Homo sapiens
gctcccacctgtttctg

SEQ ID NO: 5487392 - DNA, 13 bp, Homo sapiens
gctcccacgccct

SEQ ID NO: 5487393 - DNA, 21 bp, Homo sapiens
gctcccactcagaactctcca

SEQ ID NO: 5487394 - DNA, 18 bp, Homo sapiens
gctcccactgcccctgca

SEQ ID NO: 5487395 - DNA, 19 bp, Homo sapiens
gctcccactgcccctgcac

SEQ ID NO: 5487396 - DNA, 16 bp, Homo sapiens
gctcccagcagaggcc

SEQ ID NO: 5487397 - DNA, 15 bp, Homo sapiens
gctcccagccaggcc

SEQ ID NO: 5487398 - DNA, 17 bp, Homo sapiens
gctcccagccaggccct

SEQ ID NO: 5487399 - DNA, 18 bp, Homo sapiens
gctcccagccaggccctt

SEQ ID NO: 5487400 - DNA, 14 bp, Homo sapiens
gctcccagcccact

SEQ ID NO: 5487401 - DNA, 17 bp, Homo sapiens
gctcccagcctcagcgc

SEQ ID NO: 5487402 - DNA, 20 bp, Homo sapiens
gctcccagctctctctcctg

SEQ ID NO: 5487403 - DNA, 13 bp, Homo sapiens
gctcccaggacac

SEQ ID NO: 5487404 - DNA, 16 bp, Homo sapiens
gctcccaggaccacag

SEQ ID NO: 5487405 - DNA, 20 bp, Homo sapiens
gctcccaggagcctgcccag

SEQ ID NO: 5487406 - DNA, 15 bp, Homo sapiens
gctcccaggatctcc

SEQ ID NO: 5487407 - DNA, 11 bp, Homo sapiens
gctcccaggcc

SEQ ID NO: 5487408 - DNA, 12 bp, Homo sapiens
gctcccaggcca

SEQ ID NO: 5487409 - DNA, 18 bp, Homo sapiens
gctcccagggactgacac

SEQ ID NO: 5487410 - DNA, 22 bp, Homo sapiens
gctcccagggccatgaactttg

SEQ ID NO: 5487411 - DNA, 21 bp, Homo sapiens
gctcccaggggtctccctggc

SEQ ID NO: 5487412 - DNA, 11 bp, Homo sapiens
gctcccagggt

SEQ ID NO: 5487413 - DNA, 19 bp, Homo sapiens
gctcccaggtgcagccaga

SEQ ID NO: 5487414 - DNA, 20 bp, Homo sapiens
gctcccaggtgcagccagag

SEQ ID NO: 5487415 - DNA, 21 bp, Homo sapiens
gctcccaggttcccccagcaa

SEQ ID NO: 5487416 - DNA, 14 bp, Homo sapiens
gctcccagtcctgc

SEQ ID NO: 5487417 - DNA, 17 bp, Homo sapiens
gctcccagtcctgcctg

SEQ ID NO: 5487418 - DNA, 23 bp, Homo sapiens
gctcccagtcctgcctgaacagc

SEQ ID NO: 5487419 - DNA, 12 bp, Homo sapiens
gctcccagtgcc

SEQ ID NO: 5487420 - DNA, 20 bp, Homo sapiens
gctcccagtgggagcttccc

SEQ ID NO: 5487421 - DNA, 19 bp, Homo sapiens
gctcccagtgtcttcctgt

SEQ ID NO: 5487422 - DNA, 17 bp, Homo sapiens
gctcccatcctgtgtgt

SEQ ID NO: 5487423 - DNA, 13 bp, Homo sapiens
gctcccatgtgag

SEQ ID NO: 5487424 - DNA, 21 bp, Homo sapiens
gctcccatgtgagtccctgtg

SEQ ID NO: 5487425 - DNA, 16 bp, Homo sapiens
gctcccattcctccct

SEQ ID NO: 5487426 - DNA, 18 bp, Homo sapiens
gctcccatttctactctc

SEQ ID NO: 5487427 - DNA, 17 bp, Homo sapiens
gctccccaacacctgcc

SEQ ID NO: 5487428 - DNA, 20 bp, Homo sapiens
gctccccaactccctgccat

SEQ ID NO: 5487429 - DNA, 22 bp, Homo sapiens
gctccccaatccaacccatgca

SEQ ID NO: 5487430 - DNA, 16 bp, Homo sapiens
gctccccaatccctga

SEQ ID NO: 5487431 - DNA, 23 bp, Homo sapiens
gctccccacaccttccagggccc

SEQ ID NO: 5487432 - DNA, 21 bp, Homo sapiens
gctccccacacgtgctcgcag

SEQ ID NO: 5487433 - DNA, 20 bp, Homo sapiens
gctccccacagcgtccctgg

SEQ ID NO: 5487434 - DNA, 22 bp, Homo sapiens
gctccccacagcgtccctggcg

SEQ ID NO: 5487435 - DNA, 20 bp, Homo sapiens
gctccccacagctttgcacc

SEQ ID NO: 5487436 - DNA, 21 bp, Homo sapiens
gctccccacagctttgcaccc

SEQ ID NO: 5487437 - DNA, 22 bp, Homo sapiens
gctccccacagctttgcacccc

SEQ ID NO: 5487438 - DNA, 15 bp, Homo sapiens
gctccccacctaccc

SEQ ID NO: 5487439 - DNA, 19 bp, Homo sapiens
gctccccacctacccagct

SEQ ID NO: 5487440 - DNA, 23 bp, Homo sapiens
gctccccacgagtcacctgcaag

SEQ ID NO: 5487441 - DNA, 16 bp, Homo sapiens
gctccccacgccccca

SEQ ID NO: 5487442 - DNA, 17 bp, Homo sapiens
gctccccactctgctct

SEQ ID NO: 5487443 - DNA, 19 bp, Homo sapiens
gctccccactgcctactgc

SEQ ID NO: 5487444 - DNA, 20 bp, Homo sapiens
gctccccactgcctactgca

SEQ ID NO: 5487445 - DNA, 18 bp, Homo sapiens
gctccccagaactggctg

SEQ ID NO: 5487446 - DNA, 22 bp, Homo sapiens
gctccccagaactggctgggcc

SEQ ID NO: 5487447 - DNA, 23 bp, Homo sapiens
gctccccagaactggctgggccc

SEQ ID NO: 5487448 - DNA, 20 bp, Homo sapiens
gctccccagcccacctgctc

SEQ ID NO: 5487449 - DNA, 14 bp, Homo sapiens
gctccccagcccag

SEQ ID NO: 5487450 - DNA, 16 bp, Homo sapiens
gctccccagcccaggg

SEQ ID NO: 5487451 - DNA, 14 bp, Homo sapiens
gctccccagccctg

SEQ ID NO: 5487452 - DNA, 21 bp, Homo sapiens
gctccccagccctggctctgc

SEQ ID NO: 5487453 - DNA, 20 bp, Homo sapiens
gctccccaggaagcccactg

SEQ ID NO: 5487454 - DNA, 21 bp, Homo sapiens
gctccccaggactcaccctca

SEQ ID NO: 5487455 - DNA, 12 bp, Homo sapiens
gctccccatgtg

SEQ ID NO: 5487456 - DNA, 22 bp, Homo sapiens
gctcccccaccccctccccagg

SEQ ID NO: 5487457 - DNA, 13 bp, Homo sapiens
gctcccccaggca

SEQ ID NO: 5487458 - DNA, 15 bp, Homo sapiens
gctcccccaggcaga

SEQ ID NO: 5487459 - DNA, 22 bp, Homo sapiens
gctcccccaggcagaaatagtt

SEQ ID NO: 5487460 - DNA, 14 bp, Homo sapiens
gctcccccaggcct

SEQ ID NO: 5487461 - DNA, 15 bp, Homo sapiens
gctcccccaggcctg

SEQ ID NO: 5487462 - DNA, 19 bp, Homo sapiens
gctcccccaggcctgagct

SEQ ID NO: 5487463 - DNA, 15 bp, Homo sapiens
gctcccccaggctgt

SEQ ID NO: 5487464 - DNA, 18 bp, Homo sapiens
gctcccccatcctcccct

SEQ ID NO: 5487465 - DNA, 18 bp, Homo sapiens
gctcccccattttaactt

SEQ ID NO: 5487466 - DNA, 11 bp, Homo sapiens
gctccccccag

SEQ ID NO: 5487467 - DNA, 17 bp, Homo sapiens
gctccccccgcccaccc

SEQ ID NO: 5487468 - DNA, 20 bp, Homo sapiens
gctccccccgcccacccacg

SEQ ID NO: 5487469 - DNA, 17 bp, Homo sapiens
gctcccccgggaggggc

SEQ ID NO: 5487470 - DNA, 19 bp, Homo sapiens
gctcccccgtggtgcctgc

SEQ ID NO: 5487471 - DNA, 21 bp, Homo sapiens
gctcccccgtggtgcctgcac

SEQ ID NO: 5487472 - DNA, 18 bp, Homo sapiens
gctccccctccacctgct

SEQ ID NO: 5487473 - DNA, 14 bp, Homo sapiens
gctccccctcccca

SEQ ID NO: 5487474 - DNA, 20 bp, Homo sapiens
gctccccctccccaggctgg

SEQ ID NO: 5487475 - DNA, 21 bp, Homo sapiens
gctccccctccccaggctgga

SEQ ID NO: 5487476 - DNA, 14 bp, Homo sapiens
gctccccctctgct

SEQ ID NO: 5487477 - DNA, 21 bp, Homo sapiens
gctccccctgaattttgcttc

SEQ ID NO: 5487478 - DNA, 12 bp, Homo sapiens
gctccccctgct

SEQ ID NO: 5487479 - DNA, 22 bp, Homo sapiens
gctccccctggacggggcgggc

SEQ ID NO: 5487480 - DNA, 14 bp, Homo sapiens
gctccccgcctcca

SEQ ID NO: 5487481 - DNA, 17 bp, Homo sapiens
gctccccgcctccactc

SEQ ID NO: 5487482 - DNA, 20 bp, Homo sapiens
gctccccgggggcagacacc

SEQ ID NO: 5487483 - DNA, 23 bp, Homo sapiens
gctcctaaacccccgctccagat

SEQ ID NO: 5487484 - DNA, 24 bp, Homo sapiens
gctcctaaacccccgctccagatc

SEQ ID NO: 5487485 - DNA, 23 bp, Homo sapiens
gctcctaacccttatcaccagct

SEQ ID NO: 5487486 - DNA, 21 bp, Homo sapiens
gctcctaatggtacgtgggta

SEQ ID NO: 5487487 - DNA, 12 bp, Homo sapiens
gctcctacctgg

SEQ ID NO: 5487488 - DNA, 13 bp, Homo sapiens
gctcctacctggg

SEQ ID NO: 5487489 - DNA, 19 bp, Homo sapiens
gctcctacctgggggcaga

SEQ ID NO: 5487490 - DNA, 16 bp, Homo sapiens
gctcctacctgtctgc

SEQ ID NO: 5487491 - DNA, 23 bp, Homo sapiens
gctcctacctgtctgctgccagc

SEQ ID NO: 5487492 - DNA, 18 bp, Homo sapiens
gctcctagagaggagaaa

SEQ ID NO: 5487493 - DNA, 14 bp, Homo sapiens
gctcctagagggag

SEQ ID NO: 5487494 - DNA, 15 bp, Homo sapiens
gctcctagagggagg

SEQ ID NO: 5487495 - DNA, 18 bp, Homo sapiens
gctcctagagggaggggc

SEQ ID NO: 5487496 - DNA, 14 bp, Homo sapiens
gctcctagcagaga

SEQ ID NO: 5487497 - DNA, 17 bp, Homo sapiens
gctcctagcccagcaga

SEQ ID NO: 5487498 - DNA, 18 bp, Homo sapiens
gctcctagcccagcagag

SEQ ID NO: 5487499 - DNA, 14 bp, Homo sapiens
gctcctatctgtgt

SEQ ID NO: 5487500 - DNA, 16 bp, Homo sapiens
gctcctattagaaaag

SEQ ID NO: 5487501 - DNA, 16 bp, Homo sapiens
gctcctcaaagcctca

SEQ ID NO: 5487502 - DNA, 21 bp, Homo sapiens
gctcctcacatacccacacat

SEQ ID NO: 5487503 - DNA, 14 bp, Homo sapiens
gctcctcacatagc

SEQ ID NO: 5487504 - DNA, 18 bp, Homo sapiens
gctcctcacccagggccc

SEQ ID NO: 5487505 - DNA, 13 bp, Homo sapiens
gctcctcaccccc

SEQ ID NO: 5487506 - DNA, 19 bp, Homo sapiens
gctcctcacccccacccct

SEQ ID NO: 5487507 - DNA, 21 bp, Homo sapiens
gctcctcacccccacccctgt

SEQ ID NO: 5487508 - DNA, 18 bp, Homo sapiens
gctcctcacccctgtagg

SEQ ID NO: 5487509 - DNA, 18 bp, Homo sapiens
gctcctcactgcccgcac

SEQ ID NO: 5487510 - DNA, 23 bp, Homo sapiens
gctcctcactggtatactatcat

SEQ ID NO: 5487511 - DNA, 15 bp, Homo sapiens
gctcctcactgtggt

SEQ ID NO: 5487512 - DNA, 12 bp, Homo sapiens
gctcctcagccc

SEQ ID NO: 5487513 - DNA, 15 bp, Homo sapiens
gctcctcagccctct

SEQ ID NO: 5487514 - DNA, 18 bp, Homo sapiens
gctcctcatccagggctc

SEQ ID NO: 5487515 - DNA, 21 bp, Homo sapiens
gctcctcatccagggctctga

SEQ ID NO: 5487516 - DNA, 19 bp, Homo sapiens
gctcctcatggtgggttca

SEQ ID NO: 5487517 - DNA, 11 bp, Homo sapiens
gctcctccagg

SEQ ID NO: 5487518 - DNA, 15 bp, Homo sapiens
gctcctccagggcca

SEQ ID NO: 5487519 - DNA, 20 bp, Homo sapiens
gctcctccagggtgtgtgct

SEQ ID NO: 5487520 - DNA, 18 bp, Homo sapiens
gctcctccatggtgctgc

SEQ ID NO: 5487521 - DNA, 19 bp, Homo sapiens
gctcctccatggtgctgca

SEQ ID NO: 5487522 - DNA, 11 bp, Homo sapiens
gctcctcccac

SEQ ID NO: 5487523 - DNA, 15 bp, Homo sapiens
gctcctcccagctgt

SEQ ID NO: 5487524 - DNA, 23 bp, Homo sapiens
gctcctcccagcttgtaggagct

SEQ ID NO: 5487525 - DNA, 14 bp, Homo sapiens
gctcctcccctgcc

SEQ ID NO: 5487526 - DNA, 20 bp, Homo sapiens
gctcctcccctgccgcctcc

SEQ ID NO: 5487527 - DNA, 14 bp, Homo sapiens
gctcctcccggtgc

SEQ ID NO: 5487528 - DNA, 16 bp, Homo sapiens
gctcctcccggtgccc

SEQ ID NO: 5487529 - DNA, 19 bp, Homo sapiens
gctcctcccggtgcccaag

SEQ ID NO: 5487530 - DNA, 11 bp, Homo sapiens
gctcctccctc

SEQ ID NO: 5487531 - DNA, 12 bp, Homo sapiens
gctcctccctcc

SEQ ID NO: 5487532 - DNA, 15 bp, Homo sapiens
gctcctccctccagc

SEQ ID NO: 5487533 - DNA, 18 bp, Homo sapiens
gctcctccctccagctgc

SEQ ID NO: 5487534 - DNA, 19 bp, Homo sapiens
gctcctccctccagctgcg

SEQ ID NO: 5487535 - DNA, 12 bp, Homo sapiens
gctcctccctct

SEQ ID NO: 5487536 - DNA, 13 bp, Homo sapiens
gctcctccctctg

SEQ ID NO: 5487537 - DNA, 18 bp, Homo sapiens
gctcctccctctgaccca

SEQ ID NO: 5487538 - DNA, 19 bp, Homo sapiens
gctcctccctctgaggctg

SEQ ID NO: 5487539 - DNA, 16 bp, Homo sapiens
gctcctccctgccccc

SEQ ID NO: 5487540 - DNA, 17 bp, Homo sapiens
gctcctccctgcccccc

SEQ ID NO: 5487541 - DNA, 22 bp, Homo sapiens
gctcctccctgcctcagtggct

SEQ ID NO: 5487542 - DNA, 16 bp, Homo sapiens
gctcctccctgctcct

SEQ ID NO: 5487543 - DNA, 17 bp, Homo sapiens
gctcctccctgctcctc

SEQ ID NO: 5487544 - DNA, 18 bp, Homo sapiens
gctcctccctgctcctca

SEQ ID NO: 5487545 - DNA, 22 bp, Homo sapiens
gctcctccctgctcctcatggg

SEQ ID NO: 5487546 - DNA, 16 bp, Homo sapiens
gctcctccctggagct

SEQ ID NO: 5487547 - DNA, 17 bp, Homo sapiens
gctcctccctggagcta

SEQ ID NO: 5487548 - DNA, 15 bp, Homo sapiens
gctcctccctggctg

SEQ ID NO: 5487549 - DNA, 16 bp, Homo sapiens
gctcctccctggctgc

SEQ ID NO: 5487550 - DNA, 22 bp, Homo sapiens
gctcctccctggctgccctggc

SEQ ID NO: 5487551 - DNA, 23 bp, Homo sapiens
gctcctccctggctgccctggcc

SEQ ID NO: 5487552 - DNA, 15 bp, Homo sapiens
gctcctccctgtgcc

SEQ ID NO: 5487553 - DNA, 19 bp, Homo sapiens
gctcctccctgtgccccca

SEQ ID NO: 5487554 - DNA, 23 bp, Homo sapiens
gctcctccctgtgcccccagcct

SEQ ID NO: 5487555 - DNA, 11 bp, Homo sapiens
gctcctccctt

SEQ ID NO: 5487556 - DNA, 14 bp, Homo sapiens
gctcctcccttgag

SEQ ID NO: 5487557 - DNA, 20 bp, Homo sapiens
gctcctccgtctgaccctct

SEQ ID NO: 5487558 - DNA, 14 bp, Homo sapiens
gctcctccgtgctt

SEQ ID NO: 5487559 - DNA, 17 bp, Homo sapiens
gctcctcctcctgggct

SEQ ID NO: 5487560 - DNA, 18 bp, Homo sapiens
gctcctcctcctgggcta

SEQ ID NO: 5487561 - DNA, 14 bp, Homo sapiens
gctcctcctctctg

SEQ ID NO: 5487562 - DNA, 19 bp, Homo sapiens
gctcctcctctctggactt

SEQ ID NO: 5487563 - DNA, 20 bp, Homo sapiens
gctcctcctcttggagctga

SEQ ID NO: 5487564 - DNA, 20 bp, Homo sapiens
gctcctcctgccctgtccct

SEQ ID NO: 5487565 - DNA, 12 bp, Homo sapiens
gctcctcctgtg

SEQ ID NO: 5487566 - DNA, 12 bp, Homo sapiens
gctcctccttcc

SEQ ID NO: 5487567 - DNA, 21 bp, Homo sapiens
gctcctccttcccagggacca

SEQ ID NO: 5487568 - DNA, 23 bp, Homo sapiens
gctcctccttcccagggaccagc

SEQ ID NO: 5487569 - DNA, 17 bp, Homo sapiens
gctcctccttctgctgc

SEQ ID NO: 5487570 - DNA, 17 bp, Homo sapiens
gctcctcgagggcaggg

SEQ ID NO: 5487571 - DNA, 18 bp, Homo sapiens
gctcctcgagggcaggga

SEQ ID NO: 5487572 - DNA, 13 bp, Homo sapiens
gctcctcgccccc

SEQ ID NO: 5487573 - DNA, 14 bp, Homo sapiens
gctcctcgccccca

SEQ ID NO: 5487574 - DNA, 16 bp, Homo sapiens
gctcctcgcccccacc

SEQ ID NO: 5487575 - DNA, 18 bp, Homo sapiens
gctcctcggccagagctc

SEQ ID NO: 5487576 - DNA, 24 bp, Homo sapiens
gctcctcggccagagctcccagga

SEQ ID NO: 5487577 - DNA, 19 bp, Homo sapiens
gctcctcggtgttacttcc

SEQ ID NO: 5487578 - DNA, 22 bp, Homo sapiens
gctcctcgtctttgaactgccg

SEQ ID NO: 5487579 - DNA, 20 bp, Homo sapiens
gctcctctaggccctgtgag

SEQ ID NO: 5487580 - DNA, 12 bp, Homo sapiens
gctcctctaggg

SEQ ID NO: 5487581 - DNA, 12 bp, Homo sapiens
gctcctctccag

SEQ ID NO: 5487582 - DNA, 14 bp, Homo sapiens
gctcctctccagac

SEQ ID NO: 5487583 - DNA, 16 bp, Homo sapiens
gctcctctccagacac

SEQ ID NO: 5487584 - DNA, 14 bp, Homo sapiens
gctcctctccaggc

SEQ ID NO: 5487585 - DNA, 17 bp, Homo sapiens
gctcctctccaggcacc

SEQ ID NO: 5487586 - DNA, 22 bp, Homo sapiens
gctcctctccaggcacccttct

SEQ ID NO: 5487587 - DNA, 15 bp, Homo sapiens
gctcctctccccagc

SEQ ID NO: 5487588 - DNA, 16 bp, Homo sapiens
gctcctctccccagcc

SEQ ID NO: 5487589 - DNA, 21 bp, Homo sapiens
gctcctctccccagcccagag

SEQ ID NO: 5487590 - DNA, 23 bp, Homo sapiens
gctcctctccccagcccagagac

SEQ ID NO: 5487591 - DNA, 19 bp, Homo sapiens
gctcctctccctcacaagc

SEQ ID NO: 5487592 - DNA, 15 bp, Homo sapiens
gctcctctcctggag

SEQ ID NO: 5487593 - DNA, 17 bp, Homo sapiens
gctcctctcctggagga

SEQ ID NO: 5487594 - DNA, 22 bp, Homo sapiens
gctcctctccttgggctcctgg

SEQ ID NO: 5487595 - DNA, 15 bp, Homo sapiens
gctcctctctttgtg

SEQ ID NO: 5487596 - DNA, 16 bp, Homo sapiens
gctcctctgcagcctg

SEQ ID NO: 5487597 - DNA, 14 bp, Homo sapiens
gctcctctgcctgt

SEQ ID NO: 5487598 - DNA, 18 bp, Homo sapiens
gctcctctgcctgtgccc

SEQ ID NO: 5487599 - DNA, 15 bp, Homo sapiens
gctcctctgccttgg

SEQ ID NO: 5487600 - DNA, 16 bp, Homo sapiens
gctcctctgccttgga

SEQ ID NO: 5487601 - DNA, 18 bp, Homo sapiens
gctcctctgccttggaca

SEQ ID NO: 5487602 - DNA, 15 bp, Homo sapiens
gctcctctgctccac

SEQ ID NO: 5487603 - DNA, 16 bp, Homo sapiens
gctcctctgctgctcc

SEQ ID NO: 5487604 - DNA, 20 bp, Homo sapiens
gctcctctgtcctgcttctg

SEQ ID NO: 5487605 - DNA, 21 bp, Homo sapiens
gctcctctgtctcgagcgccc

SEQ ID NO: 5487606 - DNA, 20 bp, Homo sapiens
gctcctctgttatttgtcct

SEQ ID NO: 5487607 - DNA, 15 bp, Homo sapiens
gctcctctgttcagt

SEQ ID NO: 5487608 - DNA, 23 bp, Homo sapiens
gctcctcttaccgtagcctccgt

SEQ ID NO: 5487609 - DNA, 20 bp, Homo sapiens
gctcctcttagctcagctga

SEQ ID NO: 5487610 - DNA, 16 bp, Homo sapiens
gctcctcttccccaga

SEQ ID NO: 5487611 - DNA, 17 bp, Homo sapiens
gctcctcttgttcctga

SEQ ID NO: 5487612 - DNA, 18 bp, Homo sapiens
gctcctctttcccctcct

SEQ ID NO: 5487613 - DNA, 18 bp, Homo sapiens
gctcctgaatccctttca

SEQ ID NO: 5487614 - DNA, 12 bp, Homo sapiens
gctcctgaccaa

SEQ ID NO: 5487615 - DNA, 15 bp, Homo sapiens
gctcctgaccaaaga

SEQ ID NO: 5487616 - DNA, 20 bp, Homo sapiens
gctcctgaccagttgcagtc

SEQ ID NO: 5487617 - DNA, 24 bp, Homo sapiens
gctcctgaccagttgcagtcactc

SEQ ID NO: 5487618 - DNA, 16 bp, Homo sapiens
gctcctgacccctccc

SEQ ID NO: 5487619 - DNA, 14 bp, Homo sapiens
gctcctgaccttgg

SEQ ID NO: 5487620 - DNA, 15 bp, Homo sapiens
gctcctgagacacat

SEQ ID NO: 5487621 - DNA, 16 bp, Homo sapiens
gctcctgagacacatg

SEQ ID NO: 5487622 - DNA, 16 bp, Homo sapiens
gctcctgagcccccag

SEQ ID NO: 5487623 - DNA, 23 bp, Homo sapiens
gctcctgaggggcatctgcccct

SEQ ID NO: 5487624 - DNA, 21 bp, Homo sapiens
gctcctgagtagctgggcctg

SEQ ID NO: 5487625 - DNA, 22 bp, Homo sapiens
gctcctgagtagctgggcctgt

SEQ ID NO: 5487626 - DNA, 23 bp, Homo sapiens
gctcctgagtagctgggcctgtg

SEQ ID NO: 5487627 - DNA, 20 bp, Homo sapiens
gctcctgcaaaaggaggtga

SEQ ID NO: 5487628 - DNA, 16 bp, Homo sapiens
gctcctgccaaccaca

SEQ ID NO: 5487629 - DNA, 12 bp, Homo sapiens
gctcctgccacc

SEQ ID NO: 5487630 - DNA, 18 bp, Homo sapiens
gctcctgccaccacgccc

SEQ ID NO: 5487631 - DNA, 12 bp, Homo sapiens
gctcctgccagg

SEQ ID NO: 5487632 - DNA, 16 bp, Homo sapiens
gctcctgcccacgtgc

SEQ ID NO: 5487633 - DNA, 18 bp, Homo sapiens
gctcctgcccacgtgcag

SEQ ID NO: 5487634 - DNA, 12 bp, Homo sapiens
gctcctgcccag

SEQ ID NO: 5487635 - DNA, 16 bp, Homo sapiens
gctcctgcccagccac

SEQ ID NO: 5487636 - DNA, 13 bp, Homo sapiens
gctcctgcccagg

SEQ ID NO: 5487637 - DNA, 15 bp, Homo sapiens
gctcctgcccaggag

SEQ ID NO: 5487638 - DNA, 20 bp, Homo sapiens
gctcctgcccaggagcagct

SEQ ID NO: 5487639 - DNA, 14 bp, Homo sapiens
gctcctgcccaggc

SEQ ID NO: 5487640 - DNA, 20 bp, Homo sapiens
gctcctgcccaggccacaga

SEQ ID NO: 5487641 - DNA, 21 bp, Homo sapiens
gctcctgcccaggccacagag

SEQ ID NO: 5487642 - DNA, 22 bp, Homo sapiens
gctcctgcccaggccacagaga

SEQ ID NO: 5487643 - DNA, 14 bp, Homo sapiens
gctcctgcccccat

SEQ ID NO: 5487644 - DNA, 23 bp, Homo sapiens
gctcctgccccgccggccgcgca

SEQ ID NO: 5487645 - DNA, 13 bp, Homo sapiens
gctcctgcccctt

SEQ ID NO: 5487646 - DNA, 21 bp, Homo sapiens
gctcctgcccctttcaggcct

SEQ ID NO: 5487647 - DNA, 23 bp, Homo sapiens
gctcctgccgcagacgggcacag

SEQ ID NO: 5487648 - DNA, 20 bp, Homo sapiens
gctcctgccttgatgaagcc

SEQ ID NO: 5487649 - DNA, 21 bp, Homo sapiens
gctcctgccttgatgaagccc

SEQ ID NO: 5487650 - DNA, 22 bp, Homo sapiens
gctcctgctaacggtgctcagg

SEQ ID NO: 5487651 - DNA, 22 bp, Homo sapiens
gctcctgctcattgtggccagt

SEQ ID NO: 5487652 - DNA, 17 bp, Homo sapiens
gctcctgctccacagcc

SEQ ID NO: 5487653 - DNA, 11 bp, Homo sapiens
gctcctgctgc

SEQ ID NO: 5487654 - DNA, 12 bp, Homo sapiens
gctcctgctgca

SEQ ID NO: 5487655 - DNA, 14 bp, Homo sapiens
gctcctgctgcacc

SEQ ID NO: 5487656 - DNA, 13 bp, Homo sapiens
gctcctgctgggg

SEQ ID NO: 5487657 - DNA, 14 bp, Homo sapiens
gctcctgcttcccc

SEQ ID NO: 5487658 - DNA, 15 bp, Homo sapiens
gctcctgcttcccct

SEQ ID NO: 5487659 - DNA, 16 bp, Homo sapiens
gctcctgcttcccctc

SEQ ID NO: 5487660 - DNA, 19 bp, Homo sapiens
gctcctgcttcccctccct

SEQ ID NO: 5487661 - DNA, 21 bp, Homo sapiens
gctcgtcggggggacagctcc

SEQ ID NO: 5487662 - DNA, 12 bp, Homo sapiens
gctcgtgcagta

SEQ ID NO: 5487663 - DNA, 14 bp, Homo sapiens
gctcgtgcatgtaa

SEQ ID NO: 5487664 - DNA, 22 bp, Homo sapiens
gctcgtggactgagtgggaagc

SEQ ID NO: 5487665 - DNA, 21 bp, Homo sapiens
gctcgtggactgtgctggtgc

SEQ ID NO: 5487666 - DNA, 16 bp, Homo sapiens
gctcgtgggctctggc

SEQ ID NO: 5487667 - DNA, 19 bp, Homo sapiens
gctcgtgggctctggctcc

SEQ ID NO: 5487668 - DNA, 16 bp, Homo sapiens
gctcgtgtatcctggg

SEQ ID NO: 5487669 - DNA, 23 bp, Homo sapiens
gctcgtgtatcctggggctccct

SEQ ID NO: 5487670 - DNA, 17 bp, Homo sapiens
gctcgtgtatttattac

SEQ ID NO: 5487671 - DNA, 23 bp, Homo sapiens
gctcgtgtttcacagtgggcggc

SEQ ID NO: 5487672 - DNA, 18 bp, Homo sapiens
gctcgttacttcagccca

SEQ ID NO: 5487673 - DNA, 15 bp, Homo sapiens
gctcgttcccccagg

SEQ ID NO: 5487674 - DNA, 16 bp, Homo sapiens
gctcgttcccccaggg

SEQ ID NO: 5487675 - DNA, 14 bp, Homo sapiens
gctcgtttctctca

SEQ ID NO: 5487676 - DNA, 23 bp, Homo sapiens
gctcgtttttcagcacccccacc

SEQ ID NO: 5487677 - DNA, 15 bp, Homo sapiens
gctctaaaatattta

SEQ ID NO: 5487678 - DNA, 19 bp, Homo sapiens
gctctaaaatatttatgaa

SEQ ID NO: 5487679 - DNA, 14 bp, Homo sapiens
gctctaaagcagag

SEQ ID NO: 5487680 - DNA, 14 bp, Homo sapiens
gctctaaataaaga

SEQ ID NO: 5487681 - DNA, 19 bp, Homo sapiens
gctctaaataaagacgact

SEQ ID NO: 5487682 - DNA, 14 bp, Homo sapiens
gctctaaattggct

SEQ ID NO: 5487683 - DNA, 19 bp, Homo sapiens
gctctaacattactgcctt

SEQ ID NO: 5487684 - DNA, 13 bp, Homo sapiens
gctctaacgcctg

SEQ ID NO: 5487685 - DNA, 16 bp, Homo sapiens
gctctaacgcctgagc

SEQ ID NO: 5487686 - DNA, 22 bp, Homo sapiens
gctctaacgcctgagcccaggg

SEQ ID NO: 5487687 - DNA, 22 bp, Homo sapiens
gctctaactggacatgaaggaa

SEQ ID NO: 5487688 - DNA, 21 bp, Homo sapiens
gctctaagaagctgcaataaa

SEQ ID NO: 5487689 - DNA, 20 bp, Homo sapiens
gctctaagagcaattctggg

SEQ ID NO: 5487690 - DNA, 18 bp, Homo sapiens
gctctaagcagccaggag

SEQ ID NO: 5487691 - DNA, 13 bp, Homo sapiens
gctctaagcccag

SEQ ID NO: 5487692 - DNA, 15 bp, Homo sapiens
gctctaagcccagga

SEQ ID NO: 5487693 - DNA, 19 bp, Homo sapiens
gctctaaggtactgtgggg

SEQ ID NO: 5487694 - DNA, 20 bp, Homo sapiens
gctctaaggtactgtggggt

SEQ ID NO: 5487695 - DNA, 15 bp, Homo sapiens
gctctaagtctcaac

SEQ ID NO: 5487696 - DNA, 17 bp, Homo sapiens
gctctaatagagtcaca

SEQ ID NO: 5487697 - DNA, 20 bp, Homo sapiens
gctctaatgagcatttcctt

SEQ ID NO: 5487698 - DNA, 15 bp, Homo sapiens
gctctaatgtttgca

SEQ ID NO: 5487699 - DNA, 18 bp, Homo sapiens
gctctaattcttttcaaa

SEQ ID NO: 5487700 - DNA, 12 bp, Homo sapiens
gctctaattgaa

SEQ ID NO: 5487701 - DNA, 13 bp, Homo sapiens
gctctacaggcct

SEQ ID NO: 5487702 - DNA, 14 bp, Homo sapiens
gctctacaggcctg

SEQ ID NO: 5487703 - DNA, 20 bp, Homo sapiens
gctctacaggcctgcagccc

SEQ ID NO: 5487704 - DNA, 17 bp, Homo sapiens
gctctacatcttctgcc

SEQ ID NO: 5487705 - DNA, 18 bp, Homo sapiens
gctctacatcttctgcct

SEQ ID NO: 5487706 - DNA, 19 bp, Homo sapiens
gctctacatcttctgcctt

SEQ ID NO: 5487707 - DNA, 17 bp, Homo sapiens
gctctacattctgctct

SEQ ID NO: 5487708 - DNA, 20 bp, Homo sapiens
gctctacattctgctctgcc

SEQ ID NO: 5487709 - DNA, 19 bp, Homo sapiens
gctctaccaagacataatg

SEQ ID NO: 5487710 - DNA, 22 bp, Homo sapiens
gctctaccaagacataatgcac

SEQ ID NO: 5487711 - DNA, 18 bp, Homo sapiens
gctctacccagggcctgc

SEQ ID NO: 5487712 - DNA, 12 bp, Homo sapiens
gctctacccatg

SEQ ID NO: 5487713 - DNA, 19 bp, Homo sapiens
gctctacccatgagcctgc

SEQ ID NO: 5487714 - DNA, 16 bp, Homo sapiens
gctctaccctgctccc

SEQ ID NO: 5487715 - DNA, 13 bp, Homo sapiens
gctctaccctgtc

SEQ ID NO: 5487716 - DNA, 14 bp, Homo sapiens
gctctaccctgtct

SEQ ID NO: 5487717 - DNA, 17 bp, Homo sapiens
gctctaccctgtctgtc

SEQ ID NO: 5487718 - DNA, 19 bp, Homo sapiens
gctctaccctgtctgtccc

SEQ ID NO: 5487719 - DNA, 20 bp, Homo sapiens
gctctaccctgtctgtccct

SEQ ID NO: 5487720 - DNA, 20 bp, Homo sapiens
gctctaccctgtgctaagca

SEQ ID NO: 5487721 - DNA, 22 bp, Homo sapiens
gctctaccctgtgctaagcacg

SEQ ID NO: 5487722 - DNA, 15 bp, Homo sapiens
gctctacctctcttt

SEQ ID NO: 5487723 - DNA, 15 bp, Homo sapiens
gctctacctggccgg

SEQ ID NO: 5487724 - DNA, 15 bp, Homo sapiens
gctctaccttcctgt

SEQ ID NO: 5487725 - DNA, 13 bp, Homo sapiens
gctctacgggggc

SEQ ID NO: 5487726 - DNA, 16 bp, Homo sapiens
gctctacttccccatg

SEQ ID NO: 5487727 - DNA, 13 bp, Homo sapiens
gctctagaatctg

SEQ ID NO: 5487728 - DNA, 16 bp, Homo sapiens
gctctagacaaccctg

SEQ ID NO: 5487729 - DNA, 20 bp, Homo sapiens
gctctagatcataaggcttc

SEQ ID NO: 5487730 - DNA, 18 bp, Homo sapiens
gctctagatgagctgggc

SEQ ID NO: 5487731 - DNA, 18 bp, Homo sapiens
gctctagattcataaata

SEQ ID NO: 5487732 - DNA, 21 bp, Homo sapiens
gctctagattcataaatacaa

SEQ ID NO: 5487733 - DNA, 23 bp, Homo sapiens
gctctagattgagagaagagaca

SEQ ID NO: 5487734 - DNA, 13 bp, Homo sapiens
gctctagccagga

SEQ ID NO: 5487735 - DNA, 19 bp, Homo sapiens
gctctagccaggagtctgt

SEQ ID NO: 5487736 - DNA, 14 bp, Homo sapiens
gctctagccccagc

SEQ ID NO: 5487737 - DNA, 15 bp, Homo sapiens
gctctagcctctgga

SEQ ID NO: 5487738 - DNA, 13 bp, Homo sapiens
gctctagctggca

SEQ ID NO: 5487739 - DNA, 14 bp, Homo sapiens
gctctagctggcag

SEQ ID NO: 5487740 - DNA, 19 bp, Homo sapiens
gctctagctggcaggacac

SEQ ID NO: 5487741 - DNA, 15 bp, Homo sapiens
gctctaggctgttct

SEQ ID NO: 5487742 - DNA, 16 bp, Homo sapiens
gctctaggctgttctg

SEQ ID NO: 5487743 - DNA, 13 bp, Homo sapiens
gctctagggcagg

SEQ ID NO: 5487744 - DNA, 15 bp, Homo sapiens
gctctagggcctcag

SEQ ID NO: 5487745 - DNA, 24 bp, Homo sapiens
gctctagggttgctggagcctgag

SEQ ID NO: 5487746 - DNA, 15 bp, Homo sapiens
gctctagtgggacag

SEQ ID NO: 5487747 - DNA, 20 bp, Homo sapiens
gctctagtgggacagcccag

SEQ ID NO: 5487748 - DNA, 22 bp, Homo sapiens
gctctagttttcagccttggga

SEQ ID NO: 5487749 - DNA, 13 bp, Homo sapiens
gctctatactgtg

SEQ ID NO: 5487750 - DNA, 15 bp, Homo sapiens
gctctatactgtggc

SEQ ID NO: 5487751 - DNA, 18 bp, Homo sapiens
gctctatctctcaaaact

SEQ ID NO: 5487752 - DNA, 16 bp, Homo sapiens
gctctatctgcaatgt

SEQ ID NO: 5487753 - DNA, 14 bp, Homo sapiens
gctctatctgctgg

SEQ ID NO: 5487754 - DNA, 16 bp, Homo sapiens
gctctatctgctgggc

SEQ ID NO: 5487755 - DNA, 14 bp, Homo sapiens
gctctatgagtcta

SEQ ID NO: 5487756 - DNA, 21 bp, Homo sapiens
gctctatgagtctagatgttt

SEQ ID NO: 5487757 - DNA, 15 bp, Homo sapiens
gctctatgccaggct

SEQ ID NO: 5487758 - DNA, 16 bp, Homo sapiens
gctctatgccaggctg

SEQ ID NO: 5487759 - DNA, 20 bp, Homo sapiens
gctctatggattatccactg

SEQ ID NO: 5487760 - DNA, 21 bp, Homo sapiens
gctctatgggcagatctaccc

SEQ ID NO: 5487761 - DNA, 16 bp, Homo sapiens
gctctatgtcaattga

SEQ ID NO: 5487762 - DNA, 16 bp, Homo sapiens
gctctatgtctgcctt

SEQ ID NO: 5487763 - DNA, 17 bp, Homo sapiens
gctctattctctaaact

SEQ ID NO: 5487764 - DNA, 14 bp, Homo sapiens
gctctatttattaa

SEQ ID NO: 5487765 - DNA, 16 bp, Homo sapiens
gctctatttccccacc

SEQ ID NO: 5487766 - DNA, 23 bp, Homo sapiens
gctctatttcggaaatacactac

SEQ ID NO: 5487767 - DNA, 22 bp, Homo sapiens
gctctcaaatgtgaccatgtga

SEQ ID NO: 5487768 - DNA, 19 bp, Homo sapiens
gctctcaaggcttggagag

SEQ ID NO: 5487769 - DNA, 23 bp, Homo sapiens
gctctcaatatataataaatggg

SEQ ID NO: 5487770 - DNA, 13 bp, Homo sapiens
gctctcacccagt

SEQ ID NO: 5487771 - DNA, 20 bp, Homo sapiens
gctctcacccagtccccacc

SEQ ID NO: 5487772 - DNA, 16 bp, Homo sapiens
gctctcacccccatcc

SEQ ID NO: 5487773 - DNA, 19 bp, Homo sapiens
gctctcaccttggttcctg

SEQ ID NO: 5487774 - DNA, 21 bp, Homo sapiens
gctctcacggccacacagctg

SEQ ID NO: 5487775 - DNA, 23 bp, Homo sapiens
gctctcacggccacacagctgcc

SEQ ID NO: 5487776 - DNA, 11 bp, Homo sapiens
gctctcagaag

SEQ ID NO: 5487777 - DNA, 13 bp, Homo sapiens
gctctcagaagcc

SEQ ID NO: 5487778 - DNA, 12 bp, Homo sapiens
gctctcagaagg

SEQ ID NO: 5487779 - DNA, 14 bp, Homo sapiens
gctctcagcaagtg

SEQ ID NO: 5487780 - DNA, 20 bp, Homo sapiens
gctctcagcaagtgcccagt

SEQ ID NO: 5487781 - DNA, 17 bp, Homo sapiens
gctctcagccaacgagt

SEQ ID NO: 5487782 - DNA, 12 bp, Homo sapiens
gctctcagcctc

SEQ ID NO: 5487783 - DNA, 13 bp, Homo sapiens
gctctcaggccag

SEQ ID NO: 5487784 - DNA, 14 bp, Homo sapiens
gctctcaggccagc

SEQ ID NO: 5487785 - DNA, 16 bp, Homo sapiens
gctctcaggccagctg

SEQ ID NO: 5487786 - DNA, 17 bp, Homo sapiens
gctctcaggccgagagc

SEQ ID NO: 5487787 - DNA, 19 bp, Homo sapiens
gctctcaggctgagggagg

SEQ ID NO: 5487788 - DNA, 15 bp, Homo sapiens
gctctcagtagttta

SEQ ID NO: 5487789 - DNA, 16 bp, Homo sapiens
gctctcatcactacct

SEQ ID NO: 5487790 - DNA, 15 bp, Homo sapiens
gctctcatctgaggc

SEQ ID NO: 5487791 - DNA, 12 bp, Homo sapiens
gctctcatgcct

SEQ ID NO: 5487792 - DNA, 17 bp, Homo sapiens
gctctccaaaccacttt

SEQ ID NO: 5487793 - DNA, 17 bp, Homo sapiens
gctctccaaaggggctg

SEQ ID NO: 5487794 - DNA, 21 bp, Homo sapiens
gctctccaaaggggctgctgg

SEQ ID NO: 5487795 - DNA, 16 bp, Homo sapiens
gctctccaagtgccag

SEQ ID NO: 5487796 - DNA, 18 bp, Homo sapiens
gctctccaagtgccagag

SEQ ID NO: 5487797 - DNA, 11 bp, Homo sapiens
gctctccacca

SEQ ID NO: 5487798 - DNA, 13 bp, Homo sapiens
gctctccaccacc

SEQ ID NO: 5487799 - DNA, 15 bp, Homo sapiens
gctctccaccaccca

SEQ ID NO: 5487800 - DNA, 13 bp, Homo sapiens
gctctccacctca

SEQ ID NO: 5487801 - DNA, 16 bp, Homo sapiens
gctctccacctcagcc

SEQ ID NO: 5487802 - DNA, 20 bp, Homo sapiens
gctctccacctcagccttgg

SEQ ID NO: 5487803 - DNA, 16 bp, Homo sapiens
gctctccagacctgag

SEQ ID NO: 5487804 - DNA, 12 bp, Homo sapiens
gctctccaggcc

SEQ ID NO: 5487805 - DNA, 19 bp, Homo sapiens
gctctccagtcaggaggca

SEQ ID NO: 5487806 - DNA, 16 bp, Homo sapiens
gctctccatactttga

SEQ ID NO: 5487807 - DNA, 17 bp, Homo sapiens
gctctccatcataggct

SEQ ID NO: 5487808 - DNA, 14 bp, Homo sapiens
gctctccatctctt

SEQ ID NO: 5487809 - DNA, 19 bp, Homo sapiens
gctctccattctgctcctt

SEQ ID NO: 5487810 - DNA, 21 bp, Homo sapiens
gctctccattctgctccttcc

SEQ ID NO: 5487811 - DNA, 12 bp, Homo sapiens
gctctcccaagg

SEQ ID NO: 5487812 - DNA, 13 bp, Homo sapiens
gctctcccagtga

SEQ ID NO: 5487813 - DNA, 13 bp, Homo sapiens
gctctcccatgga

SEQ ID NO: 5487814 - DNA, 14 bp, Homo sapiens
gctctccccctgca

SEQ ID NO: 5487815 - DNA, 17 bp, Homo sapiens
gctctccccctgcagcc

SEQ ID NO: 5487816 - DNA, 18 bp, Homo sapiens
gctctccccctgcagccg

SEQ ID NO: 5487817 - DNA, 20 bp, Homo sapiens
gctctccccggcaggcctga

SEQ ID NO: 5487818 - DNA, 16 bp, Homo sapiens
gctctcccctcccttg

SEQ ID NO: 5487819 - DNA, 19 bp, Homo sapiens
gctctcccctcctgctggg

SEQ ID NO: 5487820 - DNA, 18 bp, Homo sapiens
gctctcccctctcgcccc

SEQ ID NO: 5487821 - DNA, 16 bp, Homo sapiens
gctctcccctgccctg

SEQ ID NO: 5487822 - DNA, 19 bp, Homo sapiens
gctctcccctgccctgctg

SEQ ID NO: 5487823 - DNA, 20 bp, Homo sapiens
gctctcccctgcgcaggccc

SEQ ID NO: 5487824 - DNA, 21 bp, Homo sapiens
gctctcccctgcgcaggccct

SEQ ID NO: 5487825 - DNA, 18 bp, Homo sapiens
gctctcccggttcttcca

SEQ ID NO: 5487826 - DNA, 19 bp, Homo sapiens
gctctcccggttcttccag

SEQ ID NO: 5487827 - DNA, 18 bp, Homo sapiens
gctctccctaccttgcct

SEQ ID NO: 5487828 - DNA, 21 bp, Homo sapiens
gctctccctaccttgcctcct

SEQ ID NO: 5487829 - DNA, 15 bp, Homo sapiens
gctctccctctctgc

SEQ ID NO: 5487830 - DNA, 23 bp, Homo sapiens
gctctccctctctgcacctgtct

SEQ ID NO: 5487831 - DNA, 14 bp, Homo sapiens
gctctccctctggc

SEQ ID NO: 5487832 - DNA, 18 bp, Homo sapiens
gctctccctctggccctg

SEQ ID NO: 5487833 - DNA, 19 bp, Homo sapiens
gctctccctctggccctgc

SEQ ID NO: 5487834 - DNA, 15 bp, Homo sapiens
gctctccctcttctc

SEQ ID NO: 5487835 - DNA, 16 bp, Homo sapiens
gctctccctcttctca

SEQ ID NO: 5487836 - DNA, 24 bp, Homo sapiens
gctctccctcttctcaagtgcctt

SEQ ID NO: 5487837 - DNA, 11 bp, Homo sapiens
gctctccctgt

SEQ ID NO: 5487838 - DNA, 15 bp, Homo sapiens
gctctccgagctctg

SEQ ID NO: 5487839 - DNA, 22 bp, Homo sapiens
gctctccggggccatttgcaat

SEQ ID NO: 5487840 - DNA, 10 bp, Homo sapiens
gctctgccca

SEQ ID NO: 5487841 - DNA, 17 bp, Homo sapiens
gctctgcccacctctct

SEQ ID NO: 5487842 - DNA, 17 bp, Homo sapiens
gctctgcccacctgggg

SEQ ID NO: 5487843 - DNA, 16 bp, Homo sapiens
gctctgcccagagctg

SEQ ID NO: 5487844 - DNA, 23 bp, Homo sapiens
gctctgcccaggaactcgcacct

SEQ ID NO: 5487845 - DNA, 18 bp, Homo sapiens
gctctgcccaggcaagga

SEQ ID NO: 5487846 - DNA, 13 bp, Homo sapiens
gctctgcccatgc

SEQ ID NO: 5487847 - DNA, 14 bp, Homo sapiens
gctctgccccaagc

SEQ ID NO: 5487848 - DNA, 16 bp, Homo sapiens
gctctgccccaagccc

SEQ ID NO: 5487849 - DNA, 23 bp, Homo sapiens
gctctgccccaccttgccagggc

SEQ ID NO: 5487850 - DNA, 15 bp, Homo sapiens
gctctgccccagagg

SEQ ID NO: 5487851 - DNA, 16 bp, Homo sapiens
gctctgccccagaggc

SEQ ID NO: 5487852 - DNA, 20 bp, Homo sapiens
gctctgccccagctctggct

SEQ ID NO: 5487853 - DNA, 16 bp, Homo sapiens
gctctgccccaggccc

SEQ ID NO: 5487854 - DNA, 14 bp, Homo sapiens
gctctgcccctcag

SEQ ID NO: 5487855 - DNA, 16 bp, Homo sapiens
gctctgcccctcaggg

SEQ ID NO: 5487856 - DNA, 23 bp, Homo sapiens
gctctgcccctcagggggccagc

SEQ ID NO: 5487857 - DNA, 16 bp, Homo sapiens
gctctgcccctccgtc

SEQ ID NO: 5487858 - DNA, 23 bp, Homo sapiens
gctctgcccctccgtccccaggg

SEQ ID NO: 5487859 - DNA, 12 bp, Homo sapiens
gctctgccctcc

SEQ ID NO: 5487860 - DNA, 19 bp, Homo sapiens
gctctgccctccctggcct

SEQ ID NO: 5487861 - DNA, 12 bp, Homo sapiens
gctctgccctgg

SEQ ID NO: 5487862 - DNA, 18 bp, Homo sapiens
gctctgccctggctgtgg

SEQ ID NO: 5487863 - DNA, 11 bp, Homo sapiens
gctctgccctt

SEQ ID NO: 5487864 - DNA, 13 bp, Homo sapiens
gctctgcccttgg

SEQ ID NO: 5487865 - DNA, 23 bp, Homo sapiens
gctctgcccttggttaggcattg

SEQ ID NO: 5487866 - DNA, 13 bp, Homo sapiens
gctctgcctcaga

SEQ ID NO: 5487867 - DNA, 13 bp, Homo sapiens
gctctgcctccca

SEQ ID NO: 5487868 - DNA, 16 bp, Homo sapiens
gctctgcctcccgggt

SEQ ID NO: 5487869 - DNA, 15 bp, Homo sapiens
gctctgcctcccgtg

SEQ ID NO: 5487870 - DNA, 23 bp, Homo sapiens
gctctgcctccctctccatatct

SEQ ID NO: 5487871 - DNA, 15 bp, Homo sapiens
gctctgcctctaact

SEQ ID NO: 5487872 - DNA, 21 bp, Homo sapiens
gctctgcctctaactccctcc

SEQ ID NO: 5487873 - DNA, 12 bp, Homo sapiens
gctctgcctgga

SEQ ID NO: 5487874 - DNA, 13 bp, Homo sapiens
gctctgcctggag

SEQ ID NO: 5487875 - DNA, 22 bp, Homo sapiens
gctctgccttcgaggtcagagg

SEQ ID NO: 5487876 - DNA, 17 bp, Homo sapiens
gctctgccttctcaggc

SEQ ID NO: 5487877 - DNA, 18 bp, Homo sapiens
gctctgccttctcaggcc

SEQ ID NO: 5487878 - DNA, 20 bp, Homo sapiens
gctctgccttctcaggcccc

SEQ ID NO: 5487879 - DNA, 12 bp, Homo sapiens
gctctgcgccag

SEQ ID NO: 5487880 - DNA, 16 bp, Homo sapiens
gctctgcgtcccactg

SEQ ID NO: 5487881 - DNA, 22 bp, Homo sapiens
gctctgcgtggcgcaggtgcca

SEQ ID NO: 5487882 - DNA, 18 bp, Homo sapiens
gctctgcgttggcttctc

SEQ ID NO: 5487883 - DNA, 22 bp, Homo sapiens
gctctgctacactcgtccccct

SEQ ID NO: 5487884 - DNA, 12 bp, Homo sapiens
gctctgctcaat

SEQ ID NO: 5487885 - DNA, 13 bp, Homo sapiens
gctctgctcgcct

SEQ ID NO: 5487886 - DNA, 14 bp, Homo sapiens
gctctgctgctgat

SEQ ID NO: 5487887 - DNA, 11 bp, Homo sapiens
gctctgctgga

SEQ ID NO: 5487888 - DNA, 12 bp, Homo sapiens
gctctgcttcct

SEQ ID NO: 5487889 - DNA, 19 bp, Homo sapiens
gctctgcttcctcagggcc

SEQ ID NO: 5487890 - DNA, 14 bp, Homo sapiens
gctctgcttttcct

SEQ ID NO: 5487891 - DNA, 15 bp, Homo sapiens
gctctggaagagagg

SEQ ID NO: 5487892 - DNA, 12 bp, Homo sapiens
gctctggaagcc

SEQ ID NO: 5487893 - DNA, 13 bp, Homo sapiens
gctctggaagcct

SEQ ID NO: 5487894 - DNA, 17 bp, Homo sapiens
gctctggaagcctgctg

SEQ ID NO: 5487895 - DNA, 20 bp, Homo sapiens
gctctggaataaagttgcag

SEQ ID NO: 5487896 - DNA, 24 bp, Homo sapiens
gctctggaataaagttgcagatga

SEQ ID NO: 5487897 - DNA, 22 bp, Homo sapiens
gctctggaattgttgaatgtat

SEQ ID NO: 5487898 - DNA, 18 bp, Homo sapiens
gctctggacagcagaagc

SEQ ID NO: 5487899 - DNA, 22 bp, Homo sapiens
gctctggacagccccaccctgg

SEQ ID NO: 5487900 - DNA, 14 bp, Homo sapiens
gctctggacaggca

SEQ ID NO: 5487901 - DNA, 15 bp, Homo sapiens
gctctggacaggcat

SEQ ID NO: 5487902 - DNA, 21 bp, Homo sapiens
gctctggacaggcatgttctc

SEQ ID NO: 5487903 - DNA, 22 bp, Homo sapiens
gctctggaccaaccctgtttcc

SEQ ID NO: 5487904 - DNA, 16 bp, Homo sapiens
gctctggaccagcctg

SEQ ID NO: 5487905 - DNA, 14 bp, Homo sapiens
gctctggacctgcc

SEQ ID NO: 5487906 - DNA, 17 bp, Homo sapiens
gctctggacctgccccc

SEQ ID NO: 5487907 - DNA, 22 bp, Homo sapiens
gctctggacctgcccccgcatc

SEQ ID NO: 5487908 - DNA, 14 bp, Homo sapiens
gctctggacgtgaa

SEQ ID NO: 5487909 - DNA, 21 bp, Homo sapiens
gctctggacgtgaaatacttc

SEQ ID NO: 5487910 - DNA, 13 bp, Homo sapiens
gctctggactcca

SEQ ID NO: 5487911 - DNA, 14 bp, Homo sapiens
gctctggactccac

SEQ ID NO: 5487912 - DNA, 16 bp, Homo sapiens
gctctggactctaaag

SEQ ID NO: 5487913 - DNA, 13 bp, Homo sapiens
gctctggagaaca

SEQ ID NO: 5487914 - DNA, 23 bp, Homo sapiens
gctctggagccacctgtcccacc

SEQ ID NO: 5487915 - DNA, 16 bp, Homo sapiens
gctctggagccagaga

SEQ ID NO: 5487916 - DNA, 15 bp, Homo sapiens
gctctggagcccact

SEQ ID NO: 5487917 - DNA, 23 bp, Homo sapiens
gctctggagcccactgtacttgc

SEQ ID NO: 5487918 - DNA, 15 bp, Homo sapiens
gctctggagcccgcc

SEQ ID NO: 5487919 - DNA, 13 bp, Homo sapiens
gctctggagggga

SEQ ID NO: 5487920 - DNA, 14 bp, Homo sapiens
gctctggcaccatc

SEQ ID NO: 5487921 - DNA, 19 bp, Homo sapiens
gctctggcaccatcagcct

SEQ ID NO: 5487922 - DNA, 14 bp, Homo sapiens
gctctggcaggtgg

SEQ ID NO: 5487923 - DNA, 22 bp, Homo sapiens
gctctggccacaatcctcccca

SEQ ID NO: 5487924 - DNA, 12 bp, Homo sapiens
gctctggccacc

SEQ ID NO: 5487925 - DNA, 18 bp, Homo sapiens
gctctggccaccctggcc

SEQ ID NO: 5487926 - DNA, 17 bp, Homo sapiens
gctctggccccaagatg

SEQ ID NO: 5487927 - DNA, 15 bp, Homo sapiens
gctctggccccgcta

SEQ ID NO: 5487928 - DNA, 17 bp, Homo sapiens
gctctggcctccaagtc

SEQ ID NO: 5487929 - DNA, 11 bp, Homo sapiens
gctctggctcc

SEQ ID NO: 5487930 - DNA, 21 bp, Homo sapiens
gctctggctctccccaatatc

SEQ ID NO: 5487931 - DNA, 19 bp, Homo sapiens
gctctggctgaaccctgtg

SEQ ID NO: 5487932 - DNA, 20 bp, Homo sapiens
gctctggctgaaccctgtgc

SEQ ID NO: 5487933 - DNA, 13 bp, Homo sapiens
gctctggctgctt

SEQ ID NO: 5487934 - DNA, 11 bp, Homo sapiens
gctctgggaag

SEQ ID NO: 5487935 - DNA, 13 bp, Homo sapiens
gctctgggaaggg

SEQ ID NO: 5487936 - DNA, 14 bp, Homo sapiens
gctctgggaagggg

SEQ ID NO: 5487937 - DNA, 16 bp, Homo sapiens
gctctgggaaggggct

SEQ ID NO: 5487938 - DNA, 21 bp, Homo sapiens
gctctgggacgtggacatgcc

SEQ ID NO: 5487939 - DNA, 11 bp, Homo sapiens
gctctgggact

SEQ ID NO: 5487940 - DNA, 13 bp, Homo sapiens
gctctgggactag

SEQ ID NO: 5487941 - DNA, 15 bp, Homo sapiens
gctctgggagagcca

SEQ ID NO: 5487942 - DNA, 19 bp, Homo sapiens
gctctgggagagccagctt

SEQ ID NO: 5487943 - DNA, 18 bp, Homo sapiens
gctctgggagccacgcct

SEQ ID NO: 5487944 - DNA, 17 bp, Homo sapiens
gctctgggatcctgggg

SEQ ID NO: 5487945 - DNA, 11 bp, Homo sapiens
gctctgggcct

SEQ ID NO: 5487946 - DNA, 19 bp, Homo sapiens
gctctgggctcagggctgg

SEQ ID NO: 5487947 - DNA, 13 bp, Homo sapiens
gctctgggctggc

SEQ ID NO: 5487948 - DNA, 14 bp, Homo sapiens
gctctggggatgca

SEQ ID NO: 5487949 - DNA, 17 bp, Homo sapiens
gctctggggatttctgg

SEQ ID NO: 5487950 - DNA, 16 bp, Homo sapiens
gctctgggggacccag

SEQ ID NO: 5487951 - DNA, 14 bp, Homo sapiens
gctctgggggcaga

SEQ ID NO: 5487952 - DNA, 15 bp, Homo sapiens
gctctgggggctcca

SEQ ID NO: 5487953 - DNA, 21 bp, Homo sapiens
gctctggggggcaacctggag

SEQ ID NO: 5487954 - DNA, 23 bp, Homo sapiens
gctctggggggttgcctcgagtc

SEQ ID NO: 5487955 - DNA, 21 bp, Homo sapiens
gctctggggtgggcagttttt

SEQ ID NO: 5487956 - DNA, 18 bp, Homo sapiens
gctctgggtgggcggggc

SEQ ID NO: 5487957 - DNA, 23 bp, Homo sapiens
gctctgggtgggcgtggcctgca

SEQ ID NO: 5487958 - DNA, 13 bp, Homo sapiens
gctctggtcccct

SEQ ID NO: 5487959 - DNA, 16 bp, Homo sapiens
gctctggtctgtaggt

SEQ ID NO: 5487960 - DNA, 20 bp, Homo sapiens
gctctggtgacaccagcctt

SEQ ID NO: 5487961 - DNA, 15 bp, Homo sapiens
gctctggtgcacgcc

SEQ ID NO: 5487962 - DNA, 20 bp, Homo sapiens
gctctggtggccactgagct

SEQ ID NO: 5487963 - DNA, 15 bp, Homo sapiens
gctctggtgggaaaa

SEQ ID NO: 5487964 - DNA, 22 bp, Homo sapiens
gctctggttcctccagccacct

SEQ ID NO: 5487965 - DNA, 23 bp, Homo sapiens
gctctggttcctccagccacctc

SEQ ID NO: 5487966 - DNA, 19 bp, Homo sapiens
gctctggttgtttctgttc

SEQ ID NO: 5487967 - DNA, 17 bp, Homo sapiens
gctctggttttctggtg

SEQ ID NO: 5487968 - DNA, 21 bp, Homo sapiens
gctctgtaacttacacctgga

SEQ ID NO: 5487969 - DNA, 23 bp, Homo sapiens
gctctgtaacttacacctggaat

SEQ ID NO: 5487970 - DNA, 23 bp, Homo sapiens
gctctgtaagtagatgcatttgg

SEQ ID NO: 5487971 - DNA, 23 bp, Homo sapiens
gctctgtaatctcgtttcaaaaa

SEQ ID NO: 5487972 - DNA, 21 bp, Homo sapiens
gctctgtagaaagaatgtgtt

SEQ ID NO: 5487973 - DNA, 15 bp, Homo sapiens
gctctgtagccacct

SEQ ID NO: 5487974 - DNA, 20 bp, Homo sapiens
gctctgtagccacctccttg

SEQ ID NO: 5487975 - DNA, 17 bp, Homo sapiens
gctctgtagcctggtct

SEQ ID NO: 5487976 - DNA, 18 bp, Homo sapiens
gctctgtagcctggtctg

SEQ ID NO: 5487977 - DNA, 20 bp, Homo sapiens
gctctgtagcctggtctgtg

SEQ ID NO: 5487978 - DNA, 23 bp, Homo sapiens
gctctgtatcaggacccagagga

SEQ ID NO: 5487979 - DNA, 23 bp, Homo sapiens
gctctgtattctgcaacagcctg

SEQ ID NO: 5487980 - DNA, 22 bp, Homo sapiens
gctctgtcaccctggccaccac

SEQ ID NO: 5487981 - DNA, 15 bp, Homo sapiens
gctctgtcactgagc

SEQ ID NO: 5487982 - DNA, 16 bp, Homo sapiens
gctctgtcactgagca

SEQ ID NO: 5487983 - DNA, 23 bp, Homo sapiens
gctctgtccaattccagagctgt

SEQ ID NO: 5487984 - DNA, 15 bp, Homo sapiens
gctctgtccactctg

SEQ ID NO: 5487985 - DNA, 14 bp, Homo sapiens
gctctgtccccaaa

SEQ ID NO: 5487986 - DNA, 15 bp, Homo sapiens
gctctgtccccaaag

SEQ ID NO: 5487987 - DNA, 21 bp, Homo sapiens
gctctgtccccaccccatggg

SEQ ID NO: 5487988 - DNA, 17 bp, Homo sapiens
gctctgtcccccaggct

SEQ ID NO: 5487989 - DNA, 15 bp, Homo sapiens
gctctgtcctctgtc

SEQ ID NO: 5487990 - DNA, 15 bp, Homo sapiens
gctctgtcgcccagg

SEQ ID NO: 5487991 - DNA, 18 bp, Homo sapiens
gctctgtcgcccaggctg

SEQ ID NO: 5487992 - DNA, 20 bp, Homo sapiens
gctctgtcgtggtagcagat

SEQ ID NO: 5487993 - DNA, 15 bp, Homo sapiens
gctctgtctacccag

SEQ ID NO: 5487994 - DNA, 17 bp, Homo sapiens
gctctgtctcccaggct

SEQ ID NO: 5487995 - DNA, 13 bp, Homo sapiens
gctctgtcttcct

SEQ ID NO: 5487996 - DNA, 15 bp, Homo sapiens
gctctgtcttcctgg

SEQ ID NO: 5487997 - DNA, 22 bp, Homo sapiens
gctctgtgagggtgctgactgg

SEQ ID NO: 5487998 - DNA, 14 bp, Homo sapiens
gctctgtgcagtca

SEQ ID NO: 5487999 - DNA, 15 bp, Homo sapiens
gctctgtgccagaaa

SEQ ID NO: 5488000 - DNA, 16 bp, Homo sapiens
gctctgtgcccggtgc

SEQ ID NO: 5488001 - DNA, 14 bp, Homo sapiens
gctctgtgccttgg

SEQ ID NO: 5488002 - DNA, 16 bp, Homo sapiens
gctctgtgctgaccct

SEQ ID NO: 5488003 - DNA, 18 bp, Homo sapiens
gctctgtgctgaccctcc

SEQ ID NO: 5488004 - DNA, 19 bp, Homo sapiens
gctctgtggaattcagtga

SEQ ID NO: 5488005 - DNA, 16 bp, Homo sapiens
gctctgtggcctgtgt

SEQ ID NO: 5488006 - DNA, 17 bp, Homo sapiens
gctctgtggcctgtgtc

SEQ ID NO: 5488007 - DNA, 20 bp, Homo sapiens
gctctgtggcctgtgtccag

SEQ ID NO: 5488008 - DNA, 17 bp, Homo sapiens
gctctgtggccttggcc

SEQ ID NO: 5488009 - DNA, 14 bp, Homo sapiens
gctctgtgggaaaa

SEQ ID NO: 5488010 - DNA, 17 bp, Homo sapiens
gctctgtgggtctctgg

SEQ ID NO: 5488011 - DNA, 18 bp, Homo sapiens
gctctgtgggtctctgga

SEQ ID NO: 5488012 - DNA, 20 bp, Homo sapiens
gctctgtgtatatctcttgg

SEQ ID NO: 5488013 - DNA, 17 bp, Homo sapiens
gctctgtgttcccagag

SEQ ID NO: 5488014 - DNA, 18 bp, Homo sapiens
gctctgtgttcccagagg

SEQ ID NO: 5488015 - DNA, 17 bp, Homo sapiens
gctctgtgttgccatgt

SEQ ID NO: 5488016 - DNA, 20 bp, Homo sapiens
gctctgttaataatctcaca

SEQ ID NO: 5488017 - DNA, 20 bp, Homo sapiens
gctctgttacccaggctgga

SEQ ID NO: 5488018 - DNA, 19 bp, Homo sapiens
gctctgttatcagctgggc

SEQ ID NO: 5488019 - DNA, 14 bp, Homo sapiens
gctgaaagccaagg

SEQ ID NO: 5488020 - DNA, 19 bp, Homo sapiens
gctgaaagctggtggcaga

SEQ ID NO: 5488021 - DNA, 17 bp, Homo sapiens
gctgaaagggagcccct

SEQ ID NO: 5488022 - DNA, 16 bp, Homo sapiens
gctgaaagtcctgctt

SEQ ID NO: 5488023 - DNA, 17 bp, Homo sapiens
gctgaaagtcctgcttt

SEQ ID NO: 5488024 - DNA, 20 bp, Homo sapiens
gctgaaataaaagcctctgg

SEQ ID NO: 5488025 - DNA, 20 bp, Homo sapiens
gctgaaataaactagggttt

SEQ ID NO: 5488026 - DNA, 12 bp, Homo sapiens
gctgaaatactg

SEQ ID NO: 5488027 - DNA, 16 bp, Homo sapiens
gctgaaattatgtcaa

SEQ ID NO: 5488028 - DNA, 18 bp, Homo sapiens
gctgaaattatgtcaaat

SEQ ID NO: 5488029 - DNA, 21 bp, Homo sapiens
gctgaaattccagtttaggag

SEQ ID NO: 5488030 - DNA, 16 bp, Homo sapiens
gctgaaattctcctgg

SEQ ID NO: 5488031 - DNA, 17 bp, Homo sapiens
gctgaaattctcctgga

SEQ ID NO: 5488032 - DNA, 19 bp, Homo sapiens
gctgaaattgaaaagttat

SEQ ID NO: 5488033 - DNA, 12 bp, Homo sapiens
gctgaaatttac

SEQ ID NO: 5488034 - DNA, 23 bp, Homo sapiens
gctgaaatttggaaaggaccaaa

SEQ ID NO: 5488035 - DNA, 17 bp, Homo sapiens
gctgaaattttagaaat

SEQ ID NO: 5488036 - DNA, 22 bp, Homo sapiens
gctgaacacagtgtctgttcag

SEQ ID NO: 5488037 - DNA, 16 bp, Homo sapiens
gctgaacacatttctt

SEQ ID NO: 5488038 - DNA, 21 bp, Homo sapiens
gctgaacactccaattaagga

SEQ ID NO: 5488039 - DNA, 15 bp, Homo sapiens
gctgaacaggaaaga

SEQ ID NO: 5488040 - DNA, 19 bp, Homo sapiens
gctgaacaggaaagagcta

SEQ ID NO: 5488041 - DNA, 20 bp, Homo sapiens
gctgaacaggaaagagctag

SEQ ID NO: 5488042 - DNA, 18 bp, Homo sapiens
gctgaacagtgctctgcc

SEQ ID NO: 5488043 - DNA, 20 bp, Homo sapiens
gctgaacagtgctctgcctc

SEQ ID NO: 5488044 - DNA, 13 bp, Homo sapiens
gctgaacagtgga

SEQ ID NO: 5488045 - DNA, 14 bp, Homo sapiens
gctgaacatgcctg

SEQ ID NO: 5488046 - DNA, 15 bp, Homo sapiens
gctgaaccaaagcct

SEQ ID NO: 5488047 - DNA, 14 bp, Homo sapiens
gctgaaccctcagc

SEQ ID NO: 5488048 - DNA, 17 bp, Homo sapiens
gctgaaccctgtgctgg

SEQ ID NO: 5488049 - DNA, 15 bp, Homo sapiens
gctgaacctgtctcc

SEQ ID NO: 5488050 - DNA, 23 bp, Homo sapiens
gctgaacctgttcaaaatgttaa

SEQ ID NO: 5488051 - DNA, 19 bp, Homo sapiens
gctgaacgacagtcccagt

SEQ ID NO: 5488052 - DNA, 15 bp, Homo sapiens
gctgaactcagcaca

SEQ ID NO: 5488053 - DNA, 15 bp, Homo sapiens
gctgaactcatgaga

SEQ ID NO: 5488054 - DNA, 15 bp, Homo sapiens
gctgaactcttcaga

SEQ ID NO: 5488055 - DNA, 16 bp, Homo sapiens
gctgaactcttcagaa

SEQ ID NO: 5488056 - DNA, 13 bp, Homo sapiens
gctgaacttggag

SEQ ID NO: 5488057 - DNA, 13 bp, Homo sapiens
gctgaagaatgaa

SEQ ID NO: 5488058 - DNA, 15 bp, Homo sapiens
gctgaagaatgaaga

SEQ ID NO: 5488059 - DNA, 18 bp, Homo sapiens
gctgaagaattatttttt

SEQ ID NO: 5488060 - DNA, 16 bp, Homo sapiens
gctgaagaattgaaaa

SEQ ID NO: 5488061 - DNA, 13 bp, Homo sapiens
gctgaagacattc

SEQ ID NO: 5488062 - DNA, 16 bp, Homo sapiens
gctgaagagagggaca

SEQ ID NO: 5488063 - DNA, 11 bp, Homo sapiens
gctgaagagca

SEQ ID NO: 5488064 - DNA, 20 bp, Homo sapiens
gctgaagaggttgaagctaa

SEQ ID NO: 5488065 - DNA, 17 bp, Homo sapiens
gctgaagatccccaact

SEQ ID NO: 5488066 - DNA, 20 bp, Homo sapiens
gctgaagatgcccctgctcc

SEQ ID NO: 5488067 - DNA, 14 bp, Homo sapiens
gctgaagatggagg

SEQ ID NO: 5488068 - DNA, 22 bp, Homo sapiens
gctgaagatggagggggctggg

SEQ ID NO: 5488069 - DNA, 23 bp, Homo sapiens
gctgaagatggagggggctgggg

SEQ ID NO: 5488070 - DNA, 13 bp, Homo sapiens
gctgaagatggca

SEQ ID NO: 5488071 - DNA, 15 bp, Homo sapiens
gctgaagccacacag

SEQ ID NO: 5488072 - DNA, 16 bp, Homo sapiens
gctgaagccacacagc

SEQ ID NO: 5488073 - DNA, 21 bp, Homo sapiens
gctgaagccacacagcccaga

SEQ ID NO: 5488074 - DNA, 13 bp, Homo sapiens
gctgaagccagct

SEQ ID NO: 5488075 - DNA, 15 bp, Homo sapiens
gctgaagccagctcc

SEQ ID NO: 5488076 - DNA, 16 bp, Homo sapiens
gctgaagccagctccc

SEQ ID NO: 5488077 - DNA, 13 bp, Homo sapiens
gctgaagcctgga

SEQ ID NO: 5488078 - DNA, 16 bp, Homo sapiens
gctgaagcctggacgc

SEQ ID NO: 5488079 - DNA, 18 bp, Homo sapiens
gctgaagcctggacgcag

SEQ ID NO: 5488080 - DNA, 20 bp, Homo sapiens
gctgaagcctggacgcagcc

SEQ ID NO: 5488081 - DNA, 22 bp, Homo sapiens
gctgaagcctggacgcagccac

SEQ ID NO: 5488082 - DNA, 18 bp, Homo sapiens
gctgaagcggtcagactg

SEQ ID NO: 5488083 - DNA, 15 bp, Homo sapiens
gctgaagctggagca

SEQ ID NO: 5488084 - DNA, 19 bp, Homo sapiens
gctgaaggaaaccagtgca

SEQ ID NO: 5488085 - DNA, 13 bp, Homo sapiens
gctgaaggactgt

SEQ ID NO: 5488086 - DNA, 21 bp, Homo sapiens
gctgaaggactgtgacaggca

SEQ ID NO: 5488087 - DNA, 12 bp, Homo sapiens
gctgaaggcagt

SEQ ID NO: 5488088 - DNA, 23 bp, Homo sapiens
gctgaaggtccaggcttgcctca

SEQ ID NO: 5488089 - DNA, 17 bp, Homo sapiens
gctgaagtgaaggagaa

SEQ ID NO: 5488090 - DNA, 20 bp, Homo sapiens
gctgaagtgaaggagaaagg

SEQ ID NO: 5488091 - DNA, 20 bp, Homo sapiens
gctgaagtgcatgggtcagg

SEQ ID NO: 5488092 - DNA, 19 bp, Homo sapiens
gctgaagtgttctctagaa

SEQ ID NO: 5488093 - DNA, 18 bp, Homo sapiens
gctgaataaatgtctttt

SEQ ID NO: 5488094 - DNA, 15 bp, Homo sapiens
gctgaataacaacaa

SEQ ID NO: 5488095 - DNA, 22 bp, Homo sapiens
gctgaatacagaggcaactgca

SEQ ID NO: 5488096 - DNA, 20 bp, Homo sapiens
gctgaatatctgttcacttt

SEQ ID NO: 5488097 - DNA, 16 bp, Homo sapiens
gctgaatatgcaattt

SEQ ID NO: 5488098 - DNA, 17 bp, Homo sapiens
gctgaatcaaagacatt

SEQ ID NO: 5488099 - DNA, 22 bp, Homo sapiens
gctgaatcaaagacatttcatc

SEQ ID NO: 5488100 - DNA, 18 bp, Homo sapiens
gctgaatccacctcggag

SEQ ID NO: 5488101 - DNA, 19 bp, Homo sapiens
gctgaatcccatcaggctg

SEQ ID NO: 5488102 - DNA, 20 bp, Homo sapiens
gctgaatccttccatttctt

SEQ ID NO: 5488103 - DNA, 19 bp, Homo sapiens
gctgaatgagaagtaaatt

SEQ ID NO: 5488104 - DNA, 15 bp, Homo sapiens
gctgaatgcctcgct

SEQ ID NO: 5488105 - DNA, 17 bp, Homo sapiens
gctgaatggttttcaaa

SEQ ID NO: 5488106 - DNA, 17 bp, Homo sapiens
gctgaatgttgggactg

SEQ ID NO: 5488107 - DNA, 23 bp, Homo sapiens
gctgaatgttgggactgctaaat

SEQ ID NO: 5488108 - DNA, 13 bp, Homo sapiens
gctgaattaaaat

SEQ ID NO: 5488109 - DNA, 16 bp, Homo sapiens
gctgaattaaaatggt

SEQ ID NO: 5488110 - DNA, 23 bp, Homo sapiens
gctgaattattttgttgtgattt

SEQ ID NO: 5488111 - DNA, 17 bp, Homo sapiens
gctgaattcacctgtgg

SEQ ID NO: 5488112 - DNA, 18 bp, Homo sapiens
gctgaattcatctatttc

SEQ ID NO: 5488113 - DNA, 22 bp, Homo sapiens
gctgaattgagcctaaaaataa

SEQ ID NO: 5488114 - DNA, 17 bp, Homo sapiens
gctgaattgtttataat

SEQ ID NO: 5488115 - DNA, 17 bp, Homo sapiens
gctgaatttatatttag

SEQ ID NO: 5488116 - DNA, 14 bp, Homo sapiens
gctgaattttcaca

SEQ ID NO: 5488117 - DNA, 22 bp, Homo sapiens
gctgacaaaaatattttcctag

SEQ ID NO: 5488118 - DNA, 16 bp, Homo sapiens
gctgacaataaaggaa

SEQ ID NO: 5488119 - DNA, 22 bp, Homo sapiens
gctgacaatgctgccatgccca

SEQ ID NO: 5488120 - DNA, 17 bp, Homo sapiens
gctgacacaaacctgcc

SEQ ID NO: 5488121 - DNA, 18 bp, Homo sapiens
gctgacacaaacctgcct

SEQ ID NO: 5488122 - DNA, 16 bp, Homo sapiens
gctgacacctaactct

SEQ ID NO: 5488123 - DNA, 14 bp, Homo sapiens
gctgacacctacca

SEQ ID NO: 5488124 - DNA, 19 bp, Homo sapiens
gctgacacctaccatgctg

SEQ ID NO: 5488125 - DNA, 22 bp, Homo sapiens
gctgacacctaccatgctgctt

SEQ ID NO: 5488126 - DNA, 19 bp, Homo sapiens
gctgacactgtgaccctgg

SEQ ID NO: 5488127 - DNA, 20 bp, Homo sapiens
gctgacactgtgaccctggg

SEQ ID NO: 5488128 - DNA, 22 bp, Homo sapiens
gctgacactgtgaccctgggtc

SEQ ID NO: 5488129 - DNA, 13 bp, Homo sapiens
gctgacagacaca

SEQ ID NO: 5488130 - DNA, 15 bp, Homo sapiens
gctgacagacacagg

SEQ ID NO: 5488131 - DNA, 17 bp, Homo sapiens
gctgacagacacaggcc

SEQ ID NO: 5488132 - DNA, 14 bp, Homo sapiens
gctgacagagccag

SEQ ID NO: 5488133 - DNA, 17 bp, Homo sapiens
gctgacagagccagagg

SEQ ID NO: 5488134 - DNA, 15 bp, Homo sapiens
gctgacagagcccta

SEQ ID NO: 5488135 - DNA, 17 bp, Homo sapiens
gctgacagagctctggg

SEQ ID NO: 5488136 - DNA, 22 bp, Homo sapiens
gctgacagatacatagatggac

SEQ ID NO: 5488137 - DNA, 21 bp, Homo sapiens
gctgacagccacaccgtggca

SEQ ID NO: 5488138 - DNA, 15 bp, Homo sapiens
gctgacagctcttca

SEQ ID NO: 5488139 - DNA, 12 bp, Homo sapiens
gctgacagctgc

SEQ ID NO: 5488140 - DNA, 16 bp, Homo sapiens
gctgacagcttgggag

SEQ ID NO: 5488141 - DNA, 19 bp, Homo sapiens
gctgacaggatgtggcact

SEQ ID NO: 5488142 - DNA, 20 bp, Homo sapiens
gctgacaggatgtggcactg

SEQ ID NO: 5488143 - DNA, 18 bp, Homo sapiens
gctgacaggtgatgctct

SEQ ID NO: 5488144 - DNA, 21 bp, Homo sapiens
gctgacaggtgatgctctggc

SEQ ID NO: 5488145 - DNA, 22 bp, Homo sapiens
gctgacaggtgatgctctggct

SEQ ID NO: 5488146 - DNA, 17 bp, Homo sapiens
gctgacatcagattgtt

SEQ ID NO: 5488147 - DNA, 13 bp, Homo sapiens
gctgacatctgtg

SEQ ID NO: 5488148 - DNA, 16 bp, Homo sapiens
gctgacatcttgaatc

SEQ ID NO: 5488149 - DNA, 21 bp, Homo sapiens
gctgacatgaagctgttgtgt

SEQ ID NO: 5488150 - DNA, 17 bp, Homo sapiens
gctgacattcacctgcc

SEQ ID NO: 5488151 - DNA, 22 bp, Homo sapiens
gctgacattgtggcacattctt

SEQ ID NO: 5488152 - DNA, 13 bp, Homo sapiens
gctgaccaagaga

SEQ ID NO: 5488153 - DNA, 20 bp, Homo sapiens
gctgaccaattgtgctgcca

SEQ ID NO: 5488154 - DNA, 16 bp, Homo sapiens
gctgaccacagcacag

SEQ ID NO: 5488155 - DNA, 17 bp, Homo sapiens
gctgaccacagcacagc

SEQ ID NO: 5488156 - DNA, 21 bp, Homo sapiens
gctgaccacaggcagttactt

SEQ ID NO: 5488157 - DNA, 23 bp, Homo sapiens
gctgaccagaagtggcaggagga

SEQ ID NO: 5488158 - DNA, 17 bp, Homo sapiens
gctgaccagctggagtg

SEQ ID NO: 5488159 - DNA, 18 bp, Homo sapiens
gctgaccaggccctgctc

SEQ ID NO: 5488160 - DNA, 14 bp, Homo sapiens
gctgacccaggaat

SEQ ID NO: 5488161 - DNA, 23 bp, Homo sapiens
gctgacccaggaatagtggacat

SEQ ID NO: 5488162 - DNA, 13 bp, Homo sapiens
gctgacccagtcc

SEQ ID NO: 5488163 - DNA, 14 bp, Homo sapiens
gctgacccatgggc

SEQ ID NO: 5488164 - DNA, 20 bp, Homo sapiens
gctgacccatgggcaggaga

SEQ ID NO: 5488165 - DNA, 21 bp, Homo sapiens
gctgacccatgggcaggagac

SEQ ID NO: 5488166 - DNA, 12 bp, Homo sapiens
gctgaccccagg

SEQ ID NO: 5488167 - DNA, 14 bp, Homo sapiens
gctgaccccctccc

SEQ ID NO: 5488168 - DNA, 16 bp, Homo sapiens
gctgaccccctccccc

SEQ ID NO: 5488169 - DNA, 21 bp, Homo sapiens
gctgacccctctggtgtgtgg

SEQ ID NO: 5488170 - DNA, 14 bp, Homo sapiens
gctgaccctcctgt

SEQ ID NO: 5488171 - DNA, 18 bp, Homo sapiens
gctgacctctcactgcct

SEQ ID NO: 5488172 - DNA, 23 bp, Homo sapiens
gctgacctgcctctcacacacat

SEQ ID NO: 5488173 - DNA, 19 bp, Homo sapiens
gctgaccttcacccagagc

SEQ ID NO: 5488174 - DNA, 18 bp, Homo sapiens
gctgaccttcctcgcaga

SEQ ID NO: 5488175 - DNA, 21 bp, Homo sapiens
gctgaccttgaactcctgggc

SEQ ID NO: 5488176 - DNA, 14 bp, Homo sapiens
gctgaccttgctga

SEQ ID NO: 5488177 - DNA, 19 bp, Homo sapiens
gctgacctttttatcttga

SEQ ID NO: 5488178 - DNA, 18 bp, Homo sapiens
gctgacgaggctgggcca

SEQ ID NO: 5488179 - DNA, 21 bp, Homo sapiens
gctgacgccaataataaaaaa

SEQ ID NO: 5488180 - DNA, 13 bp, Homo sapiens
gctgacggccagg

SEQ ID NO: 5488181 - DNA, 19 bp, Homo sapiens
gctgacgggacccacatgc

SEQ ID NO: 5488182 - DNA, 21 bp, Homo sapiens
gctgacgggaggccccagctc

SEQ ID NO: 5488183 - DNA, 17 bp, Homo sapiens
gctgacggtgcagtctg

SEQ ID NO: 5488184 - DNA, 20 bp, Homo sapiens
gctgactaaactttttttct

SEQ ID NO: 5488185 - DNA, 14 bp, Homo sapiens
gctgactaaatttg

SEQ ID NO: 5488186 - DNA, 16 bp, Homo sapiens
gctgactacagggccg

SEQ ID NO: 5488187 - DNA, 17 bp, Homo sapiens
gctgactacagggccgc

SEQ ID NO: 5488188 - DNA, 15 bp, Homo sapiens
gctgactagaagggc

SEQ ID NO: 5488189 - DNA, 13 bp, Homo sapiens
gctgactagatct

SEQ ID NO: 5488190 - DNA, 22 bp, Homo sapiens
gctgactataatgcctctcctt

SEQ ID NO: 5488191 - DNA, 20 bp, Homo sapiens
gctgactatttgacccccac

SEQ ID NO: 5488192 - DNA, 15 bp, Homo sapiens
gctgactcagtgcag

SEQ ID NO: 5488193 - DNA, 21 bp, Homo sapiens
gctgactccacgatcctgcca

SEQ ID NO: 5488194 - DNA, 15 bp, Homo sapiens
gctgactgaatgcag

SEQ ID NO: 5488195 - DNA, 18 bp, Homo sapiens
gctgactgatgttgaggg

SEQ ID NO: 5488196 - DNA, 18 bp, Homo sapiens
gctgaggcttgggcccag

SEQ ID NO: 5488197 - DNA, 21 bp, Homo sapiens
gctgagggaccgagcccagca

SEQ ID NO: 5488198 - DNA, 23 bp, Homo sapiens
gctgagggaccgagcccagcaga

SEQ ID NO: 5488199 - DNA, 20 bp, Homo sapiens
gctgagggaccttggagagc

SEQ ID NO: 5488200 - DNA, 15 bp, Homo sapiens
gctgagggaggcaga

SEQ ID NO: 5488201 - DNA, 22 bp, Homo sapiens
gctgagggaggcagaaagggaa

SEQ ID NO: 5488202 - DNA, 20 bp, Homo sapiens
gctgagggagggagccatgg

SEQ ID NO: 5488203 - DNA, 21 bp, Homo sapiens
gctgagggatggactgatgct

SEQ ID NO: 5488204 - DNA, 16 bp, Homo sapiens
gctgagggcagactgg

SEQ ID NO: 5488205 - DNA, 22 bp, Homo sapiens
gctgagggcagggttctagaag

SEQ ID NO: 5488206 - DNA, 16 bp, Homo sapiens
gctgagggcctgctgg

SEQ ID NO: 5488207 - DNA, 22 bp, Homo sapiens
gctgagggcctgctggaggcct

SEQ ID NO: 5488208 - DNA, 23 bp, Homo sapiens
gctgagggcctgctggaggcctc

SEQ ID NO: 5488209 - DNA, 23 bp, Homo sapiens
gctgagggctgccagcagccccg

SEQ ID NO: 5488210 - DNA, 23 bp, Homo sapiens
gctgaggggcaacgaagaaaaaa

SEQ ID NO: 5488211 - DNA, 17 bp, Homo sapiens
gctgaggggcttgggaa

SEQ ID NO: 5488212 - DNA, 21 bp, Homo sapiens
gctgaggggggccgtgcccag

SEQ ID NO: 5488213 - DNA, 23 bp, Homo sapiens
gctgaggggggccgtgcccaggg

SEQ ID NO: 5488214 - DNA, 11 bp, Homo sapiens
gctgagggtcg

SEQ ID NO: 5488215 - DNA, 15 bp, Homo sapiens
gctgaggtgagaaga

SEQ ID NO: 5488216 - DNA, 16 bp, Homo sapiens
gctgaggtgcccagga

SEQ ID NO: 5488217 - DNA, 18 bp, Homo sapiens
gctgaggtgcccaggaga

SEQ ID NO: 5488218 - DNA, 11 bp, Homo sapiens
gctgaggtggg

SEQ ID NO: 5488219 - DNA, 15 bp, Homo sapiens
gctgaggtgggagga

SEQ ID NO: 5488220 - DNA, 19 bp, Homo sapiens
gctgaggtgggaggatcac

SEQ ID NO: 5488221 - DNA, 18 bp, Homo sapiens
gctgaggtgggcagatca

SEQ ID NO: 5488222 - DNA, 14 bp, Homo sapiens
gctgaggtgggcct

SEQ ID NO: 5488223 - DNA, 19 bp, Homo sapiens
gctgaggtgggccttccat

SEQ ID NO: 5488224 - DNA, 13 bp, Homo sapiens
gctgaggtgggga

SEQ ID NO: 5488225 - DNA, 23 bp, Homo sapiens
gctgaggtggtaggatcacctga

SEQ ID NO: 5488226 - DNA, 20 bp, Homo sapiens
gctgaggtgtctggcctgag

SEQ ID NO: 5488227 - DNA, 16 bp, Homo sapiens
gctgaggttcctctgc

SEQ ID NO: 5488228 - DNA, 16 bp, Homo sapiens
gctgaggttgggaagg

SEQ ID NO: 5488229 - DNA, 22 bp, Homo sapiens
gctgaggttgggaaggcacctg

SEQ ID NO: 5488230 - DNA, 15 bp, Homo sapiens
gctgaggttttgaat

SEQ ID NO: 5488231 - DNA, 15 bp, Homo sapiens
gctgagtaaacataa

SEQ ID NO: 5488232 - DNA, 20 bp, Homo sapiens
gctgagtatggagcagcctg

SEQ ID NO: 5488233 - DNA, 16 bp, Homo sapiens
gctgagtattaaaatg

SEQ ID NO: 5488234 - DNA, 23 bp, Homo sapiens
gctgagtcatctgttagggcctt

SEQ ID NO: 5488235 - DNA, 21 bp, Homo sapiens
gctgagtcccaggctgagcct

SEQ ID NO: 5488236 - DNA, 15 bp, Homo sapiens
gctgagtcctttcca

SEQ ID NO: 5488237 - DNA, 23 bp, Homo sapiens
gctgagtcgctctcatgaagccc

SEQ ID NO: 5488238 - DNA, 19 bp, Homo sapiens
gctgagtcggctgggcagg

SEQ ID NO: 5488239 - DNA, 22 bp, Homo sapiens
gctgagtcggctgggcagggcc

SEQ ID NO: 5488240 - DNA, 14 bp, Homo sapiens
gctgagtctcccaa

SEQ ID NO: 5488241 - DNA, 18 bp, Homo sapiens
gctgagtctgaaggctgg

SEQ ID NO: 5488242 - DNA, 18 bp, Homo sapiens
gctgagtctgaattctgc

SEQ ID NO: 5488243 - DNA, 17 bp, Homo sapiens
gctgagtctgcagatga

SEQ ID NO: 5488244 - DNA, 14 bp, Homo sapiens
gctgagtctggcta

SEQ ID NO: 5488245 - DNA, 16 bp, Homo sapiens
gctgagtctggctagg

SEQ ID NO: 5488246 - DNA, 21 bp, Homo sapiens
gctgagtgactgtaggcaggg

SEQ ID NO: 5488247 - DNA, 18 bp, Homo sapiens
gctgagtgcactcctggt

SEQ ID NO: 5488248 - DNA, 19 bp, Homo sapiens
gctgagtgcactcctggtg

SEQ ID NO: 5488249 - DNA, 17 bp, Homo sapiens
gctgagtgcagccaaag

SEQ ID NO: 5488250 - DNA, 14 bp, Homo sapiens
gctgagtgcaggcc

SEQ ID NO: 5488251 - DNA, 19 bp, Homo sapiens
gctgagtgcgaccaccact

SEQ ID NO: 5488252 - DNA, 16 bp, Homo sapiens
gctgagtgctatgtgt

SEQ ID NO: 5488253 - DNA, 18 bp, Homo sapiens
gctgagtgctgggcactg

SEQ ID NO: 5488254 - DNA, 13 bp, Homo sapiens
gctgagtggcagc

SEQ ID NO: 5488255 - DNA, 14 bp, Homo sapiens
gctgagtggcagca

SEQ ID NO: 5488256 - DNA, 15 bp, Homo sapiens
gctgagtggcagcag

SEQ ID NO: 5488257 - DNA, 17 bp, Homo sapiens
gctgagtggcaggggac

SEQ ID NO: 5488258 - DNA, 19 bp, Homo sapiens
gctgagtggccagccagtg

SEQ ID NO: 5488259 - DNA, 16 bp, Homo sapiens
gctgagtggtccacat

SEQ ID NO: 5488260 - DNA, 23 bp, Homo sapiens
gctgagttccttataagaattaa

SEQ ID NO: 5488261 - DNA, 15 bp, Homo sapiens
gctgagttctgggtt

SEQ ID NO: 5488262 - DNA, 15 bp, Homo sapiens
gctgagttctggttc

SEQ ID NO: 5488263 - DNA, 23 bp, Homo sapiens
gctgagttggcctggccatttcc

SEQ ID NO: 5488264 - DNA, 23 bp, Homo sapiens
gctgagttgggggtgtggctctg

SEQ ID NO: 5488265 - DNA, 16 bp, Homo sapiens
gctgagttgttctaac

SEQ ID NO: 5488266 - DNA, 15 bp, Homo sapiens
gctgagtttcctatg

SEQ ID NO: 5488267 - DNA, 16 bp, Homo sapiens
gctgataaatttaatc

SEQ ID NO: 5488268 - DNA, 18 bp, Homo sapiens
gctgataaccgtccttca

SEQ ID NO: 5488269 - DNA, 17 bp, Homo sapiens
gctgataagcattgact

SEQ ID NO: 5488270 - DNA, 19 bp, Homo sapiens
gctgataaggaaactttat

SEQ ID NO: 5488271 - DNA, 15 bp, Homo sapiens
gctgataattttaaa

SEQ ID NO: 5488272 - DNA, 18 bp, Homo sapiens
gctgatacataactaaat

SEQ ID NO: 5488273 - DNA, 23 bp, Homo sapiens
gctgatacataactaaatttgat

SEQ ID NO: 5488274 - DNA, 14 bp, Homo sapiens
gctgatacttcatt

SEQ ID NO: 5488275 - DNA, 19 bp, Homo sapiens
gctgatagcatatattcat

SEQ ID NO: 5488276 - DNA, 13 bp, Homo sapiens
gctgatagtgttt

SEQ ID NO: 5488277 - DNA, 22 bp, Homo sapiens
gctgatagtgtttcgttaagca

SEQ ID NO: 5488278 - DNA, 13 bp, Homo sapiens
gctgatataaatt

SEQ ID NO: 5488279 - DNA, 20 bp, Homo sapiens
gctgatatatgtgtttttca

SEQ ID NO: 5488280 - DNA, 22 bp, Homo sapiens
gctgatattatttcttctctta

SEQ ID NO: 5488281 - DNA, 20 bp, Homo sapiens
gctgatcaatctgcagtttg

SEQ ID NO: 5488282 - DNA, 20 bp, Homo sapiens
gctgatcagagttcctccta

SEQ ID NO: 5488283 - DNA, 13 bp, Homo sapiens
gctgatcattgga

SEQ ID NO: 5488284 - DNA, 22 bp, Homo sapiens
gctgatccagtaacctcggaga

SEQ ID NO: 5488285 - DNA, 24 bp, Homo sapiens
gctgatccataggactaccgcagg

SEQ ID NO: 5488286 - DNA, 23 bp, Homo sapiens
gctgatcccggccggccctggct

SEQ ID NO: 5488287 - DNA, 21 bp, Homo sapiens
gctgatccctgctctctgagt

SEQ ID NO: 5488288 - DNA, 13 bp, Homo sapiens
gctgatcctgctg

SEQ ID NO: 5488289 - DNA, 15 bp, Homo sapiens
gctgatcctgctgac

SEQ ID NO: 5488290 - DNA, 18 bp, Homo sapiens
gctgatcctgctgacctc

SEQ ID NO: 5488291 - DNA, 15 bp, Homo sapiens
gctgatcgcttctcc

SEQ ID NO: 5488292 - DNA, 21 bp, Homo sapiens
gctgatctcagggaagcccag

SEQ ID NO: 5488293 - DNA, 19 bp, Homo sapiens
gctgatctttaactggaag

SEQ ID NO: 5488294 - DNA, 13 bp, Homo sapiens
gctgatgaagaag

SEQ ID NO: 5488295 - DNA, 15 bp, Homo sapiens
gctgatgaagaaggg

SEQ ID NO: 5488296 - DNA, 17 bp, Homo sapiens
gctgatgaatcactgtt

SEQ ID NO: 5488297 - DNA, 22 bp, Homo sapiens
gctgatgactcaagattcccag

SEQ ID NO: 5488298 - DNA, 23 bp, Homo sapiens
gctgatgactcaagattcccagg

SEQ ID NO: 5488299 - DNA, 15 bp, Homo sapiens
gctgatgatccagaa

SEQ ID NO: 5488300 - DNA, 20 bp, Homo sapiens
gctgatgatttgtttttgta

SEQ ID NO: 5488301 - DNA, 11 bp, Homo sapiens
gctgatgcaga

SEQ ID NO: 5488302 - DNA, 15 bp, Homo sapiens
gctgatgcaggattt

SEQ ID NO: 5488303 - DNA, 17 bp, Homo sapiens
gctgatgcattcccggt

SEQ ID NO: 5488304 - DNA, 21 bp, Homo sapiens
gctgatgcattcccggtgcag

SEQ ID NO: 5488305 - DNA, 22 bp, Homo sapiens
gctgatgcattcccggtgcaga

SEQ ID NO: 5488306 - DNA, 17 bp, Homo sapiens
gctgatgcctccttggc

SEQ ID NO: 5488307 - DNA, 15 bp, Homo sapiens
gctgatgctcatggt

SEQ ID NO: 5488308 - DNA, 16 bp, Homo sapiens
gctgatgctgaaataa

SEQ ID NO: 5488309 - DNA, 14 bp, Homo sapiens
gctgatgctgggct

SEQ ID NO: 5488310 - DNA, 16 bp, Homo sapiens
gctgatggaggaaaaa

SEQ ID NO: 5488311 - DNA, 18 bp, Homo sapiens
gctgatggaggaaaaagg

SEQ ID NO: 5488312 - DNA, 23 bp, Homo sapiens
gctgatggataacctatatgatt

SEQ ID NO: 5488313 - DNA, 16 bp, Homo sapiens
gctgatggcccctcca

SEQ ID NO: 5488314 - DNA, 13 bp, Homo sapiens
gctgatggccctc

SEQ ID NO: 5488315 - DNA, 13 bp, Homo sapiens
gctgatggcctgg

SEQ ID NO: 5488316 - DNA, 13 bp, Homo sapiens
gctgatggctgcc

SEQ ID NO: 5488317 - DNA, 13 bp, Homo sapiens
gctgatggctgct

SEQ ID NO: 5488318 - DNA, 16 bp, Homo sapiens
gctgatggctgctgga

SEQ ID NO: 5488319 - DNA, 20 bp, Homo sapiens
gctgatggcttgacatgtgc

SEQ ID NO: 5488320 - DNA, 17 bp, Homo sapiens
gctgatgggaaggaggg

SEQ ID NO: 5488321 - DNA, 20 bp, Homo sapiens
gctgatgggaaggaggggag

SEQ ID NO: 5488322 - DNA, 16 bp, Homo sapiens
gctgatgggtgccctt

SEQ ID NO: 5488323 - DNA, 17 bp, Homo sapiens
gctgatgggtggacctg

SEQ ID NO: 5488324 - DNA, 15 bp, Homo sapiens
gctgatggtgcaatg

SEQ ID NO: 5488325 - DNA, 16 bp, Homo sapiens
gctgatggtgcaatga

SEQ ID NO: 5488326 - DNA, 16 bp, Homo sapiens
gctgatgtaggagctg

SEQ ID NO: 5488327 - DNA, 15 bp, Homo sapiens
gctgatgtagtgacc

SEQ ID NO: 5488328 - DNA, 20 bp, Homo sapiens
gctgatgtcaatttctgtgt

SEQ ID NO: 5488329 - DNA, 14 bp, Homo sapiens
gctgatgttcagtg

SEQ ID NO: 5488330 - DNA, 23 bp, Homo sapiens
gctgatgttttgtattttgtgtt

SEQ ID NO: 5488331 - DNA, 15 bp, Homo sapiens
gctgattactgaaat

SEQ ID NO: 5488332 - DNA, 14 bp, Homo sapiens
gctgattcagcatt

SEQ ID NO: 5488333 - DNA, 15 bp, Homo sapiens
gctgattcccagagc

SEQ ID NO: 5488334 - DNA, 23 bp, Homo sapiens
gctgattcctaaaactctgccag

SEQ ID NO: 5488335 - DNA, 16 bp, Homo sapiens
gctgattcctaaggcc

SEQ ID NO: 5488336 - DNA, 23 bp, Homo sapiens
gctgattcctaaggcccagctgc

SEQ ID NO: 5488337 - DNA, 17 bp, Homo sapiens
gctgattcctcgtgtcc

SEQ ID NO: 5488338 - DNA, 19 bp, Homo sapiens
gctgattcctctcatttcc

SEQ ID NO: 5488339 - DNA, 13 bp, Homo sapiens
gctgattctcagg

SEQ ID NO: 5488340 - DNA, 21 bp, Homo sapiens
gctgattgcagaaaggagaga

SEQ ID NO: 5488341 - DNA, 14 bp, Homo sapiens
gctgattggaaaat

SEQ ID NO: 5488342 - DNA, 22 bp, Homo sapiens
gctgattgtcaacacaaactgg

SEQ ID NO: 5488343 - DNA, 19 bp, Homo sapiens
gctgatttaaacacattaa

SEQ ID NO: 5488344 - DNA, 19 bp, Homo sapiens
gctgatttacatgtatggt

SEQ ID NO: 5488345 - DNA, 17 bp, Homo sapiens
gctgatttccaggcccc

SEQ ID NO: 5488346 - DNA, 20 bp, Homo sapiens
gctgatttccaggcccctga

SEQ ID NO: 5488347 - DNA, 23 bp, Homo sapiens
gctgatttctaggtaggaaatgt

SEQ ID NO: 5488348 - DNA, 21 bp, Homo sapiens
gctgatttggtcaccttcctc

SEQ ID NO: 5488349 - DNA, 14 bp, Homo sapiens
gctgattttaacaa

SEQ ID NO: 5488350 - DNA, 20 bp, Homo sapiens
gctgattttaacaataacta

SEQ ID NO: 5488351 - DNA, 14 bp, Homo sapiens
gctgattttaatgg

SEQ ID NO: 5488352 - DNA, 12 bp, Homo sapiens
gctgattttatt

SEQ ID NO: 5488353 - DNA, 18 bp, Homo sapiens
gctgattttcatgaaaat

SEQ ID NO: 5488354 - DNA, 22 bp, Homo sapiens
gctgattttcatgaaaatctgc

SEQ ID NO: 5488355 - DNA, 16 bp, Homo sapiens
gctgattttcttcttt

SEQ ID NO: 5488356 - DNA, 16 bp, Homo sapiens
gctgattttgaccttg

SEQ ID NO: 5488357 - DNA, 20 bp, Homo sapiens
gctgattttttttttaactt

SEQ ID NO: 5488358 - DNA, 16 bp, Homo sapiens
gctgcaaaaattatat

SEQ ID NO: 5488359 - DNA, 22 bp, Homo sapiens
gctgcaaaagaagtttctggag

SEQ ID NO: 5488360 - DNA, 15 bp, Homo sapiens
gctgcaaaaggcctg

SEQ ID NO: 5488361 - DNA, 17 bp, Homo sapiens
gctgcaaaatgaagaca

SEQ ID NO: 5488362 - DNA, 14 bp, Homo sapiens
gctgcaaaattaaa

SEQ ID NO: 5488363 - DNA, 19 bp, Homo sapiens
gctgcaaagagaaaccgct

SEQ ID NO: 5488364 - DNA, 15 bp, Homo sapiens
gctgcaaaggagaag

SEQ ID NO: 5488365 - DNA, 22 bp, Homo sapiens
gctgcaaaggagaagcacagct

SEQ ID NO: 5488366 - DNA, 14 bp, Homo sapiens
gctgcaaagtatgc

SEQ ID NO: 5488367 - DNA, 21 bp, Homo sapiens
gctgcaaataaggacagcagc

SEQ ID NO: 5488368 - DNA, 14 bp, Homo sapiens
gctgcaacaaaatg

SEQ ID NO: 5488369 - DNA, 14 bp, Homo sapiens
gctgcaacaagctc

SEQ ID NO: 5488370 - DNA, 19 bp, Homo sapiens
gctgcaacttttttatgtc

SEQ ID NO: 5488371 - DNA, 18 bp, Homo sapiens
gctgcaagcacagccctt

SEQ ID NO: 5488372 - DNA, 16 bp, Homo sapiens
gctgcattccagagca

SEQ ID NO: 5488373 - DNA, 14 bp, Homo sapiens
gctgcatttcaagt

SEQ ID NO: 5488374 - DNA, 18 bp, Homo sapiens
gctgcatttcacatgcct

SEQ ID NO: 5488375 - DNA, 13 bp, Homo sapiens
gctgcattttata

SEQ ID NO: 5488376 - DNA, 14 bp, Homo sapiens
gctgccaaaaccac

SEQ ID NO: 5488377 - DNA, 20 bp, Homo sapiens
gctgccaaaaccacatgggc

SEQ ID NO: 5488378 - DNA, 22 bp, Homo sapiens
gctgccaaaaccacatgggctg

SEQ ID NO: 5488379 - DNA, 20 bp, Homo sapiens
gctgccaagagtgaagggaa

SEQ ID NO: 5488380 - DNA, 21 bp, Homo sapiens
gctgccaagataccttcatgg

SEQ ID NO: 5488381 - DNA, 21 bp, Homo sapiens
gctgccaagcactcgagacca

SEQ ID NO: 5488382 - DNA, 16 bp, Homo sapiens
gctgccaagtgctctt

SEQ ID NO: 5488383 - DNA, 14 bp, Homo sapiens
gctgccaatatcct

SEQ ID NO: 5488384 - DNA, 15 bp, Homo sapiens
gctgccaatatccta

SEQ ID NO: 5488385 - DNA, 18 bp, Homo sapiens
gctgccaatatcctaata

SEQ ID NO: 5488386 - DNA, 21 bp, Homo sapiens
gctgccaatatcctaataaaa

SEQ ID NO: 5488387 - DNA, 23 bp, Homo sapiens
gctgccaatatcctaataaaaag

SEQ ID NO: 5488388 - DNA, 15 bp, Homo sapiens
gctgccaatgggagc

SEQ ID NO: 5488389 - DNA, 21 bp, Homo sapiens
gctgccacaaccagccaggca

SEQ ID NO: 5488390 - DNA, 15 bp, Homo sapiens
gctgccacaacctgt

SEQ ID NO: 5488391 - DNA, 23 bp, Homo sapiens
gctgccacaccagtcacatgacc

SEQ ID NO: 5488392 - DNA, 22 bp, Homo sapiens
gctgccacacttcaggctcttc

SEQ ID NO: 5488393 - DNA, 22 bp, Homo sapiens
gctgccacagtaatactcattc

SEQ ID NO: 5488394 - DNA, 16 bp, Homo sapiens
gctgccaccacgtctg

SEQ ID NO: 5488395 - DNA, 19 bp, Homo sapiens
gctgccaccacgtctgcca

SEQ ID NO: 5488396 - DNA, 20 bp, Homo sapiens
gctgccaccacgtctgccag

SEQ ID NO: 5488397 - DNA, 23 bp, Homo sapiens
gctgccaccacgtctgccaggcc

SEQ ID NO: 5488398 - DNA, 14 bp, Homo sapiens
gctgccaccagccc

SEQ ID NO: 5488399 - DNA, 13 bp, Homo sapiens
gctgccacccacc

SEQ ID NO: 5488400 - DNA, 23 bp, Homo sapiens
gctgccacccaccccaagctgct

SEQ ID NO: 5488401 - DNA, 20 bp, Homo sapiens
gctgccacccacctccctgc

SEQ ID NO: 5488402 - DNA, 14 bp, Homo sapiens
gctgccacccctct

SEQ ID NO: 5488403 - DNA, 19 bp, Homo sapiens
gctgccacccctcttctgc

SEQ ID NO: 5488404 - DNA, 21 bp, Homo sapiens
gctgccacccctcttctgctc

SEQ ID NO: 5488405 - DNA, 23 bp, Homo sapiens
gctgccacccctcttctgctcct

SEQ ID NO: 5488406 - DNA, 14 bp, Homo sapiens
gctgccacccgccc

SEQ ID NO: 5488407 - DNA, 17 bp, Homo sapiens
gctgccacccgcccacc

SEQ ID NO: 5488408 - DNA, 12 bp, Homo sapiens
gctgccacctgc

SEQ ID NO: 5488409 - DNA, 13 bp, Homo sapiens
gctgccacctgcc

SEQ ID NO: 5488410 - DNA, 19 bp, Homo sapiens
gctgccactaacctgtaga

SEQ ID NO: 5488411 - DNA, 13 bp, Homo sapiens
gctgccactctgc

SEQ ID NO: 5488412 - DNA, 19 bp, Homo sapiens
gctgccactctgctgcctg

SEQ ID NO: 5488413 - DNA, 22 bp, Homo sapiens
gctgccactgggcacctgcgca

SEQ ID NO: 5488414 - DNA, 14 bp, Homo sapiens
gctgccagagaagt

SEQ ID NO: 5488415 - DNA, 13 bp, Homo sapiens
gctgccagcacag

SEQ ID NO: 5488416 - DNA, 16 bp, Homo sapiens
gctgccagcccagctg

SEQ ID NO: 5488417 - DNA, 18 bp, Homo sapiens
gctgccagcccagctggc

SEQ ID NO: 5488418 - DNA, 19 bp, Homo sapiens
gctgccagcccagctggcc

SEQ ID NO: 5488419 - DNA, 21 bp, Homo sapiens
gctgccagcccagctggccgg

SEQ ID NO: 5488420 - DNA, 21 bp, Homo sapiens
gctgccagccgagatagccaa

SEQ ID NO: 5488421 - DNA, 19 bp, Homo sapiens
gctgccagccttgagccct

SEQ ID NO: 5488422 - DNA, 22 bp, Homo sapiens
gctgccaggaaacaagggaagg

SEQ ID NO: 5488423 - DNA, 11 bp, Homo sapiens
gctgccaggac

SEQ ID NO: 5488424 - DNA, 15 bp, Homo sapiens
gctgccaggacacct

SEQ ID NO: 5488425 - DNA, 17 bp, Homo sapiens
gctgccaggacacctgc

SEQ ID NO: 5488426 - DNA, 18 bp, Homo sapiens
gctgccaggacacctgcc

SEQ ID NO: 5488427 - DNA, 20 bp, Homo sapiens
gctgccaggacacctgcccc

SEQ ID NO: 5488428 - DNA, 21 bp, Homo sapiens
gctgccaggacacctgcccca

SEQ ID NO: 5488429 - DNA, 23 bp, Homo sapiens
gctgccaggacacctgccccagc

SEQ ID NO: 5488430 - DNA, 13 bp, Homo sapiens
gctgccaggagca

SEQ ID NO: 5488431 - DNA, 13 bp, Homo sapiens
gctgccaggcggc

SEQ ID NO: 5488432 - DNA, 21 bp, Homo sapiens
gctgccaggcggccctgggga

SEQ ID NO: 5488433 - DNA, 20 bp, Homo sapiens
gctgccaggcgttggtgcca

SEQ ID NO: 5488434 - DNA, 20 bp, Homo sapiens
gctgccaggctttctgtaaa

SEQ ID NO: 5488435 - DNA, 22 bp, Homo sapiens
gctgccagggaagacagagcag

SEQ ID NO: 5488436 - DNA, 13 bp, Homo sapiens
gctgccaggggct

SEQ ID NO: 5488437 - DNA, 15 bp, Homo sapiens
gctgccaggggctct

SEQ ID NO: 5488438 - DNA, 18 bp, Homo sapiens
gctgccaggggctctgtg

SEQ ID NO: 5488439 - DNA, 20 bp, Homo sapiens
gctgccaggggctctgtggc

SEQ ID NO: 5488440 - DNA, 21 bp, Homo sapiens
gctgccaggggctctgtggca

SEQ ID NO: 5488441 - DNA, 17 bp, Homo sapiens
gctgccagtaccagccc

SEQ ID NO: 5488442 - DNA, 16 bp, Homo sapiens
gctgccagtgcagcca

SEQ ID NO: 5488443 - DNA, 19 bp, Homo sapiens
gctgccagtgcagccactg

SEQ ID NO: 5488444 - DNA, 16 bp, Homo sapiens
gctgccagtgctggtc

SEQ ID NO: 5488445 - DNA, 22 bp, Homo sapiens
gctgccagtggggcctgaggct

SEQ ID NO: 5488446 - DNA, 18 bp, Homo sapiens
gctgccagtgtcctgagc

SEQ ID NO: 5488447 - DNA, 19 bp, Homo sapiens
gctgccagtgtcctgagcc

SEQ ID NO: 5488448 - DNA, 14 bp, Homo sapiens
gctgccataattct

SEQ ID NO: 5488449 - DNA, 22 bp, Homo sapiens
gctgccatagggtctgcagcct

SEQ ID NO: 5488450 - DNA, 16 bp, Homo sapiens
gctgccatcaccgctg

SEQ ID NO: 5488451 - DNA, 17 bp, Homo sapiens
gctgccatcaccgctgg

SEQ ID NO: 5488452 - DNA, 18 bp, Homo sapiens
gctgccatcaccgctggg

SEQ ID NO: 5488453 - DNA, 12 bp, Homo sapiens
gctgccatccag

SEQ ID NO: 5488454 - DNA, 18 bp, Homo sapiens
gctgccatcttgcttttc

SEQ ID NO: 5488455 - DNA, 21 bp, Homo sapiens
gctgccatgccactgccaggc

SEQ ID NO: 5488456 - DNA, 14 bp, Homo sapiens
gctgccatgctttg

SEQ ID NO: 5488457 - DNA, 19 bp, Homo sapiens
gctgccatgctttgagtcc

SEQ ID NO: 5488458 - DNA, 13 bp, Homo sapiens
gctgccatgtgaa

SEQ ID NO: 5488459 - DNA, 17 bp, Homo sapiens
gctgccatttccctgaa

SEQ ID NO: 5488460 - DNA, 16 bp, Homo sapiens
gctgcccacaagccat

SEQ ID NO: 5488461 - DNA, 15 bp, Homo sapiens
gctgcccacaccacc

SEQ ID NO: 5488462 - DNA, 18 bp, Homo sapiens
gctgcccaccccctgctg

SEQ ID NO: 5488463 - DNA, 19 bp, Homo sapiens
gctgcccacgctcctgccc

SEQ ID NO: 5488464 - DNA, 16 bp, Homo sapiens
gctgcccactctgggg

SEQ ID NO: 5488465 - DNA, 18 bp, Homo sapiens
gctgcccactctggggac

SEQ ID NO: 5488466 - DNA, 23 bp, Homo sapiens
gctgcccactgtttctcttgagc

SEQ ID NO: 5488467 - DNA, 14 bp, Homo sapiens
gctgcccagacaca

SEQ ID NO: 5488468 - DNA, 15 bp, Homo sapiens
gctgcccagacacat

SEQ ID NO: 5488469 - DNA, 16 bp, Homo sapiens
gctgcccagagctgct

SEQ ID NO: 5488470 - DNA, 22 bp, Homo sapiens
gctgcccagagctgctggtctc

SEQ ID NO: 5488471 - DNA, 17 bp, Homo sapiens
gctgcccagagttgctg

SEQ ID NO: 5488472 - DNA, 21 bp, Homo sapiens
gctgcccagccccgctcaggc

SEQ ID NO: 5488473 - DNA, 13 bp, Homo sapiens
gctgcccagccct

SEQ ID NO: 5488474 - DNA, 15 bp, Homo sapiens
gctgcccagccctcc

SEQ ID NO: 5488475 - DNA, 19 bp, Homo sapiens
gctgcccagccctcccagc

SEQ ID NO: 5488476 - DNA, 15 bp, Homo sapiens
gctgcccagccctgg

SEQ ID NO: 5488477 - DNA, 24 bp, Homo sapiens
gctgcccagccctggcccaggtgc

SEQ ID NO: 5488478 - DNA, 20 bp, Homo sapiens
gctgcccagctgctcccctg

SEQ ID NO: 5488479 - DNA, 12 bp, Homo sapiens
gctgcccaggcc

SEQ ID NO: 5488480 - DNA, 12 bp, Homo sapiens
gctgcccaggct

SEQ ID NO: 5488481 - DNA, 14 bp, Homo sapiens
gctgcccaggctct

SEQ ID NO: 5488482 - DNA, 19 bp, Homo sapiens
gctgcccaggggagccctc

SEQ ID NO: 5488483 - DNA, 21 bp, Homo sapiens
gctgcccatcatgtggcccca

SEQ ID NO: 5488484 - DNA, 21 bp, Homo sapiens
gctgcccatcccagtccctcg

SEQ ID NO: 5488485 - DNA, 19 bp, Homo sapiens
gctgccccacaggtgtgtt

SEQ ID NO: 5488486 - DNA, 15 bp, Homo sapiens
gctgccccacccctc

SEQ ID NO: 5488487 - DNA, 19 bp, Homo sapiens
gctgccccactacaggccc

SEQ ID NO: 5488488 - DNA, 12 bp, Homo sapiens
gctgccccagcc

SEQ ID NO: 5488489 - DNA, 14 bp, Homo sapiens
gctgccccagccag

SEQ ID NO: 5488490 - DNA, 16 bp, Homo sapiens
gctgccccagccagat

SEQ ID NO: 5488491 - DNA, 14 bp, Homo sapiens
gctgccccagcccc

SEQ ID NO: 5488492 - DNA, 15 bp, Homo sapiens
gctgccccagccccg

SEQ ID NO: 5488493 - DNA, 18 bp, Homo sapiens
gctgccccagcgtcttga

SEQ ID NO: 5488494 - DNA, 13 bp, Homo sapiens
gctgccccaggcc

SEQ ID NO: 5488495 - DNA, 18 bp, Homo sapiens
gctgccccatcagtgctc

SEQ ID NO: 5488496 - DNA, 21 bp, Homo sapiens
gctgccccatgaagccacagc

SEQ ID NO: 5488497 - DNA, 20 bp, Homo sapiens
gctgccccattccagctctc

SEQ ID NO: 5488498 - DNA, 20 bp, Homo sapiens
gctgcccccaacactccagg

SEQ ID NO: 5488499 - DNA, 13 bp, Homo sapiens
gctgcccccacag

SEQ ID NO: 5488500 - DNA, 14 bp, Homo sapiens
gctgcccccacaga

SEQ ID NO: 5488501 - DNA, 19 bp, Homo sapiens
gctgcccccacagatccat

SEQ ID NO: 5488502 - DNA, 15 bp, Homo sapiens
gctgcccccagaccc

SEQ ID NO: 5488503 - DNA, 18 bp, Homo sapiens
gctgcccccatccagcca

SEQ ID NO: 5488504 - DNA, 22 bp, Homo sapiens
gctgcccccatccagccacgga

SEQ ID NO: 5488505 - DNA, 15 bp, Homo sapiens
gctgccccctacccg

SEQ ID NO: 5488506 - DNA, 21 bp, Homo sapiens
gctgccccgcttccccacaga

SEQ ID NO: 5488507 - DNA, 22 bp, Homo sapiens
gctgccccgcttccccacagaa

SEQ ID NO: 5488508 - DNA, 22 bp, Homo sapiens
gctgccccggcccctccccctg

SEQ ID NO: 5488509 - DNA, 18 bp, Homo sapiens
gctgccccgttccctgtc

SEQ ID NO: 5488510 - DNA, 22 bp, Homo sapiens
gctgccccgttccctgtcagag

SEQ ID NO: 5488511 - DNA, 14 bp, Homo sapiens
gctgcccctcacct

SEQ ID NO: 5488512 - DNA, 16 bp, Homo sapiens
gctgcccctccctgcc

SEQ ID NO: 5488513 - DNA, 18 bp, Homo sapiens
gctgcccctccctgccag

SEQ ID NO: 5488514 - DNA, 17 bp, Homo sapiens
gctgcccctccctgcct

SEQ ID NO: 5488515 - DNA, 18 bp, Homo sapiens
gctgcccctcctggagca

SEQ ID NO: 5488516 - DNA, 24 bp, Homo sapiens
gctgcccctcgcacacagggctca

SEQ ID NO: 5488517 - DNA, 13 bp, Homo sapiens
gctgcccctctca

SEQ ID NO: 5488518 - DNA, 14 bp, Homo sapiens
gctgcccctctcac

SEQ ID NO: 5488519 - DNA, 15 bp, Homo sapiens
gctgcccctctcacc

SEQ ID NO: 5488520 - DNA, 15 bp, Homo sapiens
gctgcccctctctgg

SEQ ID NO: 5488521 - DNA, 16 bp, Homo sapiens
gctgcccctctctggg

SEQ ID NO: 5488522 - DNA, 16 bp, Homo sapiens
gctgcccctgcacagc

SEQ ID NO: 5488523 - DNA, 15 bp, Homo sapiens
gctgcccctgcagtt

SEQ ID NO: 5488524 - DNA, 13 bp, Homo sapiens
gctgcccctgcct

SEQ ID NO: 5488525 - DNA, 14 bp, Homo sapiens
gctgcccctggcac

SEQ ID NO: 5488526 - DNA, 16 bp, Homo sapiens
gctgcccctggcagcc

SEQ ID NO: 5488527 - DNA, 17 bp, Homo sapiens
gctgcccctggcagccc

SEQ ID NO: 5488528 - DNA, 23 bp, Homo sapiens
gctgccccttaaacacaggctgt

SEQ ID NO: 5488529 - DNA, 19 bp, Homo sapiens
gctgccccttgcaagccat

SEQ ID NO: 5488530 - DNA, 21 bp, Homo sapiens
gctgccccttgcaagccataa

SEQ ID NO: 5488531 - DNA, 16 bp, Homo sapiens
gctgcccgctcccagt

SEQ ID NO: 5488532 - DNA, 20 bp, Homo sapiens
gctgcccgctcccagtgtct

SEQ ID NO: 5488533 - DNA, 19 bp, Homo sapiens
gctgcccggcgccctctgt

SEQ ID NO: 5488534 - DNA, 17 bp, Homo sapiens
gctgcccggcgcctgcc

SEQ ID NO: 5488535 - DNA, 17 bp, Homo sapiens
gctgcccgtgaggaggg

SEQ ID NO: 5488536 - DNA, 20 bp, Homo sapiens
gctgcccgtgaggaggggga

SEQ ID NO: 5488537 - DNA, 21 bp, Homo sapiens
gctgccctacagcaccctgtg

SEQ ID NO: 5488538 - DNA, 15 bp, Homo sapiens
gctgccctaggctcc

SEQ ID NO: 5488539 - DNA, 22 bp, Homo sapiens
gctgccctcccacagcctcctt

SEQ ID NO: 5488540 - DNA, 23 bp, Homo sapiens
gctgccctcccctccggactggt

SEQ ID NO: 5488541 - DNA, 21 bp, Homo sapiens
gctgccctcctgtgctcagcc

SEQ ID NO: 5488542 - DNA, 22 bp, Homo sapiens
gctgccctcctgtgctcagccc

SEQ ID NO: 5488543 - DNA, 16 bp, Homo sapiens
gctgccctccttgtcc

SEQ ID NO: 5488544 - DNA, 13 bp, Homo sapiens
gctgccctcggca

SEQ ID NO: 5488545 - DNA, 16 bp, Homo sapiens
gctgccctctcccatg

SEQ ID NO: 5488546 - DNA, 16 bp, Homo sapiens
gctgccctctcctggg

SEQ ID NO: 5488547 - DNA, 20 bp, Homo sapiens
gctgccctctcctgggcagc

SEQ ID NO: 5488548 - DNA, 23 bp, Homo sapiens
gctgccctctcctgggcagctgc

SEQ ID NO: 5488549 - DNA, 24 bp, Homo sapiens
gctgctgcaagtcattgagtgact

SEQ ID NO: 5488550 - DNA, 19 bp, Homo sapiens
gctgctgcacacactcacc

SEQ ID NO: 5488551 - DNA, 18 bp, Homo sapiens
gctgctgcacaccaaggc

SEQ ID NO: 5488552 - DNA, 13 bp, Homo sapiens
gctgctgcaccaa

SEQ ID NO: 5488553 - DNA, 12 bp, Homo sapiens
gctgctgcaggc

SEQ ID NO: 5488554 - DNA, 12 bp, Homo sapiens
gctgctgccact

SEQ ID NO: 5488555 - DNA, 13 bp, Homo sapiens
gctgctgccactc

SEQ ID NO: 5488556 - DNA, 17 bp, Homo sapiens
gctgctgccactctgct

SEQ ID NO: 5488557 - DNA, 18 bp, Homo sapiens
gctgctgccactctgctg

SEQ ID NO: 5488558 - DNA, 18 bp, Homo sapiens
gctgctgccatgtctcag

SEQ ID NO: 5488559 - DNA, 13 bp, Homo sapiens
gctgctgcccctg

SEQ ID NO: 5488560 - DNA, 13 bp, Homo sapiens
gctgctgccctgc

SEQ ID NO: 5488561 - DNA, 16 bp, Homo sapiens
gctgctgcctgctcat

SEQ ID NO: 5488562 - DNA, 13 bp, Homo sapiens
gctgctgcctggc

SEQ ID NO: 5488563 - DNA, 17 bp, Homo sapiens
gctgctgcctggccact

SEQ ID NO: 5488564 - DNA, 14 bp, Homo sapiens
gctgctgccttcac

SEQ ID NO: 5488565 - DNA, 23 bp, Homo sapiens
gctgctgcctttagtcgctgagg

SEQ ID NO: 5488566 - DNA, 17 bp, Homo sapiens
gctgctgcgccctgggc

SEQ ID NO: 5488567 - DNA, 21 bp, Homo sapiens
gctgctgcgtggcatagccca

SEQ ID NO: 5488568 - DNA, 20 bp, Homo sapiens
gctgctgctaatcttcaggg

SEQ ID NO: 5488569 - DNA, 21 bp, Homo sapiens
gctgctgctattgctgtctgg

SEQ ID NO: 5488570 - DNA, 18 bp, Homo sapiens
gctgctgctcctccctct

SEQ ID NO: 5488571 - DNA, 15 bp, Homo sapiens
gctgctgctcctctc

SEQ ID NO: 5488572 - DNA, 12 bp, Homo sapiens
gctgctgctctg

SEQ ID NO: 5488573 - DNA, 22 bp, Homo sapiens
gctgctgctcttggctggaccc

SEQ ID NO: 5488574 - DNA, 13 bp, Homo sapiens
gctgctgctgcac

SEQ ID NO: 5488575 - DNA, 15 bp, Homo sapiens
gctgctgctgcaccc

SEQ ID NO: 5488576 - DNA, 13 bp, Homo sapiens
gctgctgctgctc

SEQ ID NO: 5488577 - DNA, 13 bp, Homo sapiens
gctgctgctgctg

SEQ ID NO: 5488578 - DNA, 14 bp, Homo sapiens
gctgctgctggaga

SEQ ID NO: 5488579 - DNA, 15 bp, Homo sapiens
gctgctgctggagat

SEQ ID NO: 5488580 - DNA, 13 bp, Homo sapiens
gctgctgctgggc

SEQ ID NO: 5488581 - DNA, 16 bp, Homo sapiens
gctgctgctgggctca

SEQ ID NO: 5488582 - DNA, 13 bp, Homo sapiens
gctgctgcttctg

SEQ ID NO: 5488583 - DNA, 21 bp, Homo sapiens
gctgctggacagtatcactgt

SEQ ID NO: 5488584 - DNA, 13 bp, Homo sapiens
gctgctggagact

SEQ ID NO: 5488585 - DNA, 12 bp, Homo sapiens
gctgctggagga

SEQ ID NO: 5488586 - DNA, 22 bp, Homo sapiens
gctgctggaggggacgctggct

SEQ ID NO: 5488587 - DNA, 22 bp, Homo sapiens
gctgctggatgtcaccaagaag

SEQ ID NO: 5488588 - DNA, 11 bp, Homo sapiens
gctgctggcca

SEQ ID NO: 5488589 - DNA, 19 bp, Homo sapiens
gctgctggcccacagctct

SEQ ID NO: 5488590 - DNA, 17 bp, Homo sapiens
gctgctggcgcctctgc

SEQ ID NO: 5488591 - DNA, 18 bp, Homo sapiens
gctgctggcgcctctgca

SEQ ID NO: 5488592 - DNA, 13 bp, Homo sapiens
gctgctggctccc

SEQ ID NO: 5488593 - DNA, 18 bp, Homo sapiens
gctgctggctcccatctc

SEQ ID NO: 5488594 - DNA, 15 bp, Homo sapiens
gctgctggcttcagg

SEQ ID NO: 5488595 - DNA, 15 bp, Homo sapiens
gctgctgggatggtg

SEQ ID NO: 5488596 - DNA, 14 bp, Homo sapiens
gctgctgggccagt

SEQ ID NO: 5488597 - DNA, 15 bp, Homo sapiens
gctgctgggccagtg

SEQ ID NO: 5488598 - DNA, 20 bp, Homo sapiens
gctgctgggcgtctgttctt

SEQ ID NO: 5488599 - DNA, 20 bp, Homo sapiens
gctgctgggctcagtgaagt

SEQ ID NO: 5488600 - DNA, 21 bp, Homo sapiens
gctgctggggaagacagtggc

SEQ ID NO: 5488601 - DNA, 16 bp, Homo sapiens
gctgctggggcagggc

SEQ ID NO: 5488602 - DNA, 22 bp, Homo sapiens
gctgctggggcagggcccaggg

SEQ ID NO: 5488603 - DNA, 17 bp, Homo sapiens
gctgctggggcatgtgt

SEQ ID NO: 5488604 - DNA, 22 bp, Homo sapiens
gctgctggggcatgtgtgcctg

SEQ ID NO: 5488605 - DNA, 11 bp, Homo sapiens
gctgctggggg

SEQ ID NO: 5488606 - DNA, 18 bp, Homo sapiens
gctgctggggtatgttct

SEQ ID NO: 5488607 - DNA, 21 bp, Homo sapiens
gctgctgggtgcgaaggcaga

SEQ ID NO: 5488608 - DNA, 13 bp, Homo sapiens
gctgctgggtggc

SEQ ID NO: 5488609 - DNA, 19 bp, Homo sapiens
gctgctgggtggcaggggg

SEQ ID NO: 5488610 - DNA, 15 bp, Homo sapiens
gctgctggtgcacag

SEQ ID NO: 5488611 - DNA, 22 bp, Homo sapiens
gctgctgtaactgctgagccac

SEQ ID NO: 5488612 - DNA, 16 bp, Homo sapiens
gctgctgtcacctctc

SEQ ID NO: 5488613 - DNA, 17 bp, Homo sapiens
gctgctgtcacctctcc

SEQ ID NO: 5488614 - DNA, 21 bp, Homo sapiens
gctgctgtcacctctcccacg

SEQ ID NO: 5488615 - DNA, 15 bp, Homo sapiens
gctgctgtccctccc

SEQ ID NO: 5488616 - DNA, 23 bp, Homo sapiens
gctgctgtctgagtagtggccac

SEQ ID NO: 5488617 - DNA, 22 bp, Homo sapiens
gctgctgtctgggtgctactgg

SEQ ID NO: 5488618 - DNA, 14 bp, Homo sapiens
gctgctgtcttgtt

SEQ ID NO: 5488619 - DNA, 13 bp, Homo sapiens
gctgctgtgaatt

SEQ ID NO: 5488620 - DNA, 19 bp, Homo sapiens
gctgctgtgcagcatggaa

SEQ ID NO: 5488621 - DNA, 11 bp, Homo sapiens
gctgctgtgcc

SEQ ID NO: 5488622 - DNA, 22 bp, Homo sapiens
gctgctgtgccaggactgtgac

SEQ ID NO: 5488623 - DNA, 12 bp, Homo sapiens
gctgctgtgccc

SEQ ID NO: 5488624 - DNA, 14 bp, Homo sapiens
gctgctgtgcccag

SEQ ID NO: 5488625 - DNA, 21 bp, Homo sapiens
gctgctgtgccccaccacgtc

SEQ ID NO: 5488626 - DNA, 22 bp, Homo sapiens
gctgctgtgcgtggaaaaagac

SEQ ID NO: 5488627 - DNA, 12 bp, Homo sapiens
gctgctgtgctt

SEQ ID NO: 5488628 - DNA, 16 bp, Homo sapiens
gctgctgtggagtgag

SEQ ID NO: 5488629 - DNA, 16 bp, Homo sapiens
gctgctgtgtagctct

SEQ ID NO: 5488630 - DNA, 20 bp, Homo sapiens
gctgctgtgtagctctgtcc

SEQ ID NO: 5488631 - DNA, 20 bp, Homo sapiens
gctgctgtgtgtggcttctg

SEQ ID NO: 5488632 - DNA, 20 bp, Homo sapiens
gctgctgttactgttaacca

SEQ ID NO: 5488633 - DNA, 16 bp, Homo sapiens
gctgctgttctcagga

SEQ ID NO: 5488634 - DNA, 13 bp, Homo sapiens
gctgctgttctgt

SEQ ID NO: 5488635 - DNA, 21 bp, Homo sapiens
gctgcttaatcctaccccctc

SEQ ID NO: 5488636 - DNA, 17 bp, Homo sapiens
gctgcttacactccagg

SEQ ID NO: 5488637 - DNA, 13 bp, Homo sapiens
gctgcttcaagga

SEQ ID NO: 5488638 - DNA, 21 bp, Homo sapiens
gctgcttcaaggatcctgagc

SEQ ID NO: 5488639 - DNA, 23 bp, Homo sapiens
gctgcttcaaggatcctgagcca

SEQ ID NO: 5488640 - DNA, 12 bp, Homo sapiens
gctgcttccagg

SEQ ID NO: 5488641 - DNA, 14 bp, Homo sapiens
gctgcttccagttg

SEQ ID NO: 5488642 - DNA, 20 bp, Homo sapiens
gctgcttcccagaggagcag

SEQ ID NO: 5488643 - DNA, 21 bp, Homo sapiens
gctgcttccctctgcctgtcc

SEQ ID NO: 5488644 - DNA, 19 bp, Homo sapiens
gctgcttccctgaagctcc

SEQ ID NO: 5488645 - DNA, 14 bp, Homo sapiens
gctgcttcctcctg

SEQ ID NO: 5488646 - DNA, 15 bp, Homo sapiens
gctgcttcctcctgg

SEQ ID NO: 5488647 - DNA, 21 bp, Homo sapiens
gctgcttcctgtaatgcagga

SEQ ID NO: 5488648 - DNA, 14 bp, Homo sapiens
gctgcttcctgtga

SEQ ID NO: 5488649 - DNA, 17 bp, Homo sapiens
gctgcttcctgtgacag

SEQ ID NO: 5488650 - DNA, 16 bp, Homo sapiens
gctgcttctccacctc

SEQ ID NO: 5488651 - DNA, 14 bp, Homo sapiens
gctgcttctccctg

SEQ ID NO: 5488652 - DNA, 15 bp, Homo sapiens
gctgcttctccctgg

SEQ ID NO: 5488653 - DNA, 14 bp, Homo sapiens
gctgcttctcctcc

SEQ ID NO: 5488654 - DNA, 14 bp, Homo sapiens
gctgcttctgccca

SEQ ID NO: 5488655 - DNA, 15 bp, Homo sapiens
gctgcttctgctcca

SEQ ID NO: 5488656 - DNA, 18 bp, Homo sapiens
gctgcttctgctccagcc

SEQ ID NO: 5488657 - DNA, 23 bp, Homo sapiens
gctgcttctgctgcctaggttct

SEQ ID NO: 5488658 - DNA, 13 bp, Homo sapiens
gctgcttctgggc

SEQ ID NO: 5488659 - DNA, 15 bp, Homo sapiens
gctgcttctgggcct

SEQ ID NO: 5488660 - DNA, 21 bp, Homo sapiens
gctgcttcttaaccccagtaa

SEQ ID NO: 5488661 - DNA, 17 bp, Homo sapiens
gctgcttgagtggacag

SEQ ID NO: 5488662 - DNA, 22 bp, Homo sapiens
gctgcttgagttgcctgatgct

SEQ ID NO: 5488663 - DNA, 19 bp, Homo sapiens
gctgcttgcagccaggaga

SEQ ID NO: 5488664 - DNA, 22 bp, Homo sapiens
gctgcttgcccaagtcacacag

SEQ ID NO: 5488665 - DNA, 19 bp, Homo sapiens
gctgcttgcttttgcctct

SEQ ID NO: 5488666 - DNA, 21 bp, Homo sapiens
gctgcttggagtgccccaagg

SEQ ID NO: 5488667 - DNA, 24 bp, Homo sapiens
gctgcttggatgcgagcttggcct

SEQ ID NO: 5488668 - DNA, 17 bp, Homo sapiens
gctgcttgggcttcatc

SEQ ID NO: 5488669 - DNA, 13 bp, Homo sapiens
gctgcttgtcaaa

SEQ ID NO: 5488670 - DNA, 14 bp, Homo sapiens
gctgcttgtcctgc

SEQ ID NO: 5488671 - DNA, 19 bp, Homo sapiens
gctgcttgtcctgctctct

SEQ ID NO: 5488672 - DNA, 23 bp, Homo sapiens
gctgcttgtgcctcccttcccag

SEQ ID NO: 5488673 - DNA, 15 bp, Homo sapiens
gctgcttgtgggccc

SEQ ID NO: 5488674 - DNA, 15 bp, Homo sapiens
gctgctttcccctgt

SEQ ID NO: 5488675 - DNA, 17 bp, Homo sapiens
gctgctttcccctgtgg

SEQ ID NO: 5488676 - DNA, 20 bp, Homo sapiens
gctgctttcccctgtgggga

SEQ ID NO: 5488677 - DNA, 21 bp, Homo sapiens
gctgctttcccctgtggggat

SEQ ID NO: 5488678 - DNA, 13 bp, Homo sapiens
gctgctttcttct

SEQ ID NO: 5488679 - DNA, 20 bp, Homo sapiens
gctgctttgtagtttgccca

SEQ ID NO: 5488680 - DNA, 22 bp, Homo sapiens
gctgctttgtagtttgcccaga

SEQ ID NO: 5488681 - DNA, 23 bp, Homo sapiens
gctgctttgtagtttgcccagag

SEQ ID NO: 5488682 - DNA, 14 bp, Homo sapiens
gctgctttgtccag

SEQ ID NO: 5488683 - DNA, 20 bp, Homo sapiens
gctgctttgttaccttaaaa

SEQ ID NO: 5488684 - DNA, 22 bp, Homo sapiens
gctgctttgttgttctgcctgt

SEQ ID NO: 5488685 - DNA, 14 bp, Homo sapiens
gctgcttttaaaac

SEQ ID NO: 5488686 - DNA, 22 bp, Homo sapiens
gctgcttttccttggggcaggc

SEQ ID NO: 5488687 - DNA, 23 bp, Homo sapiens
gctgcttttccttggggcaggca

SEQ ID NO: 5488688 - DNA, 11 bp, Homo sapiens
gctgcttttct

SEQ ID NO: 5488689 - DNA, 19 bp, Homo sapiens
gctgcttttgagcctcaga

SEQ ID NO: 5488690 - DNA, 19 bp, Homo sapiens
gctgcttttgatggctatg

SEQ ID NO: 5488691 - DNA, 19 bp, Homo sapiens
gctgcttttgggggtcagc

SEQ ID NO: 5488692 - DNA, 21 bp, Homo sapiens
gctgcttttgggggtcagcat

SEQ ID NO: 5488693 - DNA, 22 bp, Homo sapiens
gctgcttttgtctatgggactc

SEQ ID NO: 5488694 - DNA, 14 bp, Homo sapiens
gctgctttttcaaa

SEQ ID NO: 5488695 - DNA, 15 bp, Homo sapiens
gctggaaaactgcca

SEQ ID NO: 5488696 - DNA, 17 bp, Homo sapiens
gctggaaaactgccaca

SEQ ID NO: 5488697 - DNA, 23 bp, Homo sapiens
gctggaaaagggctcagagctgc

SEQ ID NO: 5488698 - DNA, 15 bp, Homo sapiens
gctggaaaagggtct

SEQ ID NO: 5488699 - DNA, 23 bp, Homo sapiens
gctggaaaagtatgttagtgcaa

SEQ ID NO: 5488700 - DNA, 20 bp, Homo sapiens
gctggaaaagtcacacagac

SEQ ID NO: 5488701 - DNA, 21 bp, Homo sapiens
gctggaaagaggagaaggaga

SEQ ID NO: 5488702 - DNA, 18 bp, Homo sapiens
gctggaaagcagagcctc

SEQ ID NO: 5488703 - DNA, 22 bp, Homo sapiens
gctggaaagcagagcctcctgg

SEQ ID NO: 5488704 - DNA, 11 bp, Homo sapiens
gctggaaataa

SEQ ID NO: 5488705 - DNA, 14 bp, Homo sapiens
gctggaaataaaac

SEQ ID NO: 5488706 - DNA, 19 bp, Homo sapiens
gctggaaataaaacagctg

SEQ ID NO: 5488707 - DNA, 14 bp, Homo sapiens
gctggaaataaacc

SEQ ID NO: 5488708 - DNA, 13 bp, Homo sapiens
gctggaacacagg

SEQ ID NO: 5488709 - DNA, 14 bp, Homo sapiens
gctggaacacaggg

SEQ ID NO: 5488710 - DNA, 20 bp, Homo sapiens
gctggaacacaggggccttt

SEQ ID NO: 5488711 - DNA, 23 bp, Homo sapiens
gctggaacacaggggccttttaa

SEQ ID NO: 5488712 - DNA, 16 bp, Homo sapiens
gctggaacactgtact

SEQ ID NO: 5488713 - DNA, 19 bp, Homo sapiens
gctggaacactttcagttt

SEQ ID NO: 5488714 - DNA, 12 bp, Homo sapiens
gctggaacattt

SEQ ID NO: 5488715 - DNA, 21 bp, Homo sapiens
gctggaacctgcaaaaaatac

SEQ ID NO: 5488716 - DNA, 18 bp, Homo sapiens
gctggaagaacatcaaga

SEQ ID NO: 5488717 - DNA, 19 bp, Homo sapiens
gctggaagaaccactgtct

SEQ ID NO: 5488718 - DNA, 18 bp, Homo sapiens
gctggaagaactgcatgg

SEQ ID NO: 5488719 - DNA, 11 bp, Homo sapiens
gctggaagaat

SEQ ID NO: 5488720 - DNA, 20 bp, Homo sapiens
gctggaagacagagaaaact

SEQ ID NO: 5488721 - DNA, 17 bp, Homo sapiens
gctggaagactgtgcag

SEQ ID NO: 5488722 - DNA, 18 bp, Homo sapiens
gctggaagacttagatct

SEQ ID NO: 5488723 - DNA, 14 bp, Homo sapiens
gctggaagagtccc

SEQ ID NO: 5488724 - DNA, 17 bp, Homo sapiens
gctggaagatagctgtg

SEQ ID NO: 5488725 - DNA, 14 bp, Homo sapiens
gctggaagatcctg

SEQ ID NO: 5488726 - DNA, 17 bp, Homo sapiens
gctggaagatcctgcgg

SEQ ID NO: 5488727 - DNA, 20 bp, Homo sapiens
gctggcaaatccaggctggt

SEQ ID NO: 5488728 - DNA, 18 bp, Homo sapiens
gctggcaaccagccagcg

SEQ ID NO: 5488729 - DNA, 19 bp, Homo sapiens
gctggcaaccagccagcgt

SEQ ID NO: 5488730 - DNA, 20 bp, Homo sapiens
gctggcaagctgcaaaaggc

SEQ ID NO: 5488731 - DNA, 23 bp, Homo sapiens
gctggcaaggagttcgtggctgc

SEQ ID NO: 5488732 - DNA, 20 bp, Homo sapiens
gctggcaatgccctacctgc

SEQ ID NO: 5488733 - DNA, 16 bp, Homo sapiens
gctggcacaaaagaca

SEQ ID NO: 5488734 - DNA, 19 bp, Homo sapiens
gctggcacaaaagacagct

SEQ ID NO: 5488735 - DNA, 16 bp, Homo sapiens
gctggcacagcccctg

SEQ ID NO: 5488736 - DNA, 17 bp, Homo sapiens
gctggcacagcccctgg

SEQ ID NO: 5488737 - DNA, 23 bp, Homo sapiens
gctggcacatttccccagacctg

SEQ ID NO: 5488738 - DNA, 20 bp, Homo sapiens
gctggcaccatggtgactgc

SEQ ID NO: 5488739 - DNA, 16 bp, Homo sapiens
gctggcacccaccgtg

SEQ ID NO: 5488740 - DNA, 20 bp, Homo sapiens
gctggcacccaccgtggagg

SEQ ID NO: 5488741 - DNA, 18 bp, Homo sapiens
gctggcacgtgacaggct

SEQ ID NO: 5488742 - DNA, 19 bp, Homo sapiens
gctggcacgtgacaggctc

SEQ ID NO: 5488743 - DNA, 10 bp, Homo sapiens
gctggcactg

SEQ ID NO: 5488744 - DNA, 18 bp, Homo sapiens
gctggcactgacagcctg

SEQ ID NO: 5488745 - DNA, 17 bp, Homo sapiens
gctggcactgagcctgc

SEQ ID NO: 5488746 - DNA, 13 bp, Homo sapiens
gctggcagcactc

SEQ ID NO: 5488747 - DNA, 14 bp, Homo sapiens
gctggcagcactca

SEQ ID NO: 5488748 - DNA, 13 bp, Homo sapiens
gctggcagcagag

SEQ ID NO: 5488749 - DNA, 15 bp, Homo sapiens
gctggcagcgcctcc

SEQ ID NO: 5488750 - DNA, 18 bp, Homo sapiens
gctggcagcgcctcccgc

SEQ ID NO: 5488751 - DNA, 23 bp, Homo sapiens
gctggcagcgcctcccgccgcct

SEQ ID NO: 5488752 - DNA, 17 bp, Homo sapiens
gctggcagctctccagt

SEQ ID NO: 5488753 - DNA, 18 bp, Homo sapiens
gctggcagctctccagtc

SEQ ID NO: 5488754 - DNA, 16 bp, Homo sapiens
gctggcagctgagagc

SEQ ID NO: 5488755 - DNA, 21 bp, Homo sapiens
gctggcaggacacatcccggc

SEQ ID NO: 5488756 - DNA, 21 bp, Homo sapiens
gctggcaggagacactggtct

SEQ ID NO: 5488757 - DNA, 18 bp, Homo sapiens
gctggcaggagtggggtg

SEQ ID NO: 5488758 - DNA, 21 bp, Homo sapiens
gctggcaggcagttctagaag

SEQ ID NO: 5488759 - DNA, 12 bp, Homo sapiens
gctggcagggcc

SEQ ID NO: 5488760 - DNA, 14 bp, Homo sapiens
gctggcagggccag

SEQ ID NO: 5488761 - DNA, 13 bp, Homo sapiens
gctggcagggcct

SEQ ID NO: 5488762 - DNA, 14 bp, Homo sapiens
gctggcagggcctg

SEQ ID NO: 5488763 - DNA, 21 bp, Homo sapiens
gctggcaggtcatggagcagc

SEQ ID NO: 5488764 - DNA, 20 bp, Homo sapiens
gctggcagtacagagtgcag

SEQ ID NO: 5488765 - DNA, 17 bp, Homo sapiens
gctggcagtcctggaag

SEQ ID NO: 5488766 - DNA, 23 bp, Homo sapiens
gctggcagtgctgattcagcctg

SEQ ID NO: 5488767 - DNA, 20 bp, Homo sapiens
gctggcagtgtgcggagctg

SEQ ID NO: 5488768 - DNA, 22 bp, Homo sapiens
gctggcatcaggtctgggcaag

SEQ ID NO: 5488769 - DNA, 23 bp, Homo sapiens
gctggcatcaggtctgggcaagt

SEQ ID NO: 5488770 - DNA, 17 bp, Homo sapiens
gctggcatcctggctgg

SEQ ID NO: 5488771 - DNA, 19 bp, Homo sapiens
gctggcatcctggctggct

SEQ ID NO: 5488772 - DNA, 21 bp, Homo sapiens
gctggcatgatccaagcaaga

SEQ ID NO: 5488773 - DNA, 21 bp, Homo sapiens
gctggcatggggaggggagag

SEQ ID NO: 5488774 - DNA, 23 bp, Homo sapiens
gctggcatggggaggggagagaa

SEQ ID NO: 5488775 - DNA, 15 bp, Homo sapiens
gctggcatgttttct

SEQ ID NO: 5488776 - DNA, 20 bp, Homo sapiens
gctggccaaagagcctttcc

SEQ ID NO: 5488777 - DNA, 16 bp, Homo sapiens
gctggccaaggtgtcc

SEQ ID NO: 5488778 - DNA, 12 bp, Homo sapiens
gctggccactgc

SEQ ID NO: 5488779 - DNA, 17 bp, Homo sapiens
gctggccagcaaggcag

SEQ ID NO: 5488780 - DNA, 18 bp, Homo sapiens
gctggccagcaaggcagg

SEQ ID NO: 5488781 - DNA, 21 bp, Homo sapiens
gctggccagcaaggcaggttg

SEQ ID NO: 5488782 - DNA, 12 bp, Homo sapiens
gctggccagcac

SEQ ID NO: 5488783 - DNA, 14 bp, Homo sapiens
gctggccagcaccc

SEQ ID NO: 5488784 - DNA, 16 bp, Homo sapiens
gctggccagcaccctc

SEQ ID NO: 5488785 - DNA, 17 bp, Homo sapiens
gctggccagcaccctct

SEQ ID NO: 5488786 - DNA, 14 bp, Homo sapiens
gctggccagcccca

SEQ ID NO: 5488787 - DNA, 16 bp, Homo sapiens
gctggccagccccaca

SEQ ID NO: 5488788 - DNA, 14 bp, Homo sapiens
gctggccagcctgg

SEQ ID NO: 5488789 - DNA, 15 bp, Homo sapiens
gctggccagcctggg

SEQ ID NO: 5488790 - DNA, 21 bp, Homo sapiens
gctggccagcctggggcctgg

SEQ ID NO: 5488791 - DNA, 16 bp, Homo sapiens
gctggccagctgtgcg

SEQ ID NO: 5488792 - DNA, 16 bp, Homo sapiens
gctggccaggacacac

SEQ ID NO: 5488793 - DNA, 19 bp, Homo sapiens
gctggccaggacacactga

SEQ ID NO: 5488794 - DNA, 12 bp, Homo sapiens
gctggccaggct

SEQ ID NO: 5488795 - DNA, 17 bp, Homo sapiens
gctggccagtccaggct

SEQ ID NO: 5488796 - DNA, 22 bp, Homo sapiens
gctggccatgaatctctgcctc

SEQ ID NO: 5488797 - DNA, 15 bp, Homo sapiens
gctggccatggagaa

SEQ ID NO: 5488798 - DNA, 20 bp, Homo sapiens
gctggccatggagaaagctg

SEQ ID NO: 5488799 - DNA, 17 bp, Homo sapiens
gctggccatggggccct

SEQ ID NO: 5488800 - DNA, 17 bp, Homo sapiens
gctggcccacagctctg

SEQ ID NO: 5488801 - DNA, 18 bp, Homo sapiens
gctggcccacagctctgc

SEQ ID NO: 5488802 - DNA, 22 bp, Homo sapiens
gctggcccacagctctgctgga

SEQ ID NO: 5488803 - DNA, 15 bp, Homo sapiens
gctggcccacccagt

SEQ ID NO: 5488804 - DNA, 11 bp, Homo sapiens
gctggcccagc

SEQ ID NO: 5488805 - DNA, 23 bp, Homo sapiens
gctggcccagccaactgccccgg

SEQ ID NO: 5488806 - DNA, 13 bp, Homo sapiens
gctggcccagccc

SEQ ID NO: 5488807 - DNA, 15 bp, Homo sapiens
gctggcccagccctg

SEQ ID NO: 5488808 - DNA, 19 bp, Homo sapiens
gctggcccagccctgctgg

SEQ ID NO: 5488809 - DNA, 18 bp, Homo sapiens
gctggcccagccggcctc

SEQ ID NO: 5488810 - DNA, 23 bp, Homo sapiens
gctggcccagccggcctctctgg

SEQ ID NO: 5488811 - DNA, 14 bp, Homo sapiens
gctggcccaggaga

SEQ ID NO: 5488812 - DNA, 16 bp, Homo sapiens
gctggcccagtgggta

SEQ ID NO: 5488813 - DNA, 10 bp, Homo sapiens
gctggcccca

SEQ ID NO: 5488814 - DNA, 12 bp, Homo sapiens
gctggccccagc

SEQ ID NO: 5488815 - DNA, 15 bp, Homo sapiens
gctggccccagccct

SEQ ID NO: 5488816 - DNA, 17 bp, Homo sapiens
gctggccccagccctgc

SEQ ID NO: 5488817 - DNA, 22 bp, Homo sapiens
gctggccccagccctgctgggg

SEQ ID NO: 5488818 - DNA, 16 bp, Homo sapiens
gctggccccagggcac

SEQ ID NO: 5488819 - DNA, 18 bp, Homo sapiens
gctggccccatcctggcc

SEQ ID NO: 5488820 - DNA, 12 bp, Homo sapiens
gctggcccccac

SEQ ID NO: 5488821 - DNA, 14 bp, Homo sapiens
gctggcccccaccc

SEQ ID NO: 5488822 - DNA, 21 bp, Homo sapiens
gctggcccccacccaccttcc

SEQ ID NO: 5488823 - DNA, 20 bp, Homo sapiens
gctggcccccactggctgtg

SEQ ID NO: 5488824 - DNA, 21 bp, Homo sapiens
gctggcccccactggctgtgg

SEQ ID NO: 5488825 - DNA, 18 bp, Homo sapiens
gctggcccccagccctgg

SEQ ID NO: 5488826 - DNA, 17 bp, Homo sapiens
gctggcccccccagccc

SEQ ID NO: 5488827 - DNA, 24 bp, Homo sapiens
gctggccccgccgcctggtactca

SEQ ID NO: 5488828 - DNA, 14 bp, Homo sapiens
gctggcccctcacc

SEQ ID NO: 5488829 - DNA, 23 bp, Homo sapiens
gctggcccctcacctgggcacct

SEQ ID NO: 5488830 - DNA, 22 bp, Homo sapiens
gctggcccgtgacagactcctg

SEQ ID NO: 5488831 - DNA, 23 bp, Homo sapiens
gctggccctacttccaggatgga

SEQ ID NO: 5488832 - DNA, 12 bp, Homo sapiens
gctggccctagg

SEQ ID NO: 5488833 - DNA, 14 bp, Homo sapiens
gctggccctaggca

SEQ ID NO: 5488834 - DNA, 17 bp, Homo sapiens
gctggccctaggcactg

SEQ ID NO: 5488835 - DNA, 15 bp, Homo sapiens
gctggccctgccctc

SEQ ID NO: 5488836 - DNA, 18 bp, Homo sapiens
gctggccctgccctcccc

SEQ ID NO: 5488837 - DNA, 20 bp, Homo sapiens
gctggccctgccctccccca

SEQ ID NO: 5488838 - DNA, 16 bp, Homo sapiens
gctggccctgcctcct

SEQ ID NO: 5488839 - DNA, 17 bp, Homo sapiens
gctggccctgcctcctg

SEQ ID NO: 5488840 - DNA, 20 bp, Homo sapiens
gctggccctgcctcctggga

SEQ ID NO: 5488841 - DNA, 13 bp, Homo sapiens
gctggccctgtgc

SEQ ID NO: 5488842 - DNA, 22 bp, Homo sapiens
gctggcccttagagaccccgag

SEQ ID NO: 5488843 - DNA, 15 bp, Homo sapiens
gctggccgagggtcc

SEQ ID NO: 5488844 - DNA, 19 bp, Homo sapiens
gctggccgagggtcctggc

SEQ ID NO: 5488845 - DNA, 17 bp, Homo sapiens
gctggccgctgtgccag

SEQ ID NO: 5488846 - DNA, 18 bp, Homo sapiens
gctggccgctgtgccagg

SEQ ID NO: 5488847 - DNA, 20 bp, Homo sapiens
gctggccgctgtgccaggcg

SEQ ID NO: 5488848 - DNA, 19 bp, Homo sapiens
gctggccggaaggagactg

SEQ ID NO: 5488849 - DNA, 13 bp, Homo sapiens
gctggccgggacc

SEQ ID NO: 5488850 - DNA, 19 bp, Homo sapiens
gctggccgggactgctgct

SEQ ID NO: 5488851 - DNA, 19 bp, Homo sapiens
gctggccgggcacagctgt

SEQ ID NO: 5488852 - DNA, 22 bp, Homo sapiens
gctggccggtccaccccgtccc

SEQ ID NO: 5488853 - DNA, 19 bp, Homo sapiens
gctggcctaggtgggagcc

SEQ ID NO: 5488854 - DNA, 21 bp, Homo sapiens
gctggcctaggtgggagccac

SEQ ID NO: 5488855 - DNA, 15 bp, Homo sapiens
gctggcctcacctgg

SEQ ID NO: 5488856 - DNA, 16 bp, Homo sapiens
gctggcctcacctggg

SEQ ID NO: 5488857 - DNA, 12 bp, Homo sapiens
gctggcctcaga

SEQ ID NO: 5488858 - DNA, 16 bp, Homo sapiens
gctggcctcaggctgc

SEQ ID NO: 5488859 - DNA, 20 bp, Homo sapiens
gctggcctcccaataaagct

SEQ ID NO: 5488860 - DNA, 22 bp, Homo sapiens
gctggcctcccaataaagctgg

SEQ ID NO: 5488861 - DNA, 23 bp, Homo sapiens
gctggcctcccaataaagctgga

SEQ ID NO: 5488862 - DNA, 19 bp, Homo sapiens
gctggcctccctccgtccc

SEQ ID NO: 5488863 - DNA, 19 bp, Homo sapiens
gctggcctctctagcacaa

SEQ ID NO: 5488864 - DNA, 23 bp, Homo sapiens
gctggcctctctgacatatgcta

SEQ ID NO: 5488865 - DNA, 18 bp, Homo sapiens
gctggcctctggctctca

SEQ ID NO: 5488866 - DNA, 18 bp, Homo sapiens
gctggcctcttggcacct

SEQ ID NO: 5488867 - DNA, 21 bp, Homo sapiens
gctggcctcttggcacctgcc

SEQ ID NO: 5488868 - DNA, 15 bp, Homo sapiens
gctggcctggaccat

SEQ ID NO: 5488869 - DNA, 14 bp, Homo sapiens
gctggcctggaggc

SEQ ID NO: 5488870 - DNA, 14 bp, Homo sapiens
gctggcctggatct

SEQ ID NO: 5488871 - DNA, 15 bp, Homo sapiens
gctggcctggatctc

SEQ ID NO: 5488872 - DNA, 15 bp, Homo sapiens
gctggcctggcaggg

SEQ ID NO: 5488873 - DNA, 17 bp, Homo sapiens
gctggcctggcagttga

SEQ ID NO: 5488874 - DNA, 19 bp, Homo sapiens
gctggcctggcccccagct

SEQ ID NO: 5488875 - DNA, 15 bp, Homo sapiens
gctggcctggcccct

SEQ ID NO: 5488876 - DNA, 17 bp, Homo sapiens
gctggcctggcccctca

SEQ ID NO: 5488877 - DNA, 19 bp, Homo sapiens
gctggcctggcccctcagg

SEQ ID NO: 5488878 - DNA, 14 bp, Homo sapiens
gctggcctggccct

SEQ ID NO: 5488879 - DNA, 15 bp, Homo sapiens
gctggcctggccctt

SEQ ID NO: 5488880 - DNA, 12 bp, Homo sapiens
gctggcctggta

SEQ ID NO: 5488881 - DNA, 19 bp, Homo sapiens
gctggcctgtggcaggcct

SEQ ID NO: 5488882 - DNA, 12 bp, Homo sapiens
gctggccttcct

SEQ ID NO: 5488883 - DNA, 15 bp, Homo sapiens
gctggccttcctgcc

SEQ ID NO: 5488884 - DNA, 23 bp, Homo sapiens
gctggccttcctgccctacagag

SEQ ID NO: 5488885 - DNA, 12 bp, Homo sapiens
gctggccttggt

SEQ ID NO: 5488886 - DNA, 19 bp, Homo sapiens
gctggcctttgtaagtgca

SEQ ID NO: 5488887 - DNA, 12 bp, Homo sapiens
gctggcgacact

SEQ ID NO: 5488888 - DNA, 14 bp, Homo sapiens
gctggcgcagccaa

SEQ ID NO: 5488889 - DNA, 20 bp, Homo sapiens
gctggcgcagccaaggccga

SEQ ID NO: 5488890 - DNA, 20 bp, Homo sapiens
gctggcgcatattaagcact

SEQ ID NO: 5488891 - DNA, 14 bp, Homo sapiens
gctggcgcctctgc

SEQ ID NO: 5488892 - DNA, 15 bp, Homo sapiens
gctggcgctcagcag

SEQ ID NO: 5488893 - DNA, 14 bp, Homo sapiens
gctggcggaacctg

SEQ ID NO: 5488894 - DNA, 18 bp, Homo sapiens
gctggcggaacctggctg

SEQ ID NO: 5488895 - DNA, 18 bp, Homo sapiens
gctggcggacgcagctgg

SEQ ID NO: 5488896 - DNA, 23 bp, Homo sapiens
gctggcggcccttctgactgttt

SEQ ID NO: 5488897 - DNA, 15 bp, Homo sapiens
gctggcgggcctttt

SEQ ID NO: 5488898 - DNA, 20 bp, Homo sapiens
gctggcggggtcccccctcc

SEQ ID NO: 5488899 - DNA, 15 bp, Homo sapiens
gctggcgtcacctgt

SEQ ID NO: 5488900 - DNA, 15 bp, Homo sapiens
gctggctacgcctct

SEQ ID NO: 5488901 - DNA, 18 bp, Homo sapiens
gctggctagtcctttctg

SEQ ID NO: 5488902 - DNA, 16 bp, Homo sapiens
gctggctcacagtaca

SEQ ID NO: 5488903 - DNA, 11 bp, Homo sapiens
gctggctcacc

SEQ ID NO: 5488904 - DNA, 21 bp, Homo sapiens
gctggctcacgcgttctggga

SEQ ID NO: 5488905 - DNA, 15 bp, Homo sapiens
gctgggcacttccct

SEQ ID NO: 5488906 - DNA, 13 bp, Homo sapiens
gctgggcagaagg

SEQ ID NO: 5488907 - DNA, 14 bp, Homo sapiens
gctgggcagacagg

SEQ ID NO: 5488908 - DNA, 22 bp, Homo sapiens
gctgggcagacaggtgggagat

SEQ ID NO: 5488909 - DNA, 13 bp, Homo sapiens
gctgggcagaggg

SEQ ID NO: 5488910 - DNA, 14 bp, Homo sapiens
gctgggcagaggga

SEQ ID NO: 5488911 - DNA, 12 bp, Homo sapiens
gctgggcagccc

SEQ ID NO: 5488912 - DNA, 21 bp, Homo sapiens
gctgggcagccccagagagag

SEQ ID NO: 5488913 - DNA, 12 bp, Homo sapiens
gctgggcagcct

SEQ ID NO: 5488914 - DNA, 17 bp, Homo sapiens
gctgggcagccttgggg

SEQ ID NO: 5488915 - DNA, 13 bp, Homo sapiens
gctgggcagctac

SEQ ID NO: 5488916 - DNA, 12 bp, Homo sapiens
gctgggcagctg

SEQ ID NO: 5488917 - DNA, 21 bp, Homo sapiens
gctgggcagctgattttgtca

SEQ ID NO: 5488918 - DNA, 13 bp, Homo sapiens
gctgggcagctgt

SEQ ID NO: 5488919 - DNA, 18 bp, Homo sapiens
gctgggcagggccctgtg

SEQ ID NO: 5488920 - DNA, 14 bp, Homo sapiens
gctgggcagggccg

SEQ ID NO: 5488921 - DNA, 16 bp, Homo sapiens
gctgggcaggtcctgg

SEQ ID NO: 5488922 - DNA, 14 bp, Homo sapiens
gctgggcaggttgg

SEQ ID NO: 5488923 - DNA, 16 bp, Homo sapiens
gctgggcagtgccagc

SEQ ID NO: 5488924 - DNA, 13 bp, Homo sapiens
gctgggcatactt

SEQ ID NO: 5488925 - DNA, 16 bp, Homo sapiens
gctgggcatactttct

SEQ ID NO: 5488926 - DNA, 16 bp, Homo sapiens
gctgggcatcccagct

SEQ ID NO: 5488927 - DNA, 21 bp, Homo sapiens
gctgggcatcccagcttgccc

SEQ ID NO: 5488928 - DNA, 21 bp, Homo sapiens
gctgggcatgccatgtctgag

SEQ ID NO: 5488929 - DNA, 20 bp, Homo sapiens
gctgggcatggtggtgcgtg

SEQ ID NO: 5488930 - DNA, 13 bp, Homo sapiens
gctgggccaccag

SEQ ID NO: 5488931 - DNA, 16 bp, Homo sapiens
gctgggccaccaggga

SEQ ID NO: 5488932 - DNA, 18 bp, Homo sapiens
gctgggccactggggact

SEQ ID NO: 5488933 - DNA, 13 bp, Homo sapiens
gctgggccagcct

SEQ ID NO: 5488934 - DNA, 14 bp, Homo sapiens
gctgggccagcctc

SEQ ID NO: 5488935 - DNA, 12 bp, Homo sapiens
gctgggccaggg

SEQ ID NO: 5488936 - DNA, 13 bp, Homo sapiens
gctgggccaggga

SEQ ID NO: 5488937 - DNA, 15 bp, Homo sapiens
gctgggccagggaaa

SEQ ID NO: 5488938 - DNA, 16 bp, Homo sapiens
gctgggccagtggacc

SEQ ID NO: 5488939 - DNA, 17 bp, Homo sapiens
gctgggccagtggcact

SEQ ID NO: 5488940 - DNA, 14 bp, Homo sapiens
gctgggccatcctt

SEQ ID NO: 5488941 - DNA, 14 bp, Homo sapiens
gctgggcccaaagg

SEQ ID NO: 5488942 - DNA, 13 bp, Homo sapiens
gctgggcccagag

SEQ ID NO: 5488943 - DNA, 15 bp, Homo sapiens
gctgggcccagaggc

SEQ ID NO: 5488944 - DNA, 20 bp, Homo sapiens
gctgggcccagaggcacagc

SEQ ID NO: 5488945 - DNA, 13 bp, Homo sapiens
gctgggcccagcc

SEQ ID NO: 5488946 - DNA, 13 bp, Homo sapiens
gctgggccccagc

SEQ ID NO: 5488947 - DNA, 14 bp, Homo sapiens
gctgggccccagcc

SEQ ID NO: 5488948 - DNA, 16 bp, Homo sapiens
gctgggccccagccca

SEQ ID NO: 5488949 - DNA, 19 bp, Homo sapiens
gctgggccccagcccaccc

SEQ ID NO: 5488950 - DNA, 21 bp, Homo sapiens
gctgggccccatgctctgccc

SEQ ID NO: 5488951 - DNA, 18 bp, Homo sapiens
gctgggcccccagcctgg

SEQ ID NO: 5488952 - DNA, 20 bp, Homo sapiens
gctgggccccccagctcagg

SEQ ID NO: 5488953 - DNA, 21 bp, Homo sapiens
gctgggccccccagctcaggg

SEQ ID NO: 5488954 - DNA, 12 bp, Homo sapiens
gctgggcccctg

SEQ ID NO: 5488955 - DNA, 13 bp, Homo sapiens
gctgggcccctgc

SEQ ID NO: 5488956 - DNA, 14 bp, Homo sapiens
gctgggcccctgcc

SEQ ID NO: 5488957 - DNA, 20 bp, Homo sapiens
gctgggcccctgcctctctg

SEQ ID NO: 5488958 - DNA, 23 bp, Homo sapiens
gctgggcccctgcctctctgcag

SEQ ID NO: 5488959 - DNA, 14 bp, Homo sapiens
gctgggcccctggg

SEQ ID NO: 5488960 - DNA, 19 bp, Homo sapiens
gctgggcccctggggacag

SEQ ID NO: 5488961 - DNA, 21 bp, Homo sapiens
gctgggcccctggggacagag

SEQ ID NO: 5488962 - DNA, 17 bp, Homo sapiens
gctgggccctctcttct

SEQ ID NO: 5488963 - DNA, 21 bp, Homo sapiens
gctgggccctctttccctgcg

SEQ ID NO: 5488964 - DNA, 12 bp, Homo sapiens
gctgggccctgc

SEQ ID NO: 5488965 - DNA, 15 bp, Homo sapiens
gctgggccctgcctg

SEQ ID NO: 5488966 - DNA, 16 bp, Homo sapiens
gctgggccctgcctgc

SEQ ID NO: 5488967 - DNA, 17 bp, Homo sapiens
gctgggccctgcctgca

SEQ ID NO: 5488968 - DNA, 18 bp, Homo sapiens
gctgggccctgcctgcag

SEQ ID NO: 5488969 - DNA, 22 bp, Homo sapiens
gctgggccctgcctgcagccag

SEQ ID NO: 5488970 - DNA, 19 bp, Homo sapiens
gctgggcccttcctggcta

SEQ ID NO: 5488971 - DNA, 19 bp, Homo sapiens
gctgggccgagtaccttaa

SEQ ID NO: 5488972 - DNA, 16 bp, Homo sapiens
gctgggccgcaagggc

SEQ ID NO: 5488973 - DNA, 17 bp, Homo sapiens
gctgggccgggacccag

SEQ ID NO: 5488974 - DNA, 14 bp, Homo sapiens
gctgggcctcctgc

SEQ ID NO: 5488975 - DNA, 16 bp, Homo sapiens
gctgggcctcctgcct

SEQ ID NO: 5488976 - DNA, 15 bp, Homo sapiens
gctgggcctccttct

SEQ ID NO: 5488977 - DNA, 19 bp, Homo sapiens
gctgggcctgcgagaccca

SEQ ID NO: 5488978 - DNA, 13 bp, Homo sapiens
gctgggcctgggc

SEQ ID NO: 5488979 - DNA, 13 bp, Homo sapiens
gctgggcctggtc

SEQ ID NO: 5488980 - DNA, 14 bp, Homo sapiens
gctgggcctgtgca

SEQ ID NO: 5488981 - DNA, 19 bp, Homo sapiens
gctgggcctgtgcactggg

SEQ ID NO: 5488982 - DNA, 13 bp, Homo sapiens
gctgggccttcac

SEQ ID NO: 5488983 - DNA, 16 bp, Homo sapiens
gctgggcgcctctgtc

SEQ ID NO: 5488984 - DNA, 19 bp, Homo sapiens
gctgggcgcctctgtcctg

SEQ ID NO: 5488985 - DNA, 20 bp, Homo sapiens
gctgggcgcctctgtcctgg

SEQ ID NO: 5488986 - DNA, 22 bp, Homo sapiens
gctgggcggggctcgaggctgg

SEQ ID NO: 5488987 - DNA, 22 bp, Homo sapiens
gctgggcggtgcggagcgggcc

SEQ ID NO: 5488988 - DNA, 16 bp, Homo sapiens
gctgggcgtctgttct

SEQ ID NO: 5488989 - DNA, 22 bp, Homo sapiens
gctgggctacaaaccaggagca

SEQ ID NO: 5488990 - DNA, 15 bp, Homo sapiens
gctgggctcccccca

SEQ ID NO: 5488991 - DNA, 16 bp, Homo sapiens
gctgggctccccccag

SEQ ID NO: 5488992 - DNA, 17 bp, Homo sapiens
gctgggctccccctgac

SEQ ID NO: 5488993 - DNA, 13 bp, Homo sapiens
gctgggctccctg

SEQ ID NO: 5488994 - DNA, 13 bp, Homo sapiens
gctgggctccctt

SEQ ID NO: 5488995 - DNA, 16 bp, Homo sapiens
gctgggctcccttccc

SEQ ID NO: 5488996 - DNA, 17 bp, Homo sapiens
gctgggctcccttccca

SEQ ID NO: 5488997 - DNA, 20 bp, Homo sapiens
gctgggctctccacctcagc

SEQ ID NO: 5488998 - DNA, 21 bp, Homo sapiens
gctgggctctgccaccctacc

SEQ ID NO: 5488999 - DNA, 15 bp, Homo sapiens
gctgggctctgcctg

SEQ ID NO: 5489000 - DNA, 16 bp, Homo sapiens
gctgggctctgcctgt

SEQ ID NO: 5489001 - DNA, 16 bp, Homo sapiens
gctgggctctggtggg

SEQ ID NO: 5489002 - DNA, 17 bp, Homo sapiens
gctgggctctggtgggg

SEQ ID NO: 5489003 - DNA, 18 bp, Homo sapiens
gctgggctgagccaaagc

SEQ ID NO: 5489004 - DNA, 19 bp, Homo sapiens
gctgggctgagccaaagcc

SEQ ID NO: 5489005 - DNA, 18 bp, Homo sapiens
gctgggctgagcccctac

SEQ ID NO: 5489006 - DNA, 16 bp, Homo sapiens
gctgggctgctcctga

SEQ ID NO: 5489007 - DNA, 15 bp, Homo sapiens
gctgggctggactgg

SEQ ID NO: 5489008 - DNA, 13 bp, Homo sapiens
gctgggctggcca

SEQ ID NO: 5489009 - DNA, 13 bp, Homo sapiens
gctgggctggctc

SEQ ID NO: 5489010 - DNA, 14 bp, Homo sapiens
gctgggctgggcac

SEQ ID NO: 5489011 - DNA, 14 bp, Homo sapiens
gctgggctgggcgc

SEQ ID NO: 5489012 - DNA, 15 bp, Homo sapiens
gctgggctggggcct

SEQ ID NO: 5489013 - DNA, 12 bp, Homo sapiens
gctgggctgtgg

SEQ ID NO: 5489014 - DNA, 19 bp, Homo sapiens
gctgggcttcagtggcagc

SEQ ID NO: 5489015 - DNA, 22 bp, Homo sapiens
gctgggcttggcagcccgggtc

SEQ ID NO: 5489016 - DNA, 18 bp, Homo sapiens
gctgggcttggcctggag

SEQ ID NO: 5489017 - DNA, 23 bp, Homo sapiens
gctggggaaatcaaaagggccaa

SEQ ID NO: 5489018 - DNA, 16 bp, Homo sapiens
gctggggaacagagcg

SEQ ID NO: 5489019 - DNA, 22 bp, Homo sapiens
gctggggaacagagcgggcctc

SEQ ID NO: 5489020 - DNA, 13 bp, Homo sapiens
gctggggaagaat

SEQ ID NO: 5489021 - DNA, 15 bp, Homo sapiens
gctggggaaggaagc

SEQ ID NO: 5489022 - DNA, 21 bp, Homo sapiens
gctggggaagggttttctttt

SEQ ID NO: 5489023 - DNA, 21 bp, Homo sapiens
gctggggaagtacgtcccagc

SEQ ID NO: 5489024 - DNA, 23 bp, Homo sapiens
gctggggacacacattctgcctt

SEQ ID NO: 5489025 - DNA, 13 bp, Homo sapiens
gctggggacagag

SEQ ID NO: 5489026 - DNA, 21 bp, Homo sapiens
gctggggacagctttcctggg

SEQ ID NO: 5489027 - DNA, 22 bp, Homo sapiens
gctggggacagctttcctgggt

SEQ ID NO: 5489028 - DNA, 14 bp, Homo sapiens
gctggggacccacc

SEQ ID NO: 5489029 - DNA, 22 bp, Homo sapiens
gctggggacccacccagcccct

SEQ ID NO: 5489030 - DNA, 23 bp, Homo sapiens
gctggggacggggggccccagtc

SEQ ID NO: 5489031 - DNA, 14 bp, Homo sapiens
gctggggactcagg

SEQ ID NO: 5489032 - DNA, 15 bp, Homo sapiens
gctggggactctggc

SEQ ID NO: 5489033 - DNA, 18 bp, Homo sapiens
gctggggactctggcaca

SEQ ID NO: 5489034 - DNA, 19 bp, Homo sapiens
gctggggactggggaaggg

SEQ ID NO: 5489035 - DNA, 15 bp, Homo sapiens
gctggggagaggaaa

SEQ ID NO: 5489036 - DNA, 17 bp, Homo sapiens
gctggggagatgggggc

SEQ ID NO: 5489037 - DNA, 18 bp, Homo sapiens
gctggggagatgggggct

SEQ ID NO: 5489038 - DNA, 14 bp, Homo sapiens
gctggggaggagga

SEQ ID NO: 5489039 - DNA, 17 bp, Homo sapiens
gctggggaggaggagag

SEQ ID NO: 5489040 - DNA, 15 bp, Homo sapiens
gctggggagggaggc

SEQ ID NO: 5489041 - DNA, 18 bp, Homo sapiens
gctggggaggtgctgggg

SEQ ID NO: 5489042 - DNA, 17 bp, Homo sapiens
gctggggcaagtccctg

SEQ ID NO: 5489043 - DNA, 18 bp, Homo sapiens
gctggggcagaggggcag

SEQ ID NO: 5489044 - DNA, 19 bp, Homo sapiens
gctggggcagaggggcagc

SEQ ID NO: 5489045 - DNA, 24 bp, Homo sapiens
gctggggcagaggggcagccgcta

SEQ ID NO: 5489046 - DNA, 18 bp, Homo sapiens
gctggggcagggcccagg

SEQ ID NO: 5489047 - DNA, 15 bp, Homo sapiens
gctggggcaggggcc

SEQ ID NO: 5489048 - DNA, 21 bp, Homo sapiens
gctggggcaggggcctgggcc

SEQ ID NO: 5489049 - DNA, 15 bp, Homo sapiens
gctggggcagggggt

SEQ ID NO: 5489050 - DNA, 16 bp, Homo sapiens
gctggggccaaataaa

SEQ ID NO: 5489051 - DNA, 12 bp, Homo sapiens
gctggggccacc

SEQ ID NO: 5489052 - DNA, 18 bp, Homo sapiens
gctggggccaccctggcc

SEQ ID NO: 5489053 - DNA, 13 bp, Homo sapiens
gctggggccagcg

SEQ ID NO: 5489054 - DNA, 13 bp, Homo sapiens
gctggggccaggg

SEQ ID NO: 5489055 - DNA, 14 bp, Homo sapiens
gctggggccagggc

SEQ ID NO: 5489056 - DNA, 15 bp, Homo sapiens
gctggggccagggca

SEQ ID NO: 5489057 - DNA, 15 bp, Homo sapiens
gctggggccccatct

SEQ ID NO: 5489058 - DNA, 20 bp, Homo sapiens
gctggggcccctcggctacc

SEQ ID NO: 5489059 - DNA, 18 bp, Homo sapiens
gctggggccgccacggcc

SEQ ID NO: 5489060 - DNA, 18 bp, Homo sapiens
gctggggccgctggggtc

SEQ ID NO: 5489061 - DNA, 17 bp, Homo sapiens
gctggggccggggctga

SEQ ID NO: 5489062 - DNA, 14 bp, Homo sapiens
gctggggcctcaga

SEQ ID NO: 5489063 - DNA, 16 bp, Homo sapiens
gctggggcctcagacg

SEQ ID NO: 5489064 - DNA, 12 bp, Homo sapiens
gctggggcctga

SEQ ID NO: 5489065 - DNA, 13 bp, Homo sapiens
gctggggcctggc

SEQ ID NO: 5489066 - DNA, 16 bp, Homo sapiens
gctggggcgggctagg

SEQ ID NO: 5489067 - DNA, 17 bp, Homo sapiens
gctggggcggggcccag

SEQ ID NO: 5489068 - DNA, 18 bp, Homo sapiens
gctggggcggggcccagg

SEQ ID NO: 5489069 - DNA, 22 bp, Homo sapiens
gctggggctaagcggtggagga

SEQ ID NO: 5489070 - DNA, 21 bp, Homo sapiens
gctggggctaggggaagggct

SEQ ID NO: 5489071 - DNA, 23 bp, Homo sapiens
gctggggctaggggaagggcttt

SEQ ID NO: 5489072 - DNA, 12 bp, Homo sapiens
gctggggctctc

SEQ ID NO: 5489073 - DNA, 16 bp, Homo sapiens
gctggggctctctgag

SEQ ID NO: 5489074 - DNA, 15 bp, Homo sapiens
gctggggctgcatga

SEQ ID NO: 5489075 - DNA, 20 bp, Homo sapiens
gctggggctgccagcctgag

SEQ ID NO: 5489076 - DNA, 19 bp, Homo sapiens
gctggggcttctttctgct

SEQ ID NO: 5489077 - DNA, 18 bp, Homo sapiens
gctggggcttggggattg

SEQ ID NO: 5489078 - DNA, 20 bp, Homo sapiens
gctggggcttttgtgccagg

SEQ ID NO: 5489079 - DNA, 22 bp, Homo sapiens
gctggggcttttgtgccaggag

SEQ ID NO: 5489080 - DNA, 18 bp, Homo sapiens
gctgggggaaggcaggag

SEQ ID NO: 5489081 - DNA, 15 bp, Homo sapiens
gctgggggaagggtg

SEQ ID NO: 5489082 - DNA, 16 bp, Homo sapiens
gctgggggaagggtgg

SEQ ID NO: 5489083 - DNA, 21 bp, Homo sapiens
gctgggggaatgagcccagag

SEQ ID NO: 5489084 - DNA, 18 bp, Homo sapiens
gctgggggcaactggcca

SEQ ID NO: 5489085 - DNA, 21 bp, Homo sapiens
gctgggggcacagctgtctgc

SEQ ID NO: 5489086 - DNA, 20 bp, Homo sapiens
gctgggggcagcctgcgtgg

SEQ ID NO: 5489087 - DNA, 19 bp, Homo sapiens
gctgggggcatgggggagg

SEQ ID NO: 5489088 - DNA, 18 bp, Homo sapiens
gctgggggccagctccag

SEQ ID NO: 5489089 - DNA, 23 bp, Homo sapiens
gctgggggccagggctggatgga

SEQ ID NO: 5489090 - DNA, 13 bp, Homo sapiens
gctgggggcctca

SEQ ID NO: 5489091 - DNA, 16 bp, Homo sapiens
gctgggggctcccctt

SEQ ID NO: 5489092 - DNA, 18 bp, Homo sapiens
gctgggggctccccttgc

SEQ ID NO: 5489093 - DNA, 12 bp, Homo sapiens
gctgggggctgc

SEQ ID NO: 5489094 - DNA, 14 bp, Homo sapiens
gctgggggctgcag

SEQ ID NO: 5489095 - DNA, 18 bp, Homo sapiens
gctgggggctgcagggct

SEQ ID NO: 5489096 - DNA, 20 bp, Homo sapiens
gctgggggctgcagggctgg

SEQ ID NO: 5489097 - DNA, 13 bp, Homo sapiens
gctgggggctgga

SEQ ID NO: 5489098 - DNA, 15 bp, Homo sapiens
gctgggggctggacc

SEQ ID NO: 5489099 - DNA, 16 bp, Homo sapiens
gctgggggctggacct

SEQ ID NO: 5489100 - DNA, 17 bp, Homo sapiens
gctgggggctggacctg

SEQ ID NO: 5489101 - DNA, 15 bp, Homo sapiens
gctggggggcacccc

SEQ ID NO: 5489102 - DNA, 18 bp, Homo sapiens
gctggggggtctcagcat

SEQ ID NO: 5489103 - DNA, 20 bp, Homo sapiens
gctggggggttggcagccca

SEQ ID NO: 5489104 - DNA, 18 bp, Homo sapiens
gctgggggtgaggggcca

SEQ ID NO: 5489105 - DNA, 22 bp, Homo sapiens
gctgggggtgaggggccaggcc

SEQ ID NO: 5489106 - DNA, 23 bp, Homo sapiens
gctgggggtgaggggccaggcca

SEQ ID NO: 5489107 - DNA, 15 bp, Homo sapiens
gctgggggtgctgga

SEQ ID NO: 5489108 - DNA, 19 bp, Homo sapiens
gctggggtacacagtgaga

SEQ ID NO: 5489109 - DNA, 22 bp, Homo sapiens
gctggggtacacagtgagagta

SEQ ID NO: 5489110 - DNA, 16 bp, Homo sapiens
gctggggtcccagcag

SEQ ID NO: 5489111 - DNA, 19 bp, Homo sapiens
gctggggtcccagcagctg

SEQ ID NO: 5489112 - DNA, 22 bp, Homo sapiens
gctggggtcctcctgtgctatt

SEQ ID NO: 5489113 - DNA, 18 bp, Homo sapiens
gctggggtgagagaggaa

SEQ ID NO: 5489114 - DNA, 18 bp, Homo sapiens
gctggggtgagcctgact

SEQ ID NO: 5489115 - DNA, 20 bp, Homo sapiens
gctggggtggcctgtgtggc

SEQ ID NO: 5489116 - DNA, 17 bp, Homo sapiens
gctggggtggggacctc

SEQ ID NO: 5489117 - DNA, 19 bp, Homo sapiens
gctggggtggggacctcag

SEQ ID NO: 5489118 - DNA, 23 bp, Homo sapiens
gctggggtggggacctcaggcct

SEQ ID NO: 5489119 - DNA, 14 bp, Homo sapiens
gctggggtgtcaat

SEQ ID NO: 5489120 - DNA, 14 bp, Homo sapiens
gctggggttatctg

SEQ ID NO: 5489121 - DNA, 16 bp, Homo sapiens
gctggggttgccagag

SEQ ID NO: 5489122 - DNA, 20 bp, Homo sapiens
gctggggttgccagaggccc

SEQ ID NO: 5489123 - DNA, 21 bp, Homo sapiens
gctggggttgccagaggccct

SEQ ID NO: 5489124 - DNA, 19 bp, Homo sapiens
gctgggtattaccatgtaa

SEQ ID NO: 5489125 - DNA, 18 bp, Homo sapiens
gctgggtcaaaagagccc

SEQ ID NO: 5489126 - DNA, 19 bp, Homo sapiens
gctgggtcaaaagagccct

SEQ ID NO: 5489127 - DNA, 17 bp, Homo sapiens
gctgggtcacaggaagg

SEQ ID NO: 5489128 - DNA, 13 bp, Homo sapiens
gctgggtcagggg

SEQ ID NO: 5489129 - DNA, 17 bp, Homo sapiens
gctgggtccaggggagg

SEQ ID NO: 5489130 - DNA, 14 bp, Homo sapiens
gctgggtcccgggt

SEQ ID NO: 5489131 - DNA, 19 bp, Homo sapiens
gctgggtcctctgcagtgt

SEQ ID NO: 5489132 - DNA, 20 bp, Homo sapiens
gctgggtccttgggcctggc

SEQ ID NO: 5489133 - DNA, 12 bp, Homo sapiens
gctgggtcgccc

SEQ ID NO: 5489134 - DNA, 14 bp, Homo sapiens
gctgggtcgcccct

SEQ ID NO: 5489135 - DNA, 17 bp, Homo sapiens
gctgggtcgcccctcct

SEQ ID NO: 5489136 - DNA, 18 bp, Homo sapiens
gctgggtcgcccctcctc

SEQ ID NO: 5489137 - DNA, 20 bp, Homo sapiens
gctgggtctccctttccatg

SEQ ID NO: 5489138 - DNA, 18 bp, Homo sapiens
gctgggtgagctcttcca

SEQ ID NO: 5489139 - DNA, 13 bp, Homo sapiens
gctgggtgcccac

SEQ ID NO: 5489140 - DNA, 15 bp, Homo sapiens
gctgggtgccccagg

SEQ ID NO: 5489141 - DNA, 17 bp, Homo sapiens
gctgggtgccccaggga

SEQ ID NO: 5489142 - DNA, 15 bp, Homo sapiens
gctgggtgccctctc

SEQ ID NO: 5489143 - DNA, 16 bp, Homo sapiens
gctgggtgccctctca

SEQ ID NO: 5489144 - DNA, 18 bp, Homo sapiens
gctgggtgccctctcagg

SEQ ID NO: 5489145 - DNA, 13 bp, Homo sapiens
gctgggtgcctgc

SEQ ID NO: 5489146 - DNA, 19 bp, Homo sapiens
gctgggtgcctgcagcgcc

SEQ ID NO: 5489147 - DNA, 18 bp, Homo sapiens
gctgggtgcgaccccatc

SEQ ID NO: 5489148 - DNA, 21 bp, Homo sapiens
gctgggtgcgaccccatctgc

SEQ ID NO: 5489149 - DNA, 23 bp, Homo sapiens
gctgggtgcgaccccatctgccc

SEQ ID NO: 5489150 - DNA, 22 bp, Homo sapiens
gctgggtggcacaccacccgag

SEQ ID NO: 5489151 - DNA, 23 bp, Homo sapiens
gctgggtggcaccagcagcctgg

SEQ ID NO: 5489152 - DNA, 14 bp, Homo sapiens
gctgggtggcactg

SEQ ID NO: 5489153 - DNA, 20 bp, Homo sapiens
gctgggtggccggccctgcc

SEQ ID NO: 5489154 - DNA, 21 bp, Homo sapiens
gctgggtggccggccctgccc

SEQ ID NO: 5489155 - DNA, 14 bp, Homo sapiens
gctgggtggcctgt

SEQ ID NO: 5489156 - DNA, 13 bp, Homo sapiens
gctgggtgggaat

SEQ ID NO: 5489157 - DNA, 20 bp, Homo sapiens
gctgggtgggcccagaactg

SEQ ID NO: 5489158 - DNA, 21 bp, Homo sapiens
gctgggtggttttttccccct

SEQ ID NO: 5489159 - DNA, 15 bp, Homo sapiens
gctgggtgtggcgca

SEQ ID NO: 5489160 - DNA, 22 bp, Homo sapiens
gctgggtgtttttttttaaaag

SEQ ID NO: 5489161 - DNA, 20 bp, Homo sapiens
gctgggttcccactcccggc

SEQ ID NO: 5489162 - DNA, 15 bp, Homo sapiens
gctgggttctgatcc

SEQ ID NO: 5489163 - DNA, 14 bp, Homo sapiens
gctgggttctgcac

SEQ ID NO: 5489164 - DNA, 17 bp, Homo sapiens
gctgggttctggggctg

SEQ ID NO: 5489165 - DNA, 18 bp, Homo sapiens
gctgggttctggggctga

SEQ ID NO: 5489166 - DNA, 21 bp, Homo sapiens
gctgggttctggggctgagag

SEQ ID NO: 5489167 - DNA, 14 bp, Homo sapiens
gctgggttggaggg

SEQ ID NO: 5489168 - DNA, 16 bp, Homo sapiens
gctgggttggtgcaca

SEQ ID NO: 5489169 - DNA, 18 bp, Homo sapiens
gctgggtttgctgtcttg

SEQ ID NO: 5489170 - DNA, 21 bp, Homo sapiens
gctgggttttcaggggctttg

SEQ ID NO: 5489171 - DNA, 22 bp, Homo sapiens
gctggtaacagttcatgtttgc

SEQ ID NO: 5489172 - DNA, 14 bp, Homo sapiens
gctggtaactgtta

SEQ ID NO: 5489173 - DNA, 15 bp, Homo sapiens
gctggtaactgttaa

SEQ ID NO: 5489174 - DNA, 23 bp, Homo sapiens
gctggtaatttgtatctgaagga

SEQ ID NO: 5489175 - DNA, 14 bp, Homo sapiens
gctggtacctgccc

SEQ ID NO: 5489176 - DNA, 17 bp, Homo sapiens
gctggtacctgccctct

SEQ ID NO: 5489177 - DNA, 20 bp, Homo sapiens
gctggtagaaaaaggggcct

SEQ ID NO: 5489178 - DNA, 14 bp, Homo sapiens
gctggtagatgctg

SEQ ID NO: 5489179 - DNA, 17 bp, Homo sapiens
gctggtagatgctgagg

SEQ ID NO: 5489180 - DNA, 18 bp, Homo sapiens
gctggtagatgctgaggc

SEQ ID NO: 5489181 - DNA, 13 bp, Homo sapiens
gctggtagcagca

SEQ ID NO: 5489182 - DNA, 16 bp, Homo sapiens
gctggtagcagcaggc

SEQ ID NO: 5489183 - DNA, 14 bp, Homo sapiens
gctggtagctcagg

SEQ ID NO: 5489184 - DNA, 15 bp, Homo sapiens
gctggtagctcaggt

SEQ ID NO: 5489185 - DNA, 13 bp, Homo sapiens
gctggtagttagt

SEQ ID NO: 5489186 - DNA, 17 bp, Homo sapiens
gctggtatattgtgtaa

SEQ ID NO: 5489187 - DNA, 16 bp, Homo sapiens
gctggtattctctcta

SEQ ID NO: 5489188 - DNA, 20 bp, Homo sapiens
gctggtattctctctatgca

SEQ ID NO: 5489189 - DNA, 23 bp, Homo sapiens
gctggtattggaatagcagcctc

SEQ ID NO: 5489190 - DNA, 22 bp, Homo sapiens
gctggtcaaacaaactctctga

SEQ ID NO: 5489191 - DNA, 17 bp, Homo sapiens
gctggtcacagcctcct

SEQ ID NO: 5489192 - DNA, 18 bp, Homo sapiens
gctggtcacagcctcctc

SEQ ID NO: 5489193 - DNA, 22 bp, Homo sapiens
gctggtcacagcctcctctgtc

SEQ ID NO: 5489194 - DNA, 15 bp, Homo sapiens
gctggtcacctccca

SEQ ID NO: 5489195 - DNA, 19 bp, Homo sapiens
gctggtcactctgccctct

SEQ ID NO: 5489196 - DNA, 20 bp, Homo sapiens
gctggtcacttcttctgtcc

SEQ ID NO: 5489197 - DNA, 22 bp, Homo sapiens
gctggtcacttcttctgtccaa

SEQ ID NO: 5489198 - DNA, 14 bp, Homo sapiens
gctggtcagagtgg

SEQ ID NO: 5489199 - DNA, 20 bp, Homo sapiens
gctggtcagtctttgctcag

SEQ ID NO: 5489200 - DNA, 23 bp, Homo sapiens
gctggtcagtctttgctcagtgt

SEQ ID NO: 5489201 - DNA, 17 bp, Homo sapiens
gctggtcatcctgggca

SEQ ID NO: 5489202 - DNA, 21 bp, Homo sapiens
gctggtcatccttggtgctct

SEQ ID NO: 5489203 - DNA, 14 bp, Homo sapiens
gctggtccagggct

SEQ ID NO: 5489204 - DNA, 14 bp, Homo sapiens
gctggtcccacact

SEQ ID NO: 5489205 - DNA, 18 bp, Homo sapiens
gctggtccgagctgagga

SEQ ID NO: 5489206 - DNA, 20 bp, Homo sapiens
gctggtcctatggcctcatg

SEQ ID NO: 5489207 - DNA, 13 bp, Homo sapiens
gctggtcctgacc

SEQ ID NO: 5489208 - DNA, 19 bp, Homo sapiens
gctggtcctgaccaggatg

SEQ ID NO: 5489209 - DNA, 13 bp, Homo sapiens
gctggtcctgcac

SEQ ID NO: 5489210 - DNA, 18 bp, Homo sapiens
gctggtcctgcacatgag

SEQ ID NO: 5489211 - DNA, 19 bp, Homo sapiens
gctggtcctgcacatgagt

SEQ ID NO: 5489212 - DNA, 13 bp, Homo sapiens
gctggtcctgtgg

SEQ ID NO: 5489213 - DNA, 14 bp, Homo sapiens
gctggtccttattt

SEQ ID NO: 5489214 - DNA, 17 bp, Homo sapiens
gctggtcctttcttccg

SEQ ID NO: 5489215 - DNA, 18 bp, Homo sapiens
gctggtctcaaactcctg

SEQ ID NO: 5489216 - DNA, 19 bp, Homo sapiens
gctggtctcaaactcctga

SEQ ID NO: 5489217 - DNA, 17 bp, Homo sapiens
gctggtctccctccagc

SEQ ID NO: 5489218 - DNA, 20 bp, Homo sapiens
gctggtctcgaactcctgac

SEQ ID NO: 5489219 - DNA, 22 bp, Homo sapiens
gctggtctcgaactcctgacct

SEQ ID NO: 5489220 - DNA, 20 bp, Homo sapiens
gctggtctggagtcccaccc

SEQ ID NO: 5489221 - DNA, 16 bp, Homo sapiens
gctggtctgtttccag

SEQ ID NO: 5489222 - DNA, 19 bp, Homo sapiens
gctggtcttaaactcctgg

SEQ ID NO: 5489223 - DNA, 21 bp, Homo sapiens
gctggtcttcactttcctcag

SEQ ID NO: 5489224 - DNA, 21 bp, Homo sapiens
gctggtcttgaactcttggcc

SEQ ID NO: 5489225 - DNA, 22 bp, Homo sapiens
gctggtcttgaactcttggcct

SEQ ID NO: 5489226 - DNA, 12 bp, Homo sapiens
gctggtctttat

SEQ ID NO: 5489227 - DNA, 17 bp, Homo sapiens
gctggtctttgagcgag

SEQ ID NO: 5489228 - DNA, 16 bp, Homo sapiens
gctggtgaacactgtg

SEQ ID NO: 5489229 - DNA, 22 bp, Homo sapiens
gctggtgaacactgtgaccagg

SEQ ID NO: 5489230 - DNA, 17 bp, Homo sapiens
gctggtgacagccttgg

SEQ ID NO: 5489231 - DNA, 23 bp, Homo sapiens
gctggtgacagccttgggccttt

SEQ ID NO: 5489232 - DNA, 13 bp, Homo sapiens
gctggtgagaccc

SEQ ID NO: 5489233 - DNA, 13 bp, Homo sapiens
gctggtgaggccg

SEQ ID NO: 5489234 - DNA, 22 bp, Homo sapiens
gctggtgaggccggccctgccc

SEQ ID NO: 5489235 - DNA, 13 bp, Homo sapiens
gctggtgcaaaga

SEQ ID NO: 5489236 - DNA, 20 bp, Homo sapiens
gctggtgcattacagagagg

SEQ ID NO: 5489237 - DNA, 15 bp, Homo sapiens
gctggtgccagcctt

SEQ ID NO: 5489238 - DNA, 17 bp, Homo sapiens
gctggtgccagggtggg

SEQ ID NO: 5489239 - DNA, 18 bp, Homo sapiens
gctggtgccagggtgggt

SEQ ID NO: 5489240 - DNA, 13 bp, Homo sapiens
gctggtgcccacc

SEQ ID NO: 5489241 - DNA, 22 bp, Homo sapiens
gctggtgcccaccagctggctc

SEQ ID NO: 5489242 - DNA, 15 bp, Homo sapiens
gctggtgcccaccct

SEQ ID NO: 5489243 - DNA, 20 bp, Homo sapiens
gctggtgcccacccttcgca

SEQ ID NO: 5489244 - DNA, 14 bp, Homo sapiens
gctggtgccccaca

SEQ ID NO: 5489245 - DNA, 15 bp, Homo sapiens
gctggtgccccacag

SEQ ID NO: 5489246 - DNA, 14 bp, Homo sapiens
gctggtgccccacc

SEQ ID NO: 5489247 - DNA, 15 bp, Homo sapiens
gctggtgccccacct

SEQ ID NO: 5489248 - DNA, 20 bp, Homo sapiens
gctggtgccccacctgcctg

SEQ ID NO: 5489249 - DNA, 12 bp, Homo sapiens
gctggtgccccc

SEQ ID NO: 5489250 - DNA, 15 bp, Homo sapiens
gctggtgcccccaga

SEQ ID NO: 5489251 - DNA, 24 bp, Homo sapiens
gctggtgccctgctttcagatact

SEQ ID NO: 5489252 - DNA, 23 bp, Homo sapiens
gctggtgcctcttttcagtagtg

SEQ ID NO: 5489253 - DNA, 15 bp, Homo sapiens
gctggtgcctgagcc

SEQ ID NO: 5489254 - DNA, 13 bp, Homo sapiens
gctggtgcctgct

SEQ ID NO: 5489255 - DNA, 18 bp, Homo sapiens
gctggtgcggatggacac

SEQ ID NO: 5489256 - DNA, 23 bp, Homo sapiens
gctggtggaaagcgattcactgt

SEQ ID NO: 5489257 - DNA, 12 bp, Homo sapiens
gctggtggacca

SEQ ID NO: 5489258 - DNA, 16 bp, Homo sapiens
gctggtggacccaggg

SEQ ID NO: 5489259 - DNA, 12 bp, Homo sapiens
gctggtggagga

SEQ ID NO: 5489260 - DNA, 23 bp, Homo sapiens
gctggtggaggaagggctgggcc

SEQ ID NO: 5489261 - DNA, 16 bp, Homo sapiens
gctggtggatggtgac

SEQ ID NO: 5489262 - DNA, 19 bp, Homo sapiens
gctgtgcaacgccgtgggc

SEQ ID NO: 5489263 - DNA, 23 bp, Homo sapiens
gctgtgcaacgccgtgggctgcg

SEQ ID NO: 5489264 - DNA, 16 bp, Homo sapiens
gctgtgcagcctgtcc

SEQ ID NO: 5489265 - DNA, 11 bp, Homo sapiens
gctgtgccaaa

SEQ ID NO: 5489266 - DNA, 14 bp, Homo sapiens
gctgtgccacaggc

SEQ ID NO: 5489267 - DNA, 18 bp, Homo sapiens
gctgtgccaccctgggct

SEQ ID NO: 5489268 - DNA, 19 bp, Homo sapiens
gctgtgccaccctgggctc

SEQ ID NO: 5489269 - DNA, 17 bp, Homo sapiens
gctgtgccagctgcttc

SEQ ID NO: 5489270 - DNA, 20 bp, Homo sapiens
gctgtgccagctgcttctgc

SEQ ID NO: 5489271 - DNA, 23 bp, Homo sapiens
gctgtgccagctgcttctgccca

SEQ ID NO: 5489272 - DNA, 14 bp, Homo sapiens
gctgtgccaggact

SEQ ID NO: 5489273 - DNA, 19 bp, Homo sapiens
gctgtgccaggcgaggccc

SEQ ID NO: 5489274 - DNA, 16 bp, Homo sapiens
gctgtgccaggctggg

SEQ ID NO: 5489275 - DNA, 18 bp, Homo sapiens
gctgtgccaggctgggag

SEQ ID NO: 5489276 - DNA, 15 bp, Homo sapiens
gctgtgcccagcagg

SEQ ID NO: 5489277 - DNA, 18 bp, Homo sapiens
gctgtgcccagcaggccc

SEQ ID NO: 5489278 - DNA, 19 bp, Homo sapiens
gctgtgcccccctcctccc

SEQ ID NO: 5489279 - DNA, 21 bp, Homo sapiens
gctgtgcccccctcctccccg

SEQ ID NO: 5489280 - DNA, 16 bp, Homo sapiens
gctgtgcccctgatgc

SEQ ID NO: 5489281 - DNA, 20 bp, Homo sapiens
gctgtgcccgccctgggctg

SEQ ID NO: 5489282 - DNA, 19 bp, Homo sapiens
gctgtgcccggccccaccc

SEQ ID NO: 5489283 - DNA, 20 bp, Homo sapiens
gctgtgccgggaggcagcca

SEQ ID NO: 5489284 - DNA, 14 bp, Homo sapiens
gctgtgcctctgcc

SEQ ID NO: 5489285 - DNA, 15 bp, Homo sapiens
gctgtgcctgctaga

SEQ ID NO: 5489286 - DNA, 16 bp, Homo sapiens
gctgtgcctgctagag

SEQ ID NO: 5489287 - DNA, 20 bp, Homo sapiens
gctgtgcctgctagagcaac

SEQ ID NO: 5489288 - DNA, 22 bp, Homo sapiens
gctgtgcctgctagagcaaccc

SEQ ID NO: 5489289 - DNA, 17 bp, Homo sapiens
gctgtgcctgctcagca

SEQ ID NO: 5489290 - DNA, 15 bp, Homo sapiens
gctgtgcctgcttct

SEQ ID NO: 5489291 - DNA, 21 bp, Homo sapiens
gctgtgccttcagctgttgca

SEQ ID NO: 5489292 - DNA, 15 bp, Homo sapiens
gctgtgccttccctt

SEQ ID NO: 5489293 - DNA, 21 bp, Homo sapiens
gctgtgcgctgacaaccaccg

SEQ ID NO: 5489294 - DNA, 18 bp, Homo sapiens
gctgtgcggatctctgga

SEQ ID NO: 5489295 - DNA, 20 bp, Homo sapiens
gctgtgcggcctcaccaggc

SEQ ID NO: 5489296 - DNA, 18 bp, Homo sapiens
gctgtgcgtggaaaaaga

SEQ ID NO: 5489297 - DNA, 16 bp, Homo sapiens
gctgtgcgtgtgtgtg

SEQ ID NO: 5489298 - DNA, 20 bp, Homo sapiens
gctgtgctacgtgtgaaatc

SEQ ID NO: 5489299 - DNA, 14 bp, Homo sapiens
gctgtgctagcttt

SEQ ID NO: 5489300 - DNA, 15 bp, Homo sapiens
gctgtgctatgaatt

SEQ ID NO: 5489301 - DNA, 16 bp, Homo sapiens
gctgtgctatgaattt

SEQ ID NO: 5489302 - DNA, 17 bp, Homo sapiens
gctgtgctatggtgctc

SEQ ID NO: 5489303 - DNA, 12 bp, Homo sapiens
gctgtgctcaga

SEQ ID NO: 5489304 - DNA, 21 bp, Homo sapiens
gctgtgctccagcagtgctgg

SEQ ID NO: 5489305 - DNA, 16 bp, Homo sapiens
gctgtgctctggacag

SEQ ID NO: 5489306 - DNA, 18 bp, Homo sapiens
gctgtgctctggacaggc

SEQ ID NO: 5489307 - DNA, 13 bp, Homo sapiens
gctgtgctctggc

SEQ ID NO: 5489308 - DNA, 17 bp, Homo sapiens
gctgtgctctggcacca

SEQ ID NO: 5489309 - DNA, 13 bp, Homo sapiens
gctgtgctgccct

SEQ ID NO: 5489310 - DNA, 14 bp, Homo sapiens
gctgtgctgccctg

SEQ ID NO: 5489311 - DNA, 16 bp, Homo sapiens
gctgtgctgccctgaa

SEQ ID NO: 5489312 - DNA, 19 bp, Homo sapiens
gctgtgctgccctgcccac

SEQ ID NO: 5489313 - DNA, 11 bp, Homo sapiens
gctgtgctgga

SEQ ID NO: 5489314 - DNA, 12 bp, Homo sapiens
gctgtgctggaa

SEQ ID NO: 5489315 - DNA, 14 bp, Homo sapiens
gctgtgctgggagg

SEQ ID NO: 5489316 - DNA, 18 bp, Homo sapiens
gctgtgctggtctctagg

SEQ ID NO: 5489317 - DNA, 23 bp, Homo sapiens
gctgtgctggtctctaggcctga

SEQ ID NO: 5489318 - DNA, 15 bp, Homo sapiens
gctgtgctggttctg

SEQ ID NO: 5489319 - DNA, 23 bp, Homo sapiens
gctgtgctttatttgtgaaactt

SEQ ID NO: 5489320 - DNA, 15 bp, Homo sapiens
gctgtgctttggaac

SEQ ID NO: 5489321 - DNA, 20 bp, Homo sapiens
gctgtgcttttgatctctgc

SEQ ID NO: 5489322 - DNA, 22 bp, Homo sapiens
gctgtggaaaggattctaaaca

SEQ ID NO: 5489323 - DNA, 15 bp, Homo sapiens
gctgtggaagcaaca

SEQ ID NO: 5489324 - DNA, 20 bp, Homo sapiens
gctgtggaatgaagcttttt

SEQ ID NO: 5489325 - DNA, 12 bp, Homo sapiens
gctgtggaccgt

SEQ ID NO: 5489326 - DNA, 21 bp, Homo sapiens
gctgtggaccgtggacaggcc

SEQ ID NO: 5489327 - DNA, 24 bp, Homo sapiens
gctgtggaccgtggacaggcccag

SEQ ID NO: 5489328 - DNA, 19 bp, Homo sapiens
gctgtggactgtcctgagg

SEQ ID NO: 5489329 - DNA, 21 bp, Homo sapiens
gctgtggagacaatgtctgca

SEQ ID NO: 5489330 - DNA, 23 bp, Homo sapiens
gctgtggaggattgctatctgga

SEQ ID NO: 5489331 - DNA, 12 bp, Homo sapiens
gctgtggaggcc

SEQ ID NO: 5489332 - DNA, 13 bp, Homo sapiens
gctgtggaggcct

SEQ ID NO: 5489333 - DNA, 14 bp, Homo sapiens
gctgtggaggcctg

SEQ ID NO: 5489334 - DNA, 22 bp, Homo sapiens
gctgtggaggcctgatgctgcc

SEQ ID NO: 5489335 - DNA, 19 bp, Homo sapiens
gctgtggagtagagtttgt

SEQ ID NO: 5489336 - DNA, 18 bp, Homo sapiens
gctgtggagtgaggtgta

SEQ ID NO: 5489337 - DNA, 13 bp, Homo sapiens
gctgtggcacaga

SEQ ID NO: 5489338 - DNA, 12 bp, Homo sapiens
gctgtggcagcc

SEQ ID NO: 5489339 - DNA, 23 bp, Homo sapiens
gctgtggcagccgtcccaggcca

SEQ ID NO: 5489340 - DNA, 22 bp, Homo sapiens
gctgtggcatttccaaacatcc

SEQ ID NO: 5489341 - DNA, 15 bp, Homo sapiens
gctgtggccaggcct

SEQ ID NO: 5489342 - DNA, 20 bp, Homo sapiens
gctgtggccaggcctgcaga

SEQ ID NO: 5489343 - DNA, 13 bp, Homo sapiens
gctgtggccaggg

SEQ ID NO: 5489344 - DNA, 19 bp, Homo sapiens
gctgtggccagggtgagag

SEQ ID NO: 5489345 - DNA, 15 bp, Homo sapiens
gctgtggccctgccc

SEQ ID NO: 5489346 - DNA, 16 bp, Homo sapiens
gctgtggccctgccct

SEQ ID NO: 5489347 - DNA, 18 bp, Homo sapiens
gctgtggccctgcccttg

SEQ ID NO: 5489348 - DNA, 13 bp, Homo sapiens
gctgtggccctgg

SEQ ID NO: 5489349 - DNA, 20 bp, Homo sapiens
gctgtggccgtctcctccct

SEQ ID NO: 5489350 - DNA, 20 bp, Homo sapiens
gctgtggcctaacctgccga

SEQ ID NO: 5489351 - DNA, 12 bp, Homo sapiens
gctgtggcctca

SEQ ID NO: 5489352 - DNA, 21 bp, Homo sapiens
gctgtggcctcacttccctgg

SEQ ID NO: 5489353 - DNA, 12 bp, Homo sapiens
gctgtggctcct

SEQ ID NO: 5489354 - DNA, 19 bp, Homo sapiens
gctgtggctcctgccttga

SEQ ID NO: 5489355 - DNA, 14 bp, Homo sapiens
gctgtggctctggg

SEQ ID NO: 5489356 - DNA, 12 bp, Homo sapiens
gctgtggctggg

SEQ ID NO: 5489357 - DNA, 14 bp, Homo sapiens
gctgtggctggggg

SEQ ID NO: 5489358 - DNA, 19 bp, Homo sapiens
gctgtggctgggtggtcag

SEQ ID NO: 5489359 - DNA, 15 bp, Homo sapiens
gctgtgggaaatggt

SEQ ID NO: 5489360 - DNA, 15 bp, Homo sapiens
gctgtgggcagcacc

SEQ ID NO: 5489361 - DNA, 18 bp, Homo sapiens
gctgtgggcagcaccctc

SEQ ID NO: 5489362 - DNA, 20 bp, Homo sapiens
gctgtgggcagcaccctccc

SEQ ID NO: 5489363 - DNA, 21 bp, Homo sapiens
gctgtgggcaggcaagccctt

SEQ ID NO: 5489364 - DNA, 18 bp, Homo sapiens
gctgtgggcgagcatggg

SEQ ID NO: 5489365 - DNA, 20 bp, Homo sapiens
gctgtgggcgtgagacctgc

SEQ ID NO: 5489366 - DNA, 14 bp, Homo sapiens
gctgtgggctccct

SEQ ID NO: 5489367 - DNA, 22 bp, Homo sapiens
gctgtggggcagctgagcagct

SEQ ID NO: 5489368 - DNA, 22 bp, Homo sapiens
gctgtgggggaggtccctgcca

SEQ ID NO: 5489369 - DNA, 19 bp, Homo sapiens
gctgtggggtatacagcat

SEQ ID NO: 5489370 - DNA, 13 bp, Homo sapiens
gctgtggggtggg

SEQ ID NO: 5489371 - DNA, 18 bp, Homo sapiens
gctgtgggtacagagagg

SEQ ID NO: 5489372 - DNA, 16 bp, Homo sapiens
gctgtgggtagatgtg

SEQ ID NO: 5489373 - DNA, 20 bp, Homo sapiens
gctgtgggtcagtgtgccac

SEQ ID NO: 5489374 - DNA, 14 bp, Homo sapiens
gctgtgggtgggga

SEQ ID NO: 5489375 - DNA, 22 bp, Homo sapiens
gctgtggtaagggttgggcccc

SEQ ID NO: 5489376 - DNA, 19 bp, Homo sapiens
gctgtggtcaaggctacag

SEQ ID NO: 5489377 - DNA, 15 bp, Homo sapiens
gctgtggtcagcaga

SEQ ID NO: 5489378 - DNA, 20 bp, Homo sapiens
gctgtggtctataaaataaa

SEQ ID NO: 5489379 - DNA, 18 bp, Homo sapiens
gctgtggtggctgtctct

SEQ ID NO: 5489380 - DNA, 15 bp, Homo sapiens
gctgtggttcactgc

SEQ ID NO: 5489381 - DNA, 20 bp, Homo sapiens
gctgtggttcctaagcctgt

SEQ ID NO: 5489382 - DNA, 15 bp, Homo sapiens
gctgtggttttcttt

SEQ ID NO: 5489383 - DNA, 12 bp, Homo sapiens
gctgtgtaaagt

SEQ ID NO: 5489384 - DNA, 14 bp, Homo sapiens
gctgtgtaaagtta

SEQ ID NO: 5489385 - DNA, 18 bp, Homo sapiens
gctgtgtaaagttagtct

SEQ ID NO: 5489386 - DNA, 19 bp, Homo sapiens
gctgtgtaaagttagtcta

SEQ ID NO: 5489387 - DNA, 15 bp, Homo sapiens
gctgtgtagttccct

SEQ ID NO: 5489388 - DNA, 20 bp, Homo sapiens
gctgtgtagttccctctgcc

SEQ ID NO: 5489389 - DNA, 22 bp, Homo sapiens
gctgtgtccaaaaccgccagct

SEQ ID NO: 5489390 - DNA, 18 bp, Homo sapiens
gctgtgtccaactccagt

SEQ ID NO: 5489391 - DNA, 21 bp, Homo sapiens
gctgtgtccgctttcatgaac

SEQ ID NO: 5489392 - DNA, 18 bp, Homo sapiens
gctgtgtccttgcacctg

SEQ ID NO: 5489393 - DNA, 23 bp, Homo sapiens
gctgtgtccttgcacctgcatcc

SEQ ID NO: 5489394 - DNA, 14 bp, Homo sapiens
gctgtgtctaaact

SEQ ID NO: 5489395 - DNA, 16 bp, Homo sapiens
gctgtgtctaaactgc

SEQ ID NO: 5489396 - DNA, 15 bp, Homo sapiens
gctgtgtctcacaga

SEQ ID NO: 5489397 - DNA, 13 bp, Homo sapiens
gctgtgtctctgc

SEQ ID NO: 5489398 - DNA, 13 bp, Homo sapiens
gctgtgtctctgt

SEQ ID NO: 5489399 - DNA, 15 bp, Homo sapiens
gctgtgtctctgtat

SEQ ID NO: 5489400 - DNA, 14 bp, Homo sapiens
gctgtgtctgagcc

SEQ ID NO: 5489401 - DNA, 15 bp, Homo sapiens
gctgtgtctgagccc

SEQ ID NO: 5489402 - DNA, 21 bp, Homo sapiens
gctgtgtctgccaaacacatt

SEQ ID NO: 5489403 - DNA, 17 bp, Homo sapiens
gctgtgtcttcattttc

SEQ ID NO: 5489404 - DNA, 16 bp, Homo sapiens
gctgtgtgaaatcttt

SEQ ID NO: 5489405 - DNA, 19 bp, Homo sapiens
gctgtgtgaattcccaggt

SEQ ID NO: 5489406 - DNA, 17 bp, Homo sapiens
gctgtgtgaatttttct

SEQ ID NO: 5489407 - DNA, 20 bp, Homo sapiens
gctgtgtgacagaatcttgt

SEQ ID NO: 5489408 - DNA, 22 bp, Homo sapiens
gctgtgtgacagaatcttgtat

SEQ ID NO: 5489409 - DNA, 13 bp, Homo sapiens
gctgtgtgacctt

SEQ ID NO: 5489410 - DNA, 12 bp, Homo sapiens
gctgtgtgactt

SEQ ID NO: 5489411 - DNA, 22 bp, Homo sapiens
gctgtgtgagaccaggggacca

SEQ ID NO: 5489412 - DNA, 23 bp, Homo sapiens
gctgtgtgagtgagcacacccgt

SEQ ID NO: 5489413 - DNA, 14 bp, Homo sapiens
gctgtgtgattaga

SEQ ID NO: 5489414 - DNA, 16 bp, Homo sapiens
gctgtgtgcagagtat

SEQ ID NO: 5489415 - DNA, 13 bp, Homo sapiens
gctgtgtgcagtc

SEQ ID NO: 5489416 - DNA, 12 bp, Homo sapiens
gctgtgtgcccc

SEQ ID NO: 5489417 - DNA, 14 bp, Homo sapiens
gctgtgtgccccac

SEQ ID NO: 5489418 - DNA, 20 bp, Homo sapiens
gctgtgtgccccactccagc

SEQ ID NO: 5489419 - DNA, 22 bp, Homo sapiens
gctgtgtggacttcatctcaag

SEQ ID NO: 5489420 - DNA, 11 bp, Homo sapiens
gctgtgtggcc

SEQ ID NO: 5489421 - DNA, 13 bp, Homo sapiens
gctgtgtggccaa

SEQ ID NO: 5489422 - DNA, 14 bp, Homo sapiens
gctgtgtggccaac

SEQ ID NO: 5489423 - DNA, 15 bp, Homo sapiens
gctgtgtggccaacc

SEQ ID NO: 5489424 - DNA, 20 bp, Homo sapiens
gctgtgtggccaaccaggac

SEQ ID NO: 5489425 - DNA, 21 bp, Homo sapiens
gctgtgtggccaaccaggacc

SEQ ID NO: 5489426 - DNA, 23 bp, Homo sapiens
gctgtgtggccaaccaggaccca

SEQ ID NO: 5489427 - DNA, 14 bp, Homo sapiens
gctgtgtgtcccag

SEQ ID NO: 5489428 - DNA, 18 bp, Homo sapiens
gctgtgtgtcccaggcag

SEQ ID NO: 5489429 - DNA, 17 bp, Homo sapiens
gctgtgtgtgcccggga

SEQ ID NO: 5489430 - DNA, 14 bp, Homo sapiens
gctgtgtgtggctt

SEQ ID NO: 5489431 - DNA, 18 bp, Homo sapiens
gctgtgtgttagttccca

SEQ ID NO: 5489432 - DNA, 22 bp, Homo sapiens
gctgtgtgttagttcccaacat

SEQ ID NO: 5489433 - DNA, 19 bp, Homo sapiens
gctgtgtgttttcaatcct

SEQ ID NO: 5489434 - DNA, 18 bp, Homo sapiens
gctgtgttaaataaacct

SEQ ID NO: 5489435 - DNA, 17 bp, Homo sapiens
gctgtgttaactgttca

SEQ ID NO: 5489436 - DNA, 16 bp, Homo sapiens
gctgtgttaagaggac

SEQ ID NO: 5489437 - DNA, 16 bp, Homo sapiens
gctgtgttacttgaag

SEQ ID NO: 5489438 - DNA, 19 bp, Homo sapiens
gctgtgttacttgaagtaa

SEQ ID NO: 5489439 - DNA, 12 bp, Homo sapiens
gctgtgttcatc

SEQ ID NO: 5489440 - DNA, 17 bp, Homo sapiens
gcttaaaggtgtcttcc

SEQ ID NO: 5489441 - DNA, 12 bp, Homo sapiens
gcttaaagtgaa

SEQ ID NO: 5489442 - DNA, 17 bp, Homo sapiens
gcttaaataggaaagtt

SEQ ID NO: 5489443 - DNA, 22 bp, Homo sapiens
gcttaaatatagttcctaagaa

SEQ ID NO: 5489444 - DNA, 14 bp, Homo sapiens
gcttaaatgcaata

SEQ ID NO: 5489445 - DNA, 14 bp, Homo sapiens
gcttaaatgtgaat

SEQ ID NO: 5489446 - DNA, 13 bp, Homo sapiens
gcttaaatttctt

SEQ ID NO: 5489447 - DNA, 14 bp, Homo sapiens
gcttaaattttaac

SEQ ID NO: 5489448 - DNA, 15 bp, Homo sapiens
gcttaacataaactt

SEQ ID NO: 5489449 - DNA, 20 bp, Homo sapiens
gcttaacattgacttcttgg

SEQ ID NO: 5489450 - DNA, 14 bp, Homo sapiens
gcttaactggctgt

SEQ ID NO: 5489451 - DNA, 17 bp, Homo sapiens
gcttaagaactgcttca

SEQ ID NO: 5489452 - DNA, 20 bp, Homo sapiens
gcttaagagtccaactcact

SEQ ID NO: 5489453 - DNA, 16 bp, Homo sapiens
gcttaagcagaagcat

SEQ ID NO: 5489454 - DNA, 18 bp, Homo sapiens
gcttaagccactgcctct

SEQ ID NO: 5489455 - DNA, 21 bp, Homo sapiens
gcttaaggaaaagagaaacac

SEQ ID NO: 5489456 - DNA, 23 bp, Homo sapiens
gcttaaggagaggagaaactgag

SEQ ID NO: 5489457 - DNA, 23 bp, Homo sapiens
gcttaaggtggaaagtgttcatt

SEQ ID NO: 5489458 - DNA, 20 bp, Homo sapiens
gcttaagtgagcagaacagg

SEQ ID NO: 5489459 - DNA, 16 bp, Homo sapiens
gcttaagtgcatgcat

SEQ ID NO: 5489460 - DNA, 21 bp, Homo sapiens
gcttaagtgcatgcattgagc

SEQ ID NO: 5489461 - DNA, 21 bp, Homo sapiens
gcttaataatattaataagaa

SEQ ID NO: 5489462 - DNA, 12 bp, Homo sapiens
gcttaataccaa

SEQ ID NO: 5489463 - DNA, 21 bp, Homo sapiens
gcttaatcattttcattccta

SEQ ID NO: 5489464 - DNA, 22 bp, Homo sapiens
gcttaatcctaccccctcttca

SEQ ID NO: 5489465 - DNA, 18 bp, Homo sapiens
gcttaatgctacatgtga

SEQ ID NO: 5489466 - DNA, 17 bp, Homo sapiens
gcttaatgtttattcct

SEQ ID NO: 5489467 - DNA, 13 bp, Homo sapiens
gcttaattccaat

SEQ ID NO: 5489468 - DNA, 15 bp, Homo sapiens
gcttaattctccttc

SEQ ID NO: 5489469 - DNA, 17 bp, Homo sapiens
gcttaattctccttccc

SEQ ID NO: 5489470 - DNA, 20 bp, Homo sapiens
gcttaattctccttcccaga

SEQ ID NO: 5489471 - DNA, 21 bp, Homo sapiens
gcttaattctccttcccagat

SEQ ID NO: 5489472 - DNA, 18 bp, Homo sapiens
gcttaattgactgaaatt

SEQ ID NO: 5489473 - DNA, 22 bp, Homo sapiens
gcttaattgttctgctttttct

SEQ ID NO: 5489474 - DNA, 12 bp, Homo sapiens
gcttaatttaat

SEQ ID NO: 5489475 - DNA, 18 bp, Homo sapiens
gcttaatttccttctgtt

SEQ ID NO: 5489476 - DNA, 23 bp, Homo sapiens
gcttaatttccttctgttaagaa

SEQ ID NO: 5489477 - DNA, 15 bp, Homo sapiens
gcttaatttctgcct

SEQ ID NO: 5489478 - DNA, 17 bp, Homo sapiens
gcttaatttctgccttt

SEQ ID NO: 5489479 - DNA, 22 bp, Homo sapiens
gcttacaagccagctggagaaa

SEQ ID NO: 5489480 - DNA, 15 bp, Homo sapiens
gcttacaatctttat

SEQ ID NO: 5489481 - DNA, 14 bp, Homo sapiens
gcttacaattccct

SEQ ID NO: 5489482 - DNA, 22 bp, Homo sapiens
gcttacaatttttttaattttg

SEQ ID NO: 5489483 - DNA, 23 bp, Homo sapiens
gcttacaatttttttaattttgt

SEQ ID NO: 5489484 - DNA, 16 bp, Homo sapiens
gcttacagaaatgact

SEQ ID NO: 5489485 - DNA, 20 bp, Homo sapiens
gcttacaggaaaacctgcag

SEQ ID NO: 5489486 - DNA, 16 bp, Homo sapiens
gcttacaggagccagc

SEQ ID NO: 5489487 - DNA, 16 bp, Homo sapiens
gcttacagtgactgtg

SEQ ID NO: 5489488 - DNA, 18 bp, Homo sapiens
gcttacatctggaatctg

SEQ ID NO: 5489489 - DNA, 18 bp, Homo sapiens
gcttacatttttacaata

SEQ ID NO: 5489490 - DNA, 23 bp, Homo sapiens
gcttacccttcacctttggtgca

SEQ ID NO: 5489491 - DNA, 13 bp, Homo sapiens
gcttacctcctca

SEQ ID NO: 5489492 - DNA, 20 bp, Homo sapiens
gcttacctgaacaggaatcc

SEQ ID NO: 5489493 - DNA, 16 bp, Homo sapiens
gcttacctgacacaag

SEQ ID NO: 5489494 - DNA, 13 bp, Homo sapiens
gcttacctgggca

SEQ ID NO: 5489495 - DNA, 23 bp, Homo sapiens
gcttacctgttgtctgaaacata

SEQ ID NO: 5489496 - DNA, 12 bp, Homo sapiens
gcttacggccct

SEQ ID NO: 5489497 - DNA, 22 bp, Homo sapiens
gcttacgtactacttgtttcaa

SEQ ID NO: 5489498 - DNA, 14 bp, Homo sapiens
gcttacgtagttct

SEQ ID NO: 5489499 - DNA, 21 bp, Homo sapiens
gcttactacatgtgggagctt

SEQ ID NO: 5489500 - DNA, 20 bp, Homo sapiens
gcttactagtatcactgctt

SEQ ID NO: 5489501 - DNA, 14 bp, Homo sapiens
gcttactcattaaa

SEQ ID NO: 5489502 - DNA, 12 bp, Homo sapiens
gcttactcctct

SEQ ID NO: 5489503 - DNA, 15 bp, Homo sapiens
gcttactcctctgac

SEQ ID NO: 5489504 - DNA, 17 bp, Homo sapiens
gcttactctctgcttcc

SEQ ID NO: 5489505 - DNA, 13 bp, Homo sapiens
gcttactcttgct

SEQ ID NO: 5489506 - DNA, 13 bp, Homo sapiens
gcttactgaaaga

SEQ ID NO: 5489507 - DNA, 14 bp, Homo sapiens
gcttactgaaagac

SEQ ID NO: 5489508 - DNA, 15 bp, Homo sapiens
gcttactgaaagaca

SEQ ID NO: 5489509 - DNA, 16 bp, Homo sapiens
gcttactgatgatgtg

SEQ ID NO: 5489510 - DNA, 23 bp, Homo sapiens
gcttacttttactgtctatatat

SEQ ID NO: 5489511 - DNA, 14 bp, Homo sapiens
gcttagaaacatgt

SEQ ID NO: 5489512 - DNA, 12 bp, Homo sapiens
gcttagaaataa

SEQ ID NO: 5489513 - DNA, 22 bp, Homo sapiens
gcttagaacccttctgctttct

SEQ ID NO: 5489514 - DNA, 13 bp, Homo sapiens
gcttagaagccac

SEQ ID NO: 5489515 - DNA, 16 bp, Homo sapiens
gcttagaatggggctt

SEQ ID NO: 5489516 - DNA, 14 bp, Homo sapiens
gcttagacctcagc

SEQ ID NO: 5489517 - DNA, 18 bp, Homo sapiens
gcttagacctcagcctgt

SEQ ID NO: 5489518 - DNA, 19 bp, Homo sapiens
gcttagacctcagcctgtg

SEQ ID NO: 5489519 - DNA, 23 bp, Homo sapiens
gcttagacctcagcctgtgctgc

SEQ ID NO: 5489520 - DNA, 23 bp, Homo sapiens
gcttagacttcgactcaggatcc

SEQ ID NO: 5489521 - DNA, 13 bp, Homo sapiens
gcttagagacagt

SEQ ID NO: 5489522 - DNA, 15 bp, Homo sapiens
gcttagagaggaaaa

SEQ ID NO: 5489523 - DNA, 16 bp, Homo sapiens
gcttagagcctccctc

SEQ ID NO: 5489524 - DNA, 15 bp, Homo sapiens
gcttagagtgcccag

SEQ ID NO: 5489525 - DNA, 16 bp, Homo sapiens
gcttagagttggccat

SEQ ID NO: 5489526 - DNA, 20 bp, Homo sapiens
gcttagatgagggtgactgt

SEQ ID NO: 5489527 - DNA, 17 bp, Homo sapiens
gcttagattctgtatgc

SEQ ID NO: 5489528 - DNA, 13 bp, Homo sapiens
gcttagatttcat

SEQ ID NO: 5489529 - DNA, 18 bp, Homo sapiens
gcttagcaactgctgggg

SEQ ID NO: 5489530 - DNA, 11 bp, Homo sapiens
gcttagcagga

SEQ ID NO: 5489531 - DNA, 16 bp, Homo sapiens
gcttagcaggagagga

SEQ ID NO: 5489532 - DNA, 22 bp, Homo sapiens
gcttagcaggagaggagagcca

SEQ ID NO: 5489533 - DNA, 23 bp, Homo sapiens
gcttagcagggtgctaacgtatc

SEQ ID NO: 5489534 - DNA, 12 bp, Homo sapiens
gcttagccttgt

SEQ ID NO: 5489535 - DNA, 17 bp, Homo sapiens
gcttagccttgtgccct

SEQ ID NO: 5489536 - DNA, 19 bp, Homo sapiens
gcttagccttgtgccctgc

SEQ ID NO: 5489537 - DNA, 18 bp, Homo sapiens
gcttagcgctctggacag

SEQ ID NO: 5489538 - DNA, 17 bp, Homo sapiens
gcttagcgttctgtttc

SEQ ID NO: 5489539 - DNA, 23 bp, Homo sapiens
gcttaggatgggggatgtggcca

SEQ ID NO: 5489540 - DNA, 22 bp, Homo sapiens
gcttaggatgtgtgcatgtgtg

SEQ ID NO: 5489541 - DNA, 12 bp, Homo sapiens
gcttaggatgtt

SEQ ID NO: 5489542 - DNA, 16 bp, Homo sapiens
gcttaggccagtcagt

SEQ ID NO: 5489543 - DNA, 19 bp, Homo sapiens
gcttaggctgcttattgga

SEQ ID NO: 5489544 - DNA, 22 bp, Homo sapiens
gcttagggacaggaccccagct

SEQ ID NO: 5489545 - DNA, 23 bp, Homo sapiens
gcttagggacaggaccccagctc

SEQ ID NO: 5489546 - DNA, 16 bp, Homo sapiens
gcttagggccctggag

SEQ ID NO: 5489547 - DNA, 18 bp, Homo sapiens
gcttagggccctggaggc

SEQ ID NO: 5489548 - DNA, 16 bp, Homo sapiens
gcttaggtgccaggct

SEQ ID NO: 5489549 - DNA, 17 bp, Homo sapiens
gcttaggtgccaggctg

SEQ ID NO: 5489550 - DNA, 19 bp, Homo sapiens
gcttagtaaaatttatttc

SEQ ID NO: 5489551 - DNA, 19 bp, Homo sapiens
gcttagtaagtatttccat

SEQ ID NO: 5489552 - DNA, 17 bp, Homo sapiens
gcttagtcactgagaca

SEQ ID NO: 5489553 - DNA, 20 bp, Homo sapiens
gcttagtcactgagacagcc

SEQ ID NO: 5489554 - DNA, 17 bp, Homo sapiens
gcttagtcactgcctgc

SEQ ID NO: 5489555 - DNA, 13 bp, Homo sapiens
gcttagtcctggg

SEQ ID NO: 5489556 - DNA, 14 bp, Homo sapiens
gcttagtcctggga

SEQ ID NO: 5489557 - DNA, 22 bp, Homo sapiens
gcttagtcctgggagaggacag

SEQ ID NO: 5489558 - DNA, 16 bp, Homo sapiens
gcttagtgaaaatact

SEQ ID NO: 5489559 - DNA, 23 bp, Homo sapiens
gcttagtgctatgtgtgagatat

SEQ ID NO: 5489560 - DNA, 19 bp, Homo sapiens
gcttagtgtgaagttgata

SEQ ID NO: 5489561 - DNA, 15 bp, Homo sapiens
gcttagttctcactg

SEQ ID NO: 5489562 - DNA, 14 bp, Homo sapiens
gcttagttcttgaa

SEQ ID NO: 5489563 - DNA, 17 bp, Homo sapiens
gcttagttcttgaattg

SEQ ID NO: 5489564 - DNA, 20 bp, Homo sapiens
gcttagttcttgaattgtta

SEQ ID NO: 5489565 - DNA, 12 bp, Homo sapiens
gcttagtttgtg

SEQ ID NO: 5489566 - DNA, 18 bp, Homo sapiens
gcttagttttttttaaaa

SEQ ID NO: 5489567 - DNA, 22 bp, Homo sapiens
gcttataaaacagagtaatctt

SEQ ID NO: 5489568 - DNA, 14 bp, Homo sapiens
gcttataaacacat

SEQ ID NO: 5489569 - DNA, 13 bp, Homo sapiens
gcttataaatgtg

SEQ ID NO: 5489570 - DNA, 22 bp, Homo sapiens
gcttataacctagttaaagaaa

SEQ ID NO: 5489571 - DNA, 16 bp, Homo sapiens
gcttataattctttca

SEQ ID NO: 5489572 - DNA, 23 bp, Homo sapiens
gcttatacgaaataattgttgtt

SEQ ID NO: 5489573 - DNA, 15 bp, Homo sapiens
gcttataggtggcct

SEQ ID NO: 5489574 - DNA, 11 bp, Homo sapiens
gcttatatctg

SEQ ID NO: 5489575 - DNA, 21 bp, Homo sapiens
gcttatatgtccttgggttgc

SEQ ID NO: 5489576 - DNA, 22 bp, Homo sapiens
gcttatattcaaccatggactt

SEQ ID NO: 5489577 - DNA, 15 bp, Homo sapiens
gcttatatttgtgta

SEQ ID NO: 5489578 - DNA, 13 bp, Homo sapiens
gcttatcaatttg

SEQ ID NO: 5489579 - DNA, 23 bp, Homo sapiens
gcttatcaatttgtcattttgaa

SEQ ID NO: 5489580 - DNA, 16 bp, Homo sapiens
gcttatcagaactcct

SEQ ID NO: 5489581 - DNA, 13 bp, Homo sapiens
gcttatctcaggg

SEQ ID NO: 5489582 - DNA, 19 bp, Homo sapiens
gcttatctcaggggtgtgc

SEQ ID NO: 5489583 - DNA, 15 bp, Homo sapiens
gcttatctccctgct

SEQ ID NO: 5489584 - DNA, 18 bp, Homo sapiens
gcttatctccctgcttca

SEQ ID NO: 5489585 - DNA, 19 bp, Homo sapiens
gcttatctccctgcttcat

SEQ ID NO: 5489586 - DNA, 15 bp, Homo sapiens
gcttatctcttttat

SEQ ID NO: 5489587 - DNA, 21 bp, Homo sapiens
gcttatctcttttatatttgt

SEQ ID NO: 5489588 - DNA, 16 bp, Homo sapiens
gcttatctgcccctcc

SEQ ID NO: 5489589 - DNA, 15 bp, Homo sapiens
gcttatgaaaacacc

SEQ ID NO: 5489590 - DNA, 18 bp, Homo sapiens
gcttatgaaagaggcagc

SEQ ID NO: 5489591 - DNA, 22 bp, Homo sapiens
gcttatgacagaggttttgaaa

SEQ ID NO: 5489592 - DNA, 22 bp, Homo sapiens
gcttatgacatcacttgtacaa

SEQ ID NO: 5489593 - DNA, 23 bp, Homo sapiens
gcttatgacatcacttgtacaaa

SEQ ID NO: 5489594 - DNA, 18 bp, Homo sapiens
gcttatgagatctaatgt

SEQ ID NO: 5489595 - DNA, 21 bp, Homo sapiens
gcttatgagatctaatgtgaa

SEQ ID NO: 5489596 - DNA, 22 bp, Homo sapiens
gcttatgatgagccatattaat

SEQ ID NO: 5489597 - DNA, 22 bp, Homo sapiens
gcttatgatgggctccccagga

SEQ ID NO: 5489598 - DNA, 19 bp, Homo sapiens
gcttatgcccctgcactga

SEQ ID NO: 5489599 - DNA, 18 bp, Homo sapiens
gcttatgctcagaagcca

SEQ ID NO: 5489600 - DNA, 16 bp, Homo sapiens
gcttatgcttgtgtat

SEQ ID NO: 5489601 - DNA, 15 bp, Homo sapiens
gcttatggtaccaga

SEQ ID NO: 5489602 - DNA, 16 bp, Homo sapiens
gcttatggtaccagat

SEQ ID NO: 5489603 - DNA, 13 bp, Homo sapiens
gcttatgtcatca

SEQ ID NO: 5489604 - DNA, 15 bp, Homo sapiens
gcttatgtctctgcc

SEQ ID NO: 5489605 - DNA, 20 bp, Homo sapiens
gcttatgtgtaggtgaacag

SEQ ID NO: 5489606 - DNA, 23 bp, Homo sapiens
gcttatgtgtaggtgaacagtca

SEQ ID NO: 5489607 - DNA, 20 bp, Homo sapiens
gcttatgtgttgcataaaca

SEQ ID NO: 5489608 - DNA, 20 bp, Homo sapiens
gcttatgtttcttattctct

SEQ ID NO: 5489609 - DNA, 22 bp, Homo sapiens
gcttatgtttcttattctctgt

SEQ ID NO: 5489610 - DNA, 14 bp, Homo sapiens
gcttatgtttttgt

SEQ ID NO: 5489611 - DNA, 17 bp, Homo sapiens
gcttattaagaccaaag

SEQ ID NO: 5489612 - DNA, 18 bp, Homo sapiens
gcttattaagaccaaaga

SEQ ID NO: 5489613 - DNA, 15 bp, Homo sapiens
gcttattaatgctaa

SEQ ID NO: 5489614 - DNA, 20 bp, Homo sapiens
gcttattaatgctaagggca

SEQ ID NO: 5489615 - DNA, 14 bp, Homo sapiens
gcttattagcagct

SEQ ID NO: 5489616 - DNA, 17 bp, Homo sapiens
gcttattgatcccacat

SEQ ID NO: 5489617 - DNA, 21 bp, Homo sapiens
gcttccacgtactgcagcctc

SEQ ID NO: 5489618 - DNA, 18 bp, Homo sapiens
gcttccactgtcagccct

SEQ ID NO: 5489619 - DNA, 20 bp, Homo sapiens
gcttccagaaggcagcaaag

SEQ ID NO: 5489620 - DNA, 20 bp, Homo sapiens
gcttccagagagtcctctgg

SEQ ID NO: 5489621 - DNA, 23 bp, Homo sapiens
gcttccagattgacgacaagtgc

SEQ ID NO: 5489622 - DNA, 14 bp, Homo sapiens
gcttccagcaggag

SEQ ID NO: 5489623 - DNA, 18 bp, Homo sapiens
gcttccagcgggccctct

SEQ ID NO: 5489624 - DNA, 13 bp, Homo sapiens
gcttccagcttcc

SEQ ID NO: 5489625 - DNA, 18 bp, Homo sapiens
gcttccagcttcctctga

SEQ ID NO: 5489626 - DNA, 19 bp, Homo sapiens
gcttccagcttcctctgag

SEQ ID NO: 5489627 - DNA, 22 bp, Homo sapiens
gcttccagcttcctctgagccg

SEQ ID NO: 5489628 - DNA, 21 bp, Homo sapiens
gcttccaggaaactccacatc

SEQ ID NO: 5489629 - DNA, 19 bp, Homo sapiens
gcttccaggataaggagac

SEQ ID NO: 5489630 - DNA, 12 bp, Homo sapiens
gcttccaggctc

SEQ ID NO: 5489631 - DNA, 13 bp, Homo sapiens
gcttccaggctct

SEQ ID NO: 5489632 - DNA, 16 bp, Homo sapiens
gcttccaggctgagag

SEQ ID NO: 5489633 - DNA, 19 bp, Homo sapiens
gcttccaggctgggcagca

SEQ ID NO: 5489634 - DNA, 21 bp, Homo sapiens
gcttccaggtaaaaacagata

SEQ ID NO: 5489635 - DNA, 17 bp, Homo sapiens
gcttccaggtggcagga

SEQ ID NO: 5489636 - DNA, 18 bp, Homo sapiens
gcttccaggtggcaggat

SEQ ID NO: 5489637 - DNA, 19 bp, Homo sapiens
gcttccagtctcactgaca

SEQ ID NO: 5489638 - DNA, 18 bp, Homo sapiens
gcttccagtgaggctctg

SEQ ID NO: 5489639 - DNA, 17 bp, Homo sapiens
gcttccatgagaacagc

SEQ ID NO: 5489640 - DNA, 17 bp, Homo sapiens
gcttccatgatgcacag

SEQ ID NO: 5489641 - DNA, 22 bp, Homo sapiens
gcttccatgatgcacagtatct

SEQ ID NO: 5489642 - DNA, 14 bp, Homo sapiens
gcttccatgattct

SEQ ID NO: 5489643 - DNA, 18 bp, Homo sapiens
gcttccatgattctattt

SEQ ID NO: 5489644 - DNA, 11 bp, Homo sapiens
gcttccatgcc

SEQ ID NO: 5489645 - DNA, 22 bp, Homo sapiens
gcttccatgcctgtagctttcc

SEQ ID NO: 5489646 - DNA, 14 bp, Homo sapiens
gcttccatgtttaa

SEQ ID NO: 5489647 - DNA, 20 bp, Homo sapiens
gcttccatttgtgtgtgtgc

SEQ ID NO: 5489648 - DNA, 22 bp, Homo sapiens
gcttccattttcctacaggcag

SEQ ID NO: 5489649 - DNA, 14 bp, Homo sapiens
gcttcccaacaata

SEQ ID NO: 5489650 - DNA, 21 bp, Homo sapiens
gcttcccaacagatcatatgg

SEQ ID NO: 5489651 - DNA, 18 bp, Homo sapiens
gcttcccaagggctgccg

SEQ ID NO: 5489652 - DNA, 17 bp, Homo sapiens
gcttcccacacctgcct

SEQ ID NO: 5489653 - DNA, 19 bp, Homo sapiens
gcttcccacacctgcctgc

SEQ ID NO: 5489654 - DNA, 14 bp, Homo sapiens
gcttcccacctccc

SEQ ID NO: 5489655 - DNA, 17 bp, Homo sapiens
gcttcccacctccctgc

SEQ ID NO: 5489656 - DNA, 13 bp, Homo sapiens
gcttcccacctgc

SEQ ID NO: 5489657 - DNA, 16 bp, Homo sapiens
gcttcccactggggcc

SEQ ID NO: 5489658 - DNA, 13 bp, Homo sapiens
gcttcccagaggc

SEQ ID NO: 5489659 - DNA, 15 bp, Homo sapiens
gcttcccagccatgc

SEQ ID NO: 5489660 - DNA, 18 bp, Homo sapiens
gcttcccagccatgccca

SEQ ID NO: 5489661 - DNA, 21 bp, Homo sapiens
gcttcccagccatgcccagga

SEQ ID NO: 5489662 - DNA, 12 bp, Homo sapiens
gcttcccaggac

SEQ ID NO: 5489663 - DNA, 13 bp, Homo sapiens
gcttcccaggacc

SEQ ID NO: 5489664 - DNA, 20 bp, Homo sapiens
gcttcccagtggctgctgcc

SEQ ID NO: 5489665 - DNA, 22 bp, Homo sapiens
gcttcccatcaccggaggagct

SEQ ID NO: 5489666 - DNA, 13 bp, Homo sapiens
gcttcccatccta

SEQ ID NO: 5489667 - DNA, 17 bp, Homo sapiens
gcttcccatcctaccct

SEQ ID NO: 5489668 - DNA, 22 bp, Homo sapiens
gcttcccatcctaccctcgggc

SEQ ID NO: 5489669 - DNA, 17 bp, Homo sapiens
gcttcccatctgaagag

SEQ ID NO: 5489670 - DNA, 13 bp, Homo sapiens
gcttcccatgccg

SEQ ID NO: 5489671 - DNA, 17 bp, Homo sapiens
gcttcccatgtctttct

SEQ ID NO: 5489672 - DNA, 23 bp, Homo sapiens
gcttccccaaaggccaacagcat

SEQ ID NO: 5489673 - DNA, 12 bp, Homo sapiens
gcttccccacag

SEQ ID NO: 5489674 - DNA, 21 bp, Homo sapiens
gcttccccacagaactgctta

SEQ ID NO: 5489675 - DNA, 13 bp, Homo sapiens
gcttccccagctc

SEQ ID NO: 5489676 - DNA, 16 bp, Homo sapiens
gcttccccagctcaga

SEQ ID NO: 5489677 - DNA, 23 bp, Homo sapiens
gcttccccaggagctctctgctg

SEQ ID NO: 5489678 - DNA, 16 bp, Homo sapiens
gcttccccatcagctc

SEQ ID NO: 5489679 - DNA, 18 bp, Homo sapiens
gcttccccatcagctccc

SEQ ID NO: 5489680 - DNA, 20 bp, Homo sapiens
gcttccccatcagctcccaa

SEQ ID NO: 5489681 - DNA, 15 bp, Homo sapiens
gcttccccatcgcct

SEQ ID NO: 5489682 - DNA, 18 bp, Homo sapiens
gcttcccccacttcacct

SEQ ID NO: 5489683 - DNA, 15 bp, Homo sapiens
gcttcccccatagcc

SEQ ID NO: 5489684 - DNA, 16 bp, Homo sapiens
gcttcccccatagcca

SEQ ID NO: 5489685 - DNA, 18 bp, Homo sapiens
gcttcccccatagccacc

SEQ ID NO: 5489686 - DNA, 13 bp, Homo sapiens
gcttcccctccac

SEQ ID NO: 5489687 - DNA, 17 bp, Homo sapiens
gcttcccctccaggagg

SEQ ID NO: 5489688 - DNA, 15 bp, Homo sapiens
gcttcccctcgctgt

SEQ ID NO: 5489689 - DNA, 22 bp, Homo sapiens
gcttcccctcgctgtcctgctg

SEQ ID NO: 5489690 - DNA, 16 bp, Homo sapiens
gcttcccctctctcct

SEQ ID NO: 5489691 - DNA, 18 bp, Homo sapiens
gcttcccctctctcctcc

SEQ ID NO: 5489692 - DNA, 15 bp, Homo sapiens
gcttccccttcagac

SEQ ID NO: 5489693 - DNA, 20 bp, Homo sapiens
gcttccccttgccacggttt

SEQ ID NO: 5489694 - DNA, 18 bp, Homo sapiens
gcttcccgctcagccctc

SEQ ID NO: 5489695 - DNA, 22 bp, Homo sapiens
gcttcccgggataaactgagcc

SEQ ID NO: 5489696 - DNA, 17 bp, Homo sapiens
gcttccctaaactgcag

SEQ ID NO: 5489697 - DNA, 19 bp, Homo sapiens
gcttccctaaactgcagcc

SEQ ID NO: 5489698 - DNA, 21 bp, Homo sapiens
gcttccctacccacagggcct

SEQ ID NO: 5489699 - DNA, 15 bp, Homo sapiens
gcttccctagatggt

SEQ ID NO: 5489700 - DNA, 14 bp, Homo sapiens
gcttccctccctgc

SEQ ID NO: 5489701 - DNA, 13 bp, Homo sapiens
gcttccctccttc

SEQ ID NO: 5489702 - DNA, 15 bp, Homo sapiens
gcttccctctgcctg

SEQ ID NO: 5489703 - DNA, 19 bp, Homo sapiens
gcttccctctgcctgtccc

SEQ ID NO: 5489704 - DNA, 13 bp, Homo sapiens
gcttccctctgct

SEQ ID NO: 5489705 - DNA, 11 bp, Homo sapiens
gcttccctgaa

SEQ ID NO: 5489706 - DNA, 18 bp, Homo sapiens
gcttccctgaacactcat

SEQ ID NO: 5489707 - DNA, 15 bp, Homo sapiens
gcttccctgaagctc

SEQ ID NO: 5489708 - DNA, 17 bp, Homo sapiens
gcttccctgacttgctt

SEQ ID NO: 5489709 - DNA, 16 bp, Homo sapiens
gcttccctgcagctga

SEQ ID NO: 5489710 - DNA, 14 bp, Homo sapiens
gcttccctgcccaa

SEQ ID NO: 5489711 - DNA, 19 bp, Homo sapiens
gcttccctgcgacggaggc

SEQ ID NO: 5489712 - DNA, 11 bp, Homo sapiens
gcttccctgga

SEQ ID NO: 5489713 - DNA, 14 bp, Homo sapiens
gcttccctggcctc

SEQ ID NO: 5489714 - DNA, 14 bp, Homo sapiens
gcttccctgtccca

SEQ ID NO: 5489715 - DNA, 15 bp, Homo sapiens
gcttccctgtcccag

SEQ ID NO: 5489716 - DNA, 19 bp, Homo sapiens
gcttcccttctccccagcc

SEQ ID NO: 5489717 - DNA, 23 bp, Homo sapiens
gcttcccttctccccagccagag

SEQ ID NO: 5489718 - DNA, 23 bp, Homo sapiens
gcttccctttcactgaagtgaat

SEQ ID NO: 5489719 - DNA, 16 bp, Homo sapiens
gcttcccttttttcct

SEQ ID NO: 5489720 - DNA, 14 bp, Homo sapiens
gcttccgagacacc

SEQ ID NO: 5489721 - DNA, 23 bp, Homo sapiens
gcttccgagatccccagggcagc

SEQ ID NO: 5489722 - DNA, 22 bp, Homo sapiens
gcttccgagattcagactgctt

SEQ ID NO: 5489723 - DNA, 22 bp, Homo sapiens
gcttccgctttgaaagaagcaa

SEQ ID NO: 5489724 - DNA, 16 bp, Homo sapiens
gcttccggctcctgtg

SEQ ID NO: 5489725 - DNA, 15 bp, Homo sapiens
gcttccggctgagct

SEQ ID NO: 5489726 - DNA, 21 bp, Homo sapiens
gcttccgggaaaacagctatt

SEQ ID NO: 5489727 - DNA, 21 bp, Homo sapiens
gcttccggtagggaggcagcc

SEQ ID NO: 5489728 - DNA, 16 bp, Homo sapiens
gcttcctaacttattg

SEQ ID NO: 5489729 - DNA, 22 bp, Homo sapiens
gcttcctacccacacctctgcc

SEQ ID NO: 5489730 - DNA, 18 bp, Homo sapiens
gcttcctagaagttactg

SEQ ID NO: 5489731 - DNA, 23 bp, Homo sapiens
gcttcctagaagttactgaatgc

SEQ ID NO: 5489732 - DNA, 12 bp, Homo sapiens
gcttcctagctt

SEQ ID NO: 5489733 - DNA, 18 bp, Homo sapiens
gcttcctaggccccagag

SEQ ID NO: 5489734 - DNA, 23 bp, Homo sapiens
gcttcctagtaagtcaggacagc

SEQ ID NO: 5489735 - DNA, 19 bp, Homo sapiens
gcttcctcaaatacatgca

SEQ ID NO: 5489736 - DNA, 20 bp, Homo sapiens
gcttcctcaaatacatgcac

SEQ ID NO: 5489737 - DNA, 21 bp, Homo sapiens
gcttcctcaaatacatgcaca

SEQ ID NO: 5489738 - DNA, 15 bp, Homo sapiens
gcttcctcagcctcc

SEQ ID NO: 5489739 - DNA, 13 bp, Homo sapiens
gcttcctcagggg

SEQ ID NO: 5489740 - DNA, 19 bp, Homo sapiens
gcttcctccgtctgcaatg

SEQ ID NO: 5489741 - DNA, 15 bp, Homo sapiens
gcttcctcctcaggc

SEQ ID NO: 5489742 - DNA, 21 bp, Homo sapiens
gcttcctcctccccaactgtg

SEQ ID NO: 5489743 - DNA, 13 bp, Homo sapiens
gcttcctcctgga

SEQ ID NO: 5489744 - DNA, 22 bp, Homo sapiens
gcttcctctagaagccaaggga

SEQ ID NO: 5489745 - DNA, 23 bp, Homo sapiens
gcttcctctagaagccaagggaa

SEQ ID NO: 5489746 - DNA, 13 bp, Homo sapiens
gcttcctctcttg

SEQ ID NO: 5489747 - DNA, 13 bp, Homo sapiens
gcttcctctgaat

SEQ ID NO: 5489748 - DNA, 21 bp, Homo sapiens
gcttcctctgaatattaagaa

SEQ ID NO: 5489749 - DNA, 13 bp, Homo sapiens
gcttcctctgagc

SEQ ID NO: 5489750 - DNA, 15 bp, Homo sapiens
gcttcctctgagccg

SEQ ID NO: 5489751 - DNA, 13 bp, Homo sapiens
gcttcctctgctg

SEQ ID NO: 5489752 - DNA, 19 bp, Homo sapiens
gcttcctctgctgcatccc

SEQ ID NO: 5489753 - DNA, 22 bp, Homo sapiens
gcttcctctgctgcatcccctt

SEQ ID NO: 5489754 - DNA, 23 bp, Homo sapiens
gcttcctctgctgcatccccttc

SEQ ID NO: 5489755 - DNA, 14 bp, Homo sapiens
gcttcctgaaataa

SEQ ID NO: 5489756 - DNA, 15 bp, Homo sapiens
gcttcctgaaataaa

SEQ ID NO: 5489757 - DNA, 19 bp, Homo sapiens
gcttcctgaaataaacact

SEQ ID NO: 5489758 - DNA, 21 bp, Homo sapiens
gcttcctgaaataaacactgg

SEQ ID NO: 5489759 - DNA, 18 bp, Homo sapiens
gcttcctgactgacacag

SEQ ID NO: 5489760 - DNA, 21 bp, Homo sapiens
gcttcctgagaaagcccacct

SEQ ID NO: 5489761 - DNA, 14 bp, Homo sapiens
gcttcctgagcagt

SEQ ID NO: 5489762 - DNA, 15 bp, Homo sapiens
gcttcctgaggggag

SEQ ID NO: 5489763 - DNA, 19 bp, Homo sapiens
gcttcctgcatggtaggga

SEQ ID NO: 5489764 - DNA, 13 bp, Homo sapiens
gcttcctgcccta

SEQ ID NO: 5489765 - DNA, 13 bp, Homo sapiens
gcttcctgccctt

SEQ ID NO: 5489766 - DNA, 20 bp, Homo sapiens
gcttcctgcgtcctcctcac

SEQ ID NO: 5489767 - DNA, 17 bp, Homo sapiens
gcttcctgctgggactg

SEQ ID NO: 5489768 - DNA, 12 bp, Homo sapiens
gcttcctgctgt

SEQ ID NO: 5489769 - DNA, 14 bp, Homo sapiens
gcttcctgcttgcc

SEQ ID NO: 5489770 - DNA, 12 bp, Homo sapiens
gcttcctggagc

SEQ ID NO: 5489771 - DNA, 19 bp, Homo sapiens
gcttcctggcaatagtcaa

SEQ ID NO: 5489772 - DNA, 14 bp, Homo sapiens
gcttcctggcctcc

SEQ ID NO: 5489773 - DNA, 15 bp, Homo sapiens
gcttcctggcctccc

SEQ ID NO: 5489774 - DNA, 15 bp, Homo sapiens
gcttcctggcgcccc

SEQ ID NO: 5489775 - DNA, 13 bp, Homo sapiens
gcttcctggctct

SEQ ID NO: 5489776 - DNA, 14 bp, Homo sapiens
gcttcctggctctg

SEQ ID NO: 5489777 - DNA, 16 bp, Homo sapiens
gcttcctggctctggg

SEQ ID NO: 5489778 - DNA, 11 bp, Homo sapiens
gcttcctgggt

SEQ ID NO: 5489779 - DNA, 18 bp, Homo sapiens
gcttcctgggtcctgcct

SEQ ID NO: 5489780 - DNA, 16 bp, Homo sapiens
gcttcctggtgctgga

SEQ ID NO: 5489781 - DNA, 13 bp, Homo sapiens
gcttcctgtccac

SEQ ID NO: 5489782 - DNA, 19 bp, Homo sapiens
gcttcctgtgccctcaccc

SEQ ID NO: 5489783 - DNA, 21 bp, Homo sapiens
gcttcctgtgccctcacccca

SEQ ID NO: 5489784 - DNA, 22 bp, Homo sapiens
gcttcctgtgctaagtctttcc

SEQ ID NO: 5489785 - DNA, 22 bp, Homo sapiens
gcttccttagaacttctacaga

SEQ ID NO: 5489786 - DNA, 19 bp, Homo sapiens
gcttccttcagagagcagt

SEQ ID NO: 5489787 - DNA, 20 bp, Homo sapiens
gcttccttcagagagcagtg

SEQ ID NO: 5489788 - DNA, 22 bp, Homo sapiens
gcttccttcatctctaaggcta

SEQ ID NO: 5489789 - DNA, 17 bp, Homo sapiens
gcttccttcatttcctc

SEQ ID NO: 5489790 - DNA, 18 bp, Homo sapiens
gcttccttctgcacccag

SEQ ID NO: 5489791 - DNA, 14 bp, Homo sapiens
gcttccttgcctga

SEQ ID NO: 5489792 - DNA, 16 bp, Homo sapiens
gcttcctttcccaagc

SEQ ID NO: 5489793 - DNA, 12 bp, Homo sapiens
gcttcctttctc

SEQ ID NO: 5489794 - DNA, 18 bp, Homo sapiens
gcttcctttctctcctgg

SEQ ID NO: 5489795 - DNA, 13 bp, Homo sapiens
gcttctgttgtaa

SEQ ID NO: 5489796 - DNA, 17 bp, Homo sapiens
gcttctgttgtcacctt

SEQ ID NO: 5489797 - DNA, 14 bp, Homo sapiens
gcttcttaaaaact

SEQ ID NO: 5489798 - DNA, 16 bp, Homo sapiens
gcttcttaaaaactgt

SEQ ID NO: 5489799 - DNA, 21 bp, Homo sapiens
gcttcttaaaaactgtgtatc

SEQ ID NO: 5489800 - DNA, 22 bp, Homo sapiens
gcttcttaatataactgcctta

SEQ ID NO: 5489801 - DNA, 21 bp, Homo sapiens
gcttcttaatcttttcacaaa

SEQ ID NO: 5489802 - DNA, 23 bp, Homo sapiens
gcttcttaatcttttcacaaata

SEQ ID NO: 5489803 - DNA, 13 bp, Homo sapiens
gcttcttaattaa

SEQ ID NO: 5489804 - DNA, 21 bp, Homo sapiens
gcttcttatgtagagttttta

SEQ ID NO: 5489805 - DNA, 19 bp, Homo sapiens
gcttcttcccttaaaattt

SEQ ID NO: 5489806 - DNA, 20 bp, Homo sapiens
gcttcttcccttaaaattta

SEQ ID NO: 5489807 - DNA, 19 bp, Homo sapiens
gcttcttcctaggtccaag

SEQ ID NO: 5489808 - DNA, 22 bp, Homo sapiens
gcttcttcctaggtccaagccc

SEQ ID NO: 5489809 - DNA, 21 bp, Homo sapiens
gcttcttcctatttgccatgg

SEQ ID NO: 5489810 - DNA, 21 bp, Homo sapiens
gcttcttcctcacactgctgt

SEQ ID NO: 5489811 - DNA, 20 bp, Homo sapiens
gcttcttcctggatggggca

SEQ ID NO: 5489812 - DNA, 22 bp, Homo sapiens
gcttcttcgttaatagattatt

SEQ ID NO: 5489813 - DNA, 14 bp, Homo sapiens
gcttcttcgttcct

SEQ ID NO: 5489814 - DNA, 16 bp, Homo sapiens
gcttcttctcatgggg

SEQ ID NO: 5489815 - DNA, 16 bp, Homo sapiens
gcttcttcttccaaat

SEQ ID NO: 5489816 - DNA, 15 bp, Homo sapiens
gcttcttgcactcct

SEQ ID NO: 5489817 - DNA, 21 bp, Homo sapiens
gcttcttgcctctgtgctgtg

SEQ ID NO: 5489818 - DNA, 15 bp, Homo sapiens
gcttcttgctcctgt

SEQ ID NO: 5489819 - DNA, 18 bp, Homo sapiens
gcttcttgcttgtaaaaa

SEQ ID NO: 5489820 - DNA, 14 bp, Homo sapiens
gcttcttggagctt

SEQ ID NO: 5489821 - DNA, 19 bp, Homo sapiens
gcttcttgggctgagtgca

SEQ ID NO: 5489822 - DNA, 18 bp, Homo sapiens
gcttcttgtgaaggccat

SEQ ID NO: 5489823 - DNA, 20 bp, Homo sapiens
gcttctttaaaaaagctata

SEQ ID NO: 5489824 - DNA, 16 bp, Homo sapiens
gcttctttcaaagtgt

SEQ ID NO: 5489825 - DNA, 23 bp, Homo sapiens
gcttctttcaagggctttcctgt

SEQ ID NO: 5489826 - DNA, 16 bp, Homo sapiens
gcttctttcattttct

SEQ ID NO: 5489827 - DNA, 12 bp, Homo sapiens
gcttctttccag

SEQ ID NO: 5489828 - DNA, 21 bp, Homo sapiens
gcttctttctagaaagagaaa

SEQ ID NO: 5489829 - DNA, 20 bp, Homo sapiens
gcttctttctgctggctgat

SEQ ID NO: 5489830 - DNA, 12 bp, Homo sapiens
gcttcttttagt

SEQ ID NO: 5489831 - DNA, 20 bp, Homo sapiens
gcttcttttagtcagaaatg

SEQ ID NO: 5489832 - DNA, 17 bp, Homo sapiens
gcttcttttctttgtat

SEQ ID NO: 5489833 - DNA, 20 bp, Homo sapiens
gcttcttttctttgtatcat

SEQ ID NO: 5489834 - DNA, 20 bp, Homo sapiens
gcttctttttcaaaactagt

SEQ ID NO: 5489835 - DNA, 23 bp, Homo sapiens
gcttgaaaactcacttcaatgaa

SEQ ID NO: 5489836 - DNA, 20 bp, Homo sapiens
gcttgaaagaaaatatgcat

SEQ ID NO: 5489837 - DNA, 17 bp, Homo sapiens
gcttgaaatagtgtctg

SEQ ID NO: 5489838 - DNA, 19 bp, Homo sapiens
gcttgaaattactgtgtaa

SEQ ID NO: 5489839 - DNA, 21 bp, Homo sapiens
gcttgaaattactgtgtaaat

SEQ ID NO: 5489840 - DNA, 12 bp, Homo sapiens
gcttgaacacag

SEQ ID NO: 5489841 - DNA, 13 bp, Homo sapiens
gcttgaacctgct

SEQ ID NO: 5489842 - DNA, 21 bp, Homo sapiens
gcttgaacctgcttcctggct

SEQ ID NO: 5489843 - DNA, 21 bp, Homo sapiens
gcttgaacctgggaagtggag

SEQ ID NO: 5489844 - DNA, 19 bp, Homo sapiens
gcttgaactaggctgagca

SEQ ID NO: 5489845 - DNA, 15 bp, Homo sapiens
gcttgaactgctgcc

SEQ ID NO: 5489846 - DNA, 18 bp, Homo sapiens
gcttgaagcaaacagttg

SEQ ID NO: 5489847 - DNA, 11 bp, Homo sapiens
gcttgaagcca

SEQ ID NO: 5489848 - DNA, 14 bp, Homo sapiens
gcttgaagccaaag

SEQ ID NO: 5489849 - DNA, 15 bp, Homo sapiens
gcttgaagccaaaga

SEQ ID NO: 5489850 - DNA, 18 bp, Homo sapiens
gcttgaagccaaagaaaa

SEQ ID NO: 5489851 - DNA, 14 bp, Homo sapiens
gcttgaagccaagt

SEQ ID NO: 5489852 - DNA, 15 bp, Homo sapiens
gcttgaaggaacagt

SEQ ID NO: 5489853 - DNA, 14 bp, Homo sapiens
gcttgaaggactgc

SEQ ID NO: 5489854 - DNA, 17 bp, Homo sapiens
gcttgaagtaaccttat

SEQ ID NO: 5489855 - DNA, 15 bp, Homo sapiens
gcttgacacagtcag

SEQ ID NO: 5489856 - DNA, 17 bp, Homo sapiens
gcttgacacagtcagca

SEQ ID NO: 5489857 - DNA, 15 bp, Homo sapiens
gcttgacacctgtct

SEQ ID NO: 5489858 - DNA, 20 bp, Homo sapiens
gcttgacattatgttttatt

SEQ ID NO: 5489859 - DNA, 13 bp, Homo sapiens
gcttgaccagacc

SEQ ID NO: 5489860 - DNA, 19 bp, Homo sapiens
gcttgaccagacctagacc

SEQ ID NO: 5489861 - DNA, 23 bp, Homo sapiens
gcttgaccagacctagacctggg

SEQ ID NO: 5489862 - DNA, 20 bp, Homo sapiens
gcttgaccaggcttggcctt

SEQ ID NO: 5489863 - DNA, 18 bp, Homo sapiens
gcttgaccgtactctcac

SEQ ID NO: 5489864 - DNA, 20 bp, Homo sapiens
gcttgaccgtgaggccagag

SEQ ID NO: 5489865 - DNA, 18 bp, Homo sapiens
gcttgacctttaagagaa

SEQ ID NO: 5489866 - DNA, 14 bp, Homo sapiens
gcttgactatcaca

SEQ ID NO: 5489867 - DNA, 19 bp, Homo sapiens
gcttgactatcacatacaa

SEQ ID NO: 5489868 - DNA, 21 bp, Homo sapiens
gcttgactatcacatacaatt

SEQ ID NO: 5489869 - DNA, 17 bp, Homo sapiens
gcttgactcccaagttt

SEQ ID NO: 5489870 - DNA, 15 bp, Homo sapiens
gcttgactctactcc

SEQ ID NO: 5489871 - DNA, 14 bp, Homo sapiens
gcttgactgcattg

SEQ ID NO: 5489872 - DNA, 13 bp, Homo sapiens
gcttgactgcttt

SEQ ID NO: 5489873 - DNA, 16 bp, Homo sapiens
gcttgactttccagaa

SEQ ID NO: 5489874 - DNA, 15 bp, Homo sapiens
gcttgacttttgtat

SEQ ID NO: 5489875 - DNA, 21 bp, Homo sapiens
gcttgagacaaatcctttctg

SEQ ID NO: 5489876 - DNA, 13 bp, Homo sapiens
gcttgagcccagg

SEQ ID NO: 5489877 - DNA, 16 bp, Homo sapiens
gcttgagcccaggagt

SEQ ID NO: 5489878 - DNA, 17 bp, Homo sapiens
gcttgagccgggcccct

SEQ ID NO: 5489879 - DNA, 16 bp, Homo sapiens
gcttgagcctccccca

SEQ ID NO: 5489880 - DNA, 20 bp, Homo sapiens
gcttgagcctcccccaaagc

SEQ ID NO: 5489881 - DNA, 16 bp, Homo sapiens
gcttgagctcccctgg

SEQ ID NO: 5489882 - DNA, 20 bp, Homo sapiens
gcttgagctcccctggagcc

SEQ ID NO: 5489883 - DNA, 23 bp, Homo sapiens
gcttgagctttctgtgcatgtgc

SEQ ID NO: 5489884 - DNA, 19 bp, Homo sapiens
gcttgaggccaagatggct

SEQ ID NO: 5489885 - DNA, 18 bp, Homo sapiens
gcttgagggacaatgcca

SEQ ID NO: 5489886 - DNA, 16 bp, Homo sapiens
gcttgagggttgggct

SEQ ID NO: 5489887 - DNA, 15 bp, Homo sapiens
gcttgaggtgaattt

SEQ ID NO: 5489888 - DNA, 13 bp, Homo sapiens
gcttgagtggaca

SEQ ID NO: 5489889 - DNA, 16 bp, Homo sapiens
gcttgagtggacagca

SEQ ID NO: 5489890 - DNA, 22 bp, Homo sapiens
gcttgagtggacagcagctgga

SEQ ID NO: 5489891 - DNA, 17 bp, Homo sapiens
gcttgagttctgcactc

SEQ ID NO: 5489892 - DNA, 14 bp, Homo sapiens
gcttgagttttcat

SEQ ID NO: 5489893 - DNA, 16 bp, Homo sapiens
gcttgatatcccaagt

SEQ ID NO: 5489894 - DNA, 19 bp, Homo sapiens
gcttgatatttattatatt

SEQ ID NO: 5489895 - DNA, 14 bp, Homo sapiens
gcttgatattttct

SEQ ID NO: 5489896 - DNA, 13 bp, Homo sapiens
gcttgatccagaa

SEQ ID NO: 5489897 - DNA, 15 bp, Homo sapiens
gcttgatctgtgatt

SEQ ID NO: 5489898 - DNA, 20 bp, Homo sapiens
gcttgatggtgacagctgca

SEQ ID NO: 5489899 - DNA, 21 bp, Homo sapiens
gcttgatggtgacagctgcaa

SEQ ID NO: 5489900 - DNA, 16 bp, Homo sapiens
gcttgattagaagcca

SEQ ID NO: 5489901 - DNA, 21 bp, Homo sapiens
gcttgattctaaaggggacag

SEQ ID NO: 5489902 - DNA, 14 bp, Homo sapiens
gcttgatttttgcc

SEQ ID NO: 5489903 - DNA, 21 bp, Homo sapiens
gcttgcaagaggaggtggttc

SEQ ID NO: 5489904 - DNA, 23 bp, Homo sapiens
gcttgcaagtatgttttagcatg

SEQ ID NO: 5489905 - DNA, 15 bp, Homo sapiens
gcttgcacacttccc

SEQ ID NO: 5489906 - DNA, 17 bp, Homo sapiens
gcttgcacatgaatgca

SEQ ID NO: 5489907 - DNA, 14 bp, Homo sapiens
gcttgcactctctt

SEQ ID NO: 5489908 - DNA, 21 bp, Homo sapiens
gcttgcactttgtgagtattc

SEQ ID NO: 5489909 - DNA, 12 bp, Homo sapiens
gcttgcagccag

SEQ ID NO: 5489910 - DNA, 16 bp, Homo sapiens
gcttgcagccaggaga

SEQ ID NO: 5489911 - DNA, 15 bp, Homo sapiens
gcttgcataataagc

SEQ ID NO: 5489912 - DNA, 16 bp, Homo sapiens
gcttgcatcctatttg

SEQ ID NO: 5489913 - DNA, 17 bp, Homo sapiens
gcttgcatctgcacata

SEQ ID NO: 5489914 - DNA, 18 bp, Homo sapiens
gcttgcatggagaatggg

SEQ ID NO: 5489915 - DNA, 14 bp, Homo sapiens
gcttgccaaagtac

SEQ ID NO: 5489916 - DNA, 11 bp, Homo sapiens
gcttgccagcc

SEQ ID NO: 5489917 - DNA, 21 bp, Homo sapiens
gcttgccatccctccctccac

SEQ ID NO: 5489918 - DNA, 22 bp, Homo sapiens
gcttgcccaggagcaagtgagg

SEQ ID NO: 5489919 - DNA, 21 bp, Homo sapiens
gcttgccccactctgcctgcc

SEQ ID NO: 5489920 - DNA, 22 bp, Homo sapiens
gcttgccccactctgcctgcct

SEQ ID NO: 5489921 - DNA, 21 bp, Homo sapiens
gcttgccccaggactctggca

SEQ ID NO: 5489922 - DNA, 18 bp, Homo sapiens
gcttgcccgctcccacag

SEQ ID NO: 5489923 - DNA, 19 bp, Homo sapiens
gcttgccctaagcagaaag

SEQ ID NO: 5489924 - DNA, 11 bp, Homo sapiens
gcttgccctgg

SEQ ID NO: 5489925 - DNA, 18 bp, Homo sapiens
gcttgccctgttaaaaga

SEQ ID NO: 5489926 - DNA, 17 bp, Homo sapiens
gcttgccgaaactggaa

SEQ ID NO: 5489927 - DNA, 19 bp, Homo sapiens
gcttgccgaaactggaagt

SEQ ID NO: 5489928 - DNA, 15 bp, Homo sapiens
gcttgcctaatggct

SEQ ID NO: 5489929 - DNA, 22 bp, Homo sapiens
gcttgcctagggcctggtccat

SEQ ID NO: 5489930 - DNA, 16 bp, Homo sapiens
gcttgcctcagggcca

SEQ ID NO: 5489931 - DNA, 16 bp, Homo sapiens
gcttgcctcggctcct

SEQ ID NO: 5489932 - DNA, 14 bp, Homo sapiens
gcttgcctgcaggg

SEQ ID NO: 5489933 - DNA, 16 bp, Homo sapiens
gcttgcctgcagggcc

SEQ ID NO: 5489934 - DNA, 13 bp, Homo sapiens
gcttgcctgggct

SEQ ID NO: 5489935 - DNA, 21 bp, Homo sapiens
gcttgcctgggctgggcagcc

SEQ ID NO: 5489936 - DNA, 22 bp, Homo sapiens
gcttgcctgggctgggcagcct

SEQ ID NO: 5489937 - DNA, 14 bp, Homo sapiens
gcttgcctgtttct

SEQ ID NO: 5489938 - DNA, 16 bp, Homo sapiens
gcttgcgtatgtctgt

SEQ ID NO: 5489939 - DNA, 18 bp, Homo sapiens
gcttgcgtgctgggacag

SEQ ID NO: 5489940 - DNA, 22 bp, Homo sapiens
gcttgcgttagaatgaggagga

SEQ ID NO: 5489941 - DNA, 16 bp, Homo sapiens
gcttgctaccaatctg

SEQ ID NO: 5489942 - DNA, 23 bp, Homo sapiens
gcttgctaccaatctgtgagaag

SEQ ID NO: 5489943 - DNA, 14 bp, Homo sapiens
gcttgctattctgt

SEQ ID NO: 5489944 - DNA, 22 bp, Homo sapiens
gcttgctccagattctgatgca

SEQ ID NO: 5489945 - DNA, 15 bp, Homo sapiens
gcttgctccagggtc

SEQ ID NO: 5489946 - DNA, 16 bp, Homo sapiens
gcttgctcccaagccc

SEQ ID NO: 5489947 - DNA, 21 bp, Homo sapiens
gcttgctcccgccccagggtc

SEQ ID NO: 5489948 - DNA, 13 bp, Homo sapiens
gcttgctccctgt

SEQ ID NO: 5489949 - DNA, 18 bp, Homo sapiens
gcttgctcgcttgctgga

SEQ ID NO: 5489950 - DNA, 23 bp, Homo sapiens
gcttgctcttaagtaccagaagc

SEQ ID NO: 5489951 - DNA, 23 bp, Homo sapiens
gcttgctcttcagtgggagaaaa

SEQ ID NO: 5489952 - DNA, 12 bp, Homo sapiens
gcttgctgagag

SEQ ID NO: 5489953 - DNA, 19 bp, Homo sapiens
gcttgctgatggctgctgg

SEQ ID NO: 5489954 - DNA, 19 bp, Homo sapiens
gcttgctggaaaactgcca

SEQ ID NO: 5489955 - DNA, 22 bp, Homo sapiens
gcttgctggaaaactgccacaa

SEQ ID NO: 5489956 - DNA, 20 bp, Homo sapiens
gcttgctggaacacaggggc

SEQ ID NO: 5489957 - DNA, 13 bp, Homo sapiens
gcttgctgggctt

SEQ ID NO: 5489958 - DNA, 15 bp, Homo sapiens
gcttgctgggctttg

SEQ ID NO: 5489959 - DNA, 22 bp, Homo sapiens
gcttgctgtatgacccctggcc

SEQ ID NO: 5489960 - DNA, 12 bp, Homo sapiens
gcttgctgtgtg

SEQ ID NO: 5489961 - DNA, 23 bp, Homo sapiens
gcttgcttagagtgcccagcaga

SEQ ID NO: 5489962 - DNA, 13 bp, Homo sapiens
gcttgcttctgca

SEQ ID NO: 5489963 - DNA, 14 bp, Homo sapiens
gcttgcttggggaa

SEQ ID NO: 5489964 - DNA, 19 bp, Homo sapiens
gcttgctttcttctcctgt

SEQ ID NO: 5489965 - DNA, 21 bp, Homo sapiens
gcttgcttttcatgcaaactc

SEQ ID NO: 5489966 - DNA, 12 bp, Homo sapiens
gcttgcttttct

SEQ ID NO: 5489967 - DNA, 23 bp, Homo sapiens
gcttggaaaatgttctgacagca

SEQ ID NO: 5489968 - DNA, 18 bp, Homo sapiens
gcttggaaattccttgcc

SEQ ID NO: 5489969 - DNA, 21 bp, Homo sapiens
gcttggaacatttgggagact

SEQ ID NO: 5489970 - DNA, 12 bp, Homo sapiens
gcttggaagcca

SEQ ID NO: 5489971 - DNA, 15 bp, Homo sapiens
gcttggaagccaggt

SEQ ID NO: 5489972 - DNA, 22 bp, Homo sapiens
gctttaaaaatgcaatatctga

SEQ ID NO: 5489973 - DNA, 14 bp, Homo sapiens
gctttaaaacaaag

SEQ ID NO: 5489974 - DNA, 19 bp, Homo sapiens
gctttaaaacaaagggaaa

SEQ ID NO: 5489975 - DNA, 17 bp, Homo sapiens
gctttaaaaccacagct

SEQ ID NO: 5489976 - DNA, 20 bp, Homo sapiens
gctttaaaagtcattattcc

SEQ ID NO: 5489977 - DNA, 21 bp, Homo sapiens
gctttaaaagtcattattcct

SEQ ID NO: 5489978 - DNA, 13 bp, Homo sapiens
gctttaaaataaa

SEQ ID NO: 5489979 - DNA, 20 bp, Homo sapiens
gctttaaaattctcttccaa

SEQ ID NO: 5489980 - DNA, 15 bp, Homo sapiens
gctttaaacatgatt

SEQ ID NO: 5489981 - DNA, 18 bp, Homo sapiens
gctttaaactaccctcca

SEQ ID NO: 5489982 - DNA, 20 bp, Homo sapiens
gctttaaagagcaggatagc

SEQ ID NO: 5489983 - DNA, 18 bp, Homo sapiens
gctttaaagggcctgcct

SEQ ID NO: 5489984 - DNA, 14 bp, Homo sapiens
gctttaacaaaaca

SEQ ID NO: 5489985 - DNA, 17 bp, Homo sapiens
gctttaacaaaacaaga

SEQ ID NO: 5489986 - DNA, 23 bp, Homo sapiens
gctttaacaaaacaagaaagaaa

SEQ ID NO: 5489987 - DNA, 16 bp, Homo sapiens
gctttaacagtggagc

SEQ ID NO: 5489988 - DNA, 14 bp, Homo sapiens
gctttaacttcaga

SEQ ID NO: 5489989 - DNA, 13 bp, Homo sapiens
gctttaagccttc

SEQ ID NO: 5489990 - DNA, 23 bp, Homo sapiens
gctttaagctccagctttaaggg

SEQ ID NO: 5489991 - DNA, 22 bp, Homo sapiens
gctttaagtaaaaatccaaaaa

SEQ ID NO: 5489992 - DNA, 20 bp, Homo sapiens
gctttaagtgtgctgggcag

SEQ ID NO: 5489993 - DNA, 23 bp, Homo sapiens
gctttaataaaggccacaggaga

SEQ ID NO: 5489994 - DNA, 17 bp, Homo sapiens
gctttaatataaatgca

SEQ ID NO: 5489995 - DNA, 20 bp, Homo sapiens
gctttaatatagctatcatt

SEQ ID NO: 5489996 - DNA, 22 bp, Homo sapiens
gctttaatatcatcagtattga

SEQ ID NO: 5489997 - DNA, 23 bp, Homo sapiens
gctttaatatcatcagtattgaa

SEQ ID NO: 5489998 - DNA, 17 bp, Homo sapiens
gctttaatcaattctag

SEQ ID NO: 5489999 - DNA, 13 bp, Homo sapiens
gctttaatcagaa

SEQ ID NO: 5490000 - DNA, 20 bp, Homo sapiens
gctttaatgagtgcacctgc

SEQ ID NO: 5490001 - DNA, 15 bp, Homo sapiens
gctttaattgtataa

SEQ ID NO: 5490002 - DNA, 16 bp, Homo sapiens
gctttaattgtataag

SEQ ID NO: 5490003 - DNA, 14 bp, Homo sapiens
gctttacaaaaaga

SEQ ID NO: 5490004 - DNA, 15 bp, Homo sapiens
gctttacaaataatt

SEQ ID NO: 5490005 - DNA, 17 bp, Homo sapiens
gctttacaggatcatgt

SEQ ID NO: 5490006 - DNA, 21 bp, Homo sapiens
gctttacaggatcatgtaaat

SEQ ID NO: 5490007 - DNA, 20 bp, Homo sapiens
gctttacatatgattgtatt

SEQ ID NO: 5490008 - DNA, 20 bp, Homo sapiens
gctttacatgctgtgctctt

SEQ ID NO: 5490009 - DNA, 16 bp, Homo sapiens
gctttaccaaacagca

SEQ ID NO: 5490010 - DNA, 21 bp, Homo sapiens
gctttaccaaacagcaaacca

SEQ ID NO: 5490011 - DNA, 18 bp, Homo sapiens
gctttaccttctaaaagt

SEQ ID NO: 5490012 - DNA, 17 bp, Homo sapiens
gctttaccttttcaggg

SEQ ID NO: 5490013 - DNA, 18 bp, Homo sapiens
gctttaccttttcagggc

SEQ ID NO: 5490014 - DNA, 20 bp, Homo sapiens
gctttaccttttcagggctg

SEQ ID NO: 5490015 - DNA, 22 bp, Homo sapiens
gctttacctttttgtatgtgaa

SEQ ID NO: 5490016 - DNA, 16 bp, Homo sapiens
gctttactctttcatg

SEQ ID NO: 5490017 - DNA, 23 bp, Homo sapiens
gctttactgtcaaaataatttta

SEQ ID NO: 5490018 - DNA, 14 bp, Homo sapiens
gctttactgtgtat

SEQ ID NO: 5490019 - DNA, 14 bp, Homo sapiens
gctttactgtttct

SEQ ID NO: 5490020 - DNA, 15 bp, Homo sapiens
gctttacttagctta

SEQ ID NO: 5490021 - DNA, 15 bp, Homo sapiens
gctttactttagaat

SEQ ID NO: 5490022 - DNA, 21 bp, Homo sapiens
gctttagaatcccagccccct

SEQ ID NO: 5490023 - DNA, 21 bp, Homo sapiens
gctttagaattctaattgtca

SEQ ID NO: 5490024 - DNA, 21 bp, Homo sapiens
gctttagacttgaaaagagac

SEQ ID NO: 5490025 - DNA, 17 bp, Homo sapiens
gctttagagaagccata

SEQ ID NO: 5490026 - DNA, 20 bp, Homo sapiens
gctttagattgaaatttatg

SEQ ID NO: 5490027 - DNA, 21 bp, Homo sapiens
gctttagattgaaatttatga

SEQ ID NO: 5490028 - DNA, 20 bp, Homo sapiens
gctttaggcatatgcttctt

SEQ ID NO: 5490029 - DNA, 20 bp, Homo sapiens
gctttaggggtggtgggggt

SEQ ID NO: 5490030 - DNA, 21 bp, Homo sapiens
gctttagtacaatagtataca

SEQ ID NO: 5490031 - DNA, 21 bp, Homo sapiens
gctttagtacatggagctcag

SEQ ID NO: 5490032 - DNA, 22 bp, Homo sapiens
gctttagtacatggagctcagg

SEQ ID NO: 5490033 - DNA, 23 bp, Homo sapiens
gctttagttctgctttctgcctc

SEQ ID NO: 5490034 - DNA, 17 bp, Homo sapiens
gctttataataaactgt

SEQ ID NO: 5490035 - DNA, 20 bp, Homo sapiens
gctttatacgtgtagctata

SEQ ID NO: 5490036 - DNA, 16 bp, Homo sapiens
gctttatactctctcc

SEQ ID NO: 5490037 - DNA, 14 bp, Homo sapiens
gctttatcagaagc

SEQ ID NO: 5490038 - DNA, 14 bp, Homo sapiens
gctttatctttgtg

SEQ ID NO: 5490039 - DNA, 15 bp, Homo sapiens
gctttatctttgtgt

SEQ ID NO: 5490040 - DNA, 21 bp, Homo sapiens
gctttatgataatagattctc

SEQ ID NO: 5490041 - DNA, 17 bp, Homo sapiens
gctttatgcaaatacaa

SEQ ID NO: 5490042 - DNA, 18 bp, Homo sapiens
gctttatgcaaatacaat

SEQ ID NO: 5490043 - DNA, 20 bp, Homo sapiens
gctttatgggtgttaattga

SEQ ID NO: 5490044 - DNA, 23 bp, Homo sapiens
gctttatgttcatttgtttgttt

SEQ ID NO: 5490045 - DNA, 18 bp, Homo sapiens
gctttattaaagaaataa

SEQ ID NO: 5490046 - DNA, 16 bp, Homo sapiens
gctttattaatgtttt

SEQ ID NO: 5490047 - DNA, 22 bp, Homo sapiens
gctttattgcctctgtcttaaa

SEQ ID NO: 5490048 - DNA, 19 bp, Homo sapiens
gctttatttatagaaatga

SEQ ID NO: 5490049 - DNA, 17 bp, Homo sapiens
gctttatttgtaaattt

SEQ ID NO: 5490050 - DNA, 13 bp, Homo sapiens
gctttatttttca

SEQ ID NO: 5490051 - DNA, 22 bp, Homo sapiens
gctttatttttctttaaagcca

SEQ ID NO: 5490052 - DNA, 23 bp, Homo sapiens
gctttatttttctttaaagccag

SEQ ID NO: 5490053 - DNA, 18 bp, Homo sapiens
gctttatttttcttttcc

SEQ ID NO: 5490054 - DNA, 13 bp, Homo sapiens
gctttatttttta

SEQ ID NO: 5490055 - DNA, 15 bp, Homo sapiens
gctttcaaacatgtt

SEQ ID NO: 5490056 - DNA, 23 bp, Homo sapiens
gctttcaaaggagctcgaaggat

SEQ ID NO: 5490057 - DNA, 16 bp, Homo sapiens
gctttcaacttaaatc

SEQ ID NO: 5490058 - DNA, 15 bp, Homo sapiens
gctttcaaggctggg

SEQ ID NO: 5490059 - DNA, 18 bp, Homo sapiens
gctttcaaggctggggca

SEQ ID NO: 5490060 - DNA, 22 bp, Homo sapiens
gctttcactaggaaaatcatgt

SEQ ID NO: 5490061 - DNA, 17 bp, Homo sapiens
gctttcactatttcctt

SEQ ID NO: 5490062 - DNA, 18 bp, Homo sapiens
gctttcagaaaacgggaa

SEQ ID NO: 5490063 - DNA, 19 bp, Homo sapiens
gctttcagaaaacgggaag

SEQ ID NO: 5490064 - DNA, 15 bp, Homo sapiens
gctttcagaagtgcc

SEQ ID NO: 5490065 - DNA, 15 bp, Homo sapiens
gctttcagaatatgt

SEQ ID NO: 5490066 - DNA, 21 bp, Homo sapiens
gctttcagatgcagttttcaa

SEQ ID NO: 5490067 - DNA, 15 bp, Homo sapiens
gctttcagcaactga

SEQ ID NO: 5490068 - DNA, 21 bp, Homo sapiens
gctttcaggctacctttttct

SEQ ID NO: 5490069 - DNA, 14 bp, Homo sapiens
gctttcagggcctc

SEQ ID NO: 5490070 - DNA, 18 bp, Homo sapiens
gctttcagggcctccagc

SEQ ID NO: 5490071 - DNA, 23 bp, Homo sapiens
gctttcagtgatatctttctcat

SEQ ID NO: 5490072 - DNA, 21 bp, Homo sapiens
gctttcagtgcctgctgttcg

SEQ ID NO: 5490073 - DNA, 20 bp, Homo sapiens
gctttcatcctgtgtcccct

SEQ ID NO: 5490074 - DNA, 23 bp, Homo sapiens
gctttcatgaccactgggcctgc

SEQ ID NO: 5490075 - DNA, 18 bp, Homo sapiens
gctttcatgattagcaag

SEQ ID NO: 5490076 - DNA, 20 bp, Homo sapiens
gctttcatgtaaactgtgca

SEQ ID NO: 5490077 - DNA, 18 bp, Homo sapiens
gctttcatgtaattatct

SEQ ID NO: 5490078 - DNA, 19 bp, Homo sapiens
gctttcatgttgcaaagaa

SEQ ID NO: 5490079 - DNA, 22 bp, Homo sapiens
gctttccaaaccttatctccac

SEQ ID NO: 5490080 - DNA, 18 bp, Homo sapiens
gctttccacacctggcac

SEQ ID NO: 5490081 - DNA, 11 bp, Homo sapiens
gctttccagct

SEQ ID NO: 5490082 - DNA, 21 bp, Homo sapiens
gctttccatatttttttcctt

SEQ ID NO: 5490083 - DNA, 19 bp, Homo sapiens
gctttccatctgaggacca

SEQ ID NO: 5490084 - DNA, 23 bp, Homo sapiens
gctttccatgggcccgctgcctc

SEQ ID NO: 5490085 - DNA, 16 bp, Homo sapiens
gctttccatgttgctg

SEQ ID NO: 5490086 - DNA, 19 bp, Homo sapiens
gctttccatgttgctgcca

SEQ ID NO: 5490087 - DNA, 22 bp, Homo sapiens
gctttcccacttcccaccctgc

SEQ ID NO: 5490088 - DNA, 16 bp, Homo sapiens
gctttcccagaggaca

SEQ ID NO: 5490089 - DNA, 14 bp, Homo sapiens
gctttcccaggaga

SEQ ID NO: 5490090 - DNA, 21 bp, Homo sapiens
gctttcccatatcttgccttc

SEQ ID NO: 5490091 - DNA, 22 bp, Homo sapiens
gctttcccccaggcgcctgcgc

SEQ ID NO: 5490092 - DNA, 23 bp, Homo sapiens
gctttcccgcccagcctcacttc

SEQ ID NO: 5490093 - DNA, 15 bp, Homo sapiens
gctttccctccccag

SEQ ID NO: 5490094 - DNA, 14 bp, Homo sapiens
gctttccctgaagc

SEQ ID NO: 5490095 - DNA, 14 bp, Homo sapiens
gctttccctgagga

SEQ ID NO: 5490096 - DNA, 18 bp, Homo sapiens
gctttccctgaggaatga

SEQ ID NO: 5490097 - DNA, 23 bp, Homo sapiens
gctttccgtttttttctttcctg

SEQ ID NO: 5490098 - DNA, 15 bp, Homo sapiens
gctttcctaaaacag

SEQ ID NO: 5490099 - DNA, 23 bp, Homo sapiens
gctttcctaaagtctctgctgct

SEQ ID NO: 5490100 - DNA, 15 bp, Homo sapiens
gctttcctaaatcag

SEQ ID NO: 5490101 - DNA, 23 bp, Homo sapiens
gctttcctcaaaaagcagaagga

SEQ ID NO: 5490102 - DNA, 11 bp, Homo sapiens
gctttcctccg

SEQ ID NO: 5490103 - DNA, 17 bp, Homo sapiens
gctttcctcttactttc

SEQ ID NO: 5490104 - DNA, 11 bp, Homo sapiens
gctttcctgaa

SEQ ID NO: 5490105 - DNA, 14 bp, Homo sapiens
gctttcctgcagca

SEQ ID NO: 5490106 - DNA, 12 bp, Homo sapiens
gctttcctgccc

SEQ ID NO: 5490107 - DNA, 23 bp, Homo sapiens
gctttcctggagagtctcactcc

SEQ ID NO: 5490108 - DNA, 15 bp, Homo sapiens
gctttcctggagcca

SEQ ID NO: 5490109 - DNA, 16 bp, Homo sapiens
gctttcctggtccctc

SEQ ID NO: 5490110 - DNA, 14 bp, Homo sapiens
gctttcctgtttct

SEQ ID NO: 5490111 - DNA, 13 bp, Homo sapiens
gctttccttcctc

SEQ ID NO: 5490112 - DNA, 16 bp, Homo sapiens
gctttccttcctcccc

SEQ ID NO: 5490113 - DNA, 23 bp, Homo sapiens
gctttccttcggaatccagtgct

SEQ ID NO: 5490114 - DNA, 20 bp, Homo sapiens
gctttccttctgcccttcct

SEQ ID NO: 5490115 - DNA, 21 bp, Homo sapiens
gctttccttctgcccttcctc

SEQ ID NO: 5490116 - DNA, 19 bp, Homo sapiens
gctttccttgtggcagagg

SEQ ID NO: 5490117 - DNA, 23 bp, Homo sapiens
gctttccttgttagaatgcaagc

SEQ ID NO: 5490118 - DNA, 13 bp, Homo sapiens
gctttccttttct

SEQ ID NO: 5490119 - DNA, 14 bp, Homo sapiens
gctttcggggaggg

SEQ ID NO: 5490120 - DNA, 16 bp, Homo sapiens
gctttcggggagggcg

SEQ ID NO: 5490121 - DNA, 18 bp, Homo sapiens
gctttcgtagcccctgct

SEQ ID NO: 5490122 - DNA, 13 bp, Homo sapiens
gctttcgtccaca

SEQ ID NO: 5490123 - DNA, 21 bp, Homo sapiens
gctttcgtccacagcttcctg

SEQ ID NO: 5490124 - DNA, 17 bp, Homo sapiens
gctttcgtccatgtttc

SEQ ID NO: 5490125 - DNA, 19 bp, Homo sapiens
gctttctaactcacaggca

SEQ ID NO: 5490126 - DNA, 14 bp, Homo sapiens
gctttctaattaaa

SEQ ID NO: 5490127 - DNA, 13 bp, Homo sapiens
gctttctaccaca

SEQ ID NO: 5490128 - DNA, 22 bp, Homo sapiens
gctttctacccagcgagccctg

SEQ ID NO: 5490129 - DNA, 23 bp, Homo sapiens
gctttctacccagcgagccctgg

SEQ ID NO: 5490130 - DNA, 12 bp, Homo sapiens
gctttctagaag

SEQ ID NO: 5490131 - DNA, 20 bp, Homo sapiens
gctttctattacccctcatt

SEQ ID NO: 5490132 - DNA, 21 bp, Homo sapiens
gctttctattggcatggattt

SEQ ID NO: 5490133 - DNA, 19 bp, Homo sapiens
gctttctcaaaatttgatg

SEQ ID NO: 5490134 - DNA, 14 bp, Homo sapiens
gctttctcagtgtg

SEQ ID NO: 5490135 - DNA, 11 bp, Homo sapiens
gctttctcatg

SEQ ID NO: 5490136 - DNA, 13 bp, Homo sapiens
gctttctcatgca

SEQ ID NO: 5490137 - DNA, 17 bp, Homo sapiens
gctttctcatgcataga

SEQ ID NO: 5490138 - DNA, 19 bp, Homo sapiens
gctttctccagaaccagtg

SEQ ID NO: 5490139 - DNA, 15 bp, Homo sapiens
gctttctccggggtc

SEQ ID NO: 5490140 - DNA, 18 bp, Homo sapiens
gctttctcctctgctatg

SEQ ID NO: 5490141 - DNA, 12 bp, Homo sapiens
gctttctcctgg

SEQ ID NO: 5490142 - DNA, 16 bp, Homo sapiens
gctttctcctgtgccc

SEQ ID NO: 5490143 - DNA, 13 bp, Homo sapiens
gctttctcctttc

SEQ ID NO: 5490144 - DNA, 19 bp, Homo sapiens
gctttctcgcgccctcccc

SEQ ID NO: 5490145 - DNA, 16 bp, Homo sapiens
gctttctcgtgggtcc

SEQ ID NO: 5490146 - DNA, 17 bp, Homo sapiens
gctttctctctggcttc

SEQ ID NO: 5490147 - DNA, 21 bp, Homo sapiens
gctttctctctggcttctctc

SEQ ID NO: 5490148 - DNA, 22 bp, Homo sapiens
gctttgtgtctggccagcttga

SEQ ID NO: 5490149 - DNA, 15 bp, Homo sapiens
gctttgtgttgtaat

SEQ ID NO: 5490150 - DNA, 15 bp, Homo sapiens
gctttgtgtttactt

SEQ ID NO: 5490151 - DNA, 13 bp, Homo sapiens
gctttgtgtttgg

SEQ ID NO: 5490152 - DNA, 19 bp, Homo sapiens
gctttgtgtttggtttaca

SEQ ID NO: 5490153 - DNA, 12 bp, Homo sapiens
gctttgttaatg

SEQ ID NO: 5490154 - DNA, 16 bp, Homo sapiens
gctttgttcttgtcat

SEQ ID NO: 5490155 - DNA, 22 bp, Homo sapiens
gctttgttcttgtcatcagtaa

SEQ ID NO: 5490156 - DNA, 19 bp, Homo sapiens
gctttgttgtcctcccagg

SEQ ID NO: 5490157 - DNA, 20 bp, Homo sapiens
gctttgttgtcctcccagga

SEQ ID NO: 5490158 - DNA, 21 bp, Homo sapiens
gctttgttgtcctcccaggaa

SEQ ID NO: 5490159 - DNA, 22 bp, Homo sapiens
gctttgttgtgtgcctctagct

SEQ ID NO: 5490160 - DNA, 16 bp, Homo sapiens
gctttgttgttctgcc

SEQ ID NO: 5490161 - DNA, 15 bp, Homo sapiens
gctttgtttactctc

SEQ ID NO: 5490162 - DNA, 14 bp, Homo sapiens
gctttgtttgttct

SEQ ID NO: 5490163 - DNA, 22 bp, Homo sapiens
gctttgttttggctgctctcca

SEQ ID NO: 5490164 - DNA, 17 bp, Homo sapiens
gcttttaaaaaaaaata

SEQ ID NO: 5490165 - DNA, 17 bp, Homo sapiens
gcttttaaaaatgtttg

SEQ ID NO: 5490166 - DNA, 13 bp, Homo sapiens
gcttttaaaacat

SEQ ID NO: 5490167 - DNA, 14 bp, Homo sapiens
gcttttaaaaggaa

SEQ ID NO: 5490168 - DNA, 20 bp, Homo sapiens
gcttttaaaagtgcacatta

SEQ ID NO: 5490169 - DNA, 19 bp, Homo sapiens
gcttttaacagagtctgaa

SEQ ID NO: 5490170 - DNA, 21 bp, Homo sapiens
gcttttaactggggtattaac

SEQ ID NO: 5490171 - DNA, 17 bp, Homo sapiens
gcttttaacttctgata

SEQ ID NO: 5490172 - DNA, 12 bp, Homo sapiens
gcttttaagaaa

SEQ ID NO: 5490173 - DNA, 13 bp, Homo sapiens
gcttttaataaaa

SEQ ID NO: 5490174 - DNA, 23 bp, Homo sapiens
gcttttaatgaatttaaggcaaa

SEQ ID NO: 5490175 - DNA, 22 bp, Homo sapiens
gcttttaattctcatttgttct

SEQ ID NO: 5490176 - DNA, 13 bp, Homo sapiens
gcttttacccttt

SEQ ID NO: 5490177 - DNA, 17 bp, Homo sapiens
gcttttacggtgatatt

SEQ ID NO: 5490178 - DNA, 18 bp, Homo sapiens
gcttttacgtagtaaaag

SEQ ID NO: 5490179 - DNA, 17 bp, Homo sapiens
gcttttaggagaattca

SEQ ID NO: 5490180 - DNA, 14 bp, Homo sapiens
gcttttagtaccca

SEQ ID NO: 5490181 - DNA, 19 bp, Homo sapiens
gcttttagtacccacctga

SEQ ID NO: 5490182 - DNA, 20 bp, Homo sapiens
gcttttagtttttctgtccc

SEQ ID NO: 5490183 - DNA, 13 bp, Homo sapiens
gcttttatagttg

SEQ ID NO: 5490184 - DNA, 22 bp, Homo sapiens
gcttttatagttgtattttgta

SEQ ID NO: 5490185 - DNA, 18 bp, Homo sapiens
gcttttatatatgaagtt

SEQ ID NO: 5490186 - DNA, 16 bp, Homo sapiens
gcttttatatggccca

SEQ ID NO: 5490187 - DNA, 22 bp, Homo sapiens
gcttttatatggcccagccttg

SEQ ID NO: 5490188 - DNA, 22 bp, Homo sapiens
gcttttatattctaaattttta

SEQ ID NO: 5490189 - DNA, 19 bp, Homo sapiens
gcttttatcagtgttaaag

SEQ ID NO: 5490190 - DNA, 12 bp, Homo sapiens
gcttttatggat

SEQ ID NO: 5490191 - DNA, 17 bp, Homo sapiens
gcttttattaaatttgt

SEQ ID NO: 5490192 - DNA, 19 bp, Homo sapiens
gcttttattaatgcacttt

SEQ ID NO: 5490193 - DNA, 22 bp, Homo sapiens
gcttttattaatgcactttcta

SEQ ID NO: 5490194 - DNA, 16 bp, Homo sapiens
gcttttattagaaagc

SEQ ID NO: 5490195 - DNA, 19 bp, Homo sapiens
gcttttattcctttgaata

SEQ ID NO: 5490196 - DNA, 18 bp, Homo sapiens
gcttttattcgtcctttg

SEQ ID NO: 5490197 - DNA, 22 bp, Homo sapiens
gcttttattgcaccattttcaa

SEQ ID NO: 5490198 - DNA, 12 bp, Homo sapiens
gcttttattgga

SEQ ID NO: 5490199 - DNA, 15 bp, Homo sapiens
gcttttattgtataa

SEQ ID NO: 5490200 - DNA, 15 bp, Homo sapiens
gcttttatttcagtg

SEQ ID NO: 5490201 - DNA, 18 bp, Homo sapiens
gcttttatttcagtgcca

SEQ ID NO: 5490202 - DNA, 16 bp, Homo sapiens
gcttttatttggtgtg

SEQ ID NO: 5490203 - DNA, 15 bp, Homo sapiens
gcttttattttgaaa

SEQ ID NO: 5490204 - DNA, 21 bp, Homo sapiens
gcttttattttttaagttcaa

SEQ ID NO: 5490205 - DNA, 22 bp, Homo sapiens
gcttttattttttaagttcaat

SEQ ID NO: 5490206 - DNA, 20 bp, Homo sapiens
gcttttattttttcttttgt

SEQ ID NO: 5490207 - DNA, 13 bp, Homo sapiens
gcttttcacccca

SEQ ID NO: 5490208 - DNA, 12 bp, Homo sapiens
gcttttcactgc

SEQ ID NO: 5490209 - DNA, 16 bp, Homo sapiens
gcttttcactgctgca

SEQ ID NO: 5490210 - DNA, 17 bp, Homo sapiens
gcttttcactgctgcaa

SEQ ID NO: 5490211 - DNA, 14 bp, Homo sapiens
gcttttcagaagaa

SEQ ID NO: 5490212 - DNA, 23 bp, Homo sapiens
gcttttcagattgtggaatgttg

SEQ ID NO: 5490213 - DNA, 18 bp, Homo sapiens
gcttttcatgcaaactct

SEQ ID NO: 5490214 - DNA, 21 bp, Homo sapiens
gcttttccaggatcctgcagg

SEQ ID NO: 5490215 - DNA, 19 bp, Homo sapiens
gcttttcccaacccccagc

SEQ ID NO: 5490216 - DNA, 19 bp, Homo sapiens
gcttttccctaagccaagg

SEQ ID NO: 5490217 - DNA, 12 bp, Homo sapiens
gcttttccctct

SEQ ID NO: 5490218 - DNA, 17 bp, Homo sapiens
gcttttccctcttttct

SEQ ID NO: 5490219 - DNA, 12 bp, Homo sapiens
gcttttccctgg

SEQ ID NO: 5490220 - DNA, 13 bp, Homo sapiens
gcttttccctggg

SEQ ID NO: 5490221 - DNA, 13 bp, Homo sapiens
gcttttcctgtct

SEQ ID NO: 5490222 - DNA, 14 bp, Homo sapiens
gcttttcctgtctg

SEQ ID NO: 5490223 - DNA, 23 bp, Homo sapiens
gcttttccttggggcaggcagtg

SEQ ID NO: 5490224 - DNA, 22 bp, Homo sapiens
gcttttcctttgtttttatgaa

SEQ ID NO: 5490225 - DNA, 16 bp, Homo sapiens
gcttttccttttgcac

SEQ ID NO: 5490226 - DNA, 20 bp, Homo sapiens
gcttttcgcttgcttctgca

SEQ ID NO: 5490227 - DNA, 18 bp, Homo sapiens
gcttttctaatcttgtta

SEQ ID NO: 5490228 - DNA, 14 bp, Homo sapiens
gcttttctcagctg

SEQ ID NO: 5490229 - DNA, 13 bp, Homo sapiens
gcttttctcagga

SEQ ID NO: 5490230 - DNA, 15 bp, Homo sapiens
gcttttctcccagaa

SEQ ID NO: 5490231 - DNA, 22 bp, Homo sapiens
gcttttctcttgccccaaatca

SEQ ID NO: 5490232 - DNA, 11 bp, Homo sapiens
gcttttctgat

SEQ ID NO: 5490233 - DNA, 18 bp, Homo sapiens
gcttttctgccctggctg

SEQ ID NO: 5490234 - DNA, 12 bp, Homo sapiens
gcttttctgtcc

SEQ ID NO: 5490235 - DNA, 15 bp, Homo sapiens
gcttttctgtcctgg

SEQ ID NO: 5490236 - DNA, 17 bp, Homo sapiens
gcttttctgtttcctgt

SEQ ID NO: 5490237 - DNA, 18 bp, Homo sapiens
gcttttctgtttcctgta

SEQ ID NO: 5490238 - DNA, 15 bp, Homo sapiens
gcttttcttagtgtg

SEQ ID NO: 5490239 - DNA, 14 bp, Homo sapiens
gcttttcttcctag

SEQ ID NO: 5490240 - DNA, 15 bp, Homo sapiens
gcttttcttgccagc

SEQ ID NO: 5490241 - DNA, 16 bp, Homo sapiens
gcttttcttgccagct

SEQ ID NO: 5490242 - DNA, 19 bp, Homo sapiens
gcttttgaaaagttgaaat

SEQ ID NO: 5490243 - DNA, 18 bp, Homo sapiens
gcttttgaaaatgtttat

SEQ ID NO: 5490244 - DNA, 22 bp, Homo sapiens
gcttttgagtgggccctgcccg

SEQ ID NO: 5490245 - DNA, 20 bp, Homo sapiens
gcttttgatggctatgtttt

SEQ ID NO: 5490246 - DNA, 21 bp, Homo sapiens
gcttttgcagacgggcaagaa

SEQ ID NO: 5490247 - DNA, 18 bp, Homo sapiens
gcttttgcataatgcaat

SEQ ID NO: 5490248 - DNA, 17 bp, Homo sapiens
gcttttgcatagaataa

SEQ ID NO: 5490249 - DNA, 13 bp, Homo sapiens
gcttttgcatatt

SEQ ID NO: 5490250 - DNA, 12 bp, Homo sapiens
gcttttgcatct

SEQ ID NO: 5490251 - DNA, 13 bp, Homo sapiens
gcttttgcatttc

SEQ ID NO: 5490252 - DNA, 15 bp, Homo sapiens
gcttttgccactttg

SEQ ID NO: 5490253 - DNA, 15 bp, Homo sapiens
gcttttgcccacaca

SEQ ID NO: 5490254 - DNA, 17 bp, Homo sapiens
gcttttgcccacacact

SEQ ID NO: 5490255 - DNA, 14 bp, Homo sapiens
gcttttgcctctgc

SEQ ID NO: 5490256 - DNA, 23 bp, Homo sapiens
gcttttgcctgcaagagaatctg

SEQ ID NO: 5490257 - DNA, 17 bp, Homo sapiens
gcttttgcctgtaagaa

SEQ ID NO: 5490258 - DNA, 12 bp, Homo sapiens
gcttttgctgct

SEQ ID NO: 5490259 - DNA, 18 bp, Homo sapiens
gcttttgctgctgcttaa

SEQ ID NO: 5490260 - DNA, 19 bp, Homo sapiens
gcttttgctggtcactgcc

SEQ ID NO: 5490261 - DNA, 17 bp, Homo sapiens
gcttttgctttccctga

SEQ ID NO: 5490262 - DNA, 11 bp, Homo sapiens
gcttttggaag

SEQ ID NO: 5490263 - DNA, 14 bp, Homo sapiens
gcttttggcctgga

SEQ ID NO: 5490264 - DNA, 18 bp, Homo sapiens
gcttttggggagccagaa

SEQ ID NO: 5490265 - DNA, 14 bp, Homo sapiens
gcttttggtcatca

SEQ ID NO: 5490266 - DNA, 20 bp, Homo sapiens
gcttttggtgaatttgttta

SEQ ID NO: 5490267 - DNA, 21 bp, Homo sapiens
gcttttggtggtccccacagc

SEQ ID NO: 5490268 - DNA, 20 bp, Homo sapiens
gcttttggtgtttgagtgtt

SEQ ID NO: 5490269 - DNA, 22 bp, Homo sapiens
gcttttggttaatatgtctttt

SEQ ID NO: 5490270 - DNA, 13 bp, Homo sapiens
gcttttgtagatg

SEQ ID NO: 5490271 - DNA, 20 bp, Homo sapiens
gcttttgtctaattaaaaca

SEQ ID NO: 5490272 - DNA, 18 bp, Homo sapiens
gcttttgtctatgggact

SEQ ID NO: 5490273 - DNA, 13 bp, Homo sapiens
gcttttgtgcatt

SEQ ID NO: 5490274 - DNA, 23 bp, Homo sapiens
gcttttgtgggggactgtaagtt

SEQ ID NO: 5490275 - DNA, 15 bp, Homo sapiens
gcttttgtgtcccat

SEQ ID NO: 5490276 - DNA, 15 bp, Homo sapiens
gcttttgttctagac

SEQ ID NO: 5490277 - DNA, 16 bp, Homo sapiens
gcttttgttctagact

SEQ ID NO: 5490278 - DNA, 20 bp, Homo sapiens
gcttttgttgtgacttttta

SEQ ID NO: 5490279 - DNA, 14 bp, Homo sapiens
gcttttgttgttta

SEQ ID NO: 5490280 - DNA, 21 bp, Homo sapiens
gcttttgtttcctttttcaga

SEQ ID NO: 5490281 - DNA, 23 bp, Homo sapiens
gcttttgtttcctttttcagata

SEQ ID NO: 5490282 - DNA, 16 bp, Homo sapiens
gcttttgttttgctta

SEQ ID NO: 5490283 - DNA, 17 bp, Homo sapiens
gctttttaaattttcca

SEQ ID NO: 5490284 - DNA, 20 bp, Homo sapiens
gctttttaattgttgtttct

SEQ ID NO: 5490285 - DNA, 22 bp, Homo sapiens
gctttttaattgttgtttcttt

SEQ ID NO: 5490286 - DNA, 21 bp, Homo sapiens
gctttttaccgttcacttccc

SEQ ID NO: 5490287 - DNA, 23 bp, Homo sapiens
gctttttaccgttcacttcccct

SEQ ID NO: 5490288 - DNA, 18 bp, Homo sapiens
gctttttactattaacat

SEQ ID NO: 5490289 - DNA, 12 bp, Homo sapiens
gctttttataaa

SEQ ID NO: 5490290 - DNA, 19 bp, Homo sapiens
gctttttattccctgccca

SEQ ID NO: 5490291 - DNA, 15 bp, Homo sapiens
gctttttcacagtca

SEQ ID NO: 5490292 - DNA, 19 bp, Homo sapiens
gctttttccagattcttcc

SEQ ID NO: 5490293 - DNA, 18 bp, Homo sapiens
gctttttcctctcattgt

SEQ ID NO: 5490294 - DNA, 15 bp, Homo sapiens
gctttttcctctgag

SEQ ID NO: 5490295 - DNA, 16 bp, Homo sapiens
gctttttctcagatct

SEQ ID NO: 5490296 - DNA, 18 bp, Homo sapiens
gctttttctctcagggtt

SEQ ID NO: 5490297 - DNA, 18 bp, Homo sapiens
gctttttctgactccagt

SEQ ID NO: 5490298 - DNA, 14 bp, Homo sapiens
gctttttgaaatga

SEQ ID NO: 5490299 - DNA, 16 bp, Homo sapiens
gctttttgaaatgaaa

SEQ ID NO: 5490300 - DNA, 17 bp, Homo sapiens
gctttttgaaatgaaat

SEQ ID NO: 5490301 - DNA, 18 bp, Homo sapiens
gctttttgatcctctact

SEQ ID NO: 5490302 - DNA, 12 bp, Homo sapiens
gctttttggaaa

SEQ ID NO: 5490303 - DNA, 13 bp, Homo sapiens
gctttttggaatc

SEQ ID NO: 5490304 - DNA, 15 bp, Homo sapiens
gctttttggcacagt

SEQ ID NO: 5490305 - DNA, 19 bp, Homo sapiens
gctttttgtactgtagttc

SEQ ID NO: 5490306 - DNA, 20 bp, Homo sapiens
gctttttgtactgtagttca

SEQ ID NO: 5490307 - DNA, 23 bp, Homo sapiens
gctttttgtgatatgcacaatgt

SEQ ID NO: 5490308 - DNA, 16 bp, Homo sapiens
gctttttgtgtttttt

SEQ ID NO: 5490309 - DNA, 21 bp, Homo sapiens
gcttttttaaccaaggagggg

SEQ ID NO: 5490310 - DNA, 23 bp, Homo sapiens
gcttttttaaccaaggaggggcc

SEQ ID NO: 5490311 - DNA, 18 bp, Homo sapiens
gcttttttatcatgtgaa

SEQ ID NO: 5490312 - DNA, 18 bp, Homo sapiens
gcttttttcctcctttct

SEQ ID NO: 5490313 - DNA, 18 bp, Homo sapiens
gcttttttgattttgctg

SEQ ID NO: 5490314 - DNA, 19 bp, Homo sapiens
gctttttttcttgctagta

SEQ ID NO: 5490315 - DNA, 21 bp, Homo sapiens
gctttttttgtgtgtatttgc

SEQ ID NO: 5490316 - DNA, 15 bp, Homo sapiens
gctttttttttctct

SEQ ID NO: 5490317 - DNA, 20 bp, Homo sapiens
gctttttttttttaattttg

SEQ ID NO: 5490318 - DNA, 18 bp, Homo sapiens
ggaaaaaaaaaaaagagg

SEQ ID NO: 5490319 - DNA, 15 bp, Homo sapiens
ggaaaaaaaaacagc

SEQ ID NO: 5490320 - DNA, 14 bp, Homo sapiens
ggaaaaaaaagaaa

SEQ ID NO: 5490321 - DNA, 16 bp, Homo sapiens
ggaaaaaaaagagact

SEQ ID NO: 5490322 - DNA, 16 bp, Homo sapiens
ggaaaaaaaataatgt

SEQ ID NO: 5490323 - DNA, 16 bp, Homo sapiens
ggaaaaaaaatatata

SEQ ID NO: 5490324 - DNA, 19 bp, Homo sapiens
ggaaaaaaacttggcactt

SEQ ID NO: 5490325 - DNA, 12 bp, Homo sapiens
ggaaaaaaagac

SEQ ID NO: 5490326 - DNA, 19 bp, Homo sapiens
ggaaaccccttctctgtga

SEQ ID NO: 5490327 - DNA, 21 bp, Homo sapiens
ggaaacccggggaactggttt

SEQ ID NO: 5490328 - DNA, 22 bp, Homo sapiens
ggaaaccgagtagaaaatgtga

SEQ ID NO: 5490329 - DNA, 18 bp, Homo sapiens
ggaaaccgggtggcagcg

SEQ ID NO: 5490330 - DNA, 12 bp, Homo sapiens
ggaaacctgccc

SEQ ID NO: 5490331 - DNA, 13 bp, Homo sapiens
ggaaacctgccct

SEQ ID NO: 5490332 - DNA, 14 bp, Homo sapiens
ggaaacctgccctg

SEQ ID NO: 5490333 - DNA, 23 bp, Homo sapiens
ggaaacctgtgaaagctgcactc

SEQ ID NO: 5490334 - DNA, 14 bp, Homo sapiens
ggaaaccttgcagc

SEQ ID NO: 5490335 - DNA, 16 bp, Homo sapiens
ggaaaccttgcagcat

SEQ ID NO: 5490336 - DNA, 19 bp, Homo sapiens
ggaaaccttggagaggaga

SEQ ID NO: 5490337 - DNA, 18 bp, Homo sapiens
ggaaacgaaacccactct

SEQ ID NO: 5490338 - DNA, 15 bp, Homo sapiens
ggaaacgagactttc

SEQ ID NO: 5490339 - DNA, 23 bp, Homo sapiens
ggaaacgctacctctctgtccct

SEQ ID NO: 5490340 - DNA, 21 bp, Homo sapiens
ggaaacggaagctgacataat

SEQ ID NO: 5490341 - DNA, 22 bp, Homo sapiens
ggaaacggtatcctccctgccc

SEQ ID NO: 5490342 - DNA, 22 bp, Homo sapiens
ggaaacgtatgtgtgcaggagc

SEQ ID NO: 5490343 - DNA, 15 bp, Homo sapiens
ggaaacgtctcccag

SEQ ID NO: 5490344 - DNA, 16 bp, Homo sapiens
ggaaacgtctcccaga

SEQ ID NO: 5490345 - DNA, 15 bp, Homo sapiens
ggaaacgtggcagga

SEQ ID NO: 5490346 - DNA, 17 bp, Homo sapiens
ggaaacgtgggttcaat

SEQ ID NO: 5490347 - DNA, 16 bp, Homo sapiens
ggaaactaagattctt

SEQ ID NO: 5490348 - DNA, 17 bp, Homo sapiens
ggaaactaagattcttt

SEQ ID NO: 5490349 - DNA, 16 bp, Homo sapiens
ggaaactactgccttt

SEQ ID NO: 5490350 - DNA, 16 bp, Homo sapiens
ggaaactagcttacat

SEQ ID NO: 5490351 - DNA, 21 bp, Homo sapiens
ggaaactcacctgctggcccc

SEQ ID NO: 5490352 - DNA, 17 bp, Homo sapiens
ggaaactcagatgtcca

SEQ ID NO: 5490353 - DNA, 20 bp, Homo sapiens
ggaaactccacatctgcctt

SEQ ID NO: 5490354 - DNA, 16 bp, Homo sapiens
ggaaactcctgtgacc

SEQ ID NO: 5490355 - DNA, 17 bp, Homo sapiens
ggaaactcctgtgacca

SEQ ID NO: 5490356 - DNA, 15 bp, Homo sapiens
ggaaactcttgctat

SEQ ID NO: 5490357 - DNA, 17 bp, Homo sapiens
ggaaactgaggcccaga

SEQ ID NO: 5490358 - DNA, 20 bp, Homo sapiens
ggaaactgagggcagagagg

SEQ ID NO: 5490359 - DNA, 13 bp, Homo sapiens
ggaaactgagtca

SEQ ID NO: 5490360 - DNA, 18 bp, Homo sapiens
ggaaactgcagctgggaa

SEQ ID NO: 5490361 - DNA, 23 bp, Homo sapiens
ggaaactgcagctgggaagagga

SEQ ID NO: 5490362 - DNA, 20 bp, Homo sapiens
ggaaactgccaaacctcctg

SEQ ID NO: 5490363 - DNA, 22 bp, Homo sapiens
ggaaactgctttatttttataa

SEQ ID NO: 5490364 - DNA, 13 bp, Homo sapiens
ggaaactgggaaa

SEQ ID NO: 5490365 - DNA, 21 bp, Homo sapiens
ggaaacttctgtaaggggcag

SEQ ID NO: 5490366 - DNA, 14 bp, Homo sapiens
ggaaacttgccttt

SEQ ID NO: 5490367 - DNA, 19 bp, Homo sapiens
ggaaacttgtcacttgcat

SEQ ID NO: 5490368 - DNA, 22 bp, Homo sapiens
ggaaactttaggtctagtttct

SEQ ID NO: 5490369 - DNA, 16 bp, Homo sapiens
ggaaagaaagaaggaa

SEQ ID NO: 5490370 - DNA, 16 bp, Homo sapiens
ggaaagaaggaaaaaa

SEQ ID NO: 5490371 - DNA, 12 bp, Homo sapiens
ggaaagaaggag

SEQ ID NO: 5490372 - DNA, 15 bp, Homo sapiens
ggaaagaaggagatg

SEQ ID NO: 5490373 - DNA, 19 bp, Homo sapiens
ggaaagaagggggccctgc

SEQ ID NO: 5490374 - DNA, 14 bp, Homo sapiens
ggaaagacactgcc

SEQ ID NO: 5490375 - DNA, 15 bp, Homo sapiens
ggaaagacaggaaga

SEQ ID NO: 5490376 - DNA, 19 bp, Homo sapiens
ggaaagacaggaagaccaa

SEQ ID NO: 5490377 - DNA, 22 bp, Homo sapiens
ggaaagacatccataaagaagc

SEQ ID NO: 5490378 - DNA, 22 bp, Homo sapiens
ggaaagacctacattccctctc

SEQ ID NO: 5490379 - DNA, 20 bp, Homo sapiens
ggaaagacctgtgaggggaa

SEQ ID NO: 5490380 - DNA, 16 bp, Homo sapiens
ggaaagacgtttttgt

SEQ ID NO: 5490381 - DNA, 20 bp, Homo sapiens
ggaaagacttttccaaccct

SEQ ID NO: 5490382 - DNA, 17 bp, Homo sapiens
ggaaagagaaagagaca

SEQ ID NO: 5490383 - DNA, 12 bp, Homo sapiens
ggaaagagacca

SEQ ID NO: 5490384 - DNA, 14 bp, Homo sapiens
ggaaagagagctgg

SEQ ID NO: 5490385 - DNA, 17 bp, Homo sapiens
ggaaagagagctggagt

SEQ ID NO: 5490386 - DNA, 13 bp, Homo sapiens
ggaaagagctagg

SEQ ID NO: 5490387 - DNA, 18 bp, Homo sapiens
ggaaagagctaggaaccc

SEQ ID NO: 5490388 - DNA, 13 bp, Homo sapiens
ggaaagaggagaa

SEQ ID NO: 5490389 - DNA, 15 bp, Homo sapiens
ggaaagatcccaagt

SEQ ID NO: 5490390 - DNA, 15 bp, Homo sapiens
ggaaagatggataaa

SEQ ID NO: 5490391 - DNA, 14 bp, Homo sapiens
ggaaagatggggag

SEQ ID NO: 5490392 - DNA, 16 bp, Homo sapiens
ggaaagatggggagct

SEQ ID NO: 5490393 - DNA, 23 bp, Homo sapiens
ggaaagatggtgtgggtgtcctg

SEQ ID NO: 5490394 - DNA, 12 bp, Homo sapiens
ggaaagatgtcc

SEQ ID NO: 5490395 - DNA, 20 bp, Homo sapiens
ggaaagatgtcccacaggga

SEQ ID NO: 5490396 - DNA, 15 bp, Homo sapiens
ggaaagattgtgtct

SEQ ID NO: 5490397 - DNA, 15 bp, Homo sapiens
ggaaagatttaatgt

SEQ ID NO: 5490398 - DNA, 17 bp, Homo sapiens
ggaaagcaaagcacaga

SEQ ID NO: 5490399 - DNA, 21 bp, Homo sapiens
ggaaagcaacttcatcccagc

SEQ ID NO: 5490400 - DNA, 21 bp, Homo sapiens
ggaaagcaagaatcagagaag

SEQ ID NO: 5490401 - DNA, 22 bp, Homo sapiens
ggaaagcacaagactggcccag

SEQ ID NO: 5490402 - DNA, 21 bp, Homo sapiens
ggaaagcacagaggcctcctg

SEQ ID NO: 5490403 - DNA, 23 bp, Homo sapiens
ggaaagcaccgcagcatgtgggg

SEQ ID NO: 5490404 - DNA, 14 bp, Homo sapiens
ggaaagcagaactg

SEQ ID NO: 5490405 - DNA, 15 bp, Homo sapiens
ggaaagcagaactga

SEQ ID NO: 5490406 - DNA, 18 bp, Homo sapiens
ggaaagcagcattctgga

SEQ ID NO: 5490407 - DNA, 22 bp, Homo sapiens
ggaaagcagctcaaaggcacag

SEQ ID NO: 5490408 - DNA, 11 bp, Homo sapiens
ggaaagcaggt

SEQ ID NO: 5490409 - DNA, 19 bp, Homo sapiens
ggaaagcagtcagcggaga

SEQ ID NO: 5490410 - DNA, 21 bp, Homo sapiens
ggaaagcagtcagcggagagg

SEQ ID NO: 5490411 - DNA, 13 bp, Homo sapiens
ggaaagcagtgtg

SEQ ID NO: 5490412 - DNA, 14 bp, Homo sapiens
ggaaagcatgcatt

SEQ ID NO: 5490413 - DNA, 14 bp, Homo sapiens
ggaaagcatttaaa

SEQ ID NO: 5490414 - DNA, 18 bp, Homo sapiens
ggaaagccacctctccct

SEQ ID NO: 5490415 - DNA, 14 bp, Homo sapiens
ggaaagccagcctg

SEQ ID NO: 5490416 - DNA, 15 bp, Homo sapiens
ggaaagccagcctgg

SEQ ID NO: 5490417 - DNA, 22 bp, Homo sapiens
ggaaagccagcctgggggctgg

SEQ ID NO: 5490418 - DNA, 12 bp, Homo sapiens
ggaaagccaggt

SEQ ID NO: 5490419 - DNA, 13 bp, Homo sapiens
ggaaagccaggtt

SEQ ID NO: 5490420 - DNA, 12 bp, Homo sapiens
ggaaagccatga

SEQ ID NO: 5490421 - DNA, 17 bp, Homo sapiens
ggaaagccatgaccttg

SEQ ID NO: 5490422 - DNA, 11 bp, Homo sapiens
ggaaagcccag

SEQ ID NO: 5490423 - DNA, 13 bp, Homo sapiens
ggaaagcccagac

SEQ ID NO: 5490424 - DNA, 14 bp, Homo sapiens
ggaaagcccagact

SEQ ID NO: 5490425 - DNA, 17 bp, Homo sapiens
ggaaagcccagacttta

SEQ ID NO: 5490426 - DNA, 12 bp, Homo sapiens
ggaaagccctcc

SEQ ID NO: 5490427 - DNA, 16 bp, Homo sapiens
ggaaagccctgtgctc

SEQ ID NO: 5490428 - DNA, 13 bp, Homo sapiens
ggaaagcctctgc

SEQ ID NO: 5490429 - DNA, 15 bp, Homo sapiens
ggaaagcgggcagcc

SEQ ID NO: 5490430 - DNA, 18 bp, Homo sapiens
ggaaagcgggcagccccg

SEQ ID NO: 5490431 - DNA, 24 bp, Homo sapiens
ggaaagctaagtcttgtctcattt

SEQ ID NO: 5490432 - DNA, 23 bp, Homo sapiens
ggaaagctcttcctaatcgctaa

SEQ ID NO: 5490433 - DNA, 20 bp, Homo sapiens
ggaaagctgatgatgtctct

SEQ ID NO: 5490434 - DNA, 15 bp, Homo sapiens
ggaaagcttactgtt

SEQ ID NO: 5490435 - DNA, 16 bp, Homo sapiens
ggaaagcttttcagtg

SEQ ID NO: 5490436 - DNA, 21 bp, Homo sapiens
ggaaaggaaaaccagggatag

SEQ ID NO: 5490437 - DNA, 13 bp, Homo sapiens
ggaaaggaatgca

SEQ ID NO: 5490438 - DNA, 12 bp, Homo sapiens
ggaaaggaattg

SEQ ID NO: 5490439 - DNA, 12 bp, Homo sapiens
ggaaaggaccca

SEQ ID NO: 5490440 - DNA, 20 bp, Homo sapiens
ggaaaggatcctacaatatt

SEQ ID NO: 5490441 - DNA, 20 bp, Homo sapiens
ggaaaggcaaatgcccaagg

SEQ ID NO: 5490442 - DNA, 20 bp, Homo sapiens
ggaaaggcagggccctgaaa

SEQ ID NO: 5490443 - DNA, 15 bp, Homo sapiens
ggaaaggcagtatgg

SEQ ID NO: 5490444 - DNA, 16 bp, Homo sapiens
ggaaaggccagcactc

SEQ ID NO: 5490445 - DNA, 21 bp, Homo sapiens
ggaaaggccagcagccttcca

SEQ ID NO: 5490446 - DNA, 22 bp, Homo sapiens
ggaaaggccagcagccttccag

SEQ ID NO: 5490447 - DNA, 22 bp, Homo sapiens
ggaaaggccagctggcagcaga

SEQ ID NO: 5490448 - DNA, 22 bp, Homo sapiens
ggaaaggccctgcacaggtggc

SEQ ID NO: 5490449 - DNA, 12 bp, Homo sapiens
ggaaaggctcag

SEQ ID NO: 5490450 - DNA, 19 bp, Homo sapiens
ggaaaggctcagtctcagg

SEQ ID NO: 5490451 - DNA, 12 bp, Homo sapiens
ggaaaggctcca

SEQ ID NO: 5490452 - DNA, 22 bp, Homo sapiens
ggaaaggctccaggagcagcca

SEQ ID NO: 5490453 - DNA, 15 bp, Homo sapiens
ggaaaggcttggctg

SEQ ID NO: 5490454 - DNA, 11 bp, Homo sapiens
ggaaagggaag

SEQ ID NO: 5490455 - DNA, 13 bp, Homo sapiens
ggaaagggaagag

SEQ ID NO: 5490456 - DNA, 13 bp, Homo sapiens
ggaaagggaagcc

SEQ ID NO: 5490457 - DNA, 18 bp, Homo sapiens
ggaaagggaagcctgact

SEQ ID NO: 5490458 - DNA, 14 bp, Homo sapiens
ggaaagggagatgt

SEQ ID NO: 5490459 - DNA, 12 bp, Homo sapiens
ggaaagggagga

SEQ ID NO: 5490460 - DNA, 17 bp, Homo sapiens
ggaaagggatggtcagg

SEQ ID NO: 5490461 - DNA, 21 bp, Homo sapiens
ggaaagggatggtcaggccca

SEQ ID NO: 5490462 - DNA, 23 bp, Homo sapiens
ggaaagggattttcagccctcag

SEQ ID NO: 5490463 - DNA, 20 bp, Homo sapiens
ggaaagggccctccttccta

SEQ ID NO: 5490464 - DNA, 15 bp, Homo sapiens
ggaaagggcctggcc

SEQ ID NO: 5490465 - DNA, 20 bp, Homo sapiens
ggaaagggctggctccccct

SEQ ID NO: 5490466 - DNA, 12 bp, Homo sapiens
ggaaaggggaca

SEQ ID NO: 5490467 - DNA, 13 bp, Homo sapiens
ggaaaggggagag

SEQ ID NO: 5490468 - DNA, 14 bp, Homo sapiens
ggaaaggggagagc

SEQ ID NO: 5490469 - DNA, 21 bp, Homo sapiens
ggaaaggggcaggccagagct

SEQ ID NO: 5490470 - DNA, 14 bp, Homo sapiens
ggaaaggggggagc

SEQ ID NO: 5490471 - DNA, 18 bp, Homo sapiens
ggaaaggggggagctggg

SEQ ID NO: 5490472 - DNA, 20 bp, Homo sapiens
ggaaaggggtcggctgacca

SEQ ID NO: 5490473 - DNA, 22 bp, Homo sapiens
ggaaaggggttggggtgacagt

SEQ ID NO: 5490474 - DNA, 15 bp, Homo sapiens
ggaaaggtcagcccg

SEQ ID NO: 5490475 - DNA, 11 bp, Homo sapiens
ggaaaggtgct

SEQ ID NO: 5490476 - DNA, 16 bp, Homo sapiens
ggaaaggtggtgtttc

SEQ ID NO: 5490477 - DNA, 23 bp, Homo sapiens
ggaaaggtttcaagacttgatac

SEQ ID NO: 5490478 - DNA, 21 bp, Homo sapiens
ggaaaggtttggaaaactaac

SEQ ID NO: 5490479 - DNA, 19 bp, Homo sapiens
ggaaagtacactctgctgt

SEQ ID NO: 5490480 - DNA, 19 bp, Homo sapiens
ggaaagtactgcatgatct

SEQ ID NO: 5490481 - DNA, 22 bp, Homo sapiens
ggaaagtcacctacaggactgg

SEQ ID NO: 5490482 - DNA, 22 bp, Homo sapiens
ggaaagtccccgtcccccagaa

SEQ ID NO: 5490483 - DNA, 23 bp, Homo sapiens
ggaaagtcctcctattccagtgt

SEQ ID NO: 5490484 - DNA, 18 bp, Homo sapiens
ggaaagtgaatttgaatg

SEQ ID NO: 5490485 - DNA, 13 bp, Homo sapiens
ggaaagtgccagc

SEQ ID NO: 5490486 - DNA, 21 bp, Homo sapiens
ggaaagtgccagcattccaga

SEQ ID NO: 5490487 - DNA, 22 bp, Homo sapiens
ggaaagtgccagcattccagac

SEQ ID NO: 5490488 - DNA, 23 bp, Homo sapiens
ggaaagtggccaagaagcagtgg

SEQ ID NO: 5490489 - DNA, 20 bp, Homo sapiens
ggaaagtgtgagctcttccc

SEQ ID NO: 5490490 - DNA, 23 bp, Homo sapiens
ggaaagtgttcattgcacaatat

SEQ ID NO: 5490491 - DNA, 14 bp, Homo sapiens
ggaaagttaatgtc

SEQ ID NO: 5490492 - DNA, 15 bp, Homo sapiens
ggaaagttactgtaa

SEQ ID NO: 5490493 - DNA, 16 bp, Homo sapiens
ggaaagttcagccaga

SEQ ID NO: 5490494 - DNA, 18 bp, Homo sapiens
ggaaagttgcatttaatg

SEQ ID NO: 5490495 - DNA, 23 bp, Homo sapiens
ggaaagttggaaccgtgtccagc

SEQ ID NO: 5490496 - DNA, 18 bp, Homo sapiens
ggaaagtttgccaggagg

SEQ ID NO: 5490497 - DNA, 20 bp, Homo sapiens
ggaaagtttgtagcattttt

SEQ ID NO: 5490498 - DNA, 15 bp, Homo sapiens
ggaaagttttctcca

SEQ ID NO: 5490499 - DNA, 17 bp, Homo sapiens
ggaaagttttgttctgt

SEQ ID NO: 5490500 - DNA, 15 bp, Homo sapiens
ggaaataaaaaagtc

SEQ ID NO: 5490501 - DNA, 22 bp, Homo sapiens
ggaaataaaaaagtctctattt

SEQ ID NO: 5490502 - DNA, 22 bp, Homo sapiens
ggaaataaaacctttcaaattt

SEQ ID NO: 5490503 - DNA, 20 bp, Homo sapiens
ggaaataaaagataaaagag

SEQ ID NO: 5490504 - DNA, 16 bp, Homo sapiens
ggaacccggtcccagg

SEQ ID NO: 5490505 - DNA, 17 bp, Homo sapiens
ggaacccggtcccaggc

SEQ ID NO: 5490506 - DNA, 17 bp, Homo sapiens
ggaaccctaaagcagta

SEQ ID NO: 5490507 - DNA, 23 bp, Homo sapiens
ggaaccctaaagcagtaaaataa

SEQ ID NO: 5490508 - DNA, 12 bp, Homo sapiens
ggaaccctcagg

SEQ ID NO: 5490509 - DNA, 20 bp, Homo sapiens
ggaaccctctggggcccttt

SEQ ID NO: 5490510 - DNA, 14 bp, Homo sapiens
ggaaccctgtccct

SEQ ID NO: 5490511 - DNA, 23 bp, Homo sapiens
ggaacccttttcctccagacaga

SEQ ID NO: 5490512 - DNA, 14 bp, Homo sapiens
ggaaccgaggactc

SEQ ID NO: 5490513 - DNA, 15 bp, Homo sapiens
ggaaccgaggcaggg

SEQ ID NO: 5490514 - DNA, 16 bp, Homo sapiens
ggaaccgcaggaagct

SEQ ID NO: 5490515 - DNA, 17 bp, Homo sapiens
ggaaccgcaggaagctg

SEQ ID NO: 5490516 - DNA, 14 bp, Homo sapiens
ggaaccgctcacct

SEQ ID NO: 5490517 - DNA, 20 bp, Homo sapiens
ggaaccggagggtgacccat

SEQ ID NO: 5490518 - DNA, 16 bp, Homo sapiens
ggaaccgtaggaccca

SEQ ID NO: 5490519 - DNA, 21 bp, Homo sapiens
ggaaccgtaggacccaagcag

SEQ ID NO: 5490520 - DNA, 17 bp, Homo sapiens
ggaaccgtgtccagcac

SEQ ID NO: 5490521 - DNA, 20 bp, Homo sapiens
ggaaccgtgtccagcacaga

SEQ ID NO: 5490522 - DNA, 19 bp, Homo sapiens
ggaacctagctacactgag

SEQ ID NO: 5490523 - DNA, 23 bp, Homo sapiens
ggaacctagtactctctgctcta

SEQ ID NO: 5490524 - DNA, 12 bp, Homo sapiens
ggaacctcactc

SEQ ID NO: 5490525 - DNA, 18 bp, Homo sapiens
ggaacctcactcttgcca

SEQ ID NO: 5490526 - DNA, 19 bp, Homo sapiens
ggaacctcagcctggccag

SEQ ID NO: 5490527 - DNA, 14 bp, Homo sapiens
ggaacctcccagag

SEQ ID NO: 5490528 - DNA, 17 bp, Homo sapiens
ggaacctccccagcctg

SEQ ID NO: 5490529 - DNA, 21 bp, Homo sapiens
ggaacctccccagcctgcgcc

SEQ ID NO: 5490530 - DNA, 16 bp, Homo sapiens
ggaacctccctgggcc

SEQ ID NO: 5490531 - DNA, 18 bp, Homo sapiens
ggaacctccctgggcctg

SEQ ID NO: 5490532 - DNA, 19 bp, Homo sapiens
ggaacctcgaagctgttct

SEQ ID NO: 5490533 - DNA, 21 bp, Homo sapiens
ggaacctcgaagctgttctct

SEQ ID NO: 5490534 - DNA, 15 bp, Homo sapiens
ggaacctctgtctca

SEQ ID NO: 5490535 - DNA, 16 bp, Homo sapiens
ggaacctgcaaaaaat

SEQ ID NO: 5490536 - DNA, 19 bp, Homo sapiens
ggaacctggaccccagcct

SEQ ID NO: 5490537 - DNA, 12 bp, Homo sapiens
ggaacctggcag

SEQ ID NO: 5490538 - DNA, 19 bp, Homo sapiens
ggaacctggcaggccctgc

SEQ ID NO: 5490539 - DNA, 20 bp, Homo sapiens
ggaacctggcaggccctgcc

SEQ ID NO: 5490540 - DNA, 17 bp, Homo sapiens
ggaacctgtactgggtt

SEQ ID NO: 5490541 - DNA, 23 bp, Homo sapiens
ggaaccttaacctctctaagcca

SEQ ID NO: 5490542 - DNA, 21 bp, Homo sapiens
ggaaccttccttcctgcttga

SEQ ID NO: 5490543 - DNA, 13 bp, Homo sapiens
ggaaccttgctgt

SEQ ID NO: 5490544 - DNA, 16 bp, Homo sapiens
ggaaccttgctgtcct

SEQ ID NO: 5490545 - DNA, 15 bp, Homo sapiens
ggaacgatgtgtctg

SEQ ID NO: 5490546 - DNA, 21 bp, Homo sapiens
ggaacgcaagaggcatcccaa

SEQ ID NO: 5490547 - DNA, 16 bp, Homo sapiens
ggaacgcagaggcgga

SEQ ID NO: 5490548 - DNA, 21 bp, Homo sapiens
ggaacgccgggactgagagac

SEQ ID NO: 5490549 - DNA, 15 bp, Homo sapiens
ggaacggaggaggac

SEQ ID NO: 5490550 - DNA, 22 bp, Homo sapiens
ggaacggatgctccgaggactg

SEQ ID NO: 5490551 - DNA, 21 bp, Homo sapiens
ggaacggccctgcaggagcag

SEQ ID NO: 5490552 - DNA, 20 bp, Homo sapiens
ggaacggctgatgtggactg

SEQ ID NO: 5490553 - DNA, 15 bp, Homo sapiens
ggaacgggcagccac

SEQ ID NO: 5490554 - DNA, 18 bp, Homo sapiens
ggaacgggcagcctgggc

SEQ ID NO: 5490555 - DNA, 18 bp, Homo sapiens
ggaacgggcatgggcctc

SEQ ID NO: 5490556 - DNA, 22 bp, Homo sapiens
ggaacgggcatgggcctctctg

SEQ ID NO: 5490557 - DNA, 22 bp, Homo sapiens
ggaacggtgaaggtgacagcag

SEQ ID NO: 5490558 - DNA, 14 bp, Homo sapiens
ggaacgtgaactca

SEQ ID NO: 5490559 - DNA, 22 bp, Homo sapiens
ggaacgtgtgtccaggctctgg

SEQ ID NO: 5490560 - DNA, 16 bp, Homo sapiens
ggaacgttctctacct

SEQ ID NO: 5490561 - DNA, 15 bp, Homo sapiens
ggaacgttggacttt

SEQ ID NO: 5490562 - DNA, 14 bp, Homo sapiens
ggaactaataaata

SEQ ID NO: 5490563 - DNA, 22 bp, Homo sapiens
ggaactagaaagaaggacccag

SEQ ID NO: 5490564 - DNA, 18 bp, Homo sapiens
ggaactagactgcctggg

SEQ ID NO: 5490565 - DNA, 17 bp, Homo sapiens
ggaactagactttcctt

SEQ ID NO: 5490566 - DNA, 21 bp, Homo sapiens
ggaactagagggatacactga

SEQ ID NO: 5490567 - DNA, 13 bp, Homo sapiens
ggaactagataac

SEQ ID NO: 5490568 - DNA, 17 bp, Homo sapiens
ggaactcacctggggct

SEQ ID NO: 5490569 - DNA, 23 bp, Homo sapiens
ggaactcacgtggggagcggtgg

SEQ ID NO: 5490570 - DNA, 19 bp, Homo sapiens
ggaactcactctttagata

SEQ ID NO: 5490571 - DNA, 13 bp, Homo sapiens
ggaactcagatcc

SEQ ID NO: 5490572 - DNA, 17 bp, Homo sapiens
ggaactcagatccaggg

SEQ ID NO: 5490573 - DNA, 19 bp, Homo sapiens
ggaactcagatccagggac

SEQ ID NO: 5490574 - DNA, 22 bp, Homo sapiens
ggaactcattcctgcctgtctc

SEQ ID NO: 5490575 - DNA, 12 bp, Homo sapiens
ggaactccagga

SEQ ID NO: 5490576 - DNA, 11 bp, Homo sapiens
ggaactcccag

SEQ ID NO: 5490577 - DNA, 15 bp, Homo sapiens
ggaactcccccagag

SEQ ID NO: 5490578 - DNA, 21 bp, Homo sapiens
ggaactccccttcttcctgga

SEQ ID NO: 5490579 - DNA, 12 bp, Homo sapiens
ggaactcctgcc

SEQ ID NO: 5490580 - DNA, 16 bp, Homo sapiens
ggaactcctgccacaa

SEQ ID NO: 5490581 - DNA, 19 bp, Homo sapiens
ggaactcgcacctgtgctg

SEQ ID NO: 5490582 - DNA, 14 bp, Homo sapiens
ggaactcgcctcag

SEQ ID NO: 5490583 - DNA, 15 bp, Homo sapiens
ggaactcgcctcagc

SEQ ID NO: 5490584 - DNA, 23 bp, Homo sapiens
ggaactctatctgggcctgggct

SEQ ID NO: 5490585 - DNA, 13 bp, Homo sapiens
ggaactctcctgg

SEQ ID NO: 5490586 - DNA, 13 bp, Homo sapiens
ggaactctgacaa

SEQ ID NO: 5490587 - DNA, 14 bp, Homo sapiens
ggaactctgacaag

SEQ ID NO: 5490588 - DNA, 21 bp, Homo sapiens
ggaactctgacaagggctgac

SEQ ID NO: 5490589 - DNA, 20 bp, Homo sapiens
ggaactctggcttccaggta

SEQ ID NO: 5490590 - DNA, 16 bp, Homo sapiens
ggaactctgtgcaggt

SEQ ID NO: 5490591 - DNA, 17 bp, Homo sapiens
ggaactctgtgcaggtg

SEQ ID NO: 5490592 - DNA, 19 bp, Homo sapiens
ggaactctgtgcaggtgct

SEQ ID NO: 5490593 - DNA, 19 bp, Homo sapiens
ggaactgaagacctccaca

SEQ ID NO: 5490594 - DNA, 20 bp, Homo sapiens
ggaactgaagggggcggcct

SEQ ID NO: 5490595 - DNA, 18 bp, Homo sapiens
ggaactgaccctcaggca

SEQ ID NO: 5490596 - DNA, 23 bp, Homo sapiens
ggaactgagccagaaacgcagat

SEQ ID NO: 5490597 - DNA, 20 bp, Homo sapiens
ggaactgattgctcccagga

SEQ ID NO: 5490598 - DNA, 22 bp, Homo sapiens
ggaactgcaatgaaagtcaaat

SEQ ID NO: 5490599 - DNA, 17 bp, Homo sapiens
ggaactgcagacctgtc

SEQ ID NO: 5490600 - DNA, 22 bp, Homo sapiens
ggaactgcagtatggccatggg

SEQ ID NO: 5490601 - DNA, 23 bp, Homo sapiens
ggaactgcatatcggaggtggtg

SEQ ID NO: 5490602 - DNA, 16 bp, Homo sapiens
ggaactgcatgctgct

SEQ ID NO: 5490603 - DNA, 14 bp, Homo sapiens
ggaactgctgccac

SEQ ID NO: 5490604 - DNA, 14 bp, Homo sapiens
ggaactgctgctga

SEQ ID NO: 5490605 - DNA, 15 bp, Homo sapiens
ggaactgcttgccca

SEQ ID NO: 5490606 - DNA, 11 bp, Homo sapiens
ggaactggagg

SEQ ID NO: 5490607 - DNA, 12 bp, Homo sapiens
ggaactggaggc

SEQ ID NO: 5490608 - DNA, 16 bp, Homo sapiens
ggaactggccaagctg

SEQ ID NO: 5490609 - DNA, 12 bp, Homo sapiens
ggaactggctcc

SEQ ID NO: 5490610 - DNA, 23 bp, Homo sapiens
ggaactggctgtgaagacccagg

SEQ ID NO: 5490611 - DNA, 12 bp, Homo sapiens
ggaactgggctg

SEQ ID NO: 5490612 - DNA, 14 bp, Homo sapiens
ggaactgggctggc

SEQ ID NO: 5490613 - DNA, 21 bp, Homo sapiens
ggaactgggtggtttggtttt

SEQ ID NO: 5490614 - DNA, 23 bp, Homo sapiens
ggaactggtccaggccaggcctc

SEQ ID NO: 5490615 - DNA, 19 bp, Homo sapiens
ggaactggtttttctgttc

SEQ ID NO: 5490616 - DNA, 23 bp, Homo sapiens
ggaactggtttttctgttccctg

SEQ ID NO: 5490617 - DNA, 13 bp, Homo sapiens
ggaactgtaataa

SEQ ID NO: 5490618 - DNA, 14 bp, Homo sapiens
ggaactgtccagag

SEQ ID NO: 5490619 - DNA, 14 bp, Homo sapiens
ggaactgtgcaaag

SEQ ID NO: 5490620 - DNA, 15 bp, Homo sapiens
ggaactgtgtattta

SEQ ID NO: 5490621 - DNA, 13 bp, Homo sapiens
ggaacttgagaac

SEQ ID NO: 5490622 - DNA, 17 bp, Homo sapiens
ggaacttgcctgccttt

SEQ ID NO: 5490623 - DNA, 22 bp, Homo sapiens
ggaacttgcgagtccaaggcca

SEQ ID NO: 5490624 - DNA, 20 bp, Homo sapiens
ggaactttctgttccctatg

SEQ ID NO: 5490625 - DNA, 22 bp, Homo sapiens
ggaactttctgttccctatgga

SEQ ID NO: 5490626 - DNA, 17 bp, Homo sapiens
ggaagaaaaaaatcttc

SEQ ID NO: 5490627 - DNA, 13 bp, Homo sapiens
ggaagaaaaaatg

SEQ ID NO: 5490628 - DNA, 15 bp, Homo sapiens
ggaagaaaacactgt

SEQ ID NO: 5490629 - DNA, 15 bp, Homo sapiens
ggaagaaaatatttt

SEQ ID NO: 5490630 - DNA, 20 bp, Homo sapiens
ggaagaaaatggtttatttt

SEQ ID NO: 5490631 - DNA, 22 bp, Homo sapiens
ggaagaaaattatgtaaagttt

SEQ ID NO: 5490632 - DNA, 18 bp, Homo sapiens
ggaagaaacactcttatt

SEQ ID NO: 5490633 - DNA, 19 bp, Homo sapiens
ggaagaaacactttctctt

SEQ ID NO: 5490634 - DNA, 21 bp, Homo sapiens
ggaagaaacaggggatcaaag

SEQ ID NO: 5490635 - DNA, 19 bp, Homo sapiens
ggaagaaaccccaagcagc

SEQ ID NO: 5490636 - DNA, 21 bp, Homo sapiens
ggaagaaacctggaaccagag

SEQ ID NO: 5490637 - DNA, 15 bp, Homo sapiens
ggaagaaactttttt

SEQ ID NO: 5490638 - DNA, 13 bp, Homo sapiens
ggaagaaagaagc

SEQ ID NO: 5490639 - DNA, 15 bp, Homo sapiens
ggaagaaagaatgtt

SEQ ID NO: 5490640 - DNA, 22 bp, Homo sapiens
ggaagaaattcaggtacagaaa

SEQ ID NO: 5490641 - DNA, 19 bp, Homo sapiens
ggaagaaattcctgtagca

SEQ ID NO: 5490642 - DNA, 21 bp, Homo sapiens
ggaagaacagccccggggccc

SEQ ID NO: 5490643 - DNA, 22 bp, Homo sapiens
ggaagaacagccccggggcccc

SEQ ID NO: 5490644 - DNA, 16 bp, Homo sapiens
ggaagaactgcatggg

SEQ ID NO: 5490645 - DNA, 15 bp, Homo sapiens
ggaagaagaaaggac

SEQ ID NO: 5490646 - DNA, 18 bp, Homo sapiens
ggaagaagaaaggactga

SEQ ID NO: 5490647 - DNA, 22 bp, Homo sapiens
ggaagaagaaatctttctccct

SEQ ID NO: 5490648 - DNA, 21 bp, Homo sapiens
ggaagaagaaccaggcatgga

SEQ ID NO: 5490649 - DNA, 21 bp, Homo sapiens
ggaagaagagatcaggaagag

SEQ ID NO: 5490650 - DNA, 22 bp, Homo sapiens
ggaagaagagatcaggaagaga

SEQ ID NO: 5490651 - DNA, 15 bp, Homo sapiens
ggaagaagagatgca

SEQ ID NO: 5490652 - DNA, 18 bp, Homo sapiens
ggaagaagaggaggaaga

SEQ ID NO: 5490653 - DNA, 16 bp, Homo sapiens
ggaagaagagggagag

SEQ ID NO: 5490654 - DNA, 20 bp, Homo sapiens
ggaagaagccccgtttccag

SEQ ID NO: 5490655 - DNA, 18 bp, Homo sapiens
ggaagaagcttaggcagg

SEQ ID NO: 5490656 - DNA, 19 bp, Homo sapiens
ggaagaagcttaggcaggg

SEQ ID NO: 5490657 - DNA, 17 bp, Homo sapiens
ggaagaaggcccgggag

SEQ ID NO: 5490658 - DNA, 19 bp, Homo sapiens
ggaagaaggcccgggagga

SEQ ID NO: 5490659 - DNA, 13 bp, Homo sapiens
ggaagaagggaga

SEQ ID NO: 5490660 - DNA, 14 bp, Homo sapiens
ggaagaagggagaa

SEQ ID NO: 5490661 - DNA, 18 bp, Homo sapiens
ggaagaagggccaccctg

SEQ ID NO: 5490662 - DNA, 16 bp, Homo sapiens
ggaagaagtatatttt

SEQ ID NO: 5490663 - DNA, 19 bp, Homo sapiens
ggaagaagttttttacttt

SEQ ID NO: 5490664 - DNA, 23 bp, Homo sapiens
ggaagaatagggcccatgggagg

SEQ ID NO: 5490665 - DNA, 16 bp, Homo sapiens
ggaagaatgaaagctg

SEQ ID NO: 5490666 - DNA, 14 bp, Homo sapiens
ggaagacaagtctg

SEQ ID NO: 5490667 - DNA, 15 bp, Homo sapiens
ggaagacacttcaga

SEQ ID NO: 5490668 - DNA, 22 bp, Homo sapiens
ggaagacacttcagatctgagg

SEQ ID NO: 5490669 - DNA, 23 bp, Homo sapiens
ggaagacagagacctcctgcctc

SEQ ID NO: 5490670 - DNA, 23 bp, Homo sapiens
ggaagacagagatggcagagcca

SEQ ID NO: 5490671 - DNA, 14 bp, Homo sapiens
ggaagacagagcag

SEQ ID NO: 5490672 - DNA, 15 bp, Homo sapiens
ggaagacagagcagg

SEQ ID NO: 5490673 - DNA, 17 bp, Homo sapiens
ggaagacagcatttaaa

SEQ ID NO: 5490674 - DNA, 14 bp, Homo sapiens
ggaagacagctctt

SEQ ID NO: 5490675 - DNA, 23 bp, Homo sapiens
ggaagacagttctacagaaaaac

SEQ ID NO: 5490676 - DNA, 23 bp, Homo sapiens
ggaagacatatattatatataga

SEQ ID NO: 5490677 - DNA, 13 bp, Homo sapiens
ggaagacatttct

SEQ ID NO: 5490678 - DNA, 15 bp, Homo sapiens
ggaagacatttttcc

SEQ ID NO: 5490679 - DNA, 20 bp, Homo sapiens
ggaagacccattccttccca

SEQ ID NO: 5490680 - DNA, 19 bp, Homo sapiens
ggaagaccccacccaagct

SEQ ID NO: 5490681 - DNA, 20 bp, Homo sapiens
ggaagcccatcctgaccagc

SEQ ID NO: 5490682 - DNA, 13 bp, Homo sapiens
ggaagcccccacc

SEQ ID NO: 5490683 - DNA, 21 bp, Homo sapiens
ggaagcccccaccgtgggcag

SEQ ID NO: 5490684 - DNA, 18 bp, Homo sapiens
ggaagccccccacctttc

SEQ ID NO: 5490685 - DNA, 23 bp, Homo sapiens
ggaagccccccacctttctcgct

SEQ ID NO: 5490686 - DNA, 18 bp, Homo sapiens
ggaagccccctcttcctc

SEQ ID NO: 5490687 - DNA, 14 bp, Homo sapiens
ggaagcccctgggc

SEQ ID NO: 5490688 - DNA, 15 bp, Homo sapiens
ggaagcccctgggcc

SEQ ID NO: 5490689 - DNA, 18 bp, Homo sapiens
ggaagcccctgggcccag

SEQ ID NO: 5490690 - DNA, 13 bp, Homo sapiens
ggaagcccggact

SEQ ID NO: 5490691 - DNA, 12 bp, Homo sapiens
ggaagccctcct

SEQ ID NO: 5490692 - DNA, 15 bp, Homo sapiens
ggaagccctccttcc

SEQ ID NO: 5490693 - DNA, 17 bp, Homo sapiens
ggaagccctctcagatc

SEQ ID NO: 5490694 - DNA, 15 bp, Homo sapiens
ggaagccctggattt

SEQ ID NO: 5490695 - DNA, 15 bp, Homo sapiens
ggaagccgctggggc

SEQ ID NO: 5490696 - DNA, 18 bp, Homo sapiens
ggaagccggtgcctgggt

SEQ ID NO: 5490697 - DNA, 21 bp, Homo sapiens
ggaagccgttgaatctgggag

SEQ ID NO: 5490698 - DNA, 22 bp, Homo sapiens
ggaagccgttgaatctgggagg

SEQ ID NO: 5490699 - DNA, 20 bp, Homo sapiens
ggaagcctccgtcaggagag

SEQ ID NO: 5490700 - DNA, 15 bp, Homo sapiens
ggaagcctcttcagg

SEQ ID NO: 5490701 - DNA, 17 bp, Homo sapiens
ggaagcctgactgctcg

SEQ ID NO: 5490702 - DNA, 18 bp, Homo sapiens
ggaagcctgactgctcgg

SEQ ID NO: 5490703 - DNA, 13 bp, Homo sapiens
ggaagccttgctc

SEQ ID NO: 5490704 - DNA, 17 bp, Homo sapiens
ggaagcgagcagaggct

SEQ ID NO: 5490705 - DNA, 23 bp, Homo sapiens
ggaagcgatgaatttggagactc

SEQ ID NO: 5490706 - DNA, 17 bp, Homo sapiens
ggaagcgtcgccccagt

SEQ ID NO: 5490707 - DNA, 18 bp, Homo sapiens
ggaagcgtcgccccagtg

SEQ ID NO: 5490708 - DNA, 13 bp, Homo sapiens
ggaagctacaggt

SEQ ID NO: 5490709 - DNA, 15 bp, Homo sapiens
ggaagctacaggtta

SEQ ID NO: 5490710 - DNA, 19 bp, Homo sapiens
ggaagctagacacatgaag

SEQ ID NO: 5490711 - DNA, 16 bp, Homo sapiens
ggaagctagctcccct

SEQ ID NO: 5490712 - DNA, 17 bp, Homo sapiens
ggaagctagctcccctc

SEQ ID NO: 5490713 - DNA, 16 bp, Homo sapiens
ggaagctagtcttttg

SEQ ID NO: 5490714 - DNA, 17 bp, Homo sapiens
ggaagctagtcttttgc

SEQ ID NO: 5490715 - DNA, 13 bp, Homo sapiens
ggaagctcagcct

SEQ ID NO: 5490716 - DNA, 20 bp, Homo sapiens
ggaagctcagccttctcctc

SEQ ID NO: 5490717 - DNA, 16 bp, Homo sapiens
ggaagctcagggcctg

SEQ ID NO: 5490718 - DNA, 17 bp, Homo sapiens
ggaagctcagggcctgg

SEQ ID NO: 5490719 - DNA, 22 bp, Homo sapiens
ggaagctcccaccccactcagg

SEQ ID NO: 5490720 - DNA, 13 bp, Homo sapiens
ggaagctccttcc

SEQ ID NO: 5490721 - DNA, 19 bp, Homo sapiens
ggaagctctccgagctctg

SEQ ID NO: 5490722 - DNA, 13 bp, Homo sapiens
ggaagctcttctt

SEQ ID NO: 5490723 - DNA, 21 bp, Homo sapiens
ggaagctcttggagctgtgag

SEQ ID NO: 5490724 - DNA, 14 bp, Homo sapiens
ggaagctgaattat

SEQ ID NO: 5490725 - DNA, 12 bp, Homo sapiens
ggaagctgagcc

SEQ ID NO: 5490726 - DNA, 13 bp, Homo sapiens
ggaagctgaggcg

SEQ ID NO: 5490727 - DNA, 19 bp, Homo sapiens
ggaagctgatacagagaga

SEQ ID NO: 5490728 - DNA, 17 bp, Homo sapiens
ggaagctgattcccaga

SEQ ID NO: 5490729 - DNA, 18 bp, Homo sapiens
ggaagctgattcccagag

SEQ ID NO: 5490730 - DNA, 10 bp, Homo sapiens
ggaagctgca

SEQ ID NO: 5490731 - DNA, 13 bp, Homo sapiens
ggaagctgcagct

SEQ ID NO: 5490732 - DNA, 16 bp, Homo sapiens
ggaagctgccagccca

SEQ ID NO: 5490733 - DNA, 21 bp, Homo sapiens
ggaagctgccagcccagaaca

SEQ ID NO: 5490734 - DNA, 17 bp, Homo sapiens
ggaagctgccctgccca

SEQ ID NO: 5490735 - DNA, 13 bp, Homo sapiens
ggaagctgctagg

SEQ ID NO: 5490736 - DNA, 15 bp, Homo sapiens
ggaagctgctccgtg

SEQ ID NO: 5490737 - DNA, 12 bp, Homo sapiens
ggaagctggaag

SEQ ID NO: 5490738 - DNA, 14 bp, Homo sapiens
ggaagctggaagac

SEQ ID NO: 5490739 - DNA, 19 bp, Homo sapiens
ggaagctggcaggagacac

SEQ ID NO: 5490740 - DNA, 20 bp, Homo sapiens
ggaagctggcaggagacact

SEQ ID NO: 5490741 - DNA, 15 bp, Homo sapiens
ggaagctggcctgag

SEQ ID NO: 5490742 - DNA, 13 bp, Homo sapiens
ggaagctgggtga

SEQ ID NO: 5490743 - DNA, 18 bp, Homo sapiens
ggaagctgtactcagagc

SEQ ID NO: 5490744 - DNA, 20 bp, Homo sapiens
ggaagctgtactcagagcag

SEQ ID NO: 5490745 - DNA, 21 bp, Homo sapiens
ggaagctgtactcagagcaga

SEQ ID NO: 5490746 - DNA, 23 bp, Homo sapiens
ggaagctgtactcagagcagagc

SEQ ID NO: 5490747 - DNA, 13 bp, Homo sapiens
ggaagctgtcctg

SEQ ID NO: 5490748 - DNA, 16 bp, Homo sapiens
ggaagctgtcctggag

SEQ ID NO: 5490749 - DNA, 17 bp, Homo sapiens
ggaagctgtgtccttgc

SEQ ID NO: 5490750 - DNA, 14 bp, Homo sapiens
ggaagctgttggtg

SEQ ID NO: 5490751 - DNA, 22 bp, Homo sapiens
ggaagcttaaagtatctacctg

SEQ ID NO: 5490752 - DNA, 16 bp, Homo sapiens
ggaagcttgagcctcc

SEQ ID NO: 5490753 - DNA, 17 bp, Homo sapiens
ggaagcttgagcctccc

SEQ ID NO: 5490754 - DNA, 20 bp, Homo sapiens
ggaagctttggaagcagcaa

SEQ ID NO: 5490755 - DNA, 22 bp, Homo sapiens
ggaagctttggaagcagcaagg

SEQ ID NO: 5490756 - DNA, 21 bp, Homo sapiens
ggaagctttgtcccctgcttc

SEQ ID NO: 5490757 - DNA, 15 bp, Homo sapiens
ggaaggaaaactatg

SEQ ID NO: 5490758 - DNA, 12 bp, Homo sapiens
ggaaggaaacaa

SEQ ID NO: 5490759 - DNA, 19 bp, Homo sapiens
ggaaggaaacaacaaagga

SEQ ID NO: 5490760 - DNA, 19 bp, Homo sapiens
ggaaggaaacatagaaaga

SEQ ID NO: 5490761 - DNA, 19 bp, Homo sapiens
ggaaggaaacccagctctg

SEQ ID NO: 5490762 - DNA, 20 bp, Homo sapiens
ggaaggaaacccagctctgg

SEQ ID NO: 5490763 - DNA, 17 bp, Homo sapiens
ggaaggaaataaacatt

SEQ ID NO: 5490764 - DNA, 14 bp, Homo sapiens
ggaaggaaatctgg

SEQ ID NO: 5490765 - DNA, 15 bp, Homo sapiens
ggaaggaaatctggc

SEQ ID NO: 5490766 - DNA, 20 bp, Homo sapiens
ggaaggaaatctggcccttg

SEQ ID NO: 5490767 - DNA, 15 bp, Homo sapiens
ggaaggaacaaagac

SEQ ID NO: 5490768 - DNA, 22 bp, Homo sapiens
ggaaggaaccccctcaccacct

SEQ ID NO: 5490769 - DNA, 14 bp, Homo sapiens
ggaaggaagcccgc

SEQ ID NO: 5490770 - DNA, 23 bp, Homo sapiens
ggaaggaataaagggagaagagg

SEQ ID NO: 5490771 - DNA, 20 bp, Homo sapiens
ggaaggaatgtcagggccag

SEQ ID NO: 5490772 - DNA, 23 bp, Homo sapiens
ggaaggaatgtcagggccaggtg

SEQ ID NO: 5490773 - DNA, 18 bp, Homo sapiens
ggaaggacaatcccagga

SEQ ID NO: 5490774 - DNA, 11 bp, Homo sapiens
ggaaggacaca

SEQ ID NO: 5490775 - DNA, 22 bp, Homo sapiens
ggaaggacacagcagtattgga

SEQ ID NO: 5490776 - DNA, 15 bp, Homo sapiens
ggaaggacacagtca

SEQ ID NO: 5490777 - DNA, 21 bp, Homo sapiens
ggaaggacacagtcaggggcc

SEQ ID NO: 5490778 - DNA, 16 bp, Homo sapiens
ggaaggacagactggc

SEQ ID NO: 5490779 - DNA, 17 bp, Homo sapiens
ggaaggacaggaagctg

SEQ ID NO: 5490780 - DNA, 20 bp, Homo sapiens
ggaaggacagtccctgctgg

SEQ ID NO: 5490781 - DNA, 22 bp, Homo sapiens
ggaaggacagtccctgctgggg

SEQ ID NO: 5490782 - DNA, 17 bp, Homo sapiens
ggaaggacccctcacca

SEQ ID NO: 5490783 - DNA, 17 bp, Homo sapiens
ggaaggacctgctccca

SEQ ID NO: 5490784 - DNA, 21 bp, Homo sapiens
ggaaggagactcacctctgcc

SEQ ID NO: 5490785 - DNA, 15 bp, Homo sapiens
ggaaggagacttagg

SEQ ID NO: 5490786 - DNA, 12 bp, Homo sapiens
ggaaggagagaa

SEQ ID NO: 5490787 - DNA, 14 bp, Homo sapiens
ggaaggagagaggt

SEQ ID NO: 5490788 - DNA, 16 bp, Homo sapiens
ggaaggagagatgacc

SEQ ID NO: 5490789 - DNA, 15 bp, Homo sapiens
ggaaggagaggaaac

SEQ ID NO: 5490790 - DNA, 12 bp, Homo sapiens
ggaaggagcaca

SEQ ID NO: 5490791 - DNA, 12 bp, Homo sapiens
ggaaggagcagt

SEQ ID NO: 5490792 - DNA, 12 bp, Homo sapiens
ggaaggagccag

SEQ ID NO: 5490793 - DNA, 12 bp, Homo sapiens
ggaaggagcctg

SEQ ID NO: 5490794 - DNA, 14 bp, Homo sapiens
ggaaggagcctgcg

SEQ ID NO: 5490795 - DNA, 12 bp, Homo sapiens
ggaaggagctgc

SEQ ID NO: 5490796 - DNA, 19 bp, Homo sapiens
ggaaggagctgcctggacc

SEQ ID NO: 5490797 - DNA, 23 bp, Homo sapiens
ggaaggagggacttggctgtcct

SEQ ID NO: 5490798 - DNA, 18 bp, Homo sapiens
ggaaggagggagctgctc

SEQ ID NO: 5490799 - DNA, 14 bp, Homo sapiens
ggaaggagggcaca

SEQ ID NO: 5490800 - DNA, 20 bp, Homo sapiens
ggaaggaggggaagctgcag

SEQ ID NO: 5490801 - DNA, 14 bp, Homo sapiens
ggaaggatctgctg

SEQ ID NO: 5490802 - DNA, 18 bp, Homo sapiens
ggaaggatctgctgaggc

SEQ ID NO: 5490803 - DNA, 19 bp, Homo sapiens
ggaaggatctgctgaggcc

SEQ ID NO: 5490804 - DNA, 22 bp, Homo sapiens
ggaaggatctgctgaggcccag

SEQ ID NO: 5490805 - DNA, 20 bp, Homo sapiens
ggaaggatgggatctttctg

SEQ ID NO: 5490806 - DNA, 19 bp, Homo sapiens
ggaaggatgtttagcagtg

SEQ ID NO: 5490807 - DNA, 16 bp, Homo sapiens
ggaaggattctgctgg

SEQ ID NO: 5490808 - DNA, 23 bp, Homo sapiens
ggaaggattgtaaaaaaaaatgc

SEQ ID NO: 5490809 - DNA, 14 bp, Homo sapiens
ggaaggcacctgct

SEQ ID NO: 5490810 - DNA, 17 bp, Homo sapiens
ggaaggcagacagcagg

SEQ ID NO: 5490811 - DNA, 18 bp, Homo sapiens
ggaaggcagacagcaggc

SEQ ID NO: 5490812 - DNA, 22 bp, Homo sapiens
ggaaggcagacagcaggcagcg

SEQ ID NO: 5490813 - DNA, 14 bp, Homo sapiens
ggaaggcagaggct

SEQ ID NO: 5490814 - DNA, 12 bp, Homo sapiens
ggaaggcagctg

SEQ ID NO: 5490815 - DNA, 15 bp, Homo sapiens
ggaaggcaggcaggg

SEQ ID NO: 5490816 - DNA, 17 bp, Homo sapiens
ggaaggcaggcagggct

SEQ ID NO: 5490817 - DNA, 14 bp, Homo sapiens
ggaaggcagggagg

SEQ ID NO: 5490818 - DNA, 20 bp, Homo sapiens
ggaaggcagggcagagggaa

SEQ ID NO: 5490819 - DNA, 13 bp, Homo sapiens
ggaaggccacctc

SEQ ID NO: 5490820 - DNA, 14 bp, Homo sapiens
ggaaggccacctgc

SEQ ID NO: 5490821 - DNA, 23 bp, Homo sapiens
ggaaggccaggaccatgcaggga

SEQ ID NO: 5490822 - DNA, 20 bp, Homo sapiens
ggaaggcccaactggttcag

SEQ ID NO: 5490823 - DNA, 23 bp, Homo sapiens
ggaaggcccaggggtggggccca

SEQ ID NO: 5490824 - DNA, 17 bp, Homo sapiens
ggaaggccccttccctg

SEQ ID NO: 5490825 - DNA, 19 bp, Homo sapiens
ggaaggccgggtgcgaaag

SEQ ID NO: 5490826 - DNA, 15 bp, Homo sapiens
ggaaggcctccctct

SEQ ID NO: 5490827 - DNA, 17 bp, Homo sapiens
ggaaggcctgagcccct

SEQ ID NO: 5490828 - DNA, 16 bp, Homo sapiens
ggaaggcctgagggaa

SEQ ID NO: 5490829 - DNA, 19 bp, Homo sapiens
ggaaggcctgagggaagcc

SEQ ID NO: 5490830 - DNA, 13 bp, Homo sapiens
ggaaggcctgggt

SEQ ID NO: 5490831 - DNA, 14 bp, Homo sapiens
ggaaggcctgggtg

SEQ ID NO: 5490832 - DNA, 16 bp, Homo sapiens
ggaaggccttccactg

SEQ ID NO: 5490833 - DNA, 14 bp, Homo sapiens
ggaaggcctttctt

SEQ ID NO: 5490834 - DNA, 14 bp, Homo sapiens
ggaaggccttttca

SEQ ID NO: 5490835 - DNA, 15 bp, Homo sapiens
ggaaggcgctgggtg

SEQ ID NO: 5490836 - DNA, 21 bp, Homo sapiens
ggaaggctaagcatggcctgg

SEQ ID NO: 5490837 - DNA, 22 bp, Homo sapiens
ggaaggctaagcatggcctgga

SEQ ID NO: 5490838 - DNA, 19 bp, Homo sapiens
ggaaggctacttcggggct

SEQ ID NO: 5490839 - DNA, 12 bp, Homo sapiens
ggaaggctctcg

SEQ ID NO: 5490840 - DNA, 21 bp, Homo sapiens
ggaaggctcttctccccagag

SEQ ID NO: 5490841 - DNA, 17 bp, Homo sapiens
ggaaggctgagaggaga

SEQ ID NO: 5490842 - DNA, 17 bp, Homo sapiens
ggaaggctgctgtgtag

SEQ ID NO: 5490843 - DNA, 13 bp, Homo sapiens
ggaaggctggctg

SEQ ID NO: 5490844 - DNA, 18 bp, Homo sapiens
ggaagggaaaaaaaatgt

SEQ ID NO: 5490845 - DNA, 15 bp, Homo sapiens
ggaagggaaagtttt

SEQ ID NO: 5490846 - DNA, 17 bp, Homo sapiens
ggaagggaaagtttttt

SEQ ID NO: 5490847 - DNA, 13 bp, Homo sapiens
ggaagggaaccag

SEQ ID NO: 5490848 - DNA, 16 bp, Homo sapiens
ggaagggaaccagccc

SEQ ID NO: 5490849 - DNA, 12 bp, Homo sapiens
ggaagggaagcg

SEQ ID NO: 5490850 - DNA, 15 bp, Homo sapiens
ggaagggacacacac

SEQ ID NO: 5490851 - DNA, 16 bp, Homo sapiens
ggaagggaccccagat

SEQ ID NO: 5490852 - DNA, 23 bp, Homo sapiens
ggaagggactctgggctgtgcct

SEQ ID NO: 5490853 - DNA, 18 bp, Homo sapiens
ggaagggactggtccagg

SEQ ID NO: 5490854 - DNA, 23 bp, Homo sapiens
ggaagggactggtccaggcatgg

SEQ ID NO: 5490855 - DNA, 11 bp, Homo sapiens
ggaagggagcc

SEQ ID NO: 5490856 - DNA, 16 bp, Homo sapiens
ggaagggaggcctgag

SEQ ID NO: 5490857 - DNA, 16 bp, Homo sapiens
ggaagggagggagctg

SEQ ID NO: 5490858 - DNA, 19 bp, Homo sapiens
ggaagggagggagctgagg

SEQ ID NO: 5490859 - DNA, 14 bp, Homo sapiens
ggaagggaggggaa

SEQ ID NO: 5490860 - DNA, 21 bp, Homo sapiens
ggaagggcaggaaggagagcc

SEQ ID NO: 5490861 - DNA, 17 bp, Homo sapiens
ggaattgattgtcagcc

SEQ ID NO: 5490862 - DNA, 17 bp, Homo sapiens
ggaattgatttgcattg

SEQ ID NO: 5490863 - DNA, 20 bp, Homo sapiens
ggaattgcatacaactgtgc

SEQ ID NO: 5490864 - DNA, 16 bp, Homo sapiens
ggaattgcgctcaggg

SEQ ID NO: 5490865 - DNA, 17 bp, Homo sapiens
ggaattgcgctcagggg

SEQ ID NO: 5490866 - DNA, 18 bp, Homo sapiens
ggaattgcttctgtgtag

SEQ ID NO: 5490867 - DNA, 17 bp, Homo sapiens
ggaattgtcaaatgatg

SEQ ID NO: 5490868 - DNA, 13 bp, Homo sapiens
ggaattgtggcta

SEQ ID NO: 5490869 - DNA, 16 bp, Homo sapiens
ggaattgtttatacac

SEQ ID NO: 5490870 - DNA, 11 bp, Homo sapiens
ggaatttaaaa

SEQ ID NO: 5490871 - DNA, 15 bp, Homo sapiens
ggaatttaaaattaa

SEQ ID NO: 5490872 - DNA, 13 bp, Homo sapiens
ggaatttataatt

SEQ ID NO: 5490873 - DNA, 12 bp, Homo sapiens
ggaatttcaatg

SEQ ID NO: 5490874 - DNA, 23 bp, Homo sapiens
ggaatttcagctggagatactga

SEQ ID NO: 5490875 - DNA, 14 bp, Homo sapiens
ggaatttcccagga

SEQ ID NO: 5490876 - DNA, 16 bp, Homo sapiens
ggaatttcccaggacc

SEQ ID NO: 5490877 - DNA, 19 bp, Homo sapiens
ggaatttcccaggaccctg

SEQ ID NO: 5490878 - DNA, 12 bp, Homo sapiens
ggaatttgaagc

SEQ ID NO: 5490879 - DNA, 19 bp, Homo sapiens
ggaatttgattgctttgct

SEQ ID NO: 5490880 - DNA, 16 bp, Homo sapiens
ggaatttgcctgctgg

SEQ ID NO: 5490881 - DNA, 19 bp, Homo sapiens
ggaatttggaaatctcttt

SEQ ID NO: 5490882 - DNA, 12 bp, Homo sapiens
ggaatttgtaag

SEQ ID NO: 5490883 - DNA, 19 bp, Homo sapiens
ggaatttgtaagtttatgt

SEQ ID NO: 5490884 - DNA, 13 bp, Homo sapiens
ggaatttgtactt

SEQ ID NO: 5490885 - DNA, 21 bp, Homo sapiens
ggaatttgttcaagttttggg

SEQ ID NO: 5490886 - DNA, 22 bp, Homo sapiens
ggaattttaacttttgggattt

SEQ ID NO: 5490887 - DNA, 11 bp, Homo sapiens
ggaattttatt

SEQ ID NO: 5490888 - DNA, 19 bp, Homo sapiens
ggaattttgtaaaaagaaa

SEQ ID NO: 5490889 - DNA, 20 bp, Homo sapiens
ggaattttgtaaaaagaaat

SEQ ID NO: 5490890 - DNA, 18 bp, Homo sapiens
ggaatttttaaaataaac

SEQ ID NO: 5490891 - DNA, 17 bp, Homo sapiens
ggacaaaacatagctgg

SEQ ID NO: 5490892 - DNA, 20 bp, Homo sapiens
ggacaaaaccccccagatat

SEQ ID NO: 5490893 - DNA, 14 bp, Homo sapiens
ggacaaaacttctt

SEQ ID NO: 5490894 - DNA, 14 bp, Homo sapiens
ggacaaaagggcca

SEQ ID NO: 5490895 - DNA, 19 bp, Homo sapiens
ggacaaaataaagtgtgtg

SEQ ID NO: 5490896 - DNA, 20 bp, Homo sapiens
ggacaaaataaagtgtgtgt

SEQ ID NO: 5490897 - DNA, 21 bp, Homo sapiens
ggacaaaataaagtgtgtgtg

SEQ ID NO: 5490898 - DNA, 17 bp, Homo sapiens
ggacaaaatggaatact

SEQ ID NO: 5490899 - DNA, 21 bp, Homo sapiens
ggacaaacagtgaatttaagc

SEQ ID NO: 5490900 - DNA, 15 bp, Homo sapiens
ggacaaacccttctt

SEQ ID NO: 5490901 - DNA, 13 bp, Homo sapiens
ggacaaacctaga

SEQ ID NO: 5490902 - DNA, 13 bp, Homo sapiens
ggacaaaggagcc

SEQ ID NO: 5490903 - DNA, 15 bp, Homo sapiens
ggacaaaggagcctg

SEQ ID NO: 5490904 - DNA, 16 bp, Homo sapiens
ggacaaaggagcctgt

SEQ ID NO: 5490905 - DNA, 17 bp, Homo sapiens
ggacaaaggagcctgtg

SEQ ID NO: 5490906 - DNA, 15 bp, Homo sapiens
ggacaaaggcctggc

SEQ ID NO: 5490907 - DNA, 17 bp, Homo sapiens
ggacaaagggagggagc

SEQ ID NO: 5490908 - DNA, 18 bp, Homo sapiens
ggacaaagggagggagca

SEQ ID NO: 5490909 - DNA, 15 bp, Homo sapiens
ggacaaagtatttga

SEQ ID NO: 5490910 - DNA, 15 bp, Homo sapiens
ggacaaagtctccag

SEQ ID NO: 5490911 - DNA, 19 bp, Homo sapiens
ggacaaagtctccagccca

SEQ ID NO: 5490912 - DNA, 20 bp, Homo sapiens
ggacaaagtctccagcccac

SEQ ID NO: 5490913 - DNA, 21 bp, Homo sapiens
ggacaaagtctccagcccacg

SEQ ID NO: 5490914 - DNA, 18 bp, Homo sapiens
ggacaaagtgccaaagaa

SEQ ID NO: 5490915 - DNA, 13 bp, Homo sapiens
ggacaaattagca

SEQ ID NO: 5490916 - DNA, 22 bp, Homo sapiens
ggacaaattagcatgcaagctt

SEQ ID NO: 5490917 - DNA, 13 bp, Homo sapiens
ggacaacactgat

SEQ ID NO: 5490918 - DNA, 16 bp, Homo sapiens
ggacaacagtgctttg

SEQ ID NO: 5490919 - DNA, 20 bp, Homo sapiens
ggacaacattttactactga

SEQ ID NO: 5490920 - DNA, 18 bp, Homo sapiens
ggacaaccagaaggccct

SEQ ID NO: 5490921 - DNA, 22 bp, Homo sapiens
ggacaaccagaaggcccttaac

SEQ ID NO: 5490922 - DNA, 23 bp, Homo sapiens
ggacaaccatgcaaattgtgaaa

SEQ ID NO: 5490923 - DNA, 14 bp, Homo sapiens
ggacaacctgcccc

SEQ ID NO: 5490924 - DNA, 17 bp, Homo sapiens
ggacaaccttggcttgg

SEQ ID NO: 5490925 - DNA, 17 bp, Homo sapiens
ggacaacgaggaagccc

SEQ ID NO: 5490926 - DNA, 13 bp, Homo sapiens
ggacaactgcggt

SEQ ID NO: 5490927 - DNA, 21 bp, Homo sapiens
ggacaactgctcccacctcct

SEQ ID NO: 5490928 - DNA, 17 bp, Homo sapiens
ggacaacttatttaaaa

SEQ ID NO: 5490929 - DNA, 13 bp, Homo sapiens
ggacaagagcagg

SEQ ID NO: 5490930 - DNA, 22 bp, Homo sapiens
ggacaagagggttcacacagcc

SEQ ID NO: 5490931 - DNA, 13 bp, Homo sapiens
ggacaagcagagg

SEQ ID NO: 5490932 - DNA, 16 bp, Homo sapiens
ggacaagcaggccgcc

SEQ ID NO: 5490933 - DNA, 13 bp, Homo sapiens
ggacaagcagtgg

SEQ ID NO: 5490934 - DNA, 21 bp, Homo sapiens
ggacaagccaacttgtaaata

SEQ ID NO: 5490935 - DNA, 23 bp, Homo sapiens
ggacaagccacagcccctgcctg

SEQ ID NO: 5490936 - DNA, 15 bp, Homo sapiens
ggacaagccaggccc

SEQ ID NO: 5490937 - DNA, 13 bp, Homo sapiens
ggacaagcccagg

SEQ ID NO: 5490938 - DNA, 19 bp, Homo sapiens
ggacaaggactagggtcct

SEQ ID NO: 5490939 - DNA, 13 bp, Homo sapiens
ggacaaggagctg

SEQ ID NO: 5490940 - DNA, 20 bp, Homo sapiens
ggacaaggaggtctgtgcca

SEQ ID NO: 5490941 - DNA, 23 bp, Homo sapiens
ggacaaggatgatctaggaagac

SEQ ID NO: 5490942 - DNA, 20 bp, Homo sapiens
ggacaaggctgtgccaggct

SEQ ID NO: 5490943 - DNA, 23 bp, Homo sapiens
ggacaaggctgtgccaggctggg

SEQ ID NO: 5490944 - DNA, 14 bp, Homo sapiens
ggacaagggaggca

SEQ ID NO: 5490945 - DNA, 21 bp, Homo sapiens
ggacaaggggtggaagggcag

SEQ ID NO: 5490946 - DNA, 18 bp, Homo sapiens
ggacaaggtgcaggcagg

SEQ ID NO: 5490947 - DNA, 17 bp, Homo sapiens
ggacaagtcatggacat

SEQ ID NO: 5490948 - DNA, 20 bp, Homo sapiens
ggacaagtctttctcctctt

SEQ ID NO: 5490949 - DNA, 12 bp, Homo sapiens
ggacaataaacc

SEQ ID NO: 5490950 - DNA, 19 bp, Homo sapiens
ggacaataaacctccgcca

SEQ ID NO: 5490951 - DNA, 16 bp, Homo sapiens
ggacaatcagtcccct

SEQ ID NO: 5490952 - DNA, 18 bp, Homo sapiens
ggacaatcagtcccctcc

SEQ ID NO: 5490953 - DNA, 13 bp, Homo sapiens
ggacaatgccact

SEQ ID NO: 5490954 - DNA, 14 bp, Homo sapiens
ggacaatgccacta

SEQ ID NO: 5490955 - DNA, 16 bp, Homo sapiens
ggacaatggaccggag

SEQ ID NO: 5490956 - DNA, 22 bp, Homo sapiens
ggacacaaaactccgcccccag

SEQ ID NO: 5490957 - DNA, 13 bp, Homo sapiens
ggacacaaatttt

SEQ ID NO: 5490958 - DNA, 22 bp, Homo sapiens
ggacacaaattttcaagtttac

SEQ ID NO: 5490959 - DNA, 21 bp, Homo sapiens
ggacacaagcggccctgacac

SEQ ID NO: 5490960 - DNA, 16 bp, Homo sapiens
ggacacaaggcacggc

SEQ ID NO: 5490961 - DNA, 23 bp, Homo sapiens
ggacacaataggtctttctctca

SEQ ID NO: 5490962 - DNA, 13 bp, Homo sapiens
ggacacacacaca

SEQ ID NO: 5490963 - DNA, 13 bp, Homo sapiens
ggacacacactca

SEQ ID NO: 5490964 - DNA, 13 bp, Homo sapiens
ggacacacagcct

SEQ ID NO: 5490965 - DNA, 14 bp, Homo sapiens
ggacacacagccta

SEQ ID NO: 5490966 - DNA, 19 bp, Homo sapiens
ggacacacagtgacaaaag

SEQ ID NO: 5490967 - DNA, 15 bp, Homo sapiens
ggacacacattctgc

SEQ ID NO: 5490968 - DNA, 11 bp, Homo sapiens
ggacacactgt

SEQ ID NO: 5490969 - DNA, 21 bp, Homo sapiens
ggacacagaagtccctaggag

SEQ ID NO: 5490970 - DNA, 13 bp, Homo sapiens
ggacacagaccca

SEQ ID NO: 5490971 - DNA, 14 bp, Homo sapiens
ggacacagaccggc

SEQ ID NO: 5490972 - DNA, 19 bp, Homo sapiens
ggacacagatcccactgga

SEQ ID NO: 5490973 - DNA, 22 bp, Homo sapiens
ggacacagatcccactggaaga

SEQ ID NO: 5490974 - DNA, 13 bp, Homo sapiens
ggacacagcagta

SEQ ID NO: 5490975 - DNA, 12 bp, Homo sapiens
ggacacagctct

SEQ ID NO: 5490976 - DNA, 13 bp, Homo sapiens
ggacacagctctt

SEQ ID NO: 5490977 - DNA, 16 bp, Homo sapiens
ggacacagctcttcat

SEQ ID NO: 5490978 - DNA, 21 bp, Homo sapiens
ggacacagctcttctccaggc

SEQ ID NO: 5490979 - DNA, 19 bp, Homo sapiens
ggacacaggagaccacccc

SEQ ID NO: 5490980 - DNA, 21 bp, Homo sapiens
ggacacaggatcctggcctga

SEQ ID NO: 5490981 - DNA, 18 bp, Homo sapiens
ggacacaggcctgctctc

SEQ ID NO: 5490982 - DNA, 17 bp, Homo sapiens
ggacacagtcagggcgg

SEQ ID NO: 5490983 - DNA, 15 bp, Homo sapiens
ggacacagtggagcc

SEQ ID NO: 5490984 - DNA, 21 bp, Homo sapiens
ggacacagtgtgtgacgcaga

SEQ ID NO: 5490985 - DNA, 16 bp, Homo sapiens
ggacacagttcctggg

SEQ ID NO: 5490986 - DNA, 19 bp, Homo sapiens
ggacacagttcctgggaac

SEQ ID NO: 5490987 - DNA, 21 bp, Homo sapiens
ggacacagttcctgggaacat

SEQ ID NO: 5490988 - DNA, 20 bp, Homo sapiens
ggacacatcccggcctcttc

SEQ ID NO: 5490989 - DNA, 22 bp, Homo sapiens
ggacacatcccggcctcttcca

SEQ ID NO: 5490990 - DNA, 18 bp, Homo sapiens
ggacacatgaaaggcatc

SEQ ID NO: 5490991 - DNA, 15 bp, Homo sapiens
ggacacatgcccctc

SEQ ID NO: 5490992 - DNA, 12 bp, Homo sapiens
ggacacatgtcc

SEQ ID NO: 5490993 - DNA, 19 bp, Homo sapiens
ggacaccacacccagcctc

SEQ ID NO: 5490994 - DNA, 20 bp, Homo sapiens
ggacaccacacccagcctca

SEQ ID NO: 5490995 - DNA, 18 bp, Homo sapiens
ggacaccactgagctctg

SEQ ID NO: 5490996 - DNA, 12 bp, Homo sapiens
ggacaccagagc

SEQ ID NO: 5490997 - DNA, 13 bp, Homo sapiens
ggacaccagagct

SEQ ID NO: 5490998 - DNA, 13 bp, Homo sapiens
ggacaccagccag

SEQ ID NO: 5490999 - DNA, 16 bp, Homo sapiens
ggacaccagccaggct

SEQ ID NO: 5491000 - DNA, 18 bp, Homo sapiens
ggacaccagccaggctct

SEQ ID NO: 5491001 - DNA, 18 bp, Homo sapiens
ggacaccagtccaggtag

SEQ ID NO: 5491002 - DNA, 15 bp, Homo sapiens
ggacacccagggtct

SEQ ID NO: 5491003 - DNA, 15 bp, Homo sapiens
ggacaccccctcgct

SEQ ID NO: 5491004 - DNA, 18 bp, Homo sapiens
ggacacccctacacacac

SEQ ID NO: 5491005 - DNA, 13 bp, Homo sapiens
ggacacccctgct

SEQ ID NO: 5491006 - DNA, 20 bp, Homo sapiens
ggacaccccttatccaggac

SEQ ID NO: 5491007 - DNA, 15 bp, Homo sapiens
ggacaccctcctgcc

SEQ ID NO: 5491008 - DNA, 14 bp, Homo sapiens
ggacaccgtggcct

SEQ ID NO: 5491009 - DNA, 14 bp, Homo sapiens
ggacacctacagca

SEQ ID NO: 5491010 - DNA, 21 bp, Homo sapiens
ggacacctcaaatacatacct

SEQ ID NO: 5491011 - DNA, 18 bp, Homo sapiens
ggacacctcccaggggac

SEQ ID NO: 5491012 - DNA, 10 bp, Homo sapiens
ggacacctgc

SEQ ID NO: 5491013 - DNA, 14 bp, Homo sapiens
ggacacctgcccca

SEQ ID NO: 5491014 - DNA, 16 bp, Homo sapiens
ggacacctgccccagc

SEQ ID NO: 5491015 - DNA, 17 bp, Homo sapiens
ggacacctgccccagcg

SEQ ID NO: 5491016 - DNA, 13 bp, Homo sapiens
ggacacctgccct

SEQ ID NO: 5491017 - DNA, 15 bp, Homo sapiens
ggacacctgccctgc

SEQ ID NO: 5491018 - DNA, 13 bp, Homo sapiens
ggacacctgggag

SEQ ID NO: 5491019 - DNA, 14 bp, Homo sapiens
ggacacctgggaga

SEQ ID NO: 5491020 - DNA, 17 bp, Homo sapiens
ggacacctgggccgggc

SEQ ID NO: 5491021 - DNA, 19 bp, Homo sapiens
ggacacctgtactggagag

SEQ ID NO: 5491022 - DNA, 15 bp, Homo sapiens
ggacacgaaggctgc

SEQ ID NO: 5491023 - DNA, 16 bp, Homo sapiens
ggacacgctcagtggg

SEQ ID NO: 5491024 - DNA, 22 bp, Homo sapiens
ggacacgctcagtggggcagag

SEQ ID NO: 5491025 - DNA, 16 bp, Homo sapiens
ggacacggcctctggg

SEQ ID NO: 5491026 - DNA, 21 bp, Homo sapiens
ggacacggcctctggggagac

SEQ ID NO: 5491027 - DNA, 21 bp, Homo sapiens
ggacacgggcagcctggctcc

SEQ ID NO: 5491028 - DNA, 21 bp, Homo sapiens
ggacactaagaggaggcagga

SEQ ID NO: 5491029 - DNA, 15 bp, Homo sapiens
ggacactacaaacat

SEQ ID NO: 5491030 - DNA, 19 bp, Homo sapiens
ggacactacacccagcaat

SEQ ID NO: 5491031 - DNA, 20 bp, Homo sapiens
ggacactacacccagcaata

SEQ ID NO: 5491032 - DNA, 21 bp, Homo sapiens
ggacactacacccagcaatag

SEQ ID NO: 5491033 - DNA, 22 bp, Homo sapiens
ggacactcaaaagctgggcagg

SEQ ID NO: 5491034 - DNA, 14 bp, Homo sapiens
ggacactccagtgc

SEQ ID NO: 5491035 - DNA, 18 bp, Homo sapiens
ggacactccagtgccagc

SEQ ID NO: 5491036 - DNA, 14 bp, Homo sapiens
ggacactcctagag

SEQ ID NO: 5491037 - DNA, 15 bp, Homo sapiens
ggacactcctagaga

SEQ ID NO: 5491038 - DNA, 19 bp, Homo sapiens
ggacactcgtcaccccagc

SEQ ID NO: 5491039 - DNA, 17 bp, Homo sapiens
ggacactgacagccttt

SEQ ID NO: 5491040 - DNA, 21 bp, Homo sapiens
ggacactgatgggtcctgctg

SEQ ID NO: 5491041 - DNA, 21 bp, Homo sapiens
ggacagtcacctcatggaatt

SEQ ID NO: 5491042 - DNA, 15 bp, Homo sapiens
ggacagtcagctctt

SEQ ID NO: 5491043 - DNA, 12 bp, Homo sapiens
ggacagtccctg

SEQ ID NO: 5491044 - DNA, 14 bp, Homo sapiens
ggacagtccctgct

SEQ ID NO: 5491045 - DNA, 19 bp, Homo sapiens
ggacagtccctgctgggga

SEQ ID NO: 5491046 - DNA, 18 bp, Homo sapiens
ggacagtcggaaaagcgt

SEQ ID NO: 5491047 - DNA, 19 bp, Homo sapiens
ggacagtctgctctagatg

SEQ ID NO: 5491048 - DNA, 14 bp, Homo sapiens
ggacagtctggagg

SEQ ID NO: 5491049 - DNA, 15 bp, Homo sapiens
ggacagtctggaggt

SEQ ID NO: 5491050 - DNA, 18 bp, Homo sapiens
ggacagtctggaggtccc

SEQ ID NO: 5491051 - DNA, 17 bp, Homo sapiens
ggacagtgataggccca

SEQ ID NO: 5491052 - DNA, 16 bp, Homo sapiens
ggacagtgctgcagct

SEQ ID NO: 5491053 - DNA, 17 bp, Homo sapiens
ggacagtgcttcagcct

SEQ ID NO: 5491054 - DNA, 19 bp, Homo sapiens
ggacagtgcttcagcctga

SEQ ID NO: 5491055 - DNA, 22 bp, Homo sapiens
ggacagtggagtgcaaaaggct

SEQ ID NO: 5491056 - DNA, 15 bp, Homo sapiens
ggacagtggatgccc

SEQ ID NO: 5491057 - DNA, 12 bp, Homo sapiens
ggacagtggcag

SEQ ID NO: 5491058 - DNA, 13 bp, Homo sapiens
ggacagtggcagg

SEQ ID NO: 5491059 - DNA, 22 bp, Homo sapiens
ggacagttagcatttaccaaca

SEQ ID NO: 5491060 - DNA, 17 bp, Homo sapiens
ggacagttcacaccctg

SEQ ID NO: 5491061 - DNA, 18 bp, Homo sapiens
ggacagttcacaccctgc

SEQ ID NO: 5491062 - DNA, 14 bp, Homo sapiens
ggacagttcagaga

SEQ ID NO: 5491063 - DNA, 21 bp, Homo sapiens
ggacagttgatggagccccag

SEQ ID NO: 5491064 - DNA, 22 bp, Homo sapiens
ggacagttgatggagccccagg

SEQ ID NO: 5491065 - DNA, 18 bp, Homo sapiens
ggacagttggcagagaag

SEQ ID NO: 5491066 - DNA, 23 bp, Homo sapiens
ggacagttggcagagaaggcctc

SEQ ID NO: 5491067 - DNA, 19 bp, Homo sapiens
ggacagttgtttggagaac

SEQ ID NO: 5491068 - DNA, 19 bp, Homo sapiens
ggacagtttatcatgaagc

SEQ ID NO: 5491069 - DNA, 20 bp, Homo sapiens
ggacagtttatcatgaagcc

SEQ ID NO: 5491070 - DNA, 22 bp, Homo sapiens
ggacagtttatcatgaagcctg

SEQ ID NO: 5491071 - DNA, 19 bp, Homo sapiens
ggacagtttatcctgtctg

SEQ ID NO: 5491072 - DNA, 15 bp, Homo sapiens
ggacagtttgtttcc

SEQ ID NO: 5491073 - DNA, 16 bp, Homo sapiens
ggacataaagagagcc

SEQ ID NO: 5491074 - DNA, 18 bp, Homo sapiens
ggacataagataaaatga

SEQ ID NO: 5491075 - DNA, 12 bp, Homo sapiens
ggacataatttc

SEQ ID NO: 5491076 - DNA, 23 bp, Homo sapiens
ggacatagaggtatattggaaga

SEQ ID NO: 5491077 - DNA, 18 bp, Homo sapiens
ggacatagcgaatacaaa

SEQ ID NO: 5491078 - DNA, 12 bp, Homo sapiens
ggacatcacctg

SEQ ID NO: 5491079 - DNA, 19 bp, Homo sapiens
ggacatcgtaggcagccac

SEQ ID NO: 5491080 - DNA, 14 bp, Homo sapiens
ggacatctctctgg

SEQ ID NO: 5491081 - DNA, 18 bp, Homo sapiens
ggacatctctctggcttc

SEQ ID NO: 5491082 - DNA, 20 bp, Homo sapiens
ggacatctctctggcttctg

SEQ ID NO: 5491083 - DNA, 22 bp, Homo sapiens
ggacatctgaccccaagggggc

SEQ ID NO: 5491084 - DNA, 20 bp, Homo sapiens
ggacatgagagtagggccct

SEQ ID NO: 5491085 - DNA, 20 bp, Homo sapiens
ggacatgagatcagggcctg

SEQ ID NO: 5491086 - DNA, 21 bp, Homo sapiens
ggacatgcacccgcatgtaca

SEQ ID NO: 5491087 - DNA, 23 bp, Homo sapiens
ggacatgcacccgcatgtacaaa

SEQ ID NO: 5491088 - DNA, 22 bp, Homo sapiens
ggacatgcataaaaattaaatg

SEQ ID NO: 5491089 - DNA, 13 bp, Homo sapiens
ggacatgcctgtc

SEQ ID NO: 5491090 - DNA, 16 bp, Homo sapiens
ggacatgcgtgtgtca

SEQ ID NO: 5491091 - DNA, 17 bp, Homo sapiens
ggacatgcgtgtgtcag

SEQ ID NO: 5491092 - DNA, 17 bp, Homo sapiens
ggacatgctaaataact

SEQ ID NO: 5491093 - DNA, 21 bp, Homo sapiens
ggacatgctcacctctagcct

SEQ ID NO: 5491094 - DNA, 13 bp, Homo sapiens
ggacatgcttagc

SEQ ID NO: 5491095 - DNA, 14 bp, Homo sapiens
ggacatgcttagca

SEQ ID NO: 5491096 - DNA, 15 bp, Homo sapiens
ggacatggagagaga

SEQ ID NO: 5491097 - DNA, 17 bp, Homo sapiens
ggacatggcacaggccc

SEQ ID NO: 5491098 - DNA, 17 bp, Homo sapiens
ggacatggggcaagcca

SEQ ID NO: 5491099 - DNA, 21 bp, Homo sapiens
ggacatggggcaagccagggc

SEQ ID NO: 5491100 - DNA, 22 bp, Homo sapiens
ggacatggggcaagccagggcc

SEQ ID NO: 5491101 - DNA, 23 bp, Homo sapiens
ggacatggggcaagccagggccc

SEQ ID NO: 5491102 - DNA, 21 bp, Homo sapiens
ggacatggggcatagaaactg

SEQ ID NO: 5491103 - DNA, 22 bp, Homo sapiens
ggacatggggcatagaaactga

SEQ ID NO: 5491104 - DNA, 17 bp, Homo sapiens
ggacatggtctgtcctg

SEQ ID NO: 5491105 - DNA, 22 bp, Homo sapiens
ggacatggtgtgccacaggctg

SEQ ID NO: 5491106 - DNA, 19 bp, Homo sapiens
ggacatggtgtttaaaatt

SEQ ID NO: 5491107 - DNA, 22 bp, Homo sapiens
ggacatggttgggggaatgcac

SEQ ID NO: 5491108 - DNA, 16 bp, Homo sapiens
ggacatgttttgataa

SEQ ID NO: 5491109 - DNA, 14 bp, Homo sapiens
ggacattcactgct

SEQ ID NO: 5491110 - DNA, 17 bp, Homo sapiens
ggacattcactgctgat

SEQ ID NO: 5491111 - DNA, 16 bp, Homo sapiens
ggacattccaagacag

SEQ ID NO: 5491112 - DNA, 17 bp, Homo sapiens
ggacattccaagacagt

SEQ ID NO: 5491113 - DNA, 15 bp, Homo sapiens
ggacattctaatgca

SEQ ID NO: 5491114 - DNA, 22 bp, Homo sapiens
ggacattctctttgataacaaa

SEQ ID NO: 5491115 - DNA, 18 bp, Homo sapiens
ggacattgaaagtgaaat

SEQ ID NO: 5491116 - DNA, 11 bp, Homo sapiens
ggacattgaga

SEQ ID NO: 5491117 - DNA, 20 bp, Homo sapiens
ggacattgcggacagccacg

SEQ ID NO: 5491118 - DNA, 18 bp, Homo sapiens
ggacattgtatgcaggga

SEQ ID NO: 5491119 - DNA, 20 bp, Homo sapiens
ggacattgtatgcagggagc

SEQ ID NO: 5491120 - DNA, 22 bp, Homo sapiens
ggacattgttctttccggccaa

SEQ ID NO: 5491121 - DNA, 19 bp, Homo sapiens
ggacatttcatataaatgg

SEQ ID NO: 5491122 - DNA, 14 bp, Homo sapiens
ggacatttctctaa

SEQ ID NO: 5491123 - DNA, 13 bp, Homo sapiens
ggacattttatgt

SEQ ID NO: 5491124 - DNA, 18 bp, Homo sapiens
ggacattttctggattct

SEQ ID NO: 5491125 - DNA, 22 bp, Homo sapiens
ggacatttttgtctgtcctaca

SEQ ID NO: 5491126 - DNA, 15 bp, Homo sapiens
ggacattttttcagt

SEQ ID NO: 5491127 - DNA, 20 bp, Homo sapiens
ggaccaaaaaacctcactgg

SEQ ID NO: 5491128 - DNA, 23 bp, Homo sapiens
ggaccaaaaaccagtattgtaca

SEQ ID NO: 5491129 - DNA, 22 bp, Homo sapiens
ggaccaaacccttagcagccca

SEQ ID NO: 5491130 - DNA, 20 bp, Homo sapiens
ggaccaaagccacctgctgc

SEQ ID NO: 5491131 - DNA, 17 bp, Homo sapiens
ggaccaaagggggagtc

SEQ ID NO: 5491132 - DNA, 16 bp, Homo sapiens
ggaccaaatagccacc

SEQ ID NO: 5491133 - DNA, 20 bp, Homo sapiens
ggaccaaattgcttctagga

SEQ ID NO: 5491134 - DNA, 19 bp, Homo sapiens
ggaccaacccatgccctgc

SEQ ID NO: 5491135 - DNA, 20 bp, Homo sapiens
ggaccaaccctggggaagga

SEQ ID NO: 5491136 - DNA, 18 bp, Homo sapiens
ggaccaaccctgtttcct

SEQ ID NO: 5491137 - DNA, 22 bp, Homo sapiens
ggaccaaccctgtttcctgagt

SEQ ID NO: 5491138 - DNA, 15 bp, Homo sapiens
ggaccaacctgacct

SEQ ID NO: 5491139 - DNA, 21 bp, Homo sapiens
ggaccaacctgctctgtcccc

SEQ ID NO: 5491140 - DNA, 18 bp, Homo sapiens
ggaccaagcgaccaagga

SEQ ID NO: 5491141 - DNA, 20 bp, Homo sapiens
ggaccaagcgaccaaggatg

SEQ ID NO: 5491142 - DNA, 20 bp, Homo sapiens
ggaccaagcttaaggagagg

SEQ ID NO: 5491143 - DNA, 17 bp, Homo sapiens
ggaccaaggagatgaag

SEQ ID NO: 5491144 - DNA, 18 bp, Homo sapiens
ggaccaaggagatgggga

SEQ ID NO: 5491145 - DNA, 17 bp, Homo sapiens
ggaccaaggcaaggcag

SEQ ID NO: 5491146 - DNA, 22 bp, Homo sapiens
ggaccaaggcaaggcaggtgcc

SEQ ID NO: 5491147 - DNA, 19 bp, Homo sapiens
ggaccaagggcagaggggt

SEQ ID NO: 5491148 - DNA, 23 bp, Homo sapiens
ggaccaatgccttaattaaagaa

SEQ ID NO: 5491149 - DNA, 17 bp, Homo sapiens
ggaccaatgtccttgtg

SEQ ID NO: 5491150 - DNA, 16 bp, Homo sapiens
ggaccaattctggaca

SEQ ID NO: 5491151 - DNA, 22 bp, Homo sapiens
ggaccacaaaaatgaaagcatg

SEQ ID NO: 5491152 - DNA, 13 bp, Homo sapiens
ggaccacacctcc

SEQ ID NO: 5491153 - DNA, 14 bp, Homo sapiens
ggaccacagaggct

SEQ ID NO: 5491154 - DNA, 18 bp, Homo sapiens
ggaccacaggtgcccgcc

SEQ ID NO: 5491155 - DNA, 16 bp, Homo sapiens
ggaccacatccacccc

SEQ ID NO: 5491156 - DNA, 18 bp, Homo sapiens
ggaccacatccaccccag

SEQ ID NO: 5491157 - DNA, 19 bp, Homo sapiens
ggaccacatccaccccagc

SEQ ID NO: 5491158 - DNA, 20 bp, Homo sapiens
ggaccacatccaccccagcc

SEQ ID NO: 5491159 - DNA, 21 bp, Homo sapiens
ggaccacatccaccccagccc

SEQ ID NO: 5491160 - DNA, 12 bp, Homo sapiens
ggaccacatgcc

SEQ ID NO: 5491161 - DNA, 20 bp, Homo sapiens
ggaccacatgccactgcctg

SEQ ID NO: 5491162 - DNA, 17 bp, Homo sapiens
ggaccaccaatggattg

SEQ ID NO: 5491163 - DNA, 16 bp, Homo sapiens
ggaccaccagcaggca

SEQ ID NO: 5491164 - DNA, 21 bp, Homo sapiens
ggaccaccagcaggcaggtgg

SEQ ID NO: 5491165 - DNA, 13 bp, Homo sapiens
ggaccaccagccc

SEQ ID NO: 5491166 - DNA, 15 bp, Homo sapiens
ggaccaccagcccca

SEQ ID NO: 5491167 - DNA, 22 bp, Homo sapiens
ggaccaccctcactggctctcc

SEQ ID NO: 5491168 - DNA, 22 bp, Homo sapiens
ggaccaccctccctgactggcc

SEQ ID NO: 5491169 - DNA, 11 bp, Homo sapiens
ggaccaccctg

SEQ ID NO: 5491170 - DNA, 17 bp, Homo sapiens
ggaccaccctgccaagg

SEQ ID NO: 5491171 - DNA, 20 bp, Homo sapiens
ggaccacctcctctgccagc

SEQ ID NO: 5491172 - DNA, 23 bp, Homo sapiens
ggaccacctcctctgccagcagg

SEQ ID NO: 5491173 - DNA, 18 bp, Homo sapiens
ggaccacgccgccctcca

SEQ ID NO: 5491174 - DNA, 18 bp, Homo sapiens
ggaccacgtctccctggc

SEQ ID NO: 5491175 - DNA, 22 bp, Homo sapiens
ggaccactagctaagcaagcca

SEQ ID NO: 5491176 - DNA, 23 bp, Homo sapiens
ggaccactagctaagcaagccag

SEQ ID NO: 5491177 - DNA, 16 bp, Homo sapiens
ggaccactcagcccct

SEQ ID NO: 5491178 - DNA, 17 bp, Homo sapiens
ggaccactcgaggcctg

SEQ ID NO: 5491179 - DNA, 22 bp, Homo sapiens
ggaccactcttctctccaagga

SEQ ID NO: 5491180 - DNA, 13 bp, Homo sapiens
ggaccactgggcc

SEQ ID NO: 5491181 - DNA, 18 bp, Homo sapiens
ggaccagaagctccccca

SEQ ID NO: 5491182 - DNA, 21 bp, Homo sapiens
ggaccagaagctcccccagca

SEQ ID NO: 5491183 - DNA, 17 bp, Homo sapiens
ggaccagagccagatgc

SEQ ID NO: 5491184 - DNA, 18 bp, Homo sapiens
ggaccagagccagatgca

SEQ ID NO: 5491185 - DNA, 12 bp, Homo sapiens
ggaccagaggag

SEQ ID NO: 5491186 - DNA, 14 bp, Homo sapiens
ggaccagatgctga

SEQ ID NO: 5491187 - DNA, 12 bp, Homo sapiens
ggaccagcccac

SEQ ID NO: 5491188 - DNA, 20 bp, Homo sapiens
ggaccagcccattggccgag

SEQ ID NO: 5491189 - DNA, 15 bp, Homo sapiens
ggaccagcctggccc

SEQ ID NO: 5491190 - DNA, 17 bp, Homo sapiens
ggaccagcctgttggac

SEQ ID NO: 5491191 - DNA, 22 bp, Homo sapiens
ggaccagctcaggacagatgcc

SEQ ID NO: 5491192 - DNA, 12 bp, Homo sapiens
ggaccagctccc

SEQ ID NO: 5491193 - DNA, 15 bp, Homo sapiens
ggaccagctggcctg

SEQ ID NO: 5491194 - DNA, 17 bp, Homo sapiens
ggaccagctggcctggg

SEQ ID NO: 5491195 - DNA, 14 bp, Homo sapiens
ggaccagctggggg

SEQ ID NO: 5491196 - DNA, 17 bp, Homo sapiens
ggaccagctggggggca

SEQ ID NO: 5491197 - DNA, 17 bp, Homo sapiens
ggaccagcttggctcag

SEQ ID NO: 5491198 - DNA, 18 bp, Homo sapiens
ggaccagcttggctcagg

SEQ ID NO: 5491199 - DNA, 15 bp, Homo sapiens
ggaccagcttttccc

SEQ ID NO: 5491200 - DNA, 14 bp, Homo sapiens
ggaccaggacagga

SEQ ID NO: 5491201 - DNA, 17 bp, Homo sapiens
ggaccaggacaggacca

SEQ ID NO: 5491202 - DNA, 14 bp, Homo sapiens
ggaccaggacccag

SEQ ID NO: 5491203 - DNA, 16 bp, Homo sapiens
ggaccaggacccaggg

SEQ ID NO: 5491204 - DNA, 19 bp, Homo sapiens
ggaccaggacccagggaga

SEQ ID NO: 5491205 - DNA, 11 bp, Homo sapiens
ggaccaggact

SEQ ID NO: 5491206 - DNA, 17 bp, Homo sapiens
ggaccaggactccctcc

SEQ ID NO: 5491207 - DNA, 12 bp, Homo sapiens
ggaccaggagcc

SEQ ID NO: 5491208 - DNA, 15 bp, Homo sapiens
ggaccaggagccagg

SEQ ID NO: 5491209 - DNA, 12 bp, Homo sapiens
ggaccaggagct

SEQ ID NO: 5491210 - DNA, 11 bp, Homo sapiens
ggaccaggagt

SEQ ID NO: 5491211 - DNA, 20 bp, Homo sapiens
ggaccaggagtgggtgggga

SEQ ID NO: 5491212 - DNA, 13 bp, Homo sapiens
ggaccaggcaatg

SEQ ID NO: 5491213 - DNA, 21 bp, Homo sapiens
ggaccaggccaatcccttctc

SEQ ID NO: 5491214 - DNA, 12 bp, Homo sapiens
ggaccaggcctg

SEQ ID NO: 5491215 - DNA, 14 bp, Homo sapiens
ggaccaggcctgga

SEQ ID NO: 5491216 - DNA, 19 bp, Homo sapiens
ggaccaggcctggagggca

SEQ ID NO: 5491217 - DNA, 15 bp, Homo sapiens
ggaccaggctccaat

SEQ ID NO: 5491218 - DNA, 19 bp, Homo sapiens
ggacctcagtttctgttgt

SEQ ID NO: 5491219 - DNA, 11 bp, Homo sapiens
ggacctcatcc

SEQ ID NO: 5491220 - DNA, 13 bp, Homo sapiens
ggacctccacctg

SEQ ID NO: 5491221 - DNA, 17 bp, Homo sapiens
ggacctccacctgggag

SEQ ID NO: 5491222 - DNA, 18 bp, Homo sapiens
ggacctccacctgggaga

SEQ ID NO: 5491223 - DNA, 15 bp, Homo sapiens
ggacctccatgcccc

SEQ ID NO: 5491224 - DNA, 16 bp, Homo sapiens
ggacctccccagccca

SEQ ID NO: 5491225 - DNA, 15 bp, Homo sapiens
ggacctccccctctt

SEQ ID NO: 5491226 - DNA, 24 bp, Homo sapiens
ggacctccccctgtgtggccctgg

SEQ ID NO: 5491227 - DNA, 20 bp, Homo sapiens
ggacctccggagcgccctgc

SEQ ID NO: 5491228 - DNA, 14 bp, Homo sapiens
ggacctcctccctc

SEQ ID NO: 5491229 - DNA, 15 bp, Homo sapiens
ggacctcctccctca

SEQ ID NO: 5491230 - DNA, 17 bp, Homo sapiens
ggacctcctccctcatt

SEQ ID NO: 5491231 - DNA, 20 bp, Homo sapiens
ggacctcctccctcattcat

SEQ ID NO: 5491232 - DNA, 11 bp, Homo sapiens
ggacctcctta

SEQ ID NO: 5491233 - DNA, 23 bp, Homo sapiens
ggacctcgtcccatcttcactct

SEQ ID NO: 5491234 - DNA, 13 bp, Homo sapiens
ggacctctgctct

SEQ ID NO: 5491235 - DNA, 14 bp, Homo sapiens
ggacctctgctctg

SEQ ID NO: 5491236 - DNA, 16 bp, Homo sapiens
ggacctctgctctgag

SEQ ID NO: 5491237 - DNA, 23 bp, Homo sapiens
ggacctgaagggtgacatcccag

SEQ ID NO: 5491238 - DNA, 20 bp, Homo sapiens
ggacctgaaggtattggcct

SEQ ID NO: 5491239 - DNA, 21 bp, Homo sapiens
ggacctgaaggtattggcctg

SEQ ID NO: 5491240 - DNA, 20 bp, Homo sapiens
ggacctgagcccgcagccca

SEQ ID NO: 5491241 - DNA, 13 bp, Homo sapiens
ggacctgagcctg

SEQ ID NO: 5491242 - DNA, 14 bp, Homo sapiens
ggacctgagcctgc

SEQ ID NO: 5491243 - DNA, 23 bp, Homo sapiens
ggacctgagcctgccgagcaacc

SEQ ID NO: 5491244 - DNA, 17 bp, Homo sapiens
ggacctgagcctggcca

SEQ ID NO: 5491245 - DNA, 19 bp, Homo sapiens
ggacctgagcctggccatg

SEQ ID NO: 5491246 - DNA, 18 bp, Homo sapiens
ggacctgagctggccagg

SEQ ID NO: 5491247 - DNA, 17 bp, Homo sapiens
ggacctgagtctgctat

SEQ ID NO: 5491248 - DNA, 23 bp, Homo sapiens
ggacctgatttattgaaattttt

SEQ ID NO: 5491249 - DNA, 21 bp, Homo sapiens
ggacctgcacgccaccgctgc

SEQ ID NO: 5491250 - DNA, 19 bp, Homo sapiens
ggacctgcagttggcctca

SEQ ID NO: 5491251 - DNA, 22 bp, Homo sapiens
ggacctgcagttggcctcagca

SEQ ID NO: 5491252 - DNA, 16 bp, Homo sapiens
ggacctgccaggcagg

SEQ ID NO: 5491253 - DNA, 10 bp, Homo sapiens
ggacctgccc

SEQ ID NO: 5491254 - DNA, 22 bp, Homo sapiens
ggacctgcccccgcatcccctg

SEQ ID NO: 5491255 - DNA, 23 bp, Homo sapiens
ggacctgcccccgcatcccctgc

SEQ ID NO: 5491256 - DNA, 23 bp, Homo sapiens
ggacctgccccggacctacctcc

SEQ ID NO: 5491257 - DNA, 18 bp, Homo sapiens
ggacctgcctagcatggg

SEQ ID NO: 5491258 - DNA, 15 bp, Homo sapiens
ggacctgcctccccg

SEQ ID NO: 5491259 - DNA, 19 bp, Homo sapiens
ggacctgcctcctgcctgc

SEQ ID NO: 5491260 - DNA, 22 bp, Homo sapiens
ggacctgcctcctgcctgcccc

SEQ ID NO: 5491261 - DNA, 23 bp, Homo sapiens
ggacctgcctcctgcctgcccct

SEQ ID NO: 5491262 - DNA, 13 bp, Homo sapiens
ggacctgcggcct

SEQ ID NO: 5491263 - DNA, 17 bp, Homo sapiens
ggacctgcggccttggg

SEQ ID NO: 5491264 - DNA, 12 bp, Homo sapiens
ggacctgctcat

SEQ ID NO: 5491265 - DNA, 13 bp, Homo sapiens
ggacctgctgctc

SEQ ID NO: 5491266 - DNA, 17 bp, Homo sapiens
ggacctgctgctccatg

SEQ ID NO: 5491267 - DNA, 20 bp, Homo sapiens
ggacctggactagggcctcg

SEQ ID NO: 5491268 - DNA, 20 bp, Homo sapiens
ggacctgggacaagcaggcc

SEQ ID NO: 5491269 - DNA, 12 bp, Homo sapiens
ggacctggggtc

SEQ ID NO: 5491270 - DNA, 19 bp, Homo sapiens
ggacctggggtcccccctc

SEQ ID NO: 5491271 - DNA, 21 bp, Homo sapiens
ggacctggggtcccccctccc

SEQ ID NO: 5491272 - DNA, 22 bp, Homo sapiens
ggacctggggtcccccctccct

SEQ ID NO: 5491273 - DNA, 23 bp, Homo sapiens
ggacctggggtcccccctccctg

SEQ ID NO: 5491274 - DNA, 17 bp, Homo sapiens
ggacctggtgctgcctc

SEQ ID NO: 5491275 - DNA, 22 bp, Homo sapiens
ggacctgtatttaagcaaatac

SEQ ID NO: 5491276 - DNA, 23 bp, Homo sapiens
ggacctgtatttaagcaaatact

SEQ ID NO: 5491277 - DNA, 14 bp, Homo sapiens
ggacctgtccccca

SEQ ID NO: 5491278 - DNA, 17 bp, Homo sapiens
ggacctgtcccccactc

SEQ ID NO: 5491279 - DNA, 20 bp, Homo sapiens
ggacctgtcccccactctct

SEQ ID NO: 5491280 - DNA, 22 bp, Homo sapiens
ggacctgtcccccactctctca

SEQ ID NO: 5491281 - DNA, 18 bp, Homo sapiens
ggacctgtggggccccag

SEQ ID NO: 5491282 - DNA, 18 bp, Homo sapiens
ggacctgtggtcatgtga

SEQ ID NO: 5491283 - DNA, 18 bp, Homo sapiens
ggacctgtgttcttgctg

SEQ ID NO: 5491284 - DNA, 18 bp, Homo sapiens
ggaccttaggccttcctc

SEQ ID NO: 5491285 - DNA, 21 bp, Homo sapiens
ggaccttcactctaagatgtt

SEQ ID NO: 5491286 - DNA, 12 bp, Homo sapiens
ggaccttcctgc

SEQ ID NO: 5491287 - DNA, 19 bp, Homo sapiens
ggaccttctttattctgtg

SEQ ID NO: 5491288 - DNA, 20 bp, Homo sapiens
ggaccttctttattctgtgt

SEQ ID NO: 5491289 - DNA, 18 bp, Homo sapiens
ggaccttgaactgggtac

SEQ ID NO: 5491290 - DNA, 13 bp, Homo sapiens
ggaccttgcttcc

SEQ ID NO: 5491291 - DNA, 17 bp, Homo sapiens
ggacctttcagctgtga

SEQ ID NO: 5491292 - DNA, 19 bp, Homo sapiens
ggacctttccaccacagcc

SEQ ID NO: 5491293 - DNA, 20 bp, Homo sapiens
ggacctttccaccacagcca

SEQ ID NO: 5491294 - DNA, 22 bp, Homo sapiens
ggacctttccaccacagccagc

SEQ ID NO: 5491295 - DNA, 13 bp, Homo sapiens
ggaccttttaaag

SEQ ID NO: 5491296 - DNA, 21 bp, Homo sapiens
ggaccttttcccttgctgtac

SEQ ID NO: 5491297 - DNA, 19 bp, Homo sapiens
ggaccttttggtcttcagc

SEQ ID NO: 5491298 - DNA, 16 bp, Homo sapiens
ggaccttttgttttct

SEQ ID NO: 5491299 - DNA, 13 bp, Homo sapiens
ggacgaacagggg

SEQ ID NO: 5491300 - DNA, 17 bp, Homo sapiens
ggacgacgaatcttctc

SEQ ID NO: 5491301 - DNA, 14 bp, Homo sapiens
ggacgactctgacc

SEQ ID NO: 5491302 - DNA, 22 bp, Homo sapiens
ggacgagacccccatccagcct

SEQ ID NO: 5491303 - DNA, 14 bp, Homo sapiens
ggacgagcagagcg

SEQ ID NO: 5491304 - DNA, 19 bp, Homo sapiens
ggacgagcagagcgcagcc

SEQ ID NO: 5491305 - DNA, 21 bp, Homo sapiens
ggacgagcagagcgcagcccc

SEQ ID NO: 5491306 - DNA, 14 bp, Homo sapiens
ggacgaggaggaca

SEQ ID NO: 5491307 - DNA, 14 bp, Homo sapiens
ggacgagggccagg

SEQ ID NO: 5491308 - DNA, 19 bp, Homo sapiens
ggacgagggccaggcaccc

SEQ ID NO: 5491309 - DNA, 13 bp, Homo sapiens
ggacgcacagcac

SEQ ID NO: 5491310 - DNA, 15 bp, Homo sapiens
ggacgcacagtgcag

SEQ ID NO: 5491311 - DNA, 21 bp, Homo sapiens
ggacgcaccgccgccaccagc

SEQ ID NO: 5491312 - DNA, 19 bp, Homo sapiens
ggacgcacgctcgctgcca

SEQ ID NO: 5491313 - DNA, 22 bp, Homo sapiens
ggacgcacgctcgctgccatca

SEQ ID NO: 5491314 - DNA, 14 bp, Homo sapiens
ggacgcagccacac

SEQ ID NO: 5491315 - DNA, 17 bp, Homo sapiens
ggacgcaggcccctctc

SEQ ID NO: 5491316 - DNA, 14 bp, Homo sapiens
ggacgcaggccctg

SEQ ID NO: 5491317 - DNA, 20 bp, Homo sapiens
ggacgcaggccctgtccagc

SEQ ID NO: 5491318 - DNA, 14 bp, Homo sapiens
ggacgcagggagac

SEQ ID NO: 5491319 - DNA, 19 bp, Homo sapiens
ggacgcaggtgctgcggcg

SEQ ID NO: 5491320 - DNA, 22 bp, Homo sapiens
ggacgcatgaaggtcactcgtg

SEQ ID NO: 5491321 - DNA, 19 bp, Homo sapiens
ggacgccaacttctcccac

SEQ ID NO: 5491322 - DNA, 21 bp, Homo sapiens
ggacgccaacttctcccaccc

SEQ ID NO: 5491323 - DNA, 15 bp, Homo sapiens
ggacgccacccagca

SEQ ID NO: 5491324 - DNA, 19 bp, Homo sapiens
ggacgccactcatttcatc

SEQ ID NO: 5491325 - DNA, 20 bp, Homo sapiens
ggacgccactcatttcatct

SEQ ID NO: 5491326 - DNA, 16 bp, Homo sapiens
ggacgcccagccccca

SEQ ID NO: 5491327 - DNA, 20 bp, Homo sapiens
ggacgcccagctgaggctgg

SEQ ID NO: 5491328 - DNA, 17 bp, Homo sapiens
ggacgcccaggacccca

SEQ ID NO: 5491329 - DNA, 24 bp, Homo sapiens
ggacgccgggccggccctagccca

SEQ ID NO: 5491330 - DNA, 12 bp, Homo sapiens
ggacgcctgccc

SEQ ID NO: 5491331 - DNA, 19 bp, Homo sapiens
ggacgcctgccctgcccag

SEQ ID NO: 5491332 - DNA, 13 bp, Homo sapiens
ggacgcctggctc

SEQ ID NO: 5491333 - DNA, 14 bp, Homo sapiens
ggacgcctggctcc

SEQ ID NO: 5491334 - DNA, 20 bp, Homo sapiens
ggacgcctggctccaggctc

SEQ ID NO: 5491335 - DNA, 22 bp, Homo sapiens
ggacgcctggctccaggctcca

SEQ ID NO: 5491336 - DNA, 16 bp, Homo sapiens
ggacgcgcacacacac

SEQ ID NO: 5491337 - DNA, 13 bp, Homo sapiens
ggacgcggcaggc

SEQ ID NO: 5491338 - DNA, 13 bp, Homo sapiens
ggacgcgggctgt

SEQ ID NO: 5491339 - DNA, 19 bp, Homo sapiens
ggacgcgggctgtgcctta

SEQ ID NO: 5491340 - DNA, 17 bp, Homo sapiens
ggacgctccctgctcca

SEQ ID NO: 5491341 - DNA, 13 bp, Homo sapiens
ggacgctctctgg

SEQ ID NO: 5491342 - DNA, 14 bp, Homo sapiens
ggacgctctctggc

SEQ ID NO: 5491343 - DNA, 16 bp, Homo sapiens
ggacgctctctggcct

SEQ ID NO: 5491344 - DNA, 13 bp, Homo sapiens
ggacgctctgctg

SEQ ID NO: 5491345 - DNA, 19 bp, Homo sapiens
ggacgctgcagaccccagg

SEQ ID NO: 5491346 - DNA, 16 bp, Homo sapiens
ggacgctgccgggaga

SEQ ID NO: 5491347 - DNA, 21 bp, Homo sapiens
ggacgctggagaccctgcgcc

SEQ ID NO: 5491348 - DNA, 19 bp, Homo sapiens
ggacgctggctactgtcta

SEQ ID NO: 5491349 - DNA, 13 bp, Homo sapiens
ggacgcttctgaa

SEQ ID NO: 5491350 - DNA, 15 bp, Homo sapiens
ggacgctttgtctgt

SEQ ID NO: 5491351 - DNA, 20 bp, Homo sapiens
ggacgcttttgagtgggccc

SEQ ID NO: 5491352 - DNA, 21 bp, Homo sapiens
ggacgcttttgagtgggccct

SEQ ID NO: 5491353 - DNA, 13 bp, Homo sapiens
ggacggagagcct

SEQ ID NO: 5491354 - DNA, 12 bp, Homo sapiens
ggacggccaaga

SEQ ID NO: 5491355 - DNA, 17 bp, Homo sapiens
ggacggccaagaatgta

SEQ ID NO: 5491356 - DNA, 21 bp, Homo sapiens
ggacggccaatggtgcttccc

SEQ ID NO: 5491357 - DNA, 15 bp, Homo sapiens
ggacggccctgcctg

SEQ ID NO: 5491358 - DNA, 19 bp, Homo sapiens
ggacggccctgcctgcctc

SEQ ID NO: 5491359 - DNA, 21 bp, Homo sapiens
ggacgggacagcggcccggcc

SEQ ID NO: 5491360 - DNA, 20 bp, Homo sapiens
ggacgggatgacctccagaa

SEQ ID NO: 5491361 - DNA, 16 bp, Homo sapiens
ggacggggcagagctg

SEQ ID NO: 5491362 - DNA, 12 bp, Homo sapiens
ggacggggctcc

SEQ ID NO: 5491363 - DNA, 18 bp, Homo sapiens
ggacgggggctgcttctc

SEQ ID NO: 5491364 - DNA, 23 bp, Homo sapiens
ggacggggggccccagtcagcct

SEQ ID NO: 5491365 - DNA, 13 bp, Homo sapiens
ggacggtctgtgc

SEQ ID NO: 5491366 - DNA, 19 bp, Homo sapiens
ggacggtgccaagggcccc

SEQ ID NO: 5491367 - DNA, 19 bp, Homo sapiens
ggacggtgcccaagccaga

SEQ ID NO: 5491368 - DNA, 18 bp, Homo sapiens
ggacggtgctccaggcag

SEQ ID NO: 5491369 - DNA, 22 bp, Homo sapiens
ggacggtttctagcctctgaga

SEQ ID NO: 5491370 - DNA, 21 bp, Homo sapiens
ggacgtacgtaataaggtttt

SEQ ID NO: 5491371 - DNA, 19 bp, Homo sapiens
ggacgtcacgctccctgac

SEQ ID NO: 5491372 - DNA, 22 bp, Homo sapiens
ggacgtcatcggaggctgggcc

SEQ ID NO: 5491373 - DNA, 16 bp, Homo sapiens
ggacgtccctgcccat

SEQ ID NO: 5491374 - DNA, 19 bp, Homo sapiens
ggacgtcctatctccccca

SEQ ID NO: 5491375 - DNA, 22 bp, Homo sapiens
ggacgtcctatctcccccaacc

SEQ ID NO: 5491376 - DNA, 22 bp, Homo sapiens
ggacgtcctgccacctggggca

SEQ ID NO: 5491377 - DNA, 20 bp, Homo sapiens
ggacgtcgctgtccgtcctg

SEQ ID NO: 5491378 - DNA, 13 bp, Homo sapiens
ggacgtctttctt

SEQ ID NO: 5491379 - DNA, 13 bp, Homo sapiens
ggacgtgcactga

SEQ ID NO: 5491380 - DNA, 16 bp, Homo sapiens
ggacgtggcacctcct

SEQ ID NO: 5491381 - DNA, 18 bp, Homo sapiens
ggacgtggcccctgccca

SEQ ID NO: 5491382 - DNA, 21 bp, Homo sapiens
ggacgtgttacccactgccat

SEQ ID NO: 5491383 - DNA, 23 bp, Homo sapiens
ggacgttgctgagccagctgcag

SEQ ID NO: 5491384 - DNA, 19 bp, Homo sapiens
ggacgttggcctcagggcc

SEQ ID NO: 5491385 - DNA, 23 bp, Homo sapiens
ggacgttggcctcagggccagga

SEQ ID NO: 5491386 - DNA, 23 bp, Homo sapiens
ggacgtttctggaactgtctgaa

SEQ ID NO: 5491387 - DNA, 19 bp, Homo sapiens
ggactaaaagatataagtg

SEQ ID NO: 5491388 - DNA, 18 bp, Homo sapiens
ggactaaagccaggaaca

SEQ ID NO: 5491389 - DNA, 21 bp, Homo sapiens
ggactaaatgcctagttttta

SEQ ID NO: 5491390 - DNA, 10 bp, Homo sapiens
ggactaaatt

SEQ ID NO: 5491391 - DNA, 18 bp, Homo sapiens
ggactaacactcagaagc

SEQ ID NO: 5491392 - DNA, 20 bp, Homo sapiens
ggactaacttgtctttggac

SEQ ID NO: 5491393 - DNA, 19 bp, Homo sapiens
ggactaagcctacctgctc

SEQ ID NO: 5491394 - DNA, 19 bp, Homo sapiens
ggactggaggtgggcatgc

SEQ ID NO: 5491395 - DNA, 15 bp, Homo sapiens
ggactggagtggagc

SEQ ID NO: 5491396 - DNA, 21 bp, Homo sapiens
ggactggccatttttctgggg

SEQ ID NO: 5491397 - DNA, 18 bp, Homo sapiens
ggactggcccacccctct

SEQ ID NO: 5491398 - DNA, 21 bp, Homo sapiens
ggactggcgttcacctccctg

SEQ ID NO: 5491399 - DNA, 11 bp, Homo sapiens
ggactggctca

SEQ ID NO: 5491400 - DNA, 15 bp, Homo sapiens
ggactggctgtcctt

SEQ ID NO: 5491401 - DNA, 17 bp, Homo sapiens
ggactgggaagggggca

SEQ ID NO: 5491402 - DNA, 18 bp, Homo sapiens
ggactgggaagggggcag

SEQ ID NO: 5491403 - DNA, 22 bp, Homo sapiens
ggactgggaagggggcaggccc

SEQ ID NO: 5491404 - DNA, 22 bp, Homo sapiens
ggactgggaccgtgcgagctgc

SEQ ID NO: 5491405 - DNA, 17 bp, Homo sapiens
ggactgggacttctggg

SEQ ID NO: 5491406 - DNA, 21 bp, Homo sapiens
ggactgggagcccccagcctg

SEQ ID NO: 5491407 - DNA, 18 bp, Homo sapiens
ggactgggccgggcccag

SEQ ID NO: 5491408 - DNA, 19 bp, Homo sapiens
ggactgggggactgggagt

SEQ ID NO: 5491409 - DNA, 22 bp, Homo sapiens
ggactgggtctgacctggtggg

SEQ ID NO: 5491410 - DNA, 13 bp, Homo sapiens
ggactgggtttgg

SEQ ID NO: 5491411 - DNA, 17 bp, Homo sapiens
ggactggtgatgggaca

SEQ ID NO: 5491412 - DNA, 14 bp, Homo sapiens
ggactggtgccctc

SEQ ID NO: 5491413 - DNA, 17 bp, Homo sapiens
ggactggtgccctcctc

SEQ ID NO: 5491414 - DNA, 12 bp, Homo sapiens
ggactggtgcct

SEQ ID NO: 5491415 - DNA, 22 bp, Homo sapiens
ggactggtgcgaccccccaccc

SEQ ID NO: 5491416 - DNA, 23 bp, Homo sapiens
ggactggtgcgaccccccacccc

SEQ ID NO: 5491417 - DNA, 19 bp, Homo sapiens
ggactggtggcccctgcct

SEQ ID NO: 5491418 - DNA, 14 bp, Homo sapiens
ggactggtgggggt

SEQ ID NO: 5491419 - DNA, 21 bp, Homo sapiens
ggactggtgggggttctggca

SEQ ID NO: 5491420 - DNA, 22 bp, Homo sapiens
ggactggtgggggttctggcag

SEQ ID NO: 5491421 - DNA, 14 bp, Homo sapiens
ggactggttatctt

SEQ ID NO: 5491422 - DNA, 14 bp, Homo sapiens
ggactggttgtctc

SEQ ID NO: 5491423 - DNA, 18 bp, Homo sapiens
ggactgtaaagatttgtt

SEQ ID NO: 5491424 - DNA, 13 bp, Homo sapiens
ggactgtacacac

SEQ ID NO: 5491425 - DNA, 22 bp, Homo sapiens
ggactgtagaaggtgagaggcg

SEQ ID NO: 5491426 - DNA, 13 bp, Homo sapiens
ggactgtcagctg

SEQ ID NO: 5491427 - DNA, 14 bp, Homo sapiens
ggactgtcctagcc

SEQ ID NO: 5491428 - DNA, 17 bp, Homo sapiens
ggactgtcctagccagg

SEQ ID NO: 5491429 - DNA, 19 bp, Homo sapiens
ggactgtcctaggtgaccc

SEQ ID NO: 5491430 - DNA, 19 bp, Homo sapiens
ggactgtcctcccacagac

SEQ ID NO: 5491431 - DNA, 24 bp, Homo sapiens
ggactgtcctcccacagacctgca

SEQ ID NO: 5491432 - DNA, 20 bp, Homo sapiens
ggactgtcgctgcttcgtgg

SEQ ID NO: 5491433 - DNA, 21 bp, Homo sapiens
ggactgtgacaggcagcagag

SEQ ID NO: 5491434 - DNA, 15 bp, Homo sapiens
ggactgtgaccaaag

SEQ ID NO: 5491435 - DNA, 16 bp, Homo sapiens
ggactgtgaccaaagc

SEQ ID NO: 5491436 - DNA, 18 bp, Homo sapiens
ggactgtgataatcagaa

SEQ ID NO: 5491437 - DNA, 18 bp, Homo sapiens
ggactgtgcctcaggcca

SEQ ID NO: 5491438 - DNA, 13 bp, Homo sapiens
ggactgtgcctgg

SEQ ID NO: 5491439 - DNA, 16 bp, Homo sapiens
ggactgtgctggtgca

SEQ ID NO: 5491440 - DNA, 15 bp, Homo sapiens
ggactgtggagggga

SEQ ID NO: 5491441 - DNA, 17 bp, Homo sapiens
ggactgtggaggggagc

SEQ ID NO: 5491442 - DNA, 15 bp, Homo sapiens
ggactgtggcctcag

SEQ ID NO: 5491443 - DNA, 22 bp, Homo sapiens
ggactgtggcgactctgcagag

SEQ ID NO: 5491444 - DNA, 14 bp, Homo sapiens
ggactgtggtgact

SEQ ID NO: 5491445 - DNA, 17 bp, Homo sapiens
ggactgtggtgactttg

SEQ ID NO: 5491446 - DNA, 15 bp, Homo sapiens
ggactgttcatttga

SEQ ID NO: 5491447 - DNA, 16 bp, Homo sapiens
ggactgttctcacctt

SEQ ID NO: 5491448 - DNA, 21 bp, Homo sapiens
ggactgttgtggtactggcaa

SEQ ID NO: 5491449 - DNA, 14 bp, Homo sapiens
ggactgttttcaat

SEQ ID NO: 5491450 - DNA, 20 bp, Homo sapiens
ggacttaaaattagtctttt

SEQ ID NO: 5491451 - DNA, 22 bp, Homo sapiens
ggacttaagacaaatgggactg

SEQ ID NO: 5491452 - DNA, 14 bp, Homo sapiens
ggacttacaaaatg

SEQ ID NO: 5491453 - DNA, 14 bp, Homo sapiens
ggacttactgcctg

SEQ ID NO: 5491454 - DNA, 16 bp, Homo sapiens
ggacttagccgactgc

SEQ ID NO: 5491455 - DNA, 24 bp, Homo sapiens
ggacttatttttggacttagtgca

SEQ ID NO: 5491456 - DNA, 10 bp, Homo sapiens
ggacttcaaa

SEQ ID NO: 5491457 - DNA, 18 bp, Homo sapiens
ggacttcaactgcccagc

SEQ ID NO: 5491458 - DNA, 16 bp, Homo sapiens
ggacttccacacctcc

SEQ ID NO: 5491459 - DNA, 19 bp, Homo sapiens
ggacttccccggagggctg

SEQ ID NO: 5491460 - DNA, 11 bp, Homo sapiens
ggacttcctga

SEQ ID NO: 5491461 - DNA, 14 bp, Homo sapiens
ggacttcctggggc

SEQ ID NO: 5491462 - DNA, 16 bp, Homo sapiens
ggacttcctggggccc

SEQ ID NO: 5491463 - DNA, 14 bp, Homo sapiens
ggacttcctgtcat

SEQ ID NO: 5491464 - DNA, 19 bp, Homo sapiens
ggacttcctgtccagctcc

SEQ ID NO: 5491465 - DNA, 23 bp, Homo sapiens
ggacttcggaccgcttgtgggga

SEQ ID NO: 5491466 - DNA, 20 bp, Homo sapiens
ggacttcgggggcggctctg

SEQ ID NO: 5491467 - DNA, 23 bp, Homo sapiens
ggacttctacctgccctcaaggg

SEQ ID NO: 5491468 - DNA, 18 bp, Homo sapiens
ggacttctgcagctatgc

SEQ ID NO: 5491469 - DNA, 13 bp, Homo sapiens
ggacttctgggag

SEQ ID NO: 5491470 - DNA, 22 bp, Homo sapiens
ggacttctggggtaagtggtct

SEQ ID NO: 5491471 - DNA, 16 bp, Homo sapiens
ggacttctgtgggccc

SEQ ID NO: 5491472 - DNA, 22 bp, Homo sapiens
ggacttctttaattttggaatt

SEQ ID NO: 5491473 - DNA, 11 bp, Homo sapiens
ggacttctttt

SEQ ID NO: 5491474 - DNA, 17 bp, Homo sapiens
ggacttcttttcacatt

SEQ ID NO: 5491475 - DNA, 15 bp, Homo sapiens
ggacttgaacccagg

SEQ ID NO: 5491476 - DNA, 12 bp, Homo sapiens
ggacttgaagtt

SEQ ID NO: 5491477 - DNA, 16 bp, Homo sapiens
ggacttgatgttcctt

SEQ ID NO: 5491478 - DNA, 21 bp, Homo sapiens
ggacttgctaaagcactttgc

SEQ ID NO: 5491479 - DNA, 22 bp, Homo sapiens
ggacttgcttcttgtgtttgaa

SEQ ID NO: 5491480 - DNA, 15 bp, Homo sapiens
ggacttggaagctcc

SEQ ID NO: 5491481 - DNA, 16 bp, Homo sapiens
ggacttggacaggagt

SEQ ID NO: 5491482 - DNA, 18 bp, Homo sapiens
ggacttggagagcaaagg

SEQ ID NO: 5491483 - DNA, 16 bp, Homo sapiens
ggacttggaggtagct

SEQ ID NO: 5491484 - DNA, 13 bp, Homo sapiens
ggacttggcctct

SEQ ID NO: 5491485 - DNA, 13 bp, Homo sapiens
ggacttggctgtc

SEQ ID NO: 5491486 - DNA, 21 bp, Homo sapiens
ggacttggctgtccttcccct

SEQ ID NO: 5491487 - DNA, 16 bp, Homo sapiens
ggacttggtaagatga

SEQ ID NO: 5491488 - DNA, 20 bp, Homo sapiens
ggacttgtaggaatctgcct

SEQ ID NO: 5491489 - DNA, 14 bp, Homo sapiens
ggacttgtatattt

SEQ ID NO: 5491490 - DNA, 15 bp, Homo sapiens
ggacttgtatatttg

SEQ ID NO: 5491491 - DNA, 20 bp, Homo sapiens
ggacttgtatatttgtacaa

SEQ ID NO: 5491492 - DNA, 19 bp, Homo sapiens
ggacttgtgattggctgca

SEQ ID NO: 5491493 - DNA, 13 bp, Homo sapiens
ggacttgtgccag

SEQ ID NO: 5491494 - DNA, 23 bp, Homo sapiens
ggacttgtgcctcttgggagacg

SEQ ID NO: 5491495 - DNA, 16 bp, Homo sapiens
ggacttgtgtctctgt

SEQ ID NO: 5491496 - DNA, 18 bp, Homo sapiens
ggacttgtttagagagcc

SEQ ID NO: 5491497 - DNA, 13 bp, Homo sapiens
ggacttgtttccc

SEQ ID NO: 5491498 - DNA, 12 bp, Homo sapiens
ggacttgtttta

SEQ ID NO: 5491499 - DNA, 17 bp, Homo sapiens
ggactttaaaaaaacaa

SEQ ID NO: 5491500 - DNA, 20 bp, Homo sapiens
ggactttatagatcagccag

SEQ ID NO: 5491501 - DNA, 11 bp, Homo sapiens
ggactttattt

SEQ ID NO: 5491502 - DNA, 16 bp, Homo sapiens
ggactttatttaattt

SEQ ID NO: 5491503 - DNA, 22 bp, Homo sapiens
ggactttatttaatttcataaa

SEQ ID NO: 5491504 - DNA, 21 bp, Homo sapiens
ggactttccaccccctccctg

SEQ ID NO: 5491505 - DNA, 16 bp, Homo sapiens
ggactttcccacccag

SEQ ID NO: 5491506 - DNA, 17 bp, Homo sapiens
ggactttccttccctct

SEQ ID NO: 5491507 - DNA, 20 bp, Homo sapiens
ggactttccttccctctcct

SEQ ID NO: 5491508 - DNA, 23 bp, Homo sapiens
ggactttcttgcatgaatcagat

SEQ ID NO: 5491509 - DNA, 23 bp, Homo sapiens
ggactttcttttcgccgtggctg

SEQ ID NO: 5491510 - DNA, 23 bp, Homo sapiens
ggactttgcacactttggcccag

SEQ ID NO: 5491511 - DNA, 12 bp, Homo sapiens
ggactttgtaca

SEQ ID NO: 5491512 - DNA, 20 bp, Homo sapiens
ggacttttaaacaaaagtgt

SEQ ID NO: 5491513 - DNA, 19 bp, Homo sapiens
ggacttttaatcagtgaag

SEQ ID NO: 5491514 - DNA, 18 bp, Homo sapiens
ggacttttcgttaacatt

SEQ ID NO: 5491515 - DNA, 19 bp, Homo sapiens
ggacttttgcagcttcctt

SEQ ID NO: 5491516 - DNA, 21 bp, Homo sapiens
ggacttttttgattaagtggt

SEQ ID NO: 5491517 - DNA, 11 bp, Homo sapiens
ggagaaaaaaa

SEQ ID NO: 5491518 - DNA, 15 bp, Homo sapiens
ggagaaaaaaaaagt

SEQ ID NO: 5491519 - DNA, 20 bp, Homo sapiens
ggagaaaaaaaaccttgtaa

SEQ ID NO: 5491520 - DNA, 20 bp, Homo sapiens
ggagaaaaaaagcatgtgtc

SEQ ID NO: 5491521 - DNA, 22 bp, Homo sapiens
ggagaaaaaaatcaaccctgca

SEQ ID NO: 5491522 - DNA, 12 bp, Homo sapiens
ggagaaaaacaa

SEQ ID NO: 5491523 - DNA, 14 bp, Homo sapiens
ggagaaaaagaaga

SEQ ID NO: 5491524 - DNA, 16 bp, Homo sapiens
ggagaaaaagaagaaa

SEQ ID NO: 5491525 - DNA, 21 bp, Homo sapiens
ggagaaaagacggatggcagg

SEQ ID NO: 5491526 - DNA, 15 bp, Homo sapiens
ggagaaaagagaaac

SEQ ID NO: 5491527 - DNA, 15 bp, Homo sapiens
ggagaaaagcacaat

SEQ ID NO: 5491528 - DNA, 18 bp, Homo sapiens
ggagaaaagcacaatcaa

SEQ ID NO: 5491529 - DNA, 13 bp, Homo sapiens
ggagaaaagccag

SEQ ID NO: 5491530 - DNA, 15 bp, Homo sapiens
ggagaaaaggaaaag

SEQ ID NO: 5491531 - DNA, 18 bp, Homo sapiens
ggagaaaatcatcaagaa

SEQ ID NO: 5491532 - DNA, 16 bp, Homo sapiens
ggagaaaatgaagaaa

SEQ ID NO: 5491533 - DNA, 19 bp, Homo sapiens
ggagaaaatggacgtgtta

SEQ ID NO: 5491534 - DNA, 20 bp, Homo sapiens
ggagaaaattcaattgtaaa

SEQ ID NO: 5491535 - DNA, 16 bp, Homo sapiens
ggagaaacaaaatcct

SEQ ID NO: 5491536 - DNA, 13 bp, Homo sapiens
ggagaaacagaga

SEQ ID NO: 5491537 - DNA, 23 bp, Homo sapiens
ggagaaacccacgacctgtcctg

SEQ ID NO: 5491538 - DNA, 13 bp, Homo sapiens
ggagaaaccctaa

SEQ ID NO: 5491539 - DNA, 15 bp, Homo sapiens
ggagaaactccaaag

SEQ ID NO: 5491540 - DNA, 15 bp, Homo sapiens
ggagaaagaaaactg

SEQ ID NO: 5491541 - DNA, 18 bp, Homo sapiens
ggagaaagaaagtaccca

SEQ ID NO: 5491542 - DNA, 12 bp, Homo sapiens
ggagaaagaagt

SEQ ID NO: 5491543 - DNA, 17 bp, Homo sapiens
ggagaaagcactgacct

SEQ ID NO: 5491544 - DNA, 14 bp, Homo sapiens
ggagaaagccacgc

SEQ ID NO: 5491545 - DNA, 19 bp, Homo sapiens
ggagaaagccacgccctcc

SEQ ID NO: 5491546 - DNA, 22 bp, Homo sapiens
ggagaaagctgacttggctggt

SEQ ID NO: 5491547 - DNA, 16 bp, Homo sapiens
ggagaaaggaagggct

SEQ ID NO: 5491548 - DNA, 12 bp, Homo sapiens
ggagaaaggaga

SEQ ID NO: 5491549 - DNA, 13 bp, Homo sapiens
ggagaaaggatgg

SEQ ID NO: 5491550 - DNA, 18 bp, Homo sapiens
ggagaaagggagagaaaa

SEQ ID NO: 5491551 - DNA, 21 bp, Homo sapiens
ggagaaagggagcgaggtcag

SEQ ID NO: 5491552 - DNA, 16 bp, Homo sapiens
ggagaaagggccctgg

SEQ ID NO: 5491553 - DNA, 22 bp, Homo sapiens
ggagaaaggggtgattgaaaga

SEQ ID NO: 5491554 - DNA, 17 bp, Homo sapiens
ggagaaagtaagtcttt

SEQ ID NO: 5491555 - DNA, 20 bp, Homo sapiens
ggagaaagtggaaaatgacc

SEQ ID NO: 5491556 - DNA, 15 bp, Homo sapiens
ggagaaatacccatg

SEQ ID NO: 5491557 - DNA, 16 bp, Homo sapiens
ggagaaatacccatgt

SEQ ID NO: 5491558 - DNA, 20 bp, Homo sapiens
ggagaaatctggctgtcctt

SEQ ID NO: 5491559 - DNA, 12 bp, Homo sapiens
ggagaaatgaag

SEQ ID NO: 5491560 - DNA, 14 bp, Homo sapiens
ggagaaatggcatc

SEQ ID NO: 5491561 - DNA, 17 bp, Homo sapiens
ggagaaatgttgttcat

SEQ ID NO: 5491562 - DNA, 22 bp, Homo sapiens
ggagaaatttgataatgacact

SEQ ID NO: 5491563 - DNA, 11 bp, Homo sapiens
ggagaacaaat

SEQ ID NO: 5491564 - DNA, 18 bp, Homo sapiens
ggagaacatctgccttgc

SEQ ID NO: 5491565 - DNA, 22 bp, Homo sapiens
ggagaaccaaaaagaggctatg

SEQ ID NO: 5491566 - DNA, 21 bp, Homo sapiens
ggagaaccagggctcttctca

SEQ ID NO: 5491567 - DNA, 15 bp, Homo sapiens
ggagaacccttcctg

SEQ ID NO: 5491568 - DNA, 16 bp, Homo sapiens
ggagaacccttcctgc

SEQ ID NO: 5491569 - DNA, 17 bp, Homo sapiens
ggagaaccttgtgcctg

SEQ ID NO: 5491570 - DNA, 19 bp, Homo sapiens
ggagaactccgctggatgg

SEQ ID NO: 5491571 - DNA, 18 bp, Homo sapiens
ggagaacttgctgcctcg

SEQ ID NO: 5491572 - DNA, 18 bp, Homo sapiens
ggagagactgtgaggcgg

SEQ ID NO: 5491573 - DNA, 19 bp, Homo sapiens
ggagagacttggatgagga

SEQ ID NO: 5491574 - DNA, 17 bp, Homo sapiens
ggagagagaaagccagg

SEQ ID NO: 5491575 - DNA, 14 bp, Homo sapiens
ggagagagaagcag

SEQ ID NO: 5491576 - DNA, 17 bp, Homo sapiens
ggagagagaagcaggca

SEQ ID NO: 5491577 - DNA, 15 bp, Homo sapiens
ggagagagaccccgc

SEQ ID NO: 5491578 - DNA, 17 bp, Homo sapiens
ggagagagagagagaaa

SEQ ID NO: 5491579 - DNA, 23 bp, Homo sapiens
ggagagagaggctgcctcagcca

SEQ ID NO: 5491580 - DNA, 23 bp, Homo sapiens
ggagagagcaatcttgctgtgaa

SEQ ID NO: 5491581 - DNA, 12 bp, Homo sapiens
ggagagagcaga

SEQ ID NO: 5491582 - DNA, 22 bp, Homo sapiens
ggagagagcagcttctgccact

SEQ ID NO: 5491583 - DNA, 13 bp, Homo sapiens
ggagagagcaggg

SEQ ID NO: 5491584 - DNA, 13 bp, Homo sapiens
ggagagagccagg

SEQ ID NO: 5491585 - DNA, 13 bp, Homo sapiens
ggagagagccctt

SEQ ID NO: 5491586 - DNA, 19 bp, Homo sapiens
ggagagagcccttcccagg

SEQ ID NO: 5491587 - DNA, 23 bp, Homo sapiens
ggagagagcccttcccagggcac

SEQ ID NO: 5491588 - DNA, 14 bp, Homo sapiens
ggagagaggaggag

SEQ ID NO: 5491589 - DNA, 10 bp, Homo sapiens
ggagagaggc

SEQ ID NO: 5491590 - DNA, 18 bp, Homo sapiens
ggagagaggcagagagcg

SEQ ID NO: 5491591 - DNA, 17 bp, Homo sapiens
ggagagagggactcaag

SEQ ID NO: 5491592 - DNA, 18 bp, Homo sapiens
ggagagagtattaaatat

SEQ ID NO: 5491593 - DNA, 17 bp, Homo sapiens
ggagagagttgaaccta

SEQ ID NO: 5491594 - DNA, 20 bp, Homo sapiens
ggagagagttgaacctaaac

SEQ ID NO: 5491595 - DNA, 20 bp, Homo sapiens
ggagagatcatagctcactg

SEQ ID NO: 5491596 - DNA, 22 bp, Homo sapiens
ggagagatccctgcagaaccca

SEQ ID NO: 5491597 - DNA, 20 bp, Homo sapiens
ggagagatgacccctacccc

SEQ ID NO: 5491598 - DNA, 16 bp, Homo sapiens
ggagagcaaaggccca

SEQ ID NO: 5491599 - DNA, 20 bp, Homo sapiens
ggagagcaccttaatattat

SEQ ID NO: 5491600 - DNA, 19 bp, Homo sapiens
ggagagcactgcctctatg

SEQ ID NO: 5491601 - DNA, 13 bp, Homo sapiens
ggagagcagcagc

SEQ ID NO: 5491602 - DNA, 13 bp, Homo sapiens
ggagagcagcagg

SEQ ID NO: 5491603 - DNA, 15 bp, Homo sapiens
ggagagcagctggct

SEQ ID NO: 5491604 - DNA, 14 bp, Homo sapiens
ggagagcaggctgg

SEQ ID NO: 5491605 - DNA, 17 bp, Homo sapiens
ggagagcatcaccacca

SEQ ID NO: 5491606 - DNA, 21 bp, Homo sapiens
ggagagcatcaccaccacacc

SEQ ID NO: 5491607 - DNA, 17 bp, Homo sapiens
ggagagccaacctcggc

SEQ ID NO: 5491608 - DNA, 22 bp, Homo sapiens
ggagagccaccaagagggacgc

SEQ ID NO: 5491609 - DNA, 18 bp, Homo sapiens
ggagagccactgggcccc

SEQ ID NO: 5491610 - DNA, 19 bp, Homo sapiens
ggagagccagaacctggag

SEQ ID NO: 5491611 - DNA, 15 bp, Homo sapiens
ggagagccagagaag

SEQ ID NO: 5491612 - DNA, 12 bp, Homo sapiens
ggagagccagcc

SEQ ID NO: 5491613 - DNA, 14 bp, Homo sapiens
ggagagccagccct

SEQ ID NO: 5491614 - DNA, 23 bp, Homo sapiens
ggagagccagccctccctgtcct

SEQ ID NO: 5491615 - DNA, 21 bp, Homo sapiens
ggagagccagctaaggggtgg

SEQ ID NO: 5491616 - DNA, 13 bp, Homo sapiens
ggagagccagctt

SEQ ID NO: 5491617 - DNA, 11 bp, Homo sapiens
ggagagcccag

SEQ ID NO: 5491618 - DNA, 15 bp, Homo sapiens
ggagagcccaggagc

SEQ ID NO: 5491619 - DNA, 21 bp, Homo sapiens
ggagagcccaggagctcccct

SEQ ID NO: 5491620 - DNA, 22 bp, Homo sapiens
ggagagcccaggagctcccctc

SEQ ID NO: 5491621 - DNA, 21 bp, Homo sapiens
ggagagcccccaccagcagca

SEQ ID NO: 5491622 - DNA, 17 bp, Homo sapiens
ggagagcccctggggcc

SEQ ID NO: 5491623 - DNA, 13 bp, Homo sapiens
ggagagccctggg

SEQ ID NO: 5491624 - DNA, 16 bp, Homo sapiens
ggagagcctgctggca

SEQ ID NO: 5491625 - DNA, 14 bp, Homo sapiens
ggagagcctggggg

SEQ ID NO: 5491626 - DNA, 15 bp, Homo sapiens
ggagagcgccacccg

SEQ ID NO: 5491627 - DNA, 19 bp, Homo sapiens
ggagagcgcctcttcctct

SEQ ID NO: 5491628 - DNA, 20 bp, Homo sapiens
ggagagcgcctgcccctccc

SEQ ID NO: 5491629 - DNA, 22 bp, Homo sapiens
ggagagctagaacctggagagc

SEQ ID NO: 5491630 - DNA, 22 bp, Homo sapiens
ggagagctagaacctggagggc

SEQ ID NO: 5491631 - DNA, 13 bp, Homo sapiens
ggagagctaggag

SEQ ID NO: 5491632 - DNA, 22 bp, Homo sapiens
ggagagctaggagcaaagcctg

SEQ ID NO: 5491633 - DNA, 17 bp, Homo sapiens
ggagagctcaggatggc

SEQ ID NO: 5491634 - DNA, 17 bp, Homo sapiens
ggagagctggagcctgg

SEQ ID NO: 5491635 - DNA, 18 bp, Homo sapiens
ggagagctggagcctggt

SEQ ID NO: 5491636 - DNA, 14 bp, Homo sapiens
ggagagctgggcag

SEQ ID NO: 5491637 - DNA, 18 bp, Homo sapiens
ggagagcttagggtctca

SEQ ID NO: 5491638 - DNA, 20 bp, Homo sapiens
ggagagcttagggtctcagg

SEQ ID NO: 5491639 - DNA, 22 bp, Homo sapiens
ggagaggaacgggcagcctggg

SEQ ID NO: 5491640 - DNA, 16 bp, Homo sapiens
ggagaggaactccttg

SEQ ID NO: 5491641 - DNA, 13 bp, Homo sapiens
ggagaggaagaga

SEQ ID NO: 5491642 - DNA, 23 bp, Homo sapiens
ggagaggaagcacactgcagggc

SEQ ID NO: 5491643 - DNA, 12 bp, Homo sapiens
ggagaggaagcc

SEQ ID NO: 5491644 - DNA, 17 bp, Homo sapiens
ggagaggacagagcagg

SEQ ID NO: 5491645 - DNA, 21 bp, Homo sapiens
ggagaggacggccctgcctgc

SEQ ID NO: 5491646 - DNA, 16 bp, Homo sapiens
ggagaggagacagaca

SEQ ID NO: 5491647 - DNA, 18 bp, Homo sapiens
ggagaggagagaggcaga

SEQ ID NO: 5491648 - DNA, 12 bp, Homo sapiens
ggagaggagagc

SEQ ID NO: 5491649 - DNA, 17 bp, Homo sapiens
ggagaggagaggctgct

SEQ ID NO: 5491650 - DNA, 12 bp, Homo sapiens
ggagaggagccc

SEQ ID NO: 5491651 - DNA, 15 bp, Homo sapiens
ggagaggagccctgc

SEQ ID NO: 5491652 - DNA, 13 bp, Homo sapiens
ggagaggatgaga

SEQ ID NO: 5491653 - DNA, 21 bp, Homo sapiens
ggagaggatgagagcccagag

SEQ ID NO: 5491654 - DNA, 12 bp, Homo sapiens
ggagaggcaaag

SEQ ID NO: 5491655 - DNA, 12 bp, Homo sapiens
ggagaggcctgg

SEQ ID NO: 5491656 - DNA, 14 bp, Homo sapiens
ggagaggcgagagg

SEQ ID NO: 5491657 - DNA, 18 bp, Homo sapiens
ggagaggctctgaaagct

SEQ ID NO: 5491658 - DNA, 15 bp, Homo sapiens
ggagaggctgggctg

SEQ ID NO: 5491659 - DNA, 21 bp, Homo sapiens
ggagaggctgggctgggtggc

SEQ ID NO: 5491660 - DNA, 19 bp, Homo sapiens
ggagaggctgtctggggcc

SEQ ID NO: 5491661 - DNA, 12 bp, Homo sapiens
ggagaggctgtg

SEQ ID NO: 5491662 - DNA, 23 bp, Homo sapiens
ggagagggaaacgtgccctctgt

SEQ ID NO: 5491663 - DNA, 13 bp, Homo sapiens
ggagagggaagag

SEQ ID NO: 5491664 - DNA, 14 bp, Homo sapiens
ggagagggaatgtg

SEQ ID NO: 5491665 - DNA, 19 bp, Homo sapiens
ggagagggacagcccactg

SEQ ID NO: 5491666 - DNA, 20 bp, Homo sapiens
ggagagggacatagaatctg

SEQ ID NO: 5491667 - DNA, 16 bp, Homo sapiens
ggagagggagcaagcc

SEQ ID NO: 5491668 - DNA, 17 bp, Homo sapiens
ggagagggagggagccg

SEQ ID NO: 5491669 - DNA, 22 bp, Homo sapiens
ggagagggagtacaaagacagg

SEQ ID NO: 5491670 - DNA, 24 bp, Homo sapiens
ggagagggatgaggtgctgggagg

SEQ ID NO: 5491671 - DNA, 13 bp, Homo sapiens
ggagagggatgga

SEQ ID NO: 5491672 - DNA, 18 bp, Homo sapiens
ggagagggatttccctgc

SEQ ID NO: 5491673 - DNA, 18 bp, Homo sapiens
ggagagggcctctgcctg

SEQ ID NO: 5491674 - DNA, 18 bp, Homo sapiens
ggagagggctagccctga

SEQ ID NO: 5491675 - DNA, 18 bp, Homo sapiens
ggagaggggaagggccag

SEQ ID NO: 5491676 - DNA, 17 bp, Homo sapiens
ggagaggggacgcaggc

SEQ ID NO: 5491677 - DNA, 20 bp, Homo sapiens
ggagaggggacgcaggcccc

SEQ ID NO: 5491678 - DNA, 13 bp, Homo sapiens
ggagaggggcctg

SEQ ID NO: 5491679 - DNA, 16 bp, Homo sapiens
ggagaggggcctggga

SEQ ID NO: 5491680 - DNA, 17 bp, Homo sapiens
ggagaggggcctgggaa

SEQ ID NO: 5491681 - DNA, 15 bp, Homo sapiens
ggagagggggccgga

SEQ ID NO: 5491682 - DNA, 14 bp, Homo sapiens
ggagagggggctgg

SEQ ID NO: 5491683 - DNA, 21 bp, Homo sapiens
ggagagggggctggtgggtgc

SEQ ID NO: 5491684 - DNA, 12 bp, Homo sapiens
ggagaggggggc

SEQ ID NO: 5491685 - DNA, 22 bp, Homo sapiens
ggagaggggtcacacccacccc

SEQ ID NO: 5491686 - DNA, 17 bp, Homo sapiens
ggagagggtctggagaa

SEQ ID NO: 5491687 - DNA, 16 bp, Homo sapiens
ggagagggtggcatca

SEQ ID NO: 5491688 - DNA, 14 bp, Homo sapiens
ggagaggtcaccag

SEQ ID NO: 5491689 - DNA, 11 bp, Homo sapiens
ggagaggtctt

SEQ ID NO: 5491690 - DNA, 22 bp, Homo sapiens
ggagaggtcttgctcacaggga

SEQ ID NO: 5491691 - DNA, 16 bp, Homo sapiens
ggagaggtggcaggaa

SEQ ID NO: 5491692 - DNA, 21 bp, Homo sapiens
ggagaggttataggtcactcc

SEQ ID NO: 5491693 - DNA, 23 bp, Homo sapiens
ggagaggttataggtcactcctg

SEQ ID NO: 5491694 - DNA, 16 bp, Homo sapiens
ggagaggttgtctgtg

SEQ ID NO: 5491695 - DNA, 22 bp, Homo sapiens
ggagaggtttgtcaacacaaag

SEQ ID NO: 5491696 - DNA, 17 bp, Homo sapiens
ggagagtacagtgagcc

SEQ ID NO: 5491697 - DNA, 20 bp, Homo sapiens
ggagagtacagtgagccaag

SEQ ID NO: 5491698 - DNA, 22 bp, Homo sapiens
ggagagtacattgaaggcctgg

SEQ ID NO: 5491699 - DNA, 17 bp, Homo sapiens
ggagagtcacagaacaa

SEQ ID NO: 5491700 - DNA, 21 bp, Homo sapiens
ggagagtcccagagcaggagg

SEQ ID NO: 5491701 - DNA, 21 bp, Homo sapiens
ggagagtcccctgaaggtctg

SEQ ID NO: 5491702 - DNA, 15 bp, Homo sapiens
ggagagtcctgggag

SEQ ID NO: 5491703 - DNA, 13 bp, Homo sapiens
ggagagtgagagc

SEQ ID NO: 5491704 - DNA, 18 bp, Homo sapiens
ggagagtgagggctccct

SEQ ID NO: 5491705 - DNA, 12 bp, Homo sapiens
ggagagtgaggt

SEQ ID NO: 5491706 - DNA, 19 bp, Homo sapiens
ggagagtgcacatgcccct

SEQ ID NO: 5491707 - DNA, 18 bp, Homo sapiens
ggagagtgcactgacctg

SEQ ID NO: 5491708 - DNA, 17 bp, Homo sapiens
ggagagtggacctgtgc

SEQ ID NO: 5491709 - DNA, 21 bp, Homo sapiens
ggagagtggcaggtgggctgc

SEQ ID NO: 5491710 - DNA, 12 bp, Homo sapiens
ggagagtggcat

SEQ ID NO: 5491711 - DNA, 21 bp, Homo sapiens
ggagagtggttgttgccaact

SEQ ID NO: 5491712 - DNA, 12 bp, Homo sapiens
ggagagtgtcaa

SEQ ID NO: 5491713 - DNA, 21 bp, Homo sapiens
ggagagtgtcaaccagacaga

SEQ ID NO: 5491714 - DNA, 17 bp, Homo sapiens
ggagagtgtgtgggcag

SEQ ID NO: 5491715 - DNA, 20 bp, Homo sapiens
ggagagtgtgtgggcagggt

SEQ ID NO: 5491716 - DNA, 21 bp, Homo sapiens
ggagagtgtgtgggcagggtt

SEQ ID NO: 5491717 - DNA, 21 bp, Homo sapiens
ggagagttcaagcctgtggga

SEQ ID NO: 5491718 - DNA, 22 bp, Homo sapiens
ggagagttcaagcctgtgggag

SEQ ID NO: 5491719 - DNA, 23 bp, Homo sapiens
ggagagttcaatggctgctgaag

SEQ ID NO: 5491720 - DNA, 17 bp, Homo sapiens
ggagagttgggggccag

SEQ ID NO: 5491721 - DNA, 19 bp, Homo sapiens
ggagagttgggggccagca

SEQ ID NO: 5491722 - DNA, 18 bp, Homo sapiens
ggagagttgtgatggagg

SEQ ID NO: 5491723 - DNA, 21 bp, Homo sapiens
ggagagttgtgatggagggga

SEQ ID NO: 5491724 - DNA, 13 bp, Homo sapiens
ggagagtttgcct

SEQ ID NO: 5491725 - DNA, 21 bp, Homo sapiens
ggagataaaagaaccccagac

SEQ ID NO: 5491726 - DNA, 22 bp, Homo sapiens
ggagataacagcctcttgcccg

SEQ ID NO: 5491727 - DNA, 15 bp, Homo sapiens
ggagataaggtggct

SEQ ID NO: 5491728 - DNA, 18 bp, Homo sapiens
ggagataaggtggcttct

SEQ ID NO: 5491729 - DNA, 18 bp, Homo sapiens
ggagatactggtggaagt

SEQ ID NO: 5491730 - DNA, 20 bp, Homo sapiens
ggagatagccccacaggagg

SEQ ID NO: 5491731 - DNA, 16 bp, Homo sapiens
ggagatagctggggct

SEQ ID NO: 5491732 - DNA, 12 bp, Homo sapiens
ggagatatttaa

SEQ ID NO: 5491733 - DNA, 14 bp, Homo sapiens
ggagatccgccctg

SEQ ID NO: 5491734 - DNA, 22 bp, Homo sapiens
ggagatccgccctgggctctgg

SEQ ID NO: 5491735 - DNA, 18 bp, Homo sapiens
ggagatctgaacccagct

SEQ ID NO: 5491736 - DNA, 19 bp, Homo sapiens
ggagatcttcccctaacct

SEQ ID NO: 5491737 - DNA, 19 bp, Homo sapiens
ggagatgaaactggttcct

SEQ ID NO: 5491738 - DNA, 19 bp, Homo sapiens
ggagatgaatagaagaaag

SEQ ID NO: 5491739 - DNA, 21 bp, Homo sapiens
ggagatgaatagaagaaagaa

SEQ ID NO: 5491740 - DNA, 22 bp, Homo sapiens
ggagatgaatagaagaaagaaa

SEQ ID NO: 5491741 - DNA, 16 bp, Homo sapiens
ggagatgaccagggat

SEQ ID NO: 5491742 - DNA, 17 bp, Homo sapiens
ggagatgaccagggatg

SEQ ID NO: 5491743 - DNA, 15 bp, Homo sapiens
ggagatgaggctgga

SEQ ID NO: 5491744 - DNA, 16 bp, Homo sapiens
ggagatgaggctggat

SEQ ID NO: 5491745 - DNA, 18 bp, Homo sapiens
ggagatgagtgggcttcg

SEQ ID NO: 5491746 - DNA, 12 bp, Homo sapiens
ggagatgatgat

SEQ ID NO: 5491747 - DNA, 13 bp, Homo sapiens
ggagatgatgtga

SEQ ID NO: 5491748 - DNA, 18 bp, Homo sapiens
ggagatgcaaggtgctgg

SEQ ID NO: 5491749 - DNA, 15 bp, Homo sapiens
ggagatgcagccttc

SEQ ID NO: 5491750 - DNA, 15 bp, Homo sapiens
ggagcctcctgccct

SEQ ID NO: 5491751 - DNA, 22 bp, Homo sapiens
ggagcctcgcaacccgtgccaa

SEQ ID NO: 5491752 - DNA, 23 bp, Homo sapiens
ggagcctcgtccaaggcagttct

SEQ ID NO: 5491753 - DNA, 23 bp, Homo sapiens
ggagcctctgcagtcgcttgcca

SEQ ID NO: 5491754 - DNA, 13 bp, Homo sapiens
ggagcctctggaa

SEQ ID NO: 5491755 - DNA, 12 bp, Homo sapiens
ggagcctctttt

SEQ ID NO: 5491756 - DNA, 21 bp, Homo sapiens
ggagcctctttttccttcttc

SEQ ID NO: 5491757 - DNA, 13 bp, Homo sapiens
ggagcctgaaccg

SEQ ID NO: 5491758 - DNA, 13 bp, Homo sapiens
ggagcctgaggca

SEQ ID NO: 5491759 - DNA, 15 bp, Homo sapiens
ggagcctgaggcagg

SEQ ID NO: 5491760 - DNA, 23 bp, Homo sapiens
ggagcctgagtcagggcccagag

SEQ ID NO: 5491761 - DNA, 22 bp, Homo sapiens
ggagcctgccgcccccgcctgg

SEQ ID NO: 5491762 - DNA, 11 bp, Homo sapiens
ggagcctgcct

SEQ ID NO: 5491763 - DNA, 14 bp, Homo sapiens
ggagcctgcggctg

SEQ ID NO: 5491764 - DNA, 15 bp, Homo sapiens
ggagcctgcggctgc

SEQ ID NO: 5491765 - DNA, 22 bp, Homo sapiens
ggagcctgcggctgctggcaca

SEQ ID NO: 5491766 - DNA, 20 bp, Homo sapiens
ggagcctgcggggcagcagg

SEQ ID NO: 5491767 - DNA, 22 bp, Homo sapiens
ggagcctgcggggcagcagggg

SEQ ID NO: 5491768 - DNA, 19 bp, Homo sapiens
ggagcctgcgtggcctggg

SEQ ID NO: 5491769 - DNA, 14 bp, Homo sapiens
ggagcctgctaagg

SEQ ID NO: 5491770 - DNA, 16 bp, Homo sapiens
ggagcctgctaaggaa

SEQ ID NO: 5491771 - DNA, 14 bp, Homo sapiens
ggagcctgctctcc

SEQ ID NO: 5491772 - DNA, 18 bp, Homo sapiens
ggagcctggagcccctgt

SEQ ID NO: 5491773 - DNA, 13 bp, Homo sapiens
ggagcctggcaca

SEQ ID NO: 5491774 - DNA, 13 bp, Homo sapiens
ggagcctggccag

SEQ ID NO: 5491775 - DNA, 12 bp, Homo sapiens
ggagcctgggat

SEQ ID NO: 5491776 - DNA, 18 bp, Homo sapiens
ggagcctgggggctcctc

SEQ ID NO: 5491777 - DNA, 18 bp, Homo sapiens
ggagcctggtccttccct

SEQ ID NO: 5491778 - DNA, 13 bp, Homo sapiens
ggagcctgtcctg

SEQ ID NO: 5491779 - DNA, 14 bp, Homo sapiens
ggagcctgtcctgc

SEQ ID NO: 5491780 - DNA, 20 bp, Homo sapiens
ggagcctgtcctgcctgtgg

SEQ ID NO: 5491781 - DNA, 19 bp, Homo sapiens
ggagcctgtgaacccagga

SEQ ID NO: 5491782 - DNA, 22 bp, Homo sapiens
ggagcctgtgaacccaggacaa

SEQ ID NO: 5491783 - DNA, 13 bp, Homo sapiens
ggagcctgtgcag

SEQ ID NO: 5491784 - DNA, 22 bp, Homo sapiens
ggagcctgtgcgtcccagctga

SEQ ID NO: 5491785 - DNA, 17 bp, Homo sapiens
ggagcctgtggccagca

SEQ ID NO: 5491786 - DNA, 19 bp, Homo sapiens
ggagcctgtggccagcagc

SEQ ID NO: 5491787 - DNA, 15 bp, Homo sapiens
ggagcctgtgtaaca

SEQ ID NO: 5491788 - DNA, 18 bp, Homo sapiens
ggagcctgtgtaacagct

SEQ ID NO: 5491789 - DNA, 12 bp, Homo sapiens
ggagcctgtgtt

SEQ ID NO: 5491790 - DNA, 20 bp, Homo sapiens
ggagcctgtgttagtgtctg

SEQ ID NO: 5491791 - DNA, 11 bp, Homo sapiens
ggagccttcca

SEQ ID NO: 5491792 - DNA, 19 bp, Homo sapiens
ggagccttcccgggcgggc

SEQ ID NO: 5491793 - DNA, 21 bp, Homo sapiens
ggagccttcctttctcctgcc

SEQ ID NO: 5491794 - DNA, 20 bp, Homo sapiens
ggagccttgataatacttga

SEQ ID NO: 5491795 - DNA, 21 bp, Homo sapiens
ggagccttgataatacttgac

SEQ ID NO: 5491796 - DNA, 20 bp, Homo sapiens
ggagccttgctgggccaggg

SEQ ID NO: 5491797 - DNA, 21 bp, Homo sapiens
ggagcctttggggggccaccc

SEQ ID NO: 5491798 - DNA, 22 bp, Homo sapiens
ggagcgaactcccccgaagaag

SEQ ID NO: 5491799 - DNA, 22 bp, Homo sapiens
ggagcgaagccttctgcagcag

SEQ ID NO: 5491800 - DNA, 13 bp, Homo sapiens
ggagcgaccctgg

SEQ ID NO: 5491801 - DNA, 19 bp, Homo sapiens
ggagcgatcgctcccctgg

SEQ ID NO: 5491802 - DNA, 15 bp, Homo sapiens
ggagcgcacctgccc

SEQ ID NO: 5491803 - DNA, 14 bp, Homo sapiens
ggagcgcacctgct

SEQ ID NO: 5491804 - DNA, 22 bp, Homo sapiens
ggagcgcccgccgtctgctccg

SEQ ID NO: 5491805 - DNA, 16 bp, Homo sapiens
ggagcgccctgcaggg

SEQ ID NO: 5491806 - DNA, 17 bp, Homo sapiens
ggagcgccctgcagggc

SEQ ID NO: 5491807 - DNA, 15 bp, Homo sapiens
ggagcgctagtgcct

SEQ ID NO: 5491808 - DNA, 14 bp, Homo sapiens
ggagcggaaagcag

SEQ ID NO: 5491809 - DNA, 15 bp, Homo sapiens
ggagcggaaagcagc

SEQ ID NO: 5491810 - DNA, 18 bp, Homo sapiens
ggagcggagcttgcctgc

SEQ ID NO: 5491811 - DNA, 20 bp, Homo sapiens
ggagcggagcttgcctgcct

SEQ ID NO: 5491812 - DNA, 16 bp, Homo sapiens
ggagcggagcttggcc

SEQ ID NO: 5491813 - DNA, 21 bp, Homo sapiens
ggagcggagcttggccctgcg

SEQ ID NO: 5491814 - DNA, 19 bp, Homo sapiens
ggagcggcgccctggactt

SEQ ID NO: 5491815 - DNA, 13 bp, Homo sapiens
ggagcggctctcc

SEQ ID NO: 5491816 - DNA, 13 bp, Homo sapiens
ggagcggctgagg

SEQ ID NO: 5491817 - DNA, 16 bp, Homo sapiens
ggagcgggaggcggtg

SEQ ID NO: 5491818 - DNA, 21 bp, Homo sapiens
ggagcgggggctaactggccc

SEQ ID NO: 5491819 - DNA, 22 bp, Homo sapiens
ggagcgggggctaactggcccc

SEQ ID NO: 5491820 - DNA, 13 bp, Homo sapiens
ggagcggggggga

SEQ ID NO: 5491821 - DNA, 14 bp, Homo sapiens
ggagcgggtctgct

SEQ ID NO: 5491822 - DNA, 16 bp, Homo sapiens
ggagcgtctgggaact

SEQ ID NO: 5491823 - DNA, 16 bp, Homo sapiens
ggagcgtgaaggactt

SEQ ID NO: 5491824 - DNA, 18 bp, Homo sapiens
ggagcgtggactctgcta

SEQ ID NO: 5491825 - DNA, 23 bp, Homo sapiens
ggagcgtggactctgctagactc

SEQ ID NO: 5491826 - DNA, 15 bp, Homo sapiens
ggagcgtggactggt

SEQ ID NO: 5491827 - DNA, 22 bp, Homo sapiens
ggagcgtggggaggggctgagg

SEQ ID NO: 5491828 - DNA, 13 bp, Homo sapiens
ggagcgtgtccta

SEQ ID NO: 5491829 - DNA, 23 bp, Homo sapiens
ggagcgttctaaatatgaatgaa

SEQ ID NO: 5491830 - DNA, 17 bp, Homo sapiens
ggagcgtttgctgtgcc

SEQ ID NO: 5491831 - DNA, 17 bp, Homo sapiens
ggagctaaggaagacac

SEQ ID NO: 5491832 - DNA, 14 bp, Homo sapiens
ggagctaaggccag

SEQ ID NO: 5491833 - DNA, 15 bp, Homo sapiens
ggagctaaggccagc

SEQ ID NO: 5491834 - DNA, 12 bp, Homo sapiens
ggagctaaggct

SEQ ID NO: 5491835 - DNA, 22 bp, Homo sapiens
ggagctacctgtgtggacagga

SEQ ID NO: 5491836 - DNA, 22 bp, Homo sapiens
ggagctacgaaaggatgagcag

SEQ ID NO: 5491837 - DNA, 23 bp, Homo sapiens
ggagctacgaaaggatgagcaga

SEQ ID NO: 5491838 - DNA, 14 bp, Homo sapiens
ggagctagaatttg

SEQ ID NO: 5491839 - DNA, 12 bp, Homo sapiens
ggagctagccag

SEQ ID NO: 5491840 - DNA, 15 bp, Homo sapiens
ggagctagcccagtc

SEQ ID NO: 5491841 - DNA, 22 bp, Homo sapiens
ggagctagcccagtccctggag

SEQ ID NO: 5491842 - DNA, 14 bp, Homo sapiens
ggagctagtgttaa

SEQ ID NO: 5491843 - DNA, 15 bp, Homo sapiens
ggagctatcaggaac

SEQ ID NO: 5491844 - DNA, 16 bp, Homo sapiens
ggagctatcagtgctt

SEQ ID NO: 5491845 - DNA, 12 bp, Homo sapiens
ggagctatttta

SEQ ID NO: 5491846 - DNA, 23 bp, Homo sapiens
ggagctcacaccgcaccgggctg

SEQ ID NO: 5491847 - DNA, 17 bp, Homo sapiens
ggagctcaccctgcccg

SEQ ID NO: 5491848 - DNA, 20 bp, Homo sapiens
ggagctcaccctgcccgctc

SEQ ID NO: 5491849 - DNA, 21 bp, Homo sapiens
ggagctcaccctgcccgctcc

SEQ ID NO: 5491850 - DNA, 23 bp, Homo sapiens
ggagctcactgtggtgtctgtgt

SEQ ID NO: 5491851 - DNA, 14 bp, Homo sapiens
ggagctcagagagg

SEQ ID NO: 5491852 - DNA, 18 bp, Homo sapiens
ggagctcagggctggatt

SEQ ID NO: 5491853 - DNA, 20 bp, Homo sapiens
ggagctcaggtttctggaca

SEQ ID NO: 5491854 - DNA, 23 bp, Homo sapiens
ggagctcagttgagaaacagttc

SEQ ID NO: 5491855 - DNA, 22 bp, Homo sapiens
ggagctcattttccacatggca

SEQ ID NO: 5491856 - DNA, 20 bp, Homo sapiens
ggagctccactctgcttctc

SEQ ID NO: 5491857 - DNA, 19 bp, Homo sapiens
ggagctccagtgtcctgag

SEQ ID NO: 5491858 - DNA, 13 bp, Homo sapiens
ggagctcccctcc

SEQ ID NO: 5491859 - DNA, 16 bp, Homo sapiens
ggagctcctccctcca

SEQ ID NO: 5491860 - DNA, 22 bp, Homo sapiens
ggagctcctccctccagctgcg

SEQ ID NO: 5491861 - DNA, 18 bp, Homo sapiens
ggagctcctctcctggag

SEQ ID NO: 5491862 - DNA, 20 bp, Homo sapiens
ggagctcctctcctggagga

SEQ ID NO: 5491863 - DNA, 18 bp, Homo sapiens
ggagctcctggccaggat

SEQ ID NO: 5491864 - DNA, 14 bp, Homo sapiens
ggagctcctgggac

SEQ ID NO: 5491865 - DNA, 13 bp, Homo sapiens
ggagctctaactg

SEQ ID NO: 5491866 - DNA, 21 bp, Homo sapiens
ggagctctaccctgctccctg

SEQ ID NO: 5491867 - DNA, 11 bp, Homo sapiens
ggagctctgcg

SEQ ID NO: 5491868 - DNA, 16 bp, Homo sapiens
ggagctctgcgccagg

SEQ ID NO: 5491869 - DNA, 17 bp, Homo sapiens
ggagctctgcgccaggc

SEQ ID NO: 5491870 - DNA, 20 bp, Homo sapiens
ggagctctgcgccaggcaga

SEQ ID NO: 5491871 - DNA, 18 bp, Homo sapiens
ggagctcttcaggcctcc

SEQ ID NO: 5491872 - DNA, 19 bp, Homo sapiens
ggagctcttgacagaaagc

SEQ ID NO: 5491873 - DNA, 14 bp, Homo sapiens
ggagctcttggaag

SEQ ID NO: 5491874 - DNA, 20 bp, Homo sapiens
ggagctgaattttctggaaa

SEQ ID NO: 5491875 - DNA, 20 bp, Homo sapiens
ggagctgactggtttctcct

SEQ ID NO: 5491876 - DNA, 12 bp, Homo sapiens
ggagctgagaat

SEQ ID NO: 5491877 - DNA, 21 bp, Homo sapiens
ggagctgaggccattccctgt

SEQ ID NO: 5491878 - DNA, 22 bp, Homo sapiens
ggagctgaggccattccctgta

SEQ ID NO: 5491879 - DNA, 17 bp, Homo sapiens
ggagctgaggcctccct

SEQ ID NO: 5491880 - DNA, 11 bp, Homo sapiens
ggagctgaggg

SEQ ID NO: 5491881 - DNA, 20 bp, Homo sapiens
ggagctgagggagggagcca

SEQ ID NO: 5491882 - DNA, 14 bp, Homo sapiens
ggagctgaggggca

SEQ ID NO: 5491883 - DNA, 17 bp, Homo sapiens
ggagctgaggggcaggg

SEQ ID NO: 5491884 - DNA, 18 bp, Homo sapiens
ggagctgatggcagctgg

SEQ ID NO: 5491885 - DNA, 17 bp, Homo sapiens
ggagctgatttccaggc

SEQ ID NO: 5491886 - DNA, 19 bp, Homo sapiens
ggagctgatttccaggccc

SEQ ID NO: 5491887 - DNA, 15 bp, Homo sapiens
ggagctgcagagcag

SEQ ID NO: 5491888 - DNA, 23 bp, Homo sapiens
ggagctgcagcgcctcctggaca

SEQ ID NO: 5491889 - DNA, 20 bp, Homo sapiens
ggagctgcaggggcatggga

SEQ ID NO: 5491890 - DNA, 21 bp, Homo sapiens
ggagctgcagtcccatgcaca

SEQ ID NO: 5491891 - DNA, 13 bp, Homo sapiens
ggagctgccacag

SEQ ID NO: 5491892 - DNA, 18 bp, Homo sapiens
ggagctgccacagagaag

SEQ ID NO: 5491893 - DNA, 13 bp, Homo sapiens
ggagctgcccaga

SEQ ID NO: 5491894 - DNA, 12 bp, Homo sapiens
ggagctgcctgc

SEQ ID NO: 5491895 - DNA, 15 bp, Homo sapiens
ggagctgcctggacc

SEQ ID NO: 5491896 - DNA, 17 bp, Homo sapiens
ggagctgcctggacccg

SEQ ID NO: 5491897 - DNA, 12 bp, Homo sapiens
ggagctgcctgt

SEQ ID NO: 5491898 - DNA, 16 bp, Homo sapiens
ggagctgcgccggaca

SEQ ID NO: 5491899 - DNA, 22 bp, Homo sapiens
ggagctgcgcttccctgcagtc

SEQ ID NO: 5491900 - DNA, 24 bp, Homo sapiens
ggagctgctcactacctcctcagg

SEQ ID NO: 5491901 - DNA, 12 bp, Homo sapiens
ggagctgctggc

SEQ ID NO: 5491902 - DNA, 19 bp, Homo sapiens
ggagctgctggccatggct

SEQ ID NO: 5491903 - DNA, 21 bp, Homo sapiens
ggagctgctggccatggctgc

SEQ ID NO: 5491904 - DNA, 18 bp, Homo sapiens
ggagctgctggctgacct

SEQ ID NO: 5491905 - DNA, 21 bp, Homo sapiens
ggagctgctggctgacctggg

SEQ ID NO: 5491906 - DNA, 15 bp, Homo sapiens
ggagctgctggcttg

SEQ ID NO: 5491907 - DNA, 13 bp, Homo sapiens
ggagctgctgggc

SEQ ID NO: 5491908 - DNA, 20 bp, Homo sapiens
ggagctgctgggtggcaggg

SEQ ID NO: 5491909 - DNA, 21 bp, Homo sapiens
ggagctgctgggtggcagggg

SEQ ID NO: 5491910 - DNA, 12 bp, Homo sapiens
ggagctggaggg

SEQ ID NO: 5491911 - DNA, 23 bp, Homo sapiens
ggagctggaggggtggggagcta

SEQ ID NO: 5491912 - DNA, 22 bp, Homo sapiens
ggagctggcaatgccctacctg

SEQ ID NO: 5491913 - DNA, 15 bp, Homo sapiens
ggagctggcccaggg

SEQ ID NO: 5491914 - DNA, 21 bp, Homo sapiens
ggagctggccgtgggcctggg

SEQ ID NO: 5491915 - DNA, 13 bp, Homo sapiens
ggagctggcctgc

SEQ ID NO: 5491916 - DNA, 14 bp, Homo sapiens
ggagctggcctgtg

SEQ ID NO: 5491917 - DNA, 16 bp, Homo sapiens
ggagctggcctgtggc

SEQ ID NO: 5491918 - DNA, 22 bp, Homo sapiens
ggagctggcctgtggcacagcc

SEQ ID NO: 5491919 - DNA, 17 bp, Homo sapiens
ggagctggctgtgcctg

SEQ ID NO: 5491920 - DNA, 18 bp, Homo sapiens
ggagctggctgtgcctgc

SEQ ID NO: 5491921 - DNA, 12 bp, Homo sapiens
ggagctgggagg

SEQ ID NO: 5491922 - DNA, 15 bp, Homo sapiens
ggagctgggaggaaa

SEQ ID NO: 5491923 - DNA, 16 bp, Homo sapiens
ggagctgggcccctgc

SEQ ID NO: 5491924 - DNA, 17 bp, Homo sapiens
ggagctgggggaaggca

SEQ ID NO: 5491925 - DNA, 14 bp, Homo sapiens
ggagctggggtctg

SEQ ID NO: 5491926 - DNA, 22 bp, Homo sapiens
ggagctggggtctgggcagtgc

SEQ ID NO: 5491927 - DNA, 22 bp, Homo sapiens
ggagctggtctgccaggggctt

SEQ ID NO: 5491928 - DNA, 23 bp, Homo sapiens
ggaggaggtaacatagatgcctg

SEQ ID NO: 5491929 - DNA, 18 bp, Homo sapiens
ggaggaggtgtcccaagc

SEQ ID NO: 5491930 - DNA, 23 bp, Homo sapiens
ggaggagtcagatgaggccctgc

SEQ ID NO: 5491931 - DNA, 13 bp, Homo sapiens
ggaggagtcaggg

SEQ ID NO: 5491932 - DNA, 15 bp, Homo sapiens
ggaggagtcaggggc

SEQ ID NO: 5491933 - DNA, 16 bp, Homo sapiens
ggaggagtggattcct

SEQ ID NO: 5491934 - DNA, 16 bp, Homo sapiens
ggaggagttgtctgtc

SEQ ID NO: 5491935 - DNA, 14 bp, Homo sapiens
ggaggatacagagg

SEQ ID NO: 5491936 - DNA, 13 bp, Homo sapiens
ggaggatattaaa

SEQ ID NO: 5491937 - DNA, 17 bp, Homo sapiens
ggaggatcactggagcc

SEQ ID NO: 5491938 - DNA, 19 bp, Homo sapiens
ggaggatcactggagccca

SEQ ID NO: 5491939 - DNA, 20 bp, Homo sapiens
ggaggatcactggagcccag

SEQ ID NO: 5491940 - DNA, 22 bp, Homo sapiens
ggaggatcactggagcccagga

SEQ ID NO: 5491941 - DNA, 12 bp, Homo sapiens
ggaggatcactt

SEQ ID NO: 5491942 - DNA, 18 bp, Homo sapiens
ggaggatcagttttttgt

SEQ ID NO: 5491943 - DNA, 14 bp, Homo sapiens
ggaggatccctcca

SEQ ID NO: 5491944 - DNA, 20 bp, Homo sapiens
ggaggatcctgagctgctgt

SEQ ID NO: 5491945 - DNA, 20 bp, Homo sapiens
ggaggatcttttgaacccag

SEQ ID NO: 5491946 - DNA, 16 bp, Homo sapiens
ggaggatgagccacag

SEQ ID NO: 5491947 - DNA, 16 bp, Homo sapiens
ggaggatgccacagcc

SEQ ID NO: 5491948 - DNA, 18 bp, Homo sapiens
ggaggatgccacagcccc

SEQ ID NO: 5491949 - DNA, 23 bp, Homo sapiens
ggaggatgccacagccccacagc

SEQ ID NO: 5491950 - DNA, 22 bp, Homo sapiens
ggaggatgccacgcacttcctc

SEQ ID NO: 5491951 - DNA, 16 bp, Homo sapiens
ggaggatgctgtgcct

SEQ ID NO: 5491952 - DNA, 20 bp, Homo sapiens
ggaggatgtccctgggccag

SEQ ID NO: 5491953 - DNA, 21 bp, Homo sapiens
ggaggatgtccctgggccagg

SEQ ID NO: 5491954 - DNA, 17 bp, Homo sapiens
ggaggattgctgccaga

SEQ ID NO: 5491955 - DNA, 19 bp, Homo sapiens
ggaggcaacactgctgtcc

SEQ ID NO: 5491956 - DNA, 21 bp, Homo sapiens
ggaggcaacactgctgtccac

SEQ ID NO: 5491957 - DNA, 19 bp, Homo sapiens
ggaggcaagaaaaggacaa

SEQ ID NO: 5491958 - DNA, 12 bp, Homo sapiens
ggaggcaagcaa

SEQ ID NO: 5491959 - DNA, 16 bp, Homo sapiens
ggaggcacacagctgc

SEQ ID NO: 5491960 - DNA, 13 bp, Homo sapiens
ggaggcacagcag

SEQ ID NO: 5491961 - DNA, 17 bp, Homo sapiens
ggaggcaccagctctgt

SEQ ID NO: 5491962 - DNA, 20 bp, Homo sapiens
ggaggcaccagctctgtggc

SEQ ID NO: 5491963 - DNA, 19 bp, Homo sapiens
ggaggcacctccaggcagg

SEQ ID NO: 5491964 - DNA, 13 bp, Homo sapiens
ggaggcacgcacc

SEQ ID NO: 5491965 - DNA, 13 bp, Homo sapiens
ggaggcactgaag

SEQ ID NO: 5491966 - DNA, 23 bp, Homo sapiens
ggaggcagaaacctatctcaggg

SEQ ID NO: 5491967 - DNA, 13 bp, Homo sapiens
ggaggcagaaaga

SEQ ID NO: 5491968 - DNA, 21 bp, Homo sapiens
ggaggcagaaagcagaggctg

SEQ ID NO: 5491969 - DNA, 15 bp, Homo sapiens
ggaggcagagaagaa

SEQ ID NO: 5491970 - DNA, 19 bp, Homo sapiens
ggaggcagagaagaaagaa

SEQ ID NO: 5491971 - DNA, 22 bp, Homo sapiens
ggaggcagagaatctcttggga

SEQ ID NO: 5491972 - DNA, 21 bp, Homo sapiens
ggaggcagagcgggagggagt

SEQ ID NO: 5491973 - DNA, 13 bp, Homo sapiens
ggaggcagaggtg

SEQ ID NO: 5491974 - DNA, 12 bp, Homo sapiens
ggaggcagagtt

SEQ ID NO: 5491975 - DNA, 13 bp, Homo sapiens
ggaggcagatgga

SEQ ID NO: 5491976 - DNA, 14 bp, Homo sapiens
ggaggcagcagagc

SEQ ID NO: 5491977 - DNA, 17 bp, Homo sapiens
ggaggcagccagggctt

SEQ ID NO: 5491978 - DNA, 15 bp, Homo sapiens
ggaggcagccccctc

SEQ ID NO: 5491979 - DNA, 16 bp, Homo sapiens
ggaggcagccgaggcc

SEQ ID NO: 5491980 - DNA, 21 bp, Homo sapiens
ggaggcagccgaggcctggcc

SEQ ID NO: 5491981 - DNA, 18 bp, Homo sapiens
ggaggcagcgccccacca

SEQ ID NO: 5491982 - DNA, 17 bp, Homo sapiens
ggaggcagcgtgggctc

SEQ ID NO: 5491983 - DNA, 19 bp, Homo sapiens
ggaggcagcgtgggctctg

SEQ ID NO: 5491984 - DNA, 20 bp, Homo sapiens
ggaggcagcgtgggctctgc

SEQ ID NO: 5491985 - DNA, 13 bp, Homo sapiens
ggaggcagctcca

SEQ ID NO: 5491986 - DNA, 15 bp, Homo sapiens
ggaggcaggagcatg

SEQ ID NO: 5491987 - DNA, 16 bp, Homo sapiens
ggaggcaggaggagca

SEQ ID NO: 5491988 - DNA, 23 bp, Homo sapiens
ggaggcaggatatccccagggaa

SEQ ID NO: 5491989 - DNA, 18 bp, Homo sapiens
ggaggcagggaggcagcc

SEQ ID NO: 5491990 - DNA, 15 bp, Homo sapiens
ggaggcagggcagcc

SEQ ID NO: 5491991 - DNA, 16 bp, Homo sapiens
ggaggcagggctctcc

SEQ ID NO: 5491992 - DNA, 22 bp, Homo sapiens
ggaggcaggtcgggctgccagc

SEQ ID NO: 5491993 - DNA, 22 bp, Homo sapiens
ggaggcagtgctgatccggctg

SEQ ID NO: 5491994 - DNA, 13 bp, Homo sapiens
ggaggcagtggac

SEQ ID NO: 5491995 - DNA, 17 bp, Homo sapiens
ggaggcagtggcttgga

SEQ ID NO: 5491996 - DNA, 16 bp, Homo sapiens
ggaggcatcagtgtcc

SEQ ID NO: 5491997 - DNA, 20 bp, Homo sapiens
ggaggcatccaaaggctcct

SEQ ID NO: 5491998 - DNA, 16 bp, Homo sapiens
ggaggcatggccctgg

SEQ ID NO: 5491999 - DNA, 20 bp, Homo sapiens
ggaggccaaactgtccctcc

SEQ ID NO: 5492000 - DNA, 18 bp, Homo sapiens
ggaggccaaccagcccga

SEQ ID NO: 5492001 - DNA, 22 bp, Homo sapiens
ggaggccaagagtggccccacc

SEQ ID NO: 5492002 - DNA, 12 bp, Homo sapiens
ggaggccaagcc

SEQ ID NO: 5492003 - DNA, 20 bp, Homo sapiens
ggaggccaaggtgggaggat

SEQ ID NO: 5492004 - DNA, 18 bp, Homo sapiens
ggaggccaagtgcaggct

SEQ ID NO: 5492005 - DNA, 22 bp, Homo sapiens
ggaggccacacgcactggtgcc

SEQ ID NO: 5492006 - DNA, 22 bp, Homo sapiens
ggaggccaccccaaaccccagc

SEQ ID NO: 5492007 - DNA, 22 bp, Homo sapiens
ggaggccaccgggacagacctg

SEQ ID NO: 5492008 - DNA, 18 bp, Homo sapiens
ggaggccacctcctaaaa

SEQ ID NO: 5492009 - DNA, 14 bp, Homo sapiens
ggaggccacctctc

SEQ ID NO: 5492010 - DNA, 18 bp, Homo sapiens
ggaggccacctctccaag

SEQ ID NO: 5492011 - DNA, 16 bp, Homo sapiens
ggaggccacgggggag

SEQ ID NO: 5492012 - DNA, 19 bp, Homo sapiens
ggaggccacgtcccacccc

SEQ ID NO: 5492013 - DNA, 15 bp, Homo sapiens
ggaggccagaggaga

SEQ ID NO: 5492014 - DNA, 18 bp, Homo sapiens
ggaggccagagtctccca

SEQ ID NO: 5492015 - DNA, 22 bp, Homo sapiens
ggaggccagagtctcccagtgg

SEQ ID NO: 5492016 - DNA, 20 bp, Homo sapiens
ggaggccagcacggtggtga

SEQ ID NO: 5492017 - DNA, 12 bp, Homo sapiens
ggaggccagcct

SEQ ID NO: 5492018 - DNA, 21 bp, Homo sapiens
ggaggccaggcgagcctgact

SEQ ID NO: 5492019 - DNA, 12 bp, Homo sapiens
ggaggccatctg

SEQ ID NO: 5492020 - DNA, 20 bp, Homo sapiens
ggaggcccagccgcaggaag

SEQ ID NO: 5492021 - DNA, 13 bp, Homo sapiens
ggaggcccagttc

SEQ ID NO: 5492022 - DNA, 15 bp, Homo sapiens
ggaggccccaaagga

SEQ ID NO: 5492023 - DNA, 22 bp, Homo sapiens
ggaggccccaaccctgtcctcc

SEQ ID NO: 5492024 - DNA, 16 bp, Homo sapiens
ggaggccccactgatg

SEQ ID NO: 5492025 - DNA, 15 bp, Homo sapiens
ggaggccccagctct

SEQ ID NO: 5492026 - DNA, 17 bp, Homo sapiens
ggaggccccagctctga

SEQ ID NO: 5492027 - DNA, 18 bp, Homo sapiens
ggaggccccctcctcacg

SEQ ID NO: 5492028 - DNA, 16 bp, Homo sapiens
ggaggcccctggccca

SEQ ID NO: 5492029 - DNA, 20 bp, Homo sapiens
ggaggcccctgggctctcac

SEQ ID NO: 5492030 - DNA, 18 bp, Homo sapiens
ggaggccctaggggagca

SEQ ID NO: 5492031 - DNA, 23 bp, Homo sapiens
ggaggccctcctgtgctggggga

SEQ ID NO: 5492032 - DNA, 19 bp, Homo sapiens
ggaggccctgcctgaccca

SEQ ID NO: 5492033 - DNA, 21 bp, Homo sapiens
ggaggccctggtgtcaggcag

SEQ ID NO: 5492034 - DNA, 18 bp, Homo sapiens
ggaggccctgttccctgg

SEQ ID NO: 5492035 - DNA, 19 bp, Homo sapiens
ggaggcccttgtcgtggga

SEQ ID NO: 5492036 - DNA, 21 bp, Homo sapiens
ggaggcccttgtcgtgggatg

SEQ ID NO: 5492037 - DNA, 20 bp, Homo sapiens
ggaggccgacgttttctccg

SEQ ID NO: 5492038 - DNA, 14 bp, Homo sapiens
ggaggccgaggcag

SEQ ID NO: 5492039 - DNA, 21 bp, Homo sapiens
ggaggccgaggcaggggctgg

SEQ ID NO: 5492040 - DNA, 13 bp, Homo sapiens
ggaggccgaggcc

SEQ ID NO: 5492041 - DNA, 18 bp, Homo sapiens
ggaggccgaggtgggcag

SEQ ID NO: 5492042 - DNA, 22 bp, Homo sapiens
ggaggccgaggtgggcagatca

SEQ ID NO: 5492043 - DNA, 16 bp, Homo sapiens
ggaggccgagtctgtc

SEQ ID NO: 5492044 - DNA, 16 bp, Homo sapiens
ggaggcctacctctcg

SEQ ID NO: 5492045 - DNA, 17 bp, Homo sapiens
ggaggcctcaccctgct

SEQ ID NO: 5492046 - DNA, 14 bp, Homo sapiens
ggaggcctcaggga

SEQ ID NO: 5492047 - DNA, 13 bp, Homo sapiens
ggaggcctgaggg

SEQ ID NO: 5492048 - DNA, 14 bp, Homo sapiens
ggaggcctgagggg

SEQ ID NO: 5492049 - DNA, 18 bp, Homo sapiens
ggaggcctgaggggcaga

SEQ ID NO: 5492050 - DNA, 10 bp, Homo sapiens
ggaggcctgg

SEQ ID NO: 5492051 - DNA, 14 bp, Homo sapiens
ggaggcctggcctt

SEQ ID NO: 5492052 - DNA, 17 bp, Homo sapiens
ggaggcctggtctggag

SEQ ID NO: 5492053 - DNA, 17 bp, Homo sapiens
ggaggccttccagctgc

SEQ ID NO: 5492054 - DNA, 19 bp, Homo sapiens
ggaggccttccagctgctg

SEQ ID NO: 5492055 - DNA, 21 bp, Homo sapiens
ggaggccttccagctgctgtc

SEQ ID NO: 5492056 - DNA, 17 bp, Homo sapiens
ggaggccttccagggac

SEQ ID NO: 5492057 - DNA, 16 bp, Homo sapiens
ggaggccttggggtgg

SEQ ID NO: 5492058 - DNA, 17 bp, Homo sapiens
ggaggcgaataaatgtt

SEQ ID NO: 5492059 - DNA, 18 bp, Homo sapiens
ggaggcgaataaatgttc

SEQ ID NO: 5492060 - DNA, 12 bp, Homo sapiens
ggaggcgagcca

SEQ ID NO: 5492061 - DNA, 13 bp, Homo sapiens
ggaggcgcaggga

SEQ ID NO: 5492062 - DNA, 12 bp, Homo sapiens
ggaggcgcccac

SEQ ID NO: 5492063 - DNA, 17 bp, Homo sapiens
ggaggcgcccacctgcc

SEQ ID NO: 5492064 - DNA, 13 bp, Homo sapiens
ggaggcgcccttg

SEQ ID NO: 5492065 - DNA, 23 bp, Homo sapiens
ggaggcgcccttggcttctgtga

SEQ ID NO: 5492066 - DNA, 16 bp, Homo sapiens
ggaggcgctcctccct

SEQ ID NO: 5492067 - DNA, 20 bp, Homo sapiens
ggaggcggaccttgtagtga

SEQ ID NO: 5492068 - DNA, 22 bp, Homo sapiens
ggaggcggacgttccagccggc

SEQ ID NO: 5492069 - DNA, 20 bp, Homo sapiens
ggaggcggagcttgcagtga

SEQ ID NO: 5492070 - DNA, 18 bp, Homo sapiens
ggaggcggcccggccagc

SEQ ID NO: 5492071 - DNA, 14 bp, Homo sapiens
ggaggcggctccag

SEQ ID NO: 5492072 - DNA, 15 bp, Homo sapiens
ggaggcggggaggag

SEQ ID NO: 5492073 - DNA, 13 bp, Homo sapiens
ggaggcggggctc

SEQ ID NO: 5492074 - DNA, 16 bp, Homo sapiens
ggaggcggtgcggcag

SEQ ID NO: 5492075 - DNA, 16 bp, Homo sapiens
ggaggcgtggaggaga

SEQ ID NO: 5492076 - DNA, 18 bp, Homo sapiens
ggaggcgtggaggagagg

SEQ ID NO: 5492077 - DNA, 16 bp, Homo sapiens
ggaggctaagcctgga

SEQ ID NO: 5492078 - DNA, 17 bp, Homo sapiens
ggaggctaagcctggac

SEQ ID NO: 5492079 - DNA, 18 bp, Homo sapiens
ggaggctaagcctggaca

SEQ ID NO: 5492080 - DNA, 16 bp, Homo sapiens
ggaggctatgtggagt

SEQ ID NO: 5492081 - DNA, 15 bp, Homo sapiens
ggaggctcaggtccc

SEQ ID NO: 5492082 - DNA, 13 bp, Homo sapiens
ggaggctcccaga

SEQ ID NO: 5492083 - DNA, 23 bp, Homo sapiens
ggaggctcccagacccagggcag

SEQ ID NO: 5492084 - DNA, 16 bp, Homo sapiens
ggaggctcccggggcc

SEQ ID NO: 5492085 - DNA, 23 bp, Homo sapiens
ggaggctcccggggcctggacag

SEQ ID NO: 5492086 - DNA, 19 bp, Homo sapiens
ggaggctcctccctctgcc

SEQ ID NO: 5492087 - DNA, 19 bp, Homo sapiens
ggaggctcctctaggccct

SEQ ID NO: 5492088 - DNA, 20 bp, Homo sapiens
ggaggctcctggtggggcag

SEQ ID NO: 5492089 - DNA, 21 bp, Homo sapiens
ggaggctcctgtggtagtcct

SEQ ID NO: 5492090 - DNA, 22 bp, Homo sapiens
ggaggctcctgtggtagtcctc

SEQ ID NO: 5492091 - DNA, 10 bp, Homo sapiens
ggaggctctc

SEQ ID NO: 5492092 - DNA, 15 bp, Homo sapiens
ggaggctctggagcc

SEQ ID NO: 5492093 - DNA, 17 bp, Homo sapiens
ggaggctctggagccca

SEQ ID NO: 5492094 - DNA, 17 bp, Homo sapiens
ggaggctgactcctggt

SEQ ID NO: 5492095 - DNA, 14 bp, Homo sapiens
ggaggctgagacag

SEQ ID NO: 5492096 - DNA, 16 bp, Homo sapiens
ggaggctgagacagga

SEQ ID NO: 5492097 - DNA, 17 bp, Homo sapiens
ggaggctgaggcaccag

SEQ ID NO: 5492098 - DNA, 16 bp, Homo sapiens
ggaggctgaggcagaa

SEQ ID NO: 5492099 - DNA, 13 bp, Homo sapiens
ggaggctgcactg

SEQ ID NO: 5492100 - DNA, 18 bp, Homo sapiens
ggaggctgcactggagcc

SEQ ID NO: 5492101 - DNA, 19 bp, Homo sapiens
ggaggctgcactggagcca

SEQ ID NO: 5492102 - DNA, 13 bp, Homo sapiens
ggaggctgcagag

SEQ ID NO: 5492103 - DNA, 20 bp, Homo sapiens
ggaggctgcagagctgaccc

SEQ ID NO: 5492104 - DNA, 21 bp, Homo sapiens
ggaggctgcagagctgaccca

SEQ ID NO: 5492105 - DNA, 12 bp, Homo sapiens
ggaggctgcagc

SEQ ID NO: 5492106 - DNA, 19 bp, Homo sapiens
ggagggggtgagaggcagg

SEQ ID NO: 5492107 - DNA, 22 bp, Homo sapiens
ggagggggtttgctggggaact

SEQ ID NO: 5492108 - DNA, 14 bp, Homo sapiens
ggaggggtaaatat

SEQ ID NO: 5492109 - DNA, 18 bp, Homo sapiens
ggaggggtaaatatatgt

SEQ ID NO: 5492110 - DNA, 23 bp, Homo sapiens
ggaggggtaacttgcacctctga

SEQ ID NO: 5492111 - DNA, 18 bp, Homo sapiens
ggaggggtaggggctggg

SEQ ID NO: 5492112 - DNA, 19 bp, Homo sapiens
ggaggggtcagctctggcc

SEQ ID NO: 5492113 - DNA, 15 bp, Homo sapiens
ggaggggtggcccag

SEQ ID NO: 5492114 - DNA, 16 bp, Homo sapiens
ggaggggtggcccaga

SEQ ID NO: 5492115 - DNA, 18 bp, Homo sapiens
ggaggggtggtacttggc

SEQ ID NO: 5492116 - DNA, 16 bp, Homo sapiens
ggaggggtgtgggcac

SEQ ID NO: 5492117 - DNA, 17 bp, Homo sapiens
ggaggggttgccacagg

SEQ ID NO: 5492118 - DNA, 18 bp, Homo sapiens
ggaggggttgccacaggc

SEQ ID NO: 5492119 - DNA, 19 bp, Homo sapiens
ggaggggttgccacaggcc

SEQ ID NO: 5492120 - DNA, 20 bp, Homo sapiens
ggagggtaaataaaccactg

SEQ ID NO: 5492121 - DNA, 15 bp, Homo sapiens
ggagggtaggcagga

SEQ ID NO: 5492122 - DNA, 13 bp, Homo sapiens
ggagggtagggga

SEQ ID NO: 5492123 - DNA, 16 bp, Homo sapiens
ggagggtcaccaggtt

SEQ ID NO: 5492124 - DNA, 12 bp, Homo sapiens
ggagggtcagtg

SEQ ID NO: 5492125 - DNA, 19 bp, Homo sapiens
ggagggtctagaggcctga

SEQ ID NO: 5492126 - DNA, 18 bp, Homo sapiens
ggagggtcttttaccctg

SEQ ID NO: 5492127 - DNA, 23 bp, Homo sapiens
ggagggtgacccacagctctggg

SEQ ID NO: 5492128 - DNA, 21 bp, Homo sapiens
ggagggtgacgggggtgaact

SEQ ID NO: 5492129 - DNA, 21 bp, Homo sapiens
ggagggtgcagtatctcttgc

SEQ ID NO: 5492130 - DNA, 15 bp, Homo sapiens
ggagggtgcccctgg

SEQ ID NO: 5492131 - DNA, 20 bp, Homo sapiens
ggagggtgccctcctagctc

SEQ ID NO: 5492132 - DNA, 15 bp, Homo sapiens
ggagggtggcagaga

SEQ ID NO: 5492133 - DNA, 18 bp, Homo sapiens
ggagggtggcagagacag

SEQ ID NO: 5492134 - DNA, 14 bp, Homo sapiens
ggagggtgggaagg

SEQ ID NO: 5492135 - DNA, 22 bp, Homo sapiens
ggagggtggggcaatggggaga

SEQ ID NO: 5492136 - DNA, 18 bp, Homo sapiens
ggagggtggggccgggtg

SEQ ID NO: 5492137 - DNA, 15 bp, Homo sapiens
ggagggttgccatgg

SEQ ID NO: 5492138 - DNA, 20 bp, Homo sapiens
ggagggttggcctgagttag

SEQ ID NO: 5492139 - DNA, 20 bp, Homo sapiens
ggagggtttcattgtctgtg

SEQ ID NO: 5492140 - DNA, 15 bp, Homo sapiens
ggagggtttctctcc

SEQ ID NO: 5492141 - DNA, 15 bp, Homo sapiens
ggaggtaaaggatga

SEQ ID NO: 5492142 - DNA, 13 bp, Homo sapiens
ggaggtagagagg

SEQ ID NO: 5492143 - DNA, 21 bp, Homo sapiens
ggaggtagagaggggactggg

SEQ ID NO: 5492144 - DNA, 13 bp, Homo sapiens
ggaggtagggctg

SEQ ID NO: 5492145 - DNA, 20 bp, Homo sapiens
ggaggtcaagatcagcctgg

SEQ ID NO: 5492146 - DNA, 23 bp, Homo sapiens
ggaggtcaagcctgcagcgagct

SEQ ID NO: 5492147 - DNA, 16 bp, Homo sapiens
ggaggtcacagctgga

SEQ ID NO: 5492148 - DNA, 18 bp, Homo sapiens
ggaggtcacagctggatc

SEQ ID NO: 5492149 - DNA, 21 bp, Homo sapiens
ggaggtcacagctggatctgc

SEQ ID NO: 5492150 - DNA, 20 bp, Homo sapiens
ggaggtcacattcaggaaga

SEQ ID NO: 5492151 - DNA, 23 bp, Homo sapiens
ggaggtcacctgccgccctgtgg

SEQ ID NO: 5492152 - DNA, 17 bp, Homo sapiens
ggaggtcactggaaagg

SEQ ID NO: 5492153 - DNA, 21 bp, Homo sapiens
ggaggtcatctggcggaggtc

SEQ ID NO: 5492154 - DNA, 21 bp, Homo sapiens
ggaggtcattttttaaatcca

SEQ ID NO: 5492155 - DNA, 13 bp, Homo sapiens
ggaggtccaagca

SEQ ID NO: 5492156 - DNA, 18 bp, Homo sapiens
ggaggtcccagacatgct

SEQ ID NO: 5492157 - DNA, 23 bp, Homo sapiens
ggaggtcccagacatgctgccca

SEQ ID NO: 5492158 - DNA, 14 bp, Homo sapiens
ggaggtcccagccc

SEQ ID NO: 5492159 - DNA, 14 bp, Homo sapiens
ggaggtcccaggaa

SEQ ID NO: 5492160 - DNA, 16 bp, Homo sapiens
ggaggtcccaggaagt

SEQ ID NO: 5492161 - DNA, 17 bp, Homo sapiens
ggaggtcccaggaagtc

SEQ ID NO: 5492162 - DNA, 14 bp, Homo sapiens
ggaggtcccagggc

SEQ ID NO: 5492163 - DNA, 15 bp, Homo sapiens
ggaggtcccagggcc

SEQ ID NO: 5492164 - DNA, 16 bp, Homo sapiens
ggaggtcccagggccc

SEQ ID NO: 5492165 - DNA, 22 bp, Homo sapiens
ggaggtccctggtcggagaggg

SEQ ID NO: 5492166 - DNA, 19 bp, Homo sapiens
ggaggtcctttggacagct

SEQ ID NO: 5492167 - DNA, 22 bp, Homo sapiens
ggaggtcgaccccaaagcccct

SEQ ID NO: 5492168 - DNA, 14 bp, Homo sapiens
ggaggtcgaggcag

SEQ ID NO: 5492169 - DNA, 16 bp, Homo sapiens
ggaggtcgaggcagga

SEQ ID NO: 5492170 - DNA, 21 bp, Homo sapiens
ggaggtctccactgaggatgt

SEQ ID NO: 5492171 - DNA, 12 bp, Homo sapiens
ggaggtctctgg

SEQ ID NO: 5492172 - DNA, 17 bp, Homo sapiens
ggaggtctggctgagcc

SEQ ID NO: 5492173 - DNA, 17 bp, Homo sapiens
ggaggtgaaaagggcag

SEQ ID NO: 5492174 - DNA, 14 bp, Homo sapiens
ggaggtgaccccag

SEQ ID NO: 5492175 - DNA, 18 bp, Homo sapiens
ggaggtgagagtgggagg

SEQ ID NO: 5492176 - DNA, 18 bp, Homo sapiens
ggaggtgaggggggctgg

SEQ ID NO: 5492177 - DNA, 18 bp, Homo sapiens
ggaggtgatagcattgct

SEQ ID NO: 5492178 - DNA, 17 bp, Homo sapiens
ggaggtgcagtggaggg

SEQ ID NO: 5492179 - DNA, 16 bp, Homo sapiens
ggaggtgccactggag

SEQ ID NO: 5492180 - DNA, 13 bp, Homo sapiens
ggaggtgccagga

SEQ ID NO: 5492181 - DNA, 20 bp, Homo sapiens
ggaggtgccggtaccagcct

SEQ ID NO: 5492182 - DNA, 17 bp, Homo sapiens
ggaggtgcctgagctgg

SEQ ID NO: 5492183 - DNA, 13 bp, Homo sapiens
ggaggtgcctgga

SEQ ID NO: 5492184 - DNA, 20 bp, Homo sapiens
ggaggtgcgtgttcagcaga

SEQ ID NO: 5492185 - DNA, 14 bp, Homo sapiens
ggaggtgctgcagg

SEQ ID NO: 5492186 - DNA, 14 bp, Homo sapiens
ggaggtgctgctct

SEQ ID NO: 5492187 - DNA, 14 bp, Homo sapiens
ggaggtgctggttc

SEQ ID NO: 5492188 - DNA, 17 bp, Homo sapiens
ggaggtggaagaaggga

SEQ ID NO: 5492189 - DNA, 23 bp, Homo sapiens
ggaggtggaagcagaggccctgc

SEQ ID NO: 5492190 - DNA, 20 bp, Homo sapiens
ggaggtggagattgcagtga

SEQ ID NO: 5492191 - DNA, 20 bp, Homo sapiens
ggaggtggagcttgcagtga

SEQ ID NO: 5492192 - DNA, 20 bp, Homo sapiens
ggaggtggaggctgcagtga

SEQ ID NO: 5492193 - DNA, 20 bp, Homo sapiens
ggaggtggaggctgcggtga

SEQ ID NO: 5492194 - DNA, 17 bp, Homo sapiens
ggaggtggcactaggga

SEQ ID NO: 5492195 - DNA, 15 bp, Homo sapiens
ggaggtggcagccct

SEQ ID NO: 5492196 - DNA, 13 bp, Homo sapiens
ggaggtggcaggg

SEQ ID NO: 5492197 - DNA, 22 bp, Homo sapiens
ggaggtggcgccccctggtggg

SEQ ID NO: 5492198 - DNA, 16 bp, Homo sapiens
ggaggtgggagcagga

SEQ ID NO: 5492199 - DNA, 19 bp, Homo sapiens
ggaggtgggaggccaggcg

SEQ ID NO: 5492200 - DNA, 20 bp, Homo sapiens
ggaggtgggcatgccaccct

SEQ ID NO: 5492201 - DNA, 14 bp, Homo sapiens
ggaggtggggaagg

SEQ ID NO: 5492202 - DNA, 15 bp, Homo sapiens
ggaggtggggcctca

SEQ ID NO: 5492203 - DNA, 14 bp, Homo sapiens
ggaggtgggggctg

SEQ ID NO: 5492204 - DNA, 22 bp, Homo sapiens
ggaggtgggtgtgggtggaagg

SEQ ID NO: 5492205 - DNA, 12 bp, Homo sapiens
ggaggtggtcct

SEQ ID NO: 5492206 - DNA, 17 bp, Homo sapiens
ggaggtggtgaattttt

SEQ ID NO: 5492207 - DNA, 14 bp, Homo sapiens
ggaggtggtggagg

SEQ ID NO: 5492208 - DNA, 15 bp, Homo sapiens
ggaggtggtggagga

SEQ ID NO: 5492209 - DNA, 18 bp, Homo sapiens
ggaggtggtggaggagga

SEQ ID NO: 5492210 - DNA, 16 bp, Homo sapiens
ggaggtgtctcaggct

SEQ ID NO: 5492211 - DNA, 18 bp, Homo sapiens
ggaggtgtctcaggctgc

SEQ ID NO: 5492212 - DNA, 20 bp, Homo sapiens
ggaggtgtctcaggctgcct

SEQ ID NO: 5492213 - DNA, 22 bp, Homo sapiens
ggaggtgtctcaggctgcctga

SEQ ID NO: 5492214 - DNA, 14 bp, Homo sapiens
ggaggtgtctgggg

SEQ ID NO: 5492215 - DNA, 13 bp, Homo sapiens
ggaggtgtgaatg

SEQ ID NO: 5492216 - DNA, 15 bp, Homo sapiens
ggaggtgtgaggcag

SEQ ID NO: 5492217 - DNA, 21 bp, Homo sapiens
ggaggtgtgatagagcctttg

SEQ ID NO: 5492218 - DNA, 21 bp, Homo sapiens
ggaggttcgggattccctggt

SEQ ID NO: 5492219 - DNA, 14 bp, Homo sapiens
ggaggttctcagag

SEQ ID NO: 5492220 - DNA, 21 bp, Homo sapiens
ggaggttgcagtgagctgaga

SEQ ID NO: 5492221 - DNA, 17 bp, Homo sapiens
ggaggttggagggaaag

SEQ ID NO: 5492222 - DNA, 15 bp, Homo sapiens
ggaggttgggtgggc

SEQ ID NO: 5492223 - DNA, 14 bp, Homo sapiens
ggaggttgtgcatg

SEQ ID NO: 5492224 - DNA, 22 bp, Homo sapiens
ggaggtttaccggttgtttaga

SEQ ID NO: 5492225 - DNA, 20 bp, Homo sapiens
ggaggtttaggtcaagaaga

SEQ ID NO: 5492226 - DNA, 21 bp, Homo sapiens
ggaggtttccttttggaacat

SEQ ID NO: 5492227 - DNA, 19 bp, Homo sapiens
ggagtaaacggcccaggcc

SEQ ID NO: 5492228 - DNA, 11 bp, Homo sapiens
ggagtaaatat

SEQ ID NO: 5492229 - DNA, 22 bp, Homo sapiens
ggagtaaatatatatgtcaata

SEQ ID NO: 5492230 - DNA, 21 bp, Homo sapiens
ggagtaagaaatgggcctcag

SEQ ID NO: 5492231 - DNA, 16 bp, Homo sapiens
ggagtaagacaagtgg

SEQ ID NO: 5492232 - DNA, 16 bp, Homo sapiens
ggagtaagcccaagct

SEQ ID NO: 5492233 - DNA, 15 bp, Homo sapiens
ggagtaagtgtacaa

SEQ ID NO: 5492234 - DNA, 16 bp, Homo sapiens
ggagtaagtgtacaat

SEQ ID NO: 5492235 - DNA, 18 bp, Homo sapiens
ggagtaatctgtgtacaa

SEQ ID NO: 5492236 - DNA, 14 bp, Homo sapiens
ggagtaattgcaca

SEQ ID NO: 5492237 - DNA, 15 bp, Homo sapiens
ggagtacaaaacaat

SEQ ID NO: 5492238 - DNA, 17 bp, Homo sapiens
ggagtacaggtgaagca

SEQ ID NO: 5492239 - DNA, 14 bp, Homo sapiens
ggagtacccagcct

SEQ ID NO: 5492240 - DNA, 15 bp, Homo sapiens
ggagtacccagccta

SEQ ID NO: 5492241 - DNA, 13 bp, Homo sapiens
ggagtacctgctg

SEQ ID NO: 5492242 - DNA, 16 bp, Homo sapiens
ggagtacggctggtgt

SEQ ID NO: 5492243 - DNA, 20 bp, Homo sapiens
ggagtagacccctggctggt

SEQ ID NO: 5492244 - DNA, 15 bp, Homo sapiens
ggagtagcctggact

SEQ ID NO: 5492245 - DNA, 17 bp, Homo sapiens
ggagtagcctggactgt

SEQ ID NO: 5492246 - DNA, 21 bp, Homo sapiens
ggagtaggctccagacaggag

SEQ ID NO: 5492247 - DNA, 12 bp, Homo sapiens
ggagtagtggag

SEQ ID NO: 5492248 - DNA, 12 bp, Homo sapiens
ggagtagttgga

SEQ ID NO: 5492249 - DNA, 17 bp, Homo sapiens
ggagtatgtctgatgga

SEQ ID NO: 5492250 - DNA, 17 bp, Homo sapiens
ggagtattatggaaatc

SEQ ID NO: 5492251 - DNA, 13 bp, Homo sapiens
ggagtattgaatg

SEQ ID NO: 5492252 - DNA, 21 bp, Homo sapiens
ggagtatttggaagcaacgtg

SEQ ID NO: 5492253 - DNA, 16 bp, Homo sapiens
ggagtattttaagtct

SEQ ID NO: 5492254 - DNA, 16 bp, Homo sapiens
ggagtcaagtgtgcct

SEQ ID NO: 5492255 - DNA, 13 bp, Homo sapiens
ggagtcacacagt

SEQ ID NO: 5492256 - DNA, 21 bp, Homo sapiens
ggagtcacagatgaggccccc

SEQ ID NO: 5492257 - DNA, 22 bp, Homo sapiens
ggagtcagatgagcaaggacat

SEQ ID NO: 5492258 - DNA, 18 bp, Homo sapiens
ggagtcagatgaggccct

SEQ ID NO: 5492259 - DNA, 13 bp, Homo sapiens
ggagtcaggcccg

SEQ ID NO: 5492260 - DNA, 19 bp, Homo sapiens
ggagtcaggcctgggcagg

SEQ ID NO: 5492261 - DNA, 18 bp, Homo sapiens
ggagtcaggcttctcttg

SEQ ID NO: 5492262 - DNA, 13 bp, Homo sapiens
ggagtcagggagc

SEQ ID NO: 5492263 - DNA, 22 bp, Homo sapiens
ggagtcagggctgtgctttccg

SEQ ID NO: 5492264 - DNA, 18 bp, Homo sapiens
ggagtcaggggctctgtg

SEQ ID NO: 5492265 - DNA, 15 bp, Homo sapiens
ggagtcagtagccag

SEQ ID NO: 5492266 - DNA, 16 bp, Homo sapiens
ggagtcagtagccaga

SEQ ID NO: 5492267 - DNA, 16 bp, Homo sapiens
ggagtcagtctctttc

SEQ ID NO: 5492268 - DNA, 15 bp, Homo sapiens
ggagtcagtgtctgg

SEQ ID NO: 5492269 - DNA, 18 bp, Homo sapiens
ggagtccaaaccttctac

SEQ ID NO: 5492270 - DNA, 15 bp, Homo sapiens
ggagtccactgcctc

SEQ ID NO: 5492271 - DNA, 22 bp, Homo sapiens
ggagtccactttcctctctctc

SEQ ID NO: 5492272 - DNA, 11 bp, Homo sapiens
ggagtccagac

SEQ ID NO: 5492273 - DNA, 12 bp, Homo sapiens
ggagtccagacc

SEQ ID NO: 5492274 - DNA, 15 bp, Homo sapiens
ggagtccagacctgg

SEQ ID NO: 5492275 - DNA, 21 bp, Homo sapiens
ggagtccagacctgggccctg

SEQ ID NO: 5492276 - DNA, 22 bp, Homo sapiens
ggagtccagacctgggccctgg

SEQ ID NO: 5492277 - DNA, 14 bp, Homo sapiens
ggagtccagcccct

SEQ ID NO: 5492278 - DNA, 16 bp, Homo sapiens
ggagtccagcccctcc

SEQ ID NO: 5492279 - DNA, 15 bp, Homo sapiens
ggagtccagctctac

SEQ ID NO: 5492280 - DNA, 20 bp, Homo sapiens
ggagtccaggacaggagatg

SEQ ID NO: 5492281 - DNA, 19 bp, Homo sapiens
ggagtccaggcccccagcc

SEQ ID NO: 5492282 - DNA, 22 bp, Homo sapiens
ggagtccaggcccccagcccct

SEQ ID NO: 5492283 - DNA, 23 bp, Homo sapiens
ggagtccaggcccccagcccctc

SEQ ID NO: 5492284 - DNA, 18 bp, Homo sapiens
ggagtttgagacaagccc

SEQ ID NO: 5492285 - DNA, 21 bp, Homo sapiens
ggagtttgagacaagccctgg

SEQ ID NO: 5492286 - DNA, 13 bp, Homo sapiens
ggagtttgaggct

SEQ ID NO: 5492287 - DNA, 15 bp, Homo sapiens
ggagtttgaggctgc

SEQ ID NO: 5492288 - DNA, 20 bp, Homo sapiens
ggagtttgaggctgcagcga

SEQ ID NO: 5492289 - DNA, 22 bp, Homo sapiens
ggagtttgctgttgaggtggct

SEQ ID NO: 5492290 - DNA, 13 bp, Homo sapiens
ggagtttggccag

SEQ ID NO: 5492291 - DNA, 15 bp, Homo sapiens
ggagtttggccagaa

SEQ ID NO: 5492292 - DNA, 15 bp, Homo sapiens
ggagttttgctctct

SEQ ID NO: 5492293 - DNA, 17 bp, Homo sapiens
ggagttttgtttcctct

SEQ ID NO: 5492294 - DNA, 11 bp, Homo sapiens
ggagtttttgt

SEQ ID NO: 5492295 - DNA, 16 bp, Homo sapiens
ggagtttttttataca

SEQ ID NO: 5492296 - DNA, 13 bp, Homo sapiens
ggataaaaaagaa

SEQ ID NO: 5492297 - DNA, 15 bp, Homo sapiens
ggataaaaagatgtt

SEQ ID NO: 5492298 - DNA, 21 bp, Homo sapiens
ggataaaaagccagggctgga

SEQ ID NO: 5492299 - DNA, 15 bp, Homo sapiens
ggataaaaaggaagg

SEQ ID NO: 5492300 - DNA, 17 bp, Homo sapiens
ggataaaaaggaaggag

SEQ ID NO: 5492301 - DNA, 22 bp, Homo sapiens
ggataaaacattagaagaaaac

SEQ ID NO: 5492302 - DNA, 19 bp, Homo sapiens
ggataaaataatgctgcaa

SEQ ID NO: 5492303 - DNA, 21 bp, Homo sapiens
ggataaaccaccctctgggga

SEQ ID NO: 5492304 - DNA, 22 bp, Homo sapiens
ggataaaccaccctctggggac

SEQ ID NO: 5492305 - DNA, 19 bp, Homo sapiens
ggataaagaaaagacattt

SEQ ID NO: 5492306 - DNA, 22 bp, Homo sapiens
ggataaagaatactatttccaa

SEQ ID NO: 5492307 - DNA, 12 bp, Homo sapiens
ggataaagacag

SEQ ID NO: 5492308 - DNA, 13 bp, Homo sapiens
ggataaagcagct

SEQ ID NO: 5492309 - DNA, 17 bp, Homo sapiens
ggataaagccacttctg

SEQ ID NO: 5492310 - DNA, 21 bp, Homo sapiens
ggataaataataaaggttcta

SEQ ID NO: 5492311 - DNA, 12 bp, Homo sapiens
ggataaatcatt

SEQ ID NO: 5492312 - DNA, 13 bp, Homo sapiens
ggataaatttaaa

SEQ ID NO: 5492313 - DNA, 17 bp, Homo sapiens
ggataaattttttgacc

SEQ ID NO: 5492314 - DNA, 16 bp, Homo sapiens
ggataacaaaatcaca

SEQ ID NO: 5492315 - DNA, 18 bp, Homo sapiens
ggataacaaaatcacaag

SEQ ID NO: 5492316 - DNA, 14 bp, Homo sapiens
ggataacaaagata

SEQ ID NO: 5492317 - DNA, 16 bp, Homo sapiens
ggataacaaagatatc

SEQ ID NO: 5492318 - DNA, 20 bp, Homo sapiens
ggataacaaagatatctttt

SEQ ID NO: 5492319 - DNA, 12 bp, Homo sapiens
ggataacaccac

SEQ ID NO: 5492320 - DNA, 20 bp, Homo sapiens
ggataaccccaggcactgtt

SEQ ID NO: 5492321 - DNA, 23 bp, Homo sapiens
ggataactgatttctatggcttt

SEQ ID NO: 5492322 - DNA, 17 bp, Homo sapiens
ggataacttccttgccc

SEQ ID NO: 5492323 - DNA, 21 bp, Homo sapiens
ggataacttccttgcccctgc

SEQ ID NO: 5492324 - DNA, 23 bp, Homo sapiens
ggataacttccttgcccctgctc

SEQ ID NO: 5492325 - DNA, 20 bp, Homo sapiens
ggataactttacagaaatgg

SEQ ID NO: 5492326 - DNA, 15 bp, Homo sapiens
ggataagaaaaatgc

SEQ ID NO: 5492327 - DNA, 23 bp, Homo sapiens
ggataagctatccgtgttgcagg

SEQ ID NO: 5492328 - DNA, 13 bp, Homo sapiens
ggataaggcagtt

SEQ ID NO: 5492329 - DNA, 17 bp, Homo sapiens
ggataagtggctgtttc

SEQ ID NO: 5492330 - DNA, 10 bp, Homo sapiens
ggataataaa

SEQ ID NO: 5492331 - DNA, 22 bp, Homo sapiens
ggataataaggaaaagtttaat

SEQ ID NO: 5492332 - DNA, 14 bp, Homo sapiens
ggataataggaatt

SEQ ID NO: 5492333 - DNA, 18 bp, Homo sapiens
ggataatatatttgcaga

SEQ ID NO: 5492334 - DNA, 17 bp, Homo sapiens
ggataatgggagacagt

SEQ ID NO: 5492335 - DNA, 19 bp, Homo sapiens
ggataatggtgaacatttt

SEQ ID NO: 5492336 - DNA, 14 bp, Homo sapiens
ggataatgtcatta

SEQ ID NO: 5492337 - DNA, 14 bp, Homo sapiens
ggataattagcatc

SEQ ID NO: 5492338 - DNA, 15 bp, Homo sapiens
ggatacagagccacg

SEQ ID NO: 5492339 - DNA, 21 bp, Homo sapiens
ggataccagatagctcaatac

SEQ ID NO: 5492340 - DNA, 15 bp, Homo sapiens
ggataccagctcagg

SEQ ID NO: 5492341 - DNA, 19 bp, Homo sapiens
ggataccccaaagtccagg

SEQ ID NO: 5492342 - DNA, 21 bp, Homo sapiens
ggatacgcatcagacagatgg

SEQ ID NO: 5492343 - DNA, 22 bp, Homo sapiens
ggatactccatggggtgggggt

SEQ ID NO: 5492344 - DNA, 20 bp, Homo sapiens
ggatactgcttattttatga

SEQ ID NO: 5492345 - DNA, 17 bp, Homo sapiens
ggatactggcacagagg

SEQ ID NO: 5492346 - DNA, 13 bp, Homo sapiens
ggatactgtactg

SEQ ID NO: 5492347 - DNA, 21 bp, Homo sapiens
ggatacttagtggtatgtctc

SEQ ID NO: 5492348 - DNA, 13 bp, Homo sapiens
ggatacttcctgg

SEQ ID NO: 5492349 - DNA, 12 bp, Homo sapiens
ggatagaaaaaa

SEQ ID NO: 5492350 - DNA, 13 bp, Homo sapiens
ggatagagcagcc

SEQ ID NO: 5492351 - DNA, 14 bp, Homo sapiens
ggatagatgctggc

SEQ ID NO: 5492352 - DNA, 21 bp, Homo sapiens
ggatagatgctggcccagggc

SEQ ID NO: 5492353 - DNA, 13 bp, Homo sapiens
ggatagcctttgt

SEQ ID NO: 5492354 - DNA, 18 bp, Homo sapiens
ggatagcgaatgcactca

SEQ ID NO: 5492355 - DNA, 16 bp, Homo sapiens
ggatagcgctcccctt

SEQ ID NO: 5492356 - DNA, 18 bp, Homo sapiens
ggataggaaaaatgagta

SEQ ID NO: 5492357 - DNA, 22 bp, Homo sapiens
ggataggactccatttctttct

SEQ ID NO: 5492358 - DNA, 12 bp, Homo sapiens
ggataggagaag

SEQ ID NO: 5492359 - DNA, 17 bp, Homo sapiens
ggataggagcttccaga

SEQ ID NO: 5492360 - DNA, 20 bp, Homo sapiens
ggataggagggtgcccctgg

SEQ ID NO: 5492361 - DNA, 14 bp, Homo sapiens
ggataggggcagag

SEQ ID NO: 5492362 - DNA, 16 bp, Homo sapiens
ggatagtctgggtcag

SEQ ID NO: 5492363 - DNA, 21 bp, Homo sapiens
ggatagtctgggtcagaccca

SEQ ID NO: 5492364 - DNA, 17 bp, Homo sapiens
ggatagtgttctgctcc

SEQ ID NO: 5492365 - DNA, 19 bp, Homo sapiens
ggatagtgttctgctcctg

SEQ ID NO: 5492366 - DNA, 16 bp, Homo sapiens
ggatagttgctatttt

SEQ ID NO: 5492367 - DNA, 18 bp, Homo sapiens
ggatagttgctccgcctc

SEQ ID NO: 5492368 - DNA, 21 bp, Homo sapiens
ggatagtttgggggaacttgt

SEQ ID NO: 5492369 - DNA, 15 bp, Homo sapiens
ggatataaaacacat

SEQ ID NO: 5492370 - DNA, 12 bp, Homo sapiens
ggatataaaatg

SEQ ID NO: 5492371 - DNA, 15 bp, Homo sapiens
ggatataatctgaat

SEQ ID NO: 5492372 - DNA, 18 bp, Homo sapiens
ggatataatgtgtgcttt

SEQ ID NO: 5492373 - DNA, 19 bp, Homo sapiens
ggatatataggctattttc

SEQ ID NO: 5492374 - DNA, 16 bp, Homo sapiens
ggatatatttgaaata

SEQ ID NO: 5492375 - DNA, 14 bp, Homo sapiens
ggatatcagggcac

SEQ ID NO: 5492376 - DNA, 21 bp, Homo sapiens
ggatatcattttaaaaacttt

SEQ ID NO: 5492377 - DNA, 22 bp, Homo sapiens
ggatatccatgagctgcactga

SEQ ID NO: 5492378 - DNA, 21 bp, Homo sapiens
ggatatctttacaagcaggca

SEQ ID NO: 5492379 - DNA, 15 bp, Homo sapiens
ggatatgaaaaatga

SEQ ID NO: 5492380 - DNA, 16 bp, Homo sapiens
ggatatgattggttca

SEQ ID NO: 5492381 - DNA, 17 bp, Homo sapiens
ggatatgccctcctggt

SEQ ID NO: 5492382 - DNA, 13 bp, Homo sapiens
ggatatgctgctt

SEQ ID NO: 5492383 - DNA, 17 bp, Homo sapiens
ggatatgctttaagaca

SEQ ID NO: 5492384 - DNA, 16 bp, Homo sapiens
ggatatggcaggactc

SEQ ID NO: 5492385 - DNA, 22 bp, Homo sapiens
ggatatggcaggactcctggca

SEQ ID NO: 5492386 - DNA, 12 bp, Homo sapiens
ggatatggtctt

SEQ ID NO: 5492387 - DNA, 15 bp, Homo sapiens
ggatatggtgcagag

SEQ ID NO: 5492388 - DNA, 21 bp, Homo sapiens
ggatatgtccagtcatcctgc

SEQ ID NO: 5492389 - DNA, 20 bp, Homo sapiens
ggatatgttatactgaacca

SEQ ID NO: 5492390 - DNA, 20 bp, Homo sapiens
ggatatgttgtattaactgg

SEQ ID NO: 5492391 - DNA, 13 bp, Homo sapiens
ggatattagatgc

SEQ ID NO: 5492392 - DNA, 21 bp, Homo sapiens
ggatattaggccagttgaagt

SEQ ID NO: 5492393 - DNA, 17 bp, Homo sapiens
ggatattatagaaaatt

SEQ ID NO: 5492394 - DNA, 14 bp, Homo sapiens
ggatattcaagcct

SEQ ID NO: 5492395 - DNA, 15 bp, Homo sapiens
ggatattccaaaata

SEQ ID NO: 5492396 - DNA, 12 bp, Homo sapiens
ggatattgcctt

SEQ ID NO: 5492397 - DNA, 11 bp, Homo sapiens
ggatatttaac

SEQ ID NO: 5492398 - DNA, 12 bp, Homo sapiens
ggatatttcaaa

SEQ ID NO: 5492399 - DNA, 13 bp, Homo sapiens
ggatatttcaaat

SEQ ID NO: 5492400 - DNA, 17 bp, Homo sapiens
ggatatttgagtcactt

SEQ ID NO: 5492401 - DNA, 18 bp, Homo sapiens
ggatatttgatatttggt

SEQ ID NO: 5492402 - DNA, 19 bp, Homo sapiens
ggatatttgatatttggtt

SEQ ID NO: 5492403 - DNA, 19 bp, Homo sapiens
ggatatttgtactgtttaa

SEQ ID NO: 5492404 - DNA, 19 bp, Homo sapiens
ggatatttgtcaacagatt

SEQ ID NO: 5492405 - DNA, 15 bp, Homo sapiens
ggatattttaaattc

SEQ ID NO: 5492406 - DNA, 16 bp, Homo sapiens
ggatattttcttaaaa

SEQ ID NO: 5492407 - DNA, 21 bp, Homo sapiens
ggatattttgaaatgaacttt

SEQ ID NO: 5492408 - DNA, 16 bp, Homo sapiens
ggatatttttaattta

SEQ ID NO: 5492409 - DNA, 21 bp, Homo sapiens
ggatattttttggtgtgccct

SEQ ID NO: 5492410 - DNA, 21 bp, Homo sapiens
ggatcaaacctttctggcctg

SEQ ID NO: 5492411 - DNA, 17 bp, Homo sapiens
ggatcaaccaagttaca

SEQ ID NO: 5492412 - DNA, 16 bp, Homo sapiens
ggatcaagcagaaaac

SEQ ID NO: 5492413 - DNA, 20 bp, Homo sapiens
ggatcaagcttgtgtacttg

SEQ ID NO: 5492414 - DNA, 14 bp, Homo sapiens
ggatcaaggagcgc

SEQ ID NO: 5492415 - DNA, 18 bp, Homo sapiens
ggatcaagttcagccacc

SEQ ID NO: 5492416 - DNA, 13 bp, Homo sapiens
ggatcaatacaca

SEQ ID NO: 5492417 - DNA, 13 bp, Homo sapiens
ggatcaattttca

SEQ ID NO: 5492418 - DNA, 14 bp, Homo sapiens
ggatcacaagatgg

SEQ ID NO: 5492419 - DNA, 21 bp, Homo sapiens
ggatcacacctcagtgggaag

SEQ ID NO: 5492420 - DNA, 22 bp, Homo sapiens
ggatcacacctcagtgggaaga

SEQ ID NO: 5492421 - DNA, 18 bp, Homo sapiens
ggatcacagcctcacccc

SEQ ID NO: 5492422 - DNA, 20 bp, Homo sapiens
ggatcacagcctcacccctg

SEQ ID NO: 5492423 - DNA, 21 bp, Homo sapiens
ggatcacagcctcacccctgc

SEQ ID NO: 5492424 - DNA, 23 bp, Homo sapiens
ggatcacagcctcacccctgccc

SEQ ID NO: 5492425 - DNA, 16 bp, Homo sapiens
ggatcacagcctctga

SEQ ID NO: 5492426 - DNA, 13 bp, Homo sapiens
ggatcacagggcc

SEQ ID NO: 5492427 - DNA, 14 bp, Homo sapiens
ggatcacagggccc

SEQ ID NO: 5492428 - DNA, 16 bp, Homo sapiens
ggatcaccccagcccc

SEQ ID NO: 5492429 - DNA, 17 bp, Homo sapiens
ggatcaccccagccccc

SEQ ID NO: 5492430 - DNA, 18 bp, Homo sapiens
ggatcaccccagccccca

SEQ ID NO: 5492431 - DNA, 17 bp, Homo sapiens
ggatcacctgaggtcag

SEQ ID NO: 5492432 - DNA, 20 bp, Homo sapiens
ggatcactctctgctggcag

SEQ ID NO: 5492433 - DNA, 14 bp, Homo sapiens
ggatcactggagcc

SEQ ID NO: 5492434 - DNA, 20 bp, Homo sapiens
ggatcacttgggcccaggag

SEQ ID NO: 5492435 - DNA, 22 bp, Homo sapiens
ggatcagaaagagttcagtaag

SEQ ID NO: 5492436 - DNA, 17 bp, Homo sapiens
ggatcagaacagcagag

SEQ ID NO: 5492437 - DNA, 18 bp, Homo sapiens
ggatcagaagtaggaagg

SEQ ID NO: 5492438 - DNA, 15 bp, Homo sapiens
ggatcagagcaggac

SEQ ID NO: 5492439 - DNA, 22 bp, Homo sapiens
ggatcagagcaggacctccctt

SEQ ID NO: 5492440 - DNA, 19 bp, Homo sapiens
ggatcagagcgcacaggga

SEQ ID NO: 5492441 - DNA, 16 bp, Homo sapiens
ggatcagatagcagga

SEQ ID NO: 5492442 - DNA, 16 bp, Homo sapiens
ggatcagatgaactct

SEQ ID NO: 5492443 - DNA, 17 bp, Homo sapiens
ggatcagattcttgctg

SEQ ID NO: 5492444 - DNA, 23 bp, Homo sapiens
ggatcagcaacccttcctgctgc

SEQ ID NO: 5492445 - DNA, 15 bp, Homo sapiens
ggatcagcagggcag

SEQ ID NO: 5492446 - DNA, 13 bp, Homo sapiens
ggatcagccagga

SEQ ID NO: 5492447 - DNA, 12 bp, Homo sapiens
ggatcagccccg

SEQ ID NO: 5492448 - DNA, 12 bp, Homo sapiens
ggatcagctttg

SEQ ID NO: 5492449 - DNA, 12 bp, Homo sapiens
ggatcaggagcc

SEQ ID NO: 5492450 - DNA, 13 bp, Homo sapiens
ggatcaggctgct

SEQ ID NO: 5492451 - DNA, 20 bp, Homo sapiens
ggatcagggaatccagctcc

SEQ ID NO: 5492452 - DNA, 20 bp, Homo sapiens
ggatcagttgccccccatca

SEQ ID NO: 5492453 - DNA, 17 bp, Homo sapiens
ggatcatagcttgtttt

SEQ ID NO: 5492454 - DNA, 18 bp, Homo sapiens
ggatcatagtcgggcata

SEQ ID NO: 5492455 - DNA, 13 bp, Homo sapiens
ggatcatatgaat

SEQ ID NO: 5492456 - DNA, 21 bp, Homo sapiens
ggatcatatgaccattgaaaa

SEQ ID NO: 5492457 - DNA, 18 bp, Homo sapiens
ggatcatcatgcagctca

SEQ ID NO: 5492458 - DNA, 12 bp, Homo sapiens
ggatcatgaaag

SEQ ID NO: 5492459 - DNA, 21 bp, Homo sapiens
ggatcatgaggtcaggagttc

SEQ ID NO: 5492460 - DNA, 12 bp, Homo sapiens
ggatcattgcat

SEQ ID NO: 5492461 - DNA, 15 bp, Homo sapiens
ggatccacacctggt

SEQ ID NO: 5492462 - DNA, 20 bp, Homo sapiens
ggatccacgacgcttaaata

SEQ ID NO: 5492463 - DNA, 14 bp, Homo sapiens
ggatgcccctggcc

SEQ ID NO: 5492464 - DNA, 15 bp, Homo sapiens
ggatgcccctggccc

SEQ ID NO: 5492465 - DNA, 16 bp, Homo sapiens
ggatgcccctggccct

SEQ ID NO: 5492466 - DNA, 12 bp, Homo sapiens
ggatgccctgga

SEQ ID NO: 5492467 - DNA, 12 bp, Homo sapiens
ggatgccctgtt

SEQ ID NO: 5492468 - DNA, 19 bp, Homo sapiens
ggatgccctgttgggggct

SEQ ID NO: 5492469 - DNA, 14 bp, Homo sapiens
ggatgcccttcccc

SEQ ID NO: 5492470 - DNA, 19 bp, Homo sapiens
ggatgcctggtggcagctg

SEQ ID NO: 5492471 - DNA, 21 bp, Homo sapiens
ggatgccttcccctgggccct

SEQ ID NO: 5492472 - DNA, 16 bp, Homo sapiens
ggatgccttttctgtg

SEQ ID NO: 5492473 - DNA, 19 bp, Homo sapiens
ggatgcgagcttggccttg

SEQ ID NO: 5492474 - DNA, 16 bp, Homo sapiens
ggatgcgcagtgcctt

SEQ ID NO: 5492475 - DNA, 13 bp, Homo sapiens
ggatgcggctttc

SEQ ID NO: 5492476 - DNA, 19 bp, Homo sapiens
ggatgcggctttctctgcc

SEQ ID NO: 5492477 - DNA, 15 bp, Homo sapiens
ggatgcgtgggcaga

SEQ ID NO: 5492478 - DNA, 17 bp, Homo sapiens
ggatgcgtgggcagagg

SEQ ID NO: 5492479 - DNA, 20 bp, Homo sapiens
ggatgcgtgttccagccaaa

SEQ ID NO: 5492480 - DNA, 19 bp, Homo sapiens
ggatgctagccccagagat

SEQ ID NO: 5492481 - DNA, 13 bp, Homo sapiens
ggatgctcagtga

SEQ ID NO: 5492482 - DNA, 13 bp, Homo sapiens
ggatgctccaggg

SEQ ID NO: 5492483 - DNA, 19 bp, Homo sapiens
ggatgctccagggcagcct

SEQ ID NO: 5492484 - DNA, 18 bp, Homo sapiens
ggatgctcccccagggaa

SEQ ID NO: 5492485 - DNA, 17 bp, Homo sapiens
ggatgctccgaggactg

SEQ ID NO: 5492486 - DNA, 13 bp, Homo sapiens
ggatgctctcagg

SEQ ID NO: 5492487 - DNA, 17 bp, Homo sapiens
ggatgctctttcccagg

SEQ ID NO: 5492488 - DNA, 20 bp, Homo sapiens
ggatgctctttcccttttct

SEQ ID NO: 5492489 - DNA, 17 bp, Homo sapiens
ggatgctgacatcattt

SEQ ID NO: 5492490 - DNA, 15 bp, Homo sapiens
ggatgctgacccagg

SEQ ID NO: 5492491 - DNA, 18 bp, Homo sapiens
ggatgctgacccaggaat

SEQ ID NO: 5492492 - DNA, 15 bp, Homo sapiens
ggatgctgctccgcc

SEQ ID NO: 5492493 - DNA, 17 bp, Homo sapiens
ggatgctgggttctggg

SEQ ID NO: 5492494 - DNA, 17 bp, Homo sapiens
ggatgctgtgcctccca

SEQ ID NO: 5492495 - DNA, 21 bp, Homo sapiens
ggatgctgtgcctcccaagct

SEQ ID NO: 5492496 - DNA, 17 bp, Homo sapiens
ggatgcttacagtgact

SEQ ID NO: 5492497 - DNA, 17 bp, Homo sapiens
ggatggaaacttcctgc

SEQ ID NO: 5492498 - DNA, 20 bp, Homo sapiens
ggatggaacgggcatgggcc

SEQ ID NO: 5492499 - DNA, 15 bp, Homo sapiens
ggatggaagaaagaa

SEQ ID NO: 5492500 - DNA, 17 bp, Homo sapiens
ggatggaagcaggacag

SEQ ID NO: 5492501 - DNA, 15 bp, Homo sapiens
ggatggaaggagaga

SEQ ID NO: 5492502 - DNA, 14 bp, Homo sapiens
ggatggaagtgtct

SEQ ID NO: 5492503 - DNA, 19 bp, Homo sapiens
ggatggacagaatgatgga

SEQ ID NO: 5492504 - DNA, 20 bp, Homo sapiens
ggatggacagacacctcccc

SEQ ID NO: 5492505 - DNA, 15 bp, Homo sapiens
ggatggacagatgga

SEQ ID NO: 5492506 - DNA, 18 bp, Homo sapiens
ggatggacagatggacca

SEQ ID NO: 5492507 - DNA, 22 bp, Homo sapiens
ggatggacagatggaccaaaag

SEQ ID NO: 5492508 - DNA, 15 bp, Homo sapiens
ggatggacagtgggc

SEQ ID NO: 5492509 - DNA, 18 bp, Homo sapiens
ggatggaccaacctgctc

SEQ ID NO: 5492510 - DNA, 21 bp, Homo sapiens
ggatggaccctcgcagcaggt

SEQ ID NO: 5492511 - DNA, 22 bp, Homo sapiens
ggatggacgctgccgggagact

SEQ ID NO: 5492512 - DNA, 22 bp, Homo sapiens
ggatggactcttctcggctcag

SEQ ID NO: 5492513 - DNA, 14 bp, Homo sapiens
ggatggagagcagc

SEQ ID NO: 5492514 - DNA, 17 bp, Homo sapiens
ggatggagatgggaagg

SEQ ID NO: 5492515 - DNA, 21 bp, Homo sapiens
ggatggagcaagctcttccct

SEQ ID NO: 5492516 - DNA, 21 bp, Homo sapiens
ggatggagcccagttggaaaa

SEQ ID NO: 5492517 - DNA, 14 bp, Homo sapiens
ggatggagctggag

SEQ ID NO: 5492518 - DNA, 17 bp, Homo sapiens
ggatggaggagaaataa

SEQ ID NO: 5492519 - DNA, 14 bp, Homo sapiens
ggatggaggagaag

SEQ ID NO: 5492520 - DNA, 13 bp, Homo sapiens
ggatggaggccag

SEQ ID NO: 5492521 - DNA, 16 bp, Homo sapiens
ggatggaggccagagt

SEQ ID NO: 5492522 - DNA, 19 bp, Homo sapiens
ggatggatcttttctaaat

SEQ ID NO: 5492523 - DNA, 14 bp, Homo sapiens
ggatggcacaatga

SEQ ID NO: 5492524 - DNA, 15 bp, Homo sapiens
ggatggcacaatgaa

SEQ ID NO: 5492525 - DNA, 15 bp, Homo sapiens
ggatggcaccagagg

SEQ ID NO: 5492526 - DNA, 18 bp, Homo sapiens
ggatggcaccctggaacc

SEQ ID NO: 5492527 - DNA, 12 bp, Homo sapiens
ggatggcagact

SEQ ID NO: 5492528 - DNA, 18 bp, Homo sapiens
ggatggcaggatccaagg

SEQ ID NO: 5492529 - DNA, 14 bp, Homo sapiens
ggatggcagtggct

SEQ ID NO: 5492530 - DNA, 17 bp, Homo sapiens
ggatggcatttggtctc

SEQ ID NO: 5492531 - DNA, 20 bp, Homo sapiens
ggatggcatttggtctcagg

SEQ ID NO: 5492532 - DNA, 13 bp, Homo sapiens
ggatggccagtgt

SEQ ID NO: 5492533 - DNA, 15 bp, Homo sapiens
ggatggcccagggtg

SEQ ID NO: 5492534 - DNA, 13 bp, Homo sapiens
ggatggccccagc

SEQ ID NO: 5492535 - DNA, 18 bp, Homo sapiens
ggatggcccctccttgca

SEQ ID NO: 5492536 - DNA, 15 bp, Homo sapiens
ggatggcccttcctc

SEQ ID NO: 5492537 - DNA, 20 bp, Homo sapiens
ggatggcccttcctcctcca

SEQ ID NO: 5492538 - DNA, 23 bp, Homo sapiens
ggatggcccttcctcctccacca

SEQ ID NO: 5492539 - DNA, 12 bp, Homo sapiens
ggatggccgtgg

SEQ ID NO: 5492540 - DNA, 14 bp, Homo sapiens
ggatggcctctggg

SEQ ID NO: 5492541 - DNA, 15 bp, Homo sapiens
ggatggcgggtgggg

SEQ ID NO: 5492542 - DNA, 23 bp, Homo sapiens
ggatggcgggtgggggtggaata

SEQ ID NO: 5492543 - DNA, 14 bp, Homo sapiens
ggatgggaacactg

SEQ ID NO: 5492544 - DNA, 13 bp, Homo sapiens
ggatgggaagatg

SEQ ID NO: 5492545 - DNA, 18 bp, Homo sapiens
ggatgggaatttgtcagc

SEQ ID NO: 5492546 - DNA, 21 bp, Homo sapiens
ggatgggacagggaggccaca

SEQ ID NO: 5492547 - DNA, 11 bp, Homo sapiens
ggatgggactc

SEQ ID NO: 5492548 - DNA, 14 bp, Homo sapiens
ggatgggaggagag

SEQ ID NO: 5492549 - DNA, 16 bp, Homo sapiens
ggatgggaggagagcc

SEQ ID NO: 5492550 - DNA, 15 bp, Homo sapiens
ggatgggaggctcct

SEQ ID NO: 5492551 - DNA, 16 bp, Homo sapiens
ggatgggaggctcctg

SEQ ID NO: 5492552 - DNA, 13 bp, Homo sapiens
ggatgggaggttg

SEQ ID NO: 5492553 - DNA, 19 bp, Homo sapiens
ggatgggatcccaggccag

SEQ ID NO: 5492554 - DNA, 21 bp, Homo sapiens
ggatgggatcccaggccaggg

SEQ ID NO: 5492555 - DNA, 14 bp, Homo sapiens
ggatgggcacaggc

SEQ ID NO: 5492556 - DNA, 15 bp, Homo sapiens
ggatgggcacaggct

SEQ ID NO: 5492557 - DNA, 21 bp, Homo sapiens
ggatgggccctatgtctcagg

SEQ ID NO: 5492558 - DNA, 11 bp, Homo sapiens
ggatgggcctt

SEQ ID NO: 5492559 - DNA, 15 bp, Homo sapiens
ggatgggctcccacc

SEQ ID NO: 5492560 - DNA, 18 bp, Homo sapiens
ggatgggctcccaccctc

SEQ ID NO: 5492561 - DNA, 22 bp, Homo sapiens
ggatgggctgagctagcctcca

SEQ ID NO: 5492562 - DNA, 16 bp, Homo sapiens
ggatgggctgcagcag

SEQ ID NO: 5492563 - DNA, 18 bp, Homo sapiens
ggatgggctttctcagtg

SEQ ID NO: 5492564 - DNA, 18 bp, Homo sapiens
ggatggggacatttgaac

SEQ ID NO: 5492565 - DNA, 19 bp, Homo sapiens
ggatggggagaatggtcaa

SEQ ID NO: 5492566 - DNA, 15 bp, Homo sapiens
ggatggggaggggct

SEQ ID NO: 5492567 - DNA, 17 bp, Homo sapiens
ggatggggaggggctct

SEQ ID NO: 5492568 - DNA, 19 bp, Homo sapiens
ggatggggagtcccaaagc

SEQ ID NO: 5492569 - DNA, 15 bp, Homo sapiens
ggatggggcacggac

SEQ ID NO: 5492570 - DNA, 19 bp, Homo sapiens
ggatggggcagagcttctc

SEQ ID NO: 5492571 - DNA, 19 bp, Homo sapiens
ggatggggcggcctgcaga

SEQ ID NO: 5492572 - DNA, 20 bp, Homo sapiens
ggatgggggaaatggtgcct

SEQ ID NO: 5492573 - DNA, 17 bp, Homo sapiens
ggatgggggatgggcca

SEQ ID NO: 5492574 - DNA, 17 bp, Homo sapiens
ggatgggggatgtggcc

SEQ ID NO: 5492575 - DNA, 22 bp, Homo sapiens
ggatgggggctggcctctggct

SEQ ID NO: 5492576 - DNA, 16 bp, Homo sapiens
ggatggggttctggaa

SEQ ID NO: 5492577 - DNA, 17 bp, Homo sapiens
ggatggggttctggaaa

SEQ ID NO: 5492578 - DNA, 22 bp, Homo sapiens
ggatggggttcttgtccacggg

SEQ ID NO: 5492579 - DNA, 18 bp, Homo sapiens
ggatggggttgggctctg

SEQ ID NO: 5492580 - DNA, 16 bp, Homo sapiens
ggatgggtccagaaga

SEQ ID NO: 5492581 - DNA, 18 bp, Homo sapiens
ggatgggtcccctccgcc

SEQ ID NO: 5492582 - DNA, 12 bp, Homo sapiens
ggatgggtgggg

SEQ ID NO: 5492583 - DNA, 19 bp, Homo sapiens
ggatggtctccacctgtgc

SEQ ID NO: 5492584 - DNA, 20 bp, Homo sapiens
ggatggtctcgatctcctga

SEQ ID NO: 5492585 - DNA, 21 bp, Homo sapiens
ggatggtgacttttgaagaac

SEQ ID NO: 5492586 - DNA, 19 bp, Homo sapiens
ggatggtgatggagaggga

SEQ ID NO: 5492587 - DNA, 17 bp, Homo sapiens
ggatggtgcatgggctc

SEQ ID NO: 5492588 - DNA, 22 bp, Homo sapiens
ggatggtggactacaaaataca

SEQ ID NO: 5492589 - DNA, 16 bp, Homo sapiens
ggatggtggcacaggc

SEQ ID NO: 5492590 - DNA, 18 bp, Homo sapiens
ggatggtgggcaggatct

SEQ ID NO: 5492591 - DNA, 17 bp, Homo sapiens
ggatggtgggcttcagg

SEQ ID NO: 5492592 - DNA, 20 bp, Homo sapiens
ggatggtggggcccccagca

SEQ ID NO: 5492593 - DNA, 18 bp, Homo sapiens
ggatggtggttattttaa

SEQ ID NO: 5492594 - DNA, 16 bp, Homo sapiens
ggatggtgtcctgagg

SEQ ID NO: 5492595 - DNA, 19 bp, Homo sapiens
ggatggtgtcctgaggcct

SEQ ID NO: 5492596 - DNA, 15 bp, Homo sapiens
ggatggtgttcaaaa

SEQ ID NO: 5492597 - DNA, 19 bp, Homo sapiens
ggatggttccccaggagga

SEQ ID NO: 5492598 - DNA, 11 bp, Homo sapiens
ggatggtttgt

SEQ ID NO: 5492599 - DNA, 18 bp, Homo sapiens
ggatgtaaacagtgcctg

SEQ ID NO: 5492600 - DNA, 21 bp, Homo sapiens
ggatgtaaacagtgcctgctg

SEQ ID NO: 5492601 - DNA, 14 bp, Homo sapiens
ggatgtaaagcggg

SEQ ID NO: 5492602 - DNA, 23 bp, Homo sapiens
ggatgtaaatcctgagctcaaat

SEQ ID NO: 5492603 - DNA, 14 bp, Homo sapiens
ggatgtaaggcctt

SEQ ID NO: 5492604 - DNA, 21 bp, Homo sapiens
ggatgtacaaggacagcccct

SEQ ID NO: 5492605 - DNA, 18 bp, Homo sapiens
ggatgtactgttgaaaaa

SEQ ID NO: 5492606 - DNA, 15 bp, Homo sapiens
ggatgtactgtttgc

SEQ ID NO: 5492607 - DNA, 11 bp, Homo sapiens
ggatgtagaac

SEQ ID NO: 5492608 - DNA, 13 bp, Homo sapiens
ggatgtagaactt

SEQ ID NO: 5492609 - DNA, 23 bp, Homo sapiens
ggatgtatccatgggggcagggc

SEQ ID NO: 5492610 - DNA, 15 bp, Homo sapiens
ggatgtcaggcccag

SEQ ID NO: 5492611 - DNA, 20 bp, Homo sapiens
ggatgtcccatctgctcctc

SEQ ID NO: 5492612 - DNA, 15 bp, Homo sapiens
ggatgtccccagcag

SEQ ID NO: 5492613 - DNA, 20 bp, Homo sapiens
ggatgtcccctgtcccacca

SEQ ID NO: 5492614 - DNA, 14 bp, Homo sapiens
ggatgtccctgggc

SEQ ID NO: 5492615 - DNA, 18 bp, Homo sapiens
ggatgtccctgggccagg

SEQ ID NO: 5492616 - DNA, 23 bp, Homo sapiens
ggatgtccctgggccagggtctg

SEQ ID NO: 5492617 - DNA, 13 bp, Homo sapiens
ggatgtctgggcc

SEQ ID NO: 5492618 - DNA, 18 bp, Homo sapiens
ggatgtctgttgaaataa

SEQ ID NO: 5492619 - DNA, 16 bp, Homo sapiens
ggatgtgaagaaataa

SEQ ID NO: 5492620 - DNA, 13 bp, Homo sapiens
ggatgtgagcccc

SEQ ID NO: 5492621 - DNA, 16 bp, Homo sapiens
ggatgtgcccacaggg

SEQ ID NO: 5492622 - DNA, 14 bp, Homo sapiens
ggatgtgctggagg

SEQ ID NO: 5492623 - DNA, 16 bp, Homo sapiens
ggatgtgctggagggg

SEQ ID NO: 5492624 - DNA, 12 bp, Homo sapiens
ggatgtgctttc

SEQ ID NO: 5492625 - DNA, 17 bp, Homo sapiens
ggatgtggaaagcactt

SEQ ID NO: 5492626 - DNA, 18 bp, Homo sapiens
ggatgtggaacctgttta

SEQ ID NO: 5492627 - DNA, 17 bp, Homo sapiens
ggatgtggcaggggcag

SEQ ID NO: 5492628 - DNA, 22 bp, Homo sapiens
ggatgtggccaggggtgctcct

SEQ ID NO: 5492629 - DNA, 17 bp, Homo sapiens
ggatgtggctgcagcag

SEQ ID NO: 5492630 - DNA, 15 bp, Homo sapiens
ggatgtgggagggag

SEQ ID NO: 5492631 - DNA, 14 bp, Homo sapiens
ggatgtgggcagct

SEQ ID NO: 5492632 - DNA, 19 bp, Homo sapiens
ggatgtgggtaagaggagc

SEQ ID NO: 5492633 - DNA, 19 bp, Homo sapiens
ggatgtgggttccacagac

SEQ ID NO: 5492634 - DNA, 18 bp, Homo sapiens
ggatgtggttttcttaag

SEQ ID NO: 5492635 - DNA, 13 bp, Homo sapiens
ggatgtgtaaatg

SEQ ID NO: 5492636 - DNA, 18 bp, Homo sapiens
ggatgtgtagccttctcc

SEQ ID NO: 5492637 - DNA, 22 bp, Homo sapiens
ggatgtgtcctagactccgggt

SEQ ID NO: 5492638 - DNA, 15 bp, Homo sapiens
ggatgtgtgctttcc

SEQ ID NO: 5492639 - DNA, 17 bp, Homo sapiens
ggatgtgtgggccagga

SEQ ID NO: 5492640 - DNA, 23 bp, Homo sapiens
ggatgttagacttgctccctctc

SEQ ID NO: 5492641 - DNA, 19 bp, Homo sapiens
ggatgttatgaacagctgt

SEQ ID NO: 5492642 - DNA, 15 bp, Homo sapiens
ggattttttcccttt

SEQ ID NO: 5492643 - DNA, 15 bp, Homo sapiens
ggatttttttgttct

SEQ ID NO: 5492644 - DNA, 21 bp, Homo sapiens
ggatttttttgttttctgatg

SEQ ID NO: 5492645 - DNA, 17 bp, Homo sapiens
ggcaaaaaaaaaaatta

SEQ ID NO: 5492646 - DNA, 15 bp, Homo sapiens
ggcaaaaaaattaaa

SEQ ID NO: 5492647 - DNA, 17 bp, Homo sapiens
ggcaaaaaagggacagc

SEQ ID NO: 5492648 - DNA, 11 bp, Homo sapiens
ggcaaaaacaa

SEQ ID NO: 5492649 - DNA, 21 bp, Homo sapiens
ggcaaaaatgcaacaaatgaa

SEQ ID NO: 5492650 - DNA, 16 bp, Homo sapiens
ggcaaaaatgtgccct

SEQ ID NO: 5492651 - DNA, 15 bp, Homo sapiens
ggcaaaacaggaagg

SEQ ID NO: 5492652 - DNA, 12 bp, Homo sapiens
ggcaaaaccagt

SEQ ID NO: 5492653 - DNA, 13 bp, Homo sapiens
ggcaaaacccagg

SEQ ID NO: 5492654 - DNA, 23 bp, Homo sapiens
ggcaaaaccttgtgactcagtgt

SEQ ID NO: 5492655 - DNA, 10 bp, Homo sapiens
ggcaaaataa

SEQ ID NO: 5492656 - DNA, 14 bp, Homo sapiens
ggcaaaataaaaca

SEQ ID NO: 5492657 - DNA, 18 bp, Homo sapiens
ggcaaaatcttgttaatg

SEQ ID NO: 5492658 - DNA, 12 bp, Homo sapiens
ggcaaacaatcc

SEQ ID NO: 5492659 - DNA, 18 bp, Homo sapiens
ggcaaacagggcctctgc

SEQ ID NO: 5492660 - DNA, 22 bp, Homo sapiens
ggcaaacattttctcttagaaa

SEQ ID NO: 5492661 - DNA, 17 bp, Homo sapiens
ggcaaaccaggctgcag

SEQ ID NO: 5492662 - DNA, 16 bp, Homo sapiens
ggcaaacccttctctt

SEQ ID NO: 5492663 - DNA, 15 bp, Homo sapiens
ggcaaacgggcttga

SEQ ID NO: 5492664 - DNA, 13 bp, Homo sapiens
ggcaaactctcta

SEQ ID NO: 5492665 - DNA, 15 bp, Homo sapiens
ggcaaagaaaggaga

SEQ ID NO: 5492666 - DNA, 16 bp, Homo sapiens
ggcaaagacagaagcc

SEQ ID NO: 5492667 - DNA, 18 bp, Homo sapiens
ggcaaagataatttattt

SEQ ID NO: 5492668 - DNA, 20 bp, Homo sapiens
ggcaaagccacaaggctggc

SEQ ID NO: 5492669 - DNA, 22 bp, Homo sapiens
ggcaaagccacaaggctggcca

SEQ ID NO: 5492670 - DNA, 11 bp, Homo sapiens
ggcaaagccag

SEQ ID NO: 5492671 - DNA, 22 bp, Homo sapiens
ggcaaagctgatttttttttta

SEQ ID NO: 5492672 - DNA, 14 bp, Homo sapiens
ggcaaagctgctgg

SEQ ID NO: 5492673 - DNA, 20 bp, Homo sapiens
ggcaaagctgctgggccagt

SEQ ID NO: 5492674 - DNA, 21 bp, Homo sapiens
ggcaaagctgctgggccagtg

SEQ ID NO: 5492675 - DNA, 17 bp, Homo sapiens
ggcaaaggacatgaaca

SEQ ID NO: 5492676 - DNA, 21 bp, Homo sapiens
ggcaaagggagcagaactgaa

SEQ ID NO: 5492677 - DNA, 19 bp, Homo sapiens
ggcaaagggtccagaagga

SEQ ID NO: 5492678 - DNA, 12 bp, Homo sapiens
ggcaaagggtct

SEQ ID NO: 5492679 - DNA, 19 bp, Homo sapiens
ggcaaaggtccctgagctc

SEQ ID NO: 5492680 - DNA, 21 bp, Homo sapiens
ggcaaagtacttgtcatagac

SEQ ID NO: 5492681 - DNA, 24 bp, Homo sapiens
ggcaaagtttaaatgtattttaca

SEQ ID NO: 5492682 - DNA, 23 bp, Homo sapiens
ggcaaagttttacagagaggata

SEQ ID NO: 5492683 - DNA, 12 bp, Homo sapiens
ggcaaataaaga

SEQ ID NO: 5492684 - DNA, 18 bp, Homo sapiens
ggcaaatcaggggccaga

SEQ ID NO: 5492685 - DNA, 16 bp, Homo sapiens
ggcaaatcagttacta

SEQ ID NO: 5492686 - DNA, 20 bp, Homo sapiens
ggcaaatccgaaatcagcag

SEQ ID NO: 5492687 - DNA, 16 bp, Homo sapiens
ggcaaatctaaaattt

SEQ ID NO: 5492688 - DNA, 11 bp, Homo sapiens
ggcaaatctcc

SEQ ID NO: 5492689 - DNA, 13 bp, Homo sapiens
ggcaaatgagcct

SEQ ID NO: 5492690 - DNA, 21 bp, Homo sapiens
ggcaaatgagccttaagaaat

SEQ ID NO: 5492691 - DNA, 15 bp, Homo sapiens
ggcaaatgccagggc

SEQ ID NO: 5492692 - DNA, 15 bp, Homo sapiens
ggcaaatggctgaga

SEQ ID NO: 5492693 - DNA, 17 bp, Homo sapiens
ggcaaatgtccaagcat

SEQ ID NO: 5492694 - DNA, 13 bp, Homo sapiens
ggcaaattaaaca

SEQ ID NO: 5492695 - DNA, 15 bp, Homo sapiens
ggcaaattaaacaat

SEQ ID NO: 5492696 - DNA, 19 bp, Homo sapiens
ggcaaattaaacaatataa

SEQ ID NO: 5492697 - DNA, 20 bp, Homo sapiens
ggcaaattaacttgagtttt

SEQ ID NO: 5492698 - DNA, 12 bp, Homo sapiens
ggcaaattctga

SEQ ID NO: 5492699 - DNA, 20 bp, Homo sapiens
ggcaaattgttcaaaaataa

SEQ ID NO: 5492700 - DNA, 19 bp, Homo sapiens
ggcaacaaaagaagcccgg

SEQ ID NO: 5492701 - DNA, 20 bp, Homo sapiens
ggcaacaagagcgaaactcc

SEQ ID NO: 5492702 - DNA, 20 bp, Homo sapiens
ggcaacacctccttgctttg

SEQ ID NO: 5492703 - DNA, 17 bp, Homo sapiens
ggcaacagagcaagact

SEQ ID NO: 5492704 - DNA, 20 bp, Homo sapiens
ggcaacagagcaagactcca

SEQ ID NO: 5492705 - DNA, 19 bp, Homo sapiens
ggcaacagagcaagatcct

SEQ ID NO: 5492706 - DNA, 16 bp, Homo sapiens
ggcaacagagtgagac

SEQ ID NO: 5492707 - DNA, 18 bp, Homo sapiens
ggcaacagatcagtaaag

SEQ ID NO: 5492708 - DNA, 20 bp, Homo sapiens
ggcaacagatcagtaaagaa

SEQ ID NO: 5492709 - DNA, 16 bp, Homo sapiens
ggcaacagggagcacc

SEQ ID NO: 5492710 - DNA, 22 bp, Homo sapiens
ggcaacataataagacttttct

SEQ ID NO: 5492711 - DNA, 16 bp, Homo sapiens
ggcaacattggacaga

SEQ ID NO: 5492712 - DNA, 23 bp, Homo sapiens
ggcaacattggacagaaaatgca

SEQ ID NO: 5492713 - DNA, 19 bp, Homo sapiens
ggcaacatttggggagaga

SEQ ID NO: 5492714 - DNA, 14 bp, Homo sapiens
ggcaaccaataaaa

SEQ ID NO: 5492715 - DNA, 21 bp, Homo sapiens
ggcaaccacaggcagcattta

SEQ ID NO: 5492716 - DNA, 16 bp, Homo sapiens
ggcaaccactaagaat

SEQ ID NO: 5492717 - DNA, 22 bp, Homo sapiens
ggcaaccatttttagaaggaaa

SEQ ID NO: 5492718 - DNA, 14 bp, Homo sapiens
ggcaaccccagacc

SEQ ID NO: 5492719 - DNA, 16 bp, Homo sapiens
ggcaaccccagttctg

SEQ ID NO: 5492720 - DNA, 23 bp, Homo sapiens
ggcaaccccagttctgctcctct

SEQ ID NO: 5492721 - DNA, 16 bp, Homo sapiens
ggcaacccccagcctg

SEQ ID NO: 5492722 - DNA, 18 bp, Homo sapiens
ggcaacccccagcctgct

SEQ ID NO: 5492723 - DNA, 21 bp, Homo sapiens
ggcaaccccctcggagcctgt

SEQ ID NO: 5492724 - DNA, 13 bp, Homo sapiens
ggcaaccctcagc

SEQ ID NO: 5492725 - DNA, 14 bp, Homo sapiens
ggcaaccctcagct

SEQ ID NO: 5492726 - DNA, 18 bp, Homo sapiens
ggcaaccgtggggaggcc

SEQ ID NO: 5492727 - DNA, 18 bp, Homo sapiens
ggcaacctgattgtaaac

SEQ ID NO: 5492728 - DNA, 15 bp, Homo sapiens
ggcaacgaagaaaaa

SEQ ID NO: 5492729 - DNA, 20 bp, Homo sapiens
ggcaacgaagaaaaaaaata

SEQ ID NO: 5492730 - DNA, 19 bp, Homo sapiens
ggcaacgattcacagcctc

SEQ ID NO: 5492731 - DNA, 16 bp, Homo sapiens
ggcaacgtagcctggg

SEQ ID NO: 5492732 - DNA, 15 bp, Homo sapiens
ggcaacgttcatgtt

SEQ ID NO: 5492733 - DNA, 18 bp, Homo sapiens
ggcaactaagcagtccct

SEQ ID NO: 5492734 - DNA, 12 bp, Homo sapiens
ggcaactcagca

SEQ ID NO: 5492735 - DNA, 19 bp, Homo sapiens
ggcaactcgtgacagcctc

SEQ ID NO: 5492736 - DNA, 21 bp, Homo sapiens
ggcaactcgtgacagcctctg

SEQ ID NO: 5492737 - DNA, 21 bp, Homo sapiens
ggcaactctggctccaggcag

SEQ ID NO: 5492738 - DNA, 14 bp, Homo sapiens
ggcaactgaacaaa

SEQ ID NO: 5492739 - DNA, 19 bp, Homo sapiens
ggcaactgaacaaaaaaat

SEQ ID NO: 5492740 - DNA, 13 bp, Homo sapiens
ggcaactgaggca

SEQ ID NO: 5492741 - DNA, 23 bp, Homo sapiens
ggcaactgaggcagacagcagct

SEQ ID NO: 5492742 - DNA, 19 bp, Homo sapiens
ggcaactggccatttgcca

SEQ ID NO: 5492743 - DNA, 19 bp, Homo sapiens
ggcaactgtattaaagaaa

SEQ ID NO: 5492744 - DNA, 14 bp, Homo sapiens
ggcaactgtggaag

SEQ ID NO: 5492745 - DNA, 21 bp, Homo sapiens
ggcaacttcagtcctgggaga

SEQ ID NO: 5492746 - DNA, 15 bp, Homo sapiens
ggcaacttgaagaaa

SEQ ID NO: 5492747 - DNA, 17 bp, Homo sapiens
ggcaacttgtgataggt

SEQ ID NO: 5492748 - DNA, 19 bp, Homo sapiens
ggcaagaaaagcgcagaga

SEQ ID NO: 5492749 - DNA, 18 bp, Homo sapiens
ggcaagaaattcattaaa

SEQ ID NO: 5492750 - DNA, 15 bp, Homo sapiens
ggcaagaaccagttg

SEQ ID NO: 5492751 - DNA, 21 bp, Homo sapiens
ggcaagaacccaagtgcctca

SEQ ID NO: 5492752 - DNA, 11 bp, Homo sapiens
ggcaagaagac

SEQ ID NO: 5492753 - DNA, 14 bp, Homo sapiens
ggcaagaagctgct

SEQ ID NO: 5492754 - DNA, 15 bp, Homo sapiens
ggcaagaagctgctt

SEQ ID NO: 5492755 - DNA, 18 bp, Homo sapiens
ggcaagaaggaattgact

SEQ ID NO: 5492756 - DNA, 17 bp, Homo sapiens
ggcaagaaggcattttt

SEQ ID NO: 5492757 - DNA, 20 bp, Homo sapiens
ggcaagacaccttcccagct

SEQ ID NO: 5492758 - DNA, 21 bp, Homo sapiens
ggcaagacagaaaagtgcctg

SEQ ID NO: 5492759 - DNA, 22 bp, Homo sapiens
ggcaagactctgccttaatttt

SEQ ID NO: 5492760 - DNA, 17 bp, Homo sapiens
ggcaagactgcaaactt

SEQ ID NO: 5492761 - DNA, 20 bp, Homo sapiens
ggcaagactgcaaacttttt

SEQ ID NO: 5492762 - DNA, 23 bp, Homo sapiens
ggcaagagaatcgcttgaaccca

SEQ ID NO: 5492763 - DNA, 17 bp, Homo sapiens
ggcaagagactgggagc

SEQ ID NO: 5492764 - DNA, 15 bp, Homo sapiens
ggcaagaggaaaatg

SEQ ID NO: 5492765 - DNA, 12 bp, Homo sapiens
ggcaagaggcct

SEQ ID NO: 5492766 - DNA, 22 bp, Homo sapiens
ggcaagaggcctcatgcctgct

SEQ ID NO: 5492767 - DNA, 19 bp, Homo sapiens
ggcaagagggaaggtgacc

SEQ ID NO: 5492768 - DNA, 12 bp, Homo sapiens
ggcaagattttc

SEQ ID NO: 5492769 - DNA, 19 bp, Homo sapiens
ggcaagcaagagctcttgt

SEQ ID NO: 5492770 - DNA, 13 bp, Homo sapiens
ggcaagcagcggg

SEQ ID NO: 5492771 - DNA, 14 bp, Homo sapiens
ggcaagcagcgggc

SEQ ID NO: 5492772 - DNA, 16 bp, Homo sapiens
ggcaagcaggacctgg

SEQ ID NO: 5492773 - DNA, 12 bp, Homo sapiens
ggcaagcaggga

SEQ ID NO: 5492774 - DNA, 13 bp, Homo sapiens
ggcaagcatgaat

SEQ ID NO: 5492775 - DNA, 21 bp, Homo sapiens
ggcaagcatgtaacttatatt

SEQ ID NO: 5492776 - DNA, 14 bp, Homo sapiens
ggcaagccacagaa

SEQ ID NO: 5492777 - DNA, 18 bp, Homo sapiens
ggcaagccacaggaagga

SEQ ID NO: 5492778 - DNA, 13 bp, Homo sapiens
ggcaagccaggct

SEQ ID NO: 5492779 - DNA, 15 bp, Homo sapiens
ggcaagccagggccc

SEQ ID NO: 5492780 - DNA, 18 bp, Homo sapiens
ggcaagccagggcccaga

SEQ ID NO: 5492781 - DNA, 22 bp, Homo sapiens
ggcaagccagggcccagagccc

SEQ ID NO: 5492782 - DNA, 23 bp, Homo sapiens
ggcaagccagggcccagagccct

SEQ ID NO: 5492783 - DNA, 14 bp, Homo sapiens
ggcaagcccctcag

SEQ ID NO: 5492784 - DNA, 17 bp, Homo sapiens
ggcaagcccctcagccc

SEQ ID NO: 5492785 - DNA, 17 bp, Homo sapiens
ggcaagcgtgctgcctc

SEQ ID NO: 5492786 - DNA, 18 bp, Homo sapiens
ggcaagcgtgttctcagc

SEQ ID NO: 5492787 - DNA, 23 bp, Homo sapiens
ggcaagctaggccccagaggccc

SEQ ID NO: 5492788 - DNA, 15 bp, Homo sapiens
ggcaagctcatagca

SEQ ID NO: 5492789 - DNA, 17 bp, Homo sapiens
ggcaagctcatagcaca

SEQ ID NO: 5492790 - DNA, 18 bp, Homo sapiens
ggcaagctccgcaggact

SEQ ID NO: 5492791 - DNA, 12 bp, Homo sapiens
ggcaagctgcag

SEQ ID NO: 5492792 - DNA, 13 bp, Homo sapiens
ggcaagctgcagg

SEQ ID NO: 5492793 - DNA, 14 bp, Homo sapiens
ggcaagctgcaggt

SEQ ID NO: 5492794 - DNA, 15 bp, Homo sapiens
ggcaagctggcagga

SEQ ID NO: 5492795 - DNA, 16 bp, Homo sapiens
ggcaagctggcaggag

SEQ ID NO: 5492796 - DNA, 16 bp, Homo sapiens
ggcaagcttgaggcca

SEQ ID NO: 5492797 - DNA, 21 bp, Homo sapiens
ggcaagcttgaggccaagatg

SEQ ID NO: 5492798 - DNA, 12 bp, Homo sapiens
ggcaaggaaaaa

SEQ ID NO: 5492799 - DNA, 17 bp, Homo sapiens
ggcaaggaaaaagaaaa

SEQ ID NO: 5492800 - DNA, 11 bp, Homo sapiens
ggcaaggaaag

SEQ ID NO: 5492801 - DNA, 11 bp, Homo sapiens
ggcaaggaaat

SEQ ID NO: 5492802 - DNA, 13 bp, Homo sapiens
ggcaaggaacaga

SEQ ID NO: 5492803 - DNA, 14 bp, Homo sapiens
ggcaaggacacaga

SEQ ID NO: 5492804 - DNA, 16 bp, Homo sapiens
ggcaaggagtttatta

SEQ ID NO: 5492805 - DNA, 21 bp, Homo sapiens
ggcaaggatgggtccagaaga

SEQ ID NO: 5492806 - DNA, 14 bp, Homo sapiens
ggcaaggatggtgg

SEQ ID NO: 5492807 - DNA, 17 bp, Homo sapiens
ggcaaggatggtggggc

SEQ ID NO: 5492808 - DNA, 14 bp, Homo sapiens
ggcaaggcaggtgc

SEQ ID NO: 5492809 - DNA, 18 bp, Homo sapiens
ggcaaggcccagacctgg

SEQ ID NO: 5492810 - DNA, 19 bp, Homo sapiens
ggcaaggcccagacctggc

SEQ ID NO: 5492811 - DNA, 14 bp, Homo sapiens
ggcaaggccctgcc

SEQ ID NO: 5492812 - DNA, 16 bp, Homo sapiens
ggcaaggctgacttct

SEQ ID NO: 5492813 - DNA, 18 bp, Homo sapiens
ggcaaggctgccggctgc

SEQ ID NO: 5492814 - DNA, 16 bp, Homo sapiens
ggcaagggaggggtgg

SEQ ID NO: 5492815 - DNA, 12 bp, Homo sapiens
ggcaagggctcc

SEQ ID NO: 5492816 - DNA, 16 bp, Homo sapiens
ggcaaggggcagccag

SEQ ID NO: 5492817 - DNA, 18 bp, Homo sapiens
ggcaaggggccaggaagg

SEQ ID NO: 5492818 - DNA, 23 bp, Homo sapiens
ggcaaggggtgaggataggacag

SEQ ID NO: 5492819 - DNA, 15 bp, Homo sapiens
ggcaaggggtgcctg

SEQ ID NO: 5492820 - DNA, 16 bp, Homo sapiens
ggcaagggtgcctcag

SEQ ID NO: 5492821 - DNA, 21 bp, Homo sapiens
ggcactgtccagggcccatgt

SEQ ID NO: 5492822 - DNA, 20 bp, Homo sapiens
ggcactgtgaactattttga

SEQ ID NO: 5492823 - DNA, 20 bp, Homo sapiens
ggcactgtgatacagttttg

SEQ ID NO: 5492824 - DNA, 21 bp, Homo sapiens
ggcactgtggaactgccacct

SEQ ID NO: 5492825 - DNA, 12 bp, Homo sapiens
ggcactgtggca

SEQ ID NO: 5492826 - DNA, 15 bp, Homo sapiens
ggcactgtggcactg

SEQ ID NO: 5492827 - DNA, 18 bp, Homo sapiens
ggcactgtggcactgcca

SEQ ID NO: 5492828 - DNA, 16 bp, Homo sapiens
ggcactgtggcccttc

SEQ ID NO: 5492829 - DNA, 16 bp, Homo sapiens
ggcactgtggtcaggc

SEQ ID NO: 5492830 - DNA, 23 bp, Homo sapiens
ggcactgtggtcaggcccagcct

SEQ ID NO: 5492831 - DNA, 21 bp, Homo sapiens
ggcactgttgtcatttccaaa

SEQ ID NO: 5492832 - DNA, 15 bp, Homo sapiens
ggcacttaagcacaa

SEQ ID NO: 5492833 - DNA, 21 bp, Homo sapiens
ggcacttaatttgtaaacttc

SEQ ID NO: 5492834 - DNA, 20 bp, Homo sapiens
ggcacttactggtccttacc

SEQ ID NO: 5492835 - DNA, 21 bp, Homo sapiens
ggcacttactggtccttacca

SEQ ID NO: 5492836 - DNA, 15 bp, Homo sapiens
ggcacttcaagcaaa

SEQ ID NO: 5492837 - DNA, 22 bp, Homo sapiens
ggcacttcaggtccgtgggccg

SEQ ID NO: 5492838 - DNA, 15 bp, Homo sapiens
ggcacttccacctcc

SEQ ID NO: 5492839 - DNA, 19 bp, Homo sapiens
ggcacttccacctccagcc

SEQ ID NO: 5492840 - DNA, 23 bp, Homo sapiens
ggcacttccacctccagcctctg

SEQ ID NO: 5492841 - DNA, 22 bp, Homo sapiens
ggcacttccattggttcttcct

SEQ ID NO: 5492842 - DNA, 13 bp, Homo sapiens
ggcacttccctgc

SEQ ID NO: 5492843 - DNA, 14 bp, Homo sapiens
ggcacttccctgct

SEQ ID NO: 5492844 - DNA, 14 bp, Homo sapiens
ggcacttcctcccc

SEQ ID NO: 5492845 - DNA, 16 bp, Homo sapiens
ggcacttgattccttg

SEQ ID NO: 5492846 - DNA, 13 bp, Homo sapiens
ggcacttggagga

SEQ ID NO: 5492847 - DNA, 18 bp, Homo sapiens
ggcacttggcagccttgt

SEQ ID NO: 5492848 - DNA, 20 bp, Homo sapiens
ggcacttgggacaaaaacaa

SEQ ID NO: 5492849 - DNA, 11 bp, Homo sapiens
ggcacttgtat

SEQ ID NO: 5492850 - DNA, 18 bp, Homo sapiens
ggcacttgtatttaattc

SEQ ID NO: 5492851 - DNA, 22 bp, Homo sapiens
ggcactttgaaggggcctcacc

SEQ ID NO: 5492852 - DNA, 14 bp, Homo sapiens
ggcactttttaatt

SEQ ID NO: 5492853 - DNA, 13 bp, Homo sapiens
ggcagaaaacaga

SEQ ID NO: 5492854 - DNA, 17 bp, Homo sapiens
ggcagaaaacagagcct

SEQ ID NO: 5492855 - DNA, 20 bp, Homo sapiens
ggcagaaaacagagcctgcc

SEQ ID NO: 5492856 - DNA, 23 bp, Homo sapiens
ggcagaaaacagagcctgcctaa

SEQ ID NO: 5492857 - DNA, 23 bp, Homo sapiens
ggcagaaaacggagagtgcttgg

SEQ ID NO: 5492858 - DNA, 17 bp, Homo sapiens
ggcagaaaagaggagac

SEQ ID NO: 5492859 - DNA, 23 bp, Homo sapiens
ggcagaaaagaggagaccctgga

SEQ ID NO: 5492860 - DNA, 17 bp, Homo sapiens
ggcagaaaattgcacaa

SEQ ID NO: 5492861 - DNA, 20 bp, Homo sapiens
ggcagaaacctatctcaggg

SEQ ID NO: 5492862 - DNA, 21 bp, Homo sapiens
ggcagaaacctatctcaggga

SEQ ID NO: 5492863 - DNA, 22 bp, Homo sapiens
ggcagaaacctatctcagggag

SEQ ID NO: 5492864 - DNA, 18 bp, Homo sapiens
ggcagaaagatggagagg

SEQ ID NO: 5492865 - DNA, 19 bp, Homo sapiens
ggcagaaagatggagaggc

SEQ ID NO: 5492866 - DNA, 20 bp, Homo sapiens
ggcagaaagatggagaggca

SEQ ID NO: 5492867 - DNA, 23 bp, Homo sapiens
ggcagaaagatggagaggcatgg

SEQ ID NO: 5492868 - DNA, 22 bp, Homo sapiens
ggcagaaagcaaatgtgacctg

SEQ ID NO: 5492869 - DNA, 15 bp, Homo sapiens
ggcagaaaggctgca

SEQ ID NO: 5492870 - DNA, 20 bp, Homo sapiens
ggcagaaaggttctgcccgg

SEQ ID NO: 5492871 - DNA, 22 bp, Homo sapiens
ggcagaaaggttctgcccggga

SEQ ID NO: 5492872 - DNA, 20 bp, Homo sapiens
ggcagaaatagttgtctgtg

SEQ ID NO: 5492873 - DNA, 14 bp, Homo sapiens
ggcagaacactaac

SEQ ID NO: 5492874 - DNA, 20 bp, Homo sapiens
ggcagaacagccgctcctgt

SEQ ID NO: 5492875 - DNA, 14 bp, Homo sapiens
ggcagaaccctggt

SEQ ID NO: 5492876 - DNA, 15 bp, Homo sapiens
ggcagaaccctggtg

SEQ ID NO: 5492877 - DNA, 21 bp, Homo sapiens
ggcagaaccggtcccagcctg

SEQ ID NO: 5492878 - DNA, 22 bp, Homo sapiens
ggcagaaccggtcccagcctgg

SEQ ID NO: 5492879 - DNA, 15 bp, Homo sapiens
ggcagaacctggtgg

SEQ ID NO: 5492880 - DNA, 14 bp, Homo sapiens
ggcagaactcccac

SEQ ID NO: 5492881 - DNA, 18 bp, Homo sapiens
ggcagaactcccacaacc

SEQ ID NO: 5492882 - DNA, 21 bp, Homo sapiens
ggcagaactcctacctgaagg

SEQ ID NO: 5492883 - DNA, 15 bp, Homo sapiens
ggcagaactctctgt

SEQ ID NO: 5492884 - DNA, 13 bp, Homo sapiens
ggcagaactgagc

SEQ ID NO: 5492885 - DNA, 15 bp, Homo sapiens
ggcagaactgagctc

SEQ ID NO: 5492886 - DNA, 23 bp, Homo sapiens
ggcagaactgctggggctggtga

SEQ ID NO: 5492887 - DNA, 19 bp, Homo sapiens
ggcagaagaagctgggagg

SEQ ID NO: 5492888 - DNA, 21 bp, Homo sapiens
ggcagaagaagctgggaggga

SEQ ID NO: 5492889 - DNA, 18 bp, Homo sapiens
ggcagaagaatctttctt

SEQ ID NO: 5492890 - DNA, 17 bp, Homo sapiens
ggcagaagaattgaacc

SEQ ID NO: 5492891 - DNA, 17 bp, Homo sapiens
ggcagaagacaccagag

SEQ ID NO: 5492892 - DNA, 21 bp, Homo sapiens
ggcagaagacaccagagcaga

SEQ ID NO: 5492893 - DNA, 19 bp, Homo sapiens
ggcagaagcttggaggagg

SEQ ID NO: 5492894 - DNA, 13 bp, Homo sapiens
ggcagaaggccag

SEQ ID NO: 5492895 - DNA, 11 bp, Homo sapiens
ggcagaaggga

SEQ ID NO: 5492896 - DNA, 14 bp, Homo sapiens
ggcagaagggaatt

SEQ ID NO: 5492897 - DNA, 15 bp, Homo sapiens
ggcagaagggagaag

SEQ ID NO: 5492898 - DNA, 16 bp, Homo sapiens
ggcagaaggggaagat

SEQ ID NO: 5492899 - DNA, 21 bp, Homo sapiens
ggcagaagtaggggaagaata

SEQ ID NO: 5492900 - DNA, 21 bp, Homo sapiens
ggcagaagtgtcaccctgtgg

SEQ ID NO: 5492901 - DNA, 21 bp, Homo sapiens
ggcagaataaaccggatcctg

SEQ ID NO: 5492902 - DNA, 18 bp, Homo sapiens
ggcagaataagaaaacaa

SEQ ID NO: 5492903 - DNA, 17 bp, Homo sapiens
ggcagaatcctgggccc

SEQ ID NO: 5492904 - DNA, 21 bp, Homo sapiens
ggcagaatcctgggcccccag

SEQ ID NO: 5492905 - DNA, 14 bp, Homo sapiens
ggcagacaagagct

SEQ ID NO: 5492906 - DNA, 14 bp, Homo sapiens
ggcagacacaaccc

SEQ ID NO: 5492907 - DNA, 20 bp, Homo sapiens
ggcagacacagggacttgaa

SEQ ID NO: 5492908 - DNA, 21 bp, Homo sapiens
ggcagacacggatctgagaat

SEQ ID NO: 5492909 - DNA, 13 bp, Homo sapiens
ggcagacagcagc

SEQ ID NO: 5492910 - DNA, 17 bp, Homo sapiens
ggcagacagcagctcag

SEQ ID NO: 5492911 - DNA, 19 bp, Homo sapiens
ggcagacagcagctcaggc

SEQ ID NO: 5492912 - DNA, 20 bp, Homo sapiens
ggcagacagcagctcaggca

SEQ ID NO: 5492913 - DNA, 23 bp, Homo sapiens
ggcagacagcaggcagcgccaag

SEQ ID NO: 5492914 - DNA, 16 bp, Homo sapiens
ggcagacaggaaggaa

SEQ ID NO: 5492915 - DNA, 15 bp, Homo sapiens
ggcagaccagagagc

SEQ ID NO: 5492916 - DNA, 17 bp, Homo sapiens
ggcagaccatctccagc

SEQ ID NO: 5492917 - DNA, 16 bp, Homo sapiens
ggcagacccagtatga

SEQ ID NO: 5492918 - DNA, 19 bp, Homo sapiens
ggcagaccctgagcagaat

SEQ ID NO: 5492919 - DNA, 16 bp, Homo sapiens
ggcagaccctggaccc

SEQ ID NO: 5492920 - DNA, 17 bp, Homo sapiens
ggcagaccgggcccccc

SEQ ID NO: 5492921 - DNA, 21 bp, Homo sapiens
ggcagacctcttagagtcctt

SEQ ID NO: 5492922 - DNA, 20 bp, Homo sapiens
ggcagacgtctgtcaggggc

SEQ ID NO: 5492923 - DNA, 18 bp, Homo sapiens
ggcagactcaaggggctg

SEQ ID NO: 5492924 - DNA, 18 bp, Homo sapiens
ggcagagaaagaagagac

SEQ ID NO: 5492925 - DNA, 18 bp, Homo sapiens
ggcagagaactgtctttc

SEQ ID NO: 5492926 - DNA, 20 bp, Homo sapiens
ggcagagaagaaagaacgga

SEQ ID NO: 5492927 - DNA, 17 bp, Homo sapiens
ggcagagaaggcttcct

SEQ ID NO: 5492928 - DNA, 14 bp, Homo sapiens
ggcagagaatctct

SEQ ID NO: 5492929 - DNA, 18 bp, Homo sapiens
ggcagagaatctcttggg

SEQ ID NO: 5492930 - DNA, 21 bp, Homo sapiens
ggcagagaatctcttgggagt

SEQ ID NO: 5492931 - DNA, 12 bp, Homo sapiens
ggcagagagaga

SEQ ID NO: 5492932 - DNA, 16 bp, Homo sapiens
ggcagagagagagaaa

SEQ ID NO: 5492933 - DNA, 17 bp, Homo sapiens
ggcagagaggaagtggt

SEQ ID NO: 5492934 - DNA, 14 bp, Homo sapiens
ggcagagaggagtg

SEQ ID NO: 5492935 - DNA, 19 bp, Homo sapiens
ggcagagagtacagactgc

SEQ ID NO: 5492936 - DNA, 21 bp, Homo sapiens
ggcagagagtacagactgcag

SEQ ID NO: 5492937 - DNA, 16 bp, Homo sapiens
ggcagagatgcctccc

SEQ ID NO: 5492938 - DNA, 22 bp, Homo sapiens
ggcagagatgcctccctgagct

SEQ ID NO: 5492939 - DNA, 21 bp, Homo sapiens
ggcagagattgggggggcttg

SEQ ID NO: 5492940 - DNA, 19 bp, Homo sapiens
ggcagagcaattccaggct

SEQ ID NO: 5492941 - DNA, 21 bp, Homo sapiens
ggcagagcaattccaggctga

SEQ ID NO: 5492942 - DNA, 23 bp, Homo sapiens
ggcagagcaattccaggctgagc

SEQ ID NO: 5492943 - DNA, 10 bp, Homo sapiens
ggcagagcag

SEQ ID NO: 5492944 - DNA, 15 bp, Homo sapiens
ggcagagcagagacc

SEQ ID NO: 5492945 - DNA, 20 bp, Homo sapiens
ggcagagccaccagggcact

SEQ ID NO: 5492946 - DNA, 17 bp, Homo sapiens
ggcagagccaggaagat

SEQ ID NO: 5492947 - DNA, 19 bp, Homo sapiens
ggcagagccatgggcctgg

SEQ ID NO: 5492948 - DNA, 12 bp, Homo sapiens
ggcagagcccaa

SEQ ID NO: 5492949 - DNA, 22 bp, Homo sapiens
ggcagagcccgcccacctgggc

SEQ ID NO: 5492950 - DNA, 15 bp, Homo sapiens
ggcagagcctctgag

SEQ ID NO: 5492951 - DNA, 22 bp, Homo sapiens
ggcagagcctttggatgaccag

SEQ ID NO: 5492952 - DNA, 23 bp, Homo sapiens
ggcagagcctttttacctggcct

SEQ ID NO: 5492953 - DNA, 19 bp, Homo sapiens
ggcagagcggggaggtgcc

SEQ ID NO: 5492954 - DNA, 21 bp, Homo sapiens
ggcagagcggggaggtgcctg

SEQ ID NO: 5492955 - DNA, 22 bp, Homo sapiens
ggcagagcggggaggtgcctga

SEQ ID NO: 5492956 - DNA, 17 bp, Homo sapiens
ggcagagctcagaggag

SEQ ID NO: 5492957 - DNA, 19 bp, Homo sapiens
ggcagagctcagcacagcc

SEQ ID NO: 5492958 - DNA, 20 bp, Homo sapiens
ggcagagctcagcacagcct

SEQ ID NO: 5492959 - DNA, 13 bp, Homo sapiens
ggcagagctctac

SEQ ID NO: 5492960 - DNA, 21 bp, Homo sapiens
ggcagagctctacaggcctgc

SEQ ID NO: 5492961 - DNA, 16 bp, Homo sapiens
ggcagagctggctctg

SEQ ID NO: 5492962 - DNA, 18 bp, Homo sapiens
ggcagagcttctcctgac

SEQ ID NO: 5492963 - DNA, 21 bp, Homo sapiens
ggcagagcttctcctgaccag

SEQ ID NO: 5492964 - DNA, 21 bp, Homo sapiens
ggcagagcttgcagtgagccg

SEQ ID NO: 5492965 - DNA, 21 bp, Homo sapiens
ggcagagcttggactggatgc

SEQ ID NO: 5492966 - DNA, 20 bp, Homo sapiens
ggcagagcttgtagccctgg

SEQ ID NO: 5492967 - DNA, 19 bp, Homo sapiens
ggcagagcttttgcatttc

SEQ ID NO: 5492968 - DNA, 21 bp, Homo sapiens
ggcagaggaatttggctgctt

SEQ ID NO: 5492969 - DNA, 13 bp, Homo sapiens
ggcagaggagagt

SEQ ID NO: 5492970 - DNA, 18 bp, Homo sapiens
ggcagaggatgtctcaaa

SEQ ID NO: 5492971 - DNA, 16 bp, Homo sapiens
ggcagaggatgttctg

SEQ ID NO: 5492972 - DNA, 13 bp, Homo sapiens
ggcagaggcaggg

SEQ ID NO: 5492973 - DNA, 15 bp, Homo sapiens
ggcagaggcagggcc

SEQ ID NO: 5492974 - DNA, 17 bp, Homo sapiens
ggcagaggcagggccct

SEQ ID NO: 5492975 - DNA, 15 bp, Homo sapiens
ggcagaggcagtacc

SEQ ID NO: 5492976 - DNA, 13 bp, Homo sapiens
ggcagaggctgga

SEQ ID NO: 5492977 - DNA, 19 bp, Homo sapiens
ggcagaggctggaggcagg

SEQ ID NO: 5492978 - DNA, 21 bp, Homo sapiens
ggcagaggctggaggcagggc

SEQ ID NO: 5492979 - DNA, 14 bp, Homo sapiens
ggcagaggctggca

SEQ ID NO: 5492980 - DNA, 20 bp, Homo sapiens
ggcagagggaatgttccctg

SEQ ID NO: 5492981 - DNA, 23 bp, Homo sapiens
ggcagagggatgaaatgccaaga

SEQ ID NO: 5492982 - DNA, 12 bp, Homo sapiens
ggcagagggctg

SEQ ID NO: 5492983 - DNA, 14 bp, Homo sapiens
ggcagaggggagag

SEQ ID NO: 5492984 - DNA, 16 bp, Homo sapiens
ggcagaggggagagga

SEQ ID NO: 5492985 - DNA, 18 bp, Homo sapiens
ggcagaggggagaggaag

SEQ ID NO: 5492986 - DNA, 16 bp, Homo sapiens
ggcagaggggagcttg

SEQ ID NO: 5492987 - DNA, 16 bp, Homo sapiens
ggcagaggggcagccg

SEQ ID NO: 5492988 - DNA, 17 bp, Homo sapiens
ggcagaggggcagccgc

SEQ ID NO: 5492989 - DNA, 18 bp, Homo sapiens
ggcagaggggcagccgct

SEQ ID NO: 5492990 - DNA, 22 bp, Homo sapiens
ggcagagggttgcagtgagccg

SEQ ID NO: 5492991 - DNA, 18 bp, Homo sapiens
ggcagaggtcccctgagg

SEQ ID NO: 5492992 - DNA, 14 bp, Homo sapiens
ggcagaggtgacag

SEQ ID NO: 5492993 - DNA, 15 bp, Homo sapiens
ggcagaggtggtctg

SEQ ID NO: 5492994 - DNA, 18 bp, Homo sapiens
ggcagaggttcatttcaa

SEQ ID NO: 5492995 - DNA, 20 bp, Homo sapiens
ggcagaggttgcagtgagcc

SEQ ID NO: 5492996 - DNA, 20 bp, Homo sapiens
ggcagaggttgcagtgagtc

SEQ ID NO: 5492997 - DNA, 20 bp, Homo sapiens
ggcagcctcaggggcctcag

SEQ ID NO: 5492998 - DNA, 17 bp, Homo sapiens
ggcagcctccagagcca

SEQ ID NO: 5492999 - DNA, 18 bp, Homo sapiens
ggcagcctccagagccag

SEQ ID NO: 5493000 - DNA, 20 bp, Homo sapiens
ggcagcctccagagccagcc

SEQ ID NO: 5493001 - DNA, 22 bp, Homo sapiens
ggcagcctccagagccagcctg

SEQ ID NO: 5493002 - DNA, 23 bp, Homo sapiens
ggcagcctccagagccagcctgg

SEQ ID NO: 5493003 - DNA, 24 bp, Homo sapiens
ggcagcctccagagccagcctggg

SEQ ID NO: 5493004 - DNA, 13 bp, Homo sapiens
ggcagcctccagt

SEQ ID NO: 5493005 - DNA, 15 bp, Homo sapiens
ggcagcctccagtct

SEQ ID NO: 5493006 - DNA, 14 bp, Homo sapiens
ggcagcctccagtg

SEQ ID NO: 5493007 - DNA, 20 bp, Homo sapiens
ggcagcctccgtcatccatg

SEQ ID NO: 5493008 - DNA, 17 bp, Homo sapiens
ggcagcctctcttcact

SEQ ID NO: 5493009 - DNA, 18 bp, Homo sapiens
ggcagcctctcttcactg

SEQ ID NO: 5493010 - DNA, 23 bp, Homo sapiens
ggcagcctctgggcccacatccg

SEQ ID NO: 5493011 - DNA, 13 bp, Homo sapiens
ggcagcctgagag

SEQ ID NO: 5493012 - DNA, 18 bp, Homo sapiens
ggcagcctgagagctggc

SEQ ID NO: 5493013 - DNA, 12 bp, Homo sapiens
ggcagcctgccg

SEQ ID NO: 5493014 - DNA, 14 bp, Homo sapiens
ggcagcctgccgcc

SEQ ID NO: 5493015 - DNA, 19 bp, Homo sapiens
ggcagcctgcgtggctgac

SEQ ID NO: 5493016 - DNA, 18 bp, Homo sapiens
ggcagcctggctcccagg

SEQ ID NO: 5493017 - DNA, 20 bp, Homo sapiens
ggcagcctggctcccaggac

SEQ ID NO: 5493018 - DNA, 21 bp, Homo sapiens
ggcagcctggctcccaggaca

SEQ ID NO: 5493019 - DNA, 22 bp, Homo sapiens
ggcagcctggctcccaggacac

SEQ ID NO: 5493020 - DNA, 21 bp, Homo sapiens
ggcagcctgtgggagaaggga

SEQ ID NO: 5493021 - DNA, 18 bp, Homo sapiens
ggcagcctgtgggtcctt

SEQ ID NO: 5493022 - DNA, 14 bp, Homo sapiens
ggcagccttgggga

SEQ ID NO: 5493023 - DNA, 20 bp, Homo sapiens
ggcagcctttttctggcctt

SEQ ID NO: 5493024 - DNA, 23 bp, Homo sapiens
ggcagcgacctcaagtgtcctga

SEQ ID NO: 5493025 - DNA, 14 bp, Homo sapiens
ggcagcgaggctgg

SEQ ID NO: 5493026 - DNA, 17 bp, Homo sapiens
ggcagcgaggctgggct

SEQ ID NO: 5493027 - DNA, 21 bp, Homo sapiens
ggcagcgcacgcggatgctac

SEQ ID NO: 5493028 - DNA, 15 bp, Homo sapiens
ggcagcgcagggctg

SEQ ID NO: 5493029 - DNA, 15 bp, Homo sapiens
ggcagcgcatgtgtg

SEQ ID NO: 5493030 - DNA, 23 bp, Homo sapiens
ggcagcgccaagcaacctgggtc

SEQ ID NO: 5493031 - DNA, 20 bp, Homo sapiens
ggcagcgccaagtgcgtgcc

SEQ ID NO: 5493032 - DNA, 18 bp, Homo sapiens
ggcagcgccactgtccgc

SEQ ID NO: 5493033 - DNA, 22 bp, Homo sapiens
ggcagcgccaggctgaccacag

SEQ ID NO: 5493034 - DNA, 15 bp, Homo sapiens
ggcagcgcccagcct

SEQ ID NO: 5493035 - DNA, 15 bp, Homo sapiens
ggcagcgcctcccgc

SEQ ID NO: 5493036 - DNA, 15 bp, Homo sapiens
ggcagcgcctgtccc

SEQ ID NO: 5493037 - DNA, 18 bp, Homo sapiens
ggcagcgcggggagcccg

SEQ ID NO: 5493038 - DNA, 15 bp, Homo sapiens
ggcagcgctcctgga

SEQ ID NO: 5493039 - DNA, 12 bp, Homo sapiens
ggcagcggcccc

SEQ ID NO: 5493040 - DNA, 17 bp, Homo sapiens
ggcagcggccccgcacc

SEQ ID NO: 5493041 - DNA, 20 bp, Homo sapiens
ggcagcggccccgcacccct

SEQ ID NO: 5493042 - DNA, 22 bp, Homo sapiens
ggcagcggccccgcacccctcc

SEQ ID NO: 5493043 - DNA, 12 bp, Homo sapiens
ggcagcgggcca

SEQ ID NO: 5493044 - DNA, 15 bp, Homo sapiens
ggcagcgggccaggc

SEQ ID NO: 5493045 - DNA, 17 bp, Homo sapiens
ggcagcgggccaggccc

SEQ ID NO: 5493046 - DNA, 13 bp, Homo sapiens
ggcagcgggcgga

SEQ ID NO: 5493047 - DNA, 14 bp, Homo sapiens
ggcagcggggctgg

SEQ ID NO: 5493048 - DNA, 16 bp, Homo sapiens
ggcagcggggctggcc

SEQ ID NO: 5493049 - DNA, 21 bp, Homo sapiens
ggcagcgtactcatcatcaac

SEQ ID NO: 5493050 - DNA, 16 bp, Homo sapiens
ggcagcgtgccgagcc

SEQ ID NO: 5493051 - DNA, 14 bp, Homo sapiens
ggcagcgtgggctc

SEQ ID NO: 5493052 - DNA, 12 bp, Homo sapiens
ggcagctaagat

SEQ ID NO: 5493053 - DNA, 22 bp, Homo sapiens
ggcagctaagatagaaagctgg

SEQ ID NO: 5493054 - DNA, 23 bp, Homo sapiens
ggcagctaagatagaaagctgga

SEQ ID NO: 5493055 - DNA, 17 bp, Homo sapiens
ggcagctagtgccttta

SEQ ID NO: 5493056 - DNA, 15 bp, Homo sapiens
ggcagctataggaaa

SEQ ID NO: 5493057 - DNA, 18 bp, Homo sapiens
ggcagctatctgcactct

SEQ ID NO: 5493058 - DNA, 17 bp, Homo sapiens
ggcagctcacccctggg

SEQ ID NO: 5493059 - DNA, 20 bp, Homo sapiens
ggcagctcacccctgggcag

SEQ ID NO: 5493060 - DNA, 22 bp, Homo sapiens
ggcagctcacccctgggcaggc

SEQ ID NO: 5493061 - DNA, 12 bp, Homo sapiens
ggcagctcacct

SEQ ID NO: 5493062 - DNA, 16 bp, Homo sapiens
ggcagctcacctctcc

SEQ ID NO: 5493063 - DNA, 14 bp, Homo sapiens
ggcagctcaggata

SEQ ID NO: 5493064 - DNA, 15 bp, Homo sapiens
ggcagctccaacagc

SEQ ID NO: 5493065 - DNA, 16 bp, Homo sapiens
ggcagctccaacagct

SEQ ID NO: 5493066 - DNA, 19 bp, Homo sapiens
ggcagctcctccctgtgcc

SEQ ID NO: 5493067 - DNA, 23 bp, Homo sapiens
ggcagctcctccctgtgccccca

SEQ ID NO: 5493068 - DNA, 23 bp, Homo sapiens
ggcagctcctcgggtggggcctg

SEQ ID NO: 5493069 - DNA, 16 bp, Homo sapiens
ggcagctcctctcctt

SEQ ID NO: 5493070 - DNA, 18 bp, Homo sapiens
ggcagctcctctgtctcg

SEQ ID NO: 5493071 - DNA, 14 bp, Homo sapiens
ggcagctctgagcc

SEQ ID NO: 5493072 - DNA, 20 bp, Homo sapiens
ggcagctcttctgggcagag

SEQ ID NO: 5493073 - DNA, 21 bp, Homo sapiens
ggcagctcttctgggcagagc

SEQ ID NO: 5493074 - DNA, 13 bp, Homo sapiens
ggcagctgaaatt

SEQ ID NO: 5493075 - DNA, 14 bp, Homo sapiens
ggcagctgagacca

SEQ ID NO: 5493076 - DNA, 17 bp, Homo sapiens
ggcagctgatccaggca

SEQ ID NO: 5493077 - DNA, 21 bp, Homo sapiens
ggcagctgcagttagcacaga

SEQ ID NO: 5493078 - DNA, 14 bp, Homo sapiens
ggcagctgccagag

SEQ ID NO: 5493079 - DNA, 13 bp, Homo sapiens
ggcagctgcccct

SEQ ID NO: 5493080 - DNA, 15 bp, Homo sapiens
ggcagctgcccctcc

SEQ ID NO: 5493081 - DNA, 20 bp, Homo sapiens
ggcagctgcccctcctggag

SEQ ID NO: 5493082 - DNA, 18 bp, Homo sapiens
ggcagctgcccctggcac

SEQ ID NO: 5493083 - DNA, 19 bp, Homo sapiens
ggcagctgcccctggcacc

SEQ ID NO: 5493084 - DNA, 22 bp, Homo sapiens
ggcagctgcccctggcacctgt

SEQ ID NO: 5493085 - DNA, 13 bp, Homo sapiens
ggcagctgcctcc

SEQ ID NO: 5493086 - DNA, 15 bp, Homo sapiens
ggcagctgcctctgc

SEQ ID NO: 5493087 - DNA, 17 bp, Homo sapiens
ggcagctgcctctgctc

SEQ ID NO: 5493088 - DNA, 21 bp, Homo sapiens
ggcagctgcctctgctccctc

SEQ ID NO: 5493089 - DNA, 20 bp, Homo sapiens
ggcagctgcctggccatgct

SEQ ID NO: 5493090 - DNA, 22 bp, Homo sapiens
ggcagctgctcttagtgcccgc

SEQ ID NO: 5493091 - DNA, 12 bp, Homo sapiens
ggcagctgctgt

SEQ ID NO: 5493092 - DNA, 10 bp, Homo sapiens
ggcagctgga

SEQ ID NO: 5493093 - DNA, 19 bp, Homo sapiens
ggcagctggaccatctctg

SEQ ID NO: 5493094 - DNA, 13 bp, Homo sapiens
ggcagctggcagg

SEQ ID NO: 5493095 - DNA, 23 bp, Homo sapiens
ggcagctggcccccagccctggg

SEQ ID NO: 5493096 - DNA, 16 bp, Homo sapiens
ggcagctggctctgaa

SEQ ID NO: 5493097 - DNA, 17 bp, Homo sapiens
ggcagctggctctgaat

SEQ ID NO: 5493098 - DNA, 12 bp, Homo sapiens
ggcagctgggcc

SEQ ID NO: 5493099 - DNA, 13 bp, Homo sapiens
ggcagctgggccc

SEQ ID NO: 5493100 - DNA, 18 bp, Homo sapiens
ggcagctgggcccaaccc

SEQ ID NO: 5493101 - DNA, 15 bp, Homo sapiens
ggcagctgggcccac

SEQ ID NO: 5493102 - DNA, 17 bp, Homo sapiens
ggcagctgggcccacag

SEQ ID NO: 5493103 - DNA, 22 bp, Homo sapiens
ggcagctgggcccacagccccc

SEQ ID NO: 5493104 - DNA, 18 bp, Homo sapiens
ggcagctgggccccacct

SEQ ID NO: 5493105 - DNA, 20 bp, Homo sapiens
ggcagctggggggctgtcct

SEQ ID NO: 5493106 - DNA, 23 bp, Homo sapiens
ggcagctggtctttattcctccc

SEQ ID NO: 5493107 - DNA, 20 bp, Homo sapiens
ggcagctgtcctgtgatgtc

SEQ ID NO: 5493108 - DNA, 16 bp, Homo sapiens
ggcagctgttgtctct

SEQ ID NO: 5493109 - DNA, 16 bp, Homo sapiens
ggcagctgtttctcat

SEQ ID NO: 5493110 - DNA, 18 bp, Homo sapiens
ggcagcttagggccctgg

SEQ ID NO: 5493111 - DNA, 17 bp, Homo sapiens
ggcagcttcaagtgcct

SEQ ID NO: 5493112 - DNA, 14 bp, Homo sapiens
ggcagcttctctgt

SEQ ID NO: 5493113 - DNA, 16 bp, Homo sapiens
ggcagcttctgccccc

SEQ ID NO: 5493114 - DNA, 13 bp, Homo sapiens
ggcagcttctttg

SEQ ID NO: 5493115 - DNA, 14 bp, Homo sapiens
ggcagcttgagcct

SEQ ID NO: 5493116 - DNA, 20 bp, Homo sapiens
ggcagcttgagcctgtcacg

SEQ ID NO: 5493117 - DNA, 13 bp, Homo sapiens
ggcagcttgcccc

SEQ ID NO: 5493118 - DNA, 14 bp, Homo sapiens
ggcagcttgggctg

SEQ ID NO: 5493119 - DNA, 14 bp, Homo sapiens
ggcagcttgtgaag

SEQ ID NO: 5493120 - DNA, 21 bp, Homo sapiens
ggcagctttaaccattaaaac

SEQ ID NO: 5493121 - DNA, 15 bp, Homo sapiens
ggcagcttttaaaag

SEQ ID NO: 5493122 - DNA, 14 bp, Homo sapiens
ggcagctttttctg

SEQ ID NO: 5493123 - DNA, 19 bp, Homo sapiens
ggcagctttttctgtggag

SEQ ID NO: 5493124 - DNA, 22 bp, Homo sapiens
ggcagctttttctgtggaggac

SEQ ID NO: 5493125 - DNA, 16 bp, Homo sapiens
ggcaggaaagcatgca

SEQ ID NO: 5493126 - DNA, 19 bp, Homo sapiens
ggcaggaaccatggacctg

SEQ ID NO: 5493127 - DNA, 22 bp, Homo sapiens
ggcaggaactgcagtatggcca

SEQ ID NO: 5493128 - DNA, 23 bp, Homo sapiens
ggcaggaactgcagtatggccat

SEQ ID NO: 5493129 - DNA, 14 bp, Homo sapiens
ggcaggaagagaga

SEQ ID NO: 5493130 - DNA, 23 bp, Homo sapiens
ggcaggaagcccaattgctggag

SEQ ID NO: 5493131 - DNA, 23 bp, Homo sapiens
ggcaggaaggagagcctgctgca

SEQ ID NO: 5493132 - DNA, 15 bp, Homo sapiens
ggcaggaaggagcgg

SEQ ID NO: 5493133 - DNA, 16 bp, Homo sapiens
ggcaggaaggagcggc

SEQ ID NO: 5493134 - DNA, 15 bp, Homo sapiens
ggcaggaagtcagga

SEQ ID NO: 5493135 - DNA, 16 bp, Homo sapiens
ggcaggaagtcaggag

SEQ ID NO: 5493136 - DNA, 21 bp, Homo sapiens
ggcaggaagtcaggagccagc

SEQ ID NO: 5493137 - DNA, 14 bp, Homo sapiens
ggcaggaagtccct

SEQ ID NO: 5493138 - DNA, 19 bp, Homo sapiens
ggcaggaatcaaggagcct

SEQ ID NO: 5493139 - DNA, 22 bp, Homo sapiens
ggcaggaatgcggttgggaggc

SEQ ID NO: 5493140 - DNA, 18 bp, Homo sapiens
ggcaggacaacgaggaag

SEQ ID NO: 5493141 - DNA, 19 bp, Homo sapiens
ggcaggacaacgaggaagc

SEQ ID NO: 5493142 - DNA, 21 bp, Homo sapiens
ggcaggacaacgaggaagccc

SEQ ID NO: 5493143 - DNA, 21 bp, Homo sapiens
ggcaggacacatcccggcctc

SEQ ID NO: 5493144 - DNA, 18 bp, Homo sapiens
ggcaggaccagcccacgc

SEQ ID NO: 5493145 - DNA, 19 bp, Homo sapiens
ggcaggaccagcccacgct

SEQ ID NO: 5493146 - DNA, 14 bp, Homo sapiens
ggcaggaccaggac

SEQ ID NO: 5493147 - DNA, 14 bp, Homo sapiens
ggcaggaccctgct

SEQ ID NO: 5493148 - DNA, 16 bp, Homo sapiens
ggcaggaccctgctga

SEQ ID NO: 5493149 - DNA, 17 bp, Homo sapiens
ggcaggaccctgctgac

SEQ ID NO: 5493150 - DNA, 17 bp, Homo sapiens
ggcaggacctgcctagc

SEQ ID NO: 5493151 - DNA, 21 bp, Homo sapiens
ggcaggactcagctccccaga

SEQ ID NO: 5493152 - DNA, 23 bp, Homo sapiens
ggcaggactcagctccccagagt

SEQ ID NO: 5493153 - DNA, 23 bp, Homo sapiens
ggcaggactcctggcagggccac

SEQ ID NO: 5493154 - DNA, 17 bp, Homo sapiens
ggcaggactgagtcccc

SEQ ID NO: 5493155 - DNA, 14 bp, Homo sapiens
ggcaggactgcaga

SEQ ID NO: 5493156 - DNA, 16 bp, Homo sapiens
ggcaggactgcagagc

SEQ ID NO: 5493157 - DNA, 19 bp, Homo sapiens
ggcaggagaatcaataaaa

SEQ ID NO: 5493158 - DNA, 15 bp, Homo sapiens
ggcaggagaatttct

SEQ ID NO: 5493159 - DNA, 15 bp, Homo sapiens
ggcaggagacactgg

SEQ ID NO: 5493160 - DNA, 23 bp, Homo sapiens
ggcaggagagtgtgtgggcaggg

SEQ ID NO: 5493161 - DNA, 17 bp, Homo sapiens
ggcaggagcacgaggtc

SEQ ID NO: 5493162 - DNA, 13 bp, Homo sapiens
ggcaggagcagga

SEQ ID NO: 5493163 - DNA, 16 bp, Homo sapiens
ggcaggagcaggaaca

SEQ ID NO: 5493164 - DNA, 22 bp, Homo sapiens
ggcaggagcaggaacagagact

SEQ ID NO: 5493165 - DNA, 13 bp, Homo sapiens
ggcaggagccttc

SEQ ID NO: 5493166 - DNA, 15 bp, Homo sapiens
ggcaggagctcagat

SEQ ID NO: 5493167 - DNA, 15 bp, Homo sapiens
ggcaggaggatcact

SEQ ID NO: 5493168 - DNA, 23 bp, Homo sapiens
ggcaggagggagggtttctctcc

SEQ ID NO: 5493169 - DNA, 14 bp, Homo sapiens
ggcaggagggaggt

SEQ ID NO: 5493170 - DNA, 14 bp, Homo sapiens
ggcaggagggcagt

SEQ ID NO: 5493171 - DNA, 20 bp, Homo sapiens
ggcaggagggcatgtgcaga

SEQ ID NO: 5493172 - DNA, 16 bp, Homo sapiens
ggcaggagggtggcac

SEQ ID NO: 5493173 - DNA, 19 bp, Homo sapiens
ggcaggagtagctgagctc

SEQ ID NO: 5493174 - DNA, 15 bp, Homo sapiens
ggcaggggtgggaga

SEQ ID NO: 5493175 - DNA, 14 bp, Homo sapiens
ggcaggggtggggg

SEQ ID NO: 5493176 - DNA, 16 bp, Homo sapiens
ggcaggggtgggggtg

SEQ ID NO: 5493177 - DNA, 15 bp, Homo sapiens
ggcaggggtgtcctg

SEQ ID NO: 5493178 - DNA, 17 bp, Homo sapiens
ggcagggtcaggagagg

SEQ ID NO: 5493179 - DNA, 15 bp, Homo sapiens
ggcagggtccacgcc

SEQ ID NO: 5493180 - DNA, 19 bp, Homo sapiens
ggcagggtctcactctgtc

SEQ ID NO: 5493181 - DNA, 14 bp, Homo sapiens
ggcagggtgaccct

SEQ ID NO: 5493182 - DNA, 16 bp, Homo sapiens
ggcagggtgagaagct

SEQ ID NO: 5493183 - DNA, 21 bp, Homo sapiens
ggcagggtgggatggaggaga

SEQ ID NO: 5493184 - DNA, 20 bp, Homo sapiens
ggcagggtggggagggagcc

SEQ ID NO: 5493185 - DNA, 13 bp, Homo sapiens
ggcagggtggggg

SEQ ID NO: 5493186 - DNA, 17 bp, Homo sapiens
ggcagggttctagaagg

SEQ ID NO: 5493187 - DNA, 17 bp, Homo sapiens
ggcaggtaaactcctgt

SEQ ID NO: 5493188 - DNA, 15 bp, Homo sapiens
ggcaggtactgtctg

SEQ ID NO: 5493189 - DNA, 15 bp, Homo sapiens
ggcaggtagccaggg

SEQ ID NO: 5493190 - DNA, 20 bp, Homo sapiens
ggcaggtagccagggggact

SEQ ID NO: 5493191 - DNA, 20 bp, Homo sapiens
ggcaggtaggtattagtgtt

SEQ ID NO: 5493192 - DNA, 15 bp, Homo sapiens
ggcaggtcactgtca

SEQ ID NO: 5493193 - DNA, 16 bp, Homo sapiens
ggcaggtcactgtcac

SEQ ID NO: 5493194 - DNA, 17 bp, Homo sapiens
ggcaggtcactgtcact

SEQ ID NO: 5493195 - DNA, 17 bp, Homo sapiens
ggcaggtcaggaccagg

SEQ ID NO: 5493196 - DNA, 20 bp, Homo sapiens
ggcaggtcatggagcagccc

SEQ ID NO: 5493197 - DNA, 23 bp, Homo sapiens
ggcaggtccagctctgtgggccc

SEQ ID NO: 5493198 - DNA, 14 bp, Homo sapiens
ggcaggtccccaga

SEQ ID NO: 5493199 - DNA, 15 bp, Homo sapiens
ggcaggtcctgccca

SEQ ID NO: 5493200 - DNA, 18 bp, Homo sapiens
ggcaggtcgggctgccag

SEQ ID NO: 5493201 - DNA, 19 bp, Homo sapiens
ggcaggtcgggctgccagc

SEQ ID NO: 5493202 - DNA, 20 bp, Homo sapiens
ggcaggtctgcaagggccca

SEQ ID NO: 5493203 - DNA, 22 bp, Homo sapiens
ggcaggtctgcaagggcccaga

SEQ ID NO: 5493204 - DNA, 20 bp, Homo sapiens
ggcaggtcttcatatttttg

SEQ ID NO: 5493205 - DNA, 23 bp, Homo sapiens
ggcaggtcttgaactcctggcct

SEQ ID NO: 5493206 - DNA, 18 bp, Homo sapiens
ggcaggtgaaaggaatag

SEQ ID NO: 5493207 - DNA, 24 bp, Homo sapiens
ggcaggtgccctctgctccccagt

SEQ ID NO: 5493208 - DNA, 13 bp, Homo sapiens
ggcaggtgcctcc

SEQ ID NO: 5493209 - DNA, 20 bp, Homo sapiens
ggcaggtgcctccaggtgtg

SEQ ID NO: 5493210 - DNA, 21 bp, Homo sapiens
ggcaggtgcttttggcagaga

SEQ ID NO: 5493211 - DNA, 17 bp, Homo sapiens
ggcaggtggactgactg

SEQ ID NO: 5493212 - DNA, 19 bp, Homo sapiens
ggcaggtggactgactgtg

SEQ ID NO: 5493213 - DNA, 23 bp, Homo sapiens
ggcaggtggaggtgtcaggctgc

SEQ ID NO: 5493214 - DNA, 13 bp, Homo sapiens
ggcaggtggccac

SEQ ID NO: 5493215 - DNA, 18 bp, Homo sapiens
ggcaggtggccgcccctg

SEQ ID NO: 5493216 - DNA, 16 bp, Homo sapiens
ggcaggtggcctaagg

SEQ ID NO: 5493217 - DNA, 13 bp, Homo sapiens
ggcaggtgggagc

SEQ ID NO: 5493218 - DNA, 16 bp, Homo sapiens
ggcaggtgggagcttg

SEQ ID NO: 5493219 - DNA, 17 bp, Homo sapiens
ggcaggtgggagcttga

SEQ ID NO: 5493220 - DNA, 16 bp, Homo sapiens
ggcaggtgggctgcct

SEQ ID NO: 5493221 - DNA, 14 bp, Homo sapiens
ggcaggtggtggca

SEQ ID NO: 5493222 - DNA, 19 bp, Homo sapiens
ggcaggtgtgggatctggg

SEQ ID NO: 5493223 - DNA, 21 bp, Homo sapiens
ggcaggtgtgggatctgggga

SEQ ID NO: 5493224 - DNA, 15 bp, Homo sapiens
ggcaggtgtgggctc

SEQ ID NO: 5493225 - DNA, 16 bp, Homo sapiens
ggcaggtgtgggctcc

SEQ ID NO: 5493226 - DNA, 17 bp, Homo sapiens
ggcaggtgttgggacct

SEQ ID NO: 5493227 - DNA, 18 bp, Homo sapiens
ggcaggtgttgggacctg

SEQ ID NO: 5493228 - DNA, 23 bp, Homo sapiens
ggcaggtgttgggacctgctgct

SEQ ID NO: 5493229 - DNA, 22 bp, Homo sapiens
ggcaggtgtttattaaaattct

SEQ ID NO: 5493230 - DNA, 20 bp, Homo sapiens
ggcaggttcctggggccgcc

SEQ ID NO: 5493231 - DNA, 16 bp, Homo sapiens
ggcaggttggatggga

SEQ ID NO: 5493232 - DNA, 17 bp, Homo sapiens
ggcaggttggtgggggc

SEQ ID NO: 5493233 - DNA, 16 bp, Homo sapiens
ggcaggtttggagagc

SEQ ID NO: 5493234 - DNA, 13 bp, Homo sapiens
ggcagtacctgag

SEQ ID NO: 5493235 - DNA, 14 bp, Homo sapiens
ggcagtacctggga

SEQ ID NO: 5493236 - DNA, 17 bp, Homo sapiens
ggcagtacctgggcaag

SEQ ID NO: 5493237 - DNA, 16 bp, Homo sapiens
ggcagtactcctccct

SEQ ID NO: 5493238 - DNA, 17 bp, Homo sapiens
ggcagtactcctccctg

SEQ ID NO: 5493239 - DNA, 21 bp, Homo sapiens
ggcagtagaaggtcggaggct

SEQ ID NO: 5493240 - DNA, 18 bp, Homo sapiens
ggcagtagcctcctcctg

SEQ ID NO: 5493241 - DNA, 22 bp, Homo sapiens
ggcagtagcctcctcctgggct

SEQ ID NO: 5493242 - DNA, 19 bp, Homo sapiens
ggcagtaggtgtcccccac

SEQ ID NO: 5493243 - DNA, 20 bp, Homo sapiens
ggcagtatgtgatggactgg

SEQ ID NO: 5493244 - DNA, 19 bp, Homo sapiens
ggcagtattttctgttttt

SEQ ID NO: 5493245 - DNA, 19 bp, Homo sapiens
ggcagtcacactgctggga

SEQ ID NO: 5493246 - DNA, 19 bp, Homo sapiens
ggcagtcacctgcccagat

SEQ ID NO: 5493247 - DNA, 13 bp, Homo sapiens
ggcagtccagagc

SEQ ID NO: 5493248 - DNA, 20 bp, Homo sapiens
ggcagtccagccagctcctg

SEQ ID NO: 5493249 - DNA, 16 bp, Homo sapiens
ggcagtcccgggagaa

SEQ ID NO: 5493250 - DNA, 16 bp, Homo sapiens
ggcagtcctgagtggg

SEQ ID NO: 5493251 - DNA, 13 bp, Homo sapiens
ggcagtcctggag

SEQ ID NO: 5493252 - DNA, 15 bp, Homo sapiens
ggcagtcctgtgtga

SEQ ID NO: 5493253 - DNA, 20 bp, Homo sapiens
ggcagtcgctgcagggagca

SEQ ID NO: 5493254 - DNA, 14 bp, Homo sapiens
ggcagtcgggggct

SEQ ID NO: 5493255 - DNA, 18 bp, Homo sapiens
ggcagtcgggggctggcc

SEQ ID NO: 5493256 - DNA, 17 bp, Homo sapiens
ggcagtctagtcctggg

SEQ ID NO: 5493257 - DNA, 22 bp, Homo sapiens
ggcagtctccccttcctggcac

SEQ ID NO: 5493258 - DNA, 19 bp, Homo sapiens
ggcagtctctatattatgt

SEQ ID NO: 5493259 - DNA, 15 bp, Homo sapiens
ggcagtctgaaccct

SEQ ID NO: 5493260 - DNA, 19 bp, Homo sapiens
ggcagtctgaatttttaaa

SEQ ID NO: 5493261 - DNA, 13 bp, Homo sapiens
ggcagtctgctct

SEQ ID NO: 5493262 - DNA, 20 bp, Homo sapiens
ggcagtctgctctgctgctc

SEQ ID NO: 5493263 - DNA, 17 bp, Homo sapiens
ggcagtcttgcaacagt

SEQ ID NO: 5493264 - DNA, 19 bp, Homo sapiens
ggcagtgacaagtggaggg

SEQ ID NO: 5493265 - DNA, 22 bp, Homo sapiens
ggcagtgacaagtggagggggt

SEQ ID NO: 5493266 - DNA, 16 bp, Homo sapiens
ggcagtgactccccag

SEQ ID NO: 5493267 - DNA, 22 bp, Homo sapiens
ggcagtgactccccagcccagc

SEQ ID NO: 5493268 - DNA, 14 bp, Homo sapiens
ggcagtgactggca

SEQ ID NO: 5493269 - DNA, 16 bp, Homo sapiens
ggcagtgactggcagg

SEQ ID NO: 5493270 - DNA, 21 bp, Homo sapiens
ggcagtgactggcaggtgcag

SEQ ID NO: 5493271 - DNA, 11 bp, Homo sapiens
ggcagtgactt

SEQ ID NO: 5493272 - DNA, 21 bp, Homo sapiens
ggcagtgagggagggctgtca

SEQ ID NO: 5493273 - DNA, 12 bp, Homo sapiens
ggcagtgcatgc

SEQ ID NO: 5493274 - DNA, 13 bp, Homo sapiens
ggcagtgcatgca

SEQ ID NO: 5493275 - DNA, 14 bp, Homo sapiens
ggcagtgccacagc

SEQ ID NO: 5493276 - DNA, 16 bp, Homo sapiens
ggcagtgccacagcct

SEQ ID NO: 5493277 - DNA, 20 bp, Homo sapiens
ggcagtgccacagcctgctg

SEQ ID NO: 5493278 - DNA, 22 bp, Homo sapiens
ggcagtgccacagcctgctggc

SEQ ID NO: 5493279 - DNA, 24 bp, Homo sapiens
ggcagtgccacagcctgctggcag

SEQ ID NO: 5493280 - DNA, 15 bp, Homo sapiens
ggcagtgccacccgc

SEQ ID NO: 5493281 - DNA, 19 bp, Homo sapiens
ggcagtgcccaccatgcac

SEQ ID NO: 5493282 - DNA, 19 bp, Homo sapiens
ggcagtgcccatgtgtaca

SEQ ID NO: 5493283 - DNA, 21 bp, Homo sapiens
ggcagtgccccagggagtcca

SEQ ID NO: 5493284 - DNA, 17 bp, Homo sapiens
ggcagtgcctgctctgc

SEQ ID NO: 5493285 - DNA, 16 bp, Homo sapiens
ggcagtgcttggccca

SEQ ID NO: 5493286 - DNA, 15 bp, Homo sapiens
ggcagtggaggctgc

SEQ ID NO: 5493287 - DNA, 18 bp, Homo sapiens
ggcagtggaggctgctgt

SEQ ID NO: 5493288 - DNA, 12 bp, Homo sapiens
ggcagtggaggt

SEQ ID NO: 5493289 - DNA, 20 bp, Homo sapiens
ggcagtggagtcggaagggc

SEQ ID NO: 5493290 - DNA, 17 bp, Homo sapiens
ggcagtggcaggggagc

SEQ ID NO: 5493291 - DNA, 16 bp, Homo sapiens
ggcagtggccaagcct

SEQ ID NO: 5493292 - DNA, 18 bp, Homo sapiens
ggcagtggccaagcctgc

SEQ ID NO: 5493293 - DNA, 13 bp, Homo sapiens
ggcagtggcccag

SEQ ID NO: 5493294 - DNA, 14 bp, Homo sapiens
ggcagtggcccagg

SEQ ID NO: 5493295 - DNA, 23 bp, Homo sapiens
ggcagtggcccagggaatcaggg

SEQ ID NO: 5493296 - DNA, 14 bp, Homo sapiens
ggcagtggcctgga

SEQ ID NO: 5493297 - DNA, 17 bp, Homo sapiens
ggcagtggcctggatgc

SEQ ID NO: 5493298 - DNA, 22 bp, Homo sapiens
ggcagtggcctggatgcacagt

SEQ ID NO: 5493299 - DNA, 20 bp, Homo sapiens
ggcagtggcttggagcagag

SEQ ID NO: 5493300 - DNA, 15 bp, Homo sapiens
ggcagtgggaaaaat

SEQ ID NO: 5493301 - DNA, 13 bp, Homo sapiens
ggcagtggggctg

SEQ ID NO: 5493302 - DNA, 20 bp, Homo sapiens
ggcagtggggctggaagcag

SEQ ID NO: 5493303 - DNA, 20 bp, Homo sapiens
ggcagtgggtcccacttccc

SEQ ID NO: 5493304 - DNA, 20 bp, Homo sapiens
ggcagtggtggttttctgtt

SEQ ID NO: 5493305 - DNA, 23 bp, Homo sapiens
ggcagtgtcccagggccctggat

SEQ ID NO: 5493306 - DNA, 18 bp, Homo sapiens
ggcagtgtcttaaggaga

SEQ ID NO: 5493307 - DNA, 16 bp, Homo sapiens
ggcagtgtgcggagct

SEQ ID NO: 5493308 - DNA, 12 bp, Homo sapiens
ggcagtgtggcc

SEQ ID NO: 5493309 - DNA, 13 bp, Homo sapiens
ggcagtgtggcct

SEQ ID NO: 5493310 - DNA, 14 bp, Homo sapiens
ggcagtgttccttg

SEQ ID NO: 5493311 - DNA, 19 bp, Homo sapiens
ggcagtgttcttgggggtg

SEQ ID NO: 5493312 - DNA, 17 bp, Homo sapiens
ggcagttagagatgcct

SEQ ID NO: 5493313 - DNA, 20 bp, Homo sapiens
ggcagttagagatgcctccc

SEQ ID NO: 5493314 - DNA, 15 bp, Homo sapiens
ggcagttagagcagc

SEQ ID NO: 5493315 - DNA, 15 bp, Homo sapiens
ggcagttaggtgctg

SEQ ID NO: 5493316 - DNA, 15 bp, Homo sapiens
ggcagttcctggcat

SEQ ID NO: 5493317 - DNA, 16 bp, Homo sapiens
ggcagttcgcagccac

SEQ ID NO: 5493318 - DNA, 17 bp, Homo sapiens
ggcagttcgcagccacc

SEQ ID NO: 5493319 - DNA, 21 bp, Homo sapiens
ggcagttcgcagccaccctga

SEQ ID NO: 5493320 - DNA, 23 bp, Homo sapiens
ggcagttcgcagccaccctgagg

SEQ ID NO: 5493321 - DNA, 15 bp, Homo sapiens
ggcagttctcccagg

SEQ ID NO: 5493322 - DNA, 14 bp, Homo sapiens
ggcagttctgtgtc

SEQ ID NO: 5493323 - DNA, 20 bp, Homo sapiens
ggcagttctgtgtcctcgca

SEQ ID NO: 5493324 - DNA, 16 bp, Homo sapiens
ggcagttgcccagcct

SEQ ID NO: 5493325 - DNA, 14 bp, Homo sapiens
ggcagttgcttgtg

SEQ ID NO: 5493326 - DNA, 14 bp, Homo sapiens
ggcagttggccaga

SEQ ID NO: 5493327 - DNA, 22 bp, Homo sapiens
ggcagttggggcggcccacgcc

SEQ ID NO: 5493328 - DNA, 22 bp, Homo sapiens
ggcagttgggtagatgggtggg

SEQ ID NO: 5493329 - DNA, 12 bp, Homo sapiens
ggcagtttcctc

SEQ ID NO: 5493330 - DNA, 16 bp, Homo sapiens
ggcagtttgggaaggt

SEQ ID NO: 5493331 - DNA, 19 bp, Homo sapiens
ggcagtttgttgatctttt

SEQ ID NO: 5493332 - DNA, 23 bp, Homo sapiens
ggcagttttaatcttatcttttg

SEQ ID NO: 5493333 - DNA, 20 bp, Homo sapiens
ggcagttttgaaatgaaaat

SEQ ID NO: 5493334 - DNA, 21 bp, Homo sapiens
ggcagttttgacatcagccag

SEQ ID NO: 5493335 - DNA, 15 bp, Homo sapiens
ggcagtttttctgta

SEQ ID NO: 5493336 - DNA, 19 bp, Homo sapiens
ggcagtttttctgtatttt

SEQ ID NO: 5493337 - DNA, 13 bp, Homo sapiens
ggcataaactgtt

SEQ ID NO: 5493338 - DNA, 17 bp, Homo sapiens
ggcataacataaatctg

SEQ ID NO: 5493339 - DNA, 16 bp, Homo sapiens
ggcatacctgtcctag

SEQ ID NO: 5493340 - DNA, 15 bp, Homo sapiens
ggcataccttgtgca

SEQ ID NO: 5493341 - DNA, 21 bp, Homo sapiens
ggcatacgcctgtagtcctag

SEQ ID NO: 5493342 - DNA, 21 bp, Homo sapiens
ggcatactgccttgtttaatg

SEQ ID NO: 5493343 - DNA, 18 bp, Homo sapiens
ggcatagaaactgaggag

SEQ ID NO: 5493344 - DNA, 21 bp, Homo sapiens
ggcatagcacccgtggtgcat

SEQ ID NO: 5493345 - DNA, 15 bp, Homo sapiens
ggcatagcccagaca

SEQ ID NO: 5493346 - DNA, 21 bp, Homo sapiens
ggcatagctccccgcttctgc

SEQ ID NO: 5493347 - DNA, 20 bp, Homo sapiens
ggcataggtctctttgcttt

SEQ ID NO: 5493348 - DNA, 14 bp, Homo sapiens
ggcatagtcagtgt

SEQ ID NO: 5493349 - DNA, 12 bp, Homo sapiens
ggcatagtggca

SEQ ID NO: 5493350 - DNA, 15 bp, Homo sapiens
ggcatataataaaga

SEQ ID NO: 5493351 - DNA, 22 bp, Homo sapiens
ggcatataattttcacttctgt

SEQ ID NO: 5493352 - DNA, 19 bp, Homo sapiens
ggcatggggtgggcctctg

SEQ ID NO: 5493353 - DNA, 23 bp, Homo sapiens
ggcatgggtcccttccccctgct

SEQ ID NO: 5493354 - DNA, 19 bp, Homo sapiens
ggcatgggtcgggagaggg

SEQ ID NO: 5493355 - DNA, 20 bp, Homo sapiens
ggcatgggtcgggagagggg

SEQ ID NO: 5493356 - DNA, 17 bp, Homo sapiens
ggcatggtaccagccct

SEQ ID NO: 5493357 - DNA, 19 bp, Homo sapiens
ggcatggtacggagatgtt

SEQ ID NO: 5493358 - DNA, 19 bp, Homo sapiens
ggcatggtcccttaaggca

SEQ ID NO: 5493359 - DNA, 14 bp, Homo sapiens
ggcatggtcctgtg

SEQ ID NO: 5493360 - DNA, 20 bp, Homo sapiens
ggcatggtcctgtgccccga

SEQ ID NO: 5493361 - DNA, 23 bp, Homo sapiens
ggcatggtggcacacgcctgtag

SEQ ID NO: 5493362 - DNA, 18 bp, Homo sapiens
ggcatggtgtgtggtgct

SEQ ID NO: 5493363 - DNA, 20 bp, Homo sapiens
ggcatggttccttccctggg

SEQ ID NO: 5493364 - DNA, 18 bp, Homo sapiens
ggcatgtaaatgtaaact

SEQ ID NO: 5493365 - DNA, 16 bp, Homo sapiens
ggcatgtaggaccctg

SEQ ID NO: 5493366 - DNA, 21 bp, Homo sapiens
ggcatgtatgacgtgactggc

SEQ ID NO: 5493367 - DNA, 16 bp, Homo sapiens
ggcatgtattggcctg

SEQ ID NO: 5493368 - DNA, 14 bp, Homo sapiens
ggcatgtcagagcc

SEQ ID NO: 5493369 - DNA, 22 bp, Homo sapiens
ggcatgtcagaggaccccaggg

SEQ ID NO: 5493370 - DNA, 18 bp, Homo sapiens
ggcatgtctcctcaaccc

SEQ ID NO: 5493371 - DNA, 13 bp, Homo sapiens
ggcatgtgaaggg

SEQ ID NO: 5493372 - DNA, 17 bp, Homo sapiens
ggcatgtgatattttca

SEQ ID NO: 5493373 - DNA, 18 bp, Homo sapiens
ggcatgtgatgagaggaa

SEQ ID NO: 5493374 - DNA, 13 bp, Homo sapiens
ggcatgtggcctg

SEQ ID NO: 5493375 - DNA, 16 bp, Homo sapiens
ggcatgtggcctgtgg

SEQ ID NO: 5493376 - DNA, 19 bp, Homo sapiens
ggcatgtggcctgtggcct

SEQ ID NO: 5493377 - DNA, 21 bp, Homo sapiens
ggcatgtggcctttatctcaa

SEQ ID NO: 5493378 - DNA, 14 bp, Homo sapiens
ggcatgtgggcttc

SEQ ID NO: 5493379 - DNA, 19 bp, Homo sapiens
ggcatgtgggttgtgatat

SEQ ID NO: 5493380 - DNA, 18 bp, Homo sapiens
ggcatgtgtagttaattt

SEQ ID NO: 5493381 - DNA, 14 bp, Homo sapiens
ggcatgtgtatgtg

SEQ ID NO: 5493382 - DNA, 18 bp, Homo sapiens
ggcatgtgtatgtgtctg

SEQ ID NO: 5493383 - DNA, 17 bp, Homo sapiens
ggcatgtgtctggccct

SEQ ID NO: 5493384 - DNA, 14 bp, Homo sapiens
ggcatgtgtgcctg

SEQ ID NO: 5493385 - DNA, 13 bp, Homo sapiens
ggcatgttcaggg

SEQ ID NO: 5493386 - DNA, 14 bp, Homo sapiens
ggcatgttcctctg

SEQ ID NO: 5493387 - DNA, 20 bp, Homo sapiens
ggcatgttctctgaggacac

SEQ ID NO: 5493388 - DNA, 16 bp, Homo sapiens
ggcatgttggactctg

SEQ ID NO: 5493389 - DNA, 22 bp, Homo sapiens
ggcatgttggactctgagctca

SEQ ID NO: 5493390 - DNA, 12 bp, Homo sapiens
ggcatgttttga

SEQ ID NO: 5493391 - DNA, 19 bp, Homo sapiens
ggcattaaaacttgggcac

SEQ ID NO: 5493392 - DNA, 18 bp, Homo sapiens
ggcattaaaccacatcat

SEQ ID NO: 5493393 - DNA, 15 bp, Homo sapiens
ggcattaaatgcaaa

SEQ ID NO: 5493394 - DNA, 20 bp, Homo sapiens
ggcattaacaataaagcatt

SEQ ID NO: 5493395 - DNA, 16 bp, Homo sapiens
ggcattaacacaaagg

SEQ ID NO: 5493396 - DNA, 17 bp, Homo sapiens
ggcattaatgtttctat

SEQ ID NO: 5493397 - DNA, 20 bp, Homo sapiens
ggcattaattgttccttgct

SEQ ID NO: 5493398 - DNA, 22 bp, Homo sapiens
ggcattaattgttccttgcttt

SEQ ID NO: 5493399 - DNA, 15 bp, Homo sapiens
ggcattactctgcac

SEQ ID NO: 5493400 - DNA, 21 bp, Homo sapiens
ggcattactggccttttcact

SEQ ID NO: 5493401 - DNA, 17 bp, Homo sapiens
ggcattagaattattta

SEQ ID NO: 5493402 - DNA, 20 bp, Homo sapiens
ggcattagaattatttaaac

SEQ ID NO: 5493403 - DNA, 17 bp, Homo sapiens
ggcattagcaaggcaga

SEQ ID NO: 5493404 - DNA, 18 bp, Homo sapiens
ggcattagcaaggcagag

SEQ ID NO: 5493405 - DNA, 21 bp, Homo sapiens
ggcattagcaaggcagagcct

SEQ ID NO: 5493406 - DNA, 18 bp, Homo sapiens
ggcattagtgtcccccct

SEQ ID NO: 5493407 - DNA, 14 bp, Homo sapiens
ggcattcacacaca

SEQ ID NO: 5493408 - DNA, 15 bp, Homo sapiens
ggcattcacacacag

SEQ ID NO: 5493409 - DNA, 17 bp, Homo sapiens
ggcattcacacacagcc

SEQ ID NO: 5493410 - DNA, 23 bp, Homo sapiens
ggcattccagctcctccgtgctt

SEQ ID NO: 5493411 - DNA, 18 bp, Homo sapiens
ggcattcctctaatgttg

SEQ ID NO: 5493412 - DNA, 19 bp, Homo sapiens
ggcattcgcagtgcccagt

SEQ ID NO: 5493413 - DNA, 12 bp, Homo sapiens
ggcattctctct

SEQ ID NO: 5493414 - DNA, 19 bp, Homo sapiens
ggcattctgtataaatgca

SEQ ID NO: 5493415 - DNA, 21 bp, Homo sapiens
ggcattgaatgacaagcatca

SEQ ID NO: 5493416 - DNA, 14 bp, Homo sapiens
ggcattgaccttca

SEQ ID NO: 5493417 - DNA, 23 bp, Homo sapiens
ggcattgagggctctaaacagga

SEQ ID NO: 5493418 - DNA, 16 bp, Homo sapiens
ggcattgatggggaag

SEQ ID NO: 5493419 - DNA, 16 bp, Homo sapiens
ggcattgcactaaaag

SEQ ID NO: 5493420 - DNA, 14 bp, Homo sapiens
ggcattgctcagcc

SEQ ID NO: 5493421 - DNA, 21 bp, Homo sapiens
ggcattgctcagcccgcttgg

SEQ ID NO: 5493422 - DNA, 23 bp, Homo sapiens
ggcattgctcagcccgcttggcc

SEQ ID NO: 5493423 - DNA, 24 bp, Homo sapiens
ggcattgctttgccctggagcagc

SEQ ID NO: 5493424 - DNA, 23 bp, Homo sapiens
ggcattggaggatgggggtcctg

SEQ ID NO: 5493425 - DNA, 21 bp, Homo sapiens
ggcattggcagcaggtgctgc

SEQ ID NO: 5493426 - DNA, 13 bp, Homo sapiens
ggcattgggctga

SEQ ID NO: 5493427 - DNA, 14 bp, Homo sapiens
ggcattgggtggca

SEQ ID NO: 5493428 - DNA, 20 bp, Homo sapiens
ggcattgggttcaaggaatc

SEQ ID NO: 5493429 - DNA, 20 bp, Homo sapiens
ggcattggttccctttgctc

SEQ ID NO: 5493430 - DNA, 14 bp, Homo sapiens
ggcattgtttccac

SEQ ID NO: 5493431 - DNA, 19 bp, Homo sapiens
ggcatttagcacagtattt

SEQ ID NO: 5493432 - DNA, 22 bp, Homo sapiens
ggcatttagcacagtatttaac

SEQ ID NO: 5493433 - DNA, 15 bp, Homo sapiens
ggcatttattttata

SEQ ID NO: 5493434 - DNA, 13 bp, Homo sapiens
ggcatttcaatcc

SEQ ID NO: 5493435 - DNA, 18 bp, Homo sapiens
ggcatttccgtggacagc

SEQ ID NO: 5493436 - DNA, 20 bp, Homo sapiens
ggcatttctaaaatgttaaa

SEQ ID NO: 5493437 - DNA, 22 bp, Homo sapiens
ggcatttctatactttacagga

SEQ ID NO: 5493438 - DNA, 20 bp, Homo sapiens
ggcatttgcagggtcctctt

SEQ ID NO: 5493439 - DNA, 21 bp, Homo sapiens
ggcatttgcagggtcctcttc

SEQ ID NO: 5493440 - DNA, 13 bp, Homo sapiens
ggcatttgctgaa

SEQ ID NO: 5493441 - DNA, 14 bp, Homo sapiens
ggcatttgctgaat

SEQ ID NO: 5493442 - DNA, 13 bp, Homo sapiens
ggcatttgtaaaa

SEQ ID NO: 5493443 - DNA, 19 bp, Homo sapiens
ggcatttgtaaaaagtaga

SEQ ID NO: 5493444 - DNA, 23 bp, Homo sapiens
ggcatttgtttctttctctgagg

SEQ ID NO: 5493445 - DNA, 22 bp, Homo sapiens
ggcattttaagtgtttaaaagc

SEQ ID NO: 5493446 - DNA, 22 bp, Homo sapiens
ggcattttattaaacttaaaac

SEQ ID NO: 5493447 - DNA, 22 bp, Homo sapiens
ggcattttcccccttggctctc

SEQ ID NO: 5493448 - DNA, 13 bp, Homo sapiens
ggcattttcctcc

SEQ ID NO: 5493449 - DNA, 16 bp, Homo sapiens
ggcattttcctcctct

SEQ ID NO: 5493450 - DNA, 17 bp, Homo sapiens
ggcattttcctcgccta

SEQ ID NO: 5493451 - DNA, 21 bp, Homo sapiens
ggcattttcctcgcctaggcc

SEQ ID NO: 5493452 - DNA, 16 bp, Homo sapiens
ggcattttctgttcca

SEQ ID NO: 5493453 - DNA, 17 bp, Homo sapiens
ggcattttgaatgtgat

SEQ ID NO: 5493454 - DNA, 14 bp, Homo sapiens
ggcatttttcttgg

SEQ ID NO: 5493455 - DNA, 22 bp, Homo sapiens
ggcatttttcttggatcttttt

SEQ ID NO: 5493456 - DNA, 17 bp, Homo sapiens
ggccaaaagcagtaaat

SEQ ID NO: 5493457 - DNA, 15 bp, Homo sapiens
ggccaaaagcttccc

SEQ ID NO: 5493458 - DNA, 23 bp, Homo sapiens
ggccaaaagcttccctccctgct

SEQ ID NO: 5493459 - DNA, 19 bp, Homo sapiens
ggccaaaaggaaaaagctc

SEQ ID NO: 5493460 - DNA, 14 bp, Homo sapiens
ggccaaaagggcag

SEQ ID NO: 5493461 - DNA, 14 bp, Homo sapiens
ggccaaaatcaaga

SEQ ID NO: 5493462 - DNA, 19 bp, Homo sapiens
ggccaaacatcagacctgt

SEQ ID NO: 5493463 - DNA, 23 bp, Homo sapiens
ggccaaacatcagacctgtcttc

SEQ ID NO: 5493464 - DNA, 17 bp, Homo sapiens
ggccaaacccacttctg

SEQ ID NO: 5493465 - DNA, 15 bp, Homo sapiens
ggccaaacccttgct

SEQ ID NO: 5493466 - DNA, 15 bp, Homo sapiens
ggccaaacctctgtt

SEQ ID NO: 5493467 - DNA, 15 bp, Homo sapiens
ggccaaacctgggac

SEQ ID NO: 5493468 - DNA, 19 bp, Homo sapiens
ggccaaacggtgcaacaga

SEQ ID NO: 5493469 - DNA, 15 bp, Homo sapiens
ggccaaactgtccct

SEQ ID NO: 5493470 - DNA, 22 bp, Homo sapiens
ggccaaactgtccctcccttgc

SEQ ID NO: 5493471 - DNA, 15 bp, Homo sapiens
ggccaaagaaggcag

SEQ ID NO: 5493472 - DNA, 15 bp, Homo sapiens
ggccaaagacctccc

SEQ ID NO: 5493473 - DNA, 12 bp, Homo sapiens
ggccaaagataa

SEQ ID NO: 5493474 - DNA, 15 bp, Homo sapiens
ggccaaagataaaag

SEQ ID NO: 5493475 - DNA, 15 bp, Homo sapiens
ggccaaagccaaagc

SEQ ID NO: 5493476 - DNA, 13 bp, Homo sapiens
ggccaaaggaagc

SEQ ID NO: 5493477 - DNA, 21 bp, Homo sapiens
ggccaaaggagggtcaggaag

SEQ ID NO: 5493478 - DNA, 21 bp, Homo sapiens
ggccaaatatattctctttgg

SEQ ID NO: 5493479 - DNA, 22 bp, Homo sapiens
ggccaaatatattctctttggt

SEQ ID NO: 5493480 - DNA, 17 bp, Homo sapiens
ggccaaatatgcacttt

SEQ ID NO: 5493481 - DNA, 24 bp, Homo sapiens
ggccaaatatgcactttccctaga

SEQ ID NO: 5493482 - DNA, 20 bp, Homo sapiens
ggccaaatattgatctgtat

SEQ ID NO: 5493483 - DNA, 21 bp, Homo sapiens
ggccaaatccttggagtccca

SEQ ID NO: 5493484 - DNA, 21 bp, Homo sapiens
ggccaaattatttgtgtaata

SEQ ID NO: 5493485 - DNA, 15 bp, Homo sapiens
ggccaacaccaggga

SEQ ID NO: 5493486 - DNA, 23 bp, Homo sapiens
ggccaacagggtagatttctctt

SEQ ID NO: 5493487 - DNA, 13 bp, Homo sapiens
ggccaacatggta

SEQ ID NO: 5493488 - DNA, 23 bp, Homo sapiens
ggccaacatggtgaaaccctgta

SEQ ID NO: 5493489 - DNA, 20 bp, Homo sapiens
ggccaaccagcccgacagtg

SEQ ID NO: 5493490 - DNA, 17 bp, Homo sapiens
ggccaaccccaaagaag

SEQ ID NO: 5493491 - DNA, 22 bp, Homo sapiens
ggccaaccctcctccaatggaa

SEQ ID NO: 5493492 - DNA, 23 bp, Homo sapiens
ggccaacccttctcctcttgtaa

SEQ ID NO: 5493493 - DNA, 17 bp, Homo sapiens
ggccaacctcaggctcc

SEQ ID NO: 5493494 - DNA, 18 bp, Homo sapiens
ggccaacgtggacctgcc

SEQ ID NO: 5493495 - DNA, 16 bp, Homo sapiens
ggccaactcacccttg

SEQ ID NO: 5493496 - DNA, 21 bp, Homo sapiens
ggccaacttgagggcccagag

SEQ ID NO: 5493497 - DNA, 21 bp, Homo sapiens
ggccaagaatgtacgtccagc

SEQ ID NO: 5493498 - DNA, 13 bp, Homo sapiens
ggccaagacggga

SEQ ID NO: 5493499 - DNA, 23 bp, Homo sapiens
ggccaagacttggcaacagaagc

SEQ ID NO: 5493500 - DNA, 23 bp, Homo sapiens
ggccaagagagacattgcctcca

SEQ ID NO: 5493501 - DNA, 15 bp, Homo sapiens
ggccaagaggaaaaa

SEQ ID NO: 5493502 - DNA, 13 bp, Homo sapiens
ggccaagaggctg

SEQ ID NO: 5493503 - DNA, 17 bp, Homo sapiens
ggccaagataggacctt

SEQ ID NO: 5493504 - DNA, 19 bp, Homo sapiens
ggccaagatgcttttcaaa

SEQ ID NO: 5493505 - DNA, 17 bp, Homo sapiens
ggccaagatggctgctg

SEQ ID NO: 5493506 - DNA, 18 bp, Homo sapiens
ggccaagatggctgctgc

SEQ ID NO: 5493507 - DNA, 22 bp, Homo sapiens
ggccaagattgtccttttctcc

SEQ ID NO: 5493508 - DNA, 20 bp, Homo sapiens
ggccaagcagaaaaaaaagt

SEQ ID NO: 5493509 - DNA, 22 bp, Homo sapiens
ggccaagcaggctggtttgcaa

SEQ ID NO: 5493510 - DNA, 16 bp, Homo sapiens
ggccaagcagtgcctg

SEQ ID NO: 5493511 - DNA, 14 bp, Homo sapiens
ggccaagccagctg

SEQ ID NO: 5493512 - DNA, 15 bp, Homo sapiens
ggccaagccagctgc

SEQ ID NO: 5493513 - DNA, 21 bp, Homo sapiens
ggccaagccagggttccagac

SEQ ID NO: 5493514 - DNA, 12 bp, Homo sapiens
ggccaagccggc

SEQ ID NO: 5493515 - DNA, 12 bp, Homo sapiens
ggccaagcctgc

SEQ ID NO: 5493516 - DNA, 15 bp, Homo sapiens
ggccaagcctgcccc

SEQ ID NO: 5493517 - DNA, 15 bp, Homo sapiens
ggccaagcctgctgt

SEQ ID NO: 5493518 - DNA, 20 bp, Homo sapiens
ggccaagcgggggcgtggct

SEQ ID NO: 5493519 - DNA, 22 bp, Homo sapiens
ggccaagcgggggcgtggctgg

SEQ ID NO: 5493520 - DNA, 16 bp, Homo sapiens
ggccaagctgaagtga

SEQ ID NO: 5493521 - DNA, 14 bp, Homo sapiens
ggccaagctgagga

SEQ ID NO: 5493522 - DNA, 23 bp, Homo sapiens
ggccaagctgaggaggtgctgca

SEQ ID NO: 5493523 - DNA, 15 bp, Homo sapiens
ggccaagctgaggtg

SEQ ID NO: 5493524 - DNA, 20 bp, Homo sapiens
ggccaagctgaggtgcccag

SEQ ID NO: 5493525 - DNA, 22 bp, Homo sapiens
ggccaagctgaggtgcccagga

SEQ ID NO: 5493526 - DNA, 22 bp, Homo sapiens
ggccaagctttgaggctctgtc

SEQ ID NO: 5493527 - DNA, 21 bp, Homo sapiens
ggccactccctgccaactcca

SEQ ID NO: 5493528 - DNA, 12 bp, Homo sapiens
ggccactcctcc

SEQ ID NO: 5493529 - DNA, 14 bp, Homo sapiens
ggccactcctcttc

SEQ ID NO: 5493530 - DNA, 15 bp, Homo sapiens
ggccactcctcttca

SEQ ID NO: 5493531 - DNA, 16 bp, Homo sapiens
ggccactcctgggccc

SEQ ID NO: 5493532 - DNA, 19 bp, Homo sapiens
ggccactcctgggccccag

SEQ ID NO: 5493533 - DNA, 16 bp, Homo sapiens
ggccactccttcctgc

SEQ ID NO: 5493534 - DNA, 16 bp, Homo sapiens
ggccactctcagagac

SEQ ID NO: 5493535 - DNA, 16 bp, Homo sapiens
ggccactctcccctcc

SEQ ID NO: 5493536 - DNA, 19 bp, Homo sapiens
ggccactctcccctccctc

SEQ ID NO: 5493537 - DNA, 11 bp, Homo sapiens
ggccactctgc

SEQ ID NO: 5493538 - DNA, 15 bp, Homo sapiens
ggccactctgcctct

SEQ ID NO: 5493539 - DNA, 16 bp, Homo sapiens
ggccactctgcctctg

SEQ ID NO: 5493540 - DNA, 21 bp, Homo sapiens
ggccactctgcctctgcctgc

SEQ ID NO: 5493541 - DNA, 15 bp, Homo sapiens
ggccactctgtttgc

SEQ ID NO: 5493542 - DNA, 17 bp, Homo sapiens
ggccactgaagaggagg

SEQ ID NO: 5493543 - DNA, 12 bp, Homo sapiens
ggccactgaccc

SEQ ID NO: 5493544 - DNA, 14 bp, Homo sapiens
ggccactgacccac

SEQ ID NO: 5493545 - DNA, 16 bp, Homo sapiens
ggccactgacccacct

SEQ ID NO: 5493546 - DNA, 20 bp, Homo sapiens
ggccactgacccacctgcgc

SEQ ID NO: 5493547 - DNA, 15 bp, Homo sapiens
ggccactgagctggc

SEQ ID NO: 5493548 - DNA, 17 bp, Homo sapiens
ggccactgagctggctg

SEQ ID NO: 5493549 - DNA, 18 bp, Homo sapiens
ggccactgagctggctga

SEQ ID NO: 5493550 - DNA, 20 bp, Homo sapiens
ggccactgcaaaccctgctg

SEQ ID NO: 5493551 - DNA, 15 bp, Homo sapiens
ggccactgcacagag

SEQ ID NO: 5493552 - DNA, 19 bp, Homo sapiens
ggccactgcacagagctct

SEQ ID NO: 5493553 - DNA, 13 bp, Homo sapiens
ggccactgcagtc

SEQ ID NO: 5493554 - DNA, 18 bp, Homo sapiens
ggccactgcgccactgcc

SEQ ID NO: 5493555 - DNA, 13 bp, Homo sapiens
ggccactgctccc

SEQ ID NO: 5493556 - DNA, 20 bp, Homo sapiens
ggccactggccctgtttctc

SEQ ID NO: 5493557 - DNA, 12 bp, Homo sapiens
ggccactggccg

SEQ ID NO: 5493558 - DNA, 12 bp, Homo sapiens
ggccactgggga

SEQ ID NO: 5493559 - DNA, 13 bp, Homo sapiens
ggccactggggac

SEQ ID NO: 5493560 - DNA, 18 bp, Homo sapiens
ggccactgtcaaggcagg

SEQ ID NO: 5493561 - DNA, 17 bp, Homo sapiens
ggccactgtccctgtcc

SEQ ID NO: 5493562 - DNA, 20 bp, Homo sapiens
ggccactgtccctgtccttc

SEQ ID NO: 5493563 - DNA, 23 bp, Homo sapiens
ggccactgtccctgtccttctac

SEQ ID NO: 5493564 - DNA, 14 bp, Homo sapiens
ggccactgtggcca

SEQ ID NO: 5493565 - DNA, 21 bp, Homo sapiens
ggccactgtggccagagctgg

SEQ ID NO: 5493566 - DNA, 16 bp, Homo sapiens
ggccactgtgtctctg

SEQ ID NO: 5493567 - DNA, 21 bp, Homo sapiens
ggccactgtgtttctgtgctc

SEQ ID NO: 5493568 - DNA, 20 bp, Homo sapiens
ggccacttagtcgtcttttt

SEQ ID NO: 5493569 - DNA, 21 bp, Homo sapiens
ggccacttcattccagcagct

SEQ ID NO: 5493570 - DNA, 15 bp, Homo sapiens
ggccacttctgggtg

SEQ ID NO: 5493571 - DNA, 16 bp, Homo sapiens
ggccacttgcttgctg

SEQ ID NO: 5493572 - DNA, 21 bp, Homo sapiens
ggccactttcagagcccccag

SEQ ID NO: 5493573 - DNA, 17 bp, Homo sapiens
ggccactttgcagacct

SEQ ID NO: 5493574 - DNA, 19 bp, Homo sapiens
ggccactttgcagacctgg

SEQ ID NO: 5493575 - DNA, 16 bp, Homo sapiens
ggccagaaaaggcagc

SEQ ID NO: 5493576 - DNA, 22 bp, Homo sapiens
ggccagaaaaggcagccagatc

SEQ ID NO: 5493577 - DNA, 21 bp, Homo sapiens
ggccagaaaccttcctgctga

SEQ ID NO: 5493578 - DNA, 23 bp, Homo sapiens
ggccagaaactccttttgctgtc

SEQ ID NO: 5493579 - DNA, 19 bp, Homo sapiens
ggccagaaggagggcagag

SEQ ID NO: 5493580 - DNA, 21 bp, Homo sapiens
ggccagaaggagggcagagcc

SEQ ID NO: 5493581 - DNA, 16 bp, Homo sapiens
ggccagaagtaccaga

SEQ ID NO: 5493582 - DNA, 19 bp, Homo sapiens
ggccagaagtagctttgca

SEQ ID NO: 5493583 - DNA, 16 bp, Homo sapiens
ggccagacacaggccc

SEQ ID NO: 5493584 - DNA, 19 bp, Homo sapiens
ggccagacacaggccgtgg

SEQ ID NO: 5493585 - DNA, 17 bp, Homo sapiens
ggccagacagaccttca

SEQ ID NO: 5493586 - DNA, 12 bp, Homo sapiens
ggccagacatgg

SEQ ID NO: 5493587 - DNA, 14 bp, Homo sapiens
ggccagaccacagc

SEQ ID NO: 5493588 - DNA, 15 bp, Homo sapiens
ggccagaccagagct

SEQ ID NO: 5493589 - DNA, 19 bp, Homo sapiens
ggccagaccagagctctgg

SEQ ID NO: 5493590 - DNA, 16 bp, Homo sapiens
ggccagaccatggaca

SEQ ID NO: 5493591 - DNA, 22 bp, Homo sapiens
ggccagacctgcagacgcccag

SEQ ID NO: 5493592 - DNA, 15 bp, Homo sapiens
ggccagactcccttg

SEQ ID NO: 5493593 - DNA, 11 bp, Homo sapiens
ggccagactcg

SEQ ID NO: 5493594 - DNA, 18 bp, Homo sapiens
ggccagagacacaagcct

SEQ ID NO: 5493595 - DNA, 14 bp, Homo sapiens
ggccagagagcagg

SEQ ID NO: 5493596 - DNA, 17 bp, Homo sapiens
ggccagagagcagggga

SEQ ID NO: 5493597 - DNA, 19 bp, Homo sapiens
ggccagagagcaggggagc

SEQ ID NO: 5493598 - DNA, 16 bp, Homo sapiens
ggccagagagggccca

SEQ ID NO: 5493599 - DNA, 18 bp, Homo sapiens
ggccagagagggcccagc

SEQ ID NO: 5493600 - DNA, 23 bp, Homo sapiens
ggccagagagggcccagctgtag

SEQ ID NO: 5493601 - DNA, 15 bp, Homo sapiens
ggccagagcacctca

SEQ ID NO: 5493602 - DNA, 22 bp, Homo sapiens
ggccagagcacctcaggaccct

SEQ ID NO: 5493603 - DNA, 14 bp, Homo sapiens
ggccagagcagctc

SEQ ID NO: 5493604 - DNA, 14 bp, Homo sapiens
ggccagagccaagg

SEQ ID NO: 5493605 - DNA, 22 bp, Homo sapiens
ggccagagccatgccaggctgc

SEQ ID NO: 5493606 - DNA, 12 bp, Homo sapiens
ggccagagccga

SEQ ID NO: 5493607 - DNA, 19 bp, Homo sapiens
ggccagagcctggtagaga

SEQ ID NO: 5493608 - DNA, 14 bp, Homo sapiens
ggccagagctgaac

SEQ ID NO: 5493609 - DNA, 16 bp, Homo sapiens
ggccagagctggaagg

SEQ ID NO: 5493610 - DNA, 17 bp, Homo sapiens
ggccagagctggaaggc

SEQ ID NO: 5493611 - DNA, 18 bp, Homo sapiens
ggccagagctggaaggca

SEQ ID NO: 5493612 - DNA, 19 bp, Homo sapiens
ggccagagctggaaggcag

SEQ ID NO: 5493613 - DNA, 22 bp, Homo sapiens
ggccagagctggaaggcagggc

SEQ ID NO: 5493614 - DNA, 14 bp, Homo sapiens
ggccagagctggga

SEQ ID NO: 5493615 - DNA, 17 bp, Homo sapiens
ggccagagctgggaggc

SEQ ID NO: 5493616 - DNA, 21 bp, Homo sapiens
ggccagagctgggaggcatgg

SEQ ID NO: 5493617 - DNA, 17 bp, Homo sapiens
ggccagaggaagggagg

SEQ ID NO: 5493618 - DNA, 22 bp, Homo sapiens
ggccagaggaagggaggcctga

SEQ ID NO: 5493619 - DNA, 13 bp, Homo sapiens
ggccagaggcagc

SEQ ID NO: 5493620 - DNA, 22 bp, Homo sapiens
ggccagaggcccccagcccagg

SEQ ID NO: 5493621 - DNA, 11 bp, Homo sapiens
ggccagaggct

SEQ ID NO: 5493622 - DNA, 18 bp, Homo sapiens
ggccagagggcagtggcc

SEQ ID NO: 5493623 - DNA, 13 bp, Homo sapiens
ggccagaggtgaa

SEQ ID NO: 5493624 - DNA, 19 bp, Homo sapiens
ggccagagtctcccagtgg

SEQ ID NO: 5493625 - DNA, 14 bp, Homo sapiens
ggccagagtggcct

SEQ ID NO: 5493626 - DNA, 18 bp, Homo sapiens
ggccagagtggcctggcc

SEQ ID NO: 5493627 - DNA, 21 bp, Homo sapiens
ggccagatgcacatccctgga

SEQ ID NO: 5493628 - DNA, 23 bp, Homo sapiens
ggccagatgcacatccctggaag

SEQ ID NO: 5493629 - DNA, 15 bp, Homo sapiens
ggccagatgcaccag

SEQ ID NO: 5493630 - DNA, 16 bp, Homo sapiens
ggccagatgcaccagc

SEQ ID NO: 5493631 - DNA, 15 bp, Homo sapiens
ggccagatggcccct

SEQ ID NO: 5493632 - DNA, 21 bp, Homo sapiens
ggccagcacaccaagtggctg

SEQ ID NO: 5493633 - DNA, 16 bp, Homo sapiens
ggccagcaccctctcc

SEQ ID NO: 5493634 - DNA, 21 bp, Homo sapiens
ggccagcactggaggggccca

SEQ ID NO: 5493635 - DNA, 11 bp, Homo sapiens
ggccagcagag

SEQ ID NO: 5493636 - DNA, 14 bp, Homo sapiens
ggccagcagagcat

SEQ ID NO: 5493637 - DNA, 13 bp, Homo sapiens
ggccagcagaggg

SEQ ID NO: 5493638 - DNA, 12 bp, Homo sapiens
ggccagcagcac

SEQ ID NO: 5493639 - DNA, 14 bp, Homo sapiens
ggccagcagccttc

SEQ ID NO: 5493640 - DNA, 16 bp, Homo sapiens
ggccagcagccttcca

SEQ ID NO: 5493641 - DNA, 17 bp, Homo sapiens
ggccagcagccttccag

SEQ ID NO: 5493642 - DNA, 21 bp, Homo sapiens
ggccagcaggcgggctccttt

SEQ ID NO: 5493643 - DNA, 12 bp, Homo sapiens
ggccagcaggct

SEQ ID NO: 5493644 - DNA, 20 bp, Homo sapiens
ggccagcaggctcctggctg

SEQ ID NO: 5493645 - DNA, 19 bp, Homo sapiens
ggccagcatccatgcggcc

SEQ ID NO: 5493646 - DNA, 12 bp, Homo sapiens
ggccagccaggc

SEQ ID NO: 5493647 - DNA, 13 bp, Homo sapiens
ggccagccaggcg

SEQ ID NO: 5493648 - DNA, 14 bp, Homo sapiens
ggccagccatgtct

SEQ ID NO: 5493649 - DNA, 13 bp, Homo sapiens
ggccagcccagcc

SEQ ID NO: 5493650 - DNA, 16 bp, Homo sapiens
ggccagcccagccagg

SEQ ID NO: 5493651 - DNA, 13 bp, Homo sapiens
ggccagcccagga

SEQ ID NO: 5493652 - DNA, 14 bp, Homo sapiens
ggccagccccacag

SEQ ID NO: 5493653 - DNA, 19 bp, Homo sapiens
ggccagccccacagcccac

SEQ ID NO: 5493654 - DNA, 14 bp, Homo sapiens
ggccagccccaccc

SEQ ID NO: 5493655 - DNA, 21 bp, Homo sapiens
ggccagccccacccaggaggg

SEQ ID NO: 5493656 - DNA, 21 bp, Homo sapiens
ggccagccccatcttggtcct

SEQ ID NO: 5493657 - DNA, 17 bp, Homo sapiens
ggccagccccggccctg

SEQ ID NO: 5493658 - DNA, 20 bp, Homo sapiens
ggccagccccggccctgggc

SEQ ID NO: 5493659 - DNA, 14 bp, Homo sapiens
ggccagcccctcca

SEQ ID NO: 5493660 - DNA, 15 bp, Homo sapiens
ggccagcccctccca

SEQ ID NO: 5493661 - DNA, 21 bp, Homo sapiens
ggccagcccctcccaccacag

SEQ ID NO: 5493662 - DNA, 19 bp, Homo sapiens
ggccagcccctccccgcct

SEQ ID NO: 5493663 - DNA, 13 bp, Homo sapiens
ggccagcccctgg

SEQ ID NO: 5493664 - DNA, 22 bp, Homo sapiens
ggccagcccctggggcccagcc

SEQ ID NO: 5493665 - DNA, 15 bp, Homo sapiens
ggccagccccttaga

SEQ ID NO: 5493666 - DNA, 23 bp, Homo sapiens
ggccagccccttagacagaggcc

SEQ ID NO: 5493667 - DNA, 12 bp, Homo sapiens
ggccagcccgca

SEQ ID NO: 5493668 - DNA, 14 bp, Homo sapiens
ggccagcccgcaga

SEQ ID NO: 5493669 - DNA, 16 bp, Homo sapiens
ggccagcccgcagagg

SEQ ID NO: 5493670 - DNA, 15 bp, Homo sapiens
ggccagcccggctgg

SEQ ID NO: 5493671 - DNA, 18 bp, Homo sapiens
ggccagcccggctggttt

SEQ ID NO: 5493672 - DNA, 19 bp, Homo sapiens
ggccagcccggctggtttt

SEQ ID NO: 5493673 - DNA, 12 bp, Homo sapiens
ggccagccctcc

SEQ ID NO: 5493674 - DNA, 13 bp, Homo sapiens
ggccagccgctct

SEQ ID NO: 5493675 - DNA, 22 bp, Homo sapiens
ggccagccggacacaagcggcc

SEQ ID NO: 5493676 - DNA, 19 bp, Homo sapiens
ggccagccgggagcttggc

SEQ ID NO: 5493677 - DNA, 14 bp, Homo sapiens
ggccagcctagccc

SEQ ID NO: 5493678 - DNA, 17 bp, Homo sapiens
ggccagcctagcccttg

SEQ ID NO: 5493679 - DNA, 14 bp, Homo sapiens
ggccagcctcaccc

SEQ ID NO: 5493680 - DNA, 16 bp, Homo sapiens
ggccagcctcaccctt

SEQ ID NO: 5493681 - DNA, 11 bp, Homo sapiens
ggccagcctgg

SEQ ID NO: 5493682 - DNA, 18 bp, Homo sapiens
ggccagcctggcatcagt

SEQ ID NO: 5493683 - DNA, 22 bp, Homo sapiens
ggccagcctggcctcctgcctc

SEQ ID NO: 5493684 - DNA, 15 bp, Homo sapiens
ggccagcctggggcc

SEQ ID NO: 5493685 - DNA, 18 bp, Homo sapiens
ggccagcctggggcctgg

SEQ ID NO: 5493686 - DNA, 21 bp, Homo sapiens
ggccagcctggggcctggcag

SEQ ID NO: 5493687 - DNA, 15 bp, Homo sapiens
ggccagcctgtccct

SEQ ID NO: 5493688 - DNA, 14 bp, Homo sapiens
ggccagccttggca

SEQ ID NO: 5493689 - DNA, 17 bp, Homo sapiens
ggccagcgccagggccc

SEQ ID NO: 5493690 - DNA, 18 bp, Homo sapiens
ggccagcgccagggccca

SEQ ID NO: 5493691 - DNA, 19 bp, Homo sapiens
ggccagcgccagggcccag

SEQ ID NO: 5493692 - DNA, 13 bp, Homo sapiens
ggccagcggccct

SEQ ID NO: 5493693 - DNA, 14 bp, Homo sapiens
ggccagcggggctg

SEQ ID NO: 5493694 - DNA, 17 bp, Homo sapiens
ggccagcgtcccagggt

SEQ ID NO: 5493695 - DNA, 20 bp, Homo sapiens
ggccagcgtgaaggacctgg

SEQ ID NO: 5493696 - DNA, 16 bp, Homo sapiens
ggccagctatctgcct

SEQ ID NO: 5493697 - DNA, 18 bp, Homo sapiens
ggccagctatctgcctga

SEQ ID NO: 5493698 - DNA, 12 bp, Homo sapiens
ggccagctcagg

SEQ ID NO: 5493699 - DNA, 21 bp, Homo sapiens
ggccagctccaggagggcttg

SEQ ID NO: 5493700 - DNA, 23 bp, Homo sapiens
ggccagctccaggagggcttgag

SEQ ID NO: 5493701 - DNA, 12 bp, Homo sapiens
ggccagctcccc

SEQ ID NO: 5493702 - DNA, 21 bp, Homo sapiens
ggccagctcccccttgcccgc

SEQ ID NO: 5493703 - DNA, 19 bp, Homo sapiens
ggccagctccttttctgtg

SEQ ID NO: 5493704 - DNA, 24 bp, Homo sapiens
ggccagctctgaggggaggcacct

SEQ ID NO: 5493705 - DNA, 13 bp, Homo sapiens
ggccagctctgga

SEQ ID NO: 5493706 - DNA, 14 bp, Homo sapiens
ggccagctctggag

SEQ ID NO: 5493707 - DNA, 17 bp, Homo sapiens
ggccataattatgaaaa

SEQ ID NO: 5493708 - DNA, 13 bp, Homo sapiens
ggccataccaggt

SEQ ID NO: 5493709 - DNA, 17 bp, Homo sapiens
ggccataccaggtgcta

SEQ ID NO: 5493710 - DNA, 15 bp, Homo sapiens
ggccatactggcctc

SEQ ID NO: 5493711 - DNA, 16 bp, Homo sapiens
ggccatactggcctcg

SEQ ID NO: 5493712 - DNA, 23 bp, Homo sapiens
ggccatactggcctcgcctggcc

SEQ ID NO: 5493713 - DNA, 19 bp, Homo sapiens
ggccatacttttgagaggg

SEQ ID NO: 5493714 - DNA, 13 bp, Homo sapiens
ggccatagaggcc

SEQ ID NO: 5493715 - DNA, 16 bp, Homo sapiens
ggccatagaggcccag

SEQ ID NO: 5493716 - DNA, 17 bp, Homo sapiens
ggccatagctcctgctc

SEQ ID NO: 5493717 - DNA, 18 bp, Homo sapiens
ggccatagtcattctgcc

SEQ ID NO: 5493718 - DNA, 20 bp, Homo sapiens
ggccatagtcattctgcctg

SEQ ID NO: 5493719 - DNA, 20 bp, Homo sapiens
ggccatatatgctgtatttc

SEQ ID NO: 5493720 - DNA, 21 bp, Homo sapiens
ggccatatgtgctatggagag

SEQ ID NO: 5493721 - DNA, 21 bp, Homo sapiens
ggccatattccgcactgggca

SEQ ID NO: 5493722 - DNA, 18 bp, Homo sapiens
ggccatatttacctcagc

SEQ ID NO: 5493723 - DNA, 23 bp, Homo sapiens
ggccatatttgtggcccgtgcag

SEQ ID NO: 5493724 - DNA, 19 bp, Homo sapiens
ggccatcacaggatgccag

SEQ ID NO: 5493725 - DNA, 22 bp, Homo sapiens
ggccatcacaggatgccagccc

SEQ ID NO: 5493726 - DNA, 14 bp, Homo sapiens
ggccatcactcagc

SEQ ID NO: 5493727 - DNA, 17 bp, Homo sapiens
ggccatcactcagcccc

SEQ ID NO: 5493728 - DNA, 19 bp, Homo sapiens
ggccatcactcagccccta

SEQ ID NO: 5493729 - DNA, 21 bp, Homo sapiens
ggccatcactcagcccctacc

SEQ ID NO: 5493730 - DNA, 13 bp, Homo sapiens
ggccatcagggcc

SEQ ID NO: 5493731 - DNA, 16 bp, Homo sapiens
ggccatcagggccctg

SEQ ID NO: 5493732 - DNA, 17 bp, Homo sapiens
ggccatcagggccctgc

SEQ ID NO: 5493733 - DNA, 20 bp, Homo sapiens
ggccatcagggccctgcccc

SEQ ID NO: 5493734 - DNA, 16 bp, Homo sapiens
ggccatccactgtgac

SEQ ID NO: 5493735 - DNA, 13 bp, Homo sapiens
ggccatccctggg

SEQ ID NO: 5493736 - DNA, 17 bp, Homo sapiens
ggccatccctgggcccc

SEQ ID NO: 5493737 - DNA, 19 bp, Homo sapiens
ggccatccctgggcccctc

SEQ ID NO: 5493738 - DNA, 16 bp, Homo sapiens
ggccatcctacccagc

SEQ ID NO: 5493739 - DNA, 15 bp, Homo sapiens
ggccatcctgtccca

SEQ ID NO: 5493740 - DNA, 20 bp, Homo sapiens
ggccatccttccgccaatct

SEQ ID NO: 5493741 - DNA, 21 bp, Homo sapiens
ggccatccttccgccaatctg

SEQ ID NO: 5493742 - DNA, 22 bp, Homo sapiens
ggccatccttccgccaatctgg

SEQ ID NO: 5493743 - DNA, 16 bp, Homo sapiens
ggccatccttctgtgt

SEQ ID NO: 5493744 - DNA, 17 bp, Homo sapiens
ggccatctcaggagatg

SEQ ID NO: 5493745 - DNA, 15 bp, Homo sapiens
ggccatctccctccc

SEQ ID NO: 5493746 - DNA, 17 bp, Homo sapiens
ggccatctccctcccca

SEQ ID NO: 5493747 - DNA, 16 bp, Homo sapiens
ggccatctccttcacc

SEQ ID NO: 5493748 - DNA, 22 bp, Homo sapiens
ggccatctgactgccaagccag

SEQ ID NO: 5493749 - DNA, 14 bp, Homo sapiens
ggccatctgctcct

SEQ ID NO: 5493750 - DNA, 21 bp, Homo sapiens
ggccatctggaaatccagctg

SEQ ID NO: 5493751 - DNA, 22 bp, Homo sapiens
ggccatctgggctcctccaggg

SEQ ID NO: 5493752 - DNA, 15 bp, Homo sapiens
ggccatctgtaaata

SEQ ID NO: 5493753 - DNA, 20 bp, Homo sapiens
ggccatctgtaaatatccca

SEQ ID NO: 5493754 - DNA, 18 bp, Homo sapiens
ggccatcttccaggtggg

SEQ ID NO: 5493755 - DNA, 22 bp, Homo sapiens
ggccatcttccaggtggggtga

SEQ ID NO: 5493756 - DNA, 16 bp, Homo sapiens
ggccatcttctttctt

SEQ ID NO: 5493757 - DNA, 15 bp, Homo sapiens
ggccatgaactttgt

SEQ ID NO: 5493758 - DNA, 17 bp, Homo sapiens
ggccatgaactttgtcc

SEQ ID NO: 5493759 - DNA, 16 bp, Homo sapiens
ggccatgagctccaga

SEQ ID NO: 5493760 - DNA, 18 bp, Homo sapiens
ggccatgagctccagacc

SEQ ID NO: 5493761 - DNA, 22 bp, Homo sapiens
ggccatgagctccagaccccca

SEQ ID NO: 5493762 - DNA, 22 bp, Homo sapiens
ggccatgatggcaacagatctg

SEQ ID NO: 5493763 - DNA, 21 bp, Homo sapiens
ggccatgatgtccttggactc

SEQ ID NO: 5493764 - DNA, 15 bp, Homo sapiens
ggccatgcaggaggt

SEQ ID NO: 5493765 - DNA, 22 bp, Homo sapiens
ggccatgcccaccgcccctgga

SEQ ID NO: 5493766 - DNA, 12 bp, Homo sapiens
ggccatgcccca

SEQ ID NO: 5493767 - DNA, 22 bp, Homo sapiens
ggccatgcgaggggccagcaga

SEQ ID NO: 5493768 - DNA, 23 bp, Homo sapiens
ggccatgcgaggggccagcagag

SEQ ID NO: 5493769 - DNA, 20 bp, Homo sapiens
ggccatgctcaacccccctc

SEQ ID NO: 5493770 - DNA, 16 bp, Homo sapiens
ggccatgctgaaggga

SEQ ID NO: 5493771 - DNA, 14 bp, Homo sapiens
ggccatgctgaggc

SEQ ID NO: 5493772 - DNA, 15 bp, Homo sapiens
ggccatgctgaggcc

SEQ ID NO: 5493773 - DNA, 18 bp, Homo sapiens
ggccatgctgaggcctgg

SEQ ID NO: 5493774 - DNA, 14 bp, Homo sapiens
ggccatgctgtccc

SEQ ID NO: 5493775 - DNA, 16 bp, Homo sapiens
ggccatgctgtccctg

SEQ ID NO: 5493776 - DNA, 17 bp, Homo sapiens
ggccatgctgtccctgc

SEQ ID NO: 5493777 - DNA, 19 bp, Homo sapiens
ggccatgcttcttgcccct

SEQ ID NO: 5493778 - DNA, 20 bp, Homo sapiens
ggccatgcttcttgcccctt

SEQ ID NO: 5493779 - DNA, 22 bp, Homo sapiens
ggccatgcttcttgccccttgg

SEQ ID NO: 5493780 - DNA, 19 bp, Homo sapiens
ggccatgctttccttttct

SEQ ID NO: 5493781 - DNA, 21 bp, Homo sapiens
ggccatggactctgtcctgaa

SEQ ID NO: 5493782 - DNA, 22 bp, Homo sapiens
ggccatggactctgtcctgaag

SEQ ID NO: 5493783 - DNA, 21 bp, Homo sapiens
ggccatggagaaagctgactt

SEQ ID NO: 5493784 - DNA, 14 bp, Homo sapiens
ggccatggagagct

SEQ ID NO: 5493785 - DNA, 16 bp, Homo sapiens
ggccatggagagctgg

SEQ ID NO: 5493786 - DNA, 15 bp, Homo sapiens
ggccatggccaaggg

SEQ ID NO: 5493787 - DNA, 15 bp, Homo sapiens
ggccatggcctctgc

SEQ ID NO: 5493788 - DNA, 13 bp, Homo sapiens
ggccatggcctgc

SEQ ID NO: 5493789 - DNA, 14 bp, Homo sapiens
ggccatggcctgca

SEQ ID NO: 5493790 - DNA, 13 bp, Homo sapiens
ggccatggctgct

SEQ ID NO: 5493791 - DNA, 14 bp, Homo sapiens
ggccatggctgctt

SEQ ID NO: 5493792 - DNA, 22 bp, Homo sapiens
ggccatggctttcatcctgtgt

SEQ ID NO: 5493793 - DNA, 23 bp, Homo sapiens
ggccatggctttcatcctgtgtc

SEQ ID NO: 5493794 - DNA, 22 bp, Homo sapiens
ggccatgggacagggaggacgc

SEQ ID NO: 5493795 - DNA, 13 bp, Homo sapiens
ggccatgggaggc

SEQ ID NO: 5493796 - DNA, 21 bp, Homo sapiens
ggccatgggaggcctttccct

SEQ ID NO: 5493797 - DNA, 13 bp, Homo sapiens
ggccatgggcctc

SEQ ID NO: 5493798 - DNA, 15 bp, Homo sapiens
ggccatggggcagcc

SEQ ID NO: 5493799 - DNA, 22 bp, Homo sapiens
ggccatggggcagcctccagtc

SEQ ID NO: 5493800 - DNA, 18 bp, Homo sapiens
ggccatggggccctccca

SEQ ID NO: 5493801 - DNA, 13 bp, Homo sapiens
ggccatgggggcc

SEQ ID NO: 5493802 - DNA, 15 bp, Homo sapiens
ggccatgggtcctcg

SEQ ID NO: 5493803 - DNA, 20 bp, Homo sapiens
ggccatgggtcctcggccca

SEQ ID NO: 5493804 - DNA, 19 bp, Homo sapiens
ggccatggtacccccttct

SEQ ID NO: 5493805 - DNA, 20 bp, Homo sapiens
ggccatggtacccccttctg

SEQ ID NO: 5493806 - DNA, 15 bp, Homo sapiens
ggccatggtggaggg

SEQ ID NO: 5493807 - DNA, 18 bp, Homo sapiens
ggccatggtggagggcac

SEQ ID NO: 5493808 - DNA, 21 bp, Homo sapiens
ggccatggtggagggcacttc

SEQ ID NO: 5493809 - DNA, 23 bp, Homo sapiens
ggccatggtggagggcacttcag

SEQ ID NO: 5493810 - DNA, 16 bp, Homo sapiens
ggccatgtatgaagcc

SEQ ID NO: 5493811 - DNA, 16 bp, Homo sapiens
ggccatgtcacctggc

SEQ ID NO: 5493812 - DNA, 13 bp, Homo sapiens
ggccatgtccaaa

SEQ ID NO: 5493813 - DNA, 15 bp, Homo sapiens
ggccatgtccaaaga

SEQ ID NO: 5493814 - DNA, 23 bp, Homo sapiens
ggccatgtgagccaccgctgcca

SEQ ID NO: 5493815 - DNA, 16 bp, Homo sapiens
ggccatgtgctgccct

SEQ ID NO: 5493816 - DNA, 20 bp, Homo sapiens
ggccatgtgctgccctgttg

SEQ ID NO: 5493817 - DNA, 15 bp, Homo sapiens
ggccatgtggcctgc

SEQ ID NO: 5493818 - DNA, 22 bp, Homo sapiens
ggccatgtggcctgcccagcct

SEQ ID NO: 5493819 - DNA, 19 bp, Homo sapiens
ggccatgttatgctggtgg

SEQ ID NO: 5493820 - DNA, 13 bp, Homo sapiens
ggccatgttccaa

SEQ ID NO: 5493821 - DNA, 23 bp, Homo sapiens
ggccatgttccaataaacaggag

SEQ ID NO: 5493822 - DNA, 15 bp, Homo sapiens
ggccatgttcccaga

SEQ ID NO: 5493823 - DNA, 17 bp, Homo sapiens
ggccatgttcccagaac

SEQ ID NO: 5493824 - DNA, 21 bp, Homo sapiens
ggccatgttgtgcctccctgg

SEQ ID NO: 5493825 - DNA, 11 bp, Homo sapiens
ggccattaccc

SEQ ID NO: 5493826 - DNA, 23 bp, Homo sapiens
ggccattctgattggacctggcc

SEQ ID NO: 5493827 - DNA, 13 bp, Homo sapiens
ggccattcttatg

SEQ ID NO: 5493828 - DNA, 17 bp, Homo sapiens
ggccattgaacactgca

SEQ ID NO: 5493829 - DNA, 20 bp, Homo sapiens
ggccattgaacactgcaccc

SEQ ID NO: 5493830 - DNA, 17 bp, Homo sapiens
ggccattgtgaaccaat

SEQ ID NO: 5493831 - DNA, 23 bp, Homo sapiens
ggccatttcaccagtcactgcca

SEQ ID NO: 5493832 - DNA, 16 bp, Homo sapiens
ggccatttctaaataa

SEQ ID NO: 5493833 - DNA, 22 bp, Homo sapiens
ggccatttgctagttctgctgc

SEQ ID NO: 5493834 - DNA, 15 bp, Homo sapiens
ggccatttgctgccc

SEQ ID NO: 5493835 - DNA, 19 bp, Homo sapiens
ggccatttgctgccctggg

SEQ ID NO: 5493836 - DNA, 20 bp, Homo sapiens
ggccatttgctgccctgggg

SEQ ID NO: 5493837 - DNA, 21 bp, Homo sapiens
ggccatttgctgccctggggc

SEQ ID NO: 5493838 - DNA, 22 bp, Homo sapiens
ggccatttgctgccctggggca

SEQ ID NO: 5493839 - DNA, 14 bp, Homo sapiens
ggccatttggcccc

SEQ ID NO: 5493840 - DNA, 23 bp, Homo sapiens
ggccattttggggggttatttat

SEQ ID NO: 5493841 - DNA, 18 bp, Homo sapiens
ggcccaaagcccagctct

SEQ ID NO: 5493842 - DNA, 14 bp, Homo sapiens
ggcccaaaggccca

SEQ ID NO: 5493843 - DNA, 16 bp, Homo sapiens
ggcccaaaggcccagg

SEQ ID NO: 5493844 - DNA, 19 bp, Homo sapiens
ggcccaaaggcccagggag

SEQ ID NO: 5493845 - DNA, 14 bp, Homo sapiens
ggcccaaataacag

SEQ ID NO: 5493846 - DNA, 21 bp, Homo sapiens
ggcccaaattatcaagctaat

SEQ ID NO: 5493847 - DNA, 17 bp, Homo sapiens
ggcccaaccctgtctgt

SEQ ID NO: 5493848 - DNA, 13 bp, Homo sapiens
ggcccaacctcgc

SEQ ID NO: 5493849 - DNA, 17 bp, Homo sapiens
ggcccaacctcgccctc

SEQ ID NO: 5493850 - DNA, 18 bp, Homo sapiens
ggcccaacctcgccctct

SEQ ID NO: 5493851 - DNA, 20 bp, Homo sapiens
ggcccaacctcgccctctct

SEQ ID NO: 5493852 - DNA, 13 bp, Homo sapiens
ggcccaagaactg

SEQ ID NO: 5493853 - DNA, 12 bp, Homo sapiens
ggcccaagagag

SEQ ID NO: 5493854 - DNA, 14 bp, Homo sapiens
ggcccaagagagac

SEQ ID NO: 5493855 - DNA, 20 bp, Homo sapiens
ggcccaagagcagagtctgg

SEQ ID NO: 5493856 - DNA, 20 bp, Homo sapiens
ggcccaagagtctggggacc

SEQ ID NO: 5493857 - DNA, 18 bp, Homo sapiens
ggcccaagcatgccccac

SEQ ID NO: 5493858 - DNA, 18 bp, Homo sapiens
ggcccaagccccatctca

SEQ ID NO: 5493859 - DNA, 18 bp, Homo sapiens
ggcccaagccctccacat

SEQ ID NO: 5493860 - DNA, 13 bp, Homo sapiens
ggcccaagctggg

SEQ ID NO: 5493861 - DNA, 19 bp, Homo sapiens
ggcccaagctgggctccct

SEQ ID NO: 5493862 - DNA, 20 bp, Homo sapiens
ggcccaagctgggctccctt

SEQ ID NO: 5493863 - DNA, 13 bp, Homo sapiens
ggcccaaggagct

SEQ ID NO: 5493864 - DNA, 14 bp, Homo sapiens
ggcccaaggagctt

SEQ ID NO: 5493865 - DNA, 21 bp, Homo sapiens
ggcccaaggagggtccaggcg

SEQ ID NO: 5493866 - DNA, 13 bp, Homo sapiens
ggcccaaggcggc

SEQ ID NO: 5493867 - DNA, 19 bp, Homo sapiens
ggcccaaggtcccctccac

SEQ ID NO: 5493868 - DNA, 17 bp, Homo sapiens
ggcccaagtcattgttt

SEQ ID NO: 5493869 - DNA, 21 bp, Homo sapiens
ggcccaagtggggtgctctgg

SEQ ID NO: 5493870 - DNA, 19 bp, Homo sapiens
ggcccaagttgcagtgagc

SEQ ID NO: 5493871 - DNA, 23 bp, Homo sapiens
ggcccaagttgcagtgagcaggg

SEQ ID NO: 5493872 - DNA, 21 bp, Homo sapiens
ggcccaatgaggtggctcatg

SEQ ID NO: 5493873 - DNA, 20 bp, Homo sapiens
ggcccacaaaggggagaagg

SEQ ID NO: 5493874 - DNA, 15 bp, Homo sapiens
ggcccacacacaggt

SEQ ID NO: 5493875 - DNA, 12 bp, Homo sapiens
ggcccacacctg

SEQ ID NO: 5493876 - DNA, 14 bp, Homo sapiens
ggcccacacctggt

SEQ ID NO: 5493877 - DNA, 23 bp, Homo sapiens
ggcccacagcccccaccccagca

SEQ ID NO: 5493878 - DNA, 13 bp, Homo sapiens
ggcccacagctcc

SEQ ID NO: 5493879 - DNA, 18 bp, Homo sapiens
ggcccacagctcccaccc

SEQ ID NO: 5493880 - DNA, 16 bp, Homo sapiens
ggcccacagctctgct

SEQ ID NO: 5493881 - DNA, 22 bp, Homo sapiens
ggcccacaggaagctcagcctt

SEQ ID NO: 5493882 - DNA, 18 bp, Homo sapiens
ggcccacaggaggcaagc

SEQ ID NO: 5493883 - DNA, 19 bp, Homo sapiens
ggcccccgccttggcctgt

SEQ ID NO: 5493884 - DNA, 23 bp, Homo sapiens
ggcccccgccttggcctgtgttc

SEQ ID NO: 5493885 - DNA, 22 bp, Homo sapiens
ggcccccggaggcgcccacctg

SEQ ID NO: 5493886 - DNA, 18 bp, Homo sapiens
ggcccccggccacgctcc

SEQ ID NO: 5493887 - DNA, 21 bp, Homo sapiens
ggcccccggctttcctccgga

SEQ ID NO: 5493888 - DNA, 22 bp, Homo sapiens
ggcccccggctttcctccggag

SEQ ID NO: 5493889 - DNA, 17 bp, Homo sapiens
ggcccccgggcctgcac

SEQ ID NO: 5493890 - DNA, 19 bp, Homo sapiens
ggcccccgggcctgcacag

SEQ ID NO: 5493891 - DNA, 20 bp, Homo sapiens
ggcccccgggcctgcacaga

SEQ ID NO: 5493892 - DNA, 22 bp, Homo sapiens
ggccccctaggattccccctgc

SEQ ID NO: 5493893 - DNA, 20 bp, Homo sapiens
ggccccctcaccccagctcc

SEQ ID NO: 5493894 - DNA, 15 bp, Homo sapiens
ggccccctcagctct

SEQ ID NO: 5493895 - DNA, 19 bp, Homo sapiens
ggccccctcagctctgtcc

SEQ ID NO: 5493896 - DNA, 15 bp, Homo sapiens
ggccccctccatcgg

SEQ ID NO: 5493897 - DNA, 17 bp, Homo sapiens
ggccccctccctggatg

SEQ ID NO: 5493898 - DNA, 21 bp, Homo sapiens
ggccccctcgcgcccctgtcc

SEQ ID NO: 5493899 - DNA, 20 bp, Homo sapiens
ggccccctctcggccaggca

SEQ ID NO: 5493900 - DNA, 13 bp, Homo sapiens
ggccccctgcatc

SEQ ID NO: 5493901 - DNA, 11 bp, Homo sapiens
ggccccctgcc

SEQ ID NO: 5493902 - DNA, 13 bp, Homo sapiens
ggccccctgcccg

SEQ ID NO: 5493903 - DNA, 12 bp, Homo sapiens
ggccccctgcct

SEQ ID NO: 5493904 - DNA, 13 bp, Homo sapiens
ggccccctgcctg

SEQ ID NO: 5493905 - DNA, 17 bp, Homo sapiens
ggccccctgcctgccct

SEQ ID NO: 5493906 - DNA, 14 bp, Homo sapiens
ggccccctgtgcca

SEQ ID NO: 5493907 - DNA, 20 bp, Homo sapiens
ggccccctgtgccagctcag

SEQ ID NO: 5493908 - DNA, 19 bp, Homo sapiens
ggcccccttcaccccttca

SEQ ID NO: 5493909 - DNA, 13 bp, Homo sapiens
ggcccccttcctg

SEQ ID NO: 5493910 - DNA, 17 bp, Homo sapiens
ggccccctttcccgggc

SEQ ID NO: 5493911 - DNA, 23 bp, Homo sapiens
ggccccgacgtttgcggcagtgt

SEQ ID NO: 5493912 - DNA, 17 bp, Homo sapiens
ggccccgaggacccaga

SEQ ID NO: 5493913 - DNA, 19 bp, Homo sapiens
ggccccgaggacccagacc

SEQ ID NO: 5493914 - DNA, 22 bp, Homo sapiens
ggccccgatggactcctgacca

SEQ ID NO: 5493915 - DNA, 21 bp, Homo sapiens
ggccccgcacccctcctcctt

SEQ ID NO: 5493916 - DNA, 16 bp, Homo sapiens
ggccccgccagggctg

SEQ ID NO: 5493917 - DNA, 21 bp, Homo sapiens
ggccccgcccgagcccctgcc

SEQ ID NO: 5493918 - DNA, 16 bp, Homo sapiens
ggccccgccctcaggc

SEQ ID NO: 5493919 - DNA, 13 bp, Homo sapiens
ggccccgcctcaa

SEQ ID NO: 5493920 - DNA, 22 bp, Homo sapiens
ggccccgcgcgtgcccccagcg

SEQ ID NO: 5493921 - DNA, 17 bp, Homo sapiens
ggccccgcggagccccc

SEQ ID NO: 5493922 - DNA, 18 bp, Homo sapiens
ggccccgcggagcccccg

SEQ ID NO: 5493923 - DNA, 21 bp, Homo sapiens
ggccccgcttgtccagcgcct

SEQ ID NO: 5493924 - DNA, 17 bp, Homo sapiens
ggccccggatcagagca

SEQ ID NO: 5493925 - DNA, 20 bp, Homo sapiens
ggccccggatgacttgggga

SEQ ID NO: 5493926 - DNA, 16 bp, Homo sapiens
ggccccggccccagcc

SEQ ID NO: 5493927 - DNA, 17 bp, Homo sapiens
ggccccggccccagcca

SEQ ID NO: 5493928 - DNA, 21 bp, Homo sapiens
ggccccggccccagccagagt

SEQ ID NO: 5493929 - DNA, 13 bp, Homo sapiens
ggccccggctccc

SEQ ID NO: 5493930 - DNA, 19 bp, Homo sapiens
ggccccgggacccacggag

SEQ ID NO: 5493931 - DNA, 17 bp, Homo sapiens
ggccccgggctctggcc

SEQ ID NO: 5493932 - DNA, 21 bp, Homo sapiens
ggccccgggctctggccaccc

SEQ ID NO: 5493933 - DNA, 14 bp, Homo sapiens
ggccccgggcttcc

SEQ ID NO: 5493934 - DNA, 13 bp, Homo sapiens
ggccccggggctg

SEQ ID NO: 5493935 - DNA, 15 bp, Homo sapiens
ggccccggggctggc

SEQ ID NO: 5493936 - DNA, 16 bp, Homo sapiens
ggccccgggtccagga

SEQ ID NO: 5493937 - DNA, 20 bp, Homo sapiens
ggccccgggttcagcctggc

SEQ ID NO: 5493938 - DNA, 22 bp, Homo sapiens
ggccccgtctctcttggaccca

SEQ ID NO: 5493939 - DNA, 18 bp, Homo sapiens
ggccccgtgggtgggcct

SEQ ID NO: 5493940 - DNA, 15 bp, Homo sapiens
ggccccgtggtgaca

SEQ ID NO: 5493941 - DNA, 23 bp, Homo sapiens
ggcccctagaaaccacctgggtt

SEQ ID NO: 5493942 - DNA, 20 bp, Homo sapiens
ggcccctaggctgctgctgt

SEQ ID NO: 5493943 - DNA, 13 bp, Homo sapiens
ggcccctcacatc

SEQ ID NO: 5493944 - DNA, 12 bp, Homo sapiens
ggcccctcaccc

SEQ ID NO: 5493945 - DNA, 15 bp, Homo sapiens
ggcccctcaccctct

SEQ ID NO: 5493946 - DNA, 23 bp, Homo sapiens
ggcccctcacctggtacctggac

SEQ ID NO: 5493947 - DNA, 15 bp, Homo sapiens
ggcccctcactggct

SEQ ID NO: 5493948 - DNA, 17 bp, Homo sapiens
ggcccctcactggctgg

SEQ ID NO: 5493949 - DNA, 19 bp, Homo sapiens
ggcccctcactggctggac

SEQ ID NO: 5493950 - DNA, 21 bp, Homo sapiens
ggcccctcagagccctgccct

SEQ ID NO: 5493951 - DNA, 14 bp, Homo sapiens
ggcccctcagccac

SEQ ID NO: 5493952 - DNA, 16 bp, Homo sapiens
ggcccctcagcctgcc

SEQ ID NO: 5493953 - DNA, 18 bp, Homo sapiens
ggcccctcagcctgcctg

SEQ ID NO: 5493954 - DNA, 21 bp, Homo sapiens
ggcccctcagcctgcctgaag

SEQ ID NO: 5493955 - DNA, 22 bp, Homo sapiens
ggcccctcaggggaagctgcta

SEQ ID NO: 5493956 - DNA, 23 bp, Homo sapiens
ggcccctcaggggaagctgctag

SEQ ID NO: 5493957 - DNA, 16 bp, Homo sapiens
ggcccctcagggtccc

SEQ ID NO: 5493958 - DNA, 20 bp, Homo sapiens
ggcccctcagggtccctggt

SEQ ID NO: 5493959 - DNA, 12 bp, Homo sapiens
ggcccctccact

SEQ ID NO: 5493960 - DNA, 14 bp, Homo sapiens
ggcccctccagacc

SEQ ID NO: 5493961 - DNA, 12 bp, Homo sapiens
ggcccctccagc

SEQ ID NO: 5493962 - DNA, 15 bp, Homo sapiens
ggcccctccagcaca

SEQ ID NO: 5493963 - DNA, 14 bp, Homo sapiens
ggcccctcccacac

SEQ ID NO: 5493964 - DNA, 12 bp, Homo sapiens
ggcccctcccca

SEQ ID NO: 5493965 - DNA, 23 bp, Homo sapiens
ggcccctccccaactccttcctc

SEQ ID NO: 5493966 - DNA, 15 bp, Homo sapiens
ggcccctcccctcag

SEQ ID NO: 5493967 - DNA, 18 bp, Homo sapiens
ggcccctcccctcagagc

SEQ ID NO: 5493968 - DNA, 18 bp, Homo sapiens
ggcccctccctcccggct

SEQ ID NO: 5493969 - DNA, 23 bp, Homo sapiens
ggcccctccctctccagcaggcc

SEQ ID NO: 5493970 - DNA, 14 bp, Homo sapiens
ggcccctccctctg

SEQ ID NO: 5493971 - DNA, 17 bp, Homo sapiens
ggcccctccctctgccc

SEQ ID NO: 5493972 - DNA, 18 bp, Homo sapiens
ggcccctccctctgcccc

SEQ ID NO: 5493973 - DNA, 17 bp, Homo sapiens
ggcccctcctagaccca

SEQ ID NO: 5493974 - DNA, 15 bp, Homo sapiens
ggcccctcctccaga

SEQ ID NO: 5493975 - DNA, 14 bp, Homo sapiens
ggcccctcctccta

SEQ ID NO: 5493976 - DNA, 19 bp, Homo sapiens
ggcccctcctctgtgctcc

SEQ ID NO: 5493977 - DNA, 20 bp, Homo sapiens
ggcccctcctctgtgctccc

SEQ ID NO: 5493978 - DNA, 21 bp, Homo sapiens
ggcccctcctctgtgctccct

SEQ ID NO: 5493979 - DNA, 23 bp, Homo sapiens
ggcccctcctctgtgctccctcg

SEQ ID NO: 5493980 - DNA, 15 bp, Homo sapiens
ggcccctccttctcc

SEQ ID NO: 5493981 - DNA, 23 bp, Homo sapiens
ggcccctccttctcccctccaga

SEQ ID NO: 5493982 - DNA, 16 bp, Homo sapiens
ggcccctccttgcaac

SEQ ID NO: 5493983 - DNA, 11 bp, Homo sapiens
ggcccctctct

SEQ ID NO: 5493984 - DNA, 19 bp, Homo sapiens
ggcccctctctagggaccc

SEQ ID NO: 5493985 - DNA, 15 bp, Homo sapiens
ggcccctctgcccag

SEQ ID NO: 5493986 - DNA, 12 bp, Homo sapiens
ggcccctctgct

SEQ ID NO: 5493987 - DNA, 20 bp, Homo sapiens
ggcccctcttattcctctag

SEQ ID NO: 5493988 - DNA, 23 bp, Homo sapiens
ggcccctcttattcctctaggca

SEQ ID NO: 5493989 - DNA, 19 bp, Homo sapiens
ggcccctgagcctgtgtcc

SEQ ID NO: 5493990 - DNA, 13 bp, Homo sapiens
ggcccctgaggac

SEQ ID NO: 5493991 - DNA, 19 bp, Homo sapiens
ggcccctgaggactggaga

SEQ ID NO: 5493992 - DNA, 21 bp, Homo sapiens
ggcccctgaggagctttgtgt

SEQ ID NO: 5493993 - DNA, 11 bp, Homo sapiens
ggcccctgccc

SEQ ID NO: 5493994 - DNA, 13 bp, Homo sapiens
ggcccctgcccgg

SEQ ID NO: 5493995 - DNA, 16 bp, Homo sapiens
ggcccctgcccggctg

SEQ ID NO: 5493996 - DNA, 16 bp, Homo sapiens
ggcccctgcttctcca

SEQ ID NO: 5493997 - DNA, 21 bp, Homo sapiens
ggcccctgcttctccagcctg

SEQ ID NO: 5493998 - DNA, 12 bp, Homo sapiens
ggcccctggcac

SEQ ID NO: 5493999 - DNA, 21 bp, Homo sapiens
ggcccctggcagcacagccca

SEQ ID NO: 5494000 - DNA, 15 bp, Homo sapiens
ggcccctggcccagc

SEQ ID NO: 5494001 - DNA, 17 bp, Homo sapiens
ggcccctggcccagcgg

SEQ ID NO: 5494002 - DNA, 16 bp, Homo sapiens
ggcccctggcccagga

SEQ ID NO: 5494003 - DNA, 19 bp, Homo sapiens
ggcccctggcccaggagga

SEQ ID NO: 5494004 - DNA, 22 bp, Homo sapiens
ggcccctgggatgggaccaggg

SEQ ID NO: 5494005 - DNA, 13 bp, Homo sapiens
ggcccctgggccc

SEQ ID NO: 5494006 - DNA, 13 bp, Homo sapiens
ggcccctgggctc

SEQ ID NO: 5494007 - DNA, 23 bp, Homo sapiens
ggcccctgggcttggcctgctgt

SEQ ID NO: 5494008 - DNA, 17 bp, Homo sapiens
ggcccctggggacagag

SEQ ID NO: 5494009 - DNA, 13 bp, Homo sapiens
ggcccctgtctgt

SEQ ID NO: 5494010 - DNA, 19 bp, Homo sapiens
ggcccctgtctgttcccag

SEQ ID NO: 5494011 - DNA, 19 bp, Homo sapiens
ggcccctgtgcagtagaga

SEQ ID NO: 5494012 - DNA, 18 bp, Homo sapiens
ggcccctgtgtgagttga

SEQ ID NO: 5494013 - DNA, 21 bp, Homo sapiens
ggcccctgttcccccgctggc

SEQ ID NO: 5494014 - DNA, 21 bp, Homo sapiens
ggccccttccaaatgtccctc

SEQ ID NO: 5494015 - DNA, 20 bp, Homo sapiens
ggccccttgactctggggac

SEQ ID NO: 5494016 - DNA, 19 bp, Homo sapiens
ggccccttgctgctggctc

SEQ ID NO: 5494017 - DNA, 21 bp, Homo sapiens
ggccccttgctgctggctccc

SEQ ID NO: 5494018 - DNA, 18 bp, Homo sapiens
ggcccctttgctgaccct

SEQ ID NO: 5494019 - DNA, 18 bp, Homo sapiens
ggcccctttggacctgca

SEQ ID NO: 5494020 - DNA, 18 bp, Homo sapiens
ggcccctttgggccctgc

SEQ ID NO: 5494021 - DNA, 20 bp, Homo sapiens
ggcccctttgggccctgcat

SEQ ID NO: 5494022 - DNA, 19 bp, Homo sapiens
ggcccctttttactcccct

SEQ ID NO: 5494023 - DNA, 17 bp, Homo sapiens
ggcccgaacagggactt

SEQ ID NO: 5494024 - DNA, 13 bp, Homo sapiens
ggcccgacagaga

SEQ ID NO: 5494025 - DNA, 16 bp, Homo sapiens
ggcccgacagagagat

SEQ ID NO: 5494026 - DNA, 18 bp, Homo sapiens
ggcccgacaggtgggcct

SEQ ID NO: 5494027 - DNA, 21 bp, Homo sapiens
ggcccgacaggtgggcctggg

SEQ ID NO: 5494028 - DNA, 13 bp, Homo sapiens
ggcccgacatggc

SEQ ID NO: 5494029 - DNA, 18 bp, Homo sapiens
ggcccgagagctgggact

SEQ ID NO: 5494030 - DNA, 22 bp, Homo sapiens
ggcccgagcagctgagcagggc

SEQ ID NO: 5494031 - DNA, 22 bp, Homo sapiens
ggcccgagcctgaactgagccc

SEQ ID NO: 5494032 - DNA, 15 bp, Homo sapiens
ggcccgagcgcctgc

SEQ ID NO: 5494033 - DNA, 14 bp, Homo sapiens
ggcccgaggcaccg

SEQ ID NO: 5494034 - DNA, 13 bp, Homo sapiens
ggcccgagggtgg

SEQ ID NO: 5494035 - DNA, 19 bp, Homo sapiens
ggcccgcaagagggacaga

SEQ ID NO: 5494036 - DNA, 23 bp, Homo sapiens
ggcccgcaagagggacagagccc

SEQ ID NO: 5494037 - DNA, 20 bp, Homo sapiens
ggcccgcactcaggagcaca

SEQ ID NO: 5494038 - DNA, 18 bp, Homo sapiens
ggcccgcagcctggcatc

SEQ ID NO: 5494039 - DNA, 21 bp, Homo sapiens
ggcccgcagtgctgggaccag

SEQ ID NO: 5494040 - DNA, 22 bp, Homo sapiens
ggcccgcagtgctgggaccaga

SEQ ID NO: 5494041 - DNA, 23 bp, Homo sapiens
ggcccgcagtgctgggaccagag

SEQ ID NO: 5494042 - DNA, 15 bp, Homo sapiens
ggcccgccccaggcc

SEQ ID NO: 5494043 - DNA, 21 bp, Homo sapiens
ggcccgccccaggccccagca

SEQ ID NO: 5494044 - DNA, 12 bp, Homo sapiens
ggcccgcccctc

SEQ ID NO: 5494045 - DNA, 18 bp, Homo sapiens
ggcccgccctcacctctg

SEQ ID NO: 5494046 - DNA, 18 bp, Homo sapiens
ggcccgccgtgcctgcat

SEQ ID NO: 5494047 - DNA, 19 bp, Homo sapiens
ggcccgcctcggcctccca

SEQ ID NO: 5494048 - DNA, 12 bp, Homo sapiens
ggcccgcctgcc

SEQ ID NO: 5494049 - DNA, 14 bp, Homo sapiens
ggcccgcctgccac

SEQ ID NO: 5494050 - DNA, 15 bp, Homo sapiens
ggcccgcctggcaga

SEQ ID NO: 5494051 - DNA, 23 bp, Homo sapiens
ggcccgcgatgtggaactgctgc

SEQ ID NO: 5494052 - DNA, 17 bp, Homo sapiens
ggcccgcgccacaggac

SEQ ID NO: 5494053 - DNA, 15 bp, Homo sapiens
ggcccgcggcctgca

SEQ ID NO: 5494054 - DNA, 15 bp, Homo sapiens
ggcccgcgggcacag

SEQ ID NO: 5494055 - DNA, 17 bp, Homo sapiens
ggcccgctcaacctctc

SEQ ID NO: 5494056 - DNA, 22 bp, Homo sapiens
ggcccgctcaacctctcagatc

SEQ ID NO: 5494057 - DNA, 18 bp, Homo sapiens
ggcccgctgcagcctctg

SEQ ID NO: 5494058 - DNA, 16 bp, Homo sapiens
ggcccgctgcctcttg

SEQ ID NO: 5494059 - DNA, 17 bp, Homo sapiens
ggcccgctgcctcttgg

SEQ ID NO: 5494060 - DNA, 14 bp, Homo sapiens
ggccctgcgccctg

SEQ ID NO: 5494061 - DNA, 16 bp, Homo sapiens
ggccctgcgccctgtg

SEQ ID NO: 5494062 - DNA, 18 bp, Homo sapiens
ggccctgcgccctgtgca

SEQ ID NO: 5494063 - DNA, 17 bp, Homo sapiens
ggccctgcgtcggccct

SEQ ID NO: 5494064 - DNA, 10 bp, Homo sapiens
ggccctgcta

SEQ ID NO: 5494065 - DNA, 14 bp, Homo sapiens
ggccctgctacctg

SEQ ID NO: 5494066 - DNA, 12 bp, Homo sapiens
ggccctgctgcc

SEQ ID NO: 5494067 - DNA, 14 bp, Homo sapiens
ggccctgctgccca

SEQ ID NO: 5494068 - DNA, 14 bp, Homo sapiens
ggccctgctgcccc

SEQ ID NO: 5494069 - DNA, 18 bp, Homo sapiens
ggccctgctgcccctccc

SEQ ID NO: 5494070 - DNA, 15 bp, Homo sapiens
ggccctgcttcctgc

SEQ ID NO: 5494071 - DNA, 12 bp, Homo sapiens
ggccctggaaga

SEQ ID NO: 5494072 - DNA, 19 bp, Homo sapiens
ggccctggacacagcccac

SEQ ID NO: 5494073 - DNA, 11 bp, Homo sapiens
ggccctggagc

SEQ ID NO: 5494074 - DNA, 21 bp, Homo sapiens
ggccctggagcagccacccca

SEQ ID NO: 5494075 - DNA, 18 bp, Homo sapiens
ggccctggagccagggca

SEQ ID NO: 5494076 - DNA, 12 bp, Homo sapiens
ggccctggagct

SEQ ID NO: 5494077 - DNA, 12 bp, Homo sapiens
ggccctggaggc

SEQ ID NO: 5494078 - DNA, 15 bp, Homo sapiens
ggccctggagggcag

SEQ ID NO: 5494079 - DNA, 19 bp, Homo sapiens
ggccctggagggcagagac

SEQ ID NO: 5494080 - DNA, 22 bp, Homo sapiens
ggccctggatcagcgtggcctt

SEQ ID NO: 5494081 - DNA, 18 bp, Homo sapiens
ggccctggatgtgcccac

SEQ ID NO: 5494082 - DNA, 17 bp, Homo sapiens
ggccctggcagaagcca

SEQ ID NO: 5494083 - DNA, 15 bp, Homo sapiens
ggccctggccagccg

SEQ ID NO: 5494084 - DNA, 13 bp, Homo sapiens
ggccctggccctt

SEQ ID NO: 5494085 - DNA, 14 bp, Homo sapiens
ggccctggcctccc

SEQ ID NO: 5494086 - DNA, 13 bp, Homo sapiens
ggccctggccttg

SEQ ID NO: 5494087 - DNA, 14 bp, Homo sapiens
ggccctggcgggtg

SEQ ID NO: 5494088 - DNA, 12 bp, Homo sapiens
ggccctggctct

SEQ ID NO: 5494089 - DNA, 18 bp, Homo sapiens
ggccctggctctgtcact

SEQ ID NO: 5494090 - DNA, 11 bp, Homo sapiens
ggccctggctg

SEQ ID NO: 5494091 - DNA, 14 bp, Homo sapiens
ggccctggcttgga

SEQ ID NO: 5494092 - DNA, 18 bp, Homo sapiens
ggccctggcttggaggct

SEQ ID NO: 5494093 - DNA, 14 bp, Homo sapiens
ggccctgggcaggg

SEQ ID NO: 5494094 - DNA, 12 bp, Homo sapiens
ggccctgggcct

SEQ ID NO: 5494095 - DNA, 21 bp, Homo sapiens
ggccctgggctcggaggctgc

SEQ ID NO: 5494096 - DNA, 16 bp, Homo sapiens
ggccctgggctgatgg

SEQ ID NO: 5494097 - DNA, 13 bp, Homo sapiens
ggccctgggctgg

SEQ ID NO: 5494098 - DNA, 15 bp, Homo sapiens
ggccctgggctggaa

SEQ ID NO: 5494099 - DNA, 21 bp, Homo sapiens
ggccctgggctgggtgctggg

SEQ ID NO: 5494100 - DNA, 12 bp, Homo sapiens
ggccctggggag

SEQ ID NO: 5494101 - DNA, 22 bp, Homo sapiens
ggccctggggatcttcccacag

SEQ ID NO: 5494102 - DNA, 12 bp, Homo sapiens
ggccctggggcc

SEQ ID NO: 5494103 - DNA, 13 bp, Homo sapiens
ggccctggggcct

SEQ ID NO: 5494104 - DNA, 18 bp, Homo sapiens
ggccctggggcctgtact

SEQ ID NO: 5494105 - DNA, 23 bp, Homo sapiens
ggccctggggcctgtactgcctg

SEQ ID NO: 5494106 - DNA, 21 bp, Homo sapiens
ggccctggggcgggcagccag

SEQ ID NO: 5494107 - DNA, 22 bp, Homo sapiens
ggccctggggcgggcagccagg

SEQ ID NO: 5494108 - DNA, 14 bp, Homo sapiens
ggccctggggctgc

SEQ ID NO: 5494109 - DNA, 22 bp, Homo sapiens
ggccctggggctgccctcggca

SEQ ID NO: 5494110 - DNA, 11 bp, Homo sapiens
ggccctggggg

SEQ ID NO: 5494111 - DNA, 20 bp, Homo sapiens
ggccctggggtctctgagca

SEQ ID NO: 5494112 - DNA, 17 bp, Homo sapiens
ggccctggtcctggcct

SEQ ID NO: 5494113 - DNA, 15 bp, Homo sapiens
ggccctggtccttcc

SEQ ID NO: 5494114 - DNA, 14 bp, Homo sapiens
ggccctggtctggc

SEQ ID NO: 5494115 - DNA, 15 bp, Homo sapiens
ggccctggtgtcagg

SEQ ID NO: 5494116 - DNA, 17 bp, Homo sapiens
ggccctggttcctgctg

SEQ ID NO: 5494117 - DNA, 20 bp, Homo sapiens
ggccctggttcctgctgtcc

SEQ ID NO: 5494118 - DNA, 22 bp, Homo sapiens
ggccctggttcctgctgtcctg

SEQ ID NO: 5494119 - DNA, 18 bp, Homo sapiens
ggccctgtagccctggcc

SEQ ID NO: 5494120 - DNA, 19 bp, Homo sapiens
ggccctgtagttaggcctg

SEQ ID NO: 5494121 - DNA, 18 bp, Homo sapiens
ggccctgtcactgtccag

SEQ ID NO: 5494122 - DNA, 11 bp, Homo sapiens
ggccctgtccc

SEQ ID NO: 5494123 - DNA, 16 bp, Homo sapiens
ggccctgtcccagcag

SEQ ID NO: 5494124 - DNA, 16 bp, Homo sapiens
ggccctgtccctccca

SEQ ID NO: 5494125 - DNA, 17 bp, Homo sapiens
ggccctgtccctcccac

SEQ ID NO: 5494126 - DNA, 12 bp, Homo sapiens
ggccctgtctct

SEQ ID NO: 5494127 - DNA, 14 bp, Homo sapiens
ggccctgtctctgg

SEQ ID NO: 5494128 - DNA, 20 bp, Homo sapiens
ggccctgtgatatggcggcc

SEQ ID NO: 5494129 - DNA, 12 bp, Homo sapiens
ggccctgtgcct

SEQ ID NO: 5494130 - DNA, 17 bp, Homo sapiens
ggccctgtgccttggtg

SEQ ID NO: 5494131 - DNA, 10 bp, Homo sapiens
ggccctgtgg

SEQ ID NO: 5494132 - DNA, 15 bp, Homo sapiens
ggccctgtggcagga

SEQ ID NO: 5494133 - DNA, 20 bp, Homo sapiens
ggccctgtggtgctgggaga

SEQ ID NO: 5494134 - DNA, 20 bp, Homo sapiens
ggccctgtgtgtttgacatg

SEQ ID NO: 5494135 - DNA, 16 bp, Homo sapiens
ggcccttacacactca

SEQ ID NO: 5494136 - DNA, 19 bp, Homo sapiens
ggcccttacacccttgtcc

SEQ ID NO: 5494137 - DNA, 18 bp, Homo sapiens
ggcccttagaatgtgaaa

SEQ ID NO: 5494138 - DNA, 21 bp, Homo sapiens
ggcccttcaggaactggggct

SEQ ID NO: 5494139 - DNA, 11 bp, Homo sapiens
ggcccttcagt

SEQ ID NO: 5494140 - DNA, 18 bp, Homo sapiens
ggcccttcagtctgctcc

SEQ ID NO: 5494141 - DNA, 21 bp, Homo sapiens
ggcccttcagtctgctccacc

SEQ ID NO: 5494142 - DNA, 19 bp, Homo sapiens
ggcccttcccacaggacat

SEQ ID NO: 5494143 - DNA, 15 bp, Homo sapiens
ggcccttcccctccc

SEQ ID NO: 5494144 - DNA, 11 bp, Homo sapiens
ggcccttcctc

SEQ ID NO: 5494145 - DNA, 19 bp, Homo sapiens
ggcccttcctctccactgc

SEQ ID NO: 5494146 - DNA, 22 bp, Homo sapiens
ggcccttcctctccactgcctt

SEQ ID NO: 5494147 - DNA, 23 bp, Homo sapiens
ggcccttcctctccactgccttc

SEQ ID NO: 5494148 - DNA, 16 bp, Homo sapiens
ggcccttcctctttgg

SEQ ID NO: 5494149 - DNA, 14 bp, Homo sapiens
ggcccttcctggac

SEQ ID NO: 5494150 - DNA, 16 bp, Homo sapiens
ggcccttcctggacag

SEQ ID NO: 5494151 - DNA, 20 bp, Homo sapiens
ggcccttcctggacagctgt

SEQ ID NO: 5494152 - DNA, 16 bp, Homo sapiens
ggcccttcctggctag

SEQ ID NO: 5494153 - DNA, 12 bp, Homo sapiens
ggcccttccttc

SEQ ID NO: 5494154 - DNA, 19 bp, Homo sapiens
ggcccttctctccagcccc

SEQ ID NO: 5494155 - DNA, 22 bp, Homo sapiens
ggcccttctctccagcccctgg

SEQ ID NO: 5494156 - DNA, 17 bp, Homo sapiens
ggcccttctgactgttt

SEQ ID NO: 5494157 - DNA, 18 bp, Homo sapiens
ggcccttctgactgttta

SEQ ID NO: 5494158 - DNA, 23 bp, Homo sapiens
ggcccttctgactgtttatttaa

SEQ ID NO: 5494159 - DNA, 15 bp, Homo sapiens
ggcccttctgtccac

SEQ ID NO: 5494160 - DNA, 19 bp, Homo sapiens
ggcccttcttgctgccctg

SEQ ID NO: 5494161 - DNA, 19 bp, Homo sapiens
ggcccttgagtccccattg

SEQ ID NO: 5494162 - DNA, 15 bp, Homo sapiens
ggcccttgcccaact

SEQ ID NO: 5494163 - DNA, 21 bp, Homo sapiens
ggcccttgcccaactcccagc

SEQ ID NO: 5494164 - DNA, 21 bp, Homo sapiens
ggcccttgccggggcctggac

SEQ ID NO: 5494165 - DNA, 18 bp, Homo sapiens
ggcccttgcctttgtggc

SEQ ID NO: 5494166 - DNA, 21 bp, Homo sapiens
ggcccttgcctttgtggcctt

SEQ ID NO: 5494167 - DNA, 11 bp, Homo sapiens
ggcccttggaa

SEQ ID NO: 5494168 - DNA, 16 bp, Homo sapiens
ggcccttggaaaaaca

SEQ ID NO: 5494169 - DNA, 13 bp, Homo sapiens
ggcccttggaata

SEQ ID NO: 5494170 - DNA, 16 bp, Homo sapiens
ggcccttggaataaag

SEQ ID NO: 5494171 - DNA, 17 bp, Homo sapiens
ggcccttgggacagcca

SEQ ID NO: 5494172 - DNA, 19 bp, Homo sapiens
ggcccttgggccacgctct

SEQ ID NO: 5494173 - DNA, 15 bp, Homo sapiens
ggcccttggggcctg

SEQ ID NO: 5494174 - DNA, 16 bp, Homo sapiens
ggcccttggggcctgg

SEQ ID NO: 5494175 - DNA, 18 bp, Homo sapiens
ggcccttggggcctggct

SEQ ID NO: 5494176 - DNA, 17 bp, Homo sapiens
ggcccttggggctgggg

SEQ ID NO: 5494177 - DNA, 18 bp, Homo sapiens
ggcccttgtcattgcctt

SEQ ID NO: 5494178 - DNA, 18 bp, Homo sapiens
ggcccttgtcctgccagc

SEQ ID NO: 5494179 - DNA, 21 bp, Homo sapiens
ggcccttgtcctgccagctgc

SEQ ID NO: 5494180 - DNA, 23 bp, Homo sapiens
ggcccttgtgctcctctcgcaca

SEQ ID NO: 5494181 - DNA, 21 bp, Homo sapiens
ggccctttcacccctcttccc

SEQ ID NO: 5494182 - DNA, 20 bp, Homo sapiens
ggccctttccccttcccctc

SEQ ID NO: 5494183 - DNA, 19 bp, Homo sapiens
ggccctttccttccagatc

SEQ ID NO: 5494184 - DNA, 13 bp, Homo sapiens
ggccctttgctgt

SEQ ID NO: 5494185 - DNA, 14 bp, Homo sapiens
ggcccttttctggc

SEQ ID NO: 5494186 - DNA, 20 bp, Homo sapiens
ggcccttttctggctcctgt

SEQ ID NO: 5494187 - DNA, 22 bp, Homo sapiens
ggcccttttctggctcctgtgt

SEQ ID NO: 5494188 - DNA, 19 bp, Homo sapiens
ggccctttttcaataactg

SEQ ID NO: 5494189 - DNA, 16 bp, Homo sapiens
ggccctttttcccttc

SEQ ID NO: 5494190 - DNA, 19 bp, Homo sapiens
ggccctttttcccttccct

SEQ ID NO: 5494191 - DNA, 18 bp, Homo sapiens
ggccgaaccccccactcc

SEQ ID NO: 5494192 - DNA, 19 bp, Homo sapiens
ggccgaagccccttggaga

SEQ ID NO: 5494193 - DNA, 14 bp, Homo sapiens
ggccgaagctctgg

SEQ ID NO: 5494194 - DNA, 20 bp, Homo sapiens
ggccgaagctgctgtgactg

SEQ ID NO: 5494195 - DNA, 16 bp, Homo sapiens
ggccgaaggtgcctca

SEQ ID NO: 5494196 - DNA, 13 bp, Homo sapiens
ggccgaatgggca

SEQ ID NO: 5494197 - DNA, 21 bp, Homo sapiens
ggccgacagtcggtgacccca

SEQ ID NO: 5494198 - DNA, 17 bp, Homo sapiens
ggccgacatcagcccgg

SEQ ID NO: 5494199 - DNA, 18 bp, Homo sapiens
ggccgacatcagcccggt

SEQ ID NO: 5494200 - DNA, 17 bp, Homo sapiens
ggccgacattgtctccc

SEQ ID NO: 5494201 - DNA, 19 bp, Homo sapiens
ggccgacattgtctcccgc

SEQ ID NO: 5494202 - DNA, 17 bp, Homo sapiens
ggccgaccctgcggcct

SEQ ID NO: 5494203 - DNA, 22 bp, Homo sapiens
ggccgaccctgcggcctccacc

SEQ ID NO: 5494204 - DNA, 17 bp, Homo sapiens
ggccgacggcggcggcc

SEQ ID NO: 5494205 - DNA, 17 bp, Homo sapiens
ggccgactcagggacct

SEQ ID NO: 5494206 - DNA, 16 bp, Homo sapiens
ggccgactgggctgct

SEQ ID NO: 5494207 - DNA, 19 bp, Homo sapiens
ggccgactgggctgctggg

SEQ ID NO: 5494208 - DNA, 12 bp, Homo sapiens
ggccgagaagca

SEQ ID NO: 5494209 - DNA, 12 bp, Homo sapiens
ggccgagagcct

SEQ ID NO: 5494210 - DNA, 15 bp, Homo sapiens
ggccgagagccttat

SEQ ID NO: 5494211 - DNA, 14 bp, Homo sapiens
ggccgagaggacag

SEQ ID NO: 5494212 - DNA, 14 bp, Homo sapiens
ggccgagcccacac

SEQ ID NO: 5494213 - DNA, 19 bp, Homo sapiens
ggccgagcccacaccatct

SEQ ID NO: 5494214 - DNA, 20 bp, Homo sapiens
ggccgagcggtggccccgag

SEQ ID NO: 5494215 - DNA, 18 bp, Homo sapiens
ggccgagcgttcccagca

SEQ ID NO: 5494216 - DNA, 19 bp, Homo sapiens
ggccgagcgttcccagcag

SEQ ID NO: 5494217 - DNA, 19 bp, Homo sapiens
ggccgagctcctggggagc

SEQ ID NO: 5494218 - DNA, 18 bp, Homo sapiens
ggccgaggaccaccagca

SEQ ID NO: 5494219 - DNA, 12 bp, Homo sapiens
ggccgaggcagg

SEQ ID NO: 5494220 - DNA, 13 bp, Homo sapiens
ggccgaggcaggg

SEQ ID NO: 5494221 - DNA, 16 bp, Homo sapiens
ggccgaggcccagcgg

SEQ ID NO: 5494222 - DNA, 19 bp, Homo sapiens
ggccgaggcccagcgggca

SEQ ID NO: 5494223 - DNA, 14 bp, Homo sapiens
ggccgagggaaatg

SEQ ID NO: 5494224 - DNA, 16 bp, Homo sapiens
ggccgagggccaggca

SEQ ID NO: 5494225 - DNA, 17 bp, Homo sapiens
ggccgagggccaggcag

SEQ ID NO: 5494226 - DNA, 18 bp, Homo sapiens
ggccgagggccaggcaga

SEQ ID NO: 5494227 - DNA, 21 bp, Homo sapiens
ggccgagggcttccctagatg

SEQ ID NO: 5494228 - DNA, 16 bp, Homo sapiens
ggccgagtccaagctg

SEQ ID NO: 5494229 - DNA, 15 bp, Homo sapiens
ggccgagtctgtcct

SEQ ID NO: 5494230 - DNA, 19 bp, Homo sapiens
ggccgagtctgtcctggaa

SEQ ID NO: 5494231 - DNA, 16 bp, Homo sapiens
ggccgatggggcagtc

SEQ ID NO: 5494232 - DNA, 20 bp, Homo sapiens
ggccgatgtgggtccctctc

SEQ ID NO: 5494233 - DNA, 20 bp, Homo sapiens
ggccgatttgggaaccaagc

SEQ ID NO: 5494234 - DNA, 15 bp, Homo sapiens
ggccgcaacttccca

SEQ ID NO: 5494235 - DNA, 16 bp, Homo sapiens
ggccgcaacttcccag

SEQ ID NO: 5494236 - DNA, 18 bp, Homo sapiens
ggccgcaacttcccaggc

SEQ ID NO: 5494237 - DNA, 19 bp, Homo sapiens
ggccgcaacttcccaggcc

SEQ ID NO: 5494238 - DNA, 16 bp, Homo sapiens
ggccgcaagggcctgg

SEQ ID NO: 5494239 - DNA, 18 bp, Homo sapiens
ggccgcaagggcctggac

SEQ ID NO: 5494240 - DNA, 19 bp, Homo sapiens
ggcctagctgctacaaaga

SEQ ID NO: 5494241 - DNA, 13 bp, Homo sapiens
ggcctaggcacct

SEQ ID NO: 5494242 - DNA, 14 bp, Homo sapiens
ggcctaggcacctc

SEQ ID NO: 5494243 - DNA, 22 bp, Homo sapiens
ggcctaggcacctccccgctct

SEQ ID NO: 5494244 - DNA, 12 bp, Homo sapiens
ggcctaggctgc

SEQ ID NO: 5494245 - DNA, 14 bp, Homo sapiens
ggcctaggctgcat

SEQ ID NO: 5494246 - DNA, 22 bp, Homo sapiens
ggcctaggggtggcgctcagac

SEQ ID NO: 5494247 - DNA, 22 bp, Homo sapiens
ggcctaggtcacgttggccctc

SEQ ID NO: 5494248 - DNA, 20 bp, Homo sapiens
ggcctagtaaccaaggccct

SEQ ID NO: 5494249 - DNA, 15 bp, Homo sapiens
ggcctagtacaatct

SEQ ID NO: 5494250 - DNA, 19 bp, Homo sapiens
ggcctagtacaatcttggg

SEQ ID NO: 5494251 - DNA, 15 bp, Homo sapiens
ggcctagtcagatgg

SEQ ID NO: 5494252 - DNA, 19 bp, Homo sapiens
ggcctagtcagatggatgt

SEQ ID NO: 5494253 - DNA, 15 bp, Homo sapiens
ggcctagtcccttcc

SEQ ID NO: 5494254 - DNA, 14 bp, Homo sapiens
ggcctagtggcttc

SEQ ID NO: 5494255 - DNA, 20 bp, Homo sapiens
ggcctagtggcttcagcccc

SEQ ID NO: 5494256 - DNA, 21 bp, Homo sapiens
ggcctagtggcttcagcccct

SEQ ID NO: 5494257 - DNA, 15 bp, Homo sapiens
ggcctatcagtgtgc

SEQ ID NO: 5494258 - DNA, 18 bp, Homo sapiens
ggcctatcagtgtgcccc

SEQ ID NO: 5494259 - DNA, 23 bp, Homo sapiens
ggcctatcagtgtgccccccatc

SEQ ID NO: 5494260 - DNA, 18 bp, Homo sapiens
ggcctatctcctagggct

SEQ ID NO: 5494261 - DNA, 16 bp, Homo sapiens
ggcctatgaccctgtg

SEQ ID NO: 5494262 - DNA, 20 bp, Homo sapiens
ggcctatgaccctgtgcctg

SEQ ID NO: 5494263 - DNA, 21 bp, Homo sapiens
ggcctatgaccctgtgcctgt

SEQ ID NO: 5494264 - DNA, 14 bp, Homo sapiens
ggcctatgcagaca

SEQ ID NO: 5494265 - DNA, 21 bp, Homo sapiens
ggcctatgcagacatctctgg

SEQ ID NO: 5494266 - DNA, 22 bp, Homo sapiens
ggcctatgcagacatctctgga

SEQ ID NO: 5494267 - DNA, 17 bp, Homo sapiens
ggcctatgccacctgca

SEQ ID NO: 5494268 - DNA, 18 bp, Homo sapiens
ggcctatgccacctgcag

SEQ ID NO: 5494269 - DNA, 19 bp, Homo sapiens
ggcctatgccacctgcagc

SEQ ID NO: 5494270 - DNA, 18 bp, Homo sapiens
ggcctatggagagccctg

SEQ ID NO: 5494271 - DNA, 19 bp, Homo sapiens
ggcctattatattaaaata

SEQ ID NO: 5494272 - DNA, 18 bp, Homo sapiens
ggcctattgcttgggtct

SEQ ID NO: 5494273 - DNA, 18 bp, Homo sapiens
ggcctattgttgaataaa

SEQ ID NO: 5494274 - DNA, 14 bp, Homo sapiens
ggcctatttcatca

SEQ ID NO: 5494275 - DNA, 15 bp, Homo sapiens
ggcctcaaaacagaa

SEQ ID NO: 5494276 - DNA, 23 bp, Homo sapiens
ggcctcaaagcaagcattcagaa

SEQ ID NO: 5494277 - DNA, 15 bp, Homo sapiens
ggcctcaacaaggat

SEQ ID NO: 5494278 - DNA, 16 bp, Homo sapiens
ggcctcaaccctccct

SEQ ID NO: 5494279 - DNA, 19 bp, Homo sapiens
ggcctcaaccctccctcag

SEQ ID NO: 5494280 - DNA, 23 bp, Homo sapiens
ggcctcaagaaacaatgtctggg

SEQ ID NO: 5494281 - DNA, 21 bp, Homo sapiens
ggcctcaagagcacacagaga

SEQ ID NO: 5494282 - DNA, 21 bp, Homo sapiens
ggcctcaagccatcttcccgc

SEQ ID NO: 5494283 - DNA, 13 bp, Homo sapiens
ggcctcaagcgtg

SEQ ID NO: 5494284 - DNA, 15 bp, Homo sapiens
ggcctcaccacctga

SEQ ID NO: 5494285 - DNA, 18 bp, Homo sapiens
ggcctcacccctcccctg

SEQ ID NO: 5494286 - DNA, 15 bp, Homo sapiens
ggcctcacctctacc

SEQ ID NO: 5494287 - DNA, 17 bp, Homo sapiens
ggcctcacctgcccctc

SEQ ID NO: 5494288 - DNA, 22 bp, Homo sapiens
ggcctcacctggcttcccagga

SEQ ID NO: 5494289 - DNA, 23 bp, Homo sapiens
ggcctcacctggcttcccaggac

SEQ ID NO: 5494290 - DNA, 21 bp, Homo sapiens
ggcctcacgcccagcctcctc

SEQ ID NO: 5494291 - DNA, 22 bp, Homo sapiens
ggcctcacgggaccgtcagcat

SEQ ID NO: 5494292 - DNA, 14 bp, Homo sapiens
ggcctcactggctg

SEQ ID NO: 5494293 - DNA, 15 bp, Homo sapiens
ggcctcactggctgg

SEQ ID NO: 5494294 - DNA, 18 bp, Homo sapiens
ggcctcacttaattagaa

SEQ ID NO: 5494295 - DNA, 10 bp, Homo sapiens
ggcctcagaa

SEQ ID NO: 5494296 - DNA, 23 bp, Homo sapiens
ggcctcagaccaactctctcctg

SEQ ID NO: 5494297 - DNA, 23 bp, Homo sapiens
ggcctcagactgcacccaggagg

SEQ ID NO: 5494298 - DNA, 11 bp, Homo sapiens
ggcctcagagc

SEQ ID NO: 5494299 - DNA, 15 bp, Homo sapiens
ggcctcagagcctga

SEQ ID NO: 5494300 - DNA, 18 bp, Homo sapiens
ggcctcagagcctgacct

SEQ ID NO: 5494301 - DNA, 13 bp, Homo sapiens
ggcctcagagctt

SEQ ID NO: 5494302 - DNA, 18 bp, Homo sapiens
ggcctcagagcttcctgg

SEQ ID NO: 5494303 - DNA, 22 bp, Homo sapiens
ggcctcagagcttcctggggac

SEQ ID NO: 5494304 - DNA, 11 bp, Homo sapiens
ggcctcagcag

SEQ ID NO: 5494305 - DNA, 17 bp, Homo sapiens
ggcctcagccagagaag

SEQ ID NO: 5494306 - DNA, 16 bp, Homo sapiens
ggcctcagccagctgc

SEQ ID NO: 5494307 - DNA, 12 bp, Homo sapiens
ggcctcagccct

SEQ ID NO: 5494308 - DNA, 13 bp, Homo sapiens
ggcctcagccctc

SEQ ID NO: 5494309 - DNA, 16 bp, Homo sapiens
ggcctcagccctgctc

SEQ ID NO: 5494310 - DNA, 21 bp, Homo sapiens
ggcctcagccctgctccctgc

SEQ ID NO: 5494311 - DNA, 22 bp, Homo sapiens
ggcctcagccctgctccctgcc

SEQ ID NO: 5494312 - DNA, 22 bp, Homo sapiens
ggcctcagcctggggctctctg

SEQ ID NO: 5494313 - DNA, 17 bp, Homo sapiens
ggcctcagctgcctcac

SEQ ID NO: 5494314 - DNA, 16 bp, Homo sapiens
ggcctcagctggctgt

SEQ ID NO: 5494315 - DNA, 13 bp, Homo sapiens
ggcctcaggctcc

SEQ ID NO: 5494316 - DNA, 14 bp, Homo sapiens
ggcctcaggctctg

SEQ ID NO: 5494317 - DNA, 22 bp, Homo sapiens
ggcctcagggaccaaggagatg

SEQ ID NO: 5494318 - DNA, 14 bp, Homo sapiens
ggcctcagggcgct

SEQ ID NO: 5494319 - DNA, 24 bp, Homo sapiens
ggcctcagggcgctcagacggcgg

SEQ ID NO: 5494320 - DNA, 13 bp, Homo sapiens
ggcctcagggctc

SEQ ID NO: 5494321 - DNA, 17 bp, Homo sapiens
ggcctcagggctccttg

SEQ ID NO: 5494322 - DNA, 14 bp, Homo sapiens
ggcctcagggtcct

SEQ ID NO: 5494323 - DNA, 19 bp, Homo sapiens
ggcctcagggtcctgccct

SEQ ID NO: 5494324 - DNA, 14 bp, Homo sapiens
ggcctcagggtcta

SEQ ID NO: 5494325 - DNA, 13 bp, Homo sapiens
ggcctcaggtgct

SEQ ID NO: 5494326 - DNA, 16 bp, Homo sapiens
ggcctcagtgccccat

SEQ ID NO: 5494327 - DNA, 20 bp, Homo sapiens
ggcctcagtggactttccac

SEQ ID NO: 5494328 - DNA, 18 bp, Homo sapiens
ggcctcagttcccagctc

SEQ ID NO: 5494329 - DNA, 14 bp, Homo sapiens
ggcctcagtttccc

SEQ ID NO: 5494330 - DNA, 20 bp, Homo sapiens
ggcctcagtttctccatcag

SEQ ID NO: 5494331 - DNA, 21 bp, Homo sapiens
ggcctcatcacagcaatattt

SEQ ID NO: 5494332 - DNA, 15 bp, Homo sapiens
ggcctcatccagggc

SEQ ID NO: 5494333 - DNA, 21 bp, Homo sapiens
ggcctcatccctcggaagccg

SEQ ID NO: 5494334 - DNA, 15 bp, Homo sapiens
ggcctcatcctcctg

SEQ ID NO: 5494335 - DNA, 19 bp, Homo sapiens
ggcctcatctcagaccctg

SEQ ID NO: 5494336 - DNA, 17 bp, Homo sapiens
ggcctcatctctgcctg

SEQ ID NO: 5494337 - DNA, 18 bp, Homo sapiens
ggcctcatctctgcctga

SEQ ID NO: 5494338 - DNA, 15 bp, Homo sapiens
ggcctcatgaataaa

SEQ ID NO: 5494339 - DNA, 22 bp, Homo sapiens
ggcctcatgaataaatggcttc

SEQ ID NO: 5494340 - DNA, 16 bp, Homo sapiens
ggcctcatgcctgctg

SEQ ID NO: 5494341 - DNA, 18 bp, Homo sapiens
ggcctcatgcctgctgag

SEQ ID NO: 5494342 - DNA, 19 bp, Homo sapiens
ggcctcatgtggctggaag

SEQ ID NO: 5494343 - DNA, 16 bp, Homo sapiens
ggcctcattcagcaga

SEQ ID NO: 5494344 - DNA, 13 bp, Homo sapiens
ggcctccaacctt

SEQ ID NO: 5494345 - DNA, 17 bp, Homo sapiens
ggcctccaacgcccctg

SEQ ID NO: 5494346 - DNA, 18 bp, Homo sapiens
ggcctccacctctgtgca

SEQ ID NO: 5494347 - DNA, 12 bp, Homo sapiens
ggcctccactcc

SEQ ID NO: 5494348 - DNA, 16 bp, Homo sapiens
ggcctccactccccca

SEQ ID NO: 5494349 - DNA, 23 bp, Homo sapiens
ggcctccactcccccacctgaca

SEQ ID NO: 5494350 - DNA, 15 bp, Homo sapiens
ggcctccactccttc

SEQ ID NO: 5494351 - DNA, 21 bp, Homo sapiens
ggcctccactccttccatctc

SEQ ID NO: 5494352 - DNA, 14 bp, Homo sapiens
ggcctccagaacct

SEQ ID NO: 5494353 - DNA, 12 bp, Homo sapiens
ggcctccagact

SEQ ID NO: 5494354 - DNA, 13 bp, Homo sapiens
ggcctccagactg

SEQ ID NO: 5494355 - DNA, 17 bp, Homo sapiens
ggcctccagactgcgga

SEQ ID NO: 5494356 - DNA, 22 bp, Homo sapiens
ggcctccagactgcggagcagc

SEQ ID NO: 5494357 - DNA, 22 bp, Homo sapiens
ggcctccagccctctcactgtg

SEQ ID NO: 5494358 - DNA, 12 bp, Homo sapiens
ggcctccagcct

SEQ ID NO: 5494359 - DNA, 13 bp, Homo sapiens
ggcctccagcctc

SEQ ID NO: 5494360 - DNA, 14 bp, Homo sapiens
ggcctccagcctct

SEQ ID NO: 5494361 - DNA, 23 bp, Homo sapiens
ggcctccagcctctcccggctgc

SEQ ID NO: 5494362 - DNA, 12 bp, Homo sapiens
ggcctccagctc

SEQ ID NO: 5494363 - DNA, 10 bp, Homo sapiens
ggcctccagg

SEQ ID NO: 5494364 - DNA, 11 bp, Homo sapiens
ggcctccagga

SEQ ID NO: 5494365 - DNA, 15 bp, Homo sapiens
ggcctccaggagggg

SEQ ID NO: 5494366 - DNA, 14 bp, Homo sapiens
ggcctccaggcccg

SEQ ID NO: 5494367 - DNA, 17 bp, Homo sapiens
ggcctccaggcccgtct

SEQ ID NO: 5494368 - DNA, 23 bp, Homo sapiens
ggcctccaggcccgtctgtccat

SEQ ID NO: 5494369 - DNA, 16 bp, Homo sapiens
ggcctccaggctgggg

SEQ ID NO: 5494370 - DNA, 19 bp, Homo sapiens
ggcctccaggctggggcct

SEQ ID NO: 5494371 - DNA, 16 bp, Homo sapiens
ggcctccatcctcatc

SEQ ID NO: 5494372 - DNA, 13 bp, Homo sapiens
ggcctccatcctg

SEQ ID NO: 5494373 - DNA, 22 bp, Homo sapiens
ggcctccatgccccagctctgg

SEQ ID NO: 5494374 - DNA, 18 bp, Homo sapiens
ggcctccatgggccccag

SEQ ID NO: 5494375 - DNA, 17 bp, Homo sapiens
ggcctccattcctggag

SEQ ID NO: 5494376 - DNA, 14 bp, Homo sapiens
ggcctccatttctg

SEQ ID NO: 5494377 - DNA, 12 bp, Homo sapiens
ggcctcccaaag

SEQ ID NO: 5494378 - DNA, 17 bp, Homo sapiens
ggcctcccaaagtgctg

SEQ ID NO: 5494379 - DNA, 13 bp, Homo sapiens
ggcctcccaactc

SEQ ID NO: 5494380 - DNA, 18 bp, Homo sapiens
ggcctcccaactcacccc

SEQ ID NO: 5494381 - DNA, 20 bp, Homo sapiens
ggcctcccaactcaccccag

SEQ ID NO: 5494382 - DNA, 12 bp, Homo sapiens
ggcctcccaagc

SEQ ID NO: 5494383 - DNA, 18 bp, Homo sapiens
ggcctcccaataaagctg

SEQ ID NO: 5494384 - DNA, 19 bp, Homo sapiens
ggcctcccaataaagctgg

SEQ ID NO: 5494385 - DNA, 20 bp, Homo sapiens
ggcctcccaataaagctgga

SEQ ID NO: 5494386 - DNA, 15 bp, Homo sapiens
ggcctcccacagtga

SEQ ID NO: 5494387 - DNA, 12 bp, Homo sapiens
ggcctcccaccc

SEQ ID NO: 5494388 - DNA, 20 bp, Homo sapiens
ggcctcccacccgatgctgc

SEQ ID NO: 5494389 - DNA, 21 bp, Homo sapiens
ggcctcccacccgatgctgct

SEQ ID NO: 5494390 - DNA, 19 bp, Homo sapiens
ggcctcccactcccatggc

SEQ ID NO: 5494391 - DNA, 17 bp, Homo sapiens
ggcctcccagagtgctg

SEQ ID NO: 5494392 - DNA, 14 bp, Homo sapiens
ggcctcccagccac

SEQ ID NO: 5494393 - DNA, 15 bp, Homo sapiens
ggcctcccagccacc

SEQ ID NO: 5494394 - DNA, 19 bp, Homo sapiens
ggcctcccagccacccgga

SEQ ID NO: 5494395 - DNA, 12 bp, Homo sapiens
ggcctcccccac

SEQ ID NO: 5494396 - DNA, 16 bp, Homo sapiens
ggcctcccccagccag

SEQ ID NO: 5494397 - DNA, 18 bp, Homo sapiens
ggcctcccccagccagga

SEQ ID NO: 5494398 - DNA, 12 bp, Homo sapiens
ggcctccccgag

SEQ ID NO: 5494399 - DNA, 22 bp, Homo sapiens
ggcctccccgggggtccccgga

SEQ ID NO: 5494400 - DNA, 21 bp, Homo sapiens
ggcctcccctccatgggcgtc

SEQ ID NO: 5494401 - DNA, 17 bp, Homo sapiens
ggcctcccctgggcagg

SEQ ID NO: 5494402 - DNA, 16 bp, Homo sapiens
ggcctcccgaggaggg

SEQ ID NO: 5494403 - DNA, 19 bp, Homo sapiens
ggcctcccgaggaggggcc

SEQ ID NO: 5494404 - DNA, 21 bp, Homo sapiens
ggcctccctagcacctccccc

SEQ ID NO: 5494405 - DNA, 21 bp, Homo sapiens
ggcctccctcaggctctgtgg

SEQ ID NO: 5494406 - DNA, 11 bp, Homo sapiens
ggcctccctcc

SEQ ID NO: 5494407 - DNA, 12 bp, Homo sapiens
ggcctccctcca

SEQ ID NO: 5494408 - DNA, 15 bp, Homo sapiens
ggcctccctccttgg

SEQ ID NO: 5494409 - DNA, 14 bp, Homo sapiens
ggcctccctgcaga

SEQ ID NO: 5494410 - DNA, 13 bp, Homo sapiens
ggcctccctgcca

SEQ ID NO: 5494411 - DNA, 15 bp, Homo sapiens
ggcctccctgcctca

SEQ ID NO: 5494412 - DNA, 12 bp, Homo sapiens
ggcctccctgct

SEQ ID NO: 5494413 - DNA, 12 bp, Homo sapiens
ggcctccctggc

SEQ ID NO: 5494414 - DNA, 22 bp, Homo sapiens
ggcctcccttgagtaggccctg

SEQ ID NO: 5494415 - DNA, 22 bp, Homo sapiens
ggcctccgatgcctggcctgcc

SEQ ID NO: 5494416 - DNA, 14 bp, Homo sapiens
ggcctccggcctcc

SEQ ID NO: 5494417 - DNA, 19 bp, Homo sapiens
ggcctccggcgtcagcctc

SEQ ID NO: 5494418 - DNA, 22 bp, Homo sapiens
ggcctccgtcatgaatgccttc

SEQ ID NO: 5494419 - DNA, 20 bp, Homo sapiens
ggcctgcagaccctgccagg

SEQ ID NO: 5494420 - DNA, 22 bp, Homo sapiens
ggcctgcagaccctgccagggg

SEQ ID NO: 5494421 - DNA, 13 bp, Homo sapiens
ggcctgcagccca

SEQ ID NO: 5494422 - DNA, 17 bp, Homo sapiens
ggcctgcagcccagaac

SEQ ID NO: 5494423 - DNA, 18 bp, Homo sapiens
ggcctgcagcccctaagt

SEQ ID NO: 5494424 - DNA, 20 bp, Homo sapiens
ggcctgcaggacctgcctgt

SEQ ID NO: 5494425 - DNA, 21 bp, Homo sapiens
ggcctgcaggacctgcctgta

SEQ ID NO: 5494426 - DNA, 12 bp, Homo sapiens
ggcctgcaggag

SEQ ID NO: 5494427 - DNA, 14 bp, Homo sapiens
ggcctgcaggcccc

SEQ ID NO: 5494428 - DNA, 20 bp, Homo sapiens
ggcctgcaggccccagccaa

SEQ ID NO: 5494429 - DNA, 13 bp, Homo sapiens
ggcctgcagggcc

SEQ ID NO: 5494430 - DNA, 17 bp, Homo sapiens
ggcctgcagggcctctg

SEQ ID NO: 5494431 - DNA, 16 bp, Homo sapiens
ggcctgcatggagaag

SEQ ID NO: 5494432 - DNA, 18 bp, Homo sapiens
ggcctgccaatgccacag

SEQ ID NO: 5494433 - DNA, 19 bp, Homo sapiens
ggcctgccaatgccacagc

SEQ ID NO: 5494434 - DNA, 23 bp, Homo sapiens
ggcctgccaatgccacagccaag

SEQ ID NO: 5494435 - DNA, 19 bp, Homo sapiens
ggcctgccaccctcctgcg

SEQ ID NO: 5494436 - DNA, 20 bp, Homo sapiens
ggcctgccactctcctgagg

SEQ ID NO: 5494437 - DNA, 21 bp, Homo sapiens
ggcctgcccaatgctttggga

SEQ ID NO: 5494438 - DNA, 13 bp, Homo sapiens
ggcctgcccagcc

SEQ ID NO: 5494439 - DNA, 16 bp, Homo sapiens
ggcctgcccagcctca

SEQ ID NO: 5494440 - DNA, 12 bp, Homo sapiens
ggcctgccccca

SEQ ID NO: 5494441 - DNA, 13 bp, Homo sapiens
ggcctgcccccct

SEQ ID NO: 5494442 - DNA, 18 bp, Homo sapiens
ggcctgccccccttccca

SEQ ID NO: 5494443 - DNA, 15 bp, Homo sapiens
ggcctgccccctggg

SEQ ID NO: 5494444 - DNA, 19 bp, Homo sapiens
ggcctgccccctgggctgg

SEQ ID NO: 5494445 - DNA, 21 bp, Homo sapiens
ggcctgccctcacgctctcca

SEQ ID NO: 5494446 - DNA, 16 bp, Homo sapiens
ggcctgccctcaggga

SEQ ID NO: 5494447 - DNA, 17 bp, Homo sapiens
ggcctgccctctgcccc

SEQ ID NO: 5494448 - DNA, 11 bp, Homo sapiens
ggcctgccctg

SEQ ID NO: 5494449 - DNA, 17 bp, Homo sapiens
ggcctgccggacacagc

SEQ ID NO: 5494450 - DNA, 17 bp, Homo sapiens
ggcctgcctagcactca

SEQ ID NO: 5494451 - DNA, 20 bp, Homo sapiens
ggcctgcctcccagccctgc

SEQ ID NO: 5494452 - DNA, 23 bp, Homo sapiens
ggcctgcctcccagccctgccag

SEQ ID NO: 5494453 - DNA, 18 bp, Homo sapiens
ggcctgcctctgactcac

SEQ ID NO: 5494454 - DNA, 15 bp, Homo sapiens
ggcctgcctgcctcc

SEQ ID NO: 5494455 - DNA, 18 bp, Homo sapiens
ggcctgcctgcctccacc

SEQ ID NO: 5494456 - DNA, 18 bp, Homo sapiens
ggcctgccttgaagccac

SEQ ID NO: 5494457 - DNA, 15 bp, Homo sapiens
ggcctgcgagaccca

SEQ ID NO: 5494458 - DNA, 18 bp, Homo sapiens
ggcctgcgcccagagctg

SEQ ID NO: 5494459 - DNA, 19 bp, Homo sapiens
ggcctgcgcccagagctgg

SEQ ID NO: 5494460 - DNA, 21 bp, Homo sapiens
ggcctgcgcccagagctggcc

SEQ ID NO: 5494461 - DNA, 19 bp, Homo sapiens
ggcctgcggaggcggtggc

SEQ ID NO: 5494462 - DNA, 20 bp, Homo sapiens
ggcctgcggccgggctgccc

SEQ ID NO: 5494463 - DNA, 21 bp, Homo sapiens
ggcctgcggggttccctgcgc

SEQ ID NO: 5494464 - DNA, 18 bp, Homo sapiens
ggcctgctaaggctcctc

SEQ ID NO: 5494465 - DNA, 20 bp, Homo sapiens
ggcctgctaaggctcctcct

SEQ ID NO: 5494466 - DNA, 16 bp, Homo sapiens
ggcctgctagtcactg

SEQ ID NO: 5494467 - DNA, 13 bp, Homo sapiens
ggcctgctctgct

SEQ ID NO: 5494468 - DNA, 15 bp, Homo sapiens
ggcctgctgaggcct

SEQ ID NO: 5494469 - DNA, 10 bp, Homo sapiens
ggcctgctgc

SEQ ID NO: 5494470 - DNA, 13 bp, Homo sapiens
ggcctgctgccag

SEQ ID NO: 5494471 - DNA, 18 bp, Homo sapiens
ggcctgctgcgtcagacc

SEQ ID NO: 5494472 - DNA, 11 bp, Homo sapiens
ggcctgctgct

SEQ ID NO: 5494473 - DNA, 20 bp, Homo sapiens
ggcctgctggaggcctcagg

SEQ ID NO: 5494474 - DNA, 23 bp, Homo sapiens
ggcctgctggagttccggcctgg

SEQ ID NO: 5494475 - DNA, 12 bp, Homo sapiens
ggcctgctggca

SEQ ID NO: 5494476 - DNA, 15 bp, Homo sapiens
ggcctgctggcatca

SEQ ID NO: 5494477 - DNA, 23 bp, Homo sapiens
ggcctgctgggctctccacctca

SEQ ID NO: 5494478 - DNA, 19 bp, Homo sapiens
ggcctgctgggcttggctc

SEQ ID NO: 5494479 - DNA, 20 bp, Homo sapiens
ggcctgcttgactttccaga

SEQ ID NO: 5494480 - DNA, 17 bp, Homo sapiens
ggcctgcttttccagga

SEQ ID NO: 5494481 - DNA, 21 bp, Homo sapiens
ggcctgcttttccaggatcct

SEQ ID NO: 5494482 - DNA, 24 bp, Homo sapiens
ggcctggaaccagggaggagagga

SEQ ID NO: 5494483 - DNA, 15 bp, Homo sapiens
ggcctggacccctgg

SEQ ID NO: 5494484 - DNA, 20 bp, Homo sapiens
ggcctggaccgagatgtgag

SEQ ID NO: 5494485 - DNA, 21 bp, Homo sapiens
ggcctggaccgagatgtgagt

SEQ ID NO: 5494486 - DNA, 22 bp, Homo sapiens
ggcctggaccgcttcccagagg

SEQ ID NO: 5494487 - DNA, 20 bp, Homo sapiens
ggcctggacctatgcaggga

SEQ ID NO: 5494488 - DNA, 21 bp, Homo sapiens
ggcctggacctatgcagggag

SEQ ID NO: 5494489 - DNA, 22 bp, Homo sapiens
ggcctggacctgcctcctgcct

SEQ ID NO: 5494490 - DNA, 16 bp, Homo sapiens
ggcctggacctgggat

SEQ ID NO: 5494491 - DNA, 20 bp, Homo sapiens
ggcctggactgactgcagcc

SEQ ID NO: 5494492 - DNA, 17 bp, Homo sapiens
ggcctggagaggacggc

SEQ ID NO: 5494493 - DNA, 15 bp, Homo sapiens
ggcctggagaggggc

SEQ ID NO: 5494494 - DNA, 11 bp, Homo sapiens
ggcctggagat

SEQ ID NO: 5494495 - DNA, 11 bp, Homo sapiens
ggcctggagca

SEQ ID NO: 5494496 - DNA, 13 bp, Homo sapiens
ggcctggagcagg

SEQ ID NO: 5494497 - DNA, 19 bp, Homo sapiens
ggcctggagcaggccttgc

SEQ ID NO: 5494498 - DNA, 20 bp, Homo sapiens
ggcctggagcatggacagtg

SEQ ID NO: 5494499 - DNA, 15 bp, Homo sapiens
ggcctggagccccat

SEQ ID NO: 5494500 - DNA, 23 bp, Homo sapiens
ggcctggagccccatcggccaag

SEQ ID NO: 5494501 - DNA, 23 bp, Homo sapiens
ggcctggagcgtttgctgtgcca

SEQ ID NO: 5494502 - DNA, 10 bp, Homo sapiens
ggcctggagg

SEQ ID NO: 5494503 - DNA, 13 bp, Homo sapiens
ggcctggaggctc

SEQ ID NO: 5494504 - DNA, 22 bp, Homo sapiens
ggcctggagggcacttcctcca

SEQ ID NO: 5494505 - DNA, 11 bp, Homo sapiens
ggcctggaggt

SEQ ID NO: 5494506 - DNA, 21 bp, Homo sapiens
ggcctggatccatcctgctag

SEQ ID NO: 5494507 - DNA, 15 bp, Homo sapiens
ggcctggatgcacag

SEQ ID NO: 5494508 - DNA, 18 bp, Homo sapiens
ggcctggatgccagctgt

SEQ ID NO: 5494509 - DNA, 21 bp, Homo sapiens
ggcctggatgccagctgtgtc

SEQ ID NO: 5494510 - DNA, 17 bp, Homo sapiens
ggcctggattcacgccc

SEQ ID NO: 5494511 - DNA, 17 bp, Homo sapiens
ggcctggattcatttcc

SEQ ID NO: 5494512 - DNA, 19 bp, Homo sapiens
ggcctggattcatttcctg

SEQ ID NO: 5494513 - DNA, 22 bp, Homo sapiens
ggcctggattcatttcctgccc

SEQ ID NO: 5494514 - DNA, 22 bp, Homo sapiens
ggcctggcacagtgtctgggct

SEQ ID NO: 5494515 - DNA, 17 bp, Homo sapiens
ggcctggcacatcagaa

SEQ ID NO: 5494516 - DNA, 15 bp, Homo sapiens
ggcctggcagccgtg

SEQ ID NO: 5494517 - DNA, 16 bp, Homo sapiens
ggcctggcagctcagc

SEQ ID NO: 5494518 - DNA, 23 bp, Homo sapiens
ggcctggcagggggtgaaggcag

SEQ ID NO: 5494519 - DNA, 18 bp, Homo sapiens
ggcctggcatagagtagg

SEQ ID NO: 5494520 - DNA, 17 bp, Homo sapiens
ggcctggcatctgtgtg

SEQ ID NO: 5494521 - DNA, 15 bp, Homo sapiens
ggcctggcatgcagc

SEQ ID NO: 5494522 - DNA, 19 bp, Homo sapiens
ggcctggccaatgcggccc

SEQ ID NO: 5494523 - DNA, 15 bp, Homo sapiens
ggcctggccagacca

SEQ ID NO: 5494524 - DNA, 18 bp, Homo sapiens
ggcctggccaggagctct

SEQ ID NO: 5494525 - DNA, 13 bp, Homo sapiens
ggcctggccaggc

SEQ ID NO: 5494526 - DNA, 17 bp, Homo sapiens
ggcctggccagggcctg

SEQ ID NO: 5494527 - DNA, 21 bp, Homo sapiens
ggcctggccagtcctggtcct

SEQ ID NO: 5494528 - DNA, 16 bp, Homo sapiens
ggcctggccagtgccc

SEQ ID NO: 5494529 - DNA, 19 bp, Homo sapiens
ggcctggccagtgccctga

SEQ ID NO: 5494530 - DNA, 14 bp, Homo sapiens
ggcctggccatgtg

SEQ ID NO: 5494531 - DNA, 16 bp, Homo sapiens
ggcctggccatgtggc

SEQ ID NO: 5494532 - DNA, 15 bp, Homo sapiens
ggcctggccatttcc

SEQ ID NO: 5494533 - DNA, 12 bp, Homo sapiens
ggcctggcccag

SEQ ID NO: 5494534 - DNA, 18 bp, Homo sapiens
ggcctggcccagccagca

SEQ ID NO: 5494535 - DNA, 20 bp, Homo sapiens
ggcctggcccagccagcagg

SEQ ID NO: 5494536 - DNA, 17 bp, Homo sapiens
ggcctggcccccagctt

SEQ ID NO: 5494537 - DNA, 13 bp, Homo sapiens
ggcctggcccctc

SEQ ID NO: 5494538 - DNA, 12 bp, Homo sapiens
ggcctggccctt

SEQ ID NO: 5494539 - DNA, 14 bp, Homo sapiens
ggcctggcccttga

SEQ ID NO: 5494540 - DNA, 21 bp, Homo sapiens
ggcctggccggcaaccccagt

SEQ ID NO: 5494541 - DNA, 17 bp, Homo sapiens
ggcctggcctccagctc

SEQ ID NO: 5494542 - DNA, 20 bp, Homo sapiens
ggcctggcctccagctccca

SEQ ID NO: 5494543 - DNA, 22 bp, Homo sapiens
ggcctggcctcgcctgcctttc

SEQ ID NO: 5494544 - DNA, 15 bp, Homo sapiens
ggcctggcctctggg

SEQ ID NO: 5494545 - DNA, 17 bp, Homo sapiens
ggcctggcctctgggca

SEQ ID NO: 5494546 - DNA, 12 bp, Homo sapiens
ggcctggcctga

SEQ ID NO: 5494547 - DNA, 14 bp, Homo sapiens
ggcctggcctgagc

SEQ ID NO: 5494548 - DNA, 16 bp, Homo sapiens
ggcctggcctgagctg

SEQ ID NO: 5494549 - DNA, 19 bp, Homo sapiens
ggcctggcctgagctggga

SEQ ID NO: 5494550 - DNA, 16 bp, Homo sapiens
ggcctggcctggccct

SEQ ID NO: 5494551 - DNA, 14 bp, Homo sapiens
ggcctggcctgggt

SEQ ID NO: 5494552 - DNA, 11 bp, Homo sapiens
ggcctggctca

SEQ ID NO: 5494553 - DNA, 11 bp, Homo sapiens
ggcctggctcc

SEQ ID NO: 5494554 - DNA, 13 bp, Homo sapiens
ggcctggctcccc

SEQ ID NO: 5494555 - DNA, 23 bp, Homo sapiens
ggcctggctccccacgagtcacc

SEQ ID NO: 5494556 - DNA, 14 bp, Homo sapiens
ggcctggctccctc

SEQ ID NO: 5494557 - DNA, 14 bp, Homo sapiens
ggcctggctccgct

SEQ ID NO: 5494558 - DNA, 15 bp, Homo sapiens
ggcctggctctggag

SEQ ID NO: 5494559 - DNA, 18 bp, Homo sapiens
ggcctggctctggagccc

SEQ ID NO: 5494560 - DNA, 15 bp, Homo sapiens
ggcctggctgcagct

SEQ ID NO: 5494561 - DNA, 13 bp, Homo sapiens
ggcctggctggag

SEQ ID NO: 5494562 - DNA, 14 bp, Homo sapiens
ggcctggctggcca

SEQ ID NO: 5494563 - DNA, 16 bp, Homo sapiens
ggcctggctggccagg

SEQ ID NO: 5494564 - DNA, 19 bp, Homo sapiens
ggcctggctggctgagggc

SEQ ID NO: 5494565 - DNA, 21 bp, Homo sapiens
ggcctggctgggagtggaaga

SEQ ID NO: 5494566 - DNA, 14 bp, Homo sapiens
ggcctggcttctgg

SEQ ID NO: 5494567 - DNA, 22 bp, Homo sapiens
ggcctgggaaaccctctccatc

SEQ ID NO: 5494568 - DNA, 21 bp, Homo sapiens
ggcctgggacaactgctccca

SEQ ID NO: 5494569 - DNA, 15 bp, Homo sapiens
ggcctgggacccagc

SEQ ID NO: 5494570 - DNA, 17 bp, Homo sapiens
ggcctgggacttccatg

SEQ ID NO: 5494571 - DNA, 22 bp, Homo sapiens
ggcctgggagatgcagctggat

SEQ ID NO: 5494572 - DNA, 13 bp, Homo sapiens
ggcctgggagggc

SEQ ID NO: 5494573 - DNA, 14 bp, Homo sapiens
ggcctgggagggtg

SEQ ID NO: 5494574 - DNA, 15 bp, Homo sapiens
ggcctgggagggtgg

SEQ ID NO: 5494575 - DNA, 23 bp, Homo sapiens
ggcctgggagggttcccctggcc

SEQ ID NO: 5494576 - DNA, 15 bp, Homo sapiens
ggcctgggatgcagt

SEQ ID NO: 5494577 - DNA, 23 bp, Homo sapiens
ggcctgggatgctagccccagag

SEQ ID NO: 5494578 - DNA, 16 bp, Homo sapiens
ggcctgggcaggaccc

SEQ ID NO: 5494579 - DNA, 14 bp, Homo sapiens
ggcctgggcaggag

SEQ ID NO: 5494580 - DNA, 15 bp, Homo sapiens
ggcctgggcaggagg

SEQ ID NO: 5494581 - DNA, 19 bp, Homo sapiens
ggcctgggcaggagggagg

SEQ ID NO: 5494582 - DNA, 18 bp, Homo sapiens
ggcctgggcagtggatgg

SEQ ID NO: 5494583 - DNA, 15 bp, Homo sapiens
ggcctgggccgctgc

SEQ ID NO: 5494584 - DNA, 14 bp, Homo sapiens
ggcctgggcctctg

SEQ ID NO: 5494585 - DNA, 13 bp, Homo sapiens
ggcctgggcctgc

SEQ ID NO: 5494586 - DNA, 15 bp, Homo sapiens
ggcctgggcctgctt

SEQ ID NO: 5494587 - DNA, 15 bp, Homo sapiens
ggcctgggcctggct

SEQ ID NO: 5494588 - DNA, 16 bp, Homo sapiens
ggcctgggctgtgagg

SEQ ID NO: 5494589 - DNA, 18 bp, Homo sapiens
ggcctgggctgtgaggac

SEQ ID NO: 5494590 - DNA, 15 bp, Homo sapiens
ggcctgggcttggcc

SEQ ID NO: 5494591 - DNA, 23 bp, Homo sapiens
ggcctggggacccaaaccccctg

SEQ ID NO: 5494592 - DNA, 15 bp, Homo sapiens
ggcctggggcctgag

SEQ ID NO: 5494593 - DNA, 16 bp, Homo sapiens
ggcctggggcctgaga

SEQ ID NO: 5494594 - DNA, 20 bp, Homo sapiens
ggcctgggggacccctggct

SEQ ID NO: 5494595 - DNA, 22 bp, Homo sapiens
ggcctgggggacccctggctct

SEQ ID NO: 5494596 - DNA, 17 bp, Homo sapiens
ggcctgggggaggtcag

SEQ ID NO: 5494597 - DNA, 23 bp, Homo sapiens
ggcctgggggctgttagctcaga

SEQ ID NO: 5494598 - DNA, 14 bp, Homo sapiens
ggcctttcctggaa

SEQ ID NO: 5494599 - DNA, 13 bp, Homo sapiens
ggcctttcctgtg

SEQ ID NO: 5494600 - DNA, 11 bp, Homo sapiens
ggcctttcctt

SEQ ID NO: 5494601 - DNA, 12 bp, Homo sapiens
ggcctttccttc

SEQ ID NO: 5494602 - DNA, 19 bp, Homo sapiens
ggcctttccttccctctct

SEQ ID NO: 5494603 - DNA, 16 bp, Homo sapiens
ggcctttctcctcccc

SEQ ID NO: 5494604 - DNA, 14 bp, Homo sapiens
ggcctttcttctgt

SEQ ID NO: 5494605 - DNA, 15 bp, Homo sapiens
ggcctttcttctgtg

SEQ ID NO: 5494606 - DNA, 23 bp, Homo sapiens
ggcctttgagcccacaaagcctt

SEQ ID NO: 5494607 - DNA, 23 bp, Homo sapiens
ggcctttgcaagatgcttggttg

SEQ ID NO: 5494608 - DNA, 14 bp, Homo sapiens
ggcctttgctgccc

SEQ ID NO: 5494609 - DNA, 23 bp, Homo sapiens
ggcctttgctgcccttggtttct

SEQ ID NO: 5494610 - DNA, 19 bp, Homo sapiens
ggcctttggacccagggcc

SEQ ID NO: 5494611 - DNA, 21 bp, Homo sapiens
ggcctttggacccagggcctg

SEQ ID NO: 5494612 - DNA, 17 bp, Homo sapiens
ggcctttggaggggaaa

SEQ ID NO: 5494613 - DNA, 18 bp, Homo sapiens
ggcctttgtaagacacac

SEQ ID NO: 5494614 - DNA, 20 bp, Homo sapiens
ggcctttgtaagacacacag

SEQ ID NO: 5494615 - DNA, 17 bp, Homo sapiens
ggcctttgttctggggg

SEQ ID NO: 5494616 - DNA, 22 bp, Homo sapiens
ggccttttagaaacctcattgg

SEQ ID NO: 5494617 - DNA, 21 bp, Homo sapiens
ggccttttatgtaatttcttt

SEQ ID NO: 5494618 - DNA, 16 bp, Homo sapiens
ggccttttctggcacc

SEQ ID NO: 5494619 - DNA, 13 bp, Homo sapiens
ggccttttctgtg

SEQ ID NO: 5494620 - DNA, 12 bp, Homo sapiens
ggccttttggat

SEQ ID NO: 5494621 - DNA, 16 bp, Homo sapiens
ggcctttttctgagat

SEQ ID NO: 5494622 - DNA, 15 bp, Homo sapiens
ggcgaaagggtgaga

SEQ ID NO: 5494623 - DNA, 13 bp, Homo sapiens
ggcgaagatggtc

SEQ ID NO: 5494624 - DNA, 16 bp, Homo sapiens
ggcgaagcccaggccc

SEQ ID NO: 5494625 - DNA, 18 bp, Homo sapiens
ggcgaagcctgagcaggc

SEQ ID NO: 5494626 - DNA, 21 bp, Homo sapiens
ggcgaagctgagcgggtctag

SEQ ID NO: 5494627 - DNA, 11 bp, Homo sapiens
ggcgaataaat

SEQ ID NO: 5494628 - DNA, 12 bp, Homo sapiens
ggcgaataaatg

SEQ ID NO: 5494629 - DNA, 15 bp, Homo sapiens
ggcgaataaatgttc

SEQ ID NO: 5494630 - DNA, 16 bp, Homo sapiens
ggcgaataaatgttca

SEQ ID NO: 5494631 - DNA, 19 bp, Homo sapiens
ggcgaattcatcccctccc

SEQ ID NO: 5494632 - DNA, 23 bp, Homo sapiens
ggcgacaagagtgagactccacc

SEQ ID NO: 5494633 - DNA, 15 bp, Homo sapiens
ggcgacactcagggc

SEQ ID NO: 5494634 - DNA, 16 bp, Homo sapiens
ggcgacactcagggca

SEQ ID NO: 5494635 - DNA, 17 bp, Homo sapiens
ggcgacactcagggcag

SEQ ID NO: 5494636 - DNA, 13 bp, Homo sapiens
ggcgacagagcaa

SEQ ID NO: 5494637 - DNA, 14 bp, Homo sapiens
ggcgacagagcaag

SEQ ID NO: 5494638 - DNA, 20 bp, Homo sapiens
ggcgacagagcaagactccg

SEQ ID NO: 5494639 - DNA, 18 bp, Homo sapiens
ggcgacagttttccttct

SEQ ID NO: 5494640 - DNA, 13 bp, Homo sapiens
ggcgaccaccaaa

SEQ ID NO: 5494641 - DNA, 14 bp, Homo sapiens
ggcgaccaccaaag

SEQ ID NO: 5494642 - DNA, 11 bp, Homo sapiens
ggcgacctcct

SEQ ID NO: 5494643 - DNA, 17 bp, Homo sapiens
ggcgacgcggttttttc

SEQ ID NO: 5494644 - DNA, 14 bp, Homo sapiens
ggcgactctgcaga

SEQ ID NO: 5494645 - DNA, 19 bp, Homo sapiens
ggcgagaaggggaaaaatg

SEQ ID NO: 5494646 - DNA, 22 bp, Homo sapiens
ggcgagacctgatttctcctgc

SEQ ID NO: 5494647 - DNA, 16 bp, Homo sapiens
ggcgagagaggagcca

SEQ ID NO: 5494648 - DNA, 14 bp, Homo sapiens
ggcgagaggagggg

SEQ ID NO: 5494649 - DNA, 13 bp, Homo sapiens
ggcgagcagggca

SEQ ID NO: 5494650 - DNA, 19 bp, Homo sapiens
ggcgagcagggcaggcccc

SEQ ID NO: 5494651 - DNA, 22 bp, Homo sapiens
ggcgagcatgggggctgccagc

SEQ ID NO: 5494652 - DNA, 21 bp, Homo sapiens
ggcgagccctgtggatgagcc

SEQ ID NO: 5494653 - DNA, 11 bp, Homo sapiens
ggcgagccctt

SEQ ID NO: 5494654 - DNA, 15 bp, Homo sapiens
ggcgagcccttagcc

SEQ ID NO: 5494655 - DNA, 14 bp, Homo sapiens
ggcgagcctgactc

SEQ ID NO: 5494656 - DNA, 18 bp, Homo sapiens
ggcgagcctgactctgtt

SEQ ID NO: 5494657 - DNA, 19 bp, Homo sapiens
ggcgagcctgactctgttg

SEQ ID NO: 5494658 - DNA, 14 bp, Homo sapiens
ggcgagctgcagga

SEQ ID NO: 5494659 - DNA, 17 bp, Homo sapiens
ggcgagctttctctccg

SEQ ID NO: 5494660 - DNA, 15 bp, Homo sapiens
ggcgaggcccctccc

SEQ ID NO: 5494661 - DNA, 18 bp, Homo sapiens
ggcgaggcgggggagcct

SEQ ID NO: 5494662 - DNA, 22 bp, Homo sapiens
ggcgaggcgggggagcctggag

SEQ ID NO: 5494663 - DNA, 18 bp, Homo sapiens
ggcgaggcgggggatcct

SEQ ID NO: 5494664 - DNA, 17 bp, Homo sapiens
ggcgaggctgcctctgg

SEQ ID NO: 5494665 - DNA, 18 bp, Homo sapiens
ggcgaggctgcctctggg

SEQ ID NO: 5494666 - DNA, 19 bp, Homo sapiens
ggcgaggctgcctctgggt

SEQ ID NO: 5494667 - DNA, 12 bp, Homo sapiens
ggcgagggaggg

SEQ ID NO: 5494668 - DNA, 22 bp, Homo sapiens
ggcgagggatgatgagggaagc

SEQ ID NO: 5494669 - DNA, 20 bp, Homo sapiens
ggcgagggcggcggggcctg

SEQ ID NO: 5494670 - DNA, 22 bp, Homo sapiens
ggcgagggggccggggggaggg

SEQ ID NO: 5494671 - DNA, 19 bp, Homo sapiens
ggcgagtcaccctcctcac

SEQ ID NO: 5494672 - DNA, 12 bp, Homo sapiens
ggcgagtccaga

SEQ ID NO: 5494673 - DNA, 23 bp, Homo sapiens
ggcgagtgaatgccagtgtgctg

SEQ ID NO: 5494674 - DNA, 19 bp, Homo sapiens
ggcgagttctctttggaaa

SEQ ID NO: 5494675 - DNA, 19 bp, Homo sapiens
ggcgataaaactaaatata

SEQ ID NO: 5494676 - DNA, 15 bp, Homo sapiens
ggcgatctcccaggg

SEQ ID NO: 5494677 - DNA, 13 bp, Homo sapiens
ggcgatggggact

SEQ ID NO: 5494678 - DNA, 19 bp, Homo sapiens
ggcgatggggactctgccg

SEQ ID NO: 5494679 - DNA, 23 bp, Homo sapiens
ggcgatgtcactcagccccttcc

SEQ ID NO: 5494680 - DNA, 15 bp, Homo sapiens
ggcgcaaagggcatg

SEQ ID NO: 5494681 - DNA, 17 bp, Homo sapiens
ggcgcaaagggcatggg

SEQ ID NO: 5494682 - DNA, 20 bp, Homo sapiens
ggcgcaagggaggcccagcg

SEQ ID NO: 5494683 - DNA, 22 bp, Homo sapiens
ggcgcaatctcggctcactgca

SEQ ID NO: 5494684 - DNA, 22 bp, Homo sapiens
ggcgcaccccacagctggggcc

SEQ ID NO: 5494685 - DNA, 23 bp, Homo sapiens
ggcgcaccccacagctggggccg

SEQ ID NO: 5494686 - DNA, 17 bp, Homo sapiens
ggcgcaccctcccctcc

SEQ ID NO: 5494687 - DNA, 16 bp, Homo sapiens
ggcgcactgcctctca

SEQ ID NO: 5494688 - DNA, 15 bp, Homo sapiens
ggcgcacttcagaat

SEQ ID NO: 5494689 - DNA, 15 bp, Homo sapiens
ggcgcagagccctcc

SEQ ID NO: 5494690 - DNA, 24 bp, Homo sapiens
ggcgcagcatattcaggaagctca

SEQ ID NO: 5494691 - DNA, 14 bp, Homo sapiens
ggcgcagcgcagag

SEQ ID NO: 5494692 - DNA, 15 bp, Homo sapiens
ggcgcagctgaagcc

SEQ ID NO: 5494693 - DNA, 20 bp, Homo sapiens
ggcgcagctgaagcctggac

SEQ ID NO: 5494694 - DNA, 20 bp, Homo sapiens
ggcgcatgagtatctgtggg

SEQ ID NO: 5494695 - DNA, 21 bp, Homo sapiens
ggcgcatgagtatctgtggga

SEQ ID NO: 5494696 - DNA, 15 bp, Homo sapiens
ggcgcatgcctccca

SEQ ID NO: 5494697 - DNA, 17 bp, Homo sapiens
ggcgcatgcctcccagg

SEQ ID NO: 5494698 - DNA, 20 bp, Homo sapiens
ggcgcatgcctcccaggcca

SEQ ID NO: 5494699 - DNA, 19 bp, Homo sapiens
ggcgccaagtctggcacca

SEQ ID NO: 5494700 - DNA, 13 bp, Homo sapiens
ggcgccaccacca

SEQ ID NO: 5494701 - DNA, 14 bp, Homo sapiens
ggcgccaggacagc

SEQ ID NO: 5494702 - DNA, 21 bp, Homo sapiens
ggcgcccacccggcccggctg

SEQ ID NO: 5494703 - DNA, 15 bp, Homo sapiens
ggcgcccaccctggg

SEQ ID NO: 5494704 - DNA, 17 bp, Homo sapiens
ggcgcccaccctgggct

SEQ ID NO: 5494705 - DNA, 18 bp, Homo sapiens
ggcgcccaccctgggctc

SEQ ID NO: 5494706 - DNA, 19 bp, Homo sapiens
ggcgcccaccctgggctcc

SEQ ID NO: 5494707 - DNA, 13 bp, Homo sapiens
ggcgcccacctcc

SEQ ID NO: 5494708 - DNA, 12 bp, Homo sapiens
ggcgcccacctg

SEQ ID NO: 5494709 - DNA, 14 bp, Homo sapiens
ggcgcccacctgcc

SEQ ID NO: 5494710 - DNA, 16 bp, Homo sapiens
ggcgcccacctgccca

SEQ ID NO: 5494711 - DNA, 17 bp, Homo sapiens
ggcgcccacctgcccag

SEQ ID NO: 5494712 - DNA, 17 bp, Homo sapiens
ggcgcccagcagcctgc

SEQ ID NO: 5494713 - DNA, 19 bp, Homo sapiens
ggcgcccccgccccaggct

SEQ ID NO: 5494714 - DNA, 13 bp, Homo sapiens
ggcgcccctgcca

SEQ ID NO: 5494715 - DNA, 15 bp, Homo sapiens
ggcgcccctgccacc

SEQ ID NO: 5494716 - DNA, 13 bp, Homo sapiens
ggcgcccctgggg

SEQ ID NO: 5494717 - DNA, 19 bp, Homo sapiens
ggcgcccgccaacacgcct

SEQ ID NO: 5494718 - DNA, 16 bp, Homo sapiens
ggcgcccggactgacc

SEQ ID NO: 5494719 - DNA, 19 bp, Homo sapiens
ggcgccctgcctcctggag

SEQ ID NO: 5494720 - DNA, 21 bp, Homo sapiens
ggcgccctgcctcctggagga

SEQ ID NO: 5494721 - DNA, 14 bp, Homo sapiens
ggcgccctggaagc

SEQ ID NO: 5494722 - DNA, 15 bp, Homo sapiens
ggcgccctggacttg

SEQ ID NO: 5494723 - DNA, 16 bp, Homo sapiens
ggcgccctggacttgg

SEQ ID NO: 5494724 - DNA, 22 bp, Homo sapiens
ggcgccgcaaaccacactggac

SEQ ID NO: 5494725 - DNA, 17 bp, Homo sapiens
ggcgcctgcgctcctct

SEQ ID NO: 5494726 - DNA, 21 bp, Homo sapiens
ggcgcctgcgctcctctgcag

SEQ ID NO: 5494727 - DNA, 24 bp, Homo sapiens
ggcgcctgcgctcctctgcagcct

SEQ ID NO: 5494728 - DNA, 18 bp, Homo sapiens
ggcgcctggagagcgagg

SEQ ID NO: 5494729 - DNA, 22 bp, Homo sapiens
ggcgcctggagggatgccccca

SEQ ID NO: 5494730 - DNA, 18 bp, Homo sapiens
ggcgcctgtagtcccagc

SEQ ID NO: 5494731 - DNA, 18 bp, Homo sapiens
ggcgcctgtcgggcccgc

SEQ ID NO: 5494732 - DNA, 13 bp, Homo sapiens
ggcgcgaccctcc

SEQ ID NO: 5494733 - DNA, 13 bp, Homo sapiens
ggcgcgcaccgcc

SEQ ID NO: 5494734 - DNA, 23 bp, Homo sapiens
ggcgcgcgcccccaggacccccc

SEQ ID NO: 5494735 - DNA, 14 bp, Homo sapiens
ggcgcggccagccc

SEQ ID NO: 5494736 - DNA, 16 bp, Homo sapiens
ggcgcggccagccccg

SEQ ID NO: 5494737 - DNA, 17 bp, Homo sapiens
ggcgcggcctcccgagg

SEQ ID NO: 5494738 - DNA, 16 bp, Homo sapiens
ggcgcgggaggcacca

SEQ ID NO: 5494739 - DNA, 16 bp, Homo sapiens
ggcgcgggcagccacc

SEQ ID NO: 5494740 - DNA, 22 bp, Homo sapiens
ggcgcggggaggccggcgcagc

SEQ ID NO: 5494741 - DNA, 23 bp, Homo sapiens
ggcgctacaaaataaagctgttc

SEQ ID NO: 5494742 - DNA, 23 bp, Homo sapiens
ggcgctcagacggcggccaggca

SEQ ID NO: 5494743 - DNA, 14 bp, Homo sapiens
ggcgctcagaggcc

SEQ ID NO: 5494744 - DNA, 22 bp, Homo sapiens
ggcgctcagaggccgctctggg

SEQ ID NO: 5494745 - DNA, 13 bp, Homo sapiens
ggcgctcagcagc

SEQ ID NO: 5494746 - DNA, 15 bp, Homo sapiens
ggcgctcaggaccca

SEQ ID NO: 5494747 - DNA, 20 bp, Homo sapiens
ggcgctcaggacccaggccc

SEQ ID NO: 5494748 - DNA, 21 bp, Homo sapiens
ggcgctcaggacccaggccct

SEQ ID NO: 5494749 - DNA, 16 bp, Homo sapiens
ggcgctccggcagagg

SEQ ID NO: 5494750 - DNA, 18 bp, Homo sapiens
ggcgctccggcagaggca

SEQ ID NO: 5494751 - DNA, 21 bp, Homo sapiens
ggcgctccggcagaggcaggg

SEQ ID NO: 5494752 - DNA, 15 bp, Homo sapiens
ggcgctcctcccagc

SEQ ID NO: 5494753 - DNA, 22 bp, Homo sapiens
ggcgctcggtctccaccccagg

SEQ ID NO: 5494754 - DNA, 14 bp, Homo sapiens
ggcgctctgccctc

SEQ ID NO: 5494755 - DNA, 21 bp, Homo sapiens
ggcgctgaggtgtctggcctg

SEQ ID NO: 5494756 - DNA, 22 bp, Homo sapiens
ggcgctgaggtgtctggcctga

SEQ ID NO: 5494757 - DNA, 21 bp, Homo sapiens
ggcgctgcccacctgccggcc

SEQ ID NO: 5494758 - DNA, 23 bp, Homo sapiens
ggcgctgccccatctcccctcag

SEQ ID NO: 5494759 - DNA, 18 bp, Homo sapiens
ggcgctgcccccacagat

SEQ ID NO: 5494760 - DNA, 18 bp, Homo sapiens
ggcgctgcccctggcagc

SEQ ID NO: 5494761 - DNA, 23 bp, Homo sapiens
ggcgctgcggacaccgtggcctg

SEQ ID NO: 5494762 - DNA, 18 bp, Homo sapiens
ggcgctgctgggagcaga

SEQ ID NO: 5494763 - DNA, 11 bp, Homo sapiens
ggcgctggccc

SEQ ID NO: 5494764 - DNA, 13 bp, Homo sapiens
ggcgctggcccag

SEQ ID NO: 5494765 - DNA, 14 bp, Homo sapiens
ggcgctggctgcac

SEQ ID NO: 5494766 - DNA, 16 bp, Homo sapiens
ggcgctggctgcactc

SEQ ID NO: 5494767 - DNA, 13 bp, Homo sapiens
ggcgctgggaagg

SEQ ID NO: 5494768 - DNA, 20 bp, Homo sapiens
ggcgctgggtattggaaatg

SEQ ID NO: 5494769 - DNA, 20 bp, Homo sapiens
ggcgctgtgcggcctcacca

SEQ ID NO: 5494770 - DNA, 21 bp, Homo sapiens
ggcgctgtgctagctttcctt

SEQ ID NO: 5494771 - DNA, 16 bp, Homo sapiens
ggcgctgtggctcctg

SEQ ID NO: 5494772 - DNA, 17 bp, Homo sapiens
ggcgctgtggctcctgc

SEQ ID NO: 5494773 - DNA, 20 bp, Homo sapiens
ggcgctgtggctcctgcctt

SEQ ID NO: 5494774 - DNA, 14 bp, Homo sapiens
ggcgcttggatctg

SEQ ID NO: 5494775 - DNA, 14 bp, Homo sapiens
ggcggaaaccttgc

SEQ ID NO: 5494776 - DNA, 19 bp, Homo sapiens
ggctgtgcccagcaggccc

SEQ ID NO: 5494777 - DNA, 21 bp, Homo sapiens
ggctgtgcccagcaggcccag

SEQ ID NO: 5494778 - DNA, 12 bp, Homo sapiens
ggctgtgcccca

SEQ ID NO: 5494779 - DNA, 19 bp, Homo sapiens
ggctgtgcccctgatgcag

SEQ ID NO: 5494780 - DNA, 16 bp, Homo sapiens
ggctgtgcctctgcct

SEQ ID NO: 5494781 - DNA, 18 bp, Homo sapiens
ggctgtgcctgaggctgg

SEQ ID NO: 5494782 - DNA, 19 bp, Homo sapiens
ggctgtgcgggcgcccgga

SEQ ID NO: 5494783 - DNA, 16 bp, Homo sapiens
ggctgtgctcttcctc

SEQ ID NO: 5494784 - DNA, 12 bp, Homo sapiens
ggctgtgctggg

SEQ ID NO: 5494785 - DNA, 18 bp, Homo sapiens
ggctgtgctgtattttga

SEQ ID NO: 5494786 - DNA, 21 bp, Homo sapiens
ggctgtgcttgaaggccctgc

SEQ ID NO: 5494787 - DNA, 17 bp, Homo sapiens
ggctgtggaccatggag

SEQ ID NO: 5494788 - DNA, 23 bp, Homo sapiens
ggctgtggaccgtggacaggccc

SEQ ID NO: 5494789 - DNA, 12 bp, Homo sapiens
ggctgtggagca

SEQ ID NO: 5494790 - DNA, 16 bp, Homo sapiens
ggctgtggaggcctga

SEQ ID NO: 5494791 - DNA, 14 bp, Homo sapiens
ggctgtggcacaga

SEQ ID NO: 5494792 - DNA, 15 bp, Homo sapiens
ggctgtggcatttcc

SEQ ID NO: 5494793 - DNA, 13 bp, Homo sapiens
ggctgtggcccct

SEQ ID NO: 5494794 - DNA, 16 bp, Homo sapiens
ggctgtggcccctcct

SEQ ID NO: 5494795 - DNA, 21 bp, Homo sapiens
ggctgtggcccctccttctcc

SEQ ID NO: 5494796 - DNA, 20 bp, Homo sapiens
ggctgtggccctgcccttgg

SEQ ID NO: 5494797 - DNA, 15 bp, Homo sapiens
ggctgtggctctggg

SEQ ID NO: 5494798 - DNA, 15 bp, Homo sapiens
ggctgtgggaccagg

SEQ ID NO: 5494799 - DNA, 21 bp, Homo sapiens
ggctgtgggcctcaaggactt

SEQ ID NO: 5494800 - DNA, 17 bp, Homo sapiens
ggctgtggggtctggct

SEQ ID NO: 5494801 - DNA, 19 bp, Homo sapiens
ggctgtggggtctggctgt

SEQ ID NO: 5494802 - DNA, 21 bp, Homo sapiens
ggctgtggggtggagcactgg

SEQ ID NO: 5494803 - DNA, 15 bp, Homo sapiens
ggctgtggggtgggc

SEQ ID NO: 5494804 - DNA, 13 bp, Homo sapiens
ggctgtgggtgtg

SEQ ID NO: 5494805 - DNA, 16 bp, Homo sapiens
ggctgtggtggctgtc

SEQ ID NO: 5494806 - DNA, 20 bp, Homo sapiens
ggctgtggtggctgtctctg

SEQ ID NO: 5494807 - DNA, 22 bp, Homo sapiens
ggctgtggtggctgtctctgtc

SEQ ID NO: 5494808 - DNA, 14 bp, Homo sapiens
ggctgtgtacttta

SEQ ID NO: 5494809 - DNA, 16 bp, Homo sapiens
ggctgtgtctaaactg

SEQ ID NO: 5494810 - DNA, 13 bp, Homo sapiens
ggctgtgtctctg

SEQ ID NO: 5494811 - DNA, 18 bp, Homo sapiens
ggctgtgtgaatttttct

SEQ ID NO: 5494812 - DNA, 12 bp, Homo sapiens
ggctgtgtggcc

SEQ ID NO: 5494813 - DNA, 15 bp, Homo sapiens
ggctgtgtggccaag

SEQ ID NO: 5494814 - DNA, 20 bp, Homo sapiens
ggctgtgtgtcttctgcccc

SEQ ID NO: 5494815 - DNA, 15 bp, Homo sapiens
ggctgtgtgtggaaa

SEQ ID NO: 5494816 - DNA, 20 bp, Homo sapiens
ggctgtgttatgaaaatata

SEQ ID NO: 5494817 - DNA, 23 bp, Homo sapiens
ggctgtgttcgggggagcagaga

SEQ ID NO: 5494818 - DNA, 19 bp, Homo sapiens
ggctgtgttgactgctgct

SEQ ID NO: 5494819 - DNA, 14 bp, Homo sapiens
ggctgtgttggtgt

SEQ ID NO: 5494820 - DNA, 18 bp, Homo sapiens
ggctgtgtttccatctca

SEQ ID NO: 5494821 - DNA, 21 bp, Homo sapiens
ggctgttaaaaaaaagatgag

SEQ ID NO: 5494822 - DNA, 17 bp, Homo sapiens
ggctgttaaccacccgc

SEQ ID NO: 5494823 - DNA, 14 bp, Homo sapiens
ggctgttaccattt

SEQ ID NO: 5494824 - DNA, 16 bp, Homo sapiens
ggctgttcatgctcca

SEQ ID NO: 5494825 - DNA, 18 bp, Homo sapiens
ggctgttcatgctccaag

SEQ ID NO: 5494826 - DNA, 13 bp, Homo sapiens
ggctgttcccttt

SEQ ID NO: 5494827 - DNA, 14 bp, Homo sapiens
ggctgttccctttg

SEQ ID NO: 5494828 - DNA, 21 bp, Homo sapiens
ggctgttcctcccctgtaggg

SEQ ID NO: 5494829 - DNA, 16 bp, Homo sapiens
ggctgttccttgtact

SEQ ID NO: 5494830 - DNA, 18 bp, Homo sapiens
ggctgttctagacacagt

SEQ ID NO: 5494831 - DNA, 13 bp, Homo sapiens
ggctgttctgcac

SEQ ID NO: 5494832 - DNA, 17 bp, Homo sapiens
ggctgttctgcactgaa

SEQ ID NO: 5494833 - DNA, 18 bp, Homo sapiens
ggctgttctgcactgaaa

SEQ ID NO: 5494834 - DNA, 21 bp, Homo sapiens
ggctgttctgcactgaaaagg

SEQ ID NO: 5494835 - DNA, 14 bp, Homo sapiens
ggctgttctggaag

SEQ ID NO: 5494836 - DNA, 21 bp, Homo sapiens
ggctgttctgtggttcctctg

SEQ ID NO: 5494837 - DNA, 20 bp, Homo sapiens
ggctgttcttcaactcctgg

SEQ ID NO: 5494838 - DNA, 23 bp, Homo sapiens
ggctgttcttcaactcctgggct

SEQ ID NO: 5494839 - DNA, 16 bp, Homo sapiens
ggctgttgatattaaa

SEQ ID NO: 5494840 - DNA, 13 bp, Homo sapiens
ggctgttgcatgg

SEQ ID NO: 5494841 - DNA, 16 bp, Homo sapiens
ggctgttgctagggag

SEQ ID NO: 5494842 - DNA, 19 bp, Homo sapiens
ggctgttgctagggagagg

SEQ ID NO: 5494843 - DNA, 15 bp, Homo sapiens
ggctgttggcagtga

SEQ ID NO: 5494844 - DNA, 19 bp, Homo sapiens
ggctgttggcgtgtcccag

SEQ ID NO: 5494845 - DNA, 16 bp, Homo sapiens
ggctgttggctggggg

SEQ ID NO: 5494846 - DNA, 21 bp, Homo sapiens
ggctgtttactgcttttcatt

SEQ ID NO: 5494847 - DNA, 18 bp, Homo sapiens
ggctgtttcgtgtagtgg

SEQ ID NO: 5494848 - DNA, 14 bp, Homo sapiens
ggcttaaaagagta

SEQ ID NO: 5494849 - DNA, 12 bp, Homo sapiens
ggcttaaaccag

SEQ ID NO: 5494850 - DNA, 23 bp, Homo sapiens
ggcttaaacccatattgtaaaac

SEQ ID NO: 5494851 - DNA, 15 bp, Homo sapiens
ggcttaaagtgaagg

SEQ ID NO: 5494852 - DNA, 15 bp, Homo sapiens
ggcttaaatccagtt

SEQ ID NO: 5494853 - DNA, 15 bp, Homo sapiens
ggcttaacttagtat

SEQ ID NO: 5494854 - DNA, 19 bp, Homo sapiens
ggcttaagaaatctagtat

SEQ ID NO: 5494855 - DNA, 21 bp, Homo sapiens
ggcttaagtaccaatctctgc

SEQ ID NO: 5494856 - DNA, 22 bp, Homo sapiens
ggcttaataaaaatgacagact

SEQ ID NO: 5494857 - DNA, 22 bp, Homo sapiens
ggcttaattcccccaagcagaa

SEQ ID NO: 5494858 - DNA, 17 bp, Homo sapiens
ggcttacagaaatgact

SEQ ID NO: 5494859 - DNA, 13 bp, Homo sapiens
ggcttacaggagc

SEQ ID NO: 5494860 - DNA, 22 bp, Homo sapiens
ggcttacctgacctcttgctgt

SEQ ID NO: 5494861 - DNA, 14 bp, Homo sapiens
ggcttacctggccc

SEQ ID NO: 5494862 - DNA, 16 bp, Homo sapiens
ggcttacggccctggc

SEQ ID NO: 5494863 - DNA, 22 bp, Homo sapiens
ggcttagaccctcatgctgcca

SEQ ID NO: 5494864 - DNA, 23 bp, Homo sapiens
ggcttagaccctcatgctgccaa

SEQ ID NO: 5494865 - DNA, 21 bp, Homo sapiens
ggcttagacttcgactcagga

SEQ ID NO: 5494866 - DNA, 16 bp, Homo sapiens
ggcttagctttctgga

SEQ ID NO: 5494867 - DNA, 16 bp, Homo sapiens
ggcttaggtgccaggc

SEQ ID NO: 5494868 - DNA, 17 bp, Homo sapiens
ggcttaggtgccaggct

SEQ ID NO: 5494869 - DNA, 15 bp, Homo sapiens
ggcttagtatttctc

SEQ ID NO: 5494870 - DNA, 17 bp, Homo sapiens
ggcttagtatttctcag

SEQ ID NO: 5494871 - DNA, 20 bp, Homo sapiens
ggcttagtatttctcaggaa

SEQ ID NO: 5494872 - DNA, 14 bp, Homo sapiens
ggcttagtcactga

SEQ ID NO: 5494873 - DNA, 17 bp, Homo sapiens
ggcttagtgatgtaatt

SEQ ID NO: 5494874 - DNA, 15 bp, Homo sapiens
ggcttagtgccaccc

SEQ ID NO: 5494875 - DNA, 21 bp, Homo sapiens
ggcttataaacacattgaatg

SEQ ID NO: 5494876 - DNA, 16 bp, Homo sapiens
ggcttataattctttc

SEQ ID NO: 5494877 - DNA, 22 bp, Homo sapiens
ggcttatattttcagcaaagaa

SEQ ID NO: 5494878 - DNA, 13 bp, Homo sapiens
ggcttatggccag

SEQ ID NO: 5494879 - DNA, 15 bp, Homo sapiens
ggcttatgtctctgc

SEQ ID NO: 5494880 - DNA, 17 bp, Homo sapiens
ggcttatgtctctgcct

SEQ ID NO: 5494881 - DNA, 12 bp, Homo sapiens
ggcttattttaa

SEQ ID NO: 5494882 - DNA, 17 bp, Homo sapiens
ggcttatttttaaaata

SEQ ID NO: 5494883 - DNA, 18 bp, Homo sapiens
ggcttatttttaaaataa

SEQ ID NO: 5494884 - DNA, 19 bp, Homo sapiens
ggcttcaaaaagccacagc

SEQ ID NO: 5494885 - DNA, 21 bp, Homo sapiens
ggcttcaaaaagccacagcag

SEQ ID NO: 5494886 - DNA, 22 bp, Homo sapiens
ggcttcaaccactcgccgagga

SEQ ID NO: 5494887 - DNA, 22 bp, Homo sapiens
ggcttcaaccttgagacagctt

SEQ ID NO: 5494888 - DNA, 14 bp, Homo sapiens
ggcttcaatcactg

SEQ ID NO: 5494889 - DNA, 12 bp, Homo sapiens
ggcttcacagat

SEQ ID NO: 5494890 - DNA, 18 bp, Homo sapiens
ggcttcaccgcattccag

SEQ ID NO: 5494891 - DNA, 22 bp, Homo sapiens
ggcttcaccgcattccaggggc

SEQ ID NO: 5494892 - DNA, 21 bp, Homo sapiens
ggcttcacggaagagccttgc

SEQ ID NO: 5494893 - DNA, 21 bp, Homo sapiens
ggcttcactctccctgacggc

SEQ ID NO: 5494894 - DNA, 16 bp, Homo sapiens
ggcttcactgaccagc

SEQ ID NO: 5494895 - DNA, 19 bp, Homo sapiens
ggcttcactgaccagcggc

SEQ ID NO: 5494896 - DNA, 19 bp, Homo sapiens
ggcttcactgtataaatag

SEQ ID NO: 5494897 - DNA, 13 bp, Homo sapiens
ggcttcagcactt

SEQ ID NO: 5494898 - DNA, 17 bp, Homo sapiens
ggcttcagcatatttat

SEQ ID NO: 5494899 - DNA, 13 bp, Homo sapiens
ggcttcagccagt

SEQ ID NO: 5494900 - DNA, 12 bp, Homo sapiens
ggcttcagcccc

SEQ ID NO: 5494901 - DNA, 13 bp, Homo sapiens
ggcttcagcctag

SEQ ID NO: 5494902 - DNA, 13 bp, Homo sapiens
ggcttcagctcca

SEQ ID NO: 5494903 - DNA, 15 bp, Homo sapiens
ggcttcagctccagc

SEQ ID NO: 5494904 - DNA, 18 bp, Homo sapiens
ggcttcaggccgagccag

SEQ ID NO: 5494905 - DNA, 18 bp, Homo sapiens
ggcttcaggggagtcccg

SEQ ID NO: 5494906 - DNA, 22 bp, Homo sapiens
ggcttcagggtgggagtagttg

SEQ ID NO: 5494907 - DNA, 18 bp, Homo sapiens
ggcttcaggttgcattgg

SEQ ID NO: 5494908 - DNA, 18 bp, Homo sapiens
ggcttcagtctcatattt

SEQ ID NO: 5494909 - DNA, 17 bp, Homo sapiens
ggcttcagtggcagctg

SEQ ID NO: 5494910 - DNA, 19 bp, Homo sapiens
ggcttcagtggcagctgct

SEQ ID NO: 5494911 - DNA, 13 bp, Homo sapiens
ggcttcatctctt

SEQ ID NO: 5494912 - DNA, 18 bp, Homo sapiens
ggcttcatctctttagag

SEQ ID NO: 5494913 - DNA, 18 bp, Homo sapiens
ggcttcattagagcaggc

SEQ ID NO: 5494914 - DNA, 17 bp, Homo sapiens
ggcttcattcaagtcta

SEQ ID NO: 5494915 - DNA, 11 bp, Homo sapiens
ggcttcatttc

SEQ ID NO: 5494916 - DNA, 18 bp, Homo sapiens
ggcttccagaaggcagca

SEQ ID NO: 5494917 - DNA, 20 bp, Homo sapiens
ggcttccagagagtcctctg

SEQ ID NO: 5494918 - DNA, 22 bp, Homo sapiens
ggcttccagagagtcctctgga

SEQ ID NO: 5494919 - DNA, 19 bp, Homo sapiens
ggcttccagattttaaatt

SEQ ID NO: 5494920 - DNA, 19 bp, Homo sapiens
ggcttccagcgggccctct

SEQ ID NO: 5494921 - DNA, 19 bp, Homo sapiens
ggcttccagctcagtccca

SEQ ID NO: 5494922 - DNA, 23 bp, Homo sapiens
ggcttccagctcagtcccacagc

SEQ ID NO: 5494923 - DNA, 17 bp, Homo sapiens
ggcttccaggctgagag

SEQ ID NO: 5494924 - DNA, 23 bp, Homo sapiens
ggcttccatcccaaccagtgcca

SEQ ID NO: 5494925 - DNA, 15 bp, Homo sapiens
ggcttccatggtggt

SEQ ID NO: 5494926 - DNA, 18 bp, Homo sapiens
ggcttccatttgtgtgtg

SEQ ID NO: 5494927 - DNA, 18 bp, Homo sapiens
ggcttcccaaaccaagtg

SEQ ID NO: 5494928 - DNA, 12 bp, Homo sapiens
ggcttcccaagg

SEQ ID NO: 5494929 - DNA, 20 bp, Homo sapiens
ggcttcccaagggctgccgg

SEQ ID NO: 5494930 - DNA, 19 bp, Homo sapiens
ggcttcccacagcctcttc

SEQ ID NO: 5494931 - DNA, 20 bp, Homo sapiens
ggcttcccactttggcttat

SEQ ID NO: 5494932 - DNA, 18 bp, Homo sapiens
ggcttcccagagaccctg

SEQ ID NO: 5494933 - DNA, 17 bp, Homo sapiens
ggcttcccagtggctgc

SEQ ID NO: 5494934 - DNA, 22 bp, Homo sapiens
ggcttcccagtggctgctgccc

SEQ ID NO: 5494935 - DNA, 13 bp, Homo sapiens
ggcttcccctccc

SEQ ID NO: 5494936 - DNA, 21 bp, Homo sapiens
ggcttccccttggcctctctg

SEQ ID NO: 5494937 - DNA, 17 bp, Homo sapiens
ggcttcccgctcagccc

SEQ ID NO: 5494938 - DNA, 17 bp, Homo sapiens
ggcttccctaaactgca

SEQ ID NO: 5494939 - DNA, 18 bp, Homo sapiens
ggcttccctaaactgcag

SEQ ID NO: 5494940 - DNA, 20 bp, Homo sapiens
ggcttccctaaactgcagcc

SEQ ID NO: 5494941 - DNA, 20 bp, Homo sapiens
ggcttccctacacagggcct

SEQ ID NO: 5494942 - DNA, 15 bp, Homo sapiens
ggcttccctctgctc

SEQ ID NO: 5494943 - DNA, 16 bp, Homo sapiens
ggcttccctctgctcc

SEQ ID NO: 5494944 - DNA, 12 bp, Homo sapiens
ggcttccctgcc

SEQ ID NO: 5494945 - DNA, 23 bp, Homo sapiens
ggcttccctgcccaatcctccct

SEQ ID NO: 5494946 - DNA, 15 bp, Homo sapiens
ggcttccctggaagc

SEQ ID NO: 5494947 - DNA, 19 bp, Homo sapiens
ggcttccctggaagctctc

SEQ ID NO: 5494948 - DNA, 11 bp, Homo sapiens
ggcttcccttc

SEQ ID NO: 5494949 - DNA, 13 bp, Homo sapiens
ggcttcccttctc

SEQ ID NO: 5494950 - DNA, 14 bp, Homo sapiens
ggcttcccttctcc

SEQ ID NO: 5494951 - DNA, 20 bp, Homo sapiens
ggcttcccttctccccagcc

SEQ ID NO: 5494952 - DNA, 13 bp, Homo sapiens
ggcttccgcgccc

SEQ ID NO: 5494953 - DNA, 20 bp, Homo sapiens
ggcttccgcgcccagcgctc

SEQ ID NO: 5494954 - DNA, 19 bp, Homo sapiens
ggctttgcccaacctcagc

SEQ ID NO: 5494955 - DNA, 15 bp, Homo sapiens
ggctttgcccacccc

SEQ ID NO: 5494956 - DNA, 23 bp, Homo sapiens
ggctttgcccacccctcactccc

SEQ ID NO: 5494957 - DNA, 15 bp, Homo sapiens
ggctttgcctcttct

SEQ ID NO: 5494958 - DNA, 18 bp, Homo sapiens
ggctttgccttgcagcca

SEQ ID NO: 5494959 - DNA, 12 bp, Homo sapiens
ggctttggccca

SEQ ID NO: 5494960 - DNA, 20 bp, Homo sapiens
ggctttgggaaagcccagac

SEQ ID NO: 5494961 - DNA, 21 bp, Homo sapiens
ggctttgggaaagcccagact

SEQ ID NO: 5494962 - DNA, 21 bp, Homo sapiens
ggctttgggaacactggcctg

SEQ ID NO: 5494963 - DNA, 12 bp, Homo sapiens
ggctttgggaag

SEQ ID NO: 5494964 - DNA, 21 bp, Homo sapiens
ggctttgggaagtttgctgtg

SEQ ID NO: 5494965 - DNA, 22 bp, Homo sapiens
ggctttgggaagtttgctgtgc

SEQ ID NO: 5494966 - DNA, 12 bp, Homo sapiens
ggctttgggccc

SEQ ID NO: 5494967 - DNA, 13 bp, Homo sapiens
ggctttgggccca

SEQ ID NO: 5494968 - DNA, 15 bp, Homo sapiens
ggctttggtggcccc

SEQ ID NO: 5494969 - DNA, 15 bp, Homo sapiens
ggctttgtcccacag

SEQ ID NO: 5494970 - DNA, 21 bp, Homo sapiens
ggctttgtgagagaggacctc

SEQ ID NO: 5494971 - DNA, 23 bp, Homo sapiens
ggctttgtgagagaggacctcca

SEQ ID NO: 5494972 - DNA, 18 bp, Homo sapiens
ggctttgtggaaacagct

SEQ ID NO: 5494973 - DNA, 13 bp, Homo sapiens
ggctttgtgttgt

SEQ ID NO: 5494974 - DNA, 16 bp, Homo sapiens
ggcttttaaaaggaaa

SEQ ID NO: 5494975 - DNA, 14 bp, Homo sapiens
ggcttttcactgct

SEQ ID NO: 5494976 - DNA, 17 bp, Homo sapiens
ggcttttcactgctggc

SEQ ID NO: 5494977 - DNA, 12 bp, Homo sapiens
ggcttttccagt

SEQ ID NO: 5494978 - DNA, 20 bp, Homo sapiens
ggcttttcccaccagctccc

SEQ ID NO: 5494979 - DNA, 14 bp, Homo sapiens
ggcttttccctggg

SEQ ID NO: 5494980 - DNA, 12 bp, Homo sapiens
ggcttttccttt

SEQ ID NO: 5494981 - DNA, 16 bp, Homo sapiens
ggcttttctgatccag

SEQ ID NO: 5494982 - DNA, 15 bp, Homo sapiens
ggcttttctggggcc

SEQ ID NO: 5494983 - DNA, 21 bp, Homo sapiens
ggcttttctggggcccaggaa

SEQ ID NO: 5494984 - DNA, 18 bp, Homo sapiens
ggcttttgaatcaaagaa

SEQ ID NO: 5494985 - DNA, 10 bp, Homo sapiens
ggcttttgtg

SEQ ID NO: 5494986 - DNA, 18 bp, Homo sapiens
ggcttttgtttcttccct

SEQ ID NO: 5494987 - DNA, 20 bp, Homo sapiens
ggctttttactattaacatg

SEQ ID NO: 5494988 - DNA, 18 bp, Homo sapiens
ggctttttccaaatgctt

SEQ ID NO: 5494989 - DNA, 23 bp, Homo sapiens
ggctttttccatatagtttgttt

SEQ ID NO: 5494990 - DNA, 21 bp, Homo sapiens
ggctttttcctctgagcccag

SEQ ID NO: 5494991 - DNA, 21 bp, Homo sapiens
ggctttttctttttttgcata

SEQ ID NO: 5494992 - DNA, 12 bp, Homo sapiens
ggctttttgaaa

SEQ ID NO: 5494993 - DNA, 19 bp, Homo sapiens
ggcttttttaaaaaagcaa

SEQ ID NO: 5494994 - DNA, 15 bp, Homo sapiens
ggcttttttgtgggg

SEQ ID NO: 5494995 - DNA, 15 bp, Homo sapiens
gggaaaaaaaagaaa

SEQ ID NO: 5494996 - DNA, 17 bp, Homo sapiens
gggaaaaaaaagaaaaa

SEQ ID NO: 5494997 - DNA, 18 bp, Homo sapiens
gggaaaaaaaagaaaaaa

SEQ ID NO: 5494998 - DNA, 17 bp, Homo sapiens
gggaaaaaaaagagact

SEQ ID NO: 5494999 - DNA, 23 bp, Homo sapiens
gggaaaaaaaatctctcagagcc

SEQ ID NO: 5495000 - DNA, 15 bp, Homo sapiens
gggaaaaaaaatgta

SEQ ID NO: 5495001 - DNA, 16 bp, Homo sapiens
gggaaaaaaatcatct

SEQ ID NO: 5495002 - DNA, 15 bp, Homo sapiens
gggaaaaaaatgttg

SEQ ID NO: 5495003 - DNA, 22 bp, Homo sapiens
gggaaaaaactttgctccaggc

SEQ ID NO: 5495004 - DNA, 11 bp, Homo sapiens
gggaaaaaaga

SEQ ID NO: 5495005 - DNA, 19 bp, Homo sapiens
gggaaaaaagaaagaaaaa

SEQ ID NO: 5495006 - DNA, 14 bp, Homo sapiens
gggaaaaaagaaat

SEQ ID NO: 5495007 - DNA, 12 bp, Homo sapiens
gggaaaaaataa

SEQ ID NO: 5495008 - DNA, 20 bp, Homo sapiens
gggaaaaactttggaaccag

SEQ ID NO: 5495009 - DNA, 10 bp, Homo sapiens
gggaaaaagc

SEQ ID NO: 5495010 - DNA, 16 bp, Homo sapiens
gggaaaacctcagttg

SEQ ID NO: 5495011 - DNA, 23 bp, Homo sapiens
gggaaaacctcagttggcctctg

SEQ ID NO: 5495012 - DNA, 22 bp, Homo sapiens
gggaaaactgccaatatagaaa

SEQ ID NO: 5495013 - DNA, 13 bp, Homo sapiens
gggaaaagcagct

SEQ ID NO: 5495014 - DNA, 20 bp, Homo sapiens
gggaaaagggagaaaaagaa

SEQ ID NO: 5495015 - DNA, 22 bp, Homo sapiens
gggaaaataaaaaaagaaaaaa

SEQ ID NO: 5495016 - DNA, 17 bp, Homo sapiens
gggaaaatatttcctga

SEQ ID NO: 5495017 - DNA, 18 bp, Homo sapiens
gggaaaatggcagaaaga

SEQ ID NO: 5495018 - DNA, 22 bp, Homo sapiens
gggaaaatggccatgcaggagg

SEQ ID NO: 5495019 - DNA, 20 bp, Homo sapiens
gggaaaatgtcccccacctc

SEQ ID NO: 5495020 - DNA, 21 bp, Homo sapiens
gggaaaatgtcccccacctct

SEQ ID NO: 5495021 - DNA, 22 bp, Homo sapiens
gggaaaatgtgaaatctcagaa

SEQ ID NO: 5495022 - DNA, 16 bp, Homo sapiens
gggaaaatgttttgta

SEQ ID NO: 5495023 - DNA, 17 bp, Homo sapiens
gggaaaattatttgcat

SEQ ID NO: 5495024 - DNA, 14 bp, Homo sapiens
gggaaacaaagaag

SEQ ID NO: 5495025 - DNA, 13 bp, Homo sapiens
gggaaacacacac

SEQ ID NO: 5495026 - DNA, 17 bp, Homo sapiens
gggaaacagcctctctc

SEQ ID NO: 5495027 - DNA, 19 bp, Homo sapiens
gggaaacaggttgggatgg

SEQ ID NO: 5495028 - DNA, 15 bp, Homo sapiens
gggaaaccctggagc

SEQ ID NO: 5495029 - DNA, 14 bp, Homo sapiens
gggaaaccttggag

SEQ ID NO: 5495030 - DNA, 18 bp, Homo sapiens
gggaaactaagattcttt

SEQ ID NO: 5495031 - DNA, 19 bp, Homo sapiens
gggaaactaattgtattta

SEQ ID NO: 5495032 - DNA, 21 bp, Homo sapiens
gggaaactcagatgtccaaac

SEQ ID NO: 5495033 - DNA, 16 bp, Homo sapiens
gggaaactctggagag

SEQ ID NO: 5495034 - DNA, 14 bp, Homo sapiens
gggaaactggccat

SEQ ID NO: 5495035 - DNA, 14 bp, Homo sapiens
gggaaactggctga

SEQ ID NO: 5495036 - DNA, 15 bp, Homo sapiens
gggaaactgggaaac

SEQ ID NO: 5495037 - DNA, 17 bp, Homo sapiens
gggaaagaaaaggattt

SEQ ID NO: 5495038 - DNA, 13 bp, Homo sapiens
gggaaagacactg

SEQ ID NO: 5495039 - DNA, 13 bp, Homo sapiens
gggaaagagggag

SEQ ID NO: 5495040 - DNA, 13 bp, Homo sapiens
gggaaagccagcc

SEQ ID NO: 5495041 - DNA, 15 bp, Homo sapiens
gggaaagccagcctg

SEQ ID NO: 5495042 - DNA, 22 bp, Homo sapiens
gggaaagccagtgactccagga

SEQ ID NO: 5495043 - DNA, 13 bp, Homo sapiens
gggaaagccatga

SEQ ID NO: 5495044 - DNA, 15 bp, Homo sapiens
gggaaagcccagact

SEQ ID NO: 5495045 - DNA, 16 bp, Homo sapiens
gggaaagcctctggcc

SEQ ID NO: 5495046 - DNA, 12 bp, Homo sapiens
gggaaagcctga

SEQ ID NO: 5495047 - DNA, 20 bp, Homo sapiens
gggaaagcctgaagggcctc

SEQ ID NO: 5495048 - DNA, 18 bp, Homo sapiens
gggaaagccttaaaaata

SEQ ID NO: 5495049 - DNA, 23 bp, Homo sapiens
gggaaaggaggcatgcctctgat

SEQ ID NO: 5495050 - DNA, 17 bp, Homo sapiens
gggaaaggatggagtgt

SEQ ID NO: 5495051 - DNA, 19 bp, Homo sapiens
gggaaaggatggagtgttt

SEQ ID NO: 5495052 - DNA, 22 bp, Homo sapiens
gggaaaggcctgtggggagccg

SEQ ID NO: 5495053 - DNA, 14 bp, Homo sapiens
gggaaagggaagca

SEQ ID NO: 5495054 - DNA, 22 bp, Homo sapiens
gggaaagggacccgaagcccag

SEQ ID NO: 5495055 - DNA, 16 bp, Homo sapiens
gggaaagggaggaaga

SEQ ID NO: 5495056 - DNA, 12 bp, Homo sapiens
gggaaaggggac

SEQ ID NO: 5495057 - DNA, 13 bp, Homo sapiens
gggaaaggggtgc

SEQ ID NO: 5495058 - DNA, 19 bp, Homo sapiens
gggaaatagcggccctgga

SEQ ID NO: 5495059 - DNA, 21 bp, Homo sapiens
gggaaatagcttcaggatact

SEQ ID NO: 5495060 - DNA, 14 bp, Homo sapiens
gggaaatgcattta

SEQ ID NO: 5495061 - DNA, 13 bp, Homo sapiens
gggaaatggaggg

SEQ ID NO: 5495062 - DNA, 16 bp, Homo sapiens
gggaaatggagggtgg

SEQ ID NO: 5495063 - DNA, 17 bp, Homo sapiens
gggaaatggagggtggg

SEQ ID NO: 5495064 - DNA, 13 bp, Homo sapiens
gggaaatggcctt

SEQ ID NO: 5495065 - DNA, 17 bp, Homo sapiens
gggaaatggccttcccg

SEQ ID NO: 5495066 - DNA, 23 bp, Homo sapiens
gggaaatgttttgtaaacattta

SEQ ID NO: 5495067 - DNA, 23 bp, Homo sapiens
gggaaattctatatgatcctgaa

SEQ ID NO: 5495068 - DNA, 22 bp, Homo sapiens
gggaaattgtaaatcctgtgtt

SEQ ID NO: 5495069 - DNA, 19 bp, Homo sapiens
gggaacaaattagaggaga

SEQ ID NO: 5495070 - DNA, 19 bp, Homo sapiens
gggaacaagggtggcatcc

SEQ ID NO: 5495071 - DNA, 13 bp, Homo sapiens
gggaacaagtgta

SEQ ID NO: 5495072 - DNA, 15 bp, Homo sapiens
gggaacacctgctga

SEQ ID NO: 5495073 - DNA, 15 bp, Homo sapiens
gggaacactgagaaa

SEQ ID NO: 5495074 - DNA, 19 bp, Homo sapiens
gggaacagacaacagaagt

SEQ ID NO: 5495075 - DNA, 18 bp, Homo sapiens
gggaacagacaggagaaa

SEQ ID NO: 5495076 - DNA, 13 bp, Homo sapiens
gggaacagccact

SEQ ID NO: 5495077 - DNA, 13 bp, Homo sapiens
gggaacagcccca

SEQ ID NO: 5495078 - DNA, 14 bp, Homo sapiens
gggaacagccccag

SEQ ID NO: 5495079 - DNA, 19 bp, Homo sapiens
gggaacaggccccacgccc

SEQ ID NO: 5495080 - DNA, 12 bp, Homo sapiens
gggaacagggcg

SEQ ID NO: 5495081 - DNA, 19 bp, Homo sapiens
gggaacagtccataactta

SEQ ID NO: 5495082 - DNA, 20 bp, Homo sapiens
gggaacagtgtttcccataa

SEQ ID NO: 5495083 - DNA, 16 bp, Homo sapiens
gggaacatatttaagg

SEQ ID NO: 5495084 - DNA, 18 bp, Homo sapiens
gggaacatatttaaggaa

SEQ ID NO: 5495085 - DNA, 12 bp, Homo sapiens
gggaacatcctg

SEQ ID NO: 5495086 - DNA, 17 bp, Homo sapiens
gggaacatgacccagcc

SEQ ID NO: 5495087 - DNA, 15 bp, Homo sapiens
gggaacatgccccct

SEQ ID NO: 5495088 - DNA, 20 bp, Homo sapiens
gggaacatgctggaaataaa

SEQ ID NO: 5495089 - DNA, 14 bp, Homo sapiens
gggaacatggggag

SEQ ID NO: 5495090 - DNA, 18 bp, Homo sapiens
gggaaccatgaagacagg

SEQ ID NO: 5495091 - DNA, 16 bp, Homo sapiens
gggaaccatgaagctg

SEQ ID NO: 5495092 - DNA, 20 bp, Homo sapiens
gggaacccagccctggggta

SEQ ID NO: 5495093 - DNA, 16 bp, Homo sapiens
gggaaccccagggggc

SEQ ID NO: 5495094 - DNA, 22 bp, Homo sapiens
gggaacccccaaatttaattaa

SEQ ID NO: 5495095 - DNA, 14 bp, Homo sapiens
gggaacccccttcc

SEQ ID NO: 5495096 - DNA, 18 bp, Homo sapiens
gggaaccccgcagcccgt

SEQ ID NO: 5495097 - DNA, 14 bp, Homo sapiens
gggaacccctttcc

SEQ ID NO: 5495098 - DNA, 19 bp, Homo sapiens
gggaaccctctggggccct

SEQ ID NO: 5495099 - DNA, 19 bp, Homo sapiens
gggaaccctgcccactccc

SEQ ID NO: 5495100 - DNA, 12 bp, Homo sapiens
gggaaccctgct

SEQ ID NO: 5495101 - DNA, 19 bp, Homo sapiens
gggaacctcactcttgcca

SEQ ID NO: 5495102 - DNA, 13 bp, Homo sapiens
gggaacctgtgtc

SEQ ID NO: 5495103 - DNA, 21 bp, Homo sapiens
gggaacgcagaggcggaaacc

SEQ ID NO: 5495104 - DNA, 15 bp, Homo sapiens
gggaacgcagcctcc

SEQ ID NO: 5495105 - DNA, 19 bp, Homo sapiens
gggaacgcccacttccctg

SEQ ID NO: 5495106 - DNA, 20 bp, Homo sapiens
gggaacgcccacttccctgg

SEQ ID NO: 5495107 - DNA, 18 bp, Homo sapiens
gggaacgtgactgcccca

SEQ ID NO: 5495108 - DNA, 15 bp, Homo sapiens
gggaacgttctcttt

SEQ ID NO: 5495109 - DNA, 16 bp, Homo sapiens
gggaactcagatccag

SEQ ID NO: 5495110 - DNA, 15 bp, Homo sapiens
gggaactcatcctgt

SEQ ID NO: 5495111 - DNA, 17 bp, Homo sapiens
gggaactcccccagagg

SEQ ID NO: 5495112 - DNA, 22 bp, Homo sapiens
gggaactgcttgcccagggtgc

SEQ ID NO: 5495113 - DNA, 15 bp, Homo sapiens
gggaactggccaagc

SEQ ID NO: 5495114 - DNA, 19 bp, Homo sapiens
gggaactggccaagctgag

SEQ ID NO: 5495115 - DNA, 16 bp, Homo sapiens
gggaactggcctgctg

SEQ ID NO: 5495116 - DNA, 21 bp, Homo sapiens
gggaactgggaagatgctggc

SEQ ID NO: 5495117 - DNA, 19 bp, Homo sapiens
gggaacttgcgagtccaag

SEQ ID NO: 5495118 - DNA, 18 bp, Homo sapiens
gggaacttgtagccagaa

SEQ ID NO: 5495119 - DNA, 12 bp, Homo sapiens
gggaagaaaaaa

SEQ ID NO: 5495120 - DNA, 20 bp, Homo sapiens
gggaagaaacactttctctt

SEQ ID NO: 5495121 - DNA, 16 bp, Homo sapiens
gggaagaaagagaagg

SEQ ID NO: 5495122 - DNA, 16 bp, Homo sapiens
gggaagaagcagagag

SEQ ID NO: 5495123 - DNA, 15 bp, Homo sapiens
gggaagaaggggcca

SEQ ID NO: 5495124 - DNA, 19 bp, Homo sapiens
gggaagaagtgattctgtc

SEQ ID NO: 5495125 - DNA, 12 bp, Homo sapiens
gggaagacagtg

SEQ ID NO: 5495126 - DNA, 22 bp, Homo sapiens
gggaagacccattccttcccag

SEQ ID NO: 5495127 - DNA, 22 bp, Homo sapiens
gggaagactcctagctgtcctt

SEQ ID NO: 5495128 - DNA, 12 bp, Homo sapiens
gggaagagaaac

SEQ ID NO: 5495129 - DNA, 14 bp, Homo sapiens
gggaagagaagaca

SEQ ID NO: 5495130 - DNA, 23 bp, Homo sapiens
gggaagagaagagggcccagccc

SEQ ID NO: 5495131 - DNA, 17 bp, Homo sapiens
gggaagagaagggaagc

SEQ ID NO: 5495132 - DNA, 17 bp, Homo sapiens
gggaagagagaggcctg

SEQ ID NO: 5495133 - DNA, 18 bp, Homo sapiens
gggaattccctccccctc

SEQ ID NO: 5495134 - DNA, 14 bp, Homo sapiens
gggaattctcttgg

SEQ ID NO: 5495135 - DNA, 14 bp, Homo sapiens
gggaattgaggaca

SEQ ID NO: 5495136 - DNA, 22 bp, Homo sapiens
gggaattgaggtctgctcggcc

SEQ ID NO: 5495137 - DNA, 13 bp, Homo sapiens
gggaattgcatgc

SEQ ID NO: 5495138 - DNA, 18 bp, Homo sapiens
gggaattgcgctcagggg

SEQ ID NO: 5495139 - DNA, 22 bp, Homo sapiens
gggaattggggagggagaaagg

SEQ ID NO: 5495140 - DNA, 14 bp, Homo sapiens
gggaattgtgtgat

SEQ ID NO: 5495141 - DNA, 13 bp, Homo sapiens
gggaatttcctct

SEQ ID NO: 5495142 - DNA, 15 bp, Homo sapiens
gggaattttcatttt

SEQ ID NO: 5495143 - DNA, 20 bp, Homo sapiens
gggaattttccccgtgacat

SEQ ID NO: 5495144 - DNA, 15 bp, Homo sapiens
gggacaaagaggcct

SEQ ID NO: 5495145 - DNA, 17 bp, Homo sapiens
gggacaaaggagcctgt

SEQ ID NO: 5495146 - DNA, 18 bp, Homo sapiens
gggacaaatttaaaacaa

SEQ ID NO: 5495147 - DNA, 19 bp, Homo sapiens
gggacaaatttaaaacaaa

SEQ ID NO: 5495148 - DNA, 22 bp, Homo sapiens
gggacaacactttccctctctg

SEQ ID NO: 5495149 - DNA, 13 bp, Homo sapiens
gggacaacatttt

SEQ ID NO: 5495150 - DNA, 18 bp, Homo sapiens
gggacaaccagaaggccc

SEQ ID NO: 5495151 - DNA, 19 bp, Homo sapiens
gggacaaccagaaggccct

SEQ ID NO: 5495152 - DNA, 19 bp, Homo sapiens
gggacaactgctcccacct

SEQ ID NO: 5495153 - DNA, 23 bp, Homo sapiens
gggacaaggactagggtcctggg

SEQ ID NO: 5495154 - DNA, 18 bp, Homo sapiens
gggacaagggattctggg

SEQ ID NO: 5495155 - DNA, 16 bp, Homo sapiens
gggacaagtctttctc

SEQ ID NO: 5495156 - DNA, 18 bp, Homo sapiens
gggacacaaaactccgcc

SEQ ID NO: 5495157 - DNA, 19 bp, Homo sapiens
gggacacacattctgcctt

SEQ ID NO: 5495158 - DNA, 20 bp, Homo sapiens
gggacacacattctgccttg

SEQ ID NO: 5495159 - DNA, 14 bp, Homo sapiens
gggacacatgcccc

SEQ ID NO: 5495160 - DNA, 23 bp, Homo sapiens
gggacacattcaaccctggagag

SEQ ID NO: 5495161 - DNA, 16 bp, Homo sapiens
gggacaccccccgccc

SEQ ID NO: 5495162 - DNA, 20 bp, Homo sapiens
gggacacccctacacacacc

SEQ ID NO: 5495163 - DNA, 20 bp, Homo sapiens
gggacaccctggttcccacc

SEQ ID NO: 5495164 - DNA, 14 bp, Homo sapiens
gggacaccctgtga

SEQ ID NO: 5495165 - DNA, 16 bp, Homo sapiens
gggacacctgggagaa

SEQ ID NO: 5495166 - DNA, 20 bp, Homo sapiens
gggacacggcctctggggag

SEQ ID NO: 5495167 - DNA, 16 bp, Homo sapiens
gggacacggtgtccac

SEQ ID NO: 5495168 - DNA, 22 bp, Homo sapiens
gggacacggtttaactgtccca

SEQ ID NO: 5495169 - DNA, 23 bp, Homo sapiens
gggacacggtttaactgtcccag

SEQ ID NO: 5495170 - DNA, 15 bp, Homo sapiens
gggacactcctcctc

SEQ ID NO: 5495171 - DNA, 15 bp, Homo sapiens
gggacactgggcagc

SEQ ID NO: 5495172 - DNA, 13 bp, Homo sapiens
gggacactttgtt

SEQ ID NO: 5495173 - DNA, 20 bp, Homo sapiens
gggacagacagcagctggac

SEQ ID NO: 5495174 - DNA, 14 bp, Homo sapiens
gggacagacaggag

SEQ ID NO: 5495175 - DNA, 16 bp, Homo sapiens
gggacagaccagccct

SEQ ID NO: 5495176 - DNA, 13 bp, Homo sapiens
gggacagagaagg

SEQ ID NO: 5495177 - DNA, 18 bp, Homo sapiens
gggacagagacacctgca

SEQ ID NO: 5495178 - DNA, 23 bp, Homo sapiens
gggacagagccaccccatgagct

SEQ ID NO: 5495179 - DNA, 16 bp, Homo sapiens
gggacagagctgagga

SEQ ID NO: 5495180 - DNA, 20 bp, Homo sapiens
gggacagaggccccagcctc

SEQ ID NO: 5495181 - DNA, 19 bp, Homo sapiens
gggacagaggccctgccac

SEQ ID NO: 5495182 - DNA, 15 bp, Homo sapiens
gggacagaggcctgc

SEQ ID NO: 5495183 - DNA, 22 bp, Homo sapiens
gggacagattcagtcttgcctt

SEQ ID NO: 5495184 - DNA, 22 bp, Homo sapiens
gggacagattggcaatgggccg

SEQ ID NO: 5495185 - DNA, 14 bp, Homo sapiens
gggacagcagggac

SEQ ID NO: 5495186 - DNA, 22 bp, Homo sapiens
gggacagcatgccccttggctg

SEQ ID NO: 5495187 - DNA, 20 bp, Homo sapiens
gggacagccagagctgggtg

SEQ ID NO: 5495188 - DNA, 19 bp, Homo sapiens
gggacagcccagagcctgg

SEQ ID NO: 5495189 - DNA, 12 bp, Homo sapiens
gggacagcccca

SEQ ID NO: 5495190 - DNA, 16 bp, Homo sapiens
gggacagcggcccggc

SEQ ID NO: 5495191 - DNA, 12 bp, Homo sapiens
gggacagctcct

SEQ ID NO: 5495192 - DNA, 21 bp, Homo sapiens
gggacagctccttctgtccta

SEQ ID NO: 5495193 - DNA, 12 bp, Homo sapiens
gggacagctggc

SEQ ID NO: 5495194 - DNA, 14 bp, Homo sapiens
gggacagctggctg

SEQ ID NO: 5495195 - DNA, 11 bp, Homo sapiens
gggacagctgt

SEQ ID NO: 5495196 - DNA, 20 bp, Homo sapiens
gggacagcttcctcacaccc

SEQ ID NO: 5495197 - DNA, 20 bp, Homo sapiens
gggacagctttcctgggtga

SEQ ID NO: 5495198 - DNA, 16 bp, Homo sapiens
gggacaggaaagagag

SEQ ID NO: 5495199 - DNA, 20 bp, Homo sapiens
gggacaggaacacccagccc

SEQ ID NO: 5495200 - DNA, 21 bp, Homo sapiens
gggacaggaacacccagcccc

SEQ ID NO: 5495201 - DNA, 21 bp, Homo sapiens
gggacaggaaggtctgatttg

SEQ ID NO: 5495202 - DNA, 17 bp, Homo sapiens
gggacaggagaagagag

SEQ ID NO: 5495203 - DNA, 20 bp, Homo sapiens
gggacaggatctataggcag

SEQ ID NO: 5495204 - DNA, 22 bp, Homo sapiens
gggacaggattgtctgctgcct

SEQ ID NO: 5495205 - DNA, 21 bp, Homo sapiens
gggacaggcccgcttgctggg

SEQ ID NO: 5495206 - DNA, 19 bp, Homo sapiens
gggacaggctgaagagagg

SEQ ID NO: 5495207 - DNA, 12 bp, Homo sapiens
gggacagggagg

SEQ ID NO: 5495208 - DNA, 18 bp, Homo sapiens
gggacagggctggcccag

SEQ ID NO: 5495209 - DNA, 21 bp, Homo sapiens
gggacagggtgtctcctgaag

SEQ ID NO: 5495210 - DNA, 17 bp, Homo sapiens
gggacaggtgggcctgg

SEQ ID NO: 5495211 - DNA, 22 bp, Homo sapiens
gggacagtaataagaatggaaa

SEQ ID NO: 5495212 - DNA, 21 bp, Homo sapiens
gggacagtcacctcatggaat

SEQ ID NO: 5495213 - DNA, 12 bp, Homo sapiens
gggacagtctca

SEQ ID NO: 5495214 - DNA, 19 bp, Homo sapiens
gggacagtgcgtgatttct

SEQ ID NO: 5495215 - DNA, 20 bp, Homo sapiens
gggacatgctaaataactat

SEQ ID NO: 5495216 - DNA, 19 bp, Homo sapiens
gggacatgcttagcagtcc

SEQ ID NO: 5495217 - DNA, 22 bp, Homo sapiens
gggacatggggcaagccagggc

SEQ ID NO: 5495218 - DNA, 20 bp, Homo sapiens
gggacatgtatgcttccagg

SEQ ID NO: 5495219 - DNA, 16 bp, Homo sapiens
gggacatttccaagct

SEQ ID NO: 5495220 - DNA, 19 bp, Homo sapiens
gggacatttgctcatggaa

SEQ ID NO: 5495221 - DNA, 19 bp, Homo sapiens
gggacattttctggattct

SEQ ID NO: 5495222 - DNA, 18 bp, Homo sapiens
gggaccaaaactgcctac

SEQ ID NO: 5495223 - DNA, 20 bp, Homo sapiens
gggaccaaactcacggacca

SEQ ID NO: 5495224 - DNA, 23 bp, Homo sapiens
gggaccaaggcaaggcaggtgcc

SEQ ID NO: 5495225 - DNA, 13 bp, Homo sapiens
gggaccacagagg

SEQ ID NO: 5495226 - DNA, 18 bp, Homo sapiens
gggaccacagaggctgtg

SEQ ID NO: 5495227 - DNA, 19 bp, Homo sapiens
gggaccacagcaaggcacc

SEQ ID NO: 5495228 - DNA, 21 bp, Homo sapiens
gggaccacagctgctggccag

SEQ ID NO: 5495229 - DNA, 12 bp, Homo sapiens
gggaccacatct

SEQ ID NO: 5495230 - DNA, 21 bp, Homo sapiens
gggaccacatgccactgcctg

SEQ ID NO: 5495231 - DNA, 22 bp, Homo sapiens
gggaccacatgccactgcctgc

SEQ ID NO: 5495232 - DNA, 16 bp, Homo sapiens
gggaccactgggtgag

SEQ ID NO: 5495233 - DNA, 17 bp, Homo sapiens
gggaccactgggtgaga

SEQ ID NO: 5495234 - DNA, 13 bp, Homo sapiens
gggaccagagcca

SEQ ID NO: 5495235 - DNA, 20 bp, Homo sapiens
gggaccagagggatgggaga

SEQ ID NO: 5495236 - DNA, 20 bp, Homo sapiens
gggaccagcagccccacacc

SEQ ID NO: 5495237 - DNA, 14 bp, Homo sapiens
gggaccagccaaga

SEQ ID NO: 5495238 - DNA, 15 bp, Homo sapiens
gggaccagctggggg

SEQ ID NO: 5495239 - DNA, 12 bp, Homo sapiens
gggaccaggata

SEQ ID NO: 5495240 - DNA, 14 bp, Homo sapiens
gggaccaggcacca

SEQ ID NO: 5495241 - DNA, 12 bp, Homo sapiens
gggaccagggcc

SEQ ID NO: 5495242 - DNA, 18 bp, Homo sapiens
gggaccagggccaccgca

SEQ ID NO: 5495243 - DNA, 16 bp, Homo sapiens
gggaccataagaggag

SEQ ID NO: 5495244 - DNA, 15 bp, Homo sapiens
gggaccatctgctgc

SEQ ID NO: 5495245 - DNA, 17 bp, Homo sapiens
gggaccatggacacatt

SEQ ID NO: 5495246 - DNA, 15 bp, Homo sapiens
gggaccatggggagg

SEQ ID NO: 5495247 - DNA, 23 bp, Homo sapiens
gggacccaaaccccctgcagccc

SEQ ID NO: 5495248 - DNA, 21 bp, Homo sapiens
gggacccaatgtaggagctgc

SEQ ID NO: 5495249 - DNA, 16 bp, Homo sapiens
gggacccacagaactt

SEQ ID NO: 5495250 - DNA, 12 bp, Homo sapiens
gggacccacagt

SEQ ID NO: 5495251 - DNA, 22 bp, Homo sapiens
gggacccacctccccctccccg

SEQ ID NO: 5495252 - DNA, 18 bp, Homo sapiens
gggacccacggagccctc

SEQ ID NO: 5495253 - DNA, 20 bp, Homo sapiens
gggacccacggagccctccc

SEQ ID NO: 5495254 - DNA, 22 bp, Homo sapiens
gggacccacggagccctcccta

SEQ ID NO: 5495255 - DNA, 19 bp, Homo sapiens
gggacccagagtcccaggc

SEQ ID NO: 5495256 - DNA, 24 bp, Homo sapiens
gggacccagctactctgtccaggc

SEQ ID NO: 5495257 - DNA, 13 bp, Homo sapiens
gggacccagctcc

SEQ ID NO: 5495258 - DNA, 14 bp, Homo sapiens
gggacccagctcct

SEQ ID NO: 5495259 - DNA, 15 bp, Homo sapiens
gggacccagctcctc

SEQ ID NO: 5495260 - DNA, 16 bp, Homo sapiens
gggacccagctcctct

SEQ ID NO: 5495261 - DNA, 12 bp, Homo sapiens
gggacccaggct

SEQ ID NO: 5495262 - DNA, 13 bp, Homo sapiens
gggacccaggctc

SEQ ID NO: 5495263 - DNA, 14 bp, Homo sapiens
gggacccaggctcc

SEQ ID NO: 5495264 - DNA, 19 bp, Homo sapiens
gggacccaggctccgccct

SEQ ID NO: 5495265 - DNA, 22 bp, Homo sapiens
gggacccaggtgtgcctgtgct

SEQ ID NO: 5495266 - DNA, 23 bp, Homo sapiens
gggacccaggtgtgcctgtgctc

SEQ ID NO: 5495267 - DNA, 15 bp, Homo sapiens
gggacccagtggcag

SEQ ID NO: 5495268 - DNA, 13 bp, Homo sapiens
gggaccccagaga

SEQ ID NO: 5495269 - DNA, 22 bp, Homo sapiens
gggaccccagatacctgtgagg

SEQ ID NO: 5495270 - DNA, 17 bp, Homo sapiens
gggaccccagctgctct

SEQ ID NO: 5495271 - DNA, 13 bp, Homo sapiens
gggaccccccccc

SEQ ID NO: 5495272 - DNA, 21 bp, Homo sapiens
gggacccccgaggcccccctc

SEQ ID NO: 5495273 - DNA, 23 bp, Homo sapiens
gggacccccggcctccaggctgg

SEQ ID NO: 5495274 - DNA, 23 bp, Homo sapiens
gggaccccctcaccatccagtgg

SEQ ID NO: 5495275 - DNA, 18 bp, Homo sapiens
gggaccccctcgccagct

SEQ ID NO: 5495276 - DNA, 18 bp, Homo sapiens
gggaccccctggccctgc

SEQ ID NO: 5495277 - DNA, 18 bp, Homo sapiens
gggaccccgagcctggct

SEQ ID NO: 5495278 - DNA, 20 bp, Homo sapiens
gggaccccgagcctggctcc

SEQ ID NO: 5495279 - DNA, 14 bp, Homo sapiens
gggacccctcccaa

SEQ ID NO: 5495280 - DNA, 13 bp, Homo sapiens
gggacccctcctc

SEQ ID NO: 5495281 - DNA, 22 bp, Homo sapiens
gggacccctcgcaaccctgcct

SEQ ID NO: 5495282 - DNA, 18 bp, Homo sapiens
gggacccctcgccccagc

SEQ ID NO: 5495283 - DNA, 21 bp, Homo sapiens
gggacccctcgccccagcctc

SEQ ID NO: 5495284 - DNA, 22 bp, Homo sapiens
gggacccctgctcccagcctgc

SEQ ID NO: 5495285 - DNA, 20 bp, Homo sapiens
gggacccgctgggggctggc

SEQ ID NO: 5495286 - DNA, 23 bp, Homo sapiens
gggacccggggtctcctggacct

SEQ ID NO: 5495287 - DNA, 15 bp, Homo sapiens
gggaccctcagcagc

SEQ ID NO: 5495288 - DNA, 16 bp, Homo sapiens
gggaccctcagcagct

SEQ ID NO: 5495289 - DNA, 19 bp, Homo sapiens
gggaccctcagcagctctg

SEQ ID NO: 5495290 - DNA, 20 bp, Homo sapiens
gggaccctgcccagagctga

SEQ ID NO: 5495291 - DNA, 15 bp, Homo sapiens
gggaccctgccgagg

SEQ ID NO: 5495292 - DNA, 13 bp, Homo sapiens
gggaccctgcctc

SEQ ID NO: 5495293 - DNA, 22 bp, Homo sapiens
gggacccttgcctgcctcctag

SEQ ID NO: 5495294 - DNA, 16 bp, Homo sapiens
gggaccctttccttcc

SEQ ID NO: 5495295 - DNA, 19 bp, Homo sapiens
gggaccgcctggccctccc

SEQ ID NO: 5495296 - DNA, 20 bp, Homo sapiens
gggaccgcctggccctccct

SEQ ID NO: 5495297 - DNA, 14 bp, Homo sapiens
gggaccggcagagc

SEQ ID NO: 5495298 - DNA, 16 bp, Homo sapiens
gggaccggcagagctc

SEQ ID NO: 5495299 - DNA, 20 bp, Homo sapiens
gggaccggtgctgcaggagt

SEQ ID NO: 5495300 - DNA, 18 bp, Homo sapiens
gggaccgtccaggggaga

SEQ ID NO: 5495301 - DNA, 19 bp, Homo sapiens
gggaccgtctttacccctg

SEQ ID NO: 5495302 - DNA, 13 bp, Homo sapiens
gggaccgtgcccc

SEQ ID NO: 5495303 - DNA, 14 bp, Homo sapiens
gggaccgtgcccca

SEQ ID NO: 5495304 - DNA, 17 bp, Homo sapiens
gggaccgtgcgagctgc

SEQ ID NO: 5495305 - DNA, 14 bp, Homo sapiens
gggacctaggctcc

SEQ ID NO: 5495306 - DNA, 16 bp, Homo sapiens
gggacctaggctcctc

SEQ ID NO: 5495307 - DNA, 14 bp, Homo sapiens
gggacctcagcctg

SEQ ID NO: 5495308 - DNA, 15 bp, Homo sapiens
gggacctcagcctgc

SEQ ID NO: 5495309 - DNA, 20 bp, Homo sapiens
gggacctcagcctgcaccct

SEQ ID NO: 5495310 - DNA, 14 bp, Homo sapiens
gggagagagagaga

SEQ ID NO: 5495311 - DNA, 15 bp, Homo sapiens
gggagagagggaaaa

SEQ ID NO: 5495312 - DNA, 14 bp, Homo sapiens
gggagagcaggctg

SEQ ID NO: 5495313 - DNA, 14 bp, Homo sapiens
gggagagccagctc

SEQ ID NO: 5495314 - DNA, 12 bp, Homo sapiens
gggagagccagg

SEQ ID NO: 5495315 - DNA, 14 bp, Homo sapiens
gggagagccaggct

SEQ ID NO: 5495316 - DNA, 15 bp, Homo sapiens
gggagagctgagcca

SEQ ID NO: 5495317 - DNA, 12 bp, Homo sapiens
gggagagctggc

SEQ ID NO: 5495318 - DNA, 12 bp, Homo sapiens
gggagagctggg

SEQ ID NO: 5495319 - DNA, 21 bp, Homo sapiens
gggagagctgggcagacaggt

SEQ ID NO: 5495320 - DNA, 13 bp, Homo sapiens
gggagaggaactc

SEQ ID NO: 5495321 - DNA, 14 bp, Homo sapiens
gggagaggactctg

SEQ ID NO: 5495322 - DNA, 12 bp, Homo sapiens
gggagaggaggg

SEQ ID NO: 5495323 - DNA, 14 bp, Homo sapiens
gggagaggctggga

SEQ ID NO: 5495324 - DNA, 18 bp, Homo sapiens
gggagagggatttccctg

SEQ ID NO: 5495325 - DNA, 13 bp, Homo sapiens
gggagaggggaga

SEQ ID NO: 5495326 - DNA, 14 bp, Homo sapiens
gggagaggggagac

SEQ ID NO: 5495327 - DNA, 17 bp, Homo sapiens
gggagaggggcctcaaa

SEQ ID NO: 5495328 - DNA, 20 bp, Homo sapiens
gggagagggggtaatggagg

SEQ ID NO: 5495329 - DNA, 15 bp, Homo sapiens
gggagagggtctgga

SEQ ID NO: 5495330 - DNA, 16 bp, Homo sapiens
gggagagtcaggcagg

SEQ ID NO: 5495331 - DNA, 13 bp, Homo sapiens
gggagagtccagg

SEQ ID NO: 5495332 - DNA, 15 bp, Homo sapiens
gggagagtccaggcc

SEQ ID NO: 5495333 - DNA, 16 bp, Homo sapiens
gggagagtccaggcct

SEQ ID NO: 5495334 - DNA, 20 bp, Homo sapiens
gggagagtccttagcctggg

SEQ ID NO: 5495335 - DNA, 12 bp, Homo sapiens
gggagagtgagg

SEQ ID NO: 5495336 - DNA, 17 bp, Homo sapiens
gggagagtgcaggcctg

SEQ ID NO: 5495337 - DNA, 20 bp, Homo sapiens
gggagagtgtcaaccagaca

SEQ ID NO: 5495338 - DNA, 18 bp, Homo sapiens
gggagagttgtgatggag

SEQ ID NO: 5495339 - DNA, 20 bp, Homo sapiens
gggagatccgccctgggctc

SEQ ID NO: 5495340 - DNA, 22 bp, Homo sapiens
gggagatccgccctgggctctg

SEQ ID NO: 5495341 - DNA, 23 bp, Homo sapiens
gggagatccgccctgggctctgg

SEQ ID NO: 5495342 - DNA, 16 bp, Homo sapiens
gggagatgctctctga

SEQ ID NO: 5495343 - DNA, 14 bp, Homo sapiens
gggagatgctggga

SEQ ID NO: 5495344 - DNA, 15 bp, Homo sapiens
gggagatggaggtag

SEQ ID NO: 5495345 - DNA, 15 bp, Homo sapiens
gggagatgggtggga

SEQ ID NO: 5495346 - DNA, 14 bp, Homo sapiens
gggagatggtcagt

SEQ ID NO: 5495347 - DNA, 17 bp, Homo sapiens
gggagattaaaaccaga

SEQ ID NO: 5495348 - DNA, 17 bp, Homo sapiens
gggagattcaagggacc

SEQ ID NO: 5495349 - DNA, 14 bp, Homo sapiens
gggagattctgggt

SEQ ID NO: 5495350 - DNA, 15 bp, Homo sapiens
gggagattctgggtt

SEQ ID NO: 5495351 - DNA, 19 bp, Homo sapiens
gggagcaaactgcatgccc

SEQ ID NO: 5495352 - DNA, 15 bp, Homo sapiens
gggagcaactctcca

SEQ ID NO: 5495353 - DNA, 12 bp, Homo sapiens
gggagcaagccc

SEQ ID NO: 5495354 - DNA, 15 bp, Homo sapiens
gggagcaatctggaa

SEQ ID NO: 5495355 - DNA, 13 bp, Homo sapiens
gggagcacaaggc

SEQ ID NO: 5495356 - DNA, 23 bp, Homo sapiens
gggagcacatagccctgttgacc

SEQ ID NO: 5495357 - DNA, 21 bp, Homo sapiens
gggagcaccacggccagaagt

SEQ ID NO: 5495358 - DNA, 12 bp, Homo sapiens
gggagcacccag

SEQ ID NO: 5495359 - DNA, 18 bp, Homo sapiens
gggagcactggaggcctc

SEQ ID NO: 5495360 - DNA, 16 bp, Homo sapiens
gggagcagacaggagg

SEQ ID NO: 5495361 - DNA, 16 bp, Homo sapiens
gggagcagagtatagg

SEQ ID NO: 5495362 - DNA, 20 bp, Homo sapiens
gggagcagagtataggatgg

SEQ ID NO: 5495363 - DNA, 18 bp, Homo sapiens
gggagcaggagattgaga

SEQ ID NO: 5495364 - DNA, 13 bp, Homo sapiens
gggagcaggcagc

SEQ ID NO: 5495365 - DNA, 13 bp, Homo sapiens
gggagcaggcagt

SEQ ID NO: 5495366 - DNA, 15 bp, Homo sapiens
gggagcaggcggtgg

SEQ ID NO: 5495367 - DNA, 21 bp, Homo sapiens
gggagcaggcggtgggcaccc

SEQ ID NO: 5495368 - DNA, 23 bp, Homo sapiens
gggagcaggctcgggctccccag

SEQ ID NO: 5495369 - DNA, 15 bp, Homo sapiens
gggagcagggaaggc

SEQ ID NO: 5495370 - DNA, 12 bp, Homo sapiens
gggagcagggct

SEQ ID NO: 5495371 - DNA, 20 bp, Homo sapiens
gggagcaggtgcccccaggt

SEQ ID NO: 5495372 - DNA, 19 bp, Homo sapiens
gggagcagtgtcttccata

SEQ ID NO: 5495373 - DNA, 21 bp, Homo sapiens
gggagcagttttcccctggcc

SEQ ID NO: 5495374 - DNA, 22 bp, Homo sapiens
gggagcagttttcccctggcct

SEQ ID NO: 5495375 - DNA, 21 bp, Homo sapiens
gggagcatgagaggaggcagc

SEQ ID NO: 5495376 - DNA, 16 bp, Homo sapiens
gggagcatggctgtga

SEQ ID NO: 5495377 - DNA, 15 bp, Homo sapiens
gggagccaacagcag

SEQ ID NO: 5495378 - DNA, 16 bp, Homo sapiens
gggagccaacagcagc

SEQ ID NO: 5495379 - DNA, 21 bp, Homo sapiens
gggagccaatactgagtgcct

SEQ ID NO: 5495380 - DNA, 23 bp, Homo sapiens
gggagccaatactgagtgcctgc

SEQ ID NO: 5495381 - DNA, 16 bp, Homo sapiens
gggagccactgccact

SEQ ID NO: 5495382 - DNA, 15 bp, Homo sapiens
gggagccagaaatgg

SEQ ID NO: 5495383 - DNA, 18 bp, Homo sapiens
gggagccagagcctctgt

SEQ ID NO: 5495384 - DNA, 16 bp, Homo sapiens
gggagccagaggccag

SEQ ID NO: 5495385 - DNA, 17 bp, Homo sapiens
gggagccagaggccagg

SEQ ID NO: 5495386 - DNA, 20 bp, Homo sapiens
gggagccagctgctttttgt

SEQ ID NO: 5495387 - DNA, 13 bp, Homo sapiens
gggagccaggact

SEQ ID NO: 5495388 - DNA, 14 bp, Homo sapiens
gggagccaggactc

SEQ ID NO: 5495389 - DNA, 13 bp, Homo sapiens
gggagccaggagg

SEQ ID NO: 5495390 - DNA, 14 bp, Homo sapiens
gggagccagtgtgc

SEQ ID NO: 5495391 - DNA, 15 bp, Homo sapiens
gggagccagtgtgcc

SEQ ID NO: 5495392 - DNA, 14 bp, Homo sapiens
gggagccagttctg

SEQ ID NO: 5495393 - DNA, 10 bp, Homo sapiens
gggagcccac

SEQ ID NO: 5495394 - DNA, 19 bp, Homo sapiens
gggagcccactgtcctggg

SEQ ID NO: 5495395 - DNA, 18 bp, Homo sapiens
gggagcccaggcctggcc

SEQ ID NO: 5495396 - DNA, 14 bp, Homo sapiens
gggagccccagggt

SEQ ID NO: 5495397 - DNA, 16 bp, Homo sapiens
gggagccccagggtct

SEQ ID NO: 5495398 - DNA, 16 bp, Homo sapiens
gggagcccccaccaca

SEQ ID NO: 5495399 - DNA, 12 bp, Homo sapiens
gggagcccccgc

SEQ ID NO: 5495400 - DNA, 16 bp, Homo sapiens
gggagcccccgccccg

SEQ ID NO: 5495401 - DNA, 17 bp, Homo sapiens
gggagcccctaggaaag

SEQ ID NO: 5495402 - DNA, 14 bp, Homo sapiens
gggagccctagccc

SEQ ID NO: 5495403 - DNA, 10 bp, Homo sapiens
gggagccctc

SEQ ID NO: 5495404 - DNA, 13 bp, Homo sapiens
gggagccctcagg

SEQ ID NO: 5495405 - DNA, 14 bp, Homo sapiens
gggagccctcaggc

SEQ ID NO: 5495406 - DNA, 23 bp, Homo sapiens
gggagccctcaggcacctgcact

SEQ ID NO: 5495407 - DNA, 21 bp, Homo sapiens
gggagccctcaggctccccag

SEQ ID NO: 5495408 - DNA, 20 bp, Homo sapiens
gggagccctgaccttggctg

SEQ ID NO: 5495409 - DNA, 14 bp, Homo sapiens
gggagccctgggcc

SEQ ID NO: 5495410 - DNA, 17 bp, Homo sapiens
gggagccgcagagcctg

SEQ ID NO: 5495411 - DNA, 16 bp, Homo sapiens
gggagccgcaggggcc

SEQ ID NO: 5495412 - DNA, 19 bp, Homo sapiens
gggagccgcaggggcccct

SEQ ID NO: 5495413 - DNA, 16 bp, Homo sapiens
gggagccgctggcaga

SEQ ID NO: 5495414 - DNA, 13 bp, Homo sapiens
gggagccgggagc

SEQ ID NO: 5495415 - DNA, 12 bp, Homo sapiens
gggagcctagct

SEQ ID NO: 5495416 - DNA, 17 bp, Homo sapiens
gggagcctagctcctgc

SEQ ID NO: 5495417 - DNA, 21 bp, Homo sapiens
gggagcctagctcctgccaca

SEQ ID NO: 5495418 - DNA, 11 bp, Homo sapiens
gggagcctcct

SEQ ID NO: 5495419 - DNA, 12 bp, Homo sapiens
gggagcctcctg

SEQ ID NO: 5495420 - DNA, 14 bp, Homo sapiens
gggagcctcctgcc

SEQ ID NO: 5495421 - DNA, 13 bp, Homo sapiens
gggagcctctgga

SEQ ID NO: 5495422 - DNA, 17 bp, Homo sapiens
gggagcctgaggcagga

SEQ ID NO: 5495423 - DNA, 21 bp, Homo sapiens
gggagcctgatcacctgccct

SEQ ID NO: 5495424 - DNA, 16 bp, Homo sapiens
gggagcctgtggccag

SEQ ID NO: 5495425 - DNA, 18 bp, Homo sapiens
gggagcgcctgaccctgg

SEQ ID NO: 5495426 - DNA, 15 bp, Homo sapiens
gggagcggagcttgg

SEQ ID NO: 5495427 - DNA, 13 bp, Homo sapiens
gggagcggaggtt

SEQ ID NO: 5495428 - DNA, 17 bp, Homo sapiens
gggagcgtgggaggcgg

SEQ ID NO: 5495429 - DNA, 17 bp, Homo sapiens
gggagctacagccagcg

SEQ ID NO: 5495430 - DNA, 15 bp, Homo sapiens
gggagctcaaggcca

SEQ ID NO: 5495431 - DNA, 13 bp, Homo sapiens
gggagctcagctc

SEQ ID NO: 5495432 - DNA, 12 bp, Homo sapiens
gggagctcagga

SEQ ID NO: 5495433 - DNA, 22 bp, Homo sapiens
gggagctcaggaaccgaggcag

SEQ ID NO: 5495434 - DNA, 22 bp, Homo sapiens
gggagctcagtctccctggcct

SEQ ID NO: 5495435 - DNA, 23 bp, Homo sapiens
gggagctccactctgcttctctg

SEQ ID NO: 5495436 - DNA, 11 bp, Homo sapiens
gggagctcctg

SEQ ID NO: 5495437 - DNA, 12 bp, Homo sapiens
gggagctctgca

SEQ ID NO: 5495438 - DNA, 14 bp, Homo sapiens
gggagctctgggga

SEQ ID NO: 5495439 - DNA, 15 bp, Homo sapiens
gggagctctggggac

SEQ ID NO: 5495440 - DNA, 23 bp, Homo sapiens
gggagctctggggacagcttcct

SEQ ID NO: 5495441 - DNA, 17 bp, Homo sapiens
gggagctgaaccacaga

SEQ ID NO: 5495442 - DNA, 14 bp, Homo sapiens
gggagctgagctgg

SEQ ID NO: 5495443 - DNA, 22 bp, Homo sapiens
gggagctgagctggaaggggcc

SEQ ID NO: 5495444 - DNA, 19 bp, Homo sapiens
gggagctgaggcctccctt

SEQ ID NO: 5495445 - DNA, 12 bp, Homo sapiens
gggagctgaggg

SEQ ID NO: 5495446 - DNA, 13 bp, Homo sapiens
gggagctgagggg

SEQ ID NO: 5495447 - DNA, 18 bp, Homo sapiens
gggagctgaggggcaggg

SEQ ID NO: 5495448 - DNA, 22 bp, Homo sapiens
gggagctgcctgttcagctcca

SEQ ID NO: 5495449 - DNA, 15 bp, Homo sapiens
gggagctgctgccct

SEQ ID NO: 5495450 - DNA, 13 bp, Homo sapiens
gggagctgctggg

SEQ ID NO: 5495451 - DNA, 20 bp, Homo sapiens
gggagctgctgggtggcagg

SEQ ID NO: 5495452 - DNA, 21 bp, Homo sapiens
gggagctgctgggtggcaggg

SEQ ID NO: 5495453 - DNA, 15 bp, Homo sapiens
gggagctggaaataa

SEQ ID NO: 5495454 - DNA, 23 bp, Homo sapiens
gggagctggcaatgccctacctg

SEQ ID NO: 5495455 - DNA, 23 bp, Homo sapiens
gggagctggcctaggtgggagcc

SEQ ID NO: 5495456 - DNA, 16 bp, Homo sapiens
gggagctgggccctgc

SEQ ID NO: 5495457 - DNA, 17 bp, Homo sapiens
gggagctgggccctgcc

SEQ ID NO: 5495458 - DNA, 19 bp, Homo sapiens
gggagctgggccctgcctg

SEQ ID NO: 5495459 - DNA, 21 bp, Homo sapiens
gggagctgggccctgcctgca

SEQ ID NO: 5495460 - DNA, 16 bp, Homo sapiens
gggagctgggcctggt

SEQ ID NO: 5495461 - DNA, 17 bp, Homo sapiens
gggagctgggcctggtc

SEQ ID NO: 5495462 - DNA, 18 bp, Homo sapiens
gggagctgggcctggtct

SEQ ID NO: 5495463 - DNA, 14 bp, Homo sapiens
gggagctgggcttc

SEQ ID NO: 5495464 - DNA, 13 bp, Homo sapiens
gggagctggtgac

SEQ ID NO: 5495465 - DNA, 19 bp, Homo sapiens
gggagcttcctggctctgg

SEQ ID NO: 5495466 - DNA, 16 bp, Homo sapiens
gggagctttcccagag

SEQ ID NO: 5495467 - DNA, 13 bp, Homo sapiens
gggaggaaaaaag

SEQ ID NO: 5495468 - DNA, 23 bp, Homo sapiens
gggaggaagaagcttaggcaggg

SEQ ID NO: 5495469 - DNA, 12 bp, Homo sapiens
gggaggaagcag

SEQ ID NO: 5495470 - DNA, 23 bp, Homo sapiens
gggaggaagcagaataaagcaat

SEQ ID NO: 5495471 - DNA, 20 bp, Homo sapiens
gggaggaagggccaggagag

SEQ ID NO: 5495472 - DNA, 18 bp, Homo sapiens
gggaggaagttggctgag

SEQ ID NO: 5495473 - DNA, 16 bp, Homo sapiens
gggaggacagagccgg

SEQ ID NO: 5495474 - DNA, 15 bp, Homo sapiens
gggaggacatcataa

SEQ ID NO: 5495475 - DNA, 20 bp, Homo sapiens
gggaggaccacaggtgtgag

SEQ ID NO: 5495476 - DNA, 18 bp, Homo sapiens
gggaggaccagggccctg

SEQ ID NO: 5495477 - DNA, 18 bp, Homo sapiens
gggaggacccctgccctc

SEQ ID NO: 5495478 - DNA, 20 bp, Homo sapiens
gggaggacctgaccctactc

SEQ ID NO: 5495479 - DNA, 12 bp, Homo sapiens
gggaggacctgg

SEQ ID NO: 5495480 - DNA, 19 bp, Homo sapiens
gggaggacctggggcacag

SEQ ID NO: 5495481 - DNA, 21 bp, Homo sapiens
gggaggagaggggaagggcca

SEQ ID NO: 5495482 - DNA, 22 bp, Homo sapiens
gggaggagatttttttttttca

SEQ ID NO: 5495483 - DNA, 12 bp, Homo sapiens
gggaggagcacc

SEQ ID NO: 5495484 - DNA, 19 bp, Homo sapiens
gggaggagcctctggcttc

SEQ ID NO: 5495485 - DNA, 19 bp, Homo sapiens
gggaggaggaacgggcagc

SEQ ID NO: 5495486 - DNA, 15 bp, Homo sapiens
gggaggaggagctgc

SEQ ID NO: 5495487 - DNA, 13 bp, Homo sapiens
gggaggaggcagg

SEQ ID NO: 5495488 - DNA, 17 bp, Homo sapiens
gggaggagggagaggga

SEQ ID NO: 5495489 - DNA, 18 bp, Homo sapiens
gggaggagggagagggag

SEQ ID NO: 5495490 - DNA, 22 bp, Homo sapiens
gggaggagggccgagacaggag

SEQ ID NO: 5495491 - DNA, 18 bp, Homo sapiens
gggcaaacccttctcttc

SEQ ID NO: 5495492 - DNA, 14 bp, Homo sapiens
gggcaaagaaaaca

SEQ ID NO: 5495493 - DNA, 20 bp, Homo sapiens
gggcaaagccacaaggctgg

SEQ ID NO: 5495494 - DNA, 21 bp, Homo sapiens
gggcaaagccacaaggctggc

SEQ ID NO: 5495495 - DNA, 12 bp, Homo sapiens
gggcaaagccag

SEQ ID NO: 5495496 - DNA, 15 bp, Homo sapiens
gggcaaagctgctgg

SEQ ID NO: 5495497 - DNA, 23 bp, Homo sapiens
gggcaaagctgctgggccagtgg

SEQ ID NO: 5495498 - DNA, 13 bp, Homo sapiens
gggcaaagcttgt

SEQ ID NO: 5495499 - DNA, 13 bp, Homo sapiens
gggcaaaggcccc

SEQ ID NO: 5495500 - DNA, 22 bp, Homo sapiens
gggcaaatgacatgcactgacc

SEQ ID NO: 5495501 - DNA, 16 bp, Homo sapiens
gggcaaattggagaaa

SEQ ID NO: 5495502 - DNA, 20 bp, Homo sapiens
gggcaacactcactgcctgc

SEQ ID NO: 5495503 - DNA, 22 bp, Homo sapiens
gggcaacatagtgagaccctgt

SEQ ID NO: 5495504 - DNA, 16 bp, Homo sapiens
gggcaaccaataaaag

SEQ ID NO: 5495505 - DNA, 17 bp, Homo sapiens
gggcaacgaagaaaaaa

SEQ ID NO: 5495506 - DNA, 19 bp, Homo sapiens
gggcaacgattcacagcct

SEQ ID NO: 5495507 - DNA, 21 bp, Homo sapiens
gggcaagaacctaaagtagca

SEQ ID NO: 5495508 - DNA, 15 bp, Homo sapiens
gggcaagaagctgct

SEQ ID NO: 5495509 - DNA, 13 bp, Homo sapiens
gggcaagacctct

SEQ ID NO: 5495510 - DNA, 21 bp, Homo sapiens
gggcaagagagcgagaccctg

SEQ ID NO: 5495511 - DNA, 12 bp, Homo sapiens
gggcaagagatg

SEQ ID NO: 5495512 - DNA, 23 bp, Homo sapiens
gggcaagagctcaggagaaggcc

SEQ ID NO: 5495513 - DNA, 12 bp, Homo sapiens
gggcaagaggat

SEQ ID NO: 5495514 - DNA, 13 bp, Homo sapiens
gggcaagaggatg

SEQ ID NO: 5495515 - DNA, 12 bp, Homo sapiens
gggcaagaggga

SEQ ID NO: 5495516 - DNA, 12 bp, Homo sapiens
gggcaagaggtg

SEQ ID NO: 5495517 - DNA, 19 bp, Homo sapiens
gggcaagaggtgcctggga

SEQ ID NO: 5495518 - DNA, 20 bp, Homo sapiens
gggcaagaggtgcctgggag

SEQ ID NO: 5495519 - DNA, 22 bp, Homo sapiens
gggcaagaggtgcctgggagga

SEQ ID NO: 5495520 - DNA, 14 bp, Homo sapiens
gggcaagccagggc

SEQ ID NO: 5495521 - DNA, 20 bp, Homo sapiens
gggcaagccagggcccagag

SEQ ID NO: 5495522 - DNA, 21 bp, Homo sapiens
gggcaagccagggcccagagc

SEQ ID NO: 5495523 - DNA, 14 bp, Homo sapiens
gggcaagccctgcc

SEQ ID NO: 5495524 - DNA, 23 bp, Homo sapiens
gggcaagctaggccccagaggcc

SEQ ID NO: 5495525 - DNA, 13 bp, Homo sapiens
gggcaagctttgc

SEQ ID NO: 5495526 - DNA, 22 bp, Homo sapiens
gggcaaggaagctttggaagca

SEQ ID NO: 5495527 - DNA, 23 bp, Homo sapiens
gggcaaggaagctttggaagcag

SEQ ID NO: 5495528 - DNA, 20 bp, Homo sapiens
gggcaaggaatcctctggga

SEQ ID NO: 5495529 - DNA, 17 bp, Homo sapiens
gggcaaggccccttcca

SEQ ID NO: 5495530 - DNA, 20 bp, Homo sapiens
gggcaaggccccttccacgg

SEQ ID NO: 5495531 - DNA, 23 bp, Homo sapiens
gggcaagggctcctatctttcct

SEQ ID NO: 5495532 - DNA, 16 bp, Homo sapiens
gggcaaggggccagga

SEQ ID NO: 5495533 - DNA, 16 bp, Homo sapiens
gggcaagggtgcctca

SEQ ID NO: 5495534 - DNA, 20 bp, Homo sapiens
gggcaaggtgggggagcctg

SEQ ID NO: 5495535 - DNA, 23 bp, Homo sapiens
gggcaaggtgggggagcctggag

SEQ ID NO: 5495536 - DNA, 22 bp, Homo sapiens
gggcaataaatgccctctctga

SEQ ID NO: 5495537 - DNA, 15 bp, Homo sapiens
gggcaatctctctct

SEQ ID NO: 5495538 - DNA, 22 bp, Homo sapiens
gggcaatgccatcagcccctgg

SEQ ID NO: 5495539 - DNA, 19 bp, Homo sapiens
gggcaatggccaggggcca

SEQ ID NO: 5495540 - DNA, 19 bp, Homo sapiens
gggcaatggggagaggcaa

SEQ ID NO: 5495541 - DNA, 20 bp, Homo sapiens
gggcaattaattccttcagc

SEQ ID NO: 5495542 - DNA, 18 bp, Homo sapiens
gggcaatttagaaaaaga

SEQ ID NO: 5495543 - DNA, 21 bp, Homo sapiens
gggcacaaactgcagctgtga

SEQ ID NO: 5495544 - DNA, 16 bp, Homo sapiens
gggcacaagactgacg

SEQ ID NO: 5495545 - DNA, 15 bp, Homo sapiens
gggcacaagcagggc

SEQ ID NO: 5495546 - DNA, 11 bp, Homo sapiens
gggcacaccac

SEQ ID NO: 5495547 - DNA, 17 bp, Homo sapiens
gggcacaccactgccct

SEQ ID NO: 5495548 - DNA, 22 bp, Homo sapiens
gggcacaccactgccctgcctg

SEQ ID NO: 5495549 - DNA, 21 bp, Homo sapiens
gggcacacccctggggctgag

SEQ ID NO: 5495550 - DNA, 18 bp, Homo sapiens
gggcacaccgccatcctc

SEQ ID NO: 5495551 - DNA, 23 bp, Homo sapiens
gggcacaccgggcactcagaaga

SEQ ID NO: 5495552 - DNA, 16 bp, Homo sapiens
gggcacacgctgctct

SEQ ID NO: 5495553 - DNA, 19 bp, Homo sapiens
gggcacacgctgctctgcc

SEQ ID NO: 5495554 - DNA, 22 bp, Homo sapiens
gggcacacgctgctctgcccca

SEQ ID NO: 5495555 - DNA, 23 bp, Homo sapiens
gggcacacttccccttgggatgg

SEQ ID NO: 5495556 - DNA, 13 bp, Homo sapiens
gggcacagccagc

SEQ ID NO: 5495557 - DNA, 17 bp, Homo sapiens
gggcacagccagcccaa

SEQ ID NO: 5495558 - DNA, 14 bp, Homo sapiens
gggcacagcctagg

SEQ ID NO: 5495559 - DNA, 17 bp, Homo sapiens
gggcacagctgccctgc

SEQ ID NO: 5495560 - DNA, 22 bp, Homo sapiens
gggcacagctgctgtgccagga

SEQ ID NO: 5495561 - DNA, 12 bp, Homo sapiens
gggcacagctgg

SEQ ID NO: 5495562 - DNA, 15 bp, Homo sapiens
gggcacagctgtctg

SEQ ID NO: 5495563 - DNA, 16 bp, Homo sapiens
gggcacagctgtctgc

SEQ ID NO: 5495564 - DNA, 21 bp, Homo sapiens
gggcacagctgtctgccaggc

SEQ ID NO: 5495565 - DNA, 9 bp, Homo sapiens
gggcacagg

SEQ ID NO: 5495566 - DNA, 12 bp, Homo sapiens
gggcacaggagc

SEQ ID NO: 5495567 - DNA, 15 bp, Homo sapiens
gggcacaggagctac

SEQ ID NO: 5495568 - DNA, 18 bp, Homo sapiens
gggcacaggagctacctg

SEQ ID NO: 5495569 - DNA, 13 bp, Homo sapiens
gggcacaggctgc

SEQ ID NO: 5495570 - DNA, 13 bp, Homo sapiens
gggcacagggcac

SEQ ID NO: 5495571 - DNA, 15 bp, Homo sapiens
gggcacagggcacca

SEQ ID NO: 5495572 - DNA, 18 bp, Homo sapiens
gggcacagggcctggccc

SEQ ID NO: 5495573 - DNA, 20 bp, Homo sapiens
gggcacagggcctggcccat

SEQ ID NO: 5495574 - DNA, 16 bp, Homo sapiens
gggcacagggtctcta

SEQ ID NO: 5495575 - DNA, 15 bp, Homo sapiens
gggcacaggtcaggc

SEQ ID NO: 5495576 - DNA, 15 bp, Homo sapiens
gggcacagtccagga

SEQ ID NO: 5495577 - DNA, 16 bp, Homo sapiens
gggcacagtccaggaa

SEQ ID NO: 5495578 - DNA, 15 bp, Homo sapiens
gggcacagtgctgcc

SEQ ID NO: 5495579 - DNA, 18 bp, Homo sapiens
gggcacagtgctgcccct

SEQ ID NO: 5495580 - DNA, 21 bp, Homo sapiens
gggcacatagcataggctggg

SEQ ID NO: 5495581 - DNA, 14 bp, Homo sapiens
gggcacatgaggag

SEQ ID NO: 5495582 - DNA, 20 bp, Homo sapiens
gggcacatgaggagggtgcc

SEQ ID NO: 5495583 - DNA, 22 bp, Homo sapiens
gggcacatgctgagtctcccaa

SEQ ID NO: 5495584 - DNA, 20 bp, Homo sapiens
gggcacattaactccctcca

SEQ ID NO: 5495585 - DNA, 17 bp, Homo sapiens
gggcaccacaaaatata

SEQ ID NO: 5495586 - DNA, 22 bp, Homo sapiens
gggcaccacaaaatatacaaaa

SEQ ID NO: 5495587 - DNA, 17 bp, Homo sapiens
gggcaccacccccagtc

SEQ ID NO: 5495588 - DNA, 23 bp, Homo sapiens
gggcaccacccccagtcccccca

SEQ ID NO: 5495589 - DNA, 15 bp, Homo sapiens
gggcaccagaggccg

SEQ ID NO: 5495590 - DNA, 12 bp, Homo sapiens
gggcacccaccc

SEQ ID NO: 5495591 - DNA, 15 bp, Homo sapiens
gggcaccccaggcag

SEQ ID NO: 5495592 - DNA, 20 bp, Homo sapiens
gggcaccccaggcagctcct

SEQ ID NO: 5495593 - DNA, 21 bp, Homo sapiens
gggcaccccaggcagctcctg

SEQ ID NO: 5495594 - DNA, 20 bp, Homo sapiens
gggcacccccaaattcaaag

SEQ ID NO: 5495595 - DNA, 16 bp, Homo sapiens
gggcacccccagcctg

SEQ ID NO: 5495596 - DNA, 13 bp, Homo sapiens
gggcacccctgcc

SEQ ID NO: 5495597 - DNA, 14 bp, Homo sapiens
gggcacccctgcct

SEQ ID NO: 5495598 - DNA, 16 bp, Homo sapiens
gggcaccggctcagga

SEQ ID NO: 5495599 - DNA, 18 bp, Homo sapiens
gggcaccgggaccccctc

SEQ ID NO: 5495600 - DNA, 19 bp, Homo sapiens
gggcaccgtattcctctcc

SEQ ID NO: 5495601 - DNA, 22 bp, Homo sapiens
gggcaccgtattcctctcccag

SEQ ID NO: 5495602 - DNA, 18 bp, Homo sapiens
gggcaccgtgtcctcctc

SEQ ID NO: 5495603 - DNA, 22 bp, Homo sapiens
gggcacctatgagatggccatg

SEQ ID NO: 5495604 - DNA, 13 bp, Homo sapiens
gggcacctcagaa

SEQ ID NO: 5495605 - DNA, 11 bp, Homo sapiens
gggcacctgcc

SEQ ID NO: 5495606 - DNA, 19 bp, Homo sapiens
gggcacctgcgcacaggtg

SEQ ID NO: 5495607 - DNA, 12 bp, Homo sapiens
gggcacctggga

SEQ ID NO: 5495608 - DNA, 18 bp, Homo sapiens
gggcacgcctgcccagcc

SEQ ID NO: 5495609 - DNA, 17 bp, Homo sapiens
gggcacgctgtgggcag

SEQ ID NO: 5495610 - DNA, 20 bp, Homo sapiens
gggcacgggagagcgccacc

SEQ ID NO: 5495611 - DNA, 13 bp, Homo sapiens
gggcacgggcctg

SEQ ID NO: 5495612 - DNA, 20 bp, Homo sapiens
gggcacggtcacacggccac

SEQ ID NO: 5495613 - DNA, 21 bp, Homo sapiens
gggcacgtgtgggccgtggct

SEQ ID NO: 5495614 - DNA, 16 bp, Homo sapiens
gggcactagctagatg

SEQ ID NO: 5495615 - DNA, 23 bp, Homo sapiens
gggcactcagaagttgtgctaaa

SEQ ID NO: 5495616 - DNA, 12 bp, Homo sapiens
gggcactcagcc

SEQ ID NO: 5495617 - DNA, 17 bp, Homo sapiens
gggcactcccaaccctg

SEQ ID NO: 5495618 - DNA, 21 bp, Homo sapiens
gggcactcccgggatgggtgg

SEQ ID NO: 5495619 - DNA, 21 bp, Homo sapiens
gggcactccgcgccgatgcca

SEQ ID NO: 5495620 - DNA, 23 bp, Homo sapiens
gggcactccgcgccgatgccacc

SEQ ID NO: 5495621 - DNA, 14 bp, Homo sapiens
gggcactgaccagg

SEQ ID NO: 5495622 - DNA, 13 bp, Homo sapiens
gggcactgccagc

SEQ ID NO: 5495623 - DNA, 22 bp, Homo sapiens
gggcactgccagcccaccccct

SEQ ID NO: 5495624 - DNA, 21 bp, Homo sapiens
gggcactgctccaagggacag

SEQ ID NO: 5495625 - DNA, 14 bp, Homo sapiens
gggcactgctgggt

SEQ ID NO: 5495626 - DNA, 20 bp, Homo sapiens
gggcactgctgggtggccca

SEQ ID NO: 5495627 - DNA, 22 bp, Homo sapiens
gggcactgctgggtggcccatc

SEQ ID NO: 5495628 - DNA, 16 bp, Homo sapiens
gggcactggaaaacat

SEQ ID NO: 5495629 - DNA, 17 bp, Homo sapiens
gggcactggaaaacata

SEQ ID NO: 5495630 - DNA, 14 bp, Homo sapiens
gggcactggagctg

SEQ ID NO: 5495631 - DNA, 14 bp, Homo sapiens
gggcactggcccag

SEQ ID NO: 5495632 - DNA, 17 bp, Homo sapiens
gggcactggctgctctg

SEQ ID NO: 5495633 - DNA, 20 bp, Homo sapiens
gggcactggctgctctgtct

SEQ ID NO: 5495634 - DNA, 12 bp, Homo sapiens
gggcactgggca

SEQ ID NO: 5495635 - DNA, 14 bp, Homo sapiens
gggcactgggctgt

SEQ ID NO: 5495636 - DNA, 13 bp, Homo sapiens
gggcactggggcc

SEQ ID NO: 5495637 - DNA, 21 bp, Homo sapiens
gggcactgtcatgcccagctt

SEQ ID NO: 5495638 - DNA, 16 bp, Homo sapiens
gggcacttcacagagt

SEQ ID NO: 5495639 - DNA, 14 bp, Homo sapiens
gggcacttcaggtc

SEQ ID NO: 5495640 - DNA, 23 bp, Homo sapiens
gggcactttttaattcaccaaag

SEQ ID NO: 5495641 - DNA, 22 bp, Homo sapiens
gggcagaacactaacctgaccg

SEQ ID NO: 5495642 - DNA, 22 bp, Homo sapiens
gggcagaacagccgctcctgtc

SEQ ID NO: 5495643 - DNA, 21 bp, Homo sapiens
gggcagaagactagaggccag

SEQ ID NO: 5495644 - DNA, 22 bp, Homo sapiens
gggcagaagactagaggccagg

SEQ ID NO: 5495645 - DNA, 18 bp, Homo sapiens
gggcagaaggaagacttc

SEQ ID NO: 5495646 - DNA, 23 bp, Homo sapiens
gggcagaaggaggaagggactgg

SEQ ID NO: 5495647 - DNA, 14 bp, Homo sapiens
gggcagaagggaga

SEQ ID NO: 5495648 - DNA, 15 bp, Homo sapiens
gggcagaatcctggg

SEQ ID NO: 5495649 - DNA, 18 bp, Homo sapiens
gggcagaatcctgggccc

SEQ ID NO: 5495650 - DNA, 19 bp, Homo sapiens
gggcagaccagagagctca

SEQ ID NO: 5495651 - DNA, 20 bp, Homo sapiens
gggcagaccctgagcagaat

SEQ ID NO: 5495652 - DNA, 16 bp, Homo sapiens
gggcagagaccaccgc

SEQ ID NO: 5495653 - DNA, 18 bp, Homo sapiens
gggcagagaggctgtggt

SEQ ID NO: 5495654 - DNA, 18 bp, Homo sapiens
gggcagagccaccagggc

SEQ ID NO: 5495655 - DNA, 13 bp, Homo sapiens
gggcagagccagg

SEQ ID NO: 5495656 - DNA, 14 bp, Homo sapiens
gggcagagccagga

SEQ ID NO: 5495657 - DNA, 17 bp, Homo sapiens
gggcagagccatgggcc

SEQ ID NO: 5495658 - DNA, 12 bp, Homo sapiens
gggcagagccca

SEQ ID NO: 5495659 - DNA, 14 bp, Homo sapiens
gggcagagcccaag

SEQ ID NO: 5495660 - DNA, 21 bp, Homo sapiens
gggcagagcccccaggaagcc

SEQ ID NO: 5495661 - DNA, 16 bp, Homo sapiens
gggcagagctgagtcg

SEQ ID NO: 5495662 - DNA, 21 bp, Homo sapiens
gggcagagctgagtcggctgg

SEQ ID NO: 5495663 - DNA, 13 bp, Homo sapiens
gggcagagctggt

SEQ ID NO: 5495664 - DNA, 16 bp, Homo sapiens
gggcagagctggtgcg

SEQ ID NO: 5495665 - DNA, 20 bp, Homo sapiens
gggcagagcttgtagccctg

SEQ ID NO: 5495666 - DNA, 21 bp, Homo sapiens
gggcagagcttgtagccctgg

SEQ ID NO: 5495667 - DNA, 22 bp, Homo sapiens
gggcagagcttgtagccctgga

SEQ ID NO: 5495668 - DNA, 17 bp, Homo sapiens
gggcaggtgtttctttc

SEQ ID NO: 5495669 - DNA, 16 bp, Homo sapiens
gggcaggttcctgggg

SEQ ID NO: 5495670 - DNA, 22 bp, Homo sapiens
gggcaggttcctggggccgcct

SEQ ID NO: 5495671 - DNA, 15 bp, Homo sapiens
gggcagtacctgagg

SEQ ID NO: 5495672 - DNA, 17 bp, Homo sapiens
gggcagtacctgagggt

SEQ ID NO: 5495673 - DNA, 18 bp, Homo sapiens
gggcagtactcctccctg

SEQ ID NO: 5495674 - DNA, 21 bp, Homo sapiens
gggcagtactcctccctgggg

SEQ ID NO: 5495675 - DNA, 23 bp, Homo sapiens
gggcagtatgtgatggactgggg

SEQ ID NO: 5495676 - DNA, 17 bp, Homo sapiens
gggcagtcaccacccag

SEQ ID NO: 5495677 - DNA, 16 bp, Homo sapiens
gggcagtcagtggagg

SEQ ID NO: 5495678 - DNA, 20 bp, Homo sapiens
gggcagtccttactccccca

SEQ ID NO: 5495679 - DNA, 21 bp, Homo sapiens
gggcagtccttactcccccac

SEQ ID NO: 5495680 - DNA, 18 bp, Homo sapiens
gggcagtctgagagaggc

SEQ ID NO: 5495681 - DNA, 24 bp, Homo sapiens
gggcagtctgctctgctgctctga

SEQ ID NO: 5495682 - DNA, 15 bp, Homo sapiens
gggcagtctggaggg

SEQ ID NO: 5495683 - DNA, 21 bp, Homo sapiens
gggcagtctttcttgaaattg

SEQ ID NO: 5495684 - DNA, 19 bp, Homo sapiens
gggcagtgacgtgagtggg

SEQ ID NO: 5495685 - DNA, 20 bp, Homo sapiens
gggcagtgacgtgagtgggg

SEQ ID NO: 5495686 - DNA, 12 bp, Homo sapiens
gggcagtgactg

SEQ ID NO: 5495687 - DNA, 17 bp, Homo sapiens
gggcagtgactggcagg

SEQ ID NO: 5495688 - DNA, 18 bp, Homo sapiens
gggcagtgactggcaggt

SEQ ID NO: 5495689 - DNA, 16 bp, Homo sapiens
gggcagtgagtgccat

SEQ ID NO: 5495690 - DNA, 15 bp, Homo sapiens
gggcagtgccacagc

SEQ ID NO: 5495691 - DNA, 16 bp, Homo sapiens
gggcagtgccacagcc

SEQ ID NO: 5495692 - DNA, 17 bp, Homo sapiens
gggcagtgccacagcct

SEQ ID NO: 5495693 - DNA, 13 bp, Homo sapiens
gggcagtgccagc

SEQ ID NO: 5495694 - DNA, 17 bp, Homo sapiens
gggcagtgccagccaat

SEQ ID NO: 5495695 - DNA, 17 bp, Homo sapiens
gggcagtggacgtgctg

SEQ ID NO: 5495696 - DNA, 16 bp, Homo sapiens
gggcagtggagagggg

SEQ ID NO: 5495697 - DNA, 21 bp, Homo sapiens
gggcagtggaggctgctgtga

SEQ ID NO: 5495698 - DNA, 14 bp, Homo sapiens
gggcagtggaggtg

SEQ ID NO: 5495699 - DNA, 18 bp, Homo sapiens
gggcagtggcctggatgc

SEQ ID NO: 5495700 - DNA, 11 bp, Homo sapiens
gggcagtgggt

SEQ ID NO: 5495701 - DNA, 18 bp, Homo sapiens
gggcagtgggtcccagat

SEQ ID NO: 5495702 - DNA, 20 bp, Homo sapiens
gggcagtggtgtggagaagc

SEQ ID NO: 5495703 - DNA, 18 bp, Homo sapiens
gggcagttagagcagcct

SEQ ID NO: 5495704 - DNA, 21 bp, Homo sapiens
gggcagttcgcagccaccctg

SEQ ID NO: 5495705 - DNA, 22 bp, Homo sapiens
gggcagttcgcagccaccctga

SEQ ID NO: 5495706 - DNA, 13 bp, Homo sapiens
gggcagttctccc

SEQ ID NO: 5495707 - DNA, 19 bp, Homo sapiens
gggcagttctcccagggag

SEQ ID NO: 5495708 - DNA, 20 bp, Homo sapiens
gggcagttctcccagggagt

SEQ ID NO: 5495709 - DNA, 21 bp, Homo sapiens
gggcagttgtcgggcagtcct

SEQ ID NO: 5495710 - DNA, 17 bp, Homo sapiens
gggcagtttgggaaggt

SEQ ID NO: 5495711 - DNA, 22 bp, Homo sapiens
gggcatagaaactgaggagtag

SEQ ID NO: 5495712 - DNA, 22 bp, Homo sapiens
gggcatagatgcaggtgagccc

SEQ ID NO: 5495713 - DNA, 17 bp, Homo sapiens
gggcataggctgcccaa

SEQ ID NO: 5495714 - DNA, 23 bp, Homo sapiens
gggcatatcggctcacaaagaga

SEQ ID NO: 5495715 - DNA, 21 bp, Homo sapiens
gggcatcagctttccctggct

SEQ ID NO: 5495716 - DNA, 12 bp, Homo sapiens
gggcatcaggca

SEQ ID NO: 5495717 - DNA, 14 bp, Homo sapiens
gggcatcatgggca

SEQ ID NO: 5495718 - DNA, 17 bp, Homo sapiens
gggcatccacccagtgc

SEQ ID NO: 5495719 - DNA, 14 bp, Homo sapiens
gggcatcccagctt

SEQ ID NO: 5495720 - DNA, 16 bp, Homo sapiens
gggcatccccagcccc

SEQ ID NO: 5495721 - DNA, 14 bp, Homo sapiens
gggcatcctgcttc

SEQ ID NO: 5495722 - DNA, 19 bp, Homo sapiens
gggcatcctgcttcctgaa

SEQ ID NO: 5495723 - DNA, 15 bp, Homo sapiens
gggcatcctggatga

SEQ ID NO: 5495724 - DNA, 23 bp, Homo sapiens
gggcatcctggatgatttcatct

SEQ ID NO: 5495725 - DNA, 18 bp, Homo sapiens
gggcatctcaatggcatg

SEQ ID NO: 5495726 - DNA, 13 bp, Homo sapiens
gggcatctctgag

SEQ ID NO: 5495727 - DNA, 15 bp, Homo sapiens
gggcatctctgggct

SEQ ID NO: 5495728 - DNA, 22 bp, Homo sapiens
gggcatctctgggctggatgag

SEQ ID NO: 5495729 - DNA, 14 bp, Homo sapiens
gggcatctgcccct

SEQ ID NO: 5495730 - DNA, 19 bp, Homo sapiens
gggcatctgcccctccccc

SEQ ID NO: 5495731 - DNA, 22 bp, Homo sapiens
gggcatctggccctgctgcccc

SEQ ID NO: 5495732 - DNA, 22 bp, Homo sapiens
gggcatctgtctgtctgtgggc

SEQ ID NO: 5495733 - DNA, 17 bp, Homo sapiens
gggcatcttctggcttg

SEQ ID NO: 5495734 - DNA, 15 bp, Homo sapiens
gggcatgagtctgtt

SEQ ID NO: 5495735 - DNA, 22 bp, Homo sapiens
gggcatgagtctgtttcccaag

SEQ ID NO: 5495736 - DNA, 20 bp, Homo sapiens
gggcatgatgggccgagcca

SEQ ID NO: 5495737 - DNA, 19 bp, Homo sapiens
gggcatgccaccctcacac

SEQ ID NO: 5495738 - DNA, 19 bp, Homo sapiens
gggcatgccatgtctgagc

SEQ ID NO: 5495739 - DNA, 22 bp, Homo sapiens
gggcatgccccggccacctctg

SEQ ID NO: 5495740 - DNA, 23 bp, Homo sapiens
gggcatgccccggccacctctgc

SEQ ID NO: 5495741 - DNA, 17 bp, Homo sapiens
gggcatgcctggcctga

SEQ ID NO: 5495742 - DNA, 19 bp, Homo sapiens
gggcatggactaccagatg

SEQ ID NO: 5495743 - DNA, 17 bp, Homo sapiens
gggcatggccaggtggc

SEQ ID NO: 5495744 - DNA, 20 bp, Homo sapiens
gggcatggccaggtggccac

SEQ ID NO: 5495745 - DNA, 21 bp, Homo sapiens
gggcatggccgcttctagagc

SEQ ID NO: 5495746 - DNA, 14 bp, Homo sapiens
gggcatggcgtgga

SEQ ID NO: 5495747 - DNA, 16 bp, Homo sapiens
gggcatgggcctctct

SEQ ID NO: 5495748 - DNA, 18 bp, Homo sapiens
gggcatgggcctctctgg

SEQ ID NO: 5495749 - DNA, 15 bp, Homo sapiens
gggcatgggggaggc

SEQ ID NO: 5495750 - DNA, 16 bp, Homo sapiens
gggcatgggggaggct

SEQ ID NO: 5495751 - DNA, 15 bp, Homo sapiens
gggcatggggtgggc

SEQ ID NO: 5495752 - DNA, 18 bp, Homo sapiens
gggcatgggtccagggcc

SEQ ID NO: 5495753 - DNA, 17 bp, Homo sapiens
gggcatgggtcgggaga

SEQ ID NO: 5495754 - DNA, 16 bp, Homo sapiens
gggcatgggtggaggg

SEQ ID NO: 5495755 - DNA, 20 bp, Homo sapiens
gggcatgggttggcagggtg

SEQ ID NO: 5495756 - DNA, 18 bp, Homo sapiens
gggcatggtaccagccct

SEQ ID NO: 5495757 - DNA, 21 bp, Homo sapiens
gggcatggtgttctcctgctg

SEQ ID NO: 5495758 - DNA, 22 bp, Homo sapiens
gggcatggttccttccctggga

SEQ ID NO: 5495759 - DNA, 22 bp, Homo sapiens
gggcatgtattggcctggaggt

SEQ ID NO: 5495760 - DNA, 16 bp, Homo sapiens
gggcatgtcctttcca

SEQ ID NO: 5495761 - DNA, 17 bp, Homo sapiens
gggcatgtctgcctgga

SEQ ID NO: 5495762 - DNA, 16 bp, Homo sapiens
gggcatgtgtgcctgt

SEQ ID NO: 5495763 - DNA, 23 bp, Homo sapiens
gggcatgtgtgcctgtggcagaa

SEQ ID NO: 5495764 - DNA, 15 bp, Homo sapiens
gggcattaaaaatag

SEQ ID NO: 5495765 - DNA, 16 bp, Homo sapiens
gggcattagcaaggca

SEQ ID NO: 5495766 - DNA, 19 bp, Homo sapiens
gggcattagtgtcccccct

SEQ ID NO: 5495767 - DNA, 14 bp, Homo sapiens
gggcattcgggcca

SEQ ID NO: 5495768 - DNA, 17 bp, Homo sapiens
gggcattctgttggcct

SEQ ID NO: 5495769 - DNA, 18 bp, Homo sapiens
gggcattgagaatggagg

SEQ ID NO: 5495770 - DNA, 15 bp, Homo sapiens
gggcattgagcaagc

SEQ ID NO: 5495771 - DNA, 14 bp, Homo sapiens
gggcattgcagcct

SEQ ID NO: 5495772 - DNA, 23 bp, Homo sapiens
gggcattgggctgacacctacca

SEQ ID NO: 5495773 - DNA, 21 bp, Homo sapiens
gggcatttcttgcgagcctcg

SEQ ID NO: 5495774 - DNA, 21 bp, Homo sapiens
gggcatttggcttcctctgct

SEQ ID NO: 5495775 - DNA, 15 bp, Homo sapiens
gggcatttggtgaga

SEQ ID NO: 5495776 - DNA, 21 bp, Homo sapiens
gggcattttcctcctctgcct

SEQ ID NO: 5495777 - DNA, 16 bp, Homo sapiens
gggcattttgacaaca

SEQ ID NO: 5495778 - DNA, 19 bp, Homo sapiens
gggcattttgacaacatgg

SEQ ID NO: 5495779 - DNA, 17 bp, Homo sapiens
gggccaaaaggaaaaag

SEQ ID NO: 5495780 - DNA, 14 bp, Homo sapiens
gggccaaaagggca

SEQ ID NO: 5495781 - DNA, 16 bp, Homo sapiens
gggccaaaagggcagc

SEQ ID NO: 5495782 - DNA, 23 bp, Homo sapiens
gggccaaaagggcagccaggggc

SEQ ID NO: 5495783 - DNA, 15 bp, Homo sapiens
gggccaaacgctgag

SEQ ID NO: 5495784 - DNA, 17 bp, Homo sapiens
gggccaaacgctgagcc

SEQ ID NO: 5495785 - DNA, 18 bp, Homo sapiens
gggccaaacgctgagcca

SEQ ID NO: 5495786 - DNA, 18 bp, Homo sapiens
gggccaacctcaggctcc

SEQ ID NO: 5495787 - DNA, 19 bp, Homo sapiens
gggccaactcacccttggc

SEQ ID NO: 5495788 - DNA, 17 bp, Homo sapiens
gggccaagacttggcaa

SEQ ID NO: 5495789 - DNA, 23 bp, Homo sapiens
gggccaagagatctgtgtggctc

SEQ ID NO: 5495790 - DNA, 12 bp, Homo sapiens
gggccaagagga

SEQ ID NO: 5495791 - DNA, 19 bp, Homo sapiens
gggccaagaggaaaaacag

SEQ ID NO: 5495792 - DNA, 23 bp, Homo sapiens
gggccaagaggaaaaacagggaa

SEQ ID NO: 5495793 - DNA, 18 bp, Homo sapiens
gggccaagccagggatgg

SEQ ID NO: 5495794 - DNA, 20 bp, Homo sapiens
gggccaagccagggttccag

SEQ ID NO: 5495795 - DNA, 24 bp, Homo sapiens
gggccaagccagggttccagacag

SEQ ID NO: 5495796 - DNA, 13 bp, Homo sapiens
gggccaaggacct

SEQ ID NO: 5495797 - DNA, 13 bp, Homo sapiens
gggccaaggactc

SEQ ID NO: 5495798 - DNA, 21 bp, Homo sapiens
gggccaattaaaatatatata

SEQ ID NO: 5495799 - DNA, 23 bp, Homo sapiens
gggccacacctgagcgctgtgga

SEQ ID NO: 5495800 - DNA, 14 bp, Homo sapiens
gggccacagccaga

SEQ ID NO: 5495801 - DNA, 11 bp, Homo sapiens
gggccacaggg

SEQ ID NO: 5495802 - DNA, 19 bp, Homo sapiens
gggccacagggcgagactc

SEQ ID NO: 5495803 - DNA, 22 bp, Homo sapiens
gggccacagggcggtgctagct

SEQ ID NO: 5495804 - DNA, 18 bp, Homo sapiens
gggccacatttcacctcc

SEQ ID NO: 5495805 - DNA, 12 bp, Homo sapiens
gggccaccacct

SEQ ID NO: 5495806 - DNA, 14 bp, Homo sapiens
gggccaccatccct

SEQ ID NO: 5495807 - DNA, 19 bp, Homo sapiens
gggccacccaccagggctc

SEQ ID NO: 5495808 - DNA, 22 bp, Homo sapiens
gggccacccaccagggctcagc

SEQ ID NO: 5495809 - DNA, 17 bp, Homo sapiens
gggccaccccactctac

SEQ ID NO: 5495810 - DNA, 19 bp, Homo sapiens
gggccaccccgtgcccctg

SEQ ID NO: 5495811 - DNA, 13 bp, Homo sapiens
gggccacccctcc

SEQ ID NO: 5495812 - DNA, 12 bp, Homo sapiens
gggccaccctga

SEQ ID NO: 5495813 - DNA, 16 bp, Homo sapiens
gggccaccctgagcag

SEQ ID NO: 5495814 - DNA, 19 bp, Homo sapiens
gggccaccctgctgcacta

SEQ ID NO: 5495815 - DNA, 22 bp, Homo sapiens
gggccacccttcacgctggctt

SEQ ID NO: 5495816 - DNA, 23 bp, Homo sapiens
gggccacccttcacgctggcttc

SEQ ID NO: 5495817 - DNA, 19 bp, Homo sapiens
gggccaccgccttgcccag

SEQ ID NO: 5495818 - DNA, 11 bp, Homo sapiens
gggccacctcc

SEQ ID NO: 5495819 - DNA, 17 bp, Homo sapiens
gggccacctccccaggc

SEQ ID NO: 5495820 - DNA, 16 bp, Homo sapiens
gggccacctcctcccc

SEQ ID NO: 5495821 - DNA, 13 bp, Homo sapiens
gggccacctgcct

SEQ ID NO: 5495822 - DNA, 14 bp, Homo sapiens
gggccacctgcctg

SEQ ID NO: 5495823 - DNA, 23 bp, Homo sapiens
gggccacgcaggggccctgagcc

SEQ ID NO: 5495824 - DNA, 15 bp, Homo sapiens
gggccacgccccagc

SEQ ID NO: 5495825 - DNA, 15 bp, Homo sapiens
gggccacggctgagc

SEQ ID NO: 5495826 - DNA, 18 bp, Homo sapiens
gggccacgtggatgggca

SEQ ID NO: 5495827 - DNA, 23 bp, Homo sapiens
gggccactcaccgacccgacact

SEQ ID NO: 5495828 - DNA, 17 bp, Homo sapiens
gggccactccttcctgc

SEQ ID NO: 5495829 - DNA, 17 bp, Homo sapiens
gggccactctcccctcc

SEQ ID NO: 5495830 - DNA, 23 bp, Homo sapiens
gggccactgacccacctgcgctt

SEQ ID NO: 5495831 - DNA, 19 bp, Homo sapiens
gggccactgccctctccac

SEQ ID NO: 5495832 - DNA, 13 bp, Homo sapiens
gggccactggcat

SEQ ID NO: 5495833 - DNA, 21 bp, Homo sapiens
gggccactggcatctctggag

SEQ ID NO: 5495834 - DNA, 20 bp, Homo sapiens
gggccactgggccccattct

SEQ ID NO: 5495835 - DNA, 22 bp, Homo sapiens
gggccacttctgggtggggcag

SEQ ID NO: 5495836 - DNA, 21 bp, Homo sapiens
gggccagaaggagggcagagc

SEQ ID NO: 5495837 - DNA, 12 bp, Homo sapiens
gggccagacaca

SEQ ID NO: 5495838 - DNA, 16 bp, Homo sapiens
gggccagactggctgc

SEQ ID NO: 5495839 - DNA, 22 bp, Homo sapiens
gggccagactggctgcacagcc

SEQ ID NO: 5495840 - DNA, 21 bp, Homo sapiens
gggccagagagcaggggagct

SEQ ID NO: 5495841 - DNA, 11 bp, Homo sapiens
gggccagagca

SEQ ID NO: 5495842 - DNA, 16 bp, Homo sapiens
gggccagagctagggc

SEQ ID NO: 5495843 - DNA, 22 bp, Homo sapiens
gggccagagctagggctgctgc

SEQ ID NO: 5495844 - DNA, 13 bp, Homo sapiens
gggccccaaagcc

SEQ ID NO: 5495845 - DNA, 17 bp, Homo sapiens
gggccccaaagcccagc

SEQ ID NO: 5495846 - DNA, 22 bp, Homo sapiens
gggccccacctacttgtgactg

SEQ ID NO: 5495847 - DNA, 14 bp, Homo sapiens
gggccccacgtccc

SEQ ID NO: 5495848 - DNA, 17 bp, Homo sapiens
gggccccacgtccctgc

SEQ ID NO: 5495849 - DNA, 14 bp, Homo sapiens
gggccccagatctg

SEQ ID NO: 5495850 - DNA, 18 bp, Homo sapiens
gggccccagatctgcctg

SEQ ID NO: 5495851 - DNA, 14 bp, Homo sapiens
gggccccagccgtg

SEQ ID NO: 5495852 - DNA, 24 bp, Homo sapiens
gggccccagcgtctgcagggtgac

SEQ ID NO: 5495853 - DNA, 17 bp, Homo sapiens
gggccccaggggcagca

SEQ ID NO: 5495854 - DNA, 22 bp, Homo sapiens
gggccccatcctcatccctgac

SEQ ID NO: 5495855 - DNA, 17 bp, Homo sapiens
gggccccatggtcacag

SEQ ID NO: 5495856 - DNA, 18 bp, Homo sapiens
gggcccccaataaaccag

SEQ ID NO: 5495857 - DNA, 21 bp, Homo sapiens
gggcccccaataaaccagtgt

SEQ ID NO: 5495858 - DNA, 12 bp, Homo sapiens
gggcccccacag

SEQ ID NO: 5495859 - DNA, 15 bp, Homo sapiens
gggcccccacaggag

SEQ ID NO: 5495860 - DNA, 13 bp, Homo sapiens
gggcccccagaga

SEQ ID NO: 5495861 - DNA, 20 bp, Homo sapiens
gggcccccagagacctttgc

SEQ ID NO: 5495862 - DNA, 13 bp, Homo sapiens
gggcccccagcac

SEQ ID NO: 5495863 - DNA, 15 bp, Homo sapiens
gggcccccagcaccc

SEQ ID NO: 5495864 - DNA, 22 bp, Homo sapiens
gggcccccatccctccccttgc

SEQ ID NO: 5495865 - DNA, 14 bp, Homo sapiens
gggccccccacacg

SEQ ID NO: 5495866 - DNA, 19 bp, Homo sapiens
gggcccccctccccccact

SEQ ID NO: 5495867 - DNA, 20 bp, Homo sapiens
gggcccccctccccccactt

SEQ ID NO: 5495868 - DNA, 17 bp, Homo sapiens
gggcccccctgccctgt

SEQ ID NO: 5495869 - DNA, 15 bp, Homo sapiens
gggcccccgccccgc

SEQ ID NO: 5495870 - DNA, 13 bp, Homo sapiens
gggccccctggga

SEQ ID NO: 5495871 - DNA, 15 bp, Homo sapiens
gggccccctggtcac

SEQ ID NO: 5495872 - DNA, 16 bp, Homo sapiens
gggccccgccagggct

SEQ ID NO: 5495873 - DNA, 20 bp, Homo sapiens
gggccccgccagggctgggg

SEQ ID NO: 5495874 - DNA, 21 bp, Homo sapiens
gggccccgccagggctgggga

SEQ ID NO: 5495875 - DNA, 15 bp, Homo sapiens
gggccccgggctgga

SEQ ID NO: 5495876 - DNA, 15 bp, Homo sapiens
gggccccggggctgg

SEQ ID NO: 5495877 - DNA, 18 bp, Homo sapiens
gggccccggggctggcaa

SEQ ID NO: 5495878 - DNA, 19 bp, Homo sapiens
gggcccctcaccctgcctt

SEQ ID NO: 5495879 - DNA, 14 bp, Homo sapiens
gggcccctcactgg

SEQ ID NO: 5495880 - DNA, 18 bp, Homo sapiens
gggcccctcactggctgg

SEQ ID NO: 5495881 - DNA, 21 bp, Homo sapiens
gggcccctcatcgcgtcctcc

SEQ ID NO: 5495882 - DNA, 17 bp, Homo sapiens
gggcccctccacgcctc

SEQ ID NO: 5495883 - DNA, 14 bp, Homo sapiens
gggcccctccagct

SEQ ID NO: 5495884 - DNA, 15 bp, Homo sapiens
gggcccctccagctt

SEQ ID NO: 5495885 - DNA, 14 bp, Homo sapiens
gggcccctccatcc

SEQ ID NO: 5495886 - DNA, 16 bp, Homo sapiens
gggcccctcccctcag

SEQ ID NO: 5495887 - DNA, 17 bp, Homo sapiens
gggcccctcccctcaga

SEQ ID NO: 5495888 - DNA, 21 bp, Homo sapiens
gggcccctcccctcagagccc

SEQ ID NO: 5495889 - DNA, 20 bp, Homo sapiens
gggcccctccctacctcaac

SEQ ID NO: 5495890 - DNA, 20 bp, Homo sapiens
gggcccctccctctgcccca

SEQ ID NO: 5495891 - DNA, 15 bp, Homo sapiens
gggcccctcctccag

SEQ ID NO: 5495892 - DNA, 18 bp, Homo sapiens
gggcccctcctctgtgct

SEQ ID NO: 5495893 - DNA, 20 bp, Homo sapiens
gggcccctcctctgtgctcc

SEQ ID NO: 5495894 - DNA, 15 bp, Homo sapiens
gggcccctcggctac

SEQ ID NO: 5495895 - DNA, 14 bp, Homo sapiens
gggcccctctcagc

SEQ ID NO: 5495896 - DNA, 16 bp, Homo sapiens
gggcccctctcagccc

SEQ ID NO: 5495897 - DNA, 12 bp, Homo sapiens
gggcccctctcc

SEQ ID NO: 5495898 - DNA, 15 bp, Homo sapiens
gggcccctctctagg

SEQ ID NO: 5495899 - DNA, 19 bp, Homo sapiens
gggcccctctctagggacc

SEQ ID NO: 5495900 - DNA, 12 bp, Homo sapiens
gggcccctctgc

SEQ ID NO: 5495901 - DNA, 22 bp, Homo sapiens
gggcccctcttattcctctagg

SEQ ID NO: 5495902 - DNA, 13 bp, Homo sapiens
gggcccctgccag

SEQ ID NO: 5495903 - DNA, 13 bp, Homo sapiens
gggcccctgcctc

SEQ ID NO: 5495904 - DNA, 22 bp, Homo sapiens
gggcccctgcctctctgcaggt

SEQ ID NO: 5495905 - DNA, 11 bp, Homo sapiens
gggcccctgcg

SEQ ID NO: 5495906 - DNA, 13 bp, Homo sapiens
gggcccctgcgtg

SEQ ID NO: 5495907 - DNA, 17 bp, Homo sapiens
gggcccctgctccgagg

SEQ ID NO: 5495908 - DNA, 15 bp, Homo sapiens
gggcccctggcactc

SEQ ID NO: 5495909 - DNA, 17 bp, Homo sapiens
gggcccctggcccagga

SEQ ID NO: 5495910 - DNA, 23 bp, Homo sapiens
gggcccctgggcttggcctgctg

SEQ ID NO: 5495911 - DNA, 12 bp, Homo sapiens
gggcccctgggg

SEQ ID NO: 5495912 - DNA, 13 bp, Homo sapiens
gggcccctggtga

SEQ ID NO: 5495913 - DNA, 16 bp, Homo sapiens
gggccccttgagaatg

SEQ ID NO: 5495914 - DNA, 22 bp, Homo sapiens
gggccccttgctgatgctcctc

SEQ ID NO: 5495915 - DNA, 21 bp, Homo sapiens
gggccccttggcgggcagccc

SEQ ID NO: 5495916 - DNA, 18 bp, Homo sapiens
gggcccctttttactccc

SEQ ID NO: 5495917 - DNA, 18 bp, Homo sapiens
gggcccgaacagggactt

SEQ ID NO: 5495918 - DNA, 15 bp, Homo sapiens
gggcccgacaggtgg

SEQ ID NO: 5495919 - DNA, 19 bp, Homo sapiens
gggcccgcagtgctgggac

SEQ ID NO: 5495920 - DNA, 21 bp, Homo sapiens
gggcccgcagtgctgggacca

SEQ ID NO: 5495921 - DNA, 23 bp, Homo sapiens
gggcccgcctgccacctctccca

SEQ ID NO: 5495922 - DNA, 20 bp, Homo sapiens
gggcccgctcaacctctcag

SEQ ID NO: 5495923 - DNA, 14 bp, Homo sapiens
gggcccgcttgcct

SEQ ID NO: 5495924 - DNA, 17 bp, Homo sapiens
gggcccgctttgcctgc

SEQ ID NO: 5495925 - DNA, 12 bp, Homo sapiens
gggcccggacgc

SEQ ID NO: 5495926 - DNA, 15 bp, Homo sapiens
gggcccggctgggcc

SEQ ID NO: 5495927 - DNA, 18 bp, Homo sapiens
gggcccggtggcggcagg

SEQ ID NO: 5495928 - DNA, 17 bp, Homo sapiens
gggcccgttgaggatga

SEQ ID NO: 5495929 - DNA, 20 bp, Homo sapiens
gggcccgttgtctccctggc

SEQ ID NO: 5495930 - DNA, 16 bp, Homo sapiens
gggccctaccctcctg

SEQ ID NO: 5495931 - DNA, 15 bp, Homo sapiens
gggccctacctgggg

SEQ ID NO: 5495932 - DNA, 17 bp, Homo sapiens
gggccctcactcaggaa

SEQ ID NO: 5495933 - DNA, 14 bp, Homo sapiens
gggccctcaggcca

SEQ ID NO: 5495934 - DNA, 19 bp, Homo sapiens
gggccctccatgcgcagat

SEQ ID NO: 5495935 - DNA, 21 bp, Homo sapiens
gggccctccgaccacttccag

SEQ ID NO: 5495936 - DNA, 23 bp, Homo sapiens
gggccctcctgaaacttacacac

SEQ ID NO: 5495937 - DNA, 22 bp, Homo sapiens
gggccctctctgcaccggacag

SEQ ID NO: 5495938 - DNA, 16 bp, Homo sapiens
gggccctctctgctct

SEQ ID NO: 5495939 - DNA, 13 bp, Homo sapiens
gggccctctgagc

SEQ ID NO: 5495940 - DNA, 12 bp, Homo sapiens
gggccctctgcc

SEQ ID NO: 5495941 - DNA, 14 bp, Homo sapiens
gggccctctgccga

SEQ ID NO: 5495942 - DNA, 14 bp, Homo sapiens
gggccctcttgcca

SEQ ID NO: 5495943 - DNA, 15 bp, Homo sapiens
gggccctcttgccag

SEQ ID NO: 5495944 - DNA, 16 bp, Homo sapiens
gggccctcttgccagc

SEQ ID NO: 5495945 - DNA, 18 bp, Homo sapiens
gggccctcttgccagcct

SEQ ID NO: 5495946 - DNA, 21 bp, Homo sapiens
gggccctcttgccagcctcct

SEQ ID NO: 5495947 - DNA, 18 bp, Homo sapiens
gggccctgaaatggcctg

SEQ ID NO: 5495948 - DNA, 12 bp, Homo sapiens
gggccctgagcc

SEQ ID NO: 5495949 - DNA, 12 bp, Homo sapiens
gggccctgagct

SEQ ID NO: 5495950 - DNA, 18 bp, Homo sapiens
gggccctgagctgagggc

SEQ ID NO: 5495951 - DNA, 12 bp, Homo sapiens
gggccctgagga

SEQ ID NO: 5495952 - DNA, 18 bp, Homo sapiens
gggccctgcacctgtgca

SEQ ID NO: 5495953 - DNA, 15 bp, Homo sapiens
gggccctgcagaggg

SEQ ID NO: 5495954 - DNA, 15 bp, Homo sapiens
gggccctgcaggagg

SEQ ID NO: 5495955 - DNA, 16 bp, Homo sapiens
gggccctgcaggaggc

SEQ ID NO: 5495956 - DNA, 20 bp, Homo sapiens
gggccctgcaggaggcctgg

SEQ ID NO: 5495957 - DNA, 18 bp, Homo sapiens
gggccctgcaggctgcag

SEQ ID NO: 5495958 - DNA, 22 bp, Homo sapiens
gggccctgcaggctgcaggagg

SEQ ID NO: 5495959 - DNA, 18 bp, Homo sapiens
gggccctgcatgtagtgt

SEQ ID NO: 5495960 - DNA, 23 bp, Homo sapiens
gggccctgcattggcctggcctc

SEQ ID NO: 5495961 - DNA, 13 bp, Homo sapiens
gggccctgcccca

SEQ ID NO: 5495962 - DNA, 21 bp, Homo sapiens
gggccctgccccaccccatcc

SEQ ID NO: 5495963 - DNA, 19 bp, Homo sapiens
gggccctgccccagcccct

SEQ ID NO: 5495964 - DNA, 20 bp, Homo sapiens
gggccctgccccagccccta

SEQ ID NO: 5495965 - DNA, 15 bp, Homo sapiens
gggccctgccccagg

SEQ ID NO: 5495966 - DNA, 18 bp, Homo sapiens
gggccctgccccaggcct

SEQ ID NO: 5495967 - DNA, 22 bp, Homo sapiens
gggccctgccccaggcctggac

SEQ ID NO: 5495968 - DNA, 23 bp, Homo sapiens
gggccctgcccggggagctgcag

SEQ ID NO: 5495969 - DNA, 19 bp, Homo sapiens
gggccctgcctgagggtgg

SEQ ID NO: 5495970 - DNA, 19 bp, Homo sapiens
gggccctgcctgcagccag

SEQ ID NO: 5495971 - DNA, 22 bp, Homo sapiens
gggccctgcctgcagccagggc

SEQ ID NO: 5495972 - DNA, 24 bp, Homo sapiens
gggccctgcctgcagccagggctg

SEQ ID NO: 5495973 - DNA, 11 bp, Homo sapiens
gggccctggcc

SEQ ID NO: 5495974 - DNA, 12 bp, Homo sapiens
gggccctggcca

SEQ ID NO: 5495975 - DNA, 14 bp, Homo sapiens
gggccctggccagc

SEQ ID NO: 5495976 - DNA, 21 bp, Homo sapiens
gggccctggcttccctgccct

SEQ ID NO: 5495977 - DNA, 14 bp, Homo sapiens
gggccctgggcctc

SEQ ID NO: 5495978 - DNA, 17 bp, Homo sapiens
gggccctgggcctgcct

SEQ ID NO: 5495979 - DNA, 15 bp, Homo sapiens
gggccctgggctgga

SEQ ID NO: 5495980 - DNA, 11 bp, Homo sapiens
gggccctgggg

SEQ ID NO: 5495981 - DNA, 12 bp, Homo sapiens
gggccctggggc

SEQ ID NO: 5495982 - DNA, 23 bp, Homo sapiens
gggccctggggtctctgagcagt

SEQ ID NO: 5495983 - DNA, 13 bp, Homo sapiens
gggccctgtcact

SEQ ID NO: 5495984 - DNA, 22 bp, Homo sapiens
gggccctgtcactgtccagagt

SEQ ID NO: 5495985 - DNA, 14 bp, Homo sapiens
gggccctgtccagg

SEQ ID NO: 5495986 - DNA, 18 bp, Homo sapiens
gggccctgtggtgctggg

SEQ ID NO: 5495987 - DNA, 20 bp, Homo sapiens
gggcccttcccaacctcccc

SEQ ID NO: 5495988 - DNA, 22 bp, Homo sapiens
gggcccttcctggctaggactg

SEQ ID NO: 5495989 - DNA, 24 bp, Homo sapiens
gggcccttcctggctaggactgtg

SEQ ID NO: 5495990 - DNA, 22 bp, Homo sapiens
gggcccttcttgctgccctgcc

SEQ ID NO: 5495991 - DNA, 17 bp, Homo sapiens
gggcccttggagcgtgg

SEQ ID NO: 5495992 - DNA, 17 bp, Homo sapiens
gggcccttggggcctgg

SEQ ID NO: 5495993 - DNA, 18 bp, Homo sapiens
gggcccttggggctgggg

SEQ ID NO: 5495994 - DNA, 22 bp, Homo sapiens
gggcccttgtgctcctctcgca

SEQ ID NO: 5495995 - DNA, 19 bp, Homo sapiens
gggccctttttcaataact

SEQ ID NO: 5495996 - DNA, 18 bp, Homo sapiens
gggccgaatcccccaggg

SEQ ID NO: 5495997 - DNA, 18 bp, Homo sapiens
gggccgaatcccctccct

SEQ ID NO: 5495998 - DNA, 16 bp, Homo sapiens
gggccgaccctgcggc

SEQ ID NO: 5495999 - DNA, 22 bp, Homo sapiens
gggccgaggaatgtgaagccag

SEQ ID NO: 5496000 - DNA, 12 bp, Homo sapiens
gggccgaggagg

SEQ ID NO: 5496001 - DNA, 19 bp, Homo sapiens
gggccgaggcccagcgggc

SEQ ID NO: 5496002 - DNA, 20 bp, Homo sapiens
gggccgaggcccagcgggca

SEQ ID NO: 5496003 - DNA, 16 bp, Homo sapiens
gggccgcaagggcctg

SEQ ID NO: 5496004 - DNA, 14 bp, Homo sapiens
gggccgcaggaggg

SEQ ID NO: 5496005 - DNA, 13 bp, Homo sapiens
gggccgcagggcc

SEQ ID NO: 5496006 - DNA, 14 bp, Homo sapiens
gggccgcagggccc

SEQ ID NO: 5496007 - DNA, 15 bp, Homo sapiens
gggccgcagggccca

SEQ ID NO: 5496008 - DNA, 16 bp, Homo sapiens
gggccgcagggcgctc

SEQ ID NO: 5496009 - DNA, 14 bp, Homo sapiens
gggccgccacggcc

SEQ ID NO: 5496010 - DNA, 19 bp, Homo sapiens
gggccgccacggcctggct

SEQ ID NO: 5496011 - DNA, 14 bp, Homo sapiens
gggccgccagggag

SEQ ID NO: 5496012 - DNA, 14 bp, Homo sapiens
gggccgcccgctcc

SEQ ID NO: 5496013 - DNA, 20 bp, Homo sapiens
gggccgcccgggcccagagg

SEQ ID NO: 5496014 - DNA, 22 bp, Homo sapiens
gggccgccgaagggcagccccg

SEQ ID NO: 5496015 - DNA, 23 bp, Homo sapiens
gggccgccgaagggcagccccgc

SEQ ID NO: 5496016 - DNA, 17 bp, Homo sapiens
gggccgccgcctctttc

SEQ ID NO: 5496017 - DNA, 23 bp, Homo sapiens
gggccgccgctgaccctgggcct

SEQ ID NO: 5496018 - DNA, 13 bp, Homo sapiens
gggccgcctcctc

SEQ ID NO: 5496019 - DNA, 17 bp, Homo sapiens
gggccgcctcctccaga

SEQ ID NO: 5496020 - DNA, 20 bp, Homo sapiens
gggccgcctcctccagactc

SEQ ID NO: 5496021 - DNA, 16 bp, Homo sapiens
gggccgcctgccctgc

SEQ ID NO: 5496022 - DNA, 18 bp, Homo sapiens
gggccgcctgccctgcct

SEQ ID NO: 5496023 - DNA, 18 bp, Homo sapiens
gggcctggcctgagctgg

SEQ ID NO: 5496024 - DNA, 21 bp, Homo sapiens
gggcctggccttgtccccagc

SEQ ID NO: 5496025 - DNA, 22 bp, Homo sapiens
gggcctggcgggatgggccacc

SEQ ID NO: 5496026 - DNA, 16 bp, Homo sapiens
gggcctggctcaggtg

SEQ ID NO: 5496027 - DNA, 14 bp, Homo sapiens
gggcctggctccag

SEQ ID NO: 5496028 - DNA, 15 bp, Homo sapiens
gggcctggctccctc

SEQ ID NO: 5496029 - DNA, 13 bp, Homo sapiens
gggcctggctggc

SEQ ID NO: 5496030 - DNA, 14 bp, Homo sapiens
gggcctggctggct

SEQ ID NO: 5496031 - DNA, 20 bp, Homo sapiens
gggcctggctggctgagggc

SEQ ID NO: 5496032 - DNA, 19 bp, Homo sapiens
gggcctggcttgctccagg

SEQ ID NO: 5496033 - DNA, 20 bp, Homo sapiens
gggcctggcttgctccaggg

SEQ ID NO: 5496034 - DNA, 23 bp, Homo sapiens
gggcctggcttgctccagggtct

SEQ ID NO: 5496035 - DNA, 17 bp, Homo sapiens
gggcctgggaaaggaaa

SEQ ID NO: 5496036 - DNA, 20 bp, Homo sapiens
gggcctgggacacttccctg

SEQ ID NO: 5496037 - DNA, 17 bp, Homo sapiens
gggcctgggcagcccca

SEQ ID NO: 5496038 - DNA, 11 bp, Homo sapiens
gggcctgggcc

SEQ ID NO: 5496039 - DNA, 14 bp, Homo sapiens
gggcctgggcctca

SEQ ID NO: 5496040 - DNA, 16 bp, Homo sapiens
gggcctgggcctcatg

SEQ ID NO: 5496041 - DNA, 14 bp, Homo sapiens
gggcctgggcctcc

SEQ ID NO: 5496042 - DNA, 15 bp, Homo sapiens
gggcctgggcctgct

SEQ ID NO: 5496043 - DNA, 15 bp, Homo sapiens
gggcctgggcctggc

SEQ ID NO: 5496044 - DNA, 12 bp, Homo sapiens
gggcctgggctc

SEQ ID NO: 5496045 - DNA, 19 bp, Homo sapiens
gggcctgggctgtgaggac

SEQ ID NO: 5496046 - DNA, 14 bp, Homo sapiens
gggcctggggcctg

SEQ ID NO: 5496047 - DNA, 17 bp, Homo sapiens
gggcctggggcctgaga

SEQ ID NO: 5496048 - DNA, 18 bp, Homo sapiens
gggcctggggcctgagag

SEQ ID NO: 5496049 - DNA, 19 bp, Homo sapiens
gggcctggggcctgagaga

SEQ ID NO: 5496050 - DNA, 13 bp, Homo sapiens
gggcctgggggtt

SEQ ID NO: 5496051 - DNA, 17 bp, Homo sapiens
gggcctgggtccccctc

SEQ ID NO: 5496052 - DNA, 18 bp, Homo sapiens
gggcctgggtccccctcc

SEQ ID NO: 5496053 - DNA, 13 bp, Homo sapiens
gggcctggtcacc

SEQ ID NO: 5496054 - DNA, 19 bp, Homo sapiens
gggcctggtctcaccctgg

SEQ ID NO: 5496055 - DNA, 23 bp, Homo sapiens
gggcctggtctcaccctggaggc

SEQ ID NO: 5496056 - DNA, 23 bp, Homo sapiens
gggcctgtacaaaagggacatga

SEQ ID NO: 5496057 - DNA, 21 bp, Homo sapiens
gggcctgtacagtctgtcttc

SEQ ID NO: 5496058 - DNA, 18 bp, Homo sapiens
gggcctgtactgcctgct

SEQ ID NO: 5496059 - DNA, 20 bp, Homo sapiens
gggcctgtcgtgccagtcct

SEQ ID NO: 5496060 - DNA, 16 bp, Homo sapiens
gggcctgtctcagtga

SEQ ID NO: 5496061 - DNA, 12 bp, Homo sapiens
gggcctgtctcc

SEQ ID NO: 5496062 - DNA, 16 bp, Homo sapiens
gggcctgtgcagcagc

SEQ ID NO: 5496063 - DNA, 21 bp, Homo sapiens
gggcctgtgcagcagcccagc

SEQ ID NO: 5496064 - DNA, 22 bp, Homo sapiens
gggcctgtgtgtgggtggggtt

SEQ ID NO: 5496065 - DNA, 16 bp, Homo sapiens
gggcctgttctcttgg

SEQ ID NO: 5496066 - DNA, 14 bp, Homo sapiens
gggcctgttgccct

SEQ ID NO: 5496067 - DNA, 22 bp, Homo sapiens
gggcctgtttggtgaggacctg

SEQ ID NO: 5496068 - DNA, 17 bp, Homo sapiens
gggccttaacatccctc

SEQ ID NO: 5496069 - DNA, 18 bp, Homo sapiens
gggccttacctcccctgc

SEQ ID NO: 5496070 - DNA, 19 bp, Homo sapiens
gggccttacctcccctgcc

SEQ ID NO: 5496071 - DNA, 21 bp, Homo sapiens
gggccttacctcccctgccag

SEQ ID NO: 5496072 - DNA, 23 bp, Homo sapiens
gggccttacctcccctgccaggg

SEQ ID NO: 5496073 - DNA, 20 bp, Homo sapiens
gggccttaggaagagccttc

SEQ ID NO: 5496074 - DNA, 18 bp, Homo sapiens
gggccttagtgggccagg

SEQ ID NO: 5496075 - DNA, 19 bp, Homo sapiens
gggccttcccctcccagcc

SEQ ID NO: 5496076 - DNA, 21 bp, Homo sapiens
gggccttcccctcccagccct

SEQ ID NO: 5496077 - DNA, 21 bp, Homo sapiens
gggccttcgggaccctggggc

SEQ ID NO: 5496078 - DNA, 16 bp, Homo sapiens
gggccttctcagctct

SEQ ID NO: 5496079 - DNA, 14 bp, Homo sapiens
gggccttgcggaag

SEQ ID NO: 5496080 - DNA, 16 bp, Homo sapiens
gggccttgcggaagcc

SEQ ID NO: 5496081 - DNA, 17 bp, Homo sapiens
gggccttgcggaagcca

SEQ ID NO: 5496082 - DNA, 18 bp, Homo sapiens
gggccttgcggaagccat

SEQ ID NO: 5496083 - DNA, 21 bp, Homo sapiens
gggccttgcggtatccgcccc

SEQ ID NO: 5496084 - DNA, 14 bp, Homo sapiens
gggccttgctctga

SEQ ID NO: 5496085 - DNA, 15 bp, Homo sapiens
gggccttggatcgct

SEQ ID NO: 5496086 - DNA, 22 bp, Homo sapiens
gggccttgtaataaatttctaa

SEQ ID NO: 5496087 - DNA, 16 bp, Homo sapiens
gggccttgtctcttcc

SEQ ID NO: 5496088 - DNA, 13 bp, Homo sapiens
gggccttgtgtgc

SEQ ID NO: 5496089 - DNA, 19 bp, Homo sapiens
gggcctttaaagacttaag

SEQ ID NO: 5496090 - DNA, 16 bp, Homo sapiens
gggcctttcagtccca

SEQ ID NO: 5496091 - DNA, 22 bp, Homo sapiens
gggcctttcctgtgccaacctg

SEQ ID NO: 5496092 - DNA, 17 bp, Homo sapiens
gggcctttctcctcccc

SEQ ID NO: 5496093 - DNA, 21 bp, Homo sapiens
gggcctttgccagcagagcca

SEQ ID NO: 5496094 - DNA, 22 bp, Homo sapiens
gggcctttgccagcagagccag

SEQ ID NO: 5496095 - DNA, 24 bp, Homo sapiens
gggcctttgccagcagagccaggg

SEQ ID NO: 5496096 - DNA, 16 bp, Homo sapiens
gggcctttggcaggtg

SEQ ID NO: 5496097 - DNA, 23 bp, Homo sapiens
gggccttttaagttgagcgtgcg

SEQ ID NO: 5496098 - DNA, 21 bp, Homo sapiens
gggccttttagaaacctcatt

SEQ ID NO: 5496099 - DNA, 20 bp, Homo sapiens
gggccttttgcccggaggcc

SEQ ID NO: 5496100 - DNA, 16 bp, Homo sapiens
gggccttttggatatg

SEQ ID NO: 5496101 - DNA, 19 bp, Homo sapiens
gggcgaagcccaggcccct

SEQ ID NO: 5496102 - DNA, 19 bp, Homo sapiens
gggcgagaaaggcctctgt

SEQ ID NO: 5496103 - DNA, 20 bp, Homo sapiens
gggcgagactccgtctcaaa

SEQ ID NO: 5496104 - DNA, 20 bp, Homo sapiens
gggcgagactctgtctcaaa

SEQ ID NO: 5496105 - DNA, 15 bp, Homo sapiens
gggcgagcccctcct

SEQ ID NO: 5496106 - DNA, 20 bp, Homo sapiens
gggcgagcccctccttctcc

SEQ ID NO: 5496107 - DNA, 12 bp, Homo sapiens
gggcgaggcagg

SEQ ID NO: 5496108 - DNA, 21 bp, Homo sapiens
gggcgaggcgggggagcctgg

SEQ ID NO: 5496109 - DNA, 15 bp, Homo sapiens
gggcgaggtcggcaa

SEQ ID NO: 5496110 - DNA, 22 bp, Homo sapiens
gggcgagtggtttcggaaaaaa

SEQ ID NO: 5496111 - DNA, 22 bp, Homo sapiens
gggcgatcgcggcggagctggc

SEQ ID NO: 5496112 - DNA, 15 bp, Homo sapiens
gggcgatgctccctc

SEQ ID NO: 5496113 - DNA, 18 bp, Homo sapiens
gggcgcaaagggcatggg

SEQ ID NO: 5496114 - DNA, 16 bp, Homo sapiens
gggcgcaaaggtgcct

SEQ ID NO: 5496115 - DNA, 23 bp, Homo sapiens
gggcgcacatgttatccacaagc

SEQ ID NO: 5496116 - DNA, 16 bp, Homo sapiens
gggcgcaccccacagc

SEQ ID NO: 5496117 - DNA, 21 bp, Homo sapiens
gggcgcaccccacagctgggg

SEQ ID NO: 5496118 - DNA, 22 bp, Homo sapiens
gggcgcaccccacagctggggc

SEQ ID NO: 5496119 - DNA, 21 bp, Homo sapiens
gggcgcaggaaccgaggactc

SEQ ID NO: 5496120 - DNA, 14 bp, Homo sapiens
gggcgcaggcccag

SEQ ID NO: 5496121 - DNA, 16 bp, Homo sapiens
gggcgcaggcccagtg

SEQ ID NO: 5496122 - DNA, 14 bp, Homo sapiens
gggcgccaggacag

SEQ ID NO: 5496123 - DNA, 16 bp, Homo sapiens
gggcgccaggacagca

SEQ ID NO: 5496124 - DNA, 23 bp, Homo sapiens
gggcgccaggacagcagcactcc

SEQ ID NO: 5496125 - DNA, 14 bp, Homo sapiens
gggcgcccaccctg

SEQ ID NO: 5496126 - DNA, 17 bp, Homo sapiens
gggcgcccaccctgggc

SEQ ID NO: 5496127 - DNA, 21 bp, Homo sapiens
gggcgcccacctccccacgcc

SEQ ID NO: 5496128 - DNA, 14 bp, Homo sapiens
gggcgcccagcagc

SEQ ID NO: 5496129 - DNA, 15 bp, Homo sapiens
gggcgcccagcagcc

SEQ ID NO: 5496130 - DNA, 18 bp, Homo sapiens
gggcgcccagcccaggcc

SEQ ID NO: 5496131 - DNA, 23 bp, Homo sapiens
gggcgcccattcgtctgtcccag

SEQ ID NO: 5496132 - DNA, 23 bp, Homo sapiens
gggcgcccgcggcgcgaccctcc

SEQ ID NO: 5496133 - DNA, 12 bp, Homo sapiens
gggcgccctctc

SEQ ID NO: 5496134 - DNA, 20 bp, Homo sapiens
gggcgccgtgctgggcagcc

SEQ ID NO: 5496135 - DNA, 22 bp, Homo sapiens
gggcgccgtgctgggcagcccg

SEQ ID NO: 5496136 - DNA, 24 bp, Homo sapiens
gggcgccgtgctgggcagcccgct

SEQ ID NO: 5496137 - DNA, 18 bp, Homo sapiens
gggcgcctagagcgcggc

SEQ ID NO: 5496138 - DNA, 22 bp, Homo sapiens
gggcgcctagagcgcggctggc

SEQ ID NO: 5496139 - DNA, 16 bp, Homo sapiens
gggcgcctctgtcctg

SEQ ID NO: 5496140 - DNA, 18 bp, Homo sapiens
gggcgcctgcgctcctct

SEQ ID NO: 5496141 - DNA, 14 bp, Homo sapiens
gggcgcctggagag

SEQ ID NO: 5496142 - DNA, 20 bp, Homo sapiens
gggcgcctggagagcgagga

SEQ ID NO: 5496143 - DNA, 13 bp, Homo sapiens
gggcgcctgtggt

SEQ ID NO: 5496144 - DNA, 20 bp, Homo sapiens
gggcgcgcgcccccaggacc

SEQ ID NO: 5496145 - DNA, 15 bp, Homo sapiens
gggcgcggccagccc

SEQ ID NO: 5496146 - DNA, 20 bp, Homo sapiens
gggcgcgtgaggcccgtggg

SEQ ID NO: 5496147 - DNA, 18 bp, Homo sapiens
gggcgctcagacggcggc

SEQ ID NO: 5496148 - DNA, 22 bp, Homo sapiens
gggcgctcagacggcggccagg

SEQ ID NO: 5496149 - DNA, 20 bp, Homo sapiens
gggcgctcgcttccgcatcc

SEQ ID NO: 5496150 - DNA, 22 bp, Homo sapiens
gggcgctctgccctccctggcc

SEQ ID NO: 5496151 - DNA, 23 bp, Homo sapiens
gggcgctctgccctccctggcct

SEQ ID NO: 5496152 - DNA, 16 bp, Homo sapiens
gggcgctgcagcctcc

SEQ ID NO: 5496153 - DNA, 17 bp, Homo sapiens
gggcgctgcccccacag

SEQ ID NO: 5496154 - DNA, 16 bp, Homo sapiens
gggcgctggcccagcc

SEQ ID NO: 5496155 - DNA, 18 bp, Homo sapiens
gggcgctggcccagccgg

SEQ ID NO: 5496156 - DNA, 19 bp, Homo sapiens
gggcgctggcccagccggc

SEQ ID NO: 5496157 - DNA, 13 bp, Homo sapiens
gggcgctgtcctg

SEQ ID NO: 5496158 - DNA, 17 bp, Homo sapiens
gggcgctgtcctgcgtt

SEQ ID NO: 5496159 - DNA, 18 bp, Homo sapiens
gggcgctgtggctcctgc

SEQ ID NO: 5496160 - DNA, 14 bp, Homo sapiens
gggcggagctgggg

SEQ ID NO: 5496161 - DNA, 12 bp, Homo sapiens
gggcggcagggc

SEQ ID NO: 5496162 - DNA, 21 bp, Homo sapiens
gggcggcaggggcctggagat

SEQ ID NO: 5496163 - DNA, 19 bp, Homo sapiens
gggcggcatccctgcagag

SEQ ID NO: 5496164 - DNA, 12 bp, Homo sapiens
gggcggccaggc

SEQ ID NO: 5496165 - DNA, 15 bp, Homo sapiens
gggcggccaggcaac

SEQ ID NO: 5496166 - DNA, 22 bp, Homo sapiens
gggcggcccacgccagctggcc

SEQ ID NO: 5496167 - DNA, 15 bp, Homo sapiens
gggcggcccagcctc

SEQ ID NO: 5496168 - DNA, 15 bp, Homo sapiens
gggcggcccgtggac

SEQ ID NO: 5496169 - DNA, 22 bp, Homo sapiens
gggcggcctatgacttgggcac

SEQ ID NO: 5496170 - DNA, 15 bp, Homo sapiens
gggcggcctgcagac

SEQ ID NO: 5496171 - DNA, 17 bp, Homo sapiens
gggcggctcctggtgct

SEQ ID NO: 5496172 - DNA, 12 bp, Homo sapiens
gggcggctgggt

SEQ ID NO: 5496173 - DNA, 18 bp, Homo sapiens
gggcgggactcctccctg

SEQ ID NO: 5496174 - DNA, 15 bp, Homo sapiens
gggcgggaggatgtt

SEQ ID NO: 5496175 - DNA, 13 bp, Homo sapiens
gggcgggaggcca

SEQ ID NO: 5496176 - DNA, 13 bp, Homo sapiens
gggcgggccaggg

SEQ ID NO: 5496177 - DNA, 19 bp, Homo sapiens
gggcgggccatgagggaca

SEQ ID NO: 5496178 - DNA, 15 bp, Homo sapiens
gggcgggcccctcat

SEQ ID NO: 5496179 - DNA, 15 bp, Homo sapiens
gggcgggcgtgggag

SEQ ID NO: 5496180 - DNA, 14 bp, Homo sapiens
gggcgggctcagag

SEQ ID NO: 5496181 - DNA, 19 bp, Homo sapiens
gggcggggactgctggctc

SEQ ID NO: 5496182 - DNA, 14 bp, Homo sapiens
gggcggggccttgc

SEQ ID NO: 5496183 - DNA, 14 bp, Homo sapiens
gggcggggctggcc

SEQ ID NO: 5496184 - DNA, 22 bp, Homo sapiens
gggcgggtacagcgcggaggag

SEQ ID NO: 5496185 - DNA, 12 bp, Homo sapiens
gggcgggtccta

SEQ ID NO: 5496186 - DNA, 14 bp, Homo sapiens
gggcgggtcctagc

SEQ ID NO: 5496187 - DNA, 15 bp, Homo sapiens
gggcgggtcctagct

SEQ ID NO: 5496188 - DNA, 21 bp, Homo sapiens
gggcgggtgacgcccaccttc

SEQ ID NO: 5496189 - DNA, 20 bp, Homo sapiens
gggcggtcacagcatggagg

SEQ ID NO: 5496190 - DNA, 17 bp, Homo sapiens
gggcggtcctgcacaga

SEQ ID NO: 5496191 - DNA, 21 bp, Homo sapiens
gggcggtgagaggggaacaga

SEQ ID NO: 5496192 - DNA, 17 bp, Homo sapiens
gggcggtgaggtggggg

SEQ ID NO: 5496193 - DNA, 13 bp, Homo sapiens
gggcggtgtcagg

SEQ ID NO: 5496194 - DNA, 12 bp, Homo sapiens
gggcggtgtgtg

SEQ ID NO: 5496195 - DNA, 14 bp, Homo sapiens
gggcgtcagagaga

SEQ ID NO: 5496196 - DNA, 13 bp, Homo sapiens
gggcgtcaggcag

SEQ ID NO: 5496197 - DNA, 22 bp, Homo sapiens
gggcgtcgctggacaacccaga

SEQ ID NO: 5496198 - DNA, 14 bp, Homo sapiens
gggcgtctgactcc

SEQ ID NO: 5496199 - DNA, 18 bp, Homo sapiens
gggcgtctgactccctcc

SEQ ID NO: 5496200 - DNA, 22 bp, Homo sapiens
gggctctgccctccctccttcc

SEQ ID NO: 5496201 - DNA, 20 bp, Homo sapiens
gggctctgcctcccatcacc

SEQ ID NO: 5496202 - DNA, 15 bp, Homo sapiens
gggctctgcttcctc

SEQ ID NO: 5496203 - DNA, 19 bp, Homo sapiens
gggctctgcttcctcagcc

SEQ ID NO: 5496204 - DNA, 23 bp, Homo sapiens
gggctctggacctcaggagggca

SEQ ID NO: 5496205 - DNA, 14 bp, Homo sapiens
gggctctggactcc

SEQ ID NO: 5496206 - DNA, 15 bp, Homo sapiens
gggctctggactcca

SEQ ID NO: 5496207 - DNA, 15 bp, Homo sapiens
gggctctggccaccc

SEQ ID NO: 5496208 - DNA, 13 bp, Homo sapiens
gggctctggctcc

SEQ ID NO: 5496209 - DNA, 15 bp, Homo sapiens
gggctctgggcggcc

SEQ ID NO: 5496210 - DNA, 17 bp, Homo sapiens
gggctctgggggcagat

SEQ ID NO: 5496211 - DNA, 15 bp, Homo sapiens
gggctctgggtgctg

SEQ ID NO: 5496212 - DNA, 18 bp, Homo sapiens
gggctctgggtgctgccc

SEQ ID NO: 5496213 - DNA, 12 bp, Homo sapiens
gggctctggtct

SEQ ID NO: 5496214 - DNA, 16 bp, Homo sapiens
gggctctgtgcagtca

SEQ ID NO: 5496215 - DNA, 15 bp, Homo sapiens
gggctcttctcattt

SEQ ID NO: 5496216 - DNA, 22 bp, Homo sapiens
gggctctttctctctgctgagc

SEQ ID NO: 5496217 - DNA, 14 bp, Homo sapiens
gggctgaaccctca

SEQ ID NO: 5496218 - DNA, 18 bp, Homo sapiens
gggctgaaccctcagcct

SEQ ID NO: 5496219 - DNA, 15 bp, Homo sapiens
gggctgaatgtatgt

SEQ ID NO: 5496220 - DNA, 15 bp, Homo sapiens
gggctgacacctacc

SEQ ID NO: 5496221 - DNA, 22 bp, Homo sapiens
gggctgacatcaagtgtaatta

SEQ ID NO: 5496222 - DNA, 16 bp, Homo sapiens
gggctgaccaggcttc

SEQ ID NO: 5496223 - DNA, 16 bp, Homo sapiens
gggctgaccttcctcg

SEQ ID NO: 5496224 - DNA, 16 bp, Homo sapiens
gggctgactgggccag

SEQ ID NO: 5496225 - DNA, 21 bp, Homo sapiens
gggctgagagggctgtggctg

SEQ ID NO: 5496226 - DNA, 15 bp, Homo sapiens
gggctgagccatggg

SEQ ID NO: 5496227 - DNA, 14 bp, Homo sapiens
gggctgagccccta

SEQ ID NO: 5496228 - DNA, 23 bp, Homo sapiens
gggctgagcccctaccccacacc

SEQ ID NO: 5496229 - DNA, 20 bp, Homo sapiens
gggctgagcccctcctctcc

SEQ ID NO: 5496230 - DNA, 13 bp, Homo sapiens
gggctgagcctgg

SEQ ID NO: 5496231 - DNA, 19 bp, Homo sapiens
gggctgagcgtggaagggg

SEQ ID NO: 5496232 - DNA, 23 bp, Homo sapiens
gggctgagctggggacctggtac

SEQ ID NO: 5496233 - DNA, 12 bp, Homo sapiens
gggctgaggagc

SEQ ID NO: 5496234 - DNA, 19 bp, Homo sapiens
gggctgaggagcagccagg

SEQ ID NO: 5496235 - DNA, 13 bp, Homo sapiens
gggctgaggatgg

SEQ ID NO: 5496236 - DNA, 20 bp, Homo sapiens
gggctgagggcatctctgag

SEQ ID NO: 5496237 - DNA, 15 bp, Homo sapiens
gggctgagtctggct

SEQ ID NO: 5496238 - DNA, 19 bp, Homo sapiens
gggctgagtgcagaggctg

SEQ ID NO: 5496239 - DNA, 14 bp, Homo sapiens
gggctgagtgcagc

SEQ ID NO: 5496240 - DNA, 20 bp, Homo sapiens
gggctgatttacatgtatgg

SEQ ID NO: 5496241 - DNA, 20 bp, Homo sapiens
gggctgcaccggctggcctg

SEQ ID NO: 5496242 - DNA, 18 bp, Homo sapiens
gggctgcactctgtgccc

SEQ ID NO: 5496243 - DNA, 15 bp, Homo sapiens
gggctgcagagcctg

SEQ ID NO: 5496244 - DNA, 11 bp, Homo sapiens
gggctgcagca

SEQ ID NO: 5496245 - DNA, 18 bp, Homo sapiens
gggctgcagcagaggcct

SEQ ID NO: 5496246 - DNA, 14 bp, Homo sapiens
gggctgcagcagcc

SEQ ID NO: 5496247 - DNA, 20 bp, Homo sapiens
gggctgcagccccctgcttc

SEQ ID NO: 5496248 - DNA, 14 bp, Homo sapiens
gggctgcaggcagg

SEQ ID NO: 5496249 - DNA, 15 bp, Homo sapiens
gggctgcaggcaggc

SEQ ID NO: 5496250 - DNA, 16 bp, Homo sapiens
gggctgcagggctggg

SEQ ID NO: 5496251 - DNA, 16 bp, Homo sapiens
gggctgcatgatgttt

SEQ ID NO: 5496252 - DNA, 20 bp, Homo sapiens
gggctgcatgatgtttgccc

SEQ ID NO: 5496253 - DNA, 22 bp, Homo sapiens
gggctgcatgatttttgccctg

SEQ ID NO: 5496254 - DNA, 21 bp, Homo sapiens
gggctgcatgcgggcttcctc

SEQ ID NO: 5496255 - DNA, 14 bp, Homo sapiens
gggctgccagccca

SEQ ID NO: 5496256 - DNA, 19 bp, Homo sapiens
gggctgccagcccagctgg

SEQ ID NO: 5496257 - DNA, 23 bp, Homo sapiens
gggctgccagcctgagcggaggc

SEQ ID NO: 5496258 - DNA, 23 bp, Homo sapiens
gggctgcccctcgcacacagggc

SEQ ID NO: 5496259 - DNA, 19 bp, Homo sapiens
gggctgcccgctcccagtg

SEQ ID NO: 5496260 - DNA, 11 bp, Homo sapiens
gggctgccctc

SEQ ID NO: 5496261 - DNA, 14 bp, Homo sapiens
gggctgccctgaga

SEQ ID NO: 5496262 - DNA, 12 bp, Homo sapiens
gggctgccctgc

SEQ ID NO: 5496263 - DNA, 21 bp, Homo sapiens
gggctgccctggtgctgccac

SEQ ID NO: 5496264 - DNA, 21 bp, Homo sapiens
gggctgcccttcgctgccagg

SEQ ID NO: 5496265 - DNA, 23 bp, Homo sapiens
gggctgcccttcgctgccaggac

SEQ ID NO: 5496266 - DNA, 20 bp, Homo sapiens
gggctgcccttgttgcctgc

SEQ ID NO: 5496267 - DNA, 21 bp, Homo sapiens
gggctgcccttgttgcctgca

SEQ ID NO: 5496268 - DNA, 20 bp, Homo sapiens
gggctgccgcatctgcctgg

SEQ ID NO: 5496269 - DNA, 23 bp, Homo sapiens
gggctgccgcatctgcctggagc

SEQ ID NO: 5496270 - DNA, 16 bp, Homo sapiens
gggctgcctgcccctg

SEQ ID NO: 5496271 - DNA, 17 bp, Homo sapiens
gggctgccttctggcct

SEQ ID NO: 5496272 - DNA, 15 bp, Homo sapiens
gggctgccttgctgt

SEQ ID NO: 5496273 - DNA, 14 bp, Homo sapiens
gggctgcctttgtg

SEQ ID NO: 5496274 - DNA, 22 bp, Homo sapiens
gggctgcgaaaacgttgacccc

SEQ ID NO: 5496275 - DNA, 22 bp, Homo sapiens
gggctgcgacgcttgctctgtt

SEQ ID NO: 5496276 - DNA, 20 bp, Homo sapiens
gggctgcggcgtacaggctg

SEQ ID NO: 5496277 - DNA, 13 bp, Homo sapiens
gggctgcgggagg

SEQ ID NO: 5496278 - DNA, 14 bp, Homo sapiens
gggctgcgtccctg

SEQ ID NO: 5496279 - DNA, 20 bp, Homo sapiens
gggctgctcacccacctctt

SEQ ID NO: 5496280 - DNA, 21 bp, Homo sapiens
gggctgctcccacctggctct

SEQ ID NO: 5496281 - DNA, 14 bp, Homo sapiens
gggctgctcccctt

SEQ ID NO: 5496282 - DNA, 16 bp, Homo sapiens
gggctgctcctccagg

SEQ ID NO: 5496283 - DNA, 14 bp, Homo sapiens
gggctgctcctgaa

SEQ ID NO: 5496284 - DNA, 17 bp, Homo sapiens
gggctgctgctcctctc

SEQ ID NO: 5496285 - DNA, 21 bp, Homo sapiens
gggctgctgctgggctcagtg

SEQ ID NO: 5496286 - DNA, 13 bp, Homo sapiens
gggctgctgcttc

SEQ ID NO: 5496287 - DNA, 20 bp, Homo sapiens
gggctgctggcctggccctt

SEQ ID NO: 5496288 - DNA, 22 bp, Homo sapiens
gggctgctggcctggcccttga

SEQ ID NO: 5496289 - DNA, 15 bp, Homo sapiens
gggctgctgggggct

SEQ ID NO: 5496290 - DNA, 11 bp, Homo sapiens
gggctgctgtg

SEQ ID NO: 5496291 - DNA, 13 bp, Homo sapiens
gggctgctgtggc

SEQ ID NO: 5496292 - DNA, 21 bp, Homo sapiens
gggctgcttaggtctcatgga

SEQ ID NO: 5496293 - DNA, 19 bp, Homo sapiens
gggctgcttcctcctggaa

SEQ ID NO: 5496294 - DNA, 22 bp, Homo sapiens
gggctggaaaagtcacacagac

SEQ ID NO: 5496295 - DNA, 23 bp, Homo sapiens
gggctggaaaagtcacacagaca

SEQ ID NO: 5496296 - DNA, 11 bp, Homo sapiens
gggctggaaca

SEQ ID NO: 5496297 - DNA, 22 bp, Homo sapiens
gggctggaagcagaaacaaaat

SEQ ID NO: 5496298 - DNA, 19 bp, Homo sapiens
gggctggaatgggagacct

SEQ ID NO: 5496299 - DNA, 21 bp, Homo sapiens
gggctggacctggcggcagga

SEQ ID NO: 5496300 - DNA, 19 bp, Homo sapiens
gggctggactgaggcctga

SEQ ID NO: 5496301 - DNA, 16 bp, Homo sapiens
gggctggactggctgt

SEQ ID NO: 5496302 - DNA, 21 bp, Homo sapiens
gggctggagaaagagctgcct

SEQ ID NO: 5496303 - DNA, 22 bp, Homo sapiens
gggctggagaaagagctgcctg

SEQ ID NO: 5496304 - DNA, 24 bp, Homo sapiens
gggctggagaaagagctgcctgga

SEQ ID NO: 5496305 - DNA, 15 bp, Homo sapiens
gggctggagaccaga

SEQ ID NO: 5496306 - DNA, 22 bp, Homo sapiens
gggctggagcagtttggggcag

SEQ ID NO: 5496307 - DNA, 15 bp, Homo sapiens
gggctggagctcctc

SEQ ID NO: 5496308 - DNA, 16 bp, Homo sapiens
gggctggagctcctcc

SEQ ID NO: 5496309 - DNA, 13 bp, Homo sapiens
gggctggaggagc

SEQ ID NO: 5496310 - DNA, 16 bp, Homo sapiens
gggctggaggcccagg

SEQ ID NO: 5496311 - DNA, 19 bp, Homo sapiens
gggctggaggcccaggctg

SEQ ID NO: 5496312 - DNA, 14 bp, Homo sapiens
gggctggagggctg

SEQ ID NO: 5496313 - DNA, 21 bp, Homo sapiens
gggctggagtgcgctcttggt

SEQ ID NO: 5496314 - DNA, 23 bp, Homo sapiens
gggctggagtgcgctcttggtcc

SEQ ID NO: 5496315 - DNA, 18 bp, Homo sapiens
gggctggatgagctccca

SEQ ID NO: 5496316 - DNA, 16 bp, Homo sapiens
gggctggatggacaga

SEQ ID NO: 5496317 - DNA, 17 bp, Homo sapiens
gggctggattggcaggt

SEQ ID NO: 5496318 - DNA, 18 bp, Homo sapiens
gggctggattggcaggtg

SEQ ID NO: 5496319 - DNA, 15 bp, Homo sapiens
gggctggcacccact

SEQ ID NO: 5496320 - DNA, 21 bp, Homo sapiens
gggctggcacgtgacaggctc

SEQ ID NO: 5496321 - DNA, 14 bp, Homo sapiens
gggctggccagctg

SEQ ID NO: 5496322 - DNA, 11 bp, Homo sapiens
gggctggccca

SEQ ID NO: 5496323 - DNA, 12 bp, Homo sapiens
gggctggcccag

SEQ ID NO: 5496324 - DNA, 18 bp, Homo sapiens
gggctggccccagggcac

SEQ ID NO: 5496325 - DNA, 12 bp, Homo sapiens
gggctggccctg

SEQ ID NO: 5496326 - DNA, 23 bp, Homo sapiens
gggctggccctgccctcccccac

SEQ ID NO: 5496327 - DNA, 13 bp, Homo sapiens
gggctggccctgt

SEQ ID NO: 5496328 - DNA, 15 bp, Homo sapiens
gggctggccgctgtg

SEQ ID NO: 5496329 - DNA, 20 bp, Homo sapiens
gggctggccgggactgctgc

SEQ ID NO: 5496330 - DNA, 21 bp, Homo sapiens
gggctggccgggactgctgct

SEQ ID NO: 5496331 - DNA, 19 bp, Homo sapiens
gggctggcctctggctctc

SEQ ID NO: 5496332 - DNA, 22 bp, Homo sapiens
gggctggcgcttggatctgggg

SEQ ID NO: 5496333 - DNA, 23 bp, Homo sapiens
gggctggcgcttggatctggggt

SEQ ID NO: 5496334 - DNA, 13 bp, Homo sapiens
gggctggctccca

SEQ ID NO: 5496335 - DNA, 15 bp, Homo sapiens
gggctggctcccagg

SEQ ID NO: 5496336 - DNA, 15 bp, Homo sapiens
gggctggctccctct

SEQ ID NO: 5496337 - DNA, 15 bp, Homo sapiens
gggctggctcctctg

SEQ ID NO: 5496338 - DNA, 11 bp, Homo sapiens
gggctggctct

SEQ ID NO: 5496339 - DNA, 17 bp, Homo sapiens
gggctggctctgcacta

SEQ ID NO: 5496340 - DNA, 15 bp, Homo sapiens
gggctggctgaagaa

SEQ ID NO: 5496341 - DNA, 22 bp, Homo sapiens
gggctggctgaagaatgaagac

SEQ ID NO: 5496342 - DNA, 15 bp, Homo sapiens
gggctggctgctcct

SEQ ID NO: 5496343 - DNA, 23 bp, Homo sapiens
gggctggctgcttgcagccagga

SEQ ID NO: 5496344 - DNA, 12 bp, Homo sapiens
gggctggcttca

SEQ ID NO: 5496345 - DNA, 13 bp, Homo sapiens
gggctgggaagtc

SEQ ID NO: 5496346 - DNA, 20 bp, Homo sapiens
gggctgggagaagaaataga

SEQ ID NO: 5496347 - DNA, 21 bp, Homo sapiens
gggctgggatggtgactcctg

SEQ ID NO: 5496348 - DNA, 13 bp, Homo sapiens
gggctgggcaccg

SEQ ID NO: 5496349 - DNA, 13 bp, Homo sapiens
gggctgggcacct

SEQ ID NO: 5496350 - DNA, 16 bp, Homo sapiens
gggctgggcactgctc

SEQ ID NO: 5496351 - DNA, 12 bp, Homo sapiens
gggctgggcaga

SEQ ID NO: 5496352 - DNA, 15 bp, Homo sapiens
gggctgggcagagga

SEQ ID NO: 5496353 - DNA, 21 bp, Homo sapiens
gggctgggcagaggggagagg

SEQ ID NO: 5496354 - DNA, 14 bp, Homo sapiens
gggctgggcagcta

SEQ ID NO: 5496355 - DNA, 16 bp, Homo sapiens
gggctgggcagggccc

SEQ ID NO: 5496356 - DNA, 11 bp, Homo sapiens
gggctgggcat

SEQ ID NO: 5496357 - DNA, 15 bp, Homo sapiens
gggctgggcatccca

SEQ ID NO: 5496358 - DNA, 15 bp, Homo sapiens
gggctgggccaccag

SEQ ID NO: 5496359 - DNA, 16 bp, Homo sapiens
gggctgggccaccagg

SEQ ID NO: 5496360 - DNA, 11 bp, Homo sapiens
gggctgggccc

SEQ ID NO: 5496361 - DNA, 12 bp, Homo sapiens
gggctgggccca

SEQ ID NO: 5496362 - DNA, 14 bp, Homo sapiens
gggctgggcccaca

SEQ ID NO: 5496363 - DNA, 22 bp, Homo sapiens
gggctgggcccacccaagcagg

SEQ ID NO: 5496364 - DNA, 20 bp, Homo sapiens
gggctgggcccacccaggga

SEQ ID NO: 5496365 - DNA, 22 bp, Homo sapiens
gggctgggcccacccagggagc

SEQ ID NO: 5496366 - DNA, 18 bp, Homo sapiens
gggctgggccctctcttc

SEQ ID NO: 5496367 - DNA, 23 bp, Homo sapiens
gggctgggccctctttccctgcg

SEQ ID NO: 5496368 - DNA, 23 bp, Homo sapiens
gggctgggcccttcctggctagg

SEQ ID NO: 5496369 - DNA, 15 bp, Homo sapiens
gggctgggcgcctct

SEQ ID NO: 5496370 - DNA, 17 bp, Homo sapiens
gggctgggcgcctctgt

SEQ ID NO: 5496371 - DNA, 18 bp, Homo sapiens
gggctgggctcacaggcc

SEQ ID NO: 5496372 - DNA, 15 bp, Homo sapiens
gggctgggctctgtc

SEQ ID NO: 5496373 - DNA, 18 bp, Homo sapiens
gggctggggaaagggctg

SEQ ID NO: 5496374 - DNA, 13 bp, Homo sapiens
gggctggggaaga

SEQ ID NO: 5496375 - DNA, 16 bp, Homo sapiens
gggctggggactctgg

SEQ ID NO: 5496376 - DNA, 20 bp, Homo sapiens
gggctggggaggaggagaga

SEQ ID NO: 5496377 - DNA, 22 bp, Homo sapiens
gggctggggcaggaggggagtg

SEQ ID NO: 5496378 - DNA, 23 bp, Homo sapiens
ggggaagagggaaatgtacactt

SEQ ID NO: 5496379 - DNA, 13 bp, Homo sapiens
ggggaagccctgg

SEQ ID NO: 5496380 - DNA, 14 bp, Homo sapiens
ggggaagccctgga

SEQ ID NO: 5496381 - DNA, 15 bp, Homo sapiens
ggggaagctgcagct

SEQ ID NO: 5496382 - DNA, 13 bp, Homo sapiens
ggggaagctgcta

SEQ ID NO: 5496383 - DNA, 14 bp, Homo sapiens
ggggaagctggcag

SEQ ID NO: 5496384 - DNA, 16 bp, Homo sapiens
ggggaagctggcagca

SEQ ID NO: 5496385 - DNA, 15 bp, Homo sapiens
ggggaaggcagaggc

SEQ ID NO: 5496386 - DNA, 16 bp, Homo sapiens
ggggaaggcagaggct

SEQ ID NO: 5496387 - DNA, 18 bp, Homo sapiens
ggggaaggcagaggctgg

SEQ ID NO: 5496388 - DNA, 15 bp, Homo sapiens
ggggaaggctgcaaa

SEQ ID NO: 5496389 - DNA, 14 bp, Homo sapiens
ggggaaggggcctg

SEQ ID NO: 5496390 - DNA, 14 bp, Homo sapiens
ggggaaggggtgca

SEQ ID NO: 5496391 - DNA, 14 bp, Homo sapiens
ggggaagggtggtc

SEQ ID NO: 5496392 - DNA, 17 bp, Homo sapiens
ggggaagggttttcttt

SEQ ID NO: 5496393 - DNA, 21 bp, Homo sapiens
ggggaatattttattcaaggt

SEQ ID NO: 5496394 - DNA, 12 bp, Homo sapiens
ggggaatgaggg

SEQ ID NO: 5496395 - DNA, 16 bp, Homo sapiens
ggggaatgcacctccc

SEQ ID NO: 5496396 - DNA, 18 bp, Homo sapiens
ggggaatgtttgcctctg

SEQ ID NO: 5496397 - DNA, 15 bp, Homo sapiens
ggggaattcatctct

SEQ ID NO: 5496398 - DNA, 15 bp, Homo sapiens
ggggaattccctccc

SEQ ID NO: 5496399 - DNA, 18 bp, Homo sapiens
ggggaattccctccccct

SEQ ID NO: 5496400 - DNA, 13 bp, Homo sapiens
ggggaattcctgg

SEQ ID NO: 5496401 - DNA, 18 bp, Homo sapiens
ggggacactgacaaagtc

SEQ ID NO: 5496402 - DNA, 18 bp, Homo sapiens
ggggacactgtggcagca

SEQ ID NO: 5496403 - DNA, 18 bp, Homo sapiens
ggggacagaccagccctt

SEQ ID NO: 5496404 - DNA, 18 bp, Homo sapiens
ggggacagagctgaggat

SEQ ID NO: 5496405 - DNA, 13 bp, Homo sapiens
ggggacagccttc

SEQ ID NO: 5496406 - DNA, 12 bp, Homo sapiens
ggggacagctcc

SEQ ID NO: 5496407 - DNA, 14 bp, Homo sapiens
ggggacagctgtgt

SEQ ID NO: 5496408 - DNA, 23 bp, Homo sapiens
ggggacagcttcctcacacccct

SEQ ID NO: 5496409 - DNA, 13 bp, Homo sapiens
ggggacagctttc

SEQ ID NO: 5496410 - DNA, 15 bp, Homo sapiens
ggggacaggatttgg

SEQ ID NO: 5496411 - DNA, 12 bp, Homo sapiens
ggggacaggcct

SEQ ID NO: 5496412 - DNA, 13 bp, Homo sapiens
ggggacagggagg

SEQ ID NO: 5496413 - DNA, 14 bp, Homo sapiens
ggggacagggggtg

SEQ ID NO: 5496414 - DNA, 19 bp, Homo sapiens
ggggacaggtaagtggcag

SEQ ID NO: 5496415 - DNA, 18 bp, Homo sapiens
ggggacagttggcagaga

SEQ ID NO: 5496416 - DNA, 19 bp, Homo sapiens
ggggaccaaatagccacct

SEQ ID NO: 5496417 - DNA, 16 bp, Homo sapiens
ggggaccacagaggct

SEQ ID NO: 5496418 - DNA, 17 bp, Homo sapiens
ggggaccacagaggctg

SEQ ID NO: 5496419 - DNA, 19 bp, Homo sapiens
ggggaccactgggcccctc

SEQ ID NO: 5496420 - DNA, 15 bp, Homo sapiens
ggggaccagagctgc

SEQ ID NO: 5496421 - DNA, 16 bp, Homo sapiens
ggggaccagagctgcc

SEQ ID NO: 5496422 - DNA, 15 bp, Homo sapiens
ggggaccagcttggc

SEQ ID NO: 5496423 - DNA, 21 bp, Homo sapiens
ggggacccaaaccccctgcag

SEQ ID NO: 5496424 - DNA, 11 bp, Homo sapiens
ggggacccagc

SEQ ID NO: 5496425 - DNA, 23 bp, Homo sapiens
ggggacccagcgccggggggagg

SEQ ID NO: 5496426 - DNA, 21 bp, Homo sapiens
ggggacccctcgcaaccctgc

SEQ ID NO: 5496427 - DNA, 20 bp, Homo sapiens
ggggacccgctgggggctgg

SEQ ID NO: 5496428 - DNA, 21 bp, Homo sapiens
ggggaccctccaaaggaaggg

SEQ ID NO: 5496429 - DNA, 20 bp, Homo sapiens
ggggaccctccagaggtgga

SEQ ID NO: 5496430 - DNA, 23 bp, Homo sapiens
ggggaccgttcagtgtcccaggc

SEQ ID NO: 5496431 - DNA, 23 bp, Homo sapiens
ggggacctcagcctgcaccctct

SEQ ID NO: 5496432 - DNA, 13 bp, Homo sapiens
ggggacctcaggc

SEQ ID NO: 5496433 - DNA, 18 bp, Homo sapiens
ggggacctgaactgtcct

SEQ ID NO: 5496434 - DNA, 23 bp, Homo sapiens
ggggacctgccaccagggagctt

SEQ ID NO: 5496435 - DNA, 20 bp, Homo sapiens
ggggacctgtcccccactct

SEQ ID NO: 5496436 - DNA, 13 bp, Homo sapiens
ggggacgcaggcc

SEQ ID NO: 5496437 - DNA, 15 bp, Homo sapiens
ggggacgcaggcccc

SEQ ID NO: 5496438 - DNA, 19 bp, Homo sapiens
ggggacgcccccagtgaga

SEQ ID NO: 5496439 - DNA, 17 bp, Homo sapiens
ggggacgcgcacacaca

SEQ ID NO: 5496440 - DNA, 14 bp, Homo sapiens
ggggacgctgagga

SEQ ID NO: 5496441 - DNA, 23 bp, Homo sapiens
ggggacgctggtagagatggagg

SEQ ID NO: 5496442 - DNA, 21 bp, Homo sapiens
ggggacgcttttgagtgggcc

SEQ ID NO: 5496443 - DNA, 14 bp, Homo sapiens
ggggacgggacaga

SEQ ID NO: 5496444 - DNA, 15 bp, Homo sapiens
ggggacgggacagac

SEQ ID NO: 5496445 - DNA, 15 bp, Homo sapiens
ggggacggggctccc

SEQ ID NO: 5496446 - DNA, 18 bp, Homo sapiens
ggggacggggggccccag

SEQ ID NO: 5496447 - DNA, 16 bp, Homo sapiens
ggggacgtggcgctgt

SEQ ID NO: 5496448 - DNA, 14 bp, Homo sapiens
ggggacgttgctga

SEQ ID NO: 5496449 - DNA, 23 bp, Homo sapiens
ggggactaatatcatagacccat

SEQ ID NO: 5496450 - DNA, 17 bp, Homo sapiens
ggggactcccaggctgg

SEQ ID NO: 5496451 - DNA, 22 bp, Homo sapiens
ggggactcggagggtgccgtgc

SEQ ID NO: 5496452 - DNA, 18 bp, Homo sapiens
ggggactcgggggctggt

SEQ ID NO: 5496453 - DNA, 13 bp, Homo sapiens
ggggactctccag

SEQ ID NO: 5496454 - DNA, 20 bp, Homo sapiens
ggggactctgagcgggaggc

SEQ ID NO: 5496455 - DNA, 15 bp, Homo sapiens
ggggactctgggcta

SEQ ID NO: 5496456 - DNA, 18 bp, Homo sapiens
ggggactgctttcagtgc

SEQ ID NO: 5496457 - DNA, 12 bp, Homo sapiens
ggggactgggga

SEQ ID NO: 5496458 - DNA, 21 bp, Homo sapiens
ggggactgtaagttgggcttg

SEQ ID NO: 5496459 - DNA, 23 bp, Homo sapiens
ggggactgttccaaagccagtga

SEQ ID NO: 5496460 - DNA, 19 bp, Homo sapiens
ggggacttacatgattcat

SEQ ID NO: 5496461 - DNA, 22 bp, Homo sapiens
ggggacttccgctccctggata

SEQ ID NO: 5496462 - DNA, 23 bp, Homo sapiens
ggggacttcgggggcggctctgg

SEQ ID NO: 5496463 - DNA, 15 bp, Homo sapiens
ggggacttggatagg

SEQ ID NO: 5496464 - DNA, 16 bp, Homo sapiens
ggggacttggatagga

SEQ ID NO: 5496465 - DNA, 17 bp, Homo sapiens
ggggagaaaattaaaag

SEQ ID NO: 5496466 - DNA, 12 bp, Homo sapiens
ggggagaaaccc

SEQ ID NO: 5496467 - DNA, 13 bp, Homo sapiens
ggggagaagccaa

SEQ ID NO: 5496468 - DNA, 18 bp, Homo sapiens
ggggagaatgcagcccac

SEQ ID NO: 5496469 - DNA, 14 bp, Homo sapiens
ggggagaatggctc

SEQ ID NO: 5496470 - DNA, 16 bp, Homo sapiens
ggggagaatggctctg

SEQ ID NO: 5496471 - DNA, 21 bp, Homo sapiens
ggggagaccgagtgtggagct

SEQ ID NO: 5496472 - DNA, 22 bp, Homo sapiens
ggggagagataatgaggcaact

SEQ ID NO: 5496473 - DNA, 16 bp, Homo sapiens
ggggagagcctgctgg

SEQ ID NO: 5496474 - DNA, 18 bp, Homo sapiens
ggggagagcctgctggca

SEQ ID NO: 5496475 - DNA, 12 bp, Homo sapiens
ggggagagctgg

SEQ ID NO: 5496476 - DNA, 12 bp, Homo sapiens
ggggagaggtca

SEQ ID NO: 5496477 - DNA, 14 bp, Homo sapiens
ggggagcaccctga

SEQ ID NO: 5496478 - DNA, 17 bp, Homo sapiens
ggggagcagagagagcc

SEQ ID NO: 5496479 - DNA, 20 bp, Homo sapiens
ggggagcagcggctctggtc

SEQ ID NO: 5496480 - DNA, 21 bp, Homo sapiens
ggggagcaggaggccaataaa

SEQ ID NO: 5496481 - DNA, 22 bp, Homo sapiens
ggggagcaggaggccaataaaa

SEQ ID NO: 5496482 - DNA, 11 bp, Homo sapiens
ggggagcaggg

SEQ ID NO: 5496483 - DNA, 23 bp, Homo sapiens
ggggagcaggtctctggcagaga

SEQ ID NO: 5496484 - DNA, 14 bp, Homo sapiens
ggggagcagtggcc

SEQ ID NO: 5496485 - DNA, 11 bp, Homo sapiens
ggggagccaga

SEQ ID NO: 5496486 - DNA, 12 bp, Homo sapiens
ggggagccagct

SEQ ID NO: 5496487 - DNA, 23 bp, Homo sapiens
ggggagccatcacctaggactga

SEQ ID NO: 5496488 - DNA, 19 bp, Homo sapiens
ggggagcccactgtcctgg

SEQ ID NO: 5496489 - DNA, 15 bp, Homo sapiens
ggggagccctcaggc

SEQ ID NO: 5496490 - DNA, 21 bp, Homo sapiens
ggggagccctcaggctcccca

SEQ ID NO: 5496491 - DNA, 12 bp, Homo sapiens
ggggagcctgga

SEQ ID NO: 5496492 - DNA, 13 bp, Homo sapiens
ggggagcctggag

SEQ ID NO: 5496493 - DNA, 13 bp, Homo sapiens
ggggagctcctgg

SEQ ID NO: 5496494 - DNA, 15 bp, Homo sapiens
ggggagctgaggggc

SEQ ID NO: 5496495 - DNA, 14 bp, Homo sapiens
ggggagctggaaat

SEQ ID NO: 5496496 - DNA, 16 bp, Homo sapiens
ggggagctggcctagg

SEQ ID NO: 5496497 - DNA, 13 bp, Homo sapiens
ggggagctggtgg

SEQ ID NO: 5496498 - DNA, 14 bp, Homo sapiens
ggggagctggtggg

SEQ ID NO: 5496499 - DNA, 15 bp, Homo sapiens
ggggagcttgggact

SEQ ID NO: 5496500 - DNA, 12 bp, Homo sapiens
ggggaggaaggg

SEQ ID NO: 5496501 - DNA, 22 bp, Homo sapiens
ggggaggaagggccaggagaga

SEQ ID NO: 5496502 - DNA, 13 bp, Homo sapiens
ggggaggaccagg

SEQ ID NO: 5496503 - DNA, 22 bp, Homo sapiens
ggggaggacccgggaccacagc

SEQ ID NO: 5496504 - DNA, 23 bp, Homo sapiens
ggggaggacggagttcagagggt

SEQ ID NO: 5496505 - DNA, 11 bp, Homo sapiens
ggggaggagaa

SEQ ID NO: 5496506 - DNA, 14 bp, Homo sapiens
ggggaggagagagg

SEQ ID NO: 5496507 - DNA, 12 bp, Homo sapiens
ggggaggagcct

SEQ ID NO: 5496508 - DNA, 19 bp, Homo sapiens
ggggaggagcctctggctt

SEQ ID NO: 5496509 - DNA, 20 bp, Homo sapiens
ggggaggaggaacgggcagc

SEQ ID NO: 5496510 - DNA, 13 bp, Homo sapiens
ggggaggaggaag

SEQ ID NO: 5496511 - DNA, 17 bp, Homo sapiens
ggggaggaggagctgcc

SEQ ID NO: 5496512 - DNA, 13 bp, Homo sapiens
ggggaggaggagg

SEQ ID NO: 5496513 - DNA, 12 bp, Homo sapiens
ggggaggagggc

SEQ ID NO: 5496514 - DNA, 14 bp, Homo sapiens
ggggaggagggggc

SEQ ID NO: 5496515 - DNA, 15 bp, Homo sapiens
ggggaggagtcaggg

SEQ ID NO: 5496516 - DNA, 15 bp, Homo sapiens
ggggaggcagcagag

SEQ ID NO: 5496517 - DNA, 16 bp, Homo sapiens
ggggaggcagggctgg

SEQ ID NO: 5496518 - DNA, 17 bp, Homo sapiens
ggggaggcagggctgga

SEQ ID NO: 5496519 - DNA, 21 bp, Homo sapiens
ggggaggccaagtgcaggctg

SEQ ID NO: 5496520 - DNA, 21 bp, Homo sapiens
ggggaggccatttgctgccct

SEQ ID NO: 5496521 - DNA, 22 bp, Homo sapiens
ggggaggccatttgctgccctg

SEQ ID NO: 5496522 - DNA, 15 bp, Homo sapiens
ggggaggcgcacagt

SEQ ID NO: 5496523 - DNA, 16 bp, Homo sapiens
ggggaggcggcactcc

SEQ ID NO: 5496524 - DNA, 13 bp, Homo sapiens
ggggaggctctga

SEQ ID NO: 5496525 - DNA, 12 bp, Homo sapiens
ggggaggctgag

SEQ ID NO: 5496526 - DNA, 13 bp, Homo sapiens
ggggaggctgaga

SEQ ID NO: 5496527 - DNA, 14 bp, Homo sapiens
ggggagggaaggga

SEQ ID NO: 5496528 - DNA, 17 bp, Homo sapiens
ggggagggaagggagcc

SEQ ID NO: 5496529 - DNA, 20 bp, Homo sapiens
ggggagggaagggagccaag

SEQ ID NO: 5496530 - DNA, 14 bp, Homo sapiens
ggggagggagagca

SEQ ID NO: 5496531 - DNA, 15 bp, Homo sapiens
ggggagggaggggaa

SEQ ID NO: 5496532 - DNA, 15 bp, Homo sapiens
ggggagggattctgg

SEQ ID NO: 5496533 - DNA, 15 bp, Homo sapiens
ggggagggcaggatg

SEQ ID NO: 5496534 - DNA, 15 bp, Homo sapiens
ggggagggctcctgg

SEQ ID NO: 5496535 - DNA, 13 bp, Homo sapiens
ggggaggggaagg

SEQ ID NO: 5496536 - DNA, 14 bp, Homo sapiens
ggggaggggccctc

SEQ ID NO: 5496537 - DNA, 15 bp, Homo sapiens
ggggaggggcctagg

SEQ ID NO: 5496538 - DNA, 22 bp, Homo sapiens
ggggaggggcctttgctgccct

SEQ ID NO: 5496539 - DNA, 13 bp, Homo sapiens
ggggaggggcgct

SEQ ID NO: 5496540 - DNA, 20 bp, Homo sapiens
ggggaggggcgctggcccag

SEQ ID NO: 5496541 - DNA, 14 bp, Homo sapiens
ggggaggggctctg

SEQ ID NO: 5496542 - DNA, 18 bp, Homo sapiens
ggggaggggctgtgggcg

SEQ ID NO: 5496543 - DNA, 12 bp, Homo sapiens
ggggagggggac

SEQ ID NO: 5496544 - DNA, 14 bp, Homo sapiens
ggggaggggggagg

SEQ ID NO: 5496545 - DNA, 20 bp, Homo sapiens
ggggagggtcaagggctggg

SEQ ID NO: 5496546 - DNA, 23 bp, Homo sapiens
ggggagggtcttttaccctgtgt

SEQ ID NO: 5496547 - DNA, 13 bp, Homo sapiens
ggggaggtgcctg

SEQ ID NO: 5496548 - DNA, 19 bp, Homo sapiens
ggggaggtgcctgagctgg

SEQ ID NO: 5496549 - DNA, 17 bp, Homo sapiens
ggggaggtgctggggga

SEQ ID NO: 5496550 - DNA, 13 bp, Homo sapiens
ggggaggtggcca

SEQ ID NO: 5496551 - DNA, 19 bp, Homo sapiens
ggggaggttttctccccca

SEQ ID NO: 5496552 - DNA, 22 bp, Homo sapiens
ggggagtaaacggcccaggcca

SEQ ID NO: 5496553 - DNA, 14 bp, Homo sapiens
ggggagtagtggag

SEQ ID NO: 5496554 - DNA, 14 bp, Homo sapiens
ggggagtatgcaaa

SEQ ID NO: 5496555 - DNA, 15 bp, Homo sapiens
ggggagtcccaaagc

SEQ ID NO: 5496556 - DNA, 14 bp, Homo sapiens
ggggagtgaaacag

SEQ ID NO: 5496557 - DNA, 22 bp, Homo sapiens
ggggagtgtacagacccctgcc

SEQ ID NO: 5496558 - DNA, 21 bp, Homo sapiens
ggggagttgagtcacaagagg

SEQ ID NO: 5496559 - DNA, 14 bp, Homo sapiens
ggggccaggctggg

SEQ ID NO: 5496560 - DNA, 22 bp, Homo sapiens
ggggccagggctggatggacag

SEQ ID NO: 5496561 - DNA, 22 bp, Homo sapiens
ggggccaggggttctgagaagc

SEQ ID NO: 5496562 - DNA, 18 bp, Homo sapiens
ggggccagtgagggctgg

SEQ ID NO: 5496563 - DNA, 22 bp, Homo sapiens
ggggccagtggattcccacagc

SEQ ID NO: 5496564 - DNA, 10 bp, Homo sapiens
ggggccatca

SEQ ID NO: 5496565 - DNA, 23 bp, Homo sapiens
ggggccatcacaggatgccagcc

SEQ ID NO: 5496566 - DNA, 20 bp, Homo sapiens
ggggccatgagctccagacc

SEQ ID NO: 5496567 - DNA, 17 bp, Homo sapiens
ggggccatgcctcctca

SEQ ID NO: 5496568 - DNA, 23 bp, Homo sapiens
ggggccatgcctcctcaggagcc

SEQ ID NO: 5496569 - DNA, 14 bp, Homo sapiens
ggggccatggaagc

SEQ ID NO: 5496570 - DNA, 13 bp, Homo sapiens
ggggccatggtgg

SEQ ID NO: 5496571 - DNA, 19 bp, Homo sapiens
ggggccatggtggagggca

SEQ ID NO: 5496572 - DNA, 21 bp, Homo sapiens
ggggccatttgcaataacagc

SEQ ID NO: 5496573 - DNA, 21 bp, Homo sapiens
ggggccatttggccggctctg

SEQ ID NO: 5496574 - DNA, 17 bp, Homo sapiens
ggggcccaaaggggagc

SEQ ID NO: 5496575 - DNA, 20 bp, Homo sapiens
ggggcccaaatgctggctgg

SEQ ID NO: 5496576 - DNA, 18 bp, Homo sapiens
ggggcccaagagagacag

SEQ ID NO: 5496577 - DNA, 19 bp, Homo sapiens
ggggcccaaggcggcccct

SEQ ID NO: 5496578 - DNA, 22 bp, Homo sapiens
ggggcccaaggcggcccctccc

SEQ ID NO: 5496579 - DNA, 23 bp, Homo sapiens
ggggcccaagtggggtgctctgg

SEQ ID NO: 5496580 - DNA, 22 bp, Homo sapiens
ggggcccaagttgcagtgagca

SEQ ID NO: 5496581 - DNA, 19 bp, Homo sapiens
ggggcccacaaaggggaga

SEQ ID NO: 5496582 - DNA, 23 bp, Homo sapiens
ggggcccaccctctgcccaggga

SEQ ID NO: 5496583 - DNA, 18 bp, Homo sapiens
ggggcccagcgctctcct

SEQ ID NO: 5496584 - DNA, 12 bp, Homo sapiens
ggggcccaggaa

SEQ ID NO: 5496585 - DNA, 14 bp, Homo sapiens
ggggcccaggaagc

SEQ ID NO: 5496586 - DNA, 17 bp, Homo sapiens
ggggcccaggggaggcg

SEQ ID NO: 5496587 - DNA, 14 bp, Homo sapiens
ggggcccagtgcat

SEQ ID NO: 5496588 - DNA, 17 bp, Homo sapiens
ggggcccatgaaagagg

SEQ ID NO: 5496589 - DNA, 20 bp, Homo sapiens
ggggcccatggccccagctg

SEQ ID NO: 5496590 - DNA, 18 bp, Homo sapiens
ggggcccatgtgggctga

SEQ ID NO: 5496591 - DNA, 18 bp, Homo sapiens
ggggcccattctgcatgc

SEQ ID NO: 5496592 - DNA, 18 bp, Homo sapiens
ggggccccaaagcccagc

SEQ ID NO: 5496593 - DNA, 19 bp, Homo sapiens
ggggccccaaagcccagcc

SEQ ID NO: 5496594 - DNA, 20 bp, Homo sapiens
ggggccccaaagcccagccc

SEQ ID NO: 5496595 - DNA, 21 bp, Homo sapiens
ggggccccaaagcccagcccg

SEQ ID NO: 5496596 - DNA, 18 bp, Homo sapiens
ggggccccagatctgcct

SEQ ID NO: 5496597 - DNA, 21 bp, Homo sapiens
ggggccccagatctgcctggg

SEQ ID NO: 5496598 - DNA, 22 bp, Homo sapiens
ggggccccagatctgcctgggc

SEQ ID NO: 5496599 - DNA, 21 bp, Homo sapiens
ggggccccagcgtctgcaggg

SEQ ID NO: 5496600 - DNA, 14 bp, Homo sapiens
ggggccccagggct

SEQ ID NO: 5496601 - DNA, 20 bp, Homo sapiens
ggggccccatggcagctcct

SEQ ID NO: 5496602 - DNA, 13 bp, Homo sapiens
ggggccccctggt

SEQ ID NO: 5496603 - DNA, 18 bp, Homo sapiens
ggggccccgccagggctg

SEQ ID NO: 5496604 - DNA, 19 bp, Homo sapiens
ggggccccgccagggctgg

SEQ ID NO: 5496605 - DNA, 18 bp, Homo sapiens
ggggccccggtcctggcc

SEQ ID NO: 5496606 - DNA, 16 bp, Homo sapiens
ggggccccgtctcagg

SEQ ID NO: 5496607 - DNA, 15 bp, Homo sapiens
ggggcccctcctctg

SEQ ID NO: 5496608 - DNA, 17 bp, Homo sapiens
ggggcccctctcagccc

SEQ ID NO: 5496609 - DNA, 11 bp, Homo sapiens
ggggcccctgc

SEQ ID NO: 5496610 - DNA, 14 bp, Homo sapiens
ggggcccgaacagg

SEQ ID NO: 5496611 - DNA, 18 bp, Homo sapiens
ggggcccgcctgccacct

SEQ ID NO: 5496612 - DNA, 21 bp, Homo sapiens
ggggcccgcctggcagaactg

SEQ ID NO: 5496613 - DNA, 23 bp, Homo sapiens
ggggcccgcctggcagaactgag

SEQ ID NO: 5496614 - DNA, 15 bp, Homo sapiens
ggggcccgcttgcct

SEQ ID NO: 5496615 - DNA, 23 bp, Homo sapiens
ggggcccggacgcccaggacccc

SEQ ID NO: 5496616 - DNA, 15 bp, Homo sapiens
ggggcccggagatag

SEQ ID NO: 5496617 - DNA, 15 bp, Homo sapiens
ggggcccggccagcc

SEQ ID NO: 5496618 - DNA, 22 bp, Homo sapiens
ggggcccgttgtctccctggcc

SEQ ID NO: 5496619 - DNA, 20 bp, Homo sapiens
ggggccctctatgctggctt

SEQ ID NO: 5496620 - DNA, 19 bp, Homo sapiens
ggggccctcttgccagcct

SEQ ID NO: 5496621 - DNA, 19 bp, Homo sapiens
ggggccctgccccacccca

SEQ ID NO: 5496622 - DNA, 23 bp, Homo sapiens
ggggccctgcctcctttgtgagg

SEQ ID NO: 5496623 - DNA, 13 bp, Homo sapiens
ggggccctgctac

SEQ ID NO: 5496624 - DNA, 20 bp, Homo sapiens
ggggccctgtcactgtccag

SEQ ID NO: 5496625 - DNA, 12 bp, Homo sapiens
ggggcccttggc

SEQ ID NO: 5496626 - DNA, 22 bp, Homo sapiens
ggggcccttggccccagaggac

SEQ ID NO: 5496627 - DNA, 22 bp, Homo sapiens
ggggcccttgggacagccagag

SEQ ID NO: 5496628 - DNA, 21 bp, Homo sapiens
ggggcccttgggccacgctct

SEQ ID NO: 5496629 - DNA, 20 bp, Homo sapiens
ggggcccttggggcctggct

SEQ ID NO: 5496630 - DNA, 21 bp, Homo sapiens
ggggccgagtccaggagcccc

SEQ ID NO: 5496631 - DNA, 21 bp, Homo sapiens
ggggccgatgcccagagacac

SEQ ID NO: 5496632 - DNA, 18 bp, Homo sapiens
ggggccgccacggcctgg

SEQ ID NO: 5496633 - DNA, 17 bp, Homo sapiens
ggggccgcctgccctgc

SEQ ID NO: 5496634 - DNA, 22 bp, Homo sapiens
ggggccgctgccacccacctcc

SEQ ID NO: 5496635 - DNA, 15 bp, Homo sapiens
ggggccgctggccca

SEQ ID NO: 5496636 - DNA, 19 bp, Homo sapiens
ggggccgctggcccagggt

SEQ ID NO: 5496637 - DNA, 14 bp, Homo sapiens
ggggccgggactgg

SEQ ID NO: 5496638 - DNA, 13 bp, Homo sapiens
ggggccgggcaca

SEQ ID NO: 5496639 - DNA, 17 bp, Homo sapiens
ggggccgggcaggtcct

SEQ ID NO: 5496640 - DNA, 23 bp, Homo sapiens
ggggccgggcaggtcctgcccat

SEQ ID NO: 5496641 - DNA, 14 bp, Homo sapiens
ggggccggggaggg

SEQ ID NO: 5496642 - DNA, 23 bp, Homo sapiens
ggggccggtagaggctccccagg

SEQ ID NO: 5496643 - DNA, 16 bp, Homo sapiens
ggggccgtgcagggcc

SEQ ID NO: 5496644 - DNA, 18 bp, Homo sapiens
ggggccgtgggggttgag

SEQ ID NO: 5496645 - DNA, 23 bp, Homo sapiens
ggggcctacagctttgatccctg

SEQ ID NO: 5496646 - DNA, 13 bp, Homo sapiens
ggggcctagggag

SEQ ID NO: 5496647 - DNA, 17 bp, Homo sapiens
ggggcctagggagccgc

SEQ ID NO: 5496648 - DNA, 23 bp, Homo sapiens
ggggcctatcagtgtgcccccca

SEQ ID NO: 5496649 - DNA, 15 bp, Homo sapiens
ggggcctcagtgcca

SEQ ID NO: 5496650 - DNA, 19 bp, Homo sapiens
ggggcctcccggggcccag

SEQ ID NO: 5496651 - DNA, 13 bp, Homo sapiens
ggggcctccctcc

SEQ ID NO: 5496652 - DNA, 14 bp, Homo sapiens
ggggcctcctcagc

SEQ ID NO: 5496653 - DNA, 16 bp, Homo sapiens
ggggcctcctcctagg

SEQ ID NO: 5496654 - DNA, 20 bp, Homo sapiens
ggggcctccttgtccaggtc

SEQ ID NO: 5496655 - DNA, 22 bp, Homo sapiens
ggggcctccttgtccaggtctc

SEQ ID NO: 5496656 - DNA, 22 bp, Homo sapiens
ggggcctctgcctccaggaggg

SEQ ID NO: 5496657 - DNA, 21 bp, Homo sapiens
ggggcctgacctccccctcct

SEQ ID NO: 5496658 - DNA, 19 bp, Homo sapiens
ggggcctgactaggaaaag

SEQ ID NO: 5496659 - DNA, 21 bp, Homo sapiens
ggggcctgactaggaaaagtt

SEQ ID NO: 5496660 - DNA, 16 bp, Homo sapiens
ggggcctgaggcaagc

SEQ ID NO: 5496661 - DNA, 15 bp, Homo sapiens
ggggcctgcagaagg

SEQ ID NO: 5496662 - DNA, 13 bp, Homo sapiens
ggggcctgcaggc

SEQ ID NO: 5496663 - DNA, 21 bp, Homo sapiens
ggggcctggacaggcgggctc

SEQ ID NO: 5496664 - DNA, 14 bp, Homo sapiens
ggggcctggactgg

SEQ ID NO: 5496665 - DNA, 12 bp, Homo sapiens
ggggcctggaga

SEQ ID NO: 5496666 - DNA, 19 bp, Homo sapiens
ggggcctggagatcctcct

SEQ ID NO: 5496667 - DNA, 13 bp, Homo sapiens
ggggcctggcagg

SEQ ID NO: 5496668 - DNA, 11 bp, Homo sapiens
ggggcctggcg

SEQ ID NO: 5496669 - DNA, 11 bp, Homo sapiens
ggggcctggct

SEQ ID NO: 5496670 - DNA, 22 bp, Homo sapiens
ggggcctggctggctgagggca

SEQ ID NO: 5496671 - DNA, 18 bp, Homo sapiens
ggggcctgggaaaggaaa

SEQ ID NO: 5496672 - DNA, 13 bp, Homo sapiens
ggggcctgggaca

SEQ ID NO: 5496673 - DNA, 16 bp, Homo sapiens
ggggcctgggacttcc

SEQ ID NO: 5496674 - DNA, 12 bp, Homo sapiens
ggggcctgggag

SEQ ID NO: 5496675 - DNA, 22 bp, Homo sapiens
ggggcctgggagggttcccctg

SEQ ID NO: 5496676 - DNA, 15 bp, Homo sapiens
ggggcctgggcagga

SEQ ID NO: 5496677 - DNA, 12 bp, Homo sapiens
ggggcctgggcc

SEQ ID NO: 5496678 - DNA, 17 bp, Homo sapiens
ggggcctgggcggggcc

SEQ ID NO: 5496679 - DNA, 12 bp, Homo sapiens
ggggcctgggct

SEQ ID NO: 5496680 - DNA, 14 bp, Homo sapiens
ggggcctggggagc

SEQ ID NO: 5496681 - DNA, 14 bp, Homo sapiens
ggggcctggggtag

SEQ ID NO: 5496682 - DNA, 20 bp, Homo sapiens
ggggcctggggtaggaggaa

SEQ ID NO: 5496683 - DNA, 18 bp, Homo sapiens
ggggccttcctggctttg

SEQ ID NO: 5496684 - DNA, 22 bp, Homo sapiens
ggggccttccttttgaggagct

SEQ ID NO: 5496685 - DNA, 22 bp, Homo sapiens
ggggccttgcggaagccatagg

SEQ ID NO: 5496686 - DNA, 16 bp, Homo sapiens
ggggccttgctctgag

SEQ ID NO: 5496687 - DNA, 17 bp, Homo sapiens
ggggccttgctctgagc

SEQ ID NO: 5496688 - DNA, 19 bp, Homo sapiens
ggggcctttgccagcagag

SEQ ID NO: 5496689 - DNA, 21 bp, Homo sapiens
ggggcctttgccagcagagcc

SEQ ID NO: 5496690 - DNA, 19 bp, Homo sapiens
ggggcctttgctgcccttg

SEQ ID NO: 5496691 - DNA, 20 bp, Homo sapiens
ggggcgacccctcagtgctc

SEQ ID NO: 5496692 - DNA, 16 bp, Homo sapiens
ggggcgaggcccctcc

SEQ ID NO: 5496693 - DNA, 14 bp, Homo sapiens
ggggcgagggaggg

SEQ ID NO: 5496694 - DNA, 18 bp, Homo sapiens
ggggcgatgctccctcag

SEQ ID NO: 5496695 - DNA, 17 bp, Homo sapiens
ggggcgcctagagcgcg

SEQ ID NO: 5496696 - DNA, 14 bp, Homo sapiens
ggggcgcctggagg

SEQ ID NO: 5496697 - DNA, 17 bp, Homo sapiens
ggggcgcgcgcccccag

SEQ ID NO: 5496698 - DNA, 21 bp, Homo sapiens
ggggcgctcaggacccaggcc

SEQ ID NO: 5496699 - DNA, 13 bp, Homo sapiens
ggggcgctgcccc

SEQ ID NO: 5496700 - DNA, 15 bp, Homo sapiens
ggggcgctggcccag

SEQ ID NO: 5496701 - DNA, 18 bp, Homo sapiens
ggggcgctggcccagccg

SEQ ID NO: 5496702 - DNA, 23 bp, Homo sapiens
ggggcgctggcccagccggcctc

SEQ ID NO: 5496703 - DNA, 16 bp, Homo sapiens
ggggcgctgtcctgcg

SEQ ID NO: 5496704 - DNA, 18 bp, Homo sapiens
ggggcggccagccctccc

SEQ ID NO: 5496705 - DNA, 14 bp, Homo sapiens
ggggcggcccagcc

SEQ ID NO: 5496706 - DNA, 16 bp, Homo sapiens
ggggcgggagtgatga

SEQ ID NO: 5496707 - DNA, 14 bp, Homo sapiens
ggggcgggccaggg

SEQ ID NO: 5496708 - DNA, 19 bp, Homo sapiens
ggggcgggcggagggaggg

SEQ ID NO: 5496709 - DNA, 17 bp, Homo sapiens
ggggcgggctcagagct

SEQ ID NO: 5496710 - DNA, 14 bp, Homo sapiens
ggggcggggcagga

SEQ ID NO: 5496711 - DNA, 15 bp, Homo sapiens
ggggcggggcttctc

SEQ ID NO: 5496712 - DNA, 15 bp, Homo sapiens
ggggcgggggcggag

SEQ ID NO: 5496713 - DNA, 15 bp, Homo sapiens
ggggcgggtgacgcc

SEQ ID NO: 5496714 - DNA, 17 bp, Homo sapiens
ggggcggtgtcaggtcc

SEQ ID NO: 5496715 - DNA, 19 bp, Homo sapiens
ggggcgtggctggcctttc

SEQ ID NO: 5496716 - DNA, 15 bp, Homo sapiens
ggggcgtggggaggg

SEQ ID NO: 5496717 - DNA, 15 bp, Homo sapiens
ggggcgtgtccctcc

SEQ ID NO: 5496718 - DNA, 17 bp, Homo sapiens
ggggctaacgggcgcct

SEQ ID NO: 5496719 - DNA, 15 bp, Homo sapiens
ggggctaactggccc

SEQ ID NO: 5496720 - DNA, 21 bp, Homo sapiens
ggggctaagcggtggaggaag

SEQ ID NO: 5496721 - DNA, 14 bp, Homo sapiens
ggggctaccaggaa

SEQ ID NO: 5496722 - DNA, 14 bp, Homo sapiens
ggggctagaaccta

SEQ ID NO: 5496723 - DNA, 16 bp, Homo sapiens
ggggctagactgggct

SEQ ID NO: 5496724 - DNA, 17 bp, Homo sapiens
ggggctaggggctggtc

SEQ ID NO: 5496725 - DNA, 16 bp, Homo sapiens
ggggctatgccttgtc

SEQ ID NO: 5496726 - DNA, 17 bp, Homo sapiens
ggggctcactctggccc

SEQ ID NO: 5496727 - DNA, 15 bp, Homo sapiens
ggggctcagcaaggc

SEQ ID NO: 5496728 - DNA, 15 bp, Homo sapiens
ggggctcagcaaggt

SEQ ID NO: 5496729 - DNA, 14 bp, Homo sapiens
ggggctcagccctg

SEQ ID NO: 5496730 - DNA, 19 bp, Homo sapiens
ggggctcagccctgagctg

SEQ ID NO: 5496731 - DNA, 18 bp, Homo sapiens
ggggctccatggaggagg

SEQ ID NO: 5496732 - DNA, 13 bp, Homo sapiens
ggggctcccagcc

SEQ ID NO: 5496733 - DNA, 20 bp, Homo sapiens
ggggctccccttgcccttcc

SEQ ID NO: 5496734 - DNA, 13 bp, Homo sapiens
ggggctcccgccc

SEQ ID NO: 5496735 - DNA, 20 bp, Homo sapiens
ggggctcccgcctccaaccc

SEQ ID NO: 5496736 - DNA, 12 bp, Homo sapiens
gggggcagaagt

SEQ ID NO: 5496737 - DNA, 21 bp, Homo sapiens
gggggcagaccagagagctca

SEQ ID NO: 5496738 - DNA, 19 bp, Homo sapiens
gggggcaggggcaggggcg

SEQ ID NO: 5496739 - DNA, 22 bp, Homo sapiens
gggggcatctgagtccagctcc

SEQ ID NO: 5496740 - DNA, 23 bp, Homo sapiens
gggggcatctgagtccagctccc

SEQ ID NO: 5496741 - DNA, 12 bp, Homo sapiens
gggggccacctg

SEQ ID NO: 5496742 - DNA, 12 bp, Homo sapiens
gggggccactgt

SEQ ID NO: 5496743 - DNA, 14 bp, Homo sapiens
gggggccagacaca

SEQ ID NO: 5496744 - DNA, 14 bp, Homo sapiens
gggggccagctggg

SEQ ID NO: 5496745 - DNA, 18 bp, Homo sapiens
gggggccagctggtgctg

SEQ ID NO: 5496746 - DNA, 13 bp, Homo sapiens
gggggccaggcct

SEQ ID NO: 5496747 - DNA, 16 bp, Homo sapiens
gggggccaggcctcgc

SEQ ID NO: 5496748 - DNA, 19 bp, Homo sapiens
gggggccagggctggatgg

SEQ ID NO: 5496749 - DNA, 20 bp, Homo sapiens
gggggccagggctggatgga

SEQ ID NO: 5496750 - DNA, 14 bp, Homo sapiens
gggggccaggtgca

SEQ ID NO: 5496751 - DNA, 14 bp, Homo sapiens
gggggccatgagct

SEQ ID NO: 5496752 - DNA, 21 bp, Homo sapiens
gggggccatgttcccagaacc

SEQ ID NO: 5496753 - DNA, 12 bp, Homo sapiens
gggggccctgct

SEQ ID NO: 5496754 - DNA, 13 bp, Homo sapiens
gggggccctgcta

SEQ ID NO: 5496755 - DNA, 18 bp, Homo sapiens
gggggccctggggtcccc

SEQ ID NO: 5496756 - DNA, 20 bp, Homo sapiens
gggggccgctctccccctgc

SEQ ID NO: 5496757 - DNA, 23 bp, Homo sapiens
gggggccgctggcccagggtagg

SEQ ID NO: 5496758 - DNA, 17 bp, Homo sapiens
gggggcctcagtgccac

SEQ ID NO: 5496759 - DNA, 14 bp, Homo sapiens
gggggcctcctcct

SEQ ID NO: 5496760 - DNA, 16 bp, Homo sapiens
gggggcctctgcctcc

SEQ ID NO: 5496761 - DNA, 10 bp, Homo sapiens
gggggcctgg

SEQ ID NO: 5496762 - DNA, 15 bp, Homo sapiens
gggggcctggatgcc

SEQ ID NO: 5496763 - DNA, 11 bp, Homo sapiens
gggggcctggc

SEQ ID NO: 5496764 - DNA, 12 bp, Homo sapiens
gggggcctggct

SEQ ID NO: 5496765 - DNA, 15 bp, Homo sapiens
gggggcctggctggc

SEQ ID NO: 5496766 - DNA, 18 bp, Homo sapiens
gggggccttgcggaagcc

SEQ ID NO: 5496767 - DNA, 13 bp, Homo sapiens
gggggcgcctgga

SEQ ID NO: 5496768 - DNA, 20 bp, Homo sapiens
gggggcgctattgcttcagc

SEQ ID NO: 5496769 - DNA, 23 bp, Homo sapiens
gggggcgctcaggacccaggccc

SEQ ID NO: 5496770 - DNA, 15 bp, Homo sapiens
gggggcggcctatga

SEQ ID NO: 5496771 - DNA, 13 bp, Homo sapiens
gggggcggctctg

SEQ ID NO: 5496772 - DNA, 14 bp, Homo sapiens
gggggcggctgagc

SEQ ID NO: 5496773 - DNA, 21 bp, Homo sapiens
gggggcggctgagctccagcc

SEQ ID NO: 5496774 - DNA, 19 bp, Homo sapiens
gggggcggggctgtcacca

SEQ ID NO: 5496775 - DNA, 18 bp, Homo sapiens
gggggcgtggctggcctt

SEQ ID NO: 5496776 - DNA, 20 bp, Homo sapiens
gggggctaggggagggggga

SEQ ID NO: 5496777 - DNA, 22 bp, Homo sapiens
gggggctatagctacaggaagc

SEQ ID NO: 5496778 - DNA, 21 bp, Homo sapiens
gggggctatttctctccccac

SEQ ID NO: 5496779 - DNA, 20 bp, Homo sapiens
gggggctcagcaaggccacc

SEQ ID NO: 5496780 - DNA, 20 bp, Homo sapiens
gggggctcagttctggactg

SEQ ID NO: 5496781 - DNA, 12 bp, Homo sapiens
gggggctccaga

SEQ ID NO: 5496782 - DNA, 19 bp, Homo sapiens
gggggctccagggggtgcc

SEQ ID NO: 5496783 - DNA, 20 bp, Homo sapiens
gggggctcggggaggcagag

SEQ ID NO: 5496784 - DNA, 12 bp, Homo sapiens
gggggctctcca

SEQ ID NO: 5496785 - DNA, 13 bp, Homo sapiens
gggggctctgcct

SEQ ID NO: 5496786 - DNA, 14 bp, Homo sapiens
gggggctctggcca

SEQ ID NO: 5496787 - DNA, 19 bp, Homo sapiens
gggggctcttcccctagac

SEQ ID NO: 5496788 - DNA, 14 bp, Homo sapiens
gggggctgatggct

SEQ ID NO: 5496789 - DNA, 23 bp, Homo sapiens
gggggctgctctgcaagcccact

SEQ ID NO: 5496790 - DNA, 24 bp, Homo sapiens
gggggctgctgggcgtctgttctt

SEQ ID NO: 5496791 - DNA, 16 bp, Homo sapiens
gggggctggaggagcc

SEQ ID NO: 5496792 - DNA, 15 bp, Homo sapiens
gggggctgggcagag

SEQ ID NO: 5496793 - DNA, 23 bp, Homo sapiens
gggggctgttagctcagaggaga

SEQ ID NO: 5496794 - DNA, 14 bp, Homo sapiens
gggggcttcttcct

SEQ ID NO: 5496795 - DNA, 16 bp, Homo sapiens
gggggcttggctcgca

SEQ ID NO: 5496796 - DNA, 23 bp, Homo sapiens
gggggctttcggggagggcgcct

SEQ ID NO: 5496797 - DNA, 17 bp, Homo sapiens
ggggggaaagaaaagga

SEQ ID NO: 5496798 - DNA, 13 bp, Homo sapiens
ggggggacagtgc

SEQ ID NO: 5496799 - DNA, 11 bp, Homo sapiens
ggggggagaaa

SEQ ID NO: 5496800 - DNA, 10 bp, Homo sapiens
ggggggaggc

SEQ ID NO: 5496801 - DNA, 12 bp, Homo sapiens
ggggggagggca

SEQ ID NO: 5496802 - DNA, 12 bp, Homo sapiens
ggggggccaggg

SEQ ID NO: 5496803 - DNA, 12 bp, Homo sapiens
ggggggccgctc

SEQ ID NO: 5496804 - DNA, 11 bp, Homo sapiens
ggggggcggct

SEQ ID NO: 5496805 - DNA, 16 bp, Homo sapiens
ggggggctcctgccca

SEQ ID NO: 5496806 - DNA, 17 bp, Homo sapiens
ggggggctcctgcccag

SEQ ID NO: 5496807 - DNA, 13 bp, Homo sapiens
gggggggctgcct

SEQ ID NO: 5496808 - DNA, 17 bp, Homo sapiens
gggggtactagaagctg

SEQ ID NO: 5496809 - DNA, 14 bp, Homo sapiens
gggggtaggagagc

SEQ ID NO: 5496810 - DNA, 14 bp, Homo sapiens
gggggtcacaggcc

SEQ ID NO: 5496811 - DNA, 17 bp, Homo sapiens
gggggtcacaggcccag

SEQ ID NO: 5496812 - DNA, 14 bp, Homo sapiens
gggggtcacccatg

SEQ ID NO: 5496813 - DNA, 18 bp, Homo sapiens
gggggtcaggaggcaggg

SEQ ID NO: 5496814 - DNA, 18 bp, Homo sapiens
gggggtcccagtgggagg

SEQ ID NO: 5496815 - DNA, 21 bp, Homo sapiens
gggggtccgtggtagaggcct

SEQ ID NO: 5496816 - DNA, 18 bp, Homo sapiens
gggggtcctcctccaggg

SEQ ID NO: 5496817 - DNA, 19 bp, Homo sapiens
gggggtcctcctccaggga

SEQ ID NO: 5496818 - DNA, 22 bp, Homo sapiens
gggggtcctctctgagtcaaat

SEQ ID NO: 5496819 - DNA, 18 bp, Homo sapiens
gggggtctatacattcct

SEQ ID NO: 5496820 - DNA, 16 bp, Homo sapiens
gggggtctggctggtg

SEQ ID NO: 5496821 - DNA, 21 bp, Homo sapiens
gggggtgacagtcctccatcc

SEQ ID NO: 5496822 - DNA, 12 bp, Homo sapiens
gggggtgactgg

SEQ ID NO: 5496823 - DNA, 22 bp, Homo sapiens
gggggtgcaaagactctgagcc

SEQ ID NO: 5496824 - DNA, 18 bp, Homo sapiens
gggggtgcggcaggagca

SEQ ID NO: 5496825 - DNA, 13 bp, Homo sapiens
gggggtgctggcc

SEQ ID NO: 5496826 - DNA, 14 bp, Homo sapiens
gggggtgctggggc

SEQ ID NO: 5496827 - DNA, 23 bp, Homo sapiens
gggggtggagagaccagcctttc

SEQ ID NO: 5496828 - DNA, 13 bp, Homo sapiens
gggggtggaggct

SEQ ID NO: 5496829 - DNA, 13 bp, Homo sapiens
gggggtggccgct

SEQ ID NO: 5496830 - DNA, 19 bp, Homo sapiens
gggggtgggggctgtcctg

SEQ ID NO: 5496831 - DNA, 22 bp, Homo sapiens
gggggtgtcacagaggcagtgg

SEQ ID NO: 5496832 - DNA, 16 bp, Homo sapiens
gggggtttgagccctg

SEQ ID NO: 5496833 - DNA, 23 bp, Homo sapiens
gggggtttgaggaccctcccagg

SEQ ID NO: 5496834 - DNA, 18 bp, Homo sapiens
ggggtaaagtttgctcta

SEQ ID NO: 5496835 - DNA, 18 bp, Homo sapiens
ggggtaaatatatgtttt

SEQ ID NO: 5496836 - DNA, 23 bp, Homo sapiens
ggggtaaatatatgttttgagaa

SEQ ID NO: 5496837 - DNA, 19 bp, Homo sapiens
ggggtaagccagagcctgg

SEQ ID NO: 5496838 - DNA, 16 bp, Homo sapiens
ggggtaccacatggtc

SEQ ID NO: 5496839 - DNA, 21 bp, Homo sapiens
ggggtaccagccactggaggg

SEQ ID NO: 5496840 - DNA, 23 bp, Homo sapiens
ggggtagaggaagacgagacagg

SEQ ID NO: 5496841 - DNA, 14 bp, Homo sapiens
ggggtagaggctgg

SEQ ID NO: 5496842 - DNA, 16 bp, Homo sapiens
ggggtagccccgcccc

SEQ ID NO: 5496843 - DNA, 19 bp, Homo sapiens
ggggtagccccgccccagc

SEQ ID NO: 5496844 - DNA, 19 bp, Homo sapiens
ggggtagctagaggaacca

SEQ ID NO: 5496845 - DNA, 22 bp, Homo sapiens
ggggtaggaaaccaccctgagg

SEQ ID NO: 5496846 - DNA, 15 bp, Homo sapiens
ggggtaggagaggag

SEQ ID NO: 5496847 - DNA, 13 bp, Homo sapiens
ggggtaggaggaa

SEQ ID NO: 5496848 - DNA, 13 bp, Homo sapiens
ggggtagggggct

SEQ ID NO: 5496849 - DNA, 14 bp, Homo sapiens
ggggtatgaagagc

SEQ ID NO: 5496850 - DNA, 18 bp, Homo sapiens
ggggtattttaggcaggg

SEQ ID NO: 5496851 - DNA, 14 bp, Homo sapiens
ggggtcaaaggaag

SEQ ID NO: 5496852 - DNA, 17 bp, Homo sapiens
ggggtcaagctgagctg

SEQ ID NO: 5496853 - DNA, 15 bp, Homo sapiens
ggggtcacaggccca

SEQ ID NO: 5496854 - DNA, 22 bp, Homo sapiens
ggggtcaccttgagaggcatga

SEQ ID NO: 5496855 - DNA, 22 bp, Homo sapiens
ggggtcacttgggaagaggact

SEQ ID NO: 5496856 - DNA, 20 bp, Homo sapiens
ggggtcagagcactccctaa

SEQ ID NO: 5496857 - DNA, 13 bp, Homo sapiens
ggggtcagcccca

SEQ ID NO: 5496858 - DNA, 19 bp, Homo sapiens
ggggtcagccccaagggct

SEQ ID NO: 5496859 - DNA, 20 bp, Homo sapiens
ggggtcagccccaagggctg

SEQ ID NO: 5496860 - DNA, 16 bp, Homo sapiens
ggggtcatataaaata

SEQ ID NO: 5496861 - DNA, 19 bp, Homo sapiens
ggggtcatgccctcctctc

SEQ ID NO: 5496862 - DNA, 13 bp, Homo sapiens
ggggtccaccagt

SEQ ID NO: 5496863 - DNA, 18 bp, Homo sapiens
ggggtccacccagcaaag

SEQ ID NO: 5496864 - DNA, 17 bp, Homo sapiens
ggggtccagggagcagg

SEQ ID NO: 5496865 - DNA, 12 bp, Homo sapiens
ggggtccagggc

SEQ ID NO: 5496866 - DNA, 13 bp, Homo sapiens
ggggtccagtgca

SEQ ID NO: 5496867 - DNA, 18 bp, Homo sapiens
ggggtccatccccttccc

SEQ ID NO: 5496868 - DNA, 12 bp, Homo sapiens
ggggtcccagca

SEQ ID NO: 5496869 - DNA, 18 bp, Homo sapiens
ggggtcccagcagctgcc

SEQ ID NO: 5496870 - DNA, 13 bp, Homo sapiens
ggggtcccagtgg

SEQ ID NO: 5496871 - DNA, 16 bp, Homo sapiens
ggggtcccatcagtga

SEQ ID NO: 5496872 - DNA, 22 bp, Homo sapiens
ggggtccctagcagcccaccct

SEQ ID NO: 5496873 - DNA, 18 bp, Homo sapiens
ggggtccctccaccccac

SEQ ID NO: 5496874 - DNA, 22 bp, Homo sapiens
ggggtccctggagggcaagccc

SEQ ID NO: 5496875 - DNA, 20 bp, Homo sapiens
ggggtccgtcttcacactgc

SEQ ID NO: 5496876 - DNA, 19 bp, Homo sapiens
ggggtccgtggtagaggcc

SEQ ID NO: 5496877 - DNA, 22 bp, Homo sapiens
ggggtccgtggtagaggcctgg

SEQ ID NO: 5496878 - DNA, 23 bp, Homo sapiens
ggggtccgtggtagaggcctggg

SEQ ID NO: 5496879 - DNA, 14 bp, Homo sapiens
ggggtcctagccca

SEQ ID NO: 5496880 - DNA, 15 bp, Homo sapiens
ggggtcctagcccag

SEQ ID NO: 5496881 - DNA, 23 bp, Homo sapiens
ggggtcctcctccagggacagca

SEQ ID NO: 5496882 - DNA, 21 bp, Homo sapiens
ggggtcctcctcgctcctcct

SEQ ID NO: 5496883 - DNA, 22 bp, Homo sapiens
ggggtcctcctgtgctatttgt

SEQ ID NO: 5496884 - DNA, 23 bp, Homo sapiens
ggggtcctctctgagtcaaatcc

SEQ ID NO: 5496885 - DNA, 16 bp, Homo sapiens
ggggtcctgaggctgg

SEQ ID NO: 5496886 - DNA, 14 bp, Homo sapiens
ggggtcctggccat

SEQ ID NO: 5496887 - DNA, 16 bp, Homo sapiens
ggggtcctgggaggct

SEQ ID NO: 5496888 - DNA, 17 bp, Homo sapiens
ggggtcgaatggggtcc

SEQ ID NO: 5496889 - DNA, 16 bp, Homo sapiens
ggggtcggacggggca

SEQ ID NO: 5496890 - DNA, 20 bp, Homo sapiens
ggggtcgggggaggagcacc

SEQ ID NO: 5496891 - DNA, 19 bp, Homo sapiens
ggggtcgtggagagctagg

SEQ ID NO: 5496892 - DNA, 23 bp, Homo sapiens
ggggtctattttataagggcact

SEQ ID NO: 5496893 - DNA, 17 bp, Homo sapiens
ggggtctcacccatgca

SEQ ID NO: 5496894 - DNA, 15 bp, Homo sapiens
ggggtctccaggagg

SEQ ID NO: 5496895 - DNA, 12 bp, Homo sapiens
ggggtctccctg

SEQ ID NO: 5496896 - DNA, 18 bp, Homo sapiens
ggggtctccctgagcctg

SEQ ID NO: 5496897 - DNA, 14 bp, Homo sapiens
ggggtctccctggc

SEQ ID NO: 5496898 - DNA, 21 bp, Homo sapiens
ggggtctccctggctccctcc

SEQ ID NO: 5496899 - DNA, 12 bp, Homo sapiens
ggggtctcctgg

SEQ ID NO: 5496900 - DNA, 18 bp, Homo sapiens
ggggtctctctccctacc

SEQ ID NO: 5496901 - DNA, 15 bp, Homo sapiens
ggggtctctgagcag

SEQ ID NO: 5496902 - DNA, 19 bp, Homo sapiens
ggggtctcttttgtaaatt

SEQ ID NO: 5496903 - DNA, 22 bp, Homo sapiens
ggggtctgctctgtgcctggga

SEQ ID NO: 5496904 - DNA, 21 bp, Homo sapiens
ggggtctggagttgatctgga

SEQ ID NO: 5496905 - DNA, 23 bp, Homo sapiens
ggggtctgggaggaatggacaga

SEQ ID NO: 5496906 - DNA, 20 bp, Homo sapiens
ggggtctgggagggggtgag

SEQ ID NO: 5496907 - DNA, 14 bp, Homo sapiens
ggggtctgggcagt

SEQ ID NO: 5496908 - DNA, 16 bp, Homo sapiens
ggggtctgggcagtgc

SEQ ID NO: 5496909 - DNA, 17 bp, Homo sapiens
ggggtctgggcagtgcc

SEQ ID NO: 5496910 - DNA, 18 bp, Homo sapiens
ggggtctgggcagtgcca

SEQ ID NO: 5496911 - DNA, 22 bp, Homo sapiens
ggggtctgggcgtccagctcag

SEQ ID NO: 5496912 - DNA, 15 bp, Homo sapiens
ggggtctgtaaaatc

SEQ ID NO: 5496913 - DNA, 18 bp, Homo sapiens
ggggtctgtgctgtgcct

SEQ ID NO: 5496914 - DNA, 23 bp, Homo sapiens
ggggtctttcagaacacgacaga

SEQ ID NO: 5496915 - DNA, 15 bp, Homo sapiens
gggtatgctcaggtc

SEQ ID NO: 5496916 - DNA, 21 bp, Homo sapiens
gggtatggggggggcaagaaa

SEQ ID NO: 5496917 - DNA, 22 bp, Homo sapiens
gggtatgtgttgccaaagctgg

SEQ ID NO: 5496918 - DNA, 16 bp, Homo sapiens
gggtattgcttgccac

SEQ ID NO: 5496919 - DNA, 19 bp, Homo sapiens
gggtatttattggtcaggg

SEQ ID NO: 5496920 - DNA, 15 bp, Homo sapiens
gggtcaactccaagg

SEQ ID NO: 5496921 - DNA, 17 bp, Homo sapiens
gggtcaacttgacacca

SEQ ID NO: 5496922 - DNA, 17 bp, Homo sapiens
gggtcaagctgagctgg

SEQ ID NO: 5496923 - DNA, 18 bp, Homo sapiens
gggtcaagctgagctggc

SEQ ID NO: 5496924 - DNA, 12 bp, Homo sapiens
gggtcaaggaat

SEQ ID NO: 5496925 - DNA, 21 bp, Homo sapiens
gggtcacacaaaggcatgctg

SEQ ID NO: 5496926 - DNA, 22 bp, Homo sapiens
gggtcacacctgacaaatggaa

SEQ ID NO: 5496927 - DNA, 13 bp, Homo sapiens
gggtcacagaggc

SEQ ID NO: 5496928 - DNA, 12 bp, Homo sapiens
gggtcacaggaa

SEQ ID NO: 5496929 - DNA, 14 bp, Homo sapiens
gggtcacaggaagg

SEQ ID NO: 5496930 - DNA, 17 bp, Homo sapiens
gggtcacatgactctca

SEQ ID NO: 5496931 - DNA, 16 bp, Homo sapiens
gggtcaccaccctccc

SEQ ID NO: 5496932 - DNA, 20 bp, Homo sapiens
gggtcacccatggcctcaga

SEQ ID NO: 5496933 - DNA, 14 bp, Homo sapiens
gggtcaccctgtga

SEQ ID NO: 5496934 - DNA, 16 bp, Homo sapiens
gggtcaccttcctggg

SEQ ID NO: 5496935 - DNA, 17 bp, Homo sapiens
gggtcaccttcctgggc

SEQ ID NO: 5496936 - DNA, 20 bp, Homo sapiens
gggtcacggtggcagtaggg

SEQ ID NO: 5496937 - DNA, 22 bp, Homo sapiens
gggtcactccaaggatcagaag

SEQ ID NO: 5496938 - DNA, 23 bp, Homo sapiens
gggtcactggcctctccccagga

SEQ ID NO: 5496939 - DNA, 19 bp, Homo sapiens
gggtcactgggatgcctct

SEQ ID NO: 5496940 - DNA, 14 bp, Homo sapiens
gggtcactggggga

SEQ ID NO: 5496941 - DNA, 20 bp, Homo sapiens
gggtcagaaccctgccatgg

SEQ ID NO: 5496942 - DNA, 20 bp, Homo sapiens
gggtcagaagaagtgggagc

SEQ ID NO: 5496943 - DNA, 14 bp, Homo sapiens
gggtcagaagagag

SEQ ID NO: 5496944 - DNA, 15 bp, Homo sapiens
gggtcagacccatct

SEQ ID NO: 5496945 - DNA, 20 bp, Homo sapiens
gggtcagacccatctctccc

SEQ ID NO: 5496946 - DNA, 19 bp, Homo sapiens
gggtcagacgcctgaggaa

SEQ ID NO: 5496947 - DNA, 18 bp, Homo sapiens
gggtcagccagggcctgc

SEQ ID NO: 5496948 - DNA, 17 bp, Homo sapiens
gggtcagccccaagggc

SEQ ID NO: 5496949 - DNA, 19 bp, Homo sapiens
gggtcagccccaagggctg

SEQ ID NO: 5496950 - DNA, 15 bp, Homo sapiens
gggtcagctctggcc

SEQ ID NO: 5496951 - DNA, 13 bp, Homo sapiens
gggtcaggaagga

SEQ ID NO: 5496952 - DNA, 17 bp, Homo sapiens
gggtcaggccgggcaga

SEQ ID NO: 5496953 - DNA, 12 bp, Homo sapiens
gggtcaggctcc

SEQ ID NO: 5496954 - DNA, 18 bp, Homo sapiens
gggtcagggaccaaggac

SEQ ID NO: 5496955 - DNA, 21 bp, Homo sapiens
gggtcaggggagacgaggcca

SEQ ID NO: 5496956 - DNA, 12 bp, Homo sapiens
gggtcagggggg

SEQ ID NO: 5496957 - DNA, 12 bp, Homo sapiens
gggtcagggtgt

SEQ ID NO: 5496958 - DNA, 19 bp, Homo sapiens
gggtcagggtgtgaggcca

SEQ ID NO: 5496959 - DNA, 19 bp, Homo sapiens
gggtcagtgcagcagagga

SEQ ID NO: 5496960 - DNA, 17 bp, Homo sapiens
gggtcagtggaagcccc

SEQ ID NO: 5496961 - DNA, 14 bp, Homo sapiens
gggtcatagaaatt

SEQ ID NO: 5496962 - DNA, 17 bp, Homo sapiens
gggtcatattcatacct

SEQ ID NO: 5496963 - DNA, 21 bp, Homo sapiens
gggtcatattcataccttctg

SEQ ID NO: 5496964 - DNA, 15 bp, Homo sapiens
gggtcatcagggagg

SEQ ID NO: 5496965 - DNA, 22 bp, Homo sapiens
gggtcatcatttgtcctgttct

SEQ ID NO: 5496966 - DNA, 22 bp, Homo sapiens
gggtcatgacaagatgggacag

SEQ ID NO: 5496967 - DNA, 12 bp, Homo sapiens
gggtcatgggcc

SEQ ID NO: 5496968 - DNA, 14 bp, Homo sapiens
gggtcatgtacttc

SEQ ID NO: 5496969 - DNA, 20 bp, Homo sapiens
gggtcatgtttgcaggggtg

SEQ ID NO: 5496970 - DNA, 18 bp, Homo sapiens
gggtcattcatggcctgg

SEQ ID NO: 5496971 - DNA, 15 bp, Homo sapiens
gggtcattgacctct

SEQ ID NO: 5496972 - DNA, 19 bp, Homo sapiens
gggtcattgacctctcagg

SEQ ID NO: 5496973 - DNA, 24 bp, Homo sapiens
gggtcattgacctctcagggcctg

SEQ ID NO: 5496974 - DNA, 17 bp, Homo sapiens
gggtcatttcagagccc

SEQ ID NO: 5496975 - DNA, 19 bp, Homo sapiens
gggtcatttttaactactg

SEQ ID NO: 5496976 - DNA, 12 bp, Homo sapiens
gggtccaaataa

SEQ ID NO: 5496977 - DNA, 13 bp, Homo sapiens
gggtccaaataaa

SEQ ID NO: 5496978 - DNA, 21 bp, Homo sapiens
gggtccaccagtgtgtggggg

SEQ ID NO: 5496979 - DNA, 17 bp, Homo sapiens
gggtccacttgccaggg

SEQ ID NO: 5496980 - DNA, 19 bp, Homo sapiens
gggtccacttgccagggct

SEQ ID NO: 5496981 - DNA, 20 bp, Homo sapiens
gggtccacttgccagggctc

SEQ ID NO: 5496982 - DNA, 13 bp, Homo sapiens
gggtccagaagga

SEQ ID NO: 5496983 - DNA, 18 bp, Homo sapiens
gggtccaggagagcctgg

SEQ ID NO: 5496984 - DNA, 13 bp, Homo sapiens
gggtccaggcatg

SEQ ID NO: 5496985 - DNA, 13 bp, Homo sapiens
gggtccaggcccg

SEQ ID NO: 5496986 - DNA, 14 bp, Homo sapiens
gggtccaggcccgt

SEQ ID NO: 5496987 - DNA, 12 bp, Homo sapiens
gggtccagggcc

SEQ ID NO: 5496988 - DNA, 14 bp, Homo sapiens
gggtccagggctgt

SEQ ID NO: 5496989 - DNA, 16 bp, Homo sapiens
gggtccagggctgttg

SEQ ID NO: 5496990 - DNA, 12 bp, Homo sapiens
gggtccagtctg

SEQ ID NO: 5496991 - DNA, 19 bp, Homo sapiens
gggtccagtggatgccaca

SEQ ID NO: 5496992 - DNA, 21 bp, Homo sapiens
gggtccatagagatgagccca

SEQ ID NO: 5496993 - DNA, 15 bp, Homo sapiens
gggtcccaagctggg

SEQ ID NO: 5496994 - DNA, 20 bp, Homo sapiens
gggtcccaggacctgagcct

SEQ ID NO: 5496995 - DNA, 21 bp, Homo sapiens
gggtcccagggctggccctag

SEQ ID NO: 5496996 - DNA, 16 bp, Homo sapiens
gggtccccagcccttc

SEQ ID NO: 5496997 - DNA, 19 bp, Homo sapiens
gggtccccagctccccagg

SEQ ID NO: 5496998 - DNA, 13 bp, Homo sapiens
gggtcccccctcc

SEQ ID NO: 5496999 - DNA, 19 bp, Homo sapiens
gggtcccccctccattccc

SEQ ID NO: 5497000 - DNA, 14 bp, Homo sapiens
gggtcccccttcgt

SEQ ID NO: 5497001 - DNA, 23 bp, Homo sapiens
gggtccccggacgctggctcggg

SEQ ID NO: 5497002 - DNA, 19 bp, Homo sapiens
gggtcccctccccagctcc

SEQ ID NO: 5497003 - DNA, 15 bp, Homo sapiens
gggtcccggccgcgc

SEQ ID NO: 5497004 - DNA, 21 bp, Homo sapiens
gggtcccggccgcgccgccgc

SEQ ID NO: 5497005 - DNA, 17 bp, Homo sapiens
gggtccctagcagccca

SEQ ID NO: 5497006 - DNA, 12 bp, Homo sapiens
gggtccctcctc

SEQ ID NO: 5497007 - DNA, 16 bp, Homo sapiens
gggtccctctaaccca

SEQ ID NO: 5497008 - DNA, 19 bp, Homo sapiens
gggtccctctaacccagtg

SEQ ID NO: 5497009 - DNA, 18 bp, Homo sapiens
gggtccctgaacgccctg

SEQ ID NO: 5497010 - DNA, 22 bp, Homo sapiens
gggtccctgcgtctcctgccca

SEQ ID NO: 5497011 - DNA, 16 bp, Homo sapiens
gggtccctgctcccct

SEQ ID NO: 5497012 - DNA, 20 bp, Homo sapiens
gggtccctgctcccctttgg

SEQ ID NO: 5497013 - DNA, 20 bp, Homo sapiens
gggtcccttgaaggaagagg

SEQ ID NO: 5497014 - DNA, 20 bp, Homo sapiens
gggtccgagagggaagctgg

SEQ ID NO: 5497015 - DNA, 19 bp, Homo sapiens
gggtccgcaccagctgctc

SEQ ID NO: 5497016 - DNA, 15 bp, Homo sapiens
gggtccgcatccctg

SEQ ID NO: 5497017 - DNA, 14 bp, Homo sapiens
gggtccggcctctc

SEQ ID NO: 5497018 - DNA, 19 bp, Homo sapiens
gggtccggcctctccctgc

SEQ ID NO: 5497019 - DNA, 20 bp, Homo sapiens
gggtccggcctctccctgcc

SEQ ID NO: 5497020 - DNA, 23 bp, Homo sapiens
gggtccgtggtagaggcctgggg

SEQ ID NO: 5497021 - DNA, 22 bp, Homo sapiens
gggtcctactcctggagcactg

SEQ ID NO: 5497022 - DNA, 18 bp, Homo sapiens
gggtcctagcccttccct

SEQ ID NO: 5497023 - DNA, 12 bp, Homo sapiens
gggtcctccaaa

SEQ ID NO: 5497024 - DNA, 15 bp, Homo sapiens
gggtcctcccagctg

SEQ ID NO: 5497025 - DNA, 16 bp, Homo sapiens
gggtcctcccagctga

SEQ ID NO: 5497026 - DNA, 23 bp, Homo sapiens
gggtcctcctaagtcccttccta

SEQ ID NO: 5497027 - DNA, 15 bp, Homo sapiens
gggtcctcctccagg

SEQ ID NO: 5497028 - DNA, 14 bp, Homo sapiens
gggtcctcggccca

SEQ ID NO: 5497029 - DNA, 15 bp, Homo sapiens
gggtcctcggccctg

SEQ ID NO: 5497030 - DNA, 18 bp, Homo sapiens
gggtcctcggccctgtag

SEQ ID NO: 5497031 - DNA, 21 bp, Homo sapiens
gggtcctcgggcccctgagcc

SEQ ID NO: 5497032 - DNA, 13 bp, Homo sapiens
gggtcctctctga

SEQ ID NO: 5497033 - DNA, 18 bp, Homo sapiens
gggtcctctctgagtcaa

SEQ ID NO: 5497034 - DNA, 20 bp, Homo sapiens
gggtcctctctgagtcaaat

SEQ ID NO: 5497035 - DNA, 23 bp, Homo sapiens
gggtcctcttagtccacaaggtc

SEQ ID NO: 5497036 - DNA, 19 bp, Homo sapiens
gggtcctcttctgggcctg

SEQ ID NO: 5497037 - DNA, 14 bp, Homo sapiens
gggtcctcttttcc

SEQ ID NO: 5497038 - DNA, 23 bp, Homo sapiens
gggtcctcttttcctggcagctg

SEQ ID NO: 5497039 - DNA, 21 bp, Homo sapiens
gggtcctgaggcctgcagcac

SEQ ID NO: 5497040 - DNA, 17 bp, Homo sapiens
gggtcctgagtggctga

SEQ ID NO: 5497041 - DNA, 13 bp, Homo sapiens
gggtcctgcaatt

SEQ ID NO: 5497042 - DNA, 13 bp, Homo sapiens
gggtcctgcctgc

SEQ ID NO: 5497043 - DNA, 13 bp, Homo sapiens
gggtcctgctttc

SEQ ID NO: 5497044 - DNA, 20 bp, Homo sapiens
gggtcctgggaggctgcagc

SEQ ID NO: 5497045 - DNA, 15 bp, Homo sapiens
gggtcctgggggcag

SEQ ID NO: 5497046 - DNA, 18 bp, Homo sapiens
gggtcctgtggcaggcag

SEQ ID NO: 5497047 - DNA, 19 bp, Homo sapiens
gggtccttttgacactgct

SEQ ID NO: 5497048 - DNA, 22 bp, Homo sapiens
gggtccttttgacactgctcta

SEQ ID NO: 5497049 - DNA, 13 bp, Homo sapiens
gggtcgccctgga

SEQ ID NO: 5497050 - DNA, 14 bp, Homo sapiens
gggtcgcctgccct

SEQ ID NO: 5497051 - DNA, 14 bp, Homo sapiens
gggtcgcctgtcct

SEQ ID NO: 5497052 - DNA, 19 bp, Homo sapiens
gggtcggaagcctgtcctc

SEQ ID NO: 5497053 - DNA, 20 bp, Homo sapiens
gggtcggcgccttctacctg

SEQ ID NO: 5497054 - DNA, 16 bp, Homo sapiens
gggtcgggggaggagc

SEQ ID NO: 5497055 - DNA, 19 bp, Homo sapiens
gggtcgggggaggagcacc

SEQ ID NO: 5497056 - DNA, 12 bp, Homo sapiens
gggtcgtgagcc

SEQ ID NO: 5497057 - DNA, 22 bp, Homo sapiens
gggtcgtttgcttttcagggtt

SEQ ID NO: 5497058 - DNA, 23 bp, Homo sapiens
gggtctaaggagcgctagtgcct

SEQ ID NO: 5497059 - DNA, 14 bp, Homo sapiens
gggtctagggagag

SEQ ID NO: 5497060 - DNA, 13 bp, Homo sapiens
gggtctatacatt

SEQ ID NO: 5497061 - DNA, 22 bp, Homo sapiens
gggtctcactatgttgcccagg

SEQ ID NO: 5497062 - DNA, 12 bp, Homo sapiens
gggtctcactct

SEQ ID NO: 5497063 - DNA, 17 bp, Homo sapiens
gggtctcactctgttgc

SEQ ID NO: 5497064 - DNA, 22 bp, Homo sapiens
gggtctcactgtgttgcccagg

SEQ ID NO: 5497065 - DNA, 22 bp, Homo sapiens
gggtctcagggtgtcccagacc

SEQ ID NO: 5497066 - DNA, 18 bp, Homo sapiens
gggtctccaggaggagac

SEQ ID NO: 5497067 - DNA, 17 bp, Homo sapiens
gggtctccccacctgca

SEQ ID NO: 5497068 - DNA, 12 bp, Homo sapiens
gggtctcccctc

SEQ ID NO: 5497069 - DNA, 18 bp, Homo sapiens
gggtctcccctcctgcac

SEQ ID NO: 5497070 - DNA, 18 bp, Homo sapiens
gggtctccctctcctgcc

SEQ ID NO: 5497071 - DNA, 20 bp, Homo sapiens
gggtctccctctcctgccta

SEQ ID NO: 5497072 - DNA, 17 bp, Homo sapiens
gggtctccctgagcctg

SEQ ID NO: 5497073 - DNA, 14 bp, Homo sapiens
gggtctccctggct

SEQ ID NO: 5497074 - DNA, 16 bp, Homo sapiens
gggtctccctggctcc

SEQ ID NO: 5497075 - DNA, 18 bp, Homo sapiens
gggtctccctggctccct

SEQ ID NO: 5497076 - DNA, 13 bp, Homo sapiens
gggtctccttgga

SEQ ID NO: 5497077 - DNA, 17 bp, Homo sapiens
gggtctcgaactcctgg

SEQ ID NO: 5497078 - DNA, 18 bp, Homo sapiens
gggtctcgaactcctggc

SEQ ID NO: 5497079 - DNA, 19 bp, Homo sapiens
gggtctcgaactcctggcc

SEQ ID NO: 5497080 - DNA, 19 bp, Homo sapiens
gggtctcgcagcctgaagc

SEQ ID NO: 5497081 - DNA, 22 bp, Homo sapiens
gggtctcggatgacaccctggc

SEQ ID NO: 5497082 - DNA, 20 bp, Homo sapiens
gggtctctagtgctgtgaaa

SEQ ID NO: 5497083 - DNA, 18 bp, Homo sapiens
gggtctctcacagacagg

SEQ ID NO: 5497084 - DNA, 22 bp, Homo sapiens
gggtctctcactgttgcagtgg

SEQ ID NO: 5497085 - DNA, 12 bp, Homo sapiens
gggtctctcagg

SEQ ID NO: 5497086 - DNA, 17 bp, Homo sapiens
gggtctctccctcaggt

SEQ ID NO: 5497087 - DNA, 20 bp, Homo sapiens
gggtctctctcggcccctgt

SEQ ID NO: 5497088 - DNA, 14 bp, Homo sapiens
gggtctctgaaggg

SEQ ID NO: 5497089 - DNA, 22 bp, Homo sapiens
gggtctctgagcagtggggagc

SEQ ID NO: 5497090 - DNA, 13 bp, Homo sapiens
gggtctctgctgc

SEQ ID NO: 5497091 - DNA, 14 bp, Homo sapiens
gggtctctgctgcc

SEQ ID NO: 5497092 - DNA, 15 bp, Homo sapiens
gggtctctgctgccg

SEQ ID NO: 5497093 - DNA, 15 bp, Homo sapiens
gggtggatgtgctgg

SEQ ID NO: 5497094 - DNA, 18 bp, Homo sapiens
gggtggcaacatttgggg

SEQ ID NO: 5497095 - DNA, 18 bp, Homo sapiens
gggtggcacctcctgaga

SEQ ID NO: 5497096 - DNA, 20 bp, Homo sapiens
gggtggcacctcctgagaag

SEQ ID NO: 5497097 - DNA, 12 bp, Homo sapiens
gggtggcagaga

SEQ ID NO: 5497098 - DNA, 22 bp, Homo sapiens
gggtggcaggcacacagcagcc

SEQ ID NO: 5497099 - DNA, 23 bp, Homo sapiens
gggtggcaggcacacagcagccc

SEQ ID NO: 5497100 - DNA, 16 bp, Homo sapiens
gggtggcaggtcactg

SEQ ID NO: 5497101 - DNA, 20 bp, Homo sapiens
gggtggcatcattccaggcc

SEQ ID NO: 5497102 - DNA, 21 bp, Homo sapiens
gggtggccaatccaggtggga

SEQ ID NO: 5497103 - DNA, 12 bp, Homo sapiens
gggtggccacac

SEQ ID NO: 5497104 - DNA, 18 bp, Homo sapiens
gggtggccacacaggcag

SEQ ID NO: 5497105 - DNA, 21 bp, Homo sapiens
gggtggccacacaggcagggc

SEQ ID NO: 5497106 - DNA, 23 bp, Homo sapiens
gggtggccactgcagcacctgcc

SEQ ID NO: 5497107 - DNA, 11 bp, Homo sapiens
gggtggccagg

SEQ ID NO: 5497108 - DNA, 20 bp, Homo sapiens
gggtggccaggccgggaaaa

SEQ ID NO: 5497109 - DNA, 12 bp, Homo sapiens
gggtggccaggg

SEQ ID NO: 5497110 - DNA, 21 bp, Homo sapiens
gggtggccatcctacccagcg

SEQ ID NO: 5497111 - DNA, 14 bp, Homo sapiens
gggtggcccagagc

SEQ ID NO: 5497112 - DNA, 15 bp, Homo sapiens
gggtggcccagagcc

SEQ ID NO: 5497113 - DNA, 13 bp, Homo sapiens
gggtggcccatcc

SEQ ID NO: 5497114 - DNA, 19 bp, Homo sapiens
gggtggcccatcccccctc

SEQ ID NO: 5497115 - DNA, 16 bp, Homo sapiens
gggtggccggccctgc

SEQ ID NO: 5497116 - DNA, 17 bp, Homo sapiens
gggtggccggccctgcc

SEQ ID NO: 5497117 - DNA, 22 bp, Homo sapiens
gggtggccggccctgcccccca

SEQ ID NO: 5497118 - DNA, 19 bp, Homo sapiens
gggtggcctgttccctaga

SEQ ID NO: 5497119 - DNA, 18 bp, Homo sapiens
gggtggctagtcagagag

SEQ ID NO: 5497120 - DNA, 22 bp, Homo sapiens
gggtggctcactactgaacaca

SEQ ID NO: 5497121 - DNA, 13 bp, Homo sapiens
gggtggctgcagc

SEQ ID NO: 5497122 - DNA, 12 bp, Homo sapiens
gggtgggaagag

SEQ ID NO: 5497123 - DNA, 15 bp, Homo sapiens
gggtgggaagagaag

SEQ ID NO: 5497124 - DNA, 15 bp, Homo sapiens
gggtgggacaccctg

SEQ ID NO: 5497125 - DNA, 13 bp, Homo sapiens
gggtgggacagcc

SEQ ID NO: 5497126 - DNA, 14 bp, Homo sapiens
gggtgggacagcct

SEQ ID NO: 5497127 - DNA, 19 bp, Homo sapiens
gggtgggacatggaaaaga

SEQ ID NO: 5497128 - DNA, 19 bp, Homo sapiens
gggtgggagagcccagcca

SEQ ID NO: 5497129 - DNA, 15 bp, Homo sapiens
gggtgggagggagga

SEQ ID NO: 5497130 - DNA, 12 bp, Homo sapiens
gggtgggcacag

SEQ ID NO: 5497131 - DNA, 12 bp, Homo sapiens
gggtgggcagca

SEQ ID NO: 5497132 - DNA, 22 bp, Homo sapiens
gggtgggcatcaaagatgagaa

SEQ ID NO: 5497133 - DNA, 15 bp, Homo sapiens
gggtgggccactctc

SEQ ID NO: 5497134 - DNA, 14 bp, Homo sapiens
gggtgggccctgcc

SEQ ID NO: 5497135 - DNA, 16 bp, Homo sapiens
gggtgggctggggact

SEQ ID NO: 5497136 - DNA, 13 bp, Homo sapiens
gggtggggaaagg

SEQ ID NO: 5497137 - DNA, 14 bp, Homo sapiens
gggtggggaaggga

SEQ ID NO: 5497138 - DNA, 22 bp, Homo sapiens
gggtggggaatgtttgggcaga

SEQ ID NO: 5497139 - DNA, 15 bp, Homo sapiens
gggtggggacagacc

SEQ ID NO: 5497140 - DNA, 13 bp, Homo sapiens
gggtggggacagg

SEQ ID NO: 5497141 - DNA, 20 bp, Homo sapiens
gggtggggacctcaggcctg

SEQ ID NO: 5497142 - DNA, 23 bp, Homo sapiens
gggtggggacgtcctgccacctg

SEQ ID NO: 5497143 - DNA, 11 bp, Homo sapiens
gggtggggagg

SEQ ID NO: 5497144 - DNA, 12 bp, Homo sapiens
gggtggggaggc

SEQ ID NO: 5497145 - DNA, 19 bp, Homo sapiens
gggtggggaggccctgcct

SEQ ID NO: 5497146 - DNA, 21 bp, Homo sapiens
gggtggggcaatggggagagg

SEQ ID NO: 5497147 - DNA, 12 bp, Homo sapiens
gggtggggccca

SEQ ID NO: 5497148 - DNA, 16 bp, Homo sapiens
gggtggggcccatggg

SEQ ID NO: 5497149 - DNA, 13 bp, Homo sapiens
gggtggggcggga

SEQ ID NO: 5497150 - DNA, 12 bp, Homo sapiens
gggtggggctgg

SEQ ID NO: 5497151 - DNA, 13 bp, Homo sapiens
gggtggggctggt

SEQ ID NO: 5497152 - DNA, 12 bp, Homo sapiens
gggtggggcttc

SEQ ID NO: 5497153 - DNA, 21 bp, Homo sapiens
gggtgggggacgatcaggagg

SEQ ID NO: 5497154 - DNA, 13 bp, Homo sapiens
gggtgggggaggg

SEQ ID NO: 5497155 - DNA, 17 bp, Homo sapiens
gggtgggggctcctggt

SEQ ID NO: 5497156 - DNA, 20 bp, Homo sapiens
gggtgggggctcctggtggc

SEQ ID NO: 5497157 - DNA, 10 bp, Homo sapiens
gggtgggggt

SEQ ID NO: 5497158 - DNA, 13 bp, Homo sapiens
gggtgggggtgga

SEQ ID NO: 5497159 - DNA, 16 bp, Homo sapiens
gggtgggggtgggtca

SEQ ID NO: 5497160 - DNA, 17 bp, Homo sapiens
gggtggggtcatgccct

SEQ ID NO: 5497161 - DNA, 16 bp, Homo sapiens
gggtggggtgcctgag

SEQ ID NO: 5497162 - DNA, 12 bp, Homo sapiens
gggtgggtataa

SEQ ID NO: 5497163 - DNA, 11 bp, Homo sapiens
gggtgggtcag

SEQ ID NO: 5497164 - DNA, 16 bp, Homo sapiens
gggtgggtgtgagcag

SEQ ID NO: 5497165 - DNA, 21 bp, Homo sapiens
gggtggtaagagaatgttata

SEQ ID NO: 5497166 - DNA, 13 bp, Homo sapiens
gggtggtcctgac

SEQ ID NO: 5497167 - DNA, 22 bp, Homo sapiens
gggtggtctcttcttggggccc

SEQ ID NO: 5497168 - DNA, 16 bp, Homo sapiens
gggtggtctgcaggca

SEQ ID NO: 5497169 - DNA, 14 bp, Homo sapiens
gggtggtgctggga

SEQ ID NO: 5497170 - DNA, 14 bp, Homo sapiens
gggtggtggacagg

SEQ ID NO: 5497171 - DNA, 20 bp, Homo sapiens
gggtggtggagggggctggg

SEQ ID NO: 5497172 - DNA, 15 bp, Homo sapiens
gggtgtattctctgt

SEQ ID NO: 5497173 - DNA, 24 bp, Homo sapiens
gggtgtcaaacattcgtgagctgg

SEQ ID NO: 5497174 - DNA, 17 bp, Homo sapiens
gggtgtcaagtgcctgc

SEQ ID NO: 5497175 - DNA, 17 bp, Homo sapiens
gggtgtcacggccaggc

SEQ ID NO: 5497176 - DNA, 18 bp, Homo sapiens
gggtgtcccctggtgccc

SEQ ID NO: 5497177 - DNA, 16 bp, Homo sapiens
gggtgtccgccatcca

SEQ ID NO: 5497178 - DNA, 20 bp, Homo sapiens
gggtgtccgccatccagggt

SEQ ID NO: 5497179 - DNA, 17 bp, Homo sapiens
gggtgtcctgcaccggg

SEQ ID NO: 5497180 - DNA, 17 bp, Homo sapiens
gggtgtcctgcctgtct

SEQ ID NO: 5497181 - DNA, 19 bp, Homo sapiens
gggtgtcctgcctgtctgc

SEQ ID NO: 5497182 - DNA, 14 bp, Homo sapiens
gggtgtctggaagc

SEQ ID NO: 5497183 - DNA, 16 bp, Homo sapiens
gggtgtctggaagctg

SEQ ID NO: 5497184 - DNA, 22 bp, Homo sapiens
gggtgtctggaagctgagcagg

SEQ ID NO: 5497185 - DNA, 18 bp, Homo sapiens
gggtgtctgtcttccttt

SEQ ID NO: 5497186 - DNA, 23 bp, Homo sapiens
gggtgtcttgggcagagctggct

SEQ ID NO: 5497187 - DNA, 20 bp, Homo sapiens
gggtgtgactcgggagctgc

SEQ ID NO: 5497188 - DNA, 21 bp, Homo sapiens
gggtgtgactcgggagctgca

SEQ ID NO: 5497189 - DNA, 18 bp, Homo sapiens
gggtgtgagcagggtgac

SEQ ID NO: 5497190 - DNA, 12 bp, Homo sapiens
gggtgtgccctg

SEQ ID NO: 5497191 - DNA, 12 bp, Homo sapiens
gggtgtgccctt

SEQ ID NO: 5497192 - DNA, 12 bp, Homo sapiens
gggtgtgctcca

SEQ ID NO: 5497193 - DNA, 21 bp, Homo sapiens
gggtgtgctccaggcttcctg

SEQ ID NO: 5497194 - DNA, 13 bp, Homo sapiens
gggtgtgctggga

SEQ ID NO: 5497195 - DNA, 17 bp, Homo sapiens
gggtgtggatggcagtg

SEQ ID NO: 5497196 - DNA, 14 bp, Homo sapiens
gggtgtggcacgca

SEQ ID NO: 5497197 - DNA, 13 bp, Homo sapiens
gggtgtggccagc

SEQ ID NO: 5497198 - DNA, 14 bp, Homo sapiens
gggtgtggcttgga

SEQ ID NO: 5497199 - DNA, 19 bp, Homo sapiens
gggtgtggtatgagggggt

SEQ ID NO: 5497200 - DNA, 15 bp, Homo sapiens
gggtgttaatttatg

SEQ ID NO: 5497201 - DNA, 19 bp, Homo sapiens
gggtgttgtagtagctgaa

SEQ ID NO: 5497202 - DNA, 19 bp, Homo sapiens
gggtgtttattacaagtgg

SEQ ID NO: 5497203 - DNA, 14 bp, Homo sapiens
gggttaaatatttt

SEQ ID NO: 5497204 - DNA, 13 bp, Homo sapiens
gggttaagaaata

SEQ ID NO: 5497205 - DNA, 18 bp, Homo sapiens
gggttaagtctcctgtct

SEQ ID NO: 5497206 - DNA, 20 bp, Homo sapiens
gggttaagtgggcattttga

SEQ ID NO: 5497207 - DNA, 21 bp, Homo sapiens
gggttaatcatatttgaaaac

SEQ ID NO: 5497208 - DNA, 15 bp, Homo sapiens
gggttacactgttaa

SEQ ID NO: 5497209 - DNA, 16 bp, Homo sapiens
gggttagacaagcctg

SEQ ID NO: 5497210 - DNA, 16 bp, Homo sapiens
gggttagcctgcaccg

SEQ ID NO: 5497211 - DNA, 21 bp, Homo sapiens
gggttagcctggtgacaggca

SEQ ID NO: 5497212 - DNA, 22 bp, Homo sapiens
gggttagcctggtgacaggcag

SEQ ID NO: 5497213 - DNA, 17 bp, Homo sapiens
gggttaggggtggagtc

SEQ ID NO: 5497214 - DNA, 22 bp, Homo sapiens
gggttaggggttcattctcccg

SEQ ID NO: 5497215 - DNA, 20 bp, Homo sapiens
gggttatctcaaattttaag

SEQ ID NO: 5497216 - DNA, 14 bp, Homo sapiens
gggttatgaatatt

SEQ ID NO: 5497217 - DNA, 23 bp, Homo sapiens
gggttatttttgtccctgctcct

SEQ ID NO: 5497218 - DNA, 14 bp, Homo sapiens
gggttcaagagact

SEQ ID NO: 5497219 - DNA, 15 bp, Homo sapiens
gggttcaagcccagg

SEQ ID NO: 5497220 - DNA, 14 bp, Homo sapiens
gggttcaagcttgt

SEQ ID NO: 5497221 - DNA, 22 bp, Homo sapiens
gggttcaaggactaacgaacgt

SEQ ID NO: 5497222 - DNA, 22 bp, Homo sapiens
gggttcaagtgactctcctgcc

SEQ ID NO: 5497223 - DNA, 17 bp, Homo sapiens
gggttcacacagcccag

SEQ ID NO: 5497224 - DNA, 21 bp, Homo sapiens
gggttcacgccattctcctgc

SEQ ID NO: 5497225 - DNA, 21 bp, Homo sapiens
gggttcacttgccatgcagga

SEQ ID NO: 5497226 - DNA, 22 bp, Homo sapiens
gggttcacttgccatgcaggaa

SEQ ID NO: 5497227 - DNA, 21 bp, Homo sapiens
gggttcagaaatgctgcctgc

SEQ ID NO: 5497228 - DNA, 17 bp, Homo sapiens
gggttcagcccctcctc

SEQ ID NO: 5497229 - DNA, 20 bp, Homo sapiens
gggttcagcccctcctctgc

SEQ ID NO: 5497230 - DNA, 16 bp, Homo sapiens
gggttcagcctctccc

SEQ ID NO: 5497231 - DNA, 13 bp, Homo sapiens
gggttcaggcctg

SEQ ID NO: 5497232 - DNA, 19 bp, Homo sapiens
gggttcataggtcactggc

SEQ ID NO: 5497233 - DNA, 22 bp, Homo sapiens
gggttcataggtcactggctct

SEQ ID NO: 5497234 - DNA, 13 bp, Homo sapiens
gggttcattattg

SEQ ID NO: 5497235 - DNA, 21 bp, Homo sapiens
gggttcattccccggccctcc

SEQ ID NO: 5497236 - DNA, 14 bp, Homo sapiens
gggttccagacagg

SEQ ID NO: 5497237 - DNA, 23 bp, Homo sapiens
gggttccagaggtattcctctct

SEQ ID NO: 5497238 - DNA, 13 bp, Homo sapiens
gggttccaggctg

SEQ ID NO: 5497239 - DNA, 20 bp, Homo sapiens
gggttccatcttgctaataa

SEQ ID NO: 5497240 - DNA, 18 bp, Homo sapiens
gggttcccactggctcct

SEQ ID NO: 5497241 - DNA, 22 bp, Homo sapiens
gggttccccacacagggcactg

SEQ ID NO: 5497242 - DNA, 22 bp, Homo sapiens
gggttccccactggtctgggaa

SEQ ID NO: 5497243 - DNA, 17 bp, Homo sapiens
gggttcccgagggagct

SEQ ID NO: 5497244 - DNA, 22 bp, Homo sapiens
gggttccctcctagctctccca

SEQ ID NO: 5497245 - DNA, 16 bp, Homo sapiens
gggttccgcactttcc

SEQ ID NO: 5497246 - DNA, 13 bp, Homo sapiens
gggttccttctgg

SEQ ID NO: 5497247 - DNA, 17 bp, Homo sapiens
gggttcggttgcagggc

SEQ ID NO: 5497248 - DNA, 17 bp, Homo sapiens
gggttcgttggggacat

SEQ ID NO: 5497249 - DNA, 17 bp, Homo sapiens
gggttctacccaggtgc

SEQ ID NO: 5497250 - DNA, 22 bp, Homo sapiens
gggttctacccaggtgctagga

SEQ ID NO: 5497251 - DNA, 16 bp, Homo sapiens
gggttctatatttact

SEQ ID NO: 5497252 - DNA, 18 bp, Homo sapiens
gggttctcctctcccctc

SEQ ID NO: 5497253 - DNA, 21 bp, Homo sapiens
gggttctgagaagcgctgccc

SEQ ID NO: 5497254 - DNA, 23 bp, Homo sapiens
gggttctgagaagcgctgccctg

SEQ ID NO: 5497255 - DNA, 21 bp, Homo sapiens
gggttctgcagcggcagagca

SEQ ID NO: 5497256 - DNA, 14 bp, Homo sapiens
gggttctgccctgc

SEQ ID NO: 5497257 - DNA, 20 bp, Homo sapiens
gggttctgccctgcctgagg

SEQ ID NO: 5497258 - DNA, 22 bp, Homo sapiens
gggttctgccctgcctgaggag

SEQ ID NO: 5497259 - DNA, 13 bp, Homo sapiens
gggttctgcctct

SEQ ID NO: 5497260 - DNA, 13 bp, Homo sapiens
gggttctggggct

SEQ ID NO: 5497261 - DNA, 19 bp, Homo sapiens
gggttctttggaaggagtg

SEQ ID NO: 5497262 - DNA, 16 bp, Homo sapiens
gggttgaaagacatca

SEQ ID NO: 5497263 - DNA, 13 bp, Homo sapiens
gggttgaaggcag

SEQ ID NO: 5497264 - DNA, 11 bp, Homo sapiens
gggttgattaa

SEQ ID NO: 5497265 - DNA, 17 bp, Homo sapiens
gggttgattaaggcagt

SEQ ID NO: 5497266 - DNA, 20 bp, Homo sapiens
gggttgccacaggcctccct

SEQ ID NO: 5497267 - DNA, 13 bp, Homo sapiens
gggttgccagagg

SEQ ID NO: 5497268 - DNA, 14 bp, Homo sapiens
gggttgcccagcct

SEQ ID NO: 5497269 - DNA, 15 bp, Homo sapiens
gggttgcccagcctg

SEQ ID NO: 5497270 - DNA, 15 bp, Homo sapiens
gggttgcgggggagc

SEQ ID NO: 5497271 - DNA, 20 bp, Homo sapiens
gggttgcgggggagctggaa

SEQ ID NO: 5497272 - DNA, 17 bp, Homo sapiens
ggtagttctgtgcctcc

SEQ ID NO: 5497273 - DNA, 21 bp, Homo sapiens
ggtagttctgtgcctcccccc

SEQ ID NO: 5497274 - DNA, 22 bp, Homo sapiens
ggtataaaactttcctcgcctg

SEQ ID NO: 5497275 - DNA, 13 bp, Homo sapiens
ggtataaagacaa

SEQ ID NO: 5497276 - DNA, 20 bp, Homo sapiens
ggtataagttgctgtaaaat

SEQ ID NO: 5497277 - DNA, 20 bp, Homo sapiens
ggtataatggttgactgggt

SEQ ID NO: 5497278 - DNA, 12 bp, Homo sapiens
ggtataattgaa

SEQ ID NO: 5497279 - DNA, 15 bp, Homo sapiens
ggtatacattgaatt

SEQ ID NO: 5497280 - DNA, 15 bp, Homo sapiens
ggtatactgaggggt

SEQ ID NO: 5497281 - DNA, 16 bp, Homo sapiens
ggtatagatgttgcta

SEQ ID NO: 5497282 - DNA, 23 bp, Homo sapiens
ggtataggacaaggggtggaagg

SEQ ID NO: 5497283 - DNA, 22 bp, Homo sapiens
ggtataggtctcatctcttcag

SEQ ID NO: 5497284 - DNA, 23 bp, Homo sapiens
ggtatagttcatgtctgctatca

SEQ ID NO: 5497285 - DNA, 22 bp, Homo sapiens
ggtatatcattataactgaagg

SEQ ID NO: 5497286 - DNA, 17 bp, Homo sapiens
ggtatatcattctaaag

SEQ ID NO: 5497287 - DNA, 16 bp, Homo sapiens
ggtatatccaaaagct

SEQ ID NO: 5497288 - DNA, 18 bp, Homo sapiens
ggtatattgtgtaaatat

SEQ ID NO: 5497289 - DNA, 17 bp, Homo sapiens
ggtatatttgtgtatgt

SEQ ID NO: 5497290 - DNA, 12 bp, Homo sapiens
ggtatattttcc

SEQ ID NO: 5497291 - DNA, 21 bp, Homo sapiens
ggtatatttttgataccttca

SEQ ID NO: 5497292 - DNA, 21 bp, Homo sapiens
ggtatcaactaggggaggaga

SEQ ID NO: 5497293 - DNA, 13 bp, Homo sapiens
ggtatcacacact

SEQ ID NO: 5497294 - DNA, 17 bp, Homo sapiens
ggtatcaggcacaggca

SEQ ID NO: 5497295 - DNA, 18 bp, Homo sapiens
ggtatcaggcacaggcag

SEQ ID NO: 5497296 - DNA, 12 bp, Homo sapiens
ggtatccagagg

SEQ ID NO: 5497297 - DNA, 14 bp, Homo sapiens
ggtatccagaggtg

SEQ ID NO: 5497298 - DNA, 19 bp, Homo sapiens
ggtatccattataaacaat

SEQ ID NO: 5497299 - DNA, 13 bp, Homo sapiens
ggtatcccacctc

SEQ ID NO: 5497300 - DNA, 14 bp, Homo sapiens
ggtatcccctgcct

SEQ ID NO: 5497301 - DNA, 17 bp, Homo sapiens
ggtatcctccctgccca

SEQ ID NO: 5497302 - DNA, 12 bp, Homo sapiens
ggtatcctgccc

SEQ ID NO: 5497303 - DNA, 18 bp, Homo sapiens
ggtatcctgcccagtgtt

SEQ ID NO: 5497304 - DNA, 13 bp, Homo sapiens
ggtatctccagga

SEQ ID NO: 5497305 - DNA, 16 bp, Homo sapiens
ggtatctggcttccct

SEQ ID NO: 5497306 - DNA, 17 bp, Homo sapiens
ggtatctttaattgtat

SEQ ID NO: 5497307 - DNA, 16 bp, Homo sapiens
ggtatgaacttgagga

SEQ ID NO: 5497308 - DNA, 19 bp, Homo sapiens
ggtatgaacttgaggacac

SEQ ID NO: 5497309 - DNA, 16 bp, Homo sapiens
ggtatgagctggagct

SEQ ID NO: 5497310 - DNA, 22 bp, Homo sapiens
ggtatgcactggttccttaagt

SEQ ID NO: 5497311 - DNA, 20 bp, Homo sapiens
ggtatgcagcatacaaaaat

SEQ ID NO: 5497312 - DNA, 17 bp, Homo sapiens
ggtatgctggccagcac

SEQ ID NO: 5497313 - DNA, 17 bp, Homo sapiens
ggtatggagctgtgccg

SEQ ID NO: 5497314 - DNA, 13 bp, Homo sapiens
ggtatggccatgc

SEQ ID NO: 5497315 - DNA, 20 bp, Homo sapiens
ggtatggcgtaagtacagag

SEQ ID NO: 5497316 - DNA, 16 bp, Homo sapiens
ggtatgtagcccggcc

SEQ ID NO: 5497317 - DNA, 12 bp, Homo sapiens
ggtatgtctgcc

SEQ ID NO: 5497318 - DNA, 14 bp, Homo sapiens
ggtatgtctgccat

SEQ ID NO: 5497319 - DNA, 15 bp, Homo sapiens
ggtatgtctgtgcca

SEQ ID NO: 5497320 - DNA, 19 bp, Homo sapiens
ggtatgtgccaggcttgcc

SEQ ID NO: 5497321 - DNA, 22 bp, Homo sapiens
ggtatgtgcccctcctgggtgc

SEQ ID NO: 5497322 - DNA, 14 bp, Homo sapiens
ggtatgtgtgtgta

SEQ ID NO: 5497323 - DNA, 17 bp, Homo sapiens
ggtatgtgtgtgtgggt

SEQ ID NO: 5497324 - DNA, 17 bp, Homo sapiens
ggtattaaagatgtgtt

SEQ ID NO: 5497325 - DNA, 20 bp, Homo sapiens
ggtattacactgtatttgta

SEQ ID NO: 5497326 - DNA, 23 bp, Homo sapiens
ggtattagcaaagcaaaaggctg

SEQ ID NO: 5497327 - DNA, 15 bp, Homo sapiens
ggtattagcacctct

SEQ ID NO: 5497328 - DNA, 19 bp, Homo sapiens
ggtattagtgtttgaaaaa

SEQ ID NO: 5497329 - DNA, 23 bp, Homo sapiens
ggtattatactgtagatttcagt

SEQ ID NO: 5497330 - DNA, 15 bp, Homo sapiens
ggtattcaatttgat

SEQ ID NO: 5497331 - DNA, 20 bp, Homo sapiens
ggtattctctctatgcaaaa

SEQ ID NO: 5497332 - DNA, 14 bp, Homo sapiens
ggtattggcctgtt

SEQ ID NO: 5497333 - DNA, 16 bp, Homo sapiens
ggtattggtgctttgt

SEQ ID NO: 5497334 - DNA, 17 bp, Homo sapiens
ggtattgtatttattca

SEQ ID NO: 5497335 - DNA, 14 bp, Homo sapiens
ggtatttaaagtat

SEQ ID NO: 5497336 - DNA, 11 bp, Homo sapiens
ggtatttactg

SEQ ID NO: 5497337 - DNA, 12 bp, Homo sapiens
ggtatttactgc

SEQ ID NO: 5497338 - DNA, 21 bp, Homo sapiens
ggtatttactgcaatgtctgt

SEQ ID NO: 5497339 - DNA, 18 bp, Homo sapiens
ggtatttagaagcagagg

SEQ ID NO: 5497340 - DNA, 18 bp, Homo sapiens
ggtatttcttggcatgca

SEQ ID NO: 5497341 - DNA, 13 bp, Homo sapiens
ggtatttgtttgt

SEQ ID NO: 5497342 - DNA, 16 bp, Homo sapiens
ggtattttaacatagc

SEQ ID NO: 5497343 - DNA, 16 bp, Homo sapiens
ggtattttgaatacca

SEQ ID NO: 5497344 - DNA, 19 bp, Homo sapiens
ggtatttttcagagattta

SEQ ID NO: 5497345 - DNA, 18 bp, Homo sapiens
ggtatttttgttaggttt

SEQ ID NO: 5497346 - DNA, 13 bp, Homo sapiens
ggtcaaaaacaaa

SEQ ID NO: 5497347 - DNA, 18 bp, Homo sapiens
ggtcaaaactgaagcttt

SEQ ID NO: 5497348 - DNA, 18 bp, Homo sapiens
ggtcaaaatagtgccact

SEQ ID NO: 5497349 - DNA, 19 bp, Homo sapiens
ggtcaaacaggctgtaatt

SEQ ID NO: 5497350 - DNA, 21 bp, Homo sapiens
ggtcaaacccaagttagttca

SEQ ID NO: 5497351 - DNA, 22 bp, Homo sapiens
ggtcaaaccgcactcacccatg

SEQ ID NO: 5497352 - DNA, 21 bp, Homo sapiens
ggtcaacacaggtagcacaga

SEQ ID NO: 5497353 - DNA, 20 bp, Homo sapiens
ggtcaacagagaaggcagga

SEQ ID NO: 5497354 - DNA, 22 bp, Homo sapiens
ggtcaacagttttcctatgctt

SEQ ID NO: 5497355 - DNA, 22 bp, Homo sapiens
ggtcaacatttctcatgttgaa

SEQ ID NO: 5497356 - DNA, 15 bp, Homo sapiens
ggtcaacggccctgt

SEQ ID NO: 5497357 - DNA, 21 bp, Homo sapiens
ggtcaactggcgaagcctgag

SEQ ID NO: 5497358 - DNA, 21 bp, Homo sapiens
ggtcaacttaaggtatattta

SEQ ID NO: 5497359 - DNA, 21 bp, Homo sapiens
ggtcaagaaacagccagcaag

SEQ ID NO: 5497360 - DNA, 11 bp, Homo sapiens
ggtcaagaaca

SEQ ID NO: 5497361 - DNA, 14 bp, Homo sapiens
ggtcaagactgtgg

SEQ ID NO: 5497362 - DNA, 13 bp, Homo sapiens
ggtcaagatcagc

SEQ ID NO: 5497363 - DNA, 14 bp, Homo sapiens
ggtcaagcccagaa

SEQ ID NO: 5497364 - DNA, 19 bp, Homo sapiens
ggtcaagcccaggaggact

SEQ ID NO: 5497365 - DNA, 17 bp, Homo sapiens
ggtcaagctgagctggc

SEQ ID NO: 5497366 - DNA, 18 bp, Homo sapiens
ggtcaaggcctgtccctg

SEQ ID NO: 5497367 - DNA, 13 bp, Homo sapiens
ggtcaagggctgg

SEQ ID NO: 5497368 - DNA, 17 bp, Homo sapiens
ggtcaagggctggggct

SEQ ID NO: 5497369 - DNA, 22 bp, Homo sapiens
ggtcaagttcatagtttctgta

SEQ ID NO: 5497370 - DNA, 18 bp, Homo sapiens
ggtcaagttcccaactga

SEQ ID NO: 5497371 - DNA, 19 bp, Homo sapiens
ggtcaagttgagattttta

SEQ ID NO: 5497372 - DNA, 22 bp, Homo sapiens
ggtcaagttgtcaggttattta

SEQ ID NO: 5497373 - DNA, 18 bp, Homo sapiens
ggtcaataacactgtatt

SEQ ID NO: 5497374 - DNA, 20 bp, Homo sapiens
ggtcaataattgtggagagg

SEQ ID NO: 5497375 - DNA, 17 bp, Homo sapiens
ggtcaatcctgtgggtg

SEQ ID NO: 5497376 - DNA, 22 bp, Homo sapiens
ggtcacaaatcctaaaagaagc

SEQ ID NO: 5497377 - DNA, 22 bp, Homo sapiens
ggtcacaagtaggagacacaga

SEQ ID NO: 5497378 - DNA, 21 bp, Homo sapiens
ggtcacacccaccccctgcct

SEQ ID NO: 5497379 - DNA, 23 bp, Homo sapiens
ggtcacacccaccccctgcctgg

SEQ ID NO: 5497380 - DNA, 14 bp, Homo sapiens
ggtcacacggccac

SEQ ID NO: 5497381 - DNA, 13 bp, Homo sapiens
ggtcacagacccc

SEQ ID NO: 5497382 - DNA, 22 bp, Homo sapiens
ggtcacagacccctgggggagg

SEQ ID NO: 5497383 - DNA, 13 bp, Homo sapiens
ggtcacagaggca

SEQ ID NO: 5497384 - DNA, 13 bp, Homo sapiens
ggtcacagcctcc

SEQ ID NO: 5497385 - DNA, 12 bp, Homo sapiens
ggtcacagctgt

SEQ ID NO: 5497386 - DNA, 18 bp, Homo sapiens
ggtcacaggaaggaaaca

SEQ ID NO: 5497387 - DNA, 18 bp, Homo sapiens
ggtcacaggactctgcct

SEQ ID NO: 5497388 - DNA, 14 bp, Homo sapiens
ggtcacaggcccag

SEQ ID NO: 5497389 - DNA, 13 bp, Homo sapiens
ggtcacaggctgt

SEQ ID NO: 5497390 - DNA, 15 bp, Homo sapiens
ggtcacaggctgtgc

SEQ ID NO: 5497391 - DNA, 18 bp, Homo sapiens
ggtcacaggctgtgcctt

SEQ ID NO: 5497392 - DNA, 19 bp, Homo sapiens
ggtcacatatgtctgtatc

SEQ ID NO: 5497393 - DNA, 14 bp, Homo sapiens
ggtcacatccatcc

SEQ ID NO: 5497394 - DNA, 17 bp, Homo sapiens
ggtcacattcaggaaga

SEQ ID NO: 5497395 - DNA, 16 bp, Homo sapiens
ggtcaccaaggcagtg

SEQ ID NO: 5497396 - DNA, 18 bp, Homo sapiens
ggtcaccagcctgactgc

SEQ ID NO: 5497397 - DNA, 11 bp, Homo sapiens
ggtcaccagct

SEQ ID NO: 5497398 - DNA, 19 bp, Homo sapiens
ggtcaccagctgctgtgcc

SEQ ID NO: 5497399 - DNA, 22 bp, Homo sapiens
ggtcaccaggggaggagcctgt

SEQ ID NO: 5497400 - DNA, 18 bp, Homo sapiens
ggtcaccatcctcagagg

SEQ ID NO: 5497401 - DNA, 22 bp, Homo sapiens
ggtcaccatcctcagaggctga

SEQ ID NO: 5497402 - DNA, 20 bp, Homo sapiens
ggtcaccattatgctggtgt

SEQ ID NO: 5497403 - DNA, 19 bp, Homo sapiens
ggtcaccctggcctgccag

SEQ ID NO: 5497404 - DNA, 23 bp, Homo sapiens
ggtcaccgagactcagcctctgc

SEQ ID NO: 5497405 - DNA, 22 bp, Homo sapiens
ggtcaccgcggacgtgctggcc

SEQ ID NO: 5497406 - DNA, 23 bp, Homo sapiens
ggtcaccgcggacgtgctggcct

SEQ ID NO: 5497407 - DNA, 22 bp, Homo sapiens
ggtcacctcactcagcaccact

SEQ ID NO: 5497408 - DNA, 16 bp, Homo sapiens
ggtcaccttcctgggc

SEQ ID NO: 5497409 - DNA, 18 bp, Homo sapiens
ggtcaccttcctgggcag

SEQ ID NO: 5497410 - DNA, 17 bp, Homo sapiens
ggtcaccttgcactcct

SEQ ID NO: 5497411 - DNA, 20 bp, Homo sapiens
ggtcaccttgcactcctcac

SEQ ID NO: 5497412 - DNA, 12 bp, Homo sapiens
ggtcaccttgtt

SEQ ID NO: 5497413 - DNA, 12 bp, Homo sapiens
ggtcactccagt

SEQ ID NO: 5497414 - DNA, 21 bp, Homo sapiens
ggtcactccagtagctcctgg

SEQ ID NO: 5497415 - DNA, 21 bp, Homo sapiens
ggtcactcgtggtgaggctga

SEQ ID NO: 5497416 - DNA, 15 bp, Homo sapiens
ggtcactctgccctc

SEQ ID NO: 5497417 - DNA, 20 bp, Homo sapiens
ggtcactctggcagctcaga

SEQ ID NO: 5497418 - DNA, 22 bp, Homo sapiens
ggtcactctggcagctcagaga

SEQ ID NO: 5497419 - DNA, 21 bp, Homo sapiens
ggtcactcttcctgcaaggac

SEQ ID NO: 5497420 - DNA, 13 bp, Homo sapiens
ggtcactcttggt

SEQ ID NO: 5497421 - DNA, 23 bp, Homo sapiens
ggtcactgaaccactgcttctct

SEQ ID NO: 5497422 - DNA, 22 bp, Homo sapiens
ggtcactgaggcctgagaccca

SEQ ID NO: 5497423 - DNA, 21 bp, Homo sapiens
ggtcactgcccacctgccagg

SEQ ID NO: 5497424 - DNA, 22 bp, Homo sapiens
ggtcactgcccacctgccaggc

SEQ ID NO: 5497425 - DNA, 13 bp, Homo sapiens
ggtcactgctgtc

SEQ ID NO: 5497426 - DNA, 22 bp, Homo sapiens
ggtcactgtgcactgccctgtt

SEQ ID NO: 5497427 - DNA, 18 bp, Homo sapiens
ggtcactgtttcctgggc

SEQ ID NO: 5497428 - DNA, 21 bp, Homo sapiens
ggtcacttaaaatgtgcagta

SEQ ID NO: 5497429 - DNA, 19 bp, Homo sapiens
ggtcacttcaaacatgccc

SEQ ID NO: 5497430 - DNA, 22 bp, Homo sapiens
ggtcacttcaaacatgccctca

SEQ ID NO: 5497431 - DNA, 13 bp, Homo sapiens
ggtcacttcattt

SEQ ID NO: 5497432 - DNA, 15 bp, Homo sapiens
ggtcagaaacaggac

SEQ ID NO: 5497433 - DNA, 18 bp, Homo sapiens
ggtcagaaacaggaccgg

SEQ ID NO: 5497434 - DNA, 19 bp, Homo sapiens
ggtcagaacaggttttttt

SEQ ID NO: 5497435 - DNA, 19 bp, Homo sapiens
ggtcagaaccggcctggag

SEQ ID NO: 5497436 - DNA, 18 bp, Homo sapiens
ggtcagaagaagtgggag

SEQ ID NO: 5497437 - DNA, 19 bp, Homo sapiens
ggtcagaagaagtgggagc

SEQ ID NO: 5497438 - DNA, 19 bp, Homo sapiens
ggtcagaagagttgtgcac

SEQ ID NO: 5497439 - DNA, 18 bp, Homo sapiens
ggtcagacccatctctcc

SEQ ID NO: 5497440 - DNA, 17 bp, Homo sapiens
ggtcagactgaaacgcc

SEQ ID NO: 5497441 - DNA, 16 bp, Homo sapiens
ggtcagactggaggtc

SEQ ID NO: 5497442 - DNA, 21 bp, Homo sapiens
ggtcagagacggcagaaaaca

SEQ ID NO: 5497443 - DNA, 19 bp, Homo sapiens
ggtcagagatgggctgaac

SEQ ID NO: 5497444 - DNA, 13 bp, Homo sapiens
ggtcagagccact

SEQ ID NO: 5497445 - DNA, 15 bp, Homo sapiens
ggtcagagcccagga

SEQ ID NO: 5497446 - DNA, 13 bp, Homo sapiens
ggtcagagcctgc

SEQ ID NO: 5497447 - DNA, 20 bp, Homo sapiens
ggtcagaggacctgtattta

SEQ ID NO: 5497448 - DNA, 14 bp, Homo sapiens
ggtcagagggactg

SEQ ID NO: 5497449 - DNA, 12 bp, Homo sapiens
ggtccaggccag

SEQ ID NO: 5497450 - DNA, 13 bp, Homo sapiens
ggtccaggccagg

SEQ ID NO: 5497451 - DNA, 19 bp, Homo sapiens
ggtccaggccagtgggcct

SEQ ID NO: 5497452 - DNA, 20 bp, Homo sapiens
ggtccaggccagtgggcctg

SEQ ID NO: 5497453 - DNA, 15 bp, Homo sapiens
ggtccaggcccgtgg

SEQ ID NO: 5497454 - DNA, 18 bp, Homo sapiens
ggtccaggccctgtggca

SEQ ID NO: 5497455 - DNA, 22 bp, Homo sapiens
ggtccaggcctactcctgtctt

SEQ ID NO: 5497456 - DNA, 11 bp, Homo sapiens
ggtccagggaa

SEQ ID NO: 5497457 - DNA, 16 bp, Homo sapiens
ggtccagggagcaggc

SEQ ID NO: 5497458 - DNA, 23 bp, Homo sapiens
ggtccagggctgttggaggaccc

SEQ ID NO: 5497459 - DNA, 15 bp, Homo sapiens
ggtccaggggcccct

SEQ ID NO: 5497460 - DNA, 16 bp, Homo sapiens
ggtccaggtcccagcc

SEQ ID NO: 5497461 - DNA, 18 bp, Homo sapiens
ggtccagtcgggaggagc

SEQ ID NO: 5497462 - DNA, 19 bp, Homo sapiens
ggtccagtcgggaggagca

SEQ ID NO: 5497463 - DNA, 21 bp, Homo sapiens
ggtccatagagatgagcccac

SEQ ID NO: 5497464 - DNA, 18 bp, Homo sapiens
ggtccatatttacattct

SEQ ID NO: 5497465 - DNA, 10 bp, Homo sapiens
ggtccatgcc

SEQ ID NO: 5497466 - DNA, 12 bp, Homo sapiens
ggtccatgccca

SEQ ID NO: 5497467 - DNA, 18 bp, Homo sapiens
ggtccatgggcagagccc

SEQ ID NO: 5497468 - DNA, 23 bp, Homo sapiens
ggtcccaacaggaggacaattca

SEQ ID NO: 5497469 - DNA, 14 bp, Homo sapiens
ggtcccaagacagt

SEQ ID NO: 5497470 - DNA, 15 bp, Homo sapiens
ggtcccaagctgggc

SEQ ID NO: 5497471 - DNA, 23 bp, Homo sapiens
ggtcccaaggcaaggggtgcctg

SEQ ID NO: 5497472 - DNA, 13 bp, Homo sapiens
ggtcccacactgg

SEQ ID NO: 5497473 - DNA, 19 bp, Homo sapiens
ggtcccacatccctgggcc

SEQ ID NO: 5497474 - DNA, 13 bp, Homo sapiens
ggtcccaccccca

SEQ ID NO: 5497475 - DNA, 16 bp, Homo sapiens
ggtcccacccccaacc

SEQ ID NO: 5497476 - DNA, 23 bp, Homo sapiens
ggtcccacccccaacccccagag

SEQ ID NO: 5497477 - DNA, 22 bp, Homo sapiens
ggtcccacgaatttgctgggga

SEQ ID NO: 5497478 - DNA, 14 bp, Homo sapiens
ggtcccacgccagg

SEQ ID NO: 5497479 - DNA, 14 bp, Homo sapiens
ggtcccactcagtc

SEQ ID NO: 5497480 - DNA, 16 bp, Homo sapiens
ggtcccagacagctgg

SEQ ID NO: 5497481 - DNA, 17 bp, Homo sapiens
ggtcccagacatgctgc

SEQ ID NO: 5497482 - DNA, 18 bp, Homo sapiens
ggtcccagacatgctgcc

SEQ ID NO: 5497483 - DNA, 14 bp, Homo sapiens
ggtcccagccaccc

SEQ ID NO: 5497484 - DNA, 15 bp, Homo sapiens
ggtcccagccacccc

SEQ ID NO: 5497485 - DNA, 19 bp, Homo sapiens
ggtcccagcccctcctccc

SEQ ID NO: 5497486 - DNA, 15 bp, Homo sapiens
ggtcccagccctggg

SEQ ID NO: 5497487 - DNA, 16 bp, Homo sapiens
ggtcccagccctgggg

SEQ ID NO: 5497488 - DNA, 17 bp, Homo sapiens
ggtcccagcctggccac

SEQ ID NO: 5497489 - DNA, 15 bp, Homo sapiens
ggtcccagcgagcca

SEQ ID NO: 5497490 - DNA, 22 bp, Homo sapiens
ggtcccagctacaggggaggct

SEQ ID NO: 5497491 - DNA, 13 bp, Homo sapiens
ggtcccaggaagc

SEQ ID NO: 5497492 - DNA, 19 bp, Homo sapiens
ggtcccaggacctgagcct

SEQ ID NO: 5497493 - DNA, 21 bp, Homo sapiens
ggtcccaggacctgagcctgg

SEQ ID NO: 5497494 - DNA, 11 bp, Homo sapiens
ggtcccaggat

SEQ ID NO: 5497495 - DNA, 18 bp, Homo sapiens
ggtcccaggatcccctgc

SEQ ID NO: 5497496 - DNA, 14 bp, Homo sapiens
ggtcccagggccct

SEQ ID NO: 5497497 - DNA, 12 bp, Homo sapiens
ggtcccagggct

SEQ ID NO: 5497498 - DNA, 18 bp, Homo sapiens
ggtcccagggctggccct

SEQ ID NO: 5497499 - DNA, 11 bp, Homo sapiens
ggtcccagtgg

SEQ ID NO: 5497500 - DNA, 15 bp, Homo sapiens
ggtcccagtgggagg

SEQ ID NO: 5497501 - DNA, 18 bp, Homo sapiens
ggtcccagtgggaggggc

SEQ ID NO: 5497502 - DNA, 19 bp, Homo sapiens
ggtcccagtgggaggggca

SEQ ID NO: 5497503 - DNA, 21 bp, Homo sapiens
ggtcccagtgggaggggcagg

SEQ ID NO: 5497504 - DNA, 23 bp, Homo sapiens
ggtcccagtgggaggggcaggct

SEQ ID NO: 5497505 - DNA, 18 bp, Homo sapiens
ggtcccatcagtgaaaga

SEQ ID NO: 5497506 - DNA, 17 bp, Homo sapiens
ggtcccatttctcactg

SEQ ID NO: 5497507 - DNA, 21 bp, Homo sapiens
ggtccccaaaacactgtctgc

SEQ ID NO: 5497508 - DNA, 20 bp, Homo sapiens
ggtccccactgctgagctgg

SEQ ID NO: 5497509 - DNA, 12 bp, Homo sapiens
ggtccccagcag

SEQ ID NO: 5497510 - DNA, 23 bp, Homo sapiens
ggtccccagcccttcctctgctc

SEQ ID NO: 5497511 - DNA, 13 bp, Homo sapiens
ggtccccagctcc

SEQ ID NO: 5497512 - DNA, 18 bp, Homo sapiens
ggtccccagctccccagg

SEQ ID NO: 5497513 - DNA, 21 bp, Homo sapiens
ggtccccatcatcccagctgc

SEQ ID NO: 5497514 - DNA, 23 bp, Homo sapiens
ggtccccatccccaccagctcgt

SEQ ID NO: 5497515 - DNA, 15 bp, Homo sapiens
ggtcccccagagcat

SEQ ID NO: 5497516 - DNA, 14 bp, Homo sapiens
ggtcccccaggagg

SEQ ID NO: 5497517 - DNA, 18 bp, Homo sapiens
ggtcccccaggaggcagc

SEQ ID NO: 5497518 - DNA, 18 bp, Homo sapiens
ggtcccccctccattccc

SEQ ID NO: 5497519 - DNA, 14 bp, Homo sapiens
ggtcccccctgagt

SEQ ID NO: 5497520 - DNA, 16 bp, Homo sapiens
ggtcccccctgagtgg

SEQ ID NO: 5497521 - DNA, 18 bp, Homo sapiens
ggtcccccgaccaatccc

SEQ ID NO: 5497522 - DNA, 16 bp, Homo sapiens
ggtcccccgactgcct

SEQ ID NO: 5497523 - DNA, 17 bp, Homo sapiens
ggtcccccgactgcctg

SEQ ID NO: 5497524 - DNA, 21 bp, Homo sapiens
ggtcccccgactgcctgtctc

SEQ ID NO: 5497525 - DNA, 23 bp, Homo sapiens
ggtcccccgactgcctgtctcca

SEQ ID NO: 5497526 - DNA, 23 bp, Homo sapiens
ggtccccctcccacttgacctga

SEQ ID NO: 5497527 - DNA, 12 bp, Homo sapiens
ggtccccctcct

SEQ ID NO: 5497528 - DNA, 14 bp, Homo sapiens
ggtccccctcctgc

SEQ ID NO: 5497529 - DNA, 16 bp, Homo sapiens
ggtccccctgcagcta

SEQ ID NO: 5497530 - DNA, 14 bp, Homo sapiens
ggtccccgccctct

SEQ ID NO: 5497531 - DNA, 14 bp, Homo sapiens
ggtccccgtagccc

SEQ ID NO: 5497532 - DNA, 16 bp, Homo sapiens
ggtcccctccaggagt

SEQ ID NO: 5497533 - DNA, 13 bp, Homo sapiens
ggtcccctccccc

SEQ ID NO: 5497534 - DNA, 18 bp, Homo sapiens
ggtcccctcctcagtgac

SEQ ID NO: 5497535 - DNA, 19 bp, Homo sapiens
ggtcccctctgccccaccc

SEQ ID NO: 5497536 - DNA, 12 bp, Homo sapiens
ggtcccctctgt

SEQ ID NO: 5497537 - DNA, 12 bp, Homo sapiens
ggtcccctgcca

SEQ ID NO: 5497538 - DNA, 18 bp, Homo sapiens
ggtcccctgcctggaact

SEQ ID NO: 5497539 - DNA, 15 bp, Homo sapiens
ggtcccctggcaggg

SEQ ID NO: 5497540 - DNA, 19 bp, Homo sapiens
ggtcccctggcccttcctt

SEQ ID NO: 5497541 - DNA, 20 bp, Homo sapiens
ggtcccctggcccttccttc

SEQ ID NO: 5497542 - DNA, 20 bp, Homo sapiens
ggtcccgcactctgccccca

SEQ ID NO: 5497543 - DNA, 16 bp, Homo sapiens
ggtcccggccagctct

SEQ ID NO: 5497544 - DNA, 19 bp, Homo sapiens
ggtcccggccagctctgga

SEQ ID NO: 5497545 - DNA, 15 bp, Homo sapiens
ggtcccggccgcgcc

SEQ ID NO: 5497546 - DNA, 19 bp, Homo sapiens
ggtcccggctctgtgggtg

SEQ ID NO: 5497547 - DNA, 23 bp, Homo sapiens
ggtcccggctgacacctcccttc

SEQ ID NO: 5497548 - DNA, 19 bp, Homo sapiens
ggtcccgggtgccccccat

SEQ ID NO: 5497549 - DNA, 20 bp, Homo sapiens
ggtcccgtctggctccagcc

SEQ ID NO: 5497550 - DNA, 22 bp, Homo sapiens
ggtcccgtgaaaacactcgtgt

SEQ ID NO: 5497551 - DNA, 17 bp, Homo sapiens
ggtccctaataaagctg

SEQ ID NO: 5497552 - DNA, 16 bp, Homo sapiens
ggtccctcactccaca

SEQ ID NO: 5497553 - DNA, 19 bp, Homo sapiens
ggtccctcaggttcctttt

SEQ ID NO: 5497554 - DNA, 21 bp, Homo sapiens
ggtccctccaccccacagaac

SEQ ID NO: 5497555 - DNA, 20 bp, Homo sapiens
ggtccctcctttggaccctg

SEQ ID NO: 5497556 - DNA, 21 bp, Homo sapiens
ggtccctcctttggaccctgt

SEQ ID NO: 5497557 - DNA, 22 bp, Homo sapiens
ggtccctctcagatacccagtg

SEQ ID NO: 5497558 - DNA, 13 bp, Homo sapiens
ggtccctctgagg

SEQ ID NO: 5497559 - DNA, 14 bp, Homo sapiens
ggtccctctgtgta

SEQ ID NO: 5497560 - DNA, 14 bp, Homo sapiens
ggtccctcttctct

SEQ ID NO: 5497561 - DNA, 15 bp, Homo sapiens
ggtccctcttctctc

SEQ ID NO: 5497562 - DNA, 16 bp, Homo sapiens
ggtccctcttctctcc

SEQ ID NO: 5497563 - DNA, 20 bp, Homo sapiens
ggtccctcttctctcctcag

SEQ ID NO: 5497564 - DNA, 15 bp, Homo sapiens
ggtccctgccagtgt

SEQ ID NO: 5497565 - DNA, 18 bp, Homo sapiens
ggtccctgccctcccctg

SEQ ID NO: 5497566 - DNA, 21 bp, Homo sapiens
ggtccctgccctcccctgctc

SEQ ID NO: 5497567 - DNA, 13 bp, Homo sapiens
ggtccctgctgcc

SEQ ID NO: 5497568 - DNA, 18 bp, Homo sapiens
ggtccctgctgtgttccc

SEQ ID NO: 5497569 - DNA, 17 bp, Homo sapiens
ggtccctggaccagcct

SEQ ID NO: 5497570 - DNA, 13 bp, Homo sapiens
ggtccctgggagg

SEQ ID NO: 5497571 - DNA, 23 bp, Homo sapiens
ggtccctgggaggaaatttgaat

SEQ ID NO: 5497572 - DNA, 11 bp, Homo sapiens
ggtccctgggt

SEQ ID NO: 5497573 - DNA, 19 bp, Homo sapiens
ggtccctggtccctcgtcc

SEQ ID NO: 5497574 - DNA, 12 bp, Homo sapiens
ggtccctgtatg

SEQ ID NO: 5497575 - DNA, 21 bp, Homo sapiens
ggtccctgtgctgatcctgct

SEQ ID NO: 5497576 - DNA, 22 bp, Homo sapiens
ggtccctgtgctgatcctgctg

SEQ ID NO: 5497577 - DNA, 22 bp, Homo sapiens
ggtccctgtgtgtaggctgggg

SEQ ID NO: 5497578 - DNA, 16 bp, Homo sapiens
ggtccctgttgtcaga

SEQ ID NO: 5497579 - DNA, 20 bp, Homo sapiens
ggtcccttccatgccctggg

SEQ ID NO: 5497580 - DNA, 21 bp, Homo sapiens
ggtcccttcccgacccagcca

SEQ ID NO: 5497581 - DNA, 22 bp, Homo sapiens
ggtcccttcccgacccagccag

SEQ ID NO: 5497582 - DNA, 19 bp, Homo sapiens
ggtcccttgaaggaagagg

SEQ ID NO: 5497583 - DNA, 20 bp, Homo sapiens
ggtcccttgaaggaagaggg

SEQ ID NO: 5497584 - DNA, 13 bp, Homo sapiens
ggtccgcaccctg

SEQ ID NO: 5497585 - DNA, 20 bp, Homo sapiens
ggtccgcaccctgtcctgca

SEQ ID NO: 5497586 - DNA, 15 bp, Homo sapiens
ggtccgcatccctgc

SEQ ID NO: 5497587 - DNA, 17 bp, Homo sapiens
ggtccgcatccctgctt

SEQ ID NO: 5497588 - DNA, 16 bp, Homo sapiens
ggtccgcggcctgcac

SEQ ID NO: 5497589 - DNA, 16 bp, Homo sapiens
ggtccgctttcctgga

SEQ ID NO: 5497590 - DNA, 19 bp, Homo sapiens
ggtccgctttcctggagcc

SEQ ID NO: 5497591 - DNA, 15 bp, Homo sapiens
ggtccggaagggtga

SEQ ID NO: 5497592 - DNA, 15 bp, Homo sapiens
ggtccggcctctccc

SEQ ID NO: 5497593 - DNA, 19 bp, Homo sapiens
ggtccggcctctccctgcc

SEQ ID NO: 5497594 - DNA, 22 bp, Homo sapiens
ggtccggcctctccctgcctgt

SEQ ID NO: 5497595 - DNA, 16 bp, Homo sapiens
ggtccggtgttctaag

SEQ ID NO: 5497596 - DNA, 17 bp, Homo sapiens
ggtccggtgttctaaga

SEQ ID NO: 5497597 - DNA, 21 bp, Homo sapiens
ggtccggtgttctaagatgtg

SEQ ID NO: 5497598 - DNA, 18 bp, Homo sapiens
ggtccgtagctcccctgg

SEQ ID NO: 5497599 - DNA, 20 bp, Homo sapiens
ggtccgtagctcccctggct

SEQ ID NO: 5497600 - DNA, 23 bp, Homo sapiens
ggtccgtagctcccctggctggc

SEQ ID NO: 5497601 - DNA, 17 bp, Homo sapiens
ggtccgtgcccaggccc

SEQ ID NO: 5497602 - DNA, 19 bp, Homo sapiens
ggtccgtgcccaggccctt

SEQ ID NO: 5497603 - DNA, 18 bp, Homo sapiens
ggtccgtgctaaggactt

SEQ ID NO: 5497604 - DNA, 18 bp, Homo sapiens
ggtccgtttccttacaca

SEQ ID NO: 5497605 - DNA, 16 bp, Homo sapiens
ggtcctaaaagcaaaa

SEQ ID NO: 5497606 - DNA, 14 bp, Homo sapiens
ggtcctacggaggg

SEQ ID NO: 5497607 - DNA, 16 bp, Homo sapiens
ggtcctactcctggag

SEQ ID NO: 5497608 - DNA, 18 bp, Homo sapiens
ggtcctactcctggagca

SEQ ID NO: 5497609 - DNA, 21 bp, Homo sapiens
ggtcctactcctggagcactg

SEQ ID NO: 5497610 - DNA, 23 bp, Homo sapiens
ggtcctagaaattccccaccctg

SEQ ID NO: 5497611 - DNA, 14 bp, Homo sapiens
ggtcctagcccttc

SEQ ID NO: 5497612 - DNA, 17 bp, Homo sapiens
ggtcctagcccttccct

SEQ ID NO: 5497613 - DNA, 19 bp, Homo sapiens
ggtcctagtgtctattccc

SEQ ID NO: 5497614 - DNA, 15 bp, Homo sapiens
ggtcctcacagcagt

SEQ ID NO: 5497615 - DNA, 19 bp, Homo sapiens
ggtcctcacttctgtctcc

SEQ ID NO: 5497616 - DNA, 21 bp, Homo sapiens
ggtcctcaggcagtggcccag

SEQ ID NO: 5497617 - DNA, 22 bp, Homo sapiens
ggtcctcaggtcagctgggagc

SEQ ID NO: 5497618 - DNA, 20 bp, Homo sapiens
ggtcctcatctgcaaagcat

SEQ ID NO: 5497619 - DNA, 16 bp, Homo sapiens
ggtcctcattcaaagg

SEQ ID NO: 5497620 - DNA, 20 bp, Homo sapiens
ggtcctccatttcaactcca

SEQ ID NO: 5497621 - DNA, 22 bp, Homo sapiens
ggtcctccatttcaactccaga

SEQ ID NO: 5497622 - DNA, 12 bp, Homo sapiens
ggtcctcccagc

SEQ ID NO: 5497623 - DNA, 16 bp, Homo sapiens
ggtcctcccctctctt

SEQ ID NO: 5497624 - DNA, 16 bp, Homo sapiens
ggtcctccgcctactg

SEQ ID NO: 5497625 - DNA, 21 bp, Homo sapiens
ggtcctcctaagtcccttcct

SEQ ID NO: 5497626 - DNA, 23 bp, Homo sapiens
ggtcctcctaagtcccttcctat

SEQ ID NO: 5497627 - DNA, 18 bp, Homo sapiens
ggtctcccaaagtgctgg

SEQ ID NO: 5497628 - DNA, 18 bp, Homo sapiens
ggtctccctccagctgga

SEQ ID NO: 5497629 - DNA, 22 bp, Homo sapiens
ggtctccctctcctgcctactc

SEQ ID NO: 5497630 - DNA, 18 bp, Homo sapiens
ggtctccctgagcctgcc

SEQ ID NO: 5497631 - DNA, 12 bp, Homo sapiens
ggtctccctggc

SEQ ID NO: 5497632 - DNA, 24 bp, Homo sapiens
ggtctccctggctccctcctccag

SEQ ID NO: 5497633 - DNA, 13 bp, Homo sapiens
ggtctccctgggc

SEQ ID NO: 5497634 - DNA, 20 bp, Homo sapiens
ggtctcccttctctacactc

SEQ ID NO: 5497635 - DNA, 15 bp, Homo sapiens
ggtctcctcaggacc

SEQ ID NO: 5497636 - DNA, 14 bp, Homo sapiens
ggtctcctcagggt

SEQ ID NO: 5497637 - DNA, 17 bp, Homo sapiens
ggtctcctcccagcggc

SEQ ID NO: 5497638 - DNA, 23 bp, Homo sapiens
ggtctcctccccgtagccactct

SEQ ID NO: 5497639 - DNA, 19 bp, Homo sapiens
ggtctcctctttgttttgt

SEQ ID NO: 5497640 - DNA, 23 bp, Homo sapiens
ggtctcctggaccttgacagagc

SEQ ID NO: 5497641 - DNA, 23 bp, Homo sapiens
ggtctcctgggcatctggccctg

SEQ ID NO: 5497642 - DNA, 16 bp, Homo sapiens
ggtctccttggaaatc

SEQ ID NO: 5497643 - DNA, 20 bp, Homo sapiens
ggtctcgaactcctgacctt

SEQ ID NO: 5497644 - DNA, 17 bp, Homo sapiens
ggtctcgaactcctggc

SEQ ID NO: 5497645 - DNA, 18 bp, Homo sapiens
ggtctcgaactcctggcc

SEQ ID NO: 5497646 - DNA, 15 bp, Homo sapiens
ggtctcgatgctgct

SEQ ID NO: 5497647 - DNA, 19 bp, Homo sapiens
ggtctcgatgctgctggcc

SEQ ID NO: 5497648 - DNA, 23 bp, Homo sapiens
ggtctcgcagcctgaagcctgga

SEQ ID NO: 5497649 - DNA, 19 bp, Homo sapiens
ggtctcgctgatgctgggc

SEQ ID NO: 5497650 - DNA, 20 bp, Homo sapiens
ggtctcgctgatgctgggct

SEQ ID NO: 5497651 - DNA, 21 bp, Homo sapiens
ggtctcgctttgttgcccagg

SEQ ID NO: 5497652 - DNA, 19 bp, Homo sapiens
ggtctcgggggtccggaag

SEQ ID NO: 5497653 - DNA, 16 bp, Homo sapiens
ggtctcgggggtgggc

SEQ ID NO: 5497654 - DNA, 16 bp, Homo sapiens
ggtctctaggcctgaa

SEQ ID NO: 5497655 - DNA, 19 bp, Homo sapiens
ggtctctagtgctgtgaaa

SEQ ID NO: 5497656 - DNA, 21 bp, Homo sapiens
ggtctctcacagacaggaccc

SEQ ID NO: 5497657 - DNA, 13 bp, Homo sapiens
ggtctctcaggga

SEQ ID NO: 5497658 - DNA, 22 bp, Homo sapiens
ggtctctcagggatggagggaa

SEQ ID NO: 5497659 - DNA, 16 bp, Homo sapiens
ggtctctccctcaggt

SEQ ID NO: 5497660 - DNA, 17 bp, Homo sapiens
ggtctctccctcaggtg

SEQ ID NO: 5497661 - DNA, 23 bp, Homo sapiens
ggtctctccctcccccagagccc

SEQ ID NO: 5497662 - DNA, 11 bp, Homo sapiens
ggtctctcctt

SEQ ID NO: 5497663 - DNA, 14 bp, Homo sapiens
ggtctctctccagg

SEQ ID NO: 5497664 - DNA, 21 bp, Homo sapiens
ggtctctctccctacctccct

SEQ ID NO: 5497665 - DNA, 14 bp, Homo sapiens
ggtctctctccctc

SEQ ID NO: 5497666 - DNA, 19 bp, Homo sapiens
ggtctctctcggcccctgt

SEQ ID NO: 5497667 - DNA, 21 bp, Homo sapiens
ggtctctctcggcccctgtct

SEQ ID NO: 5497668 - DNA, 15 bp, Homo sapiens
ggtctctgaagggac

SEQ ID NO: 5497669 - DNA, 15 bp, Homo sapiens
ggtctctgagacagg

SEQ ID NO: 5497670 - DNA, 13 bp, Homo sapiens
ggtctctgagcag

SEQ ID NO: 5497671 - DNA, 19 bp, Homo sapiens
ggtctctgagcagtgggga

SEQ ID NO: 5497672 - DNA, 18 bp, Homo sapiens
ggtctctgcatcttcagt

SEQ ID NO: 5497673 - DNA, 21 bp, Homo sapiens
ggtctctgccatgaactggag

SEQ ID NO: 5497674 - DNA, 23 bp, Homo sapiens
ggtctctgccatgaactggaggc

SEQ ID NO: 5497675 - DNA, 18 bp, Homo sapiens
ggtctctgccccagcctg

SEQ ID NO: 5497676 - DNA, 16 bp, Homo sapiens
ggtctctgctccagca

SEQ ID NO: 5497677 - DNA, 19 bp, Homo sapiens
ggtctctgctggggaaggg

SEQ ID NO: 5497678 - DNA, 11 bp, Homo sapiens
ggtctctggca

SEQ ID NO: 5497679 - DNA, 14 bp, Homo sapiens
ggtctctgggagcc

SEQ ID NO: 5497680 - DNA, 13 bp, Homo sapiens
ggtctctggggac

SEQ ID NO: 5497681 - DNA, 20 bp, Homo sapiens
ggtctctggggaccctccag

SEQ ID NO: 5497682 - DNA, 22 bp, Homo sapiens
ggtctctggggaccctccagag

SEQ ID NO: 5497683 - DNA, 19 bp, Homo sapiens
ggtctctgtacgggccagt

SEQ ID NO: 5497684 - DNA, 12 bp, Homo sapiens
ggtctcttcctt

SEQ ID NO: 5497685 - DNA, 16 bp, Homo sapiens
ggtctcttcctttgct

SEQ ID NO: 5497686 - DNA, 21 bp, Homo sapiens
ggtctcttcctttgctctgag

SEQ ID NO: 5497687 - DNA, 16 bp, Homo sapiens
ggtctcttctcccaga

SEQ ID NO: 5497688 - DNA, 22 bp, Homo sapiens
ggtctcttcttctttctggttg

SEQ ID NO: 5497689 - DNA, 15 bp, Homo sapiens
ggtctctttctttcc

SEQ ID NO: 5497690 - DNA, 17 bp, Homo sapiens
ggtctctttgctttctg

SEQ ID NO: 5497691 - DNA, 20 bp, Homo sapiens
ggtctcttttgtaaattaaa

SEQ ID NO: 5497692 - DNA, 15 bp, Homo sapiens
ggtctgaaggactgg

SEQ ID NO: 5497693 - DNA, 17 bp, Homo sapiens
ggtctgaatgttctgac

SEQ ID NO: 5497694 - DNA, 22 bp, Homo sapiens
ggtctgaccgatgtgtctccca

SEQ ID NO: 5497695 - DNA, 13 bp, Homo sapiens
ggtctgactccaa

SEQ ID NO: 5497696 - DNA, 23 bp, Homo sapiens
ggtctgactccaaagctgttcca

SEQ ID NO: 5497697 - DNA, 21 bp, Homo sapiens
ggtctgagaagattcaattta

SEQ ID NO: 5497698 - DNA, 16 bp, Homo sapiens
ggtctgagcaccccct

SEQ ID NO: 5497699 - DNA, 15 bp, Homo sapiens
ggtctgagccacagc

SEQ ID NO: 5497700 - DNA, 15 bp, Homo sapiens
ggtctgaggcccctg

SEQ ID NO: 5497701 - DNA, 19 bp, Homo sapiens
ggtctgagtctatgttcaa

SEQ ID NO: 5497702 - DNA, 24 bp, Homo sapiens
ggtctgatgccaaagctgctttct

SEQ ID NO: 5497703 - DNA, 13 bp, Homo sapiens
ggtctgattggct

SEQ ID NO: 5497704 - DNA, 17 bp, Homo sapiens
ggtctgattttctcact

SEQ ID NO: 5497705 - DNA, 16 bp, Homo sapiens
ggtctgcaagtcagag

SEQ ID NO: 5497706 - DNA, 12 bp, Homo sapiens
ggtctgcacaca

SEQ ID NO: 5497707 - DNA, 22 bp, Homo sapiens
ggtctgcacacataacacacat

SEQ ID NO: 5497708 - DNA, 15 bp, Homo sapiens
ggtctgcagaccatc

SEQ ID NO: 5497709 - DNA, 16 bp, Homo sapiens
ggtctgcagcctgctg

SEQ ID NO: 5497710 - DNA, 12 bp, Homo sapiens
ggtctgcaggcc

SEQ ID NO: 5497711 - DNA, 16 bp, Homo sapiens
ggtctgcaggccacca

SEQ ID NO: 5497712 - DNA, 15 bp, Homo sapiens
ggtctgcagggaatt

SEQ ID NO: 5497713 - DNA, 17 bp, Homo sapiens
ggtctgcaggtgagcag

SEQ ID NO: 5497714 - DNA, 11 bp, Homo sapiens
ggtctgccaat

SEQ ID NO: 5497715 - DNA, 12 bp, Homo sapiens
ggtctgccacca

SEQ ID NO: 5497716 - DNA, 11 bp, Homo sapiens
ggtctgccctg

SEQ ID NO: 5497717 - DNA, 12 bp, Homo sapiens
ggtctgccctgc

SEQ ID NO: 5497718 - DNA, 16 bp, Homo sapiens
ggtctgccctgcccat

SEQ ID NO: 5497719 - DNA, 13 bp, Homo sapiens
ggtctgccctggg

SEQ ID NO: 5497720 - DNA, 15 bp, Homo sapiens
ggtctgccctgggct

SEQ ID NO: 5497721 - DNA, 17 bp, Homo sapiens
ggtctgccttctgctga

SEQ ID NO: 5497722 - DNA, 23 bp, Homo sapiens
ggtctgctcccaaggggcctgag

SEQ ID NO: 5497723 - DNA, 19 bp, Homo sapiens
ggtctgctcgggcccaggc

SEQ ID NO: 5497724 - DNA, 20 bp, Homo sapiens
ggtctgctctttctctgcca

SEQ ID NO: 5497725 - DNA, 18 bp, Homo sapiens
ggtctgcttttgctgggg

SEQ ID NO: 5497726 - DNA, 13 bp, Homo sapiens
ggtctggaaacag

SEQ ID NO: 5497727 - DNA, 15 bp, Homo sapiens
ggtctggagccccta

SEQ ID NO: 5497728 - DNA, 16 bp, Homo sapiens
ggtctggagcccctat

SEQ ID NO: 5497729 - DNA, 14 bp, Homo sapiens
ggtctggaggacct

SEQ ID NO: 5497730 - DNA, 16 bp, Homo sapiens
ggtctggagtcccacc

SEQ ID NO: 5497731 - DNA, 16 bp, Homo sapiens
ggtctggagttgctga

SEQ ID NO: 5497732 - DNA, 16 bp, Homo sapiens
ggtctggatgggagga

SEQ ID NO: 5497733 - DNA, 18 bp, Homo sapiens
ggtctggattttcaaaga

SEQ ID NO: 5497734 - DNA, 20 bp, Homo sapiens
ggtctggcagagcctctgag

SEQ ID NO: 5497735 - DNA, 20 bp, Homo sapiens
ggtctggcagggatgggttt

SEQ ID NO: 5497736 - DNA, 13 bp, Homo sapiens
ggtctggcagggc

SEQ ID NO: 5497737 - DNA, 15 bp, Homo sapiens
ggtctggccagggct

SEQ ID NO: 5497738 - DNA, 15 bp, Homo sapiens
ggtctggcgccaggg

SEQ ID NO: 5497739 - DNA, 20 bp, Homo sapiens
ggtctggctagagggcccaa

SEQ ID NO: 5497740 - DNA, 13 bp, Homo sapiens
ggtctggctggtg

SEQ ID NO: 5497741 - DNA, 23 bp, Homo sapiens
ggtctggctttggaaagacctgt

SEQ ID NO: 5497742 - DNA, 11 bp, Homo sapiens
ggtctgggagg

SEQ ID NO: 5497743 - DNA, 21 bp, Homo sapiens
ggtctgggaggaatggacaga

SEQ ID NO: 5497744 - DNA, 14 bp, Homo sapiens
ggtctgggaggcag

SEQ ID NO: 5497745 - DNA, 19 bp, Homo sapiens
ggtctgggagtcacacagt

SEQ ID NO: 5497746 - DNA, 20 bp, Homo sapiens
ggtctgggagtcacacagtg

SEQ ID NO: 5497747 - DNA, 20 bp, Homo sapiens
ggtctgggagtcaggcccgg

SEQ ID NO: 5497748 - DNA, 13 bp, Homo sapiens
ggtctgggcagca

SEQ ID NO: 5497749 - DNA, 16 bp, Homo sapiens
ggtctgggcagtgcca

SEQ ID NO: 5497750 - DNA, 20 bp, Homo sapiens
ggtctgggcagtgccacagc

SEQ ID NO: 5497751 - DNA, 21 bp, Homo sapiens
ggtctgggccagatgctgggc

SEQ ID NO: 5497752 - DNA, 22 bp, Homo sapiens
ggtctgggcggcgggcggctgg

SEQ ID NO: 5497753 - DNA, 18 bp, Homo sapiens
ggtctggggaagaggatg

SEQ ID NO: 5497754 - DNA, 20 bp, Homo sapiens
ggtctgggggcacaagactg

SEQ ID NO: 5497755 - DNA, 16 bp, Homo sapiens
ggtctgggggcagctg

SEQ ID NO: 5497756 - DNA, 19 bp, Homo sapiens
ggtctgggtttggcaggca

SEQ ID NO: 5497757 - DNA, 14 bp, Homo sapiens
ggtctggtcaggca

SEQ ID NO: 5497758 - DNA, 15 bp, Homo sapiens
ggtctggtgctgagg

SEQ ID NO: 5497759 - DNA, 15 bp, Homo sapiens
ggtctggttcctgtg

SEQ ID NO: 5497760 - DNA, 16 bp, Homo sapiens
ggtctggttcctgtgt

SEQ ID NO: 5497761 - DNA, 24 bp, Homo sapiens
ggtctggttgttgcaccatctgct

SEQ ID NO: 5497762 - DNA, 12 bp, Homo sapiens
ggtctgtaaaat

SEQ ID NO: 5497763 - DNA, 16 bp, Homo sapiens
ggtctgtcagggttgg

SEQ ID NO: 5497764 - DNA, 15 bp, Homo sapiens
ggtctgtcccaccag

SEQ ID NO: 5497765 - DNA, 12 bp, Homo sapiens
ggtctgtctgga

SEQ ID NO: 5497766 - DNA, 23 bp, Homo sapiens
ggtctgtctgttaccataagtct

SEQ ID NO: 5497767 - DNA, 14 bp, Homo sapiens
ggtctgtgagatgc

SEQ ID NO: 5497768 - DNA, 18 bp, Homo sapiens
ggtctgtgcattgtggct

SEQ ID NO: 5497769 - DNA, 20 bp, Homo sapiens
ggtctgtgcattgtggctgt

SEQ ID NO: 5497770 - DNA, 15 bp, Homo sapiens
ggtctgtgctgtgcc

SEQ ID NO: 5497771 - DNA, 21 bp, Homo sapiens
ggtctgtgctgtgcctgctag

SEQ ID NO: 5497772 - DNA, 22 bp, Homo sapiens
ggtctgtgtaacatccaagcca

SEQ ID NO: 5497773 - DNA, 16 bp, Homo sapiens
ggtctgtgtcatttct

SEQ ID NO: 5497774 - DNA, 13 bp, Homo sapiens
ggtctgtgtctct

SEQ ID NO: 5497775 - DNA, 19 bp, Homo sapiens
ggtctgtgtctcttttctc

SEQ ID NO: 5497776 - DNA, 15 bp, Homo sapiens
ggtctgtgtgaatgt

SEQ ID NO: 5497777 - DNA, 17 bp, Homo sapiens
ggtctgtgtgaatgtgg

SEQ ID NO: 5497778 - DNA, 16 bp, Homo sapiens
ggtctgtgtgctgttt

SEQ ID NO: 5497779 - DNA, 18 bp, Homo sapiens
ggtctgtgtgctgtttga

SEQ ID NO: 5497780 - DNA, 15 bp, Homo sapiens
ggtctgtgtgtgaca

SEQ ID NO: 5497781 - DNA, 21 bp, Homo sapiens
ggtctgtgtgtgtgtatgtgg

SEQ ID NO: 5497782 - DNA, 22 bp, Homo sapiens
ggtctgtgtgtgtgtgtgtgcg

SEQ ID NO: 5497783 - DNA, 18 bp, Homo sapiens
ggtctgtgtgtgttcttc

SEQ ID NO: 5497784 - DNA, 12 bp, Homo sapiens
ggtctgttcttt

SEQ ID NO: 5497785 - DNA, 17 bp, Homo sapiens
ggtctgttctttccaaa

SEQ ID NO: 5497786 - DNA, 20 bp, Homo sapiens
ggtctgttggcaggctggcc

SEQ ID NO: 5497787 - DNA, 21 bp, Homo sapiens
ggtctgttgtaaatgaccaag

SEQ ID NO: 5497788 - DNA, 13 bp, Homo sapiens
ggtctgtttaaat

SEQ ID NO: 5497789 - DNA, 12 bp, Homo sapiens
ggtctgtttctg

SEQ ID NO: 5497790 - DNA, 23 bp, Homo sapiens
ggtcttaagaaatgtataaactt

SEQ ID NO: 5497791 - DNA, 20 bp, Homo sapiens
ggtcttacctctctgggacc

SEQ ID NO: 5497792 - DNA, 21 bp, Homo sapiens
ggtcttactttgttaatttat

SEQ ID NO: 5497793 - DNA, 17 bp, Homo sapiens
ggtcttaggatgtctgt

SEQ ID NO: 5497794 - DNA, 13 bp, Homo sapiens
ggtcttatattta

SEQ ID NO: 5497795 - DNA, 22 bp, Homo sapiens
ggtcttatgattttattacaga

SEQ ID NO: 5497796 - DNA, 19 bp, Homo sapiens
ggtcttcaagcctggccca

SEQ ID NO: 5497797 - DNA, 16 bp, Homo sapiens
ggtcttcactgcccag

SEQ ID NO: 5497798 - DNA, 17 bp, Homo sapiens
ggtcttcactgcccagg

SEQ ID NO: 5497799 - DNA, 16 bp, Homo sapiens
ggtcttcagcctccct

SEQ ID NO: 5497800 - DNA, 12 bp, Homo sapiens
ggtcttcagctt

SEQ ID NO: 5497801 - DNA, 12 bp, Homo sapiens
ggtcttcagggg

SEQ ID NO: 5497802 - DNA, 17 bp, Homo sapiens
ggtcttccagacctgct

SEQ ID NO: 5497803 - DNA, 12 bp, Homo sapiens
ggtcttccaggg

SEQ ID NO: 5497804 - DNA, 22 bp, Homo sapiens
ggtcttccggggccatgggcat

SEQ ID NO: 5497805 - DNA, 20 bp, Homo sapiens
ggtgagcctgactgccagga

SEQ ID NO: 5497806 - DNA, 11 bp, Homo sapiens
ggtgagcctgg

SEQ ID NO: 5497807 - DNA, 15 bp, Homo sapiens
ggtgagcctgggcag

SEQ ID NO: 5497808 - DNA, 22 bp, Homo sapiens
ggtgagcgatcatttatttcat

SEQ ID NO: 5497809 - DNA, 21 bp, Homo sapiens
ggtgagctatagtgaagaata

SEQ ID NO: 5497810 - DNA, 11 bp, Homo sapiens
ggtgagctcag

SEQ ID NO: 5497811 - DNA, 13 bp, Homo sapiens
ggtgagctctcag

SEQ ID NO: 5497812 - DNA, 16 bp, Homo sapiens
ggtgagctctcaggcc

SEQ ID NO: 5497813 - DNA, 19 bp, Homo sapiens
ggtgagctctcaggccgag

SEQ ID NO: 5497814 - DNA, 23 bp, Homo sapiens
ggtgagctctcaggccgagagcc

SEQ ID NO: 5497815 - DNA, 18 bp, Homo sapiens
ggtgagctgcacctgatt

SEQ ID NO: 5497816 - DNA, 17 bp, Homo sapiens
ggtgaggaagctccagt

SEQ ID NO: 5497817 - DNA, 15 bp, Homo sapiens
ggtgaggaggaggca

SEQ ID NO: 5497818 - DNA, 17 bp, Homo sapiens
ggtgaggcaggggagtc

SEQ ID NO: 5497819 - DNA, 13 bp, Homo sapiens
ggtgaggcccagc

SEQ ID NO: 5497820 - DNA, 18 bp, Homo sapiens
ggtgaggccggccctgcc

SEQ ID NO: 5497821 - DNA, 12 bp, Homo sapiens
ggtgaggcctgt

SEQ ID NO: 5497822 - DNA, 17 bp, Homo sapiens
ggtgaggcctgtctgtg

SEQ ID NO: 5497823 - DNA, 19 bp, Homo sapiens
ggtgaggcctgtctgtgac

SEQ ID NO: 5497824 - DNA, 20 bp, Homo sapiens
ggtgaggcgtgggatccaga

SEQ ID NO: 5497825 - DNA, 12 bp, Homo sapiens
ggtgagggatgt

SEQ ID NO: 5497826 - DNA, 14 bp, Homo sapiens
ggtgagggccttct

SEQ ID NO: 5497827 - DNA, 14 bp, Homo sapiens
ggtgagggctgaga

SEQ ID NO: 5497828 - DNA, 20 bp, Homo sapiens
ggtgagggctgagagggctg

SEQ ID NO: 5497829 - DNA, 17 bp, Homo sapiens
ggtgaggggccactggg

SEQ ID NO: 5497830 - DNA, 21 bp, Homo sapiens
ggtgagggtgcggggcctgca

SEQ ID NO: 5497831 - DNA, 11 bp, Homo sapiens
ggtgaggtggc

SEQ ID NO: 5497832 - DNA, 17 bp, Homo sapiens
ggtgaggtggcccaggc

SEQ ID NO: 5497833 - DNA, 16 bp, Homo sapiens
ggtgaggtgggggcag

SEQ ID NO: 5497834 - DNA, 18 bp, Homo sapiens
ggtgagtccattctccca

SEQ ID NO: 5497835 - DNA, 18 bp, Homo sapiens
ggtgagtcccctactccc

SEQ ID NO: 5497836 - DNA, 17 bp, Homo sapiens
ggtgagtcctccagaac

SEQ ID NO: 5497837 - DNA, 18 bp, Homo sapiens
ggtgagtctgaaccaata

SEQ ID NO: 5497838 - DNA, 18 bp, Homo sapiens
ggtgagtcttggttctaa

SEQ ID NO: 5497839 - DNA, 16 bp, Homo sapiens
ggtgagtgtgagggca

SEQ ID NO: 5497840 - DNA, 19 bp, Homo sapiens
ggtgagtgtgagggcagca

SEQ ID NO: 5497841 - DNA, 21 bp, Homo sapiens
ggtgagtttgagctgccttcc

SEQ ID NO: 5497842 - DNA, 19 bp, Homo sapiens
ggtgagttttaaagaagtc

SEQ ID NO: 5497843 - DNA, 14 bp, Homo sapiens
ggtgagtttttctt

SEQ ID NO: 5497844 - DNA, 15 bp, Homo sapiens
ggtgataagggaaaa

SEQ ID NO: 5497845 - DNA, 22 bp, Homo sapiens
ggtgataaggggccttgctctg

SEQ ID NO: 5497846 - DNA, 14 bp, Homo sapiens
ggtgataagtggaa

SEQ ID NO: 5497847 - DNA, 15 bp, Homo sapiens
ggtgataagtggaaa

SEQ ID NO: 5497848 - DNA, 22 bp, Homo sapiens
ggtgataatagaagagtggcag

SEQ ID NO: 5497849 - DNA, 21 bp, Homo sapiens
ggtgatactccaaggtggcat

SEQ ID NO: 5497850 - DNA, 16 bp, Homo sapiens
ggtgatagcattgctt

SEQ ID NO: 5497851 - DNA, 22 bp, Homo sapiens
ggtgataggtataagtggtgtg

SEQ ID NO: 5497852 - DNA, 20 bp, Homo sapiens
ggtgatatccattctttctg

SEQ ID NO: 5497853 - DNA, 22 bp, Homo sapiens
ggtgatatttttatgtgcagcg

SEQ ID NO: 5497854 - DNA, 14 bp, Homo sapiens
ggtgatcagaaggc

SEQ ID NO: 5497855 - DNA, 18 bp, Homo sapiens
ggtgatccacccacctca

SEQ ID NO: 5497856 - DNA, 19 bp, Homo sapiens
ggtgatcccgttttcccca

SEQ ID NO: 5497857 - DNA, 21 bp, Homo sapiens
ggtgatccgcccacctcagcc

SEQ ID NO: 5497858 - DNA, 17 bp, Homo sapiens
ggtgatctgggattagg

SEQ ID NO: 5497859 - DNA, 13 bp, Homo sapiens
ggtgatgagggca

SEQ ID NO: 5497860 - DNA, 15 bp, Homo sapiens
ggtgatgagggcagc

SEQ ID NO: 5497861 - DNA, 22 bp, Homo sapiens
ggtgatgagggcagcagccagc

SEQ ID NO: 5497862 - DNA, 18 bp, Homo sapiens
ggtgatgcctaattatga

SEQ ID NO: 5497863 - DNA, 13 bp, Homo sapiens
ggtgatgccttcc

SEQ ID NO: 5497864 - DNA, 17 bp, Homo sapiens
ggtgatgctctggcttg

SEQ ID NO: 5497865 - DNA, 15 bp, Homo sapiens
ggtgatgctgggctg

SEQ ID NO: 5497866 - DNA, 14 bp, Homo sapiens
ggtgatggaaaaag

SEQ ID NO: 5497867 - DNA, 14 bp, Homo sapiens
ggtgatggccagag

SEQ ID NO: 5497868 - DNA, 15 bp, Homo sapiens
ggtgatggccagagg

SEQ ID NO: 5497869 - DNA, 17 bp, Homo sapiens
ggtgatgggggcatggg

SEQ ID NO: 5497870 - DNA, 16 bp, Homo sapiens
ggtgatgtcctgtaaa

SEQ ID NO: 5497871 - DNA, 18 bp, Homo sapiens
ggtgattctcagggctgg

SEQ ID NO: 5497872 - DNA, 18 bp, Homo sapiens
ggtgattggaccaggcca

SEQ ID NO: 5497873 - DNA, 18 bp, Homo sapiens
ggtgatttaagggcccag

SEQ ID NO: 5497874 - DNA, 22 bp, Homo sapiens
ggtgatttcctctaaagaaact

SEQ ID NO: 5497875 - DNA, 21 bp, Homo sapiens
ggtgatttctcaccctctgtc

SEQ ID NO: 5497876 - DNA, 18 bp, Homo sapiens
ggtgcaaaaaaaaactta

SEQ ID NO: 5497877 - DNA, 12 bp, Homo sapiens
ggtgcaaatcct

SEQ ID NO: 5497878 - DNA, 15 bp, Homo sapiens
ggtgcaagagacaga

SEQ ID NO: 5497879 - DNA, 22 bp, Homo sapiens
ggtgcaagagacagagccccca

SEQ ID NO: 5497880 - DNA, 22 bp, Homo sapiens
ggtgcaaggccatctgcttacc

SEQ ID NO: 5497881 - DNA, 16 bp, Homo sapiens
ggtgcaatgacctttc

SEQ ID NO: 5497882 - DNA, 18 bp, Homo sapiens
ggtgcaatgacctttcaa

SEQ ID NO: 5497883 - DNA, 19 bp, Homo sapiens
ggtgcaatgacctttcaat

SEQ ID NO: 5497884 - DNA, 20 bp, Homo sapiens
ggtgcaatgacctttcaata

SEQ ID NO: 5497885 - DNA, 22 bp, Homo sapiens
ggtgcaatgtgtgtatatggac

SEQ ID NO: 5497886 - DNA, 16 bp, Homo sapiens
ggtgcacaagctccaa

SEQ ID NO: 5497887 - DNA, 22 bp, Homo sapiens
ggtgcacaagctccaagctccc

SEQ ID NO: 5497888 - DNA, 20 bp, Homo sapiens
ggtgcacacatcaccaggtg

SEQ ID NO: 5497889 - DNA, 14 bp, Homo sapiens
ggtgcacaggcctc

SEQ ID NO: 5497890 - DNA, 16 bp, Homo sapiens
ggtgcacaggcctctg

SEQ ID NO: 5497891 - DNA, 20 bp, Homo sapiens
ggtgcacaggcctctgcctg

SEQ ID NO: 5497892 - DNA, 21 bp, Homo sapiens
ggtgcacaggcctctgcctgc

SEQ ID NO: 5497893 - DNA, 18 bp, Homo sapiens
ggtgcacagtccacagct

SEQ ID NO: 5497894 - DNA, 16 bp, Homo sapiens
ggtgcacccacctgtt

SEQ ID NO: 5497895 - DNA, 19 bp, Homo sapiens
ggtgcacctgccccaggct

SEQ ID NO: 5497896 - DNA, 20 bp, Homo sapiens
ggtgcacgcaggcacagcag

SEQ ID NO: 5497897 - DNA, 23 bp, Homo sapiens
ggtgcacttggggcacagggaga

SEQ ID NO: 5497898 - DNA, 16 bp, Homo sapiens
ggtgcagaacaggggc

SEQ ID NO: 5497899 - DNA, 17 bp, Homo sapiens
ggtgcagaacaggggca

SEQ ID NO: 5497900 - DNA, 19 bp, Homo sapiens
ggtgcagacgcggcgggga

SEQ ID NO: 5497901 - DNA, 23 bp, Homo sapiens
ggtgcagagggtttgtgcccagt

SEQ ID NO: 5497902 - DNA, 16 bp, Homo sapiens
ggtgcagagtgcccag

SEQ ID NO: 5497903 - DNA, 20 bp, Homo sapiens
ggtgcagatggtactgctga

SEQ ID NO: 5497904 - DNA, 20 bp, Homo sapiens
ggtgcagccccagggcctgc

SEQ ID NO: 5497905 - DNA, 14 bp, Homo sapiens
ggtgcagctgcgtt

SEQ ID NO: 5497906 - DNA, 16 bp, Homo sapiens
ggtgcagctgggtggg

SEQ ID NO: 5497907 - DNA, 12 bp, Homo sapiens
ggtgcaggcagg

SEQ ID NO: 5497908 - DNA, 13 bp, Homo sapiens
ggtgcaggcgcct

SEQ ID NO: 5497909 - DNA, 21 bp, Homo sapiens
ggtgcaggcgcgcaccgccca

SEQ ID NO: 5497910 - DNA, 16 bp, Homo sapiens
ggtgcagggcctggca

SEQ ID NO: 5497911 - DNA, 17 bp, Homo sapiens
ggtgcagggcctggcat

SEQ ID NO: 5497912 - DNA, 21 bp, Homo sapiens
ggtgcaggtctccacctgcac

SEQ ID NO: 5497913 - DNA, 14 bp, Homo sapiens
ggtgcaggtgggca

SEQ ID NO: 5497914 - DNA, 19 bp, Homo sapiens
ggtgcagtatctcttgctg

SEQ ID NO: 5497915 - DNA, 17 bp, Homo sapiens
ggtgcagtggagggggc

SEQ ID NO: 5497916 - DNA, 12 bp, Homo sapiens
ggtgcagtggct

SEQ ID NO: 5497917 - DNA, 16 bp, Homo sapiens
ggtgcagtgtgaaaag

SEQ ID NO: 5497918 - DNA, 18 bp, Homo sapiens
ggtgcagtttgaggggcc

SEQ ID NO: 5497919 - DNA, 15 bp, Homo sapiens
ggtgcatagaactgg

SEQ ID NO: 5497920 - DNA, 15 bp, Homo sapiens
ggtgcatctcctccc

SEQ ID NO: 5497921 - DNA, 18 bp, Homo sapiens
ggtgcatgccgctgcatc

SEQ ID NO: 5497922 - DNA, 22 bp, Homo sapiens
ggtgcatggcttggggagcaga

SEQ ID NO: 5497923 - DNA, 23 bp, Homo sapiens
ggtgcatggcttggggagcagag

SEQ ID NO: 5497924 - DNA, 13 bp, Homo sapiens
ggtgcatgggctc

SEQ ID NO: 5497925 - DNA, 19 bp, Homo sapiens
ggtgcatgttcttttctgg

SEQ ID NO: 5497926 - DNA, 14 bp, Homo sapiens
ggtgcattgtcctt

SEQ ID NO: 5497927 - DNA, 15 bp, Homo sapiens
ggtgcattgttattt

SEQ ID NO: 5497928 - DNA, 24 bp, Homo sapiens
ggtgcatttcccccgcagtgcata

SEQ ID NO: 5497929 - DNA, 10 bp, Homo sapiens
ggtgccaaac

SEQ ID NO: 5497930 - DNA, 22 bp, Homo sapiens
ggtgccaaacccagcccctgcg

SEQ ID NO: 5497931 - DNA, 18 bp, Homo sapiens
ggtgccaaatagccccag

SEQ ID NO: 5497932 - DNA, 18 bp, Homo sapiens
ggtgccaaccacctctgg

SEQ ID NO: 5497933 - DNA, 23 bp, Homo sapiens
ggtgccaaccacctctggccctg

SEQ ID NO: 5497934 - DNA, 12 bp, Homo sapiens
ggtgccaagggc

SEQ ID NO: 5497935 - DNA, 22 bp, Homo sapiens
ggtgccaatggaacctcctttc

SEQ ID NO: 5497936 - DNA, 23 bp, Homo sapiens
ggtgccacagagggctgtgtctt

SEQ ID NO: 5497937 - DNA, 14 bp, Homo sapiens
ggtgccaccaataa

SEQ ID NO: 5497938 - DNA, 17 bp, Homo sapiens
ggtgccaccaccctgcc

SEQ ID NO: 5497939 - DNA, 17 bp, Homo sapiens
ggtgccactccctgagc

SEQ ID NO: 5497940 - DNA, 14 bp, Homo sapiens
ggtgccactgaccg

SEQ ID NO: 5497941 - DNA, 19 bp, Homo sapiens
ggtgccactttacccacct

SEQ ID NO: 5497942 - DNA, 16 bp, Homo sapiens
ggtgccagatcctctt

SEQ ID NO: 5497943 - DNA, 13 bp, Homo sapiens
ggtgccagcaaag

SEQ ID NO: 5497944 - DNA, 18 bp, Homo sapiens
ggtgccagcaaagcccca

SEQ ID NO: 5497945 - DNA, 19 bp, Homo sapiens
ggtgccagcaaagccccat

SEQ ID NO: 5497946 - DNA, 13 bp, Homo sapiens
ggtgccagcctga

SEQ ID NO: 5497947 - DNA, 17 bp, Homo sapiens
ggtgccagcctgaggca

SEQ ID NO: 5497948 - DNA, 14 bp, Homo sapiens
ggtgccagctgccc

SEQ ID NO: 5497949 - DNA, 18 bp, Homo sapiens
ggtgccaggctgtaagca

SEQ ID NO: 5497950 - DNA, 20 bp, Homo sapiens
ggtgccagggcccaccccag

SEQ ID NO: 5497951 - DNA, 16 bp, Homo sapiens
ggtgccagggctgcag

SEQ ID NO: 5497952 - DNA, 17 bp, Homo sapiens
ggtgccagttgggctcg

SEQ ID NO: 5497953 - DNA, 15 bp, Homo sapiens
ggtgccatgcctgct

SEQ ID NO: 5497954 - DNA, 19 bp, Homo sapiens
ggtgccatgcctgctccct

SEQ ID NO: 5497955 - DNA, 18 bp, Homo sapiens
ggtgccatgtctgcagtg

SEQ ID NO: 5497956 - DNA, 15 bp, Homo sapiens
ggtgccattcccagc

SEQ ID NO: 5497957 - DNA, 20 bp, Homo sapiens
ggtgccattttaaattttat

SEQ ID NO: 5497958 - DNA, 23 bp, Homo sapiens
ggtgcccaaacaccagtcacctc

SEQ ID NO: 5497959 - DNA, 14 bp, Homo sapiens
ggtgcccaagccag

SEQ ID NO: 5497960 - DNA, 21 bp, Homo sapiens
ggtgcccaagccagaggctgg

SEQ ID NO: 5497961 - DNA, 22 bp, Homo sapiens
ggtgcccaagccagaggctggg

SEQ ID NO: 5497962 - DNA, 23 bp, Homo sapiens
ggtgcccaagccagaggctgggt

SEQ ID NO: 5497963 - DNA, 21 bp, Homo sapiens
ggtgcccacaccggggacagg

SEQ ID NO: 5497964 - DNA, 13 bp, Homo sapiens
ggtgcccacaggc

SEQ ID NO: 5497965 - DNA, 16 bp, Homo sapiens
ggtgcccactccgcca

SEQ ID NO: 5497966 - DNA, 18 bp, Homo sapiens
ggtgcccactccgccagc

SEQ ID NO: 5497967 - DNA, 20 bp, Homo sapiens
ggtgcccactccgccagcca

SEQ ID NO: 5497968 - DNA, 21 bp, Homo sapiens
ggtgcccactccgccagccac

SEQ ID NO: 5497969 - DNA, 24 bp, Homo sapiens
ggtgcccactccgccagccacagg

SEQ ID NO: 5497970 - DNA, 19 bp, Homo sapiens
ggtgcccagaacttccctg

SEQ ID NO: 5497971 - DNA, 20 bp, Homo sapiens
ggtgcccagaatgaggctgc

SEQ ID NO: 5497972 - DNA, 22 bp, Homo sapiens
ggtgcccagctatacctgtgcc

SEQ ID NO: 5497973 - DNA, 22 bp, Homo sapiens
ggtgcccaggacggtctgtgcc

SEQ ID NO: 5497974 - DNA, 23 bp, Homo sapiens
ggtgcccaggacggtctgtgccc

SEQ ID NO: 5497975 - DNA, 15 bp, Homo sapiens
ggtgcccagggccag

SEQ ID NO: 5497976 - DNA, 20 bp, Homo sapiens
ggtgccccacaaggcccagc

SEQ ID NO: 5497977 - DNA, 21 bp, Homo sapiens
ggtgccccacaaggcccagcc

SEQ ID NO: 5497978 - DNA, 23 bp, Homo sapiens
ggtgccccacagctacctgagac

SEQ ID NO: 5497979 - DNA, 13 bp, Homo sapiens
ggtgccccacctc

SEQ ID NO: 5497980 - DNA, 21 bp, Homo sapiens
ggtgccccacctccccagagc

SEQ ID NO: 5497981 - DNA, 21 bp, Homo sapiens
ggtgcttgttccctctccctg

SEQ ID NO: 5497982 - DNA, 18 bp, Homo sapiens
ggtgctttccttcatctc

SEQ ID NO: 5497983 - DNA, 19 bp, Homo sapiens
ggtgcttttatagaggcta

SEQ ID NO: 5497984 - DNA, 18 bp, Homo sapiens
ggtgcttttgatgtgaaa

SEQ ID NO: 5497985 - DNA, 21 bp, Homo sapiens
ggtgctttttataaaaagata

SEQ ID NO: 5497986 - DNA, 17 bp, Homo sapiens
ggtggaaaacagggtgc

SEQ ID NO: 5497987 - DNA, 13 bp, Homo sapiens
ggtggaaaatgga

SEQ ID NO: 5497988 - DNA, 21 bp, Homo sapiens
ggtggaaataatttgaatgta

SEQ ID NO: 5497989 - DNA, 11 bp, Homo sapiens
ggtggaagagc

SEQ ID NO: 5497990 - DNA, 20 bp, Homo sapiens
ggtggaagaggttctcagca

SEQ ID NO: 5497991 - DNA, 13 bp, Homo sapiens
ggtggaagcagag

SEQ ID NO: 5497992 - DNA, 16 bp, Homo sapiens
ggtggaagcagaggcc

SEQ ID NO: 5497993 - DNA, 17 bp, Homo sapiens
ggtggaagcagaggccc

SEQ ID NO: 5497994 - DNA, 21 bp, Homo sapiens
ggtggaagcagaggccctgcc

SEQ ID NO: 5497995 - DNA, 20 bp, Homo sapiens
ggtggaagctgggtgagcca

SEQ ID NO: 5497996 - DNA, 20 bp, Homo sapiens
ggtggaaggagcctgcggct

SEQ ID NO: 5497997 - DNA, 15 bp, Homo sapiens
ggtggaaggatggga

SEQ ID NO: 5497998 - DNA, 15 bp, Homo sapiens
ggtggaaggcagaca

SEQ ID NO: 5497999 - DNA, 20 bp, Homo sapiens
ggtggaagtgcccagcccct

SEQ ID NO: 5498000 - DNA, 22 bp, Homo sapiens
ggtggaagtgtgtgccaagagc

SEQ ID NO: 5498001 - DNA, 16 bp, Homo sapiens
ggtggaagttgcagtg

SEQ ID NO: 5498002 - DNA, 15 bp, Homo sapiens
ggtggaatgccgctg

SEQ ID NO: 5498003 - DNA, 22 bp, Homo sapiens
ggtggaatgcgggggagcaggc

SEQ ID NO: 5498004 - DNA, 21 bp, Homo sapiens
ggtggaattacttaaatttta

SEQ ID NO: 5498005 - DNA, 22 bp, Homo sapiens
ggtggaattattagcaccagct

SEQ ID NO: 5498006 - DNA, 13 bp, Homo sapiens
ggtggacacacaa

SEQ ID NO: 5498007 - DNA, 15 bp, Homo sapiens
ggtggacagacccag

SEQ ID NO: 5498008 - DNA, 15 bp, Homo sapiens
ggtggacagtcctgg

SEQ ID NO: 5498009 - DNA, 18 bp, Homo sapiens
ggtggacagtcctgggag

SEQ ID NO: 5498010 - DNA, 21 bp, Homo sapiens
ggtggaccacgccgccctcca

SEQ ID NO: 5498011 - DNA, 14 bp, Homo sapiens
ggtggacccaggga

SEQ ID NO: 5498012 - DNA, 16 bp, Homo sapiens
ggtggaccctgtaaat

SEQ ID NO: 5498013 - DNA, 13 bp, Homo sapiens
ggtggacctggca

SEQ ID NO: 5498014 - DNA, 18 bp, Homo sapiens
ggtggacgctgcagaccc

SEQ ID NO: 5498015 - DNA, 18 bp, Homo sapiens
ggtggacttagaaagcag

SEQ ID NO: 5498016 - DNA, 21 bp, Homo sapiens
ggtggacttagaaagcagggg

SEQ ID NO: 5498017 - DNA, 21 bp, Homo sapiens
ggtggacttgaactttcctgg

SEQ ID NO: 5498018 - DNA, 11 bp, Homo sapiens
ggtggagaagc

SEQ ID NO: 5498019 - DNA, 14 bp, Homo sapiens
ggtggagaagccat

SEQ ID NO: 5498020 - DNA, 23 bp, Homo sapiens
ggtggagagggagatgtgtgagc

SEQ ID NO: 5498021 - DNA, 21 bp, Homo sapiens
ggtggagagtggaaggactgt

SEQ ID NO: 5498022 - DNA, 22 bp, Homo sapiens
ggtggagatgtcagtctgtcca

SEQ ID NO: 5498023 - DNA, 15 bp, Homo sapiens
ggtggagcagccaga

SEQ ID NO: 5498024 - DNA, 16 bp, Homo sapiens
ggtggagcagccagag

SEQ ID NO: 5498025 - DNA, 20 bp, Homo sapiens
ggtggagcaggactcccacc

SEQ ID NO: 5498026 - DNA, 23 bp, Homo sapiens
ggtggagccaagtggtccagcgt

SEQ ID NO: 5498027 - DNA, 14 bp, Homo sapiens
ggtggagccagggc

SEQ ID NO: 5498028 - DNA, 22 bp, Homo sapiens
ggtggagcttgcaatgagccaa

SEQ ID NO: 5498029 - DNA, 21 bp, Homo sapiens
ggtggagcttgcagtgagccg

SEQ ID NO: 5498030 - DNA, 22 bp, Homo sapiens
ggtggaggaaggctctgtcact

SEQ ID NO: 5498031 - DNA, 13 bp, Homo sapiens
ggtggaggaaggg

SEQ ID NO: 5498032 - DNA, 17 bp, Homo sapiens
ggtggaggaagggctgg

SEQ ID NO: 5498033 - DNA, 22 bp, Homo sapiens
ggtggaggaaggtgctgagctt

SEQ ID NO: 5498034 - DNA, 20 bp, Homo sapiens
ggtggaggagctgagggagg

SEQ ID NO: 5498035 - DNA, 21 bp, Homo sapiens
ggtggaggagctgagggaggg

SEQ ID NO: 5498036 - DNA, 12 bp, Homo sapiens
ggtggaggagga

SEQ ID NO: 5498037 - DNA, 12 bp, Homo sapiens
ggtggaggatgg

SEQ ID NO: 5498038 - DNA, 22 bp, Homo sapiens
ggtggaggattgctgccagaga

SEQ ID NO: 5498039 - DNA, 21 bp, Homo sapiens
ggtggaggctaagcctggaca

SEQ ID NO: 5498040 - DNA, 21 bp, Homo sapiens
ggtggaggctgcggtgagccg

SEQ ID NO: 5498041 - DNA, 14 bp, Homo sapiens
ggtggagggcacag

SEQ ID NO: 5498042 - DNA, 18 bp, Homo sapiens
ggtggagggcacagccct

SEQ ID NO: 5498043 - DNA, 14 bp, Homo sapiens
ggtggagggcactt

SEQ ID NO: 5498044 - DNA, 24 bp, Homo sapiens
ggtggagggggaggggagaagcca

SEQ ID NO: 5498045 - DNA, 17 bp, Homo sapiens
ggtggaggttgtgcatg

SEQ ID NO: 5498046 - DNA, 14 bp, Homo sapiens
ggtggagtcaggaa

SEQ ID NO: 5498047 - DNA, 15 bp, Homo sapiens
ggtggagttaatctt

SEQ ID NO: 5498048 - DNA, 15 bp, Homo sapiens
ggtggagtttctctg

SEQ ID NO: 5498049 - DNA, 15 bp, Homo sapiens
ggtggatcacagagg

SEQ ID NO: 5498050 - DNA, 16 bp, Homo sapiens
ggtggatcacctgagg

SEQ ID NO: 5498051 - DNA, 22 bp, Homo sapiens
ggtggatccactgtgcaggagt

SEQ ID NO: 5498052 - DNA, 22 bp, Homo sapiens
ggtggatggccccagcacagct

SEQ ID NO: 5498053 - DNA, 13 bp, Homo sapiens
ggtggatggtgac

SEQ ID NO: 5498054 - DNA, 16 bp, Homo sapiens
ggtggatgtgctggag

SEQ ID NO: 5498055 - DNA, 22 bp, Homo sapiens
ggtggatttactgagagaaggt

SEQ ID NO: 5498056 - DNA, 19 bp, Homo sapiens
ggtggcaagggggcggggc

SEQ ID NO: 5498057 - DNA, 20 bp, Homo sapiens
ggtggcaagggggcggggcg

SEQ ID NO: 5498058 - DNA, 17 bp, Homo sapiens
ggtggcaatgcttaaac

SEQ ID NO: 5498059 - DNA, 19 bp, Homo sapiens
ggtggcacacgcctgtaat

SEQ ID NO: 5498060 - DNA, 18 bp, Homo sapiens
ggtggcacatctgtcctg

SEQ ID NO: 5498061 - DNA, 23 bp, Homo sapiens
ggtggcacatctgtcctgacaga

SEQ ID NO: 5498062 - DNA, 16 bp, Homo sapiens
ggtggcacccaccact

SEQ ID NO: 5498063 - DNA, 19 bp, Homo sapiens
ggtggcacccaccactctc

SEQ ID NO: 5498064 - DNA, 13 bp, Homo sapiens
ggtggcacctcct

SEQ ID NO: 5498065 - DNA, 18 bp, Homo sapiens
ggtggcacgggccctccc

SEQ ID NO: 5498066 - DNA, 15 bp, Homo sapiens
ggtggcactacccca

SEQ ID NO: 5498067 - DNA, 14 bp, Homo sapiens
ggtggcactaggga

SEQ ID NO: 5498068 - DNA, 20 bp, Homo sapiens
ggtggcactgagccccccca

SEQ ID NO: 5498069 - DNA, 13 bp, Homo sapiens
ggtggcactgcca

SEQ ID NO: 5498070 - DNA, 23 bp, Homo sapiens
ggtggcacttccacctccagcct

SEQ ID NO: 5498071 - DNA, 16 bp, Homo sapiens
ggtggcactttttcat

SEQ ID NO: 5498072 - DNA, 14 bp, Homo sapiens
ggtggcagagacag

SEQ ID NO: 5498073 - DNA, 17 bp, Homo sapiens
ggtggcagagacagtgg

SEQ ID NO: 5498074 - DNA, 13 bp, Homo sapiens
ggtggcagcaaca

SEQ ID NO: 5498075 - DNA, 14 bp, Homo sapiens
ggtggcagcaacaa

SEQ ID NO: 5498076 - DNA, 12 bp, Homo sapiens
ggtggcagctgc

SEQ ID NO: 5498077 - DNA, 14 bp, Homo sapiens
ggtggcaggaccag

SEQ ID NO: 5498078 - DNA, 22 bp, Homo sapiens
ggtggcagggaagggtgcctgg

SEQ ID NO: 5498079 - DNA, 17 bp, Homo sapiens
ggtggcagggctgttcc

SEQ ID NO: 5498080 - DNA, 14 bp, Homo sapiens
ggtggcagtggaaa

SEQ ID NO: 5498081 - DNA, 15 bp, Homo sapiens
ggtggcatacgcctg

SEQ ID NO: 5498082 - DNA, 21 bp, Homo sapiens
ggtggcatggaagagggaggg

SEQ ID NO: 5498083 - DNA, 19 bp, Homo sapiens
ggtggcatgtgcctatagt

SEQ ID NO: 5498084 - DNA, 22 bp, Homo sapiens
ggtggcatttgcaggtgaccag

SEQ ID NO: 5498085 - DNA, 16 bp, Homo sapiens
ggtggcatttgctgaa

SEQ ID NO: 5498086 - DNA, 14 bp, Homo sapiens
ggtggccaagcctg

SEQ ID NO: 5498087 - DNA, 16 bp, Homo sapiens
ggtggccaagcctgcc

SEQ ID NO: 5498088 - DNA, 19 bp, Homo sapiens
ggtggccaagcctgccccg

SEQ ID NO: 5498089 - DNA, 23 bp, Homo sapiens
ggtggccaatccaggtgggagag

SEQ ID NO: 5498090 - DNA, 22 bp, Homo sapiens
ggtggccacacaggcagggcct

SEQ ID NO: 5498091 - DNA, 23 bp, Homo sapiens
ggtggccacacaggcagggcctg

SEQ ID NO: 5498092 - DNA, 12 bp, Homo sapiens
ggtggccacagt

SEQ ID NO: 5498093 - DNA, 16 bp, Homo sapiens
ggtggccactgagctg

SEQ ID NO: 5498094 - DNA, 23 bp, Homo sapiens
ggtggccacttcattccagcagc

SEQ ID NO: 5498095 - DNA, 17 bp, Homo sapiens
ggtggccagaggtgtca

SEQ ID NO: 5498096 - DNA, 22 bp, Homo sapiens
ggtggccagcccgcagaggtgg

SEQ ID NO: 5498097 - DNA, 12 bp, Homo sapiens
ggtggccaggcc

SEQ ID NO: 5498098 - DNA, 21 bp, Homo sapiens
ggtggccaggcctgccagccc

SEQ ID NO: 5498099 - DNA, 23 bp, Homo sapiens
ggtggccaggcctgccagcccct

SEQ ID NO: 5498100 - DNA, 14 bp, Homo sapiens
ggtggccaggctgg

SEQ ID NO: 5498101 - DNA, 11 bp, Homo sapiens
ggtggccaggg

SEQ ID NO: 5498102 - DNA, 18 bp, Homo sapiens
ggtggccatccctgggcc

SEQ ID NO: 5498103 - DNA, 14 bp, Homo sapiens
ggtggcccagagcc

SEQ ID NO: 5498104 - DNA, 15 bp, Homo sapiens
ggtggcccagagcca

SEQ ID NO: 5498105 - DNA, 13 bp, Homo sapiens
ggtggcccaggcc

SEQ ID NO: 5498106 - DNA, 15 bp, Homo sapiens
ggtggcccaggcccc

SEQ ID NO: 5498107 - DNA, 15 bp, Homo sapiens
ggtggcccaggtggc

SEQ ID NO: 5498108 - DNA, 21 bp, Homo sapiens
ggtggccccctgtgccagctc

SEQ ID NO: 5498109 - DNA, 15 bp, Homo sapiens
ggtggcccctcccca

SEQ ID NO: 5498110 - DNA, 14 bp, Homo sapiens
ggtggcccctgcct

SEQ ID NO: 5498111 - DNA, 22 bp, Homo sapiens
ggtggcccctgctgtctctctg

SEQ ID NO: 5498112 - DNA, 23 bp, Homo sapiens
ggtggcccctgctgtctctctgg

SEQ ID NO: 5498113 - DNA, 21 bp, Homo sapiens
ggtggccccttctatgcccag

SEQ ID NO: 5498114 - DNA, 22 bp, Homo sapiens
ggtggccccttctatgcccagc

SEQ ID NO: 5498115 - DNA, 16 bp, Homo sapiens
ggtggcccgacagcct

SEQ ID NO: 5498116 - DNA, 19 bp, Homo sapiens
ggtggcccgacagcctggc

SEQ ID NO: 5498117 - DNA, 15 bp, Homo sapiens
ggtggccctcccagg

SEQ ID NO: 5498118 - DNA, 16 bp, Homo sapiens
ggtggccctcccaggc

SEQ ID NO: 5498119 - DNA, 18 bp, Homo sapiens
ggtggccctctcccctgc

SEQ ID NO: 5498120 - DNA, 19 bp, Homo sapiens
ggtggccctctcccctgcc

SEQ ID NO: 5498121 - DNA, 20 bp, Homo sapiens
ggtggccctgactgtcaggg

SEQ ID NO: 5498122 - DNA, 21 bp, Homo sapiens
ggtggccctgactgtcaggga

SEQ ID NO: 5498123 - DNA, 12 bp, Homo sapiens
ggtggccctgcg

SEQ ID NO: 5498124 - DNA, 15 bp, Homo sapiens
ggtggccctggggaa

SEQ ID NO: 5498125 - DNA, 23 bp, Homo sapiens
ggtggcccttatgactgccaaga

SEQ ID NO: 5498126 - DNA, 24 bp, Homo sapiens
ggtggccgctcctccctgctcctc

SEQ ID NO: 5498127 - DNA, 18 bp, Homo sapiens
ggtggccggccctgcccc

SEQ ID NO: 5498128 - DNA, 21 bp, Homo sapiens
ggtggccggccctgcccccca

SEQ ID NO: 5498129 - DNA, 15 bp, Homo sapiens
ggtggccgggcacag

SEQ ID NO: 5498130 - DNA, 16 bp, Homo sapiens
ggtggccgggggtggg

SEQ ID NO: 5498131 - DNA, 15 bp, Homo sapiens
ggtggccgtcacgct

SEQ ID NO: 5498132 - DNA, 17 bp, Homo sapiens
ggtggccgtcctgaggg

SEQ ID NO: 5498133 - DNA, 20 bp, Homo sapiens
ggtggccgtcctgaggggga

SEQ ID NO: 5498134 - DNA, 23 bp, Homo sapiens
ggtggcctatttcagctgctttg

SEQ ID NO: 5498135 - DNA, 11 bp, Homo sapiens
ggtggcctcag

SEQ ID NO: 5498136 - DNA, 14 bp, Homo sapiens
ggtggcctctgcct

SEQ ID NO: 5498137 - DNA, 18 bp, Homo sapiens
ggtggcctctgctggtct

SEQ ID NO: 5498138 - DNA, 13 bp, Homo sapiens
ggtggcctggccc

SEQ ID NO: 5498139 - DNA, 17 bp, Homo sapiens
ggtggcctgttccctag

SEQ ID NO: 5498140 - DNA, 19 bp, Homo sapiens
ggtggccttgagtctctga

SEQ ID NO: 5498141 - DNA, 22 bp, Homo sapiens
ggtggcgctagaggccatggag

SEQ ID NO: 5498142 - DNA, 13 bp, Homo sapiens
ggtggcggcaggg

SEQ ID NO: 5498143 - DNA, 19 bp, Homo sapiens
ggtggcgggcacctgtaat

SEQ ID NO: 5498144 - DNA, 19 bp, Homo sapiens
ggtggcgggtgcctgtaat

SEQ ID NO: 5498145 - DNA, 22 bp, Homo sapiens
ggtggcgtctgcctaggagctg

SEQ ID NO: 5498146 - DNA, 20 bp, Homo sapiens
ggtggcgtgagcctgtagtc

SEQ ID NO: 5498147 - DNA, 20 bp, Homo sapiens
ggtggcgttatggcagcccg

SEQ ID NO: 5498148 - DNA, 14 bp, Homo sapiens
ggtggctaaaggtc

SEQ ID NO: 5498149 - DNA, 19 bp, Homo sapiens
ggtggctaagggggaccat

SEQ ID NO: 5498150 - DNA, 19 bp, Homo sapiens
ggtggctactctgtgccag

SEQ ID NO: 5498151 - DNA, 21 bp, Homo sapiens
ggtggctagtcaagctcctcc

SEQ ID NO: 5498152 - DNA, 23 bp, Homo sapiens
ggtggctagtcaagctcctcctc

SEQ ID NO: 5498153 - DNA, 15 bp, Homo sapiens
ggtggctagtcagag

SEQ ID NO: 5498154 - DNA, 17 bp, Homo sapiens
ggtggctagtcagagag

SEQ ID NO: 5498155 - DNA, 14 bp, Homo sapiens
ggtggctcacacct

SEQ ID NO: 5498156 - DNA, 19 bp, Homo sapiens
ggtggctcacgcctgtaat

SEQ ID NO: 5498157 - DNA, 16 bp, Homo sapiens
ggtggtcacaggctgt

SEQ ID NO: 5498158 - DNA, 21 bp, Homo sapiens
ggtggtcacaggctgtgcctt

SEQ ID NO: 5498159 - DNA, 15 bp, Homo sapiens
ggtggtcaccaggtc

SEQ ID NO: 5498160 - DNA, 19 bp, Homo sapiens
ggtggtcactggaactcag

SEQ ID NO: 5498161 - DNA, 21 bp, Homo sapiens
ggtggtcagcagaaaccccca

SEQ ID NO: 5498162 - DNA, 14 bp, Homo sapiens
ggtggtccctgggt

SEQ ID NO: 5498163 - DNA, 17 bp, Homo sapiens
ggtggtcctgagacctg

SEQ ID NO: 5498164 - DNA, 17 bp, Homo sapiens
ggtggtctgcaggcagg

SEQ ID NO: 5498165 - DNA, 13 bp, Homo sapiens
ggtggtctgctcg

SEQ ID NO: 5498166 - DNA, 19 bp, Homo sapiens
ggtggtctgctcgggccca

SEQ ID NO: 5498167 - DNA, 20 bp, Homo sapiens
ggtggtctgctcgggcccag

SEQ ID NO: 5498168 - DNA, 13 bp, Homo sapiens
ggtggtctgcttt

SEQ ID NO: 5498169 - DNA, 14 bp, Homo sapiens
ggtggtctggtgcc

SEQ ID NO: 5498170 - DNA, 22 bp, Homo sapiens
ggtggtcttcaagcctggccca

SEQ ID NO: 5498171 - DNA, 16 bp, Homo sapiens
ggtggtcttggagagg

SEQ ID NO: 5498172 - DNA, 17 bp, Homo sapiens
ggtggtcttggagagga

SEQ ID NO: 5498173 - DNA, 20 bp, Homo sapiens
ggtggtcttggagaggaggt

SEQ ID NO: 5498174 - DNA, 22 bp, Homo sapiens
ggtggtcttggagaggaggtgt

SEQ ID NO: 5498175 - DNA, 23 bp, Homo sapiens
ggtggtgacgtggtagtcacttg

SEQ ID NO: 5498176 - DNA, 13 bp, Homo sapiens
ggtggtgatgtcc

SEQ ID NO: 5498177 - DNA, 17 bp, Homo sapiens
ggtggtgcagccccagg

SEQ ID NO: 5498178 - DNA, 13 bp, Homo sapiens
ggtggtgccagag

SEQ ID NO: 5498179 - DNA, 20 bp, Homo sapiens
ggtggtgctgggactgagcc

SEQ ID NO: 5498180 - DNA, 12 bp, Homo sapiens
ggtggtggaggg

SEQ ID NO: 5498181 - DNA, 12 bp, Homo sapiens
ggtggtggcaca

SEQ ID NO: 5498182 - DNA, 17 bp, Homo sapiens
ggtggtggcactgagcc

SEQ ID NO: 5498183 - DNA, 19 bp, Homo sapiens
ggtggtggcagctgggcag

SEQ ID NO: 5498184 - DNA, 15 bp, Homo sapiens
ggtggtggctcggga

SEQ ID NO: 5498185 - DNA, 20 bp, Homo sapiens
ggtggtgggatccacgctgg

SEQ ID NO: 5498186 - DNA, 15 bp, Homo sapiens
ggtggtggggaccag

SEQ ID NO: 5498187 - DNA, 13 bp, Homo sapiens
ggtggtggggagg

SEQ ID NO: 5498188 - DNA, 19 bp, Homo sapiens
ggtggtgtcgggcccttct

SEQ ID NO: 5498189 - DNA, 13 bp, Homo sapiens
ggtggtgtctcac

SEQ ID NO: 5498190 - DNA, 13 bp, Homo sapiens
ggtggtgttttta

SEQ ID NO: 5498191 - DNA, 17 bp, Homo sapiens
ggtggttattggactcc

SEQ ID NO: 5498192 - DNA, 18 bp, Homo sapiens
ggtggttcattccacagg

SEQ ID NO: 5498193 - DNA, 14 bp, Homo sapiens
ggtggttctctggg

SEQ ID NO: 5498194 - DNA, 15 bp, Homo sapiens
ggtggttgagatgga

SEQ ID NO: 5498195 - DNA, 21 bp, Homo sapiens
ggtggttgctgttttcctccc

SEQ ID NO: 5498196 - DNA, 13 bp, Homo sapiens
ggtggttggaggc

SEQ ID NO: 5498197 - DNA, 15 bp, Homo sapiens
ggtggttggaggcct

SEQ ID NO: 5498198 - DNA, 17 bp, Homo sapiens
ggtggttggaggcctgg

SEQ ID NO: 5498199 - DNA, 13 bp, Homo sapiens
ggtggttgtgcct

SEQ ID NO: 5498200 - DNA, 17 bp, Homo sapiens
ggtggtttacctgcacc

SEQ ID NO: 5498201 - DNA, 19 bp, Homo sapiens
ggtggtttgatcatttctg

SEQ ID NO: 5498202 - DNA, 14 bp, Homo sapiens
ggtggtttgattgt

SEQ ID NO: 5498203 - DNA, 16 bp, Homo sapiens
ggtggttttattttcc

SEQ ID NO: 5498204 - DNA, 18 bp, Homo sapiens
ggtggttttcagagcagg

SEQ ID NO: 5498205 - DNA, 18 bp, Homo sapiens
ggtggttttctgttcttt

SEQ ID NO: 5498206 - DNA, 12 bp, Homo sapiens
ggtggtttttca

SEQ ID NO: 5498207 - DNA, 13 bp, Homo sapiens
ggtgtaaacacat

SEQ ID NO: 5498208 - DNA, 22 bp, Homo sapiens
ggtgtaaatatgtttcaccctg

SEQ ID NO: 5498209 - DNA, 19 bp, Homo sapiens
ggtgtaacttaaatatttg

SEQ ID NO: 5498210 - DNA, 16 bp, Homo sapiens
ggtgtaacttcctgct

SEQ ID NO: 5498211 - DNA, 15 bp, Homo sapiens
ggtgtaataagacat

SEQ ID NO: 5498212 - DNA, 17 bp, Homo sapiens
ggtgtaatgaaaatgat

SEQ ID NO: 5498213 - DNA, 17 bp, Homo sapiens
ggtgtaatgcacaattt

SEQ ID NO: 5498214 - DNA, 19 bp, Homo sapiens
ggtgtacactaacatttcc

SEQ ID NO: 5498215 - DNA, 14 bp, Homo sapiens
ggtgtacagtttaa

SEQ ID NO: 5498216 - DNA, 20 bp, Homo sapiens
ggtgtactctaggacttcaa

SEQ ID NO: 5498217 - DNA, 18 bp, Homo sapiens
ggtgtactgtactgaaga

SEQ ID NO: 5498218 - DNA, 18 bp, Homo sapiens
ggtgtagctacagagaaa

SEQ ID NO: 5498219 - DNA, 14 bp, Homo sapiens
ggtgtagctgtcct

SEQ ID NO: 5498220 - DNA, 13 bp, Homo sapiens
ggtgtaggctggg

SEQ ID NO: 5498221 - DNA, 12 bp, Homo sapiens
ggtgtaggggcc

SEQ ID NO: 5498222 - DNA, 21 bp, Homo sapiens
ggtgtaggggccacctcctcc

SEQ ID NO: 5498223 - DNA, 21 bp, Homo sapiens
ggtgtatgccacacctggcct

SEQ ID NO: 5498224 - DNA, 23 bp, Homo sapiens
ggtgtatttattttcctccccag

SEQ ID NO: 5498225 - DNA, 15 bp, Homo sapiens
ggtgtcaaattttta

SEQ ID NO: 5498226 - DNA, 17 bp, Homo sapiens
ggtgtcaagagggtctg

SEQ ID NO: 5498227 - DNA, 17 bp, Homo sapiens
ggtgtcacagaggcagt

SEQ ID NO: 5498228 - DNA, 20 bp, Homo sapiens
ggtgtcaccagcctgtttag

SEQ ID NO: 5498229 - DNA, 16 bp, Homo sapiens
ggtgtcaccccagagc

SEQ ID NO: 5498230 - DNA, 20 bp, Homo sapiens
ggtgtcaccctgcagagcta

SEQ ID NO: 5498231 - DNA, 15 bp, Homo sapiens
ggtgtcacttactgt

SEQ ID NO: 5498232 - DNA, 18 bp, Homo sapiens
ggtgtcagaccctggagg

SEQ ID NO: 5498233 - DNA, 20 bp, Homo sapiens
ggtgtcagcccctcttccct

SEQ ID NO: 5498234 - DNA, 10 bp, Homo sapiens
ggtgtcagct

SEQ ID NO: 5498235 - DNA, 13 bp, Homo sapiens
ggtgtcaggcccg

SEQ ID NO: 5498236 - DNA, 22 bp, Homo sapiens
ggtgtcaggcccgtcggagctg

SEQ ID NO: 5498237 - DNA, 18 bp, Homo sapiens
ggtgtcaggtcccagcga

SEQ ID NO: 5498238 - DNA, 20 bp, Homo sapiens
ggtgtcaggtcccagcgagc

SEQ ID NO: 5498239 - DNA, 17 bp, Homo sapiens
ggtgtcagtatccaggc

SEQ ID NO: 5498240 - DNA, 15 bp, Homo sapiens
ggtgtcatcatcaga

SEQ ID NO: 5498241 - DNA, 16 bp, Homo sapiens
ggtgtcatctgctcct

SEQ ID NO: 5498242 - DNA, 13 bp, Homo sapiens
ggtgtcatgcttt

SEQ ID NO: 5498243 - DNA, 21 bp, Homo sapiens
ggtgtccagcattgctggact

SEQ ID NO: 5498244 - DNA, 16 bp, Homo sapiens
ggtgtccatgtgcacc

SEQ ID NO: 5498245 - DNA, 13 bp, Homo sapiens
ggtgtccccaaca

SEQ ID NO: 5498246 - DNA, 15 bp, Homo sapiens
ggtgtccccaacgtc

SEQ ID NO: 5498247 - DNA, 20 bp, Homo sapiens
ggtgtccccaacgtcccctc

SEQ ID NO: 5498248 - DNA, 21 bp, Homo sapiens
ggtgtccccaccatctgctgt

SEQ ID NO: 5498249 - DNA, 17 bp, Homo sapiens
ggtgtccccagcccact

SEQ ID NO: 5498250 - DNA, 15 bp, Homo sapiens
ggtgtccccttcccc

SEQ ID NO: 5498251 - DNA, 19 bp, Homo sapiens
ggtgtccccttcccctgct

SEQ ID NO: 5498252 - DNA, 23 bp, Homo sapiens
ggtgtccccttcccctgctgacc

SEQ ID NO: 5498253 - DNA, 20 bp, Homo sapiens
ggtgtccctgcctggccctc

SEQ ID NO: 5498254 - DNA, 12 bp, Homo sapiens
ggtgtccctgcg

SEQ ID NO: 5498255 - DNA, 16 bp, Homo sapiens
ggtgtccgagaggctg

SEQ ID NO: 5498256 - DNA, 22 bp, Homo sapiens
ggtgtccgccatccagggtctg

SEQ ID NO: 5498257 - DNA, 14 bp, Homo sapiens
ggtgtcctacagaa

SEQ ID NO: 5498258 - DNA, 20 bp, Homo sapiens
ggtgtcctgaccaccctccc

SEQ ID NO: 5498259 - DNA, 12 bp, Homo sapiens
ggtgtcctgagc

SEQ ID NO: 5498260 - DNA, 16 bp, Homo sapiens
ggtgtcctgaggcctc

SEQ ID NO: 5498261 - DNA, 19 bp, Homo sapiens
ggtgtcctgcagaagaagc

SEQ ID NO: 5498262 - DNA, 18 bp, Homo sapiens
ggtgtcctgcctgtctgc

SEQ ID NO: 5498263 - DNA, 14 bp, Homo sapiens
ggtgtccttctcct

SEQ ID NO: 5498264 - DNA, 17 bp, Homo sapiens
ggtgtccttcttcctca

SEQ ID NO: 5498265 - DNA, 16 bp, Homo sapiens
ggtgtcctttcccctc

SEQ ID NO: 5498266 - DNA, 17 bp, Homo sapiens
ggtgtcgcgccttctcc

SEQ ID NO: 5498267 - DNA, 13 bp, Homo sapiens
ggtgtcgggcatg

SEQ ID NO: 5498268 - DNA, 17 bp, Homo sapiens
ggtgtcgtctgtgaatg

SEQ ID NO: 5498269 - DNA, 16 bp, Homo sapiens
ggtgtctagaggcaac

SEQ ID NO: 5498270 - DNA, 16 bp, Homo sapiens
ggtgtctcaggctgcc

SEQ ID NO: 5498271 - DNA, 20 bp, Homo sapiens
ggtgtctcaggctgcctgag

SEQ ID NO: 5498272 - DNA, 14 bp, Homo sapiens
ggtgtctccctcgg

SEQ ID NO: 5498273 - DNA, 15 bp, Homo sapiens
ggtgtctccctcggg

SEQ ID NO: 5498274 - DNA, 12 bp, Homo sapiens
ggtgtctctggg

SEQ ID NO: 5498275 - DNA, 15 bp, Homo sapiens
ggtgtctctgggcct

SEQ ID NO: 5498276 - DNA, 16 bp, Homo sapiens
ggtgtctctgggcctg

SEQ ID NO: 5498277 - DNA, 17 bp, Homo sapiens
ggtgtctctgggcctgt

SEQ ID NO: 5498278 - DNA, 21 bp, Homo sapiens
ggtgtctgatgtgtgcccaga

SEQ ID NO: 5498279 - DNA, 16 bp, Homo sapiens
ggtgtctgcacccagg

SEQ ID NO: 5498280 - DNA, 15 bp, Homo sapiens
ggtgtctgcctagat

SEQ ID NO: 5498281 - DNA, 20 bp, Homo sapiens
ggtgtctggaaaagcacttt

SEQ ID NO: 5498282 - DNA, 14 bp, Homo sapiens
ggtgtctggcctga

SEQ ID NO: 5498283 - DNA, 20 bp, Homo sapiens
ggtgtctggcctgaggtcaa

SEQ ID NO: 5498284 - DNA, 17 bp, Homo sapiens
ggtgtctggtttctgtc

SEQ ID NO: 5498285 - DNA, 15 bp, Homo sapiens
ggtgtcttccctgcc

SEQ ID NO: 5498286 - DNA, 14 bp, Homo sapiens
ggtgtctttctctt

SEQ ID NO: 5498287 - DNA, 20 bp, Homo sapiens
ggtgtgaaagtcagatgccc

SEQ ID NO: 5498288 - DNA, 20 bp, Homo sapiens
ggtgtgaatttgccagagga

SEQ ID NO: 5498289 - DNA, 21 bp, Homo sapiens
ggtgtgaatttgccagaggac

SEQ ID NO: 5498290 - DNA, 17 bp, Homo sapiens
ggtgtgaccatgttcat

SEQ ID NO: 5498291 - DNA, 16 bp, Homo sapiens
ggtgtgactgaatttc

SEQ ID NO: 5498292 - DNA, 19 bp, Homo sapiens
ggtgtgagaagtgccttct

SEQ ID NO: 5498293 - DNA, 21 bp, Homo sapiens
ggtgtgagaagtgccttctcc

SEQ ID NO: 5498294 - DNA, 22 bp, Homo sapiens
ggtgtgagaataacactggctt

SEQ ID NO: 5498295 - DNA, 18 bp, Homo sapiens
ggtgtgagccacagcact

SEQ ID NO: 5498296 - DNA, 20 bp, Homo sapiens
ggtgtgagccactgtgccca

SEQ ID NO: 5498297 - DNA, 19 bp, Homo sapiens
ggtgtgaggaggggcggga

SEQ ID NO: 5498298 - DNA, 20 bp, Homo sapiens
ggtgtgaggcccccggaggc

SEQ ID NO: 5498299 - DNA, 19 bp, Homo sapiens
ggtgtgataaaatgttgaa

SEQ ID NO: 5498300 - DNA, 17 bp, Homo sapiens
ggtgtgatagagccttt

SEQ ID NO: 5498301 - DNA, 13 bp, Homo sapiens
ggtgtgatggtct

SEQ ID NO: 5498302 - DNA, 16 bp, Homo sapiens
ggtgtgcacatctctg

SEQ ID NO: 5498303 - DNA, 16 bp, Homo sapiens
ggtgtgcaccagggtt

SEQ ID NO: 5498304 - DNA, 24 bp, Homo sapiens
ggtgtgcacgtggcatgtggcctg

SEQ ID NO: 5498305 - DNA, 16 bp, Homo sapiens
ggtgtgcatgccacgc

SEQ ID NO: 5498306 - DNA, 17 bp, Homo sapiens
ggtgtgcatgccacgcc

SEQ ID NO: 5498307 - DNA, 13 bp, Homo sapiens
ggtgtgccaggct

SEQ ID NO: 5498308 - DNA, 12 bp, Homo sapiens
ggtgtgccctgg

SEQ ID NO: 5498309 - DNA, 15 bp, Homo sapiens
ggtgtgccctgtgtg

SEQ ID NO: 5498310 - DNA, 14 bp, Homo sapiens
ggtgtgcctgcagc

SEQ ID NO: 5498311 - DNA, 14 bp, Homo sapiens
ggtgtgcctgtgct

SEQ ID NO: 5498312 - DNA, 18 bp, Homo sapiens
ggtgtgccttccagatcc

SEQ ID NO: 5498313 - DNA, 16 bp, Homo sapiens
ggtgtgcggaggcagg

SEQ ID NO: 5498314 - DNA, 12 bp, Homo sapiens
ggtgtgctacag

SEQ ID NO: 5498315 - DNA, 12 bp, Homo sapiens
ggtgtgctccag

SEQ ID NO: 5498316 - DNA, 17 bp, Homo sapiens
ggtgtgctccaggcttc

SEQ ID NO: 5498317 - DNA, 12 bp, Homo sapiens
ggtgtgctctga

SEQ ID NO: 5498318 - DNA, 18 bp, Homo sapiens
ggtgtggaagggaccaag

SEQ ID NO: 5498319 - DNA, 16 bp, Homo sapiens
ggtgtggaccggccgc

SEQ ID NO: 5498320 - DNA, 22 bp, Homo sapiens
ggtgtggaggctcctgtggtag

SEQ ID NO: 5498321 - DNA, 15 bp, Homo sapiens
ggtgtggagtggagg

SEQ ID NO: 5498322 - DNA, 15 bp, Homo sapiens
ggtgtggagttttca

SEQ ID NO: 5498323 - DNA, 17 bp, Homo sapiens
ggtgtggataaggctta

SEQ ID NO: 5498324 - DNA, 22 bp, Homo sapiens
ggtgtggatgtaattagctctg

SEQ ID NO: 5498325 - DNA, 23 bp, Homo sapiens
ggtgtggatgtaattagctctgg

SEQ ID NO: 5498326 - DNA, 15 bp, Homo sapiens
ggtgtggccctgcca

SEQ ID NO: 5498327 - DNA, 19 bp, Homo sapiens
ggtgtggccctgccatctt

SEQ ID NO: 5498328 - DNA, 21 bp, Homo sapiens
ggtgtggctcgggtgcccagg

SEQ ID NO: 5498329 - DNA, 14 bp, Homo sapiens
ggtgtgggctccca

SEQ ID NO: 5498330 - DNA, 15 bp, Homo sapiens
ggtgtgggctcccac

SEQ ID NO: 5498331 - DNA, 15 bp, Homo sapiens
ggtgtgggggccccg

SEQ ID NO: 5498332 - DNA, 15 bp, Homo sapiens
ggtgtggggtggggt

SEQ ID NO: 5498333 - DNA, 22 bp, Homo sapiens
ggtgtgggtgtcctgcctgtct

SEQ ID NO: 5498334 - DNA, 17 bp, Homo sapiens
ggtgtggtacagagaag

SEQ ID NO: 5498335 - DNA, 19 bp, Homo sapiens
ggtgtggtacagagaagcc

SEQ ID NO: 5498336 - DNA, 22 bp, Homo sapiens
ggtgtggtgtttgtaggctgtg

SEQ ID NO: 5498337 - DNA, 15 bp, Homo sapiens
ggttgcccagcctgg

SEQ ID NO: 5498338 - DNA, 16 bp, Homo sapiens
ggttgcccagcctgga

SEQ ID NO: 5498339 - DNA, 19 bp, Homo sapiens
ggttgcctcaacagcagga

SEQ ID NO: 5498340 - DNA, 13 bp, Homo sapiens
ggttgcctctctt

SEQ ID NO: 5498341 - DNA, 16 bp, Homo sapiens
ggttgcctctcttgcc

SEQ ID NO: 5498342 - DNA, 20 bp, Homo sapiens
ggttgccttaaaagaaatct

SEQ ID NO: 5498343 - DNA, 22 bp, Homo sapiens
ggttgcgggggagctggaaata

SEQ ID NO: 5498344 - DNA, 16 bp, Homo sapiens
ggttgcggggggaggg

SEQ ID NO: 5498345 - DNA, 15 bp, Homo sapiens
ggttgcgtctgaggc

SEQ ID NO: 5498346 - DNA, 16 bp, Homo sapiens
ggttgctcacagctgt

SEQ ID NO: 5498347 - DNA, 18 bp, Homo sapiens
ggttgctccgcctggcct

SEQ ID NO: 5498348 - DNA, 17 bp, Homo sapiens
ggttgctggttgctgtg

SEQ ID NO: 5498349 - DNA, 22 bp, Homo sapiens
ggttgctgttgatgaggcctct

SEQ ID NO: 5498350 - DNA, 21 bp, Homo sapiens
ggttgctgttttcctcccttc

SEQ ID NO: 5498351 - DNA, 18 bp, Homo sapiens
ggttgcttgggccactgc

SEQ ID NO: 5498352 - DNA, 19 bp, Homo sapiens
ggttgcttgggccactgcc

SEQ ID NO: 5498353 - DNA, 21 bp, Homo sapiens
ggttgcttgggccactgccct

SEQ ID NO: 5498354 - DNA, 22 bp, Homo sapiens
ggttggaaaagaaatcaatttt

SEQ ID NO: 5498355 - DNA, 20 bp, Homo sapiens
ggttggaactatgcagtgtg

SEQ ID NO: 5498356 - DNA, 18 bp, Homo sapiens
ggttggagaaggaggtaa

SEQ ID NO: 5498357 - DNA, 22 bp, Homo sapiens
ggttggaggcctcaccctgctt

SEQ ID NO: 5498358 - DNA, 20 bp, Homo sapiens
ggttggagtgctcttcccac

SEQ ID NO: 5498359 - DNA, 11 bp, Homo sapiens
ggttggatggg

SEQ ID NO: 5498360 - DNA, 14 bp, Homo sapiens
ggttggcacctgca

SEQ ID NO: 5498361 - DNA, 19 bp, Homo sapiens
ggttggcagagacactttg

SEQ ID NO: 5498362 - DNA, 17 bp, Homo sapiens
ggttggcagcccactgc

SEQ ID NO: 5498363 - DNA, 23 bp, Homo sapiens
ggttggcagcgcctcgccccagc

SEQ ID NO: 5498364 - DNA, 20 bp, Homo sapiens
ggttggcatttgctggcctg

SEQ ID NO: 5498365 - DNA, 10 bp, Homo sapiens
ggttggccag

SEQ ID NO: 5498366 - DNA, 15 bp, Homo sapiens
ggttggcgcaccctc

SEQ ID NO: 5498367 - DNA, 20 bp, Homo sapiens
ggttgggaacatgctggaaa

SEQ ID NO: 5498368 - DNA, 16 bp, Homo sapiens
ggttgggaaggcacct

SEQ ID NO: 5498369 - DNA, 17 bp, Homo sapiens
ggttgggacaatggcaa

SEQ ID NO: 5498370 - DNA, 19 bp, Homo sapiens
ggttgggacccagtggcag

SEQ ID NO: 5498371 - DNA, 23 bp, Homo sapiens
ggttgggacccagtggcagggca

SEQ ID NO: 5498372 - DNA, 23 bp, Homo sapiens
ggttgggaggcaggtcgggctgc

SEQ ID NO: 5498373 - DNA, 23 bp, Homo sapiens
ggttgggattgggggctggtgcc

SEQ ID NO: 5498374 - DNA, 16 bp, Homo sapiens
ggttggggcaaagcct

SEQ ID NO: 5498375 - DNA, 17 bp, Homo sapiens
ggttgggggcaccatct

SEQ ID NO: 5498376 - DNA, 16 bp, Homo sapiens
ggttgggggctcctgt

SEQ ID NO: 5498377 - DNA, 18 bp, Homo sapiens
ggttggggggtgccggca

SEQ ID NO: 5498378 - DNA, 17 bp, Homo sapiens
ggttggggtgggagggc

SEQ ID NO: 5498379 - DNA, 14 bp, Homo sapiens
ggttgggttccaga

SEQ ID NO: 5498380 - DNA, 15 bp, Homo sapiens
ggttgggttccagac

SEQ ID NO: 5498381 - DNA, 23 bp, Homo sapiens
ggttgggttccagacagagtgga

SEQ ID NO: 5498382 - DNA, 13 bp, Homo sapiens
ggttggtagggtg

SEQ ID NO: 5498383 - DNA, 16 bp, Homo sapiens
ggttggtagggtggga

SEQ ID NO: 5498384 - DNA, 15 bp, Homo sapiens
ggttggtatctcagg

SEQ ID NO: 5498385 - DNA, 20 bp, Homo sapiens
ggttggtcaaggccacctct

SEQ ID NO: 5498386 - DNA, 16 bp, Homo sapiens
ggttggtgcacagtga

SEQ ID NO: 5498387 - DNA, 17 bp, Homo sapiens
ggttggtgcacagtgat

SEQ ID NO: 5498388 - DNA, 14 bp, Homo sapiens
ggttggtgggctgg

SEQ ID NO: 5498389 - DNA, 15 bp, Homo sapiens
ggttggtgggctggc

SEQ ID NO: 5498390 - DNA, 12 bp, Homo sapiens
ggttggtgtgaa

SEQ ID NO: 5498391 - DNA, 15 bp, Homo sapiens
ggttggttagtgcat

SEQ ID NO: 5498392 - DNA, 20 bp, Homo sapiens
ggttgtaaatactttgtcct

SEQ ID NO: 5498393 - DNA, 19 bp, Homo sapiens
ggttgtacatagtggtcat

SEQ ID NO: 5498394 - DNA, 22 bp, Homo sapiens
ggttgtacatagtggtcatttg

SEQ ID NO: 5498395 - DNA, 19 bp, Homo sapiens
ggttgtaggactaaataat

SEQ ID NO: 5498396 - DNA, 18 bp, Homo sapiens
ggttgtcaaaactccact

SEQ ID NO: 5498397 - DNA, 11 bp, Homo sapiens
ggttgtcagaa

SEQ ID NO: 5498398 - DNA, 22 bp, Homo sapiens
ggttgtctcagccgagcccagg

SEQ ID NO: 5498399 - DNA, 23 bp, Homo sapiens
ggttgtctctcttcggtggcctt

SEQ ID NO: 5498400 - DNA, 15 bp, Homo sapiens
ggttgtctgaaccca

SEQ ID NO: 5498401 - DNA, 14 bp, Homo sapiens
ggttgtcttattgc

SEQ ID NO: 5498402 - DNA, 15 bp, Homo sapiens
ggttgtgaaaacagc

SEQ ID NO: 5498403 - DNA, 13 bp, Homo sapiens
ggttgtgaatgtt

SEQ ID NO: 5498404 - DNA, 22 bp, Homo sapiens
ggttgtgactctaagctcagtg

SEQ ID NO: 5498405 - DNA, 12 bp, Homo sapiens
ggttgtgatatt

SEQ ID NO: 5498406 - DNA, 11 bp, Homo sapiens
ggttgtgcatg

SEQ ID NO: 5498407 - DNA, 14 bp, Homo sapiens
ggttgtggggaggc

SEQ ID NO: 5498408 - DNA, 20 bp, Homo sapiens
ggttgtggggcctcaggctc

SEQ ID NO: 5498409 - DNA, 13 bp, Homo sapiens
ggttgtgtcactg

SEQ ID NO: 5498410 - DNA, 23 bp, Homo sapiens
ggttgtgtcccaaaatcccctca

SEQ ID NO: 5498411 - DNA, 15 bp, Homo sapiens
ggttgtgtgtgttct

SEQ ID NO: 5498412 - DNA, 22 bp, Homo sapiens
ggttgtgtttctcgtgctgcat

SEQ ID NO: 5498413 - DNA, 13 bp, Homo sapiens
ggttgttacagag

SEQ ID NO: 5498414 - DNA, 18 bp, Homo sapiens
ggttgttagaaaaatgga

SEQ ID NO: 5498415 - DNA, 21 bp, Homo sapiens
ggttgttgatattgtttgctg

SEQ ID NO: 5498416 - DNA, 22 bp, Homo sapiens
ggttgttgatattgtttgctgt

SEQ ID NO: 5498417 - DNA, 21 bp, Homo sapiens
ggttgttgcaccatctgcttg

SEQ ID NO: 5498418 - DNA, 15 bp, Homo sapiens
ggttgttgcatatag

SEQ ID NO: 5498419 - DNA, 13 bp, Homo sapiens
ggttgttgtctca

SEQ ID NO: 5498420 - DNA, 15 bp, Homo sapiens
ggttgttgttttttt

SEQ ID NO: 5498421 - DNA, 16 bp, Homo sapiens
ggttgtttagaaacag

SEQ ID NO: 5498422 - DNA, 13 bp, Homo sapiens
ggttgtttctctg

SEQ ID NO: 5498423 - DNA, 22 bp, Homo sapiens
ggttgtttctctgagctttgtt

SEQ ID NO: 5498424 - DNA, 12 bp, Homo sapiens
ggttgtttctgt

SEQ ID NO: 5498425 - DNA, 19 bp, Homo sapiens
ggttgttttatagaggttc

SEQ ID NO: 5498426 - DNA, 23 bp, Homo sapiens
ggttgtttttgttctttgtgttt

SEQ ID NO: 5498427 - DNA, 20 bp, Homo sapiens
ggttgttttttcctttgctc

SEQ ID NO: 5498428 - DNA, 17 bp, Homo sapiens
ggtttaaaacagcctgg

SEQ ID NO: 5498429 - DNA, 21 bp, Homo sapiens
ggtttaaaactagttagattc

SEQ ID NO: 5498430 - DNA, 20 bp, Homo sapiens
ggtttaaagagtctagattc

SEQ ID NO: 5498431 - DNA, 22 bp, Homo sapiens
ggtttaaagagtctagattcaa

SEQ ID NO: 5498432 - DNA, 17 bp, Homo sapiens
ggtttaactcagatcac

SEQ ID NO: 5498433 - DNA, 18 bp, Homo sapiens
ggtttaactcagatcact

SEQ ID NO: 5498434 - DNA, 20 bp, Homo sapiens
ggtttaactcagatcactac

SEQ ID NO: 5498435 - DNA, 17 bp, Homo sapiens
ggtttaagaaatagaat

SEQ ID NO: 5498436 - DNA, 17 bp, Homo sapiens
ggtttacaacaaacact

SEQ ID NO: 5498437 - DNA, 17 bp, Homo sapiens
ggtttacaatttacaaa

SEQ ID NO: 5498438 - DNA, 16 bp, Homo sapiens
ggtttacactgcggaa

SEQ ID NO: 5498439 - DNA, 21 bp, Homo sapiens
ggtttacactgcggaagccaa

SEQ ID NO: 5498440 - DNA, 16 bp, Homo sapiens
ggtttacatgaacaca

SEQ ID NO: 5498441 - DNA, 22 bp, Homo sapiens
ggtttacatgtgatgttttagt

SEQ ID NO: 5498442 - DNA, 22 bp, Homo sapiens
ggtttacattcatctcattcca

SEQ ID NO: 5498443 - DNA, 15 bp, Homo sapiens
ggtttacatttaaag

SEQ ID NO: 5498444 - DNA, 13 bp, Homo sapiens
ggtttactgctgt

SEQ ID NO: 5498445 - DNA, 17 bp, Homo sapiens
ggtttactgtgaagaga

SEQ ID NO: 5498446 - DNA, 17 bp, Homo sapiens
ggtttactttcaaaaga

SEQ ID NO: 5498447 - DNA, 15 bp, Homo sapiens
ggtttagcaggctgc

SEQ ID NO: 5498448 - DNA, 23 bp, Homo sapiens
ggtttagcgttgttttgtggata

SEQ ID NO: 5498449 - DNA, 15 bp, Homo sapiens
ggtttagctgtgcag

SEQ ID NO: 5498450 - DNA, 18 bp, Homo sapiens
ggtttagctttggaaagt

SEQ ID NO: 5498451 - DNA, 17 bp, Homo sapiens
ggtttaggctggtggcc

SEQ ID NO: 5498452 - DNA, 20 bp, Homo sapiens
ggtttaggctggtggcccag

SEQ ID NO: 5498453 - DNA, 20 bp, Homo sapiens
ggtttagtcatccaacaaga

SEQ ID NO: 5498454 - DNA, 18 bp, Homo sapiens
ggtttagtgtaaaaatga

SEQ ID NO: 5498455 - DNA, 18 bp, Homo sapiens
ggtttagtgttctgtatt

SEQ ID NO: 5498456 - DNA, 14 bp, Homo sapiens
ggtttatattttca

SEQ ID NO: 5498457 - DNA, 12 bp, Homo sapiens
ggtttattccct

SEQ ID NO: 5498458 - DNA, 13 bp, Homo sapiens
ggtttattctttg

SEQ ID NO: 5498459 - DNA, 17 bp, Homo sapiens
ggtttatttttctgtta

SEQ ID NO: 5498460 - DNA, 21 bp, Homo sapiens
ggtttcaaactcctgacctca

SEQ ID NO: 5498461 - DNA, 22 bp, Homo sapiens
ggtttcaaactcctgacctcag

SEQ ID NO: 5498462 - DNA, 23 bp, Homo sapiens
ggtttcaaagaaaaaggtccatg

SEQ ID NO: 5498463 - DNA, 15 bp, Homo sapiens
ggtttcaacaaattt

SEQ ID NO: 5498464 - DNA, 16 bp, Homo sapiens
ggtttcaacaaatttc

SEQ ID NO: 5498465 - DNA, 17 bp, Homo sapiens
ggtttcaagaaaatctt

SEQ ID NO: 5498466 - DNA, 18 bp, Homo sapiens
ggtttcaagaatatggag

SEQ ID NO: 5498467 - DNA, 22 bp, Homo sapiens
ggtttcaatgcatacaataaaa

SEQ ID NO: 5498468 - DNA, 21 bp, Homo sapiens
ggtttcaattcagattgtctt

SEQ ID NO: 5498469 - DNA, 19 bp, Homo sapiens
ggtttcaccatgttggcca

SEQ ID NO: 5498470 - DNA, 20 bp, Homo sapiens
ggtttcaccatgttggccag

SEQ ID NO: 5498471 - DNA, 16 bp, Homo sapiens
ggtttcaccttccctc

SEQ ID NO: 5498472 - DNA, 17 bp, Homo sapiens
ggtttcactattcctat

SEQ ID NO: 5498473 - DNA, 15 bp, Homo sapiens
ggtttcagaaagggc

SEQ ID NO: 5498474 - DNA, 13 bp, Homo sapiens
ggtttcagaaatg

SEQ ID NO: 5498475 - DNA, 14 bp, Homo sapiens
ggtttcagaaatgt

SEQ ID NO: 5498476 - DNA, 13 bp, Homo sapiens
ggtttcagcacta

SEQ ID NO: 5498477 - DNA, 19 bp, Homo sapiens
ggtttcagcactagccaaa

SEQ ID NO: 5498478 - DNA, 23 bp, Homo sapiens
ggtttcagccaaggggctgcgct

SEQ ID NO: 5498479 - DNA, 13 bp, Homo sapiens
ggtttcaggaagt

SEQ ID NO: 5498480 - DNA, 20 bp, Homo sapiens
ggtttcaggttcctacagga

SEQ ID NO: 5498481 - DNA, 23 bp, Homo sapiens
ggtttcatcatgttgaccaggct

SEQ ID NO: 5498482 - DNA, 13 bp, Homo sapiens
ggtttcatgttca

SEQ ID NO: 5498483 - DNA, 12 bp, Homo sapiens
ggtttccaaagg

SEQ ID NO: 5498484 - DNA, 18 bp, Homo sapiens
ggtttccaacaattcagc

SEQ ID NO: 5498485 - DNA, 20 bp, Homo sapiens
ggtttccaacaattcagcat

SEQ ID NO: 5498486 - DNA, 18 bp, Homo sapiens
ggtttccacacaggccca

SEQ ID NO: 5498487 - DNA, 19 bp, Homo sapiens
ggtttccacacaggcccat

SEQ ID NO: 5498488 - DNA, 20 bp, Homo sapiens
ggtttccacacaggcccatg

SEQ ID NO: 5498489 - DNA, 23 bp, Homo sapiens
ggtttccactgtcttgcctgcca

SEQ ID NO: 5498490 - DNA, 11 bp, Homo sapiens
ggtttccaggc

SEQ ID NO: 5498491 - DNA, 20 bp, Homo sapiens
ggtttcccaatggtgttttt

SEQ ID NO: 5498492 - DNA, 21 bp, Homo sapiens
ggtttcccagtgagcctctgc

SEQ ID NO: 5498493 - DNA, 19 bp, Homo sapiens
ggtttccccagggaaggaa

SEQ ID NO: 5498494 - DNA, 23 bp, Homo sapiens
ggtttccccagggaaggaaaaat

SEQ ID NO: 5498495 - DNA, 14 bp, Homo sapiens
ggtttcccctttct

SEQ ID NO: 5498496 - DNA, 16 bp, Homo sapiens
ggtttccctgcccctg

SEQ ID NO: 5498497 - DNA, 16 bp, Homo sapiens
ggtttcccttgccctt

SEQ ID NO: 5498498 - DNA, 14 bp, Homo sapiens
ggtttcctctggat

SEQ ID NO: 5498499 - DNA, 11 bp, Homo sapiens
ggtttcctgca

SEQ ID NO: 5498500 - DNA, 20 bp, Homo sapiens
ggtttcctgcccagcctggg

SEQ ID NO: 5498501 - DNA, 15 bp, Homo sapiens
ggtttcctgccctgg

SEQ ID NO: 5498502 - DNA, 19 bp, Homo sapiens
ggtttcctgccctgggagg

SEQ ID NO: 5498503 - DNA, 19 bp, Homo sapiens
ggtttccttaaaattttta

SEQ ID NO: 5498504 - DNA, 17 bp, Homo sapiens
ggtttcgactggtccag

SEQ ID NO: 5498505 - DNA, 18 bp, Homo sapiens
ggtttcgactggtccagc

SEQ ID NO: 5498506 - DNA, 19 bp, Homo sapiens
ggtttcgactggtccagct

SEQ ID NO: 5498507 - DNA, 19 bp, Homo sapiens
ggtttctacttcccctggg

SEQ ID NO: 5498508 - DNA, 21 bp, Homo sapiens
ggtttctcagaatccaaagat

SEQ ID NO: 5498509 - DNA, 20 bp, Homo sapiens
ggtttctccccggacactcg

SEQ ID NO: 5498510 - DNA, 13 bp, Homo sapiens
ggtttctctccct

SEQ ID NO: 5498511 - DNA, 15 bp, Homo sapiens
ggtttctctctacag

SEQ ID NO: 5498512 - DNA, 20 bp, Homo sapiens
ggtttctctcttcccttctc

SEQ ID NO: 5498513 - DNA, 13 bp, Homo sapiens
ggtttctcttctc

SEQ ID NO: 5498514 - DNA, 16 bp, Homo sapiens
gtaaaaatgctgctct

SEQ ID NO: 5498515 - DNA, 17 bp, Homo sapiens
gtaaaaatggaaactat

SEQ ID NO: 5498516 - DNA, 18 bp, Homo sapiens
gtaaaaatggaccacagt

SEQ ID NO: 5498517 - DNA, 15 bp, Homo sapiens
gtaaaacaaaacaaa

SEQ ID NO: 5498518 - DNA, 17 bp, Homo sapiens
gtaaaacaaatgaaatt

SEQ ID NO: 5498519 - DNA, 14 bp, Homo sapiens
gtaaaacaatgcca

SEQ ID NO: 5498520 - DNA, 22 bp, Homo sapiens
gtaaaacaatgccatgaacaaa

SEQ ID NO: 5498521 - DNA, 11 bp, Homo sapiens
gtaaaacacag

SEQ ID NO: 5498522 - DNA, 23 bp, Homo sapiens
gtaaaaccacagcagttgaaaag

SEQ ID NO: 5498523 - DNA, 17 bp, Homo sapiens
gtaaaaccatgtagttt

SEQ ID NO: 5498524 - DNA, 17 bp, Homo sapiens
gtaaaacctgttctcca

SEQ ID NO: 5498525 - DNA, 20 bp, Homo sapiens
gtaaaacgcaccaatcagca

SEQ ID NO: 5498526 - DNA, 19 bp, Homo sapiens
gtaaaacgctgtcaaaagt

SEQ ID NO: 5498527 - DNA, 21 bp, Homo sapiens
gtaaaacgctgtcaaaagttg

SEQ ID NO: 5498528 - DNA, 13 bp, Homo sapiens
gtaaaactgtgac

SEQ ID NO: 5498529 - DNA, 19 bp, Homo sapiens
gtaaaactgtgacattcca

SEQ ID NO: 5498530 - DNA, 15 bp, Homo sapiens
gtaaaactttatttt

SEQ ID NO: 5498531 - DNA, 18 bp, Homo sapiens
gtaaaactttattttata

SEQ ID NO: 5498532 - DNA, 12 bp, Homo sapiens
gtaaaagaaaaa

SEQ ID NO: 5498533 - DNA, 23 bp, Homo sapiens
gtaaaagatgcagagtaagtatt

SEQ ID NO: 5498534 - DNA, 17 bp, Homo sapiens
gtaaaagcaacatcagc

SEQ ID NO: 5498535 - DNA, 19 bp, Homo sapiens
gtaaaagcagcataaagaa

SEQ ID NO: 5498536 - DNA, 13 bp, Homo sapiens
gtaaaagctaatt

SEQ ID NO: 5498537 - DNA, 13 bp, Homo sapiens
gtaaaaggactct

SEQ ID NO: 5498538 - DNA, 17 bp, Homo sapiens
gtaaaaggcactgcaca

SEQ ID NO: 5498539 - DNA, 12 bp, Homo sapiens
gtaaaagtagtg

SEQ ID NO: 5498540 - DNA, 20 bp, Homo sapiens
gtaaaagtggtctctgctgg

SEQ ID NO: 5498541 - DNA, 20 bp, Homo sapiens
gtaaaagttactaatatatc

SEQ ID NO: 5498542 - DNA, 20 bp, Homo sapiens
gtaaaagttataataactga

SEQ ID NO: 5498543 - DNA, 22 bp, Homo sapiens
gtaaaagttataataactgaac

SEQ ID NO: 5498544 - DNA, 15 bp, Homo sapiens
gtaaaagttatatct

SEQ ID NO: 5498545 - DNA, 16 bp, Homo sapiens
gtaaaataaaaggtcg

SEQ ID NO: 5498546 - DNA, 19 bp, Homo sapiens
gtaaaataaaggctctgtg

SEQ ID NO: 5498547 - DNA, 12 bp, Homo sapiens
gtaaaatacttt

SEQ ID NO: 5498548 - DNA, 17 bp, Homo sapiens
gtaaaatagttttgctt

SEQ ID NO: 5498549 - DNA, 21 bp, Homo sapiens
gtaaaatagttttgctttgtt

SEQ ID NO: 5498550 - DNA, 20 bp, Homo sapiens
gtaaaatatagctgtacaaa

SEQ ID NO: 5498551 - DNA, 15 bp, Homo sapiens
gtaaaatatgtaaaa

SEQ ID NO: 5498552 - DNA, 17 bp, Homo sapiens
gtaaaatattaacatat

SEQ ID NO: 5498553 - DNA, 21 bp, Homo sapiens
gtaaaatattttgaatcaata

SEQ ID NO: 5498554 - DNA, 11 bp, Homo sapiens
gtaaaatcact

SEQ ID NO: 5498555 - DNA, 13 bp, Homo sapiens
gtaaaatcacttc

SEQ ID NO: 5498556 - DNA, 17 bp, Homo sapiens
gtaaaatcacttcagat

SEQ ID NO: 5498557 - DNA, 19 bp, Homo sapiens
gtaaaatcacttcagatct

SEQ ID NO: 5498558 - DNA, 18 bp, Homo sapiens
gtaaaatcttcagctggt

SEQ ID NO: 5498559 - DNA, 15 bp, Homo sapiens
gtaaaatcttgtcat

SEQ ID NO: 5498560 - DNA, 16 bp, Homo sapiens
gtaaaatcttgtcatg

SEQ ID NO: 5498561 - DNA, 18 bp, Homo sapiens
gtaaaatcttgtcatgtg

SEQ ID NO: 5498562 - DNA, 22 bp, Homo sapiens
gtaaaatcttgtcatgtgtata

SEQ ID NO: 5498563 - DNA, 23 bp, Homo sapiens
gtaaaatcttgtcatgtgtataa

SEQ ID NO: 5498564 - DNA, 13 bp, Homo sapiens
gtaaaatgaacat

SEQ ID NO: 5498565 - DNA, 16 bp, Homo sapiens
gtaaaatgaacatttt

SEQ ID NO: 5498566 - DNA, 14 bp, Homo sapiens
gtaaaatgaagaat

SEQ ID NO: 5498567 - DNA, 23 bp, Homo sapiens
gtaaaatgagtaggatgtctctt

SEQ ID NO: 5498568 - DNA, 13 bp, Homo sapiens
gtaaaatgagttt

SEQ ID NO: 5498569 - DNA, 20 bp, Homo sapiens
gtaaaatgcaccaatcagca

SEQ ID NO: 5498570 - DNA, 17 bp, Homo sapiens
gtaaaatggagacacca

SEQ ID NO: 5498571 - DNA, 15 bp, Homo sapiens
gtaaaatgtctttcc

SEQ ID NO: 5498572 - DNA, 18 bp, Homo sapiens
gtaaaatgtgggattatg

SEQ ID NO: 5498573 - DNA, 23 bp, Homo sapiens
gtaaaatgtgggattatgggtca

SEQ ID NO: 5498574 - DNA, 15 bp, Homo sapiens
gtaaaattaatgtaa

SEQ ID NO: 5498575 - DNA, 14 bp, Homo sapiens
gtaaaattacagaa

SEQ ID NO: 5498576 - DNA, 21 bp, Homo sapiens
gtaaaattagaaaaaaacaaa

SEQ ID NO: 5498577 - DNA, 15 bp, Homo sapiens
gtaaaattataaact

SEQ ID NO: 5498578 - DNA, 23 bp, Homo sapiens
gtaaaattataaacttttatact

SEQ ID NO: 5498579 - DNA, 15 bp, Homo sapiens
gtaaaattatctgtt

SEQ ID NO: 5498580 - DNA, 16 bp, Homo sapiens
gtaaaattcatagcat

SEQ ID NO: 5498581 - DNA, 17 bp, Homo sapiens
gtaaaattgagtgcact

SEQ ID NO: 5498582 - DNA, 18 bp, Homo sapiens
gtaaaattgagtttcaga

SEQ ID NO: 5498583 - DNA, 14 bp, Homo sapiens
gtaaaattgccata

SEQ ID NO: 5498584 - DNA, 16 bp, Homo sapiens
gtaaaattgccatatt

SEQ ID NO: 5498585 - DNA, 19 bp, Homo sapiens
gtaaaattggattattact

SEQ ID NO: 5498586 - DNA, 14 bp, Homo sapiens
gtaaaatttcagga

SEQ ID NO: 5498587 - DNA, 19 bp, Homo sapiens
gtaaaatttcccattaaag

SEQ ID NO: 5498588 - DNA, 14 bp, Homo sapiens
gtaaaatttgcaca

SEQ ID NO: 5498589 - DNA, 15 bp, Homo sapiens
gtaaaatttgtgtaa

SEQ ID NO: 5498590 - DNA, 18 bp, Homo sapiens
gtaaaatttgtgtaaatt

SEQ ID NO: 5498591 - DNA, 15 bp, Homo sapiens
gtaaacaaaatgaag

SEQ ID NO: 5498592 - DNA, 23 bp, Homo sapiens
gtaaacaacgtgtatagtgccta

SEQ ID NO: 5498593 - DNA, 20 bp, Homo sapiens
gtaaacaacttgtacttgtt

SEQ ID NO: 5498594 - DNA, 13 bp, Homo sapiens
gtaaacacatcta

SEQ ID NO: 5498595 - DNA, 14 bp, Homo sapiens
gtaaacagaaggag

SEQ ID NO: 5498596 - DNA, 16 bp, Homo sapiens
gtaaacagaaggagat

SEQ ID NO: 5498597 - DNA, 19 bp, Homo sapiens
gtaaacagatggcactttg

SEQ ID NO: 5498598 - DNA, 12 bp, Homo sapiens
gtaaacagattt

SEQ ID NO: 5498599 - DNA, 14 bp, Homo sapiens
gtaaacagggtacc

SEQ ID NO: 5498600 - DNA, 14 bp, Homo sapiens
gtaaacagtgcctg

SEQ ID NO: 5498601 - DNA, 19 bp, Homo sapiens
gtaaacataccaacatgtt

SEQ ID NO: 5498602 - DNA, 23 bp, Homo sapiens
gtaaacatcataaatagtaaata

SEQ ID NO: 5498603 - DNA, 15 bp, Homo sapiens
gtaaacatctcagag

SEQ ID NO: 5498604 - DNA, 20 bp, Homo sapiens
gtaaacatgtgttttaattc

SEQ ID NO: 5498605 - DNA, 13 bp, Homo sapiens
gtaaacatttgta

SEQ ID NO: 5498606 - DNA, 13 bp, Homo sapiens
gtaaaccaaagcc

SEQ ID NO: 5498607 - DNA, 23 bp, Homo sapiens
gtaaaccaatcctatgcatggtt

SEQ ID NO: 5498608 - DNA, 23 bp, Homo sapiens
gtaaaccacataatttttgtaca

SEQ ID NO: 5498609 - DNA, 19 bp, Homo sapiens
gtaaaccactgaaaaaata

SEQ ID NO: 5498610 - DNA, 20 bp, Homo sapiens
gtaaaccactgaaaaaatat

SEQ ID NO: 5498611 - DNA, 22 bp, Homo sapiens
gtaaaccactgaaaaaatatat

SEQ ID NO: 5498612 - DNA, 23 bp, Homo sapiens
gtaaacctgaaatatattttaaa

SEQ ID NO: 5498613 - DNA, 14 bp, Homo sapiens
gtaaacgacactct

SEQ ID NO: 5498614 - DNA, 16 bp, Homo sapiens
gtaaacgctgtcccta

SEQ ID NO: 5498615 - DNA, 14 bp, Homo sapiens
gtaaacggcccagg

SEQ ID NO: 5498616 - DNA, 23 bp, Homo sapiens
gtaaactaaagtgtgctttataa

SEQ ID NO: 5498617 - DNA, 15 bp, Homo sapiens
gtaaactacaaagta

SEQ ID NO: 5498618 - DNA, 15 bp, Homo sapiens
gtaaactatttatct

SEQ ID NO: 5498619 - DNA, 16 bp, Homo sapiens
gtaaactatttatctg

SEQ ID NO: 5498620 - DNA, 21 bp, Homo sapiens
gtaaactatttatctgtgttt

SEQ ID NO: 5498621 - DNA, 12 bp, Homo sapiens
gtaaactcctgt

SEQ ID NO: 5498622 - DNA, 22 bp, Homo sapiens
gtaaactcgggggtgctggggc

SEQ ID NO: 5498623 - DNA, 14 bp, Homo sapiens
gtaaactgaggccc

SEQ ID NO: 5498624 - DNA, 22 bp, Homo sapiens
gtaaactgatgtactgaattcc

SEQ ID NO: 5498625 - DNA, 11 bp, Homo sapiens
gtaaactgcca

SEQ ID NO: 5498626 - DNA, 14 bp, Homo sapiens
gtaaactgccctgt

SEQ ID NO: 5498627 - DNA, 18 bp, Homo sapiens
gtaaactggaattaaaag

SEQ ID NO: 5498628 - DNA, 20 bp, Homo sapiens
gtaaactgtatcaaatctgt

SEQ ID NO: 5498629 - DNA, 21 bp, Homo sapiens
gtaaactgtatcaaatctgta

SEQ ID NO: 5498630 - DNA, 12 bp, Homo sapiens
gtaaacttctga

SEQ ID NO: 5498631 - DNA, 16 bp, Homo sapiens
gtaaacttctgcaaca

SEQ ID NO: 5498632 - DNA, 17 bp, Homo sapiens
gtaaactttgcttctcc

SEQ ID NO: 5498633 - DNA, 16 bp, Homo sapiens
gtaaactttttgtgct

SEQ ID NO: 5498634 - DNA, 19 bp, Homo sapiens
gtaaagaaagagagaaaat

SEQ ID NO: 5498635 - DNA, 22 bp, Homo sapiens
gtaaagaaagagagaaaataaa

SEQ ID NO: 5498636 - DNA, 23 bp, Homo sapiens
gtaaagaaagagagaaaataaaa

SEQ ID NO: 5498637 - DNA, 22 bp, Homo sapiens
gtaaagaaatttaaaagacact

SEQ ID NO: 5498638 - DNA, 19 bp, Homo sapiens
gtaaagaacttaaattatg

SEQ ID NO: 5498639 - DNA, 16 bp, Homo sapiens
gtaaagaataaatgaa

SEQ ID NO: 5498640 - DNA, 19 bp, Homo sapiens
gtaaagaattttcatcccg

SEQ ID NO: 5498641 - DNA, 22 bp, Homo sapiens
gtaaagagacctacctcaggtt

SEQ ID NO: 5498642 - DNA, 23 bp, Homo sapiens
gtaaagaggaactagactttcct

SEQ ID NO: 5498643 - DNA, 20 bp, Homo sapiens
gtaaagagtacactcagcca

SEQ ID NO: 5498644 - DNA, 16 bp, Homo sapiens
gtaaagatcaataaaa

SEQ ID NO: 5498645 - DNA, 19 bp, Homo sapiens
gtaaagatgtcaataggaa

SEQ ID NO: 5498646 - DNA, 14 bp, Homo sapiens
gtaaagcaaaatat

SEQ ID NO: 5498647 - DNA, 19 bp, Homo sapiens
gtaaagcaaccaaaaagaa

SEQ ID NO: 5498648 - DNA, 17 bp, Homo sapiens
gtaaagcacatggttca

SEQ ID NO: 5498649 - DNA, 16 bp, Homo sapiens
gtaaagcattccaaca

SEQ ID NO: 5498650 - DNA, 16 bp, Homo sapiens
gtaaagccatgttaaa

SEQ ID NO: 5498651 - DNA, 15 bp, Homo sapiens
gtaaagccattaaat

SEQ ID NO: 5498652 - DNA, 21 bp, Homo sapiens
gtaaagcccatttttaaaata

SEQ ID NO: 5498653 - DNA, 23 bp, Homo sapiens
gtaaagccctcagatcccagggt

SEQ ID NO: 5498654 - DNA, 20 bp, Homo sapiens
gtaaagctaaaatgatttta

SEQ ID NO: 5498655 - DNA, 14 bp, Homo sapiens
gtaaagctggccct

SEQ ID NO: 5498656 - DNA, 14 bp, Homo sapiens
gtaaagctgttaaa

SEQ ID NO: 5498657 - DNA, 17 bp, Homo sapiens
gtaaagctgttaaaata

SEQ ID NO: 5498658 - DNA, 15 bp, Homo sapiens
gtaaaggaaataatt

SEQ ID NO: 5498659 - DNA, 21 bp, Homo sapiens
gtaaaggactatttataacta

SEQ ID NO: 5498660 - DNA, 15 bp, Homo sapiens
gtaaaggagggagat

SEQ ID NO: 5498661 - DNA, 15 bp, Homo sapiens
gtaaaggcctttaat

SEQ ID NO: 5498662 - DNA, 15 bp, Homo sapiens
gtaaagggcaaataa

SEQ ID NO: 5498663 - DNA, 22 bp, Homo sapiens
gtaaagggcgcaaagggcatgg

SEQ ID NO: 5498664 - DNA, 17 bp, Homo sapiens
gtaaaggtgatgaattt

SEQ ID NO: 5498665 - DNA, 15 bp, Homo sapiens
gtaaaggtttttatt

SEQ ID NO: 5498666 - DNA, 17 bp, Homo sapiens
gtaaagtacttgtagtt

SEQ ID NO: 5498667 - DNA, 18 bp, Homo sapiens
gtaaagtatcacttttct

SEQ ID NO: 5498668 - DNA, 22 bp, Homo sapiens
gtaaagtatgtattatttacat

SEQ ID NO: 5498669 - DNA, 23 bp, Homo sapiens
gtaaagtatgtattatttacatt

SEQ ID NO: 5498670 - DNA, 21 bp, Homo sapiens
gtaaagtatgtttttaaattt

SEQ ID NO: 5498671 - DNA, 20 bp, Homo sapiens
gtaaagtatttgatgtacat

SEQ ID NO: 5498672 - DNA, 21 bp, Homo sapiens
gtaaagtatttgatgtacatt

SEQ ID NO: 5498673 - DNA, 20 bp, Homo sapiens
gtaaagtatttttgattaac

SEQ ID NO: 5498674 - DNA, 14 bp, Homo sapiens
gtaaagtccccaga

SEQ ID NO: 5498675 - DNA, 16 bp, Homo sapiens
gtaaagtccccagaga

SEQ ID NO: 5498676 - DNA, 23 bp, Homo sapiens
gtaaagtccccagagaaagcgca

SEQ ID NO: 5498677 - DNA, 20 bp, Homo sapiens
gtaaagtccttttcttgctt

SEQ ID NO: 5498678 - DNA, 19 bp, Homo sapiens
gtaaagtcggtgattatat

SEQ ID NO: 5498679 - DNA, 16 bp, Homo sapiens
gtaaagtctagaaaat

SEQ ID NO: 5498680 - DNA, 18 bp, Homo sapiens
gtaaagtctagaaaataa

SEQ ID NO: 5498681 - DNA, 15 bp, Homo sapiens
gtaaagtctgggcca

SEQ ID NO: 5498682 - DNA, 17 bp, Homo sapiens
gtaaagtgataatttct

SEQ ID NO: 5498683 - DNA, 23 bp, Homo sapiens
gtaaagtgataatttctggaatt

SEQ ID NO: 5498684 - DNA, 12 bp, Homo sapiens
gtaaagtgctta

SEQ ID NO: 5498685 - DNA, 20 bp, Homo sapiens
gtaaagtggttctctgcctt

SEQ ID NO: 5498686 - DNA, 15 bp, Homo sapiens
gtaaagtgtaacata

SEQ ID NO: 5498687 - DNA, 17 bp, Homo sapiens
gtaaagtgtaacatatg

SEQ ID NO: 5498688 - DNA, 11 bp, Homo sapiens
gtaaagtgtgg

SEQ ID NO: 5498689 - DNA, 21 bp, Homo sapiens
gtaaagtgtggtcccaacagg

SEQ ID NO: 5498690 - DNA, 15 bp, Homo sapiens
gtaaagttaattcat

SEQ ID NO: 5498691 - DNA, 14 bp, Homo sapiens
gtaaattttatggc

SEQ ID NO: 5498692 - DNA, 19 bp, Homo sapiens
gtaaatttttaggcaaaga

SEQ ID NO: 5498693 - DNA, 20 bp, Homo sapiens
gtaaatttttgaaaaatatt

SEQ ID NO: 5498694 - DNA, 21 bp, Homo sapiens
gtaaatttttgaaaaatattg

SEQ ID NO: 5498695 - DNA, 22 bp, Homo sapiens
gtaaattttttacgtagctatt

SEQ ID NO: 5498696 - DNA, 20 bp, Homo sapiens
gtaacaaataaagtgcagtt

SEQ ID NO: 5498697 - DNA, 14 bp, Homo sapiens
gtaacaaataacct

SEQ ID NO: 5498698 - DNA, 14 bp, Homo sapiens
gtaacaagaaaaca

SEQ ID NO: 5498699 - DNA, 18 bp, Homo sapiens
gtaacaagaaagtggtct

SEQ ID NO: 5498700 - DNA, 13 bp, Homo sapiens
gtaacaagccaga

SEQ ID NO: 5498701 - DNA, 15 bp, Homo sapiens
gtaacaagccagatt

SEQ ID NO: 5498702 - DNA, 18 bp, Homo sapiens
gtaacaatacaaatggat

SEQ ID NO: 5498703 - DNA, 13 bp, Homo sapiens
gtaacaatactgg

SEQ ID NO: 5498704 - DNA, 22 bp, Homo sapiens
gtaacacagctgagagactttt

SEQ ID NO: 5498705 - DNA, 14 bp, Homo sapiens
gtaacacaggccac

SEQ ID NO: 5498706 - DNA, 12 bp, Homo sapiens
gtaacacagtat

SEQ ID NO: 5498707 - DNA, 14 bp, Homo sapiens
gtaacacagtcatt

SEQ ID NO: 5498708 - DNA, 17 bp, Homo sapiens
gtaacactaatatattt

SEQ ID NO: 5498709 - DNA, 19 bp, Homo sapiens
gtaacactaatatatttaa

SEQ ID NO: 5498710 - DNA, 22 bp, Homo sapiens
gtaacactaatatatttaaaaa

SEQ ID NO: 5498711 - DNA, 20 bp, Homo sapiens
gtaacactagggccttggaa

SEQ ID NO: 5498712 - DNA, 20 bp, Homo sapiens
gtaacactagtagctgtttt

SEQ ID NO: 5498713 - DNA, 18 bp, Homo sapiens
gtaacactgcaagaagtc

SEQ ID NO: 5498714 - DNA, 21 bp, Homo sapiens
gtaacactgtgtacacctcaa

SEQ ID NO: 5498715 - DNA, 21 bp, Homo sapiens
gtaacactttaaaaccagtta

SEQ ID NO: 5498716 - DNA, 16 bp, Homo sapiens
gtaacactttacaatg

SEQ ID NO: 5498717 - DNA, 17 bp, Homo sapiens
gtaacactttacaatgt

SEQ ID NO: 5498718 - DNA, 19 bp, Homo sapiens
gtaacactttgctttctga

SEQ ID NO: 5498719 - DNA, 23 bp, Homo sapiens
gtaacagaaagggcaacaataaa

SEQ ID NO: 5498720 - DNA, 14 bp, Homo sapiens
gtaacagaacagct

SEQ ID NO: 5498721 - DNA, 15 bp, Homo sapiens
gtaacagaagaggag

SEQ ID NO: 5498722 - DNA, 11 bp, Homo sapiens
gtaacagacac

SEQ ID NO: 5498723 - DNA, 15 bp, Homo sapiens
gtaacagacattgtt

SEQ ID NO: 5498724 - DNA, 16 bp, Homo sapiens
gtaacagctgaggtct

SEQ ID NO: 5498725 - DNA, 19 bp, Homo sapiens
gtaacaggaaaattttaaa

SEQ ID NO: 5498726 - DNA, 22 bp, Homo sapiens
gtaacaggaaaattttaaaaat

SEQ ID NO: 5498727 - DNA, 14 bp, Homo sapiens
gtaacaggtctcct

SEQ ID NO: 5498728 - DNA, 20 bp, Homo sapiens
gtaacaggtctcctcttaaa

SEQ ID NO: 5498729 - DNA, 18 bp, Homo sapiens
gtaacagtgaggctggga

SEQ ID NO: 5498730 - DNA, 17 bp, Homo sapiens
gtaacagttagccactg

SEQ ID NO: 5498731 - DNA, 22 bp, Homo sapiens
gtaacagttcatgtttgcttca

SEQ ID NO: 5498732 - DNA, 17 bp, Homo sapiens
gtaacagttgaagaaaa

SEQ ID NO: 5498733 - DNA, 19 bp, Homo sapiens
gtaacataactgcttcttg

SEQ ID NO: 5498734 - DNA, 19 bp, Homo sapiens
gtaacatatgcaaacataa

SEQ ID NO: 5498735 - DNA, 15 bp, Homo sapiens
gtaacatcaaagatt

SEQ ID NO: 5498736 - DNA, 19 bp, Homo sapiens
gtaacatcactatccatgc

SEQ ID NO: 5498737 - DNA, 20 bp, Homo sapiens
gtaacatcataattacattc

SEQ ID NO: 5498738 - DNA, 14 bp, Homo sapiens
gtaacatccaagcc

SEQ ID NO: 5498739 - DNA, 15 bp, Homo sapiens
gtaacatccaagcca

SEQ ID NO: 5498740 - DNA, 18 bp, Homo sapiens
gtaacatccaagccagag

SEQ ID NO: 5498741 - DNA, 13 bp, Homo sapiens
gtaacatcctttc

SEQ ID NO: 5498742 - DNA, 18 bp, Homo sapiens
gtaacatgccagcttcct

SEQ ID NO: 5498743 - DNA, 16 bp, Homo sapiens
gtaacatgtctaaagt

SEQ ID NO: 5498744 - DNA, 12 bp, Homo sapiens
gtaacatgttta

SEQ ID NO: 5498745 - DNA, 16 bp, Homo sapiens
gtaacattagttttaa

SEQ ID NO: 5498746 - DNA, 14 bp, Homo sapiens
gtaacattataaat

SEQ ID NO: 5498747 - DNA, 17 bp, Homo sapiens
gtaacattataaatgac

SEQ ID NO: 5498748 - DNA, 17 bp, Homo sapiens
gtaacattcatgttcta

SEQ ID NO: 5498749 - DNA, 17 bp, Homo sapiens
gtaacattgtaaagtat

SEQ ID NO: 5498750 - DNA, 16 bp, Homo sapiens
gtaacatttatagaag

SEQ ID NO: 5498751 - DNA, 17 bp, Homo sapiens
gtaacatttatagaaga

SEQ ID NO: 5498752 - DNA, 17 bp, Homo sapiens
gtaacatttctgttctc

SEQ ID NO: 5498753 - DNA, 19 bp, Homo sapiens
gtaacatttgctgttttaa

SEQ ID NO: 5498754 - DNA, 22 bp, Homo sapiens
gtaacatttgctgttttaaaca

SEQ ID NO: 5498755 - DNA, 20 bp, Homo sapiens
gtaaccaaatattaaagatt

SEQ ID NO: 5498756 - DNA, 15 bp, Homo sapiens
gtaaccaagagtatt

SEQ ID NO: 5498757 - DNA, 21 bp, Homo sapiens
gtaaccaagagttaagatatc

SEQ ID NO: 5498758 - DNA, 23 bp, Homo sapiens
gtaaccaatcctactaataaacc

SEQ ID NO: 5498759 - DNA, 17 bp, Homo sapiens
gtaaccacctctctgtc

SEQ ID NO: 5498760 - DNA, 21 bp, Homo sapiens
gtaaccacctctctgtctttt

SEQ ID NO: 5498761 - DNA, 19 bp, Homo sapiens
gtaaccagcagtcacaggt

SEQ ID NO: 5498762 - DNA, 16 bp, Homo sapiens
gtaaccagtgcagaaa

SEQ ID NO: 5498763 - DNA, 19 bp, Homo sapiens
gtaaccagtgcagaaatga

SEQ ID NO: 5498764 - DNA, 21 bp, Homo sapiens
gtaaccagttttttcacctcc

SEQ ID NO: 5498765 - DNA, 23 bp, Homo sapiens
gtaacccagattttgctgtatat

SEQ ID NO: 5498766 - DNA, 23 bp, Homo sapiens
gtaaccccatactctccttttga

SEQ ID NO: 5498767 - DNA, 19 bp, Homo sapiens
gtaaccctcgccctgtccc

SEQ ID NO: 5498768 - DNA, 21 bp, Homo sapiens
gtaaccgtaacccacccccaa

SEQ ID NO: 5498769 - DNA, 18 bp, Homo sapiens
gtaacctcttcagaggcc

SEQ ID NO: 5498770 - DNA, 20 bp, Homo sapiens
gtaacctcttcagaggccct

SEQ ID NO: 5498771 - DNA, 18 bp, Homo sapiens
gtaacctgagatggccct

SEQ ID NO: 5498772 - DNA, 13 bp, Homo sapiens
gtaacctgattca

SEQ ID NO: 5498773 - DNA, 16 bp, Homo sapiens
gtaaccttatatttac

SEQ ID NO: 5498774 - DNA, 17 bp, Homo sapiens
gtaacgcgtcttcctga

SEQ ID NO: 5498775 - DNA, 23 bp, Homo sapiens
gtaacgggtcgtgctcatgtctg

SEQ ID NO: 5498776 - DNA, 19 bp, Homo sapiens
gtaacgtattggacctgcc

SEQ ID NO: 5498777 - DNA, 17 bp, Homo sapiens
gtaacgtgattgattca

SEQ ID NO: 5498778 - DNA, 21 bp, Homo sapiens
gtaacgtgctcactgtgtata

SEQ ID NO: 5498779 - DNA, 18 bp, Homo sapiens
gtaacgtgtgctgtgttt

SEQ ID NO: 5498780 - DNA, 15 bp, Homo sapiens
gtaacgtgttactgg

SEQ ID NO: 5498781 - DNA, 21 bp, Homo sapiens
gtaacgttaaatgaaaaaaga

SEQ ID NO: 5498782 - DNA, 15 bp, Homo sapiens
gtaacgttgctgtgg

SEQ ID NO: 5498783 - DNA, 13 bp, Homo sapiens
gtaactaaaataa

SEQ ID NO: 5498784 - DNA, 16 bp, Homo sapiens
gtaactaactaaaaca

SEQ ID NO: 5498785 - DNA, 18 bp, Homo sapiens
gtaactactttttatact

SEQ ID NO: 5498786 - DNA, 20 bp, Homo sapiens
gtaactaggatatgtatatt

SEQ ID NO: 5498787 - DNA, 20 bp, Homo sapiens
gtaactaggccatttgtatt

SEQ ID NO: 5498788 - DNA, 11 bp, Homo sapiens
gtaactaggta

SEQ ID NO: 5498789 - DNA, 14 bp, Homo sapiens
gtaactatgtttta

SEQ ID NO: 5498790 - DNA, 22 bp, Homo sapiens
gtaactattaaccttttttgtc

SEQ ID NO: 5498791 - DNA, 19 bp, Homo sapiens
gtaactatttcttcagagt

SEQ ID NO: 5498792 - DNA, 20 bp, Homo sapiens
gtaactcaccgtgctgtctt

SEQ ID NO: 5498793 - DNA, 17 bp, Homo sapiens
gtaactccaccaaccca

SEQ ID NO: 5498794 - DNA, 19 bp, Homo sapiens
gtaactccagatagagaaa

SEQ ID NO: 5498795 - DNA, 12 bp, Homo sapiens
gtaactcccact

SEQ ID NO: 5498796 - DNA, 13 bp, Homo sapiens
gtaactcccactc

SEQ ID NO: 5498797 - DNA, 16 bp, Homo sapiens
gtaactcttggccaga

SEQ ID NO: 5498798 - DNA, 21 bp, Homo sapiens
gtaactcttggccagagctga

SEQ ID NO: 5498799 - DNA, 14 bp, Homo sapiens
gtaactctttggct

SEQ ID NO: 5498800 - DNA, 14 bp, Homo sapiens
gtaactgaagcata

SEQ ID NO: 5498801 - DNA, 15 bp, Homo sapiens
gtaactgaagcataa

SEQ ID NO: 5498802 - DNA, 14 bp, Homo sapiens
gtaactgagagaaa

SEQ ID NO: 5498803 - DNA, 15 bp, Homo sapiens
gtaactgagagaaag

SEQ ID NO: 5498804 - DNA, 18 bp, Homo sapiens
gtaactgcacctgggcag

SEQ ID NO: 5498805 - DNA, 14 bp, Homo sapiens
gtaactgcccagcc

SEQ ID NO: 5498806 - DNA, 16 bp, Homo sapiens
gtaactgcccagcccc

SEQ ID NO: 5498807 - DNA, 14 bp, Homo sapiens
gtaactgcctagaa

SEQ ID NO: 5498808 - DNA, 14 bp, Homo sapiens
gtaactgctcagag

SEQ ID NO: 5498809 - DNA, 15 bp, Homo sapiens
gtaactgctgagcca

SEQ ID NO: 5498810 - DNA, 16 bp, Homo sapiens
gtaactgctgagccac

SEQ ID NO: 5498811 - DNA, 19 bp, Homo sapiens
gtaactgctttctgttcca

SEQ ID NO: 5498812 - DNA, 23 bp, Homo sapiens
gtaactggccttacgatggcaat

SEQ ID NO: 5498813 - DNA, 14 bp, Homo sapiens
gtaactggctgtgt

SEQ ID NO: 5498814 - DNA, 23 bp, Homo sapiens
gtaactggttaaaaaacaaatgt

SEQ ID NO: 5498815 - DNA, 12 bp, Homo sapiens
gtaactgtcagg

SEQ ID NO: 5498816 - DNA, 23 bp, Homo sapiens
gtaactgtcaggctgaaaacaat

SEQ ID NO: 5498817 - DNA, 13 bp, Homo sapiens
gtaactgtccctg

SEQ ID NO: 5498818 - DNA, 13 bp, Homo sapiens
gtaactgtcctgt

SEQ ID NO: 5498819 - DNA, 16 bp, Homo sapiens
gtaactgtcctgtcct

SEQ ID NO: 5498820 - DNA, 21 bp, Homo sapiens
gtaactgtcctgtcctgctca

SEQ ID NO: 5498821 - DNA, 19 bp, Homo sapiens
gtaactgttaaattgctgt

SEQ ID NO: 5498822 - DNA, 20 bp, Homo sapiens
gtaactgttaacccagtgtt

SEQ ID NO: 5498823 - DNA, 22 bp, Homo sapiens
gtaactgttaacccagtgttca

SEQ ID NO: 5498824 - DNA, 18 bp, Homo sapiens
gtaactgttcctactttg

SEQ ID NO: 5498825 - DNA, 12 bp, Homo sapiens
gtaactgttctt

SEQ ID NO: 5498826 - DNA, 16 bp, Homo sapiens
gtaactgttctttgca

SEQ ID NO: 5498827 - DNA, 16 bp, Homo sapiens
gtaacttaaatatttg

SEQ ID NO: 5498828 - DNA, 16 bp, Homo sapiens
gtaacttaattataag

SEQ ID NO: 5498829 - DNA, 15 bp, Homo sapiens
gtaacttatattgaa

SEQ ID NO: 5498830 - DNA, 23 bp, Homo sapiens
gtaacttatattgaagacaattt

SEQ ID NO: 5498831 - DNA, 22 bp, Homo sapiens
gtaacttatgtagatatttggc

SEQ ID NO: 5498832 - DNA, 17 bp, Homo sapiens
gtaacttcagatgtttc

SEQ ID NO: 5498833 - DNA, 13 bp, Homo sapiens
gtaacttcctgct

SEQ ID NO: 5498834 - DNA, 20 bp, Homo sapiens
gtaacttcctgctgcaccct

SEQ ID NO: 5498835 - DNA, 17 bp, Homo sapiens
gtaacttgagattcaag

SEQ ID NO: 5498836 - DNA, 21 bp, Homo sapiens
gtaacttgagattcaagacaa

SEQ ID NO: 5498837 - DNA, 22 bp, Homo sapiens
gtaacttgatccatttctaatt

SEQ ID NO: 5498838 - DNA, 21 bp, Homo sapiens
gtaacttgctgtgaaatgact

SEQ ID NO: 5498839 - DNA, 21 bp, Homo sapiens
gtaacttgcttaaatttctta

SEQ ID NO: 5498840 - DNA, 19 bp, Homo sapiens
gtaacttgtttttattgca

SEQ ID NO: 5498841 - DNA, 22 bp, Homo sapiens
gtaacttgtttttattgcattt

SEQ ID NO: 5498842 - DNA, 13 bp, Homo sapiens
gtaactttaaaca

SEQ ID NO: 5498843 - DNA, 17 bp, Homo sapiens
gtaactttaaacatcta

SEQ ID NO: 5498844 - DNA, 20 bp, Homo sapiens
gtaactttaaacatctagca

SEQ ID NO: 5498845 - DNA, 17 bp, Homo sapiens
gtaactttactctgtgt

SEQ ID NO: 5498846 - DNA, 14 bp, Homo sapiens
gtaactttatgtgt

SEQ ID NO: 5498847 - DNA, 16 bp, Homo sapiens
gtaactttatgtgtaa

SEQ ID NO: 5498848 - DNA, 23 bp, Homo sapiens
gtaactttattggtcttgcccta

SEQ ID NO: 5498849 - DNA, 14 bp, Homo sapiens
gtaactttgcatgt

SEQ ID NO: 5498850 - DNA, 21 bp, Homo sapiens
gtaactttgcgggatatttag

SEQ ID NO: 5498851 - DNA, 23 bp, Homo sapiens
gtaactttgcttgattaaacagc

SEQ ID NO: 5498852 - DNA, 12 bp, Homo sapiens
gtaacttttaat

SEQ ID NO: 5498853 - DNA, 12 bp, Homo sapiens
gtaacttttgta

SEQ ID NO: 5498854 - DNA, 15 bp, Homo sapiens
gtaacttttgtaaga

SEQ ID NO: 5498855 - DNA, 14 bp, Homo sapiens
gtaacttttgtgaa

SEQ ID NO: 5498856 - DNA, 18 bp, Homo sapiens
gtaactttttacattaca

SEQ ID NO: 5498857 - DNA, 19 bp, Homo sapiens
gtaacttttttgtgtatgt

SEQ ID NO: 5498858 - DNA, 21 bp, Homo sapiens
gtaacttttttttttttttgg

SEQ ID NO: 5498859 - DNA, 13 bp, Homo sapiens
gtaagaaaacaaa

SEQ ID NO: 5498860 - DNA, 21 bp, Homo sapiens
gtaagaaaagctggtctggag

SEQ ID NO: 5498861 - DNA, 13 bp, Homo sapiens
gtaagaaaatatt

SEQ ID NO: 5498862 - DNA, 19 bp, Homo sapiens
gtaagaaaatgctagaaga

SEQ ID NO: 5498863 - DNA, 20 bp, Homo sapiens
gtaagaaacacactgaggca

SEQ ID NO: 5498864 - DNA, 19 bp, Homo sapiens
gtaagaaagccaccttgtt

SEQ ID NO: 5498865 - DNA, 13 bp, Homo sapiens
gtaagaaatacag

SEQ ID NO: 5498866 - DNA, 16 bp, Homo sapiens
gtaagaaatacagact

SEQ ID NO: 5498867 - DNA, 22 bp, Homo sapiens
gtaagaaatctcccatgtgcat

SEQ ID NO: 5498868 - DNA, 14 bp, Homo sapiens
gtaatactcattcc

SEQ ID NO: 5498869 - DNA, 18 bp, Homo sapiens
gtaatactgtagaaatat

SEQ ID NO: 5498870 - DNA, 13 bp, Homo sapiens
gtaatacttcttt

SEQ ID NO: 5498871 - DNA, 15 bp, Homo sapiens
gtaatactttacaaa

SEQ ID NO: 5498872 - DNA, 22 bp, Homo sapiens
gtaatactttcggagaaattct

SEQ ID NO: 5498873 - DNA, 22 bp, Homo sapiens
gtaatagaagcttaaaataaag

SEQ ID NO: 5498874 - DNA, 19 bp, Homo sapiens
gtaatagcatccactggaa

SEQ ID NO: 5498875 - DNA, 15 bp, Homo sapiens
gtaatagctttagtg

SEQ ID NO: 5498876 - DNA, 15 bp, Homo sapiens
gtaataggaagaaca

SEQ ID NO: 5498877 - DNA, 19 bp, Homo sapiens
gtaataggaagaacagtac

SEQ ID NO: 5498878 - DNA, 13 bp, Homo sapiens
gtaataggcattt

SEQ ID NO: 5498879 - DNA, 20 bp, Homo sapiens
gtaataggcgtaactaattt

SEQ ID NO: 5498880 - DNA, 18 bp, Homo sapiens
gtaatagtccaatatttg

SEQ ID NO: 5498881 - DNA, 22 bp, Homo sapiens
gtaatagttcagtagaattacc

SEQ ID NO: 5498882 - DNA, 19 bp, Homo sapiens
gtaatataaatttaagcaa

SEQ ID NO: 5498883 - DNA, 20 bp, Homo sapiens
gtaatataaatttaagcaaa

SEQ ID NO: 5498884 - DNA, 17 bp, Homo sapiens
gtaatataatgtatttt

SEQ ID NO: 5498885 - DNA, 14 bp, Homo sapiens
gtaatatatacata

SEQ ID NO: 5498886 - DNA, 15 bp, Homo sapiens
gtaatatatacatat

SEQ ID NO: 5498887 - DNA, 19 bp, Homo sapiens
gtaatatatcctgtttgta

SEQ ID NO: 5498888 - DNA, 20 bp, Homo sapiens
gtaatatatcctgtttgtat

SEQ ID NO: 5498889 - DNA, 19 bp, Homo sapiens
gtaatatatgatatttttc

SEQ ID NO: 5498890 - DNA, 17 bp, Homo sapiens
gtaatatattgccagta

SEQ ID NO: 5498891 - DNA, 18 bp, Homo sapiens
gtaatatattgctgctgg

SEQ ID NO: 5498892 - DNA, 12 bp, Homo sapiens
gtaatatattgt

SEQ ID NO: 5498893 - DNA, 17 bp, Homo sapiens
gtaatatattgtacaaa

SEQ ID NO: 5498894 - DNA, 21 bp, Homo sapiens
gtaatatcaaagcattttata

SEQ ID NO: 5498895 - DNA, 17 bp, Homo sapiens
gtaatatcagttacagt

SEQ ID NO: 5498896 - DNA, 18 bp, Homo sapiens
gtaatatcattttataga

SEQ ID NO: 5498897 - DNA, 13 bp, Homo sapiens
gtaatatctttca

SEQ ID NO: 5498898 - DNA, 12 bp, Homo sapiens
gtaatatgagaa

SEQ ID NO: 5498899 - DNA, 16 bp, Homo sapiens
gtaatatgcacacatt

SEQ ID NO: 5498900 - DNA, 17 bp, Homo sapiens
gtaatatggactcagcc

SEQ ID NO: 5498901 - DNA, 13 bp, Homo sapiens
gtaatattaaatt

SEQ ID NO: 5498902 - DNA, 12 bp, Homo sapiens
gtaatattatta

SEQ ID NO: 5498903 - DNA, 20 bp, Homo sapiens
gtaatattattactttatga

SEQ ID NO: 5498904 - DNA, 18 bp, Homo sapiens
gtaatattctctgatgtt

SEQ ID NO: 5498905 - DNA, 16 bp, Homo sapiens
gtaatattgacttgta

SEQ ID NO: 5498906 - DNA, 16 bp, Homo sapiens
gtaatatttaaatatt

SEQ ID NO: 5498907 - DNA, 17 bp, Homo sapiens
gtaatatttacaatgta

SEQ ID NO: 5498908 - DNA, 21 bp, Homo sapiens
gtaatatttacaatgtattaa

SEQ ID NO: 5498909 - DNA, 21 bp, Homo sapiens
gtaatatttacataaagactg

SEQ ID NO: 5498910 - DNA, 22 bp, Homo sapiens
gtaatatttacataaagactgt

SEQ ID NO: 5498911 - DNA, 18 bp, Homo sapiens
gtaatatttatatattta

SEQ ID NO: 5498912 - DNA, 16 bp, Homo sapiens
gtaatatttgaatttt

SEQ ID NO: 5498913 - DNA, 13 bp, Homo sapiens
gtaatattttcca

SEQ ID NO: 5498914 - DNA, 19 bp, Homo sapiens
gtaatattttgtattattg

SEQ ID NO: 5498915 - DNA, 13 bp, Homo sapiens
gtaatatttttgt

SEQ ID NO: 5498916 - DNA, 14 bp, Homo sapiens
gtaatatttttgtc

SEQ ID NO: 5498917 - DNA, 13 bp, Homo sapiens
gtaatcaataaac

SEQ ID NO: 5498918 - DNA, 19 bp, Homo sapiens
gtaatcaataaagaaaact

SEQ ID NO: 5498919 - DNA, 22 bp, Homo sapiens
gtaatcaatctactcaaagcat

SEQ ID NO: 5498920 - DNA, 12 bp, Homo sapiens
gtaatcaatgaa

SEQ ID NO: 5498921 - DNA, 19 bp, Homo sapiens
gtaatcaatgaatattgaa

SEQ ID NO: 5498922 - DNA, 20 bp, Homo sapiens
gtaatcacactctcttctta

SEQ ID NO: 5498923 - DNA, 14 bp, Homo sapiens
gtaatcacatttct

SEQ ID NO: 5498924 - DNA, 14 bp, Homo sapiens
gtaatcactcccat

SEQ ID NO: 5498925 - DNA, 14 bp, Homo sapiens
gtaatcacttttca

SEQ ID NO: 5498926 - DNA, 22 bp, Homo sapiens
gtaatcagcattattcttcaga

SEQ ID NO: 5498927 - DNA, 18 bp, Homo sapiens
gtaatcaggcaaggagga

SEQ ID NO: 5498928 - DNA, 23 bp, Homo sapiens
gtaatcatccccatcctccagag

SEQ ID NO: 5498929 - DNA, 15 bp, Homo sapiens
gtaatcatctaagtc

SEQ ID NO: 5498930 - DNA, 19 bp, Homo sapiens
gtaatcattatctcacttt

SEQ ID NO: 5498931 - DNA, 17 bp, Homo sapiens
gtaatcattgactaaag

SEQ ID NO: 5498932 - DNA, 17 bp, Homo sapiens
gtaatcatttatcttat

SEQ ID NO: 5498933 - DNA, 23 bp, Homo sapiens
gtaatcatttcttgggccctcct

SEQ ID NO: 5498934 - DNA, 17 bp, Homo sapiens
gtaatccatcactagcc

SEQ ID NO: 5498935 - DNA, 16 bp, Homo sapiens
gtaatcccagcacttt

SEQ ID NO: 5498936 - DNA, 13 bp, Homo sapiens
gtaatcccagcta

SEQ ID NO: 5498937 - DNA, 14 bp, Homo sapiens
gtaatcccagctac

SEQ ID NO: 5498938 - DNA, 22 bp, Homo sapiens
gtaatcccagctacccaggagg

SEQ ID NO: 5498939 - DNA, 21 bp, Homo sapiens
gtaatcccagctactcaggag

SEQ ID NO: 5498940 - DNA, 16 bp, Homo sapiens
gtaatcccagctactt

SEQ ID NO: 5498941 - DNA, 23 bp, Homo sapiens
gtaatcccagctattcaggaggc

SEQ ID NO: 5498942 - DNA, 16 bp, Homo sapiens
gtaatcccagtacttt

SEQ ID NO: 5498943 - DNA, 19 bp, Homo sapiens
gtaatcccccaggagaaca

SEQ ID NO: 5498944 - DNA, 16 bp, Homo sapiens
gtaatcctagctactt

SEQ ID NO: 5498945 - DNA, 23 bp, Homo sapiens
gtaatcctagctacttggcaggc

SEQ ID NO: 5498946 - DNA, 14 bp, Homo sapiens
gtaatcctcctgag

SEQ ID NO: 5498947 - DNA, 22 bp, Homo sapiens
gtaatcggctcccgcttgctct

SEQ ID NO: 5498948 - DNA, 22 bp, Homo sapiens
gtaatcgggcgcccgaagaggg

SEQ ID NO: 5498949 - DNA, 14 bp, Homo sapiens
gtaatctaatagaa

SEQ ID NO: 5498950 - DNA, 11 bp, Homo sapiens
gtaatctacac

SEQ ID NO: 5498951 - DNA, 14 bp, Homo sapiens
gtaatctacaccaa

SEQ ID NO: 5498952 - DNA, 22 bp, Homo sapiens
gtaatctacaccaatgaaaaca

SEQ ID NO: 5498953 - DNA, 20 bp, Homo sapiens
gtaatctatgtttataatac

SEQ ID NO: 5498954 - DNA, 22 bp, Homo sapiens
gtaatctattcctgtaaataag

SEQ ID NO: 5498955 - DNA, 20 bp, Homo sapiens
gtaatctcacttaatacaga

SEQ ID NO: 5498956 - DNA, 16 bp, Homo sapiens
gtaatctcagctactc

SEQ ID NO: 5498957 - DNA, 22 bp, Homo sapiens
gtaatctccacagtcaaagaag

SEQ ID NO: 5498958 - DNA, 19 bp, Homo sapiens
gtaatctctctgcagctgc

SEQ ID NO: 5498959 - DNA, 22 bp, Homo sapiens
gtaatctgaataaagtgtaaca

SEQ ID NO: 5498960 - DNA, 13 bp, Homo sapiens
gtaatctttcata

SEQ ID NO: 5498961 - DNA, 20 bp, Homo sapiens
gtaatctttcatagccatac

SEQ ID NO: 5498962 - DNA, 20 bp, Homo sapiens
gtaatctttcggtctcctta

SEQ ID NO: 5498963 - DNA, 12 bp, Homo sapiens
gtaatcttttct

SEQ ID NO: 5498964 - DNA, 13 bp, Homo sapiens
gtaatgaaaacca

SEQ ID NO: 5498965 - DNA, 23 bp, Homo sapiens
gtaatgaaagtgcactgcagtga

SEQ ID NO: 5498966 - DNA, 14 bp, Homo sapiens
gtaatgaatacctt

SEQ ID NO: 5498967 - DNA, 16 bp, Homo sapiens
gtaatgaatatctgct

SEQ ID NO: 5498968 - DNA, 15 bp, Homo sapiens
gtaatgacagagagt

SEQ ID NO: 5498969 - DNA, 16 bp, Homo sapiens
gtaatgacagagagtt

SEQ ID NO: 5498970 - DNA, 18 bp, Homo sapiens
gtaatgaccagttgttat

SEQ ID NO: 5498971 - DNA, 21 bp, Homo sapiens
gtaatgatatagccagaaaaa

SEQ ID NO: 5498972 - DNA, 14 bp, Homo sapiens
gtaatgatggaact

SEQ ID NO: 5498973 - DNA, 12 bp, Homo sapiens
gtaatgcacaat

SEQ ID NO: 5498974 - DNA, 15 bp, Homo sapiens
gtaatgcacaattta

SEQ ID NO: 5498975 - DNA, 17 bp, Homo sapiens
gtaatgcacaatttaga

SEQ ID NO: 5498976 - DNA, 23 bp, Homo sapiens
gtaatgcacaatttagaaaacat

SEQ ID NO: 5498977 - DNA, 14 bp, Homo sapiens
gtaatgcacatcct

SEQ ID NO: 5498978 - DNA, 17 bp, Homo sapiens
gtaatgcactgttttta

SEQ ID NO: 5498979 - DNA, 18 bp, Homo sapiens
gtaatgcagacatttaca

SEQ ID NO: 5498980 - DNA, 17 bp, Homo sapiens
gtaatgccaatatgaca

SEQ ID NO: 5498981 - DNA, 20 bp, Homo sapiens
gtaatgccacacattgtgct

SEQ ID NO: 5498982 - DNA, 16 bp, Homo sapiens
gtaatgcgattttatt

SEQ ID NO: 5498983 - DNA, 16 bp, Homo sapiens
gtaatgcgccaataaa

SEQ ID NO: 5498984 - DNA, 17 bp, Homo sapiens
gtaatgctaaatgtgta

SEQ ID NO: 5498985 - DNA, 22 bp, Homo sapiens
gtaatgctaaatgtgtaataat

SEQ ID NO: 5498986 - DNA, 17 bp, Homo sapiens
gtaatgctgcacttcct

SEQ ID NO: 5498987 - DNA, 19 bp, Homo sapiens
gtaatgctgcctcaggacc

SEQ ID NO: 5498988 - DNA, 16 bp, Homo sapiens
gtaatgcttatgtgtt

SEQ ID NO: 5498989 - DNA, 16 bp, Homo sapiens
gtaatgcttcaatcag

SEQ ID NO: 5498990 - DNA, 16 bp, Homo sapiens
gtaatggaactgaccc

SEQ ID NO: 5498991 - DNA, 19 bp, Homo sapiens
gtaatggaggtcccagccc

SEQ ID NO: 5498992 - DNA, 16 bp, Homo sapiens
gtaatggcagagcagt

SEQ ID NO: 5498993 - DNA, 20 bp, Homo sapiens
gtaatgggatctatttttgc

SEQ ID NO: 5498994 - DNA, 18 bp, Homo sapiens
gtaatgggccaattaaaa

SEQ ID NO: 5498995 - DNA, 21 bp, Homo sapiens
gtaatgggccaattaaaatat

SEQ ID NO: 5498996 - DNA, 19 bp, Homo sapiens
gtaatggggactctccagg

SEQ ID NO: 5498997 - DNA, 19 bp, Homo sapiens
gtaatggtactgactttgc

SEQ ID NO: 5498998 - DNA, 17 bp, Homo sapiens
gtaatggtgtagaacac

SEQ ID NO: 5498999 - DNA, 12 bp, Homo sapiens
gtaatggttggg

SEQ ID NO: 5499000 - DNA, 17 bp, Homo sapiens
gtaatgtaaaatccatc

SEQ ID NO: 5499001 - DNA, 18 bp, Homo sapiens
gtaatgtaaataaactat

SEQ ID NO: 5499002 - DNA, 15 bp, Homo sapiens
gtaatgtaaatacat

SEQ ID NO: 5499003 - DNA, 19 bp, Homo sapiens
gtaatgtaactgctcttgg

SEQ ID NO: 5499004 - DNA, 15 bp, Homo sapiens
gtaatgtagaaatgt

SEQ ID NO: 5499005 - DNA, 20 bp, Homo sapiens
gtaatgtagcgtgtttacat

SEQ ID NO: 5499006 - DNA, 16 bp, Homo sapiens
gtaatgtatacttgaa

SEQ ID NO: 5499007 - DNA, 18 bp, Homo sapiens
gtaatgtatatctgtaat

SEQ ID NO: 5499008 - DNA, 19 bp, Homo sapiens
gtaatgtatcaaatacatt

SEQ ID NO: 5499009 - DNA, 20 bp, Homo sapiens
gtaatgtcaccaccttccca

SEQ ID NO: 5499010 - DNA, 21 bp, Homo sapiens
gtaatgtcagactttgctgca

SEQ ID NO: 5499011 - DNA, 17 bp, Homo sapiens
gtaatgtcttgagctct

SEQ ID NO: 5499012 - DNA, 16 bp, Homo sapiens
gtaatgtgaaaagtat

SEQ ID NO: 5499013 - DNA, 14 bp, Homo sapiens
gtaatgtgaataaa

SEQ ID NO: 5499014 - DNA, 12 bp, Homo sapiens
gtaatgtgtact

SEQ ID NO: 5499015 - DNA, 22 bp, Homo sapiens
gtaatgttaatattgatttatt

SEQ ID NO: 5499016 - DNA, 14 bp, Homo sapiens
gtaatgttactgat

SEQ ID NO: 5499017 - DNA, 14 bp, Homo sapiens
gtaatgttgtgaat

SEQ ID NO: 5499018 - DNA, 17 bp, Homo sapiens
gtaatgttgtgaataat

SEQ ID NO: 5499019 - DNA, 21 bp, Homo sapiens
gtaatgttttctttgcaaagt

SEQ ID NO: 5499020 - DNA, 22 bp, Homo sapiens
gtaatgttttgtatatacagtt

SEQ ID NO: 5499021 - DNA, 18 bp, Homo sapiens
gtaatgtttttatttcaa

SEQ ID NO: 5499022 - DNA, 18 bp, Homo sapiens
gtaattaaaaacagaaaa

SEQ ID NO: 5499023 - DNA, 18 bp, Homo sapiens
gtaattaaaagcaaatca

SEQ ID NO: 5499024 - DNA, 13 bp, Homo sapiens
gtaattaaactgt

SEQ ID NO: 5499025 - DNA, 14 bp, Homo sapiens
gtaattaaattatg

SEQ ID NO: 5499026 - DNA, 12 bp, Homo sapiens
gtaattaaattt

SEQ ID NO: 5499027 - DNA, 18 bp, Homo sapiens
gtaattaaggtacatcat

SEQ ID NO: 5499028 - DNA, 22 bp, Homo sapiens
gtaattaagtgcaatttcccct

SEQ ID NO: 5499029 - DNA, 13 bp, Homo sapiens
gtaattacaacta

SEQ ID NO: 5499030 - DNA, 18 bp, Homo sapiens
gtaattacatatttgact

SEQ ID NO: 5499031 - DNA, 17 bp, Homo sapiens
gtaattacctggagaag

SEQ ID NO: 5499032 - DNA, 22 bp, Homo sapiens
gtaattacctgtcatctgggcc

SEQ ID NO: 5499033 - DNA, 23 bp, Homo sapiens
gtaattacctgtcatctgggcca

SEQ ID NO: 5499034 - DNA, 19 bp, Homo sapiens
gtaattactttcagaatgt

SEQ ID NO: 5499035 - DNA, 21 bp, Homo sapiens
gtaattaggataactaaaatt

SEQ ID NO: 5499036 - DNA, 13 bp, Homo sapiens
gtaattagtttaa

SEQ ID NO: 5499037 - DNA, 13 bp, Homo sapiens
gtaattatatctg

SEQ ID NO: 5499038 - DNA, 21 bp, Homo sapiens
gtaattatcgggaacagtgtt

SEQ ID NO: 5499039 - DNA, 22 bp, Homo sapiens
gtaattatcgggaacagtgttt

SEQ ID NO: 5499040 - DNA, 16 bp, Homo sapiens
gtaattatgaaaagaa

SEQ ID NO: 5499041 - DNA, 17 bp, Homo sapiens
gtaattatgaaaagaaa

SEQ ID NO: 5499042 - DNA, 13 bp, Homo sapiens
gtaattatgattt

SEQ ID NO: 5499043 - DNA, 14 bp, Homo sapiens
gtaattatgatttg

SEQ ID NO: 5499044 - DNA, 17 bp, Homo sapiens
gtaattatgtaacctat

SEQ ID NO: 5499045 - DNA, 13 bp, Homo sapiens
gtaattattttcc

SEQ ID NO: 5499046 - DNA, 21 bp, Homo sapiens
gtacactacgcactggacagc

SEQ ID NO: 5499047 - DNA, 13 bp, Homo sapiens
gtacactcagcca

SEQ ID NO: 5499048 - DNA, 16 bp, Homo sapiens
gtacactgacttgaga

SEQ ID NO: 5499049 - DNA, 23 bp, Homo sapiens
gtacactgccttctcaactccaa

SEQ ID NO: 5499050 - DNA, 13 bp, Homo sapiens
gtacactgtgtct

SEQ ID NO: 5499051 - DNA, 18 bp, Homo sapiens
gtacactgtgtctctatg

SEQ ID NO: 5499052 - DNA, 21 bp, Homo sapiens
gtacacttctcttaagtggtc

SEQ ID NO: 5499053 - DNA, 18 bp, Homo sapiens
gtacacttggtgtactgg

SEQ ID NO: 5499054 - DNA, 14 bp, Homo sapiens
gtacacttgtgaat

SEQ ID NO: 5499055 - DNA, 14 bp, Homo sapiens
gtacactttttaca

SEQ ID NO: 5499056 - DNA, 20 bp, Homo sapiens
gtacagaaaacatgtttaaa

SEQ ID NO: 5499057 - DNA, 20 bp, Homo sapiens
gtacagaacacaaatgtcta

SEQ ID NO: 5499058 - DNA, 23 bp, Homo sapiens
gtacagaacacaaatgtctagtt

SEQ ID NO: 5499059 - DNA, 20 bp, Homo sapiens
gtacagaaccagcactccca

SEQ ID NO: 5499060 - DNA, 17 bp, Homo sapiens
gtacagaatatttctat

SEQ ID NO: 5499061 - DNA, 21 bp, Homo sapiens
gtacagaatcattgcttatga

SEQ ID NO: 5499062 - DNA, 23 bp, Homo sapiens
gtacagaatgctatttcacttga

SEQ ID NO: 5499063 - DNA, 11 bp, Homo sapiens
gtacagaattt

SEQ ID NO: 5499064 - DNA, 14 bp, Homo sapiens
gtacagaatttcca

SEQ ID NO: 5499065 - DNA, 17 bp, Homo sapiens
gtacagaatttgaatta

SEQ ID NO: 5499066 - DNA, 15 bp, Homo sapiens
gtacagaattttgga

SEQ ID NO: 5499067 - DNA, 16 bp, Homo sapiens
gtacagaatttttaat

SEQ ID NO: 5499068 - DNA, 19 bp, Homo sapiens
gtacagacgtctcaagact

SEQ ID NO: 5499069 - DNA, 16 bp, Homo sapiens
gtacagacttgttgtg

SEQ ID NO: 5499070 - DNA, 21 bp, Homo sapiens
gtacagagaactaacactatt

SEQ ID NO: 5499071 - DNA, 11 bp, Homo sapiens
gtacagagaag

SEQ ID NO: 5499072 - DNA, 12 bp, Homo sapiens
gtacagagaagc

SEQ ID NO: 5499073 - DNA, 14 bp, Homo sapiens
gtacagagaagcca

SEQ ID NO: 5499074 - DNA, 21 bp, Homo sapiens
gtacagagaagccagcttgtt

SEQ ID NO: 5499075 - DNA, 17 bp, Homo sapiens
gtacagagaagccatca

SEQ ID NO: 5499076 - DNA, 20 bp, Homo sapiens
gtacagagacctccctgttc

SEQ ID NO: 5499077 - DNA, 20 bp, Homo sapiens
gtacagagctttcttttgta

SEQ ID NO: 5499078 - DNA, 20 bp, Homo sapiens
gtacagagtggcccctcacc

SEQ ID NO: 5499079 - DNA, 21 bp, Homo sapiens
gtacagagtgtggactctggt

SEQ ID NO: 5499080 - DNA, 13 bp, Homo sapiens
gtacagatatgca

SEQ ID NO: 5499081 - DNA, 16 bp, Homo sapiens
gtacagatccccagcc

SEQ ID NO: 5499082 - DNA, 17 bp, Homo sapiens
gtacagatccccagccc

SEQ ID NO: 5499083 - DNA, 19 bp, Homo sapiens
gtacagattgctgcttctg

SEQ ID NO: 5499084 - DNA, 13 bp, Homo sapiens
gtacagattttat

SEQ ID NO: 5499085 - DNA, 20 bp, Homo sapiens
gtacagcaaggagatttaca

SEQ ID NO: 5499086 - DNA, 14 bp, Homo sapiens
gtacagcagggtct

SEQ ID NO: 5499087 - DNA, 23 bp, Homo sapiens
gtacagcccagaggccaacactg

SEQ ID NO: 5499088 - DNA, 16 bp, Homo sapiens
gtacagcccttgcact

SEQ ID NO: 5499089 - DNA, 21 bp, Homo sapiens
gtacagcgcggaggaggaggg

SEQ ID NO: 5499090 - DNA, 21 bp, Homo sapiens
gtacagcggctcccctctgct

SEQ ID NO: 5499091 - DNA, 17 bp, Homo sapiens
gtacagctcccttccct

SEQ ID NO: 5499092 - DNA, 15 bp, Homo sapiens
gtacagctggctcta

SEQ ID NO: 5499093 - DNA, 13 bp, Homo sapiens
gtacagctgggct

SEQ ID NO: 5499094 - DNA, 14 bp, Homo sapiens
gtacaggagaggca

SEQ ID NO: 5499095 - DNA, 16 bp, Homo sapiens
gtacaggagaggcagc

SEQ ID NO: 5499096 - DNA, 19 bp, Homo sapiens
gtacaggagaggcagcatg

SEQ ID NO: 5499097 - DNA, 24 bp, Homo sapiens
gtacaggagtcagccatgtctgtg

SEQ ID NO: 5499098 - DNA, 19 bp, Homo sapiens
gtacaggatatcacctgaa

SEQ ID NO: 5499099 - DNA, 23 bp, Homo sapiens
gtacaggatatcacctgaattat

SEQ ID NO: 5499100 - DNA, 24 bp, Homo sapiens
gtacaggcaaaacacgcaagggca

SEQ ID NO: 5499101 - DNA, 12 bp, Homo sapiens
gtacaggcagca

SEQ ID NO: 5499102 - DNA, 17 bp, Homo sapiens
gtacaggcagcacagag

SEQ ID NO: 5499103 - DNA, 20 bp, Homo sapiens
gtacaggcagttaggtgctg

SEQ ID NO: 5499104 - DNA, 18 bp, Homo sapiens
gtacaggctgagacacag

SEQ ID NO: 5499105 - DNA, 13 bp, Homo sapiens
gtacaggctggag

SEQ ID NO: 5499106 - DNA, 15 bp, Homo sapiens
gtacaggtaaggtga

SEQ ID NO: 5499107 - DNA, 14 bp, Homo sapiens
gtacaggtactttg

SEQ ID NO: 5499108 - DNA, 20 bp, Homo sapiens
gtacaggtgtcaccatcatt

SEQ ID NO: 5499109 - DNA, 15 bp, Homo sapiens
gtacagtaccttgtt

SEQ ID NO: 5499110 - DNA, 20 bp, Homo sapiens
gtacagtaccttgttgcaga

SEQ ID NO: 5499111 - DNA, 20 bp, Homo sapiens
gtacagtagcttaaataaat

SEQ ID NO: 5499112 - DNA, 17 bp, Homo sapiens
gtacagtaggataagcc

SEQ ID NO: 5499113 - DNA, 20 bp, Homo sapiens
gtacagtatattcttgtaaa

SEQ ID NO: 5499114 - DNA, 21 bp, Homo sapiens
gtacagtatgggggttgtaaa

SEQ ID NO: 5499115 - DNA, 23 bp, Homo sapiens
gtacagtatgggggttgtaaatt

SEQ ID NO: 5499116 - DNA, 24 bp, Homo sapiens
gtacagtatgggggttgtaaattg

SEQ ID NO: 5499117 - DNA, 15 bp, Homo sapiens
gtacagtattctttt

SEQ ID NO: 5499118 - DNA, 16 bp, Homo sapiens
gtacagtatttacctt

SEQ ID NO: 5499119 - DNA, 16 bp, Homo sapiens
gtacagtctcaatttt

SEQ ID NO: 5499120 - DNA, 17 bp, Homo sapiens
gtacagtctcaattttg

SEQ ID NO: 5499121 - DNA, 21 bp, Homo sapiens
gtacagtctgtcttctgtata

SEQ ID NO: 5499122 - DNA, 13 bp, Homo sapiens
gtacagtcttgta

SEQ ID NO: 5499123 - DNA, 22 bp, Homo sapiens
gtacagtgaacaaatgtcttaa

SEQ ID NO: 5499124 - DNA, 18 bp, Homo sapiens
gtacagtgaattgtcttt

SEQ ID NO: 5499125 - DNA, 22 bp, Homo sapiens
gtacagtgaattgtcttttaga

SEQ ID NO: 5499126 - DNA, 18 bp, Homo sapiens
gtacagtgaggagggtgg

SEQ ID NO: 5499127 - DNA, 20 bp, Homo sapiens
gtacagtggtgccatcattg

SEQ ID NO: 5499128 - DNA, 13 bp, Homo sapiens
gtacagtgtcaga

SEQ ID NO: 5499129 - DNA, 16 bp, Homo sapiens
gtacagtgtgtaaagt

SEQ ID NO: 5499130 - DNA, 17 bp, Homo sapiens
gtacagttatcagggat

SEQ ID NO: 5499131 - DNA, 23 bp, Homo sapiens
gtacagttcttcgggaagagagg

SEQ ID NO: 5499132 - DNA, 17 bp, Homo sapiens
gtacagttgagctcagg

SEQ ID NO: 5499133 - DNA, 18 bp, Homo sapiens
gtacagttgagctcaggt

SEQ ID NO: 5499134 - DNA, 15 bp, Homo sapiens
gtacagttgcaggag

SEQ ID NO: 5499135 - DNA, 23 bp, Homo sapiens
gtacagttgctgttgtgtgatca

SEQ ID NO: 5499136 - DNA, 14 bp, Homo sapiens
gtacagtttgctgt

SEQ ID NO: 5499137 - DNA, 16 bp, Homo sapiens
gtacagtttgctgtac

SEQ ID NO: 5499138 - DNA, 16 bp, Homo sapiens
gtacagtttgtttaca

SEQ ID NO: 5499139 - DNA, 16 bp, Homo sapiens
gtacataaaagaattt

SEQ ID NO: 5499140 - DNA, 13 bp, Homo sapiens
gtacataaaattt

SEQ ID NO: 5499141 - DNA, 15 bp, Homo sapiens
gtacataaacaatga

SEQ ID NO: 5499142 - DNA, 21 bp, Homo sapiens
gtacataaagtaataactgtt

SEQ ID NO: 5499143 - DNA, 18 bp, Homo sapiens
gtacataaagtcatcaaa

SEQ ID NO: 5499144 - DNA, 23 bp, Homo sapiens
gtacataaataagaaaaaccaaa

SEQ ID NO: 5499145 - DNA, 21 bp, Homo sapiens
gtacataaattgcataaagca

SEQ ID NO: 5499146 - DNA, 17 bp, Homo sapiens
gtacataagcttctcaa

SEQ ID NO: 5499147 - DNA, 14 bp, Homo sapiens
gtacataatactga

SEQ ID NO: 5499148 - DNA, 19 bp, Homo sapiens
gtacataatactgaaccac

SEQ ID NO: 5499149 - DNA, 14 bp, Homo sapiens
gtacataattgatt

SEQ ID NO: 5499150 - DNA, 18 bp, Homo sapiens
gtacataattgcatgaaa

SEQ ID NO: 5499151 - DNA, 15 bp, Homo sapiens
gtacatacattgtat

SEQ ID NO: 5499152 - DNA, 22 bp, Homo sapiens
gtacataccggggctcctctcc

SEQ ID NO: 5499153 - DNA, 17 bp, Homo sapiens
gtacatacgatttaagg

SEQ ID NO: 5499154 - DNA, 18 bp, Homo sapiens
gtacatacggttctgtta

SEQ ID NO: 5499155 - DNA, 21 bp, Homo sapiens
gtacatacggttctgttatac

SEQ ID NO: 5499156 - DNA, 19 bp, Homo sapiens
gtacatactttttgggttt

SEQ ID NO: 5499157 - DNA, 14 bp, Homo sapiens
gtacataggcttct

SEQ ID NO: 5499158 - DNA, 21 bp, Homo sapiens
gtacataggcttctattacct

SEQ ID NO: 5499159 - DNA, 12 bp, Homo sapiens
gtacatagtaaa

SEQ ID NO: 5499160 - DNA, 14 bp, Homo sapiens
gtacatagtccttt

SEQ ID NO: 5499161 - DNA, 18 bp, Homo sapiens
gtacatagtgaattttaa

SEQ ID NO: 5499162 - DNA, 23 bp, Homo sapiens
gtacatagtgaattttaaaatgt

SEQ ID NO: 5499163 - DNA, 15 bp, Homo sapiens
gtacatatatgtata

SEQ ID NO: 5499164 - DNA, 19 bp, Homo sapiens
gtacatatggaaatcctgt

SEQ ID NO: 5499165 - DNA, 16 bp, Homo sapiens
gtacatatgtgctgga

SEQ ID NO: 5499166 - DNA, 22 bp, Homo sapiens
gtacatattatcatcctataaa

SEQ ID NO: 5499167 - DNA, 23 bp, Homo sapiens
gtacatattgttagggtcagcca

SEQ ID NO: 5499168 - DNA, 15 bp, Homo sapiens
gtacatcatgttatt

SEQ ID NO: 5499169 - DNA, 14 bp, Homo sapiens
gtacatcattattg

SEQ ID NO: 5499170 - DNA, 18 bp, Homo sapiens
gtacatcgtttacttttt

SEQ ID NO: 5499171 - DNA, 19 bp, Homo sapiens
gtacatcgtttacttttta

SEQ ID NO: 5499172 - DNA, 20 bp, Homo sapiens
gtacatcgtttactttttaa

SEQ ID NO: 5499173 - DNA, 13 bp, Homo sapiens
gtacatctggctt

SEQ ID NO: 5499174 - DNA, 19 bp, Homo sapiens
gtacatctggcttatttta

SEQ ID NO: 5499175 - DNA, 21 bp, Homo sapiens
gtacatctggcttattttaat

SEQ ID NO: 5499176 - DNA, 22 bp, Homo sapiens
gtacatctggcttattttaatg

SEQ ID NO: 5499177 - DNA, 17 bp, Homo sapiens
gtacatcttgtaagaca

SEQ ID NO: 5499178 - DNA, 17 bp, Homo sapiens
gtacatctttcatttcg

SEQ ID NO: 5499179 - DNA, 14 bp, Homo sapiens
gtacatgaaaacac

SEQ ID NO: 5499180 - DNA, 14 bp, Homo sapiens
gtacatgaaagtag

SEQ ID NO: 5499181 - DNA, 14 bp, Homo sapiens
gtacatgaagaatg

SEQ ID NO: 5499182 - DNA, 17 bp, Homo sapiens
gtacatgataagacatt

SEQ ID NO: 5499183 - DNA, 22 bp, Homo sapiens
gtacatgcctgtaatcccagct

SEQ ID NO: 5499184 - DNA, 20 bp, Homo sapiens
gtacatggaagaagtatatt

SEQ ID NO: 5499185 - DNA, 19 bp, Homo sapiens
gtacatggaataacatgta

SEQ ID NO: 5499186 - DNA, 15 bp, Homo sapiens
gtacatggaattttt

SEQ ID NO: 5499187 - DNA, 12 bp, Homo sapiens
gtacatggagct

SEQ ID NO: 5499188 - DNA, 13 bp, Homo sapiens
gtacatggaggaa

SEQ ID NO: 5499189 - DNA, 16 bp, Homo sapiens
gtacatggcccgcagt

SEQ ID NO: 5499190 - DNA, 22 bp, Homo sapiens
gtacatgggactatgcttttct

SEQ ID NO: 5499191 - DNA, 19 bp, Homo sapiens
gtacatgggactgattctg

SEQ ID NO: 5499192 - DNA, 15 bp, Homo sapiens
gtacatgggtgacta

SEQ ID NO: 5499193 - DNA, 17 bp, Homo sapiens
gtacatggtgctgggag

SEQ ID NO: 5499194 - DNA, 14 bp, Homo sapiens
gtacatgtgtgcag

SEQ ID NO: 5499195 - DNA, 15 bp, Homo sapiens
gtacattaaatacca

SEQ ID NO: 5499196 - DNA, 13 bp, Homo sapiens
gtacattacagat

SEQ ID NO: 5499197 - DNA, 19 bp, Homo sapiens
gtacattacagattaaaga

SEQ ID NO: 5499198 - DNA, 22 bp, Homo sapiens
gtacattacagattaaagaaga

SEQ ID NO: 5499199 - DNA, 21 bp, Homo sapiens
gtacattataaaccttcagaa

SEQ ID NO: 5499200 - DNA, 18 bp, Homo sapiens
gtacattcctgatactgg

SEQ ID NO: 5499201 - DNA, 12 bp, Homo sapiens
gtacattctgcc

SEQ ID NO: 5499202 - DNA, 14 bp, Homo sapiens
gtacattctgccta

SEQ ID NO: 5499203 - DNA, 22 bp, Homo sapiens
gtacattcttccatcatcactg

SEQ ID NO: 5499204 - DNA, 17 bp, Homo sapiens
gtacattgaaggcctgg

SEQ ID NO: 5499205 - DNA, 21 bp, Homo sapiens
gtacattgagcaaataaactt

SEQ ID NO: 5499206 - DNA, 20 bp, Homo sapiens
gtacattggtctttctacat

SEQ ID NO: 5499207 - DNA, 13 bp, Homo sapiens
gtacattgtaaaa

SEQ ID NO: 5499208 - DNA, 14 bp, Homo sapiens
gtacattgtgccct

SEQ ID NO: 5499209 - DNA, 15 bp, Homo sapiens
gtacattgtgccctt

SEQ ID NO: 5499210 - DNA, 17 bp, Homo sapiens
gtacatttaattgagaa

SEQ ID NO: 5499211 - DNA, 14 bp, Homo sapiens
gtacatttatgatt

SEQ ID NO: 5499212 - DNA, 21 bp, Homo sapiens
gtacatttatgatttaataaa

SEQ ID NO: 5499213 - DNA, 13 bp, Homo sapiens
gtacatttattca

SEQ ID NO: 5499214 - DNA, 18 bp, Homo sapiens
gtacatttatttattact

SEQ ID NO: 5499215 - DNA, 14 bp, Homo sapiens
gtacatttccctgt

SEQ ID NO: 5499216 - DNA, 14 bp, Homo sapiens
gtacatttctataa

SEQ ID NO: 5499217 - DNA, 21 bp, Homo sapiens
gtacatttctataaatagatg

SEQ ID NO: 5499218 - DNA, 15 bp, Homo sapiens
gtacatttctcaggc

SEQ ID NO: 5499219 - DNA, 13 bp, Homo sapiens
gtacatttctgaa

SEQ ID NO: 5499220 - DNA, 16 bp, Homo sapiens
gtacatttggaacagt

SEQ ID NO: 5499221 - DNA, 13 bp, Homo sapiens
gtacattttcata

SEQ ID NO: 5499222 - DNA, 18 bp, Homo sapiens
gtacattttcatatgctt

SEQ ID NO: 5499223 - DNA, 21 bp, Homo sapiens
gtacttggtccaactgcaact

SEQ ID NO: 5499224 - DNA, 21 bp, Homo sapiens
gtacttggttgggtcagattt

SEQ ID NO: 5499225 - DNA, 22 bp, Homo sapiens
gtacttggttgggtcagattta

SEQ ID NO: 5499226 - DNA, 22 bp, Homo sapiens
gtacttggtttttttttttctt

SEQ ID NO: 5499227 - DNA, 12 bp, Homo sapiens
gtacttgtagtt

SEQ ID NO: 5499228 - DNA, 14 bp, Homo sapiens
gtacttgtcaaaga

SEQ ID NO: 5499229 - DNA, 16 bp, Homo sapiens
gtacttgtcaaagaag

SEQ ID NO: 5499230 - DNA, 17 bp, Homo sapiens
gtacttgtcaaagaagg

SEQ ID NO: 5499231 - DNA, 17 bp, Homo sapiens
gtacttgtcatatgtag

SEQ ID NO: 5499232 - DNA, 19 bp, Homo sapiens
gtacttgtcatatgtagcc

SEQ ID NO: 5499233 - DNA, 17 bp, Homo sapiens
gtacttgtcctcagctt

SEQ ID NO: 5499234 - DNA, 20 bp, Homo sapiens
gtacttgtttcatctggttt

SEQ ID NO: 5499235 - DNA, 15 bp, Homo sapiens
gtactttactgggct

SEQ ID NO: 5499236 - DNA, 21 bp, Homo sapiens
gtactttataaccaaagcaat

SEQ ID NO: 5499237 - DNA, 17 bp, Homo sapiens
gtactttatatcttgtt

SEQ ID NO: 5499238 - DNA, 14 bp, Homo sapiens
gtactttattcttg

SEQ ID NO: 5499239 - DNA, 19 bp, Homo sapiens
gtactttatttttctgata

SEQ ID NO: 5499240 - DNA, 21 bp, Homo sapiens
gtactttatttttctgataga

SEQ ID NO: 5499241 - DNA, 18 bp, Homo sapiens
gtactttatttttgtata

SEQ ID NO: 5499242 - DNA, 22 bp, Homo sapiens
gtactttcatattttaaacaga

SEQ ID NO: 5499243 - DNA, 19 bp, Homo sapiens
gtactttcattccctttca

SEQ ID NO: 5499244 - DNA, 14 bp, Homo sapiens
gtactttcccaggt

SEQ ID NO: 5499245 - DNA, 20 bp, Homo sapiens
gtactttccttattggcaac

SEQ ID NO: 5499246 - DNA, 13 bp, Homo sapiens
gtactttctgaaa

SEQ ID NO: 5499247 - DNA, 15 bp, Homo sapiens
gtactttctgaaaat

SEQ ID NO: 5499248 - DNA, 22 bp, Homo sapiens
gtactttctgaaaatttatata

SEQ ID NO: 5499249 - DNA, 23 bp, Homo sapiens
gtactttctgaaaatttatataa

SEQ ID NO: 5499250 - DNA, 20 bp, Homo sapiens
gtactttctgtactaaacat

SEQ ID NO: 5499251 - DNA, 12 bp, Homo sapiens
gtactttctgtt

SEQ ID NO: 5499252 - DNA, 13 bp, Homo sapiens
gtactttctgtta

SEQ ID NO: 5499253 - DNA, 18 bp, Homo sapiens
gtactttctgttaaaatg

SEQ ID NO: 5499254 - DNA, 21 bp, Homo sapiens
gtactttctgttaaaatgcat

SEQ ID NO: 5499255 - DNA, 17 bp, Homo sapiens
gtactttgattcacatg

SEQ ID NO: 5499256 - DNA, 20 bp, Homo sapiens
gtactttgattcacatgttt

SEQ ID NO: 5499257 - DNA, 19 bp, Homo sapiens
gtactttggaaagccaagg

SEQ ID NO: 5499258 - DNA, 22 bp, Homo sapiens
gtactttgtgtttagctacctt

SEQ ID NO: 5499259 - DNA, 22 bp, Homo sapiens
gtactttgtttttccatgtgtt

SEQ ID NO: 5499260 - DNA, 11 bp, Homo sapiens
gtacttttaac

SEQ ID NO: 5499261 - DNA, 20 bp, Homo sapiens
gtacttttatgatgtatatt

SEQ ID NO: 5499262 - DNA, 23 bp, Homo sapiens
gtacttttattttacacagaaac

SEQ ID NO: 5499263 - DNA, 12 bp, Homo sapiens
gtacttttccat

SEQ ID NO: 5499264 - DNA, 21 bp, Homo sapiens
gtacttttcccatttgtaatt

SEQ ID NO: 5499265 - DNA, 17 bp, Homo sapiens
gtacttttctggttcca

SEQ ID NO: 5499266 - DNA, 18 bp, Homo sapiens
gtacttttgagtgtgtgt

SEQ ID NO: 5499267 - DNA, 22 bp, Homo sapiens
gtacttttgagtgtgtgtgtgc

SEQ ID NO: 5499268 - DNA, 19 bp, Homo sapiens
gtacttttggcatgaaagt

SEQ ID NO: 5499269 - DNA, 15 bp, Homo sapiens
gtactttttattgca

SEQ ID NO: 5499270 - DNA, 12 bp, Homo sapiens
gtactttttggc

SEQ ID NO: 5499271 - DNA, 21 bp, Homo sapiens
gtactttttggcataacataa

SEQ ID NO: 5499272 - DNA, 21 bp, Homo sapiens
gtacttttttcaaatattgaa

SEQ ID NO: 5499273 - DNA, 11 bp, Homo sapiens
gtagaaaaaaa

SEQ ID NO: 5499274 - DNA, 20 bp, Homo sapiens
gtagaaaaaaaaacagctct

SEQ ID NO: 5499275 - DNA, 18 bp, Homo sapiens
gtagaaaaaaaaataaca

SEQ ID NO: 5499276 - DNA, 13 bp, Homo sapiens
gtagaaaaattat

SEQ ID NO: 5499277 - DNA, 14 bp, Homo sapiens
gtagaaaactccag

SEQ ID NO: 5499278 - DNA, 16 bp, Homo sapiens
gtagaaaagaaaacat

SEQ ID NO: 5499279 - DNA, 18 bp, Homo sapiens
gtagaaaagaactggaaa

SEQ ID NO: 5499280 - DNA, 19 bp, Homo sapiens
gtagaaaatacattattag

SEQ ID NO: 5499281 - DNA, 19 bp, Homo sapiens
gtagaaaatgcaccaaata

SEQ ID NO: 5499282 - DNA, 13 bp, Homo sapiens
gtagaaaatgttt

SEQ ID NO: 5499283 - DNA, 16 bp, Homo sapiens
gtagaaaatttgcttt

SEQ ID NO: 5499284 - DNA, 22 bp, Homo sapiens
gtagaaacaaagggttttcttt

SEQ ID NO: 5499285 - DNA, 12 bp, Homo sapiens
gtagaaacattg

SEQ ID NO: 5499286 - DNA, 18 bp, Homo sapiens
gtagaaactgaggcccag

SEQ ID NO: 5499287 - DNA, 19 bp, Homo sapiens
gtagaaactgcagggaaaa

SEQ ID NO: 5499288 - DNA, 21 bp, Homo sapiens
gtagaaactggaagctgttca

SEQ ID NO: 5499289 - DNA, 15 bp, Homo sapiens
gtagaaacttaaaca

SEQ ID NO: 5499290 - DNA, 16 bp, Homo sapiens
gtagaaactttggaag

SEQ ID NO: 5499291 - DNA, 13 bp, Homo sapiens
gtagaaagaaaat

SEQ ID NO: 5499292 - DNA, 22 bp, Homo sapiens
gtagaaagacatctgcctgtaa

SEQ ID NO: 5499293 - DNA, 23 bp, Homo sapiens
gtagaaagatccttcgggtgctg

SEQ ID NO: 5499294 - DNA, 12 bp, Homo sapiens
gtagaaagcaaa

SEQ ID NO: 5499295 - DNA, 13 bp, Homo sapiens
gtagaaagctaaa

SEQ ID NO: 5499296 - DNA, 18 bp, Homo sapiens
gtagaaagctaatacaaa

SEQ ID NO: 5499297 - DNA, 14 bp, Homo sapiens
gtagaaaggaaata

SEQ ID NO: 5499298 - DNA, 21 bp, Homo sapiens
gtagaaaggaagccttgctca

SEQ ID NO: 5499299 - DNA, 14 bp, Homo sapiens
gtagaaaggccttt

SEQ ID NO: 5499300 - DNA, 16 bp, Homo sapiens
gtagaaaggcctttaa

SEQ ID NO: 5499301 - DNA, 16 bp, Homo sapiens
gtagaaagtggaaagg

SEQ ID NO: 5499302 - DNA, 16 bp, Homo sapiens
gtagaaataatatgca

SEQ ID NO: 5499303 - DNA, 21 bp, Homo sapiens
gtagaaatatctgaaaatgta

SEQ ID NO: 5499304 - DNA, 11 bp, Homo sapiens
gtagaaatctg

SEQ ID NO: 5499305 - DNA, 14 bp, Homo sapiens
gtagaaatgatgat

SEQ ID NO: 5499306 - DNA, 22 bp, Homo sapiens
gtagaaattaaacatattcaag

SEQ ID NO: 5499307 - DNA, 13 bp, Homo sapiens
gtagaaattctaa

SEQ ID NO: 5499308 - DNA, 18 bp, Homo sapiens
gtagaaattgttcctgat

SEQ ID NO: 5499309 - DNA, 23 bp, Homo sapiens
gtagaaattttacaataggtgct

SEQ ID NO: 5499310 - DNA, 20 bp, Homo sapiens
gtagaaattttatctcttct

SEQ ID NO: 5499311 - DNA, 14 bp, Homo sapiens
gtagaacaaaaaac

SEQ ID NO: 5499312 - DNA, 15 bp, Homo sapiens
gtagaacactaattc

SEQ ID NO: 5499313 - DNA, 18 bp, Homo sapiens
gtagaacactaattcata

SEQ ID NO: 5499314 - DNA, 22 bp, Homo sapiens
gtagaaccacttggctgctcat

SEQ ID NO: 5499315 - DNA, 13 bp, Homo sapiens
gtagaacccaggt

SEQ ID NO: 5499316 - DNA, 16 bp, Homo sapiens
gtagaacgccagggac

SEQ ID NO: 5499317 - DNA, 18 bp, Homo sapiens
gtagaacgtaaccacgga

SEQ ID NO: 5499318 - DNA, 17 bp, Homo sapiens
gtagaactcactctggg

SEQ ID NO: 5499319 - DNA, 21 bp, Homo sapiens
gtagaactcactctgggctgt

SEQ ID NO: 5499320 - DNA, 15 bp, Homo sapiens
gtagaactcagcagt

SEQ ID NO: 5499321 - DNA, 17 bp, Homo sapiens
gtagaacttactattca

SEQ ID NO: 5499322 - DNA, 20 bp, Homo sapiens
gtagaacttgttgctgattt

SEQ ID NO: 5499323 - DNA, 14 bp, Homo sapiens
gtagaactttgtat

SEQ ID NO: 5499324 - DNA, 15 bp, Homo sapiens
gtagaactttgtata

SEQ ID NO: 5499325 - DNA, 17 bp, Homo sapiens
gtagaagaaaatttaat

SEQ ID NO: 5499326 - DNA, 20 bp, Homo sapiens
gtagaagaaaatttaattat

SEQ ID NO: 5499327 - DNA, 14 bp, Homo sapiens
gtagaagaaagcaa

SEQ ID NO: 5499328 - DNA, 14 bp, Homo sapiens
gtagaagagggaga

SEQ ID NO: 5499329 - DNA, 13 bp, Homo sapiens
gtagaagagggat

SEQ ID NO: 5499330 - DNA, 22 bp, Homo sapiens
gtagaagatggactctgaaaaa

SEQ ID NO: 5499331 - DNA, 15 bp, Homo sapiens
gtagaagcattcctt

SEQ ID NO: 5499332 - DNA, 17 bp, Homo sapiens
gtagaagccacccttcc

SEQ ID NO: 5499333 - DNA, 13 bp, Homo sapiens
gtagaaggagaca

SEQ ID NO: 5499334 - DNA, 17 bp, Homo sapiens
gtagaagggttatattt

SEQ ID NO: 5499335 - DNA, 15 bp, Homo sapiens
gtagaagtttttgta

SEQ ID NO: 5499336 - DNA, 11 bp, Homo sapiens
gtagaatattc

SEQ ID NO: 5499337 - DNA, 17 bp, Homo sapiens
gtagaatctcttttctg

SEQ ID NO: 5499338 - DNA, 20 bp, Homo sapiens
gtagaatgaccttgtaatgt

SEQ ID NO: 5499339 - DNA, 17 bp, Homo sapiens
gtagaatgtattgtacc

SEQ ID NO: 5499340 - DNA, 14 bp, Homo sapiens
gtagaatgttttca

SEQ ID NO: 5499341 - DNA, 22 bp, Homo sapiens
gtagaattaccattaattacat

SEQ ID NO: 5499342 - DNA, 16 bp, Homo sapiens
gtagaattatatctaa

SEQ ID NO: 5499343 - DNA, 23 bp, Homo sapiens
gtagaattccttcgaaaggcctt

SEQ ID NO: 5499344 - DNA, 22 bp, Homo sapiens
gtagaatttcaatgtccagtga

SEQ ID NO: 5499345 - DNA, 19 bp, Homo sapiens
gtagaattttagtcctgaa

SEQ ID NO: 5499346 - DNA, 21 bp, Homo sapiens
gtagaatttttaaaaaagtga

SEQ ID NO: 5499347 - DNA, 18 bp, Homo sapiens
gtagacaatcattgtttt

SEQ ID NO: 5499348 - DNA, 17 bp, Homo sapiens
gtagacaatttgcctta

SEQ ID NO: 5499349 - DNA, 14 bp, Homo sapiens
gtagacacaggtca

SEQ ID NO: 5499350 - DNA, 15 bp, Homo sapiens
gtagacacaggtcac

SEQ ID NO: 5499351 - DNA, 18 bp, Homo sapiens
gtagacacgctcttctat

SEQ ID NO: 5499352 - DNA, 17 bp, Homo sapiens
gtagacactaattctgt

SEQ ID NO: 5499353 - DNA, 20 bp, Homo sapiens
gtagacactctgacaagctg

SEQ ID NO: 5499354 - DNA, 13 bp, Homo sapiens
gtagacagttttg

SEQ ID NO: 5499355 - DNA, 14 bp, Homo sapiens
gtagacataaagaa

SEQ ID NO: 5499356 - DNA, 22 bp, Homo sapiens
gtagacattttaacaagaagat

SEQ ID NO: 5499357 - DNA, 15 bp, Homo sapiens
gtagacattttgaaa

SEQ ID NO: 5499358 - DNA, 19 bp, Homo sapiens
gtagaccaggtgctcagcc

SEQ ID NO: 5499359 - DNA, 23 bp, Homo sapiens
gtagaccttgagggtgggccagc

SEQ ID NO: 5499360 - DNA, 19 bp, Homo sapiens
gtagaccttgttacttctg

SEQ ID NO: 5499361 - DNA, 20 bp, Homo sapiens
gtagaccttgttacttctga

SEQ ID NO: 5499362 - DNA, 23 bp, Homo sapiens
gtagacctttctccctccttcct

SEQ ID NO: 5499363 - DNA, 15 bp, Homo sapiens
gtagacggaacagtg

SEQ ID NO: 5499364 - DNA, 14 bp, Homo sapiens
gtagactactgttc

SEQ ID NO: 5499365 - DNA, 17 bp, Homo sapiens
gtagactaggtttattt

SEQ ID NO: 5499366 - DNA, 15 bp, Homo sapiens
gtagactatatacat

SEQ ID NO: 5499367 - DNA, 14 bp, Homo sapiens
gtagactcctgctt

SEQ ID NO: 5499368 - DNA, 21 bp, Homo sapiens
gtagactcctgcttcttcaag

SEQ ID NO: 5499369 - DNA, 18 bp, Homo sapiens
gtagactctaagatacac

SEQ ID NO: 5499370 - DNA, 13 bp, Homo sapiens
gtagactgtgaca

SEQ ID NO: 5499371 - DNA, 17 bp, Homo sapiens
gtagactgtttcacatt

SEQ ID NO: 5499372 - DNA, 15 bp, Homo sapiens
gtagacttggagctg

SEQ ID NO: 5499373 - DNA, 13 bp, Homo sapiens
gtagactttgctt

SEQ ID NO: 5499374 - DNA, 22 bp, Homo sapiens
gtagagaaaataagacttctgg

SEQ ID NO: 5499375 - DNA, 15 bp, Homo sapiens
gtagagacagagttt

SEQ ID NO: 5499376 - DNA, 23 bp, Homo sapiens
gtagagacagggtttcaccatgt

SEQ ID NO: 5499377 - DNA, 15 bp, Homo sapiens
gtagagacagtgttt

SEQ ID NO: 5499378 - DNA, 21 bp, Homo sapiens
gtagagacgggttcaccatgt

SEQ ID NO: 5499379 - DNA, 18 bp, Homo sapiens
gtagagactagggaaggg

SEQ ID NO: 5499380 - DNA, 18 bp, Homo sapiens
gtagagagcaaagatggc

SEQ ID NO: 5499381 - DNA, 14 bp, Homo sapiens
gtagagagccgggc

SEQ ID NO: 5499382 - DNA, 14 bp, Homo sapiens
gtagagaggcccgc

SEQ ID NO: 5499383 - DNA, 17 bp, Homo sapiens
gtagagatggaggagga

SEQ ID NO: 5499384 - DNA, 14 bp, Homo sapiens
gtagagatgtgtgt

SEQ ID NO: 5499385 - DNA, 14 bp, Homo sapiens
gtagagcaaaacta

SEQ ID NO: 5499386 - DNA, 16 bp, Homo sapiens
gtagagcaaaactata

SEQ ID NO: 5499387 - DNA, 15 bp, Homo sapiens
gtagagccagaggtc

SEQ ID NO: 5499388 - DNA, 15 bp, Homo sapiens
gtagagccagccttg

SEQ ID NO: 5499389 - DNA, 12 bp, Homo sapiens
gtagagccagct

SEQ ID NO: 5499390 - DNA, 18 bp, Homo sapiens
gtagagcccctactgtgg

SEQ ID NO: 5499391 - DNA, 21 bp, Homo sapiens
gtagagcccctactgtgggca

SEQ ID NO: 5499392 - DNA, 14 bp, Homo sapiens
gtagagccctccac

SEQ ID NO: 5499393 - DNA, 16 bp, Homo sapiens
gtagagcggagaaagg

SEQ ID NO: 5499394 - DNA, 11 bp, Homo sapiens
gtagagctggg

SEQ ID NO: 5499395 - DNA, 15 bp, Homo sapiens
gtagaggaaaatcaa

SEQ ID NO: 5499396 - DNA, 17 bp, Homo sapiens
gtagaggagcagggtct

SEQ ID NO: 5499397 - DNA, 23 bp, Homo sapiens
gtagaggcatgaacacacatgga

SEQ ID NO: 5499398 - DNA, 22 bp, Homo sapiens
gtagaggcatttgtcttagaga

SEQ ID NO: 5499399 - DNA, 15 bp, Homo sapiens
gtagaggtataattg

SEQ ID NO: 5499400 - DNA, 15 bp, Homo sapiens
gtagaggtggcttca

SEQ ID NO: 5499401 - DNA, 22 bp, Homo sapiens
gtagctatagttgcagcccaag

SEQ ID NO: 5499402 - DNA, 13 bp, Homo sapiens
gtagctatatcta

SEQ ID NO: 5499403 - DNA, 20 bp, Homo sapiens
gtagctattagcggctcctc

SEQ ID NO: 5499404 - DNA, 14 bp, Homo sapiens
gtagctattctttg

SEQ ID NO: 5499405 - DNA, 12 bp, Homo sapiens
gtagctattttt

SEQ ID NO: 5499406 - DNA, 17 bp, Homo sapiens
gtagctatttttataca

SEQ ID NO: 5499407 - DNA, 19 bp, Homo sapiens
gtagctatttttatacact

SEQ ID NO: 5499408 - DNA, 12 bp, Homo sapiens
gtagctcaggtg

SEQ ID NO: 5499409 - DNA, 14 bp, Homo sapiens
gtagctcaggtggg

SEQ ID NO: 5499410 - DNA, 20 bp, Homo sapiens
gtagctccagcgatggtgct

SEQ ID NO: 5499411 - DNA, 15 bp, Homo sapiens
gtagctccctcctcc

SEQ ID NO: 5499412 - DNA, 18 bp, Homo sapiens
gtagctccctcctcccat

SEQ ID NO: 5499413 - DNA, 21 bp, Homo sapiens
gtagctccctcctcccatctc

SEQ ID NO: 5499414 - DNA, 19 bp, Homo sapiens
gtagctcctcccctggagg

SEQ ID NO: 5499415 - DNA, 12 bp, Homo sapiens
gtagctcctgga

SEQ ID NO: 5499416 - DNA, 17 bp, Homo sapiens
gtagctcgtgtgcttag

SEQ ID NO: 5499417 - DNA, 14 bp, Homo sapiens
gtagctctgagccc

SEQ ID NO: 5499418 - DNA, 12 bp, Homo sapiens
gtagctctgctg

SEQ ID NO: 5499419 - DNA, 13 bp, Homo sapiens
gtagctctgctgc

SEQ ID NO: 5499420 - DNA, 20 bp, Homo sapiens
gtagctctttgtcagggagt

SEQ ID NO: 5499421 - DNA, 14 bp, Homo sapiens
gtagctgagaggaa

SEQ ID NO: 5499422 - DNA, 15 bp, Homo sapiens
gtagctgagaggaag

SEQ ID NO: 5499423 - DNA, 16 bp, Homo sapiens
gtagctgagaggaaga

SEQ ID NO: 5499424 - DNA, 22 bp, Homo sapiens
gtagctgagctcacaaggcagc

SEQ ID NO: 5499425 - DNA, 16 bp, Homo sapiens
gtagctgagctgtgac

SEQ ID NO: 5499426 - DNA, 17 bp, Homo sapiens
gtagctgagctgtgaca

SEQ ID NO: 5499427 - DNA, 18 bp, Homo sapiens
gtagctgataaagaaacc

SEQ ID NO: 5499428 - DNA, 19 bp, Homo sapiens
gtagctgccaaaaagaaca

SEQ ID NO: 5499429 - DNA, 14 bp, Homo sapiens
gtagctgccacttg

SEQ ID NO: 5499430 - DNA, 15 bp, Homo sapiens
gtagctgcccctggc

SEQ ID NO: 5499431 - DNA, 16 bp, Homo sapiens
gtagctgcccctggct

SEQ ID NO: 5499432 - DNA, 10 bp, Homo sapiens
gtagctgcga

SEQ ID NO: 5499433 - DNA, 13 bp, Homo sapiens
gtagctgctacct

SEQ ID NO: 5499434 - DNA, 16 bp, Homo sapiens
gtagctgcttcctgga

SEQ ID NO: 5499435 - DNA, 23 bp, Homo sapiens
gtagctggcaagctgcaaaaggc

SEQ ID NO: 5499436 - DNA, 22 bp, Homo sapiens
gtagctgggaaagcataaagct

SEQ ID NO: 5499437 - DNA, 18 bp, Homo sapiens
gtagctgggactacaggc

SEQ ID NO: 5499438 - DNA, 19 bp, Homo sapiens
gtagctgggactacaggca

SEQ ID NO: 5499439 - DNA, 20 bp, Homo sapiens
gtagctgggactagaggcac

SEQ ID NO: 5499440 - DNA, 18 bp, Homo sapiens
gtagctgggattacaggc

SEQ ID NO: 5499441 - DNA, 21 bp, Homo sapiens
gtagctgggattacaggcgca

SEQ ID NO: 5499442 - DNA, 17 bp, Homo sapiens
gtagctgggattttaaa

SEQ ID NO: 5499443 - DNA, 15 bp, Homo sapiens
gtagctgggcctgtg

SEQ ID NO: 5499444 - DNA, 17 bp, Homo sapiens
gtagctgggcctgtgca

SEQ ID NO: 5499445 - DNA, 16 bp, Homo sapiens
gtagctggggagccct

SEQ ID NO: 5499446 - DNA, 12 bp, Homo sapiens
gtagctggggct

SEQ ID NO: 5499447 - DNA, 23 bp, Homo sapiens
gtagctggggctttgatgttcct

SEQ ID NO: 5499448 - DNA, 15 bp, Homo sapiens
gtagctgtaagggca

SEQ ID NO: 5499449 - DNA, 16 bp, Homo sapiens
gtagctgtaagggcag

SEQ ID NO: 5499450 - DNA, 12 bp, Homo sapiens
gtagctgtcctc

SEQ ID NO: 5499451 - DNA, 16 bp, Homo sapiens
gtagctgtcgtacatt

SEQ ID NO: 5499452 - DNA, 22 bp, Homo sapiens
gtagctgtctaacccccagctg

SEQ ID NO: 5499453 - DNA, 20 bp, Homo sapiens
gtagctgtgacctgctgagc

SEQ ID NO: 5499454 - DNA, 19 bp, Homo sapiens
gtagctgtggggagctggt

SEQ ID NO: 5499455 - DNA, 18 bp, Homo sapiens
gtagctgtggtgaggtgg

SEQ ID NO: 5499456 - DNA, 15 bp, Homo sapiens
gtagcttaagaaaaa

SEQ ID NO: 5499457 - DNA, 13 bp, Homo sapiens
gtagcttatattt

SEQ ID NO: 5499458 - DNA, 17 bp, Homo sapiens
gtagcttatctgcccct

SEQ ID NO: 5499459 - DNA, 15 bp, Homo sapiens
gtagcttcagccagg

SEQ ID NO: 5499460 - DNA, 16 bp, Homo sapiens
gtagcttcagtcatta

SEQ ID NO: 5499461 - DNA, 16 bp, Homo sapiens
gtagcttccacctcat

SEQ ID NO: 5499462 - DNA, 19 bp, Homo sapiens
gtagcttccacctcatgga

SEQ ID NO: 5499463 - DNA, 21 bp, Homo sapiens
gtagcttgaaattgattaact

SEQ ID NO: 5499464 - DNA, 18 bp, Homo sapiens
gtagcttgtatcaaatgt

SEQ ID NO: 5499465 - DNA, 22 bp, Homo sapiens
gtagctttaaaaccacagctgg

SEQ ID NO: 5499466 - DNA, 16 bp, Homo sapiens
gtagctttatccttag

SEQ ID NO: 5499467 - DNA, 19 bp, Homo sapiens
gtagctttgggcagatttg

SEQ ID NO: 5499468 - DNA, 23 bp, Homo sapiens
gtagctttgggcagatttgcaac

SEQ ID NO: 5499469 - DNA, 21 bp, Homo sapiens
gtagctttttattattttaag

SEQ ID NO: 5499470 - DNA, 14 bp, Homo sapiens
gtaggaaaaaaata

SEQ ID NO: 5499471 - DNA, 15 bp, Homo sapiens
gtaggaaaaaaatag

SEQ ID NO: 5499472 - DNA, 15 bp, Homo sapiens
gtaggaaaagatgta

SEQ ID NO: 5499473 - DNA, 15 bp, Homo sapiens
gtaggaaagaatttg

SEQ ID NO: 5499474 - DNA, 14 bp, Homo sapiens
gtaggaaagggcaa

SEQ ID NO: 5499475 - DNA, 14 bp, Homo sapiens
gtaggaaagggcgc

SEQ ID NO: 5499476 - DNA, 23 bp, Homo sapiens
gtaggaaagtcacccaaacactt

SEQ ID NO: 5499477 - DNA, 19 bp, Homo sapiens
gtaggaaattgattttgaa

SEQ ID NO: 5499478 - DNA, 21 bp, Homo sapiens
gtaggaacaagctggcttctg

SEQ ID NO: 5499479 - DNA, 19 bp, Homo sapiens
gtaggaaccaacaaggaaa

SEQ ID NO: 5499480 - DNA, 21 bp, Homo sapiens
gtaggaacggtaaatttctgt

SEQ ID NO: 5499481 - DNA, 20 bp, Homo sapiens
gtaggaaggctactggcatt

SEQ ID NO: 5499482 - DNA, 18 bp, Homo sapiens
gtaggaaggttaatgttc

SEQ ID NO: 5499483 - DNA, 18 bp, Homo sapiens
gtaggaatattatatttg

SEQ ID NO: 5499484 - DNA, 19 bp, Homo sapiens
gtaggaatattatatttgg

SEQ ID NO: 5499485 - DNA, 21 bp, Homo sapiens
gtaggaatctgccttccagcc

SEQ ID NO: 5499486 - DNA, 19 bp, Homo sapiens
gtaggaccaagcatcttgg

SEQ ID NO: 5499487 - DNA, 15 bp, Homo sapiens
gtaggaccaatgttg

SEQ ID NO: 5499488 - DNA, 15 bp, Homo sapiens
gtaggaccctcgaga

SEQ ID NO: 5499489 - DNA, 15 bp, Homo sapiens
gtaggactgtagaaa

SEQ ID NO: 5499490 - DNA, 22 bp, Homo sapiens
gtaggagacacgacagcacaca

SEQ ID NO: 5499491 - DNA, 19 bp, Homo sapiens
gtaggagactgtttggaaa

SEQ ID NO: 5499492 - DNA, 14 bp, Homo sapiens
gtaggagagactgg

SEQ ID NO: 5499493 - DNA, 15 bp, Homo sapiens
gtaggagagcactgc

SEQ ID NO: 5499494 - DNA, 16 bp, Homo sapiens
gtaggagcaagggcac

SEQ ID NO: 5499495 - DNA, 17 bp, Homo sapiens
gtaggagcccttctctt

SEQ ID NO: 5499496 - DNA, 13 bp, Homo sapiens
gtaggaggaacag

SEQ ID NO: 5499497 - DNA, 17 bp, Homo sapiens
gtaggaggaggcatgga

SEQ ID NO: 5499498 - DNA, 23 bp, Homo sapiens
gtaggagtggctgaccaggccct

SEQ ID NO: 5499499 - DNA, 19 bp, Homo sapiens
gtaggatacttgctccatt

SEQ ID NO: 5499500 - DNA, 17 bp, Homo sapiens
gtaggatctaaggctgt

SEQ ID NO: 5499501 - DNA, 15 bp, Homo sapiens
gtaggatgaaaagat

SEQ ID NO: 5499502 - DNA, 18 bp, Homo sapiens
gtaggatgacaggctctc

SEQ ID NO: 5499503 - DNA, 13 bp, Homo sapiens
gtaggattgctgg

SEQ ID NO: 5499504 - DNA, 13 bp, Homo sapiens
gtaggattgctgt

SEQ ID NO: 5499505 - DNA, 19 bp, Homo sapiens
gtaggattttgagggtggg

SEQ ID NO: 5499506 - DNA, 18 bp, Homo sapiens
gtaggcaagatggcacag

SEQ ID NO: 5499507 - DNA, 15 bp, Homo sapiens
gtaggcaaggctgcc

SEQ ID NO: 5499508 - DNA, 22 bp, Homo sapiens
gtaggcagacacagggacttga

SEQ ID NO: 5499509 - DNA, 23 bp, Homo sapiens
gtaggcagacacagggacttgaa

SEQ ID NO: 5499510 - DNA, 15 bp, Homo sapiens
gtaggcagagccttt

SEQ ID NO: 5499511 - DNA, 15 bp, Homo sapiens
gtaggcagaggctgc

SEQ ID NO: 5499512 - DNA, 22 bp, Homo sapiens
gtaggcagcctgagagtctaga

SEQ ID NO: 5499513 - DNA, 18 bp, Homo sapiens
gtaggcaggattggggaa

SEQ ID NO: 5499514 - DNA, 21 bp, Homo sapiens
gtaggcatcagtatgtcactc

SEQ ID NO: 5499515 - DNA, 23 bp, Homo sapiens
gtaggcatcagtatgtcactctg

SEQ ID NO: 5499516 - DNA, 23 bp, Homo sapiens
gtaggccaagctgaagtgaagga

SEQ ID NO: 5499517 - DNA, 12 bp, Homo sapiens
gtaggccaaggt

SEQ ID NO: 5499518 - DNA, 20 bp, Homo sapiens
gtaggccaaggtgtcctaca

SEQ ID NO: 5499519 - DNA, 22 bp, Homo sapiens
gtaggccaaggtgtcctacaga

SEQ ID NO: 5499520 - DNA, 23 bp, Homo sapiens
gtaggccaaggtgtcctacagaa

SEQ ID NO: 5499521 - DNA, 14 bp, Homo sapiens
gtaggccaggcgtg

SEQ ID NO: 5499522 - DNA, 15 bp, Homo sapiens
gtaggccccacaagg

SEQ ID NO: 5499523 - DNA, 18 bp, Homo sapiens
gtaggcccttgtcctgcc

SEQ ID NO: 5499524 - DNA, 21 bp, Homo sapiens
gtaggcccttgtcctgccagc

SEQ ID NO: 5499525 - DNA, 22 bp, Homo sapiens
gtaggcccttgtcctgccagct

SEQ ID NO: 5499526 - DNA, 23 bp, Homo sapiens
gtaggcccttgtcctgccagctg

SEQ ID NO: 5499527 - DNA, 19 bp, Homo sapiens
gtaggcctggggctatgca

SEQ ID NO: 5499528 - DNA, 20 bp, Homo sapiens
gtaggccttttaacattttg

SEQ ID NO: 5499529 - DNA, 16 bp, Homo sapiens
gtaggctaaaaacatt

SEQ ID NO: 5499530 - DNA, 15 bp, Homo sapiens
gtaggctacagagaa

SEQ ID NO: 5499531 - DNA, 16 bp, Homo sapiens
gtaggctacagagaag

SEQ ID NO: 5499532 - DNA, 21 bp, Homo sapiens
gtaggctacagagaagccttc

SEQ ID NO: 5499533 - DNA, 17 bp, Homo sapiens
gtaggctcaactaggga

SEQ ID NO: 5499534 - DNA, 18 bp, Homo sapiens
gtaggctccagacaggag

SEQ ID NO: 5499535 - DNA, 19 bp, Homo sapiens
gtaggctccagacaggagg

SEQ ID NO: 5499536 - DNA, 16 bp, Homo sapiens
gtaggctgcaaaatta

SEQ ID NO: 5499537 - DNA, 18 bp, Homo sapiens
gtaggctgctccctgagg

SEQ ID NO: 5499538 - DNA, 19 bp, Homo sapiens
gtaggctgctccctgaggg

SEQ ID NO: 5499539 - DNA, 13 bp, Homo sapiens
gtaggctgtattt

SEQ ID NO: 5499540 - DNA, 22 bp, Homo sapiens
gtaggctgtattttcttttata

SEQ ID NO: 5499541 - DNA, 11 bp, Homo sapiens
gtaggctgtgg

SEQ ID NO: 5499542 - DNA, 14 bp, Homo sapiens
gtaggctgtggggt

SEQ ID NO: 5499543 - DNA, 15 bp, Homo sapiens
gtaggcttctacctg

SEQ ID NO: 5499544 - DNA, 17 bp, Homo sapiens
gtagggaaaccttggag

SEQ ID NO: 5499545 - DNA, 23 bp, Homo sapiens
gtagggaacggcctgagaggagc

SEQ ID NO: 5499546 - DNA, 21 bp, Homo sapiens
gtagggaagaaaactatcctg

SEQ ID NO: 5499547 - DNA, 16 bp, Homo sapiens
gtagggagagacacaa

SEQ ID NO: 5499548 - DNA, 13 bp, Homo sapiens
gtagggaggcagc

SEQ ID NO: 5499549 - DNA, 17 bp, Homo sapiens
gtagggagtgaagccac

SEQ ID NO: 5499550 - DNA, 16 bp, Homo sapiens
gtagggatatggcagg

SEQ ID NO: 5499551 - DNA, 15 bp, Homo sapiens
gtagggcaagggtgc

SEQ ID NO: 5499552 - DNA, 15 bp, Homo sapiens
gtagggccagggctc

SEQ ID NO: 5499553 - DNA, 15 bp, Homo sapiens
gtagggccctgacag

SEQ ID NO: 5499554 - DNA, 17 bp, Homo sapiens
gtagggccctgacaggc

SEQ ID NO: 5499555 - DNA, 19 bp, Homo sapiens
gtagggcctgactccttct

SEQ ID NO: 5499556 - DNA, 18 bp, Homo sapiens
gtagggctctgacaaagc

SEQ ID NO: 5499557 - DNA, 16 bp, Homo sapiens
gtagggctggctggag

SEQ ID NO: 5499558 - DNA, 20 bp, Homo sapiens
gtaggggaagtgtgctgagg

SEQ ID NO: 5499559 - DNA, 21 bp, Homo sapiens
gtaggggagagagcagagaag

SEQ ID NO: 5499560 - DNA, 19 bp, Homo sapiens
gtaggggagtgtgggtgat

SEQ ID NO: 5499561 - DNA, 20 bp, Homo sapiens
gtaggggcccctctcagccc

SEQ ID NO: 5499562 - DNA, 17 bp, Homo sapiens
gtaggggctcctgagtg

SEQ ID NO: 5499563 - DNA, 16 bp, Homo sapiens
gtaggggctgggaaca

SEQ ID NO: 5499564 - DNA, 18 bp, Homo sapiens
gtaggggcttagaggcat

SEQ ID NO: 5499565 - DNA, 21 bp, Homo sapiens
gtagggggcctgagttgaggg

SEQ ID NO: 5499566 - DNA, 15 bp, Homo sapiens
gtagggggctctggg

SEQ ID NO: 5499567 - DNA, 21 bp, Homo sapiens
gtaggggggtttcagggctga

SEQ ID NO: 5499568 - DNA, 18 bp, Homo sapiens
gtaggggtaccactgaat

SEQ ID NO: 5499569 - DNA, 22 bp, Homo sapiens
gtagggtaaatcagtaagaggt

SEQ ID NO: 5499570 - DNA, 17 bp, Homo sapiens
gtagggtaaggtgcctt

SEQ ID NO: 5499571 - DNA, 22 bp, Homo sapiens
gtagggtaattagtaacatgtg

SEQ ID NO: 5499572 - DNA, 17 bp, Homo sapiens
gtagggtagtggctggg

SEQ ID NO: 5499573 - DNA, 17 bp, Homo sapiens
gtagggtgagaagggca

SEQ ID NO: 5499574 - DNA, 16 bp, Homo sapiens
gtagggtgaggcgtgg

SEQ ID NO: 5499575 - DNA, 17 bp, Homo sapiens
gtagggtgaggcgtggg

SEQ ID NO: 5499576 - DNA, 19 bp, Homo sapiens
gtagggtgatgagcactca

SEQ ID NO: 5499577 - DNA, 19 bp, Homo sapiens
gtagggttgccagtcctgc

SEQ ID NO: 5499578 - DNA, 12 bp, Homo sapiens
gtataaatatac

SEQ ID NO: 5499579 - DNA, 19 bp, Homo sapiens
gtataaatccaatatcatg

SEQ ID NO: 5499580 - DNA, 17 bp, Homo sapiens
gtataaatctatgatat

SEQ ID NO: 5499581 - DNA, 22 bp, Homo sapiens
gtataaatgacaaagtgttgaa

SEQ ID NO: 5499582 - DNA, 14 bp, Homo sapiens
gtataaatgtacat

SEQ ID NO: 5499583 - DNA, 15 bp, Homo sapiens
gtataaatgtacatc

SEQ ID NO: 5499584 - DNA, 17 bp, Homo sapiens
gtataaatgtatataca

SEQ ID NO: 5499585 - DNA, 19 bp, Homo sapiens
gtataaatgtatatacaca

SEQ ID NO: 5499586 - DNA, 21 bp, Homo sapiens
gtataaattaaataaactgtt

SEQ ID NO: 5499587 - DNA, 22 bp, Homo sapiens
gtataaattaaataaactgttt

SEQ ID NO: 5499588 - DNA, 16 bp, Homo sapiens
gtataaattacatgca

SEQ ID NO: 5499589 - DNA, 20 bp, Homo sapiens
gtataaattatcttatgaaa

SEQ ID NO: 5499590 - DNA, 19 bp, Homo sapiens
gtataaattatgaaggacc

SEQ ID NO: 5499591 - DNA, 14 bp, Homo sapiens
gtataaattattca

SEQ ID NO: 5499592 - DNA, 22 bp, Homo sapiens
gtataaattgtctttaaaaact

SEQ ID NO: 5499593 - DNA, 15 bp, Homo sapiens
gtataacaaactatg

SEQ ID NO: 5499594 - DNA, 20 bp, Homo sapiens
gtataacaactatttacata

SEQ ID NO: 5499595 - DNA, 18 bp, Homo sapiens
gtataacaagccaaacat

SEQ ID NO: 5499596 - DNA, 15 bp, Homo sapiens
gtataacaggttatt

SEQ ID NO: 5499597 - DNA, 20 bp, Homo sapiens
gtataacaggttattttagt

SEQ ID NO: 5499598 - DNA, 22 bp, Homo sapiens
gtataacaggttattttagttt

SEQ ID NO: 5499599 - DNA, 13 bp, Homo sapiens
gtataacatcact

SEQ ID NO: 5499600 - DNA, 15 bp, Homo sapiens
gtataacatcactgt

SEQ ID NO: 5499601 - DNA, 18 bp, Homo sapiens
gtataacattaagaaaat

SEQ ID NO: 5499602 - DNA, 19 bp, Homo sapiens
gtataaccaagtgtgctct

SEQ ID NO: 5499603 - DNA, 21 bp, Homo sapiens
gtataacggtttaattctgtc

SEQ ID NO: 5499604 - DNA, 12 bp, Homo sapiens
gtataactgttc

SEQ ID NO: 5499605 - DNA, 14 bp, Homo sapiens
gtataagaaatgca

SEQ ID NO: 5499606 - DNA, 17 bp, Homo sapiens
gtataagaaattttatt

SEQ ID NO: 5499607 - DNA, 17 bp, Homo sapiens
gtataagcactgaaaaa

SEQ ID NO: 5499608 - DNA, 18 bp, Homo sapiens
gtataagcatgctttctt

SEQ ID NO: 5499609 - DNA, 23 bp, Homo sapiens
gtataagccacttgtcttgaaaa

SEQ ID NO: 5499610 - DNA, 18 bp, Homo sapiens
gtataaggagctttgctc

SEQ ID NO: 5499611 - DNA, 21 bp, Homo sapiens
gtataaggatcttttgtaaat

SEQ ID NO: 5499612 - DNA, 16 bp, Homo sapiens
gtataagtaagaaaat

SEQ ID NO: 5499613 - DNA, 18 bp, Homo sapiens
gtataagtaagaaaatat

SEQ ID NO: 5499614 - DNA, 15 bp, Homo sapiens
gtataagtagatctg

SEQ ID NO: 5499615 - DNA, 21 bp, Homo sapiens
gtataagtggaggcactttag

SEQ ID NO: 5499616 - DNA, 23 bp, Homo sapiens
gtataagttatttttgtacatgt

SEQ ID NO: 5499617 - DNA, 18 bp, Homo sapiens
gtataagttgtgtttgat

SEQ ID NO: 5499618 - DNA, 15 bp, Homo sapiens
gtataataaaaccaa

SEQ ID NO: 5499619 - DNA, 13 bp, Homo sapiens
gtataatactttg

SEQ ID NO: 5499620 - DNA, 13 bp, Homo sapiens
gtataatagagat

SEQ ID NO: 5499621 - DNA, 14 bp, Homo sapiens
gtataatataaaaa

SEQ ID NO: 5499622 - DNA, 16 bp, Homo sapiens
gtataatatttcttaa

SEQ ID NO: 5499623 - DNA, 14 bp, Homo sapiens
gtataatctcctct

SEQ ID NO: 5499624 - DNA, 20 bp, Homo sapiens
gtataatcttgtagacactt

SEQ ID NO: 5499625 - DNA, 16 bp, Homo sapiens
gtataatgacttttaa

SEQ ID NO: 5499626 - DNA, 14 bp, Homo sapiens
gtataatgctttct

SEQ ID NO: 5499627 - DNA, 19 bp, Homo sapiens
gtataatggttgactgggt

SEQ ID NO: 5499628 - DNA, 23 bp, Homo sapiens
gtataatggttgactgggtttct

SEQ ID NO: 5499629 - DNA, 17 bp, Homo sapiens
gtataatgtatgaattt

SEQ ID NO: 5499630 - DNA, 19 bp, Homo sapiens
gtataatgtatgaattttg

SEQ ID NO: 5499631 - DNA, 12 bp, Homo sapiens
gtataatgtgat

SEQ ID NO: 5499632 - DNA, 15 bp, Homo sapiens
gtataatgtgatttt

SEQ ID NO: 5499633 - DNA, 15 bp, Homo sapiens
gtataatgtgcttta

SEQ ID NO: 5499634 - DNA, 14 bp, Homo sapiens
gtataatgtgtctg

SEQ ID NO: 5499635 - DNA, 16 bp, Homo sapiens
gtataatgtgtctgtg

SEQ ID NO: 5499636 - DNA, 21 bp, Homo sapiens
gtataatgtgtctgtgttgct

SEQ ID NO: 5499637 - DNA, 17 bp, Homo sapiens
gtataatgttggtgtgg

SEQ ID NO: 5499638 - DNA, 14 bp, Homo sapiens
gtataatgtttaaa

SEQ ID NO: 5499639 - DNA, 15 bp, Homo sapiens
gtataatgtttatta

SEQ ID NO: 5499640 - DNA, 10 bp, Homo sapiens
gtataattaa

SEQ ID NO: 5499641 - DNA, 13 bp, Homo sapiens
gtataattaacat

SEQ ID NO: 5499642 - DNA, 23 bp, Homo sapiens
gtataattaacatgttaaaccat

SEQ ID NO: 5499643 - DNA, 18 bp, Homo sapiens
gtataattaacttaactg

SEQ ID NO: 5499644 - DNA, 22 bp, Homo sapiens
gtataattatggtgggtgatta

SEQ ID NO: 5499645 - DNA, 17 bp, Homo sapiens
gtataattcacattgta

SEQ ID NO: 5499646 - DNA, 20 bp, Homo sapiens
gtataattggatttcctaat

SEQ ID NO: 5499647 - DNA, 12 bp, Homo sapiens
gtataattgtgt

SEQ ID NO: 5499648 - DNA, 17 bp, Homo sapiens
gtataatttcgagattt

SEQ ID NO: 5499649 - DNA, 11 bp, Homo sapiens
gtatacaaaca

SEQ ID NO: 5499650 - DNA, 12 bp, Homo sapiens
gtatacaaacag

SEQ ID NO: 5499651 - DNA, 17 bp, Homo sapiens
gtatacaaacaggtgct

SEQ ID NO: 5499652 - DNA, 18 bp, Homo sapiens
gtatacaaacaggtgcta

SEQ ID NO: 5499653 - DNA, 14 bp, Homo sapiens
gtatacaagtactg

SEQ ID NO: 5499654 - DNA, 15 bp, Homo sapiens
gtatacaagtgtttc

SEQ ID NO: 5499655 - DNA, 18 bp, Homo sapiens
gtatacaatatataaaaa

SEQ ID NO: 5499656 - DNA, 15 bp, Homo sapiens
gtatacacacacaca

SEQ ID NO: 5499657 - DNA, 19 bp, Homo sapiens
gtatacacacatatacata

SEQ ID NO: 5499658 - DNA, 23 bp, Homo sapiens
gtatacacacatatacatatata

SEQ ID NO: 5499659 - DNA, 16 bp, Homo sapiens
gtatacacttaaactt

SEQ ID NO: 5499660 - DNA, 17 bp, Homo sapiens
gtatacacttaaacttg

SEQ ID NO: 5499661 - DNA, 23 bp, Homo sapiens
gtatacagagaagaaaacctcaa

SEQ ID NO: 5499662 - DNA, 19 bp, Homo sapiens
gtatacagttcaataaact

SEQ ID NO: 5499663 - DNA, 14 bp, Homo sapiens
gtatacatatgtat

SEQ ID NO: 5499664 - DNA, 17 bp, Homo sapiens
gtatacatcctgggtaa

SEQ ID NO: 5499665 - DNA, 12 bp, Homo sapiens
gtatacatgtgt

SEQ ID NO: 5499666 - DNA, 15 bp, Homo sapiens
gtatacatgtgtaca

SEQ ID NO: 5499667 - DNA, 18 bp, Homo sapiens
gtatacatgtgtacatat

SEQ ID NO: 5499668 - DNA, 13 bp, Homo sapiens
gtatacatttgtt

SEQ ID NO: 5499669 - DNA, 21 bp, Homo sapiens
gtataccaatgtgttttctgt

SEQ ID NO: 5499670 - DNA, 13 bp, Homo sapiens
gtataccacctgt

SEQ ID NO: 5499671 - DNA, 18 bp, Homo sapiens
gtataccacctgtacata

SEQ ID NO: 5499672 - DNA, 21 bp, Homo sapiens
gtataccacctgtacatacat

SEQ ID NO: 5499673 - DNA, 13 bp, Homo sapiens
gtataccatgaga

SEQ ID NO: 5499674 - DNA, 23 bp, Homo sapiens
gtatacccactgcatcctactcc

SEQ ID NO: 5499675 - DNA, 22 bp, Homo sapiens
gtataccgtgccactttccacc

SEQ ID NO: 5499676 - DNA, 16 bp, Homo sapiens
gtatacctcatttttc

SEQ ID NO: 5499677 - DNA, 21 bp, Homo sapiens
gtatactaagagtaaagcaac

SEQ ID NO: 5499678 - DNA, 13 bp, Homo sapiens
gtatactatgtaa

SEQ ID NO: 5499679 - DNA, 15 bp, Homo sapiens
gtatactgtaaaagt

SEQ ID NO: 5499680 - DNA, 12 bp, Homo sapiens
gtatactgtaat

SEQ ID NO: 5499681 - DNA, 11 bp, Homo sapiens
gtatactgtgt

SEQ ID NO: 5499682 - DNA, 15 bp, Homo sapiens
gtatacttcagtgct

SEQ ID NO: 5499683 - DNA, 20 bp, Homo sapiens
gtatactttaaataatttaa

SEQ ID NO: 5499684 - DNA, 14 bp, Homo sapiens
gtatagaaaataaa

SEQ ID NO: 5499685 - DNA, 23 bp, Homo sapiens
gtatagaaaataaaataaattat

SEQ ID NO: 5499686 - DNA, 14 bp, Homo sapiens
gtatagaaaatgga

SEQ ID NO: 5499687 - DNA, 23 bp, Homo sapiens
gtatagaaatgctggtttttcag

SEQ ID NO: 5499688 - DNA, 14 bp, Homo sapiens
gtatagacagcact

SEQ ID NO: 5499689 - DNA, 16 bp, Homo sapiens
gtatagacaggagaag

SEQ ID NO: 5499690 - DNA, 15 bp, Homo sapiens
gtatagacagtttgt

SEQ ID NO: 5499691 - DNA, 15 bp, Homo sapiens
gtatagaccaaagca

SEQ ID NO: 5499692 - DNA, 20 bp, Homo sapiens
gtatagatgagtttttcatt

SEQ ID NO: 5499693 - DNA, 16 bp, Homo sapiens
gtatagatgttgctaa

SEQ ID NO: 5499694 - DNA, 14 bp, Homo sapiens
gtatagattagaat

SEQ ID NO: 5499695 - DNA, 15 bp, Homo sapiens
gtatagcaacctatt

SEQ ID NO: 5499696 - DNA, 22 bp, Homo sapiens
gtatagctgaaattccagttta

SEQ ID NO: 5499697 - DNA, 20 bp, Homo sapiens
gtatagctgacatctcctct

SEQ ID NO: 5499698 - DNA, 19 bp, Homo sapiens
gtatagctgtattgaatca

SEQ ID NO: 5499699 - DNA, 12 bp, Homo sapiens
gtatagctttaa

SEQ ID NO: 5499700 - DNA, 19 bp, Homo sapiens
gtataggaatttgtatttt

SEQ ID NO: 5499701 - DNA, 19 bp, Homo sapiens
gtataggagccccaggcag

SEQ ID NO: 5499702 - DNA, 15 bp, Homo sapiens
gtataggataaatta

SEQ ID NO: 5499703 - DNA, 17 bp, Homo sapiens
gtatagggaattttcat

SEQ ID NO: 5499704 - DNA, 18 bp, Homo sapiens
gtataggtagatgttcag

SEQ ID NO: 5499705 - DNA, 20 bp, Homo sapiens
gtataggtctcatctcttca

SEQ ID NO: 5499706 - DNA, 15 bp, Homo sapiens
gtatagtatctgtat

SEQ ID NO: 5499707 - DNA, 22 bp, Homo sapiens
gtatagtattggaaaataaaaa

SEQ ID NO: 5499708 - DNA, 16 bp, Homo sapiens
gtatagtatttgaaaa

SEQ ID NO: 5499709 - DNA, 20 bp, Homo sapiens
gtatagtgttcacaaactgt

SEQ ID NO: 5499710 - DNA, 23 bp, Homo sapiens
gtatagtgttcacaaactgtgaa

SEQ ID NO: 5499711 - DNA, 14 bp, Homo sapiens
gtatagttatgtaa

SEQ ID NO: 5499712 - DNA, 15 bp, Homo sapiens
gtatagttatgtaaa

SEQ ID NO: 5499713 - DNA, 18 bp, Homo sapiens
gtatagttgcttgcctga

SEQ ID NO: 5499714 - DNA, 14 bp, Homo sapiens
gtatagttttacac

SEQ ID NO: 5499715 - DNA, 18 bp, Homo sapiens
gtatagttttacactcta

SEQ ID NO: 5499716 - DNA, 20 bp, Homo sapiens
gtatagttttataaaactca

SEQ ID NO: 5499717 - DNA, 17 bp, Homo sapiens
gtatagtttttagtctg

SEQ ID NO: 5499718 - DNA, 16 bp, Homo sapiens
gtatataaaatatttt

SEQ ID NO: 5499719 - DNA, 15 bp, Homo sapiens
gtatataaaatgtgc

SEQ ID NO: 5499720 - DNA, 13 bp, Homo sapiens
gtatataaactgg

SEQ ID NO: 5499721 - DNA, 18 bp, Homo sapiens
gtatataaagttttttta

SEQ ID NO: 5499722 - DNA, 11 bp, Homo sapiens
gtatataaatg

SEQ ID NO: 5499723 - DNA, 20 bp, Homo sapiens
gtatataaatgggaacattt

SEQ ID NO: 5499724 - DNA, 14 bp, Homo sapiens
gtatataacttatt

SEQ ID NO: 5499725 - DNA, 13 bp, Homo sapiens
gtatataagcttt

SEQ ID NO: 5499726 - DNA, 18 bp, Homo sapiens
gtatataagttgctgtgt

SEQ ID NO: 5499727 - DNA, 14 bp, Homo sapiens
gtatataataactt

SEQ ID NO: 5499728 - DNA, 22 bp, Homo sapiens
gtatataataactttattgcat

SEQ ID NO: 5499729 - DNA, 22 bp, Homo sapiens
gtatataataactttgaagcca

SEQ ID NO: 5499730 - DNA, 20 bp, Homo sapiens
gtatataatactaaagtgtc

SEQ ID NO: 5499731 - DNA, 18 bp, Homo sapiens
gtatataatatgtcacct

SEQ ID NO: 5499732 - DNA, 17 bp, Homo sapiens
gtatataatcatgctca

SEQ ID NO: 5499733 - DNA, 19 bp, Homo sapiens
gtatataatttactttgta

SEQ ID NO: 5499734 - DNA, 13 bp, Homo sapiens
gtatataatttta

SEQ ID NO: 5499735 - DNA, 13 bp, Homo sapiens
gtatatacaagta

SEQ ID NO: 5499736 - DNA, 18 bp, Homo sapiens
gtatatacacatatacct

SEQ ID NO: 5499737 - DNA, 19 bp, Homo sapiens
gtatatacagttattttgg

SEQ ID NO: 5499738 - DNA, 21 bp, Homo sapiens
gtatatacatattataaataa

SEQ ID NO: 5499739 - DNA, 13 bp, Homo sapiens
gtatatacatttc

SEQ ID NO: 5499740 - DNA, 15 bp, Homo sapiens
gtatatactatacaa

SEQ ID NO: 5499741 - DNA, 15 bp, Homo sapiens
gtatatacttaagaa

SEQ ID NO: 5499742 - DNA, 12 bp, Homo sapiens
gtatatactttg

SEQ ID NO: 5499743 - DNA, 16 bp, Homo sapiens
gtatatactttgccac

SEQ ID NO: 5499744 - DNA, 15 bp, Homo sapiens
gtatatacttttaaa

SEQ ID NO: 5499745 - DNA, 20 bp, Homo sapiens
gtatatacttttaaattatg

SEQ ID NO: 5499746 - DNA, 16 bp, Homo sapiens
gtatatagatgtctgt

SEQ ID NO: 5499747 - DNA, 15 bp, Homo sapiens
gtatatagcccagcc

SEQ ID NO: 5499748 - DNA, 20 bp, Homo sapiens
gtatataggccttccgccag

SEQ ID NO: 5499749 - DNA, 21 bp, Homo sapiens
gtatatagtatatttatactc

SEQ ID NO: 5499750 - DNA, 17 bp, Homo sapiens
gtatatataagaaagac

SEQ ID NO: 5499751 - DNA, 19 bp, Homo sapiens
gtatatataagaaagacat

SEQ ID NO: 5499752 - DNA, 16 bp, Homo sapiens
gtatatatacataaca

SEQ ID NO: 5499753 - DNA, 15 bp, Homo sapiens
gtatatatacataca

SEQ ID NO: 5499754 - DNA, 18 bp, Homo sapiens
gtatatatacatatatat

SEQ ID NO: 5499755 - DNA, 10 bp, Homo sapiens
gtatatatat

SEQ ID NO: 5499756 - DNA, 18 bp, Homo sapiens
gtatatatatatatatgt

SEQ ID NO: 5499757 - DNA, 13 bp, Homo sapiens
gtatatatatgtg

SEQ ID NO: 5499758 - DNA, 17 bp, Homo sapiens
gtatcccacctccagcc

SEQ ID NO: 5499759 - DNA, 17 bp, Homo sapiens
gtatcccagacccctct

SEQ ID NO: 5499760 - DNA, 18 bp, Homo sapiens
gtatcccagacccctctc

SEQ ID NO: 5499761 - DNA, 17 bp, Homo sapiens
gtatccccccatcttgc

SEQ ID NO: 5499762 - DNA, 21 bp, Homo sapiens
gtatcccctgcctcctgccac

SEQ ID NO: 5499763 - DNA, 23 bp, Homo sapiens
gtatcccgggaaggacctgcggt

SEQ ID NO: 5499764 - DNA, 13 bp, Homo sapiens
gtatcccttctca

SEQ ID NO: 5499765 - DNA, 17 bp, Homo sapiens
gtatcccttctcacagc

SEQ ID NO: 5499766 - DNA, 16 bp, Homo sapiens
gtatccgactctaagc

SEQ ID NO: 5499767 - DNA, 24 bp, Homo sapiens
gtatccgactctaagctgtgtgca

SEQ ID NO: 5499768 - DNA, 11 bp, Homo sapiens
gtatcctaaac

SEQ ID NO: 5499769 - DNA, 22 bp, Homo sapiens
gtatcctaaactttagacttcc

SEQ ID NO: 5499770 - DNA, 17 bp, Homo sapiens
gtatcctccaggttttt

SEQ ID NO: 5499771 - DNA, 21 bp, Homo sapiens
gtatcctccctggcagacaca

SEQ ID NO: 5499772 - DNA, 16 bp, Homo sapiens
gtatcctgcccagtgt

SEQ ID NO: 5499773 - DNA, 17 bp, Homo sapiens
gtatcctggaacaatat

SEQ ID NO: 5499774 - DNA, 21 bp, Homo sapiens
gtatcctggaacaatatttta

SEQ ID NO: 5499775 - DNA, 16 bp, Homo sapiens
gtatcctgggggaaga

SEQ ID NO: 5499776 - DNA, 16 bp, Homo sapiens
gtatccttgatgaatc

SEQ ID NO: 5499777 - DNA, 19 bp, Homo sapiens
gtatcgctcctattgaaag

SEQ ID NO: 5499778 - DNA, 15 bp, Homo sapiens
gtatcggcactgtac

SEQ ID NO: 5499779 - DNA, 11 bp, Homo sapiens
gtatcgggggc

SEQ ID NO: 5499780 - DNA, 17 bp, Homo sapiens
gtatctaaaaaataact

SEQ ID NO: 5499781 - DNA, 19 bp, Homo sapiens
gtatctaaaggatggaaaa

SEQ ID NO: 5499782 - DNA, 14 bp, Homo sapiens
gtatctaaagtctt

SEQ ID NO: 5499783 - DNA, 19 bp, Homo sapiens
gtatctaaatgaaaagaga

SEQ ID NO: 5499784 - DNA, 17 bp, Homo sapiens
gtatctaaatttggaac

SEQ ID NO: 5499785 - DNA, 22 bp, Homo sapiens
gtatctaatcctttaatgatct

SEQ ID NO: 5499786 - DNA, 22 bp, Homo sapiens
gtatctacagtaatgaaatgtt

SEQ ID NO: 5499787 - DNA, 16 bp, Homo sapiens
gtatctacattaaaat

SEQ ID NO: 5499788 - DNA, 19 bp, Homo sapiens
gtatctacattaaaatgac

SEQ ID NO: 5499789 - DNA, 21 bp, Homo sapiens
gtatctacattaaaatgacaa

SEQ ID NO: 5499790 - DNA, 22 bp, Homo sapiens
gtatctacattaaaatgacaaa

SEQ ID NO: 5499791 - DNA, 18 bp, Homo sapiens
gtatctactttaataaat

SEQ ID NO: 5499792 - DNA, 15 bp, Homo sapiens
gtatctagtgcagct

SEQ ID NO: 5499793 - DNA, 17 bp, Homo sapiens
gtatctatgcattttct

SEQ ID NO: 5499794 - DNA, 24 bp, Homo sapiens
gtatctatgttgcatgataaacat

SEQ ID NO: 5499795 - DNA, 18 bp, Homo sapiens
gtatctattgtgttggct

SEQ ID NO: 5499796 - DNA, 16 bp, Homo sapiens
gtatctcaataaagca

SEQ ID NO: 5499797 - DNA, 13 bp, Homo sapiens
gtatctcacactc

SEQ ID NO: 5499798 - DNA, 11 bp, Homo sapiens
gtatctcagaa

SEQ ID NO: 5499799 - DNA, 14 bp, Homo sapiens
gtatctccaggatt

SEQ ID NO: 5499800 - DNA, 18 bp, Homo sapiens
gtatctcgtaatagcttc

SEQ ID NO: 5499801 - DNA, 21 bp, Homo sapiens
gtatctcgtaatagcttctgt

SEQ ID NO: 5499802 - DNA, 22 bp, Homo sapiens
gtatctcgtaatagcttctgtg

SEQ ID NO: 5499803 - DNA, 23 bp, Homo sapiens
gtatctcgtaatagcttctgtgt

SEQ ID NO: 5499804 - DNA, 15 bp, Homo sapiens
gtatctctggcacca

SEQ ID NO: 5499805 - DNA, 13 bp, Homo sapiens
gtatctcttcagt

SEQ ID NO: 5499806 - DNA, 14 bp, Homo sapiens
gtatctgaaggaga

SEQ ID NO: 5499807 - DNA, 18 bp, Homo sapiens
gtatctgagttgccaaga

SEQ ID NO: 5499808 - DNA, 20 bp, Homo sapiens
gtatctgagttgccaagaca

SEQ ID NO: 5499809 - DNA, 23 bp, Homo sapiens
gtatctgagttgccaagacaaat

SEQ ID NO: 5499810 - DNA, 19 bp, Homo sapiens
gtatctgatatcagcactg

SEQ ID NO: 5499811 - DNA, 23 bp, Homo sapiens
gtatctgatatctgtttgcttct

SEQ ID NO: 5499812 - DNA, 23 bp, Homo sapiens
gtatctgatgatgttctgaaatg

SEQ ID NO: 5499813 - DNA, 19 bp, Homo sapiens
gtatctgatgtttgttttc

SEQ ID NO: 5499814 - DNA, 17 bp, Homo sapiens
gtatctgcaggcagaca

SEQ ID NO: 5499815 - DNA, 15 bp, Homo sapiens
gtatctgcatgtaaa

SEQ ID NO: 5499816 - DNA, 21 bp, Homo sapiens
gtatctgctgttcttcagtcc

SEQ ID NO: 5499817 - DNA, 14 bp, Homo sapiens
gtatctggctgggt

SEQ ID NO: 5499818 - DNA, 15 bp, Homo sapiens
gtatctggctgggtt

SEQ ID NO: 5499819 - DNA, 18 bp, Homo sapiens
gtatctgggtaagaagaa

SEQ ID NO: 5499820 - DNA, 23 bp, Homo sapiens
gtatctgggtaagaagaaagcaa

SEQ ID NO: 5499821 - DNA, 17 bp, Homo sapiens
gtatctggtatctgcat

SEQ ID NO: 5499822 - DNA, 12 bp, Homo sapiens
gtatctggtgac

SEQ ID NO: 5499823 - DNA, 15 bp, Homo sapiens
gtatctgtaaccctt

SEQ ID NO: 5499824 - DNA, 14 bp, Homo sapiens
gtatctgtctactt

SEQ ID NO: 5499825 - DNA, 20 bp, Homo sapiens
gtatctgtctttccactctg

SEQ ID NO: 5499826 - DNA, 23 bp, Homo sapiens
gtatctgtctttccactctggat

SEQ ID NO: 5499827 - DNA, 15 bp, Homo sapiens
gtatctgtgaactga

SEQ ID NO: 5499828 - DNA, 12 bp, Homo sapiens
gtatctgtggga

SEQ ID NO: 5499829 - DNA, 14 bp, Homo sapiens
gtatcttaaaattg

SEQ ID NO: 5499830 - DNA, 14 bp, Homo sapiens
gtatcttaaaggac

SEQ ID NO: 5499831 - DNA, 22 bp, Homo sapiens
gtatcttaaaggacataaaatt

SEQ ID NO: 5499832 - DNA, 17 bp, Homo sapiens
gtatcttaagccaagaa

SEQ ID NO: 5499833 - DNA, 18 bp, Homo sapiens
gtatcttacctagtgttt

SEQ ID NO: 5499834 - DNA, 20 bp, Homo sapiens
gtatcttacctgtaaagtct

SEQ ID NO: 5499835 - DNA, 14 bp, Homo sapiens
gtatcttagagttt

SEQ ID NO: 5499836 - DNA, 16 bp, Homo sapiens
gtatcttatttatata

SEQ ID NO: 5499837 - DNA, 12 bp, Homo sapiens
gtatcttccttt

SEQ ID NO: 5499838 - DNA, 21 bp, Homo sapiens
gtatcttgggggacagggctg

SEQ ID NO: 5499839 - DNA, 22 bp, Homo sapiens
gtatcttgggtgtattctctgt

SEQ ID NO: 5499840 - DNA, 23 bp, Homo sapiens
gtatcttgtttttccactactgc

SEQ ID NO: 5499841 - DNA, 16 bp, Homo sapiens
gtatctttaaatataa

SEQ ID NO: 5499842 - DNA, 22 bp, Homo sapiens
gtatctttaacaattgtcttaa

SEQ ID NO: 5499843 - DNA, 15 bp, Homo sapiens
gtatctttccaggct

SEQ ID NO: 5499844 - DNA, 17 bp, Homo sapiens
gtatctttctatgctgc

SEQ ID NO: 5499845 - DNA, 19 bp, Homo sapiens
gtatctttctatgctgctt

SEQ ID NO: 5499846 - DNA, 21 bp, Homo sapiens
gtatctttggttatcctgttt

SEQ ID NO: 5499847 - DNA, 19 bp, Homo sapiens
gtatcttttatcctgggag

SEQ ID NO: 5499848 - DNA, 13 bp, Homo sapiens
gtatcttttgata

SEQ ID NO: 5499849 - DNA, 20 bp, Homo sapiens
gtatgaaaacatggaacagt

SEQ ID NO: 5499850 - DNA, 14 bp, Homo sapiens
gtatgaaagctggg

SEQ ID NO: 5499851 - DNA, 13 bp, Homo sapiens
gtatgaaattata

SEQ ID NO: 5499852 - DNA, 18 bp, Homo sapiens
gtatgaactaaaaagaga

SEQ ID NO: 5499853 - DNA, 19 bp, Homo sapiens
gtatgaacttgaggacaca

SEQ ID NO: 5499854 - DNA, 20 bp, Homo sapiens
gtatgaacttgaggacacat

SEQ ID NO: 5499855 - DNA, 22 bp, Homo sapiens
gtatgaacttgaggacacatgt

SEQ ID NO: 5499856 - DNA, 17 bp, Homo sapiens
gtatgaagacagaggca

SEQ ID NO: 5499857 - DNA, 14 bp, Homo sapiens
gtatgaagagctgt

SEQ ID NO: 5499858 - DNA, 13 bp, Homo sapiens
gtatgaaggcttt

SEQ ID NO: 5499859 - DNA, 18 bp, Homo sapiens
gtatgaagtacttttaac

SEQ ID NO: 5499860 - DNA, 18 bp, Homo sapiens
gtatgaataaagacacct

SEQ ID NO: 5499861 - DNA, 17 bp, Homo sapiens
gtatgaataatgaaaat

SEQ ID NO: 5499862 - DNA, 19 bp, Homo sapiens
gtatgaataatgaaaataa

SEQ ID NO: 5499863 - DNA, 15 bp, Homo sapiens
gtatgaataattgca

SEQ ID NO: 5499864 - DNA, 23 bp, Homo sapiens
gtatgaatattttatattaaaat

SEQ ID NO: 5499865 - DNA, 16 bp, Homo sapiens
gtatgaatctatgcca

SEQ ID NO: 5499866 - DNA, 20 bp, Homo sapiens
gtatgaatctatgccaaaga

SEQ ID NO: 5499867 - DNA, 13 bp, Homo sapiens
gtatgaatgatgt

SEQ ID NO: 5499868 - DNA, 15 bp, Homo sapiens
gtatgaatgcagtgg

SEQ ID NO: 5499869 - DNA, 14 bp, Homo sapiens
gtatgaattattca

SEQ ID NO: 5499870 - DNA, 12 bp, Homo sapiens
gtatgaatttga

SEQ ID NO: 5499871 - DNA, 18 bp, Homo sapiens
gtatgaattttgtaagta

SEQ ID NO: 5499872 - DNA, 19 bp, Homo sapiens
gtatgacataggccaaggc

SEQ ID NO: 5499873 - DNA, 16 bp, Homo sapiens
gtatgacccctggcca

SEQ ID NO: 5499874 - DNA, 19 bp, Homo sapiens
gtatgacccctggccacag

SEQ ID NO: 5499875 - DNA, 21 bp, Homo sapiens
gtatgacccctggccacagcc

SEQ ID NO: 5499876 - DNA, 17 bp, Homo sapiens
gtatgacgctgatacat

SEQ ID NO: 5499877 - DNA, 22 bp, Homo sapiens
gtatgacttaattttagaaaga

SEQ ID NO: 5499878 - DNA, 14 bp, Homo sapiens
gtatgacttctgct

SEQ ID NO: 5499879 - DNA, 20 bp, Homo sapiens
gtatgagaaatacagtgctt

SEQ ID NO: 5499880 - DNA, 18 bp, Homo sapiens
gtatgagagagagagtgt

SEQ ID NO: 5499881 - DNA, 12 bp, Homo sapiens
gtatgagctgag

SEQ ID NO: 5499882 - DNA, 14 bp, Homo sapiens
gtatgagctggagc

SEQ ID NO: 5499883 - DNA, 18 bp, Homo sapiens
gtatgaggagagcttcag

SEQ ID NO: 5499884 - DNA, 15 bp, Homo sapiens
gtatgaggcatttgt

SEQ ID NO: 5499885 - DNA, 17 bp, Homo sapiens
gtatgaggcatttgttt

SEQ ID NO: 5499886 - DNA, 20 bp, Homo sapiens
gtatgaggcatttgtttgaa

SEQ ID NO: 5499887 - DNA, 20 bp, Homo sapiens
gtatgaggtcctcaggtcag

SEQ ID NO: 5499888 - DNA, 16 bp, Homo sapiens
gtatgagtaggtttgg

SEQ ID NO: 5499889 - DNA, 20 bp, Homo sapiens
gtatgagtcaatgtgcagtg

SEQ ID NO: 5499890 - DNA, 15 bp, Homo sapiens
gtatgagtgtatgtg

SEQ ID NO: 5499891 - DNA, 21 bp, Homo sapiens
gtatgagtgtgagtgtgtgtg

SEQ ID NO: 5499892 - DNA, 20 bp, Homo sapiens
gtatgagttgcatttgtaaa

SEQ ID NO: 5499893 - DNA, 15 bp, Homo sapiens
gtatgatagtgacta

SEQ ID NO: 5499894 - DNA, 21 bp, Homo sapiens
gtatgatcacggctcactgca

SEQ ID NO: 5499895 - DNA, 19 bp, Homo sapiens
gtatgatcggcaggacacc

SEQ ID NO: 5499896 - DNA, 13 bp, Homo sapiens
gtatgatctgtgt

SEQ ID NO: 5499897 - DNA, 22 bp, Homo sapiens
gtatgatgaaaataattttcca

SEQ ID NO: 5499898 - DNA, 13 bp, Homo sapiens
gtatgatgctgcc

SEQ ID NO: 5499899 - DNA, 14 bp, Homo sapiens
gtatgatgctgccg

SEQ ID NO: 5499900 - DNA, 18 bp, Homo sapiens
gtatgatgtattagtaga

SEQ ID NO: 5499901 - DNA, 16 bp, Homo sapiens
gtatgatgtgttgtga

SEQ ID NO: 5499902 - DNA, 17 bp, Homo sapiens
gtatgatgtgttgtgat

SEQ ID NO: 5499903 - DNA, 21 bp, Homo sapiens
gtatgattactggcctttttc

SEQ ID NO: 5499904 - DNA, 21 bp, Homo sapiens
gtatgatttgttttgaatttt

SEQ ID NO: 5499905 - DNA, 22 bp, Homo sapiens
gtatgatttgttttgaattttg

SEQ ID NO: 5499906 - DNA, 23 bp, Homo sapiens
gtatgcaagcagtttcaataaag

SEQ ID NO: 5499907 - DNA, 20 bp, Homo sapiens
gtatgcaagtgggagatgaa

SEQ ID NO: 5499908 - DNA, 23 bp, Homo sapiens
gtatgcagggagcactgttcaca

SEQ ID NO: 5499909 - DNA, 17 bp, Homo sapiens
gtatgcagtactaaaat

SEQ ID NO: 5499910 - DNA, 19 bp, Homo sapiens
gtatgcagtactaaaatta

SEQ ID NO: 5499911 - DNA, 19 bp, Homo sapiens
gtatgcagtgtagatttta

SEQ ID NO: 5499912 - DNA, 17 bp, Homo sapiens
gtatgcattattaaatt

SEQ ID NO: 5499913 - DNA, 19 bp, Homo sapiens
gtatgcattctttatagtg

SEQ ID NO: 5499914 - DNA, 17 bp, Homo sapiens
gtatgccacacctggcc

SEQ ID NO: 5499915 - DNA, 16 bp, Homo sapiens
gtatgccactgcactc

SEQ ID NO: 5499916 - DNA, 20 bp, Homo sapiens
gtatgccactgcactccagc

SEQ ID NO: 5499917 - DNA, 14 bp, Homo sapiens
gtatgccttaagca

SEQ ID NO: 5499918 - DNA, 15 bp, Homo sapiens
gtatgccttctgtat

SEQ ID NO: 5499919 - DNA, 22 bp, Homo sapiens
gtatgcctttaaatctgtgatg

SEQ ID NO: 5499920 - DNA, 22 bp, Homo sapiens
gtatgcgaaaaggtttttagga

SEQ ID NO: 5499921 - DNA, 13 bp, Homo sapiens
gtatgcggtgacg

SEQ ID NO: 5499922 - DNA, 15 bp, Homo sapiens
gtatgcgtgtgtgtg

SEQ ID NO: 5499923 - DNA, 21 bp, Homo sapiens
gtatgctgatcatcgccagag

SEQ ID NO: 5499924 - DNA, 14 bp, Homo sapiens
gtatgctggccagc

SEQ ID NO: 5499925 - DNA, 15 bp, Homo sapiens
gtatgctggccagca

SEQ ID NO: 5499926 - DNA, 13 bp, Homo sapiens
gtatgctggtagc

SEQ ID NO: 5499927 - DNA, 16 bp, Homo sapiens
gtatgcttattttaaa

SEQ ID NO: 5499928 - DNA, 18 bp, Homo sapiens
gtatgcttgggccctgca

SEQ ID NO: 5499929 - DNA, 20 bp, Homo sapiens
gtatgcttttataggcctgt

SEQ ID NO: 5499930 - DNA, 20 bp, Homo sapiens
gtatggaagacaaatacaca

SEQ ID NO: 5499931 - DNA, 22 bp, Homo sapiens
gtatggaagacaaatacacata

SEQ ID NO: 5499932 - DNA, 17 bp, Homo sapiens
gtatggaagggaggggt

SEQ ID NO: 5499933 - DNA, 20 bp, Homo sapiens
gtatggaaggtggagcgttc

SEQ ID NO: 5499934 - DNA, 23 bp, Homo sapiens
gtattagcacctctttttgaaca

SEQ ID NO: 5499935 - DNA, 14 bp, Homo sapiens
gtattagcttaccc

SEQ ID NO: 5499936 - DNA, 19 bp, Homo sapiens
gtattaggggtaatatatt

SEQ ID NO: 5499937 - DNA, 16 bp, Homo sapiens
gtattagtagagcaac

SEQ ID NO: 5499938 - DNA, 22 bp, Homo sapiens
gtattagtgatatttctctagt

SEQ ID NO: 5499939 - DNA, 15 bp, Homo sapiens
gtattagtggaaagt

SEQ ID NO: 5499940 - DNA, 23 bp, Homo sapiens
gtattataaacaagaatgaaggt

SEQ ID NO: 5499941 - DNA, 18 bp, Homo sapiens
gtattataaattatgttt

SEQ ID NO: 5499942 - DNA, 20 bp, Homo sapiens
gtattatacatgtgatacat

SEQ ID NO: 5499943 - DNA, 17 bp, Homo sapiens
gtattatactgtagatt

SEQ ID NO: 5499944 - DNA, 17 bp, Homo sapiens
gtattatatctctgtat

SEQ ID NO: 5499945 - DNA, 20 bp, Homo sapiens
gtattatcagtgaatataaa

SEQ ID NO: 5499946 - DNA, 23 bp, Homo sapiens
gtattatccacaattattggcaa

SEQ ID NO: 5499947 - DNA, 13 bp, Homo sapiens
gtattatctaaat

SEQ ID NO: 5499948 - DNA, 15 bp, Homo sapiens
gtattatctcctttg

SEQ ID NO: 5499949 - DNA, 18 bp, Homo sapiens
gtattatctgtaaaaatt

SEQ ID NO: 5499950 - DNA, 20 bp, Homo sapiens
gtattatcttgttcaggaaa

SEQ ID NO: 5499951 - DNA, 20 bp, Homo sapiens
gtattatgccccagttcaga

SEQ ID NO: 5499952 - DNA, 13 bp, Homo sapiens
gtattatgctgtt

SEQ ID NO: 5499953 - DNA, 14 bp, Homo sapiens
gtattatgcttctt

SEQ ID NO: 5499954 - DNA, 21 bp, Homo sapiens
gtattattacaaatattgtca

SEQ ID NO: 5499955 - DNA, 18 bp, Homo sapiens
gtattattagactctcta

SEQ ID NO: 5499956 - DNA, 14 bp, Homo sapiens
gtattattgctgtt

SEQ ID NO: 5499957 - DNA, 19 bp, Homo sapiens
gtattatttcaccagcagc

SEQ ID NO: 5499958 - DNA, 14 bp, Homo sapiens
gtattatttggagt

SEQ ID NO: 5499959 - DNA, 20 bp, Homo sapiens
gtattcaaatgttagagttt

SEQ ID NO: 5499960 - DNA, 22 bp, Homo sapiens
gtattcaaatgttagagtttaa

SEQ ID NO: 5499961 - DNA, 18 bp, Homo sapiens
gtattcaaatttgtgtca

SEQ ID NO: 5499962 - DNA, 23 bp, Homo sapiens
gtattcaaatttgtgtcatacca

SEQ ID NO: 5499963 - DNA, 14 bp, Homo sapiens
gtattcaagaaagc

SEQ ID NO: 5499964 - DNA, 22 bp, Homo sapiens
gtattcaataccgctcagtatt

SEQ ID NO: 5499965 - DNA, 20 bp, Homo sapiens
gtattcacatagtcctcagg

SEQ ID NO: 5499966 - DNA, 13 bp, Homo sapiens
gtattcacatcat

SEQ ID NO: 5499967 - DNA, 18 bp, Homo sapiens
gtattcaccctgggcagt

SEQ ID NO: 5499968 - DNA, 14 bp, Homo sapiens
gtattcagaaatta

SEQ ID NO: 5499969 - DNA, 19 bp, Homo sapiens
gtattcagaaattaaaata

SEQ ID NO: 5499970 - DNA, 13 bp, Homo sapiens
gtattcagagcca

SEQ ID NO: 5499971 - DNA, 23 bp, Homo sapiens
gtattcagcaaggcgctaacttg

SEQ ID NO: 5499972 - DNA, 16 bp, Homo sapiens
gtattcatacagcact

SEQ ID NO: 5499973 - DNA, 17 bp, Homo sapiens
gtattcatacagcacta

SEQ ID NO: 5499974 - DNA, 14 bp, Homo sapiens
gtattcatatattg

SEQ ID NO: 5499975 - DNA, 19 bp, Homo sapiens
gtattcatccagagttctt

SEQ ID NO: 5499976 - DNA, 14 bp, Homo sapiens
gtattccaccttaa

SEQ ID NO: 5499977 - DNA, 19 bp, Homo sapiens
gtattccaccttaaattaa

SEQ ID NO: 5499978 - DNA, 20 bp, Homo sapiens
gtattccaccttaaattaaa

SEQ ID NO: 5499979 - DNA, 12 bp, Homo sapiens
gtattccccttc

SEQ ID NO: 5499980 - DNA, 11 bp, Homo sapiens
gtattccctta

SEQ ID NO: 5499981 - DNA, 17 bp, Homo sapiens
gtattcccttgtatttt

SEQ ID NO: 5499982 - DNA, 22 bp, Homo sapiens
gtattcccttgtattttgttaa

SEQ ID NO: 5499983 - DNA, 18 bp, Homo sapiens
gtattcccttttatttcc

SEQ ID NO: 5499984 - DNA, 16 bp, Homo sapiens
gtattcctagcaaatt

SEQ ID NO: 5499985 - DNA, 18 bp, Homo sapiens
gtattcctgaaaagctgc

SEQ ID NO: 5499986 - DNA, 17 bp, Homo sapiens
gtattcctgatatgcct

SEQ ID NO: 5499987 - DNA, 14 bp, Homo sapiens
gtattcctgcctcc

SEQ ID NO: 5499988 - DNA, 19 bp, Homo sapiens
gtattcctgttgctgtctt

SEQ ID NO: 5499989 - DNA, 16 bp, Homo sapiens
gtattccttggcccag

SEQ ID NO: 5499990 - DNA, 17 bp, Homo sapiens
gtattccttggcccagc

SEQ ID NO: 5499991 - DNA, 19 bp, Homo sapiens
gtattccttggcccagcag

SEQ ID NO: 5499992 - DNA, 20 bp, Homo sapiens
gtattccttttgtgtacagt

SEQ ID NO: 5499993 - DNA, 17 bp, Homo sapiens
gtattcgaaacctgtga

SEQ ID NO: 5499994 - DNA, 21 bp, Homo sapiens
gtattctaaattttatatctt

SEQ ID NO: 5499995 - DNA, 24 bp, Homo sapiens
gtattctaaattttatatcttgta

SEQ ID NO: 5499996 - DNA, 17 bp, Homo sapiens
gtattctagtggctgtt

SEQ ID NO: 5499997 - DNA, 15 bp, Homo sapiens
gtattctatttgtgt

SEQ ID NO: 5499998 - DNA, 17 bp, Homo sapiens
gtattctatttgtgtaa

SEQ ID NO: 5499999 - DNA, 14 bp, Homo sapiens
gtattctcagagca

SEQ ID NO: 5500000 - DNA, 18 bp, Homo sapiens
gtattctcagagcatgtg

SEQ ID NO: 5500001 - DNA, 21 bp, Homo sapiens
gtattctcagagcatgtgtca

SEQ ID NO: 5500002 - DNA, 14 bp, Homo sapiens
gtattctcataata

SEQ ID NO: 5500003 - DNA, 17 bp, Homo sapiens
gtattctctgcaatttt

SEQ ID NO: 5500004 - DNA, 19 bp, Homo sapiens
gtattctctgtccagggct

SEQ ID NO: 5500005 - DNA, 14 bp, Homo sapiens
gtattctcttttca

SEQ ID NO: 5500006 - DNA, 23 bp, Homo sapiens
gtattctgcctttgcagaaacag

SEQ ID NO: 5500007 - DNA, 15 bp, Homo sapiens
gtattctgcttccac

SEQ ID NO: 5500008 - DNA, 13 bp, Homo sapiens
gtattctgtcatt

SEQ ID NO: 5500009 - DNA, 13 bp, Homo sapiens
gtattctgtggcc

SEQ ID NO: 5500010 - DNA, 17 bp, Homo sapiens
gtattctgttctggagg

SEQ ID NO: 5500011 - DNA, 20 bp, Homo sapiens
gtattcttaaaatgcaatat

SEQ ID NO: 5500012 - DNA, 15 bp, Homo sapiens
gtattcttcaacctc

SEQ ID NO: 5500013 - DNA, 12 bp, Homo sapiens
gtattcttcatg

SEQ ID NO: 5500014 - DNA, 16 bp, Homo sapiens
gtattcttcatgaaat

SEQ ID NO: 5500015 - DNA, 16 bp, Homo sapiens
gtattcttctcttcct

SEQ ID NO: 5500016 - DNA, 14 bp, Homo sapiens
gtattcttcttttc

SEQ ID NO: 5500017 - DNA, 14 bp, Homo sapiens
gtattcttgtcaaa

SEQ ID NO: 5500018 - DNA, 16 bp, Homo sapiens
gtattcttgtttgaat

SEQ ID NO: 5500019 - DNA, 14 bp, Homo sapiens
gtattctttattat

SEQ ID NO: 5500020 - DNA, 11 bp, Homo sapiens
gtattctttga

SEQ ID NO: 5500021 - DNA, 23 bp, Homo sapiens
gtattctttgatgttaacacatt

SEQ ID NO: 5500022 - DNA, 17 bp, Homo sapiens
gtattcttttatataac

SEQ ID NO: 5500023 - DNA, 20 bp, Homo sapiens
gtattcttttccaagctcct

SEQ ID NO: 5500024 - DNA, 15 bp, Homo sapiens
gtattgaagttaact

SEQ ID NO: 5500025 - DNA, 14 bp, Homo sapiens
gtattgaatattgt

SEQ ID NO: 5500026 - DNA, 23 bp, Homo sapiens
gtattgaatattgtgttcctttt

SEQ ID NO: 5500027 - DNA, 12 bp, Homo sapiens
gtattgaatcat

SEQ ID NO: 5500028 - DNA, 14 bp, Homo sapiens
gtattgaatcatgt

SEQ ID NO: 5500029 - DNA, 19 bp, Homo sapiens
gtattgacaaaatgttatt

SEQ ID NO: 5500030 - DNA, 16 bp, Homo sapiens
gtattgacaataagaa

SEQ ID NO: 5500031 - DNA, 17 bp, Homo sapiens
gtattgacaataagaaa

SEQ ID NO: 5500032 - DNA, 21 bp, Homo sapiens
gtattgacaataagaaacagt

SEQ ID NO: 5500033 - DNA, 20 bp, Homo sapiens
gtattgactttatgttgtat

SEQ ID NO: 5500034 - DNA, 16 bp, Homo sapiens
gtattgagatttctta

SEQ ID NO: 5500035 - DNA, 13 bp, Homo sapiens
gtattgatatcac

SEQ ID NO: 5500036 - DNA, 18 bp, Homo sapiens
gtattgattatataagca

SEQ ID NO: 5500037 - DNA, 20 bp, Homo sapiens
gtattgattgaaaaaagaga

SEQ ID NO: 5500038 - DNA, 16 bp, Homo sapiens
gtattgcagctaagct

SEQ ID NO: 5500039 - DNA, 22 bp, Homo sapiens
gtattgcatgcaatttgaagta

SEQ ID NO: 5500040 - DNA, 16 bp, Homo sapiens
gtattgccaaacatta

SEQ ID NO: 5500041 - DNA, 17 bp, Homo sapiens
gtattgccaaacattaa

SEQ ID NO: 5500042 - DNA, 24 bp, Homo sapiens
gtattgccaaacattaatgttgat

SEQ ID NO: 5500043 - DNA, 23 bp, Homo sapiens
gtattgccacaatgcctctccca

SEQ ID NO: 5500044 - DNA, 13 bp, Homo sapiens
gtattgccacctc

SEQ ID NO: 5500045 - DNA, 22 bp, Homo sapiens
gtattgccatcgggtgccaaat

SEQ ID NO: 5500046 - DNA, 23 bp, Homo sapiens
gtattgcgaaacaacttgtgttc

SEQ ID NO: 5500047 - DNA, 16 bp, Homo sapiens
gtattgctagtttaaa

SEQ ID NO: 5500048 - DNA, 14 bp, Homo sapiens
gtattgctatttat

SEQ ID NO: 5500049 - DNA, 15 bp, Homo sapiens
gtattgctccatttt

SEQ ID NO: 5500050 - DNA, 20 bp, Homo sapiens
gtattgctgctgtgcgtgga

SEQ ID NO: 5500051 - DNA, 21 bp, Homo sapiens
gtattgctgtgtctcctctca

SEQ ID NO: 5500052 - DNA, 22 bp, Homo sapiens
gtattggagcacatgttactgc

SEQ ID NO: 5500053 - DNA, 17 bp, Homo sapiens
gtattggcagcacagct

SEQ ID NO: 5500054 - DNA, 12 bp, Homo sapiens
gtattggcctgg

SEQ ID NO: 5500055 - DNA, 22 bp, Homo sapiens
gtattggctagaggttcaaaga

SEQ ID NO: 5500056 - DNA, 20 bp, Homo sapiens
gtattggctttttcagagtc

SEQ ID NO: 5500057 - DNA, 20 bp, Homo sapiens
gtattgggattacagacatg

SEQ ID NO: 5500058 - DNA, 20 bp, Homo sapiens
gtattggggttattttctgg

SEQ ID NO: 5500059 - DNA, 19 bp, Homo sapiens
gtattggtttctgtttgaa

SEQ ID NO: 5500060 - DNA, 12 bp, Homo sapiens
gtattgtaaatt

SEQ ID NO: 5500061 - DNA, 15 bp, Homo sapiens
gtattgtaatattaa

SEQ ID NO: 5500062 - DNA, 10 bp, Homo sapiens
gtattgtaca

SEQ ID NO: 5500063 - DNA, 20 bp, Homo sapiens
gtattgtaccttttaacacc

SEQ ID NO: 5500064 - DNA, 12 bp, Homo sapiens
gtattgtagaaa

SEQ ID NO: 5500065 - DNA, 18 bp, Homo sapiens
gtattgtatttattcaat

SEQ ID NO: 5500066 - DNA, 17 bp, Homo sapiens
gtattgtctgaacttgc

SEQ ID NO: 5500067 - DNA, 19 bp, Homo sapiens
gtattgtctgacacatgct

SEQ ID NO: 5500068 - DNA, 19 bp, Homo sapiens
gtattgtgaccactgaatt

SEQ ID NO: 5500069 - DNA, 15 bp, Homo sapiens
gtattgtgagatcct

SEQ ID NO: 5500070 - DNA, 17 bp, Homo sapiens
gtattgttcttgtaaaa

SEQ ID NO: 5500071 - DNA, 20 bp, Homo sapiens
gtattgttcttgtaaaactg

SEQ ID NO: 5500072 - DNA, 15 bp, Homo sapiens
gtattgttgggaaag

SEQ ID NO: 5500073 - DNA, 13 bp, Homo sapiens
gtattgttgtcct

SEQ ID NO: 5500074 - DNA, 15 bp, Homo sapiens
gtattgttgtccttt

SEQ ID NO: 5500075 - DNA, 18 bp, Homo sapiens
gtattgttgtccttttca

SEQ ID NO: 5500076 - DNA, 20 bp, Homo sapiens
gtattgttgtccttttcata

SEQ ID NO: 5500077 - DNA, 18 bp, Homo sapiens
gtattgtttaaaatgtaa

SEQ ID NO: 5500078 - DNA, 14 bp, Homo sapiens
gtattgtttacatt

SEQ ID NO: 5500079 - DNA, 20 bp, Homo sapiens
gtattgtttgggatcctatt

SEQ ID NO: 5500080 - DNA, 16 bp, Homo sapiens
gtatttaaaaatagaa

SEQ ID NO: 5500081 - DNA, 17 bp, Homo sapiens
gtatttaaaaatagaaa

SEQ ID NO: 5500082 - DNA, 22 bp, Homo sapiens
gtatttaaactatcttgtgtga

SEQ ID NO: 5500083 - DNA, 14 bp, Homo sapiens
gtatttaaatgttc

SEQ ID NO: 5500084 - DNA, 18 bp, Homo sapiens
gtatttaactacatctgc

SEQ ID NO: 5500085 - DNA, 22 bp, Homo sapiens
gtatttaactacatctgcctcg

SEQ ID NO: 5500086 - DNA, 14 bp, Homo sapiens
gtatttaactctgt

SEQ ID NO: 5500087 - DNA, 20 bp, Homo sapiens
gtatttaagaaagggaaagc

SEQ ID NO: 5500088 - DNA, 15 bp, Homo sapiens
gtatttaagactgat

SEQ ID NO: 5500089 - DNA, 19 bp, Homo sapiens
gtatttaagactgataatt

SEQ ID NO: 5500090 - DNA, 15 bp, Homo sapiens
gtatttaagcaaata

SEQ ID NO: 5500091 - DNA, 17 bp, Homo sapiens
gtatttaagcaaatact

SEQ ID NO: 5500092 - DNA, 17 bp, Homo sapiens
gtatttaaggaatcaaa

SEQ ID NO: 5500093 - DNA, 21 bp, Homo sapiens
gtatttaaggaatcaaatctt

SEQ ID NO: 5500094 - DNA, 21 bp, Homo sapiens
gtatttaatgatttttgtgta

SEQ ID NO: 5500095 - DNA, 19 bp, Homo sapiens
gtatttaattagtgctaag

SEQ ID NO: 5500096 - DNA, 16 bp, Homo sapiens
gtatttaattcatgtt

SEQ ID NO: 5500097 - DNA, 18 bp, Homo sapiens
gtatttaattgtaaactg

SEQ ID NO: 5500098 - DNA, 13 bp, Homo sapiens
gtatttaattttg

SEQ ID NO: 5500099 - DNA, 15 bp, Homo sapiens
gtatttacactatga

SEQ ID NO: 5500100 - DNA, 13 bp, Homo sapiens
gtatttacagaca

SEQ ID NO: 5500101 - DNA, 20 bp, Homo sapiens
gtatttactgcaatgtctgt

SEQ ID NO: 5500102 - DNA, 14 bp, Homo sapiens
gtatttactgtact

SEQ ID NO: 5500103 - DNA, 20 bp, Homo sapiens
gtatttactgtactaattag

SEQ ID NO: 5500104 - DNA, 13 bp, Homo sapiens
gtatttacttgtt

SEQ ID NO: 5500105 - DNA, 21 bp, Homo sapiens
gtatttagaagcagagggaca

SEQ ID NO: 5500106 - DNA, 14 bp, Homo sapiens
gtatttagaagcca

SEQ ID NO: 5500107 - DNA, 14 bp, Homo sapiens
gtatttaggccatt

SEQ ID NO: 5500108 - DNA, 17 bp, Homo sapiens
gtatttagtaaaaataa

SEQ ID NO: 5500109 - DNA, 21 bp, Homo sapiens
gtatttataagaaaaatgtga

SEQ ID NO: 5500110 - DNA, 17 bp, Homo sapiens
gtatttatataagtctg

SEQ ID NO: 5500111 - DNA, 15 bp, Homo sapiens
gtatttatatttaaa

SEQ ID NO: 5500112 - DNA, 17 bp, Homo sapiens
gtcaatgctatggactg

SEQ ID NO: 5500113 - DNA, 22 bp, Homo sapiens
gtcaatgctatttttgttttta

SEQ ID NO: 5500114 - DNA, 19 bp, Homo sapiens
gtcaatgggacctgtggct

SEQ ID NO: 5500115 - DNA, 12 bp, Homo sapiens
gtcaatgtactt

SEQ ID NO: 5500116 - DNA, 12 bp, Homo sapiens
gtcaatgtgaaa

SEQ ID NO: 5500117 - DNA, 13 bp, Homo sapiens
gtcaatgtgaaat

SEQ ID NO: 5500118 - DNA, 20 bp, Homo sapiens
gtcaatgtgaaataaagagt

SEQ ID NO: 5500119 - DNA, 18 bp, Homo sapiens
gtcaatgtgcagtgtagc

SEQ ID NO: 5500120 - DNA, 15 bp, Homo sapiens
gtcaatgttttcagt

SEQ ID NO: 5500121 - DNA, 18 bp, Homo sapiens
gtcaattaaacagctggt

SEQ ID NO: 5500122 - DNA, 16 bp, Homo sapiens
gtcaattacaggaagt

SEQ ID NO: 5500123 - DNA, 18 bp, Homo sapiens
gtcaattcattaataaaa

SEQ ID NO: 5500124 - DNA, 19 bp, Homo sapiens
gtcaattccacccctcctc

SEQ ID NO: 5500125 - DNA, 14 bp, Homo sapiens
gtcaattctgtgtg

SEQ ID NO: 5500126 - DNA, 13 bp, Homo sapiens
gtcaattctgtta

SEQ ID NO: 5500127 - DNA, 16 bp, Homo sapiens
gtcaattgatatttct

SEQ ID NO: 5500128 - DNA, 18 bp, Homo sapiens
gtcaatttatgaatataa

SEQ ID NO: 5500129 - DNA, 17 bp, Homo sapiens
gtcaatttctgtgttgc

SEQ ID NO: 5500130 - DNA, 22 bp, Homo sapiens
gtcaatttctgtgttgccaagc

SEQ ID NO: 5500131 - DNA, 15 bp, Homo sapiens
gtcaattttttcagg

SEQ ID NO: 5500132 - DNA, 16 bp, Homo sapiens
gtcacaaaccagcctg

SEQ ID NO: 5500133 - DNA, 17 bp, Homo sapiens
gtcacaaagaatttaaa

SEQ ID NO: 5500134 - DNA, 19 bp, Homo sapiens
gtcacaaagctatttaagt

SEQ ID NO: 5500135 - DNA, 15 bp, Homo sapiens
gtcacaaatttctct

SEQ ID NO: 5500136 - DNA, 21 bp, Homo sapiens
gtcacaacaaaaggaagactg

SEQ ID NO: 5500137 - DNA, 14 bp, Homo sapiens
gtcacaaccaagaa

SEQ ID NO: 5500138 - DNA, 15 bp, Homo sapiens
gtcacaacctctctg

SEQ ID NO: 5500139 - DNA, 17 bp, Homo sapiens
gtcacaagagcccagca

SEQ ID NO: 5500140 - DNA, 21 bp, Homo sapiens
gtcacaagcctcgaggtgcct

SEQ ID NO: 5500141 - DNA, 19 bp, Homo sapiens
gtcacaagtaggagacaca

SEQ ID NO: 5500142 - DNA, 17 bp, Homo sapiens
gtcacaataaaacaatc

SEQ ID NO: 5500143 - DNA, 19 bp, Homo sapiens
gtcacaataaatggccagt

SEQ ID NO: 5500144 - DNA, 18 bp, Homo sapiens
gtcacaatgttctttata

SEQ ID NO: 5500145 - DNA, 18 bp, Homo sapiens
gtcacacaaggctgggca

SEQ ID NO: 5500146 - DNA, 11 bp, Homo sapiens
gtcacacactg

SEQ ID NO: 5500147 - DNA, 12 bp, Homo sapiens
gtcacacactgg

SEQ ID NO: 5500148 - DNA, 15 bp, Homo sapiens
gtcacacagacacac

SEQ ID NO: 5500149 - DNA, 14 bp, Homo sapiens
gtcacacagcctgt

SEQ ID NO: 5500150 - DNA, 12 bp, Homo sapiens
gtcacacagcta

SEQ ID NO: 5500151 - DNA, 20 bp, Homo sapiens
gtcacacagctagtgaagac

SEQ ID NO: 5500152 - DNA, 19 bp, Homo sapiens
gtcacacagtgttggaggt

SEQ ID NO: 5500153 - DNA, 19 bp, Homo sapiens
gtcacacattacaaagtta

SEQ ID NO: 5500154 - DNA, 14 bp, Homo sapiens
gtcacacattatag

SEQ ID NO: 5500155 - DNA, 13 bp, Homo sapiens
gtcacaccagcca

SEQ ID NO: 5500156 - DNA, 15 bp, Homo sapiens
gtcacaccatcttaa

SEQ ID NO: 5500157 - DNA, 21 bp, Homo sapiens
gtcacacccaccccctgcctg

SEQ ID NO: 5500158 - DNA, 18 bp, Homo sapiens
gtcacacccatggcctca

SEQ ID NO: 5500159 - DNA, 21 bp, Homo sapiens
gtcacaccctccccattagta

SEQ ID NO: 5500160 - DNA, 17 bp, Homo sapiens
gtcacacctcactgtca

SEQ ID NO: 5500161 - DNA, 20 bp, Homo sapiens
gtcacacctcactgtcatct

SEQ ID NO: 5500162 - DNA, 22 bp, Homo sapiens
gtcacacctcactgtcatctgc

SEQ ID NO: 5500163 - DNA, 20 bp, Homo sapiens
gtcacacgcttttgaattat

SEQ ID NO: 5500164 - DNA, 15 bp, Homo sapiens
gtcacacggccaccc

SEQ ID NO: 5500165 - DNA, 21 bp, Homo sapiens
gtcacactctacacggactga

SEQ ID NO: 5500166 - DNA, 18 bp, Homo sapiens
gtcacactcttcagtgac

SEQ ID NO: 5500167 - DNA, 13 bp, Homo sapiens
gtcacactggtgc

SEQ ID NO: 5500168 - DNA, 14 bp, Homo sapiens
gtcacactggtgct

SEQ ID NO: 5500169 - DNA, 15 bp, Homo sapiens
gtcacactggtgctg

SEQ ID NO: 5500170 - DNA, 17 bp, Homo sapiens
gtcacactggtgctgag

SEQ ID NO: 5500171 - DNA, 19 bp, Homo sapiens
gtcacagaaatcagaggag

SEQ ID NO: 5500172 - DNA, 17 bp, Homo sapiens
gtcacagaaattatgat

SEQ ID NO: 5500173 - DNA, 20 bp, Homo sapiens
gtcacagacgtgaaagccag

SEQ ID NO: 5500174 - DNA, 22 bp, Homo sapiens
gtcacagacgtgaaagccagaa

SEQ ID NO: 5500175 - DNA, 13 bp, Homo sapiens
gtcacagaggcag

SEQ ID NO: 5500176 - DNA, 21 bp, Homo sapiens
gtcacagaggcagtggcagca

SEQ ID NO: 5500177 - DNA, 16 bp, Homo sapiens
gtcacagcctcctctg

SEQ ID NO: 5500178 - DNA, 15 bp, Homo sapiens
gtcacagctaataag

SEQ ID NO: 5500179 - DNA, 11 bp, Homo sapiens
gtcacagctgc

SEQ ID NO: 5500180 - DNA, 13 bp, Homo sapiens
gtcacagctgcag

SEQ ID NO: 5500181 - DNA, 13 bp, Homo sapiens
gtcacagctggat

SEQ ID NO: 5500182 - DNA, 16 bp, Homo sapiens
gtcacagctggatctg

SEQ ID NO: 5500183 - DNA, 12 bp, Homo sapiens
gtcacagctgta

SEQ ID NO: 5500184 - DNA, 15 bp, Homo sapiens
gtcacagctttccca

SEQ ID NO: 5500185 - DNA, 17 bp, Homo sapiens
gtcacaggaagaaagca

SEQ ID NO: 5500186 - DNA, 19 bp, Homo sapiens
gtcacaggaaggaaacaac

SEQ ID NO: 5500187 - DNA, 22 bp, Homo sapiens
gtcacaggacgatttcactgac

SEQ ID NO: 5500188 - DNA, 17 bp, Homo sapiens
gtcacaggactctgcct

SEQ ID NO: 5500189 - DNA, 19 bp, Homo sapiens
gtcacaggactctgcctcc

SEQ ID NO: 5500190 - DNA, 18 bp, Homo sapiens
gtcacaggagtctttgta

SEQ ID NO: 5500191 - DNA, 13 bp, Homo sapiens
gtcacaggcaggt

SEQ ID NO: 5500192 - DNA, 16 bp, Homo sapiens
gtcacaggcaggtcca

SEQ ID NO: 5500193 - DNA, 12 bp, Homo sapiens
gtcacaggccca

SEQ ID NO: 5500194 - DNA, 14 bp, Homo sapiens
gtcacaggcccaga

SEQ ID NO: 5500195 - DNA, 17 bp, Homo sapiens
gtcacaggcccagaagg

SEQ ID NO: 5500196 - DNA, 13 bp, Homo sapiens
gtcacaggctggg

SEQ ID NO: 5500197 - DNA, 16 bp, Homo sapiens
gtcacaggctgggtca

SEQ ID NO: 5500198 - DNA, 12 bp, Homo sapiens
gtcacaggctgt

SEQ ID NO: 5500199 - DNA, 18 bp, Homo sapiens
gtcacagggcctggggag

SEQ ID NO: 5500200 - DNA, 21 bp, Homo sapiens
gtcacaggttttcagagaatt

SEQ ID NO: 5500201 - DNA, 22 bp, Homo sapiens
gtcacaggttttcagagaatta

SEQ ID NO: 5500202 - DNA, 19 bp, Homo sapiens
gtcacagtaaagagtacac

SEQ ID NO: 5500203 - DNA, 21 bp, Homo sapiens
gtcacagtaaagagtacactc

SEQ ID NO: 5500204 - DNA, 21 bp, Homo sapiens
gtcacagtctctactgttatt

SEQ ID NO: 5500205 - DNA, 22 bp, Homo sapiens
gtcacagttcttggtgactgtc

SEQ ID NO: 5500206 - DNA, 14 bp, Homo sapiens
gtcacagtttcagg

SEQ ID NO: 5500207 - DNA, 17 bp, Homo sapiens
gtcacagtttgttcagt

SEQ ID NO: 5500208 - DNA, 18 bp, Homo sapiens
gtcacagtttgttcagtg

SEQ ID NO: 5500209 - DNA, 14 bp, Homo sapiens
gtcacatagtcgtg

SEQ ID NO: 5500210 - DNA, 18 bp, Homo sapiens
gtcacatatgtctgtatc

SEQ ID NO: 5500211 - DNA, 16 bp, Homo sapiens
gtcacatcagataaga

SEQ ID NO: 5500212 - DNA, 14 bp, Homo sapiens
gtcacatccatccc

SEQ ID NO: 5500213 - DNA, 19 bp, Homo sapiens
gtcacatccatccctccat

SEQ ID NO: 5500214 - DNA, 20 bp, Homo sapiens
gtcacatcctaatagaaaga

SEQ ID NO: 5500215 - DNA, 13 bp, Homo sapiens
gtcacatctcagg

SEQ ID NO: 5500216 - DNA, 14 bp, Homo sapiens
gtcacatctcaggg

SEQ ID NO: 5500217 - DNA, 13 bp, Homo sapiens
gtcacatgacatc

SEQ ID NO: 5500218 - DNA, 16 bp, Homo sapiens
gtcacatgactctcat

SEQ ID NO: 5500219 - DNA, 14 bp, Homo sapiens
gtcacatggagctc

SEQ ID NO: 5500220 - DNA, 23 bp, Homo sapiens
gtcacatggcctatgcacatatg

SEQ ID NO: 5500221 - DNA, 20 bp, Homo sapiens
gtcacatggggcctggccca

SEQ ID NO: 5500222 - DNA, 17 bp, Homo sapiens
gtcacattccacatctg

SEQ ID NO: 5500223 - DNA, 14 bp, Homo sapiens
gtcacattctgctt

SEQ ID NO: 5500224 - DNA, 20 bp, Homo sapiens
gtcacattgatgtaaggact

SEQ ID NO: 5500225 - DNA, 21 bp, Homo sapiens
gtcacattgcattctattgcc

SEQ ID NO: 5500226 - DNA, 22 bp, Homo sapiens
gtcacattgccatcactcttgt

SEQ ID NO: 5500227 - DNA, 13 bp, Homo sapiens
gtcacatttgaat

SEQ ID NO: 5500228 - DNA, 16 bp, Homo sapiens
gtcacatttgaattct

SEQ ID NO: 5500229 - DNA, 15 bp, Homo sapiens
gtcaccaaatttgta

SEQ ID NO: 5500230 - DNA, 15 bp, Homo sapiens
gtcaccaagcccagt

SEQ ID NO: 5500231 - DNA, 14 bp, Homo sapiens
gtcaccaaggaaac

SEQ ID NO: 5500232 - DNA, 21 bp, Homo sapiens
gtcaccaaggcagtgcatgca

SEQ ID NO: 5500233 - DNA, 18 bp, Homo sapiens
gtcaccaaggtggcttct

SEQ ID NO: 5500234 - DNA, 13 bp, Homo sapiens
gtcaccaccaccc

SEQ ID NO: 5500235 - DNA, 20 bp, Homo sapiens
gtcaccaccacccctaccac

SEQ ID NO: 5500236 - DNA, 16 bp, Homo sapiens
gtcaccacccagccct

SEQ ID NO: 5500237 - DNA, 18 bp, Homo sapiens
gtcaccacccagcccttc

SEQ ID NO: 5500238 - DNA, 19 bp, Homo sapiens
gtcaccacccagcccttcc

SEQ ID NO: 5500239 - DNA, 23 bp, Homo sapiens
gtcaccaccccagtgaggacctc

SEQ ID NO: 5500240 - DNA, 14 bp, Homo sapiens
gtcaccaccctccc

SEQ ID NO: 5500241 - DNA, 15 bp, Homo sapiens
gtcaccaccttccca

SEQ ID NO: 5500242 - DNA, 19 bp, Homo sapiens
gtcaccaccttcccagctc

SEQ ID NO: 5500243 - DNA, 16 bp, Homo sapiens
gtcaccacgactggcc

SEQ ID NO: 5500244 - DNA, 21 bp, Homo sapiens
gtcaccacgactggccagggc

SEQ ID NO: 5500245 - DNA, 18 bp, Homo sapiens
gtcaccagctatctgtca

SEQ ID NO: 5500246 - DNA, 23 bp, Homo sapiens
gtcaccagctatctgtcatctct

SEQ ID NO: 5500247 - DNA, 16 bp, Homo sapiens
gtcaccagctcctccc

SEQ ID NO: 5500248 - DNA, 16 bp, Homo sapiens
gtcaccagctgctgtg

SEQ ID NO: 5500249 - DNA, 12 bp, Homo sapiens
gtcaccaggact

SEQ ID NO: 5500250 - DNA, 19 bp, Homo sapiens
gtcaccagttaaaagcatt

SEQ ID NO: 5500251 - DNA, 14 bp, Homo sapiens
gtcaccatcatttc

SEQ ID NO: 5500252 - DNA, 16 bp, Homo sapiens
gtcaccatcatttcta

SEQ ID NO: 5500253 - DNA, 15 bp, Homo sapiens
gtcaccatctcaggc

SEQ ID NO: 5500254 - DNA, 17 bp, Homo sapiens
gtcaccatctcaggcca

SEQ ID NO: 5500255 - DNA, 17 bp, Homo sapiens
gtcaccattctgcattt

SEQ ID NO: 5500256 - DNA, 21 bp, Homo sapiens
gtcacccaaacacttctgctt

SEQ ID NO: 5500257 - DNA, 22 bp, Homo sapiens
gtcacccaaacacttctgcttt

SEQ ID NO: 5500258 - DNA, 21 bp, Homo sapiens
gtcacccaaaccggcaggtgc

SEQ ID NO: 5500259 - DNA, 15 bp, Homo sapiens
gtcacccaaagcctg

SEQ ID NO: 5500260 - DNA, 19 bp, Homo sapiens
gtcacccaaagcctgtccc

SEQ ID NO: 5500261 - DNA, 18 bp, Homo sapiens
gtcacccagcaaggcaca

SEQ ID NO: 5500262 - DNA, 19 bp, Homo sapiens
gtcacccagcaaggcacag

SEQ ID NO: 5500263 - DNA, 19 bp, Homo sapiens
gtcacccaggctggagtga

SEQ ID NO: 5500264 - DNA, 15 bp, Homo sapiens
gtcacccatcaggac

SEQ ID NO: 5500265 - DNA, 14 bp, Homo sapiens
gtcacccatggcct

SEQ ID NO: 5500266 - DNA, 15 bp, Homo sapiens
gtcacccatggcctc

SEQ ID NO: 5500267 - DNA, 14 bp, Homo sapiens
gtcaccccagagcc

SEQ ID NO: 5500268 - DNA, 19 bp, Homo sapiens
gtcaccccagagccacaca

SEQ ID NO: 5500269 - DNA, 21 bp, Homo sapiens
gtcaccccagagccacacatg

SEQ ID NO: 5500270 - DNA, 11 bp, Homo sapiens
gtcaccccagt

SEQ ID NO: 5500271 - DNA, 15 bp, Homo sapiens
gtcaccccagttccc

SEQ ID NO: 5500272 - DNA, 20 bp, Homo sapiens
gtcacccccaccccacccct

SEQ ID NO: 5500273 - DNA, 14 bp, Homo sapiens
gtcacccccactcc

SEQ ID NO: 5500274 - DNA, 18 bp, Homo sapiens
gtcacccccactcccgcc

SEQ ID NO: 5500275 - DNA, 16 bp, Homo sapiens
gtcacccccccaggcc

SEQ ID NO: 5500276 - DNA, 21 bp, Homo sapiens
gtcacccccccaggcctccag

SEQ ID NO: 5500277 - DNA, 14 bp, Homo sapiens
gtcaccccgccagc

SEQ ID NO: 5500278 - DNA, 15 bp, Homo sapiens
gtcaccccggccacc

SEQ ID NO: 5500279 - DNA, 19 bp, Homo sapiens
gtcacccctccctccctct

SEQ ID NO: 5500280 - DNA, 20 bp, Homo sapiens
gtcacccctccctccctctt

SEQ ID NO: 5500281 - DNA, 22 bp, Homo sapiens
gtcaccctagccctctccctct

SEQ ID NO: 5500282 - DNA, 22 bp, Homo sapiens
gtcaccctcctcacagacctct

SEQ ID NO: 5500283 - DNA, 15 bp, Homo sapiens
gtcaccctgcagagc

SEQ ID NO: 5500284 - DNA, 16 bp, Homo sapiens
gtcaccctgcagagct

SEQ ID NO: 5500285 - DNA, 14 bp, Homo sapiens
gtcaccctggccac

SEQ ID NO: 5500286 - DNA, 18 bp, Homo sapiens
gtcaccctggccaccacc

SEQ ID NO: 5500287 - DNA, 14 bp, Homo sapiens
gtcaccctgggagc

SEQ ID NO: 5500288 - DNA, 15 bp, Homo sapiens
gtcaccctgggagca

SEQ ID NO: 5500289 - DNA, 13 bp, Homo sapiens
gtcaccctgtggg

SEQ ID NO: 5500290 - DNA, 16 bp, Homo sapiens
gtcacccttctgggca

SEQ ID NO: 5500291 - DNA, 16 bp, Homo sapiens
gtcaccgagactcagc

SEQ ID NO: 5500292 - DNA, 17 bp, Homo sapiens
gtcagaataaagaacat

SEQ ID NO: 5500293 - DNA, 13 bp, Homo sapiens
gtcagaatagaaa

SEQ ID NO: 5500294 - DNA, 17 bp, Homo sapiens
gtcagaatagaaattag

SEQ ID NO: 5500295 - DNA, 16 bp, Homo sapiens
gtcagaataggaaaac

SEQ ID NO: 5500296 - DNA, 15 bp, Homo sapiens
gtcagaatcatgctg

SEQ ID NO: 5500297 - DNA, 15 bp, Homo sapiens
gtcagaatgctattg

SEQ ID NO: 5500298 - DNA, 16 bp, Homo sapiens
gtcagaatggaatcca

SEQ ID NO: 5500299 - DNA, 21 bp, Homo sapiens
gtcagaatggaatccatctgt

SEQ ID NO: 5500300 - DNA, 19 bp, Homo sapiens
gtcagaatgtgaaaaagga

SEQ ID NO: 5500301 - DNA, 20 bp, Homo sapiens
gtcagaatgtgaaaaaggaa

SEQ ID NO: 5500302 - DNA, 14 bp, Homo sapiens
gtcagaatgttgtg

SEQ ID NO: 5500303 - DNA, 22 bp, Homo sapiens
gtcagaatgttgtgttggtatt

SEQ ID NO: 5500304 - DNA, 17 bp, Homo sapiens
gtcagaatttttaactg

SEQ ID NO: 5500305 - DNA, 18 bp, Homo sapiens
gtcagaatttttaactgt

SEQ ID NO: 5500306 - DNA, 19 bp, Homo sapiens
gtcagaatttttaactgta

SEQ ID NO: 5500307 - DNA, 18 bp, Homo sapiens
gtcagacacagattggcc

SEQ ID NO: 5500308 - DNA, 15 bp, Homo sapiens
gtcagacagatgtca

SEQ ID NO: 5500309 - DNA, 21 bp, Homo sapiens
gtcagacagatgtcagcttcc

SEQ ID NO: 5500310 - DNA, 16 bp, Homo sapiens
gtcagacagcaaggaa

SEQ ID NO: 5500311 - DNA, 14 bp, Homo sapiens
gtcagacatttctt

SEQ ID NO: 5500312 - DNA, 20 bp, Homo sapiens
gtcagacatttctttggaaa

SEQ ID NO: 5500313 - DNA, 24 bp, Homo sapiens
gtcagacccataaaccacctccca

SEQ ID NO: 5500314 - DNA, 18 bp, Homo sapiens
gtcagacccatctctccc

SEQ ID NO: 5500315 - DNA, 14 bp, Homo sapiens
gtcagaccctggag

SEQ ID NO: 5500316 - DNA, 17 bp, Homo sapiens
gtcagacgcctgaggaa

SEQ ID NO: 5500317 - DNA, 13 bp, Homo sapiens
gtcagactgatag

SEQ ID NO: 5500318 - DNA, 17 bp, Homo sapiens
gtcagactgatagacac

SEQ ID NO: 5500319 - DNA, 15 bp, Homo sapiens
gtcagactggaggtc

SEQ ID NO: 5500320 - DNA, 20 bp, Homo sapiens
gtcagactggaggtcgaagc

SEQ ID NO: 5500321 - DNA, 16 bp, Homo sapiens
gtcagactttaaagaa

SEQ ID NO: 5500322 - DNA, 23 bp, Homo sapiens
gtcagactttgtgttcatttcat

SEQ ID NO: 5500323 - DNA, 10 bp, Homo sapiens
gtcagagaca

SEQ ID NO: 5500324 - DNA, 12 bp, Homo sapiens
gtcagagacaga

SEQ ID NO: 5500325 - DNA, 23 bp, Homo sapiens
gtcagagacagaccccttggctt

SEQ ID NO: 5500326 - DNA, 15 bp, Homo sapiens
gtcagagacggcaga

SEQ ID NO: 5500327 - DNA, 23 bp, Homo sapiens
gtcagagagacccgggaaggaag

SEQ ID NO: 5500328 - DNA, 16 bp, Homo sapiens
gtcagagatgggctga

SEQ ID NO: 5500329 - DNA, 16 bp, Homo sapiens
gtcagagccacagggt

SEQ ID NO: 5500330 - DNA, 22 bp, Homo sapiens
gtcagagccacagggtctgcct

SEQ ID NO: 5500331 - DNA, 23 bp, Homo sapiens
gtcagagccacagggtctgcctc

SEQ ID NO: 5500332 - DNA, 17 bp, Homo sapiens
gtcagagccaggctctg

SEQ ID NO: 5500333 - DNA, 20 bp, Homo sapiens
gtcagagccatgtcttctcc

SEQ ID NO: 5500334 - DNA, 21 bp, Homo sapiens
gtcagagccatgtcttctccc

SEQ ID NO: 5500335 - DNA, 22 bp, Homo sapiens
gtcagagccatgtcttctccct

SEQ ID NO: 5500336 - DNA, 14 bp, Homo sapiens
gtcagagcccagga

SEQ ID NO: 5500337 - DNA, 13 bp, Homo sapiens
gtcagagccctgg

SEQ ID NO: 5500338 - DNA, 16 bp, Homo sapiens
gtcagagccctggctg

SEQ ID NO: 5500339 - DNA, 22 bp, Homo sapiens
gtcagagccctggctgggttca

SEQ ID NO: 5500340 - DNA, 15 bp, Homo sapiens
gtcagagcctacctt

SEQ ID NO: 5500341 - DNA, 16 bp, Homo sapiens
gtcagagcctgcagtt

SEQ ID NO: 5500342 - DNA, 17 bp, Homo sapiens
gtcagagctgttggcct

SEQ ID NO: 5500343 - DNA, 16 bp, Homo sapiens
gtcagaggaccccagg

SEQ ID NO: 5500344 - DNA, 14 bp, Homo sapiens
gtcagaggagaaga

SEQ ID NO: 5500345 - DNA, 17 bp, Homo sapiens
gtcagaggagcgcaggc

SEQ ID NO: 5500346 - DNA, 16 bp, Homo sapiens
gtcagaggatggccag

SEQ ID NO: 5500347 - DNA, 19 bp, Homo sapiens
gtcagaggctaagatgaga

SEQ ID NO: 5500348 - DNA, 18 bp, Homo sapiens
gtcagagtaacatgccag

SEQ ID NO: 5500349 - DNA, 17 bp, Homo sapiens
gtcagagtccagtgctc

SEQ ID NO: 5500350 - DNA, 20 bp, Homo sapiens
gtcagagtccagtgctctgc

SEQ ID NO: 5500351 - DNA, 16 bp, Homo sapiens
gtcagagtgttgttcc

SEQ ID NO: 5500352 - DNA, 18 bp, Homo sapiens
gtcagataagtgtaaata

SEQ ID NO: 5500353 - DNA, 15 bp, Homo sapiens
gtcagatacaatgta

SEQ ID NO: 5500354 - DNA, 14 bp, Homo sapiens
gtcagatccaggag

SEQ ID NO: 5500355 - DNA, 18 bp, Homo sapiens
gtcagatccaggagctcc

SEQ ID NO: 5500356 - DNA, 16 bp, Homo sapiens
gtcagatcgttcattg

SEQ ID NO: 5500357 - DNA, 16 bp, Homo sapiens
gtcagatctgcctaag

SEQ ID NO: 5500358 - DNA, 19 bp, Homo sapiens
gtcagatctgcctaaggac

SEQ ID NO: 5500359 - DNA, 14 bp, Homo sapiens
gtcagatgagaaca

SEQ ID NO: 5500360 - DNA, 16 bp, Homo sapiens
gtcagatgagaacaaa

SEQ ID NO: 5500361 - DNA, 18 bp, Homo sapiens
gtcagatgagaacaaagc

SEQ ID NO: 5500362 - DNA, 21 bp, Homo sapiens
gtcagatgagaacaaagctgt

SEQ ID NO: 5500363 - DNA, 15 bp, Homo sapiens
gtcagatgagcaagg

SEQ ID NO: 5500364 - DNA, 19 bp, Homo sapiens
gtcagatgagcaaggacat

SEQ ID NO: 5500365 - DNA, 22 bp, Homo sapiens
gtcagatgagcaaggacattgc

SEQ ID NO: 5500366 - DNA, 12 bp, Homo sapiens
gtcagatgaggc

SEQ ID NO: 5500367 - DNA, 13 bp, Homo sapiens
gtcagatgaggca

SEQ ID NO: 5500368 - DNA, 20 bp, Homo sapiens
gtcagatgaggccctgcacc

SEQ ID NO: 5500369 - DNA, 21 bp, Homo sapiens
gtcagatgcccgagggagggg

SEQ ID NO: 5500370 - DNA, 16 bp, Homo sapiens
gtcagatgcgtgccca

SEQ ID NO: 5500371 - DNA, 16 bp, Homo sapiens
gtcagatggatgtaga

SEQ ID NO: 5500372 - DNA, 17 bp, Homo sapiens
gtcagatggatgtagat

SEQ ID NO: 5500373 - DNA, 15 bp, Homo sapiens
gtcagatgtttaaaa

SEQ ID NO: 5500374 - DNA, 18 bp, Homo sapiens
gtcagatgtttaaaacac

SEQ ID NO: 5500375 - DNA, 19 bp, Homo sapiens
gtcagatgtttaaaacacc

SEQ ID NO: 5500376 - DNA, 12 bp, Homo sapiens
gtcagattaaat

SEQ ID NO: 5500377 - DNA, 13 bp, Homo sapiens
gtcagatttctgg

SEQ ID NO: 5500378 - DNA, 13 bp, Homo sapiens
gtcagatttttaa

SEQ ID NO: 5500379 - DNA, 17 bp, Homo sapiens
gtcagatttttaaagtt

SEQ ID NO: 5500380 - DNA, 18 bp, Homo sapiens
gtcagatttttatttatg

SEQ ID NO: 5500381 - DNA, 15 bp, Homo sapiens
gtcagcaaaaagcaa

SEQ ID NO: 5500382 - DNA, 16 bp, Homo sapiens
gtcagcaatttaacta

SEQ ID NO: 5500383 - DNA, 22 bp, Homo sapiens
gtcagcaccgtggtgtgaggcc

SEQ ID NO: 5500384 - DNA, 18 bp, Homo sapiens
gtcagcaccttggcccag

SEQ ID NO: 5500385 - DNA, 20 bp, Homo sapiens
gtcagcacgtagtttgcatt

SEQ ID NO: 5500386 - DNA, 19 bp, Homo sapiens
gtcagcagaaacccccagg

SEQ ID NO: 5500387 - DNA, 21 bp, Homo sapiens
gtcagcagaaacccccaggag

SEQ ID NO: 5500388 - DNA, 22 bp, Homo sapiens
gtcagcagaaacccccaggagg

SEQ ID NO: 5500389 - DNA, 18 bp, Homo sapiens
gtcagcagacacacatgg

SEQ ID NO: 5500390 - DNA, 15 bp, Homo sapiens
gtcagcagagccgcc

SEQ ID NO: 5500391 - DNA, 15 bp, Homo sapiens
gtcagcagctctgag

SEQ ID NO: 5500392 - DNA, 16 bp, Homo sapiens
gtcagcaggcaggctg

SEQ ID NO: 5500393 - DNA, 19 bp, Homo sapiens
gtcagcaggcaggctgggg

SEQ ID NO: 5500394 - DNA, 12 bp, Homo sapiens
gtcagcaggccc

SEQ ID NO: 5500395 - DNA, 17 bp, Homo sapiens
gtcagcaggcccaggag

SEQ ID NO: 5500396 - DNA, 13 bp, Homo sapiens
gtcagcagggacc

SEQ ID NO: 5500397 - DNA, 13 bp, Homo sapiens
gtcagcagggggg

SEQ ID NO: 5500398 - DNA, 14 bp, Homo sapiens
gtcagcagttgctg

SEQ ID NO: 5500399 - DNA, 14 bp, Homo sapiens
gtcagcatcactga

SEQ ID NO: 5500400 - DNA, 10 bp, Homo sapiens
gtcagcatct

SEQ ID NO: 5500401 - DNA, 12 bp, Homo sapiens
gtcagcatctga

SEQ ID NO: 5500402 - DNA, 15 bp, Homo sapiens
gtcagcatctgacca

SEQ ID NO: 5500403 - DNA, 23 bp, Homo sapiens
gtcagcatctgaccatctgtgac

SEQ ID NO: 5500404 - DNA, 17 bp, Homo sapiens
gtcagcatctttgccct

SEQ ID NO: 5500405 - DNA, 14 bp, Homo sapiens
gtcagcatgaattt

SEQ ID NO: 5500406 - DNA, 19 bp, Homo sapiens
gtcagcatgcttcccagag

SEQ ID NO: 5500407 - DNA, 20 bp, Homo sapiens
gtcagcatgcttcccagagg

SEQ ID NO: 5500408 - DNA, 23 bp, Homo sapiens
gtcagccaaatgacttcatttct

SEQ ID NO: 5500409 - DNA, 11 bp, Homo sapiens
gtcagccaagt

SEQ ID NO: 5500410 - DNA, 15 bp, Homo sapiens
gtcagccactgtgat

SEQ ID NO: 5500411 - DNA, 11 bp, Homo sapiens
gtcagccagcc

SEQ ID NO: 5500412 - DNA, 12 bp, Homo sapiens
gtcagccagccg

SEQ ID NO: 5500413 - DNA, 20 bp, Homo sapiens
gtcagccaggagctgtcacc

SEQ ID NO: 5500414 - DNA, 16 bp, Homo sapiens
gtcagccagggccagg

SEQ ID NO: 5500415 - DNA, 15 bp, Homo sapiens
gtcagccatcagcca

SEQ ID NO: 5500416 - DNA, 17 bp, Homo sapiens
gtcagccatcagccatg

SEQ ID NO: 5500417 - DNA, 23 bp, Homo sapiens
gtcagccatcagccatggccctc

SEQ ID NO: 5500418 - DNA, 22 bp, Homo sapiens
gtcagccatcgccaacttgtct

SEQ ID NO: 5500419 - DNA, 13 bp, Homo sapiens
gtcagccatgtct

SEQ ID NO: 5500420 - DNA, 13 bp, Homo sapiens
gtcagccattgca

SEQ ID NO: 5500421 - DNA, 23 bp, Homo sapiens
gtcagcccaaaccaccagaagcc

SEQ ID NO: 5500422 - DNA, 16 bp, Homo sapiens
gtcagcccaagattct

SEQ ID NO: 5500423 - DNA, 21 bp, Homo sapiens
gtcagcccagcacctgctccc

SEQ ID NO: 5500424 - DNA, 23 bp, Homo sapiens
gtcagcccatggaggcagatgcc

SEQ ID NO: 5500425 - DNA, 18 bp, Homo sapiens
gtcagccccaagggctgg

SEQ ID NO: 5500426 - DNA, 19 bp, Homo sapiens
gtcagccccaagggctggg

SEQ ID NO: 5500427 - DNA, 21 bp, Homo sapiens
gtcagccctcactgtcagtcc

SEQ ID NO: 5500428 - DNA, 15 bp, Homo sapiens
gtcagccctgctgtc

SEQ ID NO: 5500429 - DNA, 14 bp, Homo sapiens
gtcagccctgtgtc

SEQ ID NO: 5500430 - DNA, 22 bp, Homo sapiens
gtcagccctgtgtctgtcacag

SEQ ID NO: 5500431 - DNA, 18 bp, Homo sapiens
gtcagcccttggcttctg

SEQ ID NO: 5500432 - DNA, 21 bp, Homo sapiens
gtcagccgagccgggcctggg

SEQ ID NO: 5500433 - DNA, 15 bp, Homo sapiens
gtcagccgggccctg

SEQ ID NO: 5500434 - DNA, 15 bp, Homo sapiens
gtcagcctcagagca

SEQ ID NO: 5500435 - DNA, 15 bp, Homo sapiens
gtcagcctccagcct

SEQ ID NO: 5500436 - DNA, 19 bp, Homo sapiens
gtcagcctccagcctctgt

SEQ ID NO: 5500437 - DNA, 22 bp, Homo sapiens
gtcagcctccctgacgtctgcc

SEQ ID NO: 5500438 - DNA, 16 bp, Homo sapiens
gtcagcctcgcaggcc

SEQ ID NO: 5500439 - DNA, 11 bp, Homo sapiens
gtcagcctctc

SEQ ID NO: 5500440 - DNA, 16 bp, Homo sapiens
gtcagcctctctccca

SEQ ID NO: 5500441 - DNA, 20 bp, Homo sapiens
gtcagcctggaagggacagt

SEQ ID NO: 5500442 - DNA, 22 bp, Homo sapiens
gtcagcctggaagggacagtat

SEQ ID NO: 5500443 - DNA, 14 bp, Homo sapiens
gtcagcctggctgg

SEQ ID NO: 5500444 - DNA, 22 bp, Homo sapiens
gtcagcctggctgggctctggt

SEQ ID NO: 5500445 - DNA, 14 bp, Homo sapiens
gtcagcctgtgctg

SEQ ID NO: 5500446 - DNA, 13 bp, Homo sapiens
gtcagcctttgtt

SEQ ID NO: 5500447 - DNA, 17 bp, Homo sapiens
gtcagcctttgttaacc

SEQ ID NO: 5500448 - DNA, 14 bp, Homo sapiens
gtcagcgactggat

SEQ ID NO: 5500449 - DNA, 22 bp, Homo sapiens
gtcagcgactggatgctcgcca

SEQ ID NO: 5500450 - DNA, 14 bp, Homo sapiens
gtcagcgagaagga

SEQ ID NO: 5500451 - DNA, 15 bp, Homo sapiens
gtcagcggagaggac

SEQ ID NO: 5500452 - DNA, 14 bp, Homo sapiens
gtcagcggcctggg

SEQ ID NO: 5500453 - DNA, 15 bp, Homo sapiens
gtcagcggggcagcg

SEQ ID NO: 5500454 - DNA, 21 bp, Homo sapiens
gtcagcggggcagcggggctg

SEQ ID NO: 5500455 - DNA, 16 bp, Homo sapiens
gtcagcggtatgtgcg

SEQ ID NO: 5500456 - DNA, 13 bp, Homo sapiens
gtcagcggtgcag

SEQ ID NO: 5500457 - DNA, 20 bp, Homo sapiens
gtcagcgtgcttagcctcct

SEQ ID NO: 5500458 - DNA, 21 bp, Homo sapiens
gtcagcgttctaccaggcaaa

SEQ ID NO: 5500459 - DNA, 19 bp, Homo sapiens
gtcagcgttgcatgtcgtg

SEQ ID NO: 5500460 - DNA, 12 bp, Homo sapiens
gtcagctaattg

SEQ ID NO: 5500461 - DNA, 15 bp, Homo sapiens
gtcagctcacaccct

SEQ ID NO: 5500462 - DNA, 15 bp, Homo sapiens
gtcagctcccttctc

SEQ ID NO: 5500463 - DNA, 21 bp, Homo sapiens
gtcagctctctgccctgtgta

SEQ ID NO: 5500464 - DNA, 20 bp, Homo sapiens
gtcagctcttgtcaaaaggt

SEQ ID NO: 5500465 - DNA, 18 bp, Homo sapiens
gtcagctgaccccctccc

SEQ ID NO: 5500466 - DNA, 16 bp, Homo sapiens
gtcagctgagcttgag

SEQ ID NO: 5500467 - DNA, 21 bp, Homo sapiens
gtcagctgagcttgagctccc

SEQ ID NO: 5500468 - DNA, 14 bp, Homo sapiens
gtcagctgggagcc

SEQ ID NO: 5500469 - DNA, 17 bp, Homo sapiens
gtcagctgggagccagt

SEQ ID NO: 5500470 - DNA, 18 bp, Homo sapiens
gtcagctgggagccagtg

SEQ ID NO: 5500471 - DNA, 15 bp, Homo sapiens
gtcataaatgtcaca

SEQ ID NO: 5500472 - DNA, 17 bp, Homo sapiens
gtcataaattactgttt

SEQ ID NO: 5500473 - DNA, 16 bp, Homo sapiens
gtcataaatttgaata

SEQ ID NO: 5500474 - DNA, 12 bp, Homo sapiens
gtcataacattt

SEQ ID NO: 5500475 - DNA, 21 bp, Homo sapiens
gtcataacggttaagaaagca

SEQ ID NO: 5500476 - DNA, 16 bp, Homo sapiens
gtcataagtgaatatt

SEQ ID NO: 5500477 - DNA, 16 bp, Homo sapiens
gtcataagtggggaga

SEQ ID NO: 5500478 - DNA, 17 bp, Homo sapiens
gtcataagtggggagag

SEQ ID NO: 5500479 - DNA, 20 bp, Homo sapiens
gtcataataaagttgtttta

SEQ ID NO: 5500480 - DNA, 12 bp, Homo sapiens
gtcataataaat

SEQ ID NO: 5500481 - DNA, 16 bp, Homo sapiens
gtcataattgcattga

SEQ ID NO: 5500482 - DNA, 17 bp, Homo sapiens
gtcatacaatccattct

SEQ ID NO: 5500483 - DNA, 16 bp, Homo sapiens
gtcatacagagaagtc

SEQ ID NO: 5500484 - DNA, 13 bp, Homo sapiens
gtcatacatagga

SEQ ID NO: 5500485 - DNA, 19 bp, Homo sapiens
gtcataccgtgacagcccg

SEQ ID NO: 5500486 - DNA, 18 bp, Homo sapiens
gtcatactcgagtctgag

SEQ ID NO: 5500487 - DNA, 19 bp, Homo sapiens
gtcatactcgagtctgagg

SEQ ID NO: 5500488 - DNA, 20 bp, Homo sapiens
gtcatactcgagtctgaggc

SEQ ID NO: 5500489 - DNA, 19 bp, Homo sapiens
gtcatactgtgcaggcctg

SEQ ID NO: 5500490 - DNA, 12 bp, Homo sapiens
gtcatagaaatt

SEQ ID NO: 5500491 - DNA, 13 bp, Homo sapiens
gtcatagaaatta

SEQ ID NO: 5500492 - DNA, 22 bp, Homo sapiens
gtcatagaaattacacccaaag

SEQ ID NO: 5500493 - DNA, 21 bp, Homo sapiens
gtcatagacaattcctccaga

SEQ ID NO: 5500494 - DNA, 22 bp, Homo sapiens
gtcatagacaattcctccagag

SEQ ID NO: 5500495 - DNA, 21 bp, Homo sapiens
gtcatagactcctttgctaat

SEQ ID NO: 5500496 - DNA, 14 bp, Homo sapiens
gtcatagattcttg

SEQ ID NO: 5500497 - DNA, 19 bp, Homo sapiens
gtcatagggattgtccctg

SEQ ID NO: 5500498 - DNA, 20 bp, Homo sapiens
gtcataggttttaaatctgc

SEQ ID NO: 5500499 - DNA, 21 bp, Homo sapiens
gtcataggttttaaatctgct

SEQ ID NO: 5500500 - DNA, 22 bp, Homo sapiens
gtcataggttttaaatctgctt

SEQ ID NO: 5500501 - DNA, 23 bp, Homo sapiens
gtcataggttttaaatctgcttt

SEQ ID NO: 5500502 - DNA, 20 bp, Homo sapiens
gtcatagtttttttcttttt

SEQ ID NO: 5500503 - DNA, 21 bp, Homo sapiens
gtcatataagattcatattta

SEQ ID NO: 5500504 - DNA, 17 bp, Homo sapiens
gtcatatactgccatgt

SEQ ID NO: 5500505 - DNA, 17 bp, Homo sapiens
gtcatatattcatgtaa

SEQ ID NO: 5500506 - DNA, 21 bp, Homo sapiens
gtcatatattcatgtaataaa

SEQ ID NO: 5500507 - DNA, 14 bp, Homo sapiens
gtcatatcaaataa

SEQ ID NO: 5500508 - DNA, 22 bp, Homo sapiens
gtcatatcaaataaagagagaa

SEQ ID NO: 5500509 - DNA, 13 bp, Homo sapiens
gtcatatcttcac

SEQ ID NO: 5500510 - DNA, 15 bp, Homo sapiens
gtcatatgtttattc

SEQ ID NO: 5500511 - DNA, 14 bp, Homo sapiens
gtcatatgtttgct

SEQ ID NO: 5500512 - DNA, 16 bp, Homo sapiens
gtcatattttgattat

SEQ ID NO: 5500513 - DNA, 21 bp, Homo sapiens
gtcatattttgccactgcctt

SEQ ID NO: 5500514 - DNA, 20 bp, Homo sapiens
gtcatcaaacatttgccaag

SEQ ID NO: 5500515 - DNA, 14 bp, Homo sapiens
gtcatcaacaatga

SEQ ID NO: 5500516 - DNA, 19 bp, Homo sapiens
gtcatcaacaatgattaat

SEQ ID NO: 5500517 - DNA, 15 bp, Homo sapiens
gtcatcaatccagga

SEQ ID NO: 5500518 - DNA, 15 bp, Homo sapiens
gtcatcaccaccctt

SEQ ID NO: 5500519 - DNA, 16 bp, Homo sapiens
gtcatcactccctgga

SEQ ID NO: 5500520 - DNA, 23 bp, Homo sapiens
gtcatcactctaggttttacaga

SEQ ID NO: 5500521 - DNA, 16 bp, Homo sapiens
gtcatcacttttcagt

SEQ ID NO: 5500522 - DNA, 16 bp, Homo sapiens
gtcatcagatatgctt

SEQ ID NO: 5500523 - DNA, 15 bp, Homo sapiens
gtcatcagtaagtat

SEQ ID NO: 5500524 - DNA, 21 bp, Homo sapiens
gtcatcagtattgtgtaaagg

SEQ ID NO: 5500525 - DNA, 23 bp, Homo sapiens
gtcatcatcagacttgcggccac

SEQ ID NO: 5500526 - DNA, 21 bp, Homo sapiens
gtcatcatcagggcctggggc

SEQ ID NO: 5500527 - DNA, 23 bp, Homo sapiens
gtcatcatcagggcctggggcct

SEQ ID NO: 5500528 - DNA, 21 bp, Homo sapiens
gtcatcatcatggccagctgg

SEQ ID NO: 5500529 - DNA, 19 bp, Homo sapiens
gtcatcatctcttgataaa

SEQ ID NO: 5500530 - DNA, 17 bp, Homo sapiens
gtcatcatctttttgtg

SEQ ID NO: 5500531 - DNA, 23 bp, Homo sapiens
gtcatcatgaactggcttgtaca

SEQ ID NO: 5500532 - DNA, 18 bp, Homo sapiens
gtcatcatgttttgattt

SEQ ID NO: 5500533 - DNA, 15 bp, Homo sapiens
gtcatccaacaagaa

SEQ ID NO: 5500534 - DNA, 22 bp, Homo sapiens
gtcatccacacaacaccaggac

SEQ ID NO: 5500535 - DNA, 23 bp, Homo sapiens
gtcatccagaaaatgtgtcagca

SEQ ID NO: 5500536 - DNA, 16 bp, Homo sapiens
gtcatccatatttgct

SEQ ID NO: 5500537 - DNA, 20 bp, Homo sapiens
gtcatccatgccctcccagg

SEQ ID NO: 5500538 - DNA, 13 bp, Homo sapiens
gtcatcccagcac

SEQ ID NO: 5500539 - DNA, 18 bp, Homo sapiens
gtcatcccagcacctgcc

SEQ ID NO: 5500540 - DNA, 21 bp, Homo sapiens
gtcatcccagcacctgccagg

SEQ ID NO: 5500541 - DNA, 19 bp, Homo sapiens
gtcatcccctctcaggaga

SEQ ID NO: 5500542 - DNA, 18 bp, Homo sapiens
gtcatcccggggccatgg

SEQ ID NO: 5500543 - DNA, 22 bp, Homo sapiens
gtcatcccggggccatggaagc

SEQ ID NO: 5500544 - DNA, 13 bp, Homo sapiens
gtcatcccttcct

SEQ ID NO: 5500545 - DNA, 16 bp, Homo sapiens
gtcatcccttcctcct

SEQ ID NO: 5500546 - DNA, 18 bp, Homo sapiens
gtcatccgaaagtgagga

SEQ ID NO: 5500547 - DNA, 14 bp, Homo sapiens
gtcatcctcccttg

SEQ ID NO: 5500548 - DNA, 13 bp, Homo sapiens
gtcatcctgggca

SEQ ID NO: 5500549 - DNA, 16 bp, Homo sapiens
gtcatcctgggcatgt

SEQ ID NO: 5500550 - DNA, 17 bp, Homo sapiens
gtcatcggcgtggccca

SEQ ID NO: 5500551 - DNA, 16 bp, Homo sapiens
gtcatcgttccccacc

SEQ ID NO: 5500552 - DNA, 17 bp, Homo sapiens
gtcatcgttccccaccc

SEQ ID NO: 5500553 - DNA, 15 bp, Homo sapiens
gtcatctacttaata

SEQ ID NO: 5500554 - DNA, 16 bp, Homo sapiens
gtcatctagttttaaa

SEQ ID NO: 5500555 - DNA, 19 bp, Homo sapiens
gtcatctcaaacactgctt

SEQ ID NO: 5500556 - DNA, 16 bp, Homo sapiens
gtcatctcagctggat

SEQ ID NO: 5500557 - DNA, 20 bp, Homo sapiens
gtcatctcagggtccagacc

SEQ ID NO: 5500558 - DNA, 17 bp, Homo sapiens
gtcatctcatgatacag

SEQ ID NO: 5500559 - DNA, 17 bp, Homo sapiens
gtcatctcattccactg

SEQ ID NO: 5500560 - DNA, 18 bp, Homo sapiens
gtcatctctcctgtgtct

SEQ ID NO: 5500561 - DNA, 14 bp, Homo sapiens
gtcatctctctggg

SEQ ID NO: 5500562 - DNA, 15 bp, Homo sapiens
gtcatctctctgggg

SEQ ID NO: 5500563 - DNA, 23 bp, Homo sapiens
gtcatctctctggggccctgggc

SEQ ID NO: 5500564 - DNA, 19 bp, Homo sapiens
gtcatctgcggggcttctg

SEQ ID NO: 5500565 - DNA, 22 bp, Homo sapiens
gtcatctgcggggcttctgggt

SEQ ID NO: 5500566 - DNA, 18 bp, Homo sapiens
gtcatctgctccttcctg

SEQ ID NO: 5500567 - DNA, 15 bp, Homo sapiens
gtcatctgtaaaata

SEQ ID NO: 5500568 - DNA, 21 bp, Homo sapiens
gtcatctgtaagagcttgctc

SEQ ID NO: 5500569 - DNA, 23 bp, Homo sapiens
gtcatctgtaagagcttgctcca

SEQ ID NO: 5500570 - DNA, 12 bp, Homo sapiens
gtcatctgtagg

SEQ ID NO: 5500571 - DNA, 12 bp, Homo sapiens
gtcatcttccct

SEQ ID NO: 5500572 - DNA, 22 bp, Homo sapiens
gtcatcttccctgcccctgtgc

SEQ ID NO: 5500573 - DNA, 22 bp, Homo sapiens
gtcatcttgaccaagcaggaag

SEQ ID NO: 5500574 - DNA, 12 bp, Homo sapiens
gtcatcttgagc

SEQ ID NO: 5500575 - DNA, 15 bp, Homo sapiens
gtcatcttgcacaca

SEQ ID NO: 5500576 - DNA, 18 bp, Homo sapiens
gtcatcttgtgagtggat

SEQ ID NO: 5500577 - DNA, 21 bp, Homo sapiens
gtcatcttgtgagtggataat

SEQ ID NO: 5500578 - DNA, 13 bp, Homo sapiens
gtcatcttttaga

SEQ ID NO: 5500579 - DNA, 18 bp, Homo sapiens
gtcatctttttctctaaa

SEQ ID NO: 5500580 - DNA, 23 bp, Homo sapiens
gtcatgaacatggtcagaacctt

SEQ ID NO: 5500581 - DNA, 18 bp, Homo sapiens
gtcatgaacatgttcctg

SEQ ID NO: 5500582 - DNA, 23 bp, Homo sapiens
gtcatgaagctcagtttggctgt

SEQ ID NO: 5500583 - DNA, 21 bp, Homo sapiens
gtcatgaagtgcacaggagcc

SEQ ID NO: 5500584 - DNA, 20 bp, Homo sapiens
gtcatgacaagatgggacag

SEQ ID NO: 5500585 - DNA, 16 bp, Homo sapiens
gtcatgacagtgcttg

SEQ ID NO: 5500586 - DNA, 20 bp, Homo sapiens
gtcatgactttcagattgta

SEQ ID NO: 5500587 - DNA, 17 bp, Homo sapiens
gtcatgagaattacaga

SEQ ID NO: 5500588 - DNA, 16 bp, Homo sapiens
gtcatgatctccctgc

SEQ ID NO: 5500589 - DNA, 19 bp, Homo sapiens
gtcatgatctccctgccgc

SEQ ID NO: 5500590 - DNA, 16 bp, Homo sapiens
gtcatgatgctctttc

SEQ ID NO: 5500591 - DNA, 15 bp, Homo sapiens
gtcatgatggcacca

SEQ ID NO: 5500592 - DNA, 16 bp, Homo sapiens
gtcatgatgtctgcaa

SEQ ID NO: 5500593 - DNA, 14 bp, Homo sapiens
gtcatgatgttttt

SEQ ID NO: 5500594 - DNA, 13 bp, Homo sapiens
gtcatgattgccg

SEQ ID NO: 5500595 - DNA, 22 bp, Homo sapiens
gtcatgatttctgtgaagcaaa

SEQ ID NO: 5500596 - DNA, 16 bp, Homo sapiens
gtcatgcaaaggctgg

SEQ ID NO: 5500597 - DNA, 15 bp, Homo sapiens
gtcatgcaagtgaga

SEQ ID NO: 5500598 - DNA, 19 bp, Homo sapiens
gtcatgcacagtatttgta

SEQ ID NO: 5500599 - DNA, 24 bp, Homo sapiens
gtcatgcacagtatttgtaattaa

SEQ ID NO: 5500600 - DNA, 19 bp, Homo sapiens
gtcatgcagttcctggccc

SEQ ID NO: 5500601 - DNA, 16 bp, Homo sapiens
gtcatgcccagcttgg

SEQ ID NO: 5500602 - DNA, 22 bp, Homo sapiens
gtcatgcccagcttggagtgcc

SEQ ID NO: 5500603 - DNA, 18 bp, Homo sapiens
gtcatgcctcactttctt

SEQ ID NO: 5500604 - DNA, 22 bp, Homo sapiens
gtcatgcggtttccaaggtgca

SEQ ID NO: 5500605 - DNA, 16 bp, Homo sapiens
gtcatgcgtgttgaat

SEQ ID NO: 5500606 - DNA, 20 bp, Homo sapiens
gtcatgctcacttttgtgaa

SEQ ID NO: 5500607 - DNA, 16 bp, Homo sapiens
gtcatgctcagccttg

SEQ ID NO: 5500608 - DNA, 22 bp, Homo sapiens
gtcatgctcagccttgctgctc

SEQ ID NO: 5500609 - DNA, 19 bp, Homo sapiens
gtcatgctcccctgtgcca

SEQ ID NO: 5500610 - DNA, 13 bp, Homo sapiens
gtcatgctgcctt

SEQ ID NO: 5500611 - DNA, 14 bp, Homo sapiens
gtcatggaaaagcc

SEQ ID NO: 5500612 - DNA, 17 bp, Homo sapiens
gtcatggaaaagcccag

SEQ ID NO: 5500613 - DNA, 19 bp, Homo sapiens
gtcatggaatcttgctgca

SEQ ID NO: 5500614 - DNA, 15 bp, Homo sapiens
gtcatggacattcat

SEQ ID NO: 5500615 - DNA, 16 bp, Homo sapiens
gtcatggactgttgcc

SEQ ID NO: 5500616 - DNA, 20 bp, Homo sapiens
gtcatggagcagcccccaaa

SEQ ID NO: 5500617 - DNA, 17 bp, Homo sapiens
gtcatggccacactgtg

SEQ ID NO: 5500618 - DNA, 20 bp, Homo sapiens
gtcatggccacactgtgaca

SEQ ID NO: 5500619 - DNA, 22 bp, Homo sapiens
gtcatggccacactgtgacaca

SEQ ID NO: 5500620 - DNA, 15 bp, Homo sapiens
gtcatggccttgaaa

SEQ ID NO: 5500621 - DNA, 19 bp, Homo sapiens
gtcatggctcaaggattca

SEQ ID NO: 5500622 - DNA, 20 bp, Homo sapiens
gtcatggcttaatgtttatt

SEQ ID NO: 5500623 - DNA, 21 bp, Homo sapiens
gtcatgggaacgcagcctcca

SEQ ID NO: 5500624 - DNA, 23 bp, Homo sapiens
gtcatgggaacgcagcctccagt

SEQ ID NO: 5500625 - DNA, 20 bp, Homo sapiens
gtcatgggccccccatgcat

SEQ ID NO: 5500626 - DNA, 22 bp, Homo sapiens
gtcatgggccccccatgcatac

SEQ ID NO: 5500627 - DNA, 20 bp, Homo sapiens
gtcatggggatcaattttca

SEQ ID NO: 5500628 - DNA, 14 bp, Homo sapiens
gtcatggtcacagt

SEQ ID NO: 5500629 - DNA, 16 bp, Homo sapiens
gtcatggtcctggctg

SEQ ID NO: 5500630 - DNA, 15 bp, Homo sapiens
gtcatggtgatgcaa

SEQ ID NO: 5500631 - DNA, 17 bp, Homo sapiens
gtcatggtgcaatttgt

SEQ ID NO: 5500632 - DNA, 19 bp, Homo sapiens
gtcatggtgcaatttgtct

SEQ ID NO: 5500633 - DNA, 24 bp, Homo sapiens
gtcatggttggtaaccatgtaggt

SEQ ID NO: 5500634 - DNA, 15 bp, Homo sapiens
gtcatgtaatactga

SEQ ID NO: 5500635 - DNA, 17 bp, Homo sapiens
gtcatgtaccatcaata

SEQ ID NO: 5500636 - DNA, 15 bp, Homo sapiens
gtcatgtagctgttt

SEQ ID NO: 5500637 - DNA, 19 bp, Homo sapiens
gtcatgtaggttgtctaaa

SEQ ID NO: 5500638 - DNA, 14 bp, Homo sapiens
gtcatgtatgcaag

SEQ ID NO: 5500639 - DNA, 15 bp, Homo sapiens
gtcatgtatgcaagt

SEQ ID NO: 5500640 - DNA, 13 bp, Homo sapiens
gtcatgtatgttt

SEQ ID NO: 5500641 - DNA, 12 bp, Homo sapiens
gtcatgtatttt

SEQ ID NO: 5500642 - DNA, 19 bp, Homo sapiens
gtcatgtctgcttgtcaaa

SEQ ID NO: 5500643 - DNA, 11 bp, Homo sapiens
gtcatgtgacc

SEQ ID NO: 5500644 - DNA, 17 bp, Homo sapiens
gtcatgtgcatctggtg

SEQ ID NO: 5500645 - DNA, 22 bp, Homo sapiens
gtcatgtgcatctggtgtagga

SEQ ID NO: 5500646 - DNA, 12 bp, Homo sapiens
gtcatgtgccac

SEQ ID NO: 5500647 - DNA, 16 bp, Homo sapiens
gtccacattctgctgc

SEQ ID NO: 5500648 - DNA, 22 bp, Homo sapiens
gtccacattctgctgcccccag

SEQ ID NO: 5500649 - DNA, 21 bp, Homo sapiens
gtccaccacttcaggggatgg

SEQ ID NO: 5500650 - DNA, 21 bp, Homo sapiens
gtccaccagacccacctggag

SEQ ID NO: 5500651 - DNA, 13 bp, Homo sapiens
gtccaccaggcct

SEQ ID NO: 5500652 - DNA, 21 bp, Homo sapiens
gtccaccaggcctcactggct

SEQ ID NO: 5500653 - DNA, 24 bp, Homo sapiens
gtccaccaggcctcactggctcat

SEQ ID NO: 5500654 - DNA, 15 bp, Homo sapiens
gtccaccagtgtgtg

SEQ ID NO: 5500655 - DNA, 16 bp, Homo sapiens
gtccaccagtgtgtgg

SEQ ID NO: 5500656 - DNA, 20 bp, Homo sapiens
gtccaccatgctctctcacc

SEQ ID NO: 5500657 - DNA, 20 bp, Homo sapiens
gtccacccacctatgtgcca

SEQ ID NO: 5500658 - DNA, 11 bp, Homo sapiens
gtccacccagc

SEQ ID NO: 5500659 - DNA, 12 bp, Homo sapiens
gtccacccagga

SEQ ID NO: 5500660 - DNA, 23 bp, Homo sapiens
gtccacccaggagccccgaggcc

SEQ ID NO: 5500661 - DNA, 13 bp, Homo sapiens
gtccacccaggct

SEQ ID NO: 5500662 - DNA, 16 bp, Homo sapiens
gtccacccaggctgca

SEQ ID NO: 5500663 - DNA, 20 bp, Homo sapiens
gtccacccccattgtgaatg

SEQ ID NO: 5500664 - DNA, 23 bp, Homo sapiens
gtccacccccattgtgaatgttg

SEQ ID NO: 5500665 - DNA, 16 bp, Homo sapiens
gtccaccccccacaca

SEQ ID NO: 5500666 - DNA, 18 bp, Homo sapiens
gtccaccccgtcccggcc

SEQ ID NO: 5500667 - DNA, 22 bp, Homo sapiens
gtccaccccgttgttgtccctg

SEQ ID NO: 5500668 - DNA, 18 bp, Homo sapiens
gtccacccgcccctgccc

SEQ ID NO: 5500669 - DNA, 20 bp, Homo sapiens
gtccacccgtttccaagcct

SEQ ID NO: 5500670 - DNA, 14 bp, Homo sapiens
gtccaccctagcct

SEQ ID NO: 5500671 - DNA, 22 bp, Homo sapiens
gtccaccctcatttctgccagc

SEQ ID NO: 5500672 - DNA, 20 bp, Homo sapiens
gtccaccctgagctcgggga

SEQ ID NO: 5500673 - DNA, 17 bp, Homo sapiens
gtccacccttccatcag

SEQ ID NO: 5500674 - DNA, 14 bp, Homo sapiens
gtccaccggcccct

SEQ ID NO: 5500675 - DNA, 16 bp, Homo sapiens
gtccaccggcccctgg

SEQ ID NO: 5500676 - DNA, 14 bp, Homo sapiens
gtccacctggagag

SEQ ID NO: 5500677 - DNA, 17 bp, Homo sapiens
gtccacctgtgctgctg

SEQ ID NO: 5500678 - DNA, 14 bp, Homo sapiens
gtccacctgtgggt

SEQ ID NO: 5500679 - DNA, 23 bp, Homo sapiens
gtccacctgtgggtgtagccagg

SEQ ID NO: 5500680 - DNA, 22 bp, Homo sapiens
gtccaccttcagccctttggct

SEQ ID NO: 5500681 - DNA, 14 bp, Homo sapiens
gtccaccttcattt

SEQ ID NO: 5500682 - DNA, 13 bp, Homo sapiens
gtccaccttctgc

SEQ ID NO: 5500683 - DNA, 19 bp, Homo sapiens
gtccaccttctgccaaggc

SEQ ID NO: 5500684 - DNA, 16 bp, Homo sapiens
gtccacgactgtctcc

SEQ ID NO: 5500685 - DNA, 15 bp, Homo sapiens
gtccacgcccaccag

SEQ ID NO: 5500686 - DNA, 17 bp, Homo sapiens
gtccacgcccaccagcc

SEQ ID NO: 5500687 - DNA, 18 bp, Homo sapiens
gtccacgcccaccagcct

SEQ ID NO: 5500688 - DNA, 23 bp, Homo sapiens
gtccacgcccaccagccttgctc

SEQ ID NO: 5500689 - DNA, 18 bp, Homo sapiens
gtccacgcggccacctca

SEQ ID NO: 5500690 - DNA, 20 bp, Homo sapiens
gtccacgcggccacctcacc

SEQ ID NO: 5500691 - DNA, 16 bp, Homo sapiens
gtccacgcgtgccgtg

SEQ ID NO: 5500692 - DNA, 19 bp, Homo sapiens
gtccacgcgtgccgtggca

SEQ ID NO: 5500693 - DNA, 20 bp, Homo sapiens
gtccacggggctcactctgg

SEQ ID NO: 5500694 - DNA, 22 bp, Homo sapiens
gtccacggggctcactctggcc

SEQ ID NO: 5500695 - DNA, 17 bp, Homo sapiens
gtccacgtacttaattt

SEQ ID NO: 5500696 - DNA, 16 bp, Homo sapiens
gtccacgtggagagaa

SEQ ID NO: 5500697 - DNA, 19 bp, Homo sapiens
gtccactcagggctgccac

SEQ ID NO: 5500698 - DNA, 12 bp, Homo sapiens
gtccactcccag

SEQ ID NO: 5500699 - DNA, 16 bp, Homo sapiens
gtccactcccagtgct

SEQ ID NO: 5500700 - DNA, 17 bp, Homo sapiens
gtccactccctgctcca

SEQ ID NO: 5500701 - DNA, 17 bp, Homo sapiens
gtccactctcggggccc

SEQ ID NO: 5500702 - DNA, 23 bp, Homo sapiens
gtccactgagactttcccctctc

SEQ ID NO: 5500703 - DNA, 20 bp, Homo sapiens
gtccactgtcactgtttctc

SEQ ID NO: 5500704 - DNA, 21 bp, Homo sapiens
gtccacttaaaatacatgaat

SEQ ID NO: 5500705 - DNA, 17 bp, Homo sapiens
gtccacttctgacagcc

SEQ ID NO: 5500706 - DNA, 15 bp, Homo sapiens
gtccacttgccaggg

SEQ ID NO: 5500707 - DNA, 16 bp, Homo sapiens
gtccacttgccagggc

SEQ ID NO: 5500708 - DNA, 17 bp, Homo sapiens
gtccacttgccagggct

SEQ ID NO: 5500709 - DNA, 14 bp, Homo sapiens
gtccacttgtaaga

SEQ ID NO: 5500710 - DNA, 14 bp, Homo sapiens
gtccacttgtgggt

SEQ ID NO: 5500711 - DNA, 18 bp, Homo sapiens
gtccacttgtgggtcctg

SEQ ID NO: 5500712 - DNA, 21 bp, Homo sapiens
gtccacttgtgggtcctgggg

SEQ ID NO: 5500713 - DNA, 16 bp, Homo sapiens
gtccactttcctctct

SEQ ID NO: 5500714 - DNA, 23 bp, Homo sapiens
gtccagaaaatagggtggacaga

SEQ ID NO: 5500715 - DNA, 14 bp, Homo sapiens
gtccagaaacaaaa

SEQ ID NO: 5500716 - DNA, 17 bp, Homo sapiens
gtccagaacaaaagata

SEQ ID NO: 5500717 - DNA, 18 bp, Homo sapiens
gtccagaagacgtggtct

SEQ ID NO: 5500718 - DNA, 19 bp, Homo sapiens
gtccagaaggagacaggca

SEQ ID NO: 5500719 - DNA, 22 bp, Homo sapiens
gtccagacaagccctgcttgct

SEQ ID NO: 5500720 - DNA, 21 bp, Homo sapiens
gtccagacacaaagagacaaa

SEQ ID NO: 5500721 - DNA, 19 bp, Homo sapiens
gtccagacaccatcaccac

SEQ ID NO: 5500722 - DNA, 12 bp, Homo sapiens
gtccagacagcc

SEQ ID NO: 5500723 - DNA, 15 bp, Homo sapiens
gtccagacagcctgt

SEQ ID NO: 5500724 - DNA, 15 bp, Homo sapiens
gtccagacccaagtc

SEQ ID NO: 5500725 - DNA, 20 bp, Homo sapiens
gtccagaccccccagcccct

SEQ ID NO: 5500726 - DNA, 14 bp, Homo sapiens
gtccagacctgggc

SEQ ID NO: 5500727 - DNA, 20 bp, Homo sapiens
gtccagacctgggccctggt

SEQ ID NO: 5500728 - DNA, 21 bp, Homo sapiens
gtccagaccttgttcacactc

SEQ ID NO: 5500729 - DNA, 22 bp, Homo sapiens
gtccagacgtcaaccaggaaca

SEQ ID NO: 5500730 - DNA, 23 bp, Homo sapiens
gtccagactcaaacggaggaagc

SEQ ID NO: 5500731 - DNA, 19 bp, Homo sapiens
gtccagactcagagggctg

SEQ ID NO: 5500732 - DNA, 19 bp, Homo sapiens
gtccagagacatgggcctc

SEQ ID NO: 5500733 - DNA, 18 bp, Homo sapiens
gtccagagagaccgagga

SEQ ID NO: 5500734 - DNA, 23 bp, Homo sapiens
gtccagagagagaagtgcccctg

SEQ ID NO: 5500735 - DNA, 19 bp, Homo sapiens
gtccagagataaaaatcat

SEQ ID NO: 5500736 - DNA, 22 bp, Homo sapiens
gtccagagccggcatccttgcc

SEQ ID NO: 5500737 - DNA, 13 bp, Homo sapiens
gtccagagctgct

SEQ ID NO: 5500738 - DNA, 16 bp, Homo sapiens
gtccagagctgcttcc

SEQ ID NO: 5500739 - DNA, 14 bp, Homo sapiens
gtccagagctggcc

SEQ ID NO: 5500740 - DNA, 17 bp, Homo sapiens
gtccagagctggccagg

SEQ ID NO: 5500741 - DNA, 13 bp, Homo sapiens
gtccagagcttgt

SEQ ID NO: 5500742 - DNA, 22 bp, Homo sapiens
gtccagaggaggtgcccgggca

SEQ ID NO: 5500743 - DNA, 18 bp, Homo sapiens
gtccagagggactggaca

SEQ ID NO: 5500744 - DNA, 21 bp, Homo sapiens
gtccagagggactggacagcc

SEQ ID NO: 5500745 - DNA, 15 bp, Homo sapiens
gtccagatggcaggc

SEQ ID NO: 5500746 - DNA, 16 bp, Homo sapiens
gtccagatggcaggct

SEQ ID NO: 5500747 - DNA, 23 bp, Homo sapiens
gtccagatgtgcaggctcctcct

SEQ ID NO: 5500748 - DNA, 22 bp, Homo sapiens
gtccagattattggctgctttg

SEQ ID NO: 5500749 - DNA, 13 bp, Homo sapiens
gtccagattgtag

SEQ ID NO: 5500750 - DNA, 14 bp, Homo sapiens
gtccagcagctgcg

SEQ ID NO: 5500751 - DNA, 15 bp, Homo sapiens
gtccagcagctgcgg

SEQ ID NO: 5500752 - DNA, 19 bp, Homo sapiens
gtccagcaggtagtgggtg

SEQ ID NO: 5500753 - DNA, 13 bp, Homo sapiens
gtccagccagctc

SEQ ID NO: 5500754 - DNA, 15 bp, Homo sapiens
gtccagcccatctcg

SEQ ID NO: 5500755 - DNA, 19 bp, Homo sapiens
gtccagcccccagtgcgct

SEQ ID NO: 5500756 - DNA, 15 bp, Homo sapiens
gtccagcccctcctc

SEQ ID NO: 5500757 - DNA, 16 bp, Homo sapiens
gtccagcccctcctcc

SEQ ID NO: 5500758 - DNA, 17 bp, Homo sapiens
gtccagcccctcctccc

SEQ ID NO: 5500759 - DNA, 18 bp, Homo sapiens
gtccagcccctcctccct

SEQ ID NO: 5500760 - DNA, 21 bp, Homo sapiens
gtccagcccctcctccctcag

SEQ ID NO: 5500761 - DNA, 17 bp, Homo sapiens
gtccagccctggctgaa

SEQ ID NO: 5500762 - DNA, 19 bp, Homo sapiens
gtccagccctggctgaagg

SEQ ID NO: 5500763 - DNA, 20 bp, Homo sapiens
gtccagccgccattgccacc

SEQ ID NO: 5500764 - DNA, 22 bp, Homo sapiens
gtccagccgccattgccaccag

SEQ ID NO: 5500765 - DNA, 14 bp, Homo sapiens
gtccagcctgcccc

SEQ ID NO: 5500766 - DNA, 22 bp, Homo sapiens
gtccagcctgccccggagctgg

SEQ ID NO: 5500767 - DNA, 19 bp, Homo sapiens
gtccagctcatctgccaaa

SEQ ID NO: 5500768 - DNA, 18 bp, Homo sapiens
gtccagctcccgctgtgg

SEQ ID NO: 5500769 - DNA, 23 bp, Homo sapiens
gtccagctcccgctgtggccgca

SEQ ID NO: 5500770 - DNA, 13 bp, Homo sapiens
gtccagctctccc

SEQ ID NO: 5500771 - DNA, 17 bp, Homo sapiens
gtccagctctcccctgc

SEQ ID NO: 5500772 - DNA, 11 bp, Homo sapiens
gtccagctctg

SEQ ID NO: 5500773 - DNA, 15 bp, Homo sapiens
gtccagctctgacat

SEQ ID NO: 5500774 - DNA, 18 bp, Homo sapiens
gtccagctctgacatccc

SEQ ID NO: 5500775 - DNA, 22 bp, Homo sapiens
gtccagctctgacatcccttcc

SEQ ID NO: 5500776 - DNA, 16 bp, Homo sapiens
gtccagctctggaggg

SEQ ID NO: 5500777 - DNA, 13 bp, Homo sapiens
gtccagctctgtg

SEQ ID NO: 5500778 - DNA, 13 bp, Homo sapiens
gtccagctggcct

SEQ ID NO: 5500779 - DNA, 18 bp, Homo sapiens
gtccagctggcctggaca

SEQ ID NO: 5500780 - DNA, 13 bp, Homo sapiens
gtccagctgggac

SEQ ID NO: 5500781 - DNA, 23 bp, Homo sapiens
gtccagctgggcctcctgcctcc

SEQ ID NO: 5500782 - DNA, 20 bp, Homo sapiens
gtccagctggggccagaggc

SEQ ID NO: 5500783 - DNA, 22 bp, Homo sapiens
gtccagctggggccagaggctg

SEQ ID NO: 5500784 - DNA, 14 bp, Homo sapiens
gtccagcttccaaa

SEQ ID NO: 5500785 - DNA, 17 bp, Homo sapiens
gtccagcttccaaagcc

SEQ ID NO: 5500786 - DNA, 23 bp, Homo sapiens
gtccagctttccttctgcccttc

SEQ ID NO: 5500787 - DNA, 12 bp, Homo sapiens
gtccaggaacaa

SEQ ID NO: 5500788 - DNA, 15 bp, Homo sapiens
gtccaggaacaagct

SEQ ID NO: 5500789 - DNA, 18 bp, Homo sapiens
gtccaggaacaagctaat

SEQ ID NO: 5500790 - DNA, 21 bp, Homo sapiens
gtccaggactgggtctgacct

SEQ ID NO: 5500791 - DNA, 22 bp, Homo sapiens
gtccaggactgggtctgacctg

SEQ ID NO: 5500792 - DNA, 23 bp, Homo sapiens
gtccaggagaagtgctccctgga

SEQ ID NO: 5500793 - DNA, 17 bp, Homo sapiens
gtccaggagaccttcca

SEQ ID NO: 5500794 - DNA, 16 bp, Homo sapiens
gtccaggagagcctgg

SEQ ID NO: 5500795 - DNA, 17 bp, Homo sapiens
gtccaggagagcctggg

SEQ ID NO: 5500796 - DNA, 14 bp, Homo sapiens
gtccaggagcccca

SEQ ID NO: 5500797 - DNA, 16 bp, Homo sapiens
gtccaggagccccagc

SEQ ID NO: 5500798 - DNA, 15 bp, Homo sapiens
gtccaggagccccgc

SEQ ID NO: 5500799 - DNA, 13 bp, Homo sapiens
gtccaggagcctg

SEQ ID NO: 5500800 - DNA, 17 bp, Homo sapiens
gtccaggagctaatctg

SEQ ID NO: 5500801 - DNA, 17 bp, Homo sapiens
gtccaggagctcaggaa

SEQ ID NO: 5500802 - DNA, 22 bp, Homo sapiens
gtccaggatctccactgataag

SEQ ID NO: 5500803 - DNA, 14 bp, Homo sapiens
gtccaggcacagga

SEQ ID NO: 5500804 - DNA, 15 bp, Homo sapiens
gtccaggcagctccc

SEQ ID NO: 5500805 - DNA, 20 bp, Homo sapiens
gtccaggcagctccctcctg

SEQ ID NO: 5500806 - DNA, 22 bp, Homo sapiens
gtccaggcagctccctcctgca

SEQ ID NO: 5500807 - DNA, 23 bp, Homo sapiens
gtccaggcatgggtcccttcccc

SEQ ID NO: 5500808 - DNA, 15 bp, Homo sapiens
gtccaggccactgtg

SEQ ID NO: 5500809 - DNA, 20 bp, Homo sapiens
gtccaggccactgtggccag

SEQ ID NO: 5500810 - DNA, 21 bp, Homo sapiens
gtccaggccactgtggccaga

SEQ ID NO: 5500811 - DNA, 22 bp, Homo sapiens
gtccaggccactgtggccagag

SEQ ID NO: 5500812 - DNA, 23 bp, Homo sapiens
gtccaggcccccaacccctcctc

SEQ ID NO: 5500813 - DNA, 19 bp, Homo sapiens
gtccaggcccccagcccct

SEQ ID NO: 5500814 - DNA, 20 bp, Homo sapiens
gtccaggcccccagcccctc

SEQ ID NO: 5500815 - DNA, 15 bp, Homo sapiens
gtccaggcctactcc

SEQ ID NO: 5500816 - DNA, 14 bp, Homo sapiens
gtccaggcctctct

SEQ ID NO: 5500817 - DNA, 20 bp, Homo sapiens
gtccaggcctctctctgctc

SEQ ID NO: 5500818 - DNA, 21 bp, Homo sapiens
gtccaggcctctctctgctcc

SEQ ID NO: 5500819 - DNA, 15 bp, Homo sapiens
gtccaggctctgggc

SEQ ID NO: 5500820 - DNA, 16 bp, Homo sapiens
gtccaggctgccgtgg

SEQ ID NO: 5500821 - DNA, 19 bp, Homo sapiens
gtccaggctggtcttgaat

SEQ ID NO: 5500822 - DNA, 20 bp, Homo sapiens
gtccagggaaacagcctctc

SEQ ID NO: 5500823 - DNA, 22 bp, Homo sapiens
gtcccagaaaaagcatcatggc

SEQ ID NO: 5500824 - DNA, 18 bp, Homo sapiens
gtcccagaaccacactgt

SEQ ID NO: 5500825 - DNA, 21 bp, Homo sapiens
gtcccagaagatgactgaggg

SEQ ID NO: 5500826 - DNA, 20 bp, Homo sapiens
gtcccagaatgcctcctgca

SEQ ID NO: 5500827 - DNA, 19 bp, Homo sapiens
gtcccagacagctggaccc

SEQ ID NO: 5500828 - DNA, 18 bp, Homo sapiens
gtcccagacatgctgccc

SEQ ID NO: 5500829 - DNA, 19 bp, Homo sapiens
gtcccagacatgctgccca

SEQ ID NO: 5500830 - DNA, 20 bp, Homo sapiens
gtcccagacatgctgcccac

SEQ ID NO: 5500831 - DNA, 23 bp, Homo sapiens
gtcccagacatgctgcccacccc

SEQ ID NO: 5500832 - DNA, 22 bp, Homo sapiens
gtcccagagacctcatcagcct

SEQ ID NO: 5500833 - DNA, 22 bp, Homo sapiens
gtcccagagcaggaggcccctg

SEQ ID NO: 5500834 - DNA, 13 bp, Homo sapiens
gtcccagaggccg

SEQ ID NO: 5500835 - DNA, 23 bp, Homo sapiens
gtcccagaggttatctgcctggc

SEQ ID NO: 5500836 - DNA, 24 bp, Homo sapiens
gtcccagaggttatctgcctggcc

SEQ ID NO: 5500837 - DNA, 19 bp, Homo sapiens
gtcccagatcaagcctgcc

SEQ ID NO: 5500838 - DNA, 20 bp, Homo sapiens
gtcccagatcaagcctgcct

SEQ ID NO: 5500839 - DNA, 13 bp, Homo sapiens
gtcccagatgctg

SEQ ID NO: 5500840 - DNA, 21 bp, Homo sapiens
gtcccagattggctcacactg

SEQ ID NO: 5500841 - DNA, 17 bp, Homo sapiens
gtcccagcacctggcac

SEQ ID NO: 5500842 - DNA, 15 bp, Homo sapiens
gtcccagcagccagc

SEQ ID NO: 5500843 - DNA, 16 bp, Homo sapiens
gtcccagcagccagcc

SEQ ID NO: 5500844 - DNA, 12 bp, Homo sapiens
gtcccagcagct

SEQ ID NO: 5500845 - DNA, 17 bp, Homo sapiens
gtcccagcagctgccag

SEQ ID NO: 5500846 - DNA, 22 bp, Homo sapiens
gtcccagcagctgccaggagca

SEQ ID NO: 5500847 - DNA, 14 bp, Homo sapiens
gtcccagcatccct

SEQ ID NO: 5500848 - DNA, 15 bp, Homo sapiens
gtcccagcatccctg

SEQ ID NO: 5500849 - DNA, 19 bp, Homo sapiens
gtcccagcatccctggagc

SEQ ID NO: 5500850 - DNA, 14 bp, Homo sapiens
gtcccagccacccc

SEQ ID NO: 5500851 - DNA, 12 bp, Homo sapiens
gtcccagccacg

SEQ ID NO: 5500852 - DNA, 14 bp, Homo sapiens
gtcccagccccagg

SEQ ID NO: 5500853 - DNA, 23 bp, Homo sapiens
gtcccagccccaggcctggcctc

SEQ ID NO: 5500854 - DNA, 21 bp, Homo sapiens
gtcccagcccctcctccctca

SEQ ID NO: 5500855 - DNA, 23 bp, Homo sapiens
gtcccagcccctcctccctcaga

SEQ ID NO: 5500856 - DNA, 14 bp, Homo sapiens
gtcccagccctggg

SEQ ID NO: 5500857 - DNA, 14 bp, Homo sapiens
gtcccagcctctgg

SEQ ID NO: 5500858 - DNA, 20 bp, Homo sapiens
gtcccagcctctggggcaga

SEQ ID NO: 5500859 - DNA, 20 bp, Homo sapiens
gtcccagcctggccaccagc

SEQ ID NO: 5500860 - DNA, 17 bp, Homo sapiens
gtcccagcctgggctcc

SEQ ID NO: 5500861 - DNA, 22 bp, Homo sapiens
gtcccagcctggggctccctct

SEQ ID NO: 5500862 - DNA, 13 bp, Homo sapiens
gtcccagcgagcc

SEQ ID NO: 5500863 - DNA, 14 bp, Homo sapiens
gtcccagcgagcca

SEQ ID NO: 5500864 - DNA, 20 bp, Homo sapiens
gtcccagcgagccacaggaa

SEQ ID NO: 5500865 - DNA, 21 bp, Homo sapiens
gtcccagcggcctcagggtct

SEQ ID NO: 5500866 - DNA, 21 bp, Homo sapiens
gtcccagctaaagaggtgggg

SEQ ID NO: 5500867 - DNA, 22 bp, Homo sapiens
gtcccagctactcagaagcctg

SEQ ID NO: 5500868 - DNA, 18 bp, Homo sapiens
gtcccagctacttgggag

SEQ ID NO: 5500869 - DNA, 18 bp, Homo sapiens
gtcccagctgaaggcagt

SEQ ID NO: 5500870 - DNA, 20 bp, Homo sapiens
gtcccagctgaaggcagtgg

SEQ ID NO: 5500871 - DNA, 16 bp, Homo sapiens
gtcccaggaagcaggg

SEQ ID NO: 5500872 - DNA, 18 bp, Homo sapiens
gtcccaggaagcagggag

SEQ ID NO: 5500873 - DNA, 17 bp, Homo sapiens
gtcccaggacctgagcc

SEQ ID NO: 5500874 - DNA, 23 bp, Homo sapiens
gtcccaggactcaccctccacaa

SEQ ID NO: 5500875 - DNA, 20 bp, Homo sapiens
gtcccaggagcaaatgctgg

SEQ ID NO: 5500876 - DNA, 17 bp, Homo sapiens
gtcccaggatcccctgc

SEQ ID NO: 5500877 - DNA, 12 bp, Homo sapiens
gtcccaggcaga

SEQ ID NO: 5500878 - DNA, 15 bp, Homo sapiens
gtcccaggcagcgcc

SEQ ID NO: 5500879 - DNA, 16 bp, Homo sapiens
gtcccaggcagggaga

SEQ ID NO: 5500880 - DNA, 16 bp, Homo sapiens
gtcccaggcatgcagc

SEQ ID NO: 5500881 - DNA, 17 bp, Homo sapiens
gtcccaggcatgcagct

SEQ ID NO: 5500882 - DNA, 18 bp, Homo sapiens
gtcccaggcatgcagctg

SEQ ID NO: 5500883 - DNA, 13 bp, Homo sapiens
gtcccaggccgca

SEQ ID NO: 5500884 - DNA, 18 bp, Homo sapiens
gtcccaggccgcatggcc

SEQ ID NO: 5500885 - DNA, 15 bp, Homo sapiens
gtcccaggctgagcc

SEQ ID NO: 5500886 - DNA, 15 bp, Homo sapiens
gtcccagggccctag

SEQ ID NO: 5500887 - DNA, 11 bp, Homo sapiens
gtcccagggct

SEQ ID NO: 5500888 - DNA, 12 bp, Homo sapiens
gtcccagggctc

SEQ ID NO: 5500889 - DNA, 14 bp, Homo sapiens
gtcccagggctgat

SEQ ID NO: 5500890 - DNA, 17 bp, Homo sapiens
gtcccagggctggccct

SEQ ID NO: 5500891 - DNA, 21 bp, Homo sapiens
gtcccagggctggccctaggc

SEQ ID NO: 5500892 - DNA, 19 bp, Homo sapiens
gtcccaggggcagccacac

SEQ ID NO: 5500893 - DNA, 21 bp, Homo sapiens
gtcccaggggcagccacacca

SEQ ID NO: 5500894 - DNA, 20 bp, Homo sapiens
gtcccaggggtctccctgag

SEQ ID NO: 5500895 - DNA, 23 bp, Homo sapiens
gtcccaggggtctccctgagcct

SEQ ID NO: 5500896 - DNA, 17 bp, Homo sapiens
gtcccaggttggctctg

SEQ ID NO: 5500897 - DNA, 18 bp, Homo sapiens
gtcccaggttggctctgc

SEQ ID NO: 5500898 - DNA, 19 bp, Homo sapiens
gtcccaggttggctctgcc

SEQ ID NO: 5500899 - DNA, 17 bp, Homo sapiens
gtcccagtagccaaggc

SEQ ID NO: 5500900 - DNA, 17 bp, Homo sapiens
gtcccagtatacctcat

SEQ ID NO: 5500901 - DNA, 19 bp, Homo sapiens
gtcccagtccggtgccttc

SEQ ID NO: 5500902 - DNA, 21 bp, Homo sapiens
gtcccagtccggtgccttcca

SEQ ID NO: 5500903 - DNA, 23 bp, Homo sapiens
gtcccagtccggtgccttccacc

SEQ ID NO: 5500904 - DNA, 17 bp, Homo sapiens
gtcccagtctctggcag

SEQ ID NO: 5500905 - DNA, 12 bp, Homo sapiens
gtcccagtgaac

SEQ ID NO: 5500906 - DNA, 15 bp, Homo sapiens
gtcccagtgccattg

SEQ ID NO: 5500907 - DNA, 21 bp, Homo sapiens
gtcccagtgtctggcccagcc

SEQ ID NO: 5500908 - DNA, 22 bp, Homo sapiens
gtcccagtgtctggcccagcca

SEQ ID NO: 5500909 - DNA, 15 bp, Homo sapiens
gtcccagttgctgtc

SEQ ID NO: 5500910 - DNA, 15 bp, Homo sapiens
gtcccagttttgttg

SEQ ID NO: 5500911 - DNA, 23 bp, Homo sapiens
gtcccagttttgttgccccagaa

SEQ ID NO: 5500912 - DNA, 20 bp, Homo sapiens
gtcccataagggtagccccc

SEQ ID NO: 5500913 - DNA, 22 bp, Homo sapiens
gtcccataatatgctttttact

SEQ ID NO: 5500914 - DNA, 17 bp, Homo sapiens
gtcccataggagcagcc

SEQ ID NO: 5500915 - DNA, 16 bp, Homo sapiens
gtcccataggcccagt

SEQ ID NO: 5500916 - DNA, 15 bp, Homo sapiens
gtcccatccagctac

SEQ ID NO: 5500917 - DNA, 21 bp, Homo sapiens
gtcccatccagctaccaccac

SEQ ID NO: 5500918 - DNA, 15 bp, Homo sapiens
gtcccatccaggcag

SEQ ID NO: 5500919 - DNA, 15 bp, Homo sapiens
gtcccatcggaagtt

SEQ ID NO: 5500920 - DNA, 14 bp, Homo sapiens
gtcccatctgccct

SEQ ID NO: 5500921 - DNA, 16 bp, Homo sapiens
gtcccatctgccctcc

SEQ ID NO: 5500922 - DNA, 19 bp, Homo sapiens
gtcccatgacccacccctg

SEQ ID NO: 5500923 - DNA, 13 bp, Homo sapiens
gtcccatgctggc

SEQ ID NO: 5500924 - DNA, 21 bp, Homo sapiens
gtcccatggacactccagtgc

SEQ ID NO: 5500925 - DNA, 22 bp, Homo sapiens
gtcccatggacactccagtgcc

SEQ ID NO: 5500926 - DNA, 16 bp, Homo sapiens
gtcccatggcctgctg

SEQ ID NO: 5500927 - DNA, 17 bp, Homo sapiens
gtcccatggctgaagct

SEQ ID NO: 5500928 - DNA, 22 bp, Homo sapiens
gtcccatggctgaagctggagc

SEQ ID NO: 5500929 - DNA, 16 bp, Homo sapiens
gtcccatgggctctgg

SEQ ID NO: 5500930 - DNA, 22 bp, Homo sapiens
gtcccatgtgagctgctgccat

SEQ ID NO: 5500931 - DNA, 14 bp, Homo sapiens
gtcccattcagtgg

SEQ ID NO: 5500932 - DNA, 23 bp, Homo sapiens
gtcccattcccccagtgcggcca

SEQ ID NO: 5500933 - DNA, 15 bp, Homo sapiens
gtcccattccctggg

SEQ ID NO: 5500934 - DNA, 18 bp, Homo sapiens
gtcccattctagatcctg

SEQ ID NO: 5500935 - DNA, 20 bp, Homo sapiens
gtcccattctccactcactg

SEQ ID NO: 5500936 - DNA, 19 bp, Homo sapiens
gtcccatttattattttaa

SEQ ID NO: 5500937 - DNA, 22 bp, Homo sapiens
gtcccatttattattttaatat

SEQ ID NO: 5500938 - DNA, 15 bp, Homo sapiens
gtcccatttccttgg

SEQ ID NO: 5500939 - DNA, 18 bp, Homo sapiens
gtcccatttccttggagg

SEQ ID NO: 5500940 - DNA, 15 bp, Homo sapiens
gtcccattttcccct

SEQ ID NO: 5500941 - DNA, 19 bp, Homo sapiens
gtcccatttttctcttgcc

SEQ ID NO: 5500942 - DNA, 16 bp, Homo sapiens
gtccccaatgaatata

SEQ ID NO: 5500943 - DNA, 15 bp, Homo sapiens
gtccccacacagcct

SEQ ID NO: 5500944 - DNA, 22 bp, Homo sapiens
gtccccacagactgccccagcc

SEQ ID NO: 5500945 - DNA, 13 bp, Homo sapiens
gtccccaccatct

SEQ ID NO: 5500946 - DNA, 14 bp, Homo sapiens
gtccccacccatgc

SEQ ID NO: 5500947 - DNA, 16 bp, Homo sapiens
gtccccacccgcctgc

SEQ ID NO: 5500948 - DNA, 18 bp, Homo sapiens
gtccccacccgcctgcag

SEQ ID NO: 5500949 - DNA, 18 bp, Homo sapiens
gtccccaccctccactca

SEQ ID NO: 5500950 - DNA, 15 bp, Homo sapiens
gtccccacctgggac

SEQ ID NO: 5500951 - DNA, 20 bp, Homo sapiens
gtccccacgaggggacccat

SEQ ID NO: 5500952 - DNA, 11 bp, Homo sapiens
gtccccactcc

SEQ ID NO: 5500953 - DNA, 14 bp, Homo sapiens
gtccccactccctg

SEQ ID NO: 5500954 - DNA, 16 bp, Homo sapiens
gtccccactcccttgg

SEQ ID NO: 5500955 - DNA, 15 bp, Homo sapiens
gtccccagaccaacc

SEQ ID NO: 5500956 - DNA, 20 bp, Homo sapiens
gtccccagaccaaccctggg

SEQ ID NO: 5500957 - DNA, 21 bp, Homo sapiens
gtccccagaccaaccctggga

SEQ ID NO: 5500958 - DNA, 22 bp, Homo sapiens
gtccccagaccagtagtgacca

SEQ ID NO: 5500959 - DNA, 12 bp, Homo sapiens
gtccccagactc

SEQ ID NO: 5500960 - DNA, 22 bp, Homo sapiens
gtccccagactccaccaagcct

SEQ ID NO: 5500961 - DNA, 17 bp, Homo sapiens
gtccccagactctgcct

SEQ ID NO: 5500962 - DNA, 18 bp, Homo sapiens
gtccccagactctgccta

SEQ ID NO: 5500963 - DNA, 12 bp, Homo sapiens
gtccccagagaa

SEQ ID NO: 5500964 - DNA, 14 bp, Homo sapiens
gtccccagcagaga

SEQ ID NO: 5500965 - DNA, 19 bp, Homo sapiens
gtccccagcccctcaaccc

SEQ ID NO: 5500966 - DNA, 12 bp, Homo sapiens
gtccccagccct

SEQ ID NO: 5500967 - DNA, 14 bp, Homo sapiens
gtccccagccctgg

SEQ ID NO: 5500968 - DNA, 16 bp, Homo sapiens
gtccccagccctgggc

SEQ ID NO: 5500969 - DNA, 15 bp, Homo sapiens
gtccccagccctgtc

SEQ ID NO: 5500970 - DNA, 14 bp, Homo sapiens
gtccccagcccttc

SEQ ID NO: 5500971 - DNA, 18 bp, Homo sapiens
gtccccagctccccagga

SEQ ID NO: 5500972 - DNA, 23 bp, Homo sapiens
gtccccagctggtccagggcctg

SEQ ID NO: 5500973 - DNA, 21 bp, Homo sapiens
gtccccaggccccaggaagcc

SEQ ID NO: 5500974 - DNA, 12 bp, Homo sapiens
gtccccagggcc

SEQ ID NO: 5500975 - DNA, 16 bp, Homo sapiens
gtccccaggggcacac

SEQ ID NO: 5500976 - DNA, 15 bp, Homo sapiens
gtccccagtccccag

SEQ ID NO: 5500977 - DNA, 17 bp, Homo sapiens
gtccccagtccccagcc

SEQ ID NO: 5500978 - DNA, 14 bp, Homo sapiens
gtccccagttgccg

SEQ ID NO: 5500979 - DNA, 21 bp, Homo sapiens
gtccccataagacaaacactg

SEQ ID NO: 5500980 - DNA, 15 bp, Homo sapiens
gtccccatcatccca

SEQ ID NO: 5500981 - DNA, 13 bp, Homo sapiens
gtccccatctagg

SEQ ID NO: 5500982 - DNA, 22 bp, Homo sapiens
gtccccatctaggtcctggctg

SEQ ID NO: 5500983 - DNA, 19 bp, Homo sapiens
gtccccatggcaccctgct

SEQ ID NO: 5500984 - DNA, 17 bp, Homo sapiens
gtccccattctataaat

SEQ ID NO: 5500985 - DNA, 14 bp, Homo sapiens
gtccccatttctgc

SEQ ID NO: 5500986 - DNA, 21 bp, Homo sapiens
gtcccccaaagggcctcctca

SEQ ID NO: 5500987 - DNA, 17 bp, Homo sapiens
gtcccccaaccccagcc

SEQ ID NO: 5500988 - DNA, 20 bp, Homo sapiens
gtcccccaaccccagccgct

SEQ ID NO: 5500989 - DNA, 23 bp, Homo sapiens
gtcccccaacttcatctggaagt

SEQ ID NO: 5500990 - DNA, 22 bp, Homo sapiens
gtcccccaaggttttggagtca

SEQ ID NO: 5500991 - DNA, 15 bp, Homo sapiens
gtcccccacccacct

SEQ ID NO: 5500992 - DNA, 17 bp, Homo sapiens
gtcccccacccacctcc

SEQ ID NO: 5500993 - DNA, 20 bp, Homo sapiens
gtcccccactctaaagcaaa

SEQ ID NO: 5500994 - DNA, 21 bp, Homo sapiens
gtcccccactgctaaggctgc

SEQ ID NO: 5500995 - DNA, 13 bp, Homo sapiens
gtcccccagagca

SEQ ID NO: 5500996 - DNA, 13 bp, Homo sapiens
gtcccccagcatc

SEQ ID NO: 5500997 - DNA, 22 bp, Homo sapiens
gtcccccagcatcgggggcctg

SEQ ID NO: 5500998 - DNA, 23 bp, Homo sapiens
gtcccccagcatcgggggcctgc

SEQ ID NO: 5500999 - DNA, 21 bp, Homo sapiens
gtcccccagccctcaggccag

SEQ ID NO: 5501000 - DNA, 17 bp, Homo sapiens
gtccctctcactcccca

SEQ ID NO: 5501001 - DNA, 11 bp, Homo sapiens
gtccctctcag

SEQ ID NO: 5501002 - DNA, 13 bp, Homo sapiens
gtccctctgaggc

SEQ ID NO: 5501003 - DNA, 14 bp, Homo sapiens
gtccctctgcagat

SEQ ID NO: 5501004 - DNA, 12 bp, Homo sapiens
gtccctctgccc

SEQ ID NO: 5501005 - DNA, 14 bp, Homo sapiens
gtccctctgcccca

SEQ ID NO: 5501006 - DNA, 13 bp, Homo sapiens
gtccctctgcctt

SEQ ID NO: 5501007 - DNA, 14 bp, Homo sapiens
gtccctctgtggct

SEQ ID NO: 5501008 - DNA, 12 bp, Homo sapiens
gtccctctgtgt

SEQ ID NO: 5501009 - DNA, 16 bp, Homo sapiens
gtccctcttctctcct

SEQ ID NO: 5501010 - DNA, 16 bp, Homo sapiens
gtccctcttctggttt

SEQ ID NO: 5501011 - DNA, 22 bp, Homo sapiens
gtccctcttctggtttcccttt

SEQ ID NO: 5501012 - DNA, 13 bp, Homo sapiens
gtccctctttgcc

SEQ ID NO: 5501013 - DNA, 20 bp, Homo sapiens
gtccctctttgcctgtgtga

SEQ ID NO: 5501014 - DNA, 23 bp, Homo sapiens
gtccctctttgcctgtgtgagca

SEQ ID NO: 5501015 - DNA, 17 bp, Homo sapiens
gtccctgaacgccctgg

SEQ ID NO: 5501016 - DNA, 17 bp, Homo sapiens
gtccctgactctctgtg

SEQ ID NO: 5501017 - DNA, 18 bp, Homo sapiens
gtccctgactctctgtga

SEQ ID NO: 5501018 - DNA, 17 bp, Homo sapiens
gtccctgacttcccagc

SEQ ID NO: 5501019 - DNA, 18 bp, Homo sapiens
gtccctgagaagcctcat

SEQ ID NO: 5501020 - DNA, 19 bp, Homo sapiens
gtccctgagcagtctactt

SEQ ID NO: 5501021 - DNA, 20 bp, Homo sapiens
gtccctgagggcccttccca

SEQ ID NO: 5501022 - DNA, 19 bp, Homo sapiens
gtccctgcagaagccagaa

SEQ ID NO: 5501023 - DNA, 19 bp, Homo sapiens
gtccctgccaatgctccag

SEQ ID NO: 5501024 - DNA, 20 bp, Homo sapiens
gtccctgccaatgctccagc

SEQ ID NO: 5501025 - DNA, 21 bp, Homo sapiens
gtccctgccaatgctccagct

SEQ ID NO: 5501026 - DNA, 14 bp, Homo sapiens
gtccctgccaatgg

SEQ ID NO: 5501027 - DNA, 17 bp, Homo sapiens
gtccctgccccctcccc

SEQ ID NO: 5501028 - DNA, 14 bp, Homo sapiens
gtccctgccccgcc

SEQ ID NO: 5501029 - DNA, 15 bp, Homo sapiens
gtccctgccccgccc

SEQ ID NO: 5501030 - DNA, 19 bp, Homo sapiens
gtccctgccccgcccccca

SEQ ID NO: 5501031 - DNA, 15 bp, Homo sapiens
gtccctgccctcccc

SEQ ID NO: 5501032 - DNA, 18 bp, Homo sapiens
gtccctgccctcccctgc

SEQ ID NO: 5501033 - DNA, 19 bp, Homo sapiens
gtccctgccctcccctgct

SEQ ID NO: 5501034 - DNA, 20 bp, Homo sapiens
gtccctgcctggaccagcct

SEQ ID NO: 5501035 - DNA, 21 bp, Homo sapiens
gtccctgcggaagccacaggg

SEQ ID NO: 5501036 - DNA, 17 bp, Homo sapiens
gtccctgcgtctcctgc

SEQ ID NO: 5501037 - DNA, 16 bp, Homo sapiens
gtccctgctcagccca

SEQ ID NO: 5501038 - DNA, 23 bp, Homo sapiens
gtccctgctcagcccatcccctg

SEQ ID NO: 5501039 - DNA, 20 bp, Homo sapiens
gtccctgctcccctttgggg

SEQ ID NO: 5501040 - DNA, 14 bp, Homo sapiens
gtccctgctcctcc

SEQ ID NO: 5501041 - DNA, 15 bp, Homo sapiens
gtccctgctcctccc

SEQ ID NO: 5501042 - DNA, 13 bp, Homo sapiens
gtccctgctgggg

SEQ ID NO: 5501043 - DNA, 17 bp, Homo sapiens
gtccctgcttacctgac

SEQ ID NO: 5501044 - DNA, 18 bp, Homo sapiens
gtccctgcttacctgacg

SEQ ID NO: 5501045 - DNA, 20 bp, Homo sapiens
gtccctggacacagctcttc

SEQ ID NO: 5501046 - DNA, 22 bp, Homo sapiens
gtccctggacacagctcttcat

SEQ ID NO: 5501047 - DNA, 13 bp, Homo sapiens
gtccctggatcag

SEQ ID NO: 5501048 - DNA, 14 bp, Homo sapiens
gtccctggcgctgt

SEQ ID NO: 5501049 - DNA, 16 bp, Homo sapiens
gtccctggcgctgtgc

SEQ ID NO: 5501050 - DNA, 19 bp, Homo sapiens
gtccctgggagggacatgc

SEQ ID NO: 5501051 - DNA, 14 bp, Homo sapiens
gtccctgggccagg

SEQ ID NO: 5501052 - DNA, 16 bp, Homo sapiens
gtccctggggcactcc

SEQ ID NO: 5501053 - DNA, 22 bp, Homo sapiens
gtccctggggcactcccccagg

SEQ ID NO: 5501054 - DNA, 15 bp, Homo sapiens
gtccctggggctagg

SEQ ID NO: 5501055 - DNA, 19 bp, Homo sapiens
gtccctgggggtgcagatg

SEQ ID NO: 5501056 - DNA, 15 bp, Homo sapiens
gtccctggtaataag

SEQ ID NO: 5501057 - DNA, 12 bp, Homo sapiens
gtccctggtccc

SEQ ID NO: 5501058 - DNA, 15 bp, Homo sapiens
gtccctgtagctcag

SEQ ID NO: 5501059 - DNA, 16 bp, Homo sapiens
gtccctgtagctcagt

SEQ ID NO: 5501060 - DNA, 14 bp, Homo sapiens
gtccctgtcacctc

SEQ ID NO: 5501061 - DNA, 15 bp, Homo sapiens
gtccctgtcacctct

SEQ ID NO: 5501062 - DNA, 14 bp, Homo sapiens
gtccctgtccccag

SEQ ID NO: 5501063 - DNA, 17 bp, Homo sapiens
gtccctgtccccaggcc

SEQ ID NO: 5501064 - DNA, 19 bp, Homo sapiens
gtccctgtcccccagcatc

SEQ ID NO: 5501065 - DNA, 16 bp, Homo sapiens
gtccctgtcccctcct

SEQ ID NO: 5501066 - DNA, 15 bp, Homo sapiens
gtccctgtccctgcc

SEQ ID NO: 5501067 - DNA, 16 bp, Homo sapiens
gtccctgtccctgccc

SEQ ID NO: 5501068 - DNA, 12 bp, Homo sapiens
gtccctgtcctt

SEQ ID NO: 5501069 - DNA, 16 bp, Homo sapiens
gtccctgtccttccct

SEQ ID NO: 5501070 - DNA, 18 bp, Homo sapiens
gtccctgtgctgatcctg

SEQ ID NO: 5501071 - DNA, 21 bp, Homo sapiens
gtccctgtgggctcacaccgg

SEQ ID NO: 5501072 - DNA, 12 bp, Homo sapiens
gtccctgtggta

SEQ ID NO: 5501073 - DNA, 19 bp, Homo sapiens
gtccctgtggtaccctggc

SEQ ID NO: 5501074 - DNA, 23 bp, Homo sapiens
gtccctgtggtaccctggcagag

SEQ ID NO: 5501075 - DNA, 14 bp, Homo sapiens
gtccctgtgttctg

SEQ ID NO: 5501076 - DNA, 19 bp, Homo sapiens
gtccctgttctcagctccg

SEQ ID NO: 5501077 - DNA, 21 bp, Homo sapiens
gtccctgttctcagctccgtc

SEQ ID NO: 5501078 - DNA, 15 bp, Homo sapiens
gtccctgtttgggaa

SEQ ID NO: 5501079 - DNA, 23 bp, Homo sapiens
gtcccttaatattgaggctgcag

SEQ ID NO: 5501080 - DNA, 18 bp, Homo sapiens
gtcccttacgtgagtcct

SEQ ID NO: 5501081 - DNA, 19 bp, Homo sapiens
gtcccttacgtgagtcctg

SEQ ID NO: 5501082 - DNA, 15 bp, Homo sapiens
gtcccttagccccga

SEQ ID NO: 5501083 - DNA, 17 bp, Homo sapiens
gtcccttcacatagttt

SEQ ID NO: 5501084 - DNA, 15 bp, Homo sapiens
gtcccttcacctcct

SEQ ID NO: 5501085 - DNA, 16 bp, Homo sapiens
gtcccttccaggagga

SEQ ID NO: 5501086 - DNA, 13 bp, Homo sapiens
gtcccttccccct

SEQ ID NO: 5501087 - DNA, 15 bp, Homo sapiens
gtcccttccccctgc

SEQ ID NO: 5501088 - DNA, 13 bp, Homo sapiens
gtcccttcccctc

SEQ ID NO: 5501089 - DNA, 18 bp, Homo sapiens
gtcccttcccctccctgg

SEQ ID NO: 5501090 - DNA, 19 bp, Homo sapiens
gtcccttcccctccctggc

SEQ ID NO: 5501091 - DNA, 22 bp, Homo sapiens
gtcccttcccctccctggctcc

SEQ ID NO: 5501092 - DNA, 13 bp, Homo sapiens
gtcccttcccctt

SEQ ID NO: 5501093 - DNA, 15 bp, Homo sapiens
gtcccttccccttca

SEQ ID NO: 5501094 - DNA, 21 bp, Homo sapiens
gtcccttcccgacccagccag

SEQ ID NO: 5501095 - DNA, 24 bp, Homo sapiens
gtcccttcccgacccagccagctg

SEQ ID NO: 5501096 - DNA, 17 bp, Homo sapiens
gtcccttcctgcttcct

SEQ ID NO: 5501097 - DNA, 13 bp, Homo sapiens
gtcccttcctgtc

SEQ ID NO: 5501098 - DNA, 15 bp, Homo sapiens
gtcccttcctgtcct

SEQ ID NO: 5501099 - DNA, 16 bp, Homo sapiens
gtcccttcctgtcctg

SEQ ID NO: 5501100 - DNA, 21 bp, Homo sapiens
gtcccttcctgtcctgctcac

SEQ ID NO: 5501101 - DNA, 20 bp, Homo sapiens
gtcccttgaactactgggtg

SEQ ID NO: 5501102 - DNA, 21 bp, Homo sapiens
gtcccttgaaggaagagggac

SEQ ID NO: 5501103 - DNA, 17 bp, Homo sapiens
gtcccttgagacctcag

SEQ ID NO: 5501104 - DNA, 16 bp, Homo sapiens
gtcccttgatgcacag

SEQ ID NO: 5501105 - DNA, 18 bp, Homo sapiens
gtcccttgatgcacagag

SEQ ID NO: 5501106 - DNA, 22 bp, Homo sapiens
gtcccttgatgcacagagaagc

SEQ ID NO: 5501107 - DNA, 18 bp, Homo sapiens
gtcccttgcccccctggc

SEQ ID NO: 5501108 - DNA, 19 bp, Homo sapiens
gtcccttgcctcaatgcca

SEQ ID NO: 5501109 - DNA, 13 bp, Homo sapiens
gtcccttgcctct

SEQ ID NO: 5501110 - DNA, 22 bp, Homo sapiens
gtcccttgcctctgccctggat

SEQ ID NO: 5501111 - DNA, 16 bp, Homo sapiens
gtcccttgctgtatgc

SEQ ID NO: 5501112 - DNA, 19 bp, Homo sapiens
gtcccttgcttagcctgtg

SEQ ID NO: 5501113 - DNA, 22 bp, Homo sapiens
gtcccttgcttgcctgcagggc

SEQ ID NO: 5501114 - DNA, 16 bp, Homo sapiens
gtcccttggcacactt

SEQ ID NO: 5501115 - DNA, 20 bp, Homo sapiens
gtcccttgtttccagctaga

SEQ ID NO: 5501116 - DNA, 15 bp, Homo sapiens
gtccctttcttctcc

SEQ ID NO: 5501117 - DNA, 18 bp, Homo sapiens
gtcccttttaatataaaa

SEQ ID NO: 5501118 - DNA, 19 bp, Homo sapiens
gtcccttttaatataaaag

SEQ ID NO: 5501119 - DNA, 15 bp, Homo sapiens
gtcccttttccctta

SEQ ID NO: 5501120 - DNA, 13 bp, Homo sapiens
gtcccttttcctt

SEQ ID NO: 5501121 - DNA, 15 bp, Homo sapiens
gtcccttttctttga

SEQ ID NO: 5501122 - DNA, 13 bp, Homo sapiens
gtcccttttgcta

SEQ ID NO: 5501123 - DNA, 21 bp, Homo sapiens
gtccctttttctccacactcc

SEQ ID NO: 5501124 - DNA, 22 bp, Homo sapiens
gtccctttttctccacactcca

SEQ ID NO: 5501125 - DNA, 22 bp, Homo sapiens
gtccctttttgcaggggactgg

SEQ ID NO: 5501126 - DNA, 20 bp, Homo sapiens
gtccgaaaccagttaagaat

SEQ ID NO: 5501127 - DNA, 20 bp, Homo sapiens
gtccgacctggcctgtctgt

SEQ ID NO: 5501128 - DNA, 13 bp, Homo sapiens
gtccgagctttga

SEQ ID NO: 5501129 - DNA, 22 bp, Homo sapiens
gtccgaggcctggctctggagc

SEQ ID NO: 5501130 - DNA, 23 bp, Homo sapiens
gtccgatggcccgagagctggga

SEQ ID NO: 5501131 - DNA, 17 bp, Homo sapiens
gtccgattaatttatgg

SEQ ID NO: 5501132 - DNA, 20 bp, Homo sapiens
gtccgcaccagctgctctgc

SEQ ID NO: 5501133 - DNA, 23 bp, Homo sapiens
gtccgcaccagctgctctgcccc

SEQ ID NO: 5501134 - DNA, 15 bp, Homo sapiens
gtccgcaccctgtcc

SEQ ID NO: 5501135 - DNA, 16 bp, Homo sapiens
gtccgcaccctgtcct

SEQ ID NO: 5501136 - DNA, 15 bp, Homo sapiens
gtccgcacgcggccg

SEQ ID NO: 5501137 - DNA, 15 bp, Homo sapiens
gtccgcataagaaaa

SEQ ID NO: 5501138 - DNA, 15 bp, Homo sapiens
gtccgcatccctgct

SEQ ID NO: 5501139 - DNA, 17 bp, Homo sapiens
gtccgccaaacactcca

SEQ ID NO: 5501140 - DNA, 15 bp, Homo sapiens
gtccgccatccaggg

SEQ ID NO: 5501141 - DNA, 16 bp, Homo sapiens
gtccgccatccagggt

SEQ ID NO: 5501142 - DNA, 23 bp, Homo sapiens
gtccgccatccagggtctggcag

SEQ ID NO: 5501143 - DNA, 15 bp, Homo sapiens
gtccgccccgtgctc

SEQ ID NO: 5501144 - DNA, 20 bp, Homo sapiens
gtccgccccgtgctcctctg

SEQ ID NO: 5501145 - DNA, 18 bp, Homo sapiens
gtccgccctgctcctccc

SEQ ID NO: 5501146 - DNA, 23 bp, Homo sapiens
gtccgccctgctcctccctggct

SEQ ID NO: 5501147 - DNA, 18 bp, Homo sapiens
gtccgcctgcgcctccat

SEQ ID NO: 5501148 - DNA, 19 bp, Homo sapiens
gtccgccttaatctggaag

SEQ ID NO: 5501149 - DNA, 12 bp, Homo sapiens
gtccgcggcctg

SEQ ID NO: 5501150 - DNA, 16 bp, Homo sapiens
gtccgcgtcctttcct

SEQ ID NO: 5501151 - DNA, 16 bp, Homo sapiens
gtccgctgtctccctc

SEQ ID NO: 5501152 - DNA, 18 bp, Homo sapiens
gtccgctgtctccctcct

SEQ ID NO: 5501153 - DNA, 14 bp, Homo sapiens
gtccggaagggtga

SEQ ID NO: 5501154 - DNA, 16 bp, Homo sapiens
gtccggaatgccaccc

SEQ ID NO: 5501155 - DNA, 16 bp, Homo sapiens
gtccggagcgaccctg

SEQ ID NO: 5501156 - DNA, 14 bp, Homo sapiens
gtccggatttctaa

SEQ ID NO: 5501157 - DNA, 21 bp, Homo sapiens
gtccggatttctaacagtcct

SEQ ID NO: 5501158 - DNA, 13 bp, Homo sapiens
gtccggcccagtg

SEQ ID NO: 5501159 - DNA, 14 bp, Homo sapiens
gtccggcccagtgc

SEQ ID NO: 5501160 - DNA, 22 bp, Homo sapiens
gtccggcccagtgccagctcca

SEQ ID NO: 5501161 - DNA, 16 bp, Homo sapiens
gtccggcctctccctg

SEQ ID NO: 5501162 - DNA, 13 bp, Homo sapiens
gtccggcctgcag

SEQ ID NO: 5501163 - DNA, 16 bp, Homo sapiens
gtccggcctgcagccc

SEQ ID NO: 5501164 - DNA, 23 bp, Homo sapiens
gtccggcgccccgcacccccgcc

SEQ ID NO: 5501165 - DNA, 13 bp, Homo sapiens
gtccggtgccttc

SEQ ID NO: 5501166 - DNA, 22 bp, Homo sapiens
gtccggtgccttccaccctgcc

SEQ ID NO: 5501167 - DNA, 17 bp, Homo sapiens
gtccggtgttctaagat

SEQ ID NO: 5501168 - DNA, 14 bp, Homo sapiens
gtccggttcttctt

SEQ ID NO: 5501169 - DNA, 17 bp, Homo sapiens
gtccggtttactttaac

SEQ ID NO: 5501170 - DNA, 21 bp, Homo sapiens
gtccggtttccgtagcagttt

SEQ ID NO: 5501171 - DNA, 17 bp, Homo sapiens
gtccgtagctcccctgg

SEQ ID NO: 5501172 - DNA, 15 bp, Homo sapiens
gtccgtccgcccgcc

SEQ ID NO: 5501173 - DNA, 12 bp, Homo sapiens
gtccgtcctgct

SEQ ID NO: 5501174 - DNA, 13 bp, Homo sapiens
gtccgtcctggca

SEQ ID NO: 5501175 - DNA, 13 bp, Homo sapiens
gtccgtctgtcct

SEQ ID NO: 5501176 - DNA, 18 bp, Homo sapiens
gtccgtctgtcctgcgcc

SEQ ID NO: 5501177 - DNA, 13 bp, Homo sapiens
gtccgtctgtctc

SEQ ID NO: 5501178 - DNA, 14 bp, Homo sapiens
gtccgtctgtctcg

SEQ ID NO: 5501179 - DNA, 15 bp, Homo sapiens
gtcctcgccccccgc

SEQ ID NO: 5501180 - DNA, 20 bp, Homo sapiens
gtcctcggagctggttcctc

SEQ ID NO: 5501181 - DNA, 15 bp, Homo sapiens
gtcctcggcagctcc

SEQ ID NO: 5501182 - DNA, 19 bp, Homo sapiens
gtcctcggccctgtagccc

SEQ ID NO: 5501183 - DNA, 23 bp, Homo sapiens
gtcctcggccctgtagccctggc

SEQ ID NO: 5501184 - DNA, 16 bp, Homo sapiens
gtcctcggtcttaccc

SEQ ID NO: 5501185 - DNA, 17 bp, Homo sapiens
gtcctcgtagccatctc

SEQ ID NO: 5501186 - DNA, 18 bp, Homo sapiens
gtcctctcagaactcctg

SEQ ID NO: 5501187 - DNA, 19 bp, Homo sapiens
gtcctctcagaactcctgt

SEQ ID NO: 5501188 - DNA, 12 bp, Homo sapiens
gtcctctccacc

SEQ ID NO: 5501189 - DNA, 18 bp, Homo sapiens
gtcctctccacctagtgg

SEQ ID NO: 5501190 - DNA, 15 bp, Homo sapiens
gtcctctccagagag

SEQ ID NO: 5501191 - DNA, 16 bp, Homo sapiens
gtcctctccccagcct

SEQ ID NO: 5501192 - DNA, 19 bp, Homo sapiens
gtcctctccccagcctggc

SEQ ID NO: 5501193 - DNA, 14 bp, Homo sapiens
gtcctctccccctt

SEQ ID NO: 5501194 - DNA, 13 bp, Homo sapiens
gtcctctcccctc

SEQ ID NO: 5501195 - DNA, 21 bp, Homo sapiens
gtcctctcccctccagccttt

SEQ ID NO: 5501196 - DNA, 16 bp, Homo sapiens
gtcctctccctcctgg

SEQ ID NO: 5501197 - DNA, 20 bp, Homo sapiens
gtcctctccctcctggccag

SEQ ID NO: 5501198 - DNA, 17 bp, Homo sapiens
gtcctctcggctgccag

SEQ ID NO: 5501199 - DNA, 21 bp, Homo sapiens
gtcctctctctgtggggctga

SEQ ID NO: 5501200 - DNA, 19 bp, Homo sapiens
gtcctctctcttggggcgc

SEQ ID NO: 5501201 - DNA, 10 bp, Homo sapiens
gtcctctctg

SEQ ID NO: 5501202 - DNA, 11 bp, Homo sapiens
gtcctctctga

SEQ ID NO: 5501203 - DNA, 20 bp, Homo sapiens
gtcctctctgagtcaaatcc

SEQ ID NO: 5501204 - DNA, 16 bp, Homo sapiens
gtcctctctggctggg

SEQ ID NO: 5501205 - DNA, 11 bp, Homo sapiens
gtcctctcttc

SEQ ID NO: 5501206 - DNA, 16 bp, Homo sapiens
gtcctctcttccacag

SEQ ID NO: 5501207 - DNA, 17 bp, Homo sapiens
gtcctctgaatgaacct

SEQ ID NO: 5501208 - DNA, 13 bp, Homo sapiens
gtcctctgcctcc

SEQ ID NO: 5501209 - DNA, 14 bp, Homo sapiens
gtcctctgcctggg

SEQ ID NO: 5501210 - DNA, 15 bp, Homo sapiens
gtcctctgcctgggc

SEQ ID NO: 5501211 - DNA, 10 bp, Homo sapiens
gtcctctgct

SEQ ID NO: 5501212 - DNA, 18 bp, Homo sapiens
gtcctctgtcagtcacag

SEQ ID NO: 5501213 - DNA, 23 bp, Homo sapiens
gtcctctgtccgtctgtcctgcg

SEQ ID NO: 5501214 - DNA, 15 bp, Homo sapiens
gtcctctgtgcccac

SEQ ID NO: 5501215 - DNA, 17 bp, Homo sapiens
gtcctcttcaagtactg

SEQ ID NO: 5501216 - DNA, 13 bp, Homo sapiens
gtcctcttctgca

SEQ ID NO: 5501217 - DNA, 22 bp, Homo sapiens
gtcctcttctgctcttttcctg

SEQ ID NO: 5501218 - DNA, 14 bp, Homo sapiens
gtcctcttgccagc

SEQ ID NO: 5501219 - DNA, 14 bp, Homo sapiens
gtcctcttgcctcc

SEQ ID NO: 5501220 - DNA, 18 bp, Homo sapiens
gtcctcttgcctcctgga

SEQ ID NO: 5501221 - DNA, 20 bp, Homo sapiens
gtcctctttacatgaaacta

SEQ ID NO: 5501222 - DNA, 16 bp, Homo sapiens
gtcctctttcagaaaa

SEQ ID NO: 5501223 - DNA, 20 bp, Homo sapiens
gtcctctttcagaaaacaga

SEQ ID NO: 5501224 - DNA, 23 bp, Homo sapiens
gtcctctttcagaaaacagaaaa

SEQ ID NO: 5501225 - DNA, 13 bp, Homo sapiens
gtcctctttcagc

SEQ ID NO: 5501226 - DNA, 16 bp, Homo sapiens
gtcctctttcagctcc

SEQ ID NO: 5501227 - DNA, 19 bp, Homo sapiens
gtcctcttttcctggcagc

SEQ ID NO: 5501228 - DNA, 22 bp, Homo sapiens
gtcctcttttcctggcagctgc

SEQ ID NO: 5501229 - DNA, 18 bp, Homo sapiens
gtcctgaaacatgaaccc

SEQ ID NO: 5501230 - DNA, 17 bp, Homo sapiens
gtcctgaaagcggctgc

SEQ ID NO: 5501231 - DNA, 18 bp, Homo sapiens
gtcctgaaagcggctgcc

SEQ ID NO: 5501232 - DNA, 20 bp, Homo sapiens
gtcctgaaagcggctgcctc

SEQ ID NO: 5501233 - DNA, 19 bp, Homo sapiens
gtcctgaacctttcaaaat

SEQ ID NO: 5501234 - DNA, 16 bp, Homo sapiens
gtcctgaactgtgagt

SEQ ID NO: 5501235 - DNA, 16 bp, Homo sapiens
gtcctgaagctgctgg

SEQ ID NO: 5501236 - DNA, 14 bp, Homo sapiens
gtcctgaatgtagc

SEQ ID NO: 5501237 - DNA, 20 bp, Homo sapiens
gtcctgacaccaggcaagaa

SEQ ID NO: 5501238 - DNA, 16 bp, Homo sapiens
gtcctgaccaccctcc

SEQ ID NO: 5501239 - DNA, 19 bp, Homo sapiens
gtcctgaccaccctcccct

SEQ ID NO: 5501240 - DNA, 19 bp, Homo sapiens
gtcctgaccaggatggagc

SEQ ID NO: 5501241 - DNA, 15 bp, Homo sapiens
gtcctgacgccctgc

SEQ ID NO: 5501242 - DNA, 13 bp, Homo sapiens
gtcctgacttccc

SEQ ID NO: 5501243 - DNA, 13 bp, Homo sapiens
gtcctgagcactg

SEQ ID NO: 5501244 - DNA, 16 bp, Homo sapiens
gtcctgagcactgcca

SEQ ID NO: 5501245 - DNA, 17 bp, Homo sapiens
gtcctgagcactgccag

SEQ ID NO: 5501246 - DNA, 22 bp, Homo sapiens
gtcctgagcactgccaggaggg

SEQ ID NO: 5501247 - DNA, 15 bp, Homo sapiens
gtcctgagctaacac

SEQ ID NO: 5501248 - DNA, 13 bp, Homo sapiens
gtcctgagctcag

SEQ ID NO: 5501249 - DNA, 15 bp, Homo sapiens
gtcctgagctcagcg

SEQ ID NO: 5501250 - DNA, 16 bp, Homo sapiens
gtcctgagctcagcgt

SEQ ID NO: 5501251 - DNA, 19 bp, Homo sapiens
gtcctgagctcagcgtgga

SEQ ID NO: 5501252 - DNA, 18 bp, Homo sapiens
gtcctgaggagtgtcctg

SEQ ID NO: 5501253 - DNA, 22 bp, Homo sapiens
gtcctgaggagtgtcctgtctg

SEQ ID NO: 5501254 - DNA, 17 bp, Homo sapiens
gtcctgaggcagaacct

SEQ ID NO: 5501255 - DNA, 20 bp, Homo sapiens
gtcctgaggcagaacctggt

SEQ ID NO: 5501256 - DNA, 22 bp, Homo sapiens
gtcctgaggctctctaagaaaa

SEQ ID NO: 5501257 - DNA, 16 bp, Homo sapiens
gtcctgaggctggggc

SEQ ID NO: 5501258 - DNA, 20 bp, Homo sapiens
gtcctgagggggaagtgaga

SEQ ID NO: 5501259 - DNA, 21 bp, Homo sapiens
gtcctgagggtccccacctgg

SEQ ID NO: 5501260 - DNA, 15 bp, Homo sapiens
gtcctgatcagagcc

SEQ ID NO: 5501261 - DNA, 14 bp, Homo sapiens
gtcctgatccctcc

SEQ ID NO: 5501262 - DNA, 16 bp, Homo sapiens
gtcctgatccctccac

SEQ ID NO: 5501263 - DNA, 17 bp, Homo sapiens
gtcctgatggtcagctc

SEQ ID NO: 5501264 - DNA, 13 bp, Homo sapiens
gtcctgatgtttt

SEQ ID NO: 5501265 - DNA, 18 bp, Homo sapiens
gtcctgattcgaggtcct

SEQ ID NO: 5501266 - DNA, 21 bp, Homo sapiens
gtcctgcaagtccatagctga

SEQ ID NO: 5501267 - DNA, 22 bp, Homo sapiens
gtcctgcaagtccatagctgag

SEQ ID NO: 5501268 - DNA, 21 bp, Homo sapiens
gtcctgcaatctccagggctg

SEQ ID NO: 5501269 - DNA, 20 bp, Homo sapiens
gtcctgcacaccctgggcca

SEQ ID NO: 5501270 - DNA, 22 bp, Homo sapiens
gtcctgcacaccctgggccacg

SEQ ID NO: 5501271 - DNA, 23 bp, Homo sapiens
gtcctgcacaccctgggccacgc

SEQ ID NO: 5501272 - DNA, 22 bp, Homo sapiens
gtcctgcacagattcccaggcc

SEQ ID NO: 5501273 - DNA, 11 bp, Homo sapiens
gtcctgcacat

SEQ ID NO: 5501274 - DNA, 12 bp, Homo sapiens
gtcctgcagagg

SEQ ID NO: 5501275 - DNA, 21 bp, Homo sapiens
gtcctgcagaggaccacagtg

SEQ ID NO: 5501276 - DNA, 20 bp, Homo sapiens
gtcctgcagtcccacactgt

SEQ ID NO: 5501277 - DNA, 13 bp, Homo sapiens
gtcctgcagtcct

SEQ ID NO: 5501278 - DNA, 19 bp, Homo sapiens
gtcctgcagtctggctgag

SEQ ID NO: 5501279 - DNA, 22 bp, Homo sapiens
gtcctgccaccaccctgtcttc

SEQ ID NO: 5501280 - DNA, 14 bp, Homo sapiens
gtcctgccacctgg

SEQ ID NO: 5501281 - DNA, 15 bp, Homo sapiens
gtcctgccagctgcc

SEQ ID NO: 5501282 - DNA, 16 bp, Homo sapiens
gtcctgccagctgcct

SEQ ID NO: 5501283 - DNA, 17 bp, Homo sapiens
gtcctgccagctgcctt

SEQ ID NO: 5501284 - DNA, 17 bp, Homo sapiens
gtcctgccagctggatc

SEQ ID NO: 5501285 - DNA, 16 bp, Homo sapiens
gtcctgcccaatgcct

SEQ ID NO: 5501286 - DNA, 22 bp, Homo sapiens
gtcctgcccccaaggaggcagc

SEQ ID NO: 5501287 - DNA, 23 bp, Homo sapiens
gtcctgcccccaaggaggcagcc

SEQ ID NO: 5501288 - DNA, 21 bp, Homo sapiens
gtcctgcccccgacagcccag

SEQ ID NO: 5501289 - DNA, 22 bp, Homo sapiens
gtcctgcccccgacagcccagc

SEQ ID NO: 5501290 - DNA, 12 bp, Homo sapiens
gtcctgccctgc

SEQ ID NO: 5501291 - DNA, 19 bp, Homo sapiens
gtcctgccgacggagccac

SEQ ID NO: 5501292 - DNA, 22 bp, Homo sapiens
gtcctgccgacggagccactgg

SEQ ID NO: 5501293 - DNA, 18 bp, Homo sapiens
gtcctgccggagaggaag

SEQ ID NO: 5501294 - DNA, 13 bp, Homo sapiens
gtcctgccggtgg

SEQ ID NO: 5501295 - DNA, 17 bp, Homo sapiens
gtcctgccggtgggacc

SEQ ID NO: 5501296 - DNA, 18 bp, Homo sapiens
gtcctgcctaaatttcac

SEQ ID NO: 5501297 - DNA, 17 bp, Homo sapiens
gtcctgcctcagcctcc

SEQ ID NO: 5501298 - DNA, 11 bp, Homo sapiens
gtcctgcctcc

SEQ ID NO: 5501299 - DNA, 14 bp, Homo sapiens
gtcctgcctcctca

SEQ ID NO: 5501300 - DNA, 16 bp, Homo sapiens
gtcctgcctcctcatc

SEQ ID NO: 5501301 - DNA, 11 bp, Homo sapiens
gtcctgcctct

SEQ ID NO: 5501302 - DNA, 12 bp, Homo sapiens
gtcctgcctctc

SEQ ID NO: 5501303 - DNA, 19 bp, Homo sapiens
gtcctgcctctctgctcca

SEQ ID NO: 5501304 - DNA, 21 bp, Homo sapiens
gtcctgcctctctgctccaga

SEQ ID NO: 5501305 - DNA, 12 bp, Homo sapiens
gtcctgcctctt

SEQ ID NO: 5501306 - DNA, 23 bp, Homo sapiens
gtcctgcctcttgtttctgtgcc

SEQ ID NO: 5501307 - DNA, 12 bp, Homo sapiens
gtcctgcctggc

SEQ ID NO: 5501308 - DNA, 14 bp, Homo sapiens
gtcctgcctggcca

SEQ ID NO: 5501309 - DNA, 21 bp, Homo sapiens
gtcctgccttcttccttgagg

SEQ ID NO: 5501310 - DNA, 22 bp, Homo sapiens
gtcctgccttgatgaagcctgt

SEQ ID NO: 5501311 - DNA, 16 bp, Homo sapiens
gtcctgcgcctgcgcc

SEQ ID NO: 5501312 - DNA, 19 bp, Homo sapiens
gtcctgcgcctgcgcctcc

SEQ ID NO: 5501313 - DNA, 19 bp, Homo sapiens
gtcctgcgttcagcccctg

SEQ ID NO: 5501314 - DNA, 18 bp, Homo sapiens
gtcctgctagctgtctct

SEQ ID NO: 5501315 - DNA, 21 bp, Homo sapiens
gtcctgctatttcccaagctg

SEQ ID NO: 5501316 - DNA, 14 bp, Homo sapiens
gtcctgctcacctg

SEQ ID NO: 5501317 - DNA, 15 bp, Homo sapiens
gtcctgctcacctgt

SEQ ID NO: 5501318 - DNA, 16 bp, Homo sapiens
gtcctgctcacctgtg

SEQ ID NO: 5501319 - DNA, 13 bp, Homo sapiens
gtcctgctcacgt

SEQ ID NO: 5501320 - DNA, 16 bp, Homo sapiens
gtcctgctcagatgct

SEQ ID NO: 5501321 - DNA, 16 bp, Homo sapiens
gtcctgctccgctgcc

SEQ ID NO: 5501322 - DNA, 19 bp, Homo sapiens
gtcctgctccgctgcctgg

SEQ ID NO: 5501323 - DNA, 20 bp, Homo sapiens
gtcctgctccgctgcctgga

SEQ ID NO: 5501324 - DNA, 21 bp, Homo sapiens
gtcctgctccgctgcctggaa

SEQ ID NO: 5501325 - DNA, 21 bp, Homo sapiens
gtcctgctcctttctgcccag

SEQ ID NO: 5501326 - DNA, 22 bp, Homo sapiens
gtcctgctcgccctgtgccctc

SEQ ID NO: 5501327 - DNA, 13 bp, Homo sapiens
gtcctgctgcagt

SEQ ID NO: 5501328 - DNA, 17 bp, Homo sapiens
gtcctgctgcagttgcc

SEQ ID NO: 5501329 - DNA, 13 bp, Homo sapiens
gtcctgctgccct

SEQ ID NO: 5501330 - DNA, 14 bp, Homo sapiens
gtcctgctgcctgg

SEQ ID NO: 5501331 - DNA, 19 bp, Homo sapiens
gtcctgctgcctggagtca

SEQ ID NO: 5501332 - DNA, 22 bp, Homo sapiens
gtcctgctgcctggagtcagta

SEQ ID NO: 5501333 - DNA, 20 bp, Homo sapiens
gtcctgctgctcgggaaggc

SEQ ID NO: 5501334 - DNA, 14 bp, Homo sapiens
gtcctgctggagtg

SEQ ID NO: 5501335 - DNA, 11 bp, Homo sapiens
gtcctgctggc

SEQ ID NO: 5501336 - DNA, 16 bp, Homo sapiens
gtcctgctggcacctc

SEQ ID NO: 5501337 - DNA, 12 bp, Homo sapiens
gtcctgcttctg

SEQ ID NO: 5501338 - DNA, 11 bp, Homo sapiens
gtcctgcttga

SEQ ID NO: 5501339 - DNA, 13 bp, Homo sapiens
gtcctggaatgaa

SEQ ID NO: 5501340 - DNA, 18 bp, Homo sapiens
gtcctggacacctcccag

SEQ ID NO: 5501341 - DNA, 19 bp, Homo sapiens
gtcctggacacctcccagg

SEQ ID NO: 5501342 - DNA, 23 bp, Homo sapiens
gtcctggacacctcccaggggac

SEQ ID NO: 5501343 - DNA, 13 bp, Homo sapiens
gtcctggaccctg

SEQ ID NO: 5501344 - DNA, 14 bp, Homo sapiens
gtcctggaggggct

SEQ ID NO: 5501345 - DNA, 17 bp, Homo sapiens
gtcctggatgatactaa

SEQ ID NO: 5501346 - DNA, 15 bp, Homo sapiens
gtcctggcagggcag

SEQ ID NO: 5501347 - DNA, 19 bp, Homo sapiens
gtcctggcagggcaggcag

SEQ ID NO: 5501348 - DNA, 23 bp, Homo sapiens
gtcctggcagggcaggcagagct

SEQ ID NO: 5501349 - DNA, 22 bp, Homo sapiens
gtcctggccagatggcccggat

SEQ ID NO: 5501350 - DNA, 15 bp, Homo sapiens
gtcctggccatccca

SEQ ID NO: 5501351 - DNA, 17 bp, Homo sapiens
gtcctggccatcccaca

SEQ ID NO: 5501352 - DNA, 18 bp, Homo sapiens
gtcctggccatcccacaa

SEQ ID NO: 5501353 - DNA, 12 bp, Homo sapiens
gtcctggcccca

SEQ ID NO: 5501354 - DNA, 17 bp, Homo sapiens
gtcctggcccgggagcc

SEQ ID NO: 5501355 - DNA, 15 bp, Homo sapiens
gtcctggcccttcag

SEQ ID NO: 5501356 - DNA, 16 bp, Homo sapiens
gtcctggcccttcagt

SEQ ID NO: 5501357 - DNA, 18 bp, Homo sapiens
gtcctggcccttcagtct

SEQ ID NO: 5501358 - DNA, 14 bp, Homo sapiens
gtcctttatgtatt

SEQ ID NO: 5501359 - DNA, 20 bp, Homo sapiens
gtcctttatgtggaaaacag

SEQ ID NO: 5501360 - DNA, 23 bp, Homo sapiens
gtcctttcaattccaccagggcc

SEQ ID NO: 5501361 - DNA, 19 bp, Homo sapiens
gtcctttccatctgtccac

SEQ ID NO: 5501362 - DNA, 21 bp, Homo sapiens
gtcctttccatctgtccacat

SEQ ID NO: 5501363 - DNA, 18 bp, Homo sapiens
gtcctttcccaccattcc

SEQ ID NO: 5501364 - DNA, 13 bp, Homo sapiens
gtcctttcccctc

SEQ ID NO: 5501365 - DNA, 14 bp, Homo sapiens
gtcctttccctcca

SEQ ID NO: 5501366 - DNA, 14 bp, Homo sapiens
gtcctttccctgga

SEQ ID NO: 5501367 - DNA, 18 bp, Homo sapiens
gtcctttcctctcctctc

SEQ ID NO: 5501368 - DNA, 22 bp, Homo sapiens
gtcctttctagagcactgccac

SEQ ID NO: 5501369 - DNA, 13 bp, Homo sapiens
gtcctttctcaga

SEQ ID NO: 5501370 - DNA, 14 bp, Homo sapiens
gtcctttctccagg

SEQ ID NO: 5501371 - DNA, 16 bp, Homo sapiens
gtcctttctcctgata

SEQ ID NO: 5501372 - DNA, 20 bp, Homo sapiens
gtcctttctggaagtttctg

SEQ ID NO: 5501373 - DNA, 15 bp, Homo sapiens
gtcctttctgtgaag

SEQ ID NO: 5501374 - DNA, 13 bp, Homo sapiens
gtcctttcttccg

SEQ ID NO: 5501375 - DNA, 21 bp, Homo sapiens
gtcctttcttttgaaatgcca

SEQ ID NO: 5501376 - DNA, 16 bp, Homo sapiens
gtcctttgagaaagaa

SEQ ID NO: 5501377 - DNA, 21 bp, Homo sapiens
gtcctttgcaattgctcttct

SEQ ID NO: 5501378 - DNA, 16 bp, Homo sapiens
gtcctttggcaggcct

SEQ ID NO: 5501379 - DNA, 21 bp, Homo sapiens
gtcctttggggcatagatcag

SEQ ID NO: 5501380 - DNA, 15 bp, Homo sapiens
gtcctttgtgaatat

SEQ ID NO: 5501381 - DNA, 21 bp, Homo sapiens
gtcctttgttataattttcct

SEQ ID NO: 5501382 - DNA, 19 bp, Homo sapiens
gtcctttgttgctgttgct

SEQ ID NO: 5501383 - DNA, 17 bp, Homo sapiens
gtcctttgttggcttct

SEQ ID NO: 5501384 - DNA, 21 bp, Homo sapiens
gtccttttagcacatcactga

SEQ ID NO: 5501385 - DNA, 22 bp, Homo sapiens
gtccttttatttctccatcttt

SEQ ID NO: 5501386 - DNA, 23 bp, Homo sapiens
gtccttttctcccatttcttgct

SEQ ID NO: 5501387 - DNA, 17 bp, Homo sapiens
gtccttttgacactgct

SEQ ID NO: 5501388 - DNA, 19 bp, Homo sapiens
gtccttttgacactgctct

SEQ ID NO: 5501389 - DNA, 22 bp, Homo sapiens
gtccttttgtaccatggtgtga

SEQ ID NO: 5501390 - DNA, 22 bp, Homo sapiens
gtccttttgtcttctctgtctc

SEQ ID NO: 5501391 - DNA, 19 bp, Homo sapiens
gtccttttgtgaaatcagt

SEQ ID NO: 5501392 - DNA, 16 bp, Homo sapiens
gtcctttttcctctcc

SEQ ID NO: 5501393 - DNA, 14 bp, Homo sapiens
gtcctttttgtaac

SEQ ID NO: 5501394 - DNA, 19 bp, Homo sapiens
gtcctttttttccatcttt

SEQ ID NO: 5501395 - DNA, 16 bp, Homo sapiens
gtcgaaagctctagaa

SEQ ID NO: 5501396 - DNA, 15 bp, Homo sapiens
gtcgaaaggtgcagc

SEQ ID NO: 5501397 - DNA, 23 bp, Homo sapiens
gtcgaaaggtgcagctgcgttct

SEQ ID NO: 5501398 - DNA, 13 bp, Homo sapiens
gtcgaaggatgct

SEQ ID NO: 5501399 - DNA, 15 bp, Homo sapiens
gtcgacaagaatgtc

SEQ ID NO: 5501400 - DNA, 17 bp, Homo sapiens
gtcgaccccaaaggaac

SEQ ID NO: 5501401 - DNA, 22 bp, Homo sapiens
gtcgagaaagaggcaccaggaa

SEQ ID NO: 5501402 - DNA, 13 bp, Homo sapiens
gtcgagagctggc

SEQ ID NO: 5501403 - DNA, 13 bp, Homo sapiens
gtcgagatctcag

SEQ ID NO: 5501404 - DNA, 18 bp, Homo sapiens
gtcgagattgcactgctg

SEQ ID NO: 5501405 - DNA, 19 bp, Homo sapiens
gtcgagcatttcttctact

SEQ ID NO: 5501406 - DNA, 16 bp, Homo sapiens
gtcgagccctgcagcc

SEQ ID NO: 5501407 - DNA, 13 bp, Homo sapiens
gtcgagctccccc

SEQ ID NO: 5501408 - DNA, 16 bp, Homo sapiens
gtcgaggaagaccacc

SEQ ID NO: 5501409 - DNA, 15 bp, Homo sapiens
gtcgaggagtaacaa

SEQ ID NO: 5501410 - DNA, 22 bp, Homo sapiens
gtcgaggattctgtgcctccag

SEQ ID NO: 5501411 - DNA, 21 bp, Homo sapiens
gtcgaggccacattgctggct

SEQ ID NO: 5501412 - DNA, 22 bp, Homo sapiens
gtcgaggccacattgctggctg

SEQ ID NO: 5501413 - DNA, 17 bp, Homo sapiens
gtcgaggctgcagtcag

SEQ ID NO: 5501414 - DNA, 11 bp, Homo sapiens
gtcgaggctgg

SEQ ID NO: 5501415 - DNA, 20 bp, Homo sapiens
gtcgagtctttgtgtgttat

SEQ ID NO: 5501416 - DNA, 22 bp, Homo sapiens
gtcgagtctttgtgtgttatat

SEQ ID NO: 5501417 - DNA, 14 bp, Homo sapiens
gtcgataatcagag

SEQ ID NO: 5501418 - DNA, 17 bp, Homo sapiens
gtcgatattcccagggc

SEQ ID NO: 5501419 - DNA, 14 bp, Homo sapiens
gtcgatatttccat

SEQ ID NO: 5501420 - DNA, 13 bp, Homo sapiens
gtcgattagactg

SEQ ID NO: 5501421 - DNA, 14 bp, Homo sapiens
gtcgattagactgg

SEQ ID NO: 5501422 - DNA, 18 bp, Homo sapiens
gtcgcagctaccctcagc

SEQ ID NO: 5501423 - DNA, 17 bp, Homo sapiens
gtcgcaggatccgctgc

SEQ ID NO: 5501424 - DNA, 20 bp, Homo sapiens
gtcgcaggatccgctgccac

SEQ ID NO: 5501425 - DNA, 16 bp, Homo sapiens
gtcgccacacccggct

SEQ ID NO: 5501426 - DNA, 23 bp, Homo sapiens
gtcgccacacccggctccccctg

SEQ ID NO: 5501427 - DNA, 19 bp, Homo sapiens
gtcgccacctggcattcct

SEQ ID NO: 5501428 - DNA, 17 bp, Homo sapiens
gtcgccagtgaaataga

SEQ ID NO: 5501429 - DNA, 15 bp, Homo sapiens
gtcgcccacccagct

SEQ ID NO: 5501430 - DNA, 17 bp, Homo sapiens
gtcgcccacccagctgg

SEQ ID NO: 5501431 - DNA, 19 bp, Homo sapiens
gtcgcccacccagctggtc

SEQ ID NO: 5501432 - DNA, 14 bp, Homo sapiens
gtcgcccaggctgg

SEQ ID NO: 5501433 - DNA, 15 bp, Homo sapiens
gtcgccccaggccct

SEQ ID NO: 5501434 - DNA, 18 bp, Homo sapiens
gtcgccccaggccctccc

SEQ ID NO: 5501435 - DNA, 22 bp, Homo sapiens
gtcgccccaggccctccctgac

SEQ ID NO: 5501436 - DNA, 15 bp, Homo sapiens
gtcgcccctcagagc

SEQ ID NO: 5501437 - DNA, 11 bp, Homo sapiens
gtcgcccctcc

SEQ ID NO: 5501438 - DNA, 21 bp, Homo sapiens
gtcgcccctccttttggcctg

SEQ ID NO: 5501439 - DNA, 18 bp, Homo sapiens
gtcgcccgctgagctgag

SEQ ID NO: 5501440 - DNA, 14 bp, Homo sapiens
gtcgccctctgtgc

SEQ ID NO: 5501441 - DNA, 16 bp, Homo sapiens
gtcgccctctgtgcct

SEQ ID NO: 5501442 - DNA, 14 bp, Homo sapiens
gtcgccctggactg

SEQ ID NO: 5501443 - DNA, 20 bp, Homo sapiens
gtcgccctgttcttgaggtc

SEQ ID NO: 5501444 - DNA, 23 bp, Homo sapiens
gtcgccctgttcttgaggtctct

SEQ ID NO: 5501445 - DNA, 14 bp, Homo sapiens
gtcgcctgccccca

SEQ ID NO: 5501446 - DNA, 20 bp, Homo sapiens
gtcgcctgcctgcagcaggc

SEQ ID NO: 5501447 - DNA, 21 bp, Homo sapiens
gtcgcctgcggactccatggc

SEQ ID NO: 5501448 - DNA, 22 bp, Homo sapiens
gtcgcctgcggactccatggcc

SEQ ID NO: 5501449 - DNA, 21 bp, Homo sapiens
gtcgcctgtaatgccagcgct

SEQ ID NO: 5501450 - DNA, 17 bp, Homo sapiens
gtcgccttagcatgttt

SEQ ID NO: 5501451 - DNA, 19 bp, Homo sapiens
gtcgcgagcacatgttcat

SEQ ID NO: 5501452 - DNA, 22 bp, Homo sapiens
gtcgcgcgcagcgcgtgcacag

SEQ ID NO: 5501453 - DNA, 16 bp, Homo sapiens
gtcgcgcgtctcccat

SEQ ID NO: 5501454 - DNA, 13 bp, Homo sapiens
gtcgcgctgcctg

SEQ ID NO: 5501455 - DNA, 22 bp, Homo sapiens
gtcgctcagtctgttcactgca

SEQ ID NO: 5501456 - DNA, 11 bp, Homo sapiens
gtcgctcctgc

SEQ ID NO: 5501457 - DNA, 18 bp, Homo sapiens
gtcgctgaacctgtctcc

SEQ ID NO: 5501458 - DNA, 23 bp, Homo sapiens
gtcgctgcagggagcaccacggc

SEQ ID NO: 5501459 - DNA, 22 bp, Homo sapiens
gtcgctgcctccatggcagcag

SEQ ID NO: 5501460 - DNA, 23 bp, Homo sapiens
gtcgctgcctccatggcagcagc

SEQ ID NO: 5501461 - DNA, 17 bp, Homo sapiens
gtcgctggacaacccag

SEQ ID NO: 5501462 - DNA, 18 bp, Homo sapiens
gtcgctggacaacccaga

SEQ ID NO: 5501463 - DNA, 19 bp, Homo sapiens
gtcgctggacaacccagaa

SEQ ID NO: 5501464 - DNA, 19 bp, Homo sapiens
gtcgctgggctgtgggtgc

SEQ ID NO: 5501465 - DNA, 16 bp, Homo sapiens
gtcgctgggtcctctg

SEQ ID NO: 5501466 - DNA, 15 bp, Homo sapiens
gtcgcttgccaaagc

SEQ ID NO: 5501467 - DNA, 15 bp, Homo sapiens
gtcgctttctcagtg

SEQ ID NO: 5501468 - DNA, 16 bp, Homo sapiens
gtcgctttctcagtgt

SEQ ID NO: 5501469 - DNA, 13 bp, Homo sapiens
gtcggaaaagcgt

SEQ ID NO: 5501470 - DNA, 16 bp, Homo sapiens
gtcggaaaagcgtctt

SEQ ID NO: 5501471 - DNA, 13 bp, Homo sapiens
gtcggaagcctgt

SEQ ID NO: 5501472 - DNA, 15 bp, Homo sapiens
gtcggaagcctgtcc

SEQ ID NO: 5501473 - DNA, 16 bp, Homo sapiens
gtcggaagcctgtcct

SEQ ID NO: 5501474 - DNA, 20 bp, Homo sapiens
gtcggagaggctgtctgggg

SEQ ID NO: 5501475 - DNA, 12 bp, Homo sapiens
gtcggagccctg

SEQ ID NO: 5501476 - DNA, 14 bp, Homo sapiens
gtcggagctgcctg

SEQ ID NO: 5501477 - DNA, 14 bp, Homo sapiens
gtcggaggtgctgt

SEQ ID NO: 5501478 - DNA, 19 bp, Homo sapiens
gtcggaggtgctgtcccca

SEQ ID NO: 5501479 - DNA, 14 bp, Homo sapiens
gtcggagtgcctgg

SEQ ID NO: 5501480 - DNA, 18 bp, Homo sapiens
gtcggagtgcctggagtc

SEQ ID NO: 5501481 - DNA, 14 bp, Homo sapiens
gtcggatctcacag

SEQ ID NO: 5501482 - DNA, 16 bp, Homo sapiens
gtcggccacaccccag

SEQ ID NO: 5501483 - DNA, 14 bp, Homo sapiens
gtcggccccatctc

SEQ ID NO: 5501484 - DNA, 14 bp, Homo sapiens
gtcggccctgccca

SEQ ID NO: 5501485 - DNA, 14 bp, Homo sapiens
gtcggccgaccagg

SEQ ID NO: 5501486 - DNA, 15 bp, Homo sapiens
gtcggccgaccaggc

SEQ ID NO: 5501487 - DNA, 20 bp, Homo sapiens
gtcggccgccatagccccag

SEQ ID NO: 5501488 - DNA, 18 bp, Homo sapiens
gtcggcgccttctacctg

SEQ ID NO: 5501489 - DNA, 11 bp, Homo sapiens
gtcggctgggc

SEQ ID NO: 5501490 - DNA, 15 bp, Homo sapiens
gtcggctgggcaggg

SEQ ID NO: 5501491 - DNA, 21 bp, Homo sapiens
gtcgggaaattctgctgcttg

SEQ ID NO: 5501492 - DNA, 22 bp, Homo sapiens
gtcgggaaattctgctgcttga

SEQ ID NO: 5501493 - DNA, 14 bp, Homo sapiens
gtcgggacagagag

SEQ ID NO: 5501494 - DNA, 20 bp, Homo sapiens
gtcgggaccacatctgtcct

SEQ ID NO: 5501495 - DNA, 15 bp, Homo sapiens
gtcgggaggagcagc

SEQ ID NO: 5501496 - DNA, 18 bp, Homo sapiens
gtcgggagttcgagacca

SEQ ID NO: 5501497 - DNA, 16 bp, Homo sapiens
gtcgggatgtcagcag

SEQ ID NO: 5501498 - DNA, 17 bp, Homo sapiens
gtcgggatgtcagcaga

SEQ ID NO: 5501499 - DNA, 14 bp, Homo sapiens
gtcgggcaccagcc

SEQ ID NO: 5501500 - DNA, 13 bp, Homo sapiens
gtcgggcagccag

SEQ ID NO: 5501501 - DNA, 14 bp, Homo sapiens
gtcgggcagccagc

SEQ ID NO: 5501502 - DNA, 22 bp, Homo sapiens
gtcgggcagtggaggctgctgt

SEQ ID NO: 5501503 - DNA, 11 bp, Homo sapiens
gtcgggcatga

SEQ ID NO: 5501504 - DNA, 12 bp, Homo sapiens
gtcgggcccctg

SEQ ID NO: 5501505 - DNA, 19 bp, Homo sapiens
gtcgggcccgcactcagga

SEQ ID NO: 5501506 - DNA, 17 bp, Homo sapiens
gtcgggcgtgggtctct

SEQ ID NO: 5501507 - DNA, 23 bp, Homo sapiens
gtcgggcgtgggtctctggggac

SEQ ID NO: 5501508 - DNA, 21 bp, Homo sapiens
gtcgggctcagctctggctca

SEQ ID NO: 5501509 - DNA, 19 bp, Homo sapiens
gtcgggctgccagcccagc

SEQ ID NO: 5501510 - DNA, 20 bp, Homo sapiens
gtcgggctgccagcccagct

SEQ ID NO: 5501511 - DNA, 21 bp, Homo sapiens
gtcggggagggggaggcggga

SEQ ID NO: 5501512 - DNA, 12 bp, Homo sapiens
gtcggggcaggc

SEQ ID NO: 5501513 - DNA, 14 bp, Homo sapiens
gtcggggcatctgg

SEQ ID NO: 5501514 - DNA, 14 bp, Homo sapiens
gtcggggcccctgc

SEQ ID NO: 5501515 - DNA, 14 bp, Homo sapiens
gtcgggggagagag

SEQ ID NO: 5501516 - DNA, 12 bp, Homo sapiens
gtcgggggagga

SEQ ID NO: 5501517 - DNA, 14 bp, Homo sapiens
gtcgggggaggagc

SEQ ID NO: 5501518 - DNA, 21 bp, Homo sapiens
gtcgggggaggagcaccccca

SEQ ID NO: 5501519 - DNA, 14 bp, Homo sapiens
gtcgggggccactg

SEQ ID NO: 5501520 - DNA, 21 bp, Homo sapiens
gtcgggggccactgtgtttct

SEQ ID NO: 5501521 - DNA, 14 bp, Homo sapiens
gtcgggggctgagg

SEQ ID NO: 5501522 - DNA, 17 bp, Homo sapiens
gtcggggggacagctcc

SEQ ID NO: 5501523 - DNA, 17 bp, Homo sapiens
gtcggggtcaagctgga

SEQ ID NO: 5501524 - DNA, 14 bp, Homo sapiens
gtcggggttggggt

SEQ ID NO: 5501525 - DNA, 15 bp, Homo sapiens
gtcggtcctggtgcc

SEQ ID NO: 5501526 - DNA, 20 bp, Homo sapiens
gtcgtagccaaggtgggctg

SEQ ID NO: 5501527 - DNA, 13 bp, Homo sapiens
gtcgtcagcctcc

SEQ ID NO: 5501528 - DNA, 14 bp, Homo sapiens
gtcgtcagcctccc

SEQ ID NO: 5501529 - DNA, 12 bp, Homo sapiens
gtcgtccccaga

SEQ ID NO: 5501530 - DNA, 15 bp, Homo sapiens
gtcgtccccagacca

SEQ ID NO: 5501531 - DNA, 16 bp, Homo sapiens
gtcgtccccagaccag

SEQ ID NO: 5501532 - DNA, 17 bp, Homo sapiens
gtcgtccccagaccagt

SEQ ID NO: 5501533 - DNA, 18 bp, Homo sapiens
gtcgtccccagaccagta

SEQ ID NO: 5501534 - DNA, 17 bp, Homo sapiens
gtcgtccgctcagccaa

SEQ ID NO: 5501535 - DNA, 15 bp, Homo sapiens
gtcgtcgcacagtct

SEQ ID NO: 5501536 - DNA, 12 bp, Homo sapiens
gtcgtctgtgaa

SEQ ID NO: 5501537 - DNA, 17 bp, Homo sapiens
gtctccccatgctgggc

SEQ ID NO: 5501538 - DNA, 23 bp, Homo sapiens
gtctcccccaacagctggaccct

SEQ ID NO: 5501539 - DNA, 20 bp, Homo sapiens
gtctcccccacccttgttcc

SEQ ID NO: 5501540 - DNA, 22 bp, Homo sapiens
gtctcccccacccttgttccag

SEQ ID NO: 5501541 - DNA, 18 bp, Homo sapiens
gtctcccccagagtgctg

SEQ ID NO: 5501542 - DNA, 19 bp, Homo sapiens
gtctcccccagagtgctgt

SEQ ID NO: 5501543 - DNA, 21 bp, Homo sapiens
gtctcccccagagtgctgtcg

SEQ ID NO: 5501544 - DNA, 19 bp, Homo sapiens
gtctcccccgtgttcccct

SEQ ID NO: 5501545 - DNA, 21 bp, Homo sapiens
gtctcccccgtgttcccctct

SEQ ID NO: 5501546 - DNA, 17 bp, Homo sapiens
gtctccccgcagccctc

SEQ ID NO: 5501547 - DNA, 22 bp, Homo sapiens
gtctccccgcagccctctccac

SEQ ID NO: 5501548 - DNA, 16 bp, Homo sapiens
gtctcccctcctgcac

SEQ ID NO: 5501549 - DNA, 21 bp, Homo sapiens
gtctcccctcctgcacacagg

SEQ ID NO: 5501550 - DNA, 15 bp, Homo sapiens
gtctcccctctgctg

SEQ ID NO: 5501551 - DNA, 16 bp, Homo sapiens
gtctcccctctgctgg

SEQ ID NO: 5501552 - DNA, 19 bp, Homo sapiens
gtctcccctctgctggccg

SEQ ID NO: 5501553 - DNA, 18 bp, Homo sapiens
gtctcccctgttcccctc

SEQ ID NO: 5501554 - DNA, 14 bp, Homo sapiens
gtctccccttcctg

SEQ ID NO: 5501555 - DNA, 17 bp, Homo sapiens
gtctccccttcctggca

SEQ ID NO: 5501556 - DNA, 18 bp, Homo sapiens
gtctccccttcctggcac

SEQ ID NO: 5501557 - DNA, 20 bp, Homo sapiens
gtctccccttctctgcctca

SEQ ID NO: 5501558 - DNA, 20 bp, Homo sapiens
gtctcccgtgcatgctctgc

SEQ ID NO: 5501559 - DNA, 21 bp, Homo sapiens
gtctcccgtgcatgctctgca

SEQ ID NO: 5501560 - DNA, 18 bp, Homo sapiens
gtctccctaaaataaaaa

SEQ ID NO: 5501561 - DNA, 22 bp, Homo sapiens
gtctccctataatgctggagcg

SEQ ID NO: 5501562 - DNA, 14 bp, Homo sapiens
gtctccctccagct

SEQ ID NO: 5501563 - DNA, 23 bp, Homo sapiens
gtctccctccccaaatggctgct

SEQ ID NO: 5501564 - DNA, 16 bp, Homo sapiens
gtctccctcccttggg

SEQ ID NO: 5501565 - DNA, 14 bp, Homo sapiens
gtctccctccgact

SEQ ID NO: 5501566 - DNA, 12 bp, Homo sapiens
gtctccctcctc

SEQ ID NO: 5501567 - DNA, 19 bp, Homo sapiens
gtctccctcctctgcccgg

SEQ ID NO: 5501568 - DNA, 14 bp, Homo sapiens
gtctccctcctgat

SEQ ID NO: 5501569 - DNA, 23 bp, Homo sapiens
gtctccctcgggggctcttcccc

SEQ ID NO: 5501570 - DNA, 14 bp, Homo sapiens
gtctccctctcctg

SEQ ID NO: 5501571 - DNA, 22 bp, Homo sapiens
gtctccctctcctgcctactca

SEQ ID NO: 5501572 - DNA, 13 bp, Homo sapiens
gtctccctggcca

SEQ ID NO: 5501573 - DNA, 21 bp, Homo sapiens
gtctccctggccacccttggc

SEQ ID NO: 5501574 - DNA, 13 bp, Homo sapiens
gtctccctggccc

SEQ ID NO: 5501575 - DNA, 14 bp, Homo sapiens
gtctccctggtgcc

SEQ ID NO: 5501576 - DNA, 19 bp, Homo sapiens
gtctccctggtgcctctgt

SEQ ID NO: 5501577 - DNA, 21 bp, Homo sapiens
gtctccctggtgcctctgtgc

SEQ ID NO: 5501578 - DNA, 23 bp, Homo sapiens
gtctccctggtggggtgtgcatg

SEQ ID NO: 5501579 - DNA, 17 bp, Homo sapiens
gtctccctggttgcctc

SEQ ID NO: 5501580 - DNA, 18 bp, Homo sapiens
gtctccctggttgcctct

SEQ ID NO: 5501581 - DNA, 19 bp, Homo sapiens
gtctccctggttgcctctc

SEQ ID NO: 5501582 - DNA, 21 bp, Homo sapiens
gtctccctggttgcctctctt

SEQ ID NO: 5501583 - DNA, 22 bp, Homo sapiens
gtctccctgtgttacccaggct

SEQ ID NO: 5501584 - DNA, 13 bp, Homo sapiens
gtctcccttagat

SEQ ID NO: 5501585 - DNA, 15 bp, Homo sapiens
gtctcccttctctct

SEQ ID NO: 5501586 - DNA, 12 bp, Homo sapiens
gtctcccttggc

SEQ ID NO: 5501587 - DNA, 18 bp, Homo sapiens
gtctcccttggccacggc

SEQ ID NO: 5501588 - DNA, 20 bp, Homo sapiens
gtctcccttggccacggcct

SEQ ID NO: 5501589 - DNA, 16 bp, Homo sapiens
gtctccgcacttggaa

SEQ ID NO: 5501590 - DNA, 17 bp, Homo sapiens
gtctccgcacttggaaa

SEQ ID NO: 5501591 - DNA, 17 bp, Homo sapiens
gtctccgccttgctggg

SEQ ID NO: 5501592 - DNA, 17 bp, Homo sapiens
gtctccgggactgccct

SEQ ID NO: 5501593 - DNA, 16 bp, Homo sapiens
gtctcctaagcacctg

SEQ ID NO: 5501594 - DNA, 17 bp, Homo sapiens
gtctcctaagcacctgt

SEQ ID NO: 5501595 - DNA, 18 bp, Homo sapiens
gtctcctaataagttcct

SEQ ID NO: 5501596 - DNA, 14 bp, Homo sapiens
gtctcctactctgt

SEQ ID NO: 5501597 - DNA, 15 bp, Homo sapiens
gtctcctactctgtg

SEQ ID NO: 5501598 - DNA, 17 bp, Homo sapiens
gtctcctactctgtgta

SEQ ID NO: 5501599 - DNA, 18 bp, Homo sapiens
gtctcctactctgtgtaa

SEQ ID NO: 5501600 - DNA, 16 bp, Homo sapiens
gtctcctactgaggat

SEQ ID NO: 5501601 - DNA, 14 bp, Homo sapiens
gtctcctcactctg

SEQ ID NO: 5501602 - DNA, 15 bp, Homo sapiens
gtctcctcactgcca

SEQ ID NO: 5501603 - DNA, 18 bp, Homo sapiens
gtctcctcactgccacta

SEQ ID NO: 5501604 - DNA, 14 bp, Homo sapiens
gtctcctcagcctc

SEQ ID NO: 5501605 - DNA, 22 bp, Homo sapiens
gtctcctcagggtggggggtga

SEQ ID NO: 5501606 - DNA, 16 bp, Homo sapiens
gtctcctcccagcggc

SEQ ID NO: 5501607 - DNA, 17 bp, Homo sapiens
gtctcctccccgtagcc

SEQ ID NO: 5501608 - DNA, 20 bp, Homo sapiens
gtctcctccccgtagccact

SEQ ID NO: 5501609 - DNA, 14 bp, Homo sapiens
gtctcctccccttc

SEQ ID NO: 5501610 - DNA, 19 bp, Homo sapiens
gtctcctccctcagctctc

SEQ ID NO: 5501611 - DNA, 14 bp, Homo sapiens
gtctcctcctccag

SEQ ID NO: 5501612 - DNA, 12 bp, Homo sapiens
gtctcctcctcg

SEQ ID NO: 5501613 - DNA, 19 bp, Homo sapiens
gtctcctcgtcccgagggc

SEQ ID NO: 5501614 - DNA, 20 bp, Homo sapiens
gtctcctctatcctgggctt

SEQ ID NO: 5501615 - DNA, 14 bp, Homo sapiens
gtctcctctcagct

SEQ ID NO: 5501616 - DNA, 16 bp, Homo sapiens
gtctcctctcagcttc

SEQ ID NO: 5501617 - DNA, 15 bp, Homo sapiens
gtctcctctccattt

SEQ ID NO: 5501618 - DNA, 16 bp, Homo sapiens
gtctcctctccatttt

SEQ ID NO: 5501619 - DNA, 22 bp, Homo sapiens
gtctcctctctggtggctgggc

SEQ ID NO: 5501620 - DNA, 20 bp, Homo sapiens
gtctcctctgattatcaggt

SEQ ID NO: 5501621 - DNA, 23 bp, Homo sapiens
gtctcctctgtcagtttgtgaag

SEQ ID NO: 5501622 - DNA, 14 bp, Homo sapiens
gtctcctcttaaaa

SEQ ID NO: 5501623 - DNA, 13 bp, Homo sapiens
gtctcctgcccac

SEQ ID NO: 5501624 - DNA, 19 bp, Homo sapiens
gtctcctgcccccacacct

SEQ ID NO: 5501625 - DNA, 12 bp, Homo sapiens
gtctcctgctgc

SEQ ID NO: 5501626 - DNA, 13 bp, Homo sapiens
gtctcctgctgcg

SEQ ID NO: 5501627 - DNA, 14 bp, Homo sapiens
gtctcctgctgcgt

SEQ ID NO: 5501628 - DNA, 13 bp, Homo sapiens
gtctcctggacct

SEQ ID NO: 5501629 - DNA, 15 bp, Homo sapiens
gtctcctgggaaagg

SEQ ID NO: 5501630 - DNA, 16 bp, Homo sapiens
gtctcctgtccccggc

SEQ ID NO: 5501631 - DNA, 19 bp, Homo sapiens
gtctcctgtttcagaccag

SEQ ID NO: 5501632 - DNA, 16 bp, Homo sapiens
gtctccttaacactga

SEQ ID NO: 5501633 - DNA, 21 bp, Homo sapiens
gtctccttactctgagcccag

SEQ ID NO: 5501634 - DNA, 23 bp, Homo sapiens
gtctccttactctgagcccaggc

SEQ ID NO: 5501635 - DNA, 14 bp, Homo sapiens
gtctccttcagcac

SEQ ID NO: 5501636 - DNA, 16 bp, Homo sapiens
gtctccttcagcacgg

SEQ ID NO: 5501637 - DNA, 16 bp, Homo sapiens
gtctccttccattcag

SEQ ID NO: 5501638 - DNA, 12 bp, Homo sapiens
gtctccttccca

SEQ ID NO: 5501639 - DNA, 20 bp, Homo sapiens
gtctccttcccactgtcctt

SEQ ID NO: 5501640 - DNA, 13 bp, Homo sapiens
gtctccttctctt

SEQ ID NO: 5501641 - DNA, 23 bp, Homo sapiens
gtctccttgggccctttttccct

SEQ ID NO: 5501642 - DNA, 19 bp, Homo sapiens
gtctcctttactgaatgta

SEQ ID NO: 5501643 - DNA, 18 bp, Homo sapiens
gtctcctttcaccccagg

SEQ ID NO: 5501644 - DNA, 20 bp, Homo sapiens
gtctcctttcaccccagggc

SEQ ID NO: 5501645 - DNA, 18 bp, Homo sapiens
gtctcctttctgactgtc

SEQ ID NO: 5501646 - DNA, 23 bp, Homo sapiens
gtctcctttgcactgagggccac

SEQ ID NO: 5501647 - DNA, 13 bp, Homo sapiens
gtctcgaactcct

SEQ ID NO: 5501648 - DNA, 15 bp, Homo sapiens
gtctcgaactcctga

SEQ ID NO: 5501649 - DNA, 16 bp, Homo sapiens
gtctcgaactcctgac

SEQ ID NO: 5501650 - DNA, 20 bp, Homo sapiens
gtctcgaactcctggcctca

SEQ ID NO: 5501651 - DNA, 18 bp, Homo sapiens
gtctcgaatgtaattgga

SEQ ID NO: 5501652 - DNA, 13 bp, Homo sapiens
gtctcgaccctgt

SEQ ID NO: 5501653 - DNA, 17 bp, Homo sapiens
gtctcgaccctgtcccc

SEQ ID NO: 5501654 - DNA, 20 bp, Homo sapiens
gtctcgaccctgtcccctag

SEQ ID NO: 5501655 - DNA, 18 bp, Homo sapiens
gtctcgagcgccctgcag

SEQ ID NO: 5501656 - DNA, 20 bp, Homo sapiens
gtctcgagcgccctgcagac

SEQ ID NO: 5501657 - DNA, 23 bp, Homo sapiens
gtctcgagcgccctgcagaccct

SEQ ID NO: 5501658 - DNA, 14 bp, Homo sapiens
gtctcgatctcctg

SEQ ID NO: 5501659 - DNA, 16 bp, Homo sapiens
gtctcgatctcctgac

SEQ ID NO: 5501660 - DNA, 15 bp, Homo sapiens
gtctcgatgcctgat

SEQ ID NO: 5501661 - DNA, 18 bp, Homo sapiens
gtctcgatgctgctggcc

SEQ ID NO: 5501662 - DNA, 14 bp, Homo sapiens
gtctcgcagcctga

SEQ ID NO: 5501663 - DNA, 17 bp, Homo sapiens
gtctcgcagcctgaagc

SEQ ID NO: 5501664 - DNA, 22 bp, Homo sapiens
gtctcgcagcctgaagcctgga

SEQ ID NO: 5501665 - DNA, 17 bp, Homo sapiens
gtctcgcgcgactgaga

SEQ ID NO: 5501666 - DNA, 14 bp, Homo sapiens
gtctcgctctgtca

SEQ ID NO: 5501667 - DNA, 18 bp, Homo sapiens
gtctcgctctgtcaccca

SEQ ID NO: 5501668 - DNA, 20 bp, Homo sapiens
gtctcgctgatgctgggctg

SEQ ID NO: 5501669 - DNA, 21 bp, Homo sapiens
gtctcgctgatgctgggctgg

SEQ ID NO: 5501670 - DNA, 15 bp, Homo sapiens
gtctcgctgtcactg

SEQ ID NO: 5501671 - DNA, 18 bp, Homo sapiens
gtctcgctgtcactggct

SEQ ID NO: 5501672 - DNA, 22 bp, Homo sapiens
gtctcgctgtcactggctggct

SEQ ID NO: 5501673 - DNA, 23 bp, Homo sapiens
gtctcgctgtcactggctggctc

SEQ ID NO: 5501674 - DNA, 19 bp, Homo sapiens
gtctcggaacctgtgagct

SEQ ID NO: 5501675 - DNA, 21 bp, Homo sapiens
gtctcggatgacaccctggcc

SEQ ID NO: 5501676 - DNA, 14 bp, Homo sapiens
gtctcggcccctct

SEQ ID NO: 5501677 - DNA, 16 bp, Homo sapiens
gtctcggccctgaacc

SEQ ID NO: 5501678 - DNA, 15 bp, Homo sapiens
gtctcggctctgcat

SEQ ID NO: 5501679 - DNA, 21 bp, Homo sapiens
gtctcgggggtccggaagggt

SEQ ID NO: 5501680 - DNA, 22 bp, Homo sapiens
gtctcgggtccgattaatttat

SEQ ID NO: 5501681 - DNA, 19 bp, Homo sapiens
gtctcgtgtacagctccct

SEQ ID NO: 5501682 - DNA, 16 bp, Homo sapiens
gtctcgtgtcagtaat

SEQ ID NO: 5501683 - DNA, 19 bp, Homo sapiens
gtctcgtgttcgctggctg

SEQ ID NO: 5501684 - DNA, 20 bp, Homo sapiens
gtctcgttttgttgccaaag

SEQ ID NO: 5501685 - DNA, 23 bp, Homo sapiens
gtctcgttttgttgccaaagctg

SEQ ID NO: 5501686 - DNA, 22 bp, Homo sapiens
gtctctaaaaagaagccacaga

SEQ ID NO: 5501687 - DNA, 22 bp, Homo sapiens
gtctctaagccaactttaattg

SEQ ID NO: 5501688 - DNA, 16 bp, Homo sapiens
gtctctaattgattca

SEQ ID NO: 5501689 - DNA, 11 bp, Homo sapiens
gtctctacatg

SEQ ID NO: 5501690 - DNA, 18 bp, Homo sapiens
gtctctactaaaaataca

SEQ ID NO: 5501691 - DNA, 22 bp, Homo sapiens
gtctctacttttccctgtactt

SEQ ID NO: 5501692 - DNA, 16 bp, Homo sapiens
gtctctagccactttg

SEQ ID NO: 5501693 - DNA, 16 bp, Homo sapiens
gtctctagctgttctg

SEQ ID NO: 5501694 - DNA, 13 bp, Homo sapiens
gtctctaggctgg

SEQ ID NO: 5501695 - DNA, 19 bp, Homo sapiens
gtctctagttgacttcaaa

SEQ ID NO: 5501696 - DNA, 18 bp, Homo sapiens
gtctctatattatgtctt

SEQ ID NO: 5501697 - DNA, 14 bp, Homo sapiens
gtctctatgtgaat

SEQ ID NO: 5501698 - DNA, 15 bp, Homo sapiens
gtctctatgtgaata

SEQ ID NO: 5501699 - DNA, 14 bp, Homo sapiens
gtctctatttaaat

SEQ ID NO: 5501700 - DNA, 21 bp, Homo sapiens
gtctctatttaaattcttttt

SEQ ID NO: 5501701 - DNA, 23 bp, Homo sapiens
gtctctatttcacaattatattt

SEQ ID NO: 5501702 - DNA, 18 bp, Homo sapiens
gtctctatttgatttgca

SEQ ID NO: 5501703 - DNA, 12 bp, Homo sapiens
gtctctcacaga

SEQ ID NO: 5501704 - DNA, 23 bp, Homo sapiens
gtctctcacagacaggacccctg

SEQ ID NO: 5501705 - DNA, 16 bp, Homo sapiens
gtctctcacagatgtg

SEQ ID NO: 5501706 - DNA, 17 bp, Homo sapiens
gtctctcactgttgcag

SEQ ID NO: 5501707 - DNA, 12 bp, Homo sapiens
gtctctcagaat

SEQ ID NO: 5501708 - DNA, 13 bp, Homo sapiens
gtctctcagggat

SEQ ID NO: 5501709 - DNA, 12 bp, Homo sapiens
gtctctcattct

SEQ ID NO: 5501710 - DNA, 18 bp, Homo sapiens
gtctctcattctctttct

SEQ ID NO: 5501711 - DNA, 19 bp, Homo sapiens
gtctctcattctctttctt

SEQ ID NO: 5501712 - DNA, 19 bp, Homo sapiens
gtctctccactgctctcag

SEQ ID NO: 5501713 - DNA, 21 bp, Homo sapiens
gtctctccccctctgtcttct

SEQ ID NO: 5501714 - DNA, 23 bp, Homo sapiens
gtctgagactctcttaggagcag

SEQ ID NO: 5501715 - DNA, 18 bp, Homo sapiens
gtctgagagaggccattc

SEQ ID NO: 5501716 - DNA, 19 bp, Homo sapiens
gtctgagatgccccgagcc

SEQ ID NO: 5501717 - DNA, 16 bp, Homo sapiens
gtctgagcatgatggg

SEQ ID NO: 5501718 - DNA, 17 bp, Homo sapiens
gtctgagccaaagagaa

SEQ ID NO: 5501719 - DNA, 20 bp, Homo sapiens
gtctgagcccatttctgggg

SEQ ID NO: 5501720 - DNA, 12 bp, Homo sapiens
gtctgagccctg

SEQ ID NO: 5501721 - DNA, 15 bp, Homo sapiens
gtctgagccctgccc

SEQ ID NO: 5501722 - DNA, 18 bp, Homo sapiens
gtctgagccctgccctca

SEQ ID NO: 5501723 - DNA, 18 bp, Homo sapiens
gtctgagcggcgcagagc

SEQ ID NO: 5501724 - DNA, 19 bp, Homo sapiens
gtctgagcggcgcagagcc

SEQ ID NO: 5501725 - DNA, 14 bp, Homo sapiens
gtctgagctggacg

SEQ ID NO: 5501726 - DNA, 21 bp, Homo sapiens
gtctgaggaatccagacccgg

SEQ ID NO: 5501727 - DNA, 19 bp, Homo sapiens
gtctgaggactgtcctccc

SEQ ID NO: 5501728 - DNA, 21 bp, Homo sapiens
gtctgaggactgtcctcccac

SEQ ID NO: 5501729 - DNA, 15 bp, Homo sapiens
gtctgaggcccctgc

SEQ ID NO: 5501730 - DNA, 17 bp, Homo sapiens
gtctgaggcccctgcct

SEQ ID NO: 5501731 - DNA, 18 bp, Homo sapiens
gtctgaggccgttgctga

SEQ ID NO: 5501732 - DNA, 14 bp, Homo sapiens
gtctgaggcctgcc

SEQ ID NO: 5501733 - DNA, 16 bp, Homo sapiens
gtctgaggcctgcccc

SEQ ID NO: 5501734 - DNA, 20 bp, Homo sapiens
gtctgaggcctgccccctgg

SEQ ID NO: 5501735 - DNA, 16 bp, Homo sapiens
gtctgaggtcctgagc

SEQ ID NO: 5501736 - DNA, 21 bp, Homo sapiens
gtctgaggtcctgagcactgc

SEQ ID NO: 5501737 - DNA, 19 bp, Homo sapiens
gtctgagtcctgtctctgc

SEQ ID NO: 5501738 - DNA, 15 bp, Homo sapiens
gtctgagtggcttca

SEQ ID NO: 5501739 - DNA, 12 bp, Homo sapiens
gtctgagtgggg

SEQ ID NO: 5501740 - DNA, 21 bp, Homo sapiens
gtctgagttgttaccccaagc

SEQ ID NO: 5501741 - DNA, 14 bp, Homo sapiens
gtctgatagtcctc

SEQ ID NO: 5501742 - DNA, 16 bp, Homo sapiens
gtctgatattaatcaa

SEQ ID NO: 5501743 - DNA, 15 bp, Homo sapiens
gtctgatattggtgt

SEQ ID NO: 5501744 - DNA, 18 bp, Homo sapiens
gtctgatgccaaagctgc

SEQ ID NO: 5501745 - DNA, 17 bp, Homo sapiens
gtctgatgtgtgcccag

SEQ ID NO: 5501746 - DNA, 20 bp, Homo sapiens
gtctgatgtgtgcccagatc

SEQ ID NO: 5501747 - DNA, 18 bp, Homo sapiens
gtctgatgttctttccat

SEQ ID NO: 5501748 - DNA, 14 bp, Homo sapiens
gtctgatgtttgtt

SEQ ID NO: 5501749 - DNA, 12 bp, Homo sapiens
gtctgattctat

SEQ ID NO: 5501750 - DNA, 22 bp, Homo sapiens
gtctgattctctttaactgtgt

SEQ ID NO: 5501751 - DNA, 20 bp, Homo sapiens
gtctgattggctcacccaag

SEQ ID NO: 5501752 - DNA, 16 bp, Homo sapiens
gtctgattggctgctt

SEQ ID NO: 5501753 - DNA, 18 bp, Homo sapiens
gtctgattggcttgtaga

SEQ ID NO: 5501754 - DNA, 11 bp, Homo sapiens
gtctgattgtt

SEQ ID NO: 5501755 - DNA, 12 bp, Homo sapiens
gtctgatttgca

SEQ ID NO: 5501756 - DNA, 15 bp, Homo sapiens
gtctgatttgcagga

SEQ ID NO: 5501757 - DNA, 16 bp, Homo sapiens
gtctgatttgcaggat

SEQ ID NO: 5501758 - DNA, 16 bp, Homo sapiens
gtctgatttgtgatga

SEQ ID NO: 5501759 - DNA, 16 bp, Homo sapiens
gtctgattttctcact

SEQ ID NO: 5501760 - DNA, 23 bp, Homo sapiens
gtctgcaaaatgaggaatgtata

SEQ ID NO: 5501761 - DNA, 14 bp, Homo sapiens
gtctgcaaaggagg

SEQ ID NO: 5501762 - DNA, 20 bp, Homo sapiens
gtctgcaactttaagcagct

SEQ ID NO: 5501763 - DNA, 23 bp, Homo sapiens
gtctgcaactttaagcagctctt

SEQ ID NO: 5501764 - DNA, 15 bp, Homo sapiens
gtctgcaagggccca

SEQ ID NO: 5501765 - DNA, 18 bp, Homo sapiens
gtctgcaagtcagaggat

SEQ ID NO: 5501766 - DNA, 16 bp, Homo sapiens
gtctgcaatgtccctt

SEQ ID NO: 5501767 - DNA, 11 bp, Homo sapiens
gtctgcacaca

SEQ ID NO: 5501768 - DNA, 15 bp, Homo sapiens
gtctgcacccagggg

SEQ ID NO: 5501769 - DNA, 20 bp, Homo sapiens
gtctgcacctccgcttgcca

SEQ ID NO: 5501770 - DNA, 15 bp, Homo sapiens
gtctgcaccttagaa

SEQ ID NO: 5501771 - DNA, 19 bp, Homo sapiens
gtctgcagatagaaagcat

SEQ ID NO: 5501772 - DNA, 13 bp, Homo sapiens
gtctgcagccctg

SEQ ID NO: 5501773 - DNA, 15 bp, Homo sapiens
gtctgcagccctgag

SEQ ID NO: 5501774 - DNA, 19 bp, Homo sapiens
gtctgcagcctgctggggc

SEQ ID NO: 5501775 - DNA, 19 bp, Homo sapiens
gtctgcagctattcacaca

SEQ ID NO: 5501776 - DNA, 15 bp, Homo sapiens
gtctgcagctcctgg

SEQ ID NO: 5501777 - DNA, 15 bp, Homo sapiens
gtctgcagctggtgt

SEQ ID NO: 5501778 - DNA, 14 bp, Homo sapiens
gtctgcaggggcct

SEQ ID NO: 5501779 - DNA, 16 bp, Homo sapiens
gtctgcaggggcctgg

SEQ ID NO: 5501780 - DNA, 20 bp, Homo sapiens
gtctgcaggggcctggagga

SEQ ID NO: 5501781 - DNA, 22 bp, Homo sapiens
gtctgcagggtgacgcctgaga

SEQ ID NO: 5501782 - DNA, 14 bp, Homo sapiens
gtctgcaggtgggc

SEQ ID NO: 5501783 - DNA, 20 bp, Homo sapiens
gtctgcatcagctttttgta

SEQ ID NO: 5501784 - DNA, 21 bp, Homo sapiens
gtctgcatcagctttttgtat

SEQ ID NO: 5501785 - DNA, 18 bp, Homo sapiens
gtctgcatggcagaagcg

SEQ ID NO: 5501786 - DNA, 23 bp, Homo sapiens
gtctgcatgtcttttatcattgc

SEQ ID NO: 5501787 - DNA, 20 bp, Homo sapiens
gtctgcatttcggtggctag

SEQ ID NO: 5501788 - DNA, 21 bp, Homo sapiens
gtctgcatttcggtggctagt

SEQ ID NO: 5501789 - DNA, 19 bp, Homo sapiens
gtctgcattttctcaggca

SEQ ID NO: 5501790 - DNA, 15 bp, Homo sapiens
gtctgcattttctga

SEQ ID NO: 5501791 - DNA, 20 bp, Homo sapiens
gtctgcattttctgaaacta

SEQ ID NO: 5501792 - DNA, 15 bp, Homo sapiens
gtctgccaatctgta

SEQ ID NO: 5501793 - DNA, 18 bp, Homo sapiens
gtctgccaatttttgcct

SEQ ID NO: 5501794 - DNA, 18 bp, Homo sapiens
gtctgccaccatcctgct

SEQ ID NO: 5501795 - DNA, 17 bp, Homo sapiens
gtctgccagccagcagc

SEQ ID NO: 5501796 - DNA, 18 bp, Homo sapiens
gtctgccagccagcagcc

SEQ ID NO: 5501797 - DNA, 10 bp, Homo sapiens
gtctgccagg

SEQ ID NO: 5501798 - DNA, 11 bp, Homo sapiens
gtctgccaggg

SEQ ID NO: 5501799 - DNA, 21 bp, Homo sapiens
gtctgccagggcccctctccc

SEQ ID NO: 5501800 - DNA, 16 bp, Homo sapiens
gtctgccatgttgccc

SEQ ID NO: 5501801 - DNA, 21 bp, Homo sapiens
gtctgccatgttgcccctttc

SEQ ID NO: 5501802 - DNA, 14 bp, Homo sapiens
gtctgcccaccatt

SEQ ID NO: 5501803 - DNA, 22 bp, Homo sapiens
gtctgccccaagttttgtgaaa

SEQ ID NO: 5501804 - DNA, 20 bp, Homo sapiens
gtctgcccccgtcttctctc

SEQ ID NO: 5501805 - DNA, 17 bp, Homo sapiens
gtctgccccgccctcat

SEQ ID NO: 5501806 - DNA, 17 bp, Homo sapiens
gtctgccccttgacccc

SEQ ID NO: 5501807 - DNA, 16 bp, Homo sapiens
gtctgccctgcccata

SEQ ID NO: 5501808 - DNA, 17 bp, Homo sapiens
gtctgcccttcacccca

SEQ ID NO: 5501809 - DNA, 17 bp, Homo sapiens
gtctgccgcccacctcg

SEQ ID NO: 5501810 - DNA, 16 bp, Homo sapiens
gtctgcctaggagctg

SEQ ID NO: 5501811 - DNA, 19 bp, Homo sapiens
gtctgcctaggagctggct

SEQ ID NO: 5501812 - DNA, 22 bp, Homo sapiens
gtctgcctaggagctggctggc

SEQ ID NO: 5501813 - DNA, 13 bp, Homo sapiens
gtctgcctatgca

SEQ ID NO: 5501814 - DNA, 14 bp, Homo sapiens
gtctgcctccagcc

SEQ ID NO: 5501815 - DNA, 17 bp, Homo sapiens
gtctgcctccagccaaa

SEQ ID NO: 5501816 - DNA, 11 bp, Homo sapiens
gtctgcctcct

SEQ ID NO: 5501817 - DNA, 13 bp, Homo sapiens
gtctgcctcctgc

SEQ ID NO: 5501818 - DNA, 19 bp, Homo sapiens
gtctgcctctgagccactg

SEQ ID NO: 5501819 - DNA, 11 bp, Homo sapiens
gtctgcctctt

SEQ ID NO: 5501820 - DNA, 23 bp, Homo sapiens
gtctgcctgcctcatgctctcta

SEQ ID NO: 5501821 - DNA, 13 bp, Homo sapiens
gtctgcctggagg

SEQ ID NO: 5501822 - DNA, 13 bp, Homo sapiens
gtctgcctggagt

SEQ ID NO: 5501823 - DNA, 13 bp, Homo sapiens
gtctgcctgtatt

SEQ ID NO: 5501824 - DNA, 19 bp, Homo sapiens
gtctgccttaggctgctgg

SEQ ID NO: 5501825 - DNA, 21 bp, Homo sapiens
gtctgccttaggctgctggga

SEQ ID NO: 5501826 - DNA, 14 bp, Homo sapiens
gtctgcgaagtcct

SEQ ID NO: 5501827 - DNA, 21 bp, Homo sapiens
gtctgcgaagtcctatggaaa

SEQ ID NO: 5501828 - DNA, 18 bp, Homo sapiens
gtctgcgccgctgtgctg

SEQ ID NO: 5501829 - DNA, 19 bp, Homo sapiens
gtctgcgccttgggatggg

SEQ ID NO: 5501830 - DNA, 23 bp, Homo sapiens
gtctgcggcagttgccgcttctg

SEQ ID NO: 5501831 - DNA, 23 bp, Homo sapiens
gtctgcgtcaggcacgtctcctg

SEQ ID NO: 5501832 - DNA, 21 bp, Homo sapiens
gtctgcgtcgggcgtgggtct

SEQ ID NO: 5501833 - DNA, 15 bp, Homo sapiens
gtctgcgtgactatt

SEQ ID NO: 5501834 - DNA, 24 bp, Homo sapiens
gtctgcgtgggtttttgtatccag

SEQ ID NO: 5501835 - DNA, 21 bp, Homo sapiens
gtctgcgttaggcagggcagg

SEQ ID NO: 5501836 - DNA, 15 bp, Homo sapiens
gtctgctaggcgctg

SEQ ID NO: 5501837 - DNA, 18 bp, Homo sapiens
gtctgctaggcgctgggg

SEQ ID NO: 5501838 - DNA, 16 bp, Homo sapiens
gtctgctatcattatt

SEQ ID NO: 5501839 - DNA, 12 bp, Homo sapiens
gtctgctcagga

SEQ ID NO: 5501840 - DNA, 18 bp, Homo sapiens
gtctgctccagctctggc

SEQ ID NO: 5501841 - DNA, 13 bp, Homo sapiens
gtctgctcctctt

SEQ ID NO: 5501842 - DNA, 22 bp, Homo sapiens
gtctgctcctcttgttcctgaa

SEQ ID NO: 5501843 - DNA, 14 bp, Homo sapiens
gtctgctcctggga

SEQ ID NO: 5501844 - DNA, 15 bp, Homo sapiens
gtctgctcctgggaa

SEQ ID NO: 5501845 - DNA, 22 bp, Homo sapiens
gtctgctcctgtggcggtgcag

SEQ ID NO: 5501846 - DNA, 21 bp, Homo sapiens
gtctgctctagatgagctggg

SEQ ID NO: 5501847 - DNA, 12 bp, Homo sapiens
gtctgctctcag

SEQ ID NO: 5501848 - DNA, 15 bp, Homo sapiens
gtctgctctcagctt

SEQ ID NO: 5501849 - DNA, 11 bp, Homo sapiens
gtctgctctgc

SEQ ID NO: 5501850 - DNA, 13 bp, Homo sapiens
gtctgctctgcat

SEQ ID NO: 5501851 - DNA, 12 bp, Homo sapiens
gtctgctctgct

SEQ ID NO: 5501852 - DNA, 21 bp, Homo sapiens
gtctgctctgctgctctgacc

SEQ ID NO: 5501853 - DNA, 17 bp, Homo sapiens
gtctgctcttatttttg

SEQ ID NO: 5501854 - DNA, 15 bp, Homo sapiens
gtctgctctttctct

SEQ ID NO: 5501855 - DNA, 19 bp, Homo sapiens
gtctgctctttctctgcca

SEQ ID NO: 5501856 - DNA, 18 bp, Homo sapiens
gtctgctgagttggcctg

SEQ ID NO: 5501857 - DNA, 13 bp, Homo sapiens
gtctgctgccagc

SEQ ID NO: 5501858 - DNA, 14 bp, Homo sapiens
gtctgctgccagca

SEQ ID NO: 5501859 - DNA, 12 bp, Homo sapiens
gtctgctgcccc

SEQ ID NO: 5501860 - DNA, 13 bp, Homo sapiens
gtctgctgccctc

SEQ ID NO: 5501861 - DNA, 16 bp, Homo sapiens
gtctgctgcctccaag

SEQ ID NO: 5501862 - DNA, 10 bp, Homo sapiens
gtctgctgct

SEQ ID NO: 5501863 - DNA, 17 bp, Homo sapiens
gtctgctgctcccagcc

SEQ ID NO: 5501864 - DNA, 20 bp, Homo sapiens
gtctgctggtgtcattgctg

SEQ ID NO: 5501865 - DNA, 23 bp, Homo sapiens
gtctgctgtaagacggccttgga

SEQ ID NO: 5501866 - DNA, 13 bp, Homo sapiens
gtctgcttagaaa

SEQ ID NO: 5501867 - DNA, 14 bp, Homo sapiens
gtctgcttagaaat

SEQ ID NO: 5501868 - DNA, 13 bp, Homo sapiens
gtctgcttctgca

SEQ ID NO: 5501869 - DNA, 21 bp, Homo sapiens
gtctgcttctgcaccttatct

SEQ ID NO: 5501870 - DNA, 23 bp, Homo sapiens
gtctgcttctgtccaggacatga

SEQ ID NO: 5501871 - DNA, 17 bp, Homo sapiens
gtctgcttgcatctgca

SEQ ID NO: 5501872 - DNA, 14 bp, Homo sapiens
gtctgcttgtcaaa

SEQ ID NO: 5501873 - DNA, 19 bp, Homo sapiens
gtctgcttttgctggggta

SEQ ID NO: 5501874 - DNA, 10 bp, Homo sapiens
gtctggaaag

SEQ ID NO: 5501875 - DNA, 22 bp, Homo sapiens
gtctggaactgctgctgacccc

SEQ ID NO: 5501876 - DNA, 13 bp, Homo sapiens
gtctggaagaaga

SEQ ID NO: 5501877 - DNA, 13 bp, Homo sapiens
gtctggaagctga

SEQ ID NO: 5501878 - DNA, 18 bp, Homo sapiens
gtctggaagctgagcagg

SEQ ID NO: 5501879 - DNA, 19 bp, Homo sapiens
gtctggaagctgagcaggc

SEQ ID NO: 5501880 - DNA, 20 bp, Homo sapiens
gtctggaagctgagcaggcc

SEQ ID NO: 5501881 - DNA, 20 bp, Homo sapiens
gtctggaaggtcacgctgaa

SEQ ID NO: 5501882 - DNA, 18 bp, Homo sapiens
gtctggaatcccagctcc

SEQ ID NO: 5501883 - DNA, 19 bp, Homo sapiens
gtctggacattcagaacac

SEQ ID NO: 5501884 - DNA, 12 bp, Homo sapiens
gtctggaccccg

SEQ ID NO: 5501885 - DNA, 15 bp, Homo sapiens
gtctggacctccatc

SEQ ID NO: 5501886 - DNA, 23 bp, Homo sapiens
gtctggacctccatccctgctct

SEQ ID NO: 5501887 - DNA, 16 bp, Homo sapiens
gtctggactagaaaat

SEQ ID NO: 5501888 - DNA, 15 bp, Homo sapiens
gtctggactgacagc

SEQ ID NO: 5501889 - DNA, 13 bp, Homo sapiens
gtctggactttgc

SEQ ID NO: 5501890 - DNA, 22 bp, Homo sapiens
gtctggagaagctcccaggaac

SEQ ID NO: 5501891 - DNA, 18 bp, Homo sapiens
gtctggagaataattctt

SEQ ID NO: 5501892 - DNA, 17 bp, Homo sapiens
gtctggagaccaggact

SEQ ID NO: 5501893 - DNA, 20 bp, Homo sapiens
gtctgtgccatttctcaggg

SEQ ID NO: 5501894 - DNA, 22 bp, Homo sapiens
gtctgtgccatttctcagggaa

SEQ ID NO: 5501895 - DNA, 23 bp, Homo sapiens
gtctgtgccccttccgccactgg

SEQ ID NO: 5501896 - DNA, 14 bp, Homo sapiens
gtctgtgcctcagt

SEQ ID NO: 5501897 - DNA, 21 bp, Homo sapiens
gtctgtgcgtctgtgtgttta

SEQ ID NO: 5501898 - DNA, 12 bp, Homo sapiens
gtctgtgctagg

SEQ ID NO: 5501899 - DNA, 13 bp, Homo sapiens
gtctgtgctctgt

SEQ ID NO: 5501900 - DNA, 14 bp, Homo sapiens
gtctgtgctgtgcc

SEQ ID NO: 5501901 - DNA, 17 bp, Homo sapiens
gtctgtgctgtgcctgc

SEQ ID NO: 5501902 - DNA, 19 bp, Homo sapiens
gtctgtgctgtgcctgcta

SEQ ID NO: 5501903 - DNA, 13 bp, Homo sapiens
gtctgtggatcag

SEQ ID NO: 5501904 - DNA, 13 bp, Homo sapiens
gtctgtggccctc

SEQ ID NO: 5501905 - DNA, 19 bp, Homo sapiens
gtctgtggctcctcccgaa

SEQ ID NO: 5501906 - DNA, 21 bp, Homo sapiens
gtctgtggctttcagcctctg

SEQ ID NO: 5501907 - DNA, 12 bp, Homo sapiens
gtctgtgggact

SEQ ID NO: 5501908 - DNA, 18 bp, Homo sapiens
gtctgtgggactggccca

SEQ ID NO: 5501909 - DNA, 12 bp, Homo sapiens
gtctgtgggctt

SEQ ID NO: 5501910 - DNA, 13 bp, Homo sapiens
gtctgtgggcttc

SEQ ID NO: 5501911 - DNA, 20 bp, Homo sapiens
gtctgtggtccagaagaaat

SEQ ID NO: 5501912 - DNA, 17 bp, Homo sapiens
gtctgtggttgcagtct

SEQ ID NO: 5501913 - DNA, 23 bp, Homo sapiens
gtctgtggttgcagtctttcccc

SEQ ID NO: 5501914 - DNA, 20 bp, Homo sapiens
gtctgtgtaacatccaagcc

SEQ ID NO: 5501915 - DNA, 23 bp, Homo sapiens
gtctgtgtaacatccaagccaga

SEQ ID NO: 5501916 - DNA, 15 bp, Homo sapiens
gtctgtgtatacata

SEQ ID NO: 5501917 - DNA, 13 bp, Homo sapiens
gtctgtgtatgtg

SEQ ID NO: 5501918 - DNA, 15 bp, Homo sapiens
gtctgtgtgaatgtg

SEQ ID NO: 5501919 - DNA, 20 bp, Homo sapiens
gtctgtgtgatgaactttct

SEQ ID NO: 5501920 - DNA, 10 bp, Homo sapiens
gtctgtgtgc

SEQ ID NO: 5501921 - DNA, 16 bp, Homo sapiens
gtctgtgtgctactaa

SEQ ID NO: 5501922 - DNA, 21 bp, Homo sapiens
gtctgtgtgctactaacagat

SEQ ID NO: 5501923 - DNA, 17 bp, Homo sapiens
gtctgtgtgctgtggtt

SEQ ID NO: 5501924 - DNA, 19 bp, Homo sapiens
gtctgtgtggccagcagcc

SEQ ID NO: 5501925 - DNA, 23 bp, Homo sapiens
gtctgtgtggccagcagcctctg

SEQ ID NO: 5501926 - DNA, 20 bp, Homo sapiens
gtctgtgtggtggagccagg

SEQ ID NO: 5501927 - DNA, 15 bp, Homo sapiens
gtctgtgtgtgcctg

SEQ ID NO: 5501928 - DNA, 12 bp, Homo sapiens
gtctgtgtgtgt

SEQ ID NO: 5501929 - DNA, 14 bp, Homo sapiens
gtctgtgtgtgtgt

SEQ ID NO: 5501930 - DNA, 16 bp, Homo sapiens
gtctgtgtgtgtgtat

SEQ ID NO: 5501931 - DNA, 15 bp, Homo sapiens
gtctgtgtgtgttct

SEQ ID NO: 5501932 - DNA, 17 bp, Homo sapiens
gtctgtgtgtgttcttc

SEQ ID NO: 5501933 - DNA, 15 bp, Homo sapiens
gtctgtgttgcttca

SEQ ID NO: 5501934 - DNA, 16 bp, Homo sapiens
gtctgtgttgcttcaa

SEQ ID NO: 5501935 - DNA, 19 bp, Homo sapiens
gtctgtgttgtgtcctgac

SEQ ID NO: 5501936 - DNA, 14 bp, Homo sapiens
gtctgtgttttaat

SEQ ID NO: 5501937 - DNA, 15 bp, Homo sapiens
gtctgttaatctttt

SEQ ID NO: 5501938 - DNA, 14 bp, Homo sapiens
gtctgttatttatt

SEQ ID NO: 5501939 - DNA, 15 bp, Homo sapiens
gtctgttatttatta

SEQ ID NO: 5501940 - DNA, 14 bp, Homo sapiens
gtctgttcccagcc

SEQ ID NO: 5501941 - DNA, 18 bp, Homo sapiens
gtctgttcccagcccctg

SEQ ID NO: 5501942 - DNA, 22 bp, Homo sapiens
gtctgttcccagcccctgcaga

SEQ ID NO: 5501943 - DNA, 14 bp, Homo sapiens
gtctgttctcacat

SEQ ID NO: 5501944 - DNA, 21 bp, Homo sapiens
gtctgttctgcacaataaaca

SEQ ID NO: 5501945 - DNA, 15 bp, Homo sapiens
gtctgttcttgaagc

SEQ ID NO: 5501946 - DNA, 22 bp, Homo sapiens
gtctgttgaagtgcatgttaaa

SEQ ID NO: 5501947 - DNA, 13 bp, Homo sapiens
gtctgttgattaa

SEQ ID NO: 5501948 - DNA, 15 bp, Homo sapiens
gtctgttgcaaaggg

SEQ ID NO: 5501949 - DNA, 20 bp, Homo sapiens
gtctgttgctgctccatggt

SEQ ID NO: 5501950 - DNA, 15 bp, Homo sapiens
gtctgttgtaaatga

SEQ ID NO: 5501951 - DNA, 22 bp, Homo sapiens
gtctgttgtgtgtcatgccagt

SEQ ID NO: 5501952 - DNA, 15 bp, Homo sapiens
gtctgtttaagaaaa

SEQ ID NO: 5501953 - DNA, 20 bp, Homo sapiens
gtctgtttaagaaaagtatt

SEQ ID NO: 5501954 - DNA, 20 bp, Homo sapiens
gtctgtttcaatgacctgta

SEQ ID NO: 5501955 - DNA, 22 bp, Homo sapiens
gtctgtttccaggtcagaaacc

SEQ ID NO: 5501956 - DNA, 15 bp, Homo sapiens
gtctgtttcccaagc

SEQ ID NO: 5501957 - DNA, 18 bp, Homo sapiens
gtctgtttccttctcttt

SEQ ID NO: 5501958 - DNA, 22 bp, Homo sapiens
gtctgtttccttctctttctcc

SEQ ID NO: 5501959 - DNA, 23 bp, Homo sapiens
gtctgtttctggaaatgttcttt

SEQ ID NO: 5501960 - DNA, 14 bp, Homo sapiens
gtctgtttgccact

SEQ ID NO: 5501961 - DNA, 21 bp, Homo sapiens
gtctgtttggactgcagaagc

SEQ ID NO: 5501962 - DNA, 19 bp, Homo sapiens
gtctgtttgtctgaacaaa

SEQ ID NO: 5501963 - DNA, 14 bp, Homo sapiens
gtctgtttgtttca

SEQ ID NO: 5501964 - DNA, 18 bp, Homo sapiens
gtctgtttgtttcaagaa

SEQ ID NO: 5501965 - DNA, 22 bp, Homo sapiens
gtctgttttggtcccctccctc

SEQ ID NO: 5501966 - DNA, 23 bp, Homo sapiens
gtctgttttgtaaagtccccaga

SEQ ID NO: 5501967 - DNA, 22 bp, Homo sapiens
gtctgttttgtgtctggtgcag

SEQ ID NO: 5501968 - DNA, 15 bp, Homo sapiens
gtctgtttttgtatc

SEQ ID NO: 5501969 - DNA, 16 bp, Homo sapiens
gtcttaaaaaatgtga

SEQ ID NO: 5501970 - DNA, 21 bp, Homo sapiens
gtcttaaaaccagagaatctt

SEQ ID NO: 5501971 - DNA, 22 bp, Homo sapiens
gtcttaaaatgggtattcaaaa

SEQ ID NO: 5501972 - DNA, 22 bp, Homo sapiens
gtcttaaactaaatgtgcaata

SEQ ID NO: 5501973 - DNA, 22 bp, Homo sapiens
gtcttaaagcatttcaggccag

SEQ ID NO: 5501974 - DNA, 20 bp, Homo sapiens
gtcttaaataaaagaaatgc

SEQ ID NO: 5501975 - DNA, 13 bp, Homo sapiens
gtcttaaatgaga

SEQ ID NO: 5501976 - DNA, 22 bp, Homo sapiens
gtcttaaatgctcataaagatg

SEQ ID NO: 5501977 - DNA, 17 bp, Homo sapiens
gtcttaaatgctcattt

SEQ ID NO: 5501978 - DNA, 23 bp, Homo sapiens
gtcttaaatgctcattttctggt

SEQ ID NO: 5501979 - DNA, 21 bp, Homo sapiens
gtcttaacaaaccaacatctt

SEQ ID NO: 5501980 - DNA, 16 bp, Homo sapiens
gtcttaacctcaggga

SEQ ID NO: 5501981 - DNA, 18 bp, Homo sapiens
gtcttaacgaataaaggt

SEQ ID NO: 5501982 - DNA, 17 bp, Homo sapiens
gtcttaactaatgtaaa

SEQ ID NO: 5501983 - DNA, 18 bp, Homo sapiens
gtcttaactaatgtaaat

SEQ ID NO: 5501984 - DNA, 16 bp, Homo sapiens
gtcttaacttctcccc

SEQ ID NO: 5501985 - DNA, 21 bp, Homo sapiens
gtcttaagaaatgtataaact

SEQ ID NO: 5501986 - DNA, 23 bp, Homo sapiens
gtcttaagccttttgctcacaaa

SEQ ID NO: 5501987 - DNA, 14 bp, Homo sapiens
gtcttaagggtcac

SEQ ID NO: 5501988 - DNA, 16 bp, Homo sapiens
gtcttaagtgtttctc

SEQ ID NO: 5501989 - DNA, 21 bp, Homo sapiens
gtcttaagtgtttctcaaaag

SEQ ID NO: 5501990 - DNA, 17 bp, Homo sapiens
gtcttaatggatgaaat

SEQ ID NO: 5501991 - DNA, 16 bp, Homo sapiens
gtcttaattgtgttta

SEQ ID NO: 5501992 - DNA, 18 bp, Homo sapiens
gtcttaattgtgtttatt

SEQ ID NO: 5501993 - DNA, 19 bp, Homo sapiens
gtcttaatttatttcttaa

SEQ ID NO: 5501994 - DNA, 20 bp, Homo sapiens
gtcttaatttctatcttgtt

SEQ ID NO: 5501995 - DNA, 20 bp, Homo sapiens
gtcttacaaggcaggccttt

SEQ ID NO: 5501996 - DNA, 22 bp, Homo sapiens
gtcttacaaggcaggcctttcc

SEQ ID NO: 5501997 - DNA, 18 bp, Homo sapiens
gtcttacaatcaaatctc

SEQ ID NO: 5501998 - DNA, 18 bp, Homo sapiens
gtcttacataaaccattt

SEQ ID NO: 5501999 - DNA, 20 bp, Homo sapiens
gtcttacctctctgggacct

SEQ ID NO: 5502000 - DNA, 18 bp, Homo sapiens
gtcttactcaagatactg

SEQ ID NO: 5502001 - DNA, 14 bp, Homo sapiens
gtcttactctgtct

SEQ ID NO: 5502002 - DNA, 16 bp, Homo sapiens
gtcttactttgttaat

SEQ ID NO: 5502003 - DNA, 22 bp, Homo sapiens
gtcttactttgttaatttatct

SEQ ID NO: 5502004 - DNA, 13 bp, Homo sapiens
gtcttagagagag

SEQ ID NO: 5502005 - DNA, 14 bp, Homo sapiens
gtcttagagagaga

SEQ ID NO: 5502006 - DNA, 15 bp, Homo sapiens
gtcttagagagagag

SEQ ID NO: 5502007 - DNA, 15 bp, Homo sapiens
gtcttagctctttct

SEQ ID NO: 5502008 - DNA, 15 bp, Homo sapiens
gtcttagctttacat

SEQ ID NO: 5502009 - DNA, 17 bp, Homo sapiens
gtcttagctttacattt

SEQ ID NO: 5502010 - DNA, 21 bp, Homo sapiens
gtcttaggtcttcctgtggct

SEQ ID NO: 5502011 - DNA, 19 bp, Homo sapiens
gtcttaggtggcagggctg

SEQ ID NO: 5502012 - DNA, 20 bp, Homo sapiens
gtcttagtcataccatccat

SEQ ID NO: 5502013 - DNA, 18 bp, Homo sapiens
gtcttagtttgaatgaaa

SEQ ID NO: 5502014 - DNA, 16 bp, Homo sapiens
gtcttataagaaaaca

SEQ ID NO: 5502015 - DNA, 19 bp, Homo sapiens
gtcttatatattgtagata

SEQ ID NO: 5502016 - DNA, 21 bp, Homo sapiens
gtcttatatttacaacacttt

SEQ ID NO: 5502017 - DNA, 16 bp, Homo sapiens
gtcttatcaactggtt

SEQ ID NO: 5502018 - DNA, 20 bp, Homo sapiens
gtcttatcccccccagcctg

SEQ ID NO: 5502019 - DNA, 20 bp, Homo sapiens
gtcttatctgagctgagcca

SEQ ID NO: 5502020 - DNA, 18 bp, Homo sapiens
gtcttatgattttattac

SEQ ID NO: 5502021 - DNA, 17 bp, Homo sapiens
gtcttatggcgttgcag

SEQ ID NO: 5502022 - DNA, 16 bp, Homo sapiens
gtcttatggtccagaa

SEQ ID NO: 5502023 - DNA, 16 bp, Homo sapiens
gtcttatggtcttgat

SEQ ID NO: 5502024 - DNA, 22 bp, Homo sapiens
gtcttatgtaaagtatgttttt

SEQ ID NO: 5502025 - DNA, 23 bp, Homo sapiens
gtcttatgtaaagtatgttttta

SEQ ID NO: 5502026 - DNA, 22 bp, Homo sapiens
gtcttatgtgaaaaattaactt

SEQ ID NO: 5502027 - DNA, 23 bp, Homo sapiens
gtcttattaaaacacttcattga

SEQ ID NO: 5502028 - DNA, 16 bp, Homo sapiens
gtcttattaagactgg

SEQ ID NO: 5502029 - DNA, 20 bp, Homo sapiens
gtcttattgaaaaaaaaaat

SEQ ID NO: 5502030 - DNA, 22 bp, Homo sapiens
gtcttatttaaccaggggtcct

SEQ ID NO: 5502031 - DNA, 14 bp, Homo sapiens
gtcttatttattat

SEQ ID NO: 5502032 - DNA, 14 bp, Homo sapiens
gtcttatttccaag

SEQ ID NO: 5502033 - DNA, 12 bp, Homo sapiens
gtcttattttat

SEQ ID NO: 5502034 - DNA, 19 bp, Homo sapiens
gtcttattttattatttct

SEQ ID NO: 5502035 - DNA, 14 bp, Homo sapiens
gtcttatttttcta

SEQ ID NO: 5502036 - DNA, 16 bp, Homo sapiens
gtcttatttttctagt

SEQ ID NO: 5502037 - DNA, 23 bp, Homo sapiens
gtcttcaaattaaagtgctgttt

SEQ ID NO: 5502038 - DNA, 20 bp, Homo sapiens
gtcttcaaattgtcttttgt

SEQ ID NO: 5502039 - DNA, 19 bp, Homo sapiens
gtcttcaaatttgattcta

SEQ ID NO: 5502040 - DNA, 24 bp, Homo sapiens
gtcttcaaatttgattctaaatag

SEQ ID NO: 5502041 - DNA, 22 bp, Homo sapiens
gtcttcaacataacccacttgt

SEQ ID NO: 5502042 - DNA, 19 bp, Homo sapiens
gtcttcaacatcctgccag

SEQ ID NO: 5502043 - DNA, 22 bp, Homo sapiens
gtcttcaacatcctgccagccc

SEQ ID NO: 5502044 - DNA, 21 bp, Homo sapiens
gtcttcaaccctgccctgcac

SEQ ID NO: 5502045 - DNA, 22 bp, Homo sapiens
gtcttcaaccctgccctgcacc

SEQ ID NO: 5502046 - DNA, 14 bp, Homo sapiens
gtcttcaagcctgg

SEQ ID NO: 5502047 - DNA, 18 bp, Homo sapiens
gtcttcaagcctggccca

SEQ ID NO: 5502048 - DNA, 23 bp, Homo sapiens
gtcttcaagcctggcccagtgag

SEQ ID NO: 5502049 - DNA, 13 bp, Homo sapiens
gtcttcaaggact

SEQ ID NO: 5502050 - DNA, 15 bp, Homo sapiens
gtcttcaatctctgt

SEQ ID NO: 5502051 - DNA, 13 bp, Homo sapiens
gtcttcacaacct

SEQ ID NO: 5502052 - DNA, 16 bp, Homo sapiens
gtcttcacactgcgca

SEQ ID NO: 5502053 - DNA, 17 bp, Homo sapiens
gtcttcacagctctgtg

SEQ ID NO: 5502054 - DNA, 13 bp, Homo sapiens
gtcttcaccaaca

SEQ ID NO: 5502055 - DNA, 17 bp, Homo sapiens
gtcttcacctgccacca

SEQ ID NO: 5502056 - DNA, 15 bp, Homo sapiens
gtcttcacggcagga

SEQ ID NO: 5502057 - DNA, 17 bp, Homo sapiens
gtcttcactgctctgcc

SEQ ID NO: 5502058 - DNA, 12 bp, Homo sapiens
gtcttcacttaa

SEQ ID NO: 5502059 - DNA, 15 bp, Homo sapiens
gtcttcagacccaga

SEQ ID NO: 5502060 - DNA, 17 bp, Homo sapiens
gtcttcagacccagaga

SEQ ID NO: 5502061 - DNA, 15 bp, Homo sapiens
gtcttcagattatta

SEQ ID NO: 5502062 - DNA, 18 bp, Homo sapiens
gtcttcagcacattccac

SEQ ID NO: 5502063 - DNA, 19 bp, Homo sapiens
gtcttcagcattccctccc

SEQ ID NO: 5502064 - DNA, 19 bp, Homo sapiens
gtcttcagcctccctcagc

SEQ ID NO: 5502065 - DNA, 14 bp, Homo sapiens
gtcttcagcctctt

SEQ ID NO: 5502066 - DNA, 16 bp, Homo sapiens
gtcttcagtaagccgt

SEQ ID NO: 5502067 - DNA, 20 bp, Homo sapiens
gtcttcagtctcacagagaa

SEQ ID NO: 5502068 - DNA, 22 bp, Homo sapiens
gtcttcagtctcacagagaagc

SEQ ID NO: 5502069 - DNA, 14 bp, Homo sapiens
gtctttaaaatgat

SEQ ID NO: 5502070 - DNA, 16 bp, Homo sapiens
gtctttaaatacttca

SEQ ID NO: 5502071 - DNA, 16 bp, Homo sapiens
gtctttaagagactca

SEQ ID NO: 5502072 - DNA, 23 bp, Homo sapiens
gtctttactgggaagcagttaag

SEQ ID NO: 5502073 - DNA, 16 bp, Homo sapiens
gtctttagatagccct

SEQ ID NO: 5502074 - DNA, 22 bp, Homo sapiens
gtctttagatagccctgtcctg

SEQ ID NO: 5502075 - DNA, 20 bp, Homo sapiens
gtctttagccccactgcttg

SEQ ID NO: 5502076 - DNA, 22 bp, Homo sapiens
gtctttaggtctttgtaagaac

SEQ ID NO: 5502077 - DNA, 17 bp, Homo sapiens
gtctttagttttgattt

SEQ ID NO: 5502078 - DNA, 21 bp, Homo sapiens
gtctttatgagctaaaaatat

SEQ ID NO: 5502079 - DNA, 17 bp, Homo sapiens
gtctttatgtaagaaga

SEQ ID NO: 5502080 - DNA, 20 bp, Homo sapiens
gtctttattagtaacatcat

SEQ ID NO: 5502081 - DNA, 14 bp, Homo sapiens
gtctttatttgtat

SEQ ID NO: 5502082 - DNA, 15 bp, Homo sapiens
gtctttcaagaatga

SEQ ID NO: 5502083 - DNA, 15 bp, Homo sapiens
gtctttcacagctcc

SEQ ID NO: 5502084 - DNA, 20 bp, Homo sapiens
gtctttcagatgatttgaaa

SEQ ID NO: 5502085 - DNA, 16 bp, Homo sapiens
gtctttcagtactttt

SEQ ID NO: 5502086 - DNA, 18 bp, Homo sapiens
gtctttcattcggtgtga

SEQ ID NO: 5502087 - DNA, 19 bp, Homo sapiens
gtctttcattcggtgtgaa

SEQ ID NO: 5502088 - DNA, 21 bp, Homo sapiens
gtctttcattcggtgtgaact

SEQ ID NO: 5502089 - DNA, 22 bp, Homo sapiens
gtctttcattttgcctgagtgt

SEQ ID NO: 5502090 - DNA, 22 bp, Homo sapiens
gtctttccaaattatttcttaa

SEQ ID NO: 5502091 - DNA, 22 bp, Homo sapiens
gtctttccactcctcctagcca

SEQ ID NO: 5502092 - DNA, 17 bp, Homo sapiens
gtctttccactttcatc

SEQ ID NO: 5502093 - DNA, 20 bp, Homo sapiens
gtctttccattggatctcat

SEQ ID NO: 5502094 - DNA, 21 bp, Homo sapiens
gtctttccctttaccactgtg

SEQ ID NO: 5502095 - DNA, 22 bp, Homo sapiens
gtctttcctcccttctttgctt

SEQ ID NO: 5502096 - DNA, 17 bp, Homo sapiens
gtctttcggaattttta

SEQ ID NO: 5502097 - DNA, 20 bp, Homo sapiens
gtctttctaatgtagctatt

SEQ ID NO: 5502098 - DNA, 13 bp, Homo sapiens
gtctttctagcca

SEQ ID NO: 5502099 - DNA, 22 bp, Homo sapiens
gtctttctagccataataaaat

SEQ ID NO: 5502100 - DNA, 13 bp, Homo sapiens
gtctttctataga

SEQ ID NO: 5502101 - DNA, 23 bp, Homo sapiens
gtctttctcaaagaaatattaag

SEQ ID NO: 5502102 - DNA, 15 bp, Homo sapiens
gtctttctcactgcc

SEQ ID NO: 5502103 - DNA, 16 bp, Homo sapiens
gtctttctcactgcct

SEQ ID NO: 5502104 - DNA, 14 bp, Homo sapiens
gtctttctcctcag

SEQ ID NO: 5502105 - DNA, 19 bp, Homo sapiens
gtctttctctaaatatgat

SEQ ID NO: 5502106 - DNA, 14 bp, Homo sapiens
gtctttctctttcc

SEQ ID NO: 5502107 - DNA, 12 bp, Homo sapiens
gtctttctgggg

SEQ ID NO: 5502108 - DNA, 21 bp, Homo sapiens
gtctttcttgaaattgaagag

SEQ ID NO: 5502109 - DNA, 13 bp, Homo sapiens
gtctttctttgct

SEQ ID NO: 5502110 - DNA, 16 bp, Homo sapiens
gtctttctttgctgct

SEQ ID NO: 5502111 - DNA, 17 bp, Homo sapiens
gtctttctttgctgctg

SEQ ID NO: 5502112 - DNA, 15 bp, Homo sapiens
gtctttgaactgccg

SEQ ID NO: 5502113 - DNA, 23 bp, Homo sapiens
gtctttgaaggaaagctaagtct

SEQ ID NO: 5502114 - DNA, 14 bp, Homo sapiens
gtctttgaataaag

SEQ ID NO: 5502115 - DNA, 14 bp, Homo sapiens
gtctttgcacatgt

SEQ ID NO: 5502116 - DNA, 15 bp, Homo sapiens
gtctttgcacatgtg

SEQ ID NO: 5502117 - DNA, 19 bp, Homo sapiens
gtctttgcacatgtgacca

SEQ ID NO: 5502118 - DNA, 21 bp, Homo sapiens
gtctttgcaccaaagatgtcc

SEQ ID NO: 5502119 - DNA, 13 bp, Homo sapiens
gtctttgccttct

SEQ ID NO: 5502120 - DNA, 22 bp, Homo sapiens
gtctttgcggggcctgtctcag

SEQ ID NO: 5502121 - DNA, 21 bp, Homo sapiens
gtctttgctaggcctcttgct

SEQ ID NO: 5502122 - DNA, 15 bp, Homo sapiens
gtctttgctgtactc

SEQ ID NO: 5502123 - DNA, 16 bp, Homo sapiens
gtctttgctgtttata

SEQ ID NO: 5502124 - DNA, 19 bp, Homo sapiens
gtctttggaaaaatgtttg

SEQ ID NO: 5502125 - DNA, 22 bp, Homo sapiens
gtctttggagaaatgcttagaa

SEQ ID NO: 5502126 - DNA, 21 bp, Homo sapiens
gtctttggataataggaattc

SEQ ID NO: 5502127 - DNA, 19 bp, Homo sapiens
gtctttggcttcagaattg

SEQ ID NO: 5502128 - DNA, 16 bp, Homo sapiens
gtctttgggcagggaa

SEQ ID NO: 5502129 - DNA, 20 bp, Homo sapiens
gtctttgggggattcaaatg

SEQ ID NO: 5502130 - DNA, 23 bp, Homo sapiens
gtctttgggggattcaaatgcat

SEQ ID NO: 5502131 - DNA, 22 bp, Homo sapiens
gtctttgggtacctattttcat

SEQ ID NO: 5502132 - DNA, 16 bp, Homo sapiens
gtctttggtgaacatt

SEQ ID NO: 5502133 - DNA, 15 bp, Homo sapiens
gtctttggttcagct

SEQ ID NO: 5502134 - DNA, 17 bp, Homo sapiens
gtctttggttcctcatg

SEQ ID NO: 5502135 - DNA, 15 bp, Homo sapiens
gtctttggttctaag

SEQ ID NO: 5502136 - DNA, 11 bp, Homo sapiens
gtctttgtaag

SEQ ID NO: 5502137 - DNA, 15 bp, Homo sapiens
gtctttgtaagtcag

SEQ ID NO: 5502138 - DNA, 18 bp, Homo sapiens
gtctttgtaatgtcacca

SEQ ID NO: 5502139 - DNA, 20 bp, Homo sapiens
gtctttgtaatgtcaccacc

SEQ ID NO: 5502140 - DNA, 16 bp, Homo sapiens
gtctttgtacagacaa

SEQ ID NO: 5502141 - DNA, 22 bp, Homo sapiens
gtctttgtcaccacgtggggct

SEQ ID NO: 5502142 - DNA, 22 bp, Homo sapiens
gtctttgtcatgcgtctctggc

SEQ ID NO: 5502143 - DNA, 13 bp, Homo sapiens
gtctttgtccctg

SEQ ID NO: 5502144 - DNA, 14 bp, Homo sapiens
gtctttgtggactg

SEQ ID NO: 5502145 - DNA, 22 bp, Homo sapiens
gtctttgtgggagggtaagaca

SEQ ID NO: 5502146 - DNA, 19 bp, Homo sapiens
gtctttgttaagactgctg

SEQ ID NO: 5502147 - DNA, 17 bp, Homo sapiens
gtctttgttatgacagt

SEQ ID NO: 5502148 - DNA, 14 bp, Homo sapiens
gtcttttaaaaagt

SEQ ID NO: 5502149 - DNA, 19 bp, Homo sapiens
gtcttttaaaaagtattgc

SEQ ID NO: 5502150 - DNA, 17 bp, Homo sapiens
gtcttttaactttagaa

SEQ ID NO: 5502151 - DNA, 19 bp, Homo sapiens
gtcttttaataaaaaggaa

SEQ ID NO: 5502152 - DNA, 24 bp, Homo sapiens
gtcttttaatgatactgtctaaga

SEQ ID NO: 5502153 - DNA, 19 bp, Homo sapiens
gtcttttaccctgtgtcag

SEQ ID NO: 5502154 - DNA, 21 bp, Homo sapiens
gtcttttaccctgtgtcagag

SEQ ID NO: 5502155 - DNA, 19 bp, Homo sapiens
gtcttttatatttgtatcg

SEQ ID NO: 5502156 - DNA, 21 bp, Homo sapiens
gtcttttcaagtaattttcat

SEQ ID NO: 5502157 - DNA, 17 bp, Homo sapiens
gtcttttcccctcattg

SEQ ID NO: 5502158 - DNA, 22 bp, Homo sapiens
gtcttttcctccccattcctac

SEQ ID NO: 5502159 - DNA, 23 bp, Homo sapiens
gtcttttcctccccattcctaca

SEQ ID NO: 5502160 - DNA, 23 bp, Homo sapiens
gtcttttctgttttttaaatgat

SEQ ID NO: 5502161 - DNA, 24 bp, Homo sapiens
gtcttttcttgcatgaggctagtg

SEQ ID NO: 5502162 - DNA, 14 bp, Homo sapiens
gtcttttcttggcg

SEQ ID NO: 5502163 - DNA, 15 bp, Homo sapiens
gtcttttctttgcca

SEQ ID NO: 5502164 - DNA, 20 bp, Homo sapiens
gtcttttctttgccatctct

SEQ ID NO: 5502165 - DNA, 14 bp, Homo sapiens
gtcttttgaatatt

SEQ ID NO: 5502166 - DNA, 13 bp, Homo sapiens
gtcttttgacatt

SEQ ID NO: 5502167 - DNA, 23 bp, Homo sapiens
gtcttttgcatgtcgcacaatgt

SEQ ID NO: 5502168 - DNA, 13 bp, Homo sapiens
gtcttttgctttt

SEQ ID NO: 5502169 - DNA, 16 bp, Homo sapiens
gtcttttgcttttggc

SEQ ID NO: 5502170 - DNA, 12 bp, Homo sapiens
gtcttttggagg

SEQ ID NO: 5502171 - DNA, 16 bp, Homo sapiens
gtcttttgtatttttg

SEQ ID NO: 5502172 - DNA, 18 bp, Homo sapiens
gtcttttgtgtctgtcat

SEQ ID NO: 5502173 - DNA, 22 bp, Homo sapiens
gtcttttgtgtctgtcatttct

SEQ ID NO: 5502174 - DNA, 20 bp, Homo sapiens
gtcttttgttctctcttggt

SEQ ID NO: 5502175 - DNA, 14 bp, Homo sapiens
gtctttttaagaat

SEQ ID NO: 5502176 - DNA, 16 bp, Homo sapiens
gtctttttatgcattt

SEQ ID NO: 5502177 - DNA, 13 bp, Homo sapiens
gtctttttccaaa

SEQ ID NO: 5502178 - DNA, 12 bp, Homo sapiens
gtctttttccta

SEQ ID NO: 5502179 - DNA, 23 bp, Homo sapiens
gtctttttcctactccgttcctg

SEQ ID NO: 5502180 - DNA, 20 bp, Homo sapiens
gtctttttctagggtccctg

SEQ ID NO: 5502181 - DNA, 13 bp, Homo sapiens
gtctttttctctt

SEQ ID NO: 5502182 - DNA, 20 bp, Homo sapiens
gtctttttctcttctgttct

SEQ ID NO: 5502183 - DNA, 16 bp, Homo sapiens
gtctttttctggactg

SEQ ID NO: 5502184 - DNA, 16 bp, Homo sapiens
gtctttttgaagtgtt

SEQ ID NO: 5502185 - DNA, 15 bp, Homo sapiens
gtctttttgtttggg

SEQ ID NO: 5502186 - DNA, 22 bp, Homo sapiens
gtcttttttcatttcttcctca

SEQ ID NO: 5502187 - DNA, 18 bp, Homo sapiens
gtcttttttctcttccct

SEQ ID NO: 5502188 - DNA, 23 bp, Homo sapiens
gtcttttttctcttcccttccca

SEQ ID NO: 5502189 - DNA, 13 bp, Homo sapiens
gtctttttttatt

SEQ ID NO: 5502190 - DNA, 16 bp, Homo sapiens
gtctttttttattact

SEQ ID NO: 5502191 - DNA, 14 bp, Homo sapiens
gtctttttttctgt

SEQ ID NO: 5502192 - DNA, 17 bp, Homo sapiens
gtcttttttttaatgtg

SEQ ID NO: 5502193 - DNA, 19 bp, Homo sapiens
gtcttttttttaatgtgct

SEQ ID NO: 5502194 - DNA, 17 bp, Homo sapiens
gtcttttttttcctttg

SEQ ID NO: 5502195 - DNA, 23 bp, Homo sapiens
gtctttttttttctttttccagt

SEQ ID NO: 5502196 - DNA, 23 bp, Homo sapiens
gtcttttttttttaagtgaaatt

SEQ ID NO: 5502197 - DNA, 19 bp, Homo sapiens
gtcttttttttttccaaat

SEQ ID NO: 5502198 - DNA, 15 bp, Homo sapiens
gtgaaaaaaaaaatg

SEQ ID NO: 5502199 - DNA, 13 bp, Homo sapiens
gtgaaaaactgct

SEQ ID NO: 5502200 - DNA, 21 bp, Homo sapiens
gtgaaaaagcctaagaaaaag

SEQ ID NO: 5502201 - DNA, 12 bp, Homo sapiens
gtgaaaaaggaa

SEQ ID NO: 5502202 - DNA, 13 bp, Homo sapiens
gtgaaaaatgagc

SEQ ID NO: 5502203 - DNA, 14 bp, Homo sapiens
gtgaaaaatgagct

SEQ ID NO: 5502204 - DNA, 20 bp, Homo sapiens
gtgaaaaatgagcttgtaaa

SEQ ID NO: 5502205 - DNA, 11 bp, Homo sapiens
gtgaaaaatgt

SEQ ID NO: 5502206 - DNA, 13 bp, Homo sapiens
gtgaaaaatgtca

SEQ ID NO: 5502207 - DNA, 18 bp, Homo sapiens
gtgaaaaatgttaggaca

SEQ ID NO: 5502208 - DNA, 14 bp, Homo sapiens
gtgaaaacaaatct

SEQ ID NO: 5502209 - DNA, 19 bp, Homo sapiens
gtgaaaacatatttgtgaa

SEQ ID NO: 5502210 - DNA, 19 bp, Homo sapiens
gtgaaaaccaaccctgtgg

SEQ ID NO: 5502211 - DNA, 21 bp, Homo sapiens
gtgaaaaccaaccctgtgggc

SEQ ID NO: 5502212 - DNA, 12 bp, Homo sapiens
gtgaaaagaata

SEQ ID NO: 5502213 - DNA, 22 bp, Homo sapiens
gtgaaaagtatggcagtgggag

SEQ ID NO: 5502214 - DNA, 19 bp, Homo sapiens
gtgaaaagtccttgattgt

SEQ ID NO: 5502215 - DNA, 21 bp, Homo sapiens
gtgaaaataaagcagaagcaa

SEQ ID NO: 5502216 - DNA, 18 bp, Homo sapiens
gtgaaaataagaaagaat

SEQ ID NO: 5502217 - DNA, 13 bp, Homo sapiens
gtgaaaatagtgt

SEQ ID NO: 5502218 - DNA, 23 bp, Homo sapiens
gtgaaaatatacttgactctaat

SEQ ID NO: 5502219 - DNA, 19 bp, Homo sapiens
gtgaaaatcgaggaagcac

SEQ ID NO: 5502220 - DNA, 15 bp, Homo sapiens
gtgaaaatgaagaag

SEQ ID NO: 5502221 - DNA, 18 bp, Homo sapiens
gtgaaaatgtaattataa

SEQ ID NO: 5502222 - DNA, 16 bp, Homo sapiens
gtgaaaatgtgtgtgt

SEQ ID NO: 5502223 - DNA, 12 bp, Homo sapiens
gtgaaaattatt

SEQ ID NO: 5502224 - DNA, 15 bp, Homo sapiens
gtgaaaattctgttg

SEQ ID NO: 5502225 - DNA, 17 bp, Homo sapiens
gtgaaaattttattgaa

SEQ ID NO: 5502226 - DNA, 15 bp, Homo sapiens
gtgaaacaaattaat

SEQ ID NO: 5502227 - DNA, 19 bp, Homo sapiens
gtgaaacaatgttgtccaa

SEQ ID NO: 5502228 - DNA, 22 bp, Homo sapiens
gtgaaacaatgttgtccaacaa

SEQ ID NO: 5502229 - DNA, 18 bp, Homo sapiens
gtgaaacaattattgtac

SEQ ID NO: 5502230 - DNA, 16 bp, Homo sapiens
gtgaaacacaccaggc

SEQ ID NO: 5502231 - DNA, 23 bp, Homo sapiens
gtgaaaccacaggcccttggggt

SEQ ID NO: 5502232 - DNA, 24 bp, Homo sapiens
gtgaaacccagtcactgtgagctc

SEQ ID NO: 5502233 - DNA, 16 bp, Homo sapiens
gtgaaaccccgtctct

SEQ ID NO: 5502234 - DNA, 19 bp, Homo sapiens
gtgaaacctttagggcagc

SEQ ID NO: 5502235 - DNA, 22 bp, Homo sapiens
gtgaaacctttagggcagcttg

SEQ ID NO: 5502236 - DNA, 14 bp, Homo sapiens
gtgaaacctttttt

SEQ ID NO: 5502237 - DNA, 19 bp, Homo sapiens
gtgaaaccttttttaagat

SEQ ID NO: 5502238 - DNA, 19 bp, Homo sapiens
gtgaaacgactcaaaatga

SEQ ID NO: 5502239 - DNA, 21 bp, Homo sapiens
gtgaaactgaaggtcaataaa

SEQ ID NO: 5502240 - DNA, 20 bp, Homo sapiens
gtgaaactgcttgtttccta

SEQ ID NO: 5502241 - DNA, 21 bp, Homo sapiens
gtgaaactgcttgtttcctag

SEQ ID NO: 5502242 - DNA, 12 bp, Homo sapiens
gtgaaactggat

SEQ ID NO: 5502243 - DNA, 18 bp, Homo sapiens
gtgaaacttgtgctatag

SEQ ID NO: 5502244 - DNA, 21 bp, Homo sapiens
gtgaaagaaagctgagaagaa

SEQ ID NO: 5502245 - DNA, 15 bp, Homo sapiens
gtgaataataaaagt

SEQ ID NO: 5502246 - DNA, 14 bp, Homo sapiens
gtgaatacaattaa

SEQ ID NO: 5502247 - DNA, 15 bp, Homo sapiens
gtgaatacaattaaa

SEQ ID NO: 5502248 - DNA, 19 bp, Homo sapiens
gtgaatacattctttgcta

SEQ ID NO: 5502249 - DNA, 21 bp, Homo sapiens
gtgaatacattctttgctagt

SEQ ID NO: 5502250 - DNA, 23 bp, Homo sapiens
gtgaatacttattttcagtgcat

SEQ ID NO: 5502251 - DNA, 17 bp, Homo sapiens
gtgaatagattttagca

SEQ ID NO: 5502252 - DNA, 17 bp, Homo sapiens
gtgaatataaatgtact

SEQ ID NO: 5502253 - DNA, 20 bp, Homo sapiens
gtgaatatgagaaatacaga

SEQ ID NO: 5502254 - DNA, 16 bp, Homo sapiens
gtgaatatgccagtga

SEQ ID NO: 5502255 - DNA, 16 bp, Homo sapiens
gtgaatattgttcata

SEQ ID NO: 5502256 - DNA, 21 bp, Homo sapiens
gtgaatatttgtaaaaataat

SEQ ID NO: 5502257 - DNA, 19 bp, Homo sapiens
gtgaatatttttgtatttt

SEQ ID NO: 5502258 - DNA, 13 bp, Homo sapiens
gtgaatcacctgg

SEQ ID NO: 5502259 - DNA, 14 bp, Homo sapiens
gtgaatcacctggc

SEQ ID NO: 5502260 - DNA, 21 bp, Homo sapiens
gtgaatcacctggctgagcag

SEQ ID NO: 5502261 - DNA, 14 bp, Homo sapiens
gtgaatccaggagg

SEQ ID NO: 5502262 - DNA, 16 bp, Homo sapiens
gtgaatccaggaggca

SEQ ID NO: 5502263 - DNA, 22 bp, Homo sapiens
gtgaatccatgatcaaaatgca

SEQ ID NO: 5502264 - DNA, 22 bp, Homo sapiens
gtgaatccatgggtctggctag

SEQ ID NO: 5502265 - DNA, 13 bp, Homo sapiens
gtgaatccctcaa

SEQ ID NO: 5502266 - DNA, 22 bp, Homo sapiens
gtgaatcctctgtttagaacac

SEQ ID NO: 5502267 - DNA, 15 bp, Homo sapiens
gtgaatcctggcaag

SEQ ID NO: 5502268 - DNA, 21 bp, Homo sapiens
gtgaatcgcaaggcctgtgct

SEQ ID NO: 5502269 - DNA, 15 bp, Homo sapiens
gtgaatctaataaaa

SEQ ID NO: 5502270 - DNA, 19 bp, Homo sapiens
gtgaatctgcttttcctct

SEQ ID NO: 5502271 - DNA, 13 bp, Homo sapiens
gtgaatctgtcta

SEQ ID NO: 5502272 - DNA, 14 bp, Homo sapiens
gtgaatctgtttca

SEQ ID NO: 5502273 - DNA, 21 bp, Homo sapiens
gtgaatcttatggtggaagag

SEQ ID NO: 5502274 - DNA, 15 bp, Homo sapiens
gtgaatctttctcct

SEQ ID NO: 5502275 - DNA, 16 bp, Homo sapiens
gtgaatctttctcctg

SEQ ID NO: 5502276 - DNA, 22 bp, Homo sapiens
gtgaatctttctcctggtgact

SEQ ID NO: 5502277 - DNA, 11 bp, Homo sapiens
gtgaatgaaag

SEQ ID NO: 5502278 - DNA, 22 bp, Homo sapiens
gtgaatgccaaagccattctcc

SEQ ID NO: 5502279 - DNA, 18 bp, Homo sapiens
gtgaatgccagtgtgctg

SEQ ID NO: 5502280 - DNA, 12 bp, Homo sapiens
gtgaatgctaag

SEQ ID NO: 5502281 - DNA, 21 bp, Homo sapiens
gtgaatgctgggactcagcct

SEQ ID NO: 5502282 - DNA, 14 bp, Homo sapiens
gtgaatggattgga

SEQ ID NO: 5502283 - DNA, 18 bp, Homo sapiens
gtgaatggctgtgcccca

SEQ ID NO: 5502284 - DNA, 13 bp, Homo sapiens
gtgaatggctttg

SEQ ID NO: 5502285 - DNA, 14 bp, Homo sapiens
gtgaatggctttgt

SEQ ID NO: 5502286 - DNA, 17 bp, Homo sapiens
gtgaatggctttgtata

SEQ ID NO: 5502287 - DNA, 12 bp, Homo sapiens
gtgaatgggtgc

SEQ ID NO: 5502288 - DNA, 21 bp, Homo sapiens
gtgaatgtagcttccacctca

SEQ ID NO: 5502289 - DNA, 23 bp, Homo sapiens
gtgaatgtaggctggctttcaga

SEQ ID NO: 5502290 - DNA, 13 bp, Homo sapiens
gtgaatgtctcag

SEQ ID NO: 5502291 - DNA, 16 bp, Homo sapiens
gtgaatgtggcagttt

SEQ ID NO: 5502292 - DNA, 17 bp, Homo sapiens
gtgaatgtggcagttta

SEQ ID NO: 5502293 - DNA, 18 bp, Homo sapiens
gtgaatgtgtgagaaaaa

SEQ ID NO: 5502294 - DNA, 15 bp, Homo sapiens
gtgaatgtgtgtatg

SEQ ID NO: 5502295 - DNA, 19 bp, Homo sapiens
gtgaatgttggtgtgaaac

SEQ ID NO: 5502296 - DNA, 21 bp, Homo sapiens
gtgaattaattaaacattgtg

SEQ ID NO: 5502297 - DNA, 15 bp, Homo sapiens
gtgaattacactcaa

SEQ ID NO: 5502298 - DNA, 16 bp, Homo sapiens
gtgaattactaacttc

SEQ ID NO: 5502299 - DNA, 13 bp, Homo sapiens
gtgaattccctca

SEQ ID NO: 5502300 - DNA, 14 bp, Homo sapiens
gtgaattccctcac

SEQ ID NO: 5502301 - DNA, 11 bp, Homo sapiens
gtgaattctgc

SEQ ID NO: 5502302 - DNA, 18 bp, Homo sapiens
gtgaattctgtgaagaat

SEQ ID NO: 5502303 - DNA, 18 bp, Homo sapiens
gtgaattcttgaaggaaa

SEQ ID NO: 5502304 - DNA, 19 bp, Homo sapiens
gtgaattgaagtcatcata

SEQ ID NO: 5502305 - DNA, 13 bp, Homo sapiens
gtgaattgactac

SEQ ID NO: 5502306 - DNA, 20 bp, Homo sapiens
gtgaattgcctgcagagaga

SEQ ID NO: 5502307 - DNA, 22 bp, Homo sapiens
gtgaattgcctgcagagagaag

SEQ ID NO: 5502308 - DNA, 23 bp, Homo sapiens
gtgaattgcctgcagagagaagc

SEQ ID NO: 5502309 - DNA, 14 bp, Homo sapiens
gtgaattgcctgcc

SEQ ID NO: 5502310 - DNA, 14 bp, Homo sapiens
gtgaattgctttat

SEQ ID NO: 5502311 - DNA, 15 bp, Homo sapiens
gtgaattgctttatg

SEQ ID NO: 5502312 - DNA, 18 bp, Homo sapiens
gtgaattgtcttttagac

SEQ ID NO: 5502313 - DNA, 19 bp, Homo sapiens
gtgaattgtcttttagaca

SEQ ID NO: 5502314 - DNA, 20 bp, Homo sapiens
gtgaattgtggctgttcact

SEQ ID NO: 5502315 - DNA, 18 bp, Homo sapiens
gtgaattgtttttgtaca

SEQ ID NO: 5502316 - DNA, 20 bp, Homo sapiens
gtgaatttaatgcttaaaaa

SEQ ID NO: 5502317 - DNA, 20 bp, Homo sapiens
gtgaatttatacctacctgt

SEQ ID NO: 5502318 - DNA, 14 bp, Homo sapiens
gtgaatttatgaga

SEQ ID NO: 5502319 - DNA, 14 bp, Homo sapiens
gtgaatttctaaat

SEQ ID NO: 5502320 - DNA, 12 bp, Homo sapiens
gtgaatttctga

SEQ ID NO: 5502321 - DNA, 13 bp, Homo sapiens
gtgaatttgaatc

SEQ ID NO: 5502322 - DNA, 16 bp, Homo sapiens
gtgaatttgaatgaaa

SEQ ID NO: 5502323 - DNA, 20 bp, Homo sapiens
gtgaatttgagtttgctgtt

SEQ ID NO: 5502324 - DNA, 18 bp, Homo sapiens
gtgaatttgtttgtgaca

SEQ ID NO: 5502325 - DNA, 12 bp, Homo sapiens
gtgaattttcaa

SEQ ID NO: 5502326 - DNA, 20 bp, Homo sapiens
gtgaattttccaagaacata

SEQ ID NO: 5502327 - DNA, 22 bp, Homo sapiens
gtgaattttggtgatgtaaaac

SEQ ID NO: 5502328 - DNA, 13 bp, Homo sapiens
gtgaatttttaag

SEQ ID NO: 5502329 - DNA, 15 bp, Homo sapiens
gtgaatttttctcta

SEQ ID NO: 5502330 - DNA, 15 bp, Homo sapiens
gtgaatttttgcaat

SEQ ID NO: 5502331 - DNA, 21 bp, Homo sapiens
gtgaatttttgcaataatgca

SEQ ID NO: 5502332 - DNA, 23 bp, Homo sapiens
gtgaatttttgcaataatgcagt

SEQ ID NO: 5502333 - DNA, 20 bp, Homo sapiens
gtgacaaaaaattaaagcat

SEQ ID NO: 5502334 - DNA, 21 bp, Homo sapiens
gtgacaaaagcagcacaagga

SEQ ID NO: 5502335 - DNA, 22 bp, Homo sapiens
gtgacaaaatgggaggaggaaa

SEQ ID NO: 5502336 - DNA, 18 bp, Homo sapiens
gtgacaaaatgttgataa

SEQ ID NO: 5502337 - DNA, 23 bp, Homo sapiens
gtgacaaaccatccagtggaggt

SEQ ID NO: 5502338 - DNA, 19 bp, Homo sapiens
gtgacaaagatggctcaga

SEQ ID NO: 5502339 - DNA, 13 bp, Homo sapiens
gtgacaaagcaat

SEQ ID NO: 5502340 - DNA, 17 bp, Homo sapiens
gtgacaaagcaatttac

SEQ ID NO: 5502341 - DNA, 16 bp, Homo sapiens
gtgacaaataagatta

SEQ ID NO: 5502342 - DNA, 11 bp, Homo sapiens
gtgacaacatg

SEQ ID NO: 5502343 - DNA, 16 bp, Homo sapiens
gtgacaaccctggcct

SEQ ID NO: 5502344 - DNA, 16 bp, Homo sapiens
gtgacaacctttgtgt

SEQ ID NO: 5502345 - DNA, 14 bp, Homo sapiens
gtgacaagtggagg

SEQ ID NO: 5502346 - DNA, 15 bp, Homo sapiens
gtgacaagtggaggg

SEQ ID NO: 5502347 - DNA, 14 bp, Homo sapiens
gtgacaagtgtgtc

SEQ ID NO: 5502348 - DNA, 23 bp, Homo sapiens
gtgacaatacaccttccccaccc

SEQ ID NO: 5502349 - DNA, 21 bp, Homo sapiens
gtgacaatgactaagccaagc

SEQ ID NO: 5502350 - DNA, 22 bp, Homo sapiens
gtgacaatgactaagccaagct

SEQ ID NO: 5502351 - DNA, 16 bp, Homo sapiens
gtgacaattctgtttt

SEQ ID NO: 5502352 - DNA, 13 bp, Homo sapiens
gtgacacaaacac

SEQ ID NO: 5502353 - DNA, 16 bp, Homo sapiens
gtgacacaaattgaag

SEQ ID NO: 5502354 - DNA, 20 bp, Homo sapiens
gtgacacaatcctcaaacat

SEQ ID NO: 5502355 - DNA, 20 bp, Homo sapiens
gtgacacactacaccacaca

SEQ ID NO: 5502356 - DNA, 22 bp, Homo sapiens
gtgacacagacattttgtgtga

SEQ ID NO: 5502357 - DNA, 14 bp, Homo sapiens
gtgacacagactca

SEQ ID NO: 5502358 - DNA, 19 bp, Homo sapiens
gtgacacagactcatcctg

SEQ ID NO: 5502359 - DNA, 19 bp, Homo sapiens
gtgacacagcagcttcacc

SEQ ID NO: 5502360 - DNA, 18 bp, Homo sapiens
gtgacaccaccactgtgt

SEQ ID NO: 5502361 - DNA, 20 bp, Homo sapiens
gtgacaccaccactgtgtcc

SEQ ID NO: 5502362 - DNA, 22 bp, Homo sapiens
gtgacaccaccactgtgtccca

SEQ ID NO: 5502363 - DNA, 23 bp, Homo sapiens
gtgacaccaccactgtgtcccag

SEQ ID NO: 5502364 - DNA, 23 bp, Homo sapiens
gtgacaccagcctttctcccagg

SEQ ID NO: 5502365 - DNA, 16 bp, Homo sapiens
gtgacacccaagaggg

SEQ ID NO: 5502366 - DNA, 18 bp, Homo sapiens
gtgacaccccccttctga

SEQ ID NO: 5502367 - DNA, 15 bp, Homo sapiens
gtgacacgcttctga

SEQ ID NO: 5502368 - DNA, 17 bp, Homo sapiens
gtgacactctccttgca

SEQ ID NO: 5502369 - DNA, 19 bp, Homo sapiens
gtgacactctccttgcagt

SEQ ID NO: 5502370 - DNA, 14 bp, Homo sapiens
gtgacactctcgtg

SEQ ID NO: 5502371 - DNA, 21 bp, Homo sapiens
gtgacactttgaactcctcaa

SEQ ID NO: 5502372 - DNA, 13 bp, Homo sapiens
gtgacagaaggcc

SEQ ID NO: 5502373 - DNA, 22 bp, Homo sapiens
gtgacagagcaagactctgtct

SEQ ID NO: 5502374 - DNA, 17 bp, Homo sapiens
gtgacagagcaataccc

SEQ ID NO: 5502375 - DNA, 21 bp, Homo sapiens
gtgacagagggacagtgggct

SEQ ID NO: 5502376 - DNA, 22 bp, Homo sapiens
gtgacagagtgagactctgtct

SEQ ID NO: 5502377 - DNA, 18 bp, Homo sapiens
gtgacagccacttggcct

SEQ ID NO: 5502378 - DNA, 17 bp, Homo sapiens
gtgacagcgatggcagg

SEQ ID NO: 5502379 - DNA, 21 bp, Homo sapiens
gtgacagcgatggcaggcctg

SEQ ID NO: 5502380 - DNA, 23 bp, Homo sapiens
gtgacagctttcctcaaaaagca

SEQ ID NO: 5502381 - DNA, 13 bp, Homo sapiens
gtgacagctttct

SEQ ID NO: 5502382 - DNA, 16 bp, Homo sapiens
gtgacaggaaagccct

SEQ ID NO: 5502383 - DNA, 15 bp, Homo sapiens
gtgacaggcagcaga

SEQ ID NO: 5502384 - DNA, 13 bp, Homo sapiens
gtgacaggcagtg

SEQ ID NO: 5502385 - DNA, 17 bp, Homo sapiens
gtgacagggaagctaca

SEQ ID NO: 5502386 - DNA, 18 bp, Homo sapiens
gtgacagggaagctacag

SEQ ID NO: 5502387 - DNA, 13 bp, Homo sapiens
gtgacagggccag

SEQ ID NO: 5502388 - DNA, 23 bp, Homo sapiens
gtgacagggccagtggggcctgt

SEQ ID NO: 5502389 - DNA, 22 bp, Homo sapiens
gtgacaggtttttatgggtact

SEQ ID NO: 5502390 - DNA, 15 bp, Homo sapiens
gtgacagtcacttcc

SEQ ID NO: 5502391 - DNA, 13 bp, Homo sapiens
gtgacagtcatca

SEQ ID NO: 5502392 - DNA, 19 bp, Homo sapiens
gtgacagtcctccatccac

SEQ ID NO: 5502393 - DNA, 13 bp, Homo sapiens
gtgacagtgaaat

SEQ ID NO: 5502394 - DNA, 21 bp, Homo sapiens
gtgacagtgaggtcctggggg

SEQ ID NO: 5502395 - DNA, 13 bp, Homo sapiens
gtgacagtttcca

SEQ ID NO: 5502396 - DNA, 18 bp, Homo sapiens
gtgacataattgtccagt

SEQ ID NO: 5502397 - DNA, 19 bp, Homo sapiens
gtgacatcacagggcctca

SEQ ID NO: 5502398 - DNA, 14 bp, Homo sapiens
gtgacatcagaagt

SEQ ID NO: 5502399 - DNA, 18 bp, Homo sapiens
gtgacatcagtggcatgg

SEQ ID NO: 5502400 - DNA, 20 bp, Homo sapiens
gtgacatcccaggaggggcc

SEQ ID NO: 5502401 - DNA, 14 bp, Homo sapiens
gtgacatcctgctt

SEQ ID NO: 5502402 - DNA, 18 bp, Homo sapiens
gtgacatcggaaaaataa

SEQ ID NO: 5502403 - DNA, 18 bp, Homo sapiens
gtgacatcggttcaggag

SEQ ID NO: 5502404 - DNA, 14 bp, Homo sapiens
gtgacatgaagcat

SEQ ID NO: 5502405 - DNA, 22 bp, Homo sapiens
gtgacatgattctgaacttttg

SEQ ID NO: 5502406 - DNA, 19 bp, Homo sapiens
gtgacatgcccaaggccac

SEQ ID NO: 5502407 - DNA, 22 bp, Homo sapiens
gtgacatgcgggctgggcagct

SEQ ID NO: 5502408 - DNA, 19 bp, Homo sapiens
gtgacatggggaaggcaga

SEQ ID NO: 5502409 - DNA, 15 bp, Homo sapiens
gtgacatgggtgtgc

SEQ ID NO: 5502410 - DNA, 20 bp, Homo sapiens
gtgacatggtgcctgagagg

SEQ ID NO: 5502411 - DNA, 20 bp, Homo sapiens
gtgacatgtctactttttaa

SEQ ID NO: 5502412 - DNA, 12 bp, Homo sapiens
gtgacattgaaa

SEQ ID NO: 5502413 - DNA, 21 bp, Homo sapiens
gtgacatttatttttctcatg

SEQ ID NO: 5502414 - DNA, 12 bp, Homo sapiens
gtgacatttctc

SEQ ID NO: 5502415 - DNA, 22 bp, Homo sapiens
gtgacatttgggagacatgtga

SEQ ID NO: 5502416 - DNA, 17 bp, Homo sapiens
gtgacattttacattaa

SEQ ID NO: 5502417 - DNA, 21 bp, Homo sapiens
gtgacattttacattaaattt

SEQ ID NO: 5502418 - DNA, 13 bp, Homo sapiens
gtgaccaactgtg

SEQ ID NO: 5502419 - DNA, 20 bp, Homo sapiens
gtgaccaactgtgttgtatt

SEQ ID NO: 5502420 - DNA, 17 bp, Homo sapiens
gtgaccaatacatttgt

SEQ ID NO: 5502421 - DNA, 19 bp, Homo sapiens
gtgaccaatacatttgtat

SEQ ID NO: 5502422 - DNA, 18 bp, Homo sapiens
gtgacttgaatgtacaaa

SEQ ID NO: 5502423 - DNA, 21 bp, Homo sapiens
gtgacttgaatgtacaaagat

SEQ ID NO: 5502424 - DNA, 20 bp, Homo sapiens
gtgacttgtctgcctcctgc

SEQ ID NO: 5502425 - DNA, 21 bp, Homo sapiens
gtgacttgtctgcctcctgct

SEQ ID NO: 5502426 - DNA, 11 bp, Homo sapiens
gtgactttaaa

SEQ ID NO: 5502427 - DNA, 13 bp, Homo sapiens
gtgactttaaaag

SEQ ID NO: 5502428 - DNA, 15 bp, Homo sapiens
gtgactttggataat

SEQ ID NO: 5502429 - DNA, 18 bp, Homo sapiens
gtgactttggctgcatgc

SEQ ID NO: 5502430 - DNA, 19 bp, Homo sapiens
gtgacttttagacagtggt

SEQ ID NO: 5502431 - DNA, 22 bp, Homo sapiens
gtgacttttagacagtggtaaa

SEQ ID NO: 5502432 - DNA, 15 bp, Homo sapiens
gtgactttttagcca

SEQ ID NO: 5502433 - DNA, 16 bp, Homo sapiens
gtgactttttttggta

SEQ ID NO: 5502434 - DNA, 19 bp, Homo sapiens
gtgagaaacatctcaataa

SEQ ID NO: 5502435 - DNA, 11 bp, Homo sapiens
gtgagaaacct

SEQ ID NO: 5502436 - DNA, 23 bp, Homo sapiens
gtgagaaacctgtatctttctat

SEQ ID NO: 5502437 - DNA, 12 bp, Homo sapiens
gtgagaaagaaa

SEQ ID NO: 5502438 - DNA, 22 bp, Homo sapiens
gtgagaaagaaagtaaaaaagg

SEQ ID NO: 5502439 - DNA, 13 bp, Homo sapiens
gtgagaaaggaaa

SEQ ID NO: 5502440 - DNA, 22 bp, Homo sapiens
gtgagaaagggattgctgaggc

SEQ ID NO: 5502441 - DNA, 21 bp, Homo sapiens
gtgagaaatagctgaaaaggg

SEQ ID NO: 5502442 - DNA, 21 bp, Homo sapiens
gtgagaaattacaggttcctt

SEQ ID NO: 5502443 - DNA, 20 bp, Homo sapiens
gtgagaaatttctgtgaaac

SEQ ID NO: 5502444 - DNA, 21 bp, Homo sapiens
gtgagaacattaggccccagc

SEQ ID NO: 5502445 - DNA, 22 bp, Homo sapiens
gtgagaacctgggttgcagaca

SEQ ID NO: 5502446 - DNA, 23 bp, Homo sapiens
gtgagaacggtgaccgcctcctg

SEQ ID NO: 5502447 - DNA, 18 bp, Homo sapiens
gtgagaactctctccctg

SEQ ID NO: 5502448 - DNA, 20 bp, Homo sapiens
gtgagaactctctccctggt

SEQ ID NO: 5502449 - DNA, 22 bp, Homo sapiens
gtgagaactctctccctggtct

SEQ ID NO: 5502450 - DNA, 14 bp, Homo sapiens
gtgagaactgagga

SEQ ID NO: 5502451 - DNA, 11 bp, Homo sapiens
gtgagaactgt

SEQ ID NO: 5502452 - DNA, 13 bp, Homo sapiens
gtgagaacttcca

SEQ ID NO: 5502453 - DNA, 14 bp, Homo sapiens
gtgagaagaatatt

SEQ ID NO: 5502454 - DNA, 21 bp, Homo sapiens
gtgagaagacttccccaagcc

SEQ ID NO: 5502455 - DNA, 17 bp, Homo sapiens
gtgagaagatgggggct

SEQ ID NO: 5502456 - DNA, 19 bp, Homo sapiens
gtgagaagatgggggctgg

SEQ ID NO: 5502457 - DNA, 14 bp, Homo sapiens
gtgagaagctgagg

SEQ ID NO: 5502458 - DNA, 16 bp, Homo sapiens
gtgagaagctgaggcc

SEQ ID NO: 5502459 - DNA, 17 bp, Homo sapiens
gtgagaagctgaggcct

SEQ ID NO: 5502460 - DNA, 18 bp, Homo sapiens
gtgagaagggcctgctct

SEQ ID NO: 5502461 - DNA, 20 bp, Homo sapiens
gtgagaagggcctgctctgc

SEQ ID NO: 5502462 - DNA, 20 bp, Homo sapiens
gtgagaagggctcagagagg

SEQ ID NO: 5502463 - DNA, 22 bp, Homo sapiens
gtgagaagggctcagagaggac

SEQ ID NO: 5502464 - DNA, 20 bp, Homo sapiens
gtgagaaggtttattgttaa

SEQ ID NO: 5502465 - DNA, 19 bp, Homo sapiens
gtgagaagtacagggcaga

SEQ ID NO: 5502466 - DNA, 20 bp, Homo sapiens
gtgagaagtgaatgctggga

SEQ ID NO: 5502467 - DNA, 19 bp, Homo sapiens
gtgagaataattgtgtaca

SEQ ID NO: 5502468 - DNA, 20 bp, Homo sapiens
gtgagaataattgtgtacaa

SEQ ID NO: 5502469 - DNA, 20 bp, Homo sapiens
gtgagaatagtggaggaagg

SEQ ID NO: 5502470 - DNA, 20 bp, Homo sapiens
gtgagaatatagacagtgcc

SEQ ID NO: 5502471 - DNA, 19 bp, Homo sapiens
gtgagaatcctgcctctcc

SEQ ID NO: 5502472 - DNA, 20 bp, Homo sapiens
gtgagaatcctgcctctccc

SEQ ID NO: 5502473 - DNA, 15 bp, Homo sapiens
gtgagaatggcctgg

SEQ ID NO: 5502474 - DNA, 18 bp, Homo sapiens
gtgagaattgggactctg

SEQ ID NO: 5502475 - DNA, 18 bp, Homo sapiens
gtgagaattgtgctttca

SEQ ID NO: 5502476 - DNA, 19 bp, Homo sapiens
gtgagacagcggtcccagg

SEQ ID NO: 5502477 - DNA, 13 bp, Homo sapiens
gtgagacaggctg

SEQ ID NO: 5502478 - DNA, 16 bp, Homo sapiens
gtgagacaggctgggt

SEQ ID NO: 5502479 - DNA, 23 bp, Homo sapiens
gtgagacaggctgggtcctgcca

SEQ ID NO: 5502480 - DNA, 19 bp, Homo sapiens
gtgagacagtccagcctgg

SEQ ID NO: 5502481 - DNA, 18 bp, Homo sapiens
gtgagacagtctggaaag

SEQ ID NO: 5502482 - DNA, 14 bp, Homo sapiens
gtgagaccagggga

SEQ ID NO: 5502483 - DNA, 21 bp, Homo sapiens
gtgagaccaggggaccagagg

SEQ ID NO: 5502484 - DNA, 14 bp, Homo sapiens
gtgagacccccaca

SEQ ID NO: 5502485 - DNA, 17 bp, Homo sapiens
gtgagacccccacacct

SEQ ID NO: 5502486 - DNA, 21 bp, Homo sapiens
gtgagaccccgcactgcagac

SEQ ID NO: 5502487 - DNA, 18 bp, Homo sapiens
gtgagaccctgtctcaaa

SEQ ID NO: 5502488 - DNA, 22 bp, Homo sapiens
gtgagaccctgtctcaaaaaaa

SEQ ID NO: 5502489 - DNA, 16 bp, Homo sapiens
gtgagaccctgtctct

SEQ ID NO: 5502490 - DNA, 16 bp, Homo sapiens
gtgagaccctgttcta

SEQ ID NO: 5502491 - DNA, 14 bp, Homo sapiens
gtgagacgaggcag

SEQ ID NO: 5502492 - DNA, 22 bp, Homo sapiens
gtgagactcctgattgctctgg

SEQ ID NO: 5502493 - DNA, 22 bp, Homo sapiens
gtgagactcgagaactttcatt

SEQ ID NO: 5502494 - DNA, 16 bp, Homo sapiens
gtgagactctgtctca

SEQ ID NO: 5502495 - DNA, 20 bp, Homo sapiens
gtgagactgacacctcactg

SEQ ID NO: 5502496 - DNA, 14 bp, Homo sapiens
gtgagactgcccca

SEQ ID NO: 5502497 - DNA, 14 bp, Homo sapiens
gtgagactgtacat

SEQ ID NO: 5502498 - DNA, 19 bp, Homo sapiens
gtgagagaaagagagaagc

SEQ ID NO: 5502499 - DNA, 13 bp, Homo sapiens
gtgagagaatgta

SEQ ID NO: 5502500 - DNA, 19 bp, Homo sapiens
gtgagagacattaactcat

SEQ ID NO: 5502501 - DNA, 23 bp, Homo sapiens
gtgagagacattaactcattaga

SEQ ID NO: 5502502 - DNA, 18 bp, Homo sapiens
gtgagagacctctgccta

SEQ ID NO: 5502503 - DNA, 14 bp, Homo sapiens
gtgagagagagggc

SEQ ID NO: 5502504 - DNA, 16 bp, Homo sapiens
gtgagagagagggcgc

SEQ ID NO: 5502505 - DNA, 13 bp, Homo sapiens
gtgagagaggacc

SEQ ID NO: 5502506 - DNA, 15 bp, Homo sapiens
gtgagagccagcagc

SEQ ID NO: 5502507 - DNA, 16 bp, Homo sapiens
gtgagagcccagtcat

SEQ ID NO: 5502508 - DNA, 21 bp, Homo sapiens
gtgagagcccagtcattgtac

SEQ ID NO: 5502509 - DNA, 13 bp, Homo sapiens
gtgagagctgggt

SEQ ID NO: 5502510 - DNA, 16 bp, Homo sapiens
gtgagaggaaatgttg

SEQ ID NO: 5502511 - DNA, 15 bp, Homo sapiens
gtgagaggaagggtg

SEQ ID NO: 5502512 - DNA, 12 bp, Homo sapiens
gtgagaggcagg

SEQ ID NO: 5502513 - DNA, 16 bp, Homo sapiens
gtgagaggcaggaatg

SEQ ID NO: 5502514 - DNA, 17 bp, Homo sapiens
gtgagaggcaggaatgg

SEQ ID NO: 5502515 - DNA, 16 bp, Homo sapiens
gtgagaggcccccacc

SEQ ID NO: 5502516 - DNA, 12 bp, Homo sapiens
gtgagaggggag

SEQ ID NO: 5502517 - DNA, 17 bp, Homo sapiens
gtgagaggggagggagg

SEQ ID NO: 5502518 - DNA, 18 bp, Homo sapiens
gtgagaggggagggaggg

SEQ ID NO: 5502519 - DNA, 15 bp, Homo sapiens
gtgagaggggagggc

SEQ ID NO: 5502520 - DNA, 20 bp, Homo sapiens
gtgagaggggagggctcctg

SEQ ID NO: 5502521 - DNA, 23 bp, Homo sapiens
gtgagagtttggaaggtgtccaa

SEQ ID NO: 5502522 - DNA, 16 bp, Homo sapiens
gtgagataaatatcat

SEQ ID NO: 5502523 - DNA, 23 bp, Homo sapiens
gtgagataaccacaaccaggaag

SEQ ID NO: 5502524 - DNA, 15 bp, Homo sapiens
gtgagataacttcct

SEQ ID NO: 5502525 - DNA, 23 bp, Homo sapiens
gtgagataacttccttcacatct

SEQ ID NO: 5502526 - DNA, 15 bp, Homo sapiens
gtgagatagttttca

SEQ ID NO: 5502527 - DNA, 21 bp, Homo sapiens
gtgagatcaacaacactactt

SEQ ID NO: 5502528 - DNA, 16 bp, Homo sapiens
gtgagatcaatgtgac

SEQ ID NO: 5502529 - DNA, 13 bp, Homo sapiens
gtgagatcagtca

SEQ ID NO: 5502530 - DNA, 16 bp, Homo sapiens
gtgagatcttacaggt

SEQ ID NO: 5502531 - DNA, 12 bp, Homo sapiens
gtgagatgaggg

SEQ ID NO: 5502532 - DNA, 19 bp, Homo sapiens
gtgagatgagggatgggcc

SEQ ID NO: 5502533 - DNA, 18 bp, Homo sapiens
gtgagatgatttgtactt

SEQ ID NO: 5502534 - DNA, 15 bp, Homo sapiens
gtgagatgcagctgg

SEQ ID NO: 5502535 - DNA, 21 bp, Homo sapiens
gtgagatgctagaactccctt

SEQ ID NO: 5502536 - DNA, 18 bp, Homo sapiens
gtgagatgctggagaaga

SEQ ID NO: 5502537 - DNA, 19 bp, Homo sapiens
gtgagatgctggagaagag

SEQ ID NO: 5502538 - DNA, 22 bp, Homo sapiens
gtgagatgctggagaagagagg

SEQ ID NO: 5502539 - DNA, 14 bp, Homo sapiens
gtgagatgggaagg

SEQ ID NO: 5502540 - DNA, 18 bp, Homo sapiens
gtgagatgggaagggctt

SEQ ID NO: 5502541 - DNA, 16 bp, Homo sapiens
gtgagatttgtattta

SEQ ID NO: 5502542 - DNA, 23 bp, Homo sapiens
gtgagatttgtatttatattaga

SEQ ID NO: 5502543 - DNA, 14 bp, Homo sapiens
gtgagattttttat

SEQ ID NO: 5502544 - DNA, 19 bp, Homo sapiens
gtgagcaaacagaggaggc

SEQ ID NO: 5502545 - DNA, 15 bp, Homo sapiens
gtgagcaatcctgca

SEQ ID NO: 5502546 - DNA, 22 bp, Homo sapiens
gtgagcacatctgggaggctgg

SEQ ID NO: 5502547 - DNA, 15 bp, Homo sapiens
gtgagcaccaccagg

SEQ ID NO: 5502548 - DNA, 21 bp, Homo sapiens
gtgagcacggccaacaaagct

SEQ ID NO: 5502549 - DNA, 23 bp, Homo sapiens
gtgagcactatctttcaggaaat

SEQ ID NO: 5502550 - DNA, 13 bp, Homo sapiens
gtgagcagaacag

SEQ ID NO: 5502551 - DNA, 16 bp, Homo sapiens
gtgagcagaacaggta

SEQ ID NO: 5502552 - DNA, 17 bp, Homo sapiens
gtgagcagaggagtcca

SEQ ID NO: 5502553 - DNA, 13 bp, Homo sapiens
gtgagcagctact

SEQ ID NO: 5502554 - DNA, 14 bp, Homo sapiens
gtgagcagctactg

SEQ ID NO: 5502555 - DNA, 16 bp, Homo sapiens
gtgagcagctactgta

SEQ ID NO: 5502556 - DNA, 23 bp, Homo sapiens
gtgagcagctactgtaacttttt

SEQ ID NO: 5502557 - DNA, 20 bp, Homo sapiens
gtgagcaggaaggcctgggt

SEQ ID NO: 5502558 - DNA, 12 bp, Homo sapiens
gtgagcaggctt

SEQ ID NO: 5502559 - DNA, 15 bp, Homo sapiens
gtgagcaggggaagc

SEQ ID NO: 5502560 - DNA, 19 bp, Homo sapiens
gtgagcaggggaagcagga

SEQ ID NO: 5502561 - DNA, 21 bp, Homo sapiens
gtgagcagggtcaagcctctt

SEQ ID NO: 5502562 - DNA, 15 bp, Homo sapiens
gtgagcagggtgggg

SEQ ID NO: 5502563 - DNA, 21 bp, Homo sapiens
gtgagcagtcgcctgcctgca

SEQ ID NO: 5502564 - DNA, 21 bp, Homo sapiens
gtgagcagtgtgtctcctgca

SEQ ID NO: 5502565 - DNA, 13 bp, Homo sapiens
gtgagcagtgttg

SEQ ID NO: 5502566 - DNA, 18 bp, Homo sapiens
gtgagcatcttgccagcc

SEQ ID NO: 5502567 - DNA, 16 bp, Homo sapiens
gtgagcatggggccag

SEQ ID NO: 5502568 - DNA, 18 bp, Homo sapiens
gtgagcatggggccagga

SEQ ID NO: 5502569 - DNA, 22 bp, Homo sapiens
gtgagcattgtggctgtcagca

SEQ ID NO: 5502570 - DNA, 18 bp, Homo sapiens
gtgagccaaagcttatgt

SEQ ID NO: 5502571 - DNA, 12 bp, Homo sapiens
gtgagccaaggg

SEQ ID NO: 5502572 - DNA, 22 bp, Homo sapiens
gtgagccaaggggtctgctcct

SEQ ID NO: 5502573 - DNA, 20 bp, Homo sapiens
gtgagccaccacacccagcc

SEQ ID NO: 5502574 - DNA, 16 bp, Homo sapiens
gtgagccaccacgccc

SEQ ID NO: 5502575 - DNA, 21 bp, Homo sapiens
gtgagccaccatgcctggccc

SEQ ID NO: 5502576 - DNA, 21 bp, Homo sapiens
gtgagccaccgtgcctggcca

SEQ ID NO: 5502577 - DNA, 22 bp, Homo sapiens
gtgagccaccgtgcctggccac

SEQ ID NO: 5502578 - DNA, 13 bp, Homo sapiens
gtgagccactgcg

SEQ ID NO: 5502579 - DNA, 19 bp, Homo sapiens
gtgagccactgtgcccagc

SEQ ID NO: 5502580 - DNA, 18 bp, Homo sapiens
gtgagccatgcctccctg

SEQ ID NO: 5502581 - DNA, 15 bp, Homo sapiens
gtgagcccagctggg

SEQ ID NO: 5502582 - DNA, 17 bp, Homo sapiens
gtgagcccatggccctc

SEQ ID NO: 5502583 - DNA, 18 bp, Homo sapiens
gtgagcccatggccctcc

SEQ ID NO: 5502584 - DNA, 22 bp, Homo sapiens
gtgagccccgccgtgtctgtgg

SEQ ID NO: 5502585 - DNA, 17 bp, Homo sapiens
gtgagcccctccccagc

SEQ ID NO: 5502586 - DNA, 19 bp, Homo sapiens
gtgagcccctccccagcca

SEQ ID NO: 5502587 - DNA, 16 bp, Homo sapiens
gtgagccctctagggc

SEQ ID NO: 5502588 - DNA, 14 bp, Homo sapiens
gtgagccctgctct

SEQ ID NO: 5502589 - DNA, 21 bp, Homo sapiens
gtgagccctgctcttctctcc

SEQ ID NO: 5502590 - DNA, 12 bp, Homo sapiens
gtgagccgcatc

SEQ ID NO: 5502591 - DNA, 18 bp, Homo sapiens
gtgagccgcatcttctcc

SEQ ID NO: 5502592 - DNA, 19 bp, Homo sapiens
gtgagcctcctgtgcctgg

SEQ ID NO: 5502593 - DNA, 14 bp, Homo sapiens
gtgagcctgggcca

SEQ ID NO: 5502594 - DNA, 16 bp, Homo sapiens
gtgagcctgggccagg

SEQ ID NO: 5502595 - DNA, 22 bp, Homo sapiens
gtgagcgatcatttatttcatg

SEQ ID NO: 5502596 - DNA, 23 bp, Homo sapiens
gtgagcgccccgcccccacccct

SEQ ID NO: 5502597 - DNA, 20 bp, Homo sapiens
gtgagcgcctgtgcacacac

SEQ ID NO: 5502598 - DNA, 21 bp, Homo sapiens
gtgataaatctagaaaattga

SEQ ID NO: 5502599 - DNA, 22 bp, Homo sapiens
gtgataaccagtaaggaaatat

SEQ ID NO: 5502600 - DNA, 21 bp, Homo sapiens
gtgataagggaaaagataaag

SEQ ID NO: 5502601 - DNA, 13 bp, Homo sapiens
gtgataaggggcc

SEQ ID NO: 5502602 - DNA, 21 bp, Homo sapiens
gtgataaggggccttgctctg

SEQ ID NO: 5502603 - DNA, 19 bp, Homo sapiens
gtgataagtggaaaaaaga

SEQ ID NO: 5502604 - DNA, 20 bp, Homo sapiens
gtgatacactgaatggaaat

SEQ ID NO: 5502605 - DNA, 12 bp, Homo sapiens
gtgatacactgt

SEQ ID NO: 5502606 - DNA, 14 bp, Homo sapiens
gtgatacactgtat

SEQ ID NO: 5502607 - DNA, 15 bp, Homo sapiens
gtgatagagcctttg

SEQ ID NO: 5502608 - DNA, 16 bp, Homo sapiens
gtgatagagcctttga

SEQ ID NO: 5502609 - DNA, 13 bp, Homo sapiens
gtgatagcacttt

SEQ ID NO: 5502610 - DNA, 14 bp, Homo sapiens
gtgatagcactttc

SEQ ID NO: 5502611 - DNA, 18 bp, Homo sapiens
gtgatagctaacatttta

SEQ ID NO: 5502612 - DNA, 23 bp, Homo sapiens
gtgatagctactgtagaaaggaa

SEQ ID NO: 5502613 - DNA, 18 bp, Homo sapiens
gtgataggcaaggatgaa

SEQ ID NO: 5502614 - DNA, 22 bp, Homo sapiens
gtgatagtcttttgcttttggc

SEQ ID NO: 5502615 - DNA, 18 bp, Homo sapiens
gtgatataaaagctgcat

SEQ ID NO: 5502616 - DNA, 20 bp, Homo sapiens
gtgatataaagaatgaaagt

SEQ ID NO: 5502617 - DNA, 19 bp, Homo sapiens
gtgatatagaattagcttt

SEQ ID NO: 5502618 - DNA, 23 bp, Homo sapiens
gtgatatataatttcctcactgc

SEQ ID NO: 5502619 - DNA, 15 bp, Homo sapiens
gtgatatatgtatta

SEQ ID NO: 5502620 - DNA, 16 bp, Homo sapiens
gtgatatatgtattta

SEQ ID NO: 5502621 - DNA, 17 bp, Homo sapiens
gtgatatatgtatttat

SEQ ID NO: 5502622 - DNA, 20 bp, Homo sapiens
gtgatatcacctctcttcag

SEQ ID NO: 5502623 - DNA, 19 bp, Homo sapiens
gtgatatccacaaatgcta

SEQ ID NO: 5502624 - DNA, 13 bp, Homo sapiens
gtgatatctttct

SEQ ID NO: 5502625 - DNA, 16 bp, Homo sapiens
gtgatatctttctcat

SEQ ID NO: 5502626 - DNA, 22 bp, Homo sapiens
gtgatatctttctcattaccag

SEQ ID NO: 5502627 - DNA, 19 bp, Homo sapiens
gtgatatgcacaatgtaga

SEQ ID NO: 5502628 - DNA, 13 bp, Homo sapiens
gtgatatggagca

SEQ ID NO: 5502629 - DNA, 17 bp, Homo sapiens
gtgatatggagcaagag

SEQ ID NO: 5502630 - DNA, 14 bp, Homo sapiens
gtgatatgtgtaat

SEQ ID NO: 5502631 - DNA, 21 bp, Homo sapiens
gtgatatgtgtaatatcattt

SEQ ID NO: 5502632 - DNA, 12 bp, Homo sapiens
gtgatattcccc

SEQ ID NO: 5502633 - DNA, 22 bp, Homo sapiens
gtgatattctttgttaatttgg

SEQ ID NO: 5502634 - DNA, 23 bp, Homo sapiens
gtgatattctttgttaatttgga

SEQ ID NO: 5502635 - DNA, 18 bp, Homo sapiens
gtgatatttcgtgtactg

SEQ ID NO: 5502636 - DNA, 13 bp, Homo sapiens
gtgatatttctct

SEQ ID NO: 5502637 - DNA, 16 bp, Homo sapiens
gtgatatttctctagt

SEQ ID NO: 5502638 - DNA, 16 bp, Homo sapiens
gtgatcaataaaatgt

SEQ ID NO: 5502639 - DNA, 19 bp, Homo sapiens
gtgatcaataaaatgtgat

SEQ ID NO: 5502640 - DNA, 20 bp, Homo sapiens
gtgatcagaaggctggggcc

SEQ ID NO: 5502641 - DNA, 21 bp, Homo sapiens
gtgatcagaaggctggggcca

SEQ ID NO: 5502642 - DNA, 20 bp, Homo sapiens
gtgatcagaccataatgtta

SEQ ID NO: 5502643 - DNA, 16 bp, Homo sapiens
gtgatcatgtgtggaa

SEQ ID NO: 5502644 - DNA, 17 bp, Homo sapiens
gtgatcatttaaaaagc

SEQ ID NO: 5502645 - DNA, 23 bp, Homo sapiens
gtgatccacccaaccctatctcc

SEQ ID NO: 5502646 - DNA, 17 bp, Homo sapiens
gtgatccacccacctca

SEQ ID NO: 5502647 - DNA, 20 bp, Homo sapiens
gtgatccacccacctcagcc

SEQ ID NO: 5502648 - DNA, 24 bp, Homo sapiens
gtgatccacccgcctcagcctccc

SEQ ID NO: 5502649 - DNA, 13 bp, Homo sapiens
gtgatccagccct

SEQ ID NO: 5502650 - DNA, 20 bp, Homo sapiens
gtgatccatccatctccagg

SEQ ID NO: 5502651 - DNA, 21 bp, Homo sapiens
gtgatccatccatctccaggg

SEQ ID NO: 5502652 - DNA, 14 bp, Homo sapiens
gtgatcccagctca

SEQ ID NO: 5502653 - DNA, 15 bp, Homo sapiens
gtgatcccagctcac

SEQ ID NO: 5502654 - DNA, 21 bp, Homo sapiens
gtgatcccagctcactgcagc

SEQ ID NO: 5502655 - DNA, 18 bp, Homo sapiens
gtgatcccgttttcccca

SEQ ID NO: 5502656 - DNA, 22 bp, Homo sapiens
gtgatccctagctgtgacctct

SEQ ID NO: 5502657 - DNA, 19 bp, Homo sapiens
gtgatccgcccacctcagc

SEQ ID NO: 5502658 - DNA, 16 bp, Homo sapiens
gtgatccgcctgcctc

SEQ ID NO: 5502659 - DNA, 18 bp, Homo sapiens
gtgatccgcctgcctctg

SEQ ID NO: 5502660 - DNA, 16 bp, Homo sapiens
gtgatcctcacgcctt

SEQ ID NO: 5502661 - DNA, 14 bp, Homo sapiens
gtgatcctcccacc

SEQ ID NO: 5502662 - DNA, 22 bp, Homo sapiens
gtgatcctcccgccccagcctc

SEQ ID NO: 5502663 - DNA, 23 bp, Homo sapiens
gtgatcctcccgccccagcctcc

SEQ ID NO: 5502664 - DNA, 23 bp, Homo sapiens
gtgatcctcctgtcttggcctcc

SEQ ID NO: 5502665 - DNA, 21 bp, Homo sapiens
gtgatcctctcacctcagcct

SEQ ID NO: 5502666 - DNA, 19 bp, Homo sapiens
gtgatccttggtgctgtgt

SEQ ID NO: 5502667 - DNA, 21 bp, Homo sapiens
gtgatccttggtgctgtgtgc

SEQ ID NO: 5502668 - DNA, 22 bp, Homo sapiens
gtgatccttggtgctgtgtgcc

SEQ ID NO: 5502669 - DNA, 22 bp, Homo sapiens
gtgatcggggtcaggcaaagga

SEQ ID NO: 5502670 - DNA, 12 bp, Homo sapiens
gtgatctaccca

SEQ ID NO: 5502671 - DNA, 19 bp, Homo sapiens
gtgatctagtccttgtctt

SEQ ID NO: 5502672 - DNA, 18 bp, Homo sapiens
gtgatctcaaatccactg

SEQ ID NO: 5502673 - DNA, 19 bp, Homo sapiens
gtgatctcactaaaaatat

SEQ ID NO: 5502674 - DNA, 14 bp, Homo sapiens
gtgatctcagatca

SEQ ID NO: 5502675 - DNA, 15 bp, Homo sapiens
gtgatctcagatcag

SEQ ID NO: 5502676 - DNA, 14 bp, Homo sapiens
gtgatctcagctca

SEQ ID NO: 5502677 - DNA, 23 bp, Homo sapiens
gtgatctcattgttcaattccca

SEQ ID NO: 5502678 - DNA, 16 bp, Homo sapiens
gtgatctcccctcaca

SEQ ID NO: 5502679 - DNA, 19 bp, Homo sapiens
gtgatctcctgtggctcat

SEQ ID NO: 5502680 - DNA, 19 bp, Homo sapiens
gtgatctcggctcactgca

SEQ ID NO: 5502681 - DNA, 15 bp, Homo sapiens
gtgatctctgctggg

SEQ ID NO: 5502682 - DNA, 15 bp, Homo sapiens
gtgatctgaacagaa

SEQ ID NO: 5502683 - DNA, 21 bp, Homo sapiens
gtgatctgcccgcctcggcct

SEQ ID NO: 5502684 - DNA, 19 bp, Homo sapiens
gtgatctgctgcagagcag

SEQ ID NO: 5502685 - DNA, 15 bp, Homo sapiens
gtgatctgctggcct

SEQ ID NO: 5502686 - DNA, 13 bp, Homo sapiens
gtgatctgggcat

SEQ ID NO: 5502687 - DNA, 20 bp, Homo sapiens
gtgatctgtcccctctcccc

SEQ ID NO: 5502688 - DNA, 13 bp, Homo sapiens
gtgatctgtcttg

SEQ ID NO: 5502689 - DNA, 19 bp, Homo sapiens
gtgatctgtcttgtaatat

SEQ ID NO: 5502690 - DNA, 14 bp, Homo sapiens
gtgatcttaaaata

SEQ ID NO: 5502691 - DNA, 15 bp, Homo sapiens
gtgatcttaaaataa

SEQ ID NO: 5502692 - DNA, 21 bp, Homo sapiens
gtgatcttaatatatttgaaa

SEQ ID NO: 5502693 - DNA, 21 bp, Homo sapiens
gtgatcttaggtttgtttttt

SEQ ID NO: 5502694 - DNA, 19 bp, Homo sapiens
gtgatcttatttttctaaa

SEQ ID NO: 5502695 - DNA, 22 bp, Homo sapiens
gtgatcttcactgtatatgtaa

SEQ ID NO: 5502696 - DNA, 21 bp, Homo sapiens
gtgatcttgcattcattttct

SEQ ID NO: 5502697 - DNA, 18 bp, Homo sapiens
gtgatcttgctctatctc

SEQ ID NO: 5502698 - DNA, 15 bp, Homo sapiens
gtgatcttttaaagt

SEQ ID NO: 5502699 - DNA, 15 bp, Homo sapiens
gtgatgaactttctc

SEQ ID NO: 5502700 - DNA, 15 bp, Homo sapiens
gtgatgaagctgagg

SEQ ID NO: 5502701 - DNA, 20 bp, Homo sapiens
gtgatgaataaaataattat

SEQ ID NO: 5502702 - DNA, 14 bp, Homo sapiens
gtgatgaatactgt

SEQ ID NO: 5502703 - DNA, 21 bp, Homo sapiens
gtgatgaatcaatgaaaaatg

SEQ ID NO: 5502704 - DNA, 22 bp, Homo sapiens
gtgatgaatgtactatgtctga

SEQ ID NO: 5502705 - DNA, 14 bp, Homo sapiens
gtgatgagacctgg

SEQ ID NO: 5502706 - DNA, 14 bp, Homo sapiens
gtgatgagaggaaa

SEQ ID NO: 5502707 - DNA, 12 bp, Homo sapiens
gtgatgagctga

SEQ ID NO: 5502708 - DNA, 16 bp, Homo sapiens
gtgatgagggcagcag

SEQ ID NO: 5502709 - DNA, 19 bp, Homo sapiens
gtgatgagggcagcagcca

SEQ ID NO: 5502710 - DNA, 13 bp, Homo sapiens
gtgatgatagcac

SEQ ID NO: 5502711 - DNA, 18 bp, Homo sapiens
gtgatgatgaccaagaat

SEQ ID NO: 5502712 - DNA, 15 bp, Homo sapiens
gtgatgccaggttct

SEQ ID NO: 5502713 - DNA, 21 bp, Homo sapiens
gtgatgccatatcaagtccat

SEQ ID NO: 5502714 - DNA, 19 bp, Homo sapiens
gtgatgccgggcgccagga

SEQ ID NO: 5502715 - DNA, 22 bp, Homo sapiens
gtgatgccgggcgccaggacag

SEQ ID NO: 5502716 - DNA, 22 bp, Homo sapiens
gtgatgccgtcctgctggagtg

SEQ ID NO: 5502717 - DNA, 13 bp, Homo sapiens
gtgatgcctccct

SEQ ID NO: 5502718 - DNA, 17 bp, Homo sapiens
gtgatgcgcagttgctg

SEQ ID NO: 5502719 - DNA, 13 bp, Homo sapiens
gtgatgcggcaga

SEQ ID NO: 5502720 - DNA, 12 bp, Homo sapiens
gtgatgctgaca

SEQ ID NO: 5502721 - DNA, 14 bp, Homo sapiens
gtgatgctgacacc

SEQ ID NO: 5502722 - DNA, 13 bp, Homo sapiens
gtgatgctgtgtg

SEQ ID NO: 5502723 - DNA, 17 bp, Homo sapiens
gtgatgcttataataaa

SEQ ID NO: 5502724 - DNA, 19 bp, Homo sapiens
gtgatgcttgatattttct

SEQ ID NO: 5502725 - DNA, 16 bp, Homo sapiens
gtgatgcttttgctgc

SEQ ID NO: 5502726 - DNA, 22 bp, Homo sapiens
gtgatgcttttgctgctgctta

SEQ ID NO: 5502727 - DNA, 21 bp, Homo sapiens
gtgatggaccaaagccacctg

SEQ ID NO: 5502728 - DNA, 22 bp, Homo sapiens
gtgatggaccaaagccacctgc

SEQ ID NO: 5502729 - DNA, 23 bp, Homo sapiens
gtgatggaccaaagccacctgct

SEQ ID NO: 5502730 - DNA, 13 bp, Homo sapiens
gtgatggagagga

SEQ ID NO: 5502731 - DNA, 16 bp, Homo sapiens
gtgatggagagggatg

SEQ ID NO: 5502732 - DNA, 17 bp, Homo sapiens
gtgatggagagggatgg

SEQ ID NO: 5502733 - DNA, 11 bp, Homo sapiens
gtgatggaggg

SEQ ID NO: 5502734 - DNA, 14 bp, Homo sapiens
gtgatggagtgtgc

SEQ ID NO: 5502735 - DNA, 14 bp, Homo sapiens
gtgatggatggcac

SEQ ID NO: 5502736 - DNA, 17 bp, Homo sapiens
gtgatggatggcacaat

SEQ ID NO: 5502737 - DNA, 22 bp, Homo sapiens
gtgatggcagaacgatgcctgc

SEQ ID NO: 5502738 - DNA, 21 bp, Homo sapiens
gtgatggcattactctgcact

SEQ ID NO: 5502739 - DNA, 14 bp, Homo sapiens
gtgatggccagagg

SEQ ID NO: 5502740 - DNA, 15 bp, Homo sapiens
gtgatggccagcccc

SEQ ID NO: 5502741 - DNA, 19 bp, Homo sapiens
gtgatggctatgccttgca

SEQ ID NO: 5502742 - DNA, 11 bp, Homo sapiens
gtgatgggagt

SEQ ID NO: 5502743 - DNA, 14 bp, Homo sapiens
gtgatgggagtaag

SEQ ID NO: 5502744 - DNA, 16 bp, Homo sapiens
gtgatgggatctgtaa

SEQ ID NO: 5502745 - DNA, 15 bp, Homo sapiens
gtgatgggattttca

SEQ ID NO: 5502746 - DNA, 15 bp, Homo sapiens
gtgatgggccaccgg

SEQ ID NO: 5502747 - DNA, 16 bp, Homo sapiens
gtgatgggctttctct

SEQ ID NO: 5502748 - DNA, 19 bp, Homo sapiens
gtgatggggccctgcctcc

SEQ ID NO: 5502749 - DNA, 22 bp, Homo sapiens
gtgatggggctcagatggactg

SEQ ID NO: 5502750 - DNA, 22 bp, Homo sapiens
gtgatggggctgttgagatgcc

SEQ ID NO: 5502751 - DNA, 22 bp, Homo sapiens
gtgatgggggcatgggtggagg

SEQ ID NO: 5502752 - DNA, 20 bp, Homo sapiens
gtgatggtctcacagagcca

SEQ ID NO: 5502753 - DNA, 18 bp, Homo sapiens
gtgatggtgtccttccct

SEQ ID NO: 5502754 - DNA, 22 bp, Homo sapiens
gtgatggttcccctgttcactc

SEQ ID NO: 5502755 - DNA, 19 bp, Homo sapiens
gtgatggttgccaggacga

SEQ ID NO: 5502756 - DNA, 14 bp, Homo sapiens
gtgatgtacgctgc

SEQ ID NO: 5502757 - DNA, 19 bp, Homo sapiens
gtgatgtacgctgcgtgcc

SEQ ID NO: 5502758 - DNA, 19 bp, Homo sapiens
gtgatgtatgtgtaataaa

SEQ ID NO: 5502759 - DNA, 14 bp, Homo sapiens
gtgatgtattttca

SEQ ID NO: 5502760 - DNA, 20 bp, Homo sapiens
gtgatgtcacagtttgttca

SEQ ID NO: 5502761 - DNA, 21 bp, Homo sapiens
gtgatgtcacagtttgttcag

SEQ ID NO: 5502762 - DNA, 13 bp, Homo sapiens
gtgatgtcactca

SEQ ID NO: 5502763 - DNA, 15 bp, Homo sapiens
gtgatgtcagcggtg

SEQ ID NO: 5502764 - DNA, 21 bp, Homo sapiens
gtgatgtcatacagagaagtc

SEQ ID NO: 5502765 - DNA, 22 bp, Homo sapiens
gtgatgtggaggaagagccacc

SEQ ID NO: 5502766 - DNA, 10 bp, Homo sapiens
gtgatgtgtc

SEQ ID NO: 5502767 - DNA, 12 bp, Homo sapiens
gtgatgttctaa

SEQ ID NO: 5502768 - DNA, 16 bp, Homo sapiens
gtgatgttctaaggct

SEQ ID NO: 5502769 - DNA, 19 bp, Homo sapiens
gtgatgttctaaggctctg

SEQ ID NO: 5502770 - DNA, 18 bp, Homo sapiens
gtgatgttgggaagctat

SEQ ID NO: 5502771 - DNA, 23 bp, Homo sapiens
gtgatgttgtttgggagagtgca

SEQ ID NO: 5502772 - DNA, 15 bp, Homo sapiens
gtgatgtttccagct

SEQ ID NO: 5502773 - DNA, 17 bp, Homo sapiens
gtgatgtttccagctgc

SEQ ID NO: 5502774 - DNA, 21 bp, Homo sapiens
gtgatgtttccagctgccaag

SEQ ID NO: 5502775 - DNA, 19 bp, Homo sapiens
gtgcacagcacaaattagt

SEQ ID NO: 5502776 - DNA, 13 bp, Homo sapiens
gtgcacagcccct

SEQ ID NO: 5502777 - DNA, 18 bp, Homo sapiens
gtgcacagcgcgggcgga

SEQ ID NO: 5502778 - DNA, 11 bp, Homo sapiens
gtgcacagctg

SEQ ID NO: 5502779 - DNA, 12 bp, Homo sapiens
gtgcacagctgt

SEQ ID NO: 5502780 - DNA, 14 bp, Homo sapiens
gtgcacagctgtcc

SEQ ID NO: 5502781 - DNA, 16 bp, Homo sapiens
gtgcacagcttcctga

SEQ ID NO: 5502782 - DNA, 23 bp, Homo sapiens
gtgcacagtaatatgaaagccac

SEQ ID NO: 5502783 - DNA, 20 bp, Homo sapiens
gtgcacatatgggtgctggc

SEQ ID NO: 5502784 - DNA, 21 bp, Homo sapiens
gtgcacatccgcgtgtgcctg

SEQ ID NO: 5502785 - DNA, 16 bp, Homo sapiens
gtgcacatgcctctgt

SEQ ID NO: 5502786 - DNA, 15 bp, Homo sapiens
gtgcacatgcttcag

SEQ ID NO: 5502787 - DNA, 18 bp, Homo sapiens
gtgcacatgtgtctgtgt

SEQ ID NO: 5502788 - DNA, 15 bp, Homo sapiens
gtgcacattctccct

SEQ ID NO: 5502789 - DNA, 18 bp, Homo sapiens
gtgcaccaccatgccagg

SEQ ID NO: 5502790 - DNA, 23 bp, Homo sapiens
gtgcacccatgggctctgacaga

SEQ ID NO: 5502791 - DNA, 16 bp, Homo sapiens
gtgcacccggcctgga

SEQ ID NO: 5502792 - DNA, 14 bp, Homo sapiens
gtgcaccgtgcagc

SEQ ID NO: 5502793 - DNA, 23 bp, Homo sapiens
gtgcacctaccccttggaaatgt

SEQ ID NO: 5502794 - DNA, 22 bp, Homo sapiens
gtgcacctagagcttttttata

SEQ ID NO: 5502795 - DNA, 17 bp, Homo sapiens
gtgcacctatggcccag

SEQ ID NO: 5502796 - DNA, 21 bp, Homo sapiens
gtgcacctatggcccagccac

SEQ ID NO: 5502797 - DNA, 20 bp, Homo sapiens
gtgcacctctcatcagccca

SEQ ID NO: 5502798 - DNA, 15 bp, Homo sapiens
gtgcacctgccccag

SEQ ID NO: 5502799 - DNA, 16 bp, Homo sapiens
gtgcacctgccccagg

SEQ ID NO: 5502800 - DNA, 21 bp, Homo sapiens
gtgcacctgccccaggctcag

SEQ ID NO: 5502801 - DNA, 21 bp, Homo sapiens
gtgcacctgcctccaccagca

SEQ ID NO: 5502802 - DNA, 23 bp, Homo sapiens
gtgcacctgggacagggagcagc

SEQ ID NO: 5502803 - DNA, 12 bp, Homo sapiens
gtgcacctgggc

SEQ ID NO: 5502804 - DNA, 18 bp, Homo sapiens
gtgcacctgtactcagga

SEQ ID NO: 5502805 - DNA, 19 bp, Homo sapiens
gtgcaccttacattcctag

SEQ ID NO: 5502806 - DNA, 16 bp, Homo sapiens
gtgcacgcctgcaggc

SEQ ID NO: 5502807 - DNA, 18 bp, Homo sapiens
gtgcacgtggagagctgg

SEQ ID NO: 5502808 - DNA, 18 bp, Homo sapiens
gtgcacgtggcatgtggc

SEQ ID NO: 5502809 - DNA, 12 bp, Homo sapiens
gtgcacgttgct

SEQ ID NO: 5502810 - DNA, 18 bp, Homo sapiens
gtgcacgttgcttcaggc

SEQ ID NO: 5502811 - DNA, 20 bp, Homo sapiens
gtgcactaatgtgtaagaca

SEQ ID NO: 5502812 - DNA, 18 bp, Homo sapiens
gtgcactcatacatatgt

SEQ ID NO: 5502813 - DNA, 12 bp, Homo sapiens
gtgcactccaga

SEQ ID NO: 5502814 - DNA, 19 bp, Homo sapiens
gtgcactccagactctggg

SEQ ID NO: 5502815 - DNA, 15 bp, Homo sapiens
gtgcactccagcttc

SEQ ID NO: 5502816 - DNA, 13 bp, Homo sapiens
gtgcactctgcta

SEQ ID NO: 5502817 - DNA, 23 bp, Homo sapiens
gtgcactgaatcgtttcatgtaa

SEQ ID NO: 5502818 - DNA, 14 bp, Homo sapiens
gtgcactgactgtg

SEQ ID NO: 5502819 - DNA, 19 bp, Homo sapiens
gtgcactgcccatggacag

SEQ ID NO: 5502820 - DNA, 16 bp, Homo sapiens
gtgcactggccccacc

SEQ ID NO: 5502821 - DNA, 18 bp, Homo sapiens
gtgcactggccccaccct

SEQ ID NO: 5502822 - DNA, 19 bp, Homo sapiens
gtgcactgtgaatcctggc

SEQ ID NO: 5502823 - DNA, 12 bp, Homo sapiens
gtgcactttctc

SEQ ID NO: 5502824 - DNA, 15 bp, Homo sapiens
gtgcactttgtaaat

SEQ ID NO: 5502825 - DNA, 15 bp, Homo sapiens
gtgcacttttctgtg

SEQ ID NO: 5502826 - DNA, 18 bp, Homo sapiens
gtgcacttttttatgaag

SEQ ID NO: 5502827 - DNA, 18 bp, Homo sapiens
gtgcagaaaagctcagag

SEQ ID NO: 5502828 - DNA, 17 bp, Homo sapiens
gtgcagaaactaccaga

SEQ ID NO: 5502829 - DNA, 14 bp, Homo sapiens
gtgcagaacacctg

SEQ ID NO: 5502830 - DNA, 17 bp, Homo sapiens
gtgcagaaccagcacta

SEQ ID NO: 5502831 - DNA, 22 bp, Homo sapiens
gtgcagaactgcagtcactgca

SEQ ID NO: 5502832 - DNA, 9 bp, Homo sapiens
gtgcagaat

SEQ ID NO: 5502833 - DNA, 21 bp, Homo sapiens
gtgcagaataatggaaacatt

SEQ ID NO: 5502834 - DNA, 21 bp, Homo sapiens
gtgcagaatatgacaatctac

SEQ ID NO: 5502835 - DNA, 13 bp, Homo sapiens
gtgcagaatgtaa

SEQ ID NO: 5502836 - DNA, 18 bp, Homo sapiens
gtgcagacaatcttctgt

SEQ ID NO: 5502837 - DNA, 16 bp, Homo sapiens
gtgcagacagccatgc

SEQ ID NO: 5502838 - DNA, 14 bp, Homo sapiens
gtgcagagaagctg

SEQ ID NO: 5502839 - DNA, 16 bp, Homo sapiens
gtgcagagaagctgga

SEQ ID NO: 5502840 - DNA, 18 bp, Homo sapiens
gtgcagagaagctggact

SEQ ID NO: 5502841 - DNA, 12 bp, Homo sapiens
gtgcagagcaga

SEQ ID NO: 5502842 - DNA, 16 bp, Homo sapiens
gtgcagagccttctca

SEQ ID NO: 5502843 - DNA, 13 bp, Homo sapiens
gtgcagagctgca

SEQ ID NO: 5502844 - DNA, 17 bp, Homo sapiens
gtgcagagctggggctg

SEQ ID NO: 5502845 - DNA, 16 bp, Homo sapiens
gtgcagaggaaactta

SEQ ID NO: 5502846 - DNA, 13 bp, Homo sapiens
gtgcagaggctgt

SEQ ID NO: 5502847 - DNA, 20 bp, Homo sapiens
gtgcagaggtgagcagagga

SEQ ID NO: 5502848 - DNA, 18 bp, Homo sapiens
gtgcagagtgcccagaac

SEQ ID NO: 5502849 - DNA, 19 bp, Homo sapiens
gtgcagatcatccgtctgt

SEQ ID NO: 5502850 - DNA, 15 bp, Homo sapiens
gtgcagatctgtgct

SEQ ID NO: 5502851 - DNA, 17 bp, Homo sapiens
gtgcagatgaggttgct

SEQ ID NO: 5502852 - DNA, 15 bp, Homo sapiens
gtgcagatgctgctg

SEQ ID NO: 5502853 - DNA, 14 bp, Homo sapiens
gtgcagcaaaagca

SEQ ID NO: 5502854 - DNA, 14 bp, Homo sapiens
gtgcagcagcccag

SEQ ID NO: 5502855 - DNA, 14 bp, Homo sapiens
gtgcagcagggcag

SEQ ID NO: 5502856 - DNA, 19 bp, Homo sapiens
gtgcagcatatacaataat

SEQ ID NO: 5502857 - DNA, 15 bp, Homo sapiens
gtgcagcatttcact

SEQ ID NO: 5502858 - DNA, 16 bp, Homo sapiens
gtgcagcatttcactt

SEQ ID NO: 5502859 - DNA, 21 bp, Homo sapiens
gtgcagccaaaggggagccag

SEQ ID NO: 5502860 - DNA, 12 bp, Homo sapiens
gtgcagccagag

SEQ ID NO: 5502861 - DNA, 15 bp, Homo sapiens
gtgcagccatagttt

SEQ ID NO: 5502862 - DNA, 14 bp, Homo sapiens
gtgcagccccagga

SEQ ID NO: 5502863 - DNA, 19 bp, Homo sapiens
gtgcagccccaggaccaag

SEQ ID NO: 5502864 - DNA, 22 bp, Homo sapiens
gtgcagccggggagctgagggg

SEQ ID NO: 5502865 - DNA, 19 bp, Homo sapiens
gtgcagcgacccttggtgt

SEQ ID NO: 5502866 - DNA, 22 bp, Homo sapiens
gtgcagcggtggaaggagcctg

SEQ ID NO: 5502867 - DNA, 15 bp, Homo sapiens
gtgcagctaacatga

SEQ ID NO: 5502868 - DNA, 16 bp, Homo sapiens
gtgcagctaacatgag

SEQ ID NO: 5502869 - DNA, 15 bp, Homo sapiens
gtgcagctcaggaga

SEQ ID NO: 5502870 - DNA, 13 bp, Homo sapiens
gtgcagctgattt

SEQ ID NO: 5502871 - DNA, 12 bp, Homo sapiens
gtgcagctggga

SEQ ID NO: 5502872 - DNA, 21 bp, Homo sapiens
gtgcagctgggcttggcctgg

SEQ ID NO: 5502873 - DNA, 20 bp, Homo sapiens
gtgcagcttcgaggacagga

SEQ ID NO: 5502874 - DNA, 15 bp, Homo sapiens
gtgcagcttctgtcc

SEQ ID NO: 5502875 - DNA, 18 bp, Homo sapiens
gtgcagcttgacattatg

SEQ ID NO: 5502876 - DNA, 15 bp, Homo sapiens
gtgcaggagcaaggc

SEQ ID NO: 5502877 - DNA, 12 bp, Homo sapiens
gtgcaggagcct

SEQ ID NO: 5502878 - DNA, 21 bp, Homo sapiens
gtgcaggagtggccggggaag

SEQ ID NO: 5502879 - DNA, 16 bp, Homo sapiens
gtgcaggcagccttga

SEQ ID NO: 5502880 - DNA, 18 bp, Homo sapiens
gtgcaggcaggctggcct

SEQ ID NO: 5502881 - DNA, 19 bp, Homo sapiens
gtgcaggcccaccctgctt

SEQ ID NO: 5502882 - DNA, 18 bp, Homo sapiens
gtgcaggcccaggcaggc

SEQ ID NO: 5502883 - DNA, 17 bp, Homo sapiens
gtgcaggctgcagtggc

SEQ ID NO: 5502884 - DNA, 16 bp, Homo sapiens
gtgcaggctggccagc

SEQ ID NO: 5502885 - DNA, 18 bp, Homo sapiens
gtgcagggaagtgcagag

SEQ ID NO: 5502886 - DNA, 21 bp, Homo sapiens
gtgcagggaagtgcagagctt

SEQ ID NO: 5502887 - DNA, 17 bp, Homo sapiens
gtgcagggacagcctgc

SEQ ID NO: 5502888 - DNA, 21 bp, Homo sapiens
gtgcagggacagcctgcacag

SEQ ID NO: 5502889 - DNA, 20 bp, Homo sapiens
gtgcagggagggcagttttc

SEQ ID NO: 5502890 - DNA, 18 bp, Homo sapiens
gtgcagggatattgcctt

SEQ ID NO: 5502891 - DNA, 19 bp, Homo sapiens
gtgcagggcctggcataga

SEQ ID NO: 5502892 - DNA, 11 bp, Homo sapiens
gtgcagggctg

SEQ ID NO: 5502893 - DNA, 13 bp, Homo sapiens
gtgcagggctggt

SEQ ID NO: 5502894 - DNA, 17 bp, Homo sapiens
gtgcaggggatggggtg

SEQ ID NO: 5502895 - DNA, 20 bp, Homo sapiens
gtgcaggggatggggtgggg

SEQ ID NO: 5502896 - DNA, 21 bp, Homo sapiens
gtgcaggggccaggggtggga

SEQ ID NO: 5502897 - DNA, 13 bp, Homo sapiens
gtgcagggtcctc

SEQ ID NO: 5502898 - DNA, 12 bp, Homo sapiens
gtgcagggtgga

SEQ ID NO: 5502899 - DNA, 20 bp, Homo sapiens
gtgcaggtctccacctgcac

SEQ ID NO: 5502900 - DNA, 11 bp, Homo sapiens
gtgcaggtgct

SEQ ID NO: 5502901 - DNA, 15 bp, Homo sapiens
gtgcagtaatagcac

SEQ ID NO: 5502902 - DNA, 15 bp, Homo sapiens
gtgcagtacaggcaa

SEQ ID NO: 5502903 - DNA, 15 bp, Homo sapiens
gtgcagtactttgtg

SEQ ID NO: 5502904 - DNA, 17 bp, Homo sapiens
gtgcagtaggagcaaga

SEQ ID NO: 5502905 - DNA, 13 bp, Homo sapiens
gtgcagtagtgca

SEQ ID NO: 5502906 - DNA, 18 bp, Homo sapiens
gtgcagtataattttcta

SEQ ID NO: 5502907 - DNA, 14 bp, Homo sapiens
gtgcagtcactgga

SEQ ID NO: 5502908 - DNA, 23 bp, Homo sapiens
gtgcagtctttgagataatttgt

SEQ ID NO: 5502909 - DNA, 19 bp, Homo sapiens
gtgcagtgatacatgtact

SEQ ID NO: 5502910 - DNA, 18 bp, Homo sapiens
gtgcagtgatgtttgcca

SEQ ID NO: 5502911 - DNA, 15 bp, Homo sapiens
gtgcagtggagctgg

SEQ ID NO: 5502912 - DNA, 23 bp, Homo sapiens
gtgcagtggccccatccagcatg

SEQ ID NO: 5502913 - DNA, 24 bp, Homo sapiens
gtgcagtggcgcgatctcagctca

SEQ ID NO: 5502914 - DNA, 24 bp, Homo sapiens
gtgcagtggcgtgatctcagctca

SEQ ID NO: 5502915 - DNA, 17 bp, Homo sapiens
gtgcagtgtcttgtaac

SEQ ID NO: 5502916 - DNA, 22 bp, Homo sapiens
gtgcagttcccccaacctcaga

SEQ ID NO: 5502917 - DNA, 24 bp, Homo sapiens
gtgcagttcccccaacctcagact

SEQ ID NO: 5502918 - DNA, 17 bp, Homo sapiens
gtgcagttgaggtctgc

SEQ ID NO: 5502919 - DNA, 16 bp, Homo sapiens
gtgcagttgctgttta

SEQ ID NO: 5502920 - DNA, 16 bp, Homo sapiens
gtgcagttgtgatttc

SEQ ID NO: 5502921 - DNA, 14 bp, Homo sapiens
gtgcagtttggaat

SEQ ID NO: 5502922 - DNA, 21 bp, Homo sapiens
gtgcagtttggtgtgtcctcc

SEQ ID NO: 5502923 - DNA, 15 bp, Homo sapiens
gtgcagttttccagg

SEQ ID NO: 5502924 - DNA, 13 bp, Homo sapiens
gtgcataaataat

SEQ ID NO: 5502925 - DNA, 18 bp, Homo sapiens
gtgcataaataattttgt

SEQ ID NO: 5502926 - DNA, 19 bp, Homo sapiens
gtgcataatgataaaataa

SEQ ID NO: 5502927 - DNA, 20 bp, Homo sapiens
gtgcataattcttccaaagg

SEQ ID NO: 5502928 - DNA, 13 bp, Homo sapiens
gtgcataccactt

SEQ ID NO: 5502929 - DNA, 21 bp, Homo sapiens
gtgcataccacttttgttctt

SEQ ID NO: 5502930 - DNA, 22 bp, Homo sapiens
gtgcataccacttttgttcttg

SEQ ID NO: 5502931 - DNA, 22 bp, Homo sapiens
gtgcatacgcctcttgttcatg

SEQ ID NO: 5502932 - DNA, 19 bp, Homo sapiens
gtgcatagaactgggtaaa

SEQ ID NO: 5502933 - DNA, 18 bp, Homo sapiens
gtgcatagcgtcctgccc

SEQ ID NO: 5502934 - DNA, 19 bp, Homo sapiens
gtgcatagcgtcctgccct

SEQ ID NO: 5502935 - DNA, 14 bp, Homo sapiens
gtgcatagtgctgg

SEQ ID NO: 5502936 - DNA, 16 bp, Homo sapiens
gtgcatagtgctggga

SEQ ID NO: 5502937 - DNA, 14 bp, Homo sapiens
gtgcatagtttctt

SEQ ID NO: 5502938 - DNA, 16 bp, Homo sapiens
gtgcatatagaaaaca

SEQ ID NO: 5502939 - DNA, 21 bp, Homo sapiens
gtgcatatgctacacatatgt

SEQ ID NO: 5502940 - DNA, 21 bp, Homo sapiens
gtgcatatggcaacgttcatg

SEQ ID NO: 5502941 - DNA, 13 bp, Homo sapiens
gtgcatatgtgtg

SEQ ID NO: 5502942 - DNA, 16 bp, Homo sapiens
gtgcatattcctttct

SEQ ID NO: 5502943 - DNA, 21 bp, Homo sapiens
gtgcatattcctttctatcat

SEQ ID NO: 5502944 - DNA, 13 bp, Homo sapiens
gtgcatattgtac

SEQ ID NO: 5502945 - DNA, 14 bp, Homo sapiens
gtgcatcacatctg

SEQ ID NO: 5502946 - DNA, 16 bp, Homo sapiens
gtgcatcacatctgca

SEQ ID NO: 5502947 - DNA, 19 bp, Homo sapiens
gtgcatcattactgttcca

SEQ ID NO: 5502948 - DNA, 12 bp, Homo sapiens
gtgcatcccaga

SEQ ID NO: 5502949 - DNA, 15 bp, Homo sapiens
gtgcatccccacgac

SEQ ID NO: 5502950 - DNA, 18 bp, Homo sapiens
gtgcatcccccctgctca

SEQ ID NO: 5502951 - DNA, 13 bp, Homo sapiens
gtgcatcctcctc

SEQ ID NO: 5502952 - DNA, 21 bp, Homo sapiens
gtgcatcctcctcagccccca

SEQ ID NO: 5502953 - DNA, 22 bp, Homo sapiens
gtgcatcctcctcagcccccag

SEQ ID NO: 5502954 - DNA, 16 bp, Homo sapiens
gtgccagggcagcact

SEQ ID NO: 5502955 - DNA, 18 bp, Homo sapiens
gtgccagggcagcatttt

SEQ ID NO: 5502956 - DNA, 20 bp, Homo sapiens
gtgccagggcaggctacccc

SEQ ID NO: 5502957 - DNA, 16 bp, Homo sapiens
gtgccagggcccaccc

SEQ ID NO: 5502958 - DNA, 21 bp, Homo sapiens
gtgccagggcccaccccagcc

SEQ ID NO: 5502959 - DNA, 20 bp, Homo sapiens
gtgccagggtgggctgggga

SEQ ID NO: 5502960 - DNA, 21 bp, Homo sapiens
gtgccagggtgggctggggac

SEQ ID NO: 5502961 - DNA, 15 bp, Homo sapiens
gtgccagggtgggtg

SEQ ID NO: 5502962 - DNA, 16 bp, Homo sapiens
gtgccaggtccttgcc

SEQ ID NO: 5502963 - DNA, 20 bp, Homo sapiens
gtgccaggtttttggtctga

SEQ ID NO: 5502964 - DNA, 16 bp, Homo sapiens
gtgccagtattttaaa

SEQ ID NO: 5502965 - DNA, 19 bp, Homo sapiens
gtgccagtcgcgctgcctg

SEQ ID NO: 5502966 - DNA, 18 bp, Homo sapiens
gtgccagtcttgtgtctg

SEQ ID NO: 5502967 - DNA, 18 bp, Homo sapiens
gtgccataccttctccca

SEQ ID NO: 5502968 - DNA, 19 bp, Homo sapiens
gtgccataccttctcccag

SEQ ID NO: 5502969 - DNA, 23 bp, Homo sapiens
gtgccataccttctcccaggcct

SEQ ID NO: 5502970 - DNA, 22 bp, Homo sapiens
gtgccatcattgctgtctgcag

SEQ ID NO: 5502971 - DNA, 14 bp, Homo sapiens
gtgccatcccacat

SEQ ID NO: 5502972 - DNA, 16 bp, Homo sapiens
gtgccatccctgagag

SEQ ID NO: 5502973 - DNA, 14 bp, Homo sapiens
gtgccatcttccat

SEQ ID NO: 5502974 - DNA, 14 bp, Homo sapiens
gtgccatgcctgct

SEQ ID NO: 5502975 - DNA, 15 bp, Homo sapiens
gtgccatgcctgctc

SEQ ID NO: 5502976 - DNA, 20 bp, Homo sapiens
gtgccatgcctgctccctgt

SEQ ID NO: 5502977 - DNA, 14 bp, Homo sapiens
gtgccatgctgggc

SEQ ID NO: 5502978 - DNA, 18 bp, Homo sapiens
gtgccatggccaggagtg

SEQ ID NO: 5502979 - DNA, 20 bp, Homo sapiens
gtgccatggtgttggagggg

SEQ ID NO: 5502980 - DNA, 22 bp, Homo sapiens
gtgccatgtaaatccccactgg

SEQ ID NO: 5502981 - DNA, 11 bp, Homo sapiens
gtgccatgtat

SEQ ID NO: 5502982 - DNA, 18 bp, Homo sapiens
gtgccatgtcacagcatg

SEQ ID NO: 5502983 - DNA, 16 bp, Homo sapiens
gtgccatgtctttact

SEQ ID NO: 5502984 - DNA, 14 bp, Homo sapiens
gtgccatgtgccag

SEQ ID NO: 5502985 - DNA, 18 bp, Homo sapiens
gtgccattatatttgcat

SEQ ID NO: 5502986 - DNA, 14 bp, Homo sapiens
gtgccattcccagc

SEQ ID NO: 5502987 - DNA, 16 bp, Homo sapiens
gtgccattcccagcgt

SEQ ID NO: 5502988 - DNA, 19 bp, Homo sapiens
gtgccattgtactccagcc

SEQ ID NO: 5502989 - DNA, 20 bp, Homo sapiens
gtgccattgtactccagcct

SEQ ID NO: 5502990 - DNA, 23 bp, Homo sapiens
gtgccattgtactccagcctggg

SEQ ID NO: 5502991 - DNA, 13 bp, Homo sapiens
gtgccattgtctt

SEQ ID NO: 5502992 - DNA, 14 bp, Homo sapiens
gtgccattgtcttt

SEQ ID NO: 5502993 - DNA, 15 bp, Homo sapiens
gtgccattgtcttta

SEQ ID NO: 5502994 - DNA, 18 bp, Homo sapiens
gtgccatttcctgtctgg

SEQ ID NO: 5502995 - DNA, 17 bp, Homo sapiens
gtgcccaaaagccatgt

SEQ ID NO: 5502996 - DNA, 17 bp, Homo sapiens
gtgcccaaagtggggag

SEQ ID NO: 5502997 - DNA, 19 bp, Homo sapiens
gtgcccaaagtggggaggg

SEQ ID NO: 5502998 - DNA, 15 bp, Homo sapiens
gtgcccaagagtggg

SEQ ID NO: 5502999 - DNA, 15 bp, Homo sapiens
gtgcccaagtgggca

SEQ ID NO: 5503000 - DNA, 17 bp, Homo sapiens
gtgcccaagtgggcagt

SEQ ID NO: 5503001 - DNA, 21 bp, Homo sapiens
gtgcccaagtgggtccaagtg

SEQ ID NO: 5503002 - DNA, 13 bp, Homo sapiens
gtgcccacagcag

SEQ ID NO: 5503003 - DNA, 15 bp, Homo sapiens
gtgcccacagggacc

SEQ ID NO: 5503004 - DNA, 20 bp, Homo sapiens
gtgcccacatcccaggcttc

SEQ ID NO: 5503005 - DNA, 23 bp, Homo sapiens
gtgcccaccaacatcccattgcc

SEQ ID NO: 5503006 - DNA, 19 bp, Homo sapiens
gtgcccaccagctggctct

SEQ ID NO: 5503007 - DNA, 20 bp, Homo sapiens
gtgcccaccagctggctctg

SEQ ID NO: 5503008 - DNA, 22 bp, Homo sapiens
gtgcccacccgtgttctcctcc

SEQ ID NO: 5503009 - DNA, 13 bp, Homo sapiens
gtgcccaccgccc

SEQ ID NO: 5503010 - DNA, 19 bp, Homo sapiens
gtgcccacggtctgagcta

SEQ ID NO: 5503011 - DNA, 22 bp, Homo sapiens
gtgcccacggtctgagctagct

SEQ ID NO: 5503012 - DNA, 19 bp, Homo sapiens
gtgcccactccgccagcca

SEQ ID NO: 5503013 - DNA, 18 bp, Homo sapiens
gtgcccacttaccctggg

SEQ ID NO: 5503014 - DNA, 22 bp, Homo sapiens
gtgcccagaactggactcagga

SEQ ID NO: 5503015 - DNA, 11 bp, Homo sapiens
gtgcccagagt

SEQ ID NO: 5503016 - DNA, 22 bp, Homo sapiens
gtgcccagatcgttctgccact

SEQ ID NO: 5503017 - DNA, 17 bp, Homo sapiens
gtgcccagcaggcccag

SEQ ID NO: 5503018 - DNA, 18 bp, Homo sapiens
gtgcccagcaggcccagc

SEQ ID NO: 5503019 - DNA, 19 bp, Homo sapiens
gtgcccagcaggcccagca

SEQ ID NO: 5503020 - DNA, 20 bp, Homo sapiens
gtgcccagcagtttcccaga

SEQ ID NO: 5503021 - DNA, 21 bp, Homo sapiens
gtgcccagcagtttcccagaa

SEQ ID NO: 5503022 - DNA, 13 bp, Homo sapiens
gtgcccagcccct

SEQ ID NO: 5503023 - DNA, 14 bp, Homo sapiens
gtgcccagcctgga

SEQ ID NO: 5503024 - DNA, 15 bp, Homo sapiens
gtgcccagcctggaa

SEQ ID NO: 5503025 - DNA, 14 bp, Homo sapiens
gtgcccagctaatt

SEQ ID NO: 5503026 - DNA, 20 bp, Homo sapiens
gtgcccagctatacctgtgc

SEQ ID NO: 5503027 - DNA, 13 bp, Homo sapiens
gtgcccagctcag

SEQ ID NO: 5503028 - DNA, 21 bp, Homo sapiens
gtgcccagcttcgtcagctcc

SEQ ID NO: 5503029 - DNA, 23 bp, Homo sapiens
gtgcccagcttcgtcagctccag

SEQ ID NO: 5503030 - DNA, 11 bp, Homo sapiens
gtgcccaggaa

SEQ ID NO: 5503031 - DNA, 17 bp, Homo sapiens
gtgcccaggacggtctg

SEQ ID NO: 5503032 - DNA, 23 bp, Homo sapiens
gtgcccaggacggtctgtgcccg

SEQ ID NO: 5503033 - DNA, 12 bp, Homo sapiens
gtgcccaggaga

SEQ ID NO: 5503034 - DNA, 14 bp, Homo sapiens
gtgcccaggccctt

SEQ ID NO: 5503035 - DNA, 16 bp, Homo sapiens
gtgcccagggccagtg

SEQ ID NO: 5503036 - DNA, 14 bp, Homo sapiens
gtgcccagtcttga

SEQ ID NO: 5503037 - DNA, 21 bp, Homo sapiens
gtgcccagtgatggcattact

SEQ ID NO: 5503038 - DNA, 16 bp, Homo sapiens
gtgcccagttaatctt

SEQ ID NO: 5503039 - DNA, 20 bp, Homo sapiens
gtgcccatcatctctgcctt

SEQ ID NO: 5503040 - DNA, 22 bp, Homo sapiens
gtgcccatcatctctgcctttg

SEQ ID NO: 5503041 - DNA, 23 bp, Homo sapiens
gtgcccatcatctctgcctttga

SEQ ID NO: 5503042 - DNA, 17 bp, Homo sapiens
gtgcccatccctggaag

SEQ ID NO: 5503043 - DNA, 16 bp, Homo sapiens
gtgcccatcctgccat

SEQ ID NO: 5503044 - DNA, 16 bp, Homo sapiens
gtgcccatgcaatggc

SEQ ID NO: 5503045 - DNA, 19 bp, Homo sapiens
gtgcccatgggcactgctg

SEQ ID NO: 5503046 - DNA, 16 bp, Homo sapiens
gtgcccatgtgtatgg

SEQ ID NO: 5503047 - DNA, 13 bp, Homo sapiens
gtgcccatttgtg

SEQ ID NO: 5503048 - DNA, 11 bp, Homo sapiens
gtgccccaaga

SEQ ID NO: 5503049 - DNA, 13 bp, Homo sapiens
gtgccccaagagg

SEQ ID NO: 5503050 - DNA, 18 bp, Homo sapiens
gtgccccacaaggcccag

SEQ ID NO: 5503051 - DNA, 24 bp, Homo sapiens
gtgccccacaaggcccagccctgg

SEQ ID NO: 5503052 - DNA, 17 bp, Homo sapiens
gtgccccaccactcccc

SEQ ID NO: 5503053 - DNA, 20 bp, Homo sapiens
gtgccccaccactccccaac

SEQ ID NO: 5503054 - DNA, 22 bp, Homo sapiens
gtgccccaccactccccaaccc

SEQ ID NO: 5503055 - DNA, 14 bp, Homo sapiens
gtgccccacctccc

SEQ ID NO: 5503056 - DNA, 22 bp, Homo sapiens
gtgccccacctccccagagccc

SEQ ID NO: 5503057 - DNA, 13 bp, Homo sapiens
gtgccccacctgc

SEQ ID NO: 5503058 - DNA, 19 bp, Homo sapiens
gtgccccacctgcctggtg

SEQ ID NO: 5503059 - DNA, 16 bp, Homo sapiens
gtgccccactccagcc

SEQ ID NO: 5503060 - DNA, 21 bp, Homo sapiens
gtgccccacttctggccacat

SEQ ID NO: 5503061 - DNA, 15 bp, Homo sapiens
gtgccccagactgag

SEQ ID NO: 5503062 - DNA, 20 bp, Homo sapiens
gtgccccagactgagctctc

SEQ ID NO: 5503063 - DNA, 17 bp, Homo sapiens
gtgccccagctaggaag

SEQ ID NO: 5503064 - DNA, 18 bp, Homo sapiens
gtgccccagctgccaggc

SEQ ID NO: 5503065 - DNA, 19 bp, Homo sapiens
gtgccccagctgccaggcg

SEQ ID NO: 5503066 - DNA, 22 bp, Homo sapiens
gtgccccagctgccaggcggcc

SEQ ID NO: 5503067 - DNA, 21 bp, Homo sapiens
gtgccccaggaccagctcagg

SEQ ID NO: 5503068 - DNA, 18 bp, Homo sapiens
gtgccccagggagtccag

SEQ ID NO: 5503069 - DNA, 21 bp, Homo sapiens
gtgccccagggagtccagggt

SEQ ID NO: 5503070 - DNA, 18 bp, Homo sapiens
gtgccccatgcctgtcca

SEQ ID NO: 5503071 - DNA, 13 bp, Homo sapiens
gtgccccatgtcc

SEQ ID NO: 5503072 - DNA, 13 bp, Homo sapiens
gtgcccccacccc

SEQ ID NO: 5503073 - DNA, 20 bp, Homo sapiens
gtgcccccacccccaccctc

SEQ ID NO: 5503074 - DNA, 13 bp, Homo sapiens
gtgcccccactga

SEQ ID NO: 5503075 - DNA, 14 bp, Homo sapiens
gtgcccccagcctc

SEQ ID NO: 5503076 - DNA, 21 bp, Homo sapiens
gtgcccccagcctcagcccaa

SEQ ID NO: 5503077 - DNA, 18 bp, Homo sapiens
gtgcccccagcgtggggc

SEQ ID NO: 5503078 - DNA, 14 bp, Homo sapiens
gtgcccccagggtc

SEQ ID NO: 5503079 - DNA, 16 bp, Homo sapiens
gtgcccccagggtcct

SEQ ID NO: 5503080 - DNA, 12 bp, Homo sapiens
gtgcccccaggt

SEQ ID NO: 5503081 - DNA, 21 bp, Homo sapiens
gtgccccccacccctggaaga

SEQ ID NO: 5503082 - DNA, 17 bp, Homo sapiens
gtgccccccatcctggc

SEQ ID NO: 5503083 - DNA, 20 bp, Homo sapiens
gtgccccccatcctggccca

SEQ ID NO: 5503084 - DNA, 15 bp, Homo sapiens
gtgccccccatgccc

SEQ ID NO: 5503085 - DNA, 18 bp, Homo sapiens
gtgcccccgcctgccacc

SEQ ID NO: 5503086 - DNA, 16 bp, Homo sapiens
gtgcccccgggaatgg

SEQ ID NO: 5503087 - DNA, 13 bp, Homo sapiens
gtgccccctcacc

SEQ ID NO: 5503088 - DNA, 13 bp, Homo sapiens
gtgccccctcctc

SEQ ID NO: 5503089 - DNA, 22 bp, Homo sapiens
gtgccccgaccccacctgaggc

SEQ ID NO: 5503090 - DNA, 16 bp, Homo sapiens
gtgccccgactgtggg

SEQ ID NO: 5503091 - DNA, 17 bp, Homo sapiens
gtgccccgcctccccga

SEQ ID NO: 5503092 - DNA, 15 bp, Homo sapiens
gtgccccgcctcccg

SEQ ID NO: 5503093 - DNA, 16 bp, Homo sapiens
gtgccccgcctgagtc

SEQ ID NO: 5503094 - DNA, 19 bp, Homo sapiens
gtgcccctcagagaggcat

SEQ ID NO: 5503095 - DNA, 19 bp, Homo sapiens
gtgcccctcccatggccca

SEQ ID NO: 5503096 - DNA, 21 bp, Homo sapiens
gtgcccctcccatggcccagc

SEQ ID NO: 5503097 - DNA, 16 bp, Homo sapiens
gtgcccctcctgcccc

SEQ ID NO: 5503098 - DNA, 13 bp, Homo sapiens
gtgcccctcctgg

SEQ ID NO: 5503099 - DNA, 14 bp, Homo sapiens
gtgcccctcctggg

SEQ ID NO: 5503100 - DNA, 17 bp, Homo sapiens
gtgcccctcctgggtgc

SEQ ID NO: 5503101 - DNA, 21 bp, Homo sapiens
gtgcccctctccttcttagct

SEQ ID NO: 5503102 - DNA, 19 bp, Homo sapiens
gtgcccctgatgcagcctg

SEQ ID NO: 5503103 - DNA, 13 bp, Homo sapiens
gtgcccctgcagg

SEQ ID NO: 5503104 - DNA, 12 bp, Homo sapiens
gtgcccctgcca

SEQ ID NO: 5503105 - DNA, 11 bp, Homo sapiens
gtgcccctggg

SEQ ID NO: 5503106 - DNA, 19 bp, Homo sapiens
gtgcccctgtcccacctgg

SEQ ID NO: 5503107 - DNA, 23 bp, Homo sapiens
gtgccccttaagggttgaaggca

SEQ ID NO: 5503108 - DNA, 15 bp, Homo sapiens
gtgccccttccctgg

SEQ ID NO: 5503109 - DNA, 17 bp, Homo sapiens
gtgccccttccctgggt

SEQ ID NO: 5503110 - DNA, 17 bp, Homo sapiens
gtgcccgaggttcctgt

SEQ ID NO: 5503111 - DNA, 18 bp, Homo sapiens
gtgcccgaggttcctgtc

SEQ ID NO: 5503112 - DNA, 13 bp, Homo sapiens
gtgcccgcccacc

SEQ ID NO: 5503113 - DNA, 16 bp, Homo sapiens
gtgcccgcccacctct

SEQ ID NO: 5503114 - DNA, 14 bp, Homo sapiens
gtgcccgccctgcc

SEQ ID NO: 5503115 - DNA, 15 bp, Homo sapiens
gtgcccgccctgccc

SEQ ID NO: 5503116 - DNA, 23 bp, Homo sapiens
gtgcccgccctgcccctgcccca

SEQ ID NO: 5503117 - DNA, 14 bp, Homo sapiens
gtgcccgccctggg

SEQ ID NO: 5503118 - DNA, 18 bp, Homo sapiens
gtgcccgccctgggctgg

SEQ ID NO: 5503119 - DNA, 20 bp, Homo sapiens
gtgcccgcctaggagttgag

SEQ ID NO: 5503120 - DNA, 17 bp, Homo sapiens
gtgcccgcgccaggccc

SEQ ID NO: 5503121 - DNA, 21 bp, Homo sapiens
gtgcccggggatcccccgccc

SEQ ID NO: 5503122 - DNA, 15 bp, Homo sapiens
gtgcccggggcagca

SEQ ID NO: 5503123 - DNA, 18 bp, Homo sapiens
gtgcccggtgcagggcct

SEQ ID NO: 5503124 - DNA, 19 bp, Homo sapiens
gtgcccggtgcagggcctg

SEQ ID NO: 5503125 - DNA, 14 bp, Homo sapiens
gtgcccgtgtcggt

SEQ ID NO: 5503126 - DNA, 17 bp, Homo sapiens
gtgcccgtgtggcctgg

SEQ ID NO: 5503127 - DNA, 18 bp, Homo sapiens
gtgcccgtgtggcctggg

SEQ ID NO: 5503128 - DNA, 20 bp, Homo sapiens
gtgccctactcattggggtt

SEQ ID NO: 5503129 - DNA, 20 bp, Homo sapiens
gtgccctccacagccgcagc

SEQ ID NO: 5503130 - DNA, 14 bp, Homo sapiens
gtgccctccactgc

SEQ ID NO: 5503131 - DNA, 15 bp, Homo sapiens
gtgccctccactgcc

SEQ ID NO: 5503132 - DNA, 21 bp, Homo sapiens
gtgccctcctgggagctcatg

SEQ ID NO: 5503133 - DNA, 18 bp, Homo sapiens
gtgccctcgcctcctcct

SEQ ID NO: 5503134 - DNA, 20 bp, Homo sapiens
gtgccctctgctcaggcctc

SEQ ID NO: 5503135 - DNA, 22 bp, Homo sapiens
gtgccctctgctcaggcctccc

SEQ ID NO: 5503136 - DNA, 18 bp, Homo sapiens
gtgccctctggatcctgc

SEQ ID NO: 5503137 - DNA, 19 bp, Homo sapiens
gtgccctctgggctctgag

SEQ ID NO: 5503138 - DNA, 14 bp, Homo sapiens
gtgccctgaaaatg

SEQ ID NO: 5503139 - DNA, 18 bp, Homo sapiens
gtgccctgacccctgcac

SEQ ID NO: 5503140 - DNA, 23 bp, Homo sapiens
gtgccctgcaggcacagaggagg

SEQ ID NO: 5503141 - DNA, 12 bp, Homo sapiens
gtgccctgcctt

SEQ ID NO: 5503142 - DNA, 16 bp, Homo sapiens
gtgccctgctttgcaa

SEQ ID NO: 5503143 - DNA, 20 bp, Homo sapiens
gtgccctggaggctgacaca

SEQ ID NO: 5503144 - DNA, 19 bp, Homo sapiens
gtgccctggatgcccagga

SEQ ID NO: 5503145 - DNA, 21 bp, Homo sapiens
gtgccctggcccagcctgtgg

SEQ ID NO: 5503146 - DNA, 13 bp, Homo sapiens
gtgccctggctcc

SEQ ID NO: 5503147 - DNA, 15 bp, Homo sapiens
gtgccctgggccagg

SEQ ID NO: 5503148 - DNA, 18 bp, Homo sapiens
gtgccctgggccaggcag

SEQ ID NO: 5503149 - DNA, 19 bp, Homo sapiens
gtgccctggtggcctgccc

SEQ ID NO: 5503150 - DNA, 17 bp, Homo sapiens
gtgcccttgcccttgga

SEQ ID NO: 5503151 - DNA, 14 bp, Homo sapiens
gtgccgacagaagg

SEQ ID NO: 5503152 - DNA, 15 bp, Homo sapiens
gtgccgacagaagga

SEQ ID NO: 5503153 - DNA, 21 bp, Homo sapiens
gtgccgaccacgccccaggac

SEQ ID NO: 5503154 - DNA, 23 bp, Homo sapiens
gtgccgaccacgccccaggacct

SEQ ID NO: 5503155 - DNA, 24 bp, Homo sapiens
gtgccgaccacgccccaggacctc

SEQ ID NO: 5503156 - DNA, 12 bp, Homo sapiens
gtgccgagccag

SEQ ID NO: 5503157 - DNA, 13 bp, Homo sapiens
gtgccgagccagc

SEQ ID NO: 5503158 - DNA, 22 bp, Homo sapiens
gtgccgatgatatagagtgact

SEQ ID NO: 5503159 - DNA, 14 bp, Homo sapiens
gtgccgcactctgg

SEQ ID NO: 5503160 - DNA, 16 bp, Homo sapiens
gtgccgcactctggcg

SEQ ID NO: 5503161 - DNA, 13 bp, Homo sapiens
gtgccgcctgtgc

SEQ ID NO: 5503162 - DNA, 17 bp, Homo sapiens
gtgccgcgggcgagaag

SEQ ID NO: 5503163 - DNA, 13 bp, Homo sapiens
gtgccgctcctgc

SEQ ID NO: 5503164 - DNA, 14 bp, Homo sapiens
gtgccgctcctgct

SEQ ID NO: 5503165 - DNA, 17 bp, Homo sapiens
gtgccgctgccacccgc

SEQ ID NO: 5503166 - DNA, 14 bp, Homo sapiens
gtgccgggaggcag

SEQ ID NO: 5503167 - DNA, 14 bp, Homo sapiens
gtgccgggccccca

SEQ ID NO: 5503168 - DNA, 16 bp, Homo sapiens
gtgccggggaggggca

SEQ ID NO: 5503169 - DNA, 13 bp, Homo sapiens
gtgccgtaattat

SEQ ID NO: 5503170 - DNA, 20 bp, Homo sapiens
gtgccgtaattatgtaccat

SEQ ID NO: 5503171 - DNA, 21 bp, Homo sapiens
gtgccgtaattatgtaccatg

SEQ ID NO: 5503172 - DNA, 22 bp, Homo sapiens
gtgccgtagggagtacctgctg

SEQ ID NO: 5503173 - DNA, 23 bp, Homo sapiens
gtgccgtagggagtacctgctgc

SEQ ID NO: 5503174 - DNA, 14 bp, Homo sapiens
gtgccgtgagcagg

SEQ ID NO: 5503175 - DNA, 20 bp, Homo sapiens
gtgccgtgagcaggctttgg

SEQ ID NO: 5503176 - DNA, 17 bp, Homo sapiens
gtgccgtgcgggcgagg

SEQ ID NO: 5503177 - DNA, 14 bp, Homo sapiens
gtgccgtggagctt

SEQ ID NO: 5503178 - DNA, 12 bp, Homo sapiens
gtgccgtggcac

SEQ ID NO: 5503179 - DNA, 15 bp, Homo sapiens
gtgccgtgtgagtgt

SEQ ID NO: 5503180 - DNA, 18 bp, Homo sapiens
gtgccgttactctccaac

SEQ ID NO: 5503181 - DNA, 21 bp, Homo sapiens
gtgccgttactctccaacctg

SEQ ID NO: 5503182 - DNA, 17 bp, Homo sapiens
gtgcctaaaataagaat

SEQ ID NO: 5503183 - DNA, 16 bp, Homo sapiens
gtgcctaacctgggac

SEQ ID NO: 5503184 - DNA, 13 bp, Homo sapiens
gtgcctaataaag

SEQ ID NO: 5503185 - DNA, 16 bp, Homo sapiens
gtgcctacaatgggaa

SEQ ID NO: 5503186 - DNA, 17 bp, Homo sapiens
gtgcctagactgttact

SEQ ID NO: 5503187 - DNA, 20 bp, Homo sapiens
gtgcctagtaaatgttaact

SEQ ID NO: 5503188 - DNA, 14 bp, Homo sapiens
gtgcctagtattga

SEQ ID NO: 5503189 - DNA, 16 bp, Homo sapiens
gtgcctagtattgaca

SEQ ID NO: 5503190 - DNA, 19 bp, Homo sapiens
gtgcctagtgatgtagaaa

SEQ ID NO: 5503191 - DNA, 18 bp, Homo sapiens
gtgcctatagtcccagct

SEQ ID NO: 5503192 - DNA, 19 bp, Homo sapiens
gtgcctatatctgagagac

SEQ ID NO: 5503193 - DNA, 19 bp, Homo sapiens
gtgcctatctgcctggagg

SEQ ID NO: 5503194 - DNA, 23 bp, Homo sapiens
gtgcctcaaattagaatagaact

SEQ ID NO: 5503195 - DNA, 15 bp, Homo sapiens
gtgcctcaagagaag

SEQ ID NO: 5503196 - DNA, 12 bp, Homo sapiens
gtgcctcacctt

SEQ ID NO: 5503197 - DNA, 17 bp, Homo sapiens
gtgcctcactgggggct

SEQ ID NO: 5503198 - DNA, 16 bp, Homo sapiens
gtgcctcagcgctgcc

SEQ ID NO: 5503199 - DNA, 17 bp, Homo sapiens
gtgcctcaggccagggc

SEQ ID NO: 5503200 - DNA, 23 bp, Homo sapiens
gtgcctcatagcatagccagcat

SEQ ID NO: 5503201 - DNA, 14 bp, Homo sapiens
gtgcctcattgctt

SEQ ID NO: 5503202 - DNA, 22 bp, Homo sapiens
gtgcctccaccaccactggcca

SEQ ID NO: 5503203 - DNA, 23 bp, Homo sapiens
gtgcctcccaagctcagagcagc

SEQ ID NO: 5503204 - DNA, 12 bp, Homo sapiens
gtgcctcccagt

SEQ ID NO: 5503205 - DNA, 16 bp, Homo sapiens
gtgcctcccagtggcc

SEQ ID NO: 5503206 - DNA, 21 bp, Homo sapiens
gtgcctcccagtggcctggct

SEQ ID NO: 5503207 - DNA, 18 bp, Homo sapiens
gtgcctccccccagaccc

SEQ ID NO: 5503208 - DNA, 20 bp, Homo sapiens
gtgcctccctccccagtgca

SEQ ID NO: 5503209 - DNA, 19 bp, Homo sapiens
gtgcctcctcaaacccagt

SEQ ID NO: 5503210 - DNA, 21 bp, Homo sapiens
gtgcctcctcaaacccagtct

SEQ ID NO: 5503211 - DNA, 18 bp, Homo sapiens
gtgcctcctccccaggtg

SEQ ID NO: 5503212 - DNA, 16 bp, Homo sapiens
gtgcctcctccctccc

SEQ ID NO: 5503213 - DNA, 13 bp, Homo sapiens
gtgcctcctggga

SEQ ID NO: 5503214 - DNA, 14 bp, Homo sapiens
gtgcctcctgggac

SEQ ID NO: 5503215 - DNA, 22 bp, Homo sapiens
gtgcctcctgggaccatggaca

SEQ ID NO: 5503216 - DNA, 11 bp, Homo sapiens
gtgcctcctgt

SEQ ID NO: 5503217 - DNA, 13 bp, Homo sapiens
gtgcctcctgtgt

SEQ ID NO: 5503218 - DNA, 15 bp, Homo sapiens
gtgcctcctgtgtgt

SEQ ID NO: 5503219 - DNA, 22 bp, Homo sapiens
gtgcctcgaggcaccggcgctg

SEQ ID NO: 5503220 - DNA, 15 bp, Homo sapiens
gtgcctcgctcccca

SEQ ID NO: 5503221 - DNA, 13 bp, Homo sapiens
gtgcctctagctg

SEQ ID NO: 5503222 - DNA, 16 bp, Homo sapiens
gtgcctctagctgaat

SEQ ID NO: 5503223 - DNA, 12 bp, Homo sapiens
gtgcctctccct

SEQ ID NO: 5503224 - DNA, 22 bp, Homo sapiens
gtgcctctccctgctgctccta

SEQ ID NO: 5503225 - DNA, 15 bp, Homo sapiens
gtgcctctgcctgtc

SEQ ID NO: 5503226 - DNA, 12 bp, Homo sapiens
gtgcctctggga

SEQ ID NO: 5503227 - DNA, 13 bp, Homo sapiens
gtgcctctgggac

SEQ ID NO: 5503228 - DNA, 13 bp, Homo sapiens
gtgcctctgtcct

SEQ ID NO: 5503229 - DNA, 19 bp, Homo sapiens
gtgcctctgtcctagactc

SEQ ID NO: 5503230 - DNA, 21 bp, Homo sapiens
gtgcctcttgggagacgtcca

SEQ ID NO: 5503231 - DNA, 16 bp, Homo sapiens
gtgcctgaaagctggg

SEQ ID NO: 5503232 - DNA, 20 bp, Homo sapiens
gtgcctgaaggctatccact

SEQ ID NO: 5503233 - DNA, 21 bp, Homo sapiens
gtgcctgacacactaaccaag

SEQ ID NO: 5503234 - DNA, 24 bp, Homo sapiens
gtgcctgacaccacgctggagctg

SEQ ID NO: 5503235 - DNA, 16 bp, Homo sapiens
gtgcctgagaccaggg

SEQ ID NO: 5503236 - DNA, 14 bp, Homo sapiens
gtgcctgagaggca

SEQ ID NO: 5503237 - DNA, 12 bp, Homo sapiens
gtgcctgagccc

SEQ ID NO: 5503238 - DNA, 14 bp, Homo sapiens
gtgcctgagcccct

SEQ ID NO: 5503239 - DNA, 15 bp, Homo sapiens
gtgcctgagcccctc

SEQ ID NO: 5503240 - DNA, 13 bp, Homo sapiens
gtgcctgagcccg

SEQ ID NO: 5503241 - DNA, 16 bp, Homo sapiens
gtgcctgagctgggga

SEQ ID NO: 5503242 - DNA, 14 bp, Homo sapiens
gtgcctgaggctgg

SEQ ID NO: 5503243 - DNA, 23 bp, Homo sapiens
gtgcctgatccagcctctcccct

SEQ ID NO: 5503244 - DNA, 17 bp, Homo sapiens
gtgcctgatgggagtag

SEQ ID NO: 5503245 - DNA, 19 bp, Homo sapiens
gtgcctgattcggctgtct

SEQ ID NO: 5503246 - DNA, 17 bp, Homo sapiens
gtgcctgcaccaggaga

SEQ ID NO: 5503247 - DNA, 21 bp, Homo sapiens
gtgcctgcaccaggagacaga

SEQ ID NO: 5503248 - DNA, 20 bp, Homo sapiens
gtgcctgcattcccaggaaa

SEQ ID NO: 5503249 - DNA, 21 bp, Homo sapiens
gtgcctgcattcgcagcagct

SEQ ID NO: 5503250 - DNA, 14 bp, Homo sapiens
gtgcctgccactct

SEQ ID NO: 5503251 - DNA, 18 bp, Homo sapiens
gtgcctgccatagccagg

SEQ ID NO: 5503252 - DNA, 18 bp, Homo sapiens
gtgcctgccatgggccag

SEQ ID NO: 5503253 - DNA, 21 bp, Homo sapiens
gtgcctgccatgggccagcct

SEQ ID NO: 5503254 - DNA, 21 bp, Homo sapiens
gtgcctgcctttgtgtcagaa

SEQ ID NO: 5503255 - DNA, 15 bp, Homo sapiens
gtgcctgcgttctga

SEQ ID NO: 5503256 - DNA, 23 bp, Homo sapiens
gtgcctgctagagcaacccctgt

SEQ ID NO: 5503257 - DNA, 20 bp, Homo sapiens
gtgcctgctcagcagccagt

SEQ ID NO: 5503258 - DNA, 21 bp, Homo sapiens
gtgcctgctctccttgccctg

SEQ ID NO: 5503259 - DNA, 22 bp, Homo sapiens
gtgcctgctctccttgccctgg

SEQ ID NO: 5503260 - DNA, 23 bp, Homo sapiens
gtgcctgctctccttgccctggg

SEQ ID NO: 5503261 - DNA, 20 bp, Homo sapiens
gtgcctgctgggtgccaggt

SEQ ID NO: 5503262 - DNA, 22 bp, Homo sapiens
gtgcctgctgggtgccaggtgc

SEQ ID NO: 5503263 - DNA, 23 bp, Homo sapiens
gtgcctgctgggtgccaggtgct

SEQ ID NO: 5503264 - DNA, 13 bp, Homo sapiens
gtgcctgcttcag

SEQ ID NO: 5503265 - DNA, 14 bp, Homo sapiens
gtgcctgcttctgt

SEQ ID NO: 5503266 - DNA, 13 bp, Homo sapiens
gtgcctgctttga

SEQ ID NO: 5503267 - DNA, 21 bp, Homo sapiens
gtgcctgctttgacgggccag

SEQ ID NO: 5503268 - DNA, 15 bp, Homo sapiens
gtgcctggaggtgtg

SEQ ID NO: 5503269 - DNA, 21 bp, Homo sapiens
gtgcctggagttgactgactg

SEQ ID NO: 5503270 - DNA, 23 bp, Homo sapiens
gtgcctggatgggggtgcaggca

SEQ ID NO: 5503271 - DNA, 19 bp, Homo sapiens
gtgcctggccagatttttc

SEQ ID NO: 5503272 - DNA, 23 bp, Homo sapiens
gtgcctggcccattcttgagttt

SEQ ID NO: 5503273 - DNA, 13 bp, Homo sapiens
gtgcctggccctt

SEQ ID NO: 5503274 - DNA, 17 bp, Homo sapiens
gtgcctggccgcagggc

SEQ ID NO: 5503275 - DNA, 12 bp, Homo sapiens
gtgcctggcctc

SEQ ID NO: 5503276 - DNA, 14 bp, Homo sapiens
gtgcctggcctctg

SEQ ID NO: 5503277 - DNA, 19 bp, Homo sapiens
gtgcctggcctggcacaca

SEQ ID NO: 5503278 - DNA, 18 bp, Homo sapiens
gtgcctggcgcccctgcc

SEQ ID NO: 5503279 - DNA, 12 bp, Homo sapiens
gtgcctggctca

SEQ ID NO: 5503280 - DNA, 18 bp, Homo sapiens
gtgcctggctcagagcca

SEQ ID NO: 5503281 - DNA, 12 bp, Homo sapiens
gtgcctggctcc

SEQ ID NO: 5503282 - DNA, 15 bp, Homo sapiens
gtgcctggctccctg

SEQ ID NO: 5503283 - DNA, 16 bp, Homo sapiens
gtgcctggctccctga

SEQ ID NO: 5503284 - DNA, 12 bp, Homo sapiens
gtgcctggctga

SEQ ID NO: 5503285 - DNA, 19 bp, Homo sapiens
gtgcctggctgattcagca

SEQ ID NO: 5503286 - DNA, 18 bp, Homo sapiens
gtgcctggcttgctgtgg

SEQ ID NO: 5503287 - DNA, 12 bp, Homo sapiens
gtgcctgggagg

SEQ ID NO: 5503288 - DNA, 14 bp, Homo sapiens
gtgcctgggaggag

SEQ ID NO: 5503289 - DNA, 11 bp, Homo sapiens
gtgcctgggat

SEQ ID NO: 5503290 - DNA, 11 bp, Homo sapiens
gtgcctgggcc

SEQ ID NO: 5503291 - DNA, 16 bp, Homo sapiens
gtgcctgggcccctcc

SEQ ID NO: 5503292 - DNA, 22 bp, Homo sapiens
gtgcctgggcccctcccctcag

SEQ ID NO: 5503293 - DNA, 14 bp, Homo sapiens
gtgcctgggccctg

SEQ ID NO: 5503294 - DNA, 14 bp, Homo sapiens
gtgcctggggctgg

SEQ ID NO: 5503295 - DNA, 17 bp, Homo sapiens
gtgcctggggctggctg

SEQ ID NO: 5503296 - DNA, 20 bp, Homo sapiens
gtgcctggggctggctgcag

SEQ ID NO: 5503297 - DNA, 16 bp, Homo sapiens
gtgcctgggggagaga

SEQ ID NO: 5503298 - DNA, 21 bp, Homo sapiens
gtgcctgggtggatgggccac

SEQ ID NO: 5503299 - DNA, 22 bp, Homo sapiens
gtgcctgggtggggctgctcct

SEQ ID NO: 5503300 - DNA, 23 bp, Homo sapiens
gtgcctgtaatctttttctccac

SEQ ID NO: 5503301 - DNA, 13 bp, Homo sapiens
gtgcctgtagcct

SEQ ID NO: 5503302 - DNA, 21 bp, Homo sapiens
gtgcctgtagtcccagctact

SEQ ID NO: 5503303 - DNA, 18 bp, Homo sapiens
gtgcctgtattcccagct

SEQ ID NO: 5503304 - DNA, 19 bp, Homo sapiens
gtgcctgtcacgctctggt

SEQ ID NO: 5503305 - DNA, 20 bp, Homo sapiens
gtgcctgtcccacccccacc

SEQ ID NO: 5503306 - DNA, 23 bp, Homo sapiens
gtgcctgtgagcatggggccagg

SEQ ID NO: 5503307 - DNA, 15 bp, Homo sapiens
gtgcctgtgaggcag

SEQ ID NO: 5503308 - DNA, 17 bp, Homo sapiens
gtgcctgtgaggcaggg

SEQ ID NO: 5503309 - DNA, 18 bp, Homo sapiens
gtgcctgtgctcctgccc

SEQ ID NO: 5503310 - DNA, 16 bp, Homo sapiens
gtgctcacgtgtcctt

SEQ ID NO: 5503311 - DNA, 23 bp, Homo sapiens
gtgctcacgttaccttgacacat

SEQ ID NO: 5503312 - DNA, 12 bp, Homo sapiens
gtgctcagaaga

SEQ ID NO: 5503313 - DNA, 16 bp, Homo sapiens
gtgctcagaagaggaa

SEQ ID NO: 5503314 - DNA, 19 bp, Homo sapiens
gtgctcagaataaggcagg

SEQ ID NO: 5503315 - DNA, 16 bp, Homo sapiens
gtgctcagccctgagg

SEQ ID NO: 5503316 - DNA, 16 bp, Homo sapiens
gtgctcaggagccctg

SEQ ID NO: 5503317 - DNA, 16 bp, Homo sapiens
gtgctcagggaaatgg

SEQ ID NO: 5503318 - DNA, 23 bp, Homo sapiens
gtgctcagggaaatggccttccc

SEQ ID NO: 5503319 - DNA, 16 bp, Homo sapiens
gtgctcagggcatgct

SEQ ID NO: 5503320 - DNA, 13 bp, Homo sapiens
gtgctcagggctg

SEQ ID NO: 5503321 - DNA, 9 bp, Homo sapiens
gtgctcagt

SEQ ID NO: 5503322 - DNA, 16 bp, Homo sapiens
gtgctcagtcgccctg

SEQ ID NO: 5503323 - DNA, 22 bp, Homo sapiens
gtgctcatcagaaacaatttct

SEQ ID NO: 5503324 - DNA, 20 bp, Homo sapiens
gtgctcatcggagactgccc

SEQ ID NO: 5503325 - DNA, 18 bp, Homo sapiens
gtgctccagcagtgctgg

SEQ ID NO: 5503326 - DNA, 14 bp, Homo sapiens
gtgctccaggcttc

SEQ ID NO: 5503327 - DNA, 17 bp, Homo sapiens
gtgctccagtgttttct

SEQ ID NO: 5503328 - DNA, 20 bp, Homo sapiens
gtgctccagtgttttcttgt

SEQ ID NO: 5503329 - DNA, 15 bp, Homo sapiens
gtgctccatctccgc

SEQ ID NO: 5503330 - DNA, 23 bp, Homo sapiens
gtgctccatctccgcctccacac

SEQ ID NO: 5503331 - DNA, 18 bp, Homo sapiens
gtgctccatggctgccat

SEQ ID NO: 5503332 - DNA, 23 bp, Homo sapiens
gtgctcccacggggaccactggg

SEQ ID NO: 5503333 - DNA, 16 bp, Homo sapiens
gtgctcccctctgaaa

SEQ ID NO: 5503334 - DNA, 15 bp, Homo sapiens
gtgctcccctgccac

SEQ ID NO: 5503335 - DNA, 15 bp, Homo sapiens
gtgctcccgagagat

SEQ ID NO: 5503336 - DNA, 22 bp, Homo sapiens
gtgctccctcccatcctccagc

SEQ ID NO: 5503337 - DNA, 15 bp, Homo sapiens
gtgctccctcctcag

SEQ ID NO: 5503338 - DNA, 15 bp, Homo sapiens
gtgctccctggaggc

SEQ ID NO: 5503339 - DNA, 21 bp, Homo sapiens
gtgctccgtagctctgctgct

SEQ ID NO: 5503340 - DNA, 13 bp, Homo sapiens
gtgctccgtgcct

SEQ ID NO: 5503341 - DNA, 16 bp, Homo sapiens
gtgctccgtgcctcca

SEQ ID NO: 5503342 - DNA, 14 bp, Homo sapiens
gtgctcctctgccc

SEQ ID NO: 5503343 - DNA, 14 bp, Homo sapiens
gtgctcctgaaaga

SEQ ID NO: 5503344 - DNA, 18 bp, Homo sapiens
gtgctcctgcccagccac

SEQ ID NO: 5503345 - DNA, 18 bp, Homo sapiens
gtgctcctgcccaggagc

SEQ ID NO: 5503346 - DNA, 20 bp, Homo sapiens
gtgctcctgtccctccctcc

SEQ ID NO: 5503347 - DNA, 21 bp, Homo sapiens
gtgctcgagacacagtgaagc

SEQ ID NO: 5503348 - DNA, 18 bp, Homo sapiens
gtgctcgcttctcctcca

SEQ ID NO: 5503349 - DNA, 17 bp, Homo sapiens
gtgctcggacacagttt

SEQ ID NO: 5503350 - DNA, 21 bp, Homo sapiens
gtgctcggagaagagcgcagt

SEQ ID NO: 5503351 - DNA, 12 bp, Homo sapiens
gtgctcggcagt

SEQ ID NO: 5503352 - DNA, 16 bp, Homo sapiens
gtgctcgggtgctgcc

SEQ ID NO: 5503353 - DNA, 21 bp, Homo sapiens
gtgctctacatctcgtatgga

SEQ ID NO: 5503354 - DNA, 14 bp, Homo sapiens
gtgctctaggctgc

SEQ ID NO: 5503355 - DNA, 17 bp, Homo sapiens
gtgctctaggctgcccc

SEQ ID NO: 5503356 - DNA, 17 bp, Homo sapiens
gtgctctcagctggcag

SEQ ID NO: 5503357 - DNA, 21 bp, Homo sapiens
gtgctctccccggcaggcctg

SEQ ID NO: 5503358 - DNA, 20 bp, Homo sapiens
gtgctctctgccactggaag

SEQ ID NO: 5503359 - DNA, 18 bp, Homo sapiens
gtgctctgaatctgtaca

SEQ ID NO: 5503360 - DNA, 20 bp, Homo sapiens
gtgctctgaatgggagccag

SEQ ID NO: 5503361 - DNA, 13 bp, Homo sapiens
gtgctctgaccct

SEQ ID NO: 5503362 - DNA, 16 bp, Homo sapiens
gtgctctgaggtcaat

SEQ ID NO: 5503363 - DNA, 22 bp, Homo sapiens
gtgctctgaggtcaataaagca

SEQ ID NO: 5503364 - DNA, 20 bp, Homo sapiens
gtgctctggcaccatcagcc

SEQ ID NO: 5503365 - DNA, 13 bp, Homo sapiens
gtgctctggcggc

SEQ ID NO: 5503366 - DNA, 12 bp, Homo sapiens
gtgctctggtct

SEQ ID NO: 5503367 - DNA, 22 bp, Homo sapiens
gtgctctgtaacatcgcacagt

SEQ ID NO: 5503368 - DNA, 11 bp, Homo sapiens
gtgctctgtga

SEQ ID NO: 5503369 - DNA, 14 bp, Homo sapiens
gtgctctgtgtcaa

SEQ ID NO: 5503370 - DNA, 13 bp, Homo sapiens
gtgctctgtgttc

SEQ ID NO: 5503371 - DNA, 19 bp, Homo sapiens
gtgctcttatccccagctg

SEQ ID NO: 5503372 - DNA, 20 bp, Homo sapiens
gtgctcttatccccagctgt

SEQ ID NO: 5503373 - DNA, 18 bp, Homo sapiens
gtgctcttcccactccag

SEQ ID NO: 5503374 - DNA, 13 bp, Homo sapiens
gtgctcttcctct

SEQ ID NO: 5503375 - DNA, 23 bp, Homo sapiens
gtgctcttcctctggtttctgtg

SEQ ID NO: 5503376 - DNA, 18 bp, Homo sapiens
gtgctcttgaacctgtgc

SEQ ID NO: 5503377 - DNA, 21 bp, Homo sapiens
gtgctctttgttactgtccac

SEQ ID NO: 5503378 - DNA, 15 bp, Homo sapiens
gtgctctttgttttg

SEQ ID NO: 5503379 - DNA, 23 bp, Homo sapiens
gtgctctttgttttgtgtctctt

SEQ ID NO: 5503380 - DNA, 19 bp, Homo sapiens
gtgctctttttttaaaagg

SEQ ID NO: 5503381 - DNA, 22 bp, Homo sapiens
gtgctgaacaaaaaataaaaat

SEQ ID NO: 5503382 - DNA, 23 bp, Homo sapiens
gtgctgaacacacaccagtttac

SEQ ID NO: 5503383 - DNA, 13 bp, Homo sapiens
gtgctgaacattg

SEQ ID NO: 5503384 - DNA, 19 bp, Homo sapiens
gtgctgaagcaaagtgccc

SEQ ID NO: 5503385 - DNA, 19 bp, Homo sapiens
gtgctgaatgttgggactg

SEQ ID NO: 5503386 - DNA, 20 bp, Homo sapiens
gtgctgacaacttagctcag

SEQ ID NO: 5503387 - DNA, 17 bp, Homo sapiens
gtgctgaccccaggaag

SEQ ID NO: 5503388 - DNA, 14 bp, Homo sapiens
gtgctgaccctcct

SEQ ID NO: 5503389 - DNA, 23 bp, Homo sapiens
gtgctgactgaacattagttgca

SEQ ID NO: 5503390 - DNA, 17 bp, Homo sapiens
gtgctgactgaggcctg

SEQ ID NO: 5503391 - DNA, 19 bp, Homo sapiens
gtgctgactgaggcctgct

SEQ ID NO: 5503392 - DNA, 20 bp, Homo sapiens
gtgctgactgaggcctgctt

SEQ ID NO: 5503393 - DNA, 22 bp, Homo sapiens
gtgctgactgaggcctgcttcc

SEQ ID NO: 5503394 - DNA, 13 bp, Homo sapiens
gtgctgagaagct

SEQ ID NO: 5503395 - DNA, 14 bp, Homo sapiens
gtgctgagattaca

SEQ ID NO: 5503396 - DNA, 15 bp, Homo sapiens
gtgctgagcacacaa

SEQ ID NO: 5503397 - DNA, 14 bp, Homo sapiens
gtgctgaggccagg

SEQ ID NO: 5503398 - DNA, 16 bp, Homo sapiens
gtgctgaggtgggcct

SEQ ID NO: 5503399 - DNA, 14 bp, Homo sapiens
gtgctgagtagatg

SEQ ID NO: 5503400 - DNA, 20 bp, Homo sapiens
gtgctgagtagatgcgcagc

SEQ ID NO: 5503401 - DNA, 12 bp, Homo sapiens
gtgctgagtctg

SEQ ID NO: 5503402 - DNA, 17 bp, Homo sapiens
gtgctgagtctgaaggc

SEQ ID NO: 5503403 - DNA, 14 bp, Homo sapiens
gtgctgagtgctat

SEQ ID NO: 5503404 - DNA, 16 bp, Homo sapiens
gtgctgataagaatga

SEQ ID NO: 5503405 - DNA, 15 bp, Homo sapiens
gtgctgataattgtg

SEQ ID NO: 5503406 - DNA, 23 bp, Homo sapiens
gtgctgatagggtaaggggaggc

SEQ ID NO: 5503407 - DNA, 20 bp, Homo sapiens
gtgctgatgggaaggagggg

SEQ ID NO: 5503408 - DNA, 20 bp, Homo sapiens
gtgctgcacccctggtgtcc

SEQ ID NO: 5503409 - DNA, 14 bp, Homo sapiens
gtgctgcagcaccg

SEQ ID NO: 5503410 - DNA, 19 bp, Homo sapiens
gtgctgcagctccctggct

SEQ ID NO: 5503411 - DNA, 11 bp, Homo sapiens
gtgctgcagga

SEQ ID NO: 5503412 - DNA, 13 bp, Homo sapiens
gtgctgcagtatg

SEQ ID NO: 5503413 - DNA, 21 bp, Homo sapiens
gtgctgcatccctgtgtccac

SEQ ID NO: 5503414 - DNA, 20 bp, Homo sapiens
gtgctgcatgcgacagcgtc

SEQ ID NO: 5503415 - DNA, 18 bp, Homo sapiens
gtgctgcattgagtccag

SEQ ID NO: 5503416 - DNA, 13 bp, Homo sapiens
gtgctgccacccc

SEQ ID NO: 5503417 - DNA, 18 bp, Homo sapiens
gtgctgccaccccttggc

SEQ ID NO: 5503418 - DNA, 12 bp, Homo sapiens
gtgctgccatgc

SEQ ID NO: 5503419 - DNA, 13 bp, Homo sapiens
gtgctgccatgcc

SEQ ID NO: 5503420 - DNA, 20 bp, Homo sapiens
gtgctgcccagcagcccctg

SEQ ID NO: 5503421 - DNA, 13 bp, Homo sapiens
gtgctgccccttg

SEQ ID NO: 5503422 - DNA, 19 bp, Homo sapiens
gtgctgcccgtcttcagcc

SEQ ID NO: 5503423 - DNA, 14 bp, Homo sapiens
gtgctgccctgccc

SEQ ID NO: 5503424 - DNA, 18 bp, Homo sapiens
gtgctgccctgcccacct

SEQ ID NO: 5503425 - DNA, 20 bp, Homo sapiens
gtgctgccctgcccacctgg

SEQ ID NO: 5503426 - DNA, 17 bp, Homo sapiens
gtgctgccctgctctgg

SEQ ID NO: 5503427 - DNA, 20 bp, Homo sapiens
gtgctgccctgctctgggga

SEQ ID NO: 5503428 - DNA, 12 bp, Homo sapiens
gtgctgccctgt

SEQ ID NO: 5503429 - DNA, 18 bp, Homo sapiens
gtgctgccgcgcagtgtg

SEQ ID NO: 5503430 - DNA, 11 bp, Homo sapiens
gtgctgcctct

SEQ ID NO: 5503431 - DNA, 13 bp, Homo sapiens
gtgctgcctgtcc

SEQ ID NO: 5503432 - DNA, 22 bp, Homo sapiens
gtgctgcgagatcgctggcaga

SEQ ID NO: 5503433 - DNA, 17 bp, Homo sapiens
gtgctgctaccctccct

SEQ ID NO: 5503434 - DNA, 18 bp, Homo sapiens
gtgctgctaccctccctg

SEQ ID NO: 5503435 - DNA, 21 bp, Homo sapiens
gtgctgctaccctccctgctg

SEQ ID NO: 5503436 - DNA, 17 bp, Homo sapiens
gtgctgctgcaccaacc

SEQ ID NO: 5503437 - DNA, 18 bp, Homo sapiens
gtgctgctgttctgtgta

SEQ ID NO: 5503438 - DNA, 22 bp, Homo sapiens
gtgctgcttacactccaggtgt

SEQ ID NO: 5503439 - DNA, 18 bp, Homo sapiens
gtgctgcttgtgcctccc

SEQ ID NO: 5503440 - DNA, 19 bp, Homo sapiens
gtgctgctttggctgactg

SEQ ID NO: 5503441 - DNA, 18 bp, Homo sapiens
gtgctgcttttgagcctc

SEQ ID NO: 5503442 - DNA, 19 bp, Homo sapiens
gtgctgcttttgagcctca

SEQ ID NO: 5503443 - DNA, 21 bp, Homo sapiens
gtgctgcttttgagcctcaga

SEQ ID NO: 5503444 - DNA, 20 bp, Homo sapiens
gtgctggaactttagtgaaa

SEQ ID NO: 5503445 - DNA, 20 bp, Homo sapiens
gtgctggaatggggacctgg

SEQ ID NO: 5503446 - DNA, 22 bp, Homo sapiens
gtgctggactgttccaggccct

SEQ ID NO: 5503447 - DNA, 13 bp, Homo sapiens
gtgctggagaaat

SEQ ID NO: 5503448 - DNA, 16 bp, Homo sapiens
gtgctggagcactggg

SEQ ID NO: 5503449 - DNA, 17 bp, Homo sapiens
gtgctggagcactgggc

SEQ ID NO: 5503450 - DNA, 19 bp, Homo sapiens
gtgctggagccactaacta

SEQ ID NO: 5503451 - DNA, 15 bp, Homo sapiens
gtgctggagccctgt

SEQ ID NO: 5503452 - DNA, 13 bp, Homo sapiens
gtgctggagctgg

SEQ ID NO: 5503453 - DNA, 14 bp, Homo sapiens
gtgctggaggaact

SEQ ID NO: 5503454 - DNA, 16 bp, Homo sapiens
gtgctggaggactgag

SEQ ID NO: 5503455 - DNA, 13 bp, Homo sapiens
gtgctggaggcag

SEQ ID NO: 5503456 - DNA, 22 bp, Homo sapiens
gtgctggaggggtggcccagag

SEQ ID NO: 5503457 - DNA, 16 bp, Homo sapiens
gtgctggaggtgggag

SEQ ID NO: 5503458 - DNA, 17 bp, Homo sapiens
gtgctggagtctcctga

SEQ ID NO: 5503459 - DNA, 23 bp, Homo sapiens
gtgctggagtctcctgaggacac

SEQ ID NO: 5503460 - DNA, 19 bp, Homo sapiens
gtgctggagttttgttggt

SEQ ID NO: 5503461 - DNA, 22 bp, Homo sapiens
gtgctggcacttagtaggtcct

SEQ ID NO: 5503462 - DNA, 23 bp, Homo sapiens
gtgctggcacttagtaggtcctc

SEQ ID NO: 5503463 - DNA, 15 bp, Homo sapiens
gtgctggcccaccca

SEQ ID NO: 5503464 - DNA, 18 bp, Homo sapiens
gtgctggcccagcatgga

SEQ ID NO: 5503465 - DNA, 12 bp, Homo sapiens
gtgctggccccc

SEQ ID NO: 5503466 - DNA, 23 bp, Homo sapiens
gtgctggcgacactcagggcagc

SEQ ID NO: 5503467 - DNA, 18 bp, Homo sapiens
gtgctggcggacgcagct

SEQ ID NO: 5503468 - DNA, 19 bp, Homo sapiens
gtgctggctcacagtacag

SEQ ID NO: 5503469 - DNA, 20 bp, Homo sapiens
gtgctggctccacgccctgg

SEQ ID NO: 5503470 - DNA, 13 bp, Homo sapiens
gtgctggctgctg

SEQ ID NO: 5503471 - DNA, 21 bp, Homo sapiens
gtgctgggaaatgcagaaatc

SEQ ID NO: 5503472 - DNA, 15 bp, Homo sapiens
gtgctgggaagcccg

SEQ ID NO: 5503473 - DNA, 16 bp, Homo sapiens
gtgctgggaagcccgg

SEQ ID NO: 5503474 - DNA, 11 bp, Homo sapiens
gtgctgggacc

SEQ ID NO: 5503475 - DNA, 13 bp, Homo sapiens
gtgctgggaccag

SEQ ID NO: 5503476 - DNA, 15 bp, Homo sapiens
gtgctgggaccagag

SEQ ID NO: 5503477 - DNA, 13 bp, Homo sapiens
gtgctgggactga

SEQ ID NO: 5503478 - DNA, 20 bp, Homo sapiens
gtgctgggactgagccagtc

SEQ ID NO: 5503479 - DNA, 22 bp, Homo sapiens
gtgctgggactgagccagtccc

SEQ ID NO: 5503480 - DNA, 18 bp, Homo sapiens
gtgctgggagaggcagcc

SEQ ID NO: 5503481 - DNA, 20 bp, Homo sapiens
gtgctgggagatgctctctg

SEQ ID NO: 5503482 - DNA, 23 bp, Homo sapiens
gtgctgggaggtataggggtcct

SEQ ID NO: 5503483 - DNA, 20 bp, Homo sapiens
gtgctgggataactggccag

SEQ ID NO: 5503484 - DNA, 20 bp, Homo sapiens
gtgctgggattacaggcgtg

SEQ ID NO: 5503485 - DNA, 22 bp, Homo sapiens
gtgctgggattacaggtgtgag

SEQ ID NO: 5503486 - DNA, 19 bp, Homo sapiens
gtgctgggccagtggctgg

SEQ ID NO: 5503487 - DNA, 19 bp, Homo sapiens
gtgctgggcccctgcctct

SEQ ID NO: 5503488 - DNA, 12 bp, Homo sapiens
gtggagatgccc

SEQ ID NO: 5503489 - DNA, 18 bp, Homo sapiens
gtggagatggactcagga

SEQ ID NO: 5503490 - DNA, 15 bp, Homo sapiens
gtggagattggatca

SEQ ID NO: 5503491 - DNA, 18 bp, Homo sapiens
gtggagcaaaaggcagct

SEQ ID NO: 5503492 - DNA, 19 bp, Homo sapiens
gtggagcaaaaggcagctc

SEQ ID NO: 5503493 - DNA, 20 bp, Homo sapiens
gtggagcaaaaggcagctca

SEQ ID NO: 5503494 - DNA, 21 bp, Homo sapiens
gtggagcacaaaagcctctca

SEQ ID NO: 5503495 - DNA, 16 bp, Homo sapiens
gtggagcactggactc

SEQ ID NO: 5503496 - DNA, 14 bp, Homo sapiens
gtggagcagcagcc

SEQ ID NO: 5503497 - DNA, 19 bp, Homo sapiens
gtggagcagcagccactgc

SEQ ID NO: 5503498 - DNA, 12 bp, Homo sapiens
gtggagcagcca

SEQ ID NO: 5503499 - DNA, 23 bp, Homo sapiens
gtggagcagccaacaagcagggg

SEQ ID NO: 5503500 - DNA, 13 bp, Homo sapiens
gtggagcagccag

SEQ ID NO: 5503501 - DNA, 16 bp, Homo sapiens
gtggagcagccagagc

SEQ ID NO: 5503502 - DNA, 18 bp, Homo sapiens
gtggagccacaggcagac

SEQ ID NO: 5503503 - DNA, 11 bp, Homo sapiens
gtggagccagg

SEQ ID NO: 5503504 - DNA, 22 bp, Homo sapiens
gtggagccaggttgtcgggccc

SEQ ID NO: 5503505 - DNA, 14 bp, Homo sapiens
gtggagcccaggag

SEQ ID NO: 5503506 - DNA, 15 bp, Homo sapiens
gtggagcccaggagt

SEQ ID NO: 5503507 - DNA, 14 bp, Homo sapiens
gtggagcccagggt

SEQ ID NO: 5503508 - DNA, 23 bp, Homo sapiens
gtggagcccgcacccccaccctt

SEQ ID NO: 5503509 - DNA, 22 bp, Homo sapiens
gtggagcctccaattgcagtgg

SEQ ID NO: 5503510 - DNA, 19 bp, Homo sapiens
gtggagcctgacagccaga

SEQ ID NO: 5503511 - DNA, 21 bp, Homo sapiens
gtggagcctgacagccagaac

SEQ ID NO: 5503512 - DNA, 15 bp, Homo sapiens
gtggagcctgccgcc

SEQ ID NO: 5503513 - DNA, 21 bp, Homo sapiens
gtggagcctgccgcccccgcc

SEQ ID NO: 5503514 - DNA, 23 bp, Homo sapiens
gtggagcctgccgcccccgcctg

SEQ ID NO: 5503515 - DNA, 14 bp, Homo sapiens
gtggagcctgggtg

SEQ ID NO: 5503516 - DNA, 21 bp, Homo sapiens
gtggagccttttaactgtgca

SEQ ID NO: 5503517 - DNA, 19 bp, Homo sapiens
gtggagcggggtatgaaga

SEQ ID NO: 5503518 - DNA, 16 bp, Homo sapiens
gtggagcgttcaccag

SEQ ID NO: 5503519 - DNA, 15 bp, Homo sapiens
gtggagctcagagga

SEQ ID NO: 5503520 - DNA, 20 bp, Homo sapiens
gtggagctcgcccctcccct

SEQ ID NO: 5503521 - DNA, 15 bp, Homo sapiens
gtggagctggtctgc

SEQ ID NO: 5503522 - DNA, 23 bp, Homo sapiens
gtggagcttaagccactgcctct

SEQ ID NO: 5503523 - DNA, 17 bp, Homo sapiens
gtggagcttgcaatgag

SEQ ID NO: 5503524 - DNA, 23 bp, Homo sapiens
gtggagcttgcaatgagccaaga

SEQ ID NO: 5503525 - DNA, 20 bp, Homo sapiens
gtggagcttggagccccctg

SEQ ID NO: 5503526 - DNA, 16 bp, Homo sapiens
gtggaggaagagccac

SEQ ID NO: 5503527 - DNA, 20 bp, Homo sapiens
gtggaggaagagccacctgc

SEQ ID NO: 5503528 - DNA, 13 bp, Homo sapiens
gtggaggaaggat

SEQ ID NO: 5503529 - DNA, 16 bp, Homo sapiens
gtggaggaaggattgt

SEQ ID NO: 5503530 - DNA, 16 bp, Homo sapiens
gtggaggaagggctgg

SEQ ID NO: 5503531 - DNA, 20 bp, Homo sapiens
gtggaggaagggctgggcca

SEQ ID NO: 5503532 - DNA, 19 bp, Homo sapiens
gtggaggaaggtgctgagc

SEQ ID NO: 5503533 - DNA, 20 bp, Homo sapiens
gtggaggaaggtgctgagct

SEQ ID NO: 5503534 - DNA, 16 bp, Homo sapiens
gtggaggagagcctgg

SEQ ID NO: 5503535 - DNA, 14 bp, Homo sapiens
gtggaggagaggag

SEQ ID NO: 5503536 - DNA, 17 bp, Homo sapiens
gtggaggagcagtgcag

SEQ ID NO: 5503537 - DNA, 16 bp, Homo sapiens
gtggaggagctgaggg

SEQ ID NO: 5503538 - DNA, 11 bp, Homo sapiens
gtggaggagga

SEQ ID NO: 5503539 - DNA, 15 bp, Homo sapiens
gtggaggaggacact

SEQ ID NO: 5503540 - DNA, 14 bp, Homo sapiens
gtggaggaggcctg

SEQ ID NO: 5503541 - DNA, 14 bp, Homo sapiens
gtggaggaggttgg

SEQ ID NO: 5503542 - DNA, 16 bp, Homo sapiens
gtggaggaggttggga

SEQ ID NO: 5503543 - DNA, 12 bp, Homo sapiens
gtggaggatgga

SEQ ID NO: 5503544 - DNA, 11 bp, Homo sapiens
gtggaggcctg

SEQ ID NO: 5503545 - DNA, 16 bp, Homo sapiens
gtggaggcctgatgct

SEQ ID NO: 5503546 - DNA, 21 bp, Homo sapiens
gtggaggcgagccagattagg

SEQ ID NO: 5503547 - DNA, 17 bp, Homo sapiens
gtggaggctaagcctgg

SEQ ID NO: 5503548 - DNA, 18 bp, Homo sapiens
gtggaggctaagcctgga

SEQ ID NO: 5503549 - DNA, 16 bp, Homo sapiens
gtggaggctcctgtgg

SEQ ID NO: 5503550 - DNA, 16 bp, Homo sapiens
gtggaggctgcagtga

SEQ ID NO: 5503551 - DNA, 15 bp, Homo sapiens
gtggaggctgcccca

SEQ ID NO: 5503552 - DNA, 14 bp, Homo sapiens
gtggaggctgctgt

SEQ ID NO: 5503553 - DNA, 15 bp, Homo sapiens
gtggaggcttcctgc

SEQ ID NO: 5503554 - DNA, 14 bp, Homo sapiens
gtggagggaaggat

SEQ ID NO: 5503555 - DNA, 12 bp, Homo sapiens
gtggagggaggc

SEQ ID NO: 5503556 - DNA, 14 bp, Homo sapiens
gtggagggcacagc

SEQ ID NO: 5503557 - DNA, 16 bp, Homo sapiens
gtggagggcacagccc

SEQ ID NO: 5503558 - DNA, 17 bp, Homo sapiens
gtggagggcacagccct

SEQ ID NO: 5503559 - DNA, 18 bp, Homo sapiens
gtggaggggagctgctgg

SEQ ID NO: 5503560 - DNA, 20 bp, Homo sapiens
gtggaggggagctgctggcc

SEQ ID NO: 5503561 - DNA, 20 bp, Homo sapiens
gtggaggggcatagcctttc

SEQ ID NO: 5503562 - DNA, 19 bp, Homo sapiens
gtggaggggcgcccagggt

SEQ ID NO: 5503563 - DNA, 12 bp, Homo sapiens
gtggaggggctt

SEQ ID NO: 5503564 - DNA, 15 bp, Homo sapiens
gtggagggggcaagc

SEQ ID NO: 5503565 - DNA, 16 bp, Homo sapiens
gtggagggggcaagct

SEQ ID NO: 5503566 - DNA, 18 bp, Homo sapiens
gtggagggggctgggctc

SEQ ID NO: 5503567 - DNA, 19 bp, Homo sapiens
gtggagggtcgccacaccc

SEQ ID NO: 5503568 - DNA, 18 bp, Homo sapiens
gtggagggtggcgccctg

SEQ ID NO: 5503569 - DNA, 17 bp, Homo sapiens
gtggagggttgccatgg

SEQ ID NO: 5503570 - DNA, 21 bp, Homo sapiens
gtggaggtgaagtccctgttc

SEQ ID NO: 5503571 - DNA, 14 bp, Homo sapiens
gtggaggtgccagg

SEQ ID NO: 5503572 - DNA, 13 bp, Homo sapiens
gtggaggtgggct

SEQ ID NO: 5503573 - DNA, 18 bp, Homo sapiens
gtggaggtgtcaggctgc

SEQ ID NO: 5503574 - DNA, 22 bp, Homo sapiens
gtggaggtgtcaggctgctggc

SEQ ID NO: 5503575 - DNA, 21 bp, Homo sapiens
gtggaggttaaggctgaggaa

SEQ ID NO: 5503576 - DNA, 18 bp, Homo sapiens
gtggaggttgagtgagcc

SEQ ID NO: 5503577 - DNA, 17 bp, Homo sapiens
gtggaggttgcagtgag

SEQ ID NO: 5503578 - DNA, 19 bp, Homo sapiens
gtggaggttgcagtgagct

SEQ ID NO: 5503579 - DNA, 18 bp, Homo sapiens
gtggagtatttttataat

SEQ ID NO: 5503580 - DNA, 22 bp, Homo sapiens
gtggagtcagcctcgcaggcct

SEQ ID NO: 5503581 - DNA, 16 bp, Homo sapiens
gtggagtcaggaaaga

SEQ ID NO: 5503582 - DNA, 21 bp, Homo sapiens
gtggagtcaggaaagacaggc

SEQ ID NO: 5503583 - DNA, 22 bp, Homo sapiens
gtggagtcaggcttctcttgct

SEQ ID NO: 5503584 - DNA, 14 bp, Homo sapiens
gtggagtcatttct

SEQ ID NO: 5503585 - DNA, 22 bp, Homo sapiens
gtggagtccagatggcaggcta

SEQ ID NO: 5503586 - DNA, 13 bp, Homo sapiens
gtggagtccagct

SEQ ID NO: 5503587 - DNA, 15 bp, Homo sapiens
gtggagtcccagagc

SEQ ID NO: 5503588 - DNA, 14 bp, Homo sapiens
gtggagtcgagctg

SEQ ID NO: 5503589 - DNA, 16 bp, Homo sapiens
gtggagtcgagctggc

SEQ ID NO: 5503590 - DNA, 21 bp, Homo sapiens
gtggagtctcattctgttgcc

SEQ ID NO: 5503591 - DNA, 18 bp, Homo sapiens
gtggagtgagagcctttg

SEQ ID NO: 5503592 - DNA, 19 bp, Homo sapiens
gtggagtgcagtggtgcga

SEQ ID NO: 5503593 - DNA, 23 bp, Homo sapiens
gtggagttattcactctcccaga

SEQ ID NO: 5503594 - DNA, 19 bp, Homo sapiens
gtggagttcaccttggaag

SEQ ID NO: 5503595 - DNA, 20 bp, Homo sapiens
gtggagttcaccttggaagg

SEQ ID NO: 5503596 - DNA, 17 bp, Homo sapiens
gtggagttcatcttgaa

SEQ ID NO: 5503597 - DNA, 14 bp, Homo sapiens
gtggagtttctctg

SEQ ID NO: 5503598 - DNA, 15 bp, Homo sapiens
gtggagtttctctgt

SEQ ID NO: 5503599 - DNA, 22 bp, Homo sapiens
gtggagtttgacaccttagaga

SEQ ID NO: 5503600 - DNA, 12 bp, Homo sapiens
gtggataatcag

SEQ ID NO: 5503601 - DNA, 15 bp, Homo sapiens
gtggataatcaggaa

SEQ ID NO: 5503602 - DNA, 21 bp, Homo sapiens
gtggataatcaggaaaaatga

SEQ ID NO: 5503603 - DNA, 17 bp, Homo sapiens
gtggatacctggttgag

SEQ ID NO: 5503604 - DNA, 14 bp, Homo sapiens
gtggatagagcagc

SEQ ID NO: 5503605 - DNA, 19 bp, Homo sapiens
gtggatagagcagcctgct

SEQ ID NO: 5503606 - DNA, 14 bp, Homo sapiens
gtggatattgttac

SEQ ID NO: 5503607 - DNA, 23 bp, Homo sapiens
gtggatcacaaagtggaacgaaa

SEQ ID NO: 5503608 - DNA, 23 bp, Homo sapiens
gtggatcacacctcagtgggaag

SEQ ID NO: 5503609 - DNA, 17 bp, Homo sapiens
gtggatccactgtgcag

SEQ ID NO: 5503610 - DNA, 20 bp, Homo sapiens
gtggatcctggtttcgtgtg

SEQ ID NO: 5503611 - DNA, 23 bp, Homo sapiens
gtggatcgagtgtagctgtgaaa

SEQ ID NO: 5503612 - DNA, 18 bp, Homo sapiens
gtggatctcagtttttaa

SEQ ID NO: 5503613 - DNA, 21 bp, Homo sapiens
gtggatctccttcccttctct

SEQ ID NO: 5503614 - DNA, 17 bp, Homo sapiens
gtggatctgtccaagga

SEQ ID NO: 5503615 - DNA, 17 bp, Homo sapiens
gtggatgacagggcaga

SEQ ID NO: 5503616 - DNA, 13 bp, Homo sapiens
gtggatgactgtt

SEQ ID NO: 5503617 - DNA, 16 bp, Homo sapiens
gtggatgaggagacag

SEQ ID NO: 5503618 - DNA, 12 bp, Homo sapiens
gtggatgatcaa

SEQ ID NO: 5503619 - DNA, 18 bp, Homo sapiens
gtggatgccgatttctgt

SEQ ID NO: 5503620 - DNA, 20 bp, Homo sapiens
gtggatgcctggtggcagct

SEQ ID NO: 5503621 - DNA, 17 bp, Homo sapiens
gtggatgctagtgctgt

SEQ ID NO: 5503622 - DNA, 17 bp, Homo sapiens
gtggatgctctcaggct

SEQ ID NO: 5503623 - DNA, 12 bp, Homo sapiens
gtggatgctctt

SEQ ID NO: 5503624 - DNA, 17 bp, Homo sapiens
gtggatgctgagctgtg

SEQ ID NO: 5503625 - DNA, 13 bp, Homo sapiens
gtggatgctgtgc

SEQ ID NO: 5503626 - DNA, 20 bp, Homo sapiens
gtggatggacagatggacca

SEQ ID NO: 5503627 - DNA, 16 bp, Homo sapiens
gtggatggaggagaaa

SEQ ID NO: 5503628 - DNA, 19 bp, Homo sapiens
gtggatggaggagaaataa

SEQ ID NO: 5503629 - DNA, 20 bp, Homo sapiens
gtggatggaggagaaataaa

SEQ ID NO: 5503630 - DNA, 18 bp, Homo sapiens
gtggatggatggacagaa

SEQ ID NO: 5503631 - DNA, 15 bp, Homo sapiens
gtggatggcagtgtg

SEQ ID NO: 5503632 - DNA, 15 bp, Homo sapiens
gtggatggcccagca

SEQ ID NO: 5503633 - DNA, 22 bp, Homo sapiens
gtggatggcccagcaggcaggc

SEQ ID NO: 5503634 - DNA, 13 bp, Homo sapiens
gtggatggcccca

SEQ ID NO: 5503635 - DNA, 19 bp, Homo sapiens
gtggatggccccagcacag

SEQ ID NO: 5503636 - DNA, 22 bp, Homo sapiens
gtggatggccccagcacagctt

SEQ ID NO: 5503637 - DNA, 15 bp, Homo sapiens
gtggatgggaggctc

SEQ ID NO: 5503638 - DNA, 17 bp, Homo sapiens
gtggatgggaggctcct

SEQ ID NO: 5503639 - DNA, 23 bp, Homo sapiens
gtggatgggttttatgagatgga

SEQ ID NO: 5503640 - DNA, 17 bp, Homo sapiens
gtggatggtgacttttg

SEQ ID NO: 5503641 - DNA, 22 bp, Homo sapiens
gtggatgtaattagctctgggg

SEQ ID NO: 5503642 - DNA, 19 bp, Homo sapiens
gtggatgtcttccttggag

SEQ ID NO: 5503643 - DNA, 14 bp, Homo sapiens
gtggatgtgagcag

SEQ ID NO: 5503644 - DNA, 14 bp, Homo sapiens
gtggatgtgctgga

SEQ ID NO: 5503645 - DNA, 11 bp, Homo sapiens
gtggatgtgga

SEQ ID NO: 5503646 - DNA, 16 bp, Homo sapiens
gtggatgttatgaaca

SEQ ID NO: 5503647 - DNA, 15 bp, Homo sapiens
gtggattaaaggcaa

SEQ ID NO: 5503648 - DNA, 21 bp, Homo sapiens
gtggattacgatgtaaatttt

SEQ ID NO: 5503649 - DNA, 20 bp, Homo sapiens
gtggattagctagaatgcac

SEQ ID NO: 5503650 - DNA, 23 bp, Homo sapiens
gtggattataaaaaatgtaacat

SEQ ID NO: 5503651 - DNA, 18 bp, Homo sapiens
gtggattcctccccaccc

SEQ ID NO: 5503652 - DNA, 22 bp, Homo sapiens
gtggattgcccgcgctcaggag

SEQ ID NO: 5503653 - DNA, 14 bp, Homo sapiens
gtggattgctcatc

SEQ ID NO: 5503654 - DNA, 18 bp, Homo sapiens
gtggattgtatttaagac

SEQ ID NO: 5503655 - DNA, 22 bp, Homo sapiens
gtggattgtttaaagaagctct

SEQ ID NO: 5503656 - DNA, 18 bp, Homo sapiens
gtggatttaacagaaatg

SEQ ID NO: 5503657 - DNA, 19 bp, Homo sapiens
gtggatttcctattttaaa

SEQ ID NO: 5503658 - DNA, 12 bp, Homo sapiens
gtggatttgata

SEQ ID NO: 5503659 - DNA, 14 bp, Homo sapiens
gtggatttttatca

SEQ ID NO: 5503660 - DNA, 16 bp, Homo sapiens
gtggcaaaaaagaaca

SEQ ID NO: 5503661 - DNA, 22 bp, Homo sapiens
gtggcaaaaaagaacagtgttg

SEQ ID NO: 5503662 - DNA, 21 bp, Homo sapiens
gtggcaaaaagagtcagacat

SEQ ID NO: 5503663 - DNA, 20 bp, Homo sapiens
gtggcaaaatattatgttat

SEQ ID NO: 5503664 - DNA, 14 bp, Homo sapiens
gtggcaaagtgctg

SEQ ID NO: 5503665 - DNA, 13 bp, Homo sapiens
gtggcaaatataa

SEQ ID NO: 5503666 - DNA, 16 bp, Homo sapiens
gtggccatcatcctcc

SEQ ID NO: 5503667 - DNA, 16 bp, Homo sapiens
gtggccatccctgggc

SEQ ID NO: 5503668 - DNA, 18 bp, Homo sapiens
gtggccatccctgggccc

SEQ ID NO: 5503669 - DNA, 20 bp, Homo sapiens
gtggccatccctgggcccct

SEQ ID NO: 5503670 - DNA, 15 bp, Homo sapiens
gtggccatccctgtg

SEQ ID NO: 5503671 - DNA, 16 bp, Homo sapiens
gtggccatctggaaat

SEQ ID NO: 5503672 - DNA, 20 bp, Homo sapiens
gtggccatgaccctgcctct

SEQ ID NO: 5503673 - DNA, 18 bp, Homo sapiens
gtggccatgtcgcctgcc

SEQ ID NO: 5503674 - DNA, 22 bp, Homo sapiens
gtggccatgtcgcctgccccca

SEQ ID NO: 5503675 - DNA, 22 bp, Homo sapiens
gtggcccaagcctggtctcctc

SEQ ID NO: 5503676 - DNA, 19 bp, Homo sapiens
gtggcccaaggctggcagg

SEQ ID NO: 5503677 - DNA, 22 bp, Homo sapiens
gtggcccaccagagcctccctc

SEQ ID NO: 5503678 - DNA, 22 bp, Homo sapiens
gtggcccacgggccggccagct

SEQ ID NO: 5503679 - DNA, 14 bp, Homo sapiens
gtggcccagagcca

SEQ ID NO: 5503680 - DNA, 17 bp, Homo sapiens
gtggcccaggcccccgg

SEQ ID NO: 5503681 - DNA, 21 bp, Homo sapiens
gtggcccaggtggctattttg

SEQ ID NO: 5503682 - DNA, 17 bp, Homo sapiens
gtggcccatcccccctc

SEQ ID NO: 5503683 - DNA, 15 bp, Homo sapiens
gtggccccaagaggg

SEQ ID NO: 5503684 - DNA, 11 bp, Homo sapiens
gtggccccacc

SEQ ID NO: 5503685 - DNA, 12 bp, Homo sapiens
gtggccccaccc

SEQ ID NO: 5503686 - DNA, 20 bp, Homo sapiens
gtggccccaccctgggccct

SEQ ID NO: 5503687 - DNA, 22 bp, Homo sapiens
gtggccccaccgagctggagcg

SEQ ID NO: 5503688 - DNA, 13 bp, Homo sapiens
gtggccccacctg

SEQ ID NO: 5503689 - DNA, 13 bp, Homo sapiens
gtggccccagcct

SEQ ID NO: 5503690 - DNA, 15 bp, Homo sapiens
gtggccccagcctgg

SEQ ID NO: 5503691 - DNA, 17 bp, Homo sapiens
gtggccccagcctggcc

SEQ ID NO: 5503692 - DNA, 21 bp, Homo sapiens
gtggccccatccagcatgtgt

SEQ ID NO: 5503693 - DNA, 17 bp, Homo sapiens
gtggcccccgggcctgc

SEQ ID NO: 5503694 - DNA, 18 bp, Homo sapiens
gtggcccccgggcctgca

SEQ ID NO: 5503695 - DNA, 18 bp, Homo sapiens
gtggccccctgtgccagc

SEQ ID NO: 5503696 - DNA, 13 bp, Homo sapiens
gtggccccgaggc

SEQ ID NO: 5503697 - DNA, 18 bp, Homo sapiens
gtggccccgcccgagccc

SEQ ID NO: 5503698 - DNA, 20 bp, Homo sapiens
gtggccccgcccgagcccct

SEQ ID NO: 5503699 - DNA, 16 bp, Homo sapiens
gtggccccgtttctgg

SEQ ID NO: 5503700 - DNA, 18 bp, Homo sapiens
gtggcccctcacctgggc

SEQ ID NO: 5503701 - DNA, 21 bp, Homo sapiens
gtggcccctcacctgggcctt

SEQ ID NO: 5503702 - DNA, 18 bp, Homo sapiens
gtggcccctccttctccc

SEQ ID NO: 5503703 - DNA, 22 bp, Homo sapiens
gtggcccctccttctcccctcc

SEQ ID NO: 5503704 - DNA, 20 bp, Homo sapiens
gtggcccctgctgtctctct

SEQ ID NO: 5503705 - DNA, 23 bp, Homo sapiens
gtggcccctgctgtctctctggg

SEQ ID NO: 5503706 - DNA, 16 bp, Homo sapiens
gtggccccttttactt

SEQ ID NO: 5503707 - DNA, 22 bp, Homo sapiens
gtggcccggttgaactcactcc

SEQ ID NO: 5503708 - DNA, 16 bp, Homo sapiens
gtggcccgtggcctgg

SEQ ID NO: 5503709 - DNA, 15 bp, Homo sapiens
gtggccctctcccct

SEQ ID NO: 5503710 - DNA, 17 bp, Homo sapiens
gtggccctctcccctgc

SEQ ID NO: 5503711 - DNA, 19 bp, Homo sapiens
gtggccctctcccctgccc

SEQ ID NO: 5503712 - DNA, 14 bp, Homo sapiens
gtggccctgaacct

SEQ ID NO: 5503713 - DNA, 17 bp, Homo sapiens
gtggccctgccatcttc

SEQ ID NO: 5503714 - DNA, 21 bp, Homo sapiens
gtggccctgccatcttcccag

SEQ ID NO: 5503715 - DNA, 13 bp, Homo sapiens
gtggccctggcct

SEQ ID NO: 5503716 - DNA, 18 bp, Homo sapiens
gtggccctggcctgctgg

SEQ ID NO: 5503717 - DNA, 19 bp, Homo sapiens
gtggccctggcctgctggg

SEQ ID NO: 5503718 - DNA, 13 bp, Homo sapiens
gtggccctgggga

SEQ ID NO: 5503719 - DNA, 19 bp, Homo sapiens
gtggccctgtcctgccatg

SEQ ID NO: 5503720 - DNA, 20 bp, Homo sapiens
gtggcccttatgactgccaa

SEQ ID NO: 5503721 - DNA, 16 bp, Homo sapiens
gtggcccttcccggca

SEQ ID NO: 5503722 - DNA, 21 bp, Homo sapiens
gtggcccttcctggacagctg

SEQ ID NO: 5503723 - DNA, 22 bp, Homo sapiens
gtggccgcaagcgcagggagga

SEQ ID NO: 5503724 - DNA, 16 bp, Homo sapiens
gtggccgcacgcctct

SEQ ID NO: 5503725 - DNA, 22 bp, Homo sapiens
gtggccgcccacccgcccgagg

SEQ ID NO: 5503726 - DNA, 15 bp, Homo sapiens
gtggccgcctggcag

SEQ ID NO: 5503727 - DNA, 17 bp, Homo sapiens
gtggccgcctggcaggt

SEQ ID NO: 5503728 - DNA, 17 bp, Homo sapiens
gtggccgctcctccctg

SEQ ID NO: 5503729 - DNA, 15 bp, Homo sapiens
gtggccgctgcccac

SEQ ID NO: 5503730 - DNA, 17 bp, Homo sapiens
gtggccggccctgcccc

SEQ ID NO: 5503731 - DNA, 14 bp, Homo sapiens
gtggccggcctcct

SEQ ID NO: 5503732 - DNA, 19 bp, Homo sapiens
gtggccggggctgaagcca

SEQ ID NO: 5503733 - DNA, 20 bp, Homo sapiens
gtggccggggtccaggcatg

SEQ ID NO: 5503734 - DNA, 17 bp, Homo sapiens
gtggccggtgccagctg

SEQ ID NO: 5503735 - DNA, 18 bp, Homo sapiens
gtggccggtgccagctgc

SEQ ID NO: 5503736 - DNA, 20 bp, Homo sapiens
gtggccgtcctgagggggaa

SEQ ID NO: 5503737 - DNA, 22 bp, Homo sapiens
gtggccgtcctgagggggaagt

SEQ ID NO: 5503738 - DNA, 18 bp, Homo sapiens
gtggcctaaggctgctgt

SEQ ID NO: 5503739 - DNA, 18 bp, Homo sapiens
gtggcctagagcactctc

SEQ ID NO: 5503740 - DNA, 20 bp, Homo sapiens
gtggcctatgaaactggttt

SEQ ID NO: 5503741 - DNA, 13 bp, Homo sapiens
gtggcctcacttc

SEQ ID NO: 5503742 - DNA, 16 bp, Homo sapiens
gtggcctcacttccct

SEQ ID NO: 5503743 - DNA, 22 bp, Homo sapiens
gtggcctcacttccctgggaac

SEQ ID NO: 5503744 - DNA, 12 bp, Homo sapiens
gtggcctcagaa

SEQ ID NO: 5503745 - DNA, 15 bp, Homo sapiens
gtggcctcagccctc

SEQ ID NO: 5503746 - DNA, 18 bp, Homo sapiens
gtggcctcagctgaatgc

SEQ ID NO: 5503747 - DNA, 13 bp, Homo sapiens
gtggcctccctgc

SEQ ID NO: 5503748 - DNA, 13 bp, Homo sapiens
gtggcctcctggc

SEQ ID NO: 5503749 - DNA, 22 bp, Homo sapiens
gtggcctcgggacacctgccct

SEQ ID NO: 5503750 - DNA, 19 bp, Homo sapiens
gtggcctcgtgctccgcag

SEQ ID NO: 5503751 - DNA, 23 bp, Homo sapiens
gtggcctcgtgctccgcagggcg

SEQ ID NO: 5503752 - DNA, 23 bp, Homo sapiens
gtggcctctccttgtggcctggg

SEQ ID NO: 5503753 - DNA, 14 bp, Homo sapiens
gtggcctctgcctg

SEQ ID NO: 5503754 - DNA, 20 bp, Homo sapiens
gtggcctcttgagcagtggc

SEQ ID NO: 5503755 - DNA, 23 bp, Homo sapiens
gtggcctcttggctatttctgtg

SEQ ID NO: 5503756 - DNA, 18 bp, Homo sapiens
gtggcctgactcccccag

SEQ ID NO: 5503757 - DNA, 20 bp, Homo sapiens
gtggcctgcataggctcctt

SEQ ID NO: 5503758 - DNA, 22 bp, Homo sapiens
gtggcctgcataggctccttcc

SEQ ID NO: 5503759 - DNA, 20 bp, Homo sapiens
gtggcctgcgtcttttttct

SEQ ID NO: 5503760 - DNA, 22 bp, Homo sapiens
gtggcctgctaaggctcctcct

SEQ ID NO: 5503761 - DNA, 21 bp, Homo sapiens
gtggcctggatccatcctgct

SEQ ID NO: 5503762 - DNA, 20 bp, Homo sapiens
gtggcctggcatctgtgtgc

SEQ ID NO: 5503763 - DNA, 12 bp, Homo sapiens
gtggcctggcca

SEQ ID NO: 5503764 - DNA, 20 bp, Homo sapiens
gtggcctggccaggagctct

SEQ ID NO: 5503765 - DNA, 21 bp, Homo sapiens
gtggcctggccgttcagcctg

SEQ ID NO: 5503766 - DNA, 22 bp, Homo sapiens
gtggcctggccgttcagcctgt

SEQ ID NO: 5503767 - DNA, 11 bp, Homo sapiens
gtggcctggct

SEQ ID NO: 5503768 - DNA, 21 bp, Homo sapiens
gtggcctggcttctgggacag

SEQ ID NO: 5503769 - DNA, 20 bp, Homo sapiens
gtggcctggcttgtcggagc

SEQ ID NO: 5503770 - DNA, 12 bp, Homo sapiens
gtggcctgggcc

SEQ ID NO: 5503771 - DNA, 19 bp, Homo sapiens
gtggcctgggtcccagggc

SEQ ID NO: 5503772 - DNA, 19 bp, Homo sapiens
gtggcctggtgggtcaggg

SEQ ID NO: 5503773 - DNA, 22 bp, Homo sapiens
gtggcctgtagaatagcctgtg

SEQ ID NO: 5503774 - DNA, 13 bp, Homo sapiens
gtggcctgtggct

SEQ ID NO: 5503775 - DNA, 16 bp, Homo sapiens
gtggcctgtgtccagc

SEQ ID NO: 5503776 - DNA, 20 bp, Homo sapiens
gtggcctgtgtccagcagct

SEQ ID NO: 5503777 - DNA, 23 bp, Homo sapiens
gtggcctgtgtccagcagctgcg

SEQ ID NO: 5503778 - DNA, 17 bp, Homo sapiens
gtggcctgtgtcccatg

SEQ ID NO: 5503779 - DNA, 13 bp, Homo sapiens
gtggcctgtttct

SEQ ID NO: 5503780 - DNA, 23 bp, Homo sapiens
gtggccttaagtctttttgaagt

SEQ ID NO: 5503781 - DNA, 15 bp, Homo sapiens
gtggccttagaaaac

SEQ ID NO: 5503782 - DNA, 19 bp, Homo sapiens
gtggccttccccagcatgc

SEQ ID NO: 5503783 - DNA, 15 bp, Homo sapiens
gtggccttccccctt

SEQ ID NO: 5503784 - DNA, 23 bp, Homo sapiens
gtggccttccccttttgcctggc

SEQ ID NO: 5503785 - DNA, 24 bp, Homo sapiens
gtggccttccccttttgcctggct

SEQ ID NO: 5503786 - DNA, 21 bp, Homo sapiens
gtggccttctgctgcccaggc

SEQ ID NO: 5503787 - DNA, 16 bp, Homo sapiens
gtggccttgagtctct

SEQ ID NO: 5503788 - DNA, 18 bp, Homo sapiens
gtggccttgagtctctga

SEQ ID NO: 5503789 - DNA, 12 bp, Homo sapiens
gtggccttgccc

SEQ ID NO: 5503790 - DNA, 19 bp, Homo sapiens
gtggccttgggaggacatg

SEQ ID NO: 5503791 - DNA, 20 bp, Homo sapiens
gtggcctttatgttctttca

SEQ ID NO: 5503792 - DNA, 24 bp, Homo sapiens
gtggcctttcagtgtagcgggagg

SEQ ID NO: 5503793 - DNA, 14 bp, Homo sapiens
gtggcctttgtgct

SEQ ID NO: 5503794 - DNA, 19 bp, Homo sapiens
gtggcgccccctggtggga

SEQ ID NO: 5503795 - DNA, 19 bp, Homo sapiens
gtggcgccgcgtggacagc

SEQ ID NO: 5503796 - DNA, 17 bp, Homo sapiens
gtggcgccgtctccagg

SEQ ID NO: 5503797 - DNA, 22 bp, Homo sapiens
gtggcgccgtctccaggggctg

SEQ ID NO: 5503798 - DNA, 19 bp, Homo sapiens
gtggcgcgatctcagctca

SEQ ID NO: 5503799 - DNA, 16 bp, Homo sapiens
gtggcgcgcctgcctt

SEQ ID NO: 5503800 - DNA, 13 bp, Homo sapiens
gtggcgctggtgc

SEQ ID NO: 5503801 - DNA, 14 bp, Homo sapiens
gtggcgctttctcc

SEQ ID NO: 5503802 - DNA, 22 bp, Homo sapiens
gtggcgctttctcctgtgccca

SEQ ID NO: 5503803 - DNA, 15 bp, Homo sapiens
gtggcggccccagca

SEQ ID NO: 5503804 - DNA, 14 bp, Homo sapiens
gtggcggccttccg

SEQ ID NO: 5503805 - DNA, 17 bp, Homo sapiens
gtggcggctgcacaaca

SEQ ID NO: 5503806 - DNA, 21 bp, Homo sapiens
gtggcgggaagggtgggccct

SEQ ID NO: 5503807 - DNA, 20 bp, Homo sapiens
gtggcgggaatgagctgtgt

SEQ ID NO: 5503808 - DNA, 23 bp, Homo sapiens
gtggcgggaatgagctgtgtaaa

SEQ ID NO: 5503809 - DNA, 15 bp, Homo sapiens
gtggcggggcagcag

SEQ ID NO: 5503810 - DNA, 15 bp, Homo sapiens
gtggcggggcccctg

SEQ ID NO: 5503811 - DNA, 19 bp, Homo sapiens
gtggcggggcccctgctcc

SEQ ID NO: 5503812 - DNA, 22 bp, Homo sapiens
gtggcggggcccctgctccgag

SEQ ID NO: 5503813 - DNA, 20 bp, Homo sapiens
gtggcgtgagaggcaatgac

SEQ ID NO: 5503814 - DNA, 16 bp, Homo sapiens
gtggcgtgagctgccc

SEQ ID NO: 5503815 - DNA, 13 bp, Homo sapiens
gtggctaaagtgc

SEQ ID NO: 5503816 - DNA, 16 bp, Homo sapiens
gtggctactctgtgcc

SEQ ID NO: 5503817 - DNA, 22 bp, Homo sapiens
gtggctactctgtgccagagcc

SEQ ID NO: 5503818 - DNA, 18 bp, Homo sapiens
gtggctaggcctttcctg

SEQ ID NO: 5503819 - DNA, 20 bp, Homo sapiens
gtggctattaaaactctttt

SEQ ID NO: 5503820 - DNA, 23 bp, Homo sapiens
gtggctattttgagaactccagc

SEQ ID NO: 5503821 - DNA, 16 bp, Homo sapiens
gtggctcacacctgca

SEQ ID NO: 5503822 - DNA, 16 bp, Homo sapiens
gtggctcacgcctgta

SEQ ID NO: 5503823 - DNA, 14 bp, Homo sapiens
gtggctcactactg

SEQ ID NO: 5503824 - DNA, 21 bp, Homo sapiens
gtggctcagacccctcagccc

SEQ ID NO: 5503825 - DNA, 14 bp, Homo sapiens
gtggctcatgcctg

SEQ ID NO: 5503826 - DNA, 22 bp, Homo sapiens
gtggctcatggcgtaatgggcc

SEQ ID NO: 5503827 - DNA, 23 bp, Homo sapiens
gtggctccagaatgtgctgcctt

SEQ ID NO: 5503828 - DNA, 15 bp, Homo sapiens
gtggctccagcacca

SEQ ID NO: 5503829 - DNA, 17 bp, Homo sapiens
gtggctcccacaggtct

SEQ ID NO: 5503830 - DNA, 20 bp, Homo sapiens
gtggctccccacctggacac

SEQ ID NO: 5503831 - DNA, 22 bp, Homo sapiens
gtggctccccacctggacacac

SEQ ID NO: 5503832 - DNA, 14 bp, Homo sapiens
gtggctccccctct

SEQ ID NO: 5503833 - DNA, 12 bp, Homo sapiens
gtggctcccctc

SEQ ID NO: 5503834 - DNA, 23 bp, Homo sapiens
gtggctcccctctatttagcatg

SEQ ID NO: 5503835 - DNA, 19 bp, Homo sapiens
gtggctccctctctcctgg

SEQ ID NO: 5503836 - DNA, 15 bp, Homo sapiens
gtggctcctgccact

SEQ ID NO: 5503837 - DNA, 12 bp, Homo sapiens
gtggctcctggg

SEQ ID NO: 5503838 - DNA, 19 bp, Homo sapiens
gtggctcctgggccggctg

SEQ ID NO: 5503839 - DNA, 13 bp, Homo sapiens
gtggctcctggta

SEQ ID NO: 5503840 - DNA, 16 bp, Homo sapiens
gtggctcgggaggcga

SEQ ID NO: 5503841 - DNA, 14 bp, Homo sapiens
gtggggcctcagcc

SEQ ID NO: 5503842 - DNA, 15 bp, Homo sapiens
gtggggcctcagcct

SEQ ID NO: 5503843 - DNA, 21 bp, Homo sapiens
gtggggcctcagcctggggct

SEQ ID NO: 5503844 - DNA, 23 bp, Homo sapiens
gtggggcctccttgtccaggtct

SEQ ID NO: 5503845 - DNA, 14 bp, Homo sapiens
gtggggcctgatgg

SEQ ID NO: 5503846 - DNA, 12 bp, Homo sapiens
gtggggcctggg

SEQ ID NO: 5503847 - DNA, 14 bp, Homo sapiens
gtggggcctgggag

SEQ ID NO: 5503848 - DNA, 21 bp, Homo sapiens
gtggggcctgggagggttccc

SEQ ID NO: 5503849 - DNA, 14 bp, Homo sapiens
gtggggcctggggt

SEQ ID NO: 5503850 - DNA, 19 bp, Homo sapiens
gtggggcctggggtaggag

SEQ ID NO: 5503851 - DNA, 13 bp, Homo sapiens
gtggggcctgtgg

SEQ ID NO: 5503852 - DNA, 15 bp, Homo sapiens
gtggggcgtggatcg

SEQ ID NO: 5503853 - DNA, 21 bp, Homo sapiens
gtggggctcacttttcatcct

SEQ ID NO: 5503854 - DNA, 22 bp, Homo sapiens
gtggggctcccggcatcctgaa

SEQ ID NO: 5503855 - DNA, 12 bp, Homo sapiens
gtggggctccta

SEQ ID NO: 5503856 - DNA, 16 bp, Homo sapiens
gtggggctcctacctg

SEQ ID NO: 5503857 - DNA, 18 bp, Homo sapiens
gtggggctcctacctggg

SEQ ID NO: 5503858 - DNA, 22 bp, Homo sapiens
gtggggctcctacctgggggca

SEQ ID NO: 5503859 - DNA, 13 bp, Homo sapiens
gtggggctcctgg

SEQ ID NO: 5503860 - DNA, 18 bp, Homo sapiens
gtggggctcgtggccttc

SEQ ID NO: 5503861 - DNA, 16 bp, Homo sapiens
gtggggctgagcctga

SEQ ID NO: 5503862 - DNA, 13 bp, Homo sapiens
gtggggctgcagg

SEQ ID NO: 5503863 - DNA, 14 bp, Homo sapiens
gtggggctgcaggc

SEQ ID NO: 5503864 - DNA, 17 bp, Homo sapiens
gtggggctgcaggcagg

SEQ ID NO: 5503865 - DNA, 16 bp, Homo sapiens
gtggggctgctcctcc

SEQ ID NO: 5503866 - DNA, 18 bp, Homo sapiens
gtggggctgctcctccag

SEQ ID NO: 5503867 - DNA, 16 bp, Homo sapiens
gtggggctggaagcag

SEQ ID NO: 5503868 - DNA, 18 bp, Homo sapiens
gtggggctggaagcagaa

SEQ ID NO: 5503869 - DNA, 11 bp, Homo sapiens
gtggggctggg

SEQ ID NO: 5503870 - DNA, 15 bp, Homo sapiens
gtggggctgggcacc

SEQ ID NO: 5503871 - DNA, 12 bp, Homo sapiens
gtggggctgggg

SEQ ID NO: 5503872 - DNA, 11 bp, Homo sapiens
gtggggctggt

SEQ ID NO: 5503873 - DNA, 18 bp, Homo sapiens
gtggggctgtcctgctgc

SEQ ID NO: 5503874 - DNA, 24 bp, Homo sapiens
gtggggcttagaatggggcttcca

SEQ ID NO: 5503875 - DNA, 16 bp, Homo sapiens
gtggggcttctctggg

SEQ ID NO: 5503876 - DNA, 12 bp, Homo sapiens
gtggggcttggc

SEQ ID NO: 5503877 - DNA, 17 bp, Homo sapiens
gtggggcttggcgtgga

SEQ ID NO: 5503878 - DNA, 15 bp, Homo sapiens
gtgggggaaaaataa

SEQ ID NO: 5503879 - DNA, 19 bp, Homo sapiens
gtgggggaagagcacagcc

SEQ ID NO: 5503880 - DNA, 14 bp, Homo sapiens
gtgggggagaatgg

SEQ ID NO: 5503881 - DNA, 12 bp, Homo sapiens
gtgggggagcct

SEQ ID NO: 5503882 - DNA, 16 bp, Homo sapiens
gtgggggagcctctgg

SEQ ID NO: 5503883 - DNA, 14 bp, Homo sapiens
gtgggggagggaaa

SEQ ID NO: 5503884 - DNA, 18 bp, Homo sapiens
gtgggggatgctgaggag

SEQ ID NO: 5503885 - DNA, 17 bp, Homo sapiens
gtgggggcagagggcag

SEQ ID NO: 5503886 - DNA, 21 bp, Homo sapiens
gtgggggccaaacctgggacc

SEQ ID NO: 5503887 - DNA, 20 bp, Homo sapiens
gtgggggccccgtctcaggt

SEQ ID NO: 5503888 - DNA, 18 bp, Homo sapiens
gtgggggccgctggccca

SEQ ID NO: 5503889 - DNA, 16 bp, Homo sapiens
gtgggggcctcctcag

SEQ ID NO: 5503890 - DNA, 14 bp, Homo sapiens
gtgggggcctgctg

SEQ ID NO: 5503891 - DNA, 18 bp, Homo sapiens
gtgggggcctgctgtggg

SEQ ID NO: 5503892 - DNA, 14 bp, Homo sapiens
gtgggggcggctgt

SEQ ID NO: 5503893 - DNA, 12 bp, Homo sapiens
gtgggggctgca

SEQ ID NO: 5503894 - DNA, 20 bp, Homo sapiens
gtgggggctgtcctgctcac

SEQ ID NO: 5503895 - DNA, 21 bp, Homo sapiens
gtgggggctgtcctgctcacc

SEQ ID NO: 5503896 - DNA, 18 bp, Homo sapiens
gtgggggctgtggccctg

SEQ ID NO: 5503897 - DNA, 16 bp, Homo sapiens
gtggggggaggaagca

SEQ ID NO: 5503898 - DNA, 15 bp, Homo sapiens
gtggggggagggcac

SEQ ID NO: 5503899 - DNA, 16 bp, Homo sapiens
gtggggggagggcacc

SEQ ID NO: 5503900 - DNA, 14 bp, Homo sapiens
gtgggggggcagag

SEQ ID NO: 5503901 - DNA, 13 bp, Homo sapiens
gtggggggtcctt

SEQ ID NO: 5503902 - DNA, 17 bp, Homo sapiens
gtggggggtgcaggtgg

SEQ ID NO: 5503903 - DNA, 18 bp, Homo sapiens
gtggggggtgcaggtggg

SEQ ID NO: 5503904 - DNA, 19 bp, Homo sapiens
gtgggggtagagctgatcc

SEQ ID NO: 5503905 - DNA, 15 bp, Homo sapiens
gtgggggtctgggag

SEQ ID NO: 5503906 - DNA, 21 bp, Homo sapiens
gtgggggtctgggaggcaggt

SEQ ID NO: 5503907 - DNA, 14 bp, Homo sapiens
gtgggggtctgtgt

SEQ ID NO: 5503908 - DNA, 16 bp, Homo sapiens
gtgggggtctgtgtgt

SEQ ID NO: 5503909 - DNA, 14 bp, Homo sapiens
gtgggggtggagga

SEQ ID NO: 5503910 - DNA, 13 bp, Homo sapiens
gtgggggtgggca

SEQ ID NO: 5503911 - DNA, 20 bp, Homo sapiens
gtgggggttctggcaggacc

SEQ ID NO: 5503912 - DNA, 21 bp, Homo sapiens
gtggggtagaggaagacgaga

SEQ ID NO: 5503913 - DNA, 19 bp, Homo sapiens
gtggggtaggttgggagaa

SEQ ID NO: 5503914 - DNA, 20 bp, Homo sapiens
gtggggtcaagctgagctgg

SEQ ID NO: 5503915 - DNA, 15 bp, Homo sapiens
gtggggtcactctgg

SEQ ID NO: 5503916 - DNA, 21 bp, Homo sapiens
gtggggtcactctggcagctc

SEQ ID NO: 5503917 - DNA, 19 bp, Homo sapiens
gtggggtcatgccctcctc

SEQ ID NO: 5503918 - DNA, 22 bp, Homo sapiens
gtggggtcctgccggagaggaa

SEQ ID NO: 5503919 - DNA, 20 bp, Homo sapiens
gtggggtgaaattttcttaa

SEQ ID NO: 5503920 - DNA, 20 bp, Homo sapiens
gtggggtgaacagctggtgc

SEQ ID NO: 5503921 - DNA, 14 bp, Homo sapiens
gtggggtgaagctg

SEQ ID NO: 5503922 - DNA, 15 bp, Homo sapiens
gtggggtgaagctgg

SEQ ID NO: 5503923 - DNA, 17 bp, Homo sapiens
gtggggtgaggaccact

SEQ ID NO: 5503924 - DNA, 19 bp, Homo sapiens
gtggggtgatggccagagg

SEQ ID NO: 5503925 - DNA, 14 bp, Homo sapiens
gtggggtgcctgag

SEQ ID NO: 5503926 - DNA, 15 bp, Homo sapiens
gtggggtgctgccct

SEQ ID NO: 5503927 - DNA, 16 bp, Homo sapiens
gtggggtgctggggct

SEQ ID NO: 5503928 - DNA, 15 bp, Homo sapiens
gtggggtggacctgg

SEQ ID NO: 5503929 - DNA, 17 bp, Homo sapiens
gtggggtgggctggagt

SEQ ID NO: 5503930 - DNA, 13 bp, Homo sapiens
gtggggtgggggt

SEQ ID NO: 5503931 - DNA, 22 bp, Homo sapiens
gtggggttgggggacagccttc

SEQ ID NO: 5503932 - DNA, 14 bp, Homo sapiens
gtggggtttcctgg

SEQ ID NO: 5503933 - DNA, 23 bp, Homo sapiens
gtggggtttttaatctcttgtca

SEQ ID NO: 5503934 - DNA, 17 bp, Homo sapiens
gtgggtaagaggagcag

SEQ ID NO: 5503935 - DNA, 20 bp, Homo sapiens
gtgggtaagaggagcagagg

SEQ ID NO: 5503936 - DNA, 21 bp, Homo sapiens
gtgggtaattgtacaataaat

SEQ ID NO: 5503937 - DNA, 19 bp, Homo sapiens
gtgggtacccaggctggtt

SEQ ID NO: 5503938 - DNA, 17 bp, Homo sapiens
gtgggtactattctgat

SEQ ID NO: 5503939 - DNA, 21 bp, Homo sapiens
gtgggtaggttggactggaaa

SEQ ID NO: 5503940 - DNA, 12 bp, Homo sapiens
gtgggtataaaa

SEQ ID NO: 5503941 - DNA, 13 bp, Homo sapiens
gtgggtataaaag

SEQ ID NO: 5503942 - DNA, 20 bp, Homo sapiens
gtgggtattcaccaccctgg

SEQ ID NO: 5503943 - DNA, 20 bp, Homo sapiens
gtgggtatttcttatttgaa

SEQ ID NO: 5503944 - DNA, 17 bp, Homo sapiens
gtgggtcaaaccaagaa

SEQ ID NO: 5503945 - DNA, 18 bp, Homo sapiens
gtgggtcaactccaaggc

SEQ ID NO: 5503946 - DNA, 19 bp, Homo sapiens
gtgggtcaactccaaggca

SEQ ID NO: 5503947 - DNA, 15 bp, Homo sapiens
gtgggtcagcccagc

SEQ ID NO: 5503948 - DNA, 18 bp, Homo sapiens
gtgggtcagcccagcacc

SEQ ID NO: 5503949 - DNA, 19 bp, Homo sapiens
gtgggtcagtgtgccaccc

SEQ ID NO: 5503950 - DNA, 22 bp, Homo sapiens
gtgggtcatcccagcacctgcc

SEQ ID NO: 5503951 - DNA, 16 bp, Homo sapiens
gtgggtccaggaaggc

SEQ ID NO: 5503952 - DNA, 16 bp, Homo sapiens
gtgggtccaggggccc

SEQ ID NO: 5503953 - DNA, 18 bp, Homo sapiens
gtgggtccatgggcagag

SEQ ID NO: 5503954 - DNA, 20 bp, Homo sapiens
gtgggtccatgggcagagcc

SEQ ID NO: 5503955 - DNA, 20 bp, Homo sapiens
gtgggtccctgcgtctcctg

SEQ ID NO: 5503956 - DNA, 18 bp, Homo sapiens
gtgggtcctgaggcctgc

SEQ ID NO: 5503957 - DNA, 19 bp, Homo sapiens
gtgggtctatgttccccag

SEQ ID NO: 5503958 - DNA, 11 bp, Homo sapiens
gtgggtctctg

SEQ ID NO: 5503959 - DNA, 14 bp, Homo sapiens
gtgggtctctgggg

SEQ ID NO: 5503960 - DNA, 17 bp, Homo sapiens
gtgggtctgagctggac

SEQ ID NO: 5503961 - DNA, 14 bp, Homo sapiens
gtgggtctggagga

SEQ ID NO: 5503962 - DNA, 14 bp, Homo sapiens
gtgggtctggggag

SEQ ID NO: 5503963 - DNA, 17 bp, Homo sapiens
gtgggtctttttctctt

SEQ ID NO: 5503964 - DNA, 13 bp, Homo sapiens
gtgggtgaaagaa

SEQ ID NO: 5503965 - DNA, 20 bp, Homo sapiens
gtgggtgaaagaaatcatgt

SEQ ID NO: 5503966 - DNA, 21 bp, Homo sapiens
gtgggtgaaagaaatcatgtt

SEQ ID NO: 5503967 - DNA, 13 bp, Homo sapiens
gtgggtgaccagg

SEQ ID NO: 5503968 - DNA, 14 bp, Homo sapiens
gtgggtgagagaga

SEQ ID NO: 5503969 - DNA, 23 bp, Homo sapiens
gtgggtgagatgctggagaagag

SEQ ID NO: 5503970 - DNA, 16 bp, Homo sapiens
gtgggtgaggctgggc

SEQ ID NO: 5503971 - DNA, 24 bp, Homo sapiens
gtgggtgatcagaaggctggggcc

SEQ ID NO: 5503972 - DNA, 22 bp, Homo sapiens
gtgggtgatgcttttgctgctg

SEQ ID NO: 5503973 - DNA, 20 bp, Homo sapiens
gtgggtgcgtaaggatgtgt

SEQ ID NO: 5503974 - DNA, 14 bp, Homo sapiens
gtgggtgctcagaa

SEQ ID NO: 5503975 - DNA, 12 bp, Homo sapiens
gtgggtgctgcc

SEQ ID NO: 5503976 - DNA, 13 bp, Homo sapiens
gtgggtgctgcca

SEQ ID NO: 5503977 - DNA, 13 bp, Homo sapiens
gtgggtggagaag

SEQ ID NO: 5503978 - DNA, 14 bp, Homo sapiens
gtgggtggagaagg

SEQ ID NO: 5503979 - DNA, 16 bp, Homo sapiens
gtgggtggagtcaggc

SEQ ID NO: 5503980 - DNA, 17 bp, Homo sapiens
gtgggtggcacctcctg

SEQ ID NO: 5503981 - DNA, 20 bp, Homo sapiens
gtgggtggcacctcctgaga

SEQ ID NO: 5503982 - DNA, 18 bp, Homo sapiens
gtgggtgggaggggccca

SEQ ID NO: 5503983 - DNA, 13 bp, Homo sapiens
gtgggtgggagtg

SEQ ID NO: 5503984 - DNA, 20 bp, Homo sapiens
gtgggtggggaggccctgcc

SEQ ID NO: 5503985 - DNA, 14 bp, Homo sapiens
gtgggtggggctgc

SEQ ID NO: 5503986 - DNA, 16 bp, Homo sapiens
gtgggtggggcttctc

SEQ ID NO: 5503987 - DNA, 12 bp, Homo sapiens
gtgggtggtgga

SEQ ID NO: 5503988 - DNA, 16 bp, Homo sapiens
gtgggtggtggggagg

SEQ ID NO: 5503989 - DNA, 19 bp, Homo sapiens
gtgggtggtgtatttgaga

SEQ ID NO: 5503990 - DNA, 23 bp, Homo sapiens
gtgggtgtcagtgtcattattag

SEQ ID NO: 5503991 - DNA, 22 bp, Homo sapiens
gtgggtgtcctgcctgtctgcc

SEQ ID NO: 5503992 - DNA, 15 bp, Homo sapiens
gtgggtgtgagcagc

SEQ ID NO: 5503993 - DNA, 13 bp, Homo sapiens
gtgggtgtggcca

SEQ ID NO: 5503994 - DNA, 21 bp, Homo sapiens
gtgggtgttctttcctgccct

SEQ ID NO: 5503995 - DNA, 22 bp, Homo sapiens
gtgggttagtcgggtgccagga

SEQ ID NO: 5503996 - DNA, 21 bp, Homo sapiens
gtgggttatcatggaagaaaa

SEQ ID NO: 5503997 - DNA, 16 bp, Homo sapiens
gtgggttattctggag

SEQ ID NO: 5503998 - DNA, 15 bp, Homo sapiens
gtgggttccacagac

SEQ ID NO: 5503999 - DNA, 22 bp, Homo sapiens
gtgggttgaatatagcctgcct

SEQ ID NO: 5504000 - DNA, 23 bp, Homo sapiens
gtgggttgaatatagcctgcctc

SEQ ID NO: 5504001 - DNA, 13 bp, Homo sapiens
gtgggttgctaac

SEQ ID NO: 5504002 - DNA, 17 bp, Homo sapiens
gtgggttgtgatattga

SEQ ID NO: 5504003 - DNA, 16 bp, Homo sapiens
gtgggtttagcaggct

SEQ ID NO: 5504004 - DNA, 17 bp, Homo sapiens
gtgggtttagcaggctg

SEQ ID NO: 5504005 - DNA, 19 bp, Homo sapiens
gtgggtttctctgtgctct

SEQ ID NO: 5504006 - DNA, 22 bp, Homo sapiens
gtgggtttgggtgcctcctgca

SEQ ID NO: 5504007 - DNA, 16 bp, Homo sapiens
gtgggtttggttagag

SEQ ID NO: 5504008 - DNA, 18 bp, Homo sapiens
gtgggtttgtggggggag

SEQ ID NO: 5504009 - DNA, 22 bp, Homo sapiens
gtgggttttattgtccttcaga

SEQ ID NO: 5504010 - DNA, 21 bp, Homo sapiens
gtgggttttcatcaagactgg

SEQ ID NO: 5504011 - DNA, 17 bp, Homo sapiens
gtggtaaaaaagaaatg

SEQ ID NO: 5504012 - DNA, 13 bp, Homo sapiens
gtggtaaagaaag

SEQ ID NO: 5504013 - DNA, 21 bp, Homo sapiens
gtggtaaagtgttaaggaata

SEQ ID NO: 5504014 - DNA, 16 bp, Homo sapiens
gtggtaaattcagaca

SEQ ID NO: 5504015 - DNA, 16 bp, Homo sapiens
gtggtaacaagaggag

SEQ ID NO: 5504016 - DNA, 22 bp, Homo sapiens
gtggtaacaagaggagcaggaa

SEQ ID NO: 5504017 - DNA, 13 bp, Homo sapiens
gtggtaacagctc

SEQ ID NO: 5504018 - DNA, 13 bp, Homo sapiens
gtggtaactgcca

SEQ ID NO: 5504019 - DNA, 15 bp, Homo sapiens
gtggtaactgccagc

SEQ ID NO: 5504020 - DNA, 12 bp, Homo sapiens
gtggttccagta

SEQ ID NO: 5504021 - DNA, 17 bp, Homo sapiens
gtggttcctaagggaaa

SEQ ID NO: 5504022 - DNA, 18 bp, Homo sapiens
gtggttcgtgctgtgctc

SEQ ID NO: 5504023 - DNA, 19 bp, Homo sapiens
gtggttctacaatctattt

SEQ ID NO: 5504024 - DNA, 15 bp, Homo sapiens
gtggttctctgcctt

SEQ ID NO: 5504025 - DNA, 15 bp, Homo sapiens
gtggttctgtgcctc

SEQ ID NO: 5504026 - DNA, 12 bp, Homo sapiens
gtggttcttttt

SEQ ID NO: 5504027 - DNA, 18 bp, Homo sapiens
gtggttgaatatgattaa

SEQ ID NO: 5504028 - DNA, 17 bp, Homo sapiens
gtggttgcctgccctcc

SEQ ID NO: 5504029 - DNA, 19 bp, Homo sapiens
gtggttgctgttttcctcc

SEQ ID NO: 5504030 - DNA, 22 bp, Homo sapiens
gtggttggaggcctggtctgga

SEQ ID NO: 5504031 - DNA, 17 bp, Homo sapiens
gtggttgggctgtgcct

SEQ ID NO: 5504032 - DNA, 13 bp, Homo sapiens
gtggttgtgatcc

SEQ ID NO: 5504033 - DNA, 13 bp, Homo sapiens
gtggttgtttttt

SEQ ID NO: 5504034 - DNA, 20 bp, Homo sapiens
gtggtttagtgtaaaaatga

SEQ ID NO: 5504035 - DNA, 16 bp, Homo sapiens
gtggtttataatctga

SEQ ID NO: 5504036 - DNA, 17 bp, Homo sapiens
gtggtttatatatttaa

SEQ ID NO: 5504037 - DNA, 15 bp, Homo sapiens
gtggtttcagaaatg

SEQ ID NO: 5504038 - DNA, 17 bp, Homo sapiens
gtggtttcccctttctt

SEQ ID NO: 5504039 - DNA, 18 bp, Homo sapiens
gtggtttcccctttcttt

SEQ ID NO: 5504040 - DNA, 15 bp, Homo sapiens
gtggtttgcagatga

SEQ ID NO: 5504041 - DNA, 18 bp, Homo sapiens
gtggtttgccatgtcgct

SEQ ID NO: 5504042 - DNA, 16 bp, Homo sapiens
gtggtttggtgtgttc

SEQ ID NO: 5504043 - DNA, 21 bp, Homo sapiens
gtggtttgtgagccttgctgc

SEQ ID NO: 5504044 - DNA, 16 bp, Homo sapiens
gtggtttgtggcttta

SEQ ID NO: 5504045 - DNA, 14 bp, Homo sapiens
gtggttttaggata

SEQ ID NO: 5504046 - DNA, 22 bp, Homo sapiens
gtggttttaggatacttaacaa

SEQ ID NO: 5504047 - DNA, 23 bp, Homo sapiens
gtggttttcagagcaggaggccg

SEQ ID NO: 5504048 - DNA, 19 bp, Homo sapiens
gtggttttcccctccctgg

SEQ ID NO: 5504049 - DNA, 24 bp, Homo sapiens
gtggttttcccctccctgggttca

SEQ ID NO: 5504050 - DNA, 16 bp, Homo sapiens
gtggttttctgtttct

SEQ ID NO: 5504051 - DNA, 17 bp, Homo sapiens
gtggttttctgtttcta

SEQ ID NO: 5504052 - DNA, 23 bp, Homo sapiens
gtggttttcttaaggtgaggcct

SEQ ID NO: 5504053 - DNA, 22 bp, Homo sapiens
gtggttttgggaaaaattattt

SEQ ID NO: 5504054 - DNA, 17 bp, Homo sapiens
gtggttttgggtttttt

SEQ ID NO: 5504055 - DNA, 12 bp, Homo sapiens
gtggtttttatt

SEQ ID NO: 5504056 - DNA, 16 bp, Homo sapiens
gtggtttttcttttct

SEQ ID NO: 5504057 - DNA, 15 bp, Homo sapiens
gtgtaaaaaatggaa

SEQ ID NO: 5504058 - DNA, 16 bp, Homo sapiens
gtgtaaaaaatggaaa

SEQ ID NO: 5504059 - DNA, 19 bp, Homo sapiens
gtgtaaaaaatggaaaaaa

SEQ ID NO: 5504060 - DNA, 20 bp, Homo sapiens
gtgtaaaaaatggaaaaaaa

SEQ ID NO: 5504061 - DNA, 17 bp, Homo sapiens
gtgtaaaaagcctcctt

SEQ ID NO: 5504062 - DNA, 12 bp, Homo sapiens
gtgtaaaaatga

SEQ ID NO: 5504063 - DNA, 16 bp, Homo sapiens
gtgtaaaaatgagaac

SEQ ID NO: 5504064 - DNA, 19 bp, Homo sapiens
gtgtaaaatattttgaatc

SEQ ID NO: 5504065 - DNA, 13 bp, Homo sapiens
gtgtaaaatgtat

SEQ ID NO: 5504066 - DNA, 12 bp, Homo sapiens
gtgtaaaattaa

SEQ ID NO: 5504067 - DNA, 11 bp, Homo sapiens
gtgtaaaattg

SEQ ID NO: 5504068 - DNA, 14 bp, Homo sapiens
gtgtaaacacatct

SEQ ID NO: 5504069 - DNA, 15 bp, Homo sapiens
gtgtaaaccaaagcc

SEQ ID NO: 5504070 - DNA, 22 bp, Homo sapiens
gtgtaaaccaaagccctaaaat

SEQ ID NO: 5504071 - DNA, 19 bp, Homo sapiens
gtgtaaaccacataatttt

SEQ ID NO: 5504072 - DNA, 15 bp, Homo sapiens
gtgtaaagaataaat

SEQ ID NO: 5504073 - DNA, 22 bp, Homo sapiens
gtgtaaagaataaatgaatctt

SEQ ID NO: 5504074 - DNA, 12 bp, Homo sapiens
gtgtaaagactg

SEQ ID NO: 5504075 - DNA, 14 bp, Homo sapiens
gtgtaaagactgag

SEQ ID NO: 5504076 - DNA, 21 bp, Homo sapiens
gtgtaaagacttgagaagtct

SEQ ID NO: 5504077 - DNA, 21 bp, Homo sapiens
gtgtaaagcattccaacaaag

SEQ ID NO: 5504078 - DNA, 15 bp, Homo sapiens
gtgtaaagctggccc

SEQ ID NO: 5504079 - DNA, 17 bp, Homo sapiens
gtgtaaaggaaaataat

SEQ ID NO: 5504080 - DNA, 15 bp, Homo sapiens
gtgtaaataatataa

SEQ ID NO: 5504081 - DNA, 12 bp, Homo sapiens
gtgtaaatatgt

SEQ ID NO: 5504082 - DNA, 15 bp, Homo sapiens
gtgtaaatatgtaca

SEQ ID NO: 5504083 - DNA, 19 bp, Homo sapiens
gtgtaacaattgtgtagcc

SEQ ID NO: 5504084 - DNA, 15 bp, Homo sapiens
gtgtaacagctcctt

SEQ ID NO: 5504085 - DNA, 18 bp, Homo sapiens
gtgtaacagttagccact

SEQ ID NO: 5504086 - DNA, 15 bp, Homo sapiens
gtgtaacatccaagc

SEQ ID NO: 5504087 - DNA, 19 bp, Homo sapiens
gtgtaaccagctcagtgtt

SEQ ID NO: 5504088 - DNA, 22 bp, Homo sapiens
gtgtaaccgtaacccaccccca

SEQ ID NO: 5504089 - DNA, 19 bp, Homo sapiens
gtgtaactgcccaaagcag

SEQ ID NO: 5504090 - DNA, 20 bp, Homo sapiens
gtgtaactgcccaaagcagc

SEQ ID NO: 5504091 - DNA, 14 bp, Homo sapiens
gtgtaacttcctgc

SEQ ID NO: 5504092 - DNA, 16 bp, Homo sapiens
gtgtaacttcctgctg

SEQ ID NO: 5504093 - DNA, 18 bp, Homo sapiens
gtgtaacttcctgctgca

SEQ ID NO: 5504094 - DNA, 19 bp, Homo sapiens
gtgtaacttcctgctgcac

SEQ ID NO: 5504095 - DNA, 20 bp, Homo sapiens
gtgtaacttgcttaaatttc

SEQ ID NO: 5504096 - DNA, 19 bp, Homo sapiens
gtgtaactttaaacatcta

SEQ ID NO: 5504097 - DNA, 21 bp, Homo sapiens
gtgtaagaacaatgccagggc

SEQ ID NO: 5504098 - DNA, 15 bp, Homo sapiens
gtgtaagaactgtac

SEQ ID NO: 5504099 - DNA, 17 bp, Homo sapiens
gtgtaagaactgtacat

SEQ ID NO: 5504100 - DNA, 19 bp, Homo sapiens
gtgtaagaagctgtgaata

SEQ ID NO: 5504101 - DNA, 17 bp, Homo sapiens
gtgtaagacaaaaagct

SEQ ID NO: 5504102 - DNA, 16 bp, Homo sapiens
gtgtaagacttcagat

SEQ ID NO: 5504103 - DNA, 20 bp, Homo sapiens
gtgtaagacttcagatttca

SEQ ID NO: 5504104 - DNA, 21 bp, Homo sapiens
gtgtaagatttgtttttaaac

SEQ ID NO: 5504105 - DNA, 21 bp, Homo sapiens
gtgtaagtattcttatttaat

SEQ ID NO: 5504106 - DNA, 13 bp, Homo sapiens
gtgtaataaagtg

SEQ ID NO: 5504107 - DNA, 15 bp, Homo sapiens
gtgtaataagacata

SEQ ID NO: 5504108 - DNA, 20 bp, Homo sapiens
gtgtaatagatctgaataaa

SEQ ID NO: 5504109 - DNA, 13 bp, Homo sapiens
gtgtaatattctc

SEQ ID NO: 5504110 - DNA, 14 bp, Homo sapiens
gtgtaatcaataaa

SEQ ID NO: 5504111 - DNA, 15 bp, Homo sapiens
gtgtaatcaataaac

SEQ ID NO: 5504112 - DNA, 14 bp, Homo sapiens
gtgtaatcatttta

SEQ ID NO: 5504113 - DNA, 15 bp, Homo sapiens
gtgtaatcattttaa

SEQ ID NO: 5504114 - DNA, 19 bp, Homo sapiens
gtgtaatctaagtatatgt

SEQ ID NO: 5504115 - DNA, 18 bp, Homo sapiens
gtgtaatgcacaatttag

SEQ ID NO: 5504116 - DNA, 14 bp, Homo sapiens
gtgtaattatcatg

SEQ ID NO: 5504117 - DNA, 18 bp, Homo sapiens
gtgtaattgagaaggaaa

SEQ ID NO: 5504118 - DNA, 20 bp, Homo sapiens
gtgtaatttaaaattgtgat

SEQ ID NO: 5504119 - DNA, 23 bp, Homo sapiens
gtgtaatttaaaattgtgatgtg

SEQ ID NO: 5504120 - DNA, 12 bp, Homo sapiens
gtgtaatttatg

SEQ ID NO: 5504121 - DNA, 15 bp, Homo sapiens
gtgtaatttctttgc

SEQ ID NO: 5504122 - DNA, 11 bp, Homo sapiens
gtgtaattttt

SEQ ID NO: 5504123 - DNA, 18 bp, Homo sapiens
gtgtacagaaacaactgc

SEQ ID NO: 5504124 - DNA, 14 bp, Homo sapiens
gtgtacagcacaga

SEQ ID NO: 5504125 - DNA, 18 bp, Homo sapiens
gtgtacagtatgtgtcta

SEQ ID NO: 5504126 - DNA, 13 bp, Homo sapiens
gtgtacagtgaat

SEQ ID NO: 5504127 - DNA, 19 bp, Homo sapiens
gtgtacagtttaacagagt

SEQ ID NO: 5504128 - DNA, 19 bp, Homo sapiens
gtgtacatagagcaatgtt

SEQ ID NO: 5504129 - DNA, 15 bp, Homo sapiens
gtgtacatatgtgct

SEQ ID NO: 5504130 - DNA, 19 bp, Homo sapiens
gtgtacatcccatgtaaca

SEQ ID NO: 5504131 - DNA, 22 bp, Homo sapiens
gtgtacatcccatgtaacagaa

SEQ ID NO: 5504132 - DNA, 15 bp, Homo sapiens
gtgtacatgaagaat

SEQ ID NO: 5504133 - DNA, 17 bp, Homo sapiens
gtgtacatgaagaatgt

SEQ ID NO: 5504134 - DNA, 17 bp, Homo sapiens
gtgtacatggaataaca

SEQ ID NO: 5504135 - DNA, 14 bp, Homo sapiens
gtgtacatgtacat

SEQ ID NO: 5504136 - DNA, 17 bp, Homo sapiens
gtgtacatgtacatagt

SEQ ID NO: 5504137 - DNA, 11 bp, Homo sapiens
gtgtacatttt

SEQ ID NO: 5504138 - DNA, 12 bp, Homo sapiens
gtgtaccaagtg

SEQ ID NO: 5504139 - DNA, 22 bp, Homo sapiens
gtgtaccaatcgtctcagcctt

SEQ ID NO: 5504140 - DNA, 18 bp, Homo sapiens
gtgtaccacttcctgagg

SEQ ID NO: 5504141 - DNA, 22 bp, Homo sapiens
gtgtaccgcgtctaccctggga

SEQ ID NO: 5504142 - DNA, 21 bp, Homo sapiens
gtgtacctcctctcagtgttt

SEQ ID NO: 5504143 - DNA, 20 bp, Homo sapiens
gtgtacgtggagagggatga

SEQ ID NO: 5504144 - DNA, 20 bp, Homo sapiens
gtgtactagtttatggttct

SEQ ID NO: 5504145 - DNA, 18 bp, Homo sapiens
gtgtactcactgaagcct

SEQ ID NO: 5504146 - DNA, 14 bp, Homo sapiens
gtgtactctaggac

SEQ ID NO: 5504147 - DNA, 17 bp, Homo sapiens
gtgtactctaggacttc

SEQ ID NO: 5504148 - DNA, 20 bp, Homo sapiens
gtgtactctaggacttcaaa

SEQ ID NO: 5504149 - DNA, 17 bp, Homo sapiens
gtgtactctggcctctg

SEQ ID NO: 5504150 - DNA, 14 bp, Homo sapiens
gtgtactctgtgtg

SEQ ID NO: 5504151 - DNA, 13 bp, Homo sapiens
gtgtactgataaa

SEQ ID NO: 5504152 - DNA, 13 bp, Homo sapiens
gtgtactggagcc

SEQ ID NO: 5504153 - DNA, 19 bp, Homo sapiens
gtgtactgggttaatggct

SEQ ID NO: 5504154 - DNA, 19 bp, Homo sapiens
gtgtacttcccgggccagg

SEQ ID NO: 5504155 - DNA, 16 bp, Homo sapiens
gtgtactttttttgga

SEQ ID NO: 5504156 - DNA, 16 bp, Homo sapiens
gtgtagacacaggtca

SEQ ID NO: 5504157 - DNA, 17 bp, Homo sapiens
gtgtagactgtaacttt

SEQ ID NO: 5504158 - DNA, 20 bp, Homo sapiens
gtgtagagttaagaagctgt

SEQ ID NO: 5504159 - DNA, 11 bp, Homo sapiens
gtgtagatatt

SEQ ID NO: 5504160 - DNA, 18 bp, Homo sapiens
gtgtagattttatagtgt

SEQ ID NO: 5504161 - DNA, 17 bp, Homo sapiens
gtgtagcatcttcctct

SEQ ID NO: 5504162 - DNA, 17 bp, Homo sapiens
gtgtagccacaccagga

SEQ ID NO: 5504163 - DNA, 23 bp, Homo sapiens
gtgtagccaggaagccccgctca

SEQ ID NO: 5504164 - DNA, 21 bp, Homo sapiens
gtgtagccaggtatggctctg

SEQ ID NO: 5504165 - DNA, 23 bp, Homo sapiens
gtgtagccaggtatggctctgca

SEQ ID NO: 5504166 - DNA, 22 bp, Homo sapiens
gtgtagccaggtccccctgcag

SEQ ID NO: 5504167 - DNA, 18 bp, Homo sapiens
gtgtagcctaaagggcag

SEQ ID NO: 5504168 - DNA, 22 bp, Homo sapiens
gtgtagcgtcctgaggaataaa

SEQ ID NO: 5504169 - DNA, 17 bp, Homo sapiens
gtgtagctacagagaaa

SEQ ID NO: 5504170 - DNA, 18 bp, Homo sapiens
gtgtagctacagagaaac

SEQ ID NO: 5504171 - DNA, 14 bp, Homo sapiens
gtgtagctcctctg

SEQ ID NO: 5504172 - DNA, 20 bp, Homo sapiens
gtgtagctcctctgctgctc

SEQ ID NO: 5504173 - DNA, 14 bp, Homo sapiens
gtgtagctgagctg

SEQ ID NO: 5504174 - DNA, 15 bp, Homo sapiens
gtgtagctgagctgt

SEQ ID NO: 5504175 - DNA, 20 bp, Homo sapiens
gtgtagctgccacattgatt

SEQ ID NO: 5504176 - DNA, 16 bp, Homo sapiens
gtgtagctgtaagggc

SEQ ID NO: 5504177 - DNA, 18 bp, Homo sapiens
gtgtagctgtaagggcag

SEQ ID NO: 5504178 - DNA, 14 bp, Homo sapiens
gtgtagctgtgaaa

SEQ ID NO: 5504179 - DNA, 16 bp, Homo sapiens
gtgtagctgtgacctg

SEQ ID NO: 5504180 - DNA, 19 bp, Homo sapiens
gtgtagctgtgacctgctg

SEQ ID NO: 5504181 - DNA, 23 bp, Homo sapiens
gtgtagctgtgacctgctgagct

SEQ ID NO: 5504182 - DNA, 19 bp, Homo sapiens
gtgtaggaaatctgaagcc

SEQ ID NO: 5504183 - DNA, 20 bp, Homo sapiens
gtgtaggaaatctgaagcct

SEQ ID NO: 5504184 - DNA, 14 bp, Homo sapiens
gtgtaggcagacac

SEQ ID NO: 5504185 - DNA, 16 bp, Homo sapiens
gtgtaggcctgcctta

SEQ ID NO: 5504186 - DNA, 12 bp, Homo sapiens
gtgtaggcctgg

SEQ ID NO: 5504187 - DNA, 13 bp, Homo sapiens
gtgtaggctgggg

SEQ ID NO: 5504188 - DNA, 16 bp, Homo sapiens
gtgtaggggccacctc

SEQ ID NO: 5504189 - DNA, 23 bp, Homo sapiens
gtgtagggggccttgcggaagcc

SEQ ID NO: 5504190 - DNA, 13 bp, Homo sapiens
gtgtaggtgactt

SEQ ID NO: 5504191 - DNA, 17 bp, Homo sapiens
gtgtagtcaggtgctca

SEQ ID NO: 5504192 - DNA, 22 bp, Homo sapiens
gtgtagtggaagagcagcctga

SEQ ID NO: 5504193 - DNA, 17 bp, Homo sapiens
gtgtagttaattttatt

SEQ ID NO: 5504194 - DNA, 14 bp, Homo sapiens
gtgtagttccctct

SEQ ID NO: 5504195 - DNA, 15 bp, Homo sapiens
gtgtagttccctctg

SEQ ID NO: 5504196 - DNA, 21 bp, Homo sapiens
gtgtagttccctctgcctggg

SEQ ID NO: 5504197 - DNA, 17 bp, Homo sapiens
gtgtagttgaactgata

SEQ ID NO: 5504198 - DNA, 18 bp, Homo sapiens
gtgtataaaaataaaaaa

SEQ ID NO: 5504199 - DNA, 16 bp, Homo sapiens
gtgtctgtctttgtgg

SEQ ID NO: 5504200 - DNA, 14 bp, Homo sapiens
gtgtctgtggccct

SEQ ID NO: 5504201 - DNA, 15 bp, Homo sapiens
gtgtctgtggggagg

SEQ ID NO: 5504202 - DNA, 15 bp, Homo sapiens
gtgtctgtgtttaat

SEQ ID NO: 5504203 - DNA, 23 bp, Homo sapiens
gtgtcttaaactaggtgttctaa

SEQ ID NO: 5504204 - DNA, 21 bp, Homo sapiens
gtgtcttaagaaaaataatct

SEQ ID NO: 5504205 - DNA, 22 bp, Homo sapiens
gtgtcttaattaaaagaatatt

SEQ ID NO: 5504206 - DNA, 12 bp, Homo sapiens
gtgtcttagcat

SEQ ID NO: 5504207 - DNA, 13 bp, Homo sapiens
gtgtcttccataa

SEQ ID NO: 5504208 - DNA, 15 bp, Homo sapiens
gtgtcttccataatg

SEQ ID NO: 5504209 - DNA, 13 bp, Homo sapiens
gtgtcttccctgc

SEQ ID NO: 5504210 - DNA, 15 bp, Homo sapiens
gtgtcttcctcccaa

SEQ ID NO: 5504211 - DNA, 12 bp, Homo sapiens
gtgtcttcctgt

SEQ ID NO: 5504212 - DNA, 20 bp, Homo sapiens
gtgtcttgagaccagcctgc

SEQ ID NO: 5504213 - DNA, 17 bp, Homo sapiens
gtgtcttgcaatggcag

SEQ ID NO: 5504214 - DNA, 18 bp, Homo sapiens
gtgtcttggagtgcattt

SEQ ID NO: 5504215 - DNA, 17 bp, Homo sapiens
gtgtcttgggcagagct

SEQ ID NO: 5504216 - DNA, 20 bp, Homo sapiens
gtgtcttgggcagagctggc

SEQ ID NO: 5504217 - DNA, 15 bp, Homo sapiens
gtgtcttgtgttttt

SEQ ID NO: 5504218 - DNA, 18 bp, Homo sapiens
gtgtcttgttctgtcact

SEQ ID NO: 5504219 - DNA, 19 bp, Homo sapiens
gtgtctttagatagccctg

SEQ ID NO: 5504220 - DNA, 17 bp, Homo sapiens
gtgtctttccactcctc

SEQ ID NO: 5504221 - DNA, 16 bp, Homo sapiens
gtgtctttctaagaaa

SEQ ID NO: 5504222 - DNA, 18 bp, Homo sapiens
gtgtctttgtttaaaatt

SEQ ID NO: 5504223 - DNA, 15 bp, Homo sapiens
gtgtcttttaatgat

SEQ ID NO: 5504224 - DNA, 20 bp, Homo sapiens
gtgtcttttaatgatactgt

SEQ ID NO: 5504225 - DNA, 22 bp, Homo sapiens
gtgtcttttaatgatactgtct

SEQ ID NO: 5504226 - DNA, 15 bp, Homo sapiens
gtgtcttttgacatt

SEQ ID NO: 5504227 - DNA, 17 bp, Homo sapiens
gtgtgaaaaaagaaaat

SEQ ID NO: 5504228 - DNA, 20 bp, Homo sapiens
gtgtgaaactttcattcctt

SEQ ID NO: 5504229 - DNA, 15 bp, Homo sapiens
gtgtgaaatctgtct

SEQ ID NO: 5504230 - DNA, 23 bp, Homo sapiens
gtgtgaactaagttattgctgca

SEQ ID NO: 5504231 - DNA, 23 bp, Homo sapiens
gtgtgaactcaccctgggagcca

SEQ ID NO: 5504232 - DNA, 18 bp, Homo sapiens
gtgtgaactgctttcaag

SEQ ID NO: 5504233 - DNA, 14 bp, Homo sapiens
gtgtgaactggacc

SEQ ID NO: 5504234 - DNA, 14 bp, Homo sapiens
gtgtgaactgggca

SEQ ID NO: 5504235 - DNA, 19 bp, Homo sapiens
gtgtgaaggtaactaagaa

SEQ ID NO: 5504236 - DNA, 13 bp, Homo sapiens
gtgtgaaggtcct

SEQ ID NO: 5504237 - DNA, 13 bp, Homo sapiens
gtgtgaaggtctt

SEQ ID NO: 5504238 - DNA, 18 bp, Homo sapiens
gtgtgaaggtcttgcctg

SEQ ID NO: 5504239 - DNA, 19 bp, Homo sapiens
gtgtgaaggtcttgcctga

SEQ ID NO: 5504240 - DNA, 22 bp, Homo sapiens
gtgtgaagtccacttatgtaga

SEQ ID NO: 5504241 - DNA, 17 bp, Homo sapiens
gtgtgaagttacacaat

SEQ ID NO: 5504242 - DNA, 16 bp, Homo sapiens
gtgtgaataaagtgct

SEQ ID NO: 5504243 - DNA, 17 bp, Homo sapiens
gtgtgaataccccaaga

SEQ ID NO: 5504244 - DNA, 11 bp, Homo sapiens
gtgtgaatgca

SEQ ID NO: 5504245 - DNA, 14 bp, Homo sapiens
gtgtgaatgcacgt

SEQ ID NO: 5504246 - DNA, 14 bp, Homo sapiens
gtgtgaatgctgta

SEQ ID NO: 5504247 - DNA, 11 bp, Homo sapiens
gtgtgaatgta

SEQ ID NO: 5504248 - DNA, 14 bp, Homo sapiens
gtgtgaattcccag

SEQ ID NO: 5504249 - DNA, 16 bp, Homo sapiens
gtgtgacaccaccact

SEQ ID NO: 5504250 - DNA, 19 bp, Homo sapiens
gtgtgacatcacagggcct

SEQ ID NO: 5504251 - DNA, 20 bp, Homo sapiens
gtgtgacatcagtggcatgg

SEQ ID NO: 5504252 - DNA, 14 bp, Homo sapiens
gtgtgacattccag

SEQ ID NO: 5504253 - DNA, 15 bp, Homo sapiens
gtgtgacattccagg

SEQ ID NO: 5504254 - DNA, 19 bp, Homo sapiens
gtgtgacatttggagaggg

SEQ ID NO: 5504255 - DNA, 21 bp, Homo sapiens
gtgtgaccactgcagaagaca

SEQ ID NO: 5504256 - DNA, 12 bp, Homo sapiens
gtgtgaccagtt

SEQ ID NO: 5504257 - DNA, 12 bp, Homo sapiens
gtgtgacccctc

SEQ ID NO: 5504258 - DNA, 23 bp, Homo sapiens
gtgtgacccctcctggggccagg

SEQ ID NO: 5504259 - DNA, 13 bp, Homo sapiens
gtgtgaccctgag

SEQ ID NO: 5504260 - DNA, 21 bp, Homo sapiens
gtgtgaccctgagggctcctc

SEQ ID NO: 5504261 - DNA, 23 bp, Homo sapiens
gtgtgacctacaagattcctggt

SEQ ID NO: 5504262 - DNA, 13 bp, Homo sapiens
gtgtgacctgaca

SEQ ID NO: 5504263 - DNA, 13 bp, Homo sapiens
gtgtgacctgagg

SEQ ID NO: 5504264 - DNA, 19 bp, Homo sapiens
gtgtgactattcatggcta

SEQ ID NO: 5504265 - DNA, 10 bp, Homo sapiens
gtgtgactcc

SEQ ID NO: 5504266 - DNA, 20 bp, Homo sapiens
gtgtgactcgggagctgcac

SEQ ID NO: 5504267 - DNA, 22 bp, Homo sapiens
gtgtgactcgggagctgcacac

SEQ ID NO: 5504268 - DNA, 17 bp, Homo sapiens
gtgtgactctagcaagg

SEQ ID NO: 5504269 - DNA, 20 bp, Homo sapiens
gtgtgactctagcaaggctc

SEQ ID NO: 5504270 - DNA, 18 bp, Homo sapiens
gtgtgactgcgcactgag

SEQ ID NO: 5504271 - DNA, 12 bp, Homo sapiens
gtgtgactggca

SEQ ID NO: 5504272 - DNA, 19 bp, Homo sapiens
gtgtgactggcaagaggcc

SEQ ID NO: 5504273 - DNA, 18 bp, Homo sapiens
gtgtgactttgaacacat

SEQ ID NO: 5504274 - DNA, 18 bp, Homo sapiens
gtgtgagaaacttaaaga

SEQ ID NO: 5504275 - DNA, 22 bp, Homo sapiens
gtgtgagaccaggggaccagag

SEQ ID NO: 5504276 - DNA, 13 bp, Homo sapiens
gtgtgagcagtga

SEQ ID NO: 5504277 - DNA, 19 bp, Homo sapiens
gtgtgagcatctctgtgta

SEQ ID NO: 5504278 - DNA, 15 bp, Homo sapiens
gtgtgagccacagca

SEQ ID NO: 5504279 - DNA, 20 bp, Homo sapiens
gtgtgagccagagggagctg

SEQ ID NO: 5504280 - DNA, 14 bp, Homo sapiens
gtgtgagcgccttg

SEQ ID NO: 5504281 - DNA, 22 bp, Homo sapiens
gtgtgagcgcttctgcagcctc

SEQ ID NO: 5504282 - DNA, 14 bp, Homo sapiens
gtgtgagcgtggcc

SEQ ID NO: 5504283 - DNA, 17 bp, Homo sapiens
gtgtgagcgtggccttg

SEQ ID NO: 5504284 - DNA, 19 bp, Homo sapiens
gtgtgagcgtggccttggg

SEQ ID NO: 5504285 - DNA, 15 bp, Homo sapiens
gtgtgagctatgcaa

SEQ ID NO: 5504286 - DNA, 14 bp, Homo sapiens
gtgtgaggagagag

SEQ ID NO: 5504287 - DNA, 16 bp, Homo sapiens
gtgtgaggagctgctg

SEQ ID NO: 5504288 - DNA, 18 bp, Homo sapiens
gtgtgaggagctgctggc

SEQ ID NO: 5504289 - DNA, 12 bp, Homo sapiens
gtgtgaggaggg

SEQ ID NO: 5504290 - DNA, 18 bp, Homo sapiens
gtgtgaggaggggcggga

SEQ ID NO: 5504291 - DNA, 14 bp, Homo sapiens
gtgtgaggccacac

SEQ ID NO: 5504292 - DNA, 17 bp, Homo sapiens
gtgtgaggccagggcag

SEQ ID NO: 5504293 - DNA, 15 bp, Homo sapiens
gtgtgaggctgggcc

SEQ ID NO: 5504294 - DNA, 17 bp, Homo sapiens
gtgtgagggtcctgcag

SEQ ID NO: 5504295 - DNA, 12 bp, Homo sapiens
gtgtgagggtgc

SEQ ID NO: 5504296 - DNA, 17 bp, Homo sapiens
gtgtgagggtgcaggga

SEQ ID NO: 5504297 - DNA, 17 bp, Homo sapiens
gtgtgagtaagagctgg

SEQ ID NO: 5504298 - DNA, 17 bp, Homo sapiens
gtgtgagtgcatgtact

SEQ ID NO: 5504299 - DNA, 14 bp, Homo sapiens
gtgtgagtggcagc

SEQ ID NO: 5504300 - DNA, 17 bp, Homo sapiens
gtgtgagtggcagccat

SEQ ID NO: 5504301 - DNA, 18 bp, Homo sapiens
gtgtgagtggcagccatg

SEQ ID NO: 5504302 - DNA, 17 bp, Homo sapiens
gtgtgagtgtatgtata

SEQ ID NO: 5504303 - DNA, 14 bp, Homo sapiens
gtgtgagtgtgatg

SEQ ID NO: 5504304 - DNA, 15 bp, Homo sapiens
gtgtgagtgtgtgtg

SEQ ID NO: 5504305 - DNA, 16 bp, Homo sapiens
gtgtgatcatatatca

SEQ ID NO: 5504306 - DNA, 14 bp, Homo sapiens
gtgtgatcgtctga

SEQ ID NO: 5504307 - DNA, 18 bp, Homo sapiens
gtgtgatctcttcagggt

SEQ ID NO: 5504308 - DNA, 22 bp, Homo sapiens
gtgtgatcttaatatatttgaa

SEQ ID NO: 5504309 - DNA, 22 bp, Homo sapiens
gtgtgatgaactttctcttcat

SEQ ID NO: 5504310 - DNA, 16 bp, Homo sapiens
gtgtgattgacagctt

SEQ ID NO: 5504311 - DNA, 21 bp, Homo sapiens
gtgtgattgacagctttgctg

SEQ ID NO: 5504312 - DNA, 19 bp, Homo sapiens
gtgtgattgcacagaattt

SEQ ID NO: 5504313 - DNA, 17 bp, Homo sapiens
gtgtgattgcacgtgcc

SEQ ID NO: 5504314 - DNA, 21 bp, Homo sapiens
gtgtgattgggaataaatatg

SEQ ID NO: 5504315 - DNA, 14 bp, Homo sapiens
gtgtgatttcctaa

SEQ ID NO: 5504316 - DNA, 17 bp, Homo sapiens
gtgtgatttgtctctga

SEQ ID NO: 5504317 - DNA, 19 bp, Homo sapiens
gtgtgatttgtctctgagc

SEQ ID NO: 5504318 - DNA, 16 bp, Homo sapiens
gtgtgcaactggccag

SEQ ID NO: 5504319 - DNA, 17 bp, Homo sapiens
gtgtgcaagggcagtga

SEQ ID NO: 5504320 - DNA, 15 bp, Homo sapiens
gtgtgcaattgtaaa

SEQ ID NO: 5504321 - DNA, 20 bp, Homo sapiens
gtgtgcacaaatatttattt

SEQ ID NO: 5504322 - DNA, 18 bp, Homo sapiens
gtgtgcacaccaccctcc

SEQ ID NO: 5504323 - DNA, 14 bp, Homo sapiens
gtgtgcacacccat

SEQ ID NO: 5504324 - DNA, 24 bp, Homo sapiens
gtgtgcacatctacatgccatgcc

SEQ ID NO: 5504325 - DNA, 16 bp, Homo sapiens
gtgtgcaccagggttg

SEQ ID NO: 5504326 - DNA, 20 bp, Homo sapiens
gtgtgcacgcctgcaggctg

SEQ ID NO: 5504327 - DNA, 19 bp, Homo sapiens
gtgtgcacgcgtgtgcagg

SEQ ID NO: 5504328 - DNA, 14 bp, Homo sapiens
gtgtgcactccagc

SEQ ID NO: 5504329 - DNA, 20 bp, Homo sapiens
gtgtgcagagcagacaggct

SEQ ID NO: 5504330 - DNA, 19 bp, Homo sapiens
gtgtgcagagtatacaagt

SEQ ID NO: 5504331 - DNA, 14 bp, Homo sapiens
gtgtgcagcaacca

SEQ ID NO: 5504332 - DNA, 13 bp, Homo sapiens
gtgtgcagggctg

SEQ ID NO: 5504333 - DNA, 20 bp, Homo sapiens
gtgtgcatagcgtcctgccc

SEQ ID NO: 5504334 - DNA, 22 bp, Homo sapiens
gtgtgcatatgcatgtgtgtgt

SEQ ID NO: 5504335 - DNA, 14 bp, Homo sapiens
gtgtgcatattgta

SEQ ID NO: 5504336 - DNA, 16 bp, Homo sapiens
gtgtgcatattgtaca

SEQ ID NO: 5504337 - DNA, 18 bp, Homo sapiens
gtgtgcatattgtacact

SEQ ID NO: 5504338 - DNA, 21 bp, Homo sapiens
gtgtgcatcatgtttctgaga

SEQ ID NO: 5504339 - DNA, 20 bp, Homo sapiens
gtgtgcatggaagttggggc

SEQ ID NO: 5504340 - DNA, 12 bp, Homo sapiens
gtgtgcatgtgt

SEQ ID NO: 5504341 - DNA, 18 bp, Homo sapiens
gtgtgcatgtgtgtgctc

SEQ ID NO: 5504342 - DNA, 16 bp, Homo sapiens
gtgtgcattgctgtga

SEQ ID NO: 5504343 - DNA, 16 bp, Homo sapiens
gtgtgccaagccctgg

SEQ ID NO: 5504344 - DNA, 14 bp, Homo sapiens
gtgtgccacagagt

SEQ ID NO: 5504345 - DNA, 13 bp, Homo sapiens
gtgtgccaccctc

SEQ ID NO: 5504346 - DNA, 22 bp, Homo sapiens
gtgtgccagacaaataggagtg

SEQ ID NO: 5504347 - DNA, 17 bp, Homo sapiens
gtgtgcccagcacctgg

SEQ ID NO: 5504348 - DNA, 21 bp, Homo sapiens
gtgtgccccactccagcctgg

SEQ ID NO: 5504349 - DNA, 23 bp, Homo sapiens
gtgtgccccccatcctggcccat

SEQ ID NO: 5504350 - DNA, 18 bp, Homo sapiens
gtgtgccctagggctcag

SEQ ID NO: 5504351 - DNA, 19 bp, Homo sapiens
gtgtgccctagggctcaga

SEQ ID NO: 5504352 - DNA, 16 bp, Homo sapiens
gtgtgccctctgggct

SEQ ID NO: 5504353 - DNA, 17 bp, Homo sapiens
gtgtgccctctgggctc

SEQ ID NO: 5504354 - DNA, 21 bp, Homo sapiens
gtgtgccctctgggctctgag

SEQ ID NO: 5504355 - DNA, 22 bp, Homo sapiens
gtgtgccctctgggctctgagt

SEQ ID NO: 5504356 - DNA, 15 bp, Homo sapiens
gtgtgccctggctcc

SEQ ID NO: 5504357 - DNA, 21 bp, Homo sapiens
gtgtgccctgggccaggcagg

SEQ ID NO: 5504358 - DNA, 22 bp, Homo sapiens
gtgtgccctgggccaggcaggc

SEQ ID NO: 5504359 - DNA, 14 bp, Homo sapiens
gtgtgcccttgggg

SEQ ID NO: 5504360 - DNA, 19 bp, Homo sapiens
gtgtgccgttgctccggcc

SEQ ID NO: 5504361 - DNA, 19 bp, Homo sapiens
gtgtgcctcagtatattta

SEQ ID NO: 5504362 - DNA, 22 bp, Homo sapiens
gtgtgcctcagtatatttaaac

SEQ ID NO: 5504363 - DNA, 13 bp, Homo sapiens
gtgtgcctcctag

SEQ ID NO: 5504364 - DNA, 13 bp, Homo sapiens
gtgtgcctctagc

SEQ ID NO: 5504365 - DNA, 16 bp, Homo sapiens
gtgtgcctctagctga

SEQ ID NO: 5504366 - DNA, 20 bp, Homo sapiens
gtgtgcctgactgcccagca

SEQ ID NO: 5504367 - DNA, 14 bp, Homo sapiens
gtgtgcctgcagcc

SEQ ID NO: 5504368 - DNA, 15 bp, Homo sapiens
gtgtgcctgcagccc

SEQ ID NO: 5504369 - DNA, 18 bp, Homo sapiens
gtgtgcctgcagccccgc

SEQ ID NO: 5504370 - DNA, 13 bp, Homo sapiens
gtgtgcctgccct

SEQ ID NO: 5504371 - DNA, 13 bp, Homo sapiens
gtgtgcctggaag

SEQ ID NO: 5504372 - DNA, 16 bp, Homo sapiens
gtgtgcctggcagcca

SEQ ID NO: 5504373 - DNA, 19 bp, Homo sapiens
gtgtgcctggccgcagggc

SEQ ID NO: 5504374 - DNA, 14 bp, Homo sapiens
gtgtgcctgtgctc

SEQ ID NO: 5504375 - DNA, 15 bp, Homo sapiens
gtgtgcctgtgctcc

SEQ ID NO: 5504376 - DNA, 14 bp, Homo sapiens
gtgtgcctgtggca

SEQ ID NO: 5504377 - DNA, 15 bp, Homo sapiens
gtgtgccttgttcaa

SEQ ID NO: 5504378 - DNA, 23 bp, Homo sapiens
gtgttctggcctctggcctggga

SEQ ID NO: 5504379 - DNA, 12 bp, Homo sapiens
gtgttctgggct

SEQ ID NO: 5504380 - DNA, 13 bp, Homo sapiens
gtgttctgggctg

SEQ ID NO: 5504381 - DNA, 13 bp, Homo sapiens
gtgttctgtgata

SEQ ID NO: 5504382 - DNA, 13 bp, Homo sapiens
gtgttctgttaca

SEQ ID NO: 5504383 - DNA, 17 bp, Homo sapiens
gtgttctgtttgttaaa

SEQ ID NO: 5504384 - DNA, 17 bp, Homo sapiens
gtgttcttaggtttact

SEQ ID NO: 5504385 - DNA, 22 bp, Homo sapiens
gtgttcttcaagccagctctag

SEQ ID NO: 5504386 - DNA, 12 bp, Homo sapiens
gtgttcttccca

SEQ ID NO: 5504387 - DNA, 15 bp, Homo sapiens
gtgttcttcccaaag

SEQ ID NO: 5504388 - DNA, 19 bp, Homo sapiens
gtgttcttcgtaactttat

SEQ ID NO: 5504389 - DNA, 17 bp, Homo sapiens
gtgttcttcgtatatac

SEQ ID NO: 5504390 - DNA, 15 bp, Homo sapiens
gtgttcttcttctct

SEQ ID NO: 5504391 - DNA, 18 bp, Homo sapiens
gtgttcttcttctcttct

SEQ ID NO: 5504392 - DNA, 13 bp, Homo sapiens
gtgttctttataa

SEQ ID NO: 5504393 - DNA, 15 bp, Homo sapiens
gtgttctttcctgcc

SEQ ID NO: 5504394 - DNA, 17 bp, Homo sapiens
gtgttctttcctgccct

SEQ ID NO: 5504395 - DNA, 23 bp, Homo sapiens
gtgttcttttgatacatttatct

SEQ ID NO: 5504396 - DNA, 15 bp, Homo sapiens
gtgttgaaaaatatc

SEQ ID NO: 5504397 - DNA, 12 bp, Homo sapiens
gtgttgaaaacc

SEQ ID NO: 5504398 - DNA, 13 bp, Homo sapiens
gtgttgaaaacca

SEQ ID NO: 5504399 - DNA, 21 bp, Homo sapiens
gtgttgaaaaccaaaatgaca

SEQ ID NO: 5504400 - DNA, 17 bp, Homo sapiens
gtgttgaaaatgttcag

SEQ ID NO: 5504401 - DNA, 23 bp, Homo sapiens
gtgttgaaacggatgatttctat

SEQ ID NO: 5504402 - DNA, 14 bp, Homo sapiens
gtgttgaaatatag

SEQ ID NO: 5504403 - DNA, 20 bp, Homo sapiens
gtgttgaatcccacttcagt

SEQ ID NO: 5504404 - DNA, 15 bp, Homo sapiens
gtgttgaattttatt

SEQ ID NO: 5504405 - DNA, 11 bp, Homo sapiens
gtgttgacact

SEQ ID NO: 5504406 - DNA, 15 bp, Homo sapiens
gtgttgacatagcct

SEQ ID NO: 5504407 - DNA, 16 bp, Homo sapiens
gtgttgacatagcctt

SEQ ID NO: 5504408 - DNA, 17 bp, Homo sapiens
gtgttgacatagccttt

SEQ ID NO: 5504409 - DNA, 17 bp, Homo sapiens
gtgttgaccggctgccg

SEQ ID NO: 5504410 - DNA, 21 bp, Homo sapiens
gtgttgaccggctgccgtttg

SEQ ID NO: 5504411 - DNA, 20 bp, Homo sapiens
gtgttgagaagaatcaggag

SEQ ID NO: 5504412 - DNA, 22 bp, Homo sapiens
gtgttgagcatctgtccccctt

SEQ ID NO: 5504413 - DNA, 17 bp, Homo sapiens
gtgttgagcgtattctt

SEQ ID NO: 5504414 - DNA, 17 bp, Homo sapiens
gtgttgaggaggggagc

SEQ ID NO: 5504415 - DNA, 16 bp, Homo sapiens
gtgttgataagctgca

SEQ ID NO: 5504416 - DNA, 24 bp, Homo sapiens
gtgttgataagctgcacatgacta

SEQ ID NO: 5504417 - DNA, 18 bp, Homo sapiens
gtgttgatacgtgtgtga

SEQ ID NO: 5504418 - DNA, 20 bp, Homo sapiens
gtgttgatacgtgtgtgaag

SEQ ID NO: 5504419 - DNA, 19 bp, Homo sapiens
gtgttgattttctgttgta

SEQ ID NO: 5504420 - DNA, 20 bp, Homo sapiens
gtgttgcaaatcactctgca

SEQ ID NO: 5504421 - DNA, 16 bp, Homo sapiens
gtgttgcactgaacag

SEQ ID NO: 5504422 - DNA, 17 bp, Homo sapiens
gtgttgcactgaacagg

SEQ ID NO: 5504423 - DNA, 23 bp, Homo sapiens
gtgttgcccctcctccgcatgcc

SEQ ID NO: 5504424 - DNA, 15 bp, Homo sapiens
gtgttgcctcttgca

SEQ ID NO: 5504425 - DNA, 22 bp, Homo sapiens
gtgttgccttagcacttctttc

SEQ ID NO: 5504426 - DNA, 16 bp, Homo sapiens
gtgttgctcagctcct

SEQ ID NO: 5504427 - DNA, 17 bp, Homo sapiens
gtgttgctgtggctcca

SEQ ID NO: 5504428 - DNA, 12 bp, Homo sapiens
gtgttgctgttt

SEQ ID NO: 5504429 - DNA, 14 bp, Homo sapiens
gtgttgctgtttag

SEQ ID NO: 5504430 - DNA, 12 bp, Homo sapiens
gtgttggaagcc

SEQ ID NO: 5504431 - DNA, 13 bp, Homo sapiens
gtgttggaagcca

SEQ ID NO: 5504432 - DNA, 16 bp, Homo sapiens
gtgttggacaaatgtg

SEQ ID NO: 5504433 - DNA, 19 bp, Homo sapiens
gtgttggacaaatgtgaag

SEQ ID NO: 5504434 - DNA, 14 bp, Homo sapiens
gtgttggacagaga

SEQ ID NO: 5504435 - DNA, 12 bp, Homo sapiens
gtgttggacagg

SEQ ID NO: 5504436 - DNA, 15 bp, Homo sapiens
gtgttggaggggcag

SEQ ID NO: 5504437 - DNA, 20 bp, Homo sapiens
gtgttggcaaacgagacttt

SEQ ID NO: 5504438 - DNA, 19 bp, Homo sapiens
gtgttggctgtgtgacaga

SEQ ID NO: 5504439 - DNA, 16 bp, Homo sapiens
gtgttggctttacaaa

SEQ ID NO: 5504440 - DNA, 15 bp, Homo sapiens
gtgttggctttgcag

SEQ ID NO: 5504441 - DNA, 22 bp, Homo sapiens
gtgttggctttgcagctgctgt

SEQ ID NO: 5504442 - DNA, 20 bp, Homo sapiens
gtgttgggaaggggtcctgc

SEQ ID NO: 5504443 - DNA, 18 bp, Homo sapiens
gtgttgggacctgctgct

SEQ ID NO: 5504444 - DNA, 24 bp, Homo sapiens
gtgttgggacctgctgctccatgg

SEQ ID NO: 5504445 - DNA, 21 bp, Homo sapiens
gtgttgggaggggaagggctg

SEQ ID NO: 5504446 - DNA, 14 bp, Homo sapiens
gtgttgggatactg

SEQ ID NO: 5504447 - DNA, 21 bp, Homo sapiens
gtgttgggatactgcagggcc

SEQ ID NO: 5504448 - DNA, 23 bp, Homo sapiens
gtgttggggaaaccttcatctga

SEQ ID NO: 5504449 - DNA, 18 bp, Homo sapiens
gtgttgggggaaatgttg

SEQ ID NO: 5504450 - DNA, 20 bp, Homo sapiens
gtgttggtctttctaatgta

SEQ ID NO: 5504451 - DNA, 18 bp, Homo sapiens
gtgttgtaattcttcagt

SEQ ID NO: 5504452 - DNA, 12 bp, Homo sapiens
gtgttgtacaat

SEQ ID NO: 5504453 - DNA, 23 bp, Homo sapiens
gtgttgtagctaattaggaagct

SEQ ID NO: 5504454 - DNA, 15 bp, Homo sapiens
gtgttgtatacttca

SEQ ID NO: 5504455 - DNA, 13 bp, Homo sapiens
gtgttgtatttct

SEQ ID NO: 5504456 - DNA, 15 bp, Homo sapiens
gtgttgtcagcaggc

SEQ ID NO: 5504457 - DNA, 16 bp, Homo sapiens
gtgttgtcagcaggca

SEQ ID NO: 5504458 - DNA, 17 bp, Homo sapiens
gtgttgtcagcctgtgc

SEQ ID NO: 5504459 - DNA, 19 bp, Homo sapiens
gtgttgtcagcctgtgctg

SEQ ID NO: 5504460 - DNA, 22 bp, Homo sapiens
gtgttgtcagcctgtgctgtgg

SEQ ID NO: 5504461 - DNA, 15 bp, Homo sapiens
gtgttgtcattgtaa

SEQ ID NO: 5504462 - DNA, 16 bp, Homo sapiens
gtgttgtccaggaagt

SEQ ID NO: 5504463 - DNA, 14 bp, Homo sapiens
gtgttgtcccttct

SEQ ID NO: 5504464 - DNA, 15 bp, Homo sapiens
gtgttgtctcttgag

SEQ ID NO: 5504465 - DNA, 17 bp, Homo sapiens
gtgttgtcttcagcagt

SEQ ID NO: 5504466 - DNA, 16 bp, Homo sapiens
gtgttgtggagaaaag

SEQ ID NO: 5504467 - DNA, 17 bp, Homo sapiens
gtgttgtgggcttcctg

SEQ ID NO: 5504468 - DNA, 13 bp, Homo sapiens
gtgttgtgtgagc

SEQ ID NO: 5504469 - DNA, 15 bp, Homo sapiens
gtgttgtgttcctgg

SEQ ID NO: 5504470 - DNA, 14 bp, Homo sapiens
gtgttgttgttgct

SEQ ID NO: 5504471 - DNA, 18 bp, Homo sapiens
gtgttgttgttgctgctg

SEQ ID NO: 5504472 - DNA, 13 bp, Homo sapiens
gtgttgttttctc

SEQ ID NO: 5504473 - DNA, 22 bp, Homo sapiens
gtgtttaaaaagtaagttaata

SEQ ID NO: 5504474 - DNA, 21 bp, Homo sapiens
gtgtttaaaaattgaaaaaag

SEQ ID NO: 5504475 - DNA, 13 bp, Homo sapiens
gtgtttaaatgct

SEQ ID NO: 5504476 - DNA, 20 bp, Homo sapiens
gtgtttaacattcacagccc

SEQ ID NO: 5504477 - DNA, 23 bp, Homo sapiens
gtgtttaacggcactgtggcctt

SEQ ID NO: 5504478 - DNA, 12 bp, Homo sapiens
gtgtttaactga

SEQ ID NO: 5504479 - DNA, 15 bp, Homo sapiens
gtgtttaattgtata

SEQ ID NO: 5504480 - DNA, 23 bp, Homo sapiens
gtgtttaattttggagtaacgtt

SEQ ID NO: 5504481 - DNA, 16 bp, Homo sapiens
gtgtttacaaaaggca

SEQ ID NO: 5504482 - DNA, 18 bp, Homo sapiens
gtgtttactatgtgccag

SEQ ID NO: 5504483 - DNA, 14 bp, Homo sapiens
gtgtttagaagcct

SEQ ID NO: 5504484 - DNA, 15 bp, Homo sapiens
gtgtttagaattgaa

SEQ ID NO: 5504485 - DNA, 22 bp, Homo sapiens
gtgtttataaaatataaacaaa

SEQ ID NO: 5504486 - DNA, 18 bp, Homo sapiens
gtgtttatatctcctttg

SEQ ID NO: 5504487 - DNA, 22 bp, Homo sapiens
gtgtttatcctatctctccaac

SEQ ID NO: 5504488 - DNA, 21 bp, Homo sapiens
gtgtttatgaaacagccattt

SEQ ID NO: 5504489 - DNA, 17 bp, Homo sapiens
gtgtttatgcatttcaa

SEQ ID NO: 5504490 - DNA, 16 bp, Homo sapiens
gtgtttatgtgctatt

SEQ ID NO: 5504491 - DNA, 18 bp, Homo sapiens
gtgtttatgtgctattaa

SEQ ID NO: 5504492 - DNA, 16 bp, Homo sapiens
gtgtttatgtgtgtgt

SEQ ID NO: 5504493 - DNA, 19 bp, Homo sapiens
gtgtttattaaaattctga

SEQ ID NO: 5504494 - DNA, 18 bp, Homo sapiens
gtgtttattataaagctt

SEQ ID NO: 5504495 - DNA, 16 bp, Homo sapiens
gtgtttatttttcata

SEQ ID NO: 5504496 - DNA, 18 bp, Homo sapiens
gtgtttcaattctgtaat

SEQ ID NO: 5504497 - DNA, 19 bp, Homo sapiens
gtgtttcaggacagctgct

SEQ ID NO: 5504498 - DNA, 11 bp, Homo sapiens
gtgtttccagt

SEQ ID NO: 5504499 - DNA, 18 bp, Homo sapiens
gtgtttccatattttata

SEQ ID NO: 5504500 - DNA, 14 bp, Homo sapiens
gtgtttccatctca

SEQ ID NO: 5504501 - DNA, 15 bp, Homo sapiens
gtgtttcccataatt

SEQ ID NO: 5504502 - DNA, 20 bp, Homo sapiens
gtgtttccctagactctgta

SEQ ID NO: 5504503 - DNA, 21 bp, Homo sapiens
gtgtttccctagactctgtaa

SEQ ID NO: 5504504 - DNA, 15 bp, Homo sapiens
gtgtttccctctgtg

SEQ ID NO: 5504505 - DNA, 18 bp, Homo sapiens
gtgtttcccttcctcggt

SEQ ID NO: 5504506 - DNA, 20 bp, Homo sapiens
gtgtttcgttaagcagtaca

SEQ ID NO: 5504507 - DNA, 19 bp, Homo sapiens
gtgtttctagcactggcct

SEQ ID NO: 5504508 - DNA, 11 bp, Homo sapiens
gtgtttctagg

SEQ ID NO: 5504509 - DNA, 18 bp, Homo sapiens
gtgtttctctaaggaatt

SEQ ID NO: 5504510 - DNA, 13 bp, Homo sapiens
gtgtttctgactc

SEQ ID NO: 5504511 - DNA, 17 bp, Homo sapiens
gtgtttctgcagaggca

SEQ ID NO: 5504512 - DNA, 13 bp, Homo sapiens
gtgtttctggagt

SEQ ID NO: 5504513 - DNA, 12 bp, Homo sapiens
gtgtttctgtaa

SEQ ID NO: 5504514 - DNA, 19 bp, Homo sapiens
gtgtttctgtaacaaattg

SEQ ID NO: 5504515 - DNA, 21 bp, Homo sapiens
gtgtttctgtaacaaattggg

SEQ ID NO: 5504516 - DNA, 12 bp, Homo sapiens
gtgtttctgtat

SEQ ID NO: 5504517 - DNA, 13 bp, Homo sapiens
gtgtttctgtcct

SEQ ID NO: 5504518 - DNA, 21 bp, Homo sapiens
gtgtttctgtcctgtaactgt

SEQ ID NO: 5504519 - DNA, 15 bp, Homo sapiens
gtgtttctgttatta

SEQ ID NO: 5504520 - DNA, 12 bp, Homo sapiens
gtgtttctgttc

SEQ ID NO: 5504521 - DNA, 23 bp, Homo sapiens
gtgtttgaaaaagctggtctttg

SEQ ID NO: 5504522 - DNA, 13 bp, Homo sapiens
gtgtttgaagttt

SEQ ID NO: 5504523 - DNA, 16 bp, Homo sapiens
gtgtttgacatgtgaa

SEQ ID NO: 5504524 - DNA, 24 bp, Homo sapiens
gtgtttgacatgtgaagctatttg

SEQ ID NO: 5504525 - DNA, 16 bp, Homo sapiens
gtgtttgactgtaatg

SEQ ID NO: 5504526 - DNA, 20 bp, Homo sapiens
gtgtttgaggccaaaacaga

SEQ ID NO: 5504527 - DNA, 15 bp, Homo sapiens
gtgtttgattggctt

SEQ ID NO: 5504528 - DNA, 14 bp, Homo sapiens
gtgtttgcttggtg

SEQ ID NO: 5504529 - DNA, 13 bp, Homo sapiens
gtgtttgctttct

SEQ ID NO: 5504530 - DNA, 20 bp, Homo sapiens
gtgtttggatacatctgctg

SEQ ID NO: 5504531 - DNA, 15 bp, Homo sapiens
gtgtttggcttggcc

SEQ ID NO: 5504532 - DNA, 15 bp, Homo sapiens
gtgtttgggaaaggc

SEQ ID NO: 5504533 - DNA, 15 bp, Homo sapiens
gtgtttggtttacat

SEQ ID NO: 5504534 - DNA, 14 bp, Homo sapiens
gtgtttgtatataa

SEQ ID NO: 5504535 - DNA, 16 bp, Homo sapiens
gtgtttgtatgtctgt

SEQ ID NO: 5504536 - DNA, 17 bp, Homo sapiens
gtgtttgtatgtctgtg

SEQ ID NO: 5504537 - DNA, 14 bp, Homo sapiens
gtgtttgtcaaaaa

SEQ ID NO: 5504538 - DNA, 12 bp, Homo sapiens
gtgtttgtcatt

SEQ ID NO: 5504539 - DNA, 12 bp, Homo sapiens
gtgtttgtctct

SEQ ID NO: 5504540 - DNA, 15 bp, Homo sapiens
gtgtttgtctcttct

SEQ ID NO: 5504541 - DNA, 14 bp, Homo sapiens
gtgtttgtctgtgt

SEQ ID NO: 5504542 - DNA, 11 bp, Homo sapiens
gtgtttgtgtg

SEQ ID NO: 5504543 - DNA, 11 bp, Homo sapiens
gtgtttgtgtt

SEQ ID NO: 5504544 - DNA, 16 bp, Homo sapiens
gtgttttaagaaatgt

SEQ ID NO: 5504545 - DNA, 16 bp, Homo sapiens
gtgttttaattgtaaa

SEQ ID NO: 5504546 - DNA, 15 bp, Homo sapiens
gtgttttaatttaaa

SEQ ID NO: 5504547 - DNA, 16 bp, Homo sapiens
gtgttttacagtatat

SEQ ID NO: 5504548 - DNA, 16 bp, Homo sapiens
gtgttttaggtgcctg

SEQ ID NO: 5504549 - DNA, 15 bp, Homo sapiens
gtgttttatttccta

SEQ ID NO: 5504550 - DNA, 16 bp, Homo sapiens
gtgttttatttcctat

SEQ ID NO: 5504551 - DNA, 16 bp, Homo sapiens
gtgttttcattttaga

SEQ ID NO: 5504552 - DNA, 14 bp, Homo sapiens
gtgttttcctaaac

SEQ ID NO: 5504553 - DNA, 20 bp, Homo sapiens
gtgttttcttgtaaatgttt

SEQ ID NO: 5504554 - DNA, 13 bp, Homo sapiens
gtgttttcttgtg

SEQ ID NO: 5504555 - DNA, 15 bp, Homo sapiens
gtgttttgaaagaat

SEQ ID NO: 5504556 - DNA, 20 bp, Homo sapiens
gtgttttgaaagaatagaac

SEQ ID NO: 5504557 - DNA, 22 bp, Homo sapiens
gtgttttgccctatatacctca

SEQ ID NO: 5504558 - DNA, 14 bp, Homo sapiens
gttaataaaggttt

SEQ ID NO: 5504559 - DNA, 21 bp, Homo sapiens
gttaataaaggtttcgttgca

SEQ ID NO: 5504560 - DNA, 15 bp, Homo sapiens
gttaataaattaaaa

SEQ ID NO: 5504561 - DNA, 15 bp, Homo sapiens
gttaataacagctcc

SEQ ID NO: 5504562 - DNA, 18 bp, Homo sapiens
gttaataacagctccttt

SEQ ID NO: 5504563 - DNA, 19 bp, Homo sapiens
gttaataagcaaaatcctg

SEQ ID NO: 5504564 - DNA, 21 bp, Homo sapiens
gttaataataagataatgatg

SEQ ID NO: 5504565 - DNA, 13 bp, Homo sapiens
gttaataatctat

SEQ ID NO: 5504566 - DNA, 14 bp, Homo sapiens
gttaatacaaggta

SEQ ID NO: 5504567 - DNA, 19 bp, Homo sapiens
gttaatacacagtacttta

SEQ ID NO: 5504568 - DNA, 22 bp, Homo sapiens
gttaatacatcacatcttattt

SEQ ID NO: 5504569 - DNA, 17 bp, Homo sapiens
gttaatacttaacattg

SEQ ID NO: 5504570 - DNA, 18 bp, Homo sapiens
gttaatagattatttcat

SEQ ID NO: 5504571 - DNA, 15 bp, Homo sapiens
gttaatagccagata

SEQ ID NO: 5504572 - DNA, 14 bp, Homo sapiens
gttaatataattta

SEQ ID NO: 5504573 - DNA, 20 bp, Homo sapiens
gttaatataccccaaattgt

SEQ ID NO: 5504574 - DNA, 18 bp, Homo sapiens
gttaatatcactcattaa

SEQ ID NO: 5504575 - DNA, 15 bp, Homo sapiens
gttaatatgtctttt

SEQ ID NO: 5504576 - DNA, 13 bp, Homo sapiens
gttaatattaatt

SEQ ID NO: 5504577 - DNA, 16 bp, Homo sapiens
gttaatattctttcaa

SEQ ID NO: 5504578 - DNA, 15 bp, Homo sapiens
gttaatatttaagac

SEQ ID NO: 5504579 - DNA, 13 bp, Homo sapiens
gttaatcaattta

SEQ ID NO: 5504580 - DNA, 21 bp, Homo sapiens
gttaatcaatttaaacccatt

SEQ ID NO: 5504581 - DNA, 18 bp, Homo sapiens
gttaatcatcttctcttt

SEQ ID NO: 5504582 - DNA, 18 bp, Homo sapiens
gttaatcattaggtgtga

SEQ ID NO: 5504583 - DNA, 23 bp, Homo sapiens
gttaatccaatcaatttaaatgt

SEQ ID NO: 5504584 - DNA, 19 bp, Homo sapiens
gttaatctctgttatgtac

SEQ ID NO: 5504585 - DNA, 23 bp, Homo sapiens
gttaatctctgttatgtactgta

SEQ ID NO: 5504586 - DNA, 21 bp, Homo sapiens
gttaatctgatgtataatgta

SEQ ID NO: 5504587 - DNA, 22 bp, Homo sapiens
gttaatctgatgtataatgtaa

SEQ ID NO: 5504588 - DNA, 14 bp, Homo sapiens
gttaatcttaatgt

SEQ ID NO: 5504589 - DNA, 14 bp, Homo sapiens
gttaatcttcatgg

SEQ ID NO: 5504590 - DNA, 16 bp, Homo sapiens
gttaatcttgctttct

SEQ ID NO: 5504591 - DNA, 17 bp, Homo sapiens
gttaatgaaaaatctga

SEQ ID NO: 5504592 - DNA, 16 bp, Homo sapiens
gttaatgaaaatgtca

SEQ ID NO: 5504593 - DNA, 21 bp, Homo sapiens
gttaatgaaggtgtgctacag

SEQ ID NO: 5504594 - DNA, 20 bp, Homo sapiens
gttaatgaatagaataaata

SEQ ID NO: 5504595 - DNA, 18 bp, Homo sapiens
gttaatgatggcagagga

SEQ ID NO: 5504596 - DNA, 22 bp, Homo sapiens
gttaatgatggttgatgggttc

SEQ ID NO: 5504597 - DNA, 18 bp, Homo sapiens
gttaatgcattgttgtaa

SEQ ID NO: 5504598 - DNA, 19 bp, Homo sapiens
gttaatgcttaagagggaa

SEQ ID NO: 5504599 - DNA, 16 bp, Homo sapiens
gttaatgtatataaaa

SEQ ID NO: 5504600 - DNA, 15 bp, Homo sapiens
gttaatgtcattgct

SEQ ID NO: 5504601 - DNA, 23 bp, Homo sapiens
gttaatgtcattgctaaaaaata

SEQ ID NO: 5504602 - DNA, 15 bp, Homo sapiens
gttaatgtgccaaaa

SEQ ID NO: 5504603 - DNA, 15 bp, Homo sapiens
gttaatgtggactgg

SEQ ID NO: 5504604 - DNA, 23 bp, Homo sapiens
gttaatgttatatcatatgtata

SEQ ID NO: 5504605 - DNA, 17 bp, Homo sapiens
gttaatgttgggattta

SEQ ID NO: 5504606 - DNA, 22 bp, Homo sapiens
gttaattaaagtaaaattattc

SEQ ID NO: 5504607 - DNA, 12 bp, Homo sapiens
gttaattaatgt

SEQ ID NO: 5504608 - DNA, 20 bp, Homo sapiens
gttaattacttttgaaaaag

SEQ ID NO: 5504609 - DNA, 23 bp, Homo sapiens
gttaattacttttgaaaaaggat

SEQ ID NO: 5504610 - DNA, 14 bp, Homo sapiens
gttaattagcattc

SEQ ID NO: 5504611 - DNA, 16 bp, Homo sapiens
gttaattataaacagc

SEQ ID NO: 5504612 - DNA, 21 bp, Homo sapiens
gttaattataaacagcagggt

SEQ ID NO: 5504613 - DNA, 15 bp, Homo sapiens
gttaattatgcagtg

SEQ ID NO: 5504614 - DNA, 16 bp, Homo sapiens
gttaattcctatgaag

SEQ ID NO: 5504615 - DNA, 15 bp, Homo sapiens
gttaattctttctca

SEQ ID NO: 5504616 - DNA, 13 bp, Homo sapiens
gttaattgattaa

SEQ ID NO: 5504617 - DNA, 19 bp, Homo sapiens
gttaattggttaatcactt

SEQ ID NO: 5504618 - DNA, 23 bp, Homo sapiens
gttaattgtaattgcatgacaaa

SEQ ID NO: 5504619 - DNA, 19 bp, Homo sapiens
gttaattgtatttatgtat

SEQ ID NO: 5504620 - DNA, 9 bp, Homo sapiens
gttaattta

SEQ ID NO: 5504621 - DNA, 12 bp, Homo sapiens
gttaatttaaag

SEQ ID NO: 5504622 - DNA, 17 bp, Homo sapiens
gttaatttaaagctgtt

SEQ ID NO: 5504623 - DNA, 22 bp, Homo sapiens
gttaatttagtggaaaaggcac

SEQ ID NO: 5504624 - DNA, 13 bp, Homo sapiens
gttaatttatcag

SEQ ID NO: 5504625 - DNA, 21 bp, Homo sapiens
gttaatttatccatgctggca

SEQ ID NO: 5504626 - DNA, 17 bp, Homo sapiens
gttaatttatctaaatt

SEQ ID NO: 5504627 - DNA, 17 bp, Homo sapiens
gttaatttcttgcaatt

SEQ ID NO: 5504628 - DNA, 18 bp, Homo sapiens
gttaattttattaaaatg

SEQ ID NO: 5504629 - DNA, 23 bp, Homo sapiens
gttaattttcctcattttgaatt

SEQ ID NO: 5504630 - DNA, 17 bp, Homo sapiens
gttaattttgaagtgct

SEQ ID NO: 5504631 - DNA, 15 bp, Homo sapiens
gttaattttgctaac

SEQ ID NO: 5504632 - DNA, 11 bp, Homo sapiens
gttaattttgg

SEQ ID NO: 5504633 - DNA, 19 bp, Homo sapiens
gttaatttttcctgcatgt

SEQ ID NO: 5504634 - DNA, 22 bp, Homo sapiens
gttaatttttcctgcatgttct

SEQ ID NO: 5504635 - DNA, 14 bp, Homo sapiens
gttaatttttctta

SEQ ID NO: 5504636 - DNA, 12 bp, Homo sapiens
gttaatttttga

SEQ ID NO: 5504637 - DNA, 20 bp, Homo sapiens
gttaattttttggtacaaaa

SEQ ID NO: 5504638 - DNA, 19 bp, Homo sapiens
gttacaaaagaaaaaagca

SEQ ID NO: 5504639 - DNA, 17 bp, Homo sapiens
gttacaaaatgtaactg

SEQ ID NO: 5504640 - DNA, 18 bp, Homo sapiens
gttacaaaatgtaactgt

SEQ ID NO: 5504641 - DNA, 21 bp, Homo sapiens
gttacaaaccaggtcaccatc

SEQ ID NO: 5504642 - DNA, 13 bp, Homo sapiens
gttacaaactgca

SEQ ID NO: 5504643 - DNA, 15 bp, Homo sapiens
gttacaaactgcaat

SEQ ID NO: 5504644 - DNA, 19 bp, Homo sapiens
gttacaaactgcaatagag

SEQ ID NO: 5504645 - DNA, 23 bp, Homo sapiens
gttacaaactgcaatagagactg

SEQ ID NO: 5504646 - DNA, 16 bp, Homo sapiens
gttacaaatttttact

SEQ ID NO: 5504647 - DNA, 19 bp, Homo sapiens
gttacaacagatttgtgaa

SEQ ID NO: 5504648 - DNA, 20 bp, Homo sapiens
gttacaacagatttgtgaac

SEQ ID NO: 5504649 - DNA, 20 bp, Homo sapiens
gttacaagattgtaagtaaa

SEQ ID NO: 5504650 - DNA, 13 bp, Homo sapiens
gttacaagtatac

SEQ ID NO: 5504651 - DNA, 12 bp, Homo sapiens
gttacaagtttg

SEQ ID NO: 5504652 - DNA, 16 bp, Homo sapiens
gttacaagtttgctaa

SEQ ID NO: 5504653 - DNA, 21 bp, Homo sapiens
gttacaagtttgctaaaagaa

SEQ ID NO: 5504654 - DNA, 20 bp, Homo sapiens
gttacaataaaactaaatgt

SEQ ID NO: 5504655 - DNA, 21 bp, Homo sapiens
gttacacaaaggacctcagct

SEQ ID NO: 5504656 - DNA, 21 bp, Homo sapiens
gttacacactttttaagaaat

SEQ ID NO: 5504657 - DNA, 22 bp, Homo sapiens
gttacacagaaatgctgctggc

SEQ ID NO: 5504658 - DNA, 11 bp, Homo sapiens
gttacacatac

SEQ ID NO: 5504659 - DNA, 12 bp, Homo sapiens
gttacacccttt

SEQ ID NO: 5504660 - DNA, 20 bp, Homo sapiens
gttacactaatttgaataaa

SEQ ID NO: 5504661 - DNA, 23 bp, Homo sapiens
gttacactggaggagagaagaat

SEQ ID NO: 5504662 - DNA, 17 bp, Homo sapiens
gttacactgggctgggt

SEQ ID NO: 5504663 - DNA, 22 bp, Homo sapiens
gttacactgttagaacactatt

SEQ ID NO: 5504664 - DNA, 22 bp, Homo sapiens
gttacactgttattttcagcat

SEQ ID NO: 5504665 - DNA, 17 bp, Homo sapiens
gttacactttttggaag

SEQ ID NO: 5504666 - DNA, 18 bp, Homo sapiens
gttacactttttggaagt

SEQ ID NO: 5504667 - DNA, 19 bp, Homo sapiens
gttacagaaagtggtgctc

SEQ ID NO: 5504668 - DNA, 21 bp, Homo sapiens
gttacagaaagtggtgctcag

SEQ ID NO: 5504669 - DNA, 22 bp, Homo sapiens
gttacagaaagtggtgctcagt

SEQ ID NO: 5504670 - DNA, 13 bp, Homo sapiens
gttacagaagctg

SEQ ID NO: 5504671 - DNA, 17 bp, Homo sapiens
gttacagacaaagcgtg

SEQ ID NO: 5504672 - DNA, 23 bp, Homo sapiens
gttacagccaagtgccaaatgct

SEQ ID NO: 5504673 - DNA, 13 bp, Homo sapiens
gttacagctcccc

SEQ ID NO: 5504674 - DNA, 16 bp, Homo sapiens
gttacagtatgcttgc

SEQ ID NO: 5504675 - DNA, 19 bp, Homo sapiens
gttacagtgagctgagagt

SEQ ID NO: 5504676 - DNA, 21 bp, Homo sapiens
gttacagtttatattgtggaa

SEQ ID NO: 5504677 - DNA, 19 bp, Homo sapiens
gttacagtttcttcatgca

SEQ ID NO: 5504678 - DNA, 19 bp, Homo sapiens
gttacataagataaatgtg

SEQ ID NO: 5504679 - DNA, 22 bp, Homo sapiens
gttacatacatttaaaaaacat

SEQ ID NO: 5504680 - DNA, 15 bp, Homo sapiens
gttacatatcaaaac

SEQ ID NO: 5504681 - DNA, 16 bp, Homo sapiens
gttacatctgtgcagg

SEQ ID NO: 5504682 - DNA, 12 bp, Homo sapiens
gttacatcttgt

SEQ ID NO: 5504683 - DNA, 14 bp, Homo sapiens
gttacatgaattaa

SEQ ID NO: 5504684 - DNA, 21 bp, Homo sapiens
gttacatgcatacttcaaaag

SEQ ID NO: 5504685 - DNA, 16 bp, Homo sapiens
gttacatgtttgcacc

SEQ ID NO: 5504686 - DNA, 14 bp, Homo sapiens
gttacattaaagcc

SEQ ID NO: 5504687 - DNA, 19 bp, Homo sapiens
gttacattaatgcccagcc

SEQ ID NO: 5504688 - DNA, 13 bp, Homo sapiens
gttacattaatgt

SEQ ID NO: 5504689 - DNA, 16 bp, Homo sapiens
gttacattaggaagat

SEQ ID NO: 5504690 - DNA, 12 bp, Homo sapiens
gttacatttatg

SEQ ID NO: 5504691 - DNA, 21 bp, Homo sapiens
gttacatttttaagtgctgca

SEQ ID NO: 5504692 - DNA, 17 bp, Homo sapiens
gttaccaaaaatatccc

SEQ ID NO: 5504693 - DNA, 14 bp, Homo sapiens
gttaccaaatacac

SEQ ID NO: 5504694 - DNA, 22 bp, Homo sapiens
gttaccaaatacacatttcaca

SEQ ID NO: 5504695 - DNA, 16 bp, Homo sapiens
gttaccaaatctcagt

SEQ ID NO: 5504696 - DNA, 19 bp, Homo sapiens
gttaccaatgtaacactgg

SEQ ID NO: 5504697 - DNA, 20 bp, Homo sapiens
gttaccacagcaactgacct

SEQ ID NO: 5504698 - DNA, 19 bp, Homo sapiens
gttaccatactgtctctgg

SEQ ID NO: 5504699 - DNA, 22 bp, Homo sapiens
gttaccatactgtctctggagt

SEQ ID NO: 5504700 - DNA, 15 bp, Homo sapiens
gttaccatgtctttc

SEQ ID NO: 5504701 - DNA, 21 bp, Homo sapiens
gttaccattaaaccatctccc

SEQ ID NO: 5504702 - DNA, 14 bp, Homo sapiens
gttaccattggaaa

SEQ ID NO: 5504703 - DNA, 16 bp, Homo sapiens
gttaccattggaaatt

SEQ ID NO: 5504704 - DNA, 22 bp, Homo sapiens
gttaccattttaacgctgccta

SEQ ID NO: 5504705 - DNA, 21 bp, Homo sapiens
gttaccatttttctggattta

SEQ ID NO: 5504706 - DNA, 13 bp, Homo sapiens
gttacccagagaa

SEQ ID NO: 5504707 - DNA, 15 bp, Homo sapiens
gttacccagcctggt

SEQ ID NO: 5504708 - DNA, 14 bp, Homo sapiens
gttacccatttgaa

SEQ ID NO: 5504709 - DNA, 14 bp, Homo sapiens
gttaccccaccctg

SEQ ID NO: 5504710 - DNA, 14 bp, Homo sapiens
gttaccgagacatg

SEQ ID NO: 5504711 - DNA, 15 bp, Homo sapiens
gttacctcctataaa

SEQ ID NO: 5504712 - DNA, 19 bp, Homo sapiens
gttacctgacctaaattag

SEQ ID NO: 5504713 - DNA, 21 bp, Homo sapiens
gttacctgtcattttgcactg

SEQ ID NO: 5504714 - DNA, 18 bp, Homo sapiens
gttacctgttagctccct

SEQ ID NO: 5504715 - DNA, 16 bp, Homo sapiens
gttacctgttccattg

SEQ ID NO: 5504716 - DNA, 12 bp, Homo sapiens
gttaccttaaat

SEQ ID NO: 5504717 - DNA, 23 bp, Homo sapiens
gttaccttttacagaataaaaga

SEQ ID NO: 5504718 - DNA, 23 bp, Homo sapiens
gttacgcacacgtacttaaatga

SEQ ID NO: 5504719 - DNA, 21 bp, Homo sapiens
gttacggcagtcacactgctg

SEQ ID NO: 5504720 - DNA, 18 bp, Homo sapiens
gttacgtagcctaaggct

SEQ ID NO: 5504721 - DNA, 21 bp, Homo sapiens
gttacgtgaagaaataaatga

SEQ ID NO: 5504722 - DNA, 19 bp, Homo sapiens
gttacgttggttaaataaa

SEQ ID NO: 5504723 - DNA, 13 bp, Homo sapiens
gttactaaaattt

SEQ ID NO: 5504724 - DNA, 15 bp, Homo sapiens
gttactacatgcact

SEQ ID NO: 5504725 - DNA, 15 bp, Homo sapiens
gttactaccctcacc

SEQ ID NO: 5504726 - DNA, 18 bp, Homo sapiens
gttactatgtatgttttt

SEQ ID NO: 5504727 - DNA, 19 bp, Homo sapiens
gttactcacacctgtaatc

SEQ ID NO: 5504728 - DNA, 23 bp, Homo sapiens
gttactcagatgacctgaggaaa

SEQ ID NO: 5504729 - DNA, 17 bp, Homo sapiens
gttactcagccctgggc

SEQ ID NO: 5504730 - DNA, 21 bp, Homo sapiens
gttactccaaaacttcgttta

SEQ ID NO: 5504731 - DNA, 19 bp, Homo sapiens
gttactccattactgtgat

SEQ ID NO: 5504732 - DNA, 17 bp, Homo sapiens
gttactcccctggctgg

SEQ ID NO: 5504733 - DNA, 18 bp, Homo sapiens
gttactctccaacctgga

SEQ ID NO: 5504734 - DNA, 11 bp, Homo sapiens
gttactctctt

SEQ ID NO: 5504735 - DNA, 13 bp, Homo sapiens
gttatttaaatga

SEQ ID NO: 5504736 - DNA, 17 bp, Homo sapiens
gttatttaatagctgtg

SEQ ID NO: 5504737 - DNA, 18 bp, Homo sapiens
gttatttaatatggtatt

SEQ ID NO: 5504738 - DNA, 16 bp, Homo sapiens
gttatttacactggtc

SEQ ID NO: 5504739 - DNA, 17 bp, Homo sapiens
gttatttacactggtct

SEQ ID NO: 5504740 - DNA, 15 bp, Homo sapiens
gttatttacttgaaa

SEQ ID NO: 5504741 - DNA, 15 bp, Homo sapiens
gttatttagtaaagt

SEQ ID NO: 5504742 - DNA, 19 bp, Homo sapiens
gttatttatagtcatttat

SEQ ID NO: 5504743 - DNA, 14 bp, Homo sapiens
gttatttatatatt

SEQ ID NO: 5504744 - DNA, 13 bp, Homo sapiens
gttatttatggtt

SEQ ID NO: 5504745 - DNA, 23 bp, Homo sapiens
gttatttattccccagtgactcc

SEQ ID NO: 5504746 - DNA, 18 bp, Homo sapiens
gttatttcatccagggaa

SEQ ID NO: 5504747 - DNA, 23 bp, Homo sapiens
gttatttccctacattaaacatg

SEQ ID NO: 5504748 - DNA, 18 bp, Homo sapiens
gttatttccctttagctg

SEQ ID NO: 5504749 - DNA, 17 bp, Homo sapiens
gttatttcctgctttct

SEQ ID NO: 5504750 - DNA, 16 bp, Homo sapiens
gttatttcttaaaatt

SEQ ID NO: 5504751 - DNA, 15 bp, Homo sapiens
gttatttcttccctg

SEQ ID NO: 5504752 - DNA, 22 bp, Homo sapiens
gttatttgaaaacatgtttatt

SEQ ID NO: 5504753 - DNA, 16 bp, Homo sapiens
gttatttgtaatagat

SEQ ID NO: 5504754 - DNA, 19 bp, Homo sapiens
gttattttaaatataaata

SEQ ID NO: 5504755 - DNA, 21 bp, Homo sapiens
gttattttaatacctttaaat

SEQ ID NO: 5504756 - DNA, 15 bp, Homo sapiens
gttattttcagcatg

SEQ ID NO: 5504757 - DNA, 12 bp, Homo sapiens
gttattttcagt

SEQ ID NO: 5504758 - DNA, 15 bp, Homo sapiens
gttattttcagtatt

SEQ ID NO: 5504759 - DNA, 17 bp, Homo sapiens
gttattttcagtatttt

SEQ ID NO: 5504760 - DNA, 16 bp, Homo sapiens
gttattttccttctga

SEQ ID NO: 5504761 - DNA, 20 bp, Homo sapiens
gttattttctacagtggttt

SEQ ID NO: 5504762 - DNA, 14 bp, Homo sapiens
gttattttggatat

SEQ ID NO: 5504763 - DNA, 20 bp, Homo sapiens
gttattttgtgtacaagttg

SEQ ID NO: 5504764 - DNA, 14 bp, Homo sapiens
gttatttttacagc

SEQ ID NO: 5504765 - DNA, 14 bp, Homo sapiens
gttatttttataca

SEQ ID NO: 5504766 - DNA, 15 bp, Homo sapiens
gttatttttatacag

SEQ ID NO: 5504767 - DNA, 20 bp, Homo sapiens
gttatttttatacagtagtg

SEQ ID NO: 5504768 - DNA, 23 bp, Homo sapiens
gttatttttatatcagcctgagt

SEQ ID NO: 5504769 - DNA, 20 bp, Homo sapiens
gttatttttattaaatgtat

SEQ ID NO: 5504770 - DNA, 14 bp, Homo sapiens
gttatttttattat

SEQ ID NO: 5504771 - DNA, 17 bp, Homo sapiens
gttatttttcaaggaag

SEQ ID NO: 5504772 - DNA, 19 bp, Homo sapiens
gttatttttctcttgtacc

SEQ ID NO: 5504773 - DNA, 14 bp, Homo sapiens
gttatttttgtaca

SEQ ID NO: 5504774 - DNA, 15 bp, Homo sapiens
gttatttttgtacat

SEQ ID NO: 5504775 - DNA, 16 bp, Homo sapiens
gttatttttgtatttt

SEQ ID NO: 5504776 - DNA, 13 bp, Homo sapiens
gttatttttgtct

SEQ ID NO: 5504777 - DNA, 19 bp, Homo sapiens
gttatttttgtctcgaaat

SEQ ID NO: 5504778 - DNA, 22 bp, Homo sapiens
gttatttttgtttcttccaaag

SEQ ID NO: 5504779 - DNA, 21 bp, Homo sapiens
gttattttttaattattattt

SEQ ID NO: 5504780 - DNA, 23 bp, Homo sapiens
gttattttttcagactgtgcaat

SEQ ID NO: 5504781 - DNA, 16 bp, Homo sapiens
gttcaaaaatttctgc

SEQ ID NO: 5504782 - DNA, 23 bp, Homo sapiens
gttcaaaacaaccactttctcag

SEQ ID NO: 5504783 - DNA, 16 bp, Homo sapiens
gttcaaaacattccaa

SEQ ID NO: 5504784 - DNA, 21 bp, Homo sapiens
gttcaaaacttattggaatgt

SEQ ID NO: 5504785 - DNA, 12 bp, Homo sapiens
gttcaaaagtgg

SEQ ID NO: 5504786 - DNA, 15 bp, Homo sapiens
gttcaaaatgttaat

SEQ ID NO: 5504787 - DNA, 15 bp, Homo sapiens
gttcaaactactgta

SEQ ID NO: 5504788 - DNA, 19 bp, Homo sapiens
gttcaaactactgtacatt

SEQ ID NO: 5504789 - DNA, 14 bp, Homo sapiens
gttcaaactgcagc

SEQ ID NO: 5504790 - DNA, 12 bp, Homo sapiens
gttcaaagaacc

SEQ ID NO: 5504791 - DNA, 13 bp, Homo sapiens
gttcaaagactgt

SEQ ID NO: 5504792 - DNA, 19 bp, Homo sapiens
gttcaaagactgtgaacag

SEQ ID NO: 5504793 - DNA, 22 bp, Homo sapiens
gttcaaagaggtgaacattaaa

SEQ ID NO: 5504794 - DNA, 21 bp, Homo sapiens
gttcaaagatgcattttgagt

SEQ ID NO: 5504795 - DNA, 13 bp, Homo sapiens
gttcaaagccagc

SEQ ID NO: 5504796 - DNA, 13 bp, Homo sapiens
gttcaaagtcatg

SEQ ID NO: 5504797 - DNA, 18 bp, Homo sapiens
gttcaaagtcatgatgtt

SEQ ID NO: 5504798 - DNA, 19 bp, Homo sapiens
gttcaaagtcatgatgttt

SEQ ID NO: 5504799 - DNA, 16 bp, Homo sapiens
gttcaaatattgtaaa

SEQ ID NO: 5504800 - DNA, 19 bp, Homo sapiens
gttcaaattcctgcaaaat

SEQ ID NO: 5504801 - DNA, 13 bp, Homo sapiens
gttcaacaaagaa

SEQ ID NO: 5504802 - DNA, 20 bp, Homo sapiens
gttcaacctggtggcaccag

SEQ ID NO: 5504803 - DNA, 14 bp, Homo sapiens
gttcaacttattaa

SEQ ID NO: 5504804 - DNA, 15 bp, Homo sapiens
gttcaacttatttca

SEQ ID NO: 5504805 - DNA, 17 bp, Homo sapiens
gttcaacttatttcata

SEQ ID NO: 5504806 - DNA, 15 bp, Homo sapiens
gttcaacttccagaa

SEQ ID NO: 5504807 - DNA, 13 bp, Homo sapiens
gttcaagaagact

SEQ ID NO: 5504808 - DNA, 16 bp, Homo sapiens
gttcaagaccagcctg

SEQ ID NO: 5504809 - DNA, 20 bp, Homo sapiens
gttcaagatcaaaaaggctt

SEQ ID NO: 5504810 - DNA, 22 bp, Homo sapiens
gttcaagcaatcctcctgcctc

SEQ ID NO: 5504811 - DNA, 18 bp, Homo sapiens
gttcaagcacactggaat

SEQ ID NO: 5504812 - DNA, 15 bp, Homo sapiens
gttcaagcagttctc

SEQ ID NO: 5504813 - DNA, 14 bp, Homo sapiens
gttcaagcccaggc

SEQ ID NO: 5504814 - DNA, 15 bp, Homo sapiens
gttcaagcccaggct

SEQ ID NO: 5504815 - DNA, 13 bp, Homo sapiens
gttcaagcctgtg

SEQ ID NO: 5504816 - DNA, 14 bp, Homo sapiens
gttcaagcctgtgg

SEQ ID NO: 5504817 - DNA, 19 bp, Homo sapiens
gttcaagcgactctcctgc

SEQ ID NO: 5504818 - DNA, 19 bp, Homo sapiens
gttcaagcgattctcctgt

SEQ ID NO: 5504819 - DNA, 19 bp, Homo sapiens
gttcaagcgattcttctgc

SEQ ID NO: 5504820 - DNA, 14 bp, Homo sapiens
gttcaagcgccaga

SEQ ID NO: 5504821 - DNA, 22 bp, Homo sapiens
gttcaaggaacttgaaaaatac

SEQ ID NO: 5504822 - DNA, 19 bp, Homo sapiens
gttcaaggccatccttccc

SEQ ID NO: 5504823 - DNA, 22 bp, Homo sapiens
gttcaaggtcactgtttcctgg

SEQ ID NO: 5504824 - DNA, 16 bp, Homo sapiens
gttcaagtattaagca

SEQ ID NO: 5504825 - DNA, 18 bp, Homo sapiens
gttcaagtgatctttcaa

SEQ ID NO: 5504826 - DNA, 23 bp, Homo sapiens
gttcaagtgattctcatgcctca

SEQ ID NO: 5504827 - DNA, 20 bp, Homo sapiens
gttcaagtgattctcctgcc

SEQ ID NO: 5504828 - DNA, 23 bp, Homo sapiens
gttcaagtgattctcctgcctca

SEQ ID NO: 5504829 - DNA, 24 bp, Homo sapiens
gttcaagtgattctcctgcctcag

SEQ ID NO: 5504830 - DNA, 22 bp, Homo sapiens
gttcaagtgattcttccacctc

SEQ ID NO: 5504831 - DNA, 15 bp, Homo sapiens
gttcaagtgcgtgac

SEQ ID NO: 5504832 - DNA, 20 bp, Homo sapiens
gttcaataaacttaacttta

SEQ ID NO: 5504833 - DNA, 23 bp, Homo sapiens
gttcaataaagcactgagcaagt

SEQ ID NO: 5504834 - DNA, 21 bp, Homo sapiens
gttcaatactcttgaaatgta

SEQ ID NO: 5504835 - DNA, 15 bp, Homo sapiens
gttcaatagaacatg

SEQ ID NO: 5504836 - DNA, 18 bp, Homo sapiens
gttcaatatgagtctcaa

SEQ ID NO: 5504837 - DNA, 23 bp, Homo sapiens
gttcaatctggattcatatttaa

SEQ ID NO: 5504838 - DNA, 19 bp, Homo sapiens
gttcaatgaatattgtaaa

SEQ ID NO: 5504839 - DNA, 12 bp, Homo sapiens
gttcaatgatct

SEQ ID NO: 5504840 - DNA, 13 bp, Homo sapiens
gttcaatgatcta

SEQ ID NO: 5504841 - DNA, 17 bp, Homo sapiens
gttcaatgatctaggtt

SEQ ID NO: 5504842 - DNA, 21 bp, Homo sapiens
gttcaatgatctaggtttaac

SEQ ID NO: 5504843 - DNA, 20 bp, Homo sapiens
gttcaatgcaaagtaaaaaa

SEQ ID NO: 5504844 - DNA, 15 bp, Homo sapiens
gttcaatgttccatt

SEQ ID NO: 5504845 - DNA, 18 bp, Homo sapiens
gttcaattatttccccca

SEQ ID NO: 5504846 - DNA, 19 bp, Homo sapiens
gttcaattatttcccccat

SEQ ID NO: 5504847 - DNA, 15 bp, Homo sapiens
gttcaattccctgaa

SEQ ID NO: 5504848 - DNA, 18 bp, Homo sapiens
gttcaattgtgtctgtgg

SEQ ID NO: 5504849 - DNA, 14 bp, Homo sapiens
gttcaatttcatgt

SEQ ID NO: 5504850 - DNA, 12 bp, Homo sapiens
gttcacaaactg

SEQ ID NO: 5504851 - DNA, 15 bp, Homo sapiens
gttcacaaactgtga

SEQ ID NO: 5504852 - DNA, 16 bp, Homo sapiens
gttcacaaactgtgaa

SEQ ID NO: 5504853 - DNA, 18 bp, Homo sapiens
gttcacaacataaggaga

SEQ ID NO: 5504854 - DNA, 14 bp, Homo sapiens
gttcacaccctgca

SEQ ID NO: 5504855 - DNA, 15 bp, Homo sapiens
gttcacaccctgcaa

SEQ ID NO: 5504856 - DNA, 19 bp, Homo sapiens
gttcacaccctgcaaggcc

SEQ ID NO: 5504857 - DNA, 17 bp, Homo sapiens
gttcacagaaaaagcat

SEQ ID NO: 5504858 - DNA, 13 bp, Homo sapiens
gttcacagaagga

SEQ ID NO: 5504859 - DNA, 16 bp, Homo sapiens
gttcacagcttttctt

SEQ ID NO: 5504860 - DNA, 19 bp, Homo sapiens
gttcacagcttttcttgat

SEQ ID NO: 5504861 - DNA, 11 bp, Homo sapiens
gttcacaggag

SEQ ID NO: 5504862 - DNA, 21 bp, Homo sapiens
gttcacaggaggccagtgggc

SEQ ID NO: 5504863 - DNA, 18 bp, Homo sapiens
gttcacatatgattctct

SEQ ID NO: 5504864 - DNA, 17 bp, Homo sapiens
gttcacattaactcagg

SEQ ID NO: 5504865 - DNA, 17 bp, Homo sapiens
gttcacattagaattag

SEQ ID NO: 5504866 - DNA, 11 bp, Homo sapiens
gttcaccagcc

SEQ ID NO: 5504867 - DNA, 13 bp, Homo sapiens
gttcaccagccct

SEQ ID NO: 5504868 - DNA, 18 bp, Homo sapiens
gttcaccagccctgagcc

SEQ ID NO: 5504869 - DNA, 22 bp, Homo sapiens
gttcaccatctcttcattcaaa

SEQ ID NO: 5504870 - DNA, 13 bp, Homo sapiens
gttcaccatgttg

SEQ ID NO: 5504871 - DNA, 17 bp, Homo sapiens
gttcaccattataatga

SEQ ID NO: 5504872 - DNA, 19 bp, Homo sapiens
gttcacccagcgccctcta

SEQ ID NO: 5504873 - DNA, 12 bp, Homo sapiens
gttcacccctcc

SEQ ID NO: 5504874 - DNA, 19 bp, Homo sapiens
gttcaccccttatcctgag

SEQ ID NO: 5504875 - DNA, 15 bp, Homo sapiens
gttcaccctgcatta

SEQ ID NO: 5504876 - DNA, 22 bp, Homo sapiens
gttcacctccaagcatttcatg

SEQ ID NO: 5504877 - DNA, 21 bp, Homo sapiens
gttcaccttcaaaatgttcta

SEQ ID NO: 5504878 - DNA, 22 bp, Homo sapiens
gttcaccttcaaaatgttctat

SEQ ID NO: 5504879 - DNA, 14 bp, Homo sapiens
gttcaccttggaag

SEQ ID NO: 5504880 - DNA, 22 bp, Homo sapiens
gttcaccttggaagggcgttct

SEQ ID NO: 5504881 - DNA, 15 bp, Homo sapiens
gttcacctttgtagc

SEQ ID NO: 5504882 - DNA, 17 bp, Homo sapiens
gttcacctttgtagcac

SEQ ID NO: 5504883 - DNA, 20 bp, Homo sapiens
gttcacgccattctcctgcc

SEQ ID NO: 5504884 - DNA, 21 bp, Homo sapiens
gttcacgccattctcctgcct

SEQ ID NO: 5504885 - DNA, 16 bp, Homo sapiens
gttcacgggtggcctg

SEQ ID NO: 5504886 - DNA, 18 bp, Homo sapiens
gttcacgtaagatacaag

SEQ ID NO: 5504887 - DNA, 20 bp, Homo sapiens
gttcacgtaatcctcctgag

SEQ ID NO: 5504888 - DNA, 23 bp, Homo sapiens
gttcacgtacaaaactctgtata

SEQ ID NO: 5504889 - DNA, 16 bp, Homo sapiens
gttcacgtgactcctc

SEQ ID NO: 5504890 - DNA, 19 bp, Homo sapiens
gttcacgtgcagctcaagg

SEQ ID NO: 5504891 - DNA, 20 bp, Homo sapiens
gttcactaaactctgaataa

SEQ ID NO: 5504892 - DNA, 15 bp, Homo sapiens
gttcactaaagcagt

SEQ ID NO: 5504893 - DNA, 23 bp, Homo sapiens
gttcactccatttggtcctttct

SEQ ID NO: 5504894 - DNA, 24 bp, Homo sapiens
gttcactctacttagcatgtccct

SEQ ID NO: 5504895 - DNA, 20 bp, Homo sapiens
gttcactcttggagcctgca

SEQ ID NO: 5504896 - DNA, 20 bp, Homo sapiens
gttcactgaaggtgattcac

SEQ ID NO: 5504897 - DNA, 24 bp, Homo sapiens
gttcactgagctccccagatctcc

SEQ ID NO: 5504898 - DNA, 22 bp, Homo sapiens
gttcactgcactgttcaggagt

SEQ ID NO: 5504899 - DNA, 21 bp, Homo sapiens
gttcacttaaaagctggcttt

SEQ ID NO: 5504900 - DNA, 17 bp, Homo sapiens
gttcacttcaaagctaa

SEQ ID NO: 5504901 - DNA, 21 bp, Homo sapiens
gttcacttcctagagcatctg

SEQ ID NO: 5504902 - DNA, 17 bp, Homo sapiens
gttcacttctaaaccaa

SEQ ID NO: 5504903 - DNA, 20 bp, Homo sapiens
gttcacttgccatgcaggaa

SEQ ID NO: 5504904 - DNA, 19 bp, Homo sapiens
gttcacttgggctctctct

SEQ ID NO: 5504905 - DNA, 16 bp, Homo sapiens
gttcacttttgacaaa

SEQ ID NO: 5504906 - DNA, 11 bp, Homo sapiens
gttcacttttt

SEQ ID NO: 5504907 - DNA, 12 bp, Homo sapiens
gttcagaaaaaa

SEQ ID NO: 5504908 - DNA, 16 bp, Homo sapiens
gttcagaaaaccactt

SEQ ID NO: 5504909 - DNA, 17 bp, Homo sapiens
gttcagaaaagcacctc

SEQ ID NO: 5504910 - DNA, 17 bp, Homo sapiens
gttcagaaatagctcct

SEQ ID NO: 5504911 - DNA, 20 bp, Homo sapiens
gttcagaaatagctcctcaa

SEQ ID NO: 5504912 - DNA, 16 bp, Homo sapiens
gttccctgttcttcct

SEQ ID NO: 5504913 - DNA, 15 bp, Homo sapiens
gttccctgttcttcg

SEQ ID NO: 5504914 - DNA, 19 bp, Homo sapiens
gttcccttcaagtataata

SEQ ID NO: 5504915 - DNA, 19 bp, Homo sapiens
gttcccttcctctgtgcca

SEQ ID NO: 5504916 - DNA, 19 bp, Homo sapiens
gttcccttcctcttcctgc

SEQ ID NO: 5504917 - DNA, 22 bp, Homo sapiens
gttcccttcctcttcctgccct

SEQ ID NO: 5504918 - DNA, 19 bp, Homo sapiens
gttcccttcctgccctgtg

SEQ ID NO: 5504919 - DNA, 14 bp, Homo sapiens
gttcccttctcccc

SEQ ID NO: 5504920 - DNA, 22 bp, Homo sapiens
gttcccttgaaactttgggaaa

SEQ ID NO: 5504921 - DNA, 12 bp, Homo sapiens
gttcccttgaat

SEQ ID NO: 5504922 - DNA, 14 bp, Homo sapiens
gttcccttgaccat

SEQ ID NO: 5504923 - DNA, 15 bp, Homo sapiens
gttcccttgaccatt

SEQ ID NO: 5504924 - DNA, 23 bp, Homo sapiens
gttcccttgaccattggctgcgc

SEQ ID NO: 5504925 - DNA, 20 bp, Homo sapiens
gttcccttgagggctgcagt

SEQ ID NO: 5504926 - DNA, 14 bp, Homo sapiens
gttcccttggcctc

SEQ ID NO: 5504927 - DNA, 15 bp, Homo sapiens
gttcccttgtaaaga

SEQ ID NO: 5504928 - DNA, 12 bp, Homo sapiens
gttcccttgtgt

SEQ ID NO: 5504929 - DNA, 22 bp, Homo sapiens
gttccctttccttccatcccta

SEQ ID NO: 5504930 - DNA, 19 bp, Homo sapiens
gttccctttgccttaaacc

SEQ ID NO: 5504931 - DNA, 17 bp, Homo sapiens
gttccctttgctccacc

SEQ ID NO: 5504932 - DNA, 23 bp, Homo sapiens
gttccctttggggatagtctgga

SEQ ID NO: 5504933 - DNA, 22 bp, Homo sapiens
gttcccttttttggctgctgaa

SEQ ID NO: 5504934 - DNA, 23 bp, Homo sapiens
gttccgcccgccctcccggagag

SEQ ID NO: 5504935 - DNA, 22 bp, Homo sapiens
gttccgcttctctcttttaaag

SEQ ID NO: 5504936 - DNA, 14 bp, Homo sapiens
gttccggcatggac

SEQ ID NO: 5504937 - DNA, 14 bp, Homo sapiens
gttccggcctgggc

SEQ ID NO: 5504938 - DNA, 19 bp, Homo sapiens
gttccggcctgggcaccag

SEQ ID NO: 5504939 - DNA, 15 bp, Homo sapiens
gttccggggagaaac

SEQ ID NO: 5504940 - DNA, 16 bp, Homo sapiens
gttccggtccccacag

SEQ ID NO: 5504941 - DNA, 16 bp, Homo sapiens
gttccgtctcctctcc

SEQ ID NO: 5504942 - DNA, 19 bp, Homo sapiens
gttccgtgggaccctcagc

SEQ ID NO: 5504943 - DNA, 21 bp, Homo sapiens
gttccgtgggaccctcagcag

SEQ ID NO: 5504944 - DNA, 19 bp, Homo sapiens
gttccgtgggatgccataa

SEQ ID NO: 5504945 - DNA, 13 bp, Homo sapiens
gttccgtgtgggc

SEQ ID NO: 5504946 - DNA, 18 bp, Homo sapiens
gttccgttcatctgagga

SEQ ID NO: 5504947 - DNA, 23 bp, Homo sapiens
gttccgttcatctgaggagtcca

SEQ ID NO: 5504948 - DNA, 18 bp, Homo sapiens
gttcctaaactctgaaat

SEQ ID NO: 5504949 - DNA, 19 bp, Homo sapiens
gttcctaagaagcttctaa

SEQ ID NO: 5504950 - DNA, 21 bp, Homo sapiens
gttcctaagaagcttctaata

SEQ ID NO: 5504951 - DNA, 14 bp, Homo sapiens
gttcctaagttctt

SEQ ID NO: 5504952 - DNA, 14 bp, Homo sapiens
gttcctaatcctct

SEQ ID NO: 5504953 - DNA, 17 bp, Homo sapiens
gttcctacacaggacag

SEQ ID NO: 5504954 - DNA, 22 bp, Homo sapiens
gttcctaccgtactccctgcac

SEQ ID NO: 5504955 - DNA, 15 bp, Homo sapiens
gttcctagagtagag

SEQ ID NO: 5504956 - DNA, 23 bp, Homo sapiens
gttcctagcactgccccacatgc

SEQ ID NO: 5504957 - DNA, 22 bp, Homo sapiens
gttcctcaatggccttttgcta

SEQ ID NO: 5504958 - DNA, 13 bp, Homo sapiens
gttcctcaccaat

SEQ ID NO: 5504959 - DNA, 23 bp, Homo sapiens
gttcctcagcacccctagcatga

SEQ ID NO: 5504960 - DNA, 17 bp, Homo sapiens
gttcctcatccatgcag

SEQ ID NO: 5504961 - DNA, 21 bp, Homo sapiens
gttcctcatctgagaggctct

SEQ ID NO: 5504962 - DNA, 12 bp, Homo sapiens
gttcctcatggc

SEQ ID NO: 5504963 - DNA, 18 bp, Homo sapiens
gttcctcatgttgctgaa

SEQ ID NO: 5504964 - DNA, 22 bp, Homo sapiens
gttcctcattagcattttgcta

SEQ ID NO: 5504965 - DNA, 14 bp, Homo sapiens
gttcctccagccac

SEQ ID NO: 5504966 - DNA, 15 bp, Homo sapiens
gttcctccagccacc

SEQ ID NO: 5504967 - DNA, 17 bp, Homo sapiens
gttcctccagccacctc

SEQ ID NO: 5504968 - DNA, 22 bp, Homo sapiens
gttcctccccagccccctggca

SEQ ID NO: 5504969 - DNA, 22 bp, Homo sapiens
gttcctcccccagttcctccca

SEQ ID NO: 5504970 - DNA, 23 bp, Homo sapiens
gttcctcccctccagctccctgt

SEQ ID NO: 5504971 - DNA, 20 bp, Homo sapiens
gttcctcccctgtagggttt

SEQ ID NO: 5504972 - DNA, 23 bp, Homo sapiens
gttcctcctacttacaacccagg

SEQ ID NO: 5504973 - DNA, 22 bp, Homo sapiens
gttcctcctaggcgctcagagg

SEQ ID NO: 5504974 - DNA, 13 bp, Homo sapiens
gttcctcctcagc

SEQ ID NO: 5504975 - DNA, 16 bp, Homo sapiens
gttcctcctcagcctc

SEQ ID NO: 5504976 - DNA, 23 bp, Homo sapiens
gttcctcgggatgaaaagccata

SEQ ID NO: 5504977 - DNA, 20 bp, Homo sapiens
gttcctcggtgggccagagc

SEQ ID NO: 5504978 - DNA, 20 bp, Homo sapiens
gttcctcgttctccctggga

SEQ ID NO: 5504979 - DNA, 14 bp, Homo sapiens
gttcctctctccca

SEQ ID NO: 5504980 - DNA, 12 bp, Homo sapiens
gttcctctgcct

SEQ ID NO: 5504981 - DNA, 13 bp, Homo sapiens
gttcctctgcctg

SEQ ID NO: 5504982 - DNA, 18 bp, Homo sapiens
gttcctctgggtttctaa

SEQ ID NO: 5504983 - DNA, 19 bp, Homo sapiens
gttcctctgggtttctaag

SEQ ID NO: 5504984 - DNA, 19 bp, Homo sapiens
gttcctctttgccctgagg

SEQ ID NO: 5504985 - DNA, 22 bp, Homo sapiens
gttcctcttttctttcaagaac

SEQ ID NO: 5504986 - DNA, 16 bp, Homo sapiens
gttcctgaacctgatg

SEQ ID NO: 5504987 - DNA, 14 bp, Homo sapiens
gttcctgaagctgc

SEQ ID NO: 5504988 - DNA, 15 bp, Homo sapiens
gttcctgaagctgct

SEQ ID NO: 5504989 - DNA, 16 bp, Homo sapiens
gttcctgaagctgctg

SEQ ID NO: 5504990 - DNA, 18 bp, Homo sapiens
gttcctgaagctgctgtg

SEQ ID NO: 5504991 - DNA, 20 bp, Homo sapiens
gttcctgaagctgctgtgtc

SEQ ID NO: 5504992 - DNA, 21 bp, Homo sapiens
gttcctgaattctatttgctg

SEQ ID NO: 5504993 - DNA, 20 bp, Homo sapiens
gttcctgacatcacagcagc

SEQ ID NO: 5504994 - DNA, 21 bp, Homo sapiens
gttcctgacatcacagcagcc

SEQ ID NO: 5504995 - DNA, 14 bp, Homo sapiens
gttcctgactggca

SEQ ID NO: 5504996 - DNA, 15 bp, Homo sapiens
gttcctgataattgt

SEQ ID NO: 5504997 - DNA, 22 bp, Homo sapiens
gttcctgatagctacccacaga

SEQ ID NO: 5504998 - DNA, 16 bp, Homo sapiens
gttcctgatgacccag

SEQ ID NO: 5504999 - DNA, 18 bp, Homo sapiens
gttcctgatttttcatat

SEQ ID NO: 5505000 - DNA, 15 bp, Homo sapiens
gttcctgcaatgaag

SEQ ID NO: 5505001 - DNA, 12 bp, Homo sapiens
gttcctgcactc

SEQ ID NO: 5505002 - DNA, 16 bp, Homo sapiens
gttcctgcactccaga

SEQ ID NO: 5505003 - DNA, 17 bp, Homo sapiens
gttcctgcactccagaa

SEQ ID NO: 5505004 - DNA, 19 bp, Homo sapiens
gttcctgcagccagaaagg

SEQ ID NO: 5505005 - DNA, 15 bp, Homo sapiens
gttcctgccccaccc

SEQ ID NO: 5505006 - DNA, 20 bp, Homo sapiens
gttcctgccccaccctaact

SEQ ID NO: 5505007 - DNA, 18 bp, Homo sapiens
gttcctgcccccgccctg

SEQ ID NO: 5505008 - DNA, 13 bp, Homo sapiens
gttcctgccttct

SEQ ID NO: 5505009 - DNA, 14 bp, Homo sapiens
gttcctgccttctc

SEQ ID NO: 5505010 - DNA, 18 bp, Homo sapiens
gttcctgccttctcttct

SEQ ID NO: 5505011 - DNA, 20 bp, Homo sapiens
gttcctgcggagtgaagagg

SEQ ID NO: 5505012 - DNA, 13 bp, Homo sapiens
gttcctgctgcct

SEQ ID NO: 5505013 - DNA, 14 bp, Homo sapiens
gttcctgctgctgt

SEQ ID NO: 5505014 - DNA, 15 bp, Homo sapiens
gttcctgctgtattt

SEQ ID NO: 5505015 - DNA, 16 bp, Homo sapiens
gttcctgctgtatttc

SEQ ID NO: 5505016 - DNA, 19 bp, Homo sapiens
gttcctgctgtatttcctg

SEQ ID NO: 5505017 - DNA, 19 bp, Homo sapiens
gttcctgctgtcctggtgg

SEQ ID NO: 5505018 - DNA, 12 bp, Homo sapiens
gttcctgctttc

SEQ ID NO: 5505019 - DNA, 15 bp, Homo sapiens
gttcctgctttctct

SEQ ID NO: 5505020 - DNA, 23 bp, Homo sapiens
gttcctggacaccacccagagca

SEQ ID NO: 5505021 - DNA, 13 bp, Homo sapiens
gttcctggagttt

SEQ ID NO: 5505022 - DNA, 12 bp, Homo sapiens
gttcctggcaat

SEQ ID NO: 5505023 - DNA, 13 bp, Homo sapiens
gttcctggcaata

SEQ ID NO: 5505024 - DNA, 11 bp, Homo sapiens
gttcctggcat

SEQ ID NO: 5505025 - DNA, 22 bp, Homo sapiens
gttcctggcctcagccagctgc

SEQ ID NO: 5505026 - DNA, 16 bp, Homo sapiens
gttcctggctcagcct

SEQ ID NO: 5505027 - DNA, 12 bp, Homo sapiens
gttcctggctga

SEQ ID NO: 5505028 - DNA, 22 bp, Homo sapiens
gttcctggggcatccatggggt

SEQ ID NO: 5505029 - DNA, 22 bp, Homo sapiens
gttcctggggccgcctgccctg

SEQ ID NO: 5505030 - DNA, 19 bp, Homo sapiens
gttcctggggtgccctcca

SEQ ID NO: 5505031 - DNA, 21 bp, Homo sapiens
gttcctggttgttcctgcatc

SEQ ID NO: 5505032 - DNA, 20 bp, Homo sapiens
gttcctgtaaaatccattta

SEQ ID NO: 5505033 - DNA, 15 bp, Homo sapiens
gttcctgtcccacat

SEQ ID NO: 5505034 - DNA, 12 bp, Homo sapiens
gttcctgtctca

SEQ ID NO: 5505035 - DNA, 16 bp, Homo sapiens
gttcctgtgcacagcc

SEQ ID NO: 5505036 - DNA, 14 bp, Homo sapiens
gttcctgtggagac

SEQ ID NO: 5505037 - DNA, 16 bp, Homo sapiens
gttcctgtggagacac

SEQ ID NO: 5505038 - DNA, 17 bp, Homo sapiens
gttcctgtggccaggag

SEQ ID NO: 5505039 - DNA, 16 bp, Homo sapiens
gttcctgtggctccct

SEQ ID NO: 5505040 - DNA, 15 bp, Homo sapiens
gttcctgttctcagc

SEQ ID NO: 5505041 - DNA, 22 bp, Homo sapiens
gttcctgtttgaacccaggaga

SEQ ID NO: 5505042 - DNA, 23 bp, Homo sapiens
gttccttaagtggctgtgattaa

SEQ ID NO: 5505043 - DNA, 19 bp, Homo sapiens
gttccttaggttttctttg

SEQ ID NO: 5505044 - DNA, 18 bp, Homo sapiens
gttccttatttctctctc

SEQ ID NO: 5505045 - DNA, 14 bp, Homo sapiens
gttccttcccaatc

SEQ ID NO: 5505046 - DNA, 17 bp, Homo sapiens
gttccttcccaatccag

SEQ ID NO: 5505047 - DNA, 13 bp, Homo sapiens
gttccttcctcca

SEQ ID NO: 5505048 - DNA, 19 bp, Homo sapiens
gttccttcctctgagcctt

SEQ ID NO: 5505049 - DNA, 19 bp, Homo sapiens
gttccttcctgcagacctg

SEQ ID NO: 5505050 - DNA, 22 bp, Homo sapiens
gttccttcctgcagacctggct

SEQ ID NO: 5505051 - DNA, 23 bp, Homo sapiens
gttccttcctgcagacctggctg

SEQ ID NO: 5505052 - DNA, 24 bp, Homo sapiens
gttccttcctgcagacctggctgg

SEQ ID NO: 5505053 - DNA, 13 bp, Homo sapiens
gttccttcctgcg

SEQ ID NO: 5505054 - DNA, 21 bp, Homo sapiens
gttccttcgagggttccaggc

SEQ ID NO: 5505055 - DNA, 14 bp, Homo sapiens
gttccttctctggg

SEQ ID NO: 5505056 - DNA, 12 bp, Homo sapiens
gttccttctgct

SEQ ID NO: 5505057 - DNA, 16 bp, Homo sapiens
gttccttctgcttctc

SEQ ID NO: 5505058 - DNA, 17 bp, Homo sapiens
gttccttctgcttctcc

SEQ ID NO: 5505059 - DNA, 12 bp, Homo sapiens
gttccttctgtg

SEQ ID NO: 5505060 - DNA, 13 bp, Homo sapiens
gttccttctgtga

SEQ ID NO: 5505061 - DNA, 14 bp, Homo sapiens
gttccttctgtgaa

SEQ ID NO: 5505062 - DNA, 15 bp, Homo sapiens
gttccttctgtgaag

SEQ ID NO: 5505063 - DNA, 15 bp, Homo sapiens
gttccttgccttaat

SEQ ID NO: 5505064 - DNA, 14 bp, Homo sapiens
gttccttgctctct

SEQ ID NO: 5505065 - DNA, 21 bp, Homo sapiens
gttcctttcatctctctacct

SEQ ID NO: 5505066 - DNA, 21 bp, Homo sapiens
gttcctttccaacgtttggaa

SEQ ID NO: 5505067 - DNA, 23 bp, Homo sapiens
gttcctttctggaattgggctcc

SEQ ID NO: 5505068 - DNA, 13 bp, Homo sapiens
gttcctttctttt

SEQ ID NO: 5505069 - DNA, 17 bp, Homo sapiens
gttcctttgaagaattg

SEQ ID NO: 5505070 - DNA, 19 bp, Homo sapiens
gttcctttgtgtgtactca

SEQ ID NO: 5505071 - DNA, 19 bp, Homo sapiens
gttcctttgttaaatttag

SEQ ID NO: 5505072 - DNA, 15 bp, Homo sapiens
gttcctttgttccct

SEQ ID NO: 5505073 - DNA, 20 bp, Homo sapiens
gttccttttatttataacaa

SEQ ID NO: 5505074 - DNA, 16 bp, Homo sapiens
gttcctttttaaatgt

SEQ ID NO: 5505075 - DNA, 14 bp, Homo sapiens
gttcctttttatga

SEQ ID NO: 5505076 - DNA, 12 bp, Homo sapiens
gttcctttttca

SEQ ID NO: 5505077 - DNA, 21 bp, Homo sapiens
gttcctttttcaacttggaaa

SEQ ID NO: 5505078 - DNA, 15 bp, Homo sapiens
gttcctttttctttt

SEQ ID NO: 5505079 - DNA, 14 bp, Homo sapiens
gttcctttttgcag

SEQ ID NO: 5505080 - DNA, 20 bp, Homo sapiens
gttccttttttcaatatgca

SEQ ID NO: 5505081 - DNA, 22 bp, Homo sapiens
gttccttttttcaatatgcaag

SEQ ID NO: 5505082 - DNA, 22 bp, Homo sapiens
gttcgacgagacggtcgagcag

SEQ ID NO: 5505083 - DNA, 19 bp, Homo sapiens
gttcgagagcagcctggcc

SEQ ID NO: 5505084 - DNA, 21 bp, Homo sapiens
gttcgatgcctgcatgctgaa

SEQ ID NO: 5505085 - DNA, 12 bp, Homo sapiens
gttcgatttcta

SEQ ID NO: 5505086 - DNA, 22 bp, Homo sapiens
gttcgcacaatctacactgcct

SEQ ID NO: 5505087 - DNA, 13 bp, Homo sapiens
gttcgcagagctt

SEQ ID NO: 5505088 - DNA, 19 bp, Homo sapiens
gttcgccgtctggcgagcc

SEQ ID NO: 5505089 - DNA, 21 bp, Homo sapiens
gttgacctttatttattaaac

SEQ ID NO: 5505090 - DNA, 14 bp, Homo sapiens
gttgacgagactgg

SEQ ID NO: 5505091 - DNA, 15 bp, Homo sapiens
gttgacgagactggt

SEQ ID NO: 5505092 - DNA, 16 bp, Homo sapiens
gttgacgggccgcagg

SEQ ID NO: 5505093 - DNA, 14 bp, Homo sapiens
gttgactaaaatgc

SEQ ID NO: 5505094 - DNA, 22 bp, Homo sapiens
gttgactcacaggccctggaga

SEQ ID NO: 5505095 - DNA, 19 bp, Homo sapiens
gttgactctagtactgtga

SEQ ID NO: 5505096 - DNA, 13 bp, Homo sapiens
gttgactgctgct

SEQ ID NO: 5505097 - DNA, 15 bp, Homo sapiens
gttgactgctgctcc

SEQ ID NO: 5505098 - DNA, 22 bp, Homo sapiens
gttgactgtaggcgcccctggg

SEQ ID NO: 5505099 - DNA, 19 bp, Homo sapiens
gttgactgtgattagatca

SEQ ID NO: 5505100 - DNA, 19 bp, Homo sapiens
gttgacttatagtacatga

SEQ ID NO: 5505101 - DNA, 21 bp, Homo sapiens
gttgacttattttctctgtgt

SEQ ID NO: 5505102 - DNA, 20 bp, Homo sapiens
gttgacttgacagaacactg

SEQ ID NO: 5505103 - DNA, 18 bp, Homo sapiens
gttgactttataaatttc

SEQ ID NO: 5505104 - DNA, 14 bp, Homo sapiens
gttgactttcaggt

SEQ ID NO: 5505105 - DNA, 12 bp, Homo sapiens
gttgactttctc

SEQ ID NO: 5505106 - DNA, 15 bp, Homo sapiens
gttgagaaggtgcct

SEQ ID NO: 5505107 - DNA, 16 bp, Homo sapiens
gttgagaaggtgcctg

SEQ ID NO: 5505108 - DNA, 20 bp, Homo sapiens
gttgagaatcactgctccag

SEQ ID NO: 5505109 - DNA, 12 bp, Homo sapiens
gttgagacagag

SEQ ID NO: 5505110 - DNA, 16 bp, Homo sapiens
gttgagacgctgttgc

SEQ ID NO: 5505111 - DNA, 14 bp, Homo sapiens
gttgagaggacact

SEQ ID NO: 5505112 - DNA, 14 bp, Homo sapiens
gttgagagggaaaa

SEQ ID NO: 5505113 - DNA, 22 bp, Homo sapiens
gttgagagggggatgcccctgg

SEQ ID NO: 5505114 - DNA, 15 bp, Homo sapiens
gttgagagtgtgacc

SEQ ID NO: 5505115 - DNA, 18 bp, Homo sapiens
gttgagatagttttcatc

SEQ ID NO: 5505116 - DNA, 14 bp, Homo sapiens
gttgagatccagtg

SEQ ID NO: 5505117 - DNA, 14 bp, Homo sapiens
gttgagatgatatt

SEQ ID NO: 5505118 - DNA, 14 bp, Homo sapiens
gttgagcaagcagt

SEQ ID NO: 5505119 - DNA, 22 bp, Homo sapiens
gttgagcatagagaacaaagta

SEQ ID NO: 5505120 - DNA, 20 bp, Homo sapiens
gttgagccagcagacattgt

SEQ ID NO: 5505121 - DNA, 15 bp, Homo sapiens
gttgagccaggcctg

SEQ ID NO: 5505122 - DNA, 20 bp, Homo sapiens
gttgagccatgctacagtta

SEQ ID NO: 5505123 - DNA, 20 bp, Homo sapiens
gttgagcgtgcgcactgcat

SEQ ID NO: 5505124 - DNA, 15 bp, Homo sapiens
gttgagctatgactt

SEQ ID NO: 5505125 - DNA, 16 bp, Homo sapiens
gttgagctatgactta

SEQ ID NO: 5505126 - DNA, 15 bp, Homo sapiens
gttgagctatgatat

SEQ ID NO: 5505127 - DNA, 24 bp, Homo sapiens
gttgagctctcggaactgcatgct

SEQ ID NO: 5505128 - DNA, 13 bp, Homo sapiens
gttgaggaagtca

SEQ ID NO: 5505129 - DNA, 18 bp, Homo sapiens
gttgaggacaggagaggg

SEQ ID NO: 5505130 - DNA, 21 bp, Homo sapiens
gttgaggcagggcaaatgaca

SEQ ID NO: 5505131 - DNA, 22 bp, Homo sapiens
gttgaggctgcagtgagctgtg

SEQ ID NO: 5505132 - DNA, 17 bp, Homo sapiens
gttgagggaacagacag

SEQ ID NO: 5505133 - DNA, 14 bp, Homo sapiens
gttgaggggagagg

SEQ ID NO: 5505134 - DNA, 12 bp, Homo sapiens
gttgaggggagc

SEQ ID NO: 5505135 - DNA, 18 bp, Homo sapiens
gttgaggggagcatgctt

SEQ ID NO: 5505136 - DNA, 14 bp, Homo sapiens
gttgaggggaggag

SEQ ID NO: 5505137 - DNA, 17 bp, Homo sapiens
gttgaggggcctggaga

SEQ ID NO: 5505138 - DNA, 16 bp, Homo sapiens
gttgaggggctcctgg

SEQ ID NO: 5505139 - DNA, 17 bp, Homo sapiens
gttgaggggctcctgga

SEQ ID NO: 5505140 - DNA, 20 bp, Homo sapiens
gttgaggggcttccctctgc

SEQ ID NO: 5505141 - DNA, 23 bp, Homo sapiens
gttgagggtgacttttcctgctg

SEQ ID NO: 5505142 - DNA, 20 bp, Homo sapiens
gttgaggtctttctcctcag

SEQ ID NO: 5505143 - DNA, 21 bp, Homo sapiens
gttgaggtctttctcctcagg

SEQ ID NO: 5505144 - DNA, 22 bp, Homo sapiens
gttgaggtctttctcctcagga

SEQ ID NO: 5505145 - DNA, 16 bp, Homo sapiens
gttgaggtggtctgaa

SEQ ID NO: 5505146 - DNA, 15 bp, Homo sapiens
gttgagtattacaca

SEQ ID NO: 5505147 - DNA, 21 bp, Homo sapiens
gttgagtctcctctctgagac

SEQ ID NO: 5505148 - DNA, 15 bp, Homo sapiens
gttgagtctgtacta

SEQ ID NO: 5505149 - DNA, 17 bp, Homo sapiens
gttgagtcttcacattt

SEQ ID NO: 5505150 - DNA, 18 bp, Homo sapiens
gttgagtcttcacattta

SEQ ID NO: 5505151 - DNA, 19 bp, Homo sapiens
gttgagtcttcacatttag

SEQ ID NO: 5505152 - DNA, 14 bp, Homo sapiens
gttgagtgagccgg

SEQ ID NO: 5505153 - DNA, 18 bp, Homo sapiens
gttgagtgcactgactgt

SEQ ID NO: 5505154 - DNA, 13 bp, Homo sapiens
gttgagtgtgtgg

SEQ ID NO: 5505155 - DNA, 22 bp, Homo sapiens
gttgagttcaggtagctgcccc

SEQ ID NO: 5505156 - DNA, 16 bp, Homo sapiens
gttgagttctgattgt

SEQ ID NO: 5505157 - DNA, 22 bp, Homo sapiens
gttgagttgggggtattttcta

SEQ ID NO: 5505158 - DNA, 14 bp, Homo sapiens
gttgagtttgctgt

SEQ ID NO: 5505159 - DNA, 12 bp, Homo sapiens
gttgataaaaac

SEQ ID NO: 5505160 - DNA, 20 bp, Homo sapiens
gttgataaaccaaaaacatt

SEQ ID NO: 5505161 - DNA, 22 bp, Homo sapiens
gttgataaaccaaaaacatttg

SEQ ID NO: 5505162 - DNA, 13 bp, Homo sapiens
gttgataactttg

SEQ ID NO: 5505163 - DNA, 23 bp, Homo sapiens
gttgataaggaacatttatccag

SEQ ID NO: 5505164 - DNA, 18 bp, Homo sapiens
gttgatactgttgcacgt

SEQ ID NO: 5505165 - DNA, 19 bp, Homo sapiens
gttgatactgttgcacgtg

SEQ ID NO: 5505166 - DNA, 22 bp, Homo sapiens
gttgatagcaagtgaatttttc

SEQ ID NO: 5505167 - DNA, 19 bp, Homo sapiens
gttgatataaaactctggg

SEQ ID NO: 5505168 - DNA, 16 bp, Homo sapiens
gttgatattgtttgct

SEQ ID NO: 5505169 - DNA, 16 bp, Homo sapiens
gttgatcatgcaggaa

SEQ ID NO: 5505170 - DNA, 22 bp, Homo sapiens
gttgatcatgtactttttagta

SEQ ID NO: 5505171 - DNA, 16 bp, Homo sapiens
gttgatctacccgtgc

SEQ ID NO: 5505172 - DNA, 20 bp, Homo sapiens
gttgatctacccgtgcctgg

SEQ ID NO: 5505173 - DNA, 19 bp, Homo sapiens
gttgatcttacaagatatt

SEQ ID NO: 5505174 - DNA, 13 bp, Homo sapiens
gttgatgaccaat

SEQ ID NO: 5505175 - DNA, 19 bp, Homo sapiens
gttgatgactcgaaactga

SEQ ID NO: 5505176 - DNA, 15 bp, Homo sapiens
gttgatgaggcctct

SEQ ID NO: 5505177 - DNA, 23 bp, Homo sapiens
gttgatgatctttgcagacaggc

SEQ ID NO: 5505178 - DNA, 20 bp, Homo sapiens
gttgatgctccgccaggaag

SEQ ID NO: 5505179 - DNA, 17 bp, Homo sapiens
gttgatggagccccagg

SEQ ID NO: 5505180 - DNA, 22 bp, Homo sapiens
gttgatggcaaaaaaaaaaaag

SEQ ID NO: 5505181 - DNA, 22 bp, Homo sapiens
gttgatgggatgattgaagaaa

SEQ ID NO: 5505182 - DNA, 17 bp, Homo sapiens
gttgatgggttctaatt

SEQ ID NO: 5505183 - DNA, 21 bp, Homo sapiens
gttgatggtggtatgttttca

SEQ ID NO: 5505184 - DNA, 16 bp, Homo sapiens
gttgatgttggctggg

SEQ ID NO: 5505185 - DNA, 13 bp, Homo sapiens
gttgattaaactc

SEQ ID NO: 5505186 - DNA, 19 bp, Homo sapiens
gttgattaagaaaggaagt

SEQ ID NO: 5505187 - DNA, 18 bp, Homo sapiens
gttgattaagttaataag

SEQ ID NO: 5505188 - DNA, 19 bp, Homo sapiens
gttgattaatttctgccat

SEQ ID NO: 5505189 - DNA, 23 bp, Homo sapiens
gttgattcggtatccccccatct

SEQ ID NO: 5505190 - DNA, 21 bp, Homo sapiens
gttgattctcatgcactgcaa

SEQ ID NO: 5505191 - DNA, 19 bp, Homo sapiens
gttgattctgaatctgaaa

SEQ ID NO: 5505192 - DNA, 13 bp, Homo sapiens
gttgattctgtcc

SEQ ID NO: 5505193 - DNA, 14 bp, Homo sapiens
gttgattctttcaa

SEQ ID NO: 5505194 - DNA, 17 bp, Homo sapiens
gttgattgctaaatgta

SEQ ID NO: 5505195 - DNA, 20 bp, Homo sapiens
gttgattgctaaatgtaaca

SEQ ID NO: 5505196 - DNA, 22 bp, Homo sapiens
gttgattgtacgtagccacagg

SEQ ID NO: 5505197 - DNA, 13 bp, Homo sapiens
gttgattgtatgt

SEQ ID NO: 5505198 - DNA, 14 bp, Homo sapiens
gttgatttctttcc

SEQ ID NO: 5505199 - DNA, 19 bp, Homo sapiens
gttgattttgaacttttta

SEQ ID NO: 5505200 - DNA, 15 bp, Homo sapiens
gttgcaaactcagtt

SEQ ID NO: 5505201 - DNA, 17 bp, Homo sapiens
gttgcaaagagacattt

SEQ ID NO: 5505202 - DNA, 20 bp, Homo sapiens
gttgcaaaggtaggttgaag

SEQ ID NO: 5505203 - DNA, 17 bp, Homo sapiens
gttgcaaattattctag

SEQ ID NO: 5505204 - DNA, 17 bp, Homo sapiens
gttgcaaattccacccc

SEQ ID NO: 5505205 - DNA, 13 bp, Homo sapiens
gttgcaaccactg

SEQ ID NO: 5505206 - DNA, 17 bp, Homo sapiens
gttgcaagatgtgaatt

SEQ ID NO: 5505207 - DNA, 23 bp, Homo sapiens
gttgcaaggccgctgttcaccca

SEQ ID NO: 5505208 - DNA, 13 bp, Homo sapiens
gttgcaattaaaa

SEQ ID NO: 5505209 - DNA, 13 bp, Homo sapiens
gttgcacacagta

SEQ ID NO: 5505210 - DNA, 19 bp, Homo sapiens
gttgcacagcatctcagct

SEQ ID NO: 5505211 - DNA, 19 bp, Homo sapiens
gttgcacagctgtttgaaa

SEQ ID NO: 5505212 - DNA, 20 bp, Homo sapiens
gttgcacagctgtttgaaat

SEQ ID NO: 5505213 - DNA, 18 bp, Homo sapiens
gttgcacagtccctcctg

SEQ ID NO: 5505214 - DNA, 15 bp, Homo sapiens
gttgcacatcattca

SEQ ID NO: 5505215 - DNA, 14 bp, Homo sapiens
gttgcaccattctt

SEQ ID NO: 5505216 - DNA, 20 bp, Homo sapiens
gttgcacccagccctggtct

SEQ ID NO: 5505217 - DNA, 22 bp, Homo sapiens
gttgcacgtgtgtttttctatt

SEQ ID NO: 5505218 - DNA, 15 bp, Homo sapiens
gttgcactgaaaacc

SEQ ID NO: 5505219 - DNA, 12 bp, Homo sapiens
gttgcactgaag

SEQ ID NO: 5505220 - DNA, 15 bp, Homo sapiens
gttgcactgaagttt

SEQ ID NO: 5505221 - DNA, 14 bp, Homo sapiens
gttgcactgatatt

SEQ ID NO: 5505222 - DNA, 17 bp, Homo sapiens
gttgcactgccccctgc

SEQ ID NO: 5505223 - DNA, 14 bp, Homo sapiens
gttgcactgtttgc

SEQ ID NO: 5505224 - DNA, 21 bp, Homo sapiens
gttgcactgtttgcatgcgcc

SEQ ID NO: 5505225 - DNA, 14 bp, Homo sapiens
gttgcactttagac

SEQ ID NO: 5505226 - DNA, 22 bp, Homo sapiens
gttgcactttagacatttttgt

SEQ ID NO: 5505227 - DNA, 20 bp, Homo sapiens
gttgcacttttgaatgtcca

SEQ ID NO: 5505228 - DNA, 16 bp, Homo sapiens
gttgcagacaggaatc

SEQ ID NO: 5505229 - DNA, 22 bp, Homo sapiens
gttgcagagaagcatcctccac

SEQ ID NO: 5505230 - DNA, 22 bp, Homo sapiens
gttgcagattgaagcatttcag

SEQ ID NO: 5505231 - DNA, 20 bp, Homo sapiens
gttgcagcacattcacactg

SEQ ID NO: 5505232 - DNA, 12 bp, Homo sapiens
gttgcagcccaa

SEQ ID NO: 5505233 - DNA, 19 bp, Homo sapiens
gttgcagccgcagagaaat

SEQ ID NO: 5505234 - DNA, 14 bp, Homo sapiens
gttgcagctgtcac

SEQ ID NO: 5505235 - DNA, 15 bp, Homo sapiens
gttgcagctgtcacc

SEQ ID NO: 5505236 - DNA, 22 bp, Homo sapiens
gttgcaggaaggagccagactt

SEQ ID NO: 5505237 - DNA, 16 bp, Homo sapiens
gttgcaggcagtgtct

SEQ ID NO: 5505238 - DNA, 21 bp, Homo sapiens
gttgcaggtgccaatgactaa

SEQ ID NO: 5505239 - DNA, 15 bp, Homo sapiens
gttgcagtcactgtg

SEQ ID NO: 5505240 - DNA, 19 bp, Homo sapiens
gttgcagtctcagaaagcc

SEQ ID NO: 5505241 - DNA, 14 bp, Homo sapiens
gttgcagtctttcc

SEQ ID NO: 5505242 - DNA, 17 bp, Homo sapiens
gttgcagtctttccccc

SEQ ID NO: 5505243 - DNA, 15 bp, Homo sapiens
gttgcagtgagcagg

SEQ ID NO: 5505244 - DNA, 20 bp, Homo sapiens
gttgcagtgagctgagatca

SEQ ID NO: 5505245 - DNA, 15 bp, Homo sapiens
gttgcagtggagagg

SEQ ID NO: 5505246 - DNA, 22 bp, Homo sapiens
gttgcagtgtctagtttctcaa

SEQ ID NO: 5505247 - DNA, 21 bp, Homo sapiens
gttgcataaacaatccaaatg

SEQ ID NO: 5505248 - DNA, 21 bp, Homo sapiens
gttgcatatagttaaactgag

SEQ ID NO: 5505249 - DNA, 18 bp, Homo sapiens
gttgcatatgagcctgcc

SEQ ID NO: 5505250 - DNA, 19 bp, Homo sapiens
gttgcatccacaggattcc

SEQ ID NO: 5505251 - DNA, 16 bp, Homo sapiens
gttgcatgtagtaaca

SEQ ID NO: 5505252 - DNA, 20 bp, Homo sapiens
gttgcatgtagtaacactaa

SEQ ID NO: 5505253 - DNA, 20 bp, Homo sapiens
gttgcatgtcgtgaccaact

SEQ ID NO: 5505254 - DNA, 20 bp, Homo sapiens
gttgcattaattgtgctgtt

SEQ ID NO: 5505255 - DNA, 18 bp, Homo sapiens
gttgcattcctttgtctt

SEQ ID NO: 5505256 - DNA, 13 bp, Homo sapiens
gttgcatttagct

SEQ ID NO: 5505257 - DNA, 16 bp, Homo sapiens
gttgcatttccagctg

SEQ ID NO: 5505258 - DNA, 18 bp, Homo sapiens
gttgcatttgtaaaaatg

SEQ ID NO: 5505259 - DNA, 23 bp, Homo sapiens
gttgcatttgttttgtttacaga

SEQ ID NO: 5505260 - DNA, 17 bp, Homo sapiens
gttgccaaacagccaca

SEQ ID NO: 5505261 - DNA, 19 bp, Homo sapiens
gttgccaaagctggtctca

SEQ ID NO: 5505262 - DNA, 21 bp, Homo sapiens
gttgccaaatatgtcctgggg

SEQ ID NO: 5505263 - DNA, 18 bp, Homo sapiens
gttgccaactaagccctc

SEQ ID NO: 5505264 - DNA, 19 bp, Homo sapiens
gttgccaactaagccctcg

SEQ ID NO: 5505265 - DNA, 18 bp, Homo sapiens
gttgccaagctccaagcc

SEQ ID NO: 5505266 - DNA, 23 bp, Homo sapiens
gttgtgtccctccgcctccccca

SEQ ID NO: 5505267 - DNA, 14 bp, Homo sapiens
gttgtgtctggagc

SEQ ID NO: 5505268 - DNA, 20 bp, Homo sapiens
gttgtgtgagcgtggccttg

SEQ ID NO: 5505269 - DNA, 21 bp, Homo sapiens
gttgtgtgagcgtggccttgg

SEQ ID NO: 5505270 - DNA, 10 bp, Homo sapiens
gttgtgtgcc

SEQ ID NO: 5505271 - DNA, 21 bp, Homo sapiens
gttgtgtgcctctagctgaat

SEQ ID NO: 5505272 - DNA, 19 bp, Homo sapiens
gttgtgtgtatatgtattt

SEQ ID NO: 5505273 - DNA, 13 bp, Homo sapiens
gttgtgtgtgttc

SEQ ID NO: 5505274 - DNA, 13 bp, Homo sapiens
gttgtgtgttgca

SEQ ID NO: 5505275 - DNA, 19 bp, Homo sapiens
gttgtgttaattctttctc

SEQ ID NO: 5505276 - DNA, 12 bp, Homo sapiens
gttgtgttacaa

SEQ ID NO: 5505277 - DNA, 17 bp, Homo sapiens
gttgtgttcctggctga

SEQ ID NO: 5505278 - DNA, 18 bp, Homo sapiens
gttgtgttgagatccagt

SEQ ID NO: 5505279 - DNA, 12 bp, Homo sapiens
gttgtgttgtca

SEQ ID NO: 5505280 - DNA, 21 bp, Homo sapiens
gttgtgtttggttcaattttt

SEQ ID NO: 5505281 - DNA, 16 bp, Homo sapiens
gttgttaaatgctatg

SEQ ID NO: 5505282 - DNA, 15 bp, Homo sapiens
gttgttaataaaagt

SEQ ID NO: 5505283 - DNA, 19 bp, Homo sapiens
gttgttaatactgtattgc

SEQ ID NO: 5505284 - DNA, 18 bp, Homo sapiens
gttgttaatgaaaatgtc

SEQ ID NO: 5505285 - DNA, 19 bp, Homo sapiens
gttgttactaactaaactc

SEQ ID NO: 5505286 - DNA, 21 bp, Homo sapiens
gttgttactaactaaactctc

SEQ ID NO: 5505287 - DNA, 14 bp, Homo sapiens
gttgttactgaagt

SEQ ID NO: 5505288 - DNA, 15 bp, Homo sapiens
gttgttactgattct

SEQ ID NO: 5505289 - DNA, 16 bp, Homo sapiens
gttgttactgattctc

SEQ ID NO: 5505290 - DNA, 19 bp, Homo sapiens
gttgttatattatttacat

SEQ ID NO: 5505291 - DNA, 14 bp, Homo sapiens
gttgttatattcat

SEQ ID NO: 5505292 - DNA, 17 bp, Homo sapiens
gttgttatctgtttgag

SEQ ID NO: 5505293 - DNA, 23 bp, Homo sapiens
gttgttatgatgtgcttaacagg

SEQ ID NO: 5505294 - DNA, 16 bp, Homo sapiens
gttgttatggaaactg

SEQ ID NO: 5505295 - DNA, 15 bp, Homo sapiens
gttgttcaactattt

SEQ ID NO: 5505296 - DNA, 18 bp, Homo sapiens
gttgttcaagcttttcct

SEQ ID NO: 5505297 - DNA, 16 bp, Homo sapiens
gttgttcagaagttgt

SEQ ID NO: 5505298 - DNA, 16 bp, Homo sapiens
gttgttccaaatgtgt

SEQ ID NO: 5505299 - DNA, 18 bp, Homo sapiens
gttgttccattttatgca

SEQ ID NO: 5505300 - DNA, 19 bp, Homo sapiens
gttgttccattttatgcag

SEQ ID NO: 5505301 - DNA, 12 bp, Homo sapiens
gttgttcctcta

SEQ ID NO: 5505302 - DNA, 16 bp, Homo sapiens
gttgttcgggccaagg

SEQ ID NO: 5505303 - DNA, 15 bp, Homo sapiens
gttgttctgttaact

SEQ ID NO: 5505304 - DNA, 23 bp, Homo sapiens
gttgttcttttcccccaaagtgg

SEQ ID NO: 5505305 - DNA, 21 bp, Homo sapiens
gttgttgccaggttgcagctg

SEQ ID NO: 5505306 - DNA, 12 bp, Homo sapiens
gttgttgctgct

SEQ ID NO: 5505307 - DNA, 18 bp, Homo sapiens
gttgttggcaagctgcag

SEQ ID NO: 5505308 - DNA, 22 bp, Homo sapiens
gttgttgtcattgtccagctgg

SEQ ID NO: 5505309 - DNA, 15 bp, Homo sapiens
gttgttgtccctgca

SEQ ID NO: 5505310 - DNA, 21 bp, Homo sapiens
gttgttgtgtgtatatgtatt

SEQ ID NO: 5505311 - DNA, 22 bp, Homo sapiens
gttgttgtgtgtatatgtattt

SEQ ID NO: 5505312 - DNA, 15 bp, Homo sapiens
gttgttgttgctgct

SEQ ID NO: 5505313 - DNA, 15 bp, Homo sapiens
gttgttgtttgccaa

SEQ ID NO: 5505314 - DNA, 20 bp, Homo sapiens
gttgtttacttaaagattta

SEQ ID NO: 5505315 - DNA, 10 bp, Homo sapiens
gttgtttata

SEQ ID NO: 5505316 - DNA, 18 bp, Homo sapiens
gttgtttatatgaaaaca

SEQ ID NO: 5505317 - DNA, 19 bp, Homo sapiens
gttgtttatatgaaaacac

SEQ ID NO: 5505318 - DNA, 20 bp, Homo sapiens
gttgtttcatgagtttgcat

SEQ ID NO: 5505319 - DNA, 15 bp, Homo sapiens
gttgtttccaggaga

SEQ ID NO: 5505320 - DNA, 12 bp, Homo sapiens
gttgtttccata

SEQ ID NO: 5505321 - DNA, 14 bp, Homo sapiens
gttgtttctataaa

SEQ ID NO: 5505322 - DNA, 15 bp, Homo sapiens
gttgtttctgaccca

SEQ ID NO: 5505323 - DNA, 17 bp, Homo sapiens
gttgtttctgttccaaa

SEQ ID NO: 5505324 - DNA, 20 bp, Homo sapiens
gttgtttcttaatttggaaa

SEQ ID NO: 5505325 - DNA, 14 bp, Homo sapiens
gttgtttcttatag

SEQ ID NO: 5505326 - DNA, 11 bp, Homo sapiens
gttgtttcttt

SEQ ID NO: 5505327 - DNA, 14 bp, Homo sapiens
gttgtttctttcta

SEQ ID NO: 5505328 - DNA, 23 bp, Homo sapiens
gttgtttgaaaatattatctttg

SEQ ID NO: 5505329 - DNA, 18 bp, Homo sapiens
gttgtttgagaaattaag

SEQ ID NO: 5505330 - DNA, 14 bp, Homo sapiens
gttgtttgatgtgt

SEQ ID NO: 5505331 - DNA, 20 bp, Homo sapiens
gttgtttgtaaataagagat

SEQ ID NO: 5505332 - DNA, 12 bp, Homo sapiens
gttgtttgttta

SEQ ID NO: 5505333 - DNA, 23 bp, Homo sapiens
gttgttttaacctcccctctccc

SEQ ID NO: 5505334 - DNA, 13 bp, Homo sapiens
gttgttttctctg

SEQ ID NO: 5505335 - DNA, 21 bp, Homo sapiens
gttgttttgggtgaatcttga

SEQ ID NO: 5505336 - DNA, 13 bp, Homo sapiens
gttgttttgtgga

SEQ ID NO: 5505337 - DNA, 17 bp, Homo sapiens
gttgtttttaaaaagaa

SEQ ID NO: 5505338 - DNA, 18 bp, Homo sapiens
gttgtttttagagacagg

SEQ ID NO: 5505339 - DNA, 18 bp, Homo sapiens
gttgttttttcatagtgc

SEQ ID NO: 5505340 - DNA, 18 bp, Homo sapiens
gttgttttttcattgtgt

SEQ ID NO: 5505341 - DNA, 19 bp, Homo sapiens
gttgttttttgaaaacatg

SEQ ID NO: 5505342 - DNA, 22 bp, Homo sapiens
gtttaaaaaaaaagttggtatt

SEQ ID NO: 5505343 - DNA, 17 bp, Homo sapiens
gtttaaaaaaataacat

SEQ ID NO: 5505344 - DNA, 20 bp, Homo sapiens
gtttaaaaaaataacatctc

SEQ ID NO: 5505345 - DNA, 23 bp, Homo sapiens
gtttaaaaaagtttaaaatgtat

SEQ ID NO: 5505346 - DNA, 17 bp, Homo sapiens
gtttaaaaaataacttc

SEQ ID NO: 5505347 - DNA, 15 bp, Homo sapiens
gtttaaaaaatacac

SEQ ID NO: 5505348 - DNA, 16 bp, Homo sapiens
gtttaaaaacaggaaa

SEQ ID NO: 5505349 - DNA, 17 bp, Homo sapiens
gtttaaaaacaggaaaa

SEQ ID NO: 5505350 - DNA, 20 bp, Homo sapiens
gtttaaaaacaggaaaaaaa

SEQ ID NO: 5505351 - DNA, 20 bp, Homo sapiens
gtttaaaaagatgaaaaaga

SEQ ID NO: 5505352 - DNA, 19 bp, Homo sapiens
gtttaaaaatcaacttttt

SEQ ID NO: 5505353 - DNA, 15 bp, Homo sapiens
gtttaaaaatcagaa

SEQ ID NO: 5505354 - DNA, 20 bp, Homo sapiens
gtttaaaaatctgccacctg

SEQ ID NO: 5505355 - DNA, 20 bp, Homo sapiens
gtttaaaaattgaaaaaagt

SEQ ID NO: 5505356 - DNA, 22 bp, Homo sapiens
gtttaaaaattgtctcttttca

SEQ ID NO: 5505357 - DNA, 17 bp, Homo sapiens
gtttaaaaatttataac

SEQ ID NO: 5505358 - DNA, 18 bp, Homo sapiens
gtttaaaaatttataaca

SEQ ID NO: 5505359 - DNA, 17 bp, Homo sapiens
gtttaaaacagtattta

SEQ ID NO: 5505360 - DNA, 12 bp, Homo sapiens
gtttaaaaccca

SEQ ID NO: 5505361 - DNA, 13 bp, Homo sapiens
gtttaaaagaaaa

SEQ ID NO: 5505362 - DNA, 23 bp, Homo sapiens
gtttaaaagacacacttgtccac

SEQ ID NO: 5505363 - DNA, 15 bp, Homo sapiens
gtttaaaagcaaata

SEQ ID NO: 5505364 - DNA, 16 bp, Homo sapiens
gtttaaaatcatttct

SEQ ID NO: 5505365 - DNA, 19 bp, Homo sapiens
gtttaaaatgtaatttaaa

SEQ ID NO: 5505366 - DNA, 20 bp, Homo sapiens
gtttaaaatgtaatttaaat

SEQ ID NO: 5505367 - DNA, 13 bp, Homo sapiens
gtttaaaatgtgt

SEQ ID NO: 5505368 - DNA, 17 bp, Homo sapiens
gtttaaaattattaaaa

SEQ ID NO: 5505369 - DNA, 11 bp, Homo sapiens
gtttaaaattc

SEQ ID NO: 5505370 - DNA, 14 bp, Homo sapiens
gtttaaaattcagt

SEQ ID NO: 5505371 - DNA, 20 bp, Homo sapiens
gtttaaaattcagtttttgt

SEQ ID NO: 5505372 - DNA, 14 bp, Homo sapiens
gtttaaacaaaaaa

SEQ ID NO: 5505373 - DNA, 20 bp, Homo sapiens
gtttaaacccaagtgctgca

SEQ ID NO: 5505374 - DNA, 12 bp, Homo sapiens
gtttaaactgat

SEQ ID NO: 5505375 - DNA, 16 bp, Homo sapiens
gtttaaactgattcat

SEQ ID NO: 5505376 - DNA, 21 bp, Homo sapiens
gtttaaactgattcataataa

SEQ ID NO: 5505377 - DNA, 19 bp, Homo sapiens
gtttaaacttttatgcgca

SEQ ID NO: 5505378 - DNA, 23 bp, Homo sapiens
gtttaaagaagctctccaggccc

SEQ ID NO: 5505379 - DNA, 16 bp, Homo sapiens
gtttaaagagaggtta

SEQ ID NO: 5505380 - DNA, 14 bp, Homo sapiens
gtttaaagagtcta

SEQ ID NO: 5505381 - DNA, 18 bp, Homo sapiens
gtttaaagagtctagatt

SEQ ID NO: 5505382 - DNA, 12 bp, Homo sapiens
gtttaaagagtt

SEQ ID NO: 5505383 - DNA, 18 bp, Homo sapiens
gtttaaagtatatgtgca

SEQ ID NO: 5505384 - DNA, 20 bp, Homo sapiens
gtttaaagtgcagtcatttg

SEQ ID NO: 5505385 - DNA, 21 bp, Homo sapiens
gtttaaagtgtattataacag

SEQ ID NO: 5505386 - DNA, 13 bp, Homo sapiens
gtttaaagttctg

SEQ ID NO: 5505387 - DNA, 20 bp, Homo sapiens
gtttaaagttctgtgtattt

SEQ ID NO: 5505388 - DNA, 13 bp, Homo sapiens
gtttaaagttgca

SEQ ID NO: 5505389 - DNA, 14 bp, Homo sapiens
gtttaaataaagta

SEQ ID NO: 5505390 - DNA, 15 bp, Homo sapiens
gtttaaataaagtat

SEQ ID NO: 5505391 - DNA, 23 bp, Homo sapiens
gtttaaataaagtatcatgcatt

SEQ ID NO: 5505392 - DNA, 19 bp, Homo sapiens
gtttaaataccagtacttg

SEQ ID NO: 5505393 - DNA, 14 bp, Homo sapiens
gtttaaatcatgta

SEQ ID NO: 5505394 - DNA, 17 bp, Homo sapiens
gtttaaatcatgtatgt

SEQ ID NO: 5505395 - DNA, 15 bp, Homo sapiens
gtttaaatctttgtt

SEQ ID NO: 5505396 - DNA, 12 bp, Homo sapiens
gtttaaattgta

SEQ ID NO: 5505397 - DNA, 13 bp, Homo sapiens
gtttaaattgtaa

SEQ ID NO: 5505398 - DNA, 16 bp, Homo sapiens
gtttaacaaatctaat

SEQ ID NO: 5505399 - DNA, 12 bp, Homo sapiens
gtttaacaagta

SEQ ID NO: 5505400 - DNA, 15 bp, Homo sapiens
gtttaacactttctt

SEQ ID NO: 5505401 - DNA, 16 bp, Homo sapiens
gtttaacagatattta

SEQ ID NO: 5505402 - DNA, 13 bp, Homo sapiens
gtttaacataaag

SEQ ID NO: 5505403 - DNA, 13 bp, Homo sapiens
gtttaacatatat

SEQ ID NO: 5505404 - DNA, 16 bp, Homo sapiens
gtttaacattcacagc

SEQ ID NO: 5505405 - DNA, 17 bp, Homo sapiens
gtttaacattcacagcc

SEQ ID NO: 5505406 - DNA, 20 bp, Homo sapiens
gtttaacattgattggataa

SEQ ID NO: 5505407 - DNA, 23 bp, Homo sapiens
gtttaaccaaaaagaccagacta

SEQ ID NO: 5505408 - DNA, 22 bp, Homo sapiens
gtttaacgtttctcattaaaat

SEQ ID NO: 5505409 - DNA, 14 bp, Homo sapiens
gtttaactcagatc

SEQ ID NO: 5505410 - DNA, 17 bp, Homo sapiens
gtttaactcagatcact

SEQ ID NO: 5505411 - DNA, 19 bp, Homo sapiens
gtttaactcagatcactac

SEQ ID NO: 5505412 - DNA, 13 bp, Homo sapiens
gtttaactcccta

SEQ ID NO: 5505413 - DNA, 20 bp, Homo sapiens
gtttaactgcagttgacttt

SEQ ID NO: 5505414 - DNA, 17 bp, Homo sapiens
gtttaactgtcccagcg

SEQ ID NO: 5505415 - DNA, 15 bp, Homo sapiens
gtttaactgtgcatg

SEQ ID NO: 5505416 - DNA, 18 bp, Homo sapiens
gtttaacttccactgtta

SEQ ID NO: 5505417 - DNA, 19 bp, Homo sapiens
gtttaacttgtctttttgt

SEQ ID NO: 5505418 - DNA, 17 bp, Homo sapiens
gtttaactttaaaactg

SEQ ID NO: 5505419 - DNA, 18 bp, Homo sapiens
gtttaagaaaagtatttt

SEQ ID NO: 5505420 - DNA, 18 bp, Homo sapiens
gtttaagaaatgagaaat

SEQ ID NO: 5505421 - DNA, 20 bp, Homo sapiens
gtttaagacatttttggaag

SEQ ID NO: 5505422 - DNA, 12 bp, Homo sapiens
gtttaagattta

SEQ ID NO: 5505423 - DNA, 19 bp, Homo sapiens
gtttaagcaatgcttctgc

SEQ ID NO: 5505424 - DNA, 19 bp, Homo sapiens
gtttaagcagaattggaaa

SEQ ID NO: 5505425 - DNA, 22 bp, Homo sapiens
gtttaagccgcagacctggagc

SEQ ID NO: 5505426 - DNA, 15 bp, Homo sapiens
gtttaagctgagcca

SEQ ID NO: 5505427 - DNA, 23 bp, Homo sapiens
gtttaaggaatatgggagaaata

SEQ ID NO: 5505428 - DNA, 18 bp, Homo sapiens
gtttaaggctgaggctgc

SEQ ID NO: 5505429 - DNA, 22 bp, Homo sapiens
gtttaagtaagtaagtttcatt

SEQ ID NO: 5505430 - DNA, 13 bp, Homo sapiens
gtttaataaagct

SEQ ID NO: 5505431 - DNA, 14 bp, Homo sapiens
gtttaataatatgt

SEQ ID NO: 5505432 - DNA, 18 bp, Homo sapiens
gtttaataccctgtacat

SEQ ID NO: 5505433 - DNA, 19 bp, Homo sapiens
gtttaataccctgtacata

SEQ ID NO: 5505434 - DNA, 20 bp, Homo sapiens
gtttaatactcatccttgta

SEQ ID NO: 5505435 - DNA, 14 bp, Homo sapiens
gtttaatacttttt

SEQ ID NO: 5505436 - DNA, 14 bp, Homo sapiens
gtttaatagatttg

SEQ ID NO: 5505437 - DNA, 13 bp, Homo sapiens
gtttaatatctga

SEQ ID NO: 5505438 - DNA, 14 bp, Homo sapiens
gtttaatattaaag

SEQ ID NO: 5505439 - DNA, 19 bp, Homo sapiens
gtttaatattaaagccatg

SEQ ID NO: 5505440 - DNA, 20 bp, Homo sapiens
gtttaatattaaagccatgt

SEQ ID NO: 5505441 - DNA, 21 bp, Homo sapiens
gtttaatattacctaatgaaa

SEQ ID NO: 5505442 - DNA, 19 bp, Homo sapiens
gtttaatattgagaaagaa

SEQ ID NO: 5505443 - DNA, 15 bp, Homo sapiens
gtttaatatttaaac

SEQ ID NO: 5505444 - DNA, 19 bp, Homo sapiens
gtttaatccccagtaaaat

SEQ ID NO: 5505445 - DNA, 14 bp, Homo sapiens
gtttctcccagttc

SEQ ID NO: 5505446 - DNA, 14 bp, Homo sapiens
gtttctccccctgg

SEQ ID NO: 5505447 - DNA, 23 bp, Homo sapiens
gtttctccccctgggctctgccc

SEQ ID NO: 5505448 - DNA, 22 bp, Homo sapiens
gtttctccctctcactgtctga

SEQ ID NO: 5505449 - DNA, 20 bp, Homo sapiens
gtttctccttagttggctgg

SEQ ID NO: 5505450 - DNA, 17 bp, Homo sapiens
gtttctccttgaaatga

SEQ ID NO: 5505451 - DNA, 20 bp, Homo sapiens
gtttctcctttattgctcct

SEQ ID NO: 5505452 - DNA, 23 bp, Homo sapiens
gtttctcggcaccagtgcctcag

SEQ ID NO: 5505453 - DNA, 23 bp, Homo sapiens
gtttctcgtactttcacatctct

SEQ ID NO: 5505454 - DNA, 11 bp, Homo sapiens
gtttctctaag

SEQ ID NO: 5505455 - DNA, 14 bp, Homo sapiens
gtttctctaaggaa

SEQ ID NO: 5505456 - DNA, 13 bp, Homo sapiens
gtttctctccctc

SEQ ID NO: 5505457 - DNA, 14 bp, Homo sapiens
gtttctctccctcc

SEQ ID NO: 5505458 - DNA, 19 bp, Homo sapiens
gtttctctctacagtgcca

SEQ ID NO: 5505459 - DNA, 21 bp, Homo sapiens
gtttctctcttcccttctccc

SEQ ID NO: 5505460 - DNA, 17 bp, Homo sapiens
gtttctctcttgttgtc

SEQ ID NO: 5505461 - DNA, 23 bp, Homo sapiens
gtttctctgccgctacctccctc

SEQ ID NO: 5505462 - DNA, 12 bp, Homo sapiens
gtttctctgctg

SEQ ID NO: 5505463 - DNA, 17 bp, Homo sapiens
gtttctctgtgctctga

SEQ ID NO: 5505464 - DNA, 20 bp, Homo sapiens
gtttctcttgagctggcctc

SEQ ID NO: 5505465 - DNA, 18 bp, Homo sapiens
gtttctcttgtcttaaaa

SEQ ID NO: 5505466 - DNA, 19 bp, Homo sapiens
gtttctctttgattatttg

SEQ ID NO: 5505467 - DNA, 14 bp, Homo sapiens
gtttctgaaaagaa

SEQ ID NO: 5505468 - DNA, 22 bp, Homo sapiens
gtttctgaaaagaaataataat

SEQ ID NO: 5505469 - DNA, 22 bp, Homo sapiens
gtttctgaaaatgtttaagtat

SEQ ID NO: 5505470 - DNA, 20 bp, Homo sapiens
gtttctgaaagaatcatttg

SEQ ID NO: 5505471 - DNA, 13 bp, Homo sapiens
gtttctgaatgtt

SEQ ID NO: 5505472 - DNA, 15 bp, Homo sapiens
gtttctgaatgtttg

SEQ ID NO: 5505473 - DNA, 20 bp, Homo sapiens
gtttctgacccaagaggtgg

SEQ ID NO: 5505474 - DNA, 19 bp, Homo sapiens
gtttctgacccactgatct

SEQ ID NO: 5505475 - DNA, 12 bp, Homo sapiens
gtttctgactct

SEQ ID NO: 5505476 - DNA, 21 bp, Homo sapiens
gtttctgatctgtactttgtg

SEQ ID NO: 5505477 - DNA, 19 bp, Homo sapiens
gtttctgattaatgctaaa

SEQ ID NO: 5505478 - DNA, 14 bp, Homo sapiens
gtttctgcagaggc

SEQ ID NO: 5505479 - DNA, 16 bp, Homo sapiens
gtttctgcagaggcag

SEQ ID NO: 5505480 - DNA, 20 bp, Homo sapiens
gtttctgcagtagtctctgt

SEQ ID NO: 5505481 - DNA, 20 bp, Homo sapiens
gtttctgcattcatttttat

SEQ ID NO: 5505482 - DNA, 21 bp, Homo sapiens
gtttctgcccacattggaccc

SEQ ID NO: 5505483 - DNA, 13 bp, Homo sapiens
gtttctgcccagc

SEQ ID NO: 5505484 - DNA, 13 bp, Homo sapiens
gtttctgccctgc

SEQ ID NO: 5505485 - DNA, 15 bp, Homo sapiens
gtttctgccgcagcc

SEQ ID NO: 5505486 - DNA, 18 bp, Homo sapiens
gtttctgccgcagccctg

SEQ ID NO: 5505487 - DNA, 22 bp, Homo sapiens
gtttctgccgcagccctgcaga

SEQ ID NO: 5505488 - DNA, 18 bp, Homo sapiens
gtttctgcggccttccac

SEQ ID NO: 5505489 - DNA, 12 bp, Homo sapiens
gtttctgcttct

SEQ ID NO: 5505490 - DNA, 10 bp, Homo sapiens
gtttctggaa

SEQ ID NO: 5505491 - DNA, 18 bp, Homo sapiens
gtttctggaaatgttctt

SEQ ID NO: 5505492 - DNA, 22 bp, Homo sapiens
gtttctggacaagaagagtcct

SEQ ID NO: 5505493 - DNA, 22 bp, Homo sapiens
gtttctggacccttataaaatc

SEQ ID NO: 5505494 - DNA, 21 bp, Homo sapiens
gtttctggagtgattctagag

SEQ ID NO: 5505495 - DNA, 15 bp, Homo sapiens
gtttctggataaacc

SEQ ID NO: 5505496 - DNA, 21 bp, Homo sapiens
gtttctggataaaccaccctc

SEQ ID NO: 5505497 - DNA, 22 bp, Homo sapiens
gtttctggataaaccaccctct

SEQ ID NO: 5505498 - DNA, 20 bp, Homo sapiens
gtttctggattagcttttcc

SEQ ID NO: 5505499 - DNA, 15 bp, Homo sapiens
gtttctgggggctgg

SEQ ID NO: 5505500 - DNA, 22 bp, Homo sapiens
gtttctgggtccctgctcccct

SEQ ID NO: 5505501 - DNA, 17 bp, Homo sapiens
gtttctgggtctacaag

SEQ ID NO: 5505502 - DNA, 20 bp, Homo sapiens
gtttctggtctctaggctgg

SEQ ID NO: 5505503 - DNA, 15 bp, Homo sapiens
gtttctggtgactgc

SEQ ID NO: 5505504 - DNA, 16 bp, Homo sapiens
gtttctgtaacaaatt

SEQ ID NO: 5505505 - DNA, 17 bp, Homo sapiens
gtttctgtaattggctt

SEQ ID NO: 5505506 - DNA, 13 bp, Homo sapiens
gtttctgtagaaa

SEQ ID NO: 5505507 - DNA, 21 bp, Homo sapiens
gtttctgtagaaaagaaaaca

SEQ ID NO: 5505508 - DNA, 23 bp, Homo sapiens
gtttctgtagaaaagaaaacatt

SEQ ID NO: 5505509 - DNA, 21 bp, Homo sapiens
gtttctgtatatgattctctg

SEQ ID NO: 5505510 - DNA, 13 bp, Homo sapiens
gtttctgtcaagc

SEQ ID NO: 5505511 - DNA, 21 bp, Homo sapiens
gtttctgtcaggagagcagcg

SEQ ID NO: 5505512 - DNA, 23 bp, Homo sapiens
gtttctgtcctcaggtgaataac

SEQ ID NO: 5505513 - DNA, 16 bp, Homo sapiens
gtttctgtcctgctgg

SEQ ID NO: 5505514 - DNA, 19 bp, Homo sapiens
gtttctgtcctgtaactgt

SEQ ID NO: 5505515 - DNA, 14 bp, Homo sapiens
gtttctgtctcctc

SEQ ID NO: 5505516 - DNA, 13 bp, Homo sapiens
gtttctgtctgta

SEQ ID NO: 5505517 - DNA, 21 bp, Homo sapiens
gtttctgtgaaattctcagag

SEQ ID NO: 5505518 - DNA, 22 bp, Homo sapiens
gtttctgttctgtggaaagtgt

SEQ ID NO: 5505519 - DNA, 19 bp, Homo sapiens
gtttctgtttcttgctctc

SEQ ID NO: 5505520 - DNA, 16 bp, Homo sapiens
gtttctgtttgaattt

SEQ ID NO: 5505521 - DNA, 13 bp, Homo sapiens
gtttcttaactta

SEQ ID NO: 5505522 - DNA, 15 bp, Homo sapiens
gtttcttaatttgga

SEQ ID NO: 5505523 - DNA, 18 bp, Homo sapiens
gtttcttaatttggaaac

SEQ ID NO: 5505524 - DNA, 14 bp, Homo sapiens
gtttcttacaaata

SEQ ID NO: 5505525 - DNA, 14 bp, Homo sapiens
gtttcttacacact

SEQ ID NO: 5505526 - DNA, 11 bp, Homo sapiens
gtttcttagac

SEQ ID NO: 5505527 - DNA, 20 bp, Homo sapiens
gtttcttagacctcttcctg

SEQ ID NO: 5505528 - DNA, 15 bp, Homo sapiens
gtttcttagctgcac

SEQ ID NO: 5505529 - DNA, 18 bp, Homo sapiens
gtttcttcaagagctgag

SEQ ID NO: 5505530 - DNA, 21 bp, Homo sapiens
gtttcttcctgctccttttgt

SEQ ID NO: 5505531 - DNA, 14 bp, Homo sapiens
gtttcttctctgga

SEQ ID NO: 5505532 - DNA, 17 bp, Homo sapiens
gtttcttctctggagaa

SEQ ID NO: 5505533 - DNA, 11 bp, Homo sapiens
gtttcttcttc

SEQ ID NO: 5505534 - DNA, 18 bp, Homo sapiens
gtttcttctttcttttaa

SEQ ID NO: 5505535 - DNA, 15 bp, Homo sapiens
gtttcttcttttcct

SEQ ID NO: 5505536 - DNA, 22 bp, Homo sapiens
gtttcttgaagtccagtgtttc

SEQ ID NO: 5505537 - DNA, 20 bp, Homo sapiens
gtttcttgccccagtgtggt

SEQ ID NO: 5505538 - DNA, 22 bp, Homo sapiens
gtttcttgcctcatttttttcc

SEQ ID NO: 5505539 - DNA, 16 bp, Homo sapiens
gtttcttgctctctct

SEQ ID NO: 5505540 - DNA, 14 bp, Homo sapiens
gtttcttgctgcca

SEQ ID NO: 5505541 - DNA, 14 bp, Homo sapiens
gtttcttgcttgta

SEQ ID NO: 5505542 - DNA, 18 bp, Homo sapiens
gtttcttgcttgtacctc

SEQ ID NO: 5505543 - DNA, 23 bp, Homo sapiens
gtttcttgctttgaatgcatgtg

SEQ ID NO: 5505544 - DNA, 12 bp, Homo sapiens
gtttcttgtctt

SEQ ID NO: 5505545 - DNA, 15 bp, Homo sapiens
gtttctttaaaattg

SEQ ID NO: 5505546 - DNA, 19 bp, Homo sapiens
gtttctttaaccttgtata

SEQ ID NO: 5505547 - DNA, 23 bp, Homo sapiens
gtttctttctagtggtctttgta

SEQ ID NO: 5505548 - DNA, 19 bp, Homo sapiens
gtttctttctctgaggaca

SEQ ID NO: 5505549 - DNA, 19 bp, Homo sapiens
gtttctttctgtctgcttt

SEQ ID NO: 5505550 - DNA, 23 bp, Homo sapiens
gtttctttcttttttttttcatt

SEQ ID NO: 5505551 - DNA, 14 bp, Homo sapiens
gtttctttgaagaa

SEQ ID NO: 5505552 - DNA, 12 bp, Homo sapiens
gtttctttgaat

SEQ ID NO: 5505553 - DNA, 17 bp, Homo sapiens
gtttctttgtaatgaaa

SEQ ID NO: 5505554 - DNA, 14 bp, Homo sapiens
gtttctttgtgttg

SEQ ID NO: 5505555 - DNA, 17 bp, Homo sapiens
gtttctttgtgtttgct

SEQ ID NO: 5505556 - DNA, 14 bp, Homo sapiens
gtttcttttaaaga

SEQ ID NO: 5505557 - DNA, 23 bp, Homo sapiens
gtttcttttataaaaaaaatgaa

SEQ ID NO: 5505558 - DNA, 14 bp, Homo sapiens
gtttcttttggaaa

SEQ ID NO: 5505559 - DNA, 17 bp, Homo sapiens
gtttcttttgtaaagag

SEQ ID NO: 5505560 - DNA, 17 bp, Homo sapiens
gtttcttttgtatgtaa

SEQ ID NO: 5505561 - DNA, 20 bp, Homo sapiens
gtttcttttgtatgtaaatg

SEQ ID NO: 5505562 - DNA, 19 bp, Homo sapiens
gtttctttttaagtaatgt

SEQ ID NO: 5505563 - DNA, 18 bp, Homo sapiens
gtttctttttacagcatt

SEQ ID NO: 5505564 - DNA, 24 bp, Homo sapiens
gtttctttttacagcattgtcttt

SEQ ID NO: 5505565 - DNA, 18 bp, Homo sapiens
gtttctttttattttagt

SEQ ID NO: 5505566 - DNA, 13 bp, Homo sapiens
gtttctttttgaa

SEQ ID NO: 5505567 - DNA, 22 bp, Homo sapiens
gtttcttttttttttttttaca

SEQ ID NO: 5505568 - DNA, 14 bp, Homo sapiens
gtttgaaaacttca

SEQ ID NO: 5505569 - DNA, 18 bp, Homo sapiens
gtttgaaaacttcagaag

SEQ ID NO: 5505570 - DNA, 21 bp, Homo sapiens
gtttgaaaacttcagaagcaa

SEQ ID NO: 5505571 - DNA, 15 bp, Homo sapiens
gtttgaaaagcaata

SEQ ID NO: 5505572 - DNA, 11 bp, Homo sapiens
gtttgaaacac

SEQ ID NO: 5505573 - DNA, 13 bp, Homo sapiens
gtttgaaagactt

SEQ ID NO: 5505574 - DNA, 17 bp, Homo sapiens
gtttgaaagattatgat

SEQ ID NO: 5505575 - DNA, 19 bp, Homo sapiens
gtttgaaagttgtacatga

SEQ ID NO: 5505576 - DNA, 23 bp, Homo sapiens
gtttgaaagttgtacatgataag

SEQ ID NO: 5505577 - DNA, 18 bp, Homo sapiens
gtttgaaatatattattt

SEQ ID NO: 5505578 - DNA, 21 bp, Homo sapiens
gtttgaaatgtcgatcaagag

SEQ ID NO: 5505579 - DNA, 11 bp, Homo sapiens
gtttgaaattc

SEQ ID NO: 5505580 - DNA, 17 bp, Homo sapiens
gtttgaaattctgaatt

SEQ ID NO: 5505581 - DNA, 18 bp, Homo sapiens
gtttgaaattctgaattt

SEQ ID NO: 5505582 - DNA, 19 bp, Homo sapiens
gtttgaagaaccgcatttt

SEQ ID NO: 5505583 - DNA, 18 bp, Homo sapiens
gtttgaagacacagcctc

SEQ ID NO: 5505584 - DNA, 21 bp, Homo sapiens
gtttgaagattatatgaagtt

SEQ ID NO: 5505585 - DNA, 20 bp, Homo sapiens
gtttgaagcacaactccctt

SEQ ID NO: 5505586 - DNA, 15 bp, Homo sapiens
gtttgaagcctgccc

SEQ ID NO: 5505587 - DNA, 14 bp, Homo sapiens
gtttgaagcctgga

SEQ ID NO: 5505588 - DNA, 14 bp, Homo sapiens
gtttgaagcctgtg

SEQ ID NO: 5505589 - DNA, 15 bp, Homo sapiens
gtttgaagcctgtgc

SEQ ID NO: 5505590 - DNA, 12 bp, Homo sapiens
gtttgaagctgc

SEQ ID NO: 5505591 - DNA, 15 bp, Homo sapiens
gtttgaaggaaacag

SEQ ID NO: 5505592 - DNA, 17 bp, Homo sapiens
gtttgaaggaaacagtt

SEQ ID NO: 5505593 - DNA, 14 bp, Homo sapiens
gtttgaatatggac

SEQ ID NO: 5505594 - DNA, 17 bp, Homo sapiens
gtttgaatgttaaataa

SEQ ID NO: 5505595 - DNA, 20 bp, Homo sapiens
gtttgaatttgtattaaaaa

SEQ ID NO: 5505596 - DNA, 17 bp, Homo sapiens
gtttgacactaagaaaa

SEQ ID NO: 5505597 - DNA, 11 bp, Homo sapiens
gtttgacactg

SEQ ID NO: 5505598 - DNA, 19 bp, Homo sapiens
gtttgacagtttttgacat

SEQ ID NO: 5505599 - DNA, 16 bp, Homo sapiens
gtttgaccaatttgca

SEQ ID NO: 5505600 - DNA, 17 bp, Homo sapiens
gtttgaccaatttgcac

SEQ ID NO: 5505601 - DNA, 16 bp, Homo sapiens
gtttgactacatagtc

SEQ ID NO: 5505602 - DNA, 18 bp, Homo sapiens
gtttgactagccatctca

SEQ ID NO: 5505603 - DNA, 13 bp, Homo sapiens
gtttgactcagtt

SEQ ID NO: 5505604 - DNA, 23 bp, Homo sapiens
gtttgactctgtccaactctgta

SEQ ID NO: 5505605 - DNA, 13 bp, Homo sapiens
gtttgactgtaat

SEQ ID NO: 5505606 - DNA, 14 bp, Homo sapiens
gtttgacttgtttg

SEQ ID NO: 5505607 - DNA, 14 bp, Homo sapiens
gtttgactttaaag

SEQ ID NO: 5505608 - DNA, 19 bp, Homo sapiens
gtttgactttcaaaatata

SEQ ID NO: 5505609 - DNA, 13 bp, Homo sapiens
gtttgactttttg

SEQ ID NO: 5505610 - DNA, 23 bp, Homo sapiens
gtttgagaaaggcacatattgga

SEQ ID NO: 5505611 - DNA, 11 bp, Homo sapiens
gtttgagaaat

SEQ ID NO: 5505612 - DNA, 15 bp, Homo sapiens
gtttgagaccagccc

SEQ ID NO: 5505613 - DNA, 20 bp, Homo sapiens
gtttgagaccagcctgggca

SEQ ID NO: 5505614 - DNA, 15 bp, Homo sapiens
gtttgagaccaggct

SEQ ID NO: 5505615 - DNA, 21 bp, Homo sapiens
gtttgagaccaggctgggcat

SEQ ID NO: 5505616 - DNA, 21 bp, Homo sapiens
gtttgagcacaatctgttcta

SEQ ID NO: 5505617 - DNA, 22 bp, Homo sapiens
gtttgagcgcagagtaaaataa

SEQ ID NO: 5505618 - DNA, 15 bp, Homo sapiens
gtttgagctcagacc

SEQ ID NO: 5505619 - DNA, 16 bp, Homo sapiens
gtttgagctcagaccc

SEQ ID NO: 5505620 - DNA, 14 bp, Homo sapiens
gtttgagctgcctt

SEQ ID NO: 5505621 - DNA, 15 bp, Homo sapiens
gtttgagctgccttc

SEQ ID NO: 5505622 - DNA, 18 bp, Homo sapiens
gtttgagctgccttccct

SEQ ID NO: 5505623 - DNA, 12 bp, Homo sapiens
gttttctccttc

SEQ ID NO: 5505624 - DNA, 13 bp, Homo sapiens
gttttctccttcc

SEQ ID NO: 5505625 - DNA, 17 bp, Homo sapiens
gttttctctcggctccc

SEQ ID NO: 5505626 - DNA, 10 bp, Homo sapiens
gttttctctg

SEQ ID NO: 5505627 - DNA, 19 bp, Homo sapiens
gttttctcttactgcagta

SEQ ID NO: 5505628 - DNA, 17 bp, Homo sapiens
gttttctctttgtgggg

SEQ ID NO: 5505629 - DNA, 13 bp, Homo sapiens
gttttctgaaaca

SEQ ID NO: 5505630 - DNA, 17 bp, Homo sapiens
gttttctgaaacacacg

SEQ ID NO: 5505631 - DNA, 23 bp, Homo sapiens
gttttctgagaaagactattcaa

SEQ ID NO: 5505632 - DNA, 17 bp, Homo sapiens
gttttctgagcccgggc

SEQ ID NO: 5505633 - DNA, 22 bp, Homo sapiens
gttttctgcagaaaaaaataaa

SEQ ID NO: 5505634 - DNA, 14 bp, Homo sapiens
gttttctgctgttt

SEQ ID NO: 5505635 - DNA, 11 bp, Homo sapiens
gttttctggaa

SEQ ID NO: 5505636 - DNA, 17 bp, Homo sapiens
gttttctggctggagcc

SEQ ID NO: 5505637 - DNA, 17 bp, Homo sapiens
gttttctggcttctgct

SEQ ID NO: 5505638 - DNA, 18 bp, Homo sapiens
gttttctgggggaaaaag

SEQ ID NO: 5505639 - DNA, 23 bp, Homo sapiens
gttttctgtagtcatttactaaa

SEQ ID NO: 5505640 - DNA, 14 bp, Homo sapiens
gttttctgtgcact

SEQ ID NO: 5505641 - DNA, 18 bp, Homo sapiens
gttttctgtgtaaccatt

SEQ ID NO: 5505642 - DNA, 11 bp, Homo sapiens
gttttctgttc

SEQ ID NO: 5505643 - DNA, 19 bp, Homo sapiens
gttttctgttctttctggc

SEQ ID NO: 5505644 - DNA, 18 bp, Homo sapiens
gttttctgtttgtaaatt

SEQ ID NO: 5505645 - DNA, 19 bp, Homo sapiens
gttttctgtttgtaaatta

SEQ ID NO: 5505646 - DNA, 18 bp, Homo sapiens
gttttcttaaatgttttc

SEQ ID NO: 5505647 - DNA, 20 bp, Homo sapiens
gttttcttaaccagatcatt

SEQ ID NO: 5505648 - DNA, 16 bp, Homo sapiens
gttttcttaacttaaa

SEQ ID NO: 5505649 - DNA, 13 bp, Homo sapiens
gttttcttctttc

SEQ ID NO: 5505650 - DNA, 19 bp, Homo sapiens
gttttcttctttccctgga

SEQ ID NO: 5505651 - DNA, 19 bp, Homo sapiens
gttttcttgccaccctctg

SEQ ID NO: 5505652 - DNA, 17 bp, Homo sapiens
gttttcttgtaaatgtt

SEQ ID NO: 5505653 - DNA, 20 bp, Homo sapiens
gttttcttgtaaatgtttct

SEQ ID NO: 5505654 - DNA, 19 bp, Homo sapiens
gttttcttgttgctttgtt

SEQ ID NO: 5505655 - DNA, 14 bp, Homo sapiens
gttttctttacaca

SEQ ID NO: 5505656 - DNA, 20 bp, Homo sapiens
gttttctttgcaaagtattg

SEQ ID NO: 5505657 - DNA, 19 bp, Homo sapiens
gttttctttgtaaaggtca

SEQ ID NO: 5505658 - DNA, 22 bp, Homo sapiens
gttttcttttttaaatgtttct

SEQ ID NO: 5505659 - DNA, 21 bp, Homo sapiens
gttttgaaaagctattagcca

SEQ ID NO: 5505660 - DNA, 20 bp, Homo sapiens
gttttgaaataaaaagagta

SEQ ID NO: 5505661 - DNA, 22 bp, Homo sapiens
gttttgaactaataaaagcata

SEQ ID NO: 5505662 - DNA, 17 bp, Homo sapiens
gttttgaagattctatg

SEQ ID NO: 5505663 - DNA, 20 bp, Homo sapiens
gttttgaagattctatgtta

SEQ ID NO: 5505664 - DNA, 19 bp, Homo sapiens
gttttgaagctactgtgtg

SEQ ID NO: 5505665 - DNA, 21 bp, Homo sapiens
gttttgaaggcaaaattgcaa

SEQ ID NO: 5505666 - DNA, 14 bp, Homo sapiens
gttttgaataaaaa

SEQ ID NO: 5505667 - DNA, 16 bp, Homo sapiens
gttttgaataaaaagt

SEQ ID NO: 5505668 - DNA, 23 bp, Homo sapiens
gttttgaataaaaagtgaacttt

SEQ ID NO: 5505669 - DNA, 18 bp, Homo sapiens
gttttgaatggtgttgta

SEQ ID NO: 5505670 - DNA, 14 bp, Homo sapiens
gttttgaattgtgt

SEQ ID NO: 5505671 - DNA, 19 bp, Homo sapiens
gttttgacaggttttccaa

SEQ ID NO: 5505672 - DNA, 16 bp, Homo sapiens
gttttgacttaagaaa

SEQ ID NO: 5505673 - DNA, 11 bp, Homo sapiens
gttttgagaaa

SEQ ID NO: 5505674 - DNA, 12 bp, Homo sapiens
gttttgagaaaa

SEQ ID NO: 5505675 - DNA, 23 bp, Homo sapiens
gttttgagataagttttgtttca

SEQ ID NO: 5505676 - DNA, 12 bp, Homo sapiens
gttttgagccct

SEQ ID NO: 5505677 - DNA, 21 bp, Homo sapiens
gttttgagctactggattctt

SEQ ID NO: 5505678 - DNA, 12 bp, Homo sapiens
gttttgagcttt

SEQ ID NO: 5505679 - DNA, 18 bp, Homo sapiens
gttttgaggcatgactaa

SEQ ID NO: 5505680 - DNA, 13 bp, Homo sapiens
gttttgagtaaaa

SEQ ID NO: 5505681 - DNA, 22 bp, Homo sapiens
gttttgagtagatattacttta

SEQ ID NO: 5505682 - DNA, 15 bp, Homo sapiens
gttttgatacttgta

SEQ ID NO: 5505683 - DNA, 20 bp, Homo sapiens
gttttgatacttgtaacttt

SEQ ID NO: 5505684 - DNA, 21 bp, Homo sapiens
gttttgataggaataattttc

SEQ ID NO: 5505685 - DNA, 15 bp, Homo sapiens
gttttgatatgagta

SEQ ID NO: 5505686 - DNA, 20 bp, Homo sapiens
gttttgatatttatttcctg

SEQ ID NO: 5505687 - DNA, 21 bp, Homo sapiens
gttttgatgaaattcttgaag

SEQ ID NO: 5505688 - DNA, 14 bp, Homo sapiens
gttttgatgccatt

SEQ ID NO: 5505689 - DNA, 18 bp, Homo sapiens
gttttgatggctgggtcc

SEQ ID NO: 5505690 - DNA, 19 bp, Homo sapiens
gttttgatggctgggtcct

SEQ ID NO: 5505691 - DNA, 21 bp, Homo sapiens
gttttgatgtttgtggcctca

SEQ ID NO: 5505692 - DNA, 20 bp, Homo sapiens
gttttgatttaatgttttca

SEQ ID NO: 5505693 - DNA, 13 bp, Homo sapiens
gttttgcaaaggg

SEQ ID NO: 5505694 - DNA, 22 bp, Homo sapiens
gttttgcacagccaaatttaaa

SEQ ID NO: 5505695 - DNA, 17 bp, Homo sapiens
gttttgcacattttgtg

SEQ ID NO: 5505696 - DNA, 13 bp, Homo sapiens
gttttgcactctt

SEQ ID NO: 5505697 - DNA, 18 bp, Homo sapiens
gttttgcactgacaagat

SEQ ID NO: 5505698 - DNA, 16 bp, Homo sapiens
gttttgcatgtctgca

SEQ ID NO: 5505699 - DNA, 18 bp, Homo sapiens
gttttgcattgtctgttg

SEQ ID NO: 5505700 - DNA, 20 bp, Homo sapiens
gttttgccatgtagcagaca

SEQ ID NO: 5505701 - DNA, 16 bp, Homo sapiens
gttttgccatgttggc

SEQ ID NO: 5505702 - DNA, 21 bp, Homo sapiens
gttttgccatgttggccaggc

SEQ ID NO: 5505703 - DNA, 22 bp, Homo sapiens
gttttgccccatgataaaataa

SEQ ID NO: 5505704 - DNA, 19 bp, Homo sapiens
gttttgcctcatgaacact

SEQ ID NO: 5505705 - DNA, 13 bp, Homo sapiens
gttttgcctcttt

SEQ ID NO: 5505706 - DNA, 23 bp, Homo sapiens
gttttgcctctttaaattatgac

SEQ ID NO: 5505707 - DNA, 13 bp, Homo sapiens
gttttgcctgaga

SEQ ID NO: 5505708 - DNA, 11 bp, Homo sapiens
gttttgctaat

SEQ ID NO: 5505709 - DNA, 19 bp, Homo sapiens
gttttgctaggtataaaaa

SEQ ID NO: 5505710 - DNA, 19 bp, Homo sapiens
gttttgctattagactgta

SEQ ID NO: 5505711 - DNA, 18 bp, Homo sapiens
gttttgctcttgtagccc

SEQ ID NO: 5505712 - DNA, 11 bp, Homo sapiens
gttttgctgct

SEQ ID NO: 5505713 - DNA, 16 bp, Homo sapiens
gttttgctgtttcctt

SEQ ID NO: 5505714 - DNA, 18 bp, Homo sapiens
gttttgcttttgtaactt

SEQ ID NO: 5505715 - DNA, 15 bp, Homo sapiens
gttttggactctctg

SEQ ID NO: 5505716 - DNA, 22 bp, Homo sapiens
gttttggactctctgtggtccc

SEQ ID NO: 5505717 - DNA, 22 bp, Homo sapiens
gttttggatgttgctatagtga

SEQ ID NO: 5505718 - DNA, 20 bp, Homo sapiens
gttttggcaaacgctaaaga

SEQ ID NO: 5505719 - DNA, 14 bp, Homo sapiens
gttttggcagccag

SEQ ID NO: 5505720 - DNA, 18 bp, Homo sapiens
gttttggcagccatgata

SEQ ID NO: 5505721 - DNA, 14 bp, Homo sapiens
gttttggcagctga

SEQ ID NO: 5505722 - DNA, 20 bp, Homo sapiens
gttttggctctcccaccccg

SEQ ID NO: 5505723 - DNA, 22 bp, Homo sapiens
gttttggctgaaattctcctgg

SEQ ID NO: 5505724 - DNA, 14 bp, Homo sapiens
gttttgggaaaaat

SEQ ID NO: 5505725 - DNA, 23 bp, Homo sapiens
gttttgggccagaggcagcctct

SEQ ID NO: 5505726 - DNA, 20 bp, Homo sapiens
gttttggggaaatgtggaga

SEQ ID NO: 5505727 - DNA, 16 bp, Homo sapiens
gttttggggactcatt

SEQ ID NO: 5505728 - DNA, 21 bp, Homo sapiens
gttttgggggtgtgagtgttt

SEQ ID NO: 5505729 - DNA, 15 bp, Homo sapiens
gttttgggtactttc

SEQ ID NO: 5505730 - DNA, 23 bp, Homo sapiens
gttttgggtactttctatctcat

SEQ ID NO: 5505731 - DNA, 19 bp, Homo sapiens
gttttgggtgaatcttgag

SEQ ID NO: 5505732 - DNA, 19 bp, Homo sapiens
gttttgggtgtttttcatg

SEQ ID NO: 5505733 - DNA, 18 bp, Homo sapiens
gttttgggttttttctgt

SEQ ID NO: 5505734 - DNA, 17 bp, Homo sapiens
gttttggtagattaaat

SEQ ID NO: 5505735 - DNA, 14 bp, Homo sapiens
gttttggtcccctc

SEQ ID NO: 5505736 - DNA, 16 bp, Homo sapiens
gttttggttaataaaa

SEQ ID NO: 5505737 - DNA, 15 bp, Homo sapiens
gttttggttatttct

SEQ ID NO: 5505738 - DNA, 15 bp, Homo sapiens
gttttggttccacaa

SEQ ID NO: 5505739 - DNA, 15 bp, Homo sapiens
gttttgtaaaactgt

SEQ ID NO: 5505740 - DNA, 14 bp, Homo sapiens
gttttgtaaaagaa

SEQ ID NO: 5505741 - DNA, 17 bp, Homo sapiens
gttttgtaaacatttat

SEQ ID NO: 5505742 - DNA, 18 bp, Homo sapiens
gttttgtaaactttgaaa

SEQ ID NO: 5505743 - DNA, 14 bp, Homo sapiens
gttttgtaaatgta

SEQ ID NO: 5505744 - DNA, 14 bp, Homo sapiens
gttttgtaaatttc

SEQ ID NO: 5505745 - DNA, 15 bp, Homo sapiens
gttttgtaagccctc

SEQ ID NO: 5505746 - DNA, 20 bp, Homo sapiens
gttttgtacaaagttttcct

SEQ ID NO: 5505747 - DNA, 17 bp, Homo sapiens
gttttgtacactgctgt

SEQ ID NO: 5505748 - DNA, 12 bp, Homo sapiens
gttttgtacatg

SEQ ID NO: 5505749 - DNA, 16 bp, Homo sapiens
gttttgtacttgttct

SEQ ID NO: 5505750 - DNA, 15 bp, Homo sapiens
gttttgtaggtactt

SEQ ID NO: 5505751 - DNA, 12 bp, Homo sapiens
gttttgtataca

SEQ ID NO: 5505752 - DNA, 21 bp, Homo sapiens
gttttgtatacaaatatattg

SEQ ID NO: 5505753 - DNA, 16 bp, Homo sapiens
gttttgtatatacagt

SEQ ID NO: 5505754 - DNA, 17 bp, Homo sapiens
gttttgtatatacagtt

SEQ ID NO: 5505755 - DNA, 18 bp, Homo sapiens
gttttgtatatgctgcat

SEQ ID NO: 5505756 - DNA, 19 bp, Homo sapiens
gttttgtatcttaaatttg

SEQ ID NO: 5505757 - DNA, 23 bp, Homo sapiens
gttttgtattgagggccagtgat

SEQ ID NO: 5505758 - DNA, 22 bp, Homo sapiens
gttttgtattttttaaaacact

SEQ ID NO: 5505759 - DNA, 15 bp, Homo sapiens
gttttgtcagacttc

SEQ ID NO: 5505760 - DNA, 20 bp, Homo sapiens
gttttgtcattcagagtcag

SEQ ID NO: 5505761 - DNA, 16 bp, Homo sapiens
gttttgtccattatta

SEQ ID NO: 5505762 - DNA, 19 bp, Homo sapiens
gttttgtcctgcctcttgt

SEQ ID NO: 5505763 - DNA, 17 bp, Homo sapiens
gttttgtctctgcatct

SEQ ID NO: 5505764 - DNA, 18 bp, Homo sapiens
gttttgtctgtgttgctg

SEQ ID NO: 5505765 - DNA, 19 bp, Homo sapiens
gttttgtcttgaaagtggc

SEQ ID NO: 5505766 - DNA, 14 bp, Homo sapiens
gttttgtcttgaat

SEQ ID NO: 5505767 - DNA, 19 bp, Homo sapiens
gttttgtgaaatttttcat

SEQ ID NO: 5505768 - DNA, 22 bp, Homo sapiens
gttttgtgaaatttttcatatt

SEQ ID NO: 5505769 - DNA, 23 bp, Homo sapiens
gttttgtgaaatttttcatattt

SEQ ID NO: 5505770 - DNA, 20 bp, Homo sapiens
gttttgtgatgcattttata

SEQ ID NO: 5505771 - DNA, 21 bp, Homo sapiens
gttttgtgctttaaaaatgca

SEQ ID NO: 5505772 - DNA, 22 bp, Homo sapiens
gttttgtggactgagcgaggaa

SEQ ID NO: 5505773 - DNA, 17 bp, Homo sapiens
gttttgtggataagaaa

SEQ ID NO: 5505774 - DNA, 19 bp, Homo sapiens
gttttgtggattaaacctt

SEQ ID NO: 5505775 - DNA, 17 bp, Homo sapiens
gttttgtgtaacatatt

SEQ ID NO: 5505776 - DNA, 17 bp, Homo sapiens
gttttgtgtacttttaa

SEQ ID NO: 5505777 - DNA, 15 bp, Homo sapiens
gttttgtgtatattg

SEQ ID NO: 5505778 - DNA, 21 bp, Homo sapiens
gttttgtgtatatttgcttca

SEQ ID NO: 5505779 - DNA, 16 bp, Homo sapiens
gttttgtgttgtgtct

SEQ ID NO: 5505780 - DNA, 17 bp, Homo sapiens
gttttgtgtttgttgta

SEQ ID NO: 5505781 - DNA, 15 bp, Homo sapiens
gttttgtgtttttcc

SEQ ID NO: 5505782 - DNA, 15 bp, Homo sapiens
gttttgtgttttttt

SEQ ID NO: 5505783 - DNA, 13 bp, Homo sapiens
gttttgttaacaa

SEQ ID NO: 5505784 - DNA, 14 bp, Homo sapiens
gttttgttaacaat

SEQ ID NO: 5505785 - DNA, 13 bp, Homo sapiens
gttttgttaatat

SEQ ID NO: 5505786 - DNA, 23 bp, Homo sapiens
gttttgttcacttgttatctaat

SEQ ID NO: 5505787 - DNA, 14 bp, Homo sapiens
gttttgttccagag

SEQ ID NO: 5505788 - DNA, 15 bp, Homo sapiens
gttttgttcccctcc

SEQ ID NO: 5505789 - DNA, 17 bp, Homo sapiens
gttttgttcccctcctc

SEQ ID NO: 5505790 - DNA, 22 bp, Homo sapiens
gttttgttcccctcctccactc

SEQ ID NO: 5505791 - DNA, 13 bp, Homo sapiens
gttttgttctgta

SEQ ID NO: 5505792 - DNA, 12 bp, Homo sapiens
gttttgttcttt

SEQ ID NO: 5505793 - DNA, 10 bp, Homo sapiens
gttttgttgc

SEQ ID NO: 5505794 - DNA, 12 bp, Homo sapiens
gttttgttgcta

SEQ ID NO: 5505795 - DNA, 14 bp, Homo sapiens
gttttgtttcttga

SEQ ID NO: 5505796 - DNA, 20 bp, Homo sapiens
gttttgtttggcaaggaaag

SEQ ID NO: 5505797 - DNA, 19 bp, Homo sapiens
gttttgtttggttttacat

SEQ ID NO: 5505798 - DNA, 13 bp, Homo sapiens
gttttgttttttg

SEQ ID NO: 5505799 - DNA, 16 bp, Homo sapiens
gttttgttttttgagt

SEQ ID NO: 5505800 - DNA, 16 bp, Homo sapiens
gttttgtttttttcct

SEQ ID NO: 5505801 - DNA, 15 bp, Homo sapiens
taaaaattattatat

SEQ ID NO: 5505802 - DNA, 16 bp, Homo sapiens
taaaaattcatataaa

SEQ ID NO: 5505803 - DNA, 16 bp, Homo sapiens
taaaaattccagaatg

SEQ ID NO: 5505804 - DNA, 12 bp, Homo sapiens
taaaaattctag

SEQ ID NO: 5505805 - DNA, 14 bp, Homo sapiens
taaaaattctgaat

SEQ ID NO: 5505806 - DNA, 15 bp, Homo sapiens
taaaaattctgaatg

SEQ ID NO: 5505807 - DNA, 16 bp, Homo sapiens
taaaaattgaaaaaag

SEQ ID NO: 5505808 - DNA, 18 bp, Homo sapiens
taaaaattgaattcgttt

SEQ ID NO: 5505809 - DNA, 17 bp, Homo sapiens
taaaaattggagctcat

SEQ ID NO: 5505810 - DNA, 16 bp, Homo sapiens
taaaaattggcatttt

SEQ ID NO: 5505811 - DNA, 19 bp, Homo sapiens
taaaaattggcattttaag

SEQ ID NO: 5505812 - DNA, 16 bp, Homo sapiens
taaaaattgtagcttt

SEQ ID NO: 5505813 - DNA, 13 bp, Homo sapiens
taaaaattgtttc

SEQ ID NO: 5505814 - DNA, 12 bp, Homo sapiens
taaaaatttata

SEQ ID NO: 5505815 - DNA, 14 bp, Homo sapiens
taaaaatttataac

SEQ ID NO: 5505816 - DNA, 16 bp, Homo sapiens
taaaaatttataacag

SEQ ID NO: 5505817 - DNA, 14 bp, Homo sapiens
taaaaatttgttta

SEQ ID NO: 5505818 - DNA, 16 bp, Homo sapiens
taaaaatttgtttaaa

SEQ ID NO: 5505819 - DNA, 17 bp, Homo sapiens
taaaaattttgcatttc

SEQ ID NO: 5505820 - DNA, 11 bp, Homo sapiens
taaaacaaaac

SEQ ID NO: 5505821 - DNA, 14 bp, Homo sapiens
taaaacaaaacaaa

SEQ ID NO: 5505822 - DNA, 22 bp, Homo sapiens
taaaacaaaacaaaacaaactt

SEQ ID NO: 5505823 - DNA, 20 bp, Homo sapiens
taaaacaaaacaaacaacct

SEQ ID NO: 5505824 - DNA, 16 bp, Homo sapiens
taaaacaaaagctcat

SEQ ID NO: 5505825 - DNA, 14 bp, Homo sapiens
taaaacaaaatctg

SEQ ID NO: 5505826 - DNA, 17 bp, Homo sapiens
taaaacaaaatttgact

SEQ ID NO: 5505827 - DNA, 21 bp, Homo sapiens
taaaacaaaatttgactaatt

SEQ ID NO: 5505828 - DNA, 17 bp, Homo sapiens
taaaacaaaatttgttt

SEQ ID NO: 5505829 - DNA, 11 bp, Homo sapiens
taaaacaaata

SEQ ID NO: 5505830 - DNA, 18 bp, Homo sapiens
taaaacaaataaatatga

SEQ ID NO: 5505831 - DNA, 21 bp, Homo sapiens
taaaacaaatatacattttct

SEQ ID NO: 5505832 - DNA, 17 bp, Homo sapiens
taaaacaacagctcgat

SEQ ID NO: 5505833 - DNA, 20 bp, Homo sapiens
taaaacaactctgatgtgga

SEQ ID NO: 5505834 - DNA, 22 bp, Homo sapiens
taaaacaactctgatgtggaat

SEQ ID NO: 5505835 - DNA, 20 bp, Homo sapiens
taaaacaagaaagtttcccc

SEQ ID NO: 5505836 - DNA, 23 bp, Homo sapiens
taaaacaagagaccacttcctta

SEQ ID NO: 5505837 - DNA, 21 bp, Homo sapiens
taaaacaagaggacacaatgg

SEQ ID NO: 5505838 - DNA, 11 bp, Homo sapiens
taaaacaagcc

SEQ ID NO: 5505839 - DNA, 13 bp, Homo sapiens
taaaacaagcctt

SEQ ID NO: 5505840 - DNA, 24 bp, Homo sapiens
taaaacaaggcttaaaagagtaga

SEQ ID NO: 5505841 - DNA, 17 bp, Homo sapiens
taaaacaagggaaaaat

SEQ ID NO: 5505842 - DNA, 19 bp, Homo sapiens
taaaacaaggggttacttt

SEQ ID NO: 5505843 - DNA, 20 bp, Homo sapiens
taaaacaaggggttacttta

SEQ ID NO: 5505844 - DNA, 19 bp, Homo sapiens
taaaacaataaatgaatga

SEQ ID NO: 5505845 - DNA, 14 bp, Homo sapiens
taaaacaatattgt

SEQ ID NO: 5505846 - DNA, 24 bp, Homo sapiens
taaaacaatgaattgaatgctcta

SEQ ID NO: 5505847 - DNA, 18 bp, Homo sapiens
taaaacaatgccatgaac

SEQ ID NO: 5505848 - DNA, 22 bp, Homo sapiens
taaaacaatgtttttcatactg

SEQ ID NO: 5505849 - DNA, 20 bp, Homo sapiens
taaaacacaaaatgaataaa

SEQ ID NO: 5505850 - DNA, 19 bp, Homo sapiens
taaaacacaacaagaaact

SEQ ID NO: 5505851 - DNA, 17 bp, Homo sapiens
taaaacacaacatcttt

SEQ ID NO: 5505852 - DNA, 14 bp, Homo sapiens
taaaacacacaggt

SEQ ID NO: 5505853 - DNA, 16 bp, Homo sapiens
taaaacacagtattgt

SEQ ID NO: 5505854 - DNA, 20 bp, Homo sapiens
taaaacacagtattgtagaa

SEQ ID NO: 5505855 - DNA, 12 bp, Homo sapiens
taaaacacatga

SEQ ID NO: 5505856 - DNA, 21 bp, Homo sapiens
taaaacacctcagctgcctcc

SEQ ID NO: 5505857 - DNA, 14 bp, Homo sapiens
taaaacactaaaag

SEQ ID NO: 5505858 - DNA, 17 bp, Homo sapiens
taaaacactttcaaaac

SEQ ID NO: 5505859 - DNA, 18 bp, Homo sapiens
taaaacagaatcttctgg

SEQ ID NO: 5505860 - DNA, 18 bp, Homo sapiens
taaaacagacactggcat

SEQ ID NO: 5505861 - DNA, 21 bp, Homo sapiens
taaaacagcctatagatgatg

SEQ ID NO: 5505862 - DNA, 19 bp, Homo sapiens
taaaacagctattttagta

SEQ ID NO: 5505863 - DNA, 12 bp, Homo sapiens
taaaacagctgt

SEQ ID NO: 5505864 - DNA, 17 bp, Homo sapiens
taaaacagctgttttta

SEQ ID NO: 5505865 - DNA, 17 bp, Homo sapiens
taaaacaggcaaagttt

SEQ ID NO: 5505866 - DNA, 23 bp, Homo sapiens
taaaacaggcaaagttttacaga

SEQ ID NO: 5505867 - DNA, 14 bp, Homo sapiens
taaaacagtatctc

SEQ ID NO: 5505868 - DNA, 12 bp, Homo sapiens
taaaacagtcat

SEQ ID NO: 5505869 - DNA, 19 bp, Homo sapiens
taaaacagtgtttccagtg

SEQ ID NO: 5505870 - DNA, 22 bp, Homo sapiens
taaaacagttggcatgcatccc

SEQ ID NO: 5505871 - DNA, 18 bp, Homo sapiens
taaaacataaacacattt

SEQ ID NO: 5505872 - DNA, 13 bp, Homo sapiens
taaaacatagcaa

SEQ ID NO: 5505873 - DNA, 14 bp, Homo sapiens
taaaacatcaaaat

SEQ ID NO: 5505874 - DNA, 17 bp, Homo sapiens
taaaacatcattccttt

SEQ ID NO: 5505875 - DNA, 19 bp, Homo sapiens
taaaacatctttgaaatta

SEQ ID NO: 5505876 - DNA, 23 bp, Homo sapiens
taaaacatgaaaattatctccct

SEQ ID NO: 5505877 - DNA, 13 bp, Homo sapiens
taaaacatgcacg

SEQ ID NO: 5505878 - DNA, 23 bp, Homo sapiens
taaaacatggtgcctatatctga

SEQ ID NO: 5505879 - DNA, 12 bp, Homo sapiens
taaaacattaaa

SEQ ID NO: 5505880 - DNA, 15 bp, Homo sapiens
taaaacattaaaata

SEQ ID NO: 5505881 - DNA, 16 bp, Homo sapiens
taaaacattaagaaaa

SEQ ID NO: 5505882 - DNA, 12 bp, Homo sapiens
taaaacattaat

SEQ ID NO: 5505883 - DNA, 13 bp, Homo sapiens
taaaacattactt

SEQ ID NO: 5505884 - DNA, 17 bp, Homo sapiens
taaaacattagaagaaa

SEQ ID NO: 5505885 - DNA, 20 bp, Homo sapiens
taaaacattagaagaaaaca

SEQ ID NO: 5505886 - DNA, 23 bp, Homo sapiens
taaaacattagaagaaaacatat

SEQ ID NO: 5505887 - DNA, 14 bp, Homo sapiens
taaaacattatttc

SEQ ID NO: 5505888 - DNA, 14 bp, Homo sapiens
taaaacattcccct

SEQ ID NO: 5505889 - DNA, 17 bp, Homo sapiens
taaaacattggattatc

SEQ ID NO: 5505890 - DNA, 19 bp, Homo sapiens
taaaacattggattatcct

SEQ ID NO: 5505891 - DNA, 21 bp, Homo sapiens
taaaacattggattatcctga

SEQ ID NO: 5505892 - DNA, 12 bp, Homo sapiens
taaaacattgtc

SEQ ID NO: 5505893 - DNA, 20 bp, Homo sapiens
taaaacatttattttgacat

SEQ ID NO: 5505894 - DNA, 12 bp, Homo sapiens
taaaacatttca

SEQ ID NO: 5505895 - DNA, 22 bp, Homo sapiens
taaaacatttcatgtatttctt

SEQ ID NO: 5505896 - DNA, 19 bp, Homo sapiens
taaaacatttgtttccccc

SEQ ID NO: 5505897 - DNA, 14 bp, Homo sapiens
taaaacattttaaa

SEQ ID NO: 5505898 - DNA, 16 bp, Homo sapiens
taaaacattttaaatg

SEQ ID NO: 5505899 - DNA, 21 bp, Homo sapiens
taaaacattttaaatggacag

SEQ ID NO: 5505900 - DNA, 22 bp, Homo sapiens
taaaacattttaaatggacaga

SEQ ID NO: 5505901 - DNA, 15 bp, Homo sapiens
taaaacattttcaca

SEQ ID NO: 5505902 - DNA, 18 bp, Homo sapiens
taaaacattttcacacaa

SEQ ID NO: 5505903 - DNA, 13 bp, Homo sapiens
taaaaccaaagag

SEQ ID NO: 5505904 - DNA, 16 bp, Homo sapiens
taaaaccaatcaataa

SEQ ID NO: 5505905 - DNA, 13 bp, Homo sapiens
taaaaccacagca

SEQ ID NO: 5505906 - DNA, 15 bp, Homo sapiens
taaaaccacagcagt

SEQ ID NO: 5505907 - DNA, 13 bp, Homo sapiens
taaaaccacagct

SEQ ID NO: 5505908 - DNA, 14 bp, Homo sapiens
taaaaccaccaaag

SEQ ID NO: 5505909 - DNA, 15 bp, Homo sapiens
taaaaccagtaacgt

SEQ ID NO: 5505910 - DNA, 22 bp, Homo sapiens
taaaaccataaacatttgccaa

SEQ ID NO: 5505911 - DNA, 12 bp, Homo sapiens
taaaaccatgca

SEQ ID NO: 5505912 - DNA, 21 bp, Homo sapiens
taaaaccatgtagaaaatttg

SEQ ID NO: 5505913 - DNA, 19 bp, Homo sapiens
taaaaccatgtagttttaa

SEQ ID NO: 5505914 - DNA, 23 bp, Homo sapiens
taaaacccaaaccacatatgaaa

SEQ ID NO: 5505915 - DNA, 22 bp, Homo sapiens
taaaacccttggtctgtgttct

SEQ ID NO: 5505916 - DNA, 18 bp, Homo sapiens
taaaaccctttaaatgta

SEQ ID NO: 5505917 - DNA, 17 bp, Homo sapiens
taaaacctagaacttca

SEQ ID NO: 5505918 - DNA, 13 bp, Homo sapiens
taaaacctcagct

SEQ ID NO: 5505919 - DNA, 13 bp, Homo sapiens
taaaacctggaga

SEQ ID NO: 5505920 - DNA, 13 bp, Homo sapiens
taaaacctgggat

SEQ ID NO: 5505921 - DNA, 16 bp, Homo sapiens
taaaaccttgatttaa

SEQ ID NO: 5505922 - DNA, 17 bp, Homo sapiens
taaaaccttgttctatt

SEQ ID NO: 5505923 - DNA, 11 bp, Homo sapiens
taaaacctttc

SEQ ID NO: 5505924 - DNA, 13 bp, Homo sapiens
taaaacctttcaa

SEQ ID NO: 5505925 - DNA, 14 bp, Homo sapiens
taaaacgcaccaat

SEQ ID NO: 5505926 - DNA, 19 bp, Homo sapiens
taaaacgcgtctgcctggg

SEQ ID NO: 5505927 - DNA, 21 bp, Homo sapiens
taaaacggtgctttctgtgaa

SEQ ID NO: 5505928 - DNA, 22 bp, Homo sapiens
taaaacggtgctttctgtgaaa

SEQ ID NO: 5505929 - DNA, 16 bp, Homo sapiens
taaaacgtgtaaatga

SEQ ID NO: 5505930 - DNA, 23 bp, Homo sapiens
taaaacgttagttaatccctttg

SEQ ID NO: 5505931 - DNA, 12 bp, Homo sapiens
taaaactaaata

SEQ ID NO: 5505932 - DNA, 20 bp, Homo sapiens
taaaactaaatatatgtctg

SEQ ID NO: 5505933 - DNA, 17 bp, Homo sapiens
taaaactaaatttcact

SEQ ID NO: 5505934 - DNA, 11 bp, Homo sapiens
taaaactaaga

SEQ ID NO: 5505935 - DNA, 20 bp, Homo sapiens
taaaactaagctctttgaga

SEQ ID NO: 5505936 - DNA, 19 bp, Homo sapiens
taaaactaaggcttttatt

SEQ ID NO: 5505937 - DNA, 15 bp, Homo sapiens
taaaactactgcctt

SEQ ID NO: 5505938 - DNA, 17 bp, Homo sapiens
taaaactacttagcact

SEQ ID NO: 5505939 - DNA, 14 bp, Homo sapiens
taaaactataacat

SEQ ID NO: 5505940 - DNA, 22 bp, Homo sapiens
taaaactatattcatttccact

SEQ ID NO: 5505941 - DNA, 18 bp, Homo sapiens
taaaactatggttcccaa

SEQ ID NO: 5505942 - DNA, 17 bp, Homo sapiens
taaaactatttaaaatt

SEQ ID NO: 5505943 - DNA, 19 bp, Homo sapiens
taaaactatttaaaattgg

SEQ ID NO: 5505944 - DNA, 22 bp, Homo sapiens
taaaactcaacattactgttaa

SEQ ID NO: 5505945 - DNA, 17 bp, Homo sapiens
taaaactcactgtgatc

SEQ ID NO: 5505946 - DNA, 12 bp, Homo sapiens
taaaactcagaa

SEQ ID NO: 5505947 - DNA, 22 bp, Homo sapiens
taaaactcagaatataacatgt

SEQ ID NO: 5505948 - DNA, 14 bp, Homo sapiens
taaaactcagattt

SEQ ID NO: 5505949 - DNA, 17 bp, Homo sapiens
taaaactcataatgttg

SEQ ID NO: 5505950 - DNA, 14 bp, Homo sapiens
taaaactcataatt

SEQ ID NO: 5505951 - DNA, 20 bp, Homo sapiens
taaaactcataattattttg

SEQ ID NO: 5505952 - DNA, 16 bp, Homo sapiens
taaaactcatcacata

SEQ ID NO: 5505953 - DNA, 21 bp, Homo sapiens
taaaactccaaaatctggctt

SEQ ID NO: 5505954 - DNA, 21 bp, Homo sapiens
taaaactcgcttttattttaa

SEQ ID NO: 5505955 - DNA, 16 bp, Homo sapiens
taaaactctacagatg

SEQ ID NO: 5505956 - DNA, 13 bp, Homo sapiens
taaaactctgcca

SEQ ID NO: 5505957 - DNA, 14 bp, Homo sapiens
taaaactgaaataa

SEQ ID NO: 5505958 - DNA, 18 bp, Homo sapiens
taaaactgagtccatgaa

SEQ ID NO: 5505959 - DNA, 19 bp, Homo sapiens
taaaactgagtccatgaaa

SEQ ID NO: 5505960 - DNA, 14 bp, Homo sapiens
taaaactgatgtga

SEQ ID NO: 5505961 - DNA, 10 bp, Homo sapiens
taaaactgcg

SEQ ID NO: 5505962 - DNA, 19 bp, Homo sapiens
taaaactggcatctgacac

SEQ ID NO: 5505963 - DNA, 18 bp, Homo sapiens
taaaactgggtcatcatt

SEQ ID NO: 5505964 - DNA, 13 bp, Homo sapiens
taaaactgggttg

SEQ ID NO: 5505965 - DNA, 20 bp, Homo sapiens
taaaactggtttagcacaat

SEQ ID NO: 5505966 - DNA, 15 bp, Homo sapiens
taaaactgtaccttt

SEQ ID NO: 5505967 - DNA, 17 bp, Homo sapiens
taaaactgtaccttttg

SEQ ID NO: 5505968 - DNA, 14 bp, Homo sapiens
taaaactgtacttt

SEQ ID NO: 5505969 - DNA, 17 bp, Homo sapiens
taaaactgtactttgat

SEQ ID NO: 5505970 - DNA, 22 bp, Homo sapiens
taaaactgtactttgattcaca

SEQ ID NO: 5505971 - DNA, 23 bp, Homo sapiens
taaaactgtactttgattcacat

SEQ ID NO: 5505972 - DNA, 16 bp, Homo sapiens
taaaactgtcactgtt

SEQ ID NO: 5505973 - DNA, 10 bp, Homo sapiens
taaaactgtg

SEQ ID NO: 5505974 - DNA, 13 bp, Homo sapiens
taaaactgtgaca

SEQ ID NO: 5505975 - DNA, 13 bp, Homo sapiens
taaaactgtgtaa

SEQ ID NO: 5505976 - DNA, 14 bp, Homo sapiens
taaaactgtgtaaa

SEQ ID NO: 5505977 - DNA, 21 bp, Homo sapiens
taaaactgtttgacttctcaa

SEQ ID NO: 5505978 - DNA, 20 bp, Homo sapiens
taaaactgtttttgaacctg

SEQ ID NO: 5505979 - DNA, 18 bp, Homo sapiens
taaaacttactatggtat

SEQ ID NO: 5505980 - DNA, 20 bp, Homo sapiens
taaaacttataaatttcatt

SEQ ID NO: 5505981 - DNA, 15 bp, Homo sapiens
taaaattaatgtaat

SEQ ID NO: 5505982 - DNA, 19 bp, Homo sapiens
taaaattaatgtaataaag

SEQ ID NO: 5505983 - DNA, 20 bp, Homo sapiens
taaaattaatgtaataaagt

SEQ ID NO: 5505984 - DNA, 21 bp, Homo sapiens
taaaattaatgtaataaagtg

SEQ ID NO: 5505985 - DNA, 13 bp, Homo sapiens
taaaattacaaaa

SEQ ID NO: 5505986 - DNA, 17 bp, Homo sapiens
taaaattacaactaagt

SEQ ID NO: 5505987 - DNA, 19 bp, Homo sapiens
taaaattacactttgaact

SEQ ID NO: 5505988 - DNA, 17 bp, Homo sapiens
taaaattacagatgtga

SEQ ID NO: 5505989 - DNA, 12 bp, Homo sapiens
taaaattactaa

SEQ ID NO: 5505990 - DNA, 16 bp, Homo sapiens
taaaattacttggctt

SEQ ID NO: 5505991 - DNA, 15 bp, Homo sapiens
taaaattagaaaaaa

SEQ ID NO: 5505992 - DNA, 22 bp, Homo sapiens
taaaattaggaacagtaaaatc

SEQ ID NO: 5505993 - DNA, 23 bp, Homo sapiens
taaaattagtgagattaaaaatc

SEQ ID NO: 5505994 - DNA, 17 bp, Homo sapiens
taaaattagtgagattt

SEQ ID NO: 5505995 - DNA, 21 bp, Homo sapiens
taaaattagtgagatttgtat

SEQ ID NO: 5505996 - DNA, 22 bp, Homo sapiens
taaaattagttttaaaatacta

SEQ ID NO: 5505997 - DNA, 16 bp, Homo sapiens
taaaattataaacttt

SEQ ID NO: 5505998 - DNA, 14 bp, Homo sapiens
taaaattatactgt

SEQ ID NO: 5505999 - DNA, 19 bp, Homo sapiens
taaaattatactgtgtgtg

SEQ ID NO: 5506000 - DNA, 20 bp, Homo sapiens
taaaattatactgtgtgtga

SEQ ID NO: 5506001 - DNA, 21 bp, Homo sapiens
taaaattatagctctaatgtt

SEQ ID NO: 5506002 - DNA, 15 bp, Homo sapiens
taaaattatatagca

SEQ ID NO: 5506003 - DNA, 19 bp, Homo sapiens
taaaattatcctctttgta

SEQ ID NO: 5506004 - DNA, 13 bp, Homo sapiens
taaaattatctgt

SEQ ID NO: 5506005 - DNA, 16 bp, Homo sapiens
taaaattatctgttct

SEQ ID NO: 5506006 - DNA, 17 bp, Homo sapiens
taaaattatctgttcta

SEQ ID NO: 5506007 - DNA, 20 bp, Homo sapiens
taaaattatctgttctatgg

SEQ ID NO: 5506008 - DNA, 21 bp, Homo sapiens
taaaattatctgttctatgga

SEQ ID NO: 5506009 - DNA, 16 bp, Homo sapiens
taaaattatggaaaca

SEQ ID NO: 5506010 - DNA, 18 bp, Homo sapiens
taaaattatggtgaaatt

SEQ ID NO: 5506011 - DNA, 15 bp, Homo sapiens
taaaattattaaaaa

SEQ ID NO: 5506012 - DNA, 18 bp, Homo sapiens
taaaattatttttattaa

SEQ ID NO: 5506013 - DNA, 18 bp, Homo sapiens
taaaattcaaaagtattg

SEQ ID NO: 5506014 - DNA, 13 bp, Homo sapiens
taaaattcaacaa

SEQ ID NO: 5506015 - DNA, 15 bp, Homo sapiens
taaaattcaccccca

SEQ ID NO: 5506016 - DNA, 12 bp, Homo sapiens
taaaattcagaa

SEQ ID NO: 5506017 - DNA, 14 bp, Homo sapiens
taaaattcagtttt

SEQ ID NO: 5506018 - DNA, 18 bp, Homo sapiens
taaaattcagtttttgta

SEQ ID NO: 5506019 - DNA, 19 bp, Homo sapiens
taaaattcagtttttgtat

SEQ ID NO: 5506020 - DNA, 20 bp, Homo sapiens
taaaattcatggaactttca

SEQ ID NO: 5506021 - DNA, 14 bp, Homo sapiens
taaaattcatttct

SEQ ID NO: 5506022 - DNA, 13 bp, Homo sapiens
taaaattctaaat

SEQ ID NO: 5506023 - DNA, 16 bp, Homo sapiens
taaaattctactgtat

SEQ ID NO: 5506024 - DNA, 13 bp, Homo sapiens
taaaattctagtc

SEQ ID NO: 5506025 - DNA, 19 bp, Homo sapiens
taaaattctagtctctgat

SEQ ID NO: 5506026 - DNA, 21 bp, Homo sapiens
taaaattctctagatttatta

SEQ ID NO: 5506027 - DNA, 20 bp, Homo sapiens
taaaattctgatgtttctgt

SEQ ID NO: 5506028 - DNA, 14 bp, Homo sapiens
taaaattctgtaat

SEQ ID NO: 5506029 - DNA, 19 bp, Homo sapiens
taaaattctgtaatttgaa

SEQ ID NO: 5506030 - DNA, 23 bp, Homo sapiens
taaaattgagttcttcctgtaat

SEQ ID NO: 5506031 - DNA, 15 bp, Homo sapiens
taaaattgagtttca

SEQ ID NO: 5506032 - DNA, 23 bp, Homo sapiens
taaaattgagtttgtagaacttt

SEQ ID NO: 5506033 - DNA, 16 bp, Homo sapiens
taaaattgatattata

SEQ ID NO: 5506034 - DNA, 19 bp, Homo sapiens
taaaattgattgtcaaata

SEQ ID NO: 5506035 - DNA, 18 bp, Homo sapiens
taaaattgcagtttcatg

SEQ ID NO: 5506036 - DNA, 19 bp, Homo sapiens
taaaattgcagtttcatgt

SEQ ID NO: 5506037 - DNA, 21 bp, Homo sapiens
taaaattgcagtttcatgtat

SEQ ID NO: 5506038 - DNA, 24 bp, Homo sapiens
taaaattgcagtttcatgtatgta

SEQ ID NO: 5506039 - DNA, 22 bp, Homo sapiens
taaaattgcatgggttttgtag

SEQ ID NO: 5506040 - DNA, 14 bp, Homo sapiens
taaaattgccatat

SEQ ID NO: 5506041 - DNA, 16 bp, Homo sapiens
taaaattgccatattg

SEQ ID NO: 5506042 - DNA, 16 bp, Homo sapiens
taaaattgccatttta

SEQ ID NO: 5506043 - DNA, 23 bp, Homo sapiens
taaaattgctaacgttttttctt

SEQ ID NO: 5506044 - DNA, 23 bp, Homo sapiens
taaaattggaaatgtcatctaac

SEQ ID NO: 5506045 - DNA, 17 bp, Homo sapiens
taaaattggcaccatgt

SEQ ID NO: 5506046 - DNA, 22 bp, Homo sapiens
taaaattgtaacctgcattttt

SEQ ID NO: 5506047 - DNA, 23 bp, Homo sapiens
taaaattgtcacctctgttaagg

SEQ ID NO: 5506048 - DNA, 16 bp, Homo sapiens
taaaattgtgatgtgt

SEQ ID NO: 5506049 - DNA, 19 bp, Homo sapiens
taaaattgtgatgttttgt

SEQ ID NO: 5506050 - DNA, 23 bp, Homo sapiens
taaaattgtgatgttttgttcaa

SEQ ID NO: 5506051 - DNA, 21 bp, Homo sapiens
taaaattgtgcataatgcttt

SEQ ID NO: 5506052 - DNA, 18 bp, Homo sapiens
taaaattgtgttcttaaa

SEQ ID NO: 5506053 - DNA, 22 bp, Homo sapiens
taaaattgtgttcttaaaatat

SEQ ID NO: 5506054 - DNA, 23 bp, Homo sapiens
taaaattgtgttcttaaaatatt

SEQ ID NO: 5506055 - DNA, 22 bp, Homo sapiens
taaaattgttaaccttgtaaga

SEQ ID NO: 5506056 - DNA, 19 bp, Homo sapiens
taaaattgttagtaaacat

SEQ ID NO: 5506057 - DNA, 12 bp, Homo sapiens
taaaattgttat

SEQ ID NO: 5506058 - DNA, 15 bp, Homo sapiens
taaaattgttcctga

SEQ ID NO: 5506059 - DNA, 14 bp, Homo sapiens
taaaatttaaaatt

SEQ ID NO: 5506060 - DNA, 19 bp, Homo sapiens
taaaatttaacatctgcag

SEQ ID NO: 5506061 - DNA, 17 bp, Homo sapiens
taaaatttaagtatctt

SEQ ID NO: 5506062 - DNA, 15 bp, Homo sapiens
taaaatttaatttca

SEQ ID NO: 5506063 - DNA, 14 bp, Homo sapiens
taaaatttacattt

SEQ ID NO: 5506064 - DNA, 15 bp, Homo sapiens
taaaatttacattta

SEQ ID NO: 5506065 - DNA, 17 bp, Homo sapiens
taaaatttacatttaat

SEQ ID NO: 5506066 - DNA, 21 bp, Homo sapiens
taaaatttacatttaatacag

SEQ ID NO: 5506067 - DNA, 15 bp, Homo sapiens
taaaatttagctgcc

SEQ ID NO: 5506068 - DNA, 16 bp, Homo sapiens
taaaatttatcttaag

SEQ ID NO: 5506069 - DNA, 16 bp, Homo sapiens
taaaatttatttgcaa

SEQ ID NO: 5506070 - DNA, 13 bp, Homo sapiens
taaaatttcagga

SEQ ID NO: 5506071 - DNA, 20 bp, Homo sapiens
taaaatttccttcaggtttt

SEQ ID NO: 5506072 - DNA, 23 bp, Homo sapiens
taaaatttcgttgtccaatttgt

SEQ ID NO: 5506073 - DNA, 18 bp, Homo sapiens
taaaatttcttagaaaac

SEQ ID NO: 5506074 - DNA, 16 bp, Homo sapiens
taaaatttgaaacatt

SEQ ID NO: 5506075 - DNA, 15 bp, Homo sapiens
taaaatttgaaactg

SEQ ID NO: 5506076 - DNA, 13 bp, Homo sapiens
taaaatttgcaca

SEQ ID NO: 5506077 - DNA, 15 bp, Homo sapiens
taaaatttggtgctt

SEQ ID NO: 5506078 - DNA, 13 bp, Homo sapiens
taaaatttgttct

SEQ ID NO: 5506079 - DNA, 19 bp, Homo sapiens
taaaattttaagctaggaa

SEQ ID NO: 5506080 - DNA, 17 bp, Homo sapiens
taaaattttaatttcta

SEQ ID NO: 5506081 - DNA, 20 bp, Homo sapiens
taaaattttacttttgttct

SEQ ID NO: 5506082 - DNA, 19 bp, Homo sapiens
taaaattttagatgtagat

SEQ ID NO: 5506083 - DNA, 15 bp, Homo sapiens
taaaattttatgaca

SEQ ID NO: 5506084 - DNA, 13 bp, Homo sapiens
taaaattttcaaa

SEQ ID NO: 5506085 - DNA, 19 bp, Homo sapiens
taaaattttcattctgaat

SEQ ID NO: 5506086 - DNA, 20 bp, Homo sapiens
taaaattttcattctgaatc

SEQ ID NO: 5506087 - DNA, 13 bp, Homo sapiens
taaaattttcctt

SEQ ID NO: 5506088 - DNA, 22 bp, Homo sapiens
taaaattttgaaccattcccta

SEQ ID NO: 5506089 - DNA, 16 bp, Homo sapiens
taaaattttgcctaat

SEQ ID NO: 5506090 - DNA, 19 bp, Homo sapiens
taaaattttgtatgttaaa

SEQ ID NO: 5506091 - DNA, 18 bp, Homo sapiens
taaaattttttattttaa

SEQ ID NO: 5506092 - DNA, 20 bp, Homo sapiens
taaaatttttttagaaagca

SEQ ID NO: 5506093 - DNA, 22 bp, Homo sapiens
taaaatttttttggtctttttg

SEQ ID NO: 5506094 - DNA, 20 bp, Homo sapiens
taaaattttttttcatgttt

SEQ ID NO: 5506095 - DNA, 17 bp, Homo sapiens
taaacaaaaagaacaat

SEQ ID NO: 5506096 - DNA, 21 bp, Homo sapiens
taaacaaaagcaaagatgcat

SEQ ID NO: 5506097 - DNA, 19 bp, Homo sapiens
taaacaaaagtgtacctgt

SEQ ID NO: 5506098 - DNA, 18 bp, Homo sapiens
taaacaaaatagaaagtt

SEQ ID NO: 5506099 - DNA, 22 bp, Homo sapiens
taaacaaaatagaaagttgcaa

SEQ ID NO: 5506100 - DNA, 23 bp, Homo sapiens
taaacaaaatagaagctgtagta

SEQ ID NO: 5506101 - DNA, 16 bp, Homo sapiens
taaacaaaatgaaaat

SEQ ID NO: 5506102 - DNA, 16 bp, Homo sapiens
taaacaaaatgaagct

SEQ ID NO: 5506103 - DNA, 13 bp, Homo sapiens
taaacaaaattta

SEQ ID NO: 5506104 - DNA, 20 bp, Homo sapiens
taaacaaaatttatgtcatt

SEQ ID NO: 5506105 - DNA, 21 bp, Homo sapiens
taaacaaaatttatgtcattt

SEQ ID NO: 5506106 - DNA, 22 bp, Homo sapiens
taaacaaaatttatgtcatttt

SEQ ID NO: 5506107 - DNA, 12 bp, Homo sapiens
taaacaaacaag

SEQ ID NO: 5506108 - DNA, 14 bp, Homo sapiens
taaacaaacaagcc

SEQ ID NO: 5506109 - DNA, 22 bp, Homo sapiens
taaacaaacaagccccctgccc

SEQ ID NO: 5506110 - DNA, 17 bp, Homo sapiens
taaacaaactcttgaag

SEQ ID NO: 5506111 - DNA, 13 bp, Homo sapiens
taaacaaagacat

SEQ ID NO: 5506112 - DNA, 18 bp, Homo sapiens
taaacaaagacattgaca

SEQ ID NO: 5506113 - DNA, 21 bp, Homo sapiens
taaacaaagacattgacagca

SEQ ID NO: 5506114 - DNA, 22 bp, Homo sapiens
taaacaaagagtagaactttaa

SEQ ID NO: 5506115 - DNA, 18 bp, Homo sapiens
taaacaaagattcatgat

SEQ ID NO: 5506116 - DNA, 14 bp, Homo sapiens
taaacaaagttact

SEQ ID NO: 5506117 - DNA, 17 bp, Homo sapiens
taaacaaagttactagg

SEQ ID NO: 5506118 - DNA, 19 bp, Homo sapiens
taaacaaataaaatacttt

SEQ ID NO: 5506119 - DNA, 14 bp, Homo sapiens
taaacaaataataa

SEQ ID NO: 5506120 - DNA, 14 bp, Homo sapiens
taaacaaatatgaa

SEQ ID NO: 5506121 - DNA, 21 bp, Homo sapiens
taaacaaatatgaaaaatgta

SEQ ID NO: 5506122 - DNA, 23 bp, Homo sapiens
taaacaaatatgaaaaatgtaaa

SEQ ID NO: 5506123 - DNA, 13 bp, Homo sapiens
taaacaaatgagt

SEQ ID NO: 5506124 - DNA, 15 bp, Homo sapiens
taaacaaatgatttc

SEQ ID NO: 5506125 - DNA, 11 bp, Homo sapiens
taaacaaatgg

SEQ ID NO: 5506126 - DNA, 13 bp, Homo sapiens
taaacaaatgtgt

SEQ ID NO: 5506127 - DNA, 17 bp, Homo sapiens
taaacaaattcatattc

SEQ ID NO: 5506128 - DNA, 19 bp, Homo sapiens
taaacaaattcatattctg

SEQ ID NO: 5506129 - DNA, 17 bp, Homo sapiens
taaacaaattccttccc

SEQ ID NO: 5506130 - DNA, 18 bp, Homo sapiens
taaacaaatttagaagaa

SEQ ID NO: 5506131 - DNA, 18 bp, Homo sapiens
taaacaacacctcctcct

SEQ ID NO: 5506132 - DNA, 18 bp, Homo sapiens
taaacaacagctgaagca

SEQ ID NO: 5506133 - DNA, 17 bp, Homo sapiens
taaacaagaaaaataaa

SEQ ID NO: 5506134 - DNA, 20 bp, Homo sapiens
taaacaagaaaaataaagaa

SEQ ID NO: 5506135 - DNA, 20 bp, Homo sapiens
taaacaagaaccatttgcaa

SEQ ID NO: 5506136 - DNA, 21 bp, Homo sapiens
taaacaagaccacgtttctaa

SEQ ID NO: 5506137 - DNA, 15 bp, Homo sapiens
taaacaagattttaa

SEQ ID NO: 5506138 - DNA, 20 bp, Homo sapiens
taaacaagattttaaagaca

SEQ ID NO: 5506139 - DNA, 17 bp, Homo sapiens
taaacaaggtaattttt

SEQ ID NO: 5506140 - DNA, 19 bp, Homo sapiens
taaacaagtaagaaaaata

SEQ ID NO: 5506141 - DNA, 22 bp, Homo sapiens
taaacaagtatttgttaattta

SEQ ID NO: 5506142 - DNA, 13 bp, Homo sapiens
taaacaataaact

SEQ ID NO: 5506143 - DNA, 18 bp, Homo sapiens
taaacaatataagaagga

SEQ ID NO: 5506144 - DNA, 21 bp, Homo sapiens
taaacaatataagaaggaaaa

SEQ ID NO: 5506145 - DNA, 16 bp, Homo sapiens
taaacaatctttcatg

SEQ ID NO: 5506146 - DNA, 15 bp, Homo sapiens
taaacaatgaagtga

SEQ ID NO: 5506147 - DNA, 16 bp, Homo sapiens
taaacaatgaagtgaa

SEQ ID NO: 5506148 - DNA, 23 bp, Homo sapiens
taaacaatgaagtgaaaaagttt

SEQ ID NO: 5506149 - DNA, 22 bp, Homo sapiens
taaacaatgccaagtcactctt

SEQ ID NO: 5506150 - DNA, 16 bp, Homo sapiens
taaacaatgtaaagta

SEQ ID NO: 5506151 - DNA, 19 bp, Homo sapiens
taaacaatgtcctctttga

SEQ ID NO: 5506152 - DNA, 13 bp, Homo sapiens
taaacaatgttca

SEQ ID NO: 5506153 - DNA, 14 bp, Homo sapiens
taaacaattcttgt

SEQ ID NO: 5506154 - DNA, 24 bp, Homo sapiens
taaacaatttattttattttagca

SEQ ID NO: 5506155 - DNA, 22 bp, Homo sapiens
taaacaatttctgcattcttaa

SEQ ID NO: 5506156 - DNA, 15 bp, Homo sapiens
taaacaattttgtta

SEQ ID NO: 5506157 - DNA, 17 bp, Homo sapiens
taaacttattcctcctt

SEQ ID NO: 5506158 - DNA, 14 bp, Homo sapiens
taaacttcacctac

SEQ ID NO: 5506159 - DNA, 13 bp, Homo sapiens
taaacttcagcaa

SEQ ID NO: 5506160 - DNA, 16 bp, Homo sapiens
taaacttcagcaccat

SEQ ID NO: 5506161 - DNA, 20 bp, Homo sapiens
taaacttcatggtcatgggt

SEQ ID NO: 5506162 - DNA, 11 bp, Homo sapiens
taaacttccaa

SEQ ID NO: 5506163 - DNA, 15 bp, Homo sapiens
taaacttccaaagaa

SEQ ID NO: 5506164 - DNA, 21 bp, Homo sapiens
taaacttccaaagaaagttct

SEQ ID NO: 5506165 - DNA, 17 bp, Homo sapiens
taaacttccctctagtt

SEQ ID NO: 5506166 - DNA, 17 bp, Homo sapiens
taaacttctctgaaggg

SEQ ID NO: 5506167 - DNA, 20 bp, Homo sapiens
taaacttctctgaagggagg

SEQ ID NO: 5506168 - DNA, 21 bp, Homo sapiens
taaacttctctgaagggaggt

SEQ ID NO: 5506169 - DNA, 14 bp, Homo sapiens
taaacttctgaaga

SEQ ID NO: 5506170 - DNA, 20 bp, Homo sapiens
taaacttctgaagactgaga

SEQ ID NO: 5506171 - DNA, 16 bp, Homo sapiens
taaacttcttaacatg

SEQ ID NO: 5506172 - DNA, 22 bp, Homo sapiens
taaacttcttttctcttctaca

SEQ ID NO: 5506173 - DNA, 23 bp, Homo sapiens
taaacttcttttctcttctacat

SEQ ID NO: 5506174 - DNA, 17 bp, Homo sapiens
taaacttgaaatatata

SEQ ID NO: 5506175 - DNA, 21 bp, Homo sapiens
taaacttgcaatgaaaagaaa

SEQ ID NO: 5506176 - DNA, 18 bp, Homo sapiens
taaacttgcacatttgaa

SEQ ID NO: 5506177 - DNA, 22 bp, Homo sapiens
taaacttggaagggggagacag

SEQ ID NO: 5506178 - DNA, 14 bp, Homo sapiens
taaacttgtcagaa

SEQ ID NO: 5506179 - DNA, 20 bp, Homo sapiens
taaacttgtttgctgtgaac

SEQ ID NO: 5506180 - DNA, 20 bp, Homo sapiens
taaactttaacttccacttt

SEQ ID NO: 5506181 - DNA, 23 bp, Homo sapiens
taaactttaacttccactttgta

SEQ ID NO: 5506182 - DNA, 16 bp, Homo sapiens
taaactttaatatgta

SEQ ID NO: 5506183 - DNA, 20 bp, Homo sapiens
taaactttacccaaaaacta

SEQ ID NO: 5506184 - DNA, 14 bp, Homo sapiens
taaactttagactt

SEQ ID NO: 5506185 - DNA, 18 bp, Homo sapiens
taaactttagacttccca

SEQ ID NO: 5506186 - DNA, 15 bp, Homo sapiens
taaactttatcactt

SEQ ID NO: 5506187 - DNA, 16 bp, Homo sapiens
taaactttatcactta

SEQ ID NO: 5506188 - DNA, 22 bp, Homo sapiens
taaactttatttgtaaaccatt

SEQ ID NO: 5506189 - DNA, 23 bp, Homo sapiens
taaactttatttgtaaaccattg

SEQ ID NO: 5506190 - DNA, 21 bp, Homo sapiens
taaactttcagaactgctacc

SEQ ID NO: 5506191 - DNA, 15 bp, Homo sapiens
taaactttgaaatat

SEQ ID NO: 5506192 - DNA, 19 bp, Homo sapiens
taaactttgaagcaactgt

SEQ ID NO: 5506193 - DNA, 19 bp, Homo sapiens
taaactttgaataaaagaa

SEQ ID NO: 5506194 - DNA, 16 bp, Homo sapiens
taaactttgcttctcc

SEQ ID NO: 5506195 - DNA, 13 bp, Homo sapiens
taaactttgtcac

SEQ ID NO: 5506196 - DNA, 19 bp, Homo sapiens
taaactttgtcacttctgc

SEQ ID NO: 5506197 - DNA, 18 bp, Homo sapiens
taaactttgtgctgatct

SEQ ID NO: 5506198 - DNA, 15 bp, Homo sapiens
taaacttttaattca

SEQ ID NO: 5506199 - DNA, 16 bp, Homo sapiens
taaacttttaattcat

SEQ ID NO: 5506200 - DNA, 14 bp, Homo sapiens
taaacttttagaaa

SEQ ID NO: 5506201 - DNA, 22 bp, Homo sapiens
taaacttttatgcgcaaataca

SEQ ID NO: 5506202 - DNA, 23 bp, Homo sapiens
taaacttttatgcgcaaatacaa

SEQ ID NO: 5506203 - DNA, 15 bp, Homo sapiens
taaactttttaaaat

SEQ ID NO: 5506204 - DNA, 19 bp, Homo sapiens
taaactttttaaaatactt

SEQ ID NO: 5506205 - DNA, 14 bp, Homo sapiens
taaactttttcaat

SEQ ID NO: 5506206 - DNA, 18 bp, Homo sapiens
taaactttttcaatggtt

SEQ ID NO: 5506207 - DNA, 21 bp, Homo sapiens
taaactttttcaatggttggg

SEQ ID NO: 5506208 - DNA, 14 bp, Homo sapiens
taaactttttttca

SEQ ID NO: 5506209 - DNA, 17 bp, Homo sapiens
taaacttttttttgaga

SEQ ID NO: 5506210 - DNA, 20 bp, Homo sapiens
taaagaaaaaaatagtttta

SEQ ID NO: 5506211 - DNA, 14 bp, Homo sapiens
taaagaaaaaaatg

SEQ ID NO: 5506212 - DNA, 16 bp, Homo sapiens
taaagaaaaaaatgta

SEQ ID NO: 5506213 - DNA, 20 bp, Homo sapiens
taaagaaaaaaatgtcaaaa

SEQ ID NO: 5506214 - DNA, 11 bp, Homo sapiens
taaagaaaaac

SEQ ID NO: 5506215 - DNA, 22 bp, Homo sapiens
taaagaaaaactttaaaaatta

SEQ ID NO: 5506216 - DNA, 13 bp, Homo sapiens
taaagaaaaagaa

SEQ ID NO: 5506217 - DNA, 15 bp, Homo sapiens
taaagaaaaatattt

SEQ ID NO: 5506218 - DNA, 20 bp, Homo sapiens
taaagaaaaccacagttatt

SEQ ID NO: 5506219 - DNA, 12 bp, Homo sapiens
taaagaaaactg

SEQ ID NO: 5506220 - DNA, 22 bp, Homo sapiens
taaagaaaacttacagaagagg

SEQ ID NO: 5506221 - DNA, 12 bp, Homo sapiens
taaagaaaagat

SEQ ID NO: 5506222 - DNA, 16 bp, Homo sapiens
taaagaaaagatgaaa

SEQ ID NO: 5506223 - DNA, 14 bp, Homo sapiens
taaagaaaagatgc

SEQ ID NO: 5506224 - DNA, 15 bp, Homo sapiens
taaagaaaagatgca

SEQ ID NO: 5506225 - DNA, 12 bp, Homo sapiens
taaagaaaataa

SEQ ID NO: 5506226 - DNA, 14 bp, Homo sapiens
taaagaaaataaaa

SEQ ID NO: 5506227 - DNA, 16 bp, Homo sapiens
taaagaaaatgtgtct

SEQ ID NO: 5506228 - DNA, 11 bp, Homo sapiens
taaagaaaatt

SEQ ID NO: 5506229 - DNA, 21 bp, Homo sapiens
taaagaaaattaattatgtgt

SEQ ID NO: 5506230 - DNA, 17 bp, Homo sapiens
taaagaaaattctctca

SEQ ID NO: 5506231 - DNA, 18 bp, Homo sapiens
taaagaaaattctctcaa

SEQ ID NO: 5506232 - DNA, 17 bp, Homo sapiens
taaagaaaattgcatga

SEQ ID NO: 5506233 - DNA, 18 bp, Homo sapiens
taaagaaaattgcatgaa

SEQ ID NO: 5506234 - DNA, 19 bp, Homo sapiens
taaagaaaattgccaaaat

SEQ ID NO: 5506235 - DNA, 15 bp, Homo sapiens
taaagaaacactaaa

SEQ ID NO: 5506236 - DNA, 14 bp, Homo sapiens
taaagaaacagctt

SEQ ID NO: 5506237 - DNA, 20 bp, Homo sapiens
taaagaaacagctttcaagt

SEQ ID NO: 5506238 - DNA, 19 bp, Homo sapiens
taaagaaacatctacagga

SEQ ID NO: 5506239 - DNA, 14 bp, Homo sapiens
taaagaaacatggt

SEQ ID NO: 5506240 - DNA, 22 bp, Homo sapiens
taaagaaacggtatgacttaat

SEQ ID NO: 5506241 - DNA, 24 bp, Homo sapiens
taaagaaacggtatgacttaattt

SEQ ID NO: 5506242 - DNA, 18 bp, Homo sapiens
taaagaaactgaggccca

SEQ ID NO: 5506243 - DNA, 19 bp, Homo sapiens
taaagaaactgcttacagt

SEQ ID NO: 5506244 - DNA, 20 bp, Homo sapiens
taaagaaacttggctggaat

SEQ ID NO: 5506245 - DNA, 15 bp, Homo sapiens
taaagaaacttttga

SEQ ID NO: 5506246 - DNA, 16 bp, Homo sapiens
taaagaaacttttgaa

SEQ ID NO: 5506247 - DNA, 20 bp, Homo sapiens
taaagaaacttttgaaaaag

SEQ ID NO: 5506248 - DNA, 15 bp, Homo sapiens
taaagaaagagagaa

SEQ ID NO: 5506249 - DNA, 18 bp, Homo sapiens
taaagaaagagagaaaat

SEQ ID NO: 5506250 - DNA, 11 bp, Homo sapiens
taaagaaagat

SEQ ID NO: 5506251 - DNA, 16 bp, Homo sapiens
taaagaaagattgtaa

SEQ ID NO: 5506252 - DNA, 18 bp, Homo sapiens
taaagaaagattgtaaac

SEQ ID NO: 5506253 - DNA, 14 bp, Homo sapiens
taaagaaagcagaa

SEQ ID NO: 5506254 - DNA, 15 bp, Homo sapiens
taaagaaagcagaat

SEQ ID NO: 5506255 - DNA, 15 bp, Homo sapiens
taaagaaaggaaaag

SEQ ID NO: 5506256 - DNA, 17 bp, Homo sapiens
taaagaaaggaaaagaa

SEQ ID NO: 5506257 - DNA, 23 bp, Homo sapiens
taaagaaaggaaaagaaaacaaa

SEQ ID NO: 5506258 - DNA, 11 bp, Homo sapiens
taaagaaagtc

SEQ ID NO: 5506259 - DNA, 14 bp, Homo sapiens
taaagaaagtcata

SEQ ID NO: 5506260 - DNA, 13 bp, Homo sapiens
taaagaaagtgta

SEQ ID NO: 5506261 - DNA, 14 bp, Homo sapiens
taaagaaagtgtat

SEQ ID NO: 5506262 - DNA, 16 bp, Homo sapiens
taaagaaagtgtattt

SEQ ID NO: 5506263 - DNA, 18 bp, Homo sapiens
taaagaaatacacaggga

SEQ ID NO: 5506264 - DNA, 15 bp, Homo sapiens
taaagaaatatttac

SEQ ID NO: 5506265 - DNA, 16 bp, Homo sapiens
taaagaaattcaagaa

SEQ ID NO: 5506266 - DNA, 18 bp, Homo sapiens
taaagaaatttactatat

SEQ ID NO: 5506267 - DNA, 15 bp, Homo sapiens
taaagaaatttggta

SEQ ID NO: 5506268 - DNA, 19 bp, Homo sapiens
taaagaacaccctatattt

SEQ ID NO: 5506269 - DNA, 13 bp, Homo sapiens
taaagaacagtga

SEQ ID NO: 5506270 - DNA, 17 bp, Homo sapiens
taaagaacagtgagaaa

SEQ ID NO: 5506271 - DNA, 22 bp, Homo sapiens
taaagaacccctcgttagcctt

SEQ ID NO: 5506272 - DNA, 19 bp, Homo sapiens
taaagaactccttattttg

SEQ ID NO: 5506273 - DNA, 21 bp, Homo sapiens
taaagaactccttattttgta

SEQ ID NO: 5506274 - DNA, 14 bp, Homo sapiens
taaagaactgcaca

SEQ ID NO: 5506275 - DNA, 16 bp, Homo sapiens
taaagaagaaagcttt

SEQ ID NO: 5506276 - DNA, 18 bp, Homo sapiens
taaagaagaaagctttta

SEQ ID NO: 5506277 - DNA, 21 bp, Homo sapiens
taaagaagaagtggatctaaa

SEQ ID NO: 5506278 - DNA, 18 bp, Homo sapiens
taaagaagacacacagcc

SEQ ID NO: 5506279 - DNA, 17 bp, Homo sapiens
taaagaagacattttct

SEQ ID NO: 5506280 - DNA, 11 bp, Homo sapiens
taaagaagacc

SEQ ID NO: 5506281 - DNA, 12 bp, Homo sapiens
taaagaagacct

SEQ ID NO: 5506282 - DNA, 16 bp, Homo sapiens
taaagaagacctgaga

SEQ ID NO: 5506283 - DNA, 16 bp, Homo sapiens
taaagaagaggagaaa

SEQ ID NO: 5506284 - DNA, 19 bp, Homo sapiens
taaagaagaggagaaaaag

SEQ ID NO: 5506285 - DNA, 13 bp, Homo sapiens
taaagaagcaata

SEQ ID NO: 5506286 - DNA, 14 bp, Homo sapiens
taaagaagctgcat

SEQ ID NO: 5506287 - DNA, 17 bp, Homo sapiens
taaagaagctgcatgtt

SEQ ID NO: 5506288 - DNA, 23 bp, Homo sapiens
taaagaaggaggtcgtttatgtg

SEQ ID NO: 5506289 - DNA, 16 bp, Homo sapiens
taaagaaggataaatt

SEQ ID NO: 5506290 - DNA, 16 bp, Homo sapiens
taaagaagtaaatttg

SEQ ID NO: 5506291 - DNA, 16 bp, Homo sapiens
taaagaagtgcatgaa

SEQ ID NO: 5506292 - DNA, 21 bp, Homo sapiens
taaagaagttcaaaccctgta

SEQ ID NO: 5506293 - DNA, 13 bp, Homo sapiens
taaagaagtttga

SEQ ID NO: 5506294 - DNA, 14 bp, Homo sapiens
taaagaataaagtc

SEQ ID NO: 5506295 - DNA, 16 bp, Homo sapiens
taaagaatacttgaac

SEQ ID NO: 5506296 - DNA, 20 bp, Homo sapiens
taaagaatacttgaacttgt

SEQ ID NO: 5506297 - DNA, 14 bp, Homo sapiens
taaagaataggact

SEQ ID NO: 5506298 - DNA, 17 bp, Homo sapiens
taaagaatagtgcctca

SEQ ID NO: 5506299 - DNA, 14 bp, Homo sapiens
taaagaatatatat

SEQ ID NO: 5506300 - DNA, 17 bp, Homo sapiens
taaagaatatgaaacat

SEQ ID NO: 5506301 - DNA, 20 bp, Homo sapiens
taaagaatatttacaataaa

SEQ ID NO: 5506302 - DNA, 18 bp, Homo sapiens
taaagaatccaagacaaa

SEQ ID NO: 5506303 - DNA, 22 bp, Homo sapiens
taaagaatccaagacaaactaa

SEQ ID NO: 5506304 - DNA, 20 bp, Homo sapiens
taaagaatccttatctataa

SEQ ID NO: 5506305 - DNA, 21 bp, Homo sapiens
taaagaatccttatctataaa

SEQ ID NO: 5506306 - DNA, 23 bp, Homo sapiens
taaagaatccttatctataaaag

SEQ ID NO: 5506307 - DNA, 18 bp, Homo sapiens
taaagaatgagaaacata

SEQ ID NO: 5506308 - DNA, 20 bp, Homo sapiens
taaagaatgccatttctcac

SEQ ID NO: 5506309 - DNA, 19 bp, Homo sapiens
taaagaatgctgcaacttt

SEQ ID NO: 5506310 - DNA, 13 bp, Homo sapiens
taaagaatgttag

SEQ ID NO: 5506311 - DNA, 18 bp, Homo sapiens
taaagaatgttttggaat

SEQ ID NO: 5506312 - DNA, 18 bp, Homo sapiens
taaagaattaatgactta

SEQ ID NO: 5506313 - DNA, 14 bp, Homo sapiens
taaagaattcaaat

SEQ ID NO: 5506314 - DNA, 15 bp, Homo sapiens
taaagaattcaaatt

SEQ ID NO: 5506315 - DNA, 13 bp, Homo sapiens
taaagaatttaaa

SEQ ID NO: 5506316 - DNA, 23 bp, Homo sapiens
taaagaatttaagctgtaaatta

SEQ ID NO: 5506317 - DNA, 21 bp, Homo sapiens
taaagaatttaatgtacagta

SEQ ID NO: 5506318 - DNA, 16 bp, Homo sapiens
taaagaatttctttat

SEQ ID NO: 5506319 - DNA, 14 bp, Homo sapiens
taaagaatttgaaa

SEQ ID NO: 5506320 - DNA, 16 bp, Homo sapiens
taaagaatttgaaagt

SEQ ID NO: 5506321 - DNA, 19 bp, Homo sapiens
taaagaattttcatcccgt

SEQ ID NO: 5506322 - DNA, 14 bp, Homo sapiens
taaagacaaaaaac

SEQ ID NO: 5506323 - DNA, 16 bp, Homo sapiens
taaagacaaataaatg

SEQ ID NO: 5506324 - DNA, 19 bp, Homo sapiens
taaagacaacaaaagaaat

SEQ ID NO: 5506325 - DNA, 10 bp, Homo sapiens
taaagacaag

SEQ ID NO: 5506326 - DNA, 10 bp, Homo sapiens
taaagacaga

SEQ ID NO: 5506327 - DNA, 14 bp, Homo sapiens
taaagacagaaaaa

SEQ ID NO: 5506328 - DNA, 20 bp, Homo sapiens
taaagacagaaaaaaataaa

SEQ ID NO: 5506329 - DNA, 16 bp, Homo sapiens
taaagacagggtcttg

SEQ ID NO: 5506330 - DNA, 16 bp, Homo sapiens
taaagacatgaagcca

SEQ ID NO: 5506331 - DNA, 17 bp, Homo sapiens
taaagaccaataaactt

SEQ ID NO: 5506332 - DNA, 22 bp, Homo sapiens
taaagaccaatttatgggagaa

SEQ ID NO: 5506333 - DNA, 18 bp, Homo sapiens
taaagacccaacttgcca

SEQ ID NO: 5506334 - DNA, 23 bp, Homo sapiens
taaagaccctcctattctataaa

SEQ ID NO: 5506335 - DNA, 21 bp, Homo sapiens
taaagacctgctgtaataaat

SEQ ID NO: 5506336 - DNA, 22 bp, Homo sapiens
taaagtatgtaaacaggagaca

SEQ ID NO: 5506337 - DNA, 19 bp, Homo sapiens
taaagtatgtattatttac

SEQ ID NO: 5506338 - DNA, 21 bp, Homo sapiens
taaagtatgtattatttacat

SEQ ID NO: 5506339 - DNA, 19 bp, Homo sapiens
taaagtattctccatcctc

SEQ ID NO: 5506340 - DNA, 13 bp, Homo sapiens
taaagtattcttc

SEQ ID NO: 5506341 - DNA, 14 bp, Homo sapiens
taaagtattcttct

SEQ ID NO: 5506342 - DNA, 13 bp, Homo sapiens
taaagtattcttt

SEQ ID NO: 5506343 - DNA, 10 bp, Homo sapiens
taaagtattt

SEQ ID NO: 5506344 - DNA, 12 bp, Homo sapiens
taaagtatttaa

SEQ ID NO: 5506345 - DNA, 19 bp, Homo sapiens
taaagtatttaattagtgc

SEQ ID NO: 5506346 - DNA, 21 bp, Homo sapiens
taaagtatttaattagtgcta

SEQ ID NO: 5506347 - DNA, 21 bp, Homo sapiens
taaagtatttataaaaatata

SEQ ID NO: 5506348 - DNA, 24 bp, Homo sapiens
taaagtatttataaaaatataaat

SEQ ID NO: 5506349 - DNA, 17 bp, Homo sapiens
taaagtatttgatgtac

SEQ ID NO: 5506350 - DNA, 23 bp, Homo sapiens
taaagtatttgatgtacattaca

SEQ ID NO: 5506351 - DNA, 14 bp, Homo sapiens
taaagtattttaat

SEQ ID NO: 5506352 - DNA, 14 bp, Homo sapiens
taaagtattttctt

SEQ ID NO: 5506353 - DNA, 14 bp, Homo sapiens
taaagtatttttat

SEQ ID NO: 5506354 - DNA, 16 bp, Homo sapiens
taaagtatttttataa

SEQ ID NO: 5506355 - DNA, 19 bp, Homo sapiens
taaagtatttttgattaac

SEQ ID NO: 5506356 - DNA, 16 bp, Homo sapiens
taaagtcacttccagt

SEQ ID NO: 5506357 - DNA, 13 bp, Homo sapiens
taaagtcagatgg

SEQ ID NO: 5506358 - DNA, 19 bp, Homo sapiens
taaagtcaggccattcagt

SEQ ID NO: 5506359 - DNA, 18 bp, Homo sapiens
taaagtcaggtccaattt

SEQ ID NO: 5506360 - DNA, 13 bp, Homo sapiens
taaagtcagtgtt

SEQ ID NO: 5506361 - DNA, 13 bp, Homo sapiens
taaagtcatcaaa

SEQ ID NO: 5506362 - DNA, 23 bp, Homo sapiens
taaagtcatggtcattgcaggaa

SEQ ID NO: 5506363 - DNA, 19 bp, Homo sapiens
taaagtcattaacaagaaa

SEQ ID NO: 5506364 - DNA, 23 bp, Homo sapiens
taaagtcattaacaagaaacagg

SEQ ID NO: 5506365 - DNA, 11 bp, Homo sapiens
taaagtcattg

SEQ ID NO: 5506366 - DNA, 17 bp, Homo sapiens
taaagtccctatagtat

SEQ ID NO: 5506367 - DNA, 15 bp, Homo sapiens
taaagtcctgaacct

SEQ ID NO: 5506368 - DNA, 14 bp, Homo sapiens
taaagtcctgttta

SEQ ID NO: 5506369 - DNA, 21 bp, Homo sapiens
taaagtccttttcttgcttac

SEQ ID NO: 5506370 - DNA, 18 bp, Homo sapiens
taaagtcggtgattatat

SEQ ID NO: 5506371 - DNA, 20 bp, Homo sapiens
taaagtcggtgattatattt

SEQ ID NO: 5506372 - DNA, 15 bp, Homo sapiens
taaagtctaagcaag

SEQ ID NO: 5506373 - DNA, 15 bp, Homo sapiens
taaagtctacactgc

SEQ ID NO: 5506374 - DNA, 18 bp, Homo sapiens
taaagtctacactgcctt

SEQ ID NO: 5506375 - DNA, 14 bp, Homo sapiens
taaagtctagcaca

SEQ ID NO: 5506376 - DNA, 18 bp, Homo sapiens
taaagtctattgtttgtt

SEQ ID NO: 5506377 - DNA, 14 bp, Homo sapiens
taaagtctgaatca

SEQ ID NO: 5506378 - DNA, 13 bp, Homo sapiens
taaagtctgtctg

SEQ ID NO: 5506379 - DNA, 19 bp, Homo sapiens
taaagtcttctttcatgta

SEQ ID NO: 5506380 - DNA, 15 bp, Homo sapiens
taaagtcttgctgtg

SEQ ID NO: 5506381 - DNA, 22 bp, Homo sapiens
taaagtgaacagattttattaa

SEQ ID NO: 5506382 - DNA, 22 bp, Homo sapiens
taaagtgaagaatttatctctt

SEQ ID NO: 5506383 - DNA, 14 bp, Homo sapiens
taaagtgaattgtt

SEQ ID NO: 5506384 - DNA, 15 bp, Homo sapiens
taaagtgaccaggct

SEQ ID NO: 5506385 - DNA, 12 bp, Homo sapiens
taaagtgacttt

SEQ ID NO: 5506386 - DNA, 18 bp, Homo sapiens
taaagtgagaaaactgtg

SEQ ID NO: 5506387 - DNA, 19 bp, Homo sapiens
taaagtgaggccactgaag

SEQ ID NO: 5506388 - DNA, 14 bp, Homo sapiens
taaagtgatgtttg

SEQ ID NO: 5506389 - DNA, 16 bp, Homo sapiens
taaagtgattaaacgt

SEQ ID NO: 5506390 - DNA, 18 bp, Homo sapiens
taaagtgattaaacgtgc

SEQ ID NO: 5506391 - DNA, 22 bp, Homo sapiens
taaagtgattaaacgtgcagac

SEQ ID NO: 5506392 - DNA, 12 bp, Homo sapiens
taaagtgattga

SEQ ID NO: 5506393 - DNA, 19 bp, Homo sapiens
taaagtgattgacttgact

SEQ ID NO: 5506394 - DNA, 14 bp, Homo sapiens
taaagtgatttttg

SEQ ID NO: 5506395 - DNA, 22 bp, Homo sapiens
taaagtgcaaacagaagtgcat

SEQ ID NO: 5506396 - DNA, 22 bp, Homo sapiens
taaagtgcacacctttattcag

SEQ ID NO: 5506397 - DNA, 13 bp, Homo sapiens
taaagtgcagtca

SEQ ID NO: 5506398 - DNA, 12 bp, Homo sapiens
taaagtgcatta

SEQ ID NO: 5506399 - DNA, 22 bp, Homo sapiens
taaagtgccagtattttaaaat

SEQ ID NO: 5506400 - DNA, 23 bp, Homo sapiens
taaagtgccagtattttaaaata

SEQ ID NO: 5506401 - DNA, 19 bp, Homo sapiens
taaagtgcttgctttttgc

SEQ ID NO: 5506402 - DNA, 16 bp, Homo sapiens
taaagtgcttgtgtaa

SEQ ID NO: 5506403 - DNA, 17 bp, Homo sapiens
taaagtgcttgtgtaat

SEQ ID NO: 5506404 - DNA, 17 bp, Homo sapiens
taaagtggacttctgaa

SEQ ID NO: 5506405 - DNA, 18 bp, Homo sapiens
taaagtggacttctgaaa

SEQ ID NO: 5506406 - DNA, 21 bp, Homo sapiens
taaagtgggttattctggagt

SEQ ID NO: 5506407 - DNA, 19 bp, Homo sapiens
taaagtggttctctgcctt

SEQ ID NO: 5506408 - DNA, 14 bp, Homo sapiens
taaagtggttttgt

SEQ ID NO: 5506409 - DNA, 22 bp, Homo sapiens
taaagtgtaaatcctttttctt

SEQ ID NO: 5506410 - DNA, 20 bp, Homo sapiens
taaagtgtatttttttacta

SEQ ID NO: 5506411 - DNA, 21 bp, Homo sapiens
taaagtgtatttttttactaa

SEQ ID NO: 5506412 - DNA, 17 bp, Homo sapiens
taaagtgtccattgaca

SEQ ID NO: 5506413 - DNA, 18 bp, Homo sapiens
taaagtgtccattgacat

SEQ ID NO: 5506414 - DNA, 21 bp, Homo sapiens
taaagtgtccattgacatgta

SEQ ID NO: 5506415 - DNA, 23 bp, Homo sapiens
taaagtgtccattgacatgtaca

SEQ ID NO: 5506416 - DNA, 18 bp, Homo sapiens
taaagtgtgctttataaa

SEQ ID NO: 5506417 - DNA, 21 bp, Homo sapiens
taaagtgtgctttataaaaaa

SEQ ID NO: 5506418 - DNA, 18 bp, Homo sapiens
taaagtgtggtcccaaca

SEQ ID NO: 5506419 - DNA, 13 bp, Homo sapiens
taaagtgtgtgtg

SEQ ID NO: 5506420 - DNA, 17 bp, Homo sapiens
taaagtgtgtgtgcagg

SEQ ID NO: 5506421 - DNA, 17 bp, Homo sapiens
taaagtgttaaggaata

SEQ ID NO: 5506422 - DNA, 19 bp, Homo sapiens
taaagtgttacgttttatt

SEQ ID NO: 5506423 - DNA, 20 bp, Homo sapiens
taaagtgttggtctttctaa

SEQ ID NO: 5506424 - DNA, 16 bp, Homo sapiens
taaagtgtttagctgt

SEQ ID NO: 5506425 - DNA, 17 bp, Homo sapiens
taaagtgtttctgttat

SEQ ID NO: 5506426 - DNA, 14 bp, Homo sapiens
taaagtgtttgaaa

SEQ ID NO: 5506427 - DNA, 13 bp, Homo sapiens
taaagtgttttca

SEQ ID NO: 5506428 - DNA, 18 bp, Homo sapiens
taaagttaaactgattat

SEQ ID NO: 5506429 - DNA, 14 bp, Homo sapiens
taaagttacagttt

SEQ ID NO: 5506430 - DNA, 21 bp, Homo sapiens
taaagttagggcatttttctt

SEQ ID NO: 5506431 - DNA, 14 bp, Homo sapiens
taaagttcaaagca

SEQ ID NO: 5506432 - DNA, 22 bp, Homo sapiens
taaagttcagatgtttcatcaa

SEQ ID NO: 5506433 - DNA, 17 bp, Homo sapiens
taaagttctaagattct

SEQ ID NO: 5506434 - DNA, 20 bp, Homo sapiens
taaagttcttattttagtat

SEQ ID NO: 5506435 - DNA, 14 bp, Homo sapiens
taaagttgaaaata

SEQ ID NO: 5506436 - DNA, 21 bp, Homo sapiens
taaagttgaaaatacattctt

SEQ ID NO: 5506437 - DNA, 18 bp, Homo sapiens
taaagttgaagcatttgt

SEQ ID NO: 5506438 - DNA, 20 bp, Homo sapiens
taaagttgaagctaagattt

SEQ ID NO: 5506439 - DNA, 13 bp, Homo sapiens
taaagttgaattt

SEQ ID NO: 5506440 - DNA, 20 bp, Homo sapiens
taaagttgataaagattttt

SEQ ID NO: 5506441 - DNA, 18 bp, Homo sapiens
taaagttgattttgaact

SEQ ID NO: 5506442 - DNA, 12 bp, Homo sapiens
taaagttgcttt

SEQ ID NO: 5506443 - DNA, 20 bp, Homo sapiens
taaagttggtattaataaaa

SEQ ID NO: 5506444 - DNA, 17 bp, Homo sapiens
taaagttgtaaataatt

SEQ ID NO: 5506445 - DNA, 18 bp, Homo sapiens
taaagttgtaaataattt

SEQ ID NO: 5506446 - DNA, 13 bp, Homo sapiens
taaagttgtaaca

SEQ ID NO: 5506447 - DNA, 14 bp, Homo sapiens
taaagttgtaacaa

SEQ ID NO: 5506448 - DNA, 12 bp, Homo sapiens
taaagttgtact

SEQ ID NO: 5506449 - DNA, 21 bp, Homo sapiens
taaagttgtatttcaaatatc

SEQ ID NO: 5506450 - DNA, 18 bp, Homo sapiens
taaagttgttttatcttt

SEQ ID NO: 5506451 - DNA, 21 bp, Homo sapiens
taaagttgttttatcttttaa

SEQ ID NO: 5506452 - DNA, 22 bp, Homo sapiens
taaagttgttttatcttttaag

SEQ ID NO: 5506453 - DNA, 15 bp, Homo sapiens
taaagtttaaaaaat

SEQ ID NO: 5506454 - DNA, 17 bp, Homo sapiens
taaagtttaaagttgca

SEQ ID NO: 5506455 - DNA, 13 bp, Homo sapiens
taaagtttaaata

SEQ ID NO: 5506456 - DNA, 19 bp, Homo sapiens
taaagtttaaataccagta

SEQ ID NO: 5506457 - DNA, 20 bp, Homo sapiens
taaagtttaatttttgcttg

SEQ ID NO: 5506458 - DNA, 12 bp, Homo sapiens
taaagtttacaa

SEQ ID NO: 5506459 - DNA, 17 bp, Homo sapiens
taaagtttacagtaaat

SEQ ID NO: 5506460 - DNA, 12 bp, Homo sapiens
taaagtttatta

SEQ ID NO: 5506461 - DNA, 14 bp, Homo sapiens
taaagtttatttca

SEQ ID NO: 5506462 - DNA, 15 bp, Homo sapiens
taaagtttatttcat

SEQ ID NO: 5506463 - DNA, 16 bp, Homo sapiens
taaagtttatttcatg

SEQ ID NO: 5506464 - DNA, 12 bp, Homo sapiens
taaagtttcaaa

SEQ ID NO: 5506465 - DNA, 19 bp, Homo sapiens
taaagtttcaaaaatctga

SEQ ID NO: 5506466 - DNA, 20 bp, Homo sapiens
taaagtttctagaattttat

SEQ ID NO: 5506467 - DNA, 17 bp, Homo sapiens
taaagtttgatcttcct

SEQ ID NO: 5506468 - DNA, 13 bp, Homo sapiens
taaagtttggact

SEQ ID NO: 5506469 - DNA, 23 bp, Homo sapiens
taaagtttggtattgtaaaacat

SEQ ID NO: 5506470 - DNA, 22 bp, Homo sapiens
taaagttttgtacaaagttttc

SEQ ID NO: 5506471 - DNA, 15 bp, Homo sapiens
taaagtttttttcct

SEQ ID NO: 5506472 - DNA, 22 bp, Homo sapiens
taaataaaaaataataatacaa

SEQ ID NO: 5506473 - DNA, 18 bp, Homo sapiens
taaataaaaaattcaaac

SEQ ID NO: 5506474 - DNA, 19 bp, Homo sapiens
taaataaaaaattcaaacc

SEQ ID NO: 5506475 - DNA, 17 bp, Homo sapiens
taaataaaaagaaaggc

SEQ ID NO: 5506476 - DNA, 17 bp, Homo sapiens
taaataaaaagtacaaa

SEQ ID NO: 5506477 - DNA, 15 bp, Homo sapiens
taaataaaaataata

SEQ ID NO: 5506478 - DNA, 15 bp, Homo sapiens
taaataaaaataatt

SEQ ID NO: 5506479 - DNA, 17 bp, Homo sapiens
taaataaaaatagctat

SEQ ID NO: 5506480 - DNA, 13 bp, Homo sapiens
taaataaaaatat

SEQ ID NO: 5506481 - DNA, 21 bp, Homo sapiens
taaataaaaatatgtaatttc

SEQ ID NO: 5506482 - DNA, 21 bp, Homo sapiens
taaataaaaatgcattgaaca

SEQ ID NO: 5506483 - DNA, 14 bp, Homo sapiens
taaataaaaattat

SEQ ID NO: 5506484 - DNA, 16 bp, Homo sapiens
taaataaaaatttata

SEQ ID NO: 5506485 - DNA, 13 bp, Homo sapiens
taaataaaacaat

SEQ ID NO: 5506486 - DNA, 12 bp, Homo sapiens
taaataaaacat

SEQ ID NO: 5506487 - DNA, 12 bp, Homo sapiens
taaataaaacta

SEQ ID NO: 5506488 - DNA, 10 bp, Homo sapiens
taaataaaag

SEQ ID NO: 5506489 - DNA, 23 bp, Homo sapiens
taaataaaagaggtccattaata

SEQ ID NO: 5506490 - DNA, 13 bp, Homo sapiens
taaataaaagcac

SEQ ID NO: 5506491 - DNA, 19 bp, Homo sapiens
taaataaaagcagcatctg

SEQ ID NO: 5506492 - DNA, 22 bp, Homo sapiens
taaataaaagctagatactgga

SEQ ID NO: 5506493 - DNA, 18 bp, Homo sapiens
taaataaaagttttacaa

SEQ ID NO: 5506494 - DNA, 16 bp, Homo sapiens
taaataaaataaaagc

SEQ ID NO: 5506495 - DNA, 14 bp, Homo sapiens
taaataaaataacc

SEQ ID NO: 5506496 - DNA, 14 bp, Homo sapiens
taaataaaatcaat

SEQ ID NO: 5506497 - DNA, 15 bp, Homo sapiens
taaataaaatgacca

SEQ ID NO: 5506498 - DNA, 20 bp, Homo sapiens
taaataaaatggatagaaaa

SEQ ID NO: 5506499 - DNA, 14 bp, Homo sapiens
taaataaaatgtgt

SEQ ID NO: 5506500 - DNA, 16 bp, Homo sapiens
taaataaaatgtgtac

SEQ ID NO: 5506501 - DNA, 18 bp, Homo sapiens
taaataaaatgtgtacag

SEQ ID NO: 5506502 - DNA, 22 bp, Homo sapiens
taaataaaatgtgtacagtgaa

SEQ ID NO: 5506503 - DNA, 14 bp, Homo sapiens
taaataaaatttgt

SEQ ID NO: 5506504 - DNA, 13 bp, Homo sapiens
taaataaaatttt

SEQ ID NO: 5506505 - DNA, 23 bp, Homo sapiens
taaataaacacatagattcacct

SEQ ID NO: 5506506 - DNA, 17 bp, Homo sapiens
taaataaacagatgtat

SEQ ID NO: 5506507 - DNA, 15 bp, Homo sapiens
taaataaaccactgt

SEQ ID NO: 5506508 - DNA, 13 bp, Homo sapiens
taaataaaccctt

SEQ ID NO: 5506509 - DNA, 13 bp, Homo sapiens
taaataaactctt

SEQ ID NO: 5506510 - DNA, 12 bp, Homo sapiens
taaataaactgt

SEQ ID NO: 5506511 - DNA, 20 bp, Homo sapiens
taaataaactgttgctcgtt

SEQ ID NO: 5506512 - DNA, 14 bp, Homo sapiens
taaataaactgttt

SEQ ID NO: 5506513 - DNA, 16 bp, Homo sapiens
taaataaactttggga

SEQ ID NO: 5506514 - DNA, 14 bp, Homo sapiens
taaataaacttttt

SEQ ID NO: 5506515 - DNA, 17 bp, Homo sapiens
taaatggtgatttcttg

SEQ ID NO: 5506516 - DNA, 21 bp, Homo sapiens
taaatggtgtacataatgtat

SEQ ID NO: 5506517 - DNA, 20 bp, Homo sapiens
taaatggtgtcataactaga

SEQ ID NO: 5506518 - DNA, 18 bp, Homo sapiens
taaatggtgttacattaa

SEQ ID NO: 5506519 - DNA, 18 bp, Homo sapiens
taaatggttaaattttac

SEQ ID NO: 5506520 - DNA, 15 bp, Homo sapiens
taaatggttaagaca

SEQ ID NO: 5506521 - DNA, 21 bp, Homo sapiens
taaatggttccgctaatctct

SEQ ID NO: 5506522 - DNA, 21 bp, Homo sapiens
taaatggtttctcattaaact

SEQ ID NO: 5506523 - DNA, 20 bp, Homo sapiens
taaatggtttggtgcttttt

SEQ ID NO: 5506524 - DNA, 14 bp, Homo sapiens
taaatggttttcaa

SEQ ID NO: 5506525 - DNA, 21 bp, Homo sapiens
taaatgtaaaaatgaaggaat

SEQ ID NO: 5506526 - DNA, 17 bp, Homo sapiens
taaatgtaaagacaaaa

SEQ ID NO: 5506527 - DNA, 14 bp, Homo sapiens
taaatgtaacagtc

SEQ ID NO: 5506528 - DNA, 16 bp, Homo sapiens
taaatgtaagaatcat

SEQ ID NO: 5506529 - DNA, 22 bp, Homo sapiens
taaatgtacctgagacatatta

SEQ ID NO: 5506530 - DNA, 21 bp, Homo sapiens
taaatgtaccttcagaataag

SEQ ID NO: 5506531 - DNA, 13 bp, Homo sapiens
taaatgtactaca

SEQ ID NO: 5506532 - DNA, 20 bp, Homo sapiens
taaatgtactacatttgcat

SEQ ID NO: 5506533 - DNA, 23 bp, Homo sapiens
taaatgtactggtaattgtacaa

SEQ ID NO: 5506534 - DNA, 15 bp, Homo sapiens
taaatgtacttatat

SEQ ID NO: 5506535 - DNA, 16 bp, Homo sapiens
taaatgtacttatatt

SEQ ID NO: 5506536 - DNA, 18 bp, Homo sapiens
taaatgtagagtttttaa

SEQ ID NO: 5506537 - DNA, 23 bp, Homo sapiens
taaatgtagcttcagtcattaaa

SEQ ID NO: 5506538 - DNA, 21 bp, Homo sapiens
taaatgtagttctgctccaga

SEQ ID NO: 5506539 - DNA, 14 bp, Homo sapiens
taaatgtagttgtc

SEQ ID NO: 5506540 - DNA, 12 bp, Homo sapiens
taaatgtatact

SEQ ID NO: 5506541 - DNA, 14 bp, Homo sapiens
taaatgtatataca

SEQ ID NO: 5506542 - DNA, 17 bp, Homo sapiens
taaatgtatatacacat

SEQ ID NO: 5506543 - DNA, 19 bp, Homo sapiens
taaatgtatattgatgtaa

SEQ ID NO: 5506544 - DNA, 14 bp, Homo sapiens
taaatgtatctgaa

SEQ ID NO: 5506545 - DNA, 19 bp, Homo sapiens
taaatgtatcttattcaca

SEQ ID NO: 5506546 - DNA, 18 bp, Homo sapiens
taaatgtattaactgaaa

SEQ ID NO: 5506547 - DNA, 19 bp, Homo sapiens
taaatgtatttaattaaat

SEQ ID NO: 5506548 - DNA, 17 bp, Homo sapiens
taaatgtcaaatgtgaa

SEQ ID NO: 5506549 - DNA, 14 bp, Homo sapiens
taaatgtcactgcc

SEQ ID NO: 5506550 - DNA, 12 bp, Homo sapiens
taaatgtctata

SEQ ID NO: 5506551 - DNA, 17 bp, Homo sapiens
taaatgtctataaatgg

SEQ ID NO: 5506552 - DNA, 18 bp, Homo sapiens
taaatgtctattattatg

SEQ ID NO: 5506553 - DNA, 19 bp, Homo sapiens
taaatgtctgacacattaa

SEQ ID NO: 5506554 - DNA, 17 bp, Homo sapiens
taaatgtcttcatgttg

SEQ ID NO: 5506555 - DNA, 19 bp, Homo sapiens
taaatgtctttaatgcaat

SEQ ID NO: 5506556 - DNA, 17 bp, Homo sapiens
taaatgtctttgtaagt

SEQ ID NO: 5506557 - DNA, 22 bp, Homo sapiens
taaatgtcttttttttaatgtg

SEQ ID NO: 5506558 - DNA, 11 bp, Homo sapiens
taaatgtgaat

SEQ ID NO: 5506559 - DNA, 13 bp, Homo sapiens
taaatgtgaatta

SEQ ID NO: 5506560 - DNA, 21 bp, Homo sapiens
taaatgtgaatttttatttct

SEQ ID NO: 5506561 - DNA, 12 bp, Homo sapiens
taaatgtgacaa

SEQ ID NO: 5506562 - DNA, 16 bp, Homo sapiens
taaatgtgccttcatt

SEQ ID NO: 5506563 - DNA, 16 bp, Homo sapiens
taaatgtgcttttaaa

SEQ ID NO: 5506564 - DNA, 17 bp, Homo sapiens
taaatgtggattttgta

SEQ ID NO: 5506565 - DNA, 12 bp, Homo sapiens
taaatgtgtaat

SEQ ID NO: 5506566 - DNA, 14 bp, Homo sapiens
taaatgtgtaataa

SEQ ID NO: 5506567 - DNA, 20 bp, Homo sapiens
taaatgtgtggtgctaactg

SEQ ID NO: 5506568 - DNA, 22 bp, Homo sapiens
taaatgtgtggtgctaactgta

SEQ ID NO: 5506569 - DNA, 11 bp, Homo sapiens
taaatgtgtgt

SEQ ID NO: 5506570 - DNA, 16 bp, Homo sapiens
taaatgtgtgtatgtg

SEQ ID NO: 5506571 - DNA, 20 bp, Homo sapiens
taaatgtgttagcactgata

SEQ ID NO: 5506572 - DNA, 22 bp, Homo sapiens
taaatgtgttagcactgatagt

SEQ ID NO: 5506573 - DNA, 12 bp, Homo sapiens
taaatgtgttcc

SEQ ID NO: 5506574 - DNA, 20 bp, Homo sapiens
taaatgtgttggacaaatgt

SEQ ID NO: 5506575 - DNA, 21 bp, Homo sapiens
taaatgttaaagatgtagcaa

SEQ ID NO: 5506576 - DNA, 22 bp, Homo sapiens
taaatgttaaagatgtagcaaa

SEQ ID NO: 5506577 - DNA, 19 bp, Homo sapiens
taaatgttaaataagtgcg

SEQ ID NO: 5506578 - DNA, 16 bp, Homo sapiens
taaatgttaagaaaaa

SEQ ID NO: 5506579 - DNA, 18 bp, Homo sapiens
taaatgttacctctgaat

SEQ ID NO: 5506580 - DNA, 17 bp, Homo sapiens
taaatgttacttctgat

SEQ ID NO: 5506581 - DNA, 16 bp, Homo sapiens
taaatgttagttctag

SEQ ID NO: 5506582 - DNA, 17 bp, Homo sapiens
taaatgttagttctagc

SEQ ID NO: 5506583 - DNA, 18 bp, Homo sapiens
taaatgttagtttcttgg

SEQ ID NO: 5506584 - DNA, 15 bp, Homo sapiens
taaatgttatgactc

SEQ ID NO: 5506585 - DNA, 15 bp, Homo sapiens
taaatgttatgtata

SEQ ID NO: 5506586 - DNA, 16 bp, Homo sapiens
taaatgttatgtatat

SEQ ID NO: 5506587 - DNA, 13 bp, Homo sapiens
taaatgttattat

SEQ ID NO: 5506588 - DNA, 15 bp, Homo sapiens
taaatgttatttctg

SEQ ID NO: 5506589 - DNA, 16 bp, Homo sapiens
taaatgttcatgattt

SEQ ID NO: 5506590 - DNA, 20 bp, Homo sapiens
taaatgttcatgatttcaag

SEQ ID NO: 5506591 - DNA, 18 bp, Homo sapiens
taaatgttctaacagatc

SEQ ID NO: 5506592 - DNA, 14 bp, Homo sapiens
taaatgttctcgtt

SEQ ID NO: 5506593 - DNA, 23 bp, Homo sapiens
taaatgttctggtatgcattctt

SEQ ID NO: 5506594 - DNA, 20 bp, Homo sapiens
taaatgttcttggtgtttga

SEQ ID NO: 5506595 - DNA, 16 bp, Homo sapiens
taaatgttgaaatctt

SEQ ID NO: 5506596 - DNA, 15 bp, Homo sapiens
taaatgttgacatgg

SEQ ID NO: 5506597 - DNA, 15 bp, Homo sapiens
taaatgtttaaagaa

SEQ ID NO: 5506598 - DNA, 13 bp, Homo sapiens
taaatgtttacta

SEQ ID NO: 5506599 - DNA, 15 bp, Homo sapiens
taaatgtttactata

SEQ ID NO: 5506600 - DNA, 19 bp, Homo sapiens
taaatgtttactatagacc

SEQ ID NO: 5506601 - DNA, 15 bp, Homo sapiens
taaatgtttatactg

SEQ ID NO: 5506602 - DNA, 13 bp, Homo sapiens
taaatgtttcaaa

SEQ ID NO: 5506603 - DNA, 19 bp, Homo sapiens
taaatgtttcaaaatagac

SEQ ID NO: 5506604 - DNA, 14 bp, Homo sapiens
taaatgtttcatga

SEQ ID NO: 5506605 - DNA, 15 bp, Homo sapiens
taaatgtttccccca

SEQ ID NO: 5506606 - DNA, 18 bp, Homo sapiens
taaatgtttcccccactc

SEQ ID NO: 5506607 - DNA, 13 bp, Homo sapiens
taaatgtttctag

SEQ ID NO: 5506608 - DNA, 14 bp, Homo sapiens
taaatgtttctttt

SEQ ID NO: 5506609 - DNA, 18 bp, Homo sapiens
taaatgtttctttttctt

SEQ ID NO: 5506610 - DNA, 11 bp, Homo sapiens
taaatgtttga

SEQ ID NO: 5506611 - DNA, 12 bp, Homo sapiens
taaatgtttgga

SEQ ID NO: 5506612 - DNA, 14 bp, Homo sapiens
taaatgtttggaaa

SEQ ID NO: 5506613 - DNA, 22 bp, Homo sapiens
taaatgtttggcatgtaaatgt

SEQ ID NO: 5506614 - DNA, 19 bp, Homo sapiens
taaatgtttgttatttaca

SEQ ID NO: 5506615 - DNA, 22 bp, Homo sapiens
taaatgtttgtttatatcactg

SEQ ID NO: 5506616 - DNA, 14 bp, Homo sapiens
taaatgttttacaa

SEQ ID NO: 5506617 - DNA, 15 bp, Homo sapiens
taaatgttttcattg

SEQ ID NO: 5506618 - DNA, 18 bp, Homo sapiens
taaatgttttgtaaactt

SEQ ID NO: 5506619 - DNA, 19 bp, Homo sapiens
taaatgttttgtaaacttt

SEQ ID NO: 5506620 - DNA, 21 bp, Homo sapiens
taaatgttttgtaaactttga

SEQ ID NO: 5506621 - DNA, 22 bp, Homo sapiens
taaatgttttgtaaactttgaa

SEQ ID NO: 5506622 - DNA, 23 bp, Homo sapiens
taaatgttttgtaaactttgaaa

SEQ ID NO: 5506623 - DNA, 20 bp, Homo sapiens
taaatgtttttttttaaaga

SEQ ID NO: 5506624 - DNA, 18 bp, Homo sapiens
taaattaaaactgaattg

SEQ ID NO: 5506625 - DNA, 13 bp, Homo sapiens
taaattaaaatgt

SEQ ID NO: 5506626 - DNA, 16 bp, Homo sapiens
taaattaaacaattta

SEQ ID NO: 5506627 - DNA, 19 bp, Homo sapiens
taaattaaacatgctgtta

SEQ ID NO: 5506628 - DNA, 18 bp, Homo sapiens
taaattaaagcctttagt

SEQ ID NO: 5506629 - DNA, 16 bp, Homo sapiens
taaattaaataaaata

SEQ ID NO: 5506630 - DNA, 16 bp, Homo sapiens
taaattaaataaactg

SEQ ID NO: 5506631 - DNA, 21 bp, Homo sapiens
taaattaaataaactgttttc

SEQ ID NO: 5506632 - DNA, 13 bp, Homo sapiens
taaattaaatata

SEQ ID NO: 5506633 - DNA, 14 bp, Homo sapiens
taaattaacaaatt

SEQ ID NO: 5506634 - DNA, 17 bp, Homo sapiens
taaattaacaaattcag

SEQ ID NO: 5506635 - DNA, 17 bp, Homo sapiens
taaattaacattatatt

SEQ ID NO: 5506636 - DNA, 12 bp, Homo sapiens
taaattaacttt

SEQ ID NO: 5506637 - DNA, 14 bp, Homo sapiens
taaattaactttta

SEQ ID NO: 5506638 - DNA, 17 bp, Homo sapiens
taaattaacttttataa

SEQ ID NO: 5506639 - DNA, 21 bp, Homo sapiens
taaattaacttttataaactt

SEQ ID NO: 5506640 - DNA, 20 bp, Homo sapiens
taaattaagatcctaaactc

SEQ ID NO: 5506641 - DNA, 12 bp, Homo sapiens
taaattaagtgt

SEQ ID NO: 5506642 - DNA, 17 bp, Homo sapiens
taaattaatacataagt

SEQ ID NO: 5506643 - DNA, 15 bp, Homo sapiens
taaattaatatcttt

SEQ ID NO: 5506644 - DNA, 17 bp, Homo sapiens
taaattaatatctttct

SEQ ID NO: 5506645 - DNA, 13 bp, Homo sapiens
taaattaatcttt

SEQ ID NO: 5506646 - DNA, 14 bp, Homo sapiens
taaattaatgattc

SEQ ID NO: 5506647 - DNA, 24 bp, Homo sapiens
taaattaatggtttattctttgca

SEQ ID NO: 5506648 - DNA, 22 bp, Homo sapiens
taaattacaattgatctgtcat

SEQ ID NO: 5506649 - DNA, 14 bp, Homo sapiens
taaattacaatttt

SEQ ID NO: 5506650 - DNA, 20 bp, Homo sapiens
taaattacacaataaagcag

SEQ ID NO: 5506651 - DNA, 20 bp, Homo sapiens
taaattacagcttttatgga

SEQ ID NO: 5506652 - DNA, 23 bp, Homo sapiens
taaattacagcttttatggatga

SEQ ID NO: 5506653 - DNA, 17 bp, Homo sapiens
taaattacagtcatctg

SEQ ID NO: 5506654 - DNA, 12 bp, Homo sapiens
taaattacatta

SEQ ID NO: 5506655 - DNA, 22 bp, Homo sapiens
taaattacattaaaacaaaaaa

SEQ ID NO: 5506656 - DNA, 21 bp, Homo sapiens
taaattacatttgtaatttaa

SEQ ID NO: 5506657 - DNA, 20 bp, Homo sapiens
taaattaccataaaatgtca

SEQ ID NO: 5506658 - DNA, 18 bp, Homo sapiens
taaattactaattatctt

SEQ ID NO: 5506659 - DNA, 20 bp, Homo sapiens
taaattactatagcaaagta

SEQ ID NO: 5506660 - DNA, 23 bp, Homo sapiens
taaattactatagcaaagtagta

SEQ ID NO: 5506661 - DNA, 20 bp, Homo sapiens
taaattactatctgttgaaa

SEQ ID NO: 5506662 - DNA, 21 bp, Homo sapiens
taaattactatctgttgaaaa

SEQ ID NO: 5506663 - DNA, 21 bp, Homo sapiens
taaattactgttttatgttga

SEQ ID NO: 5506664 - DNA, 22 bp, Homo sapiens
taaattactgttttatgttgat

SEQ ID NO: 5506665 - DNA, 13 bp, Homo sapiens
taaattagaaaat

SEQ ID NO: 5506666 - DNA, 19 bp, Homo sapiens
taaattagaatgaatttat

SEQ ID NO: 5506667 - DNA, 23 bp, Homo sapiens
taaattagatttggcatctcctg

SEQ ID NO: 5506668 - DNA, 18 bp, Homo sapiens
taaattagtacagcactt

SEQ ID NO: 5506669 - DNA, 18 bp, Homo sapiens
taaattagtatttattta

SEQ ID NO: 5506670 - DNA, 20 bp, Homo sapiens
taaattagtttgacactgct

SEQ ID NO: 5506671 - DNA, 17 bp, Homo sapiens
taaattataaaattgaa

SEQ ID NO: 5506672 - DNA, 14 bp, Homo sapiens
taaattataaatgt

SEQ ID NO: 5506673 - DNA, 15 bp, Homo sapiens
taaattataaatgtt

SEQ ID NO: 5506674 - DNA, 16 bp, Homo sapiens
taaattataaatgttt

SEQ ID NO: 5506675 - DNA, 20 bp, Homo sapiens
taaattataaggactgcatg

SEQ ID NO: 5506676 - DNA, 21 bp, Homo sapiens
taaattataaggactgcatgg

SEQ ID NO: 5506677 - DNA, 17 bp, Homo sapiens
taaattatagtgtagaa

SEQ ID NO: 5506678 - DNA, 12 bp, Homo sapiens
taaattatcatt

SEQ ID NO: 5506679 - DNA, 21 bp, Homo sapiens
taaattatcattgtttgtcct

SEQ ID NO: 5506680 - DNA, 13 bp, Homo sapiens
taaattatctgaa

SEQ ID NO: 5506681 - DNA, 16 bp, Homo sapiens
taaattatctgaatat

SEQ ID NO: 5506682 - DNA, 19 bp, Homo sapiens
taaattatgaatattaaag

SEQ ID NO: 5506683 - DNA, 20 bp, Homo sapiens
taaattatgaatattaaagg

SEQ ID NO: 5506684 - DNA, 21 bp, Homo sapiens
taaattatgaatattaaaggt

SEQ ID NO: 5506685 - DNA, 11 bp, Homo sapiens
taaattatgac

SEQ ID NO: 5506686 - DNA, 19 bp, Homo sapiens
taaattatgacgtgcacaa

SEQ ID NO: 5506687 - DNA, 14 bp, Homo sapiens
taaattatggcatt

SEQ ID NO: 5506688 - DNA, 18 bp, Homo sapiens
taaattatggcatttcta

SEQ ID NO: 5506689 - DNA, 16 bp, Homo sapiens
taaattatggtattaa

SEQ ID NO: 5506690 - DNA, 18 bp, Homo sapiens
taaattatgtaatgcaaa

SEQ ID NO: 5506691 - DNA, 13 bp, Homo sapiens
taaattatgttta

SEQ ID NO: 5506692 - DNA, 16 bp, Homo sapiens
taaattatgttttact

SEQ ID NO: 5506693 - DNA, 23 bp, Homo sapiens
taaccagtgttgtggatttaaca

SEQ ID NO: 5506694 - DNA, 13 bp, Homo sapiens
taaccagttattt

SEQ ID NO: 5506695 - DNA, 22 bp, Homo sapiens
taaccagttgtggtgtgagtat

SEQ ID NO: 5506696 - DNA, 20 bp, Homo sapiens
taaccatatgattgaaaaga

SEQ ID NO: 5506697 - DNA, 21 bp, Homo sapiens
taaccatatgattgaaaagaa

SEQ ID NO: 5506698 - DNA, 22 bp, Homo sapiens
taaccatatgattgaaaagaag

SEQ ID NO: 5506699 - DNA, 14 bp, Homo sapiens
taaccatattcaca

SEQ ID NO: 5506700 - DNA, 17 bp, Homo sapiens
taaccatcactggttgc

SEQ ID NO: 5506701 - DNA, 16 bp, Homo sapiens
taaccatcagttactg

SEQ ID NO: 5506702 - DNA, 22 bp, Homo sapiens
taaccatcagttactggtttca

SEQ ID NO: 5506703 - DNA, 15 bp, Homo sapiens
taaccatccccaact

SEQ ID NO: 5506704 - DNA, 16 bp, Homo sapiens
taaccatccccaactc

SEQ ID NO: 5506705 - DNA, 23 bp, Homo sapiens
taaccatctttaatcaatgtgac

SEQ ID NO: 5506706 - DNA, 22 bp, Homo sapiens
taaccatgatggaataaggagc

SEQ ID NO: 5506707 - DNA, 20 bp, Homo sapiens
taaccatgtaggttcttggg

SEQ ID NO: 5506708 - DNA, 22 bp, Homo sapiens
taaccatgtgaaaaggcaaaaa

SEQ ID NO: 5506709 - DNA, 17 bp, Homo sapiens
taaccattacatgttta

SEQ ID NO: 5506710 - DNA, 22 bp, Homo sapiens
taaccattattatgcaaaattt

SEQ ID NO: 5506711 - DNA, 16 bp, Homo sapiens
taaccattgatgagca

SEQ ID NO: 5506712 - DNA, 15 bp, Homo sapiens
taaccattggaatgg

SEQ ID NO: 5506713 - DNA, 18 bp, Homo sapiens
taaccattgtcttgttct

SEQ ID NO: 5506714 - DNA, 19 bp, Homo sapiens
taaccattgtcttgttctg

SEQ ID NO: 5506715 - DNA, 19 bp, Homo sapiens
taaccatttcagtgtattg

SEQ ID NO: 5506716 - DNA, 23 bp, Homo sapiens
taaccatttcagtgtattgttta

SEQ ID NO: 5506717 - DNA, 20 bp, Homo sapiens
taaccatttctcactagtgt

SEQ ID NO: 5506718 - DNA, 14 bp, Homo sapiens
taaccatttgcact

SEQ ID NO: 5506719 - DNA, 20 bp, Homo sapiens
taaccattttataaagtgct

SEQ ID NO: 5506720 - DNA, 14 bp, Homo sapiens
taacccaaaagatt

SEQ ID NO: 5506721 - DNA, 14 bp, Homo sapiens
taacccaactctcc

SEQ ID NO: 5506722 - DNA, 16 bp, Homo sapiens
taacccaactctcctg

SEQ ID NO: 5506723 - DNA, 14 bp, Homo sapiens
taacccaactgact

SEQ ID NO: 5506724 - DNA, 16 bp, Homo sapiens
taacccacctctcctg

SEQ ID NO: 5506725 - DNA, 22 bp, Homo sapiens
taacccacctctcctgccctgt

SEQ ID NO: 5506726 - DNA, 13 bp, Homo sapiens
taacccagaaaat

SEQ ID NO: 5506727 - DNA, 16 bp, Homo sapiens
taacccagaaaatctg

SEQ ID NO: 5506728 - DNA, 14 bp, Homo sapiens
taacccagatttta

SEQ ID NO: 5506729 - DNA, 16 bp, Homo sapiens
taacccagattttatt

SEQ ID NO: 5506730 - DNA, 16 bp, Homo sapiens
taacccagtctttctt

SEQ ID NO: 5506731 - DNA, 13 bp, Homo sapiens
taacccagtgttc

SEQ ID NO: 5506732 - DNA, 18 bp, Homo sapiens
taacccatatctgtgcaa

SEQ ID NO: 5506733 - DNA, 19 bp, Homo sapiens
taacccatttttgagccaa

SEQ ID NO: 5506734 - DNA, 19 bp, Homo sapiens
taaccccaaaatgaagatt

SEQ ID NO: 5506735 - DNA, 14 bp, Homo sapiens
taaccccagcctga

SEQ ID NO: 5506736 - DNA, 13 bp, Homo sapiens
taaccccagctcc

SEQ ID NO: 5506737 - DNA, 17 bp, Homo sapiens
taaccccaggcactgtt

SEQ ID NO: 5506738 - DNA, 18 bp, Homo sapiens
taaccccaggcatcccat

SEQ ID NO: 5506739 - DNA, 14 bp, Homo sapiens
taaccccattcttt

SEQ ID NO: 5506740 - DNA, 15 bp, Homo sapiens
taacccccagctggg

SEQ ID NO: 5506741 - DNA, 17 bp, Homo sapiens
taacccccagctgggtc

SEQ ID NO: 5506742 - DNA, 18 bp, Homo sapiens
taacccccagtgccacag

SEQ ID NO: 5506743 - DNA, 19 bp, Homo sapiens
taacccccagtgccacaga

SEQ ID NO: 5506744 - DNA, 21 bp, Homo sapiens
taacccccagtgccacagaga

SEQ ID NO: 5506745 - DNA, 23 bp, Homo sapiens
taacccccagtgccacagagaag

SEQ ID NO: 5506746 - DNA, 19 bp, Homo sapiens
taacccccttaaatttaat

SEQ ID NO: 5506747 - DNA, 16 bp, Homo sapiens
taaccccgtcaacaaa

SEQ ID NO: 5506748 - DNA, 20 bp, Homo sapiens
taaccccgtctgctcctccc

SEQ ID NO: 5506749 - DNA, 18 bp, Homo sapiens
taacccctaagactgcct

SEQ ID NO: 5506750 - DNA, 15 bp, Homo sapiens
taacccctgcctgga

SEQ ID NO: 5506751 - DNA, 18 bp, Homo sapiens
taacccctgcctggattt

SEQ ID NO: 5506752 - DNA, 22 bp, Homo sapiens
taacccctgcctggatttcttc

SEQ ID NO: 5506753 - DNA, 12 bp, Homo sapiens
taacccctttcc

SEQ ID NO: 5506754 - DNA, 16 bp, Homo sapiens
taacccctttcctgcg

SEQ ID NO: 5506755 - DNA, 12 bp, Homo sapiens
taaccctcactg

SEQ ID NO: 5506756 - DNA, 19 bp, Homo sapiens
taaccctcattgctgtctt

SEQ ID NO: 5506757 - DNA, 17 bp, Homo sapiens
taaccctccacctcctc

SEQ ID NO: 5506758 - DNA, 16 bp, Homo sapiens
taaccctcgccctgtc

SEQ ID NO: 5506759 - DNA, 16 bp, Homo sapiens
taaccctctcttccct

SEQ ID NO: 5506760 - DNA, 23 bp, Homo sapiens
taaccctgggctgtccagcctta

SEQ ID NO: 5506761 - DNA, 17 bp, Homo sapiens
taaccctgtcacccaca

SEQ ID NO: 5506762 - DNA, 12 bp, Homo sapiens
taaccctgtgga

SEQ ID NO: 5506763 - DNA, 17 bp, Homo sapiens
taaccctgttacaaagc

SEQ ID NO: 5506764 - DNA, 20 bp, Homo sapiens
taacccttcatcttcctgtg

SEQ ID NO: 5506765 - DNA, 19 bp, Homo sapiens
taaccctttgtgtgctctc

SEQ ID NO: 5506766 - DNA, 19 bp, Homo sapiens
taaccgatgctttaccaaa

SEQ ID NO: 5506767 - DNA, 19 bp, Homo sapiens
taaccgcacatgcacacac

SEQ ID NO: 5506768 - DNA, 13 bp, Homo sapiens
taaccgctccagg

SEQ ID NO: 5506769 - DNA, 20 bp, Homo sapiens
taaccgtcctcgagcaactg

SEQ ID NO: 5506770 - DNA, 20 bp, Homo sapiens
taaccgtgaagctcttccta

SEQ ID NO: 5506771 - DNA, 14 bp, Homo sapiens
taaccgtttttcaa

SEQ ID NO: 5506772 - DNA, 15 bp, Homo sapiens
taaccgtttttcaag

SEQ ID NO: 5506773 - DNA, 20 bp, Homo sapiens
taacctaaaaatcaatcact

SEQ ID NO: 5506774 - DNA, 12 bp, Homo sapiens
taacctaataat

SEQ ID NO: 5506775 - DNA, 17 bp, Homo sapiens
taacctacgaccccaga

SEQ ID NO: 5506776 - DNA, 20 bp, Homo sapiens
taacctagttaaagaaagga

SEQ ID NO: 5506777 - DNA, 19 bp, Homo sapiens
taacctataaagtgtttat

SEQ ID NO: 5506778 - DNA, 21 bp, Homo sapiens
taacctatctatgaacaacag

SEQ ID NO: 5506779 - DNA, 23 bp, Homo sapiens
taacctatttatcgcaacatgaa

SEQ ID NO: 5506780 - DNA, 23 bp, Homo sapiens
taacctatttttttctctattct

SEQ ID NO: 5506781 - DNA, 14 bp, Homo sapiens
taacctcactgcct

SEQ ID NO: 5506782 - DNA, 14 bp, Homo sapiens
taacctcagctctg

SEQ ID NO: 5506783 - DNA, 15 bp, Homo sapiens
taacctcagctctgg

SEQ ID NO: 5506784 - DNA, 12 bp, Homo sapiens
taacctcaggga

SEQ ID NO: 5506785 - DNA, 14 bp, Homo sapiens
taacctcagtattt

SEQ ID NO: 5506786 - DNA, 17 bp, Homo sapiens
taacctcagtatttatg

SEQ ID NO: 5506787 - DNA, 19 bp, Homo sapiens
taacctcagtatttatgta

SEQ ID NO: 5506788 - DNA, 21 bp, Homo sapiens
taacctcagtatttatgtaat

SEQ ID NO: 5506789 - DNA, 19 bp, Homo sapiens
taacctcagtctacccctc

SEQ ID NO: 5506790 - DNA, 19 bp, Homo sapiens
taacctcagtgtcatttat

SEQ ID NO: 5506791 - DNA, 18 bp, Homo sapiens
taacctcatcttcttcac

SEQ ID NO: 5506792 - DNA, 14 bp, Homo sapiens
taacctcccctctc

SEQ ID NO: 5506793 - DNA, 15 bp, Homo sapiens
taacctcgccctctc

SEQ ID NO: 5506794 - DNA, 17 bp, Homo sapiens
taacctcgccctctcct

SEQ ID NO: 5506795 - DNA, 17 bp, Homo sapiens
taacctctatatcttta

SEQ ID NO: 5506796 - DNA, 15 bp, Homo sapiens
taacctctggccctt

SEQ ID NO: 5506797 - DNA, 22 bp, Homo sapiens
taacctctggcccttggaataa

SEQ ID NO: 5506798 - DNA, 13 bp, Homo sapiens
taacctctgggga

SEQ ID NO: 5506799 - DNA, 14 bp, Homo sapiens
taacctctgttcag

SEQ ID NO: 5506800 - DNA, 18 bp, Homo sapiens
taacctctgttcaggaag

SEQ ID NO: 5506801 - DNA, 19 bp, Homo sapiens
taacctcttatcactaaga

SEQ ID NO: 5506802 - DNA, 12 bp, Homo sapiens
taacctcttttt

SEQ ID NO: 5506803 - DNA, 22 bp, Homo sapiens
taacctgactggttaacagcag

SEQ ID NO: 5506804 - DNA, 16 bp, Homo sapiens
taacctgatgctaatt

SEQ ID NO: 5506805 - DNA, 19 bp, Homo sapiens
taacctgcaagttgctctg

SEQ ID NO: 5506806 - DNA, 17 bp, Homo sapiens
taacctgcatgcagcaa

SEQ ID NO: 5506807 - DNA, 19 bp, Homo sapiens
taacctgccagggagacag

SEQ ID NO: 5506808 - DNA, 17 bp, Homo sapiens
taacctggacctggaac

SEQ ID NO: 5506809 - DNA, 12 bp, Homo sapiens
taacctggagac

SEQ ID NO: 5506810 - DNA, 14 bp, Homo sapiens
taacctggagacag

SEQ ID NO: 5506811 - DNA, 21 bp, Homo sapiens
taacctgggaccaacctgacc

SEQ ID NO: 5506812 - DNA, 14 bp, Homo sapiens
taacctgggacctg

SEQ ID NO: 5506813 - DNA, 12 bp, Homo sapiens
taacctggtgct

SEQ ID NO: 5506814 - DNA, 15 bp, Homo sapiens
taacctggtgctgga

SEQ ID NO: 5506815 - DNA, 18 bp, Homo sapiens
taacctggtgctggatat

SEQ ID NO: 5506816 - DNA, 19 bp, Homo sapiens
taacctggtgctggatatt

SEQ ID NO: 5506817 - DNA, 19 bp, Homo sapiens
taacctgtacttcaagtta

SEQ ID NO: 5506818 - DNA, 16 bp, Homo sapiens
taacctgtagaacacc

SEQ ID NO: 5506819 - DNA, 16 bp, Homo sapiens
taacctgtctatacta

SEQ ID NO: 5506820 - DNA, 23 bp, Homo sapiens
taacctgtgtctgcgaagtccta

SEQ ID NO: 5506821 - DNA, 22 bp, Homo sapiens
taacctgttacactgggctggg

SEQ ID NO: 5506822 - DNA, 15 bp, Homo sapiens
taacctgttatttct

SEQ ID NO: 5506823 - DNA, 17 bp, Homo sapiens
taacctgttatttctat

SEQ ID NO: 5506824 - DNA, 21 bp, Homo sapiens
taacctgttatttctatgaaa

SEQ ID NO: 5506825 - DNA, 18 bp, Homo sapiens
taacctgttgctccagga

SEQ ID NO: 5506826 - DNA, 16 bp, Homo sapiens
taaccttaatttatta

SEQ ID NO: 5506827 - DNA, 19 bp, Homo sapiens
taaccttactaattatact

SEQ ID NO: 5506828 - DNA, 17 bp, Homo sapiens
taaccttatatttacaa

SEQ ID NO: 5506829 - DNA, 16 bp, Homo sapiens
taaccttatcaggatg

SEQ ID NO: 5506830 - DNA, 15 bp, Homo sapiens
taaccttgaatgctg

SEQ ID NO: 5506831 - DNA, 21 bp, Homo sapiens
taaccttgcctggtacagtat

SEQ ID NO: 5506832 - DNA, 19 bp, Homo sapiens
taacctttctaaccttcac

SEQ ID NO: 5506833 - DNA, 13 bp, Homo sapiens
taacctttgctat

SEQ ID NO: 5506834 - DNA, 14 bp, Homo sapiens
taaccttttcaaat

SEQ ID NO: 5506835 - DNA, 16 bp, Homo sapiens
taacctttttgtcttt

SEQ ID NO: 5506836 - DNA, 20 bp, Homo sapiens
taaccttttttgtcttattg

SEQ ID NO: 5506837 - DNA, 13 bp, Homo sapiens
taacgaataaagg

SEQ ID NO: 5506838 - DNA, 21 bp, Homo sapiens
taacgattgacaccaaaatga

SEQ ID NO: 5506839 - DNA, 20 bp, Homo sapiens
taacgcaaaaatagctcttg

SEQ ID NO: 5506840 - DNA, 23 bp, Homo sapiens
taacgcaataaacgcattatcag

SEQ ID NO: 5506841 - DNA, 17 bp, Homo sapiens
taacgcaggagagagag

SEQ ID NO: 5506842 - DNA, 20 bp, Homo sapiens
taacgccctatttttgcaat

SEQ ID NO: 5506843 - DNA, 13 bp, Homo sapiens
taacgcctgagcc

SEQ ID NO: 5506844 - DNA, 17 bp, Homo sapiens
taacgcgtcttcctgag

SEQ ID NO: 5506845 - DNA, 19 bp, Homo sapiens
taacggatcagaaatacag

SEQ ID NO: 5506846 - DNA, 21 bp, Homo sapiens
taacggatcagaaatacagat

SEQ ID NO: 5506847 - DNA, 16 bp, Homo sapiens
taacgggaggctgggc

SEQ ID NO: 5506848 - DNA, 19 bp, Homo sapiens
taacgggggtgcggcagga

SEQ ID NO: 5506849 - DNA, 21 bp, Homo sapiens
taacgtaaatccaccaccaaa

SEQ ID NO: 5506850 - DNA, 19 bp, Homo sapiens
taacgtatgtatttcattg

SEQ ID NO: 5506851 - DNA, 17 bp, Homo sapiens
taacgtgatgtgccact

SEQ ID NO: 5506852 - DNA, 20 bp, Homo sapiens
taacgtgcattataattttt

SEQ ID NO: 5506853 - DNA, 19 bp, Homo sapiens
taacgtgcccccagagtgt

SEQ ID NO: 5506854 - DNA, 19 bp, Homo sapiens
taacgtgctcactgtgtat

SEQ ID NO: 5506855 - DNA, 14 bp, Homo sapiens
taacgtgctgctca

SEQ ID NO: 5506856 - DNA, 15 bp, Homo sapiens
taacgtgctgctcaa

SEQ ID NO: 5506857 - DNA, 15 bp, Homo sapiens
taacgtgtgctgtgt

SEQ ID NO: 5506858 - DNA, 17 bp, Homo sapiens
taacgtgtgctgtgttt

SEQ ID NO: 5506859 - DNA, 18 bp, Homo sapiens
taacgtgttccagtgtct

SEQ ID NO: 5506860 - DNA, 22 bp, Homo sapiens
taacgttagaccacaaatagtg

SEQ ID NO: 5506861 - DNA, 20 bp, Homo sapiens
taacgtttaagccaaaacaa

SEQ ID NO: 5506862 - DNA, 18 bp, Homo sapiens
taacgttttctactttga

SEQ ID NO: 5506863 - DNA, 23 bp, Homo sapiens
taacgttttctactttgaaatat

SEQ ID NO: 5506864 - DNA, 22 bp, Homo sapiens
taacgttttcttaaatgttttc

SEQ ID NO: 5506865 - DNA, 20 bp, Homo sapiens
taacgtttttcctttaaaaa

SEQ ID NO: 5506866 - DNA, 15 bp, Homo sapiens
taacgttttttcttc

SEQ ID NO: 5506867 - DNA, 18 bp, Homo sapiens
taactaaaataattttgt

SEQ ID NO: 5506868 - DNA, 21 bp, Homo sapiens
taactaaaataattttgtaat

SEQ ID NO: 5506869 - DNA, 17 bp, Homo sapiens
taactaaaatgtatcta

SEQ ID NO: 5506870 - DNA, 15 bp, Homo sapiens
taacttcttgcttct

SEQ ID NO: 5506871 - DNA, 11 bp, Homo sapiens
taacttgaaaa

SEQ ID NO: 5506872 - DNA, 22 bp, Homo sapiens
taacttgagagtagatggtttg

SEQ ID NO: 5506873 - DNA, 18 bp, Homo sapiens
taacttgagattcaagac

SEQ ID NO: 5506874 - DNA, 21 bp, Homo sapiens
taacttgatatagaaagctgt

SEQ ID NO: 5506875 - DNA, 12 bp, Homo sapiens
taacttgatgca

SEQ ID NO: 5506876 - DNA, 15 bp, Homo sapiens
taacttgatgcatgt

SEQ ID NO: 5506877 - DNA, 16 bp, Homo sapiens
taacttgccatttctt

SEQ ID NO: 5506878 - DNA, 16 bp, Homo sapiens
taacttgcctccatct

SEQ ID NO: 5506879 - DNA, 17 bp, Homo sapiens
taacttgcctccatctt

SEQ ID NO: 5506880 - DNA, 21 bp, Homo sapiens
taacttgctgaatttcaggca

SEQ ID NO: 5506881 - DNA, 15 bp, Homo sapiens
taacttgctgtgaaa

SEQ ID NO: 5506882 - DNA, 13 bp, Homo sapiens
taacttgcttaaa

SEQ ID NO: 5506883 - DNA, 15 bp, Homo sapiens
taacttgcttaaatg

SEQ ID NO: 5506884 - DNA, 19 bp, Homo sapiens
taacttgcttagtatggtt

SEQ ID NO: 5506885 - DNA, 18 bp, Homo sapiens
taacttgctttcttcttt

SEQ ID NO: 5506886 - DNA, 20 bp, Homo sapiens
taacttgctttcttctttcc

SEQ ID NO: 5506887 - DNA, 16 bp, Homo sapiens
taacttggagccccag

SEQ ID NO: 5506888 - DNA, 15 bp, Homo sapiens
taacttggctaacat

SEQ ID NO: 5506889 - DNA, 15 bp, Homo sapiens
taacttggctttcat

SEQ ID NO: 5506890 - DNA, 19 bp, Homo sapiens
taacttgggagtgtggttt

SEQ ID NO: 5506891 - DNA, 13 bp, Homo sapiens
taacttggggaag

SEQ ID NO: 5506892 - DNA, 20 bp, Homo sapiens
taacttggggaaggggcctg

SEQ ID NO: 5506893 - DNA, 13 bp, Homo sapiens
taacttggggagg

SEQ ID NO: 5506894 - DNA, 14 bp, Homo sapiens
taacttggggaggc

SEQ ID NO: 5506895 - DNA, 21 bp, Homo sapiens
taacttggtcagagccactct

SEQ ID NO: 5506896 - DNA, 15 bp, Homo sapiens
taacttggttataca

SEQ ID NO: 5506897 - DNA, 19 bp, Homo sapiens
taacttggttctcagactc

SEQ ID NO: 5506898 - DNA, 15 bp, Homo sapiens
taacttgtatattcc

SEQ ID NO: 5506899 - DNA, 20 bp, Homo sapiens
taacttgtatattccaccat

SEQ ID NO: 5506900 - DNA, 13 bp, Homo sapiens
taacttgtcttaa

SEQ ID NO: 5506901 - DNA, 20 bp, Homo sapiens
taacttgtcttctagtttag

SEQ ID NO: 5506902 - DNA, 21 bp, Homo sapiens
taacttgtcttctagtttaga

SEQ ID NO: 5506903 - DNA, 12 bp, Homo sapiens
taacttgtcttt

SEQ ID NO: 5506904 - DNA, 16 bp, Homo sapiens
taacttgtctttggac

SEQ ID NO: 5506905 - DNA, 18 bp, Homo sapiens
taacttgtctttttgtta

SEQ ID NO: 5506906 - DNA, 15 bp, Homo sapiens
taacttgtgaagaca

SEQ ID NO: 5506907 - DNA, 15 bp, Homo sapiens
taacttgtgttacta

SEQ ID NO: 5506908 - DNA, 16 bp, Homo sapiens
taacttgttgcagact

SEQ ID NO: 5506909 - DNA, 15 bp, Homo sapiens
taactttaaaactgt

SEQ ID NO: 5506910 - DNA, 16 bp, Homo sapiens
taactttaaacatcta

SEQ ID NO: 5506911 - DNA, 18 bp, Homo sapiens
taactttaccaaatgaaa

SEQ ID NO: 5506912 - DNA, 21 bp, Homo sapiens
taactttactaagtaatctca

SEQ ID NO: 5506913 - DNA, 21 bp, Homo sapiens
taactttagaaataaacctta

SEQ ID NO: 5506914 - DNA, 16 bp, Homo sapiens
taactttataaatcca

SEQ ID NO: 5506915 - DNA, 14 bp, Homo sapiens
taactttatgtgta

SEQ ID NO: 5506916 - DNA, 15 bp, Homo sapiens
taactttattctttg

SEQ ID NO: 5506917 - DNA, 14 bp, Homo sapiens
taactttattgcat

SEQ ID NO: 5506918 - DNA, 13 bp, Homo sapiens
taactttcagaag

SEQ ID NO: 5506919 - DNA, 23 bp, Homo sapiens
taactttcagaagagatgggctt

SEQ ID NO: 5506920 - DNA, 19 bp, Homo sapiens
taactttcattaaagcatt

SEQ ID NO: 5506921 - DNA, 13 bp, Homo sapiens
taactttccagtc

SEQ ID NO: 5506922 - DNA, 10 bp, Homo sapiens
taactttccc

SEQ ID NO: 5506923 - DNA, 23 bp, Homo sapiens
taactttcgaccgactttcccca

SEQ ID NO: 5506924 - DNA, 17 bp, Homo sapiens
taactttctctgtgaaa

SEQ ID NO: 5506925 - DNA, 22 bp, Homo sapiens
taactttctctgtgaaagcttt

SEQ ID NO: 5506926 - DNA, 18 bp, Homo sapiens
taactttgcatgttcttg

SEQ ID NO: 5506927 - DNA, 22 bp, Homo sapiens
taactttgcgggatatttaggg

SEQ ID NO: 5506928 - DNA, 12 bp, Homo sapiens
taactttgcttg

SEQ ID NO: 5506929 - DNA, 22 bp, Homo sapiens
taactttgcttgattaaacagc

SEQ ID NO: 5506930 - DNA, 21 bp, Homo sapiens
taactttgttttattttcaaa

SEQ ID NO: 5506931 - DNA, 15 bp, Homo sapiens
taacttttaaagaat

SEQ ID NO: 5506932 - DNA, 11 bp, Homo sapiens
taacttttaat

SEQ ID NO: 5506933 - DNA, 23 bp, Homo sapiens
taacttttaatccctatgtttgt

SEQ ID NO: 5506934 - DNA, 15 bp, Homo sapiens
taacttttaatttaa

SEQ ID NO: 5506935 - DNA, 22 bp, Homo sapiens
taacttttataaactttacctt

SEQ ID NO: 5506936 - DNA, 13 bp, Homo sapiens
taacttttatatt

SEQ ID NO: 5506937 - DNA, 11 bp, Homo sapiens
taacttttatt

SEQ ID NO: 5506938 - DNA, 15 bp, Homo sapiens
taacttttattatct

SEQ ID NO: 5506939 - DNA, 16 bp, Homo sapiens
taacttttattatctt

SEQ ID NO: 5506940 - DNA, 22 bp, Homo sapiens
taacttttccaagcaaaatcta

SEQ ID NO: 5506941 - DNA, 12 bp, Homo sapiens
taacttttcctt

SEQ ID NO: 5506942 - DNA, 13 bp, Homo sapiens
taacttttctacc

SEQ ID NO: 5506943 - DNA, 16 bp, Homo sapiens
taacttttggaatcat

SEQ ID NO: 5506944 - DNA, 15 bp, Homo sapiens
taacttttgggattt

SEQ ID NO: 5506945 - DNA, 20 bp, Homo sapiens
taacttttgtagtcttatga

SEQ ID NO: 5506946 - DNA, 15 bp, Homo sapiens
taactttttatttct

SEQ ID NO: 5506947 - DNA, 12 bp, Homo sapiens
taactttttcca

SEQ ID NO: 5506948 - DNA, 14 bp, Homo sapiens
taactttttgtagg

SEQ ID NO: 5506949 - DNA, 21 bp, Homo sapiens
taactttttgtttttatttct

SEQ ID NO: 5506950 - DNA, 19 bp, Homo sapiens
taacttttttgagtcattg

SEQ ID NO: 5506951 - DNA, 16 bp, Homo sapiens
taacttttttgtgtat

SEQ ID NO: 5506952 - DNA, 22 bp, Homo sapiens
taacttttttgtgtatgtactt

SEQ ID NO: 5506953 - DNA, 23 bp, Homo sapiens
taactttttttaggggatttttt

SEQ ID NO: 5506954 - DNA, 15 bp, Homo sapiens
taactttttttcagt

SEQ ID NO: 5506955 - DNA, 22 bp, Homo sapiens
taacttttttttctctcttttg

SEQ ID NO: 5506956 - DNA, 19 bp, Homo sapiens
taacttttttttttcttta

SEQ ID NO: 5506957 - DNA, 20 bp, Homo sapiens
taacttttttttttttaaca

SEQ ID NO: 5506958 - DNA, 22 bp, Homo sapiens
taacttttttttttttaacatc

SEQ ID NO: 5506959 - DNA, 16 bp, Homo sapiens
taagaaaaaaagcaca

SEQ ID NO: 5506960 - DNA, 21 bp, Homo sapiens
taagaaaaaaagcacaaagtt

SEQ ID NO: 5506961 - DNA, 22 bp, Homo sapiens
taagaaaaaaagcacaaagttc

SEQ ID NO: 5506962 - DNA, 22 bp, Homo sapiens
taagaaaaaaataattttatga

SEQ ID NO: 5506963 - DNA, 11 bp, Homo sapiens
taagaaaaaag

SEQ ID NO: 5506964 - DNA, 10 bp, Homo sapiens
taagaaaaac

SEQ ID NO: 5506965 - DNA, 13 bp, Homo sapiens
taagaaaaacaaa

SEQ ID NO: 5506966 - DNA, 12 bp, Homo sapiens
taagaaaaacat

SEQ ID NO: 5506967 - DNA, 23 bp, Homo sapiens
taagaaaaaccaaaatactccaa

SEQ ID NO: 5506968 - DNA, 19 bp, Homo sapiens
taagaaaaacttttttggt

SEQ ID NO: 5506969 - DNA, 19 bp, Homo sapiens
taagaaaaagcaaaaggca

SEQ ID NO: 5506970 - DNA, 16 bp, Homo sapiens
taagaaaaaggatgca

SEQ ID NO: 5506971 - DNA, 13 bp, Homo sapiens
taagaaaaatcat

SEQ ID NO: 5506972 - DNA, 17 bp, Homo sapiens
taagaaaaatcatgttt

SEQ ID NO: 5506973 - DNA, 22 bp, Homo sapiens
taagaaaaatgaaaacttttgt

SEQ ID NO: 5506974 - DNA, 14 bp, Homo sapiens
taagaaaacaagta

SEQ ID NO: 5506975 - DNA, 14 bp, Homo sapiens
taagaaaacatgta

SEQ ID NO: 5506976 - DNA, 12 bp, Homo sapiens
taagaaaacatt

SEQ ID NO: 5506977 - DNA, 23 bp, Homo sapiens
taagaaaaccaaaataaaaattg

SEQ ID NO: 5506978 - DNA, 21 bp, Homo sapiens
taagaaaaccaccccttagat

SEQ ID NO: 5506979 - DNA, 19 bp, Homo sapiens
taagaaaactacatgtaaa

SEQ ID NO: 5506980 - DNA, 11 bp, Homo sapiens
taagaaaagag

SEQ ID NO: 5506981 - DNA, 14 bp, Homo sapiens
taagaaaagatttt

SEQ ID NO: 5506982 - DNA, 13 bp, Homo sapiens
taagaaaagcact

SEQ ID NO: 5506983 - DNA, 14 bp, Homo sapiens
taagaaaagcactt

SEQ ID NO: 5506984 - DNA, 14 bp, Homo sapiens
taagaaaagctgat

SEQ ID NO: 5506985 - DNA, 17 bp, Homo sapiens
taagaaaagtaatgaag

SEQ ID NO: 5506986 - DNA, 15 bp, Homo sapiens
taagaaaagtatttt

SEQ ID NO: 5506987 - DNA, 17 bp, Homo sapiens
taagaaaatacaataaa

SEQ ID NO: 5506988 - DNA, 18 bp, Homo sapiens
taagaaaatacaataaac

SEQ ID NO: 5506989 - DNA, 20 bp, Homo sapiens
taagaaaatattttgtctaa

SEQ ID NO: 5506990 - DNA, 18 bp, Homo sapiens
taagaaaatgctagaaga

SEQ ID NO: 5506991 - DNA, 23 bp, Homo sapiens
taagaaaatgttacggcatcaca

SEQ ID NO: 5506992 - DNA, 16 bp, Homo sapiens
taagaaaatttaaaaa

SEQ ID NO: 5506993 - DNA, 21 bp, Homo sapiens
taagaaacaactctttgagaa

SEQ ID NO: 5506994 - DNA, 13 bp, Homo sapiens
taagaaacagagg

SEQ ID NO: 5506995 - DNA, 12 bp, Homo sapiens
taagaaacagtt

SEQ ID NO: 5506996 - DNA, 17 bp, Homo sapiens
taagaaacagtttaaca

SEQ ID NO: 5506997 - DNA, 18 bp, Homo sapiens
taagaaacagtttaacag

SEQ ID NO: 5506998 - DNA, 12 bp, Homo sapiens
taagaaacattg

SEQ ID NO: 5506999 - DNA, 21 bp, Homo sapiens
taagaaaccaatcaagataaa

SEQ ID NO: 5507000 - DNA, 19 bp, Homo sapiens
taagaaacttttgtaaaga

SEQ ID NO: 5507001 - DNA, 17 bp, Homo sapiens
taagaaagaaaatattt

SEQ ID NO: 5507002 - DNA, 16 bp, Homo sapiens
taagaaagacatcttt

SEQ ID NO: 5507003 - DNA, 24 bp, Homo sapiens
taagaaagactatctaaatgttga

SEQ ID NO: 5507004 - DNA, 21 bp, Homo sapiens
taagaaagagaatgaactgtg

SEQ ID NO: 5507005 - DNA, 22 bp, Homo sapiens
taagaaagagaatgaactgtgg

SEQ ID NO: 5507006 - DNA, 17 bp, Homo sapiens
taagaaagattaaatat

SEQ ID NO: 5507007 - DNA, 14 bp, Homo sapiens
taagaaagcaaaac

SEQ ID NO: 5507008 - DNA, 14 bp, Homo sapiens
taagaaagcaaata

SEQ ID NO: 5507009 - DNA, 20 bp, Homo sapiens
taagaaagcacttaaacaga

SEQ ID NO: 5507010 - DNA, 22 bp, Homo sapiens
taagaaagccaccttgttacaa

SEQ ID NO: 5507011 - DNA, 15 bp, Homo sapiens
taagaaagcctgagt

SEQ ID NO: 5507012 - DNA, 16 bp, Homo sapiens
taagaaagctatatat

SEQ ID NO: 5507013 - DNA, 19 bp, Homo sapiens
taagaaagctatatatgaa

SEQ ID NO: 5507014 - DNA, 16 bp, Homo sapiens
taagaaagcttcttgt

SEQ ID NO: 5507015 - DNA, 18 bp, Homo sapiens
taagaaaggaagcattgt

SEQ ID NO: 5507016 - DNA, 18 bp, Homo sapiens
taagaaaggatataaaag

SEQ ID NO: 5507017 - DNA, 21 bp, Homo sapiens
taagaaaggatataaaaggat

SEQ ID NO: 5507018 - DNA, 18 bp, Homo sapiens
taagaaagggaaagctgt

SEQ ID NO: 5507019 - DNA, 23 bp, Homo sapiens
taagaaagggaaagctgtgcctt

SEQ ID NO: 5507020 - DNA, 22 bp, Homo sapiens
taagaaagtaatttaatttgta

SEQ ID NO: 5507021 - DNA, 15 bp, Homo sapiens
taagaaagtgcagaa

SEQ ID NO: 5507022 - DNA, 19 bp, Homo sapiens
taagaaagtgcagaatcaa

SEQ ID NO: 5507023 - DNA, 19 bp, Homo sapiens
taagaaataaaactgttaa

SEQ ID NO: 5507024 - DNA, 13 bp, Homo sapiens
taagaaataaatc

SEQ ID NO: 5507025 - DNA, 16 bp, Homo sapiens
taagaaataagaataa

SEQ ID NO: 5507026 - DNA, 15 bp, Homo sapiens
taagaaatactcatg

SEQ ID NO: 5507027 - DNA, 19 bp, Homo sapiens
taagaaatactcatgtgca

SEQ ID NO: 5507028 - DNA, 12 bp, Homo sapiens
taagaaatatgt

SEQ ID NO: 5507029 - DNA, 17 bp, Homo sapiens
taagaaatatgtgagat

SEQ ID NO: 5507030 - DNA, 20 bp, Homo sapiens
taagaaatatgtgagatttt

SEQ ID NO: 5507031 - DNA, 14 bp, Homo sapiens
taagaaatcaagta

SEQ ID NO: 5507032 - DNA, 15 bp, Homo sapiens
taagaaatcaagtaa

SEQ ID NO: 5507033 - DNA, 24 bp, Homo sapiens
taagaaatctagtatttcatgctg

SEQ ID NO: 5507034 - DNA, 19 bp, Homo sapiens
taagaaatctcccatgtgc

SEQ ID NO: 5507035 - DNA, 21 bp, Homo sapiens
taagaaatctggcccagggtg

SEQ ID NO: 5507036 - DNA, 15 bp, Homo sapiens
taagaaatctgtttt

SEQ ID NO: 5507037 - DNA, 14 bp, Homo sapiens
taagaaatgaacaa

SEQ ID NO: 5507038 - DNA, 20 bp, Homo sapiens
taagaaatgctgaaaatcaa

SEQ ID NO: 5507039 - DNA, 20 bp, Homo sapiens
taagaaatggctttccacat

SEQ ID NO: 5507040 - DNA, 18 bp, Homo sapiens
taagaaatgggcctcagc

SEQ ID NO: 5507041 - DNA, 16 bp, Homo sapiens
taagaaatgtataaac

SEQ ID NO: 5507042 - DNA, 18 bp, Homo sapiens
taagaaatgtatatgcta

SEQ ID NO: 5507043 - DNA, 17 bp, Homo sapiens
taagaaattgaatactt

SEQ ID NO: 5507044 - DNA, 18 bp, Homo sapiens
taagaaattgaatacttt

SEQ ID NO: 5507045 - DNA, 22 bp, Homo sapiens
taagaaattgaatactttgaat

SEQ ID NO: 5507046 - DNA, 14 bp, Homo sapiens
taagaaattttatt

SEQ ID NO: 5507047 - DNA, 17 bp, Homo sapiens
taagaaattttgccttt

SEQ ID NO: 5507048 - DNA, 17 bp, Homo sapiens
taagaacaaaagaagca

SEQ ID NO: 5507049 - DNA, 18 bp, Homo sapiens
taagcctgtccccagacc

SEQ ID NO: 5507050 - DNA, 19 bp, Homo sapiens
taagcctgtccccagacca

SEQ ID NO: 5507051 - DNA, 18 bp, Homo sapiens
taagcctgtggctgtgga

SEQ ID NO: 5507052 - DNA, 15 bp, Homo sapiens
taagcctgttgagac

SEQ ID NO: 5507053 - DNA, 13 bp, Homo sapiens
taagcctgttgct

SEQ ID NO: 5507054 - DNA, 17 bp, Homo sapiens
taagccttacaaaggga

SEQ ID NO: 5507055 - DNA, 17 bp, Homo sapiens
taagccttataaaccaa

SEQ ID NO: 5507056 - DNA, 16 bp, Homo sapiens
taagccttcatttgca

SEQ ID NO: 5507057 - DNA, 20 bp, Homo sapiens
taagccttcatttgcaattc

SEQ ID NO: 5507058 - DNA, 20 bp, Homo sapiens
taagcctttgccgtgagcat

SEQ ID NO: 5507059 - DNA, 14 bp, Homo sapiens
taagcctttggaaa

SEQ ID NO: 5507060 - DNA, 21 bp, Homo sapiens
taagcctttggaaacagctcg

SEQ ID NO: 5507061 - DNA, 23 bp, Homo sapiens
taagcgaatgtgtacaaagtgta

SEQ ID NO: 5507062 - DNA, 17 bp, Homo sapiens
taagcgatttgaaacac

SEQ ID NO: 5507063 - DNA, 21 bp, Homo sapiens
taagcggaacatgtgcttcat

SEQ ID NO: 5507064 - DNA, 18 bp, Homo sapiens
taagcgggatcccagcat

SEQ ID NO: 5507065 - DNA, 15 bp, Homo sapiens
taagcgtatggcttt

SEQ ID NO: 5507066 - DNA, 16 bp, Homo sapiens
taagctaaagaaactg

SEQ ID NO: 5507067 - DNA, 18 bp, Homo sapiens
taagctaccttgtcatat

SEQ ID NO: 5507068 - DNA, 17 bp, Homo sapiens
taagctagaaaaattag

SEQ ID NO: 5507069 - DNA, 13 bp, Homo sapiens
taagctaggaaaa

SEQ ID NO: 5507070 - DNA, 19 bp, Homo sapiens
taagctatccgtgttgcag

SEQ ID NO: 5507071 - DNA, 14 bp, Homo sapiens
taagctattcagta

SEQ ID NO: 5507072 - DNA, 21 bp, Homo sapiens
taagctattcagtaataactc

SEQ ID NO: 5507073 - DNA, 10 bp, Homo sapiens
taagctattt

SEQ ID NO: 5507074 - DNA, 18 bp, Homo sapiens
taagctatttgatgtaat

SEQ ID NO: 5507075 - DNA, 19 bp, Homo sapiens
taagctatttgatgtaata

SEQ ID NO: 5507076 - DNA, 21 bp, Homo sapiens
taagctatttgatgtaatact

SEQ ID NO: 5507077 - DNA, 22 bp, Homo sapiens
taagctcacgtcctgagaaagc

SEQ ID NO: 5507078 - DNA, 15 bp, Homo sapiens
taagctcagtgatac

SEQ ID NO: 5507079 - DNA, 13 bp, Homo sapiens
taagctcagtggc

SEQ ID NO: 5507080 - DNA, 14 bp, Homo sapiens
taagctcccctgcc

SEQ ID NO: 5507081 - DNA, 17 bp, Homo sapiens
taagctcccctgcctta

SEQ ID NO: 5507082 - DNA, 21 bp, Homo sapiens
taagctcccctgccttaacct

SEQ ID NO: 5507083 - DNA, 20 bp, Homo sapiens
taagctcctctgtaagacaa

SEQ ID NO: 5507084 - DNA, 12 bp, Homo sapiens
taagctctctgg

SEQ ID NO: 5507085 - DNA, 14 bp, Homo sapiens
taagctctctgggc

SEQ ID NO: 5507086 - DNA, 17 bp, Homo sapiens
taagctctgccccttcc

SEQ ID NO: 5507087 - DNA, 13 bp, Homo sapiens
taagctgaaaata

SEQ ID NO: 5507088 - DNA, 18 bp, Homo sapiens
taagctgatcctgcggag

SEQ ID NO: 5507089 - DNA, 15 bp, Homo sapiens
taagctgcagcttcc

SEQ ID NO: 5507090 - DNA, 21 bp, Homo sapiens
taagctgcccaatttcacaga

SEQ ID NO: 5507091 - DNA, 12 bp, Homo sapiens
taagctggagct

SEQ ID NO: 5507092 - DNA, 17 bp, Homo sapiens
taagctggctctgtttg

SEQ ID NO: 5507093 - DNA, 21 bp, Homo sapiens
taagctgggaaaaaagttttg

SEQ ID NO: 5507094 - DNA, 19 bp, Homo sapiens
taagctggtatcagtggtt

SEQ ID NO: 5507095 - DNA, 20 bp, Homo sapiens
taagctggtttacagatgtt

SEQ ID NO: 5507096 - DNA, 20 bp, Homo sapiens
taagctgtgccttcagctgt

SEQ ID NO: 5507097 - DNA, 21 bp, Homo sapiens
taagctgtgccttcagctgtt

SEQ ID NO: 5507098 - DNA, 15 bp, Homo sapiens
taagctgtgtgcagg

SEQ ID NO: 5507099 - DNA, 22 bp, Homo sapiens
taagctgttactgtcttcagta

SEQ ID NO: 5507100 - DNA, 16 bp, Homo sapiens
taagctgtttagtttg

SEQ ID NO: 5507101 - DNA, 11 bp, Homo sapiens
taagctgtttc

SEQ ID NO: 5507102 - DNA, 19 bp, Homo sapiens
taagctgtttgccaagctg

SEQ ID NO: 5507103 - DNA, 16 bp, Homo sapiens
taagcttaaaataagt

SEQ ID NO: 5507104 - DNA, 15 bp, Homo sapiens
taagcttatgcttaa

SEQ ID NO: 5507105 - DNA, 14 bp, Homo sapiens
taagcttatttaat

SEQ ID NO: 5507106 - DNA, 14 bp, Homo sapiens
taagcttatttcta

SEQ ID NO: 5507107 - DNA, 16 bp, Homo sapiens
taagcttccaggaaaa

SEQ ID NO: 5507108 - DNA, 20 bp, Homo sapiens
taagcttccaggaaaaagga

SEQ ID NO: 5507109 - DNA, 16 bp, Homo sapiens
taagcttccattttaa

SEQ ID NO: 5507110 - DNA, 16 bp, Homo sapiens
taagctttaaatgaca

SEQ ID NO: 5507111 - DNA, 23 bp, Homo sapiens
taagctttaaatgacagtaatat

SEQ ID NO: 5507112 - DNA, 11 bp, Homo sapiens
taagctttatt

SEQ ID NO: 5507113 - DNA, 16 bp, Homo sapiens
taagctttattgtgat

SEQ ID NO: 5507114 - DNA, 15 bp, Homo sapiens
taagctttctccttt

SEQ ID NO: 5507115 - DNA, 17 bp, Homo sapiens
taagctttctctcagaa

SEQ ID NO: 5507116 - DNA, 18 bp, Homo sapiens
taagctttctctcagaaa

SEQ ID NO: 5507117 - DNA, 19 bp, Homo sapiens
taagctttgccagctgctg

SEQ ID NO: 5507118 - DNA, 22 bp, Homo sapiens
taagctttgccagctgctgctg

SEQ ID NO: 5507119 - DNA, 13 bp, Homo sapiens
taagctttgttct

SEQ ID NO: 5507120 - DNA, 15 bp, Homo sapiens
taagcttttaaacaa

SEQ ID NO: 5507121 - DNA, 21 bp, Homo sapiens
taagcttttaagaaaaacaaa

SEQ ID NO: 5507122 - DNA, 15 bp, Homo sapiens
taagcttttatttct

SEQ ID NO: 5507123 - DNA, 22 bp, Homo sapiens
taagcttttcattttaatatat

SEQ ID NO: 5507124 - DNA, 16 bp, Homo sapiens
taagcttttcttttct

SEQ ID NO: 5507125 - DNA, 15 bp, Homo sapiens
taaggaaaaggattt

SEQ ID NO: 5507126 - DNA, 13 bp, Homo sapiens
taaggaaaagtaa

SEQ ID NO: 5507127 - DNA, 19 bp, Homo sapiens
taaggaaaagtttaatatt

SEQ ID NO: 5507128 - DNA, 10 bp, Homo sapiens
taaggaaact

SEQ ID NO: 5507129 - DNA, 17 bp, Homo sapiens
taaggaaactcttatct

SEQ ID NO: 5507130 - DNA, 17 bp, Homo sapiens
taaggaaactgctttat

SEQ ID NO: 5507131 - DNA, 14 bp, Homo sapiens
taaggaaactttat

SEQ ID NO: 5507132 - DNA, 21 bp, Homo sapiens
taaggaaactttatttaaatg

SEQ ID NO: 5507133 - DNA, 15 bp, Homo sapiens
taaggaaacttttta

SEQ ID NO: 5507134 - DNA, 18 bp, Homo sapiens
taaggaaactttttaatt

SEQ ID NO: 5507135 - DNA, 19 bp, Homo sapiens
taaggaaatatcataatgt

SEQ ID NO: 5507136 - DNA, 20 bp, Homo sapiens
taaggaaatcaacttgctta

SEQ ID NO: 5507137 - DNA, 16 bp, Homo sapiens
taaggaaatccagccc

SEQ ID NO: 5507138 - DNA, 21 bp, Homo sapiens
taaggaaatgttgagggcaag

SEQ ID NO: 5507139 - DNA, 15 bp, Homo sapiens
taaggaacaatgccg

SEQ ID NO: 5507140 - DNA, 14 bp, Homo sapiens
taaggaaccaacaa

SEQ ID NO: 5507141 - DNA, 16 bp, Homo sapiens
taaggaaccctggaaa

SEQ ID NO: 5507142 - DNA, 13 bp, Homo sapiens
taaggaactggaa

SEQ ID NO: 5507143 - DNA, 14 bp, Homo sapiens
taaggaactggaac

SEQ ID NO: 5507144 - DNA, 15 bp, Homo sapiens
taaggaactggaaca

SEQ ID NO: 5507145 - DNA, 20 bp, Homo sapiens
taaggaactggaacacacat

SEQ ID NO: 5507146 - DNA, 13 bp, Homo sapiens
taaggaagaaaaa

SEQ ID NO: 5507147 - DNA, 21 bp, Homo sapiens
taaggaagaataaaaaagaag

SEQ ID NO: 5507148 - DNA, 23 bp, Homo sapiens
taaggaagaataaaaaagaagag

SEQ ID NO: 5507149 - DNA, 20 bp, Homo sapiens
taaggaagatcactttgctc

SEQ ID NO: 5507150 - DNA, 9 bp, Homo sapiens
taaggaata

SEQ ID NO: 5507151 - DNA, 18 bp, Homo sapiens
taaggaatacctgtcccc

SEQ ID NO: 5507152 - DNA, 14 bp, Homo sapiens
taaggaatagcttt

SEQ ID NO: 5507153 - DNA, 21 bp, Homo sapiens
taaggaatgatattgctgaag

SEQ ID NO: 5507154 - DNA, 14 bp, Homo sapiens
taaggaattatttc

SEQ ID NO: 5507155 - DNA, 18 bp, Homo sapiens
taaggaatttcctcccaa

SEQ ID NO: 5507156 - DNA, 18 bp, Homo sapiens
taaggaattttgtctcac

SEQ ID NO: 5507157 - DNA, 15 bp, Homo sapiens
taaggacaaagtgcc

SEQ ID NO: 5507158 - DNA, 22 bp, Homo sapiens
taaggacaaattagcatgcaag

SEQ ID NO: 5507159 - DNA, 14 bp, Homo sapiens
taaggacacactaa

SEQ ID NO: 5507160 - DNA, 19 bp, Homo sapiens
taaggacactggggtctgt

SEQ ID NO: 5507161 - DNA, 15 bp, Homo sapiens
taaggacagagattt

SEQ ID NO: 5507162 - DNA, 14 bp, Homo sapiens
taaggacagcagct

SEQ ID NO: 5507163 - DNA, 13 bp, Homo sapiens
taaggacaggatg

SEQ ID NO: 5507164 - DNA, 15 bp, Homo sapiens
taaggacagtgttca

SEQ ID NO: 5507165 - DNA, 23 bp, Homo sapiens
taaggacagtgttcaaattctga

SEQ ID NO: 5507166 - DNA, 20 bp, Homo sapiens
taaggacccaaatttccctg

SEQ ID NO: 5507167 - DNA, 22 bp, Homo sapiens
taaggacctgaaattccaaagt

SEQ ID NO: 5507168 - DNA, 15 bp, Homo sapiens
taaggactacagaat

SEQ ID NO: 5507169 - DNA, 19 bp, Homo sapiens
taaggactgactgaggcag

SEQ ID NO: 5507170 - DNA, 12 bp, Homo sapiens
taaggactgcat

SEQ ID NO: 5507171 - DNA, 15 bp, Homo sapiens
taaggactgtaaaca

SEQ ID NO: 5507172 - DNA, 14 bp, Homo sapiens
taaggacttcctga

SEQ ID NO: 5507173 - DNA, 17 bp, Homo sapiens
taaggacttctgcagct

SEQ ID NO: 5507174 - DNA, 14 bp, Homo sapiens
taaggacttcttta

SEQ ID NO: 5507175 - DNA, 22 bp, Homo sapiens
taaggacttgtgcctcttggga

SEQ ID NO: 5507176 - DNA, 15 bp, Homo sapiens
taaggacttgttaga

SEQ ID NO: 5507177 - DNA, 16 bp, Homo sapiens
taaggacttgttagat

SEQ ID NO: 5507178 - DNA, 23 bp, Homo sapiens
taaggagaaagaaagtacccagc

SEQ ID NO: 5507179 - DNA, 14 bp, Homo sapiens
taaggagaatggcc

SEQ ID NO: 5507180 - DNA, 14 bp, Homo sapiens
taaggagactggta

SEQ ID NO: 5507181 - DNA, 20 bp, Homo sapiens
taaggagaggagaaactgag

SEQ ID NO: 5507182 - DNA, 19 bp, Homo sapiens
taaggagatgtaagagctt

SEQ ID NO: 5507183 - DNA, 18 bp, Homo sapiens
taaggagcatcagccagt

SEQ ID NO: 5507184 - DNA, 15 bp, Homo sapiens
taaggagctttgctc

SEQ ID NO: 5507185 - DNA, 17 bp, Homo sapiens
taaggagctttgctctt

SEQ ID NO: 5507186 - DNA, 12 bp, Homo sapiens
taaggaggaaaa

SEQ ID NO: 5507187 - DNA, 12 bp, Homo sapiens
taaggaggagaa

SEQ ID NO: 5507188 - DNA, 18 bp, Homo sapiens
taaggaggaggagggaga

SEQ ID NO: 5507189 - DNA, 19 bp, Homo sapiens
taaggagggacatgatggg

SEQ ID NO: 5507190 - DNA, 22 bp, Homo sapiens
taaggaggggaaaaaaatgttg

SEQ ID NO: 5507191 - DNA, 14 bp, Homo sapiens
taaggagtatacca

SEQ ID NO: 5507192 - DNA, 17 bp, Homo sapiens
taaggagttaaatcttc

SEQ ID NO: 5507193 - DNA, 22 bp, Homo sapiens
taaggataaatcataaagtcag

SEQ ID NO: 5507194 - DNA, 17 bp, Homo sapiens
taaggatacaggctgga

SEQ ID NO: 5507195 - DNA, 14 bp, Homo sapiens
taaggatagccttt

SEQ ID NO: 5507196 - DNA, 14 bp, Homo sapiens
taaggatagggaaa

SEQ ID NO: 5507197 - DNA, 20 bp, Homo sapiens
taaggatagtgtgaagatct

SEQ ID NO: 5507198 - DNA, 21 bp, Homo sapiens
taaggatatgcattaaccact

SEQ ID NO: 5507199 - DNA, 20 bp, Homo sapiens
taaggatcaccccagccccc

SEQ ID NO: 5507200 - DNA, 17 bp, Homo sapiens
taaggatcttttgtaaa

SEQ ID NO: 5507201 - DNA, 12 bp, Homo sapiens
taaggatgactt

SEQ ID NO: 5507202 - DNA, 17 bp, Homo sapiens
taaggatgactttagaa

SEQ ID NO: 5507203 - DNA, 16 bp, Homo sapiens
taaggatgactttttt

SEQ ID NO: 5507204 - DNA, 15 bp, Homo sapiens
taaggatgagcagca

SEQ ID NO: 5507205 - DNA, 20 bp, Homo sapiens
taaggatgagggaagcgaag

SEQ ID NO: 5507206 - DNA, 17 bp, Homo sapiens
taaggatgctaaacctt

SEQ ID NO: 5507207 - DNA, 18 bp, Homo sapiens
taaggatgcttgtacata

SEQ ID NO: 5507208 - DNA, 19 bp, Homo sapiens
taaggatgcttgtacataa

SEQ ID NO: 5507209 - DNA, 20 bp, Homo sapiens
taaggatggagccagctctg

SEQ ID NO: 5507210 - DNA, 14 bp, Homo sapiens
taaggatggatggc

SEQ ID NO: 5507211 - DNA, 15 bp, Homo sapiens
taaggatggatggca

SEQ ID NO: 5507212 - DNA, 16 bp, Homo sapiens
taaggatggatggcac

SEQ ID NO: 5507213 - DNA, 19 bp, Homo sapiens
taaggatggatggcaccct

SEQ ID NO: 5507214 - DNA, 20 bp, Homo sapiens
taaggatggatggcaccctg

SEQ ID NO: 5507215 - DNA, 21 bp, Homo sapiens
taaggatggatggcaccctgg

SEQ ID NO: 5507216 - DNA, 22 bp, Homo sapiens
taaggatggatggcaccctgga

SEQ ID NO: 5507217 - DNA, 12 bp, Homo sapiens
taaggatgggaa

SEQ ID NO: 5507218 - DNA, 16 bp, Homo sapiens
taaggatgggaaggag

SEQ ID NO: 5507219 - DNA, 19 bp, Homo sapiens
taaggatgtcacagggcca

SEQ ID NO: 5507220 - DNA, 20 bp, Homo sapiens
taaggatttattctcagaac

SEQ ID NO: 5507221 - DNA, 12 bp, Homo sapiens
taaggattttat

SEQ ID NO: 5507222 - DNA, 18 bp, Homo sapiens
taaggcaaatcaggtaaa

SEQ ID NO: 5507223 - DNA, 22 bp, Homo sapiens
taaggcaaatcaggtaaaatag

SEQ ID NO: 5507224 - DNA, 20 bp, Homo sapiens
taaggcaacatttccgaaga

SEQ ID NO: 5507225 - DNA, 19 bp, Homo sapiens
taaggcaactgaacaaaaa

SEQ ID NO: 5507226 - DNA, 17 bp, Homo sapiens
taaggcacagtgggagc

SEQ ID NO: 5507227 - DNA, 15 bp, Homo sapiens
taaggcagacaggaa

SEQ ID NO: 5507228 - DNA, 18 bp, Homo sapiens
taataaacactgttttat

SEQ ID NO: 5507229 - DNA, 13 bp, Homo sapiens
taataaacattct

SEQ ID NO: 5507230 - DNA, 13 bp, Homo sapiens
taataaaccagtt

SEQ ID NO: 5507231 - DNA, 16 bp, Homo sapiens
taataaacgatgttgt

SEQ ID NO: 5507232 - DNA, 13 bp, Homo sapiens
taataaactaata

SEQ ID NO: 5507233 - DNA, 13 bp, Homo sapiens
taataaactctct

SEQ ID NO: 5507234 - DNA, 17 bp, Homo sapiens
taataaactgtattaaa

SEQ ID NO: 5507235 - DNA, 20 bp, Homo sapiens
taataaactgtcctctttca

SEQ ID NO: 5507236 - DNA, 16 bp, Homo sapiens
taataaactgtttaac

SEQ ID NO: 5507237 - DNA, 19 bp, Homo sapiens
taataaacttttttttgag

SEQ ID NO: 5507238 - DNA, 21 bp, Homo sapiens
taataaacttttttttgagaa

SEQ ID NO: 5507239 - DNA, 21 bp, Homo sapiens
taataaagaaatatttaccta

SEQ ID NO: 5507240 - DNA, 22 bp, Homo sapiens
taataaagaaatatttacctaa

SEQ ID NO: 5507241 - DNA, 20 bp, Homo sapiens
taataaagaattaacagaga

SEQ ID NO: 5507242 - DNA, 13 bp, Homo sapiens
taataaagagaaa

SEQ ID NO: 5507243 - DNA, 16 bp, Homo sapiens
taataaagagaaatat

SEQ ID NO: 5507244 - DNA, 18 bp, Homo sapiens
taataaagagaaatatat

SEQ ID NO: 5507245 - DNA, 20 bp, Homo sapiens
taataaagatacaaaatgtt

SEQ ID NO: 5507246 - DNA, 17 bp, Homo sapiens
taataaagatcatgtaa

SEQ ID NO: 5507247 - DNA, 13 bp, Homo sapiens
taataaagatgat

SEQ ID NO: 5507248 - DNA, 16 bp, Homo sapiens
taataaagatgattga

SEQ ID NO: 5507249 - DNA, 15 bp, Homo sapiens
taataaagatgtgaa

SEQ ID NO: 5507250 - DNA, 10 bp, Homo sapiens
taataaagca

SEQ ID NO: 5507251 - DNA, 17 bp, Homo sapiens
taataaagcaatctgat

SEQ ID NO: 5507252 - DNA, 20 bp, Homo sapiens
taataaagccatttcttata

SEQ ID NO: 5507253 - DNA, 17 bp, Homo sapiens
taataaagctcctctgc

SEQ ID NO: 5507254 - DNA, 11 bp, Homo sapiens
taataaagctg

SEQ ID NO: 5507255 - DNA, 13 bp, Homo sapiens
taataaaggactg

SEQ ID NO: 5507256 - DNA, 19 bp, Homo sapiens
taataaaggctgaagcttt

SEQ ID NO: 5507257 - DNA, 14 bp, Homo sapiens
taataaaggttgtg

SEQ ID NO: 5507258 - DNA, 12 bp, Homo sapiens
taataaagtact

SEQ ID NO: 5507259 - DNA, 13 bp, Homo sapiens
taataaagtactt

SEQ ID NO: 5507260 - DNA, 21 bp, Homo sapiens
taataaagtatgaatatttca

SEQ ID NO: 5507261 - DNA, 14 bp, Homo sapiens
taataaagtgaact

SEQ ID NO: 5507262 - DNA, 18 bp, Homo sapiens
taataaagtgaactttgt

SEQ ID NO: 5507263 - DNA, 22 bp, Homo sapiens
taataaagtgttacgttttatt

SEQ ID NO: 5507264 - DNA, 15 bp, Homo sapiens
taataaagttgcttt

SEQ ID NO: 5507265 - DNA, 16 bp, Homo sapiens
taataaagttgtttta

SEQ ID NO: 5507266 - DNA, 17 bp, Homo sapiens
taataaagtttccatta

SEQ ID NO: 5507267 - DNA, 16 bp, Homo sapiens
taataaataaacttca

SEQ ID NO: 5507268 - DNA, 19 bp, Homo sapiens
taataaatataatttataa

SEQ ID NO: 5507269 - DNA, 12 bp, Homo sapiens
taataaatattt

SEQ ID NO: 5507270 - DNA, 15 bp, Homo sapiens
taataaatctggtag

SEQ ID NO: 5507271 - DNA, 19 bp, Homo sapiens
taataaatgacaaatgtat

SEQ ID NO: 5507272 - DNA, 14 bp, Homo sapiens
taataaatgaccag

SEQ ID NO: 5507273 - DNA, 18 bp, Homo sapiens
taataaatgaccagttta

SEQ ID NO: 5507274 - DNA, 17 bp, Homo sapiens
taataaatggatactta

SEQ ID NO: 5507275 - DNA, 11 bp, Homo sapiens
taataaatggg

SEQ ID NO: 5507276 - DNA, 17 bp, Homo sapiens
taataaatgtacattaa

SEQ ID NO: 5507277 - DNA, 14 bp, Homo sapiens
taataaattaacat

SEQ ID NO: 5507278 - DNA, 15 bp, Homo sapiens
taataaattaacatt

SEQ ID NO: 5507279 - DNA, 20 bp, Homo sapiens
taataaattaatttttcaat

SEQ ID NO: 5507280 - DNA, 14 bp, Homo sapiens
taataaattcaaaa

SEQ ID NO: 5507281 - DNA, 15 bp, Homo sapiens
taataaattcaaaac

SEQ ID NO: 5507282 - DNA, 15 bp, Homo sapiens
taataaattcagata

SEQ ID NO: 5507283 - DNA, 16 bp, Homo sapiens
taataaattcatcaga

SEQ ID NO: 5507284 - DNA, 19 bp, Homo sapiens
taataaattccatctatca

SEQ ID NO: 5507285 - DNA, 18 bp, Homo sapiens
taataaattgaataggta

SEQ ID NO: 5507286 - DNA, 16 bp, Homo sapiens
taataaattgacataa

SEQ ID NO: 5507287 - DNA, 21 bp, Homo sapiens
taataaattgcttactgatat

SEQ ID NO: 5507288 - DNA, 21 bp, Homo sapiens
taataaattgtttggcttcct

SEQ ID NO: 5507289 - DNA, 16 bp, Homo sapiens
taataaatttactcac

SEQ ID NO: 5507290 - DNA, 19 bp, Homo sapiens
taataaattttaacatttt

SEQ ID NO: 5507291 - DNA, 23 bp, Homo sapiens
taataaattttaacattttccaa

SEQ ID NO: 5507292 - DNA, 15 bp, Homo sapiens
taataaattttctaa

SEQ ID NO: 5507293 - DNA, 20 bp, Homo sapiens
taataacaacaacttaatgt

SEQ ID NO: 5507294 - DNA, 13 bp, Homo sapiens
taataacaatata

SEQ ID NO: 5507295 - DNA, 13 bp, Homo sapiens
taataacataaca

SEQ ID NO: 5507296 - DNA, 15 bp, Homo sapiens
taataacatatctaa

SEQ ID NO: 5507297 - DNA, 22 bp, Homo sapiens
taataaccaaatgcaatgtgaa

SEQ ID NO: 5507298 - DNA, 19 bp, Homo sapiens
taataacctttaagtcaga

SEQ ID NO: 5507299 - DNA, 15 bp, Homo sapiens
taataactaaaccag

SEQ ID NO: 5507300 - DNA, 16 bp, Homo sapiens
taataactagatctcc

SEQ ID NO: 5507301 - DNA, 19 bp, Homo sapiens
taataactagatctcctgt

SEQ ID NO: 5507302 - DNA, 20 bp, Homo sapiens
taataactagatctcctgta

SEQ ID NO: 5507303 - DNA, 21 bp, Homo sapiens
taataactagatctcctgtaa

SEQ ID NO: 5507304 - DNA, 15 bp, Homo sapiens
taataactatggtaa

SEQ ID NO: 5507305 - DNA, 20 bp, Homo sapiens
taataactcggattccagcc

SEQ ID NO: 5507306 - DNA, 17 bp, Homo sapiens
taataactgtcttctgg

SEQ ID NO: 5507307 - DNA, 21 bp, Homo sapiens
taataactgtgaagtttacat

SEQ ID NO: 5507308 - DNA, 13 bp, Homo sapiens
taataactgtgta

SEQ ID NO: 5507309 - DNA, 13 bp, Homo sapiens
taataactgttag

SEQ ID NO: 5507310 - DNA, 22 bp, Homo sapiens
taataactttattgcatataga

SEQ ID NO: 5507311 - DNA, 14 bp, Homo sapiens
taataactttctct

SEQ ID NO: 5507312 - DNA, 20 bp, Homo sapiens
taataactttctctgtgaaa

SEQ ID NO: 5507313 - DNA, 22 bp, Homo sapiens
taataactttctctgtgaaagc

SEQ ID NO: 5507314 - DNA, 13 bp, Homo sapiens
taataagactttt

SEQ ID NO: 5507315 - DNA, 22 bp, Homo sapiens
taataagacttttctctacttt

SEQ ID NO: 5507316 - DNA, 13 bp, Homo sapiens
taataagataatg

SEQ ID NO: 5507317 - DNA, 14 bp, Homo sapiens
taataagatggctg

SEQ ID NO: 5507318 - DNA, 17 bp, Homo sapiens
taataagatggctgtgg

SEQ ID NO: 5507319 - DNA, 17 bp, Homo sapiens
taataagatttttcaaa

SEQ ID NO: 5507320 - DNA, 22 bp, Homo sapiens
taataagcacttgcctggaata

SEQ ID NO: 5507321 - DNA, 18 bp, Homo sapiens
taataagcataagaccaa

SEQ ID NO: 5507322 - DNA, 20 bp, Homo sapiens
taataagctagttgaatact

SEQ ID NO: 5507323 - DNA, 23 bp, Homo sapiens
taataagctagttgaatacttga

SEQ ID NO: 5507324 - DNA, 16 bp, Homo sapiens
taataaggaaaagttt

SEQ ID NO: 5507325 - DNA, 18 bp, Homo sapiens
taataaggaaaagtttaa

SEQ ID NO: 5507326 - DNA, 14 bp, Homo sapiens
taataagtactttc

SEQ ID NO: 5507327 - DNA, 21 bp, Homo sapiens
taataagtgaagaatacatca

SEQ ID NO: 5507328 - DNA, 21 bp, Homo sapiens
taataagtgacaaataagatt

SEQ ID NO: 5507329 - DNA, 23 bp, Homo sapiens
taataagtgacaaataagattaa

SEQ ID NO: 5507330 - DNA, 17 bp, Homo sapiens
taataagtgatgtgctg

SEQ ID NO: 5507331 - DNA, 15 bp, Homo sapiens
taataagtttgatca

SEQ ID NO: 5507332 - DNA, 21 bp, Homo sapiens
taataagtttgtgttagaaaa

SEQ ID NO: 5507333 - DNA, 15 bp, Homo sapiens
taataagttttgata

SEQ ID NO: 5507334 - DNA, 16 bp, Homo sapiens
taataagttttgatat

SEQ ID NO: 5507335 - DNA, 21 bp, Homo sapiens
taataagttttgatataatct

SEQ ID NO: 5507336 - DNA, 16 bp, Homo sapiens
taataataaagaatag

SEQ ID NO: 5507337 - DNA, 18 bp, Homo sapiens
taataataaatagttctt

SEQ ID NO: 5507338 - DNA, 14 bp, Homo sapiens
taataataatgttt

SEQ ID NO: 5507339 - DNA, 17 bp, Homo sapiens
taataataattgaagaa

SEQ ID NO: 5507340 - DNA, 20 bp, Homo sapiens
taataatagttattatttaa

SEQ ID NO: 5507341 - DNA, 19 bp, Homo sapiens
taataatatacttgtggac

SEQ ID NO: 5507342 - DNA, 22 bp, Homo sapiens
taataatatacttgtggactaa

SEQ ID NO: 5507343 - DNA, 21 bp, Homo sapiens
taataatatcaaagagaagat

SEQ ID NO: 5507344 - DNA, 19 bp, Homo sapiens
taataatatgtacaaataa

SEQ ID NO: 5507345 - DNA, 20 bp, Homo sapiens
taataatatgtacaaataat

SEQ ID NO: 5507346 - DNA, 23 bp, Homo sapiens
taataatatgtactaagaatgtc

SEQ ID NO: 5507347 - DNA, 14 bp, Homo sapiens
taataatattgttt

SEQ ID NO: 5507348 - DNA, 14 bp, Homo sapiens
taataatcaagagc

SEQ ID NO: 5507349 - DNA, 17 bp, Homo sapiens
taataatcattttagaa

SEQ ID NO: 5507350 - DNA, 20 bp, Homo sapiens
taataatcttgtttctgaaa

SEQ ID NO: 5507351 - DNA, 19 bp, Homo sapiens
taataatgaagtagaagtt

SEQ ID NO: 5507352 - DNA, 22 bp, Homo sapiens
taataatgagctattaaaactc

SEQ ID NO: 5507353 - DNA, 23 bp, Homo sapiens
taataatgagctattaaaactca

SEQ ID NO: 5507354 - DNA, 18 bp, Homo sapiens
taataatgccaatgaaca

SEQ ID NO: 5507355 - DNA, 19 bp, Homo sapiens
taataatgccaatgaacat

SEQ ID NO: 5507356 - DNA, 21 bp, Homo sapiens
taataatgcccttaatgtgag

SEQ ID NO: 5507357 - DNA, 16 bp, Homo sapiens
taataatggcatcaat

SEQ ID NO: 5507358 - DNA, 15 bp, Homo sapiens
taataatgtaatact

SEQ ID NO: 5507359 - DNA, 20 bp, Homo sapiens
taataatgtattgtaatctt

SEQ ID NO: 5507360 - DNA, 17 bp, Homo sapiens
taataatgtcctttccc

SEQ ID NO: 5507361 - DNA, 14 bp, Homo sapiens
taataatgtgcaaa

SEQ ID NO: 5507362 - DNA, 15 bp, Homo sapiens
taataatgtttaata

SEQ ID NO: 5507363 - DNA, 23 bp, Homo sapiens
taataattaattaattaacatca

SEQ ID NO: 5507364 - DNA, 17 bp, Homo sapiens
taataattacttaatgt

SEQ ID NO: 5507365 - DNA, 16 bp, Homo sapiens
taataattatatgcta

SEQ ID NO: 5507366 - DNA, 19 bp, Homo sapiens
taataattatatgctattt

SEQ ID NO: 5507367 - DNA, 20 bp, Homo sapiens
taataattatatgctatttc

SEQ ID NO: 5507368 - DNA, 23 bp, Homo sapiens
taataattatatgctatttctat

SEQ ID NO: 5507369 - DNA, 17 bp, Homo sapiens
taataattattattaaa

SEQ ID NO: 5507370 - DNA, 15 bp, Homo sapiens
taataattgaagaat

SEQ ID NO: 5507371 - DNA, 20 bp, Homo sapiens
taataattggccttcgattt

SEQ ID NO: 5507372 - DNA, 15 bp, Homo sapiens
taataattgtatcta

SEQ ID NO: 5507373 - DNA, 22 bp, Homo sapiens
taataattgtatctacattaaa

SEQ ID NO: 5507374 - DNA, 21 bp, Homo sapiens
taataatttcatccctattta

SEQ ID NO: 5507375 - DNA, 17 bp, Homo sapiens
taataatttgccattat

SEQ ID NO: 5507376 - DNA, 19 bp, Homo sapiens
taataatttgccattatct

SEQ ID NO: 5507377 - DNA, 17 bp, Homo sapiens
taataatttgtaaattg

SEQ ID NO: 5507378 - DNA, 19 bp, Homo sapiens
taataatttgtaaattgaa

SEQ ID NO: 5507379 - DNA, 22 bp, Homo sapiens
taataattttaggcacccatcc

SEQ ID NO: 5507380 - DNA, 21 bp, Homo sapiens
taataatttttacctaatctc

SEQ ID NO: 5507381 - DNA, 15 bp, Homo sapiens
taataatttttgctg

SEQ ID NO: 5507382 - DNA, 18 bp, Homo sapiens
taataatttttgctgaat

SEQ ID NO: 5507383 - DNA, 18 bp, Homo sapiens
taatacaaaaggctccat

SEQ ID NO: 5507384 - DNA, 14 bp, Homo sapiens
taatacaaactaat

SEQ ID NO: 5507385 - DNA, 18 bp, Homo sapiens
taatacaaagaaaaagcc

SEQ ID NO: 5507386 - DNA, 14 bp, Homo sapiens
taatacaaaggctt

SEQ ID NO: 5507387 - DNA, 12 bp, Homo sapiens
taatacaacaat

SEQ ID NO: 5507388 - DNA, 14 bp, Homo sapiens
taatacaaggtata

SEQ ID NO: 5507389 - DNA, 21 bp, Homo sapiens
taatacaaggtataataaaat

SEQ ID NO: 5507390 - DNA, 15 bp, Homo sapiens
taatacaatattaat

SEQ ID NO: 5507391 - DNA, 16 bp, Homo sapiens
taatacaatggtcatt

SEQ ID NO: 5507392 - DNA, 14 bp, Homo sapiens
taatacacaaaatc

SEQ ID NO: 5507393 - DNA, 17 bp, Homo sapiens
taatacacaaaatcaaa

SEQ ID NO: 5507394 - DNA, 18 bp, Homo sapiens
taatacacacagttactg

SEQ ID NO: 5507395 - DNA, 22 bp, Homo sapiens
taatacacagtactttattgta

SEQ ID NO: 5507396 - DNA, 20 bp, Homo sapiens
taatacactaatagtaagat

SEQ ID NO: 5507397 - DNA, 13 bp, Homo sapiens
taatacagatgta

SEQ ID NO: 5507398 - DNA, 12 bp, Homo sapiens
taatacagattt

SEQ ID NO: 5507399 - DNA, 22 bp, Homo sapiens
taatacaggagacccaacaatg

SEQ ID NO: 5507400 - DNA, 13 bp, Homo sapiens
taatacataagtt

SEQ ID NO: 5507401 - DNA, 16 bp, Homo sapiens
taatacatcacatctt

SEQ ID NO: 5507402 - DNA, 17 bp, Homo sapiens
taatacatcacatctta

SEQ ID NO: 5507403 - DNA, 15 bp, Homo sapiens
taatacattacatgt

SEQ ID NO: 5507404 - DNA, 19 bp, Homo sapiens
taatacattccatcacagc

SEQ ID NO: 5507405 - DNA, 21 bp, Homo sapiens
taatacattctatgacatttt

SEQ ID NO: 5507406 - DNA, 17 bp, Homo sapiens
taatctgtagggctgga

SEQ ID NO: 5507407 - DNA, 16 bp, Homo sapiens
taatctgtcaaaacac

SEQ ID NO: 5507408 - DNA, 21 bp, Homo sapiens
taatctgtgctgtttcaaagt

SEQ ID NO: 5507409 - DNA, 12 bp, Homo sapiens
taatctgttgtt

SEQ ID NO: 5507410 - DNA, 19 bp, Homo sapiens
taatctgtttgtgcaaaca

SEQ ID NO: 5507411 - DNA, 22 bp, Homo sapiens
taatctgtttgtgcaaacataa

SEQ ID NO: 5507412 - DNA, 10 bp, Homo sapiens
taatcttaag

SEQ ID NO: 5507413 - DNA, 17 bp, Homo sapiens
taatcttaatctgttta

SEQ ID NO: 5507414 - DNA, 16 bp, Homo sapiens
taatcttaatgtatat

SEQ ID NO: 5507415 - DNA, 17 bp, Homo sapiens
taatcttaatgtctggt

SEQ ID NO: 5507416 - DNA, 22 bp, Homo sapiens
taatcttaattttgtatttttt

SEQ ID NO: 5507417 - DNA, 13 bp, Homo sapiens
taatcttagaaca

SEQ ID NO: 5507418 - DNA, 16 bp, Homo sapiens
taatcttagcttttaa

SEQ ID NO: 5507419 - DNA, 18 bp, Homo sapiens
taatcttagcttttaata

SEQ ID NO: 5507420 - DNA, 19 bp, Homo sapiens
taatcttaggggagagctt

SEQ ID NO: 5507421 - DNA, 15 bp, Homo sapiens
taatcttagtgtatg

SEQ ID NO: 5507422 - DNA, 15 bp, Homo sapiens
taatcttataattgt

SEQ ID NO: 5507423 - DNA, 14 bp, Homo sapiens
taatcttatacaac

SEQ ID NO: 5507424 - DNA, 21 bp, Homo sapiens
taatcttattagggagaaaat

SEQ ID NO: 5507425 - DNA, 22 bp, Homo sapiens
taatcttattcattttctctaa

SEQ ID NO: 5507426 - DNA, 15 bp, Homo sapiens
taatcttatttagga

SEQ ID NO: 5507427 - DNA, 17 bp, Homo sapiens
taatcttcaaagccttc

SEQ ID NO: 5507428 - DNA, 15 bp, Homo sapiens
taatcttcaatagtt

SEQ ID NO: 5507429 - DNA, 16 bp, Homo sapiens
taatcttcagttttat

SEQ ID NO: 5507430 - DNA, 18 bp, Homo sapiens
taatcttctctcttgatt

SEQ ID NO: 5507431 - DNA, 20 bp, Homo sapiens
taatcttgaaggaacacaaa

SEQ ID NO: 5507432 - DNA, 19 bp, Homo sapiens
taatcttgcttcattgtta

SEQ ID NO: 5507433 - DNA, 18 bp, Homo sapiens
taatcttggcttcttaaa

SEQ ID NO: 5507434 - DNA, 11 bp, Homo sapiens
taatcttggtc

SEQ ID NO: 5507435 - DNA, 16 bp, Homo sapiens
taatcttgtagacact

SEQ ID NO: 5507436 - DNA, 12 bp, Homo sapiens
taatcttgtgta

SEQ ID NO: 5507437 - DNA, 19 bp, Homo sapiens
taatcttgttgataaaaat

SEQ ID NO: 5507438 - DNA, 15 bp, Homo sapiens
taatctttaaactgg

SEQ ID NO: 5507439 - DNA, 17 bp, Homo sapiens
taatctttaattttaca

SEQ ID NO: 5507440 - DNA, 20 bp, Homo sapiens
taatctttattttattattc

SEQ ID NO: 5507441 - DNA, 19 bp, Homo sapiens
taatctttcaaaccagctt

SEQ ID NO: 5507442 - DNA, 20 bp, Homo sapiens
taatctttcacttgaaagat

SEQ ID NO: 5507443 - DNA, 21 bp, Homo sapiens
taatctttcacttgaaagatt

SEQ ID NO: 5507444 - DNA, 23 bp, Homo sapiens
taatctttcacttgaaagatttt

SEQ ID NO: 5507445 - DNA, 17 bp, Homo sapiens
taatctttcggtctcct

SEQ ID NO: 5507446 - DNA, 21 bp, Homo sapiens
taatctttctttacctgagac

SEQ ID NO: 5507447 - DNA, 23 bp, Homo sapiens
taatctttctttacctgagacca

SEQ ID NO: 5507448 - DNA, 22 bp, Homo sapiens
taatctttgggtaacttcaaaa

SEQ ID NO: 5507449 - DNA, 13 bp, Homo sapiens
taatcttttacat

SEQ ID NO: 5507450 - DNA, 16 bp, Homo sapiens
taatcttttacattga

SEQ ID NO: 5507451 - DNA, 19 bp, Homo sapiens
taatcttttagtgtttact

SEQ ID NO: 5507452 - DNA, 11 bp, Homo sapiens
taatcttttat

SEQ ID NO: 5507453 - DNA, 14 bp, Homo sapiens
taatcttttattta

SEQ ID NO: 5507454 - DNA, 14 bp, Homo sapiens
taatcttttctgag

SEQ ID NO: 5507455 - DNA, 17 bp, Homo sapiens
taatctttttacagttg

SEQ ID NO: 5507456 - DNA, 15 bp, Homo sapiens
taatctttttgtttt

SEQ ID NO: 5507457 - DNA, 17 bp, Homo sapiens
taatgaaaaacaaaaag

SEQ ID NO: 5507458 - DNA, 15 bp, Homo sapiens
taatgaaaaatctga

SEQ ID NO: 5507459 - DNA, 21 bp, Homo sapiens
taatgaaaacagaatgtctct

SEQ ID NO: 5507460 - DNA, 17 bp, Homo sapiens
taatgaaaataaaacac

SEQ ID NO: 5507461 - DNA, 13 bp, Homo sapiens
taatgaaaatgtc

SEQ ID NO: 5507462 - DNA, 16 bp, Homo sapiens
taatgaaaatgtctca

SEQ ID NO: 5507463 - DNA, 13 bp, Homo sapiens
taatgaaacaaag

SEQ ID NO: 5507464 - DNA, 14 bp, Homo sapiens
taatgaaagactgt

SEQ ID NO: 5507465 - DNA, 18 bp, Homo sapiens
taatgaaataaaatttga

SEQ ID NO: 5507466 - DNA, 14 bp, Homo sapiens
taatgaaataatca

SEQ ID NO: 5507467 - DNA, 19 bp, Homo sapiens
taatgaaataatcagtgac

SEQ ID NO: 5507468 - DNA, 14 bp, Homo sapiens
taatgaaatatctg

SEQ ID NO: 5507469 - DNA, 19 bp, Homo sapiens
taatgaaatatctgtattt

SEQ ID NO: 5507470 - DNA, 16 bp, Homo sapiens
taatgaaatcaaatgt

SEQ ID NO: 5507471 - DNA, 19 bp, Homo sapiens
taatgaaatgataaagact

SEQ ID NO: 5507472 - DNA, 13 bp, Homo sapiens
taatgaaatggag

SEQ ID NO: 5507473 - DNA, 15 bp, Homo sapiens
taatgaaattccaga

SEQ ID NO: 5507474 - DNA, 16 bp, Homo sapiens
taatgaaattgagaag

SEQ ID NO: 5507475 - DNA, 14 bp, Homo sapiens
taatgaacaaaatt

SEQ ID NO: 5507476 - DNA, 13 bp, Homo sapiens
taatgaacaaatg

SEQ ID NO: 5507477 - DNA, 14 bp, Homo sapiens
taatgaacaaatgg

SEQ ID NO: 5507478 - DNA, 16 bp, Homo sapiens
taatgaaccgctgaat

SEQ ID NO: 5507479 - DNA, 18 bp, Homo sapiens
taatgaaccgtttacagt

SEQ ID NO: 5507480 - DNA, 20 bp, Homo sapiens
taatgaaccgtttacagtgt

SEQ ID NO: 5507481 - DNA, 19 bp, Homo sapiens
taatgaactaccatctgat

SEQ ID NO: 5507482 - DNA, 22 bp, Homo sapiens
taatgaagaaagtggaaaacaa

SEQ ID NO: 5507483 - DNA, 23 bp, Homo sapiens
taatgaagaaagtggaaaacaag

SEQ ID NO: 5507484 - DNA, 17 bp, Homo sapiens
taatgaagaacactgta

SEQ ID NO: 5507485 - DNA, 11 bp, Homo sapiens
taatgaagaca

SEQ ID NO: 5507486 - DNA, 12 bp, Homo sapiens
taatgaagagaa

SEQ ID NO: 5507487 - DNA, 13 bp, Homo sapiens
taatgaagatcta

SEQ ID NO: 5507488 - DNA, 22 bp, Homo sapiens
taatgaaggcatatttccaata

SEQ ID NO: 5507489 - DNA, 18 bp, Homo sapiens
taatgaaggtgtgctaca

SEQ ID NO: 5507490 - DNA, 17 bp, Homo sapiens
taatgaagtattacatg

SEQ ID NO: 5507491 - DNA, 22 bp, Homo sapiens
taatgaagtattacatgattta

SEQ ID NO: 5507492 - DNA, 16 bp, Homo sapiens
taatgaagtgtttcct

SEQ ID NO: 5507493 - DNA, 14 bp, Homo sapiens
taatgaagtttgaa

SEQ ID NO: 5507494 - DNA, 16 bp, Homo sapiens
taatgaataaactgaa

SEQ ID NO: 5507495 - DNA, 22 bp, Homo sapiens
taatgaataaagtgcaaacaga

SEQ ID NO: 5507496 - DNA, 18 bp, Homo sapiens
taatgaataccttagtgc

SEQ ID NO: 5507497 - DNA, 20 bp, Homo sapiens
taatgaataccttagtgcag

SEQ ID NO: 5507498 - DNA, 20 bp, Homo sapiens
taatgaatcgtaatgaagtt

SEQ ID NO: 5507499 - DNA, 12 bp, Homo sapiens
taatgaatgact

SEQ ID NO: 5507500 - DNA, 18 bp, Homo sapiens
taatgaatgcttaaagaa

SEQ ID NO: 5507501 - DNA, 20 bp, Homo sapiens
taatgaatgcttaaagaatt

SEQ ID NO: 5507502 - DNA, 23 bp, Homo sapiens
taatgaatgcttaaagaattcaa

SEQ ID NO: 5507503 - DNA, 16 bp, Homo sapiens
taatgaattataacag

SEQ ID NO: 5507504 - DNA, 17 bp, Homo sapiens
taatgaatttaaggcaa

SEQ ID NO: 5507505 - DNA, 21 bp, Homo sapiens
taatgaatttaaggcaaaaaa

SEQ ID NO: 5507506 - DNA, 18 bp, Homo sapiens
taatgaattttatgtgac

SEQ ID NO: 5507507 - DNA, 13 bp, Homo sapiens
taatgacaaaaga

SEQ ID NO: 5507508 - DNA, 13 bp, Homo sapiens
taatgacaacaaa

SEQ ID NO: 5507509 - DNA, 22 bp, Homo sapiens
taatgacaacacttaatagcaa

SEQ ID NO: 5507510 - DNA, 16 bp, Homo sapiens
taatgacaattcagag

SEQ ID NO: 5507511 - DNA, 16 bp, Homo sapiens
taatgacacaccttgg

SEQ ID NO: 5507512 - DNA, 14 bp, Homo sapiens
taatgacacggtag

SEQ ID NO: 5507513 - DNA, 19 bp, Homo sapiens
taatgacactgtttcctga

SEQ ID NO: 5507514 - DNA, 14 bp, Homo sapiens
taatgacacttctt

SEQ ID NO: 5507515 - DNA, 15 bp, Homo sapiens
taatgacacttgtcc

SEQ ID NO: 5507516 - DNA, 17 bp, Homo sapiens
taatgacagatggtgaa

SEQ ID NO: 5507517 - DNA, 20 bp, Homo sapiens
taatgacaggcctgtccaac

SEQ ID NO: 5507518 - DNA, 20 bp, Homo sapiens
taatgaccaacctgtttcta

SEQ ID NO: 5507519 - DNA, 18 bp, Homo sapiens
taatgaccaattgagtaa

SEQ ID NO: 5507520 - DNA, 14 bp, Homo sapiens
taatgaccatgaaa

SEQ ID NO: 5507521 - DNA, 16 bp, Homo sapiens
taatgaccatgaaaga

SEQ ID NO: 5507522 - DNA, 14 bp, Homo sapiens
taatgacgaggaac

SEQ ID NO: 5507523 - DNA, 17 bp, Homo sapiens
taatgacgtattgtgaa

SEQ ID NO: 5507524 - DNA, 19 bp, Homo sapiens
taatgacgtattgtgaaat

SEQ ID NO: 5507525 - DNA, 15 bp, Homo sapiens
taatgacgtgtgtgg

SEQ ID NO: 5507526 - DNA, 22 bp, Homo sapiens
taatgactctttctgaaggaag

SEQ ID NO: 5507527 - DNA, 23 bp, Homo sapiens
taatgactggtcttccttacctg

SEQ ID NO: 5507528 - DNA, 15 bp, Homo sapiens
taatgacttaagcac

SEQ ID NO: 5507529 - DNA, 17 bp, Homo sapiens
taatgacttttaaaatt

SEQ ID NO: 5507530 - DNA, 17 bp, Homo sapiens
taatgacttttgaatta

SEQ ID NO: 5507531 - DNA, 14 bp, Homo sapiens
taatgagaatagaa

SEQ ID NO: 5507532 - DNA, 15 bp, Homo sapiens
taatgagaatagaaa

SEQ ID NO: 5507533 - DNA, 18 bp, Homo sapiens
taatgagagtgcactgct

SEQ ID NO: 5507534 - DNA, 20 bp, Homo sapiens
taatgagcagcccctcccag

SEQ ID NO: 5507535 - DNA, 12 bp, Homo sapiens
taatgagccatc

SEQ ID NO: 5507536 - DNA, 19 bp, Homo sapiens
taatgagctattaaaactc

SEQ ID NO: 5507537 - DNA, 17 bp, Homo sapiens
taatgaggaaaaaatgg

SEQ ID NO: 5507538 - DNA, 18 bp, Homo sapiens
taatgaggaaaaaatggt

SEQ ID NO: 5507539 - DNA, 16 bp, Homo sapiens
taatgaggatgattat

SEQ ID NO: 5507540 - DNA, 17 bp, Homo sapiens
taatgagggaaatctgt

SEQ ID NO: 5507541 - DNA, 15 bp, Homo sapiens
taatgagggctgagt

SEQ ID NO: 5507542 - DNA, 21 bp, Homo sapiens
taatgaggtctttaaaccttt

SEQ ID NO: 5507543 - DNA, 19 bp, Homo sapiens
taatgaggtggtactatga

SEQ ID NO: 5507544 - DNA, 15 bp, Homo sapiens
taatgagtatatgta

SEQ ID NO: 5507545 - DNA, 18 bp, Homo sapiens
taatgagtatatgtaaca

SEQ ID NO: 5507546 - DNA, 15 bp, Homo sapiens
taatgagtatgaact

SEQ ID NO: 5507547 - DNA, 14 bp, Homo sapiens
taatgagtatttgg

SEQ ID NO: 5507548 - DNA, 16 bp, Homo sapiens
taatgagtgcacctgc

SEQ ID NO: 5507549 - DNA, 17 bp, Homo sapiens
taatgagttgctggaaa

SEQ ID NO: 5507550 - DNA, 18 bp, Homo sapiens
taatgagttgctggaaaa

SEQ ID NO: 5507551 - DNA, 13 bp, Homo sapiens
taatgataaaata

SEQ ID NO: 5507552 - DNA, 15 bp, Homo sapiens
taatgatactgatta

SEQ ID NO: 5507553 - DNA, 22 bp, Homo sapiens
taatgatactgtctaagaataa

SEQ ID NO: 5507554 - DNA, 16 bp, Homo sapiens
taatgatactgtgtgt

SEQ ID NO: 5507555 - DNA, 22 bp, Homo sapiens
taatgatcaacaatttaatgta

SEQ ID NO: 5507556 - DNA, 13 bp, Homo sapiens
taatgatctaaga

SEQ ID NO: 5507557 - DNA, 19 bp, Homo sapiens
taatgatgaaatctttctt

SEQ ID NO: 5507558 - DNA, 16 bp, Homo sapiens
taatgatgaacttata

SEQ ID NO: 5507559 - DNA, 14 bp, Homo sapiens
taatgatgagcatt

SEQ ID NO: 5507560 - DNA, 17 bp, Homo sapiens
taatgatggatttaaca

SEQ ID NO: 5507561 - DNA, 14 bp, Homo sapiens
taatgatgtaacag

SEQ ID NO: 5507562 - DNA, 18 bp, Homo sapiens
taatgatgtgtcatatga

SEQ ID NO: 5507563 - DNA, 16 bp, Homo sapiens
taatgatgttgataat

SEQ ID NO: 5507564 - DNA, 19 bp, Homo sapiens
taatgatgttgataatttc

SEQ ID NO: 5507565 - DNA, 11 bp, Homo sapiens
taatgatgttt

SEQ ID NO: 5507566 - DNA, 19 bp, Homo sapiens
taatgattaagggacattt

SEQ ID NO: 5507567 - DNA, 21 bp, Homo sapiens
taatgattaagggacatttct

SEQ ID NO: 5507568 - DNA, 23 bp, Homo sapiens
taatgattatataaaatacataa

SEQ ID NO: 5507569 - DNA, 16 bp, Homo sapiens
taatgattcaaatgtt

SEQ ID NO: 5507570 - DNA, 21 bp, Homo sapiens
taatgattcaaatgttttaaa

SEQ ID NO: 5507571 - DNA, 14 bp, Homo sapiens
taatgattcataag

SEQ ID NO: 5507572 - DNA, 16 bp, Homo sapiens
taatgatttgctcttt

SEQ ID NO: 5507573 - DNA, 20 bp, Homo sapiens
taatgatttgctctttgaca

SEQ ID NO: 5507574 - DNA, 22 bp, Homo sapiens
taatgatttgtgtccatttcaa

SEQ ID NO: 5507575 - DNA, 21 bp, Homo sapiens
taatgcaaaatttttttaatc

SEQ ID NO: 5507576 - DNA, 14 bp, Homo sapiens
taatgcaaagaatc

SEQ ID NO: 5507577 - DNA, 22 bp, Homo sapiens
taatgcaagagaacattttact

SEQ ID NO: 5507578 - DNA, 22 bp, Homo sapiens
taatgcaatgataaataaagtc

SEQ ID NO: 5507579 - DNA, 11 bp, Homo sapiens
taatgcacaat

SEQ ID NO: 5507580 - DNA, 12 bp, Homo sapiens
taatgcacaatt

SEQ ID NO: 5507581 - DNA, 21 bp, Homo sapiens
taatgcacaatttagaaaaca

SEQ ID NO: 5507582 - DNA, 15 bp, Homo sapiens
taatgcacagtgcat

SEQ ID NO: 5507583 - DNA, 17 bp, Homo sapiens
taatgcactcctgcccc

SEQ ID NO: 5507584 - DNA, 23 bp, Homo sapiens
taatgcactcctgccccggccca

SEQ ID NO: 5507585 - DNA, 14 bp, Homo sapiens
taattccttcagca

SEQ ID NO: 5507586 - DNA, 18 bp, Homo sapiens
taattcgagcaaacaact

SEQ ID NO: 5507587 - DNA, 18 bp, Homo sapiens
taattctaaacttagaaa

SEQ ID NO: 5507588 - DNA, 12 bp, Homo sapiens
taattctaaagg

SEQ ID NO: 5507589 - DNA, 23 bp, Homo sapiens
taattctaaccagagcaagcttt

SEQ ID NO: 5507590 - DNA, 21 bp, Homo sapiens
taattctaagttatttacttt

SEQ ID NO: 5507591 - DNA, 16 bp, Homo sapiens
taattctactaaatat

SEQ ID NO: 5507592 - DNA, 12 bp, Homo sapiens
taattctatact

SEQ ID NO: 5507593 - DNA, 15 bp, Homo sapiens
taattctatgcctgt

SEQ ID NO: 5507594 - DNA, 23 bp, Homo sapiens
taattctattaaagtgctaaggt

SEQ ID NO: 5507595 - DNA, 20 bp, Homo sapiens
taattctcagccatgtgctt

SEQ ID NO: 5507596 - DNA, 12 bp, Homo sapiens
taattctcaggc

SEQ ID NO: 5507597 - DNA, 18 bp, Homo sapiens
taattctcattaaaagaa

SEQ ID NO: 5507598 - DNA, 19 bp, Homo sapiens
taattctcattatgaagat

SEQ ID NO: 5507599 - DNA, 14 bp, Homo sapiens
taattctcatttgt

SEQ ID NO: 5507600 - DNA, 22 bp, Homo sapiens
taattctccctaaggaatctga

SEQ ID NO: 5507601 - DNA, 23 bp, Homo sapiens
taattctccctaaggaatctgaa

SEQ ID NO: 5507602 - DNA, 13 bp, Homo sapiens
taattctccttcc

SEQ ID NO: 5507603 - DNA, 13 bp, Homo sapiens
taattctctgcaa

SEQ ID NO: 5507604 - DNA, 17 bp, Homo sapiens
taattctgaagttatat

SEQ ID NO: 5507605 - DNA, 19 bp, Homo sapiens
taattctgaagttatattt

SEQ ID NO: 5507606 - DNA, 20 bp, Homo sapiens
taattctgaagttatatttc

SEQ ID NO: 5507607 - DNA, 19 bp, Homo sapiens
taattctgacgtcagcgca

SEQ ID NO: 5507608 - DNA, 20 bp, Homo sapiens
taattctgataaacctgtct

SEQ ID NO: 5507609 - DNA, 13 bp, Homo sapiens
taattctgcctta

SEQ ID NO: 5507610 - DNA, 22 bp, Homo sapiens
taattctgcttgtgacattaaa

SEQ ID NO: 5507611 - DNA, 12 bp, Homo sapiens
taattctgtaaa

SEQ ID NO: 5507612 - DNA, 13 bp, Homo sapiens
taattctgtaaat

SEQ ID NO: 5507613 - DNA, 21 bp, Homo sapiens
taattctgtacatagcctata

SEQ ID NO: 5507614 - DNA, 14 bp, Homo sapiens
taattcttaaaact

SEQ ID NO: 5507615 - DNA, 16 bp, Homo sapiens
taattcttaaaactat

SEQ ID NO: 5507616 - DNA, 15 bp, Homo sapiens
taattcttaagtctt

SEQ ID NO: 5507617 - DNA, 15 bp, Homo sapiens
taattcttacctcat

SEQ ID NO: 5507618 - DNA, 21 bp, Homo sapiens
taattcttacctcatttgcat

SEQ ID NO: 5507619 - DNA, 18 bp, Homo sapiens
taattcttagctcattct

SEQ ID NO: 5507620 - DNA, 17 bp, Homo sapiens
taattcttatgactaaa

SEQ ID NO: 5507621 - DNA, 14 bp, Homo sapiens
taattcttattcca

SEQ ID NO: 5507622 - DNA, 14 bp, Homo sapiens
taattcttattctt

SEQ ID NO: 5507623 - DNA, 14 bp, Homo sapiens
taattcttatttct

SEQ ID NO: 5507624 - DNA, 18 bp, Homo sapiens
taattcttattttgtgga

SEQ ID NO: 5507625 - DNA, 19 bp, Homo sapiens
taattcttcacctttgtaa

SEQ ID NO: 5507626 - DNA, 23 bp, Homo sapiens
taattcttcagcgtaaaatggtg

SEQ ID NO: 5507627 - DNA, 14 bp, Homo sapiens
taattcttcattat

SEQ ID NO: 5507628 - DNA, 15 bp, Homo sapiens
taattcttgcatatt

SEQ ID NO: 5507629 - DNA, 15 bp, Homo sapiens
taattcttgtatatt

SEQ ID NO: 5507630 - DNA, 20 bp, Homo sapiens
taattctttatcacatgttg

SEQ ID NO: 5507631 - DNA, 20 bp, Homo sapiens
taattctttcaatacagata

SEQ ID NO: 5507632 - DNA, 18 bp, Homo sapiens
taattctttctattttca

SEQ ID NO: 5507633 - DNA, 21 bp, Homo sapiens
taattctttctattttcacaa

SEQ ID NO: 5507634 - DNA, 15 bp, Homo sapiens
taattctttctgtct

SEQ ID NO: 5507635 - DNA, 18 bp, Homo sapiens
taattctttgataagatg

SEQ ID NO: 5507636 - DNA, 13 bp, Homo sapiens
taattctttgcaa

SEQ ID NO: 5507637 - DNA, 16 bp, Homo sapiens
taattctttgtttcct

SEQ ID NO: 5507638 - DNA, 15 bp, Homo sapiens
taattcttttcaaaa

SEQ ID NO: 5507639 - DNA, 19 bp, Homo sapiens
taattcttttttattaatc

SEQ ID NO: 5507640 - DNA, 20 bp, Homo sapiens
taattcttttttattaatca

SEQ ID NO: 5507641 - DNA, 16 bp, Homo sapiens
taattgaaactagtta

SEQ ID NO: 5507642 - DNA, 22 bp, Homo sapiens
taattgaaagggacaagtatca

SEQ ID NO: 5507643 - DNA, 14 bp, Homo sapiens
taattgaaagtata

SEQ ID NO: 5507644 - DNA, 22 bp, Homo sapiens
taattgaaatttaaaaataaag

SEQ ID NO: 5507645 - DNA, 15 bp, Homo sapiens
taattgaacaataaa

SEQ ID NO: 5507646 - DNA, 16 bp, Homo sapiens
taattgaacaataaag

SEQ ID NO: 5507647 - DNA, 22 bp, Homo sapiens
taattgaaggaaagatttgtac

SEQ ID NO: 5507648 - DNA, 22 bp, Homo sapiens
taattgaagtgtataatataaa

SEQ ID NO: 5507649 - DNA, 22 bp, Homo sapiens
taattgaattttcaagcatctc

SEQ ID NO: 5507650 - DNA, 23 bp, Homo sapiens
taattgacggttttttattattg

SEQ ID NO: 5507651 - DNA, 13 bp, Homo sapiens
taattgactgaaa

SEQ ID NO: 5507652 - DNA, 20 bp, Homo sapiens
taattgacttgcaaagacct

SEQ ID NO: 5507653 - DNA, 15 bp, Homo sapiens
taattgagactgaaa

SEQ ID NO: 5507654 - DNA, 22 bp, Homo sapiens
taattgagccttttattaacat

SEQ ID NO: 5507655 - DNA, 22 bp, Homo sapiens
taattgatagcaggtgtaataa

SEQ ID NO: 5507656 - DNA, 19 bp, Homo sapiens
taattgatcaaattcattt

SEQ ID NO: 5507657 - DNA, 13 bp, Homo sapiens
taattgattaaaa

SEQ ID NO: 5507658 - DNA, 18 bp, Homo sapiens
taattgattaaaatctct

SEQ ID NO: 5507659 - DNA, 18 bp, Homo sapiens
taattgattaaactgtat

SEQ ID NO: 5507660 - DNA, 21 bp, Homo sapiens
taattgattaaactgtatgtc

SEQ ID NO: 5507661 - DNA, 22 bp, Homo sapiens
taattgattaaactgtatgtct

SEQ ID NO: 5507662 - DNA, 23 bp, Homo sapiens
taattgatttgacccactcacac

SEQ ID NO: 5507663 - DNA, 15 bp, Homo sapiens
taattgcaacaatgc

SEQ ID NO: 5507664 - DNA, 17 bp, Homo sapiens
taattgcaacaatgcaa

SEQ ID NO: 5507665 - DNA, 16 bp, Homo sapiens
taattgcaagtctgcc

SEQ ID NO: 5507666 - DNA, 19 bp, Homo sapiens
taattgcactttttaagtt

SEQ ID NO: 5507667 - DNA, 18 bp, Homo sapiens
taattgcatctcaaaatt

SEQ ID NO: 5507668 - DNA, 14 bp, Homo sapiens
taattgcatgaaaa

SEQ ID NO: 5507669 - DNA, 22 bp, Homo sapiens
taattgcatgaaaatagctatt

SEQ ID NO: 5507670 - DNA, 13 bp, Homo sapiens
taattgcattcat

SEQ ID NO: 5507671 - DNA, 17 bp, Homo sapiens
taattgcattgactttc

SEQ ID NO: 5507672 - DNA, 18 bp, Homo sapiens
taattgcatttctgctct

SEQ ID NO: 5507673 - DNA, 16 bp, Homo sapiens
taattgccaaatacct

SEQ ID NO: 5507674 - DNA, 14 bp, Homo sapiens
taattgccacctct

SEQ ID NO: 5507675 - DNA, 23 bp, Homo sapiens
taattgccactgagagatctgct

SEQ ID NO: 5507676 - DNA, 17 bp, Homo sapiens
taattgccagcttttat

SEQ ID NO: 5507677 - DNA, 12 bp, Homo sapiens
taattgctgcaa

SEQ ID NO: 5507678 - DNA, 21 bp, Homo sapiens
taattgctggagactacaatt

SEQ ID NO: 5507679 - DNA, 22 bp, Homo sapiens
taattgctgtgtgtcccaggca

SEQ ID NO: 5507680 - DNA, 14 bp, Homo sapiens
taattgctgttgaa

SEQ ID NO: 5507681 - DNA, 18 bp, Homo sapiens
taattgctgttgaaagca

SEQ ID NO: 5507682 - DNA, 23 bp, Homo sapiens
taattgcttacatttttacaata

SEQ ID NO: 5507683 - DNA, 20 bp, Homo sapiens
taattgcttatttattgtat

SEQ ID NO: 5507684 - DNA, 22 bp, Homo sapiens
taattgcttatttattgtattc

SEQ ID NO: 5507685 - DNA, 22 bp, Homo sapiens
taattgctttcctgcctccttg

SEQ ID NO: 5507686 - DNA, 17 bp, Homo sapiens
taattgctttgccaaaa

SEQ ID NO: 5507687 - DNA, 16 bp, Homo sapiens
taattggaagtgcagt

SEQ ID NO: 5507688 - DNA, 14 bp, Homo sapiens
taattggactttta

SEQ ID NO: 5507689 - DNA, 14 bp, Homo sapiens
taattggatgttca

SEQ ID NO: 5507690 - DNA, 17 bp, Homo sapiens
taattggatttcctaat

SEQ ID NO: 5507691 - DNA, 12 bp, Homo sapiens
taattggcagca

SEQ ID NO: 5507692 - DNA, 21 bp, Homo sapiens
taattggcagcacccactcag

SEQ ID NO: 5507693 - DNA, 16 bp, Homo sapiens
taattgggaactgaaa

SEQ ID NO: 5507694 - DNA, 20 bp, Homo sapiens
taattgggattttaaaaaca

SEQ ID NO: 5507695 - DNA, 18 bp, Homo sapiens
taattgggtcatagaaat

SEQ ID NO: 5507696 - DNA, 12 bp, Homo sapiens
taattgggtgac

SEQ ID NO: 5507697 - DNA, 24 bp, Homo sapiens
taattggtctaccaagtaagacat

SEQ ID NO: 5507698 - DNA, 16 bp, Homo sapiens
taattggtttaaagtc

SEQ ID NO: 5507699 - DNA, 18 bp, Homo sapiens
taattggtttagttctta

SEQ ID NO: 5507700 - DNA, 15 bp, Homo sapiens
taattggttttatgc

SEQ ID NO: 5507701 - DNA, 13 bp, Homo sapiens
taattgtaaactg

SEQ ID NO: 5507702 - DNA, 16 bp, Homo sapiens
taattgtaaactgtac

SEQ ID NO: 5507703 - DNA, 18 bp, Homo sapiens
taattgtaaactgtacta

SEQ ID NO: 5507704 - DNA, 16 bp, Homo sapiens
taattgtaaaggtgat

SEQ ID NO: 5507705 - DNA, 17 bp, Homo sapiens
taattgtaaatattttg

SEQ ID NO: 5507706 - DNA, 23 bp, Homo sapiens
taattgtacaaaattaagcaaat

SEQ ID NO: 5507707 - DNA, 14 bp, Homo sapiens
taattgtacaataa

SEQ ID NO: 5507708 - DNA, 15 bp, Homo sapiens
taattgtacaataaa

SEQ ID NO: 5507709 - DNA, 16 bp, Homo sapiens
taattgtacaataaat

SEQ ID NO: 5507710 - DNA, 22 bp, Homo sapiens
taattgtactaaagccaaacat

SEQ ID NO: 5507711 - DNA, 14 bp, Homo sapiens
taattgtactgtgt

SEQ ID NO: 5507712 - DNA, 15 bp, Homo sapiens
taattgtactttgaa

SEQ ID NO: 5507713 - DNA, 12 bp, Homo sapiens
taattgtataaa

SEQ ID NO: 5507714 - DNA, 17 bp, Homo sapiens
taattgtataaaacagt

SEQ ID NO: 5507715 - DNA, 16 bp, Homo sapiens
taattgtataacaggt

SEQ ID NO: 5507716 - DNA, 17 bp, Homo sapiens
taattgtataacaggtt

SEQ ID NO: 5507717 - DNA, 19 bp, Homo sapiens
taattgtatctacattaaa

SEQ ID NO: 5507718 - DNA, 20 bp, Homo sapiens
taattgtatctacattaaaa

SEQ ID NO: 5507719 - DNA, 15 bp, Homo sapiens
taattgtcagtgatt

SEQ ID NO: 5507720 - DNA, 22 bp, Homo sapiens
taattgtcatgactttcagatt

SEQ ID NO: 5507721 - DNA, 14 bp, Homo sapiens
taattgtcatggtt

SEQ ID NO: 5507722 - DNA, 12 bp, Homo sapiens
taattgtcatta

SEQ ID NO: 5507723 - DNA, 21 bp, Homo sapiens
taattgtcctgtgtctatgta

SEQ ID NO: 5507724 - DNA, 14 bp, Homo sapiens
taattgtctctgag

SEQ ID NO: 5507725 - DNA, 21 bp, Homo sapiens
taattgtgaaaaagttaaaca

SEQ ID NO: 5507726 - DNA, 21 bp, Homo sapiens
taattgtgcaaaggataaatt

SEQ ID NO: 5507727 - DNA, 12 bp, Homo sapiens
taattgtgcccc

SEQ ID NO: 5507728 - DNA, 13 bp, Homo sapiens
taattgtgcccct

SEQ ID NO: 5507729 - DNA, 14 bp, Homo sapiens
taattgtggagagg

SEQ ID NO: 5507730 - DNA, 14 bp, Homo sapiens
taattgtggattaa

SEQ ID NO: 5507731 - DNA, 17 bp, Homo sapiens
taattgtggattaatgt

SEQ ID NO: 5507732 - DNA, 17 bp, Homo sapiens
taattgtggctttatga

SEQ ID NO: 5507733 - DNA, 22 bp, Homo sapiens
taattgtgtaaaaaatggaaaa

SEQ ID NO: 5507734 - DNA, 18 bp, Homo sapiens
taattgtgtaactgttct

SEQ ID NO: 5507735 - DNA, 12 bp, Homo sapiens
taattgtgtaca

SEQ ID NO: 5507736 - DNA, 13 bp, Homo sapiens
taattgtgtatat

SEQ ID NO: 5507737 - DNA, 16 bp, Homo sapiens
taattgtgtatatgtt

SEQ ID NO: 5507738 - DNA, 16 bp, Homo sapiens
taattgtgtttacatt

SEQ ID NO: 5507739 - DNA, 17 bp, Homo sapiens
taattgtgtttacattt

SEQ ID NO: 5507740 - DNA, 20 bp, Homo sapiens
taattgttaagatatgatgt

SEQ ID NO: 5507741 - DNA, 16 bp, Homo sapiens
taattgttacaatttt

SEQ ID NO: 5507742 - DNA, 18 bp, Homo sapiens
taattgttccctatgaaa

SEQ ID NO: 5507743 - DNA, 17 bp, Homo sapiens
taattgttccttgcttt

SEQ ID NO: 5507744 - DNA, 16 bp, Homo sapiens
taattgttctcagaat

SEQ ID NO: 5507745 - DNA, 15 bp, Homo sapiens
taattgttctgcttt

SEQ ID NO: 5507746 - DNA, 18 bp, Homo sapiens
taattgttgaaattttgc

SEQ ID NO: 5507747 - DNA, 22 bp, Homo sapiens
taattgttgaaattttgcaaat

SEQ ID NO: 5507748 - DNA, 18 bp, Homo sapiens
taattgttggagtattta

SEQ ID NO: 5507749 - DNA, 13 bp, Homo sapiens
taattgttgtgtg

SEQ ID NO: 5507750 - DNA, 14 bp, Homo sapiens
taattgttgttctg

SEQ ID NO: 5507751 - DNA, 18 bp, Homo sapiens
taattgttgttctgttaa

SEQ ID NO: 5507752 - DNA, 19 bp, Homo sapiens
taattgttgttctgttaac

SEQ ID NO: 5507753 - DNA, 14 bp, Homo sapiens
taattgttgtttct

SEQ ID NO: 5507754 - DNA, 15 bp, Homo sapiens
taattgttgtttgta

SEQ ID NO: 5507755 - DNA, 22 bp, Homo sapiens
taattgttgtttgtatgtataa

SEQ ID NO: 5507756 - DNA, 20 bp, Homo sapiens
taattgtttataaaacaatg

SEQ ID NO: 5507757 - DNA, 16 bp, Homo sapiens
taattgtttcaaaaaa

SEQ ID NO: 5507758 - DNA, 15 bp, Homo sapiens
taattgtttcagaat

SEQ ID NO: 5507759 - DNA, 12 bp, Homo sapiens
taattgttttgc

SEQ ID NO: 5507760 - DNA, 18 bp, Homo sapiens
taattgttttgcactttt

SEQ ID NO: 5507761 - DNA, 18 bp, Homo sapiens
taattgttttggaataaa

SEQ ID NO: 5507762 - DNA, 19 bp, Homo sapiens
taattgttttttaaagcaa

SEQ ID NO: 5507763 - DNA, 13 bp, Homo sapiens
tacaaaaagaaga

SEQ ID NO: 5507764 - DNA, 14 bp, Homo sapiens
tacaaaaagaagag

SEQ ID NO: 5507765 - DNA, 16 bp, Homo sapiens
tacaaaaagcaaaaat

SEQ ID NO: 5507766 - DNA, 20 bp, Homo sapiens
tacaaaaagcataaaaatta

SEQ ID NO: 5507767 - DNA, 18 bp, Homo sapiens
tacaaaaaggtataaata

SEQ ID NO: 5507768 - DNA, 20 bp, Homo sapiens
tacaaaaaggtataaataat

SEQ ID NO: 5507769 - DNA, 19 bp, Homo sapiens
tacaaaaagtaaaaattaa

SEQ ID NO: 5507770 - DNA, 13 bp, Homo sapiens
tacaaaaatagta

SEQ ID NO: 5507771 - DNA, 23 bp, Homo sapiens
tacaaaaatcccaaattcacttt

SEQ ID NO: 5507772 - DNA, 13 bp, Homo sapiens
tacaaaaatggga

SEQ ID NO: 5507773 - DNA, 16 bp, Homo sapiens
tacaaaaatgggaaaa

SEQ ID NO: 5507774 - DNA, 18 bp, Homo sapiens
tacaaaaattagccggac

SEQ ID NO: 5507775 - DNA, 19 bp, Homo sapiens
tacaaaaattagccgggca

SEQ ID NO: 5507776 - DNA, 20 bp, Homo sapiens
tacaaaaattatgcaattca

SEQ ID NO: 5507777 - DNA, 22 bp, Homo sapiens
tacaaaaatttgccaggcgtgg

SEQ ID NO: 5507778 - DNA, 22 bp, Homo sapiens
tacaaaacaaactcattcatta

SEQ ID NO: 5507779 - DNA, 11 bp, Homo sapiens
tacaaaacaat

SEQ ID NO: 5507780 - DNA, 19 bp, Homo sapiens
tacaaaacctatttttcct

SEQ ID NO: 5507781 - DNA, 17 bp, Homo sapiens
tacaaaacgcgcagatg

SEQ ID NO: 5507782 - DNA, 17 bp, Homo sapiens
tacaaaactatcctatg

SEQ ID NO: 5507783 - DNA, 13 bp, Homo sapiens
tacaaaactgcca

SEQ ID NO: 5507784 - DNA, 22 bp, Homo sapiens
tacaaaactgctttgtgcatat

SEQ ID NO: 5507785 - DNA, 23 bp, Homo sapiens
tacaaaactgctttgtgcatatg

SEQ ID NO: 5507786 - DNA, 19 bp, Homo sapiens
tacaaaagagcatggatgc

SEQ ID NO: 5507787 - DNA, 12 bp, Homo sapiens
tacaaaagcttg

SEQ ID NO: 5507788 - DNA, 13 bp, Homo sapiens
tacaaaaggctcc

SEQ ID NO: 5507789 - DNA, 18 bp, Homo sapiens
tacaaaagggacatgaaa

SEQ ID NO: 5507790 - DNA, 15 bp, Homo sapiens
tacaaaagtaccata

SEQ ID NO: 5507791 - DNA, 11 bp, Homo sapiens
tacaaaataaa

SEQ ID NO: 5507792 - DNA, 18 bp, Homo sapiens
tacaaaataaagttacat

SEQ ID NO: 5507793 - DNA, 19 bp, Homo sapiens
tacaaaataaagttacatt

SEQ ID NO: 5507794 - DNA, 17 bp, Homo sapiens
tacaaaataatttaact

SEQ ID NO: 5507795 - DNA, 22 bp, Homo sapiens
tacaaaatacagggattactgg

SEQ ID NO: 5507796 - DNA, 16 bp, Homo sapiens
tacaaaatgaattgcc

SEQ ID NO: 5507797 - DNA, 13 bp, Homo sapiens
tacaaaatgattt

SEQ ID NO: 5507798 - DNA, 10 bp, Homo sapiens
tacaaaatgg

SEQ ID NO: 5507799 - DNA, 11 bp, Homo sapiens
tacaaaatgga

SEQ ID NO: 5507800 - DNA, 15 bp, Homo sapiens
tacaaaatgtaactg

SEQ ID NO: 5507801 - DNA, 14 bp, Homo sapiens
tacaaaatgtgtgc

SEQ ID NO: 5507802 - DNA, 23 bp, Homo sapiens
tacaaaattaagcaaatgttaaa

SEQ ID NO: 5507803 - DNA, 17 bp, Homo sapiens
tacaaaattagccaggt

SEQ ID NO: 5507804 - DNA, 15 bp, Homo sapiens
tacaaaatttattct

SEQ ID NO: 5507805 - DNA, 18 bp, Homo sapiens
tacaaacaaaatttctat

SEQ ID NO: 5507806 - DNA, 20 bp, Homo sapiens
tacaaacaaaggatttgaaa

SEQ ID NO: 5507807 - DNA, 14 bp, Homo sapiens
tacaaacaagcata

SEQ ID NO: 5507808 - DNA, 20 bp, Homo sapiens
tacaaacaagcatataaaat

SEQ ID NO: 5507809 - DNA, 18 bp, Homo sapiens
tacaaacaataagaacaa

SEQ ID NO: 5507810 - DNA, 15 bp, Homo sapiens
tacaaacaatctctt

SEQ ID NO: 5507811 - DNA, 12 bp, Homo sapiens
tacaaacaatgg

SEQ ID NO: 5507812 - DNA, 22 bp, Homo sapiens
tacaaacaatggaaactgaatg

SEQ ID NO: 5507813 - DNA, 15 bp, Homo sapiens
tacaaacaggtgcta

SEQ ID NO: 5507814 - DNA, 15 bp, Homo sapiens
tacaaacatatttgt

SEQ ID NO: 5507815 - DNA, 13 bp, Homo sapiens
tacaaacatgaaa

SEQ ID NO: 5507816 - DNA, 14 bp, Homo sapiens
tacaaacatggaaa

SEQ ID NO: 5507817 - DNA, 23 bp, Homo sapiens
tacaaacatggaaaacagagtat

SEQ ID NO: 5507818 - DNA, 16 bp, Homo sapiens
tacaaacatttaagct

SEQ ID NO: 5507819 - DNA, 14 bp, Homo sapiens
tacaaacatttcac

SEQ ID NO: 5507820 - DNA, 22 bp, Homo sapiens
tacaaacatttcacttctccaa

SEQ ID NO: 5507821 - DNA, 19 bp, Homo sapiens
tacaaaccattacctgtac

SEQ ID NO: 5507822 - DNA, 13 bp, Homo sapiens
tacaaacctacca

SEQ ID NO: 5507823 - DNA, 19 bp, Homo sapiens
tacaaactaactaataaaa

SEQ ID NO: 5507824 - DNA, 16 bp, Homo sapiens
tacaaactaaggtgct

SEQ ID NO: 5507825 - DNA, 16 bp, Homo sapiens
tacaaactatttcaga

SEQ ID NO: 5507826 - DNA, 15 bp, Homo sapiens
tacaaactgaagagt

SEQ ID NO: 5507827 - DNA, 13 bp, Homo sapiens
tacaaactgcaat

SEQ ID NO: 5507828 - DNA, 13 bp, Homo sapiens
tacaaacttttaa

SEQ ID NO: 5507829 - DNA, 16 bp, Homo sapiens
tacaaacttttaagat

SEQ ID NO: 5507830 - DNA, 19 bp, Homo sapiens
tacaaacttttataaatgt

SEQ ID NO: 5507831 - DNA, 15 bp, Homo sapiens
tacaaagaaaaatta

SEQ ID NO: 5507832 - DNA, 16 bp, Homo sapiens
tacaaagaaaaattaa

SEQ ID NO: 5507833 - DNA, 13 bp, Homo sapiens
tacaaagaaaata

SEQ ID NO: 5507834 - DNA, 21 bp, Homo sapiens
tacaaagaaacaaaatataaa

SEQ ID NO: 5507835 - DNA, 15 bp, Homo sapiens
tacaaagaaactttt

SEQ ID NO: 5507836 - DNA, 21 bp, Homo sapiens
tacaaagaaagcacttcttat

SEQ ID NO: 5507837 - DNA, 19 bp, Homo sapiens
tacaaagaaccatgcagga

SEQ ID NO: 5507838 - DNA, 21 bp, Homo sapiens
tacaaagaaccatgcaggaag

SEQ ID NO: 5507839 - DNA, 14 bp, Homo sapiens
tacaaagaagacat

SEQ ID NO: 5507840 - DNA, 22 bp, Homo sapiens
tacaaagaagacatgttttaga

SEQ ID NO: 5507841 - DNA, 20 bp, Homo sapiens
tacaaagagaagcaaagtgg

SEQ ID NO: 5507842 - DNA, 18 bp, Homo sapiens
tacaaagagatgcttgga

SEQ ID NO: 5507843 - DNA, 16 bp, Homo sapiens
tacaaagcgtgcacaa

SEQ ID NO: 5507844 - DNA, 21 bp, Homo sapiens
tacaaagcgtttctttacttc

SEQ ID NO: 5507845 - DNA, 15 bp, Homo sapiens
tacaaagctgtcact

SEQ ID NO: 5507846 - DNA, 16 bp, Homo sapiens
tacaaagctttgctac

SEQ ID NO: 5507847 - DNA, 17 bp, Homo sapiens
tacaaaggctgtattca

SEQ ID NO: 5507848 - DNA, 17 bp, Homo sapiens
tacaaagggaaagcctc

SEQ ID NO: 5507849 - DNA, 23 bp, Homo sapiens
tacaaagggaagcagagcctggg

SEQ ID NO: 5507850 - DNA, 18 bp, Homo sapiens
tacaaaggggaaagaaca

SEQ ID NO: 5507851 - DNA, 19 bp, Homo sapiens
tacaaagggtctatcttgt

SEQ ID NO: 5507852 - DNA, 23 bp, Homo sapiens
tacaaagggtctatcttgtaaat

SEQ ID NO: 5507853 - DNA, 20 bp, Homo sapiens
tacaaaggtgctaattaata

SEQ ID NO: 5507854 - DNA, 15 bp, Homo sapiens
tacaaaggttccatt

SEQ ID NO: 5507855 - DNA, 15 bp, Homo sapiens
tacaaaggtttaaat

SEQ ID NO: 5507856 - DNA, 16 bp, Homo sapiens
tacaaagtaaaaataa

SEQ ID NO: 5507857 - DNA, 20 bp, Homo sapiens
tacaaagtaaaatgaacatt

SEQ ID NO: 5507858 - DNA, 22 bp, Homo sapiens
tacaaagtaaatacaagactgt

SEQ ID NO: 5507859 - DNA, 19 bp, Homo sapiens
tacaaagtactgtcctcaa

SEQ ID NO: 5507860 - DNA, 18 bp, Homo sapiens
tacaaagtagaagtctta

SEQ ID NO: 5507861 - DNA, 14 bp, Homo sapiens
tacaaagtagagaa

SEQ ID NO: 5507862 - DNA, 15 bp, Homo sapiens
tacaaagtagagaag

SEQ ID NO: 5507863 - DNA, 17 bp, Homo sapiens
tacaaagtagagaagta

SEQ ID NO: 5507864 - DNA, 18 bp, Homo sapiens
tacaaagtagagaagtat

SEQ ID NO: 5507865 - DNA, 12 bp, Homo sapiens
tacaaagtatta

SEQ ID NO: 5507866 - DNA, 18 bp, Homo sapiens
tacaaagtattaagcata

SEQ ID NO: 5507867 - DNA, 13 bp, Homo sapiens
tacaaagtgatgt

SEQ ID NO: 5507868 - DNA, 15 bp, Homo sapiens
tacaaagtggaaact

SEQ ID NO: 5507869 - DNA, 15 bp, Homo sapiens
tacaaagtgtgtatt

SEQ ID NO: 5507870 - DNA, 20 bp, Homo sapiens
tacaaagtttcaatttgttt

SEQ ID NO: 5507871 - DNA, 13 bp, Homo sapiens
tacaaagttttcc

SEQ ID NO: 5507872 - DNA, 18 bp, Homo sapiens
tacaaagttttcctttgt

SEQ ID NO: 5507873 - DNA, 13 bp, Homo sapiens
tacaaataaacag

SEQ ID NO: 5507874 - DNA, 12 bp, Homo sapiens
tacaaataaacc

SEQ ID NO: 5507875 - DNA, 16 bp, Homo sapiens
tacaaataaacctgag

SEQ ID NO: 5507876 - DNA, 14 bp, Homo sapiens
tacaaataaagatg

SEQ ID NO: 5507877 - DNA, 18 bp, Homo sapiens
tacaaataatattgcctt

SEQ ID NO: 5507878 - DNA, 19 bp, Homo sapiens
tacaaataatattgccttg

SEQ ID NO: 5507879 - DNA, 16 bp, Homo sapiens
tacaaataatttagaa

SEQ ID NO: 5507880 - DNA, 19 bp, Homo sapiens
tacaaataatttagaaata

SEQ ID NO: 5507881 - DNA, 17 bp, Homo sapiens
tacaaatactcttagga

SEQ ID NO: 5507882 - DNA, 18 bp, Homo sapiens
tacaaatagaagcttctt

SEQ ID NO: 5507883 - DNA, 12 bp, Homo sapiens
tacaaatataag

SEQ ID NO: 5507884 - DNA, 16 bp, Homo sapiens
tacaaatataagaata

SEQ ID NO: 5507885 - DNA, 17 bp, Homo sapiens
tacaaatataagatttt

SEQ ID NO: 5507886 - DNA, 15 bp, Homo sapiens
tacaaatatattgtt

SEQ ID NO: 5507887 - DNA, 13 bp, Homo sapiens
tacaaatattaag

SEQ ID NO: 5507888 - DNA, 17 bp, Homo sapiens
tacaaatattgtcatct

SEQ ID NO: 5507889 - DNA, 13 bp, Homo sapiens
tacaaatctgtat

SEQ ID NO: 5507890 - DNA, 14 bp, Homo sapiens
tacaaatgaagaaa

SEQ ID NO: 5507891 - DNA, 15 bp, Homo sapiens
tacaaatgaagaaag

SEQ ID NO: 5507892 - DNA, 21 bp, Homo sapiens
tacaaatgaagtatttcatgt

SEQ ID NO: 5507893 - DNA, 13 bp, Homo sapiens
tacaaatgattgc

SEQ ID NO: 5507894 - DNA, 19 bp, Homo sapiens
tacaaatgattgcttttaa

SEQ ID NO: 5507895 - DNA, 16 bp, Homo sapiens
tacaaatgcatctttg

SEQ ID NO: 5507896 - DNA, 22 bp, Homo sapiens
tacaaatgccttaaaatggaat

SEQ ID NO: 5507897 - DNA, 21 bp, Homo sapiens
tacaaatggacataggactca

SEQ ID NO: 5507898 - DNA, 13 bp, Homo sapiens
tacaaatgtgtga

SEQ ID NO: 5507899 - DNA, 17 bp, Homo sapiens
tacaaatgtttataact

SEQ ID NO: 5507900 - DNA, 19 bp, Homo sapiens
tacaaatgtttataactct

SEQ ID NO: 5507901 - DNA, 14 bp, Homo sapiens
tacaaattaaaaag

SEQ ID NO: 5507902 - DNA, 16 bp, Homo sapiens
tacaaattaaaaagat

SEQ ID NO: 5507903 - DNA, 21 bp, Homo sapiens
tacaaattaatatttgtgctt

SEQ ID NO: 5507904 - DNA, 15 bp, Homo sapiens
tacaaattataatgt

SEQ ID NO: 5507905 - DNA, 15 bp, Homo sapiens
tacaaattgcttact

SEQ ID NO: 5507906 - DNA, 21 bp, Homo sapiens
tacaaattgcttactttggaa

SEQ ID NO: 5507907 - DNA, 13 bp, Homo sapiens
tacaaattgttca

SEQ ID NO: 5507908 - DNA, 17 bp, Homo sapiens
tacaaatttataaaggt

SEQ ID NO: 5507909 - DNA, 16 bp, Homo sapiens
tacaaatttatgcatt

SEQ ID NO: 5507910 - DNA, 18 bp, Homo sapiens
tacaaatttatgcatttc

SEQ ID NO: 5507911 - DNA, 22 bp, Homo sapiens
tacaaatttatgcatttcattc

SEQ ID NO: 5507912 - DNA, 20 bp, Homo sapiens
tacaaatttggccttaagaa

SEQ ID NO: 5507913 - DNA, 20 bp, Homo sapiens
tacaaattttcactgctgct

SEQ ID NO: 5507914 - DNA, 13 bp, Homo sapiens
tacaaattttgta

SEQ ID NO: 5507915 - DNA, 22 bp, Homo sapiens
tacaaatttttactcaggcttt

SEQ ID NO: 5507916 - DNA, 15 bp, Homo sapiens
tacaaatttttactt

SEQ ID NO: 5507917 - DNA, 16 bp, Homo sapiens
tacaaatttttctgtg

SEQ ID NO: 5507918 - DNA, 16 bp, Homo sapiens
tacaaattttttaatt

SEQ ID NO: 5507919 - DNA, 16 bp, Homo sapiens
tacaacaaaaggactt

SEQ ID NO: 5507920 - DNA, 14 bp, Homo sapiens
tacaacaaacactg

SEQ ID NO: 5507921 - DNA, 14 bp, Homo sapiens
tacaacaaagagga

SEQ ID NO: 5507922 - DNA, 23 bp, Homo sapiens
tacaacaaaggcaagttaagaga

SEQ ID NO: 5507923 - DNA, 21 bp, Homo sapiens
tacaacaacaacaaaaaatac

SEQ ID NO: 5507924 - DNA, 17 bp, Homo sapiens
tacaacaagcaaactga

SEQ ID NO: 5507925 - DNA, 18 bp, Homo sapiens
tacaacaagcaaactgaa

SEQ ID NO: 5507926 - DNA, 21 bp, Homo sapiens
tacaacaagcaaactgaaatt

SEQ ID NO: 5507927 - DNA, 14 bp, Homo sapiens
tacaacaatgcttt

SEQ ID NO: 5507928 - DNA, 17 bp, Homo sapiens
tacaacacaaagagaaa

SEQ ID NO: 5507929 - DNA, 13 bp, Homo sapiens
tacaacacagtag

SEQ ID NO: 5507930 - DNA, 18 bp, Homo sapiens
tacaacacattgaaactg

SEQ ID NO: 5507931 - DNA, 19 bp, Homo sapiens
tacaacaccaaaaaatatc

SEQ ID NO: 5507932 - DNA, 18 bp, Homo sapiens
tacaacactttaatgggt

SEQ ID NO: 5507933 - DNA, 19 bp, Homo sapiens
tacaacagatattccagac

SEQ ID NO: 5507934 - DNA, 21 bp, Homo sapiens
tacaacagatttgtgaactca

SEQ ID NO: 5507935 - DNA, 20 bp, Homo sapiens
tacaacagcacgtgcagcca

SEQ ID NO: 5507936 - DNA, 14 bp, Homo sapiens
tacaacatatactt

SEQ ID NO: 5507937 - DNA, 13 bp, Homo sapiens
tacaacatttata

SEQ ID NO: 5507938 - DNA, 21 bp, Homo sapiens
tacaacatttatatattgtct

SEQ ID NO: 5507939 - DNA, 17 bp, Homo sapiens
tacaacatttttcagtt

SEQ ID NO: 5507940 - DNA, 14 bp, Homo sapiens
tacaaccaagctct

SEQ ID NO: 5507941 - DNA, 16 bp, Homo sapiens
tacaaccagagccccc

SEQ ID NO: 5507942 - DNA, 15 bp, Homo sapiens
tacaaccaggtcttg

SEQ ID NO: 5507943 - DNA, 16 bp, Homo sapiens
tacacatacatatata

SEQ ID NO: 5507944 - DNA, 18 bp, Homo sapiens
tacacatacatatataca

SEQ ID NO: 5507945 - DNA, 20 bp, Homo sapiens
tacacatacatatatacatt

SEQ ID NO: 5507946 - DNA, 17 bp, Homo sapiens
tacacatagttctgtaa

SEQ ID NO: 5507947 - DNA, 21 bp, Homo sapiens
tacacatagttctgtaataaa

SEQ ID NO: 5507948 - DNA, 14 bp, Homo sapiens
tacacatataaaaa

SEQ ID NO: 5507949 - DNA, 17 bp, Homo sapiens
tacacatataaacacag

SEQ ID NO: 5507950 - DNA, 18 bp, Homo sapiens
tacacatatacctataat

SEQ ID NO: 5507951 - DNA, 20 bp, Homo sapiens
tacacatatgtgcttctcag

SEQ ID NO: 5507952 - DNA, 20 bp, Homo sapiens
tacacatatttgaagggtct

SEQ ID NO: 5507953 - DNA, 18 bp, Homo sapiens
tacacatccccagaatcc

SEQ ID NO: 5507954 - DNA, 18 bp, Homo sapiens
tacacatccccagccaga

SEQ ID NO: 5507955 - DNA, 20 bp, Homo sapiens
tacacatctctgtcagtgtg

SEQ ID NO: 5507956 - DNA, 13 bp, Homo sapiens
tacacatcttaaa

SEQ ID NO: 5507957 - DNA, 14 bp, Homo sapiens
tacacatgtaaaat

SEQ ID NO: 5507958 - DNA, 15 bp, Homo sapiens
tacacatgtaaaata

SEQ ID NO: 5507959 - DNA, 17 bp, Homo sapiens
tacacatgtaaaatatg

SEQ ID NO: 5507960 - DNA, 16 bp, Homo sapiens
tacacatgtatccttt

SEQ ID NO: 5507961 - DNA, 11 bp, Homo sapiens
tacacatgtgt

SEQ ID NO: 5507962 - DNA, 19 bp, Homo sapiens
tacacatgtgttatctacc

SEQ ID NO: 5507963 - DNA, 17 bp, Homo sapiens
tacacatgttgccttgc

SEQ ID NO: 5507964 - DNA, 23 bp, Homo sapiens
tacacattagattttattttact

SEQ ID NO: 5507965 - DNA, 16 bp, Homo sapiens
tacacattatcactga

SEQ ID NO: 5507966 - DNA, 18 bp, Homo sapiens
tacacattcaataagcat

SEQ ID NO: 5507967 - DNA, 17 bp, Homo sapiens
tacacattgctacctca

SEQ ID NO: 5507968 - DNA, 22 bp, Homo sapiens
tacacattgctacctcagtgct

SEQ ID NO: 5507969 - DNA, 14 bp, Homo sapiens
tacacatttcactg

SEQ ID NO: 5507970 - DNA, 18 bp, Homo sapiens
tacacatttcatctaatt

SEQ ID NO: 5507971 - DNA, 20 bp, Homo sapiens
tacacatttcatctaattta

SEQ ID NO: 5507972 - DNA, 23 bp, Homo sapiens
tacacatttcttaaaacacatga

SEQ ID NO: 5507973 - DNA, 13 bp, Homo sapiens
tacacatttgcta

SEQ ID NO: 5507974 - DNA, 22 bp, Homo sapiens
tacacattttattttattatgc

SEQ ID NO: 5507975 - DNA, 13 bp, Homo sapiens
tacacattttgta

SEQ ID NO: 5507976 - DNA, 21 bp, Homo sapiens
tacacattttgtaaatctgta

SEQ ID NO: 5507977 - DNA, 17 bp, Homo sapiens
tacacatttttaaattg

SEQ ID NO: 5507978 - DNA, 19 bp, Homo sapiens
tacacatttttaaattgtt

SEQ ID NO: 5507979 - DNA, 20 bp, Homo sapiens
tacacatttttaaattgtta

SEQ ID NO: 5507980 - DNA, 17 bp, Homo sapiens
tacacatttttcagata

SEQ ID NO: 5507981 - DNA, 21 bp, Homo sapiens
tacacatttttcagatataaa

SEQ ID NO: 5507982 - DNA, 14 bp, Homo sapiens
tacaccaaacattt

SEQ ID NO: 5507983 - DNA, 16 bp, Homo sapiens
tacaccaaacatttct

SEQ ID NO: 5507984 - DNA, 22 bp, Homo sapiens
tacaccaaacatttctgtgaaa

SEQ ID NO: 5507985 - DNA, 20 bp, Homo sapiens
tacaccaaatagcttttcac

SEQ ID NO: 5507986 - DNA, 21 bp, Homo sapiens
tacaccaaatagcttttcact

SEQ ID NO: 5507987 - DNA, 21 bp, Homo sapiens
tacaccaatgaaaacatgtac

SEQ ID NO: 5507988 - DNA, 22 bp, Homo sapiens
tacaccaatttggtaaaaatgc

SEQ ID NO: 5507989 - DNA, 13 bp, Homo sapiens
tacaccacaagta

SEQ ID NO: 5507990 - DNA, 14 bp, Homo sapiens
tacaccacaagtat

SEQ ID NO: 5507991 - DNA, 19 bp, Homo sapiens
tacaccacacacaacagcc

SEQ ID NO: 5507992 - DNA, 17 bp, Homo sapiens
tacaccacactaaaaca

SEQ ID NO: 5507993 - DNA, 15 bp, Homo sapiens
tacaccactacattc

SEQ ID NO: 5507994 - DNA, 18 bp, Homo sapiens
tacaccactacattctgt

SEQ ID NO: 5507995 - DNA, 19 bp, Homo sapiens
tacaccactctggcagcca

SEQ ID NO: 5507996 - DNA, 18 bp, Homo sapiens
tacaccatagtttacaat

SEQ ID NO: 5507997 - DNA, 20 bp, Homo sapiens
tacaccatagtttacaatat

SEQ ID NO: 5507998 - DNA, 24 bp, Homo sapiens
tacaccatgtttgagctcagaccc

SEQ ID NO: 5507999 - DNA, 19 bp, Homo sapiens
tacacccagttctgaataa

SEQ ID NO: 5508000 - DNA, 19 bp, Homo sapiens
tacacccatgaaagaaaac

SEQ ID NO: 5508001 - DNA, 20 bp, Homo sapiens
tacaccccctcttctgagca

SEQ ID NO: 5508002 - DNA, 22 bp, Homo sapiens
tacaccccctcttctgagcaca

SEQ ID NO: 5508003 - DNA, 23 bp, Homo sapiens
tacacccctgtgctcccctgcca

SEQ ID NO: 5508004 - DNA, 16 bp, Homo sapiens
tacaccccttttccag

SEQ ID NO: 5508005 - DNA, 15 bp, Homo sapiens
tacaccctttccagg

SEQ ID NO: 5508006 - DNA, 17 bp, Homo sapiens
tacaccgtgaggccaag

SEQ ID NO: 5508007 - DNA, 21 bp, Homo sapiens
tacaccgtttagaaaaaacaa

SEQ ID NO: 5508008 - DNA, 15 bp, Homo sapiens
tacacctaaaggtgt

SEQ ID NO: 5508009 - DNA, 22 bp, Homo sapiens
tacacctaactcacctaactca

SEQ ID NO: 5508010 - DNA, 18 bp, Homo sapiens
tacacctattatcccagc

SEQ ID NO: 5508011 - DNA, 17 bp, Homo sapiens
tacacctccactcagca

SEQ ID NO: 5508012 - DNA, 12 bp, Homo sapiens
tacacctccccc

SEQ ID NO: 5508013 - DNA, 15 bp, Homo sapiens
tacacctccccctgc

SEQ ID NO: 5508014 - DNA, 21 bp, Homo sapiens
tacacctcgttagggaagaga

SEQ ID NO: 5508015 - DNA, 22 bp, Homo sapiens
tacacctcgttagggaagagaa

SEQ ID NO: 5508016 - DNA, 13 bp, Homo sapiens
tacacctctgggc

SEQ ID NO: 5508017 - DNA, 21 bp, Homo sapiens
tacacctctgggccctgcagg

SEQ ID NO: 5508018 - DNA, 23 bp, Homo sapiens
tacacctgaggctgaggcaggag

SEQ ID NO: 5508019 - DNA, 15 bp, Homo sapiens
tacacctggctgagg

SEQ ID NO: 5508020 - DNA, 16 bp, Homo sapiens
tacaccttccccaccc

SEQ ID NO: 5508021 - DNA, 19 bp, Homo sapiens
tacacctttctcctttgta

SEQ ID NO: 5508022 - DNA, 20 bp, Homo sapiens
tacacctttctcctttgtac

SEQ ID NO: 5508023 - DNA, 14 bp, Homo sapiens
tacacgaaagagag

SEQ ID NO: 5508024 - DNA, 16 bp, Homo sapiens
tacacgaaagagagag

SEQ ID NO: 5508025 - DNA, 15 bp, Homo sapiens
tacacgaagaaatag

SEQ ID NO: 5508026 - DNA, 13 bp, Homo sapiens
tacacggaaaacg

SEQ ID NO: 5508027 - DNA, 19 bp, Homo sapiens
tacacggactgaggtgcct

SEQ ID NO: 5508028 - DNA, 21 bp, Homo sapiens
tacacggactgaggtgcctgc

SEQ ID NO: 5508029 - DNA, 23 bp, Homo sapiens
tacacggattattatttgtactt

SEQ ID NO: 5508030 - DNA, 19 bp, Homo sapiens
tacacggggttacactgtt

SEQ ID NO: 5508031 - DNA, 23 bp, Homo sapiens
tacacgtatttgaatggccttca

SEQ ID NO: 5508032 - DNA, 14 bp, Homo sapiens
tacacgtgcctgta

SEQ ID NO: 5508033 - DNA, 17 bp, Homo sapiens
tacacgtgcgtgtgagt

SEQ ID NO: 5508034 - DNA, 23 bp, Homo sapiens
tacacgtgcgtgtgagtgtgtgt

SEQ ID NO: 5508035 - DNA, 14 bp, Homo sapiens
tacacgtgtatatg

SEQ ID NO: 5508036 - DNA, 16 bp, Homo sapiens
tacacgtgtatatgag

SEQ ID NO: 5508037 - DNA, 13 bp, Homo sapiens
tacacgtgtcctg

SEQ ID NO: 5508038 - DNA, 15 bp, Homo sapiens
tacactaaaatttaa

SEQ ID NO: 5508039 - DNA, 14 bp, Homo sapiens
tacactaaattatt

SEQ ID NO: 5508040 - DNA, 19 bp, Homo sapiens
tacactaacatatttagaa

SEQ ID NO: 5508041 - DNA, 15 bp, Homo sapiens
tacactaacatttcc

SEQ ID NO: 5508042 - DNA, 22 bp, Homo sapiens
tacactacattttttctaataa

SEQ ID NO: 5508043 - DNA, 23 bp, Homo sapiens
tacactaccaaacactcagtcca

SEQ ID NO: 5508044 - DNA, 18 bp, Homo sapiens
tacactacgcactggaca

SEQ ID NO: 5508045 - DNA, 17 bp, Homo sapiens
tacactaggaaacgtgt

SEQ ID NO: 5508046 - DNA, 13 bp, Homo sapiens
tacactatcttaa

SEQ ID NO: 5508047 - DNA, 14 bp, Homo sapiens
tacactatgaaatt

SEQ ID NO: 5508048 - DNA, 20 bp, Homo sapiens
tacactatgataaagttgta

SEQ ID NO: 5508049 - DNA, 18 bp, Homo sapiens
tacactcaactaattttt

SEQ ID NO: 5508050 - DNA, 21 bp, Homo sapiens
tacactcaagtgccattcatc

SEQ ID NO: 5508051 - DNA, 15 bp, Homo sapiens
tacactcagccactg

SEQ ID NO: 5508052 - DNA, 23 bp, Homo sapiens
tacactcagccactgtcacaggc

SEQ ID NO: 5508053 - DNA, 16 bp, Homo sapiens
tacactcaggctttca

SEQ ID NO: 5508054 - DNA, 19 bp, Homo sapiens
tacactcatggggaagctt

SEQ ID NO: 5508055 - DNA, 14 bp, Homo sapiens
tacactccagcctg

SEQ ID NO: 5508056 - DNA, 16 bp, Homo sapiens
tacactccagcctgag

SEQ ID NO: 5508057 - DNA, 18 bp, Homo sapiens
tacactccagcctgagca

SEQ ID NO: 5508058 - DNA, 14 bp, Homo sapiens
tacactcctgctgt

SEQ ID NO: 5508059 - DNA, 17 bp, Homo sapiens
tacactctcctgggccc

SEQ ID NO: 5508060 - DNA, 16 bp, Homo sapiens
tacactctctgtacaa

SEQ ID NO: 5508061 - DNA, 22 bp, Homo sapiens
tacactctctgtacaaaaacaa

SEQ ID NO: 5508062 - DNA, 14 bp, Homo sapiens
tacactctgctgtt

SEQ ID NO: 5508063 - DNA, 15 bp, Homo sapiens
tacactctgctgttt

SEQ ID NO: 5508064 - DNA, 23 bp, Homo sapiens
tacactctgtattgaaaatggct

SEQ ID NO: 5508065 - DNA, 15 bp, Homo sapiens
tacactgaaaggaaa

SEQ ID NO: 5508066 - DNA, 19 bp, Homo sapiens
tacactgaaaggaaaaatg

SEQ ID NO: 5508067 - DNA, 17 bp, Homo sapiens
tacactgaatatttata

SEQ ID NO: 5508068 - DNA, 18 bp, Homo sapiens
tacactgaatatttatat

SEQ ID NO: 5508069 - DNA, 17 bp, Homo sapiens
tacactgaatggaaata

SEQ ID NO: 5508070 - DNA, 22 bp, Homo sapiens
tacactgaatttttatgtgtga

SEQ ID NO: 5508071 - DNA, 23 bp, Homo sapiens
tacactgaatttttatgtgtgat

SEQ ID NO: 5508072 - DNA, 16 bp, Homo sapiens
tacactgacacctttg

SEQ ID NO: 5508073 - DNA, 14 bp, Homo sapiens
tacactgaggactg

SEQ ID NO: 5508074 - DNA, 20 bp, Homo sapiens
tacactgaggactgtggcga

SEQ ID NO: 5508075 - DNA, 15 bp, Homo sapiens
tacactgatgcaagg

SEQ ID NO: 5508076 - DNA, 16 bp, Homo sapiens
tacactgcctgtatac

SEQ ID NO: 5508077 - DNA, 21 bp, Homo sapiens
tacactgcctgtatactttag

SEQ ID NO: 5508078 - DNA, 19 bp, Homo sapiens
tacactgcggaagccaaag

SEQ ID NO: 5508079 - DNA, 17 bp, Homo sapiens
tacactgctgtacccag

SEQ ID NO: 5508080 - DNA, 15 bp, Homo sapiens
tacactggatatgtt

SEQ ID NO: 5508081 - DNA, 16 bp, Homo sapiens
tacactggtatttata

SEQ ID NO: 5508082 - DNA, 11 bp, Homo sapiens
tacactggtct

SEQ ID NO: 5508083 - DNA, 18 bp, Homo sapiens
tacactggtctaatgttt

SEQ ID NO: 5508084 - DNA, 21 bp, Homo sapiens
tacactggtctaatgtttgtg

SEQ ID NO: 5508085 - DNA, 13 bp, Homo sapiens
tacactggtgtgt

SEQ ID NO: 5508086 - DNA, 21 bp, Homo sapiens
tacactggtttgagcttagtg

SEQ ID NO: 5508087 - DNA, 23 bp, Homo sapiens
tacactgtagtttttgaaaatta

SEQ ID NO: 5508088 - DNA, 16 bp, Homo sapiens
tacactgtatctaaaa

SEQ ID NO: 5508089 - DNA, 22 bp, Homo sapiens
tacactgtattacataaataaa

SEQ ID NO: 5508090 - DNA, 15 bp, Homo sapiens
tacactgtcaaacat

SEQ ID NO: 5508091 - DNA, 20 bp, Homo sapiens
tacactgtcagcagggactg

SEQ ID NO: 5508092 - DNA, 21 bp, Homo sapiens
tacactgtgctgagtctgaag

SEQ ID NO: 5508093 - DNA, 23 bp, Homo sapiens
tacactgtgctgagtctgaaggc

SEQ ID NO: 5508094 - DNA, 11 bp, Homo sapiens
tacactgtgta

SEQ ID NO: 5508095 - DNA, 13 bp, Homo sapiens
tacactgtgtctc

SEQ ID NO: 5508096 - DNA, 20 bp, Homo sapiens
tacactgttagaacactatt

SEQ ID NO: 5508097 - DNA, 19 bp, Homo sapiens
tacactgtttcaaacttta

SEQ ID NO: 5508098 - DNA, 13 bp, Homo sapiens
tacactgtttcat

SEQ ID NO: 5508099 - DNA, 12 bp, Homo sapiens
tacacttaaaag

SEQ ID NO: 5508100 - DNA, 21 bp, Homo sapiens
tacacttaaacttgcacattt

SEQ ID NO: 5508101 - DNA, 17 bp, Homo sapiens
tacacttaattacagtt

SEQ ID NO: 5508102 - DNA, 22 bp, Homo sapiens
tacacttacaagtaatgaattt

SEQ ID NO: 5508103 - DNA, 14 bp, Homo sapiens
tacacttactgttg

SEQ ID NO: 5508104 - DNA, 23 bp, Homo sapiens
tacacttataaaataacttgcat

SEQ ID NO: 5508105 - DNA, 20 bp, Homo sapiens
tacacttcacctccttctgc

SEQ ID NO: 5508106 - DNA, 20 bp, Homo sapiens
tacacttctggctcacagga

SEQ ID NO: 5508107 - DNA, 15 bp, Homo sapiens
tacacttcttttgaa

SEQ ID NO: 5508108 - DNA, 18 bp, Homo sapiens
tacacttgagatgatttc

SEQ ID NO: 5508109 - DNA, 15 bp, Homo sapiens
tacacttgccctgct

SEQ ID NO: 5508110 - DNA, 13 bp, Homo sapiens
tacacttggattt

SEQ ID NO: 5508111 - DNA, 13 bp, Homo sapiens
tacacttgggtga

SEQ ID NO: 5508112 - DNA, 17 bp, Homo sapiens
tacacttgtataaatgt

SEQ ID NO: 5508113 - DNA, 20 bp, Homo sapiens
tacacttgtataaatgtata

SEQ ID NO: 5508114 - DNA, 22 bp, Homo sapiens
tacactttatggtaagtagcag

SEQ ID NO: 5508115 - DNA, 14 bp, Homo sapiens
tacactttgttgca

SEQ ID NO: 5508116 - DNA, 18 bp, Homo sapiens
tacactttgttgcaagat

SEQ ID NO: 5508117 - DNA, 17 bp, Homo sapiens
tacactttttacagcag

SEQ ID NO: 5508118 - DNA, 15 bp, Homo sapiens
tacagaaaaaccttg

SEQ ID NO: 5508119 - DNA, 23 bp, Homo sapiens
tacagtattgaaaaattatcagt

SEQ ID NO: 5508120 - DNA, 22 bp, Homo sapiens
tacagtattgagctttgcattt

SEQ ID NO: 5508121 - DNA, 12 bp, Homo sapiens
tacagtattgct

SEQ ID NO: 5508122 - DNA, 15 bp, Homo sapiens
tacagtatttacagt

SEQ ID NO: 5508123 - DNA, 21 bp, Homo sapiens
tacagtatttttcagatataa

SEQ ID NO: 5508124 - DNA, 22 bp, Homo sapiens
tacagtatttttcagatataaa

SEQ ID NO: 5508125 - DNA, 18 bp, Homo sapiens
tacagtcaagatagaaag

SEQ ID NO: 5508126 - DNA, 15 bp, Homo sapiens
tacagtcaattttac

SEQ ID NO: 5508127 - DNA, 16 bp, Homo sapiens
tacagtcaggacacat

SEQ ID NO: 5508128 - DNA, 15 bp, Homo sapiens
tacagtcatctgtct

SEQ ID NO: 5508129 - DNA, 16 bp, Homo sapiens
tacagtcattccaaga

SEQ ID NO: 5508130 - DNA, 20 bp, Homo sapiens
tacagtcattccaagaacta

SEQ ID NO: 5508131 - DNA, 19 bp, Homo sapiens
tacagtccaaaatactgtt

SEQ ID NO: 5508132 - DNA, 14 bp, Homo sapiens
tacagtctaaagct

SEQ ID NO: 5508133 - DNA, 14 bp, Homo sapiens
tacagtctcaattt

SEQ ID NO: 5508134 - DNA, 17 bp, Homo sapiens
tacagtctcaattttgt

SEQ ID NO: 5508135 - DNA, 19 bp, Homo sapiens
tacagtctcaattttgtat

SEQ ID NO: 5508136 - DNA, 21 bp, Homo sapiens
tacagtctcaattttgtattt

SEQ ID NO: 5508137 - DNA, 22 bp, Homo sapiens
tacagtctcaattttgtattta

SEQ ID NO: 5508138 - DNA, 15 bp, Homo sapiens
tacagtctcgtctct

SEQ ID NO: 5508139 - DNA, 19 bp, Homo sapiens
tacagtctctgttgtaaat

SEQ ID NO: 5508140 - DNA, 22 bp, Homo sapiens
tacagtctctttcttcctttct

SEQ ID NO: 5508141 - DNA, 13 bp, Homo sapiens
tacagtctgtcat

SEQ ID NO: 5508142 - DNA, 12 bp, Homo sapiens
tacagtctgtct

SEQ ID NO: 5508143 - DNA, 18 bp, Homo sapiens
tacagtctgtcttctgta

SEQ ID NO: 5508144 - DNA, 18 bp, Homo sapiens
tacagtcttccatttgca

SEQ ID NO: 5508145 - DNA, 19 bp, Homo sapiens
tacagtcttccatttgcaa

SEQ ID NO: 5508146 - DNA, 21 bp, Homo sapiens
tacagtgaaaatgtaagctgt

SEQ ID NO: 5508147 - DNA, 23 bp, Homo sapiens
tacagtgaaaatgtaagctgttt

SEQ ID NO: 5508148 - DNA, 18 bp, Homo sapiens
tacagtgaaatgagcagc

SEQ ID NO: 5508149 - DNA, 12 bp, Homo sapiens
tacagtgaagat

SEQ ID NO: 5508150 - DNA, 19 bp, Homo sapiens
tacagtgactccctgggag

SEQ ID NO: 5508151 - DNA, 22 bp, Homo sapiens
tacagtgactgtcgtgtttaca

SEQ ID NO: 5508152 - DNA, 16 bp, Homo sapiens
tacagtgagctgagag

SEQ ID NO: 5508153 - DNA, 22 bp, Homo sapiens
tacagtgaggactcggccactg

SEQ ID NO: 5508154 - DNA, 13 bp, Homo sapiens
tacagtgaggagg

SEQ ID NO: 5508155 - DNA, 17 bp, Homo sapiens
tacagtgatagaacaaa

SEQ ID NO: 5508156 - DNA, 13 bp, Homo sapiens
tacagtgatatgg

SEQ ID NO: 5508157 - DNA, 16 bp, Homo sapiens
tacagtgattcatgta

SEQ ID NO: 5508158 - DNA, 21 bp, Homo sapiens
tacagtgcagagccttctcag

SEQ ID NO: 5508159 - DNA, 22 bp, Homo sapiens
tacagtgcagagccttctcaga

SEQ ID NO: 5508160 - DNA, 12 bp, Homo sapiens
tacagtgcagtt

SEQ ID NO: 5508161 - DNA, 23 bp, Homo sapiens
tacagtgcatccttgaactgtca

SEQ ID NO: 5508162 - DNA, 17 bp, Homo sapiens
tacagtgcccaccgccc

SEQ ID NO: 5508163 - DNA, 24 bp, Homo sapiens
tacagtgcccaccgccctcctcca

SEQ ID NO: 5508164 - DNA, 13 bp, Homo sapiens
tacagtgcctgta

SEQ ID NO: 5508165 - DNA, 13 bp, Homo sapiens
tacagtgccttgc

SEQ ID NO: 5508166 - DNA, 15 bp, Homo sapiens
tacagtggagaaata

SEQ ID NO: 5508167 - DNA, 16 bp, Homo sapiens
tacagtggattgctca

SEQ ID NO: 5508168 - DNA, 18 bp, Homo sapiens
tacagtggtgccatcatt

SEQ ID NO: 5508169 - DNA, 16 bp, Homo sapiens
tacagtgtacagtctt

SEQ ID NO: 5508170 - DNA, 22 bp, Homo sapiens
tacagtgtacagtcttgtatta

SEQ ID NO: 5508171 - DNA, 13 bp, Homo sapiens
tacagtgtacatg

SEQ ID NO: 5508172 - DNA, 14 bp, Homo sapiens
tacagtgtatttaa

SEQ ID NO: 5508173 - DNA, 13 bp, Homo sapiens
tacagtgtctttt

SEQ ID NO: 5508174 - DNA, 21 bp, Homo sapiens
tacagtgtctttttttgtata

SEQ ID NO: 5508175 - DNA, 12 bp, Homo sapiens
tacagtgttacc

SEQ ID NO: 5508176 - DNA, 15 bp, Homo sapiens
tacagtgtttatcct

SEQ ID NO: 5508177 - DNA, 15 bp, Homo sapiens
tacagtgttttatcc

SEQ ID NO: 5508178 - DNA, 14 bp, Homo sapiens
tacagtgtttttta

SEQ ID NO: 5508179 - DNA, 21 bp, Homo sapiens
tacagtgttttttaggaaaag

SEQ ID NO: 5508180 - DNA, 18 bp, Homo sapiens
tacagttaaggaatataa

SEQ ID NO: 5508181 - DNA, 19 bp, Homo sapiens
tacagttactcagaattct

SEQ ID NO: 5508182 - DNA, 23 bp, Homo sapiens
tacagttactcagaattctctag

SEQ ID NO: 5508183 - DNA, 16 bp, Homo sapiens
tacagttacttccttc

SEQ ID NO: 5508184 - DNA, 17 bp, Homo sapiens
tacagttacttttcctt

SEQ ID NO: 5508185 - DNA, 13 bp, Homo sapiens
tacagttagtctt

SEQ ID NO: 5508186 - DNA, 14 bp, Homo sapiens
tacagttataaaat

SEQ ID NO: 5508187 - DNA, 17 bp, Homo sapiens
tacagttataaaattaa

SEQ ID NO: 5508188 - DNA, 14 bp, Homo sapiens
tacagttatacata

SEQ ID NO: 5508189 - DNA, 19 bp, Homo sapiens
tacagttatctaagttaat

SEQ ID NO: 5508190 - DNA, 20 bp, Homo sapiens
tacagttatgcatcctgtat

SEQ ID NO: 5508191 - DNA, 17 bp, Homo sapiens
tacagttcataaatttg

SEQ ID NO: 5508192 - DNA, 23 bp, Homo sapiens
tacagttcggtgagctacaaatg

SEQ ID NO: 5508193 - DNA, 14 bp, Homo sapiens
tacagttctggagg

SEQ ID NO: 5508194 - DNA, 15 bp, Homo sapiens
tacagttctggagga

SEQ ID NO: 5508195 - DNA, 16 bp, Homo sapiens
tacagttctggaggag

SEQ ID NO: 5508196 - DNA, 17 bp, Homo sapiens
tacagttctggaggagg

SEQ ID NO: 5508197 - DNA, 21 bp, Homo sapiens
tacagttctttcctctttctg

SEQ ID NO: 5508198 - DNA, 22 bp, Homo sapiens
tacagttctttcctctttctgc

SEQ ID NO: 5508199 - DNA, 19 bp, Homo sapiens
tacagttgaaaaacagctg

SEQ ID NO: 5508200 - DNA, 19 bp, Homo sapiens
tacagttgaaataactgga

SEQ ID NO: 5508201 - DNA, 21 bp, Homo sapiens
tacagttgactggctttcctc

SEQ ID NO: 5508202 - DNA, 16 bp, Homo sapiens
tacagttgagctcagg

SEQ ID NO: 5508203 - DNA, 19 bp, Homo sapiens
tacagttgatatttaaaag

SEQ ID NO: 5508204 - DNA, 19 bp, Homo sapiens
tacagttgcaggagcgtga

SEQ ID NO: 5508205 - DNA, 19 bp, Homo sapiens
tacagttggaaatccatcc

SEQ ID NO: 5508206 - DNA, 23 bp, Homo sapiens
tacagttgggaagtctcagcctg

SEQ ID NO: 5508207 - DNA, 13 bp, Homo sapiens
tacagttgtataa

SEQ ID NO: 5508208 - DNA, 15 bp, Homo sapiens
tacagttgttggcct

SEQ ID NO: 5508209 - DNA, 20 bp, Homo sapiens
tacagttgttttttgaaaac

SEQ ID NO: 5508210 - DNA, 18 bp, Homo sapiens
tacagtttataaagccaa

SEQ ID NO: 5508211 - DNA, 23 bp, Homo sapiens
tacagtttataaagccaagaatt

SEQ ID NO: 5508212 - DNA, 22 bp, Homo sapiens
tacagtttattgatattcaata

SEQ ID NO: 5508213 - DNA, 20 bp, Homo sapiens
tacagtttattttctgtgta

SEQ ID NO: 5508214 - DNA, 23 bp, Homo sapiens
tacagtttatttttaaagataga

SEQ ID NO: 5508215 - DNA, 23 bp, Homo sapiens
tacagtttcattaactccttccc

SEQ ID NO: 5508216 - DNA, 23 bp, Homo sapiens
tacagtttcttcatgcattactt

SEQ ID NO: 5508217 - DNA, 13 bp, Homo sapiens
tacagtttgactt

SEQ ID NO: 5508218 - DNA, 16 bp, Homo sapiens
tacagtttgacttttt

SEQ ID NO: 5508219 - DNA, 23 bp, Homo sapiens
tacagtttggggcaagtcatgta

SEQ ID NO: 5508220 - DNA, 17 bp, Homo sapiens
tacagtttgtcacatga

SEQ ID NO: 5508221 - DNA, 20 bp, Homo sapiens
tacagtttgtgaggaccttt

SEQ ID NO: 5508222 - DNA, 23 bp, Homo sapiens
tacagtttgtgctctactgttac

SEQ ID NO: 5508223 - DNA, 15 bp, Homo sapiens
tacagtttgtgtttt

SEQ ID NO: 5508224 - DNA, 17 bp, Homo sapiens
tacagtttgtgttttaa

SEQ ID NO: 5508225 - DNA, 23 bp, Homo sapiens
tacagtttgtgttttaaaaaaac

SEQ ID NO: 5508226 - DNA, 16 bp, Homo sapiens
tacagtttgtttacac

SEQ ID NO: 5508227 - DNA, 20 bp, Homo sapiens
tacagttttatacccttttt

SEQ ID NO: 5508228 - DNA, 15 bp, Homo sapiens
tacagttttcagaaa

SEQ ID NO: 5508229 - DNA, 14 bp, Homo sapiens
tacagttttcattg

SEQ ID NO: 5508230 - DNA, 15 bp, Homo sapiens
tacagttttcctaaa

SEQ ID NO: 5508231 - DNA, 22 bp, Homo sapiens
tacagttttcctaaatgtatac

SEQ ID NO: 5508232 - DNA, 20 bp, Homo sapiens
tacagttttctagcaatttt

SEQ ID NO: 5508233 - DNA, 22 bp, Homo sapiens
tacagttttgtggactgagcga

SEQ ID NO: 5508234 - DNA, 13 bp, Homo sapiens
tacataaaagaaa

SEQ ID NO: 5508235 - DNA, 21 bp, Homo sapiens
tacataaacaacgcattgcca

SEQ ID NO: 5508236 - DNA, 14 bp, Homo sapiens
tacataaacaatga

SEQ ID NO: 5508237 - DNA, 23 bp, Homo sapiens
tacataaaccatttttgttactc

SEQ ID NO: 5508238 - DNA, 13 bp, Homo sapiens
tacataaacttaa

SEQ ID NO: 5508239 - DNA, 14 bp, Homo sapiens
tacataaacttaaa

SEQ ID NO: 5508240 - DNA, 16 bp, Homo sapiens
tacataaacttttgca

SEQ ID NO: 5508241 - DNA, 12 bp, Homo sapiens
tacataaagact

SEQ ID NO: 5508242 - DNA, 19 bp, Homo sapiens
tacataaagtcatcaaagt

SEQ ID NO: 5508243 - DNA, 15 bp, Homo sapiens
tacataaataaaaga

SEQ ID NO: 5508244 - DNA, 22 bp, Homo sapiens
tacataaattgcataaagcata

SEQ ID NO: 5508245 - DNA, 13 bp, Homo sapiens
tacataacacatt

SEQ ID NO: 5508246 - DNA, 16 bp, Homo sapiens
tacataacaggcattg

SEQ ID NO: 5508247 - DNA, 23 bp, Homo sapiens
tacataacagggtaaattattca

SEQ ID NO: 5508248 - DNA, 18 bp, Homo sapiens
tacataactaaatttgat

SEQ ID NO: 5508249 - DNA, 13 bp, Homo sapiens
tacataactcctg

SEQ ID NO: 5508250 - DNA, 16 bp, Homo sapiens
tacataactcctgtcc

SEQ ID NO: 5508251 - DNA, 19 bp, Homo sapiens
tacataactcctgtccctt

SEQ ID NO: 5508252 - DNA, 15 bp, Homo sapiens
tacataactgaaaat

SEQ ID NO: 5508253 - DNA, 17 bp, Homo sapiens
tacataactgaaaatgt

SEQ ID NO: 5508254 - DNA, 16 bp, Homo sapiens
tacataactgataatt

SEQ ID NO: 5508255 - DNA, 15 bp, Homo sapiens
tacataactgatcta

SEQ ID NO: 5508256 - DNA, 16 bp, Homo sapiens
tacataactgatctat

SEQ ID NO: 5508257 - DNA, 18 bp, Homo sapiens
tacataactgatctattt

SEQ ID NO: 5508258 - DNA, 22 bp, Homo sapiens
tacataactgatctatttatta

SEQ ID NO: 5508259 - DNA, 13 bp, Homo sapiens
tacataactgcct

SEQ ID NO: 5508260 - DNA, 14 bp, Homo sapiens
tacataactgcctt

SEQ ID NO: 5508261 - DNA, 16 bp, Homo sapiens
tacataactgccttga

SEQ ID NO: 5508262 - DNA, 21 bp, Homo sapiens
tacataacttcagatacttgt

SEQ ID NO: 5508263 - DNA, 22 bp, Homo sapiens
tacataagataaatgtgctgaa

SEQ ID NO: 5508264 - DNA, 16 bp, Homo sapiens
tacataagcttctcaa

SEQ ID NO: 5508265 - DNA, 17 bp, Homo sapiens
tacataaggatgacttt

SEQ ID NO: 5508266 - DNA, 18 bp, Homo sapiens
tacataaggatgactttt

SEQ ID NO: 5508267 - DNA, 15 bp, Homo sapiens
tacataagtaattca

SEQ ID NO: 5508268 - DNA, 12 bp, Homo sapiens
tacataagtcct

SEQ ID NO: 5508269 - DNA, 18 bp, Homo sapiens
tacataagtcctttcaat

SEQ ID NO: 5508270 - DNA, 20 bp, Homo sapiens
tacataatactgaaccactt

SEQ ID NO: 5508271 - DNA, 12 bp, Homo sapiens
tacataatctgt

SEQ ID NO: 5508272 - DNA, 15 bp, Homo sapiens
tacataatgcgtgca

SEQ ID NO: 5508273 - DNA, 23 bp, Homo sapiens
tacataatgcgtgcataccactt

SEQ ID NO: 5508274 - DNA, 21 bp, Homo sapiens
tacataatgcttaatttctaa

SEQ ID NO: 5508275 - DNA, 23 bp, Homo sapiens
tacataatgggccactgaaatct

SEQ ID NO: 5508276 - DNA, 13 bp, Homo sapiens
tacataatggtac

SEQ ID NO: 5508277 - DNA, 19 bp, Homo sapiens
tacataatggtactcccaa

SEQ ID NO: 5508278 - DNA, 18 bp, Homo sapiens
tacataatgtttttcctt

SEQ ID NO: 5508279 - DNA, 20 bp, Homo sapiens
tacataatgtttttcctttc

SEQ ID NO: 5508280 - DNA, 14 bp, Homo sapiens
tacataattaaatt

SEQ ID NO: 5508281 - DNA, 15 bp, Homo sapiens
tacataattcactct

SEQ ID NO: 5508282 - DNA, 23 bp, Homo sapiens
tacataattgattaaaatctctt

SEQ ID NO: 5508283 - DNA, 17 bp, Homo sapiens
tacataattgcatgaaa

SEQ ID NO: 5508284 - DNA, 18 bp, Homo sapiens
tacataattgcatgaaaa

SEQ ID NO: 5508285 - DNA, 19 bp, Homo sapiens
tacataattttttattcaa

SEQ ID NO: 5508286 - DNA, 22 bp, Homo sapiens
tacataattttttattcaagtt

SEQ ID NO: 5508287 - DNA, 15 bp, Homo sapiens
tacatacaaatatat

SEQ ID NO: 5508288 - DNA, 16 bp, Homo sapiens
tacatacaaatatatg

SEQ ID NO: 5508289 - DNA, 15 bp, Homo sapiens
tacatacacatacat

SEQ ID NO: 5508290 - DNA, 21 bp, Homo sapiens
tacatacacttgtataaatgt

SEQ ID NO: 5508291 - DNA, 20 bp, Homo sapiens
tacatacagaattactgtaa

SEQ ID NO: 5508292 - DNA, 21 bp, Homo sapiens
tacatacagagattgtagtat

SEQ ID NO: 5508293 - DNA, 13 bp, Homo sapiens
tacatacagaggt

SEQ ID NO: 5508294 - DNA, 12 bp, Homo sapiens
tacatacataca

SEQ ID NO: 5508295 - DNA, 13 bp, Homo sapiens
tacatacatacaa

SEQ ID NO: 5508296 - DNA, 13 bp, Homo sapiens
tacatacatacat

SEQ ID NO: 5508297 - DNA, 14 bp, Homo sapiens
tacatacatatata

SEQ ID NO: 5508298 - DNA, 15 bp, Homo sapiens
tacatacatatatat

SEQ ID NO: 5508299 - DNA, 18 bp, Homo sapiens
tacatacattcatactgt

SEQ ID NO: 5508300 - DNA, 13 bp, Homo sapiens
tacatacatttaa

SEQ ID NO: 5508301 - DNA, 23 bp, Homo sapiens
tacatacctctctctatatatac

SEQ ID NO: 5508302 - DNA, 21 bp, Homo sapiens
tacataccttgttatatgcag

SEQ ID NO: 5508303 - DNA, 21 bp, Homo sapiens
tacatacgcaaaaacttcctt

SEQ ID NO: 5508304 - DNA, 23 bp, Homo sapiens
tacatacgcaaaaacttccttta

SEQ ID NO: 5508305 - DNA, 15 bp, Homo sapiens
tacatacggtcaggt

SEQ ID NO: 5508306 - DNA, 19 bp, Homo sapiens
tacatacggttctgttata

SEQ ID NO: 5508307 - DNA, 16 bp, Homo sapiens
tacatacgtctgccag

SEQ ID NO: 5508308 - DNA, 17 bp, Homo sapiens
tacatacgtctgccagg

SEQ ID NO: 5508309 - DNA, 14 bp, Homo sapiens
tacatacgtgttct

SEQ ID NO: 5508310 - DNA, 18 bp, Homo sapiens
tacatactaggtgccttt

SEQ ID NO: 5508311 - DNA, 21 bp, Homo sapiens
tacatactatagattctttat

SEQ ID NO: 5508312 - DNA, 13 bp, Homo sapiens
tacatactggcct

SEQ ID NO: 5508313 - DNA, 15 bp, Homo sapiens
tacatacttttgcaa

SEQ ID NO: 5508314 - DNA, 16 bp, Homo sapiens
tacatacttttgcaaa

SEQ ID NO: 5508315 - DNA, 12 bp, Homo sapiens
tacatacttttt

SEQ ID NO: 5508316 - DNA, 16 bp, Homo sapiens
tacatactttttcaag

SEQ ID NO: 5508317 - DNA, 20 bp, Homo sapiens
tacatagaccctctttcttg

SEQ ID NO: 5508318 - DNA, 18 bp, Homo sapiens
tacatagagatctatttt

SEQ ID NO: 5508319 - DNA, 17 bp, Homo sapiens
tacatagagcaatgttg

SEQ ID NO: 5508320 - DNA, 17 bp, Homo sapiens
tacatagatcagccatt

SEQ ID NO: 5508321 - DNA, 18 bp, Homo sapiens
tacatagatcagccatta

SEQ ID NO: 5508322 - DNA, 16 bp, Homo sapiens
tacatagatggaccag

SEQ ID NO: 5508323 - DNA, 22 bp, Homo sapiens
tacatagatttatttttcagtt

SEQ ID NO: 5508324 - DNA, 22 bp, Homo sapiens
tacatagcagactttcccaaat

SEQ ID NO: 5508325 - DNA, 22 bp, Homo sapiens
tacatagcatttgtgtaaagac

SEQ ID NO: 5508326 - DNA, 15 bp, Homo sapiens
tacatagcctatatt

SEQ ID NO: 5508327 - DNA, 23 bp, Homo sapiens
tacatagctttagagaagccata

SEQ ID NO: 5508328 - DNA, 14 bp, Homo sapiens
tacataggatggct

SEQ ID NO: 5508329 - DNA, 15 bp, Homo sapiens
tacataggcagcact

SEQ ID NO: 5508330 - DNA, 21 bp, Homo sapiens
tacatagggatatgcgtatta

SEQ ID NO: 5508331 - DNA, 16 bp, Homo sapiens
tacataggtctgtatg

SEQ ID NO: 5508332 - DNA, 22 bp, Homo sapiens
tacataggtctgtatggctgta

SEQ ID NO: 5508333 - DNA, 15 bp, Homo sapiens
tacatagtaaagtat

SEQ ID NO: 5508334 - DNA, 14 bp, Homo sapiens
tacatagtaaatgg

SEQ ID NO: 5508335 - DNA, 14 bp, Homo sapiens
tacatagtcacaaa

SEQ ID NO: 5508336 - DNA, 12 bp, Homo sapiens
tacatagtcctt

SEQ ID NO: 5508337 - DNA, 16 bp, Homo sapiens
tacatagtctgaagtg

SEQ ID NO: 5508338 - DNA, 12 bp, Homo sapiens
tacatagtcttt

SEQ ID NO: 5508339 - DNA, 13 bp, Homo sapiens
tacatagtctttg

SEQ ID NO: 5508340 - DNA, 22 bp, Homo sapiens
tacatagtgcattgtttctgtg

SEQ ID NO: 5508341 - DNA, 19 bp, Homo sapiens
tacatagtgctgctgtgtg

SEQ ID NO: 5508342 - DNA, 16 bp, Homo sapiens
tacatagtggtcattt

SEQ ID NO: 5508343 - DNA, 20 bp, Homo sapiens
tacatagttatttttctctt

SEQ ID NO: 5508344 - DNA, 16 bp, Homo sapiens
tacatagttgagattg

SEQ ID NO: 5508345 - DNA, 15 bp, Homo sapiens
tacatagttttaaac

SEQ ID NO: 5508346 - DNA, 19 bp, Homo sapiens
tacatataaagattaacac

SEQ ID NO: 5508347 - DNA, 19 bp, Homo sapiens
tacatataagtgattgctg

SEQ ID NO: 5508348 - DNA, 17 bp, Homo sapiens
tacatataataaataga

SEQ ID NO: 5508349 - DNA, 23 bp, Homo sapiens
tacatatataaaactaaggcttt

SEQ ID NO: 5508350 - DNA, 13 bp, Homo sapiens
tacatatatacat

SEQ ID NO: 5508351 - DNA, 20 bp, Homo sapiens
tacatatatacattttgcag

SEQ ID NO: 5508352 - DNA, 23 bp, Homo sapiens
tacatatatatatacacatacat

SEQ ID NO: 5508353 - DNA, 20 bp, Homo sapiens
tacatatatatatttgtaac

SEQ ID NO: 5508354 - DNA, 20 bp, Homo sapiens
tacatatatgtataatatat

SEQ ID NO: 5508355 - DNA, 22 bp, Homo sapiens
tacatatatgtataatatatat

SEQ ID NO: 5508356 - DNA, 15 bp, Homo sapiens
tacatatatttttaa

SEQ ID NO: 5508357 - DNA, 15 bp, Homo sapiens
tacatatcagaaaag

SEQ ID NO: 5508358 - DNA, 16 bp, Homo sapiens
tacatatcagaaaagt

SEQ ID NO: 5508359 - DNA, 20 bp, Homo sapiens
tacatatcagaaaagtagaa

SEQ ID NO: 5508360 - DNA, 23 bp, Homo sapiens
tacatatcctttggtcctggtgc

SEQ ID NO: 5508361 - DNA, 20 bp, Homo sapiens
tacatatcgctgacttcatg

SEQ ID NO: 5508362 - DNA, 14 bp, Homo sapiens
tacatatctgtccc

SEQ ID NO: 5508363 - DNA, 17 bp, Homo sapiens
tacatatctgtttagga

SEQ ID NO: 5508364 - DNA, 21 bp, Homo sapiens
tacatatgagaatatacctta

SEQ ID NO: 5508365 - DNA, 15 bp, Homo sapiens
tacatatgataaatt

SEQ ID NO: 5508366 - DNA, 15 bp, Homo sapiens
tacatatgatcaaat

SEQ ID NO: 5508367 - DNA, 16 bp, Homo sapiens
tacatatgatcaaata

SEQ ID NO: 5508368 - DNA, 19 bp, Homo sapiens
tacatatgatcaaatactc

SEQ ID NO: 5508369 - DNA, 18 bp, Homo sapiens
tacatatgctgatctttt

SEQ ID NO: 5508370 - DNA, 19 bp, Homo sapiens
tacatatgctgatctttta

SEQ ID NO: 5508371 - DNA, 17 bp, Homo sapiens
tacatatgctttaagaa

SEQ ID NO: 5508372 - DNA, 17 bp, Homo sapiens
tacatatggaaatatag

SEQ ID NO: 5508373 - DNA, 23 bp, Homo sapiens
tacatatggaaatcctgttactt

SEQ ID NO: 5508374 - DNA, 18 bp, Homo sapiens
tacatatggatgttactc

SEQ ID NO: 5508375 - DNA, 12 bp, Homo sapiens
tacatatgtaaa

SEQ ID NO: 5508376 - DNA, 16 bp, Homo sapiens
tacatatgtaaaataa

SEQ ID NO: 5508377 - DNA, 15 bp, Homo sapiens
tacatatgtaattct

SEQ ID NO: 5508378 - DNA, 16 bp, Homo sapiens
tacatatgtaattctt

SEQ ID NO: 5508379 - DNA, 20 bp, Homo sapiens
tacatatgtagaaacattta

SEQ ID NO: 5508380 - DNA, 19 bp, Homo sapiens
tacatatgtagactatata

SEQ ID NO: 5508381 - DNA, 20 bp, Homo sapiens
tacatatgtagactatatac

SEQ ID NO: 5508382 - DNA, 21 bp, Homo sapiens
tacatatgtagactatataca

SEQ ID NO: 5508383 - DNA, 23 bp, Homo sapiens
tacatatgtagactatatacatg

SEQ ID NO: 5508384 - DNA, 13 bp, Homo sapiens
tacatatgtatgt

SEQ ID NO: 5508385 - DNA, 22 bp, Homo sapiens
tacatatgtatgtgtgagtgta

SEQ ID NO: 5508386 - DNA, 21 bp, Homo sapiens
tacatatgttaataaactgca

SEQ ID NO: 5508387 - DNA, 15 bp, Homo sapiens
tacatattactgttg

SEQ ID NO: 5508388 - DNA, 18 bp, Homo sapiens
tacatattaggaaaatat

SEQ ID NO: 5508389 - DNA, 13 bp, Homo sapiens
tacatattcaaag

SEQ ID NO: 5508390 - DNA, 14 bp, Homo sapiens
tacatattcctttg

SEQ ID NO: 5508391 - DNA, 15 bp, Homo sapiens
tacatattctttaaa

SEQ ID NO: 5508392 - DNA, 12 bp, Homo sapiens
tacatattgaat

SEQ ID NO: 5508393 - DNA, 23 bp, Homo sapiens
tacatattgcaggagacattttc

SEQ ID NO: 5508394 - DNA, 14 bp, Homo sapiens
tacatattggaaag

SEQ ID NO: 5508395 - DNA, 15 bp, Homo sapiens
tacatattgtatata

SEQ ID NO: 5508396 - DNA, 22 bp, Homo sapiens
tacatattgttagggtcagcca

SEQ ID NO: 5508397 - DNA, 18 bp, Homo sapiens
tacatatttacctgtatt

SEQ ID NO: 5508398 - DNA, 19 bp, Homo sapiens
tacatatttgcatatgtat

SEQ ID NO: 5508399 - DNA, 16 bp, Homo sapiens
tacatatttgtggaat

SEQ ID NO: 5508400 - DNA, 16 bp, Homo sapiens
tacatattttttgtat

SEQ ID NO: 5508401 - DNA, 15 bp, Homo sapiens
tacatcaaaaatggg

SEQ ID NO: 5508402 - DNA, 19 bp, Homo sapiens
tacatcaacaagaagaaac

SEQ ID NO: 5508403 - DNA, 17 bp, Homo sapiens
tacatcaagtccatctg

SEQ ID NO: 5508404 - DNA, 20 bp, Homo sapiens
tacatcaagtccatctgaca

SEQ ID NO: 5508405 - DNA, 18 bp, Homo sapiens
tacatcaatgataatgct

SEQ ID NO: 5508406 - DNA, 20 bp, Homo sapiens
tacatcaatgataatgctaa

SEQ ID NO: 5508407 - DNA, 16 bp, Homo sapiens
tacatcacatcttatt

SEQ ID NO: 5508408 - DNA, 17 bp, Homo sapiens
tacatcacatcttattt

SEQ ID NO: 5508409 - DNA, 12 bp, Homo sapiens
tacatcactgct

SEQ ID NO: 5508410 - DNA, 13 bp, Homo sapiens
tacatcactgctt

SEQ ID NO: 5508411 - DNA, 23 bp, Homo sapiens
tacatcactgcttgatgaagcaa

SEQ ID NO: 5508412 - DNA, 13 bp, Homo sapiens
tacatcactttgt

SEQ ID NO: 5508413 - DNA, 20 bp, Homo sapiens
tacatcagaaaataaaatat

SEQ ID NO: 5508414 - DNA, 21 bp, Homo sapiens
tacatcagagtgtatttttgt

SEQ ID NO: 5508415 - DNA, 21 bp, Homo sapiens
tacatcagtatagtgttttat

SEQ ID NO: 5508416 - DNA, 18 bp, Homo sapiens
tacatcagttattcattc

SEQ ID NO: 5508417 - DNA, 14 bp, Homo sapiens
tacatcagtttgtt

SEQ ID NO: 5508418 - DNA, 15 bp, Homo sapiens
tacatcatcctcctt

SEQ ID NO: 5508419 - DNA, 13 bp, Homo sapiens
tacatcatttctt

SEQ ID NO: 5508420 - DNA, 20 bp, Homo sapiens
tacatcatttctttttggga

SEQ ID NO: 5508421 - DNA, 21 bp, Homo sapiens
tacatcattttttgtttcttc

SEQ ID NO: 5508422 - DNA, 20 bp, Homo sapiens
tacatcccaaaggatgagaa

SEQ ID NO: 5508423 - DNA, 15 bp, Homo sapiens
tacatcctcatgcag

SEQ ID NO: 5508424 - DNA, 13 bp, Homo sapiens
tacatcctctgct

SEQ ID NO: 5508425 - DNA, 20 bp, Homo sapiens
tacatcctgctttccctccc

SEQ ID NO: 5508426 - DNA, 22 bp, Homo sapiens
tacatcctgctttccctcccca

SEQ ID NO: 5508427 - DNA, 14 bp, Homo sapiens
tacatcctgggtaa

SEQ ID NO: 5508428 - DNA, 22 bp, Homo sapiens
tacatccttgattacttccact

SEQ ID NO: 5508429 - DNA, 19 bp, Homo sapiens
tacatcgtttactttttaa

SEQ ID NO: 5508430 - DNA, 14 bp, Homo sapiens
tacatctaagtcag

SEQ ID NO: 5508431 - DNA, 21 bp, Homo sapiens
tacatctaagtcagtttcaca

SEQ ID NO: 5508432 - DNA, 22 bp, Homo sapiens
tacatctattttggattgtata

SEQ ID NO: 5508433 - DNA, 13 bp, Homo sapiens
tacatctccaaat

SEQ ID NO: 5508434 - DNA, 19 bp, Homo sapiens
tacatctccttgatcatgt

SEQ ID NO: 5508435 - DNA, 18 bp, Homo sapiens
tacatctctaattttgga

SEQ ID NO: 5508436 - DNA, 16 bp, Homo sapiens
tacatctgaaatctac

SEQ ID NO: 5508437 - DNA, 18 bp, Homo sapiens
tacatctgatatcaggaa

SEQ ID NO: 5508438 - DNA, 20 bp, Homo sapiens
tacatctgatatcaggaaat

SEQ ID NO: 5508439 - DNA, 19 bp, Homo sapiens
tacatctgatgcatgcttt

SEQ ID NO: 5508440 - DNA, 23 bp, Homo sapiens
tacatctgcagctctttcttctt

SEQ ID NO: 5508441 - DNA, 13 bp, Homo sapiens
tacatctgcctta

SEQ ID NO: 5508442 - DNA, 12 bp, Homo sapiens
tacatctgctgt

SEQ ID NO: 5508443 - DNA, 14 bp, Homo sapiens
tacatctgctgtgt

SEQ ID NO: 5508444 - DNA, 16 bp, Homo sapiens
tacatctgctgtgtgg

SEQ ID NO: 5508445 - DNA, 13 bp, Homo sapiens
tacatctggctgg

SEQ ID NO: 5508446 - DNA, 13 bp, Homo sapiens
tacatctgtgatg

SEQ ID NO: 5508447 - DNA, 19 bp, Homo sapiens
tacatctgtgtatttgagt

SEQ ID NO: 5508448 - DNA, 18 bp, Homo sapiens
tacatcttataaactgac

SEQ ID NO: 5508449 - DNA, 13 bp, Homo sapiens
tacatcttcagct

SEQ ID NO: 5508450 - DNA, 23 bp, Homo sapiens
tacatcttctgtgaaatataatt

SEQ ID NO: 5508451 - DNA, 17 bp, Homo sapiens
tacatcttcttcccagt

SEQ ID NO: 5508452 - DNA, 15 bp, Homo sapiens
tacatcttgtgcatg

SEQ ID NO: 5508453 - DNA, 23 bp, Homo sapiens
tacatcttgttggtacctttcta

SEQ ID NO: 5508454 - DNA, 16 bp, Homo sapiens
tacatctttaaacagt

SEQ ID NO: 5508455 - DNA, 13 bp, Homo sapiens
tacatctttatta

SEQ ID NO: 5508456 - DNA, 15 bp, Homo sapiens
tacatctttcacatt

SEQ ID NO: 5508457 - DNA, 20 bp, Homo sapiens
tacatctttcacattggcta

SEQ ID NO: 5508458 - DNA, 17 bp, Homo sapiens
tacatcttttctaatca

SEQ ID NO: 5508459 - DNA, 14 bp, Homo sapiens
tacatcttttggga

SEQ ID NO: 5508460 - DNA, 15 bp, Homo sapiens
tacatcttttgggaa

SEQ ID NO: 5508461 - DNA, 18 bp, Homo sapiens
tacatcttttttcacaaa

SEQ ID NO: 5508462 - DNA, 20 bp, Homo sapiens
tacatcttttttcacaaatt

SEQ ID NO: 5508463 - DNA, 20 bp, Homo sapiens
tacatgaaatttttgtaaat

SEQ ID NO: 5508464 - DNA, 21 bp, Homo sapiens
tacatgaagagcagctggtca

SEQ ID NO: 5508465 - DNA, 14 bp, Homo sapiens
tacatgaagcagaa

SEQ ID NO: 5508466 - DNA, 23 bp, Homo sapiens
tacatgaagcagaaccttctttg

SEQ ID NO: 5508467 - DNA, 15 bp, Homo sapiens
tacatgaagtatttt

SEQ ID NO: 5508468 - DNA, 18 bp, Homo sapiens
tacatgaattgcatttta

SEQ ID NO: 5508469 - DNA, 18 bp, Homo sapiens
tacatgacactgaaatgc

SEQ ID NO: 5508470 - DNA, 15 bp, Homo sapiens
tacatgacatcaaaa

SEQ ID NO: 5508471 - DNA, 19 bp, Homo sapiens
tacatgacatcaaaatgag

SEQ ID NO: 5508472 - DNA, 16 bp, Homo sapiens
tacatgacatttattt

SEQ ID NO: 5508473 - DNA, 22 bp, Homo sapiens
tacatgaccagaaaacaaatct

SEQ ID NO: 5508474 - DNA, 18 bp, Homo sapiens
taccacccggtccccact

SEQ ID NO: 5508475 - DNA, 17 bp, Homo sapiens
taccaccctcgctgcca

SEQ ID NO: 5508476 - DNA, 20 bp, Homo sapiens
taccaccgtctgtctcagag

SEQ ID NO: 5508477 - DNA, 18 bp, Homo sapiens
taccacctcaggtgactt

SEQ ID NO: 5508478 - DNA, 13 bp, Homo sapiens
taccacctgtaca

SEQ ID NO: 5508479 - DNA, 15 bp, Homo sapiens
taccacctgtacata

SEQ ID NO: 5508480 - DNA, 16 bp, Homo sapiens
taccacctttactgtg

SEQ ID NO: 5508481 - DNA, 16 bp, Homo sapiens
taccacgaaatactta

SEQ ID NO: 5508482 - DNA, 16 bp, Homo sapiens
taccacgccttgacct

SEQ ID NO: 5508483 - DNA, 17 bp, Homo sapiens
taccacgccttgacctt

SEQ ID NO: 5508484 - DNA, 18 bp, Homo sapiens
taccacggcctcctttcc

SEQ ID NO: 5508485 - DNA, 15 bp, Homo sapiens
taccactaattttgt

SEQ ID NO: 5508486 - DNA, 22 bp, Homo sapiens
taccactacttagagatatgta

SEQ ID NO: 5508487 - DNA, 16 bp, Homo sapiens
taccactcacatgaca

SEQ ID NO: 5508488 - DNA, 13 bp, Homo sapiens
taccactctgtaa

SEQ ID NO: 5508489 - DNA, 15 bp, Homo sapiens
taccactctgtaatt

SEQ ID NO: 5508490 - DNA, 19 bp, Homo sapiens
taccactctgtaattgcaa

SEQ ID NO: 5508491 - DNA, 19 bp, Homo sapiens
taccactcttttgctgtgc

SEQ ID NO: 5508492 - DNA, 15 bp, Homo sapiens
taccactgaatctgt

SEQ ID NO: 5508493 - DNA, 19 bp, Homo sapiens
taccactgaatctgtacag

SEQ ID NO: 5508494 - DNA, 11 bp, Homo sapiens
taccactgcta

SEQ ID NO: 5508495 - DNA, 16 bp, Homo sapiens
taccactgctaataaa

SEQ ID NO: 5508496 - DNA, 17 bp, Homo sapiens
taccactgctgatattt

SEQ ID NO: 5508497 - DNA, 20 bp, Homo sapiens
taccactgctgatattttct

SEQ ID NO: 5508498 - DNA, 22 bp, Homo sapiens
taccactggtacttcctttctc

SEQ ID NO: 5508499 - DNA, 16 bp, Homo sapiens
taccactggtgtaaaa

SEQ ID NO: 5508500 - DNA, 21 bp, Homo sapiens
taccactggtgtatgaaatga

SEQ ID NO: 5508501 - DNA, 20 bp, Homo sapiens
taccactgtggccccaagag

SEQ ID NO: 5508502 - DNA, 15 bp, Homo sapiens
taccacttacctcaa

SEQ ID NO: 5508503 - DNA, 20 bp, Homo sapiens
taccacttacctcaaattaa

SEQ ID NO: 5508504 - DNA, 17 bp, Homo sapiens
taccacttcctgaggcc

SEQ ID NO: 5508505 - DNA, 19 bp, Homo sapiens
taccacttctgtgggcatg

SEQ ID NO: 5508506 - DNA, 21 bp, Homo sapiens
taccacttctgtgggcatggc

SEQ ID NO: 5508507 - DNA, 15 bp, Homo sapiens
taccactttcttatt

SEQ ID NO: 5508508 - DNA, 21 bp, Homo sapiens
taccactttcttattctgtat

SEQ ID NO: 5508509 - DNA, 17 bp, Homo sapiens
taccagaaatatttgct

SEQ ID NO: 5508510 - DNA, 18 bp, Homo sapiens
taccagaagcaaggtctc

SEQ ID NO: 5508511 - DNA, 16 bp, Homo sapiens
taccagaagggcttca

SEQ ID NO: 5508512 - DNA, 22 bp, Homo sapiens
taccagaagtttaaatctttgt

SEQ ID NO: 5508513 - DNA, 23 bp, Homo sapiens
taccagacggttcaccagcctct

SEQ ID NO: 5508514 - DNA, 14 bp, Homo sapiens
taccagactgcagg

SEQ ID NO: 5508515 - DNA, 12 bp, Homo sapiens
taccagagaagg

SEQ ID NO: 5508516 - DNA, 15 bp, Homo sapiens
taccagagctagttt

SEQ ID NO: 5508517 - DNA, 19 bp, Homo sapiens
taccagaggttgtgcactg

SEQ ID NO: 5508518 - DNA, 18 bp, Homo sapiens
taccagagttaaagcata

SEQ ID NO: 5508519 - DNA, 23 bp, Homo sapiens
taccagataacttttttttttct

SEQ ID NO: 5508520 - DNA, 21 bp, Homo sapiens
taccagatagttatattaaat

SEQ ID NO: 5508521 - DNA, 14 bp, Homo sapiens
taccagatatttga

SEQ ID NO: 5508522 - DNA, 16 bp, Homo sapiens
taccagatatttgaat

SEQ ID NO: 5508523 - DNA, 16 bp, Homo sapiens
taccagatgaacattt

SEQ ID NO: 5508524 - DNA, 17 bp, Homo sapiens
taccagatgaacatttc

SEQ ID NO: 5508525 - DNA, 12 bp, Homo sapiens
taccagatgcta

SEQ ID NO: 5508526 - DNA, 21 bp, Homo sapiens
taccagatgctactggacttg

SEQ ID NO: 5508527 - DNA, 22 bp, Homo sapiens
taccagcaaagagaatgtattt

SEQ ID NO: 5508528 - DNA, 16 bp, Homo sapiens
taccagcaaagcaaat

SEQ ID NO: 5508529 - DNA, 12 bp, Homo sapiens
taccagcagagc

SEQ ID NO: 5508530 - DNA, 13 bp, Homo sapiens
taccagcagagca

SEQ ID NO: 5508531 - DNA, 15 bp, Homo sapiens
taccagcagcaactg

SEQ ID NO: 5508532 - DNA, 16 bp, Homo sapiens
taccagcagcaactga

SEQ ID NO: 5508533 - DNA, 23 bp, Homo sapiens
taccagcagcaactgaaaatgaa

SEQ ID NO: 5508534 - DNA, 15 bp, Homo sapiens
taccagcatttgtcc

SEQ ID NO: 5508535 - DNA, 14 bp, Homo sapiens
taccagccacgggc

SEQ ID NO: 5508536 - DNA, 11 bp, Homo sapiens
taccagccact

SEQ ID NO: 5508537 - DNA, 12 bp, Homo sapiens
taccagccagcc

SEQ ID NO: 5508538 - DNA, 15 bp, Homo sapiens
taccagccagcctca

SEQ ID NO: 5508539 - DNA, 18 bp, Homo sapiens
taccagccagtaaatggg

SEQ ID NO: 5508540 - DNA, 13 bp, Homo sapiens
taccagcccaggc

SEQ ID NO: 5508541 - DNA, 19 bp, Homo sapiens
taccagccctggggctggg

SEQ ID NO: 5508542 - DNA, 20 bp, Homo sapiens
taccagccctggggctgggc

SEQ ID NO: 5508543 - DNA, 13 bp, Homo sapiens
taccagcgaggag

SEQ ID NO: 5508544 - DNA, 15 bp, Homo sapiens
taccagcgaggaggc

SEQ ID NO: 5508545 - DNA, 17 bp, Homo sapiens
taccagcgcccgctggg

SEQ ID NO: 5508546 - DNA, 20 bp, Homo sapiens
taccagcgcccgctgggctg

SEQ ID NO: 5508547 - DNA, 23 bp, Homo sapiens
taccagcggggacaccaatggct

SEQ ID NO: 5508548 - DNA, 22 bp, Homo sapiens
taccagcgtatatataagaaag

SEQ ID NO: 5508549 - DNA, 21 bp, Homo sapiens
taccagctaactccagtctcc

SEQ ID NO: 5508550 - DNA, 17 bp, Homo sapiens
taccagctaccctgtgt

SEQ ID NO: 5508551 - DNA, 17 bp, Homo sapiens
taccagctcactccctg

SEQ ID NO: 5508552 - DNA, 19 bp, Homo sapiens
taccagctcactccctggg

SEQ ID NO: 5508553 - DNA, 13 bp, Homo sapiens
taccagctcaggg

SEQ ID NO: 5508554 - DNA, 11 bp, Homo sapiens
taccagctcct

SEQ ID NO: 5508555 - DNA, 13 bp, Homo sapiens
taccagctcctcc

SEQ ID NO: 5508556 - DNA, 21 bp, Homo sapiens
taccagctgcgcttgcttttc

SEQ ID NO: 5508557 - DNA, 16 bp, Homo sapiens
taccaggatgctaaag

SEQ ID NO: 5508558 - DNA, 17 bp, Homo sapiens
taccaggcaacctccca

SEQ ID NO: 5508559 - DNA, 16 bp, Homo sapiens
taccaggcacatggct

SEQ ID NO: 5508560 - DNA, 17 bp, Homo sapiens
taccaggcaccaaaaga

SEQ ID NO: 5508561 - DNA, 18 bp, Homo sapiens
taccaggcaccaaaagaa

SEQ ID NO: 5508562 - DNA, 11 bp, Homo sapiens
taccaggccac

SEQ ID NO: 5508563 - DNA, 14 bp, Homo sapiens
taccaggccaccca

SEQ ID NO: 5508564 - DNA, 22 bp, Homo sapiens
taccaggccgccccagcctctg

SEQ ID NO: 5508565 - DNA, 17 bp, Homo sapiens
taccagggatgtagatt

SEQ ID NO: 5508566 - DNA, 18 bp, Homo sapiens
taccaggggaggcagtgt

SEQ ID NO: 5508567 - DNA, 20 bp, Homo sapiens
taccaggtctcctccaccgc

SEQ ID NO: 5508568 - DNA, 16 bp, Homo sapiens
taccagtaaagtgtaa

SEQ ID NO: 5508569 - DNA, 16 bp, Homo sapiens
taccagtatctccatc

SEQ ID NO: 5508570 - DNA, 18 bp, Homo sapiens
taccagtatttaacttct

SEQ ID NO: 5508571 - DNA, 15 bp, Homo sapiens
taccagtatttagaa

SEQ ID NO: 5508572 - DNA, 20 bp, Homo sapiens
taccagtatttagaagccaa

SEQ ID NO: 5508573 - DNA, 16 bp, Homo sapiens
taccagtcaatgcatt

SEQ ID NO: 5508574 - DNA, 17 bp, Homo sapiens
taccagtcgccctctgt

SEQ ID NO: 5508575 - DNA, 19 bp, Homo sapiens
taccagtcgccctctgtgc

SEQ ID NO: 5508576 - DNA, 21 bp, Homo sapiens
taccagtcgccctctgtgcct

SEQ ID NO: 5508577 - DNA, 22 bp, Homo sapiens
taccagtcgccctctgtgccta

SEQ ID NO: 5508578 - DNA, 15 bp, Homo sapiens
taccagtctatttcc

SEQ ID NO: 5508579 - DNA, 14 bp, Homo sapiens
taccagtctcacat

SEQ ID NO: 5508580 - DNA, 13 bp, Homo sapiens
taccagtctgatt

SEQ ID NO: 5508581 - DNA, 23 bp, Homo sapiens
taccagtctttaaaggcccagcc

SEQ ID NO: 5508582 - DNA, 18 bp, Homo sapiens
taccagtgaaaaaatgta

SEQ ID NO: 5508583 - DNA, 13 bp, Homo sapiens
taccagtgaattt

SEQ ID NO: 5508584 - DNA, 19 bp, Homo sapiens
taccagtgaatttttgcaa

SEQ ID NO: 5508585 - DNA, 20 bp, Homo sapiens
taccagtgaatttttgcaat

SEQ ID NO: 5508586 - DNA, 21 bp, Homo sapiens
taccagtgaatttttgcaata

SEQ ID NO: 5508587 - DNA, 17 bp, Homo sapiens
taccagtgacgctgctg

SEQ ID NO: 5508588 - DNA, 15 bp, Homo sapiens
taccagtgagtggcc

SEQ ID NO: 5508589 - DNA, 18 bp, Homo sapiens
taccagtgagtggcccca

SEQ ID NO: 5508590 - DNA, 19 bp, Homo sapiens
taccagtgcaggctggcca

SEQ ID NO: 5508591 - DNA, 13 bp, Homo sapiens
taccagtgtactg

SEQ ID NO: 5508592 - DNA, 20 bp, Homo sapiens
taccagtgttaataaatgga

SEQ ID NO: 5508593 - DNA, 17 bp, Homo sapiens
taccagtgttgggtttt

SEQ ID NO: 5508594 - DNA, 19 bp, Homo sapiens
taccagttaatttttccaa

SEQ ID NO: 5508595 - DNA, 18 bp, Homo sapiens
taccagttcagacactac

SEQ ID NO: 5508596 - DNA, 14 bp, Homo sapiens
taccagttcttgca

SEQ ID NO: 5508597 - DNA, 12 bp, Homo sapiens
taccagttgcct

SEQ ID NO: 5508598 - DNA, 16 bp, Homo sapiens
taccagttggcagaca

SEQ ID NO: 5508599 - DNA, 15 bp, Homo sapiens
taccagtttctttgt

SEQ ID NO: 5508600 - DNA, 21 bp, Homo sapiens
taccataaaatgtcagcaaat

SEQ ID NO: 5508601 - DNA, 15 bp, Homo sapiens
taccataaagccttt

SEQ ID NO: 5508602 - DNA, 16 bp, Homo sapiens
taccataaagccttta

SEQ ID NO: 5508603 - DNA, 17 bp, Homo sapiens
taccataagggactgtg

SEQ ID NO: 5508604 - DNA, 15 bp, Homo sapiens
taccataatcttaga

SEQ ID NO: 5508605 - DNA, 14 bp, Homo sapiens
taccatacagacag

SEQ ID NO: 5508606 - DNA, 16 bp, Homo sapiens
taccatactcatttct

SEQ ID NO: 5508607 - DNA, 20 bp, Homo sapiens
taccatagaaaaatgtataa

SEQ ID NO: 5508608 - DNA, 14 bp, Homo sapiens
taccatagaacaga

SEQ ID NO: 5508609 - DNA, 20 bp, Homo sapiens
taccatagcttaagaagtat

SEQ ID NO: 5508610 - DNA, 16 bp, Homo sapiens
taccatatacagctca

SEQ ID NO: 5508611 - DNA, 19 bp, Homo sapiens
taccatatgaatgaaacat

SEQ ID NO: 5508612 - DNA, 16 bp, Homo sapiens
taccatattgctctta

SEQ ID NO: 5508613 - DNA, 18 bp, Homo sapiens
taccatattgctcttaaa

SEQ ID NO: 5508614 - DNA, 20 bp, Homo sapiens
taccatattgctcttaaaaa

SEQ ID NO: 5508615 - DNA, 15 bp, Homo sapiens
taccatcaaacaaat

SEQ ID NO: 5508616 - DNA, 22 bp, Homo sapiens
taccatcaaatgttaacagagt

SEQ ID NO: 5508617 - DNA, 16 bp, Homo sapiens
taccatcaataaagta

SEQ ID NO: 5508618 - DNA, 16 bp, Homo sapiens
taccatcagctctgcc

SEQ ID NO: 5508619 - DNA, 18 bp, Homo sapiens
taccatcagctctgcctt

SEQ ID NO: 5508620 - DNA, 18 bp, Homo sapiens
taccatcagggacaggat

SEQ ID NO: 5508621 - DNA, 17 bp, Homo sapiens
taccatcatctctgaag

SEQ ID NO: 5508622 - DNA, 14 bp, Homo sapiens
taccatcattttat

SEQ ID NO: 5508623 - DNA, 14 bp, Homo sapiens
taccatcccactga

SEQ ID NO: 5508624 - DNA, 17 bp, Homo sapiens
taccatcccctgtagag

SEQ ID NO: 5508625 - DNA, 16 bp, Homo sapiens
taccatcggtcagcag

SEQ ID NO: 5508626 - DNA, 17 bp, Homo sapiens
taccatctgatgtttca

SEQ ID NO: 5508627 - DNA, 14 bp, Homo sapiens
taccatctgcatgg

SEQ ID NO: 5508628 - DNA, 16 bp, Homo sapiens
taccatcttaatcttt

SEQ ID NO: 5508629 - DNA, 13 bp, Homo sapiens
taccatcttctgt

SEQ ID NO: 5508630 - DNA, 16 bp, Homo sapiens
taccatgaattcttga

SEQ ID NO: 5508631 - DNA, 16 bp, Homo sapiens
taccatgacatgaaga

SEQ ID NO: 5508632 - DNA, 18 bp, Homo sapiens
taccatgagaaatcatgc

SEQ ID NO: 5508633 - DNA, 20 bp, Homo sapiens
taccatgagaagagggcctg

SEQ ID NO: 5508634 - DNA, 15 bp, Homo sapiens
taccatgatgcatgg

SEQ ID NO: 5508635 - DNA, 19 bp, Homo sapiens
taccatgatgctgagcccg

SEQ ID NO: 5508636 - DNA, 22 bp, Homo sapiens
taccatgctgctttttggcaca

SEQ ID NO: 5508637 - DNA, 15 bp, Homo sapiens
taccatgggtgtgga

SEQ ID NO: 5508638 - DNA, 17 bp, Homo sapiens
taccatgggtgtggatg

SEQ ID NO: 5508639 - DNA, 21 bp, Homo sapiens
taccatgggtgtggatggcag

SEQ ID NO: 5508640 - DNA, 14 bp, Homo sapiens
taccatgtaaataa

SEQ ID NO: 5508641 - DNA, 16 bp, Homo sapiens
taccatgtaaataatc

SEQ ID NO: 5508642 - DNA, 18 bp, Homo sapiens
taccatgtaatggcagtt

SEQ ID NO: 5508643 - DNA, 14 bp, Homo sapiens
taccatgtcactgt

SEQ ID NO: 5508644 - DNA, 16 bp, Homo sapiens
taccatgtcactgtgg

SEQ ID NO: 5508645 - DNA, 15 bp, Homo sapiens
taccatgttaaagag

SEQ ID NO: 5508646 - DNA, 20 bp, Homo sapiens
taccatgttaatacatcatt

SEQ ID NO: 5508647 - DNA, 14 bp, Homo sapiens
taccattaaaatat

SEQ ID NO: 5508648 - DNA, 17 bp, Homo sapiens
taccattaaaatatgca

SEQ ID NO: 5508649 - DNA, 15 bp, Homo sapiens
taccattaaaccatc

SEQ ID NO: 5508650 - DNA, 22 bp, Homo sapiens
taccattaattacatacagatt

SEQ ID NO: 5508651 - DNA, 23 bp, Homo sapiens
taccattatggataaagatgaga

SEQ ID NO: 5508652 - DNA, 21 bp, Homo sapiens
taccattatggctttgtgctt

SEQ ID NO: 5508653 - DNA, 13 bp, Homo sapiens
tacctactttgac

SEQ ID NO: 5508654 - DNA, 21 bp, Homo sapiens
tacctactttgactttttgca

SEQ ID NO: 5508655 - DNA, 18 bp, Homo sapiens
tacctagctaattattta

SEQ ID NO: 5508656 - DNA, 15 bp, Homo sapiens
tacctagtgaaactt

SEQ ID NO: 5508657 - DNA, 16 bp, Homo sapiens
tacctagtgaaacttt

SEQ ID NO: 5508658 - DNA, 19 bp, Homo sapiens
tacctataaagtaaagcta

SEQ ID NO: 5508659 - DNA, 13 bp, Homo sapiens
tacctataaatgg

SEQ ID NO: 5508660 - DNA, 17 bp, Homo sapiens
tacctataaatggactt

SEQ ID NO: 5508661 - DNA, 21 bp, Homo sapiens
tacctataaatggacttgctt

SEQ ID NO: 5508662 - DNA, 17 bp, Homo sapiens
tacctataatgtgtgta

SEQ ID NO: 5508663 - DNA, 18 bp, Homo sapiens
tacctataatgtgtgtat

SEQ ID NO: 5508664 - DNA, 19 bp, Homo sapiens
tacctataatgtgtgtatg

SEQ ID NO: 5508665 - DNA, 15 bp, Homo sapiens
tacctatctgtggaa

SEQ ID NO: 5508666 - DNA, 20 bp, Homo sapiens
tacctatctgtggaaagcta

SEQ ID NO: 5508667 - DNA, 20 bp, Homo sapiens
tacctatgacttttttaaac

SEQ ID NO: 5508668 - DNA, 21 bp, Homo sapiens
tacctatgacttttttaaact

SEQ ID NO: 5508669 - DNA, 15 bp, Homo sapiens
tacctatgtgaaact

SEQ ID NO: 5508670 - DNA, 21 bp, Homo sapiens
tacctattctgaaaaagacat

SEQ ID NO: 5508671 - DNA, 18 bp, Homo sapiens
tacctattgctgtaaata

SEQ ID NO: 5508672 - DNA, 12 bp, Homo sapiens
tacctatttctg

SEQ ID NO: 5508673 - DNA, 18 bp, Homo sapiens
tacctatttctgatgatg

SEQ ID NO: 5508674 - DNA, 15 bp, Homo sapiens
tacctcaaaacactt

SEQ ID NO: 5508675 - DNA, 16 bp, Homo sapiens
tacctcaaaacacttt

SEQ ID NO: 5508676 - DNA, 14 bp, Homo sapiens
tacctcaaactatc

SEQ ID NO: 5508677 - DNA, 18 bp, Homo sapiens
tacctcaaagggcagttt

SEQ ID NO: 5508678 - DNA, 19 bp, Homo sapiens
tacctcaaagggcagtttt

SEQ ID NO: 5508679 - DNA, 19 bp, Homo sapiens
tacctcaaatgaattcttt

SEQ ID NO: 5508680 - DNA, 16 bp, Homo sapiens
tacctcaacctgtaaa

SEQ ID NO: 5508681 - DNA, 22 bp, Homo sapiens
tacctcaacctgtaaattattt

SEQ ID NO: 5508682 - DNA, 13 bp, Homo sapiens
tacctcaatgttt

SEQ ID NO: 5508683 - DNA, 15 bp, Homo sapiens
tacctcaatttttgt

SEQ ID NO: 5508684 - DNA, 18 bp, Homo sapiens
tacctcaatttttgtttt

SEQ ID NO: 5508685 - DNA, 15 bp, Homo sapiens
tacctcaccctgcta

SEQ ID NO: 5508686 - DNA, 13 bp, Homo sapiens
tacctcactgtcc

SEQ ID NO: 5508687 - DNA, 20 bp, Homo sapiens
tacctcactttggttttggg

SEQ ID NO: 5508688 - DNA, 17 bp, Homo sapiens
tacctcagaacataaaa

SEQ ID NO: 5508689 - DNA, 18 bp, Homo sapiens
tacctcagataatatgtt

SEQ ID NO: 5508690 - DNA, 13 bp, Homo sapiens
tacctcagcctgg

SEQ ID NO: 5508691 - DNA, 14 bp, Homo sapiens
tacctcagcctggg

SEQ ID NO: 5508692 - DNA, 14 bp, Homo sapiens
tacctcaggaaaga

SEQ ID NO: 5508693 - DNA, 16 bp, Homo sapiens
tacctcaggaaagaat

SEQ ID NO: 5508694 - DNA, 16 bp, Homo sapiens
tacctcaggcagctca

SEQ ID NO: 5508695 - DNA, 19 bp, Homo sapiens
tacctcaggtgccaaccca

SEQ ID NO: 5508696 - DNA, 17 bp, Homo sapiens
tacctcagtgctcctgg

SEQ ID NO: 5508697 - DNA, 20 bp, Homo sapiens
tacctcagtgctcctggaaa

SEQ ID NO: 5508698 - DNA, 20 bp, Homo sapiens
tacctcagtggatcttcaga

SEQ ID NO: 5508699 - DNA, 22 bp, Homo sapiens
tacctcagttccacggttgcta

SEQ ID NO: 5508700 - DNA, 19 bp, Homo sapiens
tacctcatcatccacccgc

SEQ ID NO: 5508701 - DNA, 20 bp, Homo sapiens
tacctcatcatccacccgct

SEQ ID NO: 5508702 - DNA, 20 bp, Homo sapiens
tacctcatccatgcacttta

SEQ ID NO: 5508703 - DNA, 13 bp, Homo sapiens
tacctcatgttta

SEQ ID NO: 5508704 - DNA, 15 bp, Homo sapiens
tacctcatgtttatg

SEQ ID NO: 5508705 - DNA, 18 bp, Homo sapiens
tacctcatgtttatgaaa

SEQ ID NO: 5508706 - DNA, 20 bp, Homo sapiens
tacctcatgtttatgaaaat

SEQ ID NO: 5508707 - DNA, 23 bp, Homo sapiens
tacctcattcacagctccttgtg

SEQ ID NO: 5508708 - DNA, 19 bp, Homo sapiens
tacctcattcgcctgtggg

SEQ ID NO: 5508709 - DNA, 13 bp, Homo sapiens
tacctcatttgca

SEQ ID NO: 5508710 - DNA, 15 bp, Homo sapiens
tacctcatttgcatc

SEQ ID NO: 5508711 - DNA, 16 bp, Homo sapiens
tacctcatttttcata

SEQ ID NO: 5508712 - DNA, 16 bp, Homo sapiens
tacctccaaaaaagaa

SEQ ID NO: 5508713 - DNA, 17 bp, Homo sapiens
tacctccaaaaaagaaa

SEQ ID NO: 5508714 - DNA, 16 bp, Homo sapiens
tacctccaaccctgcc

SEQ ID NO: 5508715 - DNA, 14 bp, Homo sapiens
tacctcccacactc

SEQ ID NO: 5508716 - DNA, 22 bp, Homo sapiens
tacctcccctccccgccccctg

SEQ ID NO: 5508717 - DNA, 13 bp, Homo sapiens
tacctcccctgcc

SEQ ID NO: 5508718 - DNA, 15 bp, Homo sapiens
tacctcccctgccag

SEQ ID NO: 5508719 - DNA, 15 bp, Homo sapiens
tacctcccctgcctt

SEQ ID NO: 5508720 - DNA, 17 bp, Homo sapiens
tacctcccctgccttgc

SEQ ID NO: 5508721 - DNA, 18 bp, Homo sapiens
tacctccccttttctatg

SEQ ID NO: 5508722 - DNA, 11 bp, Homo sapiens
tacctccctcc

SEQ ID NO: 5508723 - DNA, 12 bp, Homo sapiens
tacctccctcct

SEQ ID NO: 5508724 - DNA, 19 bp, Homo sapiens
tacctccctcctgatgttt

SEQ ID NO: 5508725 - DNA, 17 bp, Homo sapiens
tacctcctaatggcatg

SEQ ID NO: 5508726 - DNA, 20 bp, Homo sapiens
tacctcctaatggcatggag

SEQ ID NO: 5508727 - DNA, 15 bp, Homo sapiens
tacctcctcagggat

SEQ ID NO: 5508728 - DNA, 18 bp, Homo sapiens
tacctcctcctttgttta

SEQ ID NO: 5508729 - DNA, 13 bp, Homo sapiens
tacctcctctcag

SEQ ID NO: 5508730 - DNA, 14 bp, Homo sapiens
tacctcctgagaaa

SEQ ID NO: 5508731 - DNA, 13 bp, Homo sapiens
tacctcctgccca

SEQ ID NO: 5508732 - DNA, 15 bp, Homo sapiens
tacctcctgcccagg

SEQ ID NO: 5508733 - DNA, 19 bp, Homo sapiens
tacctccttagctttccct

SEQ ID NO: 5508734 - DNA, 23 bp, Homo sapiens
tacctccttagctttccctgtgc

SEQ ID NO: 5508735 - DNA, 16 bp, Homo sapiens
tacctcgaacatcagt

SEQ ID NO: 5508736 - DNA, 22 bp, Homo sapiens
tacctcgagtggcgagtccaga

SEQ ID NO: 5508737 - DNA, 14 bp, Homo sapiens
tacctcgccgagct

SEQ ID NO: 5508738 - DNA, 15 bp, Homo sapiens
tacctcggggagagg

SEQ ID NO: 5508739 - DNA, 19 bp, Homo sapiens
tacctcggggagaggggga

SEQ ID NO: 5508740 - DNA, 18 bp, Homo sapiens
tacctctaacaccacact

SEQ ID NO: 5508741 - DNA, 21 bp, Homo sapiens
tacctctaataaacactgttt

SEQ ID NO: 5508742 - DNA, 17 bp, Homo sapiens
tacctctaatagtataa

SEQ ID NO: 5508743 - DNA, 19 bp, Homo sapiens
tacctctaatagtataaac

SEQ ID NO: 5508744 - DNA, 18 bp, Homo sapiens
tacctctagctgttcttt

SEQ ID NO: 5508745 - DNA, 21 bp, Homo sapiens
tacctctagctgttctttttt

SEQ ID NO: 5508746 - DNA, 15 bp, Homo sapiens
tacctctatatacca

SEQ ID NO: 5508747 - DNA, 21 bp, Homo sapiens
tacctctcaagctagtgtttc

SEQ ID NO: 5508748 - DNA, 15 bp, Homo sapiens
tacctctcattagaa

SEQ ID NO: 5508749 - DNA, 19 bp, Homo sapiens
tacctctcgtttctgccca

SEQ ID NO: 5508750 - DNA, 20 bp, Homo sapiens
tacctctcgtttctgcccag

SEQ ID NO: 5508751 - DNA, 16 bp, Homo sapiens
tacctctctctgctcc

SEQ ID NO: 5508752 - DNA, 19 bp, Homo sapiens
tacctctctctgctcctca

SEQ ID NO: 5508753 - DNA, 20 bp, Homo sapiens
tacctctctgtcccttgctg

SEQ ID NO: 5508754 - DNA, 13 bp, Homo sapiens
tacctctgagaag

SEQ ID NO: 5508755 - DNA, 15 bp, Homo sapiens
tacctctgatacctc

SEQ ID NO: 5508756 - DNA, 21 bp, Homo sapiens
tacctctggctgactaaattt

SEQ ID NO: 5508757 - DNA, 13 bp, Homo sapiens
tacctctgtatag

SEQ ID NO: 5508758 - DNA, 13 bp, Homo sapiens
tacctctgtgcca

SEQ ID NO: 5508759 - DNA, 14 bp, Homo sapiens
tacctctgtgccag

SEQ ID NO: 5508760 - DNA, 19 bp, Homo sapiens
tacctctgtgccagggcag

SEQ ID NO: 5508761 - DNA, 18 bp, Homo sapiens
tacctcttactttgcttg

SEQ ID NO: 5508762 - DNA, 21 bp, Homo sapiens
tacctcttactttgcttgaga

SEQ ID NO: 5508763 - DNA, 14 bp, Homo sapiens
tacctcttagctga

SEQ ID NO: 5508764 - DNA, 16 bp, Homo sapiens
tacctcttcacctgac

SEQ ID NO: 5508765 - DNA, 19 bp, Homo sapiens
tacctcttccaggaagcac

SEQ ID NO: 5508766 - DNA, 20 bp, Homo sapiens
tacctcttccgttggaaaga

SEQ ID NO: 5508767 - DNA, 21 bp, Homo sapiens
tacctcttccgttggaaagaa

SEQ ID NO: 5508768 - DNA, 22 bp, Homo sapiens
tacctcttccgttggaaagaac

SEQ ID NO: 5508769 - DNA, 19 bp, Homo sapiens
tacctctttattttttgat

SEQ ID NO: 5508770 - DNA, 16 bp, Homo sapiens
tacctctttgaaagaa

SEQ ID NO: 5508771 - DNA, 17 bp, Homo sapiens
tacctgaacaggaatcc

SEQ ID NO: 5508772 - DNA, 12 bp, Homo sapiens
tacctgaacatt

SEQ ID NO: 5508773 - DNA, 16 bp, Homo sapiens
tacctgaaggcagggc

SEQ ID NO: 5508774 - DNA, 18 bp, Homo sapiens
tacctgaaggggttttct

SEQ ID NO: 5508775 - DNA, 20 bp, Homo sapiens
tacctgacctcttgctgtct

SEQ ID NO: 5508776 - DNA, 22 bp, Homo sapiens
tacctgacctcttgctgtctct

SEQ ID NO: 5508777 - DNA, 20 bp, Homo sapiens
tacctgacggacgtcctgct

SEQ ID NO: 5508778 - DNA, 24 bp, Homo sapiens
tacctgagatctatatggagctta

SEQ ID NO: 5508779 - DNA, 21 bp, Homo sapiens
tacctgaggcctatctgagac

SEQ ID NO: 5508780 - DNA, 16 bp, Homo sapiens
tacctgataagggaga

SEQ ID NO: 5508781 - DNA, 23 bp, Homo sapiens
tacctgatggaagtaaagcctca

SEQ ID NO: 5508782 - DNA, 21 bp, Homo sapiens
tacctgattgatcacacagtg

SEQ ID NO: 5508783 - DNA, 23 bp, Homo sapiens
tacctgattgatcacacagtgtt

SEQ ID NO: 5508784 - DNA, 17 bp, Homo sapiens
tacctgattgtattttt

SEQ ID NO: 5508785 - DNA, 14 bp, Homo sapiens
tacctgatttcagc

SEQ ID NO: 5508786 - DNA, 21 bp, Homo sapiens
tacctgatttcttcagggctg

SEQ ID NO: 5508787 - DNA, 12 bp, Homo sapiens
tacctgattttt

SEQ ID NO: 5508788 - DNA, 15 bp, Homo sapiens
tacctgcaaaaatga

SEQ ID NO: 5508789 - DNA, 13 bp, Homo sapiens
tacctgcacgttc

SEQ ID NO: 5508790 - DNA, 22 bp, Homo sapiens
tacctgcacgttcataaccaac

SEQ ID NO: 5508791 - DNA, 17 bp, Homo sapiens
tacctgcaggcggggct

SEQ ID NO: 5508792 - DNA, 19 bp, Homo sapiens
tacctgcaggcggggctcc

SEQ ID NO: 5508793 - DNA, 20 bp, Homo sapiens
tacctgcaggcggggctcct

SEQ ID NO: 5508794 - DNA, 23 bp, Homo sapiens
tacctgcaggcggggctcctcct

SEQ ID NO: 5508795 - DNA, 13 bp, Homo sapiens
tacctgcaggctc

SEQ ID NO: 5508796 - DNA, 14 bp, Homo sapiens
tacctgcaggctcc

SEQ ID NO: 5508797 - DNA, 16 bp, Homo sapiens
tacctgcaggctccat

SEQ ID NO: 5508798 - DNA, 20 bp, Homo sapiens
tacctgcaggctccatgcac

SEQ ID NO: 5508799 - DNA, 16 bp, Homo sapiens
tacctgccactcacac

SEQ ID NO: 5508800 - DNA, 21 bp, Homo sapiens
tacctgccactcacacagcca

SEQ ID NO: 5508801 - DNA, 18 bp, Homo sapiens
tacctgccaggaagccag

SEQ ID NO: 5508802 - DNA, 20 bp, Homo sapiens
tacctgccaggaagccagca

SEQ ID NO: 5508803 - DNA, 20 bp, Homo sapiens
tacctgccccacttgtcctt

SEQ ID NO: 5508804 - DNA, 20 bp, Homo sapiens
tacctgcccccactcagcat

SEQ ID NO: 5508805 - DNA, 12 bp, Homo sapiens
tacctgccctct

SEQ ID NO: 5508806 - DNA, 24 bp, Homo sapiens
tacctgccctctatttattagcca

SEQ ID NO: 5508807 - DNA, 13 bp, Homo sapiens
tacctgccctgga

SEQ ID NO: 5508808 - DNA, 15 bp, Homo sapiens
tacctgcctgttctc

SEQ ID NO: 5508809 - DNA, 22 bp, Homo sapiens
tacctgcctgttctccagatgg

SEQ ID NO: 5508810 - DNA, 16 bp, Homo sapiens
tacctgccttgcctgt

SEQ ID NO: 5508811 - DNA, 11 bp, Homo sapiens
tacctgctgct

SEQ ID NO: 5508812 - DNA, 15 bp, Homo sapiens
tacctgctggaagaa

SEQ ID NO: 5508813 - DNA, 21 bp, Homo sapiens
tacctgctggaagaattctag

SEQ ID NO: 5508814 - DNA, 15 bp, Homo sapiens
tacctgctggacagc

SEQ ID NO: 5508815 - DNA, 13 bp, Homo sapiens
tacctgcttgagc

SEQ ID NO: 5508816 - DNA, 23 bp, Homo sapiens
tacctgcttgagctttctgtgca

SEQ ID NO: 5508817 - DNA, 17 bp, Homo sapiens
tacctggaaacagcttt

SEQ ID NO: 5508818 - DNA, 14 bp, Homo sapiens
tacctggaatgtgt

SEQ ID NO: 5508819 - DNA, 23 bp, Homo sapiens
tacctggagaagaatggctttca

SEQ ID NO: 5508820 - DNA, 22 bp, Homo sapiens
tacctggatccagccattcctg

SEQ ID NO: 5508821 - DNA, 22 bp, Homo sapiens
tacctggccggtaggctgctgg

SEQ ID NO: 5508822 - DNA, 15 bp, Homo sapiens
tacctggcctagaaa

SEQ ID NO: 5508823 - DNA, 18 bp, Homo sapiens
tacctgggaaaggaccca

SEQ ID NO: 5508824 - DNA, 22 bp, Homo sapiens
tacctggggaaagcctgaaggg

SEQ ID NO: 5508825 - DNA, 19 bp, Homo sapiens
tacctgggtccccagccct

SEQ ID NO: 5508826 - DNA, 18 bp, Homo sapiens
tacctgggtttccagggc

SEQ ID NO: 5508827 - DNA, 18 bp, Homo sapiens
tacctggtcaacccgctg

SEQ ID NO: 5508828 - DNA, 22 bp, Homo sapiens
tacctggtcaacccgctgcttc

SEQ ID NO: 5508829 - DNA, 23 bp, Homo sapiens
tacctggtccccactgctgagct

SEQ ID NO: 5508830 - DNA, 22 bp, Homo sapiens
tacctggtttacttctttagca

SEQ ID NO: 5508831 - DNA, 14 bp, Homo sapiens
tacctgtacacaca

SEQ ID NO: 5508832 - DNA, 15 bp, Homo sapiens
tacctgtacacacac

SEQ ID NO: 5508833 - DNA, 16 bp, Homo sapiens
tacctgtaggaaacag

SEQ ID NO: 5508834 - DNA, 15 bp, Homo sapiens
tacctgtataatgga

SEQ ID NO: 5508835 - DNA, 20 bp, Homo sapiens
tacctgtataatggagaatt

SEQ ID NO: 5508836 - DNA, 12 bp, Homo sapiens
tacctgtataca

SEQ ID NO: 5508837 - DNA, 19 bp, Homo sapiens
tacctgtatttaagatttt

SEQ ID NO: 5508838 - DNA, 18 bp, Homo sapiens
tacctgtcacattgcatt

SEQ ID NO: 5508839 - DNA, 16 bp, Homo sapiens
tacctgtcatctgggc

SEQ ID NO: 5508840 - DNA, 16 bp, Homo sapiens
tacctgtcattttgca

SEQ ID NO: 5508841 - DNA, 16 bp, Homo sapiens
tacctgtccccctgac

SEQ ID NO: 5508842 - DNA, 17 bp, Homo sapiens
tacctgtccccctgaca

SEQ ID NO: 5508843 - DNA, 14 bp, Homo sapiens
tacctgtccctcca

SEQ ID NO: 5508844 - DNA, 18 bp, Homo sapiens
tacctgtccctccaggcc

SEQ ID NO: 5508845 - DNA, 16 bp, Homo sapiens
tacctgtcctagcagg

SEQ ID NO: 5508846 - DNA, 14 bp, Homo sapiens
tacctgtctctctc

SEQ ID NO: 5508847 - DNA, 16 bp, Homo sapiens
tacctgtctgctgcca

SEQ ID NO: 5508848 - DNA, 20 bp, Homo sapiens
tacctgtctgctgccagcac

SEQ ID NO: 5508849 - DNA, 15 bp, Homo sapiens
tacctgtgaagtgtt

SEQ ID NO: 5508850 - DNA, 17 bp, Homo sapiens
tacctgtgaatcaaaac

SEQ ID NO: 5508851 - DNA, 12 bp, Homo sapiens
tacctgtgagga

SEQ ID NO: 5508852 - DNA, 14 bp, Homo sapiens
tacctgtgaggact

SEQ ID NO: 5508853 - DNA, 12 bp, Homo sapiens
tacctgtgcctg

SEQ ID NO: 5508854 - DNA, 19 bp, Homo sapiens
tacctgtgcctgagaattt

SEQ ID NO: 5508855 - DNA, 11 bp, Homo sapiens
tacctgtggct

SEQ ID NO: 5508856 - DNA, 21 bp, Homo sapiens
tacctgtgtggtactctgaaa

SEQ ID NO: 5508857 - DNA, 13 bp, Homo sapiens
tacctgtgtgttt

SEQ ID NO: 5508858 - DNA, 20 bp, Homo sapiens
tacctgtgtttcttgcctca

SEQ ID NO: 5508859 - DNA, 21 bp, Homo sapiens
tacctgtgtttcttgcctcat

SEQ ID NO: 5508860 - DNA, 23 bp, Homo sapiens
tacctgttactattatctgtgct

SEQ ID NO: 5508861 - DNA, 20 bp, Homo sapiens
tacctgttatttatcaattt

SEQ ID NO: 5508862 - DNA, 12 bp, Homo sapiens
tacctgttctgt

SEQ ID NO: 5508863 - DNA, 16 bp, Homo sapiens
tacctgttctgtagct

SEQ ID NO: 5508864 - DNA, 14 bp, Homo sapiens
tacctgttgagcat

SEQ ID NO: 5508865 - DNA, 21 bp, Homo sapiens
tacctgttgagcatcacagaa

SEQ ID NO: 5508866 - DNA, 13 bp, Homo sapiens
tacctgtttaaat

SEQ ID NO: 5508867 - DNA, 13 bp, Homo sapiens
tacctgtttagtt

SEQ ID NO: 5508868 - DNA, 22 bp, Homo sapiens
tacctgttttgtggtcagctgt

SEQ ID NO: 5508869 - DNA, 16 bp, Homo sapiens
taccttaaaatttgaa

SEQ ID NO: 5508870 - DNA, 17 bp, Homo sapiens
taccttaaaatttgaaa

SEQ ID NO: 5508871 - DNA, 18 bp, Homo sapiens
taccttaaaatttgaaac

SEQ ID NO: 5508872 - DNA, 22 bp, Homo sapiens
taccttaactcacccctcagca

SEQ ID NO: 5508873 - DNA, 21 bp, Homo sapiens
taccttaatttgactgtcctc

SEQ ID NO: 5508874 - DNA, 22 bp, Homo sapiens
taccttactgtggaggaaggat

SEQ ID NO: 5508875 - DNA, 21 bp, Homo sapiens
taccttagattagctctggac

SEQ ID NO: 5508876 - DNA, 22 bp, Homo sapiens
taccttagattagctctggacc

SEQ ID NO: 5508877 - DNA, 20 bp, Homo sapiens
taccttagctcccttgagct

SEQ ID NO: 5508878 - DNA, 21 bp, Homo sapiens
taccttagctcccttgagctg

SEQ ID NO: 5508879 - DNA, 22 bp, Homo sapiens
taccttagtgcagttatttgct

SEQ ID NO: 5508880 - DNA, 15 bp, Homo sapiens
taccttatgctacac

SEQ ID NO: 5508881 - DNA, 21 bp, Homo sapiens
taccttattgagcgtgattct

SEQ ID NO: 5508882 - DNA, 17 bp, Homo sapiens
taccttcaacatgtgct

SEQ ID NO: 5508883 - DNA, 13 bp, Homo sapiens
taccttcaataaa

SEQ ID NO: 5508884 - DNA, 16 bp, Homo sapiens
taccttcaataaagta

SEQ ID NO: 5508885 - DNA, 23 bp, Homo sapiens
taccttcaatgaattaattcaga

SEQ ID NO: 5508886 - DNA, 17 bp, Homo sapiens
taccttcagatcctacc

SEQ ID NO: 5508887 - DNA, 18 bp, Homo sapiens
taccttcagatcctaccc

SEQ ID NO: 5508888 - DNA, 22 bp, Homo sapiens
taccttcagccatagcttgatt

SEQ ID NO: 5508889 - DNA, 17 bp, Homo sapiens
taccttcagccctggcc

SEQ ID NO: 5508890 - DNA, 19 bp, Homo sapiens
taccttcagtaaacaccat

SEQ ID NO: 5508891 - DNA, 16 bp, Homo sapiens
taccttcatatgcagt

SEQ ID NO: 5508892 - DNA, 14 bp, Homo sapiens
taccttcatttcag

SEQ ID NO: 5508893 - DNA, 19 bp, Homo sapiens
taccttccatacacagagg

SEQ ID NO: 5508894 - DNA, 13 bp, Homo sapiens
taccttccccaga

SEQ ID NO: 5508895 - DNA, 15 bp, Homo sapiens
taccttcctgtccct

SEQ ID NO: 5508896 - DNA, 18 bp, Homo sapiens
taccttccttaagccagg

SEQ ID NO: 5508897 - DNA, 16 bp, Homo sapiens
taccttccttccctgg

SEQ ID NO: 5508898 - DNA, 22 bp, Homo sapiens
taccttctcaaaagattgtttt

SEQ ID NO: 5508899 - DNA, 15 bp, Homo sapiens
taccttctcccaggc

SEQ ID NO: 5508900 - DNA, 16 bp, Homo sapiens
taccttctcccaggcc

SEQ ID NO: 5508901 - DNA, 19 bp, Homo sapiens
taccttctccccagctccc

SEQ ID NO: 5508902 - DNA, 22 bp, Homo sapiens
taccttctccccagctcccagg

SEQ ID NO: 5508903 - DNA, 18 bp, Homo sapiens
taccttctgatgaagttg

SEQ ID NO: 5508904 - DNA, 20 bp, Homo sapiens
taccttctgatgaagttgta

SEQ ID NO: 5508905 - DNA, 24 bp, Homo sapiens
taccttctgttccttatgatattc

SEQ ID NO: 5508906 - DNA, 12 bp, Homo sapiens
taccttctttct

SEQ ID NO: 5508907 - DNA, 17 bp, Homo sapiens
taccttgaaatgctgtt

SEQ ID NO: 5508908 - DNA, 18 bp, Homo sapiens
taccttgaacactggggg

SEQ ID NO: 5508909 - DNA, 22 bp, Homo sapiens
taccttgaatagaagttttcct

SEQ ID NO: 5508910 - DNA, 23 bp, Homo sapiens
taccttgagaccctcttctctgg

SEQ ID NO: 5508911 - DNA, 16 bp, Homo sapiens
taccttgcaaagcaac

SEQ ID NO: 5508912 - DNA, 21 bp, Homo sapiens
taccttgcacacatcatctgt

SEQ ID NO: 5508913 - DNA, 20 bp, Homo sapiens
taccttgcagccatgaccag

SEQ ID NO: 5508914 - DNA, 13 bp, Homo sapiens
taccttgcagtgt

SEQ ID NO: 5508915 - DNA, 15 bp, Homo sapiens
taccttgccccaacc

SEQ ID NO: 5508916 - DNA, 16 bp, Homo sapiens
taccttgccccaaccc

SEQ ID NO: 5508917 - DNA, 23 bp, Homo sapiens
taccttgctagctagccagccaa

SEQ ID NO: 5508918 - DNA, 13 bp, Homo sapiens
taccttgctgtgg

SEQ ID NO: 5508919 - DNA, 18 bp, Homo sapiens
taccttgcttttgcttct

SEQ ID NO: 5508920 - DNA, 13 bp, Homo sapiens
taccttggttccc

SEQ ID NO: 5508921 - DNA, 20 bp, Homo sapiens
taccttgtatactgtaggca

SEQ ID NO: 5508922 - DNA, 18 bp, Homo sapiens
taccttgtgacccagcac

SEQ ID NO: 5508923 - DNA, 18 bp, Homo sapiens
taccttgtgagggagaga

SEQ ID NO: 5508924 - DNA, 13 bp, Homo sapiens
taccttgtgcatt

SEQ ID NO: 5508925 - DNA, 12 bp, Homo sapiens
taccttgtggga

SEQ ID NO: 5508926 - DNA, 14 bp, Homo sapiens
taccttgtgggaat

SEQ ID NO: 5508927 - DNA, 21 bp, Homo sapiens
taccttgtgtactttcttccc

SEQ ID NO: 5508928 - DNA, 22 bp, Homo sapiens
taccttgtgtactttcttccct

SEQ ID NO: 5508929 - DNA, 22 bp, Homo sapiens
taccttgttatttaacccattt

SEQ ID NO: 5508930 - DNA, 21 bp, Homo sapiens
taccttgttgcagatgggtga

SEQ ID NO: 5508931 - DNA, 15 bp, Homo sapiens
taccttgttttctct

SEQ ID NO: 5508932 - DNA, 17 bp, Homo sapiens
taccttgttttctctat

SEQ ID NO: 5508933 - DNA, 22 bp, Homo sapiens
taccttgttttgccatgtagca

SEQ ID NO: 5508934 - DNA, 22 bp, Homo sapiens
taccttgtttttaatctcctgt

SEQ ID NO: 5508935 - DNA, 22 bp, Homo sapiens
tacctttaaaaaataatttaga

SEQ ID NO: 5508936 - DNA, 11 bp, Homo sapiens
tacctttaaat

SEQ ID NO: 5508937 - DNA, 12 bp, Homo sapiens
tacctttaaata

SEQ ID NO: 5508938 - DNA, 22 bp, Homo sapiens
tacctttaaatatcattctttg

SEQ ID NO: 5508939 - DNA, 13 bp, Homo sapiens
tacctttatgtaa

SEQ ID NO: 5508940 - DNA, 20 bp, Homo sapiens
tacctttccacccagaccct

SEQ ID NO: 5508941 - DNA, 16 bp, Homo sapiens
tacctttcccatgctg

SEQ ID NO: 5508942 - DNA, 23 bp, Homo sapiens
tacctttcctgatgcccctgaca

SEQ ID NO: 5508943 - DNA, 17 bp, Homo sapiens
tacctttctagccttag

SEQ ID NO: 5508944 - DNA, 22 bp, Homo sapiens
tacctttctagccttagacaaa

SEQ ID NO: 5508945 - DNA, 21 bp, Homo sapiens
tacctttctgacaataaataa

SEQ ID NO: 5508946 - DNA, 16 bp, Homo sapiens
tacctttgctcttgca

SEQ ID NO: 5508947 - DNA, 13 bp, Homo sapiens
tacctttgctgtc

SEQ ID NO: 5508948 - DNA, 15 bp, Homo sapiens
tacctttgctgtcac

SEQ ID NO: 5508949 - DNA, 12 bp, Homo sapiens
tacctttggaaa

SEQ ID NO: 5508950 - DNA, 14 bp, Homo sapiens
tacctttggaaaaa

SEQ ID NO: 5508951 - DNA, 17 bp, Homo sapiens
tacctttgtaaaacagc

SEQ ID NO: 5508952 - DNA, 19 bp, Homo sapiens
tacctttgtaaaacagcct

SEQ ID NO: 5508953 - DNA, 22 bp, Homo sapiens
tacctttgtctcacgattccag

SEQ ID NO: 5508954 - DNA, 23 bp, Homo sapiens
tacctttgttcccaaatttcata

SEQ ID NO: 5508955 - DNA, 17 bp, Homo sapiens
taccttttaaaatagta

SEQ ID NO: 5508956 - DNA, 19 bp, Homo sapiens
taccttttaagacattttc

SEQ ID NO: 5508957 - DNA, 16 bp, Homo sapiens
taccttttaattaatg

SEQ ID NO: 5508958 - DNA, 14 bp, Homo sapiens
taccttttcagggc

SEQ ID NO: 5508959 - DNA, 21 bp, Homo sapiens
taccttttcctattctgttgc

SEQ ID NO: 5508960 - DNA, 15 bp, Homo sapiens
taccttttctataag

SEQ ID NO: 5508961 - DNA, 21 bp, Homo sapiens
taccttttctataagttgtac

SEQ ID NO: 5508962 - DNA, 18 bp, Homo sapiens
taccttttctcacaaaaa

SEQ ID NO: 5508963 - DNA, 17 bp, Homo sapiens
taccttttctgttgtac

SEQ ID NO: 5508964 - DNA, 21 bp, Homo sapiens
taccttttgaggagccccagc

SEQ ID NO: 5508965 - DNA, 22 bp, Homo sapiens
taccttttgataaaatgttcct

SEQ ID NO: 5508966 - DNA, 21 bp, Homo sapiens
taccttttgatgttcagagtg

SEQ ID NO: 5508967 - DNA, 14 bp, Homo sapiens
tacctttttatatt

SEQ ID NO: 5508968 - DNA, 22 bp, Homo sapiens
taccttttttagagttgatact

SEQ ID NO: 5508969 - DNA, 13 bp, Homo sapiens
taccttttttata

SEQ ID NO: 5508970 - DNA, 17 bp, Homo sapiens
taccttttttatacata

SEQ ID NO: 5508971 - DNA, 20 bp, Homo sapiens
taccttttttatacataaac

SEQ ID NO: 5508972 - DNA, 21 bp, Homo sapiens
taccttttttgataaagtttc

SEQ ID NO: 5508973 - DNA, 16 bp, Homo sapiens
tacctttttttagtta

SEQ ID NO: 5508974 - DNA, 15 bp, Homo sapiens
tacctttttttttct

SEQ ID NO: 5508975 - DNA, 19 bp, Homo sapiens
tacctttttttttcttttt

SEQ ID NO: 5508976 - DNA, 18 bp, Homo sapiens
taccttttttttttcttg

SEQ ID NO: 5508977 - DNA, 21 bp, Homo sapiens
tacgaaaagaggggaagagac

SEQ ID NO: 5508978 - DNA, 16 bp, Homo sapiens
tacgaaataattgttg

SEQ ID NO: 5508979 - DNA, 12 bp, Homo sapiens
tacgaacaaaac

SEQ ID NO: 5508980 - DNA, 21 bp, Homo sapiens
tacgaacccctcccctccccc

SEQ ID NO: 5508981 - DNA, 19 bp, Homo sapiens
tacgaagccacaggcctgg

SEQ ID NO: 5508982 - DNA, 16 bp, Homo sapiens
tacgaagttcaagatc

SEQ ID NO: 5508983 - DNA, 14 bp, Homo sapiens
tacgaatctcatcc

SEQ ID NO: 5508984 - DNA, 18 bp, Homo sapiens
tacgaatcttatttttcc

SEQ ID NO: 5508985 - DNA, 21 bp, Homo sapiens
tacgaatcttatttttcctgt

SEQ ID NO: 5508986 - DNA, 23 bp, Homo sapiens
tacgaattatttttttaaacttc

SEQ ID NO: 5508987 - DNA, 21 bp, Homo sapiens
tacgacaaaggacgctcccag

SEQ ID NO: 5508988 - DNA, 21 bp, Homo sapiens
tacgacacgggtggggaaagg

SEQ ID NO: 5508989 - DNA, 15 bp, Homo sapiens
tacgagaaaatctgc

SEQ ID NO: 5508990 - DNA, 21 bp, Homo sapiens
tacgagaaaatctgcatgttt

SEQ ID NO: 5508991 - DNA, 20 bp, Homo sapiens
tacgagcaagcttttacaac

SEQ ID NO: 5508992 - DNA, 21 bp, Homo sapiens
tacgagcacctccagcctgaa

SEQ ID NO: 5508993 - DNA, 14 bp, Homo sapiens
tacgagccttctca

SEQ ID NO: 5508994 - DNA, 15 bp, Homo sapiens
tacgataaagtaaca

SEQ ID NO: 5508995 - DNA, 14 bp, Homo sapiens
tacgataaggaaga

SEQ ID NO: 5508996 - DNA, 14 bp, Homo sapiens
tacgatacgctact

SEQ ID NO: 5508997 - DNA, 16 bp, Homo sapiens
tacgatctgtttccaa

SEQ ID NO: 5508998 - DNA, 20 bp, Homo sapiens
tacgatggaggcctacctct

SEQ ID NO: 5508999 - DNA, 20 bp, Homo sapiens
tacgattatacttgagattt

SEQ ID NO: 5509000 - DNA, 14 bp, Homo sapiens
tacgcaaggaagga

SEQ ID NO: 5509001 - DNA, 14 bp, Homo sapiens
tacgcaattctcga

SEQ ID NO: 5509002 - DNA, 18 bp, Homo sapiens
tacgcaattgtatatata

SEQ ID NO: 5509003 - DNA, 20 bp, Homo sapiens
tacgcaattgtatatatatg

SEQ ID NO: 5509004 - DNA, 13 bp, Homo sapiens
tacgcacagacag

SEQ ID NO: 5509005 - DNA, 17 bp, Homo sapiens
tacgcacagacaggttt

SEQ ID NO: 5509006 - DNA, 12 bp, Homo sapiens
tacgcacgcacc

SEQ ID NO: 5509007 - DNA, 16 bp, Homo sapiens
tactatttgaagcaat

SEQ ID NO: 5509008 - DNA, 17 bp, Homo sapiens
tactattttaatttgta

SEQ ID NO: 5509009 - DNA, 19 bp, Homo sapiens
tactattttacttctagag

SEQ ID NO: 5509010 - DNA, 13 bp, Homo sapiens
tactatttttact

SEQ ID NO: 5509011 - DNA, 16 bp, Homo sapiens
tactcaaaatgcagga

SEQ ID NO: 5509012 - DNA, 14 bp, Homo sapiens
tactcaaacatgtt

SEQ ID NO: 5509013 - DNA, 20 bp, Homo sapiens
tactcaaatggcattgggct

SEQ ID NO: 5509014 - DNA, 23 bp, Homo sapiens
tactcaaatggtgtcatggctga

SEQ ID NO: 5509015 - DNA, 17 bp, Homo sapiens
tactcaaattcaatgat

SEQ ID NO: 5509016 - DNA, 18 bp, Homo sapiens
tactcaaattcaatgatt

SEQ ID NO: 5509017 - DNA, 22 bp, Homo sapiens
tactcaaccaaattaaaaattt

SEQ ID NO: 5509018 - DNA, 23 bp, Homo sapiens
tactcaaccctctcaggtgacca

SEQ ID NO: 5509019 - DNA, 15 bp, Homo sapiens
tactcaagaggctga

SEQ ID NO: 5509020 - DNA, 19 bp, Homo sapiens
tactcaagaggctgaggca

SEQ ID NO: 5509021 - DNA, 22 bp, Homo sapiens
tactcaagatactggactaagt

SEQ ID NO: 5509022 - DNA, 19 bp, Homo sapiens
tactcaagcaggtttcttg

SEQ ID NO: 5509023 - DNA, 19 bp, Homo sapiens
tactcaagtagcatttact

SEQ ID NO: 5509024 - DNA, 21 bp, Homo sapiens
tactcaagtagcatttactgt

SEQ ID NO: 5509025 - DNA, 16 bp, Homo sapiens
tactcaagtgttaaat

SEQ ID NO: 5509026 - DNA, 22 bp, Homo sapiens
tactcaatgcctggagacagat

SEQ ID NO: 5509027 - DNA, 22 bp, Homo sapiens
tactcaattgataaacatttaa

SEQ ID NO: 5509028 - DNA, 14 bp, Homo sapiens
tactcaatttacta

SEQ ID NO: 5509029 - DNA, 12 bp, Homo sapiens
tactcaatttta

SEQ ID NO: 5509030 - DNA, 14 bp, Homo sapiens
tactcacagccagc

SEQ ID NO: 5509031 - DNA, 21 bp, Homo sapiens
tactcacagctgaagaaaatg

SEQ ID NO: 5509032 - DNA, 15 bp, Homo sapiens
tactcacagtctctt

SEQ ID NO: 5509033 - DNA, 14 bp, Homo sapiens
tactcaccatattt

SEQ ID NO: 5509034 - DNA, 18 bp, Homo sapiens
tactcaccatatttgaat

SEQ ID NO: 5509035 - DNA, 19 bp, Homo sapiens
tactcaccatatttgaatt

SEQ ID NO: 5509036 - DNA, 13 bp, Homo sapiens
tactcacctcctc

SEQ ID NO: 5509037 - DNA, 18 bp, Homo sapiens
tactcacctctctctaag

SEQ ID NO: 5509038 - DNA, 20 bp, Homo sapiens
tactcactcaagttcaagga

SEQ ID NO: 5509039 - DNA, 21 bp, Homo sapiens
tactcagaaatggacaaagaa

SEQ ID NO: 5509040 - DNA, 15 bp, Homo sapiens
tactcagaatagctg

SEQ ID NO: 5509041 - DNA, 12 bp, Homo sapiens
tactcagagcag

SEQ ID NO: 5509042 - DNA, 12 bp, Homo sapiens
tactcagagctg

SEQ ID NO: 5509043 - DNA, 17 bp, Homo sapiens
tactcagagctgcgggc

SEQ ID NO: 5509044 - DNA, 23 bp, Homo sapiens
tactcagagctgcgggctgaggg

SEQ ID NO: 5509045 - DNA, 23 bp, Homo sapiens
tactcagataaggtaaaatgcca

SEQ ID NO: 5509046 - DNA, 21 bp, Homo sapiens
tactcagatgacctgaggaaa

SEQ ID NO: 5509047 - DNA, 19 bp, Homo sapiens
tactcagcagccctcctca

SEQ ID NO: 5509048 - DNA, 19 bp, Homo sapiens
tactcagcagtaagcaggc

SEQ ID NO: 5509049 - DNA, 12 bp, Homo sapiens
tactcagcccag

SEQ ID NO: 5509050 - DNA, 12 bp, Homo sapiens
tactcagccctg

SEQ ID NO: 5509051 - DNA, 15 bp, Homo sapiens
tactcagccctgggc

SEQ ID NO: 5509052 - DNA, 22 bp, Homo sapiens
tactcagccctgggccccacca

SEQ ID NO: 5509053 - DNA, 16 bp, Homo sapiens
tactcagctctcctgc

SEQ ID NO: 5509054 - DNA, 14 bp, Homo sapiens
tactcaggaggctg

SEQ ID NO: 5509055 - DNA, 21 bp, Homo sapiens
tactcaggaggctgagacagg

SEQ ID NO: 5509056 - DNA, 21 bp, Homo sapiens
tactcaggaggctgaggcagg

SEQ ID NO: 5509057 - DNA, 23 bp, Homo sapiens
tactcaggctggtggagaactct

SEQ ID NO: 5509058 - DNA, 15 bp, Homo sapiens
tactcagggaaagca

SEQ ID NO: 5509059 - DNA, 17 bp, Homo sapiens
tactcagggaaagcatt

SEQ ID NO: 5509060 - DNA, 15 bp, Homo sapiens
tactcagggattcct

SEQ ID NO: 5509061 - DNA, 15 bp, Homo sapiens
tactcagggctcctc

SEQ ID NO: 5509062 - DNA, 18 bp, Homo sapiens
tactcagggctcctccca

SEQ ID NO: 5509063 - DNA, 20 bp, Homo sapiens
tactcaggggatgtttacct

SEQ ID NO: 5509064 - DNA, 16 bp, Homo sapiens
tactcagggttaggaa

SEQ ID NO: 5509065 - DNA, 20 bp, Homo sapiens
tactcagggttcatctgtcc

SEQ ID NO: 5509066 - DNA, 21 bp, Homo sapiens
tactcagggttcatctgtcca

SEQ ID NO: 5509067 - DNA, 12 bp, Homo sapiens
tactcaggtttg

SEQ ID NO: 5509068 - DNA, 15 bp, Homo sapiens
tactcagtatagcat

SEQ ID NO: 5509069 - DNA, 21 bp, Homo sapiens
tactcagtcagcccagtggga

SEQ ID NO: 5509070 - DNA, 20 bp, Homo sapiens
tactcagtgaaatcatatta

SEQ ID NO: 5509071 - DNA, 17 bp, Homo sapiens
tactcagtggggctggc

SEQ ID NO: 5509072 - DNA, 19 bp, Homo sapiens
tactcagtgttagagaaat

SEQ ID NO: 5509073 - DNA, 14 bp, Homo sapiens
tactcataaaggac

SEQ ID NO: 5509074 - DNA, 22 bp, Homo sapiens
tactcataaaggacactggatc

SEQ ID NO: 5509075 - DNA, 20 bp, Homo sapiens
tactcataaggcatatacaa

SEQ ID NO: 5509076 - DNA, 22 bp, Homo sapiens
tactcataaggcatatacaaat

SEQ ID NO: 5509077 - DNA, 17 bp, Homo sapiens
tactcatccttgtataa

SEQ ID NO: 5509078 - DNA, 15 bp, Homo sapiens
tactcatctttatcc

SEQ ID NO: 5509079 - DNA, 16 bp, Homo sapiens
tactcatgaatgaaaa

SEQ ID NO: 5509080 - DNA, 17 bp, Homo sapiens
tactcatgaatgaaaat

SEQ ID NO: 5509081 - DNA, 16 bp, Homo sapiens
tactcatgatcttgtg

SEQ ID NO: 5509082 - DNA, 14 bp, Homo sapiens
tactcatgccagat

SEQ ID NO: 5509083 - DNA, 16 bp, Homo sapiens
tactcatggaagagat

SEQ ID NO: 5509084 - DNA, 19 bp, Homo sapiens
tactcatgtacattggtct

SEQ ID NO: 5509085 - DNA, 11 bp, Homo sapiens
tactcatgtgt

SEQ ID NO: 5509086 - DNA, 12 bp, Homo sapiens
tactcatgtgta

SEQ ID NO: 5509087 - DNA, 13 bp, Homo sapiens
tactcatgtgtat

SEQ ID NO: 5509088 - DNA, 20 bp, Homo sapiens
tactcatgtgtatgggcaaa

SEQ ID NO: 5509089 - DNA, 20 bp, Homo sapiens
tactcattaattcaatgaaa

SEQ ID NO: 5509090 - DNA, 21 bp, Homo sapiens
tactcattaattcaatgaaat

SEQ ID NO: 5509091 - DNA, 13 bp, Homo sapiens
tactcattactgc

SEQ ID NO: 5509092 - DNA, 20 bp, Homo sapiens
tactcattcatttattcatt

SEQ ID NO: 5509093 - DNA, 18 bp, Homo sapiens
tactcattccccggggcg

SEQ ID NO: 5509094 - DNA, 14 bp, Homo sapiens
tactcattgaaatg

SEQ ID NO: 5509095 - DNA, 18 bp, Homo sapiens
tactcattgcccccacct

SEQ ID NO: 5509096 - DNA, 17 bp, Homo sapiens
tactcatttaaagtatt

SEQ ID NO: 5509097 - DNA, 18 bp, Homo sapiens
tactcatttctaaaagaa

SEQ ID NO: 5509098 - DNA, 19 bp, Homo sapiens
tactcatttggatataaat

SEQ ID NO: 5509099 - DNA, 11 bp, Homo sapiens
tactcattttt

SEQ ID NO: 5509100 - DNA, 18 bp, Homo sapiens
tactccaagcttcaagtg

SEQ ID NO: 5509101 - DNA, 14 bp, Homo sapiens
tactccacactgca

SEQ ID NO: 5509102 - DNA, 12 bp, Homo sapiens
tactccacagcg

SEQ ID NO: 5509103 - DNA, 22 bp, Homo sapiens
tactccacagcggaggagacca

SEQ ID NO: 5509104 - DNA, 19 bp, Homo sapiens
tactccactgccctggcag

SEQ ID NO: 5509105 - DNA, 21 bp, Homo sapiens
tactccactgccctggcagca

SEQ ID NO: 5509106 - DNA, 23 bp, Homo sapiens
tactccactgccctggcagcagc

SEQ ID NO: 5509107 - DNA, 16 bp, Homo sapiens
tactccactggtctgt

SEQ ID NO: 5509108 - DNA, 20 bp, Homo sapiens
tactccactggtctgtcttt

SEQ ID NO: 5509109 - DNA, 23 bp, Homo sapiens
tactccaggacttagaatagtgc

SEQ ID NO: 5509110 - DNA, 20 bp, Homo sapiens
tactccagtatgacagagga

SEQ ID NO: 5509111 - DNA, 21 bp, Homo sapiens
tactccagtgccaacaatcct

SEQ ID NO: 5509112 - DNA, 14 bp, Homo sapiens
tactccagtggtga

SEQ ID NO: 5509113 - DNA, 22 bp, Homo sapiens
tactcccactcccggcctgtca

SEQ ID NO: 5509114 - DNA, 14 bp, Homo sapiens
tactcccagacacc

SEQ ID NO: 5509115 - DNA, 13 bp, Homo sapiens
tactcccaggcac

SEQ ID NO: 5509116 - DNA, 16 bp, Homo sapiens
tactcccatctgtgaa

SEQ ID NO: 5509117 - DNA, 17 bp, Homo sapiens
tactcccccaccactca

SEQ ID NO: 5509118 - DNA, 23 bp, Homo sapiens
tactcccccaccactcaggccac

SEQ ID NO: 5509119 - DNA, 20 bp, Homo sapiens
tactcccctttcttccaaac

SEQ ID NO: 5509120 - DNA, 15 bp, Homo sapiens
tactccctacactga

SEQ ID NO: 5509121 - DNA, 14 bp, Homo sapiens
tactccctctcagg

SEQ ID NO: 5509122 - DNA, 14 bp, Homo sapiens
tactccctcttcca

SEQ ID NO: 5509123 - DNA, 16 bp, Homo sapiens
tactccctgcagatgc

SEQ ID NO: 5509124 - DNA, 18 bp, Homo sapiens
tactccctgcagatgcca

SEQ ID NO: 5509125 - DNA, 18 bp, Homo sapiens
tactcccttcctggcctc

SEQ ID NO: 5509126 - DNA, 21 bp, Homo sapiens
tactcccttctcgtgtttgct

SEQ ID NO: 5509127 - DNA, 15 bp, Homo sapiens
tactcccttctgtag

SEQ ID NO: 5509128 - DNA, 18 bp, Homo sapiens
tactccgtgaggctgctg

SEQ ID NO: 5509129 - DNA, 16 bp, Homo sapiens
tactccgttcctggca

SEQ ID NO: 5509130 - DNA, 15 bp, Homo sapiens
tactcctaaaacttt

SEQ ID NO: 5509131 - DNA, 14 bp, Homo sapiens
tactcctacctcag

SEQ ID NO: 5509132 - DNA, 16 bp, Homo sapiens
tactcctacctcagcc

SEQ ID NO: 5509133 - DNA, 16 bp, Homo sapiens
tactcctacctggtca

SEQ ID NO: 5509134 - DNA, 19 bp, Homo sapiens
tactcctatgatctgagtc

SEQ ID NO: 5509135 - DNA, 12 bp, Homo sapiens
tactcctcccag

SEQ ID NO: 5509136 - DNA, 16 bp, Homo sapiens
tactcctccccctcct

SEQ ID NO: 5509137 - DNA, 18 bp, Homo sapiens
tactcctccccctcctcc

SEQ ID NO: 5509138 - DNA, 19 bp, Homo sapiens
tactcctccccctcctcca

SEQ ID NO: 5509139 - DNA, 22 bp, Homo sapiens
tactcctcctctttctctcccc

SEQ ID NO: 5509140 - DNA, 13 bp, Homo sapiens
tactcctctgcag

SEQ ID NO: 5509141 - DNA, 12 bp, Homo sapiens
tactcctgactc

SEQ ID NO: 5509142 - DNA, 12 bp, Homo sapiens
tactcctgcaaa

SEQ ID NO: 5509143 - DNA, 22 bp, Homo sapiens
tactcctgcaaaattttatagc

SEQ ID NO: 5509144 - DNA, 13 bp, Homo sapiens
tactcctgccagg

SEQ ID NO: 5509145 - DNA, 22 bp, Homo sapiens
tactcctgcctccccattcctt

SEQ ID NO: 5509146 - DNA, 19 bp, Homo sapiens
tactcctggtaacagtaat

SEQ ID NO: 5509147 - DNA, 16 bp, Homo sapiens
tactcctggtttgatt

SEQ ID NO: 5509148 - DNA, 22 bp, Homo sapiens
tactcctgtaattcctacctcc

SEQ ID NO: 5509149 - DNA, 13 bp, Homo sapiens
tactcctgtcttc

SEQ ID NO: 5509150 - DNA, 15 bp, Homo sapiens
tactcctgtcttctg

SEQ ID NO: 5509151 - DNA, 16 bp, Homo sapiens
tactcctgtgctctgg

SEQ ID NO: 5509152 - DNA, 17 bp, Homo sapiens
tactcctgtgctctgga

SEQ ID NO: 5509153 - DNA, 17 bp, Homo sapiens
tactcctgtgggagcct

SEQ ID NO: 5509154 - DNA, 20 bp, Homo sapiens
tactcctgtgggagcctcgc

SEQ ID NO: 5509155 - DNA, 21 bp, Homo sapiens
tactcctgtgggagcctcgca

SEQ ID NO: 5509156 - DNA, 23 bp, Homo sapiens
tactccttaatttacctgttgtt

SEQ ID NO: 5509157 - DNA, 19 bp, Homo sapiens
tactccttgcttcctgatg

SEQ ID NO: 5509158 - DNA, 15 bp, Homo sapiens
tactccttggatttg

SEQ ID NO: 5509159 - DNA, 12 bp, Homo sapiens
tactccttttgg

SEQ ID NO: 5509160 - DNA, 22 bp, Homo sapiens
tactcgagaggccaaagaagga

SEQ ID NO: 5509161 - DNA, 13 bp, Homo sapiens
tactcgagcccac

SEQ ID NO: 5509162 - DNA, 22 bp, Homo sapiens
tactcgcacctcttggctttgt

SEQ ID NO: 5509163 - DNA, 23 bp, Homo sapiens
tactcgcaggggcgctggctgca

SEQ ID NO: 5509164 - DNA, 17 bp, Homo sapiens
tactcggatggggcacg

SEQ ID NO: 5509165 - DNA, 16 bp, Homo sapiens
tactcggcttcctgtg

SEQ ID NO: 5509166 - DNA, 13 bp, Homo sapiens
tactcgtttttat

SEQ ID NO: 5509167 - DNA, 21 bp, Homo sapiens
tactctaaaatggacattttc

SEQ ID NO: 5509168 - DNA, 22 bp, Homo sapiens
tactctaaaatggacattttct

SEQ ID NO: 5509169 - DNA, 20 bp, Homo sapiens
tactctaaagaaaaatgcct

SEQ ID NO: 5509170 - DNA, 23 bp, Homo sapiens
tactctaaagcttctataaaata

SEQ ID NO: 5509171 - DNA, 21 bp, Homo sapiens
tactctaagatcttagattct

SEQ ID NO: 5509172 - DNA, 22 bp, Homo sapiens
tactctaagatcttagattctc

SEQ ID NO: 5509173 - DNA, 17 bp, Homo sapiens
tactctaaggtaaaacc

SEQ ID NO: 5509174 - DNA, 14 bp, Homo sapiens
tactctaatataca

SEQ ID NO: 5509175 - DNA, 16 bp, Homo sapiens
tactctaatatacagt

SEQ ID NO: 5509176 - DNA, 14 bp, Homo sapiens
tactctaattctaa

SEQ ID NO: 5509177 - DNA, 19 bp, Homo sapiens
tactctacaattcctctga

SEQ ID NO: 5509178 - DNA, 23 bp, Homo sapiens
tactctacaattcctctgataat

SEQ ID NO: 5509179 - DNA, 15 bp, Homo sapiens
tactctacactgaaa

SEQ ID NO: 5509180 - DNA, 19 bp, Homo sapiens
tactctacactgaaacgta

SEQ ID NO: 5509181 - DNA, 16 bp, Homo sapiens
tactctaccctcttag

SEQ ID NO: 5509182 - DNA, 16 bp, Homo sapiens
tactctacgccaaagt

SEQ ID NO: 5509183 - DNA, 13 bp, Homo sapiens
tactctactgata

SEQ ID NO: 5509184 - DNA, 21 bp, Homo sapiens
tactgtaatgctgcctcagga

SEQ ID NO: 5509185 - DNA, 20 bp, Homo sapiens
tactgtaatttgtgatacaa

SEQ ID NO: 5509186 - DNA, 14 bp, Homo sapiens
tactgtaattttat

SEQ ID NO: 5509187 - DNA, 19 bp, Homo sapiens
tactgtaattttgtttgta

SEQ ID NO: 5509188 - DNA, 14 bp, Homo sapiens
tactgtacaataaa

SEQ ID NO: 5509189 - DNA, 15 bp, Homo sapiens
tactgtacaataaaa

SEQ ID NO: 5509190 - DNA, 19 bp, Homo sapiens
tactgtacaatgactttat

SEQ ID NO: 5509191 - DNA, 13 bp, Homo sapiens
tactgtacacatt

SEQ ID NO: 5509192 - DNA, 14 bp, Homo sapiens
tactgtacacattt

SEQ ID NO: 5509193 - DNA, 19 bp, Homo sapiens
tactgtacagacagaaaaa

SEQ ID NO: 5509194 - DNA, 18 bp, Homo sapiens
tactgtacagattgctgc

SEQ ID NO: 5509195 - DNA, 19 bp, Homo sapiens
tactgtacagattgctgct

SEQ ID NO: 5509196 - DNA, 19 bp, Homo sapiens
tactgtacagctggctcta

SEQ ID NO: 5509197 - DNA, 15 bp, Homo sapiens
tactgtactgaagaa

SEQ ID NO: 5509198 - DNA, 21 bp, Homo sapiens
tactgtactgatactattcaa

SEQ ID NO: 5509199 - DNA, 20 bp, Homo sapiens
tactgtactttgccattttt

SEQ ID NO: 5509200 - DNA, 15 bp, Homo sapiens
tactgtagaaaggaa

SEQ ID NO: 5509201 - DNA, 16 bp, Homo sapiens
tactgtagaaaggaaa

SEQ ID NO: 5509202 - DNA, 18 bp, Homo sapiens
tactgtagaactgatttt

SEQ ID NO: 5509203 - DNA, 15 bp, Homo sapiens
tactgtagacactct

SEQ ID NO: 5509204 - DNA, 13 bp, Homo sapiens
tactgtagatttc

SEQ ID NO: 5509205 - DNA, 15 bp, Homo sapiens
tactgtagatttcag

SEQ ID NO: 5509206 - DNA, 17 bp, Homo sapiens
tactgtagcaatatatt

SEQ ID NO: 5509207 - DNA, 19 bp, Homo sapiens
tactgtagcaatatatttg

SEQ ID NO: 5509208 - DNA, 17 bp, Homo sapiens
tactgtagctgatgaaa

SEQ ID NO: 5509209 - DNA, 14 bp, Homo sapiens
tactgtagtattct

SEQ ID NO: 5509210 - DNA, 15 bp, Homo sapiens
tactgtagtttttct

SEQ ID NO: 5509211 - DNA, 20 bp, Homo sapiens
tactgtataagtaacactag

SEQ ID NO: 5509212 - DNA, 20 bp, Homo sapiens
tactgtatagacagtttgta

SEQ ID NO: 5509213 - DNA, 22 bp, Homo sapiens
tactgtatagacagtttgtaaa

SEQ ID NO: 5509214 - DNA, 13 bp, Homo sapiens
tactgtatatgta

SEQ ID NO: 5509215 - DNA, 14 bp, Homo sapiens
tactgtatatgtat

SEQ ID NO: 5509216 - DNA, 16 bp, Homo sapiens
tactgtatatgtcaaa

SEQ ID NO: 5509217 - DNA, 19 bp, Homo sapiens
tactgtatatgtcaaaaat

SEQ ID NO: 5509218 - DNA, 15 bp, Homo sapiens
tactgtatattcagg

SEQ ID NO: 5509219 - DNA, 19 bp, Homo sapiens
tactgtatcaataaaattc

SEQ ID NO: 5509220 - DNA, 18 bp, Homo sapiens
tactgtatcaatttctaa

SEQ ID NO: 5509221 - DNA, 14 bp, Homo sapiens
tactgtatcctgaa

SEQ ID NO: 5509222 - DNA, 13 bp, Homo sapiens
tactgtatgatca

SEQ ID NO: 5509223 - DNA, 18 bp, Homo sapiens
tactgtatgatcaaatgt

SEQ ID NO: 5509224 - DNA, 22 bp, Homo sapiens
tactgtatggaaacactgattt

SEQ ID NO: 5509225 - DNA, 18 bp, Homo sapiens
tactgtatggttttgttt

SEQ ID NO: 5509226 - DNA, 14 bp, Homo sapiens
tactgtatgtgatg

SEQ ID NO: 5509227 - DNA, 16 bp, Homo sapiens
tactgtatgtgatgaa

SEQ ID NO: 5509228 - DNA, 16 bp, Homo sapiens
tactgtatgtgccaaa

SEQ ID NO: 5509229 - DNA, 13 bp, Homo sapiens
tactgtatgtttt

SEQ ID NO: 5509230 - DNA, 19 bp, Homo sapiens
tactgtatgtttttactga

SEQ ID NO: 5509231 - DNA, 14 bp, Homo sapiens
tactgtatttaaga

SEQ ID NO: 5509232 - DNA, 16 bp, Homo sapiens
tactgtatttcattat

SEQ ID NO: 5509233 - DNA, 17 bp, Homo sapiens
tactgtatttctaagaa

SEQ ID NO: 5509234 - DNA, 19 bp, Homo sapiens
tactgtatttttactattg

SEQ ID NO: 5509235 - DNA, 20 bp, Homo sapiens
tactgtcaaatgatgtgcaa

SEQ ID NO: 5509236 - DNA, 16 bp, Homo sapiens
tactgtcaataaacag

SEQ ID NO: 5509237 - DNA, 12 bp, Homo sapiens
tactgtcagtgt

SEQ ID NO: 5509238 - DNA, 17 bp, Homo sapiens
tactgtcctgttttcta

SEQ ID NO: 5509239 - DNA, 11 bp, Homo sapiens
tactgtctaag

SEQ ID NO: 5509240 - DNA, 21 bp, Homo sapiens
tactgtctaagcagttttgta

SEQ ID NO: 5509241 - DNA, 22 bp, Homo sapiens
tactgtctaagcagttttgtaa

SEQ ID NO: 5509242 - DNA, 22 bp, Homo sapiens
tactgtctctccagtgaaatga

SEQ ID NO: 5509243 - DNA, 16 bp, Homo sapiens
tactgtctctggagtg

SEQ ID NO: 5509244 - DNA, 17 bp, Homo sapiens
tactgtctctggagtga

SEQ ID NO: 5509245 - DNA, 21 bp, Homo sapiens
tactgtctgctgatataatat

SEQ ID NO: 5509246 - DNA, 20 bp, Homo sapiens
tactgtctgcttctctctct

SEQ ID NO: 5509247 - DNA, 13 bp, Homo sapiens
tactgtctgggat

SEQ ID NO: 5509248 - DNA, 17 bp, Homo sapiens
tactgtctgtaagagaa

SEQ ID NO: 5509249 - DNA, 13 bp, Homo sapiens
tactgtctgtagt

SEQ ID NO: 5509250 - DNA, 14 bp, Homo sapiens
tactgtctgtagtg

SEQ ID NO: 5509251 - DNA, 19 bp, Homo sapiens
tactgtcttaaatcagttt

SEQ ID NO: 5509252 - DNA, 15 bp, Homo sapiens
tactgtcttaattaa

SEQ ID NO: 5509253 - DNA, 19 bp, Homo sapiens
tactgtcttaattaagtaa

SEQ ID NO: 5509254 - DNA, 23 bp, Homo sapiens
tactgtcttacgtttttctggtg

SEQ ID NO: 5509255 - DNA, 20 bp, Homo sapiens
tactgtgaaaaaaaatttgt

SEQ ID NO: 5509256 - DNA, 19 bp, Homo sapiens
tactgtgagaactgtgaat

SEQ ID NO: 5509257 - DNA, 20 bp, Homo sapiens
tactgtgaggagtctgggtc

SEQ ID NO: 5509258 - DNA, 14 bp, Homo sapiens
tactgtggaggaag

SEQ ID NO: 5509259 - DNA, 18 bp, Homo sapiens
tactgtggaggaaggatt

SEQ ID NO: 5509260 - DNA, 15 bp, Homo sapiens
tactgtggaggtggc

SEQ ID NO: 5509261 - DNA, 21 bp, Homo sapiens
tactgtggcaaatgccaactg

SEQ ID NO: 5509262 - DNA, 15 bp, Homo sapiens
tactgtggcctgcag

SEQ ID NO: 5509263 - DNA, 19 bp, Homo sapiens
tactgtggctggtactttc

SEQ ID NO: 5509264 - DNA, 23 bp, Homo sapiens
tactgtggctggtactttctgta

SEQ ID NO: 5509265 - DNA, 19 bp, Homo sapiens
tactgtgggcaatttagaa

SEQ ID NO: 5509266 - DNA, 20 bp, Homo sapiens
tactgtggggagagatggca

SEQ ID NO: 5509267 - DNA, 16 bp, Homo sapiens
tactgtggtgttttgt

SEQ ID NO: 5509268 - DNA, 16 bp, Homo sapiens
tactgtgtaatataaa

SEQ ID NO: 5509269 - DNA, 13 bp, Homo sapiens
tactgtgtaatta

SEQ ID NO: 5509270 - DNA, 23 bp, Homo sapiens
tactgtgtacagaattctgctac

SEQ ID NO: 5509271 - DNA, 15 bp, Homo sapiens
tactgtgtactgtat

SEQ ID NO: 5509272 - DNA, 18 bp, Homo sapiens
tactgtgtatatctctgt

SEQ ID NO: 5509273 - DNA, 13 bp, Homo sapiens
tactgtgtatgtt

SEQ ID NO: 5509274 - DNA, 16 bp, Homo sapiens
tactgtgtatgtttta

SEQ ID NO: 5509275 - DNA, 17 bp, Homo sapiens
tactgtgtatgttttat

SEQ ID NO: 5509276 - DNA, 16 bp, Homo sapiens
tactgtgtcataaaca

SEQ ID NO: 5509277 - DNA, 23 bp, Homo sapiens
tactgtgtcatggtgatgcaagt

SEQ ID NO: 5509278 - DNA, 17 bp, Homo sapiens
tactgtgtgaaatgaat

SEQ ID NO: 5509279 - DNA, 13 bp, Homo sapiens
tactgtgtggaac

SEQ ID NO: 5509280 - DNA, 18 bp, Homo sapiens
tactgtgtgtgtgaatga

SEQ ID NO: 5509281 - DNA, 22 bp, Homo sapiens
tactgtgtgtgtgaatgaacac

SEQ ID NO: 5509282 - DNA, 23 bp, Homo sapiens
tactgtgtgtgtgaatgaacact

SEQ ID NO: 5509283 - DNA, 21 bp, Homo sapiens
tactgtgttaccttttaaaat

SEQ ID NO: 5509284 - DNA, 17 bp, Homo sapiens
tactgtgttatgcaaaa

SEQ ID NO: 5509285 - DNA, 15 bp, Homo sapiens
tactgtgttcaatta

SEQ ID NO: 5509286 - DNA, 13 bp, Homo sapiens
tactgtgttccaa

SEQ ID NO: 5509287 - DNA, 16 bp, Homo sapiens
tactgtgttccctcat

SEQ ID NO: 5509288 - DNA, 16 bp, Homo sapiens
tactgtgttcctggca

SEQ ID NO: 5509289 - DNA, 13 bp, Homo sapiens
tactgtgtttcag

SEQ ID NO: 5509290 - DNA, 21 bp, Homo sapiens
tactgtgtttttaaattttgt

SEQ ID NO: 5509291 - DNA, 20 bp, Homo sapiens
tactgttaaaactgtacctt

SEQ ID NO: 5509292 - DNA, 22 bp, Homo sapiens
tactgttaaaactgtacctttt

SEQ ID NO: 5509293 - DNA, 18 bp, Homo sapiens
tactgttaaccatttaag

SEQ ID NO: 5509294 - DNA, 21 bp, Homo sapiens
tactgttaagaataataaaat

SEQ ID NO: 5509295 - DNA, 12 bp, Homo sapiens
tactgttactct

SEQ ID NO: 5509296 - DNA, 16 bp, Homo sapiens
tactgttactctaaat

SEQ ID NO: 5509297 - DNA, 13 bp, Homo sapiens
tactgttactggg

SEQ ID NO: 5509298 - DNA, 17 bp, Homo sapiens
tactgttacttgataac

SEQ ID NO: 5509299 - DNA, 21 bp, Homo sapiens
tactgttatccatattacgtt

SEQ ID NO: 5509300 - DNA, 13 bp, Homo sapiens
tactgttattctt

SEQ ID NO: 5509301 - DNA, 15 bp, Homo sapiens
tactgttattctttg

SEQ ID NO: 5509302 - DNA, 16 bp, Homo sapiens
tactgttattctttgc

SEQ ID NO: 5509303 - DNA, 17 bp, Homo sapiens
tactgttattctttgca

SEQ ID NO: 5509304 - DNA, 20 bp, Homo sapiens
tactgttattctttgcactt

SEQ ID NO: 5509305 - DNA, 16 bp, Homo sapiens
tactgttcagctttta

SEQ ID NO: 5509306 - DNA, 18 bp, Homo sapiens
tactgttcatacagtttt

SEQ ID NO: 5509307 - DNA, 14 bp, Homo sapiens
tactgttcctttca

SEQ ID NO: 5509308 - DNA, 17 bp, Homo sapiens
tactgttcctttcagat

SEQ ID NO: 5509309 - DNA, 15 bp, Homo sapiens
tactgttctaaagct

SEQ ID NO: 5509310 - DNA, 17 bp, Homo sapiens
tactgttctaaagctct

SEQ ID NO: 5509311 - DNA, 21 bp, Homo sapiens
tactgttctaaagctctgaca

SEQ ID NO: 5509312 - DNA, 12 bp, Homo sapiens
tactgttctcaa

SEQ ID NO: 5509313 - DNA, 17 bp, Homo sapiens
tactgttctcaacatac

SEQ ID NO: 5509314 - DNA, 12 bp, Homo sapiens
tactgttctctt

SEQ ID NO: 5509315 - DNA, 14 bp, Homo sapiens
tactgttctgaaat

SEQ ID NO: 5509316 - DNA, 14 bp, Homo sapiens
tactgttctgtgtc

SEQ ID NO: 5509317 - DNA, 17 bp, Homo sapiens
tactgttcttcatttta

SEQ ID NO: 5509318 - DNA, 13 bp, Homo sapiens
tactgttcttgct

SEQ ID NO: 5509319 - DNA, 14 bp, Homo sapiens
tactgttcttgctg

SEQ ID NO: 5509320 - DNA, 16 bp, Homo sapiens
tactgttcttgctgct

SEQ ID NO: 5509321 - DNA, 20 bp, Homo sapiens
tactgttcttgctgctagaa

SEQ ID NO: 5509322 - DNA, 21 bp, Homo sapiens
tactgttcttgctgctagaac

SEQ ID NO: 5509323 - DNA, 23 bp, Homo sapiens
tactgttcttgctgctagaactt

SEQ ID NO: 5509324 - DNA, 22 bp, Homo sapiens
tactgttgataattcttatttt

SEQ ID NO: 5509325 - DNA, 18 bp, Homo sapiens
tactgttgatacaaacca

SEQ ID NO: 5509326 - DNA, 15 bp, Homo sapiens
tactgttgcaaagct

SEQ ID NO: 5509327 - DNA, 16 bp, Homo sapiens
tactgttgcacagcca

SEQ ID NO: 5509328 - DNA, 14 bp, Homo sapiens
tactgttgcacgtg

SEQ ID NO: 5509329 - DNA, 21 bp, Homo sapiens
tactgttgcatttacttttaa

SEQ ID NO: 5509330 - DNA, 11 bp, Homo sapiens
tactgttggtg

SEQ ID NO: 5509331 - DNA, 16 bp, Homo sapiens
tactgttgtaagaatt

SEQ ID NO: 5509332 - DNA, 15 bp, Homo sapiens
tactgtttacagttt

SEQ ID NO: 5509333 - DNA, 15 bp, Homo sapiens
tactgtttattactt

SEQ ID NO: 5509334 - DNA, 15 bp, Homo sapiens
tactgtttatttctg

SEQ ID NO: 5509335 - DNA, 23 bp, Homo sapiens
tactgtttatttctgtttctcat

SEQ ID NO: 5509336 - DNA, 19 bp, Homo sapiens
tactgtttctcaagtgttt

SEQ ID NO: 5509337 - DNA, 18 bp, Homo sapiens
tactgtttcttgcactga

SEQ ID NO: 5509338 - DNA, 20 bp, Homo sapiens
tactgtttgaaacttttcaa

SEQ ID NO: 5509339 - DNA, 22 bp, Homo sapiens
tactgtttgaaacttttcaagg

SEQ ID NO: 5509340 - DNA, 17 bp, Homo sapiens
tactgtttgtaatatac

SEQ ID NO: 5509341 - DNA, 22 bp, Homo sapiens
tactgtttgtaatatacagttt

SEQ ID NO: 5509342 - DNA, 20 bp, Homo sapiens
tactgtttgtcttctcccca

SEQ ID NO: 5509343 - DNA, 16 bp, Homo sapiens
tactgttttaattgta

SEQ ID NO: 5509344 - DNA, 14 bp, Homo sapiens
tactgttttatctc

SEQ ID NO: 5509345 - DNA, 16 bp, Homo sapiens
tactgttttatgttga

SEQ ID NO: 5509346 - DNA, 17 bp, Homo sapiens
tactgttttctgggcca

SEQ ID NO: 5509347 - DNA, 19 bp, Homo sapiens
tactgttttgaagctgggc

SEQ ID NO: 5509348 - DNA, 15 bp, Homo sapiens
tactgttttgggcct

SEQ ID NO: 5509349 - DNA, 16 bp, Homo sapiens
tactgttttgtatcaa

SEQ ID NO: 5509350 - DNA, 23 bp, Homo sapiens
tactgttttgtgcggtgtgtctc

SEQ ID NO: 5509351 - DNA, 14 bp, Homo sapiens
tactgtttttgcta

SEQ ID NO: 5509352 - DNA, 22 bp, Homo sapiens
tacttaaaaaatcctgcccaaa

SEQ ID NO: 5509353 - DNA, 16 bp, Homo sapiens
tacttaaaaataaagt

SEQ ID NO: 5509354 - DNA, 15 bp, Homo sapiens
tacttaaaaatatgt

SEQ ID NO: 5509355 - DNA, 21 bp, Homo sapiens
tacttaaaaattaatagtttt

SEQ ID NO: 5509356 - DNA, 18 bp, Homo sapiens
tacttaaaaatttattag

SEQ ID NO: 5509357 - DNA, 20 bp, Homo sapiens
tacttaaaatgacaaagcca

SEQ ID NO: 5509358 - DNA, 21 bp, Homo sapiens
tacttaaacaaaaactttcca

SEQ ID NO: 5509359 - DNA, 12 bp, Homo sapiens
tacttaaacagc

SEQ ID NO: 5509360 - DNA, 12 bp, Homo sapiens
tacttaaataaa

SEQ ID NO: 5509361 - DNA, 20 bp, Homo sapiens
tacttaaatagcatctgctc

SEQ ID NO: 5509362 - DNA, 21 bp, Homo sapiens
tacttaaatttggtttgttaa

SEQ ID NO: 5509363 - DNA, 14 bp, Homo sapiens
tacttaacaaatac

SEQ ID NO: 5509364 - DNA, 19 bp, Homo sapiens
tacttaacacgtgaatatt

SEQ ID NO: 5509365 - DNA, 15 bp, Homo sapiens
tacttaacatttcat

SEQ ID NO: 5509366 - DNA, 22 bp, Homo sapiens
tacttaacatttcattgtacaa

SEQ ID NO: 5509367 - DNA, 16 bp, Homo sapiens
tacttaagaatatgct

SEQ ID NO: 5509368 - DNA, 16 bp, Homo sapiens
tacttaagagaaatgg

SEQ ID NO: 5509369 - DNA, 23 bp, Homo sapiens
tacttaagtgttcattttaagta

SEQ ID NO: 5509370 - DNA, 22 bp, Homo sapiens
tacttaagtttgtaagacagtg

SEQ ID NO: 5509371 - DNA, 12 bp, Homo sapiens
tacttaatgctt

SEQ ID NO: 5509372 - DNA, 23 bp, Homo sapiens
tacttaattcagtctcagctgct

SEQ ID NO: 5509373 - DNA, 18 bp, Homo sapiens
tacttaattcctttctca

SEQ ID NO: 5509374 - DNA, 16 bp, Homo sapiens
tacttacaaaaatggg

SEQ ID NO: 5509375 - DNA, 23 bp, Homo sapiens
tacttacaaactgcggtatacat

SEQ ID NO: 5509376 - DNA, 21 bp, Homo sapiens
tacttacacacctgagaatgt

SEQ ID NO: 5509377 - DNA, 22 bp, Homo sapiens
tacttacactgaaatccaaaat

SEQ ID NO: 5509378 - DNA, 18 bp, Homo sapiens
tacttacatatctgactt

SEQ ID NO: 5509379 - DNA, 19 bp, Homo sapiens
tacttacatgcattactgc

SEQ ID NO: 5509380 - DNA, 12 bp, Homo sapiens
tacttacatgtt

SEQ ID NO: 5509381 - DNA, 13 bp, Homo sapiens
tacttacattcca

SEQ ID NO: 5509382 - DNA, 22 bp, Homo sapiens
tacttacattctctaataagaa

SEQ ID NO: 5509383 - DNA, 18 bp, Homo sapiens
tacttacatttcagacat

SEQ ID NO: 5509384 - DNA, 17 bp, Homo sapiens
tacttaccaagctgagc

SEQ ID NO: 5509385 - DNA, 17 bp, Homo sapiens
tacttaccatatgtgct

SEQ ID NO: 5509386 - DNA, 19 bp, Homo sapiens
tacttacccaggtgggtcc

SEQ ID NO: 5509387 - DNA, 16 bp, Homo sapiens
tacttacccttctaca

SEQ ID NO: 5509388 - DNA, 18 bp, Homo sapiens
tacttacccttctacaaa

SEQ ID NO: 5509389 - DNA, 16 bp, Homo sapiens
tacttacctaaacaga

SEQ ID NO: 5509390 - DNA, 18 bp, Homo sapiens
tacttacctagtgaaact

SEQ ID NO: 5509391 - DNA, 19 bp, Homo sapiens
tacttacctagtgaaactt

SEQ ID NO: 5509392 - DNA, 15 bp, Homo sapiens
tacttactaaaatat

SEQ ID NO: 5509393 - DNA, 17 bp, Homo sapiens
tacttactaaaatatat

SEQ ID NO: 5509394 - DNA, 16 bp, Homo sapiens
tacttactataatttg

SEQ ID NO: 5509395 - DNA, 13 bp, Homo sapiens
tacttactgttaa

SEQ ID NO: 5509396 - DNA, 18 bp, Homo sapiens
tacttactgttaaaactg

SEQ ID NO: 5509397 - DNA, 15 bp, Homo sapiens
tacttacttagagat

SEQ ID NO: 5509398 - DNA, 17 bp, Homo sapiens
tacttagaaagtaagag

SEQ ID NO: 5509399 - DNA, 17 bp, Homo sapiens
tacttagaatgccataa

SEQ ID NO: 5509400 - DNA, 15 bp, Homo sapiens
tacttagagatatgt

SEQ ID NO: 5509401 - DNA, 16 bp, Homo sapiens
tacttagatatttcat

SEQ ID NO: 5509402 - DNA, 19 bp, Homo sapiens
tacttagatatttcatgtg

SEQ ID NO: 5509403 - DNA, 17 bp, Homo sapiens
tacttagattgtgttcc

SEQ ID NO: 5509404 - DNA, 18 bp, Homo sapiens
tacttagcaaagttttac

SEQ ID NO: 5509405 - DNA, 17 bp, Homo sapiens
tacttagcacttggcct

SEQ ID NO: 5509406 - DNA, 14 bp, Homo sapiens
tacttagctgtact

SEQ ID NO: 5509407 - DNA, 18 bp, Homo sapiens
tacttagcttatcaattt

SEQ ID NO: 5509408 - DNA, 19 bp, Homo sapiens
tacttagcttatcaatttg

SEQ ID NO: 5509409 - DNA, 20 bp, Homo sapiens
tacttagcttatcaatttgt

SEQ ID NO: 5509410 - DNA, 16 bp, Homo sapiens
tacttaggactacatt

SEQ ID NO: 5509411 - DNA, 23 bp, Homo sapiens
tacttaggactacattttgctct

SEQ ID NO: 5509412 - DNA, 19 bp, Homo sapiens
tacttaggttattttgctt

SEQ ID NO: 5509413 - DNA, 20 bp, Homo sapiens
tacttaggttattttgcttt

SEQ ID NO: 5509414 - DNA, 21 bp, Homo sapiens
tacttaggttattttgctttg

SEQ ID NO: 5509415 - DNA, 17 bp, Homo sapiens
tacttagtagattaaaa

SEQ ID NO: 5509416 - DNA, 17 bp, Homo sapiens
tacttagtattgcaaag

SEQ ID NO: 5509417 - DNA, 20 bp, Homo sapiens
tacttagtattgcaaagtca

SEQ ID NO: 5509418 - DNA, 15 bp, Homo sapiens
tacttagtggtatgt

SEQ ID NO: 5509419 - DNA, 19 bp, Homo sapiens
tacttagtggtatgtctct

SEQ ID NO: 5509420 - DNA, 15 bp, Homo sapiens
tacttatacacctta

SEQ ID NO: 5509421 - DNA, 14 bp, Homo sapiens
tacttatattctgc

SEQ ID NO: 5509422 - DNA, 15 bp, Homo sapiens
tacttatattctgca

SEQ ID NO: 5509423 - DNA, 14 bp, Homo sapiens
tacttatattttcg

SEQ ID NO: 5509424 - DNA, 23 bp, Homo sapiens
tacttatattttcgtatgaaaat

SEQ ID NO: 5509425 - DNA, 13 bp, Homo sapiens
tacttatcacatt

SEQ ID NO: 5509426 - DNA, 20 bp, Homo sapiens
tacttatcatccacattgtt

SEQ ID NO: 5509427 - DNA, 15 bp, Homo sapiens
tacttatcatttttg

SEQ ID NO: 5509428 - DNA, 15 bp, Homo sapiens
tacttatccctgccc

SEQ ID NO: 5509429 - DNA, 20 bp, Homo sapiens
tacttatctctcaaaacaat

SEQ ID NO: 5509430 - DNA, 17 bp, Homo sapiens
tacttatgcacatttgt

SEQ ID NO: 5509431 - DNA, 18 bp, Homo sapiens
tacttatgtagaaactga

SEQ ID NO: 5509432 - DNA, 15 bp, Homo sapiens
tacttattacagtct

SEQ ID NO: 5509433 - DNA, 15 bp, Homo sapiens
tacttattactgcta

SEQ ID NO: 5509434 - DNA, 12 bp, Homo sapiens
tacttattcatt

SEQ ID NO: 5509435 - DNA, 13 bp, Homo sapiens
tacttattcattg

SEQ ID NO: 5509436 - DNA, 13 bp, Homo sapiens
tacttattccaga

SEQ ID NO: 5509437 - DNA, 12 bp, Homo sapiens
tacttatttaaa

SEQ ID NO: 5509438 - DNA, 17 bp, Homo sapiens
tacttatttaaaaatgc

SEQ ID NO: 5509439 - DNA, 21 bp, Homo sapiens
tacttatttaaaaatgcatga

SEQ ID NO: 5509440 - DNA, 21 bp, Homo sapiens
tacttatttaaatagatgaca

SEQ ID NO: 5509441 - DNA, 13 bp, Homo sapiens
tacttatttaact

SEQ ID NO: 5509442 - DNA, 20 bp, Homo sapiens
tacttatttataacattgta

SEQ ID NO: 5509443 - DNA, 22 bp, Homo sapiens
tacttatttctcagctgtgcct

SEQ ID NO: 5509444 - DNA, 15 bp, Homo sapiens
tacttattttccaat

SEQ ID NO: 5509445 - DNA, 13 bp, Homo sapiens
tacttattttctg

SEQ ID NO: 5509446 - DNA, 15 bp, Homo sapiens
tacttatttttctga

SEQ ID NO: 5509447 - DNA, 13 bp, Homo sapiens
tacttcaaaaata

SEQ ID NO: 5509448 - DNA, 19 bp, Homo sapiens
tacttcaaaagtattttcc

SEQ ID NO: 5509449 - DNA, 17 bp, Homo sapiens
tacttcaaaagtttgtt

SEQ ID NO: 5509450 - DNA, 18 bp, Homo sapiens
tacttcaaagtgcctggg

SEQ ID NO: 5509451 - DNA, 20 bp, Homo sapiens
tacttcaaagtgcctgggct

SEQ ID NO: 5509452 - DNA, 21 bp, Homo sapiens
tacttcaaagtgcctgggctc

SEQ ID NO: 5509453 - DNA, 21 bp, Homo sapiens
tacttcaaatccttgaagatt

SEQ ID NO: 5509454 - DNA, 23 bp, Homo sapiens
tacttcaagttaaagtgaataac

SEQ ID NO: 5509455 - DNA, 18 bp, Homo sapiens
tacttcacccggctgggc

SEQ ID NO: 5509456 - DNA, 22 bp, Homo sapiens
tacttcacccggctgggctcct

SEQ ID NO: 5509457 - DNA, 14 bp, Homo sapiens
tacttcactgtcag

SEQ ID NO: 5509458 - DNA, 19 bp, Homo sapiens
tacttcactgtcatcttca

SEQ ID NO: 5509459 - DNA, 20 bp, Homo sapiens
tacttcactgtcatcttcaa

SEQ ID NO: 5509460 - DNA, 17 bp, Homo sapiens
tacttcactttcatctg

SEQ ID NO: 5509461 - DNA, 22 bp, Homo sapiens
tacttcagcaagagagaaccta

SEQ ID NO: 5509462 - DNA, 23 bp, Homo sapiens
tacttcagccaccctttctggca

SEQ ID NO: 5509463 - DNA, 22 bp, Homo sapiens
tacttcaggggcacttcattga

SEQ ID NO: 5509464 - DNA, 19 bp, Homo sapiens
tacttcaggtgcttttgat

SEQ ID NO: 5509465 - DNA, 18 bp, Homo sapiens
tacttcatagctccttgg

SEQ ID NO: 5509466 - DNA, 19 bp, Homo sapiens
tacttcatcgcagtggact

SEQ ID NO: 5509467 - DNA, 11 bp, Homo sapiens
tacttcatgag

SEQ ID NO: 5509468 - DNA, 16 bp, Homo sapiens
tacttcattttcagag

SEQ ID NO: 5509469 - DNA, 18 bp, Homo sapiens
tacttcattttcagagtg

SEQ ID NO: 5509470 - DNA, 16 bp, Homo sapiens
tacttccaatttataa

SEQ ID NO: 5509471 - DNA, 22 bp, Homo sapiens
tacttccacctcgggcacattt

SEQ ID NO: 5509472 - DNA, 18 bp, Homo sapiens
tacttccagcaaaatcca

SEQ ID NO: 5509473 - DNA, 22 bp, Homo sapiens
tacttccatgcactcttcatgt

SEQ ID NO: 5509474 - DNA, 20 bp, Homo sapiens
tacttccattatacatcaat

SEQ ID NO: 5509475 - DNA, 17 bp, Homo sapiens
tacttcccaaagccctt

SEQ ID NO: 5509476 - DNA, 17 bp, Homo sapiens
tacttccccatggccct

SEQ ID NO: 5509477 - DNA, 17 bp, Homo sapiens
tacttcccctgggatgc

SEQ ID NO: 5509478 - DNA, 14 bp, Homo sapiens
tacttccccttcct

SEQ ID NO: 5509479 - DNA, 18 bp, Homo sapiens
tacttccccttcctaatt

SEQ ID NO: 5509480 - DNA, 14 bp, Homo sapiens
tacttccctcaggc

SEQ ID NO: 5509481 - DNA, 16 bp, Homo sapiens
tacttccctcttgaaa

SEQ ID NO: 5509482 - DNA, 13 bp, Homo sapiens
tacttcccttcct

SEQ ID NO: 5509483 - DNA, 14 bp, Homo sapiens
tacttcccttcctc

SEQ ID NO: 5509484 - DNA, 13 bp, Homo sapiens
tacttcctcctga

SEQ ID NO: 5509485 - DNA, 16 bp, Homo sapiens
tacttcctcctgatgg

SEQ ID NO: 5509486 - DNA, 19 bp, Homo sapiens
tacttcctctaggaaatgt

SEQ ID NO: 5509487 - DNA, 14 bp, Homo sapiens
tacttcctctgtga

SEQ ID NO: 5509488 - DNA, 18 bp, Homo sapiens
tacttcctctgtgaactg

SEQ ID NO: 5509489 - DNA, 10 bp, Homo sapiens
tacttcctgg

SEQ ID NO: 5509490 - DNA, 13 bp, Homo sapiens
tacttcctggcct

SEQ ID NO: 5509491 - DNA, 17 bp, Homo sapiens
tacttcctggcctcttc

SEQ ID NO: 5509492 - DNA, 17 bp, Homo sapiens
tacttccttataaaaat

SEQ ID NO: 5509493 - DNA, 18 bp, Homo sapiens
tacttccttataaaaatt

SEQ ID NO: 5509494 - DNA, 22 bp, Homo sapiens
tacttccttatgcttctttcaa

SEQ ID NO: 5509495 - DNA, 12 bp, Homo sapiens
tacttctaagag

SEQ ID NO: 5509496 - DNA, 23 bp, Homo sapiens
tacttctaatcttaaatcagaat

SEQ ID NO: 5509497 - DNA, 22 bp, Homo sapiens
tacttctctataaaaaatatgt

SEQ ID NO: 5509498 - DNA, 20 bp, Homo sapiens
tacttctctgagtcagctga

SEQ ID NO: 5509499 - DNA, 23 bp, Homo sapiens
tacttctgaaataaatgttctct

SEQ ID NO: 5509500 - DNA, 20 bp, Homo sapiens
tacttctgactttacttgtg

SEQ ID NO: 5509501 - DNA, 15 bp, Homo sapiens
tacttctgagcccca

SEQ ID NO: 5509502 - DNA, 10 bp, Homo sapiens
tacttctggc

SEQ ID NO: 5509503 - DNA, 17 bp, Homo sapiens
tacttctgggaaaaaca

SEQ ID NO: 5509504 - DNA, 18 bp, Homo sapiens
tacttctgggaaaaacaa

SEQ ID NO: 5509505 - DNA, 20 bp, Homo sapiens
tacttctgtaattgtgtgga

SEQ ID NO: 5509506 - DNA, 14 bp, Homo sapiens
tacttctgtgttca

SEQ ID NO: 5509507 - DNA, 15 bp, Homo sapiens
tacttctgtgttcat

SEQ ID NO: 5509508 - DNA, 16 bp, Homo sapiens
tacttctgtgttcatt

SEQ ID NO: 5509509 - DNA, 17 bp, Homo sapiens
tacttctgtgttcattt

SEQ ID NO: 5509510 - DNA, 19 bp, Homo sapiens
tacttcttagggttatgat

SEQ ID NO: 5509511 - DNA, 15 bp, Homo sapiens
tacttcttattcact

SEQ ID NO: 5509512 - DNA, 14 bp, Homo sapiens
tacttcttattgca

SEQ ID NO: 5509513 - DNA, 13 bp, Homo sapiens
tacttcttgaata

SEQ ID NO: 5509514 - DNA, 16 bp, Homo sapiens
tacttcttggaaaaaa

SEQ ID NO: 5509515 - DNA, 16 bp, Homo sapiens
tacttctttgctttgc

SEQ ID NO: 5509516 - DNA, 19 bp, Homo sapiens
tacttctttgttattataa

SEQ ID NO: 5509517 - DNA, 14 bp, Homo sapiens
tacttctttttggt

SEQ ID NO: 5509518 - DNA, 20 bp, Homo sapiens
tacttgaaaaaatgttctat

SEQ ID NO: 5509519 - DNA, 22 bp, Homo sapiens
tacttgaaaaatgttataactt

SEQ ID NO: 5509520 - DNA, 15 bp, Homo sapiens
tacttgaaaattaac

SEQ ID NO: 5509521 - DNA, 13 bp, Homo sapiens
tacttgaaataag

SEQ ID NO: 5509522 - DNA, 13 bp, Homo sapiens
tacttgaacaaaa

SEQ ID NO: 5509523 - DNA, 15 bp, Homo sapiens
tacttgaacaaaagg

SEQ ID NO: 5509524 - DNA, 21 bp, Homo sapiens
tacttgaacaaaagggtcaga

SEQ ID NO: 5509525 - DNA, 17 bp, Homo sapiens
tacttgaaccataaaat

SEQ ID NO: 5509526 - DNA, 19 bp, Homo sapiens
tacttgaaccataaaatgt

SEQ ID NO: 5509527 - DNA, 20 bp, Homo sapiens
tacttgaaccataaaatgtc

SEQ ID NO: 5509528 - DNA, 13 bp, Homo sapiens
tacttgaactgtt

SEQ ID NO: 5509529 - DNA, 11 bp, Homo sapiens
tacttgaactt

SEQ ID NO: 5509530 - DNA, 13 bp, Homo sapiens
tacttgaacttgt

SEQ ID NO: 5509531 - DNA, 17 bp, Homo sapiens
tacttgaactttccaaa

SEQ ID NO: 5509532 - DNA, 14 bp, Homo sapiens
tacttgaagggcca

SEQ ID NO: 5509533 - DNA, 20 bp, Homo sapiens
tacttgaagggccagagcca

SEQ ID NO: 5509534 - DNA, 22 bp, Homo sapiens
tacttgaagtaactataacaaa

SEQ ID NO: 5509535 - DNA, 18 bp, Homo sapiens
tacttgaataaccatctg

SEQ ID NO: 5509536 - DNA, 12 bp, Homo sapiens
tacttgaatgta

SEQ ID NO: 5509537 - DNA, 16 bp, Homo sapiens
tacttgaattttttga

SEQ ID NO: 5509538 - DNA, 23 bp, Homo sapiens
tacttgaccgtttttatattact

SEQ ID NO: 5509539 - DNA, 14 bp, Homo sapiens
tacttgacctccta

SEQ ID NO: 5509540 - DNA, 17 bp, Homo sapiens
tacttgactacctactg

SEQ ID NO: 5509541 - DNA, 17 bp, Homo sapiens
tagaaactcaggaaaga

SEQ ID NO: 5509542 - DNA, 19 bp, Homo sapiens
tagaaactgaggcccagag

SEQ ID NO: 5509543 - DNA, 18 bp, Homo sapiens
tagaaactgagtcctgtt

SEQ ID NO: 5509544 - DNA, 16 bp, Homo sapiens
tagaaactgatttctt

SEQ ID NO: 5509545 - DNA, 23 bp, Homo sapiens
tagaaacttatcttacaaagtgt

SEQ ID NO: 5509546 - DNA, 17 bp, Homo sapiens
tagaaacttcatggttt

SEQ ID NO: 5509547 - DNA, 23 bp, Homo sapiens
tagaaactttggaagttttactt

SEQ ID NO: 5509548 - DNA, 22 bp, Homo sapiens
tagaaagaaaagaccctgagac

SEQ ID NO: 5509549 - DNA, 21 bp, Homo sapiens
tagaaagaaaattatattctg

SEQ ID NO: 5509550 - DNA, 13 bp, Homo sapiens
tagaaagaaacta

SEQ ID NO: 5509551 - DNA, 15 bp, Homo sapiens
tagaaagaagccata

SEQ ID NO: 5509552 - DNA, 16 bp, Homo sapiens
tagaaagaagccatat

SEQ ID NO: 5509553 - DNA, 19 bp, Homo sapiens
tagaaagaataaaatgttt

SEQ ID NO: 5509554 - DNA, 18 bp, Homo sapiens
tagaaagacatctgcctg

SEQ ID NO: 5509555 - DNA, 19 bp, Homo sapiens
tagaaagacatctgcctgt

SEQ ID NO: 5509556 - DNA, 23 bp, Homo sapiens
tagaaagacatctgcctgtaatt

SEQ ID NO: 5509557 - DNA, 15 bp, Homo sapiens
tagaaagaccaggcc

SEQ ID NO: 5509558 - DNA, 21 bp, Homo sapiens
tagaaagagtgttatcatatt

SEQ ID NO: 5509559 - DNA, 14 bp, Homo sapiens
tagaaagcaggggc

SEQ ID NO: 5509560 - DNA, 19 bp, Homo sapiens
tagaaagcatccattaatt

SEQ ID NO: 5509561 - DNA, 23 bp, Homo sapiens
tagaaagcatccattaattaatg

SEQ ID NO: 5509562 - DNA, 15 bp, Homo sapiens
tagaaagcattacat

SEQ ID NO: 5509563 - DNA, 15 bp, Homo sapiens
tagaaagcatttgaa

SEQ ID NO: 5509564 - DNA, 16 bp, Homo sapiens
tagaaagcatttgaat

SEQ ID NO: 5509565 - DNA, 18 bp, Homo sapiens
tagaaagcatttgaatgc

SEQ ID NO: 5509566 - DNA, 20 bp, Homo sapiens
tagaaagcatttgaatgcat

SEQ ID NO: 5509567 - DNA, 23 bp, Homo sapiens
tagaaagcctgttcccctcactg

SEQ ID NO: 5509568 - DNA, 15 bp, Homo sapiens
tagaaagctaaatga

SEQ ID NO: 5509569 - DNA, 16 bp, Homo sapiens
tagaaagctaatacaa

SEQ ID NO: 5509570 - DNA, 23 bp, Homo sapiens
tagaaagctgctgtgatcccagt

SEQ ID NO: 5509571 - DNA, 12 bp, Homo sapiens
tagaaagctgga

SEQ ID NO: 5509572 - DNA, 18 bp, Homo sapiens
tagaaagctggactgacc

SEQ ID NO: 5509573 - DNA, 23 bp, Homo sapiens
tagaaagctgtttatttattcac

SEQ ID NO: 5509574 - DNA, 21 bp, Homo sapiens
tagaaagcttgaaaagattct

SEQ ID NO: 5509575 - DNA, 21 bp, Homo sapiens
tagaaaggaagccttgctcat

SEQ ID NO: 5509576 - DNA, 15 bp, Homo sapiens
tagaaaggggcccag

SEQ ID NO: 5509577 - DNA, 23 bp, Homo sapiens
tagaaaggtcatccaaagaacat

SEQ ID NO: 5509578 - DNA, 22 bp, Homo sapiens
tagaaagtaagaaaacaatatg

SEQ ID NO: 5509579 - DNA, 21 bp, Homo sapiens
tagaaagtaagagctctaagt

SEQ ID NO: 5509580 - DNA, 19 bp, Homo sapiens
tagaaagtataatttcagt

SEQ ID NO: 5509581 - DNA, 17 bp, Homo sapiens
tagaaagtgaataaaaa

SEQ ID NO: 5509582 - DNA, 20 bp, Homo sapiens
tagaaagtgaataaaaatta

SEQ ID NO: 5509583 - DNA, 16 bp, Homo sapiens
tagaaagtgttctgtt

SEQ ID NO: 5509584 - DNA, 19 bp, Homo sapiens
tagaaagtgttctgttaca

SEQ ID NO: 5509585 - DNA, 21 bp, Homo sapiens
tagaaataaaagtgaatgaaa

SEQ ID NO: 5509586 - DNA, 23 bp, Homo sapiens
tagaaataaaagtgaatgaaaga

SEQ ID NO: 5509587 - DNA, 20 bp, Homo sapiens
tagaaataaaggatgtgatt

SEQ ID NO: 5509588 - DNA, 16 bp, Homo sapiens
tagaaataaatagcta

SEQ ID NO: 5509589 - DNA, 11 bp, Homo sapiens
tagaaataagt

SEQ ID NO: 5509590 - DNA, 23 bp, Homo sapiens
tagaaataagtggttatttctca

SEQ ID NO: 5509591 - DNA, 15 bp, Homo sapiens
tagaaatacctcatt

SEQ ID NO: 5509592 - DNA, 18 bp, Homo sapiens
tagaaatacttttcctta

SEQ ID NO: 5509593 - DNA, 14 bp, Homo sapiens
tagaaatagagata

SEQ ID NO: 5509594 - DNA, 16 bp, Homo sapiens
tagaaatagatttaaa

SEQ ID NO: 5509595 - DNA, 22 bp, Homo sapiens
tagaaatagctccgtggagcag

SEQ ID NO: 5509596 - DNA, 15 bp, Homo sapiens
tagaaatatattcat

SEQ ID NO: 5509597 - DNA, 16 bp, Homo sapiens
tagaaatatattcata

SEQ ID NO: 5509598 - DNA, 13 bp, Homo sapiens
tagaaatatcctt

SEQ ID NO: 5509599 - DNA, 15 bp, Homo sapiens
tagaaatatctttct

SEQ ID NO: 5509600 - DNA, 14 bp, Homo sapiens
tagaaatatgattt

SEQ ID NO: 5509601 - DNA, 18 bp, Homo sapiens
tagaaatattaaagattt

SEQ ID NO: 5509602 - DNA, 15 bp, Homo sapiens
tagaaatattcacat

SEQ ID NO: 5509603 - DNA, 19 bp, Homo sapiens
tagaaatattttaaaatca

SEQ ID NO: 5509604 - DNA, 20 bp, Homo sapiens
tagaaatattttaaaatcag

SEQ ID NO: 5509605 - DNA, 13 bp, Homo sapiens
tagaaatcaactt

SEQ ID NO: 5509606 - DNA, 14 bp, Homo sapiens
tagaaatcattgta

SEQ ID NO: 5509607 - DNA, 15 bp, Homo sapiens
tagaaatctgtcctg

SEQ ID NO: 5509608 - DNA, 16 bp, Homo sapiens
tagaaatctgtcctgt

SEQ ID NO: 5509609 - DNA, 18 bp, Homo sapiens
tagaaatgaccaatatta

SEQ ID NO: 5509610 - DNA, 20 bp, Homo sapiens
tagaaatgcggtctggtctc

SEQ ID NO: 5509611 - DNA, 21 bp, Homo sapiens
tagaaatggaaattttgctat

SEQ ID NO: 5509612 - DNA, 16 bp, Homo sapiens
tagaaatggttgtatt

SEQ ID NO: 5509613 - DNA, 20 bp, Homo sapiens
tagaaatggttgtattagat

SEQ ID NO: 5509614 - DNA, 17 bp, Homo sapiens
tagaaatggtttcctct

SEQ ID NO: 5509615 - DNA, 18 bp, Homo sapiens
tagaaatggtttcctctg

SEQ ID NO: 5509616 - DNA, 15 bp, Homo sapiens
tagaaatgtaaactg

SEQ ID NO: 5509617 - DNA, 16 bp, Homo sapiens
tagaaatgtattttga

SEQ ID NO: 5509618 - DNA, 17 bp, Homo sapiens
tagaaatgtattttgaa

SEQ ID NO: 5509619 - DNA, 12 bp, Homo sapiens
tagaaatgtgaa

SEQ ID NO: 5509620 - DNA, 11 bp, Homo sapiens
tagaaatgttt

SEQ ID NO: 5509621 - DNA, 18 bp, Homo sapiens
tagaaattacaagtttca

SEQ ID NO: 5509622 - DNA, 16 bp, Homo sapiens
tagaaattacctgtgg

SEQ ID NO: 5509623 - DNA, 18 bp, Homo sapiens
tagaaattacctgtggat

SEQ ID NO: 5509624 - DNA, 16 bp, Homo sapiens
tagaaattagatttgt

SEQ ID NO: 5509625 - DNA, 23 bp, Homo sapiens
tagaaattctataagagacaaag

SEQ ID NO: 5509626 - DNA, 21 bp, Homo sapiens
tagaaattggtacataggctt

SEQ ID NO: 5509627 - DNA, 15 bp, Homo sapiens
tagaaatttactatg

SEQ ID NO: 5509628 - DNA, 14 bp, Homo sapiens
tagaaatttccaga

SEQ ID NO: 5509629 - DNA, 16 bp, Homo sapiens
tagaaatttccagaga

SEQ ID NO: 5509630 - DNA, 22 bp, Homo sapiens
tagaaattttacaataggtgct

SEQ ID NO: 5509631 - DNA, 13 bp, Homo sapiens
tagaaattttcaa

SEQ ID NO: 5509632 - DNA, 15 bp, Homo sapiens
tagaaattttgtaag

SEQ ID NO: 5509633 - DNA, 22 bp, Homo sapiens
tagaaatttttcagatgcttct

SEQ ID NO: 5509634 - DNA, 16 bp, Homo sapiens
tagaacaaaggacaga

SEQ ID NO: 5509635 - DNA, 15 bp, Homo sapiens
tagaacaagaccctg

SEQ ID NO: 5509636 - DNA, 15 bp, Homo sapiens
tagaacaagatgcac

SEQ ID NO: 5509637 - DNA, 16 bp, Homo sapiens
tagaacaagccagagc

SEQ ID NO: 5509638 - DNA, 13 bp, Homo sapiens
tagaacaatagct

SEQ ID NO: 5509639 - DNA, 18 bp, Homo sapiens
tagaacaatgggaggctg

SEQ ID NO: 5509640 - DNA, 23 bp, Homo sapiens
tagaacacaagggatataaaatg

SEQ ID NO: 5509641 - DNA, 15 bp, Homo sapiens
tagaacacagaaagc

SEQ ID NO: 5509642 - DNA, 23 bp, Homo sapiens
tagaacaccaaagataaggacta

SEQ ID NO: 5509643 - DNA, 16 bp, Homo sapiens
tagaacacccactggc

SEQ ID NO: 5509644 - DNA, 14 bp, Homo sapiens
tagaacactatttt

SEQ ID NO: 5509645 - DNA, 19 bp, Homo sapiens
tagaacactattttcagaa

SEQ ID NO: 5509646 - DNA, 22 bp, Homo sapiens
tagaacactattttcagaatct

SEQ ID NO: 5509647 - DNA, 20 bp, Homo sapiens
tagaacactgcctctgagtt

SEQ ID NO: 5509648 - DNA, 19 bp, Homo sapiens
tagaacacttcagacacag

SEQ ID NO: 5509649 - DNA, 19 bp, Homo sapiens
tagaacagaaatatataaa

SEQ ID NO: 5509650 - DNA, 23 bp, Homo sapiens
tagaacaggttcttaaaaaggaa

SEQ ID NO: 5509651 - DNA, 16 bp, Homo sapiens
tagaacataaagcaaa

SEQ ID NO: 5509652 - DNA, 15 bp, Homo sapiens
tagaacatgcaagaa

SEQ ID NO: 5509653 - DNA, 17 bp, Homo sapiens
tagaacatgcaagaatt

SEQ ID NO: 5509654 - DNA, 16 bp, Homo sapiens
tagaacattgatctgt

SEQ ID NO: 5509655 - DNA, 19 bp, Homo sapiens
tagaacattgatctgtttt

SEQ ID NO: 5509656 - DNA, 23 bp, Homo sapiens
tagaacattgatctgttttacag

SEQ ID NO: 5509657 - DNA, 18 bp, Homo sapiens
tagaacattgattgctgt

SEQ ID NO: 5509658 - DNA, 17 bp, Homo sapiens
tagaaccaagaagggct

SEQ ID NO: 5509659 - DNA, 23 bp, Homo sapiens
tagaaccaagaagggctagaacc

SEQ ID NO: 5509660 - DNA, 14 bp, Homo sapiens
tagaaccaagcact

SEQ ID NO: 5509661 - DNA, 16 bp, Homo sapiens
tagaaccaagcttcag

SEQ ID NO: 5509662 - DNA, 17 bp, Homo sapiens
tagaaccaagcttcaga

SEQ ID NO: 5509663 - DNA, 15 bp, Homo sapiens
tagaaccacagcaga

SEQ ID NO: 5509664 - DNA, 18 bp, Homo sapiens
tagaaccaccaaaattat

SEQ ID NO: 5509665 - DNA, 12 bp, Homo sapiens
tagaaccaggca

SEQ ID NO: 5509666 - DNA, 21 bp, Homo sapiens
tagaaccagtcttttgaaaga

SEQ ID NO: 5509667 - DNA, 21 bp, Homo sapiens
tagaacccaggtctgatgcca

SEQ ID NO: 5509668 - DNA, 22 bp, Homo sapiens
tagaacccggcaggctagaacc

SEQ ID NO: 5509669 - DNA, 21 bp, Homo sapiens
tagaaccctctgttccttccc

SEQ ID NO: 5509670 - DNA, 23 bp, Homo sapiens
tagaacctaattcaattcaaagc

SEQ ID NO: 5509671 - DNA, 16 bp, Homo sapiens
tagaacctagaagggc

SEQ ID NO: 5509672 - DNA, 17 bp, Homo sapiens
tagaacctgcatttaag

SEQ ID NO: 5509673 - DNA, 22 bp, Homo sapiens
tagaacctgcatttaagaacag

SEQ ID NO: 5509674 - DNA, 16 bp, Homo sapiens
tagaacctggaagggc

SEQ ID NO: 5509675 - DNA, 17 bp, Homo sapiens
tagaacctggaagggct

SEQ ID NO: 5509676 - DNA, 22 bp, Homo sapiens
tagaacctggagggctagaacc

SEQ ID NO: 5509677 - DNA, 17 bp, Homo sapiens
tagaacctggagggctg

SEQ ID NO: 5509678 - DNA, 16 bp, Homo sapiens
tagaacctttctgtgt

SEQ ID NO: 5509679 - DNA, 19 bp, Homo sapiens
tagaacgagagtgcctccc

SEQ ID NO: 5509680 - DNA, 23 bp, Homo sapiens
tagaacgccagggaccccagaat

SEQ ID NO: 5509681 - DNA, 22 bp, Homo sapiens
tagaacgtccagggtttacatt

SEQ ID NO: 5509682 - DNA, 16 bp, Homo sapiens
tagaacgtgcatcctt

SEQ ID NO: 5509683 - DNA, 23 bp, Homo sapiens
tagaacgtgcatccttgtaatac

SEQ ID NO: 5509684 - DNA, 20 bp, Homo sapiens
tagaactaaatataaatttt

SEQ ID NO: 5509685 - DNA, 23 bp, Homo sapiens
tagaactacttgcatttgatttt

SEQ ID NO: 5509686 - DNA, 20 bp, Homo sapiens
tagaactatattttccccca

SEQ ID NO: 5509687 - DNA, 19 bp, Homo sapiens
tagaactatcatttttaca

SEQ ID NO: 5509688 - DNA, 22 bp, Homo sapiens
tagaactatcatttttacacta

SEQ ID NO: 5509689 - DNA, 12 bp, Homo sapiens
tagaactatctg

SEQ ID NO: 5509690 - DNA, 21 bp, Homo sapiens
tagaactcaacctctacaggg

SEQ ID NO: 5509691 - DNA, 15 bp, Homo sapiens
tagaactcactctgg

SEQ ID NO: 5509692 - DNA, 17 bp, Homo sapiens
tagaactcactctgggc

SEQ ID NO: 5509693 - DNA, 18 bp, Homo sapiens
tagaactcactctgggct

SEQ ID NO: 5509694 - DNA, 19 bp, Homo sapiens
tagaactcactctgggctg

SEQ ID NO: 5509695 - DNA, 17 bp, Homo sapiens
tagaactcagcagttga

SEQ ID NO: 5509696 - DNA, 16 bp, Homo sapiens
tagaactccaggccct

SEQ ID NO: 5509697 - DNA, 17 bp, Homo sapiens
tagaactcctgtcttct

SEQ ID NO: 5509698 - DNA, 18 bp, Homo sapiens
tagaactcctgtcttctt

SEQ ID NO: 5509699 - DNA, 22 bp, Homo sapiens
tagaactcctgtcttctttctc

SEQ ID NO: 5509700 - DNA, 19 bp, Homo sapiens
tagaactctagagagcctt

SEQ ID NO: 5509701 - DNA, 13 bp, Homo sapiens
tagaactgaattt

SEQ ID NO: 5509702 - DNA, 17 bp, Homo sapiens
tagaactgaattttgtc

SEQ ID NO: 5509703 - DNA, 22 bp, Homo sapiens
tagaactggagaggctagaacc

SEQ ID NO: 5509704 - DNA, 20 bp, Homo sapiens
tagaactgggtaaatgcaaa

SEQ ID NO: 5509705 - DNA, 18 bp, Homo sapiens
tagaactggtgatataaa

SEQ ID NO: 5509706 - DNA, 13 bp, Homo sapiens
tagaactgtactg

SEQ ID NO: 5509707 - DNA, 20 bp, Homo sapiens
tagaactgtatgtcagacat

SEQ ID NO: 5509708 - DNA, 15 bp, Homo sapiens
tagaactgtctgtga

SEQ ID NO: 5509709 - DNA, 16 bp, Homo sapiens
tagaacttagttttgt

SEQ ID NO: 5509710 - DNA, 12 bp, Homo sapiens
tagaacttcaaa

SEQ ID NO: 5509711 - DNA, 23 bp, Homo sapiens
tagaacttcaagaagtaagagct

SEQ ID NO: 5509712 - DNA, 15 bp, Homo sapiens
tagaacttcatggat

SEQ ID NO: 5509713 - DNA, 19 bp, Homo sapiens
tagaacttgcagtgtcttt

SEQ ID NO: 5509714 - DNA, 17 bp, Homo sapiens
tagaactttaagtctca

SEQ ID NO: 5509715 - DNA, 13 bp, Homo sapiens
tagaactttgtat

SEQ ID NO: 5509716 - DNA, 14 bp, Homo sapiens
tagaactttgtata

SEQ ID NO: 5509717 - DNA, 23 bp, Homo sapiens
tagaatggagggcaacattccac

SEQ ID NO: 5509718 - DNA, 13 bp, Homo sapiens
tagaatggggctt

SEQ ID NO: 5509719 - DNA, 15 bp, Homo sapiens
tagaatgtaaagctt

SEQ ID NO: 5509720 - DNA, 15 bp, Homo sapiens
tagaatgtaaatgtc

SEQ ID NO: 5509721 - DNA, 18 bp, Homo sapiens
tagaatgtaaatgtctca

SEQ ID NO: 5509722 - DNA, 14 bp, Homo sapiens
tagaatgtagtttg

SEQ ID NO: 5509723 - DNA, 13 bp, Homo sapiens
tagaatgtattgt

SEQ ID NO: 5509724 - DNA, 16 bp, Homo sapiens
tagaatgtattgtacc

SEQ ID NO: 5509725 - DNA, 23 bp, Homo sapiens
tagaatgtctgaagtacaaacat

SEQ ID NO: 5509726 - DNA, 15 bp, Homo sapiens
tagaatgtcttggtg

SEQ ID NO: 5509727 - DNA, 12 bp, Homo sapiens
tagaatgtggat

SEQ ID NO: 5509728 - DNA, 19 bp, Homo sapiens
tagaatgtggccacttatt

SEQ ID NO: 5509729 - DNA, 14 bp, Homo sapiens
tagaatgttttcct

SEQ ID NO: 5509730 - DNA, 13 bp, Homo sapiens
tagaattaaaatt

SEQ ID NO: 5509731 - DNA, 16 bp, Homo sapiens
tagaattaacacatga

SEQ ID NO: 5509732 - DNA, 22 bp, Homo sapiens
tagaattacaccacaagtatct

SEQ ID NO: 5509733 - DNA, 16 bp, Homo sapiens
tagaattaccatttgt

SEQ ID NO: 5509734 - DNA, 17 bp, Homo sapiens
tagaattaccatttgtt

SEQ ID NO: 5509735 - DNA, 19 bp, Homo sapiens
tagaattaccatttgttaa

SEQ ID NO: 5509736 - DNA, 14 bp, Homo sapiens
tagaattagctttt

SEQ ID NO: 5509737 - DNA, 18 bp, Homo sapiens
tagaattaggtaatggat

SEQ ID NO: 5509738 - DNA, 14 bp, Homo sapiens
tagaattatatcta

SEQ ID NO: 5509739 - DNA, 17 bp, Homo sapiens
tagaattatatctaatt

SEQ ID NO: 5509740 - DNA, 19 bp, Homo sapiens
tagaattatatctaattta

SEQ ID NO: 5509741 - DNA, 23 bp, Homo sapiens
tagaattatatctaatttataca

SEQ ID NO: 5509742 - DNA, 24 bp, Homo sapiens
tagaattatatctaatttatacaa

SEQ ID NO: 5509743 - DNA, 19 bp, Homo sapiens
tagaattatctaatttata

SEQ ID NO: 5509744 - DNA, 21 bp, Homo sapiens
tagaattatctaatttataaa

SEQ ID NO: 5509745 - DNA, 12 bp, Homo sapiens
tagaattattta

SEQ ID NO: 5509746 - DNA, 15 bp, Homo sapiens
tagaattatttttca

SEQ ID NO: 5509747 - DNA, 19 bp, Homo sapiens
tagaattatttttcactct

SEQ ID NO: 5509748 - DNA, 15 bp, Homo sapiens
tagaattcactgagt

SEQ ID NO: 5509749 - DNA, 19 bp, Homo sapiens
tagaattcagaaaattgtt

SEQ ID NO: 5509750 - DNA, 16 bp, Homo sapiens
tagaattccttcaggg

SEQ ID NO: 5509751 - DNA, 23 bp, Homo sapiens
tagaattccttcagggtgatgcc

SEQ ID NO: 5509752 - DNA, 17 bp, Homo sapiens
tagaattctagcttttt

SEQ ID NO: 5509753 - DNA, 19 bp, Homo sapiens
tagaattctagtgctgctg

SEQ ID NO: 5509754 - DNA, 20 bp, Homo sapiens
tagaattctagtgctgctga

SEQ ID NO: 5509755 - DNA, 11 bp, Homo sapiens
tagaattctgt

SEQ ID NO: 5509756 - DNA, 21 bp, Homo sapiens
tagaattctgtatagattaga

SEQ ID NO: 5509757 - DNA, 21 bp, Homo sapiens
tagaattctgtattggatata

SEQ ID NO: 5509758 - DNA, 13 bp, Homo sapiens
tagaattgaaaat

SEQ ID NO: 5509759 - DNA, 17 bp, Homo sapiens
tagaattgaaggttttt

SEQ ID NO: 5509760 - DNA, 23 bp, Homo sapiens
tagaattgaaggtttttgatagc

SEQ ID NO: 5509761 - DNA, 20 bp, Homo sapiens
tagaattgagtgtttaaagt

SEQ ID NO: 5509762 - DNA, 21 bp, Homo sapiens
tagaattgatttccaagaatc

SEQ ID NO: 5509763 - DNA, 18 bp, Homo sapiens
tagaattgcaatctataa

SEQ ID NO: 5509764 - DNA, 16 bp, Homo sapiens
tagaattgcagtcatt

SEQ ID NO: 5509765 - DNA, 13 bp, Homo sapiens
tagaattgcattg

SEQ ID NO: 5509766 - DNA, 23 bp, Homo sapiens
tagaattgctggatgcattttta

SEQ ID NO: 5509767 - DNA, 22 bp, Homo sapiens
tagaattgctgtctatgattgt

SEQ ID NO: 5509768 - DNA, 13 bp, Homo sapiens
tagaattgttaga

SEQ ID NO: 5509769 - DNA, 14 bp, Homo sapiens
tagaattgttatag

SEQ ID NO: 5509770 - DNA, 22 bp, Homo sapiens
tagaatttagccctggtttgaa

SEQ ID NO: 5509771 - DNA, 15 bp, Homo sapiens
tagaatttattcaat

SEQ ID NO: 5509772 - DNA, 16 bp, Homo sapiens
tagaatttcctgtaat

SEQ ID NO: 5509773 - DNA, 18 bp, Homo sapiens
tagaatttgaaaggaaaa

SEQ ID NO: 5509774 - DNA, 19 bp, Homo sapiens
tagaatttgatatgtgaac

SEQ ID NO: 5509775 - DNA, 22 bp, Homo sapiens
tagaatttgatatgtgaacagt

SEQ ID NO: 5509776 - DNA, 17 bp, Homo sapiens
tagaatttggcccagag

SEQ ID NO: 5509777 - DNA, 16 bp, Homo sapiens
tagaatttgtattttg

SEQ ID NO: 5509778 - DNA, 23 bp, Homo sapiens
tagaatttgtattttgcttaaaa

SEQ ID NO: 5509779 - DNA, 21 bp, Homo sapiens
tagaatttgtttcatctattt

SEQ ID NO: 5509780 - DNA, 22 bp, Homo sapiens
tagaattttatatcattggatg

SEQ ID NO: 5509781 - DNA, 15 bp, Homo sapiens
tagaattttctccct

SEQ ID NO: 5509782 - DNA, 22 bp, Homo sapiens
tagaattttgagtattccatga

SEQ ID NO: 5509783 - DNA, 13 bp, Homo sapiens
tagacaaaaagta

SEQ ID NO: 5509784 - DNA, 20 bp, Homo sapiens
tagacaaaaagtatattaaa

SEQ ID NO: 5509785 - DNA, 16 bp, Homo sapiens
tagacaaaacttataa

SEQ ID NO: 5509786 - DNA, 22 bp, Homo sapiens
tagacaaacaagggagaagagt

SEQ ID NO: 5509787 - DNA, 21 bp, Homo sapiens
tagacaaagccttaagcaaat

SEQ ID NO: 5509788 - DNA, 16 bp, Homo sapiens
tagacaaaggcccaga

SEQ ID NO: 5509789 - DNA, 13 bp, Homo sapiens
tagacaaaggcct

SEQ ID NO: 5509790 - DNA, 16 bp, Homo sapiens
tagacaaatactcatg

SEQ ID NO: 5509791 - DNA, 21 bp, Homo sapiens
tagacaaatactcatgtgtat

SEQ ID NO: 5509792 - DNA, 19 bp, Homo sapiens
tagacaaatatttggaggg

SEQ ID NO: 5509793 - DNA, 13 bp, Homo sapiens
tagacaaccatag

SEQ ID NO: 5509794 - DNA, 22 bp, Homo sapiens
tagacaaccctgaggtatctgt

SEQ ID NO: 5509795 - DNA, 19 bp, Homo sapiens
tagacaacctgaaatttat

SEQ ID NO: 5509796 - DNA, 20 bp, Homo sapiens
tagacaacctgaaatttatt

SEQ ID NO: 5509797 - DNA, 20 bp, Homo sapiens
tagacaacgatgaatttctt

SEQ ID NO: 5509798 - DNA, 13 bp, Homo sapiens
tagacaactagat

SEQ ID NO: 5509799 - DNA, 17 bp, Homo sapiens
tagacaagagaatgctg

SEQ ID NO: 5509800 - DNA, 20 bp, Homo sapiens
tagacaagatattgtacata

SEQ ID NO: 5509801 - DNA, 11 bp, Homo sapiens
tagacaagcct

SEQ ID NO: 5509802 - DNA, 15 bp, Homo sapiens
tagacaagcctggag

SEQ ID NO: 5509803 - DNA, 18 bp, Homo sapiens
tagacaaggttgctgttg

SEQ ID NO: 5509804 - DNA, 22 bp, Homo sapiens
tagacaagtccagcctggcaag

SEQ ID NO: 5509805 - DNA, 17 bp, Homo sapiens
tagacaatcattgtttt

SEQ ID NO: 5509806 - DNA, 20 bp, Homo sapiens
tagacaatgatttggccagg

SEQ ID NO: 5509807 - DNA, 20 bp, Homo sapiens
tagacaatggctatattaat

SEQ ID NO: 5509808 - DNA, 22 bp, Homo sapiens
tagacaatgtggaattacataa

SEQ ID NO: 5509809 - DNA, 21 bp, Homo sapiens
tagacaattcctccagagaca

SEQ ID NO: 5509810 - DNA, 23 bp, Homo sapiens
tagacaattcctccagagacact

SEQ ID NO: 5509811 - DNA, 18 bp, Homo sapiens
tagacaattgaggtaagt

SEQ ID NO: 5509812 - DNA, 16 bp, Homo sapiens
tagacaatttgcctta

SEQ ID NO: 5509813 - DNA, 16 bp, Homo sapiens
tagacacaatttcatt

SEQ ID NO: 5509814 - DNA, 21 bp, Homo sapiens
tagacacaatttcatttccag

SEQ ID NO: 5509815 - DNA, 17 bp, Homo sapiens
tagacacacatatacat

SEQ ID NO: 5509816 - DNA, 20 bp, Homo sapiens
tagacacaggatagataact

SEQ ID NO: 5509817 - DNA, 22 bp, Homo sapiens
tagacacatgaaggtaaataaa

SEQ ID NO: 5509818 - DNA, 14 bp, Homo sapiens
tagacaccaaagtt

SEQ ID NO: 5509819 - DNA, 17 bp, Homo sapiens
tagacaccaaagttcta

SEQ ID NO: 5509820 - DNA, 20 bp, Homo sapiens
tagacacgagcttaatcaac

SEQ ID NO: 5509821 - DNA, 21 bp, Homo sapiens
tagacactccccgaagtcttt

SEQ ID NO: 5509822 - DNA, 12 bp, Homo sapiens
tagacactggac

SEQ ID NO: 5509823 - DNA, 17 bp, Homo sapiens
tagacactggctgccag

SEQ ID NO: 5509824 - DNA, 22 bp, Homo sapiens
tagacactggctgccagctatt

SEQ ID NO: 5509825 - DNA, 14 bp, Homo sapiens
tagacactgggaga

SEQ ID NO: 5509826 - DNA, 20 bp, Homo sapiens
tagacactgggagaagagaa

SEQ ID NO: 5509827 - DNA, 16 bp, Homo sapiens
tagacacttacttgat

SEQ ID NO: 5509828 - DNA, 15 bp, Homo sapiens
tagacacttgagtta

SEQ ID NO: 5509829 - DNA, 19 bp, Homo sapiens
tagacacttgagttaactt

SEQ ID NO: 5509830 - DNA, 19 bp, Homo sapiens
tagacagaaaccaagccat

SEQ ID NO: 5509831 - DNA, 14 bp, Homo sapiens
tagacagaagaaac

SEQ ID NO: 5509832 - DNA, 19 bp, Homo sapiens
tagacagaggccctcaagt

SEQ ID NO: 5509833 - DNA, 18 bp, Homo sapiens
tagacagaggtttcattt

SEQ ID NO: 5509834 - DNA, 19 bp, Homo sapiens
tagacagaggtttcatttt

SEQ ID NO: 5509835 - DNA, 18 bp, Homo sapiens
tagacagcaaaaactatc

SEQ ID NO: 5509836 - DNA, 18 bp, Homo sapiens
tagacagccaaaggctgg

SEQ ID NO: 5509837 - DNA, 18 bp, Homo sapiens
tagacaggagaagaaaga

SEQ ID NO: 5509838 - DNA, 22 bp, Homo sapiens
tagacaggttaaatatataaac

SEQ ID NO: 5509839 - DNA, 19 bp, Homo sapiens
tagacagtaagagtttaca

SEQ ID NO: 5509840 - DNA, 22 bp, Homo sapiens
tagacagtatgagtcaatgtgc

SEQ ID NO: 5509841 - DNA, 20 bp, Homo sapiens
tagacagtattgccacctct

SEQ ID NO: 5509842 - DNA, 12 bp, Homo sapiens
tagacagtgccc

SEQ ID NO: 5509843 - DNA, 17 bp, Homo sapiens
tagacagtgctgccctg

SEQ ID NO: 5509844 - DNA, 20 bp, Homo sapiens
tagacagtgctgccctgcga

SEQ ID NO: 5509845 - DNA, 22 bp, Homo sapiens
tagacagtggtaaatatagaac

SEQ ID NO: 5509846 - DNA, 17 bp, Homo sapiens
tagacagttagagactc

SEQ ID NO: 5509847 - DNA, 13 bp, Homo sapiens
tagacagtttgta

SEQ ID NO: 5509848 - DNA, 16 bp, Homo sapiens
tagacagttttgagaa

SEQ ID NO: 5509849 - DNA, 21 bp, Homo sapiens
tagacataactggtttgactc

SEQ ID NO: 5509850 - DNA, 23 bp, Homo sapiens
tagacatagttcagccacaaagt

SEQ ID NO: 5509851 - DNA, 22 bp, Homo sapiens
tagacatataccaaaaacaagt

SEQ ID NO: 5509852 - DNA, 20 bp, Homo sapiens
tagacatcaatcctggtaac

SEQ ID NO: 5509853 - DNA, 21 bp, Homo sapiens
tagacatcaatcctggtaacc

SEQ ID NO: 5509854 - DNA, 12 bp, Homo sapiens
tagacatgaaag

SEQ ID NO: 5509855 - DNA, 17 bp, Homo sapiens
tagacatggaggttcta

SEQ ID NO: 5509856 - DNA, 20 bp, Homo sapiens
tagacatggaggttctaagg

SEQ ID NO: 5509857 - DNA, 11 bp, Homo sapiens
tagacatgtag

SEQ ID NO: 5509858 - DNA, 13 bp, Homo sapiens
tagacatgtcatg

SEQ ID NO: 5509859 - DNA, 21 bp, Homo sapiens
tagacattattttgtatggaa

SEQ ID NO: 5509860 - DNA, 20 bp, Homo sapiens
tagacattctcttacttttt

SEQ ID NO: 5509861 - DNA, 15 bp, Homo sapiens
tagacattgaggacc

SEQ ID NO: 5509862 - DNA, 23 bp, Homo sapiens
tagacatttcaaaattaatagct

SEQ ID NO: 5509863 - DNA, 17 bp, Homo sapiens
tagacattttaacaaga

SEQ ID NO: 5509864 - DNA, 14 bp, Homo sapiens
tagacattttgaaa

SEQ ID NO: 5509865 - DNA, 17 bp, Homo sapiens
tagaccaaaagcaacat

SEQ ID NO: 5509866 - DNA, 14 bp, Homo sapiens
tagaccaattgaag

SEQ ID NO: 5509867 - DNA, 17 bp, Homo sapiens
tagaccaccaagccttg

SEQ ID NO: 5509868 - DNA, 19 bp, Homo sapiens
tagaccaccaagccttgat

SEQ ID NO: 5509869 - DNA, 20 bp, Homo sapiens
tagaccagtttgcatgattc

SEQ ID NO: 5509870 - DNA, 20 bp, Homo sapiens
tagacccactggactcacct

SEQ ID NO: 5509871 - DNA, 13 bp, Homo sapiens
tagacccaggtgg

SEQ ID NO: 5509872 - DNA, 20 bp, Homo sapiens
tagacccaggtggagggcac

SEQ ID NO: 5509873 - DNA, 19 bp, Homo sapiens
tagacccatagcagctttg

SEQ ID NO: 5509874 - DNA, 21 bp, Homo sapiens
tagacccctgggtgggccctg

SEQ ID NO: 5509875 - DNA, 16 bp, Homo sapiens
tagacccgccaggtca

SEQ ID NO: 5509876 - DNA, 18 bp, Homo sapiens
tagaccctcatgctgcca

SEQ ID NO: 5509877 - DNA, 18 bp, Homo sapiens
tagaccgtggtgtcctct

SEQ ID NO: 5509878 - DNA, 16 bp, Homo sapiens
tagacctacagacctg

SEQ ID NO: 5509879 - DNA, 19 bp, Homo sapiens
tagacctagggaggacctt

SEQ ID NO: 5509880 - DNA, 21 bp, Homo sapiens
tagacctataatccttgataa

SEQ ID NO: 5509881 - DNA, 13 bp, Homo sapiens
tagacctcagcct

SEQ ID NO: 5509882 - DNA, 21 bp, Homo sapiens
tagacctcagcctgtgctgcc

SEQ ID NO: 5509883 - DNA, 16 bp, Homo sapiens
tagacctccagctgtt

SEQ ID NO: 5509884 - DNA, 18 bp, Homo sapiens
tagacctccccctcactt

SEQ ID NO: 5509885 - DNA, 21 bp, Homo sapiens
tagacctctggttaatttata

SEQ ID NO: 5509886 - DNA, 20 bp, Homo sapiens
tagacctcttcctggaataa

SEQ ID NO: 5509887 - DNA, 23 bp, Homo sapiens
tagacctcttcctggaataaaca

SEQ ID NO: 5509888 - DNA, 14 bp, Homo sapiens
tagacctgacaatt

SEQ ID NO: 5509889 - DNA, 16 bp, Homo sapiens
tagacctgccagccac

SEQ ID NO: 5509890 - DNA, 16 bp, Homo sapiens
tagacctgtctcctgg

SEQ ID NO: 5509891 - DNA, 22 bp, Homo sapiens
tagaccttgagggtgggccagc

SEQ ID NO: 5509892 - DNA, 23 bp, Homo sapiens
tagaccttgagggtgggccagca

SEQ ID NO: 5509893 - DNA, 16 bp, Homo sapiens
tagagcacttttaaca

SEQ ID NO: 5509894 - DNA, 15 bp, Homo sapiens
tagagcagaaattct

SEQ ID NO: 5509895 - DNA, 20 bp, Homo sapiens
tagagcagattctagcacat

SEQ ID NO: 5509896 - DNA, 12 bp, Homo sapiens
tagagcagccca

SEQ ID NO: 5509897 - DNA, 18 bp, Homo sapiens
tagagcagcctcgtggag

SEQ ID NO: 5509898 - DNA, 19 bp, Homo sapiens
tagagcagcctcgtggagc

SEQ ID NO: 5509899 - DNA, 14 bp, Homo sapiens
tagagcagcctgct

SEQ ID NO: 5509900 - DNA, 16 bp, Homo sapiens
tagagcagctttggga

SEQ ID NO: 5509901 - DNA, 23 bp, Homo sapiens
tagagcagggattaacctctgca

SEQ ID NO: 5509902 - DNA, 17 bp, Homo sapiens
tagagcagtttctgtcc

SEQ ID NO: 5509903 - DNA, 13 bp, Homo sapiens
tagagccagcctt

SEQ ID NO: 5509904 - DNA, 14 bp, Homo sapiens
tagagcccactgct

SEQ ID NO: 5509905 - DNA, 18 bp, Homo sapiens
tagagcccattaatcttg

SEQ ID NO: 5509906 - DNA, 21 bp, Homo sapiens
tagagcccattaatcttgatc

SEQ ID NO: 5509907 - DNA, 19 bp, Homo sapiens
tagagccccccgtgtggct

SEQ ID NO: 5509908 - DNA, 20 bp, Homo sapiens
tagagccctggccagccctt

SEQ ID NO: 5509909 - DNA, 14 bp, Homo sapiens
tagagccgagggga

SEQ ID NO: 5509910 - DNA, 17 bp, Homo sapiens
tagagccgaggggagag

SEQ ID NO: 5509911 - DNA, 22 bp, Homo sapiens
tagagccgaggggagagaggga

SEQ ID NO: 5509912 - DNA, 21 bp, Homo sapiens
tagagccgggtgtccccaaca

SEQ ID NO: 5509913 - DNA, 14 bp, Homo sapiens
tagagcctctgcct

SEQ ID NO: 5509914 - DNA, 21 bp, Homo sapiens
tagagcctctgcctgacagca

SEQ ID NO: 5509915 - DNA, 17 bp, Homo sapiens
tagagcctgcatctgtc

SEQ ID NO: 5509916 - DNA, 16 bp, Homo sapiens
tagagcctgcctggag

SEQ ID NO: 5509917 - DNA, 17 bp, Homo sapiens
tagagcctgcctggagc

SEQ ID NO: 5509918 - DNA, 22 bp, Homo sapiens
tagagccttctgatgtctctaa

SEQ ID NO: 5509919 - DNA, 12 bp, Homo sapiens
tagagcctttga

SEQ ID NO: 5509920 - DNA, 22 bp, Homo sapiens
tagagcctttgggatcgtcctg

SEQ ID NO: 5509921 - DNA, 22 bp, Homo sapiens
tagagccttttatctgcagaac

SEQ ID NO: 5509922 - DNA, 17 bp, Homo sapiens
tagagcgcggctggctc

SEQ ID NO: 5509923 - DNA, 20 bp, Homo sapiens
tagagcgtttggttaaagta

SEQ ID NO: 5509924 - DNA, 15 bp, Homo sapiens
tagagctagctgcca

SEQ ID NO: 5509925 - DNA, 17 bp, Homo sapiens
tagagctagtctttcac

SEQ ID NO: 5509926 - DNA, 17 bp, Homo sapiens
tagagctcctgtcccta

SEQ ID NO: 5509927 - DNA, 19 bp, Homo sapiens
tagagctcctgtccctacc

SEQ ID NO: 5509928 - DNA, 14 bp, Homo sapiens
tagagctcgaaata

SEQ ID NO: 5509929 - DNA, 21 bp, Homo sapiens
tagagctcttgtgttcagaag

SEQ ID NO: 5509930 - DNA, 22 bp, Homo sapiens
tagagctcttgtgttcagaaga

SEQ ID NO: 5509931 - DNA, 14 bp, Homo sapiens
tagagctgatccag

SEQ ID NO: 5509932 - DNA, 15 bp, Homo sapiens
tagagctgatccaga

SEQ ID NO: 5509933 - DNA, 13 bp, Homo sapiens
tagagctgccact

SEQ ID NO: 5509934 - DNA, 18 bp, Homo sapiens
tagagctgccactgggca

SEQ ID NO: 5509935 - DNA, 16 bp, Homo sapiens
tagagctgggaaacag

SEQ ID NO: 5509936 - DNA, 20 bp, Homo sapiens
tagagctgggaaacagggag

SEQ ID NO: 5509937 - DNA, 18 bp, Homo sapiens
tagagctgggtggcctgt

SEQ ID NO: 5509938 - DNA, 17 bp, Homo sapiens
tagagcttagatttccc

SEQ ID NO: 5509939 - DNA, 22 bp, Homo sapiens
tagagcttccaaatgtgtcaga

SEQ ID NO: 5509940 - DNA, 22 bp, Homo sapiens
tagagcttccactgtcagccct

SEQ ID NO: 5509941 - DNA, 23 bp, Homo sapiens
tagagcttgcagtgaagtgttct

SEQ ID NO: 5509942 - DNA, 18 bp, Homo sapiens
tagagcttgtaataaata

SEQ ID NO: 5509943 - DNA, 23 bp, Homo sapiens
tagagctttctttcacaaaaaag

SEQ ID NO: 5509944 - DNA, 18 bp, Homo sapiens
tagagcttttcagaacat

SEQ ID NO: 5509945 - DNA, 17 bp, Homo sapiens
tagaggaaaaaaatgac

SEQ ID NO: 5509946 - DNA, 22 bp, Homo sapiens
tagaggaaaaaaatgactaaaa

SEQ ID NO: 5509947 - DNA, 14 bp, Homo sapiens
tagaggaaaatcaa

SEQ ID NO: 5509948 - DNA, 19 bp, Homo sapiens
tagaggaaataagaaaaat

SEQ ID NO: 5509949 - DNA, 22 bp, Homo sapiens
tagaggaagaaatgtcagatgc

SEQ ID NO: 5509950 - DNA, 15 bp, Homo sapiens
tagaggaagcagcca

SEQ ID NO: 5509951 - DNA, 21 bp, Homo sapiens
tagaggaagcctgattaaaga

SEQ ID NO: 5509952 - DNA, 19 bp, Homo sapiens
tagaggaataaagctgtga

SEQ ID NO: 5509953 - DNA, 17 bp, Homo sapiens
tagaggacactaggaga

SEQ ID NO: 5509954 - DNA, 14 bp, Homo sapiens
tagaggataaataa

SEQ ID NO: 5509955 - DNA, 16 bp, Homo sapiens
tagaggataaataata

SEQ ID NO: 5509956 - DNA, 19 bp, Homo sapiens
tagaggataaataataaag

SEQ ID NO: 5509957 - DNA, 22 bp, Homo sapiens
tagaggcaacaggattgatcat

SEQ ID NO: 5509958 - DNA, 20 bp, Homo sapiens
tagaggcagggctgcattgg

SEQ ID NO: 5509959 - DNA, 23 bp, Homo sapiens
tagaggcattacttgctttcaat

SEQ ID NO: 5509960 - DNA, 15 bp, Homo sapiens
tagaggcattgttag

SEQ ID NO: 5509961 - DNA, 20 bp, Homo sapiens
tagaggccaaattaatcttt

SEQ ID NO: 5509962 - DNA, 13 bp, Homo sapiens
tagaggccaccta

SEQ ID NO: 5509963 - DNA, 14 bp, Homo sapiens
tagaggcccaggca

SEQ ID NO: 5509964 - DNA, 15 bp, Homo sapiens
tagaggcctgaggat

SEQ ID NO: 5509965 - DNA, 23 bp, Homo sapiens
tagaggcctgaggatgagctgga

SEQ ID NO: 5509966 - DNA, 21 bp, Homo sapiens
tagaggctccagctctggcac

SEQ ID NO: 5509967 - DNA, 23 bp, Homo sapiens
tagaggctccagctctggcacag

SEQ ID NO: 5509968 - DNA, 14 bp, Homo sapiens
tagaggctccccag

SEQ ID NO: 5509969 - DNA, 19 bp, Homo sapiens
tagaggcttccttcatttc

SEQ ID NO: 5509970 - DNA, 18 bp, Homo sapiens
tagaggcttctccgccag

SEQ ID NO: 5509971 - DNA, 19 bp, Homo sapiens
tagaggcttctccgccagc

SEQ ID NO: 5509972 - DNA, 17 bp, Homo sapiens
tagaggcttgatgatga

SEQ ID NO: 5509973 - DNA, 17 bp, Homo sapiens
tagaggctttcaaatgt

SEQ ID NO: 5509974 - DNA, 18 bp, Homo sapiens
tagaggctttgagcaact

SEQ ID NO: 5509975 - DNA, 15 bp, Homo sapiens
tagaggcttttatta

SEQ ID NO: 5509976 - DNA, 18 bp, Homo sapiens
tagaggcttttattagaa

SEQ ID NO: 5509977 - DNA, 19 bp, Homo sapiens
tagaggcttttattagaaa

SEQ ID NO: 5509978 - DNA, 13 bp, Homo sapiens
tagagggaatcta

SEQ ID NO: 5509979 - DNA, 23 bp, Homo sapiens
tagagggaggagaatgagcctcg

SEQ ID NO: 5509980 - DNA, 18 bp, Homo sapiens
tagagggcattgactggt

SEQ ID NO: 5509981 - DNA, 14 bp, Homo sapiens
tagagggcccatca

SEQ ID NO: 5509982 - DNA, 14 bp, Homo sapiens
tagagggccctggt

SEQ ID NO: 5509983 - DNA, 20 bp, Homo sapiens
tagagggccttgcttctctt

SEQ ID NO: 5509984 - DNA, 22 bp, Homo sapiens
tagagggccttgcttctcttct

SEQ ID NO: 5509985 - DNA, 17 bp, Homo sapiens
tagaggggacaagccag

SEQ ID NO: 5509986 - DNA, 23 bp, Homo sapiens
tagaggggagacattagaaaaaa

SEQ ID NO: 5509987 - DNA, 23 bp, Homo sapiens
tagaggggggatttccagccagg

SEQ ID NO: 5509988 - DNA, 22 bp, Homo sapiens
tagaggggttttagatttttaa

SEQ ID NO: 5509989 - DNA, 16 bp, Homo sapiens
tagagggtcggggagg

SEQ ID NO: 5509990 - DNA, 17 bp, Homo sapiens
tagagggtgctgcccca

SEQ ID NO: 5509991 - DNA, 18 bp, Homo sapiens
tagaggtaaaatttgcac

SEQ ID NO: 5509992 - DNA, 15 bp, Homo sapiens
tagaggtataattgt

SEQ ID NO: 5509993 - DNA, 17 bp, Homo sapiens
tagaggtatattggaag

SEQ ID NO: 5509994 - DNA, 15 bp, Homo sapiens
tagaggtcctcatgg

SEQ ID NO: 5509995 - DNA, 17 bp, Homo sapiens
tagaggtcctctggagc

SEQ ID NO: 5509996 - DNA, 18 bp, Homo sapiens
tagaggtcctctggagcc

SEQ ID NO: 5509997 - DNA, 19 bp, Homo sapiens
tagaggtcctctggagccc

SEQ ID NO: 5509998 - DNA, 16 bp, Homo sapiens
tagaggtgagggaagc

SEQ ID NO: 5509999 - DNA, 17 bp, Homo sapiens
tagaggtgagttttaaa

SEQ ID NO: 5510000 - DNA, 18 bp, Homo sapiens
tagaggtgggcagctggg

SEQ ID NO: 5510001 - DNA, 20 bp, Homo sapiens
tagaggtgggcagctgggcc

SEQ ID NO: 5510002 - DNA, 23 bp, Homo sapiens
tagaggtgttacagaggaccctt

SEQ ID NO: 5510003 - DNA, 15 bp, Homo sapiens
tagaggttcaaagat

SEQ ID NO: 5510004 - DNA, 16 bp, Homo sapiens
tagaggttcaaagata

SEQ ID NO: 5510005 - DNA, 19 bp, Homo sapiens
tagaggttcaaagatattt

SEQ ID NO: 5510006 - DNA, 21 bp, Homo sapiens
tagaggttcaaagatattttg

SEQ ID NO: 5510007 - DNA, 21 bp, Homo sapiens
tagaggttctgggttttctga

SEQ ID NO: 5510008 - DNA, 22 bp, Homo sapiens
tagaggttctgggttttctgaa

SEQ ID NO: 5510009 - DNA, 23 bp, Homo sapiens
tagaggttctgggttttctgaaa

SEQ ID NO: 5510010 - DNA, 21 bp, Homo sapiens
tagaggttgcagcatgagact

SEQ ID NO: 5510011 - DNA, 13 bp, Homo sapiens
tagaggtttaaag

SEQ ID NO: 5510012 - DNA, 19 bp, Homo sapiens
tagaggtttaaagaaaaat

SEQ ID NO: 5510013 - DNA, 14 bp, Homo sapiens
tagaggtttgtcaa

SEQ ID NO: 5510014 - DNA, 21 bp, Homo sapiens
tagaggtttgtcaacaaaaag

SEQ ID NO: 5510015 - DNA, 19 bp, Homo sapiens
tagaggttttaaagtgatt

SEQ ID NO: 5510016 - DNA, 14 bp, Homo sapiens
tagaggttttgtat

SEQ ID NO: 5510017 - DNA, 16 bp, Homo sapiens
tagaggttttgtattg

SEQ ID NO: 5510018 - DNA, 16 bp, Homo sapiens
tagaggttttgttgtt

SEQ ID NO: 5510019 - DNA, 17 bp, Homo sapiens
tagagtaaaaagaaaac

SEQ ID NO: 5510020 - DNA, 19 bp, Homo sapiens
tagagtaaaaagaaaacaa

SEQ ID NO: 5510021 - DNA, 23 bp, Homo sapiens
tagagtaaataaactgtttatat

SEQ ID NO: 5510022 - DNA, 21 bp, Homo sapiens
tagagtaagaaatttcaggtt

SEQ ID NO: 5510023 - DNA, 14 bp, Homo sapiens
tagagtaatgatgt

SEQ ID NO: 5510024 - DNA, 21 bp, Homo sapiens
tagagtagaagatttgatgct

SEQ ID NO: 5510025 - DNA, 17 bp, Homo sapiens
tagagtcaatttgctga

SEQ ID NO: 5510026 - DNA, 18 bp, Homo sapiens
tagagtcacagctttccc

SEQ ID NO: 5510027 - DNA, 21 bp, Homo sapiens
tagagtcacccccccaggcct

SEQ ID NO: 5510028 - DNA, 12 bp, Homo sapiens
tagagtcattca

SEQ ID NO: 5510029 - DNA, 14 bp, Homo sapiens
tagagtcattgtaa

SEQ ID NO: 5510030 - DNA, 15 bp, Homo sapiens
tagagtcattgtaat

SEQ ID NO: 5510031 - DNA, 19 bp, Homo sapiens
tagagtccaacgtggggca

SEQ ID NO: 5510032 - DNA, 20 bp, Homo sapiens
tagagtcccaggttggctct

SEQ ID NO: 5510033 - DNA, 20 bp, Homo sapiens
tagagtccccccgaccagat

SEQ ID NO: 5510034 - DNA, 14 bp, Homo sapiens
tagagtcctcactc

SEQ ID NO: 5510035 - DNA, 11 bp, Homo sapiens
tagagtgacag

SEQ ID NO: 5510036 - DNA, 15 bp, Homo sapiens
tagagtgagggcctg

SEQ ID NO: 5510037 - DNA, 14 bp, Homo sapiens
tagagtgcagtggc

SEQ ID NO: 5510038 - DNA, 14 bp, Homo sapiens
tagagtgcccagca

SEQ ID NO: 5510039 - DNA, 15 bp, Homo sapiens
tagagtgcccagcag

SEQ ID NO: 5510040 - DNA, 22 bp, Homo sapiens
tagagtgcccttaaaataatga

SEQ ID NO: 5510041 - DNA, 16 bp, Homo sapiens
tagagtgctctgaccc

SEQ ID NO: 5510042 - DNA, 19 bp, Homo sapiens
tagagtggtctatttctcc

SEQ ID NO: 5510043 - DNA, 11 bp, Homo sapiens
tagagtgtagc

SEQ ID NO: 5510044 - DNA, 20 bp, Homo sapiens
tagagtgtagcctaaagggc

SEQ ID NO: 5510045 - DNA, 18 bp, Homo sapiens
tagagtgtagctgtaagg

SEQ ID NO: 5510046 - DNA, 20 bp, Homo sapiens
tagagtgtagtttacagaaa

SEQ ID NO: 5510047 - DNA, 15 bp, Homo sapiens
tagagtgtctttcca

SEQ ID NO: 5510048 - DNA, 22 bp, Homo sapiens
tagagttaaaagttagcattgt

SEQ ID NO: 5510049 - DNA, 13 bp, Homo sapiens
tagagttaagaag

SEQ ID NO: 5510050 - DNA, 17 bp, Homo sapiens
tagagttagactgttgg

SEQ ID NO: 5510051 - DNA, 17 bp, Homo sapiens
tagagttatcttcttta

SEQ ID NO: 5510052 - DNA, 14 bp, Homo sapiens
tagagttcttttgg

SEQ ID NO: 5510053 - DNA, 18 bp, Homo sapiens
tagagttcttttggatca

SEQ ID NO: 5510054 - DNA, 23 bp, Homo sapiens
tagagttgattgtctagtgagga

SEQ ID NO: 5510055 - DNA, 13 bp, Homo sapiens
tagagtttaacac

SEQ ID NO: 5510056 - DNA, 17 bp, Homo sapiens
tagagtttaacagatat

SEQ ID NO: 5510057 - DNA, 21 bp, Homo sapiens
tagagtttacagtttgtgttt

SEQ ID NO: 5510058 - DNA, 23 bp, Homo sapiens
tagagtttctgtttgattctttt

SEQ ID NO: 5510059 - DNA, 21 bp, Homo sapiens
tagagttttattcctttcctt

SEQ ID NO: 5510060 - DNA, 18 bp, Homo sapiens
tagagtttttaaacatca

SEQ ID NO: 5510061 - DNA, 19 bp, Homo sapiens
tagataaaacatctttgaa

SEQ ID NO: 5510062 - DNA, 14 bp, Homo sapiens
tagataaaaggaga

SEQ ID NO: 5510063 - DNA, 17 bp, Homo sapiens
tagataaacacaggcag

SEQ ID NO: 5510064 - DNA, 15 bp, Homo sapiens
tagataaactcagaa

SEQ ID NO: 5510065 - DNA, 14 bp, Homo sapiens
tagataaagcactg

SEQ ID NO: 5510066 - DNA, 13 bp, Homo sapiens
tagataaaggaaa

SEQ ID NO: 5510067 - DNA, 15 bp, Homo sapiens
tagataaaggaaaca

SEQ ID NO: 5510068 - DNA, 23 bp, Homo sapiens
tagataaatataatatgcgtctt

SEQ ID NO: 5510069 - DNA, 19 bp, Homo sapiens
tagcaaggtcatttcttca

SEQ ID NO: 5510070 - DNA, 15 bp, Homo sapiens
tagcaagtcccatca

SEQ ID NO: 5510071 - DNA, 19 bp, Homo sapiens
tagcaagttctagaaggtc

SEQ ID NO: 5510072 - DNA, 22 bp, Homo sapiens
tagcaagttgactaaacagcaa

SEQ ID NO: 5510073 - DNA, 15 bp, Homo sapiens
tagcaataaataaca

SEQ ID NO: 5510074 - DNA, 15 bp, Homo sapiens
tagcaataaatgctt

SEQ ID NO: 5510075 - DNA, 23 bp, Homo sapiens
tagcaataaatgcttttctaatg

SEQ ID NO: 5510076 - DNA, 16 bp, Homo sapiens
tagcaataactgaaaa

SEQ ID NO: 5510077 - DNA, 19 bp, Homo sapiens
tagcaataactgaaaatga

SEQ ID NO: 5510078 - DNA, 20 bp, Homo sapiens
tagcaataagttgaatgata

SEQ ID NO: 5510079 - DNA, 14 bp, Homo sapiens
tagcaatacttgga

SEQ ID NO: 5510080 - DNA, 21 bp, Homo sapiens
tagcaataggtttgtaaaatg

SEQ ID NO: 5510081 - DNA, 13 bp, Homo sapiens
tagcaatatattt

SEQ ID NO: 5510082 - DNA, 18 bp, Homo sapiens
tagcaatatatttgtagg

SEQ ID NO: 5510083 - DNA, 14 bp, Homo sapiens
tagcaatatttata

SEQ ID NO: 5510084 - DNA, 20 bp, Homo sapiens
tagcaatggccagagcctct

SEQ ID NO: 5510085 - DNA, 14 bp, Homo sapiens
tagcaatgtgcctt

SEQ ID NO: 5510086 - DNA, 14 bp, Homo sapiens
tagcaatgtgtttc

SEQ ID NO: 5510087 - DNA, 18 bp, Homo sapiens
tagcaattagcagaagtg

SEQ ID NO: 5510088 - DNA, 21 bp, Homo sapiens
tagcaattcatgggctgtgtg

SEQ ID NO: 5510089 - DNA, 16 bp, Homo sapiens
tagcaattggttgttt

SEQ ID NO: 5510090 - DNA, 19 bp, Homo sapiens
tagcacaagataaattgag

SEQ ID NO: 5510091 - DNA, 14 bp, Homo sapiens
tagcacaatttgag

SEQ ID NO: 5510092 - DNA, 16 bp, Homo sapiens
tagcacagaccctgcc

SEQ ID NO: 5510093 - DNA, 17 bp, Homo sapiens
tagcacagaccctgccc

SEQ ID NO: 5510094 - DNA, 19 bp, Homo sapiens
tagcacagaccctgccctg

SEQ ID NO: 5510095 - DNA, 12 bp, Homo sapiens
tagcacagagag

SEQ ID NO: 5510096 - DNA, 14 bp, Homo sapiens
tagcacagagaggg

SEQ ID NO: 5510097 - DNA, 16 bp, Homo sapiens
tagcacagagagggac

SEQ ID NO: 5510098 - DNA, 22 bp, Homo sapiens
tagcacagaggatggcttcccc

SEQ ID NO: 5510099 - DNA, 17 bp, Homo sapiens
tagcacagaggcctgac

SEQ ID NO: 5510100 - DNA, 19 bp, Homo sapiens
tagcacagaggcctgactg

SEQ ID NO: 5510101 - DNA, 17 bp, Homo sapiens
tagcacagatggccagc

SEQ ID NO: 5510102 - DNA, 15 bp, Homo sapiens
tagcacagattttaa

SEQ ID NO: 5510103 - DNA, 22 bp, Homo sapiens
tagcacagattttgaatctgtg

SEQ ID NO: 5510104 - DNA, 23 bp, Homo sapiens
tagcacagccagacttgcttcct

SEQ ID NO: 5510105 - DNA, 20 bp, Homo sapiens
tagcacagcgttatgtgtct

SEQ ID NO: 5510106 - DNA, 21 bp, Homo sapiens
tagcacaggctgagtgcaggc

SEQ ID NO: 5510107 - DNA, 22 bp, Homo sapiens
tagcacagtaaaagtaaagact

SEQ ID NO: 5510108 - DNA, 13 bp, Homo sapiens
tagcacagtattt

SEQ ID NO: 5510109 - DNA, 22 bp, Homo sapiens
tagcacatacacccccttgtag

SEQ ID NO: 5510110 - DNA, 15 bp, Homo sapiens
tagcacatcactgag

SEQ ID NO: 5510111 - DNA, 15 bp, Homo sapiens
tagcacatcattcct

SEQ ID NO: 5510112 - DNA, 22 bp, Homo sapiens
tagcacatccaccaaactcctg

SEQ ID NO: 5510113 - DNA, 23 bp, Homo sapiens
tagcacatccaccaaactcctgc

SEQ ID NO: 5510114 - DNA, 21 bp, Homo sapiens
tagcacatgtctgtcctcaga

SEQ ID NO: 5510115 - DNA, 18 bp, Homo sapiens
tagcacatgtgtaagaca

SEQ ID NO: 5510116 - DNA, 16 bp, Homo sapiens
tagcacatgttttaca

SEQ ID NO: 5510117 - DNA, 14 bp, Homo sapiens
tagcaccaaataaa

SEQ ID NO: 5510118 - DNA, 19 bp, Homo sapiens
tagcaccaatacaaattga

SEQ ID NO: 5510119 - DNA, 11 bp, Homo sapiens
tagcaccagct

SEQ ID NO: 5510120 - DNA, 16 bp, Homo sapiens
tagcaccagggaaggg

SEQ ID NO: 5510121 - DNA, 15 bp, Homo sapiens
tagcaccatcaccct

SEQ ID NO: 5510122 - DNA, 13 bp, Homo sapiens
tagcaccatggca

SEQ ID NO: 5510123 - DNA, 23 bp, Homo sapiens
tagcacctccccagacagggctc

SEQ ID NO: 5510124 - DNA, 13 bp, Homo sapiens
tagcacctccccc

SEQ ID NO: 5510125 - DNA, 15 bp, Homo sapiens
tagcacctttcaacc

SEQ ID NO: 5510126 - DNA, 23 bp, Homo sapiens
tagcacggagtgttggggctggg

SEQ ID NO: 5510127 - DNA, 15 bp, Homo sapiens
tagcactatttaaaa

SEQ ID NO: 5510128 - DNA, 17 bp, Homo sapiens
tagcactcacatgctgg

SEQ ID NO: 5510129 - DNA, 18 bp, Homo sapiens
tagcactcacatgctgga

SEQ ID NO: 5510130 - DNA, 22 bp, Homo sapiens
tagcactcctcaagactttgat

SEQ ID NO: 5510131 - DNA, 14 bp, Homo sapiens
tagcactctcagag

SEQ ID NO: 5510132 - DNA, 22 bp, Homo sapiens
tagcactgccccacatgcatgt

SEQ ID NO: 5510133 - DNA, 20 bp, Homo sapiens
tagcactgggaactctggct

SEQ ID NO: 5510134 - DNA, 20 bp, Homo sapiens
tagcactggtttgtttctca

SEQ ID NO: 5510135 - DNA, 23 bp, Homo sapiens
tagcactgttgatgtatctgagt

SEQ ID NO: 5510136 - DNA, 16 bp, Homo sapiens
tagcacttacgtaaaa

SEQ ID NO: 5510137 - DNA, 23 bp, Homo sapiens
tagcactttcattgccagtgtct

SEQ ID NO: 5510138 - DNA, 14 bp, Homo sapiens
tagcactttgaaat

SEQ ID NO: 5510139 - DNA, 21 bp, Homo sapiens
tagcactttgaaatacctcat

SEQ ID NO: 5510140 - DNA, 16 bp, Homo sapiens
tagcactttgggaggc

SEQ ID NO: 5510141 - DNA, 19 bp, Homo sapiens
tagcagaaaacagaggcca

SEQ ID NO: 5510142 - DNA, 23 bp, Homo sapiens
tagcagaaaccaagtctacttca

SEQ ID NO: 5510143 - DNA, 21 bp, Homo sapiens
tagcagaagaaaggaacattt

SEQ ID NO: 5510144 - DNA, 20 bp, Homo sapiens
tagcagaatcaaaatgacct

SEQ ID NO: 5510145 - DNA, 14 bp, Homo sapiens
tagcagacactgcc

SEQ ID NO: 5510146 - DNA, 17 bp, Homo sapiens
tagcagacagaaactgg

SEQ ID NO: 5510147 - DNA, 15 bp, Homo sapiens
tagcagacagtgttt

SEQ ID NO: 5510148 - DNA, 22 bp, Homo sapiens
tagcagactttcccaaatgtat

SEQ ID NO: 5510149 - DNA, 15 bp, Homo sapiens
tagcagagagccaaa

SEQ ID NO: 5510150 - DNA, 16 bp, Homo sapiens
tagcagagagccaaat

SEQ ID NO: 5510151 - DNA, 18 bp, Homo sapiens
tagcagaggaaaaagaaa

SEQ ID NO: 5510152 - DNA, 19 bp, Homo sapiens
tagcagaggaaaaagaaaa

SEQ ID NO: 5510153 - DNA, 13 bp, Homo sapiens
tagcagaggggcc

SEQ ID NO: 5510154 - DNA, 21 bp, Homo sapiens
tagcagaggggccaggcccag

SEQ ID NO: 5510155 - DNA, 22 bp, Homo sapiens
tagcagaggggccaggcccagg

SEQ ID NO: 5510156 - DNA, 18 bp, Homo sapiens
tagcagaggtttaaatgt

SEQ ID NO: 5510157 - DNA, 15 bp, Homo sapiens
tagcagagtcattgt

SEQ ID NO: 5510158 - DNA, 14 bp, Homo sapiens
tagcagagtctgtc

SEQ ID NO: 5510159 - DNA, 14 bp, Homo sapiens
tagcagagttaaat

SEQ ID NO: 5510160 - DNA, 23 bp, Homo sapiens
tagcagataaagacagctgacag

SEQ ID NO: 5510161 - DNA, 14 bp, Homo sapiens
tagcagatggtttc

SEQ ID NO: 5510162 - DNA, 15 bp, Homo sapiens
tagcagatttaagat

SEQ ID NO: 5510163 - DNA, 20 bp, Homo sapiens
tagcagattttaattttgaa

SEQ ID NO: 5510164 - DNA, 17 bp, Homo sapiens
tagcagcaactgaagac

SEQ ID NO: 5510165 - DNA, 15 bp, Homo sapiens
tagcagcagaggcag

SEQ ID NO: 5510166 - DNA, 20 bp, Homo sapiens
tagcagcagcctttaatgca

SEQ ID NO: 5510167 - DNA, 12 bp, Homo sapiens
tagcagcaggct

SEQ ID NO: 5510168 - DNA, 16 bp, Homo sapiens
tagcagcccaccctgc

SEQ ID NO: 5510169 - DNA, 12 bp, Homo sapiens
tagcagcccagc

SEQ ID NO: 5510170 - DNA, 13 bp, Homo sapiens
tagcagcccagca

SEQ ID NO: 5510171 - DNA, 15 bp, Homo sapiens
tagcagccctggatg

SEQ ID NO: 5510172 - DNA, 22 bp, Homo sapiens
tagcagcccttgtgtgtgccct

SEQ ID NO: 5510173 - DNA, 14 bp, Homo sapiens
tagcagctatctct

SEQ ID NO: 5510174 - DNA, 12 bp, Homo sapiens
tagcagctcagg

SEQ ID NO: 5510175 - DNA, 22 bp, Homo sapiens
tagcagctcaggcgcagcccta

SEQ ID NO: 5510176 - DNA, 20 bp, Homo sapiens
tagcagctcttcccctttcc

SEQ ID NO: 5510177 - DNA, 14 bp, Homo sapiens
tagcagctgctact

SEQ ID NO: 5510178 - DNA, 10 bp, Homo sapiens
tagcagctgg

SEQ ID NO: 5510179 - DNA, 11 bp, Homo sapiens
tagcagctgga

SEQ ID NO: 5510180 - DNA, 23 bp, Homo sapiens
tagcagctggcctaatcactctg

SEQ ID NO: 5510181 - DNA, 17 bp, Homo sapiens
tagcagctgggttggta

SEQ ID NO: 5510182 - DNA, 15 bp, Homo sapiens
tagcaggaaatagtg

SEQ ID NO: 5510183 - DNA, 15 bp, Homo sapiens
tagcaggaaatgtag

SEQ ID NO: 5510184 - DNA, 20 bp, Homo sapiens
tagcaggaatttaattaggt

SEQ ID NO: 5510185 - DNA, 17 bp, Homo sapiens
tagcaggacctgccaag

SEQ ID NO: 5510186 - DNA, 17 bp, Homo sapiens
tagcaggagaggagagc

SEQ ID NO: 5510187 - DNA, 15 bp, Homo sapiens
tagcaggcccagctg

SEQ ID NO: 5510188 - DNA, 15 bp, Homo sapiens
tagcaggctgttcca

SEQ ID NO: 5510189 - DNA, 18 bp, Homo sapiens
tagcaggggcaccttccg

SEQ ID NO: 5510190 - DNA, 16 bp, Homo sapiens
tagcaggggctgcagt

SEQ ID NO: 5510191 - DNA, 19 bp, Homo sapiens
tagcagggggggaaatgca

SEQ ID NO: 5510192 - DNA, 23 bp, Homo sapiens
tagcagggggggaaatgcattta

SEQ ID NO: 5510193 - DNA, 17 bp, Homo sapiens
tagcaggtaccactgat

SEQ ID NO: 5510194 - DNA, 16 bp, Homo sapiens
tagcagtaaaagatga

SEQ ID NO: 5510195 - DNA, 20 bp, Homo sapiens
tagcagtaaaagatgaagtt

SEQ ID NO: 5510196 - DNA, 17 bp, Homo sapiens
tagcagtgagtcatatc

SEQ ID NO: 5510197 - DNA, 16 bp, Homo sapiens
tagcagtggcaaaata

SEQ ID NO: 5510198 - DNA, 15 bp, Homo sapiens
tagcagtggcaggca

SEQ ID NO: 5510199 - DNA, 16 bp, Homo sapiens
tagcagtggcaggcag

SEQ ID NO: 5510200 - DNA, 21 bp, Homo sapiens
tagcagtggctggtgcccatg

SEQ ID NO: 5510201 - DNA, 17 bp, Homo sapiens
tagcagtgtgaagtaca

SEQ ID NO: 5510202 - DNA, 21 bp, Homo sapiens
tagcagtgtgaagtacaataa

SEQ ID NO: 5510203 - DNA, 13 bp, Homo sapiens
tagcagttataac

SEQ ID NO: 5510204 - DNA, 20 bp, Homo sapiens
tagcagttataacagatgtg

SEQ ID NO: 5510205 - DNA, 20 bp, Homo sapiens
tagcagttctgcaaatagaa

SEQ ID NO: 5510206 - DNA, 21 bp, Homo sapiens
tagcagttgctcacatgtctt

SEQ ID NO: 5510207 - DNA, 22 bp, Homo sapiens
tagcagtttagaatggaggaag

SEQ ID NO: 5510208 - DNA, 17 bp, Homo sapiens
tagcagtttcctcagtg

SEQ ID NO: 5510209 - DNA, 15 bp, Homo sapiens
tagcagtttgcctct

SEQ ID NO: 5510210 - DNA, 18 bp, Homo sapiens
tagcagtttgcctctgca

SEQ ID NO: 5510211 - DNA, 19 bp, Homo sapiens
tagcagtttgcctctgcac

SEQ ID NO: 5510212 - DNA, 23 bp, Homo sapiens
tagcataaacacatcacagatga

SEQ ID NO: 5510213 - DNA, 13 bp, Homo sapiens
tagcataaataaa

SEQ ID NO: 5510214 - DNA, 15 bp, Homo sapiens
tagcataaataaaac

SEQ ID NO: 5510215 - DNA, 16 bp, Homo sapiens
tagcataaataaaact

SEQ ID NO: 5510216 - DNA, 16 bp, Homo sapiens
tagcataaatttaatg

SEQ ID NO: 5510217 - DNA, 13 bp, Homo sapiens
tagcataagggct

SEQ ID NO: 5510218 - DNA, 21 bp, Homo sapiens
tagcataatatgaagcctttg

SEQ ID NO: 5510219 - DNA, 18 bp, Homo sapiens
tagcatacattcagacgt

SEQ ID NO: 5510220 - DNA, 17 bp, Homo sapiens
tagcatacgtacacatt

SEQ ID NO: 5510221 - DNA, 12 bp, Homo sapiens
tagcatactgtg

SEQ ID NO: 5510222 - DNA, 14 bp, Homo sapiens
tagcatactgtgta

SEQ ID NO: 5510223 - DNA, 16 bp, Homo sapiens
tagcatactgtgtatg

SEQ ID NO: 5510224 - DNA, 18 bp, Homo sapiens
tagcatactgtgtatgtt

SEQ ID NO: 5510225 - DNA, 19 bp, Homo sapiens
tagcatagcttattattga

SEQ ID NO: 5510226 - DNA, 13 bp, Homo sapiens
tagcataggctgg

SEQ ID NO: 5510227 - DNA, 14 bp, Homo sapiens
tagcatataaatgt

SEQ ID NO: 5510228 - DNA, 22 bp, Homo sapiens
tagcatataaatgtttatattg

SEQ ID NO: 5510229 - DNA, 18 bp, Homo sapiens
tagcatatataattttat

SEQ ID NO: 5510230 - DNA, 21 bp, Homo sapiens
tagcatatattcatacctgtt

SEQ ID NO: 5510231 - DNA, 18 bp, Homo sapiens
tagcatatctgcctttat

SEQ ID NO: 5510232 - DNA, 22 bp, Homo sapiens
tagcatatctgcctttattgtg

SEQ ID NO: 5510233 - DNA, 19 bp, Homo sapiens
tagcatatgacaaatgttt

SEQ ID NO: 5510234 - DNA, 19 bp, Homo sapiens
tagcatattcatggttgtt

SEQ ID NO: 5510235 - DNA, 18 bp, Homo sapiens
tagcatcacttaaaacac

SEQ ID NO: 5510236 - DNA, 15 bp, Homo sapiens
tagcatcatcctgca

SEQ ID NO: 5510237 - DNA, 14 bp, Homo sapiens
tagcatccaggctg

SEQ ID NO: 5510238 - DNA, 15 bp, Homo sapiens
tagcatcccatctca

SEQ ID NO: 5510239 - DNA, 16 bp, Homo sapiens
tagcatcctaagaaat

SEQ ID NO: 5510240 - DNA, 19 bp, Homo sapiens
tagcatcctaagaaatatg

SEQ ID NO: 5510241 - DNA, 20 bp, Homo sapiens
tagcatcctaagaaatatgt

SEQ ID NO: 5510242 - DNA, 19 bp, Homo sapiens
tagcatcctgattattgaa

SEQ ID NO: 5510243 - DNA, 14 bp, Homo sapiens
tagcatctgagaag

SEQ ID NO: 5510244 - DNA, 14 bp, Homo sapiens
tagcatcttcctct

SEQ ID NO: 5510245 - DNA, 13 bp, Homo sapiens
tagcatcttctgg

SEQ ID NO: 5510246 - DNA, 12 bp, Homo sapiens
tagcatctttca

SEQ ID NO: 5510247 - DNA, 15 bp, Homo sapiens
tagcatgaaataaaa

SEQ ID NO: 5510248 - DNA, 16 bp, Homo sapiens
tagcatgaagacagag

SEQ ID NO: 5510249 - DNA, 16 bp, Homo sapiens
tagcatgacaagcccc

SEQ ID NO: 5510250 - DNA, 19 bp, Homo sapiens
tagcatgaccttttggcct

SEQ ID NO: 5510251 - DNA, 14 bp, Homo sapiens
tagcatgagttctg

SEQ ID NO: 5510252 - DNA, 18 bp, Homo sapiens
tagcatgcaagcttggtc

SEQ ID NO: 5510253 - DNA, 21 bp, Homo sapiens
tagcatgccaacaagaatgca

SEQ ID NO: 5510254 - DNA, 14 bp, Homo sapiens
tagcatgcttcctt

SEQ ID NO: 5510255 - DNA, 16 bp, Homo sapiens
tagcatgcttcctttc

SEQ ID NO: 5510256 - DNA, 23 bp, Homo sapiens
tagcatgcttcctttctctcctg

SEQ ID NO: 5510257 - DNA, 17 bp, Homo sapiens
tagcatgcttgttgcaa

SEQ ID NO: 5510258 - DNA, 17 bp, Homo sapiens
tagcatggatagagtat

SEQ ID NO: 5510259 - DNA, 17 bp, Homo sapiens
tagcatggcggcacaca

SEQ ID NO: 5510260 - DNA, 22 bp, Homo sapiens
tagcatggggcccctggcccag

SEQ ID NO: 5510261 - DNA, 12 bp, Homo sapiens
tagcatggtttt

SEQ ID NO: 5510262 - DNA, 18 bp, Homo sapiens
tagcatggttttagcaaa

SEQ ID NO: 5510263 - DNA, 18 bp, Homo sapiens
tagcatgtaatattaaat

SEQ ID NO: 5510264 - DNA, 21 bp, Homo sapiens
tagcatgtaatattaaattcc

SEQ ID NO: 5510265 - DNA, 20 bp, Homo sapiens
tagcatgtactctgttgagt

SEQ ID NO: 5510266 - DNA, 18 bp, Homo sapiens
tagcatgtcctaatgctt

SEQ ID NO: 5510267 - DNA, 21 bp, Homo sapiens
tagcatgtcgtcaaagctgaa

SEQ ID NO: 5510268 - DNA, 22 bp, Homo sapiens
tagcatgtgttgcagctgtcac

SEQ ID NO: 5510269 - DNA, 22 bp, Homo sapiens
tagcatgtgtttggttctgggg

SEQ ID NO: 5510270 - DNA, 12 bp, Homo sapiens
tagcatgttcta

SEQ ID NO: 5510271 - DNA, 22 bp, Homo sapiens
tagcatgtttatatctgcaaaa

SEQ ID NO: 5510272 - DNA, 13 bp, Homo sapiens
tagcattaaaaat

SEQ ID NO: 5510273 - DNA, 15 bp, Homo sapiens
tagcattaaaaataa

SEQ ID NO: 5510274 - DNA, 17 bp, Homo sapiens
tagcattaaaaataaaa

SEQ ID NO: 5510275 - DNA, 13 bp, Homo sapiens
tagcattaaatat

SEQ ID NO: 5510276 - DNA, 14 bp, Homo sapiens
tagcattacctaat

SEQ ID NO: 5510277 - DNA, 17 bp, Homo sapiens
tagcattatcttatcat

SEQ ID NO: 5510278 - DNA, 22 bp, Homo sapiens
tagcattatgcaattaggtttt

SEQ ID NO: 5510279 - DNA, 17 bp, Homo sapiens
tagcattcctcaggaag

SEQ ID NO: 5510280 - DNA, 14 bp, Homo sapiens
tagcattctttgga

SEQ ID NO: 5510281 - DNA, 15 bp, Homo sapiens
tagcattgaaataat

SEQ ID NO: 5510282 - DNA, 18 bp, Homo sapiens
tagcattgaacatttctt

SEQ ID NO: 5510283 - DNA, 16 bp, Homo sapiens
tagcattgaagtgtcg

SEQ ID NO: 5510284 - DNA, 16 bp, Homo sapiens
tagcattgataatctt

SEQ ID NO: 5510285 - DNA, 19 bp, Homo sapiens
tagcattgtcttgttctgt

SEQ ID NO: 5510286 - DNA, 21 bp, Homo sapiens
tagcattgtcttgttctgtcc

SEQ ID NO: 5510287 - DNA, 14 bp, Homo sapiens
tagcattgttccac

SEQ ID NO: 5510288 - DNA, 16 bp, Homo sapiens
tagcattgttccacac

SEQ ID NO: 5510289 - DNA, 12 bp, Homo sapiens
tagcattgttct

SEQ ID NO: 5510290 - DNA, 21 bp, Homo sapiens
tagcatttagagcttttcaga

SEQ ID NO: 5510291 - DNA, 12 bp, Homo sapiens
tagcatttattt

SEQ ID NO: 5510292 - DNA, 18 bp, Homo sapiens
tagcatttcattcttctc

SEQ ID NO: 5510293 - DNA, 12 bp, Homo sapiens
tagcatttcttg

SEQ ID NO: 5510294 - DNA, 13 bp, Homo sapiens
tagcatttggaaa

SEQ ID NO: 5510295 - DNA, 15 bp, Homo sapiens
tagcatttggtgctt

SEQ ID NO: 5510296 - DNA, 21 bp, Homo sapiens
tagcattttcctgtttactga

SEQ ID NO: 5510297 - DNA, 19 bp, Homo sapiens
tagcattttcttgaaccaa

SEQ ID NO: 5510298 - DNA, 22 bp, Homo sapiens
tagcatttttatgcagacagtc

SEQ ID NO: 5510299 - DNA, 18 bp, Homo sapiens
tagcatttttattcatgc

SEQ ID NO: 5510300 - DNA, 21 bp, Homo sapiens
tagcatttttccaacacacac

SEQ ID NO: 5510301 - DNA, 20 bp, Homo sapiens
tagcatttttgatttatgca

SEQ ID NO: 5510302 - DNA, 22 bp, Homo sapiens
tagccaaaaaggcaaataatgg

SEQ ID NO: 5510303 - DNA, 19 bp, Homo sapiens
tagccaaaacacttaggaa

SEQ ID NO: 5510304 - DNA, 21 bp, Homo sapiens
tagccaaaagaatggctgact

SEQ ID NO: 5510305 - DNA, 14 bp, Homo sapiens
tagccaaacaacaa

SEQ ID NO: 5510306 - DNA, 22 bp, Homo sapiens
tagccaaacctcaccaactcct

SEQ ID NO: 5510307 - DNA, 16 bp, Homo sapiens
tagccaaagaaatttc

SEQ ID NO: 5510308 - DNA, 23 bp, Homo sapiens
tagccaaagatttcatatctaac

SEQ ID NO: 5510309 - DNA, 14 bp, Homo sapiens
tagccaaagccagg

SEQ ID NO: 5510310 - DNA, 17 bp, Homo sapiens
tagccaaagccaggcct

SEQ ID NO: 5510311 - DNA, 23 bp, Homo sapiens
tagccaaatgactgaaagcactg

SEQ ID NO: 5510312 - DNA, 20 bp, Homo sapiens
tagccaaatggtttaacttc

SEQ ID NO: 5510313 - DNA, 20 bp, Homo sapiens
tagccaacggccccagcttc

SEQ ID NO: 5510314 - DNA, 14 bp, Homo sapiens
tagccaactcctcc

SEQ ID NO: 5510315 - DNA, 19 bp, Homo sapiens
tagccaagccctaagcctg

SEQ ID NO: 5510316 - DNA, 17 bp, Homo sapiens
tagccaaggcccggggt

SEQ ID NO: 5510317 - DNA, 20 bp, Homo sapiens
tagccaaggtgggctgagcc

SEQ ID NO: 5510318 - DNA, 21 bp, Homo sapiens
tagccaaggtgggctgagccc

SEQ ID NO: 5510319 - DNA, 19 bp, Homo sapiens
tagccaagtagctttgggc

SEQ ID NO: 5510320 - DNA, 19 bp, Homo sapiens
tagccaatattaaaagaga

SEQ ID NO: 5510321 - DNA, 21 bp, Homo sapiens
tagccaatattaaaagagacc

SEQ ID NO: 5510322 - DNA, 21 bp, Homo sapiens
tagccaatggacaagcagtgt

SEQ ID NO: 5510323 - DNA, 21 bp, Homo sapiens
tagccaatgtctcctcccctt

SEQ ID NO: 5510324 - DNA, 20 bp, Homo sapiens
tagccacaaaattgggaaag

SEQ ID NO: 5510325 - DNA, 17 bp, Homo sapiens
tagccacaaatgccttg

SEQ ID NO: 5510326 - DNA, 21 bp, Homo sapiens
tagccacaaatgccttgaact

SEQ ID NO: 5510327 - DNA, 15 bp, Homo sapiens
tagccacaccaggat

SEQ ID NO: 5510328 - DNA, 17 bp, Homo sapiens
tagccacaccaggatag

SEQ ID NO: 5510329 - DNA, 15 bp, Homo sapiens
tagccacagctgctg

SEQ ID NO: 5510330 - DNA, 22 bp, Homo sapiens
tagccacagctgctgttctcag

SEQ ID NO: 5510331 - DNA, 16 bp, Homo sapiens
tagccacatttggaat

SEQ ID NO: 5510332 - DNA, 23 bp, Homo sapiens
tagccaccaccggggcactggct

SEQ ID NO: 5510333 - DNA, 14 bp, Homo sapiens
tagccaccagtgtc

SEQ ID NO: 5510334 - DNA, 18 bp, Homo sapiens
tagccacccaccacactg

SEQ ID NO: 5510335 - DNA, 13 bp, Homo sapiens
tagccacctccca

SEQ ID NO: 5510336 - DNA, 18 bp, Homo sapiens
tagccacctcccacccca

SEQ ID NO: 5510337 - DNA, 16 bp, Homo sapiens
tagccaccttgatttt

SEQ ID NO: 5510338 - DNA, 21 bp, Homo sapiens
tagccaccttgattttcttct

SEQ ID NO: 5510339 - DNA, 17 bp, Homo sapiens
tagccacggaaacatag

SEQ ID NO: 5510340 - DNA, 13 bp, Homo sapiens
tagccactcagga

SEQ ID NO: 5510341 - DNA, 12 bp, Homo sapiens
tagccactggca

SEQ ID NO: 5510342 - DNA, 19 bp, Homo sapiens
tagccactggtttctcaga

SEQ ID NO: 5510343 - DNA, 17 bp, Homo sapiens
tagccacttaccttcaa

SEQ ID NO: 5510344 - DNA, 14 bp, Homo sapiens
tagccagacacatg

SEQ ID NO: 5510345 - DNA, 15 bp, Homo sapiens
tagccagagaggagc

SEQ ID NO: 5510346 - DNA, 17 bp, Homo sapiens
tagccagagaggagcac

SEQ ID NO: 5510347 - DNA, 20 bp, Homo sapiens
tagccagagaggagcacctg

SEQ ID NO: 5510348 - DNA, 11 bp, Homo sapiens
tagccagagga

SEQ ID NO: 5510349 - DNA, 17 bp, Homo sapiens
tagccagaggctctaat

SEQ ID NO: 5510350 - DNA, 13 bp, Homo sapiens
tagccagaggctg

SEQ ID NO: 5510351 - DNA, 17 bp, Homo sapiens
tagccagagggtgggag

SEQ ID NO: 5510352 - DNA, 21 bp, Homo sapiens
tagccagagggtgggagccta

SEQ ID NO: 5510353 - DNA, 20 bp, Homo sapiens
tagccagagttgttctcagg

SEQ ID NO: 5510354 - DNA, 19 bp, Homo sapiens
tagccagcacacagggcag

SEQ ID NO: 5510355 - DNA, 15 bp, Homo sapiens
tagccagcccacatc

SEQ ID NO: 5510356 - DNA, 23 bp, Homo sapiens
tagccagccggggcgagtggcac

SEQ ID NO: 5510357 - DNA, 17 bp, Homo sapiens
tagccagcgtttattgt

SEQ ID NO: 5510358 - DNA, 19 bp, Homo sapiens
tagccagcgtttattgtag

SEQ ID NO: 5510359 - DNA, 18 bp, Homo sapiens
tagccagctgtcaagggc

SEQ ID NO: 5510360 - DNA, 17 bp, Homo sapiens
tagccaggaagccccgc

SEQ ID NO: 5510361 - DNA, 16 bp, Homo sapiens
tagccaggagtctgtg

SEQ ID NO: 5510362 - DNA, 21 bp, Homo sapiens
tagccaggagtctgtgctctt

SEQ ID NO: 5510363 - DNA, 22 bp, Homo sapiens
tagccaggatcatggtgtaata

SEQ ID NO: 5510364 - DNA, 11 bp, Homo sapiens
tagccaggcct

SEQ ID NO: 5510365 - DNA, 12 bp, Homo sapiens
tagccaggcctc

SEQ ID NO: 5510366 - DNA, 22 bp, Homo sapiens
tagccagggtgtggccctgcca

SEQ ID NO: 5510367 - DNA, 19 bp, Homo sapiens
tagccaggtccccctgcag

SEQ ID NO: 5510368 - DNA, 23 bp, Homo sapiens
tagccaggtctcctgggaaaggg

SEQ ID NO: 5510369 - DNA, 12 bp, Homo sapiens
tagccaggtgtg

SEQ ID NO: 5510370 - DNA, 18 bp, Homo sapiens
tagccagtaatcctgtag

SEQ ID NO: 5510371 - DNA, 16 bp, Homo sapiens
tagccagtgaaacact

SEQ ID NO: 5510372 - DNA, 15 bp, Homo sapiens
tagccagtgaacata

SEQ ID NO: 5510373 - DNA, 16 bp, Homo sapiens
tagccagttgaattta

SEQ ID NO: 5510374 - DNA, 19 bp, Homo sapiens
tagccatatttgtaaaatg

SEQ ID NO: 5510375 - DNA, 18 bp, Homo sapiens
tagccatcccttggggaa

SEQ ID NO: 5510376 - DNA, 19 bp, Homo sapiens
tagccatcccttggggaag

SEQ ID NO: 5510377 - DNA, 13 bp, Homo sapiens
tagccatctgcac

SEQ ID NO: 5510378 - DNA, 16 bp, Homo sapiens
tagccatgactagggt

SEQ ID NO: 5510379 - DNA, 22 bp, Homo sapiens
tagccatgactagggtcctcag

SEQ ID NO: 5510380 - DNA, 19 bp, Homo sapiens
tagccatgaggaggcagag

SEQ ID NO: 5510381 - DNA, 19 bp, Homo sapiens
tagccatgatggcaacaga

SEQ ID NO: 5510382 - DNA, 21 bp, Homo sapiens
tagccatgatttgtcccagcc

SEQ ID NO: 5510383 - DNA, 18 bp, Homo sapiens
tagccatgcaacatggat

SEQ ID NO: 5510384 - DNA, 22 bp, Homo sapiens
tagccatgcatttgatttgttt

SEQ ID NO: 5510385 - DNA, 15 bp, Homo sapiens
tagccatggctggca

SEQ ID NO: 5510386 - DNA, 22 bp, Homo sapiens
tagccatgtgaaactcatctca

SEQ ID NO: 5510387 - DNA, 23 bp, Homo sapiens
tagccatgtgaaactcatctcat

SEQ ID NO: 5510388 - DNA, 19 bp, Homo sapiens
tagccatgttaacatgaca

SEQ ID NO: 5510389 - DNA, 15 bp, Homo sapiens
tagccattacccacg

SEQ ID NO: 5510390 - DNA, 13 bp, Homo sapiens
tagccattgaaat

SEQ ID NO: 5510391 - DNA, 17 bp, Homo sapiens
tagccattgatcataaa

SEQ ID NO: 5510392 - DNA, 19 bp, Homo sapiens
tagccatttctccatgggc

SEQ ID NO: 5510393 - DNA, 19 bp, Homo sapiens
tagccatttttcaaagcaa

SEQ ID NO: 5510394 - DNA, 21 bp, Homo sapiens
tagcccaatggagaaatgaag

SEQ ID NO: 5510395 - DNA, 23 bp, Homo sapiens
tagcccacacttgagaggatgaa

SEQ ID NO: 5510396 - DNA, 21 bp, Homo sapiens
tagcccacttacatttacaaa

SEQ ID NO: 5510397 - DNA, 19 bp, Homo sapiens
tagcccagaacaaaaagaa

SEQ ID NO: 5510398 - DNA, 14 bp, Homo sapiens
tagcccagactctg

SEQ ID NO: 5510399 - DNA, 17 bp, Homo sapiens
tagcccagactctgagc

SEQ ID NO: 5510400 - DNA, 13 bp, Homo sapiens
tagcccagagtga

SEQ ID NO: 5510401 - DNA, 18 bp, Homo sapiens
tagcccaggagagagaaa

SEQ ID NO: 5510402 - DNA, 14 bp, Homo sapiens
tagcccaggagcaa

SEQ ID NO: 5510403 - DNA, 16 bp, Homo sapiens
tagcccaggagcaaca

SEQ ID NO: 5510404 - DNA, 15 bp, Homo sapiens
tagcccagtgttttc

SEQ ID NO: 5510405 - DNA, 14 bp, Homo sapiens
tagcccatccctgc

SEQ ID NO: 5510406 - DNA, 17 bp, Homo sapiens
tagcccatccctgcctg

SEQ ID NO: 5510407 - DNA, 18 bp, Homo sapiens
tagcccatccctgcctgg

SEQ ID NO: 5510408 - DNA, 21 bp, Homo sapiens
tagcccatccctgcctggtca

SEQ ID NO: 5510409 - DNA, 17 bp, Homo sapiens
tagcccatctctccaga

SEQ ID NO: 5510410 - DNA, 22 bp, Homo sapiens
tagcccatggacttcacataag

SEQ ID NO: 5510411 - DNA, 13 bp, Homo sapiens
tagccccaaatct

SEQ ID NO: 5510412 - DNA, 18 bp, Homo sapiens
tagccccaagaaggctgg

SEQ ID NO: 5510413 - DNA, 13 bp, Homo sapiens
tagccccacccag

SEQ ID NO: 5510414 - DNA, 17 bp, Homo sapiens
tagccccacccagaggt

SEQ ID NO: 5510415 - DNA, 13 bp, Homo sapiens
tagccccagactg

SEQ ID NO: 5510416 - DNA, 22 bp, Homo sapiens
tagccccagagatgccagccct

SEQ ID NO: 5510417 - DNA, 20 bp, Homo sapiens
tagccccaggcccgccctgc

SEQ ID NO: 5510418 - DNA, 22 bp, Homo sapiens
tagccccaggcccgccctgccc

SEQ ID NO: 5510419 - DNA, 14 bp, Homo sapiens
tagccccagggtga

SEQ ID NO: 5510420 - DNA, 19 bp, Homo sapiens
tagccccaggtcttttctt

SEQ ID NO: 5510421 - DNA, 16 bp, Homo sapiens
tagccccctggcctct

SEQ ID NO: 5510422 - DNA, 17 bp, Homo sapiens
tagccccgagacaccat

SEQ ID NO: 5510423 - DNA, 21 bp, Homo sapiens
tagccccgagacaccatcctg

SEQ ID NO: 5510424 - DNA, 18 bp, Homo sapiens
tagctgtacaaatataag

SEQ ID NO: 5510425 - DNA, 17 bp, Homo sapiens
tagctgtactataagta

SEQ ID NO: 5510426 - DNA, 18 bp, Homo sapiens
tagctgtagagtccttgg

SEQ ID NO: 5510427 - DNA, 20 bp, Homo sapiens
tagctgtagagtccttggca

SEQ ID NO: 5510428 - DNA, 19 bp, Homo sapiens
tagctgtaggttttctgtg

SEQ ID NO: 5510429 - DNA, 19 bp, Homo sapiens
tagctgtattcatatattg

SEQ ID NO: 5510430 - DNA, 12 bp, Homo sapiens
tagctgtattga

SEQ ID NO: 5510431 - DNA, 20 bp, Homo sapiens
tagctgtcatggtgcaattt

SEQ ID NO: 5510432 - DNA, 22 bp, Homo sapiens
tagctgtcatggtgcaatttgt

SEQ ID NO: 5510433 - DNA, 17 bp, Homo sapiens
tagctgtcgtacattga

SEQ ID NO: 5510434 - DNA, 15 bp, Homo sapiens
tagctgtctagagta

SEQ ID NO: 5510435 - DNA, 17 bp, Homo sapiens
tagctgtctagagtagc

SEQ ID NO: 5510436 - DNA, 16 bp, Homo sapiens
tagctgtctctcttgt

SEQ ID NO: 5510437 - DNA, 12 bp, Homo sapiens
tagctgtctgtg

SEQ ID NO: 5510438 - DNA, 14 bp, Homo sapiens
tagctgtgacctgc

SEQ ID NO: 5510439 - DNA, 17 bp, Homo sapiens
tagctgtgacctgctga

SEQ ID NO: 5510440 - DNA, 20 bp, Homo sapiens
tagctgtgacctgctgagct

SEQ ID NO: 5510441 - DNA, 22 bp, Homo sapiens
tagctgtgacctgctgagctct

SEQ ID NO: 5510442 - DNA, 16 bp, Homo sapiens
tagctgtgatcagtga

SEQ ID NO: 5510443 - DNA, 18 bp, Homo sapiens
tagctgtggggagctggt

SEQ ID NO: 5510444 - DNA, 13 bp, Homo sapiens
tagctgtgggggt

SEQ ID NO: 5510445 - DNA, 14 bp, Homo sapiens
tagctgttactgca

SEQ ID NO: 5510446 - DNA, 20 bp, Homo sapiens
tagctgttatttctattttt

SEQ ID NO: 5510447 - DNA, 15 bp, Homo sapiens
tagctgttctggact

SEQ ID NO: 5510448 - DNA, 19 bp, Homo sapiens
tagcttaaaaaaaggaaaa

SEQ ID NO: 5510449 - DNA, 18 bp, Homo sapiens
tagcttaaataaattcaa

SEQ ID NO: 5510450 - DNA, 14 bp, Homo sapiens
tagcttaagaaaaa

SEQ ID NO: 5510451 - DNA, 15 bp, Homo sapiens
tagcttaatgactta

SEQ ID NO: 5510452 - DNA, 16 bp, Homo sapiens
tagcttaatgacttac

SEQ ID NO: 5510453 - DNA, 19 bp, Homo sapiens
tagcttacatgagaacaga

SEQ ID NO: 5510454 - DNA, 16 bp, Homo sapiens
tagcttaccagaagct

SEQ ID NO: 5510455 - DNA, 19 bp, Homo sapiens
tagcttacccaatgggacc

SEQ ID NO: 5510456 - DNA, 18 bp, Homo sapiens
tagcttacctgaacagga

SEQ ID NO: 5510457 - DNA, 15 bp, Homo sapiens
tagcttacctgggca

SEQ ID NO: 5510458 - DNA, 14 bp, Homo sapiens
tagcttactgatga

SEQ ID NO: 5510459 - DNA, 15 bp, Homo sapiens
tagcttagacctcag

SEQ ID NO: 5510460 - DNA, 17 bp, Homo sapiens
tagcttagacctcagcc

SEQ ID NO: 5510461 - DNA, 18 bp, Homo sapiens
tagcttagacctcagcct

SEQ ID NO: 5510462 - DNA, 23 bp, Homo sapiens
tagcttagacctcagcctgtgct

SEQ ID NO: 5510463 - DNA, 20 bp, Homo sapiens
tagcttagtgctatgtgtga

SEQ ID NO: 5510464 - DNA, 17 bp, Homo sapiens
tagcttataagagggca

SEQ ID NO: 5510465 - DNA, 18 bp, Homo sapiens
tagcttatcaatttgtca

SEQ ID NO: 5510466 - DNA, 19 bp, Homo sapiens
tagcttatctacttccaaa

SEQ ID NO: 5510467 - DNA, 18 bp, Homo sapiens
tagcttatctccctgctt

SEQ ID NO: 5510468 - DNA, 12 bp, Homo sapiens
tagcttatcttt

SEQ ID NO: 5510469 - DNA, 13 bp, Homo sapiens
tagcttatctttc

SEQ ID NO: 5510470 - DNA, 14 bp, Homo sapiens
tagcttatctttct

SEQ ID NO: 5510471 - DNA, 19 bp, Homo sapiens
tagcttatctttctttcca

SEQ ID NO: 5510472 - DNA, 12 bp, Homo sapiens
tagcttatgaaa

SEQ ID NO: 5510473 - DNA, 20 bp, Homo sapiens
tagcttcactcagctggact

SEQ ID NO: 5510474 - DNA, 14 bp, Homo sapiens
tagcttcagccagg

SEQ ID NO: 5510475 - DNA, 14 bp, Homo sapiens
tagcttcaggacct

SEQ ID NO: 5510476 - DNA, 15 bp, Homo sapiens
tagcttcaggacctg

SEQ ID NO: 5510477 - DNA, 14 bp, Homo sapiens
tagcttcagtcatt

SEQ ID NO: 5510478 - DNA, 17 bp, Homo sapiens
tagcttcagttgttctt

SEQ ID NO: 5510479 - DNA, 16 bp, Homo sapiens
tagcttcatcttgagc

SEQ ID NO: 5510480 - DNA, 12 bp, Homo sapiens
tagcttccatga

SEQ ID NO: 5510481 - DNA, 14 bp, Homo sapiens
tagcttcctccaga

SEQ ID NO: 5510482 - DNA, 19 bp, Homo sapiens
tagcttctagtctggaact

SEQ ID NO: 5510483 - DNA, 21 bp, Homo sapiens
tagcttctcttctttctgaag

SEQ ID NO: 5510484 - DNA, 21 bp, Homo sapiens
tagcttctgaaaggtgctttc

SEQ ID NO: 5510485 - DNA, 13 bp, Homo sapiens
tagcttctgacct

SEQ ID NO: 5510486 - DNA, 19 bp, Homo sapiens
tagcttctgacctcagcat

SEQ ID NO: 5510487 - DNA, 12 bp, Homo sapiens
tagcttctgtgt

SEQ ID NO: 5510488 - DNA, 18 bp, Homo sapiens
tagcttctgtgtgtgagc

SEQ ID NO: 5510489 - DNA, 12 bp, Homo sapiens
tagcttctttcc

SEQ ID NO: 5510490 - DNA, 13 bp, Homo sapiens
tagcttgaaattg

SEQ ID NO: 5510491 - DNA, 17 bp, Homo sapiens
tagcttgaagcccaaga

SEQ ID NO: 5510492 - DNA, 19 bp, Homo sapiens
tagcttgataaagggccaa

SEQ ID NO: 5510493 - DNA, 20 bp, Homo sapiens
tagcttgcctaatggctttc

SEQ ID NO: 5510494 - DNA, 19 bp, Homo sapiens
tagcttgcgcattctcatg

SEQ ID NO: 5510495 - DNA, 18 bp, Homo sapiens
tagcttggcatggtggca

SEQ ID NO: 5510496 - DNA, 15 bp, Homo sapiens
tagcttgggacaaat

SEQ ID NO: 5510497 - DNA, 19 bp, Homo sapiens
tagcttgtatagtgtaaaa

SEQ ID NO: 5510498 - DNA, 18 bp, Homo sapiens
tagcttgtatcaaatgtt

SEQ ID NO: 5510499 - DNA, 17 bp, Homo sapiens
tagcttgtctattattg

SEQ ID NO: 5510500 - DNA, 21 bp, Homo sapiens
tagcttgtctgtgatctctgc

SEQ ID NO: 5510501 - DNA, 22 bp, Homo sapiens
tagctttaacttaaatagtatt

SEQ ID NO: 5510502 - DNA, 21 bp, Homo sapiens
tagctttaatcaatcatgccc

SEQ ID NO: 5510503 - DNA, 18 bp, Homo sapiens
tagctttacatattcctt

SEQ ID NO: 5510504 - DNA, 24 bp, Homo sapiens
tagctttacattttcagtaccaaa

SEQ ID NO: 5510505 - DNA, 15 bp, Homo sapiens
tagctttaccctcag

SEQ ID NO: 5510506 - DNA, 13 bp, Homo sapiens
tagctttactgtt

SEQ ID NO: 5510507 - DNA, 19 bp, Homo sapiens
tagctttactgtttgttat

SEQ ID NO: 5510508 - DNA, 18 bp, Homo sapiens
tagctttagaccctgggt

SEQ ID NO: 5510509 - DNA, 19 bp, Homo sapiens
tagctttagagaagccata

SEQ ID NO: 5510510 - DNA, 13 bp, Homo sapiens
tagctttataaag

SEQ ID NO: 5510511 - DNA, 20 bp, Homo sapiens
tagctttatatatggacatg

SEQ ID NO: 5510512 - DNA, 21 bp, Homo sapiens
tagctttatatatggacatgg

SEQ ID NO: 5510513 - DNA, 21 bp, Homo sapiens
tagctttattatggcttgtga

SEQ ID NO: 5510514 - DNA, 13 bp, Homo sapiens
tagctttattctt

SEQ ID NO: 5510515 - DNA, 18 bp, Homo sapiens
tagctttattttttaagt

SEQ ID NO: 5510516 - DNA, 22 bp, Homo sapiens
tagctttattttttaagtattt

SEQ ID NO: 5510517 - DNA, 15 bp, Homo sapiens
tagctttcaattccg

SEQ ID NO: 5510518 - DNA, 22 bp, Homo sapiens
tagctttcatttactgatcatc

SEQ ID NO: 5510519 - DNA, 16 bp, Homo sapiens
tagctttccctgtgcc

SEQ ID NO: 5510520 - DNA, 15 bp, Homo sapiens
tagctttcctggaag

SEQ ID NO: 5510521 - DNA, 13 bp, Homo sapiens
tagctttcctggt

SEQ ID NO: 5510522 - DNA, 14 bp, Homo sapiens
tagctttcctggtc

SEQ ID NO: 5510523 - DNA, 21 bp, Homo sapiens
tagctttctgagcaagaggat

SEQ ID NO: 5510524 - DNA, 11 bp, Homo sapiens
tagctttgaca

SEQ ID NO: 5510525 - DNA, 14 bp, Homo sapiens
tagctttgctctgc

SEQ ID NO: 5510526 - DNA, 16 bp, Homo sapiens
tagctttgctctgcca

SEQ ID NO: 5510527 - DNA, 12 bp, Homo sapiens
tagctttggaaa

SEQ ID NO: 5510528 - DNA, 13 bp, Homo sapiens
tagctttgtgttt

SEQ ID NO: 5510529 - DNA, 21 bp, Homo sapiens
tagctttgtgtttggtttaca

SEQ ID NO: 5510530 - DNA, 15 bp, Homo sapiens
tagctttgttgtcct

SEQ ID NO: 5510531 - DNA, 19 bp, Homo sapiens
tagctttgttgtcctccca

SEQ ID NO: 5510532 - DNA, 20 bp, Homo sapiens
tagctttgttgtcctcccag

SEQ ID NO: 5510533 - DNA, 21 bp, Homo sapiens
tagctttgttgtcctcccagg

SEQ ID NO: 5510534 - DNA, 15 bp, Homo sapiens
tagcttttaaaaaat

SEQ ID NO: 5510535 - DNA, 17 bp, Homo sapiens
tagcttttaaaaaatat
